United States Patent 11,640,849 (METHODS FOR HISTOLOGICAL DIAGNOSIS AND TREATMENT OF DISEASES) - sequence listing, part 8

SEQ ID NO: 276289 - protein, 10 aa, Mycobacterium
PRLSQVTNEV

SEQ ID NO: 276290 - protein, 5 aa, Mycobacterium
PRMPQ

SEQ ID NO: 276291 - protein, 6 aa, Mycobacterium
PRMPRK

SEQ ID NO: 276292 - protein, 8 aa, Mycobacterium
PRNAGQAY

SEQ ID NO: 276293 - protein, 7 aa, Mycobacterium
PRNASGK

SEQ ID NO: 276294 - protein, 7 aa, Mycobacterium
PRNETIT

SEQ ID NO: 276295 - protein, 7 aa, Mycobacterium
PRNGETD

SEQ ID NO: 276296 - protein, 10 aa, Mycobacterium
PRNGPPSTAT

SEQ ID NO: 276297 - protein, 7 aa, Mycobacterium
PRNGQTD

SEQ ID NO: 276298 - protein, 4 aa, Mycobacterium
PRNL

SEQ ID NO: 276299 - protein, 4 aa, Mycobacterium
PRNN

SEQ ID NO: 276300 - protein, 6 aa, Mycobacterium
PRNPEK

SEQ ID NO: 276301 - protein, 17 aa, Mycobacterium
PRNPTGKILKRELREME

SEQ ID NO: 276302 - protein, 17 aa, Mycobacterium
PRNPTGKILKRELRNID

SEQ ID NO: 276303 - protein, 5 aa, Mycobacterium
PRNQV

SEQ ID NO: 276304 - protein, 7 aa, Mycobacterium
PRNRDDE

SEQ ID NO: 276305 - protein, 7 aa, Mycobacterium
PRNSTGK

SEQ ID NO: 276306 - protein, 17 aa, Mycobacterium
PRNTDRGTTTFASDRQG

SEQ ID NO: 276307 - protein, 4 aa, Mycobacterium
PRPA

SEQ ID NO: 276308 - protein, 6 aa, Mycobacterium
PRPANT

SEQ ID NO: 276309 - protein, 9 aa, Mycobacterium
PRPAPAKKN

SEQ ID NO: 276310 - protein, 19 aa, Mycobacterium
PRPDGTLSGEFSKTSANGC

SEQ ID NO: 276311 - protein, 21 aa, Mycobacterium
PRPDSDESPDPDESQLAGSDL

SEQ ID NO: 276312 - protein, 9 aa, Mycobacterium
PRPDSGGVA

SEQ ID NO: 276313 - protein, 19 aa, Mycobacterium
PRPDTPDRRRETPPTPPAE

SEQ ID NO: 276314 - protein, 6 aa, Mycobacterium
PRPEAE

SEQ ID NO: 276315 - protein, 13 aa, Mycobacterium
PRPERISSTPELQ

SEQ ID NO: 276316 - protein, 7 aa, Mycobacterium
PRPESVD

SEQ ID NO: 276317 - protein, 5 aa, Mycobacterium
PRPFT

SEQ ID NO: 276318 - protein, 4 aa, Mycobacterium
PRPG

SEQ ID NO: 276319 - protein, 6 aa, Mycobacterium
PRPGDD

SEQ ID NO: 276320 - protein, 8 aa, Mycobacterium
PRPGPGPR

SEQ ID NO: 276321 - protein, 6 aa, Mycobacterium
PRPGPS

SEQ ID NO: 276322 - protein, 14 aa, Mycobacterium
PRPGRADDGGAPCC

SEQ ID NO: 276323 - protein, 6 aa, Mycobacterium
PRPGSD

SEQ ID NO: 276324 - protein, 8 aa, Mycobacterium
PRPGYPGD

SEQ ID NO: 276325 - protein, 5 aa, Mycobacterium
PRPHA

SEQ ID NO: 276326 - protein, 4 aa, Mycobacterium
PRPK

SEQ ID NO: 276327 - protein, 4 aa, Mycobacterium
PRPL

SEQ ID NO: 276328 - protein, 9 aa, Mycobacterium
PRPLPPGRG

SEQ ID NO: 276329 - protein, 4 aa, Mycobacterium
PRPM

SEQ ID NO: 276330 - protein, 9 aa, Mycobacterium
PRPMPRARR

SEQ ID NO: 276331 - protein, 6 aa, Mycobacterium
PRPMRP

SEQ ID NO: 276332 - protein, 12 aa, Mycobacterium
PRPNDPAGTLEP

SEQ ID NO: 276333 - protein, 16 aa, Mycobacterium
PRPNPATSTPPLGGNC

SEQ ID NO: 276334 - protein, 7 aa, Mycobacterium
PRPPAPV

SEQ ID NO: 276335 - protein, 6 aa, Mycobacterium
PRPPLG

SEQ ID NO: 276336 - protein, 17 aa, Mycobacterium
PRPPTVAEYENASDGYA

SEQ ID NO: 276337 - protein, 13 aa, Mycobacterium
PRPQLTAATGGAL

SEQ ID NO: 276338 - protein, 5 aa, Mycobacterium
PRPQM

SEQ ID NO: 276339 - protein, 5 aa, Mycobacterium
PRPRD

SEQ ID NO: 276340 - protein, 7 aa, Mycobacterium
PRPRDEE

SEQ ID NO: 276341 - protein, 7 aa, Mycobacterium
PRPRPAS

SEQ ID NO: 276342 - protein, 13 aa, Mycobacterium
PRPRPHDDEQPTN

SEQ ID NO: 276343 - protein, 21 aa, Mycobacterium
PRPRPQPWPQPLHAGAAEAVR

SEQ ID NO: 276344 - protein, 7 aa, Mycobacterium
PRPRPSG

SEQ ID NO: 276345 - protein, 7 aa, Mycobacterium
PRPRPSS

SEQ ID NO: 276346 - protein, 7 aa, Mycobacterium
PRPRPTS

SEQ ID NO: 276347 - protein, 24 aa, Mycobacterium
PRPSAAGDGYDPMATSASNLGPES

SEQ ID NO: 276348 - protein, 13 aa, Mycobacterium
PRPSADPEYEKTS

SEQ ID NO: 276349 - protein, 21 aa, Mycobacterium
PRPSANRPVPPEAGDPPVRSR

SEQ ID NO: 276350 - protein, 15 aa, Mycobacterium
PRPSDHPEKAPGQRP

SEQ ID NO: 276351 - protein, 10 aa, Mycobacterium
PRPSQLRPGI

SEQ ID NO: 276352 - protein, 11 aa, Mycobacterium
PRPSQLRPGIP

SEQ ID NO: 276353 - protein, 10 aa, Mycobacterium
PRPSRHRPDI

SEQ ID NO: 276354 - protein, 13 aa, Mycobacterium
PRPSSPTSLAPAG

SEQ ID NO: 276355 - protein, 4 aa, Mycobacterium
PRPT

SEQ ID NO: 276356 - protein, 11 aa, Mycobacterium
PRPTDEDREEA

SEQ ID NO: 276357 - protein, 13 aa, Mycobacterium
PRPTDVNPALPPA

SEQ ID NO: 276358 - protein, 5 aa, Mycobacterium
PRPVQ

SEQ ID NO: 276359 - protein, 5 aa, Mycobacterium
PRPWP

SEQ ID NO: 276360 - protein, 13 aa, Mycobacterium
PRQAGAVSSSTEV

SEQ ID NO: 276361 - protein, 7 aa, Mycobacterium
PRQDTIR

SEQ ID NO: 276362 - protein, 7 aa, Mycobacterium
PRQGPKL

SEQ ID NO: 276363 - protein, 23 aa, Mycobacterium
PRQGQATRPARTRPSHDSGPPTL

SEQ ID NO: 276364 - protein, 6 aa, Mycobacterium
PRQQQR

SEQ ID NO: 276365 - protein, 6 aa, Mycobacterium
PRQRES

SEQ ID NO: 276366 - protein, 12 aa, Mycobacterium
PRQRGEVGPVSA

SEQ ID NO: 276367 - protein, 6 aa, Mycobacterium
PRQSRY

SEQ ID NO: 276368 - protein, 10 aa, Mycobacterium
PRQTGVTTPD

SEQ ID NO: 276369 - protein, 7 aa, Mycobacterium
PRQVARG

SEQ ID NO: 276370 - protein, 12 aa, Mycobacterium
PRQVQGGSKEAL

SEQ ID NO: 276371 - protein, 10 aa, Mycobacterium
PRRAATTAIG

SEQ ID NO: 276372 - protein, 13 aa, Mycobacterium
PRRAIEGTAYSAD

SEQ ID NO: 276373 - protein, 6 aa, Mycobacterium
PRRAST

SEQ ID NO: 276374 - protein, 12 aa, Mycobacterium
PRREDNRITRSI

SEQ ID NO: 276375 - protein, 6 aa, Mycobacterium
PRREWG

SEQ ID NO: 276376 - protein, 10 aa, Mycobacterium
PRRGEKAGGH

SEQ ID NO: 276377 - protein, 5 aa, Mycobacterium
PRRGH

SEQ ID NO: 276378 - protein, 80 aa, Mycobacterium
PRRGRGRDGQQPSDSVPEPEAGPSNPAPVAPQGSPPVAPGAGPTSSQAGQPVEVGRSPGTLPEQPGSPETNGSPAPQLER

SEQ ID NO: 276379 - protein, 5 aa, Mycobacterium
PRRPR

SEQ ID NO: 276380 - protein, 6 aa, Mycobacterium
PRRPRD

SEQ ID NO: 276381 - protein, 5 aa, Mycobacterium
PRRQP

SEQ ID NO: 276382 - protein, 20 aa, Mycobacterium
PRRQSPPPYEGPDPGRPPSK

SEQ ID NO: 276383 - protein, 4 aa, Mycobacterium
PRRR

SEQ ID NO: 276384 - protein, 6 aa, Mycobacterium
PRRRGA

SEQ ID NO: 276385 - protein, 21 aa, Mycobacterium
PRRRQIEDTGDAAQSKSALAE

SEQ ID NO: 276386 - protein, 13 aa, Mycobacterium
PRRRRSRVNPDGT

SEQ ID NO: 276387 - protein, 5 aa, Mycobacterium
PRRRT

SEQ ID NO: 276388 - protein, 8 aa, Mycobacterium
PRRRTDRR

SEQ ID NO: 276389 - protein, 9 aa, Mycobacterium
PRRRTDRRH

SEQ ID NO: 276390 - protein, 7 aa, Mycobacterium
PRRSMDE

SEQ ID NO: 276391 - protein, 7 aa, Mycobacterium
PRRTHAA

SEQ ID NO: 276392 - protein, 11 aa, Mycobacterium
PRSASAHQVGD

SEQ ID NO: 276393 - protein, 6 aa, Mycobacterium
PRSASV

SEQ ID NO: 276394 - protein, 7 aa, Mycobacterium
PRSASVQ

SEQ ID NO: 276395 - protein, 18 aa, Mycobacterium
PRSDAPEGDLAAAAPTAL

SEQ ID NO: 276396 - protein, 5 aa, Mycobacterium
PRSDI

SEQ ID NO: 276397 - protein, 24 aa, Mycobacterium
PRSDPDDIPAPQQTETPPRPADRE

SEQ ID NO: 276398 - protein, 12 aa, Mycobacterium
PRSEGANNTLSA

SEQ ID NO: 276399 - protein, 8 aa, Mycobacterium
PRSEIPDD

SEQ ID NO: 276400 - protein, 11 aa, Mycobacterium
PRSGGLYPTGN

SEQ ID NO: 276401 - protein, 8 aa, Mycobacterium
PRSGGTGD

SEQ ID NO: 276402 - protein, 14 aa, Mycobacterium
PRSGPAAHAREAPR

SEQ ID NO: 276403 - protein, 17 aa, Mycobacterium
PRSGTDAAGLGLDQPQH

SEQ ID NO: 276404 - protein, 17 aa, Mycobacterium
PRSIPKTTSGKIRRAQT

SEQ ID NO: 276405 - protein, 13 aa, Mycobacterium
PRSKGPAAARNTG

SEQ ID NO: 276406 - protein, 17 aa, Mycobacterium
PRSLSPVTGHPTQRRPS

SEQ ID NO: 276407 - protein, 19 aa, Mycobacterium
PRSPDTHPDNRHQHSYPDR

SEQ ID NO: 276408 - protein, 10 aa, Mycobacterium
PRSPSSPQDE

SEQ ID NO: 276409 - protein, 22 aa, Mycobacterium
PRSPVASAPRKPNEDPQLSDAA

SEQ ID NO: 276410 - protein, 14 aa, Mycobacterium
PRSPVGKALRRELP

SEQ ID NO: 276411 - protein, 7 aa, Mycobacterium
PRSRDEE

SEQ ID NO: 276412 - protein, 7 aa, Mycobacterium
PRSRHHR

SEQ ID NO: 276413 - protein, 5 aa, Mycobacterium
PRSRR

SEQ ID NO: 276414 - protein, 5 aa, Mycobacterium
PRSST

SEQ ID NO: 276415 - protein, 31 aa, Mycobacterium
PRSTTVAGRPTRIPTEATASGAAPAITQPGV

SEQ ID NO: 276416 - protein, 11 aa, Mycobacterium
PRTDPDGPAMT

SEQ ID NO: 276417 - protein, 13 aa, Mycobacterium
PRTDVGEERFGTH

SEQ ID NO: 276418 - protein, 6 aa, Mycobacterium
PRTELT

SEQ ID NO: 276419 - protein, 10 aa, Mycobacterium
PRTGAPSTAS

SEQ ID NO: 276420 - protein, 8 aa, Mycobacterium
PRTGAPSV

SEQ ID NO: 276421 - protein, 5 aa, Mycobacterium
PRTGG

SEQ ID NO: 276422 - protein, 7 aa, Mycobacterium
PRTGHGV

SEQ ID NO: 276423 - protein, 7 aa, Mycobacterium
PRTKDSA

SEQ ID NO: 276424 - protein, 7 aa, Mycobacterium
PRTKNSA

SEQ ID NO: 276425 - protein, 7 aa, Mycobacterium
PRTKNST

SEQ ID NO: 276426 - protein, 7 aa, Mycobacterium
PRTKSSA

SEQ ID NO: 276427 - protein, 17 aa, Mycobacterium
PRTLEDTWNRGSGAVVS

SEQ ID NO: 276428 - protein, 6 aa, Mycobacterium
PRTLGR

SEQ ID NO: 276429 - protein, 7 aa, Mycobacterium
PRTLGRQ

SEQ ID NO: 276430 - protein, 6 aa, Mycobacterium
PRTLTP

SEQ ID NO: 276431 - protein, 13 aa, Mycobacterium
PRTNARGGPGGIP

SEQ ID NO: 276432 - protein, 14 aa, Mycobacterium
PRTNARGGPGGRPG

SEQ ID NO: 276433 - protein, 11 aa, Mycobacterium
PRTPADNDESI

SEQ ID NO: 276434 - protein, 29 aa, Mycobacterium
PRTPAGKVDTSALPPVPAKAGTAGSSALP

SEQ ID NO: 276435 - protein, 7 aa, Mycobacterium
PRTPANR

SEQ ID NO: 276436 - protein, 25 aa, Mycobacterium
PRTPDGSSTLGAGTNHLPGQPPIEI

SEQ ID NO: 276437 - protein, 8 aa, Mycobacterium
PRTPENSR

SEQ ID NO: 276438 - protein, 8 aa, Mycobacterium
PRTPKNSR

SEQ ID NO: 276439 - protein, 7 aa, Mycobacterium
PRTPPAP

SEQ ID NO: 276440 - protein, 20 aa, Mycobacterium
PRTPSGKADLRAVRDHLESG

SEQ ID NO: 276441 - protein, 11 aa, Mycobacterium
PRTPSGKPDLG

SEQ ID NO: 276442 - protein, 7 aa, Mycobacterium
PRTPSVS

SEQ ID NO: 276443 - protein, 8 aa, Mycobacterium
PRTPTGKA

SEQ ID NO: 276444 - protein, 7 aa, Mycobacterium
PRTRESG

SEQ ID NO: 276445 - protein, 7 aa, Mycobacterium
PRTSTKG

SEQ ID NO: 276446 - protein, 8 aa, Mycobacterium
PRTVGRQN

SEQ ID NO: 276447 - protein, 5 aa, Mycobacterium
PRTVP

SEQ ID NO: 276448 - protein, 30 aa, Mycobacterium
PRVAGGVDKSSAPSGPTRQRKQRGGGSFTN

SEQ ID NO: 276449 - protein, 4 aa, Mycobacterium
PRVD

SEQ ID NO: 276450 - protein, 11 aa, Mycobacterium
PRVEAPSAGNL

SEQ ID NO: 276451 - protein, 15 aa, Mycobacterium
PRVEEKVADDVPSTT

SEQ ID NO: 276452 - protein, 4 aa, Mycobacterium
PRVP

SEQ ID NO: 276453 - protein, 9 aa, Mycobacterium
PRVPPTRPG

SEQ ID NO: 276454 - protein, 8 aa, Mycobacterium
PRVPPTTR

SEQ ID NO: 276455 - protein, 6 aa, Mycobacterium
PRVPTL

SEQ ID NO: 276456 - protein, 4 aa, Mycobacterium
PRVR

SEQ ID NO: 276457 - protein, 12 aa, Mycobacterium
PRVSKGERVPND

SEQ ID NO: 276458 - protein, 16 aa, Mycobacterium
PRVTARTPPVRRDQTH

SEQ ID NO: 276459 - protein, 35 aa, Mycobacterium
PRYATDSGAHPQGQPETTSAEPSGPPSIETPKSDL

SEQ ID NO: 276460 - protein, 14 aa, Mycobacterium
PRYDSAKPADQQQP

SEQ ID NO: 276461 - protein, 4 aa, Mycobacterium
PRYG

SEQ ID NO: 276462 - protein, 7 aa, Mycobacterium
PRYGDAR

SEQ ID NO: 276463 - protein, 5 aa, Mycobacterium
PRYGE

SEQ ID NO: 276464 - protein, 4 aa, Mycobacterium
PRYQ

SEQ ID NO: 276465 - protein, 8 aa, Mycobacterium
PSAAAAAK

SEQ ID NO: 276466 - protein, 9 aa, Mycobacterium
PSAAAGAAV

SEQ ID NO: 276467 - protein, 23 aa, Mycobacterium
PSAAAGGQAGAGDVVDDDYDDDE

SEQ ID NO: 276468 - protein, 10 aa, Mycobacterium
PSAAGPGGLA

SEQ ID NO: 276469 - protein, 14 aa, Mycobacterium
PSAAISAASDSDDL

SEQ ID NO: 276470 - protein, 8 aa, Mycobacterium
PSAAKASS

SEQ ID NO: 276471 - protein, 25 aa, Mycobacterium
PSAAPAGAAPIAPSRQPVARSSDHP

SEQ ID NO: 276472 - protein, 26 aa, Mycobacterium
PSAAPTRIPTAVPPQPGTPPSAALSP

SEQ ID NO: 276473 - protein, 5 aa, Mycobacterium
PSAAV

SEQ ID NO: 276474 - protein, 7 aa, Mycobacterium
PSADEKI

SEQ ID NO: 276475 - protein, 13 aa, Mycobacterium
PSADPTPAPVPAP

SEQ ID NO: 276476 - protein, 6 aa, Mycobacterium
PSAERE

SEQ ID NO: 276477 - protein, 10 aa, Mycobacterium
PSAESLDSNS

SEQ ID NO: 276478 - protein, 8 aa, Mycobacterium
PSAGLNPA

SEQ ID NO: 276479 - protein, 7 aa, Mycobacterium
PSAGSAY

SEQ ID NO: 276480 - protein, 5 aa, Mycobacterium
PSAGV

SEQ ID NO: 276481 - protein, 11 aa, Mycobacterium
PSAHGKYTNHG

SEQ ID NO: 276482 - protein, 4 aa, Mycobacterium
PSAI

SEQ ID NO: 276483 - protein, 4 aa, Mycobacterium
PSAL

SEQ ID NO: 276484 - protein, 15 aa, Mycobacterium
PSALDPAIDPKGARD

SEQ ID NO: 276485 - protein, 13 aa, Mycobacterium
PSALGAGSPQSFA

SEQ ID NO: 276486 - protein, 12 aa, Mycobacterium
PSALSSGFSSTL

SEQ ID NO: 276487 - protein, 10 aa, Mycobacterium
PSANEQQTQQ

SEQ ID NO: 276488 - protein, 5 aa, Mycobacterium
PSANL

SEQ ID NO: 276489 - protein, 7 aa, Mycobacterium
PSAPLAA

SEQ ID NO: 276490 - protein, 9 aa, Mycobacterium
PSAPVAPRV

SEQ ID NO: 276491 - protein, 6 aa, Mycobacterium
PSARAA

SEQ ID NO: 276492 - protein, 8 aa, Mycobacterium
PSASDKIA

SEQ ID NO: 276493 - protein, 8 aa, Mycobacterium
PSASEKIT

SEQ ID NO: 276494 - protein, 10 aa, Mycobacterium
PSATAGASLV

SEQ ID NO: 276495 - protein, 7 aa, Mycobacterium
PSATAVG

SEQ ID NO: 276496 - protein, 4 aa, Mycobacterium
PSAV

SEQ ID NO: 276497 - protein, 14 aa, Mycobacterium
PSAVADTKDDIARA

SEQ ID NO: 276498 - protein, 5 aa, Mycobacterium
PSAVD

SEQ ID NO: 276499 - protein, 10 aa, Mycobacterium
PSAVEVPSGP

SEQ ID NO: 276500 - protein, 14 aa, Mycobacterium
PSAVGAGAGGGLDS

SEQ ID NO: 276501 - protein, 5 aa, Mycobacterium
PSCPL

SEQ ID NO: 276502 - protein, 25 aa, Mycobacterium
PSDAKGFNGGRNGDGADHVVSEDAS

SEQ ID NO: 276503 - protein, 8 aa, Mycobacterium
PSDDEAVT

SEQ ID NO: 276504 - protein, 6 aa, Mycobacterium
PSDDGV

SEQ ID NO: 276505 - protein, 4 aa, Mycobacterium
PSDE

SEQ ID NO: 276506 - protein, 7 aa, Mycobacterium
PSDERGA

SEQ ID NO: 276507 - protein, 7 aa, Mycobacterium
PSDGSHF

SEQ ID NO: 276508 - protein, 7 aa, Mycobacterium
PSDPNAK

SEQ ID NO: 276509 - protein, 7 aa, Mycobacterium
PSDPQWS

SEQ ID NO: 276510 - protein, 8 aa, Mycobacterium
PSDQIPAA

SEQ ID NO: 276511 - protein, 8 aa, Mycobacterium
PSDSGPGN

SEQ ID NO: 276512 - protein, 14 aa, Mycobacterium
PSDSPGVTIQPPED

SEQ ID NO: 276513 - protein, 82 aa, Mycobacterium
PSDSPVTSSAPPAPDAEPAATSGAPESTAPTSPVTSEMSTGSPAPTSKPTASPSSPPPTSTPVSPAAGASEPGSSPAPAGEP

SEQ ID NO: 276514 - protein, 8 aa, Mycobacterium
PSDTLEDE

SEQ ID NO: 276515 - protein, 6 aa, Mycobacterium
PSDVKT

SEQ ID NO: 276516 - protein, 6 aa, Mycobacterium
PSDWSG

SEQ ID NO: 276517 - protein, 13 aa, Mycobacterium
PSEDLTDADLTQT

SEQ ID NO: 276518 - protein, 9 aa, Mycobacterium
PSEDPATPD

SEQ ID NO: 276519 - protein, 10 aa, Mycobacterium
PSEDPATPEA

SEQ ID NO: 276520 - protein, 5 aa, Mycobacterium
PSEHG

SEQ ID NO: 276521 - protein, 4 aa, Mycobacterium
PSER

SEQ ID NO: 276522 - protein, 7 aa, Mycobacterium
PSERAGW

SEQ ID NO: 276523 - protein, 6 aa, Mycobacterium
PSERDG

SEQ ID NO: 276524 - protein, 5 aa, Mycobacterium
PSERQ

SEQ ID NO: 276525 - protein, 6 aa, Mycobacterium
PSETAA

SEQ ID NO: 276526 - protein, 8 aa, Mycobacterium
PSETGYGL

SEQ ID NO: 276527 - protein, 7 aa, Mycobacterium
PSEVRRQ

SEQ ID NO: 276528 - protein, 7 aa, Mycobacterium
PSEVTTD

SEQ ID NO: 276529 - protein, 5 aa, Mycobacterium
PSFGR

SEQ ID NO: 276530 - protein, 8 aa, Mycobacterium
PSFPTSEA

SEQ ID NO: 276531 - protein, 9 aa, Mycobacterium
PSFQPPPAA

SEQ ID NO: 276532 - protein, 11 aa, Mycobacterium
PSFRPNTDPVV

SEQ ID NO: 276533 - protein, 5 aa, Mycobacterium
PSGAA

SEQ ID NO: 276534 - protein, 7 aa, Mycobacterium
PSGALGG

SEQ ID NO: 276535 - protein, 5 aa, Mycobacterium
PSGAR

SEQ ID NO: 276536 - protein, 15 aa, Mycobacterium
PSGASYHPDTAQRQS

SEQ ID NO: 276537 - protein, 6 aa, Mycobacterium
PSGDDS

SEQ ID NO: 276538 - protein, 7 aa, Mycobacterium
PSGDETA

SEQ ID NO: 276539 - protein, 4 aa, Mycobacterium
PSGE

SEQ ID NO: 276540 - protein, 6 aa, Mycobacterium
PSGEKK

SEQ ID NO: 276541 - protein, 9 aa, Mycobacterium
PSGELISPQ

SEQ ID NO: 276542 - protein, 7 aa, Mycobacterium
PSGENAH

SEQ ID NO: 276543 - protein, 7 aa, Mycobacterium
PSGETAQ

SEQ ID NO: 276544 - protein, 13 aa, Mycobacterium
PSGGLGPYEPQTL

SEQ ID NO: 276545 - protein, 4 aa, Mycobacterium
PSGH

SEQ ID NO: 276546 - protein, 9 aa, Mycobacterium
PSGLTDPTR

SEQ ID NO: 276547 - protein, 9 aa, Mycobacterium
PSGNAYSKG

SEQ ID NO: 276548 - protein, 23 aa, Mycobacterium
PSGNDNDDQGPKGRPEANRRAGA

SEQ ID NO: 276549 - protein, 5 aa, Mycobacterium
PSGNQ

SEQ ID NO: 276550 - protein, 4 aa, Mycobacterium
PSGP

SEQ ID NO: 276551 - protein, 8 aa, Mycobacterium
PSGPDTGF

SEQ ID NO: 276552 - protein, 8 aa, Mycobacterium
PSGQLNES

SEQ ID NO: 276553 - protein, 16 aa, Mycobacterium
PSGQQVQLPKKDGNVS

SEQ ID NO: 276554 - protein, 6 aa, Mycobacterium
PSGRAA

SEQ ID NO: 276555 - protein, 7 aa, Mycobacterium
PSGRAPR

SEQ ID NO: 276556 - protein, 7 aa, Mycobacterium
PSGRRRQ

SEQ ID NO: 276557 - protein, 4 aa, Mycobacterium
PSGS

SEQ ID NO: 276558 - protein, 7 aa, Mycobacterium
PSGSGLP

SEQ ID NO: 276559 - protein, 9 aa, Mycobacterium
PSGSGPTPI

SEQ ID NO: 276560 - protein, 10 aa, Mycobacterium
PSGSGPTPIQ

SEQ ID NO: 276561 - protein, 32 aa, Mycobacterium
PSGSPTPGGSTTTTVTSGGSAPPAPAPATATP

SEQ ID NO: 276562 - protein, 5 aa, Mycobacterium
PSGST

SEQ ID NO: 276563 - protein, 6 aa, Mycobacterium
PSGSTL

SEQ ID NO: 276564 - protein, 5 aa, Mycobacterium
PSGTA

SEQ ID NO: 276565 - protein, 8 aa, Mycobacterium
PSGTGKSS

SEQ ID NO: 276566 - protein, 7 aa, Mycobacterium
PSGTGRE

SEQ ID NO: 276567 - protein, 8 aa, Mycobacterium
PSGTRLPE

SEQ ID NO: 276568 - protein, 11 aa, Mycobacterium
PSGVNEGPGRI

SEQ ID NO: 276569 - protein, 11 aa, Mycobacterium
PSGVSAGRPAV

SEQ ID NO: 276570 - protein, 4 aa, Mycobacterium
PSGW

SEQ ID NO: 276571 - protein, 6 aa, Mycobacterium
PSGYID

SEQ ID NO: 276572 - protein, 8 aa, Mycobacterium
PSHAGRAT

SEQ ID NO: 276573 - protein, 9 aa, Mycobacterium
PSHAGRATT

SEQ ID NO: 276574 - protein, 6 aa, Mycobacterium
PSHHAG

SEQ ID NO: 276575 - protein, 7 aa, Mycobacterium
PSHSYTR

SEQ ID NO: 276576 - protein, 4 aa, Mycobacterium
PSIA

SEQ ID NO: 276577 - protein, 6 aa, Mycobacterium
PSIATS

SEQ ID NO: 276578 - protein, 10 aa, Mycobacterium
PSINATNDPV

SEQ ID NO: 276579 - protein, 43 aa, Mycobacterium
PSINNGLNPAPSDRVAGTPPPTSDPLSRPGSGSVQCNGQQPNP

SEQ ID NO: 276580 - protein, 4 aa, Mycobacterium
PSIR

SEQ ID NO: 276581 - protein, 8 aa, Mycobacterium
PSKAADEA

SEQ ID NO: 276582 - protein, 12 aa, Mycobacterium
PSKAREKARDAA

SEQ ID NO: 276583 - protein, 13 aa, Mycobacterium
PSLGDGRAPEVED

SEQ ID NO: 276584 - protein, 22 aa, Mycobacterium
PSLGGEPPVGPPSGQWQPTYPP

SEQ ID NO: 276585 - protein, 7 aa, Mycobacterium
PSLGGYG

SEQ ID NO: 276586 - protein, 11 aa, Mycobacterium
PSLGRYGNAGE

SEQ ID NO: 276587 - protein, 6 aa, Mycobacterium
PSLNGL

SEQ ID NO: 276588 - protein, 6 aa, Mycobacterium
PSLPDS

SEQ ID NO: 276589 - protein, 36 aa, Mycobacterium
PSLPGPQQRGYAPPADPAYADQTPYAPTYGGTMPPW

SEQ ID NO: 276590 - protein, 14 aa, Mycobacterium
PSLPNTPSPKPMPN

SEQ ID NO: 276591 - protein, 6 aa, Mycobacterium
PSLPRR

SEQ ID NO: 276592 - protein, 5 aa, Mycobacterium
PSLPT

SEQ ID NO: 276593 - protein, 5 aa, Mycobacterium
PSLQG

SEQ ID NO: 276594 - protein, 7 aa, Mycobacterium
PSLRDQL

SEQ ID NO: 276595 - protein, 8 aa, Mycobacterium
PSLSGSPF

SEQ ID NO: 276596 - protein, 7 aa, Mycobacterium
PSLSIDG

SEQ ID NO: 276597 - protein, 10 aa, Mycobacterium
PSLSPGGVPA

SEQ ID NO: 276598 - protein, 4 aa, Mycobacterium
PSLT

SEQ ID NO: 276599 - protein, 5 aa, Mycobacterium
PSLTD

SEQ ID NO: 276600 - protein, 12 aa, Mycobacterium
PSLTDGQLATGG

SEQ ID NO: 276601 - protein, 12 aa, Mycobacterium
PSLTDGRLATEG

SEQ ID NO: 276602 - protein, 12 aa, Mycobacterium
PSLTDSAEDNAR

SEQ ID NO: 276603 - protein, 9 aa, Mycobacterium
PSMRAAPRA

SEQ ID NO: 276604 - protein, 10 aa, Mycobacterium
PSNELPPPHA

SEQ ID NO: 276605 - protein, 6 aa, Mycobacterium
PSNIGY

SEQ ID NO: 276606 - protein, 13 aa, Mycobacterium
PSNKQAQITNNTQ

SEQ ID NO: 276607 - protein, 7 aa, Mycobacterium
PSNNAQK

SEQ ID NO: 276608 - protein, 8 aa, Mycobacterium
PSNNATFD

SEQ ID NO: 276609 - protein, 10 aa, Mycobacterium
PSNNATFGEA

SEQ ID NO: 276610 - protein, 14 aa, Mycobacterium
PSNNATFNKTMSEQ

SEQ ID NO: 276611 - protein, 11 aa, Mycobacterium
PSNNATFNQTM

SEQ ID NO: 276612 - protein, 10 aa, Mycobacterium
PSNPPSRKAP

SEQ ID NO: 276613 - protein, 4 aa, Mycobacterium
PSNR

SEQ ID NO: 276614 - protein, 5 aa, Mycobacterium
PSNRS

SEQ ID NO: 276615 - protein, 4 aa, Mycobacterium
PSPA

SEQ ID NO: 276616 - protein, 5 aa, Mycobacterium
PSPAG

SEQ ID NO: 276617 - protein, 5 aa, Mycobacterium
PSPAL

SEQ ID NO: 276618 - protein, 16 aa, Mycobacterium
PSPDDPPQSAPEHSTL

SEQ ID NO: 276619 - protein, 11 aa, Mycobacterium
PSPDEMRDPTA

SEQ ID NO: 276620 - protein, 7 aa, Mycobacterium
PSPDNIP

SEQ ID NO: 276621 - protein, 7 aa, Mycobacterium
PSPDTNL

SEQ ID NO: 276622 - protein, 14 aa, Mycobacterium
PSPGITGGSITATS

SEQ ID NO: 276623 - protein, 5 aa, Mycobacterium
PSPHA

SEQ ID NO: 276624 - protein, 21 aa, Mycobacterium
PSPKPTHGDKTGASTKEPAIG

SEQ ID NO: 276625 - protein, 12 aa, Mycobacterium
PSPKSHSGSPTW

SEQ ID NO: 276626 - protein, 6 aa, Mycobacterium
PSPLPG

SEQ ID NO: 276627 - protein, 11 aa, Mycobacterium
PSPPDAYDDTR

SEQ ID NO: 276628 - protein, 20 aa, Mycobacterium
PSPPSPSAPPGPGVLPPPPR

SEQ ID NO: 276629 - protein, 8 aa, Mycobacterium
PSPPVPLT

SEQ ID NO: 276630 - protein, 5 aa, Mycobacterium
PSPQP

SEQ ID NO: 276631 - protein, 13 aa, Mycobacterium
PSPQQPPPQPDRP

SEQ ID NO: 276632 - protein, 4 aa, Mycobacterium
PSPR

SEQ ID NO: 276633 - protein, 6 aa, Mycobacterium
PSPRPR

SEQ ID NO: 276634 - protein, 16 aa, Mycobacterium
PSPSTTVVDAINRKPP

SEQ ID NO: 276635 - protein, 5 aa, Mycobacterium
PSPSV

SEQ ID NO: 276636 - protein, 8 aa, Mycobacterium
PSPSVAES

SEQ ID NO: 276637 - protein, 7 aa, Mycobacterium
PSPTAAL

SEQ ID NO: 276638 - protein, 5 aa, Mycobacterium
PSPVL

SEQ ID NO: 276639 - protein, 4 aa, Mycobacterium
PSQG

SEQ ID NO: 276640 - protein, 12 aa, Mycobacterium
PSQIPPRTLNPD

SEQ ID NO: 276641 - protein, 6 aa, Mycobacterium
PSQLGS

SEQ ID NO: 276642 - protein, 16 aa, Mycobacterium
PSQQASGTVQPGDPAQ

SEQ ID NO: 276643 - protein, 18 aa, Mycobacterium
PSQSDDSGQRASTYPGER

SEQ ID NO: 276644 - protein, 11 aa, Mycobacterium
PSQSSDDSVRR

SEQ ID NO: 276645 - protein, 7 aa, Mycobacterium
PSQSSSR

SEQ ID NO: 276646 - protein, 13 aa, Mycobacterium
PSQTVIGGPPEQI

SEQ ID NO: 276647 - protein, 5 aa, Mycobacterium
PSRAE

SEQ ID NO: 276648 - protein, 9 aa, Mycobacterium
PSRARNSSL

SEQ ID NO: 276649 - protein, 6 aa, Mycobacterium
PSRAVP

SEQ ID NO: 276650 - protein, 32 aa, Mycobacterium
PSREQPQPQYPPQYPQQYPQNPQYPQNPFQPY

SEQ ID NO: 276651 - protein, 12 aa, Mycobacterium
PSRGDERTKADV

SEQ ID NO: 276652 - protein, 4 aa, Mycobacterium
PSRI

SEQ ID NO: 276653 - protein, 6 aa, Mycobacterium
PSRLDP

SEQ ID NO: 276654 - protein, 5 aa, Mycobacterium
PSRNQ

SEQ ID NO: 276655 - protein, 13 aa, Mycobacterium
PSRPAGGPRISRS

SEQ ID NO: 276656 - protein, 9 aa, Mycobacterium
PSRPARSVA

SEQ ID NO: 276657 - protein, 6 aa, Mycobacterium
PSRPLR

SEQ ID NO: 276658 - protein, 6 aa, Mycobacterium
PSRPRI

SEQ ID NO: 276659 - protein, 9 aa, Mycobacterium
PSRPTPKRL

SEQ ID NO: 276660 - protein, 8 aa, Mycobacterium
PSRQAAAP

SEQ ID NO: 276661 - protein, 8 aa, Mycobacterium
PSRQASEH

SEQ ID NO: 276662 - protein, 9 aa, Mycobacterium
PSRQRGQSA

SEQ ID NO: 276663 - protein, 7 aa, Mycobacterium
PSRQRRH

SEQ ID NO: 276664 - protein, 8 aa, Mycobacterium
PSRQRRQT

SEQ ID NO: 276665 - protein, 9 aa, Mycobacterium
PSRQSSRPL

SEQ ID NO: 276666 - protein, 11 aa, Mycobacterium
PSRRDKHPERA

SEQ ID NO: 276667 - protein, 8 aa, Mycobacterium
PSRRSAPL

SEQ ID NO: 276668 - protein, 9 aa, Mycobacterium
PSRSALPAH

SEQ ID NO: 276669 - protein, 8 aa, Mycobacterium
PSRSNPLR

SEQ ID NO: 276670 - protein, 5 aa, Mycobacterium
PSRST

SEQ ID NO: 276671 - protein, 14 aa, Mycobacterium
PSRTEGGTRRYSPE

SEQ ID NO: 276672 - protein, 11 aa, Mycobacterium
PSRTEVPAHPK

SEQ ID NO: 276673 - protein, 7 aa, Mycobacterium
PSRTPVM

SEQ ID NO: 276674 - protein, 6 aa, Mycobacterium
PSRVRA

SEQ ID NO: 276675 - protein, 12 aa, Mycobacterium
PSRVRRSGGTGL

SEQ ID NO: 276676 - protein, 9 aa, Mycobacterium
PSSDDTQTA

SEQ ID NO: 276677 - protein, 8 aa, Mycobacterium
PSSGADER

SEQ ID NO: 276678 - protein, 19 aa, Mycobacterium
PSSGMTGDLDTRDRTRLTR

SEQ ID NO: 276679 - protein, 11 aa, Mycobacterium
PSSGNADAAQL

SEQ ID NO: 276680 - protein, 7 aa, Mycobacterium
PSSNAQK

SEQ ID NO: 276681 - protein, 8 aa, Mycobacterium
PSSNPQKY

SEQ ID NO: 276682 - protein, 6 aa, Mycobacterium
PSSPRR

SEQ ID NO: 276683 - protein, 12 aa, Mycobacterium
PSSQPLPGVGAG

SEQ ID NO: 276684 - protein, 6 aa, Mycobacterium
PSSRAQ

SEQ ID NO: 276685 - protein, 11 aa, Mycobacterium
PSSRDDSAAPL

SEQ ID NO: 276686 - protein, 12 aa, Mycobacterium
PSSRSLPGVGAR

SEQ ID NO: 276687 - protein, 5 aa, Mycobacterium
PSSRY

SEQ ID NO: 276688 - protein, 5 aa, Mycobacterium
PSSSS

SEQ ID NO: 276689 - protein, 8 aa, Mycobacterium
PSSTSPLD

SEQ ID NO: 276690 - protein, 8 aa, Mycobacterium
PSSTYTRA

SEQ ID NO: 276691 - protein, 10 aa, Mycobacterium
PSSWRSPADL

SEQ ID NO: 276692 - protein, 9 aa, Mycobacterium
PSSYNAQTT

SEQ ID NO: 276693 - protein, 10 aa, Mycobacterium
PSTAAVPGAV

SEQ ID NO: 276694 - protein, 8 aa, Mycobacterium
PSTASGFT

SEQ ID NO: 276695 - protein, 4 aa, Mycobacterium
PSTD

SEQ ID NO: 276696 - protein, 8 aa, Mycobacterium
PSTGATIP

SEQ ID NO: 276697 - protein, 5 aa, Mycobacterium
PSTGG

SEQ ID NO: 276698 - protein, 5 aa, Mycobacterium
PSTGN

SEQ ID NO: 276699 - protein, 6 aa, Mycobacterium
PSTLDG

SEQ ID NO: 276700 - protein, 13 aa, Mycobacterium
PSTLDPAVDPDGA

SEQ ID NO: 276701 - protein, 13 aa, Mycobacterium
PSTLDPAVDPEGA

SEQ ID NO: 276702 - protein, 5 aa, Mycobacterium
PSTLQ

SEQ ID NO: 276703 - protein, 6 aa, Mycobacterium
PSTPDA

SEQ ID NO: 276704 - protein, 5 aa, Mycobacterium
PSTPE

SEQ ID NO: 276705 - protein, 8 aa, Mycobacterium
PSTPVTTE

SEQ ID NO: 276706 - protein, 4 aa, Mycobacterium
PSTT

SEQ ID NO: 276707 - protein, 86 aa, Mycobacterium
PSTTTPPPPPATTTTAPPSTTTTSPPTTTTTTTTTTAPPTTTTTQPTTTKPTTTTAPPTTTAPPTTTQQPPTTTAAPVTPTTAAPG

SEQ ID NO: 276708 - protein, 4 aa, Mycobacterium
PSTV

SEQ ID NO: 276709 - protein, 4 aa, Mycobacterium
PSVC

SEQ ID NO: 276710 - protein, 29 aa, Mycobacterium
PSVDAPSDDGVKPNLAGAAGDNGEFDTPI

SEQ ID NO: 276711 - protein, 29 aa, Mycobacterium
PSVDAPTEDGVKPDWAGPPGDNGEFDTPI

SEQ ID NO: 276712 - protein, 43 aa, Mycobacterium
PSVDNGLNPAPSDRVAGTPPPISDPLQRPGSGSVECNGQQPNP

SEQ ID NO: 276713 - protein, 43 aa, Mycobacterium
PSVDTGINPLPSDRVTGTPPPRSDPLQRPGSGSVQCNGQQPNP

SEQ ID NO: 276714 - protein, 11 aa, Mycobacterium
PSVGPDGARPM

SEQ ID NO: 276715 - protein, 4 aa, Mycobacterium
PSVP

SEQ ID NO: 276716 - protein, 11 aa, Mycobacterium
PSVPPPPAPLS

SEQ ID NO: 276717 - protein, 12 aa, Mycobacterium
PSVRSTDFSGDA

SEQ ID NO: 276718 - protein, 4 aa, Mycobacterium
PSVT

SEQ ID NO: 276719 - protein, 11 aa, Mycobacterium
PSVVNPDRGLR

SEQ ID NO: 276720 - protein, 12 aa, Mycobacterium
PSVVNPDRGLRR

SEQ ID NO: 276721 - protein, 4 aa, Mycobacterium
PSWE

SEQ ID NO: 276722 - protein, 14 aa, Mycobacterium
PSWIGSSSSDAALR

SEQ ID NO: 276723 - protein, 8 aa, Mycobacterium
PSWPKRPG

SEQ ID NO: 276724 - protein, 4 aa, Mycobacterium
PSYA

SEQ ID NO: 276725 - protein, 13 aa, Mycobacterium
PSYADPSQSMLSP

SEQ ID NO: 276726 - protein, 6 aa, Mycobacterium
PSYNPW

SEQ ID NO: 276727 - protein, 7 aa, Mycobacterium
PSYPGID

SEQ ID NO: 276728 - protein, 10 aa, Mycobacterium
PSYSGGARVT

SEQ ID NO: 276729 - protein, 4 aa, Mycobacterium
PSYT

SEQ ID NO: 276730 - protein, 6 aa, Mycobacterium
PSYTYP

SEQ ID NO: 276731 - protein, 4 aa, Mycobacterium
PTAA

SEQ ID NO: 276732 - protein, 10 aa, Mycobacterium
PTAAAADLPG

SEQ ID NO: 276733 - protein, 10 aa, Mycobacterium
PTAAAGAGLP

SEQ ID NO: 276734 - protein, 10 aa, Mycobacterium
PTAAEEGGAV

SEQ ID NO: 276735 - protein, 7 aa, Mycobacterium
PTAAGSD

SEQ ID NO: 276736 - protein, 9 aa, Mycobacterium
PTAAPREPL

SEQ ID NO: 276737 - protein, 8 aa, Mycobacterium
PTAAQQPV

SEQ ID NO: 276738 - protein, 33 aa, Mycobacterium
PTAATAKKSPPAPNPTDSCGRTNGNTMPARPDL

SEQ ID NO: 276739 - protein, 13 aa, Mycobacterium
PTAATGGTAETAA

SEQ ID NO: 276740 - protein, 22 aa, Mycobacterium
PTAAVSPQPRGDAPTPAKNEPW

SEQ ID NO: 276741 - protein, 16 aa, Mycobacterium
PTADAQGSGYQGRQAR

SEQ ID NO: 276742 - protein, 6 aa, Mycobacterium
PTADLD

SEQ ID NO: 276743 - protein, 13 aa, Mycobacterium
PTADPPAPAQPTV

SEQ ID NO: 276744 - protein, 6 aa, Mycobacterium
PTADQA

SEQ ID NO: 276745 - protein, 4 aa, Mycobacterium
PTAE

SEQ ID NO: 276746 - protein, 19 aa, Mycobacterium
PTAEAMEPATGEPPRRKRK

SEQ ID NO: 276747 - protein, 5 aa, Mycobacterium
PTAEG

SEQ ID NO: 276748 - protein, 7 aa, Mycobacterium
PTAESAP

SEQ ID NO: 276749 - protein, 13 aa, Mycobacterium
PTAFSPSAAPVGT

SEQ ID NO: 276750 - protein, 4 aa, Mycobacterium
PTAG

SEQ ID NO: 276751 - protein, 11 aa, Mycobacterium
PTAGDGTGVTP

SEQ ID NO: 276752 - protein, 9 aa, Mycobacterium
PTAGPPKNL

SEQ ID NO: 276753 - protein, 7 aa, Mycobacterium
PTAGRQA

SEQ ID NO: 276754 - protein, 17 aa, Mycobacterium
PTAIPEPSVTAGQHDDV

SEQ ID NO: 276755 - protein, 25 aa, Mycobacterium
PTAKAALKGTSLGGSKISIGGAGGT

SEQ ID NO: 276756 - protein, 13 aa, Mycobacterium
PTALPEDTAAPRR

SEQ ID NO: 276757 - protein, 7 aa, Mycobacterium
PTANGDR

SEQ ID NO: 276758 - protein, 8 aa, Mycobacterium
PTANGKQP

SEQ ID NO: 276759 - protein, 10 aa, Mycobacterium
PTAPSPGFPD

SEQ ID NO: 276760 - protein, 33 aa, Mycobacterium
PTAPVAKAPAPAPAPEAKPVQEAPPPAPPPETI

SEQ ID NO: 276761 - protein, 5 aa, Mycobacterium
PTAQT

SEQ ID NO: 276762 - protein, 9 aa, Mycobacterium
PTARLGSTY

SEQ ID NO: 276763 - protein, 8 aa, Mycobacterium
PTASQQPV

SEQ ID NO: 276764 - protein, 8 aa, Mycobacterium
PTASRADR

SEQ ID NO: 276765 - protein, 17 aa, Mycobacterium
PTASSEPVEGHQNAQPG

SEQ ID NO: 276766 - protein, 10 aa, Mycobacterium
PTATAGAPLV

SEQ ID NO: 276767 - protein, 10 aa, Mycobacterium
PTATAGSSLV

SEQ ID NO: 276768 - protein, 16 aa, Mycobacterium
PTATAPEAERTGPAPS

SEQ ID NO: 276769 - protein, 9 aa, Mycobacterium
PTATPQEPL

SEQ ID NO: 276770 - protein, 30 aa, Mycobacterium
PTATPVPTASASAPSAPAPAPAPTAAGAGF

SEQ ID NO: 276771 - protein, 26 aa, Mycobacterium
PTAWANQAGSAAASESASDNAKSATY

SEQ ID NO: 276772 - protein, 9 aa, Mycobacterium
PTAYREGAE

SEQ ID NO: 276773 - protein, 24 aa, Mycobacterium
PTDADDSLRTEATAEDSSESEAEA

SEQ ID NO: 276774 - protein, 11 aa, Mycobacterium
PTDAERPVAPG

SEQ ID NO: 276775 - protein, 11 aa, Mycobacterium
PTDAPSSVGYR

SEQ ID NO: 276776 - protein, 11 aa, Mycobacterium
PTDEPASAALA

SEQ ID NO: 276777 - protein, 11 aa, Mycobacterium
PTDGPGERHDK

SEQ ID NO: 276778 - protein, 6 aa, Mycobacterium
PTDGPV

SEQ ID NO: 276779 - protein, 8 aa, Mycobacterium
PTDGQGSI

SEQ ID NO: 276780 - protein, 17 aa, Mycobacterium
PTDGTDSEGNETPRTTD

SEQ ID NO: 276781 - protein, 5 aa, Mycobacterium
PTDGY

SEQ ID NO: 276782 - protein, 10 aa, Mycobacterium
PTDMRTGKGL

SEQ ID NO: 276783 - protein, 7 aa, Mycobacterium
PTDMRTS

SEQ ID NO: 276784 - protein, 5 aa, Mycobacterium
PTDQQ

SEQ ID NO: 276785 - protein, 4 aa, Mycobacterium
PTDR

SEQ ID NO: 276786 - protein, 5 aa, Mycobacterium
PTDRA

SEQ ID NO: 276787 - protein, 13 aa, Mycobacterium
PTDRAEPGSVRPL

SEQ ID NO: 276788 - protein, 6 aa, Mycobacterium
PTDRPY

SEQ ID NO: 276789 - protein, 16 aa, Mycobacterium
PTDRPYPLAADQRGAT

SEQ ID NO: 276790 - protein, 17 aa, Mycobacterium
PTDRPYPPVADQRGSTV

SEQ ID NO: 276791 - protein, 16 aa, Mycobacterium
PTDRPYPSTADQRGST

SEQ ID NO: 276792 - protein, 11 aa, Mycobacterium
PTDSNHNPESA

SEQ ID NO: 276793 - protein, 10 aa, Mycobacterium
PTDTAPEAVN

SEQ ID NO: 276794 - protein, 5 aa, Mycobacterium
PTDYH

SEQ ID NO: 276795 - protein, 7 aa, Mycobacterium
PTEAAPT

SEQ ID NO: 276796 - protein, 13 aa, Mycobacterium
PTEAERAQDRSCA

SEQ ID NO: 276797 - protein, 17 aa, Mycobacterium
PTEAGGAHREPAAEAAR

SEQ ID NO: 276798 - protein, 15 aa, Mycobacterium
PTEDRSLVGAAGRVL

SEQ ID NO: 276799 - protein, 12 aa, Mycobacterium
PTEEAPSAEPFS

SEQ ID NO: 276800 - protein, 12 aa, Mycobacterium
PTEHLDASDADA

SEQ ID NO: 276801 - protein, 4 aa, Mycobacterium
PTEL

SEQ ID NO: 276802 - protein, 7 aa, Mycobacterium
PTELTNP

SEQ ID NO: 276803 - protein, 12 aa, Mycobacterium
PTENLDAGDARQ

SEQ ID NO: 276804 - protein, 5 aa, Mycobacterium
PTEPG

SEQ ID NO: 276805 - protein, 38 aa, Mycobacterium
PTEPGQATPQGDERRFTAPSSFDGSTQKIDTPPDPETE

SEQ ID NO: 276806 - protein, 5 aa, Mycobacterium
PTEPS

SEQ ID NO: 276807 - protein, 5 aa, Mycobacterium
PTEQL

SEQ ID NO: 276808 - protein, 11 aa, Mycobacterium
PTERANPVGAG

SEQ ID NO: 276809 - protein, 9 aa, Mycobacterium
PTESGRSER

SEQ ID NO: 276810 - protein, 37 aa, Mycobacterium
PTETAAGAAGRPAPLPASAPQPSAESAAEPTGAESIT

SEQ ID NO: 276811 - protein, 9 aa, Mycobacterium
PTETVSPAR

SEQ ID NO: 276812 - protein, 4 aa, Mycobacterium
PTEV

SEQ ID NO: 276813 - protein, 4 aa, Mycobacterium
PTFD

SEQ ID NO: 276814 - protein, 19 aa, Mycobacterium
PTFGDDGQESVRAAGDREP

SEQ ID NO: 276815 - protein, 8 aa, Mycobacterium
PTFGDESN

SEQ ID NO: 276816 - protein, 4 aa, Mycobacterium
PTGA

SEQ ID NO: 276817 - protein, 19 aa, Mycobacterium
PTGADTDEHEPAPGVPTST

SEQ ID NO: 276818 - protein, 5 aa, Mycobacterium
PTGAL

SEQ ID NO: 276819 - protein, 18 aa, Mycobacterium
PTGAVGESSIIGDRDSGA

SEQ ID NO: 276820 - protein, 4 aa, Mycobacterium
PTGF

SEQ ID NO: 276821 - protein, 4 aa, Mycobacterium
PTGG

SEQ ID NO: 276822 - protein, 5 aa, Mycobacterium
PTGGE

SEQ ID NO: 276823 - protein, 25 aa, Mycobacterium
PTGGHSAAGDSVIKPGYDPALTNGD

SEQ ID NO: 276824 - protein, 10 aa, Mycobacterium
PTGGIDAGKN

SEQ ID NO: 276825 - protein, 4 aa, Mycobacterium
PTGI

SEQ ID NO: 276826 - protein, 11 aa, Mycobacterium
PTGKGGLAHGG

SEQ ID NO: 276827 - protein, 9 aa, Mycobacterium
PTGNPGPSF

SEQ ID NO: 276828 - protein, 4 aa, Mycobacterium
PTGP

SEQ ID NO: 276829 - protein, 12 aa, Mycobacterium
PTGPATPLPLRS

SEQ ID NO: 276830 - protein, 12 aa, Mycobacterium
PTGQSGQLQPAT

SEQ ID NO: 276831 - protein, 10 aa, Mycobacterium
PTGRGAEHHG

SEQ ID NO: 276832 - protein, 9 aa, Mycobacterium
PTGSGKSAI

SEQ ID NO: 276833 - protein, 6 aa, Mycobacterium
PTGTNT

SEQ ID NO: 276834 - protein, 9 aa, Mycobacterium
PTGTPMDQT

SEQ ID NO: 276835 - protein, 12 aa, Mycobacterium
PTGTVAAGADDQ

SEQ ID NO: 276836 - protein, 12 aa, Mycobacterium
PTGVTADNSGTV

SEQ ID NO: 276837 - protein, 4 aa, Mycobacterium
PTGY

SEQ ID NO: 276838 - protein, 6 aa, Mycobacterium
PTHEWG

SEQ ID NO: 276839 - protein, 19 aa, Mycobacterium
PTIPPDQASTQNQTTGPNG

SEQ ID NO: 276840 - protein, 17 aa, Mycobacterium
PTKNAQSTNTRGQQSRS

SEQ ID NO: 276841 - protein, 10 aa, Mycobacterium
PTKQDTDTNY

SEQ ID NO: 276842 - protein, 7 aa, Mycobacterium
PTKQLDG

SEQ ID NO: 276843 - protein, 7 aa, Mycobacterium
PTKRTHP

SEQ ID NO: 276844 - protein, 14 aa, Mycobacterium
PTKSGRWPVPPRRG

SEQ ID NO: 276845 - protein, 14 aa, Mycobacterium
PTKTAQTTPEPGID

SEQ ID NO: 276846 - protein, 7 aa, Mycobacterium
PTLAGRS

SEQ ID NO: 276847 - protein, 6 aa, Mycobacterium
PTLGAY

SEQ ID NO: 276848 - protein, 5 aa, Mycobacterium
PTLGP

SEQ ID NO: 276849 - protein, 12 aa, Mycobacterium
PTLPDPTDPTDL

SEQ ID NO: 276850 - protein, 13 aa, Mycobacterium
PTLPDPTNLTDPT

SEQ ID NO: 276851 - protein, 14 aa, Mycobacterium
PTLPEPAALATPPA

SEQ ID NO: 276852 - protein, 10 aa, Mycobacterium
PTLPGPTNLT

SEQ ID NO: 276853 - protein, 5 aa, Mycobacterium
PTLSA

SEQ ID NO: 276854 - protein, 7 aa, Mycobacterium
PTLSSDP

SEQ ID NO: 276855 - protein, 19 aa, Mycobacterium
PTLTAGDAAPADTKSAPRI

SEQ ID NO: 276856 - protein, 5 aa, Mycobacterium
PTLTT

SEQ ID NO: 276857 - protein, 4 aa, Mycobacterium
PTLV

SEQ ID NO: 276858 - protein, 6 aa, Mycobacterium
PTMAPG

SEQ ID NO: 276859 - protein, 4 aa, Mycobacterium
PTMP

SEQ ID NO: 276860 - protein, 4 aa, Mycobacterium
PTMT

SEQ ID NO: 276861 - protein, 6 aa, Mycobacterium
PTMYGG

SEQ ID NO: 276862 - protein, 8 aa, Mycobacterium
PTNDDQAT

SEQ ID NO: 276863 - protein, 5 aa, Mycobacterium
PTNGG

SEQ ID NO: 276864 - protein, 15 aa, Mycobacterium
PTNLRPEPGPDAGVA

SEQ ID NO: 276865 - protein, 18 aa, Mycobacterium
PTNRSSDTGGDPADPTAA

SEQ ID NO: 276866 - protein, 18 aa, Mycobacterium
PTPADAAAAPPPPPLPER

SEQ ID NO: 276867 - protein, 9 aa, Mycobacterium
PTPAESIST

SEQ ID NO: 276868 - protein, 16 aa, Mycobacterium
PTPAGTEIRDNRSING

SEQ ID NO: 276869 - protein, 11 aa, Mycobacterium
PTPAPTTLGPG

SEQ ID NO: 276870 - protein, 4 aa, Mycobacterium
PTPD

SEQ ID NO: 276871 - protein, 10 aa, Mycobacterium
PTPDEARSGD

SEQ ID NO: 276872 - protein, 6 aa, Mycobacterium
PTPELT

SEQ ID NO: 276873 - protein, 6 aa, Mycobacterium
PTPEPK

SEQ ID NO: 276874 - protein, 6 aa, Mycobacterium
PTPGFP

SEQ ID NO: 276875 - protein, 25 aa, Mycobacterium
PTPHPDAASKGGHYNQRKTGPVGPM

SEQ ID NO: 276876 - protein, 4 aa, Mycobacterium
PTPI

SEQ ID NO: 276877 - protein, 12 aa, Mycobacterium
PTPIQRTPEEAL

SEQ ID NO: 276878 - protein, 5 aa, Mycobacterium
PTPNA

SEQ ID NO: 276879 - protein, 24 aa, Mycobacterium
PTPPAGPTEQFPGPGEEPAPEKKK

SEQ ID NO: 276880 - protein, 20 aa, Mycobacterium
PTPPHTPGPDDPAGSEPAPG

SEQ ID NO: 276881 - protein, 7 aa, Mycobacterium
PTPPLGP

SEQ ID NO: 276882 - protein, 9 aa, Mycobacterium
PTPPLPAKE

SEQ ID NO: 276883 - protein, 15 aa, Mycobacterium
PTPPPAPAAPPPAPV

SEQ ID NO: 276884 - protein, 9 aa, Mycobacterium
PTPPPLGTY

SEQ ID NO: 276885 - protein, 57 aa, Mycobacterium
PTPPPPPSPPTTPPWSPPGYPAAGYPPQPPVPAYSPPPAVPAHSPPQQPSAGGFAPP

SEQ ID NO: 276886 - protein, 7 aa, Mycobacterium
PTPPSGP

SEQ ID NO: 276887 - protein, 89 aa, Mycobacterium
PTPPSTTTTSPSATTTTTQPTTTTTTTTTPTTTTTTTTTTTPPTTTTTTQPTTTRTTTTQATTTAPPTTTQQPSTTTAAPITPTTEAPG

SEQ ID NO: 276888 - protein, 7 aa, Mycobacterium
PTPPTPV

SEQ ID NO: 276889 - protein, 15 aa, Mycobacterium
PTPQGTEIHDNRSIN

SEQ ID NO: 276890 - protein, 15 aa, Mycobacterium
PTPQGTEIRDNRSIN

SEQ ID NO: 276891 - protein, 11 aa, Mycobacterium
PTPQQAPTQLP

SEQ ID NO: 276892 - protein, 10 aa, Mycobacterium
PTPRGSYGAT

SEQ ID NO: 276893 - protein, 7 aa, Mycobacterium
PTPRPIP

SEQ ID NO: 276894 - protein, 8 aa, Mycobacterium
PTPRPIPP

SEQ ID NO: 276895 - protein, 17 aa, Mycobacterium
PTPSERVEQGAAAVSAA

SEQ ID NO: 276896 - protein, 27 aa, Mycobacterium
PTPVAEPAQPRPAAARTEDGAEVGPPR

SEQ ID NO: 276897 - protein, 4 aa, Mycobacterium
PTPW

SEQ ID NO: 276898 - protein, 5 aa, Mycobacterium
PTPWT

SEQ ID NO: 276899 - protein, 4 aa, Mycobacterium
PTPY

SEQ ID NO: 276900 - protein, 14 aa, Mycobacterium
PTPYGGPQLPIEPP

SEQ ID NO: 276901 - protein, 14 aa, Mycobacterium
PTPYGGPTLPIEPP

SEQ ID NO: 276902 - protein, 14 aa, Mycobacterium
PTPYGGPVLPIEPP

SEQ ID NO: 276903 - protein, 6 aa, Mycobacterium
PTQAAE

SEQ ID NO: 276904 - protein, 5 aa, Mycobacterium
PTQMP

SEQ ID NO: 276905 - protein, 8 aa, Mycobacterium
PTQQFGSG

SEQ ID NO: 276906 - protein, 5 aa, Mycobacterium
PTQRY

SEQ ID NO: 276907 - protein, 4 aa, Mycobacterium
PTQS

SEQ ID NO: 276908 - protein, 10 aa, Mycobacterium
PTQSLGSEGG

SEQ ID NO: 276909 - protein, 7 aa, Mycobacterium
PTQSSAR

SEQ ID NO: 276910 - protein, 18 aa, Mycobacterium
PTQSSGGDAAKPGSPAKI

SEQ ID NO: 276911 - protein, 7 aa, Mycobacterium
PTQSSSR

SEQ ID NO: 276912 - protein, 4 aa, Mycobacterium
PTRA

SEQ ID NO: 276913 - protein, 13 aa, Mycobacterium
PTRAGEALPEDSV

SEQ ID NO: 276914 - protein, 7 aa, Mycobacterium
PTRGQSA

SEQ ID NO: 276915 - protein, 9 aa, Mycobacterium
PTRGSARGG

SEQ ID NO: 276916 - protein, 4 aa, Mycobacterium
PTRH

SEQ ID NO: 276917 - protein, 5 aa, Mycobacterium
PTRNG

SEQ ID NO: 276918 - protein, 4 aa, Mycobacterium
PTRP

SEQ ID NO: 276919 - protein, 7 aa, Mycobacterium
PTRPAGV

SEQ ID NO: 276920 - protein, 7 aa, Mycobacterium
PTRPPSP

SEQ ID NO: 276921 - protein, 10 aa, Mycobacterium
PTRSSDELAN

SEQ ID NO: 276922 - protein, 6 aa, Mycobacterium
PTRSYG

SEQ ID NO: 276923 - protein, 10 aa, Mycobacterium
PTRTHTGSRQ

SEQ ID NO: 276924 - protein, 9 aa, Mycobacterium
PTRTNRVRD

SEQ ID NO: 276925 - protein, 23 aa, Mycobacterium
PTRTPDAGTPAKESVTPTEAQLA

SEQ ID NO: 276926 - protein, 10 aa, Mycobacterium
PTRTSGKVDR

SEQ ID NO: 276927 - protein, 4 aa, Mycobacterium
PTSA

SEQ ID NO: 276928 - protein, 6 aa, Mycobacterium
PTSDTP

SEQ ID NO: 276929 - protein, 8 aa, Mycobacterium
PTSENGPL

SEQ ID NO: 276930 - protein, 11 aa, Mycobacterium
PTSEPASAALA

SEQ ID NO: 276931 - protein, 9 aa, Mycobacterium
PTSEPLGGA

SEQ ID NO: 276932 - protein, 14 aa, Mycobacterium
PTSGKWADTGNPAR

SEQ ID NO: 276933 - protein, 14 aa, Mycobacterium
PTSGKWADVGNPAR

SEQ ID NO: 276934 - protein, 9 aa, Mycobacterium
PTSGLDPAL

SEQ ID NO: 276935 - protein, 10 aa, Mycobacterium
PTSGLDPGYE

SEQ ID NO: 276936 - protein, 11 aa, Mycobacterium
PTSGLDPSTAA

SEQ ID NO: 276937 - protein, 4 aa, Mycobacterium
PTSN

SEQ ID NO: 276938 - protein, 8 aa, Mycobacterium
PTSNSQKY

SEQ ID NO: 276939 - protein, 9 aa, Mycobacterium
PTSPPGPEL

SEQ ID NO: 276940 - protein, 8 aa, Mycobacterium
PTSPRGPM

SEQ ID NO: 276941 - protein, 6 aa, Mycobacterium
PTSPVG

SEQ ID NO: 276942 - protein, 6 aa, Mycobacterium
PTSSAI

SEQ ID NO: 276943 - protein, 6 aa, Mycobacterium
PTSSYR

SEQ ID NO: 276944 - protein, 5 aa, Mycobacterium
PTSTA

SEQ ID NO: 276945 - protein, 16 aa, Mycobacterium
PTSTAPELVTSVATML

SEQ ID NO: 276946 - protein, 9 aa, Mycobacterium
PTSTDFPPD

SEQ ID NO: 276947 - protein, 6 aa, Mycobacterium
PTSTRY

SEQ ID NO: 276948 - protein, 5 aa, Mycobacterium
PTTAD

SEQ ID NO: 276949 - protein, 9 aa, Mycobacterium
PTTAGRPNA

SEQ ID NO: 276950 - protein, 5 aa, Mycobacterium
PTTAI

SEQ ID NO: 276951 - protein, 42 aa, Mycobacterium
PTTAPAATPAPETGSAEPAHSMSGAPSDATPGSAEERGKHEA

SEQ ID NO: 276952 - protein, 5 aa, Mycobacterium
PTTAR

SEQ ID NO: 276953 - protein, 9 aa, Mycobacterium
PTTARPQPE

SEQ ID NO: 276954 - protein, 5 aa, Mycobacterium
PTTAT

SEQ ID NO: 276955 - protein, 6 aa, Mycobacterium
PTTDLA

SEQ ID NO: 276956 - protein, 16 aa, Mycobacterium
PTTEPGGLAPEAASTL

SEQ ID NO: 276957 - protein, 7 aa, Mycobacterium
PTTGAVS

SEQ ID NO: 276958 - protein, 9 aa, Mycobacterium
PTTGLDPAL

SEQ ID NO: 276959 - protein, 11 aa, Mycobacterium
PTTGPGDRHDK

SEQ ID NO: 276960 - protein, 4 aa, Mycobacterium
PTTH

SEQ ID NO: 276961 - protein, 8 aa, Mycobacterium
PTTHARSA

SEQ ID NO: 276962 - protein, 4 aa, Mycobacterium
PTTI

SEQ ID NO: 276963 - protein, 5 aa, Mycobacterium
PTTKA

SEQ ID NO: 276964 - protein, 10 aa, Mycobacterium
PTTKTREKLA

SEQ ID NO: 276965 - protein, 4 aa, Mycobacterium
PTTL

SEQ ID NO: 276966 - protein, 11 aa, Mycobacterium
PTTLSAAVGSP

SEQ ID NO: 276967 - protein, 10 aa, Mycobacterium
PTTNNGPFLG

SEQ ID NO: 276968 - protein, 12 aa, Mycobacterium
PTTNRDSTKAAL

SEQ ID NO: 276969 - protein, 11 aa, Mycobacterium
PTTNRDSTKRA

SEQ ID NO: 276970 - protein, 11 aa, Mycobacterium
PTTNREATKAA

SEQ ID NO: 276971 - protein, 12 aa, Mycobacterium
PTTNREATKNGL

SEQ ID NO: 276972 - protein, 12 aa, Mycobacterium
PTTNRESTKTAI

SEQ ID NO: 276973 - protein, 5 aa, Mycobacterium
PTTPL

SEQ ID NO: 276974 - protein, 5 aa, Mycobacterium
PTTPQ

SEQ ID NO: 276975 - protein, 5 aa, Mycobacterium
PTTPV

SEQ ID NO: 276976 - protein, 7 aa, Mycobacterium
PTTQARR

SEQ ID NO: 276977 - protein, 27 aa, Mycobacterium
PTTRDRDSAASAITARSETGDIVVNEA

SEQ ID NO: 276978 - protein, 5 aa, Mycobacterium
PTTRS

SEQ ID NO: 276979 - protein, 11 aa, Mycobacterium
PTTRTSSPYSL

SEQ ID NO: 276980 - protein, 9 aa, Mycobacterium
PTTTQARHA

SEQ ID NO: 276981 - protein, 5 aa, Mycobacterium
PTTVG

SEQ ID NO: 276982 - protein, 4 aa, Mycobacterium
PTVA

SEQ ID NO: 276983 - protein, 13 aa, Mycobacterium
PTVDQRPAPAQGA

SEQ ID NO: 276984 - protein, 10 aa, Mycobacterium
PTVPADQPNM

SEQ ID NO: 276985 - protein, 4 aa, Mycobacterium
PTVQ

SEQ ID NO: 276986 - protein, 8 aa, Mycobacterium
PTVQPKNC

SEQ ID NO: 276987 - protein, 4 aa, Mycobacterium
PTVR

SEQ ID NO: 276988 - protein, 12 aa, Mycobacterium
PTYADPGQSLLP

SEQ ID NO: 276989 - protein, 6 aa, Mycobacterium
PTYDES

SEQ ID NO: 276990 - protein, 6 aa, Mycobacterium
PTYSNG

SEQ ID NO: 276991 - protein, 5 aa, Mycobacterium
PVAAG

SEQ ID NO: 276992 - protein, 11 aa, Mycobacterium
PVAAGNEKIGD

SEQ ID NO: 276993 - protein, 6 aa, Mycobacterium
PVADGD

SEQ ID NO: 276994 - protein, 7 aa, Mycobacterium
PVADTPG

SEQ ID NO: 276995 - protein, 4 aa, Mycobacterium
PVAE

SEQ ID NO: 276996 - protein, 6 aa, Mycobacterium
PVAEGQ

SEQ ID NO: 276997 - protein, 11 aa, Mycobacterium
PVAERSDQRRR

SEQ ID NO: 276998 - protein, 8 aa, Mycobacterium
PVAETQRQ

SEQ ID NO: 276999 - protein, 9 aa, Mycobacterium
PVAGAQPGA

SEQ ID NO: 277000 - protein, 10 aa, Mycobacterium
PVAGRDDAAL

SEQ ID NO: 277001 - protein, 9 aa, Mycobacterium
PVAKGNERI

SEQ ID NO: 277002 - protein, 10 aa, Mycobacterium
PVAKGRGDEV

SEQ ID NO: 277003 - protein, 13 aa, Mycobacterium
PVAPPAAEPSRSR

SEQ ID NO: 277004 - protein, 8 aa, Mycobacterium
PVAPPLTP

SEQ ID NO: 277005 - protein, 14 aa, Mycobacterium
PVAPRAAAGEPGVT

SEQ ID NO: 277006 - protein, 4 aa, Mycobacterium
PVAR

SEQ ID NO: 277007 - protein, 5 aa, Mycobacterium
PVARE

SEQ ID NO: 277008 - protein, 30 aa, Mycobacterium
PVARETDYGRVDQHSSAIRAPGDARRTYNR

SEQ ID NO: 277009 - protein, 5 aa, Mycobacterium
PVARP

SEQ ID NO: 277010 - protein, 8 aa, Mycobacterium
PVARPNRE

SEQ ID NO: 277011 - protein, 5 aa, Mycobacterium
PVAST

SEQ ID NO: 277012 - protein, 13 aa, Mycobacterium
PVATGDDQSGQRS

SEQ ID NO: 277013 - protein, 12 aa, Mycobacterium
PVATGNEKIGDL

SEQ ID NO: 277014 - protein, 10 aa, Mycobacterium
PVATSDSDEY

SEQ ID NO: 277015 - protein, 27 aa, Mycobacterium
PVAVGPPRRGLSRAERARKARNDRKRR

SEQ ID NO: 277016 - protein, 13 aa, Mycobacterium
PVCNTDPACAAAR

SEQ ID NO: 277017 - protein, 13 aa, Mycobacterium
PVDANPAELEVPK

SEQ ID NO: 277018 - protein, 19 aa, Mycobacterium
PVDDSAPPTLARRPQPAAV

SEQ ID NO: 277019 - protein, 9 aa, Mycobacterium
PVDDTAGLT

SEQ ID NO: 277020 - protein, 5 aa, Mycobacterium
PVDEE

SEQ ID NO: 277021 - protein, 9 aa, Mycobacterium
PVDEGGATR

SEQ ID NO: 277022 - protein, 7 aa, Mycobacterium
PVDGPEA

SEQ ID NO: 277023 - protein, 26 aa, Mycobacterium
PVDPDFSEPATRHTAGVGASGRGAGQ

SEQ ID NO: 277024 - protein, 15 aa, Mycobacterium
PVDPEADTYETAGQL

SEQ ID NO: 277025 - protein, 8 aa, Mycobacterium
PVDPKNSH

SEQ ID NO: 277026 - protein, 7 aa, Mycobacterium
PVDRSDH

SEQ ID NO: 277027 - protein, 5 aa, Mycobacterium
PVDSF

SEQ ID NO: 277028 - protein, 17 aa, Mycobacterium
PVEAPSDATTGGAGPDL

SEQ ID NO: 277029 - protein, 10 aa, Mycobacterium
PVEGDATSTF

SEQ ID NO: 277030 - protein, 18 aa, Mycobacterium
PVEGSGVPAIDPPPTDTV

SEQ ID NO: 277031 - protein, 14 aa, Mycobacterium
PVEGTKAEKRAERG

SEQ ID NO: 277032 - protein, 4 aa, Mycobacterium
PVEN

SEQ ID NO: 277033 - protein, 35 aa, Mycobacterium
PVEPATQKAAPQKAAKSTAKKATGRRAGSAELRST

SEQ ID NO: 277034 - protein, 14 aa, Mycobacterium
PVEPGPAAEGEPTA

SEQ ID NO: 277035 - protein, 14 aa, Mycobacterium
PVEPGPAAEGEPTP

SEQ ID NO: 277036 - protein, 12 aa, Mycobacterium
PVEPPNDDDEGH

SEQ ID NO: 277037 - protein, 14 aa, Mycobacterium
PVEQEQEKAPEFEA

SEQ ID NO: 277038 - protein, 6 aa, Mycobacterium
PVERGV

SEQ ID NO: 277039 - protein, 7 aa, Mycobacterium
PVERGVA

SEQ ID NO: 277040 - protein, 4 aa, Mycobacterium
PVES

SEQ ID NO: 277041 - protein, 10 aa, Mycobacterium
PVGASAADTV

SEQ ID NO: 277042 - protein, 8 aa, Mycobacterium
PVGATTSS

SEQ ID NO: 277043 - protein, 7 aa, Mycobacterium
PVGDPTE

SEQ ID NO: 277044 - protein, 9 aa, Mycobacterium
PVGEPPTHT

SEQ ID NO: 277045 - protein, 16 aa, Mycobacterium
PVGESTAADESTWEPT

SEQ ID NO: 277046 - protein, 6 aa, Mycobacterium
PVGETQ

SEQ ID NO: 277047 - protein, 5 aa, Mycobacterium
PVGGM

SEQ ID NO: 277048 - protein, 9 aa, Mycobacterium
PVGGSSADV

SEQ ID NO: 277049 - protein, 7 aa, Mycobacterium
PVGGVST

SEQ ID NO: 277050 - protein, 10 aa, Mycobacterium
PVGHGAPAAA

SEQ ID NO: 277051 - protein, 26 aa, Mycobacterium
PVGPDGQPSEQAVSDSAVSETWGGQI

SEQ ID NO: 277052 - protein, 5 aa, Mycobacterium
PVGQD

SEQ ID NO: 277053 - protein, 5 aa, Mycobacterium
PVGQG

SEQ ID NO: 277054 - protein, 11 aa, Mycobacterium
PVGRGPAAPPL

SEQ ID NO: 277055 - protein, 7 aa, Mycobacterium
PVGRPRV

SEQ ID NO: 277056 - protein, 15 aa, Mycobacterium
PVGRSDSETKGASEG

SEQ ID NO: 277057 - protein, 10 aa, Mycobacterium
PVGRSPSHTV

SEQ ID NO: 277058 - protein, 5 aa, Mycobacterium
PVGSA

SEQ ID NO: 277059 - protein, 26 aa, Mycobacterium
PVGSAPAAEPAAGGSRPSVTSGAPFA

SEQ ID NO: 277060 - protein, 8 aa, Mycobacterium
PVGSESRA

SEQ ID NO: 277061 - protein, 7 aa, Mycobacterium
PVGTGVD

SEQ ID NO: 277062 - protein, 21 aa, Mycobacterium
PVGTGVDQAMQKSQSAQNQQW

SEQ ID NO: 277063 - protein, 13 aa, Mycobacterium
PVGTPPLSSRRRR

SEQ ID NO: 277064 - protein, 10 aa, Mycobacterium
PVGTRYSGTG

SEQ ID NO: 277065 - protein, 14 aa, Mycobacterium
PVHDARSTASEDAA

SEQ ID NO: 277066 - protein, 13 aa, Mycobacterium
PVIPQGGSVPGYA

SEQ ID NO: 277067 - protein, 5 aa, Mycobacterium
PVISP

SEQ ID NO: 277068 - protein, 7 aa, Mycobacterium
PVKAPAF

SEQ ID NO: 277069 - protein, 7 aa, Mycobacterium
PVKGQHR

SEQ ID NO: 277070 - protein, 7 aa, Mycobacterium
PVKPGRG

SEQ ID NO: 277071 - protein, 8 aa, Mycobacterium
PVKPNGEK

SEQ ID NO: 277072 - protein, 5 aa, Mycobacterium
PVKPR

SEQ ID NO: 277073 - protein, 12 aa, Mycobacterium
PVKPTEQATQRM

SEQ ID NO: 277074 - protein, 4 aa, Mycobacterium
PVKT

SEQ ID NO: 277075 - protein, 12 aa, Mycobacterium
PVLDTQTDTAGA

SEQ ID NO: 277076 - protein, 42 aa, Mycobacterium
PVMEQPGADNFADTDGSADDTSGEAGTEGGTTVAAGVNGSRA

SEQ ID NO: 277077 - protein, 10 aa, Mycobacterium
PVMERPGDRS

SEQ ID NO: 277078 - protein, 5 aa, Mycobacterium
PVNAN

SEQ ID NO: 277079 - protein, 7 aa, Mycobacterium
PVNEAAR

SEQ ID NO: 277080 - protein, 4 aa, Mycobacterium
PVNK

SEQ ID NO: 277081 - protein, 16 aa, Mycobacterium
PVNPATVKSSELDRFP

SEQ ID NO: 277082 - protein, 9 aa, Mycobacterium
PVNTPANAG

SEQ ID NO: 277083 - protein, 8 aa, Mycobacterium
PVPAERPG

SEQ ID NO: 277084 - protein, 9 aa, Mycobacterium
PVPAGAPGE

SEQ ID NO: 277085 - protein, 12 aa, Mycobacterium
PVPAGPPDADSV

SEQ ID NO: 277086 - protein, 16 aa, Mycobacterium
PVPAPAGESASGQNHH

SEQ ID NO: 277087 - protein, 11 aa, Mycobacterium
PVPAPATADPG

SEQ ID NO: 277088 - protein, 15 aa, Mycobacterium
PVPATSAARPDNESP

SEQ ID NO: 277089 - protein, 11 aa, Mycobacterium
PVPAVPSTLDG

SEQ ID NO: 277090 - protein, 4 aa, Mycobacterium
PVPD

SEQ ID NO: 277091 - protein, 6 aa, Mycobacterium
PVPDDP

SEQ ID NO: 277092 - protein, 15 aa, Mycobacterium
PVPDPAAPPPSSPGV

SEQ ID NO: 277093 - protein, 4 aa, Mycobacterium
PVPE

SEQ ID NO: 277094 - protein, 31 aa, Mycobacterium
PVPERGRGALGARRRDPDRPRRRFGSDNRTL

SEQ ID NO: 277095 - protein, 4 aa, Mycobacterium
PVPG

SEQ ID NO: 277096 - protein, 9 aa, Mycobacterium
PVPGDTGGA

SEQ ID NO: 277097 - protein, 10 aa, Mycobacterium
PVPGETVDNE

SEQ ID NO: 277098 - protein, 5 aa, Mycobacterium
PVPGF

SEQ ID NO: 277099 - protein, 37 aa, Mycobacterium
PVPGQPPALGSSVATGSTPKPAPPRPGGGPVKPKAGA

SEQ ID NO: 277100 - protein, 7 aa, Mycobacterium
PVPGQPV

SEQ ID NO: 277101 - protein, 19 aa, Mycobacterium
PVPGRTANELAADAGRELP

SEQ ID NO: 277102 - protein, 20 aa, Mycobacterium
PVPGRTATELARTAGRTLPA

SEQ ID NO: 277103 - protein, 9 aa, Mycobacterium
PVPGSEVPH

SEQ ID NO: 277104 - protein, 18 aa, Mycobacterium
PVPGSPPPGFTPARPRRL

SEQ ID NO: 277105 - protein, 4 aa, Mycobacterium
PVPP

SEQ ID NO: 277106 - protein, 17 aa, Mycobacterium
PVPPADPATGPAPPAEA

SEQ ID NO: 277107 - protein, 8 aa, Mycobacterium
PVPPAKRS

SEQ ID NO: 277108 - protein, 17 aa, Mycobacterium
PVPPAPAPAPAGSAGRR

SEQ ID NO: 277109 - protein, 5 aa, Mycobacterium
PVPPP

SEQ ID NO: 277110 - protein, 7 aa, Mycobacterium
PVPPPGF

SEQ ID NO: 277111 - protein, 8 aa, Mycobacterium
PVPPPGPQ

SEQ ID NO: 277112 - protein, 6 aa, Mycobacterium
PVPPQT

SEQ ID NO: 277113 - protein, 8 aa, Mycobacterium
PVPPQTQT

SEQ ID NO: 277114 - protein, 6 aa, Mycobacterium
PVPPQW

SEQ ID NO: 277115 - protein, 12 aa, Mycobacterium
PVPPSLSEGENR

SEQ ID NO: 277116 - protein, 4 aa, Mycobacterium
PVPQ

SEQ ID NO: 277117 - protein, 46 aa, Mycobacterium
PVPQNGSQAALPRRGGSPSRPLAPTPAGRRELPPGRADVPPARGDV

SEQ ID NO: 277118 - protein, 4 aa, Mycobacterium
PVPR

SEQ ID NO: 277119 - protein, 12 aa, Mycobacterium
PVPRGMHHRCGQ

SEQ ID NO: 277120 - protein, 5 aa, Mycobacterium
PVPRR

SEQ ID NO: 277121 - protein, 18 aa, Mycobacterium
PVPRSDAKDTSTAKGGEM

SEQ ID NO: 277122 - protein, 7 aa, Mycobacterium
PVPRVAP

SEQ ID NO: 277123 - protein, 5 aa, Mycobacterium
PVPSG

SEQ ID NO: 277124 - protein, 4 aa, Mycobacterium
PVPT

SEQ ID NO: 277125 - protein, 11 aa, Mycobacterium
PVPTGPAAPGI

SEQ ID NO: 277126 - protein, 13 aa, Mycobacterium
PVPTPPRRDDDEK

SEQ ID NO: 277127 - protein, 6 aa, Mycobacterium
PVPTRP

SEQ ID NO: 277128 - protein, 12 aa, Mycobacterium
PVPVPQAPAPVP

SEQ ID NO: 277129 - protein, 10 aa, Mycobacterium
PVQDREPAAP

SEQ ID NO: 277130 - protein, 10 aa, Mycobacterium
PVQPPAQYNP

SEQ ID NO: 277131 - protein, 9 aa, Mycobacterium
PVQQDSSSL

SEQ ID NO: 277132 - protein, 5 aa, Mycobacterium
PVQQG

SEQ ID NO: 277133 - protein, 12 aa, Mycobacterium
PVQTAPPTTPLK

SEQ ID NO: 277134 - protein, 5 aa, Mycobacterium
PVQTH

SEQ ID NO: 277135 - protein, 9 aa, Mycobacterium
PVRAGRGGA

SEQ ID NO: 277136 - protein, 10 aa, Mycobacterium
PVRDGDIAPP

SEQ ID NO: 277137 - protein, 17 aa, Mycobacterium
PVRGAAEGAETEPPPPA

SEQ ID NO: 277138 - protein, 7 aa, Mycobacterium
PVRGTPL

SEQ ID NO: 277139 - protein, 8 aa, Mycobacterium
PVRGTPVR

SEQ ID NO: 277140 - protein, 8 aa, Mycobacterium
PVRHQDSQ

SEQ ID NO: 277141 - protein, 4 aa, Mycobacterium
PVRI

SEQ ID NO: 277142 - protein, 6 aa, Mycobacterium
PVRKTQ

SEQ ID NO: 277143 - protein, 6 aa, Mycobacterium
PVRRGD

SEQ ID NO: 277144 - protein, 5 aa, Mycobacterium
PVRRT

SEQ ID NO: 277145 - protein, 16 aa, Mycobacterium
PVRTGGMTPYVVRIIE

SEQ ID NO: 277146 - protein, 6 aa, Mycobacterium
PVRTPG

SEQ ID NO: 277147 - protein, 18 aa, Mycobacterium
PVSDEASKLAGQGQSGSI

SEQ ID NO: 277148 - protein, 17 aa, Mycobacterium
PVSEDESEDEDNELTDI

SEQ ID NO: 277149 - protein, 12 aa, Mycobacterium
PVSETAAANGIN

SEQ ID NO: 277150 - protein, 4 aa, Mycobacterium
PVSG

SEQ ID NO: 277151 - protein, 8 aa, Mycobacterium
PVSGANER

SEQ ID NO: 277152 - protein, 8 aa, Mycobacterium
PVSGANNR

SEQ ID NO: 277153 - protein, 8 aa, Mycobacterium
PVSGTGER

SEQ ID NO: 277154 - protein, 7 aa, Mycobacterium
PVSNEAH

SEQ ID NO: 277155 - protein, 6 aa, Mycobacterium
PVSPAD

SEQ ID NO: 277156 - protein, 4 aa, Mycobacterium
PVSR

SEQ ID NO: 277157 - protein, 21 aa, Mycobacterium
PVSRDSGKRTGRLHTPKRYSR

SEQ ID NO: 277158 - protein, 6 aa, Mycobacterium
PVSRQQ

SEQ ID NO: 277159 - protein, 12 aa, Mycobacterium
PVTASQAVSQDR

SEQ ID NO: 277160 - protein, 6 aa, Mycobacterium
PVTDGG

SEQ ID NO: 277161 - protein, 13 aa, Mycobacterium
PVTEAGAESSDGK

SEQ ID NO: 277162 - protein, 10 aa, Mycobacterium
PVTEREPVPP

SEQ ID NO: 277163 - protein, 8 aa, Mycobacterium
PVTGLPDG

SEQ ID NO: 277164 - protein, 15 aa, Mycobacterium
PVTGQPLSDKSKTIA

SEQ ID NO: 277165 - protein, 13 aa, Mycobacterium
PVTGRDKRPTITR

SEQ ID NO: 277166 - protein, 14 aa, Mycobacterium
PVTGRQLPEPDPDA

SEQ ID NO: 277167 - protein, 10 aa, Mycobacterium
PVTNGGTQVH

SEQ ID NO: 277168 - protein, 5 aa, Mycobacterium
PVTNQ

SEQ ID NO: 277169 - protein, 9 aa, Mycobacterium
PVTQGLNPH

SEQ ID NO: 277170 - protein, 6 aa, Mycobacterium
PVTRNR

SEQ ID NO: 277171 - protein, 14 aa, Mycobacterium
PVTSKAAESSDGKA

SEQ ID NO: 277172 - protein, 4 aa, Mycobacterium
PVTT

SEQ ID NO: 277173 - protein, 7 aa, Mycobacterium
PVTTAAR

SEQ ID NO: 277174 - protein, 64 aa, Mycobacterium
PVTTTTAPPPPPSATSPAKPSTTTVTSTPAQETPTAEPSTEAPPPEPPPSNPMLPPEGQRPITP

SEQ ID NO: 277175 - protein, 6 aa, Mycobacterium
PVVEGT

SEQ ID NO: 277176 - protein, 10 aa, Mycobacterium
PVYSTDPEEA

SEQ ID NO: 277177 - protein, 11 aa, Mycobacterium
PWDTPQPPPDM

SEQ ID NO: 277178 - protein, 18 aa, Mycobacterium
PWDTPRPAPGMVSTDGKS

SEQ ID NO: 277179 - protein, 4 aa, Mycobacterium
PWEG

SEQ ID NO: 277180 - protein, 5 aa, Mycobacterium
PWGPD

SEQ ID NO: 277181 - protein, 4 aa, Mycobacterium
PWGR

SEQ ID NO: 277182 - protein, 4 aa, Mycobacterium
PWPA

SEQ ID NO: 277183 - protein, 6 aa, Mycobacterium
PWPAEV

SEQ ID NO: 277184 - protein, 22 aa, Mycobacterium
PWPDLTSPGWSPAENPQWWRGR

SEQ ID NO: 277185 - protein, 11 aa, Mycobacterium
PWPDQRPPRRG

SEQ ID NO: 277186 - protein, 7 aa, Mycobacterium
PWPEPGD

SEQ ID NO: 277187 - protein, 8 aa, Mycobacterium
PWPEPGDE

SEQ ID NO: 277188 - protein, 16 aa, Mycobacterium
PWPGAEPQPVPTTSTA

SEQ ID NO: 277189 - protein, 154 aa, Mycobacterium
PWPGQQPEPGRDQPAGGEAWQPPTGGTEEPTTHNPAWQPPAYTQQPQPQYPQYQPPAQPGYGQPQQGYPSPEQFGQQPPYGQQPQYGQPGQYGQPSQPGQYGQPGQYPQPGQYGQQPQYGQPGQYGQPGQPGQYGQPGQFGPYTPPGSADGSKK

SEQ ID NO: 277190 - protein, 6 aa, Mycobacterium
PWPHSD

SEQ ID NO: 277191 - protein, 15 aa, Mycobacterium
PWPPPDGTDQDAPEL

SEQ ID NO: 277192 - protein, 18 aa, Mycobacterium
PWPPPGAGADDEAPELGG

SEQ ID NO: 277193 - protein, 20 aa, Mycobacterium
PWPPPGSSDTEETPDLAGTT

SEQ ID NO: 277194 - protein, 11 aa, Mycobacterium
PWPQDHQKRSY

SEQ ID NO: 277195 - protein, 4 aa, Mycobacterium
PWPT

SEQ ID NO: 277196 - protein, 6 aa, Mycobacterium
PWPTPD

SEQ ID NO: 277197 - protein, 6 aa, Mycobacterium
PWQTTT

SEQ ID NO: 277198 - protein, 10 aa, Mycobacterium
PWRDPNARSH

SEQ ID NO: 277199 - protein, 7 aa, Mycobacterium
PWSAGYD

SEQ ID NO: 277200 - protein, 135 aa, Mycobacterium
PWSGQQPEQGTDQPAGDAAANQGWQPPSTEQPAWQPPAYQPQQYPQYQQPTQPPTYSPQQYPPGDQYGQPQTGEYNPAAYPPPGQYGQQPGYGQYGQQPQYGQPGQYGQQPGQYGQYPGAPGYPGQGGDEGSKRS

SEQ ID NO: 277201 - protein, 4 aa, Mycobacterium
PWSR

SEQ ID NO: 277202 - protein, 16 aa, Mycobacterium
PWSSAGPAPKRGLGSY

SEQ ID NO: 277203 - protein, 16 aa, Mycobacterium
PWTAPQPGLVSGDGKS

SEQ ID NO: 277204 - protein, 20 aa, Mycobacterium
PWTGPAPASGDLVSTDGKSG

SEQ ID NO: 277205 - protein, 23 aa, Mycobacterium
PWTGPSADPKSAPDLVSKDGKSG

SEQ ID NO: 277206 - protein, 16 aa, Mycobacterium
PWTSRRDSHPDAEPSI

SEQ ID NO: 277207 - protein, 5 aa, Mycobacterium
PWYGD

SEQ ID NO: 277208 - protein, 16 aa, Mycobacterium
PYAAPPQRRQSDGGRL

SEQ ID NO: 277209 - protein, 13 aa, Mycobacterium
PYAETETEPSGVK

SEQ ID NO: 277210 - protein, 23 aa, Mycobacterium
PYARTGLDPQRARKTARTSPHRR

SEQ ID NO: 277211 - protein, 13 aa, Mycobacterium
PYDPTNSGAVPSG

SEQ ID NO: 277212 - protein, 9 aa, Mycobacterium
PYDRAPDLA

SEQ ID NO: 277213 - protein, 7 aa, Mycobacterium
PYEQRRD

SEQ ID NO: 277214 - protein, 10 aa, Mycobacterium
PYGNASTGWS

SEQ ID NO: 277215 - protein, 5 aa, Mycobacterium
PYGPR

SEQ ID NO: 277216 - protein, 7 aa, Mycobacterium
PYGPRSA

SEQ ID NO: 277217 - protein, 7 aa, Mycobacterium
PYGQPAS

SEQ ID NO: 277218 - protein, 14 aa, Mycobacterium
PYGQPGPNPQFPPS

SEQ ID NO: 277219 - protein, 8 aa, Mycobacterium
PYGSDPNE

SEQ ID NO: 277220 - protein, 6 aa, Mycobacterium
PYGSGG

SEQ ID NO: 277221 - protein, 6 aa, Mycobacterium
PYGSRR

SEQ ID NO: 277222 - protein, 8 aa, Mycobacterium
PYHTPDGT

SEQ ID NO: 277223 - protein, 4 aa, Mycobacterium
PYHY

SEQ ID NO: 277224 - protein, 14 aa, Mycobacterium
PYKPSQVAAGSPPD

SEQ ID NO: 277225 - protein, 13 aa, Mycobacterium
PYNPSQVSAGSQP

SEQ ID NO: 277226 - protein, 9 aa, Mycobacterium
PYNRGTACD

SEQ ID NO: 277227 - protein, 4 aa, Mycobacterium
PYNT

SEQ ID NO: 277228 - protein, 8 aa, Mycobacterium
PYPAPANR

SEQ ID NO: 277229 - protein, 8 aa, Mycobacterium
PYPAPARR

SEQ ID NO: 277230 - protein, 5 aa, Mycobacterium
PYPDV

SEQ ID NO: 277231 - protein, 5 aa, Mycobacterium
PYPGT

SEQ ID NO: 277232 - protein, 22 aa, Mycobacterium
PYPIPGAPVPGAPAGPPVPRPP

SEQ ID NO: 277233 - protein, 4 aa, Mycobacterium
PYPL

SEQ ID NO: 277234 - protein, 13 aa, Mycobacterium
PYPRTGQGGEPRL

SEQ ID NO: 277235 - protein, 4 aa, Mycobacterium
PYPS

SEQ ID NO: 277236 - protein, 6 aa, Mycobacterium
PYPSFG

SEQ ID NO: 277237 - protein, 17 aa, Mycobacterium
PYPSGPAAPPPPNGSRY

SEQ ID NO: 277238 - protein, 10 aa, Mycobacterium
PYQAPEGYPI

SEQ ID NO: 277239 - protein, 15 aa, Mycobacterium
PYQAPYQEARPSRPL

SEQ ID NO: 277240 - protein, 6 aa, Mycobacterium
PYQPQL

SEQ ID NO: 277241 - protein, 20 aa, Mycobacterium
PYQTGADAPFPEVTDPASAA

SEQ ID NO: 277242 - protein, 6 aa, Mycobacterium
PYRASA

SEQ ID NO: 277243 - protein, 4 aa, Mycobacterium
PYRE

SEQ ID NO: 277244 - protein, 7 aa, Mycobacterium
PYRTPGG

SEQ ID NO: 277245 - protein, 14 aa, Mycobacterium
PYSGYEPPEAPESF

SEQ ID NO: 277246 - protein, 6 aa, Mycobacterium
PYSPAR

SEQ ID NO: 277247 - protein, 17 aa, Mycobacterium
PYSPEWNESMGDARRDA

SEQ ID NO: 277248 - protein, 11 aa, Mycobacterium
PYSPTAGDPVD

SEQ ID NO: 277249 - protein, 15 aa, Mycobacterium
PYTAKAAVSTDGEAE

SEQ ID NO: 277250 - protein, 4 aa, Mycobacterium
PYTE

SEQ ID NO: 277251 - protein, 13 aa, Mycobacterium
PYTPSQVSAGSQP

SEQ ID NO: 277252 - protein, 10 aa, Mycobacterium
PYVPSRTEAL

SEQ ID NO: 277253 - protein, 6 aa, Mycobacterium
PYYAPP

SEQ ID NO: 277254 - protein, 9 aa, Mycobacterium
QAAADGAKA

SEQ ID NO: 277255 - protein, 20 aa, Mycobacterium
QAAADPALRDGSPPRARETR

SEQ ID NO: 277256 - protein, 12 aa, Mycobacterium
QAAAGNGEQVKT

SEQ ID NO: 277257 - protein, 9 aa, Mycobacterium
QAAAGTASD

SEQ ID NO: 277258 - protein, 8 aa, Mycobacterium
QAAASPGE

SEQ ID NO: 277259 - protein, 8 aa, Mycobacterium
QAAASRPG

SEQ ID NO: 277260 - protein, 13 aa, Mycobacterium
QAADTLDGNGDSF

SEQ ID NO: 277261 - protein, 13 aa, Mycobacterium
QAADTLNGNGDSF

SEQ ID NO: 277262 - protein, 11 aa, Mycobacterium
QAAEDDGVEQR

SEQ ID NO: 277263 - protein, 14 aa, Mycobacterium
QAAEEALKNTPLEN

SEQ ID NO: 277264 - protein, 9 aa, Mycobacterium
QAAEEGGTN

SEQ ID NO: 277265 - protein, 15 aa, Mycobacterium
QAAEGLGRAGRVAAA

SEQ ID NO: 277266 - protein, 21 aa, Mycobacterium
QAAEGTLAAAERAETAEQKAA

SEQ ID NO: 277267 - protein, 7 aa, Mycobacterium
QAAEPRG

SEQ ID NO: 277268 - protein, 14 aa, Mycobacterium
QAAESASAPAGDVG

SEQ ID NO: 277269 - protein, 10 aa, Mycobacterium
QAAGASGTDT

SEQ ID NO: 277270 - protein, 11 aa, Mycobacterium
QAAGGALAGAD

SEQ ID NO: 277271 - protein, 11 aa, Mycobacterium
QAAGGAVDGAD

SEQ ID NO: 277272 - protein, 13 aa, Mycobacterium
QAAGRLGDSRSDI

SEQ ID NO: 277273 - protein, 24 aa, Mycobacterium
QAAGTAAALAAGQGVSPRAISPSA

SEQ ID NO: 277274 - protein, 10 aa, Mycobacterium
QAAHDSTAIG

SEQ ID NO: 277275 - protein, 14 aa, Mycobacterium
QAAKEAIKGTPLEG

SEQ ID NO: 277276 - protein, 6 aa, Mycobacterium
QAANAT

SEQ ID NO: 277277 - protein, 8 aa, Mycobacterium
QAANGSAV

SEQ ID NO: 277278 - protein, 13 aa, Mycobacterium
QAAPADDGNPHVH

SEQ ID NO: 277279 - protein, 8 aa, Mycobacterium
QAAPANVR

SEQ ID NO: 277280 - protein, 30 aa, Mycobacterium
QAAPAPRFSRTPTGPVEPPPAATTPLDEIN

SEQ ID NO: 277281 - protein, 10 aa, Mycobacterium
QAAPGIPGAV

SEQ ID NO: 277282 - protein, 7 aa, Mycobacterium
QAAPQPV

SEQ ID NO: 277283 - protein, 8 aa, Mycobacterium
QAAPRALP

SEQ ID NO: 277284 - protein, 5 aa, Mycobacterium
QAAPS

SEQ ID NO: 277285 - protein, 8 aa, Mycobacterium
QAAPTADQ

SEQ ID NO: 277286 - protein, 9 aa, Mycobacterium
QAAPTADQI

SEQ ID NO: 277287 - protein, 7 aa, Mycobacterium
QAAQADQ

SEQ ID NO: 277288 - protein, 27 aa, Mycobacterium
QAAQANASRQPAAWQTPPTAADTRGFR

SEQ ID NO: 277289 - protein, 8 aa, Mycobacterium
QAAQDRLS

SEQ ID NO: 277290 - protein, 5 aa, Mycobacterium
QAAQL

SEQ ID NO: 277291 - protein, 4 aa, Mycobacterium
QAAR

SEQ ID NO: 277292 - protein, 15 aa, Mycobacterium
QAARDQRAANPTEAI

SEQ ID NO: 277293 - protein, 5 aa, Mycobacterium
QAART

SEQ ID NO: 277294 - protein, 6 aa, Mycobacterium
QAARTS

SEQ ID NO: 277295 - protein, 11 aa, Mycobacterium
QAASPSSPEMA

SEQ ID NO: 277296 - protein, 5 aa, Mycobacterium
QAATE

SEQ ID NO: 277297 - protein, 14 aa, Mycobacterium
QAATEATKGTPLES

SEQ ID NO: 277298 - protein, 14 aa, Mycobacterium
QAATGENHPDGRAY

SEQ ID NO: 277299 - protein, 9 aa, Mycobacterium
QAATVERAA

SEQ ID NO: 277300 - protein, 6 aa, Mycobacterium
QAATVS

SEQ ID NO: 277301 - protein, 6 aa, Mycobacterium
QADAFG

SEQ ID NO: 277302 - protein, 5 aa, Mycobacterium
QADAV

SEQ ID NO: 277303 - protein, 8 aa, Mycobacterium
QADDPGRV

SEQ ID NO: 277304 - protein, 14 aa, Mycobacterium
QADDQESTAAARAP

SEQ ID NO: 277305 - protein, 5 aa, Mycobacterium
QADDV

SEQ ID NO: 277306 - protein, 9 aa, Mycobacterium
QADGRGPAL

SEQ ID NO: 277307 - protein, 8 aa, Mycobacterium
QADGRTQG

SEQ ID NO: 277308 - protein, 5 aa, Mycobacterium
QADPD

SEQ ID NO: 277309 - protein, 7 aa, Mycobacterium
QADPGLR

SEQ ID NO: 277310 - protein, 6 aa, Mycobacterium
QADPKH

SEQ ID NO: 277311 - protein, 9 aa, Mycobacterium
QADPRARGP

SEQ ID NO: 277312 - protein, 6 aa, Mycobacterium
QADPRV

SEQ ID NO: 277313 - protein, 11 aa, Mycobacterium
QADPTKATGLD

SEQ ID NO: 277314 - protein, 9 aa, Mycobacterium
QADQRPNET

SEQ ID NO: 277315 - protein, 4 aa, Mycobacterium
QADR

SEQ ID NO: 277316 - protein, 5 aa, Mycobacterium
QADRH

SEQ ID NO: 277317 - protein, 10 aa, Mycobacterium
QADRLATTGP

SEQ ID NO: 277318 - protein, 8 aa, Mycobacterium
QADSAQRL

SEQ ID NO: 277319 - protein, 7 aa, Mycobacterium
QADYEEA

SEQ ID NO: 277320 - protein, 6 aa, Mycobacterium
QADYEK

SEQ ID NO: 277321 - protein, 6 aa, Mycobacterium
QADYEQ

SEQ ID NO: 277322 - protein, 7 aa, Mycobacterium
QAEAARS

SEQ ID NO: 277323 - protein, 10 aa, Mycobacterium
QAEADQARAR

SEQ ID NO: 277324 - protein, 9 aa, Mycobacterium
QAEAMSKSG

SEQ ID NO: 277325 - protein, 6 aa, Mycobacterium
QAEDFG

SEQ ID NO: 277326 - protein, 11 aa, Mycobacterium
QAEDGTDSNGV

SEQ ID NO: 277327 - protein, 7 aa, Mycobacterium
QAEDTTK

SEQ ID NO: 277328 - protein, 5 aa, Mycobacterium
QAEDV

SEQ ID NO: 277329 - protein, 12 aa, Mycobacterium
QAEDVDTRYHPS

SEQ ID NO: 277330 - protein, 75 aa, Mycobacterium
QAEEAAKRSSEADAENESVDESETGEPEDAENAEDTEDTEAAEDTEAAEKDSAGKPEAQEAQELPEAKLTTRTNA

SEQ ID NO: 277331 - protein, 8 aa, Mycobacterium
QAEEATDK

SEQ ID NO: 277332 - protein, 10 aa, Mycobacterium
QAEEGPGAVT

SEQ ID NO: 277333 - protein, 6 aa, Mycobacterium
QAEETL

SEQ ID NO: 277334 - protein, 11 aa, Mycobacterium
QAEEWPPPPTE

SEQ ID NO: 277335 - protein, 4 aa, Mycobacterium
QAEG

SEQ ID NO: 277336 - protein, 9 aa, Mycobacterium
QAEGGRGGD

SEQ ID NO: 277337 - protein, 5 aa, Mycobacterium
QAEGK

SEQ ID NO: 277338 - protein, 8 aa, Mycobacterium
QAEGQTGA

SEQ ID NO: 277339 - protein, 6 aa, Mycobacterium
QAEHPG

SEQ ID NO: 277340 - protein, 6 aa, Mycobacterium
QAEHRS

SEQ ID NO: 277341 - protein, 10 aa, Mycobacterium
QAEPAAPAAR

SEQ ID NO: 277342 - protein, 8 aa, Mycobacterium
QAEPADYA

SEQ ID NO: 277343 - protein, 8 aa, Mycobacterium
QAEQVSQT

SEQ ID NO: 277344 - protein, 5 aa, Mycobacterium
QAERA

SEQ ID NO: 277345 - protein, 6 aa, Mycobacterium
QAERSA

SEQ ID NO: 277346 - protein, 11 aa, Mycobacterium
QAERSRDAERR

SEQ ID NO: 277347 - protein, 12 aa, Mycobacterium
QAERSSDPARRE

SEQ ID NO: 277348 - protein, 6 aa, Mycobacterium
QAETEL

SEQ ID NO: 277349 - protein, 7 aa, Mycobacterium
QAETPCH

SEQ ID NO: 277350 - protein, 24 aa, Mycobacterium
QAETPEPVAQSPVAATPRGSWRAQ

SEQ ID NO: 277351 - protein, 9 aa, Mycobacterium
QAETVPRER

SEQ ID NO: 277352 - protein, 5 aa, Mycobacterium
QAEVE

SEQ ID NO: 277353 - protein, 19 aa, Mycobacterium
QAEVQPDDGQGAGDPDAEH

SEQ ID NO: 277354 - protein, 11 aa, Mycobacterium
QAEWGEQQVPA

SEQ ID NO: 277355 - protein, 6 aa, Mycobacterium
QAEYPG

SEQ ID NO: 277356 - protein, 14 aa, Mycobacterium
QAFPPEPSKAQEFS

SEQ ID NO: 277357 - protein, 8 aa, Mycobacterium
QAFPTDTR

SEQ ID NO: 277358 - protein, 12 aa, Mycobacterium
QAFRPEPEPPLE

SEQ ID NO: 277359 - protein, 4 aa, Mycobacterium
QAGA

SEQ ID NO: 277360 - protein, 7 aa, Mycobacterium
QAGAAGK

SEQ ID NO: 277361 - protein, 8 aa, Mycobacterium
QAGAENAP

SEQ ID NO: 277362 - protein, 8 aa, Mycobacterium
QAGAESAP

SEQ ID NO: 277363 - protein, 8 aa, Mycobacterium
QAGAETAP

SEQ ID NO: 277364 - protein, 9 aa, Mycobacterium
QAGASSLNR

SEQ ID NO: 277365 - protein, 8 aa, Mycobacterium
QAGASTLE

SEQ ID NO: 277366 - protein, 8 aa, Mycobacterium
QAGASTLQ

SEQ ID NO: 277367 - protein, 8 aa, Mycobacterium
QAGDGLPT

SEQ ID NO: 277368 - protein, 8 aa, Mycobacterium
QAGDGLSD

SEQ ID NO: 277369 - protein, 9 aa, Mycobacterium
QAGDGLSDC

SEQ ID NO: 277370 - protein, 5 aa, Mycobacterium
QAGEL

SEQ ID NO: 277371 - protein, 19 aa, Mycobacterium
QAGELQPPVPTRGSFAPAD

SEQ ID NO: 277372 - protein, 4 aa, Mycobacterium
QAGF

SEQ ID NO: 277373 - protein, 6 aa, Mycobacterium
QAGGAA

SEQ ID NO: 277374 - protein, 6 aa, Mycobacterium
QAGGFS

SEQ ID NO: 277375 - protein, 34 aa, Mycobacterium
QAGGGANNASGAGSSVGAGITPPAQTAPAPPGYR

SEQ ID NO: 277376 - protein, 8 aa, Mycobacterium
QAGGKMSA

SEQ ID NO: 277377 - protein, 5 aa, Mycobacterium
QAGGL

SEQ ID NO: 277378 - protein, 13 aa, Mycobacterium
QAGGLRPPKPAFR

SEQ ID NO: 277379 - protein, 11 aa, Mycobacterium
QAGGLYPGGNV

SEQ ID NO: 277380 - protein, 6 aa, Mycobacterium
QAGGPV

SEQ ID NO: 277381 - protein, 5 aa, Mycobacterium
QAGGV

SEQ ID NO: 277382 - protein, 5 aa, Mycobacterium
QAGHP

SEQ ID NO: 277383 - protein, 8 aa, Mycobacterium
QAGISDDE

SEQ ID NO: 277384 - protein, 8 aa, Mycobacterium
QAGISGDE

SEQ ID NO: 277385 - protein, 4 aa, Mycobacterium
QAGK

SEQ ID NO: 277386 - protein, 7 aa, Mycobacterium
QAGNSGL

SEQ ID NO: 277387 - protein, 29 aa, Mycobacterium
QAGPAGQAAAGETPSDTAASGQPQQGAPI

SEQ ID NO: 277388 - protein, 6 aa, Mycobacterium
QAGPAV

SEQ ID NO: 277389 - protein, 12 aa, Mycobacterium
QAGQSDGAQAPA

SEQ ID NO: 277390 - protein, 10 aa, Mycobacterium
QAGRDVQGSA

SEQ ID NO: 277391 - protein, 14 aa, Mycobacterium
QAGRGSAKQYGGTG

SEQ ID NO: 277392 - protein, 4 aa, Mycobacterium
QAGS

SEQ ID NO: 277393 - protein, 9 aa, Mycobacterium
QAGSDAPRK

SEQ ID NO: 277394 - protein, 11 aa, Mycobacterium
QAGSRLGYQES

SEQ ID NO: 277395 - protein, 5 aa, Mycobacterium
QAGVP

SEQ ID NO: 277396 - protein, 8 aa, Mycobacterium
QAGVPGGN

SEQ ID NO: 277397 - protein, 6 aa, Mycobacterium
QAGVSA

SEQ ID NO: 277398 - protein, 14 aa, Mycobacterium
QAHPAPGRLTGPQP

SEQ ID NO: 277399 - protein, 6 aa, Mycobacterium
QAHQTG

SEQ ID NO: 277400 - protein, 7 aa, Mycobacterium
QAHRQSA

SEQ ID NO: 277401 - protein, 6 aa, Mycobacterium
QAHTDD

SEQ ID NO: 277402 - protein, 8 aa, Mycobacterium
QAHTTDSI

SEQ ID NO: 277403 - protein, 7 aa, Mycobacterium
QAIDPER

SEQ ID NO: 277404 - protein, 8 aa, Mycobacterium
QAIDPGRT

SEQ ID NO: 277405 - protein, 9 aa, Mycobacterium
QAIDSSDPA

SEQ ID NO: 277406 - protein, 9 aa, Mycobacterium
QAIKGTPLE

SEQ ID NO: 277407 - protein, 6 aa, Mycobacterium
QAIPGD

SEQ ID NO: 277408 - protein, 8 aa, Mycobacterium
QAIPGDGD

SEQ ID NO: 277409 - protein, 11 aa, Mycobacterium
QAIPNDKSWAD

SEQ ID NO: 277410 - protein, 8 aa, Mycobacterium
QAKAEALQ

SEQ ID NO: 277411 - protein, 5 aa, Mycobacterium
QAKEQ

SEQ ID NO: 277412 - protein, 12 aa, Mycobacterium
QAKLTSGAISTA

SEQ ID NO: 277413 - protein, 16 aa, Mycobacterium
QAKPDAGASPRKGPNW

SEQ ID NO: 277414 - protein, 13 aa, Mycobacterium
QALGQDASPSSDV

SEQ ID NO: 277415 - protein, 4 aa, Mycobacterium
QALP

SEQ ID NO: 277416 - protein, 7 aa, Mycobacterium
QALPPGR

SEQ ID NO: 277417 - protein, 14 aa, Mycobacterium
QALPPVQPDTDTYV

SEQ ID NO: 277418 - protein, 4 aa, Mycobacterium
QALR

SEQ ID NO: 277419 - protein, 4 aa, Mycobacterium
QALS

SEQ ID NO: 277420 - protein, 8 aa, Mycobacterium
QALSGLGD

SEQ ID NO: 277421 - protein, 9 aa, Mycobacterium
QALSGLGDR

SEQ ID NO: 277422 - protein, 6 aa, Mycobacterium
QALTGL

SEQ ID NO: 277423 - protein, 8 aa, Mycobacterium
QAMDPGRT

SEQ ID NO: 277424 - protein, 4 aa, Mycobacterium
QANG

SEQ ID NO: 277425 - protein, 9 aa, Mycobacterium
QANGGGNVE

SEQ ID NO: 277426 - protein, 16 aa, Mycobacterium
QANGGGPTTVRNPDGS

SEQ ID NO: 277427 - protein, 17 aa, Mycobacterium
QANGGGPTTVRNPDGSL

SEQ ID NO: 277428 - protein, 18 aa, Mycobacterium
QANGGGPTVPRDDHGAVA

SEQ ID NO: 277429 - protein, 31 aa, Mycobacterium
QANGGGPTVVRNPDGSIATKSLRGDDLGRGG

SEQ ID NO: 277430 - protein, 7 aa, Mycobacterium
QANPNSM

SEQ ID NO: 277431 - protein, 7 aa, Mycobacterium
QANPSPI

SEQ ID NO: 277432 - protein, 10 aa, Mycobacterium
QANSPSSPEL

SEQ ID NO: 277433 - protein, 10 aa, Mycobacterium
QANSPSTPEL

SEQ ID NO: 277434 - protein, 10 aa, Mycobacterium
QANSRGNVEG

SEQ ID NO: 277435 - protein, 6 aa, Mycobacterium
QAPAAV

SEQ ID NO: 277436 - protein, 11 aa, Mycobacterium
QAPADYPDDSI

SEQ ID NO: 277437 - protein, 6 aa, Mycobacterium
QAPAGA

SEQ ID NO: 277438 - protein, 9 aa, Mycobacterium
QAPAGVTED

SEQ ID NO: 277439 - protein, 5 aa, Mycobacterium
QAPAI

SEQ ID NO: 277440 - protein, 22 aa, Mycobacterium
QAPAPAPTQALTPAPRKERSEG

SEQ ID NO: 277441 - protein, 102 aa, Mycobacterium
QAPAYTPPAEYPQYQQPAEQAYPQQYPQQPGYAQPGQYGQPGQYAQPGQYGQPGQYPQPGQYGQPGQYPPPGQYGQYGQYGQPGQYPPQYPPYEQPGKKRPV

SEQ ID NO: 277442 - protein, 13 aa, Mycobacterium
QAPDPQAPFGRDP

SEQ ID NO: 277443 - protein, 29 aa, Mycobacterium
QAPEAQPGRNVAAAPDPLDGTTVARAPTT

SEQ ID NO: 277444 - protein, 9 aa, Mycobacterium
QAPEQFTPK

SEQ ID NO: 277445 - protein, 4 aa, Mycobacterium
QAPG

SEQ ID NO: 277446 - protein, 36 aa, Mycobacterium
QAPGPPPGYGPLPGPPPASAAAPAPAAPLPAEQGAG

SEQ ID NO: 277447 - protein, 7 aa, Mycobacterium
QAPIAAA

SEQ ID NO: 277448 - protein, 9 aa, Mycobacterium
QAPIKTESR

SEQ ID NO: 277449 - protein, 27 aa, Mycobacterium
QAPLPAKSGSAKPKKKEDAVTRTRAAA

SEQ ID NO: 277450 - protein, 4 aa, Mycobacterium
QAPP

SEQ ID NO: 277451 - protein, 33 aa, Mycobacterium
QAPPAGPPPIGMPPKTAVPQSIPPRDSGRPAAL

SEQ ID NO: 277452 - protein, 6 aa, Mycobacterium
QAPPGV

SEQ ID NO: 277453 - protein, 19 aa, Mycobacterium
QAPPLAAPGIPNAGAPAGF

SEQ ID NO: 277454 - protein, 30 aa, Mycobacterium
QAPPPDNGPKKGPDKKGEKGNNGRGNGNKP

SEQ ID NO: 277455 - protein, 17 aa, Mycobacterium
QAPPPPPSTAPPPVSGA

SEQ ID NO: 277456 - protein, 7 aa, Mycobacterium
QAPPSTA

SEQ ID NO: 277457 - protein, 7 aa, Mycobacterium
QAPPVLT

SEQ ID NO: 277458 - protein, 4 aa, Mycobacterium
QAPQ

SEQ ID NO: 277459 - protein, 8 aa, Mycobacterium
QAPQGGPD

SEQ ID NO: 277460 - protein, 8 aa, Mycobacterium
QAPQQAPR

SEQ ID NO: 277461 - protein, 18 aa, Mycobacterium
QAPQVGTPEENAGNNPSG

SEQ ID NO: 277462 - protein, 9 aa, Mycobacterium
QAPRVSRTR

SEQ ID NO: 277463 - protein, 9 aa, Mycobacterium
QAPSDPAAS

SEQ ID NO: 277464 - protein, 10 aa, Mycobacterium
QAPSQRTFEP

SEQ ID NO: 277465 - protein, 14 aa, Mycobacterium
QAPSRPDGSPIAKT

SEQ ID NO: 277466 - protein, 7 aa, Mycobacterium
QAPSVER

SEQ ID NO: 277467 - protein, 4 aa, Mycobacterium
QAQA

SEQ ID NO: 277468 - protein, 9 aa, Mycobacterium
QAQARQGEA

SEQ ID NO: 277469 - protein, 8 aa, Mycobacterium
QAQEGTLA

SEQ ID NO: 277470 - protein, 5 aa, Mycobacterium
QAQGR

SEQ ID NO: 277471 - protein, 13 aa, Mycobacterium
QAQHDAADAAEKL

SEQ ID NO: 277472 - protein, 22 aa, Mycobacterium
QAQHQAKERARDRDSTESSSEE

SEQ ID NO: 277473 - protein, 19 aa, Mycobacterium
QAQPAFPSQASPAADLGEP

SEQ ID NO: 277474 - protein, 14 aa, Mycobacterium
QAQPAPGDKPQKPQ

SEQ ID NO: 277475 - protein, 7 aa, Mycobacterium
QAQPGLS

SEQ ID NO: 277476 - protein, 11 aa, Mycobacterium
QAQRPAPTPLR

SEQ ID NO: 277477 - protein, 8 aa, Mycobacterium
QAQRSGNA

SEQ ID NO: 277478 - protein, 12 aa, Mycobacterium
QAQSKSEGTIAE

SEQ ID NO: 277479 - protein, 18 aa, Mycobacterium
QAQSSAGAPTGAGPAVDA

SEQ ID NO: 277480 - protein, 8 aa, Mycobacterium
QAQTADSI

SEQ ID NO: 277481 - protein, 24 aa, Mycobacterium
QAQTEELQTQEEELRAANEQLTQR

SEQ ID NO: 277482 - protein, 8 aa, Mycobacterium
QAQTRQSV

SEQ ID NO: 277483 - protein, 7 aa, Mycobacterium
QAQTTDS

SEQ ID NO: 277484 - protein, 9 aa, Mycobacterium
QARAERDAE

SEQ ID NO: 277485 - protein, 9 aa, Mycobacterium
QARAETDAA

SEQ ID NO: 277486 - protein, 10 aa, Mycobacterium
QARAETDAAH

SEQ ID NO: 277487 - protein, 9 aa, Mycobacterium
QARAGSAGM

SEQ ID NO: 277488 - protein, 11 aa, Mycobacterium
QARARDDTLAP

SEQ ID NO: 277489 - protein, 8 aa, Mycobacterium
QARARSAN

SEQ ID NO: 277490 - protein, 6 aa, Mycobacterium
QARDIE

SEQ ID NO: 277491 - protein, 12 aa, Mycobacterium
QAREAQKHAREL

SEQ ID NO: 277492 - protein, 5 aa, Mycobacterium
QARET

SEQ ID NO: 277493 - protein, 8 aa, Mycobacterium
QARGGEPG

SEQ ID NO: 277494 - protein, 5 aa, Mycobacterium
QARHT

SEQ ID NO: 277495 - protein, 14 aa, Mycobacterium
QARPGPDQPPQKPQ

SEQ ID NO: 277496 - protein, 19 aa, Mycobacterium
QARPVAGDAFGGSDPGLGE

SEQ ID NO: 277497 - protein, 7 aa, Mycobacterium
QARQAGP

SEQ ID NO: 277498 - protein, 7 aa, Mycobacterium
QARQANP

SEQ ID NO: 277499 - protein, 4 aa, Mycobacterium
QARR

SEQ ID NO: 277500 - protein, 5 aa, Mycobacterium
QARRD

SEQ ID NO: 277501 - protein, 27 aa, Mycobacterium
QARREAKAAAKGKYVEQGKGAGRGKVQ

SEQ ID NO: 277502 - protein, 5 aa, Mycobacterium
QARTG

SEQ ID NO: 277503 - protein, 13 aa, Mycobacterium
QARYTDPSARSFT

SEQ ID NO: 277504 - protein, 6 aa, Mycobacterium
QASAAQ

SEQ ID NO: 277505 - protein, 8 aa, Mycobacterium
QASAVKTT

SEQ ID NO: 277506 - protein, 7 aa, Mycobacterium
QASDTQL

SEQ ID NO: 277507 - protein, 8 aa, Mycobacterium
QASEAQLR

SEQ ID NO: 277508 - protein, 14 aa, Mycobacterium
QASESPAPVAAEVA

SEQ ID NO: 277509 - protein, 4 aa, Mycobacterium
QASG

SEQ ID NO: 277510 - protein, 11 aa, Mycobacterium
QASGGPADGDL

SEQ ID NO: 277511 - protein, 20 aa, Mycobacterium
QASGLGRDLAEQSSVELDRA

SEQ ID NO: 277512 - protein, 16 aa, Mycobacterium
QASGNNDQAAIESAQA

SEQ ID NO: 277513 - protein, 27 aa, Mycobacterium
QASGSLPSAPPAVAAPGRPPAELTTGQ

SEQ ID NO: 277514 - protein, 15 aa, Mycobacterium
QASGSSDQAAIENAQ

SEQ ID NO: 277515 - protein, 5 aa, Mycobacterium
QASNA

SEQ ID NO: 277516 - protein, 24 aa, Mycobacterium
QASPGANDTFENNGATTVDLQPGE

SEQ ID NO: 277517 - protein, 12 aa, Mycobacterium
QASPSDSGDSLL

SEQ ID NO: 277518 - protein, 9 aa, Mycobacterium
QASPTGSSV

SEQ ID NO: 277519 - protein, 4 aa, Mycobacterium
QASS

SEQ ID NO: 277520 - protein, 8 aa, Mycobacterium
QASSARRL

SEQ ID NO: 277521 - protein, 9 aa, Mycobacterium
QASSGEAGQ

SEQ ID NO: 277522 - protein, 16 aa, Mycobacterium
QASSYRDNARAEGRKV

SEQ ID NO: 277523 - protein, 4 aa, Mycobacterium
QAST

SEQ ID NO: 277524 - protein, 14 aa, Mycobacterium
QASTTVSVSAPGAP

SEQ ID NO: 277525 - protein, 4 aa, Mycobacterium
QASV

SEQ ID NO: 277526 - protein, 13 aa, Mycobacterium
QASVDSPKPAGSV

SEQ ID NO: 277527 - protein, 5 aa, Mycobacterium
QATEP

SEQ ID NO: 277528 - protein, 7 aa, Mycobacterium
QATGARS

SEQ ID NO: 277529 - protein, 6 aa, Mycobacterium
QATGDR

SEQ ID NO: 277530 - protein, 8 aa, Mycobacterium
QATGMSST

SEQ ID NO: 277531 - protein, 9 aa, Mycobacterium
QATGSPPAG

SEQ ID NO: 277532 - protein, 6 aa, Mycobacterium
QATGVR

SEQ ID NO: 277533 - protein, 18 aa, Mycobacterium
QATPGLRREDRDQSMPAR

SEQ ID NO: 277534 - protein, 5 aa, Mycobacterium
QATPN

SEQ ID NO: 277535 - protein, 14 aa, Mycobacterium
QATPSGGGGRRRRE

SEQ ID NO: 277536 - protein, 46 aa, Mycobacterium
QATQAAQAAQAAQSASEGTGRGPNGSRGADANPGSHPDYGAPAGWR

SEQ ID NO: 277537 - protein, 4 aa, Mycobacterium
QATR

SEQ ID NO: 277538 - protein, 21 aa, Mycobacterium
QATRADRLSRRHPPAQLCQQA

SEQ ID NO: 277539 - protein, 6 aa, Mycobacterium
QATRDV

SEQ ID NO: 277540 - protein, 18 aa, Mycobacterium
QATSERVDAETTASTQIP

SEQ ID NO: 277541 - protein, 18 aa, Mycobacterium
QATSERVDTETTASTQIP

SEQ ID NO: 277542 - protein, 7 aa, Mycobacterium
QATSRED

SEQ ID NO: 277543 - protein, 23 aa, Mycobacterium
QATTADPATTAAPARKRRPPRTL

SEQ ID NO: 277544 - protein, 7 aa, Mycobacterium
QATTEAM

SEQ ID NO: 277545 - protein, 6 aa, Mycobacterium
QATTEL

SEQ ID NO: 277546 - protein, 9 aa, Mycobacterium
QATTRHGET

SEQ ID NO: 277547 - protein, 94 aa, Mycobacterium
QATTSSETTAGTTSDTTAPSSETTAPSSETTGPSSETTTAPSETTGPAPTTTAPTSAPTTTAPAPSTTPTTSVGQTRSSAAPSTPPSSAPTSTT

SEQ ID NO: 277548 - protein, 13 aa, Mycobacterium
QATTVTGSVTVET

SEQ ID NO: 277549 - protein, 6 aa, Mycobacterium
QAVADT

SEQ ID NO: 277550 - protein, 11 aa, Mycobacterium
QAVAGNVGANE

SEQ ID NO: 277551 - protein, 10 aa, Mycobacterium
QAVARGNAAA

SEQ ID NO: 277552 - protein, 9 aa, Mycobacterium
QAVDSSNPA

SEQ ID NO: 277553 - protein, 4 aa, Mycobacterium
QAVG

SEQ ID NO: 277554 - protein, 10 aa, Mycobacterium
QAVGDATGYA

SEQ ID NO: 277555 - protein, 8 aa, Mycobacterium
QAVGPSLG

SEQ ID NO: 277556 - protein, 9 aa, Mycobacterium
QAVKGTALT

SEQ ID NO: 277557 - protein, 9 aa, Mycobacterium
QAVPGTGLT

SEQ ID NO: 277558 - protein, 11 aa, Mycobacterium
QAVQGAGPVNN

SEQ ID NO: 277559 - protein, 14 aa, Mycobacterium
QAVQPAIPESESAA

SEQ ID NO: 277560 - protein, 13 aa, Mycobacterium
QAVSQSPTDAPSF

SEQ ID NO: 277561 - protein, 8 aa, Mycobacterium
QAVTDGRD

SEQ ID NO: 277562 - protein, 6 aa, Mycobacterium
QAYART

SEQ ID NO: 277563 - protein, 11 aa, Mycobacterium
QAYQSTSVPGL

SEQ ID NO: 277564 - protein, 5 aa, Mycobacterium
QAYRD

SEQ ID NO: 277565 - protein, 14 aa, Mycobacterium
QAYTSQNRAQSQRT

SEQ ID NO: 277566 - protein, 11 aa, Mycobacterium
QCAGPGPAAVA

SEQ ID NO: 277567 - protein, 10 aa, Mycobacterium
QCAPAGVDSA

SEQ ID NO: 277568 - protein, 4 aa, Mycobacterium
QCDT

SEQ ID NO: 277569 - protein, 9 aa, Mycobacterium
QCGDSGGPV

SEQ ID NO: 277570 - protein, 4 aa, Mycobacterium
QCGK

SEQ ID NO: 277571 - protein, 6 aa, Mycobacterium
QCGKTA

SEQ ID NO: 277572 - protein, 8 aa, Mycobacterium
QCGSPGDR

SEQ ID NO: 277573 - protein, 49 aa, Mycobacterium
QCPPDCGGGSNGSGSYGPDASQFQPPQMPGQMPDYQGGINQPALDQNSS

SEQ ID NO: 277574 - protein, 49 aa, Mycobacterium
QCPPDCGGGSNGSGSYGPDASQFQPPQMPGQMPDYQGGINQPPLDQNSS

SEQ ID NO: 277575 - protein, 6 aa, Mycobacterium
QCPSDA

SEQ ID NO: 277576 - protein, 12 aa, Mycobacterium
QCRSAKERLSYE

SEQ ID NO: 277577 - protein, 19 aa, Mycobacterium
QCRSDTGLTVDGKPLKEPY

SEQ ID NO: 277578 - protein, 10 aa, Mycobacterium
QCTGPGPAAL

SEQ ID NO: 277579 - protein, 25 aa, Mycobacterium
QDAAAATVRARRREGLDQSGAQPLA

SEQ ID NO: 277580 - protein, 9 aa, Mycobacterium
QDAATPGEV

SEQ ID NO: 277581 - protein, 44 aa, Mycobacterium
QDADTGNEPVPYTGPDATGEYGREPATDYAPRYDYPDQDRYAEA

SEQ ID NO: 277582 - protein, 9 aa, Mycobacterium
QDAGPTGKQ

SEQ ID NO: 277583 - protein, 8 aa, Mycobacterium
QDAHNDAT

SEQ ID NO: 277584 - protein, 15 aa, Mycobacterium
QDANLAAARAAAAAE

SEQ ID NO: 277585 - protein, 7 aa, Mycobacterium
QDANTAS

SEQ ID NO: 277586 - protein, 4 aa, Mycobacterium
QDAP

SEQ ID NO: 277587 - protein, 14 aa, Mycobacterium
QDAPARRKLTPTAT

SEQ ID NO: 277588 - protein, 10 aa, Mycobacterium
QDAPTSTASS

SEQ ID NO: 277589 - protein, 11 aa, Mycobacterium
QDARRARRRTK

SEQ ID NO: 277590 - protein, 9 aa, Mycobacterium
QDATAAKAA

SEQ ID NO: 277591 - protein, 6 aa, Mycobacterium
QDATAM

SEQ ID NO: 277592 - protein, 17 aa, Mycobacterium
QDAVRQQLADSKTAADK

SEQ ID NO: 277593 - protein, 12 aa, Mycobacterium
QDDDGTYEVGRP

SEQ ID NO: 277594 - protein, 12 aa, Mycobacterium
QDDGAPVSRTQQ

SEQ ID NO: 277595 - protein, 6 aa, Mycobacterium
QDDGRT

SEQ ID NO: 277596 - protein, 9 aa, Mycobacterium
QDDGSQPAY

SEQ ID NO: 277597 - protein, 6 aa, Mycobacterium
QDDIDG

SEQ ID NO: 277598 - protein, 17 aa, Mycobacterium
QDDLPEESRASGFGRSE

SEQ ID NO: 277599 - protein, 6 aa, Mycobacterium
QDDNMA

SEQ ID NO: 277600 - protein, 9 aa, Mycobacterium
QDDPGVPAR

SEQ ID NO: 277601 - protein, 6 aa, Mycobacterium
QDDPKV

SEQ ID NO: 277602 - protein, 9 aa, Mycobacterium
QDDPNGQPV

SEQ ID NO: 277603 - protein, 8 aa, Mycobacterium
QDDPSADD

SEQ ID NO: 277604 - protein, 8 aa, Mycobacterium
QDDPSVTT

SEQ ID NO: 277605 - protein, 20 aa, Mycobacterium
QDDSAPDLAPLQETGYQSGY

SEQ ID NO: 277606 - protein, 9 aa, Mycobacterium
QDDSPPPPR

SEQ ID NO: 277607 - protein, 9 aa, Mycobacterium
QDEDEKVEA

SEQ ID NO: 277608 - protein, 4 aa, Mycobacterium
QDEG

SEQ ID NO: 277609 - protein, 7 aa, Mycobacterium
QDEKDPV

SEQ ID NO: 277610 - protein, 7 aa, Mycobacterium
QDENDPV

SEQ ID NO: 277611 - protein, 16 aa, Mycobacterium
QDEPRQTGPDFGKASP

SEQ ID NO: 277612 - protein, 7 aa, Mycobacterium
QDEQDPV

SEQ ID NO: 277613 - protein, 5 aa, Mycobacterium
QDERD

SEQ ID NO: 277614 - protein, 5 aa, Mycobacterium
QDERG

SEQ ID NO: 277615 - protein, 5 aa, Mycobacterium
QDERQ

SEQ ID NO: 277616 - protein, 17 aa, Mycobacterium
QDESSEIHDGTTDSAGI

SEQ ID NO: 277617 - protein, 12 aa, Mycobacterium
QDETSKDSTAMG

SEQ ID NO: 277618 - protein, 6 aa, Mycobacterium
QDEVTS

SEQ ID NO: 277619 - protein, 4 aa, Mycobacterium
QDFE

SEQ ID NO: 277620 - protein, 7 aa, Mycobacterium
QDGAGNN

SEQ ID NO: 277621 - protein, 9 aa, Mycobacterium
QDGASSQVS

SEQ ID NO: 277622 - protein, 27 aa, Mycobacterium
QDGDPGVDSGDPFAARPSEDSAGPLGF

SEQ ID NO: 277623 - protein, 9 aa, Mycobacterium
QDGEPVTDQ

SEQ ID NO: 277624 - protein, 5 aa, Mycobacterium
QDGNN

SEQ ID NO: 277625 - protein, 10 aa, Mycobacterium
QDGPKPPDNL

SEQ ID NO: 277626 - protein, 5 aa, Mycobacterium
QDGPV

SEQ ID NO: 277627 - protein, 4 aa, Mycobacterium
QDGQ

SEQ ID NO: 277628 - protein, 4 aa, Mycobacterium
QDGT

SEQ ID NO: 277629 - protein, 6 aa, Mycobacterium
QDGTAM

SEQ ID NO: 277630 - protein, 16 aa, Mycobacterium
QDGTGAKLTAESRTAG

SEQ ID NO: 277631 - protein, 5 aa, Mycobacterium
QDGTR

SEQ ID NO: 277632 - protein, 5 aa, Mycobacterium
QDGTT

SEQ ID NO: 277633 - protein, 6 aa, Mycobacterium
QDGVGA

SEQ ID NO: 277634 - protein, 4 aa, Mycobacterium
QDHE

SEQ ID NO: 277635 - protein, 7 aa, Mycobacterium
QDKDKID

SEQ ID NO: 277636 - protein, 6 aa, Mycobacterium
QDKDRI

SEQ ID NO: 277637 - protein, 11 aa, Mycobacterium
QDKGAKTNTVV

SEQ ID NO: 277638 - protein, 8 aa, Mycobacterium
QDKKHVNS

SEQ ID NO: 277639 - protein, 5 aa, Mycobacterium
QDLGG

SEQ ID NO: 277640 - protein, 14 aa, Mycobacterium
QDLGGSASNLDKPQ

SEQ ID NO: 277641 - protein, 11 aa, Mycobacterium
QDLPDGAEQEV

SEQ ID NO: 277642 - protein, 8 aa, Mycobacterium
QDLPTAGN

SEQ ID NO: 277643 - protein, 8 aa, Mycobacterium
QDNDADSM

SEQ ID NO: 277644 - protein, 10 aa, Mycobacterium
QDNPLASQQG

SEQ ID NO: 277645 - protein, 8 aa, Mycobacterium
QDNPVGKL

SEQ ID NO: 277646 - protein, 41 aa, Mycobacterium
QDNQRASQTTTAVAGPSLSQQIAPKTAAPVAPELPARGAVG

SEQ ID NO: 277647 - protein, 9 aa, Mycobacterium
QDNVPPDSI

SEQ ID NO: 277648 - protein, 5 aa, Mycobacterium
QDPCD

SEQ ID NO: 277649 - protein, 6 aa, Mycobacterium
QDPDAR

SEQ ID NO: 277650 - protein, 4 aa, Mycobacterium
QDPE

SEQ ID NO: 277651 - protein, 10 aa, Mycobacterium
QDPESGEEVP

SEQ ID NO: 277652 - protein, 5 aa, Mycobacterium
QDPHW

SEQ ID NO: 277653 - protein, 20 aa, Mycobacterium
QDPKTGKHENVPPPLPEGEG

SEQ ID NO: 277654 - protein, 4 aa, Mycobacterium
QDPL

SEQ ID NO: 277655 - protein, 5 aa, Mycobacterium
QDPPD

SEQ ID NO: 277656 - protein, 11 aa, Mycobacterium
QDPPRDEVSES

SEQ ID NO: 277657 - protein, 8 aa, Mycobacterium
QDPQLPGR

SEQ ID NO: 277658 - protein, 5 aa, Mycobacterium
QDPRD

SEQ ID NO: 277659 - protein, 5 aa, Mycobacterium
QDPRS

SEQ ID NO: 277660 - protein, 21 aa, Mycobacterium
QDPSARRRVGPLDEQRDEKVA

SEQ ID NO: 277661 - protein, 9 aa, Mycobacterium
QDPSPQRLK

SEQ ID NO: 277662 - protein, 5 aa, Mycobacterium
QDPTG

SEQ ID NO: 277663 - protein, 58 aa, Mycobacterium
QDQQNSPNRTTNTVTETPGSPPAAPGEGPAETPGAAAPVKPDEPGQNRVSGPVDTASP

SEQ ID NO: 277664 - protein, 17 aa, Mycobacterium
QDQSSAGAPTGAGPAVD

SEQ ID NO: 277665 - protein, 7 aa, Mycobacterium
QDRAEDL

SEQ ID NO: 277666 - protein, 7 aa, Mycobacterium
QDRAERV

SEQ ID NO: 277667 - protein, 7 aa, Mycobacterium
QDRAGVA

SEQ ID NO: 277668 - protein, 10 aa, Mycobacterium
QDRDGAPVSV

SEQ ID NO: 277669 - protein, 6 aa, Mycobacterium
QDRDTI

SEQ ID NO: 277670 - protein, 4 aa, Mycobacterium
QDRE

SEQ ID NO: 277671 - protein, 13 aa, Mycobacterium
QDRHDGRSPEVHR

SEQ ID NO: 277672 - protein, 13 aa, Mycobacterium
QDRIHGNGETNGH

SEQ ID NO: 277673 - protein, 30 aa, Mycobacterium
QDRKDREQSPPPTVTDTVTETTPYEETPAA

SEQ ID NO: 277674 - protein, 5 aa, Mycobacterium
QDRKP

SEQ ID NO: 277675 - protein, 4 aa, Mycobacterium
QDRS

SEQ ID NO: 277676 - protein, 4 aa, Mycobacterium
QDRV

SEQ ID NO: 277677 - protein, 4 aa, Mycobacterium
QDSA

SEQ ID NO: 277678 - protein, 17 aa, Mycobacterium
QDSAERHGRLSGQFGAE

SEQ ID NO: 277679 - protein, 7 aa, Mycobacterium
QDSETAG

SEQ ID NO: 277680 - protein, 14 aa, Mycobacterium
QDSIAGSPNDEHGQ

SEQ ID NO: 277681 - protein, 7 aa, Mycobacterium
QDSKTGH

SEQ ID NO: 277682 - protein, 13 aa, Mycobacterium
QDSLNETSNGEGD

SEQ ID NO: 277683 - protein, 9 aa, Mycobacterium
QDSPIGVRG

SEQ ID NO: 277684 - protein, 9 aa, Mycobacterium
QDSPISVRG

SEQ ID NO: 277685 - protein, 7 aa, Mycobacterium
QDSPLNV

SEQ ID NO: 277686 - protein, 7 aa, Mycobacterium
QDSPMNV

SEQ ID NO: 277687 - protein, 7 aa, Mycobacterium
QDSPVAV

SEQ ID NO: 277688 - protein, 8 aa, Mycobacterium
QDSQRTRA

SEQ ID NO: 277689 - protein, 9 aa, Mycobacterium
QDSSAPDAQ

SEQ ID NO: 277690 - protein, 38 aa, Mycobacterium
QDSSAQPTEAPPPAASSPSRPVASPPARVAPPAPAPRI

SEQ ID NO: 277691 - protein, 8 aa, Mycobacterium
QDSSTGQL

SEQ ID NO: 277692 - protein, 8 aa, Mycobacterium
QDSTSGEL

SEQ ID NO: 277693 - protein, 7 aa, Mycobacterium
QDSVSAT

SEQ ID NO: 277694 - protein, 9 aa, Mycobacterium
QDTGPADGL

SEQ ID NO: 277695 - protein, 13 aa, Mycobacterium
QDTLQRTPPPPGL

SEQ ID NO: 277696 - protein, 9 aa, Mycobacterium
QDTRGNPNG

SEQ ID NO: 277697 - protein, 14 aa, Mycobacterium
QDVDEMPDPEAPIK

SEQ ID NO: 277698 - protein, 13 aa, Mycobacterium
QDVGPNPAGQGAE

SEQ ID NO: 277699 - protein, 6 aa, Mycobacterium
QDVPGA

SEQ ID NO: 277700 - protein, 8 aa, Mycobacterium
QDVPGCGA

SEQ ID NO: 277701 - protein, 4 aa, Mycobacterium
QDVQ

SEQ ID NO: 277702 - protein, 6 aa, Mycobacterium
QDYGIE

SEQ ID NO: 277703 - protein, 6 aa, Mycobacterium
QDYGTA

SEQ ID NO: 277704 - protein, 14 aa, Mycobacterium
QDYTGSVAPQPEWY

SEQ ID NO: 277705 - protein, 41 aa, Mycobacterium
QEAAAGDPAVPGVDYGDAGAGVTADTERPDAHSDDASQRTH

SEQ ID NO: 277706 - protein, 11 aa, Mycobacterium
QEAAKVDGATA

SEQ ID NO: 277707 - protein, 8 aa, Mycobacterium
QEAERIKA

SEQ ID NO: 277708 - protein, 12 aa, Mycobacterium
QEAFSPANLPTT

SEQ ID NO: 277709 - protein, 15 aa, Mycobacterium
QEAPEEQQPPAGGPW

SEQ ID NO: 277710 - protein, 13 aa, Mycobacterium
QEAPPADEPRPRV

SEQ ID NO: 277711 - protein, 12 aa, Mycobacterium
QEAPPSAVPPGV

SEQ ID NO: 277712 - protein, 13 aa, Mycobacterium
QEARGAGEDRETA

SEQ ID NO: 277713 - protein, 14 aa, Mycobacterium
QEARQAGEDREQAY

SEQ ID NO: 277714 - protein, 14 aa, Mycobacterium
QEARQSGEDRESAY

SEQ ID NO: 277715 - protein, 12 aa, Mycobacterium
QEARRAQRRGKR

SEQ ID NO: 277716 - protein, 12 aa, Mycobacterium
QEARRNGEDKEA

SEQ ID NO: 277717 - protein, 12 aa, Mycobacterium
QEARSAGEERDT

SEQ ID NO: 277718 - protein, 4 aa, Mycobacterium
QEAV

SEQ ID NO: 277719 - protein, 7 aa, Mycobacterium
QECEDAS

SEQ ID NO: 277720 - protein, 8 aa, Mycobacterium
QEDLGPKQ

SEQ ID NO: 277721 - protein, 10 aa, Mycobacterium
QEDSSAMGEA

SEQ ID NO: 277722 - protein, 7 aa, Mycobacterium
QEEDDTP

SEQ ID NO: 277723 - protein, 10 aa, Mycobacterium
QEESSQRAET

SEQ ID NO: 277724 - protein, 4 aa, Mycobacterium
QEFD

SEQ ID NO: 277725 - protein, 5 aa, Mycobacterium
QEFTE

SEQ ID NO: 277726 - protein, 5 aa, Mycobacterium
QEGAD

SEQ ID NO: 277727 - protein, 7 aa, Mycobacterium
QEGAEGW

SEQ ID NO: 277728 - protein, 5 aa, Mycobacterium
QEGCR

SEQ ID NO: 277729 - protein, 11 aa, Mycobacterium
QEGCSRGRGGS

SEQ ID NO: 277730 - protein, 5 aa, Mycobacterium
QEGKH

SEQ ID NO: 277731 - protein, 4 aa, Mycobacterium
QEGN

SEQ ID NO: 277732 - protein, 25 aa, Mycobacterium
QEGPGGTRQLRPGDTIPLSRTSPAL

SEQ ID NO: 277733 - protein, 7 aa, Mycobacterium
QEGQTAM

SEQ ID NO: 277734 - protein, 11 aa, Mycobacterium
QEGRERGLDRE

SEQ ID NO: 277735 - protein, 20 aa, Mycobacterium
QEGRGRLRRGPDADSGQPYG

SEQ ID NO: 277736 - protein, 8 aa, Mycobacterium
QEGRRAGL

SEQ ID NO: 277737 - protein, 14 aa, Mycobacterium
QEGSWQPPSYPAAD

SEQ ID NO: 277738 - protein, 13 aa, Mycobacterium
QEHRGPETGAASR

SEQ ID NO: 277739 - protein, 6 aa, Mycobacterium
QEHSGA

SEQ ID NO: 277740 - protein, 13 aa, Mycobacterium
QEIAEKAKSSRRR

SEQ ID NO: 277741 - protein, 18 aa, Mycobacterium
QEIPAEPAMTAAPEPDPV

SEQ ID NO: 277742 - protein, 10 aa, Mycobacterium
QEKKRSTPMV

SEQ ID NO: 277743 - protein, 10 aa, Mycobacterium
QEKLRRQSSD

SEQ ID NO: 277744 - protein, 6 aa, Mycobacterium
QEKSMA

SEQ ID NO: 277745 - protein, 21 aa, Mycobacterium
QEKVDSSNVNAEWDDSTNSVV

SEQ ID NO: 277746 - protein, 5 aa, Mycobacterium
QELAD

SEQ ID NO: 277747 - protein, 8 aa, Mycobacterium
QELAEGST

SEQ ID NO: 277748 - protein, 9 aa, Mycobacterium
QELAEQATA

SEQ ID NO: 277749 - protein, 10 aa, Mycobacterium
QELDDNQRAE

SEQ ID NO: 277750 - protein, 9 aa, Mycobacterium
QELGSGTAV

SEQ ID NO: 277751 - protein, 5 aa, Mycobacterium
QELPT

SEQ ID NO: 277752 - protein, 6 aa, Mycobacterium
QELQTH

SEQ ID NO: 277753 - protein, 4 aa, Mycobacterium
QENG

SEQ ID NO: 277754 - protein, 9 aa, Mycobacterium
QENSTAMGE

SEQ ID NO: 277755 - protein, 6 aa, Mycobacterium
QEPESG

SEQ ID NO: 277756 - protein, 12 aa, Mycobacterium
QEPGAPPLPEDE

SEQ ID NO: 277757 - protein, 4 aa, Mycobacterium
QEPL

SEQ ID NO: 277758 - protein, 6 aa, Mycobacterium
QEPLGA

SEQ ID NO: 277759 - protein, 8 aa, Mycobacterium
QEPLGDDA

SEQ ID NO: 277760 - protein, 11 aa, Mycobacterium
QEPLGDDTRAY

SEQ ID NO: 277761 - protein, 4 aa, Mycobacterium
QEPP

SEQ ID NO: 277762 - protein, 5 aa, Mycobacterium
QEPRE

SEQ ID NO: 277763 - protein, 6 aa, Mycobacterium
QEQAGG

SEQ ID NO: 277764 - protein, 7 aa, Mycobacterium
QEQANAE

SEQ ID NO: 277765 - protein, 14 aa, Mycobacterium
QEQAPTAAIEEGST

SEQ ID NO: 277766 - protein, 5 aa, Mycobacterium
QEQCE

SEQ ID NO: 277767 - protein, 11 aa, Mycobacterium
QEQEPEGRETA

SEQ ID NO: 277768 - protein, 12 aa, Mycobacterium
QEQNRDDKARAY

SEQ ID NO: 277769 - protein, 7 aa, Mycobacterium
QEQTQVG

SEQ ID NO: 277770 - protein, 9 aa, Mycobacterium
QEQTSAASE

SEQ ID NO: 277771 - protein, 8 aa, Mycobacterium
QEQTTAAS

SEQ ID NO: 277772 - protein, 14 aa, Mycobacterium
QEQYQEKFGPGDYR

SEQ ID NO: 277773 - protein, 29 aa, Mycobacterium
QEREQAAQERARYAQEQQLTAERHATTLR

SEQ ID NO: 277774 - protein, 10 aa, Mycobacterium
QERGHPGATI

SEQ ID NO: 277775 - protein, 11 aa, Mycobacterium
QERKAGANLPR

SEQ ID NO: 277776 - protein, 6 aa, Mycobacterium
QERRRI

SEQ ID NO: 277777 - protein, 7 aa, Mycobacterium
QERYDNK

SEQ ID NO: 277778 - protein, 4 aa, Mycobacterium
QESA

SEQ ID NO: 277779 - protein, 6 aa, Mycobacterium
QESETR

SEQ ID NO: 277780 - protein, 20 aa, Mycobacterium
QESGANAGQPQRTGYPDPNL

SEQ ID NO: 277781 - protein, 6 aa, Mycobacterium
QESGAQ

SEQ ID NO: 277782 - protein, 12 aa, Mycobacterium
QESGDVAESPMK

SEQ ID NO: 277783 - protein, 18 aa, Mycobacterium
QESIDAGRWDQARNQLTE

SEQ ID NO: 277784 - protein, 8 aa, Mycobacterium
QESNRLNK

SEQ ID NO: 277785 - protein, 7 aa, Mycobacterium
QESNSES

SEQ ID NO: 277786 - protein, 7 aa, Mycobacterium
QESNSNS

SEQ ID NO: 277787 - protein, 5 aa, Mycobacterium
QESPL

SEQ ID NO: 277788 - protein, 23 aa, Mycobacterium
QESSKFSPRLTAGGDPSTNAATQ

SEQ ID NO: 277789 - protein, 13 aa, Mycobacterium
QESTSGWRIAAAT

SEQ ID NO: 277790 - protein, 5 aa, Mycobacterium
QETDY

SEQ ID NO: 277791 - protein, 26 aa, Mycobacterium
QETEEADAADPGEAPGDEPGAAGGPM

SEQ ID NO: 277792 - protein, 8 aa, Mycobacterium
QETELSGL

SEQ ID NO: 277793 - protein, 7 aa, Mycobacterium
QETPPDG

SEQ ID NO: 277794 - protein, 8 aa, Mycobacterium
QETRAERA

SEQ ID NO: 277795 - protein, 12 aa, Mycobacterium
QETRDAGTTRPL

SEQ ID NO: 277796 - protein, 6 aa, Mycobacterium
QETTRE

SEQ ID NO: 277797 - protein, 7 aa, Mycobacterium
QETVRQQ

SEQ ID NO: 277798 - protein, 12 aa, Mycobacterium
QEVADTAPSPVG

SEQ ID NO: 277799 - protein, 6 aa, Mycobacterium
QEVPDA

SEQ ID NO: 277800 - protein, 14 aa, Mycobacterium
QEVSPSPERDLDPA

SEQ ID NO: 277801 - protein, 7 aa, Mycobacterium
QEYTTPY

SEQ ID NO: 277802 - protein, 5 aa, Mycobacterium
QFAPA

SEQ ID NO: 277803 - protein, 13 aa, Mycobacterium
QFAPANESADGKA

SEQ ID NO: 277804 - protein, 11 aa, Mycobacterium
QFASPPPLSAG

SEQ ID NO: 277805 - protein, 7 aa, Mycobacterium
QFASTGL

SEQ ID NO: 277806 - protein, 6 aa, Mycobacterium
QFATGA

SEQ ID NO: 277807 - protein, 7 aa, Mycobacterium
QFDSDSS

SEQ ID NO: 277808 - protein, 6 aa, Mycobacterium
QFEPRR

SEQ ID NO: 277809 - protein, 5 aa, Mycobacterium
QFGAD

SEQ ID NO: 277810 - protein, 8 aa, Mycobacterium
QFGDGASK

SEQ ID NO: 277811 - protein, 11 aa, Mycobacterium
QFGGGDATMTD

SEQ ID NO: 277812 - protein, 7 aa, Mycobacterium
QFGPAAA

SEQ ID NO: 277813 - protein, 6 aa, Mycobacterium
QFGPTQ

SEQ ID NO: 277814 - protein, 7 aa, Mycobacterium
QFGQQAA

SEQ ID NO: 277815 - protein, 10 aa, Mycobacterium
QFGSSGGPFA

SEQ ID NO: 277816 - protein, 10 aa, Mycobacterium
QFGSSGGPLA

SEQ ID NO: 277817 - protein, 10 aa, Mycobacterium
QFKGTDFRGQ

SEQ ID NO: 277818 - protein, 5 aa, Mycobacterium
QFKRP

SEQ ID NO: 277819 - protein, 17 aa, Mycobacterium
QFNTPSTTTVEFASQVC

SEQ ID NO: 277820 - protein, 18 aa, Mycobacterium
QFNTPSTTTVQYAPQVCR

SEQ ID NO: 277821 - protein, 9 aa, Mycobacterium
QFPDQGASP

SEQ ID NO: 277822 - protein, 7 aa, Mycobacterium
QFPGGER

SEQ ID NO: 277823 - protein, 11 aa, Mycobacterium
QFPGPGATEKN

SEQ ID NO: 277824 - protein, 11 aa, Mycobacterium
QFPGPGRTENN

SEQ ID NO: 277825 - protein, 11 aa, Mycobacterium
QFPGPRRTESN

SEQ ID NO: 277826 - protein, 15 aa, Mycobacterium
QFPGRDGGSYPIEND

SEQ ID NO: 277827 - protein, 13 aa, Mycobacterium
QFPGSVPPEPDQD

SEQ ID NO: 277828 - protein, 20 aa, Mycobacterium
QFSTSNASIPKSQQDPCFAG

SEQ ID NO: 277829 - protein, 4 aa, Mycobacterium
QGAA

SEQ ID NO: 277830 - protein, 14 aa, Mycobacterium
QGAAAGNDAVRDSG

SEQ ID NO: 277831 - protein, 8 aa, Mycobacterium
QGAATDTE

SEQ ID NO: 277832 - protein, 11 aa, Mycobacterium
QGADLDGRADQ

SEQ ID NO: 277833 - protein, 12 aa, Mycobacterium
QGAGAIRRRAHR

SEQ ID NO: 277834 - protein, 14 aa, Mycobacterium
QGAIQGAKYAAGTI

SEQ ID NO: 277835 - protein, 9 aa, Mycobacterium
QGAIQGGRY

SEQ ID NO: 277836 - protein, 19 aa, Mycobacterium
QGAPAEAGRPAVPESWAQV

SEQ ID NO: 277837 - protein, 8 aa, Mycobacterium
QGAPAGPL

SEQ ID NO: 277838 - protein, 11 aa, Mycobacterium
QGAPASDDDYE

SEQ ID NO: 277839 - protein, 15 aa, Mycobacterium
QGAPGATGNALAAPQ

SEQ ID NO: 277840 - protein, 25 aa, Mycobacterium
QGAPKPGGALPGKTTPVTGTYDRNS

SEQ ID NO: 277841 - protein, 11 aa, Mycobacterium
QGAPLDGRADQ

SEQ ID NO: 277842 - protein, 5 aa, Mycobacterium
QGAPT

SEQ ID NO: 277843 - protein, 7 aa, Mycobacterium
QGAPTPV

SEQ ID NO: 277844 - protein, 6 aa, Mycobacterium
QGAPTS

SEQ ID NO: 277845 - protein, 5 aa, Mycobacterium
QGART

SEQ ID NO: 277846 - protein, 7 aa, Mycobacterium
QGASATD

SEQ ID NO: 277847 - protein, 5 aa, Mycobacterium
QGASN

SEQ ID NO: 277848 - protein, 7 aa, Mycobacterium
QGASNVV

SEQ ID NO: 277849 - protein, 5 aa, Mycobacterium
QGASV

SEQ ID NO: 277850 - protein, 4 aa, Mycobacterium
QGAT

SEQ ID NO: 277851 - protein, 5 aa, Mycobacterium
QGATA

SEQ ID NO: 277852 - protein, 10 aa, Mycobacterium
QGATGRTPMG

SEQ ID NO: 277853 - protein, 11 aa, Mycobacterium
QGATSAGTMNT

SEQ ID NO: 277854 - protein, 5 aa, Mycobacterium
QGAVG

SEQ ID NO: 277855 - protein, 12 aa, Mycobacterium
QGDAIDSRYHPS

SEQ ID NO: 277856 - protein, 7 aa, Mycobacterium
QGDDAQS

SEQ ID NO: 277857 - protein, 8 aa, Mycobacterium
QGDDDDEI

SEQ ID NO: 277858 - protein, 9 aa, Mycobacterium
QGDEPGWDD

SEQ ID NO: 277859 - protein, 8 aa, Mycobacterium
QGDPASVD

SEQ ID NO: 277860 - protein, 8 aa, Mycobacterium
QGDPASVE

SEQ ID NO: 277861 - protein, 9 aa, Mycobacterium
QGDPQTSEG

SEQ ID NO: 277862 - protein, 7 aa, Mycobacterium
QGDRNVS

SEQ ID NO: 277863 - protein, 5 aa, Mycobacterium
QGDRT

SEQ ID NO: 277864 - protein, 6 aa, Mycobacterium
QGDTAS

SEQ ID NO: 277865 - protein, 6 aa, Mycobacterium
QGDTDQ

SEQ ID NO: 277866 - protein, 6 aa, Mycobacterium
QGDTLS

SEQ ID NO: 277867 - protein, 10 aa, Mycobacterium
QGDWEEAQQQ

SEQ ID NO: 277868 - protein, 6 aa, Mycobacterium
QGEADS

SEQ ID NO: 277869 - protein, 6 aa, Mycobacterium
QGEGAT

SEQ ID NO: 277870 - protein, 7 aa, Mycobacterium
QGEGGTI

SEQ ID NO: 277871 - protein, 4 aa, Mycobacterium
QGEL

SEQ ID NO: 277872 - protein, 15 aa, Mycobacterium
QGELPDADDEPRLPE

SEQ ID NO: 277873 - protein, 15 aa, Mycobacterium
QGENTSQGLGGSANQ

SEQ ID NO: 277874 - protein, 12 aa, Mycobacterium
QGEPLPPEPLGG

SEQ ID NO: 277875 - protein, 13 aa, Mycobacterium
QGETPPDEGGGAA

SEQ ID NO: 277876 - protein, 5 aa, Mycobacterium
QGFAP

SEQ ID NO: 277877 - protein, 6 aa, Mycobacterium
QGFDSG

SEQ ID NO: 277878 - protein, 10 aa, Mycobacterium
QGGAKAALDP

SEQ ID NO: 277879 - protein, 9 aa, Mycobacterium
QGGAMSNPA

SEQ ID NO: 277880 - protein, 8 aa, Mycobacterium
QGGAPGCT

SEQ ID NO: 277881 - protein, 16 aa, Mycobacterium
QGGATYRAATGQTQDP

SEQ ID NO: 277882 - protein, 9 aa, Mycobacterium
QGGDAVSGV

SEQ ID NO: 277883 - protein, 9 aa, Mycobacterium
QGGDPNEQI

SEQ ID NO: 277884 - protein, 5 aa, Mycobacterium
QGGDS

SEQ ID NO: 277885 - protein, 9 aa, Mycobacterium
QGGEVPPEL

SEQ ID NO: 277886 - protein, 5 aa, Mycobacterium
QGGFG

SEQ ID NO: 277887 - protein, 20 aa, Mycobacterium
QGGGALGSAVTPGLADPLGG

SEQ ID NO: 277888 - protein, 14 aa, Mycobacterium
QGGGALGSGVTSPL

SEQ ID NO: 277889 - protein, 6 aa, Mycobacterium
QGGGGG

SEQ ID NO: 277890 - protein, 18 aa, Mycobacterium
QGGGLSTEDVPSDGNNRA

SEQ ID NO: 277891 - protein, 11 aa, Mycobacterium
QGGHRSADGWR

SEQ ID NO: 277892 - protein, 6 aa, Mycobacterium
QGGNDL

SEQ ID NO: 277893 - protein, 5 aa, Mycobacterium
QGGPA

SEQ ID NO: 277894 - protein, 10 aa, Mycobacterium
QGGPFTEAGA

SEQ ID NO: 277895 - protein, 9 aa, Mycobacterium
QGGPGTASA

SEQ ID NO: 277896 - protein, 6 aa, Mycobacterium
QGGPPK

SEQ ID NO: 277897 - protein, 7 aa, Mycobacterium
QGGQYPG

SEQ ID NO: 277898 - protein, 6 aa, Mycobacterium
QGGRTE

SEQ ID NO: 277899 - protein, 4 aa, Mycobacterium
QGGS

SEQ ID NO: 277900 - protein, 5 aa, Mycobacterium
QGGSA

SEQ ID NO: 277901 - protein, 6 aa, Mycobacterium
QGGSPA

SEQ ID NO: 277902 - protein, 9 aa, Mycobacterium
QGGSPTKLI

SEQ ID NO: 277903 - protein, 5 aa, Mycobacterium
QGGSV

SEQ ID NO: 277904 - protein, 8 aa, Mycobacterium
QGGTPGSY

SEQ ID NO: 277905 - protein, 5 aa, Mycobacterium
QGGTR

SEQ ID NO: 277906 - protein, 5 aa, Mycobacterium
QGGTT

SEQ ID NO: 277907 - protein, 4 aa, Mycobacterium
QGGY

SEQ ID NO: 277908 - protein, 4 aa, Mycobacterium
QGHD

SEQ ID NO: 277909 - protein, 9 aa, Mycobacterium
QGIDTQPYT

SEQ ID NO: 277910 - protein, 4 aa, Mycobacterium
QGIG

SEQ ID NO: 277911 - protein, 5 aa, Mycobacterium
QGIGG

SEQ ID NO: 277912 - protein, 8 aa, Mycobacterium
QGINEGDR

SEQ ID NO: 277913 - protein, 5 aa, Mycobacterium
QGIPA

SEQ ID NO: 277914 - protein, 11 aa, Mycobacterium
QGIRDGDERQP

SEQ ID NO: 277915 - protein, 5 aa, Mycobacterium
QGISP

SEQ ID NO: 277916 - protein, 11 aa, Mycobacterium
QGITASRIEQT

SEQ ID NO: 277917 - protein, 8 aa, Mycobacterium
QGKLGASS

SEQ ID NO: 277918 - protein, 10 aa, Mycobacterium
QGKPAPPRHI

SEQ ID NO: 277919 - protein, 6 aa, Mycobacterium
QGKPYE

SEQ ID NO: 277920 - protein, 4 aa, Mycobacterium
QGLG

SEQ ID NO: 277921 - protein, 6 aa, Mycobacterium
QGLGKS

SEQ ID NO: 277922 - protein, 5 aa, Mycobacterium
QGLGS

SEQ ID NO: 277923 - protein, 17 aa, Mycobacterium
QGLPGTPISSPSPEALQ

SEQ ID NO: 277924 - protein, 11 aa, Mycobacterium
QGLPTPPESDD

SEQ ID NO: 277925 - protein, 9 aa, Mycobacterium
QGLRDNSPI

SEQ ID NO: 277926 - protein, 8 aa, Mycobacterium
QGLSAGQR

SEQ ID NO: 277927 - protein, 6 aa, Mycobacterium
QGLSPH

SEQ ID NO: 277928 - protein, 8 aa, Mycobacterium
QGLSTTEA

SEQ ID NO: 277929 - protein, 12 aa, Mycobacterium
QGLTGQQAGASH

SEQ ID NO: 277930 - protein, 12 aa, Mycobacterium
QGMADTDSIEGA

SEQ ID NO: 277931 - protein, 6 aa, Mycobacterium
QGMGAS

SEQ ID NO: 277932 - protein, 7 aa, Mycobacterium
QGMIPTR

SEQ ID NO: 277933 - protein, 5 aa, Mycobacterium
QGMPR

SEQ ID NO: 277934 - protein, 7 aa, Mycobacterium
QGNGDSI

SEQ ID NO: 277935 - protein, 6 aa, Mycobacterium
QGNGDT

SEQ ID NO: 277936 - protein, 18 aa, Mycobacterium
QGNGFKTVTPKEKGANYG

SEQ ID NO: 277937 - protein, 4 aa, Mycobacterium
QGNM

SEQ ID NO: 277938 - protein, 7 aa, Mycobacterium
QGNNADN

SEQ ID NO: 277939 - protein, 18 aa, Mycobacterium
QGNPRCDADPSCSDTRGA

SEQ ID NO: 277940 - protein, 7 aa, Mycobacterium
QGNQAAA

SEQ ID NO: 277941 - protein, 6 aa, Mycobacterium
QGNTNS

SEQ ID NO: 277942 - protein, 5 aa, Mycobacterium
QGNWG

SEQ ID NO: 277943 - protein, 11 aa, Mycobacterium
QGPAERSRDFR

SEQ ID NO: 277944 - protein, 10 aa, Mycobacterium
QGPDRGWDSP

SEQ ID NO: 277945 - protein, 6 aa, Mycobacterium
QGPESG

SEQ ID NO: 277946 - protein, 8 aa, Mycobacterium
QGPGAFDE

SEQ ID NO: 277947 - protein, 10 aa, Mycobacterium
QGPGSPSAAT

SEQ ID NO: 277948 - protein, 8 aa, Mycobacterium
QGPMPAPQ

SEQ ID NO: 277949 - protein, 4 aa, Mycobacterium
QGPN

SEQ ID NO: 277950 - protein, 21 aa, Mycobacterium
QGPNAEHPGAPLRGEKSGYDF

SEQ ID NO: 277951 - protein, 20 aa, Mycobacterium
QGPNAEHPGEPLRGERGGYD

SEQ ID NO: 277952 - protein, 20 aa, Mycobacterium
QGPNAEHPGEPLRGERSGYD

SEQ ID NO: 277953 - protein, 7 aa, Mycobacterium
QGPPGLR

SEQ ID NO: 277954 - protein, 7 aa, Mycobacterium
QGPSAES

SEQ ID NO: 277955 - protein, 8 aa, Mycobacterium
QGPTLSRS

SEQ ID NO: 277956 - protein, 50 aa, Mycobacterium
QGPYGPVPGGYPPPNVATSAPNPDGIAHSPGVPSAAIPGQMPPEQPGAPV

SEQ ID NO: 277957 - protein, 7 aa, Mycobacterium
QGQATVP

SEQ ID NO: 277958 - protein, 6 aa, Mycobacterium
QGQESF

SEQ ID NO: 277959 - protein, 7 aa, Mycobacterium
QGQGGTI

SEQ ID NO: 277960 - protein, 18 aa, Mycobacterium
QGQPVVASTTNSILATCT

SEQ ID NO: 277961 - protein, 6 aa, Mycobacterium
QGQSAS

SEQ ID NO: 277962 - protein, 4 aa, Mycobacterium
QGQT

SEQ ID NO: 277963 - protein, 6 aa, Mycobacterium
QGQTSN

SEQ ID NO: 277964 - protein, 8 aa, Mycobacterium
QGQTTGVT

SEQ ID NO: 277965 - protein, 8 aa, Mycobacterium
QGRARSGA

SEQ ID NO: 277966 - protein, 5 aa, Mycobacterium
QGRAT

SEQ ID NO: 277967 - protein, 16 aa, Mycobacterium
QGRDAVTEFPNDRGWD

SEQ ID NO: 277968 - protein, 11 aa, Mycobacterium
QGREDTASIEG

SEQ ID NO: 277969 - protein, 8 aa, Mycobacterium
QGREGPVP

SEQ ID NO: 277970 - protein, 8 aa, Mycobacterium
QGRGGKQY

SEQ ID NO: 277971 - protein, 9 aa, Mycobacterium
QGRPDPGDR

SEQ ID NO: 277972 - protein, 8 aa, Mycobacterium
QGRPNPLA

SEQ ID NO: 277973 - protein, 9 aa, Mycobacterium
QGRRGASIG

SEQ ID NO: 277974 - protein, 4 aa, Mycobacterium
QGRT

SEQ ID NO: 277975 - protein, 16 aa, Mycobacterium
QGSANSVDRQLTGNDR

SEQ ID NO: 277976 - protein, 9 aa, Mycobacterium
QGSAPLTQQ

SEQ ID NO: 277977 - protein, 5 aa, Mycobacterium
QGSAT

SEQ ID NO: 277978 - protein, 6 aa, Mycobacterium
QGSATV

SEQ ID NO: 277979 - protein, 13 aa, Mycobacterium
QGSATVAATTAGS

SEQ ID NO: 277980 - protein, 9 aa, Mycobacterium
QGSEGGGAA

SEQ ID NO: 277981 - protein, 17 aa, Mycobacterium
QGSPGAGASARAAGDTA

SEQ ID NO: 277982 - protein, 7 aa, Mycobacterium
QGSPPKI

SEQ ID NO: 277983 - protein, 12 aa, Mycobacterium
QGSSAAPAQGLE

SEQ ID NO: 277984 - protein, 11 aa, Mycobacterium
QGSSATPAQGL

SEQ ID NO: 277985 - protein, 26 aa, Mycobacterium
QGSTNGQQLPFSEQANENTDRQAEIQ

SEQ ID NO: 277986 - protein, 9 aa, Mycobacterium
QGSTPDGHV

SEQ ID NO: 277987 - protein, 12 aa, Mycobacterium
QGTADSKGTIGS

SEQ ID NO: 277988 - protein, 5 aa, Mycobacterium
QGTEF

SEQ ID NO: 277989 - protein, 6 aa, Mycobacterium
QGTETL

SEQ ID NO: 277990 - protein, 5 aa, Mycobacterium
QGTFG

SEQ ID NO: 277991 - protein, 44 aa, Mycobacterium
QGTPLPPGAQRAGTPPVSEPGTPPFPVGPPGPPAPGVAPAPSQP

SEQ ID NO: 277992 - protein, 16 aa, Mycobacterium
QGTTAAGVQSSDGQAA

SEQ ID NO: 277993 - protein, 10 aa, Mycobacterium
QGTTGSSIGK

SEQ ID NO: 277994 - protein, 6 aa, Mycobacterium
QGTVEG

SEQ ID NO: 277995 - protein, 13 aa, Mycobacterium
QGVAADDDVVKQS

SEQ ID NO: 277996 - protein, 8 aa, Mycobacterium
QGVADGPI

SEQ ID NO: 277997 - protein, 8 aa, Mycobacterium
QGVADPRD

SEQ ID NO: 277998 - protein, 4 aa, Mycobacterium
QGVD

SEQ ID NO: 277999 - protein, 11 aa, Mycobacterium
QGVDDRQSLTA

SEQ ID NO: 278000 - protein, 4 aa, Mycobacterium
QGVG

SEQ ID NO: 278001 - protein, 6 aa, Mycobacterium
QGVGGA

SEQ ID NO: 278002 - protein, 8 aa, Mycobacterium
QGVGGGAI

SEQ ID NO: 278003 - protein, 8 aa, Mycobacterium
QGVKSPQM

SEQ ID NO: 278004 - protein, 8 aa, Mycobacterium
QGVPDHGP

SEQ ID NO: 278005 - protein, 14 aa, Mycobacterium
QGVPDRGPSLIGTG

SEQ ID NO: 278006 - protein, 9 aa, Mycobacterium
QGVPPDDRI

SEQ ID NO: 278007 - protein, 9 aa, Mycobacterium
QGVPPDDRV

SEQ ID NO: 278008 - protein, 12 aa, Mycobacterium
QGVPPDDRVTRD

SEQ ID NO: 278009 - protein, 30 aa, Mycobacterium
QGVQPGASPADHVTNDDASAGAASGPTGAW

SEQ ID NO: 278010 - protein, 12 aa, Mycobacterium
QGVSPSERARQL

SEQ ID NO: 278011 - protein, 4 aa, Mycobacterium
QGWP

SEQ ID NO: 278012 - protein, 7 aa, Mycobacterium
QGWTPGK

SEQ ID NO: 278013 - protein, 8 aa, Mycobacterium
QGYNSGIR

SEQ ID NO: 278014 - protein, 7 aa, Mycobacterium
QGYTPEF

SEQ ID NO: 278015 - protein, 6 aa, Mycobacterium
QHADGS

SEQ ID NO: 278016 - protein, 5 aa, Mycobacterium
QHAEA

SEQ ID NO: 278017 - protein, 5 aa, Mycobacterium
QHAET

SEQ ID NO: 278018 - protein, 6 aa, Mycobacterium
QHAGNK

SEQ ID NO: 278019 - protein, 10 aa, Mycobacterium
QHAGSGAPAV

SEQ ID NO: 278020 - protein, 9 aa, Mycobacterium
QHDPDRPKV

SEQ ID NO: 278021 - protein, 10 aa, Mycobacterium
QHDPDTIARA

SEQ ID NO: 278022 - protein, 11 aa, Mycobacterium
QHDPSTIARAD

SEQ ID NO: 278023 - protein, 28 aa, Mycobacterium
QHDQQRRGPQGQQQVAARERRDAETPEA

SEQ ID NO: 278024 - protein, 9 aa, Mycobacterium
QHEANGGTV

SEQ ID NO: 278025 - protein, 9 aa, Mycobacterium
QHEATGGTV

SEQ ID NO: 278026 - protein, 4 aa, Mycobacterium
QHEG

SEQ ID NO: 278027 - protein, 10 aa, Mycobacterium
QHETTAAAYN

SEQ ID NO: 278028 - protein, 6 aa, Mycobacterium
QHGEGT

SEQ ID NO: 278029 - protein, 4 aa, Mycobacterium
QHGG

SEQ ID NO: 278030 - protein, 14 aa, Mycobacterium
QHGGESGEVGSPIG

SEQ ID NO: 278031 - protein, 6 aa, Mycobacterium
QHGGTV

SEQ ID NO: 278032 - protein, 16 aa, Mycobacterium
QHGGTVEVTDGPAGGA

SEQ ID NO: 278033 - protein, 6 aa, Mycobacterium
QHGPGT

SEQ ID NO: 278034 - protein, 6 aa, Mycobacterium
QHGSGT

SEQ ID NO: 278035 - protein, 6 aa, Mycobacterium
QHLGSS

SEQ ID NO: 278036 - protein, 10 aa, Mycobacterium
QHNGHGGLTG

SEQ ID NO: 278037 - protein, 8 aa, Mycobacterium
QHNSGADT

SEQ ID NO: 278038 - protein, 4 aa, Mycobacterium
QHPA

SEQ ID NO: 278039 - protein, 10 aa, Mycobacterium
QHPAAADELG

SEQ ID NO: 278040 - protein, 12 aa, Mycobacterium
QHPDDEAGSFDA

SEQ ID NO: 278041 - protein, 6 aa, Mycobacterium
QHPETA

SEQ ID NO: 278042 - protein, 14 aa, Mycobacterium
QHPGTGWPTAEPEM

SEQ ID NO: 278043 - protein, 6 aa, Mycobacterium
QHPGVA

SEQ ID NO: 278044 - protein, 9 aa, Mycobacterium
QHPSHHDEV

SEQ ID NO: 278045 - protein, 4 aa, Mycobacterium
QHPT

SEQ ID NO: 278046 - protein, 5 aa, Mycobacterium
QHQPA

SEQ ID NO: 278047 - protein, 4 aa, Mycobacterium
QHQR

SEQ ID NO: 278048 - protein, 13 aa, Mycobacterium
QHQTDTDAAGPTR

SEQ ID NO: 278049 - protein, 11 aa, Mycobacterium
QHRDDLRAARD

SEQ ID NO: 278050 - protein, 20 aa, Mycobacterium
QHRQQPAAAAKTDTHGVDPE

SEQ ID NO: 278051 - protein, 19 aa, Mycobacterium
QHRRTGSTGFRGVSGRPGS

SEQ ID NO: 278052 - protein, 4 aa, Mycobacterium
QHRT

SEQ ID NO: 278053 - protein, 8 aa, Mycobacterium
QHSAGDTS

SEQ ID NO: 278054 - protein, 9 aa, Mycobacterium
QHSAGQKSL

SEQ ID NO: 278055 - protein, 11 aa, Mycobacterium
QHSAPMTPMDA

SEQ ID NO: 278056 - protein, 8 aa, Mycobacterium
QHSGDKSL

SEQ ID NO: 278057 - protein, 6 aa, Mycobacterium
QHSGNR

SEQ ID NO: 278058 - protein, 17 aa, Mycobacterium
QHSMGRDHHGAAAGGHR

SEQ ID NO: 278059 - protein, 4 aa, Mycobacterium
QHSP

SEQ ID NO: 278060 - protein, 9 aa, Mycobacterium
QHTAAPVPS

SEQ ID NO: 278061 - protein, 6 aa, Mycobacterium
QHTEAG

SEQ ID NO: 278062 - protein, 8 aa, Mycobacterium
QHTPASAD

SEQ ID NO: 278063 - protein, 8 aa, Mycobacterium
QHTPDSAD

SEQ ID NO: 278064 - protein, 7 aa, Mycobacterium
QHTPEAA

SEQ ID NO: 278065 - protein, 8 aa, Mycobacterium
QHTPESAD

SEQ ID NO: 278066 - protein, 8 aa, Mycobacterium
QHTPESAG

SEQ ID NO: 278067 - protein, 8 aa, Mycobacterium
QHTPETAG

SEQ ID NO: 278068 - protein, 5 aa, Mycobacterium
QHVRP

SEQ ID NO: 278069 - protein, 9 aa, Mycobacterium
QIANQPHGP

SEQ ID NO: 278070 - protein, 4 aa, Mycobacterium
QIDE

SEQ ID NO: 278071 - protein, 10 aa, Mycobacterium
QIDEETSRRV

SEQ ID NO: 278072 - protein, 8 aa, Mycobacterium
QIDPAGKQ

SEQ ID NO: 278073 - protein, 11 aa, Mycobacterium
QIDQASPTPEM

SEQ ID NO: 278074 - protein, 10 aa, Mycobacterium
QIDSQQTNRD

SEQ ID NO: 278075 - protein, 10 aa, Mycobacterium
QIESQQTNRD

SEQ ID NO: 278076 - protein, 6 aa, Mycobacterium
QIETRA

SEQ ID NO: 278077 - protein, 6 aa, Mycobacterium
QIGPTA

SEQ ID NO: 278078 - protein, 9 aa, Mycobacterium
QIGRDGQNR

SEQ ID NO: 278079 - protein, 4 aa, Mycobacterium
QIGT

SEQ ID NO: 278080 - protein, 7 aa, Mycobacterium
QINTTSG

SEQ ID NO: 278081 - protein, 8 aa, Mycobacterium
QIPAGDGT

SEQ ID NO: 278082 - protein, 12 aa, Mycobacterium
QIPDAPAVSGPY

SEQ ID NO: 278083 - protein, 12 aa, Mycobacterium
QIPDDPASAIAA

SEQ ID NO: 278084 - protein, 18 aa, Mycobacterium
QIPDGPAVSGPYAGQRPW

SEQ ID NO: 278085 - protein, 6 aa, Mycobacterium
QIPDQV

SEQ ID NO: 278086 - protein, 12 aa, Mycobacterium
QIPDSAAMTGPY

SEQ ID NO: 278087 - protein, 12 aa, Mycobacterium
QIPDSPAMGGPY

SEQ ID NO: 278088 - protein, 12 aa, Mycobacterium
QIPDSPAMSGPY

SEQ ID NO: 278089 - protein, 26 aa, Mycobacterium
QIPDSQATQAEEEKLPESDGEMVSVT

SEQ ID NO: 278090 - protein, 6 aa, Mycobacterium
QIPDTA

SEQ ID NO: 278091 - protein, 12 aa, Mycobacterium
QIPDTPAVSGPF

SEQ ID NO: 278092 - protein, 5 aa, Mycobacterium
QIPGV

SEQ ID NO: 278093 - protein, 5 aa, Mycobacterium
QIPQG

SEQ ID NO: 278094 - protein, 10 aa, Mycobacterium
QIPRSPNDQD

SEQ ID NO: 278095 - protein, 5 aa, Mycobacterium
QIQGT

SEQ ID NO: 278096 - protein, 12 aa, Mycobacterium
QIQNATSGMDQR

SEQ ID NO: 278097 - protein, 5 aa, Mycobacterium
QIQPY

SEQ ID NO: 278098 - protein, 6 aa, Mycobacterium
QIRSGA

SEQ ID NO: 278099 - protein, 10 aa, Mycobacterium
QISDSGSANA

SEQ ID NO: 278100 - protein, 13 aa, Mycobacterium
QISGGDPPFTAAT

SEQ ID NO: 278101 - protein, 8 aa, Mycobacterium
QISGPRRR

SEQ ID NO: 278102 - protein, 7 aa, Mycobacterium
QISRDGL

SEQ ID NO: 278103 - protein, 18 aa, Mycobacterium
QISRDGLDPYRVGPASGL

SEQ ID NO: 278104 - protein, 8 aa, Mycobacterium
QITDPELK

SEQ ID NO: 278105 - protein, 4 aa, Mycobacterium
QITP

SEQ ID NO: 278106 - protein, 15 aa, Mycobacterium
QITRNRRAAAEQTRP

SEQ ID NO: 278107 - protein, 26 aa, Mycobacterium
QKACPPRADPRASRTRSTRRSSRRSC

SEQ ID NO: 278108 - protein, 7 aa, Mycobacterium
QKAPANY

SEQ ID NO: 278109 - protein, 6 aa, Mycobacterium
QKAPGA

SEQ ID NO: 278110 - protein, 7 aa, Mycobacterium
QKAPRNY

SEQ ID NO: 278111 - protein, 9 aa, Mycobacterium
QKAQQDQNM

SEQ ID NO: 278112 - protein, 9 aa, Mycobacterium
QKAQQDQTM

SEQ ID NO: 278113 - protein, 13 aa, Mycobacterium
QKATVSAGEARGL

SEQ ID NO: 278114 - protein, 7 aa, Mycobacterium
QKDARIH

SEQ ID NO: 278115 - protein, 12 aa, Mycobacterium
QKDDAAKEALAA

SEQ ID NO: 278116 - protein, 8 aa, Mycobacterium
QKDNPDEV

SEQ ID NO: 278117 - protein, 4 aa, Mycobacterium
QKDQ

SEQ ID NO: 278118 - protein, 24 aa, Mycobacterium
QKESLERDVREAESAPALAEAARK

SEQ ID NO: 278119 - protein, 7 aa, Mycobacterium
QKETIPD

SEQ ID NO: 278120 - protein, 47 aa, Mycobacterium
QKFADAATAAFTESAVGSDLTVSPEQRRTGLPTDPVTGLTSQTAAGP

SEQ ID NO: 278121 - protein, 7 aa, Mycobacterium
QKFTGGK

SEQ ID NO: 278122 - protein, 7 aa, Mycobacterium
QKGLQEQ

SEQ ID NO: 278123 - protein, 15 aa, Mycobacterium
QKGLSTKGGPTGVAN

SEQ ID NO: 278124 - protein, 16 aa, Mycobacterium
QKGLSTKGGPTGVANS

SEQ ID NO: 278125 - protein, 5 aa, Mycobacterium
QKGNP

SEQ ID NO: 278126 - protein, 6 aa, Mycobacterium
QKGQKR

SEQ ID NO: 278127 - protein, 10 aa, Mycobacterium
QKGRARSQPV

SEQ ID NO: 278128 - protein, 9 aa, Mycobacterium
QKKAGLDPT

SEQ ID NO: 278129 - protein, 7 aa, Mycobacterium
QKKDDVR

SEQ ID NO: 278130 - protein, 17 aa, Mycobacterium
QKKGGGAAGPDDSVRVT

SEQ ID NO: 278131 - protein, 4 aa, Mycobacterium
QKKL

SEQ ID NO: 278132 - protein, 6 aa, Mycobacterium
QKLGDE

SEQ ID NO: 278133 - protein, 6 aa, Mycobacterium
QKLGGG

SEQ ID NO: 278134 - protein, 9 aa, Mycobacterium
QKPATHRQT

SEQ ID NO: 278135 - protein, 9 aa, Mycobacterium
QKPEETQRT

SEQ ID NO: 278136 - protein, 7 aa, Mycobacterium
QKPGESF

SEQ ID NO: 278137 - protein, 7 aa, Mycobacterium
QKPLGAD

SEQ ID NO: 278138 - protein, 10 aa, Mycobacterium
QKPQETERTF

SEQ ID NO: 278139 - protein, 6 aa, Mycobacterium
QKQADD

SEQ ID NO: 278140 - protein, 7 aa, Mycobacterium
QKRGRKG

SEQ ID NO: 278141 - protein, 11 aa, Mycobacterium
QKRPAGPEQDE

SEQ ID NO: 278142 - protein, 8 aa, Mycobacterium
QKRYDSKG

SEQ ID NO: 278143 - protein, 10 aa, Mycobacterium
QKSAATSAEA

SEQ ID NO: 278144 - protein, 15 aa, Mycobacterium
QKSIYSKAEGQTGAA

SEQ ID NO: 278145 - protein, 7 aa, Mycobacterium
QKSLEGT

SEQ ID NO: 278146 - protein, 5 aa, Mycobacterium
QKSTI

SEQ ID NO: 278147 - protein, 15 aa, Mycobacterium
QKSVYRKAEGQTGAA

SEQ ID NO: 278148 - protein, 9 aa, Mycobacterium
QKTAGTVQA

SEQ ID NO: 278149 - protein, 4 aa, Mycobacterium
QKTG

SEQ ID NO: 278150 - protein, 12 aa, Mycobacterium
QKTIASSSRRRV

SEQ ID NO: 278151 - protein, 16 aa, Mycobacterium
QKTPSGRYERCSPQHS

SEQ ID NO: 278152 - protein, 9 aa, Mycobacterium
QKTQSAEEI

SEQ ID NO: 278153 - protein, 10 aa, Mycobacterium
QKTQTAEEIA

SEQ ID NO: 278154 - protein, 19 aa, Mycobacterium
QKVDHKNVNADWDDTTNSV

SEQ ID NO: 278155 - protein, 9 aa, Mycobacterium
QKVDHNNVN

SEQ ID NO: 278156 - protein, 4 aa, Mycobacterium
QKVN

SEQ ID NO: 278157 - protein, 5 aa, Mycobacterium
QKVNT

SEQ ID NO: 278158 - protein, 6 aa, Mycobacterium
QKYGES

SEQ ID NO: 278159 - protein, 10 aa, Mycobacterium
QKYHESDSDS

SEQ ID NO: 278160 - protein, 6 aa, Mycobacterium
QLAAGA

SEQ ID NO: 278161 - protein, 10 aa, Mycobacterium
QLAANGEKTY

SEQ ID NO: 278162 - protein, 11 aa, Mycobacterium
QLAENRPPQEV

SEQ ID NO: 278163 - protein, 6 aa, Mycobacterium
QLAGDR

SEQ ID NO: 278164 - protein, 7 aa, Mycobacterium
QLAGGKV

SEQ ID NO: 278165 - protein, 8 aa, Mycobacterium
QLAKQASH

SEQ ID NO: 278166 - protein, 16 aa, Mycobacterium
QLANSASEHHDGSQYR

SEQ ID NO: 278167 - protein, 16 aa, Mycobacterium
QLANSASQQHADGQYR

SEQ ID NO: 278168 - protein, 10 aa, Mycobacterium
QLAPAGSDLG

SEQ ID NO: 278169 - protein, 7 aa, Mycobacterium
QLAPHTR

SEQ ID NO: 278170 - protein, 12 aa, Mycobacterium
QLAQENHQAPVG

SEQ ID NO: 278171 - protein, 9 aa, Mycobacterium
QLASGAQAL

SEQ ID NO: 278172 - protein, 10 aa, Mycobacterium
QLASGAQALA

SEQ ID NO: 278173 - protein, 5 aa, Mycobacterium
QLAST

SEQ ID NO: 278174 - protein, 6 aa, Mycobacterium
QLDDLG

SEQ ID NO: 278175 - protein, 9 aa, Mycobacterium
QLDDPDLAR

SEQ ID NO: 278176 - protein, 6 aa, Mycobacterium
QLDDSG

SEQ ID NO: 278177 - protein, 9 aa, Mycobacterium
QLDDTTDMK

SEQ ID NO: 278178 - protein, 4 aa, Mycobacterium
QLDE

SEQ ID NO: 278179 - protein, 15 aa, Mycobacterium
QLDEQTEELRRSNAE

SEQ ID NO: 278180 - protein, 4 aa, Mycobacterium
QLDP

SEQ ID NO: 278181 - protein, 8 aa, Mycobacterium
QLDPTPIT

SEQ ID NO: 278182 - protein, 12 aa, Mycobacterium
QLDSAPASDRAR

SEQ ID NO: 278183 - protein, 4 aa, Mycobacterium
QLED

SEQ ID NO: 278184 - protein, 10 aa, Mycobacterium
QLEQVGQENA

SEQ ID NO: 278185 - protein, 14 aa, Mycobacterium
QLESTEGDETLDEA

SEQ ID NO: 278186 - protein, 9 aa, Mycobacterium
QLGADEASH

SEQ ID NO: 278187 - protein, 6 aa, Mycobacterium
QLGASR

SEQ ID NO: 278188 - protein, 7 aa, Mycobacterium
QLGDNTA

SEQ ID NO: 278189 - protein, 4 aa, Mycobacterium
QLGE

SEQ ID NO: 278190 - protein, 9 aa, Mycobacterium
QLGPGRDGV

SEQ ID NO: 278191 - protein, 5 aa, Mycobacterium
QLGPV

SEQ ID NO: 278192 - protein, 4 aa, Mycobacterium
QLGT

SEQ ID NO: 278193 - protein, 26 aa, Mycobacterium
QLHGGTASLQDSPLGGARLLLKLPGP

SEQ ID NO: 278194 - protein, 20 aa, Mycobacterium
QLKPGSVPRSVPVGAGEYRT

SEQ ID NO: 278195 - protein, 8 aa, Mycobacterium
QLKRERDA

SEQ ID NO: 278196 - protein, 7 aa, Mycobacterium
QLNGAPQ

SEQ ID NO: 278197 - protein, 5 aa, Mycobacterium
QLNGV

SEQ ID NO: 278198 - protein, 15 aa, Mycobacterium
QLNPQQARSVLDDPD

SEQ ID NO: 278199 - protein, 11 aa, Mycobacterium
QLNPTTAESGL

SEQ ID NO: 278200 - protein, 4 aa, Mycobacterium
QLNS

SEQ ID NO: 278201 - protein, 7 aa, Mycobacterium
QLPAANS

SEQ ID NO: 278202 - protein, 10 aa, Mycobacterium
QLPAEPAELA

SEQ ID NO: 278203 - protein, 8 aa, Mycobacterium
QLPAGQRA

SEQ ID NO: 278204 - protein, 9 aa, Mycobacterium
QLPAGTADH

SEQ ID NO: 278205 - protein, 9 aa, Mycobacterium
QLPAPTADF

SEQ ID NO: 278206 - protein, 11 aa, Mycobacterium
QLPGGNTFSGW

SEQ ID NO: 278207 - protein, 11 aa, Mycobacterium
QLPGLRPGTGL

SEQ ID NO: 278208 - protein, 6 aa, Mycobacterium
QLPGQR

SEQ ID NO: 278209 - protein, 7 aa, Mycobacterium
QLPPGFD

SEQ ID NO: 278210 - protein, 9 aa, Mycobacterium
QLPPGLTKE

SEQ ID NO: 278211 - protein, 13 aa, Mycobacterium
QLPPLPKGTTATV

SEQ ID NO: 278212 - protein, 10 aa, Mycobacterium
QLPPLPRATT

SEQ ID NO: 278213 - protein, 12 aa, Mycobacterium
QLPPLPRATTST

SEQ ID NO: 278214 - protein, 36 aa, Mycobacterium
QLPPPTATYTPTPTSTPPPPPPPPVTTTTTPPPGQL

SEQ ID NO: 278215 - protein, 5 aa, Mycobacterium
QLPPQ

SEQ ID NO: 278216 - protein, 17 aa, Mycobacterium
QLPPQLPLPDAATALPP

SEQ ID NO: 278217 - protein, 5 aa, Mycobacterium
QLPQQ

SEQ ID NO: 278218 - protein, 24 aa, Mycobacterium
QLPQRRAGAAPKAIPLGAGEYKTS

SEQ ID NO: 278219 - protein, 17 aa, Mycobacterium
QLPSCPAANPDPGTPAL

SEQ ID NO: 278220 - protein, 9 aa, Mycobacterium
QLPSEQPEL

SEQ ID NO: 278221 - protein, 21 aa, Mycobacterium
QLPSPAKSTKSTKSTGPARQH

SEQ ID NO: 278222 - protein, 13 aa, Mycobacterium
QLPSTSVSDAGAN

SEQ ID NO: 278223 - protein, 14 aa, Mycobacterium
QLPSTSVSDSGAKY

SEQ ID NO: 278224 - protein, 6 aa, Mycobacterium
QLPTGD

SEQ ID NO: 278225 - protein, 15 aa, Mycobacterium
QLQGGADTAAANAPR

SEQ ID NO: 278226 - protein, 5 aa, Mycobacterium
QLQPG

SEQ ID NO: 278227 - protein, 19 aa, Mycobacterium
QLQQGADRFAGGSRQVADG

SEQ ID NO: 278228 - protein, 42 aa, Mycobacterium
QLQQGQQRQNGNQKLPKAPSRDKKQDDKDQQDRDDQSGDNDL

SEQ ID NO: 278229 - protein, 43 aa, Mycobacterium
QLQQQGQQRQNGNQKLPKAPSKDKKQDDKDQQDRDDQSGDNDL

SEQ ID NO: 278230 - protein, 9 aa, Mycobacterium
QLQRGRTAD

SEQ ID NO: 278231 - protein, 4 aa, Mycobacterium
QLQS

SEQ ID NO: 278232 - protein, 6 aa, Mycobacterium
QLRAES

SEQ ID NO: 278233 - protein, 18 aa, Mycobacterium
QLRDGAQQVATGNAELAG

SEQ ID NO: 278234 - protein, 6 aa, Mycobacterium
QLRGDD

SEQ ID NO: 278235 - protein, 13 aa, Mycobacterium
QLRPDGDKTGVTV

SEQ ID NO: 278236 - protein, 15 aa, Mycobacterium
QLRPEQATAAAADPD

SEQ ID NO: 278237 - protein, 5 aa, Mycobacterium
QLRPG

SEQ ID NO: 278238 - protein, 42 aa, Mycobacterium
QLRSDVPSLPATRPAPSSRRGIPTTDGGGGPTSSAEIGPGPV

SEQ ID NO: 278239 - protein, 7 aa, Mycobacterium
QLRSGSA

SEQ ID NO: 278240 - protein, 9 aa, Mycobacterium
QLSAGTQMS

SEQ ID NO: 278241 - protein, 19 aa, Mycobacterium
QLSDDTSESIVGPAAPDYG

SEQ ID NO: 278242 - protein, 11 aa, Mycobacterium
QLSGGNAYNAA

SEQ ID NO: 278243 - protein, 12 aa, Mycobacterium
QLSGGNAYNAAS

SEQ ID NO: 278244 - protein, 12 aa, Mycobacterium
QLSGGNAYNAAT

SEQ ID NO: 278245 - protein, 11 aa, Mycobacterium
QLSGGNSYNAA

SEQ ID NO: 278246 - protein, 6 aa, Mycobacterium
QLSGGQ

SEQ ID NO: 278247 - protein, 17 aa, Mycobacterium
QLSGGRLDRNGIRPLET

SEQ ID NO: 278248 - protein, 12 aa, Mycobacterium
QLSGSANGLGRV

SEQ ID NO: 278249 - protein, 4 aa, Mycobacterium
QLSR

SEQ ID NO: 278250 - protein, 12 aa, Mycobacterium
QLSSHKSVTDTL

SEQ ID NO: 278251 - protein, 7 aa, Mycobacterium
QLSTGGS

SEQ ID NO: 278252 - protein, 5 aa, Mycobacterium
QLTAG

SEQ ID NO: 278253 - protein, 37 aa, Mycobacterium
QLTAPGAAELPTTTTVPASTGVWGPSRREVRTPASAR

SEQ ID NO: 278254 - protein, 9 aa, Mycobacterium
QLTDAENAS

SEQ ID NO: 278255 - protein, 4 aa, Mycobacterium
QLTE

SEQ ID NO: 278256 - protein, 14 aa, Mycobacterium
QLTGAEADGRSDQY

SEQ ID NO: 278257 - protein, 5 aa, Mycobacterium
QLTGI

SEQ ID NO: 278258 - protein, 5 aa, Mycobacterium
QLTPG

SEQ ID NO: 278259 - protein, 38 aa, Mycobacterium
QLTPPAAGELPGAAAVPAETGAWSATRREVRAPASQTP

SEQ ID NO: 278260 - protein, 5 aa, Mycobacterium
QLTSE

SEQ ID NO: 278261 - protein, 5 aa, Mycobacterium
QLTTE

SEQ ID NO: 278262 - protein, 5 aa, Mycobacterium
QMGAD

SEQ ID NO: 278263 - protein, 8 aa, Mycobacterium
QMGPGSPW

SEQ ID NO: 278264 - protein, 11 aa, Mycobacterium
QMGSSKTGTRS

SEQ ID NO: 278265 - protein, 6 aa, Mycobacterium
QMPAPG

SEQ ID NO: 278266 - protein, 17 aa, Mycobacterium
QMPEAPPVDAPAETVPA

SEQ ID NO: 278267 - protein, 17 aa, Mycobacterium
QMPPRPPGGAEGEAAAS

SEQ ID NO: 278268 - protein, 8 aa, Mycobacterium
QMQANESV

SEQ ID NO: 278269 - protein, 15 aa, Mycobacterium
QMSPREQAFERPTRP

SEQ ID NO: 278270 - protein, 9 aa, Mycobacterium
QNAAATAWS

SEQ ID NO: 278271 - protein, 16 aa, Mycobacterium
QNAAMPKGEEDPCFAG

SEQ ID NO: 278272 - protein, 7 aa, Mycobacterium
QNAAPGK

SEQ ID NO: 278273 - protein, 16 aa, Mycobacterium
QNAGAGASFPGAPGPI

SEQ ID NO: 278274 - protein, 16 aa, Mycobacterium
QNAGSAASFPGAPGPI

SEQ ID NO: 278275 - protein, 5 aa, Mycobacterium
QNANA

SEQ ID NO: 278276 - protein, 14 aa, Mycobacterium
QNAPGQPASRSAPA

SEQ ID NO: 278277 - protein, 12 aa, Mycobacterium
QNAPGQPPSQVA

SEQ ID NO: 278278 - protein, 7 aa, Mycobacterium
QNARAGA

SEQ ID NO: 278279 - protein, 6 aa, Mycobacterium
QNASRE

SEQ ID NO: 278280 - protein, 10 aa, Mycobacterium
QNATAAGLDP

SEQ ID NO: 278281 - protein, 10 aa, Mycobacterium
QNATGRTGQL

SEQ ID NO: 278282 - protein, 11 aa, Mycobacterium
QNDATTVRGAR

SEQ ID NO: 278283 - protein, 12 aa, Mycobacterium
QNDDGTYEVGRP

SEQ ID NO: 278284 - protein, 12 aa, Mycobacterium
QNDKGTYEVGRP

SEQ ID NO: 278285 - protein, 5 aa, Mycobacterium
QNDNL

SEQ ID NO: 278286 - protein, 5 aa, Mycobacterium
QNDPQ

SEQ ID NO: 278287 - protein, 6 aa, Mycobacterium
QNEAAP

SEQ ID NO: 278288 - protein, 11 aa, Mycobacterium
QNESNRATPNL

SEQ ID NO: 278289 - protein, 7 aa, Mycobacterium
QNETRPL

SEQ ID NO: 278290 - protein, 14 aa, Mycobacterium
QNGATPTPLKPVGP

SEQ ID NO: 278291 - protein, 28 aa, Mycobacterium
QNGGTPHDAAAATVNNTGITPAQASAGI

SEQ ID NO: 278292 - protein, 24 aa, Mycobacterium
QNGNQPPPAPAPQEQVRDTSERGS

SEQ ID NO: 278293 - protein, 7 aa, Mycobacterium
QNGPDLA

SEQ ID NO: 278294 - protein, 8 aa, Mycobacterium
QNGPHQSA

SEQ ID NO: 278295 - protein, 6 aa, Mycobacterium
QNGQLN

SEQ ID NO: 278296 - protein, 7 aa, Mycobacterium
QNGQLNS

SEQ ID NO: 278297 - protein, 7 aa, Mycobacterium
QNGQPGA

SEQ ID NO: 278298 - protein, 7 aa, Mycobacterium
QNGSGTF

SEQ ID NO: 278299 - protein, 4 aa, Mycobacterium
QNGT

SEQ ID NO: 278300 - protein, 7 aa, Mycobacterium
QNGTPGK

SEQ ID NO: 278301 - protein, 4 aa, Mycobacterium
QNHS

SEQ ID NO: 278302 - protein, 14 aa, Mycobacterium
QNLATADDVERNAT

SEQ ID NO: 278303 - protein, 7 aa, Mycobacterium
QNLSDMP

SEQ ID NO: 278304 - protein, 5 aa, Mycobacterium
QNNCD

SEQ ID NO: 278305 - protein, 6 aa, Mycobacterium
QNNCDS

SEQ ID NO: 278306 - protein, 5 aa, Mycobacterium
QNNLN

SEQ ID NO: 278307 - protein, 16 aa, Mycobacterium
QNPAESATPPPAPTGL

SEQ ID NO: 278308 - protein, 6 aa, Mycobacterium
QNPDFE

SEQ ID NO: 278309 - protein, 8 aa, Mycobacterium
QNPGAPDM

SEQ ID NO: 278310 - protein, 9 aa, Mycobacterium
QNPGQPGEV

SEQ ID NO: 278311 - protein, 6 aa, Mycobacterium
QNPGWR

SEQ ID NO: 278312 - protein, 7 aa, Mycobacterium
QNPLGAD

SEQ ID NO: 278313 - protein, 6 aa, Mycobacterium
QNPPID

SEQ ID NO: 278314 - protein, 8 aa, Mycobacterium
QNPQAQRR

SEQ ID NO: 278315 - protein, 8 aa, Mycobacterium
QNPSTDAN

SEQ ID NO: 278316 - protein, 9 aa, Mycobacterium
QNQAQSQHA

SEQ ID NO: 278317 - protein, 10 aa, Mycobacterium
QNQTTGPNGL

SEQ ID NO: 278318 - protein, 59 aa, Mycobacterium
QNRGIGTVATGGSLELPRGTTARTSSGTRISKSDGSGSVSRSPSVSRGGFGSSSSGSSG

SEQ ID NO: 278319 - protein, 7 aa, Mycobacterium
QNRSATP

SEQ ID NO: 278320 - protein, 7 aa, Mycobacterium
QNRSGRT

SEQ ID NO: 278321 - protein, 8 aa, Mycobacterium
QNSARGKA

SEQ ID NO: 278322 - protein, 4 aa, Mycobacterium
QNSG

SEQ ID NO: 278323 - protein, 8 aa, Mycobacterium
QNSGEAAA

SEQ ID NO: 278324 - protein, 9 aa, Mycobacterium
QNSRRRSTR

SEQ ID NO: 278325 - protein, 12 aa, Mycobacterium
QNSSSRAQRLAD

SEQ ID NO: 278326 - protein, 7 aa, Mycobacterium
QNSTAMG

SEQ ID NO: 278327 - protein, 6 aa, Mycobacterium
QNTGRT

SEQ ID NO: 278328 - protein, 5 aa, Mycobacterium
QNTLG

SEQ ID NO: 278329 - protein, 11 aa, Mycobacterium
QNTNDGGPSRA

SEQ ID NO: 278330 - protein, 11 aa, Mycobacterium
QNTNQGGPSRA

SEQ ID NO: 278331 - protein, 10 aa, Mycobacterium
QNTPAEPPLA

SEQ ID NO: 278332 - protein, 8 aa, Mycobacterium
QNTSTAGV

SEQ ID NO: 278333 - protein, 4 aa, Mycobacterium
QNTT

SEQ ID NO: 278334 - protein, 8 aa, Mycobacterium
QNTTQQLN

SEQ ID NO: 278335 - protein, 13 aa, Mycobacterium
QNTVGSSGASRTT

SEQ ID NO: 278336 - protein, 9 aa, Mycobacterium
QNVGELDKP

SEQ ID NO: 278337 - protein, 15 aa, Mycobacterium
QPAAAGPRLPARGVD

SEQ ID NO: 278338 - protein, 13 aa, Mycobacterium
QPAAESTGAAARP

SEQ ID NO: 278339 - protein, 18 aa, Mycobacterium
QPAAPAPNAAGRRPATGG

SEQ ID NO: 278340 - protein, 6 aa, Mycobacterium
QPAAPE

SEQ ID NO: 278341 - protein, 10 aa, Mycobacterium
QPAASQRTYG

SEQ ID NO: 278342 - protein, 11 aa, Mycobacterium
QPADGGGQLRH

SEQ ID NO: 278343 - protein, 10 aa, Mycobacterium
QPAGATPIAD

SEQ ID NO: 278344 - protein, 5 aa, Mycobacterium
QPAGL

SEQ ID NO: 278345 - protein, 9 aa, Mycobacterium
QPAGLSGGT

SEQ ID NO: 278346 - protein, 9 aa, Mycobacterium
QPAGPRGPA

SEQ ID NO: 278347 - protein, 7 aa, Mycobacterium
QPAGTTL

SEQ ID NO: 278348 - protein, 4 aa, Mycobacterium
QPAI

SEQ ID NO: 278349 - protein, 11 aa, Mycobacterium
QPAIGREAAPA

SEQ ID NO: 278350 - protein, 5 aa, Mycobacterium
QPALA

SEQ ID NO: 278351 - protein, 8 aa, Mycobacterium
QPAPEGAS

SEQ ID NO: 278352 - protein, 13 aa, Mycobacterium
QPAPEPGRTTEDL

SEQ ID NO: 278353 - protein, 30 aa, Mycobacterium
QPAPGQTFGPDGPLGGSNPVGFKPDGVGTD

SEQ ID NO: 278354 - protein, 11 aa, Mycobacterium
QPAPPDPRKDL

SEQ ID NO: 278355 - protein, 17 aa, Mycobacterium
QPAPQGTGAWSSAAADE

SEQ ID NO: 278356 - protein, 10 aa, Mycobacterium
QPAPRPSSLR

SEQ ID NO: 278357 - protein, 76 aa, Mycobacterium
QPAPSYPGPQPYPGQQGHAGHQQGYPGGQGRSGQQGQAQPSYPPYPPYPPPGQPAQEGGSPDRQDDDVSRSNPPAH

SEQ ID NO: 278358 - protein, 7 aa, Mycobacterium
QPAQIEY

SEQ ID NO: 278359 - protein, 7 aa, Mycobacterium
QPAQKDS

SEQ ID NO: 278360 - protein, 4 aa, Mycobacterium
QPAS

SEQ ID NO: 278361 - protein, 23 aa, Mycobacterium
QPASNTAATAGATASAVSPEGRS

SEQ ID NO: 278362 - protein, 9 aa, Mycobacterium
QPASSGRYQ

SEQ ID NO: 278363 - protein, 34 aa, Mycobacterium
QPASVGVPPADAGLATASAKPVAAHTGAKPLWDS

SEQ ID NO: 278364 - protein, 15 aa, Mycobacterium
QPATAAGAQSSDGRA

SEQ ID NO: 278365 - protein, 11 aa, Mycobacterium
QPATDARRPRE

SEQ ID NO: 278366 - protein, 24 aa, Mycobacterium
QPATVATGPANAGLATASAAPVAA

SEQ ID NO: 278367 - protein, 5 aa, Mycobacterium
QPAVG

SEQ ID NO: 278368 - protein, 13 aa, Mycobacterium
QPDARVPRPAPSG

SEQ ID NO: 278369 - protein, 11 aa, Mycobacterium
QPDDGITRTRV

SEQ ID NO: 278370 - protein, 9 aa, Mycobacterium
QPDDPGRYA

SEQ ID NO: 278371 - protein, 8 aa, Mycobacterium
QPDDPRDW

SEQ ID NO: 278372 - protein, 19 aa, Mycobacterium
QPDEPDEGTEAEAGADQTR

SEQ ID NO: 278373 - protein, 5 aa, Mycobacterium
QPDGS

SEQ ID NO: 278374 - protein, 33 aa, Mycobacterium
QPDIPADPDRGAGSRPRRPDRLNGDADTRGPIP

SEQ ID NO: 278375 - protein, 46 aa, Mycobacterium
QPDIPADRNPERPSDQRNGGAAPESRRGPAAFDAPRDRGNDPAGDD

SEQ ID NO: 278376 - protein, 32 aa, Mycobacterium
QPDIPAGPDRGRGASQRPSDQSNGDSVGYTRG

SEQ ID NO: 278377 - protein, 8 aa, Mycobacterium
QPDKPARL

SEQ ID NO: 278378 - protein, 8 aa, Mycobacterium
QPDNAAAV

SEQ ID NO: 278379 - protein, 5 aa, Mycobacterium
QPDPT

SEQ ID NO: 278380 - protein, 4 aa, Mycobacterium
QPDQ

SEQ ID NO: 278381 - protein, 7 aa, Mycobacterium
QPDQPTR

SEQ ID NO: 278382 - protein, 8 aa, Mycobacterium
QPDRPPAK

SEQ ID NO: 278383 - protein, 9 aa, Mycobacterium
QPDSTRAEA

SEQ ID NO: 278384 - protein, 6 aa, Mycobacterium
QPDTSS

SEQ ID NO: 278385 - protein, 14 aa, Mycobacterium
QPDTTRARGDSDGL

SEQ ID NO: 278386 - protein, 26 aa, Mycobacterium
QPEADPAALPKDSSPSATAGMQSSAC

SEQ ID NO: 278387 - protein, 13 aa, Mycobacterium
QPEAEPEPDARPE

SEQ ID NO: 278388 - protein, 14 aa, Mycobacterium
QPECATGDTASDTT

SEQ ID NO: 278389 - protein, 14 aa, Mycobacterium
QPECATGDTASKTT

SEQ ID NO: 278390 - protein, 15 aa, Mycobacterium
QPECISGDRASKTGV

SEQ ID NO: 278391 - protein, 35 aa, Mycobacterium
QPEGADRPEDFSTPSPARDEPPRGPDASAARRPDA

SEQ ID NO: 278392 - protein, 38 aa, Mycobacterium
QPEGGADAGDEEPQIDPDAVDTTPTRIPTPSEVAGDSP

SEQ ID NO: 278393 - protein, 12 aa, Mycobacterium
QPEGPGSLPNKT

SEQ ID NO: 278394 - protein, 12 aa, Mycobacterium
QPEHATTAANNV

SEQ ID NO: 278395 - protein, 9 aa, Mycobacterium
QPEKPTDRK

SEQ ID NO: 278396 - protein, 9 aa, Mycobacterium
QPELDPGHA

SEQ ID NO: 278397 - protein, 7 aa, Mycobacterium
QPEMAPE

SEQ ID NO: 278398 - protein, 31 aa, Mycobacterium
QPEPGVDQTGPLGDEREPDADTADPGDDAAI

SEQ ID NO: 278399 - protein, 9 aa, Mycobacterium
QPEPRDGLE

SEQ ID NO: 278400 - protein, 7 aa, Mycobacterium
QPESLSD

SEQ ID NO: 278401 - protein, 6 aa, Mycobacterium
QPEVDA

SEQ ID NO: 278402 - protein, 16 aa, Mycobacterium
QPEVPAGRPPRTAPIP

SEQ ID NO: 278403 - protein, 4 aa, Mycobacterium
QPFA

SEQ ID NO: 278404 - protein, 4 aa, Mycobacterium
QPFD

SEQ ID NO: 278405 - protein, 5 aa, Mycobacterium
QPFEF

SEQ ID NO: 278406 - protein, 5 aa, Mycobacterium
QPFGG

SEQ ID NO: 278407 - protein, 6 aa, Mycobacterium
QPFPSP

SEQ ID NO: 278408 - protein, 8 aa, Mycobacterium
QPFTEQDR

SEQ ID NO: 278409 - protein, 7 aa, Mycobacterium
QPGEQVT

SEQ ID NO: 278410 - protein, 14 aa, Mycobacterium
QPGETRVAATPQTV

SEQ ID NO: 278411 - protein, 8 aa, Mycobacterium
QPGGRGGY

SEQ ID NO: 278412 - protein, 14 aa, Mycobacterium
QPGGTNRGRIPSYD

SEQ ID NO: 278413 - protein, 6 aa, Mycobacterium
QPGKHD

SEQ ID NO: 278414 - protein, 4 aa, Mycobacterium
QPGM

SEQ ID NO: 278415 - protein, 7 aa, Mycobacterium
QPGPATD

SEQ ID NO: 278416 - protein, 9 aa, Mycobacterium
QPGPGGAFT

SEQ ID NO: 278417 - protein, 24 aa, Mycobacterium
QPGPNGTFTGEYRGAASNSCAEKR

SEQ ID NO: 278418 - protein, 15 aa, Mycobacterium
QPGPPLQPLPPQAAG

SEQ ID NO: 278419 - protein, 6 aa, Mycobacterium
QPGPPY

SEQ ID NO: 278420 - protein, 19 aa, Mycobacterium
QPGPSPVPVATKTGPAAAT

SEQ ID NO: 278421 - protein, 6 aa, Mycobacterium
QPGPTL

SEQ ID NO: 278422 - protein, 4 aa, Mycobacterium
QPGQ

SEQ ID NO: 278423 - protein, 9 aa, Mycobacterium
QPGQGKERH

SEQ ID NO: 278424 - protein, 9 aa, Mycobacterium
QPGQGRERR

SEQ ID NO: 278425 - protein, 5 aa, Mycobacterium
QPGRH

SEQ ID NO: 278426 - protein, 7 aa, Mycobacterium
QPGRPHI

SEQ ID NO: 278427 - protein, 16 aa, Mycobacterium
QPGRTYDVSSPDLPTV

SEQ ID NO: 278428 - protein, 12 aa, Mycobacterium
QPGSPPKASELE

SEQ ID NO: 278429 - protein, 23 aa, Mycobacterium
QPGSYKPPPDIAPPPGTVFPPPA

SEQ ID NO: 278430 - protein, 9 aa, Mycobacterium
QPGTGGHDG

SEQ ID NO: 278431 - protein, 8 aa, Mycobacterium
QPGTHDER

SEQ ID NO: 278432 - protein, 5 aa, Mycobacterium
QPGTK

SEQ ID NO: 278433 - protein, 9 aa, Mycobacterium
QPGTYRRGG

SEQ ID NO: 278434 - protein, 5 aa, Mycobacterium
QPGVN

SEQ ID NO: 278435 - protein, 12 aa, Mycobacterium
QPHEPSTRETAT

SEQ ID NO: 278436 - protein, 30 aa, Mycobacterium
QPHGVTPTIPPAPPVPPAPGEPAPIPPAPV

SEQ ID NO: 278437 - protein, 4 aa, Mycobacterium
QPHR

SEQ ID NO: 278438 - protein, 8 aa, Mycobacterium
QPHRPKEV

SEQ ID NO: 278439 - protein, 8 aa, Mycobacterium
QPHTPDIP

SEQ ID NO: 278440 - protein, 6 aa, Mycobacterium
QPIGAG

SEQ ID NO: 278441 - protein, 7 aa, Mycobacterium
QPIGPGT

SEQ ID NO: 278442 - protein, 15 aa, Mycobacterium
QPIPRPSAARPGIPA

SEQ ID NO: 278443 - protein, 14 aa, Mycobacterium
QPIPTGPSPSLGAA

SEQ ID NO: 278444 - protein, 8 aa, Mycobacterium
QPISAPAM

SEQ ID NO: 278445 - protein, 6 aa, Mycobacterium
QPISSP

SEQ ID NO: 278446 - protein, 6 aa, Mycobacterium
QPITSP

SEQ ID NO: 278447 - protein, 9 aa, Mycobacterium
QPKEVVESE

SEQ ID NO: 278448 - protein, 16 aa, Mycobacterium
QPKGADGQPSKQVISD

SEQ ID NO: 278449 - protein, 5 aa, Mycobacterium
QPKTA

SEQ ID NO: 278450 - protein, 8 aa, Mycobacterium
QPLDTTTM

SEQ ID NO: 278451 - protein, 5 aa, Mycobacterium
QPLEK

SEQ ID NO: 278452 - protein, 5 aa, Mycobacterium
QPLGA

SEQ ID NO: 278453 - protein, 9 aa, Mycobacterium
QPLQSHTGS

SEQ ID NO: 278454 - protein, 9 aa, Mycobacterium
QPLRGHSDT

SEQ ID NO: 278455 - protein, 6 aa, Mycobacterium
QPLSPA

SEQ ID NO: 278456 - protein, 12 aa, Mycobacterium
QPLSTHANRGYQ

SEQ ID NO: 278457 - protein, 6 aa, Mycobacterium
QPNGYG

SEQ ID NO: 278458 - protein, 12 aa, Mycobacterium
QPNHPTDDPRGV

SEQ ID NO: 278459 - protein, 8 aa, Mycobacterium
QPNPDTRP

SEQ ID NO: 278460 - protein, 6 aa, Mycobacterium
QPNPSG

SEQ ID NO: 278461 - protein, 4 aa, Mycobacterium
QPNR

SEQ ID NO: 278462 - protein, 4 aa, Mycobacterium
QPNT

SEQ ID NO: 278463 - protein, 5 aa, Mycobacterium
QPNVS

SEQ ID NO: 278464 - protein, 13 aa, Mycobacterium
QPPAAASPRRPGT

SEQ ID NO: 278465 - protein, 13 aa, Mycobacterium
QPPAAVPAKRTGP

SEQ ID NO: 278466 - protein, 18 aa, Mycobacterium
QPPAPPPSAWAPAPAEGQ

SEQ ID NO: 278467 - protein, 9 aa, Mycobacterium
QPPAPVSAN

SEQ ID NO: 278468 - protein, 5 aa, Mycobacterium
QPPDV

SEQ ID NO: 278469 - protein, 6 aa, Mycobacterium
QPPDVS

SEQ ID NO: 278470 - protein, 4 aa, Mycobacterium
QPPF

SEQ ID NO: 278471 - protein, 10 aa, Mycobacterium
QPPFGSGNSL

SEQ ID NO: 278472 - protein, 5 aa, Mycobacterium
QPPGL

SEQ ID NO: 278473 - protein, 7 aa, Mycobacterium
QPPGNPL

SEQ ID NO: 278474 - protein, 20 aa, Mycobacterium
QPPGQGQGSDHSSDPTQVAP

SEQ ID NO: 278475 - protein, 30 aa, Mycobacterium
QPPGQGSDQSAEPTQVGSPWQQQPGQEATW

SEQ ID NO: 278476 - protein, 8 aa, Mycobacterium
QPPGSPVP

SEQ ID NO: 278477 - protein, 12 aa, Mycobacterium
QPPGVPPVPPQL

SEQ ID NO: 278478 - protein, 43 aa, Mycobacterium
QPPGYGPQPNPQGPPPPPPGYPSPQGYPGYPGYPGYGGYPGYV

SEQ ID NO: 278479 - protein, 4 aa, Mycobacterium
QPPH

SEQ ID NO: 278480 - protein, 22 aa, Mycobacterium
QPPHQPLPESTADLARYGQPAY

SEQ ID NO: 278481 - protein, 5 aa, Mycobacterium
QPPIT

SEQ ID NO: 278482 - protein, 6 aa, Mycobacterium
QPPITD

SEQ ID NO: 278483 - protein, 20 aa, Mycobacterium
QPPKAPSKLARTPSTARSGA

SEQ ID NO: 278484 - protein, 4 aa, Mycobacterium
QPPL

SEQ ID NO: 278485 - protein, 6 aa, Mycobacterium
QPPLGD

SEQ ID NO: 278486 - protein, 5 aa, Mycobacterium
QPPNA

SEQ ID NO: 278487 - protein, 5 aa, Mycobacterium
QPPNT

SEQ ID NO: 278488 - protein, 4 aa, Mycobacterium
QPPP

SEQ ID NO: 278489 - protein, 5 aa, Mycobacterium
QPPPC

SEQ ID NO: 278490 - protein, 5 aa, Mycobacterium
QPPPL

SEQ ID NO: 278491 - protein, 13 aa, Mycobacterium
QPPPPAPPGPEHP

SEQ ID NO: 278492 - protein, 20 aa, Mycobacterium
QPPPPPGPVPGPGQPAAAPP

SEQ ID NO: 278493 - protein, 7 aa, Mycobacterium
QPPPQPT

SEQ ID NO: 278494 - protein, 8 aa, Mycobacterium
QPPPQPTW

SEQ ID NO: 278495 - protein, 27 aa, Mycobacterium
QPPQPPGPPPAPGPAVAPPPEAPPAQG

SEQ ID NO: 278496 - protein, 6 aa, Mycobacterium
QPPRRA

SEQ ID NO: 278497 - protein, 5 aa, Mycobacterium
QPPSA

SEQ ID NO: 278498 - protein, 5 aa, Mycobacterium
QPPSR

SEQ ID NO: 278499 - protein, 5 aa, Mycobacterium
QPPST

SEQ ID NO: 278500 - protein, 6 aa, Mycobacterium
QPPTDL

SEQ ID NO: 278501 - protein, 5 aa, Mycobacterium
QPPTE

SEQ ID NO: 278502 - protein, 8 aa, Mycobacterium
QPPTGDDE

SEQ ID NO: 278503 - protein, 12 aa, Mycobacterium
QPPVAPPDIPAE

SEQ ID NO: 278504 - protein, 16 aa, Mycobacterium
QPPVASAPSVPAAPVA

SEQ ID NO: 278505 - protein, 11 aa, Mycobacterium
QPPVPPPDIPA

SEQ ID NO: 278506 - protein, 11 aa, Mycobacterium
QPPVPPPDIPE

SEQ ID NO: 278507 - protein, 12 aa, Mycobacterium
QPPVPPPDIPEE

SEQ ID NO: 278508 - protein, 105 aa, Mycobacterium
QPPYNPPYNPTTPYTPPTITTSQPPTTTYSPPTTTYSPPTTTYSPPTTTYSPPTTTYSPPTTTYSPPTTTHAPPTTTYAPPSTKATTQPPVQTHTQQTAPPTHSQ

SEQ ID NO: 278509 - protein, 16 aa, Mycobacterium
QPQAAESGSALDSSNN

SEQ ID NO: 278510 - protein, 24 aa, Mycobacterium
QPQAPAPAPAAPPPAPEAPPPAPV

SEQ ID NO: 278511 - protein, 8 aa, Mycobacterium
QPQAYNTN

SEQ ID NO: 278512 - protein, 16 aa, Mycobacterium
QPQDPPAGQRGHDQRH

SEQ ID NO: 278513 - protein, 11 aa, Mycobacterium
QPQDTDPQNEV

SEQ ID NO: 278514 - protein, 5 aa, Mycobacterium
QPQEQ

SEQ ID NO: 278515 - protein, 11 aa, Mycobacterium
QPQGPLAAATR

SEQ ID NO: 278516 - protein, 9 aa, Mycobacterium
QPQLASQPA

SEQ ID NO: 278517 - protein, 6 aa, Mycobacterium
QPQLDA

SEQ ID NO: 278518 - protein, 7 aa, Mycobacterium
QPQLDTP

SEQ ID NO: 278519 - protein, 19 aa, Mycobacterium
QPQNAGPPPMFPWMAPAPQ

SEQ ID NO: 278520 - protein, 11 aa, Mycobacterium
QPQNATTREGV

SEQ ID NO: 278521 - protein, 8 aa, Mycobacterium
QPQPGARH

SEQ ID NO: 278522 - protein, 16 aa, Mycobacterium
QPQPTRHAAAEPVEID

SEQ ID NO: 278523 - protein, 6 aa, Mycobacterium
QPQTRN

SEQ ID NO: 278524 - protein, 6 aa, Mycobacterium
QPRHSR

SEQ ID NO: 278525 - protein, 4 aa, Mycobacterium
QPRL

SEQ ID NO: 278526 - protein, 4 aa, Mycobacterium
QPRP

SEQ ID NO: 278527 - protein, 8 aa, Mycobacterium
QPRPDGTL

SEQ ID NO: 278528 - protein, 7 aa, Mycobacterium
QPRPNEN

SEQ ID NO: 278529 - protein, 10 aa, Mycobacterium
QPRPRQKRGV

SEQ ID NO: 278530 - protein, 4 aa, Mycobacterium
QPRR

SEQ ID NO: 278531 - protein, 8 aa, Mycobacterium
QPRRPRSA

SEQ ID NO: 278532 - protein, 11 aa, Mycobacterium
QPRRYGADDPA

SEQ ID NO: 278533 - protein, 11 aa, Mycobacterium
QPRSRSGPYLE

SEQ ID NO: 278534 - protein, 4 aa, Mycobacterium
QPRV

SEQ ID NO: 278535 - protein, 5 aa, Mycobacterium
QPRYS

SEQ ID NO: 278536 - protein, 7 aa, Mycobacterium
QPSGTPT

SEQ ID NO: 278537 - protein, 4 aa, Mycobacterium
QPSH

SEQ ID NO: 278538 - protein, 7 aa, Mycobacterium
QPSKPGV

SEQ ID NO: 278539 - protein, 5 aa, Mycobacterium
QPSLA

SEQ ID NO: 278540 - protein, 5 aa, Mycobacterium
QPSNR

SEQ ID NO: 278541 - protein, 28 aa, Mycobacterium
QPSPASEPSSAKERTPTRDRAQGSAVGR

SEQ ID NO: 278542 - protein, 9 aa, Mycobacterium
QPSPFSPKD

SEQ ID NO: 278543 - protein, 10 aa, Mycobacterium
QPSPSADAVQ

SEQ ID NO: 278544 - protein, 5 aa, Mycobacterium
QPSRA

SEQ ID NO: 278545 - protein, 5 aa, Mycobacterium
QPSSW

SEQ ID NO: 278546 - protein, 8 aa, Mycobacterium
QPSYNDQK

SEQ ID NO: 278547 - protein, 5 aa, Mycobacterium
QPTAA

SEQ ID NO: 278548 - protein, 6 aa, Mycobacterium
QPTAEA

SEQ ID NO: 278549 - protein, 8 aa, Mycobacterium
QPTALPSN

SEQ ID NO: 278550 - protein, 8 aa, Mycobacterium
QPTDDGWE

SEQ ID NO: 278551 - protein, 11 aa, Mycobacterium
QPTHADRPTIT

SEQ ID NO: 278552 - protein, 11 aa, Mycobacterium
QPTNSASGFGR

SEQ ID NO: 278553 - protein, 8 aa, Mycobacterium
QPTRGARS

SEQ ID NO: 278554 - protein, 9 aa, Mycobacterium
QPTSNGRYE

SEQ ID NO: 278555 - protein, 11 aa, Mycobacterium
QPTTPSSINPP

SEQ ID NO: 278556 - protein, 17 aa, Mycobacterium
QPVDEPPKKSSRAGRNL

SEQ ID NO: 278557 - protein, 9 aa, Mycobacterium
QPVDSPQSI

SEQ ID NO: 278558 - protein, 7 aa, Mycobacterium
QPVGPSR

SEQ ID NO: 278559 - protein, 5 aa, Mycobacterium
QPVNA

SEQ ID NO: 278560 - protein, 5 aa, Mycobacterium
QPVPA

SEQ ID NO: 278561 - protein, 7 aa, Mycobacterium
QPVPAPA

SEQ ID NO: 278562 - protein, 24 aa, Mycobacterium
QPVPEDTAADGGPGEAGLAPTTRQ

SEQ ID NO: 278563 - protein, 52 aa, Mycobacterium
QPVPGAEAETEKLPAQRPDSSDDGPDSDKTPPDSAESSSESGSAEPSGPEER

SEQ ID NO: 278564 - protein, 26 aa, Mycobacterium
QPVRAAGVDTAGRPTPADTSSPRSRG

SEQ ID NO: 278565 - protein, 6 aa, Mycobacterium
QPVRDA

SEQ ID NO: 278566 - protein, 4 aa, Mycobacterium
QPVS

SEQ ID NO: 278567 - protein, 4 aa, Mycobacterium
QPWD

SEQ ID NO: 278568 - protein, 12 aa, Mycobacterium
QPWDDELPVQVN

SEQ ID NO: 278569 - protein, 8 aa, Mycobacterium
QPWPEAGD

SEQ ID NO: 278570 - protein, 8 aa, Mycobacterium
QPWPEPGD

SEQ ID NO: 278571 - protein, 6 aa, Mycobacterium
QPYAPT

SEQ ID NO: 278572 - protein, 9 aa, Mycobacterium
QPYGDDPDD

SEQ ID NO: 278573 - protein, 11 aa, Mycobacterium
QPYGDSTTGWT

SEQ ID NO: 278574 - protein, 25 aa, Mycobacterium
QPYPLGGPPFGGAPEAAGQHTARDD

SEQ ID NO: 278575 - protein, 9 aa, Mycobacterium
QPYPPGETA

SEQ ID NO: 278576 - protein, 8 aa, Mycobacterium
QQAAPTLD

SEQ ID NO: 278577 - protein, 16 aa, Mycobacterium
QQAEKSQLAAAEAQLR

SEQ ID NO: 278578 - protein, 5 aa, Mycobacterium
QQAET

SEQ ID NO: 278579 - protein, 6 aa, Mycobacterium
QQAGDR

SEQ ID NO: 278580 - protein, 11 aa, Mycobacterium
QQAKDLSEARS

SEQ ID NO: 278581 - protein, 10 aa, Mycobacterium
QQAKNLSGAH

SEQ ID NO: 278582 - protein, 13 aa, Mycobacterium
QQAKNLSGARNAS

SEQ ID NO: 278583 - protein, 11 aa, Mycobacterium
QQAKNVSGAHN

SEQ ID NO: 278584 - protein, 11 aa, Mycobacterium
QQANSHRGRSS

SEQ ID NO: 278585 - protein, 12 aa, Mycobacterium
QQANSHSGRASY

SEQ ID NO: 278586 - protein, 8 aa, Mycobacterium
QQAPPARV

SEQ ID NO: 278587 - protein, 13 aa, Mycobacterium
QQAPPPPVPAGAP

SEQ ID NO: 278588 - protein, 16 aa, Mycobacterium
QQAQPGGAEPEHPAPA

SEQ ID NO: 278589 - protein, 7 aa, Mycobacterium
QQAQVPD

SEQ ID NO: 278590 - protein, 7 aa, Mycobacterium
QQARADE

SEQ ID NO: 278591 - protein, 10 aa, Mycobacterium
QQARAGSAGM

SEQ ID NO: 278592 - protein, 10 aa, Mycobacterium
QQARAGSANM

SEQ ID NO: 278593 - protein, 10 aa, Mycobacterium
QQARNLSGAH

SEQ ID NO: 278594 - protein, 29 aa, Mycobacterium
QQARRGSATRASGRSRDQSRTAGSRARSY

SEQ ID NO: 278595 - protein, 14 aa, Mycobacterium
QQARSIDADERPQV

SEQ ID NO: 278596 - protein, 6 aa, Mycobacterium
QQASAR

SEQ ID NO: 278597 - protein, 7 aa, Mycobacterium
QQASARR

SEQ ID NO: 278598 - protein, 6 aa, Mycobacterium
QQCDDD

SEQ ID NO: 278599 - protein, 5 aa, Mycobacterium
QQDHE

SEQ ID NO: 278600 - protein, 6 aa, Mycobacterium
QQDRAA

SEQ ID NO: 278601 - protein, 12 aa, Mycobacterium
QQDSKAPGFAGT

SEQ ID NO: 278602 - protein, 10 aa, Mycobacterium
QQDSSAPGAQ

SEQ ID NO: 278603 - protein, 5 aa, Mycobacterium
QQEGH

SEQ ID NO: 278604 - protein, 7 aa, Mycobacterium
QQELTQQ

SEQ ID NO: 278605 - protein, 9 aa, Mycobacterium
QQENYSQLK

SEQ ID NO: 278606 - protein, 10 aa, Mycobacterium
QQESNAQDFP

SEQ ID NO: 278607 - protein, 7 aa, Mycobacterium
QQFNAGA

SEQ ID NO: 278608 - protein, 8 aa, Mycobacterium
QQFNAGDE

SEQ ID NO: 278609 - protein, 6 aa, Mycobacterium
QQFPQA

SEQ ID NO: 278610 - protein, 5 aa, Mycobacterium
QQFPR

SEQ ID NO: 278611 - protein, 9 aa, Mycobacterium
QQGAHPHTT

SEQ ID NO: 278612 - protein, 16 aa, Mycobacterium
QQGANALADGSQRVAD

SEQ ID NO: 278613 - protein, 17 aa, Mycobacterium
QQGDPRGVHGRYMPPPT

SEQ ID NO: 278614 - protein, 9 aa, Mycobacterium
QQGLQTGSS

SEQ ID NO: 278615 - protein, 7 aa, Mycobacterium
QQGRAAD

SEQ ID NO: 278616 - protein, 5 aa, Mycobacterium
QQGRE

SEQ ID NO: 278617 - protein, 6 aa, Mycobacterium
QQGRET

SEQ ID NO: 278618 - protein, 6 aa, Mycobacterium
QQGSNV

SEQ ID NO: 278619 - protein, 8 aa, Mycobacterium
QQGSTGVV

SEQ ID NO: 278620 - protein, 11 aa, Mycobacterium
QQGTTGSSVGK

SEQ ID NO: 278621 - protein, 4 aa, Mycobacterium
QQHG

SEQ ID NO: 278622 - protein, 4 aa, Mycobacterium
QQHP

SEQ ID NO: 278623 - protein, 6 aa, Mycobacterium
QQIARG

SEQ ID NO: 278624 - protein, 21 aa, Mycobacterium
QQIDPDAPPPGNGAEPAPRTD

SEQ ID NO: 278625 - protein, 7 aa, Mycobacterium
QQITSRP

SEQ ID NO: 278626 - protein, 8 aa, Mycobacterium
QQKGITAT

SEQ ID NO: 278627 - protein, 20 aa, Mycobacterium
QQLEEAKKKSPAAPDPQQRL

SEQ ID NO: 278628 - protein, 7 aa, Mycobacterium
QQLGPGR

SEQ ID NO: 278629 - protein, 6 aa, Mycobacterium
QQLNPG

SEQ ID NO: 278630 - protein, 8 aa, Mycobacterium
QQLSRPDR

SEQ ID NO: 278631 - protein, 11 aa, Mycobacterium
QQNSSGRYERC

SEQ ID NO: 278632 - protein, 10 aa, Mycobacterium
QQNSVAPGDQ

SEQ ID NO: 278633 - protein, 6 aa, Mycobacterium
QQNTDM

SEQ ID NO: 278634 - protein, 5 aa, Mycobacterium
QQPDF

SEQ ID NO: 278635 - protein, 8 aa, Mycobacterium
QQPEMSPE

SEQ ID NO: 278636 - protein, 13 aa, Mycobacterium
QQPGETGSTYPDN

SEQ ID NO: 278637 - protein, 32 aa, Mycobacterium
QQPGTTVATGDSDVIDPQGSSYAATDGDPGTV

SEQ ID NO: 278638 - protein, 8 aa, Mycobacterium
QQPLDDEA

SEQ ID NO: 278639 - protein, 7 aa, Mycobacterium
QQPLGDA

SEQ ID NO: 278640 - protein, 7 aa, Mycobacterium
QQPLGDD

SEQ ID NO: 278641 - protein, 9 aa, Mycobacterium
QQPLGEDTH

SEQ ID NO: 278642 - protein, 6 aa, Mycobacterium
QQPMDD

SEQ ID NO: 278643 - protein, 10 aa, Mycobacterium
QQPPAGQQPD

SEQ ID NO: 278644 - protein, 25 aa, Mycobacterium
QQPPPTTDRAGSGKGDGGERRSKRG

SEQ ID NO: 278645 - protein, 7 aa, Mycobacterium
QQPPSPE

SEQ ID NO: 278646 - protein, 7 aa, Mycobacterium
QQPPTTT

SEQ ID NO: 278647 - protein, 6 aa, Mycobacterium
QQPSPL

SEQ ID NO: 278648 - protein, 13 aa, Mycobacterium
QQPVDNREAVAPG

SEQ ID NO: 278649 - protein, 8 aa, Mycobacterium
QQPVPQPR

SEQ ID NO: 278650 - protein, 8 aa, Mycobacterium
QQPVSRPS

SEQ ID NO: 278651 - protein, 65 aa, Mycobacterium
QQQAPLPPPPPEAPNAGFQGGTVPAPEHVAPPSGGGPQVAPVPEAPSNPGVVPNPDPGWAPRPNP

SEQ ID NO: 278652 - protein, 24 aa, Mycobacterium
QQQAPVPPPPPDAPTAGFQGGTIP

SEQ ID NO: 278653 - protein, 60 aa, Mycobacterium
QQQAPVPPPPVDQPNAGFQGGTVPAPTAIPQVPPAGGGTAPVPAAPGAPGFVPNPNPGVP

SEQ ID NO: 278654 - protein, 8 aa, Mycobacterium
QQQDGRPI

SEQ ID NO: 278655 - protein, 9 aa, Mycobacterium
QQQEQASTA

SEQ ID NO: 278656 - protein, 4 aa, Mycobacterium
QQQG

SEQ ID NO: 278657 - protein, 23 aa, Mycobacterium
QQQGSAGGEGEKAAPQRAKKKGV

SEQ ID NO: 278658 - protein, 5 aa, Mycobacterium
QQQID

SEQ ID NO: 278659 - protein, 9 aa, Mycobacterium
QQQLGDDAH

SEQ ID NO: 278660 - protein, 9 aa, Mycobacterium
QQQLGDSAH

SEQ ID NO: 278661 - protein, 19 aa, Mycobacterium
QQQMPAGAAQPSAAPQASI

SEQ ID NO: 278662 - protein, 5 aa, Mycobacterium
QQQNQ

SEQ ID NO: 278663 - protein, 5 aa, Mycobacterium
QQQPF

SEQ ID NO: 278664 - protein, 4 aa, Mycobacterium
QQRA

SEQ ID NO: 278665 - protein, 18 aa, Mycobacterium
QQRAPQQSPSITSDETNR

SEQ ID NO: 278666 - protein, 7 aa, Mycobacterium
QQRAQTI

SEQ ID NO: 278667 - protein, 7 aa, Mycobacterium
QQREANL

SEQ ID NO: 278668 - protein, 10 aa, Mycobacterium
QQREASLNTE

SEQ ID NO: 278669 - protein, 10 aa, Mycobacterium
QQRGRPAQAR

SEQ ID NO: 278670 - protein, 37 aa, Mycobacterium
QQRLPQPSRRPRAPGSPPTGPLPPVPAGVDRRRPELS

SEQ ID NO: 278671 - protein, 10 aa, Mycobacterium
QQRNDEDTDA

SEQ ID NO: 278672 - protein, 10 aa, Mycobacterium
QQRRQNPGSD

SEQ ID NO: 278673 - protein, 4 aa, Mycobacterium
QQSA

SEQ ID NO: 278674 - protein, 11 aa, Mycobacterium
QQSAAIARNNA

SEQ ID NO: 278675 - protein, 4 aa, Mycobacterium
QQSD

SEQ ID NO: 278676 - protein, 19 aa, Mycobacterium
QQSDGRSDAQPGTDHEAHS

SEQ ID NO: 278677 - protein, 5 aa, Mycobacterium
QQSDL

SEQ ID NO: 278678 - protein, 6 aa, Mycobacterium
QQSDRV

SEQ ID NO: 278679 - protein, 11 aa, Mycobacterium
QQSERANATSF

SEQ ID NO: 278680 - protein, 6 aa, Mycobacterium
QQSGFN

SEQ ID NO: 278681 - protein, 5 aa, Mycobacterium
QQSGP

SEQ ID NO: 278682 - protein, 7 aa, Mycobacterium
QQSPTGY

SEQ ID NO: 278683 - protein, 4 aa, Mycobacterium
QQSQ

SEQ ID NO: 278684 - protein, 8 aa, Mycobacterium
QQSTSTVD

SEQ ID NO: 278685 - protein, 8 aa, Mycobacterium
QQTDPSFD

SEQ ID NO: 278686 - protein, 5 aa, Mycobacterium
QQTQE

SEQ ID NO: 278687 - protein, 39 aa, Mycobacterium
QQTQPQQFPTYQQPSPYGMPPGGYAPAPKPPRPPLTPQQ

SEQ ID NO: 278688 - protein, 8 aa, Mycobacterium
QQVGEEVP

SEQ ID NO: 278689 - protein, 8 aa, Mycobacterium
QQVPPAGM

SEQ ID NO: 278690 - protein, 12 aa, Mycobacterium
QQYGDSSSLSGT

SEQ ID NO: 278691 - protein, 27 aa, Mycobacterium
QQYGGDGSDGAEGYAMTGTSTSVASGR

SEQ ID NO: 278692 - protein, 23 aa, Mycobacterium
QQYGQQYGSYGPAPKDPEPPRRS

SEQ ID NO: 278693 - protein, 6 aa, Mycobacterium
QQYQAS

SEQ ID NO: 278694 - protein, 7 aa, Mycobacterium
QRAAKDF

SEQ ID NO: 278695 - protein, 16 aa, Mycobacterium
QRAASYEDYPDSPNGD

SEQ ID NO: 278696 - protein, 12 aa, Mycobacterium
QRADQDPDARQT

SEQ ID NO: 278697 - protein, 9 aa, Mycobacterium
QRAEGAQGE

SEQ ID NO: 278698 - protein, 9 aa, Mycobacterium
QRAEHASER

SEQ ID NO: 278699 - protein, 15 aa, Mycobacterium
QRAENALTGEDESAI

SEQ ID NO: 278700 - protein, 5 aa, Mycobacterium
QRAEQ

SEQ ID NO: 278701 - protein, 8 aa, Mycobacterium
QRAEQDQR

SEQ ID NO: 278702 - protein, 6 aa, Mycobacterium
QRAGGL

SEQ ID NO: 278703 - protein, 33 aa, Mycobacterium
QRANAEATAVTETAAAELARQGEVTAGELATNV

SEQ ID NO: 278704 - protein, 5 aa, Mycobacterium
QRAPR

SEQ ID NO: 278705 - protein, 5 aa, Mycobacterium
QRAQT

SEQ ID NO: 278706 - protein, 8 aa, Mycobacterium
QRARAQER

SEQ ID NO: 278707 - protein, 17 aa, Mycobacterium
QRASAHGYKAMTHELPP

SEQ ID NO: 278708 - protein, 19 aa, Mycobacterium
QRASGKELSGLSARDYPGA

SEQ ID NO: 278709 - protein, 15 aa, Mycobacterium
QRASNALTGEDESAI

SEQ ID NO: 278710 - protein, 8 aa, Mycobacterium
QRATESVA

SEQ ID NO: 278711 - protein, 7 aa, Mycobacterium
QRATSAA

SEQ ID NO: 278712 - protein, 7 aa, Mycobacterium
QRAVREH

SEQ ID NO: 278713 - protein, 7 aa, Mycobacterium
QRAVRSA

SEQ ID NO: 278714 - protein, 12 aa, Mycobacterium
QRCNPHDAGNAL

SEQ ID NO: 278715 - protein, 22 aa, Mycobacterium
QRDPLGQAAGRARVDRDRPRQW

SEQ ID NO: 278716 - protein, 6 aa, Mycobacterium
QRDQRD

SEQ ID NO: 278717 - protein, 8 aa, Mycobacterium
QRDRAEAS

SEQ ID NO: 278718 - protein, 6 aa, Mycobacterium
QRDRAN

SEQ ID NO: 278719 - protein, 9 aa, Mycobacterium
QRDRSPLAT

SEQ ID NO: 278720 - protein, 11 aa, Mycobacterium
QRDTDSDRAAW

SEQ ID NO: 278721 - protein, 6 aa, Mycobacterium
QRDTNA

SEQ ID NO: 278722 - protein, 10 aa, Mycobacterium
QREADEATSG

SEQ ID NO: 278723 - protein, 11 aa, Mycobacterium
QREAGKTNAEA

SEQ ID NO: 278724 - protein, 12 aa, Mycobacterium
QREASGRASSVA

SEQ ID NO: 278725 - protein, 9 aa, Mycobacterium
QREASLNTE

SEQ ID NO: 278726 - protein, 6 aa, Mycobacterium
QREATL

SEQ ID NO: 278727 - protein, 5 aa, Mycobacterium
QREAV

SEQ ID NO: 278728 - protein, 14 aa, Mycobacterium
QREGSGPAREESAT

SEQ ID NO: 278729 - protein, 6 aa, Mycobacterium
QREGTL

SEQ ID NO: 278730 - protein, 9 aa, Mycobacterium
QRENDRAAV

SEQ ID NO: 278731 - protein, 14 aa, Mycobacterium
QREPGEPAPPSQAG

SEQ ID NO: 278732 - protein, 10 aa, Mycobacterium
QREQGVADTD

SEQ ID NO: 278733 - protein, 12 aa, Mycobacterium
QRERAQKLAQAD

SEQ ID NO: 278734 - protein, 10 aa, Mycobacterium
QRESKPQDFS

SEQ ID NO: 278735 - protein, 6 aa, Mycobacterium
QREYPS

SEQ ID NO: 278736 - protein, 8 aa, Mycobacterium
QRFGPNDY

SEQ ID NO: 278737 - protein, 9 aa, Mycobacterium
QRFGPNDYR

SEQ ID NO: 278738 - protein, 6 aa, Mycobacterium
QRFGTG

SEQ ID NO: 278739 - protein, 6 aa, Mycobacterium
QRGASD

SEQ ID NO: 278740 - protein, 11 aa, Mycobacterium
QRGDNGERQRA

SEQ ID NO: 278741 - protein, 6 aa, Mycobacterium
QRGEGL

SEQ ID NO: 278742 - protein, 6 aa, Mycobacterium
QRGERI

SEQ ID NO: 278743 - protein, 7 aa, Mycobacterium
QRGGAFG

SEQ ID NO: 278744 - protein, 9 aa, Mycobacterium
QRGGDGDEL

SEQ ID NO: 278745 - protein, 51 aa, Mycobacterium
QRGGETEQNRPTAAVPGGDTAPRRKPPPPPPPPPARRGNGQGPGAQPPPPV

SEQ ID NO: 278746 - protein, 6 aa, Mycobacterium
QRGGGL

SEQ ID NO: 278747 - protein, 14 aa, Mycobacterium
QRGGHSSQRNVGSC

SEQ ID NO: 278748 - protein, 8 aa, Mycobacterium
QRGNHGPT

SEQ ID NO: 278749 - protein, 6 aa, Mycobacterium
QRGNVS

SEQ ID NO: 278750 - protein, 7 aa, Mycobacterium
QRGPDDA

SEQ ID NO: 278751 - protein, 5 aa, Mycobacterium
QRGPQ

SEQ ID NO: 278752 - protein, 14 aa, Mycobacterium
QRGPYAKYGSDYSQ

SEQ ID NO: 278753 - protein, 19 aa, Mycobacterium
QRGSEPKLSARAEPGDLGE

SEQ ID NO: 278754 - protein, 5 aa, Mycobacterium
QRGSG

SEQ ID NO: 278755 - protein, 8 aa, Mycobacterium
QRGSLPQT

SEQ ID NO: 278756 - protein, 5 aa, Mycobacterium
QRGVP

SEQ ID NO: 278757 - protein, 11 aa, Mycobacterium
QRHADSAYKMP

SEQ ID NO: 278758 - protein, 16 aa, Mycobacterium
QRHGAAVNNGGYRDGY

SEQ ID NO: 278759 - protein, 29 aa, Mycobacterium
QRHPADAGKLDAADEGPDAAEDPWRDPTA

SEQ ID NO: 278760 - protein, 7 aa, Mycobacterium
QRHPGDL

SEQ ID NO: 278761 - protein, 9 aa, Mycobacterium
QRHPGGTRA

SEQ ID NO: 278762 - protein, 46 aa, Mycobacterium
QRIGADGTGAAASTSTDERAPVTTATGATQHHPPRVGTPAGLARIL

SEQ ID NO: 278763 - protein, 6 aa, Mycobacterium
QRISDP

SEQ ID NO: 278764 - protein, 13 aa, Mycobacterium
QRISSNRTHPEPD

SEQ ID NO: 278765 - protein, 13 aa, Mycobacterium
QRITAGDPQRGPR

SEQ ID NO: 278766 - protein, 5 aa, Mycobacterium
QRITD

SEQ ID NO: 278767 - protein, 5 aa, Mycobacterium
QRKAL

SEQ ID NO: 278768 - protein, 5 aa, Mycobacterium
QRKAM

SEQ ID NO: 278769 - protein, 5 aa, Mycobacterium
QRKAR

SEQ ID NO: 278770 - protein, 16 aa, Mycobacterium
QRKASGAALQKPAKMS

SEQ ID NO: 278771 - protein, 10 aa, Mycobacterium
QRKQAELPDD

SEQ ID NO: 278772 - protein, 7 aa, Mycobacterium
QRKQPRR

SEQ ID NO: 278773 - protein, 10 aa, Mycobacterium
QRKRGELPDD

SEQ ID NO: 278774 - protein, 8 aa, Mycobacterium
QRLAPGDR

SEQ ID NO: 278775 - protein, 9 aa, Mycobacterium
QRLGDDAHN

SEQ ID NO: 278776 - protein, 7 aa, Mycobacterium
QRLGGTT

SEQ ID NO: 278777 - protein, 8 aa, Mycobacterium
QRLPAATP

SEQ ID NO: 278778 - protein, 12 aa, Mycobacterium
QRLPGLQGTATA

SEQ ID NO: 278779 - protein, 6 aa, Mycobacterium
QRLPQH

SEQ ID NO: 278780 - protein, 8 aa, Mycobacterium
QRLSGPEI

SEQ ID NO: 278781 - protein, 10 aa, Mycobacterium
QRLSPGTAFG

SEQ ID NO: 278782 - protein, 9 aa, Mycobacterium
QRMGDDREA

SEQ ID NO: 278783 - protein, 10 aa, Mycobacterium
QRMGDDREAV

SEQ ID NO: 278784 - protein, 11 aa, Mycobacterium
QRNAGKTNAEA

SEQ ID NO: 278785 - protein, 5 aa, Mycobacterium
QRNDG

SEQ ID NO: 278786 - protein, 11 aa, Mycobacterium
QRNELPDGTGI

SEQ ID NO: 278787 - protein, 7 aa, Mycobacterium
QRNNARS

SEQ ID NO: 278788 - protein, 7 aa, Mycobacterium
QRNPYAK

SEQ ID NO: 278789 - protein, 18 aa, Mycobacterium
QRNQEKVTTGALSTAGTL

SEQ ID NO: 278790 - protein, 4 aa, Mycobacterium
QRNR

SEQ ID NO: 278791 - protein, 5 aa, Mycobacterium
QRNTA

SEQ ID NO: 278792 - protein, 8 aa, Mycobacterium
QRNTNPSK

SEQ ID NO: 278793 - protein, 7 aa, Mycobacterium
QRPAADL

SEQ ID NO: 278794 - protein, 7 aa, Mycobacterium
QRPAGPA

SEQ ID NO: 278795 - protein, 7 aa, Mycobacterium
QRPALEG

SEQ ID NO: 278796 - protein, 19 aa, Mycobacterium
QRPAPQPWPTPAPTPATTS

SEQ ID NO: 278797 - protein, 5 aa, Mycobacterium
QRPDR

SEQ ID NO: 278798 - protein, 53 aa, Mycobacterium
QRPEASAPAAKAKLAPVPDQEEPAKAAPQKAPAKTAAKKSTGRRAGAAELRST

SEQ ID NO: 278799 - protein, 52 aa, Mycobacterium
QRPEGTDTEAATEQLNARGGQPDGGENPRPRRRGAGGAGGLSAQDLLRREGR

SEQ ID NO: 278800 - protein, 8 aa, Mycobacterium
QRPFPARG

SEQ ID NO: 278801 - protein, 6 aa, Mycobacterium
QRPGAA

SEQ ID NO: 278802 - protein, 6 aa, Mycobacterium
QRPGNL

SEQ ID NO: 278803 - protein, 13 aa, Mycobacterium
QRPGRHPGAVAEE

SEQ ID NO: 278804 - protein, 5 aa, Mycobacterium
QRPGS

SEQ ID NO: 278805 - protein, 6 aa, Mycobacterium
QRPHPY

SEQ ID NO: 278806 - protein, 5 aa, Mycobacterium
QRPLE

SEQ ID NO: 278807 - protein, 6 aa, Mycobacterium
QRPLER

SEQ ID NO: 278808 - protein, 7 aa, Mycobacterium
QRPLHGT

SEQ ID NO: 278809 - protein, 22 aa, Mycobacterium
QRPLPAPWPQPVQRDPEDALNR

SEQ ID NO: 278810 - protein, 7 aa, Mycobacterium
QRPLPRR

SEQ ID NO: 278811 - protein, 25 aa, Mycobacterium
QRPNLTETQPRAVSGEETAASTDPA

SEQ ID NO: 278812 - protein, 14 aa, Mycobacterium
QRPNMPLPQENPPY

SEQ ID NO: 278813 - protein, 7 aa, Mycobacterium
QRPNRAT

SEQ ID NO: 278814 - protein, 4 aa, Mycobacterium
QRPS

SEQ ID NO: 278815 - protein, 6 aa, Mycobacterium
QRPSAN

SEQ ID NO: 278816 - protein, 7 aa, Mycobacterium
QRPVESY

SEQ ID NO: 278817 - protein, 6 aa, Mycobacterium
QRPVIT

SEQ ID NO: 278818 - protein, 22 aa, Mycobacterium
QRPVPSPWPKPAAKERESVTAH

SEQ ID NO: 278819 - protein, 26 aa, Mycobacterium
QRPVPSPWPKPSAAKAIEETESLSPA

SEQ ID NO: 278820 - protein, 5 aa, Mycobacterium
QRQAA

SEQ ID NO: 278821 - protein, 11 aa, Mycobacterium
QRQAEQRERTR

SEQ ID NO: 278822 - protein, 9 aa, Mycobacterium
QRQAPQPQV

SEQ ID NO: 278823 - protein, 4 aa, Mycobacterium
QRQD

SEQ ID NO: 278824 - protein, 8 aa, Mycobacterium
QRQDQAAI

SEQ ID NO: 278825 - protein, 7 aa, Mycobacterium
QRQPVPV

SEQ ID NO: 278826 - protein, 9 aa, Mycobacterium
QRQQAREAQ

SEQ ID NO: 278827 - protein, 5 aa, Mycobacterium
QRQQE

SEQ ID NO: 278828 - protein, 14 aa, Mycobacterium
QRQSAPGDARRGFL

SEQ ID NO: 278829 - protein, 5 aa, Mycobacterium
QRQSV

SEQ ID NO: 278830 - protein, 6 aa, Mycobacterium
QRQYPS

SEQ ID NO: 278831 - protein, 5 aa, Mycobacterium
QRRAD

SEQ ID NO: 278832 - protein, 23 aa, Mycobacterium
QRRAGADAQAADTDAALAPAGAP

SEQ ID NO: 278833 - protein, 9 aa, Mycobacterium
QRRAGRELG

SEQ ID NO: 278834 - protein, 9 aa, Mycobacterium
QRRAHRGED

SEQ ID NO: 278835 - protein, 9 aa, Mycobacterium
QRRAQGQCQ

SEQ ID NO: 278836 - protein, 9 aa, Mycobacterium
QRRAQVPAD

SEQ ID NO: 278837 - protein, 21 aa, Mycobacterium
QRRDGRRTAANATEATEISAS

SEQ ID NO: 278838 - protein, 5 aa, Mycobacterium
QRRDQ

SEQ ID NO: 278839 - protein, 4 aa, Mycobacterium
QRRG

SEQ ID NO: 278840 - protein, 5 aa, Mycobacterium
QRRGR

SEQ ID NO: 278841 - protein, 5 aa, Mycobacterium
QRRGV

SEQ ID NO: 278842 - protein, 7 aa, Mycobacterium
QRRHGDK

SEQ ID NO: 278843 - protein, 8 aa, Mycobacterium
QRRKTQRE

SEQ ID NO: 278844 - protein, 7 aa, Mycobacterium
QRRNRPH

SEQ ID NO: 278845 - protein, 5 aa, Mycobacterium
QRRPE

SEQ ID NO: 278846 - protein, 15 aa, Mycobacterium
QRRPPTDLPSTANEH

SEQ ID NO: 278847 - protein, 15 aa, Mycobacterium
QRRPPTDVPSTANEH

SEQ ID NO: 278848 - protein, 5 aa, Mycobacterium
QRRPQ

SEQ ID NO: 278849 - protein, 19 aa, Mycobacterium
QRRQAATAISRGDIPRDPA

SEQ ID NO: 278850 - protein, 9 aa, Mycobacterium
QRRQNPGSD

SEQ ID NO: 278851 - protein, 10 aa, Mycobacterium
QRRQNPSSDM

SEQ ID NO: 278852 - protein, 9 aa, Mycobacterium
QRRQNVPPD

SEQ ID NO: 278853 - protein, 9 aa, Mycobacterium
QRRQSPGSD

SEQ ID NO: 278854 - protein, 10 aa, Mycobacterium
QRRRDGAYEQ

SEQ ID NO: 278855 - protein, 36 aa, Mycobacterium
QRRRERAAQAKKDAAGPRPAAELTPEEKLADRYGKR

SEQ ID NO: 278856 - protein, 4 aa, Mycobacterium
QRRS

SEQ ID NO: 278857 - protein, 7 aa, Mycobacterium
QRRSDAP

SEQ ID NO: 278858 - protein, 5 aa, Mycobacterium
QRRST

SEQ ID NO: 278859 - protein, 19 aa, Mycobacterium
QRRTGRELGSASAVADSKQ

SEQ ID NO: 278860 - protein, 8 aa, Mycobacterium
QRRTPDKK

SEQ ID NO: 278861 - protein, 6 aa, Mycobacterium
QRSADA

SEQ ID NO: 278862 - protein, 5 aa, Mycobacterium
QRSAN

SEQ ID NO: 278863 - protein, 5 aa, Mycobacterium
QRSAQ

SEQ ID NO: 278864 - protein, 6 aa, Mycobacterium
QRSAQF

SEQ ID NO: 278865 - protein, 13 aa, Mycobacterium
QRSAQQVTDKPVG

SEQ ID NO: 278866 - protein, 10 aa, Mycobacterium
QRSAQRGAEQ

SEQ ID NO: 278867 - protein, 24 aa, Mycobacterium
QRSDLTDTQPRVASVEDGGATDPA

SEQ ID NO: 278868 - protein, 7 aa, Mycobacterium
QRSDYTD

SEQ ID NO: 278869 - protein, 5 aa, Mycobacterium
QRSEQ

SEQ ID NO: 278870 - protein, 29 aa, Mycobacterium
QRSGGRHAAADDAEDGSENGLAGPDGRPT

SEQ ID NO: 278871 - protein, 26 aa, Mycobacterium
QRSGQVSPTDEAAMSGPTPADRSTPL

SEQ ID NO: 278872 - protein, 8 aa, Mycobacterium
QRSGSDAG

SEQ ID NO: 278873 - protein, 5 aa, Mycobacterium
QRSGV

SEQ ID NO: 278874 - protein, 6 aa, Mycobacterium
QRSIGR

SEQ ID NO: 278875 - protein, 7 aa, Mycobacterium
QRSKNPL

SEQ ID NO: 278876 - protein, 19 aa, Mycobacterium
QRSNGKELSGLRPRDYPGA

SEQ ID NO: 278877 - protein, 7 aa, Mycobacterium
QRSPGGR

SEQ ID NO: 278878 - protein, 4 aa, Mycobacterium
QRSQ

SEQ ID NO: 278879 - protein, 9 aa, Mycobacterium
QRSSGFAQK

SEQ ID NO: 278880 - protein, 8 aa, Mycobacterium
QRSSQEGR

SEQ ID NO: 278881 - protein, 21 aa, Mycobacterium
QRSTRFASAGELARAASEAVS

SEQ ID NO: 278882 - protein, 24 aa, Mycobacterium
QRTARRHAGETVTYGANAPGLAGS

SEQ ID NO: 278883 - protein, 7 aa, Mycobacterium
QRTATAT

SEQ ID NO: 278884 - protein, 9 aa, Mycobacterium
QRTFDDESE

SEQ ID NO: 278885 - protein, 6 aa, Mycobacterium
QRTGGL

SEQ ID NO: 278886 - protein, 8 aa, Mycobacterium
QRTGSFPI

SEQ ID NO: 278887 - protein, 12 aa, Mycobacterium
QRTGSSVDPDAA

SEQ ID NO: 278888 - protein, 10 aa, Mycobacterium
QRTKDRDSSI

SEQ ID NO: 278889 - protein, 6 aa, Mycobacterium
QRTKEK

SEQ ID NO: 278890 - protein, 13 aa, Mycobacterium
QRTLAGETVLAEL

SEQ ID NO: 278891 - protein, 7 aa, Mycobacterium
QRTLDGE

SEQ ID NO: 278892 - protein, 16 aa, Mycobacterium
QRTNAIRDGAAYAGRS

SEQ ID NO: 278893 - protein, 14 aa, Mycobacterium
QRTPTGSSQDSAAG

SEQ ID NO: 278894 - protein, 11 aa, Mycobacterium
QRTPVTSQYPR

SEQ ID NO: 278895 - protein, 4 aa, Mycobacterium
QRTR

SEQ ID NO: 278896 - protein, 9 aa, Mycobacterium
QRTSDEQAR

SEQ ID NO: 278897 - protein, 10 aa, Mycobacterium
QRTSSEVNAA

SEQ ID NO: 278898 - protein, 7 aa, Mycobacterium
QRTTGED

SEQ ID NO: 278899 - protein, 15 aa, Mycobacterium
QRTTPDQAAPDDPAL

SEQ ID NO: 278900 - protein, 8 aa, Mycobacterium
QRTVRDVP

SEQ ID NO: 278901 - protein, 8 aa, Mycobacterium
QRTVRSAP

SEQ ID NO: 278902 - protein, 13 aa, Mycobacterium
QRTYEAAQERDQR

SEQ ID NO: 278903 - protein, 5 aa, Mycobacterium
QRVAD

SEQ ID NO: 278904 - protein, 20 aa, Mycobacterium
QRVADGKSNAISERATRSVP

SEQ ID NO: 278905 - protein, 7 aa, Mycobacterium
QRVAPGQ

SEQ ID NO: 278906 - protein, 11 aa, Mycobacterium
QRVDPSDPEAL

SEQ ID NO: 278907 - protein, 15 aa, Mycobacterium
QRVGDASQTSDRPDN

SEQ ID NO: 278908 - protein, 5 aa, Mycobacterium
QRVGG

SEQ ID NO: 278909 - protein, 11 aa, Mycobacterium
QRVPAPDDRDV

SEQ ID NO: 278910 - protein, 13 aa, Mycobacterium
QRVTTNSLQAAQD

SEQ ID NO: 278911 - protein, 29 aa, Mycobacterium
QSAAPAGPPPPFAPPAPFAQPPFAPPPPD

SEQ ID NO: 278912 - protein, 7 aa, Mycobacterium
QSAAPGW

SEQ ID NO: 278913 - protein, 11 aa, Mycobacterium
QSAAPRPEAVA

SEQ ID NO: 278914 - protein, 9 aa, Mycobacterium
QSAAQQQNL

SEQ ID NO: 278915 - protein, 22 aa, Mycobacterium
QSAATPSEPGGQAANPASSDPW

SEQ ID NO: 278916 - protein, 9 aa, Mycobacterium
QSADPILGQ

SEQ ID NO: 278917 - protein, 10 aa, Mycobacterium
QSADPLLGSP

SEQ ID NO: 278918 - protein, 7 aa, Mycobacterium
QSADTSS

SEQ ID NO: 278919 - protein, 6 aa, Mycobacterium
QSAERY

SEQ ID NO: 278920 - protein, 8 aa, Mycobacterium
QSAESDRV

SEQ ID NO: 278921 - protein, 6 aa, Mycobacterium
QSAGRQ

SEQ ID NO: 278922 - protein, 18 aa, Mycobacterium
QSAGRTAEPVPGHAEPAR

SEQ ID NO: 278923 - protein, 12 aa, Mycobacterium
QSAGSVKAYNAA

SEQ ID NO: 278924 - protein, 6 aa, Mycobacterium
QSAIPR

SEQ ID NO: 278925 - protein, 7 aa, Mycobacterium
QSALTGE

SEQ ID NO: 278926 - protein, 6 aa, Mycobacterium
QSANQI

SEQ ID NO: 278927 - protein, 21 aa, Mycobacterium
QSANSAAAAVQHETAAAAYST

SEQ ID NO: 278928 - protein, 7 aa, Mycobacterium
QSAPPVP

SEQ ID NO: 278929 - protein, 9 aa, Mycobacterium
QSAQSTAAQ

SEQ ID NO: 278930 - protein, 16 aa, Mycobacterium
QSAQSTASEVRRRYRE

SEQ ID NO: 278931 - protein, 11 aa, Mycobacterium
QSAQSTASQIR

SEQ ID NO: 278932 - protein, 11 aa, Mycobacterium
QSARASISADG

SEQ ID NO: 278933 - protein, 7 aa, Mycobacterium
QSARGQD

SEQ ID NO: 278934 - protein, 9 aa, Mycobacterium
QSASAQRLG

SEQ ID NO: 278935 - protein, 7 aa, Mycobacterium
QSASASL

SEQ ID NO: 278936 - protein, 8 aa, Mycobacterium
QSASERLR

SEQ ID NO: 278937 - protein, 16 aa, Mycobacterium
QSASRPDGKVPEQATL

SEQ ID NO: 278938 - protein, 21 aa, Mycobacterium
QSATSAANAALHETSAAAYTT

SEQ ID NO: 278939 - protein, 9 aa, Mycobacterium
QSAVGAQSQ

SEQ ID NO: 278940 - protein, 9 aa, Mycobacterium
QSDAPSATL

SEQ ID NO: 278941 - protein, 6 aa, Mycobacterium
QSDAVT

SEQ ID NO: 278942 - protein, 26 aa, Mycobacterium
QSDDERKDALAEAAAQDKAARAAADR

SEQ ID NO: 278943 - protein, 6 aa, Mycobacterium
QSDPAH

SEQ ID NO: 278944 - protein, 6 aa, Mycobacterium
QSDPDR

SEQ ID NO: 278945 - protein, 19 aa, Mycobacterium
QSDQPDTETDGTERRAKKT

SEQ ID NO: 278946 - protein, 10 aa, Mycobacterium
QSDRAAQREL

SEQ ID NO: 278947 - protein, 6 aa, Mycobacterium
QSDSEA

SEQ ID NO: 278948 - protein, 4 aa, Mycobacterium
QSDT

SEQ ID NO: 278949 - protein, 4 aa, Mycobacterium
QSDV

SEQ ID NO: 278950 - protein, 6 aa, Mycobacterium
QSEAAR

SEQ ID NO: 278951 - protein, 14 aa, Mycobacterium
QSECATADTASPTT

SEQ ID NO: 278952 - protein, 25 aa, Mycobacterium
QSEEPAASSEDNQDTEDTSQTPDIE

SEQ ID NO: 278953 - protein, 6 aa, Mycobacterium
QSEERK

SEQ ID NO: 278954 - protein, 6 aa, Mycobacterium
QSEERQ

SEQ ID NO: 278955 - protein, 9 aa, Mycobacterium
QSEGDGSMS

SEQ ID NO: 278956 - protein, 6 aa, Mycobacterium
QSEGKT

SEQ ID NO: 278957 - protein, 11 aa, Mycobacterium
QSERAPAEVPA

SEQ ID NO: 278958 - protein, 7 aa, Mycobacterium
QSERTAD

SEQ ID NO: 278959 - protein, 10 aa, Mycobacterium
QSESAPAEVP

SEQ ID NO: 278960 - protein, 7 aa, Mycobacterium
QSESHMR

SEQ ID NO: 278961 - protein, 5 aa, Mycobacterium
QSESP

SEQ ID NO: 278962 - protein, 15 aa, Mycobacterium
QSGADSTVVSSETAG

SEQ ID NO: 278963 - protein, 15 aa, Mycobacterium
QSGADSTVVTSETAG

SEQ ID NO: 278964 - protein, 9 aa, Mycobacterium
QSGATGGVP

SEQ ID NO: 278965 - protein, 6 aa, Mycobacterium
QSGEPI

SEQ ID NO: 278966 - protein, 7 aa, Mycobacterium
QSGETLQ

SEQ ID NO: 278967 - protein, 14 aa, Mycobacterium
QSGGGGTLTGHGGG

SEQ ID NO: 278968 - protein, 7 aa, Mycobacterium
QSGGLLP

SEQ ID NO: 278969 - protein, 7 aa, Mycobacterium
QSGGRGM

SEQ ID NO: 278970 - protein, 6 aa, Mycobacterium
QSGGTT

SEQ ID NO: 278971 - protein, 10 aa, Mycobacterium
QSGGTTAAAR

SEQ ID NO: 278972 - protein, 8 aa, Mycobacterium
QSGPQGPN

SEQ ID NO: 278973 - protein, 18 aa, Mycobacterium
QSGPVQRSGKAGKGNPYL

SEQ ID NO: 278974 - protein, 7 aa, Mycobacterium
QSGQGIG

SEQ ID NO: 278975 - protein, 6 aa, Mycobacterium
QSGQGV

SEQ ID NO: 278976 - protein, 7 aa, Mycobacterium
QSGQGVG

SEQ ID NO: 278977 - protein, 13 aa, Mycobacterium
QSGQPRQSGQSAL

SEQ ID NO: 278978 - protein, 6 aa, Mycobacterium
QSGSEL

SEQ ID NO: 278979 - protein, 5 aa, Mycobacterium
QSGSH

SEQ ID NO: 278980 - protein, 5 aa, Mycobacterium
QSGSR

SEQ ID NO: 278981 - protein, 9 aa, Mycobacterium
QSGSSQSGI

SEQ ID NO: 278982 - protein, 32 aa, Mycobacterium
QSGTAPPVLGAPPAPAAPVTPVAPAAPAPPVS

SEQ ID NO: 278983 - protein, 7 aa, Mycobacterium
QSGTGQI

SEQ ID NO: 278984 - protein, 6 aa, Mycobacterium
QSGTPN

SEQ ID NO: 278985 - protein, 5 aa, Mycobacterium
QSGVE

SEQ ID NO: 278986 - protein, 5 aa, Mycobacterium
QSGVQ

SEQ ID NO: 278987 - protein, 4 aa, Mycobacterium
QSGY

SEQ ID NO: 278988 - protein, 8 aa, Mycobacterium
QSHAGEKG

SEQ ID NO: 278989 - protein, 9 aa, Mycobacterium
QSHAGEKGV

SEQ ID NO: 278990 - protein, 6 aa, Mycobacterium
QSHAQA

SEQ ID NO: 278991 - protein, 5 aa, Mycobacterium
QSHFR

SEQ ID NO: 278992 - protein, 27 aa, Mycobacterium
QSHKPGTTARNAPSSTTTTVANTGPFT

SEQ ID NO: 278993 - protein, 7 aa, Mycobacterium
QSHPGDA

SEQ ID NO: 278994 - protein, 6 aa, Mycobacterium
QSHRPD

SEQ ID NO: 278995 - protein, 6 aa, Mycobacterium
QSHRPE

SEQ ID NO: 278996 - protein, 7 aa, Mycobacterium
QSHTGVP

SEQ ID NO: 278997 - protein, 11 aa, Mycobacterium
QSHTKNYSTRA

SEQ ID NO: 278998 - protein, 11 aa, Mycobacterium
QSHTKTYSTRA

SEQ ID NO: 278999 - protein, 13 aa, Mycobacterium
QSIADTDEPDTKL

SEQ ID NO: 279000 - protein, 13 aa, Mycobacterium
QSIADTDEPETRL

SEQ ID NO: 279001 - protein, 13 aa, Mycobacterium
QSIADTDEPSTRL

SEQ ID NO: 279002 - protein, 4 aa, Mycobacterium
QSIN

SEQ ID NO: 279003 - protein, 4 aa, Mycobacterium
QSKG

SEQ ID NO: 279004 - protein, 8 aa, Mycobacterium
QSKSAGRI

SEQ ID NO: 279005 - protein, 21 aa, Mycobacterium
QSKSVGTVTEAGIESQAGDRA

SEQ ID NO: 279006 - protein, 8 aa, Mycobacterium
QSLANDDV

SEQ ID NO: 279007 - protein, 12 aa, Mycobacterium
QSLGDAKAATHI

SEQ ID NO: 279008 - protein, 6 aa, Mycobacterium
QSLGGG

SEQ ID NO: 279009 - protein, 8 aa, Mycobacterium
QSLGVEKP

SEQ ID NO: 279010 - protein, 9 aa, Mycobacterium
QSLNSRNDS

SEQ ID NO: 279011 - protein, 5 aa, Mycobacterium
QSLNT

SEQ ID NO: 279012 - protein, 7 aa, Mycobacterium
QSLPEAI

SEQ ID NO: 279013 - protein, 8 aa, Mycobacterium
QSLSAGQR

SEQ ID NO: 279014 - protein, 7 aa, Mycobacterium
QSLSDAK

SEQ ID NO: 279015 - protein, 9 aa, Mycobacterium
QSLTTDRYR

SEQ ID NO: 279016 - protein, 10 aa, Mycobacterium
QSNDETVEKQ

SEQ ID NO: 279017 - protein, 4 aa, Mycobacterium
QSNE

SEQ ID NO: 279018 - protein, 7 aa, Mycobacterium
QSNGPTI

SEQ ID NO: 279019 - protein, 10 aa, Mycobacterium
QSNPGRARGR

SEQ ID NO: 279020 - protein, 17 aa, Mycobacterium
QSNQEKLTSGALSTAGT

SEQ ID NO: 279021 - protein, 7 aa, Mycobacterium
QSNSMAS

SEQ ID NO: 279022 - protein, 8 aa, Mycobacterium
QSNTGREL

SEQ ID NO: 279023 - protein, 10 aa, Mycobacterium
QSPAGEHGGT

SEQ ID NO: 279024 - protein, 15 aa, Mycobacterium
QSPASAPPLPPAPPA

SEQ ID NO: 279025 - protein, 6 aa, Mycobacterium
QSPATL

SEQ ID NO: 279026 - protein, 5 aa, Mycobacterium
QSPAW

SEQ ID NO: 279027 - protein, 8 aa, Mycobacterium
QSPDPRYG

SEQ ID NO: 279028 - protein, 7 aa, Mycobacterium
QSPDQRT

SEQ ID NO: 279029 - protein, 11 aa, Mycobacterium
QSPGQISPDTK

SEQ ID NO: 279030 - protein, 12 aa, Mycobacterium
QSPGQISPDTKL

SEQ ID NO: 279031 - protein, 11 aa, Mycobacterium
QSPGRVSPDTK

SEQ ID NO: 279032 - protein, 12 aa, Mycobacterium
QSPGRVSPDTKL

SEQ ID NO: 279033 - protein, 6 aa, Mycobacterium
QSPLPE

SEQ ID NO: 279034 - protein, 6 aa, Mycobacterium
QSPNAL

SEQ ID NO: 279035 - protein, 17 aa, Mycobacterium
QSPNSRYARAASRSLRD

SEQ ID NO: 279036 - protein, 20 aa, Mycobacterium
QSPPAGSGVNRDGIITLKFG

SEQ ID NO: 279037 - protein, 7 aa, Mycobacterium
QSPRRTA

SEQ ID NO: 279038 - protein, 11 aa, Mycobacterium
QSPSPNESDTA

SEQ ID NO: 279039 - protein, 11 aa, Mycobacterium
QSPSTAESDTA

SEQ ID NO: 279040 - protein, 7 aa, Mycobacterium
QSPSWRP

SEQ ID NO: 279041 - protein, 6 aa, Mycobacterium
QSPTEA

SEQ ID NO: 279042 - protein, 6 aa, Mycobacterium
QSPTGY

SEQ ID NO: 279043 - protein, 15 aa, Mycobacterium
QSPVPGETLAGTAER

SEQ ID NO: 279044 - protein, 6 aa, Mycobacterium
QSPVST

SEQ ID NO: 279045 - protein, 6 aa, Mycobacterium
QSQAGT

SEQ ID NO: 279046 - protein, 7 aa, Mycobacterium
QSQAVPD

SEQ ID NO: 279047 - protein, 5 aa, Mycobacterium
QSQHP

SEQ ID NO: 279048 - protein, 5 aa, Mycobacterium
QSQLP

SEQ ID NO: 279049 - protein, 14 aa, Mycobacterium
QSQPATPAAIEPAY

SEQ ID NO: 279050 - protein, 8 aa, Mycobacterium
QSQQASEF

SEQ ID NO: 279051 - protein, 13 aa, Mycobacterium
QSQQTEQQTEQQS

SEQ ID NO: 279052 - protein, 5 aa, Mycobacterium
QSQTI

SEQ ID NO: 279053 - protein, 4 aa, Mycobacterium
QSRD

SEQ ID NO: 279054 - protein, 4 aa, Mycobacterium
QSRH

SEQ ID NO: 279055 - protein, 4 aa, Mycobacterium
QSRM

SEQ ID NO: 279056 - protein, 13 aa, Mycobacterium
QSRPRAALGADPE

SEQ ID NO: 279057 - protein, 4 aa, Mycobacterium
QSRR

SEQ ID NO: 279058 - protein, 14 aa, Mycobacterium
QSRRAAAARSGRSR

SEQ ID NO: 279059 - protein, 15 aa, Mycobacterium
QSRSAVADAANGAAV

SEQ ID NO: 279060 - protein, 7 aa, Mycobacterium
QSRSGSV

SEQ ID NO: 279061 - protein, 7 aa, Mycobacterium
QSRTGAA

SEQ ID NO: 279062 - protein, 8 aa, Mycobacterium
QSRTTGQL

SEQ ID NO: 279063 - protein, 17 aa, Mycobacterium
QSSAQRLQSSACQFPSR

SEQ ID NO: 279064 - protein, 8 aa, Mycobacterium
QSSEAGGP

SEQ ID NO: 279065 - protein, 8 aa, Mycobacterium
QSSGPATV

SEQ ID NO: 279066 - protein, 6 aa, Mycobacterium
QSSGTY

SEQ ID NO: 279067 - protein, 9 aa, Mycobacterium
QSSKNDSLN

SEQ ID NO: 279068 - protein, 8 aa, Mycobacterium
QSSLSHPS

SEQ ID NO: 279069 - protein, 4 aa, Mycobacterium
QSSM

SEQ ID NO: 279070 - protein, 6 aa, Mycobacterium
QSSNKF

SEQ ID NO: 279071 - protein, 17 aa, Mycobacterium
QSSNQPNISAAARESKV

SEQ ID NO: 279072 - protein, 21 aa, Mycobacterium
QSSPTKQGKHDEFAGGTHVVK

SEQ ID NO: 279073 - protein, 5 aa, Mycobacterium
QSSQQ

SEQ ID NO: 279074 - protein, 5 aa, Mycobacterium
QSSSM

SEQ ID NO: 279075 - protein, 8 aa, Mycobacterium
QSSSTGGP

SEQ ID NO: 279076 - protein, 9 aa, Mycobacterium
QSSTSTFQG

SEQ ID NO: 279077 - protein, 6 aa, Mycobacterium
QSSVGS

SEQ ID NO: 279078 - protein, 6 aa, Mycobacterium
QSTAGR

SEQ ID NO: 279079 - protein, 10 aa, Mycobacterium
QSTDTWQDGI

SEQ ID NO: 279080 - protein, 10 aa, Mycobacterium
QSTDTWQDGL

SEQ ID NO: 279081 - protein, 4 aa, Mycobacterium
QSTF

SEQ ID NO: 279082 - protein, 5 aa, Mycobacterium
QSTFG

SEQ ID NO: 279083 - protein, 11 aa, Mycobacterium
QSTGADDRNMD

SEQ ID NO: 279084 - protein, 6 aa, Mycobacterium
QSTGGK

SEQ ID NO: 279085 - protein, 12 aa, Mycobacterium
QSTGTGPGDERV

SEQ ID NO: 279086 - protein, 11 aa, Mycobacterium
QSTGTGTGDQR

SEQ ID NO: 279087 - protein, 12 aa, Mycobacterium
QSTGTGTGDQRV

SEQ ID NO: 279088 - protein, 5 aa, Mycobacterium
QSTLN

SEQ ID NO: 279089 - protein, 7 aa, Mycobacterium
QSTPLRP

SEQ ID NO: 279090 - protein, 6 aa, Mycobacterium
QSTRAG

SEQ ID NO: 279091 - protein, 6 aa, Mycobacterium
QSTREF

SEQ ID NO: 279092 - protein, 15 aa, Mycobacterium
QSTTSKDNPDPAMAS

SEQ ID NO: 279093 - protein, 5 aa, Mycobacterium
QSVDG

SEQ ID NO: 279094 - protein, 11 aa, Mycobacterium
QSVDKGQMEAA

SEQ ID NO: 279095 - protein, 9 aa, Mycobacterium
QSVDPGQLE

SEQ ID NO: 279096 - protein, 7 aa, Mycobacterium
QSVESTR

SEQ ID NO: 279097 - protein, 14 aa, Mycobacterium
QSVGAEAGARVDEA

SEQ ID NO: 279098 - protein, 15 aa, Mycobacterium
QSVPAAARNAEARQR

SEQ ID NO: 279099 - protein, 10 aa, Mycobacterium
QSVPGPNDAV

SEQ ID NO: 279100 - protein, 69 aa, Mycobacterium
QSVQPPPPSPEPPPPPPPTTTTTTTPPTTTTTTTTTTTTTTTTTTTPTTTTTQPTTTTTQPTSTSRPAI

SEQ ID NO: 279101 - protein, 9 aa, Mycobacterium
QSVTRPEGI

SEQ ID NO: 279102 - protein, 4 aa, Mycobacterium
QSWP

SEQ ID NO: 279103 - protein, 5 aa, Mycobacterium
QSWPT

SEQ ID NO: 279104 - protein, 8 aa, Mycobacterium
QSWRQRRA

SEQ ID NO: 279105 - protein, 9 aa, Mycobacterium
QSYTPETTM

SEQ ID NO: 279106 - protein, 4 aa, Mycobacterium
QTAA

SEQ ID NO: 279107 - protein, 5 aa, Mycobacterium
QTAAV

SEQ ID NO: 279108 - protein, 8 aa, Mycobacterium
QTADGQVV

SEQ ID NO: 279109 - protein, 12 aa, Mycobacterium
QTAELRRSNTEL

SEQ ID NO: 279110 - protein, 8 aa, Mycobacterium
QTAERDQN

SEQ ID NO: 279111 - protein, 13 aa, Mycobacterium
QTAGGGPAAPPTG

SEQ ID NO: 279112 - protein, 11 aa, Mycobacterium
QTAGNNIRDAK

SEQ ID NO: 279113 - protein, 11 aa, Mycobacterium
QTAGNQIRDAK

SEQ ID NO: 279114 - protein, 5 aa, Mycobacterium
QTAGQ

SEQ ID NO: 279115 - protein, 5 aa, Mycobacterium
QTAGR

SEQ ID NO: 279116 - protein, 15 aa, Mycobacterium
QTAGRQVQAAEGMTA

SEQ ID NO: 279117 - protein, 11 aa, Mycobacterium
QTAGSGHPGPG

SEQ ID NO: 279118 - protein, 9 aa, Mycobacterium
QTAGTDPVG

SEQ ID NO: 279119 - protein, 14 aa, Mycobacterium
QTAITNPADPVRPA

SEQ ID NO: 279120 - protein, 7 aa, Mycobacterium
QTANGKK

SEQ ID NO: 279121 - protein, 8 aa, Mycobacterium
QTAPDKAF

SEQ ID NO: 279122 - protein, 18 aa, Mycobacterium
QTAPPGGYPPGPPPGQQY

SEQ ID NO: 279123 - protein, 5 aa, Mycobacterium
QTAPQ

SEQ ID NO: 279124 - protein, 29 aa, Mycobacterium
QTAPVKQRSYDRPASLDNPRSPRRRAGIP

SEQ ID NO: 279125 - protein, 5 aa, Mycobacterium
QTAQP

SEQ ID NO: 279126 - protein, 5 aa, Mycobacterium
QTAQT

SEQ ID NO: 279127 - protein, 16 aa, Mycobacterium
QTARHSRAARRASQNA

SEQ ID NO: 279128 - protein, 4 aa, Mycobacterium
QTAS

SEQ ID NO: 279129 - protein, 5 aa, Mycobacterium
QTASH

SEQ ID NO: 279130 - protein, 5 aa, Mycobacterium
QTASR

SEQ ID NO: 279131 - protein, 8 aa, Mycobacterium
QTASSPSW

SEQ ID NO: 279132 - protein, 8 aa, Mycobacterium
QTATGLRS

SEQ ID NO: 279133 - protein, 15 aa, Mycobacterium
QTDASINHGNSGGPL

SEQ ID NO: 279134 - protein, 9 aa, Mycobacterium
QTDDGPFLE

SEQ ID NO: 279135 - protein, 5 aa, Mycobacterium
QTDMT

SEQ ID NO: 279136 - protein, 6 aa, Mycobacterium
QTDNKD

SEQ ID NO: 279137 - protein, 8 aa, Mycobacterium
QTDPLRPA

SEQ ID NO: 279138 - protein, 15 aa, Mycobacterium
QTDRAAHSGLNEGGL

SEQ ID NO: 279139 - protein, 16 aa, Mycobacterium
QTDSSESGGGRRRRRE

SEQ ID NO: 279140 - protein, 11 aa, Mycobacterium
QTDSTDTPEIG

SEQ ID NO: 279141 - protein, 13 aa, Mycobacterium
QTDTAMSDECGNR

SEQ ID NO: 279142 - protein, 9 aa, Mycobacterium
QTDTDAAGA

SEQ ID NO: 279143 - protein, 5 aa, Mycobacterium
QTDTI

SEQ ID NO: 279144 - protein, 12 aa, Mycobacterium
QTDTQPERRAPL

SEQ ID NO: 279145 - protein, 20 aa, Mycobacterium
QTEADTEQAPVERRGPVETT

SEQ ID NO: 279146 - protein, 8 aa, Mycobacterium
QTEAKTGA

SEQ ID NO: 279147 - protein, 6 aa, Mycobacterium
QTEDGS

SEQ ID NO: 279148 - protein, 4 aa, Mycobacterium
QTEG

SEQ ID NO: 279149 - protein, 12 aa, Mycobacterium
QTEGCGPASSEV

SEQ ID NO: 279150 - protein, 9 aa, Mycobacterium
QTEGEANRF

SEQ ID NO: 279151 - protein, 7 aa, Mycobacterium
QTEGFSG

SEQ ID NO: 279152 - protein, 4 aa, Mycobacterium
QTEH

SEQ ID NO: 279153 - protein, 10 aa, Mycobacterium
QTEIDREHQR

SEQ ID NO: 279154 - protein, 11 aa, Mycobacterium
QTEIDREQQRR

SEQ ID NO: 279155 - protein, 25 aa, Mycobacterium
QTEPDAAAPAADAPEPLRGERGGYD

SEQ ID NO: 279156 - protein, 56 aa, Mycobacterium
QTEPPSAPPVATDQPPAPDAQPDTTTAPVDVGKPETEPLSAPLPPPPPTWSPPGMS

SEQ ID NO: 279157 - protein, 4 aa, Mycobacterium
QTER

SEQ ID NO: 279158 - protein, 9 aa, Mycobacterium
QTETDGAGP

SEQ ID NO: 279159 - protein, 10 aa, Mycobacterium
QTETGRKTRI

SEQ ID NO: 279160 - protein, 4 aa, Mycobacterium
QTGD

SEQ ID NO: 279161 - protein, 16 aa, Mycobacterium
QTGDPKKCDTFDAPNL

SEQ ID NO: 279162 - protein, 16 aa, Mycobacterium
QTGDPKQCDTFSAPDL

SEQ ID NO: 279163 - protein, 16 aa, Mycobacterium
QTGDPNKCDTFSATNL

SEQ ID NO: 279164 - protein, 16 aa, Mycobacterium
QTGDPNKCDTFTATDL

SEQ ID NO: 279165 - protein, 6 aa, Mycobacterium
QTGEGK

SEQ ID NO: 279166 - protein, 13 aa, Mycobacterium
QTGFRAPEGEYET

SEQ ID NO: 279167 - protein, 6 aa, Mycobacterium
QTGGGV

SEQ ID NO: 279168 - protein, 9 aa, Mycobacterium
QTGNDLSAN

SEQ ID NO: 279169 - protein, 24 aa, Mycobacterium
QTGPPPPAPPVERPGELGGDPSHT

SEQ ID NO: 279170 - protein, 5 aa, Mycobacterium
QTGPS

SEQ ID NO: 279171 - protein, 6 aa, Mycobacterium
QTGQLD

SEQ ID NO: 279172 - protein, 9 aa, Mycobacterium
QTGQSQADC

SEQ ID NO: 279173 - protein, 8 aa, Mycobacterium
QTGQTRRE

SEQ ID NO: 279174 - protein, 32 aa, Mycobacterium
QTGRDVGALPDSAAPAGSEADPFKGPVVAVEC

SEQ ID NO: 279175 - protein, 5 aa, Mycobacterium
QTGSK

SEQ ID NO: 279176 - protein, 30 aa, Mycobacterium
QTGTKESATDDDIERPEGESDRRAVAGATD

SEQ ID NO: 279177 - protein, 7 aa, Mycobacterium
QTGTSSE

SEQ ID NO: 279178 - protein, 5 aa, Mycobacterium
QTGTW

SEQ ID NO: 279179 - protein, 5 aa, Mycobacterium
QTGVP

SEQ ID NO: 279180 - protein, 11 aa, Mycobacterium
QTHAADKIGSY

SEQ ID NO: 279181 - protein, 9 aa, Mycobacterium
QTHPDQGGL

SEQ ID NO: 279182 - protein, 11 aa, Mycobacterium
QTHSGSPQPGI

SEQ ID NO: 279183 - protein, 8 aa, Mycobacterium
QTHSRGGD

SEQ ID NO: 279184 - protein, 7 aa, Mycobacterium
QTHSSGR

SEQ ID NO: 279185 - protein, 7 aa, Mycobacterium
QTHTSAR

SEQ ID NO: 279186 - protein, 8 aa, Mycobacterium
QTIPGDGD

SEQ ID NO: 279187 - protein, 6 aa, Mycobacterium
QTIPGG

SEQ ID NO: 279188 - protein, 9 aa, Mycobacterium
QTKDTQNLR

SEQ ID NO: 279189 - protein, 11 aa, Mycobacterium
QTKGAGHTSQM

SEQ ID NO: 279190 - protein, 11 aa, Mycobacterium
QTKGASHTTQM

SEQ ID NO: 279191 - protein, 10 aa, Mycobacterium
QTKLTGAGLT

SEQ ID NO: 279192 - protein, 7 aa, Mycobacterium
QTKRDQL

SEQ ID NO: 279193 - protein, 4 aa, Mycobacterium
QTLA

SEQ ID NO: 279194 - protein, 10 aa, Mycobacterium
QTLNSRNKSL

SEQ ID NO: 279195 - protein, 6 aa, Mycobacterium
QTLNTQ

SEQ ID NO: 279196 - protein, 4 aa, Mycobacterium
QTLP

SEQ ID NO: 279197 - protein, 29 aa, Mycobacterium
QTLPAPPTPPTPLSPSNPQAPTASQPPVF

SEQ ID NO: 279198 - protein, 12 aa, Mycobacterium
QTLPGEKLADGA

SEQ ID NO: 279199 - protein, 4 aa, Mycobacterium
QTLR

SEQ ID NO: 279200 - protein, 10 aa, Mycobacterium
QTLSNQSDNI

SEQ ID NO: 279201 - protein, 13 aa, Mycobacterium
QTLSSREVGAKSG

SEQ ID NO: 279202 - protein, 10 aa, Mycobacterium
QTLTTDGYRP

SEQ ID NO: 279203 - protein, 13 aa, Mycobacterium
QTMNDETLQPRTR

SEQ ID NO: 279204 - protein, 6 aa, Mycobacterium
QTMSRR

SEQ ID NO: 279205 - protein, 7 aa, Mycobacterium
QTNAALQ

SEQ ID NO: 279206 - protein, 10 aa, Mycobacterium
QTNGDSPALA

SEQ ID NO: 279207 - protein, 29 aa, Mycobacterium
QTNGESPSGKHGGTAAAVSPPPNHGPRAD

SEQ ID NO: 279208 - protein, 7 aa, Mycobacterium
QTNPGLP

SEQ ID NO: 279209 - protein, 28 aa, Mycobacterium
QTNSNSSGRHEAPGTAGTPPPNYGPRAD

SEQ ID NO: 279210 - protein, 4 aa, Mycobacterium
QTPD

SEQ ID NO: 279211 - protein, 8 aa, Mycobacterium
QTPDATRA

SEQ ID NO: 279212 - protein, 8 aa, Mycobacterium
QTPFSGDS

SEQ ID NO: 279213 - protein, 8 aa, Mycobacterium
QTPHGPRS

SEQ ID NO: 279214 - protein, 22 aa, Mycobacterium
QTPHLGPGQGCPGGTNPQVATS

SEQ ID NO: 279215 - protein, 6 aa, Mycobacterium
QTPPAR

SEQ ID NO: 279216 - protein, 7 aa, Mycobacterium
QTPQDQI

SEQ ID NO: 279217 - protein, 6 aa, Mycobacterium
QTPQGM

SEQ ID NO: 279218 - protein, 15 aa, Mycobacterium
QTPSAARALPREGLD

SEQ ID NO: 279219 - protein, 7 aa, Mycobacterium
QTPTAQI

SEQ ID NO: 279220 - protein, 6 aa, Mycobacterium
QTPTVS

SEQ ID NO: 279221 - protein, 4 aa, Mycobacterium
QTPV

SEQ ID NO: 279222 - protein, 5 aa, Mycobacterium
QTPWG

SEQ ID NO: 279223 - protein, 14 aa, Mycobacterium
QTQDTADPPAERSV

SEQ ID NO: 279224 - protein, 12 aa, Mycobacterium
QTQEHATSATTG

SEQ ID NO: 279225 - protein, 6 aa, Mycobacterium
QTQETL

SEQ ID NO: 279226 - protein, 17 aa, Mycobacterium
QTQHRTGSGLTICVGTM

SEQ ID NO: 279227 - protein, 11 aa, Mycobacterium
QTQIDTTQRQY

SEQ ID NO: 279228 - protein, 22 aa, Mycobacterium
QTQKGQLDQNAAMSEDADAMGE

SEQ ID NO: 279229 - protein, 22 aa, Mycobacterium
QTQNSQLEAGAEMSVDSGAMGD

SEQ ID NO: 279230 - protein, 8 aa, Mycobacterium
QTQPEVDS

SEQ ID NO: 279231 - protein, 4 aa, Mycobacterium
QTRD

SEQ ID NO: 279232 - protein, 11 aa, Mycobacterium
QTRDEQPSNAA

SEQ ID NO: 279233 - protein, 4 aa, Mycobacterium
QTRF

SEQ ID NO: 279234 - protein, 4 aa, Mycobacterium
QTRP

SEQ ID NO: 279235 - protein, 7 aa, Mycobacterium
QTRSGRT

SEQ ID NO: 279236 - protein, 8 aa, Mycobacterium
QTRSNGRI

SEQ ID NO: 279237 - protein, 7 aa, Mycobacterium
QTRTRTV

SEQ ID NO: 279238 - protein, 24 aa, Mycobacterium
QTSAGKWKGCAGKTVTVTNKGKTY

SEQ ID NO: 279239 - protein, 51 aa, Mycobacterium
QTSDRTPPKPANAPLSSPFVPPSAAPETVTVPQQQDEPAPPPATAEAPPPV

SEQ ID NO: 279240 - protein, 5 aa, Mycobacterium
QTSDS

SEQ ID NO: 279241 - protein, 27 aa, Mycobacterium
QTSDSFSPVGARNDPNDPNATQTAGSL

SEQ ID NO: 279242 - protein, 10 aa, Mycobacterium
QTSKNGTDTD

SEQ ID NO: 279243 - protein, 11 aa, Mycobacterium
QTSNGGEPDPM

SEQ ID NO: 279244 - protein, 17 aa, Mycobacterium
QTSPPDPNGLPPTPGIP

SEQ ID NO: 279245 - protein, 9 aa, Mycobacterium
QTSPRIPAD

SEQ ID NO: 279246 - protein, 8 aa, Mycobacterium
QTSQSTVR

SEQ ID NO: 279247 - protein, 8 aa, Mycobacterium
QTSSTAHS

SEQ ID NO: 279248 - protein, 9 aa, Mycobacterium
QTSTLTETF

SEQ ID NO: 279249 - protein, 5 aa, Mycobacterium
QTSVT

SEQ ID NO: 279250 - protein, 5 aa, Mycobacterium
QTTAQ

SEQ ID NO: 279251 - protein, 9 aa, Mycobacterium
QTTEGPAPL

SEQ ID NO: 279252 - protein, 5 aa, Mycobacterium
QTTEP

SEQ ID NO: 279253 - protein, 12 aa, Mycobacterium
QTTGTGPGDKRV

SEQ ID NO: 279254 - protein, 15 aa, Mycobacterium
QTTGTGTADQRVGNW

SEQ ID NO: 279255 - protein, 11 aa, Mycobacterium
QTTGTGTAGQR

SEQ ID NO: 279256 - protein, 10 aa, Mycobacterium
QTTPRGRRGG

SEQ ID NO: 279257 - protein, 8 aa, Mycobacterium
QTTPTASV

SEQ ID NO: 279258 - protein, 15 aa, Mycobacterium
QTTRIAPGMKQEKQG

SEQ ID NO: 279259 - protein, 6 aa, Mycobacterium
QTTSAL

SEQ ID NO: 279260 - protein, 18 aa, Mycobacterium
QTTSAPNAPDEAPPSDVK

SEQ ID NO: 279261 - protein, 8 aa, Mycobacterium
QTTSLPAA

SEQ ID NO: 279262 - protein, 12 aa, Mycobacterium
QTTSTSLPEQKD

SEQ ID NO: 279263 - protein, 49 aa, Mycobacterium
QTTTPPTTTTTTTTSPTTTEPTTTTTTPTTTETTTTTTTPTTTTNPMTT

SEQ ID NO: 279264 - protein, 7 aa, Mycobacterium
QTTYDRH

SEQ ID NO: 279265 - protein, 12 aa, Mycobacterium
QTVEAASESERA

SEQ ID NO: 279266 - protein, 5 aa, Mycobacterium
QTVES

SEQ ID NO: 279267 - protein, 4 aa, Mycobacterium
QTVG

SEQ ID NO: 279268 - protein, 11 aa, Mycobacterium
QTVIGGPPDQV

SEQ ID NO: 279269 - protein, 10 aa, Mycobacterium
QTVNDGSRRQ

SEQ ID NO: 279270 - protein, 5 aa, Mycobacterium
QTVPS

SEQ ID NO: 279271 - protein, 4 aa, Mycobacterium
QTVT

SEQ ID NO: 279272 - protein, 13 aa, Mycobacterium
QTVTTTRGGVRPE

SEQ ID NO: 279273 - protein, 7 aa, Mycobacterium
QTYSAAA

SEQ ID NO: 279274 - protein, 12 aa, Mycobacterium
QVADASARLGTG

SEQ ID NO: 279275 - protein, 6 aa, Mycobacterium
QVADTD

SEQ ID NO: 279276 - protein, 10 aa, Mycobacterium
QVAEAKGVPV

SEQ ID NO: 279277 - protein, 4 aa, Mycobacterium
QVAG

SEQ ID NO: 279278 - protein, 14 aa, Mycobacterium
QVAGGAQVDVGGST

SEQ ID NO: 279279 - protein, 13 aa, Mycobacterium
QVAGRYETGRAGA

SEQ ID NO: 279280 - protein, 6 aa, Mycobacterium
QVAPPA

SEQ ID NO: 279281 - protein, 9 aa, Mycobacterium
QVASEGGTP

SEQ ID NO: 279282 - protein, 8 aa, Mycobacterium
QVASNGSR

SEQ ID NO: 279283 - protein, 5 aa, Mycobacterium
QVATD

SEQ ID NO: 279284 - protein, 9 aa, Mycobacterium
QVATPSVSD

SEQ ID NO: 279285 - protein, 6 aa, Mycobacterium
QVATSS

SEQ ID NO: 279286 - protein, 11 aa, Mycobacterium
QVDATPGADLA

SEQ ID NO: 279287 - protein, 5 aa, Mycobacterium
QVDEK

SEQ ID NO: 279288 - protein, 7 aa, Mycobacterium
QVDGAGA

SEQ ID NO: 279289 - protein, 8 aa, Mycobacterium
QVDGAGPW

SEQ ID NO: 279290 - protein, 9 aa, Mycobacterium
QVDGAGPWK

SEQ ID NO: 279291 - protein, 7 aa, Mycobacterium
QVDGANG

SEQ ID NO: 279292 - protein, 7 aa, Mycobacterium
QVDGATQ

SEQ ID NO: 279293 - protein, 5 aa, Mycobacterium
QVDGR

SEQ ID NO: 279294 - protein, 4 aa, Mycobacterium
QVDP

SEQ ID NO: 279295 - protein, 13 aa, Mycobacterium
QVDRRGSAAEGDD

SEQ ID NO: 279296 - protein, 9 aa, Mycobacterium
QVDSGDSIE

SEQ ID NO: 279297 - protein, 4 aa, Mycobacterium
QVDV

SEQ ID NO: 279298 - protein, 7 aa, Mycobacterium
QVEAEQQ

SEQ ID NO: 279299 - protein, 6 aa, Mycobacterium
QVEDGD

SEQ ID NO: 279300 - protein, 11 aa, Mycobacterium
QVEPTPGADLA

SEQ ID NO: 279301 - protein, 6 aa, Mycobacterium
QVGASV

SEQ ID NO: 279302 - protein, 5 aa, Mycobacterium
QVGGP

SEQ ID NO: 279303 - protein, 18 aa, Mycobacterium
QVGGQSRSDIAEITLNAA

SEQ ID NO: 279304 - protein, 6 aa, Mycobacterium
QVGGSI

SEQ ID NO: 279305 - protein, 7 aa, Mycobacterium
QVGGSIG

SEQ ID NO: 279306 - protein, 11 aa, Mycobacterium
QVGPGHYRSTR

SEQ ID NO: 279307 - protein, 7 aa, Mycobacterium
QVGRESS

SEQ ID NO: 279308 - protein, 6 aa, Mycobacterium
QVGSPA

SEQ ID NO: 279309 - protein, 19 aa, Mycobacterium
QVKDQLAKADLADPVATGS

SEQ ID NO: 279310 - protein, 8 aa, Mycobacterium
QVKSRDNI

SEQ ID NO: 279311 - protein, 6 aa, Mycobacterium
QVNDGG

SEQ ID NO: 279312 - protein, 6 aa, Mycobacterium
QVNGGD

SEQ ID NO: 279313 - protein, 8 aa, Mycobacterium
QVNGPKLA

SEQ ID NO: 279314 - protein, 8 aa, Mycobacterium
QVNSGDAI

SEQ ID NO: 279315 - protein, 8 aa, Mycobacterium
QVPAGDGS

SEQ ID NO: 279316 - protein, 8 aa, Mycobacterium
QVPAGEGT

SEQ ID NO: 279317 - protein, 25 aa, Mycobacterium
QVPGAEAKTEKLPAQRPTDLPPDRP

SEQ ID NO: 279318 - protein, 14 aa, Mycobacterium
QVPGAPGPVPLPGQ

SEQ ID NO: 279319 - protein, 5 aa, Mycobacterium
QVPGV

SEQ ID NO: 279320 - protein, 8 aa, Mycobacterium
QVPPGNSL

SEQ ID NO: 279321 - protein, 17 aa, Mycobacterium
QVPPGSAATSGPTAPAA

SEQ ID NO: 279322 - protein, 19 aa, Mycobacterium
QVPPTLEEASRSLGVSPTR

SEQ ID NO: 279323 - protein, 8 aa, Mycobacterium
QVPSGTGQ

SEQ ID NO: 279324 - protein, 14 aa, Mycobacterium
QVPTSRTASRPPTR

SEQ ID NO: 279325 - protein, 6 aa, Mycobacterium
QVPTTN

SEQ ID NO: 279326 - protein, 4 aa, Mycobacterium
QVQA

SEQ ID NO: 279327 - protein, 7 aa, Mycobacterium
QVQQDTE

SEQ ID NO: 279328 - protein, 4 aa, Mycobacterium
QVQR

SEQ ID NO: 279329 - protein, 5 aa, Mycobacterium
QVQRE

SEQ ID NO: 279330 - protein, 8 aa, Mycobacterium
QVQSGDAI

SEQ ID NO: 279331 - protein, 10 aa, Mycobacterium
QVRPDAAESV

SEQ ID NO: 279332 - protein, 10 aa, Mycobacterium
QVRRRSRGAA

SEQ ID NO: 279333 - protein, 7 aa, Mycobacterium
QVRRSGV

SEQ ID NO: 279334 - protein, 4 aa, Mycobacterium
QVRT

SEQ ID NO: 279335 - protein, 11 aa, Mycobacterium
QVRTDADTAIQ

SEQ ID NO: 279336 - protein, 12 aa, Mycobacterium
QVSEKSAPAAAV

SEQ ID NO: 279337 - protein, 8 aa, Mycobacterium
QVSGTLGN

SEQ ID NO: 279338 - protein, 13 aa, Mycobacterium
QVSPGAGNDHPYE

SEQ ID NO: 279339 - protein, 10 aa, Mycobacterium
QVSSSNAGAR

SEQ ID NO: 279340 - protein, 5 aa, Mycobacterium
QVSYS

SEQ ID NO: 279341 - protein, 4 aa, Mycobacterium
QVTA

SEQ ID NO: 279342 - protein, 6 aa, Mycobacterium
QVTAAS

SEQ ID NO: 279343 - protein, 6 aa, Mycobacterium
QVTAGG

SEQ ID NO: 279344 - protein, 11 aa, Mycobacterium
QVTDKGVTSHF

SEQ ID NO: 279345 - protein, 5 aa, Mycobacterium
QVTDS

SEQ ID NO: 279346 - protein, 11 aa, Mycobacterium
QVTDSGVTSHF

SEQ ID NO: 279347 - protein, 8 aa, Mycobacterium
QVTGTDKA

SEQ ID NO: 279348 - protein, 4 aa, Mycobacterium
QVTR

SEQ ID NO: 279349 - protein, 10 aa, Mycobacterium
QVTSKPRDQT

SEQ ID NO: 279350 - protein, 12 aa, Mycobacterium
QVTTESNGDYGR

SEQ ID NO: 279351 - protein, 13 aa, Mycobacterium
QVTTESNGDYGRI

SEQ ID NO: 279352 - protein, 5 aa, Mycobacterium
QVTTT

SEQ ID NO: 279353 - protein, 10 aa, Mycobacterium
QVTTTSPQEV

SEQ ID NO: 279354 - protein, 6 aa, Mycobacterium
QVYARP

SEQ ID NO: 279355 - protein, 105 aa, Mycobacterium
QWAPQPGQGQDPWQTPQSSDPAQQGEQGWQQPAYGQGQQYPQYQQPGFPGGGFGDPSQFGQQPGQGFGEPSQFGQPGAYGQQGQYGQQGAYPGQYGQPQGQPFPQ

SEQ ID NO: 279356 - protein, 6 aa, Mycobacterium
QWEPAS

SEQ ID NO: 279357 - protein, 4 aa, Mycobacterium
QWGQ

SEQ ID NO: 279358 - protein, 8 aa, Mycobacterium
QWKSRSEA

SEQ ID NO: 279359 - protein, 8 aa, Mycobacterium
QWNPPRPA

SEQ ID NO: 279360 - protein, 49 aa, Mycobacterium
QWPGAGSGSGSGSGSSSGSGSSRGDSGSRGGDSSSGRGSGSGVPGDING

SEQ ID NO: 279361 - protein, 9 aa, Mycobacterium
QWQAAEDGG

SEQ ID NO: 279362 - protein, 9 aa, Mycobacterium
QWQSAADGG

SEQ ID NO: 279363 - protein, 18 aa, Mycobacterium
QWQSAGMGRGTETYLAGP

SEQ ID NO: 279364 - protein, 14 aa, Mycobacterium
QWRNPADTTIVDTP

SEQ ID NO: 279365 - protein, 9 aa, Mycobacterium
QWRQSTDPT

SEQ ID NO: 279366 - protein, 22 aa, Mycobacterium
QWRRAGGTFPTNSGLTTESTAS

SEQ ID NO: 279367 - protein, 8 aa, Mycobacterium
QWRSRPDT

SEQ ID NO: 279368 - protein, 9 aa, Mycobacterium
QWSRPANSD

SEQ ID NO: 279369 - protein, 8 aa, Mycobacterium
QYADADSA

SEQ ID NO: 279370 - protein, 13 aa, Mycobacterium
QYAKSIPSTATAR

SEQ ID NO: 279371 - protein, 8 aa, Mycobacterium
QYAKSSAD

SEQ ID NO: 279372 - protein, 8 aa, Mycobacterium
QYATAATE

SEQ ID NO: 279373 - protein, 7 aa, Mycobacterium
QYDGTPA

SEQ ID NO: 279374 - protein, 40 aa, Mycobacterium
QYDPATGTYIGPDGHQYTQSDLAQTAPKDKTWQTMLMPPG

SEQ ID NO: 279375 - protein, 16 aa, Mycobacterium
QYDPRTGRYVGPDGQL

SEQ ID NO: 279376 - protein, 4 aa, Mycobacterium
QYDQ

SEQ ID NO: 279377 - protein, 7 aa, Mycobacterium
QYDSDSS

SEQ ID NO: 279378 - protein, 6 aa, Mycobacterium
QYGGAQ

SEQ ID NO: 279379 - protein, 19 aa, Mycobacterium
QYGNESQINAATQGGPMGA

SEQ ID NO: 279380 - protein, 4 aa, Mycobacterium
QYGP

SEQ ID NO: 279381 - protein, 6 aa, Mycobacterium
QYGSRD

SEQ ID NO: 279382 - protein, 12 aa, Mycobacterium
QYKDVAGKDAFP

SEQ ID NO: 279383 - protein, 5 aa, Mycobacterium
QYKGS

SEQ ID NO: 279384 - protein, 9 aa, Mycobacterium
QYPDQEAPS

SEQ ID NO: 279385 - protein, 9 aa, Mycobacterium
QYPDQGASS

SEQ ID NO: 279386 - protein, 19 aa, Mycobacterium
QYPESVPPQQYPEQIPSAY

SEQ ID NO: 279387 - protein, 7 aa, Mycobacterium
QYPNPGH

SEQ ID NO: 279388 - protein, 9 aa, Mycobacterium
QYPPQPAPF

SEQ ID NO: 279389 - protein, 28 aa, Mycobacterium
QYPPSPDKAAKEAKPPRTGKVPTEPAQI

SEQ ID NO: 279390 - protein, 5 aa, Mycobacterium
QYPQG

SEQ ID NO: 279391 - protein, 7 aa, Mycobacterium
QYPSYSN

SEQ ID NO: 279392 - protein, 4 aa, Mycobacterium
QYQA

SEQ ID NO: 279393 - protein, 5 aa, Mycobacterium
QYQAS

SEQ ID NO: 279394 - protein, 4 aa, Mycobacterium
QYRA

SEQ ID NO: 279395 - protein, 4 aa, Mycobacterium
QYRD

SEQ ID NO: 279396 - protein, 5 aa, Mycobacterium
QYRDY

SEQ ID NO: 279397 - protein, 4 aa, Mycobacterium
QYRH

SEQ ID NO: 279398 - protein, 30 aa, Mycobacterium
QYRPSGKASKTIEKQIPRTGKIPTDPATLT

SEQ ID NO: 279399 - protein, 7 aa, Mycobacterium
QYRSGRG

SEQ ID NO: 279400 - protein, 6 aa, Mycobacterium
QYSLGG

SEQ ID NO: 279401 - protein, 7 aa, Mycobacterium
QYSTGNG

SEQ ID NO: 279402 - protein, 4 aa, Mycobacterium
QYTG

SEQ ID NO: 279403 - protein, 10 aa, Mycobacterium
QYTPEQAQQL

SEQ ID NO: 279404 - protein, 5 aa, Mycobacterium
QYTRR

SEQ ID NO: 279405 - protein, 4 aa, Mycobacterium
QYTT

SEQ ID NO: 279406 - protein, 9 aa, Mycobacterium
RAAAAAAAV

SEQ ID NO: 279407 - protein, 12 aa, Mycobacterium
RAAAAPLEPAGV

SEQ ID NO: 279408 - protein, 16 aa, Mycobacterium
RAAAASARKKTTEKPA

SEQ ID NO: 279409 - protein, 7 aa, Mycobacterium
RAAAATK

SEQ ID NO: 279410 - protein, 6 aa, Mycobacterium
RAAADN

SEQ ID NO: 279411 - protein, 6 aa, Mycobacterium
RAAAEA

SEQ ID NO: 279412 - protein, 11 aa, Mycobacterium
RAAAEAGRRGV

SEQ ID NO: 279413 - protein, 17 aa, Mycobacterium
RAAAEDTALQVADRSSP

SEQ ID NO: 279414 - protein, 5 aa, Mycobacterium
RAAAG

SEQ ID NO: 279415 - protein, 7 aa, Mycobacterium
RAAAGRR

SEQ ID NO: 279416 - protein, 8 aa, Mycobacterium
RAAAGSPV

SEQ ID NO: 279417 - protein, 7 aa, Mycobacterium
RAAAKRS

SEQ ID NO: 279418 - protein, 15 aa, Mycobacterium
RAAAPIPPDVQPAGV

SEQ ID NO: 279419 - protein, 11 aa, Mycobacterium
RAAAQRSREMG

SEQ ID NO: 279420 - protein, 14 aa, Mycobacterium
RAAARAAARRDREM

SEQ ID NO: 279421 - protein, 24 aa, Mycobacterium
RAAASDPATLSVQPDAGPAATYEP

SEQ ID NO: 279422 - protein, 14 aa, Mycobacterium
RAAASTPAQTPFTP

SEQ ID NO: 279423 - protein, 22 aa, Mycobacterium
RAAASTVAPANAASLARDARDL

SEQ ID NO: 279424 - protein, 5 aa, Mycobacterium
RAADA

SEQ ID NO: 279425 - protein, 6 aa, Mycobacterium
RAADGA

SEQ ID NO: 279426 - protein, 12 aa, Mycobacterium
RAADRDDDADLA

SEQ ID NO: 279427 - protein, 11 aa, Mycobacterium
RAADRDDDAEL

SEQ ID NO: 279428 - protein, 16 aa, Mycobacterium
RAADRGESGTLTDTSY

SEQ ID NO: 279429 - protein, 4 aa, Mycobacterium
RAAE

SEQ ID NO: 279430 - protein, 14 aa, Mycobacterium
RAAEAAGRDPRSIG

SEQ ID NO: 279431 - protein, 6 aa, Mycobacterium
RAAEAY

SEQ ID NO: 279432 - protein, 5 aa, Mycobacterium
RAAER

SEQ ID NO: 279433 - protein, 7 aa, Mycobacterium
RAAERGL

SEQ ID NO: 279434 - protein, 12 aa, Mycobacterium
RAAETGGPSRPT

SEQ ID NO: 279435 - protein, 5 aa, Mycobacterium
RAAFD

SEQ ID NO: 279436 - protein, 7 aa, Mycobacterium
RAAGAAR

SEQ ID NO: 279437 - protein, 9 aa, Mycobacterium
RAAGDSGSA

SEQ ID NO: 279438 - protein, 6 aa, Mycobacterium
RAAGEQ

SEQ ID NO: 279439 - protein, 10 aa, Mycobacterium
RAAGGDQDPL

SEQ ID NO: 279440 - protein, 8 aa, Mycobacterium
RAAGGTFD

SEQ ID NO: 279441 - protein, 6 aa, Mycobacterium
RAAGLP

SEQ ID NO: 279442 - protein, 7 aa, Mycobacterium
RAAGSAH

SEQ ID NO: 279443 - protein, 18 aa, Mycobacterium
RAAGSMPSIPADSGWTQV

SEQ ID NO: 279444 - protein, 6 aa, Mycobacterium
RAAGTA

SEQ ID NO: 279445 - protein, 8 aa, Mycobacterium
RAAGTARE

SEQ ID NO: 279446 - protein, 6 aa, Mycobacterium
RAAGTH

SEQ ID NO: 279447 - protein, 9 aa, Mycobacterium
RAAHPEGTV

SEQ ID NO: 279448 - protein, 19 aa, Mycobacterium
RAAKRASSTDTATDAASPA

SEQ ID NO: 279449 - protein, 24 aa, Mycobacterium
RAALPDPEPVEQAPAPVAGTGTAS

SEQ ID NO: 279450 - protein, 86 aa, Mycobacterium
RAANAPAPGAKPSRKKKATTDSESVESTTEIEDAEPVAESASGDSASAKKTTPTAGSTPRNPNRSAAQGGTANRTPKPGARPKKKK

SEQ ID NO: 279451 - protein, 6 aa, Mycobacterium
RAANRG

SEQ ID NO: 279452 - protein, 7 aa, Mycobacterium
RAAPAAA

SEQ ID NO: 279453 - protein, 5 aa, Mycobacterium
RAAPD

SEQ ID NO: 279454 - protein, 5 aa, Mycobacterium
RAAPG

SEQ ID NO: 279455 - protein, 14 aa, Mycobacterium
RAAPGSRRSGLRPP

SEQ ID NO: 279456 - protein, 7 aa, Mycobacterium
RAAPTQL

SEQ ID NO: 279457 - protein, 4 aa, Mycobacterium
RAAQ

SEQ ID NO: 279458 - protein, 14 aa, Mycobacterium
RAAQDAVKQSPLAT

SEQ ID NO: 279459 - protein, 16 aa, Mycobacterium
RAAQHQSEAEATRTQL

SEQ ID NO: 279460 - protein, 29 aa, Mycobacterium
RAAQRAASFGAGTDAVGNGLTSQNNSPGL

SEQ ID NO: 279461 - protein, 20 aa, Mycobacterium
RAAQSDTEPAPVESAPATAG

SEQ ID NO: 279462 - protein, 5 aa, Mycobacterium
RAAQW

SEQ ID NO: 279463 - protein, 6 aa, Mycobacterium
RAAQYS

SEQ ID NO: 279464 - protein, 8 aa, Mycobacterium
RAARAGDG

SEQ ID NO: 279465 - protein, 14 aa, Mycobacterium
RAARARETRGARAR

SEQ ID NO: 279466 - protein, 5 aa, Mycobacterium
RAARD

SEQ ID NO: 279467 - protein, 18 aa, Mycobacterium
RAAREAMDSPGGHAGHGE

SEQ ID NO: 279468 - protein, 7 aa, Mycobacterium
RAAREAQ

SEQ ID NO: 279469 - protein, 6 aa, Mycobacterium
RAARKG

SEQ ID NO: 279470 - protein, 12 aa, Mycobacterium
RAARSGRGAPHI

SEQ ID NO: 279471 - protein, 6 aa, Mycobacterium
RAARYQ

SEQ ID NO: 279472 - protein, 4 aa, Mycobacterium
RAAS

SEQ ID NO: 279473 - protein, 7 aa, Mycobacterium
RAASDGA

SEQ ID NO: 279474 - protein, 7 aa, Mycobacterium
RAASEGT

SEQ ID NO: 279475 - protein, 19 aa, Mycobacterium
RAASEKSRTRVIGPDDDPD

SEQ ID NO: 279476 - protein, 7 aa, Mycobacterium
RAASGAA

SEQ ID NO: 279477 - protein, 9 aa, Mycobacterium
RAASKEADR

SEQ ID NO: 279478 - protein, 21 aa, Mycobacterium
RAASPLTSASPQLAGASKSTS

SEQ ID NO: 279479 - protein, 9 aa, Mycobacterium
RAASPVADP

SEQ ID NO: 279480 - protein, 9 aa, Mycobacterium
RAASRDTVA

SEQ ID NO: 279481 - protein, 10 aa, Mycobacterium
RAASSQGHRI

SEQ ID NO: 279482 - protein, 9 aa, Mycobacterium
RAATATDTG

SEQ ID NO: 279483 - protein, 7 aa, Mycobacterium
RAATDPR

SEQ ID NO: 279484 - protein, 7 aa, Mycobacterium
RAATGAA

SEQ ID NO: 279485 - protein, 9 aa, Mycobacterium
RAATGRDIS

SEQ ID NO: 279486 - protein, 8 aa, Mycobacterium
RAATGRRK

SEQ ID NO: 279487 - protein, 9 aa, Mycobacterium
RAATGSAAP

SEQ ID NO: 279488 - protein, 7 aa, Mycobacterium
RAATGTA

SEQ ID NO: 279489 - protein, 14 aa, Mycobacterium
RAATPVTAHDRGDY

SEQ ID NO: 279490 - protein, 8 aa, Mycobacterium
RAATVGTL

SEQ ID NO: 279491 - protein, 6 aa, Mycobacterium
RAATVS

SEQ ID NO: 279492 - protein, 13 aa, Mycobacterium
RAAVEPPDHPRAI

SEQ ID NO: 279493 - protein, 8 aa, Mycobacterium
RADAAPSV

SEQ ID NO: 279494 - protein, 13 aa, Mycobacterium
RADAPEGHLSQAA

SEQ ID NO: 279495 - protein, 8 aa, Mycobacterium
RADARTAV

SEQ ID NO: 279496 - protein, 4 aa, Mycobacterium
RADD

SEQ ID NO: 279497 - protein, 7 aa, Mycobacterium
RADDARR

SEQ ID NO: 279498 - protein, 38 aa, Mycobacterium
RADDERPVARASGAATTTSHTTTPVTTAPASPPPEVTD

SEQ ID NO: 279499 - protein, 54 aa, Mycobacterium
RADDERVAPPAATSSSRPSPTAAKTSTTTATTTAPTSTSTSTAAATTESVTPAP

SEQ ID NO: 279500 - protein, 58 aa, Mycobacterium
RADDERVVSATTSGSPATTTTSAPTTSTTTTSTTTPPTTPSTTAAAQTETTTSAAPAP

SEQ ID NO: 279501 - protein, 7 aa, Mycobacterium
RADDQLK

SEQ ID NO: 279502 - protein, 10 aa, Mycobacterium
RADDQVKVGG

SEQ ID NO: 279503 - protein, 11 aa, Mycobacterium
RADDQVKVGGR

SEQ ID NO: 279504 - protein, 16 aa, Mycobacterium
RADDRRDYSKWLPEEV

SEQ ID NO: 279505 - protein, 11 aa, Mycobacterium
RADEEAGRTEL

SEQ ID NO: 279506 - protein, 11 aa, Mycobacterium
RADEENGRTEL

SEQ ID NO: 279507 - protein, 9 aa, Mycobacterium
RADEETGRA

SEQ ID NO: 279508 - protein, 10 aa, Mycobacterium
RADEETGRAE

SEQ ID NO: 279509 - protein, 7 aa, Mycobacterium
RADEPRL

SEQ ID NO: 279510 - protein, 6 aa, Mycobacterium
RADEQV

SEQ ID NO: 279511 - protein, 7 aa, Mycobacterium
RADGDEY

SEQ ID NO: 279512 - protein, 17 aa, Mycobacterium
RADGGNGGFDDGYDDPD

SEQ ID NO: 279513 - protein, 5 aa, Mycobacterium
RADGK

SEQ ID NO: 279514 - protein, 6 aa, Mycobacterium
RADGPR

SEQ ID NO: 279515 - protein, 8 aa, Mycobacterium
RADGTLAQ

SEQ ID NO: 279516 - protein, 8 aa, Mycobacterium
RADGTPMR

SEQ ID NO: 279517 - protein, 15 aa, Mycobacterium
RADGTTQPETARREP

SEQ ID NO: 279518 - protein, 9 aa, Mycobacterium
RADKKITAT

SEQ ID NO: 279519 - protein, 5 aa, Mycobacterium
RADKV

SEQ ID NO: 279520 - protein, 6 aa, Mycobacterium
RADLSG

SEQ ID NO: 279521 - protein, 7 aa, Mycobacterium
RADNARH

SEQ ID NO: 279522 - protein, 5 aa, Mycobacterium
RADNP

SEQ ID NO: 279523 - protein, 8 aa, Mycobacterium
RADNRDDL

SEQ ID NO: 279524 - protein, 20 aa, Mycobacterium
RADNSATAVPGVASDVAEVQ

SEQ ID NO: 279525 - protein, 10 aa, Mycobacterium
RADPAPEKTS

SEQ ID NO: 279526 - protein, 9 aa, Mycobacterium
RADPDEPKG

SEQ ID NO: 279527 - protein, 10 aa, Mycobacterium
RADPRRRAAR

SEQ ID NO: 279528 - protein, 4 aa, Mycobacterium
RADQ

SEQ ID NO: 279529 - protein, 7 aa, Mycobacterium
RADQPDQ

SEQ ID NO: 279530 - protein, 15 aa, Mycobacterium
RADRADRADPPPMAR

SEQ ID NO: 279531 - protein, 10 aa, Mycobacterium
RADREALRAT

SEQ ID NO: 279532 - protein, 10 aa, Mycobacterium
RADRELEAQS

SEQ ID NO: 279533 - protein, 13 aa, Mycobacterium
RADRELESQTEAF

SEQ ID NO: 279534 - protein, 7 aa, Mycobacterium
RADRGAG

SEQ ID NO: 279535 - protein, 5 aa, Mycobacterium
RADRR

SEQ ID NO: 279536 - protein, 5 aa, Mycobacterium
RADSA

SEQ ID NO: 279537 - protein, 30 aa, Mycobacterium
RADSQQQPPPPTVTQTTTAHQTPTGQGPRL

SEQ ID NO: 279538 - protein, 12 aa, Mycobacterium
RADSRLALKEEQ

SEQ ID NO: 279539 - protein, 16 aa, Mycobacterium
RADTAPTPTVPPDAPP

SEQ ID NO: 279540 - protein, 8 aa, Mycobacterium
RADTAVSD

SEQ ID NO: 279541 - protein, 7 aa, Mycobacterium
RADTDEL

SEQ ID NO: 279542 - protein, 6 aa, Mycobacterium
RADTEN

SEQ ID NO: 279543 - protein, 8 aa, Mycobacterium
RADTGATA

SEQ ID NO: 279544 - protein, 25 aa, Mycobacterium
RADTMDPTSQTPDMPRTADRKEHQA

SEQ ID NO: 279545 - protein, 16 aa, Mycobacterium
RAEAAAHEAIKGTSLS

SEQ ID NO: 279546 - protein, 7 aa, Mycobacterium
RAEAAQS

SEQ ID NO: 279547 - protein, 13 aa, Mycobacterium
RAEASGLRADGGL

SEQ ID NO: 279548 - protein, 15 aa, Mycobacterium
RAEASGLSGDGGLIE

SEQ ID NO: 279549 - protein, 4 aa, Mycobacterium
RAED

SEQ ID NO: 279550 - protein, 7 aa, Mycobacterium
RAEDGWT

SEQ ID NO: 279551 - protein, 6 aa, Mycobacterium
RAEEAQ

SEQ ID NO: 279552 - protein, 9 aa, Mycobacterium
RAEEESGTA

SEQ ID NO: 279553 - protein, 23 aa, Mycobacterium
RAEEHPVPKPDPDPSAPKAGTMK

SEQ ID NO: 279554 - protein, 7 aa, Mycobacterium
RAEETEL

SEQ ID NO: 279555 - protein, 5 aa, Mycobacterium
RAEFG

SEQ ID NO: 279556 - protein, 9 aa, Mycobacterium
RAEGGGSVR

SEQ ID NO: 279557 - protein, 8 aa, Mycobacterium
RAEGKERL

SEQ ID NO: 279558 - protein, 4 aa, Mycobacterium
RAEI

SEQ ID NO: 279559 - protein, 17 aa, Mycobacterium
RAEINRTRRLTKTERSV

SEQ ID NO: 279560 - protein, 9 aa, Mycobacterium
RAEKQPDDI

SEQ ID NO: 279561 - protein, 7 aa, Mycobacterium
RAELADP

SEQ ID NO: 279562 - protein, 14 aa, Mycobacterium
RAENALTGEDESAI

SEQ ID NO: 279563 - protein, 5 aa, Mycobacterium
RAENK

SEQ ID NO: 279564 - protein, 10 aa, Mycobacterium
RAENKITETW

SEQ ID NO: 279565 - protein, 5 aa, Mycobacterium
RAENQ

SEQ ID NO: 279566 - protein, 28 aa, Mycobacterium
RAEPDADAAAGDSGTTSAEDSANDDQNS

SEQ ID NO: 279567 - protein, 7 aa, Mycobacterium
RAEPGLA

SEQ ID NO: 279568 - protein, 13 aa, Mycobacterium
RAEPTSGVKSPAR

SEQ ID NO: 279569 - protein, 4 aa, Mycobacterium
RAEQ

SEQ ID NO: 279570 - protein, 8 aa, Mycobacterium
RAEQNPDD

SEQ ID NO: 279571 - protein, 6 aa, Mycobacterium
RAEQRR

SEQ ID NO: 279572 - protein, 10 aa, Mycobacterium
RAERAEAAAE

SEQ ID NO: 279573 - protein, 7 aa, Mycobacterium
RAEREKA

SEQ ID NO: 279574 - protein, 10 aa, Mycobacterium
RAERERKRRQ

SEQ ID NO: 279575 - protein, 13 aa, Mycobacterium
RAERGRSGRTKKG

SEQ ID NO: 279576 - protein, 6 aa, Mycobacterium
RAERSA

SEQ ID NO: 279577 - protein, 4 aa, Mycobacterium
RAES

SEQ ID NO: 279578 - protein, 5 aa, Mycobacterium
RAESA

SEQ ID NO: 279579 - protein, 7 aa, Mycobacterium
RAESAEL

SEQ ID NO: 279580 - protein, 14 aa, Mycobacterium
RAESAMENEYERSE

SEQ ID NO: 279581 - protein, 8 aa, Mycobacterium
RAESEGKF

SEQ ID NO: 279582 - protein, 7 aa, Mycobacterium
RAESERA

SEQ ID NO: 279583 - protein, 13 aa, Mycobacterium
RAESLEGATGAGQ

SEQ ID NO: 279584 - protein, 13 aa, Mycobacterium
RAESLEGTTGAGQ

SEQ ID NO: 279585 - protein, 18 aa, Mycobacterium
RAESNEHPERGRPKYPGL

SEQ ID NO: 279586 - protein, 15 aa, Mycobacterium
RAESSKPIRQLTDEA

SEQ ID NO: 279587 - protein, 18 aa, Mycobacterium
RAETETAGAEDRPQPPID

SEQ ID NO: 279588 - protein, 12 aa, Mycobacterium
RAETLQGTGAGE

SEQ ID NO: 279589 - protein, 8 aa, Mycobacterium
RAETQDHA

SEQ ID NO: 279590 - protein, 6 aa, Mycobacterium
RAETQR

SEQ ID NO: 279591 - protein, 6 aa, Mycobacterium
RAEYED

SEQ ID NO: 279592 - protein, 4 aa, Mycobacterium
RAFG

SEQ ID NO: 279593 - protein, 10 aa, Mycobacterium
RAFGPPPGRW

SEQ ID NO: 279594 - protein, 8 aa, Mycobacterium
RAFGPPPV

SEQ ID NO: 279595 - protein, 15 aa, Mycobacterium
RAGAASAVASTSRQV

SEQ ID NO: 279596 - protein, 11 aa, Mycobacterium
RAGAASRRPVG

SEQ ID NO: 279597 - protein, 8 aa, Mycobacterium
RAGAATTA

SEQ ID NO: 279598 - protein, 17 aa, Mycobacterium
RAGADPGEFDDDALPGT

SEQ ID NO: 279599 - protein, 6 aa, Mycobacterium
RAGADV

SEQ ID NO: 279600 - protein, 5 aa, Mycobacterium
RAGAE

SEQ ID NO: 279601 - protein, 7 aa, Mycobacterium
RAGAEEL

SEQ ID NO: 279602 - protein, 7 aa, Mycobacterium
RAGAEIP

SEQ ID NO: 279603 - protein, 9 aa, Mycobacterium
RAGAGAAAP

SEQ ID NO: 279604 - protein, 8 aa, Mycobacterium
RAGAGRFR

SEQ ID NO: 279605 - protein, 19 aa, Mycobacterium
RAGAGSGGNAAYLRWPHPQ

SEQ ID NO: 279606 - protein, 5 aa, Mycobacterium
RAGAI

SEQ ID NO: 279607 - protein, 15 aa, Mycobacterium
RAGATTQAPAPVNAG

SEQ ID NO: 279608 - protein, 7 aa, Mycobacterium
RAGAYRR

SEQ ID NO: 279609 - protein, 11 aa, Mycobacterium
RAGDADAGPGN

SEQ ID NO: 279610 - protein, 22 aa, Mycobacterium
RAGDDDPAGGPCDGVADAPPGW

SEQ ID NO: 279611 - protein, 7 aa, Mycobacterium
RAGDQIP

SEQ ID NO: 279612 - protein, 13 aa, Mycobacterium
RAGDRPSLGVQQP

SEQ ID NO: 279613 - protein, 10 aa, Mycobacterium
RAGEDRETAY

SEQ ID NO: 279614 - protein, 7 aa, Mycobacterium
RAGEPVK

SEQ ID NO: 279615 - protein, 9 aa, Mycobacterium
RAGESPPDA

SEQ ID NO: 279616 - protein, 6 aa, Mycobacterium
RAGEVE

SEQ ID NO: 279617 - protein, 71 aa, Mycobacterium
RAGGARAGAENAPDADDVADVPDEDAKADAAESASRPSGPSKPAPSKPAPGARPVRPTGTRRPTGKRNVGR

SEQ ID NO: 279618 - protein, 16 aa, Mycobacterium
RAGGDAHITSSPGAGT

SEQ ID NO: 279619 - protein, 7 aa, Mycobacterium
RAGGDIK

SEQ ID NO: 279620 - protein, 8 aa, Mycobacterium
RAGGDRVE

SEQ ID NO: 279621 - protein, 7 aa, Mycobacterium
RAGGDTV

SEQ ID NO: 279622 - protein, 6 aa, Mycobacterium
RAGGDV

SEQ ID NO: 279623 - protein, 10 aa, Mycobacterium
RAGGEPGPIT

SEQ ID NO: 279624 - protein, 27 aa, Mycobacterium
RAGGGSSSDDGGVLTASEGTEVRSPSD

SEQ ID NO: 279625 - protein, 7 aa, Mycobacterium
RAGGGYR

SEQ ID NO: 279626 - protein, 10 aa, Mycobacterium
RAGGKAEELQ

SEQ ID NO: 279627 - protein, 5 aa, Mycobacterium
RAGGN

SEQ ID NO: 279628 - protein, 8 aa, Mycobacterium
RAGGPGHG

SEQ ID NO: 279629 - protein, 5 aa, Mycobacterium
RAGGR

SEQ ID NO: 279630 - protein, 8 aa, Mycobacterium
RAGGSALP

SEQ ID NO: 279631 - protein, 6 aa, Mycobacterium
RAGGSL

SEQ ID NO: 279632 - protein, 9 aa, Mycobacterium
RAGGTPTTR

SEQ ID NO: 279633 - protein, 8 aa, Mycobacterium
RAGHAPGW

SEQ ID NO: 279634 - protein, 5 aa, Mycobacterium
RAGHD

SEQ ID NO: 279635 - protein, 5 aa, Mycobacterium
RAGHP

SEQ ID NO: 279636 - protein, 15 aa, Mycobacterium
RAGHQPGAEKPTGTV

SEQ ID NO: 279637 - protein, 11 aa, Mycobacterium
RAGKPFTGAGY

SEQ ID NO: 279638 - protein, 9 aa, Mycobacterium
RAGKVGSKT

SEQ ID NO: 279639 - protein, 4 aa, Mycobacterium
RAGL

SEQ ID NO: 279640 - protein, 4 aa, Mycobacterium
RAGM

SEQ ID NO: 279641 - protein, 5 aa, Mycobacterium
RAGNI

SEQ ID NO: 279642 - protein, 5 aa, Mycobacterium
RAGNP

SEQ ID NO: 279643 - protein, 11 aa, Mycobacterium
RAGPDLASRPD

SEQ ID NO: 279644 - protein, 6 aa, Mycobacterium
RAGPDR

SEQ ID NO: 279645 - protein, 16 aa, Mycobacterium
RAGPIDTPERAHSIHR

SEQ ID NO: 279646 - protein, 5 aa, Mycobacterium
RAGPL

SEQ ID NO: 279647 - protein, 6 aa, Mycobacterium
RAGPPE

SEQ ID NO: 279648 - protein, 11 aa, Mycobacterium
RAGPRAEPRTS

SEQ ID NO: 279649 - protein, 4 aa, Mycobacterium
RAGQ

SEQ ID NO: 279650 - protein, 5 aa, Mycobacterium
RAGQA

SEQ ID NO: 279651 - protein, 16 aa, Mycobacterium
RAGQPTPAQTEPALAQ

SEQ ID NO: 279652 - protein, 7 aa, Mycobacterium
RAGQRTL

SEQ ID NO: 279653 - protein, 6 aa, Mycobacterium
RAGQSV

SEQ ID NO: 279654 - protein, 7 aa, Mycobacterium
RAGRAPV

SEQ ID NO: 279655 - protein, 7 aa, Mycobacterium
RAGRDDR

SEQ ID NO: 279656 - protein, 8 aa, Mycobacterium
RAGRDDTV

SEQ ID NO: 279657 - protein, 10 aa, Mycobacterium
RAGRDQQDAI

SEQ ID NO: 279658 - protein, 5 aa, Mycobacterium
RAGRI

SEQ ID NO: 279659 - protein, 19 aa, Mycobacterium
RAGRLGQLGDSSEPRVSKT

SEQ ID NO: 279660 - protein, 11 aa, Mycobacterium
RAGRPEPSNPA

SEQ ID NO: 279661 - protein, 6 aa, Mycobacterium
RAGRRT

SEQ ID NO: 279662 - protein, 10 aa, Mycobacterium
RAGRTPPNQH

SEQ ID NO: 279663 - protein, 33 aa, Mycobacterium
RAGRTQPLAGIPQPHGRRVSTRRATAQIGNAAH

SEQ ID NO: 279664 - protein, 24 aa, Mycobacterium
RAGRTQPLTAPEHANTPAAQLAQQ

SEQ ID NO: 279665 - protein, 6 aa, Mycobacterium
RAGRVP

SEQ ID NO: 279666 - protein, 29 aa, Mycobacterium
RAGSGAITSTGASPGTAANVPLSDQDRAA

SEQ ID NO: 279667 - protein, 8 aa, Mycobacterium
RAGSGDRM

SEQ ID NO: 279668 - protein, 7 aa, Mycobacterium
RAGSQRV

SEQ ID NO: 279669 - protein, 9 aa, Mycobacterium
RAGSRKPNL

SEQ ID NO: 279670 - protein, 7 aa, Mycobacterium
RAGSSRL

SEQ ID NO: 279671 - protein, 8 aa, Mycobacterium
RAGSTGAD

SEQ ID NO: 279672 - protein, 15 aa, Mycobacterium
RAGSTPQSWKRRTSR

SEQ ID NO: 279673 - protein, 7 aa, Mycobacterium
RAGTAAG

SEQ ID NO: 279674 - protein, 7 aa, Mycobacterium
RAGTERP

SEQ ID NO: 279675 - protein, 8 aa, Mycobacterium
RAGTGGVG

SEQ ID NO: 279676 - protein, 10 aa, Mycobacterium
RAGTPSSLTD

SEQ ID NO: 279677 - protein, 6 aa, Mycobacterium
RAGTTA

SEQ ID NO: 279678 - protein, 12 aa, Mycobacterium
RAGTTAIYGQGS

SEQ ID NO: 279679 - protein, 16 aa, Mycobacterium
RAGVAGADDDTDTTAT

SEQ ID NO: 279680 - protein, 5 aa, Mycobacterium
RAGYG

SEQ ID NO: 279681 - protein, 8 aa, Mycobacterium
RAHAEQEV

SEQ ID NO: 279682 - protein, 7 aa, Mycobacterium
RAHAPGK

SEQ ID NO: 279683 - protein, 8 aa, Mycobacterium
RAHDGDAG

SEQ ID NO: 279684 - protein, 5 aa, Mycobacterium
RAHGG

SEQ ID NO: 279685 - protein, 13 aa, Mycobacterium
RAHGLPGGSSPAP

SEQ ID NO: 279686 - protein, 19 aa, Mycobacterium
RAHGPADGDVTRTDDVSVR

SEQ ID NO: 279687 - protein, 19 aa, Mycobacterium
RAHGPADKDVTRLDDVQVR

SEQ ID NO: 279688 - protein, 19 aa, Mycobacterium
RAHGPDDGDVTRLDDAQVR

SEQ ID NO: 279689 - protein, 19 aa, Mycobacterium
RAHGPEDGDVTRIDDVEVR

SEQ ID NO: 279690 - protein, 18 aa, Mycobacterium
RAHGPEDGDVTRNEENVR

SEQ ID NO: 279691 - protein, 19 aa, Mycobacterium
RAHGPTDKDVTRMDDVQVR

SEQ ID NO: 279692 - protein, 15 aa, Mycobacterium
RAHPEPDQAADEGTD

SEQ ID NO: 279693 - protein, 5 aa, Mycobacterium
RAHPI

SEQ ID NO: 279694 - protein, 5 aa, Mycobacterium
RAHPR

SEQ ID NO: 279695 - protein, 15 aa, Mycobacterium
RAHRAEEEAVGDPAD

SEQ ID NO: 279696 - protein, 17 aa, Mycobacterium
RAHSGEHIGRTSAPVPV

SEQ ID NO: 279697 - protein, 9 aa, Mycobacterium
RAHSGGTGP

SEQ ID NO: 279698 - protein, 4 aa, Mycobacterium
RAHT

SEQ ID NO: 279699 - protein, 10 aa, Mycobacterium
RAIAENPDDI

SEQ ID NO: 279700 - protein, 12 aa, Mycobacterium
RAINAQSNPEEV

SEQ ID NO: 279701 - protein, 13 aa, Mycobacterium
RAINAQSSPDEVQ

SEQ ID NO: 279702 - protein, 12 aa, Mycobacterium
RAINEGASLSGD

SEQ ID NO: 279703 - protein, 6 aa, Mycobacterium
RAINEP

SEQ ID NO: 279704 - protein, 7 aa, Mycobacterium
RAINEPD

SEQ ID NO: 279705 - protein, 9 aa, Mycobacterium
RAIPSGERL

SEQ ID NO: 279706 - protein, 6 aa, Mycobacterium
RAIRPG

SEQ ID NO: 279707 - protein, 7 aa, Mycobacterium
RAIRQQD

SEQ ID NO: 279708 - protein, 6 aa, Mycobacterium
RAISSR

SEQ ID NO: 279709 - protein, 11 aa, Mycobacterium
RAKERLSTESA

SEQ ID NO: 279710 - protein, 15 aa, Mycobacterium
RAKGGTNAPSNHAPA

SEQ ID NO: 279711 - protein, 15 aa, Mycobacterium
RAKPASAAPAEEPAD

SEQ ID NO: 279712 - protein, 19 aa, Mycobacterium
RAKPQDPQSRPPSVEVQPR

SEQ ID NO: 279713 - protein, 19 aa, Mycobacterium
RAKPQEPQSRPPSVEVQPR

SEQ ID NO: 279714 - protein, 49 aa, Mycobacterium
RAKPQQADQGRDVREPKRLRKAKQPKASRGAQRPEPVGAGHSARERRTR

SEQ ID NO: 279715 - protein, 9 aa, Mycobacterium
RAKPTHEER

SEQ ID NO: 279716 - protein, 12 aa, Mycobacterium
RAKRGEATNGGV

SEQ ID NO: 279717 - protein, 14 aa, Mycobacterium
RAKSDEPAPLPKST

SEQ ID NO: 279718 - protein, 16 aa, Mycobacterium
RAKSPVTGETPSSVTK

SEQ ID NO: 279719 - protein, 9 aa, Mycobacterium
RAKSRPGKL

SEQ ID NO: 279720 - protein, 15 aa, Mycobacterium
RAKSTHPSPPQPLPP

SEQ ID NO: 279721 - protein, 10 aa, Mycobacterium
RAKTGNYPGV

SEQ ID NO: 279722 - protein, 11 aa, Mycobacterium
RAKTGNYPGVT

SEQ ID NO: 279723 - protein, 9 aa, Mycobacterium
RAKTPGQLT

SEQ ID NO: 279724 - protein, 8 aa, Mycobacterium
RAKTPLQS

SEQ ID NO: 279725 - protein, 9 aa, Mycobacterium
RAKTRSGAA

SEQ ID NO: 279726 - protein, 5 aa, Mycobacterium
RAKTS

SEQ ID NO: 279727 - protein, 5 aa, Mycobacterium
RAKTW

SEQ ID NO: 279728 - protein, 14 aa, Mycobacterium
RALDAAAERRASRD

SEQ ID NO: 279729 - protein, 14 aa, Mycobacterium
RALDAAASRRASRD

SEQ ID NO: 279730 - protein, 13 aa, Mycobacterium
RALEAAAERRASH

SEQ ID NO: 279731 - protein, 8 aa, Mycobacterium
RALEDPAD

SEQ ID NO: 279732 - protein, 7 aa, Mycobacterium
RALGATR

SEQ ID NO: 279733 - protein, 7 aa, Mycobacterium
RALGPPD

SEQ ID NO: 279734 - protein, 8 aa, Mycobacterium
RALGTSEH

SEQ ID NO: 279735 - protein, 7 aa, Mycobacterium
RALKPKT

SEQ ID NO: 279736 - protein, 10 aa, Mycobacterium
RALNDGSSTD

SEQ ID NO: 279737 - protein, 26 aa, Mycobacterium
RALPPHDPTHPAPGRPAPVRPPAVTT

SEQ ID NO: 279738 - protein, 10 aa, Mycobacterium
RALQEDHDVD

SEQ ID NO: 279739 - protein, 12 aa, Mycobacterium
RALQQDRDVDDA

SEQ ID NO: 279740 - protein, 6 aa, Mycobacterium
RALRTD

SEQ ID NO: 279741 - protein, 12 aa, Mycobacterium
RALSDDPGSAAE

SEQ ID NO: 279742 - protein, 14 aa, Mycobacterium
RALSETSERRAQRG

SEQ ID NO: 279743 - protein, 20 aa, Mycobacterium
RALSSGAHAAKRGAELGAEP

SEQ ID NO: 279744 - protein, 10 aa, Mycobacterium
RALTEDTGPL

SEQ ID NO: 279745 - protein, 9 aa, Mycobacterium
RALTPPPTP

SEQ ID NO: 279746 - protein, 25 aa, Mycobacterium
RAMGNTGSSGGSSKQAREADDRITD

SEQ ID NO: 279747 - protein, 42 aa, Mycobacterium
RAMGTKRGDDDKTPEVNPAPRADKPEAPAPAAAGRGNWRAQA

SEQ ID NO: 279748 - protein, 14 aa, Mycobacterium
RAMRRGEPLPHHPT

SEQ ID NO: 279749 - protein, 12 aa, Mycobacterium
RAMRRGEPLPSS

SEQ ID NO: 279750 - protein, 7 aa, Mycobacterium
RANDADV

SEQ ID NO: 279751 - protein, 8 aa, Mycobacterium
RANGEELA

SEQ ID NO: 279752 - protein, 18 aa, Mycobacterium
RANGEELTGLSPRDYPGA

SEQ ID NO: 279753 - protein, 7 aa, Mycobacterium
RANGGEL

SEQ ID NO: 279754 - protein, 8 aa, Mycobacterium
RANGPAGK

SEQ ID NO: 279755 - protein, 6 aa, Mycobacterium
RANGSP

SEQ ID NO: 279756 - protein, 7 aa, Mycobacterium
RANGSPT

SEQ ID NO: 279757 - protein, 9 aa, Mycobacterium
RANNSGVST

SEQ ID NO: 279758 - protein, 21 aa, Mycobacterium
RANPAADTGTTVTSGAAATSD

SEQ ID NO: 279759 - protein, 5 aa, Mycobacterium
RANPH

SEQ ID NO: 279760 - protein, 8 aa, Mycobacterium
RANPKTTL

SEQ ID NO: 279761 - protein, 6 aa, Mycobacterium
RANPPN

SEQ ID NO: 279762 - protein, 8 aa, Mycobacterium
RANPRRLA

SEQ ID NO: 279763 - protein, 9 aa, Mycobacterium
RANPRRLAD

SEQ ID NO: 279764 - protein, 14 aa, Mycobacterium
RANTALSKTALAAG

SEQ ID NO: 279765 - protein, 5 aa, Mycobacterium
RANTS

SEQ ID NO: 279766 - protein, 12 aa, Mycobacterium
RAPAAAAASPEA

SEQ ID NO: 279767 - protein, 16 aa, Mycobacterium
RAPAAAAPRPAPQPAA

SEQ ID NO: 279768 - protein, 22 aa, Mycobacterium
RAPAAASSSQTAKRRQQRAQTI

SEQ ID NO: 279769 - protein, 8 aa, Mycobacterium
RAPAAPGS

SEQ ID NO: 279770 - protein, 6 aa, Mycobacterium
RAPAGA

SEQ ID NO: 279771 - protein, 5 aa, Mycobacterium
RAPAL

SEQ ID NO: 279772 - protein, 5 aa, Mycobacterium
RAPAN

SEQ ID NO: 279773 - protein, 6 aa, Mycobacterium
RAPANY

SEQ ID NO: 279774 - protein, 42 aa, Mycobacterium
RAPAPAFRGPFGGGHGPFRGGPFGGGHGPFRGGPFGGGRGGF

SEQ ID NO: 279775 - protein, 45 aa, Mycobacterium
RAPAPRPGKPGKNGDANRPRASQARRRAAEARPAQIEQAPDESVA

SEQ ID NO: 279776 - protein, 9 aa, Mycobacterium
RAPARSDER

SEQ ID NO: 279777 - protein, 7 aa, Mycobacterium
RAPASGR

SEQ ID NO: 279778 - protein, 10 aa, Mycobacterium
RAPASSVGSV

SEQ ID NO: 279779 - protein, 10 aa, Mycobacterium
RAPDDELTPV

SEQ ID NO: 279780 - protein, 5 aa, Mycobacterium
RAPDL

SEQ ID NO: 279781 - protein, 4 aa, Mycobacterium
RAPE

SEQ ID NO: 279782 - protein, 11 aa, Mycobacterium
RAPEAAADPFT

SEQ ID NO: 279783 - protein, 7 aa, Mycobacterium
RAPEKSW

SEQ ID NO: 279784 - protein, 8 aa, Mycobacterium
RAPENDSQ

SEQ ID NO: 279785 - protein, 12 aa, Mycobacterium
RAPEVGELGGDG

SEQ ID NO: 279786 - protein, 13 aa, Mycobacterium
RAPGAGRADPAPI

SEQ ID NO: 279787 - protein, 14 aa, Mycobacterium
RAPGAGRAEAAPIQ

SEQ ID NO: 279788 - protein, 8 aa, Mycobacterium
RAPGEPPK

SEQ ID NO: 279789 - protein, 9 aa, Mycobacterium
RAPGETGNI

SEQ ID NO: 279790 - protein, 10 aa, Mycobacterium
RAPGLSQTIE

SEQ ID NO: 279791 - protein, 21 aa, Mycobacterium
RAPGPMDDRAHDRSSRPQTGV

SEQ ID NO: 279792 - protein, 10 aa, Mycobacterium
RAPGSGRVEQ

SEQ ID NO: 279793 - protein, 9 aa, Mycobacterium
RAPHSSEIR

SEQ ID NO: 279794 - protein, 10 aa, Mycobacterium
RAPHSSEIRN

SEQ ID NO: 279795 - protein, 13 aa, Mycobacterium
RAPHSSNPSNTGV

SEQ ID NO: 279796 - protein, 16 aa, Mycobacterium
RAPHTTAPTPAVALTQ

SEQ ID NO: 279797 - protein, 6 aa, Mycobacterium
RAPIGG

SEQ ID NO: 279798 - protein, 4 aa, Mycobacterium
RAPK

SEQ ID NO: 279799 - protein, 12 aa, Mycobacterium
RAPKDAETKKFT

SEQ ID NO: 279800 - protein, 12 aa, Mycobacterium
RAPQFEASRQSP

SEQ ID NO: 279801 - protein, 9 aa, Mycobacterium
RAPQTTPAP

SEQ ID NO: 279802 - protein, 6 aa, Mycobacterium
RAPRGA

SEQ ID NO: 279803 - protein, 5 aa, Mycobacterium
RAPRL

SEQ ID NO: 279804 - protein, 13 aa, Mycobacterium
RAPRMRPQRGIST

SEQ ID NO: 279805 - protein, 9 aa, Mycobacterium
RAPRPGPDV

SEQ ID NO: 279806 - protein, 25 aa, Mycobacterium
RAPRPRSSNETSSRASSPRSGPARK

SEQ ID NO: 279807 - protein, 12 aa, Mycobacterium
RAPRPRVNRGEP

SEQ ID NO: 279808 - protein, 13 aa, Mycobacterium
RAPRQAPPPAMPP

SEQ ID NO: 279809 - protein, 6 aa, Mycobacterium
RAPRRW

SEQ ID NO: 279810 - protein, 7 aa, Mycobacterium
RAPRTDR

SEQ ID NO: 279811 - protein, 14 aa, Mycobacterium
RAPRVGDAAGQPDV

SEQ ID NO: 279812 - protein, 7 aa, Mycobacterium
RAPSAAL

SEQ ID NO: 279813 - protein, 11 aa, Mycobacterium
RAPSGTAAAVK

SEQ ID NO: 279814 - protein, 7 aa, Mycobacterium
RAPSRAR

SEQ ID NO: 279815 - protein, 5 aa, Mycobacterium
RAPST

SEQ ID NO: 279816 - protein, 10 aa, Mycobacterium
RAPTPRAPGD

SEQ ID NO: 279817 - protein, 14 aa, Mycobacterium
RAPTTAATAQAAPS

SEQ ID NO: 279818 - protein, 6 aa, Mycobacterium
RAPTTS

SEQ ID NO: 279819 - protein, 12 aa, Mycobacterium
RAPVAQPAPHGV

SEQ ID NO: 279820 - protein, 11 aa, Mycobacterium
RAQAAEQRAAA

SEQ ID NO: 279821 - protein, 14 aa, Mycobacterium
RAQAAGGTQNGAQV

SEQ ID NO: 279822 - protein, 9 aa, Mycobacterium
RAQAATPEM

SEQ ID NO: 279823 - protein, 9 aa, Mycobacterium
RAQADSLQT

SEQ ID NO: 279824 - protein, 6 aa, Mycobacterium
RAQAGR

SEQ ID NO: 279825 - protein, 7 aa, Mycobacterium
RAQERGQ

SEQ ID NO: 279826 - protein, 9 aa, Mycobacterium
RAQGKAREA

SEQ ID NO: 279827 - protein, 24 aa, Mycobacterium
RAQGRVDSRTEDAGSGSGRASTTV

SEQ ID NO: 279828 - protein, 5 aa, Mycobacterium
RAQGV

SEQ ID NO: 279829 - protein, 8 aa, Mycobacterium
RAQIPERT

SEQ ID NO: 279830 - protein, 8 aa, Mycobacterium
RAQPGARA

SEQ ID NO: 279831 - protein, 8 aa, Mycobacterium
RAQPNRRS

SEQ ID NO: 279832 - protein, 26 aa, Mycobacterium
RAQPPRPARSGGWPPHDGSVRGGTAS

SEQ ID NO: 279833 - protein, 9 aa, Mycobacterium
RAQQQAERI

SEQ ID NO: 279834 - protein, 8 aa, Mycobacterium
RAQRDALG

SEQ ID NO: 279835 - protein, 10 aa, Mycobacterium
RAQRNQLGEQ

SEQ ID NO: 279836 - protein, 6 aa, Mycobacterium
RAQRQA

SEQ ID NO: 279837 - protein, 8 aa, Mycobacterium
RAQRQTDV

SEQ ID NO: 279838 - protein, 8 aa, Mycobacterium
RAQSNPST

SEQ ID NO: 279839 - protein, 18 aa, Mycobacterium
RAQSRARNQHYADSAARQ

SEQ ID NO: 279840 - protein, 9 aa, Mycobacterium
RAQTGKAEV

SEQ ID NO: 279841 - protein, 6 aa, Mycobacterium
RAQTLG

SEQ ID NO: 279842 - protein, 7 aa, Mycobacterium
RAQTSAD

SEQ ID NO: 279843 - protein, 4 aa, Mycobacterium
RARA

SEQ ID NO: 279844 - protein, 7 aa, Mycobacterium
RARAARK

SEQ ID NO: 279845 - protein, 13 aa, Mycobacterium
RARADRRVSATPV

SEQ ID NO: 279846 - protein, 8 aa, Mycobacterium
RARAEDQF

SEQ ID NO: 279847 - protein, 7 aa, Mycobacterium
RARAGAP

SEQ ID NO: 279848 - protein, 12 aa, Mycobacterium
RARAGSAGRPVH

SEQ ID NO: 279849 - protein, 5 aa, Mycobacterium
RARAR

SEQ ID NO: 279850 - protein, 14 aa, Mycobacterium
RARDRSPGLDPEQE

SEQ ID NO: 279851 - protein, 8 aa, Mycobacterium
RARDSGAR

SEQ ID NO: 279852 - protein, 8 aa, Mycobacterium
RARELTSN

SEQ ID NO: 279853 - protein, 5 aa, Mycobacterium
RARGA

SEQ ID NO: 279854 - protein, 6 aa, Mycobacterium
RARGDH

SEQ ID NO: 279855 - protein, 10 aa, Mycobacterium
RARGKASEAI

SEQ ID NO: 279856 - protein, 6 aa, Mycobacterium
RARGKP

SEQ ID NO: 279857 - protein, 6 aa, Mycobacterium
RARGLP

SEQ ID NO: 279858 - protein, 5 aa, Mycobacterium
RARGM

SEQ ID NO: 279859 - protein, 6 aa, Mycobacterium
RARGQD

SEQ ID NO: 279860 - protein, 5 aa, Mycobacterium
RARGV

SEQ ID NO: 279861 - protein, 6 aa, Mycobacterium
RARGVA

SEQ ID NO: 279862 - protein, 9 aa, Mycobacterium
RARGVADQD

SEQ ID NO: 279863 - protein, 11 aa, Mycobacterium
RARHGSPDKLR

SEQ ID NO: 279864 - protein, 8 aa, Mycobacterium
RARIPERT

SEQ ID NO: 279865 - protein, 9 aa, Mycobacterium
RARKAGLNI

SEQ ID NO: 279866 - protein, 10 aa, Mycobacterium
RARKRSSGKI

SEQ ID NO: 279867 - protein, 7 aa, Mycobacterium
RARLGVS

SEQ ID NO: 279868 - protein, 4 aa, Mycobacterium
RARN

SEQ ID NO: 279869 - protein, 6 aa, Mycobacterium
RARNTV

SEQ ID NO: 279870 - protein, 7 aa, Mycobacterium
RARPGAR

SEQ ID NO: 279871 - protein, 8 aa, Mycobacterium
RARPQAER

SEQ ID NO: 279872 - protein, 20 aa, Mycobacterium
RARPRRPKPAPAAAEEPADF

SEQ ID NO: 279873 - protein, 16 aa, Mycobacterium
RARPTRPSWKKRTSRI

SEQ ID NO: 279874 - protein, 17 aa, Mycobacterium
RARQAARQARASADAFE

SEQ ID NO: 279875 - protein, 6 aa, Mycobacterium
RARQAI

SEQ ID NO: 279876 - protein, 6 aa, Mycobacterium
RARQGA

SEQ ID NO: 279877 - protein, 23 aa, Mycobacterium
RARQRTRAREMAPRATNQRPGDG

SEQ ID NO: 279878 - protein, 4 aa, Mycobacterium
RARR

SEQ ID NO: 279879 - protein, 14 aa, Mycobacterium
RARRAAGECRDDPY

SEQ ID NO: 279880 - protein, 7 aa, Mycobacterium
RARRASG

SEQ ID NO: 279881 - protein, 7 aa, Mycobacterium
RARRGDA

SEQ ID NO: 279882 - protein, 7 aa, Mycobacterium
RARRGGD

SEQ ID NO: 279883 - protein, 42 aa, Mycobacterium
RARRGVAESTDEPETAAEAAAAVEAGGKAKKVKKDASGPSRN

SEQ ID NO: 279884 - protein, 5 aa, Mycobacterium
RARRP

SEQ ID NO: 279885 - protein, 8 aa, Mycobacterium
RARRPGGV

SEQ ID NO: 279886 - protein, 10 aa, Mycobacterium
RARRPVDPEW

SEQ ID NO: 279887 - protein, 11 aa, Mycobacterium
RARRRGFEPVP

SEQ ID NO: 279888 - protein, 5 aa, Mycobacterium
RARRT

SEQ ID NO: 279889 - protein, 16 aa, Mycobacterium
RARSDWDGYSPHPDQP

SEQ ID NO: 279890 - protein, 8 aa, Mycobacterium
RARSRGEH

SEQ ID NO: 279891 - protein, 9 aa, Mycobacterium
RARSTDATH

SEQ ID NO: 279892 - protein, 7 aa, Mycobacterium
RARSTGK

SEQ ID NO: 279893 - protein, 4 aa, Mycobacterium
RART

SEQ ID NO: 279894 - protein, 6 aa, Mycobacterium
RARTAA

SEQ ID NO: 279895 - protein, 7 aa, Mycobacterium
RARTTGT

SEQ ID NO: 279896 - protein, 5 aa, Mycobacterium
RASAA

SEQ ID NO: 279897 - protein, 8 aa, Mycobacterium
RASAAGSA

SEQ ID NO: 279898 - protein, 9 aa, Mycobacterium
RASADAYTD

SEQ ID NO: 279899 - protein, 6 aa, Mycobacterium
RASANR

SEQ ID NO: 279900 - protein, 7 aa, Mycobacterium
RASATGT

SEQ ID NO: 279901 - protein, 8 aa, Mycobacterium
RASATTPA

SEQ ID NO: 279902 - protein, 11 aa, Mycobacterium
RASAWGRRSNQ

SEQ ID NO: 279903 - protein, 4 aa, Mycobacterium
RASD

SEQ ID NO: 279904 - protein, 9 aa, Mycobacterium
RASDALGRR

SEQ ID NO: 279905 - protein, 16 aa, Mycobacterium
RASELPDLEAPRPPQH

SEQ ID NO: 279906 - protein, 4 aa, Mycobacterium
RASG

SEQ ID NO: 279907 - protein, 8 aa, Mycobacterium
RASGDGEL

SEQ ID NO: 279908 - protein, 12 aa, Mycobacterium
RASGFSSSPAVG

SEQ ID NO: 279909 - protein, 9 aa, Mycobacterium
RASGPEQRI

SEQ ID NO: 279910 - protein, 7 aa, Mycobacterium
RASGSAH

SEQ ID NO: 279911 - protein, 7 aa, Mycobacterium
RASGSGH

SEQ ID NO: 279912 - protein, 22 aa, Mycobacterium
RASGVGTAREFGTSVAGGAAPL

SEQ ID NO: 279913 - protein, 5 aa, Mycobacterium
RASKP

SEQ ID NO: 279914 - protein, 5 aa, Mycobacterium
RASLP

SEQ ID NO: 279915 - protein, 6 aa, Mycobacterium
RASLPQ

SEQ ID NO: 279916 - protein, 7 aa, Mycobacterium
RASLTDV

SEQ ID NO: 279917 - protein, 9 aa, Mycobacterium
RASMSAGPN

SEQ ID NO: 279918 - protein, 6 aa, Mycobacterium
RASPGH

SEQ ID NO: 279919 - protein, 4 aa, Mycobacterium
RASQ

SEQ ID NO: 279920 - protein, 5 aa, Mycobacterium
RASQL

SEQ ID NO: 279921 - protein, 7 aa, Mycobacterium
RASRSTK

SEQ ID NO: 279922 - protein, 15 aa, Mycobacterium
RASSGTAVLVLGEEV

SEQ ID NO: 279923 - protein, 5 aa, Mycobacterium
RASSV

SEQ ID NO: 279924 - protein, 10 aa, Mycobacterium
RASTDPLTSI

SEQ ID NO: 279925 - protein, 6 aa, Mycobacterium
RASTSA

SEQ ID NO: 279926 - protein, 10 aa, Mycobacterium
RASYRDTRAA

SEQ ID NO: 279927 - protein, 7 aa, Mycobacterium
RATAAAQ

SEQ ID NO: 279928 - protein, 8 aa, Mycobacterium
RATADGDD

SEQ ID NO: 279929 - protein, 16 aa, Mycobacterium
RATAELKAKGISQQGE

SEQ ID NO: 279930 - protein, 7 aa, Mycobacterium
RATARAD

SEQ ID NO: 279931 - protein, 9 aa, Mycobacterium
RATAREHGA

SEQ ID NO: 279932 - protein, 9 aa, Mycobacterium
RATATSSAV

SEQ ID NO: 279933 - protein, 4 aa, Mycobacterium
RATD

SEQ ID NO: 279934 - protein, 7 aa, Mycobacterium
RATDDAM

SEQ ID NO: 279935 - protein, 7 aa, Mycobacterium
RATDEAD

SEQ ID NO: 279936 - protein, 33 aa, Mycobacterium
RATDGTGAVQTDQIASPVPDGATGYPKRLVTVA

SEQ ID NO: 279937 - protein, 10 aa, Mycobacterium
RATDKPGRTI

SEQ ID NO: 279938 - protein, 8 aa, Mycobacterium
RATDPNAA

SEQ ID NO: 279939 - protein, 9 aa, Mycobacterium
RATDSAVGQ

SEQ ID NO: 279940 - protein, 10 aa, Mycobacterium
RATDVEPNRL

SEQ ID NO: 279941 - protein, 10 aa, Mycobacterium
RATDVPPNRL

SEQ ID NO: 279942 - protein, 4 aa, Mycobacterium
RATE

SEQ ID NO: 279943 - protein, 5 aa, Mycobacterium
RATGG

SEQ ID NO: 279944 - protein, 16 aa, Mycobacterium
RATGGISPQERQRLPG

SEQ ID NO: 279945 - protein, 10 aa, Mycobacterium
RATGGVDADQ

SEQ ID NO: 279946 - protein, 16 aa, Mycobacterium
RATGGVDPQQRRELPG

SEQ ID NO: 279947 - protein, 16 aa, Mycobacterium
RATGGVDRERRRALPG

SEQ ID NO: 279948 - protein, 10 aa, Mycobacterium
RATGKTSEAI

SEQ ID NO: 279949 - protein, 7 aa, Mycobacterium
RATGSAH

SEQ ID NO: 279950 - protein, 6 aa, Mycobacterium
RATGSG

SEQ ID NO: 279951 - protein, 7 aa, Mycobacterium
RATHGAS

SEQ ID NO: 279952 - protein, 23 aa, Mycobacterium
RATISRPAAEPAPNPTPARQVPA

SEQ ID NO: 279953 - protein, 24 aa, Mycobacterium
RATISRPAATPAPNPTPAREVPST

SEQ ID NO: 279954 - protein, 4 aa, Mycobacterium
RATL

SEQ ID NO: 279955 - protein, 13 aa, Mycobacterium
RATLSRPAAAPVP

SEQ ID NO: 279956 - protein, 37 aa, Mycobacterium
RATPEATPSAAPGNASARGAGADTCRPSEPAQDKTAP

SEQ ID NO: 279957 - protein, 9 aa, Mycobacterium
RATPQPKQF

SEQ ID NO: 279958 - protein, 7 aa, Mycobacterium
RATPRAD

SEQ ID NO: 279959 - protein, 8 aa, Mycobacterium
RATPVAAP

SEQ ID NO: 279960 - protein, 10 aa, Mycobacterium
RATPVPAPRN

SEQ ID NO: 279961 - protein, 37 aa, Mycobacterium
RATRAAEAAQAAQSGAGGANGLDRDRSAYQPDYGAPA

SEQ ID NO: 279962 - protein, 5 aa, Mycobacterium
RATRD

SEQ ID NO: 279963 - protein, 8 aa, Mycobacterium
RATSADGH

SEQ ID NO: 279964 - protein, 9 aa, Mycobacterium
RATSADGHV

SEQ ID NO: 279965 - protein, 6 aa, Mycobacterium
RATSDG

SEQ ID NO: 279966 - protein, 4 aa, Mycobacterium
RATT

SEQ ID NO: 279967 - protein, 23 aa, Mycobacterium
RATTTPRTAATGRHRRSAGQARS

SEQ ID NO: 279968 - protein, 8 aa, Mycobacterium
RATTTSRP

SEQ ID NO: 279969 - protein, 9 aa, Mycobacterium
RATTVSGGK

SEQ ID NO: 279970 - protein, 13 aa, Mycobacterium
RATTVTGSVTVES

SEQ ID NO: 279971 - protein, 14 aa, Mycobacterium
RATVPGSHRSRPGL

SEQ ID NO: 279972 - protein, 23 aa, Mycobacterium
RATVSRPAAAPAPNPSPAREVPG

SEQ ID NO: 279973 - protein, 24 aa, Mycobacterium
RATVSRPAAGDIKRPMSATRVPDS

SEQ ID NO: 279974 - protein, 7 aa, Mycobacterium
RATWTPA

SEQ ID NO: 279975 - protein, 6 aa, Mycobacterium
RATYSE

SEQ ID NO: 279976 - protein, 4 aa, Mycobacterium
RAVA

SEQ ID NO: 279977 - protein, 11 aa, Mycobacterium
RAVADRSSGRL

SEQ ID NO: 279978 - protein, 16 aa, Mycobacterium
RAVAQTAGAPVRGDAA

SEQ ID NO: 279979 - protein, 11 aa, Mycobacterium
RAVDDDRANAL

SEQ ID NO: 279980 - protein, 12 aa, Mycobacterium
RAVEEGASLSGD

SEQ ID NO: 279981 - protein, 9 aa, Mycobacterium
RAVESAPGA

SEQ ID NO: 279982 - protein, 11 aa, Mycobacterium
RAVGPDQQQFS

SEQ ID NO: 279983 - protein, 7 aa, Mycobacterium
RAVGTAG

SEQ ID NO: 279984 - protein, 8 aa, Mycobacterium
RAVPPPDY

SEQ ID NO: 279985 - protein, 14 aa, Mycobacterium
RAVRRQDRANWRTP

SEQ ID NO: 279986 - protein, 9 aa, Mycobacterium
RAVTGGKTI

SEQ ID NO: 279987 - protein, 7 aa, Mycobacterium
RAYDPKN

SEQ ID NO: 279988 - protein, 7 aa, Mycobacterium
RAYSPTY

SEQ ID NO: 279989 - protein, 8 aa, Mycobacterium
RCADETDQ

SEQ ID NO: 279990 - protein, 11 aa, Mycobacterium
RCAEGQAGGGV

SEQ ID NO: 279991 - protein, 11 aa, Mycobacterium
RCDQPVKPGQV

SEQ ID NO: 279992 - protein, 4 aa, Mycobacterium
RCDR

SEQ ID NO: 279993 - protein, 5 aa, Mycobacterium
RCDRS

SEQ ID NO: 279994 - protein, 8 aa, Mycobacterium
RCDSGDRP

SEQ ID NO: 279995 - protein, 10 aa, Mycobacterium
RCDSGDTPAA

SEQ ID NO: 279996 - protein, 5 aa, Mycobacterium
RCDSY

SEQ ID NO: 279997 - protein, 4 aa, Mycobacterium
RCDT

SEQ ID NO: 279998 - protein, 13 aa, Mycobacterium
RCGGNQSRHRQVA

SEQ ID NO: 279999 - protein, 6 aa, Mycobacterium
RCGRRD

SEQ ID NO: 280000 - protein, 7 aa, Mycobacterium
RCPQGRN

SEQ ID NO: 280001 - protein, 12 aa, Mycobacterium
RCQPQGDSDHNP

SEQ ID NO: 280002 - protein, 10 aa, Mycobacterium
RCSTGYAEEV

SEQ ID NO: 280003 - protein, 12 aa, Mycobacterium
RCSTGYAEEVNG

SEQ ID NO: 280004 - protein, 5 aa, Mycobacterium
RCTPR

SEQ ID NO: 280005 - protein, 4 aa, Mycobacterium
RDAA

SEQ ID NO: 280006 - protein, 14 aa, Mycobacterium
RDAAANPGNQTAAA

SEQ ID NO: 280007 - protein, 12 aa, Mycobacterium
RDAAAPPAPDVE

SEQ ID NO: 280008 - protein, 23 aa, Mycobacterium
RDAAAQALEESRNTRGTGVADPL

SEQ ID NO: 280009 - protein, 11 aa, Mycobacterium
RDAAATTQADG

SEQ ID NO: 280010 - protein, 13 aa, Mycobacterium
RDAADRKRATSGR

SEQ ID NO: 280011 - protein, 18 aa, Mycobacterium
RDAAGKGELVGSAPHRRG

SEQ ID NO: 280012 - protein, 8 aa, Mycobacterium
RDAAPGSM

SEQ ID NO: 280013 - protein, 20 aa, Mycobacterium
RDAATRAVESARAGGSEDPL

SEQ ID NO: 280014 - protein, 7 aa, Mycobacterium
RDADNLT

SEQ ID NO: 280015 - protein, 7 aa, Mycobacterium
RDADPGA

SEQ ID NO: 280016 - protein, 11 aa, Mycobacterium
RDAEGTGRKAR

SEQ ID NO: 280017 - protein, 11 aa, Mycobacterium
RDAERAAEHSR

SEQ ID NO: 280018 - protein, 9 aa, Mycobacterium
RDAGAQIES

SEQ ID NO: 280019 - protein, 7 aa, Mycobacterium
RDAGARV

SEQ ID NO: 280020 - protein, 8 aa, Mycobacterium
RDAGGTRR

SEQ ID NO: 280021 - protein, 12 aa, Mycobacterium
RDAGKARRSWPE

SEQ ID NO: 280022 - protein, 7 aa, Mycobacterium
RDAGLTS

SEQ ID NO: 280023 - protein, 8 aa, Mycobacterium
RDAGPAGR

SEQ ID NO: 280024 - protein, 7 aa, Mycobacterium
RDAMRPG

SEQ ID NO: 280025 - protein, 4 aa, Mycobacterium
RDAN

SEQ ID NO: 280026 - protein, 12 aa, Mycobacterium
RDANRADHDPAL

SEQ ID NO: 280027 - protein, 7 aa, Mycobacterium
RDAPRKM

SEQ ID NO: 280028 - protein, 7 aa, Mycobacterium
RDAPSLQ

SEQ ID NO: 280029 - protein, 8 aa, Mycobacterium
RDAPSLQT

SEQ ID NO: 280030 - protein, 5 aa, Mycobacterium
RDAQK

SEQ ID NO: 280031 - protein, 22 aa, Mycobacterium
RDAQKPKLVPEKADEPGALGEP

SEQ ID NO: 280032 - protein, 4 aa, Mycobacterium
RDAR

SEQ ID NO: 280033 - protein, 7 aa, Mycobacterium
RDARDSL

SEQ ID NO: 280034 - protein, 10 aa, Mycobacterium
RDARGGRPPA

SEQ ID NO: 280035 - protein, 8 aa, Mycobacterium
RDASGAHA

SEQ ID NO: 280036 - protein, 21 aa, Mycobacterium
RDASGRPAGYAQSRWESSRAE

SEQ ID NO: 280037 - protein, 5 aa, Mycobacterium
RDASQ

SEQ ID NO: 280038 - protein, 7 aa, Mycobacterium
RDASSSR

SEQ ID NO: 280039 - protein, 5 aa, Mycobacterium
RDATG

SEQ ID NO: 280040 - protein, 7 aa, Mycobacterium
RDATNTF

SEQ ID NO: 280041 - protein, 8 aa, Mycobacterium
RDATPQLR

SEQ ID NO: 280042 - protein, 12 aa, Mycobacterium
RDATPRDIHPKH

SEQ ID NO: 280043 - protein, 15 aa, Mycobacterium
RDATPRDIHPKHNAP

SEQ ID NO: 280044 - protein, 45 aa, Mycobacterium
RDATVGTAEAERDAQIQSAKARQEGSIAQAEADTAIASANQKRDV

SEQ ID NO: 280045 - protein, 14 aa, Mycobacterium
RDAVGPGRAVPLQG

SEQ ID NO: 280046 - protein, 12 aa, Mycobacterium
RDAVSEFPSDRG

SEQ ID NO: 280047 - protein, 8 aa, Mycobacterium
RDAYTGTG

SEQ ID NO: 280048 - protein, 11 aa, Mycobacterium
RDCPSRTDSLG

SEQ ID NO: 280049 - protein, 4 aa, Mycobacterium
RDDA

SEQ ID NO: 280050 - protein, 6 aa, Mycobacterium
RDDAGQ

SEQ ID NO: 280051 - protein, 9 aa, Mycobacterium
RDDASVRDK

SEQ ID NO: 280052 - protein, 5 aa, Mycobacterium
RDDDG

SEQ ID NO: 280053 - protein, 5 aa, Mycobacterium
RDDDP

SEQ ID NO: 280054 - protein, 10 aa, Mycobacterium
RDDDPAAAYE

SEQ ID NO: 280055 - protein, 6 aa, Mycobacterium
RDDDVE

SEQ ID NO: 280056 - protein, 11 aa, Mycobacterium
RDDETAPLQPS

SEQ ID NO: 280057 - protein, 8 aa, Mycobacterium
RDDGGTVG

SEQ ID NO: 280058 - protein, 22 aa, Mycobacterium
RDDGSGIADGRLDQAEREGRMG

SEQ ID NO: 280059 - protein, 5 aa, Mycobacterium
RDDGT

SEQ ID NO: 280060 - protein, 8 aa, Mycobacterium
RDDHATPA

SEQ ID NO: 280061 - protein, 9 aa, Mycobacterium
RDDHATPAE

SEQ ID NO: 280062 - protein, 11 aa, Mycobacterium
RDDKAAWPPIQ

SEQ ID NO: 280063 - protein, 4 aa, Mycobacterium
RDDL

SEQ ID NO: 280064 - protein, 8 aa, Mycobacterium
RDDPAGQA

SEQ ID NO: 280065 - protein, 9 aa, Mycobacterium
RDDPARSET

SEQ ID NO: 280066 - protein, 9 aa, Mycobacterium
RDDPGAQTA

SEQ ID NO: 280067 - protein, 7 aa, Mycobacterium
RDDPVKA

SEQ ID NO: 280068 - protein, 9 aa, Mycobacterium
RDDSQPGGS

SEQ ID NO: 280069 - protein, 4 aa, Mycobacterium
RDDT

SEQ ID NO: 280070 - protein, 8 aa, Mycobacterium
RDDTAERR

SEQ ID NO: 280071 - protein, 5 aa, Mycobacterium
RDDTE

SEQ ID NO: 280072 - protein, 6 aa, Mycobacterium
RDDTEY

SEQ ID NO: 280073 - protein, 6 aa, Mycobacterium
RDDTRH

SEQ ID NO: 280074 - protein, 7 aa, Mycobacterium
RDDTSIP

SEQ ID NO: 280075 - protein, 10 aa, Mycobacterium
RDDTTQPKAH

SEQ ID NO: 280076 - protein, 4 aa, Mycobacterium
RDEA

SEQ ID NO: 280077 - protein, 18 aa, Mycobacterium
RDEAAKGELVGAAPPRRG

SEQ ID NO: 280078 - protein, 10 aa, Mycobacterium
RDEADAGDGL

SEQ ID NO: 280079 - protein, 8 aa, Mycobacterium
RDEAGNAV

SEQ ID NO: 280080 - protein, 22 aa, Mycobacterium
RDEAPAPSNRTSTTTTATSTPH

SEQ ID NO: 280081 - protein, 9 aa, Mycobacterium
RDEEGEEVP

SEQ ID NO: 280082 - protein, 7 aa, Mycobacterium
RDEERAR

SEQ ID NO: 280083 - protein, 8 aa, Mycobacterium
RDEFGQDG

SEQ ID NO: 280084 - protein, 5 aa, Mycobacterium
RDEFS

SEQ ID NO: 280085 - protein, 5 aa, Mycobacterium
RDEGT

SEQ ID NO: 280086 - protein, 18 aa, Mycobacterium
RDEHDDATPDVMPAGKGW

SEQ ID NO: 280087 - protein, 17 aa, Mycobacterium
RDEHDDATPDVVPAGTG

SEQ ID NO: 280088 - protein, 17 aa, Mycobacterium
RDEHDDATPDVVSSGGG

SEQ ID NO: 280089 - protein, 11 aa, Mycobacterium
RDEHDDEPPDV

SEQ ID NO: 280090 - protein, 8 aa, Mycobacterium
RDEHPDTN

SEQ ID NO: 280091 - protein, 5 aa, Mycobacterium
RDEIG

SEQ ID NO: 280092 - protein, 6 aa, Mycobacterium
RDEKSL

SEQ ID NO: 280093 - protein, 8 aa, Mycobacterium
RDENGQVR

SEQ ID NO: 280094 - protein, 16 aa, Mycobacterium
RDENGRPQTAATLNGT

SEQ ID NO: 280095 - protein, 5 aa, Mycobacterium
RDENN

SEQ ID NO: 280096 - protein, 8 aa, Mycobacterium
RDENNRYL

SEQ ID NO: 280097 - protein, 5 aa, Mycobacterium
RDEPL

SEQ ID NO: 280098 - protein, 5 aa, Mycobacterium
RDEQA

SEQ ID NO: 280099 - protein, 12 aa, Mycobacterium
RDEQSPPDPKAL

SEQ ID NO: 280100 - protein, 19 aa, Mycobacterium
RDERSSTHANADVTCRVKS

SEQ ID NO: 280101 - protein, 20 aa, Mycobacterium
RDERSTALRQRREAKTERTI

SEQ ID NO: 280102 - protein, 8 aa, Mycobacterium
RDESASSV

SEQ ID NO: 280103 - protein, 9 aa, Mycobacterium
RDESPNGIR

SEQ ID NO: 280104 - protein, 7 aa, Mycobacterium
RDESPVR

SEQ ID NO: 280105 - protein, 8 aa, Mycobacterium
RDEYSGDL

SEQ ID NO: 280106 - protein, 9 aa, Mycobacterium
RDFATSGLE

SEQ ID NO: 280107 - protein, 6 aa, Mycobacterium
RDFPSR

SEQ ID NO: 280108 - protein, 7 aa, Mycobacterium
RDFYGNP

SEQ ID NO: 280109 - protein, 8 aa, Mycobacterium
RDFYSNPG

SEQ ID NO: 280110 - protein, 10 aa, Mycobacterium
RDGAATALAP

SEQ ID NO: 280111 - protein, 8 aa, Mycobacterium
RDGANALE

SEQ ID NO: 280112 - protein, 13 aa, Mycobacterium
RDGATQKSVDQTA

SEQ ID NO: 280113 - protein, 9 aa, Mycobacterium
RDGATSGSV

SEQ ID NO: 280114 - protein, 10 aa, Mycobacterium
RDGAVPAKGT

SEQ ID NO: 280115 - protein, 9 aa, Mycobacterium
RDGDGVASR

SEQ ID NO: 280116 - protein, 5 aa, Mycobacterium
RDGEP

SEQ ID NO: 280117 - protein, 7 aa, Mycobacterium
RDGEPIG

SEQ ID NO: 280118 - protein, 19 aa, Mycobacterium
RDGFSDGPSVPMMPSTWDR

SEQ ID NO: 280119 - protein, 7 aa, Mycobacterium
RDGGASH

SEQ ID NO: 280120 - protein, 11 aa, Mycobacterium
RDGGDAASNST

SEQ ID NO: 280121 - protein, 5 aa, Mycobacterium
RDGGE

SEQ ID NO: 280122 - protein, 9 aa, Mycobacterium
RDGGEKTVA

SEQ ID NO: 280123 - protein, 14 aa, Mycobacterium
RDGGQLKVAKVEAL

SEQ ID NO: 280124 - protein, 12 aa, Mycobacterium
RDGIGDGDRPVR

SEQ ID NO: 280125 - protein, 4 aa, Mycobacterium
RDGK

SEQ ID NO: 280126 - protein, 10 aa, Mycobacterium
RDGKPTTFGA

SEQ ID NO: 280127 - protein, 11 aa, Mycobacterium
RDGKPTTFGAA

SEQ ID NO: 280128 - protein, 6 aa, Mycobacterium
RDGKRI

SEQ ID NO: 280129 - protein, 23 aa, Mycobacterium
RDGKSANPSGTADTDRFPVSTPH

SEQ ID NO: 280130 - protein, 4 aa, Mycobacterium
RDGL

SEQ ID NO: 280131 - protein, 12 aa, Mycobacterium
RDGLDTQAGYVP

SEQ ID NO: 280132 - protein, 7 aa, Mycobacterium
RDGNRTV

SEQ ID NO: 280133 - protein, 7 aa, Mycobacterium
RDGPDAP

SEQ ID NO: 280134 - protein, 7 aa, Mycobacterium
RDGPESP

SEQ ID NO: 280135 - protein, 8 aa, Mycobacterium
RDGPMTPA

SEQ ID NO: 280136 - protein, 13 aa, Mycobacterium
RDGPPPPEGPKTP

SEQ ID NO: 280137 - protein, 13 aa, Mycobacterium
RDGPPPPTRDPID

SEQ ID NO: 280138 - protein, 7 aa, Mycobacterium
RDGPPVD

SEQ ID NO: 280139 - protein, 4 aa, Mycobacterium
RDGQ

SEQ ID NO: 280140 - protein, 8 aa, Mycobacterium
RDGQGMPE

SEQ ID NO: 280141 - protein, 7 aa, Mycobacterium
RDGQRTL

SEQ ID NO: 280142 - protein, 6 aa, Mycobacterium
RDGRGR

SEQ ID NO: 280143 - protein, 7 aa, Mycobacterium
RDGRPVA

SEQ ID NO: 280144 - protein, 6 aa, Mycobacterium
RDGRSS

SEQ ID NO: 280145 - protein, 9 aa, Mycobacterium
RDGRTDAHG

SEQ ID NO: 280146 - protein, 7 aa, Mycobacterium
RDGSETV

SEQ ID NO: 280147 - protein, 8 aa, Mycobacterium
RDGSREQV

SEQ ID NO: 280148 - protein, 4 aa, Mycobacterium
RDGT

SEQ ID NO: 280149 - protein, 22 aa, Mycobacterium
RDGTAEVTVTDSGPGIPDGERE

SEQ ID NO: 280150 - protein, 9 aa, Mycobacterium
RDGTDAMST

SEQ ID NO: 280151 - protein, 9 aa, Mycobacterium
RDGTETTIT

SEQ ID NO: 280152 - protein, 14 aa, Mycobacterium
RDGTQLKISKVEFV

SEQ ID NO: 280153 - protein, 6 aa, Mycobacterium
RDGTVS

SEQ ID NO: 280154 - protein, 4 aa, Mycobacterium
RDGV

SEQ ID NO: 280155 - protein, 11 aa, Mycobacterium
RDGVARRGQLR

SEQ ID NO: 280156 - protein, 8 aa, Mycobacterium
RDGYTAEQ

SEQ ID NO: 280157 - protein, 7 aa, Mycobacterium
RDGYTAT

SEQ ID NO: 280158 - protein, 6 aa, Mycobacterium
RDHDVR

SEQ ID NO: 280159 - protein, 8 aa, Mycobacterium
RDHPGRTP

SEQ ID NO: 280160 - protein, 6 aa, Mycobacterium
RDHQAT

SEQ ID NO: 280161 - protein, 10 aa, Mycobacterium
RDIEPGHRRD

SEQ ID NO: 280162 - protein, 5 aa, Mycobacterium
RDIGT

SEQ ID NO: 280163 - protein, 6 aa, Mycobacterium
RDITER

SEQ ID NO: 280164 - protein, 9 aa, Mycobacterium
RDKDGTERR

SEQ ID NO: 280165 - protein, 10 aa, Mycobacterium
RDKDSDDSVA

SEQ ID NO: 280166 - protein, 9 aa, Mycobacterium
RDKDTDDTI

SEQ ID NO: 280167 - protein, 7 aa, Mycobacterium
RDKGPVR

SEQ ID NO: 280168 - protein, 11 aa, Mycobacterium
RDKGSRNGTYV

SEQ ID NO: 280169 - protein, 5 aa, Mycobacterium
RDKKH

SEQ ID NO: 280170 - protein, 13 aa, Mycobacterium
RDKLTGEYRGGPA

SEQ ID NO: 280171 - protein, 10 aa, Mycobacterium
RDKRSDQALA

SEQ ID NO: 280172 - protein, 9 aa, Mycobacterium
RDKSLPDHQ

SEQ ID NO: 280173 - protein, 13 aa, Mycobacterium
RDLDREDDEYADD

SEQ ID NO: 280174 - protein, 6 aa, Mycobacterium
RDLESG

SEQ ID NO: 280175 - protein, 4 aa, Mycobacterium
RDLG

SEQ ID NO: 280176 - protein, 6 aa, Mycobacterium
RDLGAD

SEQ ID NO: 280177 - protein, 46 aa, Mycobacterium
RDLGESDRLDETARLPARTRTLRGRAQDPARDARRRKRRAQRAQTL

SEQ ID NO: 280178 - protein, 7 aa, Mycobacterium
RDLPASV

SEQ ID NO: 280179 - protein, 29 aa, Mycobacterium
RDLQQAKDDRASLDLGGSSGGFGGGNNPY

SEQ ID NO: 280180 - protein, 31 aa, Mycobacterium
RDLQQAKDDRNALGSSGSGGGFGGGNNPYAK

SEQ ID NO: 280181 - protein, 8 aa, Mycobacterium
RDLRNPTA

SEQ ID NO: 280182 - protein, 8 aa, Mycobacterium
RDLRTPQA

SEQ ID NO: 280183 - protein, 6 aa, Mycobacterium
RDLSGN

SEQ ID NO: 280184 - protein, 4 aa, Mycobacterium
RDMG

SEQ ID NO: 280185 - protein, 8 aa, Mycobacterium
RDNALPDH

SEQ ID NO: 280186 - protein, 6 aa, Mycobacterium
RDNEIA

SEQ ID NO: 280187 - protein, 4 aa, Mycobacterium
RDNG

SEQ ID NO: 280188 - protein, 18 aa, Mycobacterium
RDNGAHQTASSQPSTQAP

SEQ ID NO: 280189 - protein, 8 aa, Mycobacterium
RDNGGEVN

SEQ ID NO: 280190 - protein, 5 aa, Mycobacterium
RDNPA

SEQ ID NO: 280191 - protein, 8 aa, Mycobacterium
RDNPPPFG

SEQ ID NO: 280192 - protein, 8 aa, Mycobacterium
RDNPTKAY

SEQ ID NO: 280193 - protein, 6 aa, Mycobacterium
RDNQNR

SEQ ID NO: 280194 - protein, 19 aa, Mycobacterium
RDNQNSDGHNAQTFCLVKS

SEQ ID NO: 280195 - protein, 5 aa, Mycobacterium
RDNQP

SEQ ID NO: 280196 - protein, 8 aa, Mycobacterium
RDNRAAGL

SEQ ID NO: 280197 - protein, 5 aa, Mycobacterium
RDNRS

SEQ ID NO: 280198 - protein, 10 aa, Mycobacterium
RDNSADEDES

SEQ ID NO: 280199 - protein, 6 aa, Mycobacterium
RDNSEA

SEQ ID NO: 280200 - protein, 7 aa, Mycobacterium
RDNSGIA

SEQ ID NO: 280201 - protein, 8 aa, Mycobacterium
RDNTDADI

SEQ ID NO: 280202 - protein, 11 aa, Mycobacterium
RDNTGDEDESL

SEQ ID NO: 280203 - protein, 9 aa, Mycobacterium
RDPAANNAL

SEQ ID NO: 280204 - protein, 10 aa, Mycobacterium
RDPAGAQSQL

SEQ ID NO: 280205 - protein, 9 aa, Mycobacterium
RDPAGQPVE

SEQ ID NO: 280206 - protein, 5 aa, Mycobacterium
RDPAK

SEQ ID NO: 280207 - protein, 8 aa, Mycobacterium
RDPAKAAL

SEQ ID NO: 280208 - protein, 5 aa, Mycobacterium
RDPAQ

SEQ ID NO: 280209 - protein, 7 aa, Mycobacterium
RDPAQAA

SEQ ID NO: 280210 - protein, 8 aa, Mycobacterium
RDPAQAAA

SEQ ID NO: 280211 - protein, 8 aa, Mycobacterium
RDPARAVP

SEQ ID NO: 280212 - protein, 9 aa, Mycobacterium
RDPASLDAA

SEQ ID NO: 280213 - protein, 15 aa, Mycobacterium
RDPATPAGISTVTSE

SEQ ID NO: 280214 - protein, 5 aa, Mycobacterium
RDPAY

SEQ ID NO: 280215 - protein, 4 aa, Mycobacterium
RDPD

SEQ ID NO: 280216 - protein, 16 aa, Mycobacterium
RDPDEPDSTDAGTEIA

SEQ ID NO: 280217 - protein, 20 aa, Mycobacterium
RDPDERSAATEPAEGGAGFP

SEQ ID NO: 280218 - protein, 6 aa, Mycobacterium
RDPDLR

SEQ ID NO: 280219 - protein, 5 aa, Mycobacterium
RDPEP

SEQ ID NO: 280220 - protein, 7 aa, Mycobacterium
RDPEQRA

SEQ ID NO: 280221 - protein, 8 aa, Mycobacterium
RDPEQRPA

SEQ ID NO: 280222 - protein, 5 aa, Mycobacterium
RDPGG

SEQ ID NO: 280223 - protein, 7 aa, Mycobacterium
RDPGGIL

SEQ ID NO: 280224 - protein, 5 aa, Mycobacterium
RDPGS

SEQ ID NO: 280225 - protein, 13 aa, Mycobacterium
RDPGTDKPPEVST

SEQ ID NO: 280226 - protein, 7 aa, Mycobacterium
RDPLGAD

SEQ ID NO: 280227 - protein, 7 aa, Mycobacterium
RDPNAVR

SEQ ID NO: 280228 - protein, 9 aa, Mycobacterium
RDPNGQRID

SEQ ID NO: 280229 - protein, 26 aa, Mycobacterium
RDPNRRPPWPPNPPTPARRPIPPPHR

SEQ ID NO: 280230 - protein, 9 aa, Mycobacterium
RDPPRDDIA

SEQ ID NO: 280231 - protein, 6 aa, Mycobacterium
RDPQFG

SEQ ID NO: 280232 - protein, 6 aa, Mycobacterium
RDPQGL

SEQ ID NO: 280233 - protein, 14 aa, Mycobacterium
RDPQGLSVDSGGTV

SEQ ID NO: 280234 - protein, 10 aa, Mycobacterium
RDPQSPGGFK

SEQ ID NO: 280235 - protein, 7 aa, Mycobacterium
RDPQTAE

SEQ ID NO: 280236 - protein, 8 aa, Mycobacterium
RDPQYPRN

SEQ ID NO: 280237 - protein, 16 aa, Mycobacterium
RDPRGIQQGTGPQAAV

SEQ ID NO: 280238 - protein, 17 aa, Mycobacterium
RDPRTPEVEPRYDDGRT

SEQ ID NO: 280239 - protein, 6 aa, Mycobacterium
RDPSNR

SEQ ID NO: 280240 - protein, 8 aa, Mycobacterium
RDPSPVRA

SEQ ID NO: 280241 - protein, 6 aa, Mycobacterium
RDPSQT

SEQ ID NO: 280242 - protein, 12 aa, Mycobacterium
RDPSSDATGRLR

SEQ ID NO: 280243 - protein, 9 aa, Mycobacterium
RDPVDGYGR

SEQ ID NO: 280244 - protein, 11 aa, Mycobacterium
RDPVSDTGSAQ

SEQ ID NO: 280245 - protein, 12 aa, Mycobacterium
RDPVSNTGSAQH

SEQ ID NO: 280246 - protein, 57 aa, Mycobacterium
RDPYEGFSPTVRDSTGAKAPAGTIPAAASGIAASAAERRKRRRRQKEEIKGRGYADA

SEQ ID NO: 280247 - protein, 8 aa, Mycobacterium
RDQAAHRE

SEQ ID NO: 280248 - protein, 8 aa, Mycobacterium
RDQAMSPQ

SEQ ID NO: 280249 - protein, 7 aa, Mycobacterium
RDQESGI

SEQ ID NO: 280250 - protein, 6 aa, Mycobacterium
RDQETA

SEQ ID NO: 280251 - protein, 7 aa, Mycobacterium
RDQETAV

SEQ ID NO: 280252 - protein, 7 aa, Mycobacterium
RDQETGV

SEQ ID NO: 280253 - protein, 6 aa, Mycobacterium
RDQGPV

SEQ ID NO: 280254 - protein, 4 aa, Mycobacterium
RDQH

SEQ ID NO: 280255 - protein, 12 aa, Mycobacterium
RDQLEAGSNPRA

SEQ ID NO: 280256 - protein, 10 aa, Mycobacterium
RDQLGPADQH

SEQ ID NO: 280257 - protein, 7 aa, Mycobacterium
RDQPDAT

SEQ ID NO: 280258 - protein, 4 aa, Mycobacterium
RDQR

SEQ ID NO: 280259 - protein, 13 aa, Mycobacterium
RDQRKRRAYTADE

SEQ ID NO: 280260 - protein, 13 aa, Mycobacterium
RDQRRRNAYTPDD

SEQ ID NO: 280261 - protein, 4 aa, Mycobacterium
RDQS

SEQ ID NO: 280262 - protein, 20 aa, Mycobacterium
RDQSAPDFSGAESDTGTDRI

SEQ ID NO: 280263 - protein, 6 aa, Mycobacterium
RDQTRR

SEQ ID NO: 280264 - protein, 8 aa, Mycobacterium
RDQVSQKP

SEQ ID NO: 280265 - protein, 17 aa, Mycobacterium
RDRAAAQHRRDESAALQ

SEQ ID NO: 280266 - protein, 6 aa, Mycobacterium
RDRAGA

SEQ ID NO: 280267 - protein, 5 aa, Mycobacterium
RDRAQ

SEQ ID NO: 280268 - protein, 16 aa, Mycobacterium
RDRDAEARAVGRGPAL

SEQ ID NO: 280269 - protein, 10 aa, Mycobacterium
RDRDAETRRV

SEQ ID NO: 280270 - protein, 7 aa, Mycobacterium
RDRDDQW

SEQ ID NO: 280271 - protein, 14 aa, Mycobacterium
RDRDGVAPTYAAID

SEQ ID NO: 280272 - protein, 5 aa, Mycobacterium
RDRDP

SEQ ID NO: 280273 - protein, 6 aa, Mycobacterium
RDRDPA

SEQ ID NO: 280274 - protein, 8 aa, Mycobacterium
RDREARRD

SEQ ID NO: 280275 - protein, 5 aa, Mycobacterium
RDRGD

SEQ ID NO: 280276 - protein, 8 aa, Mycobacterium
RDRGEGRV

SEQ ID NO: 280277 - protein, 12 aa, Mycobacterium
RDRGRQRRSWPE

SEQ ID NO: 280278 - protein, 10 aa, Mycobacterium
RDRHGHAEGP

SEQ ID NO: 280279 - protein, 12 aa, Mycobacterium
RDRHGHPEPGPF

SEQ ID NO: 280280 - protein, 14 aa, Mycobacterium
RDRHGHPGPGEPRR

SEQ ID NO: 280281 - protein, 14 aa, Mycobacterium
RDRHGRPAEGEPRR

SEQ ID NO: 280282 - protein, 6 aa, Mycobacterium
RDRKAA

SEQ ID NO: 280283 - protein, 48 aa, Mycobacterium
RDRLRAKSAAQSAAAARPQPERKRQSASAPGPKRTPRARTDNEAGHHR

SEQ ID NO: 280284 - protein, 9 aa, Mycobacterium
RDRPAAGAR

SEQ ID NO: 280285 - protein, 17 aa, Mycobacterium
RDRPAGTMTESSGGSGA

SEQ ID NO: 280286 - protein, 9 aa, Mycobacterium
RDRPPTPPL

SEQ ID NO: 280287 - protein, 7 aa, Mycobacterium
RDRPPVA

SEQ ID NO: 280288 - protein, 16 aa, Mycobacterium
RDRPRYTPPAQTQQPP

SEQ ID NO: 280289 - protein, 18 aa, Mycobacterium
RDRQSRGELPGQQGSATD

SEQ ID NO: 280290 - protein, 11 aa, Mycobacterium
RDRQYADSLTR

SEQ ID NO: 280291 - protein, 13 aa, Mycobacterium
RDRRQADAHRRRD

SEQ ID NO: 280292 - protein, 10 aa, Mycobacterium
RDRRQRGGAG

SEQ ID NO: 280293 - protein, 19 aa, Mycobacterium
RDRSPNRETEPRRDSPSPL

SEQ ID NO: 280294 - protein, 7 aa, Mycobacterium
RDRTTVD

SEQ ID NO: 280295 - protein, 9 aa, Mycobacterium
RDRVAGPDC

SEQ ID NO: 280296 - protein, 11 aa, Mycobacterium
RDRVSTATKAV

SEQ ID NO: 280297 - protein, 15 aa, Mycobacterium
RDSAGDAEAARTGAR

SEQ ID NO: 280298 - protein, 11 aa, Mycobacterium
RDSEAAAEHSR

SEQ ID NO: 280299 - protein, 16 aa, Mycobacterium
RDSEPTAVGKEPFTRD

SEQ ID NO: 280300 - protein, 8 aa, Mycobacterium
RDSFSGAS

SEQ ID NO: 280301 - protein, 4 aa, Mycobacterium
RDSG

SEQ ID NO: 280302 - protein, 6 aa, Mycobacterium
RDSHHD

SEQ ID NO: 280303 - protein, 9 aa, Mycobacterium
RDSKPDWTP

SEQ ID NO: 280304 - protein, 7 aa, Mycobacterium
RDSPQWS

SEQ ID NO: 280305 - protein, 8 aa, Mycobacterium
RDSPTWSP

SEQ ID NO: 280306 - protein, 8 aa, Mycobacterium
RDSRAAGA

SEQ ID NO: 280307 - protein, 15 aa, Mycobacterium
RDSRADVRVAGDRLR

SEQ ID NO: 280308 - protein, 9 aa, Mycobacterium
RDSSGTPIG

SEQ ID NO: 280309 - protein, 10 aa, Mycobacterium
RDSSTFNPGT

SEQ ID NO: 280310 - protein, 50 aa, Mycobacterium
RDSSTTAGSPGSSPTTSAPTSQPNGSEQTATDCTPNVSGGDKPDDGTISA

SEQ ID NO: 280311 - protein, 7 aa, Mycobacterium
RDSVNGI

SEQ ID NO: 280312 - protein, 8 aa, Mycobacterium
RDSVNRHH

SEQ ID NO: 280313 - protein, 11 aa, Mycobacterium
RDSVQDQGPRY

SEQ ID NO: 280314 - protein, 8 aa, Mycobacterium
RDSYGGTG

SEQ ID NO: 280315 - protein, 8 aa, Mycobacterium
RDSYSGTG

SEQ ID NO: 280316 - protein, 9 aa, Mycobacterium
RDTAAAQAA

SEQ ID NO: 280317 - protein, 11 aa, Mycobacterium
RDTAAPAGPEL

SEQ ID NO: 280318 - protein, 16 aa, Mycobacterium
RDTAGSHATAKRNPLT

SEQ ID NO: 280319 - protein, 5 aa, Mycobacterium
RDTAH

SEQ ID NO: 280320 - protein, 11 aa, Mycobacterium
RDTAPAAGPQL

SEQ ID NO: 280321 - protein, 9 aa, Mycobacterium
RDTATDSRP

SEQ ID NO: 280322 - protein, 6 aa, Mycobacterium
RDTDAV

SEQ ID NO: 280323 - protein, 5 aa, Mycobacterium
RDTDD

SEQ ID NO: 280324 - protein, 12 aa, Mycobacterium
RDTEHDDDADNA

SEQ ID NO: 280325 - protein, 10 aa, Mycobacterium
RDTEIAGRQA

SEQ ID NO: 280326 - protein, 7 aa, Mycobacterium
RDTETAP

SEQ ID NO: 280327 - protein, 9 aa, Mycobacterium
RDTGPGTTT

SEQ ID NO: 280328 - protein, 6 aa, Mycobacterium
RDTGQL

SEQ ID NO: 280329 - protein, 43 aa, Mycobacterium
RDTGSSEGNSEDYDRYADGTESQQQSSSVAVADDETRPVDKRD

SEQ ID NO: 280330 - protein, 13 aa, Mycobacterium
RDTHAAETSVTPI

SEQ ID NO: 280331 - protein, 6 aa, Mycobacterium
RDTKMR

SEQ ID NO: 280332 - protein, 9 aa, Mycobacterium
RDTPAPSET

SEQ ID NO: 280333 - protein, 10 aa, Mycobacterium
RDTTNQFEKP

SEQ ID NO: 280334 - protein, 22 aa, Mycobacterium
RDTTPGVDAREPGAEPGTEVLK

SEQ ID NO: 280335 - protein, 6 aa, Mycobacterium
RDTTRE

SEQ ID NO: 280336 - protein, 8 aa, Mycobacterium
RDTYGGTG

SEQ ID NO: 280337 - protein, 8 aa, Mycobacterium
RDVAQRQR

SEQ ID NO: 280338 - protein, 13 aa, Mycobacterium
RDVEADRAHPTKR

SEQ ID NO: 280339 - protein, 12 aa, Mycobacterium
RDVEADRQHPTK

SEQ ID NO: 280340 - protein, 11 aa, Mycobacterium
RDVEGSGRRAR

SEQ ID NO: 280341 - protein, 11 aa, Mycobacterium
RDVGSSTSVQT

SEQ ID NO: 280342 - protein, 4 aa, Mycobacterium
RDVK

SEQ ID NO: 280343 - protein, 4 aa, Mycobacterium
RDVP

SEQ ID NO: 280344 - protein, 9 aa, Mycobacterium
RDVPPPSSV

SEQ ID NO: 280345 - protein, 4 aa, Mycobacterium
RDVQ

SEQ ID NO: 280346 - protein, 5 aa, Mycobacterium
RDVST

SEQ ID NO: 280347 - protein, 26 aa, Mycobacterium
RDVTERRREQDRLREAQRQIEASHQE

SEQ ID NO: 280348 - protein, 6 aa, Mycobacterium
RDVTGR

SEQ ID NO: 280349 - protein, 4 aa, Mycobacterium
RDWE

SEQ ID NO: 280350 - protein, 6 aa, Mycobacterium
RDYEER

SEQ ID NO: 280351 - protein, 5 aa, Mycobacterium
RDYER

SEQ ID NO: 280352 - protein, 23 aa, Mycobacterium
RDYPGNASATAQQVAADRATTSN

SEQ ID NO: 280353 - protein, 8 aa, Mycobacterium
RDYQRTGA

SEQ ID NO: 280354 - protein, 10 aa, Mycobacterium
RDYSSRASAA

SEQ ID NO: 280355 - protein, 4 aa, Mycobacterium
REAA

SEQ ID NO: 280356 - protein, 10 aa, Mycobacterium
REAAAHNATM

SEQ ID NO: 280357 - protein, 13 aa, Mycobacterium
REAAANPANQTAA

SEQ ID NO: 280358 - protein, 14 aa, Mycobacterium
REAAANPSNQTAAA

SEQ ID NO: 280359 - protein, 16 aa, Mycobacterium
REAAENANETVSDAQK

SEQ ID NO: 280360 - protein, 9 aa, Mycobacterium
REAAERAGL

SEQ ID NO: 280361 - protein, 6 aa, Mycobacterium
READAA

SEQ ID NO: 280362 - protein, 9 aa, Mycobacterium
READTNNAL

SEQ ID NO: 280363 - protein, 8 aa, Mycobacterium
REAEDLSE

SEQ ID NO: 280364 - protein, 9 aa, Mycobacterium
REAEDLSEA

SEQ ID NO: 280365 - protein, 23 aa, Mycobacterium
REAEPELPADNNVGPEPRTVGSV

SEQ ID NO: 280366 - protein, 6 aa, Mycobacterium
REAEVP

SEQ ID NO: 280367 - protein, 13 aa, Mycobacterium
REAFAGAGEGRAD

SEQ ID NO: 280368 - protein, 4 aa, Mycobacterium
REAG

SEQ ID NO: 280369 - protein, 9 aa, Mycobacterium
REAGDPSTA

SEQ ID NO: 280370 - protein, 11 aa, Mycobacterium
REAGDRTVRTR

SEQ ID NO: 280371 - protein, 8 aa, Mycobacterium
REAGHAAE

SEQ ID NO: 280372 - protein, 14 aa, Mycobacterium
REAGLSDAKGTFPR

SEQ ID NO: 280373 - protein, 13 aa, Mycobacterium
REAGLSDPQGTFP

SEQ ID NO: 280374 - protein, 10 aa, Mycobacterium
REAHAAGRLQ

SEQ ID NO: 280375 - protein, 5 aa, Mycobacterium
REAIR

SEQ ID NO: 280376 - protein, 5 aa, Mycobacterium
REAIS

SEQ ID NO: 280377 - protein, 8 aa, Mycobacterium
REAKPRDF

SEQ ID NO: 280378 - protein, 9 aa, Mycobacterium
REAKRKRRN

SEQ ID NO: 280379 - protein, 14 aa, Mycobacterium
REANDRTVRSREKL

SEQ ID NO: 280380 - protein, 7 aa, Mycobacterium
REANRAG

SEQ ID NO: 280381 - protein, 4 aa, Mycobacterium
REAP

SEQ ID NO: 280382 - protein, 5 aa, Mycobacterium
REAPA

SEQ ID NO: 280383 - protein, 6 aa, Mycobacterium
REAPAS

SEQ ID NO: 280384 - protein, 13 aa, Mycobacterium
REAPLAAAGGRFG

SEQ ID NO: 280385 - protein, 14 aa, Mycobacterium
REAPPPAVHTTSPG

SEQ ID NO: 280386 - protein, 6 aa, Mycobacterium
REAPPQ

SEQ ID NO: 280387 - protein, 35 aa, Mycobacterium
REAPPSAVPPGVLPPPSTTTHPHKPRPATQDASCP

SEQ ID NO: 280388 - protein, 12 aa, Mycobacterium
REAQSATGLPGG

SEQ ID NO: 280389 - protein, 6 aa, Mycobacterium
REARAA

SEQ ID NO: 280390 - protein, 9 aa, Mycobacterium
REARRASAR

SEQ ID NO: 280391 - protein, 8 aa, Mycobacterium
REARTAGR

SEQ ID NO: 280392 - protein, 10 aa, Mycobacterium
REASDRTVHS

SEQ ID NO: 280393 - protein, 15 aa, Mycobacterium
REASDRTVRSRGKLE

SEQ ID NO: 280394 - protein, 7 aa, Mycobacterium
REATESA

SEQ ID NO: 280395 - protein, 19 aa, Mycobacterium
REATGKGQQLVGTAPRRRG

SEQ ID NO: 280396 - protein, 11 aa, Mycobacterium
REATGPDGQPM

SEQ ID NO: 280397 - protein, 8 aa, Mycobacterium
REATPEDF

SEQ ID NO: 280398 - protein, 8 aa, Mycobacterium
REAVAEEA

SEQ ID NO: 280399 - protein, 11 aa, Mycobacterium
REAVRAQPNCA

SEQ ID NO: 280400 - protein, 8 aa, Mycobacterium
REAYPDSF

SEQ ID NO: 280401 - protein, 15 aa, Mycobacterium
REAYSQRGQEDPRSP

SEQ ID NO: 280402 - protein, 8 aa, Mycobacterium
REDDEIQR

SEQ ID NO: 280403 - protein, 19 aa, Mycobacterium
REDEAPSDTKAIKPVDPSG

SEQ ID NO: 280404 - protein, 9 aa, Mycobacterium
REDESDWGV

SEQ ID NO: 280405 - protein, 18 aa, Mycobacterium
REDGPPSHHKKRGTPSMG

SEQ ID NO: 280406 - protein, 18 aa, Mycobacterium
REDGPPSHHSKRGTPSMG

SEQ ID NO: 280407 - protein, 10 aa, Mycobacterium
REDNQDDPDI

SEQ ID NO: 280408 - protein, 8 aa, Mycobacterium
REDPPGVT

SEQ ID NO: 280409 - protein, 8 aa, Mycobacterium
REDRDPEA

SEQ ID NO: 280410 - protein, 9 aa, Mycobacterium
REDRPGDRR

SEQ ID NO: 280411 - protein, 5 aa, Mycobacterium
REDSP

SEQ ID NO: 280412 - protein, 6 aa, Mycobacterium
REDSSR

SEQ ID NO: 280413 - protein, 6 aa, Mycobacterium
REDTRD

SEQ ID NO: 280414 - protein, 4 aa, Mycobacterium
REEA

SEQ ID NO: 280415 - protein, 10 aa, Mycobacterium
REEAAHHGAR

SEQ ID NO: 280416 - protein, 11 aa, Mycobacterium
REEAARHGARD

SEQ ID NO: 280417 - protein, 11 aa, Mycobacterium
REEAARRGARA

SEQ ID NO: 280418 - protein, 4 aa, Mycobacterium
REED

SEQ ID NO: 280419 - protein, 6 aa, Mycobacterium
REEDLA

SEQ ID NO: 280420 - protein, 5 aa, Mycobacterium
REEFS

SEQ ID NO: 280421 - protein, 4 aa, Mycobacterium
REEG

SEQ ID NO: 280422 - protein, 8 aa, Mycobacterium
REEKSQRR

SEQ ID NO: 280423 - protein, 9 aa, Mycobacterium
REERGQAAG

SEQ ID NO: 280424 - protein, 20 aa, Mycobacterium
REERSTALQRRRQAKSERTI

SEQ ID NO: 280425 - protein, 11 aa, Mycobacterium
REESARNGARA

SEQ ID NO: 280426 - protein, 7 aa, Mycobacterium
REESGHS

SEQ ID NO: 280427 - protein, 8 aa, Mycobacterium
REESGTNI

SEQ ID NO: 280428 - protein, 4 aa, Mycobacterium
REET

SEQ ID NO: 280429 - protein, 5 aa, Mycobacterium
REETD

SEQ ID NO: 280430 - protein, 8 aa, Mycobacterium
REETDVNP

SEQ ID NO: 280431 - protein, 11 aa, Mycobacterium
REETPGHGTRD

SEQ ID NO: 280432 - protein, 11 aa, Mycobacterium
REETPQYGNRE

SEQ ID NO: 280433 - protein, 8 aa, Mycobacterium
REFADESD

SEQ ID NO: 280434 - protein, 9 aa, Mycobacterium
REFGGAGGS

SEQ ID NO: 280435 - protein, 5 aa, Mycobacterium
REGAD

SEQ ID NO: 280436 - protein, 6 aa, Mycobacterium
REGAGV

SEQ ID NO: 280437 - protein, 38 aa, Mycobacterium
REGANGSRRSRRHARTQESDDYAEEPAPASSADDSHTD

SEQ ID NO: 280438 - protein, 8 aa, Mycobacterium
REGARHAP

SEQ ID NO: 280439 - protein, 8 aa, Mycobacterium
REGDSDSA

SEQ ID NO: 280440 - protein, 11 aa, Mycobacterium
REGEETIAQDH

SEQ ID NO: 280441 - protein, 10 aa, Mycobacterium
REGEETIAQK

SEQ ID NO: 280442 - protein, 10 aa, Mycobacterium
REGEQTIAQE

SEQ ID NO: 280443 - protein, 13 aa, Mycobacterium
REGMNDPALQPHA

SEQ ID NO: 280444 - protein, 5 aa, Mycobacterium
REGPT

SEQ ID NO: 280445 - protein, 8 aa, Mycobacterium
REGPTNPA

SEQ ID NO: 280446 - protein, 17 aa, Mycobacterium
REGQASSVAPAGLSSDN

SEQ ID NO: 280447 - protein, 4 aa, Mycobacterium
REGR

SEQ ID NO: 280448 - protein, 7 aa, Mycobacterium
REGRAPV

SEQ ID NO: 280449 - protein, 6 aa, Mycobacterium
REGRRM

SEQ ID NO: 280450 - protein, 4 aa, Mycobacterium
REHE

SEQ ID NO: 280451 - protein, 8 aa, Mycobacterium
REHEERAD

SEQ ID NO: 280452 - protein, 10 aa, Mycobacterium
REHGVADTDR

SEQ ID NO: 280453 - protein, 9 aa, Mycobacterium
REHKPSAWR

SEQ ID NO: 280454 - protein, 5 aa, Mycobacterium
REHNA

SEQ ID NO: 280455 - protein, 4 aa, Mycobacterium
REHP

SEQ ID NO: 280456 - protein, 18 aa, Mycobacterium
REHTDQDEPAKGSGRPSL

SEQ ID NO: 280457 - protein, 5 aa, Mycobacterium
REIAR

SEQ ID NO: 280458 - protein, 6 aa, Mycobacterium
REIDGT

SEQ ID NO: 280459 - protein, 7 aa, Mycobacterium
REIDPEP

SEQ ID NO: 280460 - protein, 8 aa, Mycobacterium
REIDPGPR

SEQ ID NO: 280461 - protein, 16 aa, Mycobacterium
REITDGPREQAPRGGR

SEQ ID NO: 280462 - protein, 14 aa, Mycobacterium
REKAEGAAASGTHS

SEQ ID NO: 280463 - protein, 96 aa, Mycobacterium
REKATLPEKGTAAKEAEKRAKAAPKAAAPAAPAPAPAEAPAKAAEAPAAATAASPAAPAKGLGMAGGAKRPGAKKAAPAPAAETAAAEAPAAPAKG

SEQ ID NO: 280464 - protein, 5 aa, Mycobacterium
REKGI

SEQ ID NO: 280465 - protein, 9 aa, Mycobacterium
REKGTHFKT

SEQ ID NO: 280466 - protein, 7 aa, Mycobacterium
REKPWSE

SEQ ID NO: 280467 - protein, 7 aa, Mycobacterium
REKQNDA

SEQ ID NO: 280468 - protein, 10 aa, Mycobacterium
RELEARAADA

SEQ ID NO: 280469 - protein, 6 aa, Mycobacterium
RELEGE

SEQ ID NO: 280470 - protein, 10 aa, Mycobacterium
RELGADPDEL

SEQ ID NO: 280471 - protein, 4 aa, Mycobacterium
RELP

SEQ ID NO: 280472 - protein, 5 aa, Mycobacterium
RELPD

SEQ ID NO: 280473 - protein, 13 aa, Mycobacterium
RELPSNPRPPDPP

SEQ ID NO: 280474 - protein, 28 aa, Mycobacterium
RELPTRPRLAGPPGSSRPGRRGRAPTPP

SEQ ID NO: 280475 - protein, 6 aa, Mycobacterium
RELSGE

SEQ ID NO: 280476 - protein, 6 aa, Mycobacterium
REMPAR

SEQ ID NO: 280477 - protein, 8 aa, Mycobacterium
RENATEEM

SEQ ID NO: 280478 - protein, 8 aa, Mycobacterium
RENGMSTQ

SEQ ID NO: 280479 - protein, 6 aa, Mycobacterium
RENGTI

SEQ ID NO: 280480 - protein, 6 aa, Mycobacterium
RENGTV

SEQ ID NO: 280481 - protein, 8 aa, Mycobacterium
RENKASAH

SEQ ID NO: 280482 - protein, 4 aa, Mycobacterium
RENP

SEQ ID NO: 280483 - protein, 8 aa, Mycobacterium
RENPDRQR

SEQ ID NO: 280484 - protein, 6 aa, Mycobacterium
RENSLP

SEQ ID NO: 280485 - protein, 8 aa, Mycobacterium
RENSTPDQ

SEQ ID NO: 280486 - protein, 9 aa, Mycobacterium
RENTRADTG

SEQ ID NO: 280487 - protein, 5 aa, Mycobacterium
RENWS

SEQ ID NO: 280488 - protein, 4 aa, Mycobacterium
REPA

SEQ ID NO: 280489 - protein, 9 aa, Mycobacterium
REPAQKPVA

SEQ ID NO: 280490 - protein, 6 aa, Mycobacterium
REPDEA

SEQ ID NO: 280491 - protein, 26 aa, Mycobacterium
REPDPESAPAAPAQAGESEAASAEGH

SEQ ID NO: 280492 - protein, 51 aa, Mycobacterium
REPDPFRGVNSGGSPGQLRGPNDVEPGGTTAQPGGFEDSDLSPQSKEPLPE

SEQ ID NO: 280493 - protein, 19 aa, Mycobacterium
REPEAPPQPGTADFRGHPA

SEQ ID NO: 280494 - protein, 14 aa, Mycobacterium
REPELASPDRPQAP

SEQ ID NO: 280495 - protein, 26 aa, Mycobacterium
REPEPAPEAQAAPEAAAETADAPTME

SEQ ID NO: 280496 - protein, 14 aa, Mycobacterium
REPEQQSEKSPFLE

SEQ ID NO: 280497 - protein, 12 aa, Mycobacterium
REPETDPGATGG

SEQ ID NO: 280498 - protein, 9 aa, Mycobacterium
REPFGAPPA

SEQ ID NO: 280499 - protein, 12 aa, Mycobacterium
REPGDQAPKTTV

SEQ ID NO: 280500 - protein, 8 aa, Mycobacterium
REPGEPPK

SEQ ID NO: 280501 - protein, 5 aa, Mycobacterium
REPGF

SEQ ID NO: 280502 - protein, 6 aa, Mycobacterium
REPGTD

SEQ ID NO: 280503 - protein, 5 aa, Mycobacterium
REPGY

SEQ ID NO: 280504 - protein, 23 aa, Mycobacterium
REPIPGGKTEISGQFTSDSAKQL

SEQ ID NO: 280505 - protein, 9 aa, Mycobacterium
REPKESDAA

SEQ ID NO: 280506 - protein, 6 aa, Mycobacterium
REPKRQ

SEQ ID NO: 280507 - protein, 7 aa, Mycobacterium
REPKRST

SEQ ID NO: 280508 - protein, 4 aa, Mycobacterium
REPL

SEQ ID NO: 280509 - protein, 5 aa, Mycobacterium
REPPQ

SEQ ID NO: 280510 - protein, 12 aa, Mycobacterium
REPPTPGVPESA

SEQ ID NO: 280511 - protein, 12 aa, Mycobacterium
REPQPAVADEYQ

SEQ ID NO: 280512 - protein, 7 aa, Mycobacterium
REPQVGE

SEQ ID NO: 280513 - protein, 5 aa, Mycobacterium
REPRR

SEQ ID NO: 280514 - protein, 10 aa, Mycobacterium
REPSPTDQRN

SEQ ID NO: 280515 - protein, 14 aa, Mycobacterium
REPTSGQIERPGSV

SEQ ID NO: 280516 - protein, 13 aa, Mycobacterium
REPTSGSVERAGA

SEQ ID NO: 280517 - protein, 14 aa, Mycobacterium
REPTSGTIDRPGAV

SEQ ID NO: 280518 - protein, 14 aa, Mycobacterium
REPTSGTVERPGAV

SEQ ID NO: 280519 - protein, 7 aa, Mycobacterium
REQAGGK

SEQ ID NO: 280520 - protein, 14 aa, Mycobacterium
REQAGTHPDRQVRN

SEQ ID NO: 280521 - protein, 9 aa, Mycobacterium
REQATAASE

SEQ ID NO: 280522 - protein, 5 aa, Mycobacterium
REQDL

SEQ ID NO: 280523 - protein, 7 aa, Mycobacterium
REQDSLS

SEQ ID NO: 280524 - protein, 7 aa, Mycobacterium
REQEGGK

SEQ ID NO: 280525 - protein, 7 aa, Mycobacterium
REQGGGR

SEQ ID NO: 280526 - protein, 24 aa, Mycobacterium
REQLDADSDDPVGRAPKAAQTVEG

SEQ ID NO: 280527 - protein, 10 aa, Mycobacterium
REQNGEAGAS

SEQ ID NO: 280528 - protein, 13 aa, Mycobacterium
REQNSNTDAQADI

SEQ ID NO: 280529 - protein, 13 aa, Mycobacterium
REQNSNTDAQAEI

SEQ ID NO: 280530 - protein, 11 aa, Mycobacterium
REQPLDGDQVT

SEQ ID NO: 280531 - protein, 6 aa, Mycobacterium
REQPRL

SEQ ID NO: 280532 - protein, 5 aa, Mycobacterium
REQQT

SEQ ID NO: 280533 - protein, 6 aa, Mycobacterium
REQTRD

SEQ ID NO: 280534 - protein, 20 aa, Mycobacterium
REQVQRAATTAGRDTASVGM

SEQ ID NO: 280535 - protein, 11 aa, Mycobacterium
RERAPSSTSTG

SEQ ID NO: 280536 - protein, 9 aa, Mycobacterium
REREPAPPL

SEQ ID NO: 280537 - protein, 9 aa, Mycobacterium
RERGAALPP

SEQ ID NO: 280538 - protein, 19 aa, Mycobacterium
RERGEQLGKSESASSSSSF

SEQ ID NO: 280539 - protein, 13 aa, Mycobacterium
RERGEVEQAQDTE

SEQ ID NO: 280540 - protein, 8 aa, Mycobacterium
RERGLSTA

SEQ ID NO: 280541 - protein, 9 aa, Mycobacterium
RERIDRGAG

SEQ ID NO: 280542 - protein, 21 aa, Mycobacterium
RERIGEEVPPPAAGDAGHDHD

SEQ ID NO: 280543 - protein, 18 aa, Mycobacterium
RERKVQAARGPGVPPRLT

SEQ ID NO: 280544 - protein, 7 aa, Mycobacterium
RERMPDT

SEQ ID NO: 280545 - protein, 8 aa, Mycobacterium
RERNPDPA

SEQ ID NO: 280546 - protein, 4 aa, Mycobacterium
RERP

SEQ ID NO: 280547 - protein, 5 aa, Mycobacterium
RERPA

SEQ ID NO: 280548 - protein, 6 aa, Mycobacterium
RERPKA

SEQ ID NO: 280549 - protein, 8 aa, Mycobacterium
RERPSHPD

SEQ ID NO: 280550 - protein, 12 aa, Mycobacterium
RERQDTAEAHAA

SEQ ID NO: 280551 - protein, 12 aa, Mycobacterium
RERRAAATAAGR

SEQ ID NO: 280552 - protein, 14 aa, Mycobacterium
RERRAQAGAAKTGR

SEQ ID NO: 280553 - protein, 19 aa, Mycobacterium
RERRASDSRTRSGIAKTGR

SEQ ID NO: 280554 - protein, 13 aa, Mycobacterium
RERREVSHATAGR

SEQ ID NO: 280555 - protein, 10 aa, Mycobacterium
RERRTATAAG

SEQ ID NO: 280556 - protein, 9 aa, Mycobacterium
RERSGAGQV

SEQ ID NO: 280557 - protein, 9 aa, Mycobacterium
RERSGKGQV

SEQ ID NO: 280558 - protein, 9 aa, Mycobacterium
RERSGQGQV

SEQ ID NO: 280559 - protein, 9 aa, Mycobacterium
RERSGRGQY

SEQ ID NO: 280560 - protein, 6 aa, Mycobacterium
RERSGS

SEQ ID NO: 280561 - protein, 13 aa, Mycobacterium
RERTADDDDPALA

SEQ ID NO: 280562 - protein, 14 aa, Mycobacterium
RERTPQDRPTGAGA

SEQ ID NO: 280563 - protein, 5 aa, Mycobacterium
RESAE

SEQ ID NO: 280564 - protein, 9 aa, Mycobacterium
RESATDETW

SEQ ID NO: 280565 - protein, 8 aa, Mycobacterium
RESDRTEF

SEQ ID NO: 280566 - protein, 13 aa, Mycobacterium
RESGEVSQSPLRE

SEQ ID NO: 280567 - protein, 15 aa, Mycobacterium
RESGGDRSAVTGGTT

SEQ ID NO: 280568 - protein, 8 aa, Mycobacterium
RESGMSTQ

SEQ ID NO: 280569 - protein, 7 aa, Mycobacterium
RESGPRD

SEQ ID NO: 280570 - protein, 6 aa, Mycobacterium
RESGQV

SEQ ID NO: 280571 - protein, 5 aa, Mycobacterium
RESGT

SEQ ID NO: 280572 - protein, 6 aa, Mycobacterium
RESGYD

SEQ ID NO: 280573 - protein, 12 aa, Mycobacterium
RESHAAAGVNDP

SEQ ID NO: 280574 - protein, 5 aa, Mycobacterium
RESLG

SEQ ID NO: 280575 - protein, 8 aa, Mycobacterium
RESPERLQ

SEQ ID NO: 280576 - protein, 14 aa, Mycobacterium
RESPSPSTPEQKGR

SEQ ID NO: 280577 - protein, 11 aa, Mycobacterium
RESQAAAGIND

SEQ ID NO: 280578 - protein, 7 aa, Mycobacterium
RESQARQ

SEQ ID NO: 280579 - protein, 7 aa, Mycobacterium
RESQKRA

SEQ ID NO: 280580 - protein, 5 aa, Mycobacterium
RESRA

SEQ ID NO: 280581 - protein, 7 aa, Mycobacterium
RESRAAR

SEQ ID NO: 280582 - protein, 11 aa, Mycobacterium
RESSKGARADR

SEQ ID NO: 280583 - protein, 9 aa, Mycobacterium
RESTALTPR

SEQ ID NO: 280584 - protein, 6 aa, Mycobacterium
RESTRP

SEQ ID NO: 280585 - protein, 4 aa, Mycobacterium
RESV

SEQ ID NO: 280586 - protein, 5 aa, Mycobacterium
RESVL

SEQ ID NO: 280587 - protein, 7 aa, Mycobacterium
RESVRNG

SEQ ID NO: 280588 - protein, 8 aa, Mycobacterium
RETADTVA

SEQ ID NO: 280589 - protein, 8 aa, Mycobacterium
RETAEANA

SEQ ID NO: 280590 - protein, 6 aa, Mycobacterium
RETAGR

SEQ ID NO: 280591 - protein, 13 aa, Mycobacterium
RETEEAAASLGAT

SEQ ID NO: 280592 - protein, 16 aa, Mycobacterium
RETEEAAASLGATAPK

SEQ ID NO: 280593 - protein, 5 aa, Mycobacterium
RETGY

SEQ ID NO: 280594 - protein, 4 aa, Mycobacterium
RETI

SEQ ID NO: 280595 - protein, 6 aa, Mycobacterium
RETKGI

SEQ ID NO: 280596 - protein, 14 aa, Mycobacterium
RETNGHIEVRTATR

SEQ ID NO: 280597 - protein, 4 aa, Mycobacterium
RETP

SEQ ID NO: 280598 - protein, 10 aa, Mycobacterium
RETPGLPPGV

SEQ ID NO: 280599 - protein, 6 aa, Mycobacterium
RETPPA

SEQ ID NO: 280600 - protein, 7 aa, Mycobacterium
RETPSIP

SEQ ID NO: 280601 - protein, 11 aa, Mycobacterium
RETQASYATRL

SEQ ID NO: 280602 - protein, 7 aa, Mycobacterium
RETRAAR

SEQ ID NO: 280603 - protein, 8 aa, Mycobacterium
RETREATA

SEQ ID NO: 280604 - protein, 7 aa, Mycobacterium
RETRSGG

SEQ ID NO: 280605 - protein, 7 aa, Mycobacterium
RETSPCS

SEQ ID NO: 280606 - protein, 36 aa, Mycobacterium
RETTPPAVDASEVPKPGEAAPGPLPVPPKAIGGEAL

SEQ ID NO: 280607 - protein, 8 aa, Mycobacterium
RETTSPTA

SEQ ID NO: 280608 - protein, 11 aa, Mycobacterium
RETYDGDRSRV

SEQ ID NO: 280609 - protein, 14 aa, Mycobacterium
REVADARNRPRSFA

SEQ ID NO: 280610 - protein, 10 aa, Mycobacterium
REVDSGKIDA

SEQ ID NO: 280611 - protein, 4 aa, Mycobacterium
REVP

SEQ ID NO: 280612 - protein, 6 aa, Mycobacterium
REVPRQ

SEQ ID NO: 280613 - protein, 7 aa, Mycobacterium
REVSPGI

SEQ ID NO: 280614 - protein, 4 aa, Mycobacterium
RFAP

SEQ ID NO: 280615 - protein, 10 aa, Mycobacterium
RFDAPDEQPA

SEQ ID NO: 280616 - protein, 11 aa, Mycobacterium
RFDPDKPGHPL

SEQ ID NO: 280617 - protein, 10 aa, Mycobacterium
RFDTNRTGRP

SEQ ID NO: 280618 - protein, 13 aa, Mycobacterium
RFEPATDGRTNLE

SEQ ID NO: 280619 - protein, 13 aa, Mycobacterium
RFEPSDAGRSGLE

SEQ ID NO: 280620 - protein, 4 aa, Mycobacterium
RFET

SEQ ID NO: 280621 - protein, 5 aa, Mycobacterium
RFETS

SEQ ID NO: 280622 - protein, 22 aa, Mycobacterium
RFGENSQMGAGSTDDADGARSD

SEQ ID NO: 280623 - protein, 18 aa, Mycobacterium
RFGPGSDGIGGTDPNDTF

SEQ ID NO: 280624 - protein, 12 aa, Mycobacterium
RFGQADANESVE

SEQ ID NO: 280625 - protein, 13 aa, Mycobacterium
RFGVEDTKEAREA

SEQ ID NO: 280626 - protein, 7 aa, Mycobacterium
RFPGGDR

SEQ ID NO: 280627 - protein, 33 aa, Mycobacterium
RFRDEQAVAEDRADQRADRYADDHADDTVDPGR

SEQ ID NO: 280628 - protein, 15 aa, Mycobacterium
RFRPGGHPTPLPNPG

SEQ ID NO: 280629 - protein, 45 aa, Mycobacterium
RFRPSRRSPASASRRYPRFPGSRPGDLEPGSASVRPSPRLSHPGL

SEQ ID NO: 280630 - protein, 6 aa, Mycobacterium
RFSGGS

SEQ ID NO: 280631 - protein, 5 aa, Mycobacterium
RFSPR

SEQ ID NO: 280632 - protein, 15 aa, Mycobacterium
RFSSRPDNDCANPSA

SEQ ID NO: 280633 - protein, 4 aa, Mycobacterium
RGAA

SEQ ID NO: 280634 - protein, 7 aa, Mycobacterium
RGAAADE

SEQ ID NO: 280635 - protein, 11 aa, Mycobacterium
RGAAADPDLQS

SEQ ID NO: 280636 - protein, 5 aa, Mycobacterium
RGAAG

SEQ ID NO: 280637 - protein, 7 aa, Mycobacterium
RGAAGEK

SEQ ID NO: 280638 - protein, 9 aa, Mycobacterium
RGAAPDERY

SEQ ID NO: 280639 - protein, 7 aa, Mycobacterium
RGAAPET

SEQ ID NO: 280640 - protein, 9 aa, Mycobacterium
RGAAPPGVA

SEQ ID NO: 280641 - protein, 21 aa, Mycobacterium
RGAASPVAAEQGEDTAAELTE

SEQ ID NO: 280642 - protein, 22 aa, Mycobacterium
RGAATPKSADCGGDCAACTLSC

SEQ ID NO: 280643 - protein, 8 aa, Mycobacterium
RGACPASQ

SEQ ID NO: 280644 - protein, 5 aa, Mycobacterium
RGADD

SEQ ID NO: 280645 - protein, 10 aa, Mycobacterium
RGADDSELPA

SEQ ID NO: 280646 - protein, 18 aa, Mycobacterium
RGADGLQTPSPEAITGGA

SEQ ID NO: 280647 - protein, 5 aa, Mycobacterium
RGADN

SEQ ID NO: 280648 - protein, 7 aa, Mycobacterium
RGADPET

SEQ ID NO: 280649 - protein, 6 aa, Mycobacterium
RGADTS

SEQ ID NO: 280650 - protein, 8 aa, Mycobacterium
RGAETSIT

SEQ ID NO: 280651 - protein, 7 aa, Mycobacterium
RGAGAER

SEQ ID NO: 280652 - protein, 38 aa, Mycobacterium
RGAGASDEPAAEPRPERRNRSRAYGRPQRPSADSWEYD

SEQ ID NO: 280653 - protein, 15 aa, Mycobacterium
RGAGDSSEPARRSDY

SEQ ID NO: 280654 - protein, 5 aa, Mycobacterium
RGAGE

SEQ ID NO: 280655 - protein, 50 aa, Mycobacterium
RGAGESDGPPDDGDDSEAALRNESGGDPQTAQDTPPDAGGHHEFGRPEGA

SEQ ID NO: 280656 - protein, 11 aa, Mycobacterium
RGAGHGEAPPM

SEQ ID NO: 280657 - protein, 5 aa, Mycobacterium
RGAGI

SEQ ID NO: 280658 - protein, 5 aa, Mycobacterium
RGAGN

SEQ ID NO: 280659 - protein, 6 aa, Mycobacterium
RGAGQK

SEQ ID NO: 280660 - protein, 12 aa, Mycobacterium
RGAGQPDEDTDA

SEQ ID NO: 280661 - protein, 6 aa, Mycobacterium
RGAGQR

SEQ ID NO: 280662 - protein, 24 aa, Mycobacterium
RGAGSAALSGLRGQHGSGKTPWEQ

SEQ ID NO: 280663 - protein, 19 aa, Mycobacterium
RGAGSDGSDGGAVAAPNPA

SEQ ID NO: 280664 - protein, 8 aa, Mycobacterium
RGAGSLRG

SEQ ID NO: 280665 - protein, 10 aa, Mycobacterium
RGAGTGTSDS

SEQ ID NO: 280666 - protein, 11 aa, Mycobacterium
RGAIGPEARTR

SEQ ID NO: 280667 - protein, 5 aa, Mycobacterium
RGAIT

SEQ ID NO: 280668 - protein, 10 aa, Mycobacterium
RGAKTVSRIT

SEQ ID NO: 280669 - protein, 12 aa, Mycobacterium
RGALRASRDVHT

SEQ ID NO: 280670 - protein, 4 aa, Mycobacterium
RGAM

SEQ ID NO: 280671 - protein, 9 aa, Mycobacterium
RGAPNGIDE

SEQ ID NO: 280672 - protein, 10 aa, Mycobacterium
RGAPPSPAVP

SEQ ID NO: 280673 - protein, 8 aa, Mycobacterium
RGAPRGGA

SEQ ID NO: 280674 - protein, 8 aa, Mycobacterium
RGAPRGSA

SEQ ID NO: 280675 - protein, 10 aa, Mycobacterium
RGAPRPAPDV

SEQ ID NO: 280676 - protein, 8 aa, Mycobacterium
RGAPRRTR

SEQ ID NO: 280677 - protein, 9 aa, Mycobacterium
RGAPSSSTV

SEQ ID NO: 280678 - protein, 4 aa, Mycobacterium
RGAQ

SEQ ID NO: 280679 - protein, 32 aa, Mycobacterium
RGAQDRRGLEAAGGGEGLRRGPGGPDRRHDRR

SEQ ID NO: 280680 - protein, 12 aa, Mycobacterium
RGAQESGDFAQY

SEQ ID NO: 280681 - protein, 10 aa, Mycobacterium
RGAQPNTALA

SEQ ID NO: 280682 - protein, 10 aa, Mycobacterium
RGAQPTDAKG

SEQ ID NO: 280683 - protein, 10 aa, Mycobacterium
RGARESEELA

SEQ ID NO: 280684 - protein, 6 aa, Mycobacterium
RGARGL

SEQ ID NO: 280685 - protein, 14 aa, Mycobacterium
RGARKPHKGTVQKV

SEQ ID NO: 280686 - protein, 8 aa, Mycobacterium
RGARPSDV

SEQ ID NO: 280687 - protein, 7 aa, Mycobacterium
RGASAEE

SEQ ID NO: 280688 - protein, 9 aa, Mycobacterium
RGASEEATD

SEQ ID NO: 280689 - protein, 9 aa, Mycobacterium
RGASPLSRP

SEQ ID NO: 280690 - protein, 25 aa, Mycobacterium
RGASQLSVSTSHTAQGLTTADHSVG

SEQ ID NO: 280691 - protein, 7 aa, Mycobacterium
RGASRKM

SEQ ID NO: 280692 - protein, 4 aa, Mycobacterium
RGAT

SEQ ID NO: 280693 - protein, 11 aa, Mycobacterium
RGATGYGRSGL

SEQ ID NO: 280694 - protein, 11 aa, Mycobacterium
RGATTAAAATA

SEQ ID NO: 280695 - protein, 5 aa, Mycobacterium
RGATV

SEQ ID NO: 280696 - protein, 9 aa, Mycobacterium
RGATVPHGP

SEQ ID NO: 280697 - protein, 4 aa, Mycobacterium
RGAV

SEQ ID NO: 280698 - protein, 7 aa, Mycobacterium
RGAVDGQ

SEQ ID NO: 280699 - protein, 11 aa, Mycobacterium
RGAYGPKAGTL

SEQ ID NO: 280700 - protein, 4 aa, Mycobacterium
RGCE

SEQ ID NO: 280701 - protein, 7 aa, Mycobacterium
RGDAGLS

SEQ ID NO: 280702 - protein, 8 aa, Mycobacterium
RGDAMADR

SEQ ID NO: 280703 - protein, 9 aa, Mycobacterium
RGDAPDGDL

SEQ ID NO: 280704 - protein, 6 aa, Mycobacterium
RGDARG

SEQ ID NO: 280705 - protein, 8 aa, Mycobacterium
RGDATDDE

SEQ ID NO: 280706 - protein, 7 aa, Mycobacterium
RGDATRA

SEQ ID NO: 280707 - protein, 59 aa, Mycobacterium
RGDDAPTGEIPAAGAQHEERTAAVATAEREAPTEAVGTAEQEAPTETIAKTEDDPKTEV

SEQ ID NO: 280708 - protein, 9 aa, Mycobacterium
RGDDLGRGG

SEQ ID NO: 280709 - protein, 13 aa, Mycobacterium
RGDDPGRQNGPTR

SEQ ID NO: 280710 - protein, 8 aa, Mycobacterium
RGDDRRRR

SEQ ID NO: 280711 - protein, 13 aa, Mycobacterium
RGDEAQSLSATPG

SEQ ID NO: 280712 - protein, 11 aa, Mycobacterium
RGDEEKRKESF

SEQ ID NO: 280713 - protein, 11 aa, Mycobacterium
RGDEEKRKQSF

SEQ ID NO: 280714 - protein, 7 aa, Mycobacterium
RGDEMGD

SEQ ID NO: 280715 - protein, 9 aa, Mycobacterium
RGDEPGWDD

SEQ ID NO: 280716 - protein, 4 aa, Mycobacterium
RGDG

SEQ ID NO: 280717 - protein, 7 aa, Mycobacterium
RGDGDGI

SEQ ID NO: 280718 - protein, 8 aa, Mycobacterium
RGDGPGFG

SEQ ID NO: 280719 - protein, 6 aa, Mycobacterium
RGDGSA

SEQ ID NO: 280720 - protein, 10 aa, Mycobacterium
RGDLGRRPGI

SEQ ID NO: 280721 - protein, 6 aa, Mycobacterium
RGDNAT

SEQ ID NO: 280722 - protein, 4 aa, Mycobacterium
RGDP

SEQ ID NO: 280723 - protein, 11 aa, Mycobacterium
RGDPASAEGIS

SEQ ID NO: 280724 - protein, 9 aa, Mycobacterium
RGDPATPEG

SEQ ID NO: 280725 - protein, 11 aa, Mycobacterium
RGDPATPEGIS

SEQ ID NO: 280726 - protein, 11 aa, Mycobacterium
RGDPATPEGLS

SEQ ID NO: 280727 - protein, 9 aa, Mycobacterium
RGDPATREG

SEQ ID NO: 280728 - protein, 10 aa, Mycobacterium
RGDPDADRSE

SEQ ID NO: 280729 - protein, 7 aa, Mycobacterium
RGDPPVR

SEQ ID NO: 280730 - protein, 6 aa, Mycobacterium
RGDPRV

SEQ ID NO: 280731 - protein, 10 aa, Mycobacterium
RGDPTSPEGL

SEQ ID NO: 280732 - protein, 9 aa, Mycobacterium
RGDPTTPEA

SEQ ID NO: 280733 - protein, 5 aa, Mycobacterium
RGDPV

SEQ ID NO: 280734 - protein, 13 aa, Mycobacterium
RGDQGGAVGDKSV

SEQ ID NO: 280735 - protein, 7 aa, Mycobacterium
RGDRPAT

SEQ ID NO: 280736 - protein, 22 aa, Mycobacterium
RGDSNTRLAAGGTIPVERTQPA

SEQ ID NO: 280737 - protein, 7 aa, Mycobacterium
RGDSRRA

SEQ ID NO: 280738 - protein, 15 aa, Mycobacterium
RGDSSRSRKGGSTGL

SEQ ID NO: 280739 - protein, 15 aa, Mycobacterium
RGDSSRSRREGSTGL

SEQ ID NO: 280740 - protein, 7 aa, Mycobacterium
RGDTPDG

SEQ ID NO: 280741 - protein, 9 aa, Mycobacterium
RGDTQLQAG

SEQ ID NO: 280742 - protein, 15 aa, Mycobacterium
RGDTSRSRRAGSTGL

SEQ ID NO: 280743 - protein, 15 aa, Mycobacterium
RGDTSRSRRGGSTGL

SEQ ID NO: 280744 - protein, 4 aa, Mycobacterium
RGEA

SEQ ID NO: 280745 - protein, 33 aa, Mycobacterium
RGEAAAVDRTESSGGAPRRKRARDASAEESFGP

SEQ ID NO: 280746 - protein, 13 aa, Mycobacterium
RGEAAEEPATVPA

SEQ ID NO: 280747 - protein, 16 aa, Mycobacterium
RGEAAPDEGAGSETGA

SEQ ID NO: 280748 - protein, 10 aa, Mycobacterium
RGEAAPKLTY

SEQ ID NO: 280749 - protein, 15 aa, Mycobacterium
RGEAATMAAGAGRDV

SEQ ID NO: 280750 - protein, 26 aa, Mycobacterium
RGEAATVSAGAGRDVKSNERPTAATQ

SEQ ID NO: 280751 - protein, 7 aa, Mycobacterium
RGEADDG

SEQ ID NO: 280752 - protein, 10 aa, Mycobacterium
RGEAEEPDLV

SEQ ID NO: 280753 - protein, 15 aa, Mycobacterium
RGEAEKVAEEAVESG

SEQ ID NO: 280754 - protein, 7 aa, Mycobacterium
RGEAGRG

SEQ ID NO: 280755 - protein, 12 aa, Mycobacterium
RGEAKRQLDTGR

SEQ ID NO: 280756 - protein, 5 aa, Mycobacterium
RGEAP

SEQ ID NO: 280757 - protein, 7 aa, Mycobacterium
RGEAPRS

SEQ ID NO: 280758 - protein, 4 aa, Mycobacterium
RGEC

SEQ ID NO: 280759 - protein, 4 aa, Mycobacterium
RGED

SEQ ID NO: 280760 - protein, 6 aa, Mycobacterium
RGEDAL

SEQ ID NO: 280761 - protein, 17 aa, Mycobacterium
RGEDEKVDAYEHPERPA

SEQ ID NO: 280762 - protein, 25 aa, Mycobacterium
RGEDMTSDVRSRSAAIAGADRSEPA

SEQ ID NO: 280763 - protein, 8 aa, Mycobacterium
RGEDQTVT

SEQ ID NO: 280764 - protein, 9 aa, Mycobacterium
RGEEPGPMQ

SEQ ID NO: 280765 - protein, 11 aa, Mycobacterium
RGEGDGSDRIM

SEQ ID NO: 280766 - protein, 13 aa, Mycobacterium
RGEGEGADRVLPP

SEQ ID NO: 280767 - protein, 6 aa, Mycobacterium
RGEGQS

SEQ ID NO: 280768 - protein, 12 aa, Mycobacterium
RGEGRLVLDLPA

SEQ ID NO: 280769 - protein, 5 aa, Mycobacterium
RGEHA

SEQ ID NO: 280770 - protein, 6 aa, Mycobacterium
RGEHDG

SEQ ID NO: 280771 - protein, 9 aa, Mycobacterium
RGEKGQRSL

SEQ ID NO: 280772 - protein, 6 aa, Mycobacterium
RGEKID

SEQ ID NO: 280773 - protein, 17 aa, Mycobacterium
RGEKPHGATGPGKPDAE

SEQ ID NO: 280774 - protein, 4 aa, Mycobacterium
RGEL

SEQ ID NO: 280775 - protein, 6 aa, Mycobacterium
RGENRA

SEQ ID NO: 280776 - protein, 11 aa, Mycobacterium
RGEPADSGTAQ

SEQ ID NO: 280777 - protein, 21 aa, Mycobacterium
RGEPAGDDGAAEREPDMPDTG

SEQ ID NO: 280778 - protein, 19 aa, Mycobacterium
RGEPEPALGGATGIGEGEG

SEQ ID NO: 280779 - protein, 10 aa, Mycobacterium
RGEPGAPSLD

SEQ ID NO: 280780 - protein, 23 aa, Mycobacterium
RGEPNNGPHCEEPHGPAHRSNDI

SEQ ID NO: 280781 - protein, 13 aa, Mycobacterium
RGEPWPKPVPEPA

SEQ ID NO: 280782 - protein, 19 aa, Mycobacterium
RGEQQPAPGGAVGIAKGGA

SEQ ID NO: 280783 - protein, 7 aa, Mycobacterium
RGEQRSR

SEQ ID NO: 280784 - protein, 11 aa, Mycobacterium
RGEQRSRLQRA

SEQ ID NO: 280785 - protein, 18 aa, Mycobacterium
RGEQVNNHEPAGTTDERR

SEQ ID NO: 280786 - protein, 5 aa, Mycobacterium
RGERD

SEQ ID NO: 280787 - protein, 6 aa, Mycobacterium
RGERPN

SEQ ID NO: 280788 - protein, 12 aa, Mycobacterium
RGERTSAPTPVG

SEQ ID NO: 280789 - protein, 5 aa, Mycobacterium
RGESG

SEQ ID NO: 280790 - protein, 7 aa, Mycobacterium
RGESLSR

SEQ ID NO: 280791 - protein, 6 aa, Mycobacterium
RGETGY

SEQ ID NO: 280792 - protein, 10 aa, Mycobacterium
RGEVAPPDTT

SEQ ID NO: 280793 - protein, 7 aa, Mycobacterium
RGEYESA

SEQ ID NO: 280794 - protein, 4 aa, Mycobacterium
RGFG

SEQ ID NO: 280795 - protein, 5 aa, Mycobacterium
RGFGD

SEQ ID NO: 280796 - protein, 8 aa, Mycobacterium
RGFYSNPG

SEQ ID NO: 280797 - protein, 4 aa, Mycobacterium
RGGA

SEQ ID NO: 280798 - protein, 18 aa, Mycobacterium
RGGAEAAKASASLDEWGP

SEQ ID NO: 280799 - protein, 7 aa, Mycobacterium
RGGANDA

SEQ ID NO: 280800 - protein, 14 aa, Mycobacterium
RGGAQEAAPESTAV

SEQ ID NO: 280801 - protein, 13 aa, Mycobacterium
RGGARGGRTVPHG

SEQ ID NO: 280802 - protein, 28 aa, Mycobacterium
RGGCASEATTTPNGATQTSTPDPASKNR

SEQ ID NO: 280803 - protein, 12 aa, Mycobacterium
RGGDDTSVATAG

SEQ ID NO: 280804 - protein, 5 aa, Mycobacterium
RGGDG

SEQ ID NO: 280805 - protein, 14 aa, Mycobacterium
RGGDLGGPLPPTVH

SEQ ID NO: 280806 - protein, 6 aa, Mycobacterium
RGGELD

SEQ ID NO: 280807 - protein, 16 aa, Mycobacterium
RGGELTATQAAAELSR

SEQ ID NO: 280808 - protein, 6 aa, Mycobacterium
RGGEPG

SEQ ID NO: 280809 - protein, 6 aa, Mycobacterium
RGGERG

SEQ ID NO: 280810 - protein, 11 aa, Mycobacterium
RGGESDGPGYA

SEQ ID NO: 280811 - protein, 9 aa, Mycobacterium
RGGGCGRDG

SEQ ID NO: 280812 - protein, 18 aa, Mycobacterium
RGGGGADEDEDDGGVPED

SEQ ID NO: 280813 - protein, 10 aa, Mycobacterium
RGGGGLTPSD

SEQ ID NO: 280814 - protein, 15 aa, Mycobacterium
RGGGRPLTEDEPVPS

SEQ ID NO: 280815 - protein, 9 aa, Mycobacterium
RGGGRRGAE

SEQ ID NO: 280816 - protein, 12 aa, Mycobacterium
RGGGSPTAAQHG

SEQ ID NO: 280817 - protein, 88 aa, Mycobacterium
RGGGTTGPAGAPQPMRPSAEPTRAMPDSGEDAASDDEPDDTATRAIPAQRKPDAEAATEKLNTRPDPDAPRRGGSGVSAQDLLRREGR

SEQ ID NO: 280818 - protein, 6 aa, Mycobacterium
RGGGVQ

SEQ ID NO: 280819 - protein, 4 aa, Mycobacterium
RGGH

SEQ ID NO: 280820 - protein, 10 aa, Mycobacterium
RGGHEHTVPS

SEQ ID NO: 280821 - protein, 18 aa, Mycobacterium
RGGHHDDDSDNQDHSHRR

SEQ ID NO: 280822 - protein, 4 aa, Mycobacterium
RGGM

SEQ ID NO: 280823 - protein, 4 aa, Mycobacterium
RGGN

SEQ ID NO: 280824 - protein, 8 aa, Mycobacterium
RGGPAGDA

SEQ ID NO: 280825 - protein, 10 aa, Mycobacterium
RGGPEGTGTT

SEQ ID NO: 280826 - protein, 19 aa, Mycobacterium
RGGPGGAPGCGSLPDATKN

SEQ ID NO: 280827 - protein, 11 aa, Mycobacterium
RGGPGNATSVP

SEQ ID NO: 280828 - protein, 8 aa, Mycobacterium
RGGPHRRA

SEQ ID NO: 280829 - protein, 10 aa, Mycobacterium
RGGPQGTGTT

SEQ ID NO: 280830 - protein, 8 aa, Mycobacterium
RGGPRRRH

SEQ ID NO: 280831 - protein, 8 aa, Mycobacterium
RGGPTLKN

SEQ ID NO: 280832 - protein, 6 aa, Mycobacterium
RGGPYE

SEQ ID NO: 280833 - protein, 20 aa, Mycobacterium
RGGPYRSAGETLNQKPECDT

SEQ ID NO: 280834 - protein, 4 aa, Mycobacterium
RGGQ

SEQ ID NO: 280835 - protein, 11 aa, Mycobacterium
RGGQGPSLKNG

SEQ ID NO: 280836 - protein, 14 aa, Mycobacterium
RGGQHDAIDGSAVQ

SEQ ID NO: 280837 - protein, 4 aa, Mycobacterium
RGGR

SEQ ID NO: 280838 - protein, 8 aa, Mycobacterium
RGGRHRRG

SEQ ID NO: 280839 - protein, 9 aa, Mycobacterium
RGGRKLPRK

SEQ ID NO: 280840 - protein, 14 aa, Mycobacterium
RGGRPATPAPFDGP

SEQ ID NO: 280841 - protein, 6 aa, Mycobacterium
RGGRRP

SEQ ID NO: 280842 - protein, 4 aa, Mycobacterium
RGGS

SEQ ID NO: 280843 - protein, 9 aa, Mycobacterium
RGGSANATL

SEQ ID NO: 280844 - protein, 6 aa, Mycobacterium
RGGSAV

SEQ ID NO: 280845 - protein, 7 aa, Mycobacterium
RGGSHTD

SEQ ID NO: 280846 - protein, 7 aa, Mycobacterium
RGGSYAG

SEQ ID NO: 280847 - protein, 4 aa, Mycobacterium
RGGT

SEQ ID NO: 280848 - protein, 10 aa, Mycobacterium
RGGTAGGKMT

SEQ ID NO: 280849 - protein, 15 aa, Mycobacterium
RGGTAPIPAVPADAP

SEQ ID NO: 280850 - protein, 7 aa, Mycobacterium
RGGTGAN

SEQ ID NO: 280851 - protein, 5 aa, Mycobacterium
RGGTT

SEQ ID NO: 280852 - protein, 4 aa, Mycobacterium
RGGV

SEQ ID NO: 280853 - protein, 6 aa, Mycobacterium
RGGVPA

SEQ ID NO: 280854 - protein, 7 aa, Mycobacterium
RGGVPAP

SEQ ID NO: 280855 - protein, 6 aa, Mycobacterium
RGHAPD

SEQ ID NO: 280856 - protein, 4 aa, Mycobacterium
RGHD

SEQ ID NO: 280857 - protein, 6 aa, Mycobacterium
RGHDPG

SEQ ID NO: 280858 - protein, 15 aa, Mycobacterium
RGHDQVRSPPPARPV

SEQ ID NO: 280859 - protein, 5 aa, Mycobacterium
RGHDR

SEQ ID NO: 280860 - protein, 15 aa, Mycobacterium
RGHDSEAGAASEQEV

SEQ ID NO: 280861 - protein, 8 aa, Mycobacterium
RGHGESPK

SEQ ID NO: 280862 - protein, 23 aa, Mycobacterium
RGHGGSASTPDGLARPADSRDVR

SEQ ID NO: 280863 - protein, 14 aa, Mycobacterium
RGHGQSGEADPQTY

SEQ ID NO: 280864 - protein, 16 aa, Mycobacterium
RGHGSDDVVDSGAPGV

SEQ ID NO: 280865 - protein, 7 aa, Mycobacterium
RGHGSNT

SEQ ID NO: 280866 - protein, 19 aa, Mycobacterium
RGHHSRVATPDDPASSRLG

SEQ ID NO: 280867 - protein, 6 aa, Mycobacterium
RGHQAG

SEQ ID NO: 280868 - protein, 4 aa, Mycobacterium
RGHR

SEQ ID NO: 280869 - protein, 7 aa, Mycobacterium
RGHTAGA

SEQ ID NO: 280870 - protein, 10 aa, Mycobacterium
RGHTDPAGAR

SEQ ID NO: 280871 - protein, 7 aa, Mycobacterium
RGHTPSD

SEQ ID NO: 280872 - protein, 12 aa, Mycobacterium
RGHTQAVESTET

SEQ ID NO: 280873 - protein, 10 aa, Mycobacterium
RGIDQSRTQL

SEQ ID NO: 280874 - protein, 7 aa, Mycobacterium
RGIDSTK

SEQ ID NO: 280875 - protein, 11 aa, Mycobacterium
RGIEAEQAREQ

SEQ ID NO: 280876 - protein, 6 aa, Mycobacterium
RGIEPP

SEQ ID NO: 280877 - protein, 10 aa, Mycobacterium
RGIETTSRQR

SEQ ID NO: 280878 - protein, 8 aa, Mycobacterium
RGISESVK

SEQ ID NO: 280879 - protein, 9 aa, Mycobacterium
RGISGKARA

SEQ ID NO: 280880 - protein, 9 aa, Mycobacterium
RGISGRMAS

SEQ ID NO: 280881 - protein, 18 aa, Mycobacterium
RGISREAAPEPLAPATAV

SEQ ID NO: 280882 - protein, 7 aa, Mycobacterium
RGITTSE

SEQ ID NO: 280883 - protein, 8 aa, Mycobacterium
RGITTSEK

SEQ ID NO: 280884 - protein, 9 aa, Mycobacterium
RGKDADTGL

SEQ ID NO: 280885 - protein, 19 aa, Mycobacterium
RGKGFDPEEVPQDRQGIAR

SEQ ID NO: 280886 - protein, 15 aa, Mycobacterium
RGKGSPLTEDDPVPS

SEQ ID NO: 280887 - protein, 9 aa, Mycobacterium
RGKHPRGGL

SEQ ID NO: 280888 - protein, 5 aa, Mycobacterium
RGKHR

SEQ ID NO: 280889 - protein, 9 aa, Mycobacterium
RGKLSTTGW

SEQ ID NO: 280890 - protein, 10 aa, Mycobacterium
RGKPADTGLD

SEQ ID NO: 280891 - protein, 10 aa, Mycobacterium
RGKPADTGVA

SEQ ID NO: 280892 - protein, 10 aa, Mycobacterium
RGKPAPEQLD

SEQ ID NO: 280893 - protein, 9 aa, Mycobacterium
RGKPSDTGL

SEQ ID NO: 280894 - protein, 12 aa, Mycobacterium
RGKTASQRVKPA

SEQ ID NO: 280895 - protein, 12 aa, Mycobacterium
RGKTHPKPVTIG

SEQ ID NO: 280896 - protein, 5 aa, Mycobacterium
RGKWD

SEQ ID NO: 280897 - protein, 4 aa, Mycobacterium
RGLA

SEQ ID NO: 280898 - protein, 6 aa, Mycobacterium
RGLAAD

SEQ ID NO: 280899 - protein, 7 aa, Mycobacterium
RGLAADG

SEQ ID NO: 280900 - protein, 10 aa, Mycobacterium
RGLAGDYPHP

SEQ ID NO: 280901 - protein, 4 aa, Mycobacterium
RGLD

SEQ ID NO: 280902 - protein, 11 aa, Mycobacterium
RGLGAKGNVGS

SEQ ID NO: 280903 - protein, 11 aa, Mycobacterium
RGLGASRLTEA

SEQ ID NO: 280904 - protein, 9 aa, Mycobacterium
RGLGESREK

SEQ ID NO: 280905 - protein, 8 aa, Mycobacterium
RGLGETRE

SEQ ID NO: 280906 - protein, 10 aa, Mycobacterium
RGLKPADLDS

SEQ ID NO: 280907 - protein, 5 aa, Mycobacterium
RGLPA

SEQ ID NO: 280908 - protein, 9 aa, Mycobacterium
RGLPPAGET

SEQ ID NO: 280909 - protein, 10 aa, Mycobacterium
RGLPPEGEEL

SEQ ID NO: 280910 - protein, 6 aa, Mycobacterium
RGLPSA

SEQ ID NO: 280911 - protein, 8 aa, Mycobacterium
RGLPTPSY

SEQ ID NO: 280912 - protein, 8 aa, Mycobacterium
RGLPVAST

SEQ ID NO: 280913 - protein, 9 aa, Mycobacterium
RGLQASAPE

SEQ ID NO: 280914 - protein, 8 aa, Mycobacterium
RGLQATAP

SEQ ID NO: 280915 - protein, 6 aa, Mycobacterium
RGLSAV

SEQ ID NO: 280916 - protein, 9 aa, Mycobacterium
RGLSQSAPE

SEQ ID NO: 280917 - protein, 5 aa, Mycobacterium
RGLTP

SEQ ID NO: 280918 - protein, 11 aa, Mycobacterium
RGLTPADLDGY

SEQ ID NO: 280919 - protein, 9 aa, Mycobacterium
RGLTPGELA

SEQ ID NO: 280920 - protein, 6 aa, Mycobacterium
RGMPQP

SEQ ID NO: 280921 - protein, 4 aa, Mycobacterium
RGMQ

SEQ ID NO: 280922 - protein, 8 aa, Mycobacterium
RGMSDPQL

SEQ ID NO: 280923 - protein, 8 aa, Mycobacterium
RGMTPEDR

SEQ ID NO: 280924 - protein, 11 aa, Mycobacterium
RGNADDDTKPV

SEQ ID NO: 280925 - protein, 17 aa, Mycobacterium
RGNDDDDDDDDGRVAGK

SEQ ID NO: 280926 - protein, 12 aa, Mycobacterium
RGNDEADSVYDE

SEQ ID NO: 280927 - protein, 17 aa, Mycobacterium
RGNDNKMRTEEVDAERA

SEQ ID NO: 280928 - protein, 16 aa, Mycobacterium
RGNGDDDGDAKVAGKT

SEQ ID NO: 280929 - protein, 5 aa, Mycobacterium
RGNGE

SEQ ID NO: 280930 - protein, 13 aa, Mycobacterium
RGNGGSAELERDR

SEQ ID NO: 280931 - protein, 16 aa, Mycobacterium
RGNGSQARRPKDEQQV

SEQ ID NO: 280932 - protein, 20 aa, Mycobacterium
RGNPATAEQISQAAASVGER

SEQ ID NO: 280933 - protein, 4 aa, Mycobacterium
RGNQ

SEQ ID NO: 280934 - protein, 14 aa, Mycobacterium
RGNQGDTESNNSVA

SEQ ID NO: 280935 - protein, 6 aa, Mycobacterium
RGNSTG

SEQ ID NO: 280936 - protein, 6 aa, Mycobacterium
RGPAAA

SEQ ID NO: 280937 - protein, 9 aa, Mycobacterium
RGPAAPAPE

SEQ ID NO: 280938 - protein, 5 aa, Mycobacterium
RGPAE

SEQ ID NO: 280939 - protein, 7 aa, Mycobacterium
RGPAEPR

SEQ ID NO: 280940 - protein, 6 aa, Mycobacterium
RGPAGP

SEQ ID NO: 280941 - protein, 7 aa, Mycobacterium
RGPAGQV

SEQ ID NO: 280942 - protein, 113 aa, Mycobacterium
RGPAPAKNVPQPPAQPQRPSTDTTRAMPPQGRPPAGPADRGNENAPTTAFSAQRPPNGGAPADATTAIPTPPQREQEPSTEKLNTREDAPEDPETKRRGGGMSAQDLLRREGR

SEQ ID NO: 280943 - protein, 13 aa, Mycobacterium
RGPARESVNGPLE

SEQ ID NO: 280944 - protein, 6 aa, Mycobacterium
RGPARI

SEQ ID NO: 280945 - protein, 11 aa, Mycobacterium
RGPATTGQPQL

SEQ ID NO: 280946 - protein, 11 aa, Mycobacterium
RGPEGADPASV

SEQ ID NO: 280947 - protein, 8 aa, Mycobacterium
RGPEGGQS

SEQ ID NO: 280948 - protein, 20 aa, Mycobacterium
RGPELSSAAASVARDALPST

SEQ ID NO: 280949 - protein, 5 aa, Mycobacterium
RGPEP

SEQ ID NO: 280950 - protein, 9 aa, Mycobacterium
RGPGASRGW

SEQ ID NO: 280951 - protein, 11 aa, Mycobacterium
RGPGMTKTDAE

SEQ ID NO: 280952 - protein, 7 aa, Mycobacterium
RGPGPVT

SEQ ID NO: 280953 - protein, 7 aa, Mycobacterium
RGPGRVR

SEQ ID NO: 280954 - protein, 5 aa, Mycobacterium
RGPHG

SEQ ID NO: 280955 - protein, 8 aa, Mycobacterium
RGPKGNKL

SEQ ID NO: 280956 - protein, 11 aa, Mycobacterium
RGPKLPPPPMM

SEQ ID NO: 280957 - protein, 11 aa, Mycobacterium
RGPKPSQVGDD

SEQ ID NO: 280958 - protein, 50 aa, Mycobacterium
RGPKQPGAAAGTEAGDATTAIPVSKPQSTPRPAQPNRASGTPGEDATTAM

SEQ ID NO: 280959 - protein, 6 aa, Mycobacterium
RGPMPP

SEQ ID NO: 280960 - protein, 7 aa, Mycobacterium
RGPMPPY

SEQ ID NO: 280961 - protein, 8 aa, Mycobacterium
RGPNGELT

SEQ ID NO: 280962 - protein, 25 aa, Mycobacterium
RGPPVRAAARPRSGRVLLNDLCIIR

SEQ ID NO: 280963 - protein, 12 aa, Mycobacterium
RGPQATIESVKE

SEQ ID NO: 280964 - protein, 6 aa, Mycobacterium
RGPQGL

SEQ ID NO: 280965 - protein, 15 aa, Mycobacterium
RGPQQTIESVKETRT

SEQ ID NO: 280966 - protein, 11 aa, Mycobacterium
RGPQTSENPLP

SEQ ID NO: 280967 - protein, 4 aa, Mycobacterium
RGPR

SEQ ID NO: 280968 - protein, 8 aa, Mycobacterium
RGPRDGSG

SEQ ID NO: 280969 - protein, 46 aa, Mycobacterium
RGPRETIESVKETRTALTPGHDKAPGQANQLAERGKHEKPDTDPSG

SEQ ID NO: 280970 - protein, 43 aa, Mycobacterium
RGPRETIESVKETRTALTPGHDKQLTGSHGRHAKRDAAADPSG

SEQ ID NO: 280971 - protein, 13 aa, Mycobacterium
RGPRLAPPPAMPP

SEQ ID NO: 280972 - protein, 9 aa, Mycobacterium
RGPRLTPGE

SEQ ID NO: 280973 - protein, 8 aa, Mycobacterium
RGPRNSPY

SEQ ID NO: 280974 - protein, 7 aa, Mycobacterium
RGPRQTI

SEQ ID NO: 280975 - protein, 40 aa, Mycobacterium
RGPRQTIESVKETREALTPGHDKTPAQVDADAKPASDPSG

SEQ ID NO: 280976 - protein, 7 aa, Mycobacterium
RGPRRSP

SEQ ID NO: 280977 - protein, 6 aa, Mycobacterium
RGPSGS

SEQ ID NO: 280978 - protein, 14 aa, Mycobacterium
RGPSTGEAGGGTTA

SEQ ID NO: 280979 - protein, 14 aa, Mycobacterium
RGPSTGEAGNGTTA

SEQ ID NO: 280980 - protein, 21 aa, Mycobacterium
RGPSVESASPGQRPIQRLRDT

SEQ ID NO: 280981 - protein, 7 aa, Mycobacterium
RGPSVSD

SEQ ID NO: 280982 - protein, 9 aa, Mycobacterium
RGPTGPAQL

SEQ ID NO: 280983 - protein, 10 aa, Mycobacterium
RGPTGYGRSA

SEQ ID NO: 280984 - protein, 5 aa, Mycobacterium
RGPVG

SEQ ID NO: 280985 - protein, 10 aa, Mycobacterium
RGPYAKEGWD

SEQ ID NO: 280986 - protein, 6 aa, Mycobacterium
RGQAPA

SEQ ID NO: 280987 - protein, 5 aa, Mycobacterium
RGQDM

SEQ ID NO: 280988 - protein, 14 aa, Mycobacterium
RGQGEGADKVLPPG

SEQ ID NO: 280989 - protein, 7 aa, Mycobacterium
RGQGPPA

SEQ ID NO: 280990 - protein, 8 aa, Mycobacterium
RGQGPPAH

SEQ ID NO: 280991 - protein, 5 aa, Mycobacterium
RGQGV

SEQ ID NO: 280992 - protein, 6 aa, Mycobacterium
RGQIGS

SEQ ID NO: 280993 - protein, 5 aa, Mycobacterium
RGQKR

SEQ ID NO: 280994 - protein, 5 aa, Mycobacterium
RGQLT

SEQ ID NO: 280995 - protein, 6 aa, Mycobacterium
RGQLTI

SEQ ID NO: 280996 - protein, 7 aa, Mycobacterium
RGQPRAE

SEQ ID NO: 280997 - protein, 4 aa, Mycobacterium
RGQR

SEQ ID NO: 280998 - protein, 4 aa, Mycobacterium
RGQS

SEQ ID NO: 280999 - protein, 14 aa, Mycobacterium
RGQSGITKDTDYLG

SEQ ID NO: 281000 - protein, 4 aa, Mycobacterium
RGRA

SEQ ID NO: 281001 - protein, 10 aa, Mycobacterium
RGRAADKPAL

SEQ ID NO: 281002 - protein, 12 aa, Mycobacterium
RGRAAKAYSTYT

SEQ ID NO: 281003 - protein, 23 aa, Mycobacterium
RGRAAVDPEDRPDMLTSTFGQEI

SEQ ID NO: 281004 - protein, 10 aa, Mycobacterium
RGRAPLSSTV

SEQ ID NO: 281005 - protein, 12 aa, Mycobacterium
RGRARSKGAYGR

SEQ ID NO: 281006 - protein, 7 aa, Mycobacterium
RGRARSV

SEQ ID NO: 281007 - protein, 7 aa, Mycobacterium
RGRDRPT

SEQ ID NO: 281008 - protein, 17 aa, Mycobacterium
RGRDRPTRLAIPASSPR

SEQ ID NO: 281009 - protein, 4 aa, Mycobacterium
RGRG

SEQ ID NO: 281010 - protein, 23 aa, Mycobacterium
RGRGAHRTSEPDRSRGAAPTGGS

SEQ ID NO: 281011 - protein, 11 aa, Mycobacterium
RGRGDTASIEG

SEQ ID NO: 281012 - protein, 5 aa, Mycobacterium
RGRGG

SEQ ID NO: 281013 - protein, 6 aa, Mycobacterium
RGRGGV

SEQ ID NO: 281014 - protein, 6 aa, Mycobacterium
RGRGRG

SEQ ID NO: 281015 - protein, 7 aa, Mycobacterium
RGRHGRG

SEQ ID NO: 281016 - protein, 4 aa, Mycobacterium
RGRI

SEQ ID NO: 281017 - protein, 16 aa, Mycobacterium
RGRLGSTPKAVDDATP

SEQ ID NO: 281018 - protein, 7 aa, Mycobacterium
RGRNAPP

SEQ ID NO: 281019 - protein, 9 aa, Mycobacterium
RGRPAATGM

SEQ ID NO: 281020 - protein, 8 aa, Mycobacterium
RGRPADTG

SEQ ID NO: 281021 - protein, 7 aa, Mycobacterium
RGRPAGP

SEQ ID NO: 281022 - protein, 15 aa, Mycobacterium
RGRPDELLQVAWTDP

SEQ ID NO: 281023 - protein, 9 aa, Mycobacterium
RGRPGFPTT

SEQ ID NO: 281024 - protein, 7 aa, Mycobacterium
RGRPGGR

SEQ ID NO: 281025 - protein, 27 aa, Mycobacterium
RGRPRRAASASQRGEPENTGEDTGADT

SEQ ID NO: 281026 - protein, 4 aa, Mycobacterium
RGRR

SEQ ID NO: 281027 - protein, 13 aa, Mycobacterium
RGRRAAQSTTSNW

SEQ ID NO: 281028 - protein, 5 aa, Mycobacterium
RGRRG

SEQ ID NO: 281029 - protein, 19 aa, Mycobacterium
RGRRPDEKDPLVLATSQEM

SEQ ID NO: 281030 - protein, 12 aa, Mycobacterium
RGRRRGAGLDQD

SEQ ID NO: 281031 - protein, 23 aa, Mycobacterium
RGRRRLDPEDPPGVVSSTIGEEM

SEQ ID NO: 281032 - protein, 20 aa, Mycobacterium
RGRRRVTETADREPEKLPAS

SEQ ID NO: 281033 - protein, 8 aa, Mycobacterium
RGRRTTPR

SEQ ID NO: 281034 - protein, 13 aa, Mycobacterium
RGRSADDGDAGEF

SEQ ID NO: 281035 - protein, 7 aa, Mycobacterium
RGRSDSL

SEQ ID NO: 281036 - protein, 9 aa, Mycobacterium
RGRSGADYS

SEQ ID NO: 281037 - protein, 6 aa, Mycobacterium
RGRSGD

SEQ ID NO: 281038 - protein, 7 aa, Mycobacterium
RGRSGEV

SEQ ID NO: 281039 - protein, 5 aa, Mycobacterium
RGRSL

SEQ ID NO: 281040 - protein, 7 aa, Mycobacterium
RGRTGGH

SEQ ID NO: 281041 - protein, 19 aa, Mycobacterium
RGRTQRPAEQPPVVEPAAD

SEQ ID NO: 281042 - protein, 5 aa, Mycobacterium
RGRTR

SEQ ID NO: 281043 - protein, 5 aa, Mycobacterium
RGRTS

SEQ ID NO: 281044 - protein, 6 aa, Mycobacterium
RGRTSL

SEQ ID NO: 281045 - protein, 8 aa, Mycobacterium
RGRTTLPP

SEQ ID NO: 281046 - protein, 5 aa, Mycobacterium
RGSAA

SEQ ID NO: 281047 - protein, 9 aa, Mycobacterium
RGSAKPASW

SEQ ID NO: 281048 - protein, 8 aa, Mycobacterium
RGSAPYDE

SEQ ID NO: 281049 - protein, 8 aa, Mycobacterium
RGSATKSD

SEQ ID NO: 281050 - protein, 10 aa, Mycobacterium
RGSDDGDDHA

SEQ ID NO: 281051 - protein, 10 aa, Mycobacterium
RGSDDPEYAR

SEQ ID NO: 281052 - protein, 11 aa, Mycobacterium
RGSDRAKIAAA

SEQ ID NO: 281053 - protein, 9 aa, Mycobacterium
RGSDSAHTT

SEQ ID NO: 281054 - protein, 7 aa, Mycobacterium
RGSGAEL

SEQ ID NO: 281055 - protein, 6 aa, Mycobacterium
RGSGAI

SEQ ID NO: 281056 - protein, 10 aa, Mycobacterium
RGSGAIGADQ

SEQ ID NO: 281057 - protein, 6 aa, Mycobacterium
RGSGEG

SEQ ID NO: 281058 - protein, 8 aa, Mycobacterium
RGSGERDG

SEQ ID NO: 281059 - protein, 15 aa, Mycobacterium
RGSGRPLAEDEPVPS

SEQ ID NO: 281060 - protein, 10 aa, Mycobacterium
RGSGRTGTLA

SEQ ID NO: 281061 - protein, 7 aa, Mycobacterium
RGSGSIK

SEQ ID NO: 281062 - protein, 6 aa, Mycobacterium
RGSGSV

SEQ ID NO: 281063 - protein, 9 aa, Mycobacterium
RGSKPAQAI

SEQ ID NO: 281064 - protein, 8 aa, Mycobacterium
RGSKPMQA

SEQ ID NO: 281065 - protein, 12 aa, Mycobacterium
RGSKTSHSGSGL

SEQ ID NO: 281066 - protein, 20 aa, Mycobacterium
RGSNGRVPRADSSLPSGSGL

SEQ ID NO: 281067 - protein, 8 aa, Mycobacterium
RGSNRPAA

SEQ ID NO: 281068 - protein, 20 aa, Mycobacterium
RGSNSRVPRSDSSLPSGSGL

SEQ ID NO: 281069 - protein, 4 aa, Mycobacterium
RGSP

SEQ ID NO: 281070 - protein, 9 aa, Mycobacterium
RGSPPEEVY

SEQ ID NO: 281071 - protein, 6 aa, Mycobacterium
RGSQAA

SEQ ID NO: 281072 - protein, 9 aa, Mycobacterium
RGSQPAVAA

SEQ ID NO: 281073 - protein, 7 aa, Mycobacterium
RGSRFGK

SEQ ID NO: 281074 - protein, 15 aa, Mycobacterium
RGSRPASADSRTVGV

SEQ ID NO: 281075 - protein, 16 aa, Mycobacterium
RGSSAPAPTVPSDAPS

SEQ ID NO: 281076 - protein, 6 aa, Mycobacterium
RGSSDL

SEQ ID NO: 281077 - protein, 24 aa, Mycobacterium
RGSSGLTSPTSTPTATTVPPATSA

SEQ ID NO: 281078 - protein, 13 aa, Mycobacterium
RGSSNAPAKLPED

SEQ ID NO: 281079 - protein, 6 aa, Mycobacterium
RGSSTG

SEQ ID NO: 281080 - protein, 12 aa, Mycobacterium
RGSTASQSGSGL

SEQ ID NO: 281081 - protein, 12 aa, Mycobacterium
RGSTAVAGGSGL

SEQ ID NO: 281082 - protein, 6 aa, Mycobacterium
RGSTLT

SEQ ID NO: 281083 - protein, 17 aa, Mycobacterium
RGSTRPPSRRAKELTGA

SEQ ID NO: 281084 - protein, 9 aa, Mycobacterium
RGSTSPART

SEQ ID NO: 281085 - protein, 21 aa, Mycobacterium
RGSVGEADAGEDVDPNSPGDW

SEQ ID NO: 281086 - protein, 12 aa, Mycobacterium
RGSVGRANPGAQ

SEQ ID NO: 281087 - protein, 7 aa, Mycobacterium
RGSYGKS

SEQ ID NO: 281088 - protein, 7 aa, Mycobacterium
RGTAGTT

SEQ ID NO: 281089 - protein, 14 aa, Mycobacterium
RGTAQAAARTTEFT

SEQ ID NO: 281090 - protein, 7 aa, Mycobacterium
RGTDGRT

SEQ ID NO: 281091 - protein, 8 aa, Mycobacterium
RGTEQQTA

SEQ ID NO: 281092 - protein, 9 aa, Mycobacterium
RGTERSDHD

SEQ ID NO: 281093 - protein, 5 aa, Mycobacterium
RGTGA

SEQ ID NO: 281094 - protein, 7 aa, Mycobacterium
RGTGAGL

SEQ ID NO: 281095 - protein, 23 aa, Mycobacterium
RGTGGAARSIGRARDIEPGHRRD

SEQ ID NO: 281096 - protein, 8 aa, Mycobacterium
RGTGLREA

SEQ ID NO: 281097 - protein, 15 aa, Mycobacterium
RGTGRPLAEDEPVPS

SEQ ID NO: 281098 - protein, 4 aa, Mycobacterium
RGTH

SEQ ID NO: 281099 - protein, 9 aa, Mycobacterium
RGTKGLGPQ

SEQ ID NO: 281100 - protein, 4 aa, Mycobacterium
RGTP

SEQ ID NO: 281101 - protein, 13 aa, Mycobacterium
RGTPARTRAGARA

SEQ ID NO: 281102 - protein, 9 aa, Mycobacterium
RGTPEPPSI

SEQ ID NO: 281103 - protein, 9 aa, Mycobacterium
RGTPGFPAD

SEQ ID NO: 281104 - protein, 17 aa, Mycobacterium
RGTPGPGPQAISEAGPH

SEQ ID NO: 281105 - protein, 8 aa, Mycobacterium
RGTPTTAT

SEQ ID NO: 281106 - protein, 7 aa, Mycobacterium
RGTQPPL

SEQ ID NO: 281107 - protein, 4 aa, Mycobacterium
RGTR

SEQ ID NO: 281108 - protein, 6 aa, Mycobacterium
RGTRDF

SEQ ID NO: 281109 - protein, 7 aa, Mycobacterium
RGTRDFS

SEQ ID NO: 281110 - protein, 14 aa, Mycobacterium
RGTRNLPADQQPEV

SEQ ID NO: 281111 - protein, 6 aa, Mycobacterium
RGTRPL

SEQ ID NO: 281112 - protein, 5 aa, Mycobacterium
RGTSF

SEQ ID NO: 281113 - protein, 31 aa, Mycobacterium
RGTTISVSRDESAADAAQPNSAQLNSGQGGG

SEQ ID NO: 281114 - protein, 16 aa, Mycobacterium
RGTTNRDDVEERLSQR

SEQ ID NO: 281115 - protein, 10 aa, Mycobacterium
RGTTSELADR

SEQ ID NO: 281116 - protein, 10 aa, Mycobacterium
RGTTTAAAAT

SEQ ID NO: 281117 - protein, 11 aa, Mycobacterium
RGVDPAPQQKS

SEQ ID NO: 281118 - protein, 4 aa, Mycobacterium
RGVG

SEQ ID NO: 281119 - protein, 10 aa, Mycobacterium
RGVGGTPELA

SEQ ID NO: 281120 - protein, 5 aa, Mycobacterium
RGVGN

SEQ ID NO: 281121 - protein, 11 aa, Mycobacterium
RGVGSVSTVRG

SEQ ID NO: 281122 - protein, 4 aa, Mycobacterium
RGVL

SEQ ID NO: 281123 - protein, 6 aa, Mycobacterium
RGVPAG

SEQ ID NO: 281124 - protein, 7 aa, Mycobacterium
RGVQGGD

SEQ ID NO: 281125 - protein, 5 aa, Mycobacterium
RGVRD

SEQ ID NO: 281126 - protein, 9 aa, Mycobacterium
RGVRRRTDG

SEQ ID NO: 281127 - protein, 5 aa, Mycobacterium
RGVSS

SEQ ID NO: 281128 - protein, 7 aa, Mycobacterium
RGVTGKG

SEQ ID NO: 281129 - protein, 5 aa, Mycobacterium
RGVTP

SEQ ID NO: 281130 - protein, 7 aa, Mycobacterium
RGVTPDQ

SEQ ID NO: 281131 - protein, 26 aa, Mycobacterium
RGWAQNPRRQSPPPYEGPDPGRPPSK

SEQ ID NO: 281132 - protein, 4 aa, Mycobacterium
RGWP

SEQ ID NO: 281133 - protein, 10 aa, Mycobacterium
RGWPKPPADA

SEQ ID NO: 281134 - protein, 5 aa, Mycobacterium
RGWPR

SEQ ID NO: 281135 - protein, 6 aa, Mycobacterium
RGWPST

SEQ ID NO: 281136 - protein, 7 aa, Mycobacterium
RGYAEPR

SEQ ID NO: 281137 - protein, 8 aa, Mycobacterium
RGYAYGPG

SEQ ID NO: 281138 - protein, 7 aa, Mycobacterium
RGYDVSP

SEQ ID NO: 281139 - protein, 4 aa, Mycobacterium
RGYE

SEQ ID NO: 281140 - protein, 5 aa, Mycobacterium
RGYGY

SEQ ID NO: 281141 - protein, 4 aa, Mycobacterium
RGYR

SEQ ID NO: 281142 - protein, 56 aa, Mycobacterium
RHAGALDADEESDEEADVDASESDDADSDLDADADADADGDVKADAAEADPSETSV

SEQ ID NO: 281143 - protein, 9 aa, Mycobacterium
RHAPPTGAP

SEQ ID NO: 281144 - protein, 5 aa, Mycobacterium
RHAQR

SEQ ID NO: 281145 - protein, 14 aa, Mycobacterium
RHAQVTGEAAPKIS

SEQ ID NO: 281146 - protein, 5 aa, Mycobacterium
RHARG

SEQ ID NO: 281147 - protein, 5 aa, Mycobacterium
RHARS

SEQ ID NO: 281148 - protein, 8 aa, Mycobacterium
RHASSGER

SEQ ID NO: 281149 - protein, 9 aa, Mycobacterium
RHASSTDLS

SEQ ID NO: 281150 - protein, 8 aa, Mycobacterium
RHATGSAG

SEQ ID NO: 281151 - protein, 7 aa, Mycobacterium
RHATPDQ

SEQ ID NO: 281152 - protein, 8 aa, Mycobacterium
RHDPEQGW

SEQ ID NO: 281153 - protein, 4 aa, Mycobacterium
RHDR

SEQ ID NO: 281154 - protein, 20 aa, Mycobacterium
RHDRNRSERALLPAGVLSPA

SEQ ID NO: 281155 - protein, 19 aa, Mycobacterium
RHERPAELDSPAGPRQLPP

SEQ ID NO: 281156 - protein, 5 aa, Mycobacterium
RHFPP

SEQ ID NO: 281157 - protein, 5 aa, Mycobacterium
RHGAP

SEQ ID NO: 281158 - protein, 7 aa, Mycobacterium
RHGASTM

SEQ ID NO: 281159 - protein, 8 aa, Mycobacterium
RHGDGSNW

SEQ ID NO: 281160 - protein, 7 aa, Mycobacterium
RHGEHRD

SEQ ID NO: 281161 - protein, 7 aa, Mycobacterium
RHGERTQ

SEQ ID NO: 281162 - protein, 13 aa, Mycobacterium
RHGGDAVPDRPVV

SEQ ID NO: 281163 - protein, 7 aa, Mycobacterium
RHGGPQT

SEQ ID NO: 281164 - protein, 9 aa, Mycobacterium
RHGKPHVPA

SEQ ID NO: 281165 - protein, 8 aa, Mycobacterium
RHGLTDED

SEQ ID NO: 281166 - protein, 5 aa, Mycobacterium
RHGPS

SEQ ID NO: 281167 - protein, 7 aa, Mycobacterium
RHGQSPA

SEQ ID NO: 281168 - protein, 20 aa, Mycobacterium
RHGRHTAPVSGPGPALGVAA

SEQ ID NO: 281169 - protein, 8 aa, Mycobacterium
RHGRRPGL

SEQ ID NO: 281170 - protein, 7 aa, Mycobacterium
RHGSSKV

SEQ ID NO: 281171 - protein, 7 aa, Mycobacterium
RHGTETK

SEQ ID NO: 281172 - protein, 7 aa, Mycobacterium
RHGTGTA

SEQ ID NO: 281173 - protein, 6 aa, Mycobacterium
RHGTTP

SEQ ID NO: 281174 - protein, 19 aa, Mycobacterium
RHHPSTDATKGDTHELPLR

SEQ ID NO: 281175 - protein, 10 aa, Mycobacterium
RHHRGGDLSR

SEQ ID NO: 281176 - protein, 7 aa, Mycobacterium
RHNEDGT

SEQ ID NO: 281177 - protein, 7 aa, Mycobacterium
RHNGGVR

SEQ ID NO: 281178 - protein, 23 aa, Mycobacterium
RHPAPDDGNTTADVGATTAAEPA

SEQ ID NO: 281179 - protein, 7 aa, Mycobacterium
RHPAPWG

SEQ ID NO: 281180 - protein, 12 aa, Mycobacterium
RHPDSAGDADRA

SEQ ID NO: 281181 - protein, 5 aa, Mycobacterium
RHPEA

SEQ ID NO: 281182 - protein, 5 aa, Mycobacterium
RHPGD

SEQ ID NO: 281183 - protein, 5 aa, Mycobacterium
RHPGE

SEQ ID NO: 281184 - protein, 4 aa, Mycobacterium
RHPH

SEQ ID NO: 281185 - protein, 5 aa, Mycobacterium
RHPPM

SEQ ID NO: 281186 - protein, 7 aa, Mycobacterium
RHPPPGV

SEQ ID NO: 281187 - protein, 8 aa, Mycobacterium
RHPPPRSG

SEQ ID NO: 281188 - protein, 8 aa, Mycobacterium
RHPQAERD

SEQ ID NO: 281189 - protein, 13 aa, Mycobacterium
RHPQRHATSNYQM

SEQ ID NO: 281190 - protein, 32 aa, Mycobacterium
RHPSSPAGAASTPQKSQRAKDATMSSTPPPLH

SEQ ID NO: 281191 - protein, 47 aa, Mycobacterium
RHPVRGRRRAGPGDDRRGRRPAAPRRARGVQEPRVPRRGFGPGRDRA

SEQ ID NO: 281192 - protein, 13 aa, Mycobacterium
RHQGSAGRTPTAA

SEQ ID NO: 281193 - protein, 9 aa, Mycobacterium
RHQQQQQAA

SEQ ID NO: 281194 - protein, 51 aa, Mycobacterium
RHQSPTTAAPSTSAAATAAGPFTGTYRGDYGAATRIDGGALEGSKPSTTTW

SEQ ID NO: 281195 - protein, 91 aa, Mycobacterium
RHRDHSSTGAQQPNPPAGAPNSSPQGGPAAPAGAQPAPTPAPGRGGSPERPTHQRANPASPPHQPQRPSTRPQPDRVDVDEDSTPVKGRPT

SEQ ID NO: 281196 - protein, 7 aa, Mycobacterium
RHRGPWD

SEQ ID NO: 281197 - protein, 4 aa, Mycobacterium
RHRP

SEQ ID NO: 281198 - protein, 19 aa, Mycobacterium
RHRPASGANAAYLRWPHPQ

SEQ ID NO: 281199 - protein, 8 aa, Mycobacterium
RHRPEPVT

SEQ ID NO: 281200 - protein, 7 aa, Mycobacterium
RHRPSGM

SEQ ID NO: 281201 - protein, 16 aa, Mycobacterium
RHRRNGRAEAASPRAQ

SEQ ID NO: 281202 - protein, 27 aa, Mycobacterium
RHRRPEEERPDVAGSHDSDSQSGGQSV

SEQ ID NO: 281203 - protein, 11 aa, Mycobacterium
RHRTAPGDKQV

SEQ ID NO: 281204 - protein, 6 aa, Mycobacterium
RHRTAS

SEQ ID NO: 281205 - protein, 7 aa, Mycobacterium
RHSAPLA

SEQ ID NO: 281206 - protein, 7 aa, Mycobacterium
RHSDGRD

SEQ ID NO: 281207 - protein, 4 aa, Mycobacterium
RHSI

SEQ ID NO: 281208 - protein, 10 aa, Mycobacterium
RHSQASSATV

SEQ ID NO: 281209 - protein, 11 aa, Mycobacterium
RHSSPNGSVNG

SEQ ID NO: 281210 - protein, 5 aa, Mycobacterium
RHSTD

SEQ ID NO: 281211 - protein, 45 aa, Mycobacterium
RHTGDSDAAGQGPGAEDMSPDPVGHYGDTSVDVSDSEAESEVEDS

SEQ ID NO: 281212 - protein, 5 aa, Mycobacterium
RHTGE

SEQ ID NO: 281213 - protein, 10 aa, Mycobacterium
RHTGPGGQVT

SEQ ID NO: 281214 - protein, 7 aa, Mycobacterium
RHTGPGV

SEQ ID NO: 281215 - protein, 13 aa, Mycobacterium
RHTGSAATQAATG

SEQ ID NO: 281216 - protein, 14 aa, Mycobacterium
RHTGTPVRADRLGT

SEQ ID NO: 281217 - protein, 9 aa, Mycobacterium
RHTPSGGSV

SEQ ID NO: 281218 - protein, 10 aa, Mycobacterium
RHTPSGGSVE

SEQ ID NO: 281219 - protein, 6 aa, Mycobacterium
RHTRSV

SEQ ID NO: 281220 - protein, 8 aa, Mycobacterium
RHTSQQPV

SEQ ID NO: 281221 - protein, 8 aa, Mycobacterium
RHTTAAGA

SEQ ID NO: 281222 - protein, 13 aa, Mycobacterium
RHTTPISERIGSS

SEQ ID NO: 281223 - protein, 7 aa, Mycobacterium
RHVSPDQ

SEQ ID NO: 281224 - protein, 11 aa, Mycobacterium
RIADASSSLSP

SEQ ID NO: 281225 - protein, 17 aa, Mycobacterium
RIAEGKTNDVPTRAART

SEQ ID NO: 281226 - protein, 13 aa, Mycobacterium
RIAGSTAGRSAVD

SEQ ID NO: 281227 - protein, 8 aa, Mycobacterium
RIAQPDTY

SEQ ID NO: 281228 - protein, 23 aa, Mycobacterium
RIARKARGRVGPPSGMAEPGTPN

SEQ ID NO: 281229 - protein, 8 aa, Mycobacterium
RIARPGRS

SEQ ID NO: 281230 - protein, 8 aa, Mycobacterium
RIASESLP

SEQ ID NO: 281231 - protein, 8 aa, Mycobacterium
RIASKSTA

SEQ ID NO: 281232 - protein, 7 aa, Mycobacterium
RIDGANS

SEQ ID NO: 281233 - protein, 33 aa, Mycobacterium
RIDGSTDKTQCPQGSKAESYPEPARVYCLARAD

SEQ ID NO: 281234 - protein, 8 aa, Mycobacterium
RIDGVGPA

SEQ ID NO: 281235 - protein, 17 aa, Mycobacterium
RIDPPAGSYPNAAERRQ

SEQ ID NO: 281236 - protein, 17 aa, Mycobacterium
RIDPPAGSYPTAAERRQ

SEQ ID NO: 281237 - protein, 17 aa, Mycobacterium
RIDPPAGTYPDPNVRRK

SEQ ID NO: 281238 - protein, 16 aa, Mycobacterium
RIDPPAGTYPTPAERR

SEQ ID NO: 281239 - protein, 4 aa, Mycobacterium
RIDT

SEQ ID NO: 281240 - protein, 11 aa, Mycobacterium
RIEEQSSREAL

SEQ ID NO: 281241 - protein, 6 aa, Mycobacterium
RIEPAV

SEQ ID NO: 281242 - protein, 19 aa, Mycobacterium
RIEPGPAHQPVTRTRQPRS

SEQ ID NO: 281243 - protein, 5 aa, Mycobacterium
RIERG

SEQ ID NO: 281244 - protein, 7 aa, Mycobacterium
RIGAEGH

SEQ ID NO: 281245 - protein, 5 aa, Mycobacterium
RIGAG

SEQ ID NO: 281246 - protein, 11 aa, Mycobacterium
RIGGAPGGAAV

SEQ ID NO: 281247 - protein, 7 aa, Mycobacterium
RIGGETV

SEQ ID NO: 281248 - protein, 12 aa, Mycobacterium
RIGGGTPRPAPL

SEQ ID NO: 281249 - protein, 8 aa, Mycobacterium
RIGGPATD

SEQ ID NO: 281250 - protein, 5 aa, Mycobacterium
RIGGS

SEQ ID NO: 281251 - protein, 9 aa, Mycobacterium
RIGKNGTAR

SEQ ID NO: 281252 - protein, 6 aa, Mycobacterium
RIGKTT

SEQ ID NO: 281253 - protein, 9 aa, Mycobacterium
RIGPQAVRT

SEQ ID NO: 281254 - protein, 8 aa, Mycobacterium
RIGRRPSA

SEQ ID NO: 281255 - protein, 13 aa, Mycobacterium
RIGSASLNTDQNI

SEQ ID NO: 281256 - protein, 8 aa, Mycobacterium
RIGSDTQL

SEQ ID NO: 281257 - protein, 4 aa, Mycobacterium
RIGT

SEQ ID NO: 281258 - protein, 8 aa, Mycobacterium
RIGTDGKP

SEQ ID NO: 281259 - protein, 6 aa, Mycobacterium
RIGTSS

SEQ ID NO: 281260 - protein, 26 aa, Mycobacterium
RINGTESRSDSDTLPTPGPKEPVPHG

SEQ ID NO: 281261 - protein, 4 aa, Mycobacterium
RIPA

SEQ ID NO: 281262 - protein, 8 aa, Mycobacterium
RIPAEGKT

SEQ ID NO: 281263 - protein, 8 aa, Mycobacterium
RIPASGVR

SEQ ID NO: 281264 - protein, 25 aa, Mycobacterium
RIPDPGATRSAEGFVDDRGGHTVAT

SEQ ID NO: 281265 - protein, 5 aa, Mycobacterium
RIPEP

SEQ ID NO: 281266 - protein, 9 aa, Mycobacterium
RIPLQDTTE

SEQ ID NO: 281267 - protein, 14 aa, Mycobacterium
RIPPNQRFESPNPH

SEQ ID NO: 281268 - protein, 6 aa, Mycobacterium
RIPQRT

SEQ ID NO: 281269 - protein, 9 aa, Mycobacterium
RIPSEGKTI

SEQ ID NO: 281270 - protein, 4 aa, Mycobacterium
RIQG

SEQ ID NO: 281271 - protein, 5 aa, Mycobacterium
RIQRG

SEQ ID NO: 281272 - protein, 13 aa, Mycobacterium
RIRDGKATTLGAA

SEQ ID NO: 281273 - protein, 4 aa, Mycobacterium
RISD

SEQ ID NO: 281274 - protein, 7 aa, Mycobacterium
RISDADM

SEQ ID NO: 281275 - protein, 13 aa, Mycobacterium
RISPPPPPGAPPQ

SEQ ID NO: 281276 - protein, 11 aa, Mycobacterium
RISPPRRPKDV

SEQ ID NO: 281277 - protein, 5 aa, Mycobacterium
RISRA

SEQ ID NO: 281278 - protein, 30 aa, Mycobacterium
RISSTEAAGSNPDARAARSRERHSRKPAAT

SEQ ID NO: 281279 - protein, 15 aa, Mycobacterium
RITADGSRERLSPQA

SEQ ID NO: 281280 - protein, 12 aa, Mycobacterium
RITAEEAHSHPQ

SEQ ID NO: 281281 - protein, 4 aa, Mycobacterium
RITP

SEQ ID NO: 281282 - protein, 4 aa, Mycobacterium
RITV

SEQ ID NO: 281283 - protein, 12 aa, Mycobacterium
RITVGGRASTTA

SEQ ID NO: 281284 - protein, 20 aa, Mycobacterium
RKAAKQAGIATPPMEAGEQA

SEQ ID NO: 281285 - protein, 8 aa, Mycobacterium
RKAAPGAG

SEQ ID NO: 281286 - protein, 11 aa, Mycobacterium
RKAASDRSRRR

SEQ ID NO: 281287 - protein, 25 aa, Mycobacterium
RKAEADTEPDKASDTDPDAEKVGAS

SEQ ID NO: 281288 - protein, 6 aa, Mycobacterium
RKAGYR

SEQ ID NO: 281289 - protein, 8 aa, Mycobacterium
RKARESGM

SEQ ID NO: 281290 - protein, 7 aa, Mycobacterium
RKARLGN

SEQ ID NO: 281291 - protein, 11 aa, Mycobacterium
RKARQDNMTRT

SEQ ID NO: 281292 - protein, 6 aa, Mycobacterium
RKASTP

SEQ ID NO: 281293 - protein, 9 aa, Mycobacterium
RKASTRGWS

SEQ ID NO: 281294 - protein, 9 aa, Mycobacterium
RKATGDGGV

SEQ ID NO: 281295 - protein, 6 aa, Mycobacterium
RKDGPP

SEQ ID NO: 281296 - protein, 7 aa, Mycobacterium
RKDLRDA

SEQ ID NO: 281297 - protein, 5 aa, Mycobacterium
RKDLT

SEQ ID NO: 281298 - protein, 8 aa, Mycobacterium
RKDPADDR

SEQ ID NO: 281299 - protein, 8 aa, Mycobacterium
RKDPADER

SEQ ID NO: 281300 - protein, 9 aa, Mycobacterium
RKDPSSPKI

SEQ ID NO: 281301 - protein, 9 aa, Mycobacterium
RKDSGPYLE

SEQ ID NO: 281302 - protein, 7 aa, Mycobacterium
RKEDITK

SEQ ID NO: 281303 - protein, 7 aa, Mycobacterium
RKEFGPS

SEQ ID NO: 281304 - protein, 19 aa, Mycobacterium
RKEHAEEPEISEEPAVAPR

SEQ ID NO: 281305 - protein, 19 aa, Mycobacterium
RKEHAEEPELPRHQAVAPR

SEQ ID NO: 281306 - protein, 6 aa, Mycobacterium
RKENVQ

SEQ ID NO: 281307 - protein, 13 aa, Mycobacterium
RKEQTYPQKPPVG

SEQ ID NO: 281308 - protein, 28 aa, Mycobacterium
RKETGAQQGLAPTTPPAGQPSGGAGNPA

SEQ ID NO: 281309 - protein, 6 aa, Mycobacterium
RKFKNG

SEQ ID NO: 281310 - protein, 8 aa, Mycobacterium
RKGAASSV

SEQ ID NO: 281311 - protein, 9 aa, Mycobacterium
RKGDSDPRV

SEQ ID NO: 281312 - protein, 6 aa, Mycobacterium
RKGDVP

SEQ ID NO: 281313 - protein, 10 aa, Mycobacterium
RKGEVEQADD

SEQ ID NO: 281314 - protein, 5 aa, Mycobacterium
RKGFD

SEQ ID NO: 281315 - protein, 4 aa, Mycobacterium
RKGI

SEQ ID NO: 281316 - protein, 8 aa, Mycobacterium
RKGIARGK

SEQ ID NO: 281317 - protein, 12 aa, Mycobacterium
RKGPDSSGRSYP

SEQ ID NO: 281318 - protein, 9 aa, Mycobacterium
RKGQDSDLA

SEQ ID NO: 281319 - protein, 7 aa, Mycobacterium
RKGQPIR

SEQ ID NO: 281320 - protein, 7 aa, Mycobacterium
RKGRHGR

SEQ ID NO: 281321 - protein, 5 aa, Mycobacterium
RKGRN

SEQ ID NO: 281322 - protein, 13 aa, Mycobacterium
RKGTDAAQCPPGE

SEQ ID NO: 281323 - protein, 21 aa, Mycobacterium
RKGTSRPRGDDPASKNFVEIS

SEQ ID NO: 281324 - protein, 4 aa, Mycobacterium
RKHG

SEQ ID NO: 281325 - protein, 5 aa, Mycobacterium
RKIPY

SEQ ID NO: 281326 - protein, 6 aa, Mycobacterium
RKIQPA

SEQ ID NO: 281327 - protein, 10 aa, Mycobacterium
RKKATDTELP

SEQ ID NO: 281328 - protein, 10 aa, Mycobacterium
RKKKTDTDFP

SEQ ID NO: 281329 - protein, 7 aa, Mycobacterium
RKKPERE

SEQ ID NO: 281330 - protein, 5 aa, Mycobacterium
RKMRT

SEQ ID NO: 281331 - protein, 26 aa, Mycobacterium
RKNGTSEGSEGPDAVDDTETPHGDRA

SEQ ID NO: 281332 - protein, 8 aa, Mycobacterium
RKNPIETP

SEQ ID NO: 281333 - protein, 8 aa, Mycobacterium
RKNPPAVK

SEQ ID NO: 281334 - protein, 7 aa, Mycobacterium
RKPAPAV

SEQ ID NO: 281335 - protein, 7 aa, Mycobacterium
RKPAPHI

SEQ ID NO: 281336 - protein, 5 aa, Mycobacterium
RKPAR

SEQ ID NO: 281337 - protein, 12 aa, Mycobacterium
RKPGETGGTFSA

SEQ ID NO: 281338 - protein, 16 aa, Mycobacterium
RKPGTEDLDDAPQVSA

SEQ ID NO: 281339 - protein, 9 aa, Mycobacterium
RKPHTGHHP

SEQ ID NO: 281340 - protein, 8 aa, Mycobacterium
RKPNGSDT

SEQ ID NO: 281341 - protein, 10 aa, Mycobacterium
RKPPDVPSEP

SEQ ID NO: 281342 - protein, 9 aa, Mycobacterium
RKPRAPSES

SEQ ID NO: 281343 - protein, 19 aa, Mycobacterium
RKPRPGSTFFSQDSKWRIE

SEQ ID NO: 281344 - protein, 7 aa, Mycobacterium
RKPSTAS

SEQ ID NO: 281345 - protein, 6 aa, Mycobacterium
RKPTGG

SEQ ID NO: 281346 - protein, 15 aa, Mycobacterium
RKQEPPKAAKASLKA

SEQ ID NO: 281347 - protein, 11 aa, Mycobacterium
RKQQAAAQDLA

SEQ ID NO: 281348 - protein, 4 aa, Mycobacterium
RKQS

SEQ ID NO: 281349 - protein, 8 aa, Mycobacterium
RKQSGHGL

SEQ ID NO: 281350 - protein, 9 aa, Mycobacterium
RKQTAASSN

SEQ ID NO: 281351 - protein, 16 aa, Mycobacterium
RKQTRAKQSRRPTRLA

SEQ ID NO: 281352 - protein, 6 aa, Mycobacterium
RKRDAR

SEQ ID NO: 281353 - protein, 9 aa, Mycobacterium
RKRDRDPLR

SEQ ID NO: 281354 - protein, 9 aa, Mycobacterium
RKRGTPLDQ

SEQ ID NO: 281355 - protein, 13 aa, Mycobacterium
RKRHRGQSHEPAS

SEQ ID NO: 281356 - protein, 7 aa, Mycobacterium
RKRHSTV

SEQ ID NO: 281357 - protein, 12 aa, Mycobacterium
RKRPGAEHGGRQ

SEQ ID NO: 281358 - protein, 8 aa, Mycobacterium
RKRPHDPA

SEQ ID NO: 281359 - protein, 6 aa, Mycobacterium
RKRPWG

SEQ ID NO: 281360 - protein, 5 aa, Mycobacterium
RKRRA

SEQ ID NO: 281361 - protein, 10 aa, Mycobacterium
RKRRSYSADE

SEQ ID NO: 281362 - protein, 19 aa, Mycobacterium
RKRSDDDVAEPATTSRSSG

SEQ ID NO: 281363 - protein, 15 aa, Mycobacterium
RKRSEAYVRGPDGRR

SEQ ID NO: 281364 - protein, 7 aa, Mycobacterium
RKRSFEA

SEQ ID NO: 281365 - protein, 15 aa, Mycobacterium
RKRYGDSTSEVVGND

SEQ ID NO: 281366 - protein, 12 aa, Mycobacterium
RKSESAESTSAT

SEQ ID NO: 281367 - protein, 9 aa, Mycobacterium
RKSGKRYRT

SEQ ID NO: 281368 - protein, 5 aa, Mycobacterium
RKSGP

SEQ ID NO: 281369 - protein, 15 aa, Mycobacterium
RKSQAQRENAREETR

SEQ ID NO: 281370 - protein, 9 aa, Mycobacterium
RKSTDADLA

SEQ ID NO: 281371 - protein, 6 aa, Mycobacterium
RKTIEQ

SEQ ID NO: 281372 - protein, 6 aa, Mycobacterium
RKTNPN

SEQ ID NO: 281373 - protein, 7 aa, Mycobacterium
RKTPPTL

SEQ ID NO: 281374 - protein, 9 aa, Mycobacterium
RKTSDDDMN

SEQ ID NO: 281375 - protein, 8 aa, Mycobacterium
RKTSGGAG

SEQ ID NO: 281376 - protein, 7 aa, Mycobacterium
RKTSGHP

SEQ ID NO: 281377 - protein, 8 aa, Mycobacterium
RKTTDADL

SEQ ID NO: 281378 - protein, 39 aa, Mycobacterium
RKTTGDHRQAAGPQTSSSSASSMPATSDPAAPPAPLDGT

SEQ ID NO: 281379 - protein, 6 aa, Mycobacterium
RKTVHD

SEQ ID NO: 281380 - protein, 6 aa, Mycobacterium
RKVADA

SEQ ID NO: 281381 - protein, 7 aa, Mycobacterium
RKVADSD

SEQ ID NO: 281382 - protein, 9 aa, Mycobacterium
RKVPTERYP

SEQ ID NO: 281383 - protein, 8 aa, Mycobacterium
RKYQEGRL

SEQ ID NO: 281384 - protein, 12 aa, Mycobacterium
RLAADADSTGDR

SEQ ID NO: 281385 - protein, 17 aa, Mycobacterium
RLADAPDEVPAGPVRSI

SEQ ID NO: 281386 - protein, 9 aa, Mycobacterium
RLADRDDPR

SEQ ID NO: 281387 - protein, 17 aa, Mycobacterium
RLAEGKSNDIPERTTRS

SEQ ID NO: 281388 - protein, 10 aa, Mycobacterium
RLAGGAGDRR

SEQ ID NO: 281389 - protein, 30 aa, Mycobacterium
RLAGRPDHPGSAPGSLRQRRNKGGGGSFTS

SEQ ID NO: 281390 - protein, 7 aa, Mycobacterium
RLAKGGP

SEQ ID NO: 281391 - protein, 8 aa, Mycobacterium
RLAPDRRE

SEQ ID NO: 281392 - protein, 16 aa, Mycobacterium
RLAPKAAPLSTTKGAS

SEQ ID NO: 281393 - protein, 27 aa, Mycobacterium
RLAPRPVERPPVDPAAQRTFGRPAGVE

SEQ ID NO: 281394 - protein, 8 aa, Mycobacterium
RLAQPAAQ

SEQ ID NO: 281395 - protein, 10 aa, Mycobacterium
RLAQRGGTGY

SEQ ID NO: 281396 - protein, 5 aa, Mycobacterium
RLARG

SEQ ID NO: 281397 - protein, 4 aa, Mycobacterium
RLDA

SEQ ID NO: 281398 - protein, 32 aa, Mycobacterium
RLDAAAASTPLAPQTVPAESPLAQSLPAPPTR

SEQ ID NO: 281399 - protein, 6 aa, Mycobacterium
RLDEGR

SEQ ID NO: 281400 - protein, 5 aa, Mycobacterium
RLDEP

SEQ ID NO: 281401 - protein, 5 aa, Mycobacterium
RLDES

SEQ ID NO: 281402 - protein, 6 aa, Mycobacterium
RLDESR

SEQ ID NO: 281403 - protein, 17 aa, Mycobacterium
RLDGPSSETGTDPGRRR

SEQ ID NO: 281404 - protein, 7 aa, Mycobacterium
RLDPAAG

SEQ ID NO: 281405 - protein, 6 aa, Mycobacterium
RLDPGV

SEQ ID NO: 281406 - protein, 12 aa, Mycobacterium
RLDQNGQPLPQD

SEQ ID NO: 281407 - protein, 12 aa, Mycobacterium
RLDQNGRPLPQE

SEQ ID NO: 281408 - protein, 9 aa, Mycobacterium
RLDRARDAA

SEQ ID NO: 281409 - protein, 6 aa, Mycobacterium
RLDRGT

SEQ ID NO: 281410 - protein, 17 aa, Mycobacterium
RLDSDRADKTGSGRAPG

SEQ ID NO: 281411 - protein, 7 aa, Mycobacterium
RLDSSPS

SEQ ID NO: 281412 - protein, 6 aa, Mycobacterium
RLEPDP

SEQ ID NO: 281413 - protein, 8 aa, Mycobacterium
RLEQGRAA

SEQ ID NO: 281414 - protein, 9 aa, Mycobacterium
RLEQPEDQA

SEQ ID NO: 281415 - protein, 8 aa, Mycobacterium
RLEQQRAQ

SEQ ID NO: 281416 - protein, 22 aa, Mycobacterium
RLESHPGKHEMPKTRRPPTRSQ

SEQ ID NO: 281417 - protein, 10 aa, Mycobacterium
RLGANKGSYD

SEQ ID NO: 281418 - protein, 9 aa, Mycobacterium
RLGANSNSL

SEQ ID NO: 281419 - protein, 12 aa, Mycobacterium
RLGDPDTDSAAA

SEQ ID NO: 281420 - protein, 7 aa, Mycobacterium
RLGEERQ

SEQ ID NO: 281421 - protein, 10 aa, Mycobacterium
RLGEPATEGA

SEQ ID NO: 281422 - protein, 10 aa, Mycobacterium
RLGEPDADGA

SEQ ID NO: 281423 - protein, 24 aa, Mycobacterium
RLGGAAADSHTAERVESAALGGGH

SEQ ID NO: 281424 - protein, 9 aa, Mycobacterium
RLGGETTSL

SEQ ID NO: 281425 - protein, 5 aa, Mycobacterium
RLGKD

SEQ ID NO: 281426 - protein, 6 aa, Mycobacterium
RLGKDT

SEQ ID NO: 281427 - protein, 7 aa, Mycobacterium
RLGNPTF

SEQ ID NO: 281428 - protein, 7 aa, Mycobacterium
RLGPERA

SEQ ID NO: 281429 - protein, 5 aa, Mycobacterium
RLGPG

SEQ ID NO: 281430 - protein, 11 aa, Mycobacterium
RLGPGDVKGEL

SEQ ID NO: 281431 - protein, 7 aa, Mycobacterium
RLGPQGH

SEQ ID NO: 281432 - protein, 12 aa, Mycobacterium
RLGPQGKQLADV

SEQ ID NO: 281433 - protein, 9 aa, Mycobacterium
RLGQDDAEV

SEQ ID NO: 281434 - protein, 7 aa, Mycobacterium
RLGQEDR

SEQ ID NO: 281435 - protein, 4 aa, Mycobacterium
RLGR

SEQ ID NO: 281436 - protein, 8 aa, Mycobacterium
RLGRGSRV

SEQ ID NO: 281437 - protein, 5 aa, Mycobacterium
RLGRQ

SEQ ID NO: 281438 - protein, 5 aa, Mycobacterium
RLGRR

SEQ ID NO: 281439 - protein, 10 aa, Mycobacterium
RLGSGATVGP

SEQ ID NO: 281440 - protein, 15 aa, Mycobacterium
RLGSGGRGGLPVGDE

SEQ ID NO: 281441 - protein, 8 aa, Mycobacterium
RLGSSEGV

SEQ ID NO: 281442 - protein, 9 aa, Mycobacterium
RLGSTGFDE

SEQ ID NO: 281443 - protein, 14 aa, Mycobacterium
RLGTGGAGLSLGER

SEQ ID NO: 281444 - protein, 7 aa, Mycobacterium
RLGYQES

SEQ ID NO: 281445 - protein, 6 aa, Mycobacterium
RLKAGQ

SEQ ID NO: 281446 - protein, 8 aa, Mycobacterium
RLKPGETV

SEQ ID NO: 281447 - protein, 4 aa, Mycobacterium
RLKR

SEQ ID NO: 281448 - protein, 9 aa, Mycobacterium
RLKSSSRSV

SEQ ID NO: 281449 - protein, 4 aa, Mycobacterium
RLND

SEQ ID NO: 281450 - protein, 7 aa, Mycobacterium
RLNPAAG

SEQ ID NO: 281451 - protein, 10 aa, Mycobacterium
RLNSSSAQIA

SEQ ID NO: 281452 - protein, 4 aa, Mycobacterium
RLPA

SEQ ID NO: 281453 - protein, 8 aa, Mycobacterium
RLPAPERH

SEQ ID NO: 281454 - protein, 10 aa, Mycobacterium
RLPAQSSQLY

SEQ ID NO: 281455 - protein, 67 aa, Mycobacterium
RLPARTRRDPEPAPEPEMDPEPAPAPEPDPEPAPEPEPQREPEPESEPEADTDEGPEIDPSDPPESA

SEQ ID NO: 281456 - protein, 7 aa, Mycobacterium
RLPATTK

SEQ ID NO: 281457 - protein, 6 aa, Mycobacterium
RLPDRA

SEQ ID NO: 281458 - protein, 10 aa, Mycobacterium
RLPEQPEKLA

SEQ ID NO: 281459 - protein, 11 aa, Mycobacterium
RLPEQQDELAE

SEQ ID NO: 281460 - protein, 6 aa, Mycobacterium
RLPESE

SEQ ID NO: 281461 - protein, 4 aa, Mycobacterium
RLPG

SEQ ID NO: 281462 - protein, 12 aa, Mycobacterium
RLPGDMNSPDET

SEQ ID NO: 281463 - protein, 6 aa, Mycobacterium
RLPGGS

SEQ ID NO: 281464 - protein, 7 aa, Mycobacterium
RLPGRAA

SEQ ID NO: 281465 - protein, 7 aa, Mycobacterium
RLPGSAR

SEQ ID NO: 281466 - protein, 7 aa, Mycobacterium
RLPLPRA

SEQ ID NO: 281467 - protein, 24 aa, Mycobacterium
RLPNGDASKVGEAGAALSGGERQR

SEQ ID NO: 281468 - protein, 5 aa, Mycobacterium
RLPNQ

SEQ ID NO: 281469 - protein, 5 aa, Mycobacterium
RLPPG

SEQ ID NO: 281470 - protein, 16 aa, Mycobacterium
RLPQSHQGQRDRSRRR

SEQ ID NO: 281471 - protein, 6 aa, Mycobacterium
RLPRGR

SEQ ID NO: 281472 - protein, 6 aa, Mycobacterium
RLPRPA

SEQ ID NO: 281473 - protein, 7 aa, Mycobacterium
RLPSDDL

SEQ ID NO: 281474 - protein, 5 aa, Mycobacterium
RLPSG

SEQ ID NO: 281475 - protein, 6 aa, Mycobacterium
RLPSRG

SEQ ID NO: 281476 - protein, 8 aa, Mycobacterium
RLPVDNPA

SEQ ID NO: 281477 - protein, 9 aa, Mycobacterium
RLPVDNPAT

SEQ ID NO: 281478 - protein, 6 aa, Mycobacterium
RLQPGD

SEQ ID NO: 281479 - protein, 14 aa, Mycobacterium
RLQPPAPEKPSRRA

SEQ ID NO: 281480 - protein, 14 aa, Mycobacterium
RLQPPPGYKDTTVP

SEQ ID NO: 281481 - protein, 8 aa, Mycobacterium
RLQSGKAC

SEQ ID NO: 281482 - protein, 5 aa, Mycobacterium
RLRAG

SEQ ID NO: 281483 - protein, 4 aa, Mycobacterium
RLRE

SEQ ID NO: 281484 - protein, 10 aa, Mycobacterium
RLRERDPEYD

SEQ ID NO: 281485 - protein, 7 aa, Mycobacterium
RLRPAAS

SEQ ID NO: 281486 - protein, 8 aa, Mycobacterium
RLRTRDSG

SEQ ID NO: 281487 - protein, 6 aa, Mycobacterium
RLSARD

SEQ ID NO: 281488 - protein, 9 aa, Mycobacterium
RLSDPENRV

SEQ ID NO: 281489 - protein, 8 aa, Mycobacterium
RLSDTRPG

SEQ ID NO: 281490 - protein, 4 aa, Mycobacterium
RLSE

SEQ ID NO: 281491 - protein, 6 aa, Mycobacterium
RLSEDR

SEQ ID NO: 281492 - protein, 12 aa, Mycobacterium
RLSERADGTITA

SEQ ID NO: 281493 - protein, 11 aa, Mycobacterium
RLSGDTATSVP

SEQ ID NO: 281494 - protein, 6 aa, Mycobacterium
RLSGER

SEQ ID NO: 281495 - protein, 11 aa, Mycobacterium
RLSGGQRKRAS

SEQ ID NO: 281496 - protein, 9 aa, Mycobacterium
RLSGGQRQR

SEQ ID NO: 281497 - protein, 6 aa, Mycobacterium
RLSGQG

SEQ ID NO: 281498 - protein, 16 aa, Mycobacterium
RLSNDDLAPTTAAQAT

SEQ ID NO: 281499 - protein, 9 aa, Mycobacterium
RLSNQTATQ

SEQ ID NO: 281500 - protein, 4 aa, Mycobacterium
RLSP

SEQ ID NO: 281501 - protein, 16 aa, Mycobacterium
RLSPPAAATPGVPADG

SEQ ID NO: 281502 - protein, 8 aa, Mycobacterium
RLSPRGPE

SEQ ID NO: 281503 - protein, 4 aa, Mycobacterium
RLSR

SEQ ID NO: 281504 - protein, 16 aa, Mycobacterium
RLSREQAAAAAADPDL

SEQ ID NO: 281505 - protein, 7 aa, Mycobacterium
RLSRTAE

SEQ ID NO: 281506 - protein, 10 aa, Mycobacterium
RLSTPARNVD

SEQ ID NO: 281507 - protein, 4 aa, Mycobacterium
RLTA

SEQ ID NO: 281508 - protein, 8 aa, Mycobacterium
RLTASGSV

SEQ ID NO: 281509 - protein, 9 aa, Mycobacterium
RLTDTSAGQ

SEQ ID NO: 281510 - protein, 10 aa, Mycobacterium
RLTEAASDYR

SEQ ID NO: 281511 - protein, 11 aa, Mycobacterium
RLTEDAARAAL

SEQ ID NO: 281512 - protein, 10 aa, Mycobacterium
RLTEKGSGID

SEQ ID NO: 281513 - protein, 11 aa, Mycobacterium
RLTESGSGIEL

SEQ ID NO: 281514 - protein, 6 aa, Mycobacterium
RLTGAE

SEQ ID NO: 281515 - protein, 16 aa, Mycobacterium
RLTGTANQAARAPSNL

SEQ ID NO: 281516 - protein, 6 aa, Mycobacterium
RLTRAR

SEQ ID NO: 281517 - protein, 8 aa, Mycobacterium
RLTSSHNV

SEQ ID NO: 281518 - protein, 4 aa, Mycobacterium
RLTT

SEQ ID NO: 281519 - protein, 13 aa, Mycobacterium
RLTTDQAKELSSG

SEQ ID NO: 281520 - protein, 6 aa, Mycobacterium
RLYEEP

SEQ ID NO: 281521 - protein, 4 aa, Mycobacterium
RMAR

SEQ ID NO: 281522 - protein, 4 aa, Mycobacterium
RMDG

SEQ ID NO: 281523 - protein, 9 aa, Mycobacterium
RMDRAQPLK

SEQ ID NO: 281524 - protein, 9 aa, Mycobacterium
RMEQNTNEF

SEQ ID NO: 281525 - protein, 5 aa, Mycobacterium
RMERG

SEQ ID NO: 281526 - protein, 8 aa, Mycobacterium
RMESEPEQ

SEQ ID NO: 281527 - protein, 12 aa, Mycobacterium
RMETTDEEGRIQ

SEQ ID NO: 281528 - protein, 8 aa, Mycobacterium
RMETTDSV

SEQ ID NO: 281529 - protein, 7 aa, Mycobacterium
RMGGETV

SEQ ID NO: 281530 - protein, 5 aa, Mycobacterium
RMGGT

SEQ ID NO: 281531 - protein, 5 aa, Mycobacterium
RMGRP

SEQ ID NO: 281532 - protein, 10 aa, Mycobacterium
RMGTGGAAAT

SEQ ID NO: 281533 - protein, 10 aa, Mycobacterium
RMHSGPRSEL

SEQ ID NO: 281534 - protein, 9 aa, Mycobacterium
RMPEGPGDR

SEQ ID NO: 281535 - protein, 11 aa, Mycobacterium
RMPGPDIAPRQ

SEQ ID NO: 281536 - protein, 12 aa, Mycobacterium
RMPGPDVTQQEL

SEQ ID NO: 281537 - protein, 5 aa, Mycobacterium
RMPGT

SEQ ID NO: 281538 - protein, 7 aa, Mycobacterium
RMPKSET

SEQ ID NO: 281539 - protein, 15 aa, Mycobacterium
RMPRRGRKEAVAQPI

SEQ ID NO: 281540 - protein, 5 aa, Mycobacterium
RMQPG

SEQ ID NO: 281541 - protein, 8 aa, Mycobacterium
RMRAPTAL

SEQ ID NO: 281542 - protein, 8 aa, Mycobacterium
RMSDDREA

SEQ ID NO: 281543 - protein, 15 aa, Mycobacterium
RMSDPRTAGRLPAPN

SEQ ID NO: 281544 - protein, 7 aa, Mycobacterium
RMSRGDL

SEQ ID NO: 281545 - protein, 7 aa, Mycobacterium
RMSRGEL

SEQ ID NO: 281546 - protein, 6 aa, Mycobacterium
RMSRSQ

SEQ ID NO: 281547 - protein, 4 aa, Mycobacterium
RMSS

SEQ ID NO: 281548 - protein, 11 aa, Mycobacterium
RMSTESTAYLE

SEQ ID NO: 281549 - protein, 14 aa, Mycobacterium
RMSWPSTYKVRDRR

SEQ ID NO: 281550 - protein, 10 aa, Mycobacterium
RMTPGQAGRI

SEQ ID NO: 281551 - protein, 35 aa, Mycobacterium
RMTQGKEAFPNGSTGQNPYSPPSDTGEALGLPPSQ

SEQ ID NO: 281552 - protein, 4 aa, Mycobacterium
RNAA

SEQ ID NO: 281553 - protein, 8 aa, Mycobacterium
RNAAADDI

SEQ ID NO: 281554 - protein, 10 aa, Mycobacterium
RNAAADDTKA

SEQ ID NO: 281555 - protein, 10 aa, Mycobacterium
RNAAADDTQA

SEQ ID NO: 281556 - protein, 9 aa, Mycobacterium
RNAAKNDIP

SEQ ID NO: 281557 - protein, 10 aa, Mycobacterium
RNAASGDGGA

SEQ ID NO: 281558 - protein, 8 aa, Mycobacterium
RNADSSRQ

SEQ ID NO: 281559 - protein, 9 aa, Mycobacterium
RNADTAWGP

SEQ ID NO: 281560 - protein, 5 aa, Mycobacterium
RNAEQ

SEQ ID NO: 281561 - protein, 6 aa, Mycobacterium
RNAGKG

SEQ ID NO: 281562 - protein, 17 aa, Mycobacterium
RNAGKTAFGSAANADQL

SEQ ID NO: 281563 - protein, 15 aa, Mycobacterium
RNAGKTSFGSARTAH

SEQ ID NO: 281564 - protein, 8 aa, Mycobacterium
RNANGRYE

SEQ ID NO: 281565 - protein, 18 aa, Mycobacterium
RNAPPAPTHDGTGGRADT

SEQ ID NO: 281566 - protein, 19 aa, Mycobacterium
RNAPPPPTHDGSRGRGDTD

SEQ ID NO: 281567 - protein, 20 aa, Mycobacterium
RNAPRPADDDTAGPPPNADL

SEQ ID NO: 281568 - protein, 31 aa, Mycobacterium
RNAPRPPGDDTAGPPPGADLGATTGPTPQGR

SEQ ID NO: 281569 - protein, 20 aa, Mycobacterium
RNAPTPLDSSITEEIEPEVA

SEQ ID NO: 281570 - protein, 5 aa, Mycobacterium
RNAPV

SEQ ID NO: 281571 - protein, 17 aa, Mycobacterium
RNASIPTGKNNDPCFAN

SEQ ID NO: 281572 - protein, 5 aa, Mycobacterium
RNATA

SEQ ID NO: 281573 - protein, 7 aa, Mycobacterium
RNATSKR

SEQ ID NO: 281574 - protein, 44 aa, Mycobacterium
RNAVSGAAAAAQRAMPSSSPTPPSPTPPSPTPPPSGSPARDERE

SEQ ID NO: 281575 - protein, 9 aa, Mycobacterium
RNDADAGAE

SEQ ID NO: 281576 - protein, 14 aa, Mycobacterium
RNDGGPPVLEGPAS

SEQ ID NO: 281577 - protein, 9 aa, Mycobacterium
RNDGPTPVQ

SEQ ID NO: 281578 - protein, 9 aa, Mycobacterium
RNDGTVPGR

SEQ ID NO: 281579 - protein, 6 aa, Mycobacterium
RNDMDT

SEQ ID NO: 281580 - protein, 6 aa, Mycobacterium
RNDPEH

SEQ ID NO: 281581 - protein, 9 aa, Mycobacterium
RNDPGLTEQ

SEQ ID NO: 281582 - protein, 10 aa, Mycobacterium
RNDPRRREAQ

SEQ ID NO: 281583 - protein, 6 aa, Mycobacterium
RNDQGV

SEQ ID NO: 281584 - protein, 7 aa, Mycobacterium
RNDSKHV

SEQ ID NO: 281585 - protein, 7 aa, Mycobacterium
RNEAKTN

SEQ ID NO: 281586 - protein, 20 aa, Mycobacterium
RNEHAEEPEIPEPQEVSLSE

SEQ ID NO: 281587 - protein, 10 aa, Mycobacterium
RNENTPIRRG

SEQ ID NO: 281588 - protein, 7 aa, Mycobacterium
RNEPGVG

SEQ ID NO: 281589 - protein, 9 aa, Mycobacterium
RNEPTAGSV

SEQ ID NO: 281590 - protein, 5 aa, Mycobacterium
RNESF

SEQ ID NO: 281591 - protein, 18 aa, Mycobacterium
RNESFNHAGNASAAAITG

SEQ ID NO: 281592 - protein, 11 aa, Mycobacterium
RNFPPPGMPPM

SEQ ID NO: 281593 - protein, 22 aa, Mycobacterium
RNGAAEGKISGHRRRMRGNADA

SEQ ID NO: 281594 - protein, 7 aa, Mycobacterium
RNGAELD

SEQ ID NO: 281595 - protein, 6 aa, Mycobacterium
RNGASA

SEQ ID NO: 281596 - protein, 12 aa, Mycobacterium
RNGDRQPGPGRA

SEQ ID NO: 281597 - protein, 23 aa, Mycobacterium
RNGDSADGPEDTNTERLAVSSPH

SEQ ID NO: 281598 - protein, 9 aa, Mycobacterium
RNGDTDPRV

SEQ ID NO: 281599 - protein, 4 aa, Mycobacterium
RNGE

SEQ ID NO: 281600 - protein, 5 aa, Mycobacterium
RNGEA

SEQ ID NO: 281601 - protein, 8 aa, Mycobacterium
RNGEHTSI

SEQ ID NO: 281602 - protein, 9 aa, Mycobacterium
RNGELPGSR

SEQ ID NO: 281603 - protein, 15 aa, Mycobacterium
RNGFDADGEDGRPAP

SEQ ID NO: 281604 - protein, 11 aa, Mycobacterium
RNGGDGTLPNR

SEQ ID NO: 281605 - protein, 14 aa, Mycobacterium
RNGGTGAVPPGVGP

SEQ ID NO: 281606 - protein, 9 aa, Mycobacterium
RNGGTTYRL

SEQ ID NO: 281607 - protein, 6 aa, Mycobacterium
RNGIPK

SEQ ID NO: 281608 - protein, 5 aa, Mycobacterium
RNGIR

SEQ ID NO: 281609 - protein, 14 aa, Mycobacterium
RNGITVKDPDGTMR

SEQ ID NO: 281610 - protein, 5 aa, Mycobacterium
RNGNL

SEQ ID NO: 281611 - protein, 10 aa, Mycobacterium
RNGNSRPLRD

SEQ ID NO: 281612 - protein, 7 aa, Mycobacterium
RNGPAER

SEQ ID NO: 281613 - protein, 5 aa, Mycobacterium
RNGPF

SEQ ID NO: 281614 - protein, 25 aa, Mycobacterium
RNGSHIDSSPQTSTPSLLGSGQSAY

SEQ ID NO: 281615 - protein, 5 aa, Mycobacterium
RNGTY

SEQ ID NO: 281616 - protein, 17 aa, Mycobacterium
RNHGADPRRRGAKLDEQ

SEQ ID NO: 281617 - protein, 7 aa, Mycobacterium
RNHPTPL

SEQ ID NO: 281618 - protein, 17 aa, Mycobacterium
RNKAHTGHHPAVPEPLA

SEQ ID NO: 281619 - protein, 17 aa, Mycobacterium
RNKGPDGRPDGPRGPVR

SEQ ID NO: 281620 - protein, 29 aa, Mycobacterium
RNKPDPTPPGPDAEPTTDSDPDAEKVGAA

SEQ ID NO: 281621 - protein, 9 aa, Mycobacterium
RNKQHTGEH

SEQ ID NO: 281622 - protein, 9 aa, Mycobacterium
RNKRGEGAE

SEQ ID NO: 281623 - protein, 10 aa, Mycobacterium
RNKRPDPLRS

SEQ ID NO: 281624 - protein, 9 aa, Mycobacterium
RNMGQGLDQ

SEQ ID NO: 281625 - protein, 13 aa, Mycobacterium
RNMPSSELTTDAD

SEQ ID NO: 281626 - protein, 4 aa, Mycobacterium
RNNG

SEQ ID NO: 281627 - protein, 12 aa, Mycobacterium
RNNSDGKPLLGE

SEQ ID NO: 281628 - protein, 9 aa, Mycobacterium
RNNSGCRSG

SEQ ID NO: 281629 - protein, 6 aa, Mycobacterium
RNPADD

SEQ ID NO: 281630 - protein, 7 aa, Mycobacterium
RNPADGY

SEQ ID NO: 281631 - protein, 8 aa, Mycobacterium
RNPAIDTP

SEQ ID NO: 281632 - protein, 6 aa, Mycobacterium
RNPDGR

SEQ ID NO: 281633 - protein, 10 aa, Mycobacterium
RNPDRAYADP

SEQ ID NO: 281634 - protein, 10 aa, Mycobacterium
RNPDSAGAAA

SEQ ID NO: 281635 - protein, 10 aa, Mycobacterium
RNPDVTESGT

SEQ ID NO: 281636 - protein, 12 aa, Mycobacterium
RNPEANEPSEAA

SEQ ID NO: 281637 - protein, 10 aa, Mycobacterium
RNPGPDGRIS

SEQ ID NO: 281638 - protein, 19 aa, Mycobacterium
RNPGRLPDDRRPRRSPAVP

SEQ ID NO: 281639 - protein, 8 aa, Mycobacterium
RNPGRRRA

SEQ ID NO: 281640 - protein, 5 aa, Mycobacterium
RNPGS

SEQ ID NO: 281641 - protein, 6 aa, Mycobacterium
RNPGSP

SEQ ID NO: 281642 - protein, 4 aa, Mycobacterium
RNPH

SEQ ID NO: 281643 - protein, 6 aa, Mycobacterium
RNPHLQ

SEQ ID NO: 281644 - protein, 6 aa, Mycobacterium
RNPLAD

SEQ ID NO: 281645 - protein, 5 aa, Mycobacterium
RNPPE

SEQ ID NO: 281646 - protein, 8 aa, Mycobacterium
RNPPPPGL

SEQ ID NO: 281647 - protein, 8 aa, Mycobacterium
RNPRPPQA

SEQ ID NO: 281648 - protein, 9 aa, Mycobacterium
RNPRPPQAV

SEQ ID NO: 281649 - protein, 12 aa, Mycobacterium
RNPRPPQSTIDA

SEQ ID NO: 281650 - protein, 7 aa, Mycobacterium
RNPSDDV

SEQ ID NO: 281651 - protein, 6 aa, Mycobacterium
RNPTSA

SEQ ID NO: 281652 - protein, 11 aa, Mycobacterium
RNPVTSSASDQ

SEQ ID NO: 281653 - protein, 4 aa, Mycobacterium
RNPW

SEQ ID NO: 281654 - protein, 5 aa, Mycobacterium
RNQEG

SEQ ID NO: 281655 - protein, 9 aa, Mycobacterium
RNQNARDRL

SEQ ID NO: 281656 - protein, 8 aa, Mycobacterium
RNQPPPGV

SEQ ID NO: 281657 - protein, 4 aa, Mycobacterium
RNQR

SEQ ID NO: 281658 - protein, 4 aa, Mycobacterium
RNRA

SEQ ID NO: 281659 - protein, 6 aa, Mycobacterium
RNRASG

SEQ ID NO: 281660 - protein, 11 aa, Mycobacterium
RNRDDGFDHEP

SEQ ID NO: 281661 - protein, 14 aa, Mycobacterium
RNRGRGSEGEPLET

SEQ ID NO: 281662 - protein, 10 aa, Mycobacterium
RNRPESWPSA

SEQ ID NO: 281663 - protein, 6 aa, Mycobacterium
RNRQQA

SEQ ID NO: 281664 - protein, 6 aa, Mycobacterium
RNRQRR

SEQ ID NO: 281665 - protein, 14 aa, Mycobacterium
RNRRPTGKGSHRMR

SEQ ID NO: 281666 - protein, 25 aa, Mycobacterium
RNRRPTGKTSHRRRRTRTRGGVTVE

SEQ ID NO: 281667 - protein, 23 aa, Mycobacterium
RNRRPTGKTSHRRRRVRRGVTVE

SEQ ID NO: 281668 - protein, 27 aa, Mycobacterium
RNRRRAPAGTDGEPDSGHPTSAVRNES

SEQ ID NO: 281669 - protein, 18 aa, Mycobacterium
RNRRSDAVADAAQTQPTL

SEQ ID NO: 281670 - protein, 4 aa, Mycobacterium
RNRS

SEQ ID NO: 281671 - protein, 7 aa, Mycobacterium
RNRTGEL

SEQ ID NO: 281672 - protein, 4 aa, Mycobacterium
RNSA

SEQ ID NO: 281673 - protein, 10 aa, Mycobacterium
RNSAAAARAS

SEQ ID NO: 281674 - protein, 15 aa, Mycobacterium
RNSEPPVAGKDPFVG

SEQ ID NO: 281675 - protein, 6 aa, Mycobacterium
RNSGAF

SEQ ID NO: 281676 - protein, 7 aa, Mycobacterium
RNSMTDD

SEQ ID NO: 281677 - protein, 5 aa, Mycobacterium
RNSNR

SEQ ID NO: 281678 - protein, 10 aa, Mycobacterium
RNSPQSQKPW

SEQ ID NO: 281679 - protein, 4 aa, Mycobacterium
RNSR

SEQ ID NO: 281680 - protein, 13 aa, Mycobacterium
RNSSTPPTKLPED

SEQ ID NO: 281681 - protein, 9 aa, Mycobacterium
RNSTPATGK

SEQ ID NO: 281682 - protein, 7 aa, Mycobacterium
RNSVVPD

SEQ ID NO: 281683 - protein, 10 aa, Mycobacterium
RNTADEKSPV

SEQ ID NO: 281684 - protein, 8 aa, Mycobacterium
RNTAGAKV

SEQ ID NO: 281685 - protein, 12 aa, Mycobacterium
RNTEDGDALGRQ

SEQ ID NO: 281686 - protein, 8 aa, Mycobacterium
RNTGAQSA

SEQ ID NO: 281687 - protein, 5 aa, Mycobacterium
RNTGG

SEQ ID NO: 281688 - protein, 7 aa, Mycobacterium
RNTIQDY

SEQ ID NO: 281689 - protein, 11 aa, Mycobacterium
RNTTGAEESAW

SEQ ID NO: 281690 - protein, 26 aa, Mycobacterium
RNVARDAAATHQGVAAQSQAEQQLSG

SEQ ID NO: 281691 - protein, 7 aa, Mycobacterium
RNVARSG

SEQ ID NO: 281692 - protein, 6 aa, Mycobacterium
RNVSTE

SEQ ID NO: 281693 - protein, 7 aa, Mycobacterium
RNVSTEV

SEQ ID NO: 281694 - protein, 7 aa, Mycobacterium
RNYHATR

SEQ ID NO: 281695 - protein, 11 aa, Mycobacterium
RPAADQRTYGT

SEQ ID NO: 281696 - protein, 5 aa, Mycobacterium
RPAAE

SEQ ID NO: 281697 - protein, 30 aa, Mycobacterium
RPAAGAQENVPATSSAVGEPIRAAVSPGDG

SEQ ID NO: 281698 - protein, 6 aa, Mycobacterium
RPAAGR

SEQ ID NO: 281699 - protein, 11 aa, Mycobacterium
RPAAGSGGVAK

SEQ ID NO: 281700 - protein, 9 aa, Mycobacterium
RPAAKFPGG

SEQ ID NO: 281701 - protein, 14 aa, Mycobacterium
RPAAKGCVAERFTA

SEQ ID NO: 281702 - protein, 6 aa, Mycobacterium
RPAANA

SEQ ID NO: 281703 - protein, 28 aa, Mycobacterium
RPAARAPQHTDTPERGPRELSACAAPAG

SEQ ID NO: 281704 - protein, 9 aa, Mycobacterium
RPAARPPVE

SEQ ID NO: 281705 - protein, 21 aa, Mycobacterium
RPAATSGPATVPHGTDRQSQR

SEQ ID NO: 281706 - protein, 4 aa, Mycobacterium
RPAD

SEQ ID NO: 281707 - protein, 15 aa, Mycobacterium
RPADAVPADQPGRGL

SEQ ID NO: 281708 - protein, 11 aa, Mycobacterium
RPADEHRAEAA

SEQ ID NO: 281709 - protein, 8 aa, Mycobacterium
RPADGGHL

SEQ ID NO: 281710 - protein, 6 aa, Mycobacterium
RPADPE

SEQ ID NO: 281711 - protein, 6 aa, Mycobacterium
RPADQR

SEQ ID NO: 281712 - protein, 7 aa, Mycobacterium
RPADREM

SEQ ID NO: 281713 - protein, 7 aa, Mycobacterium
RPADSAN

SEQ ID NO: 281714 - protein, 15 aa, Mycobacterium
RPAEAVPHDQPGRGL

SEQ ID NO: 281715 - protein, 16 aa, Mycobacterium
RPAEAVPHDQPGRGLT

SEQ ID NO: 281716 - protein, 13 aa, Mycobacterium
RPAEEDRRDAENR

SEQ ID NO: 281717 - protein, 15 aa, Mycobacterium
RPAEGDSGAPTGPPH

SEQ ID NO: 281718 - protein, 9 aa, Mycobacterium
RPAEGFRSR

SEQ ID NO: 281719 - protein, 7 aa, Mycobacterium
RPAEGMS

SEQ ID NO: 281720 - protein, 15 aa, Mycobacterium
RPAEGVPADQPGRGL

SEQ ID NO: 281721 - protein, 14 aa, Mycobacterium
RPAEPGAEADTSTT

SEQ ID NO: 281722 - protein, 13 aa, Mycobacterium
RPAEPGRTPVPAA

SEQ ID NO: 281723 - protein, 14 aa, Mycobacterium
RPAEPPSSSAPRPP

SEQ ID NO: 281724 - protein, 12 aa, Mycobacterium
RPAESGPRRQRR

SEQ ID NO: 281725 - protein, 15 aa, Mycobacterium
RPAESVPHDQPGRGL

SEQ ID NO: 281726 - protein, 6 aa, Mycobacterium
RPAFRG

SEQ ID NO: 281727 - protein, 18 aa, Mycobacterium
RPAGAGAPPGWPPQTPPA

SEQ ID NO: 281728 - protein, 12 aa, Mycobacterium
RPAGAGTPAGRR

SEQ ID NO: 281729 - protein, 9 aa, Mycobacterium
RPAGGGRLE

SEQ ID NO: 281730 - protein, 6 aa, Mycobacterium
RPAGGH

SEQ ID NO: 281731 - protein, 8 aa, Mycobacterium
RPAGGLSN

SEQ ID NO: 281732 - protein, 14 aa, Mycobacterium
RPAGHTHLVFSEMR

SEQ ID NO: 281733 - protein, 6 aa, Mycobacterium
RPAGLE

SEQ ID NO: 281734 - protein, 6 aa, Mycobacterium
RPAGLS

SEQ ID NO: 281735 - protein, 7 aa, Mycobacterium
RPAGRPW

SEQ ID NO: 281736 - protein, 12 aa, Mycobacterium
RPAGSGTAKTPG

SEQ ID NO: 281737 - protein, 8 aa, Mycobacterium
RPAHEDLT

SEQ ID NO: 281738 - protein, 20 aa, Mycobacterium
RPAHQPVSDAAAGSATPACA

SEQ ID NO: 281739 - protein, 8 aa, Mycobacterium
RPAHRQGG

SEQ ID NO: 281740 - protein, 19 aa, Mycobacterium
RPAITSQAPAERRMRVLLD

SEQ ID NO: 281741 - protein, 9 aa, Mycobacterium
RPAKTNRRQ

SEQ ID NO: 281742 - protein, 5 aa, Mycobacterium
RPAMS

SEQ ID NO: 281743 - protein, 9 aa, Mycobacterium
RPANDGERI

SEQ ID NO: 281744 - protein, 6 aa, Mycobacterium
RPANPA

SEQ ID NO: 281745 - protein, 4 aa, Mycobacterium
RPAP

SEQ ID NO: 281746 - protein, 18 aa, Mycobacterium
RPAPANSSRRGTPEPANT

SEQ ID NO: 281747 - protein, 5 aa, Mycobacterium
RPAPE

SEQ ID NO: 281748 - protein, 24 aa, Mycobacterium
RPAPEPPARPPEQPAPADDAYAES

SEQ ID NO: 281749 - protein, 70 aa, Mycobacterium
RPAPERTPRPAKKKLTRATTENADDSDVDKAIASEPEAREPADEPSGDSPDSDEKVLEPARGLRNRRTRR

SEQ ID NO: 281750 - protein, 8 aa, Mycobacterium
RPAPGYSA

SEQ ID NO: 281751 - protein, 6 aa, Mycobacterium
RPAPIG

SEQ ID NO: 281752 - protein, 13 aa, Mycobacterium
RPAPPPPPPDHRA

SEQ ID NO: 281753 - protein, 20 aa, Mycobacterium
RPAPPPTPTDAETADPEMAP

SEQ ID NO: 281754 - protein, 12 aa, Mycobacterium
RPAPRIELLQVE

SEQ ID NO: 281755 - protein, 34 aa, Mycobacterium
RPAPVTAPAEEPVAAADAPAAGASPEPYSDARYS

SEQ ID NO: 281756 - protein, 5 aa, Mycobacterium
RPAQA

SEQ ID NO: 281757 - protein, 7 aa, Mycobacterium
RPAQDVR

SEQ ID NO: 281758 - protein, 6 aa, Mycobacterium
RPAQQS

SEQ ID NO: 281759 - protein, 5 aa, Mycobacterium
RPARQ

SEQ ID NO: 281760 - protein, 6 aa, Mycobacterium
RPARRP

SEQ ID NO: 281761 - protein, 5 aa, Mycobacterium
RPASA

SEQ ID NO: 281762 - protein, 8 aa, Mycobacterium
RPASESQP

SEQ ID NO: 281763 - protein, 7 aa, Mycobacterium
RPASHTG

SEQ ID NO: 281764 - protein, 8 aa, Mycobacterium
RPASQIRG

SEQ ID NO: 281765 - protein, 14 aa, Mycobacterium
RPATATSEEPGRYA

SEQ ID NO: 281766 - protein, 6 aa, Mycobacterium
RPATPR

SEQ ID NO: 281767 - protein, 5 aa, Mycobacterium
RPATV

SEQ ID NO: 281768 - protein, 17 aa, Mycobacterium
RPAVTDPPGPASPPGKI

SEQ ID NO: 281769 - protein, 4 aa, Mycobacterium
RPDA

SEQ ID NO: 281770 - protein, 10 aa, Mycobacterium
RPDAPNGVDE

SEQ ID NO: 281771 - protein, 20 aa, Mycobacterium
RPDATQPADSSLVSKIHTGA

SEQ ID NO: 281772 - protein, 20 aa, Mycobacterium
RPDAVSGPLRPHGPAATRRR

SEQ ID NO: 281773 - protein, 12 aa, Mycobacterium
RPDAYTAADKLT

SEQ ID NO: 281774 - protein, 12 aa, Mycobacterium
RPDCTYDTDGAS

SEQ ID NO: 281775 - protein, 4 aa, Mycobacterium
RPDD

SEQ ID NO: 281776 - protein, 15 aa, Mycobacterium
RPDDEVDTAATQVGA

SEQ ID NO: 281777 - protein, 9 aa, Mycobacterium
RPDDPTTLL

SEQ ID NO: 281778 - protein, 20 aa, Mycobacterium
RPDEPPQLHPRRDTRLRAGD

SEQ ID NO: 281779 - protein, 9 aa, Mycobacterium
RPDERLGET

SEQ ID NO: 281780 - protein, 4 aa, Mycobacterium
RPDG

SEQ ID NO: 281781 - protein, 8 aa, Mycobacterium
RPDGAEPE

SEQ ID NO: 281782 - protein, 5 aa, Mycobacterium
RPDGL

SEQ ID NO: 281783 - protein, 6 aa, Mycobacterium
RPDGLR

SEQ ID NO: 281784 - protein, 23 aa, Mycobacterium
RPDGLSDLTARGPHTADAAPGGP

SEQ ID NO: 281785 - protein, 19 aa, Mycobacterium
RPDGNLAGEISKTSANGCG

SEQ ID NO: 281786 - protein, 7 aa, Mycobacterium
RPDGTYQ

SEQ ID NO: 281787 - protein, 6 aa, Mycobacterium
RPDGYD

SEQ ID NO: 281788 - protein, 10 aa, Mycobacterium
RPDGYDIDGE

SEQ ID NO: 281789 - protein, 9 aa, Mycobacterium
RPDHSAGSR

SEQ ID NO: 281790 - protein, 11 aa, Mycobacterium
RPDKQTDASVA

SEQ ID NO: 281791 - protein, 11 aa, Mycobacterium
RPDLPPQDATA

SEQ ID NO: 281792 - protein, 7 aa, Mycobacterium
RPDLPRG

SEQ ID NO: 281793 - protein, 9 aa, Mycobacterium
RPDLTPTSD

SEQ ID NO: 281794 - protein, 8 aa, Mycobacterium
RPDNPRTL

SEQ ID NO: 281795 - protein, 11 aa, Mycobacterium
RPDPDSTSGAA

SEQ ID NO: 281796 - protein, 17 aa, Mycobacterium
RPDPRQTTAAPAEAPQW

SEQ ID NO: 281797 - protein, 11 aa, Mycobacterium
RPDPSDNRREM

SEQ ID NO: 281798 - protein, 9 aa, Mycobacterium
RPDPVAKPV

SEQ ID NO: 281799 - protein, 9 aa, Mycobacterium
RPDQQVDPA

SEQ ID NO: 281800 - protein, 11 aa, Mycobacterium
RPDQQVGPSVA

SEQ ID NO: 281801 - protein, 8 aa, Mycobacterium
RPDQRRKQ

SEQ ID NO: 281802 - protein, 4 aa, Mycobacterium
RPDR

SEQ ID NO: 281803 - protein, 11 aa, Mycobacterium
RPDRETDPAAA

SEQ ID NO: 281804 - protein, 6 aa, Mycobacterium
RPDRNP

SEQ ID NO: 281805 - protein, 16 aa, Mycobacterium
RPDRTPGRPNLVRNAE

SEQ ID NO: 281806 - protein, 4 aa, Mycobacterium
RPDS

SEQ ID NO: 281807 - protein, 36 aa, Mycobacterium
RPDSTPKADTTTSVPTTKPTTPSSPATTTPAGDPQS

SEQ ID NO: 281808 - protein, 7 aa, Mycobacterium
RPDSYPL

SEQ ID NO: 281809 - protein, 18 aa, Mycobacterium
RPDTAERDLGAARDRLTG

SEQ ID NO: 281810 - protein, 12 aa, Mycobacterium
RPDTDTHETAGQ

SEQ ID NO: 281811 - protein, 5 aa, Mycobacterium
RPDTI

SEQ ID NO: 281812 - protein, 6 aa, Mycobacterium
RPDTPH

SEQ ID NO: 281813 - protein, 7 aa, Mycobacterium
RPDTSGT

SEQ ID NO: 281814 - protein, 7 aa, Mycobacterium
RPDTTWA

SEQ ID NO: 281815 - protein, 6 aa, Mycobacterium
RPDVDP

SEQ ID NO: 281816 - protein, 7 aa, Mycobacterium
RPDWARP

SEQ ID NO: 281817 - protein, 12 aa, Mycobacterium
RPEAIGTPIPGG

SEQ ID NO: 281818 - protein, 8 aa, Mycobacterium
RPEATAET

SEQ ID NO: 281819 - protein, 8 aa, Mycobacterium
RPEATSAT

SEQ ID NO: 281820 - protein, 11 aa, Mycobacterium
RPEDADGVDSG

SEQ ID NO: 281821 - protein, 6 aa, Mycobacterium
RPEDKA

SEQ ID NO: 281822 - protein, 9 aa, Mycobacterium
RPEDLDAGG

SEQ ID NO: 281823 - protein, 25 aa, Mycobacterium
RPEDLDGSANGQSTDGSPAETAFQQ

SEQ ID NO: 281824 - protein, 11 aa, Mycobacterium
RPEFASTTTDL

SEQ ID NO: 281825 - protein, 7 aa, Mycobacterium
RPEFGTP

SEQ ID NO: 281826 - protein, 6 aa, Mycobacterium
RPEGAR

SEQ ID NO: 281827 - protein, 12 aa, Mycobacterium
RPEGSSDSLQRH

SEQ ID NO: 281828 - protein, 4 aa, Mycobacterium
RPEH

SEQ ID NO: 281829 - protein, 6 aa, Mycobacterium
RPEHDG

SEQ ID NO: 281830 - protein, 4 aa, Mycobacterium
RPEI

SEQ ID NO: 281831 - protein, 12 aa, Mycobacterium
RPEIDQRPTPKT

SEQ ID NO: 281832 - protein, 9 aa, Mycobacterium
RPEIGSTTT

SEQ ID NO: 281833 - protein, 4 aa, Mycobacterium
RPEL

SEQ ID NO: 281834 - protein, 7 aa, Mycobacterium
RPELGTP

SEQ ID NO: 281835 - protein, 6 aa, Mycobacterium
RPELST

SEQ ID NO: 281836 - protein, 5 aa, Mycobacterium
RPELT

SEQ ID NO: 281837 - protein, 11 aa, Mycobacterium
RPENVADGEDI

SEQ ID NO: 281838 - protein, 4 aa, Mycobacterium
RPEP

SEQ ID NO: 281839 - protein, 8 aa, Mycobacterium
RPEPAHKP

SEQ ID NO: 281840 - protein, 13 aa, Mycobacterium
RPEPAPKPPAQQV

SEQ ID NO: 281841 - protein, 9 aa, Mycobacterium
RPEPAPKPV

SEQ ID NO: 281842 - protein, 10 aa, Mycobacterium
RPEPEPKPVE

SEQ ID NO: 281843 - protein, 9 aa, Mycobacterium
RPEPPPRPV

SEQ ID NO: 281844 - protein, 8 aa, Mycobacterium
RPEPQHKP

SEQ ID NO: 281845 - protein, 8 aa, Mycobacterium
RPEPVAKD

SEQ ID NO: 281846 - protein, 6 aa, Mycobacterium
RPEPVH

SEQ ID NO: 281847 - protein, 6 aa, Mycobacterium
RPEQRP

SEQ ID NO: 281848 - protein, 8 aa, Mycobacterium
RPERDPEA

SEQ ID NO: 281849 - protein, 8 aa, Mycobacterium
RPERHGGI

SEQ ID NO: 281850 - protein, 6 aa, Mycobacterium
RPESLN

SEQ ID NO: 281851 - protein, 6 aa, Mycobacterium
RPESVG

SEQ ID NO: 281852 - protein, 26 aa, Mycobacterium
RPESWDAKPKERRDLRRDQRRDQRRA

SEQ ID NO: 281853 - protein, 5 aa, Mycobacterium
RPETN

SEQ ID NO: 281854 - protein, 19 aa, Mycobacterium
RPEVESKDRSGGYTASSGI

SEQ ID NO: 281855 - protein, 11 aa, Mycobacterium
RPEYGPLADPV

SEQ ID NO: 281856 - protein, 5 aa, Mycobacterium
RPFGG

SEQ ID NO: 281857 - protein, 9 aa, Mycobacterium
RPFGTEGSR

SEQ ID NO: 281858 - protein, 5 aa, Mycobacterium
RPFPE

SEQ ID NO: 281859 - protein, 4 aa, Mycobacterium
RPFT

SEQ ID NO: 281860 - protein, 8 aa, Mycobacterium
RPGAAPSS

SEQ ID NO: 281861 - protein, 10 aa, Mycobacterium
RPGAASAAVQ

SEQ ID NO: 281862 - protein, 6 aa, Mycobacterium
RPGADW

SEQ ID NO: 281863 - protein, 29 aa, Mycobacterium
RPGAEGPFAPAAPATPTAEGQQPPASQGV

SEQ ID NO: 281864 - protein, 11 aa, Mycobacterium
RPGAGTEDPAL

SEQ ID NO: 281865 - protein, 8 aa, Mycobacterium
RPGAPPIK

SEQ ID NO: 281866 - protein, 7 aa, Mycobacterium
RPGATAL

SEQ ID NO: 281867 - protein, 7 aa, Mycobacterium
RPGATAT

SEQ ID NO: 281868 - protein, 20 aa, Mycobacterium
RPGATEPSDPALLTKIHSSS

SEQ ID NO: 281869 - protein, 20 aa, Mycobacterium
RPGATEPSDPTLLAKIHASS

SEQ ID NO: 281870 - protein, 20 aa, Mycobacterium
RPGATEPTDPTLVAKIHASS

SEQ ID NO: 281871 - protein, 20 aa, Mycobacterium
RPGATQPPDPTLIAKIHASS

SEQ ID NO: 281872 - protein, 9 aa, Mycobacterium
RPGCADSPV

SEQ ID NO: 281873 - protein, 7 aa, Mycobacterium
RPGCPTS

SEQ ID NO: 281874 - protein, 10 aa, Mycobacterium
RPGDAPPPSW

SEQ ID NO: 281875 - protein, 6 aa, Mycobacterium
RPGDER

SEQ ID NO: 281876 - protein, 8 aa, Mycobacterium
RPGDIRTN

SEQ ID NO: 281877 - protein, 9 aa, Mycobacterium
RPGDIRTNQ

SEQ ID NO: 281878 - protein, 16 aa, Mycobacterium
RPGDLGVREPAGEDVT

SEQ ID NO: 281879 - protein, 16 aa, Mycobacterium
RPGEEIPQTKEETRKR

SEQ ID NO: 281880 - protein, 9 aa, Mycobacterium
RPGEKVPVD

SEQ ID NO: 281881 - protein, 16 aa, Mycobacterium
RPGESPESTPGRPASA

SEQ ID NO: 281882 - protein, 7 aa, Mycobacterium
RPGETIA

SEQ ID NO: 281883 - protein, 20 aa, Mycobacterium
RPGGDYVTDGDGLSDCDGHG

SEQ ID NO: 281884 - protein, 6 aa, Mycobacterium
RPGGGQ

SEQ ID NO: 281885 - protein, 7 aa, Mycobacterium
RPGGGQL

SEQ ID NO: 281886 - protein, 8 aa, Mycobacterium
RPGGLTLP

SEQ ID NO: 281887 - protein, 9 aa, Mycobacterium
RPGGPAGEY

SEQ ID NO: 281888 - protein, 8 aa, Mycobacterium
RPGGPGPL

SEQ ID NO: 281889 - protein, 6 aa, Mycobacterium
RPGGRI

SEQ ID NO: 281890 - protein, 7 aa, Mycobacterium
RPGGTAL

SEQ ID NO: 281891 - protein, 11 aa, Mycobacterium
RPGHPAPEAQP

SEQ ID NO: 281892 - protein, 10 aa, Mycobacterium
RPGIADPERP

SEQ ID NO: 281893 - protein, 9 aa, Mycobacterium
RPGIAPGFT

SEQ ID NO: 281894 - protein, 12 aa, Mycobacterium
RPGIATQTATAG

SEQ ID NO: 281895 - protein, 20 aa, Mycobacterium
RPGKPGRREVTAADGSSGRY

SEQ ID NO: 281896 - protein, 8 aa, Mycobacterium
RPGKPTAQ

SEQ ID NO: 281897 - protein, 4 aa, Mycobacterium
RPGL

SEQ ID NO: 281898 - protein, 5 aa, Mycobacterium
RPGLA

SEQ ID NO: 281899 - protein, 9 aa, Mycobacterium
RPGLAPGFT

SEQ ID NO: 281900 - protein, 25 aa, Mycobacterium
RPGLPQGDPHGRADTRPAGGSSANA

SEQ ID NO: 281901 - protein, 19 aa, Mycobacterium
RPGLSTELDPASATPMTGH

SEQ ID NO: 281902 - protein, 6 aa, Mycobacterium
RPGNHD

SEQ ID NO: 281903 - protein, 7 aa, Mycobacterium
RPGPEQG

SEQ ID NO: 281904 - protein, 9 aa, Mycobacterium
RPGPGEEAT

SEQ ID NO: 281905 - protein, 7 aa, Mycobacterium
RPGPGPL

SEQ ID NO: 281906 - protein, 9 aa, Mycobacterium
RPGPNRAGP

SEQ ID NO: 281907 - protein, 11 aa, Mycobacterium
RPGPNRVGPHG

SEQ ID NO: 281908 - protein, 16 aa, Mycobacterium
RPGPNRVGPKGSLQSL

SEQ ID NO: 281909 - protein, 6 aa, Mycobacterium
RPGPQL

SEQ ID NO: 281910 - protein, 5 aa, Mycobacterium
RPGPT

SEQ ID NO: 281911 - protein, 5 aa, Mycobacterium
RPGQP

SEQ ID NO: 281912 - protein, 8 aa, Mycobacterium
RPGQPPLQ

SEQ ID NO: 281913 - protein, 7 aa, Mycobacterium
RPGQTIA

SEQ ID NO: 281914 - protein, 5 aa, Mycobacterium
RPGQV

SEQ ID NO: 281915 - protein, 4 aa, Mycobacterium
RPGR

SEQ ID NO: 281916 - protein, 8 aa, Mycobacterium
RPGRAERY

SEQ ID NO: 281917 - protein, 7 aa, Mycobacterium
RPGRATA

SEQ ID NO: 281918 - protein, 6 aa, Mycobacterium
RPGREP

SEQ ID NO: 281919 - protein, 12 aa, Mycobacterium
RPGRGGADIQPG

SEQ ID NO: 281920 - protein, 7 aa, Mycobacterium
RPGRGPS

SEQ ID NO: 281921 - protein, 9 aa, Mycobacterium
RPGRGSTAT

SEQ ID NO: 281922 - protein, 6 aa, Mycobacterium
RPGRNP

SEQ ID NO: 281923 - protein, 7 aa, Mycobacterium
RPGRPTA

SEQ ID NO: 281924 - protein, 8 aa, Mycobacterium
RPGRPTAD

SEQ ID NO: 281925 - protein, 7 aa, Mycobacterium
RPGRTGL

SEQ ID NO: 281926 - protein, 4 aa, Mycobacterium
RPGS

SEQ ID NO: 281927 - protein, 12 aa, Mycobacterium
RPGSPSSERGHK

SEQ ID NO: 281928 - protein, 6 aa, Mycobacterium
RPGSQV

SEQ ID NO: 281929 - protein, 5 aa, Mycobacterium
RPGSV

SEQ ID NO: 281930 - protein, 5 aa, Mycobacterium
RPGTA

SEQ ID NO: 281931 - protein, 32 aa, Mycobacterium
RPGTAEHTVTPDGPAPSNDGGGPAPNPVDEVP

SEQ ID NO: 281932 - protein, 12 aa, Mycobacterium
RPGTDGTPRHPL

SEQ ID NO: 281933 - protein, 12 aa, Mycobacterium
RPGTLAPPSSAF

SEQ ID NO: 281934 - protein, 5 aa, Mycobacterium
RPGTN

SEQ ID NO: 281935 - protein, 11 aa, Mycobacterium
RPGTPGPVDPA

SEQ ID NO: 281936 - protein, 6 aa, Mycobacterium
RPGTPH

SEQ ID NO: 281937 - protein, 7 aa, Mycobacterium
RPGTTGA

SEQ ID NO: 281938 - protein, 7 aa, Mycobacterium
RPGTTTA

SEQ ID NO: 281939 - protein, 9 aa, Mycobacterium
RPGVGPGLP

SEQ ID NO: 281940 - protein, 9 aa, Mycobacterium
RPGVNGSTV

SEQ ID NO: 281941 - protein, 5 aa, Mycobacterium
RPGVT

SEQ ID NO: 281942 - protein, 5 aa, Mycobacterium
RPGYD

SEQ ID NO: 281943 - protein, 9 aa, Mycobacterium
RPHAGESLK

SEQ ID NO: 281944 - protein, 13 aa, Mycobacterium
RPHEPSKRETGTA

SEQ ID NO: 281945 - protein, 11 aa, Mycobacterium
RPHEPTRRETA

SEQ ID NO: 281946 - protein, 8 aa, Mycobacterium
RPHGATPA

SEQ ID NO: 281947 - protein, 8 aa, Mycobacterium
RPHGPGTL

SEQ ID NO: 281948 - protein, 19 aa, Mycobacterium
RPHPAARPVPPPAPGPIPA

SEQ ID NO: 281949 - protein, 54 aa, Mycobacterium
RPHPRRPRSGRRRTPPGGRPALPSEAETAQFRTPEAGHDAPTTVLSGPGPSPRI

SEQ ID NO: 281950 - protein, 11 aa, Mycobacterium
RPIDDSNGGSV

SEQ ID NO: 281951 - protein, 7 aa, Mycobacterium
RPKCPPQ

SEQ ID NO: 281952 - protein, 8 aa, Mycobacterium
RPKPGQRP

SEQ ID NO: 281953 - protein, 14 aa, Mycobacterium
RPKQPGPPRGRQDP

SEQ ID NO: 281954 - protein, 10 aa, Mycobacterium
RPKTNSPPYL

SEQ ID NO: 281955 - protein, 7 aa, Mycobacterium
RPKVERY

SEQ ID NO: 281956 - protein, 14 aa, Mycobacterium
RPKVGASAKPKSMG

SEQ ID NO: 281957 - protein, 22 aa, Mycobacterium
RPLAGDRAETRYDDRVDAPADT

SEQ ID NO: 281958 - protein, 6 aa, Mycobacterium
RPLAGE

SEQ ID NO: 281959 - protein, 6 aa, Mycobacterium
RPLDDA

SEQ ID NO: 281960 - protein, 10 aa, Mycobacterium
RPLDDGDHRY

SEQ ID NO: 281961 - protein, 10 aa, Mycobacterium
RPLDGSDHQY

SEQ ID NO: 281962 - protein, 5 aa, Mycobacterium
RPLEP

SEQ ID NO: 281963 - protein, 5 aa, Mycobacterium
RPLES

SEQ ID NO: 281964 - protein, 6 aa, Mycobacterium
RPLESY

SEQ ID NO: 281965 - protein, 8 aa, Mycobacterium
RPLGDQDH

SEQ ID NO: 281966 - protein, 25 aa, Mycobacterium
RPLGEQDPGLAGRPTGPSGSEQSAH

SEQ ID NO: 281967 - protein, 9 aa, Mycobacterium
RPLGEVPPE

SEQ ID NO: 281968 - protein, 8 aa, Mycobacterium
RPLGSPIE

SEQ ID NO: 281969 - protein, 8 aa, Mycobacterium
RPLGSPLD

SEQ ID NO: 281970 - protein, 8 aa, Mycobacterium
RPLGSTVD

SEQ ID NO: 281971 - protein, 7 aa, Mycobacterium
RPLGTPI

SEQ ID NO: 281972 - protein, 8 aa, Mycobacterium
RPLGTPIT

SEQ ID NO: 281973 - protein, 7 aa, Mycobacterium
RPLGTPL

SEQ ID NO: 281974 - protein, 8 aa, Mycobacterium
RPLGTPLD

SEQ ID NO: 281975 - protein, 11 aa, Mycobacterium
RPLLDGQAASV

SEQ ID NO: 281976 - protein, 13 aa, Mycobacterium
RPLNDDDVYEPGE

SEQ ID NO: 281977 - protein, 40 aa, Mycobacterium
RPLPPATYSATEPEAGQVDAATEAGGPAAGDEANSGESAN

SEQ ID NO: 281978 - protein, 6 aa, Mycobacterium
RPLPPI

SEQ ID NO: 281979 - protein, 6 aa, Mycobacterium
RPLPPL

SEQ ID NO: 281980 - protein, 38 aa, Mycobacterium
RPLPPPRTPQPDTTPPPPAPAPVGAGPDPATTEFPRAS

SEQ ID NO: 281981 - protein, 38 aa, Mycobacterium
RPLPPPRTTVAADPTPPPVPVGPGHGDDPITTEFPRPS

SEQ ID NO: 281982 - protein, 10 aa, Mycobacterium
RPLPPSGTPR

SEQ ID NO: 281983 - protein, 9 aa, Mycobacterium
RPLPTPAGR

SEQ ID NO: 281984 - protein, 4 aa, Mycobacterium
RPLS

SEQ ID NO: 281985 - protein, 8 aa, Mycobacterium
RPLTSGVS

SEQ ID NO: 281986 - protein, 17 aa, Mycobacterium
RPMNAPAPVPAAPPRPV

SEQ ID NO: 281987 - protein, 35 aa, Mycobacterium
RPMPDSAYPAAPDDKKTEPVDTRGANGANSRGSAN

SEQ ID NO: 281988 - protein, 39 aa, Mycobacterium
RPMPGATYPATPADTGARAEAAHSDEGAGDSTNSRSSTN

SEQ ID NO: 281989 - protein, 6 aa, Mycobacterium
RPMPKR

SEQ ID NO: 281990 - protein, 38 aa, Mycobacterium
RPMPPSAYPAPPAGYTDEESEATGPVATDQPNSREPSN

SEQ ID NO: 281991 - protein, 12 aa, Mycobacterium
RPNAAQKESEYI

SEQ ID NO: 281992 - protein, 18 aa, Mycobacterium
RPNAGSVDDATSEQRSGS

SEQ ID NO: 281993 - protein, 5 aa, Mycobacterium
RPNEA

SEQ ID NO: 281994 - protein, 4 aa, Mycobacterium
RPNP

SEQ ID NO: 281995 - protein, 5 aa, Mycobacterium
RPNPG

SEQ ID NO: 281996 - protein, 6 aa, Mycobacterium
RPNPGI

SEQ ID NO: 281997 - protein, 7 aa, Mycobacterium
RPNRDLD

SEQ ID NO: 281998 - protein, 5 aa, Mycobacterium
RPNSQ

SEQ ID NO: 281999 - protein, 5 aa, Mycobacterium
RPNSR

SEQ ID NO: 282000 - protein, 4 aa, Mycobacterium
RPNT

SEQ ID NO: 282001 - protein, 4 aa, Mycobacterium
RPPA

SEQ ID NO: 282002 - protein, 12 aa, Mycobacterium
RPPAASPAPPAP

SEQ ID NO: 282003 - protein, 17 aa, Mycobacterium
RPPAEPPSPAESPSKET

SEQ ID NO: 282004 - protein, 9 aa, Mycobacterium
RPPAGAPTR

SEQ ID NO: 282005 - protein, 8 aa, Mycobacterium
RPPAGCPT

SEQ ID NO: 282006 - protein, 6 aa, Mycobacterium
RPPAGR

SEQ ID NO: 282007 - protein, 20 aa, Mycobacterium
RPPALPDEPVRGGYPGRPGW

SEQ ID NO: 282008 - protein, 7 aa, Mycobacterium
RPPAPLT

SEQ ID NO: 282009 - protein, 13 aa, Mycobacterium
RPPAQPASEHHER

SEQ ID NO: 282010 - protein, 29 aa, Mycobacterium
RPPARSFRRRDAGRTAPQPPADAGEFPTT

SEQ ID NO: 282011 - protein, 6 aa, Mycobacterium
RPPAVR

SEQ ID NO: 282012 - protein, 13 aa, Mycobacterium
RPPDAEDREAEHS

SEQ ID NO: 282013 - protein, 6 aa, Mycobacterium
RPPDIT

SEQ ID NO: 282014 - protein, 22 aa, Mycobacterium
RPPEEEDAHEGPDSSTHRRQPA

SEQ ID NO: 282015 - protein, 16 aa, Mycobacterium
RPPEIGLPSENPRLDQ

SEQ ID NO: 282016 - protein, 5 aa, Mycobacterium
RPPEV

SEQ ID NO: 282017 - protein, 17 aa, Mycobacterium
RPPEVGLPSENPRLDQP

SEQ ID NO: 282018 - protein, 8 aa, Mycobacterium
RPPGGRPI

SEQ ID NO: 282019 - protein, 15 aa, Mycobacterium
RPPGLEPRERPQSAR

SEQ ID NO: 282020 - protein, 7 aa, Mycobacterium
RPPGTEL

SEQ ID NO: 282021 - protein, 4 aa, Mycobacterium
RPPL

SEQ ID NO: 282022 - protein, 6 aa, Mycobacterium
RPPLGE

SEQ ID NO: 282023 - protein, 40 aa, Mycobacterium
RPPPVQARETDPRPAADPSSPAQPAPTPRPTPTHDAYADS

SEQ ID NO: 282024 - protein, 4 aa, Mycobacterium
RPPR

SEQ ID NO: 282025 - protein, 23 aa, Mycobacterium
RPPRAAARANQSNGGRTDTDRAQ

SEQ ID NO: 282026 - protein, 23 aa, Mycobacterium
RPPRAATRTNQSNSGRTDTARGQ

SEQ ID NO: 282027 - protein, 6 aa, Mycobacterium
RPPRRA

SEQ ID NO: 282028 - protein, 9 aa, Mycobacterium
RPPRRDTGN

SEQ ID NO: 282029 - protein, 29 aa, Mycobacterium
RPPSSEPAPAPDAAGSAPTGDSTAVPPLP

SEQ ID NO: 282030 - protein, 9 aa, Mycobacterium
RPPSTGEVR

SEQ ID NO: 282031 - protein, 13 aa, Mycobacterium
RPPTSGTVQRPGA

SEQ ID NO: 282032 - protein, 4 aa, Mycobacterium
RPPV

SEQ ID NO: 282033 - protein, 10 aa, Mycobacterium
RPPVGAPTRA

SEQ ID NO: 282034 - protein, 7 aa, Mycobacterium
RPPYEAG

SEQ ID NO: 282035 - protein, 4 aa, Mycobacterium
RPQD

SEQ ID NO: 282036 - protein, 8 aa, Mycobacterium
RPQDKAAA

SEQ ID NO: 282037 - protein, 13 aa, Mycobacterium
RPQDLSRNPATVG

SEQ ID NO: 282038 - protein, 6 aa, Mycobacterium
RPQDNP

SEQ ID NO: 282039 - protein, 4 aa, Mycobacterium
RPQG

SEQ ID NO: 282040 - protein, 21 aa, Mycobacterium
RPQGRLRPGQPARRPGRRGRR

SEQ ID NO: 282041 - protein, 5 aa, Mycobacterium
RPQGW

SEQ ID NO: 282042 - protein, 21 aa, Mycobacterium
RPQKYRDQAEFRPSDRPADPV

SEQ ID NO: 282043 - protein, 14 aa, Mycobacterium
RPQLADSETPRRDA

SEQ ID NO: 282044 - protein, 4 aa, Mycobacterium
RPQN

SEQ ID NO: 282045 - protein, 14 aa, Mycobacterium
RPQNQNYPARAGGA

SEQ ID NO: 282046 - protein, 27 aa, Mycobacterium
RPQNSTTREGVSQPTEPERSGSPESFA

SEQ ID NO: 282047 - protein, 6 aa, Mycobacterium
RPQPGV

SEQ ID NO: 282048 - protein, 58 aa, Mycobacterium
RPQRPTGKRSRQKAADAGEDADAASPDEIEASGKDKAKKGAKAKKAAKPKKSADSRAN

SEQ ID NO: 282049 - protein, 74 aa, Mycobacterium
RPQRPTGKRSRQRAVEADEDAEDTEPSTATEVSKKGSAKKDTKSAGKSAKTSAKKSVKAKKTTKAGRPAARSAN

SEQ ID NO: 282050 - protein, 5 aa, Mycobacterium
RPQSL

SEQ ID NO: 282051 - protein, 16 aa, Mycobacterium
RPQTREDVVDTIVRAR

SEQ ID NO: 282052 - protein, 21 aa, Mycobacterium
RPQYPPPPTPPPAGKRPGRRP

SEQ ID NO: 282053 - protein, 13 aa, Mycobacterium
RPRARPWPTLRSP

SEQ ID NO: 282054 - protein, 6 aa, Mycobacterium
RPRDAA

SEQ ID NO: 282055 - protein, 11 aa, Mycobacterium
RPRDAPTRTAV

SEQ ID NO: 282056 - protein, 9 aa, Mycobacterium
RPRDAPVRT

SEQ ID NO: 282057 - protein, 10 aa, Mycobacterium
RPRDAQPGDV

SEQ ID NO: 282058 - protein, 22 aa, Mycobacterium
RPRDDRATPAEALDNGKDFVPT

SEQ ID NO: 282059 - protein, 18 aa, Mycobacterium
RPRDDTDLRPQELPDWYS

SEQ ID NO: 282060 - protein, 5 aa, Mycobacterium
RPRDL

SEQ ID NO: 282061 - protein, 13 aa, Mycobacterium
RPRDQGTGGGLKP

SEQ ID NO: 282062 - protein, 10 aa, Mycobacterium
RPRDTNQQNE

SEQ ID NO: 282063 - protein, 10 aa, Mycobacterium
RPRDTQPGDV

SEQ ID NO: 282064 - protein, 15 aa, Mycobacterium
RPRDTWRGRAGPAGL

SEQ ID NO: 282065 - protein, 19 aa, Mycobacterium
RPRGERRRRAAGTRSTRDY

SEQ ID NO: 282066 - protein, 12 aa, Mycobacterium
RPRGSAALPGKT

SEQ ID NO: 282067 - protein, 24 aa, Mycobacterium
RPRPAPAGARTGRRDDPVPPAGPI

SEQ ID NO: 282068 - protein, 9 aa, Mycobacterium
RPRPEGSSK

SEQ ID NO: 282069 - protein, 7 aa, Mycobacterium
RPRPPSA

SEQ ID NO: 282070 - protein, 46 aa, Mycobacterium
RPRPRRNQFASGTREYTPSGTGAEQMSPDPLDDLDDGAPDTGLDSG

SEQ ID NO: 282071 - protein, 7 aa, Mycobacterium
RPRPSAP

SEQ ID NO: 282072 - protein, 11 aa, Mycobacterium
RPRPSPHHSAT

SEQ ID NO: 282073 - protein, 15 aa, Mycobacterium
RPRPVPETAPPPPEV

SEQ ID NO: 282074 - protein, 4 aa, Mycobacterium
RPRR

SEQ ID NO: 282075 - protein, 12 aa, Mycobacterium
RPRRDPAQPAEL

SEQ ID NO: 282076 - protein, 9 aa, Mycobacterium
RPRRPRSPV

SEQ ID NO: 282077 - protein, 8 aa, Mycobacterium
RPRRPSGA

SEQ ID NO: 282078 - protein, 12 aa, Mycobacterium
RPRSAPGADPER

SEQ ID NO: 282079 - protein, 15 aa, Mycobacterium
RPRSEAAAHAREAPA

SEQ ID NO: 282080 - protein, 12 aa, Mycobacterium
RPRSEYEEWKVA

SEQ ID NO: 282081 - protein, 8 aa, Mycobacterium
RPRSGKSV

SEQ ID NO: 282082 - protein, 14 aa, Mycobacterium
RPRSGSAERAREAP

SEQ ID NO: 282083 - protein, 5 aa, Mycobacterium
RPRSL

SEQ ID NO: 282084 - protein, 7 aa, Mycobacterium
RPRSRRW

SEQ ID NO: 282085 - protein, 11 aa, Mycobacterium
RPRTDDAPYLQ

SEQ ID NO: 282086 - protein, 11 aa, Mycobacterium
RPRTGPPSASA

SEQ ID NO: 282087 - protein, 7 aa, Mycobacterium
RPRTLPN

SEQ ID NO: 282088 - protein, 26 aa, Mycobacterium
RPRTMPAPGPVPPGQEGALPQGSAAT

SEQ ID NO: 282089 - protein, 10 aa, Mycobacterium
RPRTNSPPYL

SEQ ID NO: 282090 - protein, 10 aa, Mycobacterium
RPRTPSHPGA

SEQ ID NO: 282091 - protein, 11 aa, Mycobacterium
RPRTSAPSTAT

SEQ ID NO: 282092 - protein, 6 aa, Mycobacterium
RPRTWP

SEQ ID NO: 282093 - protein, 5 aa, Mycobacterium
RPRVV

SEQ ID NO: 282094 - protein, 20 aa, Mycobacterium
RPSADFGTADLSGDAGGTAD

SEQ ID NO: 282095 - protein, 7 aa, Mycobacterium
RPSAFSR

SEQ ID NO: 282096 - protein, 9 aa, Mycobacterium
RPSASPTVA

SEQ ID NO: 282097 - protein, 5 aa, Mycobacterium
RPSAT

SEQ ID NO: 282098 - protein, 6 aa, Mycobacterium
RPSDED

SEQ ID NO: 282099 - protein, 10 aa, Mycobacterium
RPSEQPPGRG

SEQ ID NO: 282100 - protein, 5 aa, Mycobacterium
RPSER

SEQ ID NO: 282101 - protein, 4 aa, Mycobacterium
RPSF

SEQ ID NO: 282102 - protein, 5 aa, Mycobacterium
RPSFA

SEQ ID NO: 282103 - protein, 7 aa, Mycobacterium
RPSGPRS

SEQ ID NO: 282104 - protein, 28 aa, Mycobacterium
RPSGQHPVAHGPTSTGSHTSHEAPPTAR

SEQ ID NO: 282105 - protein, 59 aa, Mycobacterium
RPSGSYSGQHGHHQAPNHHAQSSHHYQGQSYGYPSQQPQQRPAQQPQRQAQPKGRSSGG

SEQ ID NO: 282106 - protein, 6 aa, Mycobacterium
RPSPLA

SEQ ID NO: 282107 - protein, 6 aa, Mycobacterium
RPSPNE

SEQ ID NO: 282108 - protein, 9 aa, Mycobacterium
RPSPPTTVA

SEQ ID NO: 282109 - protein, 5 aa, Mycobacterium
RPSPR

SEQ ID NO: 282110 - protein, 6 aa, Mycobacterium
RPSQAA

SEQ ID NO: 282111 - protein, 8 aa, Mycobacterium
RPSQATGV

SEQ ID NO: 282112 - protein, 11 aa, Mycobacterium
RPSQQTGVPYP

SEQ ID NO: 282113 - protein, 4 aa, Mycobacterium
RPSR

SEQ ID NO: 282114 - protein, 23 aa, Mycobacterium
RPSRSGAIQKPAGSQTIGRATDN

SEQ ID NO: 282115 - protein, 15 aa, Mycobacterium
RPSRSGGLQKPSGAL

SEQ ID NO: 282116 - protein, 13 aa, Mycobacterium
RPSRTEALAPVST

SEQ ID NO: 282117 - protein, 5 aa, Mycobacterium
RPSSV

SEQ ID NO: 282118 - protein, 10 aa, Mycobacterium
RPSTFGDDRS

SEQ ID NO: 282119 - protein, 52 aa, Mycobacterium
RPSTGVPAVAQGDPAPKAPAGSAAGRCVSGPPQFAGGGDDGTPGGAADFAPS

SEQ ID NO: 282120 - protein, 7 aa, Mycobacterium
RPSTHAR

SEQ ID NO: 282121 - protein, 16 aa, Mycobacterium
RPSTLDPAVDPEGAAD

SEQ ID NO: 282122 - protein, 23 aa, Mycobacterium
RPSVAGNGYDPLSSGASNLEPES

SEQ ID NO: 282123 - protein, 5 aa, Mycobacterium
RPSWQ

SEQ ID NO: 282124 - protein, 13 aa, Mycobacterium
RPTADQRPSPAQA

SEQ ID NO: 282125 - protein, 8 aa, Mycobacterium
RPTDVREA

SEQ ID NO: 282126 - protein, 7 aa, Mycobacterium
RPTEPLP

SEQ ID NO: 282127 - protein, 12 aa, Mycobacterium
RPTETASPRRPG

SEQ ID NO: 282128 - protein, 5 aa, Mycobacterium
RPTEV

SEQ ID NO: 282129 - protein, 6 aa, Mycobacterium
RPTFSN

SEQ ID NO: 282130 - protein, 6 aa, Mycobacterium
RPTGHP

SEQ ID NO: 282131 - protein, 5 aa, Mycobacterium
RPTGN

SEQ ID NO: 282132 - protein, 14 aa, Mycobacterium
RPTGPRPAVRALLG

SEQ ID NO: 282133 - protein, 17 aa, Mycobacterium
RPTGPRPLVRSLLLKQS

SEQ ID NO: 282134 - protein, 6 aa, Mycobacterium
RPTHEQ

SEQ ID NO: 282135 - protein, 7 aa, Mycobacterium
RPTHEQV

SEQ ID NO: 282136 - protein, 12 aa, Mycobacterium
RPTPAGPAAPGI

SEQ ID NO: 282137 - protein, 8 aa, Mycobacterium
RPTPGFPA

SEQ ID NO: 282138 - protein, 18 aa, Mycobacterium
RPTPPAPGEAQTAPGHKE

SEQ ID NO: 282139 - protein, 25 aa, Mycobacterium
RPTPPPLPTGASPPPSTDGSHGGGR

SEQ ID NO: 282140 - protein, 7 aa, Mycobacterium
RPTRGSR

SEQ ID NO: 282141 - protein, 7 aa, Mycobacterium
RPTRGST

SEQ ID NO: 282142 - protein, 53 aa, Mycobacterium
RPTRRRSGPAGEADQSDAPQDEADDSGAASRNESEDDLQTATGTPPEAGGHHS

SEQ ID NO: 282143 - protein, 12 aa, Mycobacterium
RPTSAGGGVTAD

SEQ ID NO: 282144 - protein, 19 aa, Mycobacterium
RPTSGPSGSSGALPATTTT

SEQ ID NO: 282145 - protein, 5 aa, Mycobacterium
RPTSP

SEQ ID NO: 282146 - protein, 20 aa, Mycobacterium
RPTSTAASVSDSQPHSEPAR

SEQ ID NO: 282147 - protein, 22 aa, Mycobacterium
RPTSTLNSVREASTFPLSDYVI

SEQ ID NO: 282148 - protein, 6 aa, Mycobacterium
RPTTPH

SEQ ID NO: 282149 - protein, 5 aa, Mycobacterium
RPTVE

SEQ ID NO: 282150 - protein, 5 aa, Mycobacterium
RPVDA

SEQ ID NO: 282151 - protein, 6 aa, Mycobacterium
RPVDPT

SEQ ID NO: 282152 - protein, 11 aa, Mycobacterium
RPVEQPPGDAT

SEQ ID NO: 282153 - protein, 9 aa, Mycobacterium
RPVGGADSL

SEQ ID NO: 282154 - protein, 12 aa, Mycobacterium
RPVGSPESLQRH

SEQ ID NO: 282155 - protein, 30 aa, Mycobacterium
RPVNTAPSSPRTPAAVSADPDATGPILSGV

SEQ ID NO: 282156 - protein, 5 aa, Mycobacterium
RPVPA

SEQ ID NO: 282157 - protein, 12 aa, Mycobacterium
RPVPADVPPGSA

SEQ ID NO: 282158 - protein, 14 aa, Mycobacterium
RPVPAPAGPVERHG

SEQ ID NO: 282159 - protein, 11 aa, Mycobacterium
RPVPAQPCRDQ

SEQ ID NO: 282160 - protein, 16 aa, Mycobacterium
RPVPATPTSRAESLPQ

SEQ ID NO: 282161 - protein, 7 aa, Mycobacterium
RPVPDGA

SEQ ID NO: 282162 - protein, 20 aa, Mycobacterium
RPVPPLDSSITEQPEPAPAA

SEQ ID NO: 282163 - protein, 26 aa, Mycobacterium
RPVPPSSLPLPPPSPPALRDNRGGRG

SEQ ID NO: 282164 - protein, 5 aa, Mycobacterium
RPVPT

SEQ ID NO: 282165 - protein, 9 aa, Mycobacterium
RPVPTARAA

SEQ ID NO: 282166 - protein, 16 aa, Mycobacterium
RPVRDVSEDPSPVSVS

SEQ ID NO: 282167 - protein, 4 aa, Mycobacterium
RPVS

SEQ ID NO: 282168 - protein, 7 aa, Mycobacterium
RPVSDQV

SEQ ID NO: 282169 - protein, 11 aa, Mycobacterium
RPVSPPADPEH

SEQ ID NO: 282170 - protein, 4 aa, Mycobacterium
RPVT

SEQ ID NO: 282171 - protein, 19 aa, Mycobacterium
RPVTGSAAGEQNAQRPQAG

SEQ ID NO: 282172 - protein, 9 aa, Mycobacterium
RPVTPDGRP

SEQ ID NO: 282173 - protein, 12 aa, Mycobacterium
RPVVTRASGPAL

SEQ ID NO: 282174 - protein, 11 aa, Mycobacterium
RPWIGGSPSNS

SEQ ID NO: 282175 - protein, 4 aa, Mycobacterium
RPWN

SEQ ID NO: 282176 - protein, 13 aa, Mycobacterium
RPWPETGRARRAG

SEQ ID NO: 282177 - protein, 15 aa, Mycobacterium
RPWTERDRANLAGRK

SEQ ID NO: 282178 - protein, 11 aa, Mycobacterium
RPYIGGSTDNS

SEQ ID NO: 282179 - protein, 13 aa, Mycobacterium
RPYNENDVYEPGD

SEQ ID NO: 282180 - protein, 43 aa, Mycobacterium
RPYQGGDSLQRHPTDAGALDAERDGDDADQDDPWRNPGAPVAL

SEQ ID NO: 282181 - protein, 4 aa, Mycobacterium
RPYR

SEQ ID NO: 282182 - protein, 6 aa, Mycobacterium
RPYSGT

SEQ ID NO: 282183 - protein, 6 aa, Mycobacterium
RPYSSS

SEQ ID NO: 282184 - protein, 22 aa, Mycobacterium
RPYTDPNAGLNRHEAGAPTRIP

SEQ ID NO: 282185 - protein, 4 aa, Mycobacterium
RQAA

SEQ ID NO: 282186 - protein, 20 aa, Mycobacterium
RQAAERTQTPARPVDAPTEK

SEQ ID NO: 282187 - protein, 9 aa, Mycobacterium
RQAAGEELT

SEQ ID NO: 282188 - protein, 8 aa, Mycobacterium
RQADPQLR

SEQ ID NO: 282189 - protein, 7 aa, Mycobacterium
RQAGARV

SEQ ID NO: 282190 - protein, 5 aa, Mycobacterium
RQAGG

SEQ ID NO: 282191 - protein, 8 aa, Mycobacterium
RQAGPGAG

SEQ ID NO: 282192 - protein, 12 aa, Mycobacterium
RQAKSGTARSGA

SEQ ID NO: 282193 - protein, 4 aa, Mycobacterium
RQAL

SEQ ID NO: 282194 - protein, 16 aa, Mycobacterium
RQALASRGSGVGGADR

SEQ ID NO: 282195 - protein, 8 aa, Mycobacterium
RQANGEPG

SEQ ID NO: 282196 - protein, 4 aa, Mycobacterium
RQAP

SEQ ID NO: 282197 - protein, 29 aa, Mycobacterium
RQAPEKIRPATSTRQAKARAKARKAKAPK

SEQ ID NO: 282198 - protein, 6 aa, Mycobacterium
RQAPRH

SEQ ID NO: 282199 - protein, 7 aa, Mycobacterium
RQAPRTV

SEQ ID NO: 282200 - protein, 8 aa, Mycobacterium
RQAREDRR

SEQ ID NO: 282201 - protein, 16 aa, Mycobacterium
RQATPRGRGPAPSQRV

SEQ ID NO: 282202 - protein, 21 aa, Mycobacterium
RQATPTVPAPVAPAPAPAPGV

SEQ ID NO: 282203 - protein, 10 aa, Mycobacterium
RQATSTPHAT

SEQ ID NO: 282204 - protein, 9 aa, Mycobacterium
RQAVSGDLG

SEQ ID NO: 282205 - protein, 6 aa, Mycobacterium
RQCDGR

SEQ ID NO: 282206 - protein, 19 aa, Mycobacterium
RQDDPQSATTDRFPAASPH

SEQ ID NO: 282207 - protein, 10 aa, Mycobacterium
RQDGELPPTR

SEQ ID NO: 282208 - protein, 11 aa, Mycobacterium
RQDGKSNAEAL

SEQ ID NO: 282209 - protein, 5 aa, Mycobacterium
RQDGR

SEQ ID NO: 282210 - protein, 13 aa, Mycobacterium
RQDKQAATRTFDT

SEQ ID NO: 282211 - protein, 4 aa, Mycobacterium
RQDL

SEQ ID NO: 282212 - protein, 10 aa, Mycobacterium
RQDNRLDEGI

SEQ ID NO: 282213 - protein, 8 aa, Mycobacterium
RQDPQYAQ

SEQ ID NO: 282214 - protein, 4 aa, Mycobacterium
RQDR

SEQ ID NO: 282215 - protein, 6 aa, Mycobacterium
RQDRAP

SEQ ID NO: 282216 - protein, 6 aa, Mycobacterium
RQDRLG

SEQ ID NO: 282217 - protein, 10 aa, Mycobacterium
RQDRPESQAL

SEQ ID NO: 282218 - protein, 23 aa, Mycobacterium
RQDRQVAARQDRHADSSYADDDL

SEQ ID NO: 282219 - protein, 24 aa, Mycobacterium
RQDRRVAAREDRHADSNYADDDLD

SEQ ID NO: 282220 - protein, 10 aa, Mycobacterium
RQDSEPPRRH

SEQ ID NO: 282221 - protein, 4 aa, Mycobacterium
RQDT

SEQ ID NO: 282222 - protein, 5 aa, Mycobacterium
RQEAD

SEQ ID NO: 282223 - protein, 4 aa, Mycobacterium
RQED

SEQ ID NO: 282224 - protein, 6 aa, Mycobacterium
RQEDTM

SEQ ID NO: 282225 - protein, 7 aa, Mycobacterium
RQEFRPT

SEQ ID NO: 282226 - protein, 19 aa, Mycobacterium
RQEKKSDGVNPQTFCLVKS

SEQ ID NO: 282227 - protein, 12 aa, Mycobacterium
RQELRDDPAAEL

SEQ ID NO: 282228 - protein, 12 aa, Mycobacterium
RQERSERDDDAT

SEQ ID NO: 282229 - protein, 8 aa, Mycobacterium
RQESGDCS

SEQ ID NO: 282230 - protein, 7 aa, Mycobacterium
RQESGPT

SEQ ID NO: 282231 - protein, 10 aa, Mycobacterium
RQETAVPETA

SEQ ID NO: 282232 - protein, 8 aa, Mycobacterium
RQETGDCS

SEQ ID NO: 282233 - protein, 17 aa, Mycobacterium
RQGADRLAGGSQQVAGG

SEQ ID NO: 282234 - protein, 9 aa, Mycobacterium
RQGATPLDT

SEQ ID NO: 282235 - protein, 7 aa, Mycobacterium
RQGDPGD

SEQ ID NO: 282236 - protein, 7 aa, Mycobacterium
RQGDRGD

SEQ ID NO: 282237 - protein, 9 aa, Mycobacterium
RQGDRGELV

SEQ ID NO: 282238 - protein, 23 aa, Mycobacterium
RQGDRSERRAHQITDDVSDDISD

SEQ ID NO: 282239 - protein, 5 aa, Mycobacterium
RQGGA

SEQ ID NO: 282240 - protein, 5 aa, Mycobacterium
RQGGT

SEQ ID NO: 282241 - protein, 5 aa, Mycobacterium
RQGPK

SEQ ID NO: 282242 - protein, 6 aa, Mycobacterium
RQGPNL

SEQ ID NO: 282243 - protein, 6 aa, Mycobacterium
RQGPQL

SEQ ID NO: 282244 - protein, 5 aa, Mycobacterium
RQGRD

SEQ ID NO: 282245 - protein, 6 aa, Mycobacterium
RQGRQV

SEQ ID NO: 282246 - protein, 7 aa, Mycobacterium
RQGRSDR

SEQ ID NO: 282247 - protein, 57 aa, Mycobacterium
RQGTGNPSTTTPSTTTSTTTAETTTTTPPTTTTTTVAPATTPRVQPPPQQPTHPPTH

SEQ ID NO: 282248 - protein, 15 aa, Mycobacterium
RQGTGSALDSASLSG

SEQ ID NO: 282249 - protein, 6 aa, Mycobacterium
RQGTPG

SEQ ID NO: 282250 - protein, 11 aa, Mycobacterium
RQGTTGQSIGK

SEQ ID NO: 282251 - protein, 11 aa, Mycobacterium
RQGTTGSSVGK

SEQ ID NO: 282252 - protein, 10 aa, Mycobacterium
RQGTTPESIG

SEQ ID NO: 282253 - protein, 39 aa, Mycobacterium
RQHKAPVVTSSSTGLTPIAPGRPPAAQPVASLPAGSVEQ

SEQ ID NO: 282254 - protein, 23 aa, Mycobacterium
RQHPPEARVEGEAQVRSAETPDI

SEQ ID NO: 282255 - protein, 24 aa, Mycobacterium
RQHREPGGAEDQDAGEARPDEDDY

SEQ ID NO: 282256 - protein, 7 aa, Mycobacterium
RQHSDTL

SEQ ID NO: 282257 - protein, 5 aa, Mycobacterium
RQIAQ

SEQ ID NO: 282258 - protein, 6 aa, Mycobacterium
RQIARG

SEQ ID NO: 282259 - protein, 7 aa, Mycobacterium
RQIPAPA

SEQ ID NO: 282260 - protein, 8 aa, Mycobacterium
RQKPERVA

SEQ ID NO: 282261 - protein, 5 aa, Mycobacterium
RQLAG

SEQ ID NO: 282262 - protein, 9 aa, Mycobacterium
RQLGDQDHR

SEQ ID NO: 282263 - protein, 11 aa, Mycobacterium
RQLPSDPAQLA

SEQ ID NO: 282264 - protein, 9 aa, Mycobacterium
RQLSPEEKR

SEQ ID NO: 282265 - protein, 9 aa, Mycobacterium
RQLTPDEKR

SEQ ID NO: 282266 - protein, 6 aa, Mycobacterium
RQLTSK

SEQ ID NO: 282267 - protein, 19 aa, Mycobacterium
RQMSNSSSRAGDAAEHAGE

SEQ ID NO: 282268 - protein, 7 aa, Mycobacterium
RQNDRIR

SEQ ID NO: 282269 - protein, 5 aa, Mycobacterium
RQNQM

SEQ ID NO: 282270 - protein, 10 aa, Mycobacterium
RQPAGPATVA

SEQ ID NO: 282271 - protein, 10 aa, Mycobacterium
RQPAHPSHPL

SEQ ID NO: 282272 - protein, 18 aa, Mycobacterium
RQPAPSVGQEPGEPERTL

SEQ ID NO: 282273 - protein, 6 aa, Mycobacterium
RQPASF

SEQ ID NO: 282274 - protein, 5 aa, Mycobacterium
RQPDG

SEQ ID NO: 282275 - protein, 7 aa, Mycobacterium
RQPDGGW

SEQ ID NO: 282276 - protein, 6 aa, Mycobacterium
RQPDHA

SEQ ID NO: 282277 - protein, 7 aa, Mycobacterium
RQPEMTP

SEQ ID NO: 282278 - protein, 4 aa, Mycobacterium
RQPG

SEQ ID NO: 282279 - protein, 6 aa, Mycobacterium
RQPGAT

SEQ ID NO: 282280 - protein, 5 aa, Mycobacterium
RQPGE

SEQ ID NO: 282281 - protein, 6 aa, Mycobacterium
RQPGES

SEQ ID NO: 282282 - protein, 6 aa, Mycobacterium
RQPGEV

SEQ ID NO: 282283 - protein, 7 aa, Mycobacterium
RQPGKRL

SEQ ID NO: 282284 - protein, 9 aa, Mycobacterium
RQPGRLGTS

SEQ ID NO: 282285 - protein, 6 aa, Mycobacterium
RQPGVR

SEQ ID NO: 282286 - protein, 6 aa, Mycobacterium
RQPIAP

SEQ ID NO: 282287 - protein, 12 aa, Mycobacterium
RQPKPRQYAQPV

SEQ ID NO: 282288 - protein, 6 aa, Mycobacterium
RQPNLS

SEQ ID NO: 282289 - protein, 10 aa, Mycobacterium
RQPNLSDAQA

SEQ ID NO: 282290 - protein, 6 aa, Mycobacterium
RQPNTS

SEQ ID NO: 282291 - protein, 16 aa, Mycobacterium
RQPPGPATEATERIAR

SEQ ID NO: 282292 - protein, 14 aa, Mycobacterium
RQPPQLSYPPQQQF

SEQ ID NO: 282293 - protein, 23 aa, Mycobacterium
RQPPSESDYGVEQEDPDAIDTDS

SEQ ID NO: 282294 - protein, 17 aa, Mycobacterium
RQPRFDPNSAKYTQPSG

SEQ ID NO: 282295 - protein, 9 aa, Mycobacterium
RQPRPPETH

SEQ ID NO: 282296 - protein, 33 aa, Mycobacterium
RQPSNCGNGAACEPTKGAPDAERGPAADRKHAG

SEQ ID NO: 282297 - protein, 22 aa, Mycobacterium
RQPTGVHGGPSRARPSGRRATQ

SEQ ID NO: 282298 - protein, 14 aa, Mycobacterium
RQPTSGTVERPGAV

SEQ ID NO: 282299 - protein, 4 aa, Mycobacterium
RQPV

SEQ ID NO: 282300 - protein, 5 aa, Mycobacterium
RQPWD

SEQ ID NO: 282301 - protein, 14 aa, Mycobacterium
RQQAPTDEKSAAIA

SEQ ID NO: 282302 - protein, 8 aa, Mycobacterium
RQQDRWSS

SEQ ID NO: 282303 - protein, 5 aa, Mycobacterium
RQQEL

SEQ ID NO: 282304 - protein, 5 aa, Mycobacterium
RQQGD

SEQ ID NO: 282305 - protein, 13 aa, Mycobacterium
RQQKESAPPSRAK

SEQ ID NO: 282306 - protein, 15 aa, Mycobacterium
RQQPAAAEHSAGPRP

SEQ ID NO: 282307 - protein, 7 aa, Mycobacterium
RQQPAQL

SEQ ID NO: 282308 - protein, 7 aa, Mycobacterium
RQQPTSI

SEQ ID NO: 282309 - protein, 22 aa, Mycobacterium
RQQRAQAVGQPLEDDVDRRRED

SEQ ID NO: 282310 - protein, 5 aa, Mycobacterium
RQQRP

SEQ ID NO: 282311 - protein, 9 aa, Mycobacterium
RQQVDEPER

SEQ ID NO: 282312 - protein, 6 aa, Mycobacterium
RQRADP

SEQ ID NO: 282313 - protein, 10 aa, Mycobacterium
RQREGTLRSE

SEQ ID NO: 282314 - protein, 12 aa, Mycobacterium
RQRERAGLHTDT

SEQ ID NO: 282315 - protein, 4 aa, Mycobacterium
RQRG

SEQ ID NO: 282316 - protein, 5 aa, Mycobacterium
RQRGA

SEQ ID NO: 282317 - protein, 5 aa, Mycobacterium
RQRGG

SEQ ID NO: 282318 - protein, 17 aa, Mycobacterium
RQRGGGSMFPTNGRPFD

SEQ ID NO: 282319 - protein, 5 aa, Mycobacterium
RQRGL

SEQ ID NO: 282320 - protein, 6 aa, Mycobacterium
RQRNDA

SEQ ID NO: 282321 - protein, 4 aa, Mycobacterium
RQRP

SEQ ID NO: 282322 - protein, 6 aa, Mycobacterium
RQRPAR

SEQ ID NO: 282323 - protein, 8 aa, Mycobacterium
RQRPAWNP

SEQ ID NO: 282324 - protein, 10 aa, Mycobacterium
RQRPESWPSA

SEQ ID NO: 282325 - protein, 12 aa, Mycobacterium
RQRPGDDADAVS

SEQ ID NO: 282326 - protein, 16 aa, Mycobacterium
RQRPLPSVSQEPAAAR

SEQ ID NO: 282327 - protein, 8 aa, Mycobacterium
RQRPPRRM

SEQ ID NO: 282328 - protein, 17 aa, Mycobacterium
RQRQGAVNRTGSYTDGY

SEQ ID NO: 282329 - protein, 5 aa, Mycobacterium
RQRRA

SEQ ID NO: 282330 - protein, 5 aa, Mycobacterium
RQRRG

SEQ ID NO: 282331 - protein, 13 aa, Mycobacterium
RQRRHEQARETVD

SEQ ID NO: 282332 - protein, 13 aa, Mycobacterium
RQRRHERSRHTIN

SEQ ID NO: 282333 - protein, 8 aa, Mycobacterium
RQRRSGHP

SEQ ID NO: 282334 - protein, 7 aa, Mycobacterium
RQRRSRG

SEQ ID NO: 282335 - protein, 20 aa, Mycobacterium
RQRSGIPSAAEPHRAPRAGP

SEQ ID NO: 282336 - protein, 9 aa, Mycobacterium
RQRTAADPL

SEQ ID NO: 282337 - protein, 9 aa, Mycobacterium
RQRTDTRNQ

SEQ ID NO: 282338 - protein, 4 aa, Mycobacterium
RQSA

SEQ ID NO: 282339 - protein, 13 aa, Mycobacterium
RQSDGAGSNAADP

SEQ ID NO: 282340 - protein, 6 aa, Mycobacterium
RQSDPV

SEQ ID NO: 282341 - protein, 10 aa, Mycobacterium
RQSDSDQAKV

SEQ ID NO: 282342 - protein, 7 aa, Mycobacterium
RQSDSEA

SEQ ID NO: 282343 - protein, 8 aa, Mycobacterium
RQSDSEAE

SEQ ID NO: 282344 - protein, 33 aa, Mycobacterium
RQSEEAGPDPAKPSPTTAVDTSEIASADDDGPV

SEQ ID NO: 282345 - protein, 4 aa, Mycobacterium
RQSG

SEQ ID NO: 282346 - protein, 12 aa, Mycobacterium
RQSGRLPETPAY

SEQ ID NO: 282347 - protein, 20 aa, Mycobacterium
RQSGRPATVSPIDMVSVKGR

SEQ ID NO: 282348 - protein, 13 aa, Mycobacterium
RQSGTGAGDDTAV

SEQ ID NO: 282349 - protein, 5 aa, Mycobacterium
RQSLR

SEQ ID NO: 282350 - protein, 6 aa, Mycobacterium
RQSPAV

SEQ ID NO: 282351 - protein, 6 aa, Mycobacterium
RQSPRS

SEQ ID NO: 282352 - protein, 21 aa, Mycobacterium
RQSPSAGSGVNYGATITLNFA

SEQ ID NO: 282353 - protein, 13 aa, Mycobacterium
RQSPTSPATGING

SEQ ID NO: 282354 - protein, 14 aa, Mycobacterium
RQSQVRQSLHREWF

SEQ ID NO: 282355 - protein, 8 aa, Mycobacterium
RQSRGGVR

SEQ ID NO: 282356 - protein, 17 aa, Mycobacterium
RQSRNAEGLKGSGVGDG

SEQ ID NO: 282357 - protein, 7 aa, Mycobacterium
RQSRTRG

SEQ ID NO: 282358 - protein, 9 aa, Mycobacterium
RQSSGKGQV

SEQ ID NO: 282359 - protein, 9 aa, Mycobacterium
RQSTLGREI

SEQ ID NO: 282360 - protein, 12 aa, Mycobacterium
RQTAGDNPGPGY

SEQ ID NO: 282361 - protein, 8 aa, Mycobacterium
RQTDTEAV

SEQ ID NO: 282362 - protein, 7 aa, Mycobacterium
RQTERQA

SEQ ID NO: 282363 - protein, 14 aa, Mycobacterium
RQTESGDSLETARP

SEQ ID NO: 282364 - protein, 5 aa, Mycobacterium
RQTGH

SEQ ID NO: 282365 - protein, 28 aa, Mycobacterium
RQTKVREATRHERIGPAGVEQRESANPP

SEQ ID NO: 282366 - protein, 15 aa, Mycobacterium
RQTLADKIMTTVCLP

SEQ ID NO: 282367 - protein, 5 aa, Mycobacterium
RQTPG

SEQ ID NO: 282368 - protein, 6 aa, Mycobacterium
RQTPRP

SEQ ID NO: 282369 - protein, 6 aa, Mycobacterium
RQTPTD

SEQ ID NO: 282370 - protein, 4 aa, Mycobacterium
RQTR

SEQ ID NO: 282371 - protein, 8 aa, Mycobacterium
RQTRRSYY

SEQ ID NO: 282372 - protein, 16 aa, Mycobacterium
RQTSAIDTGDEEPDID

SEQ ID NO: 282373 - protein, 7 aa, Mycobacterium
RQTSAQP

SEQ ID NO: 282374 - protein, 19 aa, Mycobacterium
RQTTLRATNGEGTGAPGTL

SEQ ID NO: 282375 - protein, 15 aa, Mycobacterium
RQTTRNVQNPEPRAT

SEQ ID NO: 282376 - protein, 9 aa, Mycobacterium
RQVADDDAQ

SEQ ID NO: 282377 - protein, 24 aa, Mycobacterium
RQVETGANGVSENLSSAGDSTDNV

SEQ ID NO: 282378 - protein, 22 aa, Mycobacterium
RQVKNGADGISDNLNSAGDSAH

SEQ ID NO: 282379 - protein, 8 aa, Mycobacterium
RQVSTGRL

SEQ ID NO: 282380 - protein, 18 aa, Mycobacterium
RQVTNGPSAAGPPHPPKH

SEQ ID NO: 282381 - protein, 5 aa, Mycobacterium
RQVTT

SEQ ID NO: 282382 - protein, 11 aa, Mycobacterium
RQWSRPANSDF

SEQ ID NO: 282383 - protein, 6 aa, Mycobacterium
RQYGGR

SEQ ID NO: 282384 - protein, 7 aa, Mycobacterium
RQYPGSS

SEQ ID NO: 282385 - protein, 7 aa, Mycobacterium
RQYSSPL

SEQ ID NO: 282386 - protein, 4 aa, Mycobacterium
RRAA

SEQ ID NO: 282387 - protein, 6 aa, Mycobacterium
RRAAAA

SEQ ID NO: 282388 - protein, 13 aa, Mycobacterium
RRAAAGVANDDPF

SEQ ID NO: 282389 - protein, 6 aa, Mycobacterium
RRAAED

SEQ ID NO: 282390 - protein, 11 aa, Mycobacterium
RRAAGGPLGPL

SEQ ID NO: 282391 - protein, 19 aa, Mycobacterium
RRAAGGPMGPLGAKDGDVY

SEQ ID NO: 282392 - protein, 8 aa, Mycobacterium
RRAAKRSS

SEQ ID NO: 282393 - protein, 16 aa, Mycobacterium
RRAAQAGRSPEHVPPG

SEQ ID NO: 282394 - protein, 10 aa, Mycobacterium
RRAAQSQEAL

SEQ ID NO: 282395 - protein, 8 aa, Mycobacterium
RRAARARK

SEQ ID NO: 282396 - protein, 6 aa, Mycobacterium
RRAATG

SEQ ID NO: 282397 - protein, 4 aa, Mycobacterium
RRAD

SEQ ID NO: 282398 - protein, 9 aa, Mycobacterium
RRADATGND

SEQ ID NO: 282399 - protein, 12 aa, Mycobacterium
RRADEQNQPYLA

SEQ ID NO: 282400 - protein, 11 aa, Mycobacterium
RRADGPPEQTR

SEQ ID NO: 282401 - protein, 5 aa, Mycobacterium
RRADQ

SEQ ID NO: 282402 - protein, 4 aa, Mycobacterium
RRAE

SEQ ID NO: 282403 - protein, 5 aa, Mycobacterium
RRAEG

SEQ ID NO: 282404 - protein, 47 aa, Mycobacterium
RRAEGLEPLPEPPVDSPPDGITGAATGVGGRAQPAGHTVSAHHGQPS

SEQ ID NO: 282405 - protein, 15 aa, Mycobacterium
RRAEGSDQQISHDVC

SEQ ID NO: 282406 - protein, 5 aa, Mycobacterium
RRAEI

SEQ ID NO: 282407 - protein, 6 aa, Mycobacterium
RRAEQR

SEQ ID NO: 282408 - protein, 4 aa, Mycobacterium
RRAG

SEQ ID NO: 282409 - protein, 6 aa, Mycobacterium
RRAGAQ

SEQ ID NO: 282410 - protein, 5 aa, Mycobacterium
RRAGD

SEQ ID NO: 282411 - protein, 7 aa, Mycobacterium
RRAGGRA

SEQ ID NO: 282412 - protein, 24 aa, Mycobacterium
RRAGQETHGYEPAEQDAESGYDAI

SEQ ID NO: 282413 - protein, 13 aa, Mycobacterium
RRAGQVQEVVRGN

SEQ ID NO: 282414 - protein, 5 aa, Mycobacterium
RRAGR

SEQ ID NO: 282415 - protein, 8 aa, Mycobacterium
RRAGRDSA

SEQ ID NO: 282416 - protein, 10 aa, Mycobacterium
RRAGRDSART

SEQ ID NO: 282417 - protein, 18 aa, Mycobacterium
RRAGRELGSASAVADSKQ

SEQ ID NO: 282418 - protein, 11 aa, Mycobacterium
RRAGRESARGV

SEQ ID NO: 282419 - protein, 9 aa, Mycobacterium
RRAGRQSAR

SEQ ID NO: 282420 - protein, 9 aa, Mycobacterium
RRAGRYEPY

SEQ ID NO: 282421 - protein, 17 aa, Mycobacterium
RRAGSTRSGRIRRRRGT

SEQ ID NO: 282422 - protein, 6 aa, Mycobacterium
RRAGTG

SEQ ID NO: 282423 - protein, 7 aa, Mycobacterium
RRAGTTH

SEQ ID NO: 282424 - protein, 5 aa, Mycobacterium
RRAHP

SEQ ID NO: 282425 - protein, 22 aa, Mycobacterium
RRAIDTASAPQPHHPPQDSADP

SEQ ID NO: 282426 - protein, 8 aa, Mycobacterium
RRAKQAKR

SEQ ID NO: 282427 - protein, 11 aa, Mycobacterium
RRAKRRKAEFE

SEQ ID NO: 282428 - protein, 4 aa, Mycobacterium
RRAL

SEQ ID NO: 282429 - protein, 14 aa, Mycobacterium
RRAMPAADEPEAAE

SEQ ID NO: 282430 - protein, 27 aa, Mycobacterium
RRAPAADASVDTPTAEAPIAEAQDTPV

SEQ ID NO: 282431 - protein, 7 aa, Mycobacterium
RRAPADS

SEQ ID NO: 282432 - protein, 13 aa, Mycobacterium
RRAPATDELDENP

SEQ ID NO: 282433 - protein, 10 aa, Mycobacterium
RRAPEATTAH

SEQ ID NO: 282434 - protein, 9 aa, Mycobacterium
RRAPQAGGR

SEQ ID NO: 282435 - protein, 10 aa, Mycobacterium
RRAPQAGGRE

SEQ ID NO: 282436 - protein, 9 aa, Mycobacterium
RRAPQARGR

SEQ ID NO: 282437 - protein, 10 aa, Mycobacterium
RRAPQASGRQ

SEQ ID NO: 282438 - protein, 5 aa, Mycobacterium
RRAPS

SEQ ID NO: 282439 - protein, 5 aa, Mycobacterium
RRAQR

SEQ ID NO: 282440 - protein, 8 aa, Mycobacterium
RRAQVRSA

SEQ ID NO: 282441 - protein, 14 aa, Mycobacterium
RRARDLASESLREA

SEQ ID NO: 282442 - protein, 12 aa, Mycobacterium
RRARDRAADALR

SEQ ID NO: 282443 - protein, 15 aa, Mycobacterium
RRARGGVAVEEALDE

SEQ ID NO: 282444 - protein, 10 aa, Mycobacterium
RRARNGRAAT

SEQ ID NO: 282445 - protein, 8 aa, Mycobacterium
RRARSMSK

SEQ ID NO: 282446 - protein, 6 aa, Mycobacterium
RRASGG

SEQ ID NO: 282447 - protein, 15 aa, Mycobacterium
RRASNPAAQSLPDPT

SEQ ID NO: 282448 - protein, 10 aa, Mycobacterium
RRASSRRAAT

SEQ ID NO: 282449 - protein, 8 aa, Mycobacterium
RRATAPKL

SEQ ID NO: 282450 - protein, 9 aa, Mycobacterium
RRATAPKLR

SEQ ID NO: 282451 - protein, 6 aa, Mycobacterium
RRATSA

SEQ ID NO: 282452 - protein, 16 aa, Mycobacterium
RRAYAGQAEAQRAKSF

SEQ ID NO: 282453 - protein, 9 aa, Mycobacterium
RRDAGSFSR

SEQ ID NO: 282454 - protein, 10 aa, Mycobacterium
RRDANRKRHE

SEQ ID NO: 282455 - protein, 5 aa, Mycobacterium
RRDAP

SEQ ID NO: 282456 - protein, 5 aa, Mycobacterium
RRDAR

SEQ ID NO: 282457 - protein, 32 aa, Mycobacterium
RRDATNLPDEHSNVPAAGDDTVDDPPRGAPLG

SEQ ID NO: 282458 - protein, 7 aa, Mycobacterium
RRDATVA

SEQ ID NO: 282459 - protein, 4 aa, Mycobacterium
RRDD

SEQ ID NO: 282460 - protein, 7 aa, Mycobacterium
RRDEGGS

SEQ ID NO: 282461 - protein, 18 aa, Mycobacterium
RRDELGGRVSTDPAEALA

SEQ ID NO: 282462 - protein, 10 aa, Mycobacterium
RRDENDGSFT

SEQ ID NO: 282463 - protein, 18 aa, Mycobacterium
RRDENDGSFTDMDRTRRQ

SEQ ID NO: 282464 - protein, 5 aa, Mycobacterium
RRDEP

SEQ ID NO: 282465 - protein, 10 aa, Mycobacterium
RRDEQGAPPI

SEQ ID NO: 282466 - protein, 6 aa, Mycobacterium
RRDESV

SEQ ID NO: 282467 - protein, 30 aa, Mycobacterium
RRDGAELPSDRAPESGTATATDPATAPQPT

SEQ ID NO: 282468 - protein, 15 aa, Mycobacterium
RRDGDQIKMAKVEFV

SEQ ID NO: 282469 - protein, 9 aa, Mycobacterium
RRDGPGGDG

SEQ ID NO: 282470 - protein, 10 aa, Mycobacterium
RRDGRPRARR

SEQ ID NO: 282471 - protein, 13 aa, Mycobacterium
RRDGVARAGQLRA

SEQ ID NO: 282472 - protein, 17 aa, Mycobacterium
RRDHEAGALDSRQAHGA

SEQ ID NO: 282473 - protein, 8 aa, Mycobacterium
RRDKPRRR

SEQ ID NO: 282474 - protein, 18 aa, Mycobacterium
RRDPGTPEVRPRYDNGRT

SEQ ID NO: 282475 - protein, 7 aa, Mycobacterium
RRDPRRS

SEQ ID NO: 282476 - protein, 21 aa, Mycobacterium
RRDPVPVAGQRSRTSSGMGDQ

SEQ ID NO: 282477 - protein, 15 aa, Mycobacterium
RRDQAATAVGQPRSR

SEQ ID NO: 282478 - protein, 7 aa, Mycobacterium
RRDQPLP

SEQ ID NO: 282479 - protein, 13 aa, Mycobacterium
RRDRAQARIEEMS

SEQ ID NO: 282480 - protein, 16 aa, Mycobacterium
RRDRDMADPDVAPTSS

SEQ ID NO: 282481 - protein, 5 aa, Mycobacterium
RRDRP

SEQ ID NO: 282482 - protein, 6 aa, Mycobacterium
RRDSRA

SEQ ID NO: 282483 - protein, 4 aa, Mycobacterium
RRDT

SEQ ID NO: 282484 - protein, 15 aa, Mycobacterium
RRDTENQFDPAVPGT

SEQ ID NO: 282485 - protein, 16 aa, Mycobacterium
RRDTENQFDPPAPGTR

SEQ ID NO: 282486 - protein, 5 aa, Mycobacterium
RRDTG

SEQ ID NO: 282487 - protein, 9 aa, Mycobacterium
RRDTGGVSR

SEQ ID NO: 282488 - protein, 5 aa, Mycobacterium
RRDTR

SEQ ID NO: 282489 - protein, 7 aa, Mycobacterium
RRDTTNQ

SEQ ID NO: 282490 - protein, 14 aa, Mycobacterium
RRDTTNQFENATPA

SEQ ID NO: 282491 - protein, 5 aa, Mycobacterium
RRDVA

SEQ ID NO: 282492 - protein, 5 aa, Mycobacterium
RRDWP

SEQ ID NO: 282493 - protein, 17 aa, Mycobacterium
RREAFRDSRGGVPDDGF

SEQ ID NO: 282494 - protein, 11 aa, Mycobacterium
RREARRRLTGT

SEQ ID NO: 282495 - protein, 4 aa, Mycobacterium
RRED

SEQ ID NO: 282496 - protein, 6 aa, Mycobacterium
RREDSA

SEQ ID NO: 282497 - protein, 7 aa, Mycobacterium
RREDTAP

SEQ ID NO: 282498 - protein, 12 aa, Mycobacterium
RREDTVGRTGGD

SEQ ID NO: 282499 - protein, 8 aa, Mycobacterium
RREEAPRG

SEQ ID NO: 282500 - protein, 11 aa, Mycobacterium
RREEDLPWEDG

SEQ ID NO: 282501 - protein, 6 aa, Mycobacterium
RREFGP

SEQ ID NO: 282502 - protein, 7 aa, Mycobacterium
RREFGPA

SEQ ID NO: 282503 - protein, 6 aa, Mycobacterium
RREGIE

SEQ ID NO: 282504 - protein, 27 aa, Mycobacterium
RREGRNVTGATKATSDASKPDTPDQER

SEQ ID NO: 282505 - protein, 20 aa, Mycobacterium
RREHPSDPLPVADSPPRAGG

SEQ ID NO: 282506 - protein, 4 aa, Mycobacterium
RREI

SEQ ID NO: 282507 - protein, 4 aa, Mycobacterium
RREK

SEQ ID NO: 282508 - protein, 12 aa, Mycobacterium
RRELRDDPAAEL

SEQ ID NO: 282509 - protein, 23 aa, Mycobacterium
RRENTAPSEPKRGVSSRDTAANI

SEQ ID NO: 282510 - protein, 103 aa, Mycobacterium
RREPRCGPANPQHSSGPMPAYSSEPIPRSGPSGPTHPPSGPIGQPAWSPGAHPAAPAHSPVAPPPWDGGMSPGAAPRALAPQQLGGTPAWNPGVPQRPPRARN

SEQ ID NO: 282511 - protein, 20 aa, Mycobacterium
RREQPHPTASPRACAEAATP

SEQ ID NO: 282512 - protein, 17 aa, Mycobacterium
RREQRAAAGAADTAASN

SEQ ID NO: 282513 - protein, 8 aa, Mycobacterium
RRERGLPG

SEQ ID NO: 282514 - protein, 16 aa, Mycobacterium
RRERIRDGQDREHGAL

SEQ ID NO: 282515 - protein, 6 aa, Mycobacterium
RRETEL

SEQ ID NO: 282516 - protein, 12 aa, Mycobacterium
RRETPGRSGSPR

SEQ ID NO: 282517 - protein, 13 aa, Mycobacterium
RRFPDAPAIDDGT

SEQ ID NO: 282518 - protein, 13 aa, Mycobacterium
RRFPDAPALDDGT

SEQ ID NO: 282519 - protein, 8 aa, Mycobacterium
RRGAAADA

SEQ ID NO: 282520 - protein, 32 aa, Mycobacterium
RRGAEGSRTDDNPAPAATPDPPLDATVGAVTF

SEQ ID NO: 282521 - protein, 10 aa, Mycobacterium
RRGAPNGIDE

SEQ ID NO: 282522 - protein, 10 aa, Mycobacterium
RRGAPNGLDE

SEQ ID NO: 282523 - protein, 6 aa, Mycobacterium
RRGAPR

SEQ ID NO: 282524 - protein, 5 aa, Mycobacterium
RRGAR

SEQ ID NO: 282525 - protein, 21 aa, Mycobacterium
RRGARGAQAGLETYLDQQQID

SEQ ID NO: 282526 - protein, 7 aa, Mycobacterium
RRGARNR

SEQ ID NO: 282527 - protein, 10 aa, Mycobacterium
RRGASTPEAV

SEQ ID NO: 282528 - protein, 7 aa, Mycobacterium
RRGAVND

SEQ ID NO: 282529 - protein, 7 aa, Mycobacterium
RRGAVNE

SEQ ID NO: 282530 - protein, 5 aa, Mycobacterium
RRGDA

SEQ ID NO: 282531 - protein, 13 aa, Mycobacterium
RRGDGTGGPTDER

SEQ ID NO: 282532 - protein, 10 aa, Mycobacterium
RRGDHKPATV

SEQ ID NO: 282533 - protein, 5 aa, Mycobacterium
RRGDL

SEQ ID NO: 282534 - protein, 11 aa, Mycobacterium
RRGDPARGRER

SEQ ID NO: 282535 - protein, 6 aa, Mycobacterium
RRGDPL

SEQ ID NO: 282536 - protein, 11 aa, Mycobacterium
RRGDRAEGAAE

SEQ ID NO: 282537 - protein, 26 aa, Mycobacterium
RRGDSDGAGDDDGSNGDADTSTPGFD

SEQ ID NO: 282538 - protein, 9 aa, Mycobacterium
RRGDSDPRV

SEQ ID NO: 282539 - protein, 4 aa, Mycobacterium
RRGE

SEQ ID NO: 282540 - protein, 5 aa, Mycobacterium
RRGEA

SEQ ID NO: 282541 - protein, 9 aa, Mycobacterium
RRGEATDDF

SEQ ID NO: 282542 - protein, 6 aa, Mycobacterium
RRGEDM

SEQ ID NO: 282543 - protein, 9 aa, Mycobacterium
RRGEKAGGH

SEQ ID NO: 282544 - protein, 12 aa, Mycobacterium
RRGEKAGGREQY

SEQ ID NO: 282545 - protein, 7 aa, Mycobacterium
RRGETEY

SEQ ID NO: 282546 - protein, 4 aa, Mycobacterium
RRGF

SEQ ID NO: 282547 - protein, 7 aa, Mycobacterium
RRGFSPA

SEQ ID NO: 282548 - protein, 8 aa, Mycobacterium
RRGGAGRL

SEQ ID NO: 282549 - protein, 17 aa, Mycobacterium
RRGGGAPTPTVPADAPP

SEQ ID NO: 282550 - protein, 5 aa, Mycobacterium
RRGGI

SEQ ID NO: 282551 - protein, 9 aa, Mycobacterium
RRGGNAAEL

SEQ ID NO: 282552 - protein, 10 aa, Mycobacterium
RRGGNAAELS

SEQ ID NO: 282553 - protein, 10 aa, Mycobacterium
RRGGPHQPVD

SEQ ID NO: 282554 - protein, 8 aa, Mycobacterium
RRGGRSLG

SEQ ID NO: 282555 - protein, 12 aa, Mycobacterium
RRGGRSPGGAIA

SEQ ID NO: 282556 - protein, 14 aa, Mycobacterium
RRGGTRNPNPESGY

SEQ ID NO: 282557 - protein, 4 aa, Mycobacterium
RRGI

SEQ ID NO: 282558 - protein, 6 aa, Mycobacterium
RRGKAL

SEQ ID NO: 282559 - protein, 8 aa, Mycobacterium
RRGKALSS

SEQ ID NO: 282560 - protein, 9 aa, Mycobacterium
RRGKRRARE

SEQ ID NO: 282561 - protein, 8 aa, Mycobacterium
RRGLAGAQ

SEQ ID NO: 282562 - protein, 17 aa, Mycobacterium
RRGLAQPRPLRGQPGRR

SEQ ID NO: 282563 - protein, 10 aa, Mycobacterium
RRGLAQPRTV

SEQ ID NO: 282564 - protein, 13 aa, Mycobacterium
RRGLGPTVVVASR

SEQ ID NO: 282565 - protein, 7 aa, Mycobacterium
RRGLPGP

SEQ ID NO: 282566 - protein, 7 aa, Mycobacterium
RRGNDTR

SEQ ID NO: 282567 - protein, 13 aa, Mycobacterium
RRGPDDPPARPWT

SEQ ID NO: 282568 - protein, 23 aa, Mycobacterium
RRGPEKPPASEADTDKFPSPRNH

SEQ ID NO: 282569 - protein, 18 aa, Mycobacterium
RRGPFNDVSGEPIAVDST

SEQ ID NO: 282570 - protein, 34 aa, Mycobacterium
RRGPNPGQRPAPAAPSGAIPPSASPSPTLTTPDQ

SEQ ID NO: 282571 - protein, 7 aa, Mycobacterium
RRGPVGD

SEQ ID NO: 282572 - protein, 6 aa, Mycobacterium
RRGQDL

SEQ ID NO: 282573 - protein, 7 aa, Mycobacterium
RRGQESF

SEQ ID NO: 282574 - protein, 8 aa, Mycobacterium
RRGQRGDH

SEQ ID NO: 282575 - protein, 5 aa, Mycobacterium
RRGQS

SEQ ID NO: 282576 - protein, 5 aa, Mycobacterium
RRGRA

SEQ ID NO: 282577 - protein, 6 aa, Mycobacterium
RRGRAR

SEQ ID NO: 282578 - protein, 24 aa, Mycobacterium
RRGRARIDPQDPSEVVSSTIGQEM

SEQ ID NO: 282579 - protein, 15 aa, Mycobacterium
RRGRARSVTGIAPAG

SEQ ID NO: 282580 - protein, 9 aa, Mycobacterium
RRGRDSNEL

SEQ ID NO: 282581 - protein, 7 aa, Mycobacterium
RRGRGDE

SEQ ID NO: 282582 - protein, 7 aa, Mycobacterium
RRGRGTP

SEQ ID NO: 282583 - protein, 9 aa, Mycobacterium
RRGRGTPTV

SEQ ID NO: 282584 - protein, 18 aa, Mycobacterium
RRGRHRKARRLPAPPSPS

SEQ ID NO: 282585 - protein, 7 aa, Mycobacterium
RRGRKHA

SEQ ID NO: 282586 - protein, 20 aa, Mycobacterium
RRGRPATEEDPVPPAATQEM

SEQ ID NO: 282587 - protein, 25 aa, Mycobacterium
RRGRQAPHARSVDGNTQPFPGVTTA

SEQ ID NO: 282588 - protein, 6 aa, Mycobacterium
RRGRRA

SEQ ID NO: 282589 - protein, 24 aa, Mycobacterium
RRGRRQPTAGTDQSANSETVAIAF

SEQ ID NO: 282590 - protein, 24 aa, Mycobacterium
RRGRRTADPDDGSDMLATTFGQEI

SEQ ID NO: 282591 - protein, 5 aa, Mycobacterium
RRGRS

SEQ ID NO: 282592 - protein, 13 aa, Mycobacterium
RRGRTDGYRPAAP

SEQ ID NO: 282593 - protein, 15 aa, Mycobacterium
RRGSATAAETSAQAA

SEQ ID NO: 282594 - protein, 6 aa, Mycobacterium
RRGSEA

SEQ ID NO: 282595 - protein, 8 aa, Mycobacterium
RRGSPPEI

SEQ ID NO: 282596 - protein, 20 aa, Mycobacterium
RRGSRKHSWRERTSRATLGR

SEQ ID NO: 282597 - protein, 15 aa, Mycobacterium
RRGSSAAATPAESTS

SEQ ID NO: 282598 - protein, 13 aa, Mycobacterium
RRGSSFKERKASE

SEQ ID NO: 282599 - protein, 11 aa, Mycobacterium
RRGSSSPDRTY

SEQ ID NO: 282600 - protein, 11 aa, Mycobacterium
RRGSSSPNRTY

SEQ ID NO: 282601 - protein, 17 aa, Mycobacterium
RRGSSYPSYPVDSSTVH

SEQ ID NO: 282602 - protein, 20 aa, Mycobacterium
RRGTADANSERQAHGPSEIT

SEQ ID NO: 282603 - protein, 6 aa, Mycobacterium
RRGTDG

SEQ ID NO: 282604 - protein, 12 aa, Mycobacterium
RRGTEIGGPTAE

SEQ ID NO: 282605 - protein, 8 aa, Mycobacterium
RRGTGMSG

SEQ ID NO: 282606 - protein, 9 aa, Mycobacterium
RRGTPLQSA

SEQ ID NO: 282607 - protein, 8 aa, Mycobacterium
RRGTPPDI

SEQ ID NO: 282608 - protein, 8 aa, Mycobacterium
RRGTQADE

SEQ ID NO: 282609 - protein, 4 aa, Mycobacterium
RRGV

SEQ ID NO: 282610 - protein, 15 aa, Mycobacterium
RRGVRPPTSDPNASS

SEQ ID NO: 282611 - protein, 7 aa, Mycobacterium
RRGYRPP

SEQ ID NO: 282612 - protein, 10 aa, Mycobacterium
RRHGIPPERA

SEQ ID NO: 282613 - protein, 4 aa, Mycobacterium
RRHP

SEQ ID NO: 282614 - protein, 5 aa, Mycobacterium
RRHPD

SEQ ID NO: 282615 - protein, 6 aa, Mycobacterium
RRHPGT

SEQ ID NO: 282616 - protein, 5 aa, Mycobacterium
RRHPN

SEQ ID NO: 282617 - protein, 6 aa, Mycobacterium
RRHPNG

SEQ ID NO: 282618 - protein, 7 aa, Mycobacterium
RRHQRGR

SEQ ID NO: 282619 - protein, 21 aa, Mycobacterium
RRIEEPGPGADGAQAGEPGRL

SEQ ID NO: 282620 - protein, 13 aa, Mycobacterium
RRIGRPRRSYPEG

SEQ ID NO: 282621 - protein, 6 aa, Mycobacterium
RRIQPA

SEQ ID NO: 282622 - protein, 5 aa, Mycobacterium
RRISR

SEQ ID NO: 282623 - protein, 17 aa, Mycobacterium
RRKAKREAQAAIPDDEA

SEQ ID NO: 282624 - protein, 12 aa, Mycobacterium
RRKDAEGRTARE

SEQ ID NO: 282625 - protein, 12 aa, Mycobacterium
RRKGNRREAETI

SEQ ID NO: 282626 - protein, 11 aa, Mycobacterium
RRKGPSAARNA

SEQ ID NO: 282627 - protein, 19 aa, Mycobacterium
RRKKSSGTKQSEGGAKDTA

SEQ ID NO: 282628 - protein, 26 aa, Mycobacterium
RRKPGSSGITDIPAPPAGQQPRARRE

SEQ ID NO: 282629 - protein, 7 aa, Mycobacterium
RRKPGTS

SEQ ID NO: 282630 - protein, 9 aa, Mycobacterium
RRKQGRSKR

SEQ ID NO: 282631 - protein, 9 aa, Mycobacterium
RRKRPADFP

SEQ ID NO: 282632 - protein, 26 aa, Mycobacterium
RRKYEDKQRELEEARREAEAKRAKQK

SEQ ID NO: 282633 - protein, 12 aa, Mycobacterium
RRLADGRDDGWA

SEQ ID NO: 282634 - protein, 7 aa, Mycobacterium
RRLERGT

SEQ ID NO: 282635 - protein, 4 aa, Mycobacterium
RRLN

SEQ ID NO: 282636 - protein, 10 aa, Mycobacterium
RRLNGEPPLG

SEQ ID NO: 282637 - protein, 11 aa, Mycobacterium
RRLPSDPAELA

SEQ ID NO: 282638 - protein, 12 aa, Mycobacterium
RRLQPAHSEVFL

SEQ ID NO: 282639 - protein, 6 aa, Mycobacterium
RRLSGN

SEQ ID NO: 282640 - protein, 10 aa, Mycobacterium
RRLSGQPGLG

SEQ ID NO: 282641 - protein, 4 aa, Mycobacterium
RRLT

SEQ ID NO: 282642 - protein, 9 aa, Mycobacterium
RRLTGEPAL

SEQ ID NO: 282643 - protein, 5 aa, Mycobacterium
RRMPG

SEQ ID NO: 282644 - protein, 8 aa, Mycobacterium
RRMSRGDL

SEQ ID NO: 282645 - protein, 8 aa, Mycobacterium
RRNAREQR

SEQ ID NO: 282646 - protein, 16 aa, Mycobacterium
RRNDPRRQAARTAAAR

SEQ ID NO: 282647 - protein, 5 aa, Mycobacterium
RRNEL

SEQ ID NO: 282648 - protein, 6 aa, Mycobacterium
RRNELN

SEQ ID NO: 282649 - protein, 9 aa, Mycobacterium
RRNGIPNTN

SEQ ID NO: 282650 - protein, 5 aa, Mycobacterium
RRNGS

SEQ ID NO: 282651 - protein, 16 aa, Mycobacterium
RRNGSDSDGEDGRPAP

SEQ ID NO: 282652 - protein, 7 aa, Mycobacterium
RRNPGIP

SEQ ID NO: 282653 - protein, 27 aa, Mycobacterium
RRNPGSSGIADVPGQQPEQQQPPRRRR

SEQ ID NO: 282654 - protein, 7 aa, Mycobacterium
RRNRETG

SEQ ID NO: 282655 - protein, 5 aa, Mycobacterium
RRNRQ

SEQ ID NO: 282656 - protein, 4 aa, Mycobacterium
RRNS

SEQ ID NO: 282657 - protein, 7 aa, Mycobacterium
RRNSAGV

SEQ ID NO: 282658 - protein, 22 aa, Mycobacterium
RRNSEAGHAGADGAPAPAAVAG

SEQ ID NO: 282659 - protein, 4 aa, Mycobacterium
RRNT

SEQ ID NO: 282660 - protein, 11 aa, Mycobacterium
RRNVSSGLNRL

SEQ ID NO: 282661 - protein, 6 aa, Mycobacterium
RRPAAR

SEQ ID NO: 282662 - protein, 16 aa, Mycobacterium
RRPADSVPADQPGRGL

SEQ ID NO: 282663 - protein, 59 aa, Mycobacterium
RRPAEPTGTPPHQPTSAPPPPRPATGPVGPRRRRRTPAPAPPPRPAAPKARRKKTKRRW

SEQ ID NO: 282664 - protein, 16 aa, Mycobacterium
RRPAESVPHDQPGRGL

SEQ ID NO: 282665 - protein, 9 aa, Mycobacterium
RRPAGRPVA

SEQ ID NO: 282666 - protein, 11 aa, Mycobacterium
RRPAPTVERAT

SEQ ID NO: 282667 - protein, 11 aa, Mycobacterium
RRPATSQGRRI

SEQ ID NO: 282668 - protein, 9 aa, Mycobacterium
RRPDDLAPQ

SEQ ID NO: 282669 - protein, 6 aa, Mycobacterium
RRPDQT

SEQ ID NO: 282670 - protein, 6 aa, Mycobacterium
RRPDRA

SEQ ID NO: 282671 - protein, 7 aa, Mycobacterium
RRPEFAT

SEQ ID NO: 282672 - protein, 8 aa, Mycobacterium
RRPESTQS

SEQ ID NO: 282673 - protein, 12 aa, Mycobacterium
RRPFPARVGPKG

SEQ ID NO: 282674 - protein, 12 aa, Mycobacterium
RRPFPDRIGPKG

SEQ ID NO: 282675 - protein, 5 aa, Mycobacterium
RRPGA

SEQ ID NO: 282676 - protein, 21 aa, Mycobacterium
RRPGAQPSSGALPSGLQPGPL

SEQ ID NO: 282677 - protein, 6 aa, Mycobacterium
RRPGAR

SEQ ID NO: 282678 - protein, 7 aa, Mycobacterium
RRPGDSD

SEQ ID NO: 282679 - protein, 15 aa, Mycobacterium
RRPGERSGVAATGRA

SEQ ID NO: 282680 - protein, 57 aa, Mycobacterium
RRPGGARADGAKTRPRRQADRRRPRDAKPTARRSAHSGAPSTRGAPSRRHSRAPETE

SEQ ID NO: 282681 - protein, 6 aa, Mycobacterium
RRPGPL

SEQ ID NO: 282682 - protein, 6 aa, Mycobacterium
RRPGQV

SEQ ID NO: 282683 - protein, 5 aa, Mycobacterium
RRPGS

SEQ ID NO: 282684 - protein, 11 aa, Mycobacterium
RRPGSPNGIDE

SEQ ID NO: 282685 - protein, 4 aa, Mycobacterium
RRPH

SEQ ID NO: 282686 - protein, 25 aa, Mycobacterium
RRPITTSRPPNATPIAAASTEVIEK

SEQ ID NO: 282687 - protein, 20 aa, Mycobacterium
RRPKPSPWPKPIQREPADAV

SEQ ID NO: 282688 - protein, 6 aa, Mycobacterium
RRPKRR

SEQ ID NO: 282689 - protein, 5 aa, Mycobacterium
RRPLE

SEQ ID NO: 282690 - protein, 7 aa, Mycobacterium
RRPLESY

SEQ ID NO: 282691 - protein, 11 aa, Mycobacterium
RRPNKLGETEY

SEQ ID NO: 282692 - protein, 4 aa, Mycobacterium
RRPP

SEQ ID NO: 282693 - protein, 10 aa, Mycobacterium
RRPPDVPSEP

SEQ ID NO: 282694 - protein, 12 aa, Mycobacterium
RRPPGLPAPRPF

SEQ ID NO: 282695 - protein, 10 aa, Mycobacterium
RRPPPPPETG

SEQ ID NO: 282696 - protein, 8 aa, Mycobacterium
RRPPPRSG

SEQ ID NO: 282697 - protein, 7 aa, Mycobacterium
RRPPPVA

SEQ ID NO: 282698 - protein, 27 aa, Mycobacterium
RRPPSRPNKTHQPHNTDTGHTVGEGSG

SEQ ID NO: 282699 - protein, 13 aa, Mycobacterium
RRPQQHSASPFKM

SEQ ID NO: 282700 - protein, 15 aa, Mycobacterium
RRPQTPDVAPTSEHP

SEQ ID NO: 282701 - protein, 12 aa, Mycobacterium
RRPRRPPPMPSA

SEQ ID NO: 282702 - protein, 7 aa, Mycobacterium
RRPRTGK

SEQ ID NO: 282703 - protein, 29 aa, Mycobacterium
RRPSFEDPADSDDEDYEDYEEEDPEEAAR

SEQ ID NO: 282704 - protein, 15 aa, Mycobacterium
RRPSGGGTAKTPGPL

SEQ ID NO: 282705 - protein, 12 aa, Mycobacterium
RRPSGGLEMPAE

SEQ ID NO: 282706 - protein, 13 aa, Mycobacterium
RRPSGSGTAKTPG

SEQ ID NO: 282707 - protein, 22 aa, Mycobacterium
RRPSRAESRRAVAQRPPGAADP

SEQ ID NO: 282708 - protein, 17 aa, Mycobacterium
RRPSRGYRHSDAAARRR

SEQ ID NO: 282709 - protein, 15 aa, Mycobacterium
RRPSSGFTPRPPDNN

SEQ ID NO: 282710 - protein, 10 aa, Mycobacterium
RRPSTAQQAD

SEQ ID NO: 282711 - protein, 7 aa, Mycobacterium
RRPTAAD

SEQ ID NO: 282712 - protein, 8 aa, Mycobacterium
RRPTAVAP

SEQ ID NO: 282713 - protein, 7 aa, Mycobacterium
RRPTFSA

SEQ ID NO: 282714 - protein, 5 aa, Mycobacterium
RRPTL

SEQ ID NO: 282715 - protein, 5 aa, Mycobacterium
RRPTR

SEQ ID NO: 282716 - protein, 17 aa, Mycobacterium
RRPTSGAPTAHGAGGHL

SEQ ID NO: 282717 - protein, 9 aa, Mycobacterium
RRPTSMTPT

SEQ ID NO: 282718 - protein, 8 aa, Mycobacterium
RRPTSVAP

SEQ ID NO: 282719 - protein, 4 aa, Mycobacterium
RRPV

SEQ ID NO: 282720 - protein, 10 aa, Mycobacterium
RRPVSVEDPD

SEQ ID NO: 282721 - protein, 4 aa, Mycobacterium
RRQA

SEQ ID NO: 282722 - protein, 61 aa, Mycobacterium
RRQAGKGAVKTAADDASEEADGGDTVTASSTPAAAKPAPGARPARPSGARTGRPSGKRTNR

SEQ ID NO: 282723 - protein, 7 aa, Mycobacterium
RRQAPAV

SEQ ID NO: 282724 - protein, 14 aa, Mycobacterium
RRQASAAGTLARRY

SEQ ID NO: 282725 - protein, 6 aa, Mycobacterium
RRQDPL

SEQ ID NO: 282726 - protein, 9 aa, Mycobacterium
RRQDRTGRT

SEQ ID NO: 282727 - protein, 12 aa, Mycobacterium
RRQGASPWNPKT

SEQ ID NO: 282728 - protein, 17 aa, Mycobacterium
RRQGRSPWNPKTYPSND

SEQ ID NO: 282729 - protein, 4 aa, Mycobacterium
RRQH

SEQ ID NO: 282730 - protein, 8 aa, Mycobacterium
RRQHPETQ

SEQ ID NO: 282731 - protein, 4 aa, Mycobacterium
RRQL

SEQ ID NO: 282732 - protein, 11 aa, Mycobacterium
RRQLNEPPLGP

SEQ ID NO: 282733 - protein, 5 aa, Mycobacterium
RRQMG

SEQ ID NO: 282734 - protein, 9 aa, Mycobacterium
RRQNPGSDM

SEQ ID NO: 282735 - protein, 7 aa, Mycobacterium
RRQPSPT

SEQ ID NO: 282736 - protein, 7 aa, Mycobacterium
RRQPSSA

SEQ ID NO: 282737 - protein, 4 aa, Mycobacterium
RRQQ

SEQ ID NO: 282738 - protein, 6 aa, Mycobacterium
RRQQAN

SEQ ID NO: 282739 - protein, 7 aa, Mycobacterium
RRQQGRE

SEQ ID NO: 282740 - protein, 14 aa, Mycobacterium
RRQQGSVGRPPPTA

SEQ ID NO: 282741 - protein, 9 aa, Mycobacterium
RRQRDAKKV

SEQ ID NO: 282742 - protein, 12 aa, Mycobacterium
RRQRSAASPVPD

SEQ ID NO: 282743 - protein, 8 aa, Mycobacterium
RRQRSASR

SEQ ID NO: 282744 - protein, 12 aa, Mycobacterium
RRQSDGAPVPGG

SEQ ID NO: 282745 - protein, 13 aa, Mycobacterium
RRQSDTDQAKVRD

SEQ ID NO: 282746 - protein, 12 aa, Mycobacterium
RRQSGTQPMPPS

SEQ ID NO: 282747 - protein, 12 aa, Mycobacterium
RRQSGTRTMSPS

SEQ ID NO: 282748 - protein, 6 aa, Mycobacterium
RRQSPV

SEQ ID NO: 282749 - protein, 8 aa, Mycobacterium
RRQSRTDH

SEQ ID NO: 282750 - protein, 24 aa, Mycobacterium
RRQTAKPAPAPAAQVTPAPVTPAV

SEQ ID NO: 282751 - protein, 8 aa, Mycobacterium
RRQTEQQA

SEQ ID NO: 282752 - protein, 5 aa, Mycobacterium
RRQWG

SEQ ID NO: 282753 - protein, 5 aa, Mycobacterium
RRRAA

SEQ ID NO: 282754 - protein, 11 aa, Mycobacterium
RRRADRRPFRG

SEQ ID NO: 282755 - protein, 55 aa, Mycobacterium
RRRAPEQPSEDRRPPRGRHSAAGEQPQEPAVPDEEPEQPDESDADGGAHTGGQSV

SEQ ID NO: 282756 - protein, 6 aa, Mycobacterium
RRRAQR

SEQ ID NO: 282757 - protein, 26 aa, Mycobacterium
RRRASRAAGPAKAASSQREAAETPVE

SEQ ID NO: 282758 - protein, 26 aa, Mycobacterium
RRRASRAAGPAKSESGESDAGETTVG

SEQ ID NO: 282759 - protein, 20 aa, Mycobacterium
RRRASRAAGPASDAPPAVTG

SEQ ID NO: 282760 - protein, 6 aa, Mycobacterium
RRRATR

SEQ ID NO: 282761 - protein, 6 aa, Mycobacterium
RRRELN

SEQ ID NO: 282762 - protein, 11 aa, Mycobacterium
RRREPAEPEFG

SEQ ID NO: 282763 - protein, 19 aa, Mycobacterium
RRRETRAREDAPPADTPMT

SEQ ID NO: 282764 - protein, 22 aa, Mycobacterium
RRREYDDATLSSRGEHPGARPV

SEQ ID NO: 282765 - protein, 8 aa, Mycobacterium
RRRGAPPT

SEQ ID NO: 282766 - protein, 8 aa, Mycobacterium
RRRGDLDG

SEQ ID NO: 282767 - protein, 6 aa, Mycobacterium
RRRGGG

SEQ ID NO: 282768 - protein, 16 aa, Mycobacterium
RRRGNEDDQANEEENR

SEQ ID NO: 282769 - protein, 5 aa, Mycobacterium
RRRGP

SEQ ID NO: 282770 - protein, 12 aa, Mycobacterium
RRRGRSRRRKSW

SEQ ID NO: 282771 - protein, 12 aa, Mycobacterium
RRRGRSRRRRSW

SEQ ID NO: 282772 - protein, 13 aa, Mycobacterium
RRRGTGPDERLDA

SEQ ID NO: 282773 - protein, 31 aa, Mycobacterium
RRRKDPPKDQPAGTRDGVHSERGGVASEDDS

SEQ ID NO: 282774 - protein, 15 aa, Mycobacterium
RRRKGAGDPQLANDP

SEQ ID NO: 282775 - protein, 9 aa, Mycobacterium
RRRKRREAE

SEQ ID NO: 282776 - protein, 8 aa, Mycobacterium
RRRKTPAA

SEQ ID NO: 282777 - protein, 7 aa, Mycobacterium
RRRNERI

SEQ ID NO: 282778 - protein, 19 aa, Mycobacterium
RRRNQRQRNDSDEPRVSKT

SEQ ID NO: 282779 - protein, 7 aa, Mycobacterium
RRRPAAK

SEQ ID NO: 282780 - protein, 21 aa, Mycobacterium
RRRPAKRKPLLPDDQKSPAWA

SEQ ID NO: 282781 - protein, 7 aa, Mycobacterium
RRRPAQS

SEQ ID NO: 282782 - protein, 14 aa, Mycobacterium
RRRPASQQQRRKIS

SEQ ID NO: 282783 - protein, 10 aa, Mycobacterium
RRRPDGGAAR

SEQ ID NO: 282784 - protein, 10 aa, Mycobacterium
RRRPDSWPSQ

SEQ ID NO: 282785 - protein, 7 aa, Mycobacterium
RRRPELS

SEQ ID NO: 282786 - protein, 8 aa, Mycobacterium
RRRPGSAE

SEQ ID NO: 282787 - protein, 9 aa, Mycobacterium
RRRPGTGED

SEQ ID NO: 282788 - protein, 6 aa, Mycobacterium
RRRPPA

SEQ ID NO: 282789 - protein, 10 aa, Mycobacterium
RRRPPRTRGR

SEQ ID NO: 282790 - protein, 18 aa, Mycobacterium
RRRPRRPKPRPAPPVEAD

SEQ ID NO: 282791 - protein, 7 aa, Mycobacterium
RRRPSAA

SEQ ID NO: 282792 - protein, 7 aa, Mycobacterium
RRRPSHE

SEQ ID NO: 282793 - protein, 12 aa, Mycobacterium
RRRPTSDDGEGA

SEQ ID NO: 282794 - protein, 6 aa, Mycobacterium
RRRQAI

SEQ ID NO: 282795 - protein, 7 aa, Mycobacterium
RRRQAIP

SEQ ID NO: 282796 - protein, 6 aa, Mycobacterium
RRRRAA

SEQ ID NO: 282797 - protein, 26 aa, Mycobacterium
RRRRAPGSVAGHGDSLPQALSTADAR

SEQ ID NO: 282798 - protein, 9 aa, Mycobacterium
RRRRAPRAD

SEQ ID NO: 282799 - protein, 6 aa, Mycobacterium
RRRRAQ

SEQ ID NO: 282800 - protein, 10 aa, Mycobacterium
RRRRARAGSI

SEQ ID NO: 282801 - protein, 7 aa, Mycobacterium
RRRRARR

SEQ ID NO: 282802 - protein, 9 aa, Mycobacterium
RRRRDREQL

SEQ ID NO: 282803 - protein, 20 aa, Mycobacterium
RRRRGIDTSGGQVDPEGQSL

SEQ ID NO: 282804 - protein, 16 aa, Mycobacterium
RRRRNASALATRSAQP

SEQ ID NO: 282805 - protein, 16 aa, Mycobacterium
RRRRPRVRRRLGVSRP

SEQ ID NO: 282806 - protein, 14 aa, Mycobacterium
RRRRRRAAGVSSER

SEQ ID NO: 282807 - protein, 9 aa, Mycobacterium
RRRRSPRAE

SEQ ID NO: 282808 - protein, 9 aa, Mycobacterium
RRRRSPRRR

SEQ ID NO: 282809 - protein, 17 aa, Mycobacterium
RRRRTSHSPPAQSSDHG

SEQ ID NO: 282810 - protein, 28 aa, Mycobacterium
RRRSDRRDAEAISQSLGGGLDPGEVDEI

SEQ ID NO: 282811 - protein, 11 aa, Mycobacterium
RRRSGTQTRFP

SEQ ID NO: 282812 - protein, 23 aa, Mycobacterium
RRRSKSQAGLRPEDLQAALLRLV

SEQ ID NO: 282813 - protein, 12 aa, Mycobacterium
RRRSRGHRRKSW

SEQ ID NO: 282814 - protein, 6 aa, Mycobacterium
RRRSRR

SEQ ID NO: 282815 - protein, 11 aa, Mycobacterium
RRRSRVNPDGT

SEQ ID NO: 282816 - protein, 5 aa, Mycobacterium
RRRSY

SEQ ID NO: 282817 - protein, 11 aa, Mycobacterium
RRRTGQPDAYE

SEQ ID NO: 282818 - protein, 10 aa, Mycobacterium
RRRTGSDVSQ

SEQ ID NO: 282819 - protein, 9 aa, Mycobacterium
RRRTGTEVQ

SEQ ID NO: 282820 - protein, 12 aa, Mycobacterium
RRRTPEPGERTT

SEQ ID NO: 282821 - protein, 23 aa, Mycobacterium
RRRTRPQHAGTDDFDEPHRRHPN

SEQ ID NO: 282822 - protein, 13 aa, Mycobacterium
RRRTRRAVTSARS

SEQ ID NO: 282823 - protein, 7 aa, Mycobacterium
RRSADSG

SEQ ID NO: 282824 - protein, 5 aa, Mycobacterium
RRSAP

SEQ ID NO: 282825 - protein, 17 aa, Mycobacterium
RRSARPSAGAEPTAKPS

SEQ ID NO: 282826 - protein, 12 aa, Mycobacterium
RRSASREGDSTS

SEQ ID NO: 282827 - protein, 44 aa, Mycobacterium
RRSATQTKRPGRPRRRQRRTGQPGPARGGAAVPSEAETTQFRSP

SEQ ID NO: 282828 - protein, 20 aa, Mycobacterium
RRSATSGDSADTISDQAGQG

SEQ ID NO: 282829 - protein, 20 aa, Mycobacterium
RRSATSPEVSHAVAEPADPG

SEQ ID NO: 282830 - protein, 17 aa, Mycobacterium
RRSDGPPRIVVHPNGDP

SEQ ID NO: 282831 - protein, 4 aa, Mycobacterium
RRSE

SEQ ID NO: 282832 - protein, 28 aa, Mycobacterium
RRSEANPAGQGAGGAASRVRKNRAAGSF

SEQ ID NO: 282833 - protein, 16 aa, Mycobacterium
RRSEAQGRDADHVPPG

SEQ ID NO: 282834 - protein, 8 aa, Mycobacterium
RRSEKSRL

SEQ ID NO: 282835 - protein, 15 aa, Mycobacterium
RRSESADRPTSPVRA

SEQ ID NO: 282836 - protein, 29 aa, Mycobacterium
RRSGADGAAGYAPDQGYDAPWGPEDPDLA

SEQ ID NO: 282837 - protein, 8 aa, Mycobacterium
RRSGADPE

SEQ ID NO: 282838 - protein, 6 aa, Mycobacterium
RRSGAR

SEQ ID NO: 282839 - protein, 7 aa, Mycobacterium
RRSGAYT

SEQ ID NO: 282840 - protein, 8 aa, Mycobacterium
RRSGAYTV

SEQ ID NO: 282841 - protein, 7 aa, Mycobacterium
RRSGNRR

SEQ ID NO: 282842 - protein, 11 aa, Mycobacterium
RRSGPPSAQAR

SEQ ID NO: 282843 - protein, 15 aa, Mycobacterium
RRSGPTQSPPQKAHT

SEQ ID NO: 282844 - protein, 11 aa, Mycobacterium
RRSGPTVEVSA

SEQ ID NO: 282845 - protein, 12 aa, Mycobacterium
RRSGSGKPTGLT

SEQ ID NO: 282846 - protein, 12 aa, Mycobacterium
RRSGTDPATEVR

SEQ ID NO: 282847 - protein, 6 aa, Mycobacterium
RRSHAA

SEQ ID NO: 282848 - protein, 6 aa, Mycobacterium
RRSKAA

SEQ ID NO: 282849 - protein, 66 aa, Mycobacterium
RRSKAADESESAGRPTGETAPDDEADPDSPPGEGGDQTPPQHGGDYTPLHEGGRGPSRNFGRHRGA

SEQ ID NO: 282850 - protein, 8 aa, Mycobacterium
RRSKNTHA

SEQ ID NO: 282851 - protein, 14 aa, Mycobacterium
RRSKVRTARRGERV

SEQ ID NO: 282852 - protein, 8 aa, Mycobacterium
RRSLSGAE

SEQ ID NO: 282853 - protein, 18 aa, Mycobacterium
RRSMPSYDHEPVREPAVT

SEQ ID NO: 282854 - protein, 4 aa, Mycobacterium
RRSN

SEQ ID NO: 282855 - protein, 4 aa, Mycobacterium
RRSP

SEQ ID NO: 282856 - protein, 6 aa, Mycobacterium
RRSPDR

SEQ ID NO: 282857 - protein, 8 aa, Mycobacterium
RRSPENGQ

SEQ ID NO: 282858 - protein, 8 aa, Mycobacterium
RRSPRARR

SEQ ID NO: 282859 - protein, 7 aa, Mycobacterium
RRSPRPE

SEQ ID NO: 282860 - protein, 7 aa, Mycobacterium
RRSPTMT

SEQ ID NO: 282861 - protein, 8 aa, Mycobacterium
RRSQRQTE

SEQ ID NO: 282862 - protein, 6 aa, Mycobacterium
RRSRAG

SEQ ID NO: 282863 - protein, 8 aa, Mycobacterium
RRSRGGGT

SEQ ID NO: 282864 - protein, 8 aa, Mycobacterium
RRSRGGGV

SEQ ID NO: 282865 - protein, 5 aa, Mycobacterium
RRSRH

SEQ ID NO: 282866 - protein, 9 aa, Mycobacterium
RRSRIDATD

SEQ ID NO: 282867 - protein, 9 aa, Mycobacterium
RRSRIDATN

SEQ ID NO: 282868 - protein, 12 aa, Mycobacterium
RRSRKGPAPMEA

SEQ ID NO: 282869 - protein, 10 aa, Mycobacterium
RRSRSAPATA

SEQ ID NO: 282870 - protein, 10 aa, Mycobacterium
RRSRVESEEL

SEQ ID NO: 282871 - protein, 7 aa, Mycobacterium
RRSSRLA

SEQ ID NO: 282872 - protein, 5 aa, Mycobacterium
RRSTA

SEQ ID NO: 282873 - protein, 6 aa, Mycobacterium
RRSTGG

SEQ ID NO: 282874 - protein, 17 aa, Mycobacterium
RRSTREKDGITEISAEK

SEQ ID NO: 282875 - protein, 10 aa, Mycobacterium
RRSTRGPAPM

SEQ ID NO: 282876 - protein, 16 aa, Mycobacterium
RRSVSQSADLSSHGET

SEQ ID NO: 282877 - protein, 11 aa, Mycobacterium
RRTAADARPSL

SEQ ID NO: 282878 - protein, 11 aa, Mycobacterium
RRTAGGDQDPL

SEQ ID NO: 282879 - protein, 17 aa, Mycobacterium
RRTAKTAAALPRHPGGR

SEQ ID NO: 282880 - protein, 24 aa, Mycobacterium
RRTATTPPFGRRDTTTAGDAVEQR

SEQ ID NO: 282881 - protein, 7 aa, Mycobacterium
RRTDAAE

SEQ ID NO: 282882 - protein, 13 aa, Mycobacterium
RRTDDVNGLTSTN

SEQ ID NO: 282883 - protein, 6 aa, Mycobacterium
RRTEDG

SEQ ID NO: 282884 - protein, 15 aa, Mycobacterium
RRTESTAPTAETEAR

SEQ ID NO: 282885 - protein, 16 aa, Mycobacterium
RRTGDTPAGAATDSAA

SEQ ID NO: 282886 - protein, 9 aa, Mycobacterium
RRTGEKRRL

SEQ ID NO: 282887 - protein, 11 aa, Mycobacterium
RRTGGQPLRTA

SEQ ID NO: 282888 - protein, 17 aa, Mycobacterium
RRTGPAAGHRSDPDFRR

SEQ ID NO: 282889 - protein, 8 aa, Mycobacterium
RRTGREPT

SEQ ID NO: 282890 - protein, 9 aa, Mycobacterium
RRTGRKRTF

SEQ ID NO: 282891 - protein, 8 aa, Mycobacterium
RRTHLSTT

SEQ ID NO: 282892 - protein, 5 aa, Mycobacterium
RRTKG

SEQ ID NO: 282893 - protein, 75 aa, Mycobacterium
RRTPASRAAGERAEADAESGQELTETTAAETSTETARPNEKADAKPAASNKPAPGARPVRPTATKRPTGKRNAGR

SEQ ID NO: 282894 - protein, 6 aa, Mycobacterium
RRTPEE

SEQ ID NO: 282895 - protein, 8 aa, Mycobacterium
RRTPGSPN

SEQ ID NO: 282896 - protein, 9 aa, Mycobacterium
RRTPPPADV

SEQ ID NO: 282897 - protein, 17 aa, Mycobacterium
RRTPPPRPATLSVPSGT

SEQ ID NO: 282898 - protein, 17 aa, Mycobacterium
RRTPRTDTPPPAMAPRR

SEQ ID NO: 282899 - protein, 4 aa, Mycobacterium
RRTQ

SEQ ID NO: 282900 - protein, 14 aa, Mycobacterium
RRTQPAPTDDPATL

SEQ ID NO: 282901 - protein, 9 aa, Mycobacterium
RRTQPPKPV

SEQ ID NO: 282902 - protein, 19 aa, Mycobacterium
RRTRAGTAVDDTVDQTADE

SEQ ID NO: 282903 - protein, 6 aa, Mycobacterium
RRTRED

SEQ ID NO: 282904 - protein, 6 aa, Mycobacterium
RRTRGL

SEQ ID NO: 282905 - protein, 5 aa, Mycobacterium
RRTRR

SEQ ID NO: 282906 - protein, 8 aa, Mycobacterium
RRTRRPAA

SEQ ID NO: 282907 - protein, 12 aa, Mycobacterium
RRTRRRAPVPAV

SEQ ID NO: 282908 - protein, 5 aa, Mycobacterium
RRTSA

SEQ ID NO: 282909 - protein, 7 aa, Mycobacterium
RRTSGRL

SEQ ID NO: 282910 - protein, 7 aa, Mycobacterium
RRTSPTV

SEQ ID NO: 282911 - protein, 14 aa, Mycobacterium
RRTSQQPGPPQNRV

SEQ ID NO: 282912 - protein, 15 aa, Mycobacterium
RRTTSPLSEEIGSAK

SEQ ID NO: 282913 - protein, 4 aa, Mycobacterium
RRTV

SEQ ID NO: 282914 - protein, 9 aa, Mycobacterium
RRVDESLEG

SEQ ID NO: 282915 - protein, 13 aa, Mycobacterium
RRVDGAVGGQPRR

SEQ ID NO: 282916 - protein, 11 aa, Mycobacterium
RRVDPTDPRAL

SEQ ID NO: 282917 - protein, 9 aa, Mycobacterium
RRVDPTDQR

SEQ ID NO: 282918 - protein, 8 aa, Mycobacterium
RRVDPTDV

SEQ ID NO: 282919 - protein, 5 aa, Mycobacterium
RRVGP

SEQ ID NO: 282920 - protein, 5 aa, Mycobacterium
RRVNT

SEQ ID NO: 282921 - protein, 14 aa, Mycobacterium
RRVPERDPRTEVGR

SEQ ID NO: 282922 - protein, 10 aa, Mycobacterium
RRVPPGSVAP

SEQ ID NO: 282923 - protein, 23 aa, Mycobacterium
RRVRPRGERPVRRPQPGRPGGAA

SEQ ID NO: 282924 - protein, 4 aa, Mycobacterium
RRVT

SEQ ID NO: 282925 - protein, 13 aa, Mycobacterium
RRYDDLGGQEHGV

SEQ ID NO: 282926 - protein, 7 aa, Mycobacterium
RRYGTRE

SEQ ID NO: 282927 - protein, 9 aa, Mycobacterium
RRYTPAGGA

SEQ ID NO: 282928 - protein, 9 aa, Mycobacterium
RRYTPPGGA

SEQ ID NO: 282929 - protein, 8 aa, Mycobacterium
RRYTSAGG

SEQ ID NO: 282930 - protein, 8 aa, Mycobacterium
RSAAGPDA

SEQ ID NO: 282931 - protein, 14 aa, Mycobacterium
RSAAPVPERAERVR

SEQ ID NO: 282932 - protein, 23 aa, Mycobacterium
RSAARKQASIGYSPGYPPPPGYL

SEQ ID NO: 282933 - protein, 6 aa, Mycobacterium
RSAARR

SEQ ID NO: 282934 - protein, 8 aa, Mycobacterium
RSAASPQI

SEQ ID NO: 282935 - protein, 5 aa, Mycobacterium
RSAAV

SEQ ID NO: 282936 - protein, 4 aa, Mycobacterium
RSAD

SEQ ID NO: 282937 - protein, 17 aa, Mycobacterium
RSADAERTAATDAASAY

SEQ ID NO: 282938 - protein, 9 aa, Mycobacterium
RSADEEGEY

SEQ ID NO: 282939 - protein, 7 aa, Mycobacterium
RSADGRA

SEQ ID NO: 282940 - protein, 14 aa, Mycobacterium
RSADNTSAERKPTG

SEQ ID NO: 282941 - protein, 22 aa, Mycobacterium
RSAEPDAKVYRTGDRVRQRADG

SEQ ID NO: 282942 - protein, 10 aa, Mycobacterium
RSAEPTIPPA

SEQ ID NO: 282943 - protein, 6 aa, Mycobacterium
RSAEQK

SEQ ID NO: 282944 - protein, 9 aa, Mycobacterium
RSAFEATTG

SEQ ID NO: 282945 - protein, 10 aa, Mycobacterium
RSAFGAPPAR

SEQ ID NO: 282946 - protein, 4 aa, Mycobacterium
RSAG

SEQ ID NO: 282947 - protein, 6 aa, Mycobacterium
RSAGAD

SEQ ID NO: 282948 - protein, 59 aa, Mycobacterium
RSAGAEPVEEAKATGDEAAADAAAPAASDKPAPSKPAPGARPVRPTGTRRPSGKRNAGR

SEQ ID NO: 282949 - protein, 8 aa, Mycobacterium
RSAGDSCA

SEQ ID NO: 282950 - protein, 15 aa, Mycobacterium
RSAGESGMTTAGSTL

SEQ ID NO: 282951 - protein, 5 aa, Mycobacterium
RSAGR

SEQ ID NO: 282952 - protein, 7 aa, Mycobacterium
RSAGRRR

SEQ ID NO: 282953 - protein, 14 aa, Mycobacterium
RSAGTEPADQINPA

SEQ ID NO: 282954 - protein, 10 aa, Mycobacterium
RSAGVPAGDR

SEQ ID NO: 282955 - protein, 17 aa, Mycobacterium
RSAIGNPANPTFPPDGI

SEQ ID NO: 282956 - protein, 8 aa, Mycobacterium
RSAKERPR

SEQ ID NO: 282957 - protein, 10 aa, Mycobacterium
RSAKQSEATV

SEQ ID NO: 282958 - protein, 7 aa, Mycobacterium
RSALPAH

SEQ ID NO: 282959 - protein, 4 aa, Mycobacterium
RSAN

SEQ ID NO: 282960 - protein, 12 aa, Mycobacterium
RSANVDAASLLR

SEQ ID NO: 282961 - protein, 13 aa, Mycobacterium
RSAPAAVTPVAET

SEQ ID NO: 282962 - protein, 5 aa, Mycobacterium
RSAPN

SEQ ID NO: 282963 - protein, 13 aa, Mycobacterium
RSAPPHTRGTRGV

SEQ ID NO: 282964 - protein, 9 aa, Mycobacterium
RSAPPPGVQ

SEQ ID NO: 282965 - protein, 9 aa, Mycobacterium
RSAPQIDRE

SEQ ID NO: 282966 - protein, 8 aa, Mycobacterium
RSAPSDTA

SEQ ID NO: 282967 - protein, 9 aa, Mycobacterium
RSAPTRDLT

SEQ ID NO: 282968 - protein, 15 aa, Mycobacterium
RSAPVPRRAVPPDDR

SEQ ID NO: 282969 - protein, 4 aa, Mycobacterium
RSAQ

SEQ ID NO: 282970 - protein, 10 aa, Mycobacterium
RSAQEITDKE

SEQ ID NO: 282971 - protein, 10 aa, Mycobacterium
RSAQEITDKQ

SEQ ID NO: 282972 - protein, 10 aa, Mycobacterium
RSAQEITDQP

SEQ ID NO: 282973 - protein, 11 aa, Mycobacterium
RSAQEVTDKPV

SEQ ID NO: 282974 - protein, 9 aa, Mycobacterium
RSAQEVTDR

SEQ ID NO: 282975 - protein, 10 aa, Mycobacterium
RSAQKPGRTV

SEQ ID NO: 282976 - protein, 8 aa, Mycobacterium
RSAQQRSD

SEQ ID NO: 282977 - protein, 7 aa, Mycobacterium
RSARQQP

SEQ ID NO: 282978 - protein, 12 aa, Mycobacterium
RSARRESLPPSA

SEQ ID NO: 282979 - protein, 7 aa, Mycobacterium
RSARSDA

SEQ ID NO: 282980 - protein, 5 aa, Mycobacterium
RSART

SEQ ID NO: 282981 - protein, 8 aa, Mycobacterium
RSARTGTA

SEQ ID NO: 282982 - protein, 4 aa, Mycobacterium
RSAS

SEQ ID NO: 282983 - protein, 7 aa, Mycobacterium
RSASRER

SEQ ID NO: 282984 - protein, 7 aa, Mycobacterium
RSASSDS

SEQ ID NO: 282985 - protein, 9 aa, Mycobacterium
RSASSGSAL

SEQ ID NO: 282986 - protein, 8 aa, Mycobacterium
RSASSTQE

SEQ ID NO: 282987 - protein, 11 aa, Mycobacterium
RSASTTARPPL

SEQ ID NO: 282988 - protein, 12 aa, Mycobacterium
RSASVDDADVLK

SEQ ID NO: 282989 - protein, 12 aa, Mycobacterium
RSASVDDANLLK

SEQ ID NO: 282990 - protein, 10 aa, Mycobacterium
RSATDSVQGI

SEQ ID NO: 282991 - protein, 6 aa, Mycobacterium
RSATRL

SEQ ID NO: 282992 - protein, 22 aa, Mycobacterium
RSATSGGPTAAHAARPRPSSNK

SEQ ID NO: 282993 - protein, 29 aa, Mycobacterium
RSATVTAREDLAGDPARRSAHRHGASSRR

SEQ ID NO: 282994 - protein, 17 aa, Mycobacterium
RSAVAGADRCEPDQSDL

SEQ ID NO: 282995 - protein, 6 aa, Mycobacterium
RSAVPE

SEQ ID NO: 282996 - protein, 10 aa, Mycobacterium
RSAVSQVPPT

SEQ ID NO: 282997 - protein, 13 aa, Mycobacterium
RSAVTGAHAPLSS

SEQ ID NO: 282998 - protein, 8 aa, Mycobacterium
RSAVTGEH

SEQ ID NO: 282999 - protein, 20 aa, Mycobacterium
RSCDRDSTGSSSDASSRAKA

SEQ ID NO: 283000 - protein, 13 aa, Mycobacterium
RSDAVDKPDLEGA

SEQ ID NO: 283001 - protein, 10 aa, Mycobacterium
RSDDAASVAD

SEQ ID NO: 283002 - protein, 6 aa, Mycobacterium
RSDDQI

SEQ ID NO: 283003 - protein, 10 aa, Mycobacterium
RSDDRTARRL

SEQ ID NO: 283004 - protein, 5 aa, Mycobacterium
RSDDT

SEQ ID NO: 283005 - protein, 10 aa, Mycobacterium
RSDEGERFSD

SEQ ID NO: 283006 - protein, 22 aa, Mycobacterium
RSDERLARRQDRAADRDDDADL

SEQ ID NO: 283007 - protein, 23 aa, Mycobacterium
RSDETNGAAKSSTVIPTPSTTPW

SEQ ID NO: 283008 - protein, 4 aa, Mycobacterium
RSDG

SEQ ID NO: 283009 - protein, 10 aa, Mycobacterium
RSDGDSTRVL

SEQ ID NO: 283010 - protein, 5 aa, Mycobacterium
RSDGE

SEQ ID NO: 283011 - protein, 14 aa, Mycobacterium
RSDGGPPVLEGPAS

SEQ ID NO: 283012 - protein, 8 aa, Mycobacterium
RSDGNSTY

SEQ ID NO: 283013 - protein, 8 aa, Mycobacterium
RSDLSDPI

SEQ ID NO: 283014 - protein, 9 aa, Mycobacterium
RSDNGPSMR

SEQ ID NO: 283015 - protein, 5 aa, Mycobacterium
RSDNP

SEQ ID NO: 283016 - protein, 6 aa, Mycobacterium
RSDPAR

SEQ ID NO: 283017 - protein, 21 aa, Mycobacterium
RSDPDGTSLEPTRASGTPVPY

SEQ ID NO: 283018 - protein, 7 aa, Mycobacterium
RSDPSFD

SEQ ID NO: 283019 - protein, 9 aa, Mycobacterium
RSDPTLSDT

SEQ ID NO: 283020 - protein, 7 aa, Mycobacterium
RSDPTSL

SEQ ID NO: 283021 - protein, 5 aa, Mycobacterium
RSDRR

SEQ ID NO: 283022 - protein, 5 aa, Mycobacterium
RSDSA

SEQ ID NO: 283023 - protein, 13 aa, Mycobacterium
RSDTGSAFSRQTF

SEQ ID NO: 283024 - protein, 21 aa, Mycobacterium
RSDTSSSARSVAAPPRRHSGA

SEQ ID NO: 283025 - protein, 6 aa, Mycobacterium
RSDVGG

SEQ ID NO: 283026 - protein, 10 aa, Mycobacterium
RSEAETSRHQ

SEQ ID NO: 283027 - protein, 22 aa, Mycobacterium
RSEAQKRMPDKADEPSGLGEPV

SEQ ID NO: 283028 - protein, 10 aa, Mycobacterium
RSEATKHRQA

SEQ ID NO: 283029 - protein, 10 aa, Mycobacterium
RSEDGDSFSD

SEQ ID NO: 283030 - protein, 13 aa, Mycobacterium
RSEERDAADQFGP

SEQ ID NO: 283031 - protein, 7 aa, Mycobacterium
RSEGARR

SEQ ID NO: 283032 - protein, 23 aa, Mycobacterium
RSEGPAVETPAASTGEPSGQQPS

SEQ ID NO: 283033 - protein, 8 aa, Mycobacterium
RSEGPRPV

SEQ ID NO: 283034 - protein, 12 aa, Mycobacterium
RSEHSQGSFTAG

SEQ ID NO: 283035 - protein, 5 aa, Mycobacterium
RSELT

SEQ ID NO: 283036 - protein, 17 aa, Mycobacterium
RSEMTPTDDEARAVDTA

SEQ ID NO: 283037 - protein, 8 aa, Mycobacterium
RSENIGAA

SEQ ID NO: 283038 - protein, 13 aa, Mycobacterium
RSEPGTRPDPGQS

SEQ ID NO: 283039 - protein, 12 aa, Mycobacterium
RSEPKKATGLDG

SEQ ID NO: 283040 - protein, 8 aa, Mycobacterium
RSEPSTGE

SEQ ID NO: 283041 - protein, 7 aa, Mycobacterium
RSEQPIK

SEQ ID NO: 283042 - protein, 37 aa, Mycobacterium
RSEQRDSGALESTRDRLSSEVAGARRSQLEGNEQGKE

SEQ ID NO: 283043 - protein, 4 aa, Mycobacterium
RSER

SEQ ID NO: 283044 - protein, 18 aa, Mycobacterium
RSETASAAAPVAASPGRH

SEQ ID NO: 283045 - protein, 7 aa, Mycobacterium
RSEVTRT

SEQ ID NO: 283046 - protein, 5 aa, Mycobacterium
RSFGR

SEQ ID NO: 283047 - protein, 13 aa, Mycobacterium
RSFSASVSDTELS

SEQ ID NO: 283048 - protein, 12 aa, Mycobacterium
RSFSASVTGTEL

SEQ ID NO: 283049 - protein, 17 aa, Mycobacterium
RSFTSRTPVNDNPDKVE

SEQ ID NO: 283050 - protein, 4 aa, Mycobacterium
RSGA

SEQ ID NO: 283051 - protein, 5 aa, Mycobacterium
RSGAA

SEQ ID NO: 283052 - protein, 9 aa, Mycobacterium
RSGAAETRR

SEQ ID NO: 283053 - protein, 7 aa, Mycobacterium
RSGAATR

SEQ ID NO: 283054 - protein, 39 aa, Mycobacterium
RSGADRSAGQTGPSDGAVGGNSSKFDSNRRVDDHVHRSP

SEQ ID NO: 283055 - protein, 10 aa, Mycobacterium
RSGAPNGIDE

SEQ ID NO: 283056 - protein, 7 aa, Mycobacterium
RSGARTR

SEQ ID NO: 283057 - protein, 4 aa, Mycobacterium
RSGD

SEQ ID NO: 283058 - protein, 12 aa, Mycobacterium
RSGDAGRRLPNG

SEQ ID NO: 283059 - protein, 7 aa, Mycobacterium
RSGDDAA

SEQ ID NO: 283060 - protein, 6 aa, Mycobacterium
RSGDDI

SEQ ID NO: 283061 - protein, 8 aa, Mycobacterium
RSGDDIRS

SEQ ID NO: 283062 - protein, 7 aa, Mycobacterium
RSGDERI

SEQ ID NO: 283063 - protein, 7 aa, Mycobacterium
RSGDETH

SEQ ID NO: 283064 - protein, 6 aa, Mycobacterium
RSGDKS

SEQ ID NO: 283065 - protein, 10 aa, Mycobacterium
RSGDNIRGSV

SEQ ID NO: 283066 - protein, 17 aa, Mycobacterium
RSGDPRPLGKAASAVGG

SEQ ID NO: 283067 - protein, 8 aa, Mycobacterium
RSGDRARA

SEQ ID NO: 283068 - protein, 10 aa, Mycobacterium
RSGDTAPVSC

SEQ ID NO: 283069 - protein, 4 aa, Mycobacterium
RSGE

SEQ ID NO: 283070 - protein, 9 aa, Mycobacterium
RSGEATATM

SEQ ID NO: 283071 - protein, 7 aa, Mycobacterium
RSGEERA

SEQ ID NO: 283072 - protein, 5 aa, Mycobacterium
RSGER

SEQ ID NO: 283073 - protein, 7 aa, Mycobacterium
RSGERTQ

SEQ ID NO: 283074 - protein, 7 aa, Mycobacterium
RSGGADV

SEQ ID NO: 283075 - protein, 12 aa, Mycobacterium
RSGGAERPAGSV

SEQ ID NO: 283076 - protein, 7 aa, Mycobacterium
RSGGAIN

SEQ ID NO: 283077 - protein, 7 aa, Mycobacterium
RSGGATR

SEQ ID NO: 283078 - protein, 11 aa, Mycobacterium
RSGGEPHAARA

SEQ ID NO: 283079 - protein, 12 aa, Mycobacterium
RSGGGGLTPSDI

SEQ ID NO: 283080 - protein, 15 aa, Mycobacterium
RSGGGPATLEGPASV

SEQ ID NO: 283081 - protein, 10 aa, Mycobacterium
RSGGNKEKTG

SEQ ID NO: 283082 - protein, 8 aa, Mycobacterium
RSGGPESL

SEQ ID NO: 283083 - protein, 7 aa, Mycobacterium
RSGGPFA

SEQ ID NO: 283084 - protein, 4 aa, Mycobacterium
RSGH

SEQ ID NO: 283085 - protein, 12 aa, Mycobacterium
RSGHLGRLPWRH

SEQ ID NO: 283086 - protein, 7 aa, Mycobacterium
RSGHRAD

SEQ ID NO: 283087 - protein, 6 aa, Mycobacterium
RSGHVA

SEQ ID NO: 283088 - protein, 16 aa, Mycobacterium
RSGIEARAKTGDSRDR

SEQ ID NO: 283089 - protein, 6 aa, Mycobacterium
RSGKPV

SEQ ID NO: 283090 - protein, 13 aa, Mycobacterium
RSGKRPAPKASRH

SEQ ID NO: 283091 - protein, 8 aa, Mycobacterium
RSGKTGEI

SEQ ID NO: 283092 - protein, 4 aa, Mycobacterium
RSGL

SEQ ID NO: 283093 - protein, 6 aa, Mycobacterium
RSGLEG

SEQ ID NO: 283094 - protein, 5 aa, Mycobacterium
RSGLT

SEQ ID NO: 283095 - protein, 6 aa, Mycobacterium
RSGLTG

SEQ ID NO: 283096 - protein, 5 aa, Mycobacterium
RSGME

SEQ ID NO: 283097 - protein, 15 aa, Mycobacterium
RSGNYGGTGDYTSGT

SEQ ID NO: 283098 - protein, 4 aa, Mycobacterium
RSGP

SEQ ID NO: 283099 - protein, 52 aa, Mycobacterium
RSGPAAGHRSDPDWQPPEDSADTDLDEEHDLAENGDDRETDDDADTDELSRR

SEQ ID NO: 283100 - protein, 40 aa, Mycobacterium
RSGPAAGHRSDPNWTPPEESAESELDLPEGEDEEHDTEEL

SEQ ID NO: 283101 - protein, 15 aa, Mycobacterium
RSGPAGSRDAAGDGA

SEQ ID NO: 283102 - protein, 7 aa, Mycobacterium
RSGPEDH

SEQ ID NO: 283103 - protein, 12 aa, Mycobacterium
RSGPSQRSFAAG

SEQ ID NO: 283104 - protein, 6 aa, Mycobacterium
RSGQAV

SEQ ID NO: 283105 - protein, 23 aa, Mycobacterium
RSGQGPSLKDGDVIPSSRTRVPT

SEQ ID NO: 283106 - protein, 19 aa, Mycobacterium
RSGQPEPSPLAPSVDPQPQ

SEQ ID NO: 283107 - protein, 9 aa, Mycobacterium
RSGRAGTDT

SEQ ID NO: 283108 - protein, 8 aa, Mycobacterium
RSGRIARQ

SEQ ID NO: 283109 - protein, 10 aa, Mycobacterium
RSGRPAPAAA

SEQ ID NO: 283110 - protein, 10 aa, Mycobacterium
RSGRQPQEAV

SEQ ID NO: 283111 - protein, 10 aa, Mycobacterium
RSGRQPREAV

SEQ ID NO: 283112 - protein, 33 aa, Mycobacterium
RSGRTVSRRTTPRCAASRTSSSDRVWRSRVRAC

SEQ ID NO: 283113 - protein, 4 aa, Mycobacterium
RSGS

SEQ ID NO: 283114 - protein, 8 aa, Mycobacterium
RSGSANTY

SEQ ID NO: 283115 - protein, 6 aa, Mycobacterium
RSGSFG

SEQ ID NO: 283116 - protein, 8 aa, Mycobacterium
RSGSGKTT

SEQ ID NO: 283117 - protein, 5 aa, Mycobacterium
RSGSL

SEQ ID NO: 283118 - protein, 9 aa, Mycobacterium
RSGSTVEEL

SEQ ID NO: 283119 - protein, 5 aa, Mycobacterium
RSGSV

SEQ ID NO: 283120 - protein, 10 aa, Mycobacterium
RSGTDPGSLL

SEQ ID NO: 283121 - protein, 7 aa, Mycobacterium
RSGTDSD

SEQ ID NO: 283122 - protein, 7 aa, Mycobacterium
RSGTETS

SEQ ID NO: 283123 - protein, 9 aa, Mycobacterium
RSGTEVARE

SEQ ID NO: 283124 - protein, 5 aa, Mycobacterium
RSGTG

SEQ ID NO: 283125 - protein, 8 aa, Mycobacterium
RSGTQQPA

SEQ ID NO: 283126 - protein, 5 aa, Mycobacterium
RSGTT

SEQ ID NO: 283127 - protein, 14 aa, Mycobacterium
RSGTTAQELPESPL

SEQ ID NO: 283128 - protein, 6 aa, Mycobacterium
RSGVPR

SEQ ID NO: 283129 - protein, 17 aa, Mycobacterium
RSGYRDVASTPEESDPL

SEQ ID NO: 283130 - protein, 5 aa, Mycobacterium
RSHAE

SEQ ID NO: 283131 - protein, 12 aa, Mycobacterium
RSHAERVAAEAS

SEQ ID NO: 283132 - protein, 10 aa, Mycobacterium
RSHGEITEEQ

SEQ ID NO: 283133 - protein, 5 aa, Mycobacterium
RSHGS

SEQ ID NO: 283134 - protein, 5 aa, Mycobacterium
RSHPA

SEQ ID NO: 283135 - protein, 7 aa, Mycobacterium
RSHPAPL

SEQ ID NO: 283136 - protein, 5 aa, Mycobacterium
RSHPV

SEQ ID NO: 283137 - protein, 8 aa, Mycobacterium
RSHSDAST

SEQ ID NO: 283138 - protein, 12 aa, Mycobacterium
RSHTDQTLDGPG

SEQ ID NO: 283139 - protein, 6 aa, Mycobacterium
RSIAGR

SEQ ID NO: 283140 - protein, 8 aa, Mycobacterium
RSIDPVNG

SEQ ID NO: 283141 - protein, 6 aa, Mycobacterium
RSIDSS

SEQ ID NO: 283142 - protein, 11 aa, Mycobacterium
RSIEPEQEKKR

SEQ ID NO: 283143 - protein, 6 aa, Mycobacterium
RSIGPD

SEQ ID NO: 283144 - protein, 9 aa, Mycobacterium
RSIGQSTGQ

SEQ ID NO: 283145 - protein, 6 aa, Mycobacterium
RSIKPN

SEQ ID NO: 283146 - protein, 9 aa, Mycobacterium
RSINRRDEA

SEQ ID NO: 283147 - protein, 5 aa, Mycobacterium
RSIRE

SEQ ID NO: 283148 - protein, 9 aa, Mycobacterium
RSKAPGDKV

SEQ ID NO: 283149 - protein, 11 aa, Mycobacterium
RSKDGSETGRR

SEQ ID NO: 283150 - protein, 9 aa, Mycobacterium
RSKGASAGS

SEQ ID NO: 283151 - protein, 12 aa, Mycobacterium
RSKGPAAARNTG

SEQ ID NO: 283152 - protein, 15 aa, Mycobacterium
RSKPHSSDQQTQAAP

SEQ ID NO: 283153 - protein, 17 aa, Mycobacterium
RSKQTYDYTPSPQPPDV

SEQ ID NO: 283154 - protein, 4 aa, Mycobacterium
RSKT

SEQ ID NO: 283155 - protein, 15 aa, Mycobacterium
RSKTGAGPINFDGGK

SEQ ID NO: 283156 - protein, 12 aa, Mycobacterium
RSKTMDDGATMD

SEQ ID NO: 283157 - protein, 6 aa, Mycobacterium
RSKTPL

SEQ ID NO: 283158 - protein, 22 aa, Mycobacterium
RSKYTAKQQGQTLPVGRPEQDV

SEQ ID NO: 283159 - protein, 9 aa, Mycobacterium
RSLAQRRGE

SEQ ID NO: 283160 - protein, 8 aa, Mycobacterium
RSLEEIEG

SEQ ID NO: 283161 - protein, 7 aa, Mycobacterium
RSLGGGD

SEQ ID NO: 283162 - protein, 9 aa, Mycobacterium
RSLNKRDEA

SEQ ID NO: 283163 - protein, 13 aa, Mycobacterium
RSLRTADSHGLER

SEQ ID NO: 283164 - protein, 5 aa, Mycobacterium
RSLSG

SEQ ID NO: 283165 - protein, 7 aa, Mycobacterium
RSLSGAE

SEQ ID NO: 283166 - protein, 9 aa, Mycobacterium
RSLSPGGRL

SEQ ID NO: 283167 - protein, 7 aa, Mycobacterium
RSLTGAE

SEQ ID NO: 283168 - protein, 14 aa, Mycobacterium
RSLTRDDDGQPSNR

SEQ ID NO: 283169 - protein, 8 aa, Mycobacterium
RSLTTDKY

SEQ ID NO: 283170 - protein, 4 aa, Mycobacterium
RSLV

SEQ ID NO: 283171 - protein, 22 aa, Mycobacterium
RSMAQGDYSRRIRSTSRDEVGQ

SEQ ID NO: 283172 - protein, 23 aa, Mycobacterium
RSMESTDVAPNRLGAAKEAGKEF

SEQ ID NO: 283173 - protein, 6 aa, Mycobacterium
RSMGEA

SEQ ID NO: 283174 - protein, 5 aa, Mycobacterium
RSNAE

SEQ ID NO: 283175 - protein, 8 aa, Mycobacterium
RSNAGDGA

SEQ ID NO: 283176 - protein, 37 aa, Mycobacterium
RSNAPSAAGTARISTPPQPPQPPQAPAQQAGDEPATT

SEQ ID NO: 283177 - protein, 4 aa, Mycobacterium
RSNE

SEQ ID NO: 283178 - protein, 13 aa, Mycobacterium
RSNRKPAAQRATV

SEQ ID NO: 283179 - protein, 10 aa, Mycobacterium
RSNTAAPYQL

SEQ ID NO: 283180 - protein, 10 aa, Mycobacterium
RSNTDADGSK

SEQ ID NO: 283181 - protein, 8 aa, Mycobacterium
RSNTKDEL

SEQ ID NO: 283182 - protein, 4 aa, Mycobacterium
RSPA

SEQ ID NO: 283183 - protein, 33 aa, Mycobacterium
RSPAAGAGPDEPAPSVKPGPPSALADPARDDSI

SEQ ID NO: 283184 - protein, 11 aa, Mycobacterium
RSPADDGAAQA

SEQ ID NO: 283185 - protein, 11 aa, Mycobacterium
RSPADDSAAQA

SEQ ID NO: 283186 - protein, 11 aa, Mycobacterium
RSPADESDARA

SEQ ID NO: 283187 - protein, 14 aa, Mycobacterium
RSPADTSLAPMPSG

SEQ ID NO: 283188 - protein, 10 aa, Mycobacterium
RSPAEESAAR

SEQ ID NO: 283189 - protein, 8 aa, Mycobacterium
RSPAGAAF

SEQ ID NO: 283190 - protein, 8 aa, Mycobacterium
RSPALRAD

SEQ ID NO: 283191 - protein, 9 aa, Mycobacterium
RSPAQSVGS

SEQ ID NO: 283192 - protein, 9 aa, Mycobacterium
RSPAQSVGT

SEQ ID NO: 283193 - protein, 12 aa, Mycobacterium
RSPARRATADDA

SEQ ID NO: 283194 - protein, 37 aa, Mycobacterium
RSPASRPGKAGDTSRARRSASPSRPASSPATGQTTRT

SEQ ID NO: 283195 - protein, 42 aa, Mycobacterium
RSPASRPGKAGESARGRRTTSVSRPTQAANTGPAASRNTART

SEQ ID NO: 283196 - protein, 8 aa, Mycobacterium
RSPDAPLE

SEQ ID NO: 283197 - protein, 10 aa, Mycobacterium
RSPDDPVQPA

SEQ ID NO: 283198 - protein, 6 aa, Mycobacterium
RSPDGE

SEQ ID NO: 283199 - protein, 9 aa, Mycobacterium
RSPDPPYPG

SEQ ID NO: 283200 - protein, 4 aa, Mycobacterium
RSPE

SEQ ID NO: 283201 - protein, 6 aa, Mycobacterium
RSPEHL

SEQ ID NO: 283202 - protein, 9 aa, Mycobacterium
RSPESPNGT

SEQ ID NO: 283203 - protein, 4 aa, Mycobacterium
RSPG

SEQ ID NO: 283204 - protein, 7 aa, Mycobacterium
RSPGARA

SEQ ID NO: 283205 - protein, 6 aa, Mycobacterium
RSPGPA

SEQ ID NO: 283206 - protein, 11 aa, Mycobacterium
RSPGPDSRIGQ

SEQ ID NO: 283207 - protein, 18 aa, Mycobacterium
RSPGPPTASAPPPPPPDA

SEQ ID NO: 283208 - protein, 5 aa, Mycobacterium
RSPID

SEQ ID NO: 283209 - protein, 10 aa, Mycobacterium
RSPISNTGGA

SEQ ID NO: 283210 - protein, 5 aa, Mycobacterium
RSPIT

SEQ ID NO: 283211 - protein, 8 aa, Mycobacterium
RSPKAGLA

SEQ ID NO: 283212 - protein, 7 aa, Mycobacterium
RSPKSGY

SEQ ID NO: 283213 - protein, 4 aa, Mycobacterium
RSPL

SEQ ID NO: 283214 - protein, 9 aa, Mycobacterium
RSPLPARSD

SEQ ID NO: 283215 - protein, 11 aa, Mycobacterium
RSPLVRSTDRV

SEQ ID NO: 283216 - protein, 33 aa, Mycobacterium
RSPPATPREVSAPATDGQAGRPVSAAKVPLSTA

SEQ ID NO: 283217 - protein, 6 aa, Mycobacterium
RSPPAW

SEQ ID NO: 283218 - protein, 7 aa, Mycobacterium
RSPPPDG

SEQ ID NO: 283219 - protein, 14 aa, Mycobacterium
RSPPPSKQPGNSSS

SEQ ID NO: 283220 - protein, 5 aa, Mycobacterium
RSPQF

SEQ ID NO: 283221 - protein, 19 aa, Mycobacterium
RSPQLRQERSELRSTEAAL

SEQ ID NO: 283222 - protein, 12 aa, Mycobacterium
RSPQVAKWGGTT

SEQ ID NO: 283223 - protein, 10 aa, Mycobacterium
RSPRDPGQPL

SEQ ID NO: 283224 - protein, 14 aa, Mycobacterium
RSPRFTAPGDQPPP

SEQ ID NO: 283225 - protein, 8 aa, Mycobacterium
RSPRPPQA

SEQ ID NO: 283226 - protein, 9 aa, Mycobacterium
RSPRPPQAV

SEQ ID NO: 283227 - protein, 9 aa, Mycobacterium
RSPRPPQSV

SEQ ID NO: 283228 - protein, 11 aa, Mycobacterium
RSPRRPDPSIE

SEQ ID NO: 283229 - protein, 21 aa, Mycobacterium
RSPRSFRRPEEAVPDGNDDAA

SEQ ID NO: 283230 - protein, 6 aa, Mycobacterium
RSPRSL

SEQ ID NO: 283231 - protein, 9 aa, Mycobacterium
RSPRSPNGT

SEQ ID NO: 283232 - protein, 6 aa, Mycobacterium
RSPRSR

SEQ ID NO: 283233 - protein, 6 aa, Mycobacterium
RSPRTG

SEQ ID NO: 283234 - protein, 8 aa, Mycobacterium
RSPRTGTA

SEQ ID NO: 283235 - protein, 7 aa, Mycobacterium
RSPSEQS

SEQ ID NO: 283236 - protein, 11 aa, Mycobacterium
RSPSRPPLGPG

SEQ ID NO: 283237 - protein, 6 aa, Mycobacterium
RSPSTA

SEQ ID NO: 283238 - protein, 4 aa, Mycobacterium
RSPT

SEQ ID NO: 283239 - protein, 9 aa, Mycobacterium
RSPTASGHR

SEQ ID NO: 283240 - protein, 12 aa, Mycobacterium
RSPVSNSGSAQH

SEQ ID NO: 283241 - protein, 14 aa, Mycobacterium
RSQAGGKWPPPPTE

SEQ ID NO: 283242 - protein, 8 aa, Mycobacterium
RSQDPENS

SEQ ID NO: 283243 - protein, 6 aa, Mycobacterium
RSQHTT

SEQ ID NO: 283244 - protein, 8 aa, Mycobacterium
RSQHTTAN

SEQ ID NO: 283245 - protein, 13 aa, Mycobacterium
RSQIAGSDQGRSF

SEQ ID NO: 283246 - protein, 5 aa, Mycobacterium
RSQID

SEQ ID NO: 283247 - protein, 7 aa, Mycobacterium
RSQIDPV

SEQ ID NO: 283248 - protein, 5 aa, Mycobacterium
RSQIN

SEQ ID NO: 283249 - protein, 7 aa, Mycobacterium
RSQIPTD

SEQ ID NO: 283250 - protein, 4 aa, Mycobacterium
RSQL

SEQ ID NO: 283251 - protein, 6 aa, Mycobacterium
RSQNVD

SEQ ID NO: 283252 - protein, 12 aa, Mycobacterium
RSQPALAPDGVP

SEQ ID NO: 283253 - protein, 12 aa, Mycobacterium
RSQPLDATQRSF

SEQ ID NO: 283254 - protein, 11 aa, Mycobacterium
RSQQPDATPAQ

SEQ ID NO: 283255 - protein, 6 aa, Mycobacterium
RSQRAA

SEQ ID NO: 283256 - protein, 48 aa, Mycobacterium
RSQRNTHAGQDELPESAASAAPEPAEAEKVDAPPADDPAKPESPTDLT

SEQ ID NO: 283257 - protein, 15 aa, Mycobacterium
RSQRSQHPAPRQALA

SEQ ID NO: 283258 - protein, 8 aa, Mycobacterium
RSQSQAAL

SEQ ID NO: 283259 - protein, 10 aa, Mycobacterium
RSQSSALEQI

SEQ ID NO: 283260 - protein, 20 aa, Mycobacterium
RSQSTASTDSPTVTGHSSSL

SEQ ID NO: 283261 - protein, 9 aa, Mycobacterium
RSQVDPASR

SEQ ID NO: 283262 - protein, 7 aa, Mycobacterium
RSQYGGD

SEQ ID NO: 283263 - protein, 4 aa, Mycobacterium
RSRA

SEQ ID NO: 283264 - protein, 8 aa, Mycobacterium
RSRAERME

SEQ ID NO: 283265 - protein, 5 aa, Mycobacterium
RSRAG

SEQ ID NO: 283266 - protein, 53 aa, Mycobacterium
RSRARRQTPPLPPPYHPGYPYPPPPPGYPGPYPTPPPYPGYPPRPAAGKSGTA

SEQ ID NO: 283267 - protein, 5 aa, Mycobacterium
RSRAS

SEQ ID NO: 283268 - protein, 7 aa, Mycobacterium
RSRASAR

SEQ ID NO: 283269 - protein, 6 aa, Mycobacterium
RSRASV

SEQ ID NO: 283270 - protein, 14 aa, Mycobacterium
RSRATTQIAETPAA

SEQ ID NO: 283271 - protein, 20 aa, Mycobacterium
RSRAVESAMRDGRPLPGAGV

SEQ ID NO: 283272 - protein, 8 aa, Mycobacterium
RSRDELGD

SEQ ID NO: 283273 - protein, 11 aa, Mycobacterium
RSRDGDETGRR

SEQ ID NO: 283274 - protein, 4 aa, Mycobacterium
RSRE

SEQ ID NO: 283275 - protein, 17 aa, Mycobacterium
RSRESSACEQDGSCDRP

SEQ ID NO: 283276 - protein, 4 aa, Mycobacterium
RSRG

SEQ ID NO: 283277 - protein, 6 aa, Mycobacterium
RSRGAV

SEQ ID NO: 283278 - protein, 5 aa, Mycobacterium
RSRGG

SEQ ID NO: 283279 - protein, 6 aa, Mycobacterium
RSRGGA

SEQ ID NO: 283280 - protein, 6 aa, Mycobacterium
RSRGGT

SEQ ID NO: 283281 - protein, 10 aa, Mycobacterium
RSRGLDKETQ

SEQ ID NO: 283282 - protein, 22 aa, Mycobacterium
RSRGLDMSEDDRRRWARAQSGS

SEQ ID NO: 283283 - protein, 22 aa, Mycobacterium
RSRGRGAPPQLGDSSDPRVSKT

SEQ ID NO: 283284 - protein, 6 aa, Mycobacterium
RSRHGD

SEQ ID NO: 283285 - protein, 4 aa, Mycobacterium
RSRI

SEQ ID NO: 283286 - protein, 8 aa, Mycobacterium
RSRKVEDR

SEQ ID NO: 283287 - protein, 4 aa, Mycobacterium
RSRM

SEQ ID NO: 283288 - protein, 9 aa, Mycobacterium
RSRNGDPRF

SEQ ID NO: 283289 - protein, 9 aa, Mycobacterium
RSRPKDERA

SEQ ID NO: 283290 - protein, 19 aa, Mycobacterium
RSRPQEPPTLAPSVEVAPK

SEQ ID NO: 283291 - protein, 19 aa, Mycobacterium
RSRQRENQPVATGAGGDSS

SEQ ID NO: 283292 - protein, 19 aa, Mycobacterium
RSRRAHGREQEVDRPQAGD

SEQ ID NO: 283293 - protein, 37 aa, Mycobacterium
RSRRHGNDQDPAHRAPHPVADHPRAAGGGAGRGQRPR

SEQ ID NO: 283294 - protein, 16 aa, Mycobacterium
RSRRQRKAQGNSHSDD

SEQ ID NO: 283295 - protein, 8 aa, Mycobacterium
RSRRRAEI

SEQ ID NO: 283296 - protein, 20 aa, Mycobacterium
RSRRRSPNNESDSSDPVVLP

SEQ ID NO: 283297 - protein, 14 aa, Mycobacterium
RSRRRTGTGDQLQG

SEQ ID NO: 283298 - protein, 8 aa, Mycobacterium
RSRRVESR

SEQ ID NO: 283299 - protein, 4 aa, Mycobacterium
RSRS

SEQ ID NO: 283300 - protein, 11 aa, Mycobacterium
RSRSAAGRTAV

SEQ ID NO: 283301 - protein, 22 aa, Mycobacterium
RSRSLGQGKPTARLRFYEMHVR

SEQ ID NO: 283302 - protein, 10 aa, Mycobacterium
RSRSPLDDLD

SEQ ID NO: 283303 - protein, 22 aa, Mycobacterium
RSRSTASPSVGRPAPSDSWAQV

SEQ ID NO: 283304 - protein, 6 aa, Mycobacterium
RSRTES

SEQ ID NO: 283305 - protein, 5 aa, Mycobacterium
RSRVG

SEQ ID NO: 283306 - protein, 13 aa, Mycobacterium
RSRVPTASPVRAR

SEQ ID NO: 283307 - protein, 7 aa, Mycobacterium
RSRYDRF

SEQ ID NO: 283308 - protein, 6 aa, Mycobacterium
RSRYTG

SEQ ID NO: 283309 - protein, 21 aa, Mycobacterium
RSSAAADTEEDTGLREPAQRE

SEQ ID NO: 283310 - protein, 5 aa, Mycobacterium
RSSAG

SEQ ID NO: 283311 - protein, 6 aa, Mycobacterium
RSSCAP

SEQ ID NO: 283312 - protein, 8 aa, Mycobacterium
RSSDGEVY

SEQ ID NO: 283313 - protein, 9 aa, Mycobacterium
RSSDSLGRT

SEQ ID NO: 283314 - protein, 8 aa, Mycobacterium
RSSEEGSG

SEQ ID NO: 283315 - protein, 20 aa, Mycobacterium
RSSGDGTELTSLAAPGEAPP

SEQ ID NO: 283316 - protein, 6 aa, Mycobacterium
RSSGDL

SEQ ID NO: 283317 - protein, 8 aa, Mycobacterium
RSSGGLSD

SEQ ID NO: 283318 - protein, 9 aa, Mycobacterium
RSSGGLSDS

SEQ ID NO: 283319 - protein, 6 aa, Mycobacterium
RSSGYS

SEQ ID NO: 283320 - protein, 10 aa, Mycobacterium
RSSIESYAQK

SEQ ID NO: 283321 - protein, 12 aa, Mycobacterium
RSSKEPAPKAAR

SEQ ID NO: 283322 - protein, 13 aa, Mycobacterium
RSSKEPAPKASKH

SEQ ID NO: 283323 - protein, 5 aa, Mycobacterium
RSSLE

SEQ ID NO: 283324 - protein, 5 aa, Mycobacterium
RSSNW

SEQ ID NO: 283325 - protein, 6 aa, Mycobacterium
RSSPDI

SEQ ID NO: 283326 - protein, 16 aa, Mycobacterium
RSSPDSTSSTPGPRVP

SEQ ID NO: 283327 - protein, 7 aa, Mycobacterium
RSSPTQA

SEQ ID NO: 283328 - protein, 11 aa, Mycobacterium
RSSQAAPRPAS

SEQ ID NO: 283329 - protein, 5 aa, Mycobacterium
RSSQY

SEQ ID NO: 283330 - protein, 9 aa, Mycobacterium
RSSRHADPI

SEQ ID NO: 283331 - protein, 6 aa, Mycobacterium
RSSRIA

SEQ ID NO: 283332 - protein, 5 aa, Mycobacterium
RSSSA

SEQ ID NO: 283333 - protein, 45 aa, Mycobacterium
RSSSAKKAPASRPGKSGDAGRAKPRAIAARRESRSAEPPPTARED

SEQ ID NO: 283334 - protein, 7 aa, Mycobacterium
RSSSSDA

SEQ ID NO: 283335 - protein, 9 aa, Mycobacterium
RSSSSRPGI

SEQ ID NO: 283336 - protein, 31 aa, Mycobacterium
RSSSTATPSSLEDTTALTEPTTLKPGSNTIE

SEQ ID NO: 283337 - protein, 13 aa, Mycobacterium
RSSTAPAPKAGKH

SEQ ID NO: 283338 - protein, 13 aa, Mycobacterium
RSSTDVKPDPGHN

SEQ ID NO: 283339 - protein, 9 aa, Mycobacterium
RSSTQTTLE

SEQ ID NO: 283340 - protein, 8 aa, Mycobacterium
RSSTRAGA

SEQ ID NO: 283341 - protein, 4 aa, Mycobacterium
RSSV

SEQ ID NO: 283342 - protein, 10 aa, Mycobacterium
RSSVGDGDLQ

SEQ ID NO: 283343 - protein, 6 aa, Mycobacterium
RSSVRA

SEQ ID NO: 283344 - protein, 4 aa, Mycobacterium
RSTA

SEQ ID NO: 283345 - protein, 24 aa, Mycobacterium
RSTAAAARPADPPPKPSVPAGPVD

SEQ ID NO: 283346 - protein, 6 aa, Mycobacterium
RSTAGG

SEQ ID NO: 283347 - protein, 5 aa, Mycobacterium
RSTAK

SEQ ID NO: 283348 - protein, 7 aa, Mycobacterium
RSTAQAK

SEQ ID NO: 283349 - protein, 11 aa, Mycobacterium
RSTARATSPHS

SEQ ID NO: 283350 - protein, 11 aa, Mycobacterium
RSTARATSPYS

SEQ ID NO: 283351 - protein, 14 aa, Mycobacterium
RSTASGAAYSLSRA

SEQ ID NO: 283352 - protein, 7 aa, Mycobacterium
RSTEADD

SEQ ID NO: 283353 - protein, 7 aa, Mycobacterium
RSTEGEM

SEQ ID NO: 283354 - protein, 21 aa, Mycobacterium
RSTENTATSLAQRRSELSSQV

SEQ ID NO: 283355 - protein, 50 aa, Mycobacterium
RSTEQPAASESAAETGQAAPPPLPGENPDVKSPIQPPAQQAPPPTPTPTA

SEQ ID NO: 283356 - protein, 4 aa, Mycobacterium
RSTF

SEQ ID NO: 283357 - protein, 11 aa, Mycobacterium
RSTGVGDPGVR

SEQ ID NO: 283358 - protein, 12 aa, Mycobacterium
RSTHTAGGFTDA

SEQ ID NO: 283359 - protein, 7 aa, Mycobacterium
RSTIDQH

SEQ ID NO: 283360 - protein, 7 aa, Mycobacterium
RSTIPAF

SEQ ID NO: 283361 - protein, 13 aa, Mycobacterium
RSTPAAADTPQWQ

SEQ ID NO: 283362 - protein, 9 aa, Mycobacterium
RSTPAQLPA

SEQ ID NO: 283363 - protein, 7 aa, Mycobacterium
RSTPDPV

SEQ ID NO: 283364 - protein, 14 aa, Mycobacterium
RSTPGIEENVTRAE

SEQ ID NO: 283365 - protein, 10 aa, Mycobacterium
RSTPVAAPRN

SEQ ID NO: 283366 - protein, 20 aa, Mycobacterium
RSTQAAAAELAQRRSALSAK

SEQ ID NO: 283367 - protein, 13 aa, Mycobacterium
RSTQAAASRLAQQ

SEQ ID NO: 283368 - protein, 6 aa, Mycobacterium
RSTQPA

SEQ ID NO: 283369 - protein, 12 aa, Mycobacterium
RSTQQTRDGREF

SEQ ID NO: 283370 - protein, 5 aa, Mycobacterium
RSTRS

SEQ ID NO: 283371 - protein, 9 aa, Mycobacterium
RSTSEVPGM

SEQ ID NO: 283372 - protein, 6 aa, Mycobacterium
RSTTES

SEQ ID NO: 283373 - protein, 5 aa, Mycobacterium
RSTTL

SEQ ID NO: 283374 - protein, 15 aa, Mycobacterium
RSTVDANARGGASRD

SEQ ID NO: 283375 - protein, 15 aa, Mycobacterium
RSTVEANARAGDRRD

SEQ ID NO: 283376 - protein, 15 aa, Mycobacterium
RSTVEANVRSGDRRD

SEQ ID NO: 283377 - protein, 8 aa, Mycobacterium
RSTVEQHH

SEQ ID NO: 283378 - protein, 7 aa, Mycobacterium
RSVADSD

SEQ ID NO: 283379 - protein, 17 aa, Mycobacterium
RSVAGAKAAGEEPVRAE

SEQ ID NO: 283380 - protein, 8 aa, Mycobacterium
RSVEPERR

SEQ ID NO: 283381 - protein, 4 aa, Mycobacterium
RSVG

SEQ ID NO: 283382 - protein, 7 aa, Mycobacterium
RSVGPDA

SEQ ID NO: 283383 - protein, 6 aa, Mycobacterium
RSVNPR

SEQ ID NO: 283384 - protein, 12 aa, Mycobacterium
RSVSHPPLSLPQ

SEQ ID NO: 283385 - protein, 13 aa, Mycobacterium
RSVSNDVAKGAQI

SEQ ID NO: 283386 - protein, 14 aa, Mycobacterium
RSVTGENAAAAVGR

SEQ ID NO: 283387 - protein, 17 aa, Mycobacterium
RSVTSDYAERDAGAMAG

SEQ ID NO: 283388 - protein, 26 aa, Mycobacterium
RSWAQAPRRAPTTPLEGPNPARPPSN

SEQ ID NO: 283389 - protein, 7 aa, Mycobacterium
RSWAQGD

SEQ ID NO: 283390 - protein, 5 aa, Mycobacterium
RSWDE

SEQ ID NO: 283391 - protein, 5 aa, Mycobacterium
RSWNP

SEQ ID NO: 283392 - protein, 7 aa, Mycobacterium
RSWPPLG

SEQ ID NO: 283393 - protein, 8 aa, Mycobacterium
RSYDNAGA

SEQ ID NO: 283394 - protein, 4 aa, Mycobacterium
RTAA

SEQ ID NO: 283395 - protein, 8 aa, Mycobacterium
RTAAADPV

SEQ ID NO: 283396 - protein, 8 aa, Mycobacterium
RTAADRGA

SEQ ID NO: 283397 - protein, 9 aa, Mycobacterium
RTAAEGSDV

SEQ ID NO: 283398 - protein, 6 aa, Mycobacterium
RTAANA

SEQ ID NO: 283399 - protein, 6 aa, Mycobacterium
RTAAPR

SEQ ID NO: 283400 - protein, 6 aa, Mycobacterium
RTADAT

SEQ ID NO: 283401 - protein, 11 aa, Mycobacterium
RTADDTAQLSG

SEQ ID NO: 283402 - protein, 7 aa, Mycobacterium
RTADKVA

SEQ ID NO: 283403 - protein, 7 aa, Mycobacterium
RTADNEA

SEQ ID NO: 283404 - protein, 23 aa, Mycobacterium
RTAEAEQRTVEADRAAAAAQEAQ

SEQ ID NO: 283405 - protein, 5 aa, Mycobacterium
RTAEG

SEQ ID NO: 283406 - protein, 15 aa, Mycobacterium
RTAEITTTRKSAGDR

SEQ ID NO: 283407 - protein, 6 aa, Mycobacterium
RTAENP

SEQ ID NO: 283408 - protein, 10 aa, Mycobacterium
RTAEPVERPA

SEQ ID NO: 283409 - protein, 10 aa, Mycobacterium
RTAESSRATA

SEQ ID NO: 283410 - protein, 10 aa, Mycobacterium
RTAEVGPMSA

SEQ ID NO: 283411 - protein, 6 aa, Mycobacterium
RTAGDQ

SEQ ID NO: 283412 - protein, 9 aa, Mycobacterium
RTAGGRSRN

SEQ ID NO: 283413 - protein, 6 aa, Mycobacterium
RTAGTA

SEQ ID NO: 283414 - protein, 8 aa, Mycobacterium
RTAIAGAR

SEQ ID NO: 283415 - protein, 7 aa, Mycobacterium
RTANRRP

SEQ ID NO: 283416 - protein, 14 aa, Mycobacterium
RTAPGTTEAANTAF

SEQ ID NO: 283417 - protein, 29 aa, Mycobacterium
RTAPPPPAPDLTPPDEPAPPPSAEPASPR

SEQ ID NO: 283418 - protein, 9 aa, Mycobacterium
RTAPPTTAT

SEQ ID NO: 283419 - protein, 7 aa, Mycobacterium
RTAPSVP

SEQ ID NO: 283420 - protein, 26 aa, Mycobacterium
RTAPYRSAAADAAGSQRQAEDLPAAV

SEQ ID NO: 283421 - protein, 9 aa, Mycobacterium
RTAQADRRA

SEQ ID NO: 283422 - protein, 12 aa, Mycobacterium
RTARAPARGVDN

SEQ ID NO: 283423 - protein, 14 aa, Mycobacterium
RTARAPARGVDNQV

SEQ ID NO: 283424 - protein, 10 aa, Mycobacterium
RTARASDLGD

SEQ ID NO: 283425 - protein, 14 aa, Mycobacterium
RTARDAGRSPSNLV

SEQ ID NO: 283426 - protein, 7 aa, Mycobacterium
RTARRAH

SEQ ID NO: 283427 - protein, 10 aa, Mycobacterium
RTARRAHDEL

SEQ ID NO: 283428 - protein, 26 aa, Mycobacterium
RTARRPNKPHQPHNTDTGHTASEGSG

SEQ ID NO: 283429 - protein, 6 aa, Mycobacterium
RTASPA

SEQ ID NO: 283430 - protein, 10 aa, Mycobacterium
RTASPQDFSA

SEQ ID NO: 283431 - protein, 10 aa, Mycobacterium
RTASSDPDAH

SEQ ID NO: 283432 - protein, 10 aa, Mycobacterium
RTASSDPEAY

SEQ ID NO: 283433 - protein, 10 aa, Mycobacterium
RTATAAGTSW

SEQ ID NO: 283434 - protein, 16 aa, Mycobacterium
RTATAGRVDSGRSAVT

SEQ ID NO: 283435 - protein, 7 aa, Mycobacterium
RTATARQ

SEQ ID NO: 283436 - protein, 10 aa, Mycobacterium
RTATASETSW

SEQ ID NO: 283437 - protein, 6 aa, Mycobacterium
RTATDA

SEQ ID NO: 283438 - protein, 6 aa, Mycobacterium
RTATPL

SEQ ID NO: 283439 - protein, 5 aa, Mycobacterium
RTAVA

SEQ ID NO: 283440 - protein, 5 aa, Mycobacterium
RTAVG

SEQ ID NO: 283441 - protein, 5 aa, Mycobacterium
RTAVP

SEQ ID NO: 283442 - protein, 6 aa, Mycobacterium
RTAYPY

SEQ ID NO: 283443 - protein, 16 aa, Mycobacterium
RTDARRTGGARAAGPV

SEQ ID NO: 283444 - protein, 12 aa, Mycobacterium
RTDATREPAETM

SEQ ID NO: 283445 - protein, 4 aa, Mycobacterium
RTDD

SEQ ID NO: 283446 - protein, 13 aa, Mycobacterium
RTDDAAAAPLRTG

SEQ ID NO: 283447 - protein, 12 aa, Mycobacterium
RTDDETPADKRT

SEQ ID NO: 283448 - protein, 8 aa, Mycobacterium
RTDDQGRN

SEQ ID NO: 283449 - protein, 5 aa, Mycobacterium
RTDDS

SEQ ID NO: 283450 - protein, 7 aa, Mycobacterium
RTDEGPS

SEQ ID NO: 283451 - protein, 7 aa, Mycobacterium
RTDGARR

SEQ ID NO: 283452 - protein, 7 aa, Mycobacterium
RTDGSGN

SEQ ID NO: 283453 - protein, 7 aa, Mycobacterium
RTDGTGN

SEQ ID NO: 283454 - protein, 9 aa, Mycobacterium
RTDKQGDAG

SEQ ID NO: 283455 - protein, 8 aa, Mycobacterium
RTDPGRAG

SEQ ID NO: 283456 - protein, 9 aa, Mycobacterium
RTDPQAAAT

SEQ ID NO: 283457 - protein, 15 aa, Mycobacterium
RTDPQAGLTAAEAGR

SEQ ID NO: 283458 - protein, 6 aa, Mycobacterium
RTDPSF

SEQ ID NO: 283459 - protein, 8 aa, Mycobacterium
RTDQRAAA

SEQ ID NO: 283460 - protein, 8 aa, Mycobacterium
RTDRAATT

SEQ ID NO: 283461 - protein, 5 aa, Mycobacterium
RTDRD

SEQ ID NO: 283462 - protein, 8 aa, Mycobacterium
RTDSEGRN

SEQ ID NO: 283463 - protein, 19 aa, Mycobacterium
RTDSGCPAPASTGTGTSGF

SEQ ID NO: 283464 - protein, 18 aa, Mycobacterium
RTDSGRPAPALTGTGAPG

SEQ ID NO: 283465 - protein, 8 aa, Mycobacterium
RTDSMGRS

SEQ ID NO: 283466 - protein, 8 aa, Mycobacterium
RTDSQGRN

SEQ ID NO: 283467 - protein, 21 aa, Mycobacterium
RTDSTKLANPATTSSVPPVQD

SEQ ID NO: 283468 - protein, 4 aa, Mycobacterium
RTDT

SEQ ID NO: 283469 - protein, 13 aa, Mycobacterium
RTDTADPNAGFDP

SEQ ID NO: 283470 - protein, 6 aa, Mycobacterium
RTDTAV

SEQ ID NO: 283471 - protein, 21 aa, Mycobacterium
RTDTDNLATPETTTRQAPPVQ

SEQ ID NO: 283472 - protein, 6 aa, Mycobacterium
RTDTLS

SEQ ID NO: 283473 - protein, 8 aa, Mycobacterium
RTDTMGRS

SEQ ID NO: 283474 - protein, 11 aa, Mycobacterium
RTEAATRTGGL

SEQ ID NO: 283475 - protein, 23 aa, Mycobacterium
RTEALSKPEPTVADSRRPGNTRG

SEQ ID NO: 283476 - protein, 29 aa, Mycobacterium
RTEAVAAPAPATAPTAGPTAGAAACPRSP

SEQ ID NO: 283477 - protein, 6 aa, Mycobacterium
RTEAVR

SEQ ID NO: 283478 - protein, 11 aa, Mycobacterium
RTEGSKKVATD

SEQ ID NO: 283479 - protein, 18 aa, Mycobacterium
RTEHSAGQDIDREADAIA

SEQ ID NO: 283480 - protein, 11 aa, Mycobacterium
RTEKAASVADR

SEQ ID NO: 283481 - protein, 5 aa, Mycobacterium
RTELQ

SEQ ID NO: 283482 - protein, 6 aa, Mycobacterium
RTELQG

SEQ ID NO: 283483 - protein, 4 aa, Mycobacterium
RTEN

SEQ ID NO: 283484 - protein, 5 aa, Mycobacterium
RTEPA

SEQ ID NO: 283485 - protein, 8 aa, Mycobacterium
RTEPAAQT

SEQ ID NO: 283486 - protein, 7 aa, Mycobacterium
RTEPPMS

SEQ ID NO: 283487 - protein, 24 aa, Mycobacterium
RTEPVDPVGPHQPRYDERERGGSL

SEQ ID NO: 283488 - protein, 6 aa, Mycobacterium
RTERGI

SEQ ID NO: 283489 - protein, 10 aa, Mycobacterium
RTESAKHRQA

SEQ ID NO: 283490 - protein, 5 aa, Mycobacterium
RTESR

SEQ ID NO: 283491 - protein, 13 aa, Mycobacterium
RTETAAATATGGL

SEQ ID NO: 283492 - protein, 7 aa, Mycobacterium
RTETGET

SEQ ID NO: 283493 - protein, 10 aa, Mycobacterium
RTETNGSGKA

SEQ ID NO: 283494 - protein, 8 aa, Mycobacterium
RTETQDTT

SEQ ID NO: 283495 - protein, 11 aa, Mycobacterium
RTETVTDDPSL

SEQ ID NO: 283496 - protein, 10 aa, Mycobacterium
RTEVTGTRQG

SEQ ID NO: 283497 - protein, 4 aa, Mycobacterium
RTFA

SEQ ID NO: 283498 - protein, 6 aa, Mycobacterium
RTFSPL

SEQ ID NO: 283499 - protein, 14 aa, Mycobacterium
RTFSPSAERRAQRG

SEQ ID NO: 283500 - protein, 9 aa, Mycobacterium
RTGAEGADV

SEQ ID NO: 283501 - protein, 10 aa, Mycobacterium
RTGAELPEGE

SEQ ID NO: 283502 - protein, 5 aa, Mycobacterium
RTGAF

SEQ ID NO: 283503 - protein, 22 aa, Mycobacterium
RTGAKIAEDPTRQLSGAPADYH

SEQ ID NO: 283504 - protein, 5 aa, Mycobacterium
RTGAL

SEQ ID NO: 283505 - protein, 8 aa, Mycobacterium
RTGARHSG

SEQ ID NO: 283506 - protein, 15 aa, Mycobacterium
RTGDERRVQVAWSPA

SEQ ID NO: 283507 - protein, 6 aa, Mycobacterium
RTGDPV

SEQ ID NO: 283508 - protein, 6 aa, Mycobacterium
RTGDRI

SEQ ID NO: 283509 - protein, 8 aa, Mycobacterium
RTGELGRD

SEQ ID NO: 283510 - protein, 13 aa, Mycobacterium
RTGELGRDRARAG

SEQ ID NO: 283511 - protein, 9 aa, Mycobacterium
RTGEQAPGV

SEQ ID NO: 283512 - protein, 5 aa, Mycobacterium
RTGER

SEQ ID NO: 283513 - protein, 7 aa, Mycobacterium
RTGERGR

SEQ ID NO: 283514 - protein, 23 aa, Mycobacterium
RTGESEAPTETIPTSDSEARTEA

SEQ ID NO: 283515 - protein, 6 aa, Mycobacterium
RTGESV

SEQ ID NO: 283516 - protein, 4 aa, Mycobacterium
RTGG

SEQ ID NO: 283517 - protein, 11 aa, Mycobacterium
RTGGGNGSGKT

SEQ ID NO: 283518 - protein, 7 aa, Mycobacterium
RTGGPRW

SEQ ID NO: 283519 - protein, 6 aa, Mycobacterium
RTGGRG

SEQ ID NO: 283520 - protein, 6 aa, Mycobacterium
RTGGRS

SEQ ID NO: 283521 - protein, 17 aa, Mycobacterium
RTGKGQPLRLLPGIGNT

SEQ ID NO: 283522 - protein, 4 aa, Mycobacterium
RTGL

SEQ ID NO: 283523 - protein, 6 aa, Mycobacterium
RTGLPS

SEQ ID NO: 283524 - protein, 15 aa, Mycobacterium
RTGNAPANAATDSTA

SEQ ID NO: 283525 - protein, 7 aa, Mycobacterium
RTGNATK

SEQ ID NO: 283526 - protein, 10 aa, Mycobacterium
RTGNERTPVQ

SEQ ID NO: 283527 - protein, 7 aa, Mycobacterium
RTGNSQA

SEQ ID NO: 283528 - protein, 39 aa, Mycobacterium
RTGPAAGHRSDPHWKPEDDWGHEPVGQAEDDAEQDTAPV

SEQ ID NO: 283529 - protein, 8 aa, Mycobacterium
RTGPDEVP

SEQ ID NO: 283530 - protein, 8 aa, Mycobacterium
RTGPGGVS

SEQ ID NO: 283531 - protein, 23 aa, Mycobacterium
RTGPPPAPPPAEKPAELGDPSHT

SEQ ID NO: 283532 - protein, 23 aa, Mycobacterium
RTGPQPPPPPAQQPADLGDPSHT

SEQ ID NO: 283533 - protein, 9 aa, Mycobacterium
RTGQGGEPH

SEQ ID NO: 283534 - protein, 10 aa, Mycobacterium
RTGQGGEPRM

SEQ ID NO: 283535 - protein, 10 aa, Mycobacterium
RTGRGTGVTL

SEQ ID NO: 283536 - protein, 6 aa, Mycobacterium
RTGRPI

SEQ ID NO: 283537 - protein, 10 aa, Mycobacterium
RTGRRPQEAV

SEQ ID NO: 283538 - protein, 5 aa, Mycobacterium
RTGRS

SEQ ID NO: 283539 - protein, 7 aa, Mycobacterium
RTGSAGL

SEQ ID NO: 283540 - protein, 7 aa, Mycobacterium
RTGSGAR

SEQ ID NO: 283541 - protein, 8 aa, Mycobacterium
RTGSHGTP

SEQ ID NO: 283542 - protein, 11 aa, Mycobacterium
RTGSNEMPAGS

SEQ ID NO: 283543 - protein, 8 aa, Mycobacterium
RTGSPRVA

SEQ ID NO: 283544 - protein, 6 aa, Mycobacterium
RTGSQL

SEQ ID NO: 283545 - protein, 23 aa, Mycobacterium
RTGSQRLANPATTSSSAPPIQDE

SEQ ID NO: 283546 - protein, 6 aa, Mycobacterium
RTGSSL

SEQ ID NO: 283547 - protein, 16 aa, Mycobacterium
RTGSTGFRGPRRPPRF

SEQ ID NO: 283548 - protein, 9 aa, Mycobacterium
RTGSTNGYS

SEQ ID NO: 283549 - protein, 5 aa, Mycobacterium
RTGTV

SEQ ID NO: 283550 - protein, 14 aa, Mycobacterium
RTGVGLPGESSGLV

SEQ ID NO: 283551 - protein, 5 aa, Mycobacterium
RTGVP

SEQ ID NO: 283552 - protein, 11 aa, Mycobacterium
RTGYADVPTPA

SEQ ID NO: 283553 - protein, 12 aa, Mycobacterium
RTGYADVPTPAG

SEQ ID NO: 283554 - protein, 14 aa, Mycobacterium
RTHPLPGVEPQPMA

SEQ ID NO: 283555 - protein, 6 aa, Mycobacterium
RTHRSS

SEQ ID NO: 283556 - protein, 8 aa, Mycobacterium
RTHSADSR

SEQ ID NO: 283557 - protein, 20 aa, Mycobacterium
RTHSGDSRAHCQSRDRDAGL

SEQ ID NO: 283558 - protein, 5 aa, Mycobacterium
RTHTE

SEQ ID NO: 283559 - protein, 10 aa, Mycobacterium
RTHTPPGTSV

SEQ ID NO: 283560 - protein, 12 aa, Mycobacterium
RTHTTHDPLPYR

SEQ ID NO: 283561 - protein, 4 aa, Mycobacterium
RTID

SEQ ID NO: 283562 - protein, 11 aa, Mycobacterium
RTIGTESRAAI

SEQ ID NO: 283563 - protein, 6 aa, Mycobacterium
RTIKNR

SEQ ID NO: 283564 - protein, 4 aa, Mycobacterium
RTIR

SEQ ID NO: 283565 - protein, 19 aa, Mycobacterium
RTIRQPRTRFGGRQRSAAP

SEQ ID NO: 283566 - protein, 5 aa, Mycobacterium
RTIST

SEQ ID NO: 283567 - protein, 6 aa, Mycobacterium
RTKEST

SEQ ID NO: 283568 - protein, 7 aa, Mycobacterium
RTKTAAQ

SEQ ID NO: 283569 - protein, 8 aa, Mycobacterium
RTKVASPD

SEQ ID NO: 283570 - protein, 9 aa, Mycobacterium
RTLDRRDEA

SEQ ID NO: 283571 - protein, 6 aa, Mycobacterium
RTLGGG

SEQ ID NO: 283572 - protein, 6 aa, Mycobacterium
RTLGRQ

SEQ ID NO: 283573 - protein, 8 aa, Mycobacterium
RTLNARDA

SEQ ID NO: 283574 - protein, 6 aa, Mycobacterium
RTLNPD

SEQ ID NO: 283575 - protein, 9 aa, Mycobacterium
RTLNSRDEA

SEQ ID NO: 283576 - protein, 20 aa, Mycobacterium
RTLPAGNPAPVSAPPMSSAT

SEQ ID NO: 283577 - protein, 9 aa, Mycobacterium
RTLPGRGDG

SEQ ID NO: 283578 - protein, 11 aa, Mycobacterium
RTLPSPRPRRW

SEQ ID NO: 283579 - protein, 6 aa, Mycobacterium
RTLPST

SEQ ID NO: 283580 - protein, 14 aa, Mycobacterium
RTLSETAERRAQRG

SEQ ID NO: 283581 - protein, 22 aa, Mycobacterium
RTLSGEQADRVSQRPVQRSDGC

SEQ ID NO: 283582 - protein, 14 aa, Mycobacterium
RTLSPTAERRAQRG

SEQ ID NO: 283583 - protein, 14 aa, Mycobacterium
RTLSQTAERRAQRG

SEQ ID NO: 283584 - protein, 12 aa, Mycobacterium
RTLTESAALGDR

SEQ ID NO: 283585 - protein, 7 aa, Mycobacterium
RTLTGAE

SEQ ID NO: 283586 - protein, 12 aa, Mycobacterium
RTLTKDAVTSPL

SEQ ID NO: 283587 - protein, 5 aa, Mycobacterium
RTNAK

SEQ ID NO: 283588 - protein, 6 aa, Mycobacterium
RTNAPA

SEQ ID NO: 283589 - protein, 4 aa, Mycobacterium
RTNG

SEQ ID NO: 283590 - protein, 15 aa, Mycobacterium
RTNGTDHAARTGKKI

SEQ ID NO: 283591 - protein, 13 aa, Mycobacterium
RTNGVTQTSTIRQ

SEQ ID NO: 283592 - protein, 8 aa, Mycobacterium
RTNGYSAE

SEQ ID NO: 283593 - protein, 21 aa, Mycobacterium
RTNPAGELPAGARWNDPATAD

SEQ ID NO: 283594 - protein, 11 aa, Mycobacterium
RTNPSLSHGGM

SEQ ID NO: 283595 - protein, 11 aa, Mycobacterium
RTNRPVSDAAG

SEQ ID NO: 283596 - protein, 7 aa, Mycobacterium
RTNSSYE

SEQ ID NO: 283597 - protein, 4 aa, Mycobacterium
RTNT

SEQ ID NO: 283598 - protein, 5 aa, Mycobacterium
RTPAD

SEQ ID NO: 283599 - protein, 6 aa, Mycobacterium
RTPADK

SEQ ID NO: 283600 - protein, 6 aa, Mycobacterium
RTPAEK

SEQ ID NO: 283601 - protein, 6 aa, Mycobacterium
RTPAEN

SEQ ID NO: 283602 - protein, 5 aa, Mycobacterium
RTPAG

SEQ ID NO: 283603 - protein, 7 aa, Mycobacterium
RTPAGAT

SEQ ID NO: 283604 - protein, 8 aa, Mycobacterium
RTPAPEGV

SEQ ID NO: 283605 - protein, 8 aa, Mycobacterium
RTPAPPGI

SEQ ID NO: 283606 - protein, 5 aa, Mycobacterium
RTPAQ

SEQ ID NO: 283607 - protein, 6 aa, Mycobacterium
RTPASG

SEQ ID NO: 283608 - protein, 5 aa, Mycobacterium
RTPCP

SEQ ID NO: 283609 - protein, 4 aa, Mycobacterium
RTPD

SEQ ID NO: 283610 - protein, 6 aa, Mycobacterium
RTPDAP

SEQ ID NO: 283611 - protein, 6 aa, Mycobacterium
RTPDCA

SEQ ID NO: 283612 - protein, 14 aa, Mycobacterium
RTPDFEDRADREQI

SEQ ID NO: 283613 - protein, 6 aa, Mycobacterium
RTPDGM

SEQ ID NO: 283614 - protein, 6 aa, Mycobacterium
RTPDRP

SEQ ID NO: 283615 - protein, 6 aa, Mycobacterium
RTPDVT

SEQ ID NO: 283616 - protein, 27 aa, Mycobacterium
RTPEAPPASASSEAPADLGAPAKTSLR

SEQ ID NO: 283617 - protein, 7 aa, Mycobacterium
RTPEGDQ

SEQ ID NO: 283618 - protein, 7 aa, Mycobacterium
RTPETRA

SEQ ID NO: 283619 - protein, 8 aa, Mycobacterium
RTPETRAR

SEQ ID NO: 283620 - protein, 4 aa, Mycobacterium
RTPF

SEQ ID NO: 283621 - protein, 6 aa, Mycobacterium
RTPGEL

SEQ ID NO: 283622 - protein, 7 aa, Mycobacterium
RTPGELS

SEQ ID NO: 283623 - protein, 8 aa, Mycobacterium
RTPGHRRP

SEQ ID NO: 283624 - protein, 40 aa, Mycobacterium
RTPGLQPGGGVPPGTTPPAAPQTSGVAQHQPPATRRFTPG

SEQ ID NO: 283625 - protein, 52 aa, Mycobacterium
RTPGREPESEFAAEEAANLGEGETSATAVTAGGAAGAAGTVAAPERADSEAE

SEQ ID NO: 283626 - protein, 5 aa, Mycobacterium
RTPGT

SEQ ID NO: 283627 - protein, 4 aa, Mycobacterium
RTPK

SEQ ID NO: 283628 - protein, 8 aa, Mycobacterium
RTPLPPRR

SEQ ID NO: 283629 - protein, 6 aa, Mycobacterium
RTPNTL

SEQ ID NO: 283630 - protein, 6 aa, Mycobacterium
RTPNVT

SEQ ID NO: 283631 - protein, 5 aa, Mycobacterium
RTPPA

SEQ ID NO: 283632 - protein, 7 aa, Mycobacterium
RTPPPPG

SEQ ID NO: 283633 - protein, 8 aa, Mycobacterium
RTPPPPGI

SEQ ID NO: 283634 - protein, 13 aa, Mycobacterium
RTPRPQVKRGGDV

SEQ ID NO: 283635 - protein, 5 aa, Mycobacterium
RTPRR

SEQ ID NO: 283636 - protein, 9 aa, Mycobacterium
RTPSTMRSD

SEQ ID NO: 283637 - protein, 5 aa, Mycobacterium
RTPTA

SEQ ID NO: 283638 - protein, 7 aa, Mycobacterium
RTPVTRS

SEQ ID NO: 283639 - protein, 11 aa, Mycobacterium
RTQAAQQRAAA

SEQ ID NO: 283640 - protein, 10 aa, Mycobacterium
RTQADNLGKT

SEQ ID NO: 283641 - protein, 8 aa, Mycobacterium
RTQAPQGV

SEQ ID NO: 283642 - protein, 7 aa, Mycobacterium
RTQDQGV

SEQ ID NO: 283643 - protein, 9 aa, Mycobacterium
RTQNGEPTA

SEQ ID NO: 283644 - protein, 24 aa, Mycobacterium
RTQQADAPASPAPAPAVHPEGWVQ

SEQ ID NO: 283645 - protein, 44 aa, Mycobacterium
RTQQGADVAGAPESGVARAPARPQPVTPRPAAAPARLPQTTADG

SEQ ID NO: 283646 - protein, 7 aa, Mycobacterium
RTQQVEP

SEQ ID NO: 283647 - protein, 13 aa, Mycobacterium
RTQSPGTAGAPEA

SEQ ID NO: 283648 - protein, 7 aa, Mycobacterium
RTQSRVE

SEQ ID NO: 283649 - protein, 9 aa, Mycobacterium
RTQSSPGLG

SEQ ID NO: 283650 - protein, 4 aa, Mycobacterium
RTQT

SEQ ID NO: 283651 - protein, 7 aa, Mycobacterium
RTQTDPD

SEQ ID NO: 283652 - protein, 12 aa, Mycobacterium
RTRAARADKEMW

SEQ ID NO: 283653 - protein, 5 aa, Mycobacterium
RTRAY

SEQ ID NO: 283654 - protein, 4 aa, Mycobacterium
RTRD

SEQ ID NO: 283655 - protein, 11 aa, Mycobacterium
RTRDGEKTSGA

SEQ ID NO: 283656 - protein, 4 aa, Mycobacterium
RTRE

SEQ ID NO: 283657 - protein, 7 aa, Mycobacterium
RTREEAT

SEQ ID NO: 283658 - protein, 7 aa, Mycobacterium
RTREEST

SEQ ID NO: 283659 - protein, 6 aa, Mycobacterium
RTREST

SEQ ID NO: 283660 - protein, 9 aa, Mycobacterium
RTRETSAAR

SEQ ID NO: 283661 - protein, 8 aa, Mycobacterium
RTRGAATR

SEQ ID NO: 283662 - protein, 6 aa, Mycobacterium
RTRGAL

SEQ ID NO: 283663 - protein, 20 aa, Mycobacterium
RTRGSIAQTAPLRQKSSRYL

SEQ ID NO: 283664 - protein, 10 aa, Mycobacterium
RTRNNGDAKK

SEQ ID NO: 283665 - protein, 5 aa, Mycobacterium
RTRPA

SEQ ID NO: 283666 - protein, 7 aa, Mycobacterium
RTRPGAV

SEQ ID NO: 283667 - protein, 12 aa, Mycobacterium
RTRPPPAGETTT

SEQ ID NO: 283668 - protein, 9 aa, Mycobacterium
RTRQGDKRY

SEQ ID NO: 283669 - protein, 8 aa, Mycobacterium
RTRQPGHR

SEQ ID NO: 283670 - protein, 13 aa, Mycobacterium
RTRRPSQAPSQIE

SEQ ID NO: 283671 - protein, 6 aa, Mycobacterium
RTRRTA

SEQ ID NO: 283672 - protein, 7 aa, Mycobacterium
RTRSAEA

SEQ ID NO: 283673 - protein, 8 aa, Mycobacterium
RTRSAEAA

SEQ ID NO: 283674 - protein, 8 aa, Mycobacterium
RTRSPYQL

SEQ ID NO: 283675 - protein, 5 aa, Mycobacterium
RTRSR

SEQ ID NO: 283676 - protein, 5 aa, Mycobacterium
RTRTA

SEQ ID NO: 283677 - protein, 6 aa, Mycobacterium
RTRTAL

SEQ ID NO: 283678 - protein, 5 aa, Mycobacterium
RTRTE

SEQ ID NO: 283679 - protein, 5 aa, Mycobacterium
RTRWS

SEQ ID NO: 283680 - protein, 7 aa, Mycobacterium
RTRYSSP

SEQ ID NO: 283681 - protein, 6 aa, Mycobacterium
RTSATR

SEQ ID NO: 283682 - protein, 11 aa, Mycobacterium
RTSDEDMAGKD

SEQ ID NO: 283683 - protein, 6 aa, Mycobacterium
RTSDGA

SEQ ID NO: 283684 - protein, 10 aa, Mycobacterium
RTSDNQAEAA

SEQ ID NO: 283685 - protein, 10 aa, Mycobacterium
RTSDPGRQEL

SEQ ID NO: 283686 - protein, 24 aa, Mycobacterium
RTSDRPAAKAPLAGLTPARGRHRP

SEQ ID NO: 283687 - protein, 6 aa, Mycobacterium
RTSEGE

SEQ ID NO: 283688 - protein, 16 aa, Mycobacterium
RTSESSPVGGSVVAAG

SEQ ID NO: 283689 - protein, 7 aa, Mycobacterium
RTSGASR

SEQ ID NO: 283690 - protein, 24 aa, Mycobacterium
RTSGPAKSDGTQAALDTARTTATA

SEQ ID NO: 283691 - protein, 6 aa, Mycobacterium
RTSGPV

SEQ ID NO: 283692 - protein, 5 aa, Mycobacterium
RTSNR

SEQ ID NO: 283693 - protein, 6 aa, Mycobacterium
RTSPAL

SEQ ID NO: 283694 - protein, 6 aa, Mycobacterium
RTSPGA

SEQ ID NO: 283695 - protein, 7 aa, Mycobacterium
RTSPGAM

SEQ ID NO: 283696 - protein, 11 aa, Mycobacterium
RTSPSAPKDVE

SEQ ID NO: 283697 - protein, 4 aa, Mycobacterium
RTSR

SEQ ID NO: 283698 - protein, 8 aa, Mycobacterium
RTSSPYSL

SEQ ID NO: 283699 - protein, 9 aa, Mycobacterium
RTSSPYSLS

SEQ ID NO: 283700 - protein, 9 aa, Mycobacterium
RTSSPYSLT

SEQ ID NO: 283701 - protein, 6 aa, Mycobacterium
RTSTGE

SEQ ID NO: 283702 - protein, 12 aa, Mycobacterium
RTSTPKASQEEL

SEQ ID NO: 283703 - protein, 12 aa, Mycobacterium
RTSTPRRRLPGQ

SEQ ID NO: 283704 - protein, 7 aa, Mycobacterium
RTSTRAG

SEQ ID NO: 283705 - protein, 16 aa, Mycobacterium
RTSTTYTDAYGNTSET

SEQ ID NO: 283706 - protein, 11 aa, Mycobacterium
RTTALATSPYS

SEQ ID NO: 283707 - protein, 7 aa, Mycobacterium
RTTDEDL

SEQ ID NO: 283708 - protein, 10 aa, Mycobacterium
RTTDRPPAIA

SEQ ID NO: 283709 - protein, 4 aa, Mycobacterium
RTTE

SEQ ID NO: 283710 - protein, 5 aa, Mycobacterium
RTTEG

SEQ ID NO: 283711 - protein, 4 aa, Mycobacterium
RTTG

SEQ ID NO: 283712 - protein, 6 aa, Mycobacterium
RTTGGF

SEQ ID NO: 283713 - protein, 9 aa, Mycobacterium
RTTGGFGQP

SEQ ID NO: 283714 - protein, 23 aa, Mycobacterium
RTTGGRDGDKTADLRDSVRGRNA

SEQ ID NO: 283715 - protein, 8 aa, Mycobacterium
RTTLSGPT

SEQ ID NO: 283716 - protein, 6 aa, Mycobacterium
RTTNDV

SEQ ID NO: 283717 - protein, 6 aa, Mycobacterium
RTTPAL

SEQ ID NO: 283718 - protein, 13 aa, Mycobacterium
RTTPSGRVNREDA

SEQ ID NO: 283719 - protein, 5 aa, Mycobacterium
RTTRQ

SEQ ID NO: 283720 - protein, 16 aa, Mycobacterium
RTTRRDGEATEISAEK

SEQ ID NO: 283721 - protein, 17 aa, Mycobacterium
RTTRTFQAGAAATAAAL

SEQ ID NO: 283722 - protein, 8 aa, Mycobacterium
RTTSPYQL

SEQ ID NO: 283723 - protein, 5 aa, Mycobacterium
RTTSV

SEQ ID NO: 283724 - protein, 5 aa, Mycobacterium
RTTTA

SEQ ID NO: 283725 - protein, 22 aa, Mycobacterium
RTTTAAKAKDATTATTPRKSAI

SEQ ID NO: 283726 - protein, 4 aa, Mycobacterium
RTTV

SEQ ID NO: 283727 - protein, 9 aa, Mycobacterium
RTTVAGGAG

SEQ ID NO: 283728 - protein, 5 aa, Mycobacterium
RTVAD

SEQ ID NO: 283729 - protein, 12 aa, Mycobacterium
RTVDDIPQARPT

SEQ ID NO: 283730 - protein, 9 aa, Mycobacterium
RTVDEGSQR

SEQ ID NO: 283731 - protein, 15 aa, Mycobacterium
RTVHSSSAESAPRGR

SEQ ID NO: 283732 - protein, 12 aa, Mycobacterium
RTVPGEGARARA

SEQ ID NO: 283733 - protein, 5 aa, Mycobacterium
RTVPT

SEQ ID NO: 283734 - protein, 5 aa, Mycobacterium
RTVQA

SEQ ID NO: 283735 - protein, 4 aa, Mycobacterium
RTVR

SEQ ID NO: 283736 - protein, 17 aa, Mycobacterium
RTVRQPRTQFGGRQRSV

SEQ ID NO: 283737 - protein, 7 aa, Mycobacterium
RTVSADD

SEQ ID NO: 283738 - protein, 12 aa, Mycobacterium
RTVSGSLGTGTA

SEQ ID NO: 283739 - protein, 19 aa, Mycobacterium
RTVSSGSLGTYTGNGLGPG

SEQ ID NO: 283740 - protein, 29 aa, Mycobacterium
RTVTVNSEASSAELPAGEGGAETPSARTE

SEQ ID NO: 283741 - protein, 4 aa, Mycobacterium
RTYD

SEQ ID NO: 283742 - protein, 11 aa, Mycobacterium
RTYGGSALPGL

SEQ ID NO: 283743 - protein, 9 aa, Mycobacterium
RTYKSSGYT

SEQ ID NO: 283744 - protein, 24 aa, Mycobacterium
RTYRSSGSIADTPSGQDSWTGTRW

SEQ ID NO: 283745 - protein, 7 aa, Mycobacterium
RVAAEAS

SEQ ID NO: 283746 - protein, 10 aa, Mycobacterium
RVAAGPDAAA

SEQ ID NO: 283747 - protein, 18 aa, Mycobacterium
RVADGQSNAVRKRATRSI

SEQ ID NO: 283748 - protein, 10 aa, Mycobacterium
RVAEAKGVPV

SEQ ID NO: 283749 - protein, 12 aa, Mycobacterium
RVAEATDTGRTL

SEQ ID NO: 283750 - protein, 5 aa, Mycobacterium
RVAGE

SEQ ID NO: 283751 - protein, 7 aa, Mycobacterium
RVAGGPE

SEQ ID NO: 283752 - protein, 6 aa, Mycobacterium
RVAHDA

SEQ ID NO: 283753 - protein, 12 aa, Mycobacterium
RVANPNVQGRPR

SEQ ID NO: 283754 - protein, 13 aa, Mycobacterium
RVANPNVQGRPRP

SEQ ID NO: 283755 - protein, 20 aa, Mycobacterium
RVAPARSQTGQAVAAARGTT

SEQ ID NO: 283756 - protein, 10 aa, Mycobacterium
RVAPEAPRSA

SEQ ID NO: 283757 - protein, 22 aa, Mycobacterium
RVAPRAASPQLPAPAAPVQRAP

SEQ ID NO: 283758 - protein, 19 aa, Mycobacterium
RVAQGKTNDVPSRAARSVS

SEQ ID NO: 283759 - protein, 13 aa, Mycobacterium
RVARGEANNPRTA

SEQ ID NO: 283760 - protein, 8 aa, Mycobacterium
RVDAENAH

SEQ ID NO: 283761 - protein, 13 aa, Mycobacterium
RVDDEPSPEPATV

SEQ ID NO: 283762 - protein, 8 aa, Mycobacterium
RVDDPALE

SEQ ID NO: 283763 - protein, 4 aa, Mycobacterium
RVDG

SEQ ID NO: 283764 - protein, 5 aa, Mycobacterium
RVDGA

SEQ ID NO: 283765 - protein, 8 aa, Mycobacterium
RVDGAGPV

SEQ ID NO: 283766 - protein, 7 aa, Mycobacterium
RVDGQGP

SEQ ID NO: 283767 - protein, 5 aa, Mycobacterium
RVDGR

SEQ ID NO: 283768 - protein, 5 aa, Mycobacterium
RVDHT

SEQ ID NO: 283769 - protein, 18 aa, Mycobacterium
RVDPPRRTDRVDGRGTGD

SEQ ID NO: 283770 - protein, 8 aa, Mycobacterium
RVDPTDAR

SEQ ID NO: 283771 - protein, 10 aa, Mycobacterium
RVDPTDPDAL

SEQ ID NO: 283772 - protein, 10 aa, Mycobacterium
RVDSPAEQTR

SEQ ID NO: 283773 - protein, 7 aa, Mycobacterium
RVEAAGG

SEQ ID NO: 283774 - protein, 13 aa, Mycobacterium
RVEGETAEQGPEV

SEQ ID NO: 283775 - protein, 12 aa, Mycobacterium
RVEGQTPDRGPE

SEQ ID NO: 283776 - protein, 12 aa, Mycobacterium
RVEHDGSVTGED

SEQ ID NO: 283777 - protein, 5 aa, Mycobacterium
RVEPA

SEQ ID NO: 283778 - protein, 8 aa, Mycobacterium
RVEPEPDT

SEQ ID NO: 283779 - protein, 7 aa, Mycobacterium
RVEPEQD

SEQ ID NO: 283780 - protein, 6 aa, Mycobacterium
RVEPGE

SEQ ID NO: 283781 - protein, 9 aa, Mycobacterium
RVEPTEQGV

SEQ ID NO: 283782 - protein, 5 aa, Mycobacterium
RVEQR

SEQ ID NO: 283783 - protein, 6 aa, Mycobacterium
RVESRD

SEQ ID NO: 283784 - protein, 6 aa, Mycobacterium
RVETGQ

SEQ ID NO: 283785 - protein, 7 aa, Mycobacterium
RVGADTQ

SEQ ID NO: 283786 - protein, 4 aa, Mycobacterium
RVGD

SEQ ID NO: 283787 - protein, 7 aa, Mycobacterium
RVGESHS

SEQ ID NO: 283788 - protein, 13 aa, Mycobacterium
RVGESSQTTSRPD

SEQ ID NO: 283789 - protein, 6 aa, Mycobacterium
RVGGAR

SEQ ID NO: 283790 - protein, 9 aa, Mycobacterium
RVGGRASTI

SEQ ID NO: 283791 - protein, 6 aa, Mycobacterium
RVGGSR

SEQ ID NO: 283792 - protein, 13 aa, Mycobacterium
RVGHGTDGDSETE

SEQ ID NO: 283793 - protein, 8 aa, Mycobacterium
RVGPATGL

SEQ ID NO: 283794 - protein, 12 aa, Mycobacterium
RVGPPAAATALA

SEQ ID NO: 283795 - protein, 18 aa, Mycobacterium
RVGQSPSATATAPAQDLA

SEQ ID NO: 283796 - protein, 5 aa, Mycobacterium
RVGRK

SEQ ID NO: 283797 - protein, 14 aa, Mycobacterium
RVGRPSPSDDRPIP

SEQ ID NO: 283798 - protein, 6 aa, Mycobacterium
RVGSAT

SEQ ID NO: 283799 - protein, 5 aa, Mycobacterium
RVGTE

SEQ ID NO: 283800 - protein, 13 aa, Mycobacterium
RVGTSNDDVRRRN

SEQ ID NO: 283801 - protein, 5 aa, Mycobacterium
RVHGS

SEQ ID NO: 283802 - protein, 4 aa, Mycobacterium
RVHP

SEQ ID NO: 283803 - protein, 4 aa, Mycobacterium
RVIP

SEQ ID NO: 283804 - protein, 7 aa, Mycobacterium
RVKEQNK

SEQ ID NO: 283805 - protein, 8 aa, Mycobacterium
RVLGDEDH

SEQ ID NO: 283806 - protein, 10 aa, Mycobacterium
RVLPGDGNPV

SEQ ID NO: 283807 - protein, 13 aa, Mycobacterium
RVNAKGGPEGRPG

SEQ ID NO: 283808 - protein, 13 aa, Mycobacterium
RVNAKGGPGGRPG

SEQ ID NO: 283809 - protein, 13 aa, Mycobacterium
RVNARGGPEGRPG

SEQ ID NO: 283810 - protein, 9 aa, Mycobacterium
RVNATEPVA

SEQ ID NO: 283811 - protein, 5 aa, Mycobacterium
RVNEG

SEQ ID NO: 283812 - protein, 5 aa, Mycobacterium
RVNEK

SEQ ID NO: 283813 - protein, 15 aa, Mycobacterium
RVNNTTAAALRATNS

SEQ ID NO: 283814 - protein, 7 aa, Mycobacterium
RVNPDGT

SEQ ID NO: 283815 - protein, 18 aa, Mycobacterium
RVNTERTEEAIDTGASAI

SEQ ID NO: 283816 - protein, 10 aa, Mycobacterium
RVPADAECNS

SEQ ID NO: 283817 - protein, 5 aa, Mycobacterium
RVPAS

SEQ ID NO: 283818 - protein, 5 aa, Mycobacterium
RVPDD

SEQ ID NO: 283819 - protein, 14 aa, Mycobacterium
RVPDDDSTDQNPAS

SEQ ID NO: 283820 - protein, 5 aa, Mycobacterium
RVPDV

SEQ ID NO: 283821 - protein, 33 aa, Mycobacterium
RVPDVSSVSAPAGTFAEGNRVGPPVAPTGVANG

SEQ ID NO: 283822 - protein, 8 aa, Mycobacterium
RVPENATA

SEQ ID NO: 283823 - protein, 11 aa, Mycobacterium
RVPERDPRTEV

SEQ ID NO: 283824 - protein, 5 aa, Mycobacterium
RVPGA

SEQ ID NO: 283825 - protein, 7 aa, Mycobacterium
RVPGAVS

SEQ ID NO: 283826 - protein, 21 aa, Mycobacterium
RVPGGEVNVQPPPEIPRPVPS

SEQ ID NO: 283827 - protein, 5 aa, Mycobacterium
RVPGT

SEQ ID NO: 283828 - protein, 60 aa, Mycobacterium
RVPGTSDPDDLEPPPPPATPPIPPAPVAPGGINGAGRPAVAPASYGGNVGPVGSRGERDQ

SEQ ID NO: 283829 - protein, 24 aa, Mycobacterium
RVPPEPPPIPPPAPAPPPAPYRPP

SEQ ID NO: 283830 - protein, 4 aa, Mycobacterium
RVPR

SEQ ID NO: 283831 - protein, 11 aa, Mycobacterium
RVPSPRISPTE

SEQ ID NO: 283832 - protein, 10 aa, Mycobacterium
RVPSSTTSEQ

SEQ ID NO: 283833 - protein, 8 aa, Mycobacterium
RVQGGKAV

SEQ ID NO: 283834 - protein, 26 aa, Mycobacterium
RVQPPAARPPAKQAAARKAPKAATRL

SEQ ID NO: 283835 - protein, 15 aa, Mycobacterium
RVQQETRQAQRAAER

SEQ ID NO: 283836 - protein, 11 aa, Mycobacterium
RVQRGEANNPR

SEQ ID NO: 283837 - protein, 9 aa, Mycobacterium
RVRDAGRAG

SEQ ID NO: 283838 - protein, 8 aa, Mycobacterium
RVRDDGKE

SEQ ID NO: 283839 - protein, 10 aa, Mycobacterium
RVREDQEALN

SEQ ID NO: 283840 - protein, 9 aa, Mycobacterium
RVRGGDMGS

SEQ ID NO: 283841 - protein, 8 aa, Mycobacterium
RVRPDQKR

SEQ ID NO: 283842 - protein, 6 aa, Mycobacterium
RVRPSD

SEQ ID NO: 283843 - protein, 22 aa, Mycobacterium
RVRRRASRAAGPAKAEAAQAAT

SEQ ID NO: 283844 - protein, 18 aa, Mycobacterium
RVRSGSCDVEQGRPPGTV

SEQ ID NO: 283845 - protein, 17 aa, Mycobacterium
RVRSRRRRAGIPPNGLS

SEQ ID NO: 283846 - protein, 5 aa, Mycobacterium
RVSAT

SEQ ID NO: 283847 - protein, 6 aa, Mycobacterium
RVSATE

SEQ ID NO: 283848 - protein, 5 aa, Mycobacterium
RVSDD

SEQ ID NO: 283849 - protein, 13 aa, Mycobacterium
RVSEAGRAGYGSL

SEQ ID NO: 283850 - protein, 7 aa, Mycobacterium
RVSGDER

SEQ ID NO: 283851 - protein, 7 aa, Mycobacterium
RVSGEHE

SEQ ID NO: 283852 - protein, 7 aa, Mycobacterium
RVSGKHR

SEQ ID NO: 283853 - protein, 25 aa, Mycobacterium
RVSGPSGSGPRPSATPGQPPGPDRP

SEQ ID NO: 283854 - protein, 5 aa, Mycobacterium
RVSGT

SEQ ID NO: 283855 - protein, 7 aa, Mycobacterium
RVSKTRA

SEQ ID NO: 283856 - protein, 10 aa, Mycobacterium
RVSKTRAALS

SEQ ID NO: 283857 - protein, 7 aa, Mycobacterium
RVSPAHY

SEQ ID NO: 283858 - protein, 7 aa, Mycobacterium
RVSPTSA

SEQ ID NO: 283859 - protein, 9 aa, Mycobacterium
RVSRNAPRE

SEQ ID NO: 283860 - protein, 8 aa, Mycobacterium
RVSRTEMT

SEQ ID NO: 283861 - protein, 14 aa, Mycobacterium
RVSSQAARRNMSEP

SEQ ID NO: 283862 - protein, 13 aa, Mycobacterium
RVTAATSAKTLGD

SEQ ID NO: 283863 - protein, 5 aa, Mycobacterium
RVTDT

SEQ ID NO: 283864 - protein, 8 aa, Mycobacterium
RVTGTAEH

SEQ ID NO: 283865 - protein, 17 aa, Mycobacterium
RVTKSQRQGFSTRLGRF

SEQ ID NO: 283866 - protein, 28 aa, Mycobacterium
RVTPADHVTQDDHTTGAAAGTPTAQRVP

SEQ ID NO: 283867 - protein, 13 aa, Mycobacterium
RVTPYDVGPTPSW

SEQ ID NO: 283868 - protein, 12 aa, Mycobacterium
RVTSATGTGAAG

SEQ ID NO: 283869 - protein, 8 aa, Mycobacterium
RVTSSAAA

SEQ ID NO: 283870 - protein, 8 aa, Mycobacterium
RVTSSASA

SEQ ID NO: 283871 - protein, 9 aa, Mycobacterium
RVTTSATSQ

SEQ ID NO: 283872 - protein, 4 aa, Mycobacterium
RVVP

SEQ ID NO: 283873 - protein, 12 aa, Mycobacterium
RWGPQAGTAGAA

SEQ ID NO: 283874 - protein, 12 aa, Mycobacterium
RWGPQTGTAGAA

SEQ ID NO: 283875 - protein, 9 aa, Mycobacterium
RWNDDGSAT

SEQ ID NO: 283876 - protein, 4 aa, Mycobacterium
RWPD

SEQ ID NO: 283877 - protein, 7 aa, Mycobacterium
RWPRGGR

SEQ ID NO: 283878 - protein, 15 aa, Mycobacterium
RWPVEGTKAEKRAER

SEQ ID NO: 283879 - protein, 11 aa, Mycobacterium
RWSPDSGETIA

SEQ ID NO: 283880 - protein, 11 aa, Mycobacterium
RYAAPAPDAIY

SEQ ID NO: 283881 - protein, 15 aa, Mycobacterium
RYADPHTRGRIPAPN

SEQ ID NO: 283882 - protein, 13 aa, Mycobacterium
RYAEAQAAADNAK

SEQ ID NO: 283883 - protein, 13 aa, Mycobacterium
RYAEAQAAADSAK

SEQ ID NO: 283884 - protein, 13 aa, Mycobacterium
RYAEAQASAESAK

SEQ ID NO: 283885 - protein, 9 aa, Mycobacterium
RYAGEDRET

SEQ ID NO: 283886 - protein, 5 aa, Mycobacterium
RYANT

SEQ ID NO: 283887 - protein, 8 aa, Mycobacterium
RYASGKLQ

SEQ ID NO: 283888 - protein, 6 aa, Mycobacterium
RYDGRP

SEQ ID NO: 283889 - protein, 4 aa, Mycobacterium
RYDP

SEQ ID NO: 283890 - protein, 8 aa, Mycobacterium
RYDPASPG

SEQ ID NO: 283891 - protein, 13 aa, Mycobacterium
RYDPPGAPEQFGR

SEQ ID NO: 283892 - protein, 7 aa, Mycobacterium
RYDTATG

SEQ ID NO: 283893 - protein, 8 aa, Mycobacterium
RYEGPGAL

SEQ ID NO: 283894 - protein, 4 aa, Mycobacterium
RYGA

SEQ ID NO: 283895 - protein, 15 aa, Mycobacterium
RYGDPDGDSAGDSGV

SEQ ID NO: 283896 - protein, 9 aa, Mycobacterium
RYGGPLPDS

SEQ ID NO: 283897 - protein, 10 aa, Mycobacterium
RYGKPDATNA

SEQ ID NO: 283898 - protein, 11 aa, Mycobacterium
RYGKSDATDEE

SEQ ID NO: 283899 - protein, 5 aa, Mycobacterium
RYGPK

SEQ ID NO: 283900 - protein, 6 aa, Mycobacterium
RYGPQA

SEQ ID NO: 283901 - protein, 6 aa, Mycobacterium
RYGPRA

SEQ ID NO: 283902 - protein, 7 aa, Mycobacterium
RYGPRAP

SEQ ID NO: 283903 - protein, 17 aa, Mycobacterium
RYGPRPEEAHWQSNSSP

SEQ ID NO: 283904 - protein, 5 aa, Mycobacterium
RYGPT

SEQ ID NO: 283905 - protein, 5 aa, Mycobacterium
RYGRS

SEQ ID NO: 283906 - protein, 10 aa, Mycobacterium
RYGTPPAAAA

SEQ ID NO: 283907 - protein, 9 aa, Mycobacterium
RYNPESGRA

SEQ ID NO: 283908 - protein, 9 aa, Mycobacterium
RYPASGGTY

SEQ ID NO: 283909 - protein, 6 aa, Mycobacterium
RYPATT

SEQ ID NO: 283910 - protein, 9 aa, Mycobacterium
RYPESGGTY

SEQ ID NO: 283911 - protein, 6 aa, Mycobacterium
RYPGAP

SEQ ID NO: 283912 - protein, 7 aa, Mycobacterium
RYPGAPR

SEQ ID NO: 283913 - protein, 9 aa, Mycobacterium
RYPGAPRRE

SEQ ID NO: 283914 - protein, 6 aa, Mycobacterium
RYPGMA

SEQ ID NO: 283915 - protein, 15 aa, Mycobacterium
RYPGTKSKDKHRLGS

SEQ ID NO: 283916 - protein, 4 aa, Mycobacterium
RYPH

SEQ ID NO: 283917 - protein, 4 aa, Mycobacterium
RYPP

SEQ ID NO: 283918 - protein, 5 aa, Mycobacterium
RYPSN

SEQ ID NO: 283919 - protein, 10 aa, Mycobacterium
RYQDKNGSLR

SEQ ID NO: 283920 - protein, 4 aa, Mycobacterium
RYSG

SEQ ID NO: 283921 - protein, 4 aa, Mycobacterium
RYSQ

SEQ ID NO: 283922 - protein, 8 aa, Mycobacterium
RYSQAARR

SEQ ID NO: 283923 - protein, 4 aa, Mycobacterium
RYSY

SEQ ID NO: 283924 - protein, 7 aa, Mycobacterium
RYTEGEA

SEQ ID NO: 283925 - protein, 9 aa, Mycobacterium
RYTPSSAAK

SEQ ID NO: 283926 - protein, 10 aa, Mycobacterium
RYTPSSASKL

SEQ ID NO: 283927 - protein, 14 aa, Mycobacterium
RYVSDNGGTPAAGD

SEQ ID NO: 283928 - protein, 8 aa, Mycobacterium
SAAAAAGL

SEQ ID NO: 283929 - protein, 7 aa, Mycobacterium
SAAAAGL

SEQ ID NO: 283930 - protein, 10 aa, Mycobacterium
SAAAANSSAV

SEQ ID NO: 283931 - protein, 6 aa, Mycobacterium
SAAAAY

SEQ ID NO: 283932 - protein, 8 aa, Mycobacterium
SAAADPRA

SEQ ID NO: 283933 - protein, 9 aa, Mycobacterium
SAAADPRAK

SEQ ID NO: 283934 - protein, 13 aa, Mycobacterium
SAAAEFSEPLPTG

SEQ ID NO: 283935 - protein, 7 aa, Mycobacterium
SAAAGET

SEQ ID NO: 283936 - protein, 6 aa, Mycobacterium
SAAAGG

SEQ ID NO: 283937 - protein, 7 aa, Mycobacterium
SAAAGTG

SEQ ID NO: 283938 - protein, 8 aa, Mycobacterium
SAAAQFER

SEQ ID NO: 283939 - protein, 11 aa, Mycobacterium
SAAAQLRASSP

SEQ ID NO: 283940 - protein, 8 aa, Mycobacterium
SAAAQRGG

SEQ ID NO: 283941 - protein, 8 aa, Mycobacterium
SAAASGAG

SEQ ID NO: 283942 - protein, 9 aa, Mycobacterium
SAAASSSAV

SEQ ID NO: 283943 - protein, 9 aa, Mycobacterium
SAAASSSSV

SEQ ID NO: 283944 - protein, 7 aa, Mycobacterium
SAAASVL

SEQ ID NO: 283945 - protein, 6 aa, Mycobacterium
SAAATT

SEQ ID NO: 283946 - protein, 15 aa, Mycobacterium
SAAAVAATPHTNHAP

SEQ ID NO: 283947 - protein, 8 aa, Mycobacterium
SAADAARE

SEQ ID NO: 283948 - protein, 8 aa, Mycobacterium
SAADANNA

SEQ ID NO: 283949 - protein, 8 aa, Mycobacterium
SAADEQDN

SEQ ID NO: 283950 - protein, 21 aa, Mycobacterium
SAADPVATTTTGRRRLSQPAR

SEQ ID NO: 283951 - protein, 14 aa, Mycobacterium
SAADTQDDASNAER

SEQ ID NO: 283952 - protein, 7 aa, Mycobacterium
SAADYPE

SEQ ID NO: 283953 - protein, 7 aa, Mycobacterium
SAAEAAD

SEQ ID NO: 283954 - protein, 24 aa, Mycobacterium
SAAEAADAAPVRHRTPEGLPVRRP

SEQ ID NO: 283955 - protein, 22 aa, Mycobacterium
SAAEAQGSSETAVDTAPRRLSP

SEQ ID NO: 283956 - protein, 11 aa, Mycobacterium
SAAEGVTRSPL

SEQ ID NO: 283957 - protein, 18 aa, Mycobacterium
SAAEHRATAERYAAAGDW

SEQ ID NO: 283958 - protein, 7 aa, Mycobacterium
SAAEKIE

SEQ ID NO: 283959 - protein, 6 aa, Mycobacterium
SAAELD

SEQ ID NO: 283960 - protein, 16 aa, Mycobacterium
SAAELENELGDPNSKM

SEQ ID NO: 283961 - protein, 12 aa, Mycobacterium
SAAEQGPATEQA

SEQ ID NO: 283962 - protein, 13 aa, Mycobacterium
SAAEQRALPGEGA

SEQ ID NO: 283963 - protein, 7 aa, Mycobacterium
SAAERSY

SEQ ID NO: 283964 - protein, 13 aa, Mycobacterium
SAAESGTTGWEAV

SEQ ID NO: 283965 - protein, 6 aa, Mycobacterium
SAAESL

SEQ ID NO: 283966 - protein, 10 aa, Mycobacterium
SAAESRAALG

SEQ ID NO: 283967 - protein, 7 aa, Mycobacterium
SAAESRT

SEQ ID NO: 283968 - protein, 13 aa, Mycobacterium
SAAGAAAATAIAA

SEQ ID NO: 283969 - protein, 7 aa, Mycobacterium
SAAGAAS

SEQ ID NO: 283970 - protein, 10 aa, Mycobacterium
SAAGAATTSE

SEQ ID NO: 283971 - protein, 9 aa, Mycobacterium
SAAGAGGYA

SEQ ID NO: 283972 - protein, 8 aa, Mycobacterium
SAAGGLAQ

SEQ ID NO: 283973 - protein, 7 aa, Mycobacterium
SAAGGTP

SEQ ID NO: 283974 - protein, 5 aa, Mycobacterium
SAAGL

SEQ ID NO: 283975 - protein, 11 aa, Mycobacterium
SAAGLSAAEAA

SEQ ID NO: 283976 - protein, 8 aa, Mycobacterium
SAAGPGLG

SEQ ID NO: 283977 - protein, 16 aa, Mycobacterium
SAAGTIDLTGTSAIGS

SEQ ID NO: 283978 - protein, 8 aa, Mycobacterium
SAAGYLPS

SEQ ID NO: 283979 - protein, 8 aa, Mycobacterium
SAAHSPEH

SEQ ID NO: 283980 - protein, 10 aa, Mycobacterium
SAAHTSPDRI

SEQ ID NO: 283981 - protein, 9 aa, Mycobacterium
SAALASQAY

SEQ ID NO: 283982 - protein, 10 aa, Mycobacterium
SAALNTDQNI

SEQ ID NO: 283983 - protein, 4 aa, Mycobacterium
SAAN

SEQ ID NO: 283984 - protein, 12 aa, Mycobacterium
SAANDAAAATTT

SEQ ID NO: 283985 - protein, 11 aa, Mycobacterium
SAANNNGSAFG

SEQ ID NO: 283986 - protein, 10 aa, Mycobacterium
SAAPAAPITQ

SEQ ID NO: 283987 - protein, 10 aa, Mycobacterium
SAAPAPRRGL

SEQ ID NO: 283988 - protein, 5 aa, Mycobacterium
SAAPE

SEQ ID NO: 283989 - protein, 22 aa, Mycobacterium
SAAPGAQPSAPVTEPDSPFGGQ

SEQ ID NO: 283990 - protein, 9 aa, Mycobacterium
SAAPGRPKL

SEQ ID NO: 283991 - protein, 8 aa, Mycobacterium
SAAPPSIG

SEQ ID NO: 283992 - protein, 18 aa, Mycobacterium
SAAPRQSEATQAAGPGSL

SEQ ID NO: 283993 - protein, 9 aa, Mycobacterium
SAAPTMGGA

SEQ ID NO: 283994 - protein, 9 aa, Mycobacterium
SAAQPASLA

SEQ ID NO: 283995 - protein, 6 aa, Mycobacterium
SAAQVR

SEQ ID NO: 283996 - protein, 6 aa, Mycobacterium
SAARAA

SEQ ID NO: 283997 - protein, 19 aa, Mycobacterium
SAARANDDAGAANTPVPGG

SEQ ID NO: 283998 - protein, 8 aa, Mycobacterium
SAARATPQ

SEQ ID NO: 283999 - protein, 14 aa, Mycobacterium
SAARNANNSNGADI

SEQ ID NO: 284000 - protein, 7 aa, Mycobacterium
SAARNAS

SEQ ID NO: 284001 - protein, 6 aa, Mycobacterium
SAARPL

SEQ ID NO: 284002 - protein, 68 aa, Mycobacterium
SAARPQRPTGKRSRQRATAAEDADDEQSSTEPQASEEGAKKDAKKETSKAAKDKKPKTASKPAARAAS

SEQ ID NO: 284003 - protein, 15 aa, Mycobacterium
SAARQPLRQRAPSDI

SEQ ID NO: 284004 - protein, 10 aa, Mycobacterium
SAASDPGAPW

SEQ ID NO: 284005 - protein, 8 aa, Mycobacterium
SAASEPTF

SEQ ID NO: 284006 - protein, 7 aa, Mycobacterium
SAASERR

SEQ ID NO: 284007 - protein, 5 aa, Mycobacterium
SAASG

SEQ ID NO: 284008 - protein, 8 aa, Mycobacterium
SAASLTVS

SEQ ID NO: 284009 - protein, 11 aa, Mycobacterium
SAASSSGGGGF

SEQ ID NO: 284010 - protein, 11 aa, Mycobacterium
SAASSSGGGGM

SEQ ID NO: 284011 - protein, 22 aa, Mycobacterium
SAASSVGDDRIQKRATGRVNPE

SEQ ID NO: 284012 - protein, 10 aa, Mycobacterium
SAATAVADGR

SEQ ID NO: 284013 - protein, 10 aa, Mycobacterium
SAATDEKLTQ

SEQ ID NO: 284014 - protein, 12 aa, Mycobacterium
SAATDEKLTQLG

SEQ ID NO: 284015 - protein, 11 aa, Mycobacterium
SAATDPRARQL

SEQ ID NO: 284016 - protein, 5 aa, Mycobacterium
SAATG

SEQ ID NO: 284017 - protein, 8 aa, Mycobacterium
SAATGGRG

SEQ ID NO: 284018 - protein, 8 aa, Mycobacterium
SAATGTRL

SEQ ID NO: 284019 - protein, 6 aa, Mycobacterium
SAATPL

SEQ ID NO: 284020 - protein, 39 aa, Mycobacterium
SAATRQDPRLTSEGPTRVSSEPVGEHAQAASAQGGQGMG

SEQ ID NO: 284021 - protein, 6 aa, Mycobacterium
SAATST

SEQ ID NO: 284022 - protein, 6 aa, Mycobacterium
SAATTT

SEQ ID NO: 284023 - protein, 8 aa, Mycobacterium
SAATTTAG

SEQ ID NO: 284024 - protein, 6 aa, Mycobacterium
SAATYN

SEQ ID NO: 284025 - protein, 7 aa, Mycobacterium
SAAVGPS

SEQ ID NO: 284026 - protein, 9 aa, Mycobacterium
SAAVSAVPG

SEQ ID NO: 284027 - protein, 4 aa, Mycobacterium
SAAW

SEQ ID NO: 284028 - protein, 7 aa, Mycobacterium
SACSGAA

SEQ ID NO: 284029 - protein, 6 aa, Mycobacterium
SACTQT

SEQ ID NO: 284030 - protein, 13 aa, Mycobacterium
SADADGYTRSEGA

SEQ ID NO: 284031 - protein, 6 aa, Mycobacterium
SADAKI

SEQ ID NO: 284032 - protein, 13 aa, Mycobacterium
SADAVSTSGTSNA

SEQ ID NO: 284033 - protein, 6 aa, Mycobacterium
SADCAQ

SEQ ID NO: 284034 - protein, 6 aa, Mycobacterium
SADDDT

SEQ ID NO: 284035 - protein, 17 aa, Mycobacterium
SADDRDFPSRTDALGAE

SEQ ID NO: 284036 - protein, 4 aa, Mycobacterium
SADE

SEQ ID NO: 284037 - protein, 7 aa, Mycobacterium
SADEAVQ

SEQ ID NO: 284038 - protein, 7 aa, Mycobacterium
SADEKFR

SEQ ID NO: 284039 - protein, 12 aa, Mycobacterium
SADEMSETITRT

SEQ ID NO: 284040 - protein, 9 aa, Mycobacterium
SADEPSATI

SEQ ID NO: 284041 - protein, 9 aa, Mycobacterium
SADERRQRY

SEQ ID NO: 284042 - protein, 5 aa, Mycobacterium
SADES

SEQ ID NO: 284043 - protein, 23 aa, Mycobacterium
SADGAGGGVNAGSEGTEGRNTTD

SEQ ID NO: 284044 - protein, 13 aa, Mycobacterium
SADGAGKAAEHEA

SEQ ID NO: 284045 - protein, 6 aa, Mycobacterium
SADGAR

SEQ ID NO: 284046 - protein, 20 aa, Mycobacterium
SADGDTASSEADARSRAEQK

SEQ ID NO: 284047 - protein, 5 aa, Mycobacterium
SADGH

SEQ ID NO: 284048 - protein, 10 aa, Mycobacterium
SADGIKATAA

SEQ ID NO: 284049 - protein, 6 aa, Mycobacterium
SADGKS

SEQ ID NO: 284050 - protein, 10 aa, Mycobacterium
SADGRAAAAA

SEQ ID NO: 284051 - protein, 6 aa, Mycobacterium
SADGRT

SEQ ID NO: 284052 - protein, 10 aa, Mycobacterium
SADGSETGRR

SEQ ID NO: 284053 - protein, 6 aa, Mycobacterium
SADGSI

SEQ ID NO: 284054 - protein, 7 aa, Mycobacterium
SADGSIA

SEQ ID NO: 284055 - protein, 8 aa, Mycobacterium
SADGSIAD

SEQ ID NO: 284056 - protein, 8 aa, Mycobacterium
SADGSISE

SEQ ID NO: 284057 - protein, 7 aa, Mycobacterium
SADGSVT

SEQ ID NO: 284058 - protein, 7 aa, Mycobacterium
SADGTQT

SEQ ID NO: 284059 - protein, 6 aa, Mycobacterium
SADGTV

SEQ ID NO: 284060 - protein, 9 aa, Mycobacterium
SADKAKDFL

SEQ ID NO: 284061 - protein, 33 aa, Mycobacterium
SADKAKSFLENSAEKWKGCAGKTVTVTNKSKTY

SEQ ID NO: 284062 - protein, 5 aa, Mycobacterium
SADKW

SEQ ID NO: 284063 - protein, 7 aa, Mycobacterium
SADLSGD

SEQ ID NO: 284064 - protein, 16 aa, Mycobacterium
SADLTRRAGAVNPPAG

SEQ ID NO: 284065 - protein, 4 aa, Mycobacterium
SADP

SEQ ID NO: 284066 - protein, 5 aa, Mycobacterium
SADPA

SEQ ID NO: 284067 - protein, 9 aa, Mycobacterium
SADPDGAHR

SEQ ID NO: 284068 - protein, 9 aa, Mycobacterium
SADPDGTHA

SEQ ID NO: 284069 - protein, 21 aa, Mycobacterium
SADPGSEDAALREAGHAAEQR

SEQ ID NO: 284070 - protein, 7 aa, Mycobacterium
SADPGSL

SEQ ID NO: 284071 - protein, 8 aa, Mycobacterium
SADPGSLG

SEQ ID NO: 284072 - protein, 8 aa, Mycobacterium
SADPRSTE

SEQ ID NO: 284073 - protein, 8 aa, Mycobacterium
SADPSAAR

SEQ ID NO: 284074 - protein, 7 aa, Mycobacterium
SADPSGL

SEQ ID NO: 284075 - protein, 5 aa, Mycobacterium
SADPV

SEQ ID NO: 284076 - protein, 8 aa, Mycobacterium
SADPVGGW

SEQ ID NO: 284077 - protein, 10 aa, Mycobacterium
SADPVGGWRR

SEQ ID NO: 284078 - protein, 16 aa, Mycobacterium
SADPVGGWRREDPATI

SEQ ID NO: 284079 - protein, 4 aa, Mycobacterium
SADQ

SEQ ID NO: 284080 - protein, 8 aa, Mycobacterium
SADQPHPQ

SEQ ID NO: 284081 - protein, 8 aa, Mycobacterium
SADQRAEA

SEQ ID NO: 284082 - protein, 8 aa, Mycobacterium
SADQRRDR

SEQ ID NO: 284083 - protein, 5 aa, Mycobacterium
SADRA

SEQ ID NO: 284084 - protein, 11 aa, Mycobacterium
SADRDPRRYQD

SEQ ID NO: 284085 - protein, 8 aa, Mycobacterium
SADRPHTR

SEQ ID NO: 284086 - protein, 19 aa, Mycobacterium
SADSAAAAAAHESAAGAYA

SEQ ID NO: 284087 - protein, 13 aa, Mycobacterium
SADSAATAAGHDT

SEQ ID NO: 284088 - protein, 36 aa, Mycobacterium
SADSATPGSINDTKEISATATLQSGKTTIPITSSSQ

SEQ ID NO: 284089 - protein, 4 aa, Mycobacterium
SADT

SEQ ID NO: 284090 - protein, 8 aa, Mycobacterium
SADTAIEV

SEQ ID NO: 284091 - protein, 10 aa, Mycobacterium
SADTATGPWA

SEQ ID NO: 284092 - protein, 8 aa, Mycobacterium
SADTEEQR

SEQ ID NO: 284093 - protein, 6 aa, Mycobacterium
SADTEL

SEQ ID NO: 284094 - protein, 12 aa, Mycobacterium
SADTGQVLLQRS

SEQ ID NO: 284095 - protein, 6 aa, Mycobacterium
SADTTV

SEQ ID NO: 284096 - protein, 7 aa, Mycobacterium
SADTYTD

SEQ ID NO: 284097 - protein, 11 aa, Mycobacterium
SADVRSEADAR

SEQ ID NO: 284098 - protein, 6 aa, Mycobacterium
SADWDD

SEQ ID NO: 284099 - protein, 11 aa, Mycobacterium
SAEAARHGASS

SEQ ID NO: 284100 - protein, 5 aa, Mycobacterium
SAEAD

SEQ ID NO: 284101 - protein, 7 aa, Mycobacterium
SAEADEE

SEQ ID NO: 284102 - protein, 29 aa, Mycobacterium
SAEADGGATRTTGAHRESVARADEQRSRK

SEQ ID NO: 284103 - protein, 7 aa, Mycobacterium
SAEADGR

SEQ ID NO: 284104 - protein, 7 aa, Mycobacterium
SAEADRA

SEQ ID NO: 284105 - protein, 30 aa, Mycobacterium
SAEAISSDDNPGGSVQKPRAIEDETPPTTI

SEQ ID NO: 284106 - protein, 9 aa, Mycobacterium
SAEALTAQA

SEQ ID NO: 284107 - protein, 9 aa, Mycobacterium
SAEEAGRFG

SEQ ID NO: 284108 - protein, 39 aa, Mycobacterium
SAEEPSTAPEEPAEPDDATEQTGPEAGIGEAARGPSRLG

SEQ ID NO: 284109 - protein, 9 aa, Mycobacterium
SAEERNDSL

SEQ ID NO: 284110 - protein, 10 aa, Mycobacterium
SAEESARFGA

SEQ ID NO: 284111 - protein, 9 aa, Mycobacterium
SAEETARFG

SEQ ID NO: 284112 - protein, 7 aa, Mycobacterium
SAEGPIG

SEQ ID NO: 284113 - protein, 4 aa, Mycobacterium
SAEK

SEQ ID NO: 284114 - protein, 5 aa, Mycobacterium
SAEPA

SEQ ID NO: 284115 - protein, 14 aa, Mycobacterium
SAEPAPGPHDDDAE

SEQ ID NO: 284116 - protein, 13 aa, Mycobacterium
SAEPGPDDSRTYR

SEQ ID NO: 284117 - protein, 5 aa, Mycobacterium
SAEPI

SEQ ID NO: 284118 - protein, 6 aa, Mycobacterium
SAEPTH

SEQ ID NO: 284119 - protein, 6 aa, Mycobacterium
SAEQSV

SEQ ID NO: 284120 - protein, 5 aa, Mycobacterium
SAERF

SEQ ID NO: 284121 - protein, 5 aa, Mycobacterium
SAERV

SEQ ID NO: 284122 - protein, 10 aa, Mycobacterium
SAESAPAHRR

SEQ ID NO: 284123 - protein, 6 aa, Mycobacterium
SAESID

SEQ ID NO: 284124 - protein, 7 aa, Mycobacterium
SAESLKE

SEQ ID NO: 284125 - protein, 10 aa, Mycobacterium
SAESLRETLR

SEQ ID NO: 284126 - protein, 6 aa, Mycobacterium
SAESQR

SEQ ID NO: 284127 - protein, 8 aa, Mycobacterium
SAESRSVV

SEQ ID NO: 284128 - protein, 8 aa, Mycobacterium
SAESSTLS

SEQ ID NO: 284129 - protein, 6 aa, Mycobacterium
SAETPR

SEQ ID NO: 284130 - protein, 5 aa, Mycobacterium
SAETS

SEQ ID NO: 284131 - protein, 6 aa, Mycobacterium
SAETSM

SEQ ID NO: 284132 - protein, 8 aa, Mycobacterium
SAETTRAL

SEQ ID NO: 284133 - protein, 17 aa, Mycobacterium
SAEVPKSAKSAALGRQL

SEQ ID NO: 284134 - protein, 13 aa, Mycobacterium
SAEYGATDAQLQS

SEQ ID NO: 284135 - protein, 6 aa, Mycobacterium
SAFAGG

SEQ ID NO: 284136 - protein, 9 aa, Mycobacterium
SAFGAPPAR

SEQ ID NO: 284137 - protein, 6 aa, Mycobacterium
SAFGSK

SEQ ID NO: 284138 - protein, 5 aa, Mycobacterium
SAFQA

SEQ ID NO: 284139 - protein, 9 aa, Mycobacterium
SAFTAGPTF

SEQ ID NO: 284140 - protein, 19 aa, Mycobacterium
SAGAAREEARQDPRRRQPM

SEQ ID NO: 284141 - protein, 16 aa, Mycobacterium
SAGAELAAAAKAVKEQ

SEQ ID NO: 284142 - protein, 12 aa, Mycobacterium
SAGAGANPVPTD

SEQ ID NO: 284143 - protein, 22 aa, Mycobacterium
SAGAGDISLDGASNGSAPRRNP

SEQ ID NO: 284144 - protein, 6 aa, Mycobacterium
SAGAIQ

SEQ ID NO: 284145 - protein, 7 aa, Mycobacterium
SAGAIQH

SEQ ID NO: 284146 - protein, 10 aa, Mycobacterium
SAGAPFGPHA

SEQ ID NO: 284147 - protein, 6 aa, Mycobacterium
SAGAPR

SEQ ID NO: 284148 - protein, 7 aa, Mycobacterium
SAGASDM

SEQ ID NO: 284149 - protein, 7 aa, Mycobacterium
SAGATIP

SEQ ID NO: 284150 - protein, 6 aa, Mycobacterium
SAGATV

SEQ ID NO: 284151 - protein, 7 aa, Mycobacterium
SAGATVP

SEQ ID NO: 284152 - protein, 8 aa, Mycobacterium
SAGATVPL

SEQ ID NO: 284153 - protein, 9 aa, Mycobacterium
SAGATVPLE

SEQ ID NO: 284154 - protein, 9 aa, Mycobacterium
SAGAYTASR

SEQ ID NO: 284155 - protein, 20 aa, Mycobacterium
SAGCTDAGCTATAATVSPAR

SEQ ID NO: 284156 - protein, 7 aa, Mycobacterium
SAGDAPS

SEQ ID NO: 284157 - protein, 13 aa, Mycobacterium
SAGDPIAATDRKR

SEQ ID NO: 284158 - protein, 13 aa, Mycobacterium
SAGDPVAATERKR

SEQ ID NO: 284159 - protein, 11 aa, Mycobacterium
SAGDQAPNTTV

SEQ ID NO: 284160 - protein, 11 aa, Mycobacterium
SAGDQAPTTSV

SEQ ID NO: 284161 - protein, 7 aa, Mycobacterium
SAGEDGT

SEQ ID NO: 284162 - protein, 6 aa, Mycobacterium
SAGESR

SEQ ID NO: 284163 - protein, 5 aa, Mycobacterium
SAGFS

SEQ ID NO: 284164 - protein, 10 aa, Mycobacterium
SAGGDGTGRE

SEQ ID NO: 284165 - protein, 9 aa, Mycobacterium
SAGGESVGA

SEQ ID NO: 284166 - protein, 7 aa, Mycobacterium
SAGGEYG

SEQ ID NO: 284167 - protein, 8 aa, Mycobacterium
SAGGEYGS

SEQ ID NO: 284168 - protein, 5 aa, Mycobacterium
SAGGF

SEQ ID NO: 284169 - protein, 5 aa, Mycobacterium
SAGGG

SEQ ID NO: 284170 - protein, 10 aa, Mycobacterium
SAGGGPVGVG

SEQ ID NO: 284171 - protein, 10 aa, Mycobacterium
SAGGGRGTAS

SEQ ID NO: 284172 - protein, 8 aa, Mycobacterium
SAGGGTPL

SEQ ID NO: 284173 - protein, 13 aa, Mycobacterium
SAGGRPPTSARFD

SEQ ID NO: 284174 - protein, 9 aa, Mycobacterium
SAGGSAKLG

SEQ ID NO: 284175 - protein, 9 aa, Mycobacterium
SAGGSEALG

SEQ ID NO: 284176 - protein, 10 aa, Mycobacterium
SAGGTADSCA

SEQ ID NO: 284177 - protein, 7 aa, Mycobacterium
SAGHPPS

SEQ ID NO: 284178 - protein, 6 aa, Mycobacterium
SAGIGA

SEQ ID NO: 284179 - protein, 10 aa, Mycobacterium
SAGIGTTTTT

SEQ ID NO: 284180 - protein, 6 aa, Mycobacterium
SAGKVG

SEQ ID NO: 284181 - protein, 8 aa, Mycobacterium
SAGLGAGA

SEQ ID NO: 284182 - protein, 9 aa, Mycobacterium
SAGLGGAPK

SEQ ID NO: 284183 - protein, 8 aa, Mycobacterium
SAGLGQPQ

SEQ ID NO: 284184 - protein, 17 aa, Mycobacterium
SAGLRGKGLAAGKVGTF

SEQ ID NO: 284185 - protein, 7 aa, Mycobacterium
SAGLSVD

SEQ ID NO: 284186 - protein, 9 aa, Mycobacterium
SAGNGGLAV

SEQ ID NO: 284187 - protein, 7 aa, Mycobacterium
SAGPASI

SEQ ID NO: 284188 - protein, 11 aa, Mycobacterium
SAGPDSHAPRH

SEQ ID NO: 284189 - protein, 8 aa, Mycobacterium
SAGPGAAP

SEQ ID NO: 284190 - protein, 8 aa, Mycobacterium
SAGPGEPR

SEQ ID NO: 284191 - protein, 8 aa, Mycobacterium
SAGPGGPI

SEQ ID NO: 284192 - protein, 9 aa, Mycobacterium
SAGPGPAPL

SEQ ID NO: 284193 - protein, 8 aa, Mycobacterium
SAGPGPAS

SEQ ID NO: 284194 - protein, 8 aa, Mycobacterium
SAGPGPGA

SEQ ID NO: 284195 - protein, 11 aa, Mycobacterium
SAGPGPGPLQE

SEQ ID NO: 284196 - protein, 11 aa, Mycobacterium
SAGPGPGPLRE

SEQ ID NO: 284197 - protein, 10 aa, Mycobacterium
SAGPGPGPLY

SEQ ID NO: 284198 - protein, 9 aa, Mycobacterium
SAGPGPGSL

SEQ ID NO: 284199 - protein, 9 aa, Mycobacterium
SAGPGPSSL

SEQ ID NO: 284200 - protein, 7 aa, Mycobacterium
SAGPGSL

SEQ ID NO: 284201 - protein, 7 aa, Mycobacterium
SAGPPPV

SEQ ID NO: 284202 - protein, 16 aa, Mycobacterium
SAGPRPLMSFLLQKQE

SEQ ID NO: 284203 - protein, 7 aa, Mycobacterium
SAGPRRS

SEQ ID NO: 284204 - protein, 7 aa, Mycobacterium
SAGPRSA

SEQ ID NO: 284205 - protein, 8 aa, Mycobacterium
SAGPTGPI

SEQ ID NO: 284206 - protein, 8 aa, Mycobacterium
SAGQQRLD

SEQ ID NO: 284207 - protein, 8 aa, Mycobacterium
SAGQRRST

SEQ ID NO: 284208 - protein, 8 aa, Mycobacterium
SAGQSGQR

SEQ ID NO: 284209 - protein, 8 aa, Mycobacterium
SAGRPSPV

SEQ ID NO: 284210 - protein, 10 aa, Mycobacterium
SAGRTGEAAG

SEQ ID NO: 284211 - protein, 6 aa, Mycobacterium
SAGSGL

SEQ ID NO: 284212 - protein, 7 aa, Mycobacterium
SAGSGTM

SEQ ID NO: 284213 - protein, 16 aa, Mycobacterium
SAGSLTVDGAGYGPTA

SEQ ID NO: 284214 - protein, 6 aa, Mycobacterium
SAGSND

SEQ ID NO: 284215 - protein, 23 aa, Mycobacterium
SAGSRATESQTAEQPDRLPPDVG

SEQ ID NO: 284216 - protein, 10 aa, Mycobacterium
SAGSSKDTHE

SEQ ID NO: 284217 - protein, 7 aa, Mycobacterium
SAGTADR

SEQ ID NO: 284218 - protein, 17 aa, Mycobacterium
SAGTDVRDTVGRPTARA

SEQ ID NO: 284219 - protein, 10 aa, Mycobacterium
SAGTEPADRI

SEQ ID NO: 284220 - protein, 7 aa, Mycobacterium
SAGTETP

SEQ ID NO: 284221 - protein, 10 aa, Mycobacterium
SAGTGSDPSA

SEQ ID NO: 284222 - protein, 6 aa, Mycobacterium
SAGTVA

SEQ ID NO: 284223 - protein, 12 aa, Mycobacterium
SAGVDDAKEYNS

SEQ ID NO: 284224 - protein, 8 aa, Mycobacterium
SAGVGRGA

SEQ ID NO: 284225 - protein, 5 aa, Mycobacterium
SAGYS

SEQ ID NO: 284226 - protein, 15 aa, Mycobacterium
SAHARPHAKSAGTSR

SEQ ID NO: 284227 - protein, 10 aa, Mycobacterium
SAHDPAGAEL

SEQ ID NO: 284228 - protein, 8 aa, Mycobacterium
SAHEITDK

SEQ ID NO: 284229 - protein, 9 aa, Mycobacterium
SAHETDEAG

SEQ ID NO: 284230 - protein, 13 aa, Mycobacterium
SAHGVGRRRDEPV

SEQ ID NO: 284231 - protein, 11 aa, Mycobacterium
SAHPFENPTPL

SEQ ID NO: 284232 - protein, 6 aa, Mycobacterium
SAHPPA

SEQ ID NO: 284233 - protein, 6 aa, Mycobacterium
SAHPPV

SEQ ID NO: 284234 - protein, 5 aa, Mycobacterium
SAHQP

SEQ ID NO: 284235 - protein, 4 aa, Mycobacterium
SAHR

SEQ ID NO: 284236 - protein, 6 aa, Mycobacterium
SAHSSA

SEQ ID NO: 284237 - protein, 6 aa, Mycobacterium
SAIAGA

SEQ ID NO: 284238 - protein, 20 aa, Mycobacterium
SAIAKRRQKAARPTAPALTP

SEQ ID NO: 284239 - protein, 8 aa, Mycobacterium
SAIAPGTG

SEQ ID NO: 284240 - protein, 8 aa, Mycobacterium
SAIGEDGE

SEQ ID NO: 284241 - protein, 6 aa, Mycobacterium
SAIGPT

SEQ ID NO: 284242 - protein, 8 aa, Mycobacterium
SAIPDSAT

SEQ ID NO: 284243 - protein, 6 aa, Mycobacterium
SAIPEG

SEQ ID NO: 284244 - protein, 7 aa, Mycobacterium
SAIPRQT

SEQ ID NO: 284245 - protein, 9 aa, Mycobacterium
SAIPVQPSD

SEQ ID NO: 284246 - protein, 6 aa, Mycobacterium
SAIQGA

SEQ ID NO: 284247 - protein, 11 aa, Mycobacterium
SAIRPGSGRWG

SEQ ID NO: 284248 - protein, 4 aa, Mycobacterium
SAIS

SEQ ID NO: 284249 - protein, 5 aa, Mycobacterium
SAISS

SEQ ID NO: 284250 - protein, 4 aa, Mycobacterium
SAIT

SEQ ID NO: 284251 - protein, 7 aa, Mycobacterium
SAITGEN

SEQ ID NO: 284252 - protein, 7 aa, Mycobacterium
SAKAGLD

SEQ ID NO: 284253 - protein, 8 aa, Mycobacterium
SAKAVGAK

SEQ ID NO: 284254 - protein, 8 aa, Mycobacterium
SAKEQLSA

SEQ ID NO: 284255 - protein, 7 aa, Mycobacterium
SAKGHLG

SEQ ID NO: 284256 - protein, 90 aa, Mycobacterium
SAKKASGSATRPAKAKAKPKAAPRSAKAKPDARARTRATAGRVAGRANSRTGAQTARTAGKTTRAGHRTADPGARRRSQQPGSSRRSAVR

SEQ ID NO: 284257 - protein, 13 aa, Mycobacterium
SAKNQALTAEPAA

SEQ ID NO: 284258 - protein, 9 aa, Mycobacterium
SAKNQYSGD

SEQ ID NO: 284259 - protein, 10 aa, Mycobacterium
SAKPADDEHR

SEQ ID NO: 284260 - protein, 10 aa, Mycobacterium
SAKPGPNGEV

SEQ ID NO: 284261 - protein, 9 aa, Mycobacterium
SAKSATAAA

SEQ ID NO: 284262 - protein, 7 aa, Mycobacterium
SAKVDEN

SEQ ID NO: 284263 - protein, 8 aa, Mycobacterium
SALAADGT

SEQ ID NO: 284264 - protein, 6 aa, Mycobacterium
SALAGA

SEQ ID NO: 284265 - protein, 17 aa, Mycobacterium
SALATGDDGEPTTAART

SEQ ID NO: 284266 - protein, 10 aa, Mycobacterium
SALEGDVDGS

SEQ ID NO: 284267 - protein, 10 aa, Mycobacterium
SALGAPAGFA

SEQ ID NO: 284268 - protein, 5 aa, Mycobacterium
SALGG

SEQ ID NO: 284269 - protein, 13 aa, Mycobacterium
SALGPDAGWQGTA

SEQ ID NO: 284270 - protein, 16 aa, Mycobacterium
SALGPDGKKTGPFPAD

SEQ ID NO: 284271 - protein, 4 aa, Mycobacterium
SALN

SEQ ID NO: 284272 - protein, 4 aa, Mycobacterium
SALP

SEQ ID NO: 284273 - protein, 8 aa, Mycobacterium
SALPGQPL

SEQ ID NO: 284274 - protein, 10 aa, Mycobacterium
SALPGTDRTG

SEQ ID NO: 284275 - protein, 11 aa, Mycobacterium
SALPTAGGGYT

SEQ ID NO: 284276 - protein, 9 aa, Mycobacterium
SALQGPGGT

SEQ ID NO: 284277 - protein, 125 aa, Mycobacterium
SALQPDADDTDEATESRRGRTSGSSARTRRTARDGRSSTRSRSRHARPSLDDESVERLERPRRSTRRNPAAARDYDAEPPRRSRRRPRPEGDPDLRGQTPREPRREPRTRRNPYERPYDRPRGSR

SEQ ID NO: 284278 - protein, 8 aa, Mycobacterium
SALRTGKV

SEQ ID NO: 284279 - protein, 6 aa, Mycobacterium
SALSDA

SEQ ID NO: 284280 - protein, 13 aa, Mycobacterium
SALTAAAAYAAAS

SEQ ID NO: 284281 - protein, 14 aa, Mycobacterium
SALTAAGAYGAASS

SEQ ID NO: 284282 - protein, 6 aa, Mycobacterium
SALTGE

SEQ ID NO: 284283 - protein, 8 aa, Mycobacterium
SALTGEPL

SEQ ID NO: 284284 - protein, 13 aa, Mycobacterium
SALTGESAPVDKA

SEQ ID NO: 284285 - protein, 9 aa, Mycobacterium
SALTGESVP

SEQ ID NO: 284286 - protein, 15 aa, Mycobacterium
SAMKGDGKGGGPAAD

SEQ ID NO: 284287 - protein, 9 aa, Mycobacterium
SAMNTSGRA

SEQ ID NO: 284288 - protein, 7 aa, Mycobacterium
SAMPSRH

SEQ ID NO: 284289 - protein, 8 aa, Mycobacterium
SAMQGQPG

SEQ ID NO: 284290 - protein, 10 aa, Mycobacterium
SAMTGSGSGI

SEQ ID NO: 284291 - protein, 19 aa, Mycobacterium
SAMTPAARRAANDDSVTRG

SEQ ID NO: 284292 - protein, 6 aa, Mycobacterium
SANASP

SEQ ID NO: 284293 - protein, 7 aa, Mycobacterium
SANDKIG

SEQ ID NO: 284294 - protein, 12 aa, Mycobacterium
SANDPNCDSDPC

SEQ ID NO: 284295 - protein, 12 aa, Mycobacterium
SANDPTCDSDPC

SEQ ID NO: 284296 - protein, 10 aa, Mycobacterium
SANESRAAIG

SEQ ID NO: 284297 - protein, 4 aa, Mycobacterium
SANF

SEQ ID NO: 284298 - protein, 25 aa, Mycobacterium
SANGAQEHTDTTQTTPLENPDQPRQ

SEQ ID NO: 284299 - protein, 5 aa, Mycobacterium
SANGT

SEQ ID NO: 284300 - protein, 4 aa, Mycobacterium
SANP

SEQ ID NO: 284301 - protein, 7 aa, Mycobacterium
SANPEVP

SEQ ID NO: 284302 - protein, 6 aa, Mycobacterium
SANPHA

SEQ ID NO: 284303 - protein, 6 aa, Mycobacterium
SANRDE

SEQ ID NO: 284304 - protein, 10 aa, Mycobacterium
SANRSQASCP

SEQ ID NO: 284305 - protein, 5 aa, Mycobacterium
SANSD

SEQ ID NO: 284306 - protein, 7 aa, Mycobacterium
SANSTAM

SEQ ID NO: 284307 - protein, 8 aa, Mycobacterium
SANSTTHV

SEQ ID NO: 284308 - protein, 4 aa, Mycobacterium
SANT

SEQ ID NO: 284309 - protein, 5 aa, Mycobacterium
SANVA

SEQ ID NO: 284310 - protein, 14 aa, Mycobacterium
SANVQAGAKSRAST

SEQ ID NO: 284311 - protein, 5 aa, Mycobacterium
SANYR

SEQ ID NO: 284312 - protein, 11 aa, Mycobacterium
SAPAAASPSPV

SEQ ID NO: 284313 - protein, 10 aa, Mycobacterium
SAPAAGAQPS

SEQ ID NO: 284314 - protein, 11 aa, Mycobacterium
SAPAAPHPRRP

SEQ ID NO: 284315 - protein, 6 aa, Mycobacterium
SAPAAR

SEQ ID NO: 284316 - protein, 7 aa, Mycobacterium
SAPAAVR

SEQ ID NO: 284317 - protein, 10 aa, Mycobacterium
SAPADAGNGI

SEQ ID NO: 284318 - protein, 6 aa, Mycobacterium
SAPADG

SEQ ID NO: 284319 - protein, 6 aa, Mycobacterium
SAPADL

SEQ ID NO: 284320 - protein, 11 aa, Mycobacterium
SAPAGEPAAGA

SEQ ID NO: 284321 - protein, 8 aa, Mycobacterium
SAPAHKRG

SEQ ID NO: 284322 - protein, 6 aa, Mycobacterium
SAPAIE

SEQ ID NO: 284323 - protein, 5 aa, Mycobacterium
SAPAL

SEQ ID NO: 284324 - protein, 8 aa, Mycobacterium
SAPALANQ

SEQ ID NO: 284325 - protein, 7 aa, Mycobacterium
SAPALPS

SEQ ID NO: 284326 - protein, 8 aa, Mycobacterium
SAPANAYA

SEQ ID NO: 284327 - protein, 9 aa, Mycobacterium
SAPAPPHRS

SEQ ID NO: 284328 - protein, 9 aa, Mycobacterium
SAPAPRPKF

SEQ ID NO: 284329 - protein, 144 aa, Mycobacterium
SAPAPRPKFDPYGQYGQYGQYGQYGGQPGGYYGQPGAQQSAPNPQQSPQQPSGYGSQYGGFTSSQGSNPSSGGFSAPQAQSAPQPMHQTPSTPPTGFPSFSPPPSVSAGTGSQGGSAPVNYGNPGGGQQNYGQGQQSSSPGSAP

SEQ ID NO: 284330 - protein, 20 aa, Mycobacterium
SAPASAPTTVDDDARTPHGP

SEQ ID NO: 284331 - protein, 7 aa, Mycobacterium
SAPASRL

SEQ ID NO: 284332 - protein, 6 aa, Mycobacterium
SAPATV

SEQ ID NO: 284333 - protein, 12 aa, Mycobacterium
SAPAYEQNPYPN

SEQ ID NO: 284334 - protein, 5 aa, Mycobacterium
SAPDL

SEQ ID NO: 284335 - protein, 6 aa, Mycobacterium
SAPDRV

SEQ ID NO: 284336 - protein, 21 aa, Mycobacterium
SAPDTATPVDRSGGYTASSSI

SEQ ID NO: 284337 - protein, 4 aa, Mycobacterium
SAPE

SEQ ID NO: 284338 - protein, 7 aa, Mycobacterium
SAPEDSW

SEQ ID NO: 284339 - protein, 16 aa, Mycobacterium
SAPEPTHTSLADRAPA

SEQ ID NO: 284340 - protein, 5 aa, Mycobacterium
SAPEQ

SEQ ID NO: 284341 - protein, 8 aa, Mycobacterium
SAPEQLQS

SEQ ID NO: 284342 - protein, 18 aa, Mycobacterium
SAPEQLTADEAIDGRADQ

SEQ ID NO: 284343 - protein, 5 aa, Mycobacterium
SAPGA

SEQ ID NO: 284344 - protein, 6 aa, Mycobacterium
SAPGED

SEQ ID NO: 284345 - protein, 6 aa, Mycobacterium
SAPGFT

SEQ ID NO: 284346 - protein, 9 aa, Mycobacterium
SAPGGQEPV

SEQ ID NO: 284347 - protein, 7 aa, Mycobacterium
SAPGPKI

SEQ ID NO: 284348 - protein, 7 aa, Mycobacterium
SAPGPVP

SEQ ID NO: 284349 - protein, 9 aa, Mycobacterium
SAPGSGGTE

SEQ ID NO: 284350 - protein, 8 aa, Mycobacterium
SAPGTGRL

SEQ ID NO: 284351 - protein, 13 aa, Mycobacterium
SAPGWYPDPAGVG

SEQ ID NO: 284352 - protein, 9 aa, Mycobacterium
SAPHNSPAP

SEQ ID NO: 284353 - protein, 6 aa, Mycobacterium
SAPHQA

SEQ ID NO: 284354 - protein, 6 aa, Mycobacterium
SAPHSP

SEQ ID NO: 284355 - protein, 5 aa, Mycobacterium
SAPIR

SEQ ID NO: 284356 - protein, 9 aa, Mycobacterium
SAPKCPLPR

SEQ ID NO: 284357 - protein, 7 aa, Mycobacterium
SAPLGDQ

SEQ ID NO: 284358 - protein, 8 aa, Mycobacterium
SAPLPTGA

SEQ ID NO: 284359 - protein, 10 aa, Mycobacterium
SAPMPTAQAP

SEQ ID NO: 284360 - protein, 7 aa, Mycobacterium
SAPNAKS

SEQ ID NO: 284361 - protein, 7 aa, Mycobacterium
SAPNCPL

SEQ ID NO: 284362 - protein, 9 aa, Mycobacterium
SAPNHPAAH

SEQ ID NO: 284363 - protein, 7 aa, Mycobacterium
SAPPAAL

SEQ ID NO: 284364 - protein, 7 aa, Mycobacterium
SAPPAVR

SEQ ID NO: 284365 - protein, 7 aa, Mycobacterium
SAPPELP

SEQ ID NO: 284366 - protein, 8 aa, Mycobacterium
SAPPGATT

SEQ ID NO: 284367 - protein, 7 aa, Mycobacterium
SAPPIAA

SEQ ID NO: 284368 - protein, 9 aa, Mycobacterium
SAPPLKSRR

SEQ ID NO: 284369 - protein, 10 aa, Mycobacterium
SAPPLKSRRQ

SEQ ID NO: 284370 - protein, 7 aa, Mycobacterium
SAPPLPA

SEQ ID NO: 284371 - protein, 16 aa, Mycobacterium
SAPPLPEPDLGTTEDT

SEQ ID NO: 284372 - protein, 7 aa, Mycobacterium
SAPPPRI

SEQ ID NO: 284373 - protein, 8 aa, Mycobacterium
SAPPPTPE

SEQ ID NO: 284374 - protein, 17 aa, Mycobacterium
SAPPSDPGDERPGRHRA

SEQ ID NO: 284375 - protein, 6 aa, Mycobacterium
SAPPVT

SEQ ID NO: 284376 - protein, 7 aa, Mycobacterium
SAPPVTG

SEQ ID NO: 284377 - protein, 6 aa, Mycobacterium
SAPQCP

SEQ ID NO: 284378 - protein, 7 aa, Mycobacterium
SAPQDSW

SEQ ID NO: 284379 - protein, 39 aa, Mycobacterium
SAPQGRTGRHAAAEPGDEPQAPESALTPTVASGPSPAVR

SEQ ID NO: 284380 - protein, 25 aa, Mycobacterium
SAPQGTYTDGRAVGPPDAPTGVAGG

SEQ ID NO: 284381 - protein, 6 aa, Mycobacterium
SAPQRY

SEQ ID NO: 284382 - protein, 6 aa, Mycobacterium
SAPRAG

SEQ ID NO: 284383 - protein, 14 aa, Mycobacterium
SAPREGAATAHAPD

SEQ ID NO: 284384 - protein, 6 aa, Mycobacterium
SAPRGS

SEQ ID NO: 284385 - protein, 7 aa, Mycobacterium
SAPRTAP

SEQ ID NO: 284386 - protein, 6 aa, Mycobacterium
SAPSAI

SEQ ID NO: 284387 - protein, 12 aa, Mycobacterium
SAPSAQQPQRPQ

SEQ ID NO: 284388 - protein, 12 aa, Mycobacterium
SAPSDQASGALQ

SEQ ID NO: 284389 - protein, 14 aa, Mycobacterium
SAPSNQGQEAANRH

SEQ ID NO: 284390 - protein, 9 aa, Mycobacterium
SAPSPASRV

SEQ ID NO: 284391 - protein, 15 aa, Mycobacterium
SAPSPATAPSQQQVR

SEQ ID NO: 284392 - protein, 7 aa, Mycobacterium
SAPSPGD

SEQ ID NO: 284393 - protein, 8 aa, Mycobacterium
SAPSPSIG

SEQ ID NO: 284394 - protein, 25 aa, Mycobacterium
SAPSQSPTKLADTTALTPNTPLQPG

SEQ ID NO: 284395 - protein, 39 aa, Mycobacterium
SAPSTAPATTVAGSAGGGPVGGGPGVGFGPTATDGIGAG

SEQ ID NO: 284396 - protein, 8 aa, Mycobacterium
SAPSTGLT

SEQ ID NO: 284397 - protein, 5 aa, Mycobacterium
SAPTA

SEQ ID NO: 284398 - protein, 16 aa, Mycobacterium
SAPTATATKSAGQAPV

SEQ ID NO: 284399 - protein, 6 aa, Mycobacterium
SAPTGM

SEQ ID NO: 284400 - protein, 21 aa, Mycobacterium
SAPTHIAGGSMPAAQTPQTGA

SEQ ID NO: 284401 - protein, 8 aa, Mycobacterium
SAPTSTTV

SEQ ID NO: 284402 - protein, 11 aa, Mycobacterium
SAPTTAAPSVP

SEQ ID NO: 284403 - protein, 6 aa, Mycobacterium
SAPTYQ

SEQ ID NO: 284404 - protein, 8 aa, Mycobacterium
SAPVGGNA

SEQ ID NO: 284405 - protein, 43 aa, Mycobacterium
SAPVKEPPAPPKEPQRPRRLDTTGLPAVGDDATIPRDAPKRPI

SEQ ID NO: 284406 - protein, 7 aa, Mycobacterium
SAPVTPE

SEQ ID NO: 284407 - protein, 8 aa, Mycobacterium
SAPWGENP

SEQ ID NO: 284408 - protein, 4 aa, Mycobacterium
SAPY

SEQ ID NO: 284409 - protein, 5 aa, Mycobacterium
SAQAR

SEQ ID NO: 284410 - protein, 6 aa, Mycobacterium
SAQARP

SEQ ID NO: 284411 - protein, 14 aa, Mycobacterium
SAQATAAESGSSLD

SEQ ID NO: 284412 - protein, 7 aa, Mycobacterium
SAQATQV

SEQ ID NO: 284413 - protein, 9 aa, Mycobacterium
SAQDGKTAV

SEQ ID NO: 284414 - protein, 10 aa, Mycobacterium
SAQDRAGQVY

SEQ ID NO: 284415 - protein, 10 aa, Mycobacterium
SAQGERAGAV

SEQ ID NO: 284416 - protein, 5 aa, Mycobacterium
SAQGR

SEQ ID NO: 284417 - protein, 9 aa, Mycobacterium
SAQHGTRYT

SEQ ID NO: 284418 - protein, 11 aa, Mycobacterium
SAQKGRNGEVG

SEQ ID NO: 284419 - protein, 7 aa, Mycobacterium
SAQLSGD

SEQ ID NO: 284420 - protein, 18 aa, Mycobacterium
SAQPDPSPLPPSVEVTPK

SEQ ID NO: 284421 - protein, 6 aa, Mycobacterium
SAQPSA

SEQ ID NO: 284422 - protein, 9 aa, Mycobacterium
SAQQVTDEE

SEQ ID NO: 284423 - protein, 18 aa, Mycobacterium
SAQRAIAAGAELAPRSVG

SEQ ID NO: 284424 - protein, 7 aa, Mycobacterium
SAQRGQA

SEQ ID NO: 284425 - protein, 10 aa, Mycobacterium
SAQRKAHRRN

SEQ ID NO: 284426 - protein, 11 aa, Mycobacterium
SAQRNSRSRRR

SEQ ID NO: 284427 - protein, 8 aa, Mycobacterium
SAQRYEPN

SEQ ID NO: 284428 - protein, 8 aa, Mycobacterium
SAQSAEGN

SEQ ID NO: 284429 - protein, 9 aa, Mycobacterium
SAQSTASEL

SEQ ID NO: 284430 - protein, 16 aa, Mycobacterium
SAQTAISESTTQGVAS

SEQ ID NO: 284431 - protein, 6 aa, Mycobacterium
SAQTSR

SEQ ID NO: 284432 - protein, 9 aa, Mycobacterium
SAQVGSDSA

SEQ ID NO: 284433 - protein, 8 aa, Mycobacterium
SAQVQGGE

SEQ ID NO: 284434 - protein, 8 aa, Mycobacterium
SAQWTTPA

SEQ ID NO: 284435 - protein, 8 aa, Mycobacterium
SARADNPL

SEQ ID NO: 284436 - protein, 12 aa, Mycobacterium
SARAGAEATRFG

SEQ ID NO: 284437 - protein, 9 aa, Mycobacterium
SARAMPGSG

SEQ ID NO: 284438 - protein, 9 aa, Mycobacterium
SARAPGGFP

SEQ ID NO: 284439 - protein, 6 aa, Mycobacterium
SARATP

SEQ ID NO: 284440 - protein, 7 aa, Mycobacterium
SARDESL

SEQ ID NO: 284441 - protein, 5 aa, Mycobacterium
SARDG

SEQ ID NO: 284442 - protein, 8 aa, Mycobacterium
SARDGRTQ

SEQ ID NO: 284443 - protein, 7 aa, Mycobacterium
SARDQSL

SEQ ID NO: 284444 - protein, 8 aa, Mycobacterium
SAREQGLE

SEQ ID NO: 284445 - protein, 10 aa, Mycobacterium
SARGAAPGTV

SEQ ID NO: 284446 - protein, 21 aa, Mycobacterium
SARGDPTIGEAPAVQRGAQRI

SEQ ID NO: 284447 - protein, 8 aa, Mycobacterium
SARGGPTL

SEQ ID NO: 284448 - protein, 8 aa, Mycobacterium
SARGSREC

SEQ ID NO: 284449 - protein, 9 aa, Mycobacterium
SARGVDPQR

SEQ ID NO: 284450 - protein, 9 aa, Mycobacterium
SARGVPAGA

SEQ ID NO: 284451 - protein, 5 aa, Mycobacterium
SARHP

SEQ ID NO: 284452 - protein, 21 aa, Mycobacterium
SARLDAGATKLTSGSSTAATA

SEQ ID NO: 284453 - protein, 5 aa, Mycobacterium
SARNA

SEQ ID NO: 284454 - protein, 9 aa, Mycobacterium
SARNDQNIR

SEQ ID NO: 284455 - protein, 4 aa, Mycobacterium
SARP

SEQ ID NO: 284456 - protein, 22 aa, Mycobacterium
SARPDADPAQATDGTERRARKT

SEQ ID NO: 284457 - protein, 10 aa, Mycobacterium
SARPDTMTAE

SEQ ID NO: 284458 - protein, 7 aa, Mycobacterium
SARPGTL

SEQ ID NO: 284459 - protein, 6 aa, Mycobacterium
SARPHS

SEQ ID NO: 284460 - protein, 9 aa, Mycobacterium
SARPQPEAL

SEQ ID NO: 284461 - protein, 7 aa, Mycobacterium
SARPRAE

SEQ ID NO: 284462 - protein, 16 aa, Mycobacterium
SARPSTPPRPRVPNPT

SEQ ID NO: 284463 - protein, 8 aa, Mycobacterium
SARQDPLA

SEQ ID NO: 284464 - protein, 5 aa, Mycobacterium
SARQG

SEQ ID NO: 284465 - protein, 22 aa, Mycobacterium
SARQVPETAPAPVSRGNWRAQA

SEQ ID NO: 284466 - protein, 4 aa, Mycobacterium
SARR

SEQ ID NO: 284467 - protein, 9 aa, Mycobacterium
SARRETPPC

SEQ ID NO: 284468 - protein, 6 aa, Mycobacterium
SARRGA

SEQ ID NO: 284469 - protein, 13 aa, Mycobacterium
SARRGSLDDATAS

SEQ ID NO: 284470 - protein, 5 aa, Mycobacterium
SARRN

SEQ ID NO: 284471 - protein, 26 aa, Mycobacterium
SARRPLRAPARHEPPIAAAGTEVIEK

SEQ ID NO: 284472 - protein, 6 aa, Mycobacterium
SARRRR

SEQ ID NO: 284473 - protein, 11 aa, Mycobacterium
SARRSLAERGS

SEQ ID NO: 284474 - protein, 15 aa, Mycobacterium
SARSEPDDAPGGKVH

SEQ ID NO: 284475 - protein, 9 aa, Mycobacterium
SARSIAPAN

SEQ ID NO: 284476 - protein, 5 aa, Mycobacterium
SARSQ

SEQ ID NO: 284477 - protein, 9 aa, Mycobacterium
SARTAAVGR

SEQ ID NO: 284478 - protein, 7 aa, Mycobacterium
SARTPRG

SEQ ID NO: 284479 - protein, 21 aa, Mycobacterium
SARTRATFGTTAEEAEATKEL

SEQ ID NO: 284480 - protein, 18 aa, Mycobacterium
SARTRATFGTTAEEAETT

SEQ ID NO: 284481 - protein, 8 aa, Mycobacterium
SARTYRKV

SEQ ID NO: 284482 - protein, 6 aa, Mycobacterium
SARWPG

SEQ ID NO: 284483 - protein, 15 aa, Mycobacterium
SARYDSDDPSLKANA

SEQ ID NO: 284484 - protein, 10 aa, Mycobacterium
SASAADVGEA

SEQ ID NO: 284485 - protein, 31 aa, Mycobacterium
SASAAGADPNQPGPPAPAPPPLAVPQPDNLP

SEQ ID NO: 284486 - protein, 12 aa, Mycobacterium
SASAAGESRNTA

SEQ ID NO: 284487 - protein, 7 aa, Mycobacterium
SASAGSV

SEQ ID NO: 284488 - protein, 7 aa, Mycobacterium
SASAKIE

SEQ ID NO: 284489 - protein, 9 aa, Mycobacterium
SASASTQTT

SEQ ID NO: 284490 - protein, 5 aa, Mycobacterium
SASDK

SEQ ID NO: 284491 - protein, 9 aa, Mycobacterium
SASDSPSTG

SEQ ID NO: 284492 - protein, 9 aa, Mycobacterium
SASDTARRR

SEQ ID NO: 284493 - protein, 4 aa, Mycobacterium
SASG

SEQ ID NO: 284494 - protein, 6 aa, Mycobacterium
SASGAI

SEQ ID NO: 284495 - protein, 11 aa, Mycobacterium
SASGDSGSPAY

SEQ ID NO: 284496 - protein, 10 aa, Mycobacterium
SASGEAADSA

SEQ ID NO: 284497 - protein, 16 aa, Mycobacterium
SASGGGRANAIGGATG

SEQ ID NO: 284498 - protein, 9 aa, Mycobacterium
SASGGKSGR

SEQ ID NO: 284499 - protein, 18 aa, Mycobacterium
SASGRGTTMTAIIPLHQS

SEQ ID NO: 284500 - protein, 13 aa, Mycobacterium
SASGTTDSERPRL

SEQ ID NO: 284501 - protein, 16 aa, Mycobacterium
SASKESVEDYGNGSYD

SEQ ID NO: 284502 - protein, 4 aa, Mycobacterium
SASL

SEQ ID NO: 284503 - protein, 15 aa, Mycobacterium
SASLSRAASRVPTPL

SEQ ID NO: 284504 - protein, 10 aa, Mycobacterium
SASMETDQGN

SEQ ID NO: 284505 - protein, 6 aa, Mycobacterium
SASNEQ

SEQ ID NO: 284506 - protein, 6 aa, Mycobacterium
SASPAI

SEQ ID NO: 284507 - protein, 14 aa, Mycobacterium
SASPAPQRSSNFSG

SEQ ID NO: 284508 - protein, 10 aa, Mycobacterium
SASPDGVDDA

SEQ ID NO: 284509 - protein, 9 aa, Mycobacterium
SASPDGVSD

SEQ ID NO: 284510 - protein, 7 aa, Mycobacterium
SASPKTA

SEQ ID NO: 284511 - protein, 7 aa, Mycobacterium
SASPLDD

SEQ ID NO: 284512 - protein, 20 aa, Mycobacterium
SASPLGRDLADQSGVELDRA

SEQ ID NO: 284513 - protein, 16 aa, Mycobacterium
SASPLGRDLADQSTVE

SEQ ID NO: 284514 - protein, 7 aa, Mycobacterium
SASPPLI

SEQ ID NO: 284515 - protein, 9 aa, Mycobacterium
SASPPPIGD

SEQ ID NO: 284516 - protein, 6 aa, Mycobacterium
SASPSD

SEQ ID NO: 284517 - protein, 18 aa, Mycobacterium
SASQASPSALVGGPDAQA

SEQ ID NO: 284518 - protein, 6 aa, Mycobacterium
SASQPR

SEQ ID NO: 284519 - protein, 5 aa, Mycobacterium
SASQS

SEQ ID NO: 284520 - protein, 8 aa, Mycobacterium
SASQYEQS

SEQ ID NO: 284521 - protein, 4 aa, Mycobacterium
SASR

SEQ ID NO: 284522 - protein, 5 aa, Mycobacterium
SASRD

SEQ ID NO: 284523 - protein, 7 aa, Mycobacterium
SASRGGD

SEQ ID NO: 284524 - protein, 6 aa, Mycobacterium
SASRGR

SEQ ID NO: 284525 - protein, 15 aa, Mycobacterium
SASRLESELGDPQST

SEQ ID NO: 284526 - protein, 5 aa, Mycobacterium
SASRP

SEQ ID NO: 284527 - protein, 20 aa, Mycobacterium
SASRPAGSIPEEATLSDQAG

SEQ ID NO: 284528 - protein, 18 aa, Mycobacterium
SASRPAGTIPEQAALTEQ

SEQ ID NO: 284529 - protein, 5 aa, Mycobacterium
SASRR

SEQ ID NO: 284530 - protein, 8 aa, Mycobacterium
SASSAPTV

SEQ ID NO: 284531 - protein, 6 aa, Mycobacterium
SASSDS

SEQ ID NO: 284532 - protein, 6 aa, Mycobacterium
SASSDV

SEQ ID NO: 284533 - protein, 7 aa, Mycobacterium
SASSGQA

SEQ ID NO: 284534 - protein, 16 aa, Mycobacterium
SASTAVASGLSQSVGT

SEQ ID NO: 284535 - protein, 6 aa, Mycobacterium
SASTID

SEQ ID NO: 284536 - protein, 8 aa, Mycobacterium
SASTLTPV

SEQ ID NO: 284537 - protein, 8 aa, Mycobacterium
SASTPSGP

SEQ ID NO: 284538 - protein, 4 aa, Mycobacterium
SASV

SEQ ID NO: 284539 - protein, 6 aa, Mycobacterium
SASVAT

SEQ ID NO: 284540 - protein, 12 aa, Mycobacterium
SASVKATDARRR

SEQ ID NO: 284541 - protein, 13 aa, Mycobacterium
SASVKATDQRRRT

SEQ ID NO: 284542 - protein, 10 aa, Mycobacterium
SASVSGTELT

SEQ ID NO: 284543 - protein, 8 aa, Mycobacterium
SASVTGTQ

SEQ ID NO: 284544 - protein, 4 aa, Mycobacterium
SATA

SEQ ID NO: 284545 - protein, 9 aa, Mycobacterium
SATADESTY

SEQ ID NO: 284546 - protein, 6 aa, Mycobacterium
SATAGR

SEQ ID NO: 284547 - protein, 13 aa, Mycobacterium
SATAKVLNSGTNV

SEQ ID NO: 284548 - protein, 15 aa, Mycobacterium
SATALTRDRANQNPI

SEQ ID NO: 284549 - protein, 6 aa, Mycobacterium
SATARE

SEQ ID NO: 284550 - protein, 6 aa, Mycobacterium
SATASG

SEQ ID NO: 284551 - protein, 8 aa, Mycobacterium
SATDGASV

SEQ ID NO: 284552 - protein, 8 aa, Mycobacterium
SATDGATV

SEQ ID NO: 284553 - protein, 10 aa, Mycobacterium
SATDRREYEE

SEQ ID NO: 284554 - protein, 17 aa, Mycobacterium
SATDSTGVPASGDAASL

SEQ ID NO: 284555 - protein, 6 aa, Mycobacterium
SATDTA

SEQ ID NO: 284556 - protein, 9 aa, Mycobacterium
SATDTTCSS

SEQ ID NO: 284557 - protein, 6 aa, Mycobacterium
SATEAA

SEQ ID NO: 284558 - protein, 9 aa, Mycobacterium
SATEGADVA

SEQ ID NO: 284559 - protein, 8 aa, Mycobacterium
SATEGPNV

SEQ ID NO: 284560 - protein, 9 aa, Mycobacterium
SATEGSNVA

SEQ ID NO: 284561 - protein, 14 aa, Mycobacterium
SATEHGPDPYATTS

SEQ ID NO: 284562 - protein, 16 aa, Mycobacterium
SATEPDRDQYSDPERP

SEQ ID NO: 284563 - protein, 13 aa, Mycobacterium
SATGAAAASAGVN

SEQ ID NO: 284564 - protein, 10 aa, Mycobacterium
SATGDEKLTQ

SEQ ID NO: 284565 - protein, 14 aa, Mycobacterium
SATGFRAPEGPYET

SEQ ID NO: 284566 - protein, 13 aa, Mycobacterium
SATGFTSTPGRGV

SEQ ID NO: 284567 - protein, 11 aa, Mycobacterium
SATGGAHDLGT

SEQ ID NO: 284568 - protein, 6 aa, Mycobacterium
SATGIR

SEQ ID NO: 284569 - protein, 6 aa, Mycobacterium
SATGLT

SEQ ID NO: 284570 - protein, 6 aa, Mycobacterium
SATGNP

SEQ ID NO: 284571 - protein, 7 aa, Mycobacterium
SATGNPL

SEQ ID NO: 284572 - protein, 6 aa, Mycobacterium
SATGNT

SEQ ID NO: 284573 - protein, 8 aa, Mycobacterium
SATGPAAP

SEQ ID NO: 284574 - protein, 6 aa, Mycobacterium
SATGSF

SEQ ID NO: 284575 - protein, 7 aa, Mycobacterium
SATGSVD

SEQ ID NO: 284576 - protein, 11 aa, Mycobacterium
SATGTAATLAG

SEQ ID NO: 284577 - protein, 5 aa, Mycobacterium
SATHG

SEQ ID NO: 284578 - protein, 5 aa, Mycobacterium
SATHR

SEQ ID NO: 284579 - protein, 7 aa, Mycobacterium
SATKNDA

SEQ ID NO: 284580 - protein, 8 aa, Mycobacterium
SATLPTSL

SEQ ID NO: 284581 - protein, 10 aa, Mycobacterium
SATNVPPKTS

SEQ ID NO: 284582 - protein, 6 aa, Mycobacterium
SATPAK

SEQ ID NO: 284583 - protein, 9 aa, Mycobacterium
SATPEGVTD

SEQ ID NO: 284584 - protein, 6 aa, Mycobacterium
SATPGL

SEQ ID NO: 284585 - protein, 24 aa, Mycobacterium
SATPRTRSTRASTGSSTAPAARCA

SEQ ID NO: 284586 - protein, 19 aa, Mycobacterium
SATQRIPAAPTFGRTTKPI

SEQ ID NO: 284587 - protein, 7 aa, Mycobacterium
SATQRPA

SEQ ID NO: 284588 - protein, 12 aa, Mycobacterium
SATQSQPPLPTS

SEQ ID NO: 284589 - protein, 4 aa, Mycobacterium
SATS

SEQ ID NO: 284590 - protein, 11 aa, Mycobacterium
SATSAANSGVF

SEQ ID NO: 284591 - protein, 13 aa, Mycobacterium
SATSDEKLTQLGS

SEQ ID NO: 284592 - protein, 14 aa, Mycobacterium
SATSDEKLTQLGST

SEQ ID NO: 284593 - protein, 10 aa, Mycobacterium
SATSPATGIN

SEQ ID NO: 284594 - protein, 7 aa, Mycobacterium
SATSPTV

SEQ ID NO: 284595 - protein, 7 aa, Mycobacterium
SATSQEA

SEQ ID NO: 284596 - protein, 5 aa, Mycobacterium
SATTA

SEQ ID NO: 284597 - protein, 7 aa, Mycobacterium
SATTAQL

SEQ ID NO: 284598 - protein, 18 aa, Mycobacterium
SATTEHSDAADNLDGNEV

SEQ ID NO: 284599 - protein, 7 aa, Mycobacterium
SATTEPV

SEQ ID NO: 284600 - protein, 9 aa, Mycobacterium
SATTSDGDI

SEQ ID NO: 284601 - protein, 6 aa, Mycobacterium
SATTSL

SEQ ID NO: 284602 - protein, 14 aa, Mycobacterium
SATVQAGQTLVSPV

SEQ ID NO: 284603 - protein, 7 aa, Mycobacterium
SATVTAR

SEQ ID NO: 284604 - protein, 6 aa, Mycobacterium
SATYAE

SEQ ID NO: 284605 - protein, 4 aa, Mycobacterium
SAVA

SEQ ID NO: 284606 - protein, 12 aa, Mycobacterium
SAVAASAGSAQA

SEQ ID NO: 284607 - protein, 8 aa, Mycobacterium
SAVAESAQ

SEQ ID NO: 284608 - protein, 5 aa, Mycobacterium
SAVAK

SEQ ID NO: 284609 - protein, 7 aa, Mycobacterium
SAVASAA

SEQ ID NO: 284610 - protein, 5 aa, Mycobacterium
SAVAT

SEQ ID NO: 284611 - protein, 14 aa, Mycobacterium
SAVEANARGGGRRD

SEQ ID NO: 284612 - protein, 17 aa, Mycobacterium
SAVEANARGGGRRDRAI

SEQ ID NO: 284613 - protein, 13 aa, Mycobacterium
SAVGAGAKAGGPN

SEQ ID NO: 284614 - protein, 11 aa, Mycobacterium
SAVGPPPQGAV

SEQ ID NO: 284615 - protein, 10 aa, Mycobacterium
SAVKPGAGQS

SEQ ID NO: 284616 - protein, 4 aa, Mycobacterium
SAVL

SEQ ID NO: 284617 - protein, 10 aa, Mycobacterium
SAVNDADPVA

SEQ ID NO: 284618 - protein, 12 aa, Mycobacterium
SAVNNGTLPYGK

SEQ ID NO: 284619 - protein, 8 aa, Mycobacterium
SAVPARAV

SEQ ID NO: 284620 - protein, 8 aa, Mycobacterium
SAVPASRS

SEQ ID NO: 284621 - protein, 12 aa, Mycobacterium
SAVPDDQPERKP

SEQ ID NO: 284622 - protein, 5 aa, Mycobacterium
SAVPG

SEQ ID NO: 284623 - protein, 7 aa, Mycobacterium
SAVPIES

SEQ ID NO: 284624 - protein, 10 aa, Mycobacterium
SAVPPDTTRP

SEQ ID NO: 284625 - protein, 17 aa, Mycobacterium
SAVPPQRAVPSRSRDAR

SEQ ID NO: 284626 - protein, 10 aa, Mycobacterium
SAVPSGPKRR

SEQ ID NO: 284627 - protein, 9 aa, Mycobacterium
SAVREGNNA

SEQ ID NO: 284628 - protein, 12 aa, Mycobacterium
SAVRPPPRRRAR

SEQ ID NO: 284629 - protein, 19 aa, Mycobacterium
SAVSAATAVQHDTAAAAYT

SEQ ID NO: 284630 - protein, 19 aa, Mycobacterium
SAVSAGVAAQTETAATAYS

SEQ ID NO: 284631 - protein, 23 aa, Mycobacterium
SAVSAQSGASVSVTAGNQAANGI

SEQ ID NO: 284632 - protein, 11 aa, Mycobacterium
SAVSETTAAQH

SEQ ID NO: 284633 - protein, 10 aa, Mycobacterium
SAVSETWGGQ

SEQ ID NO: 284634 - protein, 9 aa, Mycobacterium
SAVSNGAVT

SEQ ID NO: 284635 - protein, 5 aa, Mycobacterium
SAVSS

SEQ ID NO: 284636 - protein, 8 aa, Mycobacterium
SAVTSKDH

SEQ ID NO: 284637 - protein, 10 aa, Mycobacterium
SAVTVETDRD

SEQ ID NO: 284638 - protein, 9 aa, Mycobacterium
SAWETADST

SEQ ID NO: 284639 - protein, 6 aa, Mycobacterium
SAYGPQ

SEQ ID NO: 284640 - protein, 8 aa, Mycobacterium
SAYPAGTV

SEQ ID NO: 284641 - protein, 12 aa, Mycobacterium
SAYPTGAVDVSG

SEQ ID NO: 284642 - protein, 6 aa, Mycobacterium
SAYRQA

SEQ ID NO: 284643 - protein, 20 aa, Mycobacterium
SAYSGGTGGGWQPDPTGRHE

SEQ ID NO: 284644 - protein, 7 aa, Mycobacterium
SAYTYTQ

SEQ ID NO: 284645 - protein, 21 aa, Mycobacterium
SCAGGDGGDGCSGCGGCGGCG

SEQ ID NO: 284646 - protein, 6 aa, Mycobacterium
SCDPKQ

SEQ ID NO: 284647 - protein, 14 aa, Mycobacterium
SCEEEPPPESGSLV

SEQ ID NO: 284648 - protein, 7 aa, Mycobacterium
SCEPGAS

SEQ ID NO: 284649 - protein, 4 aa, Mycobacterium
SCGA

SEQ ID NO: 284650 - protein, 15 aa, Mycobacterium
SCHASPGADPAAERR

SEQ ID NO: 284651 - protein, 5 aa, Mycobacterium
SCNPA

SEQ ID NO: 284652 - protein, 8 aa, Mycobacterium
SCNSGIYS

SEQ ID NO: 284653 - protein, 7 aa, Mycobacterium
SCNTAGG

SEQ ID NO: 284654 - protein, 8 aa, Mycobacterium
SCNTAGGR

SEQ ID NO: 284655 - protein, 5 aa, Mycobacterium
SCQAP

SEQ ID NO: 284656 - protein, 5 aa, Mycobacterium
SCRSG

SEQ ID NO: 284657 - protein, 6 aa, Mycobacterium
SCTPTG

SEQ ID NO: 284658 - protein, 8 aa, Mycobacterium
SDAAGLSP

SEQ ID NO: 284659 - protein, 14 aa, Mycobacterium
SDAAPEGAVSTANG

SEQ ID NO: 284660 - protein, 8 aa, Mycobacterium
SDAATEPV

SEQ ID NO: 284661 - protein, 5 aa, Mycobacterium
SDAAV

SEQ ID NO: 284662 - protein, 4 aa, Mycobacterium
SDAD

SEQ ID NO: 284663 - protein, 8 aa, Mycobacterium
SDADAPDR

SEQ ID NO: 284664 - protein, 5 aa, Mycobacterium
SDADI

SEQ ID NO: 284665 - protein, 9 aa, Mycobacterium
SDADPGHGM

SEQ ID NO: 284666 - protein, 6 aa, Mycobacterium
SDAELK

SEQ ID NO: 284667 - protein, 14 aa, Mycobacterium
SDAFAATKSLPEDV

SEQ ID NO: 284668 - protein, 15 aa, Mycobacterium
SDAFRKQYDSAEVTS

SEQ ID NO: 284669 - protein, 4 aa, Mycobacterium
SDAG

SEQ ID NO: 284670 - protein, 8 aa, Mycobacterium
SDAGPYLE

SEQ ID NO: 284671 - protein, 8 aa, Mycobacterium
SDAGSQYT

SEQ ID NO: 284672 - protein, 4 aa, Mycobacterium
SDAH

SEQ ID NO: 284673 - protein, 5 aa, Mycobacterium
SDAHI

SEQ ID NO: 284674 - protein, 6 aa, Mycobacterium
SDAITD

SEQ ID NO: 284675 - protein, 6 aa, Mycobacterium
SDAKSW

SEQ ID NO: 284676 - protein, 10 aa, Mycobacterium
SDALSDRNQT

SEQ ID NO: 284677 - protein, 5 aa, Mycobacterium
SDANA

SEQ ID NO: 284678 - protein, 16 aa, Mycobacterium
SDANAKDAAMQKVCGG

SEQ ID NO: 284679 - protein, 8 aa, Mycobacterium
SDAPGAGD

SEQ ID NO: 284680 - protein, 10 aa, Mycobacterium
SDAPSAVSAR

SEQ ID NO: 284681 - protein, 10 aa, Mycobacterium
SDAPSSVTAR

SEQ ID NO: 284682 - protein, 7 aa, Mycobacterium
SDAQQSV

SEQ ID NO: 284683 - protein, 8 aa, Mycobacterium
SDAQRDGD

SEQ ID NO: 284684 - protein, 6 aa, Mycobacterium
SDAQSQ

SEQ ID NO: 284685 - protein, 5 aa, Mycobacterium
SDAQV

SEQ ID NO: 284686 - protein, 4 aa, Mycobacterium
SDAR

SEQ ID NO: 284687 - protein, 11 aa, Mycobacterium
SDARPDGAAPL

SEQ ID NO: 284688 - protein, 6 aa, Mycobacterium
SDASGR

SEQ ID NO: 284689 - protein, 13 aa, Mycobacterium
SDATADVARSIPG

SEQ ID NO: 284690 - protein, 15 aa, Mycobacterium
SDAVGSAAPRAGGAA

SEQ ID NO: 284691 - protein, 7 aa, Mycobacterium
SDCDGHG

SEQ ID NO: 284692 - protein, 21 aa, Mycobacterium
SDCSSGSDELQQCGPAPALTG

SEQ ID NO: 284693 - protein, 13 aa, Mycobacterium
SDCTTSEHGREIS

SEQ ID NO: 284694 - protein, 86 aa, Mycobacterium
SDDAAATSALPSGETSVTDASGPAQAGKGRPTPKRDAGKRRGPVAPAPLTSAEARQRRKALRGPKLSRAERKVENAERRARMADNR

SEQ ID NO: 284695 - protein, 9 aa, Mycobacterium
SDDAEDADA

SEQ ID NO: 284696 - protein, 8 aa, Mycobacterium
SDDAGTEA

SEQ ID NO: 284697 - protein, 8 aa, Mycobacterium
SDDASSTT

SEQ ID NO: 284698 - protein, 29 aa, Mycobacterium
SDDDAPVGDDEGVPPPDEAGPTATDREPG

SEQ ID NO: 284699 - protein, 9 aa, Mycobacterium
SDDDDTAVA

SEQ ID NO: 284700 - protein, 9 aa, Mycobacterium
SDDDDTAVG

SEQ ID NO: 284701 - protein, 11 aa, Mycobacterium
SDDDPEAPPPK

SEQ ID NO: 284702 - protein, 11 aa, Mycobacterium
SDDDTEGRAVT

SEQ ID NO: 284703 - protein, 8 aa, Mycobacterium
SDDEAAER

SEQ ID NO: 284704 - protein, 7 aa, Mycobacterium
SDDEAVT

SEQ ID NO: 284705 - protein, 7 aa, Mycobacterium
SDDEVPE

SEQ ID NO: 284706 - protein, 9 aa, Mycobacterium
SDDGAFRGG

SEQ ID NO: 284707 - protein, 12 aa, Mycobacterium
SDDGAQSPAARD

SEQ ID NO: 284708 - protein, 6 aa, Mycobacterium
SDDGAV

SEQ ID NO: 284709 - protein, 9 aa, Mycobacterium
SDDGGPERL

SEQ ID NO: 284710 - protein, 5 aa, Mycobacterium
SDDGI

SEQ ID NO: 284711 - protein, 16 aa, Mycobacterium
SDDGIGGAVSGGGSGL

SEQ ID NO: 284712 - protein, 5 aa, Mycobacterium
SDDGN

SEQ ID NO: 284713 - protein, 7 aa, Mycobacterium
SDDGPGI

SEQ ID NO: 284714 - protein, 9 aa, Mycobacterium
SDDGSPERF

SEQ ID NO: 284715 - protein, 5 aa, Mycobacterium
SDDGT

SEQ ID NO: 284716 - protein, 33 aa, Mycobacterium
SDDHDAENQDWDDELTGQPGGGADSAAADPGAF

SEQ ID NO: 284717 - protein, 6 aa, Mycobacterium
SDDIGR

SEQ ID NO: 284718 - protein, 9 aa, Mycobacterium
SDDIRDEVS

SEQ ID NO: 284719 - protein, 95 aa, Mycobacterium
SDDKPAPAGNTSSVSSTTSSTPADSGGGGHEGHGGHSGGGNTTVTETQTVPESPTSQDTTTTEPTTTTTTTTEPTTTTTQPTTTTTQPTTSTRPS

SEQ ID NO: 284720 - protein, 16 aa, Mycobacterium
SDDLGTTSDLARANAA

SEQ ID NO: 284721 - protein, 7 aa, Mycobacterium
SDDLSGD

SEQ ID NO: 284722 - protein, 10 aa, Mycobacterium
SDDPDESLDR

SEQ ID NO: 284723 - protein, 5 aa, Mycobacterium
SDDPE

SEQ ID NO: 284724 - protein, 9 aa, Mycobacterium
SDDPFNETV

SEQ ID NO: 284725 - protein, 42 aa, Mycobacterium
SDDPGSTTASPTSSSAAPTTSREPTRRTRTTTSAPPATGSYD

SEQ ID NO: 284726 - protein, 8 aa, Mycobacterium
SDDPHKAQ

SEQ ID NO: 284727 - protein, 20 aa, Mycobacterium
SDDPPTHQRAHPTEQTEQVP

SEQ ID NO: 284728 - protein, 9 aa, Mycobacterium
SDDPREANA

SEQ ID NO: 284729 - protein, 9 aa, Mycobacterium
SDDRNTIGT

SEQ ID NO: 284730 - protein, 22 aa, Mycobacterium
SDDRTAKRLDRAADRDDDADLA

SEQ ID NO: 284731 - protein, 9 aa, Mycobacterium
SDDSAADRR

SEQ ID NO: 284732 - protein, 25 aa, Mycobacterium
SDDSSSTTSTTTSTTSTTPVTTSQV

SEQ ID NO: 284733 - protein, 25 aa, Mycobacterium
SDDTHPGGSVQKPRPFGDENPPTAM

SEQ ID NO: 284734 - protein, 25 aa, Mycobacterium
SDDTHTGGAVQKPRGLNDESPPTAI

SEQ ID NO: 284735 - protein, 25 aa, Mycobacterium
SDDTHTGGSVQKPRAVNDENPPTAM

SEQ ID NO: 284736 - protein, 43 aa, Mycobacterium
SDDVAETEELSADDDEPAAAGSAEADESEADELADESERSRRG

SEQ ID NO: 284737 - protein, 8 aa, Mycobacterium
SDDYPDAV

SEQ ID NO: 284738 - protein, 12 aa, Mycobacterium
SDEAANARAAAQ

SEQ ID NO: 284739 - protein, 7 aa, Mycobacterium
SDEAGVR

SEQ ID NO: 284740 - protein, 8 aa, Mycobacterium
SDEDGRTA

SEQ ID NO: 284741 - protein, 8 aa, Mycobacterium
SDEEAAKG

SEQ ID NO: 284742 - protein, 10 aa, Mycobacterium
SDEELEPVTG

SEQ ID NO: 284743 - protein, 18 aa, Mycobacterium
SDEGEAAGADESQHAEGA

SEQ ID NO: 284744 - protein, 9 aa, Mycobacterium
SDEGLGAEA

SEQ ID NO: 284745 - protein, 14 aa, Mycobacterium
SDEGVPNKKNLRPD

SEQ ID NO: 284746 - protein, 11 aa, Mycobacterium
SDELDRTPKGL

SEQ ID NO: 284747 - protein, 7 aa, Mycobacterium
SDEPGGI

SEQ ID NO: 284748 - protein, 11 aa, Mycobacterium
SDEQLADAAQL

SEQ ID NO: 284749 - protein, 8 aa, Mycobacterium
SDERTGSF

SEQ ID NO: 284750 - protein, 13 aa, Mycobacterium
SDESDDNVVAPQN

SEQ ID NO: 284751 - protein, 9 aa, Mycobacterium
SDETAPLQT

SEQ ID NO: 284752 - protein, 12 aa, Mycobacterium
SDETNGYGAKNV

SEQ ID NO: 284753 - protein, 13 aa, Mycobacterium
SDETNGYGAKNVK

SEQ ID NO: 284754 - protein, 44 aa, Mycobacterium
SDETPRAPDVESAGDAPVRRRAGGSIQYQDAETTRPRPPTPAEL

SEQ ID NO: 284755 - protein, 5 aa, Mycobacterium
SDEVR

SEQ ID NO: 284756 - protein, 10 aa, Mycobacterium
SDFGSNSASR

SEQ ID NO: 284757 - protein, 4 aa, Mycobacterium
SDFQ

SEQ ID NO: 284758 - protein, 8 aa, Mycobacterium
SDFRPPEG

SEQ ID NO: 284759 - protein, 11 aa, Mycobacterium
SDFSREGQQRL

SEQ ID NO: 284760 - protein, 9 aa, Mycobacterium
SDFTSNSAT

SEQ ID NO: 284761 - protein, 9 aa, Mycobacterium
SDGADRQLD

SEQ ID NO: 284762 - protein, 8 aa, Mycobacterium
SDGAGGAE

SEQ ID NO: 284763 - protein, 11 aa, Mycobacterium
SDGALTGLQEG

SEQ ID NO: 284764 - protein, 5 aa, Mycobacterium
SDGAR

SEQ ID NO: 284765 - protein, 10 aa, Mycobacterium
SDGAVTASVD

SEQ ID NO: 284766 - protein, 13 aa, Mycobacterium
SDGDAQAAPPAAV

SEQ ID NO: 284767 - protein, 5 aa, Mycobacterium
SDGEI

SEQ ID NO: 284768 - protein, 7 aa, Mycobacterium
SDGEVGA

SEQ ID NO: 284769 - protein, 5 aa, Mycobacterium
SDGEY

SEQ ID NO: 284770 - protein, 8 aa, Mycobacterium
SDGGAGGF

SEQ ID NO: 284771 - protein, 11 aa, Mycobacterium
SDGGDPDTCGM

SEQ ID NO: 284772 - protein, 7 aa, Mycobacterium
SDGGEPR

SEQ ID NO: 284773 - protein, 8 aa, Mycobacterium
SDGIKESV

SEQ ID NO: 284774 - protein, 11 aa, Mycobacterium
SDGIPAQAEKV

SEQ ID NO: 284775 - protein, 5 aa, Mycobacterium
SDGKA

SEQ ID NO: 284776 - protein, 6 aa, Mycobacterium
SDGLQP

SEQ ID NO: 284777 - protein, 5 aa, Mycobacterium
SDGNT

SEQ ID NO: 284778 - protein, 8 aa, Mycobacterium
SDGPAIDA

SEQ ID NO: 284779 - protein, 8 aa, Mycobacterium
SDGPERKV

SEQ ID NO: 284780 - protein, 7 aa, Mycobacterium
SDGPLGG

SEQ ID NO: 284781 - protein, 8 aa, Mycobacterium
SDGPLQPA

SEQ ID NO: 284782 - protein, 9 aa, Mycobacterium
SDGPPTARR

SEQ ID NO: 284783 - protein, 8 aa, Mycobacterium
SDGPSAFN

SEQ ID NO: 284784 - protein, 5 aa, Mycobacterium
SDGQL

SEQ ID NO: 284785 - protein, 8 aa, Mycobacterium
SDGQPATQ

SEQ ID NO: 284786 - protein, 4 aa, Mycobacterium
SDGR

SEQ ID NO: 284787 - protein, 9 aa, Mycobacterium
SDGRADDAG

SEQ ID NO: 284788 - protein, 27 aa, Mycobacterium
SDGREGLTPEQQAELTTGGDLGASRTD

SEQ ID NO: 284789 - protein, 7 aa, Mycobacterium
SDGRKRA

SEQ ID NO: 284790 - protein, 9 aa, Mycobacterium
SDGRRGNSI

SEQ ID NO: 284791 - protein, 7 aa, Mycobacterium
SDGRTSR

SEQ ID NO: 284792 - protein, 7 aa, Mycobacterium
SDGSVAA

SEQ ID NO: 284793 - protein, 6 aa, Mycobacterium
SDGTAT

SEQ ID NO: 284794 - protein, 9 aa, Mycobacterium
SDGTGTALD

SEQ ID NO: 284795 - protein, 6 aa, Mycobacterium
SDGTPV

SEQ ID NO: 284796 - protein, 7 aa, Mycobacterium
SDGTTEL

SEQ ID NO: 284797 - protein, 20 aa, Mycobacterium
SDGTTLDAADRRAAQQAAQR

SEQ ID NO: 284798 - protein, 11 aa, Mycobacterium
SDGVGGDVTGS

SEQ ID NO: 284799 - protein, 9 aa, Mycobacterium
SDGVHPTPE

SEQ ID NO: 284800 - protein, 54 aa, Mycobacterium
SDGYYDESALDDEPPAWPTADPAPALRDNEDDIPTTPEPAVGKSRRRDKKQTEV

SEQ ID NO: 284801 - protein, 4 aa, Mycobacterium
SDHD

SEQ ID NO: 284802 - protein, 5 aa, Mycobacterium
SDHDD

SEQ ID NO: 284803 - protein, 6 aa, Mycobacterium
SDHPAT

SEQ ID NO: 284804 - protein, 7 aa, Mycobacterium
SDHPDAT

SEQ ID NO: 284805 - protein, 16 aa, Mycobacterium
SDHRGPANATKPGPDS

SEQ ID NO: 284806 - protein, 7 aa, Mycobacterium
SDIETTA

SEQ ID NO: 284807 - protein, 5 aa, Mycobacterium
SDIGL

SEQ ID NO: 284808 - protein, 11 aa, Mycobacterium
SDIGNGRGPVD

SEQ ID NO: 284809 - protein, 12 aa, Mycobacterium
SDIGNGRGPVDD

SEQ ID NO: 284810 - protein, 12 aa, Mycobacterium
SDIGNGRGPVDE

SEQ ID NO: 284811 - protein, 10 aa, Mycobacterium
SDIPAPRPVA

SEQ ID NO: 284812 - protein, 5 aa, Mycobacterium
SDIPE

SEQ ID NO: 284813 - protein, 5 aa, Mycobacterium
SDIPQ

SEQ ID NO: 284814 - protein, 10 aa, Mycobacterium
SDITNGARGL

SEQ ID NO: 284815 - protein, 6 aa, Mycobacterium
SDITTD

SEQ ID NO: 284816 - protein, 10 aa, Mycobacterium
SDKDAEKYAS

SEQ ID NO: 284817 - protein, 10 aa, Mycobacterium
SDKDPSVLGR

SEQ ID NO: 284818 - protein, 8 aa, Mycobacterium
SDKDRTGR

SEQ ID NO: 284819 - protein, 5 aa, Mycobacterium
SDKFA

SEQ ID NO: 284820 - protein, 37 aa, Mycobacterium
SDKKEDDEDGAAAGSAGAERAPIDAGSNTGQGNEGTL

SEQ ID NO: 284821 - protein, 10 aa, Mycobacterium
SDKKLDTPDG

SEQ ID NO: 284822 - protein, 7 aa, Mycobacterium
SDKNAGL

SEQ ID NO: 284823 - protein, 17 aa, Mycobacterium
SDKNSGIQATANELGRT

SEQ ID NO: 284824 - protein, 16 aa, Mycobacterium
SDKNSGLGAAATELNR

SEQ ID NO: 284825 - protein, 7 aa, Mycobacterium
SDKPYEP

SEQ ID NO: 284826 - protein, 44 aa, Mycobacterium
SDKREEDEEGAAAGAGAERAPIDAGAAGGQQRQGPPPRPAPSGL

SEQ ID NO: 284827 - protein, 6 aa, Mycobacterium
SDKREK

SEQ ID NO: 284828 - protein, 10 aa, Mycobacterium
SDKRKARRAA

SEQ ID NO: 284829 - protein, 9 aa, Mycobacterium
SDKSATTAG

SEQ ID NO: 284830 - protein, 22 aa, Mycobacterium
SDKYPEVGSERQDLRQYPGGSL

SEQ ID NO: 284831 - protein, 10 aa, Mycobacterium
SDLATSTTAH

SEQ ID NO: 284832 - protein, 5 aa, Mycobacterium
SDLDE

SEQ ID NO: 284833 - protein, 4 aa, Mycobacterium
SDLG

SEQ ID NO: 284834 - protein, 17 aa, Mycobacterium
SDLGASAGGIDKAQLDQ

SEQ ID NO: 284835 - protein, 9 aa, Mycobacterium
SDLGASPSQ

SEQ ID NO: 284836 - protein, 6 aa, Mycobacterium
SDLGTT

SEQ ID NO: 284837 - protein, 18 aa, Mycobacterium
SDLKETPAPGGDGMTEGC

SEQ ID NO: 284838 - protein, 30 aa, Mycobacterium
SDLNGGVNGEIHGNDNGAEAVASANEADNG

SEQ ID NO: 284839 - protein, 6 aa, Mycobacterium
SDLPAG

SEQ ID NO: 284840 - protein, 15 aa, Mycobacterium
SDLPRRPSGRIQRDA

SEQ ID NO: 284841 - protein, 8 aa, Mycobacterium
SDLPYPEG

SEQ ID NO: 284842 - protein, 12 aa, Mycobacterium
SDLQRPDEPWGR

SEQ ID NO: 284843 - protein, 8 aa, Mycobacterium
SDLRSGQK

SEQ ID NO: 284844 - protein, 9 aa, Mycobacterium
SDLTTDAEY

SEQ ID NO: 284845 - protein, 6 aa, Mycobacterium
SDMPAD

SEQ ID NO: 284846 - protein, 6 aa, Mycobacterium
SDNERG

SEQ ID NO: 284847 - protein, 10 aa, Mycobacterium
SDNGRQRRDI

SEQ ID NO: 284848 - protein, 6 aa, Mycobacterium
SDNQPL

SEQ ID NO: 284849 - protein, 10 aa, Mycobacterium
SDNRTSVADP

SEQ ID NO: 284850 - protein, 6 aa, Mycobacterium
SDNTHR

SEQ ID NO: 284851 - protein, 16 aa, Mycobacterium
SDNTKQAAQAAGADVS

SEQ ID NO: 284852 - protein, 4 aa, Mycobacterium
SDPA

SEQ ID NO: 284853 - protein, 9 aa, Mycobacterium
SDPAAQAST

SEQ ID NO: 284854 - protein, 8 aa, Mycobacterium
SDPAERAS

SEQ ID NO: 284855 - protein, 13 aa, Mycobacterium
SDPAGADAPTPPP

SEQ ID NO: 284856 - protein, 7 aa, Mycobacterium
SDPAGAP

SEQ ID NO: 284857 - protein, 7 aa, Mycobacterium
SDPAGVR

SEQ ID NO: 284858 - protein, 5 aa, Mycobacterium
SDPAL

SEQ ID NO: 284859 - protein, 5 aa, Mycobacterium
SDPAM

SEQ ID NO: 284860 - protein, 9 aa, Mycobacterium
SDPASASGI

SEQ ID NO: 284861 - protein, 9 aa, Mycobacterium
SDPATPEGI

SEQ ID NO: 284862 - protein, 9 aa, Mycobacterium
SDPATPKGI

SEQ ID NO: 284863 - protein, 4 aa, Mycobacterium
SDPD

SEQ ID NO: 284864 - protein, 8 aa, Mycobacterium
SDPDERAQ

SEQ ID NO: 284865 - protein, 7 aa, Mycobacterium
SDPDQGF

SEQ ID NO: 284866 - protein, 6 aa, Mycobacterium
SDPDSA

SEQ ID NO: 284867 - protein, 8 aa, Mycobacterium
SDPEDRPG

SEQ ID NO: 284868 - protein, 12 aa, Mycobacterium
SDPGAQADGIAP

SEQ ID NO: 284869 - protein, 7 aa, Mycobacterium
SDPGTAP

SEQ ID NO: 284870 - protein, 4 aa, Mycobacterium
SDPH

SEQ ID NO: 284871 - protein, 5 aa, Mycobacterium
SDPHR

SEQ ID NO: 284872 - protein, 17 aa, Mycobacterium
SDPHTNEQPQPAQPGTR

SEQ ID NO: 284873 - protein, 7 aa, Mycobacterium
SDPKADY

SEQ ID NO: 284874 - protein, 10 aa, Mycobacterium
SDPKTTAHQP

SEQ ID NO: 284875 - protein, 5 aa, Mycobacterium
SDPLA

SEQ ID NO: 284876 - protein, 5 aa, Mycobacterium
SDPLV

SEQ ID NO: 284877 - protein, 15 aa, Mycobacterium
SDPPEDPPTDPQDDR

SEQ ID NO: 284878 - protein, 7 aa, Mycobacterium
SDPPPAL

SEQ ID NO: 284879 - protein, 7 aa, Mycobacterium
SDPPPRL

SEQ ID NO: 284880 - protein, 7 aa, Mycobacterium
SDPQQVE

SEQ ID NO: 284881 - protein, 6 aa, Mycobacterium
SDPQRS

SEQ ID NO: 284882 - protein, 7 aa, Mycobacterium
SDPQRVD

SEQ ID NO: 284883 - protein, 6 aa, Mycobacterium
SDPRDL

SEQ ID NO: 284884 - protein, 5 aa, Mycobacterium
SDPRE

SEQ ID NO: 284885 - protein, 9 aa, Mycobacterium
SDPRPEDVD

SEQ ID NO: 284886 - protein, 5 aa, Mycobacterium
SDPRR

SEQ ID NO: 284887 - protein, 13 aa, Mycobacterium
SDPRSARHADPIE

SEQ ID NO: 284888 - protein, 5 aa, Mycobacterium
SDPRV

SEQ ID NO: 284889 - protein, 4 aa, Mycobacterium
SDPT

SEQ ID NO: 284890 - protein, 8 aa, Mycobacterium
SDPTLPGR

SEQ ID NO: 284891 - protein, 9 aa, Mycobacterium
SDPTSGSIT

SEQ ID NO: 284892 - protein, 6 aa, Mycobacterium
SDPVRE

SEQ ID NO: 284893 - protein, 13 aa, Mycobacterium
SDPVSSPGDAGQC

SEQ ID NO: 284894 - protein, 7 aa, Mycobacterium
SDQALSD

SEQ ID NO: 284895 - protein, 16 aa, Mycobacterium
SDQARGAGDAAEHTPE

SEQ ID NO: 284896 - protein, 6 aa, Mycobacterium
SDQGPF

SEQ ID NO: 284897 - protein, 17 aa, Mycobacterium
SDQIPDGYPVKADTKSG

SEQ ID NO: 284898 - protein, 7 aa, Mycobacterium
SDQLPEP

SEQ ID NO: 284899 - protein, 6 aa, Mycobacterium
SDQPFE

SEQ ID NO: 284900 - protein, 5 aa, Mycobacterium
SDQPG

SEQ ID NO: 284901 - protein, 8 aa, Mycobacterium
SDQPTQRV

SEQ ID NO: 284902 - protein, 4 aa, Mycobacterium
SDQQ

SEQ ID NO: 284903 - protein, 10 aa, Mycobacterium
SDQSAAERSA

SEQ ID NO: 284904 - protein, 7 aa, Mycobacterium
SDQTVAS

SEQ ID NO: 284905 - protein, 4 aa, Mycobacterium
SDRA

SEQ ID NO: 284906 - protein, 12 aa, Mycobacterium
SDRARSGGGAGL

SEQ ID NO: 284907 - protein, 11 aa, Mycobacterium
SDRAYERAGRL

SEQ ID NO: 284908 - protein, 5 aa, Mycobacterium
SDRDA

SEQ ID NO: 284909 - protein, 11 aa, Mycobacterium
SDRDAGNPAPV

SEQ ID NO: 284910 - protein, 11 aa, Mycobacterium
SDREFKDDSRD

SEQ ID NO: 284911 - protein, 5 aa, Mycobacterium
SDRFG

SEQ ID NO: 284912 - protein, 6 aa, Mycobacterium
SDRFGG

SEQ ID NO: 284913 - protein, 7 aa, Mycobacterium
SDRFGGG

SEQ ID NO: 284914 - protein, 4 aa, Mycobacterium
SDRG

SEQ ID NO: 284915 - protein, 5 aa, Mycobacterium
SDRGA

SEQ ID NO: 284916 - protein, 19 aa, Mycobacterium
SDRGEWGGYATEAGAVDRA

SEQ ID NO: 284917 - protein, 12 aa, Mycobacterium
SDRGGHRPWSAD

SEQ ID NO: 284918 - protein, 9 aa, Mycobacterium
SDRGGPAPV

SEQ ID NO: 284919 - protein, 9 aa, Mycobacterium
SDRGLERAG

SEQ ID NO: 284920 - protein, 4 aa, Mycobacterium
SDRH

SEQ ID NO: 284921 - protein, 5 aa, Mycobacterium
SDRHF

SEQ ID NO: 284922 - protein, 6 aa, Mycobacterium
SDRHGK

SEQ ID NO: 284923 - protein, 4 aa, Mycobacterium
SDRI

SEQ ID NO: 284924 - protein, 6 aa, Mycobacterium
SDRIGR

SEQ ID NO: 284925 - protein, 7 aa, Mycobacterium
SDRKRAS

SEQ ID NO: 284926 - protein, 5 aa, Mycobacterium
SDRLA

SEQ ID NO: 284927 - protein, 5 aa, Mycobacterium
SDRLT

SEQ ID NO: 284928 - protein, 10 aa, Mycobacterium
SDRNGAPPIG

SEQ ID NO: 284929 - protein, 7 aa, Mycobacterium
SDRNPTL

SEQ ID NO: 284930 - protein, 6 aa, Mycobacterium
SDRNQT

SEQ ID NO: 284931 - protein, 6 aa, Mycobacterium
SDRPAI

SEQ ID NO: 284932 - protein, 5 aa, Mycobacterium
SDRPK

SEQ ID NO: 284933 - protein, 10 aa, Mycobacterium
SDRPPNTPSR

SEQ ID NO: 284934 - protein, 14 aa, Mycobacterium
SDRPVDAPDAPGVV

SEQ ID NO: 284935 - protein, 6 aa, Mycobacterium
SDRRRG

SEQ ID NO: 284936 - protein, 6 aa, Mycobacterium
SDRRSK

SEQ ID NO: 284937 - protein, 21 aa, Mycobacterium
SDRRTAKRLDRAADRDDDAEL

SEQ ID NO: 284938 - protein, 8 aa, Mycobacterium
SDRRTEIK

SEQ ID NO: 284939 - protein, 11 aa, Mycobacterium
SDRSKGSQAAK

SEQ ID NO: 284940 - protein, 14 aa, Mycobacterium
SDRSVDAPDAPGVV

SEQ ID NO: 284941 - protein, 6 aa, Mycobacterium
SDRTGH

SEQ ID NO: 284942 - protein, 7 aa, Mycobacterium
SDRTRGE

SEQ ID NO: 284943 - protein, 8 aa, Mycobacterium
SDRVTATD

SEQ ID NO: 284944 - protein, 18 aa, Mycobacterium
SDRVTRDRDGITVRTGGT

SEQ ID NO: 284945 - protein, 13 aa, Mycobacterium
SDSAGDMGSAART

SEQ ID NO: 284946 - protein, 6 aa, Mycobacterium
SDSEYP

SEQ ID NO: 284947 - protein, 4 aa, Mycobacterium
SDSG

SEQ ID NO: 284948 - protein, 8 aa, Mycobacterium
SDSGPGGF

SEQ ID NO: 284949 - protein, 9 aa, Mycobacterium
SDSGPGVPE

SEQ ID NO: 284950 - protein, 9 aa, Mycobacterium
SDSGQTMRA

SEQ ID NO: 284951 - protein, 12 aa, Mycobacterium
SDSGRTRHADAG

SEQ ID NO: 284952 - protein, 5 aa, Mycobacterium
SDSGS

SEQ ID NO: 284953 - protein, 7 aa, Mycobacterium
SDSHGPH

SEQ ID NO: 284954 - protein, 9 aa, Mycobacterium
SDSHPRDVG

SEQ ID NO: 284955 - protein, 7 aa, Mycobacterium
SDSHQSG

SEQ ID NO: 284956 - protein, 15 aa, Mycobacterium
SDSHTSSHSSCRQGL

SEQ ID NO: 284957 - protein, 15 aa, Mycobacterium
SDSLGPQGQSKGPVS

SEQ ID NO: 284958 - protein, 7 aa, Mycobacterium
SDSLGRR

SEQ ID NO: 284959 - protein, 11 aa, Mycobacterium
SDSPARCTAGQ

SEQ ID NO: 284960 - protein, 23 aa, Mycobacterium
SDSPDGPAQLPGTPTHPGAGQAA

SEQ ID NO: 284961 - protein, 23 aa, Mycobacterium
SDSPDGPAQLPGTPTHPGTGQAA

SEQ ID NO: 284962 - protein, 23 aa, Mycobacterium
SDSPDGPGQLPGTPTHPGTGQAA

SEQ ID NO: 284963 - protein, 5 aa, Mycobacterium
SDSPH

SEQ ID NO: 284964 - protein, 7 aa, Mycobacterium
SDSPKNQ

SEQ ID NO: 284965 - protein, 14 aa, Mycobacterium
SDSPVPADVLEAGN

SEQ ID NO: 284966 - protein, 5 aa, Mycobacterium
SDSRL

SEQ ID NO: 284967 - protein, 7 aa, Mycobacterium
SDSRPAR

SEQ ID NO: 284968 - protein, 17 aa, Mycobacterium
SDSSAHHALPDPGESVP

SEQ ID NO: 284969 - protein, 5 aa, Mycobacterium
SDSSD

SEQ ID NO: 284970 - protein, 8 aa, Mycobacterium
SDSSPQRA

SEQ ID NO: 284971 - protein, 39 aa, Mycobacterium
SDSTPKAGPGTTGSTTTTSPKPETTSPETTTTPAGDPQA

SEQ ID NO: 284972 - protein, 14 aa, Mycobacterium
SDSTTLEEQPEPAE

SEQ ID NO: 284973 - protein, 6 aa, Mycobacterium
SDSVDG

SEQ ID NO: 284974 - protein, 7 aa, Mycobacterium
SDTADEI

SEQ ID NO: 284975 - protein, 6 aa, Mycobacterium
SDTADG

SEQ ID NO: 284976 - protein, 7 aa, Mycobacterium
SDTAGLD

SEQ ID NO: 284977 - protein, 13 aa, Mycobacterium
SDTASAPEVPPAV

SEQ ID NO: 284978 - protein, 11 aa, Mycobacterium
SDTDANPYTEV

SEQ ID NO: 284979 - protein, 9 aa, Mycobacterium
SDTGAGPIG

SEQ ID NO: 284980 - protein, 11 aa, Mycobacterium
SDTGGLNSGDN

SEQ ID NO: 284981 - protein, 7 aa, Mycobacterium
SDTGPRS

SEQ ID NO: 284982 - protein, 4 aa, Mycobacterium
SDTI

SEQ ID NO: 284983 - protein, 10 aa, Mycobacterium
SDTIGKRDEE

SEQ ID NO: 284984 - protein, 14 aa, Mycobacterium
SDTLANASESERAR

SEQ ID NO: 284985 - protein, 11 aa, Mycobacterium
SDTLGKRDEQI

SEQ ID NO: 284986 - protein, 6 aa, Mycobacterium
SDTNDY

SEQ ID NO: 284987 - protein, 6 aa, Mycobacterium
SDTPIG

SEQ ID NO: 284988 - protein, 13 aa, Mycobacterium
SDTPIPADAFDGP

SEQ ID NO: 284989 - protein, 7 aa, Mycobacterium
SDTPPDV

SEQ ID NO: 284990 - protein, 6 aa, Mycobacterium
SDTPPQ

SEQ ID NO: 284991 - protein, 10 aa, Mycobacterium
SDTPVPENVT

SEQ ID NO: 284992 - protein, 6 aa, Mycobacterium
SDTQDG

SEQ ID NO: 284993 - protein, 6 aa, Mycobacterium
SDTRER

SEQ ID NO: 284994 - protein, 8 aa, Mycobacterium
SDTSTSRF

SEQ ID NO: 284995 - protein, 7 aa, Mycobacterium
SDTTAHI

SEQ ID NO: 284996 - protein, 27 aa, Mycobacterium
SDTTGPDAATASAPAVGATPDQEGSST

SEQ ID NO: 284997 - protein, 7 aa, Mycobacterium
SDTTSAV

SEQ ID NO: 284998 - protein, 12 aa, Mycobacterium
SDTVPDPQGYDG

SEQ ID NO: 284999 - protein, 14 aa, Mycobacterium
SDVDRATRPDRDRA

SEQ ID NO: 285000 - protein, 7 aa, Mycobacterium
SDVDSGS

SEQ ID NO: 285001 - protein, 4 aa, Mycobacterium
SDVE

SEQ ID NO: 285002 - protein, 8 aa, Mycobacterium
SDVEQRRI

SEQ ID NO: 285003 - protein, 4 aa, Mycobacterium
SDVF

SEQ ID NO: 285004 - protein, 4 aa, Mycobacterium
SDVG

SEQ ID NO: 285005 - protein, 6 aa, Mycobacterium
SDVGGA

SEQ ID NO: 285006 - protein, 14 aa, Mycobacterium
SDVGRQIEPSRFTE

SEQ ID NO: 285007 - protein, 21 aa, Mycobacterium
SDVPADAADSAAGTPAAGASR

SEQ ID NO: 285008 - protein, 10 aa, Mycobacterium
SDVPPRDAAE

SEQ ID NO: 285009 - protein, 20 aa, Mycobacterium
SDVRDTGPAVDPTGAATPTP

SEQ ID NO: 285010 - protein, 11 aa, Mycobacterium
SDVSKQRVAGS

SEQ ID NO: 285011 - protein, 4 aa, Mycobacterium
SDVT

SEQ ID NO: 285012 - protein, 5 aa, Mycobacterium
SDWAN

SEQ ID NO: 285013 - protein, 9 aa, Mycobacterium
SDYAAAAPY

SEQ ID NO: 285014 - protein, 7 aa, Mycobacterium
SDYARTP

SEQ ID NO: 285015 - protein, 24 aa, Mycobacterium
SDYEPYDDPYNSETAPQSTEYSGL

SEQ ID NO: 285016 - protein, 6 aa, Mycobacterium
SDYGGG

SEQ ID NO: 285017 - protein, 14 aa, Mycobacterium
SDYSRDDYVGSQAT

SEQ ID NO: 285018 - protein, 12 aa, Mycobacterium
SEAAAQAARPFD

SEQ ID NO: 285019 - protein, 12 aa, Mycobacterium
SEAAETSGATPL

SEQ ID NO: 285020 - protein, 6 aa, Mycobacterium
SEAAQQ

SEQ ID NO: 285021 - protein, 15 aa, Mycobacterium
SEAAQRSRANYGGYQ

SEQ ID NO: 285022 - protein, 5 aa, Mycobacterium
SEAAR

SEQ ID NO: 285023 - protein, 6 aa, Mycobacterium
SEAARR

SEQ ID NO: 285024 - protein, 7 aa, Mycobacterium
SEAARSL

SEQ ID NO: 285025 - protein, 9 aa, Mycobacterium
SEADAASGR

SEQ ID NO: 285026 - protein, 6 aa, Mycobacterium
SEAEAA

SEQ ID NO: 285027 - protein, 7 aa, Mycobacterium
SEAEIAD

SEQ ID NO: 285028 - protein, 4 aa, Mycobacterium
SEAF

SEQ ID NO: 285029 - protein, 10 aa, Mycobacterium
SEAGDRGAPS

SEQ ID NO: 285030 - protein, 8 aa, Mycobacterium
SEAGPREA

SEQ ID NO: 285031 - protein, 7 aa, Mycobacterium
SEAGYTT

SEQ ID NO: 285032 - protein, 26 aa, Mycobacterium
SEALDPEDLPGAEAPVEPLGRSAAAG

SEQ ID NO: 285033 - protein, 7 aa, Mycobacterium
SEAPAVP

SEQ ID NO: 285034 - protein, 8 aa, Mycobacterium
SEAPEDTL

SEQ ID NO: 285035 - protein, 6 aa, Mycobacterium
SEAPIE

SEQ ID NO: 285036 - protein, 7 aa, Mycobacterium
SEAPVRE

SEQ ID NO: 285037 - protein, 4 aa, Mycobacterium
SEAR

SEQ ID NO: 285038 - protein, 9 aa, Mycobacterium
SEARAGSPV

SEQ ID NO: 285039 - protein, 7 aa, Mycobacterium
SEARDSD

SEQ ID NO: 285040 - protein, 5 aa, Mycobacterium
SEART

SEQ ID NO: 285041 - protein, 13 aa, Mycobacterium
SEATQQAAQERLD

SEQ ID NO: 285042 - protein, 9 aa, Mycobacterium
SEDADAMGE

SEQ ID NO: 285043 - protein, 41 aa, Mycobacterium
SEDALDHDSAGDSAANPADEPQSRPDPEQDEKPKRKHGALR

SEQ ID NO: 285044 - protein, 8 aa, Mycobacterium
SEDEPADD

SEQ ID NO: 285045 - protein, 11 aa, Mycobacterium
SEDEPQPAPAD

SEQ ID NO: 285046 - protein, 9 aa, Mycobacterium
SEDFPADDQ

SEQ ID NO: 285047 - protein, 8 aa, Mycobacterium
SEDGASGF

SEQ ID NO: 285048 - protein, 12 aa, Mycobacterium
SEDGQGGPPNNG

SEQ ID NO: 285049 - protein, 8 aa, Mycobacterium
SEDGRNEV

SEQ ID NO: 285050 - protein, 6 aa, Mycobacterium
SEDGRT

SEQ ID NO: 285051 - protein, 9 aa, Mycobacterium
SEDGSPERF

SEQ ID NO: 285052 - protein, 5 aa, Mycobacterium
SEDKT

SEQ ID NO: 285053 - protein, 4 aa, Mycobacterium
SEDM

SEQ ID NO: 285054 - protein, 14 aa, Mycobacterium
SEDNQTYDLTGQTE

SEQ ID NO: 285055 - protein, 4 aa, Mycobacterium
SEDP

SEQ ID NO: 285056 - protein, 8 aa, Mycobacterium
SEDQNNEV

SEQ ID NO: 285057 - protein, 8 aa, Mycobacterium
SEDRGSIG

SEQ ID NO: 285058 - protein, 14 aa, Mycobacterium
SEDSSTLVAGGDGG

SEQ ID NO: 285059 - protein, 5 aa, Mycobacterium
SEDST

SEQ ID NO: 285060 - protein, 15 aa, Mycobacterium
SEDTSPGSTADEDVF

SEQ ID NO: 285061 - protein, 7 aa, Mycobacterium
SEDVTGA

SEQ ID NO: 285062 - protein, 14 aa, Mycobacterium
SEEAAREGRNRTAR

SEQ ID NO: 285063 - protein, 7 aa, Mycobacterium
SEEAGGL

SEQ ID NO: 285064 - protein, 16 aa, Mycobacterium
SEEAGGLHTDAAAEAG

SEQ ID NO: 285065 - protein, 36 aa, Mycobacterium
SEEAHTGAETPASTETSGLEVRPGDAATDNPDDTAV

SEQ ID NO: 285066 - protein, 6 aa, Mycobacterium
SEEHGY

SEQ ID NO: 285067 - protein, 30 aa, Mycobacterium
SEELNRISKGQSIGIPGAPYATPTGTPASQ

SEQ ID NO: 285068 - protein, 8 aa, Mycobacterium
SEEMNEEV

SEQ ID NO: 285069 - protein, 8 aa, Mycobacterium
SEEPANLS

SEQ ID NO: 285070 - protein, 6 aa, Mycobacterium
SEEPVN

SEQ ID NO: 285071 - protein, 5 aa, Mycobacterium
SEEQE

SEQ ID NO: 285072 - protein, 4 aa, Mycobacterium
SEEV

SEQ ID NO: 285073 - protein, 7 aa, Mycobacterium
SEEVTSL

SEQ ID NO: 285074 - protein, 5 aa, Mycobacterium
SEEYP

SEQ ID NO: 285075 - protein, 12 aa, Mycobacterium
SEFSPEKNNWHD

SEQ ID NO: 285076 - protein, 5 aa, Mycobacterium
SEFTE

SEQ ID NO: 285077 - protein, 27 aa, Mycobacterium
SEFTGTSTGLTTAEAQQRLQRYGPNEI

SEQ ID NO: 285078 - protein, 10 aa, Mycobacterium
SEGATSSPED

SEQ ID NO: 285079 - protein, 6 aa, Mycobacterium
SEGEEV

SEQ ID NO: 285080 - protein, 10 aa, Mycobacterium
SEGEGTTSEQ

SEQ ID NO: 285081 - protein, 11 aa, Mycobacterium
SEGEPKPAPAD

SEQ ID NO: 285082 - protein, 7 aa, Mycobacterium
SEGGERV

SEQ ID NO: 285083 - protein, 5 aa, Mycobacterium
SEGGI

SEQ ID NO: 285084 - protein, 5 aa, Mycobacterium
SEGGY

SEQ ID NO: 285085 - protein, 12 aa, Mycobacterium
SEGHYRSTQPIP

SEQ ID NO: 285086 - protein, 7 aa, Mycobacterium
SEGISDQ

SEQ ID NO: 285087 - protein, 13 aa, Mycobacterium
SEGKGSALDSASL

SEQ ID NO: 285088 - protein, 12 aa, Mycobacterium
SEGLDVADTEAK

SEQ ID NO: 285089 - protein, 13 aa, Mycobacterium
SEGLGAPRCGLRM

SEQ ID NO: 285090 - protein, 5 aa, Mycobacterium
SEGNV

SEQ ID NO: 285091 - protein, 7 aa, Mycobacterium
SEGPDVK

SEQ ID NO: 285092 - protein, 22 aa, Mycobacterium
SEGPPAPRHDPGTTDGGAIRSA

SEQ ID NO: 285093 - protein, 9 aa, Mycobacterium
SEGQPGGLG

SEQ ID NO: 285094 - protein, 4 aa, Mycobacterium
SEGR

SEQ ID NO: 285095 - protein, 5 aa, Mycobacterium
SEGTR

SEQ ID NO: 285096 - protein, 4 aa, Mycobacterium
SEHG

SEQ ID NO: 285097 - protein, 7 aa, Mycobacterium
SEHPASS

SEQ ID NO: 285098 - protein, 13 aa, Mycobacterium
SEHQDSVAERGDR

SEQ ID NO: 285099 - protein, 5 aa, Mycobacterium
SEHRR

SEQ ID NO: 285100 - protein, 4 aa, Mycobacterium
SEHS

SEQ ID NO: 285101 - protein, 10 aa, Mycobacterium
SEHSGSRQGA

SEQ ID NO: 285102 - protein, 5 aa, Mycobacterium
SEHTT

SEQ ID NO: 285103 - protein, 6 aa, Mycobacterium
SEIDVT

SEQ ID NO: 285104 - protein, 6 aa, Mycobacterium
SEIGGE

SEQ ID NO: 285105 - protein, 25 aa, Mycobacterium
SEIGGSTQQLQQGATALQQANDQIG

SEQ ID NO: 285106 - protein, 7 aa, Mycobacterium
SEIGKGT

SEQ ID NO: 285107 - protein, 6 aa, Mycobacterium
SEIGSE

SEQ ID NO: 285108 - protein, 4 aa, Mycobacterium
SEIH

SEQ ID NO: 285109 - protein, 7 aa, Mycobacterium
SEIKPES

SEQ ID NO: 285110 - protein, 4 aa, Mycobacterium
SEIP

SEQ ID NO: 285111 - protein, 9 aa, Mycobacterium
SEISAEATP

SEQ ID NO: 285112 - protein, 8 aa, Mycobacterium
SEKDSRAE

SEQ ID NO: 285113 - protein, 8 aa, Mycobacterium
SEKDSSVE

SEQ ID NO: 285114 - protein, 33 aa, Mycobacterium
SEKKNQTPSIPATVSGSETPSSPGSASPGALAP

SEQ ID NO: 285115 - protein, 7 aa, Mycobacterium
SEKLSNG

SEQ ID NO: 285116 - protein, 8 aa, Mycobacterium
SEKLSNPV

SEQ ID NO: 285117 - protein, 8 aa, Mycobacterium
SEKTYKAQ

SEQ ID NO: 285118 - protein, 6 aa, Mycobacterium
SELGAQ

SEQ ID NO: 285119 - protein, 7 aa, Mycobacterium
SELGGQP

SEQ ID NO: 285120 - protein, 14 aa, Mycobacterium
SELGPLNPRGSSQL

SEQ ID NO: 285121 - protein, 13 aa, Mycobacterium
SELGYTEAGASGL

SEQ ID NO: 285122 - protein, 4 aa, Mycobacterium
SELP

SEQ ID NO: 285123 - protein, 5 aa, Mycobacterium
SELPY

SEQ ID NO: 285124 - protein, 11 aa, Mycobacterium
SELRDNDSSVA

SEQ ID NO: 285125 - protein, 7 aa, Mycobacterium
SELSGDR

SEQ ID NO: 285126 - protein, 6 aa, Mycobacterium
SELSLT

SEQ ID NO: 285127 - protein, 7 aa, Mycobacterium
SELSLTG

SEQ ID NO: 285128 - protein, 10 aa, Mycobacterium
SELTDPVEQR

SEQ ID NO: 285129 - protein, 12 aa, Mycobacterium
SELTDPVEQRRR

SEQ ID NO: 285130 - protein, 13 aa, Mycobacterium
SELTDPVEQRRRL

SEQ ID NO: 285131 - protein, 14 aa, Mycobacterium
SELTDPVEQRRRLQ

SEQ ID NO: 285132 - protein, 11 aa, Mycobacterium
SELTGSGVSNQ

SEQ ID NO: 285133 - protein, 6 aa, Mycobacterium
SEMGAD

SEQ ID NO: 285134 - protein, 5 aa, Mycobacterium
SENAG

SEQ ID NO: 285135 - protein, 7 aa, Mycobacterium
SENANAM

SEQ ID NO: 285136 - protein, 5 aa, Mycobacterium
SENAR

SEQ ID NO: 285137 - protein, 7 aa, Mycobacterium
SENDGTV

SEQ ID NO: 285138 - protein, 33 aa, Mycobacterium
SENVEAERGLDGGGEGSDVDVSADADEAPARRR

SEQ ID NO: 285139 - protein, 8 aa, Mycobacterium
SEPATPQT

SEQ ID NO: 285140 - protein, 4 aa, Mycobacterium
SEPD

SEQ ID NO: 285141 - protein, 18 aa, Mycobacterium
SEPEPTAEVRPASWGARA

SEQ ID NO: 285142 - protein, 4 aa, Mycobacterium
SEPG

SEQ ID NO: 285143 - protein, 10 aa, Mycobacterium
SEPPGRDRTT

SEQ ID NO: 285144 - protein, 15 aa, Mycobacterium
SEPPPRLGNSRPDLA

SEQ ID NO: 285145 - protein, 12 aa, Mycobacterium
SEPSAGTPKGPW

SEQ ID NO: 285146 - protein, 12 aa, Mycobacterium
SEPVDASENEAK

SEQ ID NO: 285147 - protein, 31 aa, Mycobacterium
SEPVGKPPEGELREGSNISLDDAGRYPTTEE

SEQ ID NO: 285148 - protein, 7 aa, Mycobacterium
SEQDPSF

SEQ ID NO: 285149 - protein, 6 aa, Mycobacterium
SEQDRA

SEQ ID NO: 285150 - protein, 5 aa, Mycobacterium
SEQEL

SEQ ID NO: 285151 - protein, 6 aa, Mycobacterium
SEQEVT

SEQ ID NO: 285152 - protein, 11 aa, Mycobacterium
SEQIDSAGNAA

SEQ ID NO: 285153 - protein, 7 aa, Mycobacterium
SEQPLGS

SEQ ID NO: 285154 - protein, 4 aa, Mycobacterium
SEQR

SEQ ID NO: 285155 - protein, 10 aa, Mycobacterium
SEQRAVPGAG

SEQ ID NO: 285156 - protein, 13 aa, Mycobacterium
SEQRRQTDRTVRQ

SEQ ID NO: 285157 - protein, 7 aa, Mycobacterium
SEQTGQP

SEQ ID NO: 285158 - protein, 11 aa, Mycobacterium
SERAEGSITTE

SEQ ID NO: 285159 - protein, 10 aa, Mycobacterium
SERDGTDEQQ

SEQ ID NO: 285160 - protein, 7 aa, Mycobacterium
SERDRSD

SEQ ID NO: 285161 - protein, 37 aa, Mycobacterium
SEREQTTTATTENTTDTAGPPTTETQPPSAEPPGMQT

SEQ ID NO: 285162 - protein, 7 aa, Mycobacterium
SERGATG

SEQ ID NO: 285163 - protein, 7 aa, Mycobacterium
SERGPRS

SEQ ID NO: 285164 - protein, 11 aa, Mycobacterium
SERGTIKPTRP

SEQ ID NO: 285165 - protein, 5 aa, Mycobacterium
SERGV

SEQ ID NO: 285166 - protein, 5 aa, Mycobacterium
SERGY

SEQ ID NO: 285167 - protein, 15 aa, Mycobacterium
SERLSAQKPDEVEAG

SEQ ID NO: 285168 - protein, 4 aa, Mycobacterium
SERM

SEQ ID NO: 285169 - protein, 6 aa, Mycobacterium
SERMRR

SEQ ID NO: 285170 - protein, 7 aa, Mycobacterium
SERPHPY

SEQ ID NO: 285171 - protein, 4 aa, Mycobacterium
SERR

SEQ ID NO: 285172 - protein, 7 aa, Mycobacterium
SERRPTN

SEQ ID NO: 285173 - protein, 10 aa, Mycobacterium
SERSGGQQAA

SEQ ID NO: 285174 - protein, 8 aa, Mycobacterium
SERTAPEL

SEQ ID NO: 285175 - protein, 17 aa, Mycobacterium
SERTDPQVGQPGTPALP

SEQ ID NO: 285176 - protein, 10 aa, Mycobacterium
SERTGRHQRP

SEQ ID NO: 285177 - protein, 6 aa, Mycobacterium
SERVQP

SEQ ID NO: 285178 - protein, 5 aa, Mycobacterium
SERVS

SEQ ID NO: 285179 - protein, 4 aa, Mycobacterium
SERY

SEQ ID NO: 285180 - protein, 11 aa, Mycobacterium
SESAERRAQRG

SEQ ID NO: 285181 - protein, 5 aa, Mycobacterium
SESAK

SEQ ID NO: 285182 - protein, 16 aa, Mycobacterium
SESALTDPGLDRGDQD

SEQ ID NO: 285183 - protein, 6 aa, Mycobacterium
SESATT

SEQ ID NO: 285184 - protein, 5 aa, Mycobacterium
SESDS

SEQ ID NO: 285185 - protein, 11 aa, Mycobacterium
SESDTSPELQE

SEQ ID NO: 285186 - protein, 11 aa, Mycobacterium
SESEAVRGPAR

SEQ ID NO: 285187 - protein, 8 aa, Mycobacterium
SESFPDGE

SEQ ID NO: 285188 - protein, 4 aa, Mycobacterium
SESG

SEQ ID NO: 285189 - protein, 17 aa, Mycobacterium
SESGAEGDRPATATDAY

SEQ ID NO: 285190 - protein, 7 aa, Mycobacterium
SESGETL

SEQ ID NO: 285191 - protein, 12 aa, Mycobacterium
SESGGPSDQRAP

SEQ ID NO: 285192 - protein, 7 aa, Mycobacterium
SESPLGG

SEQ ID NO: 285193 - protein, 8 aa, Mycobacterium
SESQGRRR

SEQ ID NO: 285194 - protein, 7 aa, Mycobacterium
SESQQRR

SEQ ID NO: 285195 - protein, 5 aa, Mycobacterium
SESRR

SEQ ID NO: 285196 - protein, 14 aa, Mycobacterium
SESSAEKARSSEDR

SEQ ID NO: 285197 - protein, 9 aa, Mycobacterium
SESSGETDF

SEQ ID NO: 285198 - protein, 6 aa, Mycobacterium
SESSRA

SEQ ID NO: 285199 - protein, 7 aa, Mycobacterium
SESSRAA

SEQ ID NO: 285200 - protein, 10 aa, Mycobacterium
SESSSGRPSI

SEQ ID NO: 285201 - protein, 11 aa, Mycobacterium
SESTDTPTTPV

SEQ ID NO: 285202 - protein, 6 aa, Mycobacterium
SESVSP

SEQ ID NO: 285203 - protein, 27 aa, Mycobacterium
SETAPDSMTGSERITTASGLAGSAGTF

SEQ ID NO: 285204 - protein, 13 aa, Mycobacterium
SETDANPDTEVGQ

SEQ ID NO: 285205 - protein, 6 aa, Mycobacterium
SETDSY

SEQ ID NO: 285206 - protein, 8 aa, Mycobacterium
SETETIST

SEQ ID NO: 285207 - protein, 8 aa, Mycobacterium
SETKDDFA

SEQ ID NO: 285208 - protein, 7 aa, Mycobacterium
SETNPTL

SEQ ID NO: 285209 - protein, 19 aa, Mycobacterium
SETPAPAGVGQDAPALETL

SEQ ID NO: 285210 - protein, 11 aa, Mycobacterium
SETPGPITDAE

SEQ ID NO: 285211 - protein, 6 aa, Mycobacterium
SETPIN

SEQ ID NO: 285212 - protein, 7 aa, Mycobacterium
SETRDAV

SEQ ID NO: 285213 - protein, 16 aa, Mycobacterium
SETRDDSGSARTGPPA

SEQ ID NO: 285214 - protein, 7 aa, Mycobacterium
SETSAHI

SEQ ID NO: 285215 - protein, 9 aa, Mycobacterium
SETTEGRGR

SEQ ID NO: 285216 - protein, 8 aa, Mycobacterium
SETTGEPL

SEQ ID NO: 285217 - protein, 8 aa, Mycobacterium
SETTGQPL

SEQ ID NO: 285218 - protein, 6 aa, Mycobacterium
SETTHR

SEQ ID NO: 285219 - protein, 8 aa, Mycobacterium
SETVEGRG

SEQ ID NO: 285220 - protein, 17 aa, Mycobacterium
SETVEGRGRLYRSRRAR

SEQ ID NO: 285221 - protein, 12 aa, Mycobacterium
SETVRDGKPAAK

SEQ ID NO: 285222 - protein, 8 aa, Mycobacterium
SETWGGQI

SEQ ID NO: 285223 - protein, 5 aa, Mycobacterium
SETYP

SEQ ID NO: 285224 - protein, 4 aa, Mycobacterium
SEVE

SEQ ID NO: 285225 - protein, 11 aa, Mycobacterium
SEVERDGKPAA

SEQ ID NO: 285226 - protein, 10 aa, Mycobacterium
SEVSSPGGTF

SEQ ID NO: 285227 - protein, 9 aa, Mycobacterium
SEVTGSDRR

SEQ ID NO: 285228 - protein, 11 aa, Mycobacterium
SEVTRDGKPAA

SEQ ID NO: 285229 - protein, 7 aa, Mycobacterium
SEWRSPA

SEQ ID NO: 285230 - protein, 17 aa, Mycobacterium
SEWRSPADLTDVDTPDG

SEQ ID NO: 285231 - protein, 9 aa, Mycobacterium
SEYAAAAEE

SEQ ID NO: 285232 - protein, 10 aa, Mycobacterium
SEYGAASTLT

SEQ ID NO: 285233 - protein, 10 aa, Mycobacterium
SEYSRDDYVG

SEQ ID NO: 285234 - protein, 7 aa, Mycobacterium
SFAEKSR

SEQ ID NO: 285235 - protein, 10 aa, Mycobacterium
SFAGQGAFGG

SEQ ID NO: 285236 - protein, 18 aa, Mycobacterium
SFAGTSTKGSVGQPAGLT

SEQ ID NO: 285237 - protein, 9 aa, Mycobacterium
SFAGTYSTS

SEQ ID NO: 285238 - protein, 7 aa, Mycobacterium
SFAPGAD

SEQ ID NO: 285239 - protein, 27 aa, Mycobacterium
SFASPSTKPSSPTCSLGPPGSRTRCTA

SEQ ID NO: 285240 - protein, 15 aa, Mycobacterium
SFDKDDAADGGVDPG

SEQ ID NO: 285241 - protein, 9 aa, Mycobacterium
SFDPDAGEA

SEQ ID NO: 285242 - protein, 5 aa, Mycobacterium
SFEDT

SEQ ID NO: 285243 - protein, 15 aa, Mycobacterium
SFGAGPGVPDRDPTS

SEQ ID NO: 285244 - protein, 8 aa, Mycobacterium
SFGGDSQI

SEQ ID NO: 285245 - protein, 10 aa, Mycobacterium
SFGGGTSGEV

SEQ ID NO: 285246 - protein, 8 aa, Mycobacterium
SFGGPTPL

SEQ ID NO: 285247 - protein, 16 aa, Mycobacterium
SFGPKSTEKSSESAVD

SEQ ID NO: 285248 - protein, 10 aa, Mycobacterium
SFGPLGPLGG

SEQ ID NO: 285249 - protein, 8 aa, Mycobacterium
SFKTKDFQ

SEQ ID NO: 285250 - protein, 21 aa, Mycobacterium
SFNNDTECVNGPRGNAASHLT

SEQ ID NO: 285251 - protein, 5 aa, Mycobacterium
SFPGP

SEQ ID NO: 285252 - protein, 9 aa, Mycobacterium
SFPPPPKPP

SEQ ID NO: 285253 - protein, 7 aa, Mycobacterium
SFPPVEP

SEQ ID NO: 285254 - protein, 4 aa, Mycobacterium
SFPT

SEQ ID NO: 285255 - protein, 7 aa, Mycobacterium
SFPTEKT

SEQ ID NO: 285256 - protein, 6 aa, Mycobacterium
SFRNSP

SEQ ID NO: 285257 - protein, 16 aa, Mycobacterium
SFSKDADGYARSEGGG

SEQ ID NO: 285258 - protein, 8 aa, Mycobacterium
SFSKESMD

SEQ ID NO: 285259 - protein, 20 aa, Mycobacterium
SFSSRDASIPDGESDPCFAR

SEQ ID NO: 285260 - protein, 16 aa, Mycobacterium
SFSSRTPVNDNPDQVE

SEQ ID NO: 285261 - protein, 16 aa, Mycobacterium
SFSSRTPVNENPDGVQ

SEQ ID NO: 285262 - protein, 4 aa, Mycobacterium
SFTA

SEQ ID NO: 285263 - protein, 7 aa, Mycobacterium
SFTAGPR

SEQ ID NO: 285264 - protein, 7 aa, Mycobacterium
SFTGAGG

SEQ ID NO: 285265 - protein, 8 aa, Mycobacterium
SFTGGGGL

SEQ ID NO: 285266 - protein, 26 aa, Mycobacterium
SFTPQASAVPGSDAERDAERAGAAQT

SEQ ID NO: 285267 - protein, 5 aa, Mycobacterium
SFTQS

SEQ ID NO: 285268 - protein, 9 aa, Mycobacterium
SGAAAAAGA

SEQ ID NO: 285269 - protein, 8 aa, Mycobacterium
SGAAAATQ

SEQ ID NO: 285270 - protein, 10 aa, Mycobacterium
SGAAAPGADY

SEQ ID NO: 285271 - protein, 7 aa, Mycobacterium
SGAADEW

SEQ ID NO: 285272 - protein, 7 aa, Mycobacterium
SGAADRV

SEQ ID NO: 285273 - protein, 6 aa, Mycobacterium
SGAAGI

SEQ ID NO: 285274 - protein, 13 aa, Mycobacterium
SGAAGKETLPRPG

SEQ ID NO: 285275 - protein, 6 aa, Mycobacterium
SGAAIG

SEQ ID NO: 285276 - protein, 6 aa, Mycobacterium
SGAANR

SEQ ID NO: 285277 - protein, 8 aa, Mycobacterium
SGAAPELP

SEQ ID NO: 285278 - protein, 12 aa, Mycobacterium
SGAAPSLPEKLP

SEQ ID NO: 285279 - protein, 17 aa, Mycobacterium
SGAAQTIPGGPVAGQEA

SEQ ID NO: 285280 - protein, 5 aa, Mycobacterium
SGAAT

SEQ ID NO: 285281 - protein, 5 aa, Mycobacterium
SGAAV

SEQ ID NO: 285282 - protein, 8 aa, Mycobacterium
SGAAVGAA

SEQ ID NO: 285283 - protein, 4 aa, Mycobacterium
SGAD

SEQ ID NO: 285284 - protein, 10 aa, Mycobacterium
SGADLDETAK

SEQ ID NO: 285285 - protein, 9 aa, Mycobacterium
SGADRDELA

SEQ ID NO: 285286 - protein, 5 aa, Mycobacterium
SGADS

SEQ ID NO: 285287 - protein, 8 aa, Mycobacterium
SGADSRDT

SEQ ID NO: 285288 - protein, 7 aa, Mycobacterium
SGAEDGI

SEQ ID NO: 285289 - protein, 11 aa, Mycobacterium
SGAEGADPASV

SEQ ID NO: 285290 - protein, 17 aa, Mycobacterium
SGAEQTITGGPVASQET

SEQ ID NO: 285291 - protein, 5 aa, Mycobacterium
SGAER

SEQ ID NO: 285292 - protein, 6 aa, Mycobacterium
SGAERR

SEQ ID NO: 285293 - protein, 5 aa, Mycobacterium
SGAGA

SEQ ID NO: 285294 - protein, 24 aa, Mycobacterium
SGAGAAASFSDAAYADAGAQIGSA

SEQ ID NO: 285295 - protein, 25 aa, Mycobacterium
SGAGAAASFSDAAYADAGAQIGSAD

SEQ ID NO: 285296 - protein, 10 aa, Mycobacterium
SGAGESTVPQ

SEQ ID NO: 285297 - protein, 30 aa, Mycobacterium
SGAGIQQAADGARQLADGAAKVDDGAGQLA

SEQ ID NO: 285298 - protein, 5 aa, Mycobacterium
SGAGY

SEQ ID NO: 285299 - protein, 22 aa, Mycobacterium
SGAHQPGPGREALEAILEKFEL

SEQ ID NO: 285300 - protein, 5 aa, Mycobacterium
SGAHR

SEQ ID NO: 285301 - protein, 6 aa, Mycobacterium
SGAHSE

SEQ ID NO: 285302 - protein, 6 aa, Mycobacterium
SGAIRD

SEQ ID NO: 285303 - protein, 7 aa, Mycobacterium
SGAIRED

SEQ ID NO: 285304 - protein, 8 aa, Mycobacterium
SGAKPGSV

SEQ ID NO: 285305 - protein, 44 aa, Mycobacterium
SGAKRPGAKKAAPPAAAAPEAAATASAPEAAAAPAEPAAPAAPV

SEQ ID NO: 285306 - protein, 8 aa, Mycobacterium
SGALAPKT

SEQ ID NO: 285307 - protein, 5 aa, Mycobacterium
SGALT

SEQ ID NO: 285308 - protein, 19 aa, Mycobacterium
SGALTDQEYNSRRAAIIAE

SEQ ID NO: 285309 - protein, 18 aa, Mycobacterium
SGAMGRPDEHTTPGVEPL

SEQ ID NO: 285310 - protein, 9 aa, Mycobacterium
SGANSDEAV

SEQ ID NO: 285311 - protein, 7 aa, Mycobacterium
SGANTAT

SEQ ID NO: 285312 - protein, 7 aa, Mycobacterium
SGAPDPI

SEQ ID NO: 285313 - protein, 7 aa, Mycobacterium
SGAPFPD

SEQ ID NO: 285314 - protein, 21 aa, Mycobacterium
SGAPITAGEISDAAESVGEES

SEQ ID NO: 285315 - protein, 10 aa, Mycobacterium
SGAPITPEEI

SEQ ID NO: 285316 - protein, 6 aa, Mycobacterium
SGAPLA

SEQ ID NO: 285317 - protein, 7 aa, Mycobacterium
SGAPLGL

SEQ ID NO: 285318 - protein, 9 aa, Mycobacterium
SGAPPAMAS

SEQ ID NO: 285319 - protein, 7 aa, Mycobacterium
SGAPPKI

SEQ ID NO: 285320 - protein, 7 aa, Mycobacterium
SGAPQAG

SEQ ID NO: 285321 - protein, 6 aa, Mycobacterium
SGAPRS

SEQ ID NO: 285322 - protein, 9 aa, Mycobacterium
SGAPSARNP

SEQ ID NO: 285323 - protein, 12 aa, Mycobacterium
SGAPVYGSGLPS

SEQ ID NO: 285324 - protein, 10 aa, Mycobacterium
SGAQAEGTSE

SEQ ID NO: 285325 - protein, 16 aa, Mycobacterium
SGAQPAERPDDPGRSR

SEQ ID NO: 285326 - protein, 92 aa, Mycobacterium
SGAQQQAPYTGAQQHGTTGQPYHSTQQHYPTGGYQSGPQTYGQPPSQQHPYGAAPSGPQTYGTSGPTRPRQQYPSEPTPVPASYSNEPVEPF

SEQ ID NO: 285327 - protein, 10 aa, Mycobacterium
SGAQQVSAAT

SEQ ID NO: 285328 - protein, 5 aa, Mycobacterium
SGARI

SEQ ID NO: 285329 - protein, 11 aa, Mycobacterium
SGARKRKLPRA

SEQ ID NO: 285330 - protein, 5 aa, Mycobacterium
SGARL

SEQ ID NO: 285331 - protein, 15 aa, Mycobacterium
SGARRYATAGNPYPG

SEQ ID NO: 285332 - protein, 33 aa, Mycobacterium
SGARSRLRRRGPAAGHRSDPDWSPSDEDAAADV

SEQ ID NO: 285333 - protein, 5 aa, Mycobacterium
SGASA

SEQ ID NO: 285334 - protein, 7 aa, Mycobacterium
SGASAAY

SEQ ID NO: 285335 - protein, 15 aa, Mycobacterium
SGASAIAKASLDASL

SEQ ID NO: 285336 - protein, 8 aa, Mycobacterium
SGASATDA

SEQ ID NO: 285337 - protein, 13 aa, Mycobacterium
SGASGFDSDPNCT

SEQ ID NO: 285338 - protein, 12 aa, Mycobacterium
SGASHAAGSPTL

SEQ ID NO: 285339 - protein, 6 aa, Mycobacterium
SGASVG

SEQ ID NO: 285340 - protein, 7 aa, Mycobacterium
SGASVGA

SEQ ID NO: 285341 - protein, 7 aa, Mycobacterium
SGATAEA

SEQ ID NO: 285342 - protein, 12 aa, Mycobacterium
SGATGGPPPSLS

SEQ ID NO: 285343 - protein, 9 aa, Mycobacterium
SGATPSNLY

SEQ ID NO: 285344 - protein, 5 aa, Mycobacterium
SGATV

SEQ ID NO: 285345 - protein, 5 aa, Mycobacterium
SGAVG

SEQ ID NO: 285346 - protein, 11 aa, Mycobacterium
SGAWEGPSSQQ

SEQ ID NO: 285347 - protein, 7 aa, Mycobacterium
SGAYRAT

SEQ ID NO: 285348 - protein, 13 aa, Mycobacterium
SGCTTSEHGREIS

SEQ ID NO: 285349 - protein, 6 aa, Mycobacterium
SGDAAA

SEQ ID NO: 285350 - protein, 10 aa, Mycobacterium
SGDADPARLS

SEQ ID NO: 285351 - protein, 7 aa, Mycobacterium
SGDAEAQ

SEQ ID NO: 285352 - protein, 5 aa, Mycobacterium
SGDAG

SEQ ID NO: 285353 - protein, 6 aa, Mycobacterium
SGDASR

SEQ ID NO: 285354 - protein, 9 aa, Mycobacterium
SGDDRQRRR

SEQ ID NO: 285355 - protein, 4 aa, Mycobacterium
SGDE

SEQ ID NO: 285356 - protein, 7 aa, Mycobacterium
SGDEIDQ

SEQ ID NO: 285357 - protein, 15 aa, Mycobacterium
SGDEIPEQYWRTLVD

SEQ ID NO: 285358 - protein, 11 aa, Mycobacterium
SGDELHKRATR

SEQ ID NO: 285359 - protein, 8 aa, Mycobacterium
SGDEPITT

SEQ ID NO: 285360 - protein, 12 aa, Mycobacterium
SGDFEATGTLGE

SEQ ID NO: 285361 - protein, 4 aa, Mycobacterium
SGDG

SEQ ID NO: 285362 - protein, 12 aa, Mycobacterium
SGDGGGDSGEDL

SEQ ID NO: 285363 - protein, 8 aa, Mycobacterium
SGDGGPRR

SEQ ID NO: 285364 - protein, 10 aa, Mycobacterium
SGDGGRGSTV

SEQ ID NO: 285365 - protein, 6 aa, Mycobacterium
SGDGGV

SEQ ID NO: 285366 - protein, 4 aa, Mycobacterium
SGDL

SEQ ID NO: 285367 - protein, 5 aa, Mycobacterium
SGDLE

SEQ ID NO: 285368 - protein, 6 aa, Mycobacterium
SGDNYS

SEQ ID NO: 285369 - protein, 6 aa, Mycobacterium
SGDPAL

SEQ ID NO: 285370 - protein, 40 aa, Mycobacterium
SGDQSRSPASAPPSAAALSAGPFTGTYRGDYDAATGPGLD

SEQ ID NO: 285371 - protein, 4 aa, Mycobacterium
SGDS

SEQ ID NO: 285372 - protein, 84 aa, Mycobacterium
SGDSASTKATIGPAPQPVTSAPATTKASAPPSAQPSPSVTQQLPPETVTTVTTPSAAPSLAPTGTPTAAPPLTLTPPPAAALNP

SEQ ID NO: 285373 - protein, 7 aa, Mycobacterium
SGDSATF

SEQ ID NO: 285374 - protein, 20 aa, Mycobacterium
SGDSATTKATVGAPVGAPMP

SEQ ID NO: 285375 - protein, 9 aa, Mycobacterium
SGDTGAMEG

SEQ ID NO: 285376 - protein, 7 aa, Mycobacterium
SGDVATA

SEQ ID NO: 285377 - protein, 8 aa, Mycobacterium
SGDVKENG

SEQ ID NO: 285378 - protein, 7 aa, Mycobacterium
SGDWGGA

SEQ ID NO: 285379 - protein, 4 aa, Mycobacterium
SGEA

SEQ ID NO: 285380 - protein, 6 aa, Mycobacterium
SGEAGY

SEQ ID NO: 285381 - protein, 8 aa, Mycobacterium
SGEAPTIT

SEQ ID NO: 285382 - protein, 7 aa, Mycobacterium
SGEARTQ

SEQ ID NO: 285383 - protein, 5 aa, Mycobacterium
SGEDL

SEQ ID NO: 285384 - protein, 7 aa, Mycobacterium
SGEEADP

SEQ ID NO: 285385 - protein, 16 aa, Mycobacterium
SGEEIKDASSGLDQQR

SEQ ID NO: 285386 - protein, 18 aa, Mycobacterium
SGEEIKNATSGLDQQQGQ

SEQ ID NO: 285387 - protein, 15 aa, Mycobacterium
SGEERREKKLRNLFG

SEQ ID NO: 285388 - protein, 10 aa, Mycobacterium
SGEETRSLDS

SEQ ID NO: 285389 - protein, 4 aa, Mycobacterium
SGEG

SEQ ID NO: 285390 - protein, 7 aa, Mycobacterium
SGEGSTA

SEQ ID NO: 285391 - protein, 4 aa, Mycobacterium
SGEH

SEQ ID NO: 285392 - protein, 9 aa, Mycobacterium
SGEIDETQY

SEQ ID NO: 285393 - protein, 14 aa, Mycobacterium
SGEIGGPKAMESAK

SEQ ID NO: 285394 - protein, 10 aa, Mycobacterium
SGEIPGGGTA

SEQ ID NO: 285395 - protein, 5 aa, Mycobacterium
SGEIR

SEQ ID NO: 285396 - protein, 6 aa, Mycobacterium
SGEITR

SEQ ID NO: 285397 - protein, 24 aa, Mycobacterium
SGEKDAEPGRAGKQDTGARKTKKS

SEQ ID NO: 285398 - protein, 6 aa, Mycobacterium
SGEKKL

SEQ ID NO: 285399 - protein, 4 aa, Mycobacterium
SGEP

SEQ ID NO: 285400 - protein, 5 aa, Mycobacterium
SGEPE

SEQ ID NO: 285401 - protein, 6 aa, Mycobacterium
SGEPHG

SEQ ID NO: 285402 - protein, 26 aa, Mycobacterium
SGEPHGRPHVDPPPPGVGACATPSAH

SEQ ID NO: 285403 - protein, 4 aa, Mycobacterium
SGEQ

SEQ ID NO: 285404 - protein, 5 aa, Mycobacterium
SGEQI

SEQ ID NO: 285405 - protein, 11 aa, Mycobacterium
SGEQPEIGPTR

SEQ ID NO: 285406 - protein, 5 aa, Mycobacterium
SGERG

SEQ ID NO: 285407 - protein, 11 aa, Mycobacterium
SGERGGPASDI

SEQ ID NO: 285408 - protein, 7 aa, Mycobacterium
SGERSPD

SEQ ID NO: 285409 - protein, 5 aa, Mycobacterium
SGESP

SEQ ID NO: 285410 - protein, 19 aa, Mycobacterium
SGESTGPLPPKIYRRPDDP

SEQ ID NO: 285411 - protein, 7 aa, Mycobacterium
SGETAKH

SEQ ID NO: 285412 - protein, 8 aa, Mycobacterium
SGETQPVQ

SEQ ID NO: 285413 - protein, 10 aa, Mycobacterium
SGETVGPPAD

SEQ ID NO: 285414 - protein, 5 aa, Mycobacterium
SGEVG

SEQ ID NO: 285415 - protein, 20 aa, Mycobacterium
SGEVPGAPLQPDGPPRVPGI

SEQ ID NO: 285416 - protein, 9 aa, Mycobacterium
SGEVSRSTL

SEQ ID NO: 285417 - protein, 13 aa, Mycobacterium
SGEVVRGPAAAPL

SEQ ID NO: 285418 - protein, 5 aa, Mycobacterium
SGFDP

SEQ ID NO: 285419 - protein, 4 aa, Mycobacterium
SGFG

SEQ ID NO: 285420 - protein, 6 aa, Mycobacterium
SGFGPA

SEQ ID NO: 285421 - protein, 6 aa, Mycobacterium
SGFNDA

SEQ ID NO: 285422 - protein, 7 aa, Mycobacterium
SGFNPSR

SEQ ID NO: 285423 - protein, 8 aa, Mycobacterium
SGFNPSRA

SEQ ID NO: 285424 - protein, 14 aa, Mycobacterium
SGFSGASGRNIKRA

SEQ ID NO: 285425 - protein, 5 aa, Mycobacterium
SGFSS

SEQ ID NO: 285426 - protein, 6 aa, Mycobacterium
SGFTTD

SEQ ID NO: 285427 - protein, 12 aa, Mycobacterium
SGFYDEGSQSVA

SEQ ID NO: 285428 - protein, 5 aa, Mycobacterium
SGGAA

SEQ ID NO: 285429 - protein, 15 aa, Mycobacterium
SGGAAAVRRTATGTP

SEQ ID NO: 285430 - protein, 8 aa, Mycobacterium
SGGACADK

SEQ ID NO: 285431 - protein, 14 aa, Mycobacterium
SGGADIAASAAGPL

SEQ ID NO: 285432 - protein, 7 aa, Mycobacterium
SGGAESV

SEQ ID NO: 285433 - protein, 12 aa, Mycobacterium
SGGAGGLQTPDD

SEQ ID NO: 285434 - protein, 18 aa, Mycobacterium
SGGAKGGSSGEADPADKM

SEQ ID NO: 285435 - protein, 8 aa, Mycobacterium
SGGAPTAS

SEQ ID NO: 285436 - protein, 5 aa, Mycobacterium
SGGAQ

SEQ ID NO: 285437 - protein, 6 aa, Mycobacterium
SGGASA

SEQ ID NO: 285438 - protein, 6 aa, Mycobacterium
SGGATA

SEQ ID NO: 285439 - protein, 4 aa, Mycobacterium
SGGD

SEQ ID NO: 285440 - protein, 6 aa, Mycobacterium
SGGDEY

SEQ ID NO: 285441 - protein, 27 aa, Mycobacterium
SGGDGLSEEERVGRAAVGQNDAMQRED

SEQ ID NO: 285442 - protein, 5 aa, Mycobacterium
SGGDL

SEQ ID NO: 285443 - protein, 6 aa, Mycobacterium
SGGDSR

SEQ ID NO: 285444 - protein, 7 aa, Mycobacterium
SGGDYQF

SEQ ID NO: 285445 - protein, 10 aa, Mycobacterium
SGGEVTPDNA

SEQ ID NO: 285446 - protein, 17 aa, Mycobacterium
SGGGFQDPTSESARTTS

SEQ ID NO: 285447 - protein, 10 aa, Mycobacterium
SGGGGLTPSD

SEQ ID NO: 285448 - protein, 8 aa, Mycobacterium
SGGGGRTI

SEQ ID NO: 285449 - protein, 9 aa, Mycobacterium
SGGGLGGGH

SEQ ID NO: 285450 - protein, 7 aa, Mycobacterium
SGGGLTG

SEQ ID NO: 285451 - protein, 7 aa, Mycobacterium
SGGHNGY

SEQ ID NO: 285452 - protein, 7 aa, Mycobacterium
SGGIPDY

SEQ ID NO: 285453 - protein, 17 aa, Mycobacterium
SGGISDTADAVGSGASI

SEQ ID NO: 285454 - protein, 18 aa, Mycobacterium
SGGISDTADAVGSGASIA

SEQ ID NO: 285455 - protein, 14 aa, Mycobacterium
SGGITVSKPSNVTL

SEQ ID NO: 285456 - protein, 10 aa, Mycobacterium
SGGLDAHEGP

SEQ ID NO: 285457 - protein, 6 aa, Mycobacterium
SGGLGA

SEQ ID NO: 285458 - protein, 8 aa, Mycobacterium
SGGLGSPL

SEQ ID NO: 285459 - protein, 14 aa, Mycobacterium
SGGLTAASAQGAVT

SEQ ID NO: 285460 - protein, 19 aa, Mycobacterium
SGGLYSSGNVTYRGSEVGR

SEQ ID NO: 285461 - protein, 5 aa, Mycobacterium
SGGMP

SEQ ID NO: 285462 - protein, 11 aa, Mycobacterium
SGGNADQSGAL

SEQ ID NO: 285463 - protein, 17 aa, Mycobacterium
SGGNDKPPAAAVTTPVP

SEQ ID NO: 285464 - protein, 9 aa, Mycobacterium
SGGNEAATL

SEQ ID NO: 285465 - protein, 12 aa, Mycobacterium
SGGNEAATLARD

SEQ ID NO: 285466 - protein, 5 aa, Mycobacterium
SGGNP

SEQ ID NO: 285467 - protein, 6 aa, Mycobacterium
SGGNVG

SEQ ID NO: 285468 - protein, 10 aa, Mycobacterium
SGGPAGVGVA

SEQ ID NO: 285469 - protein, 7 aa, Mycobacterium
SGGPDNV

SEQ ID NO: 285470 - protein, 6 aa, Mycobacterium
SGGPEA

SEQ ID NO: 285471 - protein, 10 aa, Mycobacterium
SGGPGQPNLV

SEQ ID NO: 285472 - protein, 7 aa, Mycobacterium
SGGPIRD

SEQ ID NO: 285473 - protein, 8 aa, Mycobacterium
SGGPSGVG

SEQ ID NO: 285474 - protein, 10 aa, Mycobacterium
SGGPSGVGAA

SEQ ID NO: 285475 - protein, 10 aa, Mycobacterium
SGGPSPYSAS

SEQ ID NO: 285476 - protein, 8 aa, Mycobacterium
SGGPVGVG

SEQ ID NO: 285477 - protein, 15 aa, Mycobacterium
SGGPVGVGQASGRAI

SEQ ID NO: 285478 - protein, 6 aa, Mycobacterium
SGGQAT

SEQ ID NO: 285479 - protein, 14 aa, Mycobacterium
SGGQGGQATPSTVG

SEQ ID NO: 285480 - protein, 10 aa, Mycobacterium
SGGQPYTATN

SEQ ID NO: 285481 - protein, 23 aa, Mycobacterium
SGGQVAPVPQPGYQPGPPPGPQS

SEQ ID NO: 285482 - protein, 6 aa, Mycobacterium
SGGREA

SEQ ID NO: 285483 - protein, 5 aa, Mycobacterium
SGGRP

SEQ ID NO: 285484 - protein, 5 aa, Mycobacterium
SGGRS

SEQ ID NO: 285485 - protein, 5 aa, Mycobacterium
SGGSA

SEQ ID NO: 285486 - protein, 16 aa, Mycobacterium
SGGSGGKKVPEINADR

SEQ ID NO: 285487 - protein, 8 aa, Mycobacterium
SGGSIGGA

SEQ ID NO: 285488 - protein, 5 aa, Mycobacterium
SGGSP

SEQ ID NO: 285489 - protein, 9 aa, Mycobacterium
SGGTSLSEA

SEQ ID NO: 285490 - protein, 14 aa, Mycobacterium
SGGTVNVPGGVGPG

SEQ ID NO: 285491 - protein, 4 aa, Mycobacterium
SGGV

SEQ ID NO: 285492 - protein, 6 aa, Mycobacterium
SGGVPY

SEQ ID NO: 285493 - protein, 9 aa, Mycobacterium
SGGVSVDQA

SEQ ID NO: 285494 - protein, 6 aa, Mycobacterium
SGGVTS

SEQ ID NO: 285495 - protein, 15 aa, Mycobacterium
SGGYTPASRPRSQPL

SEQ ID NO: 285496 - protein, 7 aa, Mycobacterium
SGHAQRV

SEQ ID NO: 285497 - protein, 6 aa, Mycobacterium
SGHDNR

SEQ ID NO: 285498 - protein, 6 aa, Mycobacterium
SGHEHT

SEQ ID NO: 285499 - protein, 5 aa, Mycobacterium
SGHGA

SEQ ID NO: 285500 - protein, 7 aa, Mycobacterium
SGHGGYG

SEQ ID NO: 285501 - protein, 13 aa, Mycobacterium
SGHGSFTKGIGSG

SEQ ID NO: 285502 - protein, 8 aa, Mycobacterium
SGHPSRGR

SEQ ID NO: 285503 - protein, 5 aa, Mycobacterium
SGHRS

SEQ ID NO: 285504 - protein, 7 aa, Mycobacterium
SGHSPID

SEQ ID NO: 285505 - protein, 11 aa, Mycobacterium
SGIAEGARTGL

SEQ ID NO: 285506 - protein, 8 aa, Mycobacterium
SGIAGTDP

SEQ ID NO: 285507 - protein, 6 aa, Mycobacterium
SGIAPT

SEQ ID NO: 285508 - protein, 4 aa, Mycobacterium
SGID

SEQ ID NO: 285509 - protein, 12 aa, Mycobacterium
SGIDPTTLRGSA

SEQ ID NO: 285510 - protein, 6 aa, Mycobacterium
SGIEQR

SEQ ID NO: 285511 - protein, 4 aa, Mycobacterium
SGIG

SEQ ID NO: 285512 - protein, 5 aa, Mycobacterium
SGIGA

SEQ ID NO: 285513 - protein, 12 aa, Mycobacterium
SGIGDALSGSLS

SEQ ID NO: 285514 - protein, 8 aa, Mycobacterium
SGISAQSG

SEQ ID NO: 285515 - protein, 13 aa, Mycobacterium
SGISGASSAIKDA

SEQ ID NO: 285516 - protein, 13 aa, Mycobacterium
SGISSASSAIKDA

SEQ ID NO: 285517 - protein, 4 aa, Mycobacterium
SGIT

SEQ ID NO: 285518 - protein, 12 aa, Mycobacterium
SGITGGRRSGLL

SEQ ID NO: 285519 - protein, 13 aa, Mycobacterium
SGITQPGRKVPDD

SEQ ID NO: 285520 - protein, 13 aa, Mycobacterium
SGITQPGRKVPND

SEQ ID NO: 285521 - protein, 11 aa, Mycobacterium
SGKAADTYRDD

SEQ ID NO: 285522 - protein, 55 aa, Mycobacterium
SGKATPAKKAAPAKKAPAKKAAPAKKAAPAKAAAKKAAPAKKAPAKKAAPRTVTQ

SEQ ID NO: 285523 - protein, 10 aa, Mycobacterium
SGKDDKQAPV

SEQ ID NO: 285524 - protein, 8 aa, Mycobacterium
SGKNYDQA

SEQ ID NO: 285525 - protein, 15 aa, Mycobacterium
SGKPAPGHTDEPGKR

SEQ ID NO: 285526 - protein, 8 aa, Mycobacterium
SGKPDYPA

SEQ ID NO: 285527 - protein, 10 aa, Mycobacterium
SGKPGRSAGR

SEQ ID NO: 285528 - protein, 7 aa, Mycobacterium
SGKPLDA

SEQ ID NO: 285529 - protein, 11 aa, Mycobacterium
SGKRPFSGDGA

SEQ ID NO: 285530 - protein, 10 aa, Mycobacterium
SGKRPFTGDG

SEQ ID NO: 285531 - protein, 10 aa, Mycobacterium
SGKTGTLTTG

SEQ ID NO: 285532 - protein, 10 aa, Mycobacterium
SGKTPDSGAL

SEQ ID NO: 285533 - protein, 5 aa, Mycobacterium
SGKVV

SEQ ID NO: 285534 - protein, 38 aa, Mycobacterium
SGLAAQADDEEGYEPTPRYTSGASRRRRYDTKTAAAVS

SEQ ID NO: 285535 - protein, 8 aa, Mycobacterium
SGLAEPSA

SEQ ID NO: 285536 - protein, 13 aa, Mycobacterium
SGLAGPAAAQPSA

SEQ ID NO: 285537 - protein, 9 aa, Mycobacterium
SGLAGRFDG

SEQ ID NO: 285538 - protein, 8 aa, Mycobacterium
SGLAPGAA

SEQ ID NO: 285539 - protein, 6 aa, Mycobacterium
SGLASA

SEQ ID NO: 285540 - protein, 6 aa, Mycobacterium
SGLDAA

SEQ ID NO: 285541 - protein, 7 aa, Mycobacterium
SGLELPE

SEQ ID NO: 285542 - protein, 6 aa, Mycobacterium
SGLESG

SEQ ID NO: 285543 - protein, 13 aa, Mycobacterium
SGLGTGRRTDSDG

SEQ ID NO: 285544 - protein, 10 aa, Mycobacterium
SGLGTTPTGT

SEQ ID NO: 285545 - protein, 11 aa, Mycobacterium
SGLNENKTLDC

SEQ ID NO: 285546 - protein, 9 aa, Mycobacterium
SGLNGKRPK

SEQ ID NO: 285547 - protein, 8 aa, Mycobacterium
SGLNPEQR

SEQ ID NO: 285548 - protein, 8 aa, Mycobacterium
SGLPGGQQ

SEQ ID NO: 285549 - protein, 13 aa, Mycobacterium
SGLPHRSATRSFA

SEQ ID NO: 285550 - protein, 5 aa, Mycobacterium
SGLPS

SEQ ID NO: 285551 - protein, 4 aa, Mycobacterium
SGLQ

SEQ ID NO: 285552 - protein, 6 aa, Mycobacterium
SGLRAY

SEQ ID NO: 285553 - protein, 10 aa, Mycobacterium
SGLRGANSED

SEQ ID NO: 285554 - protein, 10 aa, Mycobacterium
SGLRGATKED

SEQ ID NO: 285555 - protein, 7 aa, Mycobacterium
SGLRPRY

SEQ ID NO: 285556 - protein, 6 aa, Mycobacterium
SGLSAG

SEQ ID NO: 285557 - protein, 6 aa, Mycobacterium
SGLSAT

SEQ ID NO: 285558 - protein, 11 aa, Mycobacterium
SGLSGAAGGLS

SEQ ID NO: 285559 - protein, 11 aa, Mycobacterium
SGLSGVADNPE

SEQ ID NO: 285560 - protein, 5 aa, Mycobacterium
SGLSP

SEQ ID NO: 285561 - protein, 9 aa, Mycobacterium
SGLSPAGEQ

SEQ ID NO: 285562 - protein, 7 aa, Mycobacterium
SGLSPAS

SEQ ID NO: 285563 - protein, 8 aa, Mycobacterium
SGLSPNSC

SEQ ID NO: 285564 - protein, 8 aa, Mycobacterium
SGLSPSSC

SEQ ID NO: 285565 - protein, 6 aa, Mycobacterium
SGLSTN

SEQ ID NO: 285566 - protein, 5 aa, Mycobacterium
SGLSV

SEQ ID NO: 285567 - protein, 4 aa, Mycobacterium
SGLT

SEQ ID NO: 285568 - protein, 8 aa, Mycobacterium
SGLTDPTR

SEQ ID NO: 285569 - protein, 20 aa, Mycobacterium
SGLTGRARRRGDGIDADRGR

SEQ ID NO: 285570 - protein, 10 aa, Mycobacterium
SGLTPASSDL

SEQ ID NO: 285571 - protein, 6 aa, Mycobacterium
SGLTPG

SEQ ID NO: 285572 - protein, 4 aa, Mycobacterium
SGMA

SEQ ID NO: 285573 - protein, 7 aa, Mycobacterium
SGMAGAR

SEQ ID NO: 285574 - protein, 7 aa, Mycobacterium
SGMAGGY

SEQ ID NO: 285575 - protein, 7 aa, Mycobacterium
SGMARPS

SEQ ID NO: 285576 - protein, 7 aa, Mycobacterium
SGMGGGL

SEQ ID NO: 285577 - protein, 6 aa, Mycobacterium
SGMPRR

SEQ ID NO: 285578 - protein, 20 aa, Mycobacterium
SGMPTDRAGAAAAITSTSRQ

SEQ ID NO: 285579 - protein, 10 aa, Mycobacterium
SGMSGESARF

SEQ ID NO: 285580 - protein, 4 aa, Mycobacterium
SGNA

SEQ ID NO: 285581 - protein, 20 aa, Mycobacterium
SGNADDGADGDYKDDDEVTD

SEQ ID NO: 285582 - protein, 8 aa, Mycobacterium
SGNAVTSA

SEQ ID NO: 285583 - protein, 7 aa, Mycobacterium
SGNDAAH

SEQ ID NO: 285584 - protein, 8 aa, Mycobacterium
SGNGSPAR

SEQ ID NO: 285585 - protein, 9 aa, Mycobacterium
SGNGTAIAA

SEQ ID NO: 285586 - protein, 5 aa, Mycobacterium
SGNIA

SEQ ID NO: 285587 - protein, 7 aa, Mycobacterium
SGNKDEG

SEQ ID NO: 285588 - protein, 5 aa, Mycobacterium
SGNLE

SEQ ID NO: 285589 - protein, 22 aa, Mycobacterium
SGNNENPKPVKDSELAKARRGP

SEQ ID NO: 285590 - protein, 6 aa, Mycobacterium
SGNPLD

SEQ ID NO: 285591 - protein, 12 aa, Mycobacterium
SGNQGEALANES

SEQ ID NO: 285592 - protein, 5 aa, Mycobacterium
SGNQI

SEQ ID NO: 285593 - protein, 4 aa, Mycobacterium
SGNR

SEQ ID NO: 285594 - protein, 4 aa, Mycobacterium
SGNY

SEQ ID NO: 285595 - protein, 6 aa, Mycobacterium
SGNYDQ

SEQ ID NO: 285596 - protein, 5 aa, Mycobacterium
SGPAA

SEQ ID NO: 285597 - protein, 14 aa, Mycobacterium
SGPAAASVSALPEN

SEQ ID NO: 285598 - protein, 41 aa, Mycobacterium
SGPAAPAGQVAAPVAGKPSPATGSTLGRPAATGAAGSVEEV

SEQ ID NO: 285599 - protein, 22 aa, Mycobacterium
SGPADDVDVSGQPGAEPGPSTG

SEQ ID NO: 285600 - protein, 7 aa, Mycobacterium
SGPAGNL

SEQ ID NO: 285601 - protein, 26 aa, Mycobacterium
SGPAGQTTGRAIDRSARALRTDARRP

SEQ ID NO: 285602 - protein, 7 aa, Mycobacterium
SGPALSR

SEQ ID NO: 285603 - protein, 5 aa, Mycobacterium
SGPAP

SEQ ID NO: 285604 - protein, 8 aa, Mycobacterium
SGPAPAGL

SEQ ID NO: 285605 - protein, 8 aa, Mycobacterium
SGPAPEGL

SEQ ID NO: 285606 - protein, 42 aa, Mycobacterium
SGPAPGGPTTADTRPKALPLSDPDDAAPPLPDDAGRSAAAAR

SEQ ID NO: 285607 - protein, 8 aa, Mycobacterium
SGPAPPGL

SEQ ID NO: 285608 - protein, 8 aa, Mycobacterium
SGPAPQGL

SEQ ID NO: 285609 - protein, 8 aa, Mycobacterium
SGPAPVES

SEQ ID NO: 285610 - protein, 6 aa, Mycobacterium
SGPARH

SEQ ID NO: 285611 - protein, 6 aa, Mycobacterium
SGPASF

SEQ ID NO: 285612 - protein, 21 aa, Mycobacterium
SGPATKQIPDVAGQSVEEAEQ

SEQ ID NO: 285613 - protein, 13 aa, Mycobacterium
SGPDATAESLAEQ

SEQ ID NO: 285614 - protein, 54 aa, Mycobacterium
SGPDEPLARRGSGPDEPLARRGSGPDEPLARRGSGPDEPLARRGSGPDEPLARR

SEQ ID NO: 285615 - protein, 5 aa, Mycobacterium
SGPDI

SEQ ID NO: 285616 - protein, 5 aa, Mycobacterium
SGPDM

SEQ ID NO: 285617 - protein, 18 aa, Mycobacterium
SGPDSPRTPSTDDRPTSI

SEQ ID NO: 285618 - protein, 12 aa, Mycobacterium
SGPEAKQIPDVA

SEQ ID NO: 285619 - protein, 6 aa, Mycobacterium
SGPEDR

SEQ ID NO: 285620 - protein, 6 aa, Mycobacterium
SGPEMR

SEQ ID NO: 285621 - protein, 13 aa, Mycobacterium
SGPETKQVPDIAG

SEQ ID NO: 285622 - protein, 13 aa, Mycobacterium
SGPETKQVPDVAG

SEQ ID NO: 285623 - protein, 11 aa, Mycobacterium
SGPFGGPGFPA

SEQ ID NO: 285624 - protein, 6 aa, Mycobacterium
SGPGFC

SEQ ID NO: 285625 - protein, 8 aa, Mycobacterium
SGPGGAHC

SEQ ID NO: 285626 - protein, 9 aa, Mycobacterium
SGPGIAPFA

SEQ ID NO: 285627 - protein, 12 aa, Mycobacterium
SGPGIPRGSEHE

SEQ ID NO: 285628 - protein, 11 aa, Mycobacterium
SGPGITPFSTQ

SEQ ID NO: 285629 - protein, 6 aa, Mycobacterium
SGPGTT

SEQ ID NO: 285630 - protein, 22 aa, Mycobacterium
SGPGYSQSQPTLGPTKTSSMTV

SEQ ID NO: 285631 - protein, 14 aa, Mycobacterium
SGPHTDQTLDGPGL

SEQ ID NO: 285632 - protein, 9 aa, Mycobacterium
SGPIGAQRG

SEQ ID NO: 285633 - protein, 6 aa, Mycobacterium
SGPIPD

SEQ ID NO: 285634 - protein, 6 aa, Mycobacterium
SGPITP

SEQ ID NO: 285635 - protein, 9 aa, Mycobacterium
SGPKIAQSQ

SEQ ID NO: 285636 - protein, 9 aa, Mycobacterium
SGPLASAVP

SEQ ID NO: 285637 - protein, 5 aa, Mycobacterium
SGPLE

SEQ ID NO: 285638 - protein, 5 aa, Mycobacterium
SGPLG

SEQ ID NO: 285639 - protein, 12 aa, Mycobacterium
SGPLSSPQRAST

SEQ ID NO: 285640 - protein, 8 aa, Mycobacterium
SGPPALRG

SEQ ID NO: 285641 - protein, 10 aa, Mycobacterium
SGPPDRLPDQ

SEQ ID NO: 285642 - protein, 7 aa, Mycobacterium
SGPPHES

SEQ ID NO: 285643 - protein, 9 aa, Mycobacterium
SGPPNLGQG

SEQ ID NO: 285644 - protein, 6 aa, Mycobacterium
SGPPVQ

SEQ ID NO: 285645 - protein, 64 aa, Mycobacterium
SGPQALPSLPTSEVNVSSSNPEASSWPGVAGTPPPQPPPPPQPPPQKTDATPPSGRRAPSLSGR

SEQ ID NO: 285646 - protein, 6 aa, Mycobacterium
SGPQLA

SEQ ID NO: 285647 - protein, 9 aa, Mycobacterium
SGPQPGKEQ

SEQ ID NO: 285648 - protein, 17 aa, Mycobacterium
SGPQPNTPHQTSNGTLP

SEQ ID NO: 285649 - protein, 8 aa, Mycobacterium
SGPRPGGF

SEQ ID NO: 285650 - protein, 6 aa, Mycobacterium
SGPRRS

SEQ ID NO: 285651 - protein, 5 aa, Mycobacterium
SGPRT

SEQ ID NO: 285652 - protein, 4 aa, Mycobacterium
SGPS

SEQ ID NO: 285653 - protein, 6 aa, Mycobacterium
SGPTGE

SEQ ID NO: 285654 - protein, 7 aa, Mycobacterium
SGPTLSR

SEQ ID NO: 285655 - protein, 4 aa, Mycobacterium
SGPV

SEQ ID NO: 285656 - protein, 5 aa, Mycobacterium
SGPVA

SEQ ID NO: 285657 - protein, 6 aa, Mycobacterium
SGPVDP

SEQ ID NO: 285658 - protein, 6 aa, Mycobacterium
SGPVGG

SEQ ID NO: 285659 - protein, 5 aa, Mycobacterium
SGPVK

SEQ ID NO: 285660 - protein, 6 aa, Mycobacterium
SGPVKP

SEQ ID NO: 285661 - protein, 7 aa, Mycobacterium
SGPVPAA

SEQ ID NO: 285662 - protein, 9 aa, Mycobacterium
SGPVPSPTT

SEQ ID NO: 285663 - protein, 4 aa, Mycobacterium
SGQA

SEQ ID NO: 285664 - protein, 8 aa, Mycobacterium
SGQANTVT

SEQ ID NO: 285665 - protein, 6 aa, Mycobacterium
SGQAPV

SEQ ID NO: 285666 - protein, 8 aa, Mycobacterium
SGQAVTDR

SEQ ID NO: 285667 - protein, 24 aa, Mycobacterium
SGQDSDVAEQPQEPVADPAPQRNT

SEQ ID NO: 285668 - protein, 9 aa, Mycobacterium
SGQDSNVPG

SEQ ID NO: 285669 - protein, 4 aa, Mycobacterium
SGQG

SEQ ID NO: 285670 - protein, 5 aa, Mycobacterium
SGQGA

SEQ ID NO: 285671 - protein, 19 aa, Mycobacterium
SGQGGTGQFADPADATAAL

SEQ ID NO: 285672 - protein, 12 aa, Mycobacterium
SGQGKQEQTQSC

SEQ ID NO: 285673 - protein, 7 aa, Mycobacterium
SGQINDS

SEQ ID NO: 285674 - protein, 18 aa, Mycobacterium
SGQKTLDENGRKNDLQKR

SEQ ID NO: 285675 - protein, 4 aa, Mycobacterium
SGQL

SEQ ID NO: 285676 - protein, 11 aa, Mycobacterium
SGQLATNDPQI

SEQ ID NO: 285677 - protein, 15 aa, Mycobacterium
SGQPLSEGNNRKDHL

SEQ ID NO: 285678 - protein, 23 aa, Mycobacterium
SGQPMGGRPDSTAASPGTLAQRR

SEQ ID NO: 285679 - protein, 10 aa, Mycobacterium
SGQPQTGPVV

SEQ ID NO: 285680 - protein, 14 aa, Mycobacterium
SGQPQTGQVPGTAG

SEQ ID NO: 285681 - protein, 12 aa, Mycobacterium
SGQPRHFWATGD

SEQ ID NO: 285682 - protein, 6 aa, Mycobacterium
SGQPVA

SEQ ID NO: 285683 - protein, 6 aa, Mycobacterium
SGQRAT

SEQ ID NO: 285684 - protein, 5 aa, Mycobacterium
SGQRG

SEQ ID NO: 285685 - protein, 8 aa, Mycobacterium
SGQRGQAI

SEQ ID NO: 285686 - protein, 5 aa, Mycobacterium
SGQSA

SEQ ID NO: 285687 - protein, 8 aa, Mycobacterium
SGQSAQTW

SEQ ID NO: 285688 - protein, 8 aa, Mycobacterium
SGQSATNW

SEQ ID NO: 285689 - protein, 9 aa, Mycobacterium
SGQSAVDES

SEQ ID NO: 285690 - protein, 7 aa, Mycobacterium
SGQSHAQ

SEQ ID NO: 285691 - protein, 5 aa, Mycobacterium
SGQSP

SEQ ID NO: 285692 - protein, 11 aa, Mycobacterium
SGQSPTGWAQG

SEQ ID NO: 285693 - protein, 9 aa, Mycobacterium
SGQSTVDES

SEQ ID NO: 285694 - protein, 10 aa, Mycobacterium
SGQTPGTGGQ

SEQ ID NO: 285695 - protein, 6 aa, Mycobacterium
SGQYSP

SEQ ID NO: 285696 - protein, 4 aa, Mycobacterium
SGRA

SEQ ID NO: 285697 - protein, 12 aa, Mycobacterium
SGRAEPAWPGER

SEQ ID NO: 285698 - protein, 9 aa, Mycobacterium
SGRAPADAA

SEQ ID NO: 285699 - protein, 16 aa, Mycobacterium
SGRAPRGALAAGGPTT

SEQ ID NO: 285700 - protein, 7 aa, Mycobacterium
SGRAQTR

SEQ ID NO: 285701 - protein, 5 aa, Mycobacterium
SGRAV

SEQ ID NO: 285702 - protein, 8 aa, Mycobacterium
SGRDQGWR

SEQ ID NO: 285703 - protein, 5 aa, Mycobacterium
SGRDR

SEQ ID NO: 285704 - protein, 13 aa, Mycobacterium
SGRDTAPAAGPEL

SEQ ID NO: 285705 - protein, 12 aa, Mycobacterium
SGREESPTDLAA

SEQ ID NO: 285706 - protein, 8 aa, Mycobacterium
SGREEVDK

SEQ ID NO: 285707 - protein, 19 aa, Mycobacterium
SGRERGAAATAETAQEEAA

SEQ ID NO: 285708 - protein, 4 aa, Mycobacterium
SGRG

SEQ ID NO: 285709 - protein, 6 aa, Mycobacterium
SGRGAD

SEQ ID NO: 285710 - protein, 16 aa, Mycobacterium
SGRGNRRVVDSDDEFE

SEQ ID NO: 285711 - protein, 6 aa, Mycobacterium
SGRGNS

SEQ ID NO: 285712 - protein, 6 aa, Mycobacterium
SGRGRG

SEQ ID NO: 285713 - protein, 7 aa, Mycobacterium
SGRGRGW

SEQ ID NO: 285714 - protein, 15 aa, Mycobacterium
SGRGSGAAAVGLPTS

SEQ ID NO: 285715 - protein, 4 aa, Mycobacterium
SGRK

SEQ ID NO: 285716 - protein, 6 aa, Mycobacterium
SGRKGG

SEQ ID NO: 285717 - protein, 8 aa, Mycobacterium
SGRLGGGT

SEQ ID NO: 285718 - protein, 8 aa, Mycobacterium
SGRNDLSV

SEQ ID NO: 285719 - protein, 11 aa, Mycobacterium
SGRPADVPGAE

SEQ ID NO: 285720 - protein, 9 aa, Mycobacterium
SGRPLAQEP

SEQ ID NO: 285721 - protein, 9 aa, Mycobacterium
SGRPLERES

SEQ ID NO: 285722 - protein, 6 aa, Mycobacterium
SGRPNV

SEQ ID NO: 285723 - protein, 10 aa, Mycobacterium
SGRPSPGLAD

SEQ ID NO: 285724 - protein, 7 aa, Mycobacterium
SGRPSVG

SEQ ID NO: 285725 - protein, 9 aa, Mycobacterium
SGRQKTSKD

SEQ ID NO: 285726 - protein, 10 aa, Mycobacterium
SGRQQESGSG

SEQ ID NO: 285727 - protein, 5 aa, Mycobacterium
SGRRK

SEQ ID NO: 285728 - protein, 9 aa, Mycobacterium
SGRRKATNA

SEQ ID NO: 285729 - protein, 6 aa, Mycobacterium
SGRRPA

SEQ ID NO: 285730 - protein, 6 aa, Mycobacterium
SGRRRQ

SEQ ID NO: 285731 - protein, 18 aa, Mycobacterium
SGRRSTAENADSTVSEVV

SEQ ID NO: 285732 - protein, 11 aa, Mycobacterium
SGRSAEVAGAD

SEQ ID NO: 285733 - protein, 11 aa, Mycobacterium
SGRSGTLSRPA

SEQ ID NO: 285734 - protein, 8 aa, Mycobacterium
SGRSRGKM

SEQ ID NO: 285735 - protein, 7 aa, Mycobacterium
SGRSSAR

SEQ ID NO: 285736 - protein, 7 aa, Mycobacterium
SGRSSLR

SEQ ID NO: 285737 - protein, 5 aa, Mycobacterium
SGRST

SEQ ID NO: 285738 - protein, 8 aa, Mycobacterium
SGRSTSAG

SEQ ID NO: 285739 - protein, 5 aa, Mycobacterium
SGRTA

SEQ ID NO: 285740 - protein, 6 aa, Mycobacterium
SGRTAL

SEQ ID NO: 285741 - protein, 11 aa, Mycobacterium
SGRTGALSRSA

SEQ ID NO: 285742 - protein, 5 aa, Mycobacterium
SGRVE

SEQ ID NO: 285743 - protein, 5 aa, Mycobacterium
SGRVP

SEQ ID NO: 285744 - protein, 9 aa, Mycobacterium
SGRVTEKDG

SEQ ID NO: 285745 - protein, 6 aa, Mycobacterium
SGRWGQ

SEQ ID NO: 285746 - protein, 5 aa, Mycobacterium
SGRYG

SEQ ID NO: 285747 - protein, 8 aa, Mycobacterium
SGRYGADS

SEQ ID NO: 285748 - protein, 7 aa, Mycobacterium
SGSAAVT

SEQ ID NO: 285749 - protein, 16 aa, Mycobacterium
SGSADAAGHAGGLAGR

SEQ ID NO: 285750 - protein, 9 aa, Mycobacterium
SGSADGDVA

SEQ ID NO: 285751 - protein, 7 aa, Mycobacterium
SGSADQT

SEQ ID NO: 285752 - protein, 11 aa, Mycobacterium
SGSAPQDPKEL

SEQ ID NO: 285753 - protein, 10 aa, Mycobacterium
SGSAQAPSVT

SEQ ID NO: 285754 - protein, 9 aa, Mycobacterium
SGSATQVEQ

SEQ ID NO: 285755 - protein, 8 aa, Mycobacterium
SGSATTER

SEQ ID NO: 285756 - protein, 15 aa, Mycobacterium
SGSAVGSELTDSERR

SEQ ID NO: 285757 - protein, 7 aa, Mycobacterium
SGSDARR

SEQ ID NO: 285758 - protein, 19 aa, Mycobacterium
SGSDRGTAQSKAAAASETL

SEQ ID NO: 285759 - protein, 4 aa, Mycobacterium
SGSE

SEQ ID NO: 285760 - protein, 15 aa, Mycobacterium
SGSEIPEHYWRTLVD

SEQ ID NO: 285761 - protein, 4 aa, Mycobacterium
SGSG

SEQ ID NO: 285762 - protein, 10 aa, Mycobacterium
SGSGGGNRAR

SEQ ID NO: 285763 - protein, 7 aa, Mycobacterium
SGSGGVG

SEQ ID NO: 285764 - protein, 22 aa, Mycobacterium
SGSGIKQAADGAAQLDDGAGQL

SEQ ID NO: 285765 - protein, 21 aa, Mycobacterium
SGSGIKQAADGAAQLDDGAGR

SEQ ID NO: 285766 - protein, 8 aa, Mycobacterium
SGSGPGPL

SEQ ID NO: 285767 - protein, 8 aa, Mycobacterium
SGSGTADV

SEQ ID NO: 285768 - protein, 10 aa, Mycobacterium
SGSGTKLTDK

SEQ ID NO: 285769 - protein, 8 aa, Mycobacterium
SGSIVNPQ

SEQ ID NO: 285770 - protein, 9 aa, Mycobacterium
SGSKWGSAI

SEQ ID NO: 285771 - protein, 15 aa, Mycobacterium
SGSLKSTDPKAARVD

SEQ ID NO: 285772 - protein, 6 aa, Mycobacterium
SGSLTA

SEQ ID NO: 285773 - protein, 11 aa, Mycobacterium
SGSNQGAGAKY

SEQ ID NO: 285774 - protein, 8 aa, Mycobacterium
SGSPAGAV

SEQ ID NO: 285775 - protein, 8 aa, Mycobacterium
SGSPATRS

SEQ ID NO: 285776 - protein, 6 aa, Mycobacterium
SGSPGR

SEQ ID NO: 285777 - protein, 6 aa, Mycobacterium
SGSPIR

SEQ ID NO: 285778 - protein, 7 aa, Mycobacterium
SGSPLDA

SEQ ID NO: 285779 - protein, 9 aa, Mycobacterium
SGSPPATQI

SEQ ID NO: 285780 - protein, 6 aa, Mycobacterium
SGSPVR

SEQ ID NO: 285781 - protein, 7 aa, Mycobacterium
SGSRGGD

SEQ ID NO: 285782 - protein, 4 aa, Mycobacterium
SGSS

SEQ ID NO: 285783 - protein, 15 aa, Mycobacterium
SGSSAIAKASLDASL

SEQ ID NO: 285784 - protein, 10 aa, Mycobacterium
SGSSCDRPGT

SEQ ID NO: 285785 - protein, 5 aa, Mycobacterium
SGSSF

SEQ ID NO: 285786 - protein, 10 aa, Mycobacterium
SGSSGPPKGV

SEQ ID NO: 285787 - protein, 9 aa, Mycobacterium
SGSSNPGTG

SEQ ID NO: 285788 - protein, 10 aa, Mycobacterium
SGSSYGDEGI

SEQ ID NO: 285789 - protein, 7 aa, Mycobacterium
SGSTDTT

SEQ ID NO: 285790 - protein, 10 aa, Mycobacterium
SGSTGAPKGV

SEQ ID NO: 285791 - protein, 10 aa, Mycobacterium
SGSTGEPKAV

SEQ ID NO: 285792 - protein, 10 aa, Mycobacterium
SGSTGKPKGA

SEQ ID NO: 285793 - protein, 13 aa, Mycobacterium
SGSTGKPKGVVTP

SEQ ID NO: 285794 - protein, 11 aa, Mycobacterium
SGSTGNPRGAR

SEQ ID NO: 285795 - protein, 9 aa, Mycobacterium
SGSTGPARV

SEQ ID NO: 285796 - protein, 9 aa, Mycobacterium
SGSTGVPKG

SEQ ID NO: 285797 - protein, 7 aa, Mycobacterium
SGSTIGT

SEQ ID NO: 285798 - protein, 62 aa, Mycobacterium
SGSTPPEPSPWQPPAQQVPPPAHEQAPTLQNPVAPPPPPVGPPPGEPAAAPEPVSPRKGRDY

SEQ ID NO: 285799 - protein, 9 aa, Mycobacterium
SGSTSAPKA

SEQ ID NO: 285800 - protein, 9 aa, Mycobacterium
SGSTSDPKG

SEQ ID NO: 285801 - protein, 10 aa, Mycobacterium
SGSTSDPKGV

SEQ ID NO: 285802 - protein, 12 aa, Mycobacterium
SGSTSDYAGDGV

SEQ ID NO: 285803 - protein, 5 aa, Mycobacterium
SGSVG

SEQ ID NO: 285804 - protein, 10 aa, Mycobacterium
SGSVRGEPSG

SEQ ID NO: 285805 - protein, 7 aa, Mycobacterium
SGSVRGY

SEQ ID NO: 285806 - protein, 6 aa, Mycobacterium
SGSVRR

SEQ ID NO: 285807 - protein, 5 aa, Mycobacterium
SGSVV

SEQ ID NO: 285808 - protein, 4 aa, Mycobacterium
SGSY

SEQ ID NO: 285809 - protein, 9 aa, Mycobacterium
SGSYASDRR

SEQ ID NO: 285810 - protein, 4 aa, Mycobacterium
SGTA

SEQ ID NO: 285811 - protein, 20 aa, Mycobacterium
SGTAAETAAVTDPGAFAQSG

SEQ ID NO: 285812 - protein, 27 aa, Mycobacterium
SGTAERPGSAGAPGAVGRGAGPIDDGV

SEQ ID NO: 285813 - protein, 5 aa, Mycobacterium
SGTAM

SEQ ID NO: 285814 - protein, 15 aa, Mycobacterium
SGTAPLSADDADAFT

SEQ ID NO: 285815 - protein, 6 aa, Mycobacterium
SGTATL

SEQ ID NO: 285816 - protein, 5 aa, Mycobacterium
SGTAW

SEQ ID NO: 285817 - protein, 10 aa, Mycobacterium
SGTEDDGRGM

SEQ ID NO: 285818 - protein, 8 aa, Mycobacterium
SGTEHGET

SEQ ID NO: 285819 - protein, 6 aa, Mycobacterium
SGTEID

SEQ ID NO: 285820 - protein, 5 aa, Mycobacterium
SGTEL

SEQ ID NO: 285821 - protein, 7 aa, Mycobacterium
SGTETTV

SEQ ID NO: 285822 - protein, 4 aa, Mycobacterium
SGTG

SEQ ID NO: 285823 - protein, 5 aa, Mycobacterium
SGTGA

SEQ ID NO: 285824 - protein, 8 aa, Mycobacterium
SGTGGLGR

SEQ ID NO: 285825 - protein, 5 aa, Mycobacterium
SGTGN

SEQ ID NO: 285826 - protein, 7 aa, Mycobacterium
SGTGQQI

SEQ ID NO: 285827 - protein, 20 aa, Mycobacterium
SGTGTPGPPVAGGGGGGGDV

SEQ ID NO: 285828 - protein, 8 aa, Mycobacterium
SGTIGGPV

SEQ ID NO: 285829 - protein, 6 aa, Mycobacterium
SGTLGR

SEQ ID NO: 285830 - protein, 14 aa, Mycobacterium
SGTLTDDDVREIED

SEQ ID NO: 285831 - protein, 4 aa, Mycobacterium
SGTM

SEQ ID NO: 285832 - protein, 10 aa, Mycobacterium
SGTPATADRL

SEQ ID NO: 285833 - protein, 37 aa, Mycobacterium
SGTPDSYTYTPPVSGGGGPLDAPLPPQVQTRTDSTEQ

SEQ ID NO: 285834 - protein, 8 aa, Mycobacterium
SGTPGRTL

SEQ ID NO: 285835 - protein, 10 aa, Mycobacterium
SGTPIPSNVT

SEQ ID NO: 285836 - protein, 15 aa, Mycobacterium
SGTPSMPATTAPPAG

SEQ ID NO: 285837 - protein, 17 aa, Mycobacterium
SGTQTFSKEETANETRG

SEQ ID NO: 285838 - protein, 4 aa, Mycobacterium
SGTR

SEQ ID NO: 285839 - protein, 17 aa, Mycobacterium
SGTRQQHSLGNNNARDR

SEQ ID NO: 285840 - protein, 16 aa, Mycobacterium
SGTRQQPSPNHDGGQR

SEQ ID NO: 285841 - protein, 5 aa, Mycobacterium
SGTSD

SEQ ID NO: 285842 - protein, 8 aa, Mycobacterium
SGTSEPVG

SEQ ID NO: 285843 - protein, 9 aa, Mycobacterium
SGTSGGGIN

SEQ ID NO: 285844 - protein, 10 aa, Mycobacterium
SGTSGPSRSS

SEQ ID NO: 285845 - protein, 8 aa, Mycobacterium
SGTSGRAK

SEQ ID NO: 285846 - protein, 6 aa, Mycobacterium
SGTSLG

SEQ ID NO: 285847 - protein, 6 aa, Mycobacterium
SGTSYA

SEQ ID NO: 285848 - protein, 8 aa, Mycobacterium
SGTSYAAG

SEQ ID NO: 285849 - protein, 4 aa, Mycobacterium
SGTT

SEQ ID NO: 285850 - protein, 12 aa, Mycobacterium
SGTTDSSQPRLA

SEQ ID NO: 285851 - protein, 13 aa, Mycobacterium
SGTTGHPKGVPTT

SEQ ID NO: 285852 - protein, 16 aa, Mycobacterium
SGTTGLAKGVPRAIKP

SEQ ID NO: 285853 - protein, 8 aa, Mycobacterium
SGTTGLPK

SEQ ID NO: 285854 - protein, 9 aa, Mycobacterium
SGTTGLPKG

SEQ ID NO: 285855 - protein, 10 aa, Mycobacterium
SGTTGPPKRI

SEQ ID NO: 285856 - protein, 10 aa, Mycobacterium
SGTTGSGKST

SEQ ID NO: 285857 - protein, 8 aa, Mycobacterium
SGTTGVPK

SEQ ID NO: 285858 - protein, 9 aa, Mycobacterium
SGTTRDPKG

SEQ ID NO: 285859 - protein, 10 aa, Mycobacterium
SGTTSAPKGV

SEQ ID NO: 285860 - protein, 6 aa, Mycobacterium
SGTTVS

SEQ ID NO: 285861 - protein, 5 aa, Mycobacterium
SGTVH

SEQ ID NO: 285862 - protein, 14 aa, Mycobacterium
SGVARDTATDSRPA

SEQ ID NO: 285863 - protein, 7 aa, Mycobacterium
SGVEAPV

SEQ ID NO: 285864 - protein, 9 aa, Mycobacterium
SGVGASPLQ

SEQ ID NO: 285865 - protein, 7 aa, Mycobacterium
SGVGPSP

SEQ ID NO: 285866 - protein, 5 aa, Mycobacterium
SGVGR

SEQ ID NO: 285867 - protein, 9 aa, Mycobacterium
SGVGSHPRL

SEQ ID NO: 285868 - protein, 6 aa, Mycobacterium
SGVGSS

SEQ ID NO: 285869 - protein, 9 aa, Mycobacterium
SGVPENLRS

SEQ ID NO: 285870 - protein, 9 aa, Mycobacterium
SGVPENLRT

SEQ ID NO: 285871 - protein, 9 aa, Mycobacterium
SGVPENVKA

SEQ ID NO: 285872 - protein, 9 aa, Mycobacterium
SGVPENVQA

SEQ ID NO: 285873 - protein, 10 aa, Mycobacterium
SGVPGDASVA

SEQ ID NO: 285874 - protein, 13 aa, Mycobacterium
SGVPKARAAALTG

SEQ ID NO: 285875 - protein, 14 aa, Mycobacterium
SGVPLSDKSAATAG

SEQ ID NO: 285876 - protein, 7 aa, Mycobacterium
SGVQIPP

SEQ ID NO: 285877 - protein, 21 aa, Mycobacterium
SGVRSGLAPAERDSSGNPVEP

SEQ ID NO: 285878 - protein, 6 aa, Mycobacterium
SGVSAG

SEQ ID NO: 285879 - protein, 13 aa, Mycobacterium
SGVSEGARSKTRE

SEQ ID NO: 285880 - protein, 4 aa, Mycobacterium
SGVT

SEQ ID NO: 285881 - protein, 12 aa, Mycobacterium
SGVTGPGGTTGE

SEQ ID NO: 285882 - protein, 14 aa, Mycobacterium
SGVTPAQAAAQASL

SEQ ID NO: 285883 - protein, 5 aa, Mycobacterium
SGVTT

SEQ ID NO: 285884 - protein, 6 aa, Mycobacterium
SGVTWT

SEQ ID NO: 285885 - protein, 4 aa, Mycobacterium
SGWA

SEQ ID NO: 285886 - protein, 4 aa, Mycobacterium
SGYA

SEQ ID NO: 285887 - protein, 5 aa, Mycobacterium
SGYFG

SEQ ID NO: 285888 - protein, 17 aa, Mycobacterium
SGYPAGACTPETRPMPG

SEQ ID NO: 285889 - protein, 19 aa, Mycobacterium
SGYTSGTCTPTSPKPDSVW

SEQ ID NO: 285890 - protein, 10 aa, Mycobacterium
SHAARDADAA

SEQ ID NO: 285891 - protein, 28 aa, Mycobacterium
SHADDETHDGNEDGPGSDDVVAEAVAEP

SEQ ID NO: 285892 - protein, 5 aa, Mycobacterium
SHADG

SEQ ID NO: 285893 - protein, 48 aa, Mycobacterium
SHAGDSDPKVSTRNPETRPDDAAAADGPVPEPGPADQASEPAAAKHST

SEQ ID NO: 285894 - protein, 9 aa, Mycobacterium
SHAGRATTS

SEQ ID NO: 285895 - protein, 6 aa, Mycobacterium
SHARNP

SEQ ID NO: 285896 - protein, 19 aa, Mycobacterium
SHDASDSIDSALESSAAGI

SEQ ID NO: 285897 - protein, 7 aa, Mycobacterium
SHDASGW

SEQ ID NO: 285898 - protein, 24 aa, Mycobacterium
SHDDRRGSHTIGQASTSGSAAVPK

SEQ ID NO: 285899 - protein, 8 aa, Mycobacterium
SHDPAAAR

SEQ ID NO: 285900 - protein, 5 aa, Mycobacterium
SHDPL

SEQ ID NO: 285901 - protein, 7 aa, Mycobacterium
SHDRAEP

SEQ ID NO: 285902 - protein, 20 aa, Mycobacterium
SHDRPASLDNPRSPRRRAGM

SEQ ID NO: 285903 - protein, 6 aa, Mycobacterium
SHEGQV

SEQ ID NO: 285904 - protein, 4 aa, Mycobacterium
SHEH

SEQ ID NO: 285905 - protein, 11 aa, Mycobacterium
SHERTETPEKV

SEQ ID NO: 285906 - protein, 14 aa, Mycobacterium
SHGATRGAREAQPV

SEQ ID NO: 285907 - protein, 7 aa, Mycobacterium
SHGGPDG

SEQ ID NO: 285908 - protein, 4 aa, Mycobacterium
SHGL

SEQ ID NO: 285909 - protein, 11 aa, Mycobacterium
SHGPRVAGGGS

SEQ ID NO: 285910 - protein, 6 aa, Mycobacterium
SHGRHE

SEQ ID NO: 285911 - protein, 5 aa, Mycobacterium
SHGRQ

SEQ ID NO: 285912 - protein, 9 aa, Mycobacterium
SHGSSEQRQ

SEQ ID NO: 285913 - protein, 8 aa, Mycobacterium
SHGSTNRN

SEQ ID NO: 285914 - protein, 7 aa, Mycobacterium
SHGTSTA

SEQ ID NO: 285915 - protein, 11 aa, Mycobacterium
SHHPSTEASTQ

SEQ ID NO: 285916 - protein, 11 aa, Mycobacterium
SHKQSPEQEPV

SEQ ID NO: 285917 - protein, 5 aa, Mycobacterium
SHKRQ

SEQ ID NO: 285918 - protein, 8 aa, Mycobacterium
SHLDSGKR

SEQ ID NO: 285919 - protein, 8 aa, Mycobacterium
SHLSPNPV

SEQ ID NO: 285920 - protein, 5 aa, Mycobacterium
SHPAV

SEQ ID NO: 285921 - protein, 8 aa, Mycobacterium
SHPDEGDV

SEQ ID NO: 285922 - protein, 26 aa, Mycobacterium
SHPDPEELTTVPGSRRQWERDPGDDD

SEQ ID NO: 285923 - protein, 10 aa, Mycobacterium
SHPEPLTDPG

SEQ ID NO: 285924 - protein, 5 aa, Mycobacterium
SHPGQ

SEQ ID NO: 285925 - protein, 5 aa, Mycobacterium
SHPGR

SEQ ID NO: 285926 - protein, 7 aa, Mycobacterium
SHPGRYA

SEQ ID NO: 285927 - protein, 19 aa, Mycobacterium
SHPLDSDSATTDDSVDANP

SEQ ID NO: 285928 - protein, 6 aa, Mycobacterium
SHPPAG

SEQ ID NO: 285929 - protein, 7 aa, Mycobacterium
SHPPGTP

SEQ ID NO: 285930 - protein, 19 aa, Mycobacterium
SHPQHESDGLDDAEHAESA

SEQ ID NO: 285931 - protein, 18 aa, Mycobacterium
SHPSDPPRTAYEPSDDGI

SEQ ID NO: 285932 - protein, 13 aa, Mycobacterium
SHPTTPFVSVDYD

SEQ ID NO: 285933 - protein, 4 aa, Mycobacterium
SHPY

SEQ ID NO: 285934 - protein, 5 aa, Mycobacterium
SHQLA

SEQ ID NO: 285935 - protein, 8 aa, Mycobacterium
SHQPGYGI

SEQ ID NO: 285936 - protein, 13 aa, Mycobacterium
SHRDGTDDCDGHG

SEQ ID NO: 285937 - protein, 22 aa, Mycobacterium
SHRGGDQGRNTGSGPTSGGASG

SEQ ID NO: 285938 - protein, 19 aa, Mycobacterium
SHRRQQQERDDEEKRRRGE

SEQ ID NO: 285939 - protein, 4 aa, Mycobacterium
SHSA

SEQ ID NO: 285940 - protein, 5 aa, Mycobacterium
SHSAQ

SEQ ID NO: 285941 - protein, 6 aa, Mycobacterium
SHSASP

SEQ ID NO: 285942 - protein, 7 aa, Mycobacterium
SHSDVSG

SEQ ID NO: 285943 - protein, 74 aa, Mycobacterium
SHSSRSRRVSGKAHSAHEPRQPRSSGKTRADRSPKQVREPKRLPQAKQAKKTRPAARTEVAPPGRSARERRTRQ

SEQ ID NO: 285944 - protein, 7 aa, Mycobacterium
SHTARPG

SEQ ID NO: 285945 - protein, 7 aa, Mycobacterium
SHTDGTR

SEQ ID NO: 285946 - protein, 4 aa, Mycobacterium
SHTN

SEQ ID NO: 285947 - protein, 19 aa, Mycobacterium
SHTPVPAGVGGRVTASVDG

SEQ ID NO: 285948 - protein, 14 aa, Mycobacterium
SHYGTASASGVYQP

SEQ ID NO: 285949 - protein, 8 aa, Mycobacterium
SIAADGVA

SEQ ID NO: 285950 - protein, 12 aa, Mycobacterium
SIAAGDDSEPDV

SEQ ID NO: 285951 - protein, 12 aa, Mycobacterium
SIAAGDDTEPDV

SEQ ID NO: 285952 - protein, 12 aa, Mycobacterium
SIAAGDGDEPDV

SEQ ID NO: 285953 - protein, 4 aa, Mycobacterium
SIAD

SEQ ID NO: 285954 - protein, 31 aa, Mycobacterium
SIADTKSDIAQAEEFQKQGRLPSSEELTKAH

SEQ ID NO: 285955 - protein, 7 aa, Mycobacterium
SIAENPT

SEQ ID NO: 285956 - protein, 9 aa, Mycobacterium
SIAGAKGTL

SEQ ID NO: 285957 - protein, 7 aa, Mycobacterium
SIAGQTL

SEQ ID NO: 285958 - protein, 5 aa, Mycobacterium
SIAPG

SEQ ID NO: 285959 - protein, 6 aa, Mycobacterium
SIAPGP

SEQ ID NO: 285960 - protein, 69 aa, Mycobacterium
SIAPITSTTTTSTTSTTSASTTTSDSTSASTSTTETSGSASPSTSSSTSTSATASTSVTSVPTSTPTTV

SEQ ID NO: 285961 - protein, 16 aa, Mycobacterium
SIARQSPEAAANPQTA

SEQ ID NO: 285962 - protein, 16 aa, Mycobacterium
SIARQSPEAQANPQTQ

SEQ ID NO: 285963 - protein, 6 aa, Mycobacterium
SIDASP

SEQ ID NO: 285964 - protein, 5 aa, Mycobacterium
SIDGQ

SEQ ID NO: 285965 - protein, 14 aa, Mycobacterium
SIDLQNPSWLTKLI

SEQ ID NO: 285966 - protein, 9 aa, Mycobacterium
SIDSNDIDE

SEQ ID NO: 285967 - protein, 8 aa, Mycobacterium
SIEAAGDK

SEQ ID NO: 285968 - protein, 5 aa, Mycobacterium
SIEGA

SEQ ID NO: 285969 - protein, 5 aa, Mycobacterium
SIEGN

SEQ ID NO: 285970 - protein, 8 aa, Mycobacterium
SIETAGDK

SEQ ID NO: 285971 - protein, 16 aa, Mycobacterium
SIFGDDDQAASSGRTA

SEQ ID NO: 285972 - protein, 12 aa, Mycobacterium
SIGDNVAEATER

SEQ ID NO: 285973 - protein, 10 aa, Mycobacterium
SIGDRSSPLA

SEQ ID NO: 285974 - protein, 7 aa, Mycobacterium
SIGEPAS

SEQ ID NO: 285975 - protein, 21 aa, Mycobacterium
SIGGASGTDPAANPEGQDAAA

SEQ ID NO: 285976 - protein, 11 aa, Mycobacterium
SIGGRTGTGGV

SEQ ID NO: 285977 - protein, 20 aa, Mycobacterium
SIGKSQVSSEEADSVETSAL

SEQ ID NO: 285978 - protein, 11 aa, Mycobacterium
SIGQADPNAPA

SEQ ID NO: 285979 - protein, 5 aa, Mycobacterium
SIGQG

SEQ ID NO: 285980 - protein, 9 aa, Mycobacterium
SIGQSPVSI

SEQ ID NO: 285981 - protein, 6 aa, Mycobacterium
SIGRNQ

SEQ ID NO: 285982 - protein, 9 aa, Mycobacterium
SIGRPNPHT

SEQ ID NO: 285983 - protein, 11 aa, Mycobacterium
SIGSSKDLKVG

SEQ ID NO: 285984 - protein, 11 aa, Mycobacterium
SIGTGGSGGIF

SEQ ID NO: 285985 - protein, 10 aa, Mycobacterium
SIGTTATALQ

SEQ ID NO: 285986 - protein, 11 aa, Mycobacterium
SIKPPPRRQPH

SEQ ID NO: 285987 - protein, 9 aa, Mycobacterium
SIKSSGRAA

SEQ ID NO: 285988 - protein, 4 aa, Mycobacterium
SING

SEQ ID NO: 285989 - protein, 6 aa, Mycobacterium
SINGSG

SEQ ID NO: 285990 - protein, 13 aa, Mycobacterium
SINPGWAARDAQG

SEQ ID NO: 285991 - protein, 9 aa, Mycobacterium
SIPANAGLQ

SEQ ID NO: 285992 - protein, 8 aa, Mycobacterium
SIPASGRT

SEQ ID NO: 285993 - protein, 7 aa, Mycobacterium
SIPDDPV

SEQ ID NO: 285994 - protein, 5 aa, Mycobacterium
SIPEG

SEQ ID NO: 285995 - protein, 4 aa, Mycobacterium
SIPG

SEQ ID NO: 285996 - protein, 6 aa, Mycobacterium
SIPGPQ

SEQ ID NO: 285997 - protein, 6 aa, Mycobacterium
SIPGRH

SEQ ID NO: 285998 - protein, 7 aa, Mycobacterium
SIPGSAR

SEQ ID NO: 285999 - protein, 11 aa, Mycobacterium
SIPITTSGKIR

SEQ ID NO: 286000 - protein, 12 aa, Mycobacterium
SIPITTSGKVRR

SEQ ID NO: 286001 - protein, 7 aa, Mycobacterium
SIPKGQW

SEQ ID NO: 286002 - protein, 6 aa, Mycobacterium
SIPKNV

SEQ ID NO: 286003 - protein, 4 aa, Mycobacterium
SIPR

SEQ ID NO: 286004 - protein, 13 aa, Mycobacterium
SIPRTTSGKLARR

SEQ ID NO: 286005 - protein, 5 aa, Mycobacterium
SIQAN

SEQ ID NO: 286006 - protein, 5 aa, Mycobacterium
SIQGN

SEQ ID NO: 286007 - protein, 10 aa, Mycobacterium
SIQSATPNRA

SEQ ID NO: 286008 - protein, 15 aa, Mycobacterium
SIREQGGQPSSQEVD

SEQ ID NO: 286009 - protein, 14 aa, Mycobacterium
SIRPGDTAARLGGD

SEQ ID NO: 286010 - protein, 21 aa, Mycobacterium
SIRRSSLQPRQPSRTHSSPAV

SEQ ID NO: 286011 - protein, 10 aa, Mycobacterium
SIRSDEANST

SEQ ID NO: 286012 - protein, 6 aa, Mycobacterium
SIRSSN

SEQ ID NO: 286013 - protein, 8 aa, Mycobacterium
SIRSSNTA

SEQ ID NO: 286014 - protein, 10 aa, Mycobacterium
SISADPEYRE

SEQ ID NO: 286015 - protein, 9 aa, Mycobacterium
SISAGGTGF

SEQ ID NO: 286016 - protein, 8 aa, Mycobacterium
SISANEAT

SEQ ID NO: 286017 - protein, 7 aa, Mycobacterium
SISDDQR

SEQ ID NO: 286018 - protein, 6 aa, Mycobacterium
SISDPI

SEQ ID NO: 286019 - protein, 8 aa, Mycobacterium
SISNGATT

SEQ ID NO: 286020 - protein, 5 aa, Mycobacterium
SISQH

SEQ ID NO: 286021 - protein, 8 aa, Mycobacterium
SISRSGAN

SEQ ID NO: 286022 - protein, 6 aa, Mycobacterium
SISSAR

SEQ ID NO: 286023 - protein, 18 aa, Mycobacterium
SISSARLKAASKTNIVSD

SEQ ID NO: 286024 - protein, 10 aa, Mycobacterium
SISSNQDLGE

SEQ ID NO: 286025 - protein, 9 aa, Mycobacterium
SITAAKGTL

SEQ ID NO: 286026 - protein, 9 aa, Mycobacterium
SITAKDHPL

SEQ ID NO: 286027 - protein, 11 aa, Mycobacterium
SITDDGSNQAR

SEQ ID NO: 286028 - protein, 11 aa, Mycobacterium
SITGKGVRATV

SEQ ID NO: 286029 - protein, 8 aa, Mycobacterium
SITGRDHP

SEQ ID NO: 286030 - protein, 14 aa, Mycobacterium
SITGTHSDDDPDRE

SEQ ID NO: 286031 - protein, 6 aa, Mycobacterium
SITPTS

SEQ ID NO: 286032 - protein, 12 aa, Mycobacterium
SITTSSHQPEIT

SEQ ID NO: 286033 - protein, 14 aa, Mycobacterium
SKAAAEDRKRGAGP

SEQ ID NO: 286034 - protein, 19 aa, Mycobacterium
SKAAPAPQDQDQDQSEEQS

SEQ ID NO: 286035 - protein, 8 aa, Mycobacterium
SKAARDLS

SEQ ID NO: 286036 - protein, 19 aa, Mycobacterium
SKAAVEQLKPKPQQLGDTA

SEQ ID NO: 286037 - protein, 7 aa, Mycobacterium
SKAEAAL

SEQ ID NO: 286038 - protein, 8 aa, Mycobacterium
SKAEAALE

SEQ ID NO: 286039 - protein, 10 aa, Mycobacterium
SKAEGQTGAA

SEQ ID NO: 286040 - protein, 8 aa, Mycobacterium
SKAESALE

SEQ ID NO: 286041 - protein, 7 aa, Mycobacterium
SKAGADL

SEQ ID NO: 286042 - protein, 7 aa, Mycobacterium
SKANAGV

SEQ ID NO: 286043 - protein, 7 aa, Mycobacterium
SKAQAGV

SEQ ID NO: 286044 - protein, 5 aa, Mycobacterium
SKARS

SEQ ID NO: 286045 - protein, 6 aa, Mycobacterium
SKDAFP

SEQ ID NO: 286046 - protein, 7 aa, Mycobacterium
SKDARTG

SEQ ID NO: 286047 - protein, 7 aa, Mycobacterium
SKDGKTG

SEQ ID NO: 286048 - protein, 7 aa, Mycobacterium
SKDHKSG

SEQ ID NO: 286049 - protein, 6 aa, Mycobacterium
SKDNKA

SEQ ID NO: 286050 - protein, 7 aa, Mycobacterium
SKDSLAV

SEQ ID NO: 286051 - protein, 7 aa, Mycobacterium
SKDTKSG

SEQ ID NO: 286052 - protein, 6 aa, Mycobacterium
SKEAPR

SEQ ID NO: 286053 - protein, 11 aa, Mycobacterium
SKEDNGEERID

SEQ ID NO: 286054 - protein, 7 aa, Mycobacterium
SKEITVE

SEQ ID NO: 286055 - protein, 9 aa, Mycobacterium
SKERAEAEA

SEQ ID NO: 286056 - protein, 6 aa, Mycobacterium
SKERVR

SEQ ID NO: 286057 - protein, 6 aa, Mycobacterium
SKESLA

SEQ ID NO: 286058 - protein, 7 aa, Mycobacterium
SKESPRT

SEQ ID NO: 286059 - protein, 6 aa, Mycobacterium
SKETEG

SEQ ID NO: 286060 - protein, 8 aa, Mycobacterium
SKETRPDV

SEQ ID NO: 286061 - protein, 6 aa, Mycobacterium
SKFASR

SEQ ID NO: 286062 - protein, 7 aa, Mycobacterium
SKGAGDV

SEQ ID NO: 286063 - protein, 5 aa, Mycobacterium
SKGEP

SEQ ID NO: 286064 - protein, 12 aa, Mycobacterium
SKGETRYYRPQT

SEQ ID NO: 286065 - protein, 12 aa, Mycobacterium
SKGIVAQPSGLT

SEQ ID NO: 286066 - protein, 8 aa, Mycobacterium
SKGKPTSF

SEQ ID NO: 286067 - protein, 5 aa, Mycobacterium
SKGLS

SEQ ID NO: 286068 - protein, 7 aa, Mycobacterium
SKGPDLG

SEQ ID NO: 286069 - protein, 15 aa, Mycobacterium
SKGTITGAGLDGLGD

SEQ ID NO: 286070 - protein, 9 aa, Mycobacterium
SKGTRAEKI

SEQ ID NO: 286071 - protein, 8 aa, Mycobacterium
SKGTRAER

SEQ ID NO: 286072 - protein, 7 aa, Mycobacterium
SKGTRAQ

SEQ ID NO: 286073 - protein, 12 aa, Mycobacterium
SKHETSRAGNTF

SEQ ID NO: 286074 - protein, 5 aa, Mycobacterium
SKHRQ

SEQ ID NO: 286075 - protein, 14 aa, Mycobacterium
SKIPRVPANSVLAT

SEQ ID NO: 286076 - protein, 8 aa, Mycobacterium
SKKGKDKG

SEQ ID NO: 286077 - protein, 7 aa, Mycobacterium
SKKGTRS

SEQ ID NO: 286078 - protein, 15 aa, Mycobacterium
SKKNPELAYDLGIIR

SEQ ID NO: 286079 - protein, 7 aa, Mycobacterium
SKKPCSL

SEQ ID NO: 286080 - protein, 7 aa, Mycobacterium
SKKQGYA

SEQ ID NO: 286081 - protein, 4 aa, Mycobacterium
SKLE

SEQ ID NO: 286082 - protein, 6 aa, Mycobacterium
SKLPPQ

SEQ ID NO: 286083 - protein, 6 aa, Mycobacterium
SKLPSP

SEQ ID NO: 286084 - protein, 7 aa, Mycobacterium
SKLTPDY

SEQ ID NO: 286085 - protein, 7 aa, Mycobacterium
SKLTPTR

SEQ ID NO: 286086 - protein, 7 aa, Mycobacterium
SKMGEEI

SEQ ID NO: 286087 - protein, 5 aa, Mycobacterium
SKMTQ

SEQ ID NO: 286088 - protein, 6 aa, Mycobacterium
SKMTTP

SEQ ID NO: 286089 - protein, 7 aa, Mycobacterium
SKNGTRS

SEQ ID NO: 286090 - protein, 7 aa, Mycobacterium
SKNGVPY

SEQ ID NO: 286091 - protein, 13 aa, Mycobacterium
SKNPDNRYQNAAE

SEQ ID NO: 286092 - protein, 9 aa, Mycobacterium
SKNTSDVAK

SEQ ID NO: 286093 - protein, 7 aa, Mycobacterium
SKPERGT

SEQ ID NO: 286094 - protein, 9 aa, Mycobacterium
SKPFTAASE

SEQ ID NO: 286095 - protein, 7 aa, Mycobacterium
SKPGELT

SEQ ID NO: 286096 - protein, 7 aa, Mycobacterium
SKPIAAA

SEQ ID NO: 286097 - protein, 6 aa, Mycobacterium
SKPLSD

SEQ ID NO: 286098 - protein, 17 aa, Mycobacterium
SKPRGQTDPNARGPDQQ

SEQ ID NO: 286099 - protein, 7 aa, Mycobacterium
SKPRRAD

SEQ ID NO: 286100 - protein, 8 aa, Mycobacterium
SKPSARTV

SEQ ID NO: 286101 - protein, 10 aa, Mycobacterium
SKPSGPIDPR

SEQ ID NO: 286102 - protein, 8 aa, Mycobacterium
SKPSQAEL

SEQ ID NO: 286103 - protein, 7 aa, Mycobacterium
SKPTNQV

SEQ ID NO: 286104 - protein, 8 aa, Mycobacterium
SKPTVAPG

SEQ ID NO: 286105 - protein, 9 aa, Mycobacterium
SKQDGGNSA

SEQ ID NO: 286106 - protein, 6 aa, Mycobacterium
SKQTAL

SEQ ID NO: 286107 - protein, 4 aa, Mycobacterium
SKQV

SEQ ID NO: 286108 - protein, 8 aa, Mycobacterium
SKRNATAD

SEQ ID NO: 286109 - protein, 8 aa, Mycobacterium
SKRNATAT

SEQ ID NO: 286110 - protein, 6 aa, Mycobacterium
SKRQGY

SEQ ID NO: 286111 - protein, 9 aa, Mycobacterium
SKRSRTGRL

SEQ ID NO: 286112 - protein, 12 aa, Mycobacterium
SKRVEAPSAEEI

SEQ ID NO: 286113 - protein, 14 aa, Mycobacterium
SKRVGGGLTICDAR

SEQ ID NO: 286114 - protein, 9 aa, Mycobacterium
SKSLTADGS

SEQ ID NO: 286115 - protein, 8 aa, Mycobacterium
SKSRPALE

SEQ ID NO: 286116 - protein, 6 aa, Mycobacterium
SKSSAE

SEQ ID NO: 286117 - protein, 7 aa, Mycobacterium
SKSSPRI

SEQ ID NO: 286118 - protein, 8 aa, Mycobacterium
SKSSTMRD

SEQ ID NO: 286119 - protein, 4 aa, Mycobacterium
SKST

SEQ ID NO: 286120 - protein, 6 aa, Mycobacterium
SKSTVR

SEQ ID NO: 286121 - protein, 7 aa, Mycobacterium
SKSTVRL

SEQ ID NO: 286122 - protein, 6 aa, Mycobacterium
SKTATM

SEQ ID NO: 286123 - protein, 5 aa, Mycobacterium
SKTDG

SEQ ID NO: 286124 - protein, 13 aa, Mycobacterium
SKTGFQRGGWPSR

SEQ ID NO: 286125 - protein, 11 aa, Mycobacterium
SKTHGGKEFGA

SEQ ID NO: 286126 - protein, 6 aa, Mycobacterium
SKTITA

SEQ ID NO: 286127 - protein, 7 aa, Mycobacterium
SKTLSPA

SEQ ID NO: 286128 - protein, 8 aa, Mycobacterium
SKTPVPQG

SEQ ID NO: 286129 - protein, 10 aa, Mycobacterium
SKTRAAAESR

SEQ ID NO: 286130 - protein, 9 aa, Mycobacterium
SKTRALTES

SEQ ID NO: 286131 - protein, 4 aa, Mycobacterium
SKVA

SEQ ID NO: 286132 - protein, 5 aa, Mycobacterium
SKVTY

SEQ ID NO: 286133 - protein, 15 aa, Mycobacterium
SLAADPGKAIEGTAY

SEQ ID NO: 286134 - protein, 7 aa, Mycobacterium
SLAAESG

SEQ ID NO: 286135 - protein, 5 aa, Mycobacterium
SLAAG

SEQ ID NO: 286136 - protein, 15 aa, Mycobacterium
SLAAPRPTEDTFATA

SEQ ID NO: 286137 - protein, 8 aa, Mycobacterium
SLAASSTV

SEQ ID NO: 286138 - protein, 10 aa, Mycobacterium
SLAATPRASL

SEQ ID NO: 286139 - protein, 10 aa, Mycobacterium
SLADGSAQLA

SEQ ID NO: 286140 - protein, 5 aa, Mycobacterium
SLADP

SEQ ID NO: 286141 - protein, 11 aa, Mycobacterium
SLAENTSDAQV

SEQ ID NO: 286142 - protein, 8 aa, Mycobacterium
SLAGDSAK

SEQ ID NO: 286143 - protein, 5 aa, Mycobacterium
SLAGN

SEQ ID NO: 286144 - protein, 25 aa, Mycobacterium
SLAKGTSQLGAGMSDTAKSLTTADQ

SEQ ID NO: 286145 - protein, 5 aa, Mycobacterium
SLAPA

SEQ ID NO: 286146 - protein, 12 aa, Mycobacterium
SLAPKTAPPSVA

SEQ ID NO: 286147 - protein, 15 aa, Mycobacterium
SLAPQHTGKLRERGQ

SEQ ID NO: 286148 - protein, 8 aa, Mycobacterium
SLASASAD

SEQ ID NO: 286149 - protein, 11 aa, Mycobacterium
SLASDNPTASA

SEQ ID NO: 286150 - protein, 12 aa, Mycobacterium
SLASKDAPSYQA

SEQ ID NO: 286151 - protein, 18 aa, Mycobacterium
SLASQGVTPSSVGTLPTH

SEQ ID NO: 286152 - protein, 7 aa, Mycobacterium
SLASRGI

SEQ ID NO: 286153 - protein, 12 aa, Mycobacterium
SLASSKAAQGAS

SEQ ID NO: 286154 - protein, 9 aa, Mycobacterium
SLATASGSA

SEQ ID NO: 286155 - protein, 6 aa, Mycobacterium
SLATDA

SEQ ID NO: 286156 - protein, 10 aa, Mycobacterium
SLATGAAAGA

SEQ ID NO: 286157 - protein, 14 aa, Mycobacterium
SLATGGDAALTPSD

SEQ ID NO: 286158 - protein, 15 aa, Mycobacterium
SLATQRKTPASAGTL

SEQ ID NO: 286159 - protein, 16 aa, Mycobacterium
SLDADPGKAIEGTAYS

SEQ ID NO: 286160 - protein, 5 aa, Mycobacterium
SLDAG

SEQ ID NO: 286161 - protein, 8 aa, Mycobacterium
SLDAQTDD

SEQ ID NO: 286162 - protein, 107 aa, Mycobacterium
SLDEPSRDDVVDEPSRGDDAGHQQRDAGEAADYYSEADDDYADDDYADEDYYSDERHYPDDDEPYADDEPYAAGDAFADSTADEYPEFPPRQGGPASSEPPAESPSL

SEQ ID NO: 286163 - protein, 8 aa, Mycobacterium
SLDGASTW

SEQ ID NO: 286164 - protein, 9 aa, Mycobacterium
SLDGQGDSE

SEQ ID NO: 286165 - protein, 16 aa, Mycobacterium
SLDKGPDVDAGGSQHN

SEQ ID NO: 286166 - protein, 9 aa, Mycobacterium
SLDKGTASL

SEQ ID NO: 286167 - protein, 10 aa, Mycobacterium
SLDQQDDVDV

SEQ ID NO: 286168 - protein, 5 aa, Mycobacterium
SLDRS

SEQ ID NO: 286169 - protein, 12 aa, Mycobacterium
SLEDRHSGPMRG

SEQ ID NO: 286170 - protein, 8 aa, Mycobacterium
SLEEQAQV

SEQ ID NO: 286171 - protein, 12 aa, Mycobacterium
SLEGRHSGPMRG

SEQ ID NO: 286172 - protein, 14 aa, Mycobacterium
SLEPGDRVHTTSGL

SEQ ID NO: 286173 - protein, 14 aa, Mycobacterium
SLEPGDRVHTTSGM

SEQ ID NO: 286174 - protein, 8 aa, Mycobacterium
SLEPPPGV

SEQ ID NO: 286175 - protein, 4 aa, Mycobacterium
SLGA

SEQ ID NO: 286176 - protein, 12 aa, Mycobacterium
SLGAGGKYAHAD

SEQ ID NO: 286177 - protein, 7 aa, Mycobacterium
SLGAPGG

SEQ ID NO: 286178 - protein, 8 aa, Mycobacterium
SLGAPPTT

SEQ ID NO: 286179 - protein, 16 aa, Mycobacterium
SLGAVDRPADRAADTV

SEQ ID NO: 286180 - protein, 9 aa, Mycobacterium
SLGDQSAQF

SEQ ID NO: 286181 - protein, 10 aa, Mycobacterium
SLGDQSSQFA

SEQ ID NO: 286182 - protein, 10 aa, Mycobacterium
SLGDSDSQVD

SEQ ID NO: 286183 - protein, 8 aa, Mycobacterium
SLGEPASA

SEQ ID NO: 286184 - protein, 7 aa, Mycobacterium
SLGEQTA

SEQ ID NO: 286185 - protein, 5 aa, Mycobacterium
SLGER

SEQ ID NO: 286186 - protein, 7 aa, Mycobacterium
SLGERGE

SEQ ID NO: 286187 - protein, 9 aa, Mycobacterium
SLGGPVGSG

SEQ ID NO: 286188 - protein, 9 aa, Mycobacterium
SLGGQSGQF

SEQ ID NO: 286189 - protein, 25 aa, Mycobacterium
SLGGRPGPGFAARDPKLSAAETAEH

SEQ ID NO: 286190 - protein, 6 aa, Mycobacterium
SLGGTA

SEQ ID NO: 286191 - protein, 7 aa, Mycobacterium
SLGRPPV

SEQ ID NO: 286192 - protein, 11 aa, Mycobacterium
SLGSSPKIPAD

SEQ ID NO: 286193 - protein, 13 aa, Mycobacterium
SLGTEARNGGAHS

SEQ ID NO: 286194 - protein, 9 aa, Mycobacterium
SLGTSTSSA

SEQ ID NO: 286195 - protein, 132 aa, Mycobacterium
SLHGGSGSEGAAGGNGDSAKSDKDKDKGPGASVPKPGSAGSTGKTADSAAGSAGSGTGTPGANSSAPGGSNGSSGGGIGGVGTTVGTTLPHSGGAAGVHTPTAEGAAATESSAGTGTHTEEHPSLKGALGSV

SEQ ID NO: 286196 - protein, 11 aa, Mycobacterium
SLKKSGEVSEP

SEQ ID NO: 286197 - protein, 13 aa, Mycobacterium
SLKPAPKTATGEG

SEQ ID NO: 286198 - protein, 8 aa, Mycobacterium
SLKPGDSV

SEQ ID NO: 286199 - protein, 20 aa, Mycobacterium
SLKPGSQANSDLISRARQST

SEQ ID NO: 286200 - protein, 12 aa, Mycobacterium
SLKREGEVSQPT

SEQ ID NO: 286201 - protein, 12 aa, Mycobacterium
SLKRRKGEKLPV

SEQ ID NO: 286202 - protein, 20 aa, Mycobacterium
SLKTAKQFATGTPLAPPNPF

SEQ ID NO: 286203 - protein, 12 aa, Mycobacterium
SLKTEGEVSEPT

SEQ ID NO: 286204 - protein, 6 aa, Mycobacterium
SLNDTD

SEQ ID NO: 286205 - protein, 10 aa, Mycobacterium
SLNDTRGHAV

SEQ ID NO: 286206 - protein, 4 aa, Mycobacterium
SLNG

SEQ ID NO: 286207 - protein, 5 aa, Mycobacterium
SLNPE

SEQ ID NO: 286208 - protein, 16 aa, Mycobacterium
SLNPTPAQQPNRGTGL

SEQ ID NO: 286209 - protein, 4 aa, Mycobacterium
SLNR

SEQ ID NO: 286210 - protein, 13 aa, Mycobacterium
SLNTAGGVVPPGL

SEQ ID NO: 286211 - protein, 9 aa, Mycobacterium
SLNTGGTRI

SEQ ID NO: 286212 - protein, 7 aa, Mycobacterium
SLNTGGV

SEQ ID NO: 286213 - protein, 28 aa, Mycobacterium
SLNTNNQLSRVEDDNLDAQAAGLPASPT

SEQ ID NO: 286214 - protein, 6 aa, Mycobacterium
SLPAAL

SEQ ID NO: 286215 - protein, 8 aa, Mycobacterium
SLPAAPAV

SEQ ID NO: 286216 - protein, 9 aa, Mycobacterium
SLPAPTARP

SEQ ID NO: 286217 - protein, 9 aa, Mycobacterium
SLPDATKAA

SEQ ID NO: 286218 - protein, 20 aa, Mycobacterium
SLPDPAGQPPRLASPAEALR

SEQ ID NO: 286219 - protein, 5 aa, Mycobacterium
SLPEA

SEQ ID NO: 286220 - protein, 13 aa, Mycobacterium
SLPEAVGSRMSRR

SEQ ID NO: 286221 - protein, 8 aa, Mycobacterium
SLPGAAGD

SEQ ID NO: 286222 - protein, 13 aa, Mycobacterium
SLPGRSEHPGGDA

SEQ ID NO: 286223 - protein, 9 aa, Mycobacterium
SLPKGQSEA

SEQ ID NO: 286224 - protein, 14 aa, Mycobacterium
SLPLTTSGKVRRAS

SEQ ID NO: 286225 - protein, 21 aa, Mycobacterium
SLPNGSGRPPADYGGDPTREP

SEQ ID NO: 286226 - protein, 6 aa, Mycobacterium
SLPNNH

SEQ ID NO: 286227 - protein, 12 aa, Mycobacterium
SLPPDKQGVASA

SEQ ID NO: 286228 - protein, 11 aa, Mycobacterium
SLPPEARRPAG

SEQ ID NO: 286229 - protein, 7 aa, Mycobacterium
SLPPEQA

SEQ ID NO: 286230 - protein, 6 aa, Mycobacterium
SLPPER

SEQ ID NO: 286231 - protein, 4 aa, Mycobacterium
SLPQ

SEQ ID NO: 286232 - protein, 15 aa, Mycobacterium
SLPSASNEMQPSYQD

SEQ ID NO: 286233 - protein, 7 aa, Mycobacterium
SLPSPGV

SEQ ID NO: 286234 - protein, 6 aa, Mycobacterium
SLPSTL

SEQ ID NO: 286235 - protein, 8 aa, Mycobacterium
SLPTPGQA

SEQ ID NO: 286236 - protein, 5 aa, Mycobacterium
SLPVP

SEQ ID NO: 286237 - protein, 4 aa, Mycobacterium
SLQG

SEQ ID NO: 286238 - protein, 13 aa, Mycobacterium
SLQGGDEAEHSTT

SEQ ID NO: 286239 - protein, 16 aa, Mycobacterium
SLQGNDPYEVGPATGL

SEQ ID NO: 286240 - protein, 4 aa, Mycobacterium
SLQP

SEQ ID NO: 286241 - protein, 6 aa, Mycobacterium
SLQPDR

SEQ ID NO: 286242 - protein, 8 aa, Mycobacterium
SLQPGANV

SEQ ID NO: 286243 - protein, 14 aa, Mycobacterium
SLQPGDRVHTTSGL

SEQ ID NO: 286244 - protein, 8 aa, Mycobacterium
SLQPLPKG

SEQ ID NO: 286245 - protein, 13 aa, Mycobacterium
SLQQTKEVQTVSQ

SEQ ID NO: 286246 - protein, 8 aa, Mycobacterium
SLRAGQPI

SEQ ID NO: 286247 - protein, 7 aa, Mycobacterium
SLRAGSL

SEQ ID NO: 286248 - protein, 14 aa, Mycobacterium
SLRAPGDTRPSLYT

SEQ ID NO: 286249 - protein, 10 aa, Mycobacterium
SLRDDAELRD

SEQ ID NO: 286250 - protein, 8 aa, Mycobacterium
SLRGAGAS

SEQ ID NO: 286251 - protein, 11 aa, Mycobacterium
SLRGTAKPAED

SEQ ID NO: 286252 - protein, 6 aa, Mycobacterium
SLRPDK

SEQ ID NO: 286253 - protein, 6 aa, Mycobacterium
SLRRRR

SEQ ID NO: 286254 - protein, 13 aa, Mycobacterium
SLRSAVQDSRRQL

SEQ ID NO: 286255 - protein, 6 aa, Mycobacterium
SLRSGE

SEQ ID NO: 286256 - protein, 12 aa, Mycobacterium
SLRSGKAGTDAL

SEQ ID NO: 286257 - protein, 6 aa, Mycobacterium
SLRSTR

SEQ ID NO: 286258 - protein, 10 aa, Mycobacterium
SLSDKPGPRW

SEQ ID NO: 286259 - protein, 9 aa, Mycobacterium
SLSDPEADV

SEQ ID NO: 286260 - protein, 9 aa, Mycobacterium
SLSDPVPGV

SEQ ID NO: 286261 - protein, 6 aa, Mycobacterium
SLSDRF

SEQ ID NO: 286262 - protein, 25 aa, Mycobacterium
SLSDTNPRLPDAPFPPADPRSEFDA

SEQ ID NO: 286263 - protein, 4 aa, Mycobacterium
SLSG

SEQ ID NO: 286264 - protein, 9 aa, Mycobacterium
SLSGGQRQR

SEQ ID NO: 286265 - protein, 11 aa, Mycobacterium
SLSGPSPLGPL

SEQ ID NO: 286266 - protein, 10 aa, Mycobacterium
SLSKEGPAKL

SEQ ID NO: 286267 - protein, 10 aa, Mycobacterium
SLSKEGPRKL

SEQ ID NO: 286268 - protein, 13 aa, Mycobacterium
SLSPAAADEQPNR

SEQ ID NO: 286269 - protein, 5 aa, Mycobacterium
SLSPD

SEQ ID NO: 286270 - protein, 11 aa, Mycobacterium
SLSPDGGPQTV

SEQ ID NO: 286271 - protein, 10 aa, Mycobacterium
SLSPERRRDD

SEQ ID NO: 286272 - protein, 14 aa, Mycobacterium
SLSPGDRVHTTSGL

SEQ ID NO: 286273 - protein, 16 aa, Mycobacterium
SLSPGGFQDPDSESAR

SEQ ID NO: 286274 - protein, 15 aa, Mycobacterium
SLSPGGFQDPHSESA

SEQ ID NO: 286275 - protein, 16 aa, Mycobacterium
SLSPGGFQDPNAESAR

SEQ ID NO: 286276 - protein, 16 aa, Mycobacterium
SLSPGGFQDPNSESAR

SEQ ID NO: 286277 - protein, 11 aa, Mycobacterium
SLSPPDAPSVK

SEQ ID NO: 286278 - protein, 11 aa, Mycobacterium
SLSPPDAPSVQ

SEQ ID NO: 286279 - protein, 10 aa, Mycobacterium
SLSPQSAPSM

SEQ ID NO: 286280 - protein, 8 aa, Mycobacterium
SLSPSDAE

SEQ ID NO: 286281 - protein, 9 aa, Mycobacterium
SLSPSDAPS

SEQ ID NO: 286282 - protein, 17 aa, Mycobacterium
SLSPSGFSDPGSQSAHA

SEQ ID NO: 286283 - protein, 9 aa, Mycobacterium
SLSPTDAPS

SEQ ID NO: 286284 - protein, 10 aa, Mycobacterium
SLSQAAKEAG

SEQ ID NO: 286285 - protein, 5 aa, Mycobacterium
SLSRA

SEQ ID NO: 286286 - protein, 12 aa, Mycobacterium
SLSRAPRVVAKS

SEQ ID NO: 286287 - protein, 10 aa, Mycobacterium
SLSSQPGAAY

SEQ ID NO: 286288 - protein, 8 aa, Mycobacterium
SLSSSGGS

SEQ ID NO: 286289 - protein, 7 aa, Mycobacterium
SLSSSQA

SEQ ID NO: 286290 - protein, 5 aa, Mycobacterium
SLSSY

SEQ ID NO: 286291 - protein, 11 aa, Mycobacterium
SLSTTLPGGPV

SEQ ID NO: 286292 - protein, 5 aa, Mycobacterium
SLTAQ

SEQ ID NO: 286293 - protein, 9 aa, Mycobacterium
SLTAQSDTS

SEQ ID NO: 286294 - protein, 5 aa, Mycobacterium
SLTAT

SEQ ID NO: 286295 - protein, 8 aa, Mycobacterium
SLTDADAD

SEQ ID NO: 286296 - protein, 5 aa, Mycobacterium
SLTEG

SEQ ID NO: 286297 - protein, 8 aa, Mycobacterium
SLTERTPH

SEQ ID NO: 286298 - protein, 4 aa, Mycobacterium
SLTG

SEQ ID NO: 286299 - protein, 6 aa, Mycobacterium
SLTGAA

SEQ ID NO: 286300 - protein, 10 aa, Mycobacterium
SLTGDTQYRQ

SEQ ID NO: 286301 - protein, 9 aa, Mycobacterium
SLTGPTSAI

SEQ ID NO: 286302 - protein, 10 aa, Mycobacterium
SLTGRLGTAP

SEQ ID NO: 286303 - protein, 9 aa, Mycobacterium
SLTPAGAQQ

SEQ ID NO: 286304 - protein, 7 aa, Mycobacterium
SLTPATR

SEQ ID NO: 286305 - protein, 5 aa, Mycobacterium
SLTPG

SEQ ID NO: 286306 - protein, 7 aa, Mycobacterium
SLTPPDD

SEQ ID NO: 286307 - protein, 25 aa, Mycobacterium
SLTPTDRQAVPVQTDTQLAQNAQES

SEQ ID NO: 286308 - protein, 66 aa, Mycobacterium
SLTPTERIRSGRASGRRGGGYGGSDVDELDRYGDSDTDALPPYRDYRPGDHDAHDAYDSDDYTDVE

SEQ ID NO: 286309 - protein, 18 aa, Mycobacterium
SLTSAAGKLSDQLNRGAG

SEQ ID NO: 286310 - protein, 5 aa, Mycobacterium
SLTSS

SEQ ID NO: 286311 - protein, 10 aa, Mycobacterium
SLTVSQPDCQ

SEQ ID NO: 286312 - protein, 7 aa, Mycobacterium
SMAAAGA

SEQ ID NO: 286313 - protein, 14 aa, Mycobacterium
SMDPANGSGSSIGG

SEQ ID NO: 286314 - protein, 14 aa, Mycobacterium
SMDPEKTGSGASIG

SEQ ID NO: 286315 - protein, 13 aa, Mycobacterium
SMDPENGSGAELG

SEQ ID NO: 286316 - protein, 12 aa, Mycobacterium
SMDPRHGSGASI

SEQ ID NO: 286317 - protein, 4 aa, Mycobacterium
SMEG

SEQ ID NO: 286318 - protein, 5 aa, Mycobacterium
SMENA

SEQ ID NO: 286319 - protein, 22 aa, Mycobacterium
SMGAPTAGIRSGSGCARRTLDV

SEQ ID NO: 286320 - protein, 4 aa, Mycobacterium
SMGM

SEQ ID NO: 286321 - protein, 8 aa, Mycobacterium
SMHASDPA

SEQ ID NO: 286322 - protein, 8 aa, Mycobacterium
SMKSQRDN

SEQ ID NO: 286323 - protein, 4 aa, Mycobacterium
SMLG

SEQ ID NO: 286324 - protein, 7 aa, Mycobacterium
SMNDPEA

SEQ ID NO: 286325 - protein, 9 aa, Mycobacterium
SMPAPATRA

SEQ ID NO: 286326 - protein, 28 aa, Mycobacterium
SMPGAPSPAPNRARSAHGSVDATPATPV

SEQ ID NO: 286327 - protein, 5 aa, Mycobacterium
SMPGS

SEQ ID NO: 286328 - protein, 4 aa, Mycobacterium
SMPM

SEQ ID NO: 286329 - protein, 12 aa, Mycobacterium
SMPSEGKSTTAI

SEQ ID NO: 286330 - protein, 14 aa, Mycobacterium
SMPSNVGDAAAGRH

SEQ ID NO: 286331 - protein, 8 aa, Mycobacterium
SMPSRPDG

SEQ ID NO: 286332 - protein, 21 aa, Mycobacterium
SMRATDVAPNRLTAAQEAAKQ

SEQ ID NO: 286333 - protein, 10 aa, Mycobacterium
SMRATDVAPS

SEQ ID NO: 286334 - protein, 10 aa, Mycobacterium
SMRATDVEPN

SEQ ID NO: 286335 - protein, 10 aa, Mycobacterium
SMRDDAELRD

SEQ ID NO: 286336 - protein, 6 aa, Mycobacterium
SMRDNK

SEQ ID NO: 286337 - protein, 13 aa, Mycobacterium
SMRGEDTKVSDGV

SEQ ID NO: 286338 - protein, 4 aa, Mycobacterium
SMRK

SEQ ID NO: 286339 - protein, 6 aa, Mycobacterium
SMSDPT

SEQ ID NO: 286340 - protein, 8 aa, Mycobacterium
SMSEQNGA

SEQ ID NO: 286341 - protein, 8 aa, Mycobacterium
SMSPDDAP

SEQ ID NO: 286342 - protein, 10 aa, Mycobacterium
SMSPKDAPSM

SEQ ID NO: 286343 - protein, 9 aa, Mycobacterium
SMSPNDAPS

SEQ ID NO: 286344 - protein, 5 aa, Mycobacterium
SMSQS

SEQ ID NO: 286345 - protein, 7 aa, Mycobacterium
SMTNATN

SEQ ID NO: 286346 - protein, 13 aa, Mycobacterium
SNAAEEMVNPQKD

SEQ ID NO: 286347 - protein, 6 aa, Mycobacterium
SNAAGT

SEQ ID NO: 286348 - protein, 10 aa, Mycobacterium
SNAAHSPGVG

SEQ ID NO: 286349 - protein, 5 aa, Mycobacterium
SNAAL

SEQ ID NO: 286350 - protein, 11 aa, Mycobacterium
SNAANASSAEI

SEQ ID NO: 286351 - protein, 12 aa, Mycobacterium
SNAANASSAEIT

SEQ ID NO: 286352 - protein, 5 aa, Mycobacterium
SNAAV

SEQ ID NO: 286353 - protein, 19 aa, Mycobacterium
SNADGGGLANGLPNQRQQL

SEQ ID NO: 286354 - protein, 8 aa, Mycobacterium
SNADGSMS

SEQ ID NO: 286355 - protein, 13 aa, Mycobacterium
SNADNNGEQRIPK

SEQ ID NO: 286356 - protein, 5 aa, Mycobacterium
SNAGQ

SEQ ID NO: 286357 - protein, 6 aa, Mycobacterium
SNAGRS

SEQ ID NO: 286358 - protein, 6 aa, Mycobacterium
SNAGTV

SEQ ID NO: 286359 - protein, 6 aa, Mycobacterium
SNAGYG

SEQ ID NO: 286360 - protein, 8 aa, Mycobacterium
SNAKTRAL

SEQ ID NO: 286361 - protein, 4 aa, Mycobacterium
SNAN

SEQ ID NO: 286362 - protein, 17 aa, Mycobacterium
SNAPDGGLSNALPSERD

SEQ ID NO: 286363 - protein, 6 aa, Mycobacterium
SNAQYQ

SEQ ID NO: 286364 - protein, 9 aa, Mycobacterium
SNASGLRPG

SEQ ID NO: 286365 - protein, 19 aa, Mycobacterium
SNATTQSGLAATATSQLKR

SEQ ID NO: 286366 - protein, 19 aa, Mycobacterium
SNATTQTGLAATATTQLKR

SEQ ID NO: 286367 - protein, 13 aa, Mycobacterium
SNAVRPDGRVDRS

SEQ ID NO: 286368 - protein, 5 aa, Mycobacterium
SNAYG

SEQ ID NO: 286369 - protein, 5 aa, Mycobacterium
SNAYS

SEQ ID NO: 286370 - protein, 7 aa, Mycobacterium
SNDEAVQ

SEQ ID NO: 286371 - protein, 9 aa, Mycobacterium
SNDGPDIDP

SEQ ID NO: 286372 - protein, 4 aa, Mycobacterium
SNDI

SEQ ID NO: 286373 - protein, 8 aa, Mycobacterium
SNDNDPVA

SEQ ID NO: 286374 - protein, 5 aa, Mycobacterium
SNDNL

SEQ ID NO: 286375 - protein, 10 aa, Mycobacterium
SNDNLQDLKT

SEQ ID NO: 286376 - protein, 5 aa, Mycobacterium
SNDPQ

SEQ ID NO: 286377 - protein, 12 aa, Mycobacterium
SNDQDQNQETGY

SEQ ID NO: 286378 - protein, 4 aa, Mycobacterium
SNEE

SEQ ID NO: 286379 - protein, 9 aa, Mycobacterium
SNEPGIPDD

SEQ ID NO: 286380 - protein, 8 aa, Mycobacterium
SNGAPAEL

SEQ ID NO: 286381 - protein, 8 aa, Mycobacterium
SNGAPEQL

SEQ ID NO: 286382 - protein, 8 aa, Mycobacterium
SNGAPGQL

SEQ ID NO: 286383 - protein, 8 aa, Mycobacterium
SNGATDAA

SEQ ID NO: 286384 - protein, 4 aa, Mycobacterium
SNGE

SEQ ID NO: 286385 - protein, 8 aa, Mycobacterium
SNGKTIDA

SEQ ID NO: 286386 - protein, 19 aa, Mycobacterium
SNGTGTTGLAATAASQLER

SEQ ID NO: 286387 - protein, 19 aa, Mycobacterium
SNGTSTAGLATTAANQLKR

SEQ ID NO: 286388 - protein, 7 aa, Mycobacterium
SNGVTSS

SEQ ID NO: 286389 - protein, 4 aa, Mycobacterium
SNHA

SEQ ID NO: 286390 - protein, 4 aa, Mycobacterium
SNHQ

SEQ ID NO: 286391 - protein, 7 aa, Mycobacterium
SNIGDRD

SEQ ID NO: 286392 - protein, 7 aa, Mycobacterium
SNIGGTA

SEQ ID NO: 286393 - protein, 8 aa, Mycobacterium
SNIGGTAT

SEQ ID NO: 286394 - protein, 4 aa, Mycobacterium
SNIS

SEQ ID NO: 286395 - protein, 5 aa, Mycobacterium
SNKDW

SEQ ID NO: 286396 - protein, 7 aa, Mycobacterium
SNKGLPE

SEQ ID NO: 286397 - protein, 12 aa, Mycobacterium
SNKLDRNVGQSA

SEQ ID NO: 286398 - protein, 7 aa, Mycobacterium
SNKPVNI

SEQ ID NO: 286399 - protein, 6 aa, Mycobacterium
SNLDPL

SEQ ID NO: 286400 - protein, 6 aa, Mycobacterium
SNLGGP

SEQ ID NO: 286401 - protein, 7 aa, Mycobacterium
SNLGGPL

SEQ ID NO: 286402 - protein, 7 aa, Mycobacterium
SNLPEGE

SEQ ID NO: 286403 - protein, 7 aa, Mycobacterium
SNLPGAP

SEQ ID NO: 286404 - protein, 4 aa, Mycobacterium
SNLR

SEQ ID NO: 286405 - protein, 8 aa, Mycobacterium
SNLSDTPT

SEQ ID NO: 286406 - protein, 5 aa, Mycobacterium
SNLTD

SEQ ID NO: 286407 - protein, 6 aa, Mycobacterium
SNLTPR

SEQ ID NO: 286408 - protein, 7 aa, Mycobacterium
SNNATFD

SEQ ID NO: 286409 - protein, 7 aa, Mycobacterium
SNNATFN

SEQ ID NO: 286410 - protein, 8 aa, Mycobacterium
SNPAARQQ

SEQ ID NO: 286411 - protein, 6 aa, Mycobacterium
SNPALR

SEQ ID NO: 286412 - protein, 7 aa, Mycobacterium
SNPALRG

SEQ ID NO: 286413 - protein, 10 aa, Mycobacterium
SNPALSSNAE

SEQ ID NO: 286414 - protein, 8 aa, Mycobacterium
SNPANGVK

SEQ ID NO: 286415 - protein, 5 aa, Mycobacterium
SNPDA

SEQ ID NO: 286416 - protein, 9 aa, Mycobacterium
SNPDAIARS

SEQ ID NO: 286417 - protein, 6 aa, Mycobacterium
SNPDCQ

SEQ ID NO: 286418 - protein, 8 aa, Mycobacterium
SNPDGSMA

SEQ ID NO: 286419 - protein, 8 aa, Mycobacterium
SNPDGSMS

SEQ ID NO: 286420 - protein, 14 aa, Mycobacterium
SNPETRAPVQERQA

SEQ ID NO: 286421 - protein, 23 aa, Mycobacterium
SNPIADGRFSGESPGRGRAGVRR

SEQ ID NO: 286422 - protein, 7 aa, Mycobacterium
SNPRERW

SEQ ID NO: 286423 - protein, 9 aa, Mycobacterium
SNPRQAGAA

SEQ ID NO: 286424 - protein, 13 aa, Mycobacterium
SNPTGLSVDSSRT

SEQ ID NO: 286425 - protein, 21 aa, Mycobacterium
SNPWRGPPAPYDTPVEDPRNI

SEQ ID NO: 286426 - protein, 21 aa, Mycobacterium
SNPWRGPPVPVGTPVQDGRNI

SEQ ID NO: 286427 - protein, 18 aa, Mycobacterium
SNPWRGPPVPYGQPIEDG

SEQ ID NO: 286428 - protein, 8 aa, Mycobacterium
SNQAGAGL

SEQ ID NO: 286429 - protein, 12 aa, Mycobacterium
SNQAQATAPTAV

SEQ ID NO: 286430 - protein, 8 aa, Mycobacterium
SNQGPPEL

SEQ ID NO: 286431 - protein, 8 aa, Mycobacterium
SNQKYQPE

SEQ ID NO: 286432 - protein, 8 aa, Mycobacterium
SNQKYQPQ

SEQ ID NO: 286433 - protein, 6 aa, Mycobacterium
SNQLGE

SEQ ID NO: 286434 - protein, 8 aa, Mycobacterium
SNRAHGKT

SEQ ID NO: 286435 - protein, 8 aa, Mycobacterium
SNRAQWDE

SEQ ID NO: 286436 - protein, 5 aa, Mycobacterium
SNRIS

SEQ ID NO: 286437 - protein, 8 aa, Mycobacterium
SNRITGAD

SEQ ID NO: 286438 - protein, 4 aa, Mycobacterium
SNRQ

SEQ ID NO: 286439 - protein, 4 aa, Mycobacterium
SNRR

SEQ ID NO: 286440 - protein, 5 aa, Mycobacterium
SNRRR

SEQ ID NO: 286441 - protein, 10 aa, Mycobacterium
SNRSHRAAGR

SEQ ID NO: 286442 - protein, 7 aa, Mycobacterium
SNRSRRG

SEQ ID NO: 286443 - protein, 42 aa, Mycobacterium
SNRSTVTAAGDPDATAHAPATPTGPRHAKPAAPTAQASASRG

SEQ ID NO: 286444 - protein, 7 aa, Mycobacterium
SNRTRRG

SEQ ID NO: 286445 - protein, 8 aa, Mycobacterium
SNSAHAGE

SEQ ID NO: 286446 - protein, 14 aa, Mycobacterium
SNSAPTGKLTDSPV

SEQ ID NO: 286447 - protein, 16 aa, Mycobacterium
SNSDAGGLANGLPNDH

SEQ ID NO: 286448 - protein, 9 aa, Mycobacterium
SNSGGDANY

SEQ ID NO: 286449 - protein, 18 aa, Mycobacterium
SNSGGKGAKTSEINEDRK

SEQ ID NO: 286450 - protein, 7 aa, Mycobacterium
SNSGTFQ

SEQ ID NO: 286451 - protein, 5 aa, Mycobacterium
SNSIL

SEQ ID NO: 286452 - protein, 25 aa, Mycobacterium
SNSPDGPGQIPGTPTHAGTGQATAT

SEQ ID NO: 286453 - protein, 9 aa, Mycobacterium
SNSPIEDSL

SEQ ID NO: 286454 - protein, 7 aa, Mycobacterium
SNSSGGV

SEQ ID NO: 286455 - protein, 10 aa, Mycobacterium
SNSSVFTGGP

SEQ ID NO: 286456 - protein, 19 aa, Mycobacterium
SNSTGQSGLAATAAGELEQ

SEQ ID NO: 286457 - protein, 18 aa, Mycobacterium
SNSTGQSGLGATASTALQ

SEQ ID NO: 286458 - protein, 19 aa, Mycobacterium
SNSTGQTGLAASAASQLSN

SEQ ID NO: 286459 - protein, 12 aa, Mycobacterium
SNSTTVKQGIAP

SEQ ID NO: 286460 - protein, 9 aa, Mycobacterium
SNSVASGAQ

SEQ ID NO: 286461 - protein, 6 aa, Mycobacterium
SNTATA

SEQ ID NO: 286462 - protein, 9 aa, Mycobacterium
SNTDSGTGF

SEQ ID NO: 286463 - protein, 11 aa, Mycobacterium
SNTFTTDPANL

SEQ ID NO: 286464 - protein, 8 aa, Mycobacterium
SNTIGSKS

SEQ ID NO: 286465 - protein, 6 aa, Mycobacterium
SNTPAD

SEQ ID NO: 286466 - protein, 8 aa, Mycobacterium
SNTSGYPD

SEQ ID NO: 286467 - protein, 10 aa, Mycobacterium
SNTSIPENVT

SEQ ID NO: 286468 - protein, 6 aa, Mycobacterium
SNTVVT

SEQ ID NO: 286469 - protein, 23 aa, Mycobacterium
SNVSDPGSQPPRVASPAEALRGR

SEQ ID NO: 286470 - protein, 6 aa, Mycobacterium
SNVTVG

SEQ ID NO: 286471 - protein, 11 aa, Mycobacterium
SNVTYRGETIG

SEQ ID NO: 286472 - protein, 6 aa, Mycobacterium
SNYPGD

SEQ ID NO: 286473 - protein, 4 aa, Mycobacterium
SPAA

SEQ ID NO: 286474 - protein, 11 aa, Mycobacterium
SPAAASPAADE

SEQ ID NO: 286475 - protein, 20 aa, Mycobacterium
SPAADPSTSVRGNRVNGPQA

SEQ ID NO: 286476 - protein, 11 aa, Mycobacterium
SPAAGELQGPL

SEQ ID NO: 286477 - protein, 8 aa, Mycobacterium
SPAAPVRE

SEQ ID NO: 286478 - protein, 8 aa, Mycobacterium
SPAAQTWT

SEQ ID NO: 286479 - protein, 10 aa, Mycobacterium
SPAARRHPVE

SEQ ID NO: 286480 - protein, 10 aa, Mycobacterium
SPAASVSTRA

SEQ ID NO: 286481 - protein, 6 aa, Mycobacterium
SPAATA

SEQ ID NO: 286482 - protein, 27 aa, Mycobacterium
SPAATAAREKAARAQPDPDDDHSPGGE

SEQ ID NO: 286483 - protein, 9 aa, Mycobacterium
SPADEGLRE

SEQ ID NO: 286484 - protein, 8 aa, Mycobacterium
SPADETLR

SEQ ID NO: 286485 - protein, 6 aa, Mycobacterium
SPADPE

SEQ ID NO: 286486 - protein, 6 aa, Mycobacterium
SPADTA

SEQ ID NO: 286487 - protein, 4 aa, Mycobacterium
SPAE

SEQ ID NO: 286488 - protein, 9 aa, Mycobacterium
SPAEAARTP

SEQ ID NO: 286489 - protein, 8 aa, Mycobacterium
SPAERRGL

SEQ ID NO: 286490 - protein, 6 aa, Mycobacterium
SPAFTP

SEQ ID NO: 286491 - protein, 6 aa, Mycobacterium
SPAGAA

SEQ ID NO: 286492 - protein, 8 aa, Mycobacterium
SPAGPAGA

SEQ ID NO: 286493 - protein, 15 aa, Mycobacterium
SPAGQASSLESIGRS

SEQ ID NO: 286494 - protein, 8 aa, Mycobacterium
SPAGVSVT

SEQ ID NO: 286495 - protein, 33 aa, Mycobacterium
SPAHAELTAKPQASGVRPLQPAPRMEPDPRSEV

SEQ ID NO: 286496 - protein, 8 aa, Mycobacterium
SPALREDR

SEQ ID NO: 286497 - protein, 4 aa, Mycobacterium
SPAM

SEQ ID NO: 286498 - protein, 4 aa, Mycobacterium
SPAN

SEQ ID NO: 286499 - protein, 21 aa, Mycobacterium
SPANAEPVEQQADRAQRERST

SEQ ID NO: 286500 - protein, 8 aa, Mycobacterium
SPANGTLT

SEQ ID NO: 286501 - protein, 8 aa, Mycobacterium
SPANTVRG

SEQ ID NO: 286502 - protein, 28 aa, Mycobacterium
SPAPAIATTPQPETEVRNAESDLAAHSE

SEQ ID NO: 286503 - protein, 8 aa, Mycobacterium
SPAPEVPE

SEQ ID NO: 286504 - protein, 5 aa, Mycobacterium
SPAPI

SEQ ID NO: 286505 - protein, 10 aa, Mycobacterium
SPAPIREPAA

SEQ ID NO: 286506 - protein, 8 aa, Mycobacterium
SPAPRPSI

SEQ ID NO: 286507 - protein, 7 aa, Mycobacterium
SPAPSGV

SEQ ID NO: 286508 - protein, 16 aa, Mycobacterium
SPAPVPAELTATVPSD

SEQ ID NO: 286509 - protein, 8 aa, Mycobacterium
SPARRSQE

SEQ ID NO: 286510 - protein, 5 aa, Mycobacterium
SPATL

SEQ ID NO: 286511 - protein, 4 aa, Mycobacterium
SPAV

SEQ ID NO: 286512 - protein, 4 aa, Mycobacterium
SPAY

SEQ ID NO: 286513 - protein, 4 aa, Mycobacterium
SPDA

SEQ ID NO: 286514 - protein, 5 aa, Mycobacterium
SPDAA

SEQ ID NO: 286515 - protein, 9 aa, Mycobacterium
SPDAAKEAL

SEQ ID NO: 286516 - protein, 13 aa, Mycobacterium
SPDAISSTAYGPE

SEQ ID NO: 286517 - protein, 102 aa, Mycobacterium
SPDASSGYEYPSLEKSAPPADPAVAANPTPSPPPAWEAPGQPTASYPAYPASAYPTAPPAYPTAPPPYPTASQAAYPQYGQSYPSYQPGQPGTYPPPGYPVA

SEQ ID NO: 286518 - protein, 7 aa, Mycobacterium
SPDDAPA

SEQ ID NO: 286519 - protein, 13 aa, Mycobacterium
SPDDSAPEADPAP

SEQ ID NO: 286520 - protein, 4 aa, Mycobacterium
SPDE

SEQ ID NO: 286521 - protein, 10 aa, Mycobacterium
SPDEEEKGID

SEQ ID NO: 286522 - protein, 4 aa, Mycobacterium
SPDG

SEQ ID NO: 286523 - protein, 10 aa, Mycobacterium
SPDGDRLPPW

SEQ ID NO: 286524 - protein, 6 aa, Mycobacterium
SPDGHS

SEQ ID NO: 286525 - protein, 6 aa, Mycobacterium
SPDGHT

SEQ ID NO: 286526 - protein, 15 aa, Mycobacterium
SPDGHTLASGGENGN

SEQ ID NO: 286527 - protein, 15 aa, Mycobacterium
SPDGHTLASGSDDGT

SEQ ID NO: 286528 - protein, 15 aa, Mycobacterium
SPDGHTLASGSDDTT

SEQ ID NO: 286529 - protein, 15 aa, Mycobacterium
SPDGHTLASGSHDGT

SEQ ID NO: 286530 - protein, 15 aa, Mycobacterium
SPDGHTLASGSSDHT

SEQ ID NO: 286531 - protein, 9 aa, Mycobacterium
SPDGIDDPR

SEQ ID NO: 286532 - protein, 8 aa, Mycobacterium
SPDGKRIA

SEQ ID NO: 286533 - protein, 7 aa, Mycobacterium
SPDGKSA

SEQ ID NO: 286534 - protein, 6 aa, Mycobacterium
SPDGKT

SEQ ID NO: 286535 - protein, 7 aa, Mycobacterium
SPDGKTA

SEQ ID NO: 286536 - protein, 5 aa, Mycobacterium
SPDGR

SEQ ID NO: 286537 - protein, 6 aa, Mycobacterium
SPDGRA

SEQ ID NO: 286538 - protein, 6 aa, Mycobacterium
SPDGRR

SEQ ID NO: 286539 - protein, 15 aa, Mycobacterium
SPDGRRIVSGSADST

SEQ ID NO: 286540 - protein, 15 aa, Mycobacterium
SPDGRRIVSGSDDKT

SEQ ID NO: 286541 - protein, 9 aa, Mycobacterium
SPDGSAHDP

SEQ ID NO: 286542 - protein, 10 aa, Mycobacterium
SPDGSAHDPD

SEQ ID NO: 286543 - protein, 7 aa, Mycobacterium
SPDGTAA

SEQ ID NO: 286544 - protein, 10 aa, Mycobacterium
SPDGTPIGPG

SEQ ID NO: 286545 - protein, 16 aa, Mycobacterium
SPDGTRIASANSDGTI

SEQ ID NO: 286546 - protein, 15 aa, Mycobacterium
SPDGTRIASGGQDKT

SEQ ID NO: 286547 - protein, 7 aa, Mycobacterium
SPDGTRL

SEQ ID NO: 286548 - protein, 10 aa, Mycobacterium
SPDGVDAGRT

SEQ ID NO: 286549 - protein, 4 aa, Mycobacterium
SPDI

SEQ ID NO: 286550 - protein, 10 aa, Mycobacterium
SPDKARAALT

SEQ ID NO: 286551 - protein, 8 aa, Mycobacterium
SPDKASAA

SEQ ID NO: 286552 - protein, 6 aa, Mycobacterium
SPDLAP

SEQ ID NO: 286553 - protein, 5 aa, Mycobacterium
SPDLE

SEQ ID NO: 286554 - protein, 8 aa, Mycobacterium
SPDLEGSD

SEQ ID NO: 286555 - protein, 17 aa, Mycobacterium
SPDLSRAKAGAEAQGKT

SEQ ID NO: 286556 - protein, 7 aa, Mycobacterium
SPDNKSA

SEQ ID NO: 286557 - protein, 8 aa, Mycobacterium
SPDNLTRD

SEQ ID NO: 286558 - protein, 8 aa, Mycobacterium
SPDPKVSA

SEQ ID NO: 286559 - protein, 7 aa, Mycobacterium
SPDPRVG

SEQ ID NO: 286560 - protein, 7 aa, Mycobacterium
SPDPRYG

SEQ ID NO: 286561 - protein, 9 aa, Mycobacterium
SPDPSGGPE

SEQ ID NO: 286562 - protein, 14 aa, Mycobacterium
SPDPTAKAAASEAG

SEQ ID NO: 286563 - protein, 7 aa, Mycobacterium
SPDRASL

SEQ ID NO: 286564 - protein, 8 aa, Mycobacterium
SPDSIDKN

SEQ ID NO: 286565 - protein, 16 aa, Mycobacterium
SPDSLDKDFATAKSHL

SEQ ID NO: 286566 - protein, 8 aa, Mycobacterium
SPDSLSRD

SEQ ID NO: 286567 - protein, 8 aa, Mycobacterium
SPDSPWNR

SEQ ID NO: 286568 - protein, 6 aa, Mycobacterium
SPDTAA

SEQ ID NO: 286569 - protein, 18 aa, Mycobacterium
SPDTDTRDTAGEGSCHQP

SEQ ID NO: 286570 - protein, 8 aa, Mycobacterium
SPDTLDDD

SEQ ID NO: 286571 - protein, 8 aa, Mycobacterium
SPDTLDRD

SEQ ID NO: 286572 - protein, 17 aa, Mycobacterium
SPDTLDRDFSSAKSHLT

SEQ ID NO: 286573 - protein, 16 aa, Mycobacterium
SPDTLERDFSSARSHL

SEQ ID NO: 286574 - protein, 6 aa, Mycobacterium
SPDYGR

SEQ ID NO: 286575 - protein, 7 aa, Mycobacterium
SPDYPGV

SEQ ID NO: 286576 - protein, 10 aa, Mycobacterium
SPDYQIDRND

SEQ ID NO: 286577 - protein, 8 aa, Mycobacterium
SPEAGTRA

SEQ ID NO: 286578 - protein, 7 aa, Mycobacterium
SPEDEEM

SEQ ID NO: 286579 - protein, 10 aa, Mycobacterium
SPEEPGRQVS

SEQ ID NO: 286580 - protein, 13 aa, Mycobacterium
SPEEPPEDGDAVP

SEQ ID NO: 286581 - protein, 5 aa, Mycobacterium
SPEFQ

SEQ ID NO: 286582 - protein, 13 aa, Mycobacterium
SPEGEADAPDAAS

SEQ ID NO: 286583 - protein, 13 aa, Mycobacterium
SPEGEADNPGQAE

SEQ ID NO: 286584 - protein, 7 aa, Mycobacterium
SPEGLES

SEQ ID NO: 286585 - protein, 12 aa, Mycobacterium
SPEGQASSLESI

SEQ ID NO: 286586 - protein, 5 aa, Mycobacterium
SPELA

SEQ ID NO: 286587 - protein, 9 aa, Mycobacterium
SPELGTSPY

SEQ ID NO: 286588 - protein, 9 aa, Mycobacterium
SPELSGVNN

SEQ ID NO: 286589 - protein, 12 aa, Mycobacterium
SPELSTGPDRAA

SEQ ID NO: 286590 - protein, 6 aa, Mycobacterium
SPENLG

SEQ ID NO: 286591 - protein, 6 aa, Mycobacterium
SPEPLA

SEQ ID NO: 286592 - protein, 7 aa, Mycobacterium
SPEPRYG

SEQ ID NO: 286593 - protein, 15 aa, Mycobacterium
SPEQARGDSVDARSD

SEQ ID NO: 286594 - protein, 6 aa, Mycobacterium
SPEQKA

SEQ ID NO: 286595 - protein, 16 aa, Mycobacterium
SPEQQPGYPPPFPPPY

SEQ ID NO: 286596 - protein, 7 aa, Mycobacterium
SPEQRSR

SEQ ID NO: 286597 - protein, 16 aa, Mycobacterium
SPEQVRDGNAGPRSDV

SEQ ID NO: 286598 - protein, 8 aa, Mycobacterium
SPERTQAP

SEQ ID NO: 286599 - protein, 18 aa, Mycobacterium
SPESLDQDFANAKSKLTG

SEQ ID NO: 286600 - protein, 8 aa, Mycobacterium
SPESPWNQ

SEQ ID NO: 286601 - protein, 5 aa, Mycobacterium
SPESY

SEQ ID NO: 286602 - protein, 8 aa, Mycobacterium
SPETGANV

SEQ ID NO: 286603 - protein, 15 aa, Mycobacterium
SPETRGRDLVQLEDA

SEQ ID NO: 286604 - protein, 4 aa, Mycobacterium
SPEV

SEQ ID NO: 286605 - protein, 5 aa, Mycobacterium
SPEVQ

SEQ ID NO: 286606 - protein, 14 aa, Mycobacterium
SPEVQSAAGTPSEI

SEQ ID NO: 286607 - protein, 14 aa, Mycobacterium
SPEVQSALGTPSDI

SEQ ID NO: 286608 - protein, 11 aa, Mycobacterium
SPFAEDPSTLE

SEQ ID NO: 286609 - protein, 9 aa, Mycobacterium
SPGAAAGTV

SEQ ID NO: 286610 - protein, 5 aa, Mycobacterium
SPGAF

SEQ ID NO: 286611 - protein, 7 aa, Mycobacterium
SPGAGAI

SEQ ID NO: 286612 - protein, 6 aa, Mycobacterium
SPGASV

SEQ ID NO: 286613 - protein, 5 aa, Mycobacterium
SPGAT

SEQ ID NO: 286614 - protein, 30 aa, Mycobacterium
SPGATDRIPATGGRTETQGHPEPGNPGKTQ

SEQ ID NO: 286615 - protein, 10 aa, Mycobacterium
SPGDPAAPLR

SEQ ID NO: 286616 - protein, 10 aa, Mycobacterium
SPGDPSGKTL

SEQ ID NO: 286617 - protein, 9 aa, Mycobacterium
SPGDTIAGQ

SEQ ID NO: 286618 - protein, 17 aa, Mycobacterium
SPGDVDETAVTTADRGL

SEQ ID NO: 286619 - protein, 13 aa, Mycobacterium
SPGEDARADRFPQ

SEQ ID NO: 286620 - protein, 4 aa, Mycobacterium
SPGF

SEQ ID NO: 286621 - protein, 4 aa, Mycobacterium
SPGG

SEQ ID NO: 286622 - protein, 10 aa, Mycobacterium
SPGGGRESTV

SEQ ID NO: 286623 - protein, 10 aa, Mycobacterium
SPGGNAYNKG

SEQ ID NO: 286624 - protein, 5 aa, Mycobacterium
SPGGS

SEQ ID NO: 286625 - protein, 15 aa, Mycobacterium
SPGGVNSEAARSVGT

SEQ ID NO: 286626 - protein, 4 aa, Mycobacterium
SPGL

SEQ ID NO: 286627 - protein, 6 aa, Mycobacterium
SPGLGD

SEQ ID NO: 286628 - protein, 7 aa, Mycobacterium
SPGLPGS

SEQ ID NO: 286629 - protein, 7 aa, Mycobacterium
SPGLQRR

SEQ ID NO: 286630 - protein, 13 aa, Mycobacterium
SPGMAGDGTKVTY

SEQ ID NO: 286631 - protein, 11 aa, Mycobacterium
SPGMGADATRV

SEQ ID NO: 286632 - protein, 6 aa, Mycobacterium
SPGNGG

SEQ ID NO: 286633 - protein, 4 aa, Mycobacterium
SPGP

SEQ ID NO: 286634 - protein, 7 aa, Mycobacterium
SPGPGGA

SEQ ID NO: 286635 - protein, 5 aa, Mycobacterium
SPGPL

SEQ ID NO: 286636 - protein, 11 aa, Mycobacterium
SPGPQSPRDSH

SEQ ID NO: 286637 - protein, 6 aa, Mycobacterium
SPGPRV

SEQ ID NO: 286638 - protein, 4 aa, Mycobacterium
SPGQ

SEQ ID NO: 286639 - protein, 5 aa, Mycobacterium
SPGQP

SEQ ID NO: 286640 - protein, 17 aa, Mycobacterium
SPGQTITKGTIPTEIGP

SEQ ID NO: 286641 - protein, 24 aa, Mycobacterium
SPGQTITKGTVPSEIGPALDTANR

SEQ ID NO: 286642 - protein, 5 aa, Mycobacterium
SPGRQ

SEQ ID NO: 286643 - protein, 25 aa, Mycobacterium
SPGSRVKRRQQRAERTAERGAAEPV

SEQ ID NO: 286644 - protein, 6 aa, Mycobacterium
SPGSTP

SEQ ID NO: 286645 - protein, 4 aa, Mycobacterium
SPGT

SEQ ID NO: 286646 - protein, 14 aa, Mycobacterium
SPGTAGTPEDPEDV

SEQ ID NO: 286647 - protein, 5 aa, Mycobacterium
SPGTG

SEQ ID NO: 286648 - protein, 11 aa, Mycobacterium
SPGTIDAGYRG

SEQ ID NO: 286649 - protein, 5 aa, Mycobacterium
SPGTK

SEQ ID NO: 286650 - protein, 5 aa, Mycobacterium
SPGTR

SEQ ID NO: 286651 - protein, 5 aa, Mycobacterium
SPGVG

SEQ ID NO: 286652 - protein, 7 aa, Mycobacterium
SPGVGGG

SEQ ID NO: 286653 - protein, 4 aa, Mycobacterium
SPGW

SEQ ID NO: 286654 - protein, 7 aa, Mycobacterium
SPGYPGL

SEQ ID NO: 286655 - protein, 5 aa, Mycobacterium
SPHAA

SEQ ID NO: 286656 - protein, 6 aa, Mycobacterium
SPHDAP

SEQ ID NO: 286657 - protein, 7 aa, Mycobacterium
SPHDDGP

SEQ ID NO: 286658 - protein, 8 aa, Mycobacterium
SPHGAPAG

SEQ ID NO: 286659 - protein, 7 aa, Mycobacterium
SPHPAPV

SEQ ID NO: 286660 - protein, 8 aa, Mycobacterium
SPHTPTTE

SEQ ID NO: 286661 - protein, 6 aa, Mycobacterium
SPIAHD

SEQ ID NO: 286662 - protein, 19 aa, Mycobacterium
SPIANPATQQRDTAPAKPP

SEQ ID NO: 286663 - protein, 15 aa, Mycobacterium
SPIAPADAVRNRSRE

SEQ ID NO: 286664 - protein, 7 aa, Mycobacterium
SPIDSGN

SEQ ID NO: 286665 - protein, 14 aa, Mycobacterium
SPIDTGVANTHGPL

SEQ ID NO: 286666 - protein, 6 aa, Mycobacterium
SPIGTG

SEQ ID NO: 286667 - protein, 54 aa, Mycobacterium
SPIPGAPDFTPGIAPPPPAITGPPPPPGPGPQLAPVGEAPLPGNPPFLPPGSQS

SEQ ID NO: 286668 - protein, 6 aa, Mycobacterium
SPIREV

SEQ ID NO: 286669 - protein, 5 aa, Mycobacterium
SPISA

SEQ ID NO: 286670 - protein, 5 aa, Mycobacterium
SPISD

SEQ ID NO: 286671 - protein, 5 aa, Mycobacterium
SPITT

SEQ ID NO: 286672 - protein, 7 aa, Mycobacterium
SPKEPEF

SEQ ID NO: 286673 - protein, 9 aa, Mycobacterium
SPKGARNDR

SEQ ID NO: 286674 - protein, 9 aa, Mycobacterium
SPKGARTDR

SEQ ID NO: 286675 - protein, 8 aa, Mycobacterium
SPKKAASA

SEQ ID NO: 286676 - protein, 7 aa, Mycobacterium
SPKKSWE

SEQ ID NO: 286677 - protein, 8 aa, Mycobacterium
SPKKSWEG

SEQ ID NO: 286678 - protein, 11 aa, Mycobacterium
SPKPTAPPTTV

SEQ ID NO: 286679 - protein, 14 aa, Mycobacterium
SPKRPFDERVGKTG

SEQ ID NO: 286680 - protein, 5 aa, Mycobacterium
SPKRR

SEQ ID NO: 286681 - protein, 7 aa, Mycobacterium
SPKTPEF

SEQ ID NO: 286682 - protein, 20 aa, Mycobacterium
SPKTRARAATTAAASGSAHR

SEQ ID NO: 286683 - protein, 4 aa, Mycobacterium
SPLA

SEQ ID NO: 286684 - protein, 11 aa, Mycobacterium
SPLAAETALSA

SEQ ID NO: 286685 - protein, 14 aa, Mycobacterium
SPLAGKEGLHPGSV

SEQ ID NO: 286686 - protein, 8 aa, Mycobacterium
SPLAGPEG

SEQ ID NO: 286687 - protein, 7 aa, Mycobacterium
SPLGAPS

SEQ ID NO: 286688 - protein, 4 aa, Mycobacterium
SPLP

SEQ ID NO: 286689 - protein, 6 aa, Mycobacterium
SPLPAE

SEQ ID NO: 286690 - protein, 6 aa, Mycobacterium
SPLPDE

SEQ ID NO: 286691 - protein, 7 aa, Mycobacterium
SPLPDEP

SEQ ID NO: 286692 - protein, 7 aa, Mycobacterium
SPLPDRP

SEQ ID NO: 286693 - protein, 12 aa, Mycobacterium
SPLPGRGLTRDG

SEQ ID NO: 286694 - protein, 6 aa, Mycobacterium
SPLPPT

SEQ ID NO: 286695 - protein, 18 aa, Mycobacterium
SPLPSGQETPPDFNPRRV

SEQ ID NO: 286696 - protein, 15 aa, Mycobacterium
SPLQGRSGCAPSPQR

SEQ ID NO: 286697 - protein, 11 aa, Mycobacterium
SPLQVSGPAAG

SEQ ID NO: 286698 - protein, 16 aa, Mycobacterium
SPLRATQSLSEQDVYD

SEQ ID NO: 286699 - protein, 15 aa, Mycobacterium
SPLRATQSLTEQEVY

SEQ ID NO: 286700 - protein, 5 aa, Mycobacterium
SPLTG

SEQ ID NO: 286701 - protein, 10 aa, Mycobacterium
SPLTGEPKQA

SEQ ID NO: 286702 - protein, 4 aa, Mycobacterium
SPMC

SEQ ID NO: 286703 - protein, 5 aa, Mycobacterium
SPMGR

SEQ ID NO: 286704 - protein, 5 aa, Mycobacterium
SPMSR

SEQ ID NO: 286705 - protein, 4 aa, Mycobacterium
SPNA

SEQ ID NO: 286706 - protein, 7 aa, Mycobacterium
SPNADEN

SEQ ID NO: 286707 - protein, 5 aa, Mycobacterium
SPNAS

SEQ ID NO: 286708 - protein, 12 aa, Mycobacterium
SPNSAAVGSHVL

SEQ ID NO: 286709 - protein, 6 aa, Mycobacterium
SPNSAS

SEQ ID NO: 286710 - protein, 6 aa, Mycobacterium
SPNSSA

SEQ ID NO: 286711 - protein, 5 aa, Mycobacterium
SPPAP

SEQ ID NO: 286712 - protein, 6 aa, Mycobacterium
SPPASM

SEQ ID NO: 286713 - protein, 24 aa, Mycobacterium
SPPDGVPQPEVTESIGSTTTVNND

SEQ ID NO: 286714 - protein, 20 aa, Mycobacterium
SPPDTGPEVTAGPENLGKVP

SEQ ID NO: 286715 - protein, 6 aa, Mycobacterium
SPPEPV

SEQ ID NO: 286716 - protein, 7 aa, Mycobacterium
SPPFQHS

SEQ ID NO: 286717 - protein, 8 aa, Mycobacterium
SPPFSHSN

SEQ ID NO: 286718 - protein, 8 aa, Mycobacterium
SPPGLGDD

SEQ ID NO: 286719 - protein, 6 aa, Mycobacterium
SPPGME

SEQ ID NO: 286720 - protein, 6 aa, Mycobacterium
SPPGWT

SEQ ID NO: 286721 - protein, 11 aa, Mycobacterium
SPPGWTPEKTA

SEQ ID NO: 286722 - protein, 20 aa, Mycobacterium
SPPGWTPEKTARLRPLLHAE

SEQ ID NO: 286723 - protein, 19 aa, Mycobacterium
SPPGWTPEKTERLRPLLRA

SEQ ID NO: 286724 - protein, 9 aa, Mycobacterium
SPPHDTEYQ

SEQ ID NO: 286725 - protein, 5 aa, Mycobacterium
SPPIE

SEQ ID NO: 286726 - protein, 6 aa, Mycobacterium
SPPKYR

SEQ ID NO: 286727 - protein, 13 aa, Mycobacterium
SPPMETPDANATI

SEQ ID NO: 286728 - protein, 13 aa, Mycobacterium
SPPPRPSDKDPRL

SEQ ID NO: 286729 - protein, 8 aa, Mycobacterium
SPPQGSLR

SEQ ID NO: 286730 - protein, 8 aa, Mycobacterium
SPPQPVHQ

SEQ ID NO: 286731 - protein, 8 aa, Mycobacterium
SPPQRTGG

SEQ ID NO: 286732 - protein, 12 aa, Mycobacterium
SPPQYAEDNGSA

SEQ ID NO: 286733 - protein, 7 aa, Mycobacterium
SPPRLGD

SEQ ID NO: 286734 - protein, 6 aa, Mycobacterium
SPPSRL

SEQ ID NO: 286735 - protein, 4 aa, Mycobacterium
SPPV

SEQ ID NO: 286736 - protein, 8 aa, Mycobacterium
SPPVGAAA

SEQ ID NO: 286737 - protein, 37 aa, Mycobacterium
SPPVSVPGGEPPTAAPAGAPAPSAAPLNDAHGDHDHG

SEQ ID NO: 286738 - protein, 9 aa, Mycobacterium
SPPYTEGPV

SEQ ID NO: 286739 - protein, 12 aa, Mycobacterium
SPPYTGGPTLRD

SEQ ID NO: 286740 - protein, 7 aa, Mycobacterium
SPQAEPS

SEQ ID NO: 286741 - protein, 13 aa, Mycobacterium
SPQEPPERGEGAE

SEQ ID NO: 286742 - protein, 7 aa, Mycobacterium
SPQFTPN

SEQ ID NO: 286743 - protein, 8 aa, Mycobacterium
SPQGDRAT

SEQ ID NO: 286744 - protein, 11 aa, Mycobacterium
SPQGFAAEASS

SEQ ID NO: 286745 - protein, 7 aa, Mycobacterium
SPQGLES

SEQ ID NO: 286746 - protein, 45 aa, Mycobacterium
SPQGPVPLDADRPDVPPTRDANSGAAVEPVGTEPAALDRDRVVGA

SEQ ID NO: 286747 - protein, 5 aa, Mycobacterium
SPQNW

SEQ ID NO: 286748 - protein, 9 aa, Mycobacterium
SPQPPTGHL

SEQ ID NO: 286749 - protein, 11 aa, Mycobacterium
SPQQAAAQVSG

SEQ ID NO: 286750 - protein, 5 aa, Mycobacterium
SPQQS

SEQ ID NO: 286751 - protein, 11 aa, Mycobacterium
SPQQSADNDES

SEQ ID NO: 286752 - protein, 8 aa, Mycobacterium
SPQQTPRQ

SEQ ID NO: 286753 - protein, 4 aa, Mycobacterium
SPQR

SEQ ID NO: 286754 - protein, 12 aa, Mycobacterium
SPQRESDEFAAR

SEQ ID NO: 286755 - protein, 4 aa, Mycobacterium
SPQV

SEQ ID NO: 286756 - protein, 5 aa, Mycobacterium
SPQVR

SEQ ID NO: 286757 - protein, 7 aa, Mycobacterium
SPRADAR

SEQ ID NO: 286758 - protein, 6 aa, Mycobacterium
SPRDDG

SEQ ID NO: 286759 - protein, 12 aa, Mycobacterium
SPREAPAATPVA

SEQ ID NO: 286760 - protein, 5 aa, Mycobacterium
SPRFE

SEQ ID NO: 286761 - protein, 6 aa, Mycobacterium
SPRGAT

SEQ ID NO: 286762 - protein, 5 aa, Mycobacterium
SPRGE

SEQ ID NO: 286763 - protein, 6 aa, Mycobacterium
SPRGEA

SEQ ID NO: 286764 - protein, 4 aa, Mycobacterium
SPRK

SEQ ID NO: 286765 - protein, 5 aa, Mycobacterium
SPRLN

SEQ ID NO: 286766 - protein, 20 aa, Mycobacterium
SPRLPPAPDHDDGDELPPAE

SEQ ID NO: 286767 - protein, 6 aa, Mycobacterium
SPRMNR

SEQ ID NO: 286768 - protein, 12 aa, Mycobacterium
SPRNDNYSARAA

SEQ ID NO: 286769 - protein, 12 aa, Mycobacterium
SPRNQNYSARAA

SEQ ID NO: 286770 - protein, 9 aa, Mycobacterium
SPRNRPPHG

SEQ ID NO: 286771 - protein, 10 aa, Mycobacterium
SPRPEFASAT

SEQ ID NO: 286772 - protein, 7 aa, Mycobacterium
SPRPTFQ

SEQ ID NO: 286773 - protein, 6 aa, Mycobacterium
SPRPVG

SEQ ID NO: 286774 - protein, 4 aa, Mycobacterium
SPRQ

SEQ ID NO: 286775 - protein, 5 aa, Mycobacterium
SPRQK

SEQ ID NO: 286776 - protein, 5 aa, Mycobacterium
SPRQL

SEQ ID NO: 286777 - protein, 8 aa, Mycobacterium
SPRQQTDI

SEQ ID NO: 286778 - protein, 5 aa, Mycobacterium
SPRQR

SEQ ID NO: 286779 - protein, 8 aa, Mycobacterium
SPRQRSDY

SEQ ID NO: 286780 - protein, 15 aa, Mycobacterium
SPRQWERSAPDRDPT

SEQ ID NO: 286781 - protein, 4 aa, Mycobacterium
SPRR

SEQ ID NO: 286782 - protein, 5 aa, Mycobacterium
SPRRD

SEQ ID NO: 286783 - protein, 5 aa, Mycobacterium
SPRRL

SEQ ID NO: 286784 - protein, 5 aa, Mycobacterium
SPRRR

SEQ ID NO: 286785 - protein, 6 aa, Mycobacterium
SPRRRT

SEQ ID NO: 286786 - protein, 9 aa, Mycobacterium
SPRRSEPRG

SEQ ID NO: 286787 - protein, 7 aa, Mycobacterium
SPRSRSG

SEQ ID NO: 286788 - protein, 13 aa, Mycobacterium
SPRSSAAAGTAGA

SEQ ID NO: 286789 - protein, 7 aa, Mycobacterium
SPRSSTD

SEQ ID NO: 286790 - protein, 6 aa, Mycobacterium
SPRTEI

SEQ ID NO: 286791 - protein, 4 aa, Mycobacterium
SPRV

SEQ ID NO: 286792 - protein, 43 aa, Mycobacterium
SPRVPGTGDPDDAPPAPPAPPGAAAPSAFGGNVGPVGSRQERD

SEQ ID NO: 286793 - protein, 29 aa, Mycobacterium
SPSAEPGSAAQSPSTASPSGGATPPSTPA

SEQ ID NO: 286794 - protein, 8 aa, Mycobacterium
SPSARSCR

SEQ ID NO: 286795 - protein, 6 aa, Mycobacterium
SPSAYR

SEQ ID NO: 286796 - protein, 14 aa, Mycobacterium
SPSDLPATNSSGAG

SEQ ID NO: 286797 - protein, 9 aa, Mycobacterium
SPSDPHPVP

SEQ ID NO: 286798 - protein, 9 aa, Mycobacterium
SPSFPDLSG

SEQ ID NO: 286799 - protein, 7 aa, Mycobacterium
SPSGALS

SEQ ID NO: 286800 - protein, 7 aa, Mycobacterium
SPSGATI

SEQ ID NO: 286801 - protein, 10 aa, Mycobacterium
SPSGPRTTMG

SEQ ID NO: 286802 - protein, 9 aa, Mycobacterium
SPSGTYQYR

SEQ ID NO: 286803 - protein, 9 aa, Mycobacterium
SPSIPDLTG

SEQ ID NO: 286804 - protein, 5 aa, Mycobacterium
SPSLS

SEQ ID NO: 286805 - protein, 6 aa, Mycobacterium
SPSLSS

SEQ ID NO: 286806 - protein, 4 aa, Mycobacterium
SPSM

SEQ ID NO: 286807 - protein, 6 aa, Mycobacterium
SPSPAL

SEQ ID NO: 286808 - protein, 15 aa, Mycobacterium
SPSQQAQGTVQPADP

SEQ ID NO: 286809 - protein, 7 aa, Mycobacterium
SPSRERR

SEQ ID NO: 286810 - protein, 15 aa, Mycobacterium
SPSRPAVDDEEAAAA

SEQ ID NO: 286811 - protein, 7 aa, Mycobacterium
SPSRRRG

SEQ ID NO: 286812 - protein, 6 aa, Mycobacterium
SPSSLT

SEQ ID NO: 286813 - protein, 10 aa, Mycobacterium
SPSSPTAPVP

SEQ ID NO: 286814 - protein, 6 aa, Mycobacterium
SPSSPW

SEQ ID NO: 286815 - protein, 6 aa, Mycobacterium
SPSSTI

SEQ ID NO: 286816 - protein, 5 aa, Mycobacterium
SPSTR

SEQ ID NO: 286817 - protein, 4 aa, Mycobacterium
SPSV

SEQ ID NO: 286818 - protein, 8 aa, Mycobacterium
SPTAADPV

SEQ ID NO: 286819 - protein, 11 aa, Mycobacterium
SPTAAGVGSAV

SEQ ID NO: 286820 - protein, 7 aa, Mycobacterium
SPTAGTL

SEQ ID NO: 286821 - protein, 5 aa, Mycobacterium
SPTAV

SEQ ID NO: 286822 - protein, 5 aa, Mycobacterium
SPTCQ

SEQ ID NO: 286823 - protein, 5 aa, Mycobacterium
SPTDA

SEQ ID NO: 286824 - protein, 7 aa, Mycobacterium
SPTDAAA

SEQ ID NO: 286825 - protein, 11 aa, Mycobacterium
SPTDPVGRRGA

SEQ ID NO: 286826 - protein, 6 aa, Mycobacterium
SPTDTM

SEQ ID NO: 286827 - protein, 4 aa, Mycobacterium
SPTG

SEQ ID NO: 286828 - protein, 5 aa, Mycobacterium
SPTGC

SEQ ID NO: 286829 - protein, 7 aa, Mycobacterium
SPTGSRH

SEQ ID NO: 286830 - protein, 6 aa, Mycobacterium
SPTHRL

SEQ ID NO: 286831 - protein, 12 aa, Mycobacterium
SPTKAALTQAPT

SEQ ID NO: 286832 - protein, 5 aa, Mycobacterium
SPTLV

SEQ ID NO: 286833 - protein, 7 aa, Mycobacterium
SPTNPAT

SEQ ID NO: 286834 - protein, 4 aa, Mycobacterium
SPTQ

SEQ ID NO: 286835 - protein, 6 aa, Mycobacterium
SPTQFP

SEQ ID NO: 286836 - protein, 7 aa, Mycobacterium
SPTQREY

SEQ ID NO: 286837 - protein, 6 aa, Mycobacterium
SPTQSN

SEQ ID NO: 286838 - protein, 4 aa, Mycobacterium
SPTR

SEQ ID NO: 286839 - protein, 6 aa, Mycobacterium
SPTRAA

SEQ ID NO: 286840 - protein, 5 aa, Mycobacterium
SPTRL

SEQ ID NO: 286841 - protein, 6 aa, Mycobacterium
SPTRSV

SEQ ID NO: 286842 - protein, 10 aa, Mycobacterium
SPTSAGFGSR

SEQ ID NO: 286843 - protein, 8 aa, Mycobacterium
SPTSGTVT

SEQ ID NO: 286844 - protein, 5 aa, Mycobacterium
SPTTM

SEQ ID NO: 286845 - protein, 8 aa, Mycobacterium
SPTTNRAA

SEQ ID NO: 286846 - protein, 13 aa, Mycobacterium
SPTTNRDATKNAL

SEQ ID NO: 286847 - protein, 10 aa, Mycobacterium
SPTTNRDATV

SEQ ID NO: 286848 - protein, 6 aa, Mycobacterium
SPTTRV

SEQ ID NO: 286849 - protein, 5 aa, Mycobacterium
SPTVR

SEQ ID NO: 286850 - protein, 5 aa, Mycobacterium
SPVAA

SEQ ID NO: 286851 - protein, 9 aa, Mycobacterium
SPVDEPATS

SEQ ID NO: 286852 - protein, 17 aa, Mycobacterium
SPVEFPSPPRPRARDYH

SEQ ID NO: 286853 - protein, 12 aa, Mycobacterium
SPVERPGNETVE

SEQ ID NO: 286854 - protein, 16 aa, Mycobacterium
SPVGATATTSDGSTAY

SEQ ID NO: 286855 - protein, 5 aa, Mycobacterium
SPVLP

SEQ ID NO: 286856 - protein, 34 aa, Mycobacterium
SPVPPGPPPPIGGPPKTAMPQSIPPRGGKPPLRQ

SEQ ID NO: 286857 - protein, 52 aa, Mycobacterium
SPVPPNESGAPESAPAPSASPTTTGAKPSASLPPAGATATSPAPTSVPTPPV

SEQ ID NO: 286858 - protein, 11 aa, Mycobacterium
SPVSDTLPDGA

SEQ ID NO: 286859 - protein, 25 aa, Mycobacterium
SPVSEADTEDEDNELTDISARGAAI

SEQ ID NO: 286860 - protein, 18 aa, Mycobacterium
SPVSEDESEDEDNELTDI

SEQ ID NO: 286861 - protein, 5 aa, Mycobacterium
SPWGV

SEQ ID NO: 286862 - protein, 19 aa, Mycobacterium
SPWTGAAPADLVSRDGKSG

SEQ ID NO: 286863 - protein, 11 aa, Mycobacterium
SPWTSPPGAAA

SEQ ID NO: 286864 - protein, 10 aa, Mycobacterium
SPWTVPPQAA

SEQ ID NO: 286865 - protein, 7 aa, Mycobacterium
SPYDIPD

SEQ ID NO: 286866 - protein, 13 aa, Mycobacterium
SPYDPTERGEGAE

SEQ ID NO: 286867 - protein, 4 aa, Mycobacterium
SPYR

SEQ ID NO: 286868 - protein, 12 aa, Mycobacterium
SQAAEEGGGGSN

SEQ ID NO: 286869 - protein, 13 aa, Mycobacterium
SQAAGRLGDSRTD

SEQ ID NO: 286870 - protein, 7 aa, Mycobacterium
SQAANTW

SEQ ID NO: 286871 - protein, 5 aa, Mycobacterium
SQADA

SEQ ID NO: 286872 - protein, 23 aa, Mycobacterium
SQADADQQAPTAHAEEVKAPPEV

SEQ ID NO: 286873 - protein, 7 aa, Mycobacterium
SQADRDA

SEQ ID NO: 286874 - protein, 4 aa, Mycobacterium
SQAF

SEQ ID NO: 286875 - protein, 12 aa, Mycobacterium
SQAPAGSGKPLQ

SEQ ID NO: 286876 - protein, 17 aa, Mycobacterium
SQAPPAPRAGRAAPTLP

SEQ ID NO: 286877 - protein, 6 aa, Mycobacterium
SQAPVP

SEQ ID NO: 286878 - protein, 13 aa, Mycobacterium
SQAQQGGQQQQAT

SEQ ID NO: 286879 - protein, 7 aa, Mycobacterium
SQAQTTD

SEQ ID NO: 286880 - protein, 7 aa, Mycobacterium
SQARRAL

SEQ ID NO: 286881 - protein, 16 aa, Mycobacterium
SQATSAPPADERPAVP

SEQ ID NO: 286882 - protein, 15 aa, Mycobacterium
SQAVGALPSGHVGGA

SEQ ID NO: 286883 - protein, 6 aa, Mycobacterium
SQCGQE

SEQ ID NO: 286884 - protein, 42 aa, Mycobacterium
SQDADGDEPVPYTGRDATGEYTSAARNFDDDAGERPAEQGPL

SEQ ID NO: 286885 - protein, 27 aa, Mycobacterium
SQDADSDEPVPYTGRDATGEYASEARE

SEQ ID NO: 286886 - protein, 16 aa, Mycobacterium
SQDAPPRRAQPPSTQV

SEQ ID NO: 286887 - protein, 35 aa, Mycobacterium
SQDDDGVQDPLPYTGADYTSPAGYGDAATGARPPV

SEQ ID NO: 286888 - protein, 11 aa, Mycobacterium
SQDDPATQSAY

SEQ ID NO: 286889 - protein, 9 aa, Mycobacterium
SQDISRAAT

SEQ ID NO: 286890 - protein, 5 aa, Mycobacterium
SQDKT

SEQ ID NO: 286891 - protein, 7 aa, Mycobacterium
SQDKTNI

SEQ ID NO: 286892 - protein, 5 aa, Mycobacterium
SQDNK

SEQ ID NO: 286893 - protein, 24 aa, Mycobacterium
SQDPADGATESRDPQGRAQHGRHE

SEQ ID NO: 286894 - protein, 13 aa, Mycobacterium
SQDPDGPTAGSAY

SEQ ID NO: 286895 - protein, 11 aa, Mycobacterium
SQDPDGTTAGS

SEQ ID NO: 286896 - protein, 11 aa, Mycobacterium
SQDPVYSGTGY

SEQ ID NO: 286897 - protein, 9 aa, Mycobacterium
SQDRDPIGT

SEQ ID NO: 286898 - protein, 7 aa, Mycobacterium
SQDRHGV

SEQ ID NO: 286899 - protein, 8 aa, Mycobacterium
SQDRNTIG

SEQ ID NO: 286900 - protein, 11 aa, Mycobacterium
SQDSSPKAPPV

SEQ ID NO: 286901 - protein, 6 aa, Mycobacterium
SQDTKH

SEQ ID NO: 286902 - protein, 27 aa, Mycobacterium
SQEAALPTAVNPDPRLSTAPPPRPYQP

SEQ ID NO: 286903 - protein, 49 aa, Mycobacterium
SQEATLPGPPDPAAPPTMPATAAAPPARPGPAATPPRPAPTPQQPPYYP

SEQ ID NO: 286904 - protein, 68 aa, Mycobacterium
SQEATLPGTAFAPQPPTLAAATPPPAPQYPEPAGSGPLPPASPTGQPAWAPASGPIPAAGQPAPVPQY

SEQ ID NO: 286905 - protein, 20 aa, Mycobacterium
SQEATLPGTATLGPQPTVAD

SEQ ID NO: 286906 - protein, 7 aa, Mycobacterium
SQEFTEP

SEQ ID NO: 286907 - protein, 36 aa, Mycobacterium
SQEPQEAAVQAEDQDEFEGPRRRARRERAERRAAEA

SEQ ID NO: 286908 - protein, 7 aa, Mycobacterium
SQEQCTP

SEQ ID NO: 286909 - protein, 9 aa, Mycobacterium
SQEQTTAAS

SEQ ID NO: 286910 - protein, 5 aa, Mycobacterium
SQERE

SEQ ID NO: 286911 - protein, 8 aa, Mycobacterium
SQFSSSGL

SEQ ID NO: 286912 - protein, 10 aa, Mycobacterium
SQGAPPSPLQ

SEQ ID NO: 286913 - protein, 8 aa, Mycobacterium
SQGDTPYV

SEQ ID NO: 286914 - protein, 20 aa, Mycobacterium
SQGGVPSPKPSLDGRAEPRP

SEQ ID NO: 286915 - protein, 11 aa, Mycobacterium
SQGKPIAEDAD

SEQ ID NO: 286916 - protein, 15 aa, Mycobacterium
SQGKPIAPDADLDGL

SEQ ID NO: 286917 - protein, 10 aa, Mycobacterium
SQGKTAPRTV

SEQ ID NO: 286918 - protein, 9 aa, Mycobacterium
SQGLATSAA

SEQ ID NO: 286919 - protein, 6 aa, Mycobacterium
SQGNRT

SEQ ID NO: 286920 - protein, 6 aa, Mycobacterium
SQGPDA

SEQ ID NO: 286921 - protein, 14 aa, Mycobacterium
SQGPGGQVGSSNCN

SEQ ID NO: 286922 - protein, 6 aa, Mycobacterium
SQGRVA

SEQ ID NO: 286923 - protein, 5 aa, Mycobacterium
SQGSP

SEQ ID NO: 286924 - protein, 11 aa, Mycobacterium
SQGSPGRSNAV

SEQ ID NO: 286925 - protein, 8 aa, Mycobacterium
SQGSTNPL

SEQ ID NO: 286926 - protein, 8 aa, Mycobacterium
SQGTSRPR

SEQ ID NO: 286927 - protein, 5 aa, Mycobacterium
SQGTT

SEQ ID NO: 286928 - protein, 8 aa, Mycobacterium
SQGVSRPT

SEQ ID NO: 286929 - protein, 17 aa, Mycobacterium
SQHHKNVGPAAPKSTLA

SEQ ID NO: 286930 - protein, 12 aa, Mycobacterium
SQHPSAFDGVGT

SEQ ID NO: 286931 - protein, 5 aa, Mycobacterium
SQHQV

SEQ ID NO: 286932 - protein, 17 aa, Mycobacterium
SQHRAAAGPSAPKSTLA

SEQ ID NO: 286933 - protein, 17 aa, Mycobacterium
SQHRKPVQPAAPKSTLA

SEQ ID NO: 286934 - protein, 8 aa, Mycobacterium
SQIARRQS

SEQ ID NO: 286935 - protein, 34 aa, Mycobacterium
SQIDPDATPAAAKDPDATPGAPPANPPKNSSDPP

SEQ ID NO: 286936 - protein, 14 aa, Mycobacterium
SQIGGSTQQLQQGA

SEQ ID NO: 286937 - protein, 5 aa, Mycobacterium
SQIPA

SEQ ID NO: 286938 - protein, 4 aa, Mycobacterium
SQIS

SEQ ID NO: 286939 - protein, 5 aa, Mycobacterium
SQKAG

SEQ ID NO: 286940 - protein, 9 aa, Mycobacterium
SQKGQQDQM

SEQ ID NO: 286941 - protein, 10 aa, Mycobacterium
SQKGTIHPSR

SEQ ID NO: 286942 - protein, 9 aa, Mycobacterium
SQLAERDQA

SEQ ID NO: 286943 - protein, 4 aa, Mycobacterium
SQLL

SEQ ID NO: 286944 - protein, 6 aa, Mycobacterium
SQLPPN

SEQ ID NO: 286945 - protein, 7 aa, Mycobacterium
SQLTGDD

SEQ ID NO: 286946 - protein, 11 aa, Mycobacterium
SQLTGSGVSNQ

SEQ ID NO: 286947 - protein, 6 aa, Mycobacterium
SQLTPG

SEQ ID NO: 286948 - protein, 29 aa, Mycobacterium
SQLTPPPADNGAYTPTGLPAREHHSTGTD

SEQ ID NO: 286949 - protein, 6 aa, Mycobacterium
SQMQPT

SEQ ID NO: 286950 - protein, 13 aa, Mycobacterium
SQNALGAEAPNLP

SEQ ID NO: 286951 - protein, 4 aa, Mycobacterium
SQNE

SEQ ID NO: 286952 - protein, 26 aa, Mycobacterium
SQNGPPPPQPPALTPSELGNPTRTSL

SEQ ID NO: 286953 - protein, 5 aa, Mycobacterium
SQNGR

SEQ ID NO: 286954 - protein, 5 aa, Mycobacterium
SQNNT

SEQ ID NO: 286955 - protein, 10 aa, Mycobacterium
SQNSSPPPPR

SEQ ID NO: 286956 - protein, 6 aa, Mycobacterium
SQNYNG

SEQ ID NO: 286957 - protein, 15 aa, Mycobacterium
SQPAGHANSKRVQGG

SEQ ID NO: 286958 - protein, 22 aa, Mycobacterium
SQPAPQGVPYPPQQPAKKKRKW

SEQ ID NO: 286959 - protein, 10 aa, Mycobacterium
SQPATAEETD

SEQ ID NO: 286960 - protein, 8 aa, Mycobacterium
SQPDADND

SEQ ID NO: 286961 - protein, 9 aa, Mycobacterium
SQPDQQALT

SEQ ID NO: 286962 - protein, 23 aa, Mycobacterium
SQPGPPAGLPPGPPPGAPPGPQF

SEQ ID NO: 286963 - protein, 7 aa, Mycobacterium
SQPGPPL

SEQ ID NO: 286964 - protein, 11 aa, Mycobacterium
SQPLNSASQAA

SEQ ID NO: 286965 - protein, 5 aa, Mycobacterium
SQPLV

SEQ ID NO: 286966 - protein, 4 aa, Mycobacterium
SQPN

SEQ ID NO: 286967 - protein, 10 aa, Mycobacterium
SQPPRAASDR

SEQ ID NO: 286968 - protein, 9 aa, Mycobacterium
SQPRAAERK

SEQ ID NO: 286969 - protein, 6 aa, Mycobacterium
SQPRAV

SEQ ID NO: 286970 - protein, 5 aa, Mycobacterium
SQPRP

SEQ ID NO: 286971 - protein, 15 aa, Mycobacterium
SQPVLDSQAGTSPSI

SEQ ID NO: 286972 - protein, 4 aa, Mycobacterium
SQPW

SEQ ID NO: 286973 - protein, 12 aa, Mycobacterium
SQQMNQKYQEDQ

SEQ ID NO: 286974 - protein, 12 aa, Mycobacterium
SQQMSQKYQEDQ

SEQ ID NO: 286975 - protein, 13 aa, Mycobacterium
SQQQTSVEAPANA

SEQ ID NO: 286976 - protein, 4 aa, Mycobacterium
SQQR

SEQ ID NO: 286977 - protein, 9 aa, Mycobacterium
SQQSTLPGQ

SEQ ID NO: 286978 - protein, 17 aa, Mycobacterium
SQRADPQVGQPATPPLP

SEQ ID NO: 286979 - protein, 7 aa, Mycobacterium
SQRDGLT

SEQ ID NO: 286980 - protein, 6 aa, Mycobacterium
SQRDSR

SEQ ID NO: 286981 - protein, 5 aa, Mycobacterium
SQREL

SEQ ID NO: 286982 - protein, 6 aa, Mycobacterium
SQRGAT

SEQ ID NO: 286983 - protein, 12 aa, Mycobacterium
SQRLGNKPDAAT

SEQ ID NO: 286984 - protein, 6 aa, Mycobacterium
SQRQQH

SEQ ID NO: 286985 - protein, 6 aa, Mycobacterium
SQRRHR

SEQ ID NO: 286986 - protein, 18 aa, Mycobacterium
SQRRISPHEPATGATDPG

SEQ ID NO: 286987 - protein, 9 aa, Mycobacterium
SQRSPDGPV

SEQ ID NO: 286988 - protein, 10 aa, Mycobacterium
SQRSPHGEEP

SEQ ID NO: 286989 - protein, 5 aa, Mycobacterium
SQRSQ

SEQ ID NO: 286990 - protein, 16 aa, Mycobacterium
SQRTDPPIGQPGTPPL

SEQ ID NO: 286991 - protein, 7 aa, Mycobacterium
SQRTLTP

SEQ ID NO: 286992 - protein, 32 aa, Mycobacterium
SQSAPADRLDTTGLPAVGDDATIPRDAPRRTI

SEQ ID NO: 286993 - protein, 8 aa, Mycobacterium
SQSCTRTR

SEQ ID NO: 286994 - protein, 5 aa, Mycobacterium
SQSEL

SEQ ID NO: 286995 - protein, 14 aa, Mycobacterium
SQSEPPDSRNGLAQ

SEQ ID NO: 286996 - protein, 13 aa, Mycobacterium
SQSEPPDTRNGLA

SEQ ID NO: 286997 - protein, 4 aa, Mycobacterium
SQSM

SEQ ID NO: 286998 - protein, 6 aa, Mycobacterium
SQSNEQ

SEQ ID NO: 286999 - protein, 10 aa, Mycobacterium
SQSPLPEGRP

SEQ ID NO: 287000 - protein, 5 aa, Mycobacterium
SQSQL

SEQ ID NO: 287001 - protein, 5 aa, Mycobacterium
SQSRA

SEQ ID NO: 287002 - protein, 5 aa, Mycobacterium
SQSRH

SEQ ID NO: 287003 - protein, 9 aa, Mycobacterium
SQSSDQKAI

SEQ ID NO: 287004 - protein, 16 aa, Mycobacterium
SQSVPADARDDAARER

SEQ ID NO: 287005 - protein, 6 aa, Mycobacterium
SQSWSK

SEQ ID NO: 287006 - protein, 14 aa, Mycobacterium
SQTAEQDAALRSGL

SEQ ID NO: 287007 - protein, 5 aa, Mycobacterium
SQTAS

SEQ ID NO: 287008 - protein, 8 aa, Mycobacterium
SQTDDPGD

SEQ ID NO: 287009 - protein, 4 aa, Mycobacterium
SQTE

SEQ ID NO: 287010 - protein, 6 aa, Mycobacterium
SQTGKE

SEQ ID NO: 287011 - protein, 5 aa, Mycobacterium
SQTHS

SEQ ID NO: 287012 - protein, 4 aa, Mycobacterium
SQTL

SEQ ID NO: 287013 - protein, 9 aa, Mycobacterium
SQTPDGRTS

SEQ ID NO: 287014 - protein, 5 aa, Mycobacterium
SQTPS

SEQ ID NO: 287015 - protein, 6 aa, Mycobacterium
SQTPSA

SEQ ID NO: 287016 - protein, 8 aa, Mycobacterium
SQTPSAAG

SEQ ID NO: 287017 - protein, 36 aa, Mycobacterium
SQTPTTTEPADRIDTSGLPAVGDDATIPRDAPKRTI

SEQ ID NO: 287018 - protein, 13 aa, Mycobacterium
SQTRLENANAVSG

SEQ ID NO: 287019 - protein, 7 aa, Mycobacterium
SQTSNRL

SEQ ID NO: 287020 - protein, 7 aa, Mycobacterium
SQTVSND

SEQ ID NO: 287021 - protein, 14 aa, Mycobacterium
SQTYLDREQGSAFN

SEQ ID NO: 287022 - protein, 4 aa, Mycobacterium
SQVA

SEQ ID NO: 287023 - protein, 5 aa, Mycobacterium
SQVGP

SEQ ID NO: 287024 - protein, 9 aa, Mycobacterium
SQVKSSDAI

SEQ ID NO: 287025 - protein, 7 aa, Mycobacterium
SQVTTTG

SEQ ID NO: 287026 - protein, 16 aa, Mycobacterium
SQWRSPADTTTIDTPD

SEQ ID NO: 287027 - protein, 24 aa, Mycobacterium
SQYAAPDEAEYESEEEAEEARRAH

SEQ ID NO: 287028 - protein, 25 aa, Mycobacterium
SQYDDPEDDSDLSDEEIEEARRRRQ

SEQ ID NO: 287029 - protein, 5 aa, Mycobacterium
SQYTP

SEQ ID NO: 287030 - protein, 5 aa, Mycobacterium
SRAAA

SEQ ID NO: 287031 - protein, 11 aa, Mycobacterium
SRAAAARDREM

SEQ ID NO: 287032 - protein, 13 aa, Mycobacterium
SRAAGRRRKPDLR

SEQ ID NO: 287033 - protein, 7 aa, Mycobacterium
SRAAGSD

SEQ ID NO: 287034 - protein, 8 aa, Mycobacterium
SRAAPGRT

SEQ ID NO: 287035 - protein, 4 aa, Mycobacterium
SRAD

SEQ ID NO: 287036 - protein, 6 aa, Mycobacterium
SRADDS

SEQ ID NO: 287037 - protein, 7 aa, Mycobacterium
SRADDSV

SEQ ID NO: 287038 - protein, 9 aa, Mycobacterium
SRAEHAAAS

SEQ ID NO: 287039 - protein, 8 aa, Mycobacterium
SRAEITAS

SEQ ID NO: 287040 - protein, 6 aa, Mycobacterium
SRAEQV

SEQ ID NO: 287041 - protein, 8 aa, Mycobacterium
SRAGADDA

SEQ ID NO: 287042 - protein, 23 aa, Mycobacterium
SRAGANSEIGAGDTEDAGGARSD

SEQ ID NO: 287043 - protein, 5 aa, Mycobacterium
SRAGD

SEQ ID NO: 287044 - protein, 23 aa, Mycobacterium
SRAGDNANMGAGDTDDADGARSD

SEQ ID NO: 287045 - protein, 23 aa, Mycobacterium
SRAGDNANMGAGDTEDAGGARSD

SEQ ID NO: 287046 - protein, 6 aa, Mycobacterium
SRAGDR

SEQ ID NO: 287047 - protein, 6 aa, Mycobacterium
SRAGGI

SEQ ID NO: 287048 - protein, 6 aa, Mycobacterium
SRAGGR

SEQ ID NO: 287049 - protein, 5 aa, Mycobacterium
SRAGQ

SEQ ID NO: 287050 - protein, 8 aa, Mycobacterium
SRAGRPQV

SEQ ID NO: 287051 - protein, 7 aa, Mycobacterium
SRAGRRV

SEQ ID NO: 287052 - protein, 11 aa, Mycobacterium
SRAGTASASVE

SEQ ID NO: 287053 - protein, 13 aa, Mycobacterium
SRAGTSGGQPVTA

SEQ ID NO: 287054 - protein, 21 aa, Mycobacterium
SRAHASSAVERPAAPDSWAQV

SEQ ID NO: 287055 - protein, 8 aa, Mycobacterium
SRAKGLAG

SEQ ID NO: 287056 - protein, 7 aa, Mycobacterium
SRANGSW

SEQ ID NO: 287057 - protein, 6 aa, Mycobacterium
SRAPEC

SEQ ID NO: 287058 - protein, 6 aa, Mycobacterium
SRAQWD

SEQ ID NO: 287059 - protein, 6 aa, Mycobacterium
SRARNA

SEQ ID NO: 287060 - protein, 6 aa, Mycobacterium
SRASQL

SEQ ID NO: 287061 - protein, 6 aa, Mycobacterium
SRASQM

SEQ ID NO: 287062 - protein, 6 aa, Mycobacterium
SRASRA

SEQ ID NO: 287063 - protein, 6 aa, Mycobacterium
SRASRR

SEQ ID NO: 287064 - protein, 7 aa, Mycobacterium
SRASRSG

SEQ ID NO: 287065 - protein, 7 aa, Mycobacterium
SRATSGP

SEQ ID NO: 287066 - protein, 5 aa, Mycobacterium
SRCGS

SEQ ID NO: 287067 - protein, 6 aa, Mycobacterium
SRDAAG

SEQ ID NO: 287068 - protein, 11 aa, Mycobacterium
SRDATGAPKFP

SEQ ID NO: 287069 - protein, 5 aa, Mycobacterium
SRDDA

SEQ ID NO: 287070 - protein, 9 aa, Mycobacterium
SRDDQRRAV

SEQ ID NO: 287071 - protein, 6 aa, Mycobacterium
SRDDSR

SEQ ID NO: 287072 - protein, 6 aa, Mycobacterium
SRDDTA

SEQ ID NO: 287073 - protein, 5 aa, Mycobacterium
SRDEH

SEQ ID NO: 287074 - protein, 7 aa, Mycobacterium
SRDEIGD

SEQ ID NO: 287075 - protein, 8 aa, Mycobacterium
SRDETRVA

SEQ ID NO: 287076 - protein, 7 aa, Mycobacterium
SRDEYSA

SEQ ID NO: 287077 - protein, 8 aa, Mycobacterium
SRDGYRAY

SEQ ID NO: 287078 - protein, 10 aa, Mycobacterium
SRDNEAVARS

SEQ ID NO: 287079 - protein, 7 aa, Mycobacterium
SRDNTIG

SEQ ID NO: 287080 - protein, 4 aa, Mycobacterium
SRDP

SEQ ID NO: 287081 - protein, 5 aa, Mycobacterium
SRDPA

SEQ ID NO: 287082 - protein, 9 aa, Mycobacterium
SRDPAAPRL

SEQ ID NO: 287083 - protein, 9 aa, Mycobacterium
SRDPAAPRV

SEQ ID NO: 287084 - protein, 5 aa, Mycobacterium
SRDPR

SEQ ID NO: 287085 - protein, 20 aa, Mycobacterium
SRDQRRRKPKSRFSDVPQRA

SEQ ID NO: 287086 - protein, 15 aa, Mycobacterium
SRDQSPKPGEPAPTE

SEQ ID NO: 287087 - protein, 4 aa, Mycobacterium
SRDR

SEQ ID NO: 287088 - protein, 6 aa, Mycobacterium
SRDRTA

SEQ ID NO: 287089 - protein, 14 aa, Mycobacterium
SRDSRDVRDHPDEL

SEQ ID NO: 287090 - protein, 5 aa, Mycobacterium
SRDTA

SEQ ID NO: 287091 - protein, 6 aa, Mycobacterium
SRDTAE

SEQ ID NO: 287092 - protein, 7 aa, Mycobacterium
SRDTEPQ

SEQ ID NO: 287093 - protein, 25 aa, Mycobacterium
SRDTGDTESATPSTRKRASDEAPNA

SEQ ID NO: 287094 - protein, 13 aa, Mycobacterium
SRDVEADRQHPTK

SEQ ID NO: 287095 - protein, 9 aa, Mycobacterium
SREAGEIPR

SEQ ID NO: 287096 - protein, 11 aa, Mycobacterium
SREAKRKPRNG

SEQ ID NO: 287097 - protein, 4 aa, Mycobacterium
SRED

SEQ ID NO: 287098 - protein, 4 aa, Mycobacterium
SREE

SEQ ID NO: 287099 - protein, 8 aa, Mycobacterium
SREEAAAG

SEQ ID NO: 287100 - protein, 5 aa, Mycobacterium
SREEC

SEQ ID NO: 287101 - protein, 4 aa, Mycobacterium
SREG

SEQ ID NO: 287102 - protein, 5 aa, Mycobacterium
SREGL

SEQ ID NO: 287103 - protein, 10 aa, Mycobacterium
SREGTSTEKA

SEQ ID NO: 287104 - protein, 5 aa, Mycobacterium
SREGY

SEQ ID NO: 287105 - protein, 5 aa, Mycobacterium
SREMG

SEQ ID NO: 287106 - protein, 9 aa, Mycobacterium
SRESDQPPL

SEQ ID NO: 287107 - protein, 35 aa, Mycobacterium
SRESRESSSRKRADLGARHASAGAQKHVAETHCGA

SEQ ID NO: 287108 - protein, 21 aa, Mycobacterium
SRESTLPGTAAITPQPPTMPA

SEQ ID NO: 287109 - protein, 9 aa, Mycobacterium
SRESVGRDR

SEQ ID NO: 287110 - protein, 13 aa, Mycobacterium
SREYQADESGAVL

SEQ ID NO: 287111 - protein, 5 aa, Mycobacterium
SRFAA

SEQ ID NO: 287112 - protein, 11 aa, Mycobacterium
SRFDVPKEQPA

SEQ ID NO: 287113 - protein, 6 aa, Mycobacterium
SRFEQP

SEQ ID NO: 287114 - protein, 23 aa, Mycobacterium
SRGADGKKTQSPEASSSLSQGGL

SEQ ID NO: 287115 - protein, 23 aa, Mycobacterium
SRGADGRETPSRQASPSLSQGGK

SEQ ID NO: 287116 - protein, 17 aa, Mycobacterium
SRGADGTATADTVKGGT

SEQ ID NO: 287117 - protein, 12 aa, Mycobacterium
SRGASRKLTTKQ

SEQ ID NO: 287118 - protein, 4 aa, Mycobacterium
SRGD

SEQ ID NO: 287119 - protein, 5 aa, Mycobacterium
SRGDL

SEQ ID NO: 287120 - protein, 7 aa, Mycobacterium
SRGDQSE

SEQ ID NO: 287121 - protein, 8 aa, Mycobacterium
SRGDQSLS

SEQ ID NO: 287122 - protein, 8 aa, Mycobacterium
SRGDSDEA

SEQ ID NO: 287123 - protein, 7 aa, Mycobacterium
SRGDSPR

SEQ ID NO: 287124 - protein, 10 aa, Mycobacterium
SRGDSPRGLH

SEQ ID NO: 287125 - protein, 4 aa, Mycobacterium
SRGE

SEQ ID NO: 287126 - protein, 4 aa, Mycobacterium
SRGG

SEQ ID NO: 287127 - protein, 8 aa, Mycobacterium
SRGGRPQV

SEQ ID NO: 287128 - protein, 5 aa, Mycobacterium
SRGHT

SEQ ID NO: 287129 - protein, 10 aa, Mycobacterium
SRGKTAPRTV

SEQ ID NO: 287130 - protein, 12 aa, Mycobacterium
SRGLSGSGAPLG

SEQ ID NO: 287131 - protein, 8 aa, Mycobacterium
SRGNYESG

SEQ ID NO: 287132 - protein, 8 aa, Mycobacterium
SRGPDGQE

SEQ ID NO: 287133 - protein, 8 aa, Mycobacterium
SRGPPLPA

SEQ ID NO: 287134 - protein, 5 aa, Mycobacterium
SRGPR

SEQ ID NO: 287135 - protein, 6 aa, Mycobacterium
SRGPRS

SEQ ID NO: 287136 - protein, 5 aa, Mycobacterium
SRGQL

SEQ ID NO: 287137 - protein, 13 aa, Mycobacterium
SRGRHDGFGDDPQ

SEQ ID NO: 287138 - protein, 6 aa, Mycobacterium
SRGRNA

SEQ ID NO: 287139 - protein, 19 aa, Mycobacterium
SRGRRMAGRARSHTPSAAE

SEQ ID NO: 287140 - protein, 8 aa, Mycobacterium
SRGRSGAR

SEQ ID NO: 287141 - protein, 20 aa, Mycobacterium
SRGRTHVTGTVAPELLSLGS

SEQ ID NO: 287142 - protein, 4 aa, Mycobacterium
SRGS

SEQ ID NO: 287143 - protein, 7 aa, Mycobacterium
SRGSGGF

SEQ ID NO: 287144 - protein, 5 aa, Mycobacterium
SRGSI

SEQ ID NO: 287145 - protein, 13 aa, Mycobacterium
SRGSTAAPGGSGL

SEQ ID NO: 287146 - protein, 6 aa, Mycobacterium
SRGTAG

SEQ ID NO: 287147 - protein, 5 aa, Mycobacterium
SRGTP

SEQ ID NO: 287148 - protein, 18 aa, Mycobacterium
SRGTQALNTYTAADDAND

SEQ ID NO: 287149 - protein, 4 aa, Mycobacterium
SRGY

SEQ ID NO: 287150 - protein, 6 aa, Mycobacterium
SRHAEP

SEQ ID NO: 287151 - protein, 8 aa, Mycobacterium
SRHGNIGD

SEQ ID NO: 287152 - protein, 9 aa, Mycobacterium
SRHGTVGDY

SEQ ID NO: 287153 - protein, 5 aa, Mycobacterium
SRHHR

SEQ ID NO: 287154 - protein, 4 aa, Mycobacterium
SRHP

SEQ ID NO: 287155 - protein, 9 aa, Mycobacterium
SRHRPDSVR

SEQ ID NO: 287156 - protein, 4 aa, Mycobacterium
SRHT

SEQ ID NO: 287157 - protein, 6 aa, Mycobacterium
SRHTSA

SEQ ID NO: 287158 - protein, 4 aa, Mycobacterium
SRHV

SEQ ID NO: 287159 - protein, 4 aa, Mycobacterium
SRIG

SEQ ID NO: 287160 - protein, 5 aa, Mycobacterium
SRIGG

SEQ ID NO: 287161 - protein, 15 aa, Mycobacterium
SRIPASGSGEPETMP

SEQ ID NO: 287162 - protein, 6 aa, Mycobacterium
SRIPVS

SEQ ID NO: 287163 - protein, 9 aa, Mycobacterium
SRISGADLG

SEQ ID NO: 287164 - protein, 10 aa, Mycobacterium
SRISKSQGLS

SEQ ID NO: 287165 - protein, 15 aa, Mycobacterium
SRISNSAGADQDPRN

SEQ ID NO: 287166 - protein, 5 aa, Mycobacterium
SRISR

SEQ ID NO: 287167 - protein, 15 aa, Mycobacterium
SRITNAAGAKDEPRN

SEQ ID NO: 287168 - protein, 11 aa, Mycobacterium
SRKDQEKAVGE

SEQ ID NO: 287169 - protein, 9 aa, Mycobacterium
SRKDQERAV

SEQ ID NO: 287170 - protein, 9 aa, Mycobacterium
SRKDQERVA

SEQ ID NO: 287171 - protein, 6 aa, Mycobacterium
SRKDST

SEQ ID NO: 287172 - protein, 5 aa, Mycobacterium
SRKEG

SEQ ID NO: 287173 - protein, 6 aa, Mycobacterium
SRKEST

SEQ ID NO: 287174 - protein, 9 aa, Mycobacterium
SRKKATAAE

SEQ ID NO: 287175 - protein, 6 aa, Mycobacterium
SRKKSL

SEQ ID NO: 287176 - protein, 7 aa, Mycobacterium
SRKSPRR

SEQ ID NO: 287177 - protein, 4 aa, Mycobacterium
SRKV

SEQ ID NO: 287178 - protein, 11 aa, Mycobacterium
SRLAGGTGGRS

SEQ ID NO: 287179 - protein, 14 aa, Mycobacterium
SRLARGSHAERSAD

SEQ ID NO: 287180 - protein, 9 aa, Mycobacterium
SRLASSAAP

SEQ ID NO: 287181 - protein, 4 aa, Mycobacterium
SRLD

SEQ ID NO: 287182 - protein, 8 aa, Mycobacterium
SRLDPAAG

SEQ ID NO: 287183 - protein, 20 aa, Mycobacterium
SRLEEEPPNPAANPEKLYYL

SEQ ID NO: 287184 - protein, 9 aa, Mycobacterium
SRLESGDSV

SEQ ID NO: 287185 - protein, 13 aa, Mycobacterium
SRLGASKDPIEPL

SEQ ID NO: 287186 - protein, 6 aa, Mycobacterium
SRLGEA

SEQ ID NO: 287187 - protein, 9 aa, Mycobacterium
SRLKSGDTV

SEQ ID NO: 287188 - protein, 8 aa, Mycobacterium
SRLKTGQD

SEQ ID NO: 287189 - protein, 16 aa, Mycobacterium
SRLPQGSHAAGAPDGA

SEQ ID NO: 287190 - protein, 48 aa, Mycobacterium
SRLRTRSSGRSARSSKTAGATPGTSPPDEHDSDTAPDEGGDRTPADNG

SEQ ID NO: 287191 - protein, 6 aa, Mycobacterium
SRLSGH

SEQ ID NO: 287192 - protein, 6 aa, Mycobacterium
SRLSRG

SEQ ID NO: 287193 - protein, 10 aa, Mycobacterium
SRLTEHGSGI

SEQ ID NO: 287194 - protein, 8 aa, Mycobacterium
SRLTNPIS

SEQ ID NO: 287195 - protein, 11 aa, Mycobacterium
SRLTRGTTGFS

SEQ ID NO: 287196 - protein, 4 aa, Mycobacterium
SRMG

SEQ ID NO: 287197 - protein, 6 aa, Mycobacterium
SRMGEE

SEQ ID NO: 287198 - protein, 5 aa, Mycobacterium
SRMPG

SEQ ID NO: 287199 - protein, 5 aa, Mycobacterium
SRMSE

SEQ ID NO: 287200 - protein, 14 aa, Mycobacterium
SRNAAHRTESRARR

SEQ ID NO: 287201 - protein, 9 aa, Mycobacterium
SRNARAGRL

SEQ ID NO: 287202 - protein, 7 aa, Mycobacterium
SRNARDR

SEQ ID NO: 287203 - protein, 8 aa, Mycobacterium
SRNDDGVA

SEQ ID NO: 287204 - protein, 9 aa, Mycobacterium
SRNDSMGRS

SEQ ID NO: 287205 - protein, 6 aa, Mycobacterium
SRNGGI

SEQ ID NO: 287206 - protein, 7 aa, Mycobacterium
SRNGRQG

SEQ ID NO: 287207 - protein, 8 aa, Mycobacterium
SRNGRTRA

SEQ ID NO: 287208 - protein, 6 aa, Mycobacterium
SRNGSF

SEQ ID NO: 287209 - protein, 26 aa, Mycobacterium
SRNGWDARDPTSPAASWTPEQSRQYE

SEQ ID NO: 287210 - protein, 14 aa, Mycobacterium
SRNHNYSSRAANAA

SEQ ID NO: 287211 - protein, 10 aa, Mycobacterium
SRNPDRPPLD

SEQ ID NO: 287212 - protein, 10 aa, Mycobacterium
SRNPDTAGAA

SEQ ID NO: 287213 - protein, 5 aa, Mycobacterium
SRNPE

SEQ ID NO: 287214 - protein, 7 aa, Mycobacterium
SRNPKYA

SEQ ID NO: 287215 - protein, 47 aa, Mycobacterium
SRNPNATLPPSVNAPSAWSAPPAAATPSAASQGPSEPVSPSQSWSKQ

SEQ ID NO: 287216 - protein, 8 aa, Mycobacterium
SRNPRSAQ

SEQ ID NO: 287217 - protein, 14 aa, Mycobacterium
SRNREWDLGLRELV

SEQ ID NO: 287218 - protein, 11 aa, Mycobacterium
SRNSDQGRGEA

SEQ ID NO: 287219 - protein, 14 aa, Mycobacterium
SRNSMRDNGNISSA

SEQ ID NO: 287220 - protein, 10 aa, Mycobacterium
SRNSTSPPIK

SEQ ID NO: 287221 - protein, 10 aa, Mycobacterium
SRNTPPTRPI

SEQ ID NO: 287222 - protein, 7 aa, Mycobacterium
SRPAAAA

SEQ ID NO: 287223 - protein, 9 aa, Mycobacterium
SRPAADQTG

SEQ ID NO: 287224 - protein, 13 aa, Mycobacterium
SRPAASASPASPH

SEQ ID NO: 287225 - protein, 6 aa, Mycobacterium
SRPAAT

SEQ ID NO: 287226 - protein, 6 aa, Mycobacterium
SRPAGA

SEQ ID NO: 287227 - protein, 7 aa, Mycobacterium
SRPAGGY

SEQ ID NO: 287228 - protein, 14 aa, Mycobacterium
SRPAHTNDPRGLSY

SEQ ID NO: 287229 - protein, 5 aa, Mycobacterium
SRPAM

SEQ ID NO: 287230 - protein, 12 aa, Mycobacterium
SRPAPSTGDLVP

SEQ ID NO: 287231 - protein, 8 aa, Mycobacterium
SRPARGSY

SEQ ID NO: 287232 - protein, 28 aa, Mycobacterium
SRPARIRSAPRGPGEEPQTDRLMAMSGE

SEQ ID NO: 287233 - protein, 5 aa, Mycobacterium
SRPAS

SEQ ID NO: 287234 - protein, 6 aa, Mycobacterium
SRPDEP

SEQ ID NO: 287235 - protein, 10 aa, Mycobacterium
SRPDLPRSFR

SEQ ID NO: 287236 - protein, 7 aa, Mycobacterium
SRPDPQH

SEQ ID NO: 287237 - protein, 7 aa, Mycobacterium
SRPDRRA

SEQ ID NO: 287238 - protein, 8 aa, Mycobacterium
SRPDYPGD

SEQ ID NO: 287239 - protein, 8 aa, Mycobacterium
SRPFTDTN

SEQ ID NO: 287240 - protein, 9 aa, Mycobacterium
SRPGGRVGG

SEQ ID NO: 287241 - protein, 6 aa, Mycobacterium
SRPGHV

SEQ ID NO: 287242 - protein, 5 aa, Mycobacterium
SRPGR

SEQ ID NO: 287243 - protein, 5 aa, Mycobacterium
SRPGT

SEQ ID NO: 287244 - protein, 4 aa, Mycobacterium
SRPI

SEQ ID NO: 287245 - protein, 13 aa, Mycobacterium
SRPLPPTGWPAAQ

SEQ ID NO: 287246 - protein, 12 aa, Mycobacterium
SRPLRADDDELS

SEQ ID NO: 287247 - protein, 4 aa, Mycobacterium
SRPM

SEQ ID NO: 287248 - protein, 9 aa, Mycobacterium
SRPNAAQVA

SEQ ID NO: 287249 - protein, 7 aa, Mycobacterium
SRPPGDE

SEQ ID NO: 287250 - protein, 9 aa, Mycobacterium
SRPPGGVDS

SEQ ID NO: 287251 - protein, 10 aa, Mycobacterium
SRPPRDPDQP

SEQ ID NO: 287252 - protein, 7 aa, Mycobacterium
SRPPRLT

SEQ ID NO: 287253 - protein, 18 aa, Mycobacterium
SRPQTVPETAHSGDSRTA

SEQ ID NO: 287254 - protein, 12 aa, Mycobacterium
SRPRAALGADPE

SEQ ID NO: 287255 - protein, 5 aa, Mycobacterium
SRPRK

SEQ ID NO: 287256 - protein, 6 aa, Mycobacterium
SRPRPL

SEQ ID NO: 287257 - protein, 7 aa, Mycobacterium
SRPRPRH

SEQ ID NO: 287258 - protein, 24 aa, Mycobacterium
SRPRTQSVPSEEARYESRAMNHEW

SEQ ID NO: 287259 - protein, 24 aa, Mycobacterium
SRPSAAGDGYDPLATSASNLGPES

SEQ ID NO: 287260 - protein, 10 aa, Mycobacterium
SRPSRRRRAA

SEQ ID NO: 287261 - protein, 4 aa, Mycobacterium
SRPT

SEQ ID NO: 287262 - protein, 44 aa, Mycobacterium
SRPTGTTTGKPLPDRSLSPHRSTPTSASATPSAVPAARAIGQPE

SEQ ID NO: 287263 - protein, 6 aa, Mycobacterium
SRPTKH

SEQ ID NO: 287264 - protein, 9 aa, Mycobacterium
SRPTPASIT

SEQ ID NO: 287265 - protein, 7 aa, Mycobacterium
SRPVETY

SEQ ID NO: 287266 - protein, 7 aa, Mycobacterium
SRPVGAG

SEQ ID NO: 287267 - protein, 12 aa, Mycobacterium
SRPVGFSSASRN

SEQ ID NO: 287268 - protein, 14 aa, Mycobacterium
SRPWPDLGRPRRAG

SEQ ID NO: 287269 - protein, 12 aa, Mycobacterium
SRPYIGGSQNNS

SEQ ID NO: 287270 - protein, 8 aa, Mycobacterium
SRQAREQG

SEQ ID NO: 287271 - protein, 9 aa, Mycobacterium
SRQASNPST

SEQ ID NO: 287272 - protein, 5 aa, Mycobacterium
SRQER

SEQ ID NO: 287273 - protein, 10 aa, Mycobacterium
SRQERELAGA

SEQ ID NO: 287274 - protein, 6 aa, Mycobacterium
SRQEVE

SEQ ID NO: 287275 - protein, 16 aa, Mycobacterium
SRQEVSPKVTPARHEL

SEQ ID NO: 287276 - protein, 14 aa, Mycobacterium
SRQGRERARPRNAI

SEQ ID NO: 287277 - protein, 8 aa, Mycobacterium
SRQGRPAL

SEQ ID NO: 287278 - protein, 5 aa, Mycobacterium
SRQGY

SEQ ID NO: 287279 - protein, 8 aa, Mycobacterium
SRQHRGPV

SEQ ID NO: 287280 - protein, 6 aa, Mycobacterium
SRQKNA

SEQ ID NO: 287281 - protein, 24 aa, Mycobacterium
SRQNYPASKISPQHRVNGKPPTSI

SEQ ID NO: 287282 - protein, 25 aa, Mycobacterium
SRQNYPERMTSKEHRVNGKPPTSAE

SEQ ID NO: 287283 - protein, 6 aa, Mycobacterium
SRQPAF

SEQ ID NO: 287284 - protein, 12 aa, Mycobacterium
SRQQSGDANPFP

SEQ ID NO: 287285 - protein, 10 aa, Mycobacterium
SRQQSHETPF

SEQ ID NO: 287286 - protein, 8 aa, Mycobacterium
SRQSPNGT

SEQ ID NO: 287287 - protein, 4 aa, Mycobacterium
SRRA

SEQ ID NO: 287288 - protein, 11 aa, Mycobacterium
SRRAAAHNATM

SEQ ID NO: 287289 - protein, 10 aa, Mycobacterium
SRRAARGPVR

SEQ ID NO: 287290 - protein, 8 aa, Mycobacterium
SRRAPDRK

SEQ ID NO: 287291 - protein, 6 aa, Mycobacterium
SRRARD

SEQ ID NO: 287292 - protein, 12 aa, Mycobacterium
SRRARDRAAAAL

SEQ ID NO: 287293 - protein, 14 aa, Mycobacterium
SRRARDRAADALRT

SEQ ID NO: 287294 - protein, 5 aa, Mycobacterium
SRRAV

SEQ ID NO: 287295 - protein, 12 aa, Mycobacterium
SRRCRGPSPDPS

SEQ ID NO: 287296 - protein, 5 aa, Mycobacterium
SRRDA

SEQ ID NO: 287297 - protein, 13 aa, Mycobacterium
SRRGAPPPDVTAS

SEQ ID NO: 287298 - protein, 5 aa, Mycobacterium
SRRGD

SEQ ID NO: 287299 - protein, 7 aa, Mycobacterium
SRRGLER

SEQ ID NO: 287300 - protein, 10 aa, Mycobacterium
SRRGPIPSYD

SEQ ID NO: 287301 - protein, 5 aa, Mycobacterium
SRRGR

SEQ ID NO: 287302 - protein, 21 aa, Mycobacterium
SRRGSSGRPGARSAADDGSNP

SEQ ID NO: 287303 - protein, 9 aa, Mycobacterium
SRRHDAAGN

SEQ ID NO: 287304 - protein, 11 aa, Mycobacterium
SRRHGTQEAKA

SEQ ID NO: 287305 - protein, 54 aa, Mycobacterium
SRRKPDAAPLADAGVGSKTAKVATSGTSDAAATGVRPAKPKPGARPQGKRNTRR

SEQ ID NO: 287306 - protein, 21 aa, Mycobacterium
SRRLPKAAGRQRTSSAHRDGL

SEQ ID NO: 287307 - protein, 4 aa, Mycobacterium
SRRN

SEQ ID NO: 287308 - protein, 9 aa, Mycobacterium
SRRNHGRSR

SEQ ID NO: 287309 - protein, 6 aa, Mycobacterium
SRRNRT

SEQ ID NO: 287310 - protein, 21 aa, Mycobacterium
SRRPATPTDSPGAQEVTPTNT

SEQ ID NO: 287311 - protein, 6 aa, Mycobacterium
SRRPEL

SEQ ID NO: 287312 - protein, 7 aa, Mycobacterium
SRRPGES

SEQ ID NO: 287313 - protein, 5 aa, Mycobacterium
SRRPI

SEQ ID NO: 287314 - protein, 5 aa, Mycobacterium
SRRPL

SEQ ID NO: 287315 - protein, 11 aa, Mycobacterium
SRRPPAGLSPA

SEQ ID NO: 287316 - protein, 12 aa, Mycobacterium
SRRPPAGLSPAE

SEQ ID NO: 287317 - protein, 13 aa, Mycobacterium
SRRPPAGLSPGEL

SEQ ID NO: 287318 - protein, 9 aa, Mycobacterium
SRRPPAGMS

SEQ ID NO: 287319 - protein, 6 aa, Mycobacterium
SRRPTA

SEQ ID NO: 287320 - protein, 4 aa, Mycobacterium
SRRQ

SEQ ID NO: 287321 - protein, 53 aa, Mycobacterium
SRRQRRTEAEAEAIAEAEAEAEAAAEAAAEAAEAEAAEAAAADAQPPRATGTV

SEQ ID NO: 287322 - protein, 6 aa, Mycobacterium
SRRREQ

SEQ ID NO: 287323 - protein, 6 aa, Mycobacterium
SRRRKG

SEQ ID NO: 287324 - protein, 9 aa, Mycobacterium
SRRRRTANR

SEQ ID NO: 287325 - protein, 7 aa, Mycobacterium
SRRRTNA

SEQ ID NO: 287326 - protein, 4 aa, Mycobacterium
SRRS

SEQ ID NO: 287327 - protein, 8 aa, Mycobacterium
SRRSPIPG

SEQ ID NO: 287328 - protein, 4 aa, Mycobacterium
SRRT

SEQ ID NO: 287329 - protein, 8 aa, Mycobacterium
SRRTHTDR

SEQ ID NO: 287330 - protein, 5 aa, Mycobacterium
SRRVP

SEQ ID NO: 287331 - protein, 9 aa, Mycobacterium
SRRYDAAGN

SEQ ID NO: 287332 - protein, 13 aa, Mycobacterium
SRSAATPATTKED

SEQ ID NO: 287333 - protein, 16 aa, Mycobacterium
SRSAPVDEDEIGGTAA

SEQ ID NO: 287334 - protein, 6 aa, Mycobacterium
SRSAQT

SEQ ID NO: 287335 - protein, 7 aa, Mycobacterium
SRSATEA

SEQ ID NO: 287336 - protein, 8 aa, Mycobacterium
SRSDPRAP

SEQ ID NO: 287337 - protein, 19 aa, Mycobacterium
SRSDQEPPEPEDLSRSTRE

SEQ ID NO: 287338 - protein, 7 aa, Mycobacterium
SRSEQTW

SEQ ID NO: 287339 - protein, 7 aa, Mycobacterium
SRSGATI

SEQ ID NO: 287340 - protein, 6 aa, Mycobacterium
SRSGDE

SEQ ID NO: 287341 - protein, 10 aa, Mycobacterium
SRSGDIPPGI

SEQ ID NO: 287342 - protein, 8 aa, Mycobacterium
SRSGDTVN

SEQ ID NO: 287343 - protein, 10 aa, Mycobacterium
SRSGERGRDR

SEQ ID NO: 287344 - protein, 9 aa, Mycobacterium
SRSGSSPMA

SEQ ID NO: 287345 - protein, 13 aa, Mycobacterium
SRSHDPATGESLA

SEQ ID NO: 287346 - protein, 8 aa, Mycobacterium
SRSHPTPL

SEQ ID NO: 287347 - protein, 31 aa, Mycobacterium
SRSKPDAQEGDCAVSDDPEAASGESSPEEPL

SEQ ID NO: 287348 - protein, 4 aa, Mycobacterium
SRSL

SEQ ID NO: 287349 - protein, 5 aa, Mycobacterium
SRSLR

SEQ ID NO: 287350 - protein, 13 aa, Mycobacterium
SRSLTKDAVTSPL

SEQ ID NO: 287351 - protein, 6 aa, Mycobacterium
SRSNEQ

SEQ ID NO: 287352 - protein, 4 aa, Mycobacterium
SRSR

SEQ ID NO: 287353 - protein, 14 aa, Mycobacterium
SRSRGPAAARNTGL

SEQ ID NO: 287354 - protein, 8 aa, Mycobacterium
SRSRSDDQ

SEQ ID NO: 287355 - protein, 8 aa, Mycobacterium
SRSRYSDR

SEQ ID NO: 287356 - protein, 13 aa, Mycobacterium
SRSTQAPGKRRSR

SEQ ID NO: 287357 - protein, 6 aa, Mycobacterium
SRSTTR

SEQ ID NO: 287358 - protein, 5 aa, Mycobacterium
SRSVA

SEQ ID NO: 287359 - protein, 4 aa, Mycobacterium
SRTA

SEQ ID NO: 287360 - protein, 6 aa, Mycobacterium
SRTAAQ

SEQ ID NO: 287361 - protein, 13 aa, Mycobacterium
SRTAPDQPRPPVA

SEQ ID NO: 287362 - protein, 75 aa, Mycobacterium
SRTAQQPGQPLGDTEQQPRPAPRPEPRETRQEPRPEHRTEAYASELPDLSGPVPRSPQRKTGADAPRASAPTTRI

SEQ ID NO: 287363 - protein, 8 aa, Mycobacterium
SRTDGAGN

SEQ ID NO: 287364 - protein, 6 aa, Mycobacterium
SRTEQP

SEQ ID NO: 287365 - protein, 7 aa, Mycobacterium
SRTEREI

SEQ ID NO: 287366 - protein, 6 aa, Mycobacterium
SRTERP

SEQ ID NO: 287367 - protein, 13 aa, Mycobacterium
SRTESGSAALSGF

SEQ ID NO: 287368 - protein, 4 aa, Mycobacterium
SRTF

SEQ ID NO: 287369 - protein, 10 aa, Mycobacterium
SRTGAETTYG

SEQ ID NO: 287370 - protein, 8 aa, Mycobacterium
SRTGEASN

SEQ ID NO: 287371 - protein, 12 aa, Mycobacterium
SRTGGANATNSI

SEQ ID NO: 287372 - protein, 9 aa, Mycobacterium
SRTGGAPTL

SEQ ID NO: 287373 - protein, 24 aa, Mycobacterium
SRTGPPPPPPPAEQPAELGDPSHT

SEQ ID NO: 287374 - protein, 7 aa, Mycobacterium
SRTGQKV

SEQ ID NO: 287375 - protein, 26 aa, Mycobacterium
SRTGRGGDPFGPDEDDIVDDDYDDDE

SEQ ID NO: 287376 - protein, 9 aa, Mycobacterium
SRTGTGFGR

SEQ ID NO: 287377 - protein, 9 aa, Mycobacterium
SRTGTVGDY

SEQ ID NO: 287378 - protein, 5 aa, Mycobacterium
SRTHS

SEQ ID NO: 287379 - protein, 10 aa, Mycobacterium
SRTKSREELE

SEQ ID NO: 287380 - protein, 4 aa, Mycobacterium
SRTP

SEQ ID NO: 287381 - protein, 15 aa, Mycobacterium
SRTPTSSRNVQSAVS

SEQ ID NO: 287382 - protein, 5 aa, Mycobacterium
SRTPV

SEQ ID NO: 287383 - protein, 5 aa, Mycobacterium
SRTRD

SEQ ID NO: 287384 - protein, 7 aa, Mycobacterium
SRTRDEW

SEQ ID NO: 287385 - protein, 5 aa, Mycobacterium
SRTRP

SEQ ID NO: 287386 - protein, 6 aa, Mycobacterium
SRTRRG

SEQ ID NO: 287387 - protein, 8 aa, Mycobacterium
SRTRRSSH

SEQ ID NO: 287388 - protein, 7 aa, Mycobacterium
SRTSDAL

SEQ ID NO: 287389 - protein, 4 aa, Mycobacterium
SRTT

SEQ ID NO: 287390 - protein, 10 aa, Mycobacterium
SRTTQPHAGE

SEQ ID NO: 287391 - protein, 8 aa, Mycobacterium
SRTTTPYT

SEQ ID NO: 287392 - protein, 12 aa, Mycobacterium
SRTYGTAEDGEY

SEQ ID NO: 287393 - protein, 5 aa, Mycobacterium
SRVEK

SEQ ID NO: 287394 - protein, 4 aa, Mycobacterium
SRVG

SEQ ID NO: 287395 - protein, 15 aa, Mycobacterium
SRVGPPAGATGFSDG

SEQ ID NO: 287396 - protein, 34 aa, Mycobacterium
SRVGRAAASHRRVGGREHRGPALAGSGRDDPELA

SEQ ID NO: 287397 - protein, 4 aa, Mycobacterium
SRVP

SEQ ID NO: 287398 - protein, 8 aa, Mycobacterium
SRVPGGTV

SEQ ID NO: 287399 - protein, 14 aa, Mycobacterium
SRVPPIPRPPADTV

SEQ ID NO: 287400 - protein, 15 aa, Mycobacterium
SRVTNGGNGKEEPRE

SEQ ID NO: 287401 - protein, 15 aa, Mycobacterium
SRVTNTAGADQEPRT

SEQ ID NO: 287402 - protein, 8 aa, Mycobacterium
SRWTPSRV

SEQ ID NO: 287403 - protein, 8 aa, Mycobacterium
SRYASDSG

SEQ ID NO: 287404 - protein, 4 aa, Mycobacterium
SRYD

SEQ ID NO: 287405 - protein, 7 aa, Mycobacterium
SRYGGDP

SEQ ID NO: 287406 - protein, 5 aa, Mycobacterium
SRYPR

SEQ ID NO: 287407 - protein, 40 aa, Mycobacterium
SRYTPGEGRLPAAGHAPELATRGAPRDLGASEGPRQLPPP

SEQ ID NO: 287408 - protein, 5 aa, Mycobacterium
SSAAA

SEQ ID NO: 287409 - protein, 13 aa, Mycobacterium
SSAAPGAPAPAEP

SEQ ID NO: 287410 - protein, 7 aa, Mycobacterium
SSAASAV

SEQ ID NO: 287411 - protein, 18 aa, Mycobacterium
SSAATPMASASGGSPGHH

SEQ ID NO: 287412 - protein, 11 aa, Mycobacterium
SSADGGIAPDE

SEQ ID NO: 287413 - protein, 8 aa, Mycobacterium
SSAEPALP

SEQ ID NO: 287414 - protein, 11 aa, Mycobacterium
SSAERGSLDPV

SEQ ID NO: 287415 - protein, 8 aa, Mycobacterium
SSAETLGS

SEQ ID NO: 287416 - protein, 18 aa, Mycobacterium
SSAGGPVQVDTDTPKPQW

SEQ ID NO: 287417 - protein, 7 aa, Mycobacterium
SSAGIAG

SEQ ID NO: 287418 - protein, 20 aa, Mycobacterium
SSAGLPGGLGLGGGSGFGSM

SEQ ID NO: 287419 - protein, 10 aa, Mycobacterium
SSAGNRPTYA

SEQ ID NO: 287420 - protein, 9 aa, Mycobacterium
SSAGNSRSR

SEQ ID NO: 287421 - protein, 8 aa, Mycobacterium
SSAGPPPV

SEQ ID NO: 287422 - protein, 9 aa, Mycobacterium
SSAGSAAAA

SEQ ID NO: 287423 - protein, 16 aa, Mycobacterium
SSAGSIDVSATSAIGS

SEQ ID NO: 287424 - protein, 8 aa, Mycobacterium
SSAGSRVT

SEQ ID NO: 287425 - protein, 8 aa, Mycobacterium
SSAHVGTA

SEQ ID NO: 287426 - protein, 7 aa, Mycobacterium
SSAIGSG

SEQ ID NO: 287427 - protein, 20 aa, Mycobacterium
SSAKFAPATDRSRSGVGDVD

SEQ ID NO: 287428 - protein, 19 aa, Mycobacterium
SSAKFAPVADRSGTGVGDV

SEQ ID NO: 287429 - protein, 4 aa, Mycobacterium
SSAL

SEQ ID NO: 287430 - protein, 9 aa, Mycobacterium
SSANFTAPP

SEQ ID NO: 287431 - protein, 9 aa, Mycobacterium
SSANGATVA

SEQ ID NO: 287432 - protein, 20 aa, Mycobacterium
SSANGGAVGEPGSQQRYREE

SEQ ID NO: 287433 - protein, 8 aa, Mycobacterium
SSANGSGS

SEQ ID NO: 287434 - protein, 10 aa, Mycobacterium
SSANRPGKPR

SEQ ID NO: 287435 - protein, 9 aa, Mycobacterium
SSANSGGHL

SEQ ID NO: 287436 - protein, 4 aa, Mycobacterium
SSAP

SEQ ID NO: 287437 - protein, 9 aa, Mycobacterium
SSAPDSTGR

SEQ ID NO: 287438 - protein, 8 aa, Mycobacterium
SSAPEGLA

SEQ ID NO: 287439 - protein, 7 aa, Mycobacterium
SSAPFPD

SEQ ID NO: 287440 - protein, 9 aa, Mycobacterium
SSAPNPRWG

SEQ ID NO: 287441 - protein, 12 aa, Mycobacterium
SSAPTPEAAAGP

SEQ ID NO: 287442 - protein, 8 aa, Mycobacterium
SSAPVSVP

SEQ ID NO: 287443 - protein, 20 aa, Mycobacterium
SSAPWSPTRGRSTSPAGACR

SEQ ID NO: 287444 - protein, 14 aa, Mycobacterium
SSARFSPRTPGGDP

SEQ ID NO: 287445 - protein, 8 aa, Mycobacterium
SSARISGD

SEQ ID NO: 287446 - protein, 5 aa, Mycobacterium
SSARQ

SEQ ID NO: 287447 - protein, 13 aa, Mycobacterium
SSARSGALDASTA

SEQ ID NO: 287448 - protein, 13 aa, Mycobacterium
SSARSGSLDPATA

SEQ ID NO: 287449 - protein, 4 aa, Mycobacterium
SSAS

SEQ ID NO: 287450 - protein, 10 aa, Mycobacterium
SSASPGQTED

SEQ ID NO: 287451 - protein, 14 aa, Mycobacterium
SSASTIGANRASRA

SEQ ID NO: 287452 - protein, 9 aa, Mycobacterium
SSATAGTVT

SEQ ID NO: 287453 - protein, 7 aa, Mycobacterium
SSATGGL

SEQ ID NO: 287454 - protein, 16 aa, Mycobacterium
SSATPEQPYPDDPRSA

SEQ ID NO: 287455 - protein, 15 aa, Mycobacterium
SSATTAGSDEDVQTT

SEQ ID NO: 287456 - protein, 17 aa, Mycobacterium
SSAVASAGDGPPSVAPE

SEQ ID NO: 287457 - protein, 7 aa, Mycobacterium
SSAVQRE

SEQ ID NO: 287458 - protein, 9 aa, Mycobacterium
SSCGPTDHI

SEQ ID NO: 287459 - protein, 27 aa, Mycobacterium
SSCVGAGGYSDVNPGTPVTVKNGKGEI

SEQ ID NO: 287460 - protein, 4 aa, Mycobacterium
SSDA

SEQ ID NO: 287461 - protein, 10 aa, Mycobacterium
SSDAANSITV

SEQ ID NO: 287462 - protein, 5 aa, Mycobacterium
SSDAG

SEQ ID NO: 287463 - protein, 4 aa, Mycobacterium
SSDD

SEQ ID NO: 287464 - protein, 8 aa, Mycobacterium
SSDDADEV

SEQ ID NO: 287465 - protein, 7 aa, Mycobacterium
SSDDGYN

SEQ ID NO: 287466 - protein, 19 aa, Mycobacterium
SSDDQLDQREPAGDPGDSI

SEQ ID NO: 287467 - protein, 4 aa, Mycobacterium
SSDG

SEQ ID NO: 287468 - protein, 5 aa, Mycobacterium
SSDGN

SEQ ID NO: 287469 - protein, 5 aa, Mycobacterium
SSDGP

SEQ ID NO: 287470 - protein, 9 aa, Mycobacterium
SSDGPVTNG

SEQ ID NO: 287471 - protein, 8 aa, Mycobacterium
SSDGTTVL

SEQ ID NO: 287472 - protein, 6 aa, Mycobacterium
SSDKAD

SEQ ID NO: 287473 - protein, 8 aa, Mycobacterium
SSDKGTFA

SEQ ID NO: 287474 - protein, 9 aa, Mycobacterium
SSDLRNPRA

SEQ ID NO: 287475 - protein, 5 aa, Mycobacterium
SSDNL

SEQ ID NO: 287476 - protein, 8 aa, Mycobacterium
SSDPANAI

SEQ ID NO: 287477 - protein, 22 aa, Mycobacterium
SSDPVPEAPSAAAASAPPALST

SEQ ID NO: 287478 - protein, 12 aa, Mycobacterium
SSDRPDRIPSTS

SEQ ID NO: 287479 - protein, 17 aa, Mycobacterium
SSDRQVRPQARAPRAHD

SEQ ID NO: 287480 - protein, 10 aa, Mycobacterium
SSDSAAVSAA

SEQ ID NO: 287481 - protein, 14 aa, Mycobacterium
SSDSAIPDFGDAPR

SEQ ID NO: 287482 - protein, 5 aa, Mycobacterium
SSDSL

SEQ ID NO: 287483 - protein, 8 aa, Mycobacterium
SSDTLDKD

SEQ ID NO: 287484 - protein, 11 aa, Mycobacterium
SSDTRSAGGAA

SEQ ID NO: 287485 - protein, 6 aa, Mycobacterium
SSDTTH

SEQ ID NO: 287486 - protein, 56 aa, Mycobacterium
SSDVVDDEKPEVNEKPEADKKPAKDEKPEETTSEPDEAATVKSKSKTDSEKSRARV

SEQ ID NO: 287487 - protein, 4 aa, Mycobacterium
SSEA

SEQ ID NO: 287488 - protein, 7 aa, Mycobacterium
SSEAATD

SEQ ID NO: 287489 - protein, 8 aa, Mycobacterium
SSEAATDV

SEQ ID NO: 287490 - protein, 9 aa, Mycobacterium
SSEAETVSA

SEQ ID NO: 287491 - protein, 8 aa, Mycobacterium
SSEAQTVS

SEQ ID NO: 287492 - protein, 6 aa, Mycobacterium
SSEASL

SEQ ID NO: 287493 - protein, 13 aa, Mycobacterium
SSEEGFGTQVTVI

SEQ ID NO: 287494 - protein, 7 aa, Mycobacterium
SSEEPLF

SEQ ID NO: 287495 - protein, 9 aa, Mycobacterium
SSEGSSALR

SEQ ID NO: 287496 - protein, 8 aa, Mycobacterium
SSEHEPAT

SEQ ID NO: 287497 - protein, 5 aa, Mycobacterium
SSEHM

SEQ ID NO: 287498 - protein, 9 aa, Mycobacterium
SSEKVTNTL

SEQ ID NO: 287499 - protein, 5 aa, Mycobacterium
SSELS

SEQ ID NO: 287500 - protein, 5 aa, Mycobacterium
SSELT

SEQ ID NO: 287501 - protein, 4 aa, Mycobacterium
SSER

SEQ ID NO: 287502 - protein, 6 aa, Mycobacterium
SSERVK

SEQ ID NO: 287503 - protein, 7 aa, Mycobacterium
SSESGSL

SEQ ID NO: 287504 - protein, 5 aa, Mycobacterium
SSESL

SEQ ID NO: 287505 - protein, 6 aa, Mycobacterium
SSETAG

SEQ ID NO: 287506 - protein, 11 aa, Mycobacterium
SSETPDPGGYG

SEQ ID NO: 287507 - protein, 6 aa, Mycobacterium
SSEWSK

SEQ ID NO: 287508 - protein, 7 aa, Mycobacterium
SSEYASV

SEQ ID NO: 287509 - protein, 11 aa, Mycobacterium
SSFAGPLPTTG

SEQ ID NO: 287510 - protein, 9 aa, Mycobacterium
SSFDPPERV

SEQ ID NO: 287511 - protein, 12 aa, Mycobacterium
SSFNDPGERERL

SEQ ID NO: 287512 - protein, 15 aa, Mycobacterium
SSFPPAVRDPATDSL

SEQ ID NO: 287513 - protein, 11 aa, Mycobacterium
SSGAAERTRDA

SEQ ID NO: 287514 - protein, 10 aa, Mycobacterium
SSGAGDGQAA

SEQ ID NO: 287515 - protein, 18 aa, Mycobacterium
SSGAGGTHDDGTVVAPNP

SEQ ID NO: 287516 - protein, 8 aa, Mycobacterium
SSGASTGA

SEQ ID NO: 287517 - protein, 13 aa, Mycobacterium
SSGATSSARSMTD

SEQ ID NO: 287518 - protein, 5 aa, Mycobacterium
SSGAY

SEQ ID NO: 287519 - protein, 8 aa, Mycobacterium
SSGDDPAK

SEQ ID NO: 287520 - protein, 7 aa, Mycobacterium
SSGDPDV

SEQ ID NO: 287521 - protein, 118 aa, Mycobacterium
SSGEQPATRSPEATTSPPTSAPAAVPPVTDAGTSAPAPSTQPPASQEPAPPPTQQAPPPPSTEAPPPSTTQAPVTTQPPATTEAPPATTQPPVTTEAPPTTQAPATQQLPTPPPIPPI

SEQ ID NO: 287522 - protein, 11 aa, Mycobacterium
SSGGAQNLPFG

SEQ ID NO: 287523 - protein, 18 aa, Mycobacterium
SSGGDPPLPASDRGPDVP

SEQ ID NO: 287524 - protein, 10 aa, Mycobacterium
SSGGGLGGQH

SEQ ID NO: 287525 - protein, 5 aa, Mycobacterium
SSGGM

SEQ ID NO: 287526 - protein, 5 aa, Mycobacterium
SSGGP

SEQ ID NO: 287527 - protein, 10 aa, Mycobacterium
SSGGRIDEGA

SEQ ID NO: 287528 - protein, 8 aa, Mycobacterium
SSGGSTGS

SEQ ID NO: 287529 - protein, 8 aa, Mycobacterium
SSGGTSTA

SEQ ID NO: 287530 - protein, 9 aa, Mycobacterium
SSGGTSTAT

SEQ ID NO: 287531 - protein, 10 aa, Mycobacterium
SSGHTGGSDI

SEQ ID NO: 287532 - protein, 4 aa, Mycobacterium
SSGI

SEQ ID NO: 287533 - protein, 5 aa, Mycobacterium
SSGIG

SEQ ID NO: 287534 - protein, 6 aa, Mycobacterium
SSGIGD

SEQ ID NO: 287535 - protein, 4 aa, Mycobacterium
SSGK

SEQ ID NO: 287536 - protein, 5 aa, Mycobacterium
SSGKD

SEQ ID NO: 287537 - protein, 9 aa, Mycobacterium
SSGKSYSAY

SEQ ID NO: 287538 - protein, 42 aa, Mycobacterium
SSGLEEPETEPETAEDEAPAAAMSSSRQRRMESKTAAQVSER

SEQ ID NO: 287539 - protein, 5 aa, Mycobacterium
SSGLR

SEQ ID NO: 287540 - protein, 8 aa, Mycobacterium
SSGLTDRP

SEQ ID NO: 287541 - protein, 13 aa, Mycobacterium
SSGNGLASLRSPS

SEQ ID NO: 287542 - protein, 9 aa, Mycobacterium
SSGNPGKYL

SEQ ID NO: 287543 - protein, 10 aa, Mycobacterium
SSGNSTGVAN

SEQ ID NO: 287544 - protein, 4 aa, Mycobacterium
SSGP

SEQ ID NO: 287545 - protein, 5 aa, Mycobacterium
SSGPG

SEQ ID NO: 287546 - protein, 9 aa, Mycobacterium
SSGPGAASL

SEQ ID NO: 287547 - protein, 9 aa, Mycobacterium
SSGPGAGPM

SEQ ID NO: 287548 - protein, 32 aa, Mycobacterium
SSGPGNVAEQASPTLVASSDPAANPEGQDAAA

SEQ ID NO: 287549 - protein, 10 aa, Mycobacterium
SSGPGPGPLL

SEQ ID NO: 287550 - protein, 8 aa, Mycobacterium
SSGPGPGS

SEQ ID NO: 287551 - protein, 9 aa, Mycobacterium
SSGPGPGSL

SEQ ID NO: 287552 - protein, 12 aa, Mycobacterium
SSGPLPDQADPA

SEQ ID NO: 287553 - protein, 8 aa, Mycobacterium
SSGPPPNL

SEQ ID NO: 287554 - protein, 5 aa, Mycobacterium
SSGQS

SEQ ID NO: 287555 - protein, 6 aa, Mycobacterium
SSGRLA

SEQ ID NO: 287556 - protein, 7 aa, Mycobacterium
SSGRTAL

SEQ ID NO: 287557 - protein, 4 aa, Mycobacterium
SSGS

SEQ ID NO: 287558 - protein, 10 aa, Mycobacterium
SSGSAPGFAT

SEQ ID NO: 287559 - protein, 9 aa, Mycobacterium
SSGSGTADV

SEQ ID NO: 287560 - protein, 22 aa, Mycobacterium
SSGSLDEDLDEDGDAARAGSLD

SEQ ID NO: 287561 - protein, 14 aa, Mycobacterium
SSGSQGGSAAHSTG

SEQ ID NO: 287562 - protein, 15 aa, Mycobacterium
SSGSRQQRQHDPGRD

SEQ ID NO: 287563 - protein, 6 aa, Mycobacterium
SSGSYY

SEQ ID NO: 287564 - protein, 9 aa, Mycobacterium
SSGTAAGAK

SEQ ID NO: 287565 - protein, 7 aa, Mycobacterium
SSGTADR

SEQ ID NO: 287566 - protein, 10 aa, Mycobacterium
SSGTTANPKG

SEQ ID NO: 287567 - protein, 10 aa, Mycobacterium
SSGTTGNPKG

SEQ ID NO: 287568 - protein, 9 aa, Mycobacterium
SSGTTPKLL

SEQ ID NO: 287569 - protein, 12 aa, Mycobacterium
SSGTVETLEKAS

SEQ ID NO: 287570 - protein, 48 aa, Mycobacterium
SSGTVGQRPSGGTTVAPKGATITTKSGTTISRGGLGGSGGKGGGGSSG

SEQ ID NO: 287571 - protein, 6 aa, Mycobacterium
SSGTVT

SEQ ID NO: 287572 - protein, 7 aa, Mycobacterium
SSGVRTY

SEQ ID NO: 287573 - protein, 5 aa, Mycobacterium
SSGVY

SEQ ID NO: 287574 - protein, 5 aa, Mycobacterium
SSHAG

SEQ ID NO: 287575 - protein, 11 aa, Mycobacterium
SSHDQRSDLDR

SEQ ID NO: 287576 - protein, 9 aa, Mycobacterium
SSHGENLPQ

SEQ ID NO: 287577 - protein, 4 aa, Mycobacterium
SSHP

SEQ ID NO: 287578 - protein, 5 aa, Mycobacterium
SSHPL

SEQ ID NO: 287579 - protein, 9 aa, Mycobacterium
SSHPRPGAL

SEQ ID NO: 287580 - protein, 26 aa, Mycobacterium
SSHRITPERGEPGGAVQPSGRSSPGT

SEQ ID NO: 287581 - protein, 10 aa, Mycobacterium
SSHRSVTDTL

SEQ ID NO: 287582 - protein, 6 aa, Mycobacterium
SSIEGN

SEQ ID NO: 287583 - protein, 10 aa, Mycobacterium
SSIGQAGSTI

SEQ ID NO: 287584 - protein, 6 aa, Mycobacterium
SSIGRT

SEQ ID NO: 287585 - protein, 23 aa, Mycobacterium
SSIGSARLEATAGSETVSDSRSL

SEQ ID NO: 287586 - protein, 4 aa, Mycobacterium
SSIL

SEQ ID NO: 287587 - protein, 8 aa, Mycobacterium
SSIPPEAT

SEQ ID NO: 287588 - protein, 13 aa, Mycobacterium
SSITTTDARRRTV

SEQ ID NO: 287589 - protein, 27 aa, Mycobacterium
SSKAFSPKDAFAGNQDPATRRKAGDIR

SEQ ID NO: 287590 - protein, 14 aa, Mycobacterium
SSKAQIDPTHLTDA

SEQ ID NO: 287591 - protein, 8 aa, Mycobacterium
SSKARDDV

SEQ ID NO: 287592 - protein, 8 aa, Mycobacterium
SSKDNKAW

SEQ ID NO: 287593 - protein, 6 aa, Mycobacterium
SSKDYG

SEQ ID NO: 287594 - protein, 5 aa, Mycobacterium
SSKGP

SEQ ID NO: 287595 - protein, 14 aa, Mycobacterium
SSKHNGPGLESDVP

SEQ ID NO: 287596 - protein, 7 aa, Mycobacterium
SSKRAGL

SEQ ID NO: 287597 - protein, 8 aa, Mycobacterium
SSKRPGVF

SEQ ID NO: 287598 - protein, 12 aa, Mycobacterium
SSKSRSSAPGHG

SEQ ID NO: 287599 - protein, 14 aa, Mycobacterium
SSKTLSRDANGVVD

SEQ ID NO: 287600 - protein, 7 aa, Mycobacterium
SSKTYRE

SEQ ID NO: 287601 - protein, 30 aa, Mycobacterium
SSLAAGPPPAPPGATLAPPPPSAPPATLGT

SEQ ID NO: 287602 - protein, 9 aa, Mycobacterium
SSLAERASA

SEQ ID NO: 287603 - protein, 9 aa, Mycobacterium
SSLAETPKT

SEQ ID NO: 287604 - protein, 25 aa, Mycobacterium
SSLANTATSAVKTAASATVSGAKAV

SEQ ID NO: 287605 - protein, 13 aa, Mycobacterium
SSLEDKKRRLADP

SEQ ID NO: 287606 - protein, 9 aa, Mycobacterium
SSLGADPRR

SEQ ID NO: 287607 - protein, 31 aa, Mycobacterium
SSLPSADQSAPPPAPRPAAPPRQHPPDNPGH

SEQ ID NO: 287608 - protein, 14 aa, Mycobacterium
SSLQDASADLGASS

SEQ ID NO: 287609 - protein, 8 aa, Mycobacterium
SSLQGQTD

SEQ ID NO: 287610 - protein, 25 aa, Mycobacterium
SSLQPVADNPAGRPALPYSPPSNPV

SEQ ID NO: 287611 - protein, 28 aa, Mycobacterium
SSLQSPARFAPYGPGSARAGADGSGPEG

SEQ ID NO: 287612 - protein, 15 aa, Mycobacterium
SSLRENISASAKPDT

SEQ ID NO: 287613 - protein, 6 aa, Mycobacterium
SSLSTE

SEQ ID NO: 287614 - protein, 9 aa, Mycobacterium
SSLTERQAE

SEQ ID NO: 287615 - protein, 6 aa, Mycobacterium
SSMPDG

SEQ ID NO: 287616 - protein, 4 aa, Mycobacterium
SSMR

SEQ ID NO: 287617 - protein, 6 aa, Mycobacterium
SSNGAF

SEQ ID NO: 287618 - protein, 4 aa, Mycobacterium
SSNI

SEQ ID NO: 287619 - protein, 15 aa, Mycobacterium
SSNLTGGGFEVEGSQ

SEQ ID NO: 287620 - protein, 10 aa, Mycobacterium
SSNPALSNHA

SEQ ID NO: 287621 - protein, 9 aa, Mycobacterium
SSNPFADPH

SEQ ID NO: 287622 - protein, 7 aa, Mycobacterium
SSNQTSW

SEQ ID NO: 287623 - protein, 9 aa, Mycobacterium
SSNRATRLR

SEQ ID NO: 287624 - protein, 18 aa, Mycobacterium
SSNRFADDAGGSGVGDVG

SEQ ID NO: 287625 - protein, 8 aa, Mycobacterium
SSNSPISG

SEQ ID NO: 287626 - protein, 7 aa, Mycobacterium
SSNTAAG

SEQ ID NO: 287627 - protein, 16 aa, Mycobacterium
SSPAPDAKLSDITGPL

SEQ ID NO: 287628 - protein, 17 aa, Mycobacterium
SSPAPPAGAKSRAGRNL

SEQ ID NO: 287629 - protein, 6 aa, Mycobacterium
SSPAVR

SEQ ID NO: 287630 - protein, 8 aa, Mycobacterium
SSPDGDNE

SEQ ID NO: 287631 - protein, 9 aa, Mycobacterium
SSPDPAVRD

SEQ ID NO: 287632 - protein, 6 aa, Mycobacterium
SSPDVN

SEQ ID NO: 287633 - protein, 12 aa, Mycobacterium
SSPEKARAAVTQ

SEQ ID NO: 287634 - protein, 6 aa, Mycobacterium
SSPEPY

SEQ ID NO: 287635 - protein, 4 aa, Mycobacterium
SSPF

SEQ ID NO: 287636 - protein, 10 aa, Mycobacterium
SSPFEDDQDP

SEQ ID NO: 287637 - protein, 15 aa, Mycobacterium
SSPFWSDGSDTGYSS

SEQ ID NO: 287638 - protein, 7 aa, Mycobacterium
SSPHGDD

SEQ ID NO: 287639 - protein, 6 aa, Mycobacterium
SSPIPA

SEQ ID NO: 287640 - protein, 8 aa, Mycobacterium
SSPKAAVD

SEQ ID NO: 287641 - protein, 7 aa, Mycobacterium
SSPKPGD

SEQ ID NO: 287642 - protein, 15 aa, Mycobacterium
SSPKPPKRSAADRLN

SEQ ID NO: 287643 - protein, 11 aa, Mycobacterium
SSPLAAPVGGL

SEQ ID NO: 287644 - protein, 6 aa, Mycobacterium
SSPLEV

SEQ ID NO: 287645 - protein, 15 aa, Mycobacterium
SSPLGGLRATLTIAA

SEQ ID NO: 287646 - protein, 12 aa, Mycobacterium
SSPLRALTISGA

SEQ ID NO: 287647 - protein, 5 aa, Mycobacterium
SSPLT

SEQ ID NO: 287648 - protein, 7 aa, Mycobacterium
SSPNAGG

SEQ ID NO: 287649 - protein, 9 aa, Mycobacterium
SSPNTPGLR

SEQ ID NO: 287650 - protein, 15 aa, Mycobacterium
SSPPAPAGHSITPST

SEQ ID NO: 287651 - protein, 24 aa, Mycobacterium
SSPPGAPRNGVGSADAEHPGGGPR

SEQ ID NO: 287652 - protein, 7 aa, Mycobacterium
SSPPPAL

SEQ ID NO: 287653 - protein, 10 aa, Mycobacterium
SSPPPRPSAV

SEQ ID NO: 287654 - protein, 9 aa, Mycobacterium
SSPPPSIST

SEQ ID NO: 287655 - protein, 11 aa, Mycobacterium
SSPPSPAGSNF

SEQ ID NO: 287656 - protein, 7 aa, Mycobacterium
SSPPTFT

SEQ ID NO: 287657 - protein, 7 aa, Mycobacterium
SSPPWDV

SEQ ID NO: 287658 - protein, 9 aa, Mycobacterium
SSPQAGPAR

SEQ ID NO: 287659 - protein, 5 aa, Mycobacterium
SSPQL

SEQ ID NO: 287660 - protein, 8 aa, Mycobacterium
SSPQPNLA

SEQ ID NO: 287661 - protein, 7 aa, Mycobacterium
SSPRLGD

SEQ ID NO: 287662 - protein, 8 aa, Mycobacterium
SSPRTGTR

SEQ ID NO: 287663 - protein, 15 aa, Mycobacterium
SSPRTSPSRSRSGTR

SEQ ID NO: 287664 - protein, 5 aa, Mycobacterium
SSPSP

SEQ ID NO: 287665 - protein, 9 aa, Mycobacterium
SSPSTRSLG

SEQ ID NO: 287666 - protein, 4 aa, Mycobacterium
SSPT

SEQ ID NO: 287667 - protein, 5 aa, Mycobacterium
SSPTA

SEQ ID NO: 287668 - protein, 7 aa, Mycobacterium
SSPTKIR

SEQ ID NO: 287669 - protein, 7 aa, Mycobacterium
SSPTNGA

SEQ ID NO: 287670 - protein, 6 aa, Mycobacterium
SSPTPF

SEQ ID NO: 287671 - protein, 5 aa, Mycobacterium
SSPTT

SEQ ID NO: 287672 - protein, 5 aa, Mycobacterium
SSPTV

SEQ ID NO: 287673 - protein, 6 aa, Mycobacterium
SSPVNG

SEQ ID NO: 287674 - protein, 20 aa, Mycobacterium
SSPVRSTGAKSDAALNRASR

SEQ ID NO: 287675 - protein, 7 aa, Mycobacterium
SSPWAEP

SEQ ID NO: 287676 - protein, 4 aa, Mycobacterium
SSQA

SEQ ID NO: 287677 - protein, 12 aa, Mycobacterium
SSQADAVKQARE

SEQ ID NO: 287678 - protein, 9 aa, Mycobacterium
SSQADAVKR

SEQ ID NO: 287679 - protein, 10 aa, Mycobacterium
SSQADAVKTA

SEQ ID NO: 287680 - protein, 11 aa, Mycobacterium
SSQADDVKQAR

SEQ ID NO: 287681 - protein, 9 aa, Mycobacterium
SSQAERPAA

SEQ ID NO: 287682 - protein, 13 aa, Mycobacterium
SSQASQGGQQATL

SEQ ID NO: 287683 - protein, 18 aa, Mycobacterium
SSQDASIPNDEADPCFAR

SEQ ID NO: 287684 - protein, 6 aa, Mycobacterium
SSQGQA

SEQ ID NO: 287685 - protein, 8 aa, Mycobacterium
SSQGTVSP

SEQ ID NO: 287686 - protein, 4 aa, Mycobacterium
SSQL

SEQ ID NO: 287687 - protein, 22 aa, Mycobacterium
SSQLSADTDRAHRAAGRRREAK

SEQ ID NO: 287688 - protein, 8 aa, Mycobacterium
SSQPDRIG

SEQ ID NO: 287689 - protein, 18 aa, Mycobacterium
SSQPEPSPRPPSVDVQPR

SEQ ID NO: 287690 - protein, 6 aa, Mycobacterium
SSQPLV

SEQ ID NO: 287691 - protein, 7 aa, Mycobacterium
SSQRQAW

SEQ ID NO: 287692 - protein, 10 aa, Mycobacterium
SSQRTDEPVE

SEQ ID NO: 287693 - protein, 10 aa, Mycobacterium
SSQTAPMGRG

SEQ ID NO: 287694 - protein, 6 aa, Mycobacterium
SSQTIT

SEQ ID NO: 287695 - protein, 5 aa, Mycobacterium
SSQTM

SEQ ID NO: 287696 - protein, 27 aa, Mycobacterium
SSRAFEPVNPPPADPNSDERVKAGTLN

SEQ ID NO: 287697 - protein, 27 aa, Mycobacterium
SSRAFEPVNPPPGDPNSDEKVKAGTLN

SEQ ID NO: 287698 - protein, 5 aa, Mycobacterium
SSRAG

SEQ ID NO: 287699 - protein, 7 aa, Mycobacterium
SSRASQL

SEQ ID NO: 287700 - protein, 4 aa, Mycobacterium
SSRG

SEQ ID NO: 287701 - protein, 8 aa, Mycobacterium
SSRKRDPL

SEQ ID NO: 287702 - protein, 11 aa, Mycobacterium
SSRKSASERYP

SEQ ID NO: 287703 - protein, 11 aa, Mycobacterium
SSRKSASQHYP

SEQ ID NO: 287704 - protein, 18 aa, Mycobacterium
SSRPEPSPRPPSVDVQPR

SEQ ID NO: 287705 - protein, 13 aa, Mycobacterium
SSRPGITGTARVD

SEQ ID NO: 287706 - protein, 14 aa, Mycobacterium
SSRPGITGTARVDR

SEQ ID NO: 287707 - protein, 5 aa, Mycobacterium
SSRPQ

SEQ ID NO: 287708 - protein, 6 aa, Mycobacterium
SSRQET

SEQ ID NO: 287709 - protein, 10 aa, Mycobacterium
SSRRASGPVK

SEQ ID NO: 287710 - protein, 24 aa, Mycobacterium
SSRTHTGDAHETDEPLVPLARGEA

SEQ ID NO: 287711 - protein, 9 aa, Mycobacterium
SSRTPATAK

SEQ ID NO: 287712 - protein, 15 aa, Mycobacterium
SSRTVSNATATGAEV

SEQ ID NO: 287713 - protein, 6 aa, Mycobacterium
SSRWPS

SEQ ID NO: 287714 - protein, 5 aa, Mycobacterium
SSSAA

SEQ ID NO: 287715 - protein, 7 aa, Mycobacterium
SSSADAT

SEQ ID NO: 287716 - protein, 7 aa, Mycobacterium
SSSALSS

SEQ ID NO: 287717 - protein, 6 aa, Mycobacterium
SSSAPA

SEQ ID NO: 287718 - protein, 12 aa, Mycobacterium
SSSAQRDSQGGW

SEQ ID NO: 287719 - protein, 8 aa, Mycobacterium
SSSAYQVG

SEQ ID NO: 287720 - protein, 19 aa, Mycobacterium
SSSDGGWKFSDGGGGTSFD

SEQ ID NO: 287721 - protein, 9 aa, Mycobacterium
SSSERRKTL

SEQ ID NO: 287722 - protein, 7 aa, Mycobacterium
SSSESAL

SEQ ID NO: 287723 - protein, 11 aa, Mycobacterium
SSSGAQALSGA

SEQ ID NO: 287724 - protein, 6 aa, Mycobacterium
SSSGKL

SEQ ID NO: 287725 - protein, 7 aa, Mycobacterium
SSSGSAI

SEQ ID NO: 287726 - protein, 8 aa, Mycobacterium
SSSGSMTA

SEQ ID NO: 287727 - protein, 15 aa, Mycobacterium
SSSIDQAPVTGESVP

SEQ ID NO: 287728 - protein, 14 aa, Mycobacterium
SSSITTTDARRQTV

SEQ ID NO: 287729 - protein, 9 aa, Mycobacterium
SSSKNNRLN

SEQ ID NO: 287730 - protein, 15 aa, Mycobacterium
SSSLQDTDGKAARVQ

SEQ ID NO: 287731 - protein, 8 aa, Mycobacterium
SSSQPHFG

SEQ ID NO: 287732 - protein, 5 aa, Mycobacterium
SSSRV

SEQ ID NO: 287733 - protein, 8 aa, Mycobacterium
SSSSQRRG

SEQ ID NO: 287734 - protein, 6 aa, Mycobacterium
SSSSQT

SEQ ID NO: 287735 - protein, 9 aa, Mycobacterium
SSSSSRSCW

SEQ ID NO: 287736 - protein, 11 aa, Mycobacterium
SSSTASGGRHH

SEQ ID NO: 287737 - protein, 15 aa, Mycobacterium
SSTAAQAWAQDPGSG

SEQ ID NO: 287738 - protein, 6 aa, Mycobacterium
SSTAGT

SEQ ID NO: 287739 - protein, 12 aa, Mycobacterium
SSTAPAPKAGKH

SEQ ID NO: 287740 - protein, 8 aa, Mycobacterium
SSTASNYL

SEQ ID NO: 287741 - protein, 15 aa, Mycobacterium
SSTAVAAAAPTTTSP

SEQ ID NO: 287742 - protein, 7 aa, Mycobacterium
SSTDAPI

SEQ ID NO: 287743 - protein, 9 aa, Mycobacterium
SSTDDASPR

SEQ ID NO: 287744 - protein, 6 aa, Mycobacterium
SSTDGK

SEQ ID NO: 287745 - protein, 7 aa, Mycobacterium
SSTEAGL

SEQ ID NO: 287746 - protein, 8 aa, Mycobacterium
SSTERREY

SEQ ID NO: 287747 - protein, 4 aa, Mycobacterium
SSTG

SEQ ID NO: 287748 - protein, 5 aa, Mycobacterium
SSTGA

SEQ ID NO: 287749 - protein, 7 aa, Mycobacterium
SSTGEFK

SEQ ID NO: 287750 - protein, 6 aa, Mycobacterium
SSTGEP

SEQ ID NO: 287751 - protein, 6 aa, Mycobacterium
SSTGGV

SEQ ID NO: 287752 - protein, 6 aa, Mycobacterium
SSTGHE

SEQ ID NO: 287753 - protein, 6 aa, Mycobacterium
SSTGQF

SEQ ID NO: 287754 - protein, 17 aa, Mycobacterium
SSTGRDVEGAKKNFTAR

SEQ ID NO: 287755 - protein, 23 aa, Mycobacterium
SSTGRDVEGPKKNFAARKNELQT

SEQ ID NO: 287756 - protein, 10 aa, Mycobacterium
SSTGREEQRG

SEQ ID NO: 287757 - protein, 5 aa, Mycobacterium
SSTIT

SEQ ID NO: 287758 - protein, 8 aa, Mycobacterium
SSTKGYSA

SEQ ID NO: 287759 - protein, 9 aa, Mycobacterium
SSTKPGIPA

SEQ ID NO: 287760 - protein, 6 aa, Mycobacterium
SSTLSA

SEQ ID NO: 287761 - protein, 19 aa, Mycobacterium
SSTNQPMKPTNEPCLQNLS

SEQ ID NO: 287762 - protein, 17 aa, Mycobacterium
SSTPAQQVTASAEPMAQ

SEQ ID NO: 287763 - protein, 6 aa, Mycobacterium
SSTPMT

SEQ ID NO: 287764 - protein, 16 aa, Mycobacterium
SSTPTSRRCCRHGRED

SEQ ID NO: 287765 - protein, 5 aa, Mycobacterium
SSTPY

SEQ ID NO: 287766 - protein, 8 aa, Mycobacterium
SSTRGATL

SEQ ID NO: 287767 - protein, 8 aa, Mycobacterium
SSTRTQWD

SEQ ID NO: 287768 - protein, 11 aa, Mycobacterium
SSTSHEVPQPA

SEQ ID NO: 287769 - protein, 10 aa, Mycobacterium
SSTSPRQRHA

SEQ ID NO: 287770 - protein, 9 aa, Mycobacterium
SSTSSFQGS

SEQ ID NO: 287771 - protein, 5 aa, Mycobacterium
SSTTH

SEQ ID NO: 287772 - protein, 4 aa, Mycobacterium
SSTV

SEQ ID NO: 287773 - protein, 10 aa, Mycobacterium
SSTVQAATTY

SEQ ID NO: 287774 - protein, 7 aa, Mycobacterium
SSTVSVT

SEQ ID NO: 287775 - protein, 5 aa, Mycobacterium
SSVAA

SEQ ID NO: 287776 - protein, 20 aa, Mycobacterium
SSVAEASATFTPQNPTGSID

SEQ ID NO: 287777 - protein, 8 aa, Mycobacterium
SSVAGDRD

SEQ ID NO: 287778 - protein, 4 aa, Mycobacterium
SSVD

SEQ ID NO: 287779 - protein, 9 aa, Mycobacterium
SSVDTGAES

SEQ ID NO: 287780 - protein, 4 aa, Mycobacterium
SSVG

SEQ ID NO: 287781 - protein, 6 aa, Mycobacterium
SSVGGR

SEQ ID NO: 287782 - protein, 9 aa, Mycobacterium
SSVGQDLTR

SEQ ID NO: 287783 - protein, 14 aa, Mycobacterium
SSVHTGSMAGHEPG

SEQ ID NO: 287784 - protein, 5 aa, Mycobacterium
SSVPA

SEQ ID NO: 287785 - protein, 9 aa, Mycobacterium
SSVPAPSAA

SEQ ID NO: 287786 - protein, 11 aa, Mycobacterium
SSVPEGQMEAS

SEQ ID NO: 287787 - protein, 5 aa, Mycobacterium
SSVPT

SEQ ID NO: 287788 - protein, 6 aa, Mycobacterium
SSVPTY

SEQ ID NO: 287789 - protein, 19 aa, Mycobacterium
SSVRSELQEDAAGLSRRDM

SEQ ID NO: 287790 - protein, 28 aa, Mycobacterium
SSVSAPGGTDVQGRHVGPPSAATGIGDG

SEQ ID NO: 287791 - protein, 10 aa, Mycobacterium
SSVSAPSGTF

SEQ ID NO: 287792 - protein, 11 aa, Mycobacterium
SSVSAPSGTFV

SEQ ID NO: 287793 - protein, 9 aa, Mycobacterium
SSVSSYREV

SEQ ID NO: 287794 - protein, 8 aa, Mycobacterium
SSVSSYRQ

SEQ ID NO: 287795 - protein, 9 aa, Mycobacterium
SSVTSPGGT

SEQ ID NO: 287796 - protein, 13 aa, Mycobacterium
SSVTTDSNEVAQN

SEQ ID NO: 287797 - protein, 16 aa, Mycobacterium
SSVVNGDGVLQAVADD

SEQ ID NO: 287798 - protein, 17 aa, Mycobacterium
SSVVPQQTDTQGVEAPG

SEQ ID NO: 287799 - protein, 7 aa, Mycobacterium
SSWNGPA

SEQ ID NO: 287800 - protein, 4 aa, Mycobacterium
SSYG

SEQ ID NO: 287801 - protein, 7 aa, Mycobacterium
SSYGTQQ

SEQ ID NO: 287802 - protein, 8 aa, Mycobacterium
STAAAAQA

SEQ ID NO: 287803 - protein, 29 aa, Mycobacterium
STAAAGTTAQERVPAGAATAPSPQPQKRV

SEQ ID NO: 287804 - protein, 9 aa, Mycobacterium
STAADQPAQ

SEQ ID NO: 287805 - protein, 15 aa, Mycobacterium
STAAGAVAASAPPAM

SEQ ID NO: 287806 - protein, 6 aa, Mycobacterium
STAAGE

SEQ ID NO: 287807 - protein, 5 aa, Mycobacterium
STAAN

SEQ ID NO: 287808 - protein, 8 aa, Mycobacterium
STAANPSL

SEQ ID NO: 287809 - protein, 10 aa, Mycobacterium
STAANVTGPA

SEQ ID NO: 287810 - protein, 8 aa, Mycobacterium
STAAQAIS

SEQ ID NO: 287811 - protein, 17 aa, Mycobacterium
STAASRSAKDTAAESLK

SEQ ID NO: 287812 - protein, 11 aa, Mycobacterium
STADAATPYTQ

SEQ ID NO: 287813 - protein, 10 aa, Mycobacterium
STADATTPYT

SEQ ID NO: 287814 - protein, 6 aa, Mycobacterium
STADGD

SEQ ID NO: 287815 - protein, 9 aa, Mycobacterium
STAEPGRWG

SEQ ID NO: 287816 - protein, 20 aa, Mycobacterium
STAEPPAPPASAKAADPTAI

SEQ ID NO: 287817 - protein, 11 aa, Mycobacterium
STAERSRRRTL

SEQ ID NO: 287818 - protein, 13 aa, Mycobacterium
STAGDEVKNPQKT

SEQ ID NO: 287819 - protein, 8 aa, Mycobacterium
STAGDITG

SEQ ID NO: 287820 - protein, 15 aa, Mycobacterium
STAGEEVNNPQQSLP

SEQ ID NO: 287821 - protein, 15 aa, Mycobacterium
STAGEEVRNPQQSVP

SEQ ID NO: 287822 - protein, 10 aa, Mycobacterium
STAGNLTGPA

SEQ ID NO: 287823 - protein, 9 aa, Mycobacterium
STAGPPKNI

SEQ ID NO: 287824 - protein, 5 aa, Mycobacterium
STAGR

SEQ ID NO: 287825 - protein, 10 aa, Mycobacterium
STAGSGPYRA

SEQ ID NO: 287826 - protein, 6 aa, Mycobacterium
STAHNH

SEQ ID NO: 287827 - protein, 11 aa, Mycobacterium
STAHTAADNTV

SEQ ID NO: 287828 - protein, 14 aa, Mycobacterium
STAIEQRTAAPSLG

SEQ ID NO: 287829 - protein, 13 aa, Mycobacterium
STALATDARKNVD

SEQ ID NO: 287830 - protein, 6 aa, Mycobacterium
STALPP

SEQ ID NO: 287831 - protein, 10 aa, Mycobacterium
STANNNGSAF

SEQ ID NO: 287832 - protein, 4 aa, Mycobacterium
STAP

SEQ ID NO: 287833 - protein, 34 aa, Mycobacterium
STAPAPAAGLASAGSAVPASNSVSTVASERGADM

SEQ ID NO: 287834 - protein, 7 aa, Mycobacterium
STAPAYS

SEQ ID NO: 287835 - protein, 6 aa, Mycobacterium
STAPHS

SEQ ID NO: 287836 - protein, 8 aa, Mycobacterium
STAPPEAN

SEQ ID NO: 287837 - protein, 6 aa, Mycobacterium
STAPVT

SEQ ID NO: 287838 - protein, 4 aa, Mycobacterium
STAR

SEQ ID NO: 287839 - protein, 16 aa, Mycobacterium
STARAGEIGSATTSSV

SEQ ID NO: 287840 - protein, 7 aa, Mycobacterium
STARPAL

SEQ ID NO: 287841 - protein, 6 aa, Mycobacterium
STARQA

SEQ ID NO: 287842 - protein, 7 aa, Mycobacterium
STASAEL

SEQ ID NO: 287843 - protein, 11 aa, Mycobacterium
STASHYGKQAP

SEQ ID NO: 287844 - protein, 12 aa, Mycobacterium
STASSSGGFPGG

SEQ ID NO: 287845 - protein, 10 aa, Mycobacterium
STASSSGGGM

SEQ ID NO: 287846 - protein, 5 aa, Mycobacterium
STATE

SEQ ID NO: 287847 - protein, 5 aa, Mycobacterium
STATG

SEQ ID NO: 287848 - protein, 6 aa, Mycobacterium
STATGI

SEQ ID NO: 287849 - protein, 12 aa, Mycobacterium
STATGSGRTRRQ

SEQ ID NO: 287850 - protein, 5 aa, Mycobacterium
STATI

SEQ ID NO: 287851 - protein, 16 aa, Mycobacterium
STATSQAPAGKGDQTT

SEQ ID NO: 287852 - protein, 6 aa, Mycobacterium
STAVTD

SEQ ID NO: 287853 - protein, 9 aa, Mycobacterium
STCGPTDHI

SEQ ID NO: 287854 - protein, 13 aa, Mycobacterium
STCTTSEHGREIS

SEQ ID NO: 287855 - protein, 4 aa, Mycobacterium
STDA

SEQ ID NO: 287856 - protein, 22 aa, Mycobacterium
STDAEEAEEAAEDGTPDVKEPL

SEQ ID NO: 287857 - protein, 71 aa, Mycobacterium
STDAEPDPSDPSAPERSTPPAPGEGPASAPRSPRTPHATAAHKAPATARSAPRQSTKPADRPGRRSSTYSR

SEQ ID NO: 287858 - protein, 9 aa, Mycobacterium
STDAGDAFA

SEQ ID NO: 287859 - protein, 9 aa, Mycobacterium
STDATSEAV

SEQ ID NO: 287860 - protein, 8 aa, Mycobacterium
STDATSRN

SEQ ID NO: 287861 - protein, 14 aa, Mycobacterium
STDCLQGGANVSAR

SEQ ID NO: 287862 - protein, 10 aa, Mycobacterium
STDDPQVEGT

SEQ ID NO: 287863 - protein, 11 aa, Mycobacterium
STDDRAPKGFA

SEQ ID NO: 287864 - protein, 10 aa, Mycobacterium
STDDRREYEG

SEQ ID NO: 287865 - protein, 4 aa, Mycobacterium
STDG

SEQ ID NO: 287866 - protein, 5 aa, Mycobacterium
STDGD

SEQ ID NO: 287867 - protein, 6 aa, Mycobacterium
STDGST

SEQ ID NO: 287868 - protein, 6 aa, Mycobacterium
STDNTP

SEQ ID NO: 287869 - protein, 18 aa, Mycobacterium
STDPAENTTLTESPQRVS

SEQ ID NO: 287870 - protein, 14 aa, Mycobacterium
STDPPKERTSGKAA

SEQ ID NO: 287871 - protein, 7 aa, Mycobacterium
STDPSVD

SEQ ID NO: 287872 - protein, 8 aa, Mycobacterium
STDQTTAY

SEQ ID NO: 287873 - protein, 19 aa, Mycobacterium
STDRESPGTGDPSGTTTAE

SEQ ID NO: 287874 - protein, 19 aa, Mycobacterium
STDTAGAAAAHEAAATAYT

SEQ ID NO: 287875 - protein, 9 aa, Mycobacterium
STDTGPSTV

SEQ ID NO: 287876 - protein, 10 aa, Mycobacterium
STDYGSTATR

SEQ ID NO: 287877 - protein, 5 aa, Mycobacterium
STEAT

SEQ ID NO: 287878 - protein, 13 aa, Mycobacterium
STEDNTGDQRIPK

SEQ ID NO: 287879 - protein, 7 aa, Mycobacterium
STEDTAP

SEQ ID NO: 287880 - protein, 11 aa, Mycobacterium
STEEQRSLRSS

SEQ ID NO: 287881 - protein, 6 aa, Mycobacterium
STEERR

SEQ ID NO: 287882 - protein, 8 aa, Mycobacterium
STEGDTFH

SEQ ID NO: 287883 - protein, 15 aa, Mycobacterium
STEKVTSTLRRQQSG

SEQ ID NO: 287884 - protein, 24 aa, Mycobacterium
STELNGGGNGAGASSLASAAPDDG

SEQ ID NO: 287885 - protein, 4 aa, Mycobacterium
STEM

SEQ ID NO: 287886 - protein, 5 aa, Mycobacterium
STENV

SEQ ID NO: 287887 - protein, 8 aa, Mycobacterium
STEPMPVS

SEQ ID NO: 287888 - protein, 11 aa, Mycobacterium
STEPVGATTRI

SEQ ID NO: 287889 - protein, 5 aa, Mycobacterium
STEPY

SEQ ID NO: 287890 - protein, 6 aa, Mycobacterium
STEPYG

SEQ ID NO: 287891 - protein, 8 aa, Mycobacterium
STEQVTNT

SEQ ID NO: 287892 - protein, 10 aa, Mycobacterium
STESSDAGFA

SEQ ID NO: 287893 - protein, 16 aa, Mycobacterium
STESSPGKASKPRSVT

SEQ ID NO: 287894 - protein, 8 aa, Mycobacterium
STETAEIA

SEQ ID NO: 287895 - protein, 36 aa, Mycobacterium
STETDTSEATGGGSCHQPAPSCHGAPVADAKGEQRK

SEQ ID NO: 287896 - protein, 7 aa, Mycobacterium
STETEDE

SEQ ID NO: 287897 - protein, 8 aa, Mycobacterium
STEYADAA

SEQ ID NO: 287898 - protein, 7 aa, Mycobacterium
STFAPSA

SEQ ID NO: 287899 - protein, 28 aa, Mycobacterium
STFKSQKGDLRKEGYGGSSGEGDEDDVK

SEQ ID NO: 287900 - protein, 8 aa, Mycobacterium
STFNEDPT

SEQ ID NO: 287901 - protein, 5 aa, Mycobacterium
STFSG

SEQ ID NO: 287902 - protein, 12 aa, Mycobacterium
STFTAGEIASTD

SEQ ID NO: 287903 - protein, 7 aa, Mycobacterium
STFTDTR

SEQ ID NO: 287904 - protein, 8 aa, Mycobacterium
STFTPTPQ

SEQ ID NO: 287905 - protein, 4 aa, Mycobacterium
STGA

SEQ ID NO: 287906 - protein, 21 aa, Mycobacterium
STGAGPNGTRCGGITDPKPGA

SEQ ID NO: 287907 - protein, 8 aa, Mycobacterium
STGARLRG

SEQ ID NO: 287908 - protein, 5 aa, Mycobacterium
STGAT

SEQ ID NO: 287909 - protein, 12 aa, Mycobacterium
STGCGPASSDVG

SEQ ID NO: 287910 - protein, 11 aa, Mycobacterium
STGCGPASSEV

SEQ ID NO: 287911 - protein, 7 aa, Mycobacterium
STGDPAV

SEQ ID NO: 287912 - protein, 7 aa, Mycobacterium
STGGAGL

SEQ ID NO: 287913 - protein, 6 aa, Mycobacterium
STGGLA

SEQ ID NO: 287914 - protein, 8 aa, Mycobacterium
STGGSNAK

SEQ ID NO: 287915 - protein, 5 aa, Mycobacterium
STGGV

SEQ ID NO: 287916 - protein, 6 aa, Mycobacterium
STGGVV

SEQ ID NO: 287917 - protein, 7 aa, Mycobacterium
STGHTTA

SEQ ID NO: 287918 - protein, 21 aa, Mycobacterium
STGLPSPPVGLGAGGEGSINT

SEQ ID NO: 287919 - protein, 5 aa, Mycobacterium
STGLS

SEQ ID NO: 287920 - protein, 40 aa, Mycobacterium
STGMGPPATTPKPPPAAAPAAVSPPTTRSRDTRARDTAVR

SEQ ID NO: 287921 - protein, 5 aa, Mycobacterium
STGNL

SEQ ID NO: 287922 - protein, 10 aa, Mycobacterium
STGNSPSAAT

SEQ ID NO: 287923 - protein, 7 aa, Mycobacterium
STGNTRS

SEQ ID NO: 287924 - protein, 10 aa, Mycobacterium
STGPEQRELP

SEQ ID NO: 287925 - protein, 11 aa, Mycobacterium
STGPEQRELPD

SEQ ID NO: 287926 - protein, 6 aa, Mycobacterium
STGPLA

SEQ ID NO: 287927 - protein, 10 aa, Mycobacterium
STGQEATGDG

SEQ ID NO: 287928 - protein, 5 aa, Mycobacterium
STGQR

SEQ ID NO: 287929 - protein, 8 aa, Mycobacterium
STGQRSGA

SEQ ID NO: 287930 - protein, 7 aa, Mycobacterium
STGRGLN

SEQ ID NO: 287931 - protein, 4 aa, Mycobacterium
STGS

SEQ ID NO: 287932 - protein, 5 aa, Mycobacterium
STGSA

SEQ ID NO: 287933 - protein, 5 aa, Mycobacterium
STGSG

SEQ ID NO: 287934 - protein, 12 aa, Mycobacterium
STGSGALVGRTG

SEQ ID NO: 287935 - protein, 6 aa, Mycobacterium
STGSGD

SEQ ID NO: 287936 - protein, 8 aa, Mycobacterium
STGSGKST

SEQ ID NO: 287937 - protein, 11 aa, Mycobacterium
STGSGTLVGRT

SEQ ID NO: 287938 - protein, 8 aa, Mycobacterium
STGTGTLV

SEQ ID NO: 287939 - protein, 5 aa, Mycobacterium
STGTI

SEQ ID NO: 287940 - protein, 11 aa, Mycobacterium
STGTMADYGPD

SEQ ID NO: 287941 - protein, 8 aa, Mycobacterium
STGTPRPS

SEQ ID NO: 287942 - protein, 5 aa, Mycobacterium
STGTV

SEQ ID NO: 287943 - protein, 4 aa, Mycobacterium
STGV

SEQ ID NO: 287944 - protein, 5 aa, Mycobacterium
STGVA

SEQ ID NO: 287945 - protein, 13 aa, Mycobacterium
STGVPDLRPDGIP

SEQ ID NO: 287946 - protein, 12 aa, Mycobacterium
STGVPRTAEGPH

SEQ ID NO: 287947 - protein, 5 aa, Mycobacterium
STGYT

SEQ ID NO: 287948 - protein, 22 aa, Mycobacterium
STHFSPERAAPPGDDPNASETA

SEQ ID NO: 287949 - protein, 4 aa, Mycobacterium
STHP

SEQ ID NO: 287950 - protein, 4 aa, Mycobacterium
STHS

SEQ ID NO: 287951 - protein, 12 aa, Mycobacterium
STIAGEGAHARE

SEQ ID NO: 287952 - protein, 7 aa, Mycobacterium
STIAPQA

SEQ ID NO: 287953 - protein, 6 aa, Mycobacterium
STIDDA

SEQ ID NO: 287954 - protein, 21 aa, Mycobacterium
STIDGSTGRRGPARSSYADPR

SEQ ID NO: 287955 - protein, 10 aa, Mycobacterium
STIPPASEEI

SEQ ID NO: 287956 - protein, 5 aa, Mycobacterium
STISD

SEQ ID NO: 287957 - protein, 6 aa, Mycobacterium
STITRT

SEQ ID NO: 287958 - protein, 6 aa, Mycobacterium
STKAGT

SEQ ID NO: 287959 - protein, 11 aa, Mycobacterium
STKDAPSTQAM

SEQ ID NO: 287960 - protein, 17 aa, Mycobacterium
STKIPGADAVPQSEGEV

SEQ ID NO: 287961 - protein, 8 aa, Mycobacterium
STKPGIPA

SEQ ID NO: 287962 - protein, 7 aa, Mycobacterium
STKQQEF

SEQ ID NO: 287963 - protein, 4 aa, Mycobacterium
STLA

SEQ ID NO: 287964 - protein, 12 aa, Mycobacterium
STLADSVRSRNT

SEQ ID NO: 287965 - protein, 15 aa, Mycobacterium
STLAEEVGQPKRDIP

SEQ ID NO: 287966 - protein, 6 aa, Mycobacterium
STLATG

SEQ ID NO: 287967 - protein, 21 aa, Mycobacterium
STLDGSTGHRGPARSGYADPR

SEQ ID NO: 287968 - protein, 12 aa, Mycobacterium
STLGARKGDVYP

SEQ ID NO: 287969 - protein, 5 aa, Mycobacterium
STLGE

SEQ ID NO: 287970 - protein, 5 aa, Mycobacterium
STLGN

SEQ ID NO: 287971 - protein, 7 aa, Mycobacterium
STLGNGA

SEQ ID NO: 287972 - protein, 6 aa, Mycobacterium
STLGRR

SEQ ID NO: 287973 - protein, 7 aa, Mycobacterium
STLGTEI

SEQ ID NO: 287974 - protein, 6 aa, Mycobacterium
STLPPR

SEQ ID NO: 287975 - protein, 16 aa, Mycobacterium
STLQQANEQLKRERDA

SEQ ID NO: 287976 - protein, 17 aa, Mycobacterium
STLTASEQRAVPADGSR

SEQ ID NO: 287977 - protein, 12 aa, Mycobacterium
STMEPGKPIQAM

SEQ ID NO: 287978 - protein, 15 aa, Mycobacterium
STMQPGKPITSTDHS

SEQ ID NO: 287979 - protein, 9 aa, Mycobacterium
STNATSEAV

SEQ ID NO: 287980 - protein, 19 aa, Mycobacterium
STNNNDAARFDPGTVTPDG

SEQ ID NO: 287981 - protein, 13 aa, Mycobacterium
STNPRAGTLGSSI

SEQ ID NO: 287982 - protein, 21 aa, Mycobacterium
STNSWRRTPVRSSPIRSTQGG

SEQ ID NO: 287983 - protein, 7 aa, Mycobacterium
STNSYAA

SEQ ID NO: 287984 - protein, 13 aa, Mycobacterium
STNVAAGAKTRAS

SEQ ID NO: 287985 - protein, 8 aa, Mycobacterium
STNVQTYT

SEQ ID NO: 287986 - protein, 4 aa, Mycobacterium
STPA

SEQ ID NO: 287987 - protein, 13 aa, Mycobacterium
STPAAGVRRPSLA

SEQ ID NO: 287988 - protein, 6 aa, Mycobacterium
STPAAI

SEQ ID NO: 287989 - protein, 7 aa, Mycobacterium
STPADVA

SEQ ID NO: 287990 - protein, 8 aa, Mycobacterium
STPAGPVQ

SEQ ID NO: 287991 - protein, 8 aa, Mycobacterium
STPAGTQV

SEQ ID NO: 287992 - protein, 8 aa, Mycobacterium
STPAPDGV

SEQ ID NO: 287993 - protein, 19 aa, Mycobacterium
STPAPPTSSPNPPPPPQTV

SEQ ID NO: 287994 - protein, 5 aa, Mycobacterium
STPDE

SEQ ID NO: 287995 - protein, 10 aa, Mycobacterium
STPDNSGRVS

SEQ ID NO: 287996 - protein, 10 aa, Mycobacterium
STPEERLGQT

SEQ ID NO: 287997 - protein, 9 aa, Mycobacterium
STPETAGRI

SEQ ID NO: 287998 - protein, 4 aa, Mycobacterium
STPF

SEQ ID NO: 287999 - protein, 6 aa, Mycobacterium
STPFGD

SEQ ID NO: 288000 - protein, 8 aa, Mycobacterium
STPFTGDT

SEQ ID NO: 288001 - protein, 16 aa, Mycobacterium
STPHPTNASGLRHPGV

SEQ ID NO: 288002 - protein, 5 aa, Mycobacterium
STPIQ

SEQ ID NO: 288003 - protein, 20 aa, Mycobacterium
STPPAVDSSEVPTAGDPPLP

SEQ ID NO: 288004 - protein, 9 aa, Mycobacterium
STPPNTPAP

SEQ ID NO: 288005 - protein, 13 aa, Mycobacterium
STPPPALAQTRPE

SEQ ID NO: 288006 - protein, 7 aa, Mycobacterium
STPPQHC

SEQ ID NO: 288007 - protein, 9 aa, Mycobacterium
STPPSYPPF

SEQ ID NO: 288008 - protein, 5 aa, Mycobacterium
STPQQ

SEQ ID NO: 288009 - protein, 10 aa, Mycobacterium
STPQVGGQTA

SEQ ID NO: 288010 - protein, 8 aa, Mycobacterium
STPRDASI

SEQ ID NO: 288011 - protein, 7 aa, Mycobacterium
STPRSYL

SEQ ID NO: 288012 - protein, 9 aa, Mycobacterium
STPRTSGRI

SEQ ID NO: 288013 - protein, 6 aa, Mycobacterium
STPSLN

SEQ ID NO: 288014 - protein, 5 aa, Mycobacterium
STPTA

SEQ ID NO: 288015 - protein, 7 aa, Mycobacterium
STPTCPN

SEQ ID NO: 288016 - protein, 8 aa, Mycobacterium
STPTSRRG

SEQ ID NO: 288017 - protein, 8 aa, Mycobacterium
STPTTASR

SEQ ID NO: 288018 - protein, 5 aa, Mycobacterium
STPVD

SEQ ID NO: 288019 - protein, 6 aa, Mycobacterium
STPVIG

SEQ ID NO: 288020 - protein, 9 aa, Mycobacterium
STPYAPNGA

SEQ ID NO: 288021 - protein, 4 aa, Mycobacterium
STQA

SEQ ID NO: 288022 - protein, 19 aa, Mycobacterium
STQAGTQAQQQELAKGATE

SEQ ID NO: 288023 - protein, 7 aa, Mycobacterium
STQAPST

SEQ ID NO: 288024 - protein, 9 aa, Mycobacterium
STQAQAVAD

SEQ ID NO: 288025 - protein, 6 aa, Mycobacterium
STQDTN

SEQ ID NO: 288026 - protein, 22 aa, Mycobacterium
STQPKPGVIDRSGGYTASSGIT

SEQ ID NO: 288027 - protein, 8 aa, Mycobacterium
STQRDTEK

SEQ ID NO: 288028 - protein, 14 aa, Mycobacterium
STQSADRPEPTLTS

SEQ ID NO: 288029 - protein, 15 aa, Mycobacterium
STQSKDRPEPTFTNS

SEQ ID NO: 288030 - protein, 5 aa, Mycobacterium
STRAA

SEQ ID NO: 288031 - protein, 7 aa, Mycobacterium
STRAAGD

SEQ ID NO: 288032 - protein, 20 aa, Mycobacterium
STRAGSEPLSVTADGTDAQV

SEQ ID NO: 288033 - protein, 6 aa, Mycobacterium
STRAQW

SEQ ID NO: 288034 - protein, 7 aa, Mycobacterium
STRASGG

SEQ ID NO: 288035 - protein, 17 aa, Mycobacterium
STRETDADNAGHDDGGL

SEQ ID NO: 288036 - protein, 6 aa, Mycobacterium
STRGDF

SEQ ID NO: 288037 - protein, 5 aa, Mycobacterium
STRHG

SEQ ID NO: 288038 - protein, 8 aa, Mycobacterium
STRHGSLP

SEQ ID NO: 288039 - protein, 4 aa, Mycobacterium
STRN

SEQ ID NO: 288040 - protein, 8 aa, Mycobacterium
STRRGSAL

SEQ ID NO: 288041 - protein, 5 aa, Mycobacterium
STRRR

SEQ ID NO: 288042 - protein, 7 aa, Mycobacterium
STRSDAT

SEQ ID NO: 288043 - protein, 11 aa, Mycobacterium
STRSRQPAPAI

SEQ ID NO: 288044 - protein, 6 aa, Mycobacterium
STRSRT

SEQ ID NO: 288045 - protein, 15 aa, Mycobacterium
STRSSGPAQEASGQS

SEQ ID NO: 288046 - protein, 17 aa, Mycobacterium
STRVGDPERERTADDLG

SEQ ID NO: 288047 - protein, 13 aa, Mycobacterium
STRVPDLRPNGIP

SEQ ID NO: 288048 - protein, 7 aa, Mycobacterium
STRVQAP

SEQ ID NO: 288049 - protein, 15 aa, Mycobacterium
STRVRAGDRLGPLDE

SEQ ID NO: 288050 - protein, 6 aa, Mycobacterium
STSAAA

SEQ ID NO: 288051 - protein, 17 aa, Mycobacterium
STSAGSHFDITRAQINS

SEQ ID NO: 288052 - protein, 6 aa, Mycobacterium
STSAHT

SEQ ID NO: 288053 - protein, 6 aa, Mycobacterium
STSALD

SEQ ID NO: 288054 - protein, 9 aa, Mycobacterium
STSALDEGL

SEQ ID NO: 288055 - protein, 7 aa, Mycobacterium
STSALDT

SEQ ID NO: 288056 - protein, 8 aa, Mycobacterium
STSAMDEG

SEQ ID NO: 288057 - protein, 27 aa, Mycobacterium
STSAPPPPEPGPQRDPTVDNAANPYRL

SEQ ID NO: 288058 - protein, 6 aa, Mycobacterium
STSATM

SEQ ID NO: 288059 - protein, 4 aa, Mycobacterium
STSG

SEQ ID NO: 288060 - protein, 7 aa, Mycobacterium
STSGSFQ

SEQ ID NO: 288061 - protein, 10 aa, Mycobacterium
STSGSMTGGL

SEQ ID NO: 288062 - protein, 34 aa, Mycobacterium
STSGTTQYLSPGQTITEGTVPSEVGPTIDAANDG

SEQ ID NO: 288063 - protein, 4 aa, Mycobacterium
STSP

SEQ ID NO: 288064 - protein, 8 aa, Mycobacterium
STSPANAS

SEQ ID NO: 288065 - protein, 10 aa, Mycobacterium
STSPDGGFEA

SEQ ID NO: 288066 - protein, 7 aa, Mycobacterium
STSPTIG

SEQ ID NO: 288067 - protein, 8 aa, Mycobacterium
STSPTIGQ

SEQ ID NO: 288068 - protein, 8 aa, Mycobacterium
STSRDDLG

SEQ ID NO: 288069 - protein, 11 aa, Mycobacterium
STSSKDHPDPT

SEQ ID NO: 288070 - protein, 8 aa, Mycobacterium
STSSLDEG

SEQ ID NO: 288071 - protein, 6 aa, Mycobacterium
STSSRT

SEQ ID NO: 288072 - protein, 12 aa, Mycobacterium
STSSSLGSSQGV

SEQ ID NO: 288073 - protein, 7 aa, Mycobacterium
STSSWGD

SEQ ID NO: 288074 - protein, 15 aa, Mycobacterium
STSTSPQVEFTPEGT

SEQ ID NO: 288075 - protein, 6 aa, Mycobacterium
STSYAR

SEQ ID NO: 288076 - protein, 4 aa, Mycobacterium
STTA

SEQ ID NO: 288077 - protein, 17 aa, Mycobacterium
STTAAGGLGGRTGAGGK

SEQ ID NO: 288078 - protein, 15 aa, Mycobacterium
STTAAGPISQNAYGA

SEQ ID NO: 288079 - protein, 17 aa, Mycobacterium
STTASRSAKDTAAESLK

SEQ ID NO: 288080 - protein, 4 aa, Mycobacterium
STTG

SEQ ID NO: 288081 - protein, 6 aa, Mycobacterium
STTGAF

SEQ ID NO: 288082 - protein, 8 aa, Mycobacterium
STTGPGRT

SEQ ID NO: 288083 - protein, 12 aa, Mycobacterium
STTGTSTGAVDA

SEQ ID NO: 288084 - protein, 14 aa, Mycobacterium
STTGYGDITPYTET

SEQ ID NO: 288085 - protein, 12 aa, Mycobacterium
STTHPEPGSTAY

SEQ ID NO: 288086 - protein, 9 aa, Mycobacterium
STTLPGGPV

SEQ ID NO: 288087 - protein, 10 aa, Mycobacterium
STTLTSTGAV

SEQ ID NO: 288088 - protein, 6 aa, Mycobacterium
STTNLA

SEQ ID NO: 288089 - protein, 8 aa, Mycobacterium
STTNLPTE

SEQ ID NO: 288090 - protein, 62 aa, Mycobacterium
STTPAPTQQPTQTQQPTYTQQPTYTQQPTRTQQPTQQTTQQPTRTSTAPTSSGAPSPPNQPG

SEQ ID NO: 288091 - protein, 9 aa, Mycobacterium
STTPEPATE

SEQ ID NO: 288092 - protein, 10 aa, Mycobacterium
STTPRPGRET

SEQ ID NO: 288093 - protein, 35 aa, Mycobacterium
STTPRTTAPPSTSPSPPPSTSARPSTSAPQLAPET

SEQ ID NO: 288094 - protein, 9 aa, Mycobacterium
STTQEPATE

SEQ ID NO: 288095 - protein, 7 aa, Mycobacterium
STTQIGG

SEQ ID NO: 288096 - protein, 10 aa, Mycobacterium
STTRAAAESR

SEQ ID NO: 288097 - protein, 6 aa, Mycobacterium
STTRSP

SEQ ID NO: 288098 - protein, 12 aa, Mycobacterium
STTSATVTSHTS

SEQ ID NO: 288099 - protein, 13 aa, Mycobacterium
STTSGGGMGRGPK

SEQ ID NO: 288100 - protein, 7 aa, Mycobacterium
STTSGNQ

SEQ ID NO: 288101 - protein, 9 aa, Mycobacterium
STTSSLSAI

SEQ ID NO: 288102 - protein, 16 aa, Mycobacterium
STTSTSGGGRRGPGRG

SEQ ID NO: 288103 - protein, 16 aa, Mycobacterium
STTSTSSGGRGPGRGI

SEQ ID NO: 288104 - protein, 5 aa, Mycobacterium
STTTE

SEQ ID NO: 288105 - protein, 19 aa, Mycobacterium
STTTGYQGNSGDPGTPSSI

SEQ ID NO: 288106 - protein, 15 aa, Mycobacterium
STTTKDNPEPTIKPS

SEQ ID NO: 288107 - protein, 65 aa, Mycobacterium
STTTSAAAPTTSAAPTTAAPTTAAPTTAVPTTPSAVETTPAVEEETPPSPVAPVTTTTPVLPLPG

SEQ ID NO: 288108 - protein, 5 aa, Mycobacterium
STTYS

SEQ ID NO: 288109 - protein, 6 aa, Mycobacterium
STTYSR

SEQ ID NO: 288110 - protein, 20 aa, Mycobacterium
STVAASPGALVGGADAQALD

SEQ ID NO: 288111 - protein, 8 aa, Mycobacterium
STVAGTGQ

SEQ ID NO: 288112 - protein, 5 aa, Mycobacterium
STVDD

SEQ ID NO: 288113 - protein, 6 aa, Mycobacterium
STVDGR

SEQ ID NO: 288114 - protein, 6 aa, Mycobacterium
STVDGS

SEQ ID NO: 288115 - protein, 7 aa, Mycobacterium
STVDPDD

SEQ ID NO: 288116 - protein, 8 aa, Mycobacterium
STVDPDRL

SEQ ID NO: 288117 - protein, 5 aa, Mycobacterium
STVEA

SEQ ID NO: 288118 - protein, 4 aa, Mycobacterium
STVP

SEQ ID NO: 288119 - protein, 7 aa, Mycobacterium
STVPPGA

SEQ ID NO: 288120 - protein, 7 aa, Mycobacterium
STVQTEP

SEQ ID NO: 288121 - protein, 14 aa, Mycobacterium
STVRPAANVATAGV

SEQ ID NO: 288122 - protein, 5 aa, Mycobacterium
STVRS

SEQ ID NO: 288123 - protein, 4 aa, Mycobacterium
STVS

SEQ ID NO: 288124 - protein, 6 aa, Mycobacterium
STVSAG

SEQ ID NO: 288125 - protein, 6 aa, Mycobacterium
STVSGA

SEQ ID NO: 288126 - protein, 7 aa, Mycobacterium
STVSGAF

SEQ ID NO: 288127 - protein, 11 aa, Mycobacterium
STVSPADATKV

SEQ ID NO: 288128 - protein, 15 aa, Mycobacterium
STVTDADGAKDAPRN

SEQ ID NO: 288129 - protein, 8 aa, Mycobacterium
STVVNPGT

SEQ ID NO: 288130 - protein, 10 aa, Mycobacterium
STWPPAGAEA

SEQ ID NO: 288131 - protein, 15 aa, Mycobacterium
STYANSLPGWRTQGR

SEQ ID NO: 288132 - protein, 5 aa, Mycobacterium
STYDG

SEQ ID NO: 288133 - protein, 8 aa, Mycobacterium
STYTEQDD

SEQ ID NO: 288134 - protein, 4 aa, Mycobacterium
SVAA

SEQ ID NO: 288135 - protein, 10 aa, Mycobacterium
SVAAGSGNTS

SEQ ID NO: 288136 - protein, 6 aa, Mycobacterium
SVAARG

SEQ ID NO: 288137 - protein, 5 aa, Mycobacterium
SVAAT

SEQ ID NO: 288138 - protein, 13 aa, Mycobacterium
SVADGADSDTLTT

SEQ ID NO: 288139 - protein, 11 aa, Mycobacterium
SVAENTSDAEV

SEQ ID NO: 288140 - protein, 11 aa, Mycobacterium
SVAENTSDAQV

SEQ ID NO: 288141 - protein, 55 aa, Mycobacterium
SVAEVPADQVDTVDDAPVAEETAEIEKTESGETAEDAIAEEPSDTITEDAHDEDL

SEQ ID NO: 288142 - protein, 5 aa, Mycobacterium
SVAGD

SEQ ID NO: 288143 - protein, 7 aa, Mycobacterium
SVAGDRD

SEQ ID NO: 288144 - protein, 10 aa, Mycobacterium
SVAGGAANTS

SEQ ID NO: 288145 - protein, 20 aa, Mycobacterium
SVAGTADDAAAEGTKVGVQE

SEQ ID NO: 288146 - protein, 25 aa, Mycobacterium
SVAGTDDDAAAEGTKVGVDAGGTYT

SEQ ID NO: 288147 - protein, 17 aa, Mycobacterium
SVAPAAVQPAAAASAEL

SEQ ID NO: 288148 - protein, 9 aa, Mycobacterium
SVAPDGTAE

SEQ ID NO: 288149 - protein, 10 aa, Mycobacterium
SVAPDTESHA

SEQ ID NO: 288150 - protein, 12 aa, Mycobacterium
SVAPGASKDPSV

SEQ ID NO: 288151 - protein, 10 aa, Mycobacterium
SVAPTPPAPT

SEQ ID NO: 288152 - protein, 9 aa, Mycobacterium
SVAQGRTNL

SEQ ID NO: 288153 - protein, 14 aa, Mycobacterium
SVAQRAQNSGVPTT

SEQ ID NO: 288154 - protein, 16 aa, Mycobacterium
SVARQSAEAAANPQTA

SEQ ID NO: 288155 - protein, 13 aa, Mycobacterium
SVASPSGGDPRQA

SEQ ID NO: 288156 - protein, 5 aa, Mycobacterium
SVASS

SEQ ID NO: 288157 - protein, 4 aa, Mycobacterium
SVDA

SEQ ID NO: 288158 - protein, 4 aa, Mycobacterium
SVDD

SEQ ID NO: 288159 - protein, 11 aa, Mycobacterium
SVDDPDSRQQQ

SEQ ID NO: 288160 - protein, 12 aa, Mycobacterium
SVDDSPAPQTPV

SEQ ID NO: 288161 - protein, 6 aa, Mycobacterium
SVDGSL

SEQ ID NO: 288162 - protein, 7 aa, Mycobacterium
SVDGSLT

SEQ ID NO: 288163 - protein, 5 aa, Mycobacterium
SVDGV

SEQ ID NO: 288164 - protein, 8 aa, Mycobacterium
SVDPATGR

SEQ ID NO: 288165 - protein, 8 aa, Mycobacterium
SVDPGSAK

SEQ ID NO: 288166 - protein, 12 aa, Mycobacterium
SVDPSVGLDPSW

SEQ ID NO: 288167 - protein, 15 aa, Mycobacterium
SVDTTDSVGDSGGDS

SEQ ID NO: 288168 - protein, 8 aa, Mycobacterium
SVEAGQLE

SEQ ID NO: 288169 - protein, 4 aa, Mycobacterium
SVEE

SEQ ID NO: 288170 - protein, 13 aa, Mycobacterium
SVEGPDPARPPSK

SEQ ID NO: 288171 - protein, 9 aa, Mycobacterium
SVEGPGLAA

SEQ ID NO: 288172 - protein, 20 aa, Mycobacterium
SVENSARTGDDGWKEMLAPA

SEQ ID NO: 288173 - protein, 20 aa, Mycobacterium
SVENSTKTGDDGWKEMLAPA

SEQ ID NO: 288174 - protein, 20 aa, Mycobacterium
SVENSTRTGDDGWKEMLAPA

SEQ ID NO: 288175 - protein, 8 aa, Mycobacterium
SVESPANA

SEQ ID NO: 288176 - protein, 6 aa, Mycobacterium
SVETTR

SEQ ID NO: 288177 - protein, 5 aa, Mycobacterium
SVGAG

SEQ ID NO: 288178 - protein, 7 aa, Mycobacterium
SVGAPPW

SEQ ID NO: 288179 - protein, 12 aa, Mycobacterium
SVGAPSPSGSSV

SEQ ID NO: 288180 - protein, 5 aa, Mycobacterium
SVGAS

SEQ ID NO: 288181 - protein, 10 aa, Mycobacterium
SVGDEDSYSL

SEQ ID NO: 288182 - protein, 17 aa, Mycobacterium
SVGENRSVSLTPRDAPA

SEQ ID NO: 288183 - protein, 9 aa, Mycobacterium
SVGGEGAQR

SEQ ID NO: 288184 - protein, 7 aa, Mycobacterium
SVGGGAS

SEQ ID NO: 288185 - protein, 12 aa, Mycobacterium
SVGGGATAPATG

SEQ ID NO: 288186 - protein, 7 aa, Mycobacterium
SVGGGGL

SEQ ID NO: 288187 - protein, 13 aa, Mycobacterium
SVGGGPAGVGNAV

SEQ ID NO: 288188 - protein, 8 aa, Mycobacterium
SVGKVGDL

SEQ ID NO: 288189 - protein, 13 aa, Mycobacterium
SVGNDAPTDTAST

SEQ ID NO: 288190 - protein, 10 aa, Mycobacterium
SVGPQGRPSA

SEQ ID NO: 288191 - protein, 6 aa, Mycobacterium
SVGPQQ

SEQ ID NO: 288192 - protein, 8 aa, Mycobacterium
SVGPQQLP

SEQ ID NO: 288193 - protein, 15 aa, Mycobacterium
SVGRARDIEPGHRRD

SEQ ID NO: 288194 - protein, 5 aa, Mycobacterium
SVGSR

SEQ ID NO: 288195 - protein, 8 aa, Mycobacterium
SVGSSPDD

SEQ ID NO: 288196 - protein, 9 aa, Mycobacterium
SVGSTPARV

SEQ ID NO: 288197 - protein, 11 aa, Mycobacterium
SVGSWKPGTSW

SEQ ID NO: 288198 - protein, 5 aa, Mycobacterium
SVGTI

SEQ ID NO: 288199 - protein, 12 aa, Mycobacterium
SVGTTTTGSDDD

SEQ ID NO: 288200 - protein, 7 aa, Mycobacterium
SVGVEQA

SEQ ID NO: 288201 - protein, 10 aa, Mycobacterium
SVHESERDQH

SEQ ID NO: 288202 - protein, 7 aa, Mycobacterium
SVHGQEH

SEQ ID NO: 288203 - protein, 9 aa, Mycobacterium
SVHGQEHRR

SEQ ID NO: 288204 - protein, 6 aa, Mycobacterium
SVKETR

SEQ ID NO: 288205 - protein, 17 aa, Mycobacterium
SVKGSVEHEAAQEAGHP

SEQ ID NO: 288206 - protein, 5 aa, Mycobacterium
SVKPH

SEQ ID NO: 288207 - protein, 11 aa, Mycobacterium
SVKPKSDITPE

SEQ ID NO: 288208 - protein, 13 aa, Mycobacterium
SVLAGSDGPRSRA

SEQ ID NO: 288209 - protein, 9 aa, Mycobacterium
SVNAGQVDS

SEQ ID NO: 288210 - protein, 5 aa, Mycobacterium
SVNGA

SEQ ID NO: 288211 - protein, 34 aa, Mycobacterium
SVNGGANGQMPGGPAAPLSQQRYRSELTGATDRL

SEQ ID NO: 288212 - protein, 5 aa, Mycobacterium
SVNPR

SEQ ID NO: 288213 - protein, 5 aa, Mycobacterium
SVNSA

SEQ ID NO: 288214 - protein, 14 aa, Mycobacterium
SVNTPPEATQSPQA

SEQ ID NO: 288215 - protein, 5 aa, Mycobacterium
SVPAA

SEQ ID NO: 288216 - protein, 12 aa, Mycobacterium
SVPAAAGSTLGA

SEQ ID NO: 288217 - protein, 5 aa, Mycobacterium
SVPAN

SEQ ID NO: 288218 - protein, 15 aa, Mycobacterium
SVPAPDGSRSSLGAA

SEQ ID NO: 288219 - protein, 7 aa, Mycobacterium
SVPAPGP

SEQ ID NO: 288220 - protein, 33 aa, Mycobacterium
SVPAPPPGGPPPGPPAPPPPDQQAPQPPTPSPV

SEQ ID NO: 288221 - protein, 10 aa, Mycobacterium
SVPAPQAASP

SEQ ID NO: 288222 - protein, 11 aa, Mycobacterium
SVPAPQADSPE

SEQ ID NO: 288223 - protein, 16 aa, Mycobacterium
SVPARAPHSADGRRAG

SEQ ID NO: 288224 - protein, 6 aa, Mycobacterium
SVPAVG

SEQ ID NO: 288225 - protein, 4 aa, Mycobacterium
SVPD

SEQ ID NO: 288226 - protein, 11 aa, Mycobacterium
SVPDDSAGRRS

SEQ ID NO: 288227 - protein, 8 aa, Mycobacterium
SVPDEASE

SEQ ID NO: 288228 - protein, 8 aa, Mycobacterium
SVPGAHNG

SEQ ID NO: 288229 - protein, 44 aa, Mycobacterium
SVPGLSEKKNPAADASSKHSQPANAPAHTSDKTSDHASETGRGA

SEQ ID NO: 288230 - protein, 5 aa, Mycobacterium
SVPGP

SEQ ID NO: 288231 - protein, 7 aa, Mycobacterium
SVPGTGR

SEQ ID NO: 288232 - protein, 7 aa, Mycobacterium
SVPKAVS

SEQ ID NO: 288233 - protein, 6 aa, Mycobacterium
SVPPDI

SEQ ID NO: 288234 - protein, 7 aa, Mycobacterium
SVPQPIG

SEQ ID NO: 288235 - protein, 6 aa, Mycobacterium
SVPRAE

SEQ ID NO: 288236 - protein, 4 aa, Mycobacterium
SVPS

SEQ ID NO: 288237 - protein, 5 aa, Mycobacterium
SVPSD

SEQ ID NO: 288238 - protein, 8 aa, Mycobacterium
SVPSNVGY

SEQ ID NO: 288239 - protein, 32 aa, Mycobacterium
SVPSPAPDRHPPAGATSREALAASPRRRRPLG

SEQ ID NO: 288240 - protein, 6 aa, Mycobacterium
SVPSPR

SEQ ID NO: 288241 - protein, 7 aa, Mycobacterium
SVPSTQW

SEQ ID NO: 288242 - protein, 7 aa, Mycobacterium
SVPTGTP

SEQ ID NO: 288243 - protein, 13 aa, Mycobacterium
SVPVEKGVGDRVA

SEQ ID NO: 288244 - protein, 14 aa, Mycobacterium
SVQAAKAGRAAAEQ

SEQ ID NO: 288245 - protein, 7 aa, Mycobacterium
SVQHADA

SEQ ID NO: 288246 - protein, 8 aa, Mycobacterium
SVQRDGER

SEQ ID NO: 288247 - protein, 10 aa, Mycobacterium
SVQVSGPAAG

SEQ ID NO: 288248 - protein, 10 aa, Mycobacterium
SVQVSGPTGA

SEQ ID NO: 288249 - protein, 9 aa, Mycobacterium
SVRAARDRA

SEQ ID NO: 288250 - protein, 5 aa, Mycobacterium
SVRAE

SEQ ID NO: 288251 - protein, 15 aa, Mycobacterium
SVRGSQQQIWQVSER

SEQ ID NO: 288252 - protein, 7 aa, Mycobacterium
SVRPAAN

SEQ ID NO: 288253 - protein, 6 aa, Mycobacterium
SVRPGA

SEQ ID NO: 288254 - protein, 14 aa, Mycobacterium
SVRRGDTVGRTGGD

SEQ ID NO: 288255 - protein, 6 aa, Mycobacterium
SVRRTS

SEQ ID NO: 288256 - protein, 15 aa, Mycobacterium
SVRTAEDAATAMSEV

SEQ ID NO: 288257 - protein, 5 aa, Mycobacterium
SVSAA

SEQ ID NO: 288258 - protein, 25 aa, Mycobacterium
SVSAARLSAATGKQTISDSRSLATS

SEQ ID NO: 288259 - protein, 10 aa, Mycobacterium
SVSAGGANGV

SEQ ID NO: 288260 - protein, 15 aa, Mycobacterium
SVSDDGSESGTGAAA

SEQ ID NO: 288261 - protein, 20 aa, Mycobacterium
SVSDHVSGYAKPQPGQSAPA

SEQ ID NO: 288262 - protein, 22 aa, Mycobacterium
SVSEARLEASTGPETISDSRSL

SEQ ID NO: 288263 - protein, 10 aa, Mycobacterium
SVSEGLNGEA

SEQ ID NO: 288264 - protein, 6 aa, Mycobacterium
SVSGAV

SEQ ID NO: 288265 - protein, 9 aa, Mycobacterium
SVSGPAQDQ

SEQ ID NO: 288266 - protein, 9 aa, Mycobacterium
SVSGPSQEQ

SEQ ID NO: 288267 - protein, 8 aa, Mycobacterium
SVSKTASM

SEQ ID NO: 288268 - protein, 11 aa, Mycobacterium
SVSPPSIPTEA

SEQ ID NO: 288269 - protein, 5 aa, Mycobacterium
SVSPS

SEQ ID NO: 288270 - protein, 6 aa, Mycobacterium
SVSPSL

SEQ ID NO: 288271 - protein, 10 aa, Mycobacterium
SVSPTPPSVL

SEQ ID NO: 288272 - protein, 5 aa, Mycobacterium
SVSRQ

SEQ ID NO: 288273 - protein, 4 aa, Mycobacterium
SVST

SEQ ID NO: 288274 - protein, 11 aa, Mycobacterium
SVSTDSEYRER

SEQ ID NO: 288275 - protein, 8 aa, Mycobacterium
SVSTPTTV

SEQ ID NO: 288276 - protein, 16 aa, Mycobacterium
SVSTSNSQIEHEASVE

SEQ ID NO: 288277 - protein, 5 aa, Mycobacterium
SVTAD

SEQ ID NO: 288278 - protein, 6 aa, Mycobacterium
SVTARQ

SEQ ID NO: 288279 - protein, 6 aa, Mycobacterium
SVTATA

SEQ ID NO: 288280 - protein, 8 aa, Mycobacterium
SVTDADAE

SEQ ID NO: 288281 - protein, 10 aa, Mycobacterium
SVTDPARLPE

SEQ ID NO: 288282 - protein, 6 aa, Mycobacterium
SVTDRG

SEQ ID NO: 288283 - protein, 10 aa, Mycobacterium
SVTDSTASGF

SEQ ID NO: 288284 - protein, 10 aa, Mycobacterium
SVTDTKEREE

SEQ ID NO: 288285 - protein, 8 aa, Mycobacterium
SVTEGASA

SEQ ID NO: 288286 - protein, 4 aa, Mycobacterium
SVTG

SEQ ID NO: 288287 - protein, 5 aa, Mycobacterium
SVTGD

SEQ ID NO: 288288 - protein, 7 aa, Mycobacterium
SVTGLRD

SEQ ID NO: 288289 - protein, 7 aa, Mycobacterium
SVTGRGR

SEQ ID NO: 288290 - protein, 9 aa, Mycobacterium
SVTGRQDPT

SEQ ID NO: 288291 - protein, 6 aa, Mycobacterium
SVTGSL

SEQ ID NO: 288292 - protein, 5 aa, Mycobacterium
SVTGY

SEQ ID NO: 288293 - protein, 11 aa, Mycobacterium
SVTPAEDGKPN

SEQ ID NO: 288294 - protein, 11 aa, Mycobacterium
SVTPAGGGMGT

SEQ ID NO: 288295 - protein, 13 aa, Mycobacterium
SVTPAGSGHATTI

SEQ ID NO: 288296 - protein, 11 aa, Mycobacterium
SVTPGRPSTTR

SEQ ID NO: 288297 - protein, 10 aa, Mycobacterium
SVTPSPPVDR

SEQ ID NO: 288298 - protein, 9 aa, Mycobacterium
SVTPSPRGP

SEQ ID NO: 288299 - protein, 8 aa, Mycobacterium
SVTPTKRT

SEQ ID NO: 288300 - protein, 9 aa, Mycobacterium
SVTRGLDES

SEQ ID NO: 288301 - protein, 7 aa, Mycobacterium
SVTSPGW

SEQ ID NO: 288302 - protein, 7 aa, Mycobacterium
SVTSQRA

SEQ ID NO: 288303 - protein, 7 aa, Mycobacterium
SVTTAPG

SEQ ID NO: 288304 - protein, 6 aa, Mycobacterium
SVTTAQ

SEQ ID NO: 288305 - protein, 5 aa, Mycobacterium
SVTTE

SEQ ID NO: 288306 - protein, 9 aa, Mycobacterium
SVTTPEEPE

SEQ ID NO: 288307 - protein, 12 aa, Mycobacterium
SVTTPPPSGSSV

SEQ ID NO: 288308 - protein, 19 aa, Mycobacterium
SVTTSSPRRLAADRDSAAA

SEQ ID NO: 288309 - protein, 14 aa, Mycobacterium
SVTVGTDDDGPALR

SEQ ID NO: 288310 - protein, 8 aa, Mycobacterium
SVVNPDRG

SEQ ID NO: 288311 - protein, 21 aa, Mycobacterium
SVVPSGGSSVPVSTPTAPAHT

SEQ ID NO: 288312 - protein, 6 aa, Mycobacterium
SVVTDT

SEQ ID NO: 288313 - protein, 8 aa, Mycobacterium
SVYGQPTG

SEQ ID NO: 288314 - protein, 6 aa, Mycobacterium
SWADTG

SEQ ID NO: 288315 - protein, 29 aa, Mycobacterium
SWASTPPGTPPQQPVGPTPWNQPPPKRNP

SEQ ID NO: 288316 - protein, 5 aa, Mycobacterium
SWDDA

SEQ ID NO: 288317 - protein, 6 aa, Mycobacterium
SWDGPA

SEQ ID NO: 288318 - protein, 10 aa, Mycobacterium
SWETRSAADV

SEQ ID NO: 288319 - protein, 6 aa, Mycobacterium
SWGGGE

SEQ ID NO: 288320 - protein, 9 aa, Mycobacterium
SWKPGPDWE

SEQ ID NO: 288321 - protein, 16 aa, Mycobacterium
SWNGAKNTFSTDPANL

SEQ ID NO: 288322 - protein, 5 aa, Mycobacterium
SWPPD

SEQ ID NO: 288323 - protein, 140 aa, Mycobacterium
SWQPPGQGDHSSDPTMAGSPWQQQPTQDATWQTPAYTPAEYPQYQQPVDPAYPQQYPQSAPAYGQPDFGSQATQFGAPPQFGQPGQYGQAAQPGQYGQPAQYGQPGQYGAPGQPGQYGQPGQYPGQYAPYDQAAKSSKRS

SEQ ID NO: 288324 - protein, 5 aa, Mycobacterium
SWRDT

SEQ ID NO: 288325 - protein, 12 aa, Mycobacterium
SWRDTPKYRFDN

SEQ ID NO: 288326 - protein, 4 aa, Mycobacterium
SWRR

SEQ ID NO: 288327 - protein, 15 aa, Mycobacterium
SWRSGGARFNPATAG

SEQ ID NO: 288328 - protein, 5 aa, Mycobacterium
SWRTP

SEQ ID NO: 288329 - protein, 8 aa, Mycobacterium
SWSAGSRE

SEQ ID NO: 288330 - protein, 9 aa, Mycobacterium
SWSAGSRQV

SEQ ID NO: 288331 - protein, 12 aa, Mycobacterium
SWTDGRPRTENL

SEQ ID NO: 288332 - protein, 7 aa, Mycobacterium
SWTTAGT

SEQ ID NO: 288333 - protein, 9 aa, Mycobacterium
SWVTPGPLA

SEQ ID NO: 288334 - protein, 6 aa, Mycobacterium
SYADDP

SEQ ID NO: 288335 - protein, 6 aa, Mycobacterium
SYADGT

SEQ ID NO: 288336 - protein, 6 aa, Mycobacterium
SYADNP

SEQ ID NO: 288337 - protein, 5 aa, Mycobacterium
SYADR

SEQ ID NO: 288338 - protein, 7 aa, Mycobacterium
SYAEEAA

SEQ ID NO: 288339 - protein, 9 aa, Mycobacterium
SYAGTYSAK

SEQ ID NO: 288340 - protein, 12 aa, Mycobacterium
SYAPGGSKDPSV

SEQ ID NO: 288341 - protein, 7 aa, Mycobacterium
SYASNRN

SEQ ID NO: 288342 - protein, 9 aa, Mycobacterium
SYATEREAF

SEQ ID NO: 288343 - protein, 26 aa, Mycobacterium
SYATPDATAATPKRISSPPDGPAERY

SEQ ID NO: 288344 - protein, 16 aa, Mycobacterium
SYDATEEPAEFAPPPR

SEQ ID NO: 288345 - protein, 12 aa, Mycobacterium
SYDDGSQLSERD

SEQ ID NO: 288346 - protein, 15 aa, Mycobacterium
SYDPHAGAWQPGPPL

SEQ ID NO: 288347 - protein, 6 aa, Mycobacterium
SYDPNA

SEQ ID NO: 288348 - protein, 10 aa, Mycobacterium
SYDSAGTETP

SEQ ID NO: 288349 - protein, 10 aa, Mycobacterium
SYDTEGTETP

SEQ ID NO: 288350 - protein, 6 aa, Mycobacterium
SYEGGR

SEQ ID NO: 288351 - protein, 10 aa, Mycobacterium
SYEGTGTGAT

SEQ ID NO: 288352 - protein, 39 aa, Mycobacterium
SYEQNGDGQWRRKGPVQARPAHAGEAISTPEGPATAADG

SEQ ID NO: 288353 - protein, 4 aa, Mycobacterium
SYER

SEQ ID NO: 288354 - protein, 5 aa, Mycobacterium
SYGAG

SEQ ID NO: 288355 - protein, 14 aa, Mycobacterium
SYGENKLAAKATSA

SEQ ID NO: 288356 - protein, 7 aa, Mycobacterium
SYGENSI

SEQ ID NO: 288357 - protein, 13 aa, Mycobacterium
SYGENSLAATATS

SEQ ID NO: 288358 - protein, 8 aa, Mycobacterium
SYGEYGSA

SEQ ID NO: 288359 - protein, 25 aa, Mycobacterium
SYGGDYGADYGAYPPPDQPPAPEPV

SEQ ID NO: 288360 - protein, 5 aa, Mycobacterium
SYGGG

SEQ ID NO: 288361 - protein, 9 aa, Mycobacterium
SYGGKDVGA

SEQ ID NO: 288362 - protein, 6 aa, Mycobacterium
SYGGPE

SEQ ID NO: 288363 - protein, 11 aa, Mycobacterium
SYGGQGRVPGD

SEQ ID NO: 288364 - protein, 9 aa, Mycobacterium
SYGPNGRAN

SEQ ID NO: 288365 - protein, 4 aa, Mycobacterium
SYGS

SEQ ID NO: 288366 - protein, 15 aa, Mycobacterium
SYGSADLQSIQTDQT

SEQ ID NO: 288367 - protein, 5 aa, Mycobacterium
SYGSS

SEQ ID NO: 288368 - protein, 9 aa, Mycobacterium
SYGSSEVAG

SEQ ID NO: 288369 - protein, 5 aa, Mycobacterium
SYGTG

SEQ ID NO: 288370 - protein, 6 aa, Mycobacterium
SYHSRT

SEQ ID NO: 288371 - protein, 10 aa, Mycobacterium
SYIKPGGEPI

SEQ ID NO: 288372 - protein, 10 aa, Mycobacterium
SYIKPGSEPV

SEQ ID NO: 288373 - protein, 5 aa, Mycobacterium
SYKTT

SEQ ID NO: 288374 - protein, 29 aa, Mycobacterium
SYNPTQTDSPPTAPPRDLPVPATTPSTAI

SEQ ID NO: 288375 - protein, 5 aa, Mycobacterium
SYNRT

SEQ ID NO: 288376 - protein, 12 aa, Mycobacterium
SYPAESGSFSDE

SEQ ID NO: 288377 - protein, 6 aa, Mycobacterium
SYPDLK

SEQ ID NO: 288378 - protein, 18 aa, Mycobacterium
SYPGGGPQLPLLPTTWSP

SEQ ID NO: 288379 - protein, 7 aa, Mycobacterium
SYPGGMP

SEQ ID NO: 288380 - protein, 5 aa, Mycobacterium
SYPRD

SEQ ID NO: 288381 - protein, 24 aa, Mycobacterium
SYQAGEVGGKLDEAGDAIRDHGSD

SEQ ID NO: 288382 - protein, 4 aa, Mycobacterium
SYQG

SEQ ID NO: 288383 - protein, 7 aa, Mycobacterium
SYQRPPG

SEQ ID NO: 288384 - protein, 10 aa, Mycobacterium
SYQSTGSDSA

SEQ ID NO: 288385 - protein, 29 aa, Mycobacterium
SYRDGSMSVDGNGRPSLAETSVQAARDST

SEQ ID NO: 288386 - protein, 7 aa, Mycobacterium
SYRGAPL

SEQ ID NO: 288387 - protein, 5 aa, Mycobacterium
SYRGP

SEQ ID NO: 288388 - protein, 18 aa, Mycobacterium
SYRPTTPGQEPEPLSGRA

SEQ ID NO: 288389 - protein, 5 aa, Mycobacterium
SYRSD

SEQ ID NO: 288390 - protein, 4 aa, Mycobacterium
SYSE

SEQ ID NO: 288391 - protein, 7 aa, Mycobacterium
SYSGSPW

SEQ ID NO: 288392 - protein, 7 aa, Mycobacterium
SYSPDGE

SEQ ID NO: 288393 - protein, 16 aa, Mycobacterium
SYSPDGSRLAASGADG

SEQ ID NO: 288394 - protein, 9 aa, Mycobacterium
SYSPPTTTV

SEQ ID NO: 288395 - protein, 9 aa, Mycobacterium
SYSPSAVSQ

SEQ ID NO: 288396 - protein, 5 aa, Mycobacterium
SYTAE

SEQ ID NO: 288397 - protein, 9 aa, Mycobacterium
SYTEEEAKA

SEQ ID NO: 288398 - protein, 5 aa, Mycobacterium
SYTGG

SEQ ID NO: 288399 - protein, 8 aa, Mycobacterium
SYTNYERQ

SEQ ID NO: 288400 - protein, 11 aa, Mycobacterium
SYTPTPGNIGG

SEQ ID NO: 288401 - protein, 5 aa, Mycobacterium
SYTSL

SEQ ID NO: 288402 - protein, 7 aa, Mycobacterium
SYTSPEQ

SEQ ID NO: 288403 - protein, 16 aa, Mycobacterium
SYTTGTDEGGRGPNAW

SEQ ID NO: 288404 - protein, 10 aa, Mycobacterium
SYVKPGSDPI

SEQ ID NO: 288405 - protein, 5 aa, Mycobacterium
SYYSP

SEQ ID NO: 288406 - protein, 5 aa, Mycobacterium
TAAAA

SEQ ID NO: 288407 - protein, 16 aa, Mycobacterium
TAAAAAGGAAQGGLAG

SEQ ID NO: 288408 - protein, 13 aa, Mycobacterium
TAAAAGISPLDTA

SEQ ID NO: 288409 - protein, 6 aa, Mycobacterium
TAAAEA

SEQ ID NO: 288410 - protein, 17 aa, Mycobacterium
TAAAETEGDAAALAPTE

SEQ ID NO: 288411 - protein, 17 aa, Mycobacterium
TAAAGKLSDELDRGAGS

SEQ ID NO: 288412 - protein, 6 aa, Mycobacterium
TAAAGM

SEQ ID NO: 288413 - protein, 7 aa, Mycobacterium
TAAAGNP

SEQ ID NO: 288414 - protein, 13 aa, Mycobacterium
TAAANKSSAAMAA

SEQ ID NO: 288415 - protein, 6 aa, Mycobacterium
TAAAPV

SEQ ID NO: 288416 - protein, 36 aa, Mycobacterium
TAAAREDTDDTDGTTDPAAASDEPGDEAEPETEAAT

SEQ ID NO: 288417 - protein, 6 aa, Mycobacterium
TAAAST

SEQ ID NO: 288418 - protein, 22 aa, Mycobacterium
TAAATGSADSESPQSNTAVDPP

SEQ ID NO: 288419 - protein, 7 aa, Mycobacterium
TAAATTA

SEQ ID NO: 288420 - protein, 14 aa, Mycobacterium
TAADDAGERRQANR

SEQ ID NO: 288421 - protein, 8 aa, Mycobacterium
TAADDALT

SEQ ID NO: 288422 - protein, 7 aa, Mycobacterium
TAADDVD

SEQ ID NO: 288423 - protein, 9 aa, Mycobacterium
TAADEDDLG

SEQ ID NO: 288424 - protein, 10 aa, Mycobacterium
TAADETDGAV

SEQ ID NO: 288425 - protein, 6 aa, Mycobacterium
TAADEV

SEQ ID NO: 288426 - protein, 5 aa, Mycobacterium
TAADL

SEQ ID NO: 288427 - protein, 87 aa, Mycobacterium
TAADNRKSAEQVAAAQADYEKEMAEARAQASALRDEARAAGRSVVDEKRAQASGEVAQTLTQADQQLSAQGDQVRSGLESSVDGLSA

SEQ ID NO: 288428 - protein, 39 aa, Mycobacterium
TAADNRKSAEQVAAARADYDKTLAEARGEASSIRDEARV

SEQ ID NO: 288429 - protein, 10 aa, Mycobacterium
TAADPQPIRE

SEQ ID NO: 288430 - protein, 8 aa, Mycobacterium
TAADPYPH

SEQ ID NO: 288431 - protein, 5 aa, Mycobacterium
TAADQ

SEQ ID NO: 288432 - protein, 11 aa, Mycobacterium
TAADRRGRYPS

SEQ ID NO: 288433 - protein, 10 aa, Mycobacterium
TAADTPRKAV

SEQ ID NO: 288434 - protein, 10 aa, Mycobacterium
TAAEAAAANA

SEQ ID NO: 288435 - protein, 13 aa, Mycobacterium
TAAEAPRRGRAAA

SEQ ID NO: 288436 - protein, 13 aa, Mycobacterium
TAAEEALKTTPLE

SEQ ID NO: 288437 - protein, 14 aa, Mycobacterium
TAAEEALKTTPLES

SEQ ID NO: 288438 - protein, 11 aa, Mycobacterium
TAAEEGHHVPE

SEQ ID NO: 288439 - protein, 12 aa, Mycobacterium
TAAEEPDTALAR

SEQ ID NO: 288440 - protein, 19 aa, Mycobacterium
TAAEHAAARGVQSDAQSVA

SEQ ID NO: 288441 - protein, 7 aa, Mycobacterium
TAAEREL

SEQ ID NO: 288442 - protein, 22 aa, Mycobacterium
TAAESRRRKAARHGSGSADRPV

SEQ ID NO: 288443 - protein, 4 aa, Mycobacterium
TAAG

SEQ ID NO: 288444 - protein, 17 aa, Mycobacterium
TAAGAAPSGDPGGAPRR

SEQ ID NO: 288445 - protein, 12 aa, Mycobacterium
TAAGAQSADGKA

SEQ ID NO: 288446 - protein, 13 aa, Mycobacterium
TAAGAQSDDGKAV

SEQ ID NO: 288447 - protein, 13 aa, Mycobacterium
TAAGAQSNDGKAA

SEQ ID NO: 288448 - protein, 13 aa, Mycobacterium
TAAGAQSNDGKAT

SEQ ID NO: 288449 - protein, 12 aa, Mycobacterium
TAAGAQSNDGMA

SEQ ID NO: 288450 - protein, 6 aa, Mycobacterium
TAAGAT

SEQ ID NO: 288451 - protein, 7 aa, Mycobacterium
TAAGAYT

SEQ ID NO: 288452 - protein, 20 aa, Mycobacterium
TAAGDARKRSDSTREDADDR

SEQ ID NO: 288453 - protein, 12 aa, Mycobacterium
TAAGETAEPEKV

SEQ ID NO: 288454 - protein, 13 aa, Mycobacterium
TAAGETANPRRTI

SEQ ID NO: 288455 - protein, 12 aa, Mycobacterium
TAAGETENPEKV

SEQ ID NO: 288456 - protein, 9 aa, Mycobacterium
TAAGGALDG

SEQ ID NO: 288457 - protein, 13 aa, Mycobacterium
TAAGGGPQDEGAK

SEQ ID NO: 288458 - protein, 12 aa, Mycobacterium
TAAGGVPPSGSP

SEQ ID NO: 288459 - protein, 13 aa, Mycobacterium
TAAGGVPQDEGAK

SEQ ID NO: 288460 - protein, 16 aa, Mycobacterium
TAAGHRQSRNPAALAA

SEQ ID NO: 288461 - protein, 7 aa, Mycobacterium
TAAGQKR

SEQ ID NO: 288462 - protein, 5 aa, Mycobacterium
TAAGS

SEQ ID NO: 288463 - protein, 9 aa, Mycobacterium
TAAGSAEIQ

SEQ ID NO: 288464 - protein, 9 aa, Mycobacterium
TAAGSGSVD

SEQ ID NO: 288465 - protein, 12 aa, Mycobacterium
TAAGSQSADDKA

SEQ ID NO: 288466 - protein, 13 aa, Mycobacterium
TAAGSQSADGKAA

SEQ ID NO: 288467 - protein, 12 aa, Mycobacterium
TAAGSQSVDGKA

SEQ ID NO: 288468 - protein, 13 aa, Mycobacterium
TAAIGAGDTVRVT

SEQ ID NO: 288469 - protein, 14 aa, Mycobacterium
TAAKEAIKGTPLEG

SEQ ID NO: 288470 - protein, 10 aa, Mycobacterium
TAAKTAELEQ

SEQ ID NO: 288471 - protein, 7 aa, Mycobacterium
TAALPGA

SEQ ID NO: 288472 - protein, 13 aa, Mycobacterium
TAALQGEKPSFTR

SEQ ID NO: 288473 - protein, 5 aa, Mycobacterium
TAALS

SEQ ID NO: 288474 - protein, 4 aa, Mycobacterium
TAAN

SEQ ID NO: 288475 - protein, 10 aa, Mycobacterium
TAANANGNVE

SEQ ID NO: 288476 - protein, 8 aa, Mycobacterium
TAANASAM

SEQ ID NO: 288477 - protein, 9 aa, Mycobacterium
TAANITGPA

SEQ ID NO: 288478 - protein, 10 aa, Mycobacterium
TAAPAAADRH

SEQ ID NO: 288479 - protein, 102 aa, Mycobacterium
TAAPAGFTTPPARAEADPEPEPYDEVPERPERSERADRPEPPRAGTPWGESGAQEPVRASKSALKNEDLPDLSGPVPRPPRRSDAAQGGSAVTVGPSRRGPL

SEQ ID NO: 288480 - protein, 10 aa, Mycobacterium
TAAPAGPRGR

SEQ ID NO: 288481 - protein, 10 aa, Mycobacterium
TAAPDDERVN

SEQ ID NO: 288482 - protein, 5 aa, Mycobacterium
TAAPL

SEQ ID NO: 288483 - protein, 15 aa, Mycobacterium
TAAPNAFATGRNPRN

SEQ ID NO: 288484 - protein, 16 aa, Mycobacterium
TAAPNAFATGRNPRNA

SEQ ID NO: 288485 - protein, 16 aa, Mycobacterium
TAAPNAFATGRNPRNS

SEQ ID NO: 288486 - protein, 10 aa, Mycobacterium
TAAPPGETDH

SEQ ID NO: 288487 - protein, 44 aa, Mycobacterium
TAAPPPPPPPPPAAAPVPPPAGAGGTPPDTDTGDRLNPGTGDPL

SEQ ID NO: 288488 - protein, 5 aa, Mycobacterium
TAAPS

SEQ ID NO: 288489 - protein, 20 aa, Mycobacterium
TAAPSTAKRPAKPAKPARSL

SEQ ID NO: 288490 - protein, 25 aa, Mycobacterium
TAAPVPASAQLPAPLPGPATQREPI

SEQ ID NO: 288491 - protein, 15 aa, Mycobacterium
TAAQEAQRSGDFAEY

SEQ ID NO: 288492 - protein, 6 aa, Mycobacterium
TAAQGV

SEQ ID NO: 288493 - protein, 10 aa, Mycobacterium
TAAQHRATAE

SEQ ID NO: 288494 - protein, 20 aa, Mycobacterium
TAAQRSSRRSDALEGAVSQG

SEQ ID NO: 288495 - protein, 4 aa, Mycobacterium
TAAR

SEQ ID NO: 288496 - protein, 6 aa, Mycobacterium
TAARDR

SEQ ID NO: 288497 - protein, 5 aa, Mycobacterium
TAARP

SEQ ID NO: 288498 - protein, 8 aa, Mycobacterium
TAASAGQL

SEQ ID NO: 288499 - protein, 12 aa, Mycobacterium
TAASAGRVPNPY

SEQ ID NO: 288500 - protein, 29 aa, Mycobacterium
TAASEDEFDESEDEFDEADDEFDESEDEF

SEQ ID NO: 288501 - protein, 5 aa, Mycobacterium
TAASL

SEQ ID NO: 288502 - protein, 16 aa, Mycobacterium
TAASRIAKDTAAESLK

SEQ ID NO: 288503 - protein, 14 aa, Mycobacterium
TAASRSAKNTAADS

SEQ ID NO: 288504 - protein, 13 aa, Mycobacterium
TAASSQSADGKAA

SEQ ID NO: 288505 - protein, 6 aa, Mycobacterium
TAASTL

SEQ ID NO: 288506 - protein, 15 aa, Mycobacterium
TAATEELGTLPTPED

SEQ ID NO: 288507 - protein, 6 aa, Mycobacterium
TAATGD

SEQ ID NO: 288508 - protein, 6 aa, Mycobacterium
TAATGG

SEQ ID NO: 288509 - protein, 9 aa, Mycobacterium
TAATGIGAS

SEQ ID NO: 288510 - protein, 8 aa, Mycobacterium
TAATGVGA

SEQ ID NO: 288511 - protein, 11 aa, Mycobacterium
TAATKSTPATL

SEQ ID NO: 288512 - protein, 9 aa, Mycobacterium
TAATPLKST

SEQ ID NO: 288513 - protein, 11 aa, Mycobacterium
TAATTAARART

SEQ ID NO: 288514 - protein, 8 aa, Mycobacterium
TAATYEQV

SEQ ID NO: 288515 - protein, 7 aa, Mycobacterium
TAATYKD

SEQ ID NO: 288516 - protein, 16 aa, Mycobacterium
TAATYKDIPSRTVPST

SEQ ID NO: 288517 - protein, 12 aa, Mycobacterium
TAATYKDIQTGA

SEQ ID NO: 288518 - protein, 10 aa, Mycobacterium
TAATYKDMSD

SEQ ID NO: 288519 - protein, 4 aa, Mycobacterium
TAAV

SEQ ID NO: 288520 - protein, 10 aa, Mycobacterium
TAAVGEQGWS

SEQ ID NO: 288521 - protein, 31 aa, Mycobacterium
TACAPPRSTAVNDPGIAAEAAATKAGGGQYA

SEQ ID NO: 288522 - protein, 8 aa, Mycobacterium
TADADRRA

SEQ ID NO: 288523 - protein, 8 aa, Mycobacterium
TADATADS

SEQ ID NO: 288524 - protein, 14 aa, Mycobacterium
TADDAPPPAIPGAP

SEQ ID NO: 288525 - protein, 15 aa, Mycobacterium
TADDDDTDADAVDAA

SEQ ID NO: 288526 - protein, 17 aa, Mycobacterium
TADDPQFQPGFEDADTS

SEQ ID NO: 288527 - protein, 14 aa, Mycobacterium
TADDTADKSLEESP

SEQ ID NO: 288528 - protein, 7 aa, Mycobacterium
TADDTRM

SEQ ID NO: 288529 - protein, 11 aa, Mycobacterium
TADEGDNRRPR

SEQ ID NO: 288530 - protein, 16 aa, Mycobacterium
TADGAASVDAVDSLAR

SEQ ID NO: 288531 - protein, 10 aa, Mycobacterium
TADGAPSSLA

SEQ ID NO: 288532 - protein, 5 aa, Mycobacterium
TADGG

SEQ ID NO: 288533 - protein, 6 aa, Mycobacterium
TADGGY

SEQ ID NO: 288534 - protein, 5 aa, Mycobacterium
TADGK

SEQ ID NO: 288535 - protein, 7 aa, Mycobacterium
TADGRRH

SEQ ID NO: 288536 - protein, 7 aa, Mycobacterium
TADGSVA

SEQ ID NO: 288537 - protein, 7 aa, Mycobacterium
TADGSVS

SEQ ID NO: 288538 - protein, 9 aa, Mycobacterium
TADGSVSEV

SEQ ID NO: 288539 - protein, 7 aa, Mycobacterium
TADGTRH

SEQ ID NO: 288540 - protein, 5 aa, Mycobacterium
TADKI

SEQ ID NO: 288541 - protein, 6 aa, Mycobacterium
TADKIS

SEQ ID NO: 288542 - protein, 12 aa, Mycobacterium
TADLGGGEPIPT

SEQ ID NO: 288543 - protein, 12 aa, Mycobacterium
TADNDDDPPPEI

SEQ ID NO: 288544 - protein, 10 aa, Mycobacterium
TADNPYPTTT

SEQ ID NO: 288545 - protein, 8 aa, Mycobacterium
TADPAAFD

SEQ ID NO: 288546 - protein, 6 aa, Mycobacterium
TADPEF

SEQ ID NO: 288547 - protein, 7 aa, Mycobacterium
TADPGLP

SEQ ID NO: 288548 - protein, 10 aa, Mycobacterium
TADPGVSPGD

SEQ ID NO: 288549 - protein, 6 aa, Mycobacterium
TADPLE

SEQ ID NO: 288550 - protein, 8 aa, Mycobacterium
TADPRRPL

SEQ ID NO: 288551 - protein, 8 aa, Mycobacterium
TADPSRRL

SEQ ID NO: 288552 - protein, 6 aa, Mycobacterium
TADPTE

SEQ ID NO: 288553 - protein, 6 aa, Mycobacterium
TADQEF

SEQ ID NO: 288554 - protein, 14 aa, Mycobacterium
TADRAARDRLSGFG

SEQ ID NO: 288555 - protein, 12 aa, Mycobacterium
TADRPTDDLPEP

SEQ ID NO: 288556 - protein, 12 aa, Mycobacterium
TADRSQSAPAAA

SEQ ID NO: 288557 - protein, 8 aa, Mycobacterium
TADRSRAL

SEQ ID NO: 288558 - protein, 7 aa, Mycobacterium
TADRSRP

SEQ ID NO: 288559 - protein, 9 aa, Mycobacterium
TADSARPLS

SEQ ID NO: 288560 - protein, 68 aa, Mycobacterium
TADSDRAVTSTKPLRPTGKRTRRADATEAVTEGSEASASETGEVKKKAGKKSRKPANKKDKSGPSRNP

SEQ ID NO: 288561 - protein, 6 aa, Mycobacterium
TADSGE

SEQ ID NO: 288562 - protein, 7 aa, Mycobacterium
TADSPVT

SEQ ID NO: 288563 - protein, 5 aa, Mycobacterium
TADSS

SEQ ID NO: 288564 - protein, 7 aa, Mycobacterium
TADTAID

SEQ ID NO: 288565 - protein, 17 aa, Mycobacterium
TADTASEIPDNPATGTR

SEQ ID NO: 288566 - protein, 8 aa, Mycobacterium
TADTATRA

SEQ ID NO: 288567 - protein, 7 aa, Mycobacterium
TADTDEA

SEQ ID NO: 288568 - protein, 11 aa, Mycobacterium
TADTGWSAPAV

SEQ ID NO: 288569 - protein, 6 aa, Mycobacterium
TADVSN

SEQ ID NO: 288570 - protein, 5 aa, Mycobacterium
TAEAG

SEQ ID NO: 288571 - protein, 11 aa, Mycobacterium
TAEDEATVDEA

SEQ ID NO: 288572 - protein, 23 aa, Mycobacterium
TAEDGYSAQRSYSLGRPTDGEQV

SEQ ID NO: 288573 - protein, 7 aa, Mycobacterium
TAEDHPL

SEQ ID NO: 288574 - protein, 6 aa, Mycobacterium
TAEDKN

SEQ ID NO: 288575 - protein, 6 aa, Mycobacterium
TAEDNS

SEQ ID NO: 288576 - protein, 7 aa, Mycobacterium
TAEEHPL

SEQ ID NO: 288577 - protein, 13 aa, Mycobacterium
TAEETKVPQRDVP

SEQ ID NO: 288578 - protein, 13 aa, Mycobacterium
TAEETRNPQRDVP

SEQ ID NO: 288579 - protein, 12 aa, Mycobacterium
TAEGALSPDGKA

SEQ ID NO: 288580 - protein, 13 aa, Mycobacterium
TAEGAQSTDGKAA

SEQ ID NO: 288581 - protein, 6 aa, Mycobacterium
TAEKHG

SEQ ID NO: 288582 - protein, 4 aa, Mycobacterium
TAEN

SEQ ID NO: 288583 - protein, 7 aa, Mycobacterium
TAEPAGW

SEQ ID NO: 288584 - protein, 5 aa, Mycobacterium
TAEPG

SEQ ID NO: 288585 - protein, 6 aa, Mycobacterium
TAEPVR

SEQ ID NO: 288586 - protein, 7 aa, Mycobacterium
TAEPYPR

SEQ ID NO: 288587 - protein, 12 aa, Mycobacterium
TAEQRQARPIYS

SEQ ID NO: 288588 - protein, 9 aa, Mycobacterium
TAEQTAAAH

SEQ ID NO: 288589 - protein, 4 aa, Mycobacterium
TAER

SEQ ID NO: 288590 - protein, 10 aa, Mycobacterium
TAEREQSNAD

SEQ ID NO: 288591 - protein, 7 aa, Mycobacterium
TAERQKQ

SEQ ID NO: 288592 - protein, 17 aa, Mycobacterium
TAESEDQARIAGTEPLR

SEQ ID NO: 288593 - protein, 6 aa, Mycobacterium
TAESGA

SEQ ID NO: 288594 - protein, 7 aa, Mycobacterium
TAESKSK

SEQ ID NO: 288595 - protein, 4 aa, Mycobacterium
TAET

SEQ ID NO: 288596 - protein, 7 aa, Mycobacterium
TAFPGDE

SEQ ID NO: 288597 - protein, 10 aa, Mycobacterium
TAFQDSPRSR

SEQ ID NO: 288598 - protein, 5 aa, Mycobacterium
TAGAA

SEQ ID NO: 288599 - protein, 11 aa, Mycobacterium
TAGAAATAAAL

SEQ ID NO: 288600 - protein, 12 aa, Mycobacterium
TAGAAESGDRKA

SEQ ID NO: 288601 - protein, 25 aa, Mycobacterium
TAGAALASAPRTGPPPKVVNPGGGQ

SEQ ID NO: 288602 - protein, 13 aa, Mycobacterium
TAGAAQSADGKAA

SEQ ID NO: 288603 - protein, 7 aa, Mycobacterium
TAGAASL

SEQ ID NO: 288604 - protein, 18 aa, Mycobacterium
TAGADQPEPSTNARGLQR

SEQ ID NO: 288605 - protein, 8 aa, Mycobacterium
TAGAEQRR

SEQ ID NO: 288606 - protein, 7 aa, Mycobacterium
TAGAGGP

SEQ ID NO: 288607 - protein, 11 aa, Mycobacterium
TAGANVSAAEV

SEQ ID NO: 288608 - protein, 14 aa, Mycobacterium
TAGAPFGPHAGEAE

SEQ ID NO: 288609 - protein, 15 aa, Mycobacterium
TAGAPFGPNAGEAEV

SEQ ID NO: 288610 - protein, 5 aa, Mycobacterium
TAGAQ

SEQ ID NO: 288611 - protein, 6 aa, Mycobacterium
TAGASG

SEQ ID NO: 288612 - protein, 6 aa, Mycobacterium
TAGATA

SEQ ID NO: 288613 - protein, 9 aa, Mycobacterium
TAGATGERV

SEQ ID NO: 288614 - protein, 11 aa, Mycobacterium
TAGATNSASGV

SEQ ID NO: 288615 - protein, 12 aa, Mycobacterium
TAGCSDTSCPNL

SEQ ID NO: 288616 - protein, 6 aa, Mycobacterium
TAGDAR

SEQ ID NO: 288617 - protein, 7 aa, Mycobacterium
TAGDDGA

SEQ ID NO: 288618 - protein, 6 aa, Mycobacterium
TAGDDR

SEQ ID NO: 288619 - protein, 8 aa, Mycobacterium
TAGDKSVR

SEQ ID NO: 288620 - protein, 9 aa, Mycobacterium
TAGDLGTTG

SEQ ID NO: 288621 - protein, 13 aa, Mycobacterium
TAGDRVQSADGMT

SEQ ID NO: 288622 - protein, 5 aa, Mycobacterium
TAGDT

SEQ ID NO: 288623 - protein, 8 aa, Mycobacterium
TAGDTRTP

SEQ ID NO: 288624 - protein, 9 aa, Mycobacterium
TAGEEEAAH

SEQ ID NO: 288625 - protein, 12 aa, Mycobacterium
TAGEHKGKTSLE

SEQ ID NO: 288626 - protein, 8 aa, Mycobacterium
TAGERSRE

SEQ ID NO: 288627 - protein, 4 aa, Mycobacterium
TAGG

SEQ ID NO: 288628 - protein, 12 aa, Mycobacterium
TAGGAQSVDEKA

SEQ ID NO: 288629 - protein, 7 aa, Mycobacterium
TAGGASI

SEQ ID NO: 288630 - protein, 6 aa, Mycobacterium
TAGGDA

SEQ ID NO: 288631 - protein, 6 aa, Mycobacterium
TAGGGA

SEQ ID NO: 288632 - protein, 13 aa, Mycobacterium
TAGGGAKGVGTAV

SEQ ID NO: 288633 - protein, 11 aa, Mycobacterium
TAGGGGNPAAA

SEQ ID NO: 288634 - protein, 10 aa, Mycobacterium
TAGGGQPTLA

SEQ ID NO: 288635 - protein, 9 aa, Mycobacterium
TAGGQPSKF

SEQ ID NO: 288636 - protein, 6 aa, Mycobacterium
TAGGRP

SEQ ID NO: 288637 - protein, 12 aa, Mycobacterium
TAGGTSVSTSTD

SEQ ID NO: 288638 - protein, 7 aa, Mycobacterium
TAGHPNR

SEQ ID NO: 288639 - protein, 4 aa, Mycobacterium
TAGI

SEQ ID NO: 288640 - protein, 10 aa, Mycobacterium
TAGIPTPSDT

SEQ ID NO: 288641 - protein, 10 aa, Mycobacterium
TAGKGEDPRY

SEQ ID NO: 288642 - protein, 13 aa, Mycobacterium
TAGKSLSDSSSGL

SEQ ID NO: 288643 - protein, 4 aa, Mycobacterium
TAGL

SEQ ID NO: 288644 - protein, 6 aa, Mycobacterium
TAGLGG

SEQ ID NO: 288645 - protein, 5 aa, Mycobacterium
TAGLQ

SEQ ID NO: 288646 - protein, 5 aa, Mycobacterium
TAGMG

SEQ ID NO: 288647 - protein, 4 aa, Mycobacterium
TAGN

SEQ ID NO: 288648 - protein, 6 aa, Mycobacterium
TAGNGA

SEQ ID NO: 288649 - protein, 10 aa, Mycobacterium
TAGNQIREAK

SEQ ID NO: 288650 - protein, 4 aa, Mycobacterium
TAGP

SEQ ID NO: 288651 - protein, 6 aa, Mycobacterium
TAGPAS

SEQ ID NO: 288652 - protein, 7 aa, Mycobacterium
TAGPGEL

SEQ ID NO: 288653 - protein, 7 aa, Mycobacterium
TAGPGNQ

SEQ ID NO: 288654 - protein, 7 aa, Mycobacterium
TAGPGPL

SEQ ID NO: 288655 - protein, 9 aa, Mycobacterium
TAGPNDPIA

SEQ ID NO: 288656 - protein, 9 aa, Mycobacterium
TAGPNDPVA

SEQ ID NO: 288657 - protein, 11 aa, Mycobacterium
TAGPPPTGSNV

SEQ ID NO: 288658 - protein, 13 aa, Mycobacterium
TAGPRGEDSAPPA

SEQ ID NO: 288659 - protein, 7 aa, Mycobacterium
TAGPTEQ

SEQ ID NO: 288660 - protein, 16 aa, Mycobacterium
TAGPTEQLFPGVPNQP

SEQ ID NO: 288661 - protein, 8 aa, Mycobacterium
TAGPTREE

SEQ ID NO: 288662 - protein, 7 aa, Mycobacterium
TAGQAAA

SEQ ID NO: 288663 - protein, 9 aa, Mycobacterium
TAGQGNYAA

SEQ ID NO: 288664 - protein, 7 aa, Mycobacterium
TAGQPVT

SEQ ID NO: 288665 - protein, 4 aa, Mycobacterium
TAGR

SEQ ID NO: 288666 - protein, 6 aa, Mycobacterium
TAGRGA

SEQ ID NO: 288667 - protein, 8 aa, Mycobacterium
TAGRGSDY

SEQ ID NO: 288668 - protein, 8 aa, Mycobacterium
TAGRNHSS

SEQ ID NO: 288669 - protein, 13 aa, Mycobacterium
TAGRPGLDPRIGG

SEQ ID NO: 288670 - protein, 12 aa, Mycobacterium
TAGRPRSGEKPV

SEQ ID NO: 288671 - protein, 11 aa, Mycobacterium
TAGRPRSPERP

SEQ ID NO: 288672 - protein, 24 aa, Mycobacterium
TAGRPTNRVRNGKHEASDPTGGQM

SEQ ID NO: 288673 - protein, 6 aa, Mycobacterium
TAGRRA

SEQ ID NO: 288674 - protein, 15 aa, Mycobacterium
TAGRRSVVAPVVGGA

SEQ ID NO: 288675 - protein, 8 aa, Mycobacterium
TAGSNATT

SEQ ID NO: 288676 - protein, 7 aa, Mycobacterium
TAGSPLG

SEQ ID NO: 288677 - protein, 6 aa, Mycobacterium
TAGSRE

SEQ ID NO: 288678 - protein, 6 aa, Mycobacterium
TAGSRQ

SEQ ID NO: 288679 - protein, 7 aa, Mycobacterium
TAGSSCT

SEQ ID NO: 288680 - protein, 7 aa, Mycobacterium
TAGSTAT

SEQ ID NO: 288681 - protein, 4 aa, Mycobacterium
TAGT

SEQ ID NO: 288682 - protein, 9 aa, Mycobacterium
TAGTGDSAE

SEQ ID NO: 288683 - protein, 15 aa, Mycobacterium
TAGTGGGYGPEGVNG

SEQ ID NO: 288684 - protein, 12 aa, Mycobacterium
TAGTPVEALTGD

SEQ ID NO: 288685 - protein, 13 aa, Mycobacterium
TAGTQHGAFTEKL

SEQ ID NO: 288686 - protein, 5 aa, Mycobacterium
TAGVG

SEQ ID NO: 288687 - protein, 4 aa, Mycobacterium
TAGW

SEQ ID NO: 288688 - protein, 6 aa, Mycobacterium
TAHAAG

SEQ ID NO: 288689 - protein, 7 aa, Mycobacterium
TAHDGNA

SEQ ID NO: 288690 - protein, 8 aa, Mycobacterium
TAHGGGAG

SEQ ID NO: 288691 - protein, 10 aa, Mycobacterium
TAHLDADTEA

SEQ ID NO: 288692 - protein, 5 aa, Mycobacterium
TAHLS

SEQ ID NO: 288693 - protein, 12 aa, Mycobacterium
TAHNGARAPSNI

SEQ ID NO: 288694 - protein, 20 aa, Mycobacterium
TAHNGARDPSNVVGAGSVDP

SEQ ID NO: 288695 - protein, 11 aa, Mycobacterium
TAHPPAGGRDN

SEQ ID NO: 288696 - protein, 5 aa, Mycobacterium
TAHQP

SEQ ID NO: 288697 - protein, 9 aa, Mycobacterium
TAHRPPGGW

SEQ ID NO: 288698 - protein, 4 aa, Mycobacterium
TAHT

SEQ ID NO: 288699 - protein, 4 aa, Mycobacterium
TAIA

SEQ ID NO: 288700 - protein, 8 aa, Mycobacterium
TAIATGGA

SEQ ID NO: 288701 - protein, 12 aa, Mycobacterium
TAIDPDDPRSRP

SEQ ID NO: 288702 - protein, 4 aa, Mycobacterium
TAIG

SEQ ID NO: 288703 - protein, 7 aa, Mycobacterium
TAIGGPP

SEQ ID NO: 288704 - protein, 7 aa, Mycobacterium
TAIGPSQ

SEQ ID NO: 288705 - protein, 6 aa, Mycobacterium
TAIPGL

SEQ ID NO: 288706 - protein, 13 aa, Mycobacterium
TAIPHAKGAKSKV

SEQ ID NO: 288707 - protein, 12 aa, Mycobacterium
TAITGGDTPPPA

SEQ ID NO: 288708 - protein, 7 aa, Mycobacterium
TAKADDV

SEQ ID NO: 288709 - protein, 6 aa, Mycobacterium
TAKAPG

SEQ ID NO: 288710 - protein, 28 aa, Mycobacterium
TAKEIGSMTDTPESTSERIAGAGERRGV

SEQ ID NO: 288711 - protein, 12 aa, Mycobacterium
TAKLATDSRQNL

SEQ ID NO: 288712 - protein, 9 aa, Mycobacterium
TAKPEQTLE

SEQ ID NO: 288713 - protein, 10 aa, Mycobacterium
TAKPQDQSAL

SEQ ID NO: 288714 - protein, 15 aa, Mycobacterium
TAKRGASLTAGPAQA

SEQ ID NO: 288715 - protein, 5 aa, Mycobacterium
TAKRS

SEQ ID NO: 288716 - protein, 8 aa, Mycobacterium
TAKTIAEP

SEQ ID NO: 288717 - protein, 11 aa, Mycobacterium
TALAAQPGVRT

SEQ ID NO: 288718 - protein, 12 aa, Mycobacterium
TALAGRAADDPV

SEQ ID NO: 288719 - protein, 4 aa, Mycobacterium
TALD

SEQ ID NO: 288720 - protein, 15 aa, Mycobacterium
TALDEAEATKTPPPR

SEQ ID NO: 288721 - protein, 16 aa, Mycobacterium
TALDTGYRDAMGGANG

SEQ ID NO: 288722 - protein, 4 aa, Mycobacterium
TALG

SEQ ID NO: 288723 - protein, 14 aa, Mycobacterium
TALGAASGQVDLGG

SEQ ID NO: 288724 - protein, 11 aa, Mycobacterium
TALGDNSNADV

SEQ ID NO: 288725 - protein, 8 aa, Mycobacterium
TALGKGSR

SEQ ID NO: 288726 - protein, 16 aa, Mycobacterium
TALGQVDDQDKPGREL

SEQ ID NO: 288727 - protein, 9 aa, Mycobacterium
TALKPGHNT

SEQ ID NO: 288728 - protein, 9 aa, Mycobacterium
TALKPGSNT

SEQ ID NO: 288729 - protein, 17 aa, Mycobacterium
TALPGPPPQPGIDCRTV

SEQ ID NO: 288730 - protein, 5 aa, Mycobacterium
TALPK

SEQ ID NO: 288731 - protein, 5 aa, Mycobacterium
TALPP

SEQ ID NO: 288732 - protein, 9 aa, Mycobacterium
TALPPRRRW

SEQ ID NO: 288733 - protein, 6 aa, Mycobacterium
TAMGDP

SEQ ID NO: 288734 - protein, 10 aa, Mycobacterium
TAMKSRRNRT

SEQ ID NO: 288735 - protein, 6 aa, Mycobacterium
TAMQDD

SEQ ID NO: 288736 - protein, 8 aa, Mycobacterium
TAMQGQPG

SEQ ID NO: 288737 - protein, 7 aa, Mycobacterium
TANARGE

SEQ ID NO: 288738 - protein, 14 aa, Mycobacterium
TANAYTAGEDFPGQ

SEQ ID NO: 288739 - protein, 10 aa, Mycobacterium
TANETNTTKR

SEQ ID NO: 288740 - protein, 7 aa, Mycobacterium
TANGALA

SEQ ID NO: 288741 - protein, 8 aa, Mycobacterium
TANGSPDG

SEQ ID NO: 288742 - protein, 11 aa, Mycobacterium
TANHGAGLSSA

SEQ ID NO: 288743 - protein, 7 aa, Mycobacterium
TANPAAR

SEQ ID NO: 288744 - protein, 10 aa, Mycobacterium
TANPSTGSFA

SEQ ID NO: 288745 - protein, 5 aa, Mycobacterium
TANPV

SEQ ID NO: 288746 - protein, 6 aa, Mycobacterium
TANQDQ

SEQ ID NO: 288747 - protein, 9 aa, Mycobacterium
TANQPGQHL

SEQ ID NO: 288748 - protein, 15 aa, Mycobacterium
TANQPGQTLPVGAPE

SEQ ID NO: 288749 - protein, 18 aa, Mycobacterium
TANQQGQTLPLGEPEKDV

SEQ ID NO: 288750 - protein, 15 aa, Mycobacterium
TANTAQTLTNDYSQA

SEQ ID NO: 288751 - protein, 13 aa, Mycobacterium
TANVRPSPNENVV

SEQ ID NO: 288752 - protein, 7 aa, Mycobacterium
TAPAAKN

SEQ ID NO: 288753 - protein, 9 aa, Mycobacterium
TAPAEGRDA

SEQ ID NO: 288754 - protein, 7 aa, Mycobacterium
TAPAGLP

SEQ ID NO: 288755 - protein, 14 aa, Mycobacterium
TAPAHTGHSGDAAW

SEQ ID NO: 288756 - protein, 6 aa, Mycobacterium
TAPAKI

SEQ ID NO: 288757 - protein, 135 aa, Mycobacterium
TAPAPRPKYDPYAQYGQYGQYGQYGQQPYYGQPGGQQQHPGYGSQYGGYAPGQGPTQTAVPTGGFGAQSAPQSGAQPAAQQGPSTPPTGFPSFSPPPAAGAGSVGSASNYSNQGGGQQPYGQEQQSPSSQSGPAP

SEQ ID NO: 288758 - protein, 16 aa, Mycobacterium
TAPARTAPARPTGRAV

SEQ ID NO: 288759 - protein, 11 aa, Mycobacterium
TAPATDHGYEG

SEQ ID NO: 288760 - protein, 13 aa, Mycobacterium
TAPATPPPPAAKR

SEQ ID NO: 288761 - protein, 13 aa, Mycobacterium
TAPDGKTVEDPAW

SEQ ID NO: 288762 - protein, 16 aa, Mycobacterium
TAPDGSRKEEPRPEPV

SEQ ID NO: 288763 - protein, 6 aa, Mycobacterium
TAPDRV

SEQ ID NO: 288764 - protein, 5 aa, Mycobacterium
TAPDY

SEQ ID NO: 288765 - protein, 4 aa, Mycobacterium
TAPE

SEQ ID NO: 288766 - protein, 14 aa, Mycobacterium
TAPEGESQTHTGTQ

SEQ ID NO: 288767 - protein, 6 aa, Mycobacterium
TAPEGH

SEQ ID NO: 288768 - protein, 11 aa, Mycobacterium
TAPEPAPSAQV

SEQ ID NO: 288769 - protein, 8 aa, Mycobacterium
TAPEPATE

SEQ ID NO: 288770 - protein, 11 aa, Mycobacterium
TAPEPDSESDV

SEQ ID NO: 288771 - protein, 10 aa, Mycobacterium
TAPEPYPGPG

SEQ ID NO: 288772 - protein, 6 aa, Mycobacterium
TAPETA

SEQ ID NO: 288773 - protein, 9 aa, Mycobacterium
TAPETRRDH

SEQ ID NO: 288774 - protein, 10 aa, Mycobacterium
TAPFKSATKW

SEQ ID NO: 288775 - protein, 7 aa, Mycobacterium
TAPFPPR

SEQ ID NO: 288776 - protein, 15 aa, Mycobacterium
TAPGADRITDEQRPK

SEQ ID NO: 288777 - protein, 6 aa, Mycobacterium
TAPGAG

SEQ ID NO: 288778 - protein, 5 aa, Mycobacterium
TAPGE

SEQ ID NO: 288779 - protein, 13 aa, Mycobacterium
TAPGPTPSGPPTA

SEQ ID NO: 288780 - protein, 20 aa, Mycobacterium
TAPGRAWSGAGAASAGASGV

SEQ ID NO: 288781 - protein, 7 aa, Mycobacterium
TAPGTKV

SEQ ID NO: 288782 - protein, 5 aa, Mycobacterium
TAPGV

SEQ ID NO: 288783 - protein, 5 aa, Mycobacterium
TAPGY

SEQ ID NO: 288784 - protein, 19 aa, Mycobacterium
TAPGYSSTTAPALPPLRTS

SEQ ID NO: 288785 - protein, 10 aa, Mycobacterium
TAPKHGKLGR

SEQ ID NO: 288786 - protein, 10 aa, Mycobacterium
TAPKKGKDAA

SEQ ID NO: 288787 - protein, 4 aa, Mycobacterium
TAPL

SEQ ID NO: 288788 - protein, 6 aa, Mycobacterium
TAPLGR

SEQ ID NO: 288789 - protein, 13 aa, Mycobacterium
TAPLGTSPDGRSG

SEQ ID NO: 288790 - protein, 19 aa, Mycobacterium
TAPLRDGAKAVSGELSRET

SEQ ID NO: 288791 - protein, 14 aa, Mycobacterium
TAPLSADDADAFTD

SEQ ID NO: 288792 - protein, 41 aa, Mycobacterium
TAPLSGPPMRPRTPNAGVADGRPDGVAGPGQPDTSTATTVP

SEQ ID NO: 288793 - protein, 8 aa, Mycobacterium
TAPLTPSD

SEQ ID NO: 288794 - protein, 5 aa, Mycobacterium
TAPLY

SEQ ID NO: 288795 - protein, 5 aa, Mycobacterium
TAPMP

SEQ ID NO: 288796 - protein, 20 aa, Mycobacterium
TAPNRPGSGRLDSSAKRTTA

SEQ ID NO: 288797 - protein, 8 aa, Mycobacterium
TAPNRPSR

SEQ ID NO: 288798 - protein, 27 aa, Mycobacterium
TAPNSSTAEARKVDDAGDGSAWSAASA

SEQ ID NO: 288799 - protein, 4 aa, Mycobacterium
TAPP

SEQ ID NO: 288800 - protein, 79 aa, Mycobacterium
TAPPAAPETTTATTTTTTTTTTSPTTTTTTTTTTTTTPPTTTTTAPTTTTAPPTTTAPTTTVPPTTVPPTTTGGIATTT

SEQ ID NO: 288801 - protein, 13 aa, Mycobacterium
TAPPATPDRHMPD

SEQ ID NO: 288802 - protein, 9 aa, Mycobacterium
TAPPAVRPV

SEQ ID NO: 288803 - protein, 10 aa, Mycobacterium
TAPPEGKEAA

SEQ ID NO: 288804 - protein, 15 aa, Mycobacterium
TAPPPALGDRRPELA

SEQ ID NO: 288805 - protein, 30 aa, Mycobacterium
TAPPPATDPGAPVAAPSAFDGGKSSGPAVT

SEQ ID NO: 288806 - protein, 29 aa, Mycobacterium
TAPPPPPPPPPGGDAPADGTGGPNAGQPL

SEQ ID NO: 288807 - protein, 8 aa, Mycobacterium
TAPPPPSG

SEQ ID NO: 288808 - protein, 14 aa, Mycobacterium
TAPPPTVGRPASPE

SEQ ID NO: 288809 - protein, 9 aa, Mycobacterium
TAPPPVPAP

SEQ ID NO: 288810 - protein, 5 aa, Mycobacterium
TAPPT

SEQ ID NO: 288811 - protein, 30 aa, Mycobacterium
TAPQAGPTPGLAPALGNAGPPPGPAPGSAF

SEQ ID NO: 288812 - protein, 11 aa, Mycobacterium
TAPQPAPPGAG

SEQ ID NO: 288813 - protein, 5 aa, Mycobacterium
TAPRG

SEQ ID NO: 288814 - protein, 6 aa, Mycobacterium
TAPRGA

SEQ ID NO: 288815 - protein, 11 aa, Mycobacterium
TAPRLPDGTPF

SEQ ID NO: 288816 - protein, 19 aa, Mycobacterium
TAPRPGARMDPASTGPDGA

SEQ ID NO: 288817 - protein, 20 aa, Mycobacterium
TAPRPGARMDPESTGPEGTH

SEQ ID NO: 288818 - protein, 12 aa, Mycobacterium
TAPSETAPAGAS

SEQ ID NO: 288819 - protein, 5 aa, Mycobacterium
TAPSL

SEQ ID NO: 288820 - protein, 12 aa, Mycobacterium
TAPSPAPSAPTT

SEQ ID NO: 288821 - protein, 9 aa, Mycobacterium
TAPSVDGSV

SEQ ID NO: 288822 - protein, 6 aa, Mycobacterium
TAPSVG

SEQ ID NO: 288823 - protein, 7 aa, Mycobacterium
TAPTAIR

SEQ ID NO: 288824 - protein, 23 aa, Mycobacterium
TAPTAWSETEELEEPEPYDDPRR

SEQ ID NO: 288825 - protein, 6 aa, Mycobacterium
TAPTFK

SEQ ID NO: 288826 - protein, 19 aa, Mycobacterium
TAPTKAHVPDAPGNFDPVP

SEQ ID NO: 288827 - protein, 138 aa, Mycobacterium
TAPTPRPKYDPYSQYGQYGQYGQYGQQPYYGQPGGQQHGGQQGYGSQYGGYGASGAPTQGGAPTGGFGAQPSPQSGSQPSAQHQGSSTPPTGFPSFSPPPNVGGGSDAGSPTNYSEQSGGQSFGQEQQSPSSPSGPAP

SEQ ID NO: 288828 - protein, 6 aa, Mycobacterium
TAPTTA

SEQ ID NO: 288829 - protein, 8 aa, Mycobacterium
TAPTYRQD

SEQ ID NO: 288830 - protein, 8 aa, Mycobacterium
TAPVAGTA

SEQ ID NO: 288831 - protein, 9 aa, Mycobacterium
TAPVGPGTR

SEQ ID NO: 288832 - protein, 11 aa, Mycobacterium
TAPVPSPNDVP

SEQ ID NO: 288833 - protein, 5 aa, Mycobacterium
TAPYG

SEQ ID NO: 288834 - protein, 4 aa, Mycobacterium
TAQA

SEQ ID NO: 288835 - protein, 19 aa, Mycobacterium
TAQAASTPDPNAGRLSSMP

SEQ ID NO: 288836 - protein, 9 aa, Mycobacterium
TAQAATLSA

SEQ ID NO: 288837 - protein, 9 aa, Mycobacterium
TAQAATVSA

SEQ ID NO: 288838 - protein, 8 aa, Mycobacterium
TAQADERG

SEQ ID NO: 288839 - protein, 5 aa, Mycobacterium
TAQAF

SEQ ID NO: 288840 - protein, 11 aa, Mycobacterium
TAQAGPRGGPA

SEQ ID NO: 288841 - protein, 8 aa, Mycobacterium
TAQANTPL

SEQ ID NO: 288842 - protein, 7 aa, Mycobacterium
TAQARQL

SEQ ID NO: 288843 - protein, 12 aa, Mycobacterium
TAQDATNEETPT

SEQ ID NO: 288844 - protein, 11 aa, Mycobacterium
TAQDNPSKQKM

SEQ ID NO: 288845 - protein, 6 aa, Mycobacterium
TAQERL

SEQ ID NO: 288846 - protein, 6 aa, Mycobacterium
TAQGTL

SEQ ID NO: 288847 - protein, 7 aa, Mycobacterium
TAQGTQI

SEQ ID NO: 288848 - protein, 5 aa, Mycobacterium
TAQIG

SEQ ID NO: 288849 - protein, 8 aa, Mycobacterium
TAQNDPAV

SEQ ID NO: 288850 - protein, 14 aa, Mycobacterium
TAQNDPSAVRGARN

SEQ ID NO: 288851 - protein, 7 aa, Mycobacterium
TAQPHAG

SEQ ID NO: 288852 - protein, 5 aa, Mycobacterium
TAQPL

SEQ ID NO: 288853 - protein, 6 aa, Mycobacterium
TAQPLG

SEQ ID NO: 288854 - protein, 11 aa, Mycobacterium
TAQPLRGASGT

SEQ ID NO: 288855 - protein, 9 aa, Mycobacterium
TAQPPRPPT

SEQ ID NO: 288856 - protein, 6 aa, Mycobacterium
TAQPPS

SEQ ID NO: 288857 - protein, 4 aa, Mycobacterium
TAQQ

SEQ ID NO: 288858 - protein, 5 aa, Mycobacterium
TAQQF

SEQ ID NO: 288859 - protein, 13 aa, Mycobacterium
TAQQPGQTLPVGA

SEQ ID NO: 288860 - protein, 15 aa, Mycobacterium
TAQQTWPGRPSPQTA

SEQ ID NO: 288861 - protein, 5 aa, Mycobacterium
TAQRG

SEQ ID NO: 288862 - protein, 10 aa, Mycobacterium
TAQRTRARVP

SEQ ID NO: 288863 - protein, 10 aa, Mycobacterium
TAQRWSSEGN

SEQ ID NO: 288864 - protein, 8 aa, Mycobacterium
TAQSAPPL

SEQ ID NO: 288865 - protein, 6 aa, Mycobacterium
TAQSTY

SEQ ID NO: 288866 - protein, 5 aa, Mycobacterium
TAQSV

SEQ ID NO: 288867 - protein, 8 aa, Mycobacterium
TAQTPRTL

SEQ ID NO: 288868 - protein, 6 aa, Mycobacterium
TAQTPV

SEQ ID NO: 288869 - protein, 6 aa, Mycobacterium
TAQTSQ

SEQ ID NO: 288870 - protein, 17 aa, Mycobacterium
TARADDIRRNSIGPSLR

SEQ ID NO: 288871 - protein, 8 aa, Mycobacterium
TARADRCD

SEQ ID NO: 288872 - protein, 5 aa, Mycobacterium
TARAE

SEQ ID NO: 288873 - protein, 10 aa, Mycobacterium
TARAGQRTAS

SEQ ID NO: 288874 - protein, 5 aa, Mycobacterium
TARAR

SEQ ID NO: 288875 - protein, 8 aa, Mycobacterium
TARARRAL

SEQ ID NO: 288876 - protein, 5 aa, Mycobacterium
TARAT

SEQ ID NO: 288877 - protein, 9 aa, Mycobacterium
TARDQHADA

SEQ ID NO: 288878 - protein, 8 aa, Mycobacterium
TARDSDGI

SEQ ID NO: 288879 - protein, 9 aa, Mycobacterium
TARDTGLSE

SEQ ID NO: 288880 - protein, 5 aa, Mycobacterium
TAREA

SEQ ID NO: 288881 - protein, 7 aa, Mycobacterium
TAREHPL

SEQ ID NO: 288882 - protein, 18 aa, Mycobacterium
TARENDYYRDDEIGTDDQ

SEQ ID NO: 288883 - protein, 8 aa, Mycobacterium
TARERPAR

SEQ ID NO: 288884 - protein, 4 aa, Mycobacterium
TARG

SEQ ID NO: 288885 - protein, 8 aa, Mycobacterium
TARGGDER

SEQ ID NO: 288886 - protein, 7 aa, Mycobacterium
TARGGIG

SEQ ID NO: 288887 - protein, 18 aa, Mycobacterium
TARGGIGQLSADPARPKL

SEQ ID NO: 288888 - protein, 12 aa, Mycobacterium
TARGGPAGVGEA

SEQ ID NO: 288889 - protein, 18 aa, Mycobacterium
TARGGTGQLSANPTRPKL

SEQ ID NO: 288890 - protein, 7 aa, Mycobacterium
TARGSLR

SEQ ID NO: 288891 - protein, 5 aa, Mycobacterium
TARGV

SEQ ID NO: 288892 - protein, 9 aa, Mycobacterium
TARHPGGGI

SEQ ID NO: 288893 - protein, 10 aa, Mycobacterium
TARHPGGGVD

SEQ ID NO: 288894 - protein, 4 aa, Mycobacterium
TARK

SEQ ID NO: 288895 - protein, 7 aa, Mycobacterium
TARNTRD

SEQ ID NO: 288896 - protein, 9 aa, Mycobacterium
TARPAPRTT

SEQ ID NO: 288897 - protein, 8 aa, Mycobacterium
TARPGATT

SEQ ID NO: 288898 - protein, 26 aa, Mycobacterium
TARPGSAQLATGAKQLSDGINQATDP

SEQ ID NO: 288899 - protein, 8 aa, Mycobacterium
TARPHTAP

SEQ ID NO: 288900 - protein, 8 aa, Mycobacterium
TARPPADQ

SEQ ID NO: 288901 - protein, 14 aa, Mycobacterium
TARQPGELAAQRDA

SEQ ID NO: 288902 - protein, 14 aa, Mycobacterium
TARQPGELATQRDA

SEQ ID NO: 288903 - protein, 14 aa, Mycobacterium
TARQPNELAAQRDA

SEQ ID NO: 288904 - protein, 26 aa, Mycobacterium
TARQTSPAPPEVAAPSPPAPETPKAR

SEQ ID NO: 288905 - protein, 5 aa, Mycobacterium
TARQV

SEQ ID NO: 288906 - protein, 7 aa, Mycobacterium
TARRPLA

SEQ ID NO: 288907 - protein, 7 aa, Mycobacterium
TARRRKR

SEQ ID NO: 288908 - protein, 6 aa, Mycobacterium
TARRSG

SEQ ID NO: 288909 - protein, 14 aa, Mycobacterium
TARRSSDGLPRPDS

SEQ ID NO: 288910 - protein, 4 aa, Mycobacterium
TARS

SEQ ID NO: 288911 - protein, 4 aa, Mycobacterium
TART

SEQ ID NO: 288912 - protein, 17 aa, Mycobacterium
TARTNNRAGNPVGSSYL

SEQ ID NO: 288913 - protein, 11 aa, Mycobacterium
TARWDPDESVT

SEQ ID NO: 288914 - protein, 4 aa, Mycobacterium
TASA

SEQ ID NO: 288915 - protein, 18 aa, Mycobacterium
TASAAADAEAMTGAAPTL

SEQ ID NO: 288916 - protein, 7 aa, Mycobacterium
TASADAL

SEQ ID NO: 288917 - protein, 6 aa, Mycobacterium
TASAGL

SEQ ID NO: 288918 - protein, 7 aa, Mycobacterium
TASALPT

SEQ ID NO: 288919 - protein, 10 aa, Mycobacterium
TASAQDSQAV

SEQ ID NO: 288920 - protein, 6 aa, Mycobacterium
TASAST

SEQ ID NO: 288921 - protein, 7 aa, Mycobacterium
TASATNS

SEQ ID NO: 288922 - protein, 13 aa, Mycobacterium
TASAYKDIADGQK

SEQ ID NO: 288923 - protein, 8 aa, Mycobacterium
TASDAGRT

SEQ ID NO: 288924 - protein, 19 aa, Mycobacterium
TASDGTVLSSNANNSAQTA

SEQ ID NO: 288925 - protein, 8 aa, Mycobacterium
TASDHPRA

SEQ ID NO: 288926 - protein, 6 aa, Mycobacterium
TASEAA

SEQ ID NO: 288927 - protein, 8 aa, Mycobacterium
TASEELQR

SEQ ID NO: 288928 - protein, 7 aa, Mycobacterium
TASEGST

SEQ ID NO: 288929 - protein, 13 aa, Mycobacterium
TASFKSATKWSGA

SEQ ID NO: 288930 - protein, 12 aa, Mycobacterium
TASGAQSVDGKA

SEQ ID NO: 288931 - protein, 10 aa, Mycobacterium
TASGETVPSA

SEQ ID NO: 288932 - protein, 12 aa, Mycobacterium
TASGGDPTQLAS

SEQ ID NO: 288933 - protein, 7 aa, Mycobacterium
TASGGGA

SEQ ID NO: 288934 - protein, 7 aa, Mycobacterium
TASGMDR

SEQ ID NO: 288935 - protein, 5 aa, Mycobacterium
TASGS

SEQ ID NO: 288936 - protein, 4 aa, Mycobacterium
TASL

SEQ ID NO: 288937 - protein, 13 aa, Mycobacterium
TASLDSASEAAVQ

SEQ ID NO: 288938 - protein, 13 aa, Mycobacterium
TASLDSESEAAVQ

SEQ ID NO: 288939 - protein, 15 aa, Mycobacterium
TASLTSALADRDQAI

SEQ ID NO: 288940 - protein, 6 aa, Mycobacterium
TASNAG

SEQ ID NO: 288941 - protein, 21 aa, Mycobacterium
TASNQTDPQTGQGTSTPQITV

SEQ ID NO: 288942 - protein, 5 aa, Mycobacterium
TASPG

SEQ ID NO: 288943 - protein, 7 aa, Mycobacterium
TASPGTV

SEQ ID NO: 288944 - protein, 9 aa, Mycobacterium
TASPIGDAE

SEQ ID NO: 288945 - protein, 9 aa, Mycobacterium
TASQSGAQW

SEQ ID NO: 288946 - protein, 4 aa, Mycobacterium
TASR

SEQ ID NO: 288947 - protein, 12 aa, Mycobacterium
TASRLSGAPVTA

SEQ ID NO: 288948 - protein, 5 aa, Mycobacterium
TASRR

SEQ ID NO: 288949 - protein, 7 aa, Mycobacterium
TASRRRR

SEQ ID NO: 288950 - protein, 8 aa, Mycobacterium
TASSAKAW

SEQ ID NO: 288951 - protein, 13 aa, Mycobacterium
TASSAQSADGKAA

SEQ ID NO: 288952 - protein, 7 aa, Mycobacterium
TASSDCS

SEQ ID NO: 288953 - protein, 9 aa, Mycobacterium
TASSDTANL

SEQ ID NO: 288954 - protein, 7 aa, Mycobacterium
TASSTAG

SEQ ID NO: 288955 - protein, 4 aa, Mycobacterium
TAST

SEQ ID NO: 288956 - protein, 5 aa, Mycobacterium
TASTA

SEQ ID NO: 288957 - protein, 7 aa, Mycobacterium
TASTAEA

SEQ ID NO: 288958 - protein, 8 aa, Mycobacterium
TASTAPAY

SEQ ID NO: 288959 - protein, 17 aa, Mycobacterium
TASTNEGDRATASRVVE

SEQ ID NO: 288960 - protein, 5 aa, Mycobacterium
TASTP

SEQ ID NO: 288961 - protein, 5 aa, Mycobacterium
TASTV

SEQ ID NO: 288962 - protein, 5 aa, Mycobacterium
TASTY

SEQ ID NO: 288963 - protein, 13 aa, Mycobacterium
TASTYKDMQDGAK

SEQ ID NO: 288964 - protein, 4 aa, Mycobacterium
TATA

SEQ ID NO: 288965 - protein, 9 aa, Mycobacterium
TATADDGTV

SEQ ID NO: 288966 - protein, 9 aa, Mycobacterium
TATADESTY

SEQ ID NO: 288967 - protein, 9 aa, Mycobacterium
TATAEDGSV

SEQ ID NO: 288968 - protein, 7 aa, Mycobacterium
TATAEPV

SEQ ID NO: 288969 - protein, 8 aa, Mycobacterium
TATAGASG

SEQ ID NO: 288970 - protein, 15 aa, Mycobacterium
TATAGGKTQTKSGIA

SEQ ID NO: 288971 - protein, 10 aa, Mycobacterium
TATAKGLSRP

SEQ ID NO: 288972 - protein, 6 aa, Mycobacterium
TATAPS

SEQ ID NO: 288973 - protein, 5 aa, Mycobacterium
TATAS

SEQ ID NO: 288974 - protein, 10 aa, Mycobacterium
TATATGTGAT

SEQ ID NO: 288975 - protein, 19 aa, Mycobacterium
TATATQEGKQWKISSLQQV

SEQ ID NO: 288976 - protein, 8 aa, Mycobacterium
TATATRKL

SEQ ID NO: 288977 - protein, 13 aa, Mycobacterium
TATAVATATPGRA

SEQ ID NO: 288978 - protein, 5 aa, Mycobacterium
TATEE

SEQ ID NO: 288979 - protein, 5 aa, Mycobacterium
TATEN

SEQ ID NO: 288980 - protein, 5 aa, Mycobacterium
TATES

SEQ ID NO: 288981 - protein, 8 aa, Mycobacterium
TATESDPQ

SEQ ID NO: 288982 - protein, 6 aa, Mycobacterium
TATGAE

SEQ ID NO: 288983 - protein, 13 aa, Mycobacterium
TATGAQSGDGKAA

SEQ ID NO: 288984 - protein, 6 aa, Mycobacterium
TATGDI

SEQ ID NO: 288985 - protein, 5 aa, Mycobacterium
TATGG

SEQ ID NO: 288986 - protein, 7 aa, Mycobacterium
TATGGEA

SEQ ID NO: 288987 - protein, 7 aa, Mycobacterium
TATGGEV

SEQ ID NO: 288988 - protein, 7 aa, Mycobacterium
TATGGNT

SEQ ID NO: 288989 - protein, 10 aa, Mycobacterium
TATGGRALPD

SEQ ID NO: 288990 - protein, 8 aa, Mycobacterium
TATGIGGP

SEQ ID NO: 288991 - protein, 5 aa, Mycobacterium
TATGL

SEQ ID NO: 288992 - protein, 6 aa, Mycobacterium
TATGPL

SEQ ID NO: 288993 - protein, 11 aa, Mycobacterium
TATGSRGGSTL

SEQ ID NO: 288994 - protein, 8 aa, Mycobacterium
TATGTSSL

SEQ ID NO: 288995 - protein, 6 aa, Mycobacterium
TATGTV

SEQ ID NO: 288996 - protein, 8 aa, Mycobacterium
TATHNPSA

SEQ ID NO: 288997 - protein, 16 aa, Mycobacterium
TATHSGLWSPGKIRIG

SEQ ID NO: 288998 - protein, 24 aa, Mycobacterium
TATIQRPGRRQRQPRAAQANAPGR

SEQ ID NO: 288999 - protein, 5 aa, Mycobacterium
TATKG

SEQ ID NO: 289000 - protein, 19 aa, Mycobacterium
TATLSVPGSADDQNAPPTV

SEQ ID NO: 289001 - protein, 7 aa, Mycobacterium
TATPEVT

SEQ ID NO: 289002 - protein, 5 aa, Mycobacterium
TATPG

SEQ ID NO: 289003 - protein, 11 aa, Mycobacterium
TATPGGGIGPD

SEQ ID NO: 289004 - protein, 7 aa, Mycobacterium
TATPGSV

SEQ ID NO: 289005 - protein, 6 aa, Mycobacterium
TATPLG

SEQ ID NO: 289006 - protein, 5 aa, Mycobacterium
TATPT

SEQ ID NO: 289007 - protein, 5 aa, Mycobacterium
TATQS

SEQ ID NO: 289008 - protein, 6 aa, Mycobacterium
TATRAA

SEQ ID NO: 289009 - protein, 7 aa, Mycobacterium
TATRETL

SEQ ID NO: 289010 - protein, 8 aa, Mycobacterium
TATRQAYG

SEQ ID NO: 289011 - protein, 5 aa, Mycobacterium
TATRS

SEQ ID NO: 289012 - protein, 6 aa, Mycobacterium
TATSEV

SEQ ID NO: 289013 - protein, 8 aa, Mycobacterium
TATSPGEL

SEQ ID NO: 289014 - protein, 6 aa, Mycobacterium
TATSTA

SEQ ID NO: 289015 - protein, 7 aa, Mycobacterium
TATSVSG

SEQ ID NO: 289016 - protein, 4 aa, Mycobacterium
TATT

SEQ ID NO: 289017 - protein, 8 aa, Mycobacterium
TATTAFGG

SEQ ID NO: 289018 - protein, 9 aa, Mycobacterium
TATTKAGGF

SEQ ID NO: 289019 - protein, 10 aa, Mycobacterium
TATTPKPNSV

SEQ ID NO: 289020 - protein, 11 aa, Mycobacterium
TATTQGASLNP

SEQ ID NO: 289021 - protein, 4 aa, Mycobacterium
TATV

SEQ ID NO: 289022 - protein, 5 aa, Mycobacterium
TATVV

SEQ ID NO: 289023 - protein, 19 aa, Mycobacterium
TATYSEHSQSRQGDARLNC

SEQ ID NO: 289024 - protein, 19 aa, Mycobacterium
TAVAPRRRTDEDPTGIKRA

SEQ ID NO: 289025 - protein, 6 aa, Mycobacterium
TAVAPT

SEQ ID NO: 289026 - protein, 9 aa, Mycobacterium
TAVASAGAA

SEQ ID NO: 289027 - protein, 24 aa, Mycobacterium
TAVATEQGRGELSPGSDRPNRLTQ

SEQ ID NO: 289028 - protein, 7 aa, Mycobacterium
TAVDGRA

SEQ ID NO: 289029 - protein, 4 aa, Mycobacterium
TAVE

SEQ ID NO: 289030 - protein, 8 aa, Mycobacterium
TAVEESGA

SEQ ID NO: 289031 - protein, 12 aa, Mycobacterium
TAVEGTKDVPGQ

SEQ ID NO: 289032 - protein, 26 aa, Mycobacterium
TAVEPAAPQDVDDTEHTGSHAGGGVS

SEQ ID NO: 289033 - protein, 7 aa, Mycobacterium
TAVEPPA

SEQ ID NO: 289034 - protein, 6 aa, Mycobacterium
TAVGAG

SEQ ID NO: 289035 - protein, 8 aa, Mycobacterium
TAVGTPME

SEQ ID NO: 289036 - protein, 6 aa, Mycobacterium
TAVGYP

SEQ ID NO: 289037 - protein, 4 aa, Mycobacterium
TAVP

SEQ ID NO: 289038 - protein, 5 aa, Mycobacterium
TAVPA

SEQ ID NO: 289039 - protein, 16 aa, Mycobacterium
TAVPRRAEPERTAEEV

SEQ ID NO: 289040 - protein, 15 aa, Mycobacterium
TAVQQATGHSDTPDE

SEQ ID NO: 289041 - protein, 4 aa, Mycobacterium
TAVS

SEQ ID NO: 289042 - protein, 6 aa, Mycobacterium
TAVSNA

SEQ ID NO: 289043 - protein, 12 aa, Mycobacterium
TAVTGGDNPPPA

SEQ ID NO: 289044 - protein, 5 aa, Mycobacterium
TAWPG

SEQ ID NO: 289045 - protein, 9 aa, Mycobacterium
TAWPGGTSP

SEQ ID NO: 289046 - protein, 15 aa, Mycobacterium
TAYEAEDDAEGDPAD

SEQ ID NO: 289047 - protein, 10 aa, Mycobacterium
TAYGADGAER

SEQ ID NO: 289048 - protein, 6 aa, Mycobacterium
TAYRDG

SEQ ID NO: 289049 - protein, 7 aa, Mycobacterium
TAYSTSP

SEQ ID NO: 289050 - protein, 5 aa, Mycobacterium
TAYTS

SEQ ID NO: 289051 - protein, 5 aa, Mycobacterium
TCGGA

SEQ ID NO: 289052 - protein, 11 aa, Mycobacterium
TCGSPSAGSVL

SEQ ID NO: 289053 - protein, 10 aa, Mycobacterium
TCPDDTSAAA

SEQ ID NO: 289054 - protein, 7 aa, Mycobacterium
TCPTSGS

SEQ ID NO: 289055 - protein, 12 aa, Mycobacterium
TCTPSSVAGTMP

SEQ ID NO: 289056 - protein, 6 aa, Mycobacterium
TCYRPP

SEQ ID NO: 289057 - protein, 8 aa, Mycobacterium
TDAAGPDI

SEQ ID NO: 289058 - protein, 9 aa, Mycobacterium
TDAAGSPIA

SEQ ID NO: 289059 - protein, 14 aa, Mycobacterium
TDAAQAGLRPGPAV

SEQ ID NO: 289060 - protein, 4 aa, Mycobacterium
TDAD

SEQ ID NO: 289061 - protein, 12 aa, Mycobacterium
TDADEADEDIDP

SEQ ID NO: 289062 - protein, 8 aa, Mycobacterium
TDADEEAV

SEQ ID NO: 289063 - protein, 5 aa, Mycobacterium
TDADR

SEQ ID NO: 289064 - protein, 6 aa, Mycobacterium
TDAEHP

SEQ ID NO: 289065 - protein, 8 aa, Mycobacterium
TDAEQQYA

SEQ ID NO: 289066 - protein, 8 aa, Mycobacterium
TDAERSTM

SEQ ID NO: 289067 - protein, 6 aa, Mycobacterium
TDAERT

SEQ ID NO: 289068 - protein, 10 aa, Mycobacterium
TDAGAPKGFG

SEQ ID NO: 289069 - protein, 6 aa, Mycobacterium
TDAGEG

SEQ ID NO: 289070 - protein, 5 aa, Mycobacterium
TDAGH

SEQ ID NO: 289071 - protein, 8 aa, Mycobacterium
TDAGPQKL

SEQ ID NO: 289072 - protein, 60 aa, Mycobacterium
TDAGQGLQQAADGAQQLATGLGTADDGARRLAGGADTLSSGLNTAQDGSAELAAGTQRLA

SEQ ID NO: 289073 - protein, 6 aa, Mycobacterium
TDAGSL

SEQ ID NO: 289074 - protein, 9 aa, Mycobacterium
TDAKTTLEE

SEQ ID NO: 289075 - protein, 8 aa, Mycobacterium
TDALAGPR

SEQ ID NO: 289076 - protein, 5 aa, Mycobacterium
TDAPV

SEQ ID NO: 289077 - protein, 8 aa, Mycobacterium
TDAPVPAP

SEQ ID NO: 289078 - protein, 8 aa, Mycobacterium
TDAQGIAN

SEQ ID NO: 289079 - protein, 8 aa, Mycobacterium
TDAQRDGD

SEQ ID NO: 289080 - protein, 5 aa, Mycobacterium
TDAQV

SEQ ID NO: 289081 - protein, 4 aa, Mycobacterium
TDAR

SEQ ID NO: 289082 - protein, 12 aa, Mycobacterium
TDARAPDLSTAG

SEQ ID NO: 289083 - protein, 7 aa, Mycobacterium
TDARLGR

SEQ ID NO: 289084 - protein, 16 aa, Mycobacterium
TDARPDRKGGSFDART

SEQ ID NO: 289085 - protein, 8 aa, Mycobacterium
TDATAWDA

SEQ ID NO: 289086 - protein, 9 aa, Mycobacterium
TDATNGSYA

SEQ ID NO: 289087 - protein, 28 aa, Mycobacterium
TDATTDTIDAADAGDTEDSESGVAPDTA

SEQ ID NO: 289088 - protein, 93 aa, Mycobacterium
TDAVSDGETEAAAAASDDEAQPDEAVQTPAAEAEPAEGAADDEATTDSVEDTGEASADSTDPDTDADADADAEADGAKGKAAARRARPKRLTG

SEQ ID NO: 289089 - protein, 14 aa, Mycobacterium
TDCSGYRPDEGDSD

SEQ ID NO: 289090 - protein, 4 aa, Mycobacterium
TDDA

SEQ ID NO: 289091 - protein, 22 aa, Mycobacterium
TDDATDSGRAGRRARTAPGGRD

SEQ ID NO: 289092 - protein, 6 aa, Mycobacterium
TDDDAS

SEQ ID NO: 289093 - protein, 6 aa, Mycobacterium
TDDDGH

SEQ ID NO: 289094 - protein, 7 aa, Mycobacterium
TDDDGHK

SEQ ID NO: 289095 - protein, 11 aa, Mycobacterium
TDDDPLEDPLD

SEQ ID NO: 289096 - protein, 4 aa, Mycobacterium
TDDG

SEQ ID NO: 289097 - protein, 10 aa, Mycobacterium
TDDGEQHSID

SEQ ID NO: 289098 - protein, 15 aa, Mycobacterium
TDDGKPIKTSWGGPI

SEQ ID NO: 289099 - protein, 9 aa, Mycobacterium
TDDGPGIAP

SEQ ID NO: 289100 - protein, 8 aa, Mycobacterium
TDDGPGID

SEQ ID NO: 289101 - protein, 10 aa, Mycobacterium
TDDGPPKTRI

SEQ ID NO: 289102 - protein, 5 aa, Mycobacterium
TDDGV

SEQ ID NO: 289103 - protein, 4 aa, Mycobacterium
TDDP

SEQ ID NO: 289104 - protein, 5 aa, Mycobacterium
TDDPE

SEQ ID NO: 289105 - protein, 11 aa, Mycobacterium
TDDPRSVTGGR

SEQ ID NO: 289106 - protein, 5 aa, Mycobacterium
TDDPT

SEQ ID NO: 289107 - protein, 4 aa, Mycobacterium
TDDQ

SEQ ID NO: 289108 - protein, 14 aa, Mycobacterium
TDDQAASGRPGGSM

SEQ ID NO: 289109 - protein, 5 aa, Mycobacterium
TDDQV

SEQ ID NO: 289110 - protein, 5 aa, Mycobacterium
TDDRG

SEQ ID NO: 289111 - protein, 9 aa, Mycobacterium
TDDRTARRL

SEQ ID NO: 289112 - protein, 11 aa, Mycobacterium
TDDSASPCPPL

SEQ ID NO: 289113 - protein, 4 aa, Mycobacterium
TDDT

SEQ ID NO: 289114 - protein, 9 aa, Mycobacterium
TDDTGKTAE

SEQ ID NO: 289115 - protein, 5 aa, Mycobacterium
TDDTV

SEQ ID NO: 289116 - protein, 8 aa, Mycobacterium
TDDTVTHS

SEQ ID NO: 289117 - protein, 7 aa, Mycobacterium
TDDVRGR

SEQ ID NO: 289118 - protein, 6 aa, Mycobacterium
TDEATK

SEQ ID NO: 289119 - protein, 8 aa, Mycobacterium
TDEDAGEF

SEQ ID NO: 289120 - protein, 4 aa, Mycobacterium
TDEP

SEQ ID NO: 289121 - protein, 11 aa, Mycobacterium
TDEPAGAFPPG

SEQ ID NO: 289122 - protein, 13 aa, Mycobacterium
TDEPHVESPKREL

SEQ ID NO: 289123 - protein, 9 aa, Mycobacterium
TDEPSRVET

SEQ ID NO: 289124 - protein, 14 aa, Mycobacterium
TDEQAAANEPGGSI

SEQ ID NO: 289125 - protein, 13 aa, Mycobacterium
TDEQAAGGHPGGS

SEQ ID NO: 289126 - protein, 8 aa, Mycobacterium
TDEQPAVA

SEQ ID NO: 289127 - protein, 17 aa, Mycobacterium
TDEQTQEFNTAYAAVTG

SEQ ID NO: 289128 - protein, 5 aa, Mycobacterium
TDESG

SEQ ID NO: 289129 - protein, 4 aa, Mycobacterium
TDET

SEQ ID NO: 289130 - protein, 6 aa, Mycobacterium
TDFGRV

SEQ ID NO: 289131 - protein, 5 aa, Mycobacterium
TDFGS

SEQ ID NO: 289132 - protein, 6 aa, Mycobacterium
TDFPGD

SEQ ID NO: 289133 - protein, 6 aa, Mycobacterium
TDFPSE

SEQ ID NO: 289134 - protein, 7 aa, Mycobacterium
TDGADGW

SEQ ID NO: 289135 - protein, 8 aa, Mycobacterium
TDGAGPAW

SEQ ID NO: 289136 - protein, 5 aa, Mycobacterium
TDGAI

SEQ ID NO: 289137 - protein, 6 aa, Mycobacterium
TDGAIS

SEQ ID NO: 289138 - protein, 5 aa, Mycobacterium
TDGAL

SEQ ID NO: 289139 - protein, 9 aa, Mycobacterium
TDGAMSPQQ

SEQ ID NO: 289140 - protein, 5 aa, Mycobacterium
TDGAN

SEQ ID NO: 289141 - protein, 10 aa, Mycobacterium
TDGCSERSCP

SEQ ID NO: 289142 - protein, 9 aa, Mycobacterium
TDGDARPGV

SEQ ID NO: 289143 - protein, 9 aa, Mycobacterium
TDGDDERVA

SEQ ID NO: 289144 - protein, 28 aa, Mycobacterium
TDGDPLRGQHHRPDPDDDPTGHGRHSSG

SEQ ID NO: 289145 - protein, 13 aa, Mycobacterium
TDGDPQASGARDA

SEQ ID NO: 289146 - protein, 13 aa, Mycobacterium
TDGEAAGGHPGGS

SEQ ID NO: 289147 - protein, 4 aa, Mycobacterium
TDGF

SEQ ID NO: 289148 - protein, 17 aa, Mycobacterium
TDGFGGNRGHCQGTPGM

SEQ ID NO: 289149 - protein, 17 aa, Mycobacterium
TDGFGGNRGQCQGTPGM

SEQ ID NO: 289150 - protein, 12 aa, Mycobacterium
TDGFQRPGRHAG

SEQ ID NO: 289151 - protein, 7 aa, Mycobacterium
TDGGERF

SEQ ID NO: 289152 - protein, 14 aa, Mycobacterium
TDGGLGLPQSTATG

SEQ ID NO: 289153 - protein, 8 aa, Mycobacterium
TDGGPTAG

SEQ ID NO: 289154 - protein, 4 aa, Mycobacterium
TDGH

SEQ ID NO: 289155 - protein, 5 aa, Mycobacterium
TDGHG

SEQ ID NO: 289156 - protein, 6 aa, Mycobacterium
TDGHGT

SEQ ID NO: 289157 - protein, 11 aa, Mycobacterium
TDGMSGGPTID

SEQ ID NO: 289158 - protein, 8 aa, Mycobacterium
TDGNGMTR

SEQ ID NO: 289159 - protein, 5 aa, Mycobacterium
TDGPA

SEQ ID NO: 289160 - protein, 10 aa, Mycobacterium
TDGPLDPRRT

SEQ ID NO: 289161 - protein, 22 aa, Mycobacterium
TDGPRGWADDDAPDPPAPPPFQ

SEQ ID NO: 289162 - protein, 15 aa, Mycobacterium
TDGQFTEQLTGPTGQ

SEQ ID NO: 289163 - protein, 23 aa, Mycobacterium
TDGSANSDGAPAPPLSRPLGAGL

SEQ ID NO: 289164 - protein, 10 aa, Mycobacterium
TDGSGRTRVN

SEQ ID NO: 289165 - protein, 4 aa, Mycobacterium
TDGV

SEQ ID NO: 289166 - protein, 13 aa, Mycobacterium
TDGVEESSQGLTS

SEQ ID NO: 289167 - protein, 9 aa, Mycobacterium
TDGVPHTQA

SEQ ID NO: 289168 - protein, 7 aa, Mycobacterium
TDGVRRV

SEQ ID NO: 289169 - protein, 8 aa, Mycobacterium
TDHDGVHG

SEQ ID NO: 289170 - protein, 12 aa, Mycobacterium
TDHEEASATLGA

SEQ ID NO: 289171 - protein, 8 aa, Mycobacterium
TDHGEELT

SEQ ID NO: 289172 - protein, 21 aa, Mycobacterium
TDHPPHTPHPPEPHPPIPTTP

SEQ ID NO: 289173 - protein, 22 aa, Mycobacterium
TDHRARRSAGGAGDAGEAQRLS

SEQ ID NO: 289174 - protein, 5 aa, Mycobacterium
TDHSG

SEQ ID NO: 289175 - protein, 19 aa, Mycobacterium
TDIADGAGQIAEQMSTKAA

SEQ ID NO: 289176 - protein, 6 aa, Mycobacterium
TDIRDA

SEQ ID NO: 289177 - protein, 6 aa, Mycobacterium
TDIRDT

SEQ ID NO: 289178 - protein, 7 aa, Mycobacterium
TDIRSAA

SEQ ID NO: 289179 - protein, 5 aa, Mycobacterium
TDISR

SEQ ID NO: 289180 - protein, 9 aa, Mycobacterium
TDKNGQTTE

SEQ ID NO: 289181 - protein, 6 aa, Mycobacterium
TDKPLG

SEQ ID NO: 289182 - protein, 12 aa, Mycobacterium
TDKQAEHVLSAH

SEQ ID NO: 289183 - protein, 13 aa, Mycobacterium
TDKRAEHVLGASV

SEQ ID NO: 289184 - protein, 9 aa, Mycobacterium
TDKSGHTTE

SEQ ID NO: 289185 - protein, 11 aa, Mycobacterium
TDLAGATAPLA

SEQ ID NO: 289186 - protein, 5 aa, Mycobacterium
TDLDE

SEQ ID NO: 289187 - protein, 8 aa, Mycobacterium
TDLGPGEV

SEQ ID NO: 289188 - protein, 7 aa, Mycobacterium
TDLNGKT

SEQ ID NO: 289189 - protein, 11 aa, Mycobacterium
TDLPANEGYAA

SEQ ID NO: 289190 - protein, 8 aa, Mycobacterium
TDLPTDEQ

SEQ ID NO: 289191 - protein, 6 aa, Mycobacterium
TDLRTG

SEQ ID NO: 289192 - protein, 14 aa, Mycobacterium
TDLSAARSANNNSV

SEQ ID NO: 289193 - protein, 17 aa, Mycobacterium
TDLSEARSANNSNGANI

SEQ ID NO: 289194 - protein, 5 aa, Mycobacterium
TDLTQ

SEQ ID NO: 289195 - protein, 5 aa, Mycobacterium
TDLVG

SEQ ID NO: 289196 - protein, 9 aa, Mycobacterium
TDMNEAADK

SEQ ID NO: 289197 - protein, 8 aa, Mycobacterium
TDMRNTDD

SEQ ID NO: 289198 - protein, 7 aa, Mycobacterium
TDNGTVF

SEQ ID NO: 289199 - protein, 11 aa, Mycobacterium
TDNGYSLNPGL

SEQ ID NO: 289200 - protein, 9 aa, Mycobacterium
TDNPAPTFG

SEQ ID NO: 289201 - protein, 5 aa, Mycobacterium
TDNSD

SEQ ID NO: 289202 - protein, 14 aa, Mycobacterium
TDPAANASVSAGDQ

SEQ ID NO: 289203 - protein, 11 aa, Mycobacterium
TDPADQTKRPH

SEQ ID NO: 289204 - protein, 11 aa, Mycobacterium
TDPATAAATGR

SEQ ID NO: 289205 - protein, 9 aa, Mycobacterium
TDPATPEGI

SEQ ID NO: 289206 - protein, 6 aa, Mycobacterium
TDPDAA

SEQ ID NO: 289207 - protein, 8 aa, Mycobacterium
TDPDGAGY

SEQ ID NO: 289208 - protein, 4 aa, Mycobacterium
TDPE

SEQ ID NO: 289209 - protein, 11 aa, Mycobacterium
TDPEAANDPVY

SEQ ID NO: 289210 - protein, 14 aa, Mycobacterium
TDPEAGSELGAGEQ

SEQ ID NO: 289211 - protein, 6 aa, Mycobacterium
TDPEFG

SEQ ID NO: 289212 - protein, 7 aa, Mycobacterium
TDPEGRS

SEQ ID NO: 289213 - protein, 10 aa, Mycobacterium
TDPGARPPLR

SEQ ID NO: 289214 - protein, 8 aa, Mycobacterium
TDPGMSRD

SEQ ID NO: 289215 - protein, 9 aa, Mycobacterium
TDPGMSRDL

SEQ ID NO: 289216 - protein, 14 aa, Mycobacterium
TDPGNDEADDRRPV

SEQ ID NO: 289217 - protein, 9 aa, Mycobacterium
TDPGPTPVT

SEQ ID NO: 289218 - protein, 8 aa, Mycobacterium
TDPGSRAA

SEQ ID NO: 289219 - protein, 14 aa, Mycobacterium
TDPGTGEELPAGAT

SEQ ID NO: 289220 - protein, 20 aa, Mycobacterium
TDPGVGPNLSDASKQRVSGS

SEQ ID NO: 289221 - protein, 21 aa, Mycobacterium
TDPGVGPNLSDASKQRVSGSQ

SEQ ID NO: 289222 - protein, 6 aa, Mycobacterium
TDPKGW

SEQ ID NO: 289223 - protein, 4 aa, Mycobacterium
TDPL

SEQ ID NO: 289224 - protein, 6 aa, Mycobacterium
TDPLGR

SEQ ID NO: 289225 - protein, 5 aa, Mycobacterium
TDPLR

SEQ ID NO: 289226 - protein, 14 aa, Mycobacterium
TDPNANTSVAAGDE

SEQ ID NO: 289227 - protein, 9 aa, Mycobacterium
TDPPRPEAA

SEQ ID NO: 289228 - protein, 7 aa, Mycobacterium
TDPPSDL

SEQ ID NO: 289229 - protein, 8 aa, Mycobacterium
TDPPVTAN

SEQ ID NO: 289230 - protein, 5 aa, Mycobacterium
TDPQF

SEQ ID NO: 289231 - protein, 8 aa, Mycobacterium
TDPRPEVA

SEQ ID NO: 289232 - protein, 14 aa, Mycobacterium
TDPRQGVSANQSVE

SEQ ID NO: 289233 - protein, 5 aa, Mycobacterium
TDPRY

SEQ ID NO: 289234 - protein, 4 aa, Mycobacterium
TDPS

SEQ ID NO: 289235 - protein, 7 aa, Mycobacterium
TDPSQIG

SEQ ID NO: 289236 - protein, 6 aa, Mycobacterium
TDPSSP

SEQ ID NO: 289237 - protein, 5 aa, Mycobacterium
TDPTA

SEQ ID NO: 289238 - protein, 5 aa, Mycobacterium
TDPTG

SEQ ID NO: 289239 - protein, 18 aa, Mycobacterium
TDPTTTATWTPADCDNPR

SEQ ID NO: 289240 - protein, 8 aa, Mycobacterium
TDPVERRP

SEQ ID NO: 289241 - protein, 9 aa, Mycobacterium
TDPVGRKQP

SEQ ID NO: 289242 - protein, 9 aa, Mycobacterium
TDPYGNTAT

SEQ ID NO: 289243 - protein, 8 aa, Mycobacterium
TDQARRSY

SEQ ID NO: 289244 - protein, 7 aa, Mycobacterium
TDQATAY

SEQ ID NO: 289245 - protein, 9 aa, Mycobacterium
TDQDDPAAA

SEQ ID NO: 289246 - protein, 6 aa, Mycobacterium
TDQDRR

SEQ ID NO: 289247 - protein, 8 aa, Mycobacterium
TDQGPSTV

SEQ ID NO: 289248 - protein, 9 aa, Mycobacterium
TDQGPSTVS

SEQ ID NO: 289249 - protein, 5 aa, Mycobacterium
TDQPA

SEQ ID NO: 289250 - protein, 15 aa, Mycobacterium
TDQVSRQVGEDIQPA

SEQ ID NO: 289251 - protein, 13 aa, Mycobacterium
TDQWRAGNTAPLP

SEQ ID NO: 289252 - protein, 5 aa, Mycobacterium
TDRAT

SEQ ID NO: 289253 - protein, 10 aa, Mycobacterium
TDRDFTDDSR

SEQ ID NO: 289254 - protein, 12 aa, Mycobacterium
TDRDGRGGLSGT

SEQ ID NO: 289255 - protein, 6 aa, Mycobacterium
TDRDPQ

SEQ ID NO: 289256 - protein, 10 aa, Mycobacterium
TDRDRTTPSV

SEQ ID NO: 289257 - protein, 8 aa, Mycobacterium
TDREVREP

SEQ ID NO: 289258 - protein, 6 aa, Mycobacterium
TDRGAK

SEQ ID NO: 289259 - protein, 7 aa, Mycobacterium
TDRGRGW

SEQ ID NO: 289260 - protein, 7 aa, Mycobacterium
TDRGTPV

SEQ ID NO: 289261 - protein, 4 aa, Mycobacterium
TDRL

SEQ ID NO: 289262 - protein, 8 aa, Mycobacterium
TDRPGSHE

SEQ ID NO: 289263 - protein, 7 aa, Mycobacterium
TDRSITA

SEQ ID NO: 289264 - protein, 6 aa, Mycobacterium
TDRSRA

SEQ ID NO: 289265 - protein, 10 aa, Mycobacterium
TDRTDEKAEK

SEQ ID NO: 289266 - protein, 5 aa, Mycobacterium
TDRTE

SEQ ID NO: 289267 - protein, 6 aa, Mycobacterium
TDRWGA

SEQ ID NO: 289268 - protein, 18 aa, Mycobacterium
TDSADAAGGVEPHRLPPK

SEQ ID NO: 289269 - protein, 8 aa, Mycobacterium
TDSAESRF

SEQ ID NO: 289270 - protein, 7 aa, Mycobacterium
TDSAETR

SEQ ID NO: 289271 - protein, 10 aa, Mycobacterium
TDSAPLGPAD

SEQ ID NO: 289272 - protein, 9 aa, Mycobacterium
TDSDERERQ

SEQ ID NO: 289273 - protein, 9 aa, Mycobacterium
TDSDREVAN

SEQ ID NO: 289274 - protein, 8 aa, Mycobacterium
TDSEPSTV

SEQ ID NO: 289275 - protein, 20 aa, Mycobacterium
TDSGITAQRIGGEAPSSPHR

SEQ ID NO: 289276 - protein, 8 aa, Mycobacterium
TDSGNNRT

SEQ ID NO: 289277 - protein, 6 aa, Mycobacterium
TDSGYQ

SEQ ID NO: 289278 - protein, 25 aa, Mycobacterium
TDSHGFAQPPRLGPDEVARTPMSRG

SEQ ID NO: 289279 - protein, 7 aa, Mycobacterium
TDSKPFA

SEQ ID NO: 289280 - protein, 6 aa, Mycobacterium
TDSLSP

SEQ ID NO: 289281 - protein, 13 aa, Mycobacterium
TDSNNNRVLKLAA

SEQ ID NO: 289282 - protein, 7 aa, Mycobacterium
TDSPGFT

SEQ ID NO: 289283 - protein, 7 aa, Mycobacterium
TDSPIED

SEQ ID NO: 289284 - protein, 8 aa, Mycobacterium
TDSPIEDE

SEQ ID NO: 289285 - protein, 8 aa, Mycobacterium
TDSPNPDT

SEQ ID NO: 289286 - protein, 6 aa, Mycobacterium
TDSSNF

SEQ ID NO: 289287 - protein, 13 aa, Mycobacterium
TDSVGQEGGRGVR

SEQ ID NO: 289288 - protein, 4 aa, Mycobacterium
TDTA

SEQ ID NO: 289289 - protein, 7 aa, Mycobacterium
TDTAHGH

SEQ ID NO: 289290 - protein, 8 aa, Mycobacterium
TDTAISTE

SEQ ID NO: 289291 - protein, 17 aa, Mycobacterium
TDTASAMGQAFDSSKAD

SEQ ID NO: 289292 - protein, 7 aa, Mycobacterium
TDTAVSQ

SEQ ID NO: 289293 - protein, 20 aa, Mycobacterium
TDTDGDGQRGDRRPPGSEKF

SEQ ID NO: 289294 - protein, 21 aa, Mycobacterium
TDTDGHGQRGDRRPPGSEKYY

SEQ ID NO: 289295 - protein, 18 aa, Mycobacterium
TDTDGNGQRGDRRPPSAE

SEQ ID NO: 289296 - protein, 9 aa, Mycobacterium
TDTDGNPLP

SEQ ID NO: 289297 - protein, 19 aa, Mycobacterium
TDTDGTGQRADRRPPGAER

SEQ ID NO: 289298 - protein, 15 aa, Mycobacterium
TDTDPFSDPGKRQLE

SEQ ID NO: 289299 - protein, 7 aa, Mycobacterium
TDTEAFT

SEQ ID NO: 289300 - protein, 8 aa, Mycobacterium
TDTEERTI

SEQ ID NO: 289301 - protein, 6 aa, Mycobacterium
TDTGAK

SEQ ID NO: 289302 - protein, 17 aa, Mycobacterium
TDTGDPVREFPSGHQGY

SEQ ID NO: 289303 - protein, 7 aa, Mycobacterium
TDTGNNR

SEQ ID NO: 289304 - protein, 12 aa, Mycobacterium
TDTGPGIPDDER

SEQ ID NO: 289305 - protein, 9 aa, Mycobacterium
TDTGPGVSA

SEQ ID NO: 289306 - protein, 8 aa, Mycobacterium
TDTGPSTV

SEQ ID NO: 289307 - protein, 6 aa, Mycobacterium
TDTGSV

SEQ ID NO: 289308 - protein, 13 aa, Mycobacterium
TDTHSNKTREAWG

SEQ ID NO: 289309 - protein, 4 aa, Mycobacterium
TDTI

SEQ ID NO: 289310 - protein, 5 aa, Mycobacterium
TDTLK

SEQ ID NO: 289311 - protein, 8 aa, Mycobacterium
TDTPPDLK

SEQ ID NO: 289312 - protein, 11 aa, Mycobacterium
TDTPPERTAPL

SEQ ID NO: 289313 - protein, 7 aa, Mycobacterium
TDTPQEL

SEQ ID NO: 289314 - protein, 31 aa, Mycobacterium
TDTPTARETDYGRVDDHSSAIRGPDDARNTF

SEQ ID NO: 289315 - protein, 8 aa, Mycobacterium
TDTPTQVA

SEQ ID NO: 289316 - protein, 12 aa, Mycobacterium
TDTQLSGGEKQR

SEQ ID NO: 289317 - protein, 25 aa, Mycobacterium
TDTQVKPSATPETTAPQGRWRSQAA

SEQ ID NO: 289318 - protein, 5 aa, Mycobacterium
TDTRA

SEQ ID NO: 289319 - protein, 11 aa, Mycobacterium
TDTSNPAQGAI

SEQ ID NO: 289320 - protein, 5 aa, Mycobacterium
TDTTP

SEQ ID NO: 289321 - protein, 11 aa, Mycobacterium
TDTVAQQNDDL

SEQ ID NO: 289322 - protein, 17 aa, Mycobacterium
TDTVTKSRDKEADQAGK

SEQ ID NO: 289323 - protein, 4 aa, Mycobacterium
TDVA

SEQ ID NO: 289324 - protein, 14 aa, Mycobacterium
TDVAGTNTDTLNQS

SEQ ID NO: 289325 - protein, 7 aa, Mycobacterium
TDVDTPD

SEQ ID NO: 289326 - protein, 6 aa, Mycobacterium
TDVESL

SEQ ID NO: 289327 - protein, 32 aa, Mycobacterium
TDVFGDDEQTSRLATGGGQRSGGWENGEWTGS

SEQ ID NO: 289328 - protein, 23 aa, Mycobacterium
TDVGARPGTTAAVPADETREPVL

SEQ ID NO: 289329 - protein, 8 aa, Mycobacterium
TDVPAAGS

SEQ ID NO: 289330 - protein, 7 aa, Mycobacterium
TDVRARA

SEQ ID NO: 289331 - protein, 6 aa, Mycobacterium
TDVRDP

SEQ ID NO: 289332 - protein, 6 aa, Mycobacterium
TDWPRY

SEQ ID NO: 289333 - protein, 7 aa, Mycobacterium
TDWQSTA

SEQ ID NO: 289334 - protein, 6 aa, Mycobacterium
TDYMPT

SEQ ID NO: 289335 - protein, 6 aa, Mycobacterium
TDYNPW

SEQ ID NO: 289336 - protein, 7 aa, Mycobacterium
TDYSPIP

SEQ ID NO: 289337 - protein, 8 aa, Mycobacterium
TDYTGNRE

SEQ ID NO: 289338 - protein, 6 aa, Mycobacterium
TDYVPT

SEQ ID NO: 289339 - protein, 4 aa, Mycobacterium
TEAA

SEQ ID NO: 289340 - protein, 11 aa, Mycobacterium
TEAAEEPGRGV

SEQ ID NO: 289341 - protein, 10 aa, Mycobacterium
TEAATRSGGL

SEQ ID NO: 289342 - protein, 7 aa, Mycobacterium
TEADDRR

SEQ ID NO: 289343 - protein, 7 aa, Mycobacterium
TEAGPQK

SEQ ID NO: 289344 - protein, 19 aa, Mycobacterium
TEAHSGRITAASRGPGLGS

SEQ ID NO: 289345 - protein, 14 aa, Mycobacterium
TEAITKAGPGLSWD

SEQ ID NO: 289346 - protein, 9 aa, Mycobacterium
TEAKTTSAA

SEQ ID NO: 289347 - protein, 4 aa, Mycobacterium
TEAL

SEQ ID NO: 289348 - protein, 110 aa, Mycobacterium
TEANSDASDAEPDSHAETDDQATQATEAVDEELGSGDVAPAAADQSEQADGGDTDSEKADSDAEAADTDSEAAGDDTDSEQSDTDAEVAGGDTETAVTDAEAAGDGAGRK

SEQ ID NO: 289349 - protein, 23 aa, Mycobacterium
TEAPEEPLSPEAKEGSRGMSDDH

SEQ ID NO: 289350 - protein, 9 aa, Mycobacterium
TEAPTYTAS

SEQ ID NO: 289351 - protein, 4 aa, Mycobacterium
TEAR

SEQ ID NO: 289352 - protein, 6 aa, Mycobacterium
TEARAA

SEQ ID NO: 289353 - protein, 10 aa, Mycobacterium
TEARAAARLT

SEQ ID NO: 289354 - protein, 10 aa, Mycobacterium
TEARDRDDAP

SEQ ID NO: 289355 - protein, 5 aa, Mycobacterium
TEARR

SEQ ID NO: 289356 - protein, 22 aa, Mycobacterium
TEASEGSAELSGSGSEKATGLP

SEQ ID NO: 289357 - protein, 9 aa, Mycobacterium
TEASSGRVT

SEQ ID NO: 289358 - protein, 8 aa, Mycobacterium
TEATFNNG

SEQ ID NO: 289359 - protein, 5 aa, Mycobacterium
TEAVP

SEQ ID NO: 289360 - protein, 10 aa, Mycobacterium
TEDAERQIDS

SEQ ID NO: 289361 - protein, 19 aa, Mycobacterium
TEDETTGADLTQHAETAYA

SEQ ID NO: 289362 - protein, 5 aa, Mycobacterium
TEDGA

SEQ ID NO: 289363 - protein, 8 aa, Mycobacterium
TEDGAPVQ

SEQ ID NO: 289364 - protein, 12 aa, Mycobacterium
TEDGIDTADGAH

SEQ ID NO: 289365 - protein, 8 aa, Mycobacterium
TEDGSTDH

SEQ ID NO: 289366 - protein, 31 aa, Mycobacterium
TEDIEKPPDDGEDASDAGEKDPKTAARQRKR

SEQ ID NO: 289367 - protein, 7 aa, Mycobacterium
TEDIGST

SEQ ID NO: 289368 - protein, 7 aa, Mycobacterium
TEDPRAA

SEQ ID NO: 289369 - protein, 13 aa, Mycobacterium
TEDQLKPAPVAAS

SEQ ID NO: 289370 - protein, 6 aa, Mycobacterium
TEDRSG

SEQ ID NO: 289371 - protein, 17 aa, Mycobacterium
TEDSPVAPSPEPKPRRR

SEQ ID NO: 289372 - protein, 9 aa, Mycobacterium
TEDSSPTRV

SEQ ID NO: 289373 - protein, 8 aa, Mycobacterium
TEDTGPIE

SEQ ID NO: 289374 - protein, 5 aa, Mycobacterium
TEDTT

SEQ ID NO: 289375 - protein, 9 aa, Mycobacterium
TEEAKTGKL

SEQ ID NO: 289376 - protein, 6 aa, Mycobacterium
TEEATD

SEQ ID NO: 289377 - protein, 15 aa, Mycobacterium
TEEDGQYKMSKVEFV

SEQ ID NO: 289378 - protein, 17 aa, Mycobacterium
TEEESADSPRRADVRTG

SEQ ID NO: 289379 - protein, 6 aa, Mycobacterium
TEEHSR

SEQ ID NO: 289380 - protein, 4 aa, Mycobacterium
TEEM

SEQ ID NO: 289381 - protein, 10 aa, Mycobacterium
TEEMPDTPAR

SEQ ID NO: 289382 - protein, 11 aa, Mycobacterium
TEEQATAERLN

SEQ ID NO: 289383 - protein, 4 aa, Mycobacterium
TEER

SEQ ID NO: 289384 - protein, 5 aa, Mycobacterium
TEERS

SEQ ID NO: 289385 - protein, 5 aa, Mycobacterium
TEETV

SEQ ID NO: 289386 - protein, 4 aa, Mycobacterium
TEEV

SEQ ID NO: 289387 - protein, 8 aa, Mycobacterium
TEGDPAAV

SEQ ID NO: 289388 - protein, 6 aa, Mycobacterium
TEGDRA

SEQ ID NO: 289389 - protein, 10 aa, Mycobacterium
TEGDTRGNAL

SEQ ID NO: 289390 - protein, 8 aa, Mycobacterium
TEGEGRPE

SEQ ID NO: 289391 - protein, 7 aa, Mycobacterium
TEGEGRR

SEQ ID NO: 289392 - protein, 6 aa, Mycobacterium
TEGFGG

SEQ ID NO: 289393 - protein, 6 aa, Mycobacterium
TEGGRT

SEQ ID NO: 289394 - protein, 10 aa, Mycobacterium
TEGHAQPYRA

SEQ ID NO: 289395 - protein, 9 aa, Mycobacterium
TEGKQPSRA

SEQ ID NO: 289396 - protein, 11 aa, Mycobacterium
TEGLKQSAPDL

SEQ ID NO: 289397 - protein, 4 aa, Mycobacterium
TEGR

SEQ ID NO: 289398 - protein, 4 aa, Mycobacterium
TEGS

SEQ ID NO: 289399 - protein, 12 aa, Mycobacterium
TEGTRHRPAPEL

SEQ ID NO: 289400 - protein, 7 aa, Mycobacterium
TEGVEDA

SEQ ID NO: 289401 - protein, 5 aa, Mycobacterium
TEGVK

SEQ ID NO: 289402 - protein, 4 aa, Mycobacterium
TEGW

SEQ ID NO: 289403 - protein, 5 aa, Mycobacterium
TEGYR

SEQ ID NO: 289404 - protein, 9 aa, Mycobacterium
TEHAAAATE

SEQ ID NO: 289405 - protein, 8 aa, Mycobacterium
TEHAEAAA

SEQ ID NO: 289406 - protein, 8 aa, Mycobacterium
TEHGAQRV

SEQ ID NO: 289407 - protein, 7 aa, Mycobacterium
TEHGGAG

SEQ ID NO: 289408 - protein, 10 aa, Mycobacterium
TEHLDATDAD

SEQ ID NO: 289409 - protein, 11 aa, Mycobacterium
TEHLDATDAEA

SEQ ID NO: 289410 - protein, 12 aa, Mycobacterium
TEHLDGRDSDSI

SEQ ID NO: 289411 - protein, 6 aa, Mycobacterium
TEHPMA

SEQ ID NO: 289412 - protein, 7 aa, Mycobacterium
TEHRPRL

SEQ ID NO: 289413 - protein, 5 aa, Mycobacterium
TEHTD

SEQ ID NO: 289414 - protein, 6 aa, Mycobacterium
TEHTGV

SEQ ID NO: 289415 - protein, 17 aa, Mycobacterium
TEHTSKLGSGGPDTLPE

SEQ ID NO: 289416 - protein, 5 aa, Mycobacterium
TEHYD

SEQ ID NO: 289417 - protein, 9 aa, Mycobacterium
TEIDSPGGY

SEQ ID NO: 289418 - protein, 8 aa, Mycobacterium
TEIGPSQA

SEQ ID NO: 289419 - protein, 10 aa, Mycobacterium
TEIKSTPTVR

SEQ ID NO: 289420 - protein, 21 aa, Mycobacterium
TEIPGTPEAPPQLDYKEPAHA

SEQ ID NO: 289421 - protein, 12 aa, Mycobacterium
TEIRDARSVNGT

SEQ ID NO: 289422 - protein, 8 aa, Mycobacterium
TEISTSPW

SEQ ID NO: 289423 - protein, 11 aa, Mycobacterium
TEITGKPRDET

SEQ ID NO: 289424 - protein, 6 aa, Mycobacterium
TEKKTY

SEQ ID NO: 289425 - protein, 7 aa, Mycobacterium
TEKQPEL

SEQ ID NO: 289426 - protein, 6 aa, Mycobacterium
TEKRSQ

SEQ ID NO: 289427 - protein, 22 aa, Mycobacterium
TEKRYRATQDTYRPTPAISLPG

SEQ ID NO: 289428 - protein, 4 aa, Mycobacterium
TELA

SEQ ID NO: 289429 - protein, 9 aa, Mycobacterium
TELAPGGRL

SEQ ID NO: 289430 - protein, 8 aa, Mycobacterium
TELDAAPG

SEQ ID NO: 289431 - protein, 4 aa, Mycobacterium
TELG

SEQ ID NO: 289432 - protein, 5 aa, Mycobacterium
TELGE

SEQ ID NO: 289433 - protein, 8 aa, Mycobacterium
TELGGQER

SEQ ID NO: 289434 - protein, 14 aa, Mycobacterium
TELPNREQYPDPER

SEQ ID NO: 289435 - protein, 6 aa, Mycobacterium
TELRDG

SEQ ID NO: 289436 - protein, 4 aa, Mycobacterium
TEMG

SEQ ID NO: 289437 - protein, 15 aa, Mycobacterium
TEMTDPGPENSLSTE

SEQ ID NO: 289438 - protein, 13 aa, Mycobacterium
TENPGPGDPATEA

SEQ ID NO: 289439 - protein, 5 aa, Mycobacterium
TENRK

SEQ ID NO: 289440 - protein, 6 aa, Mycobacterium
TENSAG

SEQ ID NO: 289441 - protein, 12 aa, Mycobacterium
TENSEDVAAGRR

SEQ ID NO: 289442 - protein, 5 aa, Mycobacterium
TENSV

SEQ ID NO: 289443 - protein, 4 aa, Mycobacterium
TENT

SEQ ID NO: 289444 - protein, 4 aa, Mycobacterium
TENV

SEQ ID NO: 289445 - protein, 11 aa, Mycobacterium
TEPAEADEPDY

SEQ ID NO: 289446 - protein, 12 aa, Mycobacterium
TEPAGTRRDPAQ

SEQ ID NO: 289447 - protein, 8 aa, Mycobacterium
TEPAGTVT

SEQ ID NO: 289448 - protein, 35 aa, Mycobacterium
TEPAPEPVTKPSPVKAAPKAPEAAPVPPPPPPVAE

SEQ ID NO: 289449 - protein, 12 aa, Mycobacterium
TEPAVDPKGELA

SEQ ID NO: 289450 - protein, 8 aa, Mycobacterium
TEPDPEVR

SEQ ID NO: 289451 - protein, 16 aa, Mycobacterium
TEPFESRRGELVPQAS

SEQ ID NO: 289452 - protein, 6 aa, Mycobacterium
TEPGAN

SEQ ID NO: 289453 - protein, 8 aa, Mycobacterium
TEPGPTTV

SEQ ID NO: 289454 - protein, 5 aa, Mycobacterium
TEPGV

SEQ ID NO: 289455 - protein, 40 aa, Mycobacterium
TEPPPAPAPPPSSEEPAPPPATTTAPPATTTTPPAGPRQV

SEQ ID NO: 289456 - protein, 6 aa, Mycobacterium
TEPQAG

SEQ ID NO: 289457 - protein, 6 aa, Mycobacterium
TEPRPG

SEQ ID NO: 289458 - protein, 23 aa, Mycobacterium
TEPTLASGVSPDHPDARPGTEPG

SEQ ID NO: 289459 - protein, 6 aa, Mycobacterium
TEPTPW

SEQ ID NO: 289460 - protein, 4 aa, Mycobacterium
TEPV

SEQ ID NO: 289461 - protein, 5 aa, Mycobacterium
TEQMQ

SEQ ID NO: 289462 - protein, 16 aa, Mycobacterium
TEQQSAPDTIGRTNEA

SEQ ID NO: 289463 - protein, 4 aa, Mycobacterium
TEQR

SEQ ID NO: 289464 - protein, 8 aa, Mycobacterium
TEQRSQNE

SEQ ID NO: 289465 - protein, 6 aa, Mycobacterium
TEQSER

SEQ ID NO: 289466 - protein, 5 aa, Mycobacterium
TEQSQ

SEQ ID NO: 289467 - protein, 8 aa, Mycobacterium
TERAARGG

SEQ ID NO: 289468 - protein, 5 aa, Mycobacterium
TERAI

SEQ ID NO: 289469 - protein, 12 aa, Mycobacterium
TERAQNEGHPTI

SEQ ID NO: 289470 - protein, 7 aa, Mycobacterium
TERDGVE

SEQ ID NO: 289471 - protein, 5 aa, Mycobacterium
TERDP

SEQ ID NO: 289472 - protein, 21 aa, Mycobacterium
TERGRASYTTEGTTGLPAGGE

SEQ ID NO: 289473 - protein, 11 aa, Mycobacterium
TERKQNPGPDV

SEQ ID NO: 289474 - protein, 8 aa, Mycobacterium
TERLGGRG

SEQ ID NO: 289475 - protein, 12 aa, Mycobacterium
TERNEASQTPLR

SEQ ID NO: 289476 - protein, 8 aa, Mycobacterium
TERPTLTN

SEQ ID NO: 289477 - protein, 10 aa, Mycobacterium
TERQRGDPPV

SEQ ID NO: 289478 - protein, 5 aa, Mycobacterium
TERRP

SEQ ID NO: 289479 - protein, 4 aa, Mycobacterium
TERS

SEQ ID NO: 289480 - protein, 7 aa, Mycobacterium
TERSPEL

SEQ ID NO: 289481 - protein, 6 aa, Mycobacterium
TERSRQ

SEQ ID NO: 289482 - protein, 11 aa, Mycobacterium
TERTAEKAEKL

SEQ ID NO: 289483 - protein, 4 aa, Mycobacterium
TERY

SEQ ID NO: 289484 - protein, 4 aa, Mycobacterium
TESA

SEQ ID NO: 289485 - protein, 8 aa, Mycobacterium
TESAGDGL

SEQ ID NO: 289486 - protein, 5 aa, Mycobacterium
TESAY

SEQ ID NO: 289487 - protein, 14 aa, Mycobacterium
TESDAAADRLDPEN

SEQ ID NO: 289488 - protein, 5 aa, Mycobacterium
TESDR

SEQ ID NO: 289489 - protein, 7 aa, Mycobacterium
TESETGR

SEQ ID NO: 289490 - protein, 5 aa, Mycobacterium
TESFS

SEQ ID NO: 289491 - protein, 9 aa, Mycobacterium
TESGADTDG

SEQ ID NO: 289492 - protein, 10 aa, Mycobacterium
TESGRAETGL

SEQ ID NO: 289493 - protein, 11 aa, Mycobacterium
TESGRSGKFGA

SEQ ID NO: 289494 - protein, 7 aa, Mycobacterium
TESGSPA

SEQ ID NO: 289495 - protein, 4 aa, Mycobacterium
TESI

SEQ ID NO: 289496 - protein, 11 aa, Mycobacterium
TESKDPDPTQL

SEQ ID NO: 289497 - protein, 8 aa, Mycobacterium
TESKKSSV

SEQ ID NO: 289498 - protein, 11 aa, Mycobacterium
TESLEQRSDQR

SEQ ID NO: 289499 - protein, 5 aa, Mycobacterium
TESLR

SEQ ID NO: 289500 - protein, 8 aa, Mycobacterium
TESLRQGT

SEQ ID NO: 289501 - protein, 5 aa, Mycobacterium
TESLS

SEQ ID NO: 289502 - protein, 6 aa, Mycobacterium
TESPAE

SEQ ID NO: 289503 - protein, 5 aa, Mycobacterium
TESPE

SEQ ID NO: 289504 - protein, 13 aa, Mycobacterium
TESQQLGRRSNNP

SEQ ID NO: 289505 - protein, 7 aa, Mycobacterium
TESQQRR

SEQ ID NO: 289506 - protein, 5 aa, Mycobacterium
TESQR

SEQ ID NO: 289507 - protein, 9 aa, Mycobacterium
TESQRDEGQ

SEQ ID NO: 289508 - protein, 8 aa, Mycobacterium
TESQSRRR

SEQ ID NO: 289509 - protein, 14 aa, Mycobacterium
TESSSEPAQSGPAG

SEQ ID NO: 289510 - protein, 4 aa, Mycobacterium
TESV

SEQ ID NO: 289511 - protein, 13 aa, Mycobacterium
TESVDDPSSELRT

SEQ ID NO: 289512 - protein, 11 aa, Mycobacterium
TESVEQRSDQR

SEQ ID NO: 289513 - protein, 7 aa, Mycobacterium
TETDPAV

SEQ ID NO: 289514 - protein, 6 aa, Mycobacterium
TETDPD

SEQ ID NO: 289515 - protein, 8 aa, Mycobacterium
TETDPGVR

SEQ ID NO: 289516 - protein, 7 aa, Mycobacterium
TETDPRV

SEQ ID NO: 289517 - protein, 6 aa, Mycobacterium
TETETA

SEQ ID NO: 289518 - protein, 9 aa, Mycobacterium
TETETQVNV

SEQ ID NO: 289519 - protein, 30 aa, Mycobacterium
TETGDQSAGDEGAAGTEGQPLIPDDAETET

SEQ ID NO: 289520 - protein, 33 aa, Mycobacterium
TETKDRSLEEASAIEASPTTPSRSERTPDKRSV

SEQ ID NO: 289521 - protein, 10 aa, Mycobacterium
TETPATELPE

SEQ ID NO: 289522 - protein, 4 aa, Mycobacterium
TETR

SEQ ID NO: 289523 - protein, 15 aa, Mycobacterium
TETRDAAAGEAGTES

SEQ ID NO: 289524 - protein, 5 aa, Mycobacterium
TETTF

SEQ ID NO: 289525 - protein, 14 aa, Mycobacterium
TETTIRRSEATRAD

SEQ ID NO: 289526 - protein, 12 aa, Mycobacterium
TETTSVRDIPGS

SEQ ID NO: 289527 - protein, 51 aa, Mycobacterium
TEVAEDTEAAEAEDDDVSRPPADASPDTDPGEGSADGEDDQRPSKRKGRRV

SEQ ID NO: 289528 - protein, 10 aa, Mycobacterium
TEVDRKPRIA

SEQ ID NO: 289529 - protein, 8 aa, Mycobacterium
TEVEHKPR

SEQ ID NO: 289530 - protein, 5 aa, Mycobacterium
TEVEP

SEQ ID NO: 289531 - protein, 14 aa, Mycobacterium
TEVGLPEENPNLAQ

SEQ ID NO: 289532 - protein, 15 aa, Mycobacterium
TEVGLPEENPNLTAP

SEQ ID NO: 289533 - protein, 16 aa, Mycobacterium
TEVPAAPKPSAKPVGS

SEQ ID NO: 289534 - protein, 5 aa, Mycobacterium
TEVPT

SEQ ID NO: 289535 - protein, 6 aa, Mycobacterium
TEVTGA

SEQ ID NO: 289536 - protein, 6 aa, Mycobacterium
TEYDTY

SEQ ID NO: 289537 - protein, 5 aa, Mycobacterium
TEYEE

SEQ ID NO: 289538 - protein, 4 aa, Mycobacterium
TFAA

SEQ ID NO: 289539 - protein, 8 aa, Mycobacterium
TFDNPDFK

SEQ ID NO: 289540 - protein, 7 aa, Mycobacterium
TFENPDF

SEQ ID NO: 289541 - protein, 6 aa, Mycobacterium
TFGAGA

SEQ ID NO: 289542 - protein, 4 aa, Mycobacterium
TFGG

SEQ ID NO: 289543 - protein, 14 aa, Mycobacterium
TFGGADLDALQELR

SEQ ID NO: 289544 - protein, 9 aa, Mycobacterium
TFGGGPDQL

SEQ ID NO: 289545 - protein, 9 aa, Mycobacterium
TFGRGAESY

SEQ ID NO: 289546 - protein, 5 aa, Mycobacterium
TFGYD

SEQ ID NO: 289547 - protein, 5 aa, Mycobacterium
TFPAP

SEQ ID NO: 289548 - protein, 11 aa, Mycobacterium
TFPDTKTAYEI

SEQ ID NO: 289549 - protein, 7 aa, Mycobacterium
TFPSAEK

SEQ ID NO: 289550 - protein, 4 aa, Mycobacterium
TFPT

SEQ ID NO: 289551 - protein, 11 aa, Mycobacterium
TFRGNGAAPFR

SEQ ID NO: 289552 - protein, 9 aa, Mycobacterium
TFRSSELGS

SEQ ID NO: 289553 - protein, 8 aa, Mycobacterium
TFSAPTAS

SEQ ID NO: 289554 - protein, 9 aa, Mycobacterium
TFSKATPSR

SEQ ID NO: 289555 - protein, 12 aa, Mycobacterium
TFSNRGRRSEEQ

SEQ ID NO: 289556 - protein, 36 aa, Mycobacterium
TFSPPGGTVPSTTTRTRTPRSTTTSTSPTPPPGSQV

SEQ ID NO: 289557 - protein, 9 aa, Mycobacterium
TFSQPPPDW

SEQ ID NO: 289558 - protein, 5 aa, Mycobacterium
TFTDN

SEQ ID NO: 289559 - protein, 19 aa, Mycobacterium
TFTLPEKGTAAKESEERAA

SEQ ID NO: 289560 - protein, 12 aa, Mycobacterium
TFTNRGKRSEEQ

SEQ ID NO: 289561 - protein, 4 aa, Mycobacterium
TFTR

SEQ ID NO: 289562 - protein, 6 aa, Mycobacterium
TFTRAR

SEQ ID NO: 289563 - protein, 5 aa, Mycobacterium
TFTTE

SEQ ID NO: 289564 - protein, 17 aa, Mycobacterium
TFTTKPPVSDHGPEPHP

SEQ ID NO: 289565 - protein, 4 aa, Mycobacterium
TGAA

SEQ ID NO: 289566 - protein, 17 aa, Mycobacterium
TGAAATSADQRAEGDAS

SEQ ID NO: 289567 - protein, 21 aa, Mycobacterium
TGAAEGIKKGMASGSHSAPAA

SEQ ID NO: 289568 - protein, 10 aa, Mycobacterium
TGAAGQPGAD

SEQ ID NO: 289569 - protein, 8 aa, Mycobacterium
TGAAPAQL

SEQ ID NO: 289570 - protein, 7 aa, Mycobacterium
TGAAPGH

SEQ ID NO: 289571 - protein, 32 aa, Mycobacterium
TGADAPAADAGSAGAGSADADGKYVPSPKGTA

SEQ ID NO: 289572 - protein, 11 aa, Mycobacterium
TGADGSTSTLV

SEQ ID NO: 289573 - protein, 6 aa, Mycobacterium
TGADGT

SEQ ID NO: 289574 - protein, 9 aa, Mycobacterium
TGADSVTDV

SEQ ID NO: 289575 - protein, 10 aa, Mycobacterium
TGADTLRKAG

SEQ ID NO: 289576 - protein, 7 aa, Mycobacterium
TGAEEQV

SEQ ID NO: 289577 - protein, 15 aa, Mycobacterium
TGAEPPTQRVGRRQT

SEQ ID NO: 289578 - protein, 9 aa, Mycobacterium
TGAEQDELS

SEQ ID NO: 289579 - protein, 41 aa, Mycobacterium
TGAERRSLTASSPSSPAAPRTDPLPRQTLDDTDRDRSTPSV

SEQ ID NO: 289580 - protein, 5 aa, Mycobacterium
TGAET

SEQ ID NO: 289581 - protein, 14 aa, Mycobacterium
TGAETGEQEPKKLS

SEQ ID NO: 289582 - protein, 20 aa, Mycobacterium
TGAFNNDTECVNGRRGNAAD

SEQ ID NO: 289583 - protein, 8 aa, Mycobacterium
TGAGAQLT

SEQ ID NO: 289584 - protein, 16 aa, Mycobacterium
TGAGGAAAMSESGNPL

SEQ ID NO: 289585 - protein, 16 aa, Mycobacterium
TGAGGAEQMSDSGNPL

SEQ ID NO: 289586 - protein, 9 aa, Mycobacterium
TGAGGSANL

SEQ ID NO: 289587 - protein, 7 aa, Mycobacterium
TGAGGYA

SEQ ID NO: 289588 - protein, 7 aa, Mycobacterium
TGAGKST

SEQ ID NO: 289589 - protein, 14 aa, Mycobacterium
TGAGLNGRRDGRTI

SEQ ID NO: 289590 - protein, 7 aa, Mycobacterium
TGAGLST

SEQ ID NO: 289591 - protein, 14 aa, Mycobacterium
TGAGLTGRRDGNTI

SEQ ID NO: 289592 - protein, 13 aa, Mycobacterium
TGAGRGGDALAGA

SEQ ID NO: 289593 - protein, 9 aa, Mycobacterium
TGAGSADQF

SEQ ID NO: 289594 - protein, 9 aa, Mycobacterium
TGAGSAEEF

SEQ ID NO: 289595 - protein, 9 aa, Mycobacterium
TGAGSSDQF

SEQ ID NO: 289596 - protein, 7 aa, Mycobacterium
TGAGTEL

SEQ ID NO: 289597 - protein, 10 aa, Mycobacterium
TGAGVPPGQT

SEQ ID NO: 289598 - protein, 5 aa, Mycobacterium
TGAGY

SEQ ID NO: 289599 - protein, 4 aa, Mycobacterium
TGAH

SEQ ID NO: 289600 - protein, 14 aa, Mycobacterium
TGAKAGKAKPPGWV

SEQ ID NO: 289601 - protein, 55 aa, Mycobacterium
TGAKRPGAKKAPARAEAPAAAAPAQPEPEATPEPEPASKQDGEPTPPAAPAAPVK

SEQ ID NO: 289602 - protein, 36 aa, Mycobacterium
TGAKRPGAKKTAAENSTAEASTATPTAEAAPAAPVK

SEQ ID NO: 289603 - protein, 4 aa, Mycobacterium
TGAL

SEQ ID NO: 289604 - protein, 8 aa, Mycobacterium
TGALGSPI

SEQ ID NO: 289605 - protein, 5 aa, Mycobacterium
TGALS

SEQ ID NO: 289606 - protein, 5 aa, Mycobacterium
TGANT

SEQ ID NO: 289607 - protein, 5 aa, Mycobacterium
TGAPA

SEQ ID NO: 289608 - protein, 6 aa, Mycobacterium
TGAPAK

SEQ ID NO: 289609 - protein, 8 aa, Mycobacterium
TGAPARVD

SEQ ID NO: 289610 - protein, 8 aa, Mycobacterium
TGAPIGAP

SEQ ID NO: 289611 - protein, 16 aa, Mycobacterium
TGAPIGAPLTGHTDSV

SEQ ID NO: 289612 - protein, 9 aa, Mycobacterium
TGAPPPSLR

SEQ ID NO: 289613 - protein, 7 aa, Mycobacterium
TGAPVTP

SEQ ID NO: 289614 - protein, 9 aa, Mycobacterium
TGAQAPSVR

SEQ ID NO: 289615 - protein, 18 aa, Mycobacterium
TGAQASSAAPGSAPRRRT

SEQ ID NO: 289616 - protein, 7 aa, Mycobacterium
TGAQPLA

SEQ ID NO: 289617 - protein, 8 aa, Mycobacterium
TGAQTELG

SEQ ID NO: 289618 - protein, 4 aa, Mycobacterium
TGAR

SEQ ID NO: 289619 - protein, 4 aa, Mycobacterium
TGAS

SEQ ID NO: 289620 - protein, 5 aa, Mycobacterium
TGASA

SEQ ID NO: 289621 - protein, 10 aa, Mycobacterium
TGASGSGKTT

SEQ ID NO: 289622 - protein, 8 aa, Mycobacterium
TGASPKIA

SEQ ID NO: 289623 - protein, 7 aa, Mycobacterium
TGASQST

SEQ ID NO: 289624 - protein, 7 aa, Mycobacterium
TGATASR

SEQ ID NO: 289625 - protein, 10 aa, Mycobacterium
TGATLGQGLA

SEQ ID NO: 289626 - protein, 9 aa, Mycobacterium
TGATLGTAQ

SEQ ID NO: 289627 - protein, 14 aa, Mycobacterium
TGATSQLREDLGPE

SEQ ID NO: 289628 - protein, 7 aa, Mycobacterium
TGATTGY

SEQ ID NO: 289629 - protein, 14 aa, Mycobacterium
TGATTPPGAHPGAP

SEQ ID NO: 289630 - protein, 5 aa, Mycobacterium
TGATV

SEQ ID NO: 289631 - protein, 4 aa, Mycobacterium
TGAV

SEQ ID NO: 289632 - protein, 12 aa, Mycobacterium
TGAVSKDLSEGA

SEQ ID NO: 289633 - protein, 8 aa, Mycobacterium
TGAVTSNS

SEQ ID NO: 289634 - protein, 4 aa, Mycobacterium
TGAY

SEQ ID NO: 289635 - protein, 14 aa, Mycobacterium
TGAYRATRVGPEAY

SEQ ID NO: 289636 - protein, 4 aa, Mycobacterium
TGCG

SEQ ID NO: 289637 - protein, 17 aa, Mycobacterium
TGCGGGDSDLLAETTVR

SEQ ID NO: 289638 - protein, 6 aa, Mycobacterium
TGCGKS

SEQ ID NO: 289639 - protein, 6 aa, Mycobacterium
TGDAPL

SEQ ID NO: 289640 - protein, 7 aa, Mycobacterium
TGDATAR

SEQ ID NO: 289641 - protein, 9 aa, Mycobacterium
TGDAVESDV

SEQ ID NO: 289642 - protein, 5 aa, Mycobacterium
TGDDA

SEQ ID NO: 289643 - protein, 7 aa, Mycobacterium
TGDDDGV

SEQ ID NO: 289644 - protein, 5 aa, Mycobacterium
TGDDT

SEQ ID NO: 289645 - protein, 8 aa, Mycobacterium
TGDEAAGL

SEQ ID NO: 289646 - protein, 13 aa, Mycobacterium
TGDEAEQQTYAKD

SEQ ID NO: 289647 - protein, 7 aa, Mycobacterium
TGDEPAS

SEQ ID NO: 289648 - protein, 6 aa, Mycobacterium
TGDGAL

SEQ ID NO: 289649 - protein, 10 aa, Mycobacterium
TGDGSLGDHD

SEQ ID NO: 289650 - protein, 5 aa, Mycobacterium
TGDGV

SEQ ID NO: 289651 - protein, 17 aa, Mycobacterium
TGDKAGHQELADPQTVS

SEQ ID NO: 289652 - protein, 13 aa, Mycobacterium
TGDKPADDVEESA

SEQ ID NO: 289653 - protein, 6 aa, Mycobacterium
TGDLDG

SEQ ID NO: 289654 - protein, 10 aa, Mycobacterium
TGDNATAGQW

SEQ ID NO: 289655 - protein, 8 aa, Mycobacterium
TGDNLGRI

SEQ ID NO: 289656 - protein, 8 aa, Mycobacterium
TGDNPQVA

SEQ ID NO: 289657 - protein, 4 aa, Mycobacterium
TGDP

SEQ ID NO: 289658 - protein, 9 aa, Mycobacterium
TGDPATVET

SEQ ID NO: 289659 - protein, 7 aa, Mycobacterium
TGDPEIH

SEQ ID NO: 289660 - protein, 6 aa, Mycobacterium
TGDPTN

SEQ ID NO: 289661 - protein, 10 aa, Mycobacterium
TGDPTSGTVP

SEQ ID NO: 289662 - protein, 19 aa, Mycobacterium
TGDQPDQAVADGTMMIESM

SEQ ID NO: 289663 - protein, 5 aa, Mycobacterium
TGDQR

SEQ ID NO: 289664 - protein, 7 aa, Mycobacterium
TGDRFGR

SEQ ID NO: 289665 - protein, 7 aa, Mycobacterium
TGDRRYA

SEQ ID NO: 289666 - protein, 13 aa, Mycobacterium
TGDRYDPAAAADA

SEQ ID NO: 289667 - protein, 12 aa, Mycobacterium
TGDRYDPTAAAD

SEQ ID NO: 289668 - protein, 7 aa, Mycobacterium
TGDSAHR

SEQ ID NO: 289669 - protein, 9 aa, Mycobacterium
TGDSSSVMP

SEQ ID NO: 289670 - protein, 4 aa, Mycobacterium
TGDT

SEQ ID NO: 289671 - protein, 4 aa, Mycobacterium
TGEA

SEQ ID NO: 289672 - protein, 15 aa, Mycobacterium
TGEADAIAKDAGDHV

SEQ ID NO: 289673 - protein, 11 aa, Mycobacterium
TGEADAIEKTI

SEQ ID NO: 289674 - protein, 9 aa, Mycobacterium
TGEADPIAK

SEQ ID NO: 289675 - protein, 16 aa, Mycobacterium
TGEADPIAKDAGDPVM

SEQ ID NO: 289676 - protein, 16 aa, Mycobacterium
TGEADPIAKDPGDPVM

SEQ ID NO: 289677 - protein, 16 aa, Mycobacterium
TGEADPITKAAGDGVM

SEQ ID NO: 289678 - protein, 6 aa, Mycobacterium
TGEADS

SEQ ID NO: 289679 - protein, 11 aa, Mycobacterium
TGEAETATGPL

SEQ ID NO: 289680 - protein, 11 aa, Mycobacterium
TGEAETPNGPL

SEQ ID NO: 289681 - protein, 11 aa, Mycobacterium
TGEAETPSGPL

SEQ ID NO: 289682 - protein, 11 aa, Mycobacterium
TGEAETSAGPL

SEQ ID NO: 289683 - protein, 11 aa, Mycobacterium
TGEAQAPRKEP

SEQ ID NO: 289684 - protein, 9 aa, Mycobacterium
TGEATVSPT

SEQ ID NO: 289685 - protein, 6 aa, Mycobacterium
TGEDTT

SEQ ID NO: 289686 - protein, 5 aa, Mycobacterium
TGEEL

SEQ ID NO: 289687 - protein, 4 aa, Mycobacterium
TGEF

SEQ ID NO: 289688 - protein, 5 aa, Mycobacterium
TGEFS

SEQ ID NO: 289689 - protein, 4 aa, Mycobacterium
TGEG

SEQ ID NO: 289690 - protein, 8 aa, Mycobacterium
TGEGEGDV

SEQ ID NO: 289691 - protein, 9 aa, Mycobacterium
TGEGPAALA

SEQ ID NO: 289692 - protein, 5 aa, Mycobacterium
TGEGR

SEQ ID NO: 289693 - protein, 6 aa, Mycobacterium
TGELTG

SEQ ID NO: 289694 - protein, 8 aa, Mycobacterium
TGENGRSV

SEQ ID NO: 289695 - protein, 9 aa, Mycobacterium
TGENRQYKA

SEQ ID NO: 289696 - protein, 14 aa, Mycobacterium
TGEPNPDADAKPLG

SEQ ID NO: 289697 - protein, 16 aa, Mycobacterium
TGEPVGPGEVGEIQAR

SEQ ID NO: 289698 - protein, 4 aa, Mycobacterium
TGER

SEQ ID NO: 289699 - protein, 10 aa, Mycobacterium
TGERSGSSRL

SEQ ID NO: 289700 - protein, 14 aa, Mycobacterium
TGESEAGGVASGEP

SEQ ID NO: 289701 - protein, 5 aa, Mycobacterium
TGESI

SEQ ID NO: 289702 - protein, 15 aa, Mycobacterium
TGESKPVRATADAPV

SEQ ID NO: 289703 - protein, 15 aa, Mycobacterium
TGESLPVEAGPGSDV

SEQ ID NO: 289704 - protein, 14 aa, Mycobacterium
TGESMPAAKGRGDE

SEQ ID NO: 289705 - protein, 25 aa, Mycobacterium
TGESRPVGRGVGDAVTAGTVATDSG

SEQ ID NO: 289706 - protein, 12 aa, Mycobacterium
TGESSPDAVGGG

SEQ ID NO: 289707 - protein, 23 aa, Mycobacterium
TGESTGAEKAPEPVPPGTDVADA

SEQ ID NO: 289708 - protein, 5 aa, Mycobacterium
TGESV

SEQ ID NO: 289709 - protein, 12 aa, Mycobacterium
TGESVPVEAGPG

SEQ ID NO: 289710 - protein, 15 aa, Mycobacterium
TGESVPVEAGPGSDV

SEQ ID NO: 289711 - protein, 12 aa, Mycobacterium
TGETSPDAVGGS

SEQ ID NO: 289712 - protein, 13 aa, Mycobacterium
TGETSPGVSGGAG

SEQ ID NO: 289713 - protein, 9 aa, Mycobacterium
TGETSPGVV

SEQ ID NO: 289714 - protein, 6 aa, Mycobacterium
TGEVPA

SEQ ID NO: 289715 - protein, 4 aa, Mycobacterium
TGEY

SEQ ID NO: 289716 - protein, 13 aa, Mycobacterium
TGFATGNPDLTVT

SEQ ID NO: 289717 - protein, 6 aa, Mycobacterium
TGFDGE

SEQ ID NO: 289718 - protein, 4 aa, Mycobacterium
TGFG

SEQ ID NO: 289719 - protein, 5 aa, Mycobacterium
TGFGS

SEQ ID NO: 289720 - protein, 10 aa, Mycobacterium
TGFNDSGQGA

SEQ ID NO: 289721 - protein, 43 aa, Mycobacterium
TGFPPPGGPAAGTEQQQHRPPAQPPGPAPPAPGAPGYPGAQRT

SEQ ID NO: 289722 - protein, 12 aa, Mycobacterium
TGFRAPEGPYET

SEQ ID NO: 289723 - protein, 11 aa, Mycobacterium
TGGAANRGNSL

SEQ ID NO: 289724 - protein, 5 aa, Mycobacterium
TGGAF

SEQ ID NO: 289725 - protein, 8 aa, Mycobacterium
TGGAGTTT

SEQ ID NO: 289726 - protein, 62 aa, Mycobacterium
TGGAKPASADKPNSAQSKPGSPAPQAPPPAAPGEQPVPVAPQQGQNPEMPTPTAAVQPPPVL

SEQ ID NO: 289727 - protein, 5 aa, Mycobacterium
TGGAP

SEQ ID NO: 289728 - protein, 6 aa, Mycobacterium
TGGAPY

SEQ ID NO: 289729 - protein, 11 aa, Mycobacterium
TGGAQRLRAEA

SEQ ID NO: 289730 - protein, 7 aa, Mycobacterium
TGGATSL

SEQ ID NO: 289731 - protein, 13 aa, Mycobacterium
TGGAYKVSGVEFV

SEQ ID NO: 289732 - protein, 31 aa, Mycobacterium
TGGDGGAGAAGVAGVNGGDGGAGGRGGNSGA

SEQ ID NO: 289733 - protein, 7 aa, Mycobacterium
TGGDHSG

SEQ ID NO: 289734 - protein, 6 aa, Mycobacterium
TGGDMS

SEQ ID NO: 289735 - protein, 10 aa, Mycobacterium
TGGDSGSGLG

SEQ ID NO: 289736 - protein, 9 aa, Mycobacterium
TGGDVQRKK

SEQ ID NO: 289737 - protein, 6 aa, Mycobacterium
TGGEAA

SEQ ID NO: 289738 - protein, 11 aa, Mycobacterium
TGGENDAQKHA

SEQ ID NO: 289739 - protein, 12 aa, Mycobacterium
TGGENNAQKYAR

SEQ ID NO: 289740 - protein, 8 aa, Mycobacterium
TGGERDFD

SEQ ID NO: 289741 - protein, 10 aa, Mycobacterium
TGGESGAQKL

SEQ ID NO: 289742 - protein, 5 aa, Mycobacterium
TGGEV

SEQ ID NO: 289743 - protein, 8 aa, Mycobacterium
TGGGNGGI

SEQ ID NO: 289744 - protein, 10 aa, Mycobacterium
TGGGPAGSTD

SEQ ID NO: 289745 - protein, 10 aa, Mycobacterium
TGGGPEGSTD

SEQ ID NO: 289746 - protein, 12 aa, Mycobacterium
TGGHPTPLPNPG

SEQ ID NO: 289747 - protein, 15 aa, Mycobacterium
TGGKTGSAETAAPPA

SEQ ID NO: 289748 - protein, 8 aa, Mycobacterium
TGGLTARE

SEQ ID NO: 289749 - protein, 33 aa, Mycobacterium
TGGNPTAVADEAGRPQAGPETGPAVPEPRPGQK

SEQ ID NO: 289750 - protein, 13 aa, Mycobacterium
TGGNTGNQAATTV

SEQ ID NO: 289751 - protein, 9 aa, Mycobacterium
TGGNTGTQI

SEQ ID NO: 289752 - protein, 10 aa, Mycobacterium
TGGNTGTQIT

SEQ ID NO: 289753 - protein, 9 aa, Mycobacterium
TGGPAGRLR

SEQ ID NO: 289754 - protein, 6 aa, Mycobacterium
TGGPAM

SEQ ID NO: 289755 - protein, 8 aa, Mycobacterium
TGGPESET

SEQ ID NO: 289756 - protein, 11 aa, Mycobacterium
TGGPGSETQVR

SEQ ID NO: 289757 - protein, 17 aa, Mycobacterium
TGGPGTAPNDQAKAANS

SEQ ID NO: 289758 - protein, 5 aa, Mycobacterium
TGGPP

SEQ ID NO: 289759 - protein, 11 aa, Mycobacterium
TGGQSSTGGGI

SEQ ID NO: 289760 - protein, 17 aa, Mycobacterium
TGGQTVECRPNTGLTVN

SEQ ID NO: 289761 - protein, 4 aa, Mycobacterium
TGGR

SEQ ID NO: 289762 - protein, 9 aa, Mycobacterium
TGGRESETL

SEQ ID NO: 289763 - protein, 7 aa, Mycobacterium
TGGRTAQ

SEQ ID NO: 289764 - protein, 8 aa, Mycobacterium
TGGRTAQA

SEQ ID NO: 289765 - protein, 7 aa, Mycobacterium
TGGSAGG

SEQ ID NO: 289766 - protein, 9 aa, Mycobacterium
TGGSDTDMA

SEQ ID NO: 289767 - protein, 13 aa, Mycobacterium
TGGSGGLSTPIRA

SEQ ID NO: 289768 - protein, 9 aa, Mycobacterium
TGGSGNDWR

SEQ ID NO: 289769 - protein, 5 aa, Mycobacterium
TGGSN

SEQ ID NO: 289770 - protein, 8 aa, Mycobacterium
TGGSNRFE

SEQ ID NO: 289771 - protein, 6 aa, Mycobacterium
TGGSRP

SEQ ID NO: 289772 - protein, 7 aa, Mycobacterium
TGGSSYF

SEQ ID NO: 289773 - protein, 10 aa, Mycobacterium
TGGSVGREGP

SEQ ID NO: 289774 - protein, 4 aa, Mycobacterium
TGGT

SEQ ID NO: 289775 - protein, 21 aa, Mycobacterium
TGGTAASADTGTAGNKSMQKT

SEQ ID NO: 289776 - protein, 8 aa, Mycobacterium
TGGTESET

SEQ ID NO: 289777 - protein, 5 aa, Mycobacterium
TGGTL

SEQ ID NO: 289778 - protein, 8 aa, Mycobacterium
TGGTLPDG

SEQ ID NO: 289779 - protein, 24 aa, Mycobacterium
TGGTNLERIGDTSDAGSASLGNIQ

SEQ ID NO: 289780 - protein, 12 aa, Mycobacterium
TGGVDARTRREL

SEQ ID NO: 289781 - protein, 5 aa, Mycobacterium
TGGVV

SEQ ID NO: 289782 - protein, 4 aa, Mycobacterium
TGGY

SEQ ID NO: 289783 - protein, 11 aa, Mycobacterium
TGHAGPHTPYP

SEQ ID NO: 289784 - protein, 7 aa, Mycobacterium
TGHEGRS

SEQ ID NO: 289785 - protein, 16 aa, Mycobacterium
TGHGRAGRSVPNSIRR

SEQ ID NO: 289786 - protein, 8 aa, Mycobacterium
TGHGTHGG

SEQ ID NO: 289787 - protein, 9 aa, Mycobacterium
TGHHSEGMA

SEQ ID NO: 289788 - protein, 9 aa, Mycobacterium
TGHPADDEI

SEQ ID NO: 289789 - protein, 10 aa, Mycobacterium
TGHPGKEFTS

SEQ ID NO: 289790 - protein, 12 aa, Mycobacterium
TGHPQGGGSETY

SEQ ID NO: 289791 - protein, 6 aa, Mycobacterium
TGHRAR

SEQ ID NO: 289792 - protein, 15 aa, Mycobacterium
TGHRHGDAGTAAPTD

SEQ ID NO: 289793 - protein, 10 aa, Mycobacterium
TGHSSGASGR

SEQ ID NO: 289794 - protein, 8 aa, Mycobacterium
TGHSSGVA

SEQ ID NO: 289795 - protein, 8 aa, Mycobacterium
TGHSSGVT

SEQ ID NO: 289796 - protein, 5 aa, Mycobacterium
TGHTA

SEQ ID NO: 289797 - protein, 9 aa, Mycobacterium
TGHTASGGN

SEQ ID NO: 289798 - protein, 8 aa, Mycobacterium
TGHTGGVD

SEQ ID NO: 289799 - protein, 20 aa, Mycobacterium
TGHTTQDPPRPTDVKPELPA

SEQ ID NO: 289800 - protein, 6 aa, Mycobacterium
TGIASG

SEQ ID NO: 289801 - protein, 9 aa, Mycobacterium
TGIATAGES

SEQ ID NO: 289802 - protein, 4 aa, Mycobacterium
TGIC

SEQ ID NO: 289803 - protein, 13 aa, Mycobacterium
TGIDPTTLRGSAT

SEQ ID NO: 289804 - protein, 7 aa, Mycobacterium
TGIEAPL

SEQ ID NO: 289805 - protein, 12 aa, Mycobacterium
TGINRHAEGRQI

SEQ ID NO: 289806 - protein, 4 aa, Mycobacterium
TGIP

SEQ ID NO: 289807 - protein, 12 aa, Mycobacterium
TGIPDMRPDGIP

SEQ ID NO: 289808 - protein, 4 aa, Mycobacterium
TGIV

SEQ ID NO: 289809 - protein, 9 aa, Mycobacterium
TGKAVSPGE

SEQ ID NO: 289810 - protein, 7 aa, Mycobacterium
TGKEAEF

SEQ ID NO: 289811 - protein, 6 aa, Mycobacterium
TGKEQL

SEQ ID NO: 289812 - protein, 22 aa, Mycobacterium
TGKGGALSSGKFAPDLGPANEQ

SEQ ID NO: 289813 - protein, 23 aa, Mycobacterium
TGKGGALSSGKYAPDLGDANPAQ

SEQ ID NO: 289814 - protein, 22 aa, Mycobacterium
TGKGGALSSGKYAPDLGPANEQ

SEQ ID NO: 289815 - protein, 22 aa, Mycobacterium
TGKGGALSSGKYAPDLGTANEA

SEQ ID NO: 289816 - protein, 10 aa, Mycobacterium
TGKHAGHSPM

SEQ ID NO: 289817 - protein, 8 aa, Mycobacterium
TGKHPGAV

SEQ ID NO: 289818 - protein, 10 aa, Mycobacterium
TGKIGTPAAA

SEQ ID NO: 289819 - protein, 6 aa, Mycobacterium
TGKPLS

SEQ ID NO: 289820 - protein, 6 aa, Mycobacterium
TGKPVL

SEQ ID NO: 289821 - protein, 13 aa, Mycobacterium
TGLAGGLPARLFA

SEQ ID NO: 289822 - protein, 13 aa, Mycobacterium
TGLAPPATSAAEY

SEQ ID NO: 289823 - protein, 9 aa, Mycobacterium
TGLAQTAPD

SEQ ID NO: 289824 - protein, 11 aa, Mycobacterium
TGLERTAAQDI

SEQ ID NO: 289825 - protein, 12 aa, Mycobacterium
TGLGDGPPYTKM

SEQ ID NO: 289826 - protein, 11 aa, Mycobacterium
TGLGGDTGRAE

SEQ ID NO: 289827 - protein, 4 aa, Mycobacterium
TGLP

SEQ ID NO: 289828 - protein, 5 aa, Mycobacterium
TGLPL

SEQ ID NO: 289829 - protein, 6 aa, Mycobacterium
TGLQPA

SEQ ID NO: 289830 - protein, 7 aa, Mycobacterium
TGLQPAW

SEQ ID NO: 289831 - protein, 5 aa, Mycobacterium
TGLRD

SEQ ID NO: 289832 - protein, 9 aa, Mycobacterium
TGLSDTRDY

SEQ ID NO: 289833 - protein, 10 aa, Mycobacterium
TGLSRSTTKD

SEQ ID NO: 289834 - protein, 11 aa, Mycobacterium
TGLTPLSPTGV

SEQ ID NO: 289835 - protein, 4 aa, Mycobacterium
TGMT

SEQ ID NO: 289836 - protein, 12 aa, Mycobacterium
TGMTSLNGSQRD

SEQ ID NO: 289837 - protein, 13 aa, Mycobacterium
TGNAGQGPDHDFA

SEQ ID NO: 289838 - protein, 5 aa, Mycobacterium
TGNAV

SEQ ID NO: 289839 - protein, 6 aa, Mycobacterium
TGNDIA

SEQ ID NO: 289840 - protein, 8 aa, Mycobacterium
TGNHADGV

SEQ ID NO: 289841 - protein, 6 aa, Mycobacterium
TGNHHA

SEQ ID NO: 289842 - protein, 14 aa, Mycobacterium
TGNLDLTPSSHWPE

SEQ ID NO: 289843 - protein, 4 aa, Mycobacterium
TGNP

SEQ ID NO: 289844 - protein, 6 aa, Mycobacterium
TGNPAT

SEQ ID NO: 289845 - protein, 8 aa, Mycobacterium
TGNPATVA

SEQ ID NO: 289846 - protein, 9 aa, Mycobacterium
TGNPELTAK

SEQ ID NO: 289847 - protein, 4 aa, Mycobacterium
TGNQ

SEQ ID NO: 289848 - protein, 7 aa, Mycobacterium
TGNQDRR

SEQ ID NO: 289849 - protein, 15 aa, Mycobacterium
TGNRGRDAAPGVRAA

SEQ ID NO: 289850 - protein, 8 aa, Mycobacterium
TGNRTAQA

SEQ ID NO: 289851 - protein, 21 aa, Mycobacterium
TGNRVGDSVRDGSLPDGTPGL

SEQ ID NO: 289852 - protein, 5 aa, Mycobacterium
TGNSL

SEQ ID NO: 289853 - protein, 8 aa, Mycobacterium
TGNSRRAP

SEQ ID NO: 289854 - protein, 6 aa, Mycobacterium
TGNSSA

SEQ ID NO: 289855 - protein, 6 aa, Mycobacterium
TGNSVD

SEQ ID NO: 289856 - protein, 12 aa, Mycobacterium
TGNTGSGTSGYR

SEQ ID NO: 289857 - protein, 7 aa, Mycobacterium
TGNTRDA

SEQ ID NO: 289858 - protein, 5 aa, Mycobacterium
TGNVR

SEQ ID NO: 289859 - protein, 7 aa, Mycobacterium
TGNYERA

SEQ ID NO: 289860 - protein, 4 aa, Mycobacterium
TGPA

SEQ ID NO: 289861 - protein, 16 aa, Mycobacterium
TGPAALSADQHVASDR

SEQ ID NO: 289862 - protein, 16 aa, Mycobacterium
TGPAALTTDMNEAADK

SEQ ID NO: 289863 - protein, 6 aa, Mycobacterium
TGPAAP

SEQ ID NO: 289864 - protein, 9 aa, Mycobacterium
TGPAARTPL

SEQ ID NO: 289865 - protein, 12 aa, Mycobacterium
TGPAASTADQRV

SEQ ID NO: 289866 - protein, 8 aa, Mycobacterium
TGPAATLA

SEQ ID NO: 289867 - protein, 7 aa, Mycobacterium
TGPAATV

SEQ ID NO: 289868 - protein, 7 aa, Mycobacterium
TGPAGRT

SEQ ID NO: 289869 - protein, 30 aa, Mycobacterium
TGPAGSHHHHGTPDQATEPARPHAADNTAR

SEQ ID NO: 289870 - protein, 6 aa, Mycobacterium
TGPALR

SEQ ID NO: 289871 - protein, 5 aa, Mycobacterium
TGPAP

SEQ ID NO: 289872 - protein, 8 aa, Mycobacterium
TGPAPAGL

SEQ ID NO: 289873 - protein, 8 aa, Mycobacterium
TGPAPDGL

SEQ ID NO: 289874 - protein, 6 aa, Mycobacterium
TGPAPL

SEQ ID NO: 289875 - protein, 6 aa, Mycobacterium
TGPAPM

SEQ ID NO: 289876 - protein, 8 aa, Mycobacterium
TGPAPPGL

SEQ ID NO: 289877 - protein, 9 aa, Mycobacterium
TGPAPPGLK

SEQ ID NO: 289878 - protein, 9 aa, Mycobacterium
TGPAPQGLS

SEQ ID NO: 289879 - protein, 7 aa, Mycobacterium
TGPAPTV

SEQ ID NO: 289880 - protein, 6 aa, Mycobacterium
TGPAQQ

SEQ ID NO: 289881 - protein, 7 aa, Mycobacterium
TGPDANS

SEQ ID NO: 289882 - protein, 8 aa, Mycobacterium
TGPDRTAF

SEQ ID NO: 289883 - protein, 14 aa, Mycobacterium
TGPDTADQTVPDDK

SEQ ID NO: 289884 - protein, 5 aa, Mycobacterium
TGPET

SEQ ID NO: 289885 - protein, 11 aa, Mycobacterium
TGPEVDPDGSL

SEQ ID NO: 289886 - protein, 10 aa, Mycobacterium
TGPGAADEAS

SEQ ID NO: 289887 - protein, 8 aa, Mycobacterium
TGPGAGTE

SEQ ID NO: 289888 - protein, 19 aa, Mycobacterium
TGPGALGADQDTSGNSSLQ

SEQ ID NO: 289889 - protein, 6 aa, Mycobacterium
TGPGAT

SEQ ID NO: 289890 - protein, 7 aa, Mycobacterium
TGPGATV

SEQ ID NO: 289891 - protein, 9 aa, Mycobacterium
TGPGGVGKT

SEQ ID NO: 289892 - protein, 9 aa, Mycobacterium
TGPGLGKGD

SEQ ID NO: 289893 - protein, 8 aa, Mycobacterium
TGPGPLAT

SEQ ID NO: 289894 - protein, 7 aa, Mycobacterium
TGPGPLG

SEQ ID NO: 289895 - protein, 6 aa, Mycobacterium
TGPGRF

SEQ ID NO: 289896 - protein, 8 aa, Mycobacterium
TGPGTDAA

SEQ ID NO: 289897 - protein, 5 aa, Mycobacterium
TGPGV

SEQ ID NO: 289898 - protein, 5 aa, Mycobacterium
TGPHG

SEQ ID NO: 289899 - protein, 14 aa, Mycobacterium
TGPHTDRSLDGPGL

SEQ ID NO: 289900 - protein, 6 aa, Mycobacterium
TGPLQS

SEQ ID NO: 289901 - protein, 10 aa, Mycobacterium
TGPNGAGKST

SEQ ID NO: 289902 - protein, 10 aa, Mycobacterium
TGPNGSGKST

SEQ ID NO: 289903 - protein, 9 aa, Mycobacterium
TGPNGVGKS

SEQ ID NO: 289904 - protein, 14 aa, Mycobacterium
TGPNPQEVDRAANP

SEQ ID NO: 289905 - protein, 12 aa, Mycobacterium
TGPPGDPLSGER

SEQ ID NO: 289906 - protein, 7 aa, Mycobacterium
TGPPLNP

SEQ ID NO: 289907 - protein, 8 aa, Mycobacterium
TGPRGREV

SEQ ID NO: 289908 - protein, 9 aa, Mycobacterium
TGPRPGGFG

SEQ ID NO: 289909 - protein, 18 aa, Mycobacterium
TGPSALNADQAEAGDKSI

SEQ ID NO: 289910 - protein, 6 aa, Mycobacterium
TGPSAV

SEQ ID NO: 289911 - protein, 17 aa, Mycobacterium
TGPTAEARPNGRRPYTQ

SEQ ID NO: 289912 - protein, 7 aa, Mycobacterium
TGPTGAT

SEQ ID NO: 289913 - protein, 18 aa, Mycobacterium
TGPTPADGLPISLQRLSG

SEQ ID NO: 289914 - protein, 8 aa, Mycobacterium
TGPTPPGL

SEQ ID NO: 289915 - protein, 8 aa, Mycobacterium
TGPTPSLD

SEQ ID NO: 289916 - protein, 5 aa, Mycobacterium
TGPTT

SEQ ID NO: 289917 - protein, 5 aa, Mycobacterium
TGPTV

SEQ ID NO: 289918 - protein, 4 aa, Mycobacterium
TGPV

SEQ ID NO: 289919 - protein, 23 aa, Mycobacterium
TGPVAADGQPGPGALSTDRGSLP

SEQ ID NO: 289920 - protein, 12 aa, Mycobacterium
TGPYKGGELSEA

SEQ ID NO: 289921 - protein, 9 aa, Mycobacterium
TGQAGSVGK

SEQ ID NO: 289922 - protein, 9 aa, Mycobacterium
TGQANDDNI

SEQ ID NO: 289923 - protein, 10 aa, Mycobacterium
TGQEAKGDAE

SEQ ID NO: 289924 - protein, 7 aa, Mycobacterium
TGQFGTP

SEQ ID NO: 289925 - protein, 4 aa, Mycobacterium
TGQG

SEQ ID NO: 289926 - protein, 7 aa, Mycobacterium
TGQGSTV

SEQ ID NO: 289927 - protein, 7 aa, Mycobacterium
TGQGTAT

SEQ ID NO: 289928 - protein, 8 aa, Mycobacterium
TGQHPDAV

SEQ ID NO: 289929 - protein, 13 aa, Mycobacterium
TGQPFSDKSKTVA

SEQ ID NO: 289930 - protein, 17 aa, Mycobacterium
TGQPIGAPLSGSTASVS

SEQ ID NO: 289931 - protein, 7 aa, Mycobacterium
TGQPWPN

SEQ ID NO: 289932 - protein, 4 aa, Mycobacterium
TGQQ

SEQ ID NO: 289933 - protein, 15 aa, Mycobacterium
TGQQIGAPLTGHTGA

SEQ ID NO: 289934 - protein, 14 aa, Mycobacterium
TGQQIGPPLSGHTG

SEQ ID NO: 289935 - protein, 15 aa, Mycobacterium
TGQRDSVLERNGHEH

SEQ ID NO: 289936 - protein, 10 aa, Mycobacterium
TGQRLGEPAQ

SEQ ID NO: 289937 - protein, 8 aa, Mycobacterium
TGQSGGAV

SEQ ID NO: 289938 - protein, 6 aa, Mycobacterium
TGQSGL

SEQ ID NO: 289939 - protein, 9 aa, Mycobacterium
TGQSHAQAS

SEQ ID NO: 289940 - protein, 14 aa, Mycobacterium
TGQSNADERQYPDK

SEQ ID NO: 289941 - protein, 6 aa, Mycobacterium
TGQTRH

SEQ ID NO: 289942 - protein, 18 aa, Mycobacterium
TGQTRRQCREEIRRSNGW

SEQ ID NO: 289943 - protein, 13 aa, Mycobacterium
TGQVSQLTGTPLA

SEQ ID NO: 289944 - protein, 11 aa, Mycobacterium
TGQYPLPQPMQ

SEQ ID NO: 289945 - protein, 13 aa, Mycobacterium
TGQYPLPQPPQDP

SEQ ID NO: 289946 - protein, 7 aa, Mycobacterium
TGQYSGF

SEQ ID NO: 289947 - protein, 4 aa, Mycobacterium
TGRA

SEQ ID NO: 289948 - protein, 13 aa, Mycobacterium
TGRAETRAEPWEP

SEQ ID NO: 289949 - protein, 21 aa, Mycobacterium
TGRAPADTAPTTTSAPGGGGL

SEQ ID NO: 289950 - protein, 11 aa, Mycobacterium
TGRARDHGGAG

SEQ ID NO: 289951 - protein, 7 aa, Mycobacterium
TGRASLR

SEQ ID NO: 289952 - protein, 6 aa, Mycobacterium
TGRDPF

SEQ ID NO: 289953 - protein, 7 aa, Mycobacterium
TGRDQSV

SEQ ID NO: 289954 - protein, 14 aa, Mycobacterium
TGRENSDDVAAGRQ

SEQ ID NO: 289955 - protein, 4 aa, Mycobacterium
TGRG

SEQ ID NO: 289956 - protein, 9 aa, Mycobacterium
TGRGDGWRS

SEQ ID NO: 289957 - protein, 23 aa, Mycobacterium
TGRGGALSSGKFAPELDPATEQQ

SEQ ID NO: 289958 - protein, 11 aa, Mycobacterium
TGRGPPQRSHR

SEQ ID NO: 289959 - protein, 9 aa, Mycobacterium
TGRGRDDHS

SEQ ID NO: 289960 - protein, 9 aa, Mycobacterium
TGRGREDDT

SEQ ID NO: 289961 - protein, 4 aa, Mycobacterium
TGRI

SEQ ID NO: 289962 - protein, 9 aa, Mycobacterium
TGRIGSQTD

SEQ ID NO: 289963 - protein, 6 aa, Mycobacterium
TGRLDP

SEQ ID NO: 289964 - protein, 5 aa, Mycobacterium
TGRLR

SEQ ID NO: 289965 - protein, 13 aa, Mycobacterium
TGRLSGAEARQPG

SEQ ID NO: 289966 - protein, 23 aa, Mycobacterium
TGRMGSASAAVAGGRAGASVPET

SEQ ID NO: 289967 - protein, 6 aa, Mycobacterium
TGRPCP

SEQ ID NO: 289968 - protein, 5 aa, Mycobacterium
TGRPD

SEQ ID NO: 289969 - protein, 9 aa, Mycobacterium
TGRPDNPAM

SEQ ID NO: 289970 - protein, 6 aa, Mycobacterium
TGRPGL

SEQ ID NO: 289971 - protein, 8 aa, Mycobacterium
TGRPGNSP

SEQ ID NO: 289972 - protein, 9 aa, Mycobacterium
TGRPLDRDS

SEQ ID NO: 289973 - protein, 8 aa, Mycobacterium
TGRPSAVA

SEQ ID NO: 289974 - protein, 8 aa, Mycobacterium
TGRPVGAP

SEQ ID NO: 289975 - protein, 14 aa, Mycobacterium
TGRQPRQVAAQRDA

SEQ ID NO: 289976 - protein, 4 aa, Mycobacterium
TGRR

SEQ ID NO: 289977 - protein, 9 aa, Mycobacterium
TGRSGDDEI

SEQ ID NO: 289978 - protein, 9 aa, Mycobacterium
TGRSRSSGQ

SEQ ID NO: 289979 - protein, 9 aa, Mycobacterium
TGRTRTGGQ

SEQ ID NO: 289980 - protein, 11 aa, Mycobacterium
TGRTSGDDASM

SEQ ID NO: 289981 - protein, 9 aa, Mycobacterium
TGRVGPQTD

SEQ ID NO: 289982 - protein, 6 aa, Mycobacterium
TGRYGA

SEQ ID NO: 289983 - protein, 5 aa, Mycobacterium
TGRYL

SEQ ID NO: 289984 - protein, 4 aa, Mycobacterium
TGSA

SEQ ID NO: 289985 - protein, 5 aa, Mycobacterium
TGSAA

SEQ ID NO: 289986 - protein, 8 aa, Mycobacterium
TGSAAQAA

SEQ ID NO: 289987 - protein, 8 aa, Mycobacterium
TGSADTTA

SEQ ID NO: 289988 - protein, 7 aa, Mycobacterium
TGSAEVS

SEQ ID NO: 289989 - protein, 8 aa, Mycobacterium
TGSAGASP

SEQ ID NO: 289990 - protein, 5 aa, Mycobacterium
TGSAL

SEQ ID NO: 289991 - protein, 10 aa, Mycobacterium
TGSAPYQSNN

SEQ ID NO: 289992 - protein, 19 aa, Mycobacterium
TGSASEMTDRAGQQAVRIP

SEQ ID NO: 289993 - protein, 9 aa, Mycobacterium
TGSATAAGS

SEQ ID NO: 289994 - protein, 7 aa, Mycobacterium
TGSATVA

SEQ ID NO: 289995 - protein, 7 aa, Mycobacterium
TGSDEEQ

SEQ ID NO: 289996 - protein, 6 aa, Mycobacterium
TGSDEL

SEQ ID NO: 289997 - protein, 8 aa, Mycobacterium
TGSDPDYG

SEQ ID NO: 289998 - protein, 11 aa, Mycobacterium
TGSDPRSPARE

SEQ ID NO: 289999 - protein, 9 aa, Mycobacterium
TGSDTSANS

SEQ ID NO: 290000 - protein, 8 aa, Mycobacterium
TGSERAMD

SEQ ID NO: 290001 - protein, 7 aa, Mycobacterium
TGSFAGS

SEQ ID NO: 290002 - protein, 22 aa, Mycobacterium
TGSFDNDTECVNGPRGNAADHL

SEQ ID NO: 290003 - protein, 22 aa, Mycobacterium
TGSFDNDTECVNGSRGSAADHL

SEQ ID NO: 290004 - protein, 11 aa, Mycobacterium
TGSGAADEASR

SEQ ID NO: 290005 - protein, 6 aa, Mycobacterium
TGSGAE

SEQ ID NO: 290006 - protein, 9 aa, Mycobacterium
TGSGDEVQI

SEQ ID NO: 290007 - protein, 5 aa, Mycobacterium
TGSGG

SEQ ID NO: 290008 - protein, 9 aa, Mycobacterium
TGSGLRITP

SEQ ID NO: 290009 - protein, 9 aa, Mycobacterium
TGSGSDYGT

SEQ ID NO: 290010 - protein, 36 aa, Mycobacterium
TGSGSSAAAGAPAISQQPSGTTSSAPVPSANPTDGD

SEQ ID NO: 290011 - protein, 4 aa, Mycobacterium
TGSI

SEQ ID NO: 290012 - protein, 6 aa, Mycobacterium
TGSIAS

SEQ ID NO: 290013 - protein, 4 aa, Mycobacterium
TGSK

SEQ ID NO: 290014 - protein, 4 aa, Mycobacterium
TGSL

SEQ ID NO: 290015 - protein, 4 aa, Mycobacterium
TGSP

SEQ ID NO: 290016 - protein, 8 aa, Mycobacterium
TGSPAAAR

SEQ ID NO: 290017 - protein, 7 aa, Mycobacterium
TGSPAEP

SEQ ID NO: 290018 - protein, 6 aa, Mycobacterium
TGSPIT

SEQ ID NO: 290019 - protein, 8 aa, Mycobacterium
TGSPLDGS

SEQ ID NO: 290020 - protein, 7 aa, Mycobacterium
TGSPLDP

SEQ ID NO: 290021 - protein, 16 aa, Mycobacterium
TGSPPAAARRKKRSQP

SEQ ID NO: 290022 - protein, 6 aa, Mycobacterium
TGSPPF

SEQ ID NO: 290023 - protein, 9 aa, Mycobacterium
TGSPPYRAD

SEQ ID NO: 290024 - protein, 6 aa, Mycobacterium
TGSPRL

SEQ ID NO: 290025 - protein, 6 aa, Mycobacterium
TGSPVP

SEQ ID NO: 290026 - protein, 9 aa, Mycobacterium
TGSQTAATE

SEQ ID NO: 290027 - protein, 7 aa, Mycobacterium
TGSRATL

SEQ ID NO: 290028 - protein, 10 aa, Mycobacterium
TGSRSTDSPV

SEQ ID NO: 290029 - protein, 15 aa, Mycobacterium
TGSRTKFTYQFFRIT

SEQ ID NO: 290030 - protein, 9 aa, Mycobacterium
TGSRTSPEI

SEQ ID NO: 290031 - protein, 7 aa, Mycobacterium
TGSSEQQ

SEQ ID NO: 290032 - protein, 7 aa, Mycobacterium
TGSSPVR

SEQ ID NO: 290033 - protein, 8 aa, Mycobacterium
TGSTDDER

SEQ ID NO: 290034 - protein, 5 aa, Mycobacterium
TGSTG

SEQ ID NO: 290035 - protein, 8 aa, Mycobacterium
TGSTITPR

SEQ ID NO: 290036 - protein, 8 aa, Mycobacterium
TGSTSAST

SEQ ID NO: 290037 - protein, 16 aa, Mycobacterium
TGSTTTVQVTGPPATF

SEQ ID NO: 290038 - protein, 19 aa, Mycobacterium
TGSVAAPDATPDEDAGPDL

SEQ ID NO: 290039 - protein, 6 aa, Mycobacterium
TGSVEE

SEQ ID NO: 290040 - protein, 5 aa, Mycobacterium
TGSVI

SEQ ID NO: 290041 - protein, 9 aa, Mycobacterium
TGSVKSPRQ

SEQ ID NO: 290042 - protein, 5 aa, Mycobacterium
TGSVV

SEQ ID NO: 290043 - protein, 4 aa, Mycobacterium
TGTA

SEQ ID NO: 290044 - protein, 22 aa, Mycobacterium
TGTAAPPQAAEAEGPVQGPPTL

SEQ ID NO: 290045 - protein, 5 aa, Mycobacterium
TGTAR

SEQ ID NO: 290046 - protein, 7 aa, Mycobacterium
TGTARGR

SEQ ID NO: 290047 - protein, 6 aa, Mycobacterium
TGTARH

SEQ ID NO: 290048 - protein, 6 aa, Mycobacterium
TGTASR

SEQ ID NO: 290049 - protein, 9 aa, Mycobacterium
TGTATDDNI

SEQ ID NO: 290050 - protein, 5 aa, Mycobacterium
TGTDN

SEQ ID NO: 290051 - protein, 5 aa, Mycobacterium
TGTDR

SEQ ID NO: 290052 - protein, 6 aa, Mycobacterium
TGTEDP

SEQ ID NO: 290053 - protein, 4 aa, Mycobacterium
TGTG

SEQ ID NO: 290054 - protein, 22 aa, Mycobacterium
TGTGANREKAPARVEATGKLDG

SEQ ID NO: 290055 - protein, 10 aa, Mycobacterium
TGTGDSASIQ

SEQ ID NO: 290056 - protein, 6 aa, Mycobacterium
TGTGFG

SEQ ID NO: 290057 - protein, 5 aa, Mycobacterium
TGTGG

SEQ ID NO: 290058 - protein, 15 aa, Mycobacterium
TGTGPETNTPTVATS

SEQ ID NO: 290059 - protein, 18 aa, Mycobacterium
TGTGTEPKAGGTESSAIP

SEQ ID NO: 290060 - protein, 20 aa, Mycobacterium
TGTGTTATVRYSGADRETVR

SEQ ID NO: 290061 - protein, 5 aa, Mycobacterium
TGTGW

SEQ ID NO: 290062 - protein, 5 aa, Mycobacterium
TGTIR

SEQ ID NO: 290063 - protein, 11 aa, Mycobacterium
TGTITAGKPAL

SEQ ID NO: 290064 - protein, 7 aa, Mycobacterium
TGTITTG

SEQ ID NO: 290065 - protein, 6 aa, Mycobacterium
TGTKLA

SEQ ID NO: 290066 - protein, 8 aa, Mycobacterium
TGTLSENR

SEQ ID NO: 290067 - protein, 9 aa, Mycobacterium
TGTLTAGEP

SEQ ID NO: 290068 - protein, 6 aa, Mycobacterium
TGTLTC

SEQ ID NO: 290069 - protein, 12 aa, Mycobacterium
TGTLTKGEPEVT

SEQ ID NO: 290070 - protein, 13 aa, Mycobacterium
TGTLTKGTPTLTG

SEQ ID NO: 290071 - protein, 7 aa, Mycobacterium
TGTLTRG

SEQ ID NO: 290072 - protein, 10 aa, Mycobacterium
TGTLTRNSPQ

SEQ ID NO: 290073 - protein, 8 aa, Mycobacterium
TGTLTSGQ

SEQ ID NO: 290074 - protein, 21 aa, Mycobacterium
TGTLTVTRDGKTTTTPIGGAP

SEQ ID NO: 290075 - protein, 4 aa, Mycobacterium
TGTN

SEQ ID NO: 290076 - protein, 4 aa, Mycobacterium
TGTP

SEQ ID NO: 290077 - protein, 9 aa, Mycobacterium
TGTPAAQQV

SEQ ID NO: 290078 - protein, 21 aa, Mycobacterium
TGTPPSPGGPDSTPQPARRKR

SEQ ID NO: 290079 - protein, 11 aa, Mycobacterium
TGTRVGRDERI

SEQ ID NO: 290080 - protein, 25 aa, Mycobacterium
TGTSAPQAVEDEGPVQGPPTIGVPS

SEQ ID NO: 290081 - protein, 28 aa, Mycobacterium
TGTSSADTAFKQAPATITATEGTDTVTA

SEQ ID NO: 290082 - protein, 8 aa, Mycobacterium
TGTTDAPR

SEQ ID NO: 290083 - protein, 7 aa, Mycobacterium
TGTTRGR

SEQ ID NO: 290084 - protein, 10 aa, Mycobacterium
TGTTSPRSAV

SEQ ID NO: 290085 - protein, 17 aa, Mycobacterium
TGTTTTAAATPSPPSSY

SEQ ID NO: 290086 - protein, 4 aa, Mycobacterium
TGTV

SEQ ID NO: 290087 - protein, 8 aa, Mycobacterium
TGTVDVGG

SEQ ID NO: 290088 - protein, 6 aa, Mycobacterium
TGTVGA

SEQ ID NO: 290089 - protein, 11 aa, Mycobacterium
TGTVTAGRPAL

SEQ ID NO: 290090 - protein, 6 aa, Mycobacterium
TGTVTT

SEQ ID NO: 290091 - protein, 8 aa, Mycobacterium
TGTVTTGD

SEQ ID NO: 290092 - protein, 4 aa, Mycobacterium
TGTW

SEQ ID NO: 290093 - protein, 12 aa, Mycobacterium
TGVAAGASWGNA

SEQ ID NO: 290094 - protein, 13 aa, Mycobacterium
TGVAKGGSYATTS

SEQ ID NO: 290095 - protein, 4 aa, Mycobacterium
TGVD

SEQ ID NO: 290096 - protein, 6 aa, Mycobacterium
TGVDRH

SEQ ID NO: 290097 - protein, 9 aa, Mycobacterium
TGVEPGWAQ

SEQ ID NO: 290098 - protein, 5 aa, Mycobacterium
TGVGG

SEQ ID NO: 290099 - protein, 6 aa, Mycobacterium
TGVGID

SEQ ID NO: 290100 - protein, 13 aa, Mycobacterium
TGVGKKELANDPL

SEQ ID NO: 290101 - protein, 9 aa, Mycobacterium
TGVGKPGAE

SEQ ID NO: 290102 - protein, 12 aa, Mycobacterium
TGVGSAKGAALL

SEQ ID NO: 290103 - protein, 7 aa, Mycobacterium
TGVGTPA

SEQ ID NO: 290104 - protein, 4 aa, Mycobacterium
TGVH

SEQ ID NO: 290105 - protein, 4 aa, Mycobacterium
TGVP

SEQ ID NO: 290106 - protein, 14 aa, Mycobacterium
TGVPGQGPETRTAN

SEQ ID NO: 290107 - protein, 9 aa, Mycobacterium
TGVPRGRTG

SEQ ID NO: 290108 - protein, 7 aa, Mycobacterium
TGVRDGD

SEQ ID NO: 290109 - protein, 6 aa, Mycobacterium
TGVRRG

SEQ ID NO: 290110 - protein, 5 aa, Mycobacterium
TGVSR

SEQ ID NO: 290111 - protein, 14 aa, Mycobacterium
TGVTDQNGDEPPRM

SEQ ID NO: 290112 - protein, 16 aa, Mycobacterium
TGVTDQNGDEPPRTAD

SEQ ID NO: 290113 - protein, 7 aa, Mycobacterium
TGVTREP

SEQ ID NO: 290114 - protein, 11 aa, Mycobacterium
TGVTWPDGSSL

SEQ ID NO: 290115 - protein, 47 aa, Mycobacterium
TGWPSQPGLSPVGQGPVGQGAGSGGSPSFGPPSQSQPTRQPRNKRKT

SEQ ID NO: 290116 - protein, 6 aa, Mycobacterium
TGWTTS

SEQ ID NO: 290117 - protein, 4 aa, Mycobacterium
TGYA

SEQ ID NO: 290118 - protein, 9 aa, Mycobacterium
TGYGQGAPA

SEQ ID NO: 290119 - protein, 4 aa, Mycobacterium
TGYP

SEQ ID NO: 290120 - protein, 15 aa, Mycobacterium
TGYPDTMSEPLDAGA

SEQ ID NO: 290121 - protein, 29 aa, Mycobacterium
TGYTATAPAAPNDAAPTDSGRDAGEADSL

SEQ ID NO: 290122 - protein, 21 aa, Mycobacterium
THAASPPAVTASPGAAATSVL

SEQ ID NO: 290123 - protein, 4 aa, Mycobacterium
THAG

SEQ ID NO: 290124 - protein, 6 aa, Mycobacterium
THAKED

SEQ ID NO: 290125 - protein, 8 aa, Mycobacterium
THAKGGDL

SEQ ID NO: 290126 - protein, 5 aa, Mycobacterium
THAMS

SEQ ID NO: 290127 - protein, 9 aa, Mycobacterium
THAPQGVPF

SEQ ID NO: 290128 - protein, 12 aa, Mycobacterium
THAVGPAMTGHA

SEQ ID NO: 290129 - protein, 4 aa, Mycobacterium
THDA

SEQ ID NO: 290130 - protein, 5 aa, Mycobacterium
THDAG

SEQ ID NO: 290131 - protein, 5 aa, Mycobacterium
THDAS

SEQ ID NO: 290132 - protein, 4 aa, Mycobacterium
THDG

SEQ ID NO: 290133 - protein, 8 aa, Mycobacterium
THDGAPAA

SEQ ID NO: 290134 - protein, 7 aa, Mycobacterium
THDGVRG

SEQ ID NO: 290135 - protein, 4 aa, Mycobacterium
THDP

SEQ ID NO: 290136 - protein, 10 aa, Mycobacterium
THDPATPYKA

SEQ ID NO: 290137 - protein, 21 aa, Mycobacterium
THDRPASLDNPRSPRRRAGMP

SEQ ID NO: 290138 - protein, 6 aa, Mycobacterium
THDRPE

SEQ ID NO: 290139 - protein, 7 aa, Mycobacterium
THDTPQV

SEQ ID NO: 290140 - protein, 8 aa, Mycobacterium
THEATAAG

SEQ ID NO: 290141 - protein, 10 aa, Mycobacterium
THEDKGKLSG

SEQ ID NO: 290142 - protein, 7 aa, Mycobacterium
THEEDRR

SEQ ID NO: 290143 - protein, 8 aa, Mycobacterium
THEEDRRV

SEQ ID NO: 290144 - protein, 8 aa, Mycobacterium
THEKGDRI

SEQ ID NO: 290145 - protein, 6 aa, Mycobacterium
THEPAG

SEQ ID NO: 290146 - protein, 6 aa, Mycobacterium
THEPGQ

SEQ ID NO: 290147 - protein, 4 aa, Mycobacterium
THEQ

SEQ ID NO: 290148 - protein, 6 aa, Mycobacterium
THEQSR

SEQ ID NO: 290149 - protein, 14 aa, Mycobacterium
THESGAHEAHPDKT

SEQ ID NO: 290150 - protein, 8 aa, Mycobacterium
THETPRET

SEQ ID NO: 290151 - protein, 18 aa, Mycobacterium
THGAATGIRPEESGIASA

SEQ ID NO: 290152 - protein, 10 aa, Mycobacterium
THGADQLAGG

SEQ ID NO: 290153 - protein, 7 aa, Mycobacterium
THGATRE

SEQ ID NO: 290154 - protein, 6 aa, Mycobacterium
THGCDP

SEQ ID NO: 290155 - protein, 5 aa, Mycobacterium
THGQA

SEQ ID NO: 290156 - protein, 9 aa, Mycobacterium
THGRAKTAE

SEQ ID NO: 290157 - protein, 9 aa, Mycobacterium
THGRKNTAE

SEQ ID NO: 290158 - protein, 9 aa, Mycobacterium
THGRSKTAE

SEQ ID NO: 290159 - protein, 6 aa, Mycobacterium
THGSGR

SEQ ID NO: 290160 - protein, 42 aa, Mycobacterium
THHNNSASPGPSSARAAAPPAPSSSPPPLTPTLSRPVKGADG

SEQ ID NO: 290161 - protein, 8 aa, Mycobacterium
THIPEDSR

SEQ ID NO: 290162 - protein, 7 aa, Mycobacterium
THKHPAA

SEQ ID NO: 290163 - protein, 5 aa, Mycobacterium
THPAA

SEQ ID NO: 290164 - protein, 4 aa, Mycobacterium
THPE

SEQ ID NO: 290165 - protein, 11 aa, Mycobacterium
THPGGGDEQTT

SEQ ID NO: 290166 - protein, 7 aa, Mycobacterium
THPRYGS

SEQ ID NO: 290167 - protein, 7 aa, Mycobacterium
THPSTGT

SEQ ID NO: 290168 - protein, 7 aa, Mycobacterium
THPTNGT

SEQ ID NO: 290169 - protein, 6 aa, Mycobacterium
THPTRG

SEQ ID NO: 290170 - protein, 7 aa, Mycobacterium
THPTSGT

SEQ ID NO: 290171 - protein, 7 aa, Mycobacterium
THPTTGQ

SEQ ID NO: 290172 - protein, 5 aa, Mycobacterium
THQDE

SEQ ID NO: 290173 - protein, 4 aa, Mycobacterium
THQG

SEQ ID NO: 290174 - protein, 7 aa, Mycobacterium
THRATPI

SEQ ID NO: 290175 - protein, 5 aa, Mycobacterium
THRPR

SEQ ID NO: 290176 - protein, 4 aa, Mycobacterium
THRR

SEQ ID NO: 290177 - protein, 12 aa, Mycobacterium
THRTQRAQPRRS

SEQ ID NO: 290178 - protein, 13 aa, Mycobacterium
THRVTDDSVGPTG

SEQ ID NO: 290179 - protein, 9 aa, Mycobacterium
THSADERAT

SEQ ID NO: 290180 - protein, 8 aa, Mycobacterium
THSGDERA

SEQ ID NO: 290181 - protein, 6 aa, Mycobacterium
THSGEH

SEQ ID NO: 290182 - protein, 5 aa, Mycobacterium
THSHA

SEQ ID NO: 290183 - protein, 18 aa, Mycobacterium
THTEIPDPESSGAPERVG

SEQ ID NO: 290184 - protein, 4 aa, Mycobacterium
THTL

SEQ ID NO: 290185 - protein, 5 aa, Mycobacterium
THTPD

SEQ ID NO: 290186 - protein, 8 aa, Mycobacterium
THTPVPGA

SEQ ID NO: 290187 - protein, 4 aa, Mycobacterium
THTR

SEQ ID NO: 290188 - protein, 5 aa, Mycobacterium
THTSA

SEQ ID NO: 290189 - protein, 11 aa, Mycobacterium
TIAGPASPAAN

SEQ ID NO: 290190 - protein, 9 aa, Mycobacterium
TIAPQAGLS

SEQ ID NO: 290191 - protein, 5 aa, Mycobacterium
TIAQS

SEQ ID NO: 290192 - protein, 19 aa, Mycobacterium
TIDGRTGMRGPARTAFADP

SEQ ID NO: 290193 - protein, 9 aa, Mycobacterium
TIDGSTGEF

SEQ ID NO: 290194 - protein, 20 aa, Mycobacterium
TIDGSTGRRGPARSSYADPK

SEQ ID NO: 290195 - protein, 10 aa, Mycobacterium
TIDKDTPPRG

SEQ ID NO: 290196 - protein, 10 aa, Mycobacterium
TIDNGGPALD

SEQ ID NO: 290197 - protein, 13 aa, Mycobacterium
TIDPQAQQAAEKA

SEQ ID NO: 290198 - protein, 6 aa, Mycobacterium
TIDQPA

SEQ ID NO: 290199 - protein, 4 aa, Mycobacterium
TIDS

SEQ ID NO: 290200 - protein, 14 aa, Mycobacterium
TIDSRSDNDPVRTS

SEQ ID NO: 290201 - protein, 8 aa, Mycobacterium
TIEDRDDV

SEQ ID NO: 290202 - protein, 5 aa, Mycobacterium
TIEES

SEQ ID NO: 290203 - protein, 7 aa, Mycobacterium
TIEKTKE

SEQ ID NO: 290204 - protein, 5 aa, Mycobacterium
TIESG

SEQ ID NO: 290205 - protein, 6 aa, Mycobacterium
TIESST

SEQ ID NO: 290206 - protein, 10 aa, Mycobacterium
TIGAGATAQL

SEQ ID NO: 290207 - protein, 4 aa, Mycobacterium
TIGD

SEQ ID NO: 290208 - protein, 7 aa, Mycobacterium
TIGGGAR

SEQ ID NO: 290209 - protein, 9 aa, Mycobacterium
TIGGQGSVL

SEQ ID NO: 290210 - protein, 8 aa, Mycobacterium
TIGKRDEQ

SEQ ID NO: 290211 - protein, 8 aa, Mycobacterium
TIGSPGDR

SEQ ID NO: 290212 - protein, 5 aa, Mycobacterium
TIGTE

SEQ ID NO: 290213 - protein, 16 aa, Mycobacterium
TIGTSGAHGGGAELET

SEQ ID NO: 290214 - protein, 10 aa, Mycobacterium
TIKASNLGDR

SEQ ID NO: 290215 - protein, 5 aa, Mycobacterium
TIKDD

SEQ ID NO: 290216 - protein, 7 aa, Mycobacterium
TINPAQQ

SEQ ID NO: 290217 - protein, 19 aa, Mycobacterium
TIPDEASCSGSCAGCTLSC

SEQ ID NO: 290218 - protein, 13 aa, Mycobacterium
TIPDEPGSGTTAG

SEQ ID NO: 290219 - protein, 5 aa, Mycobacterium
TIPGI

SEQ ID NO: 290220 - protein, 7 aa, Mycobacterium
TIPPEDI

SEQ ID NO: 290221 - protein, 6 aa, Mycobacterium
TIPPGA

SEQ ID NO: 290222 - protein, 13 aa, Mycobacterium
TIPRTSSGKIGRR

SEQ ID NO: 290223 - protein, 10 aa, Mycobacterium
TIQQKTTYKT

SEQ ID NO: 290224 - protein, 10 aa, Mycobacterium
TISAAANRTL

SEQ ID NO: 290225 - protein, 21 aa, Mycobacterium
TISAGDTPGGGLTVEIELAVP

SEQ ID NO: 290226 - protein, 9 aa, Mycobacterium
TISASYSRS

SEQ ID NO: 290227 - protein, 14 aa, Mycobacterium
TISDRGAGAPSGSI

SEQ ID NO: 290228 - protein, 6 aa, Mycobacterium
TISGLG

SEQ ID NO: 290229 - protein, 9 aa, Mycobacterium
TISKTVAGK

SEQ ID NO: 290230 - protein, 36 aa, Mycobacterium
TISNPSGTVPPPSGSKTQTPTAGPATSPAPPPGGNL

SEQ ID NO: 290231 - protein, 8 aa, Mycobacterium
TISPAQQE

SEQ ID NO: 290232 - protein, 6 aa, Mycobacterium
TISTSP

SEQ ID NO: 290233 - protein, 17 aa, Mycobacterium
TISVGGTDQAIYRLSER

SEQ ID NO: 290234 - protein, 13 aa, Mycobacterium
TITEPNGSTTETV

SEQ ID NO: 290235 - protein, 5 aa, Mycobacterium
TITGL

SEQ ID NO: 290236 - protein, 4 aa, Mycobacterium
TITS

SEQ ID NO: 290237 - protein, 6 aa, Mycobacterium
TITTSP

SEQ ID NO: 290238 - protein, 6 aa, Mycobacterium
TKAAGE

SEQ ID NO: 290239 - protein, 7 aa, Mycobacterium
TKAAITA

SEQ ID NO: 290240 - protein, 7 aa, Mycobacterium
TKADAAL

SEQ ID NO: 290241 - protein, 4 aa, Mycobacterium
TKAE

SEQ ID NO: 290242 - protein, 11 aa, Mycobacterium
TKAEGQKGAAG

SEQ ID NO: 290243 - protein, 4 aa, Mycobacterium
TKAF

SEQ ID NO: 290244 - protein, 17 aa, Mycobacterium
TKAFSSREALQPPGNPL

SEQ ID NO: 290245 - protein, 8 aa, Mycobacterium
TKAGDRRR

SEQ ID NO: 290246 - protein, 4 aa, Mycobacterium
TKAK

SEQ ID NO: 290247 - protein, 17 aa, Mycobacterium
TKAPPSPSQLRPGAFPP

SEQ ID NO: 290248 - protein, 9 aa, Mycobacterium
TKAPTWQQG

SEQ ID NO: 290249 - protein, 7 aa, Mycobacterium
TKAREDV

SEQ ID NO: 290250 - protein, 7 aa, Mycobacterium
TKASITA

SEQ ID NO: 290251 - protein, 6 aa, Mycobacterium
TKATGD

SEQ ID NO: 290252 - protein, 14 aa, Mycobacterium
TKATNPRRGDPKQK

SEQ ID NO: 290253 - protein, 4 aa, Mycobacterium
TKDF

SEQ ID NO: 290254 - protein, 28 aa, Mycobacterium
TKDGHRNRNRPVPIGPDMGDQQSRPGLK

SEQ ID NO: 290255 - protein, 7 aa, Mycobacterium
TKDLQQD

SEQ ID NO: 290256 - protein, 7 aa, Mycobacterium
TKDSPRT

SEQ ID NO: 290257 - protein, 5 aa, Mycobacterium
TKDTT

SEQ ID NO: 290258 - protein, 13 aa, Mycobacterium
TKEASQCKGKPGV

SEQ ID NO: 290259 - protein, 9 aa, Mycobacterium
TKEGTTEPK

SEQ ID NO: 290260 - protein, 9 aa, Mycobacterium
TKEHESRSR

SEQ ID NO: 290261 - protein, 7 aa, Mycobacterium
TKEMRDS

SEQ ID NO: 290262 - protein, 8 aa, Mycobacterium
TKEQAEPE

SEQ ID NO: 290263 - protein, 7 aa, Mycobacterium
TKESPRT

SEQ ID NO: 290264 - protein, 8 aa, Mycobacterium
TKFSTDMN

SEQ ID NO: 290265 - protein, 11 aa, Mycobacterium
TKGGPAGVANS

SEQ ID NO: 290266 - protein, 7 aa, Mycobacterium
TKGQTVK

SEQ ID NO: 290267 - protein, 13 aa, Mycobacterium
TKGRELEEMDDIA

SEQ ID NO: 290268 - protein, 8 aa, Mycobacterium
TKGRTAAA

SEQ ID NO: 290269 - protein, 8 aa, Mycobacterium
TKGSARTA

SEQ ID NO: 290270 - protein, 10 aa, Mycobacterium
TKGTDAARGY

SEQ ID NO: 290271 - protein, 4 aa, Mycobacterium
TKGV

SEQ ID NO: 290272 - protein, 8 aa, Mycobacterium
TKHPEEFG

SEQ ID NO: 290273 - protein, 7 aa, Mycobacterium
TKHTGDT

SEQ ID NO: 290274 - protein, 10 aa, Mycobacterium
TKKMGTGLDE

SEQ ID NO: 290275 - protein, 28 aa, Mycobacterium
TKLADGAKQVPNWTTQQKDAVADTIGGP

SEQ ID NO: 290276 - protein, 6 aa, Mycobacterium
TKLEEG

SEQ ID NO: 290277 - protein, 6 aa, Mycobacterium
TKLGSD

SEQ ID NO: 290278 - protein, 5 aa, Mycobacterium
TKNPR

SEQ ID NO: 290279 - protein, 10 aa, Mycobacterium
TKNPTGYAQG

SEQ ID NO: 290280 - protein, 6 aa, Mycobacterium
TKNTDL

SEQ ID NO: 290281 - protein, 5 aa, Mycobacterium
TKPAL

SEQ ID NO: 290282 - protein, 19 aa, Mycobacterium
TKPFDTRRGELAPQVPAAT

SEQ ID NO: 290283 - protein, 15 aa, Mycobacterium
TKPFTQPVTAGPGGA

SEQ ID NO: 290284 - protein, 8 aa, Mycobacterium
TKPGCAAQ

SEQ ID NO: 290285 - protein, 7 aa, Mycobacterium
TKPGEVS

SEQ ID NO: 290286 - protein, 20 aa, Mycobacterium
TKPPAPEPAPTEPTVAPAAQ

SEQ ID NO: 290287 - protein, 12 aa, Mycobacterium
TKPSGKRPARSL

SEQ ID NO: 290288 - protein, 7 aa, Mycobacterium
TKPSLTI

SEQ ID NO: 290289 - protein, 10 aa, Mycobacterium
TKPSSDESVE

SEQ ID NO: 290290 - protein, 8 aa, Mycobacterium
TKPTSDRL

SEQ ID NO: 290291 - protein, 7 aa, Mycobacterium
TKPTTGQ

SEQ ID NO: 290292 - protein, 6 aa, Mycobacterium
TKQAYH

SEQ ID NO: 290293 - protein, 9 aa, Mycobacterium
TKQDGTRDK

SEQ ID NO: 290294 - protein, 8 aa, Mycobacterium
TKQEGTDV

SEQ ID NO: 290295 - protein, 6 aa, Mycobacterium
TKQRLP

SEQ ID NO: 290296 - protein, 10 aa, Mycobacterium
TKRAEARALK

SEQ ID NO: 290297 - protein, 4 aa, Mycobacterium
TKRG

SEQ ID NO: 290298 - protein, 15 aa, Mycobacterium
TKRPVTAPEAPALAT

SEQ ID NO: 290299 - protein, 12 aa, Mycobacterium
TKRRREARERCR

SEQ ID NO: 290300 - protein, 11 aa, Mycobacterium
TKRRTGVADSH

SEQ ID NO: 290301 - protein, 10 aa, Mycobacterium
TKRSGYIDTD

SEQ ID NO: 290302 - protein, 5 aa, Mycobacterium
TKRTE

SEQ ID NO: 290303 - protein, 7 aa, Mycobacterium
TKRVERQ

SEQ ID NO: 290304 - protein, 9 aa, Mycobacterium
TKSAVPKRI

SEQ ID NO: 290305 - protein, 5 aa, Mycobacterium
TKSDG

SEQ ID NO: 290306 - protein, 11 aa, Mycobacterium
TKSDNGPSKIT

SEQ ID NO: 290307 - protein, 14 aa, Mycobacterium
TKSLEGDGHGGGPI

SEQ ID NO: 290308 - protein, 7 aa, Mycobacterium
TKSPSLA

SEQ ID NO: 290309 - protein, 8 aa, Mycobacterium
TKSPVGLA

SEQ ID NO: 290310 - protein, 8 aa, Mycobacterium
TKSSAQLR

SEQ ID NO: 290311 - protein, 7 aa, Mycobacterium
TKSSPLV

SEQ ID NO: 290312 - protein, 45 aa, Mycobacterium
TKTAEDNRNAAEQFTAAEADYKDELAKARGAATAVRDEARAEGRG

SEQ ID NO: 290313 - protein, 9 aa, Mycobacterium
TKTAPPGAN

SEQ ID NO: 290314 - protein, 6 aa, Mycobacterium
TKTETA

SEQ ID NO: 290315 - protein, 7 aa, Mycobacterium
TKTGKTT

SEQ ID NO: 290316 - protein, 7 aa, Mycobacterium
TKTGLGA

SEQ ID NO: 290317 - protein, 4 aa, Mycobacterium
TKTL

SEQ ID NO: 290318 - protein, 7 aa, Mycobacterium
TKTLESA

SEQ ID NO: 290319 - protein, 9 aa, Mycobacterium
TKTNANANA

SEQ ID NO: 290320 - protein, 7 aa, Mycobacterium
TKTPAQA

SEQ ID NO: 290321 - protein, 6 aa, Mycobacterium
TKTPVE

SEQ ID NO: 290322 - protein, 6 aa, Mycobacterium
TKTRAE

SEQ ID NO: 290323 - protein, 4 aa, Mycobacterium
TKTT

SEQ ID NO: 290324 - protein, 14 aa, Mycobacterium
TKTTNNTHAPREDA

SEQ ID NO: 290325 - protein, 20 aa, Mycobacterium
TKVEKRDPNATLPPSPSPRS

SEQ ID NO: 290326 - protein, 7 aa, Mycobacterium
TKVPPLA

SEQ ID NO: 290327 - protein, 6 aa, Mycobacterium
TKVSLP

SEQ ID NO: 290328 - protein, 9 aa, Mycobacterium
TKYAAKGKT

SEQ ID NO: 290329 - protein, 20 aa, Mycobacterium
TKYRTTPLPGEDEVPPPGSM

SEQ ID NO: 290330 - protein, 9 aa, Mycobacterium
TKYSEKLPS

SEQ ID NO: 290331 - protein, 7 aa, Mycobacterium
TLAETNN

SEQ ID NO: 290332 - protein, 8 aa, Mycobacterium
TLAGGDLP

SEQ ID NO: 290333 - protein, 10 aa, Mycobacterium
TLAGPARRGE

SEQ ID NO: 290334 - protein, 6 aa, Mycobacterium
TLAPGQ

SEQ ID NO: 290335 - protein, 9 aa, Mycobacterium
TLAPSTPTM

SEQ ID NO: 290336 - protein, 7 aa, Mycobacterium
TLAPTAR

SEQ ID NO: 290337 - protein, 5 aa, Mycobacterium
TLAQG

SEQ ID NO: 290338 - protein, 5 aa, Mycobacterium
TLAQK

SEQ ID NO: 290339 - protein, 7 aa, Mycobacterium
TLAQSQR

SEQ ID NO: 290340 - protein, 10 aa, Mycobacterium
TLASKNTGID

SEQ ID NO: 290341 - protein, 11 aa, Mycobacterium
TLASQKSWTHN

SEQ ID NO: 290342 - protein, 15 aa, Mycobacterium
TLASTASDPLLTPPR

SEQ ID NO: 290343 - protein, 19 aa, Mycobacterium
TLATGADAIAKKTNNGELP

SEQ ID NO: 290344 - protein, 19 aa, Mycobacterium
TLATGAEAVAAKTGDGELP

SEQ ID NO: 290345 - protein, 9 aa, Mycobacterium
TLDDAGSKL

SEQ ID NO: 290346 - protein, 8 aa, Mycobacterium
TLDERDGQ

SEQ ID NO: 290347 - protein, 18 aa, Mycobacterium
TLDGSTGRRGPARSGYAD

SEQ ID NO: 290348 - protein, 15 aa, Mycobacterium
TLDNPRIVEDMRRGY

SEQ ID NO: 290349 - protein, 11 aa, Mycobacterium
TLDQSTAPSWR

SEQ ID NO: 290350 - protein, 10 aa, Mycobacterium
TLDSSEVAHG

SEQ ID NO: 290351 - protein, 7 aa, Mycobacterium
TLDTGRA

SEQ ID NO: 290352 - protein, 9 aa, Mycobacterium
TLDTLSPDE

SEQ ID NO: 290353 - protein, 18 aa, Mycobacterium
TLDTQRAAFGKSKPGNGF

SEQ ID NO: 290354 - protein, 9 aa, Mycobacterium
TLDTSTLPR

SEQ ID NO: 290355 - protein, 5 aa, Mycobacterium
TLEAR

SEQ ID NO: 290356 - protein, 13 aa, Mycobacterium
TLEDQSAAGGGAV

SEQ ID NO: 290357 - protein, 6 aa, Mycobacterium
TLEGGN

SEQ ID NO: 290358 - protein, 16 aa, Mycobacterium
TLEGPARLRGGAATRR

SEQ ID NO: 290359 - protein, 9 aa, Mycobacterium
TLEGPTIAA

SEQ ID NO: 290360 - protein, 24 aa, Mycobacterium
TLEQNAAARGVTVDPSGLPPQALT

SEQ ID NO: 290361 - protein, 12 aa, Mycobacterium
TLEREDKPSWRD

SEQ ID NO: 290362 - protein, 4 aa, Mycobacterium
TLET

SEQ ID NO: 290363 - protein, 9 aa, Mycobacterium
TLETQRRPL

SEQ ID NO: 290364 - protein, 10 aa, Mycobacterium
TLETQRRPLG

SEQ ID NO: 290365 - protein, 8 aa, Mycobacterium
TLETRRRP

SEQ ID NO: 290366 - protein, 4 aa, Mycobacterium
TLEV

SEQ ID NO: 290367 - protein, 11 aa, Mycobacterium
TLGDGGQPTVD

SEQ ID NO: 290368 - protein, 10 aa, Mycobacterium
TLGDGHEPTV

SEQ ID NO: 290369 - protein, 11 aa, Mycobacterium
TLGDGREPTVA

SEQ ID NO: 290370 - protein, 5 aa, Mycobacterium
TLGEE

SEQ ID NO: 290371 - protein, 13 aa, Mycobacterium
TLGENARELMERS

SEQ ID NO: 290372 - protein, 11 aa, Mycobacterium
TLGGEAKTPKA

SEQ ID NO: 290373 - protein, 13 aa, Mycobacterium
TLGGNESGSGPQL

SEQ ID NO: 290374 - protein, 8 aa, Mycobacterium
TLGGPARS

SEQ ID NO: 290375 - protein, 5 aa, Mycobacterium
TLGGS

SEQ ID NO: 290376 - protein, 30 aa, Mycobacterium
TLGGSTSSHRTARDSTTSAGPPPPTVPPDT

SEQ ID NO: 290377 - protein, 7 aa, Mycobacterium
TLGNGGW

SEQ ID NO: 290378 - protein, 12 aa, Mycobacterium
TLGPGDPDNRRR

SEQ ID NO: 290379 - protein, 5 aa, Mycobacterium
TLGPQ

SEQ ID NO: 290380 - protein, 5 aa, Mycobacterium
TLGPS

SEQ ID NO: 290381 - protein, 10 aa, Mycobacterium
TLGPSTSATM

SEQ ID NO: 290382 - protein, 5 aa, Mycobacterium
TLGPT

SEQ ID NO: 290383 - protein, 11 aa, Mycobacterium
TLGRGTGGSAE

SEQ ID NO: 290384 - protein, 9 aa, Mycobacterium
TLGRTTGSV

SEQ ID NO: 290385 - protein, 14 aa, Mycobacterium
TLGSDEVQAIPGDP

SEQ ID NO: 290386 - protein, 7 aa, Mycobacterium
TLGSSTE

SEQ ID NO: 290387 - protein, 4 aa, Mycobacterium
TLGT

SEQ ID NO: 290388 - protein, 11 aa, Mycobacterium
TLGTDDDGPGL

SEQ ID NO: 290389 - protein, 7 aa, Mycobacterium
TLGTSSE

SEQ ID NO: 290390 - protein, 6 aa, Mycobacterium
TLGTTN

SEQ ID NO: 290391 - protein, 6 aa, Mycobacterium
TLGTTS

SEQ ID NO: 290392 - protein, 5 aa, Mycobacterium
TLGVG

SEQ ID NO: 290393 - protein, 13 aa, Mycobacterium
TLKPGKDTVEGLP

SEQ ID NO: 290394 - protein, 6 aa, Mycobacterium
TLLGPD

SEQ ID NO: 290395 - protein, 44 aa, Mycobacterium
TLNEGNKAQAPASGISAAAAAAASARSRARRKRGARVKDPAPQY

SEQ ID NO: 290396 - protein, 14 aa, Mycobacterium
TLNGGGRAAPLADD

SEQ ID NO: 290397 - protein, 4 aa, Mycobacterium
TLNP

SEQ ID NO: 290398 - protein, 16 aa, Mycobacterium
TLNPAPATPPGSGGLR

SEQ ID NO: 290399 - protein, 4 aa, Mycobacterium
TLNR

SEQ ID NO: 290400 - protein, 9 aa, Mycobacterium
TLNRQQRDL

SEQ ID NO: 290401 - protein, 8 aa, Mycobacterium
TLNRRQAD

SEQ ID NO: 290402 - protein, 9 aa, Mycobacterium
TLNSRNKNL

SEQ ID NO: 290403 - protein, 15 aa, Mycobacterium
TLPAPHESTAPGPLP

SEQ ID NO: 290404 - protein, 21 aa, Mycobacterium
TLPAPTSTPPPDPTEQPLSDA

SEQ ID NO: 290405 - protein, 5 aa, Mycobacterium
TLPDG

SEQ ID NO: 290406 - protein, 16 aa, Mycobacterium
TLPDRRRRGRGQLAGR

SEQ ID NO: 290407 - protein, 9 aa, Mycobacterium
TLPETAKGY

SEQ ID NO: 290408 - protein, 4 aa, Mycobacterium
TLPG

SEQ ID NO: 290409 - protein, 5 aa, Mycobacterium
TLPGA

SEQ ID NO: 290410 - protein, 5 aa, Mycobacterium
TLPGD

SEQ ID NO: 290411 - protein, 5 aa, Mycobacterium
TLPGI

SEQ ID NO: 290412 - protein, 23 aa, Mycobacterium
TLPGPDADSMTESPDRKPGAGAA

SEQ ID NO: 290413 - protein, 10 aa, Mycobacterium
TLPGSVKGYS

SEQ ID NO: 290414 - protein, 5 aa, Mycobacterium
TLPGT

SEQ ID NO: 290415 - protein, 6 aa, Mycobacterium
TLPGTD

SEQ ID NO: 290416 - protein, 24 aa, Mycobacterium
TLPIPPADAGLSTATPAPAPPNPI

SEQ ID NO: 290417 - protein, 4 aa, Mycobacterium
TLPN

SEQ ID NO: 290418 - protein, 6 aa, Mycobacterium
TLPNPG

SEQ ID NO: 290419 - protein, 7 aa, Mycobacterium
TLPNRRS

SEQ ID NO: 290420 - protein, 17 aa, Mycobacterium
TLPPDNEQSQAGANKLP

SEQ ID NO: 290421 - protein, 7 aa, Mycobacterium
TLPPGTP

SEQ ID NO: 290422 - protein, 11 aa, Mycobacterium
TLPPLPTPRHA

SEQ ID NO: 290423 - protein, 8 aa, Mycobacterium
TLPPMPTA

SEQ ID NO: 290424 - protein, 31 aa, Mycobacterium
TLPPPPPPVGTGPEPQASGQAYTTYDQSTGV

SEQ ID NO: 290425 - protein, 29 aa, Mycobacterium
TLPPPPPPVGVGPEPGPQPQASGPAYTTY

SEQ ID NO: 290426 - protein, 5 aa, Mycobacterium
TLPPR

SEQ ID NO: 290427 - protein, 5 aa, Mycobacterium
TLPPS

SEQ ID NO: 290428 - protein, 8 aa, Mycobacterium
TLPPTPSL

SEQ ID NO: 290429 - protein, 6 aa, Mycobacterium
TLPPTS

SEQ ID NO: 290430 - protein, 4 aa, Mycobacterium
TLPQ

SEQ ID NO: 290431 - protein, 6 aa, Mycobacterium
TLPQNS

SEQ ID NO: 290432 - protein, 6 aa, Mycobacterium
TLPREE

SEQ ID NO: 290433 - protein, 6 aa, Mycobacterium
TLPRRS

SEQ ID NO: 290434 - protein, 5 aa, Mycobacterium
TLPRS

SEQ ID NO: 290435 - protein, 9 aa, Mycobacterium
TLPSGHTTA

SEQ ID NO: 290436 - protein, 8 aa, Mycobacterium
TLPSPGVN

SEQ ID NO: 290437 - protein, 7 aa, Mycobacterium
TLPSSRD

SEQ ID NO: 290438 - protein, 8 aa, Mycobacterium
TLPSSRDR

SEQ ID NO: 290439 - protein, 5 aa, Mycobacterium
TLPSV

SEQ ID NO: 290440 - protein, 4 aa, Mycobacterium
TLPT

SEQ ID NO: 290441 - protein, 6 aa, Mycobacterium
TLPTEQ

SEQ ID NO: 290442 - protein, 38 aa, Mycobacterium
TLPTQAGPAQGPNGRGNGPGNGAKPAEPAQPKAPEQPA

SEQ ID NO: 290443 - protein, 5 aa, Mycobacterium
TLPTR

SEQ ID NO: 290444 - protein, 10 aa, Mycobacterium
TLQAGPSAKV

SEQ ID NO: 290445 - protein, 8 aa, Mycobacterium
TLQPGQPL

SEQ ID NO: 290446 - protein, 9 aa, Mycobacterium
TLQQQGAGS

SEQ ID NO: 290447 - protein, 7 aa, Mycobacterium
TLQSGED

SEQ ID NO: 290448 - protein, 6 aa, Mycobacterium
TLRDDD

SEQ ID NO: 290449 - protein, 6 aa, Mycobacterium
TLRDPL

SEQ ID NO: 290450 - protein, 7 aa, Mycobacterium
TLRDSQK

SEQ ID NO: 290451 - protein, 19 aa, Mycobacterium
TLRPGQTAAGEPPVPALPA

SEQ ID NO: 290452 - protein, 11 aa, Mycobacterium
TLRRPDGDNET

SEQ ID NO: 290453 - protein, 10 aa, Mycobacterium
TLRRPSQDNA

SEQ ID NO: 290454 - protein, 5 aa, Mycobacterium
TLSAT

SEQ ID NO: 290455 - protein, 10 aa, Mycobacterium
TLSDAPPNTC

SEQ ID NO: 290456 - protein, 23 aa, Mycobacterium
TLSDPGPGLAGAPLPPSQSDPEF

SEQ ID NO: 290457 - protein, 9 aa, Mycobacterium
TLSDQSDNI

SEQ ID NO: 290458 - protein, 17 aa, Mycobacterium
TLSDRANPQRLAEDAKA

SEQ ID NO: 290459 - protein, 14 aa, Mycobacterium
TLSEEAKDPKRTVP

SEQ ID NO: 290460 - protein, 10 aa, Mycobacterium
TLSESEKERL

SEQ ID NO: 290461 - protein, 7 aa, Mycobacterium
TLSETAR

SEQ ID NO: 290462 - protein, 4 aa, Mycobacterium
TLSG

SEQ ID NO: 290463 - protein, 5 aa, Mycobacterium
TLSGP

SEQ ID NO: 290464 - protein, 13 aa, Mycobacterium
TLSGPRGDGLGRA

SEQ ID NO: 290465 - protein, 7 aa, Mycobacterium
TLSGSPF

SEQ ID NO: 290466 - protein, 4 aa, Mycobacterium
TLSN

SEQ ID NO: 290467 - protein, 10 aa, Mycobacterium
TLSNAQTEKL

SEQ ID NO: 290468 - protein, 8 aa, Mycobacterium
TLSPAKAA

SEQ ID NO: 290469 - protein, 7 aa, Mycobacterium
TLSPPAG

SEQ ID NO: 290470 - protein, 6 aa, Mycobacterium
TLSPPY

SEQ ID NO: 290471 - protein, 5 aa, Mycobacterium
TLSPR

SEQ ID NO: 290472 - protein, 10 aa, Mycobacterium
TLSRPDGAND

SEQ ID NO: 290473 - protein, 11 aa, Mycobacterium
TLSRPRQTRIT

SEQ ID NO: 290474 - protein, 4 aa, Mycobacterium
TLST

SEQ ID NO: 290475 - protein, 14 aa, Mycobacterium
TLSTDNNPQGPAGR

SEQ ID NO: 290476 - protein, 14 aa, Mycobacterium
TLSTNGNAQEPAGR

SEQ ID NO: 290477 - protein, 14 aa, Mycobacterium
TLSTNGNGEGPAGR

SEQ ID NO: 290478 - protein, 14 aa, Mycobacterium
TLSTSGNAEEPAGR

SEQ ID NO: 290479 - protein, 10 aa, Mycobacterium
TLSTSTDPGE

SEQ ID NO: 290480 - protein, 11 aa, Mycobacterium
TLTDTNRHESP

SEQ ID NO: 290481 - protein, 7 aa, Mycobacterium
TLTGQPE

SEQ ID NO: 290482 - protein, 9 aa, Mycobacterium
TLTGTRHAA

SEQ ID NO: 290483 - protein, 16 aa, Mycobacterium
TLTKRSEAASRSGGLE

SEQ ID NO: 290484 - protein, 4 aa, Mycobacterium
TLTM

SEQ ID NO: 290485 - protein, 10 aa, Mycobacterium
TLTNEETEEL

SEQ ID NO: 290486 - protein, 11 aa, Mycobacterium
TLTNQAPEAIP

SEQ ID NO: 290487 - protein, 6 aa, Mycobacterium
TLTPDE

SEQ ID NO: 290488 - protein, 10 aa, Mycobacterium
TLTPNPPDQT

SEQ ID NO: 290489 - protein, 5 aa, Mycobacterium
TLTPP

SEQ ID NO: 290490 - protein, 9 aa, Mycobacterium
TLTPPNGEA

SEQ ID NO: 290491 - protein, 7 aa, Mycobacterium
TLTPQPQ

SEQ ID NO: 290492 - protein, 8 aa, Mycobacterium
TLTPQPQV

SEQ ID NO: 290493 - protein, 12 aa, Mycobacterium
TLTQPADNSQDW

SEQ ID NO: 290494 - protein, 15 aa, Mycobacterium
TLTSKTDPASGAGLA

SEQ ID NO: 290495 - protein, 17 aa, Mycobacterium
TLTSKTDPASGAGQAGA

SEQ ID NO: 290496 - protein, 15 aa, Mycobacterium
TLTSKTDQASGAGMA

SEQ ID NO: 290497 - protein, 17 aa, Mycobacterium
TLTSTGAVDSAHDSLTS

SEQ ID NO: 290498 - protein, 15 aa, Mycobacterium
TLTTDDSTQPDESRF

SEQ ID NO: 290499 - protein, 7 aa, Mycobacterium
TLTTQSR

SEQ ID NO: 290500 - protein, 9 aa, Mycobacterium
TLTTQSRQA

SEQ ID NO: 290501 - protein, 18 aa, Mycobacterium
TMAGTQAQQQELAKGATE

SEQ ID NO: 290502 - protein, 8 aa, Mycobacterium
TMAPGTSM

SEQ ID NO: 290503 - protein, 5 aa, Mycobacterium
TMARA

SEQ ID NO: 290504 - protein, 4 aa, Mycobacterium
TMDT

SEQ ID NO: 290505 - protein, 9 aa, Mycobacterium
TMGDGNEAG

SEQ ID NO: 290506 - protein, 15 aa, Mycobacterium
TMGGDSSGETQGGSI

SEQ ID NO: 290507 - protein, 5 aa, Mycobacterium
TMGGL

SEQ ID NO: 290508 - protein, 6 aa, Mycobacterium
TMGPSV

SEQ ID NO: 290509 - protein, 6 aa, Mycobacterium
TMGTPS

SEQ ID NO: 290510 - protein, 9 aa, Mycobacterium
TMKPGETAR

SEQ ID NO: 290511 - protein, 9 aa, Mycobacterium
TMPDRPRRV

SEQ ID NO: 290512 - protein, 12 aa, Mycobacterium
TMPEANPQDDIR

SEQ ID NO: 290513 - protein, 4 aa, Mycobacterium
TMPP

SEQ ID NO: 290514 - protein, 12 aa, Mycobacterium
TMPPDRPQAASQ

SEQ ID NO: 290515 - protein, 6 aa, Mycobacterium
TMPSPM

SEQ ID NO: 290516 - protein, 7 aa, Mycobacterium
TMPTGGE

SEQ ID NO: 290517 - protein, 13 aa, Mycobacterium
TMRGANGGSLDDP

SEQ ID NO: 290518 - protein, 4 aa, Mycobacterium
TMSG

SEQ ID NO: 290519 - protein, 9 aa, Mycobacterium
TMSGEAGAY

SEQ ID NO: 290520 - protein, 9 aa, Mycobacterium
TMSPQDAPA

SEQ ID NO: 290521 - protein, 13 aa, Mycobacterium
TMSPTGPYDPNRE

SEQ ID NO: 290522 - protein, 4 aa, Mycobacterium
TMST

SEQ ID NO: 290523 - protein, 5 aa, Mycobacterium
TMTDD

SEQ ID NO: 290524 - protein, 5 aa, Mycobacterium
TMTKD

SEQ ID NO: 290525 - protein, 4 aa, Mycobacterium
TMTP

SEQ ID NO: 290526 - protein, 4 aa, Mycobacterium
TMTT

SEQ ID NO: 290527 - protein, 4 aa, Mycobacterium
TNAA

SEQ ID NO: 290528 - protein, 13 aa, Mycobacterium
TNAAAPVNQDPLG

SEQ ID NO: 290529 - protein, 8 aa, Mycobacterium
TNAAASSI

SEQ ID NO: 290530 - protein, 10 aa, Mycobacterium
TNAAGNHHPW

SEQ ID NO: 290531 - protein, 10 aa, Mycobacterium
TNADGNHHPW

SEQ ID NO: 290532 - protein, 14 aa, Mycobacterium
TNADSGVNEPSKSY

SEQ ID NO: 290533 - protein, 8 aa, Mycobacterium
TNAERQFT

SEQ ID NO: 290534 - protein, 13 aa, Mycobacterium
TNAETRAALTASR

SEQ ID NO: 290535 - protein, 7 aa, Mycobacterium
TNAGVTA

SEQ ID NO: 290536 - protein, 9 aa, Mycobacterium
TNATGSGYS

SEQ ID NO: 290537 - protein, 7 aa, Mycobacterium
TNATSEA

SEQ ID NO: 290538 - protein, 8 aa, Mycobacterium
TNATSEAV

SEQ ID NO: 290539 - protein, 13 aa, Mycobacterium
TNAYGADVAPTVS

SEQ ID NO: 290540 - protein, 60 aa, Mycobacterium
TNDADTDTADDKETVDSAAETDSEIAEDAASTDTDAASSADSDSETASSDEDGDAAKGAS

SEQ ID NO: 290541 - protein, 22 aa, Mycobacterium
TNDAGGQARASLENAAAQLPGG

SEQ ID NO: 290542 - protein, 6 aa, Mycobacterium
TNDAYG

SEQ ID NO: 290543 - protein, 4 aa, Mycobacterium
TNDD

SEQ ID NO: 290544 - protein, 8 aa, Mycobacterium
TNDDSAAF

SEQ ID NO: 290545 - protein, 8 aa, Mycobacterium
TNDKDEPL

SEQ ID NO: 290546 - protein, 5 aa, Mycobacterium
TNDPD

SEQ ID NO: 290547 - protein, 11 aa, Mycobacterium
TNDPRPPEQPP

SEQ ID NO: 290548 - protein, 6 aa, Mycobacterium
TNDPSA

SEQ ID NO: 290549 - protein, 7 aa, Mycobacterium
TNDPSPL

SEQ ID NO: 290550 - protein, 4 aa, Mycobacterium
TNDQ

SEQ ID NO: 290551 - protein, 5 aa, Mycobacterium
TNEGR

SEQ ID NO: 290552 - protein, 5 aa, Mycobacterium
TNELR

SEQ ID NO: 290553 - protein, 6 aa, Mycobacterium
TNENRT

SEQ ID NO: 290554 - protein, 12 aa, Mycobacterium
TNETEGGIGPSS

SEQ ID NO: 290555 - protein, 14 aa, Mycobacterium
TNFDQASGADKAAL

SEQ ID NO: 290556 - protein, 4 aa, Mycobacterium
TNFS

SEQ ID NO: 290557 - protein, 5 aa, Mycobacterium
TNFSG

SEQ ID NO: 290558 - protein, 9 aa, Mycobacterium
TNGAGMPAT

SEQ ID NO: 290559 - protein, 7 aa, Mycobacterium
TNGALGA

SEQ ID NO: 290560 - protein, 20 aa, Mycobacterium
TNGANTGATFSEGAAKTAIQ

SEQ ID NO: 290561 - protein, 10 aa, Mycobacterium
TNGGGYPTGK

SEQ ID NO: 290562 - protein, 28 aa, Mycobacterium
TNGGRQLSNGANELAAGTEKLETGSRQL

SEQ ID NO: 290563 - protein, 5 aa, Mycobacterium
TNGLP

SEQ ID NO: 290564 - protein, 9 aa, Mycobacterium
TNGNPNCAN

SEQ ID NO: 290565 - protein, 6 aa, Mycobacterium
TNGPKV

SEQ ID NO: 290566 - protein, 8 aa, Mycobacterium
TNGRSARY

SEQ ID NO: 290567 - protein, 7 aa, Mycobacterium
TNGRTAQ

SEQ ID NO: 290568 - protein, 8 aa, Mycobacterium
TNGSGPEL

SEQ ID NO: 290569 - protein, 5 aa, Mycobacterium
TNGSV

SEQ ID NO: 290570 - protein, 7 aa, Mycobacterium
TNGTASA

SEQ ID NO: 290571 - protein, 20 aa, Mycobacterium
TNGTNSSGTLSEGAAKTAIQ

SEQ ID NO: 290572 - protein, 9 aa, Mycobacterium
TNGTPTTAE

SEQ ID NO: 290573 - protein, 4 aa, Mycobacterium
TNGV

SEQ ID NO: 290574 - protein, 43 aa, Mycobacterium
TNHPAPPTTTGPSGIPGSHPSNPTLTYPPTPPPGASSAPPWPA

SEQ ID NO: 290575 - protein, 9 aa, Mycobacterium
TNHQPVTDQ

SEQ ID NO: 290576 - protein, 14 aa, Mycobacterium
TNIAPDAGAAGASS

SEQ ID NO: 290577 - protein, 6 aa, Mycobacterium
TNISGN

SEQ ID NO: 290578 - protein, 9 aa, Mycobacterium
TNKGSMPGS

SEQ ID NO: 290579 - protein, 8 aa, Mycobacterium
TNKNPYPL

SEQ ID NO: 290580 - protein, 16 aa, Mycobacterium
TNKPGVLTDAQLEGNN

SEQ ID NO: 290581 - protein, 8 aa, Mycobacterium
TNKRKAPT

SEQ ID NO: 290582 - protein, 7 aa, Mycobacterium
TNLGGEN

SEQ ID NO: 290583 - protein, 16 aa, Mycobacterium
TNLGGRERVRTAEPAS

SEQ ID NO: 290584 - protein, 11 aa, Mycobacterium
TNLGGRETAAA

SEQ ID NO: 290585 - protein, 9 aa, Mycobacterium
TNLGPTAGL

SEQ ID NO: 290586 - protein, 5 aa, Mycobacterium
TNLPD

SEQ ID NO: 290587 - protein, 11 aa, Mycobacterium
TNLPGPEGNRV

SEQ ID NO: 290588 - protein, 8 aa, Mycobacterium
TNLPSGGV

SEQ ID NO: 290589 - protein, 8 aa, Mycobacterium
TNNNPYPI

SEQ ID NO: 290590 - protein, 9 aa, Mycobacterium
TNNQPVTDQ

SEQ ID NO: 290591 - protein, 14 aa, Mycobacterium
TNNREGNPVGSSYL

SEQ ID NO: 290592 - protein, 14 aa, Mycobacterium
TNNSSTESVRTHAS

SEQ ID NO: 290593 - protein, 5 aa, Mycobacterium
TNPAA

SEQ ID NO: 290594 - protein, 9 aa, Mycobacterium
TNPADGIDV

SEQ ID NO: 290595 - protein, 6 aa, Mycobacterium
TNPADP

SEQ ID NO: 290596 - protein, 11 aa, Mycobacterium
TNPAGGIEAGR

SEQ ID NO: 290597 - protein, 15 aa, Mycobacterium
TNPAPGQPGTTRKSV

SEQ ID NO: 290598 - protein, 5 aa, Mycobacterium
TNPAV

SEQ ID NO: 290599 - protein, 7 aa, Mycobacterium
TNPDLAG

SEQ ID NO: 290600 - protein, 8 aa, Mycobacterium
TNPDLAGR

SEQ ID NO: 290601 - protein, 6 aa, Mycobacterium
TNPERA

SEQ ID NO: 290602 - protein, 8 aa, Mycobacterium
TNPGALPR

SEQ ID NO: 290603 - protein, 8 aa, Mycobacterium
TNPGAMPR

SEQ ID NO: 290604 - protein, 23 aa, Mycobacterium
TNPGEQCAGSSPHSEMTAQRTEE

SEQ ID NO: 290605 - protein, 4 aa, Mycobacterium
TNPI

SEQ ID NO: 290606 - protein, 7 aa, Mycobacterium
TNPIDTP

SEQ ID NO: 290607 - protein, 4 aa, Mycobacterium
TNPK

SEQ ID NO: 290608 - protein, 11 aa, Mycobacterium
TNPKPGAFTEK

SEQ ID NO: 290609 - protein, 10 aa, Mycobacterium
TNPPAGTTVP

SEQ ID NO: 290610 - protein, 9 aa, Mycobacterium
TNPRASAMG

SEQ ID NO: 290611 - protein, 5 aa, Mycobacterium
TNPRG

SEQ ID NO: 290612 - protein, 7 aa, Mycobacterium
TNPRSIR

SEQ ID NO: 290613 - protein, 5 aa, Mycobacterium
TNPVN

SEQ ID NO: 290614 - protein, 11 aa, Mycobacterium
TNQPTAAAAAD

SEQ ID NO: 290615 - protein, 8 aa, Mycobacterium
TNQTPETL

SEQ ID NO: 290616 - protein, 6 aa, Mycobacterium
TNRDTN

SEQ ID NO: 290617 - protein, 20 aa, Mycobacterium
TNRGVRTAETSVDHPVKAGD

SEQ ID NO: 290618 - protein, 6 aa, Mycobacterium
TNRPAA

SEQ ID NO: 290619 - protein, 8 aa, Mycobacterium
TNRPPGKL

SEQ ID NO: 290620 - protein, 6 aa, Mycobacterium
TNRPPR

SEQ ID NO: 290621 - protein, 10 aa, Mycobacterium
TNSAKHASAG

SEQ ID NO: 290622 - protein, 19 aa, Mycobacterium
TNSETDVSAESTKANASLY

SEQ ID NO: 290623 - protein, 11 aa, Mycobacterium
TNSFSTDPANL

SEQ ID NO: 290624 - protein, 15 aa, Mycobacterium
TNSGDRAEISPTAQA

SEQ ID NO: 290625 - protein, 9 aa, Mycobacterium
TNSGGGELV

SEQ ID NO: 290626 - protein, 8 aa, Mycobacterium
TNSGTLAA

SEQ ID NO: 290627 - protein, 4 aa, Mycobacterium
TNSI

SEQ ID NO: 290628 - protein, 27 aa, Mycobacterium
TNSKPGQELEPEPAAAARAAPTTTEPA

SEQ ID NO: 290629 - protein, 18 aa, Mycobacterium
TNSTNPGDDGWKEMLAPA

SEQ ID NO: 290630 - protein, 7 aa, Mycobacterium
TNSTRDA

SEQ ID NO: 290631 - protein, 14 aa, Mycobacterium
TNSYGLQQPPHLGA

SEQ ID NO: 290632 - protein, 12 aa, Mycobacterium
TNTAAPDPRIDR

SEQ ID NO: 290633 - protein, 8 aa, Mycobacterium
TNTAETEH

SEQ ID NO: 290634 - protein, 8 aa, Mycobacterium
TNTIGTES

SEQ ID NO: 290635 - protein, 4 aa, Mycobacterium
TNTL

SEQ ID NO: 290636 - protein, 7 aa, Mycobacterium
TNTPYDG

SEQ ID NO: 290637 - protein, 8 aa, Mycobacterium
TNTRINDQ

SEQ ID NO: 290638 - protein, 7 aa, Mycobacterium
TNTRINE

SEQ ID NO: 290639 - protein, 11 aa, Mycobacterium
TNTRSSGASIG

SEQ ID NO: 290640 - protein, 11 aa, Mycobacterium
TNTTQSATAIG

SEQ ID NO: 290641 - protein, 5 aa, Mycobacterium
TNTVR

SEQ ID NO: 290642 - protein, 12 aa, Mycobacterium
TNVPGSRNPKRW

SEQ ID NO: 290643 - protein, 5 aa, Mycobacterium
TNYRP

SEQ ID NO: 290644 - protein, 12 aa, Mycobacterium
TNYSTTPQPGYP

SEQ ID NO: 290645 - protein, 22 aa, Mycobacterium
TPAAATTPPAPPPPPRVKPPRL

SEQ ID NO: 290646 - protein, 22 aa, Mycobacterium
TPAADAKPGGGSGNDHDHDHGL

SEQ ID NO: 290647 - protein, 9 aa, Mycobacterium
TPAADSLDA

SEQ ID NO: 290648 - protein, 17 aa, Mycobacterium
TPAAEPVQLPQRGAGEP

SEQ ID NO: 290649 - protein, 7 aa, Mycobacterium
TPAAGTA

SEQ ID NO: 290650 - protein, 9 aa, Mycobacterium
TPAAHGEPN

SEQ ID NO: 290651 - protein, 13 aa, Mycobacterium
TPAAKEKSVKTAA

SEQ ID NO: 290652 - protein, 16 aa, Mycobacterium
TPAAPIPESVQPKGVE

SEQ ID NO: 290653 - protein, 13 aa, Mycobacterium
TPAAPRVERAEET

SEQ ID NO: 290654 - protein, 13 aa, Mycobacterium
TPAAPRVERANET

SEQ ID NO: 290655 - protein, 20 aa, Mycobacterium
TPAAPTPSVNNDSKSKSMEL

SEQ ID NO: 290656 - protein, 6 aa, Mycobacterium
TPAARG

SEQ ID NO: 290657 - protein, 18 aa, Mycobacterium
TPAASRPYVDNSTDNSEW

SEQ ID NO: 290658 - protein, 18 aa, Mycobacterium
TPAATGATRSPAGAEGTG

SEQ ID NO: 290659 - protein, 10 aa, Mycobacterium
TPADADENTL

SEQ ID NO: 290660 - protein, 8 aa, Mycobacterium
TPADAGSV

SEQ ID NO: 290661 - protein, 7 aa, Mycobacterium
TPADAQA

SEQ ID NO: 290662 - protein, 8 aa, Mycobacterium
TPADETLR

SEQ ID NO: 290663 - protein, 9 aa, Mycobacterium
TPADETVRE

SEQ ID NO: 290664 - protein, 8 aa, Mycobacterium
TPADTPRV

SEQ ID NO: 290665 - protein, 5 aa, Mycobacterium
TPAEQ

SEQ ID NO: 290666 - protein, 4 aa, Mycobacterium
TPAF

SEQ ID NO: 290667 - protein, 5 aa, Mycobacterium
TPAGI

SEQ ID NO: 290668 - protein, 13 aa, Mycobacterium
TPAGLGQPLRGHT

SEQ ID NO: 290669 - protein, 7 aa, Mycobacterium
TPAGSRV

SEQ ID NO: 290670 - protein, 5 aa, Mycobacterium
TPAGT

SEQ ID NO: 290671 - protein, 5 aa, Mycobacterium
TPAHL

SEQ ID NO: 290672 - protein, 11 aa, Mycobacterium
TPAIESTRGTL

SEQ ID NO: 290673 - protein, 4 aa, Mycobacterium
TPAK

SEQ ID NO: 290674 - protein, 10 aa, Mycobacterium
TPAKAAATAA

SEQ ID NO: 290675 - protein, 8 aa, Mycobacterium
TPALEQDS

SEQ ID NO: 290676 - protein, 8 aa, Mycobacterium
TPANAPAH

SEQ ID NO: 290677 - protein, 6 aa, Mycobacterium
TPANDD

SEQ ID NO: 290678 - protein, 4 aa, Mycobacterium
TPAP

SEQ ID NO: 290679 - protein, 13 aa, Mycobacterium
TPAPASVAAADKA

SEQ ID NO: 290680 - protein, 11 aa, Mycobacterium
TPAPGAAEESL

SEQ ID NO: 290681 - protein, 13 aa, Mycobacterium
TPAPPPPPPDHRA

SEQ ID NO: 290682 - protein, 7 aa, Mycobacterium
TPAPPSF

SEQ ID NO: 290683 - protein, 9 aa, Mycobacterium
TPAPSLPGD

SEQ ID NO: 290684 - protein, 5 aa, Mycobacterium
TPAQI

SEQ ID NO: 290685 - protein, 7 aa, Mycobacterium
TPAQLGE

SEQ ID NO: 290686 - protein, 5 aa, Mycobacterium
TPARA

SEQ ID NO: 290687 - protein, 8 aa, Mycobacterium
TPARAGIT

SEQ ID NO: 290688 - protein, 10 aa, Mycobacterium
TPARGMPGSG

SEQ ID NO: 290689 - protein, 9 aa, Mycobacterium
TPARPDGSI

SEQ ID NO: 290690 - protein, 5 aa, Mycobacterium
TPARR

SEQ ID NO: 290691 - protein, 4 aa, Mycobacterium
TPAS

SEQ ID NO: 290692 - protein, 9 aa, Mycobacterium
TPASAADTN

SEQ ID NO: 290693 - protein, 10 aa, Mycobacterium
TPASDAKPAV

SEQ ID NO: 290694 - protein, 8 aa, Mycobacterium
TPASGSSF

SEQ ID NO: 290695 - protein, 49 aa, Mycobacterium
TPASPAAPPKTAAPVPAKAPAQVPAPGPAPAASPVPVAAPPSVVQPPPV

SEQ ID NO: 290696 - protein, 11 aa, Mycobacterium
TPATDTRYGAT

SEQ ID NO: 290697 - protein, 12 aa, Mycobacterium
TPATEAKAETPV

SEQ ID NO: 290698 - protein, 9 aa, Mycobacterium
TPATGANAL

SEQ ID NO: 290699 - protein, 13 aa, Mycobacterium
TPCDTSPIATGAG

SEQ ID NO: 290700 - protein, 5 aa, Mycobacterium
TPDAL

SEQ ID NO: 290701 - protein, 8 aa, Mycobacterium
TPDAMDRT

SEQ ID NO: 290702 - protein, 6 aa, Mycobacterium
TPDDAE

SEQ ID NO: 290703 - protein, 19 aa, Mycobacterium
TPDDASPADPGDVTQPSIS

SEQ ID NO: 290704 - protein, 11 aa, Mycobacterium
TPDDDKERPRH

SEQ ID NO: 290705 - protein, 6 aa, Mycobacterium
TPDDGH

SEQ ID NO: 290706 - protein, 9 aa, Mycobacterium
TPDDPDYDA

SEQ ID NO: 290707 - protein, 13 aa, Mycobacterium
TPDGAGPVPNDIS

SEQ ID NO: 290708 - protein, 8 aa, Mycobacterium
TPDGLPLG

SEQ ID NO: 290709 - protein, 19 aa, Mycobacterium
TPDGQAAGSAEPEQPNASI

SEQ ID NO: 290710 - protein, 23 aa, Mycobacterium
TPDPDLGSRPPDPAIDTADTVRS

SEQ ID NO: 290711 - protein, 9 aa, Mycobacterium
TPDPRPSAV

SEQ ID NO: 290712 - protein, 7 aa, Mycobacterium
TPDQSPT

SEQ ID NO: 290713 - protein, 4 aa, Mycobacterium
TPDR

SEQ ID NO: 290714 - protein, 21 aa, Mycobacterium
TPDRHSETAQRSIPTSTPEIA

SEQ ID NO: 290715 - protein, 5 aa, Mycobacterium
TPDRP

SEQ ID NO: 290716 - protein, 5 aa, Mycobacterium
TPDRV

SEQ ID NO: 290717 - protein, 12 aa, Mycobacterium
TPDSIDDASPTW

SEQ ID NO: 290718 - protein, 5 aa, Mycobacterium
TPDSK

SEQ ID NO: 290719 - protein, 6 aa, Mycobacterium
TPDSLT

SEQ ID NO: 290720 - protein, 8 aa, Mycobacterium
TPDSNQIL

SEQ ID NO: 290721 - protein, 9 aa, Mycobacterium
TPDSPAPQM

SEQ ID NO: 290722 - protein, 5 aa, Mycobacterium
TPDTP

SEQ ID NO: 290723 - protein, 5 aa, Mycobacterium
TPDTT

SEQ ID NO: 290724 - protein, 6 aa, Mycobacterium
TPDVAT

SEQ ID NO: 290725 - protein, 7 aa, Mycobacterium
TPDYGPV

SEQ ID NO: 290726 - protein, 4 aa, Mycobacterium
TPEA

SEQ ID NO: 290727 - protein, 22 aa, Mycobacterium
TPEAGAAESGDTGAAAAEAESA

SEQ ID NO: 290728 - protein, 6 aa, Mycobacterium
TPEAPW

SEQ ID NO: 290729 - protein, 5 aa, Mycobacterium
TPEAT

SEQ ID NO: 290730 - protein, 7 aa, Mycobacterium
TPEATTL

SEQ ID NO: 290731 - protein, 5 aa, Mycobacterium
TPECT

SEQ ID NO: 290732 - protein, 6 aa, Mycobacterium
TPECTQ

SEQ ID NO: 290733 - protein, 5 aa, Mycobacterium
TPEDA

SEQ ID NO: 290734 - protein, 5 aa, Mycobacterium
TPEDK

SEQ ID NO: 290735 - protein, 14 aa, Mycobacterium
TPEDLGDAGAGGIG

SEQ ID NO: 290736 - protein, 4 aa, Mycobacterium
TPEE

SEQ ID NO: 290737 - protein, 5 aa, Mycobacterium
TPEEL

SEQ ID NO: 290738 - protein, 4 aa, Mycobacterium
TPEF

SEQ ID NO: 290739 - protein, 10 aa, Mycobacterium
TPEGHPDPLN

SEQ ID NO: 290740 - protein, 11 aa, Mycobacterium
TPEGQPMPDSI

SEQ ID NO: 290741 - protein, 8 aa, Mycobacterium
TPEKDGQL

SEQ ID NO: 290742 - protein, 7 aa, Mycobacterium
TPELQPG

SEQ ID NO: 290743 - protein, 10 aa, Mycobacterium
TPENDAPGTV

SEQ ID NO: 290744 - protein, 6 aa, Mycobacterium
TPENFD

SEQ ID NO: 290745 - protein, 8 aa, Mycobacterium
TPEQAEAF

SEQ ID NO: 290746 - protein, 5 aa, Mycobacterium
TPEQR

SEQ ID NO: 290747 - protein, 8 aa, Mycobacterium
TPERTEPD

SEQ ID NO: 290748 - protein, 16 aa, Mycobacterium
TPERTEQTPVTADSAR

SEQ ID NO: 290749 - protein, 5 aa, Mycobacterium
TPESL

SEQ ID NO: 290750 - protein, 5 aa, Mycobacterium
TPESY

SEQ ID NO: 290751 - protein, 4 aa, Mycobacterium
TPET

SEQ ID NO: 290752 - protein, 6 aa, Mycobacterium
TPEVGS

SEQ ID NO: 290753 - protein, 6 aa, Mycobacterium
TPFEHS

SEQ ID NO: 290754 - protein, 16 aa, Mycobacterium
TPFGKGEEQVEGRRSQ

SEQ ID NO: 290755 - protein, 4 aa, Mycobacterium
TPFP

SEQ ID NO: 290756 - protein, 7 aa, Mycobacterium
TPFPDTD

SEQ ID NO: 290757 - protein, 4 aa, Mycobacterium
TPFT

SEQ ID NO: 290758 - protein, 4 aa, Mycobacterium
TPGA

SEQ ID NO: 290759 - protein, 9 aa, Mycobacterium
TPGAPLRPV

SEQ ID NO: 290760 - protein, 5 aa, Mycobacterium
TPGAV

SEQ ID NO: 290761 - protein, 7 aa, Mycobacterium
TPGDGAS

SEQ ID NO: 290762 - protein, 7 aa, Mycobacterium
TPGDQPL

SEQ ID NO: 290763 - protein, 11 aa, Mycobacterium
TPGEASPAGDV

SEQ ID NO: 290764 - protein, 5 aa, Mycobacterium
TPGEF

SEQ ID NO: 290765 - protein, 7 aa, Mycobacterium
TPGEQVT

SEQ ID NO: 290766 - protein, 67 aa, Mycobacterium
TPGFGAPPPGYGPPPGYGVPPGYGMPPGYGPPPPGYGAPPGYGPPPPGYGASPGYGPPPPGYGPPLV

SEQ ID NO: 290767 - protein, 12 aa, Mycobacterium
TPGFQSRRAGHE

SEQ ID NO: 290768 - protein, 5 aa, Mycobacterium
TPGGL

SEQ ID NO: 290769 - protein, 8 aa, Mycobacterium
TPGGPPPA

SEQ ID NO: 290770 - protein, 16 aa, Mycobacterium
TPGGTGGSGAATGGSQ

SEQ ID NO: 290771 - protein, 6 aa, Mycobacterium
TPGGTM

SEQ ID NO: 290772 - protein, 4 aa, Mycobacterium
TPGI

SEQ ID NO: 290773 - protein, 5 aa, Mycobacterium
TPGLK

SEQ ID NO: 290774 - protein, 7 aa, Mycobacterium
TPGNSRD

SEQ ID NO: 290775 - protein, 5 aa, Mycobacterium
TPGNT

SEQ ID NO: 290776 - protein, 4 aa, Mycobacterium
TPGP

SEQ ID NO: 290777 - protein, 6 aa, Mycobacterium
TPGPAK

SEQ ID NO: 290778 - protein, 5 aa, Mycobacterium
TPGPI

SEQ ID NO: 290779 - protein, 5 aa, Mycobacterium
TPGPL

SEQ ID NO: 290780 - protein, 15 aa, Mycobacterium
TPGPLPKPDVGTTDD

SEQ ID NO: 290781 - protein, 15 aa, Mycobacterium
TPGPLPKPDVGTTED

SEQ ID NO: 290782 - protein, 21 aa, Mycobacterium
TPGPPTAVYSPQSGELVGPDG

SEQ ID NO: 290783 - protein, 4 aa, Mycobacterium
TPGQ

SEQ ID NO: 290784 - protein, 10 aa, Mycobacterium
TPGQESESAM

SEQ ID NO: 290785 - protein, 5 aa, Mycobacterium
TPGQP

SEQ ID NO: 290786 - protein, 4 aa, Mycobacterium
TPGR

SEQ ID NO: 290787 - protein, 6 aa, Mycobacterium
TPGSTA

SEQ ID NO: 290788 - protein, 9 aa, Mycobacterium
TPGSTYTRA

SEQ ID NO: 290789 - protein, 8 aa, Mycobacterium
TPGSVNAT

SEQ ID NO: 290790 - protein, 10 aa, Mycobacterium
TPGSYPRGGS

SEQ ID NO: 290791 - protein, 10 aa, Mycobacterium
TPGTERRTAT

SEQ ID NO: 290792 - protein, 12 aa, Mycobacterium
TPGVGGHGQPHL

SEQ ID NO: 290793 - protein, 16 aa, Mycobacterium
TPGVLPGSNFADPPPG

SEQ ID NO: 290794 - protein, 5 aa, Mycobacterium
TPGVS

SEQ ID NO: 290795 - protein, 13 aa, Mycobacterium
TPHAFSSDEPASG

SEQ ID NO: 290796 - protein, 5 aa, Mycobacterium
TPHAM

SEQ ID NO: 290797 - protein, 9 aa, Mycobacterium
TPHDAPSSI

SEQ ID NO: 290798 - protein, 5 aa, Mycobacterium
TPHGQ

SEQ ID NO: 290799 - protein, 7 aa, Mycobacterium
TPHHGSG

SEQ ID NO: 290800 - protein, 30 aa, Mycobacterium
TPHKAKSGSSWIGSPPKRLRRKADGADSTL

SEQ ID NO: 290801 - protein, 24 aa, Mycobacterium
TPHPAQRPAHPAAARTTKPVAQQS

SEQ ID NO: 290802 - protein, 7 aa, Mycobacterium
TPIAGRA

SEQ ID NO: 290803 - protein, 9 aa, Mycobacterium
TPIGDTASA

SEQ ID NO: 290804 - protein, 8 aa, Mycobacterium
TPIGGTGG

SEQ ID NO: 290805 - protein, 6 aa, Mycobacterium
TPINPL

SEQ ID NO: 290806 - protein, 68 aa, Mycobacterium
TPIPPPGAPPAPPVDDAPAPEAPPEPPPAPEAPPAADPPPPADVPPPDPPPAEPAPVEPEPAPEAPPA

SEQ ID NO: 290807 - protein, 7 aa, Mycobacterium
TPIPTPR

SEQ ID NO: 290808 - protein, 5 aa, Mycobacterium
TPITA

SEQ ID NO: 290809 - protein, 12 aa, Mycobacterium
TPITLPGGAEES

SEQ ID NO: 290810 - protein, 5 aa, Mycobacterium
TPITP

SEQ ID NO: 290811 - protein, 4 aa, Mycobacterium
TPKG

SEQ ID NO: 290812 - protein, 4 aa, Mycobacterium
TPKL

SEQ ID NO: 290813 - protein, 14 aa, Mycobacterium
TPKPADGVPPPPLN

SEQ ID NO: 290814 - protein, 15 aa, Mycobacterium
TPKPADGVPPPPLNT

SEQ ID NO: 290815 - protein, 30 aa, Mycobacterium
TPKPAEGVPPPPLNAPLPEPAPPAPPAPRV

SEQ ID NO: 290816 - protein, 33 aa, Mycobacterium
TPKPAEGVPPPPLNAPLPPDAPPPPPAPPAPRV

SEQ ID NO: 290817 - protein, 7 aa, Mycobacterium
TPKPAHE

SEQ ID NO: 290818 - protein, 17 aa, Mycobacterium
TPKPGTGPSRKSRQRGH

SEQ ID NO: 290819 - protein, 13 aa, Mycobacterium
TPLDAGSAMGTTD

SEQ ID NO: 290820 - protein, 4 aa, Mycobacterium
TPLE

SEQ ID NO: 290821 - protein, 8 aa, Mycobacterium
TPLGDEHD

SEQ ID NO: 290822 - protein, 15 aa, Mycobacterium
TPLGEGGSRGSSGFA

SEQ ID NO: 290823 - protein, 5 aa, Mycobacterium
TPLGS

SEQ ID NO: 290824 - protein, 4 aa, Mycobacterium
TPLP

SEQ ID NO: 290825 - protein, 6 aa, Mycobacterium
TPLPIP

SEQ ID NO: 290826 - protein, 9 aa, Mycobacterium
TPLPPGKAA

SEQ ID NO: 290827 - protein, 9 aa, Mycobacterium
TPLPPPRRP

SEQ ID NO: 290828 - protein, 7 aa, Mycobacterium
TPLPRQP

SEQ ID NO: 290829 - protein, 14 aa, Mycobacterium
TPLPVSGKETWRGV

SEQ ID NO: 290830 - protein, 16 aa, Mycobacterium
TPLRATQSLTEQDVYD

SEQ ID NO: 290831 - protein, 12 aa, Mycobacterium
TPLREPDGTESI

SEQ ID NO: 290832 - protein, 9 aa, Mycobacterium
TPLSGTSYA

SEQ ID NO: 290833 - protein, 4 aa, Mycobacterium
TPLT

SEQ ID NO: 290834 - protein, 9 aa, Mycobacterium
TPLTSDPGY

SEQ ID NO: 290835 - protein, 4 aa, Mycobacterium
TPMT

SEQ ID NO: 290836 - protein, 5 aa, Mycobacterium
TPMTE

SEQ ID NO: 290837 - protein, 17 aa, Mycobacterium
TPNDPAFQPGFEEADTS

SEQ ID NO: 290838 - protein, 18 aa, Mycobacterium
TPNDPQFQPGFEDADTSV

SEQ ID NO: 290839 - protein, 4 aa, Mycobacterium
TPNE

SEQ ID NO: 290840 - protein, 11 aa, Mycobacterium
TPNGPGGATPI

SEQ ID NO: 290841 - protein, 11 aa, Mycobacterium
TPNGPGGPTPI

SEQ ID NO: 290842 - protein, 18 aa, Mycobacterium
TPNGQATQSAEPEKTAAA

SEQ ID NO: 290843 - protein, 4 aa, Mycobacterium
TPNN

SEQ ID NO: 290844 - protein, 11 aa, Mycobacterium
TPNPRTSGNGQ

SEQ ID NO: 290845 - protein, 11 aa, Mycobacterium
TPNQPGTDYDW

SEQ ID NO: 290846 - protein, 13 aa, Mycobacterium
TPPAAAPTAHGRR

SEQ ID NO: 290847 - protein, 7 aa, Mycobacterium
TPPAAAV

SEQ ID NO: 290848 - protein, 61 aa, Mycobacterium
TPPAEEAAEEPAPAQSAPSRPDQQSFPATMSAPPPPSGAPIAANTVSAGSPPAPGAPAAAA

SEQ ID NO: 290849 - protein, 7 aa, Mycobacterium
TPPAGDY

SEQ ID NO: 290850 - protein, 6 aa, Mycobacterium
TPPALP

SEQ ID NO: 290851 - protein, 85 aa, Mycobacterium
TPPAPTDTSAVETTPGSATPSEPTSPGESATPSDTSDTSEPSSETTVPSSPTPSTAPSSSVPTATSQTPTSTQVPTSTPTSSAAV

SEQ ID NO: 290852 - protein, 7 aa, Mycobacterium
TPPARGA

SEQ ID NO: 290853 - protein, 18 aa, Mycobacterium
TPPAVDSSEVPQAGEPPL

SEQ ID NO: 290854 - protein, 13 aa, Mycobacterium
TPPDDKKVTDKAW

SEQ ID NO: 290855 - protein, 15 aa, Mycobacterium
TPPDFGPLADPARRT

SEQ ID NO: 290856 - protein, 12 aa, Mycobacterium
TPPDGEKVDNPE

SEQ ID NO: 290857 - protein, 8 aa, Mycobacterium
TPPDVGDR

SEQ ID NO: 290858 - protein, 5 aa, Mycobacterium
TPPEL

SEQ ID NO: 290859 - protein, 24 aa, Mycobacterium
TPPFNPQPAITGDKSRKSPKTLGS

SEQ ID NO: 290860 - protein, 7 aa, Mycobacterium
TPPFQHS

SEQ ID NO: 290861 - protein, 21 aa, Mycobacterium
TPPGGGSAVTGSTSFTVVPHG

SEQ ID NO: 290862 - protein, 7 aa, Mycobacterium
TPPGPVA

SEQ ID NO: 290863 - protein, 5 aa, Mycobacterium
TPPGQ

SEQ ID NO: 290864 - protein, 15 aa, Mycobacterium
TPPGSDPVRAYKDPG

SEQ ID NO: 290865 - protein, 9 aa, Mycobacterium
TPPKKHKDR

SEQ ID NO: 290866 - protein, 9 aa, Mycobacterium
TPPLPNRRN

SEQ ID NO: 290867 - protein, 9 aa, Mycobacterium
TPPLPTRRN

SEQ ID NO: 290868 - protein, 4 aa, Mycobacterium
TPPN

SEQ ID NO: 290869 - protein, 12 aa, Mycobacterium
TPPNAGDLAAPA

SEQ ID NO: 290870 - protein, 22 aa, Mycobacterium
TPPPAPPPASDTPAAPSTSRPV

SEQ ID NO: 290871 - protein, 50 aa, Mycobacterium
TPPPAQPVAPNTRTGNNTQPAPQAPPAPQAPPPAAPAPQPPAPQAPAPVP

SEQ ID NO: 290872 - protein, 6 aa, Mycobacterium
TPPPDA

SEQ ID NO: 290873 - protein, 9 aa, Mycobacterium
TPPPDTADE

SEQ ID NO: 290874 - protein, 7 aa, Mycobacterium
TPPPGDV

SEQ ID NO: 290875 - protein, 18 aa, Mycobacterium
TPPPGTGDPGDPAAAQTA

SEQ ID NO: 290876 - protein, 10 aa, Mycobacterium
TPPPQSRPRV

SEQ ID NO: 290877 - protein, 11 aa, Mycobacterium
TPPPRPDVTAA

SEQ ID NO: 290878 - protein, 11 aa, Mycobacterium
TPPPRPDVTDA

SEQ ID NO: 290879 - protein, 10 aa, Mycobacterium
TPPPVPEQNG

SEQ ID NO: 290880 - protein, 6 aa, Mycobacterium
TPPQPF

SEQ ID NO: 290881 - protein, 7 aa, Mycobacterium
TPPQPGT

SEQ ID NO: 290882 - protein, 10 aa, Mycobacterium
TPPQPTAIPQ

SEQ ID NO: 290883 - protein, 11 aa, Mycobacterium
TPPQPTPLGPD

SEQ ID NO: 290884 - protein, 7 aa, Mycobacterium
TPPQRSG

SEQ ID NO: 290885 - protein, 6 aa, Mycobacterium
TPPRQL

SEQ ID NO: 290886 - protein, 5 aa, Mycobacterium
TPPRS

SEQ ID NO: 290887 - protein, 6 aa, Mycobacterium
TPPSDA

SEQ ID NO: 290888 - protein, 19 aa, Mycobacterium
TPPSGDPDERVTMPLWVSG

SEQ ID NO: 290889 - protein, 4 aa, Mycobacterium
TPPT

SEQ ID NO: 290890 - protein, 8 aa, Mycobacterium
TPPTSTSA

SEQ ID NO: 290891 - protein, 4 aa, Mycobacterium
TPPV

SEQ ID NO: 290892 - protein, 6 aa, Mycobacterium
TPPVES

SEQ ID NO: 290893 - protein, 5 aa, Mycobacterium
TPPVL

SEQ ID NO: 290894 - protein, 128 aa, Mycobacterium
TPPVPRPKYDQHQQQYGQYSGGYYGQQHGQQHGQQHGGPQQQGSQQQGLQQRPGYPTPYGGYSGSGQTTGGFPAAQSGPPTPPTGFPTYGQPPANNTPTTQVPTQQQSPPQSGQSSQSGQSSPSGQSS

SEQ ID NO: 290895 - protein, 170 aa, Mycobacterium
TPPWTPPWATPTSPTTPPTSTSTPTTTPPTTPSTTPPTTTAPPTSTTTAPPTTSTTTAPTTTTVPTTTAPPTSSVPTTTSAPTTTYTPPVEEEPTYTPPVEEPTYTAPVEQPSTTVYPDTPSWGDDSSSSGGSSGGSRGGSSGSSSDDSSSGGSYGGGSDDSPVTTIFDS

SEQ ID NO: 290896 - protein, 12 aa, Mycobacterium
TPPYHDGPTLQN

SEQ ID NO: 290897 - protein, 5 aa, Mycobacterium
TPQAT

SEQ ID NO: 290898 - protein, 9 aa, Mycobacterium
TPQDAQARN

SEQ ID NO: 290899 - protein, 6 aa, Mycobacterium
TPQDNP

SEQ ID NO: 290900 - protein, 6 aa, Mycobacterium
TPQDQI

SEQ ID NO: 290901 - protein, 4 aa, Mycobacterium
TPQG

SEQ ID NO: 290902 - protein, 13 aa, Mycobacterium
TPQGATSSSARAA

SEQ ID NO: 290903 - protein, 7 aa, Mycobacterium
TPQGGAN

SEQ ID NO: 290904 - protein, 4 aa, Mycobacterium
TPQM

SEQ ID NO: 290905 - protein, 8 aa, Mycobacterium
TPQNIADN

SEQ ID NO: 290906 - protein, 7 aa, Mycobacterium
TPQPALD

SEQ ID NO: 290907 - protein, 6 aa, Mycobacterium
TPQPLH

SEQ ID NO: 290908 - protein, 5 aa, Mycobacterium
TPQPM

SEQ ID NO: 290909 - protein, 11 aa, Mycobacterium
TPQPSSSAAIG

SEQ ID NO: 290910 - protein, 4 aa, Mycobacterium
TPQQ

SEQ ID NO: 290911 - protein, 6 aa, Mycobacterium
TPQQAG

SEQ ID NO: 290912 - protein, 10 aa, Mycobacterium
TPQRADGSID

SEQ ID NO: 290913 - protein, 11 aa, Mycobacterium
TPQRPDDAENP

SEQ ID NO: 290914 - protein, 9 aa, Mycobacterium
TPQRPDGSI

SEQ ID NO: 290915 - protein, 4 aa, Mycobacterium
TPQY

SEQ ID NO: 290916 - protein, 6 aa, Mycobacterium
TPRELA

SEQ ID NO: 290917 - protein, 20 aa, Mycobacterium
TPRGATATLSLGSSPKIPAD

SEQ ID NO: 290918 - protein, 4 aa, Mycobacterium
TPRH

SEQ ID NO: 290919 - protein, 6 aa, Mycobacterium
TPRHRD

SEQ ID NO: 290920 - protein, 13 aa, Mycobacterium
TPRLPGSAADYPE

SEQ ID NO: 290921 - protein, 8 aa, Mycobacterium
TPRPDASF

SEQ ID NO: 290922 - protein, 11 aa, Mycobacterium
TPRPDASYQDI

SEQ ID NO: 290923 - protein, 6 aa, Mycobacterium
TPRPGA

SEQ ID NO: 290924 - protein, 12 aa, Mycobacterium
TPRPKIETLDAD

SEQ ID NO: 290925 - protein, 8 aa, Mycobacterium
TPRPRPTG

SEQ ID NO: 290926 - protein, 7 aa, Mycobacterium
TPRQGRG

SEQ ID NO: 290927 - protein, 6 aa, Mycobacterium
TPRRAG

SEQ ID NO: 290928 - protein, 8 aa, Mycobacterium
TPRRRSDV

SEQ ID NO: 290929 - protein, 6 aa, Mycobacterium
TPRTSR

SEQ ID NO: 290930 - protein, 7 aa, Mycobacterium
TPRTSRR

SEQ ID NO: 290931 - protein, 9 aa, Mycobacterium
TPRTSRRFT

SEQ ID NO: 290932 - protein, 17 aa, Mycobacterium
TPRTSRRYSPRLDPEAV

SEQ ID NO: 290933 - protein, 19 aa, Mycobacterium
TPRTSRRYSPRLDPETVGQ

SEQ ID NO: 290934 - protein, 11 aa, Mycobacterium
TPRVGGSDFTA

SEQ ID NO: 290935 - protein, 5 aa, Mycobacterium
TPRVS

SEQ ID NO: 290936 - protein, 4 aa, Mycobacterium
TPRY

SEQ ID NO: 290937 - protein, 5 aa, Mycobacterium
TPRYA

SEQ ID NO: 290938 - protein, 6 aa, Mycobacterium
TPRYKG

SEQ ID NO: 290939 - protein, 6 aa, Mycobacterium
TPSAAG

SEQ ID NO: 290940 - protein, 11 aa, Mycobacterium
TPSAGTPEGPW

SEQ ID NO: 290941 - protein, 87 aa, Mycobacterium
TPSAPAPAAHAPAPKPQAPAPTPQAPTPQAPAPPEPAPAPQAPAPAPRAPAPAPQAPAPAPAPVPEAPAPAPAPAPVPAAPAPAPVP

SEQ ID NO: 290942 - protein, 7 aa, Mycobacterium
TPSARGR

SEQ ID NO: 290943 - protein, 8 aa, Mycobacterium
TPSATALG

SEQ ID NO: 290944 - protein, 7 aa, Mycobacterium
TPSDAVG

SEQ ID NO: 290945 - protein, 6 aa, Mycobacterium
TPSGAL

SEQ ID NO: 290946 - protein, 7 aa, Mycobacterium
TPSGALT

SEQ ID NO: 290947 - protein, 8 aa, Mycobacterium
TPSGFGPR

SEQ ID NO: 290948 - protein, 10 aa, Mycobacterium
TPSGNAYNKG

SEQ ID NO: 290949 - protein, 23 aa, Mycobacterium
TPSGPPTAVYSPQSGELVGPDGV

SEQ ID NO: 290950 - protein, 23 aa, Mycobacterium
TPSGPPVATYSPQSGELVGPDGV

SEQ ID NO: 290951 - protein, 9 aa, Mycobacterium
TPSMPGPVA

SEQ ID NO: 290952 - protein, 9 aa, Mycobacterium
TPSNAPDHL

SEQ ID NO: 290953 - protein, 9 aa, Mycobacterium
TPSNAPEHL

SEQ ID NO: 290954 - protein, 10 aa, Mycobacterium
TPSNAPEQVA

SEQ ID NO: 290955 - protein, 5 aa, Mycobacterium
TPSPA

SEQ ID NO: 290956 - protein, 6 aa, Mycobacterium
TPSPLS

SEQ ID NO: 290957 - protein, 8 aa, Mycobacterium
TPSPTAVG

SEQ ID NO: 290958 - protein, 23 aa, Mycobacterium
TPSSEDPTEPSRQSADAPTEKVT

SEQ ID NO: 290959 - protein, 6 aa, Mycobacterium
TPSSPA

SEQ ID NO: 290960 - protein, 5 aa, Mycobacterium
TPSTA

SEQ ID NO: 290961 - protein, 9 aa, Mycobacterium
TPSTPALTD

SEQ ID NO: 290962 - protein, 6 aa, Mycobacterium
TPSTST

SEQ ID NO: 290963 - protein, 9 aa, Mycobacterium
TPSVAGPGE

SEQ ID NO: 290964 - protein, 5 aa, Mycobacterium
TPSYA

SEQ ID NO: 290965 - protein, 13 aa, Mycobacterium
TPTAAAIGPPPVD

SEQ ID NO: 290966 - protein, 8 aa, Mycobacterium
TPTAAGPM

SEQ ID NO: 290967 - protein, 16 aa, Mycobacterium
TPTDGQYKISKLDQVT

SEQ ID NO: 290968 - protein, 21 aa, Mycobacterium
TPTDPAPAPTQVAAAPQPKID

SEQ ID NO: 290969 - protein, 7 aa, Mycobacterium
TPTEAAS

SEQ ID NO: 290970 - protein, 16 aa, Mycobacterium
TPTEGQYKISKLDQVA

SEQ ID NO: 290971 - protein, 9 aa, Mycobacterium
TPTELRQGG

SEQ ID NO: 290972 - protein, 19 aa, Mycobacterium
TPTGHTTPTPHNPSPERST

SEQ ID NO: 290973 - protein, 37 aa, Mycobacterium
TPTHTAATKATTSQITRPDPPRTPGCDDGGVVSTLSD

SEQ ID NO: 290974 - protein, 4 aa, Mycobacterium
TPTM

SEQ ID NO: 290975 - protein, 4 aa, Mycobacterium
TPTP

SEQ ID NO: 290976 - protein, 25 aa, Mycobacterium
TPTPEPTPAPAPEPEPTPAKVSAST

SEQ ID NO: 290977 - protein, 11 aa, Mycobacterium
TPTPLRSRPDV

SEQ ID NO: 290978 - protein, 5 aa, Mycobacterium
TPTPQ

SEQ ID NO: 290979 - protein, 7 aa, Mycobacterium
TPTQPDL

SEQ ID NO: 290980 - protein, 5 aa, Mycobacterium
TPTQQ

SEQ ID NO: 290981 - protein, 18 aa, Mycobacterium
TPTQRFTSADASAPSTVG

SEQ ID NO: 290982 - protein, 5 aa, Mycobacterium
TPTQS

SEQ ID NO: 290983 - protein, 4 aa, Mycobacterium
TPTR

SEQ ID NO: 290984 - protein, 8 aa, Mycobacterium
TPTRREIR

SEQ ID NO: 290985 - protein, 8 aa, Mycobacterium
TPTSGFGR

SEQ ID NO: 290986 - protein, 9 aa, Mycobacterium
TPTSGHARI

SEQ ID NO: 290987 - protein, 9 aa, Mycobacterium
TPTSPLAPL

SEQ ID NO: 290988 - protein, 9 aa, Mycobacterium
TPTSPPVVP

SEQ ID NO: 290989 - protein, 21 aa, Mycobacterium
TPTSRRNPSTRPGHASPRDPI

SEQ ID NO: 290990 - protein, 7 aa, Mycobacterium
TPTSSRV

SEQ ID NO: 290991 - protein, 35 aa, Mycobacterium
TPTTTAPITPTTVAPTTVNPTTVAPTTVAPTTQQT

SEQ ID NO: 290992 - protein, 4 aa, Mycobacterium
TPTV

SEQ ID NO: 290993 - protein, 11 aa, Mycobacterium
TPVASAVSSSP

SEQ ID NO: 290994 - protein, 13 aa, Mycobacterium
TPVGEGGSHGSSG

SEQ ID NO: 290995 - protein, 7 aa, Mycobacterium
TPVGTEI

SEQ ID NO: 290996 - protein, 6 aa, Mycobacterium
TPVGTG

SEQ ID NO: 290997 - protein, 7 aa, Mycobacterium
TPVPPQL

SEQ ID NO: 290998 - protein, 6 aa, Mycobacterium
TPVPVS

SEQ ID NO: 290999 - protein, 8 aa, Mycobacterium
TPVRAGRG

SEQ ID NO: 291000 - protein, 7 aa, Mycobacterium
TPVSTTG

SEQ ID NO: 291001 - protein, 12 aa, Mycobacterium
TPWGQPPPRPRR

SEQ ID NO: 291002 - protein, 4 aa, Mycobacterium
TPWS

SEQ ID NO: 291003 - protein, 4 aa, Mycobacterium
TPYE

SEQ ID NO: 291004 - protein, 13 aa, Mycobacterium
TPYGGPRLPIEPP

SEQ ID NO: 291005 - protein, 13 aa, Mycobacterium
TPYGGPVLPIEPP

SEQ ID NO: 291006 - protein, 8 aa, Mycobacterium
TPYPGIDS

SEQ ID NO: 291007 - protein, 5 aa, Mycobacterium
TPYQG

SEQ ID NO: 291008 - protein, 13 aa, Mycobacterium
TQAAAQSLDGKAT

SEQ ID NO: 291009 - protein, 19 aa, Mycobacterium
TQADQRIDSLSGGQRKRTS

SEQ ID NO: 291010 - protein, 8 aa, Mycobacterium
TQAETVSE

SEQ ID NO: 291011 - protein, 5 aa, Mycobacterium
TQAEY

SEQ ID NO: 291012 - protein, 9 aa, Mycobacterium
TQAGAAGAS

SEQ ID NO: 291013 - protein, 10 aa, Mycobacterium
TQAGSQVADL

SEQ ID NO: 291014 - protein, 10 aa, Mycobacterium
TQAGTVERRA

SEQ ID NO: 291015 - protein, 9 aa, Mycobacterium
TQAKADSKV

SEQ ID NO: 291016 - protein, 4 aa, Mycobacterium
TQAL

SEQ ID NO: 291017 - protein, 14 aa, Mycobacterium
TQAPDTNSMAASEQ

SEQ ID NO: 291018 - protein, 20 aa, Mycobacterium
TQAPDVASVAPPKFAADNRS

SEQ ID NO: 291019 - protein, 7 aa, Mycobacterium
TQAPPGI

SEQ ID NO: 291020 - protein, 108 aa, Mycobacterium
TQAPSVSNNGVQGSSGQQGPQQGWDQPAHGTQIPDYQNAAPYTQGPGRPNPDFNPGSDAGSQGGQSNQGAQQPVQQPQQASQQPPQQDAGQQPNQSPNQSSDQQKIDD

SEQ ID NO: 291021 - protein, 116 aa, Mycobacterium
TQAPSVSNNGVQGSSGQQGPQQSWDQPAHGTQIPDYQNAAPYTQGPGRPNPDFNPGSQGGQANPGSDAGSQGGQPNQGAQQPVQQPQQASQQPTQQDAGQQPNQSPDQSSDQQKID

SEQ ID NO: 291022 - protein, 10 aa, Mycobacterium
TQAPTASNAQ

SEQ ID NO: 291023 - protein, 8 aa, Mycobacterium
TQAPVAAA

SEQ ID NO: 291024 - protein, 4 aa, Mycobacterium
TQAR

SEQ ID NO: 291025 - protein, 7 aa, Mycobacterium
TQARADH

SEQ ID NO: 291026 - protein, 13 aa, Mycobacterium
TQARADSARARAN

SEQ ID NO: 291027 - protein, 9 aa, Mycobacterium
TQARDRQDR

SEQ ID NO: 291028 - protein, 22 aa, Mycobacterium
TQARPKAATPETIAPRKEEKRS

SEQ ID NO: 291029 - protein, 11 aa, Mycobacterium
TQARSDGELAA

SEQ ID NO: 291030 - protein, 4 aa, Mycobacterium
TQAS

SEQ ID NO: 291031 - protein, 5 aa, Mycobacterium
TQAST

SEQ ID NO: 291032 - protein, 6 aa, Mycobacterium
TQASYA

SEQ ID NO: 291033 - protein, 5 aa, Mycobacterium
TQATV

SEQ ID NO: 291034 - protein, 9 aa, Mycobacterium
TQAVGSAGT

SEQ ID NO: 291035 - protein, 11 aa, Mycobacterium
TQAVSGGQSGL

SEQ ID NO: 291036 - protein, 5 aa, Mycobacterium
TQAWK

SEQ ID NO: 291037 - protein, 7 aa, Mycobacterium
TQDFPAS

SEQ ID NO: 291038 - protein, 7 aa, Mycobacterium
TQDGTDV

SEQ ID NO: 291039 - protein, 7 aa, Mycobacterium
TQDGTSL

SEQ ID NO: 291040 - protein, 11 aa, Mycobacterium
TQDKPAAHAPL

SEQ ID NO: 291041 - protein, 9 aa, Mycobacterium
TQDMNEKVS

SEQ ID NO: 291042 - protein, 5 aa, Mycobacterium
TQDNP

SEQ ID NO: 291043 - protein, 25 aa, Mycobacterium
TQDPASTDASMRPDRDTNARRITPD

SEQ ID NO: 291044 - protein, 8 aa, Mycobacterium
TQDPSLPA

SEQ ID NO: 291045 - protein, 14 aa, Mycobacterium
TQDPVYAGTGYTSV

SEQ ID NO: 291046 - protein, 4 aa, Mycobacterium
TQDT

SEQ ID NO: 291047 - protein, 5 aa, Mycobacterium
TQDTN

SEQ ID NO: 291048 - protein, 11 aa, Mycobacterium
TQEAADGLSAA

SEQ ID NO: 291049 - protein, 12 aa, Mycobacterium
TQEDNSGEQRID

SEQ ID NO: 291050 - protein, 18 aa, Mycobacterium
TQEEATEDAERQGGSAPL

SEQ ID NO: 291051 - protein, 7 aa, Mycobacterium
TQEGTYA

SEQ ID NO: 291052 - protein, 4 aa, Mycobacterium
TQEL

SEQ ID NO: 291053 - protein, 18 aa, Mycobacterium
TQEPEPEKPGATVPAGQP

SEQ ID NO: 291054 - protein, 10 aa, Mycobacterium
TQESADAGGH

SEQ ID NO: 291055 - protein, 6 aa, Mycobacterium
TQEVSP

SEQ ID NO: 291056 - protein, 16 aa, Mycobacterium
TQFPGREGAGYPIEND

SEQ ID NO: 291057 - protein, 10 aa, Mycobacterium
TQGAPPSPLQ

SEQ ID NO: 291058 - protein, 8 aa, Mycobacterium
TQGENPAH

SEQ ID NO: 291059 - protein, 6 aa, Mycobacterium
TQGERT

SEQ ID NO: 291060 - protein, 26 aa, Mycobacterium
TQGGNRKPAARPGSSTAPAAPAAASR

SEQ ID NO: 291061 - protein, 17 aa, Mycobacterium
TQGKADHDGHSAHAPQV

SEQ ID NO: 291062 - protein, 4 aa, Mycobacterium
TQGN

SEQ ID NO: 291063 - protein, 21 aa, Mycobacterium
TQGPDDDDPGEAVRGERSGYD

SEQ ID NO: 291064 - protein, 6 aa, Mycobacterium
TQGPDV

SEQ ID NO: 291065 - protein, 6 aa, Mycobacterium
TQGPEV

SEQ ID NO: 291066 - protein, 5 aa, Mycobacterium
TQGPK

SEQ ID NO: 291067 - protein, 21 aa, Mycobacterium
TQGPKDAKPGQPRAGERGGYD

SEQ ID NO: 291068 - protein, 22 aa, Mycobacterium
TQGPNSEHPGSPLRGEKSGYDF

SEQ ID NO: 291069 - protein, 7 aa, Mycobacterium
TQGPTGQ

SEQ ID NO: 291070 - protein, 62 aa, Mycobacterium
TQGPYGPVPGGYPPPNVVTSEPNVHGPQPSPGVPAAAIPGQLSPEVPGARPPLPPAPPGART

SEQ ID NO: 291071 - protein, 6 aa, Mycobacterium
TQGSPT

SEQ ID NO: 291072 - protein, 16 aa, Mycobacterium
TQGSSGSTPVPSDTIA

SEQ ID NO: 291073 - protein, 9 aa, Mycobacterium
TQGTVRSPI

SEQ ID NO: 291074 - protein, 4 aa, Mycobacterium
TQGV

SEQ ID NO: 291075 - protein, 9 aa, Mycobacterium
TQHDAEQLR

SEQ ID NO: 291076 - protein, 9 aa, Mycobacterium
TQIETTQRQ

SEQ ID NO: 291077 - protein, 4 aa, Mycobacterium
TQIP

SEQ ID NO: 291078 - protein, 5 aa, Mycobacterium
TQITK

SEQ ID NO: 291079 - protein, 5 aa, Mycobacterium
TQKER

SEQ ID NO: 291080 - protein, 11 aa, Mycobacterium
TQLAENRPPQE

SEQ ID NO: 291081 - protein, 9 aa, Mycobacterium
TQLASTRGP

SEQ ID NO: 291082 - protein, 11 aa, Mycobacterium
TQLASTRPPAE

SEQ ID NO: 291083 - protein, 6 aa, Mycobacterium
TQLGES

SEQ ID NO: 291084 - protein, 14 aa, Mycobacterium
TQLGPNEDSVRGPL

SEQ ID NO: 291085 - protein, 6 aa, Mycobacterium
TQLRAD

SEQ ID NO: 291086 - protein, 6 aa, Mycobacterium
TQLRGG

SEQ ID NO: 291087 - protein, 15 aa, Mycobacterium
TQLSTVRSASGDPAL

SEQ ID NO: 291088 - protein, 63 aa, Mycobacterium
TQMAPAATDATQLAPSVDATQLAPAADATQPAPAAADATQMAPAASDATVATPTDAAGQVGPE

SEQ ID NO: 291089 - protein, 7 aa, Mycobacterium
TQMPGPT

SEQ ID NO: 291090 - protein, 8 aa, Mycobacterium
TQNPEATA

SEQ ID NO: 291091 - protein, 4 aa, Mycobacterium
TQNR

SEQ ID NO: 291092 - protein, 11 aa, Mycobacterium
TQNTNPGGPAF

SEQ ID NO: 291093 - protein, 4 aa, Mycobacterium
TQNV

SEQ ID NO: 291094 - protein, 5 aa, Mycobacterium
TQPAK

SEQ ID NO: 291095 - protein, 10 aa, Mycobacterium
TQPDGDPVVT

SEQ ID NO: 291096 - protein, 6 aa, Mycobacterium
TQPDKM

SEQ ID NO: 291097 - protein, 7 aa, Mycobacterium
TQPFEGD

SEQ ID NO: 291098 - protein, 7 aa, Mycobacterium
TQPGADL

SEQ ID NO: 291099 - protein, 6 aa, Mycobacterium
TQPGPR

SEQ ID NO: 291100 - protein, 17 aa, Mycobacterium
TQPGTTYDVSSPDLPTV

SEQ ID NO: 291101 - protein, 4 aa, Mycobacterium
TQPL

SEQ ID NO: 291102 - protein, 9 aa, Mycobacterium
TQPNPDARP

SEQ ID NO: 291103 - protein, 56 aa, Mycobacterium
TQPPASEGPAPAPVVPPGPPVGAPPPMPTPGQAPLAPSPGASPAPVAPTARPAPAR

SEQ ID NO: 291104 - protein, 10 aa, Mycobacterium
TQPPPDPGWD

SEQ ID NO: 291105 - protein, 11 aa, Mycobacterium
TQPPPDPSWDT

SEQ ID NO: 291106 - protein, 38 aa, Mycobacterium
TQPPPPPPAEAPPPPPPQTTEAPPPPPTTTTPAGPRQV

SEQ ID NO: 291107 - protein, 4 aa, Mycobacterium
TQPR

SEQ ID NO: 291108 - protein, 38 aa, Mycobacterium
TQPSRGPRKAQDGKAVRQPKRRAKQQHAGDVGEPKRFR

SEQ ID NO: 291109 - protein, 12 aa, Mycobacterium
TQPTAANDPVYA

SEQ ID NO: 291110 - protein, 12 aa, Mycobacterium
TQPTPGVGLTDD

SEQ ID NO: 291111 - protein, 7 aa, Mycobacterium
TQPYDYP

SEQ ID NO: 291112 - protein, 10 aa, Mycobacterium
TQPYESPSAA

SEQ ID NO: 291113 - protein, 12 aa, Mycobacterium
TQQADTAPLEDT

SEQ ID NO: 291114 - protein, 4 aa, Mycobacterium
TQQG

SEQ ID NO: 291115 - protein, 6 aa, Mycobacterium
TQQGLQ

SEQ ID NO: 291116 - protein, 12 aa, Mycobacterium
TQQKPDSEVPPD

SEQ ID NO: 291117 - protein, 5 aa, Mycobacterium
TQQPG

SEQ ID NO: 291118 - protein, 16 aa, Mycobacterium
TQQTYRELTSTSNCTT

SEQ ID NO: 291119 - protein, 4 aa, Mycobacterium
TQRA

SEQ ID NO: 291120 - protein, 9 aa, Mycobacterium
TQRADAPPG

SEQ ID NO: 291121 - protein, 9 aa, Mycobacterium
TQRADASLP

SEQ ID NO: 291122 - protein, 5 aa, Mycobacterium
TQRAE

SEQ ID NO: 291123 - protein, 6 aa, Mycobacterium
TQREPG

SEQ ID NO: 291124 - protein, 5 aa, Mycobacterium
TQRIQ

SEQ ID NO: 291125 - protein, 38 aa, Mycobacterium
TQRKPLSTGGREITGPHSGRAPLTPTGGRRDVFEMDTT

SEQ ID NO: 291126 - protein, 10 aa, Mycobacterium
TQRLTDGRIG

SEQ ID NO: 291127 - protein, 19 aa, Mycobacterium
TQRNAESRSTPLDSAQDVA

SEQ ID NO: 291128 - protein, 8 aa, Mycobacterium
TQRNSARS

SEQ ID NO: 291129 - protein, 15 aa, Mycobacterium
TQRPDQQPARRRAEL

SEQ ID NO: 291130 - protein, 4 aa, Mycobacterium
TQRQ

SEQ ID NO: 291131 - protein, 6 aa, Mycobacterium
TQRRRG

SEQ ID NO: 291132 - protein, 10 aa, Mycobacterium
TQRVTANADV

SEQ ID NO: 291133 - protein, 9 aa, Mycobacterium
TQRWDEKAG

SEQ ID NO: 291134 - protein, 5 aa, Mycobacterium
TQSAA

SEQ ID NO: 291135 - protein, 11 aa, Mycobacterium
TQSAPGRRPDT

SEQ ID NO: 291136 - protein, 9 aa, Mycobacterium
TQSDALDRV

SEQ ID NO: 291137 - protein, 4 aa, Mycobacterium
TQSE

SEQ ID NO: 291138 - protein, 4 aa, Mycobacterium
TQSG

SEQ ID NO: 291139 - protein, 15 aa, Mycobacterium
TQSGFYDDGSQSVKA

SEQ ID NO: 291140 - protein, 15 aa, Mycobacterium
TQSGFYDDSSQSVKA

SEQ ID NO: 291141 - protein, 7 aa, Mycobacterium
TQSIEST

SEQ ID NO: 291142 - protein, 10 aa, Mycobacterium
TQSKSVGTVT

SEQ ID NO: 291143 - protein, 28 aa, Mycobacterium
TQSSQSAIAATASTPPPPGEPAPVSPNR

SEQ ID NO: 291144 - protein, 12 aa, Mycobacterium
TQSVPGKPTDNA

SEQ ID NO: 291145 - protein, 6 aa, Mycobacterium
TQTAPP

SEQ ID NO: 291146 - protein, 6 aa, Mycobacterium
TQTAQA

SEQ ID NO: 291147 - protein, 4 aa, Mycobacterium
TQTE

SEQ ID NO: 291148 - protein, 5 aa, Mycobacterium
TQTGR

SEQ ID NO: 291149 - protein, 48 aa, Mycobacterium
TQTKTESKVSVATGAGGTGGLDSFTPQASAVPDSDAEREAERAGAAQT

SEQ ID NO: 291150 - protein, 8 aa, Mycobacterium
TQTPATAA

SEQ ID NO: 291151 - protein, 6 aa, Mycobacterium
TQTPKL

SEQ ID NO: 291152 - protein, 5 aa, Mycobacterium
TQTPS

SEQ ID NO: 291153 - protein, 6 aa, Mycobacterium
TQTPSA

SEQ ID NO: 291154 - protein, 15 aa, Mycobacterium
TQTPSAAGALSPAGL

SEQ ID NO: 291155 - protein, 8 aa, Mycobacterium
TQTPVAAA

SEQ ID NO: 291156 - protein, 5 aa, Mycobacterium
TQTQH

SEQ ID NO: 291157 - protein, 5 aa, Mycobacterium
TQTQN

SEQ ID NO: 291158 - protein, 8 aa, Mycobacterium
TQTSGGRV

SEQ ID NO: 291159 - protein, 6 aa, Mycobacterium
TQTSRY

SEQ ID NO: 291160 - protein, 4 aa, Mycobacterium
TQVA

SEQ ID NO: 291161 - protein, 13 aa, Mycobacterium
TQVADTGRNRAIA

SEQ ID NO: 291162 - protein, 6 aa, Mycobacterium
TQVATG

SEQ ID NO: 291163 - protein, 8 aa, Mycobacterium
TQVATGSV

SEQ ID NO: 291164 - protein, 4 aa, Mycobacterium
TQVG

SEQ ID NO: 291165 - protein, 6 aa, Mycobacterium
TQVGSE

SEQ ID NO: 291166 - protein, 7 aa, Mycobacterium
TQYNGQP

SEQ ID NO: 291167 - protein, 6 aa, Mycobacterium
TQYSEN

SEQ ID NO: 291168 - protein, 9 aa, Mycobacterium
TQYSGNPTF

SEQ ID NO: 291169 - protein, 4 aa, Mycobacterium
TQYT

SEQ ID NO: 291170 - protein, 9 aa, Mycobacterium
TRAADPAAM

SEQ ID NO: 291171 - protein, 6 aa, Mycobacterium
TRAAEP

SEQ ID NO: 291172 - protein, 4 aa, Mycobacterium
TRAD

SEQ ID NO: 291173 - protein, 7 aa, Mycobacterium
TRADDQS

SEQ ID NO: 291174 - protein, 6 aa, Mycobacterium
TRAFSA

SEQ ID NO: 291175 - protein, 23 aa, Mycobacterium
TRAGANSAMGAGDTSDAEGTRSD

SEQ ID NO: 291176 - protein, 23 aa, Mycobacterium
TRAGANSNVGAGDTEDAGGARSD

SEQ ID NO: 291177 - protein, 17 aa, Mycobacterium
TRAGEHATTPLPRPRAG

SEQ ID NO: 291178 - protein, 5 aa, Mycobacterium
TRAGG

SEQ ID NO: 291179 - protein, 9 aa, Mycobacterium
TRAGGAPLR

SEQ ID NO: 291180 - protein, 12 aa, Mycobacterium
TRAGGRPAGRSV

SEQ ID NO: 291181 - protein, 6 aa, Mycobacterium
TRAGRG

SEQ ID NO: 291182 - protein, 8 aa, Mycobacterium
TRAGRHDQ

SEQ ID NO: 291183 - protein, 10 aa, Mycobacterium
TRAGRSAFSP

SEQ ID NO: 291184 - protein, 11 aa, Mycobacterium
TRAGRSPFSPD

SEQ ID NO: 291185 - protein, 11 aa, Mycobacterium
TRAGRSPLSPD

SEQ ID NO: 291186 - protein, 6 aa, Mycobacterium
TRAGRT

SEQ ID NO: 291187 - protein, 4 aa, Mycobacterium
TRAL

SEQ ID NO: 291188 - protein, 12 aa, Mycobacterium
TRALDGYADAPE

SEQ ID NO: 291189 - protein, 6 aa, Mycobacterium
TRAPDS

SEQ ID NO: 291190 - protein, 19 aa, Mycobacterium
TRAPGAPGDSAPAFPGELG

SEQ ID NO: 291191 - protein, 14 aa, Mycobacterium
TRAPHSGDARTPGV

SEQ ID NO: 291192 - protein, 6 aa, Mycobacterium
TRAPLT

SEQ ID NO: 291193 - protein, 11 aa, Mycobacterium
TRAPRLGEHSN

SEQ ID NO: 291194 - protein, 13 aa, Mycobacterium
TRAPSSGRATVDG

SEQ ID NO: 291195 - protein, 7 aa, Mycobacterium
TRAQGPG

SEQ ID NO: 291196 - protein, 9 aa, Mycobacterium
TRAQSNPST

SEQ ID NO: 291197 - protein, 5 aa, Mycobacterium
TRARA

SEQ ID NO: 291198 - protein, 10 aa, Mycobacterium
TRARRAGTSV

SEQ ID NO: 291199 - protein, 18 aa, Mycobacterium
TRARSSRRRHVEPRSHRL

SEQ ID NO: 291200 - protein, 9 aa, Mycobacterium
TRASSGLTD

SEQ ID NO: 291201 - protein, 12 aa, Mycobacterium
TRASSGLTDEPQ

SEQ ID NO: 291202 - protein, 10 aa, Mycobacterium
TRDAAVDEPD

SEQ ID NO: 291203 - protein, 7 aa, Mycobacterium
TRDAPAL

SEQ ID NO: 291204 - protein, 7 aa, Mycobacterium
TRDDAGQ

SEQ ID NO: 291205 - protein, 40 aa, Mycobacterium
TRDDGDVAVPASTSTPVTTTEEVPPPPPPEAVDQPAPVQT

SEQ ID NO: 291206 - protein, 6 aa, Mycobacterium
TRDDPL

SEQ ID NO: 291207 - protein, 8 aa, Mycobacterium
TRDDPSRP

SEQ ID NO: 291208 - protein, 6 aa, Mycobacterium
TRDEAM

SEQ ID NO: 291209 - protein, 12 aa, Mycobacterium
TRDEDAPASAFP

SEQ ID NO: 291210 - protein, 6 aa, Mycobacterium
TRDEIG

SEQ ID NO: 291211 - protein, 7 aa, Mycobacterium
TRDEIGE

SEQ ID NO: 291212 - protein, 5 aa, Mycobacterium
TRDFS

SEQ ID NO: 291213 - protein, 9 aa, Mycobacterium
TRDGKTQTA

SEQ ID NO: 291214 - protein, 7 aa, Mycobacterium
TRDNSDA

SEQ ID NO: 291215 - protein, 8 aa, Mycobacterium
TRDNSDAF

SEQ ID NO: 291216 - protein, 7 aa, Mycobacterium
TRDRSAA

SEQ ID NO: 291217 - protein, 27 aa, Mycobacterium
TRDSAAQGGYQLKSSGVSWTDPAEAAA

SEQ ID NO: 291218 - protein, 22 aa, Mycobacterium
TRDTPSDAALDGARREGESRGE

SEQ ID NO: 291219 - protein, 4 aa, Mycobacterium
TRDY

SEQ ID NO: 291220 - protein, 6 aa, Mycobacterium
TRDYSN

SEQ ID NO: 291221 - protein, 5 aa, Mycobacterium
TRDYY

SEQ ID NO: 291222 - protein, 11 aa, Mycobacterium
TREANRNLRQA

SEQ ID NO: 291223 - protein, 43 aa, Mycobacterium
TREAPVKEATACNPPAAQTEPGSGTIGKPVSRSSLTGTSAATL

SEQ ID NO: 291224 - protein, 4 aa, Mycobacterium
TRED

SEQ ID NO: 291225 - protein, 13 aa, Mycobacterium
TREDAGGITPEPV

SEQ ID NO: 291226 - protein, 11 aa, Mycobacterium
TREEKHSTRGR

SEQ ID NO: 291227 - protein, 9 aa, Mycobacterium
TREGAADAG

SEQ ID NO: 291228 - protein, 7 aa, Mycobacterium
TREGAAL

SEQ ID NO: 291229 - protein, 10 aa, Mycobacterium
TREGAGEGGY

SEQ ID NO: 291230 - protein, 12 aa, Mycobacterium
TREGASEGGYQL

SEQ ID NO: 291231 - protein, 6 aa, Mycobacterium
TREGAV

SEQ ID NO: 291232 - protein, 14 aa, Mycobacterium
TREGAYEGGYQLTS

SEQ ID NO: 291233 - protein, 28 aa, Mycobacterium
TRENARQTASSGGCGSESACGSCTLSCG

SEQ ID NO: 291234 - protein, 7 aa, Mycobacterium
TREPSQT

SEQ ID NO: 291235 - protein, 12 aa, Mycobacterium
TRESAAQGGYRL

SEQ ID NO: 291236 - protein, 10 aa, Mycobacterium
TRESAETGGH

SEQ ID NO: 291237 - protein, 7 aa, Mycobacterium
TRETGMD

SEQ ID NO: 291238 - protein, 10 aa, Mycobacterium
TRETVTPQAR

SEQ ID NO: 291239 - protein, 16 aa, Mycobacterium
TREVRHPSAGTAHRHT

SEQ ID NO: 291240 - protein, 6 aa, Mycobacterium
TREVRS

SEQ ID NO: 291241 - protein, 12 aa, Mycobacterium
TRFARTQDPGEK

SEQ ID NO: 291242 - protein, 6 aa, Mycobacterium
TRFTPD

SEQ ID NO: 291243 - protein, 6 aa, Mycobacterium
TRFTRE

SEQ ID NO: 291244 - protein, 10 aa, Mycobacterium
TRGAAPGLDE

SEQ ID NO: 291245 - protein, 13 aa, Mycobacterium
TRGAAQSQDGKAA

SEQ ID NO: 291246 - protein, 15 aa, Mycobacterium
TRGANAAKPASDNQA

SEQ ID NO: 291247 - protein, 7 aa, Mycobacterium
TRGDAGE

SEQ ID NO: 291248 - protein, 7 aa, Mycobacterium
TRGDGGF

SEQ ID NO: 291249 - protein, 6 aa, Mycobacterium
TRGDPL

SEQ ID NO: 291250 - protein, 7 aa, Mycobacterium
TRGDRRR

SEQ ID NO: 291251 - protein, 4 aa, Mycobacterium
TRGG

SEQ ID NO: 291252 - protein, 11 aa, Mycobacterium
TRGGPGTETET

SEQ ID NO: 291253 - protein, 10 aa, Mycobacterium
TRGGPRKRAE

SEQ ID NO: 291254 - protein, 13 aa, Mycobacterium
TRGGPTSARLGQP

SEQ ID NO: 291255 - protein, 8 aa, Mycobacterium
TRGGQPRL

SEQ ID NO: 291256 - protein, 19 aa, Mycobacterium
TRGGQQTALPTAVGAGTVA

SEQ ID NO: 291257 - protein, 10 aa, Mycobacterium
TRGGTDTDAR

SEQ ID NO: 291258 - protein, 19 aa, Mycobacterium
TRGHKSANPAASAVSPQSL

SEQ ID NO: 291259 - protein, 20 aa, Mycobacterium
TRGHSSRKAPLIEGETSEGA

SEQ ID NO: 291260 - protein, 8 aa, Mycobacterium
TRGKGTAA

SEQ ID NO: 291261 - protein, 8 aa, Mycobacterium
TRGKNLET

SEQ ID NO: 291262 - protein, 6 aa, Mycobacterium
TRGLGG

SEQ ID NO: 291263 - protein, 11 aa, Mycobacterium
TRGLGSGRVTV

SEQ ID NO: 291264 - protein, 15 aa, Mycobacterium
TRGNQGEALANESVE

SEQ ID NO: 291265 - protein, 5 aa, Mycobacterium
TRGRG

SEQ ID NO: 291266 - protein, 5 aa, Mycobacterium
TRGSP

SEQ ID NO: 291267 - protein, 9 aa, Mycobacterium
TRGSSSYSY

SEQ ID NO: 291268 - protein, 4 aa, Mycobacterium
TRGT

SEQ ID NO: 291269 - protein, 8 aa, Mycobacterium
TRGTASAL

SEQ ID NO: 291270 - protein, 12 aa, Mycobacterium
TRGVPDQPLERA

SEQ ID NO: 291271 - protein, 12 aa, Mycobacterium
TRHRPDSPTAGG

SEQ ID NO: 291272 - protein, 15 aa, Mycobacterium
TRHRRGGRDDMAVPP

SEQ ID NO: 291273 - protein, 6 aa, Mycobacterium
TRIEPG

SEQ ID NO: 291274 - protein, 4 aa, Mycobacterium
TRIG

SEQ ID NO: 291275 - protein, 4 aa, Mycobacterium
TRIP

SEQ ID NO: 291276 - protein, 5 aa, Mycobacterium
TRIQA

SEQ ID NO: 291277 - protein, 14 aa, Mycobacterium
TRISGDGSNISAGE

SEQ ID NO: 291278 - protein, 7 aa, Mycobacterium
TRISGQA

SEQ ID NO: 291279 - protein, 28 aa, Mycobacterium
TRKDPTAKAHPGSLRASRKRPEEQRDAT

SEQ ID NO: 291280 - protein, 7 aa, Mycobacterium
TRKPDLD

SEQ ID NO: 291281 - protein, 9 aa, Mycobacterium
TRKPIGDPL

SEQ ID NO: 291282 - protein, 20 aa, Mycobacterium
TRLETESVDQRQETAGTELA

SEQ ID NO: 291283 - protein, 11 aa, Mycobacterium
TRLGDKPDSAT

SEQ ID NO: 291284 - protein, 7 aa, Mycobacterium
TRLPGKY

SEQ ID NO: 291285 - protein, 5 aa, Mycobacterium
TRLPS

SEQ ID NO: 291286 - protein, 4 aa, Mycobacterium
TRLS

SEQ ID NO: 291287 - protein, 5 aa, Mycobacterium
TRMSG

SEQ ID NO: 291288 - protein, 18 aa, Mycobacterium
TRNASIPAGDNNNPCFAN

SEQ ID NO: 291289 - protein, 6 aa, Mycobacterium
TRNGGI

SEQ ID NO: 291290 - protein, 8 aa, Mycobacterium
TRNGPAER

SEQ ID NO: 291291 - protein, 17 aa, Mycobacterium
TRNGQTTTVPISGPPTS

SEQ ID NO: 291292 - protein, 9 aa, Mycobacterium
TRNGVATEN

SEQ ID NO: 291293 - protein, 6 aa, Mycobacterium
TRNPAY

SEQ ID NO: 291294 - protein, 19 aa, Mycobacterium
TRNSTQMGQALDGSKNDDS

SEQ ID NO: 291295 - protein, 15 aa, Mycobacterium
TRPAASTGRKRVQGG

SEQ ID NO: 291296 - protein, 5 aa, Mycobacterium
TRPAG

SEQ ID NO: 291297 - protein, 16 aa, Mycobacterium
TRPAGKPLTETTTGYQ

SEQ ID NO: 291298 - protein, 25 aa, Mycobacterium
TRPAPKPFGPKPTGADDTTGPIPVS

SEQ ID NO: 291299 - protein, 10 aa, Mycobacterium
TRPAPVVTPA

SEQ ID NO: 291300 - protein, 12 aa, Mycobacterium
TRPARARPVRPQ

SEQ ID NO: 291301 - protein, 25 aa, Mycobacterium
TRPARTPSSPTADPEPDRALAMSGE

SEQ ID NO: 291302 - protein, 12 aa, Mycobacterium
TRPASSESSGVH

SEQ ID NO: 291303 - protein, 7 aa, Mycobacterium
TRPCGPN

SEQ ID NO: 291304 - protein, 4 aa, Mycobacterium
TRPD

SEQ ID NO: 291305 - protein, 9 aa, Mycobacterium
TRPDGAPIQ

SEQ ID NO: 291306 - protein, 9 aa, Mycobacterium
TRPDGGIQP

SEQ ID NO: 291307 - protein, 10 aa, Mycobacterium
TRPDGKPIKH

SEQ ID NO: 291308 - protein, 8 aa, Mycobacterium
TRPDGTAM

SEQ ID NO: 291309 - protein, 8 aa, Mycobacterium
TRPDGTTL

SEQ ID NO: 291310 - protein, 6 aa, Mycobacterium
TRPDLK

SEQ ID NO: 291311 - protein, 7 aa, Mycobacterium
TRPDRRT

SEQ ID NO: 291312 - protein, 10 aa, Mycobacterium
TRPEGSPIER

SEQ ID NO: 291313 - protein, 9 aa, Mycobacterium
TRPEGTPMD

SEQ ID NO: 291314 - protein, 17 aa, Mycobacterium
TRPEINQESPAINLESR

SEQ ID NO: 291315 - protein, 20 aa, Mycobacterium
TRPFDGRRGDLAPVDNNAAK

SEQ ID NO: 291316 - protein, 7 aa, Mycobacterium
TRPGASS

SEQ ID NO: 291317 - protein, 5 aa, Mycobacterium
TRPGE

SEQ ID NO: 291318 - protein, 6 aa, Mycobacterium
TRPGFR

SEQ ID NO: 291319 - protein, 5 aa, Mycobacterium
TRPGN

SEQ ID NO: 291320 - protein, 6 aa, Mycobacterium
TRPGTH

SEQ ID NO: 291321 - protein, 7 aa, Mycobacterium
TRPGTRN

SEQ ID NO: 291322 - protein, 5 aa, Mycobacterium
TRPGV

SEQ ID NO: 291323 - protein, 6 aa, Mycobacterium
TRPGVR

SEQ ID NO: 291324 - protein, 4 aa, Mycobacterium
TRPH

SEQ ID NO: 291325 - protein, 15 aa, Mycobacterium
TRPHAGETMKDARNL

SEQ ID NO: 291326 - protein, 10 aa, Mycobacterium
TRPKGEPLEE

SEQ ID NO: 291327 - protein, 12 aa, Mycobacterium
TRPKGSTPPQGQ

SEQ ID NO: 291328 - protein, 9 aa, Mycobacterium
TRPKGTPIE

SEQ ID NO: 291329 - protein, 12 aa, Mycobacterium
TRPKLDPDGDYR

SEQ ID NO: 291330 - protein, 4 aa, Mycobacterium
TRPL

SEQ ID NO: 291331 - protein, 6 aa, Mycobacterium
TRPLAG

SEQ ID NO: 291332 - protein, 9 aa, Mycobacterium
TRPLGSPID

SEQ ID NO: 291333 - protein, 12 aa, Mycobacterium
TRPLHEPGERTR

SEQ ID NO: 291334 - protein, 6 aa, Mycobacterium
TRPNAQ

SEQ ID NO: 291335 - protein, 11 aa, Mycobacterium
TRPNGEPLEQT

SEQ ID NO: 291336 - protein, 5 aa, Mycobacterium
TRPPA

SEQ ID NO: 291337 - protein, 22 aa, Mycobacterium
TRPPAGPPPAESPHGHDDDHSH

SEQ ID NO: 291338 - protein, 12 aa, Mycobacterium
TRPPEKDMSSPG

SEQ ID NO: 291339 - protein, 11 aa, Mycobacterium
TRPPRDPDQPL

SEQ ID NO: 291340 - protein, 14 aa, Mycobacterium
TRPPRRPHRGPSGH

SEQ ID NO: 291341 - protein, 59 aa, Mycobacterium
TRPQRPTGKRSRQRASDAGEGADVASADEAEVAKEAKATKGGKAKKAKKPKKPGDRSAN

SEQ ID NO: 291342 - protein, 60 aa, Mycobacterium
TRPQRPTGKRSRRAVEADDDADESPETDSSGSGSKDDDGRGPKARKKTSKRPKDQPSRNP

SEQ ID NO: 291343 - protein, 8 aa, Mycobacterium
TRPSAARR

SEQ ID NO: 291344 - protein, 10 aa, Mycobacterium
TRPSDDESVE

SEQ ID NO: 291345 - protein, 9 aa, Mycobacterium
TRPSGTTMD

SEQ ID NO: 291346 - protein, 7 aa, Mycobacterium
TRPTGEM

SEQ ID NO: 291347 - protein, 10 aa, Mycobacterium
TRPTMSPGRR

SEQ ID NO: 291348 - protein, 6 aa, Mycobacterium
TRPTPN

SEQ ID NO: 291349 - protein, 22 aa, Mycobacterium
TRPTRPTAVKPRRPDPPDHLPS

SEQ ID NO: 291350 - protein, 7 aa, Mycobacterium
TRPTRRD

SEQ ID NO: 291351 - protein, 21 aa, Mycobacterium
TRPTTRLSTQRAGRPKAHTPG

SEQ ID NO: 291352 - protein, 5 aa, Mycobacterium
TRPVA

SEQ ID NO: 291353 - protein, 23 aa, Mycobacterium
TRPVPAPWPRSGGLQSDPSEGVR

SEQ ID NO: 291354 - protein, 5 aa, Mycobacterium
TRPVS

SEQ ID NO: 291355 - protein, 5 aa, Mycobacterium
TRQAE

SEQ ID NO: 291356 - protein, 7 aa, Mycobacterium
TRQARDA

SEQ ID NO: 291357 - protein, 4 aa, Mycobacterium
TRQE

SEQ ID NO: 291358 - protein, 8 aa, Mycobacterium
TRQESTGV

SEQ ID NO: 291359 - protein, 12 aa, Mycobacterium
TRQGAAEGGYQL

SEQ ID NO: 291360 - protein, 7 aa, Mycobacterium
TRQGQVQ

SEQ ID NO: 291361 - protein, 4 aa, Mycobacterium
TRQL

SEQ ID NO: 291362 - protein, 14 aa, Mycobacterium
TRQNSRLPSGTPEY

SEQ ID NO: 291363 - protein, 9 aa, Mycobacterium
TRQPNPAGA

SEQ ID NO: 291364 - protein, 9 aa, Mycobacterium
TRQPNPGGA

SEQ ID NO: 291365 - protein, 13 aa, Mycobacterium
TRQPPDLAGAAER

SEQ ID NO: 291366 - protein, 16 aa, Mycobacterium
TRQPVTPHATRRRRRR

SEQ ID NO: 291367 - protein, 6 aa, Mycobacterium
TRQQSA

SEQ ID NO: 291368 - protein, 9 aa, Mycobacterium
TRQQSNPST

SEQ ID NO: 291369 - protein, 5 aa, Mycobacterium
TRQRA

SEQ ID NO: 291370 - protein, 12 aa, Mycobacterium
TRQSGRLDTPGY

SEQ ID NO: 291371 - protein, 13 aa, Mycobacterium
TRQSGRLPETPAY

SEQ ID NO: 291372 - protein, 20 aa, Mycobacterium
TRQVGSGGTQDPKICTPDSD

SEQ ID NO: 291373 - protein, 11 aa, Mycobacterium
TRRAAPDSLHA

SEQ ID NO: 291374 - protein, 9 aa, Mycobacterium
TRRAGPAAL

SEQ ID NO: 291375 - protein, 4 aa, Mycobacterium
TRRD

SEQ ID NO: 291376 - protein, 10 aa, Mycobacterium
TRREPPDQRD

SEQ ID NO: 291377 - protein, 10 aa, Mycobacterium
TRRGGEAAGP

SEQ ID NO: 291378 - protein, 10 aa, Mycobacterium
TRRGGSPGWY

SEQ ID NO: 291379 - protein, 21 aa, Mycobacterium
TRRGSIGPEARTRLAEAGRRL

SEQ ID NO: 291380 - protein, 5 aa, Mycobacterium
TRRHR

SEQ ID NO: 291381 - protein, 15 aa, Mycobacterium
TRRHRRQQQAEEIRE

SEQ ID NO: 291382 - protein, 6 aa, Mycobacterium
TRRLGG

SEQ ID NO: 291383 - protein, 12 aa, Mycobacterium
TRRPARPPQPTL

SEQ ID NO: 291384 - protein, 4 aa, Mycobacterium
TRRQ

SEQ ID NO: 291385 - protein, 6 aa, Mycobacterium
TRRQTL

SEQ ID NO: 291386 - protein, 20 aa, Mycobacterium
TRRRAARPAGPTGEVSAEPI

SEQ ID NO: 291387 - protein, 9 aa, Mycobacterium
TRRRDASTA

SEQ ID NO: 291388 - protein, 7 aa, Mycobacterium
TRRRGSA

SEQ ID NO: 291389 - protein, 8 aa, Mycobacterium
TRRRPSMV

SEQ ID NO: 291390 - protein, 5 aa, Mycobacterium
TRRRR

SEQ ID NO: 291391 - protein, 7 aa, Mycobacterium
TRRRRAR

SEQ ID NO: 291392 - protein, 4 aa, Mycobacterium
TRRS

SEQ ID NO: 291393 - protein, 5 aa, Mycobacterium
TRRSD

SEQ ID NO: 291394 - protein, 8 aa, Mycobacterium
TRRSEWPQ

SEQ ID NO: 291395 - protein, 5 aa, Mycobacterium
TRRTQ

SEQ ID NO: 291396 - protein, 8 aa, Mycobacterium
TRRVPRAG

SEQ ID NO: 291397 - protein, 15 aa, Mycobacterium
TRSAATLPDGSQTDL

SEQ ID NO: 291398 - protein, 7 aa, Mycobacterium
TRSARPE

SEQ ID NO: 291399 - protein, 8 aa, Mycobacterium
TRSDLGDQ

SEQ ID NO: 291400 - protein, 8 aa, Mycobacterium
TRSDPSRP

SEQ ID NO: 291401 - protein, 4 aa, Mycobacterium
TRSF

SEQ ID NO: 291402 - protein, 4 aa, Mycobacterium
TRSG

SEQ ID NO: 291403 - protein, 11 aa, Mycobacterium
TRSGPDSIRLG

SEQ ID NO: 291404 - protein, 6 aa, Mycobacterium
TRSGPE

SEQ ID NO: 291405 - protein, 6 aa, Mycobacterium
TRSLAT

SEQ ID NO: 291406 - protein, 15 aa, Mycobacterium
TRSNGPAAARNTGLA

SEQ ID NO: 291407 - protein, 7 aa, Mycobacterium
TRSPGDG

SEQ ID NO: 291408 - protein, 6 aa, Mycobacterium
TRSPKS

SEQ ID NO: 291409 - protein, 5 aa, Mycobacterium
TRSPR

SEQ ID NO: 291410 - protein, 7 aa, Mycobacterium
TRSRGRT

SEQ ID NO: 291411 - protein, 12 aa, Mycobacterium
TRSRRSRQLSPA

SEQ ID NO: 291412 - protein, 20 aa, Mycobacterium
TRSSGSESGVVTETQARDAI

SEQ ID NO: 291413 - protein, 5 aa, Mycobacterium
TRSSP

SEQ ID NO: 291414 - protein, 6 aa, Mycobacterium
TRSSPL

SEQ ID NO: 291415 - protein, 8 aa, Mycobacterium
TRSSQDQC

SEQ ID NO: 291416 - protein, 7 aa, Mycobacterium
TRSTDYT

SEQ ID NO: 291417 - protein, 5 aa, Mycobacterium
TRSTN

SEQ ID NO: 291418 - protein, 6 aa, Mycobacterium
TRSTND

SEQ ID NO: 291419 - protein, 7 aa, Mycobacterium
TRSTNDV

SEQ ID NO: 291420 - protein, 7 aa, Mycobacterium
TRSTRLP

SEQ ID NO: 291421 - protein, 14 aa, Mycobacterium
TRSVSNAIASGAQV

SEQ ID NO: 291422 - protein, 8 aa, Mycobacterium
TRTAPGRA

SEQ ID NO: 291423 - protein, 4 aa, Mycobacterium
TRTD

SEQ ID NO: 291424 - protein, 10 aa, Mycobacterium
TRTEEGYRVN

SEQ ID NO: 291425 - protein, 5 aa, Mycobacterium
TRTEL

SEQ ID NO: 291426 - protein, 9 aa, Mycobacterium
TRTGAANEY

SEQ ID NO: 291427 - protein, 7 aa, Mycobacterium
TRTGAAT

SEQ ID NO: 291428 - protein, 10 aa, Mycobacterium
TRTGAGGPWS

SEQ ID NO: 291429 - protein, 5 aa, Mycobacterium
TRTGD

SEQ ID NO: 291430 - protein, 6 aa, Mycobacterium
TRTGGL

SEQ ID NO: 291431 - protein, 8 aa, Mycobacterium
TRTGKGQV

SEQ ID NO: 291432 - protein, 6 aa, Mycobacterium
TRTGLS

SEQ ID NO: 291433 - protein, 10 aa, Mycobacterium
TRTGLSQTEQ

SEQ ID NO: 291434 - protein, 8 aa, Mycobacterium
TRTGPAER

SEQ ID NO: 291435 - protein, 6 aa, Mycobacterium
TRTGQS

SEQ ID NO: 291436 - protein, 9 aa, Mycobacterium
TRTGQTVDD

SEQ ID NO: 291437 - protein, 8 aa, Mycobacterium
TRTGVGGP

SEQ ID NO: 291438 - protein, 6 aa, Mycobacterium
TRTHHP

SEQ ID NO: 291439 - protein, 7 aa, Mycobacterium
TRTKDSA

SEQ ID NO: 291440 - protein, 12 aa, Mycobacterium
TRTLQKPDSIVP

SEQ ID NO: 291441 - protein, 4 aa, Mycobacterium
TRTM

SEQ ID NO: 291442 - protein, 14 aa, Mycobacterium
TRTMSRGRKVSPDR

SEQ ID NO: 291443 - protein, 13 aa, Mycobacterium
TRTPAGSAALSGF

SEQ ID NO: 291444 - protein, 5 aa, Mycobacterium
TRTPQ

SEQ ID NO: 291445 - protein, 6 aa, Mycobacterium
TRTPTR

SEQ ID NO: 291446 - protein, 5 aa, Mycobacterium
TRTPV

SEQ ID NO: 291447 - protein, 5 aa, Mycobacterium
TRTQV

SEQ ID NO: 291448 - protein, 4 aa, Mycobacterium
TRTR

SEQ ID NO: 291449 - protein, 5 aa, Mycobacterium
TRTRL

SEQ ID NO: 291450 - protein, 28 aa, Mycobacterium
TRTRNGGAEEPVRDEPDPVPGAAEEPSA

SEQ ID NO: 291451 - protein, 5 aa, Mycobacterium
TRTRR

SEQ ID NO: 291452 - protein, 9 aa, Mycobacterium
TRTTKAHGV

SEQ ID NO: 291453 - protein, 9 aa, Mycobacterium
TRTTTDVQT

SEQ ID NO: 291454 - protein, 24 aa, Mycobacterium
TRTVPVPEPDPLPSPHTLNLPEQQ

SEQ ID NO: 291455 - protein, 9 aa, Mycobacterium
TRVDERKAD

SEQ ID NO: 291456 - protein, 7 aa, Mycobacterium
TRVEAAG

SEQ ID NO: 291457 - protein, 12 aa, Mycobacterium
TRVSEAEAGLRS

SEQ ID NO: 291458 - protein, 13 aa, Mycobacterium
TRWGTGRSDKDTA

SEQ ID NO: 291459 - protein, 13 aa, Mycobacterium
TRYAGGATRPGAV

SEQ ID NO: 291460 - protein, 5 aa, Mycobacterium
TRYPA

SEQ ID NO: 291461 - protein, 13 aa, Mycobacterium
TRYRAPTKQEEEL

SEQ ID NO: 291462 - protein, 6 aa, Mycobacterium
TRYRSD

SEQ ID NO: 291463 - protein, 4 aa, Mycobacterium
TSAA

SEQ ID NO: 291464 - protein, 10 aa, Mycobacterium
TSAAAGPLRR

SEQ ID NO: 291465 - protein, 6 aa, Mycobacterium
TSAAAT

SEQ ID NO: 291466 - protein, 6 aa, Mycobacterium
TSAAEE

SEQ ID NO: 291467 - protein, 12 aa, Mycobacterium
TSAAPAPAPRRR

SEQ ID NO: 291468 - protein, 6 aa, Mycobacterium
TSAAPE

SEQ ID NO: 291469 - protein, 15 aa, Mycobacterium
TSAASAEIAAAQQNL

SEQ ID NO: 291470 - protein, 7 aa, Mycobacterium
TSADAPV

SEQ ID NO: 291471 - protein, 8 aa, Mycobacterium
TSADAPVR

SEQ ID NO: 291472 - protein, 17 aa, Mycobacterium
TSADEIGAEVEQALGMR

SEQ ID NO: 291473 - protein, 15 aa, Mycobacterium
TSADGATGEAARAVG

SEQ ID NO: 291474 - protein, 19 aa, Mycobacterium
TSADGRNWVPGSASVEGPR

SEQ ID NO: 291475 - protein, 8 aa, Mycobacterium
TSADLGAA

SEQ ID NO: 291476 - protein, 9 aa, Mycobacterium
TSADPAKPI

SEQ ID NO: 291477 - protein, 6 aa, Mycobacterium
TSADPL

SEQ ID NO: 291478 - protein, 15 aa, Mycobacterium
TSADVTGPVRLVGAS

SEQ ID NO: 291479 - protein, 7 aa, Mycobacterium
TSADYAA

SEQ ID NO: 291480 - protein, 20 aa, Mycobacterium
TSADYAATAAEHEAAAGAYA

SEQ ID NO: 291481 - protein, 20 aa, Mycobacterium
TSADYAATAAEHEAAAGAYT

SEQ ID NO: 291482 - protein, 5 aa, Mycobacterium
TSAFT

SEQ ID NO: 291483 - protein, 4 aa, Mycobacterium
TSAG

SEQ ID NO: 291484 - protein, 13 aa, Mycobacterium
TSAGAGVNPVPTD

SEQ ID NO: 291485 - protein, 12 aa, Mycobacterium
TSAGQAVADLSP

SEQ ID NO: 291486 - protein, 5 aa, Mycobacterium
TSAGR

SEQ ID NO: 291487 - protein, 6 aa, Mycobacterium
TSAGTA

SEQ ID NO: 291488 - protein, 8 aa, Mycobacterium
TSAGTPVS

SEQ ID NO: 291489 - protein, 5 aa, Mycobacterium
TSAGV

SEQ ID NO: 291490 - protein, 12 aa, Mycobacterium
TSAIGPATGREF

SEQ ID NO: 291491 - protein, 15 aa, Mycobacterium
TSAKFSPRTPGGDPL

SEQ ID NO: 291492 - protein, 6 aa, Mycobacterium
TSALDA

SEQ ID NO: 291493 - protein, 8 aa, Mycobacterium
TSALDAGQ

SEQ ID NO: 291494 - protein, 7 aa, Mycobacterium
TSALDPG

SEQ ID NO: 291495 - protein, 7 aa, Mycobacterium
TSALDSG

SEQ ID NO: 291496 - protein, 9 aa, Mycobacterium
TSALDTENE

SEQ ID NO: 291497 - protein, 24 aa, Mycobacterium
TSALDTENETAVTEAIGSDPRART

SEQ ID NO: 291498 - protein, 15 aa, Mycobacterium
TSALTGESVPEHPAV

SEQ ID NO: 291499 - protein, 4 aa, Mycobacterium
TSAP

SEQ ID NO: 291500 - protein, 19 aa, Mycobacterium
TSAPAADDSRNAPGAHFGP

SEQ ID NO: 291501 - protein, 5 aa, Mycobacterium
TSAPE

SEQ ID NO: 291502 - protein, 6 aa, Mycobacterium
TSAPEL

SEQ ID NO: 291503 - protein, 8 aa, Mycobacterium
TSAPLDDQ

SEQ ID NO: 291504 - protein, 5 aa, Mycobacterium
TSAPR

SEQ ID NO: 291505 - protein, 10 aa, Mycobacterium
TSAPRATPQD

SEQ ID NO: 291506 - protein, 13 aa, Mycobacterium
TSAPSGAPPTAGM

SEQ ID NO: 291507 - protein, 8 aa, Mycobacterium
TSAPVDAS

SEQ ID NO: 291508 - protein, 8 aa, Mycobacterium
TSAQETNI

SEQ ID NO: 291509 - protein, 6 aa, Mycobacterium
TSAQEY

SEQ ID NO: 291510 - protein, 4 aa, Mycobacterium
TSAR

SEQ ID NO: 291511 - protein, 6 aa, Mycobacterium
TSARAI

SEQ ID NO: 291512 - protein, 9 aa, Mycobacterium
TSARALRDG

SEQ ID NO: 291513 - protein, 10 aa, Mycobacterium
TSARAMPGSG

SEQ ID NO: 291514 - protein, 24 aa, Mycobacterium
TSARPDRPAPVRATRPAETASTRI

SEQ ID NO: 291515 - protein, 11 aa, Mycobacterium
TSARSGALDET

SEQ ID NO: 291516 - protein, 7 aa, Mycobacterium
TSARTIT

SEQ ID NO: 291517 - protein, 7 aa, Mycobacterium
TSASTAS

SEQ ID NO: 291518 - protein, 9 aa, Mycobacterium
TSASTASRA

SEQ ID NO: 291519 - protein, 6 aa, Mycobacterium
TSASTI

SEQ ID NO: 291520 - protein, 10 aa, Mycobacterium
TSASVSDRIG

SEQ ID NO: 291521 - protein, 8 aa, Mycobacterium
TSATLGTA

SEQ ID NO: 291522 - protein, 7 aa, Mycobacterium
TSATQTQ

SEQ ID NO: 291523 - protein, 9 aa, Mycobacterium
TSATTPREA

SEQ ID NO: 291524 - protein, 6 aa, Mycobacterium
TSATTW

SEQ ID NO: 291525 - protein, 5 aa, Mycobacterium
TSAVA

SEQ ID NO: 291526 - protein, 12 aa, Mycobacterium
TSAVSSDTGRDF

SEQ ID NO: 291527 - protein, 9 aa, Mycobacterium
TSDADTARV

SEQ ID NO: 291528 - protein, 5 aa, Mycobacterium
TSDAP

SEQ ID NO: 291529 - protein, 4 aa, Mycobacterium
TSDC

SEQ ID NO: 291530 - protein, 5 aa, Mycobacterium
TSDDD

SEQ ID NO: 291531 - protein, 6 aa, Mycobacterium
TSDDGN

SEQ ID NO: 291532 - protein, 8 aa, Mycobacterium
TSDEVREQ

SEQ ID NO: 291533 - protein, 5 aa, Mycobacterium
TSDFE

SEQ ID NO: 291534 - protein, 7 aa, Mycobacterium
TSDFEPV

SEQ ID NO: 291535 - protein, 4 aa, Mycobacterium
TSDG

SEQ ID NO: 291536 - protein, 18 aa, Mycobacterium
TSDGADREDDRASGGRTA

SEQ ID NO: 291537 - protein, 18 aa, Mycobacterium
TSDGDAGPDSAGELEGAA

SEQ ID NO: 291538 - protein, 18 aa, Mycobacterium
TSDGGATEDDRASGGRTA

SEQ ID NO: 291539 - protein, 6 aa, Mycobacterium
TSDGKH

SEQ ID NO: 291540 - protein, 9 aa, Mycobacterium
TSDGSRFAT

SEQ ID NO: 291541 - protein, 5 aa, Mycobacterium
TSDID

SEQ ID NO: 291542 - protein, 7 aa, Mycobacterium
TSDISTP

SEQ ID NO: 291543 - protein, 28 aa, Mycobacterium
TSDKTEAFTPNKGEVFTPNKGEAVTPGK

SEQ ID NO: 291544 - protein, 16 aa, Mycobacterium
TSDLPRRASGRIERDA

SEQ ID NO: 291545 - protein, 7 aa, Mycobacterium
TSDNPGE

SEQ ID NO: 291546 - protein, 10 aa, Mycobacterium
TSDPHELANS

SEQ ID NO: 291547 - protein, 19 aa, Mycobacterium
TSDPKDNPGSANADLPRER

SEQ ID NO: 291548 - protein, 9 aa, Mycobacterium
TSDPPTHTR

SEQ ID NO: 291549 - protein, 4 aa, Mycobacterium
TSDQ

SEQ ID NO: 291550 - protein, 9 aa, Mycobacterium
TSDRPDWGT

SEQ ID NO: 291551 - protein, 9 aa, Mycobacterium
TSDRPGRSH

SEQ ID NO: 291552 - protein, 5 aa, Mycobacterium
TSDRS

SEQ ID NO: 291553 - protein, 9 aa, Mycobacterium
TSDRSAEVQ

SEQ ID NO: 291554 - protein, 4 aa, Mycobacterium
TSDS

SEQ ID NO: 291555 - protein, 6 aa, Mycobacterium
TSDSDN

SEQ ID NO: 291556 - protein, 15 aa, Mycobacterium
TSDSRSAKETAAESL

SEQ ID NO: 291557 - protein, 4 aa, Mycobacterium
TSDT

SEQ ID NO: 291558 - protein, 5 aa, Mycobacterium
TSDTA

SEQ ID NO: 291559 - protein, 7 aa, Mycobacterium
TSDTIGV

SEQ ID NO: 291560 - protein, 8 aa, Mycobacterium
TSDVKGTL

SEQ ID NO: 291561 - protein, 16 aa, Mycobacterium
TSDVTNAAGAKQDPRN

SEQ ID NO: 291562 - protein, 6 aa, Mycobacterium
TSDWDG

SEQ ID NO: 291563 - protein, 22 aa, Mycobacterium
TSDYGDIGPETPITVENESGEL

SEQ ID NO: 291564 - protein, 26 aa, Mycobacterium
TSEAFEPVGSQPNPNDPNATPAAGSI

SEQ ID NO: 291565 - protein, 27 aa, Mycobacterium
TSEAFEPVGSQPNPNDPNATPAAGSIR

SEQ ID NO: 291566 - protein, 11 aa, Mycobacterium
TSEAPERSYEA

SEQ ID NO: 291567 - protein, 6 aa, Mycobacterium
TSEAPP

SEQ ID NO: 291568 - protein, 6 aa, Mycobacterium
TSEDNK

SEQ ID NO: 291569 - protein, 6 aa, Mycobacterium
TSEDPL

SEQ ID NO: 291570 - protein, 9 aa, Mycobacterium
TSEELPDTW

SEQ ID NO: 291571 - protein, 7 aa, Mycobacterium
TSEGAYA

SEQ ID NO: 291572 - protein, 8 aa, Mycobacterium
TSEGIKDT

SEQ ID NO: 291573 - protein, 5 aa, Mycobacterium
TSENL

SEQ ID NO: 291574 - protein, 4 aa, Mycobacterium
TSEP

SEQ ID NO: 291575 - protein, 8 aa, Mycobacterium
TSEPGPVV

SEQ ID NO: 291576 - protein, 13 aa, Mycobacterium
TSEQDGQRNTTSS

SEQ ID NO: 291577 - protein, 10 aa, Mycobacterium
TSERDTEGDF

SEQ ID NO: 291578 - protein, 6 aa, Mycobacterium
TSERPL

SEQ ID NO: 291579 - protein, 5 aa, Mycobacterium
TSESA

SEQ ID NO: 291580 - protein, 16 aa, Mycobacterium
TSEVTNAAGAKKDPRK

SEQ ID NO: 291581 - protein, 15 aa, Mycobacterium
TSEVTNAAGARQDPR

SEQ ID NO: 291582 - protein, 4 aa, Mycobacterium
TSFG

SEQ ID NO: 291583 - protein, 5 aa, Mycobacterium
TSFGN

SEQ ID NO: 291584 - protein, 4 aa, Mycobacterium
TSFP

SEQ ID NO: 291585 - protein, 4 aa, Mycobacterium
TSFS

SEQ ID NO: 291586 - protein, 4 aa, Mycobacterium
TSGA

SEQ ID NO: 291587 - protein, 33 aa, Mycobacterium
TSGASAIAKASLDASLQDDLPEASRASAFGRSE

SEQ ID NO: 291588 - protein, 6 aa, Mycobacterium
TSGATT

SEQ ID NO: 291589 - protein, 20 aa, Mycobacterium
TSGAVRDEYNDYAEAGRKAR

SEQ ID NO: 291590 - protein, 8 aa, Mycobacterium
TSGDDVRP

SEQ ID NO: 291591 - protein, 12 aa, Mycobacterium
TSGDGGQAIAPA

SEQ ID NO: 291592 - protein, 9 aa, Mycobacterium
TSGDLGATG

SEQ ID NO: 291593 - protein, 8 aa, Mycobacterium
TSGDMGDC

SEQ ID NO: 291594 - protein, 29 aa, Mycobacterium
TSGEELTDAISEQPNDVASQPSPNDGSPL

SEQ ID NO: 291595 - protein, 7 aa, Mycobacterium
TSGEIRT

SEQ ID NO: 291596 - protein, 4 aa, Mycobacterium
TSGF

SEQ ID NO: 291597 - protein, 4 aa, Mycobacterium
TSGG

SEQ ID NO: 291598 - protein, 35 aa, Mycobacterium
TSGGDNDSAGAAATTSETASETPVTTTPKKPGEHA

SEQ ID NO: 291599 - protein, 6 aa, Mycobacterium
TSGGEL

SEQ ID NO: 291600 - protein, 8 aa, Mycobacterium
TSGGGTGS

SEQ ID NO: 291601 - protein, 10 aa, Mycobacterium
TSGGPQNRTD

SEQ ID NO: 291602 - protein, 8 aa, Mycobacterium
TSGGVSVD

SEQ ID NO: 291603 - protein, 10 aa, Mycobacterium
TSGKASSLQA

SEQ ID NO: 291604 - protein, 4 aa, Mycobacterium
TSGL

SEQ ID NO: 291605 - protein, 5 aa, Mycobacterium
TSGNQ

SEQ ID NO: 291606 - protein, 6 aa, Mycobacterium
TSGPGD

SEQ ID NO: 291607 - protein, 7 aa, Mycobacterium
TSGPGEL

SEQ ID NO: 291608 - protein, 5 aa, Mycobacterium
TSGPI

SEQ ID NO: 291609 - protein, 15 aa, Mycobacterium
TSGPLPDQADPASVA

SEQ ID NO: 291610 - protein, 15 aa, Mycobacterium
TSGPLPDQADQATVT

SEQ ID NO: 291611 - protein, 14 aa, Mycobacterium
TSGPLPDQTDQATV

SEQ ID NO: 291612 - protein, 11 aa, Mycobacterium
TSGPNSGAKTQ

SEQ ID NO: 291613 - protein, 5 aa, Mycobacterium
TSGPR

SEQ ID NO: 291614 - protein, 7 aa, Mycobacterium
TSGQGDL

SEQ ID NO: 291615 - protein, 6 aa, Mycobacterium
TSGQVI

SEQ ID NO: 291616 - protein, 7 aa, Mycobacterium
TSGRDDL

SEQ ID NO: 291617 - protein, 7 aa, Mycobacterium
TSGRGEL

SEQ ID NO: 291618 - protein, 11 aa, Mycobacterium
TSGRSGRHSAQ

SEQ ID NO: 291619 - protein, 4 aa, Mycobacterium
TSGS

SEQ ID NO: 291620 - protein, 6 aa, Mycobacterium
TSGSDT

SEQ ID NO: 291621 - protein, 14 aa, Mycobacterium
TSGSSAIAKASLDA

SEQ ID NO: 291622 - protein, 8 aa, Mycobacterium
TSGSSLTH

SEQ ID NO: 291623 - protein, 10 aa, Mycobacterium
TSGSTNAPKG

SEQ ID NO: 291624 - protein, 11 aa, Mycobacterium
TSGSTRAPAGV

SEQ ID NO: 291625 - protein, 8 aa, Mycobacterium
TSGSTRLP

SEQ ID NO: 291626 - protein, 10 aa, Mycobacterium
TSGSTRSPAG

SEQ ID NO: 291627 - protein, 9 aa, Mycobacterium
TSGSTRTPA

SEQ ID NO: 291628 - protein, 10 aa, Mycobacterium
TSGSTRVPSG

SEQ ID NO: 291629 - protein, 9 aa, Mycobacterium
TSGSTSAPK

SEQ ID NO: 291630 - protein, 7 aa, Mycobacterium
TSGTARV

SEQ ID NO: 291631 - protein, 30 aa, Mycobacterium
TSGTENPRPAEDEQEAGPGTQPADVQTGAA

SEQ ID NO: 291632 - protein, 6 aa, Mycobacterium
TSGVDS

SEQ ID NO: 291633 - protein, 5 aa, Mycobacterium
TSGVG

SEQ ID NO: 291634 - protein, 5 aa, Mycobacterium
TSGVL

SEQ ID NO: 291635 - protein, 6 aa, Mycobacterium
TSHDEP

SEQ ID NO: 291636 - protein, 10 aa, Mycobacterium
TSHEPQPPVD

SEQ ID NO: 291637 - protein, 5 aa, Mycobacterium
TSHGF

SEQ ID NO: 291638 - protein, 9 aa, Mycobacterium
TSHPRPGDL

SEQ ID NO: 291639 - protein, 5 aa, Mycobacterium
TSHTL

SEQ ID NO: 291640 - protein, 8 aa, Mycobacterium
TSIAKTPP

SEQ ID NO: 291641 - protein, 5 aa, Mycobacterium
TSIEG

SEQ ID NO: 291642 - protein, 15 aa, Mycobacterium
TSIGANSDFAKANTA

SEQ ID NO: 291643 - protein, 4 aa, Mycobacterium
TSIP

SEQ ID NO: 291644 - protein, 14 aa, Mycobacterium
TSIPQIGNSGSYSQ

SEQ ID NO: 291645 - protein, 6 aa, Mycobacterium
TSIPRR

SEQ ID NO: 291646 - protein, 9 aa, Mycobacterium
TSIREGSLK

SEQ ID NO: 291647 - protein, 13 aa, Mycobacterium
TSITGQLANGDAV

SEQ ID NO: 291648 - protein, 4 aa, Mycobacterium
TSKD

SEQ ID NO: 291649 - protein, 12 aa, Mycobacterium
TSKGPGFPSPVP

SEQ ID NO: 291650 - protein, 8 aa, Mycobacterium
TSKGQATQ

SEQ ID NO: 291651 - protein, 9 aa, Mycobacterium
TSKRALRSA

SEQ ID NO: 291652 - protein, 9 aa, Mycobacterium
TSKRGRVTG

SEQ ID NO: 291653 - protein, 12 aa, Mycobacterium
TSKRKRPSLPPT

SEQ ID NO: 291654 - protein, 62 aa, Mycobacterium
TSKVTLPEKGTAAKESEKRAAARAEAEAKAEAAAPPVEEAAPEAEAPAAPAAGGAEAKPVTG

SEQ ID NO: 291655 - protein, 12 aa, Mycobacterium
TSLAASDQIGRS

SEQ ID NO: 291656 - protein, 8 aa, Mycobacterium
TSLAGGGR

SEQ ID NO: 291657 - protein, 8 aa, Mycobacterium
TSLAPGGF

SEQ ID NO: 291658 - protein, 10 aa, Mycobacterium
TSLAPGGKRD

SEQ ID NO: 291659 - protein, 9 aa, Mycobacterium
TSLAPGGRL

SEQ ID NO: 291660 - protein, 11 aa, Mycobacterium
TSLGGSTYSWG

SEQ ID NO: 291661 - protein, 6 aa, Mycobacterium
TSLNRV

SEQ ID NO: 291662 - protein, 6 aa, Mycobacterium
TSLPAR

SEQ ID NO: 291663 - protein, 14 aa, Mycobacterium
TSLPPRELATRRDE

SEQ ID NO: 291664 - protein, 5 aa, Mycobacterium
TSLRD

SEQ ID NO: 291665 - protein, 11 aa, Mycobacterium
TSLRNGPVRPD

SEQ ID NO: 291666 - protein, 8 aa, Mycobacterium
TSLSETAG

SEQ ID NO: 291667 - protein, 10 aa, Mycobacterium
TSLSSNLPPA

SEQ ID NO: 291668 - protein, 7 aa, Mycobacterium
TSLTRPD

SEQ ID NO: 291669 - protein, 11 aa, Mycobacterium
TSMAADRDPEE

SEQ ID NO: 291670 - protein, 23 aa, Mycobacterium
TSMATSPDAATDHEEPPGSGKLV

SEQ ID NO: 291671 - protein, 12 aa, Mycobacterium
TSMRHDPNRSAT

SEQ ID NO: 291672 - protein, 12 aa, Mycobacterium
TSNAAAAQQEPH

SEQ ID NO: 291673 - protein, 5 aa, Mycobacterium
TSNDG

SEQ ID NO: 291674 - protein, 9 aa, Mycobacterium
TSNGAPGQL

SEQ ID NO: 291675 - protein, 9 aa, Mycobacterium
TSNGASAQL

SEQ ID NO: 291676 - protein, 7 aa, Mycobacterium
TSNGTVT

SEQ ID NO: 291677 - protein, 11 aa, Mycobacterium
TSNIAAPEQRP

SEQ ID NO: 291678 - protein, 6 aa, Mycobacterium
TSNSAL

SEQ ID NO: 291679 - protein, 5 aa, Mycobacterium
TSNYG

SEQ ID NO: 291680 - protein, 9 aa, Mycobacterium
TSPAAVRSA

SEQ ID NO: 291681 - protein, 7 aa, Mycobacterium
TSPADPE

SEQ ID NO: 291682 - protein, 5 aa, Mycobacterium
TSPAN

SEQ ID NO: 291683 - protein, 8 aa, Mycobacterium
TSPDGDRA

SEQ ID NO: 291684 - protein, 7 aa, Mycobacterium
TSPDPEC

SEQ ID NO: 291685 - protein, 11 aa, Mycobacterium
TSPDRDFNRDS

SEQ ID NO: 291686 - protein, 9 aa, Mycobacterium
TSPDTVREG

SEQ ID NO: 291687 - protein, 7 aa, Mycobacterium
TSPDYNR

SEQ ID NO: 291688 - protein, 7 aa, Mycobacterium
TSPEIPA

SEQ ID NO: 291689 - protein, 13 aa, Mycobacterium
TSPELKTALGQQN

SEQ ID NO: 291690 - protein, 13 aa, Mycobacterium
TSPENPQSERISA

SEQ ID NO: 291691 - protein, 4 aa, Mycobacterium
TSPI

SEQ ID NO: 291692 - protein, 11 aa, Mycobacterium
TSPKIADPQHI

SEQ ID NO: 291693 - protein, 7 aa, Mycobacterium
TSPKPGD

SEQ ID NO: 291694 - protein, 10 aa, Mycobacterium
TSPKSPTGRL

SEQ ID NO: 291695 - protein, 5 aa, Mycobacterium
TSPLP

SEQ ID NO: 291696 - protein, 6 aa, Mycobacterium
TSPLTE

SEQ ID NO: 291697 - protein, 15 aa, Mycobacterium
TSPPNPAGLPPTPGI

SEQ ID NO: 291698 - protein, 8 aa, Mycobacterium
TSPPPPLP

SEQ ID NO: 291699 - protein, 31 aa, Mycobacterium
TSPPSVSTSPAPSASRRAAPSTSPAPPRGAR

SEQ ID NO: 291700 - protein, 22 aa, Mycobacterium
TSPQSRGEDHSHDDDISSASES

SEQ ID NO: 291701 - protein, 14 aa, Mycobacterium
TSPRPQLAAATGAA

SEQ ID NO: 291702 - protein, 14 aa, Mycobacterium
TSPRSAGAPPPQVR

SEQ ID NO: 291703 - protein, 5 aa, Mycobacterium
TSPRT

SEQ ID NO: 291704 - protein, 19 aa, Mycobacterium
TSPRTRATFGTTAEEAETT

SEQ ID NO: 291705 - protein, 19 aa, Mycobacterium
TSPRTRATFGTTPAEAETT

SEQ ID NO: 291706 - protein, 17 aa, Mycobacterium
TSPRYAPSSTGEDPALT

SEQ ID NO: 291707 - protein, 6 aa, Mycobacterium
TSPSAL

SEQ ID NO: 291708 - protein, 9 aa, Mycobacterium
TSPSSGSVT

SEQ ID NO: 291709 - protein, 9 aa, Mycobacterium
TSPTSGTVT

SEQ ID NO: 291710 - protein, 6 aa, Mycobacterium
TSPTTR

SEQ ID NO: 291711 - protein, 26 aa, Mycobacterium
TSPVDDEQTTTVTPTTTATIAPSPSL

SEQ ID NO: 291712 - protein, 9 aa, Mycobacterium
TSPVDVPGK

SEQ ID NO: 291713 - protein, 6 aa, Mycobacterium
TSPYTS

SEQ ID NO: 291714 - protein, 10 aa, Mycobacterium
TSQARDSVNS

SEQ ID NO: 291715 - protein, 8 aa, Mycobacterium
TSQELTEP

SEQ ID NO: 291716 - protein, 4 aa, Mycobacterium
TSQI

SEQ ID NO: 291717 - protein, 13 aa, Mycobacterium
TSQKRKDAPQGQA

SEQ ID NO: 291718 - protein, 4 aa, Mycobacterium
TSQL

SEQ ID NO: 291719 - protein, 6 aa, Mycobacterium
TSQLTA

SEQ ID NO: 291720 - protein, 7 aa, Mycobacterium
TSQLTES

SEQ ID NO: 291721 - protein, 7 aa, Mycobacterium
TSQPPAE

SEQ ID NO: 291722 - protein, 19 aa, Mycobacterium
TSQRAGITPAPDNTMNGAR

SEQ ID NO: 291723 - protein, 7 aa, Mycobacterium
TSQSGDV

SEQ ID NO: 291724 - protein, 12 aa, Mycobacterium
TSQTLSQSPTSL

SEQ ID NO: 291725 - protein, 4 aa, Mycobacterium
TSQY

SEQ ID NO: 291726 - protein, 5 aa, Mycobacterium
TSRAD

SEQ ID NO: 291727 - protein, 6 aa, Mycobacterium
TSRADA

SEQ ID NO: 291728 - protein, 7 aa, Mycobacterium
TSRADAL

SEQ ID NO: 291729 - protein, 13 aa, Mycobacterium
TSRANASDASRRE

SEQ ID NO: 291730 - protein, 7 aa, Mycobacterium
TSRAPQR

SEQ ID NO: 291731 - protein, 4 aa, Mycobacterium
TSRC

SEQ ID NO: 291732 - protein, 6 aa, Mycobacterium
TSRDDT

SEQ ID NO: 291733 - protein, 12 aa, Mycobacterium
TSRDPDARYADA

SEQ ID NO: 291734 - protein, 4 aa, Mycobacterium
TSRF

SEQ ID NO: 291735 - protein, 5 aa, Mycobacterium
TSRGI

SEQ ID NO: 291736 - protein, 7 aa, Mycobacterium
TSRGRRT

SEQ ID NO: 291737 - protein, 15 aa, Mycobacterium
TSRHSKRPGATPART

SEQ ID NO: 291738 - protein, 4 aa, Mycobacterium
TSRI

SEQ ID NO: 291739 - protein, 5 aa, Mycobacterium
TSRID

SEQ ID NO: 291740 - protein, 9 aa, Mycobacterium
TSRKRAEAE

SEQ ID NO: 291741 - protein, 17 aa, Mycobacterium
TSRMRKTSGARPTTSPP

SEQ ID NO: 291742 - protein, 13 aa, Mycobacterium
TSRNAGDLRAAEQ

SEQ ID NO: 291743 - protein, 13 aa, Mycobacterium
TSRNASAVQAATQ

SEQ ID NO: 291744 - protein, 13 aa, Mycobacterium
TSRNASAVQTATQ

SEQ ID NO: 291745 - protein, 11 aa, Mycobacterium
TSRNASGMQDT

SEQ ID NO: 291746 - protein, 6 aa, Mycobacterium
TSRNAT

SEQ ID NO: 291747 - protein, 4 aa, Mycobacterium
TSRP

SEQ ID NO: 291748 - protein, 6 aa, Mycobacterium
TSRPAA

SEQ ID NO: 291749 - protein, 9 aa, Mycobacterium
TSRPAPRTT

SEQ ID NO: 291750 - protein, 7 aa, Mycobacterium
TSRPGET

SEQ ID NO: 291751 - protein, 11 aa, Mycobacterium
TSRPGPEPDLG

SEQ ID NO: 291752 - protein, 10 aa, Mycobacterium
TSRPGPLPAG

SEQ ID NO: 291753 - protein, 10 aa, Mycobacterium
TSRRDDLPAR

SEQ ID NO: 291754 - protein, 9 aa, Mycobacterium
TSRRQPSSA

SEQ ID NO: 291755 - protein, 6 aa, Mycobacterium
TSRRSR

SEQ ID NO: 291756 - protein, 9 aa, Mycobacterium
TSRRTGVAG

SEQ ID NO: 291757 - protein, 7 aa, Mycobacterium
TSRRTYA

SEQ ID NO: 291758 - protein, 28 aa, Mycobacterium
TSRSPSSRNAATPTSAPSLPASTSTSTS

SEQ ID NO: 291759 - protein, 6 aa, Mycobacterium
TSRTAH

SEQ ID NO: 291760 - protein, 5 aa, Mycobacterium
TSRVP

SEQ ID NO: 291761 - protein, 9 aa, Mycobacterium
TSSAAPSVL

SEQ ID NO: 291762 - protein, 8 aa, Mycobacterium
TSSADSAR

SEQ ID NO: 291763 - protein, 7 aa, Mycobacterium
TSSAPSQ

SEQ ID NO: 291764 - protein, 8 aa, Mycobacterium
TSSDDGYN

SEQ ID NO: 291765 - protein, 16 aa, Mycobacterium
TSSDHDVASESTVSQR

SEQ ID NO: 291766 - protein, 9 aa, Mycobacterium
TSSDQPNLA

SEQ ID NO: 291767 - protein, 30 aa, Mycobacterium
TSSEGSTTVTETASTTAPSDTTPVELPPPV

SEQ ID NO: 291768 - protein, 9 aa, Mycobacterium
TSSERRKTL

SEQ ID NO: 291769 - protein, 15 aa, Mycobacterium
TSSESPAPATTTPSV

SEQ ID NO: 291770 - protein, 15 aa, Mycobacterium
TSSFTNSLADNGQTV

SEQ ID NO: 291771 - protein, 8 aa, Mycobacterium
TSSFTTSL

SEQ ID NO: 291772 - protein, 9 aa, Mycobacterium
TSSGVESYD

SEQ ID NO: 291773 - protein, 5 aa, Mycobacterium
TSSIP

SEQ ID NO: 291774 - protein, 4 aa, Mycobacterium
TSSK

SEQ ID NO: 291775 - protein, 11 aa, Mycobacterium
TSSLSTSPRPQ

SEQ ID NO: 291776 - protein, 36 aa, Mycobacterium
TSSPPPAAAPATSSPPAPSTSATSPQAATPEPLDGT

SEQ ID NO: 291777 - protein, 7 aa, Mycobacterium
TSSPYTL

SEQ ID NO: 291778 - protein, 5 aa, Mycobacterium
TSSQE

SEQ ID NO: 291779 - protein, 8 aa, Mycobacterium
TSSSQLGQ

SEQ ID NO: 291780 - protein, 9 aa, Mycobacterium
TSSSSSVSE

SEQ ID NO: 291781 - protein, 6 aa, Mycobacterium
TSSSVL

SEQ ID NO: 291782 - protein, 13 aa, Mycobacterium
TSSSVQSPDEKAA

SEQ ID NO: 291783 - protein, 12 aa, Mycobacterium
TSSTPPPKATKH

SEQ ID NO: 291784 - protein, 29 aa, Mycobacterium
TSSTSESPAGPEDSDAPGSQPAVSNGADS

SEQ ID NO: 291785 - protein, 52 aa, Mycobacterium
TSSTSSTPTTEVRTAEPKPLTPEPEPSAVAPPPVAEPPPPVTEAPPPPPPVT

SEQ ID NO: 291786 - protein, 9 aa, Mycobacterium
TSSVDPGTE

SEQ ID NO: 291787 - protein, 7 aa, Mycobacterium
TSSVDTH

SEQ ID NO: 291788 - protein, 7 aa, Mycobacterium
TSSVDTR

SEQ ID NO: 291789 - protein, 6 aa, Mycobacterium
TSSVPL

SEQ ID NO: 291790 - protein, 6 aa, Mycobacterium
TSTARG

SEQ ID NO: 291791 - protein, 16 aa, Mycobacterium
TSTATAPAPAAAQPLY

SEQ ID NO: 291792 - protein, 18 aa, Mycobacterium
TSTATAPAPAAPAPAEAV

SEQ ID NO: 291793 - protein, 22 aa, Mycobacterium
TSTAVAPPPPPAVPPAPHQTPK

SEQ ID NO: 291794 - protein, 20 aa, Mycobacterium
TSTAVEATPIETSADSAALP

SEQ ID NO: 291795 - protein, 7 aa, Mycobacterium
TSTAVPG

SEQ ID NO: 291796 - protein, 7 aa, Mycobacterium
TSTDDRE

SEQ ID NO: 291797 - protein, 9 aa, Mycobacterium
TSTDPESRA

SEQ ID NO: 291798 - protein, 10 aa, Mycobacterium
TSTDSARTVP

SEQ ID NO: 291799 - protein, 12 aa, Mycobacterium
TSTGAKSGQPRV

SEQ ID NO: 291800 - protein, 8 aa, Mycobacterium
TSTGDPAR

SEQ ID NO: 291801 - protein, 6 aa, Mycobacterium
TSTGEP

SEQ ID NO: 291802 - protein, 7 aa, Mycobacterium
TSTGTYS

SEQ ID NO: 291803 - protein, 7 aa, Mycobacterium
TSTGVPN

SEQ ID NO: 291804 - protein, 6 aa, Mycobacterium
TSTHAG

SEQ ID NO: 291805 - protein, 15 aa, Mycobacterium
TSTHGELRGDGGNGY

SEQ ID NO: 291806 - protein, 5 aa, Mycobacterium
TSTHQ

SEQ ID NO: 291807 - protein, 7 aa, Mycobacterium
TSTKAGA

SEQ ID NO: 291808 - protein, 4 aa, Mycobacterium
TSTL

SEQ ID NO: 291809 - protein, 6 aa, Mycobacterium
TSTLGL

SEQ ID NO: 291810 - protein, 10 aa, Mycobacterium
TSTNGDRVEP

SEQ ID NO: 291811 - protein, 10 aa, Mycobacterium
TSTNGDRVES

SEQ ID NO: 291812 - protein, 7 aa, Mycobacterium
TSTPPGM

SEQ ID NO: 291813 - protein, 6 aa, Mycobacterium
TSTPRL

SEQ ID NO: 291814 - protein, 5 aa, Mycobacterium
TSTPS

SEQ ID NO: 291815 - protein, 7 aa, Mycobacterium
TSTQQAA

SEQ ID NO: 291816 - protein, 10 aa, Mycobacterium
TSTRDPGSPE

SEQ ID NO: 291817 - protein, 13 aa, Mycobacterium
TSTSGVVTSDSRE

SEQ ID NO: 291818 - protein, 6 aa, Mycobacterium
TSTTIN

SEQ ID NO: 291819 - protein, 10 aa, Mycobacterium
TSTTINDRQQ

SEQ ID NO: 291820 - protein, 6 aa, Mycobacterium
TSTTRT

SEQ ID NO: 291821 - protein, 18 aa, Mycobacterium
TSTVSAPRTAPFADPGNP

SEQ ID NO: 291822 - protein, 12 aa, Mycobacterium
TSTVSTETGRAF

SEQ ID NO: 291823 - protein, 18 aa, Mycobacterium
TSTVTETTTVPEEEGGEQ

SEQ ID NO: 291824 - protein, 4 aa, Mycobacterium
TSVD

SEQ ID NO: 291825 - protein, 8 aa, Mycobacterium
TSVGANAD

SEQ ID NO: 291826 - protein, 6 aa, Mycobacterium
TSVGPR

SEQ ID NO: 291827 - protein, 6 aa, Mycobacterium
TSVGRY

SEQ ID NO: 291828 - protein, 4 aa, Mycobacterium
TSVP

SEQ ID NO: 291829 - protein, 16 aa, Mycobacterium
TSVPDLARGAADQVTA

SEQ ID NO: 291830 - protein, 11 aa, Mycobacterium
TSVPEGQLEAS

SEQ ID NO: 291831 - protein, 39 aa, Mycobacterium
TSVPSESEPEKAPPQKTTAKAPAKKASGRRAGSTELRST

SEQ ID NO: 291832 - protein, 6 aa, Mycobacterium
TSVPSR

SEQ ID NO: 291833 - protein, 7 aa, Mycobacterium
TSVRPAE

SEQ ID NO: 291834 - protein, 11 aa, Mycobacterium
TSVSGNVTTAK

SEQ ID NO: 291835 - protein, 11 aa, Mycobacterium
TSVTTANEQID

SEQ ID NO: 291836 - protein, 13 aa, Mycobacterium
TSVTTANEQIDSE

SEQ ID NO: 291837 - protein, 7 aa, Mycobacterium
TSWDGPA

SEQ ID NO: 291838 - protein, 41 aa, Mycobacterium
TSWPSQSGIRPAVGTGSSPSATPPASQPATAPPASPKKSRK

SEQ ID NO: 291839 - protein, 5 aa, Mycobacterium
TSWPT

SEQ ID NO: 291840 - protein, 6 aa, Mycobacterium
TSWRDE

SEQ ID NO: 291841 - protein, 5 aa, Mycobacterium
TSWRE

SEQ ID NO: 291842 - protein, 5 aa, Mycobacterium
TSWTH

SEQ ID NO: 291843 - protein, 6 aa, Mycobacterium
TSYQGN

SEQ ID NO: 291844 - protein, 11 aa, Mycobacterium
TSYSGADGAGM

SEQ ID NO: 291845 - protein, 12 aa, Mycobacterium
TSYSGARRTDPD

SEQ ID NO: 291846 - protein, 7 aa, Mycobacterium
TSYTEGT

SEQ ID NO: 291847 - protein, 8 aa, Mycobacterium
TTAADNSL

SEQ ID NO: 291848 - protein, 14 aa, Mycobacterium
TTAAEARDPERNLP

SEQ ID NO: 291849 - protein, 8 aa, Mycobacterium
TTAAGIDR

SEQ ID NO: 291850 - protein, 6 aa, Mycobacterium
TTAAGQ

SEQ ID NO: 291851 - protein, 13 aa, Mycobacterium
TTAAPSVARSPRV

SEQ ID NO: 291852 - protein, 6 aa, Mycobacterium
TTAAQG

SEQ ID NO: 291853 - protein, 44 aa, Mycobacterium
TTAAQQMSAAGGCGSACGGCPGAGRNDSPGRDGLRASGSSVCAR

SEQ ID NO: 291854 - protein, 6 aa, Mycobacterium
TTAATE

SEQ ID NO: 291855 - protein, 12 aa, Mycobacterium
TTADGQILVRLD

SEQ ID NO: 291856 - protein, 6 aa, Mycobacterium
TTADVS

SEQ ID NO: 291857 - protein, 15 aa, Mycobacterium
TTAEETRNPQKDVPR

SEQ ID NO: 291858 - protein, 8 aa, Mycobacterium
TTAERAAR

SEQ ID NO: 291859 - protein, 10 aa, Mycobacterium
TTAGGGSDYS

SEQ ID NO: 291860 - protein, 8 aa, Mycobacterium
TTAGPYLS

SEQ ID NO: 291861 - protein, 5 aa, Mycobacterium
TTAGT

SEQ ID NO: 291862 - protein, 9 aa, Mycobacterium
TTAGTRLSS

SEQ ID NO: 291863 - protein, 6 aa, Mycobacterium
TTAGTV

SEQ ID NO: 291864 - protein, 5 aa, Mycobacterium
TTAID

SEQ ID NO: 291865 - protein, 5 aa, Mycobacterium
TTAIE

SEQ ID NO: 291866 - protein, 9 aa, Mycobacterium
TTALATSPY

SEQ ID NO: 291867 - protein, 6 aa, Mycobacterium
TTALPA

SEQ ID NO: 291868 - protein, 8 aa, Mycobacterium
TTALPDAA

SEQ ID NO: 291869 - protein, 10 aa, Mycobacterium
TTANAAGNVE

SEQ ID NO: 291870 - protein, 8 aa, Mycobacterium
TTANEQID

SEQ ID NO: 291871 - protein, 34 aa, Mycobacterium
TTANSQSASTVGPTPRDTRSRGTPLATTSRLASA

SEQ ID NO: 291872 - protein, 7 aa, Mycobacterium
TTAPATE

SEQ ID NO: 291873 - protein, 6 aa, Mycobacterium
TTAPGE

SEQ ID NO: 291874 - protein, 6 aa, Mycobacterium
TTAPYG

SEQ ID NO: 291875 - protein, 9 aa, Mycobacterium
TTAQAPPVR

SEQ ID NO: 291876 - protein, 13 aa, Mycobacterium
TTAQGAARSPSNL

SEQ ID NO: 291877 - protein, 5 aa, Mycobacterium
TTARA

SEQ ID NO: 291878 - protein, 19 aa, Mycobacterium
TTARAARRFGSGDRPGAVH

SEQ ID NO: 291879 - protein, 9 aa, Mycobacterium
TTARGEKQR

SEQ ID NO: 291880 - protein, 7 aa, Mycobacterium
TTARQPM

SEQ ID NO: 291881 - protein, 7 aa, Mycobacterium
TTARSAR

SEQ ID NO: 291882 - protein, 13 aa, Mycobacterium
TTARSARHYGAGD

SEQ ID NO: 291883 - protein, 7 aa, Mycobacterium
TTASGGT

SEQ ID NO: 291884 - protein, 12 aa, Mycobacterium
TTASNIDTSDKL

SEQ ID NO: 291885 - protein, 7 aa, Mycobacterium
TTASTLG

SEQ ID NO: 291886 - protein, 4 aa, Mycobacterium
TTAT

SEQ ID NO: 291887 - protein, 5 aa, Mycobacterium
TTATA

SEQ ID NO: 291888 - protein, 10 aa, Mycobacterium
TTATEPPERL

SEQ ID NO: 291889 - protein, 5 aa, Mycobacterium
TTATG

SEQ ID NO: 291890 - protein, 8 aa, Mycobacterium
TTATQRYR

SEQ ID NO: 291891 - protein, 18 aa, Mycobacterium
TTATRNLPPSVAGAGSGV

SEQ ID NO: 291892 - protein, 9 aa, Mycobacterium
TTATSQPAL

SEQ ID NO: 291893 - protein, 9 aa, Mycobacterium
TTDAGAGTI

SEQ ID NO: 291894 - protein, 4 aa, Mycobacterium
TTDD

SEQ ID NO: 291895 - protein, 7 aa, Mycobacterium
TTDDGTL

SEQ ID NO: 291896 - protein, 6 aa, Mycobacterium
TTDDQA

SEQ ID NO: 291897 - protein, 11 aa, Mycobacterium
TTDDYPSALPT

SEQ ID NO: 291898 - protein, 20 aa, Mycobacterium
TTDEESVESQVASAQDERDR

SEQ ID NO: 291899 - protein, 13 aa, Mycobacterium
TTDEHGNPKAMPD

SEQ ID NO: 291900 - protein, 6 aa, Mycobacterium
TTDETD

SEQ ID NO: 291901 - protein, 7 aa, Mycobacterium
TTDETEA

SEQ ID NO: 291902 - protein, 5 aa, Mycobacterium
TTDGS

SEQ ID NO: 291903 - protein, 12 aa, Mycobacterium
TTDGSYEVSAEK

SEQ ID NO: 291904 - protein, 9 aa, Mycobacterium
TTDHGAGLS

SEQ ID NO: 291905 - protein, 12 aa, Mycobacterium
TTDHGAGLSSAT

SEQ ID NO: 291906 - protein, 5 aa, Mycobacterium
TTDHK

SEQ ID NO: 291907 - protein, 4 aa, Mycobacterium
TTDL

SEQ ID NO: 291908 - protein, 11 aa, Mycobacterium
TTDNTARGGYA

SEQ ID NO: 291909 - protein, 9 aa, Mycobacterium
TTDPDDDEI

SEQ ID NO: 291910 - protein, 5 aa, Mycobacterium
TTDPG

SEQ ID NO: 291911 - protein, 11 aa, Mycobacterium
TTDPGAKPDGV

SEQ ID NO: 291912 - protein, 9 aa, Mycobacterium
TTDPGPSTV

SEQ ID NO: 291913 - protein, 7 aa, Mycobacterium
TTDPQNV

SEQ ID NO: 291914 - protein, 6 aa, Mycobacterium
TTDPRA

SEQ ID NO: 291915 - protein, 8 aa, Mycobacterium
TTDPSELG

SEQ ID NO: 291916 - protein, 34 aa, Mycobacterium
TTDQDTPDTDGTATGERAPIDAQTLPNQQQRERL

SEQ ID NO: 291917 - protein, 11 aa, Mycobacterium
TTDRAPEDPFE

SEQ ID NO: 291918 - protein, 9 aa, Mycobacterium
TTDRTEEKA

SEQ ID NO: 291919 - protein, 8 aa, Mycobacterium
TTDSAEGV

SEQ ID NO: 291920 - protein, 8 aa, Mycobacterium
TTDSDAEA

SEQ ID NO: 291921 - protein, 13 aa, Mycobacterium
TTDSTAQSGSERI

SEQ ID NO: 291922 - protein, 4 aa, Mycobacterium
TTDT

SEQ ID NO: 291923 - protein, 5 aa, Mycobacterium
TTDTI

SEQ ID NO: 291924 - protein, 5 aa, Mycobacterium
TTDTV

SEQ ID NO: 291925 - protein, 4 aa, Mycobacterium
TTDV

SEQ ID NO: 291926 - protein, 10 aa, Mycobacterium
TTDVDGAASR

SEQ ID NO: 291927 - protein, 9 aa, Mycobacterium
TTDVGQAEA

SEQ ID NO: 291928 - protein, 4 aa, Mycobacterium
TTEA

SEQ ID NO: 291929 - protein, 10 aa, Mycobacterium
TTEAASQSSG

SEQ ID NO: 291930 - protein, 12 aa, Mycobacterium
TTEGDDGSVSAT

SEQ ID NO: 291931 - protein, 4 aa, Mycobacterium
TTEI

SEQ ID NO: 291932 - protein, 44 aa, Mycobacterium
TTEKSPRQGAQPPAAPPATTAAPTATTAPAPTTIASTPEQDSGY

SEQ ID NO: 291933 - protein, 7 aa, Mycobacterium
TTENPDV

SEQ ID NO: 291934 - protein, 5 aa, Mycobacterium
TTEPA

SEQ ID NO: 291935 - protein, 7 aa, Mycobacterium
TTEPDSM

SEQ ID NO: 291936 - protein, 21 aa, Mycobacterium
TTEPEAKTETIATTESEASTE

SEQ ID NO: 291937 - protein, 6 aa, Mycobacterium
TTEPIT

SEQ ID NO: 291938 - protein, 9 aa, Mycobacterium
TTEPKPAAE

SEQ ID NO: 291939 - protein, 17 aa, Mycobacterium
TTEPPAGELFPGVPNQP

SEQ ID NO: 291940 - protein, 6 aa, Mycobacterium
TTEPSE

SEQ ID NO: 291941 - protein, 17 aa, Mycobacterium
TTEPSPEPGRTPVSTAA

SEQ ID NO: 291942 - protein, 4 aa, Mycobacterium
TTEQ

SEQ ID NO: 291943 - protein, 9 aa, Mycobacterium
TTEQESPTE

SEQ ID NO: 291944 - protein, 16 aa, Mycobacterium
TTEQSAQAEHEVGGTR

SEQ ID NO: 291945 - protein, 8 aa, Mycobacterium
TTETPWGD

SEQ ID NO: 291946 - protein, 5 aa, Mycobacterium
TTEVE

SEQ ID NO: 291947 - protein, 11 aa, Mycobacterium
TTFDGNGDSFR

SEQ ID NO: 291948 - protein, 6 aa, Mycobacterium
TTFESG

SEQ ID NO: 291949 - protein, 12 aa, Mycobacterium
TTGADTVPSSPK

SEQ ID NO: 291950 - protein, 7 aa, Mycobacterium
TTGAEGR

SEQ ID NO: 291951 - protein, 10 aa, Mycobacterium
TTGAGKSEGL

SEQ ID NO: 291952 - protein, 5 aa, Mycobacterium
TTGAP

SEQ ID NO: 291953 - protein, 8 aa, Mycobacterium
TTGDATRE

SEQ ID NO: 291954 - protein, 8 aa, Mycobacterium
TTGDVTGG

SEQ ID NO: 291955 - protein, 6 aa, Mycobacterium
TTGEAA

SEQ ID NO: 291956 - protein, 4 aa, Mycobacterium
TTGG

SEQ ID NO: 291957 - protein, 6 aa, Mycobacterium
TTGGAQ

SEQ ID NO: 291958 - protein, 10 aa, Mycobacterium
TTGGPAATSY

SEQ ID NO: 291959 - protein, 15 aa, Mycobacterium
TTGKEPDALREFNPL

SEQ ID NO: 291960 - protein, 5 aa, Mycobacterium
TTGMT

SEQ ID NO: 291961 - protein, 8 aa, Mycobacterium
TTGNLSRE

SEQ ID NO: 291962 - protein, 6 aa, Mycobacterium
TTGNSI

SEQ ID NO: 291963 - protein, 4 aa, Mycobacterium
TTGP

SEQ ID NO: 291964 - protein, 17 aa, Mycobacterium
TTGPDAVPGSPEMPTPP

SEQ ID NO: 291965 - protein, 17 aa, Mycobacterium
TTGPDGQGAQPQASTVG

SEQ ID NO: 291966 - protein, 8 aa, Mycobacterium
TTGPLSSV

SEQ ID NO: 291967 - protein, 5 aa, Mycobacterium
TTGRL

SEQ ID NO: 291968 - protein, 4 aa, Mycobacterium
TTGS

SEQ ID NO: 291969 - protein, 10 aa, Mycobacterium
TTGSAGRRGK

SEQ ID NO: 291970 - protein, 13 aa, Mycobacterium
TTGSDAVAGPPKI

SEQ ID NO: 291971 - protein, 10 aa, Mycobacterium
TTGSEHDDDL

SEQ ID NO: 291972 - protein, 13 aa, Mycobacterium
TTGSGDQRSTETY

SEQ ID NO: 291973 - protein, 8 aa, Mycobacterium
TTGSGKST

SEQ ID NO: 291974 - protein, 17 aa, Mycobacterium
TTGSSQAPRGDAPTAEQ

SEQ ID NO: 291975 - protein, 17 aa, Mycobacterium
TTGSVRVGGNDVRRYDP

SEQ ID NO: 291976 - protein, 6 aa, Mycobacterium
TTGTAD

SEQ ID NO: 291977 - protein, 5 aa, Mycobacterium
TTGTG

SEQ ID NO: 291978 - protein, 6 aa, Mycobacterium
TTGTKA

SEQ ID NO: 291979 - protein, 5 aa, Mycobacterium
TTGTL

SEQ ID NO: 291980 - protein, 8 aa, Mycobacterium
TTGTQRRA

SEQ ID NO: 291981 - protein, 7 aa, Mycobacterium
TTGVPAP

SEQ ID NO: 291982 - protein, 15 aa, Mycobacterium
TTGYADEWGNEQPRM

SEQ ID NO: 291983 - protein, 8 aa, Mycobacterium
TTHDGVRG

SEQ ID NO: 291984 - protein, 7 aa, Mycobacterium
TTHDRHA

SEQ ID NO: 291985 - protein, 21 aa, Mycobacterium
TTHDRHAAARAERDRAELEAE

SEQ ID NO: 291986 - protein, 5 aa, Mycobacterium
TTHGH

SEQ ID NO: 291987 - protein, 10 aa, Mycobacterium
TTHRARPRPV

SEQ ID NO: 291988 - protein, 12 aa, Mycobacterium
TTHSLNGSTHEL

SEQ ID NO: 291989 - protein, 9 aa, Mycobacterium
TTIAGSAYG

SEQ ID NO: 291990 - protein, 15 aa, Mycobacterium
TTIDPKAQQAAEKAV

SEQ ID NO: 291991 - protein, 12 aa, Mycobacterium
TTIGGKGTLATR

SEQ ID NO: 291992 - protein, 4 aa, Mycobacterium
TTIN

SEQ ID NO: 291993 - protein, 6 aa, Mycobacterium
TTIPQP

SEQ ID NO: 291994 - protein, 4 aa, Mycobacterium
TTIR

SEQ ID NO: 291995 - protein, 8 aa, Mycobacterium
TTISTSPW

SEQ ID NO: 291996 - protein, 22 aa, Mycobacterium
TTITTSPTTSTTTATPPATPAS

SEQ ID NO: 291997 - protein, 6 aa, Mycobacterium
TTKDPE

SEQ ID NO: 291998 - protein, 10 aa, Mycobacterium
TTKKTGKRDR

SEQ ID NO: 291999 - protein, 11 aa, Mycobacterium
TTKPLGPGTNM

SEQ ID NO: 292000 - protein, 6 aa, Mycobacterium
TTKPLT

SEQ ID NO: 292001 - protein, 10 aa, Mycobacterium
TTKSPDEKQV

SEQ ID NO: 292002 - protein, 7 aa, Mycobacterium
TTKSRQD

SEQ ID NO: 292003 - protein, 10 aa, Mycobacterium
TTKYRSQLAA

SEQ ID NO: 292004 - protein, 4 aa, Mycobacterium
TTLA

SEQ ID NO: 292005 - protein, 8 aa, Mycobacterium
TTLAGGDL

SEQ ID NO: 292006 - protein, 4 aa, Mycobacterium
TTLD

SEQ ID NO: 292007 - protein, 6 aa, Mycobacterium
TTLDSG

SEQ ID NO: 292008 - protein, 22 aa, Mycobacterium
TTLEAPPSPTEARAANDESTAL

SEQ ID NO: 292009 - protein, 14 aa, Mycobacterium
TTLEASDDLPITTE

SEQ ID NO: 292010 - protein, 5 aa, Mycobacterium
TTLPS

SEQ ID NO: 292011 - protein, 5 aa, Mycobacterium
TTLRG

SEQ ID NO: 292012 - protein, 6 aa, Mycobacterium
TTLSDE

SEQ ID NO: 292013 - protein, 6 aa, Mycobacterium
TTLSSG

SEQ ID NO: 292014 - protein, 4 aa, Mycobacterium
TTLT

SEQ ID NO: 292015 - protein, 13 aa, Mycobacterium
TTLTGDTFDDRPV

SEQ ID NO: 292016 - protein, 18 aa, Mycobacterium
TTLTSTGAVDSTHDSYTS

SEQ ID NO: 292017 - protein, 10 aa, Mycobacterium
TTLTSTGSVD

SEQ ID NO: 292018 - protein, 13 aa, Mycobacterium
TTMPQQQQDETVT

SEQ ID NO: 292019 - protein, 12 aa, Mycobacterium
TTNAGTPEQQPR

SEQ ID NO: 292020 - protein, 9 aa, Mycobacterium
TTNDATREE

SEQ ID NO: 292021 - protein, 8 aa, Mycobacterium
TTNDDSNN

SEQ ID NO: 292022 - protein, 20 aa, Mycobacterium
TTNEESVESQVAAASDERDR

SEQ ID NO: 292023 - protein, 9 aa, Mycobacterium
TTNGATREE

SEQ ID NO: 292024 - protein, 9 aa, Mycobacterium
TTNGTTREE

SEQ ID NO: 292025 - protein, 5 aa, Mycobacterium
TTNPW

SEQ ID NO: 292026 - protein, 39 aa, Mycobacterium
TTNRHGDHAPEPGSYHGSQGYGYGSGYGRGAYAGDYQDY

SEQ ID NO: 292027 - protein, 4 aa, Mycobacterium
TTNT

SEQ ID NO: 292028 - protein, 10 aa, Mycobacterium
TTNTRTAAPI

SEQ ID NO: 292029 - protein, 4 aa, Mycobacterium
TTPA

SEQ ID NO: 292030 - protein, 8 aa, Mycobacterium
TTPAAQSA

SEQ ID NO: 292031 - protein, 5 aa, Mycobacterium
TTPAL

SEQ ID NO: 292032 - protein, 37 aa, Mycobacterium
TTPALEPGGGVTPGATPPDSAQTSGLSDPQPRPRRRV

SEQ ID NO: 292033 - protein, 11 aa, Mycobacterium
TTPANASRVSG

SEQ ID NO: 292034 - protein, 7 aa, Mycobacterium
TTPAQRR

SEQ ID NO: 292035 - protein, 11 aa, Mycobacterium
TTPDDYPGPLD

SEQ ID NO: 292036 - protein, 9 aa, Mycobacterium
TTPDGRATD

SEQ ID NO: 292037 - protein, 12 aa, Mycobacterium
TTPDREFNRDSR

SEQ ID NO: 292038 - protein, 12 aa, Mycobacterium
TTPEHPSNKKLS

SEQ ID NO: 292039 - protein, 8 aa, Mycobacterium
TTPENMRE

SEQ ID NO: 292040 - protein, 6 aa, Mycobacterium
TTPEQF

SEQ ID NO: 292041 - protein, 7 aa, Mycobacterium
TTPFPGT

SEQ ID NO: 292042 - protein, 8 aa, Mycobacterium
TTPFTGDS

SEQ ID NO: 292043 - protein, 10 aa, Mycobacterium
TTPGINGSTV

SEQ ID NO: 292044 - protein, 6 aa, Mycobacterium
TTPGPL

SEQ ID NO: 292045 - protein, 5 aa, Mycobacterium
TTPGR

SEQ ID NO: 292046 - protein, 5 aa, Mycobacterium
TTPIE

SEQ ID NO: 292047 - protein, 31 aa, Mycobacterium
TTPKLGGLSTSGPAIAEDDKFGGQSPEPLDP

SEQ ID NO: 292048 - protein, 5 aa, Mycobacterium
TTPLE

SEQ ID NO: 292049 - protein, 11 aa, Mycobacterium
TTPLGGSPVAG

SEQ ID NO: 292050 - protein, 37 aa, Mycobacterium
TTPNIGAQAPGQGAAPPPAPPAPAAPVPPAPPGHQQR

SEQ ID NO: 292051 - protein, 37 aa, Mycobacterium
TTPNPADSGSGETLASPFPEPEPISTNPSKGAKVRPA

SEQ ID NO: 292052 - protein, 8 aa, Mycobacterium
TTPPALTP

SEQ ID NO: 292053 - protein, 34 aa, Mycobacterium
TTPPAVDASEVPKPGDPTPGPLPVPAKPMGGDAL

SEQ ID NO: 292054 - protein, 7 aa, Mycobacterium
TTPPDSA

SEQ ID NO: 292055 - protein, 5 aa, Mycobacterium
TTPPL

SEQ ID NO: 292056 - protein, 17 aa, Mycobacterium
TTPPPGTGAEGGSEAVQ

SEQ ID NO: 292057 - protein, 25 aa, Mycobacterium
TTPPPPPPPPPTTEPPPPPPPPETV

SEQ ID NO: 292058 - protein, 4 aa, Mycobacterium
TTPR

SEQ ID NO: 292059 - protein, 5 aa, Mycobacterium
TTPRA

SEQ ID NO: 292060 - protein, 7 aa, Mycobacterium
TTPSNGR

SEQ ID NO: 292061 - protein, 6 aa, Mycobacterium
TTPTSG

SEQ ID NO: 292062 - protein, 14 aa, Mycobacterium
TTPTSWEERNAQGE

SEQ ID NO: 292063 - protein, 4 aa, Mycobacterium
TTPV

SEQ ID NO: 292064 - protein, 5 aa, Mycobacterium
TTPVG

SEQ ID NO: 292065 - protein, 6 aa, Mycobacterium
TTPVGG

SEQ ID NO: 292066 - protein, 9 aa, Mycobacterium
TTPVPHDPK

SEQ ID NO: 292067 - protein, 5 aa, Mycobacterium
TTPWG

SEQ ID NO: 292068 - protein, 6 aa, Mycobacterium
TTQGGA

SEQ ID NO: 292069 - protein, 8 aa, Mycobacterium
TTQGLNRS

SEQ ID NO: 292070 - protein, 6 aa, Mycobacterium
TTQGPW

SEQ ID NO: 292071 - protein, 20 aa, Mycobacterium
TTQKNSFPNEPREEPGLPAG

SEQ ID NO: 292072 - protein, 9 aa, Mycobacterium
TTQNQKAAE

SEQ ID NO: 292073 - protein, 7 aa, Mycobacterium
TTQPDKM

SEQ ID NO: 292074 - protein, 7 aa, Mycobacterium
TTQPPAE

SEQ ID NO: 292075 - protein, 8 aa, Mycobacterium
TTQRHERA

SEQ ID NO: 292076 - protein, 14 aa, Mycobacterium
TTQSADRPEPALTS

SEQ ID NO: 292077 - protein, 6 aa, Mycobacterium
TTQTPV

SEQ ID NO: 292078 - protein, 7 aa, Mycobacterium
TTQTTQV

SEQ ID NO: 292079 - protein, 5 aa, Mycobacterium
TTRAR

SEQ ID NO: 292080 - protein, 15 aa, Mycobacterium
TTRASIERGIAGEID

SEQ ID NO: 292081 - protein, 9 aa, Mycobacterium
TTRDPGSPE

SEQ ID NO: 292082 - protein, 4 aa, Mycobacterium
TTRE

SEQ ID NO: 292083 - protein, 5 aa, Mycobacterium
TTREV

SEQ ID NO: 292084 - protein, 8 aa, Mycobacterium
TTREVRST

SEQ ID NO: 292085 - protein, 9 aa, Mycobacterium
TTRGAGTLA

SEQ ID NO: 292086 - protein, 12 aa, Mycobacterium
TTRGGPGTETQT

SEQ ID NO: 292087 - protein, 9 aa, Mycobacterium
TTRGGPLRA

SEQ ID NO: 292088 - protein, 4 aa, Mycobacterium
TTRP

SEQ ID NO: 292089 - protein, 5 aa, Mycobacterium
TTRPG

SEQ ID NO: 292090 - protein, 13 aa, Mycobacterium
TTRPNADEPGDLV

SEQ ID NO: 292091 - protein, 8 aa, Mycobacterium
TTRPPVTG

SEQ ID NO: 292092 - protein, 14 aa, Mycobacterium
TTRPRSALGDGDVM

SEQ ID NO: 292093 - protein, 6 aa, Mycobacterium
TTRPVG

SEQ ID NO: 292094 - protein, 4 aa, Mycobacterium
TTRQ

SEQ ID NO: 292095 - protein, 10 aa, Mycobacterium
TTRRESVARS

SEQ ID NO: 292096 - protein, 5 aa, Mycobacterium
TTRRR

SEQ ID NO: 292097 - protein, 10 aa, Mycobacterium
TTRSGAPFPD

SEQ ID NO: 292098 - protein, 5 aa, Mycobacterium
TTRSS

SEQ ID NO: 292099 - protein, 7 aa, Mycobacterium
TTRSSQL

SEQ ID NO: 292100 - protein, 8 aa, Mycobacterium
TTRSSQLY

SEQ ID NO: 292101 - protein, 7 aa, Mycobacterium
TTRTPAP

SEQ ID NO: 292102 - protein, 8 aa, Mycobacterium
TTSDASPL

SEQ ID NO: 292103 - protein, 8 aa, Mycobacterium
TTSDDGYN

SEQ ID NO: 292104 - protein, 5 aa, Mycobacterium
TTSDS

SEQ ID NO: 292105 - protein, 5 aa, Mycobacterium
TTSER

SEQ ID NO: 292106 - protein, 7 aa, Mycobacterium
TTSFSNA

SEQ ID NO: 292107 - protein, 5 aa, Mycobacterium
TTSGF

SEQ ID NO: 292108 - protein, 7 aa, Mycobacterium
TTSGGEL

SEQ ID NO: 292109 - protein, 10 aa, Mycobacterium
TTSGLQGTIT

SEQ ID NO: 292110 - protein, 16 aa, Mycobacterium
TTSGSAEVPATAPATD

SEQ ID NO: 292111 - protein, 13 aa, Mycobacterium
TTSGSGKEFSPGQ

SEQ ID NO: 292112 - protein, 4 aa, Mycobacterium
TTSI

SEQ ID NO: 292113 - protein, 16 aa, Mycobacterium
TTSKDQPEPVKTTSSV

SEQ ID NO: 292114 - protein, 11 aa, Mycobacterium
TTSKPGPQFSP

SEQ ID NO: 292115 - protein, 6 aa, Mycobacterium
TTSPGL

SEQ ID NO: 292116 - protein, 8 aa, Mycobacterium
TTSPPRGV

SEQ ID NO: 292117 - protein, 7 aa, Mycobacterium
TTSPQEI

SEQ ID NO: 292118 - protein, 5 aa, Mycobacterium
TTSPR

SEQ ID NO: 292119 - protein, 5 aa, Mycobacterium
TTSPT

SEQ ID NO: 292120 - protein, 14 aa, Mycobacterium
TTSPTSTAATAAQA

SEQ ID NO: 292121 - protein, 9 aa, Mycobacterium
TTSQAPPVR

SEQ ID NO: 292122 - protein, 15 aa, Mycobacterium
TTSQDHSELHSATQK

SEQ ID NO: 292123 - protein, 8 aa, Mycobacterium
TTSQNAHN

SEQ ID NO: 292124 - protein, 12 aa, Mycobacterium
TTSQPGPEFSPG

SEQ ID NO: 292125 - protein, 5 aa, Mycobacterium
TTSRD

SEQ ID NO: 292126 - protein, 11 aa, Mycobacterium
TTSRGTDETGW

SEQ ID NO: 292127 - protein, 5 aa, Mycobacterium
TTSRI

SEQ ID NO: 292128 - protein, 7 aa, Mycobacterium
TTSRNAS

SEQ ID NO: 292129 - protein, 16 aa, Mycobacterium
TTSSAESKAVIGTPEA

SEQ ID NO: 292130 - protein, 18 aa, Mycobacterium
TTSSAESKAVIGTPEAQY

SEQ ID NO: 292131 - protein, 8 aa, Mycobacterium
TTSSHESK

SEQ ID NO: 292132 - protein, 14 aa, Mycobacterium
TTSSHESKAVIGTP

SEQ ID NO: 292133 - protein, 18 aa, Mycobacterium
TTSSPAVASTPHTPPAPA

SEQ ID NO: 292134 - protein, 8 aa, Mycobacterium
TTSTAELR

SEQ ID NO: 292135 - protein, 8 aa, Mycobacterium
TTSTKTSL

SEQ ID NO: 292136 - protein, 11 aa, Mycobacterium
TTSTSPLTKNV

SEQ ID NO: 292137 - protein, 14 aa, Mycobacterium
TTTAASAADAAHGG

SEQ ID NO: 292138 - protein, 7 aa, Mycobacterium
TTTAGNP

SEQ ID NO: 292139 - protein, 10 aa, Mycobacterium
TTTALSGGAA

SEQ ID NO: 292140 - protein, 7 aa, Mycobacterium
TTTAPLR

SEQ ID NO: 292141 - protein, 6 aa, Mycobacterium
TTTDGA

SEQ ID NO: 292142 - protein, 13 aa, Mycobacterium
TTTEQANRSGLDG

SEQ ID NO: 292143 - protein, 21 aa, Mycobacterium
TTTGQAVENAALNGADQVGQR

SEQ ID NO: 292144 - protein, 6 aa, Mycobacterium
TTTGRL

SEQ ID NO: 292145 - protein, 8 aa, Mycobacterium
TTTGTPLR

SEQ ID NO: 292146 - protein, 9 aa, Mycobacterium
TTTIAGQSL

SEQ ID NO: 292147 - protein, 6 aa, Mycobacterium
TTTKRV

SEQ ID NO: 292148 - protein, 4 aa, Mycobacterium
TTTL

SEQ ID NO: 292149 - protein, 4 aa, Mycobacterium
TTTP

SEQ ID NO: 292150 - protein, 6 aa, Mycobacterium
TTTPLS

SEQ ID NO: 292151 - protein, 26 aa, Mycobacterium
TTTPPPPPPPPPPTTEPPPPPPPPVV

SEQ ID NO: 292152 - protein, 48 aa, Mycobacterium
TTTPPSSAATITSTPASATETTTAPSVSTAPTTSVPGVTASTTVPPTA

SEQ ID NO: 292153 - protein, 6 aa, Mycobacterium
TTTPQQ

SEQ ID NO: 292154 - protein, 5 aa, Mycobacterium
TTTPS

SEQ ID NO: 292155 - protein, 9 aa, Mycobacterium
TTTPVPSDL

SEQ ID NO: 292156 - protein, 7 aa, Mycobacterium
TTTQPLR

SEQ ID NO: 292157 - protein, 13 aa, Mycobacterium
TTTRASDLTARMG

SEQ ID NO: 292158 - protein, 6 aa, Mycobacterium
TTTRTA

SEQ ID NO: 292159 - protein, 6 aa, Mycobacterium
TTTSDP

SEQ ID NO: 292160 - protein, 11 aa, Mycobacterium
TTTSDQTVTVT

SEQ ID NO: 292161 - protein, 14 aa, Mycobacterium
TTTSKENPDGAFAA

SEQ ID NO: 292162 - protein, 9 aa, Mycobacterium
TTTSQDNSL

SEQ ID NO: 292163 - protein, 6 aa, Mycobacterium
TTTSQE

SEQ ID NO: 292164 - protein, 17 aa, Mycobacterium
TTTSQEIPDGSFATSSV

SEQ ID NO: 292165 - protein, 5 aa, Mycobacterium
TTTTF

SEQ ID NO: 292166 - protein, 6 aa, Mycobacterium
TTTTRG

SEQ ID NO: 292167 - protein, 10 aa, Mycobacterium
TTTTSPLTKN

SEQ ID NO: 292168 - protein, 7 aa, Mycobacterium
TTVAEAD

SEQ ID NO: 292169 - protein, 7 aa, Mycobacterium
TTVAPAE

SEQ ID NO: 292170 - protein, 16 aa, Mycobacterium
TTVAPPGPVLPPTPPQ

SEQ ID NO: 292171 - protein, 4 aa, Mycobacterium
TTVG

SEQ ID NO: 292172 - protein, 12 aa, Mycobacterium
TTVGDGPEQEPR

SEQ ID NO: 292173 - protein, 13 aa, Mycobacterium
TTVGTNKQAFDNH

SEQ ID NO: 292174 - protein, 13 aa, Mycobacterium
TTVGTTRQAFDNH

SEQ ID NO: 292175 - protein, 7 aa, Mycobacterium
TTVPTDK

SEQ ID NO: 292176 - protein, 48 aa, Mycobacterium
TTVPTKPEPEPQTRKSPPQKAPTKRAAASKPAKKATGRRAGSAALRST

SEQ ID NO: 292177 - protein, 4 aa, Mycobacterium
TTVS

SEQ ID NO: 292178 - protein, 7 aa, Mycobacterium
TTVSRGV

SEQ ID NO: 292179 - protein, 38 aa, Mycobacterium
TTVTPTAETPAPAPVAPSPLLPAPQAAPPPAAAAPGTV

SEQ ID NO: 292180 - protein, 14 aa, Mycobacterium
TTVVPAPDAEEPQL

SEQ ID NO: 292181 - protein, 19 aa, Mycobacterium
TTWGTTEEYGELRTTMERC

SEQ ID NO: 292182 - protein, 5 aa, Mycobacterium
TTWPG

SEQ ID NO: 292183 - protein, 6 aa, Mycobacterium
TTYAQA

SEQ ID NO: 292184 - protein, 6 aa, Mycobacterium
TTYNQT

SEQ ID NO: 292185 - protein, 6 aa, Mycobacterium
TTYPGI

SEQ ID NO: 292186 - protein, 17 aa, Mycobacterium
TVAAAATSALAALATHA

SEQ ID NO: 292187 - protein, 48 aa, Mycobacterium
TVAAPDAGATDDATDAEATDEATDAEATEDAGEQAADAPAPAPRKRRL

SEQ ID NO: 292188 - protein, 11 aa, Mycobacterium
TVAEASSQVRA

SEQ ID NO: 292189 - protein, 80 aa, Mycobacterium
TVAEDAPKRPMGKGARAKAAVSENAETAPDLEAETPAAEADPAPADSEASEDESTPEVSEPEATEPQAEAEVEADPEPEP

SEQ ID NO: 292190 - protein, 12 aa, Mycobacterium
TVAEPANAAITQ

SEQ ID NO: 292191 - protein, 6 aa, Mycobacterium
TVAETA

SEQ ID NO: 292192 - protein, 4 aa, Mycobacterium
TVAG

SEQ ID NO: 292193 - protein, 14 aa, Mycobacterium
TVAGASGESTQLTR

SEQ ID NO: 292194 - protein, 10 aa, Mycobacterium
TVAGGGVAAG

SEQ ID NO: 292195 - protein, 6 aa, Mycobacterium
TVAGGP

SEQ ID NO: 292196 - protein, 13 aa, Mycobacterium
TVAGQPDSGTTAG

SEQ ID NO: 292197 - protein, 4 aa, Mycobacterium
TVAP

SEQ ID NO: 292198 - protein, 5 aa, Mycobacterium
TVAPG

SEQ ID NO: 292199 - protein, 13 aa, Mycobacterium
TVAPRKAVESGGC

SEQ ID NO: 292200 - protein, 6 aa, Mycobacterium
TVAPTT

SEQ ID NO: 292201 - protein, 29 aa, Mycobacterium
TVAQDDSEHNDSAVPTLTESKNKEATWLT

SEQ ID NO: 292202 - protein, 9 aa, Mycobacterium
TVAQPAASL

SEQ ID NO: 292203 - protein, 23 aa, Mycobacterium
TVASPTVSATPDPTEPPLPIDQD

SEQ ID NO: 292204 - protein, 13 aa, Mycobacterium
TVASQTRAVGERA

SEQ ID NO: 292205 - protein, 8 aa, Mycobacterium
TVATDSGL

SEQ ID NO: 292206 - protein, 8 aa, Mycobacterium
TVATGTGR

SEQ ID NO: 292207 - protein, 6 aa, Mycobacterium
TVCGES

SEQ ID NO: 292208 - protein, 4 aa, Mycobacterium
TVDA

SEQ ID NO: 292209 - protein, 5 aa, Mycobacterium
TVDAD

SEQ ID NO: 292210 - protein, 9 aa, Mycobacterium
TVDGESANL

SEQ ID NO: 292211 - protein, 18 aa, Mycobacterium
TVDGKSKTDISDITVKAA

SEQ ID NO: 292212 - protein, 7 aa, Mycobacterium
TVDGPEA

SEQ ID NO: 292213 - protein, 7 aa, Mycobacterium
TVDGPRL

SEQ ID NO: 292214 - protein, 16 aa, Mycobacterium
TVDGTERPIWRLSERQ

SEQ ID NO: 292215 - protein, 9 aa, Mycobacterium
TVDPQRGRL

SEQ ID NO: 292216 - protein, 13 aa, Mycobacterium
TVDQGPSSPDRGV

SEQ ID NO: 292217 - protein, 9 aa, Mycobacterium
TVDQTSPHL

SEQ ID NO: 292218 - protein, 8 aa, Mycobacterium
TVDRDSLR

SEQ ID NO: 292219 - protein, 13 aa, Mycobacterium
TVDRTGITTGQFG

SEQ ID NO: 292220 - protein, 5 aa, Mycobacterium
TVDSD

SEQ ID NO: 292221 - protein, 8 aa, Mycobacterium
TVDSTRQQ

SEQ ID NO: 292222 - protein, 12 aa, Mycobacterium
TVDTRYSSSPTV

SEQ ID NO: 292223 - protein, 6 aa, Mycobacterium
TVDTVG

SEQ ID NO: 292224 - protein, 6 aa, Mycobacterium
TVDVRG

SEQ ID NO: 292225 - protein, 8 aa, Mycobacterium
TVEDAGSS

SEQ ID NO: 292226 - protein, 9 aa, Mycobacterium
TVEDAGSSW

SEQ ID NO: 292227 - protein, 6 aa, Mycobacterium
TVEDNS

SEQ ID NO: 292228 - protein, 14 aa, Mycobacterium
TVEGGEAEPGDGER

SEQ ID NO: 292229 - protein, 13 aa, Mycobacterium
TVEGRQIRKGASD

SEQ ID NO: 292230 - protein, 21 aa, Mycobacterium
TVEGTSAGTLNDTAETAGQSM

SEQ ID NO: 292231 - protein, 19 aa, Mycobacterium
TVEPTTGPSAAAAAPEVST

SEQ ID NO: 292232 - protein, 7 aa, Mycobacterium
TVERPSK

SEQ ID NO: 292233 - protein, 6 aa, Mycobacterium
TVESDE

SEQ ID NO: 292234 - protein, 9 aa, Mycobacterium
TVESGPGHY

SEQ ID NO: 292235 - protein, 8 aa, Mycobacterium
TVESGQTL

SEQ ID NO: 292236 - protein, 11 aa, Mycobacterium
TVESGQTVTAT

SEQ ID NO: 292237 - protein, 8 aa, Mycobacterium
TVESPANA

SEQ ID NO: 292238 - protein, 9 aa, Mycobacterium
TVESTEDET

SEQ ID NO: 292239 - protein, 6 aa, Mycobacterium
TVESTS

SEQ ID NO: 292240 - protein, 4 aa, Mycobacterium
TVET

SEQ ID NO: 292241 - protein, 15 aa, Mycobacterium
TVETASTTAEDVTAQ

SEQ ID NO: 292242 - protein, 6 aa, Mycobacterium
TVETRT

SEQ ID NO: 292243 - protein, 8 aa, Mycobacterium
TVGAASGL

SEQ ID NO: 292244 - protein, 8 aa, Mycobacterium
TVGAPEEL

SEQ ID NO: 292245 - protein, 5 aa, Mycobacterium
TVGAS

SEQ ID NO: 292246 - protein, 11 aa, Mycobacterium
TVGERAPLSAE

SEQ ID NO: 292247 - protein, 12 aa, Mycobacterium
TVGERAPLSAEK

SEQ ID NO: 292248 - protein, 4 aa, Mycobacterium
TVGG

SEQ ID NO: 292249 - protein, 5 aa, Mycobacterium
TVGGA

SEQ ID NO: 292250 - protein, 7 aa, Mycobacterium
TVGGGAS

SEQ ID NO: 292251 - protein, 4 aa, Mycobacterium
TVGP

SEQ ID NO: 292252 - protein, 13 aa, Mycobacterium
TVGPDAPTDTASS

SEQ ID NO: 292253 - protein, 11 aa, Mycobacterium
TVGPDGQQTTT

SEQ ID NO: 292254 - protein, 7 aa, Mycobacterium
TVGPGIA

SEQ ID NO: 292255 - protein, 5 aa, Mycobacterium
TVGQL

SEQ ID NO: 292256 - protein, 10 aa, Mycobacterium
TVGQPDPDTR

SEQ ID NO: 292257 - protein, 4 aa, Mycobacterium
TVGS

SEQ ID NO: 292258 - protein, 13 aa, Mycobacterium
TVGSPGQGNYSAA

SEQ ID NO: 292259 - protein, 18 aa, Mycobacterium
TVGSPNDLDHAANTDGRV

SEQ ID NO: 292260 - protein, 5 aa, Mycobacterium
TVGSR

SEQ ID NO: 292261 - protein, 5 aa, Mycobacterium
TVGTA

SEQ ID NO: 292262 - protein, 11 aa, Mycobacterium
TVGTDDDAPGL

SEQ ID NO: 292263 - protein, 11 aa, Mycobacterium
TVGTDDEAPGL

SEQ ID NO: 292264 - protein, 11 aa, Mycobacterium
TVGTDDEGPGL

SEQ ID NO: 292265 - protein, 5 aa, Mycobacterium
TVGTL

SEQ ID NO: 292266 - protein, 7 aa, Mycobacterium
TVGTSSE

SEQ ID NO: 292267 - protein, 9 aa, Mycobacterium
TVGTVTASG

SEQ ID NO: 292268 - protein, 12 aa, Mycobacterium
TVHDAQSIAPKR

SEQ ID NO: 292269 - protein, 5 aa, Mycobacterium
TVKDD

SEQ ID NO: 292270 - protein, 6 aa, Mycobacterium
TVKDDA

SEQ ID NO: 292271 - protein, 8 aa, Mycobacterium
TVKDDAAE

SEQ ID NO: 292272 - protein, 6 aa, Mycobacterium
TVKDDS

SEQ ID NO: 292273 - protein, 7 aa, Mycobacterium
TVKDDSI

SEQ ID NO: 292274 - protein, 5 aa, Mycobacterium
TVKDR

SEQ ID NO: 292275 - protein, 9 aa, Mycobacterium
TVKESAADA

SEQ ID NO: 292276 - protein, 7 aa, Mycobacterium
TVKPDRV

SEQ ID NO: 292277 - protein, 6 aa, Mycobacterium
TVKPGD

SEQ ID NO: 292278 - protein, 7 aa, Mycobacterium
TVKPGDH

SEQ ID NO: 292279 - protein, 7 aa, Mycobacterium
TVKPGHA

SEQ ID NO: 292280 - protein, 11 aa, Mycobacterium
TVKPKADITPE

SEQ ID NO: 292281 - protein, 11 aa, Mycobacterium
TVKPKGDISPE

SEQ ID NO: 292282 - protein, 11 aa, Mycobacterium
TVKPKSDITPE

SEQ ID NO: 292283 - protein, 10 aa, Mycobacterium
TVKPSSRRAI

SEQ ID NO: 292284 - protein, 9 aa, Mycobacterium
TVKQESTGV

SEQ ID NO: 292285 - protein, 10 aa, Mycobacterium
TVKSSQPPAV

SEQ ID NO: 292286 - protein, 9 aa, Mycobacterium
TVKSSRPAV

SEQ ID NO: 292287 - protein, 11 aa, Mycobacterium
TVNATDTAGGG

SEQ ID NO: 292288 - protein, 5 aa, Mycobacterium
TVNGS

SEQ ID NO: 292289 - protein, 7 aa, Mycobacterium
TVNGSGA

SEQ ID NO: 292290 - protein, 10 aa, Mycobacterium
TVNPKTQTPI

SEQ ID NO: 292291 - protein, 6 aa, Mycobacterium
TVNPSQ

SEQ ID NO: 292292 - protein, 20 aa, Mycobacterium
TVNRGRELTGAGAARRTPET

SEQ ID NO: 292293 - protein, 28 aa, Mycobacterium
TVNTESSDDHREQPAPQSAGADAPAPVN

SEQ ID NO: 292294 - protein, 22 aa, Mycobacterium
TVPAAGSDRAEPGEGPAPPPLD

SEQ ID NO: 292295 - protein, 5 aa, Mycobacterium
TVPAL

SEQ ID NO: 292296 - protein, 7 aa, Mycobacterium
TVPASAE

SEQ ID NO: 292297 - protein, 13 aa, Mycobacterium
TVPGAAEVANETF

SEQ ID NO: 292298 - protein, 8 aa, Mycobacterium
TVPGGNGF

SEQ ID NO: 292299 - protein, 10 aa, Mycobacterium
TVPGGQPPGT

SEQ ID NO: 292300 - protein, 10 aa, Mycobacterium
TVPGHKPANL

SEQ ID NO: 292301 - protein, 9 aa, Mycobacterium
TVPGKRAPT

SEQ ID NO: 292302 - protein, 8 aa, Mycobacterium
TVPGPGSA

SEQ ID NO: 292303 - protein, 9 aa, Mycobacterium
TVPGPGSSG

SEQ ID NO: 292304 - protein, 9 aa, Mycobacterium
TVPGRGQAN

SEQ ID NO: 292305 - protein, 10 aa, Mycobacterium
TVPGSGQANL

SEQ ID NO: 292306 - protein, 22 aa, Mycobacterium
TVPGSNGFHAPGPNAGTPDEAA

SEQ ID NO: 292307 - protein, 19 aa, Mycobacterium
TVPGTRKDPRIRDDESVRA

SEQ ID NO: 292308 - protein, 5 aa, Mycobacterium
TVPHG

SEQ ID NO: 292309 - protein, 8 aa, Mycobacterium
TVPHPDGQ

SEQ ID NO: 292310 - protein, 6 aa, Mycobacterium
TVPHSS

SEQ ID NO: 292311 - protein, 10 aa, Mycobacterium
TVPKPAPPRD

SEQ ID NO: 292312 - protein, 5 aa, Mycobacterium
TVPNS

SEQ ID NO: 292313 - protein, 12 aa, Mycobacterium
TVPPANQTSAIT

SEQ ID NO: 292314 - protein, 5 aa, Mycobacterium
TVPPD

SEQ ID NO: 292315 - protein, 18 aa, Mycobacterium
TVPPDQARAANQTTGPNG

SEQ ID NO: 292316 - protein, 15 aa, Mycobacterium
TVPPGGDEYRRAHTA

SEQ ID NO: 292317 - protein, 44 aa, Mycobacterium
TVPPPPPPPPDEAGAMAPSSGPPDPQTEDEPAVPPLPPGAPDGV

SEQ ID NO: 292318 - protein, 7 aa, Mycobacterium
TVPPSIA

SEQ ID NO: 292319 - protein, 9 aa, Mycobacterium
TVPQDTEVQ

SEQ ID NO: 292320 - protein, 5 aa, Mycobacterium
TVPRP

SEQ ID NO: 292321 - protein, 8 aa, Mycobacterium
TVPSSGRV

SEQ ID NO: 292322 - protein, 5 aa, Mycobacterium
TVPTA

SEQ ID NO: 292323 - protein, 6 aa, Mycobacterium
TVPTAV

SEQ ID NO: 292324 - protein, 15 aa, Mycobacterium
TVPTAVGASTEGVEQ

SEQ ID NO: 292325 - protein, 8 aa, Mycobacterium
TVPTPRRR

SEQ ID NO: 292326 - protein, 13 aa, Mycobacterium
TVPVGTAAELGRR

SEQ ID NO: 292327 - protein, 9 aa, Mycobacterium
TVPVPSGAP

SEQ ID NO: 292328 - protein, 17 aa, Mycobacterium
TVQDGANRLAGGSRQVA

SEQ ID NO: 292329 - protein, 11 aa, Mycobacterium
TVQPAPTAAPR

SEQ ID NO: 292330 - protein, 28 aa, Mycobacterium
TVQPPPPQSTGAYPVPPLPSVGTKETAD

SEQ ID NO: 292331 - protein, 7 aa, Mycobacterium
TVRAGGA

SEQ ID NO: 292332 - protein, 9 aa, Mycobacterium
TVRASDLGG

SEQ ID NO: 292333 - protein, 27 aa, Mycobacterium
TVRDDATALAPAAPVPAETGEGTGTAT

SEQ ID NO: 292334 - protein, 4 aa, Mycobacterium
TVRE

SEQ ID NO: 292335 - protein, 5 aa, Mycobacterium
TVRGP

SEQ ID NO: 292336 - protein, 19 aa, Mycobacterium
TVRNGVDPSPHQTGTAGYR

SEQ ID NO: 292337 - protein, 12 aa, Mycobacterium
TVRQGNSGGPMI

SEQ ID NO: 292338 - protein, 7 aa, Mycobacterium
TVRRDRA

SEQ ID NO: 292339 - protein, 9 aa, Mycobacterium
TVRTQNPMP

SEQ ID NO: 292340 - protein, 11 aa, Mycobacterium
TVSDNGPGINP

SEQ ID NO: 292341 - protein, 4 aa, Mycobacterium
TVSE

SEQ ID NO: 292342 - protein, 15 aa, Mycobacterium
TVSGAADAPAGAEQQ

SEQ ID NO: 292343 - protein, 17 aa, Mycobacterium
TVSGGSEIRRGDSPSPR

SEQ ID NO: 292344 - protein, 13 aa, Mycobacterium
TVSGRGGDLAGTE

SEQ ID NO: 292345 - protein, 6 aa, Mycobacterium
TVSLAG

SEQ ID NO: 292346 - protein, 7 aa, Mycobacterium
TVSPDDL

SEQ ID NO: 292347 - protein, 18 aa, Mycobacterium
TVSPETTAAGGQLDAAAD

SEQ ID NO: 292348 - protein, 7 aa, Mycobacterium
TVSSGDL

SEQ ID NO: 292349 - protein, 6 aa, Mycobacterium
TVSTPK

SEQ ID NO: 292350 - protein, 12 aa, Mycobacterium
TVTADPPPGNTP

SEQ ID NO: 292351 - protein, 6 aa, Mycobacterium
TVTAPR

SEQ ID NO: 292352 - protein, 10 aa, Mycobacterium
TVTARRTDGG

SEQ ID NO: 292353 - protein, 15 aa, Mycobacterium
TVTDTGPGIPEQERD

SEQ ID NO: 292354 - protein, 7 aa, Mycobacterium
TVTEDSV

SEQ ID NO: 292355 - protein, 6 aa, Mycobacterium
TVTGDR

SEQ ID NO: 292356 - protein, 9 aa, Mycobacterium
TVTGRPRDE

SEQ ID NO: 292357 - protein, 24 aa, Mycobacterium
TVTGTPPVPDEHPSPQTLPEVGAR

SEQ ID NO: 292358 - protein, 4 aa, Mycobacterium
TVTN

SEQ ID NO: 292359 - protein, 13 aa, Mycobacterium
TVTPAPPPPPPAP

SEQ ID NO: 292360 - protein, 11 aa, Mycobacterium
TVTPKAEDTSL

SEQ ID NO: 292361 - protein, 11 aa, Mycobacterium
TVTPSESALSL

SEQ ID NO: 292362 - protein, 9 aa, Mycobacterium
TVTRNGRTL

SEQ ID NO: 292363 - protein, 6 aa, Mycobacterium
TVTRRT

SEQ ID NO: 292364 - protein, 9 aa, Mycobacterium
TVTSAQQKR

SEQ ID NO: 292365 - protein, 8 aa, Mycobacterium
TVTTDDHV

SEQ ID NO: 292366 - protein, 6 aa, Mycobacterium
TVTTQD

SEQ ID NO: 292367 - protein, 9 aa, Mycobacterium
TVTTTGGRV

SEQ ID NO: 292368 - protein, 11 aa, Mycobacterium
TVTVTNKSKTY

SEQ ID NO: 292369 - protein, 5 aa, Mycobacterium
TVTYT

SEQ ID NO: 292370 - protein, 7 aa, Mycobacterium
TVYPGEA

SEQ ID NO: 292371 - protein, 6 aa, Mycobacterium
TVYPSE

SEQ ID NO: 292372 - protein, 5 aa, Mycobacterium
TWAQS

SEQ ID NO: 292373 - protein, 11 aa, Mycobacterium
TWDGLPDMGTA

SEQ ID NO: 292374 - protein, 13 aa, Mycobacterium
TWESSPQDNPLNP

SEQ ID NO: 292375 - protein, 14 aa, Mycobacterium
TWESSPTDDPFNPT

SEQ ID NO: 292376 - protein, 8 aa, Mycobacterium
TWGRTQRA

SEQ ID NO: 292377 - protein, 8 aa, Mycobacterium
TWPDEPDL

SEQ ID NO: 292378 - protein, 15 aa, Mycobacterium
TWRSPDDLSDIDTPD

SEQ ID NO: 292379 - protein, 5 aa, Mycobacterium
TWSRP

SEQ ID NO: 292380 - protein, 8 aa, Mycobacterium
TYAAATDK

SEQ ID NO: 292381 - protein, 5 aa, Mycobacterium
TYADK

SEQ ID NO: 292382 - protein, 14 aa, Mycobacterium
TYAGTSTNAGQRRP

SEQ ID NO: 292383 - protein, 7 aa, Mycobacterium
TYAHASP

SEQ ID NO: 292384 - protein, 4 aa, Mycobacterium
TYAQ

SEQ ID NO: 292385 - protein, 5 aa, Mycobacterium
TYAQA

SEQ ID NO: 292386 - protein, 5 aa, Mycobacterium
TYAQR

SEQ ID NO: 292387 - protein, 12 aa, Mycobacterium
TYATGSQQQSKL

SEQ ID NO: 292388 - protein, 11 aa, Mycobacterium
TYGSGPDFRSP

SEQ ID NO: 292389 - protein, 20 aa, Mycobacterium
TYHSGTPKVSNTGSANVVER

SEQ ID NO: 292390 - protein, 7 aa, Mycobacterium
TYKPNYN

SEQ ID NO: 292391 - protein, 4 aa, Mycobacterium
TYKT

SEQ ID NO: 292392 - protein, 6 aa, Mycobacterium
TYNENP

SEQ ID NO: 292393 - protein, 17 aa, Mycobacterium
TYPDQSTVPTSPTAKNL

SEQ ID NO: 292394 - protein, 10 aa, Mycobacterium
TYPDRADVTT

SEQ ID NO: 292395 - protein, 6 aa, Mycobacterium
TYPESV

SEQ ID NO: 292396 - protein, 5 aa, Mycobacterium
TYPGV

SEQ ID NO: 292397 - protein, 6 aa, Mycobacterium
TYPGVG

SEQ ID NO: 292398 - protein, 5 aa, Mycobacterium
TYPSN

SEQ ID NO: 292399 - protein, 38 aa, Mycobacterium
TYPTPPAYPTTTNPANTYSTTPYPPASKSLAPVPPPMT

SEQ ID NO: 292400 - protein, 6 aa, Mycobacterium
TYRGTQ

SEQ ID NO: 292401 - protein, 10 aa, Mycobacterium
TYRVGEDPQD

SEQ ID NO: 292402 - protein, 4 aa, Mycobacterium
TYSE

SEQ ID NO: 292403 - protein, 7 aa, Mycobacterium
TYSGDQA

SEQ ID NO: 292404 - protein, 7 aa, Mycobacterium
TYSNGSR

SEQ ID NO: 292405 - protein, 5 aa, Mycobacterium
TYSPP

SEQ ID NO: 292406 - protein, 22 aa, Mycobacterium
TYSSGEPEITKSGMDNTVERRA

SEQ ID NO: 292407 - protein, 7 aa, Mycobacterium
TYTDADP

SEQ ID NO: 292408 - protein, 15 aa, Mycobacterium
TYTPTNSPAGLPNGE

SEQ ID NO: 292409 - protein, 6 aa, Mycobacterium
TYTQAS

SEQ ID NO: 292410 - protein, 16 aa, Mycobacterium
TYTQPKRTYCTERIGS

SEQ ID NO: 292411 - protein, 14 aa, Mycobacterium
VAAAQDDSTRRTIP

SEQ ID NO: 292412 - protein, 82 aa, Mycobacterium
VAAASTAKPPVSPGVSPKAPNAPPAKAPEPTQPASSAGPPGASTPGVRPGNLPRSQRVPPATKAQRDAAYEASAARNGGKPQ

SEQ ID NO: 292413 - protein, 6 aa, Mycobacterium
VAAATG

SEQ ID NO: 292414 - protein, 11 aa, Mycobacterium
VAADGKKMENA

SEQ ID NO: 292415 - protein, 10 aa, Mycobacterium
VAADPATQTA

SEQ ID NO: 292416 - protein, 11 aa, Mycobacterium
VAADPKSPVDD

SEQ ID NO: 292417 - protein, 8 aa, Mycobacterium
VAADRSTI

SEQ ID NO: 292418 - protein, 5 aa, Mycobacterium
VAAEA

SEQ ID NO: 292419 - protein, 8 aa, Mycobacterium
VAAEAATT

SEQ ID NO: 292420 - protein, 9 aa, Mycobacterium
VAAEPESMR

SEQ ID NO: 292421 - protein, 4 aa, Mycobacterium
VAAG

SEQ ID NO: 292422 - protein, 6 aa, Mycobacterium
VAAGAA

SEQ ID NO: 292423 - protein, 11 aa, Mycobacterium
VAAGDTPGGGL

SEQ ID NO: 292424 - protein, 21 aa, Mycobacterium
VAAGMNGARNGAPAVPSVADN

SEQ ID NO: 292425 - protein, 8 aa, Mycobacterium
VAAGPRGR

SEQ ID NO: 292426 - protein, 12 aa, Mycobacterium
VAAGQAADDGYG

SEQ ID NO: 292427 - protein, 12 aa, Mycobacterium
VAAGRTAPPPDW

SEQ ID NO: 292428 - protein, 6 aa, Mycobacterium
VAAGSD

SEQ ID NO: 292429 - protein, 10 aa, Mycobacterium
VAAGTRPAAV

SEQ ID NO: 292430 - protein, 9 aa, Mycobacterium
VAAGTTRDE

SEQ ID NO: 292431 - protein, 9 aa, Mycobacterium
VAAKDENKV

SEQ ID NO: 292432 - protein, 10 aa, Mycobacterium
VAAKTRPEQS

SEQ ID NO: 292433 - protein, 21 aa, Mycobacterium
VAANADADYVRTATAKGLSRP

SEQ ID NO: 292434 - protein, 11 aa, Mycobacterium
VAANASAERAL

SEQ ID NO: 292435 - protein, 18 aa, Mycobacterium
VAANESGDIENAPDYAPA

SEQ ID NO: 292436 - protein, 13 aa, Mycobacterium
VAAPAAGLAAAPA

SEQ ID NO: 292437 - protein, 9 aa, Mycobacterium
VAAPGGPEL

SEQ ID NO: 292438 - protein, 11 aa, Mycobacterium
VAAPPPLAEPT

SEQ ID NO: 292439 - protein, 6 aa, Mycobacterium
VAAPTG

SEQ ID NO: 292440 - protein, 9 aa, Mycobacterium
VAARAGNIQ

SEQ ID NO: 292441 - protein, 5 aa, Mycobacterium
VAARD

SEQ ID NO: 292442 - protein, 9 aa, Mycobacterium
VAASKPANW

SEQ ID NO: 292443 - protein, 23 aa, Mycobacterium
VAASPSTPAPAAPTTPAPAQPIA

SEQ ID NO: 292444 - protein, 5 aa, Mycobacterium
VAATA

SEQ ID NO: 292445 - protein, 11 aa, Mycobacterium
VAATADGPAGY

SEQ ID NO: 292446 - protein, 8 aa, Mycobacterium
VAATATGF

SEQ ID NO: 292447 - protein, 8 aa, Mycobacterium
VAATGGPQ

SEQ ID NO: 292448 - protein, 9 aa, Mycobacterium
VAATGGPQC

SEQ ID NO: 292449 - protein, 9 aa, Mycobacterium
VAATGTHAE

SEQ ID NO: 292450 - protein, 13 aa, Mycobacterium
VAATGVSAPAADM

SEQ ID NO: 292451 - protein, 12 aa, Mycobacterium
VAATNPSPIGGA

SEQ ID NO: 292452 - protein, 8 aa, Mycobacterium
VAATPQTV

SEQ ID NO: 292453 - protein, 4 aa, Mycobacterium
VADA

SEQ ID NO: 292454 - protein, 7 aa, Mycobacterium
VADAAQA

SEQ ID NO: 292455 - protein, 11 aa, Mycobacterium
VADAGEGNAGA

SEQ ID NO: 292456 - protein, 24 aa, Mycobacterium
VADDPAETALQGPLPPPDRDSADG

SEQ ID NO: 292457 - protein, 5 aa, Mycobacterium
VADEL

SEQ ID NO: 292458 - protein, 11 aa, Mycobacterium
VADESNPAPPT

SEQ ID NO: 292459 - protein, 8 aa, Mycobacterium
VADETTLT

SEQ ID NO: 292460 - protein, 6 aa, Mycobacterium
VADGGL

SEQ ID NO: 292461 - protein, 8 aa, Mycobacterium
VADGKPVS

SEQ ID NO: 292462 - protein, 7 aa, Mycobacterium
VADGTAA

SEQ ID NO: 292463 - protein, 9 aa, Mycobacterium
VADGTGTTS

SEQ ID NO: 292464 - protein, 4 aa, Mycobacterium
VADK

SEQ ID NO: 292465 - protein, 6 aa, Mycobacterium
VADNRG

SEQ ID NO: 292466 - protein, 13 aa, Mycobacterium
VADPNGKTPAEPA

SEQ ID NO: 292467 - protein, 10 aa, Mycobacterium
VADPSGDHRD

SEQ ID NO: 292468 - protein, 8 aa, Mycobacterium
VADPTTAV

SEQ ID NO: 292469 - protein, 13 aa, Mycobacterium
VADQGRRRGRGHE

SEQ ID NO: 292470 - protein, 7 aa, Mycobacterium
VADQGVA

SEQ ID NO: 292471 - protein, 5 aa, Mycobacterium
VADQL

SEQ ID NO: 292472 - protein, 10 aa, Mycobacterium
VADQPTPPGL

SEQ ID NO: 292473 - protein, 7 aa, Mycobacterium
VADRGPS

SEQ ID NO: 292474 - protein, 17 aa, Mycobacterium
VADSEKSAKAARTSEER

SEQ ID NO: 292475 - protein, 17 aa, Mycobacterium
VADSESSAEKARGSEDR

SEQ ID NO: 292476 - protein, 6 aa, Mycobacterium
VADSHG

SEQ ID NO: 292477 - protein, 9 aa, Mycobacterium
VADSTPGRV

SEQ ID NO: 292478 - protein, 7 aa, Mycobacterium
VADTGSE

SEQ ID NO: 292479 - protein, 9 aa, Mycobacterium
VADTSPAFT

SEQ ID NO: 292480 - protein, 15 aa, Mycobacterium
VAEAGQRARPGTVAA

SEQ ID NO: 292481 - protein, 19 aa, Mycobacterium
VAEATATFTPQSPTASIDR

SEQ ID NO: 292482 - protein, 28 aa, Mycobacterium
VAEEPEEADEPAAPVDEDDTADDQSDLA

SEQ ID NO: 292483 - protein, 4 aa, Mycobacterium
VAEG

SEQ ID NO: 292484 - protein, 16 aa, Mycobacterium
VAEGKTNDVPTRAARS

SEQ ID NO: 292485 - protein, 6 aa, Mycobacterium
VAEGNA

SEQ ID NO: 292486 - protein, 7 aa, Mycobacterium
VAEGPGG

SEQ ID NO: 292487 - protein, 13 aa, Mycobacterium
VAEGRGKAQAASL

SEQ ID NO: 292488 - protein, 20 aa, Mycobacterium
VAEGRGKAQADTLRKTKADT

SEQ ID NO: 292489 - protein, 21 aa, Mycobacterium
VAEGRGKAQADTLRRAKADTV

SEQ ID NO: 292490 - protein, 22 aa, Mycobacterium
VAEGRGKAQAESLRKTKADTMA

SEQ ID NO: 292491 - protein, 22 aa, Mycobacterium
VAEGRGKAQAETLRRAKTQTLA

SEQ ID NO: 292492 - protein, 22 aa, Mycobacterium
VAEGRGKAQAETLRRAKTQTVA

SEQ ID NO: 292493 - protein, 9 aa, Mycobacterium
VAENTSDAQ

SEQ ID NO: 292494 - protein, 4 aa, Mycobacterium
VAEP

SEQ ID NO: 292495 - protein, 13 aa, Mycobacterium
VAEPDERGESLSS

SEQ ID NO: 292496 - protein, 9 aa, Mycobacterium
VAEPDPQTL

SEQ ID NO: 292497 - protein, 13 aa, Mycobacterium
VAEPGESAARNNF

SEQ ID NO: 292498 - protein, 9 aa, Mycobacterium
VAEPPPRGA

SEQ ID NO: 292499 - protein, 9 aa, Mycobacterium
VAEQDQSKV

SEQ ID NO: 292500 - protein, 12 aa, Mycobacterium
VAEQEPAELVSA

SEQ ID NO: 292501 - protein, 8 aa, Mycobacterium
VAEQQPVE

SEQ ID NO: 292502 - protein, 16 aa, Mycobacterium
VAEQSADDAQAALQNR

SEQ ID NO: 292503 - protein, 10 aa, Mycobacterium
VAERNPPGFL

SEQ ID NO: 292504 - protein, 13 aa, Mycobacterium
VAERPPIPLDRDA

SEQ ID NO: 292505 - protein, 4 aa, Mycobacterium
VAES

SEQ ID NO: 292506 - protein, 6 aa, Mycobacterium
VAESAD

SEQ ID NO: 292507 - protein, 6 aa, Mycobacterium
VAESGV

SEQ ID NO: 292508 - protein, 4 aa, Mycobacterium
VAET

SEQ ID NO: 292509 - protein, 10 aa, Mycobacterium
VAETAPSPVG

SEQ ID NO: 292510 - protein, 7 aa, Mycobacterium
VAETEKA

SEQ ID NO: 292511 - protein, 8 aa, Mycobacterium
VAETGTHT

SEQ ID NO: 292512 - protein, 4 aa, Mycobacterium
VAGA

SEQ ID NO: 292513 - protein, 6 aa, Mycobacterium
VAGAPE

SEQ ID NO: 292514 - protein, 7 aa, Mycobacterium
VAGDGDA

SEQ ID NO: 292515 - protein, 7 aa, Mycobacterium
VAGDTAR

SEQ ID NO: 292516 - protein, 7 aa, Mycobacterium
VAGDTSA

SEQ ID NO: 292517 - protein, 47 aa, Mycobacterium
VAGEDEKRDGGGSPPGGLGSVEGDEALEAAGGASAANESAVEGAADA

SEQ ID NO: 292518 - protein, 7 aa, Mycobacterium
VAGEKVP

SEQ ID NO: 292519 - protein, 14 aa, Mycobacterium
VAGGKRSGSATLGT

SEQ ID NO: 292520 - protein, 12 aa, Mycobacterium
VAGGLDADGLTN

SEQ ID NO: 292521 - protein, 6 aa, Mycobacterium
VAGGRK

SEQ ID NO: 292522 - protein, 13 aa, Mycobacterium
VAGGRVDDRVGSK

SEQ ID NO: 292523 - protein, 5 aa, Mycobacterium
VAGGS

SEQ ID NO: 292524 - protein, 90 aa, Mycobacterium
VAGHPGPPPPARQSNWTAPPSARPHPGPPPKSGQPMYPSSASRQPGFAPGPPRQPSNQPPNQPPNYAPAGPRPSPPTQMQPSAAKPPEVA

SEQ ID NO: 292525 - protein, 8 aa, Mycobacterium
VAGKDSFP

SEQ ID NO: 292526 - protein, 8 aa, Mycobacterium
VAGNTAKY

SEQ ID NO: 292527 - protein, 10 aa, Mycobacterium
VAGPARSAVN

SEQ ID NO: 292528 - protein, 12 aa, Mycobacterium
VAGPDEYSNGVT

SEQ ID NO: 292529 - protein, 9 aa, Mycobacterium
VAGPDGQRV

SEQ ID NO: 292530 - protein, 10 aa, Mycobacterium
VAGPGAKSAV

SEQ ID NO: 292531 - protein, 6 aa, Mycobacterium
VAGPLR

SEQ ID NO: 292532 - protein, 10 aa, Mycobacterium
VAGPSEPLRP

SEQ ID NO: 292533 - protein, 8 aa, Mycobacterium
VAGPTTPY

SEQ ID NO: 292534 - protein, 18 aa, Mycobacterium
VAGPVTGPGQLPGPAAGA

SEQ ID NO: 292535 - protein, 11 aa, Mycobacterium
VAGQPKRFGSS

SEQ ID NO: 292536 - protein, 7 aa, Mycobacterium
VAGQTGG

SEQ ID NO: 292537 - protein, 7 aa, Mycobacterium
VAGRDGR

SEQ ID NO: 292538 - protein, 6 aa, Mycobacterium
VAGRPA

SEQ ID NO: 292539 - protein, 6 aa, Mycobacterium
VAGRPG

SEQ ID NO: 292540 - protein, 10 aa, Mycobacterium
VAGRPTDLDG

SEQ ID NO: 292541 - protein, 11 aa, Mycobacterium
VAGRSNPETWT

SEQ ID NO: 292542 - protein, 8 aa, Mycobacterium
VAGRTSSL

SEQ ID NO: 292543 - protein, 7 aa, Mycobacterium
VAGSAGA

SEQ ID NO: 292544 - protein, 17 aa, Mycobacterium
VAGSQPPAIDAPPSETV

SEQ ID NO: 292545 - protein, 7 aa, Mycobacterium
VAGSQPR

SEQ ID NO: 292546 - protein, 6 aa, Mycobacterium
VAGSQS

SEQ ID NO: 292547 - protein, 7 aa, Mycobacterium
VAGSRTP

SEQ ID NO: 292548 - protein, 5 aa, Mycobacterium
VAGST

SEQ ID NO: 292549 - protein, 10 aa, Mycobacterium
VAGSTLTANY

SEQ ID NO: 292550 - protein, 7 aa, Mycobacterium
VAGTESV

SEQ ID NO: 292551 - protein, 9 aa, Mycobacterium
VAGTPRTRV

SEQ ID NO: 292552 - protein, 24 aa, Mycobacterium
VAGTQDDANAEGTRVGVGPGGQYT

SEQ ID NO: 292553 - protein, 6 aa, Mycobacterium
VAGTTQ

SEQ ID NO: 292554 - protein, 4 aa, Mycobacterium
VAHA

SEQ ID NO: 292555 - protein, 22 aa, Mycobacterium
VAHDGDGADHQHGHGGISGERT

SEQ ID NO: 292556 - protein, 7 aa, Mycobacterium
VAHPDAG

SEQ ID NO: 292557 - protein, 6 aa, Mycobacterium
VAHTTS

SEQ ID NO: 292558 - protein, 43 aa, Mycobacterium
VAKANQKLYPGRAAGDAAAAGAVPEDERKQASVRTKNPDTGEY

SEQ ID NO: 292559 - protein, 12 aa, Mycobacterium
VAKDATGSKWSQ

SEQ ID NO: 292560 - protein, 12 aa, Mycobacterium
VAKGAQPNTTLA

SEQ ID NO: 292561 - protein, 7 aa, Mycobacterium
VAKGDTA

SEQ ID NO: 292562 - protein, 8 aa, Mycobacterium
VAKGDTNT

SEQ ID NO: 292563 - protein, 8 aa, Mycobacterium
VAKGDTTT

SEQ ID NO: 292564 - protein, 7 aa, Mycobacterium
VAKGEPT

SEQ ID NO: 292565 - protein, 6 aa, Mycobacterium
VAKGNT

SEQ ID NO: 292566 - protein, 8 aa, Mycobacterium
VAKGPQSH

SEQ ID NO: 292567 - protein, 6 aa, Mycobacterium
VAKPGA

SEQ ID NO: 292568 - protein, 6 aa, Mycobacterium
VAKQNG

SEQ ID NO: 292569 - protein, 14 aa, Mycobacterium
VAKQTDPTPGAPLA

SEQ ID NO: 292570 - protein, 14 aa, Mycobacterium
VAKQTEPTPGAPLA

SEQ ID NO: 292571 - protein, 10 aa, Mycobacterium
VAKRGSMGSW

SEQ ID NO: 292572 - protein, 10 aa, Mycobacterium
VAKTPEPQAV

SEQ ID NO: 292573 - protein, 4 aa, Mycobacterium
VANA

SEQ ID NO: 292574 - protein, 22 aa, Mycobacterium
VANGQSGGPLPMAGPQRGGGFG

SEQ ID NO: 292575 - protein, 15 aa, Mycobacterium
VANPAGAQSGSGPRP

SEQ ID NO: 292576 - protein, 6 aa, Mycobacterium
VANSSL

SEQ ID NO: 292577 - protein, 6 aa, Mycobacterium
VANSVG

SEQ ID NO: 292578 - protein, 8 aa, Mycobacterium
VANTGGLG

SEQ ID NO: 292579 - protein, 25 aa, Mycobacterium
VAPAAPAAPAAPAPAGPPLPAEAGA

SEQ ID NO: 292580 - protein, 47 aa, Mycobacterium
VAPADRPPSGGPSPSGPGYRPGPPSYPSRPSWPSPPPDRPPDPVASA

SEQ ID NO: 292581 - protein, 7 aa, Mycobacterium
VAPAGSL

SEQ ID NO: 292582 - protein, 22 aa, Mycobacterium
VAPANPGSGSANQGSGSGSHTD

SEQ ID NO: 292583 - protein, 50 aa, Mycobacterium
VAPAPAAAPPRQYAPPPTARPAPQGPPAPAPAAAPPVSAPRRPAESTESG

SEQ ID NO: 292584 - protein, 30 aa, Mycobacterium
VAPATDSGSNLNNADTSSAQQQATTTTQYP

SEQ ID NO: 292585 - protein, 4 aa, Mycobacterium
VAPD

SEQ ID NO: 292586 - protein, 6 aa, Mycobacterium
VAPDAP

SEQ ID NO: 292587 - protein, 6 aa, Mycobacterium
VAPDDI

SEQ ID NO: 292588 - protein, 6 aa, Mycobacterium
VAPDDV

SEQ ID NO: 292589 - protein, 25 aa, Mycobacterium
VAPDFSESAARQTTGVGASARGAGR

SEQ ID NO: 292590 - protein, 15 aa, Mycobacterium
VAPDGTRSEEPRPDG

SEQ ID NO: 292591 - protein, 9 aa, Mycobacterium
VAPDGVTPG

SEQ ID NO: 292592 - protein, 9 aa, Mycobacterium
VAPEAAGPD

SEQ ID NO: 292593 - protein, 7 aa, Mycobacterium
VAPETDE

SEQ ID NO: 292594 - protein, 7 aa, Mycobacterium
VAPETTK

SEQ ID NO: 292595 - protein, 9 aa, Mycobacterium
VAPGDSEIQ

SEQ ID NO: 292596 - protein, 9 aa, Mycobacterium
VAPGEGPDL

SEQ ID NO: 292597 - protein, 12 aa, Mycobacterium
VAPGGAAGRSEQ

SEQ ID NO: 292598 - protein, 9 aa, Mycobacterium
VAPGGDHTA

SEQ ID NO: 292599 - protein, 7 aa, Mycobacterium
VAPGGVG

SEQ ID NO: 292600 - protein, 11 aa, Mycobacterium
VAPGRRATTTV

SEQ ID NO: 292601 - protein, 7 aa, Mycobacterium
VAPGSFY

SEQ ID NO: 292602 - protein, 8 aa, Mycobacterium
VAPGSPAY

SEQ ID NO: 292603 - protein, 6 aa, Mycobacterium
VAPGTP

SEQ ID NO: 292604 - protein, 13 aa, Mycobacterium
VAPGTPDAYTGDV

SEQ ID NO: 292605 - protein, 11 aa, Mycobacterium
VAPKERTKASV

SEQ ID NO: 292606 - protein, 11 aa, Mycobacterium
VAPKETPEARR

SEQ ID NO: 292607 - protein, 6 aa, Mycobacterium
VAPNDH

SEQ ID NO: 292608 - protein, 7 aa, Mycobacterium
VAPPDDL

SEQ ID NO: 292609 - protein, 13 aa, Mycobacterium
VAPPDGWTRADTE

SEQ ID NO: 292610 - protein, 7 aa, Mycobacterium
VAPPDTT

SEQ ID NO: 292611 - protein, 7 aa, Mycobacterium
VAPPEDL

SEQ ID NO: 292612 - protein, 7 aa, Mycobacterium
VAPPGTL

SEQ ID NO: 292613 - protein, 8 aa, Mycobacterium
VAPPNRKR

SEQ ID NO: 292614 - protein, 10 aa, Mycobacterium
VAPPPAGRSR

SEQ ID NO: 292615 - protein, 18 aa, Mycobacterium
VAPPPPPPPPPPPPDEPS

SEQ ID NO: 292616 - protein, 11 aa, Mycobacterium
VAPPPQRPAET

SEQ ID NO: 292617 - protein, 5 aa, Mycobacterium
VAPPR

SEQ ID NO: 292618 - protein, 10 aa, Mycobacterium
VAPPRGLDAP

SEQ ID NO: 292619 - protein, 6 aa, Mycobacterium
VAPPRV

SEQ ID NO: 292620 - protein, 4 aa, Mycobacterium
VAPQ

SEQ ID NO: 292621 - protein, 11 aa, Mycobacterium
VAPQADRRTRG

SEQ ID NO: 292622 - protein, 69 aa, Mycobacterium
VAPQAEDAEAEPAEAEEAEVAEAEPAEAEEAEVAEAEPAEAEDAEVAEVESEPAPEEPEVDEARAEESE

SEQ ID NO: 292623 - protein, 34 aa, Mycobacterium
VAPQAGVPAPVPALPAPASGVQPGPAAAAAPGVS

SEQ ID NO: 292624 - protein, 11 aa, Mycobacterium
VAPQKSADPRD

SEQ ID NO: 292625 - protein, 11 aa, Mycobacterium
VAPQPDRRTRG

SEQ ID NO: 292626 - protein, 12 aa, Mycobacterium
VAPQQDSSADEM

SEQ ID NO: 292627 - protein, 5 aa, Mycobacterium
VAPQR

SEQ ID NO: 292628 - protein, 4 aa, Mycobacterium
VAPR

SEQ ID NO: 292629 - protein, 5 aa, Mycobacterium
VAPRD

SEQ ID NO: 292630 - protein, 20 aa, Mycobacterium
VAPSASADVTEESDAETLTD

SEQ ID NO: 292631 - protein, 10 aa, Mycobacterium
VAPSDQGAGP

SEQ ID NO: 292632 - protein, 20 aa, Mycobacterium
VAPSQATPAAADRCDGGPGW

SEQ ID NO: 292633 - protein, 5 aa, Mycobacterium
VAPSR

SEQ ID NO: 292634 - protein, 9 aa, Mycobacterium
VAPSRSAAA

SEQ ID NO: 292635 - protein, 10 aa, Mycobacterium
VAPSRSAAAV

SEQ ID NO: 292636 - protein, 16 aa, Mycobacterium
VAPSTTATLTNLGSSK

SEQ ID NO: 292637 - protein, 4 aa, Mycobacterium
VAPT

SEQ ID NO: 292638 - protein, 6 aa, Mycobacterium
VAPTDP

SEQ ID NO: 292639 - protein, 9 aa, Mycobacterium
VAPTPEKTS

SEQ ID NO: 292640 - protein, 6 aa, Mycobacterium
VAPTPR

SEQ ID NO: 292641 - protein, 8 aa, Mycobacterium
VAPTRPRT

SEQ ID NO: 292642 - protein, 8 aa, Mycobacterium
VAPTTNAL

SEQ ID NO: 292643 - protein, 8 aa, Mycobacterium
VAQEHPGV

SEQ ID NO: 292644 - protein, 5 aa, Mycobacterium
VAQGD

SEQ ID NO: 292645 - protein, 6 aa, Mycobacterium
VAQHGA

SEQ ID NO: 292646 - protein, 15 aa, Mycobacterium
VAQPGTAPKSPKFPS

SEQ ID NO: 292647 - protein, 12 aa, Mycobacterium
VAQPRPADTGAV

SEQ ID NO: 292648 - protein, 21 aa, Mycobacterium
VAQPSPDARSPAPSSASAAPI

SEQ ID NO: 292649 - protein, 6 aa, Mycobacterium
VAQQEG

SEQ ID NO: 292650 - protein, 5 aa, Mycobacterium
VAQQN

SEQ ID NO: 292651 - protein, 11 aa, Mycobacterium
VAQRDPDRDAL

SEQ ID NO: 292652 - protein, 8 aa, Mycobacterium
VAQRPTVA

SEQ ID NO: 292653 - protein, 10 aa, Mycobacterium
VAQRPTVGAT

SEQ ID NO: 292654 - protein, 4 aa, Mycobacterium
VAQS

SEQ ID NO: 292655 - protein, 9 aa, Mycobacterium
VAQSEGEFR

SEQ ID NO: 292656 - protein, 9 aa, Mycobacterium
VAQSNRDSV

SEQ ID NO: 292657 - protein, 7 aa, Mycobacterium
VAQTGTT

SEQ ID NO: 292658 - protein, 7 aa, Mycobacterium
VAQTHPG

SEQ ID NO: 292659 - protein, 8 aa, Mycobacterium
VAQTSADA

SEQ ID NO: 292660 - protein, 5 aa, Mycobacterium
VAQTT

SEQ ID NO: 292661 - protein, 11 aa, Mycobacterium
VARDEQALAEA

SEQ ID NO: 292662 - protein, 10 aa, Mycobacterium
VARGAKPDEV

SEQ ID NO: 292663 - protein, 12 aa, Mycobacterium
VARGYTGRPGLT

SEQ ID NO: 292664 - protein, 9 aa, Mycobacterium
VARKPGGWK

SEQ ID NO: 292665 - protein, 15 aa, Mycobacterium
VARKSPDNHTAIGWD

SEQ ID NO: 292666 - protein, 8 aa, Mycobacterium
VARPGRRD

SEQ ID NO: 292667 - protein, 5 aa, Mycobacterium
VARQT

SEQ ID NO: 292668 - protein, 17 aa, Mycobacterium
VARRGDDSMHDAAQTPG

SEQ ID NO: 292669 - protein, 5 aa, Mycobacterium
VARRP

SEQ ID NO: 292670 - protein, 11 aa, Mycobacterium
VARRPRAVTDS

SEQ ID NO: 292671 - protein, 31 aa, Mycobacterium
VARRRGESSPSTFDEEEAEADEEQGARPLSG

SEQ ID NO: 292672 - protein, 4 aa, Mycobacterium
VARS

SEQ ID NO: 292673 - protein, 5 aa, Mycobacterium
VASAA

SEQ ID NO: 292674 - protein, 11 aa, Mycobacterium
VASARTESMPG

SEQ ID NO: 292675 - protein, 9 aa, Mycobacterium
VASDATTPG

SEQ ID NO: 292676 - protein, 10 aa, Mycobacterium
VASDGRTLRT

SEQ ID NO: 292677 - protein, 9 aa, Mycobacterium
VASDPADNA

SEQ ID NO: 292678 - protein, 6 aa, Mycobacterium
VASETV

SEQ ID NO: 292679 - protein, 14 aa, Mycobacterium
VASGDEAVRTSGKD

SEQ ID NO: 292680 - protein, 6 aa, Mycobacterium
VASGPY

SEQ ID NO: 292681 - protein, 5 aa, Mycobacterium
VASGQ

SEQ ID NO: 292682 - protein, 10 aa, Mycobacterium
VASGQAPPVR

SEQ ID NO: 292683 - protein, 11 aa, Mycobacterium
VASGQVQARGA

SEQ ID NO: 292684 - protein, 9 aa, Mycobacterium
VASGTGAGR

SEQ ID NO: 292685 - protein, 8 aa, Mycobacterium
VASNTPKA

SEQ ID NO: 292686 - protein, 110 aa, Mycobacterium
VASPGDSTGAAASASPSSSDAADKPAADKPDTDTDAETDADAAEEVADDDESQEADEAADERTSRKPSSRIAEDQSEDTASEDTASEDAASEDAASEDAASEDAASDEDV

SEQ ID NO: 292687 - protein, 7 aa, Mycobacterium
VASPLDD

SEQ ID NO: 292688 - protein, 10 aa, Mycobacterium
VASPNTIGRT

SEQ ID NO: 292689 - protein, 19 aa, Mycobacterium
VASPQGAAAAVSPSDPTLP

SEQ ID NO: 292690 - protein, 8 aa, Mycobacterium
VASRTGIA

SEQ ID NO: 292691 - protein, 11 aa, Mycobacterium
VASTDVRPNGQ

SEQ ID NO: 292692 - protein, 7 aa, Mycobacterium
VASTGLA

SEQ ID NO: 292693 - protein, 14 aa, Mycobacterium
VASTGNQTRSQSGY

SEQ ID NO: 292694 - protein, 5 aa, Mycobacterium
VATAA

SEQ ID NO: 292695 - protein, 10 aa, Mycobacterium
VATASAAAGS

SEQ ID NO: 292696 - protein, 5 aa, Mycobacterium
VATAT

SEQ ID NO: 292697 - protein, 21 aa, Mycobacterium
VATATAAEATDVPATTATPDL

SEQ ID NO: 292698 - protein, 6 aa, Mycobacterium
VATATD

SEQ ID NO: 292699 - protein, 7 aa, Mycobacterium
VATATQA

SEQ ID NO: 292700 - protein, 10 aa, Mycobacterium
VATDPAERKR

SEQ ID NO: 292701 - protein, 10 aa, Mycobacterium
VATDPAERQR

SEQ ID NO: 292702 - protein, 13 aa, Mycobacterium
VATEDDRHETYRR

SEQ ID NO: 292703 - protein, 5 aa, Mycobacterium
VATES

SEQ ID NO: 292704 - protein, 16 aa, Mycobacterium
VATGGGGAVAAAAAIA

SEQ ID NO: 292705 - protein, 11 aa, Mycobacterium
VATGHSDPEAG

SEQ ID NO: 292706 - protein, 8 aa, Mycobacterium
VATGPGRL

SEQ ID NO: 292707 - protein, 7 aa, Mycobacterium
VATGRGP

SEQ ID NO: 292708 - protein, 10 aa, Mycobacterium
VATGSAAETV

SEQ ID NO: 292709 - protein, 6 aa, Mycobacterium
VATGTA

SEQ ID NO: 292710 - protein, 10 aa, Mycobacterium
VATGTTAYDT

SEQ ID NO: 292711 - protein, 6 aa, Mycobacterium
VATPDG

SEQ ID NO: 292712 - protein, 11 aa, Mycobacterium
VATPQPSGSSI

SEQ ID NO: 292713 - protein, 8 aa, Mycobacterium
VATQSVSD

SEQ ID NO: 292714 - protein, 5 aa, Mycobacterium
VATQV

SEQ ID NO: 292715 - protein, 9 aa, Mycobacterium
VATRAEELG

SEQ ID NO: 292716 - protein, 8 aa, Mycobacterium
VATSPPTH

SEQ ID NO: 292717 - protein, 9 aa, Mycobacterium
VATSPVTKN

SEQ ID NO: 292718 - protein, 45 aa, Mycobacterium
VATTAEAVEAEQTEQPEQTEQTEQTEQTEQTEEPDPAESHQTEVA

SEQ ID NO: 292719 - protein, 12 aa, Mycobacterium
VATTDASEESET

SEQ ID NO: 292720 - protein, 15 aa, Mycobacterium
VATTGAAAHTAKGAA

SEQ ID NO: 292721 - protein, 10 aa, Mycobacterium
VATTRTERSV

SEQ ID NO: 292722 - protein, 7 aa, Mycobacterium
VAVAGGG

SEQ ID NO: 292723 - protein, 10 aa, Mycobacterium
VAYGSRLNRN

SEQ ID NO: 292724 - protein, 10 aa, Mycobacterium
VAYQDGGNSY

SEQ ID NO: 292725 - protein, 8 aa, Mycobacterium
VCNGGRSG

SEQ ID NO: 292726 - protein, 11 aa, Mycobacterium
VDAASAAESAS

SEQ ID NO: 292727 - protein, 8 aa, Mycobacterium
VDADAGER

SEQ ID NO: 292728 - protein, 10 aa, Mycobacterium
VDADREHPTK

SEQ ID NO: 292729 - protein, 22 aa, Mycobacterium
VDAEESELDELTDEATAVTVGN

SEQ ID NO: 292730 - protein, 19 aa, Mycobacterium
VDAERTAAQEGLKQSSLSD

SEQ ID NO: 292731 - protein, 12 aa, Mycobacterium
VDAESTQTSEVG

SEQ ID NO: 292732 - protein, 21 aa, Mycobacterium
VDAETGTSQQRQQRVGKTTNA

SEQ ID NO: 292733 - protein, 4 aa, Mycobacterium
VDAG

SEQ ID NO: 292734 - protein, 43 aa, Mycobacterium
VDAGAPTGLAPGVAAADAPTGLGPTAALGAAGAAGTDGPESST

SEQ ID NO: 292735 - protein, 9 aa, Mycobacterium
VDAGGPSRA

SEQ ID NO: 292736 - protein, 6 aa, Mycobacterium
VDANGA

SEQ ID NO: 292737 - protein, 8 aa, Mycobacterium
VDAPAQDG

SEQ ID NO: 292738 - protein, 5 aa, Mycobacterium
VDAPE

SEQ ID NO: 292739 - protein, 7 aa, Mycobacterium
VDAPGRT

SEQ ID NO: 292740 - protein, 18 aa, Mycobacterium
VDAPSAAPARQRRAARPG

SEQ ID NO: 292741 - protein, 8 aa, Mycobacterium
VDAQGARG

SEQ ID NO: 292742 - protein, 9 aa, Mycobacterium
VDAQTGAVT

SEQ ID NO: 292743 - protein, 6 aa, Mycobacterium
VDARPG

SEQ ID NO: 292744 - protein, 7 aa, Mycobacterium
VDARQDV

SEQ ID NO: 292745 - protein, 6 aa, Mycobacterium
VDARSD

SEQ ID NO: 292746 - protein, 8 aa, Mycobacterium
VDASGATS

SEQ ID NO: 292747 - protein, 14 aa, Mycobacterium
VDASPRVPAEPGGD

SEQ ID NO: 292748 - protein, 15 aa, Mycobacterium
VDASPRVPAEPGGDF

SEQ ID NO: 292749 - protein, 88 aa, Mycobacterium
VDATATEAEESGDESPEPAADSEEPEADESAPEDSAEDTSSGESDTQSELEQSQTIEQGSDQTSAGDGEGPPPSAAVDGDTGPTRQGW

SEQ ID NO: 292750 - protein, 17 aa, Mycobacterium
VDATPKPTALVGADHAN

SEQ ID NO: 292751 - protein, 7 aa, Mycobacterium
VDDAEYR

SEQ ID NO: 292752 - protein, 8 aa, Mycobacterium
VDDAGTTT

SEQ ID NO: 292753 - protein, 5 aa, Mycobacterium
VDDAR

SEQ ID NO: 292754 - protein, 6 aa, Mycobacterium
VDDDGN

SEQ ID NO: 292755 - protein, 6 aa, Mycobacterium
VDDDGT

SEQ ID NO: 292756 - protein, 12 aa, Mycobacterium
VDDEDTSLPDRR

SEQ ID NO: 292757 - protein, 4 aa, Mycobacterium
VDDF

SEQ ID NO: 292758 - protein, 7 aa, Mycobacterium
VDDGETR

SEQ ID NO: 292759 - protein, 22 aa, Mycobacterium
VDDGQNPGVGVATPPHQRPRPQ

SEQ ID NO: 292760 - protein, 15 aa, Mycobacterium
VDDIGAAAGRATAKA

SEQ ID NO: 292761 - protein, 13 aa, Mycobacterium
VDDIGSAAGHASV

SEQ ID NO: 292762 - protein, 13 aa, Mycobacterium
VDDPAEGGAAAAA

SEQ ID NO: 292763 - protein, 13 aa, Mycobacterium
VDDPAEGPAAAAA

SEQ ID NO: 292764 - protein, 12 aa, Mycobacterium
VDDPAESGAAAA

SEQ ID NO: 292765 - protein, 18 aa, Mycobacterium
VDDPAGGGYDRAPDAAPG

SEQ ID NO: 292766 - protein, 19 aa, Mycobacterium
VDDPAGGPFDRAPDAPPGW

SEQ ID NO: 292767 - protein, 17 aa, Mycobacterium
VDDPDTQLTGAPDGYQQ

SEQ ID NO: 292768 - protein, 7 aa, Mycobacterium
VDDPELE

SEQ ID NO: 292769 - protein, 12 aa, Mycobacterium
VDDPGGSGVGDV

SEQ ID NO: 292770 - protein, 33 aa, Mycobacterium
VDDPGPGRGAKSVRSRQLAENRGSTERNVRDAI

SEQ ID NO: 292771 - protein, 7 aa, Mycobacterium
VDDPHID

SEQ ID NO: 292772 - protein, 9 aa, Mycobacterium
VDDPHIDRD

SEQ ID NO: 292773 - protein, 9 aa, Mycobacterium
VDDPNRDAR

SEQ ID NO: 292774 - protein, 5 aa, Mycobacterium
VDDPP

SEQ ID NO: 292775 - protein, 23 aa, Mycobacterium
VDDPSGGPFDRAPDAPPGWLPDW

SEQ ID NO: 292776 - protein, 9 aa, Mycobacterium
VDDPSSALR

SEQ ID NO: 292777 - protein, 10 aa, Mycobacterium
VDDPSSSLRT

SEQ ID NO: 292778 - protein, 9 aa, Mycobacterium
VDDPSSTLR

SEQ ID NO: 292779 - protein, 10 aa, Mycobacterium
VDDPSSTLRT

SEQ ID NO: 292780 - protein, 5 aa, Mycobacterium
VDDPV

SEQ ID NO: 292781 - protein, 6 aa, Mycobacterium
VDDQLR

SEQ ID NO: 292782 - protein, 8 aa, Mycobacterium
VDDRDTRE

SEQ ID NO: 292783 - protein, 8 aa, Mycobacterium
VDDTARSR

SEQ ID NO: 292784 - protein, 9 aa, Mycobacterium
VDDTEDAEV

SEQ ID NO: 292785 - protein, 15 aa, Mycobacterium
VDDVGSAAARATAKA

SEQ ID NO: 292786 - protein, 10 aa, Mycobacterium
VDEAKRAEIK

SEQ ID NO: 292787 - protein, 5 aa, Mycobacterium
VDEGG

SEQ ID NO: 292788 - protein, 6 aa, Mycobacterium
VDEHGP

SEQ ID NO: 292789 - protein, 9 aa, Mycobacterium
VDEKGAEFD

SEQ ID NO: 292790 - protein, 13 aa, Mycobacterium
VDEPAPASRVQPE

SEQ ID NO: 292791 - protein, 25 aa, Mycobacterium
VDEQPDDDEAVDEEAGQEAEEPADE

SEQ ID NO: 292792 - protein, 9 aa, Mycobacterium
VDESARGAS

SEQ ID NO: 292793 - protein, 6 aa, Mycobacterium
VDESHT

SEQ ID NO: 292794 - protein, 9 aa, Mycobacterium
VDESTQDRL

SEQ ID NO: 292795 - protein, 20 aa, Mycobacterium
VDETPAPLRDASGAISYPGF

SEQ ID NO: 292796 - protein, 6 aa, Mycobacterium
VDETPR

SEQ ID NO: 292797 - protein, 7 aa, Mycobacterium
VDEVSDK

SEQ ID NO: 292798 - protein, 4 aa, Mycobacterium
VDGA

SEQ ID NO: 292799 - protein, 5 aa, Mycobacterium
VDGAD

SEQ ID NO: 292800 - protein, 6 aa, Mycobacterium
VDGAGA

SEQ ID NO: 292801 - protein, 6 aa, Mycobacterium
VDGAGP

SEQ ID NO: 292802 - protein, 5 aa, Mycobacterium
VDGAR

SEQ ID NO: 292803 - protein, 20 aa, Mycobacterium
VDGARKEADAYRGDNPRPLG

SEQ ID NO: 292804 - protein, 20 aa, Mycobacterium
VDGARREADAYRGEAPRPLG

SEQ ID NO: 292805 - protein, 18 aa, Mycobacterium
VDGASGDPVRAAAGTTRV

SEQ ID NO: 292806 - protein, 4 aa, Mycobacterium
VDGD

SEQ ID NO: 292807 - protein, 18 aa, Mycobacterium
VDGDKATAKIESRGSTGT

SEQ ID NO: 292808 - protein, 6 aa, Mycobacterium
VDGDKQ

SEQ ID NO: 292809 - protein, 10 aa, Mycobacterium
VDGDSPTKVG

SEQ ID NO: 292810 - protein, 7 aa, Mycobacterium
VDGEGCG

SEQ ID NO: 292811 - protein, 25 aa, Mycobacterium
VDGEQDEEAPHREEVGQAGDGPLQQ

SEQ ID NO: 292812 - protein, 7 aa, Mycobacterium
VDGESCG

SEQ ID NO: 292813 - protein, 6 aa, Mycobacterium
VDGETY

SEQ ID NO: 292814 - protein, 29 aa, Mycobacterium
VDGGGRAHHGGPGMMQPGPAGFPMGPPGG

SEQ ID NO: 292815 - protein, 5 aa, Mycobacterium
VDGGP

SEQ ID NO: 292816 - protein, 4 aa, Mycobacterium
VDGH

SEQ ID NO: 292817 - protein, 7 aa, Mycobacterium
VDGHSTG

SEQ ID NO: 292818 - protein, 17 aa, Mycobacterium
VDGIGPARLEKLRGLVR

SEQ ID NO: 292819 - protein, 9 aa, Mycobacterium
VDGKPLNEP

SEQ ID NO: 292820 - protein, 13 aa, Mycobacterium
VDGLDDTDLPLGD

SEQ ID NO: 292821 - protein, 25 aa, Mycobacterium
VDGNYADAVQAPGVAGGSDGGGGCA

SEQ ID NO: 292822 - protein, 7 aa, Mycobacterium
VDGQQTG

SEQ ID NO: 292823 - protein, 7 aa, Mycobacterium
VDGRRDI

SEQ ID NO: 292824 - protein, 18 aa, Mycobacterium
VDGRVEDYSDAKSRMSGI

SEQ ID NO: 292825 - protein, 4 aa, Mycobacterium
VDGS

SEQ ID NO: 292826 - protein, 12 aa, Mycobacterium
VDGSGDGRAAGV

SEQ ID NO: 292827 - protein, 6 aa, Mycobacterium
VDGSGT

SEQ ID NO: 292828 - protein, 8 aa, Mycobacterium
VDGSPPHQ

SEQ ID NO: 292829 - protein, 11 aa, Mycobacterium
VDGSSGPSAVV

SEQ ID NO: 292830 - protein, 8 aa, Mycobacterium
VDGSSVPA

SEQ ID NO: 292831 - protein, 8 aa, Mycobacterium
VDGSTTGL

SEQ ID NO: 292832 - protein, 8 aa, Mycobacterium
VDGTPRGV

SEQ ID NO: 292833 - protein, 5 aa, Mycobacterium
VDGTR

SEQ ID NO: 292834 - protein, 11 aa, Mycobacterium
VDHPDAPGRVT

SEQ ID NO: 292835 - protein, 4 aa, Mycobacterium
VDKA

SEQ ID NO: 292836 - protein, 10 aa, Mycobacterium
VDKAGDQAQI

SEQ ID NO: 292837 - protein, 6 aa, Mycobacterium
VDKPAR

SEQ ID NO: 292838 - protein, 7 aa, Mycobacterium
VDKPGGW

SEQ ID NO: 292839 - protein, 18 aa, Mycobacterium
VDKSAADDGSAENAGEQY

SEQ ID NO: 292840 - protein, 8 aa, Mycobacterium
VDKTPKTF

SEQ ID NO: 292841 - protein, 10 aa, Mycobacterium
VDLAGEGSVE

SEQ ID NO: 292842 - protein, 5 aa, Mycobacterium
VDLSA

SEQ ID NO: 292843 - protein, 8 aa, Mycobacterium
VDMTGDGM

SEQ ID NO: 292844 - protein, 9 aa, Mycobacterium
VDNDGTPTE

SEQ ID NO: 292845 - protein, 5 aa, Mycobacterium
VDNGH

SEQ ID NO: 292846 - protein, 4 aa, Mycobacterium
VDNI

SEQ ID NO: 292847 - protein, 5 aa, Mycobacterium
VDNIQ

SEQ ID NO: 292848 - protein, 13 aa, Mycobacterium
VDNPEDVRRAGDI

SEQ ID NO: 292849 - protein, 8 aa, Mycobacterium
VDNRGDAV

SEQ ID NO: 292850 - protein, 14 aa, Mycobacterium
VDPAAASNPLINPP

SEQ ID NO: 292851 - protein, 16 aa, Mycobacterium
VDPADVPSLGRLAVGP

SEQ ID NO: 292852 - protein, 9 aa, Mycobacterium
VDPAEVPSA

SEQ ID NO: 292853 - protein, 5 aa, Mycobacterium
VDPDD

SEQ ID NO: 292854 - protein, 8 aa, Mycobacterium
VDPDETSA

SEQ ID NO: 292855 - protein, 7 aa, Mycobacterium
VDPDHTI

SEQ ID NO: 292856 - protein, 27 aa, Mycobacterium
VDPDPGPPSVQLPPGVTPGPGPAPHAP

SEQ ID NO: 292857 - protein, 9 aa, Mycobacterium
VDPDPGPPV

SEQ ID NO: 292858 - protein, 28 aa, Mycobacterium
VDPDPSLAPKQAEEPSPAQAASVLPPAD

SEQ ID NO: 292859 - protein, 5 aa, Mycobacterium
VDPDR

SEQ ID NO: 292860 - protein, 16 aa, Mycobacterium
VDPDSDTVVRNGSPFD

SEQ ID NO: 292861 - protein, 13 aa, Mycobacterium
VDPDTGSDTDGAV

SEQ ID NO: 292862 - protein, 23 aa, Mycobacterium
VDPEDDLSPGGYSGDFGNTGTTT

SEQ ID NO: 292863 - protein, 13 aa, Mycobacterium
VDPEGVPAGDRAR

SEQ ID NO: 292864 - protein, 7 aa, Mycobacterium
VDPEHGP

SEQ ID NO: 292865 - protein, 6 aa, Mycobacterium
VDPETA

SEQ ID NO: 292866 - protein, 8 aa, Mycobacterium
VDPETEQT

SEQ ID NO: 292867 - protein, 4 aa, Mycobacterium
VDPG

SEQ ID NO: 292868 - protein, 64 aa, Mycobacterium
VDPGAGGSWTNYSGSGAQPPAPQPVAPPPQYPTGDETVARPVPASTTGWRSRPDVSDQRTQAAP

SEQ ID NO: 292869 - protein, 12 aa, Mycobacterium
VDPGENKYQTRM

SEQ ID NO: 292870 - protein, 8 aa, Mycobacterium
VDPGETTA

SEQ ID NO: 292871 - protein, 6 aa, Mycobacterium
VDPGIA

SEQ ID NO: 292872 - protein, 9 aa, Mycobacterium
VDPGRVDRA

SEQ ID NO: 292873 - protein, 18 aa, Mycobacterium
VDPGRVDRDGLERAEQAA

SEQ ID NO: 292874 - protein, 7 aa, Mycobacterium
VDPGTPT

SEQ ID NO: 292875 - protein, 11 aa, Mycobacterium
VDPNADPIEAD

SEQ ID NO: 292876 - protein, 7 aa, Mycobacterium
VDPPAAV

SEQ ID NO: 292877 - protein, 14 aa, Mycobacterium
VDPPSGTPGPVQTM

SEQ ID NO: 292878 - protein, 10 aa, Mycobacterium
VDPREKPSPV

SEQ ID NO: 292879 - protein, 10 aa, Mycobacterium
VDPREKPSPW

SEQ ID NO: 292880 - protein, 9 aa, Mycobacterium
VDPSRRAAV

SEQ ID NO: 292881 - protein, 6 aa, Mycobacterium
VDPSTL

SEQ ID NO: 292882 - protein, 8 aa, Mycobacterium
VDPTAHPD

SEQ ID NO: 292883 - protein, 8 aa, Mycobacterium
VDPTNGIP

SEQ ID NO: 292884 - protein, 4 aa, Mycobacterium
VDPV

SEQ ID NO: 292885 - protein, 5 aa, Mycobacterium
VDPVQ

SEQ ID NO: 292886 - protein, 7 aa, Mycobacterium
VDQAGGG

SEQ ID NO: 292887 - protein, 8 aa, Mycobacterium
VDQDNGSF

SEQ ID NO: 292888 - protein, 4 aa, Mycobacterium
VDQG

SEQ ID NO: 292889 - protein, 28 aa, Mycobacterium
VDQPRAREQQSDHTQCDQDQNPATPSQL

SEQ ID NO: 292890 - protein, 6 aa, Mycobacterium
VDQPTD

SEQ ID NO: 292891 - protein, 5 aa, Mycobacterium
VDQQG

SEQ ID NO: 292892 - protein, 7 aa, Mycobacterium
VDRADAQ

SEQ ID NO: 292893 - protein, 6 aa, Mycobacterium
VDRAGT

SEQ ID NO: 292894 - protein, 15 aa, Mycobacterium
VDRAPESIRGELSDA

SEQ ID NO: 292895 - protein, 20 aa, Mycobacterium
VDRDGAEATLSLSGTPRVPA

SEQ ID NO: 292896 - protein, 12 aa, Mycobacterium
VDRDTAKGTVKS

SEQ ID NO: 292897 - protein, 10 aa, Mycobacterium
VDRESRTARA

SEQ ID NO: 292898 - protein, 16 aa, Mycobacterium
VDRGSRPPAVAKATDH

SEQ ID NO: 292899 - protein, 12 aa, Mycobacterium
VDRMGRTGGGAG

SEQ ID NO: 292900 - protein, 10 aa, Mycobacterium
VDRPGPADLT

SEQ ID NO: 292901 - protein, 7 aa, Mycobacterium
VDRPSPH

SEQ ID NO: 292902 - protein, 4 aa, Mycobacterium
VDRQ

SEQ ID NO: 292903 - protein, 6 aa, Mycobacterium
VDRQPS

SEQ ID NO: 292904 - protein, 13 aa, Mycobacterium
VDRRGPSAPRPGT

SEQ ID NO: 292905 - protein, 12 aa, Mycobacterium
VDRRGRTAEGDG

SEQ ID NO: 292906 - protein, 18 aa, Mycobacterium
VDRRPGGPTYDAAPQNAL

SEQ ID NO: 292907 - protein, 9 aa, Mycobacterium
VDSAHDEPE

SEQ ID NO: 292908 - protein, 9 aa, Mycobacterium
VDSAKKALA

SEQ ID NO: 292909 - protein, 13 aa, Mycobacterium
VDSDAVRAARSRG

SEQ ID NO: 292910 - protein, 9 aa, Mycobacterium
VDSDGDGLH

SEQ ID NO: 292911 - protein, 7 aa, Mycobacterium
VDSDQAV

SEQ ID NO: 292912 - protein, 10 aa, Mycobacterium
VDSDRSRNTV

SEQ ID NO: 292913 - protein, 4 aa, Mycobacterium
VDSG

SEQ ID NO: 292914 - protein, 13 aa, Mycobacterium
VDSGTYSVHPDTG

SEQ ID NO: 292915 - protein, 6 aa, Mycobacterium
VDSKGD

SEQ ID NO: 292916 - protein, 7 aa, Mycobacterium
VDSMTDD

SEQ ID NO: 292917 - protein, 10 aa, Mycobacterium
VDSPRPAGEV

SEQ ID NO: 292918 - protein, 10 aa, Mycobacterium
VDSPRPWRQE

SEQ ID NO: 292919 - protein, 11 aa, Mycobacterium
VDSPRSAHASG

SEQ ID NO: 292920 - protein, 6 aa, Mycobacterium
VDSPSE

SEQ ID NO: 292921 - protein, 11 aa, Mycobacterium
VDSPSPRDTAP

SEQ ID NO: 292922 - protein, 6 aa, Mycobacterium
VDSPTA

SEQ ID NO: 292923 - protein, 8 aa, Mycobacterium
VDSRTGAV

SEQ ID NO: 292924 - protein, 9 aa, Mycobacterium
VDSSPGRTE

SEQ ID NO: 292925 - protein, 10 aa, Mycobacterium
VDSTGQPSSF

SEQ ID NO: 292926 - protein, 8 aa, Mycobacterium
VDSTGSIS

SEQ ID NO: 292927 - protein, 6 aa, Mycobacterium
VDSTGT

SEQ ID NO: 292928 - protein, 12 aa, Mycobacterium
VDSTRGDSLPGD

SEQ ID NO: 292929 - protein, 6 aa, Mycobacterium
VDSTRT

SEQ ID NO: 292930 - protein, 8 aa, Mycobacterium
VDSYDGDV

SEQ ID NO: 292931 - protein, 16 aa, Mycobacterium
VDTDRTSFAPGEEFDD

SEQ ID NO: 292932 - protein, 7 aa, Mycobacterium
VDTGSVP

SEQ ID NO: 292933 - protein, 5 aa, Mycobacterium
VDTNT

SEQ ID NO: 292934 - protein, 4 aa, Mycobacterium
VDTP

SEQ ID NO: 292935 - protein, 9 aa, Mycobacterium
VDTPGKPSL

SEQ ID NO: 292936 - protein, 7 aa, Mycobacterium
VDTPPRD

SEQ ID NO: 292937 - protein, 5 aa, Mycobacterium
VDTSG

SEQ ID NO: 292938 - protein, 7 aa, Mycobacterium
VDTSTNG

SEQ ID NO: 292939 - protein, 6 aa, Mycobacterium
VDTTAL

SEQ ID NO: 292940 - protein, 22 aa, Mycobacterium
VDVPAEDEAPQEVAAAPRTDQP

SEQ ID NO: 292941 - protein, 5 aa, Mycobacterium
VDVPN

SEQ ID NO: 292942 - protein, 10 aa, Mycobacterium
VDVPRSGQDV

SEQ ID NO: 292943 - protein, 4 aa, Mycobacterium
VDVS

SEQ ID NO: 292944 - protein, 6 aa, Mycobacterium
VEADRK

SEQ ID NO: 292945 - protein, 19 aa, Mycobacterium
VEADVEAGAEAGTDSRLRR

SEQ ID NO: 292946 - protein, 9 aa, Mycobacterium
VEAGRAGIS

SEQ ID NO: 292947 - protein, 7 aa, Mycobacterium
VEAKGTY

SEQ ID NO: 292948 - protein, 6 aa, Mycobacterium
VEANTS

SEQ ID NO: 292949 - protein, 7 aa, Mycobacterium
VEANTST

SEQ ID NO: 292950 - protein, 12 aa, Mycobacterium
VEAPADEPRVPT

SEQ ID NO: 292951 - protein, 8 aa, Mycobacterium
VEAPSNAD

SEQ ID NO: 292952 - protein, 10 aa, Mycobacterium
VEASAGELRD

SEQ ID NO: 292953 - protein, 7 aa, Mycobacterium
VEATPAS

SEQ ID NO: 292954 - protein, 10 aa, Mycobacterium
VEATPGAELA

SEQ ID NO: 292955 - protein, 5 aa, Mycobacterium
VEATQ

SEQ ID NO: 292956 - protein, 22 aa, Mycobacterium
VEDAKSEGQKVTDEARQDSERI

SEQ ID NO: 292957 - protein, 8 aa, Mycobacterium
VEDAPEVR

SEQ ID NO: 292958 - protein, 5 aa, Mycobacterium
VEDGS

SEQ ID NO: 292959 - protein, 5 aa, Mycobacterium
VEDGT

SEQ ID NO: 292960 - protein, 6 aa, Mycobacterium
VEDITP

SEQ ID NO: 292961 - protein, 8 aa, Mycobacterium
VEDPARSR

SEQ ID NO: 292962 - protein, 4 aa, Mycobacterium
VEDS

SEQ ID NO: 292963 - protein, 10 aa, Mycobacterium
VEDTKEAREA

SEQ ID NO: 292964 - protein, 8 aa, Mycobacterium
VEDTSGYN

SEQ ID NO: 292965 - protein, 12 aa, Mycobacterium
VEEAAASLGANN

SEQ ID NO: 292966 - protein, 12 aa, Mycobacterium
VEEAAASLGASN

SEQ ID NO: 292967 - protein, 14 aa, Mycobacterium
VEEAESDSKRITEQ

SEQ ID NO: 292968 - protein, 29 aa, Mycobacterium
VEEDSPVAGEGAPAAEPVAAASEDAIGTA

SEQ ID NO: 292969 - protein, 7 aa, Mycobacterium
VEEGYGS

SEQ ID NO: 292970 - protein, 6 aa, Mycobacterium
VEEITP

SEQ ID NO: 292971 - protein, 4 aa, Mycobacterium
VEEP

SEQ ID NO: 292972 - protein, 11 aa, Mycobacterium
VEEPGRGVTAN

SEQ ID NO: 292973 - protein, 13 aa, Mycobacterium
VEEPGRGVTATLD

SEQ ID NO: 292974 - protein, 14 aa, Mycobacterium
VEEPQPAAAECASP

SEQ ID NO: 292975 - protein, 5 aa, Mycobacterium
VEEQG

SEQ ID NO: 292976 - protein, 6 aa, Mycobacterium
VEEQHR

SEQ ID NO: 292977 - protein, 14 aa, Mycobacterium
VEESTRNTAQLDQA

SEQ ID NO: 292978 - protein, 20 aa, Mycobacterium
VEETPLTAAEARAATDESTA

SEQ ID NO: 292979 - protein, 7 aa, Mycobacterium
VEETQAA

SEQ ID NO: 292980 - protein, 10 aa, Mycobacterium
VEETQNESRG

SEQ ID NO: 292981 - protein, 6 aa, Mycobacterium
VEETQV

SEQ ID NO: 292982 - protein, 9 aa, Mycobacterium
VEETRDESR

SEQ ID NO: 292983 - protein, 10 aa, Mycobacterium
VEETTDESRG

SEQ ID NO: 292984 - protein, 19 aa, Mycobacterium
VEETVDAAKPGDADSAEDV

SEQ ID NO: 292985 - protein, 4 aa, Mycobacterium
VEGA

SEQ ID NO: 292986 - protein, 8 aa, Mycobacterium
VEGAAPAV

SEQ ID NO: 292987 - protein, 5 aa, Mycobacterium
VEGAQ

SEQ ID NO: 292988 - protein, 6 aa, Mycobacterium
VEGDAQ

SEQ ID NO: 292989 - protein, 4 aa, Mycobacterium
VEGE

SEQ ID NO: 292990 - protein, 11 aa, Mycobacterium
VEGEAEAEELA

SEQ ID NO: 292991 - protein, 8 aa, Mycobacterium
VEGEPATI

SEQ ID NO: 292992 - protein, 7 aa, Mycobacterium
VEGESCG

SEQ ID NO: 292993 - protein, 18 aa, Mycobacterium
VEGESEAEELAAEADAEA

SEQ ID NO: 292994 - protein, 10 aa, Mycobacterium
VEGESPPPGS

SEQ ID NO: 292995 - protein, 20 aa, Mycobacterium
VEGGADEDGTPAAGAYHTRD

SEQ ID NO: 292996 - protein, 6 aa, Mycobacterium
VEGGPA

SEQ ID NO: 292997 - protein, 5 aa, Mycobacterium
VEGQE

SEQ ID NO: 292998 - protein, 12 aa, Mycobacterium
VEGQTSEPGSLS

SEQ ID NO: 292999 - protein, 9 aa, Mycobacterium
VEGSANAAE

SEQ ID NO: 293000 - protein, 14 aa, Mycobacterium
VEGSKGAAATLDIT

SEQ ID NO: 293001 - protein, 21 aa, Mycobacterium
VEGTAPARPVRPVGPPPRRRA

SEQ ID NO: 293002 - protein, 11 aa, Mycobacterium
VEGTKAEKRAE

SEQ ID NO: 293003 - protein, 26 aa, Mycobacterium
VEGTPVDGDALPVAPSAHTAGDGPSV

SEQ ID NO: 293004 - protein, 16 aa, Mycobacterium
VEKDGKAEDRLPNQPW

SEQ ID NO: 293005 - protein, 5 aa, Mycobacterium
VEKNQ

SEQ ID NO: 293006 - protein, 7 aa, Mycobacterium
VEKPGGW

SEQ ID NO: 293007 - protein, 11 aa, Mycobacterium
VEKTSSDCPPF

SEQ ID NO: 293008 - protein, 4 aa, Mycobacterium
VENP

SEQ ID NO: 293009 - protein, 15 aa, Mycobacterium
VENPGTLAPSSSAFG

SEQ ID NO: 293010 - protein, 6 aa, Mycobacterium
VENPNS

SEQ ID NO: 293011 - protein, 18 aa, Mycobacterium
VENQDPNATVAPDAPPPV

SEQ ID NO: 293012 - protein, 9 aa, Mycobacterium
VENSKKADV

SEQ ID NO: 293013 - protein, 20 aa, Mycobacterium
VENTSDRDYDVTPSRLRRPG

SEQ ID NO: 293014 - protein, 12 aa, Mycobacterium
VEPADDAQTDQL

SEQ ID NO: 293015 - protein, 6 aa, Mycobacterium
VEPAGD

SEQ ID NO: 293016 - protein, 17 aa, Mycobacterium
VEPAGSDADRDDDTGSA

SEQ ID NO: 293017 - protein, 23 aa, Mycobacterium
VEPAPPASVRRSAAEDGEAYARR

SEQ ID NO: 293018 - protein, 6 aa, Mycobacterium
VEPDAA

SEQ ID NO: 293019 - protein, 5 aa, Mycobacterium
VEPDN

SEQ ID NO: 293020 - protein, 7 aa, Mycobacterium
VEPDPDT

SEQ ID NO: 293021 - protein, 12 aa, Mycobacterium
VEPEAGAAVPAK

SEQ ID NO: 293022 - protein, 64 aa, Mycobacterium
VEPEGESGQAGVPEAQPRDEDQDETADETQDETQEDADADPEAGEDDAQASDGEQESPKPAPSK

SEQ ID NO: 293023 - protein, 5 aa, Mycobacterium
VEPER

SEQ ID NO: 293024 - protein, 4 aa, Mycobacterium
VEPG

SEQ ID NO: 293025 - protein, 11 aa, Mycobacterium
VEPGAERAEQI

SEQ ID NO: 293026 - protein, 8 aa, Mycobacterium
VEPGDGPD

SEQ ID NO: 293027 - protein, 5 aa, Mycobacterium
VEPGE

SEQ ID NO: 293028 - protein, 6 aa, Mycobacterium
VEPGET

SEQ ID NO: 293029 - protein, 9 aa, Mycobacterium
VEPGGDKTQ

SEQ ID NO: 293030 - protein, 14 aa, Mycobacterium
VEPGGSSGQLEGDQ

SEQ ID NO: 293031 - protein, 14 aa, Mycobacterium
VEPGPETVAPPVAP

SEQ ID NO: 293032 - protein, 5 aa, Mycobacterium
VEPGQ

SEQ ID NO: 293033 - protein, 6 aa, Mycobacterium
VEPGSN

SEQ ID NO: 293034 - protein, 7 aa, Mycobacterium
VEPGSVV

SEQ ID NO: 293035 - protein, 13 aa, Mycobacterium
VEPIPDAERTARP

SEQ ID NO: 293036 - protein, 6 aa, Mycobacterium
VEPKDE

SEQ ID NO: 293037 - protein, 8 aa, Mycobacterium
VEPNPGHT

SEQ ID NO: 293038 - protein, 7 aa, Mycobacterium
VEPPASD

SEQ ID NO: 293039 - protein, 14 aa, Mycobacterium
VEPPDAAGDCRCEA

SEQ ID NO: 293040 - protein, 16 aa, Mycobacterium
VEPPDSAADCECETEK

SEQ ID NO: 293041 - protein, 43 aa, Mycobacterium
VEPPPPPPPPVTTHEAPPPVTTTTTPPPPPPPTTTTPAGPRQI

SEQ ID NO: 293042 - protein, 25 aa, Mycobacterium
VEPPSDPIRAAAAPGPQADRRAGAA

SEQ ID NO: 293043 - protein, 10 aa, Mycobacterium
VEPRAEGGAS

SEQ ID NO: 293044 - protein, 5 aa, Mycobacterium
VEPSA

SEQ ID NO: 293045 - protein, 8 aa, Mycobacterium
VEPSDEGV

SEQ ID NO: 293046 - protein, 24 aa, Mycobacterium
VEPTGTDVIDGDPDDPAGDQAGPA

SEQ ID NO: 293047 - protein, 8 aa, Mycobacterium
VEQDDPVK

SEQ ID NO: 293048 - protein, 6 aa, Mycobacterium
VEQEAA

SEQ ID NO: 293049 - protein, 17 aa, Mycobacterium
VEQEGAPGADVLTGQAD

SEQ ID NO: 293050 - protein, 7 aa, Mycobacterium
VEQGDLD

SEQ ID NO: 293051 - protein, 7 aa, Mycobacterium
VEQGNRA

SEQ ID NO: 293052 - protein, 5 aa, Mycobacterium
VEQKQ

SEQ ID NO: 293053 - protein, 13 aa, Mycobacterium
VEQPTRPARGEDP

SEQ ID NO: 293054 - protein, 5 aa, Mycobacterium
VEQQR

SEQ ID NO: 293055 - protein, 33 aa, Mycobacterium
VEQQSSAAQPAPGAPPSAGAAPSAVVTPPEPSI

SEQ ID NO: 293056 - protein, 5 aa, Mycobacterium
VEQSG

SEQ ID NO: 293057 - protein, 11 aa, Mycobacterium
VEQSGAQPVNP

SEQ ID NO: 293058 - protein, 15 aa, Mycobacterium
VEQTDPAPRMAEGPV

SEQ ID NO: 293059 - protein, 24 aa, Mycobacterium
VEQTPAAAAATPHTDGADAEARRR

SEQ ID NO: 293060 - protein, 8 aa, Mycobacterium
VERAARRG

SEQ ID NO: 293061 - protein, 10 aa, Mycobacterium
VERDPEAPAV

SEQ ID NO: 293062 - protein, 19 aa, Mycobacterium
VEREATEDAERQGGSEPLD

SEQ ID NO: 293063 - protein, 11 aa, Mycobacterium
VERGDGEPVRS

SEQ ID NO: 293064 - protein, 9 aa, Mycobacterium
VERNNPDGS

SEQ ID NO: 293065 - protein, 10 aa, Mycobacterium
VERNNPDGSV

SEQ ID NO: 293066 - protein, 27 aa, Mycobacterium
VERPPEPLRTPTGRHLGEPNWTRLRHS

SEQ ID NO: 293067 - protein, 8 aa, Mycobacterium
VERSARAD

SEQ ID NO: 293068 - protein, 7 aa, Mycobacterium
VERSPGA

SEQ ID NO: 293069 - protein, 68 aa, Mycobacterium
VERTATAPKGKPTPKRSEAARRRGPVAPAPMTSAEARKRRKELRGPKLSREERKAERAERRAEMGERR

SEQ ID NO: 293070 - protein, 15 aa, Mycobacterium
VERTEEAMDTASTIA

SEQ ID NO: 293071 - protein, 8 aa, Mycobacterium
VERTTGEK

SEQ ID NO: 293072 - protein, 10 aa, Mycobacterium
VERTTSPYQL

SEQ ID NO: 293073 - protein, 5 aa, Mycobacterium
VESAG

SEQ ID NO: 293074 - protein, 8 aa, Mycobacterium
VESASEHP

SEQ ID NO: 293075 - protein, 7 aa, Mycobacterium
VESASRS

SEQ ID NO: 293076 - protein, 11 aa, Mycobacterium
VESDGKPARLT

SEQ ID NO: 293077 - protein, 15 aa, Mycobacterium
VESDGSPDGEEPPQH

SEQ ID NO: 293078 - protein, 8 aa, Mycobacterium
VESDQKVV

SEQ ID NO: 293079 - protein, 6 aa, Mycobacterium
VESERT

SEQ ID NO: 293080 - protein, 7 aa, Mycobacterium
VESETAR

SEQ ID NO: 293081 - protein, 8 aa, Mycobacterium
VESETSRM

SEQ ID NO: 293082 - protein, 5 aa, Mycobacterium
VESGD

SEQ ID NO: 293083 - protein, 9 aa, Mycobacterium
VESGSEHPV

SEQ ID NO: 293084 - protein, 7 aa, Mycobacterium
VESLDDN

SEQ ID NO: 293085 - protein, 6 aa, Mycobacterium
VESMTD

SEQ ID NO: 293086 - protein, 7 aa, Mycobacterium
VESNPDL

SEQ ID NO: 293087 - protein, 7 aa, Mycobacterium
VESPANA

SEQ ID NO: 293088 - protein, 12 aa, Mycobacterium
VESPDDYPGPLE

SEQ ID NO: 293089 - protein, 7 aa, Mycobacterium
VESPGAA

SEQ ID NO: 293090 - protein, 8 aa, Mycobacterium
VESPSEHP

SEQ ID NO: 293091 - protein, 7 aa, Mycobacterium
VESQREL

SEQ ID NO: 293092 - protein, 21 aa, Mycobacterium
VESRNPNATLPSSAATPGAPN

SEQ ID NO: 293093 - protein, 8 aa, Mycobacterium
VESRSGHP

SEQ ID NO: 293094 - protein, 16 aa, Mycobacterium
VESSPTVERHEQDRAA

SEQ ID NO: 293095 - protein, 5 aa, Mycobacterium
VESTR

SEQ ID NO: 293096 - protein, 7 aa, Mycobacterium
VESTRDP

SEQ ID NO: 293097 - protein, 8 aa, Mycobacterium
VESTRDPK

SEQ ID NO: 293098 - protein, 17 aa, Mycobacterium
VETDGSGTPQTRYDGRP

SEQ ID NO: 293099 - protein, 5 aa, Mycobacterium
VETGG

SEQ ID NO: 293100 - protein, 6 aa, Mycobacterium
VETGTH

SEQ ID NO: 293101 - protein, 6 aa, Mycobacterium
VETPTE

SEQ ID NO: 293102 - protein, 7 aa, Mycobacterium
VETSAGV

SEQ ID NO: 293103 - protein, 8 aa, Mycobacterium
VETSAGVQ

SEQ ID NO: 293104 - protein, 6 aa, Mycobacterium
VETTAK

SEQ ID NO: 293105 - protein, 18 aa, Mycobacterium
VETTGQEQQESHDGAEGA

SEQ ID NO: 293106 - protein, 4 aa, Mycobacterium
VEVD

SEQ ID NO: 293107 - protein, 9 aa, Mycobacterium
VEVGPGDQV

SEQ ID NO: 293108 - protein, 9 aa, Mycobacterium
VEVGPGDTV

SEQ ID NO: 293109 - protein, 18 aa, Mycobacterium
VEVGPGDTVTGATTNAGG

SEQ ID NO: 293110 - protein, 4 aa, Mycobacterium
VEVP

SEQ ID NO: 293111 - protein, 11 aa, Mycobacterium
VEVPEDDPRAI

SEQ ID NO: 293112 - protein, 6 aa, Mycobacterium
VEVTDS

SEQ ID NO: 293113 - protein, 15 aa, Mycobacterium
VFSPDGEADNPGQAD

SEQ ID NO: 293114 - protein, 5 aa, Mycobacterium
VGAAH

SEQ ID NO: 293115 - protein, 6 aa, Mycobacterium
VGAATT

SEQ ID NO: 293116 - protein, 4 aa, Mycobacterium
VGAD

SEQ ID NO: 293117 - protein, 9 aa, Mycobacterium
VGADDVDQE

SEQ ID NO: 293118 - protein, 10 aa, Mycobacterium
VGADGERTRA

SEQ ID NO: 293119 - protein, 9 aa, Mycobacterium
VGADGNVTE

SEQ ID NO: 293120 - protein, 13 aa, Mycobacterium
VGAERQDLRQYPG

SEQ ID NO: 293121 - protein, 8 aa, Mycobacterium
VGAGATAQ

SEQ ID NO: 293122 - protein, 8 aa, Mycobacterium
VGAGDAGA

SEQ ID NO: 293123 - protein, 8 aa, Mycobacterium
VGAGGGRV

SEQ ID NO: 293124 - protein, 8 aa, Mycobacterium
VGAGGSVG

SEQ ID NO: 293125 - protein, 6 aa, Mycobacterium
VGAGTH

SEQ ID NO: 293126 - protein, 9 aa, Mycobacterium
VGANGTATS

SEQ ID NO: 293127 - protein, 5 aa, Mycobacterium
VGANT

SEQ ID NO: 293128 - protein, 6 aa, Mycobacterium
VGANTT

SEQ ID NO: 293129 - protein, 7 aa, Mycobacterium
VGAPEKA

SEQ ID NO: 293130 - protein, 12 aa, Mycobacterium
VGAPGPSAVNGL

SEQ ID NO: 293131 - protein, 25 aa, Mycobacterium
VGAPLRAASEAAADLAGAGHNLDTT

SEQ ID NO: 293132 - protein, 9 aa, Mycobacterium
VGAPPKGLT

SEQ ID NO: 293133 - protein, 19 aa, Mycobacterium
VGAPQPAAAAPPQPQPQPV

SEQ ID NO: 293134 - protein, 5 aa, Mycobacterium
VGARE

SEQ ID NO: 293135 - protein, 6 aa, Mycobacterium
VGARGQ

SEQ ID NO: 293136 - protein, 12 aa, Mycobacterium
VGASAADALGAG

SEQ ID NO: 293137 - protein, 10 aa, Mycobacterium
VGASAPSAWH

SEQ ID NO: 293138 - protein, 10 aa, Mycobacterium
VGASGALSGV

SEQ ID NO: 293139 - protein, 8 aa, Mycobacterium
VGASPDSD

SEQ ID NO: 293140 - protein, 11 aa, Mycobacterium
VGASSLAGAAS

SEQ ID NO: 293141 - protein, 8 aa, Mycobacterium
VGATGPGV

SEQ ID NO: 293142 - protein, 10 aa, Mycobacterium
VGATHPPGTP

SEQ ID NO: 293143 - protein, 7 aa, Mycobacterium
VGATRSR

SEQ ID NO: 293144 - protein, 12 aa, Mycobacterium
VGATSLAGAASG

SEQ ID NO: 293145 - protein, 5 aa, Mycobacterium
VGDAE

SEQ ID NO: 293146 - protein, 8 aa, Mycobacterium
VGDALGAG

SEQ ID NO: 293147 - protein, 15 aa, Mycobacterium
VGDAVTAGTVATDSG

SEQ ID NO: 293148 - protein, 6 aa, Mycobacterium
VGDDEA

SEQ ID NO: 293149 - protein, 8 aa, Mycobacterium
VGDDPKTE

SEQ ID NO: 293150 - protein, 8 aa, Mycobacterium
VGDDPMRA

SEQ ID NO: 293151 - protein, 8 aa, Mycobacterium
VGDDRSQW

SEQ ID NO: 293152 - protein, 13 aa, Mycobacterium
VGDEAKVANVEFV

SEQ ID NO: 293153 - protein, 7 aa, Mycobacterium
VGDEGIR

SEQ ID NO: 293154 - protein, 11 aa, Mycobacterium
VGDEGQLPSSL

SEQ ID NO: 293155 - protein, 5 aa, Mycobacterium
VGDEK

SEQ ID NO: 293156 - protein, 6 aa, Mycobacterium
VGDERS

SEQ ID NO: 293157 - protein, 4 aa, Mycobacterium
VGDG

SEQ ID NO: 293158 - protein, 155 aa, Mycobacterium
VGDGDDDREPAGSVATDEAPVDEPETAESRAEQLETEEAETEEAEVEEPEAEEAEAEAEEAEAEEPEAEAEREQAEAEAEEAEAEEPEEAEEPEAEAEAEAEEPEAEEPEEAEKPEEPEAEKPEEPEAEKPEEPGAETEQPEIASAAEPEPQTRR

SEQ ID NO: 293159 - protein, 6 aa, Mycobacterium
VGDGDT

SEQ ID NO: 293160 - protein, 12 aa, Mycobacterium
VGDGLPAKSDVK

SEQ ID NO: 293161 - protein, 10 aa, Mycobacterium
VGDGLPARSD

SEQ ID NO: 293162 - protein, 10 aa, Mycobacterium
VGDGLPKRSD

SEQ ID NO: 293163 - protein, 16 aa, Mycobacterium
VGDGTGTALDSASLST

SEQ ID NO: 293164 - protein, 5 aa, Mycobacterium
VGDHV

SEQ ID NO: 293165 - protein, 4 aa, Mycobacterium
VGDP

SEQ ID NO: 293166 - protein, 10 aa, Mycobacterium
VGDPKTVPDA

SEQ ID NO: 293167 - protein, 7 aa, Mycobacterium
VGDPTEG

SEQ ID NO: 293168 - protein, 12 aa, Mycobacterium
VGDQGALPDSLP

SEQ ID NO: 293169 - protein, 6 aa, Mycobacterium
VGDRPV

SEQ ID NO: 293170 - protein, 15 aa, Mycobacterium
VGDRVAGATVNTDGR

SEQ ID NO: 293171 - protein, 8 aa, Mycobacterium
VGDRYGRR

SEQ ID NO: 293172 - protein, 19 aa, Mycobacterium
VGDSGAQAAWGSIASAPGP

SEQ ID NO: 293173 - protein, 16 aa, Mycobacterium
VGDSGARAAWGSVASS

SEQ ID NO: 293174 - protein, 12 aa, Mycobacterium
VGDTGAARRRDR

SEQ ID NO: 293175 - protein, 5 aa, Mycobacterium
VGDVT

SEQ ID NO: 293176 - protein, 4 aa, Mycobacterium
VGEA

SEQ ID NO: 293177 - protein, 10 aa, Mycobacterium
VGEAAPRAVP

SEQ ID NO: 293178 - protein, 10 aa, Mycobacterium
VGEAGRAAAD

SEQ ID NO: 293179 - protein, 15 aa, Mycobacterium
VGEAVTAGTVATDSG

SEQ ID NO: 293180 - protein, 22 aa, Mycobacterium
VGEDGRPLTQGGQGQGSTSVAG

SEQ ID NO: 293181 - protein, 6 aa, Mycobacterium
VGEEHT

SEQ ID NO: 293182 - protein, 4 aa, Mycobacterium
VGEG

SEQ ID NO: 293183 - protein, 15 aa, Mycobacterium
VGEGMPGGSSPASWL

SEQ ID NO: 293184 - protein, 6 aa, Mycobacterium
VGEGRV

SEQ ID NO: 293185 - protein, 7 aa, Mycobacterium
VGEGTEI

SEQ ID NO: 293186 - protein, 4 aa, Mycobacterium
VGEH

SEQ ID NO: 293187 - protein, 5 aa, Mycobacterium
VGELA

SEQ ID NO: 293188 - protein, 7 aa, Mycobacterium
VGEPPCA

SEQ ID NO: 293189 - protein, 14 aa, Mycobacterium
VGEPTSQHLIAAKT

SEQ ID NO: 293190 - protein, 6 aa, Mycobacterium
VGEPVR

SEQ ID NO: 293191 - protein, 6 aa, Mycobacterium
VGEQEV

SEQ ID NO: 293192 - protein, 4 aa, Mycobacterium
VGGA

SEQ ID NO: 293193 - protein, 8 aa, Mycobacterium
VGGAPNPY

SEQ ID NO: 293194 - protein, 13 aa, Mycobacterium
VGGAPNSPSVGTS

SEQ ID NO: 293195 - protein, 16 aa, Mycobacterium
VGGAQQTITGGPVASQ

SEQ ID NO: 293196 - protein, 11 aa, Mycobacterium
VGGATSSSSNT

SEQ ID NO: 293197 - protein, 8 aa, Mycobacterium
VGGDHTST

SEQ ID NO: 293198 - protein, 11 aa, Mycobacterium
VGGDVDETDYR

SEQ ID NO: 293199 - protein, 11 aa, Mycobacterium
VGGEESRSLES

SEQ ID NO: 293200 - protein, 16 aa, Mycobacterium
VGGELAASSAAPQPYL

SEQ ID NO: 293201 - protein, 7 aa, Mycobacterium
VGGEQGG

SEQ ID NO: 293202 - protein, 10 aa, Mycobacterium
VGGGAAIPEI

SEQ ID NO: 293203 - protein, 5 aa, Mycobacterium
VGGGF

SEQ ID NO: 293204 - protein, 11 aa, Mycobacterium
VGGGGPVSAGL

SEQ ID NO: 293205 - protein, 6 aa, Mycobacterium
VGGGGW

SEQ ID NO: 293206 - protein, 11 aa, Mycobacterium
VGGGPAGVGNA

SEQ ID NO: 293207 - protein, 12 aa, Mycobacterium
VGGGPAGVGNAV

SEQ ID NO: 293208 - protein, 11 aa, Mycobacterium
VGGGPAGVGRA

SEQ ID NO: 293209 - protein, 11 aa, Mycobacterium
VGGGPNSPGAG

SEQ ID NO: 293210 - protein, 8 aa, Mycobacterium
VGGGSAAS

SEQ ID NO: 293211 - protein, 5 aa, Mycobacterium
VGGGT

SEQ ID NO: 293212 - protein, 6 aa, Mycobacterium
VGGGTL

SEQ ID NO: 293213 - protein, 4 aa, Mycobacterium
VGGI

SEQ ID NO: 293214 - protein, 5 aa, Mycobacterium
VGGKD

SEQ ID NO: 293215 - protein, 9 aa, Mycobacterium
VGGKGLQAG

SEQ ID NO: 293216 - protein, 5 aa, Mycobacterium
VGGND

SEQ ID NO: 293217 - protein, 7 aa, Mycobacterium
VGGNGDA

SEQ ID NO: 293218 - protein, 7 aa, Mycobacterium
VGGNGEG

SEQ ID NO: 293219 - protein, 6 aa, Mycobacterium
VGGNGR

SEQ ID NO: 293220 - protein, 4 aa, Mycobacterium
VGGP

SEQ ID NO: 293221 - protein, 10 aa, Mycobacterium
VGGPAPKKYE

SEQ ID NO: 293222 - protein, 6 aa, Mycobacterium
VGGPES

SEQ ID NO: 293223 - protein, 11 aa, Mycobacterium
VGGPQSGKSTA

SEQ ID NO: 293224 - protein, 8 aa, Mycobacterium
VGGPRRKG

SEQ ID NO: 293225 - protein, 10 aa, Mycobacterium
VGGPSDRHDK

SEQ ID NO: 293226 - protein, 14 aa, Mycobacterium
VGGQERSDSGIRSG

SEQ ID NO: 293227 - protein, 12 aa, Mycobacterium
VGGQGGRSAHST

SEQ ID NO: 293228 - protein, 10 aa, Mycobacterium
VGGQNAKQIV

SEQ ID NO: 293229 - protein, 9 aa, Mycobacterium
VGGQRGTAG

SEQ ID NO: 293230 - protein, 12 aa, Mycobacterium
VGGRAAPDRTPR

SEQ ID NO: 293231 - protein, 4 aa, Mycobacterium
VGGS

SEQ ID NO: 293232 - protein, 10 aa, Mycobacterium
VGGSGSVATQ

SEQ ID NO: 293233 - protein, 12 aa, Mycobacterium
VGGSGTPLVGDE

SEQ ID NO: 293234 - protein, 5 aa, Mycobacterium
VGGSI

SEQ ID NO: 293235 - protein, 6 aa, Mycobacterium
VGGSMG

SEQ ID NO: 293236 - protein, 14 aa, Mycobacterium
VGGSPLQVSGPAAG

SEQ ID NO: 293237 - protein, 6 aa, Mycobacterium
VGGSVG

SEQ ID NO: 293238 - protein, 8 aa, Mycobacterium
VGGTARAV

SEQ ID NO: 293239 - protein, 14 aa, Mycobacterium
VGGTGSPSIGAPVP

SEQ ID NO: 293240 - protein, 10 aa, Mycobacterium
VGGTPALEQD

SEQ ID NO: 293241 - protein, 14 aa, Mycobacterium
VGGTPNAPSNGTGS

SEQ ID NO: 293242 - protein, 14 aa, Mycobacterium
VGGTPNIPSNGTTS

SEQ ID NO: 293243 - protein, 10 aa, Mycobacterium
VGGTPNNPIF

SEQ ID NO: 293244 - protein, 14 aa, Mycobacterium
VGGTPRGIPYPGSW

SEQ ID NO: 293245 - protein, 6 aa, Mycobacterium
VGGTTP

SEQ ID NO: 293246 - protein, 7 aa, Mycobacterium
VGGTTVV

SEQ ID NO: 293247 - protein, 25 aa, Mycobacterium
VGHDPQDPETDGHDGPHGDDGREDA

SEQ ID NO: 293248 - protein, 12 aa, Mycobacterium
VGHERQEHRHEQ

SEQ ID NO: 293249 - protein, 13 aa, Mycobacterium
VGHGGADGPEPAV

SEQ ID NO: 293250 - protein, 10 aa, Mycobacterium
VGHGPSAPAL

SEQ ID NO: 293251 - protein, 8 aa, Mycobacterium
VGHPPSHT

SEQ ID NO: 293252 - protein, 6 aa, Mycobacterium
VGHPRS

SEQ ID NO: 293253 - protein, 4 aa, Mycobacterium
VGHT

SEQ ID NO: 293254 - protein, 16 aa, Mycobacterium
VGIAPGRLDEAAGQGH

SEQ ID NO: 293255 - protein, 8 aa, Mycobacterium
VGITTDRE

SEQ ID NO: 293256 - protein, 17 aa, Mycobacterium
VGKAAGRISNSVGAEGD

SEQ ID NO: 293257 - protein, 9 aa, Mycobacterium
VGKADVSGP

SEQ ID NO: 293258 - protein, 5 aa, Mycobacterium
VGKDH

SEQ ID NO: 293259 - protein, 6 aa, Mycobacterium
VGKEHS

SEQ ID NO: 293260 - protein, 10 aa, Mycobacterium
VGKGEDPRYT

SEQ ID NO: 293261 - protein, 9 aa, Mycobacterium
VGKGPERIP

SEQ ID NO: 293262 - protein, 6 aa, Mycobacterium
VGKGSR

SEQ ID NO: 293263 - protein, 7 aa, Mycobacterium
VGKGTEI

SEQ ID NO: 293264 - protein, 4 aa, Mycobacterium
VGKQ

SEQ ID NO: 293265 - protein, 10 aa, Mycobacterium
VGKSAADALT

SEQ ID NO: 293266 - protein, 11 aa, Mycobacterium
VGKSPDDVDES

SEQ ID NO: 293267 - protein, 5 aa, Mycobacterium
VGKST

SEQ ID NO: 293268 - protein, 4 aa, Mycobacterium
VGKT

SEQ ID NO: 293269 - protein, 10 aa, Mycobacterium
VGKTPAQVST

SEQ ID NO: 293270 - protein, 6 aa, Mycobacterium
VGKTQA

SEQ ID NO: 293271 - protein, 13 aa, Mycobacterium
VGLSSAPKAVSAY

SEQ ID NO: 293272 - protein, 6 aa, Mycobacterium
VGLSTP

SEQ ID NO: 293273 - protein, 8 aa, Mycobacterium
VGNAPGDG

SEQ ID NO: 293274 - protein, 5 aa, Mycobacterium
VGNAV

SEQ ID NO: 293275 - protein, 13 aa, Mycobacterium
VGNDAKVADVEFV

SEQ ID NO: 293276 - protein, 13 aa, Mycobacterium
VGNEATPNTALAG

SEQ ID NO: 293277 - protein, 6 aa, Mycobacterium
VGNETT

SEQ ID NO: 293278 - protein, 5 aa, Mycobacterium
VGNGG

SEQ ID NO: 293279 - protein, 7 aa, Mycobacterium
VGNGSTY

SEQ ID NO: 293280 - protein, 8 aa, Mycobacterium
VGNPQGPR

SEQ ID NO: 293281 - protein, 8 aa, Mycobacterium
VGNPRGPH

SEQ ID NO: 293282 - protein, 6 aa, Mycobacterium
VGNQTA

SEQ ID NO: 293283 - protein, 8 aa, Mycobacterium
VGNRGAYG

SEQ ID NO: 293284 - protein, 4 aa, Mycobacterium
VGNS

SEQ ID NO: 293285 - protein, 11 aa, Mycobacterium
VGNSSLSAGGE

SEQ ID NO: 293286 - protein, 8 aa, Mycobacterium
VGNTASEE

SEQ ID NO: 293287 - protein, 9 aa, Mycobacterium
VGNTASPDV

SEQ ID NO: 293288 - protein, 7 aa, Mycobacterium
VGNTGAD

SEQ ID NO: 293289 - protein, 4 aa, Mycobacterium
VGPA

SEQ ID NO: 293290 - protein, 14 aa, Mycobacterium
VGPAASAAAATPPL

SEQ ID NO: 293291 - protein, 7 aa, Mycobacterium
VGPASGG

SEQ ID NO: 293292 - protein, 12 aa, Mycobacterium
VGPDGLGNSPEH

SEQ ID NO: 293293 - protein, 10 aa, Mycobacterium
VGPDTQQRRA

SEQ ID NO: 293294 - protein, 5 aa, Mycobacterium
VGPGE

SEQ ID NO: 293295 - protein, 5 aa, Mycobacterium
VGPGH

SEQ ID NO: 293296 - protein, 6 aa, Mycobacterium
VGPGKA

SEQ ID NO: 293297 - protein, 5 aa, Mycobacterium
VGPGR

SEQ ID NO: 293298 - protein, 24 aa, Mycobacterium
VGPGSAAKPPHGGSLEAETERGIE

SEQ ID NO: 293299 - protein, 6 aa, Mycobacterium
VGPGVS

SEQ ID NO: 293300 - protein, 10 aa, Mycobacterium
VGPHPPDAGF

SEQ ID NO: 293301 - protein, 4 aa, Mycobacterium
VGPI

SEQ ID NO: 293302 - protein, 6 aa, Mycobacterium
VGPKSL

SEQ ID NO: 293303 - protein, 6 aa, Mycobacterium
VGPLSQ

SEQ ID NO: 293304 - protein, 8 aa, Mycobacterium
VGPPDPVP

SEQ ID NO: 293305 - protein, 5 aa, Mycobacterium
VGPPG

SEQ ID NO: 293306 - protein, 12 aa, Mycobacterium
VGPPHGRGHAED

SEQ ID NO: 293307 - protein, 15 aa, Mycobacterium
VGPPTDDPRSRYDAP

SEQ ID NO: 293308 - protein, 35 aa, Mycobacterium
VGPPTTITNAPGGNGPGGPGGPEPGGPQAPPPQPP

SEQ ID NO: 293309 - protein, 23 aa, Mycobacterium
VGPPTTVPVGPAAPPAGDVPPPG

SEQ ID NO: 293310 - protein, 5 aa, Mycobacterium
VGPQD

SEQ ID NO: 293311 - protein, 10 aa, Mycobacterium
VGPQQQAKVT

SEQ ID NO: 293312 - protein, 7 aa, Mycobacterium
VGPQRSA

SEQ ID NO: 293313 - protein, 28 aa, Mycobacterium
VGPRPLDPPPSPPPPPAPSAGPDAFSGI

SEQ ID NO: 293314 - protein, 10 aa, Mycobacterium
VGPRSRHHRN

SEQ ID NO: 293315 - protein, 13 aa, Mycobacterium
VGPSASATGIKND

SEQ ID NO: 293316 - protein, 9 aa, Mycobacterium
VGPSETVDA

SEQ ID NO: 293317 - protein, 10 aa, Mycobacterium
VGPSGSGKST

SEQ ID NO: 293318 - protein, 9 aa, Mycobacterium
VGPSGSGKT

SEQ ID NO: 293319 - protein, 6 aa, Mycobacterium
VGPSGV

SEQ ID NO: 293320 - protein, 16 aa, Mycobacterium
VGPSLSKGATTGTPIG

SEQ ID NO: 293321 - protein, 10 aa, Mycobacterium
VGPTASVAPP

SEQ ID NO: 293322 - protein, 5 aa, Mycobacterium
VGPTI

SEQ ID NO: 293323 - protein, 14 aa, Mycobacterium
VGPTPNTPNNTSTA

SEQ ID NO: 293324 - protein, 6 aa, Mycobacterium
VGPTPR

SEQ ID NO: 293325 - protein, 17 aa, Mycobacterium
VGPTQVDRDAGDDTETA

SEQ ID NO: 293326 - protein, 8 aa, Mycobacterium
VGPTRDGW

SEQ ID NO: 293327 - protein, 7 aa, Mycobacterium
VGPTTGG

SEQ ID NO: 293328 - protein, 20 aa, Mycobacterium
VGPTWNSPGRSAQDGSIDRP

SEQ ID NO: 293329 - protein, 5 aa, Mycobacterium
VGPVP

SEQ ID NO: 293330 - protein, 5 aa, Mycobacterium
VGPVT

SEQ ID NO: 293331 - protein, 8 aa, Mycobacterium
VGPVTSEF

SEQ ID NO: 293332 - protein, 8 aa, Mycobacterium
VGQADDDV

SEQ ID NO: 293333 - protein, 6 aa, Mycobacterium
VGQELG

SEQ ID NO: 293334 - protein, 18 aa, Mycobacterium
VGQERSVSLSPKEAPSYQ

SEQ ID NO: 293335 - protein, 5 aa, Mycobacterium
VGQQQ

SEQ ID NO: 293336 - protein, 5 aa, Mycobacterium
VGQRL

SEQ ID NO: 293337 - protein, 5 aa, Mycobacterium
VGQRQ

SEQ ID NO: 293338 - protein, 5 aa, Mycobacterium
VGQRS

SEQ ID NO: 293339 - protein, 6 aa, Mycobacterium
VGQTAT

SEQ ID NO: 293340 - protein, 4 aa, Mycobacterium
VGRA

SEQ ID NO: 293341 - protein, 33 aa, Mycobacterium
VGRAAGEDPPPEAAEDENTEDENTEDDGAAVVK

SEQ ID NO: 293342 - protein, 8 aa, Mycobacterium
VGRAQDND

SEQ ID NO: 293343 - protein, 6 aa, Mycobacterium
VGRDPE

SEQ ID NO: 293344 - protein, 9 aa, Mycobacterium
VGRDPKPRR

SEQ ID NO: 293345 - protein, 6 aa, Mycobacterium
VGREPE

SEQ ID NO: 293346 - protein, 27 aa, Mycobacterium
VGREPMPAKPTLGQARNALRDRGGRSR

SEQ ID NO: 293347 - protein, 7 aa, Mycobacterium
VGRESER

SEQ ID NO: 293348 - protein, 4 aa, Mycobacterium
VGRG

SEQ ID NO: 293349 - protein, 12 aa, Mycobacterium
VGRGAAAVGNAV

SEQ ID NO: 293350 - protein, 7 aa, Mycobacterium
VGRGTEI

SEQ ID NO: 293351 - protein, 5 aa, Mycobacterium
VGRKP

SEQ ID NO: 293352 - protein, 9 aa, Mycobacterium
VGRPRGPFG

SEQ ID NO: 293353 - protein, 6 aa, Mycobacterium
VGRPRK

SEQ ID NO: 293354 - protein, 8 aa, Mycobacterium
VGRPRPPL

SEQ ID NO: 293355 - protein, 7 aa, Mycobacterium
VGRRGTQ

SEQ ID NO: 293356 - protein, 7 aa, Mycobacterium
VGRRPVP

SEQ ID NO: 293357 - protein, 15 aa, Mycobacterium
VGRRRKDDDTGDSAG

SEQ ID NO: 293358 - protein, 11 aa, Mycobacterium
VGRSPDDIDES

SEQ ID NO: 293359 - protein, 8 aa, Mycobacterium
VGRSPFGT

SEQ ID NO: 293360 - protein, 7 aa, Mycobacterium
VGRTPRI

SEQ ID NO: 293361 - protein, 24 aa, Mycobacterium
VGRTRSLGQHNPTARLRFYEMRVS

SEQ ID NO: 293362 - protein, 8 aa, Mycobacterium
VGRTTAPM

SEQ ID NO: 293363 - protein, 4 aa, Mycobacterium
VGSA

SEQ ID NO: 293364 - protein, 17 aa, Mycobacterium
VGSAAEYTRTNGRPPLP

SEQ ID NO: 293365 - protein, 14 aa, Mycobacterium
VGSAATRRAGRAEY

SEQ ID NO: 293366 - protein, 10 aa, Mycobacterium
VGSADAEELP

SEQ ID NO: 293367 - protein, 5 aa, Mycobacterium
VGSAP

SEQ ID NO: 293368 - protein, 10 aa, Mycobacterium
VGSAPGGINR

SEQ ID NO: 293369 - protein, 9 aa, Mycobacterium
VGSAPQPIT

SEQ ID NO: 293370 - protein, 5 aa, Mycobacterium
VGSAV

SEQ ID NO: 293371 - protein, 4 aa, Mycobacterium
VGSD

SEQ ID NO: 293372 - protein, 14 aa, Mycobacterium
VGSDPAKDASVASP

SEQ ID NO: 293373 - protein, 28 aa, Mycobacterium
VGSDRTGAIPAAVGRSRAEAMTPDPYTG

SEQ ID NO: 293374 - protein, 5 aa, Mycobacterium
VGSDT

SEQ ID NO: 293375 - protein, 8 aa, Mycobacterium
VGSDTDGA

SEQ ID NO: 293376 - protein, 4 aa, Mycobacterium
VGSE

SEQ ID NO: 293377 - protein, 6 aa, Mycobacterium
VGSEDA

SEQ ID NO: 293378 - protein, 8 aa, Mycobacterium
VGSEPGSV

SEQ ID NO: 293379 - protein, 8 aa, Mycobacterium
VGSETERI

SEQ ID NO: 293380 - protein, 7 aa, Mycobacterium
VGSGAAD

SEQ ID NO: 293381 - protein, 12 aa, Mycobacterium
VGSGDDRTVQPA

SEQ ID NO: 293382 - protein, 10 aa, Mycobacterium
VGSGDKPTKL

SEQ ID NO: 293383 - protein, 9 aa, Mycobacterium
VGSGGSATL

SEQ ID NO: 293384 - protein, 7 aa, Mycobacterium
VGSGPGF

SEQ ID NO: 293385 - protein, 9 aa, Mycobacterium
VGSGPTVGA

SEQ ID NO: 293386 - protein, 31 aa, Mycobacterium
VGSHRRHGSDGAVDADYPASAAGPSSGRRRG

SEQ ID NO: 293387 - protein, 7 aa, Mycobacterium
VGSKGTV

SEQ ID NO: 293388 - protein, 10 aa, Mycobacterium
VGSNNATGIP

SEQ ID NO: 293389 - protein, 10 aa, Mycobacterium
VGSPDAKNLQ

SEQ ID NO: 293390 - protein, 9 aa, Mycobacterium
VGSPDAKTL

SEQ ID NO: 293391 - protein, 45 aa, Mycobacterium
VGSPPRGSSPGRHRSDDKPAPPPPPPPPSPRRQGPGGAPPPPEPR

SEQ ID NO: 293392 - protein, 6 aa, Mycobacterium
VGSPTA

SEQ ID NO: 293393 - protein, 5 aa, Mycobacterium
VGSQR

SEQ ID NO: 293394 - protein, 6 aa, Mycobacterium
VGSRSG

SEQ ID NO: 293395 - protein, 6 aa, Mycobacterium
VGSRTA

SEQ ID NO: 293396 - protein, 5 aa, Mycobacterium
VGSSS

SEQ ID NO: 293397 - protein, 4 aa, Mycobacterium
VGST

SEQ ID NO: 293398 - protein, 8 aa, Mycobacterium
VGSTGGVV

SEQ ID NO: 293399 - protein, 9 aa, Mycobacterium
VGSTGTSTW

SEQ ID NO: 293400 - protein, 9 aa, Mycobacterium
VGSTSNFST

SEQ ID NO: 293401 - protein, 9 aa, Mycobacterium
VGSVGGELR

SEQ ID NO: 293402 - protein, 10 aa, Mycobacterium
VGSVPGCGEG

SEQ ID NO: 293403 - protein, 4 aa, Mycobacterium
VGTA

SEQ ID NO: 293404 - protein, 5 aa, Mycobacterium
VGTAA

SEQ ID NO: 293405 - protein, 6 aa, Mycobacterium
VGTAAY

SEQ ID NO: 293406 - protein, 7 aa, Mycobacterium
VGTAEYD

SEQ ID NO: 293407 - protein, 5 aa, Mycobacterium
VGTAG

SEQ ID NO: 293408 - protein, 8 aa, Mycobacterium
VGTANTGR

SEQ ID NO: 293409 - protein, 5 aa, Mycobacterium
VGTAQ

SEQ ID NO: 293410 - protein, 5 aa, Mycobacterium
VGTAT

SEQ ID NO: 293411 - protein, 6 aa, Mycobacterium
VGTATA

SEQ ID NO: 293412 - protein, 9 aa, Mycobacterium
VGTATGPTL

SEQ ID NO: 293413 - protein, 8 aa, Mycobacterium
VGTDGDDA

SEQ ID NO: 293414 - protein, 8 aa, Mycobacterium
VGTDGDNA

SEQ ID NO: 293415 - protein, 11 aa, Mycobacterium
VGTDGSPSEFS

SEQ ID NO: 293416 - protein, 6 aa, Mycobacterium
VGTDPT

SEQ ID NO: 293417 - protein, 8 aa, Mycobacterium
VGTDSRAA

SEQ ID NO: 293418 - protein, 10 aa, Mycobacterium
VGTEEQGGVI

SEQ ID NO: 293419 - protein, 7 aa, Mycobacterium
VGTEGDD

SEQ ID NO: 293420 - protein, 15 aa, Mycobacterium
VGTEGVGLGNQENAA

SEQ ID NO: 293421 - protein, 14 aa, Mycobacterium
VGTEPADGQSVPKD

SEQ ID NO: 293422 - protein, 6 aa, Mycobacterium
VGTETG

SEQ ID NO: 293423 - protein, 11 aa, Mycobacterium
VGTGAFGHTGG

SEQ ID NO: 293424 - protein, 6 aa, Mycobacterium
VGTGAT

SEQ ID NO: 293425 - protein, 13 aa, Mycobacterium
VGTGEPVAPGRSA

SEQ ID NO: 293426 - protein, 9 aa, Mycobacterium
VGTGETAQT

SEQ ID NO: 293427 - protein, 7 aa, Mycobacterium
VGTGRGA

SEQ ID NO: 293428 - protein, 8 aa, Mycobacterium
VGTGRGAE

SEQ ID NO: 293429 - protein, 6 aa, Mycobacterium
VGTGSG

SEQ ID NO: 293430 - protein, 9 aa, Mycobacterium
VGTGSSGIQ

SEQ ID NO: 293431 - protein, 18 aa, Mycobacterium
VGTKKGQTWQSMLMPPKR

SEQ ID NO: 293432 - protein, 5 aa, Mycobacterium
VGTLD

SEQ ID NO: 293433 - protein, 4 aa, Mycobacterium
VGTP

SEQ ID NO: 293434 - protein, 10 aa, Mycobacterium
VGTPGPESRS

SEQ ID NO: 293435 - protein, 11 aa, Mycobacterium
VGTPGQANYAA

SEQ ID NO: 293436 - protein, 7 aa, Mycobacterium
VGTPGVP

SEQ ID NO: 293437 - protein, 9 aa, Mycobacterium
VGTPPVSTE

SEQ ID NO: 293438 - protein, 19 aa, Mycobacterium
VGTPSKLSFPSAHATSTAA

SEQ ID NO: 293439 - protein, 8 aa, Mycobacterium
VGTPSRLS

SEQ ID NO: 293440 - protein, 5 aa, Mycobacterium
VGTPT

SEQ ID NO: 293441 - protein, 14 aa, Mycobacterium
VGTQSSPWPPAATQ

SEQ ID NO: 293442 - protein, 4 aa, Mycobacterium
VGTS

SEQ ID NO: 293443 - protein, 8 aa, Mycobacterium
VGTTGGVI

SEQ ID NO: 293444 - protein, 6 aa, Mycobacterium
VGTTPT

SEQ ID NO: 293445 - protein, 4 aa, Mycobacterium
VGTV

SEQ ID NO: 293446 - protein, 15 aa, Mycobacterium
VGVDGEDAGETENGK

SEQ ID NO: 293447 - protein, 6 aa, Mycobacterium
VGVPDN

SEQ ID NO: 293448 - protein, 10 aa, Mycobacterium
VGVPESGAGV

SEQ ID NO: 293449 - protein, 10 aa, Mycobacterium
VGVPRPNTSM

SEQ ID NO: 293450 - protein, 13 aa, Mycobacterium
VGVRRGRGRVGGV

SEQ ID NO: 293451 - protein, 4 aa, Mycobacterium
VGYD

SEQ ID NO: 293452 - protein, 4 aa, Mycobacterium
VGYG

SEQ ID NO: 293453 - protein, 5 aa, Mycobacterium
VGYGS

SEQ ID NO: 293454 - protein, 8 aa, Mycobacterium
VGYGSDGK

SEQ ID NO: 293455 - protein, 12 aa, Mycobacterium
VGYGYAGRTSLT

SEQ ID NO: 293456 - protein, 7 aa, Mycobacterium
VGYNADG

SEQ ID NO: 293457 - protein, 4 aa, Mycobacterium
VGYT

SEQ ID NO: 293458 - protein, 11 aa, Mycobacterium
VHAPGQTGQAG

SEQ ID NO: 293459 - protein, 5 aa, Mycobacterium
VHASR

SEQ ID NO: 293460 - protein, 5 aa, Mycobacterium
VHATS

SEQ ID NO: 293461 - protein, 10 aa, Mycobacterium
VHDTPNIGSV

SEQ ID NO: 293462 - protein, 5 aa, Mycobacterium
VHEPR

SEQ ID NO: 293463 - protein, 9 aa, Mycobacterium
VHESRSGAY

SEQ ID NO: 293464 - protein, 12 aa, Mycobacterium
VHGGQPGQIAGG

SEQ ID NO: 293465 - protein, 13 aa, Mycobacterium
VHGNREAANAVPD

SEQ ID NO: 293466 - protein, 4 aa, Mycobacterium
VHGS

SEQ ID NO: 293467 - protein, 10 aa, Mycobacterium
VHGSESRESI

SEQ ID NO: 293468 - protein, 6 aa, Mycobacterium
VHNEAG

SEQ ID NO: 293469 - protein, 14 aa, Mycobacterium
VHPAPAPTGPILIS

SEQ ID NO: 293470 - protein, 5 aa, Mycobacterium
VHPDA

SEQ ID NO: 293471 - protein, 17 aa, Mycobacterium
VHPESQTSDKQPSTGMQ

SEQ ID NO: 293472 - protein, 6 aa, Mycobacterium
VHPPAA

SEQ ID NO: 293473 - protein, 6 aa, Mycobacterium
VHRNSS

SEQ ID NO: 293474 - protein, 7 aa, Mycobacterium
VHSDPRG

SEQ ID NO: 293475 - protein, 14 aa, Mycobacterium
VHSGDRSGAAARGR

SEQ ID NO: 293476 - protein, 12 aa, Mycobacterium
VHSGSIGRGIAA

SEQ ID NO: 293477 - protein, 7 aa, Mycobacterium
VHSPGVG

SEQ ID NO: 293478 - protein, 9 aa, Mycobacterium
VHSQPGDKV

SEQ ID NO: 293479 - protein, 10 aa, Mycobacterium
VHSQSSVGEQ

SEQ ID NO: 293480 - protein, 10 aa, Mycobacterium
VHTPEGTSVQ

SEQ ID NO: 293481 - protein, 5 aa, Mycobacterium
VHTPG

SEQ ID NO: 293482 - protein, 8 aa, Mycobacterium
VHTPPGVT

SEQ ID NO: 293483 - protein, 10 aa, Mycobacterium
VHTRDGKAHP

SEQ ID NO: 293484 - protein, 5 aa, Mycobacterium
VIDGP

SEQ ID NO: 293485 - protein, 21 aa, Mycobacterium
VIEGEGAEAEEEEEGVRTPKV

SEQ ID NO: 293486 - protein, 12 aa, Mycobacterium
VIGGGGNRYGRP

SEQ ID NO: 293487 - protein, 12 aa, Mycobacterium
VIGPQRTTTPIP

SEQ ID NO: 293488 - protein, 10 aa, Mycobacterium
VIGRGEDGAI

SEQ ID NO: 293489 - protein, 19 aa, Mycobacterium
VIPPRDDAARPQAPATARR

SEQ ID NO: 293490 - protein, 12 aa, Mycobacterium
VITGDRSSIPQA

SEQ ID NO: 293491 - protein, 15 aa, Mycobacterium
VITSPDEVELTGPPR

SEQ ID NO: 293492 - protein, 10 aa, Mycobacterium
VKAARDTRDS

SEQ ID NO: 293493 - protein, 6 aa, Mycobacterium
VKAEQR

SEQ ID NO: 293494 - protein, 9 aa, Mycobacterium
VKAERVSNE

SEQ ID NO: 293495 - protein, 6 aa, Mycobacterium
VKAGGV

SEQ ID NO: 293496 - protein, 10 aa, Mycobacterium
VKAGKAPAPQ

SEQ ID NO: 293497 - protein, 8 aa, Mycobacterium
VKAGRAAQ

SEQ ID NO: 293498 - protein, 12 aa, Mycobacterium
VKAGSPAEKGGM

SEQ ID NO: 293499 - protein, 12 aa, Mycobacterium
VKAGSPAQKGGV

SEQ ID NO: 293500 - protein, 6 aa, Mycobacterium
VKAPAG

SEQ ID NO: 293501 - protein, 17 aa, Mycobacterium
VKASTDKPSYLAGEQPK

SEQ ID NO: 293502 - protein, 7 aa, Mycobacterium
VKATAYD

SEQ ID NO: 293503 - protein, 9 aa, Mycobacterium
VKATSAEAI

SEQ ID NO: 293504 - protein, 17 aa, Mycobacterium
VKCNGGKNPVVKKGDTF

SEQ ID NO: 293505 - protein, 20 aa, Mycobacterium
VKDERSENEVNAQTFCLVKS

SEQ ID NO: 293506 - protein, 20 aa, Mycobacterium
VKDERSENQVNAQTFCLVKS

SEQ ID NO: 293507 - protein, 21 aa, Mycobacterium
VKDKDKDKDQPPKDDEPKRVA

SEQ ID NO: 293508 - protein, 10 aa, Mycobacterium
VKDKGRFAGK

SEQ ID NO: 293509 - protein, 7 aa, Mycobacterium
VKDPAYS

SEQ ID NO: 293510 - protein, 10 aa, Mycobacterium
VKDRETLEGI

SEQ ID NO: 293511 - protein, 10 aa, Mycobacterium
VKDRRTVSTQ

SEQ ID NO: 293512 - protein, 4 aa, Mycobacterium
VKDS

SEQ ID NO: 293513 - protein, 8 aa, Mycobacterium
VKDSAADA

SEQ ID NO: 293514 - protein, 15 aa, Mycobacterium
VKDSHPDMRQPSRRK

SEQ ID NO: 293515 - protein, 8 aa, Mycobacterium
VKDTADEI

SEQ ID NO: 293516 - protein, 10 aa, Mycobacterium
VKDTSQGRAR

SEQ ID NO: 293517 - protein, 13 aa, Mycobacterium
VKEGRQAWRGQHC

SEQ ID NO: 293518 - protein, 107 aa, Mycobacterium
VKEPKQRRRRKKGDEGDDVDETDEADEADEAEDVDEAGEAEDVDETDEAEETDEAEEADEASDGEESVESEEAEPAEEAEVAEEAEADEETAEPEAQGEDATAHGGL

SEQ ID NO: 293519 - protein, 7 aa, Mycobacterium
VKEPRES

SEQ ID NO: 293520 - protein, 23 aa, Mycobacterium
VKGAAEGVQRGLSTGTKSTPAAA

SEQ ID NO: 293521 - protein, 13 aa, Mycobacterium
VKGDQAKATQCQN

SEQ ID NO: 293522 - protein, 12 aa, Mycobacterium
VKGGPKGVGDAV

SEQ ID NO: 293523 - protein, 12 aa, Mycobacterium
VKGHDDPANRKP

SEQ ID NO: 293524 - protein, 12 aa, Mycobacterium
VKGQDDPANRKP

SEQ ID NO: 293525 - protein, 5 aa, Mycobacterium
VKGRE

SEQ ID NO: 293526 - protein, 7 aa, Mycobacterium
VKGSGSG

SEQ ID NO: 293527 - protein, 8 aa, Mycobacterium
VKGTPLAN

SEQ ID NO: 293528 - protein, 8 aa, Mycobacterium
VKGTPLSN

SEQ ID NO: 293529 - protein, 9 aa, Mycobacterium
VKGTSADAI

SEQ ID NO: 293530 - protein, 16 aa, Mycobacterium
VKGVPAKSNSERKATL

SEQ ID NO: 293531 - protein, 9 aa, Mycobacterium
VKHGGASKI

SEQ ID NO: 293532 - protein, 7 aa, Mycobacterium
VKHGNAG

SEQ ID NO: 293533 - protein, 8 aa, Mycobacterium
VKHGQATQ

SEQ ID NO: 293534 - protein, 6 aa, Mycobacterium
VKIPKD

SEQ ID NO: 293535 - protein, 21 aa, Mycobacterium
VKKAGDAAPAKPASRLPEAAA

SEQ ID NO: 293536 - protein, 7 aa, Mycobacterium
VKKSYEP

SEQ ID NO: 293537 - protein, 10 aa, Mycobacterium
VKNDNSASFQ

SEQ ID NO: 293538 - protein, 12 aa, Mycobacterium
VKNGTEGAEFAE

SEQ ID NO: 293539 - protein, 13 aa, Mycobacterium
VKNGTQGSDFANS

SEQ ID NO: 293540 - protein, 20 aa, Mycobacterium
VKNKGGNDRDDPSKISGVGN

SEQ ID NO: 293541 - protein, 7 aa, Mycobacterium
VKNPDLA

SEQ ID NO: 293542 - protein, 26 aa, Mycobacterium
VKPAAAPPASAPKPAAEPKPAADKSV

SEQ ID NO: 293543 - protein, 76 aa, Mycobacterium
VKPADSPAEDVAAEPVTEDKPKTAYWSEPEPRWPKSPPQPKRVPGPERSAYPRPLANGTARPEEPSGAEDMSPDPM

SEQ ID NO: 293544 - protein, 16 aa, Mycobacterium
VKPAGQPQASDRLKGG

SEQ ID NO: 293545 - protein, 17 aa, Mycobacterium
VKPAGRRRRWQPTRDEA

SEQ ID NO: 293546 - protein, 4 aa, Mycobacterium
VKPD

SEQ ID NO: 293547 - protein, 9 aa, Mycobacterium
VKPDAPTTD

SEQ ID NO: 293548 - protein, 13 aa, Mycobacterium
VKPDGTPDLPGAS

SEQ ID NO: 293549 - protein, 7 aa, Mycobacterium
VKPGDRV

SEQ ID NO: 293550 - protein, 7 aa, Mycobacterium
VKPGPAT

SEQ ID NO: 293551 - protein, 13 aa, Mycobacterium
VKPGVGQSAYSLG

SEQ ID NO: 293552 - protein, 10 aa, Mycobacterium
VKPKADISDD

SEQ ID NO: 293553 - protein, 10 aa, Mycobacterium
VKPKQRRAAR

SEQ ID NO: 293554 - protein, 7 aa, Mycobacterium
VKPPPQY

SEQ ID NO: 293555 - protein, 6 aa, Mycobacterium
VKPPRL

SEQ ID NO: 293556 - protein, 9 aa, Mycobacterium
VKPPSSPVT

SEQ ID NO: 293557 - protein, 22 aa, Mycobacterium
VKPQSPSIGAATAAPTREPAVA

SEQ ID NO: 293558 - protein, 28 aa, Mycobacterium
VKPRPSRMRGEEETTATRTTGATTTRMA

SEQ ID NO: 293559 - protein, 9 aa, Mycobacterium
VKPRRGKPD

SEQ ID NO: 293560 - protein, 14 aa, Mycobacterium
VKPSAPKKWQDMLP

SEQ ID NO: 293561 - protein, 5 aa, Mycobacterium
VKPSG

SEQ ID NO: 293562 - protein, 11 aa, Mycobacterium
VKPSGPGREEF

SEQ ID NO: 293563 - protein, 7 aa, Mycobacterium
VKPSNAL

SEQ ID NO: 293564 - protein, 8 aa, Mycobacterium
VKPTEKAD

SEQ ID NO: 293565 - protein, 32 aa, Mycobacterium
VKPTGFTPNGVPDRTLAESVKETSVPQPGTDY

SEQ ID NO: 293566 - protein, 7 aa, Mycobacterium
VKPTSAA

SEQ ID NO: 293567 - protein, 8 aa, Mycobacterium
VKPTSAEA

SEQ ID NO: 293568 - protein, 9 aa, Mycobacterium
VKPTTATRV

SEQ ID NO: 293569 - protein, 8 aa, Mycobacterium
VKQAQTPR

SEQ ID NO: 293570 - protein, 8 aa, Mycobacterium
VKQQSTGV

SEQ ID NO: 293571 - protein, 5 aa, Mycobacterium
VKRDG

SEQ ID NO: 293572 - protein, 6 aa, Mycobacterium
VKRDGA

SEQ ID NO: 293573 - protein, 11 aa, Mycobacterium
VKRGEANNGGV

SEQ ID NO: 293574 - protein, 8 aa, Mycobacterium
VKRGEPVK

SEQ ID NO: 293575 - protein, 8 aa, Mycobacterium
VKRPQCPP

SEQ ID NO: 293576 - protein, 6 aa, Mycobacterium
VKRSYA

SEQ ID NO: 293577 - protein, 5 aa, Mycobacterium
VKRTP

SEQ ID NO: 293578 - protein, 6 aa, Mycobacterium
VKRTSD

SEQ ID NO: 293579 - protein, 8 aa, Mycobacterium
VKSAAPDK

SEQ ID NO: 293580 - protein, 9 aa, Mycobacterium
VKSNSDVTL

SEQ ID NO: 293581 - protein, 10 aa, Mycobacterium
VKSPEQSNQA

SEQ ID NO: 293582 - protein, 9 aa, Mycobacterium
VKSPSSPVT

SEQ ID NO: 293583 - protein, 9 aa, Mycobacterium
VKSSPQSRA

SEQ ID NO: 293584 - protein, 11 aa, Mycobacterium
VKSSTANTSLS

SEQ ID NO: 293585 - protein, 13 aa, Mycobacterium
VKSTDGSPNGQDI

SEQ ID NO: 293586 - protein, 8 aa, Mycobacterium
VKSTGGVI

SEQ ID NO: 293587 - protein, 8 aa, Mycobacterium
VKTGPDGW

SEQ ID NO: 293588 - protein, 6 aa, Mycobacterium
VKTNAV

SEQ ID NO: 293589 - protein, 7 aa, Mycobacterium
VKTNDVT

SEQ ID NO: 293590 - protein, 10 aa, Mycobacterium
VKTNGASYAY

SEQ ID NO: 293591 - protein, 13 aa, Mycobacterium
VKTPEPQLLTAAG

SEQ ID NO: 293592 - protein, 10 aa, Mycobacterium
VKTPSSPVTT

SEQ ID NO: 293593 - protein, 5 aa, Mycobacterium
VKTSG

SEQ ID NO: 293594 - protein, 11 aa, Mycobacterium
VKVGPDLSIPG

SEQ ID NO: 293595 - protein, 10 aa, Mycobacterium
VKVSKKASEW

SEQ ID NO: 293596 - protein, 7 aa, Mycobacterium
VKVTNDG

SEQ ID NO: 293597 - protein, 13 aa, Mycobacterium
VKYQTGADQIKTE

SEQ ID NO: 293598 - protein, 6 aa, Mycobacterium
VLDGST

SEQ ID NO: 293599 - protein, 7 aa, Mycobacterium
VLEASKK

SEQ ID NO: 293600 - protein, 12 aa, Mycobacterium
VLGAPGQANYAA

SEQ ID NO: 293601 - protein, 9 aa, Mycobacterium
VLPPATAPV

SEQ ID NO: 293602 - protein, 5 aa, Mycobacterium
VLPPM

SEQ ID NO: 293603 - protein, 4 aa, Mycobacterium
VLPR

SEQ ID NO: 293604 - protein, 27 aa, Mycobacterium
VLPRPGPALGSRNGLEERVSEKVEAEP

SEQ ID NO: 293605 - protein, 9 aa, Mycobacterium
VLPSSASAR

SEQ ID NO: 293606 - protein, 7 aa, Mycobacterium
VLQGSSA

SEQ ID NO: 293607 - protein, 4 aa, Mycobacterium
VLRE

SEQ ID NO: 293608 - protein, 9 aa, Mycobacterium
VLSDRNPTL

SEQ ID NO: 293609 - protein, 12 aa, Mycobacterium
VLSDSGRTAVTS

SEQ ID NO: 293610 - protein, 7 aa, Mycobacterium
VLSGPES

SEQ ID NO: 293611 - protein, 11 aa, Mycobacterium
VLTDPGRAAVS

SEQ ID NO: 293612 - protein, 9 aa, Mycobacterium
VMERPGDRS

SEQ ID NO: 293613 - protein, 10 aa, Mycobacterium
VMERPGDRSF

SEQ ID NO: 293614 - protein, 41 aa, Mycobacterium
VMERPGDRSFVNDEEKTGSNQAGTEGGTTPAPGINGSSAQL

SEQ ID NO: 293615 - protein, 11 aa, Mycobacterium
VMGQSNNGTRS

SEQ ID NO: 293616 - protein, 8 aa, Mycobacterium
VNADPVPL

SEQ ID NO: 293617 - protein, 11 aa, Mycobacterium
VNAEGAPSSFS

SEQ ID NO: 293618 - protein, 5 aa, Mycobacterium
VNAEW

SEQ ID NO: 293619 - protein, 4 aa, Mycobacterium
VNAG

SEQ ID NO: 293620 - protein, 5 aa, Mycobacterium
VNAGG

SEQ ID NO: 293621 - protein, 14 aa, Mycobacterium
VNAKDAQMKAVCSG

SEQ ID NO: 293622 - protein, 12 aa, Mycobacterium
VNARGGPGGAPG

SEQ ID NO: 293623 - protein, 13 aa, Mycobacterium
VNARGGPGGKPGC

SEQ ID NO: 293624 - protein, 8 aa, Mycobacterium
VNASDGLA

SEQ ID NO: 293625 - protein, 7 aa, Mycobacterium
VNASGAE

SEQ ID NO: 293626 - protein, 12 aa, Mycobacterium
VNATEPDARAAL

SEQ ID NO: 293627 - protein, 7 aa, Mycobacterium
VNDAPAL

SEQ ID NO: 293628 - protein, 9 aa, Mycobacterium
VNDAPALAQ

SEQ ID NO: 293629 - protein, 7 aa, Mycobacterium
VNDAPAM

SEQ ID NO: 293630 - protein, 9 aa, Mycobacterium
VNDEAQKQQ

SEQ ID NO: 293631 - protein, 25 aa, Mycobacterium
VNDEDSPDFSAPTSPLRSGGPGSLA

SEQ ID NO: 293632 - protein, 16 aa, Mycobacterium
VNDETDPDNPAPQSVL

SEQ ID NO: 293633 - protein, 7 aa, Mycobacterium
VNDGAPL

SEQ ID NO: 293634 - protein, 16 aa, Mycobacterium
VNDQEYASRRAQIIAE

SEQ ID NO: 293635 - protein, 8 aa, Mycobacterium
VNDRRTSS

SEQ ID NO: 293636 - protein, 9 aa, Mycobacterium
VNDSAAGVE

SEQ ID NO: 293637 - protein, 11 aa, Mycobacterium
VNDSQSNVEGA

SEQ ID NO: 293638 - protein, 4 aa, Mycobacterium
VNEA

SEQ ID NO: 293639 - protein, 4 aa, Mycobacterium
VNEI

SEQ ID NO: 293640 - protein, 10 aa, Mycobacterium
VNENAQHSSR

SEQ ID NO: 293641 - protein, 12 aa, Mycobacterium
VNEPEGESAAAH

SEQ ID NO: 293642 - protein, 6 aa, Mycobacterium
VNEQSD

SEQ ID NO: 293643 - protein, 7 aa, Mycobacterium
VNERSQR

SEQ ID NO: 293644 - protein, 4 aa, Mycobacterium
VNES

SEQ ID NO: 293645 - protein, 14 aa, Mycobacterium
VNEVPAESAVPTTV

SEQ ID NO: 293646 - protein, 11 aa, Mycobacterium
VNGAPFSADAT

SEQ ID NO: 293647 - protein, 13 aa, Mycobacterium
VNGDGAPSTTTLQ

SEQ ID NO: 293648 - protein, 10 aa, Mycobacterium
VNGGKRRAMA

SEQ ID NO: 293649 - protein, 7 aa, Mycobacterium
VNGGRDV

SEQ ID NO: 293650 - protein, 10 aa, Mycobacterium
VNGKADESFS

SEQ ID NO: 293651 - protein, 18 aa, Mycobacterium
VNGNGHAKTNGKLVTTAE

SEQ ID NO: 293652 - protein, 5 aa, Mycobacterium
VNGPD

SEQ ID NO: 293653 - protein, 10 aa, Mycobacterium
VNGRPAKEPI

SEQ ID NO: 293654 - protein, 11 aa, Mycobacterium
VNGRRGNAADH

SEQ ID NO: 293655 - protein, 11 aa, Mycobacterium
VNGSPASGWYA

SEQ ID NO: 293656 - protein, 10 aa, Mycobacterium
VNGTGTTKTV

SEQ ID NO: 293657 - protein, 7 aa, Mycobacterium
VNGTTAA

SEQ ID NO: 293658 - protein, 7 aa, Mycobacterium
VNGTTSV

SEQ ID NO: 293659 - protein, 13 aa, Mycobacterium
VNGYTDNSGSEGL

SEQ ID NO: 293660 - protein, 9 aa, Mycobacterium
VNHDGRSNG

SEQ ID NO: 293661 - protein, 10 aa, Mycobacterium
VNHDGRSNGM

SEQ ID NO: 293662 - protein, 59 aa, Mycobacterium
VNHVPKSTTSTTTTTTTTTPSTTTTTTTTESSSSAEEQPPAQQPTQQQPTGQQTQQPTH

SEQ ID NO: 293663 - protein, 6 aa, Mycobacterium
VNIAGG

SEQ ID NO: 293664 - protein, 9 aa, Mycobacterium
VNLSGGQRQ

SEQ ID NO: 293665 - protein, 24 aa, Mycobacterium
VNNEENPDNPAPTTSLRSGGPGSL

SEQ ID NO: 293666 - protein, 4 aa, Mycobacterium
VNNT

SEQ ID NO: 293667 - protein, 10 aa, Mycobacterium
VNPAGAPSSF

SEQ ID NO: 293668 - protein, 11 aa, Mycobacterium
VNPATGRRQSR

SEQ ID NO: 293669 - protein, 8 aa, Mycobacterium
VNPDRGLR

SEQ ID NO: 293670 - protein, 15 aa, Mycobacterium
VNPDSEEDSGSTDET

SEQ ID NO: 293671 - protein, 4 aa, Mycobacterium
VNPG

SEQ ID NO: 293672 - protein, 5 aa, Mycobacterium
VNPGE

SEQ ID NO: 293673 - protein, 15 aa, Mycobacterium
VNPNPSLADPNPPLP

SEQ ID NO: 293674 - protein, 9 aa, Mycobacterium
VNPPESGSN

SEQ ID NO: 293675 - protein, 7 aa, Mycobacterium
VNPPGHK

SEQ ID NO: 293676 - protein, 6 aa, Mycobacterium
VNPPGT

SEQ ID NO: 293677 - protein, 6 aa, Mycobacterium
VNPPKG

SEQ ID NO: 293678 - protein, 6 aa, Mycobacterium
VNPPLD

SEQ ID NO: 293679 - protein, 14 aa, Mycobacterium
VNPPTQGSQAATES

SEQ ID NO: 293680 - protein, 6 aa, Mycobacterium
VNPQTI

SEQ ID NO: 293681 - protein, 7 aa, Mycobacterium
VNPRPVH

SEQ ID NO: 293682 - protein, 4 aa, Mycobacterium
VNPS

SEQ ID NO: 293683 - protein, 13 aa, Mycobacterium
VNPSSGEITGRSN

SEQ ID NO: 293684 - protein, 7 aa, Mycobacterium
VNPTAGT

SEQ ID NO: 293685 - protein, 6 aa, Mycobacterium
VNPTQA

SEQ ID NO: 293686 - protein, 10 aa, Mycobacterium
VNPTTVKSTE

SEQ ID NO: 293687 - protein, 10 aa, Mycobacterium
VNQDGRSNGL

SEQ ID NO: 293688 - protein, 6 aa, Mycobacterium
VNQGDS

SEQ ID NO: 293689 - protein, 9 aa, Mycobacterium
VNQKDGTPF

SEQ ID NO: 293690 - protein, 8 aa, Mycobacterium
VNRASGRV

SEQ ID NO: 293691 - protein, 4 aa, Mycobacterium
VNRD

SEQ ID NO: 293692 - protein, 11 aa, Mycobacterium
VNRDSSQAITS

SEQ ID NO: 293693 - protein, 7 aa, Mycobacterium
VNRDSVD

SEQ ID NO: 293694 - protein, 8 aa, Mycobacterium
VNRDSVDA

SEQ ID NO: 293695 - protein, 4 aa, Mycobacterium
VNRQ

SEQ ID NO: 293696 - protein, 4 aa, Mycobacterium
VNSD

SEQ ID NO: 293697 - protein, 32 aa, Mycobacterium; identical to SEQ ID NO: 4581

SEQ ID NO: 293698 - protein, 26 aa, Mycobacterium
VNSGGPAPAAPMPASRPAPTPVSTPV

SEQ ID NO: 293699 - protein, 9 aa, Mycobacterium
VNSPDQPEL

SEQ ID NO: 293700 - protein, 5 aa, Mycobacterium
VNSPP

SEQ ID NO: 293701 - protein, 9 aa, Mycobacterium
VNSSPGHTE

SEQ ID NO: 293702 - protein, 8 aa, Mycobacterium
VNSSPGRT

SEQ ID NO: 293703 - protein, 5 aa, Mycobacterium
VNTGD

SEQ ID NO: 293704 - protein, 5 aa, Mycobacterium
VNTGQ

SEQ ID NO: 293705 - protein, 10 aa, Mycobacterium
VNTSGTPAAV

SEQ ID NO: 293706 - protein, 6 aa, Mycobacterium
VNTTGS

SEQ ID NO: 293707 - protein, 7 aa, Mycobacterium
VNTTGSL

SEQ ID NO: 293708 - protein, 4 aa, Mycobacterium
VNVT

SEQ ID NO: 293709 - protein, 18 aa, Mycobacterium
VPAAAGSSLGSRVAGTQP

SEQ ID NO: 293710 - protein, 6 aa, Mycobacterium
VPAAAT

SEQ ID NO: 293711 - protein, 7 aa, Mycobacterium
VPAAAVG

SEQ ID NO: 293712 - protein, 11 aa, Mycobacterium
VPAADISDGGQ

SEQ ID NO: 293713 - protein, 12 aa, Mycobacterium
VPAAEASSNRWT

SEQ ID NO: 293714 - protein, 8 aa, Mycobacterium
VPAAEGSV

SEQ ID NO: 293715 - protein, 18 aa, Mycobacterium
VPAAESPPPAAEASTGPL

SEQ ID NO: 293716 - protein, 22 aa, Mycobacterium
VPAAETSVTRQTTSAPDAYADS

SEQ ID NO: 293717 - protein, 6 aa, Mycobacterium
VPAAGS

SEQ ID NO: 293718 - protein, 21 aa, Mycobacterium
VPAAPESSDREAKPKAQRQSQ

SEQ ID NO: 293719 - protein, 13 aa, Mycobacterium
VPADAAVGGGGGV

SEQ ID NO: 293720 - protein, 6 aa, Mycobacterium
VPAEDG

SEQ ID NO: 293721 - protein, 15 aa, Mycobacterium
VPAERAAPPPASPLK

SEQ ID NO: 293722 - protein, 10 aa, Mycobacterium
VPAESNPARL

SEQ ID NO: 293723 - protein, 14 aa, Mycobacterium
VPAFEKPKSRNAAT

SEQ ID NO: 293724 - protein, 14 aa, Mycobacterium
VPAFRKPKSRNAAT

SEQ ID NO: 293725 - protein, 7 aa, Mycobacterium
VPAGGED

SEQ ID NO: 293726 - protein, 21 aa, Mycobacterium
VPAGLTPEQTGAAAESIGGAA

SEQ ID NO: 293727 - protein, 18 aa, Mycobacterium
VPAGPAAEVATGDAEPVD

SEQ ID NO: 293728 - protein, 5 aa, Mycobacterium
VPAGQ

SEQ ID NO: 293729 - protein, 8 aa, Mycobacterium
VPAHPQTP

SEQ ID NO: 293730 - protein, 5 aa, Mycobacterium
VPAIP

SEQ ID NO: 293731 - protein, 13 aa, Mycobacterium
VPALGSDGAPSIS

SEQ ID NO: 293732 - protein, 9 aa, Mycobacterium
VPANNDGGA

SEQ ID NO: 293733 - protein, 9 aa, Mycobacterium
VPANQGYAA

SEQ ID NO: 293734 - protein, 6 aa, Mycobacterium
VPANVG

SEQ ID NO: 293735 - protein, 23 aa, Mycobacterium
VPAPAAAEDDVEAVEPGDGEDRQ

SEQ ID NO: 293736 - protein, 34 aa, Mycobacterium
VPAPAPPPPPPPSNFGPPPPAYSPPPRKSGGDRR

SEQ ID NO: 293737 - protein, 13 aa, Mycobacterium
VPAPETGGADGSA

SEQ ID NO: 293738 - protein, 9 aa, Mycobacterium
VPAPGAPPL

SEQ ID NO: 293739 - protein, 9 aa, Mycobacterium
VPAPGRPPL

SEQ ID NO: 293740 - protein, 10 aa, Mycobacterium
VPAPNGIGEH

SEQ ID NO: 293741 - protein, 42 aa, Mycobacterium
VPAPPPASNTGSVTPSTIESTESVTTPPATTVATTQPPVPTT

SEQ ID NO: 293742 - protein, 13 aa, Mycobacterium
VPAPPPPRDARPG

SEQ ID NO: 293743 - protein, 7 aa, Mycobacterium
VPAPQGV

SEQ ID NO: 293744 - protein, 7 aa, Mycobacterium
VPAPRSA

SEQ ID NO: 293745 - protein, 21 aa, Mycobacterium
VPAPSCKGTWRPRAERRNKGR

SEQ ID NO: 293746 - protein, 7 aa, Mycobacterium
VPAPSGV

SEQ ID NO: 293747 - protein, 106 aa, Mycobacterium
VPAPSVSLRPSAAAPSPVKPPPSSVPVPSAAPAPTTVAPPPPPSPTLTASPPTSTLAPSPVVTTTTAPRLTTTSPRPTSTTSATPTTTAEPEDTTTEEAPTAPSTV

SEQ ID NO: 293748 - protein, 94 aa, Mycobacterium
VPAQPKENPEPGAGAPQQGQPAPAKEATPPAPGAGKSTPAAPPSPKPQPRPYPAQTTTPPPPPPATQPATPNATTAPAPPADLPPKPGSGEERK

SEQ ID NO: 293749 - protein, 20 aa, Mycobacterium
VPAQQPAAAPPAKMTRPSRP

SEQ ID NO: 293750 - protein, 8 aa, Mycobacterium
VPAQTRDA

SEQ ID NO: 293751 - protein, 5 aa, Mycobacterium
VPAQV

SEQ ID NO: 293752 - protein, 7 aa, Mycobacterium
VPARGTV

SEQ ID NO: 293753 - protein, 8 aa, Mycobacterium
VPASAAPD

SEQ ID NO: 293754 - protein, 7 aa, Mycobacterium
VPASGRR

SEQ ID NO: 293755 - protein, 10 aa, Mycobacterium
VPASPNVSVG

SEQ ID NO: 293756 - protein, 6 aa, Mycobacterium
VPASRT

SEQ ID NO: 293757 - protein, 7 aa, Mycobacterium
VPASSAI

SEQ ID NO: 293758 - protein, 4 aa, Mycobacterium
VPAT

SEQ ID NO: 293759 - protein, 34 aa, Mycobacterium
VPATAPAASAPASAASAKTGGQSAASKVGQAYRN

SEQ ID NO: 293760 - protein, 11 aa, Mycobacterium
VPATDAELTQE

SEQ ID NO: 293761 - protein, 9 aa, Mycobacterium
VPDADSAKA

SEQ ID NO: 293762 - protein, 9 aa, Mycobacterium
VPDAERTTI

SEQ ID NO: 293763 - protein, 6 aa, Mycobacterium
VPDAGT

SEQ ID NO: 293764 - protein, 5 aa, Mycobacterium
VPDAL

SEQ ID NO: 293765 - protein, 25 aa, Mycobacterium
VPDASSGDHDVTYPEQRKSSLPGEN

SEQ ID NO: 293766 - protein, 4 aa, Mycobacterium
VPDD

SEQ ID NO: 293767 - protein, 10 aa, Mycobacterium
VPDDDADQLD

SEQ ID NO: 293768 - protein, 18 aa, Mycobacterium
VPDDGAAATFPGAPGPVG

SEQ ID NO: 293769 - protein, 6 aa, Mycobacterium
VPDDQL

SEQ ID NO: 293770 - protein, 7 aa, Mycobacterium
VPDDSTR

SEQ ID NO: 293771 - protein, 4 aa, Mycobacterium
VPDE

SEQ ID NO: 293772 - protein, 8 aa, Mycobacterium
VPDEKDAE

SEQ ID NO: 293773 - protein, 7 aa, Mycobacterium
VPDEPEM

SEQ ID NO: 293774 - protein, 26 aa, Mycobacterium
VPDGGPSALGAKPGNGVPELGPAPPK

SEQ ID NO: 293775 - protein, 5 aa, Mycobacterium
VPDPA

SEQ ID NO: 293776 - protein, 8 aa, Mycobacterium
VPDPHATV

SEQ ID NO: 293777 - protein, 8 aa, Mycobacterium
VPDPTVGD

SEQ ID NO: 293778 - protein, 7 aa, Mycobacterium
VPDRGAE

SEQ ID NO: 293779 - protein, 5 aa, Mycobacterium
VPDSA

SEQ ID NO: 293780 - protein, 13 aa, Mycobacterium
VPDSAARLTERSR

SEQ ID NO: 293781 - protein, 6 aa, Mycobacterium
VPDTDP

SEQ ID NO: 293782 - protein, 11 aa, Mycobacterium
VPDVSAGQVEE

SEQ ID NO: 293783 - protein, 8 aa, Mycobacterium
VPEAAGGQ

SEQ ID NO: 293784 - protein, 7 aa, Mycobacterium
VPEAGPG

SEQ ID NO: 293785 - protein, 7 aa, Mycobacterium
VPEAPAV

SEQ ID NO: 293786 - protein, 8 aa, Mycobacterium
VPEAPPPV

SEQ ID NO: 293787 - protein, 7 aa, Mycobacterium
VPEAPTV

SEQ ID NO: 293788 - protein, 4 aa, Mycobacterium
VPEC

SEQ ID NO: 293789 - protein, 12 aa, Mycobacterium
VPEDDKGLATRS

SEQ ID NO: 293790 - protein, 9 aa, Mycobacterium
VPEDDKGLM

SEQ ID NO: 293791 - protein, 6 aa, Mycobacterium
VPEDRR

SEQ ID NO: 293792 - protein, 5 aa, Mycobacterium
VPEDY

SEQ ID NO: 293793 - protein, 5 aa, Mycobacterium
VPEED

SEQ ID NO: 293794 - protein, 11 aa, Mycobacterium
VPEEDKGLRTR

SEQ ID NO: 293795 - protein, 6 aa, Mycobacterium
VPEEQA

SEQ ID NO: 293796 - protein, 9 aa, Mycobacterium
VPEEQHERR

SEQ ID NO: 293797 - protein, 10 aa, Mycobacterium
VPEEVPEGSA

SEQ ID NO: 293798 - protein, 16 aa, Mycobacterium
VPEEYRASSVSSYRQV

SEQ ID NO: 293799 - protein, 5 aa, Mycobacterium
VPEGA

SEQ ID NO: 293800 - protein, 7 aa, Mycobacterium
VPEGPAG

SEQ ID NO: 293801 - protein, 5 aa, Mycobacterium
VPEGT

SEQ ID NO: 293802 - protein, 14 aa, Mycobacterium
VPEPAPAPPVPTQA

SEQ ID NO: 293803 - protein, 26 aa, Mycobacterium
VPEPARGGDTFGASAGSDRRDCSNDT

SEQ ID NO: 293804 - protein, 8 aa, Mycobacterium
VPEPDAGH

SEQ ID NO: 293805 - protein, 8 aa, Mycobacterium
VPEPGPAL

SEQ ID NO: 293806 - protein, 8 aa, Mycobacterium
VPEPGSVD

SEQ ID NO: 293807 - protein, 7 aa, Mycobacterium
VPEPPSV

SEQ ID NO: 293808 - protein, 8 aa, Mycobacterium
VPEPPVQR

SEQ ID NO: 293809 - protein, 11 aa, Mycobacterium
VPEPRAHYTGE

SEQ ID NO: 293810 - protein, 14 aa, Mycobacterium
VPESAARLQERSQL

SEQ ID NO: 293811 - protein, 5 aa, Mycobacterium
VPESF

SEQ ID NO: 293812 - protein, 47 aa, Mycobacterium
VPESFDPKHPEPDQAADEGTDAVDEADGQPPDRADGSERPPGPGDEP

SEQ ID NO: 293813 - protein, 47 aa, Mycobacterium
VPESFDPKHPEPDQAADEGTDAVDPGAGQAPDRADGSPRPPGSGDEP

SEQ ID NO: 293814 - protein, 12 aa, Mycobacterium
VPESHAEGAPDD

SEQ ID NO: 293815 - protein, 11 aa, Mycobacterium
VPETAPQGSTL

SEQ ID NO: 293816 - protein, 17 aa, Mycobacterium
VPETPDFAQESEQRRTK

SEQ ID NO: 293817 - protein, 7 aa, Mycobacterium
VPETPMQ

SEQ ID NO: 293818 - protein, 4 aa, Mycobacterium
VPEV

SEQ ID NO: 293819 - protein, 14 aa, Mycobacterium
VPFGPHAGGPEEIR

SEQ ID NO: 293820 - protein, 4 aa, Mycobacterium
VPGA

SEQ ID NO: 293821 - protein, 6 aa, Mycobacterium
VPGAAD

SEQ ID NO: 293822 - protein, 9 aa, Mycobacterium
VPGAAGERV

SEQ ID NO: 293823 - protein, 13 aa, Mycobacterium
VPGAATPNEQAVS

SEQ ID NO: 293824 - protein, 7 aa, Mycobacterium
VPGADDV

SEQ ID NO: 293825 - protein, 5 aa, Mycobacterium
VPGAS

SEQ ID NO: 293826 - protein, 5 aa, Mycobacterium
VPGAT

SEQ ID NO: 293827 - protein, 4 aa, Mycobacterium
VPGD

SEQ ID NO: 293828 - protein, 7 aa, Mycobacterium
VPGDAGG

SEQ ID NO: 293829 - protein, 25 aa, Mycobacterium
VPGDENSGRTRRGDRGDRSRGGEKD

SEQ ID NO: 293830 - protein, 6 aa, Mycobacterium
VPGDGV

SEQ ID NO: 293831 - protein, 7 aa, Mycobacterium
VPGEGRE

SEQ ID NO: 293832 - protein, 9 aa, Mycobacterium
VPGEPDESI

SEQ ID NO: 293833 - protein, 7 aa, Mycobacterium
VPGEVDR

SEQ ID NO: 293834 - protein, 5 aa, Mycobacterium
VPGGA

SEQ ID NO: 293835 - protein, 6 aa, Mycobacterium
VPGGGF

SEQ ID NO: 293836 - protein, 9 aa, Mycobacterium
VPGGGFAGG

SEQ ID NO: 293837 - protein, 7 aa, Mycobacterium
VPGGPGA

SEQ ID NO: 293838 - protein, 6 aa, Mycobacterium
VPGGTW

SEQ ID NO: 293839 - protein, 8 aa, Mycobacterium
VPGGVGPG

SEQ ID NO: 293840 - protein, 10 aa, Mycobacterium
VPGGVGPGGW

SEQ ID NO: 293841 - protein, 7 aa, Mycobacterium
VPGKRSS

SEQ ID NO: 293842 - protein, 8 aa, Mycobacterium
VPGKRSTF

SEQ ID NO: 293843 - protein, 9 aa, Mycobacterium
VPGKTEVSS

SEQ ID NO: 293844 - protein, 8 aa, Mycobacterium
VPGLASGP

SEQ ID NO: 293845 - protein, 18 aa, Mycobacterium
VPGMQDAAPAGESGGAVE

SEQ ID NO: 293846 - protein, 4 aa, Mycobacterium
VPGP

SEQ ID NO: 293847 - protein, 6 aa, Mycobacterium
VPGPAG

SEQ ID NO: 293848 - protein, 8 aa, Mycobacterium
VPGPAGRA

SEQ ID NO: 293849 - protein, 6 aa, Mycobacterium
VPGPDE

SEQ ID NO: 293850 - protein, 42 aa, Mycobacterium
VPGPGDELPPPPSPDPEPDWEPSGDGGSAEQFGERRPADDDE

SEQ ID NO: 293851 - protein, 10 aa, Mycobacterium
VPGPGGRDVQ

SEQ ID NO: 293852 - protein, 10 aa, Mycobacterium
VPGPPADSTI

SEQ ID NO: 293853 - protein, 9 aa, Mycobacterium
VPGPPAGSV

SEQ ID NO: 293854 - protein, 10 aa, Mycobacterium
VPGPPPGSAV

SEQ ID NO: 293855 - protein, 6 aa, Mycobacterium
VPGPRA

SEQ ID NO: 293856 - protein, 6 aa, Mycobacterium
VPGPSP

SEQ ID NO: 293857 - protein, 11 aa, Mycobacterium
VPGQAPGMPGS

SEQ ID NO: 293858 - protein, 14 aa, Mycobacterium
VPGQDNGSSGPGLA

SEQ ID NO: 293859 - protein, 5 aa, Mycobacterium
VPGQP

SEQ ID NO: 293860 - protein, 6 aa, Mycobacterium
VPGQPI

SEQ ID NO: 293861 - protein, 10 aa, Mycobacterium
VPGQRPDSAL

SEQ ID NO: 293862 - protein, 15 aa, Mycobacterium
VPGQTFGSDGPLGGV

SEQ ID NO: 293863 - protein, 13 aa, Mycobacterium
VPGRDTATAPKRA

SEQ ID NO: 293864 - protein, 9 aa, Mycobacterium
VPGRGSASV

SEQ ID NO: 293865 - protein, 9 aa, Mycobacterium
VPGRSSASV

SEQ ID NO: 293866 - protein, 7 aa, Mycobacterium
VPGRSSV

SEQ ID NO: 293867 - protein, 5 aa, Mycobacterium
VPGRT

SEQ ID NO: 293868 - protein, 6 aa, Mycobacterium
VPGSAG

SEQ ID NO: 293869 - protein, 8 aa, Mycobacterium
VPGSAGFG

SEQ ID NO: 293870 - protein, 8 aa, Mycobacterium
VPGSDGST

SEQ ID NO: 293871 - protein, 14 aa, Mycobacterium
VPGSDPAAPSPNQL

SEQ ID NO: 293872 - protein, 7 aa, Mycobacterium
VPGSTGF

SEQ ID NO: 293873 - protein, 4 aa, Mycobacterium
VPGT

SEQ ID NO: 293874 - protein, 8 aa, Mycobacterium
VPGTGERL

SEQ ID NO: 293875 - protein, 6 aa, Mycobacterium
VPGTGR

SEQ ID NO: 293876 - protein, 8 aa, Mycobacterium
VPGTGRLS

SEQ ID NO: 293877 - protein, 13 aa, Mycobacterium
VPGTKPEEPGSSP

SEQ ID NO: 293878 - protein, 21 aa, Mycobacterium
VPGTPEDAAQEGTKVGVGEGG

SEQ ID NO: 293879 - protein, 8 aa, Mycobacterium
VPGTRSEV

SEQ ID NO: 293880 - protein, 6 aa, Mycobacterium
VPGTST

SEQ ID NO: 293881 - protein, 4 aa, Mycobacterium
VPGV

SEQ ID NO: 293882 - protein, 5 aa, Mycobacterium
VPGVA

SEQ ID NO: 293883 - protein, 15 aa, Mycobacterium
VPGVAQGAIQGGRYA

SEQ ID NO: 293884 - protein, 8 aa, Mycobacterium
VPGVARGP

SEQ ID NO: 293885 - protein, 6 aa, Mycobacterium
VPGVGT

SEQ ID NO: 293886 - protein, 7 aa, Mycobacterium
VPGYGRD

SEQ ID NO: 293887 - protein, 21 aa, Mycobacterium
VPHDPGKGAELAGEAESAGGT

SEQ ID NO: 293888 - protein, 7 aa, Mycobacterium
VPHEPDP

SEQ ID NO: 293889 - protein, 5 aa, Mycobacterium
VPHPP

SEQ ID NO: 293890 - protein, 6 aa, Mycobacterium
VPIDSK

SEQ ID NO: 293891 - protein, 10 aa, Mycobacterium
VPIGTDPAVE

SEQ ID NO: 293892 - protein, 15 aa, Mycobacterium
VPIPGSGSVELPAGE

SEQ ID NO: 293893 - protein, 7 aa, Mycobacterium
VPKAGPA

SEQ ID NO: 293894 - protein, 10 aa, Mycobacterium
VPKARTEAGF

SEQ ID NO: 293895 - protein, 9 aa, Mycobacterium
VPKASTPAW

SEQ ID NO: 293896 - protein, 5 aa, Mycobacterium
VPKPR

SEQ ID NO: 293897 - protein, 9 aa, Mycobacterium
VPKQAPKAI

SEQ ID NO: 293898 - protein, 6 aa, Mycobacterium
VPLEGD

SEQ ID NO: 293899 - protein, 21 aa, Mycobacterium
VPLESNGTDCRSRRRKVLWRH

SEQ ID NO: 293900 - protein, 8 aa, Mycobacterium
VPLRPSTT

SEQ ID NO: 293901 - protein, 56 aa, Mycobacterium
VPLRTSSTVPLKAPQPAAKAGAAAAIQPPGAAGQGPSSLLPSQSDDHQRSPRTDTA

SEQ ID NO: 293902 - protein, 10 aa, Mycobacterium
VPMQPASTNK

SEQ ID NO: 293903 - protein, 19 aa, Mycobacterium
VPNADSAKALGLGSPKTAP

SEQ ID NO: 293904 - protein, 38 aa, Mycobacterium
VPNPSEAADKAAGLTEAANGRVESRSEDAGSRADRAQT

SEQ ID NO: 293905 - protein, 5 aa, Mycobacterium
VPNRG

SEQ ID NO: 293906 - protein, 12 aa, Mycobacterium
VPNRPSEVPPAT

SEQ ID NO: 293907 - protein, 18 aa, Mycobacterium
VPNSESKIVDPETGAEIE

SEQ ID NO: 293908 - protein, 6 aa, Mycobacterium
VPNSLD

SEQ ID NO: 293909 - protein, 12 aa, Mycobacterium
VPPAAAGEPGVT

SEQ ID NO: 293910 - protein, 19 aa, Mycobacterium
VPPAPAATPVCEPTPLARR

SEQ ID NO: 293911 - protein, 25 aa, Mycobacterium
VPPAPTEPAPIPEPLAPQQETETPS

SEQ ID NO: 293912 - protein, 24 aa, Mycobacterium
VPPAQHAPPPTPTPTAAVTPPPVL

SEQ ID NO: 293913 - protein, 7 aa, Mycobacterium
VPPARRA

SEQ ID NO: 293914 - protein, 5 aa, Mycobacterium
VPPAT

SEQ ID NO: 293915 - protein, 10 aa, Mycobacterium
VPPDARNGLA

SEQ ID NO: 293916 - protein, 13 aa, Mycobacterium
VPPDKSDRATGFD

SEQ ID NO: 293917 - protein, 19 aa, Mycobacterium
VPPDQGGDLSSAVAPDTSK

SEQ ID NO: 293918 - protein, 21 aa, Mycobacterium
VPPDRADDVGSAVAPDTSKPV

SEQ ID NO: 293919 - protein, 8 aa, Mycobacterium
VPPDRDAD

SEQ ID NO: 293920 - protein, 4 aa, Mycobacterium
VPPE

SEQ ID NO: 293921 - protein, 9 aa, Mycobacterium
VPPEPEYTA

SEQ ID NO: 293922 - protein, 9 aa, Mycobacterium
VPPEPPNAM

SEQ ID NO: 293923 - protein, 7 aa, Mycobacterium
VPPERAG

SEQ ID NO: 293924 - protein, 17 aa, Mycobacterium
VPPEVRGAQRRPARHRP

SEQ ID NO: 293925 - protein, 16 aa, Mycobacterium
VPPEYAAATQAAPAPM

SEQ ID NO: 293926 - protein, 44 aa, Mycobacterium
VPPGAAVPGTRVGPAPPSAAAPSRQPEPPAAPNPLPTQAPTLPG

SEQ ID NO: 293927 - protein, 9 aa, Mycobacterium
VPPGASELA

SEQ ID NO: 293928 - protein, 34 aa, Mycobacterium
VPPGGPNLTDPNPPLPPWQPNPSPRVPGTADPDL

SEQ ID NO: 293929 - protein, 5 aa, Mycobacterium
VPPGH

SEQ ID NO: 293930 - protein, 16 aa, Mycobacterium
VPPGPGPGLGTPPPPR

SEQ ID NO: 293931 - protein, 6 aa, Mycobacterium
VPPGRP

SEQ ID NO: 293932 - protein, 9 aa, Mycobacterium
VPPGSTDTL

SEQ ID NO: 293933 - protein, 14 aa, Mycobacterium
VPPGTRKPRPEFQS

SEQ ID NO: 293934 - protein, 7 aa, Mycobacterium
VPPGVGG

SEQ ID NO: 293935 - protein, 27 aa, Mycobacterium
VPPGWTATATAPFKSATKWSGASYAEH

SEQ ID NO: 293936 - protein, 19 aa, Mycobacterium
VPPKDGPKWVPNPNPKGNR

SEQ ID NO: 293937 - protein, 209 aa, Mycobacterium
VPPKEVPADFTPPSLPPVAPVTPAPRTTSSAPSSAPSTEPSHTPEPSSEPPANGTTSNPGPTPTSVAPAPTQKDESSAPVTTAVTPTHETPATTAPRQTATVPPSQPVEPTTAPEPTKQHSTPTHDVPTSEAPAPRATAEPAPAEPPAKQAPAERETPPSRTAAPEPAAPTREAPAREAPTREAPSYSTATQAPSAGGGNSGGGSGGGR

SEQ ID NO: 293938 - protein, 4 aa, Mycobacterium
VPPL

SEQ ID NO: 293939 - protein, 22 aa, Mycobacterium
VPPLPGQRVDTGAHPSTKEDAD

SEQ ID NO: 293940 - protein, 6 aa, Mycobacterium
VPPLSE

SEQ ID NO: 293941 - protein, 4 aa, Mycobacterium
VPPN

SEQ ID NO: 293942 - protein, 5 aa, Mycobacterium
VPPNE

SEQ ID NO: 293943 - protein, 14 aa, Mycobacterium
VPPNTLGPPPPPLP

SEQ ID NO: 293944 - protein, 82 aa, Mycobacterium
VPPPASAARAPSAAPAPTSVAPPPPPPRPVATATTTVAPPVTTTKTTVPPTTAATTTPTTTPPPTTTAPPTTTAPPSTTSTV

SEQ ID NO: 293945 - protein, 7 aa, Mycobacterium
VPPPEAR

SEQ ID NO: 293946 - protein, 6 aa, Mycobacterium
VPPPEP

SEQ ID NO: 293947 - protein, 8 aa, Mycobacterium
VPPPKPGT

SEQ ID NO: 293948 - protein, 21 aa, Mycobacterium
VPPPNNAASEPEVAPDTSRPV

SEQ ID NO: 293949 - protein, 10 aa, Mycobacterium
VPPPPLKSRR

SEQ ID NO: 293950 - protein, 16 aa, Mycobacterium
VPPPPPPVTPTTPPLA

SEQ ID NO: 293951 - protein, 13 aa, Mycobacterium
VPPPPPTPENPLP

SEQ ID NO: 293952 - protein, 36 aa, Mycobacterium
VPPPPTDPTGPSAPSIPAPPTDPSGPTGAKPSAAGL

SEQ ID NO: 293953 - protein, 7 aa, Mycobacterium
VPPPPVA

SEQ ID NO: 293954 - protein, 13 aa, Mycobacterium
VPPPPVDTNSGRL

SEQ ID NO: 293955 - protein, 65 aa, Mycobacterium
VPPPPVEQPAEPPAETPPPTTEAPPPTSEAPPTTEAPTTTEAPTTTEAPTSTPPRWSPTAPYPTI

SEQ ID NO: 293956 - protein, 21 aa, Mycobacterium
VPPPPVPNGPPAPAPTGGGEV

SEQ ID NO: 293957 - protein, 7 aa, Mycobacterium
VPPPQQV

SEQ ID NO: 293958 - protein, 7 aa, Mycobacterium
VPPPRLG

SEQ ID NO: 293959 - protein, 9 aa, Mycobacterium
VPPPRRATA

SEQ ID NO: 293960 - protein, 5 aa, Mycobacterium
VPPQI

SEQ ID NO: 293961 - protein, 4 aa, Mycobacterium
VPPR

SEQ ID NO: 293962 - protein, 13 aa, Mycobacterium
VPPRPSRAAGVGA

SEQ ID NO: 293963 - protein, 5 aa, Mycobacterium
VPPSF

SEQ ID NO: 293964 - protein, 6 aa, Mycobacterium
VPPSPG

SEQ ID NO: 293965 - protein, 15 aa, Mycobacterium
VPPSTRWQGNPISPW

SEQ ID NO: 293966 - protein, 5 aa, Mycobacterium
VPPSW

SEQ ID NO: 293967 - protein, 15 aa, Mycobacterium
VPPTAIPQETGSVHG

SEQ ID NO: 293968 - protein, 11 aa, Mycobacterium
VPPTAQGSARI

SEQ ID NO: 293969 - protein, 18 aa, Mycobacterium
VPPTGPTQLSAAKSAALQ

SEQ ID NO: 293970 - protein, 13 aa, Mycobacterium
VPPTGPVEEPAGG

SEQ ID NO: 293971 - protein, 7 aa, Mycobacterium
VPPTPPV

SEQ ID NO: 293972 - protein, 14 aa, Mycobacterium
VPPTTGSVERPAGV

SEQ ID NO: 293973 - protein, 11 aa, Mycobacterium
VPPTTPSPLGT

SEQ ID NO: 293974 - protein, 4 aa, Mycobacterium
VPPV

SEQ ID NO: 293975 - protein, 6 aa, Mycobacterium
VPPVAG

SEQ ID NO: 293976 - protein, 8 aa, Mycobacterium
VPPVTANA

SEQ ID NO: 293977 - protein, 10 aa, Mycobacterium
VPPYGDSNPT

SEQ ID NO: 293978 - protein, 11 aa, Mycobacterium
VPQAGAPSTWV

SEQ ID NO: 293979 - protein, 7 aa, Mycobacterium
VPQAGPG

SEQ ID NO: 293980 - protein, 14 aa, Mycobacterium
VPQASAVRSGIPKG

SEQ ID NO: 293981 - protein, 6 aa, Mycobacterium
VPQDGR

SEQ ID NO: 293982 - protein, 6 aa, Mycobacterium
VPQHES

SEQ ID NO: 293983 - protein, 5 aa, Mycobacterium
VPQLG

SEQ ID NO: 293984 - protein, 8 aa, Mycobacterium
VPQNASAS

SEQ ID NO: 293985 - protein, 8 aa, Mycobacterium
VPQPKSDH

SEQ ID NO: 293986 - protein, 6 aa, Mycobacterium
VPQPPS

SEQ ID NO: 293987 - protein, 7 aa, Mycobacterium
VPQPPSV

SEQ ID NO: 293988 - protein, 124 aa, Mycobacterium
VPQPTQETVAPLPTQQTVAPQPTIAPQPTQQAPEPPSGGSSGGSSGGGSSSGGGSSSGGGSSSGGGSSSGGGSSSGGGSSSGGGSSSGGGSSSGGGSSSGGGSSSGRGSSSGGSSSGGHSSGGG

SEQ ID NO: 293989 - protein, 15 aa, Mycobacterium
VPQQAAGTIRESPAA

SEQ ID NO: 293990 - protein, 10 aa, Mycobacterium
VPQRKGPAIR

SEQ ID NO: 293991 - protein, 6 aa, Mycobacterium
VPQSPT

SEQ ID NO: 293992 - protein, 6 aa, Mycobacterium
VPRGAT

SEQ ID NO: 293993 - protein, 8 aa, Mycobacterium
VPRGTTTA

SEQ ID NO: 293994 - protein, 6 aa, Mycobacterium
VPRHTR

SEQ ID NO: 293995 - protein, 4 aa, Mycobacterium
VPRN

SEQ ID NO: 293996 - protein, 12 aa, Mycobacterium
VPRPDGAPVGEH

SEQ ID NO: 293997 - protein, 8 aa, Mycobacterium
VPRPGFPD

SEQ ID NO: 293998 - protein, 9 aa, Mycobacterium
VPRPRPDHA

SEQ ID NO: 293999 - protein, 7 aa, Mycobacterium
VPRPTAT

SEQ ID NO: 294000 - protein, 8 aa, Mycobacterium
VPRPTRGN

SEQ ID NO: 294001 - protein, 7 aa, Mycobacterium
VPRPTST

SEQ ID NO: 294002 - protein, 8 aa, Mycobacterium
VPRPTTVT

SEQ ID NO: 294003 - protein, 6 aa, Mycobacterium
VPRPTV

SEQ ID NO: 294004 - protein, 4 aa, Mycobacterium
VPRR

SEQ ID NO: 294005 - protein, 14 aa, Mycobacterium
VPRSAKSAALGRQL

SEQ ID NO: 294006 - protein, 10 aa, Mycobacterium
VPRTKSPEDV

SEQ ID NO: 294007 - protein, 5 aa, Mycobacterium
VPSAA

SEQ ID NO: 294008 - protein, 63 aa, Mycobacterium
VPSAATGQPVARRTGSPSRPLTPAPAGRDLPPGPAGPVGPPPRRPAPQGPPPPRSGQQSPNYQ

SEQ ID NO: 294009 - protein, 17 aa, Mycobacterium
VPSAAVSSYQATTPAPG

SEQ ID NO: 294010 - protein, 9 aa, Mycobacterium
VPSDSETET

SEQ ID NO: 294011 - protein, 4 aa, Mycobacterium
VPSE

SEQ ID NO: 294012 - protein, 4 aa, Mycobacterium
VPSG

SEQ ID NO: 294013 - protein, 10 aa, Mycobacterium
VPSGAPQEPL

SEQ ID NO: 294014 - protein, 7 aa, Mycobacterium
VPSGEDA

SEQ ID NO: 294015 - protein, 8 aa, Mycobacterium
VPSGNSTD

SEQ ID NO: 294016 - protein, 8 aa, Mycobacterium
VPSGPAWN

SEQ ID NO: 294017 - protein, 8 aa, Mycobacterium
VPSGPGEV

SEQ ID NO: 294018 - protein, 9 aa, Mycobacterium
VPSGPPAPR

SEQ ID NO: 294019 - protein, 9 aa, Mycobacterium
VPSGPSEPP

SEQ ID NO: 294020 - protein, 7 aa, Mycobacterium
VPSGSGL

SEQ ID NO: 294021 - protein, 6 aa, Mycobacterium
VPSGTD

SEQ ID NO: 294022 - protein, 20 aa, Mycobacterium
VPSNLDPPLADAARERVPPG

SEQ ID NO: 294023 - protein, 8 aa, Mycobacterium
VPSNLDPS

SEQ ID NO: 294024 - protein, 4 aa, Mycobacterium
VPSP

SEQ ID NO: 294025 - protein, 8 aa, Mycobacterium
VPSPDAAQ

SEQ ID NO: 294026 - protein, 9 aa, Mycobacterium
VPSPDAASL

SEQ ID NO: 294027 - protein, 10 aa, Mycobacterium
VPSPESKGQI

SEQ ID NO: 294028 - protein, 13 aa, Mycobacterium
VPSRGESLDRSGS

SEQ ID NO: 294029 - protein, 5 aa, Mycobacterium
VPSRP

SEQ ID NO: 294030 - protein, 8 aa, Mycobacterium
VPSRPTRA

SEQ ID NO: 294031 - protein, 7 aa, Mycobacterium
VPSSGRV

SEQ ID NO: 294032 - protein, 34 aa, Mycobacterium
VPSSQAPTAEPAPARQEAAQIPPPPSTAETIKPP

SEQ ID NO: 294033 - protein, 26 aa, Mycobacterium
VPSTGDAPAEPPPSPEPPPPPQTHTV

SEQ ID NO: 294034 - protein, 8 aa, Mycobacterium
VPSTGTEV

SEQ ID NO: 294035 - protein, 8 aa, Mycobacterium
VPSTGTKV

SEQ ID NO: 294036 - protein, 7 aa, Mycobacterium
VPSTLDG

SEQ ID NO: 294037 - protein, 30 aa, Mycobacterium
VPSTPPPAPSGAPSAAPSGLGRAAARPGPS

SEQ ID NO: 294038 - protein, 4 aa, Mycobacterium
VPSV

SEQ ID NO: 294039 - protein, 5 aa, Mycobacterium
VPSVP

SEQ ID NO: 294040 - protein, 7 aa, Mycobacterium
VPTADGK

SEQ ID NO: 294041 - protein, 7 aa, Mycobacterium
VPTAEGK

SEQ ID NO: 294042 - protein, 5 aa, Mycobacterium
VPTAG

SEQ ID NO: 294043 - protein, 8 aa, Mycobacterium
VPTANGKK

SEQ ID NO: 294044 - protein, 12 aa, Mycobacterium
VPTDELSQSSGP

SEQ ID NO: 294045 - protein, 12 aa, Mycobacterium
VPTDPADGSVDA

SEQ ID NO: 294046 - protein, 11 aa, Mycobacterium
VPTDPAERSVD

SEQ ID NO: 294047 - protein, 6 aa, Mycobacterium
VPTDPR

SEQ ID NO: 294048 - protein, 10 aa, Mycobacterium
VPTDSPEEIH

SEQ ID NO: 294049 - protein, 15 aa, Mycobacterium
VPTEGSAADPQPPID

SEQ ID NO: 294050 - protein, 8 aa, Mycobacterium
VPTEHSGL

SEQ ID NO: 294051 - protein, 15 aa, Mycobacterium
VPTERGHVPEREEVS

SEQ ID NO: 294052 - protein, 5 aa, Mycobacterium
VPTEV

SEQ ID NO: 294053 - protein, 4 aa, Mycobacterium
VPTG

SEQ ID NO: 294054 - protein, 6 aa, Mycobacterium
VPTGAD

SEQ ID NO: 294055 - protein, 6 aa, Mycobacterium
VPTGGV

SEQ ID NO: 294056 - protein, 9 aa, Mycobacterium
VPTGPAAPG

SEQ ID NO: 294057 - protein, 6 aa, Mycobacterium
VPTGRS

SEQ ID NO: 294058 - protein, 5 aa, Mycobacterium
VPTGT

SEQ ID NO: 294059 - protein, 30 aa, Mycobacterium
VPTGTASAHATRVASDPAENAELARPPARV

SEQ ID NO: 294060 - protein, 10 aa, Mycobacterium
VPTGTGAAVP

SEQ ID NO: 294061 - protein, 8 aa, Mycobacterium
VPTGTGTF

SEQ ID NO: 294062 - protein, 7 aa, Mycobacterium
VPTHHDG

SEQ ID NO: 294063 - protein, 6 aa, Mycobacterium
VPTPAG

SEQ ID NO: 294064 - protein, 17 aa, Mycobacterium
VPTPGGTEIRDNRSING

SEQ ID NO: 294065 - protein, 7 aa, Mycobacterium
VPTPGPS

SEQ ID NO: 294066 - protein, 19 aa, Mycobacterium
VPTPHQQPGPAPDEGSESK

SEQ ID NO: 294067 - protein, 8 aa, Mycobacterium
VPTPRPDH

SEQ ID NO: 294068 - protein, 9 aa, Mycobacterium
VPTPYGGPQ

SEQ ID NO: 294069 - protein, 15 aa, Mycobacterium
VPTPYGGPTLPIEPP

SEQ ID NO: 294070 - protein, 4 aa, Mycobacterium
VPTR

SEQ ID NO: 294071 - protein, 4 aa, Mycobacterium
VPTS

SEQ ID NO: 294072 - protein, 7 aa, Mycobacterium
VPTTPEG

SEQ ID NO: 294073 - protein, 5 aa, Mycobacterium
VPTTT

SEQ ID NO: 294074 - protein, 13 aa, Mycobacterium
VPTTTLSGAPFPD

SEQ ID NO: 294075 - protein, 47 aa, Mycobacterium
VPVAPTKPAALDAAPSQTGAEPPDPDSSLPRADATPGASRRRRRQVS

SEQ ID NO: 294076 - protein, 9 aa, Mycobacterium
VPVPNGRDE

SEQ ID NO: 294077 - protein, 5 aa, Mycobacterium
VPVPR

SEQ ID NO: 294078 - protein, 6 aa, Mycobacterium
VPVPSG

SEQ ID NO: 294079 - protein, 7 aa, Mycobacterium
VPVSGSS

SEQ ID NO: 294080 - protein, 11 aa, Mycobacterium
VPVSPSRPLPK

SEQ ID NO: 294081 - protein, 7 aa, Mycobacterium
VQAAGGT

SEQ ID NO: 294082 - protein, 14 aa, Mycobacterium
VQAIPGAGLTGRLD

SEQ ID NO: 294083 - protein, 8 aa, Mycobacterium
VQANQADG

SEQ ID NO: 294084 - protein, 7 aa, Mycobacterium
VQAPAAE

SEQ ID NO: 294085 - protein, 8 aa, Mycobacterium
VQAPPGVT

SEQ ID NO: 294086 - protein, 12 aa, Mycobacterium
VQARASARRDAA

SEQ ID NO: 294087 - protein, 46 aa, Mycobacterium
VQASSYRDNARAEGRKAVEDARARAEQEVASTLQTANEQLKRERDA

SEQ ID NO: 294088 - protein, 5 aa, Mycobacterium
VQATP

SEQ ID NO: 294089 - protein, 17 aa, Mycobacterium
VQATTSAKRRRADVDAR

SEQ ID NO: 294090 - protein, 21 aa, Mycobacterium
VQCRSDTGLTVNGKPLKEPYL

SEQ ID NO: 294091 - protein, 7 aa, Mycobacterium
VQDDAGI

SEQ ID NO: 294092 - protein, 6 aa, Mycobacterium
VQDPEL

SEQ ID NO: 294093 - protein, 7 aa, Mycobacterium
VQDQTGH

SEQ ID NO: 294094 - protein, 34 aa, Mycobacterium
VQDRAPDGAACGGCGSVPATGRELSPDEQSRRER

SEQ ID NO: 294095 - protein, 10 aa, Mycobacterium
VQEDGGIRSA

SEQ ID NO: 294096 - protein, 10 aa, Mycobacterium
VQENGGIRSA

SEQ ID NO: 294097 - protein, 10 aa, Mycobacterium
VQEPRSALSD

SEQ ID NO: 294098 - protein, 7 aa, Mycobacterium
VQERERL

SEQ ID NO: 294099 - protein, 7 aa, Mycobacterium
VQESQAA

SEQ ID NO: 294100 - protein, 12 aa, Mycobacterium
VQESSERYEPLR

SEQ ID NO: 294101 - protein, 6 aa, Mycobacterium
VQESYG

SEQ ID NO: 294102 - protein, 8 aa, Mycobacterium
VQETQDRW

SEQ ID NO: 294103 - protein, 4 aa, Mycobacterium
VQGE

SEQ ID NO: 294104 - protein, 24 aa, Mycobacterium
VQGEREAVAPEPSDSLEADPNSPV

SEQ ID NO: 294105 - protein, 8 aa, Mycobacterium
VQGNPNRC

SEQ ID NO: 294106 - protein, 5 aa, Mycobacterium
VQGNT

SEQ ID NO: 294107 - protein, 14 aa, Mycobacterium
VQGPAGPLAVAGSA

SEQ ID NO: 294108 - protein, 6 aa, Mycobacterium
VQGPDE

SEQ ID NO: 294109 - protein, 22 aa, Mycobacterium
VQGRRDAGHPDKEPDPDATSAA

SEQ ID NO: 294110 - protein, 10 aa, Mycobacterium
VQGSCPGGEQ

SEQ ID NO: 294111 - protein, 11 aa, Mycobacterium
VQGSPMSSTTT

SEQ ID NO: 294112 - protein, 5 aa, Mycobacterium
VQGTG

SEQ ID NO: 294113 - protein, 6 aa, Mycobacterium
VQGTGG

SEQ ID NO: 294114 - protein, 11 aa, Mycobacterium
VQGTRRDGDRG

SEQ ID NO: 294115 - protein, 5 aa, Mycobacterium
VQGVA

SEQ ID NO: 294116 - protein, 6 aa, Mycobacterium
VQGVNA

SEQ ID NO: 294117 - protein, 6 aa, Mycobacterium
VQGVTA

SEQ ID NO: 294118 - protein, 6 aa, Mycobacterium
VQHAPD

SEQ ID NO: 294119 - protein, 11 aa, Mycobacterium
VQHGATAGVAA

SEQ ID NO: 294120 - protein, 7 aa, Mycobacterium
VQHTASA

SEQ ID NO: 294121 - protein, 13 aa, Mycobacterium
VQKNTSSKVAPEK

SEQ ID NO: 294122 - protein, 10 aa, Mycobacterium
VQLPADTATL

SEQ ID NO: 294123 - protein, 8 aa, Mycobacterium
VQNSMPPS

SEQ ID NO: 294124 - protein, 13 aa, Mycobacterium
VQNTAVPDPRIDR

SEQ ID NO: 294125 - protein, 6 aa, Mycobacterium
VQNTTQ

SEQ ID NO: 294126 - protein, 5 aa, Mycobacterium
VQPAT

SEQ ID NO: 294127 - protein, 11 aa, Mycobacterium
VQPDEGIGARQ

SEQ ID NO: 294128 - protein, 24 aa, Mycobacterium
VQPDVGAERPVLGPAPARRAPGTH

SEQ ID NO: 294129 - protein, 15 aa, Mycobacterium
VQPEEREKSGSPDSF

SEQ ID NO: 294130 - protein, 17 aa, Mycobacterium
VQPGPRLPNVDAGGDFV

SEQ ID NO: 294131 - protein, 6 aa, Mycobacterium
VQPGRA

SEQ ID NO: 294132 - protein, 20 aa, Mycobacterium
VQPGSGIAPASASASDRGAA

SEQ ID NO: 294133 - protein, 9 aa, Mycobacterium
VQPGSTDRP

SEQ ID NO: 294134 - protein, 8 aa, Mycobacterium
VQPKPDQA

SEQ ID NO: 294135 - protein, 15 aa, Mycobacterium
VQPNPEQRGAPPRPP

SEQ ID NO: 294136 - protein, 6 aa, Mycobacterium
VQPPNG

SEQ ID NO: 294137 - protein, 7 aa, Mycobacterium
VQPPSGV

SEQ ID NO: 294138 - protein, 7 aa, Mycobacterium
VQPRDDT

SEQ ID NO: 294139 - protein, 16 aa, Mycobacterium
VQPRDLEQHRDSATEV

SEQ ID NO: 294140 - protein, 14 aa, Mycobacterium
VQPRPDEPGPPPHP

SEQ ID NO: 294141 - protein, 13 aa, Mycobacterium
VQPSGGGRRRRRD

SEQ ID NO: 294142 - protein, 4 aa, Mycobacterium
VQQA

SEQ ID NO: 294143 - protein, 8 aa, Mycobacterium
VQQERGDG

SEQ ID NO: 294144 - protein, 11 aa, Mycobacterium
VQQGTGPQAAV

SEQ ID NO: 294145 - protein, 38 aa, Mycobacterium
VQQPPATVTYTPTPTTTPPPPPPPPPVTTTTTTTPPFQ

SEQ ID NO: 294146 - protein, 20 aa, Mycobacterium
VQQPPKSPKSPKPPKPPKMA

SEQ ID NO: 294147 - protein, 13 aa, Mycobacterium
VQQPPRKTAEKVV

SEQ ID NO: 294148 - protein, 6 aa, Mycobacterium
VQQSGD

SEQ ID NO: 294149 - protein, 15 aa, Mycobacterium
VQQSGTDLAGEGGVE

SEQ ID NO: 294150 - protein, 7 aa, Mycobacterium
VQRGTSD

SEQ ID NO: 294151 - protein, 7 aa, Mycobacterium
VQRPTVG

SEQ ID NO: 294152 - protein, 6 aa, Mycobacterium
VQRSAT

SEQ ID NO: 294153 - protein, 5 aa, Mycobacterium
VQRTR

SEQ ID NO: 294154 - protein, 8 aa, Mycobacterium
VQSATEDK

SEQ ID NO: 294155 - protein, 8 aa, Mycobacterium
VQSATKNK

SEQ ID NO: 294156 - protein, 8 aa, Mycobacterium
VQSDRDPL

SEQ ID NO: 294157 - protein, 7 aa, Mycobacterium
VQSGAGL

SEQ ID NO: 294158 - protein, 5 aa, Mycobacterium
VQSGS

SEQ ID NO: 294159 - protein, 7 aa, Mycobacterium
VQSGSES

SEQ ID NO: 294160 - protein, 22 aa, Mycobacterium
VQSKSEGTITSSALESVDDNTA

SEQ ID NO: 294161 - protein, 12 aa, Mycobacterium
VQSMGGNGLTKE

SEQ ID NO: 294162 - protein, 7 aa, Mycobacterium
VQSNPST

SEQ ID NO: 294163 - protein, 5 aa, Mycobacterium
VQSPA

SEQ ID NO: 294164 - protein, 6 aa, Mycobacterium
VQSPPA

SEQ ID NO: 294165 - protein, 5 aa, Mycobacterium
VQSPT

SEQ ID NO: 294166 - protein, 7 aa, Mycobacterium
VQSQTTM

SEQ ID NO: 294167 - protein, 4 aa, Mycobacterium
VQSS

SEQ ID NO: 294168 - protein, 7 aa, Mycobacterium
VQSSNTV

SEQ ID NO: 294169 - protein, 8 aa, Mycobacterium
VQSTQDPK

SEQ ID NO: 294170 - protein, 7 aa, Mycobacterium
VQTAADA

SEQ ID NO: 294171 - protein, 16 aa, Mycobacterium
VQTDASINHGNSGGPL

SEQ ID NO: 294172 - protein, 5 aa, Mycobacterium
VQTSS

SEQ ID NO: 294173 - protein, 8 aa, Mycobacterium
VQTTGTTV

SEQ ID NO: 294174 - protein, 7 aa, Mycobacterium
VQYNPKR

SEQ ID NO: 294175 - protein, 11 aa, Mycobacterium
VRAAGRRGTQD

SEQ ID NO: 294176 - protein, 9 aa, Mycobacterium
VRAAGRTPL

SEQ ID NO: 294177 - protein, 24 aa, Mycobacterium
VRADRGGVAPPASASTAAEPESAL

SEQ ID NO: 294178 - protein, 5 aa, Mycobacterium
VRAES

SEQ ID NO: 294179 - protein, 9 aa, Mycobacterium
VRAGAAPQP

SEQ ID NO: 294180 - protein, 10 aa, Mycobacterium
VRAGDKAGTR

SEQ ID NO: 294181 - protein, 8 aa, Mycobacterium
VRAGEPVK

SEQ ID NO: 294182 - protein, 18 aa, Mycobacterium
VRAGESGDIEDAPDVVPT

SEQ ID NO: 294183 - protein, 18 aa, Mycobacterium
VRAGESGDIEDAPDYAPT

SEQ ID NO: 294184 - protein, 5 aa, Mycobacterium
VRAGG

SEQ ID NO: 294185 - protein, 7 aa, Mycobacterium
VRAGGEA

SEQ ID NO: 294186 - protein, 8 aa, Mycobacterium
VRAGNSAI

SEQ ID NO: 294187 - protein, 9 aa, Mycobacterium
VRAGQAPQP

SEQ ID NO: 294188 - protein, 9 aa, Mycobacterium
VRAGRAAQP

SEQ ID NO: 294189 - protein, 26 aa, Mycobacterium
VRAGRAKPLPLAPTDQPATAHAAAAP

SEQ ID NO: 294190 - protein, 8 aa, Mycobacterium
VRAGRTKP

SEQ ID NO: 294191 - protein, 8 aa, Mycobacterium
VRAGSAGI

SEQ ID NO: 294192 - protein, 11 aa, Mycobacterium
VRAQVSGASRN

SEQ ID NO: 294193 - protein, 12 aa, Mycobacterium
VRARRGTARAIH

SEQ ID NO: 294194 - protein, 18 aa, Mycobacterium
VRARTDEGIQEAGRADVR

SEQ ID NO: 294195 - protein, 5 aa, Mycobacterium
VRATY

SEQ ID NO: 294196 - protein, 12 aa, Mycobacterium
VRDADSAQSLPH

SEQ ID NO: 294197 - protein, 11 aa, Mycobacterium
VRDAEPALEDS

SEQ ID NO: 294198 - protein, 8 aa, Mycobacterium
VRDAPTGL

SEQ ID NO: 294199 - protein, 9 aa, Mycobacterium
VRDATSAQL

SEQ ID NO: 294200 - protein, 26 aa, Mycobacterium
VRDDLGGYPPVEPRPAAPAKAPEAPV

SEQ ID NO: 294201 - protein, 8 aa, Mycobacterium
VRDDPEAA

SEQ ID NO: 294202 - protein, 8 aa, Mycobacterium
VRDDPEAE

SEQ ID NO: 294203 - protein, 7 aa, Mycobacterium
VRDERER

SEQ ID NO: 294204 - protein, 5 aa, Mycobacterium
VRDGV

SEQ ID NO: 294205 - protein, 8 aa, Mycobacterium
VRDKGDGH

SEQ ID NO: 294206 - protein, 60 aa, Mycobacterium
VRDNTPLTSTPSVSSTAPTVQLTSPSESSTAVPTATEAPSEPAAPVQTSEPTYYETPTST

SEQ ID NO: 294207 - protein, 5 aa, Mycobacterium
VRDQA

SEQ ID NO: 294208 - protein, 10 aa, Mycobacterium
VRDSDDRAAV

SEQ ID NO: 294209 - protein, 6 aa, Mycobacterium
VREAAR

SEQ ID NO: 294210 - protein, 11 aa, Mycobacterium
VREAEPALEDS

SEQ ID NO: 294211 - protein, 17 aa, Mycobacterium
VREAERQRPFGRLERQE

SEQ ID NO: 294212 - protein, 8 aa, Mycobacterium
VREASAGS

SEQ ID NO: 294213 - protein, 11 aa, Mycobacterium
VREESGTDSWS

SEQ ID NO: 294214 - protein, 8 aa, Mycobacterium
VREGAEHA

SEQ ID NO: 294215 - protein, 6 aa, Mycobacterium
VREGAP

SEQ ID NO: 294216 - protein, 6 aa, Mycobacterium
VREGRA

SEQ ID NO: 294217 - protein, 5 aa, Mycobacterium
VRESG

SEQ ID NO: 294218 - protein, 7 aa, Mycobacterium
VRESGAT

SEQ ID NO: 294219 - protein, 38 aa, Mycobacterium
VRESRAEAPVEAPNKQAPNKEAANKEAPKKDSANDTAS

SEQ ID NO: 294220 - protein, 8 aa, Mycobacterium
VRETSAEA

SEQ ID NO: 294221 - protein, 4 aa, Mycobacterium
VREV

SEQ ID NO: 294222 - protein, 4 aa, Mycobacterium
VREY

SEQ ID NO: 294223 - protein, 17 aa, Mycobacterium
VRFGPTNTFKAKDGRTM

SEQ ID NO: 294224 - protein, 15 aa, Mycobacterium
VRGDFGTTVTGQPVS

SEQ ID NO: 294225 - protein, 7 aa, Mycobacterium
VRGDGSE

SEQ ID NO: 294226 - protein, 5 aa, Mycobacterium
VRGEG

SEQ ID NO: 294227 - protein, 7 aa, Mycobacterium
VRGEVGG

SEQ ID NO: 294228 - protein, 4 aa, Mycobacterium
VRGG

SEQ ID NO: 294229 - protein, 5 aa, Mycobacterium
VRGGQ

SEQ ID NO: 294230 - protein, 9 aa, Mycobacterium
VRGNAADHL

SEQ ID NO: 294231 - protein, 7 aa, Mycobacterium
VRGPALN

SEQ ID NO: 294232 - protein, 12 aa, Mycobacterium
VRGPEGADPASV

SEQ ID NO: 294233 - protein, 11 aa, Mycobacterium
VRGPGSGTSDS

SEQ ID NO: 294234 - protein, 20 aa, Mycobacterium
VRGPGSSRGWRAAKPTPRDD

SEQ ID NO: 294235 - protein, 8 aa, Mycobacterium
VRGPRDAA

SEQ ID NO: 294236 - protein, 9 aa, Mycobacterium
VRGQASADA

SEQ ID NO: 294237 - protein, 6 aa, Mycobacterium
VRGSAG

SEQ ID NO: 294238 - protein, 6 aa, Mycobacterium
VRGSEG

SEQ ID NO: 294239 - protein, 12 aa, Mycobacterium
VRHGDTSPRSDV

SEQ ID NO: 294240 - protein, 7 aa, Mycobacterium
VRIPEAS

SEQ ID NO: 294241 - protein, 9 aa, Mycobacterium
VRKGGVEQR

SEQ ID NO: 294242 - protein, 9 aa, Mycobacterium
VRKPDGSPL

SEQ ID NO: 294243 - protein, 12 aa, Mycobacterium
VRKQRKKKRRAN

SEQ ID NO: 294244 - protein, 11 aa, Mycobacterium
VRLDPDGTTVR

SEQ ID NO: 294245 - protein, 5 aa, Mycobacterium
VRLGG

SEQ ID NO: 294246 - protein, 13 aa, Mycobacterium
VRLPGEEVAAGLS

SEQ ID NO: 294247 - protein, 6 aa, Mycobacterium
VRLTEG

SEQ ID NO: 294248 - protein, 9 aa, Mycobacterium
VRNPAGEEL

SEQ ID NO: 294249 - protein, 6 aa, Mycobacterium
VRNRPD

SEQ ID NO: 294250 - protein, 7 aa, Mycobacterium
VRNRPDK

SEQ ID NO: 294251 - protein, 27 aa, Mycobacterium
VRPAAPAPAPTPAPAPAPPPPPAPVVP

SEQ ID NO: 294252 - protein, 5 aa, Mycobacterium
VRPAD

SEQ ID NO: 294253 - protein, 8 aa, Mycobacterium
VRPADPDL

SEQ ID NO: 294254 - protein, 7 aa, Mycobacterium
VRPADPE

SEQ ID NO: 294255 - protein, 15 aa, Mycobacterium
VRPAGEPQPSDRLKG

SEQ ID NO: 294256 - protein, 17 aa, Mycobacterium
VRPAGQPQPSDKLKGGR

SEQ ID NO: 294257 - protein, 10 aa, Mycobacterium
VRPAPGFTPG

SEQ ID NO: 294258 - protein, 10 aa, Mycobacterium
VRPATDGQDF

SEQ ID NO: 294259 - protein, 7 aa, Mycobacterium
VRPDAAE

SEQ ID NO: 294260 - protein, 8 aa, Mycobacterium
VRPDARGT

SEQ ID NO: 294261 - protein, 20 aa, Mycobacterium
VRPDQGSHVPPIPRPPGGTV

SEQ ID NO: 294262 - protein, 8 aa, Mycobacterium
VRPDRDRY

SEQ ID NO: 294263 - protein, 7 aa, Mycobacterium
VRPEAPD

SEQ ID NO: 294264 - protein, 18 aa, Mycobacterium
VRPEDKASKVAALQQEGK

SEQ ID NO: 294265 - protein, 18 aa, Mycobacterium
VRPEDKASKVSALQQEGK

SEQ ID NO: 294266 - protein, 9 aa, Mycobacterium
VRPEDKATK

SEQ ID NO: 294267 - protein, 13 aa, Mycobacterium
VRPEKKVEADEPV

SEQ ID NO: 294268 - protein, 19 aa, Mycobacterium
VRPEPGSHVPPIPRAPDQT

SEQ ID NO: 294269 - protein, 20 aa, Mycobacterium
VRPEPGSHVPPIPRPPEQTV

SEQ ID NO: 294270 - protein, 20 aa, Mycobacterium
VRPEQGTSVPPIPPAPAGQV

SEQ ID NO: 294271 - protein, 5 aa, Mycobacterium
VRPGE

SEQ ID NO: 294272 - protein, 6 aa, Mycobacterium
VRPGPR

SEQ ID NO: 294273 - protein, 7 aa, Mycobacterium
VRPGTGY

SEQ ID NO: 294274 - protein, 10 aa, Mycobacterium
VRPPAAENES

SEQ ID NO: 294275 - protein, 7 aa, Mycobacterium
VRPPNAR

SEQ ID NO: 294276 - protein, 7 aa, Mycobacterium
VRPPNAS

SEQ ID NO: 294277 - protein, 10 aa, Mycobacterium
VRPPPRRPAH

SEQ ID NO: 294278 - protein, 7 aa, Mycobacterium
VRPPTPT

SEQ ID NO: 294279 - protein, 6 aa, Mycobacterium
VRPRAY

SEQ ID NO: 294280 - protein, 5 aa, Mycobacterium
VRPRG

SEQ ID NO: 294281 - protein, 7 aa, Mycobacterium
VRPRSSD

SEQ ID NO: 294282 - protein, 27 aa, Mycobacterium
VRPTAGERSDPRRNRHAGAQDRGPDAD

SEQ ID NO: 294283 - protein, 16 aa, Mycobacterium
VRPTGDLADADSNRSI

SEQ ID NO: 294284 - protein, 16 aa, Mycobacterium
VRPTGDLGDADSNRSI

SEQ ID NO: 294285 - protein, 46 aa, Mycobacterium
VRQADGRRGRRKGAAAQVAEGAARAEHSERGKGRTSRQSSHSPSGT

SEQ ID NO: 294286 - protein, 11 aa, Mycobacterium
VRQADSVDRRS

SEQ ID NO: 294287 - protein, 7 aa, Mycobacterium
VRQESTG

SEQ ID NO: 294288 - protein, 12 aa, Mycobacterium
VRQGNSGGPMVN

SEQ ID NO: 294289 - protein, 15 aa, Mycobacterium
VRQTESGDGLDTARP

SEQ ID NO: 294290 - protein, 11 aa, Mycobacterium
VRRASKSHHPY

SEQ ID NO: 294291 - protein, 11 aa, Mycobacterium
VRRDGGEHRLP

SEQ ID NO: 294292 - protein, 10 aa, Mycobacterium
VRRDGPGAAP

SEQ ID NO: 294293 - protein, 10 aa, Mycobacterium
VRRETASANA

SEQ ID NO: 294294 - protein, 8 aa, Mycobacterium
VRRGGREY

SEQ ID NO: 294295 - protein, 12 aa, Mycobacterium
VRRGSRGAQSGL

SEQ ID NO: 294296 - protein, 9 aa, Mycobacterium
VRRNPEHDL

SEQ ID NO: 294297 - protein, 138 aa, Mycobacterium
VRRNTRAAKDTADADEIDKDAADEDEAGEGEDATERAEDSADEPSDDTAVEASDEDADQTDDETEDATSENNDEPRAAEPESKAVEPESTAVEAESLDGADTDDSSGGKLRNRRPSNKANKGGSSRFRRRSRGGITVE

SEQ ID NO: 294298 - protein, 13 aa, Mycobacterium
VRRQSGTRAVPPE

SEQ ID NO: 294299 - protein, 12 aa, Mycobacterium
VRRQSGTRTLSP

SEQ ID NO: 294300 - protein, 10 aa, Mycobacterium
VRRTNDDGSV

SEQ ID NO: 294301 - protein, 11 aa, Mycobacterium
VRRTVDADTGW

SEQ ID NO: 294302 - protein, 4 aa, Mycobacterium
VRSA

SEQ ID NO: 294303 - protein, 8 aa, Mycobacterium
VRSAAKPL

SEQ ID NO: 294304 - protein, 5 aa, Mycobacterium
VRSAQ

SEQ ID NO: 294305 - protein, 6 aa, Mycobacterium
VRSDNG

SEQ ID NO: 294306 - protein, 27 aa, Mycobacterium
VRSDRAGSSDAADDPAWPAESPAARRR

SEQ ID NO: 294307 - protein, 5 aa, Mycobacterium
VRSDS

SEQ ID NO: 294308 - protein, 10 aa, Mycobacterium
VRSDYPPERA

SEQ ID NO: 294309 - protein, 5 aa, Mycobacterium
VRSET

SEQ ID NO: 294310 - protein, 13 aa, Mycobacterium
VRSGEISTPLGSE

SEQ ID NO: 294311 - protein, 12 aa, Mycobacterium
VRSGEITAPLGS

SEQ ID NO: 294312 - protein, 18 aa, Mycobacterium
VRSGEITTPLGSQREYRP

SEQ ID NO: 294313 - protein, 10 aa, Mycobacterium
VRSGHGAAGS

SEQ ID NO: 294314 - protein, 14 aa, Mycobacterium
VRSGQRAAAEITAL

SEQ ID NO: 294315 - protein, 14 aa, Mycobacterium
VRSGQRAAAEVAAL

SEQ ID NO: 294316 - protein, 9 aa, Mycobacterium
VRSGRGGPE

SEQ ID NO: 294317 - protein, 4 aa, Mycobacterium
VRSH

SEQ ID NO: 294318 - protein, 6 aa, Mycobacterium
VRSNGD

SEQ ID NO: 294319 - protein, 7 aa, Mycobacterium
VRSPSGE

SEQ ID NO: 294320 - protein, 8 aa, Mycobacterium
VRSPTGTQ

SEQ ID NO: 294321 - protein, 4 aa, Mycobacterium
VRSR

SEQ ID NO: 294322 - protein, 5 aa, Mycobacterium
VRSRP

SEQ ID NO: 294323 - protein, 11 aa, Mycobacterium
VRSTSSSPVPY

SEQ ID NO: 294324 - protein, 6 aa, Mycobacterium
VRTAEE

SEQ ID NO: 294325 - protein, 12 aa, Mycobacterium
VRTATAKGLSRP

SEQ ID NO: 294326 - protein, 9 aa, Mycobacterium
VRTDPGRFR

SEQ ID NO: 294327 - protein, 7 aa, Mycobacterium
VRTDPQA

SEQ ID NO: 294328 - protein, 8 aa, Mycobacterium
VRTDRGDE

SEQ ID NO: 294329 - protein, 9 aa, Mycobacterium
VRTEKDRAA

SEQ ID NO: 294330 - protein, 8 aa, Mycobacterium
VRTGPGPK

SEQ ID NO: 294331 - protein, 7 aa, Mycobacterium
VRTGPTH

SEQ ID NO: 294332 - protein, 5 aa, Mycobacterium
VRTGT

SEQ ID NO: 294333 - protein, 15 aa, Mycobacterium
VRTGTFETTQDSTSS

SEQ ID NO: 294334 - protein, 14 aa, Mycobacterium
VRTGTTGATQIHSG

SEQ ID NO: 294335 - protein, 8 aa, Mycobacterium
VRTPADAK

SEQ ID NO: 294336 - protein, 7 aa, Mycobacterium
VRTPAGD

SEQ ID NO: 294337 - protein, 7 aa, Mycobacterium
VRTPAIR

SEQ ID NO: 294338 - protein, 5 aa, Mycobacterium
VRTPD

SEQ ID NO: 294339 - protein, 6 aa, Mycobacterium
VRTPDG

SEQ ID NO: 294340 - protein, 9 aa, Mycobacterium
VRTPDRNTI

SEQ ID NO: 294341 - protein, 5 aa, Mycobacterium
VRTPG

SEQ ID NO: 294342 - protein, 7 aa, Mycobacterium
VRTRGGA

SEQ ID NO: 294343 - protein, 13 aa, Mycobacterium
VRTRPDADPQRAL

SEQ ID NO: 294344 - protein, 15 aa, Mycobacterium
VRTSGMTPNVVRIIE

SEQ ID NO: 294345 - protein, 15 aa, Mycobacterium
VRTSGMTPYVVRIIE

SEQ ID NO: 294346 - protein, 14 aa, Mycobacterium
VRTSPGATDRGSVA

SEQ ID NO: 294347 - protein, 13 aa, Mycobacterium
VRTSTRHRSAPGA

SEQ ID NO: 294348 - protein, 10 aa, Mycobacterium
VRVSKKASEW

SEQ ID NO: 294349 - protein, 8 aa, Mycobacterium
VSAADSAL

SEQ ID NO: 294350 - protein, 17 aa, Mycobacterium
VSAAGTPAHPAPSAPTI

SEQ ID NO: 294351 - protein, 12 aa, Mycobacterium
VSAATDPANPHG

SEQ ID NO: 294352 - protein, 11 aa, Mycobacterium
VSAATNPEDPH

SEQ ID NO: 294353 - protein, 12 aa, Mycobacterium
VSADEDAHRNPD

SEQ ID NO: 294354 - protein, 7 aa, Mycobacterium
VSADGNR

SEQ ID NO: 294355 - protein, 11 aa, Mycobacterium
VSADGQNLSSA

SEQ ID NO: 294356 - protein, 6 aa, Mycobacterium
VSADRS

SEQ ID NO: 294357 - protein, 26 aa, Mycobacterium
VSADSATPGVVEQPAQRPLDERVGRA

SEQ ID NO: 294358 - protein, 9 aa, Mycobacterium
VSAEERRQR

SEQ ID NO: 294359 - protein, 6 aa, Mycobacterium
VSAEGK

SEQ ID NO: 294360 - protein, 13 aa, Mycobacterium
VSAETPQPVQETL

SEQ ID NO: 294361 - protein, 6 aa, Mycobacterium
VSAGAD

SEQ ID NO: 294362 - protein, 7 aa, Mycobacterium
VSAGEFS

SEQ ID NO: 294363 - protein, 8 aa, Mycobacterium
VSAGGGTP

SEQ ID NO: 294364 - protein, 14 aa, Mycobacterium
VSAGGRLAAHGRAA

SEQ ID NO: 294365 - protein, 8 aa, Mycobacterium
VSAGNGGA

SEQ ID NO: 294366 - protein, 10 aa, Mycobacterium
VSAGPSGPIT

SEQ ID NO: 294367 - protein, 15 aa, Mycobacterium
VSAGRPAPVPGYRLV

SEQ ID NO: 294368 - protein, 6 aa, Mycobacterium
VSAGSV

SEQ ID NO: 294369 - protein, 11 aa, Mycobacterium
VSAGSVGSTAA

SEQ ID NO: 294370 - protein, 4 aa, Mycobacterium
VSAH

SEQ ID NO: 294371 - protein, 7 aa, Mycobacterium
VSALGTN

SEQ ID NO: 294372 - protein, 14 aa, Mycobacterium
VSANDPACDSDPCK

SEQ ID NO: 294373 - protein, 13 aa, Mycobacterium
VSANEGTDSVTGW

SEQ ID NO: 294374 - protein, 15 aa, Mycobacterium
VSAPGASGRLSGAGS

SEQ ID NO: 294375 - protein, 26 aa, Mycobacterium
VSAPGGTFTGGNRVGPPAGATGLAQG

SEQ ID NO: 294376 - protein, 9 aa, Mycobacterium
VSAPPPAVP

SEQ ID NO: 294377 - protein, 6 aa, Mycobacterium
VSAPRA

SEQ ID NO: 294378 - protein, 5 aa, Mycobacterium
VSAPS

SEQ ID NO: 294379 - protein, 7 aa, Mycobacterium
VSAPTGA

SEQ ID NO: 294380 - protein, 8 aa, Mycobacterium
VSAPTGTF

SEQ ID NO: 294381 - protein, 9 aa, Mycobacterium
VSAQGPEKL

SEQ ID NO: 294382 - protein, 8 aa, Mycobacterium
VSAQQRNA

SEQ ID NO: 294383 - protein, 10 aa, Mycobacterium
VSARTRRRGE

SEQ ID NO: 294384 - protein, 10 aa, Mycobacterium
VSASEKRSLG

SEQ ID NO: 294385 - protein, 33 aa, Mycobacterium
VSASGRRPARPRRRPSRPHRRPRHRPRTADRTA

SEQ ID NO: 294386 - protein, 14 aa, Mycobacterium
VSASPAGESPTGLT

SEQ ID NO: 294387 - protein, 17 aa, Mycobacterium
VSASPLGKDLAEQSGVE

SEQ ID NO: 294388 - protein, 17 aa, Mycobacterium
VSASPLGKNLAEQSGVE

SEQ ID NO: 294389 - protein, 12 aa, Mycobacterium
VSASTGRDVNED

SEQ ID NO: 294390 - protein, 9 aa, Mycobacterium
VSATDRRRA

SEQ ID NO: 294391 - protein, 5 aa, Mycobacterium
VSATG

SEQ ID NO: 294392 - protein, 5 aa, Mycobacterium
VSATQ

SEQ ID NO: 294393 - protein, 8 aa, Mycobacterium
VSATTSGL

SEQ ID NO: 294394 - protein, 4 aa, Mycobacterium
VSDA

SEQ ID NO: 294395 - protein, 11 aa, Mycobacterium
VSDAGNSVTQT

SEQ ID NO: 294396 - protein, 8 aa, Mycobacterium
VSDDGKAA

SEQ ID NO: 294397 - protein, 11 aa, Mycobacterium
VSDDGPGIDPD

SEQ ID NO: 294398 - protein, 6 aa, Mycobacterium
VSDDTQ

SEQ ID NO: 294399 - protein, 7 aa, Mycobacterium
VSDEELK

SEQ ID NO: 294400 - protein, 4 aa, Mycobacterium
VSDG

SEQ ID NO: 294401 - protein, 10 aa, Mycobacterium
VSDGSSEAAT

SEQ ID NO: 294402 - protein, 10 aa, Mycobacterium
VSDGTATAFD

SEQ ID NO: 294403 - protein, 12 aa, Mycobacterium
VSDGTATAFDPD

SEQ ID NO: 294404 - protein, 11 aa, Mycobacterium
VSDGTDTQLSD

SEQ ID NO: 294405 - protein, 10 aa, Mycobacterium
VSDPGQARTF

SEQ ID NO: 294406 - protein, 5 aa, Mycobacterium
VSDPQ

SEQ ID NO: 294407 - protein, 11 aa, Mycobacterium
VSDPRSATAQY

SEQ ID NO: 294408 - protein, 15 aa, Mycobacterium
VSDQTSSAGTAGGGG

SEQ ID NO: 294409 - protein, 9 aa, Mycobacterium
VSDRGAESM

SEQ ID NO: 294410 - protein, 7 aa, Mycobacterium
VSDSPDA

SEQ ID NO: 294411 - protein, 4 aa, Mycobacterium
VSDT

SEQ ID NO: 294412 - protein, 6 aa, Mycobacterium
VSDTEF

SEQ ID NO: 294413 - protein, 15 aa, Mycobacterium
VSDTGQADTAGTAAV

SEQ ID NO: 294414 - protein, 8 aa, Mycobacterium
VSDTQGNA

SEQ ID NO: 294415 - protein, 4 aa, Mycobacterium
VSEA

SEQ ID NO: 294416 - protein, 8 aa, Mycobacterium
VSEEPQVP

SEQ ID NO: 294417 - protein, 13 aa, Mycobacterium
VSEGAGSAPVGPV

SEQ ID NO: 294418 - protein, 16 aa, Mycobacterium
VSEGKGRALDPASLSG

SEQ ID NO: 294419 - protein, 7 aa, Mycobacterium
VSEGRTV

SEQ ID NO: 294420 - protein, 11 aa, Mycobacterium
VSEKDTERGFR

SEQ ID NO: 294421 - protein, 13 aa, Mycobacterium
VSEPGGHAAHSTG

SEQ ID NO: 294422 - protein, 6 aa, Mycobacterium
VSEPPA

SEQ ID NO: 294423 - protein, 6 aa, Mycobacterium
VSEQAS

SEQ ID NO: 294424 - protein, 10 aa, Mycobacterium
VSEQNGQPVT

SEQ ID NO: 294425 - protein, 6 aa, Mycobacterium
VSEREG

SEQ ID NO: 294426 - protein, 4 aa, Mycobacterium
VSES

SEQ ID NO: 294427 - protein, 8 aa, Mycobacterium
VSESERRA

SEQ ID NO: 294428 - protein, 9 aa, Mycobacterium
VSESERRSL

SEQ ID NO: 294429 - protein, 9 aa, Mycobacterium
VSESGPARR

SEQ ID NO: 294430 - protein, 17 aa, Mycobacterium
VSESSPVRSAASRAPEA

SEQ ID NO: 294431 - protein, 47 aa, Mycobacterium
VSESSVSAAPPTSPAPPVLSPDSGAAARTAAQDATKPPPIVPDPNDP

SEQ ID NO: 294432 - protein, 9 aa, Mycobacterium
VSEYEENGM

SEQ ID NO: 294433 - protein, 15 aa, Mycobacterium
VSFPRSDTQATTQQV

SEQ ID NO: 294434 - protein, 18 aa, Mycobacterium
VSGADNLPAGNRPARRTS

SEQ ID NO: 294435 - protein, 7 aa, Mycobacterium
VSGDALS

SEQ ID NO: 294436 - protein, 15 aa, Mycobacterium
VSGDAPALAPPARNT

SEQ ID NO: 294437 - protein, 25 aa, Mycobacterium
VSGDDDQLTLPNTAAGRASAITARK

SEQ ID NO: 294438 - protein, 27 aa, Mycobacterium
VSGDDDQLTLPNTAAGRASAITPRKEA

SEQ ID NO: 294439 - protein, 44 aa, Mycobacterium
VSGDDDQMTLPNTSAGRASAIRPRDESAKRVAPQPETPTRPRWP

SEQ ID NO: 294440 - protein, 30 aa, Mycobacterium
VSGDDDQSAPPNTAAGRASAFNPKRNAAKR

SEQ ID NO: 294441 - protein, 31 aa, Mycobacterium
VSGDDDQTAPPDTAAGRASAFNPRRNEPKRV

SEQ ID NO: 294442 - protein, 42 aa, Mycobacterium
VSGDEDQMTLPNTSAGRASAIRPRDESAKRVAPQPETPHRPR

SEQ ID NO: 294443 - protein, 9 aa, Mycobacterium
VSGDPRGLY

SEQ ID NO: 294444 - protein, 8 aa, Mycobacterium
VSGEATAR

SEQ ID NO: 294445 - protein, 4 aa, Mycobacterium
VSGF

SEQ ID NO: 294446 - protein, 14 aa, Mycobacterium
VSGGDGGPLGPRQG

SEQ ID NO: 294447 - protein, 8 aa, Mycobacterium
VSGGDSAQ

SEQ ID NO: 294448 - protein, 8 aa, Mycobacterium
VSGGESGQ

SEQ ID NO: 294449 - protein, 13 aa, Mycobacterium
VSGGGAKAVGNAV

SEQ ID NO: 294450 - protein, 8 aa, Mycobacterium
VSGGGHAN

SEQ ID NO: 294451 - protein, 8 aa, Mycobacterium
VSGGPQLG

SEQ ID NO: 294452 - protein, 4 aa, Mycobacterium
VSGL

SEQ ID NO: 294453 - protein, 4 aa, Mycobacterium
VSGP

SEQ ID NO: 294454 - protein, 7 aa, Mycobacterium
VSGPAQR

SEQ ID NO: 294455 - protein, 7 aa, Mycobacterium
VSGPESP

SEQ ID NO: 294456 - protein, 7 aa, Mycobacterium
VSGPGGN

SEQ ID NO: 294457 - protein, 35 aa, Mycobacterium
VSGPGSHPAALPAAPPVDAPTPAPARVQRQGATAV

SEQ ID NO: 294458 - protein, 24 aa, Mycobacterium
VSGPLRTDASPDKAPAAARSAQAF

SEQ ID NO: 294459 - protein, 5 aa, Mycobacterium
VSGPS

SEQ ID NO: 294460 - protein, 7 aa, Mycobacterium
VSGPTGA

SEQ ID NO: 294461 - protein, 4 aa, Mycobacterium
VSGQ

SEQ ID NO: 294462 - protein, 16 aa, Mycobacterium
VSGQNQPSSSAMPSHA

SEQ ID NO: 294463 - protein, 17 aa, Mycobacterium
VSGQNQPSTSAAPPHSK

SEQ ID NO: 294464 - protein, 17 aa, Mycobacterium
VSGQNQPSTSAAPSHGK

SEQ ID NO: 294465 - protein, 5 aa, Mycobacterium
VSGQP

SEQ ID NO: 294466 - protein, 11 aa, Mycobacterium
VSGQPLSTRMS

SEQ ID NO: 294467 - protein, 6 aa, Mycobacterium
VSGREY

SEQ ID NO: 294468 - protein, 12 aa, Mycobacterium
VSGRGSSAARGA

SEQ ID NO: 294469 - protein, 11 aa, Mycobacterium
VSGRPADLAGA

SEQ ID NO: 294470 - protein, 4 aa, Mycobacterium
VSGS

SEQ ID NO: 294471 - protein, 10 aa, Mycobacterium
VSGSLSGSTV

SEQ ID NO: 294472 - protein, 9 aa, Mycobacterium
VSGSNLRGL

SEQ ID NO: 294473 - protein, 23 aa, Mycobacterium
VSGSRDDAQPVTLNPPATPGAAP

SEQ ID NO: 294474 - protein, 24 aa, Mycobacterium
VSGSSGASPGSSASPAAAAGPDRP

SEQ ID NO: 294475 - protein, 28 aa, Mycobacterium
VSGTADDDADDPAAARRRRDRDAERLSG

SEQ ID NO: 294476 - protein, 5 aa, Mycobacterium
VSGTT

SEQ ID NO: 294477 - protein, 4 aa, Mycobacterium
VSGV

SEQ ID NO: 294478 - protein, 9 aa, Mycobacterium
VSGVASAAG

SEQ ID NO: 294479 - protein, 12 aa, Mycobacterium
VSGVSGPRTNPM

SEQ ID NO: 294480 - protein, 10 aa, Mycobacterium
VSHRARGSFP

SEQ ID NO: 294481 - protein, 6 aa, Mycobacterium
VSHREG

SEQ ID NO: 294482 - protein, 8 aa, Mycobacterium
VSKESPRT

SEQ ID NO: 294483 - protein, 5 aa, Mycobacterium
VSKHG

SEQ ID NO: 294484 - protein, 8 aa, Mycobacterium
VSKKASEW

SEQ ID NO: 294485 - protein, 7 aa, Mycobacterium
VSKKATQ

SEQ ID NO: 294486 - protein, 13 aa, Mycobacterium
VSKPEGKDAHGEE

SEQ ID NO: 294487 - protein, 13 aa, Mycobacterium
VSKPEGKDEHGEE

SEQ ID NO: 294488 - protein, 12 aa, Mycobacterium
VSKPLNSASQAA

SEQ ID NO: 294489 - protein, 18 aa, Mycobacterium
VSKPRDPTSLDARGPDQR

SEQ ID NO: 294490 - protein, 6 aa, Mycobacterium
VSKQAS

SEQ ID NO: 294491 - protein, 16 aa, Mycobacterium
VSKRTEAAIEDSDGRR

SEQ ID NO: 294492 - protein, 8 aa, Mycobacterium
VSKTASGF

SEQ ID NO: 294493 - protein, 7 aa, Mycobacterium
VSLETSG

SEQ ID NO: 294494 - protein, 12 aa, Mycobacterium
VSLGTDDDAPGL

SEQ ID NO: 294495 - protein, 6 aa, Mycobacterium
VSLPRS

SEQ ID NO: 294496 - protein, 13 aa, Mycobacterium
VSLRGDDEIPAGQ

SEQ ID NO: 294497 - protein, 6 aa, Mycobacterium
VSLSGR

SEQ ID NO: 294498 - protein, 12 aa, Mycobacterium
VSLSPKDAPSYE

SEQ ID NO: 294499 - protein, 10 aa, Mycobacterium
VSLSPNDAES

SEQ ID NO: 294500 - protein, 12 aa, Mycobacterium
VSLSPSDAPSMK

SEQ ID NO: 294501 - protein, 8 aa, Mycobacterium
VSLTPADN

SEQ ID NO: 294502 - protein, 9 aa, Mycobacterium
VSLTPDSNK

SEQ ID NO: 294503 - protein, 10 aa, Mycobacterium
VSMSPKDAPS

SEQ ID NO: 294504 - protein, 11 aa, Mycobacterium
VSMSPSDAESI

SEQ ID NO: 294505 - protein, 11 aa, Mycobacterium
VSMSPSNAPSM

SEQ ID NO: 294506 - protein, 10 aa, Mycobacterium
VSMSPTDAAS

SEQ ID NO: 294507 - protein, 7 aa, Mycobacterium
VSNAAQA

SEQ ID NO: 294508 - protein, 9 aa, Mycobacterium
VSNAKAALS

SEQ ID NO: 294509 - protein, 12 aa, Mycobacterium
VSNARAPEPRLD

SEQ ID NO: 294510 - protein, 4 aa, Mycobacterium
VSND

SEQ ID NO: 294511 - protein, 10 aa, Mycobacterium
VSNDPEDTRV

SEQ ID NO: 294512 - protein, 13 aa, Mycobacterium
VSNGAAPAPQLDR

SEQ ID NO: 294513 - protein, 10 aa, Mycobacterium
VSNPRDPGIT

SEQ ID NO: 294514 - protein, 4 aa, Mycobacterium
VSNS

SEQ ID NO: 294515 - protein, 6 aa, Mycobacterium
VSNSAH

SEQ ID NO: 294516 - protein, 11 aa, Mycobacterium
VSNSNGGSISC

SEQ ID NO: 294517 - protein, 6 aa, Mycobacterium
VSNTEN

SEQ ID NO: 294518 - protein, 5 aa, Mycobacterium
VSNTR

SEQ ID NO: 294519 - protein, 6 aa, Mycobacterium
VSPAAA

SEQ ID NO: 294520 - protein, 7 aa, Mycobacterium
VSPADLD

SEQ ID NO: 294521 - protein, 15 aa, Mycobacterium
VSPAGPHAPVGPATA

SEQ ID NO: 294522 - protein, 6 aa, Mycobacterium
VSPAHY

SEQ ID NO: 294523 - protein, 5 aa, Mycobacterium
VSPAR

SEQ ID NO: 294524 - protein, 6 aa, Mycobacterium
VSPATE

SEQ ID NO: 294525 - protein, 6 aa, Mycobacterium
VSPDEA

SEQ ID NO: 294526 - protein, 5 aa, Mycobacterium
VSPDG

SEQ ID NO: 294527 - protein, 11 aa, Mycobacterium
VSPDGSAHDPE

SEQ ID NO: 294528 - protein, 8 aa, Mycobacterium
VSPDGSVD

SEQ ID NO: 294529 - protein, 7 aa, Mycobacterium
VSPDGTR

SEQ ID NO: 294530 - protein, 5 aa, Mycobacterium
VSPDQ

SEQ ID NO: 294531 - protein, 12 aa, Mycobacterium
VSPDQWPATRAG

SEQ ID NO: 294532 - protein, 7 aa, Mycobacterium
VSPEPSN

SEQ ID NO: 294533 - protein, 8 aa, Mycobacterium
VSPEQLAD

SEQ ID NO: 294534 - protein, 7 aa, Mycobacterium
VSPERAG

SEQ ID NO: 294535 - protein, 12 aa, Mycobacterium
VSPFGESDWTTT

SEQ ID NO: 294536 - protein, 6 aa, Mycobacterium
VSPGAA

SEQ ID NO: 294537 - protein, 8 aa, Mycobacterium
VSPGAGAI

SEQ ID NO: 294538 - protein, 6 aa, Mycobacterium
VSPGTV

SEQ ID NO: 294539 - protein, 5 aa, Mycobacterium
VSPHP

SEQ ID NO: 294540 - protein, 7 aa, Mycobacterium
VSPIGSP

SEQ ID NO: 294541 - protein, 10 aa, Mycobacterium
VSPLTRPHRS

SEQ ID NO: 294542 - protein, 15 aa, Mycobacterium
VSPLTRPHRSEPGVA

SEQ ID NO: 294543 - protein, 15 aa, Mycobacterium
VSPLTRPHRSRRGVA

SEQ ID NO: 294544 - protein, 19 aa, Mycobacterium
VSPNETDATASGTEVRVAP

SEQ ID NO: 294545 - protein, 5 aa, Mycobacterium
VSPNT

SEQ ID NO: 294546 - protein, 5 aa, Mycobacterium
VSPPA

SEQ ID NO: 294547 - protein, 12 aa, Mycobacterium
VSPPAAPTGIAD

SEQ ID NO: 294548 - protein, 14 aa, Mycobacterium
VSPPEESRFQMALP

SEQ ID NO: 294549 - protein, 14 aa, Mycobacterium
VSPPEESRYQMALP

SEQ ID NO: 294550 - protein, 10 aa, Mycobacterium
VSPPKKRRRR

SEQ ID NO: 294551 - protein, 14 aa, Mycobacterium
VSPPPPQAERTTTL

SEQ ID NO: 294552 - protein, 15 aa, Mycobacterium
VSPQAGTAEVDRGEA

SEQ ID NO: 294553 - protein, 15 aa, Mycobacterium
VSPQTGTADVKRDEA

SEQ ID NO: 294554 - protein, 13 aa, Mycobacterium
VSPQTSNVEVERD

SEQ ID NO: 294555 - protein, 23 aa, Mycobacterium
VSPRGEGQLTGPIPQQRTTSAYQ

SEQ ID NO: 294556 - protein, 11 aa, Mycobacterium
VSPRPEATGEQ

SEQ ID NO: 294557 - protein, 10 aa, Mycobacterium
VSPRPEGVTG

SEQ ID NO: 294558 - protein, 7 aa, Mycobacterium
VSPRPQN

SEQ ID NO: 294559 - protein, 9 aa, Mycobacterium
VSPSGAGDV

SEQ ID NO: 294560 - protein, 8 aa, Mycobacterium
VSPSKGQA

SEQ ID NO: 294561 - protein, 23 aa, Mycobacterium
VSPSPPEPAAPGPAAAPRDPNRP

SEQ ID NO: 294562 - protein, 17 aa, Mycobacterium
VSPSPPGESRPRDPNRP

SEQ ID NO: 294563 - protein, 23 aa, Mycobacterium
VSPSPPGPSRPGPNAGPRDPNRP

SEQ ID NO: 294564 - protein, 20 aa, Mycobacterium
VSPSPPGTTRPPAPRDPNRP

SEQ ID NO: 294565 - protein, 5 aa, Mycobacterium
VSPTA

SEQ ID NO: 294566 - protein, 11 aa, Mycobacterium
VSPTLASSALR

SEQ ID NO: 294567 - protein, 6 aa, Mycobacterium
VSPTRR

SEQ ID NO: 294568 - protein, 7 aa, Mycobacterium
VSQDQPD

SEQ ID NO: 294569 - protein, 7 aa, Mycobacterium
VSQDRPD

SEQ ID NO: 294570 - protein, 10 aa, Mycobacterium
VSQEERSEIE

SEQ ID NO: 294571 - protein, 8 aa, Mycobacterium
VSQGASPQ

SEQ ID NO: 294572 - protein, 8 aa, Mycobacterium
VSQGTYRE

SEQ ID NO: 294573 - protein, 16 aa, Mycobacterium
VSQPPLRPAPTLQPDQ

SEQ ID NO: 294574 - protein, 37 aa, Mycobacterium
VSQQQPSANGQLAEAAKDAAAQAKSTVDRANNPLPRV

SEQ ID NO: 294575 - protein, 8 aa, Mycobacterium
VSRAEQPR

SEQ ID NO: 294576 - protein, 8 aa, Mycobacterium
VSRDDTTH

SEQ ID NO: 294577 - protein, 8 aa, Mycobacterium
VSRDGKSG

SEQ ID NO: 294578 - protein, 8 aa, Mycobacterium
VSRDGKTG

SEQ ID NO: 294579 - protein, 13 aa, Mycobacterium
VSREGERARNTSM

SEQ ID NO: 294580 - protein, 6 aa, Mycobacterium
VSRESL

SEQ ID NO: 294581 - protein, 4 aa, Mycobacterium
VSRG

SEQ ID NO: 294582 - protein, 13 aa, Mycobacterium
VSRGDEQAGGLTT

SEQ ID NO: 294583 - protein, 16 aa, Mycobacterium
VSRGELDAATGVPNRR

SEQ ID NO: 294584 - protein, 6 aa, Mycobacterium
VSRGQG

SEQ ID NO: 294585 - protein, 9 aa, Mycobacterium
VSRGRGQDL

SEQ ID NO: 294586 - protein, 11 aa, Mycobacterium
VSRHSSASNAA

SEQ ID NO: 294587 - protein, 9 aa, Mycobacterium
VSRPLGNGT

SEQ ID NO: 294588 - protein, 7 aa, Mycobacterium
VSRPSLR

SEQ ID NO: 294589 - protein, 8 aa, Mycobacterium
VSRPTRRD

SEQ ID NO: 294590 - protein, 4 aa, Mycobacterium
VSRR

SEQ ID NO: 294591 - protein, 5 aa, Mycobacterium
VSRSG

SEQ ID NO: 294592 - protein, 5 aa, Mycobacterium
VSRTP

SEQ ID NO: 294593 - protein, 7 aa, Mycobacterium
VSRTPEA

SEQ ID NO: 294594 - protein, 6 aa, Mycobacterium
VSRTPV

SEQ ID NO: 294595 - protein, 9 aa, Mycobacterium
VSRTTVPTD

SEQ ID NO: 294596 - protein, 5 aa, Mycobacterium
VSRVG

SEQ ID NO: 294597 - protein, 5 aa, Mycobacterium
VSSAA

SEQ ID NO: 294598 - protein, 32 aa, Mycobacterium
VSSAASDSTALPNVSPSSGPASAIDGDTSTSW

SEQ ID NO: 294599 - protein, 7 aa, Mycobacterium
VSSADDV

SEQ ID NO: 294600 - protein, 8 aa, Mycobacterium
VSSAGGHL

SEQ ID NO: 294601 - protein, 18 aa, Mycobacterium
VSSAGPAATTSPAVHQNP

SEQ ID NO: 294602 - protein, 24 aa, Mycobacterium
VSSANGDQLAASQRYRTELTGATD

SEQ ID NO: 294603 - protein, 17 aa, Mycobacterium
VSSAQSPRSKPTSPRTI

SEQ ID NO: 294604 - protein, 10 aa, Mycobacterium
VSSDPAENAV

SEQ ID NO: 294605 - protein, 5 aa, Mycobacterium
VSSEA

SEQ ID NO: 294606 - protein, 4 aa, Mycobacterium
VSSG

SEQ ID NO: 294607 - protein, 20 aa, Mycobacterium
VSSGDAAGHHGGPDHAEPAE

SEQ ID NO: 294608 - protein, 8 aa, Mycobacterium
VSSGDSAQ

SEQ ID NO: 294609 - protein, 5 aa, Mycobacterium
VSSGG

SEQ ID NO: 294610 - protein, 7 aa, Mycobacterium
VSSGGDV

SEQ ID NO: 294611 - protein, 9 aa, Mycobacterium
VSSGGQPVT

SEQ ID NO: 294612 - protein, 21 aa, Mycobacterium
VSSGPGAAQTDGPQLSAPCGS

SEQ ID NO: 294613 - protein, 7 aa, Mycobacterium
VSSGSPA

SEQ ID NO: 294614 - protein, 4 aa, Mycobacterium
VSSH

SEQ ID NO: 294615 - protein, 11 aa, Mycobacterium
VSSKSPDGKQV

SEQ ID NO: 294616 - protein, 4 aa, Mycobacterium
VSSL

SEQ ID NO: 294617 - protein, 5 aa, Mycobacterium
VSSLG

SEQ ID NO: 294618 - protein, 8 aa, Mycobacterium
VSSLRSPD

SEQ ID NO: 294619 - protein, 5 aa, Mycobacterium
VSSNA

SEQ ID NO: 294620 - protein, 13 aa, Mycobacterium
VSSNSAAVAGHVL

SEQ ID NO: 294621 - protein, 6 aa, Mycobacterium
VSSPAA

SEQ ID NO: 294622 - protein, 18 aa, Mycobacterium
VSSPATGPTIVTAVLPCG

SEQ ID NO: 294623 - protein, 6 aa, Mycobacterium
VSSPED

SEQ ID NO: 294624 - protein, 11 aa, Mycobacterium
VSSPEGAYPDS

SEQ ID NO: 294625 - protein, 7 aa, Mycobacterium
VSSPGWR

SEQ ID NO: 294626 - protein, 19 aa, Mycobacterium
VSSPPGAGTTLSVRIPLDA

SEQ ID NO: 294627 - protein, 18 aa, Mycobacterium
VSSPPTGPTIVTAVLPCG

SEQ ID NO: 294628 - protein, 7 aa, Mycobacterium
VSSQQRN

SEQ ID NO: 294629 - protein, 7 aa, Mycobacterium
VSSRDGV

SEQ ID NO: 294630 - protein, 7 aa, Mycobacterium
VSSREGV

SEQ ID NO: 294631 - protein, 16 aa, Mycobacterium
VSSRTPDGKATIESGS

SEQ ID NO: 294632 - protein, 4 aa, Mycobacterium
VSSS

SEQ ID NO: 294633 - protein, 19 aa, Mycobacterium
VSSSASRTALAAAAGARTQ

SEQ ID NO: 294634 - protein, 8 aa, Mycobacterium
VSSSGEGV

SEQ ID NO: 294635 - protein, 15 aa, Mycobacterium
VSSSRDSGAPRIDAP

SEQ ID NO: 294636 - protein, 31 aa, Mycobacterium
VSSSSSDSTAMPDVAPGASAAAAVDGDPATA

SEQ ID NO: 294637 - protein, 10 aa, Mycobacterium
VSSTADGPGN

SEQ ID NO: 294638 - protein, 6 aa, Mycobacterium
VSSTEN

SEQ ID NO: 294639 - protein, 7 aa, Mycobacterium
VSSTGGV

SEQ ID NO: 294640 - protein, 8 aa, Mycobacterium
VSSTGTQV

SEQ ID NO: 294641 - protein, 9 aa, Mycobacterium
VSTAEDGTS

SEQ ID NO: 294642 - protein, 46 aa, Mycobacterium
VSTAGASTARDQDFQPDTKPDPKSTPPPTKDSVGEADKSKNTLKPT

SEQ ID NO: 294643 - protein, 16 aa, Mycobacterium
VSTAGDEVKNPQKTMP

SEQ ID NO: 294644 - protein, 16 aa, Mycobacterium
VSTAGDEVNNPQKTMP

SEQ ID NO: 294645 - protein, 15 aa, Mycobacterium
VSTAGEEVKDPQRTM

SEQ ID NO: 294646 - protein, 7 aa, Mycobacterium
VSTASEA

SEQ ID NO: 294647 - protein, 13 aa, Mycobacterium
VSTATGHWDFIVG

SEQ ID NO: 294648 - protein, 5 aa, Mycobacterium
VSTDA

SEQ ID NO: 294649 - protein, 21 aa, Mycobacterium
VSTDADTDTPPPNTAAGRAAA

SEQ ID NO: 294650 - protein, 5 aa, Mycobacterium
VSTDQ

SEQ ID NO: 294651 - protein, 6 aa, Mycobacterium
VSTDQM

SEQ ID NO: 294652 - protein, 8 aa, Mycobacterium
VSTDRPEC

SEQ ID NO: 294653 - protein, 4 aa, Mycobacterium
VSTE

SEQ ID NO: 294654 - protein, 7 aa, Mycobacterium
VSTESGR

SEQ ID NO: 294655 - protein, 12 aa, Mycobacterium
VSTGCGPATTDV

SEQ ID NO: 294656 - protein, 7 aa, Mycobacterium
VSTGESS

SEQ ID NO: 294657 - protein, 6 aa, Mycobacterium
VSTGEV

SEQ ID NO: 294658 - protein, 8 aa, Mycobacterium
VSTGPEQA

SEQ ID NO: 294659 - protein, 12 aa, Mycobacterium
VSTGPEQREVPD

SEQ ID NO: 294660 - protein, 12 aa, Mycobacterium
VSTGQPGDNENY

SEQ ID NO: 294661 - protein, 7 aa, Mycobacterium
VSTNADL

SEQ ID NO: 294662 - protein, 13 aa, Mycobacterium
VSTNPNSARMEAS

SEQ ID NO: 294663 - protein, 10 aa, Mycobacterium
VSTPAPPASA

SEQ ID NO: 294664 - protein, 8 aa, Mycobacterium
VSTPRSYV

SEQ ID NO: 294665 - protein, 19 aa, Mycobacterium
VSTPSRLSFPSSHATSTAA

SEQ ID NO: 294666 - protein, 6 aa, Mycobacterium
VSTPTN

SEQ ID NO: 294667 - protein, 5 aa, Mycobacterium
VSTQD

SEQ ID NO: 294668 - protein, 5 aa, Mycobacterium
VSTQP

SEQ ID NO: 294669 - protein, 10 aa, Mycobacterium
VSTQPDTRRR

SEQ ID NO: 294670 - protein, 7 aa, Mycobacterium
VSTSADL

SEQ ID NO: 294671 - protein, 8 aa, Mycobacterium
VSTSADLN

SEQ ID NO: 294672 - protein, 6 aa, Mycobacterium
VSTSPD

SEQ ID NO: 294673 - protein, 10 aa, Mycobacterium
VSTSPVTKNV

SEQ ID NO: 294674 - protein, 5 aa, Mycobacterium
VSTTA

SEQ ID NO: 294675 - protein, 6 aa, Mycobacterium
VSTTEN

SEQ ID NO: 294676 - protein, 59 aa, Mycobacterium
VSTVTAPAPDPQAEPETQAPPGSEVPVPPPPTDPAGPSGPSGNGQPNLKGAAEALNSEA

SEQ ID NO: 294677 - protein, 9 aa, Mycobacterium
VSVESPANA

SEQ ID NO: 294678 - protein, 12 aa, Mycobacterium
VSVGTDDDAPGL

SEQ ID NO: 294679 - protein, 8 aa, Mycobacterium
VSVPAPSQ

SEQ ID NO: 294680 - protein, 8 aa, Mycobacterium
VSVPSART

SEQ ID NO: 294681 - protein, 6 aa, Mycobacterium
VSVTAD

SEQ ID NO: 294682 - protein, 30 aa, Mycobacterium
VSWPRGAAAGAAVDEYASSSGEYGGDALRA

SEQ ID NO: 294683 - protein, 7 aa, Mycobacterium
VSYPHPA

SEQ ID NO: 294684 - protein, 6 aa, Mycobacterium
VSYSQS

SEQ ID NO: 294685 - protein, 4 aa, Mycobacterium
VTAA

SEQ ID NO: 294686 - protein, 12 aa, Mycobacterium
VTAAAAAAPGQG

SEQ ID NO: 294687 - protein, 8 aa, Mycobacterium
VTAAAGPA

SEQ ID NO: 294688 - protein, 17 aa, Mycobacterium
VTAAGAQSTDGKAAYAQ

SEQ ID NO: 294689 - protein, 10 aa, Mycobacterium
VTAAGGAVDG

SEQ ID NO: 294690 - protein, 10 aa, Mycobacterium
VTAAISDSHG

SEQ ID NO: 294691 - protein, 5 aa, Mycobacterium
VTAAT

SEQ ID NO: 294692 - protein, 8 aa, Mycobacterium
VTADRRQQ

SEQ ID NO: 294693 - protein, 10 aa, Mycobacterium
VTAEQRGSPW

SEQ ID NO: 294694 - protein, 5 aa, Mycobacterium
VTAGA

SEQ ID NO: 294695 - protein, 13 aa, Mycobacterium
VTANAQPGNPPPR

SEQ ID NO: 294696 - protein, 6 aa, Mycobacterium
VTAPAA

SEQ ID NO: 294697 - protein, 7 aa, Mycobacterium
VTAPGDR

SEQ ID NO: 294698 - protein, 17 aa, Mycobacterium
VTAPGRSGARAEAEAAR

SEQ ID NO: 294699 - protein, 7 aa, Mycobacterium
VTAPPAA

SEQ ID NO: 294700 - protein, 11 aa, Mycobacterium
VTAPPPSGSSV

SEQ ID NO: 294701 - protein, 8 aa, Mycobacterium
VTAPSGTF

SEQ ID NO: 294702 - protein, 9 aa, Mycobacterium
VTAPSPGNL

SEQ ID NO: 294703 - protein, 11 aa, Mycobacterium
VTAPSPSGSPM

SEQ ID NO: 294704 - protein, 5 aa, Mycobacterium
VTAQT

SEQ ID NO: 294705 - protein, 9 aa, Mycobacterium
VTARDDSAA

SEQ ID NO: 294706 - protein, 6 aa, Mycobacterium
VTARRT

SEQ ID NO: 294707 - protein, 4 aa, Mycobacterium
VTAS

SEQ ID NO: 294708 - protein, 5 aa, Mycobacterium
VTASP

SEQ ID NO: 294709 - protein, 8 aa, Mycobacterium
VTASTGQA

SEQ ID NO: 294710 - protein, 5 aa, Mycobacterium
VTATA

SEQ ID NO: 294711 - protein, 15 aa, Mycobacterium
VTATEPAPAHAPSRG

SEQ ID NO: 294712 - protein, 7 aa, Mycobacterium
VTATETV

SEQ ID NO: 294713 - protein, 8 aa, Mycobacterium
VTATGVPG

SEQ ID NO: 294714 - protein, 7 aa, Mycobacterium
VTATSVA

SEQ ID NO: 294715 - protein, 6 aa, Mycobacterium
VTAVGE

SEQ ID NO: 294716 - protein, 9 aa, Mycobacterium
VTDAGFPDT

SEQ ID NO: 294717 - protein, 9 aa, Mycobacterium
VTDANQGPL

SEQ ID NO: 294718 - protein, 16 aa, Mycobacterium
VTDAPGDAESPAQPKR

SEQ ID NO: 294719 - protein, 6 aa, Mycobacterium
VTDASG

SEQ ID NO: 294720 - protein, 4 aa, Mycobacterium
VTDD

SEQ ID NO: 294721 - protein, 10 aa, Mycobacterium
VTDDAERTYL

SEQ ID NO: 294722 - protein, 6 aa, Mycobacterium
VTDDPK

SEQ ID NO: 294723 - protein, 21 aa, Mycobacterium
VTDFGPQIGQPEARRRPGGAA

SEQ ID NO: 294724 - protein, 7 aa, Mycobacterium
VTDGGKS

SEQ ID NO: 294725 - protein, 12 aa, Mycobacterium
VTDKSKESVYDG

SEQ ID NO: 294726 - protein, 11 aa, Mycobacterium
VTDKSRQPLYD

SEQ ID NO: 294727 - protein, 4 aa, Mycobacterium
VTDN

SEQ ID NO: 294728 - protein, 7 aa, Mycobacterium
VTDNPGA

SEQ ID NO: 294729 - protein, 7 aa, Mycobacterium
VTDPELK

SEQ ID NO: 294730 - protein, 7 aa, Mycobacterium
VTDPGAK

SEQ ID NO: 294731 - protein, 10 aa, Mycobacterium
VTDPGAKVTY

SEQ ID NO: 294732 - protein, 21 aa, Mycobacterium
VTDPGASPNLSDVSKQRVGGS

SEQ ID NO: 294733 - protein, 8 aa, Mycobacterium
VTDPPREY

SEQ ID NO: 294734 - protein, 4 aa, Mycobacterium
VTDQ

SEQ ID NO: 294735 - protein, 12 aa, Mycobacterium
VTDRDRGAARQA

SEQ ID NO: 294736 - protein, 10 aa, Mycobacterium
VTDSNGHSVG

SEQ ID NO: 294737 - protein, 12 aa, Mycobacterium
VTDSPTERAREL

SEQ ID NO: 294738 - protein, 7 aa, Mycobacterium
VTDSTGE

SEQ ID NO: 294739 - protein, 4 aa, Mycobacterium
VTDT

SEQ ID NO: 294740 - protein, 26 aa, Mycobacterium
VTDTRPEPPDASGLVSEDPAEPTVSR

SEQ ID NO: 294741 - protein, 14 aa, Mycobacterium
VTDTRPEPPDPDGL

SEQ ID NO: 294742 - protein, 10 aa, Mycobacterium
VTDVPDEAAA

SEQ ID NO: 294743 - protein, 16 aa, Mycobacterium
VTEEDGQYKMSKVEFV

SEQ ID NO: 294744 - protein, 15 aa, Mycobacterium
VTEGPMRAATSRTPA

SEQ ID NO: 294745 - protein, 17 aa, Mycobacterium
VTEGPTEQLWPPIENQP

SEQ ID NO: 294746 - protein, 5 aa, Mycobacterium
VTEGT

SEQ ID NO: 294747 - protein, 9 aa, Mycobacterium
VTEGTVTAT

SEQ ID NO: 294748 - protein, 4 aa, Mycobacterium
VTES

SEQ ID NO: 294749 - protein, 9 aa, Mycobacterium
VTESGNQVA

SEQ ID NO: 294750 - protein, 10 aa, Mycobacterium
VTESGPRAIG

SEQ ID NO: 294751 - protein, 13 aa, Mycobacterium
VTETAGSDKPRTV

SEQ ID NO: 294752 - protein, 158 aa, Mycobacterium
VTETEAEESEVEEPEAASADAADEAEPAEAEAPEAKVGEAEAPEVEAADAQTPEVEPSEVESEKAESQAADTEAADAADTEAADTEAEEAEAQEPAAQAQASEPDAEDTTAPKAAEEDTSGGADDQDADRDDHQDGDQAPPVPSAQTSDSTGSTRQGW

SEQ ID NO: 294753 - protein, 6 aa, Mycobacterium
VTETGY

SEQ ID NO: 294754 - protein, 6 aa, Mycobacterium
VTETPI

SEQ ID NO: 294755 - protein, 5 aa, Mycobacterium
VTGAA

SEQ ID NO: 294756 - protein, 21 aa, Mycobacterium
VTGAEAGTEGGTTPAPGINGS

SEQ ID NO: 294757 - protein, 5 aa, Mycobacterium
VTGAG

SEQ ID NO: 294758 - protein, 9 aa, Mycobacterium
VTGAGEASQ

SEQ ID NO: 294759 - protein, 6 aa, Mycobacterium
VTGAGS

SEQ ID NO: 294760 - protein, 9 aa, Mycobacterium
VTGAGSADE

SEQ ID NO: 294761 - protein, 7 aa, Mycobacterium
VTGAGTP

SEQ ID NO: 294762 - protein, 9 aa, Mycobacterium
VTGAHSPLS

SEQ ID NO: 294763 - protein, 12 aa, Mycobacterium
VTGATHNPNSEG

SEQ ID NO: 294764 - protein, 9 aa, Mycobacterium
VTGDAGSAR

SEQ ID NO: 294765 - protein, 6 aa, Mycobacterium
VTGDDA

SEQ ID NO: 294766 - protein, 8 aa, Mycobacterium
VTGDGQNL

SEQ ID NO: 294767 - protein, 15 aa, Mycobacterium
VTGDGRTVDGRDPIS

SEQ ID NO: 294768 - protein, 8 aa, Mycobacterium
VTGDTVPA

SEQ ID NO: 294769 - protein, 8 aa, Mycobacterium
VTGEPLPG

SEQ ID NO: 294770 - protein, 12 aa, Mycobacterium
VTGESAPVRRGV

SEQ ID NO: 294771 - protein, 6 aa, Mycobacterium
VTGGAA

SEQ ID NO: 294772 - protein, 11 aa, Mycobacterium
VTGGAGAPGTG

SEQ ID NO: 294773 - protein, 5 aa, Mycobacterium
VTGGL

SEQ ID NO: 294774 - protein, 8 aa, Mycobacterium
VTGGPAFG

SEQ ID NO: 294775 - protein, 7 aa, Mycobacterium
VTGGQAG

SEQ ID NO: 294776 - protein, 6 aa, Mycobacterium
VTGGRS

SEQ ID NO: 294777 - protein, 8 aa, Mycobacterium
VTGGTEPV

SEQ ID NO: 294778 - protein, 5 aa, Mycobacterium
VTGHR

SEQ ID NO: 294779 - protein, 7 aa, Mycobacterium
VTGKPRD

SEQ ID NO: 294780 - protein, 6 aa, Mycobacterium
VTGLKG

SEQ ID NO: 294781 - protein, 15 aa, Mycobacterium
VTGNAGQGPDHDYTT

SEQ ID NO: 294782 - protein, 17 aa, Mycobacterium
VTGPAALSADQHEAGDR

SEQ ID NO: 294783 - protein, 18 aa, Mycobacterium
VTGPAALSADQHEAGDRS

SEQ ID NO: 294784 - protein, 10 aa, Mycobacterium
VTGPNGSGKT

SEQ ID NO: 294785 - protein, 9 aa, Mycobacterium
VTGPPGRAA

SEQ ID NO: 294786 - protein, 19 aa, Mycobacterium
VTGPSALNADQAEAGDKSI

SEQ ID NO: 294787 - protein, 8 aa, Mycobacterium
VTGPTPKP

SEQ ID NO: 294788 - protein, 8 aa, Mycobacterium
VTGPTPRP

SEQ ID NO: 294789 - protein, 10 aa, Mycobacterium
VTGQDGQPGY

SEQ ID NO: 294790 - protein, 5 aa, Mycobacterium
VTGQP

SEQ ID NO: 294791 - protein, 11 aa, Mycobacterium
VTGRDGRSPHN

SEQ ID NO: 294792 - protein, 12 aa, Mycobacterium
VTGRPHRRDSYP

SEQ ID NO: 294793 - protein, 7 aa, Mycobacterium
VTGRQGR

SEQ ID NO: 294794 - protein, 6 aa, Mycobacterium
VTGSDV

SEQ ID NO: 294795 - protein, 8 aa, Mycobacterium
VTGSGALS

SEQ ID NO: 294796 - protein, 7 aa, Mycobacterium
VTGSGKP

SEQ ID NO: 294797 - protein, 9 aa, Mycobacterium
VTGSKAPLD

SEQ ID NO: 294798 - protein, 12 aa, Mycobacterium
VTGTDPRRGRVS

SEQ ID NO: 294799 - protein, 22 aa, Mycobacterium
VTGTEAGTEGGTTAAPGINGSR

SEQ ID NO: 294800 - protein, 23 aa, Mycobacterium
VTGTEAGTEGGTTAAPGINGSRA

SEQ ID NO: 294801 - protein, 21 aa, Mycobacterium
VTGTEPEPAPATPRATSRRSG

SEQ ID NO: 294802 - protein, 10 aa, Mycobacterium
VTGTKAPGDI

SEQ ID NO: 294803 - protein, 7 aa, Mycobacterium
VTGTTGW

SEQ ID NO: 294804 - protein, 11 aa, Mycobacterium
VTGTTRNPNTE

SEQ ID NO: 294805 - protein, 14 aa, Mycobacterium
VTGTTSPKPAAAEA

SEQ ID NO: 294806 - protein, 15 aa, Mycobacterium
VTHNGAIGGGGFTGQ

SEQ ID NO: 294807 - protein, 21 aa, Mycobacterium
VTIPENPPATTTPTTLPSGPG

SEQ ID NO: 294808 - protein, 7 aa, Mycobacterium
VTKGTVN

SEQ ID NO: 294809 - protein, 7 aa, Mycobacterium
VTKNPDA

SEQ ID NO: 294810 - protein, 15 aa, Mycobacterium
VTLRGRTEPTELAVP

SEQ ID NO: 294811 - protein, 8 aa, Mycobacterium
VTLSDGRT

SEQ ID NO: 294812 - protein, 26 aa, Mycobacterium
VTLSGTAASPDQKDAVERAAKTSWPG

SEQ ID NO: 294813 - protein, 16 aa, Mycobacterium
VTNAAADVRHDDTGRA

SEQ ID NO: 294814 - protein, 4 aa, Mycobacterium
VTND

SEQ ID NO: 294815 - protein, 8 aa, Mycobacterium
VTNGPRGL

SEQ ID NO: 294816 - protein, 7 aa, Mycobacterium
VTNGRKA

SEQ ID NO: 294817 - protein, 8 aa, Mycobacterium
VTNIGDRP

SEQ ID NO: 294818 - protein, 12 aa, Mycobacterium
VTNSAVPDPRID

SEQ ID NO: 294819 - protein, 13 aa, Mycobacterium
VTNTAAPDPRIDR

SEQ ID NO: 294820 - protein, 4 aa, Mycobacterium
VTPA

SEQ ID NO: 294821 - protein, 9 aa, Mycobacterium
VTPADSGRV

SEQ ID NO: 294822 - protein, 7 aa, Mycobacterium
VTPAERG

SEQ ID NO: 294823 - protein, 15 aa, Mycobacterium
VTPAGGGKATTIPLS

SEQ ID NO: 294824 - protein, 13 aa, Mycobacterium
VTPAGSGNATTIP

SEQ ID NO: 294825 - protein, 6 aa, Mycobacterium
VTPANA

SEQ ID NO: 294826 - protein, 5 aa, Mycobacterium
VTPDG

SEQ ID NO: 294827 - protein, 7 aa, Mycobacterium
VTPDGNS

SEQ ID NO: 294828 - protein, 7 aa, Mycobacterium
VTPDNRR

SEQ ID NO: 294829 - protein, 5 aa, Mycobacterium
VTPEE

SEQ ID NO: 294830 - protein, 23 aa, Mycobacterium
VTPESLADAAQLSSLADETPEGR

SEQ ID NO: 294831 - protein, 4 aa, Mycobacterium
VTPG

SEQ ID NO: 294832 - protein, 9 aa, Mycobacterium
VTPGAPANR

SEQ ID NO: 294833 - protein, 6 aa, Mycobacterium
VTPGET

SEQ ID NO: 294834 - protein, 7 aa, Mycobacterium
VTPGPGL

SEQ ID NO: 294835 - protein, 7 aa, Mycobacterium
VTPGQGV

SEQ ID NO: 294836 - protein, 12 aa, Mycobacterium
VTPGRGFRNGPF

SEQ ID NO: 294837 - protein, 12 aa, Mycobacterium
VTPGRGLRNGPF

SEQ ID NO: 294838 - protein, 8 aa, Mycobacterium
VTPGSDAE

SEQ ID NO: 294839 - protein, 6 aa, Mycobacterium
VTPHPR

SEQ ID NO: 294840 - protein, 18 aa, Mycobacterium
VTPKPGTGPSQKSRERGH

SEQ ID NO: 294841 - protein, 11 aa, Mycobacterium
VTPLPGGASSL

SEQ ID NO: 294842 - protein, 10 aa, Mycobacterium
VTPPDEAEVS

SEQ ID NO: 294843 - protein, 7 aa, Mycobacterium
VTPPKGV

SEQ ID NO: 294844 - protein, 13 aa, Mycobacterium
VTPPPALSPGART

SEQ ID NO: 294845 - protein, 8 aa, Mycobacterium
VTPPPAMP

SEQ ID NO: 294846 - protein, 39 aa, Mycobacterium
VTPPPPPPAPTTAAPPPATTTAAAPPPTTTTTLAGPRQV

SEQ ID NO: 294847 - protein, 44 aa, Mycobacterium
VTPPPPPPPPPETSAAPPPAATTPTTPAAAPPPTTTTPAGPRQV

SEQ ID NO: 294848 - protein, 20 aa, Mycobacterium
VTPPPTGSAELSSAKAAALQ

SEQ ID NO: 294849 - protein, 10 aa, Mycobacterium
VTPPSSPVTT

SEQ ID NO: 294850 - protein, 6 aa, Mycobacterium
VTPPTA

SEQ ID NO: 294851 - protein, 7 aa, Mycobacterium
VTPPTAL

SEQ ID NO: 294852 - protein, 12 aa, Mycobacterium
VTPPVNRSGSGG

SEQ ID NO: 294853 - protein, 8 aa, Mycobacterium
VTPQEQAR

SEQ ID NO: 294854 - protein, 9 aa, Mycobacterium
VTPQGAAKK

SEQ ID NO: 294855 - protein, 7 aa, Mycobacterium
VTPRATD

SEQ ID NO: 294856 - protein, 5 aa, Mycobacterium
VTPRP

SEQ ID NO: 294857 - protein, 10 aa, Mycobacterium
VTPRSGAAVN

SEQ ID NO: 294858 - protein, 57 aa, Mycobacterium
VTPRVRKPKPEPVRDADPDAADPDAAEFDDQADPDDQAELEDTASGDETPEPPTEEF

SEQ ID NO: 294859 - protein, 6 aa, Mycobacterium
VTPSQR

SEQ ID NO: 294860 - protein, 7 aa, Mycobacterium
VTPSRTM

SEQ ID NO: 294861 - protein, 10 aa, Mycobacterium
VTPTASTGDY

SEQ ID NO: 294862 - protein, 10 aa, Mycobacterium
VTPTESPVSL

SEQ ID NO: 294863 - protein, 5 aa, Mycobacterium
VTPTP

SEQ ID NO: 294864 - protein, 6 aa, Mycobacterium
VTPTQH

SEQ ID NO: 294865 - protein, 6 aa, Mycobacterium
VTPTSS

SEQ ID NO: 294866 - protein, 51 aa, Mycobacterium
VTPTTPTTTAPSTVTPTTPTTTAPSTVTPTTPTTTAPSTLTPTTPTTTVPS

SEQ ID NO: 294867 - protein, 12 aa, Mycobacterium
VTQAGQAAQRTA

SEQ ID NO: 294868 - protein, 10 aa, Mycobacterium
VTQGLNPQDV

SEQ ID NO: 294869 - protein, 4 aa, Mycobacterium
VTQH

SEQ ID NO: 294870 - protein, 5 aa, Mycobacterium
VTQHG

SEQ ID NO: 294871 - protein, 6 aa, Mycobacterium
VTQPGD

SEQ ID NO: 294872 - protein, 11 aa, Mycobacterium
VTQPGTNNPKA

SEQ ID NO: 294873 - protein, 10 aa, Mycobacterium
VTQPGTQDPK

SEQ ID NO: 294874 - protein, 19 aa, Mycobacterium
VTQRQERAEAFTDGAKTGV

SEQ ID NO: 294875 - protein, 22 aa, Mycobacterium
VTQSPSAGTPVNKDAKITLSFA

SEQ ID NO: 294876 - protein, 5 aa, Mycobacterium
VTQSS

SEQ ID NO: 294877 - protein, 4 aa, Mycobacterium
VTQT

SEQ ID NO: 294878 - protein, 7 aa, Mycobacterium
VTRAPEE

SEQ ID NO: 294879 - protein, 25 aa, Mycobacterium
VTRAQRRATDAQAAVGRAPKNVQNR

SEQ ID NO: 294880 - protein, 11 aa, Mycobacterium
VTRASSGLTDE

SEQ ID NO: 294881 - protein, 11 aa, Mycobacterium
VTRASSGLTEE

SEQ ID NO: 294882 - protein, 16 aa, Mycobacterium
VTRDGTTTTTPIGGAP

SEQ ID NO: 294883 - protein, 9 aa, Mycobacterium
VTRDQAERR

SEQ ID NO: 294884 - protein, 5 aa, Mycobacterium
VTRGR

SEQ ID NO: 294885 - protein, 16 aa, Mycobacterium
VTRNGLSSRIGRGRTD

SEQ ID NO: 294886 - protein, 9 aa, Mycobacterium
VTRPAAPRR

SEQ ID NO: 294887 - protein, 5 aa, Mycobacterium
VTRPE

SEQ ID NO: 294888 - protein, 7 aa, Mycobacterium
VTRPEGV

SEQ ID NO: 294889 - protein, 6 aa, Mycobacterium
VTRPGD

SEQ ID NO: 294890 - protein, 10 aa, Mycobacterium
VTRPGGEPLK

SEQ ID NO: 294891 - protein, 14 aa, Mycobacterium
VTRQRSAQEITDEQ

SEQ ID NO: 294892 - protein, 15 aa, Mycobacterium
VTRSGQQSADAQAAT

SEQ ID NO: 294893 - protein, 15 aa, Mycobacterium
VTRSGQQSADARAAT

SEQ ID NO: 294894 - protein, 5 aa, Mycobacterium
VTSAA

SEQ ID NO: 294895 - protein, 6 aa, Mycobacterium
VTSAAG

SEQ ID NO: 294896 - protein, 11 aa, Mycobacterium
VTSAISKSHGL

SEQ ID NO: 294897 - protein, 60 aa, Mycobacterium
VTSAPTSEPTPKPTPKPEAAKPVTPVPPAAPSAPPATPPAPVSRPVEPEPEPEPEPEPEA

SEQ ID NO: 294898 - protein, 11 aa, Mycobacterium
VTSATGSDLAG

SEQ ID NO: 294899 - protein, 6 aa, Mycobacterium
VTSEAN

SEQ ID NO: 294900 - protein, 5 aa, Mycobacterium
VTSEP

SEQ ID NO: 294901 - protein, 7 aa, Mycobacterium
VTSKGEI

SEQ ID NO: 294902 - protein, 11 aa, Mycobacterium
VTSKSPDGKEV

SEQ ID NO: 294903 - protein, 11 aa, Mycobacterium
VTSKSPDGKQV

SEQ ID NO: 294904 - protein, 4 aa, Mycobacterium
VTSL

SEQ ID NO: 294905 - protein, 14 aa, Mycobacterium
VTSNDKELNEESNF

SEQ ID NO: 294906 - protein, 20 aa, Mycobacterium
VTSNEDTVETQVNTARDERD

SEQ ID NO: 294907 - protein, 16 aa, Mycobacterium
VTSPAGGPTEVGMRCP

SEQ ID NO: 294908 - protein, 8 aa, Mycobacterium
VTSPQPQL

SEQ ID NO: 294909 - protein, 10 aa, Mycobacterium
VTSPQQAIDS

SEQ ID NO: 294910 - protein, 5 aa, Mycobacterium
VTSQG

SEQ ID NO: 294911 - protein, 8 aa, Mycobacterium
VTSQPPAD

SEQ ID NO: 294912 - protein, 8 aa, Mycobacterium
VTSQPPAE

SEQ ID NO: 294913 - protein, 11 aa, Mycobacterium
VTSREAAGHRT

SEQ ID NO: 294914 - protein, 7 aa, Mycobacterium
VTSRPAA

SEQ ID NO: 294915 - protein, 17 aa, Mycobacterium
VTSSARQNERARRAKEI

SEQ ID NO: 294916 - protein, 11 aa, Mycobacterium
VTSSDASVAAA

SEQ ID NO: 294917 - protein, 7 aa, Mycobacterium
VTSSGEP

SEQ ID NO: 294918 - protein, 5 aa, Mycobacterium
VTSSL

SEQ ID NO: 294919 - protein, 8 aa, Mycobacterium
VTSSPLPV

SEQ ID NO: 294920 - protein, 8 aa, Mycobacterium
VTSTDVPG

SEQ ID NO: 294921 - protein, 20 aa, Mycobacterium
VTSTEETVESQVNTARDERD

SEQ ID NO: 294922 - protein, 15 aa, Mycobacterium
VTSTGDAEAAGDTGT

SEQ ID NO: 294923 - protein, 6 aa, Mycobacterium
VTSTGE

SEQ ID NO: 294924 - protein, 7 aa, Mycobacterium
VTSTGTA

SEQ ID NO: 294925 - protein, 11 aa, Mycobacterium
VTTAGGRDSAE

SEQ ID NO: 294926 - protein, 8 aa, Mycobacterium
VTTAPGEG

SEQ ID NO: 294927 - protein, 15 aa, Mycobacterium
VTTARTFNQQKKDLD

SEQ ID NO: 294928 - protein, 15 aa, Mycobacterium
VTTARTLNEQQGDVD

SEQ ID NO: 294929 - protein, 14 aa, Mycobacterium
VTTARTTNHGQAGL

SEQ ID NO: 294930 - protein, 7 aa, Mycobacterium
VTTASGE

SEQ ID NO: 294931 - protein, 9 aa, Mycobacterium
VTTDGEVGG

SEQ ID NO: 294932 - protein, 8 aa, Mycobacterium
VTTDGRKT

SEQ ID NO: 294933 - protein, 5 aa, Mycobacterium
VTTDP

SEQ ID NO: 294934 - protein, 10 aa, Mycobacterium
VTTDPSAGTL

SEQ ID NO: 294935 - protein, 4 aa, Mycobacterium
VTTE

SEQ ID NO: 294936 - protein, 64 aa, Mycobacterium
VTTEDSAESEAAPDSTDQPEPEAAAEPEASAGSDDAAQEQAEDTEQSGDGQAVEPGVERRPSRL

SEQ ID NO: 294937 - protein, 9 aa, Mycobacterium
VTTEGQVGG

SEQ ID NO: 294938 - protein, 7 aa, Mycobacterium
VTTEGQW

SEQ ID NO: 294939 - protein, 6 aa, Mycobacterium
VTTEGV

SEQ ID NO: 294940 - protein, 11 aa, Mycobacterium
VTTEINGDYGR

SEQ ID NO: 294941 - protein, 8 aa, Mycobacterium
VTTEPQQV

SEQ ID NO: 294942 - protein, 7 aa, Mycobacterium
VTTGALG

SEQ ID NO: 294943 - protein, 10 aa, Mycobacterium
VTTGEGQRTL

SEQ ID NO: 294944 - protein, 5 aa, Mycobacterium
VTTGG

SEQ ID NO: 294945 - protein, 5 aa, Mycobacterium
VTTGR

SEQ ID NO: 294946 - protein, 7 aa, Mycobacterium
VTTGTPV

SEQ ID NO: 294947 - protein, 7 aa, Mycobacterium
VTTPDGV

SEQ ID NO: 294948 - protein, 7 aa, Mycobacterium
VTTPGPV

SEQ ID NO: 294949 - protein, 13 aa, Mycobacterium
VTTPKANRTTPEA

SEQ ID NO: 294950 - protein, 9 aa, Mycobacterium
VTTPPDPLG

SEQ ID NO: 294951 - protein, 6 aa, Mycobacterium
VTTPRL

SEQ ID NO: 294952 - protein, 12 aa, Mycobacterium
VTTPTTPPPTLT

SEQ ID NO: 294953 - protein, 7 aa, Mycobacterium
VTTRQET

SEQ ID NO: 294954 - protein, 7 aa, Mycobacterium
VTTSPLP

SEQ ID NO: 294955 - protein, 31 aa, Mycobacterium
VTTSPLPLKPASEQRPARRRSNKDREAAEES

SEQ ID NO: 294956 - protein, 57 aa, Mycobacterium
VTTSPLPLNPTSRPSSAVRRAASRGAHPGEQETTPMRASGAKIERPRESAGGRAEDA

SEQ ID NO: 294957 - protein, 6 aa, Mycobacterium
VTTSSL

SEQ ID NO: 294958 - protein, 8 aa, Mycobacterium
VTTTSDPV

SEQ ID NO: 294959 - protein, 11 aa, Mycobacterium
VTTTSDSTVTV

SEQ ID NO: 294960 - protein, 9 aa, Mycobacterium
VTTTSPPVV

SEQ ID NO: 294961 - protein, 5 aa, Mycobacterium
VTTTV

SEQ ID NO: 294962 - protein, 4 aa, Mycobacterium
VTVP

SEQ ID NO: 294963 - protein, 7 aa, Mycobacterium
VTVQAGG

SEQ ID NO: 294964 - protein, 33 aa, Mycobacterium
VTVSSSSADSTAMPDVAPATSAAAAIDGDSATA

SEQ ID NO: 294965 - protein, 10 aa, Mycobacterium
VTVTNSKGET

SEQ ID NO: 294966 - protein, 6 aa, Mycobacterium
VTVTQD

SEQ ID NO: 294967 - protein, 4 aa, Mycobacterium
VTYG

SEQ ID NO: 294968 - protein, 21 aa, Mycobacterium
VTYQSGSPKISKSGSGNVIEQ

SEQ ID NO: 294969 - protein, 8 aa, Mycobacterium
VVAPDSPH

SEQ ID NO: 294970 - protein, 49 aa, Mycobacterium
VVDDDAEDARVAQEPPEPVTDGKDEHRDVSESLDEDSPAELDALPTGEK

SEQ ID NO: 294971 - protein, 6 aa, Mycobacterium
VVEQGT

SEQ ID NO: 294972 - protein, 4 aa, Mycobacterium
VVGA

SEQ ID NO: 294973 - protein, 12 aa, Mycobacterium
VVGGASSASSNT

SEQ ID NO: 294974 - protein, 9 aa, Mycobacterium
VVGGNRQAL

SEQ ID NO: 294975 - protein, 7 aa, Mycobacterium
VVKSQGD

SEQ ID NO: 294976 - protein, 12 aa, Mycobacterium
VVPDTSQNQTTH

SEQ ID NO: 294977 - protein, 11 aa, Mycobacterium
VVPPAEHPPRP

SEQ ID NO: 294978 - protein, 10 aa, Mycobacterium
VVPPDTSDPV

SEQ ID NO: 294979 - protein, 52 aa, Mycobacterium
VVPPPVPSTPVPAAVPEEPRGPGRGPGPGPGPGKGKGHEKGHGPKGPKGPPH

SEQ ID NO: 294980 - protein, 17 aa, Mycobacterium
VVPQPEEPPPRPRSRRR

SEQ ID NO: 294981 - protein, 17 aa, Mycobacterium
VVPSDPYSIPDPDAGTD

SEQ ID NO: 294982 - protein, 18 aa, Mycobacterium
VVRESGGDRCAVTGGTTV

SEQ ID NO: 294983 - protein, 10 aa, Mycobacterium
VVRGPAAAPL

SEQ ID NO: 294984 - protein, 7 aa, Mycobacterium
VVRGPKR

SEQ ID NO: 294985 - protein, 11 aa, Mycobacterium
VVSPDASSSIG

SEQ ID NO: 294986 - protein, 7 aa, Mycobacterium
VVSPRDE

SEQ ID NO: 294987 - protein, 6 aa, Mycobacterium
VVSTET

SEQ ID NO: 294988 - protein, 19 aa, Mycobacterium
VVTGDGRHVDGRDPATGET

SEQ ID NO: 294989 - protein, 8 aa, Mycobacterium
VVTGQRGS

SEQ ID NO: 294990 - protein, 11 aa, Mycobacterium
VVTPEQAERYA

SEQ ID NO: 294991 - protein, 7 aa, Mycobacterium
VVTTGDE

SEQ ID NO: 294992 - protein, 17 aa, Mycobacterium
VYATGPGQRRETPSTGG

SEQ ID NO: 294993 - protein, 7 aa, Mycobacterium
VYEPGES

SEQ ID NO: 294994 - protein, 5 aa, Mycobacterium
VYGPK

SEQ ID NO: 294995 - protein, 7 aa, Mycobacterium
VYGQPSA

SEQ ID NO: 294996 - protein, 12 aa, Mycobacterium
VYPAGSAAEVQS

SEQ ID NO: 294997 - protein, 7 aa, Mycobacterium
VYPNQPN

SEQ ID NO: 294998 - protein, 9 aa, Mycobacterium
VYPNQPNVR

SEQ ID NO: 294999 - protein, 5 aa, Mycobacterium
VYSGD

SEQ ID NO: 295000 - protein, 11 aa, Mycobacterium
VYSYDSDGSPW

SEQ ID NO: 295001 - protein, 11 aa, Mycobacterium
VYTGSGQTSVR

SEQ ID NO: 295002 - protein, 8 aa, Mycobacterium
WAARRNRQ

SEQ ID NO: 295003 - protein, 8 aa, Mycobacterium
WADPAQDA

SEQ ID NO: 295004 - protein, 7 aa, Mycobacterium
WADPASG

SEQ ID NO: 295005 - protein, 14 aa, Mycobacterium
WADRTRNASGLGGR

SEQ ID NO: 295006 - protein, 6 aa, Mycobacterium
WAESSR

SEQ ID NO: 295007 - protein, 5 aa, Mycobacterium
WAETR

SEQ ID NO: 295008 - protein, 8 aa, Mycobacterium
WAGPSGLG

SEQ ID NO: 295009 - protein, 8 aa, Mycobacterium
WAPEHDPA

SEQ ID NO: 295010 - protein, 11 aa, Mycobacterium
WAPGAHPHEAP

SEQ ID NO: 295011 - protein, 10 aa, Mycobacterium
WAPGSHPHEA

SEQ ID NO: 295012 - protein, 11 aa, Mycobacterium
WAPGSHPHEAP

SEQ ID NO: 295013 - protein, 5 aa, Mycobacterium
WAPLG

SEQ ID NO: 295014 - protein, 6 aa, Mycobacterium
WAPRDT

SEQ ID NO: 295015 - protein, 8 aa, Mycobacterium
WARAGNAV

SEQ ID NO: 295016 - protein, 7 aa, Mycobacterium
WARDGDT

SEQ ID NO: 295017 - protein, 14 aa, Mycobacterium
WARRPGTALGPASA

SEQ ID NO: 295018 - protein, 29 aa, Mycobacterium
WASEQGSSASAGQAHPPPTPGAPPPPPAW

SEQ ID NO: 295019 - protein, 10 aa, Mycobacterium
WASGGSVATY

SEQ ID NO: 295020 - protein, 9 aa, Mycobacterium
WDDGPARVE

SEQ ID NO: 295021 - protein, 8 aa, Mycobacterium
WDEGGEQI

SEQ ID NO: 295022 - protein, 5 aa, Mycobacterium
WDETA

SEQ ID NO: 295023 - protein, 19 aa, Mycobacterium
WDGDENPAPSPDDPEGGPR

SEQ ID NO: 295024 - protein, 28 aa, Mycobacterium
WDGEGNPLAPPLTPQSTLREATDTSLAS

SEQ ID NO: 295025 - protein, 4 aa, Mycobacterium
WDPA

SEQ ID NO: 295026 - protein, 25 aa, Mycobacterium
WDPDATDDRHTDGRDGHDGHDGKEK

SEQ ID NO: 295027 - protein, 9 aa, Mycobacterium
WDPETGTYG

SEQ ID NO: 295028 - protein, 9 aa, Mycobacterium
WDPETREYG

SEQ ID NO: 295029 - protein, 8 aa, Mycobacterium
WDPSGRFT

SEQ ID NO: 295030 - protein, 10 aa, Mycobacterium
WDQAESQLAE

SEQ ID NO: 295031 - protein, 8 aa, Mycobacterium
WDQAETQL

SEQ ID NO: 295032 - protein, 11 aa, Mycobacterium
WDRSQRGETEI

SEQ ID NO: 295033 - protein, 14 aa, Mycobacterium
WDSPQEGREDGLQS

SEQ ID NO: 295034 - protein, 4 aa, Mycobacterium
WDST

SEQ ID NO: 295035 - protein, 7 aa, Mycobacterium
WEAPPPR

SEQ ID NO: 295036 - protein, 4 aa, Mycobacterium
WEDG

SEQ ID NO: 295037 - protein, 9 aa, Mycobacterium
WEERDGEGD

SEQ ID NO: 295038 - protein, 12 aa, Mycobacterium
WEESGLGETGET

SEQ ID NO: 295039 - protein, 9 aa, Mycobacterium
WEGPSAQSY

SEQ ID NO: 295040 - protein, 4 aa, Mycobacterium
WEGS

SEQ ID NO: 295041 - protein, 11 aa, Mycobacterium
WEGSGAHPHEA

SEQ ID NO: 295042 - protein, 18 aa, Mycobacterium
WEHDTADDDDTDADAVDA

SEQ ID NO: 295043 - protein, 18 aa, Mycobacterium
WEHGTGEEDTDADAVDAA

SEQ ID NO: 295044 - protein, 5 aa, Mycobacterium
WEKSQ

SEQ ID NO: 295045 - protein, 14 aa, Mycobacterium
WEPEQSPDDAKAKR

SEQ ID NO: 295046 - protein, 113 aa, Mycobacterium
WEPQRPPQQNPWNPPWDPPKQAPKPQWPGSGPGGWDPGPGRGSDNGPGRGGGDNDWNPGRGSGGPGRGDSGNSGWNPGSGGGRNGGGGGHNGGGHNGGGGGGPVWPFPFGGGH

SEQ ID NO: 295047 - protein, 17 aa, Mycobacterium
WEPSTASAAALTAGGTL

SEQ ID NO: 295048 - protein, 17 aa, Mycobacterium
WEPSTGSSAALGTGDTL

SEQ ID NO: 295049 - protein, 19 aa, Mycobacterium
WERASASRRRIRSSIVGGS

SEQ ID NO: 295050 - protein, 19 aa, Mycobacterium
WERSSRGRRRFRSPIVGGA

SEQ ID NO: 295051 - protein, 14 aa, Mycobacterium
WESAPQDDPANPLQ

SEQ ID NO: 295052 - protein, 14 aa, Mycobacterium
WESAPQDDPANPVQ

SEQ ID NO: 295053 - protein, 7 aa, Mycobacterium
WETGPLP

SEQ ID NO: 295054 - protein, 13 aa, Mycobacterium
WGAGSPQRSSEPP

SEQ ID NO: 295055 - protein, 4 aa, Mycobacterium
WGAP

SEQ ID NO: 295056 - protein, 30 aa, Mycobacterium
WGAPAPAGPSGEQPRDLVGGDRPASEAPGA

SEQ ID NO: 295057 - protein, 7 aa, Mycobacterium
WGEPGDG

SEQ ID NO: 295058 - protein, 7 aa, Mycobacterium
WGEPGEG

SEQ ID NO: 295059 - protein, 7 aa, Mycobacterium
WGEPGNG

SEQ ID NO: 295060 - protein, 14 aa, Mycobacterium
WGEPSGSPTAVSAD

SEQ ID NO: 295061 - protein, 31 aa, Mycobacterium
WGERDSGYSGYSDPAYASQTPYGPPYQPTER

SEQ ID NO: 295062 - protein, 9 aa, Mycobacterium
WGESATGAA

SEQ ID NO: 295063 - protein, 30 aa, Mycobacterium
WGGAPPPGQPAGPSTWNQGPQGPGPRGRNP

SEQ ID NO: 295064 - protein, 5 aa, Mycobacterium
WGGGG

SEQ ID NO: 295065 - protein, 6 aa, Mycobacterium
WGGSTY

SEQ ID NO: 295066 - protein, 8 aa, Mycobacterium
WGGTTYPW

SEQ ID NO: 295067 - protein, 10 aa, Mycobacterium
WGGTTYPWGS

SEQ ID NO: 295068 - protein, 10 aa, Mycobacterium
WGKGTRAEKI

SEQ ID NO: 295069 - protein, 4 aa, Mycobacterium
WGPA

SEQ ID NO: 295070 - protein, 4 aa, Mycobacterium
WGPE

SEQ ID NO: 295071 - protein, 6 aa, Mycobacterium
WGPGAV

SEQ ID NO: 295072 - protein, 12 aa, Mycobacterium
WGPGAVDSGAVV

SEQ ID NO: 295073 - protein, 5 aa, Mycobacterium
WGPGT

SEQ ID NO: 295074 - protein, 5 aa, Mycobacterium
WGPLA

SEQ ID NO: 295075 - protein, 11 aa, Mycobacterium
WGPQGADGAGT

SEQ ID NO: 295076 - protein, 9 aa, Mycobacterium
WGPQSETNA

SEQ ID NO: 295077 - protein, 5 aa, Mycobacterium
WGPSS

SEQ ID NO: 295078 - protein, 5 aa, Mycobacterium
WGPTA

SEQ ID NO: 295079 - protein, 9 aa, Mycobacterium
WGPTEEKLG

SEQ ID NO: 295080 - protein, 4 aa, Mycobacterium
WGPV

SEQ ID NO: 295081 - protein, 12 aa, Mycobacterium
WGQDGPLAQTAG

SEQ ID NO: 295082 - protein, 13 aa, Mycobacterium
WGQDGPLASTAGH

SEQ ID NO: 295083 - protein, 14 aa, Mycobacterium
WGQDGPYSDRAGHD

SEQ ID NO: 295084 - protein, 12 aa, Mycobacterium
WGQNPRGTPPQN

SEQ ID NO: 295085 - protein, 7 aa, Mycobacterium
WGRKTTL

SEQ ID NO: 295086 - protein, 7 aa, Mycobacterium
WGRSRPG

SEQ ID NO: 295087 - protein, 9 aa, Mycobacterium
WGSAARQPM

SEQ ID NO: 295088 - protein, 30 aa, Mycobacterium
WGTDPEPDPDRAPSVPAPDEDWPPGERGAS

SEQ ID NO: 295089 - protein, 18 aa, Mycobacterium
WGTDSEHGPDRPAEGGSS

SEQ ID NO: 295090 - protein, 10 aa, Mycobacterium
WHDTGDRGFV

SEQ ID NO: 295091 - protein, 5 aa, Mycobacterium
WKASA

SEQ ID NO: 295092 - protein, 38 aa, Mycobacterium
WKGDPNATLSGQGIPQLPPGSPPAVAGPPASAPPPIAA

SEQ ID NO: 295093 - protein, 38 aa, Mycobacterium
WKGDPNSTLSGQDIPQLPPGPSPPAAAGPGEAPPPPIA

SEQ ID NO: 295094 - protein, 38 aa, Mycobacterium
WKGDPNSTLSGQPIPQLPPEPPLEQSAPPGPAPPAPIA

SEQ ID NO: 295095 - protein, 8 aa, Mycobacterium
WKKRGRYA

SEQ ID NO: 295096 - protein, 17 aa, Mycobacterium
WKKSQTPSGPAKYSDNN

SEQ ID NO: 295097 - protein, 5 aa, Mycobacterium
WKPGP

SEQ ID NO: 295098 - protein, 13 aa, Mycobacterium
WKPGQEKTQEHAS

SEQ ID NO: 295099 - protein, 7 aa, Mycobacterium
WKTADPS

SEQ ID NO: 295100 - protein, 7 aa, Mycobacterium
WKTGTAG

SEQ ID NO: 295101 - protein, 6 aa, Mycobacterium
WLDSSS

SEQ ID NO: 295102 - protein, 7 aa, Mycobacterium
WNDDGSA

SEQ ID NO: 295103 - protein, 8 aa, Mycobacterium
WNDDGSAN

SEQ ID NO: 295104 - protein, 8 aa, Mycobacterium
WNDDGTAS

SEQ ID NO: 295105 - protein, 12 aa, Mycobacterium
WNKKTKDFTTNP

SEQ ID NO: 295106 - protein, 4 aa, Mycobacterium
WNNS

SEQ ID NO: 295107 - protein, 5 aa, Mycobacterium
WNNSG

SEQ ID NO: 295108 - protein, 6 aa, Mycobacterium
WNPDNS

SEQ ID NO: 295109 - protein, 12 aa, Mycobacterium
WNPDTGKYGPIY

SEQ ID NO: 295110 - protein, 18 aa, Mycobacterium
WNPEDAAAWEAGNKKIAR

SEQ ID NO: 295111 - protein, 9 aa, Mycobacterium
WNPGNTYGD

SEQ ID NO: 295112 - protein, 11 aa, Mycobacterium
WNQSARHETVT

SEQ ID NO: 295113 - protein, 9 aa, Mycobacterium
WPAADTHAT

SEQ ID NO: 295114 - protein, 9 aa, Mycobacterium
WPAEAAGRV

SEQ ID NO: 295115 - protein, 14 aa, Mycobacterium
WPAEPRVDNGPTAP

SEQ ID NO: 295116 - protein, 4 aa, Mycobacterium
WPAG

SEQ ID NO: 295117 - protein, 34 aa, Mycobacterium
WPAGTTASHRSEAAGPPVNAPAAAPAAANTAQRW

SEQ ID NO: 295118 - protein, 4 aa, Mycobacterium
WPAH

SEQ ID NO: 295119 - protein, 6 aa, Mycobacterium
WPAPAT

SEQ ID NO: 295120 - protein, 20 aa, Mycobacterium
WPAPAWSGYTAPAAPRPRRR

SEQ ID NO: 295121 - protein, 26 aa, Mycobacterium
WPAPQEAAAPEEVAPQANGRPTDTSS

SEQ ID NO: 295122 - protein, 8 aa, Mycobacterium
WPASGTSW

SEQ ID NO: 295123 - protein, 5 aa, Mycobacterium
WPASR

SEQ ID NO: 295124 - protein, 9 aa, Mycobacterium
WPDEPKYQQ

SEQ ID NO: 295125 - protein, 11 aa, Mycobacterium
WPDGSSKRPDC

SEQ ID NO: 295126 - protein, 11 aa, Mycobacterium
WPEGGVDLTGK

SEQ ID NO: 295127 - protein, 5 aa, Mycobacterium
WPEPQ

SEQ ID NO: 295128 - protein, 11 aa, Mycobacterium
WPETGHPRRAG

SEQ ID NO: 295129 - protein, 8 aa, Mycobacterium
WPGDLGER

SEQ ID NO: 295130 - protein, 23 aa, Mycobacterium
WPGPRGERSGTLETAEHAKAGGT

SEQ ID NO: 295131 - protein, 7 aa, Mycobacterium
WPGTPEG

SEQ ID NO: 295132 - protein, 8 aa, Mycobacterium
WPGTPEGL

SEQ ID NO: 295133 - protein, 9 aa, Mycobacterium
WPGTPEGLE

SEQ ID NO: 295134 - protein, 8 aa, Mycobacterium
WPGTTSAA

SEQ ID NO: 295135 - protein, 6 aa, Mycobacterium
WPHSEA

SEQ ID NO: 295136 - protein, 14 aa, Mycobacterium
WPIPGTKAEKRAER

SEQ ID NO: 295137 - protein, 5 aa, Mycobacterium
WPKPL

SEQ ID NO: 295138 - protein, 14 aa, Mycobacterium
WPKPSKAKRSRATA

SEQ ID NO: 295139 - protein, 7 aa, Mycobacterium
WPPEGAT

SEQ ID NO: 295140 - protein, 5 aa, Mycobacterium
WPPGD

SEQ ID NO: 295141 - protein, 9 aa, Mycobacterium
WPPHDQQPN

SEQ ID NO: 295142 - protein, 11 aa, Mycobacterium
WPPPGVNDNES

SEQ ID NO: 295143 - protein, 7 aa, Mycobacterium
WPPPPVQ

SEQ ID NO: 295144 - protein, 12 aa, Mycobacterium
WPPPSQPDRPPY

SEQ ID NO: 295145 - protein, 5 aa, Mycobacterium
WPPQR

SEQ ID NO: 295146 - protein, 12 aa, Mycobacterium
WPPSARAQPRTH

SEQ ID NO: 295147 - protein, 4 aa, Mycobacterium
WPPV

SEQ ID NO: 295148 - protein, 4 aa, Mycobacterium
WPQC

SEQ ID NO: 295149 - protein, 8 aa, Mycobacterium
WPQGGQFS

SEQ ID NO: 295150 - protein, 5 aa, Mycobacterium
WPQGR

SEQ ID NO: 295151 - protein, 8 aa, Mycobacterium
WPQNGTFS

SEQ ID NO: 295152 - protein, 11 aa, Mycobacterium
WPQPDDKADWE

SEQ ID NO: 295153 - protein, 18 aa, Mycobacterium
WPQPGGPGNQTQSAGTDG

SEQ ID NO: 295154 - protein, 7 aa, Mycobacterium
WPQQGRL

SEQ ID NO: 295155 - protein, 9 aa, Mycobacterium
WPQSGTLTS

SEQ ID NO: 295156 - protein, 15 aa, Mycobacterium
WPRGGGGPAYGEEMP

SEQ ID NO: 295157 - protein, 6 aa, Mycobacterium
WPSAES

SEQ ID NO: 295158 - protein, 8 aa, Mycobacterium
WPSELGDR

SEQ ID NO: 295159 - protein, 8 aa, Mycobacterium
WPSESAQT

SEQ ID NO: 295160 - protein, 45 aa, Mycobacterium
WPSPNTEPDGEIGEPDAPTVPEPAVARGAGKAGKSGRSAPAEKQE

SEQ ID NO: 295161 - protein, 8 aa, Mycobacterium
WPSPRSLN

SEQ ID NO: 295162 - protein, 7 aa, Mycobacterium
WPTESSG

SEQ ID NO: 295163 - protein, 5 aa, Mycobacterium
WPTLP

SEQ ID NO: 295164 - protein, 13 aa, Mycobacterium
WPVPGTKAEKRTE

SEQ ID NO: 295165 - protein, 6 aa, Mycobacterium
WQAAQQ

SEQ ID NO: 295166 - protein, 15 aa, Mycobacterium
WQAGEVGGKLNDAST

SEQ ID NO: 295167 - protein, 7 aa, Mycobacterium
WQGPGAE

SEQ ID NO: 295168 - protein, 11 aa, Mycobacterium
WQGPSAESYAA

SEQ ID NO: 295169 - protein, 8 aa, Mycobacterium
WQGQSARR

SEQ ID NO: 295170 - protein, 9 aa, Mycobacterium
WQGSSATQY

SEQ ID NO: 295171 - protein, 9 aa, Mycobacterium
WQGTSAQSY

SEQ ID NO: 295172 - protein, 31 aa, Mycobacterium
WQPNSGGRGGIENGRTDTSAGQRLNAATSTV

SEQ ID NO: 295173 - protein, 17 aa, Mycobacterium
WQPTAPSSPALAGGDTL

SEQ ID NO: 295174 - protein, 17 aa, Mycobacterium
WQPTTTTPAALTSGEAL

SEQ ID NO: 295175 - protein, 5 aa, Mycobacterium
WQQAQ

SEQ ID NO: 295176 - protein, 8 aa, Mycobacterium
WQQDPEVH

SEQ ID NO: 295177 - protein, 8 aa, Mycobacterium
WQQGTQTA

SEQ ID NO: 295178 - protein, 9 aa, Mycobacterium
WQQPEANEL

SEQ ID NO: 295179 - protein, 11 aa, Mycobacterium
WQRPTSLAPTG

SEQ ID NO: 295180 - protein, 8 aa, Mycobacterium
WQSPRSSN

SEQ ID NO: 295181 - protein, 9 aa, Mycobacterium
WQSRTGNKV

SEQ ID NO: 295182 - protein, 6 aa, Mycobacterium
WQTGQL

SEQ ID NO: 295183 - protein, 5 aa, Mycobacterium
WQTGS

SEQ ID NO: 295184 - protein, 14 aa, Mycobacterium
WRAPEDETTIDTPD

SEQ ID NO: 295185 - protein, 11 aa, Mycobacterium
WRAPSAKNRQP

SEQ ID NO: 295186 - protein, 4 aa, Mycobacterium
WRAR

SEQ ID NO: 295187 - protein, 14 aa, Mycobacterium
WRDGVGTRRTAAGR

SEQ ID NO: 295188 - protein, 9 aa, Mycobacterium
WRDTEDERG

SEQ ID NO: 295189 - protein, 14 aa, Mycobacterium
WREGDDDPPPPPLP

SEQ ID NO: 295190 - protein, 4 aa, Mycobacterium
WREN

SEQ ID NO: 295191 - protein, 9 aa, Mycobacterium
WRGESGWNP

SEQ ID NO: 295192 - protein, 5 aa, Mycobacterium
WRGPT

SEQ ID NO: 295193 - protein, 8 aa, Mycobacterium
WRGSNRNP

SEQ ID NO: 295194 - protein, 6 aa, Mycobacterium
WRNPSP

SEQ ID NO: 295195 - protein, 17 aa, Mycobacterium
WRPKAGADAPAAREPVA

SEQ ID NO: 295196 - protein, 12 aa, Mycobacterium
WRPPYAKRNAAV

SEQ ID NO: 295197 - protein, 4 aa, Mycobacterium
WRPT

SEQ ID NO: 295198 - protein, 11 aa, Mycobacterium
WRPTDGPGPAF

SEQ ID NO: 295199 - protein, 5 aa, Mycobacterium
WRQAG

SEQ ID NO: 295200 - protein, 6 aa, Mycobacterium
WRRGQD

SEQ ID NO: 295201 - protein, 8 aa, Mycobacterium
WRSGAPGS

SEQ ID NO: 295202 - protein, 15 aa, Mycobacterium
WRSPADTSIQPLPSG

SEQ ID NO: 295203 - protein, 15 aa, Mycobacterium
WRSPADTSIQPLPTG

SEQ ID NO: 295204 - protein, 14 aa, Mycobacterium
WRSPADTSQAPLPS

SEQ ID NO: 295205 - protein, 18 aa, Mycobacterium
WRSSAPRPGPTSPPAADA

SEQ ID NO: 295206 - protein, 6 aa, Mycobacterium
WRTDDT

SEQ ID NO: 295207 - protein, 9 aa, Mycobacterium
WRTTGSTGF

SEQ ID NO: 295208 - protein, 5 aa, Mycobacterium
WSAAS

SEQ ID NO: 295209 - protein, 8 aa, Mycobacterium
WSANSDLS

SEQ ID NO: 295210 - protein, 15 aa, Mycobacterium
WSDDRAELASAAGPA

SEQ ID NO: 295211 - protein, 9 aa, Mycobacterium
WSDGVGSRM

SEQ ID NO: 295212 - protein, 5 aa, Mycobacterium
WSGRE

SEQ ID NO: 295213 - protein, 8 aa, Mycobacterium
WSGTAAAE

SEQ ID NO: 295214 - protein, 8 aa, Mycobacterium
WSHPDPDA

SEQ ID NO: 295215 - protein, 7 aa, Mycobacterium
WSHPEPA

SEQ ID NO: 295216 - protein, 8 aa, Mycobacterium
WSHPEPAA

SEQ ID NO: 295217 - protein, 8 aa, Mycobacterium
WSHPEPEA

SEQ ID NO: 295218 - protein, 8 aa, Mycobacterium
WSKGGKEA

SEQ ID NO: 295219 - protein, 4 aa, Mycobacterium
WSNG

SEQ ID NO: 295220 - protein, 7 aa, Mycobacterium
WSPDGRP

SEQ ID NO: 295221 - protein, 6 aa, Mycobacterium
WSPESA

SEQ ID NO: 295222 - protein, 10 aa, Mycobacterium
WSPGAPAVEE

SEQ ID NO: 295223 - protein, 7 aa, Mycobacterium
WSPGTNW

SEQ ID NO: 295224 - protein, 23 aa, Mycobacterium
WSPTSFGGSPGSSDGGFMGGGGR

SEQ ID NO: 295225 - protein, 27 aa, Mycobacterium
WSPTSFGGSSGSSGDSSGGGFLGGGGR

SEQ ID NO: 295226 - protein, 17 aa, Mycobacterium
WSPTSRSEIADSTGGAA

SEQ ID NO: 295227 - protein, 17 aa, Mycobacterium
WSPTSRSEIADSTSGAA

SEQ ID NO: 295228 - protein, 17 aa, Mycobacterium
WSPTSRSEIADSVSGAT

SEQ ID NO: 295229 - protein, 30 aa, Mycobacterium
WSPVGGGAEGAGEHAADAAAPADAEHLTAG

SEQ ID NO: 295230 - protein, 6 aa, Mycobacterium
WSPYGG

SEQ ID NO: 295231 - protein, 37 aa, Mycobacterium
WSREQDVSDVRDPGPDLPDVPDIPDGRGEELAAEPAS

SEQ ID NO: 295232 - protein, 10 aa, Mycobacterium
WSRPTSITPT

SEQ ID NO: 295233 - protein, 6 aa, Mycobacterium
WSSDDA

SEQ ID NO: 295234 - protein, 19 aa, Mycobacterium
WSSGYDNRAAALTTATTEY

SEQ ID NO: 295235 - protein, 15 aa, Mycobacterium
WSSMSGQYAEAADEL

SEQ ID NO: 295236 - protein, 5 aa, Mycobacterium
WSSNI

SEQ ID NO: 295237 - protein, 10 aa, Mycobacterium
WSSPGAADPV

SEQ ID NO: 295238 - protein, 9 aa, Mycobacterium
WSSTERPLE

SEQ ID NO: 295239 - protein, 10 aa, Mycobacterium
WSSTQSQPVT

SEQ ID NO: 295240 - protein, 9 aa, Mycobacterium
WTAKPGSTL

SEQ ID NO: 295241 - protein, 7 aa, Mycobacterium
WTAPPQV

SEQ ID NO: 295242 - protein, 10 aa, Mycobacterium
WTAPPSAAAA

SEQ ID NO: 295243 - protein, 6 aa, Mycobacterium
WTDPTD

SEQ ID NO: 295244 - protein, 12 aa, Mycobacterium
WTEAGEAAGISG

SEQ ID NO: 295245 - protein, 4 aa, Mycobacterium
WTED

SEQ ID NO: 295246 - protein, 10 aa, Mycobacterium
WTESPAAARS

SEQ ID NO: 295247 - protein, 9 aa, Mycobacterium
WTGDPDKLA

SEQ ID NO: 295248 - protein, 10 aa, Mycobacterium
WTGDPDKVGA

SEQ ID NO: 295249 - protein, 39 aa, Mycobacterium
WTGGTITASSSASDSTALPNVAPGTSTAAAIDRDNATSW

SEQ ID NO: 295250 - protein, 10 aa, Mycobacterium
WTGSGDDADA

SEQ ID NO: 295251 - protein, 12 aa, Mycobacterium
WTKSGEPAGIGG

SEQ ID NO: 295252 - protein, 15 aa, Mycobacterium
WTPAPDRRPSPRTAV

SEQ ID NO: 295253 - protein, 9 aa, Mycobacterium
WTPDTGETI

SEQ ID NO: 295254 - protein, 12 aa, Mycobacterium
WTPGAPARSTPR

SEQ ID NO: 295255 - protein, 12 aa, Mycobacterium
WTPLTGATAQHV

SEQ ID NO: 295256 - protein, 4 aa, Mycobacterium
WTPS

SEQ ID NO: 295257 - protein, 4 aa, Mycobacterium
WTQD

SEQ ID NO: 295258 - protein, 7 aa, Mycobacterium
WTSEKTR

SEQ ID NO: 295259 - protein, 7 aa, Mycobacterium
WTSPPEM

SEQ ID NO: 295260 - protein, 7 aa, Mycobacterium
WTSPPQI

SEQ ID NO: 295261 - protein, 11 aa, Mycobacterium
WTSPPSAAPAL

SEQ ID NO: 295262 - protein, 7 aa, Mycobacterium
WTSPQPY

SEQ ID NO: 295263 - protein, 16 aa, Mycobacterium
WTTEGEAQEIRSKAQE

SEQ ID NO: 295264 - protein, 5 aa, Mycobacterium
WTTST

SEQ ID NO: 295265 - protein, 7 aa, Mycobacterium
WVPPGPL

SEQ ID NO: 295266 - protein, 26 aa, Mycobacterium
YAAAADDPYETDSAAAVSSKYRGPHR

SEQ ID NO: 295267 - protein, 25 aa, Mycobacterium
YAAADGDPGTSWTAPQRSVQPHTPP

SEQ ID NO: 295268 - protein, 9 aa, Mycobacterium
YAAATTTTT

SEQ ID NO: 295269 - protein, 5 aa, Mycobacterium
YAAEG

SEQ ID NO: 295270 - protein, 5 aa, Mycobacterium
YAAGA

SEQ ID NO: 295271 - protein, 9 aa, Mycobacterium
YAAGPAALT

SEQ ID NO: 295272 - protein, 21 aa, Mycobacterium
YAAPAARRTAAQHDVSSESMS

SEQ ID NO: 295273 - protein, 16 aa, Mycobacterium
YAAPEQLKGASVDGCA

SEQ ID NO: 295274 - protein, 17 aa, Mycobacterium
YAAPETIEGRPADHRSD

SEQ ID NO: 295275 - protein, 11 aa, Mycobacterium
YAAQSLAQSAR

SEQ ID NO: 295276 - protein, 11 aa, Mycobacterium
YAARGEDPDFH

SEQ ID NO: 295277 - protein, 9 aa, Mycobacterium
YAARTERDR

SEQ ID NO: 295278 - protein, 12 aa, Mycobacterium
YAASSTAPSGRQ

SEQ ID NO: 295279 - protein, 14 aa, Mycobacterium
YAATDGDPATAWTA

SEQ ID NO: 295280 - protein, 15 aa, Mycobacterium
YAATDGDPRTSWTAP

SEQ ID NO: 295281 - protein, 14 aa, Mycobacterium
YAATDGDRATSWTA

SEQ ID NO: 295282 - protein, 12 aa, Mycobacterium
YAAWGGADGRTL

SEQ ID NO: 295283 - protein, 5 aa, Mycobacterium
YADAA

SEQ ID NO: 295284 - protein, 7 aa, Mycobacterium
YADAAPD

SEQ ID NO: 295285 - protein, 18 aa, Mycobacterium
YADAGYPEDEYADDEYPD

SEQ ID NO: 295286 - protein, 5 aa, Mycobacterium
YADDP

SEQ ID NO: 295287 - protein, 5 aa, Mycobacterium
YADEN

SEQ ID NO: 295288 - protein, 26 aa, Mycobacterium
YADEPDEPDEIADSDYTDYSDSDYVD

SEQ ID NO: 295289 - protein, 10 aa, Mycobacterium
YADGDETVGT

SEQ ID NO: 295290 - protein, 5 aa, Mycobacterium
YADNP

SEQ ID NO: 295291 - protein, 12 aa, Mycobacterium
YADPAGESAGEA

SEQ ID NO: 295292 - protein, 38 aa, Mycobacterium
YADPASSGPLPQSAPTGQPGWAPASGPIPAAHQPAQVP

SEQ ID NO: 295293 - protein, 14 aa, Mycobacterium
YADPTSDSAGEAGT

SEQ ID NO: 295294 - protein, 7 aa, Mycobacterium
YADRAGN

SEQ ID NO: 295295 - protein, 6 aa, Mycobacterium
YADRYA

SEQ ID NO: 295296 - protein, 7 aa, Mycobacterium
YADRYES

SEQ ID NO: 295297 - protein, 9 aa, Mycobacterium
YAEADERSA

SEQ ID NO: 295298 - protein, 12 aa, Mycobacterium
YAEAQAAADSAK

SEQ ID NO: 295299 - protein, 12 aa, Mycobacterium
YAEAQAASANAK

SEQ ID NO: 295300 - protein, 12 aa, Mycobacterium
YAEAQAASASAK

SEQ ID NO: 295301 - protein, 12 aa, Mycobacterium
YAEAQASADAAK

SEQ ID NO: 295302 - protein, 12 aa, Mycobacterium
YAEAQASADSAK

SEQ ID NO: 295303 - protein, 7 aa, Mycobacterium
YAEGGRL

SEQ ID NO: 295304 - protein, 4 aa, Mycobacterium
YAEQ

SEQ ID NO: 295305 - protein, 18 aa, Mycobacterium
YAERGQTGVTKDTDYLGN

SEQ ID NO: 295306 - protein, 11 aa, Mycobacterium
YAFTSAEDTLA

SEQ ID NO: 295307 - protein, 14 aa, Mycobacterium
YAGAADGTAFSEGA

SEQ ID NO: 295308 - protein, 8 aa, Mycobacterium
YAGADRPV

SEQ ID NO: 295309 - protein, 6 aa, Mycobacterium
YAGATV

SEQ ID NO: 295310 - protein, 12 aa, Mycobacterium
YAGDEDGKITTT

SEQ ID NO: 295311 - protein, 11 aa, Mycobacterium
YAGDRGRARDT

SEQ ID NO: 295312 - protein, 11 aa, Mycobacterium
YAGDRRRAREA

SEQ ID NO: 295313 - protein, 21 aa, Mycobacterium
YAGDRRRAREAMKTALELQGR

SEQ ID NO: 295314 - protein, 21 aa, Mycobacterium
YAGDRRRAREAMKTAVELQAR

SEQ ID NO: 295315 - protein, 11 aa, Mycobacterium
YAGDRSRARDA

SEQ ID NO: 295316 - protein, 11 aa, Mycobacterium
YAGDRTRARET

SEQ ID NO: 295317 - protein, 4 aa, Mycobacterium
YAGE

SEQ ID NO: 295318 - protein, 8 aa, Mycobacterium
YAGESTQG

SEQ ID NO: 295319 - protein, 4 aa, Mycobacterium
YAGP

SEQ ID NO: 295320 - protein, 16 aa, Mycobacterium
YAGRATTRRLRPPSAA

SEQ ID NO: 295321 - protein, 11 aa, Mycobacterium
YAGRPPAGAGT

SEQ ID NO: 295322 - protein, 8 aa, Mycobacterium
YAGRQTRR

SEQ ID NO: 295323 - protein, 4 aa, Mycobacterium
YAGT

SEQ ID NO: 295324 - protein, 5 aa, Mycobacterium
YAGTG

SEQ ID NO: 295325 - protein, 19 aa, Mycobacterium
YAGTGGPAEVREDVRDDGA

SEQ ID NO: 295326 - protein, 8 aa, Mycobacterium
YAGTSGAF

SEQ ID NO: 295327 - protein, 8 aa, Mycobacterium
YAHSGDMR

SEQ ID NO: 295328 - protein, 12 aa, Mycobacterium
YAINPARDLGPR

SEQ ID NO: 295329 - protein, 11 aa, Mycobacterium
YALPADSAGHT

SEQ ID NO: 295330 - protein, 10 aa, Mycobacterium
YANGTPWAKT

SEQ ID NO: 295331 - protein, 53 aa, Mycobacterium
YANPELPTAGGAPTYHPPTAQPPTAQIPPPAPPQMPVPPPAPTGPPRAPGQVA

SEQ ID NO: 295332 - protein, 7 aa, Mycobacterium
YAPARRR

SEQ ID NO: 295333 - protein, 6 aa, Mycobacterium
YAPDDH

SEQ ID NO: 295334 - protein, 9 aa, Mycobacterium
YAPDGSTSF

SEQ ID NO: 295335 - protein, 6 aa, Mycobacterium
YAPDSP

SEQ ID NO: 295336 - protein, 4 aa, Mycobacterium
YAPE

SEQ ID NO: 295337 - protein, 12 aa, Mycobacterium
YAPGSDKLAPAE

SEQ ID NO: 295338 - protein, 15 aa, Mycobacterium
YAPGTATSKKSRALA

SEQ ID NO: 295339 - protein, 19 aa, Mycobacterium
YAPHRDRGEAERPVAARQH

SEQ ID NO: 295340 - protein, 13 aa, Mycobacterium
YAPNEFKNSDGEI

SEQ ID NO: 295341 - protein, 8 aa, Mycobacterium
YAPPDGLG

SEQ ID NO: 295342 - protein, 6 aa, Mycobacterium
YAPPEQ

SEQ ID NO: 295343 - protein, 6 aa, Mycobacterium
YAPPGS

SEQ ID NO: 295344 - protein, 8 aa, Mycobacterium
YAPPKRRG

SEQ ID NO: 295345 - protein, 13 aa, Mycobacterium
YAPPMTLSTPTTT

SEQ ID NO: 295346 - protein, 6 aa, Mycobacterium
YAPPRE

SEQ ID NO: 295347 - protein, 23 aa, Mycobacterium
YAPQYQQPYPPYPPQNPPGFNEM

SEQ ID NO: 295348 - protein, 4 aa, Mycobacterium
YAPS

SEQ ID NO: 295349 - protein, 14 aa, Mycobacterium
YAQDPGTGALDPNR

SEQ ID NO: 295350 - protein, 9 aa, Mycobacterium
YARGDGDRL

SEQ ID NO: 295351 - protein, 6 aa, Mycobacterium
YARQPR

SEQ ID NO: 295352 - protein, 11 aa, Mycobacterium
YARSDTYTTGK

SEQ ID NO: 295353 - protein, 12 aa, Mycobacterium
YASAGGTTAIPV

SEQ ID NO: 295354 - protein, 9 aa, Mycobacterium
YASAPPNTA

SEQ ID NO: 295355 - protein, 8 aa, Mycobacterium
YASPQQAA

SEQ ID NO: 295356 - protein, 15 aa, Mycobacterium
YASRAGSFVPGTSSG

SEQ ID NO: 295357 - protein, 5 aa, Mycobacterium
YASSS

SEQ ID NO: 295358 - protein, 45 aa, Mycobacterium
YATDPPPPPVPVESQTPPPPAPVPVGPSPGPAHDDAVTTEFPRPP

SEQ ID NO: 295359 - protein, 5 aa, Mycobacterium
YATEK

SEQ ID NO: 295360 - protein, 6 aa, Mycobacterium
YATERA

SEQ ID NO: 295361 - protein, 7 aa, Mycobacterium
YATEREA

SEQ ID NO: 295362 - protein, 8 aa, Mycobacterium
YATEREAF

SEQ ID NO: 295363 - protein, 5 aa, Mycobacterium
YATFP

SEQ ID NO: 295364 - protein, 15 aa, Mycobacterium
YATGEGGKPAALPGG

SEQ ID NO: 295365 - protein, 6 aa, Mycobacterium
YATPTA

SEQ ID NO: 295366 - protein, 10 aa, Mycobacterium
YATPTSGSVT

SEQ ID NO: 295367 - protein, 5 aa, Mycobacterium
YATQP

SEQ ID NO: 295368 - protein, 14 aa, Mycobacterium
YATRSEEPSAERPV

SEQ ID NO: 295369 - protein, 8 aa, Mycobacterium
YATSPGAL

SEQ ID NO: 295370 - protein, 4 aa, Mycobacterium
YATT

SEQ ID NO: 295371 - protein, 6 aa, Mycobacterium
YATTVS

SEQ ID NO: 295372 - protein, 23 aa, Mycobacterium
YAVENSSKTGDDGWKDMLAPPAG

SEQ ID NO: 295373 - protein, 10 aa, Mycobacterium
YDAAGDAIYS

SEQ ID NO: 295374 - protein, 8 aa, Mycobacterium
YDADDNDY

SEQ ID NO: 295375 - protein, 11 aa, Mycobacterium
YDADGKLADPI

SEQ ID NO: 295376 - protein, 4 aa, Mycobacterium
YDAR

SEQ ID NO: 295377 - protein, 10 aa, Mycobacterium
YDATIADTNN

SEQ ID NO: 295378 - protein, 8 aa, Mycobacterium
YDATPDVD

SEQ ID NO: 295379 - protein, 5 aa, Mycobacterium
YDDAG

SEQ ID NO: 295380 - protein, 16 aa, Mycobacterium
YDDRKALPGNVESSVG

SEQ ID NO: 295381 - protein, 16 aa, Mycobacterium
YDDRKAVSPSAPSSVG

SEQ ID NO: 295382 - protein, 26 aa, Mycobacterium
YDDYGYDERPRYREPRAEAPREPHRP

SEQ ID NO: 295383 - protein, 24 aa, Mycobacterium
YDEGQQAEADAAASIRDDLDGRDE

SEQ ID NO: 295384 - protein, 7 aa, Mycobacterium
YDESDRE

SEQ ID NO: 295385 - protein, 21 aa, Mycobacterium
YDESPAAPTETVRRGTNSVPT

SEQ ID NO: 295386 - protein, 11 aa, Mycobacterium
YDESRAAQRRA

SEQ ID NO: 295387 - protein, 14 aa, Mycobacterium
YDETPGETPGEDTV

SEQ ID NO: 295388 - protein, 4 aa, Mycobacterium
YDEY

SEQ ID NO: 295389 - protein, 16 aa, Mycobacterium
YDEYTEKVRSRLVPLV

SEQ ID NO: 295390 - protein, 25 aa, Mycobacterium
YDGADEARKHAVESKPEGKDAHGEE

SEQ ID NO: 295391 - protein, 4 aa, Mycobacterium
YDGE

SEQ ID NO: 295392 - protein, 9 aa, Mycobacterium
YDGTTYTIG

SEQ ID NO: 295393 - protein, 4 aa, Mycobacterium
YDIP

SEQ ID NO: 295394 - protein, 4 aa, Mycobacterium
YDPA

SEQ ID NO: 295395 - protein, 7 aa, Mycobacterium
YDPAAKT

SEQ ID NO: 295396 - protein, 6 aa, Mycobacterium
YDPDAD

SEQ ID NO: 295397 - protein, 15 aa, Mycobacterium
YDPDTGATGPTYPYT

SEQ ID NO: 295398 - protein, 6 aa, Mycobacterium
YDPEQR

SEQ ID NO: 295399 - protein, 15 aa, Mycobacterium
YDPETGRYATPDGQV

SEQ ID NO: 295400 - protein, 7 aa, Mycobacterium
YDPKSAV

SEQ ID NO: 295401 - protein, 5 aa, Mycobacterium
YDPNA

SEQ ID NO: 295402 - protein, 20 aa, Mycobacterium
YDPNAGYSAHAARPKRNPVP

SEQ ID NO: 295403 - protein, 8 aa, Mycobacterium
YDPPQKAK

SEQ ID NO: 295404 - protein, 7 aa, Mycobacterium
YDPPQRA

SEQ ID NO: 295405 - protein, 8 aa, Mycobacterium
YDPPRAEK

SEQ ID NO: 295406 - protein, 5 aa, Mycobacterium
YDPQG

SEQ ID NO: 295407 - protein, 17 aa, Mycobacterium
YDPQGYYEKAGAQGPYS

SEQ ID NO: 295408 - protein, 18 aa, Mycobacterium
YDPQTGRIATDDGTAVQQ

SEQ ID NO: 295409 - protein, 5 aa, Mycobacterium
YDPRI

SEQ ID NO: 295410 - protein, 9 aa, Mycobacterium
YDPRTGRYV

SEQ ID NO: 295411 - protein, 6 aa, Mycobacterium
YDPTRE

SEQ ID NO: 295412 - protein, 5 aa, Mycobacterium
YDPVE

SEQ ID NO: 295413 - protein, 12 aa, Mycobacterium
YDPVRDEIVSGA

SEQ ID NO: 295414 - protein, 9 aa, Mycobacterium
YDQGTEDKI

SEQ ID NO: 295415 - protein, 10 aa, Mycobacterium
YDQGTEDKIN

SEQ ID NO: 295416 - protein, 11 aa, Mycobacterium
YDQNPLAPSPA

SEQ ID NO: 295417 - protein, 12 aa, Mycobacterium
YDRAQESSDRAK

SEQ ID NO: 295418 - protein, 8 aa, Mycobacterium
YDRPDQPR

SEQ ID NO: 295419 - protein, 4 aa, Mycobacterium
YDRS

SEQ ID NO: 295420 - protein, 5 aa, Mycobacterium
YDRSE

SEQ ID NO: 295421 - protein, 26 aa, Mycobacterium
YDRYEPAYEPRRRRPAPNGNNGTHHP

SEQ ID NO: 295422 - protein, 5 aa, Mycobacterium
YDSDS

SEQ ID NO: 295423 - protein, 8 aa, Mycobacterium
YDSVDNDY

SEQ ID NO: 295424 - protein, 10 aa, Mycobacterium
YDTEEDVNGL

SEQ ID NO: 295425 - protein, 8 aa, Mycobacterium
YDTGDSNV

SEQ ID NO: 295426 - protein, 11 aa, Mycobacterium
YDTGSDPDPRF

SEQ ID NO: 295427 - protein, 7 aa, Mycobacterium
YDTKTQR

SEQ ID NO: 295428 - protein, 7 aa, Mycobacterium
YDTNKGR

SEQ ID NO: 295429 - protein, 8 aa, Mycobacterium
YDTPPGWE

SEQ ID NO: 295430 - protein, 7 aa, Mycobacterium
YDTRTGT

SEQ ID NO: 295431 - protein, 7 aa, Mycobacterium
YDTSREA

SEQ ID NO: 295432 - protein, 5 aa, Mycobacterium
YDTSS

SEQ ID NO: 295433 - protein, 5 aa, Mycobacterium
YDTTQ

SEQ ID NO: 295434 - protein, 7 aa, Mycobacterium
YDVEDGK

SEQ ID NO: 295435 - protein, 5 aa, Mycobacterium
YDYTG

SEQ ID NO: 295436 - protein, 13 aa, Mycobacterium
YEAGGGAGYPPAG

SEQ ID NO: 295437 - protein, 4 aa, Mycobacterium
YEAP

SEQ ID NO: 295438 - protein, 11 aa, Mycobacterium
YEDDADASVTA

SEQ ID NO: 295439 - protein, 14 aa, Mycobacterium
YEDGRTEAAHAQGV

SEQ ID NO: 295440 - protein, 9 aa, Mycobacterium
YEDGTPISR

SEQ ID NO: 295441 - protein, 9 aa, Mycobacterium
YEDYPDEAP

SEQ ID NO: 295442 - protein, 11 aa, Mycobacterium
YEEKFGPGDYR

SEQ ID NO: 295443 - protein, 27 aa, Mycobacterium
YEELPDDGPPEQPAPRVTASTRGAGPM

SEQ ID NO: 295444 - protein, 26 aa, Mycobacterium
YEEPDEDPAPQPEPRVRASERGSDAM

SEQ ID NO: 295445 - protein, 6 aa, Mycobacterium
YEESDR

SEQ ID NO: 295446 - protein, 7 aa, Mycobacterium
YEESDRE

SEQ ID NO: 295447 - protein, 18 aa, Mycobacterium
YEETSARVDAETTASTQI

SEQ ID NO: 295448 - protein, 17 aa, Mycobacterium
YEETSARVDAETTASTR

SEQ ID NO: 295449 - protein, 15 aa, Mycobacterium
YEGARRSGDPPGALP

SEQ ID NO: 295450 - protein, 9 aa, Mycobacterium
YEGKSERMT

SEQ ID NO: 295451 - protein, 5 aa, Mycobacterium
YEGRI

SEQ ID NO: 295452 - protein, 16 aa, Mycobacterium
YEGSRGHMGDGSVPTS

SEQ ID NO: 295453 - protein, 16 aa, Mycobacterium
YEGYTPDKATRPTAKE

SEQ ID NO: 295454 - protein, 8 aa, Mycobacterium
YEHPERPS

SEQ ID NO: 295455 - protein, 9 aa, Mycobacterium
YEKATEISY

SEQ ID NO: 295456 - protein, 5 aa, Mycobacterium
YENQD

SEQ ID NO: 295457 - protein, 21 aa, Mycobacterium
YENTGQTTAAQVAADRATTSN

SEQ ID NO: 295458 - protein, 5 aa, Mycobacterium
YEPED

SEQ ID NO: 295459 - protein, 11 aa, Mycobacterium
YEPPPLPPPVQ

SEQ ID NO: 295460 - protein, 9 aa, Mycobacterium
YEPPQQTKT

SEQ ID NO: 295461 - protein, 9 aa, Mycobacterium
YEPPRTTKA

SEQ ID NO: 295462 - protein, 10 aa, Mycobacterium
YEPPSTTTTV

SEQ ID NO: 295463 - protein, 18 aa, Mycobacterium
YEPRDLPEDSDDDTDRPL

SEQ ID NO: 295464 - protein, 27 aa, Mycobacterium
YEQPAEVSSGALTKPRASSDPEPKRGW

SEQ ID NO: 295465 - protein, 5 aa, Mycobacterium
YEQRT

SEQ ID NO: 295466 - protein, 13 aa, Mycobacterium
YERARAAGASLSP

SEQ ID NO: 295467 - protein, 23 aa, Mycobacterium
YERSPHDPEDTISPVADSPRDVT

SEQ ID NO: 295468 - protein, 7 aa, Mycobacterium
YERTGVD

SEQ ID NO: 295469 - protein, 4 aa, Mycobacterium
YERY

SEQ ID NO: 295470 - protein, 21 aa, Mycobacterium
YESAGQALSTATNSTADIPQT

SEQ ID NO: 295471 - protein, 4 aa, Mycobacterium
YESD

SEQ ID NO: 295472 - protein, 7 aa, Mycobacterium
YESENQR

SEQ ID NO: 295473 - protein, 5 aa, Mycobacterium
YESNS

SEQ ID NO: 295474 - protein, 10 aa, Mycobacterium
YESQEDVNGL

SEQ ID NO: 295475 - protein, 4 aa, Mycobacterium
YEST

SEQ ID NO: 295476 - protein, 9 aa, Mycobacterium
YETLEPAEQ

SEQ ID NO: 295477 - protein, 6 aa, Mycobacterium
YETNYD

SEQ ID NO: 295478 - protein, 4 aa, Mycobacterium
YETP

SEQ ID NO: 295479 - protein, 6 aa, Mycobacterium
YETTSG

SEQ ID NO: 295480 - protein, 12 aa, Mycobacterium
YFSQGAPPSPLQ

SEQ ID NO: 295481 - protein, 9 aa, Mycobacterium
YGAASGQAL

SEQ ID NO: 295482 - protein, 20 aa, Mycobacterium
YGADQQSQGHRARALEGQRY

SEQ ID NO: 295483 - protein, 10 aa, Mycobacterium
YGADRDDARK

SEQ ID NO: 295484 - protein, 4 aa, Mycobacterium
YGAG

SEQ ID NO: 295485 - protein, 9 aa, Mycobacterium
YGAKTSAKV

SEQ ID NO: 295486 - protein, 15 aa, Mycobacterium
YGANSSAKNAALEQS

SEQ ID NO: 295487 - protein, 4 aa, Mycobacterium
YGAP

SEQ ID NO: 295488 - protein, 8 aa, Mycobacterium
YGAQDAIR

SEQ ID NO: 295489 - protein, 11 aa, Mycobacterium
YGARQSSTEVG

SEQ ID NO: 295490 - protein, 4 aa, Mycobacterium
YGAT

SEQ ID NO: 295491 - protein, 9 aa, Mycobacterium
YGDEDAPRT

SEQ ID NO: 295492 - protein, 11 aa, Mycobacterium
YGDEPTPTQEQ

SEQ ID NO: 295493 - protein, 10 aa, Mycobacterium
YGDNPTKPFT

SEQ ID NO: 295494 - protein, 11 aa, Mycobacterium
YGDQLDERGKE

SEQ ID NO: 295495 - protein, 11 aa, Mycobacterium
YGDRPGTEQSY

SEQ ID NO: 295496 - protein, 5 aa, Mycobacterium
YGECG

SEQ ID NO: 295497 - protein, 11 aa, Mycobacterium
YGEESKDPKRI

SEQ ID NO: 295498 - protein, 11 aa, Mycobacterium
YGEESKNPKRI

SEQ ID NO: 295499 - protein, 10 aa, Mycobacterium
YGEESRNPKK

SEQ ID NO: 295500 - protein, 11 aa, Mycobacterium
YGEESRNPKRI

SEQ ID NO: 295501 - protein, 7 aa, Mycobacterium
YGEFGGA

SEQ ID NO: 295502 - protein, 4 aa, Mycobacterium
YGEL

SEQ ID NO: 295503 - protein, 13 aa, Mycobacterium
YGENSLAATATSS

SEQ ID NO: 295504 - protein, 7 aa, Mycobacterium
YGEPQLT

SEQ ID NO: 295505 - protein, 6 aa, Mycobacterium
YGEQAS

SEQ ID NO: 295506 - protein, 10 aa, Mycobacterium
YGEQPATEPQ

SEQ ID NO: 295507 - protein, 11 aa, Mycobacterium
YGEQPGTEDDY

SEQ ID NO: 295508 - protein, 10 aa, Mycobacterium
YGEQPGTQSA

SEQ ID NO: 295509 - protein, 9 aa, Mycobacterium
YGEQPGTRA

SEQ ID NO: 295510 - protein, 7 aa, Mycobacterium
YGEQPKA

SEQ ID NO: 295511 - protein, 7 aa, Mycobacterium
YGEQPSA

SEQ ID NO: 295512 - protein, 9 aa, Mycobacterium
YGERPGTEA

SEQ ID NO: 295513 - protein, 10 aa, Mycobacterium
YGERPGTQDS

SEQ ID NO: 295514 - protein, 8 aa, Mycobacterium
YGESKAPE

SEQ ID NO: 295515 - protein, 14 aa, Mycobacterium
YGFPPSAIKPSYGM

SEQ ID NO: 295516 - protein, 5 aa, Mycobacterium
YGGAA

SEQ ID NO: 295517 - protein, 9 aa, Mycobacterium
YGGADANGF

SEQ ID NO: 295518 - protein, 8 aa, Mycobacterium
YGGDNANG

SEQ ID NO: 295519 - protein, 4 aa, Mycobacterium
YGGE

SEQ ID NO: 295520 - protein, 7 aa, Mycobacterium
YGGETIS

SEQ ID NO: 295521 - protein, 12 aa, Mycobacterium
YGGEVKGELEGY

SEQ ID NO: 295522 - protein, 14 aa, Mycobacterium
YGGGGGAPKAEHDA

SEQ ID NO: 295523 - protein, 9 aa, Mycobacterium
YGGGGPKSE

SEQ ID NO: 295524 - protein, 9 aa, Mycobacterium
YGGGRGGTC

SEQ ID NO: 295525 - protein, 13 aa, Mycobacterium
YGGGYRDGRGMSY

SEQ ID NO: 295526 - protein, 6 aa, Mycobacterium
YGGPIG

SEQ ID NO: 295527 - protein, 5 aa, Mycobacterium
YGGQS

SEQ ID NO: 295528 - protein, 8 aa, Mycobacterium
YGGSAAPL

SEQ ID NO: 295529 - protein, 18 aa, Mycobacterium
YGGSDGAAGELYKPPASD

SEQ ID NO: 295530 - protein, 17 aa, Mycobacterium
YGGSMSGEHGDGQQRAE

SEQ ID NO: 295531 - protein, 8 aa, Mycobacterium
YGGTGDER

SEQ ID NO: 295532 - protein, 5 aa, Mycobacterium
YGGTI

SEQ ID NO: 295533 - protein, 8 aa, Mycobacterium
YGHSAGDD

SEQ ID NO: 295534 - protein, 15 aa, Mycobacterium
YGKSAAPLSTRHPDK

SEQ ID NO: 295535 - protein, 5 aa, Mycobacterium
YGKSV

SEQ ID NO: 295536 - protein, 5 aa, Mycobacterium
YGKSY

SEQ ID NO: 295537 - protein, 6 aa, Mycobacterium
YGLPDT

SEQ ID NO: 295538 - protein, 14 aa, Mycobacterium
YGLPPTAVKPSYGM

SEQ ID NO: 295539 - protein, 4 aa, Mycobacterium
YGLT

SEQ ID NO: 295540 - protein, 7 aa, Mycobacterium
YGNPSGE

SEQ ID NO: 295541 - protein, 9 aa, Mycobacterium
YGNTASTTH

SEQ ID NO: 295542 - protein, 8 aa, Mycobacterium
YGPAEATI

SEQ ID NO: 295543 - protein, 9 aa, Mycobacterium
YGPARGNTL

SEQ ID NO: 295544 - protein, 20 aa, Mycobacterium
YGPEFGDDAEAGEDAPTKLS

SEQ ID NO: 295545 - protein, 8 aa, Mycobacterium
YGPESSDA

SEQ ID NO: 295546 - protein, 18 aa, Mycobacterium
YGPGAANVSGLTDQTDNF

SEQ ID NO: 295547 - protein, 8 aa, Mycobacterium
YGPGAGAA

SEQ ID NO: 295548 - protein, 5 aa, Mycobacterium
YGPGG

SEQ ID NO: 295549 - protein, 12 aa, Mycobacterium
YGPGPRTSDNTY

SEQ ID NO: 295550 - protein, 11 aa, Mycobacterium
YGPGQSLTNSY

SEQ ID NO: 295551 - protein, 7 aa, Mycobacterium
YGPHGRA

SEQ ID NO: 295552 - protein, 5 aa, Mycobacterium
YGPHR

SEQ ID NO: 295553 - protein, 5 aa, Mycobacterium
YGPPQ

SEQ ID NO: 295554 - protein, 4 aa, Mycobacterium
YGPQ

SEQ ID NO: 295555 - protein, 4 aa, Mycobacterium
YGPR

SEQ ID NO: 295556 - protein, 5 aa, Mycobacterium
YGPRP

SEQ ID NO: 295557 - protein, 16 aa, Mycobacterium
YGPRPEDSKTQSNSSP

SEQ ID NO: 295558 - protein, 17 aa, Mycobacterium
YGPRPEEAKRYSNSNPF

SEQ ID NO: 295559 - protein, 6 aa, Mycobacterium
YGPRTA

SEQ ID NO: 295560 - protein, 7 aa, Mycobacterium
YGPTEAT

SEQ ID NO: 295561 - protein, 7 aa, Mycobacterium
YGPTEST

SEQ ID NO: 295562 - protein, 6 aa, Mycobacterium
YGPTET

SEQ ID NO: 295563 - protein, 7 aa, Mycobacterium
YGPTETT

SEQ ID NO: 295564 - protein, 14 aa, Mycobacterium
YGPTPDDPDFAGSK

SEQ ID NO: 295565 - protein, 12 aa, Mycobacterium
YGQADPKQRPPK

SEQ ID NO: 295566 - protein, 6 aa, Mycobacterium
YGQDDS

SEQ ID NO: 295567 - protein, 7 aa, Mycobacterium
YGQDRTE

SEQ ID NO: 295568 - protein, 9 aa, Mycobacterium
YGQGRPTDQ

SEQ ID NO: 295569 - protein, 7 aa, Mycobacterium
YGQNTSA

SEQ ID NO: 295570 - protein, 130 aa, Mycobacterium
YGQYGQYGQYGGQPGGYYGQPSAQQQAAPSPAQPSGYGSQYGGYSSSGGSNPSTGGFGAQQPGQSAPQPMHQGPSTPPTGFPSFGPPPPVSAGTGSQAGSAPVNYSNPAGGPQSYGQGSGQQSSSPGSAP

SEQ ID NO: 295571 - protein, 6 aa, Mycobacterium
YGRDRT

SEQ ID NO: 295572 - protein, 7 aa, Mycobacterium
YGRDRTS

SEQ ID NO: 295573 - protein, 6 aa, Mycobacterium
YGRFST

SEQ ID NO: 295574 - protein, 8 aa, Mycobacterium
YGRPDAAH

SEQ ID NO: 295575 - protein, 12 aa, Mycobacterium
YGRPDAAPHEIT

SEQ ID NO: 295576 - protein, 11 aa, Mycobacterium
YGRPDADEDEV

SEQ ID NO: 295577 - protein, 11 aa, Mycobacterium
YGRPEAGDGEV

SEQ ID NO: 295578 - protein, 12 aa, Mycobacterium
YGRPGASADEVV

SEQ ID NO: 295579 - protein, 10 aa, Mycobacterium
YGRPGASQEE

SEQ ID NO: 295580 - protein, 5 aa, Mycobacterium
YGRRP

SEQ ID NO: 295581 - protein, 7 aa, Mycobacterium
YGSAMTD

SEQ ID NO: 295582 - protein, 11 aa, Mycobacterium
YGSATSDEFDS

SEQ ID NO: 295583 - protein, 8 aa, Mycobacterium
YGSEHGDP

SEQ ID NO: 295584 - protein, 13 aa, Mycobacterium
YGSESAPQQARQD

SEQ ID NO: 295585 - protein, 4 aa, Mycobacterium
YGSG

SEQ ID NO: 295586 - protein, 26 aa, Mycobacterium
YGSGDAPKTEHDARTPVGADGQHKAQ

SEQ ID NO: 295587 - protein, 8 aa, Mycobacterium
YGSGRTLD

SEQ ID NO: 295588 - protein, 6 aa, Mycobacterium
YGSKDA

SEQ ID NO: 295589 - protein, 8 aa, Mycobacterium
YGSPDPSA

SEQ ID NO: 295590 - protein, 7 aa, Mycobacterium
YGSPEPY

SEQ ID NO: 295591 - protein, 8 aa, Mycobacterium
YGSPEPYS

SEQ ID NO: 295592 - protein, 7 aa, Mycobacterium
YGSPETA

SEQ ID NO: 295593 - protein, 8 aa, Mycobacterium
YGSRTGEQ

SEQ ID NO: 295594 - protein, 9 aa, Mycobacterium
YGSSPGDAL

SEQ ID NO: 295595 - protein, 6 aa, Mycobacterium
YGSTEA

SEQ ID NO: 295596 - protein, 7 aa, Mycobacterium
YGTGPEV

SEQ ID NO: 295597 - protein, 9 aa, Mycobacterium
YGTGPGEAR

SEQ ID NO: 295598 - protein, 5 aa, Mycobacterium
YGTHP

SEQ ID NO: 295599 - protein, 4 aa, Mycobacterium
YGTP

SEQ ID NO: 295600 - protein, 14 aa, Mycobacterium
YGTPGYPPDTAGPR

SEQ ID NO: 295601 - protein, 11 aa, Mycobacterium
YGTPRDDSRRI

SEQ ID NO: 295602 - protein, 14 aa, Mycobacterium
YGTPRRPPSSADFP

SEQ ID NO: 295603 - protein, 15 aa, Mycobacterium
YGTPRRPSSSADYPE

SEQ ID NO: 295604 - protein, 10 aa, Mycobacterium
YGTRASRRRD

SEQ ID NO: 295605 - protein, 10 aa, Mycobacterium
YGTTDGGAVA

SEQ ID NO: 295606 - protein, 6 aa, Mycobacterium
YGVEQQ

SEQ ID NO: 295607 - protein, 6 aa, Mycobacterium
YGVGDT

SEQ ID NO: 295608 - protein, 9 aa, Mycobacterium
YGVSPAAAG

SEQ ID NO: 295609 - protein, 23 aa, Mycobacterium
YGYGGSFTSGTPMDDRGDDNKNH

SEQ ID NO: 295610 - protein, 23 aa, Mycobacterium
YGYGGSLTSGKQMPDRGSSTQNH

SEQ ID NO: 295611 - protein, 6 aa, Mycobacterium
YHAGQA

SEQ ID NO: 295612 - protein, 5 aa, Mycobacterium
YHDKA

SEQ ID NO: 295613 - protein, 16 aa, Mycobacterium
YHENETAGSPFDGPTD

SEQ ID NO: 295614 - protein, 21 aa, Mycobacterium
YHESPGWTATATAPFKSATKW

SEQ ID NO: 295615 - protein, 21 aa, Mycobacterium
YHGDEDPTQTLPTAPVPAPEL

SEQ ID NO: 295616 - protein, 32 aa, Mycobacterium
YHGGPGELRRPEHPDTTGKPDKPQSVRQPMGR

SEQ ID NO: 295617 - protein, 5 aa, Mycobacterium
YHGTR

SEQ ID NO: 295618 - protein, 19 aa, Mycobacterium
YHPPKDLAPPPGTVIGPDG

SEQ ID NO: 295619 - protein, 6 aa, Mycobacterium
YHPSYD

SEQ ID NO: 295620 - protein, 19 aa, Mycobacterium
YHSGSPKVSKSGSGNVVQQ

SEQ ID NO: 295621 - protein, 19 aa, Mycobacterium
YHSGTPKISNSGDSNVVTQ

SEQ ID NO: 295622 - protein, 8 aa, Mycobacterium
YIKPGAEP

SEQ ID NO: 295623 - protein, 5 aa, Mycobacterium
YIPQD

SEQ ID NO: 295624 - protein, 4 aa, Mycobacterium
YIRT

SEQ ID NO: 295625 - protein, 4 aa, Mycobacterium
YITT

SEQ ID NO: 295626 - protein, 6 aa, Mycobacterium
YKAPSV

SEQ ID NO: 295627 - protein, 24 aa, Mycobacterium
YKASYNNRDYTPGFTRANEGYTAA

SEQ ID NO: 295628 - protein, 7 aa, Mycobacterium
YKATESP

SEQ ID NO: 295629 - protein, 7 aa, Mycobacterium
YKETPTR

SEQ ID NO: 295630 - protein, 8 aa, Mycobacterium
YKLPGAPV

SEQ ID NO: 295631 - protein, 7 aa, Mycobacterium
YKPGDTI

SEQ ID NO: 295632 - protein, 7 aa, Mycobacterium
YKPKSSV

SEQ ID NO: 295633 - protein, 5 aa, Mycobacterium
YKPPI

SEQ ID NO: 295634 - protein, 6 aa, Mycobacterium
YKPRSD

SEQ ID NO: 295635 - protein, 12 aa, Mycobacterium
YKPSQISAGSQP

SEQ ID NO: 295636 - protein, 5 aa, Mycobacterium
YKSNS

SEQ ID NO: 295637 - protein, 4 aa, Mycobacterium
YKST

SEQ ID NO: 295638 - protein, 8 aa, Mycobacterium
YKTNYDAR

SEQ ID NO: 295639 - protein, 8 aa, Mycobacterium
YKTNYNDR

SEQ ID NO: 295640 - protein, 8 aa, Mycobacterium
YKTPTSSL

SEQ ID NO: 295641 - protein, 7 aa, Mycobacterium
YKTSYDD

SEQ ID NO: 295642 - protein, 4 aa, Mycobacterium
YKTT

SEQ ID NO: 295643 - protein, 4 aa, Mycobacterium
YLAR

SEQ ID NO: 295644 - protein, 15 aa, Mycobacterium
YLDKESGAAAGSTGQ

SEQ ID NO: 295645 - protein, 12 aa, Mycobacterium
YLKDGKRRAITQ

SEQ ID NO: 295646 - protein, 12 aa, Mycobacterium
YLPASTPTNVGY

SEQ ID NO: 295647 - protein, 5 aa, Mycobacterium
YLPDD

SEQ ID NO: 295648 - protein, 7 aa, Mycobacterium
YLPPDNA

SEQ ID NO: 295649 - protein, 14 aa, Mycobacterium
YLPPDNAVRQSQEQ

SEQ ID NO: 295650 - protein, 15 aa, Mycobacterium
YLPPDNGVRTAQEDF

SEQ ID NO: 295651 - protein, 13 aa, Mycobacterium
YLPPNNAVRQSQE

SEQ ID NO: 295652 - protein, 13 aa, Mycobacterium
YLPPNNSVRQSQE

SEQ ID NO: 295653 - protein, 14 aa, Mycobacterium
YLPPTNSVRQAQEN

SEQ ID NO: 295654 - protein, 6 aa, Mycobacterium
YLPTGQ

SEQ ID NO: 295655 - protein, 12 aa, Mycobacterium
YMPDNVPSKVGY

SEQ ID NO: 295656 - protein, 16 aa, Mycobacterium
YNDGDADQVGDNNATQ

SEQ ID NO: 295657 - protein, 16 aa, Mycobacterium
YNDGPGDVTSTEGREH

SEQ ID NO: 295658 - protein, 10 aa, Mycobacterium
YNETADPVGD

SEQ ID NO: 295659 - protein, 12 aa, Mycobacterium
YNGRPSPQPPNV

SEQ ID NO: 295660 - protein, 8 aa, Mycobacterium
YNKSKMAP

SEQ ID NO: 295661 - protein, 4 aa, Mycobacterium
YNPA

SEQ ID NO: 295662 - protein, 10 aa, Mycobacterium
YNPATKRAEL

SEQ ID NO: 295663 - protein, 9 aa, Mycobacterium
YNPATRRAE

SEQ ID NO: 295664 - protein, 15 aa, Mycobacterium
YNPETGQVATPDGEV

SEQ ID NO: 295665 - protein, 10 aa, Mycobacterium
YNPETGRAEL

SEQ ID NO: 295666 - protein, 8 aa, Mycobacterium
YNPETHRA

SEQ ID NO: 295667 - protein, 10 aa, Mycobacterium
YNPRNGEYMG

SEQ ID NO: 295668 - protein, 11 aa, Mycobacterium
YNPRYGENGEQ

SEQ ID NO: 295669 - protein, 7 aa, Mycobacterium
YNPSYDD

SEQ ID NO: 295670 - protein, 9 aa, Mycobacterium
YNRGASCDA

SEQ ID NO: 295671 - protein, 9 aa, Mycobacterium
YNRGTADSV

SEQ ID NO: 295672 - protein, 5 aa, Mycobacterium
YNRGV

SEQ ID NO: 295673 - protein, 8 aa, Mycobacterium
YNSDRREL

SEQ ID NO: 295674 - protein, 5 aa, Mycobacterium
YNSDS

SEQ ID NO: 295675 - protein, 5 aa, Mycobacterium
YNSEG

SEQ ID NO: 295676 - protein, 5 aa, Mycobacterium
YNSGP

SEQ ID NO: 295677 - protein, 6 aa, Mycobacterium
YNSGPF

SEQ ID NO: 295678 - protein, 8 aa, Mycobacterium
YNSGPLPR

SEQ ID NO: 295679 - protein, 8 aa, Mycobacterium
YNSSTVGP

SEQ ID NO: 295680 - protein, 5 aa, Mycobacterium
YNTGD

SEQ ID NO: 295681 - protein, 8 aa, Mycobacterium
YNTGPLPR

SEQ ID NO: 295682 - protein, 24 aa, Mycobacterium
YNTKAGKKLTDAAAAGGGDQLSAS

SEQ ID NO: 295683 - protein, 15 aa, Mycobacterium
YPAAAVPTLADPTPA

SEQ ID NO: 295684 - protein, 25 aa, Mycobacterium
YPAAGEASKPVEPPRSGKVPTDPAT

SEQ ID NO: 295685 - protein, 4 aa, Mycobacterium
YPAE

SEQ ID NO: 295686 - protein, 7 aa, Mycobacterium
YPAEHAP

SEQ ID NO: 295687 - protein, 6 aa, Mycobacterium
YPAGSL

SEQ ID NO: 295688 - protein, 5 aa, Mycobacterium
YPALP

SEQ ID NO: 295689 - protein, 12 aa, Mycobacterium
YPAPEGSVSDEK

SEQ ID NO: 295690 - protein, 21 aa, Mycobacterium
YPAQPGGQPQPYPGNPSYPYP

SEQ ID NO: 295691 - protein, 10 aa, Mycobacterium
YPAQQDRAGF

SEQ ID NO: 295692 - protein, 27 aa, Mycobacterium
YPASPDKAAKPAKPPRSGKVPTEPAQV

SEQ ID NO: 295693 - protein, 27 aa, Mycobacterium
YPASPEPAAKPVKPPRTGKVPTDPAQV

SEQ ID NO: 295694 - protein, 8 aa, Mycobacterium
YPASPPAL

SEQ ID NO: 295695 - protein, 9 aa, Mycobacterium
YPASPPALS

SEQ ID NO: 295696 - protein, 8 aa, Mycobacterium
YPASTQVL

SEQ ID NO: 295697 - protein, 26 aa, Mycobacterium
YPATPEPAAKQVKPPRTGKVPTDPAQ

SEQ ID NO: 295698 - protein, 9 aa, Mycobacterium
YPDGEWSQT

SEQ ID NO: 295699 - protein, 6 aa, Mycobacterium
YPDGMP

SEQ ID NO: 295700 - protein, 10 aa, Mycobacterium
YPDGPPADTT

SEQ ID NO: 295701 - protein, 13 aa, Mycobacterium
YPDGTTKAIWPAG

SEQ ID NO: 295702 - protein, 4 aa, Mycobacterium
YPDL

SEQ ID NO: 295703 - protein, 5 aa, Mycobacterium
YPDLN

SEQ ID NO: 295704 - protein, 9 aa, Mycobacterium
YPDNPTGQH

SEQ ID NO: 295705 - protein, 21 aa, Mycobacterium
YPDPDSPDRRVETPPNPPQDA

SEQ ID NO: 295706 - protein, 20 aa, Mycobacterium
YPDPHNQSQLAPPGPSQGYS

SEQ ID NO: 295707 - protein, 6 aa, Mycobacterium
YPDPQN

SEQ ID NO: 295708 - protein, 15 aa, Mycobacterium
YPDPSGQPGQRYHDG

SEQ ID NO: 295709 - protein, 7 aa, Mycobacterium
YPDRPAG

SEQ ID NO: 295710 - protein, 26 aa, Mycobacterium
YPDTDDSAVPVAEEPQQGAQESAKPQ

SEQ ID NO: 295711 - protein, 8 aa, Mycobacterium
YPEAEPAR

SEQ ID NO: 295712 - protein, 6 aa, Mycobacterium
YPEDIE

SEQ ID NO: 295713 - protein, 4 aa, Mycobacterium
YPEG

SEQ ID NO: 295714 - protein, 4 aa, Mycobacterium
YPEL

SEQ ID NO: 295715 - protein, 5 aa, Mycobacterium
YPELT

SEQ ID NO: 295716 - protein, 13 aa, Mycobacterium
YPEPAGTYDDKAV

SEQ ID NO: 295717 - protein, 16 aa, Mycobacterium
YPEPPPPGTVPSCAEG

SEQ ID NO: 295718 - protein, 6 aa, Mycobacterium
YPEPRD

SEQ ID NO: 295719 - protein, 14 aa, Mycobacterium
YPEQRKSSPPGETA

SEQ ID NO: 295720 - protein, 8 aa, Mycobacterium
YPGADRDA

SEQ ID NO: 295721 - protein, 5 aa, Mycobacterium
YPGAE

SEQ ID NO: 295722 - protein, 9 aa, Mycobacterium
YPGAGQDAL

SEQ ID NO: 295723 - protein, 19 aa, Mycobacterium
YPGALGGKTGYTDDAGQTF

SEQ ID NO: 295724 - protein, 10 aa, Mycobacterium
YPGGADSPES

SEQ ID NO: 295725 - protein, 15 aa, Mycobacterium
YPGGGCGGAGSGRVM

SEQ ID NO: 295726 - protein, 6 aa, Mycobacterium
YPGGGD

SEQ ID NO: 295727 - protein, 7 aa, Mycobacterium
YPGGNPN

SEQ ID NO: 295728 - protein, 5 aa, Mycobacterium
YPGGP

SEQ ID NO: 295729 - protein, 4 aa, Mycobacterium
YPGI

SEQ ID NO: 295730 - protein, 8 aa, Mycobacterium
YPGLGTPG

SEQ ID NO: 295731 - protein, 6 aa, Mycobacterium
YPGLPA

SEQ ID NO: 295732 - protein, 17 aa, Mycobacterium
YPGSPSSRRERSGRPQW

SEQ ID NO: 295733 - protein, 10 aa, Mycobacterium
YPGTDHDALG

SEQ ID NO: 295734 - protein, 12 aa, Mycobacterium
YPGTDSAGVTPG

SEQ ID NO: 295735 - protein, 7 aa, Mycobacterium
YPGVAAP

SEQ ID NO: 295736 - protein, 24 aa, Mycobacterium
YPGYYPPPDYQGGYPTQAAVPGTN

SEQ ID NO: 295737 - protein, 11 aa, Mycobacterium
YPHSDSNWPHT

SEQ ID NO: 295738 - protein, 7 aa, Mycobacterium
YPKAGGA

SEQ ID NO: 295739 - protein, 7 aa, Mycobacterium
YPKGMPA

SEQ ID NO: 295740 - protein, 31 aa, Mycobacterium
YPKSTQDITDPSLDPTYKSGTVSKKSLRQTI

SEQ ID NO: 295741 - protein, 10 aa, Mycobacterium
YPNAGNKAET

SEQ ID NO: 295742 - protein, 11 aa, Mycobacterium
YPNAGNKAETI

SEQ ID NO: 295743 - protein, 12 aa, Mycobacterium
YPNEPGSIPDGT

SEQ ID NO: 295744 - protein, 9 aa, Mycobacterium
YPNGMPGSE

SEQ ID NO: 295745 - protein, 12 aa, Mycobacterium
YPNPDDTGFSPY

SEQ ID NO: 295746 - protein, 6 aa, Mycobacterium
YPNQPN

SEQ ID NO: 295747 - protein, 7 aa, Mycobacterium
YPNQPNV

SEQ ID NO: 295748 - protein, 7 aa, Mycobacterium
YPNRAPG

SEQ ID NO: 295749 - protein, 10 aa, Mycobacterium
YPNTDGNPSI

SEQ ID NO: 295750 - protein, 4 aa, Mycobacterium
YPPE

SEQ ID NO: 295751 - protein, 18 aa, Mycobacterium
YPPFGAPEGAEGKATAQD

SEQ ID NO: 295752 - protein, 18 aa, Mycobacterium
YPPFGPPEGAEGKATAQD

SEQ ID NO: 295753 - protein, 4 aa, Mycobacterium
YPPG

SEQ ID NO: 295754 - protein, 16 aa, Mycobacterium
YPPNPPAVGQADTIAA

SEQ ID NO: 295755 - protein, 6 aa, Mycobacterium
YPPPDG

SEQ ID NO: 295756 - protein, 7 aa, Mycobacterium
YPPPKGI

SEQ ID NO: 295757 - protein, 72 aa, Mycobacterium
YPPPQAPQQPYWPQPAGNYPGYPGQPGRPGQQGQAQPPYPPYPPYPPPSLPDPDGGKSPEQDDVSRSNPPAH

SEQ ID NO: 295758 - protein, 5 aa, Mycobacterium
YPPPR

SEQ ID NO: 295759 - protein, 25 aa, Mycobacterium
YPPPSYPGGYYPPPDPMAGYGPALP

SEQ ID NO: 295760 - protein, 11 aa, Mycobacterium
YPPQAAPRPSA

SEQ ID NO: 295761 - protein, 9 aa, Mycobacterium
YPPSPPALS

SEQ ID NO: 295762 - protein, 9 aa, Mycobacterium
YPPSRPSQL

SEQ ID NO: 295763 - protein, 30 aa, Mycobacterium
YPPTTEPAAKPARPPRTGTVPTEPATVSAG

SEQ ID NO: 295764 - protein, 8 aa, Mycobacterium
YPQAASVP

SEQ ID NO: 295765 - protein, 4 aa, Mycobacterium
YPQL

SEQ ID NO: 295766 - protein, 21 aa, Mycobacterium
YPQPPGPATAATERTARGAAQ

SEQ ID NO: 295767 - protein, 42 aa, Mycobacterium
YPQPYGYPRPYPPAPQQLGPAPWPGHGVSPAGYPPPPPAANE

SEQ ID NO: 295768 - protein, 6 aa, Mycobacterium
YPQRLG

SEQ ID NO: 295769 - protein, 7 aa, Mycobacterium
YPRAGGA

SEQ ID NO: 295770 - protein, 4 aa, Mycobacterium
YPRG

SEQ ID NO: 295771 - protein, 8 aa, Mycobacterium
YPRGARQE

SEQ ID NO: 295772 - protein, 4 aa, Mycobacterium
YPRK

SEQ ID NO: 295773 - protein, 9 aa, Mycobacterium
YPRPGPGPR

SEQ ID NO: 295774 - protein, 4 aa, Mycobacterium
YPRS

SEQ ID NO: 295775 - protein, 5 aa, Mycobacterium
YPRTA

SEQ ID NO: 295776 - protein, 13 aa, Mycobacterium
YPRTGQGGDPKLT

SEQ ID NO: 295777 - protein, 7 aa, Mycobacterium
YPSADKV

SEQ ID NO: 295778 - protein, 7 aa, Mycobacterium
YPSGMPH

SEQ ID NO: 295779 - protein, 13 aa, Mycobacterium
YPTDQYPPNDPAL

SEQ ID NO: 295780 - protein, 11 aa, Mycobacterium
YPTDTRAAADV

SEQ ID NO: 295781 - protein, 9 aa, Mycobacterium
YPTEAARAG

SEQ ID NO: 295782 - protein, 5 aa, Mycobacterium
YPTGM

SEQ ID NO: 295783 - protein, 13 aa, Mycobacterium
YPTGPQARMPSAS

SEQ ID NO: 295784 - protein, 13 aa, Mycobacterium
YPTGVTADNSGTV

SEQ ID NO: 295785 - protein, 5 aa, Mycobacterium
YPTGY

SEQ ID NO: 295786 - protein, 6 aa, Mycobacterium
YPTGYG

SEQ ID NO: 295787 - protein, 5 aa, Mycobacterium
YPTHR

SEQ ID NO: 295788 - protein, 9 aa, Mycobacterium
YPTQAARAG

SEQ ID NO: 295789 - protein, 8 aa, Mycobacterium
YPTYAEAQ

SEQ ID NO: 295790 - protein, 40 aa, Mycobacterium
YPVEYPDPAYANQTPYGGGYPAAPNPVSNPPANPQPTQQM

SEQ ID NO: 295791 - protein, 11 aa, Mycobacterium
YPVGSPPSHTV

SEQ ID NO: 295792 - protein, 20 aa, Mycobacterium
YPYPATGSAGPVGAEEGTSK

SEQ ID NO: 295793 - protein, 29 aa, Mycobacterium
YPYSQQTSLSEATFDSQVGRTGGALPNQQ

SEQ ID NO: 295794 - protein, 15 aa, Mycobacterium
YQADPGSHDPSANTW

SEQ ID NO: 295795 - protein, 8 aa, Mycobacterium
YQAGDDIQ

SEQ ID NO: 295796 - protein, 12 aa, Mycobacterium
YQAGDDLSTDTW

SEQ ID NO: 295797 - protein, 15 aa, Mycobacterium
YQAGEVGGKLGDASN

SEQ ID NO: 295798 - protein, 34 aa, Mycobacterium
YQAGEVGGKLSDASQQIAGANGDLDALTAGSRKL

SEQ ID NO: 295799 - protein, 24 aa, Mycobacterium
YQAGEVGSKLDEASSAIEDHGGEL

SEQ ID NO: 295800 - protein, 24 aa, Mycobacterium
YQANKARDWDSKRDAAVEQVESDK

SEQ ID NO: 295801 - protein, 8 aa, Mycobacterium
YQANKSDQ

SEQ ID NO: 295802 - protein, 9 aa, Mycobacterium
YQANKSSQI

SEQ ID NO: 295803 - protein, 13 aa, Mycobacterium
YQCSGSPRQAADT

SEQ ID NO: 295804 - protein, 19 aa, Mycobacterium
YQDPSGDARTVQVTLGQSE

SEQ ID NO: 295805 - protein, 5 aa, Mycobacterium
YQDSE

SEQ ID NO: 295806 - protein, 14 aa, Mycobacterium
YQDYSTPTTTARPE

SEQ ID NO: 295807 - protein, 16 aa, Mycobacterium
YQERQRAAQQEAERLE

SEQ ID NO: 295808 - protein, 8 aa, Mycobacterium
YQETRKTI

SEQ ID NO: 295809 - protein, 4 aa, Mycobacterium
YQGA

SEQ ID NO: 295810 - protein, 15 aa, Mycobacterium
YQPDPAYAPANGGLD

SEQ ID NO: 295811 - protein, 14 aa, Mycobacterium
YQPEPARTETPQVV

SEQ ID NO: 295812 - protein, 14 aa, Mycobacterium
YQPEPPAPAMDPAQ

SEQ ID NO: 295813 - protein, 6 aa, Mycobacterium
YQPGRP

SEQ ID NO: 295814 - protein, 12 aa, Mycobacterium
YQPGSDTAAGTV

SEQ ID NO: 295815 - protein, 4 aa, Mycobacterium
YQPQ

SEQ ID NO: 295816 - protein, 5 aa, Mycobacterium
YQPQL

SEQ ID NO: 295817 - protein, 5 aa, Mycobacterium
YQPTA

SEQ ID NO: 295818 - protein, 13 aa, Mycobacterium
YQPVARKAGGHGR

SEQ ID NO: 295819 - protein, 11 aa, Mycobacterium
YQQGTGPAAAV

SEQ ID NO: 295820 - protein, 13 aa, Mycobacterium
YQQGTGPAAAVPG

SEQ ID NO: 295821 - protein, 6 aa, Mycobacterium
YQQSGE

SEQ ID NO: 295822 - protein, 93 aa, Mycobacterium
YQQYQQPVEPAYPQQYPAAPGYGQSDFGSQPTQFGAPPQFGQPGQYGQPGQYGQPGQYGQPGQPGQPGQYGQPGQYPGQFSPYDQSGQGSKRS

SEQ ID NO: 295823 - protein, 9 aa, Mycobacterium
YQRAEDKGT

SEQ ID NO: 295824 - protein, 17 aa, Mycobacterium
YQRDRADDALKQANELN

SEQ ID NO: 295825 - protein, 17 aa, Mycobacterium
YQRDRADDALKQANELS

SEQ ID NO: 295826 - protein, 9 aa, Mycobacterium
YQRGHGANT

SEQ ID NO: 295827 - protein, 8 aa, Mycobacterium
YQRPEEFT

SEQ ID NO: 295828 - protein, 29 aa, Mycobacterium
YQRPTSVDGPTGELPTVTASSAKPDRPEL

SEQ ID NO: 295829 - protein, 9 aa, Mycobacterium
YQSGEDLTA

SEQ ID NO: 295830 - protein, 8 aa, Mycobacterium
YQSPNPHI

SEQ ID NO: 295831 - protein, 7 aa, Mycobacterium
YQSQQDG

SEQ ID NO: 295832 - protein, 8 aa, Mycobacterium
YQTDKSDQ

SEQ ID NO: 295833 - protein, 5 aa, Mycobacterium
YQTNY

SEQ ID NO: 295834 - protein, 11 aa, Mycobacterium
YQTNYDDQTYV

SEQ ID NO: 295835 - protein, 29 aa, Mycobacterium
YQTPPGWSATATAPFKSATKWSGTSYGEH

SEQ ID NO: 295836 - protein, 5 aa, Mycobacterium
YRADN

SEQ ID NO: 295837 - protein, 13 aa, Mycobacterium
YRAKSGDRNAVVA

SEQ ID NO: 295838 - protein, 4 aa, Mycobacterium
YRAP

SEQ ID NO: 295839 - protein, 10 aa, Mycobacterium
YRAPEGPYET

SEQ ID NO: 295840 - protein, 8 aa, Mycobacterium
YRAPGTLT

SEQ ID NO: 295841 - protein, 10 aa, Mycobacterium
YRAPSNPTEE

SEQ ID NO: 295842 - protein, 10 aa, Mycobacterium
YRAPTSPSEE

SEQ ID NO: 295843 - protein, 5 aa, Mycobacterium
YRATF

SEQ ID NO: 295844 - protein, 12 aa, Mycobacterium
YRATGTDAEESA

SEQ ID NO: 295845 - protein, 8 aa, Mycobacterium
YRDAQTHN

SEQ ID NO: 295846 - protein, 8 aa, Mycobacterium
YRDDSGNL

SEQ ID NO: 295847 - protein, 4 aa, Mycobacterium
YRDG

SEQ ID NO: 295848 - protein, 10 aa, Mycobacterium
YRDGQFGREN

SEQ ID NO: 295849 - protein, 7 aa, Mycobacterium
YRDPAAG

SEQ ID NO: 295850 - protein, 9 aa, Mycobacterium
YRDSTIKQA

SEQ ID NO: 295851 - protein, 14 aa, Mycobacterium
YRDTGAEARGIGGW

SEQ ID NO: 295852 - protein, 7 aa, Mycobacterium
YREGEHT

SEQ ID NO: 295853 - protein, 12 aa, Mycobacterium
YREGEKTIAQEH

SEQ ID NO: 295854 - protein, 11 aa, Mycobacterium
YREGQETIAQE

SEQ ID NO: 295855 - protein, 4 aa, Mycobacterium
YREH

SEQ ID NO: 295856 - protein, 5 aa, Mycobacterium
YREIN

SEQ ID NO: 295857 - protein, 21 aa, Mycobacterium
YRELTPPASSASITSPLDSRA

SEQ ID NO: 295858 - protein, 22 aa, Mycobacterium
YRERQEDAEFPASLSGMPSTLR

SEQ ID NO: 295859 - protein, 7 aa, Mycobacterium
YREVEDT

SEQ ID NO: 295860 - protein, 28 aa, Mycobacterium
YRGEESGERAEYRSRRREPRDADRWEYD

SEQ ID NO: 295861 - protein, 18 aa, Mycobacterium
YRGGDNKMRTEEVDAERA

SEQ ID NO: 295862 - protein, 27 aa, Mycobacterium
YRGGEDEDHRSEYRTRPRPPARGRHSR

SEQ ID NO: 295863 - protein, 18 aa, Mycobacterium
YRGGGDKVRTEEVDAERA

SEQ ID NO: 295864 - protein, 38 aa, Mycobacterium
YRGGTQDQPREPHTERRSRSRTPGRAHGRPAAESWEYD

SEQ ID NO: 295865 - protein, 4 aa, Mycobacterium
YRGP

SEQ ID NO: 295866 - protein, 5 aa, Mycobacterium
YRGPV

SEQ ID NO: 295867 - protein, 21 aa, Mycobacterium
YRGREDQARDQAAGALAQGGD

SEQ ID NO: 295868 - protein, 10 aa, Mycobacterium
YRGSAPGSLT

SEQ ID NO: 295869 - protein, 7 aa, Mycobacterium
YRGSQIG

SEQ ID NO: 295870 - protein, 5 aa, Mycobacterium
YRGST

SEQ ID NO: 295871 - protein, 18 aa, Mycobacterium
YRGTDNKMRTEEVDAERA

SEQ ID NO: 295872 - protein, 17 aa, Mycobacterium
YRNGEHTSIHTGTPPVS

SEQ ID NO: 295873 - protein, 4 aa, Mycobacterium
YRNR

SEQ ID NO: 295874 - protein, 12 aa, Mycobacterium
YRNRHDAVDGST

SEQ ID NO: 295875 - protein, 12 aa, Mycobacterium
YRNRHDAVNGST

SEQ ID NO: 295876 - protein, 14 aa, Mycobacterium
YRPAPAPKPPAQQV

SEQ ID NO: 295877 - protein, 12 aa, Mycobacterium
YRPEERSAELTQ

SEQ ID NO: 295878 - protein, 8 aa, Mycobacterium
YRPETSRR

SEQ ID NO: 295879 - protein, 4 aa, Mycobacterium
YRPG

SEQ ID NO: 295880 - protein, 25 aa, Mycobacterium
YRPGQSPATETDDLAPNSLEGQHQA

SEQ ID NO: 295881 - protein, 5 aa, Mycobacterium
YRPGR

SEQ ID NO: 295882 - protein, 5 aa, Mycobacterium
YRPRA

SEQ ID NO: 295883 - protein, 7 aa, Mycobacterium
YRPSYND

SEQ ID NO: 295884 - protein, 19 aa, Mycobacterium
YRQAKAGHTVRASAAARFL

SEQ ID NO: 295885 - protein, 7 aa, Mycobacterium
YRQEPRN

SEQ ID NO: 295886 - protein, 8 aa, Mycobacterium
YRRQGDPT

SEQ ID NO: 295887 - protein, 4 aa, Mycobacterium
YRSA

SEQ ID NO: 295888 - protein, 4 aa, Mycobacterium
YRSD

SEQ ID NO: 295889 - protein, 8 aa, Mycobacterium
YRSDNRIT

SEQ ID NO: 295890 - protein, 5 aa, Mycobacterium
YRSDR

SEQ ID NO: 295891 - protein, 10 aa, Mycobacterium
YRSEPGVPPD

SEQ ID NO: 295892 - protein, 9 aa, Mycobacterium
YRSPDASTA

SEQ ID NO: 295893 - protein, 18 aa, Mycobacterium
YRSRGRDKDRDKDEAALS

SEQ ID NO: 295894 - protein, 10 aa, Mycobacterium
YRSRPDRRGA

SEQ ID NO: 295895 - protein, 9 aa, Mycobacterium
YRSSGGLSD

SEQ ID NO: 295896 - protein, 17 aa, Mycobacterium
YRTGDPNKCDTFATNDL

SEQ ID NO: 295897 - protein, 8 aa, Mycobacterium
YRTNYDSK

SEQ ID NO: 295898 - protein, 24 aa, Mycobacterium
YRTNYNDRDYQPADLPANSGYAAA

SEQ ID NO: 295899 - protein, 11 aa, Mycobacterium
YRTNYNDRNYL

SEQ ID NO: 295900 - protein, 7 aa, Mycobacterium
YRTSSGA

SEQ ID NO: 295901 - protein, 5 aa, Mycobacterium
YRTTY

SEQ ID NO: 295902 - protein, 4 aa, Mycobacterium
YRYP

SEQ ID NO: 295903 - protein, 6 aa, Mycobacterium
YSAGGG

SEQ ID NO: 295904 - protein, 7 aa, Mycobacterium
YSAGPGN

SEQ ID NO: 295905 - protein, 15 aa, Mycobacterium
YSAPEAEQYTAGPYV

SEQ ID NO: 295906 - protein, 8 aa, Mycobacterium
YSAPESEQ

SEQ ID NO: 295907 - protein, 10 aa, Mycobacterium
YSDDDPTQLS

SEQ ID NO: 295908 - protein, 7 aa, Mycobacterium
YSDQITD

SEQ ID NO: 295909 - protein, 9 aa, Mycobacterium
YSDRAGTEY

SEQ ID NO: 295910 - protein, 20 aa, Mycobacterium
YSEDQTLDDDPKTTGRTDAA

SEQ ID NO: 295911 - protein, 10 aa, Mycobacterium
YSEGGNSAGW

SEQ ID NO: 295912 - protein, 6 aa, Mycobacterium
YSEHPA

SEQ ID NO: 295913 - protein, 7 aa, Mycobacterium
YSEHPAT

SEQ ID NO: 295914 - protein, 8 aa, Mycobacterium
YSENPAGS

SEQ ID NO: 295915 - protein, 17 aa, Mycobacterium
YSEPRLQPPNGYKDTTV

SEQ ID NO: 295916 - protein, 9 aa, Mycobacterium
YSESPGGAY

SEQ ID NO: 295917 - protein, 8 aa, Mycobacterium
YSGGLGSP

SEQ ID NO: 295918 - protein, 7 aa, Mycobacterium
YSGGMPP

SEQ ID NO: 295919 - protein, 13 aa, Mycobacterium
YSGLDGSRERRDG

SEQ ID NO: 295920 - protein, 8 aa, Mycobacterium
YSGNTAAT

SEQ ID NO: 295921 - protein, 15 aa, Mycobacterium
YSGQSARDQQAGART

SEQ ID NO: 295922 - protein, 11 aa, Mycobacterium
YSGTQAAQERL

SEQ ID NO: 295923 - protein, 9 aa, Mycobacterium
YSHGSSNPL

SEQ ID NO: 295924 - protein, 8 aa, Mycobacterium
YSKPPQSG

SEQ ID NO: 295925 - protein, 7 aa, Mycobacterium
YSNSNGG

SEQ ID NO: 295926 - protein, 6 aa, Mycobacterium
YSNTTA

SEQ ID NO: 295927 - protein, 7 aa, Mycobacterium
YSPAEPY

SEQ ID NO: 295928 - protein, 4 aa, Mycobacterium
YSPD

SEQ ID NO: 295929 - protein, 9 aa, Mycobacterium
YSPDTGANV

SEQ ID NO: 295930 - protein, 19 aa, Mycobacterium
YSPFVPKPEASSEAKGIDQ

SEQ ID NO: 295931 - protein, 7 aa, Mycobacterium
YSPGQPV

SEQ ID NO: 295932 - protein, 8 aa, Mycobacterium
YSPIPPSM

SEQ ID NO: 295933 - protein, 4 aa, Mycobacterium
YSPN

SEQ ID NO: 295934 - protein, 6 aa, Mycobacterium
YSPPHT

SEQ ID NO: 295935 - protein, 7 aa, Mycobacterium
YSPPRAP

SEQ ID NO: 295936 - protein, 8 aa, Mycobacterium
YSPPTAPV

SEQ ID NO: 295937 - protein, 8 aa, Mycobacterium
YSPPTSQV

SEQ ID NO: 295938 - protein, 7 aa, Mycobacterium
YSPQPSA

SEQ ID NO: 295939 - protein, 5 aa, Mycobacterium
YSPSA

SEQ ID NO: 295940 - protein, 8 aa, Mycobacterium
YSPSDNDL

SEQ ID NO: 295941 - protein, 7 aa, Mycobacterium
YSPSRRR

SEQ ID NO: 295942 - protein, 8 aa, Mycobacterium
YSPSTGQA

SEQ ID NO: 295943 - protein, 7 aa, Mycobacterium
YSQAGEN

SEQ ID NO: 295944 - protein, 11 aa, Mycobacterium
YSQAVEESQYQ

SEQ ID NO: 295945 - protein, 10 aa, Mycobacterium
YSQEPEAEPW

SEQ ID NO: 295946 - protein, 5 aa, Mycobacterium
YSQGE

SEQ ID NO: 295947 - protein, 21 aa, Mycobacterium
YSRGGEKPDGRLYPEDQPDRV

SEQ ID NO: 295948 - protein, 22 aa, Mycobacterium
YSRGGEKPDGRLYPEDQPDRVN

SEQ ID NO: 295949 - protein, 17 aa, Mycobacterium
YSSGDTRGTQFIGYTYC

SEQ ID NO: 295950 - protein, 7 aa, Mycobacterium
YSSPEPY

SEQ ID NO: 295951 - protein, 7 aa, Mycobacterium
YSSRGKT

SEQ ID NO: 295952 - protein, 15 aa, Mycobacterium
YSSSSWPHSSSPPIE

SEQ ID NO: 295953 - protein, 4 aa, Mycobacterium
YSTG

SEQ ID NO: 295954 - protein, 11 aa, Mycobacterium
YSTNGGRDTTV

SEQ ID NO: 295955 - protein, 10 aa, Mycobacterium
YSYDQDGSPW

SEQ ID NO: 295956 - protein, 7 aa, Mycobacterium
YSYEDPD

SEQ ID NO: 295957 - protein, 4 aa, Mycobacterium
YTAA

SEQ ID NO: 295958 - protein, 15 aa, Mycobacterium
YTADPSEQPKADGEG

SEQ ID NO: 295959 - protein, 12 aa, Mycobacterium
YTAKGGPAGVGA

SEQ ID NO: 295960 - protein, 8 aa, Mycobacterium
YTAPAAAG

SEQ ID NO: 295961 - protein, 8 aa, Mycobacterium
YTAPAGAG

SEQ ID NO: 295962 - protein, 8 aa, Mycobacterium
YTAPGGPD

SEQ ID NO: 295963 - protein, 9 aa, Mycobacterium
YTAQESTKA

SEQ ID NO: 295964 - protein, 4 aa, Mycobacterium
YTAV

SEQ ID NO: 295965 - protein, 5 aa, Mycobacterium
YTDAQ

SEQ ID NO: 295966 - protein, 20 aa, Mycobacterium
YTDGNGGQEKTADVTLGEVA

SEQ ID NO: 295967 - protein, 5 aa, Mycobacterium
YTDGT

SEQ ID NO: 295968 - protein, 10 aa, Mycobacterium
YTEEPGQARG

SEQ ID NO: 295969 - protein, 10 aa, Mycobacterium
YTEQPGQARG

SEQ ID NO: 295970 - protein, 11 aa, Mycobacterium
YTERASRATAE

SEQ ID NO: 295971 - protein, 5 aa, Mycobacterium
YTEVP

SEQ ID NO: 295972 - protein, 44 aa, Mycobacterium
YTGAGPQPQPQPQPQPQPPPPIAPRPQYPTENETAVRPVPSGLQ

SEQ ID NO: 295973 - protein, 5 aa, Mycobacterium
YTGAS

SEQ ID NO: 295974 - protein, 13 aa, Mycobacterium
YTGAVSKAEPPLG

SEQ ID NO: 295975 - protein, 21 aa, Mycobacterium
YTGDGEATAQQVAADRATTSN

SEQ ID NO: 295976 - protein, 12 aa, Mycobacterium
YTGEEPAERPNP

SEQ ID NO: 295977 - protein, 8 aa, Mycobacterium
YTGGGGKQ

SEQ ID NO: 295978 - protein, 9 aa, Mycobacterium
YTGGGTKEV

SEQ ID NO: 295979 - protein, 5 aa, Mycobacterium
YTGNR

SEQ ID NO: 295980 - protein, 7 aa, Mycobacterium
YTGRNVP

SEQ ID NO: 295981 - protein, 10 aa, Mycobacterium
YTGVEQPPTT

SEQ ID NO: 295982 - protein, 9 aa, Mycobacterium
YTHDAGERE

SEQ ID NO: 295983 - protein, 8 aa, Mycobacterium
YTHPTSGT

SEQ ID NO: 295984 - protein, 11 aa, Mycobacterium
YTKAVSKAEPE

SEQ ID NO: 295985 - protein, 13 aa, Mycobacterium
YTKAVSKAEPPLG

SEQ ID NO: 295986 - protein, 11 aa, Mycobacterium
YTKRASDTAPA

SEQ ID NO: 295987 - protein, 29 aa, Mycobacterium
YTLTTDRGAEPELGPQPDFPRRRGRDLAP

SEQ ID NO: 295988 - protein, 18 aa, Mycobacterium
YTLTTDRSAEPDLGPQPD

SEQ ID NO: 295989 - protein, 4 aa, Mycobacterium
YTPA

SEQ ID NO: 295990 - protein, 10 aa, Mycobacterium
YTPANVPSNI

SEQ ID NO: 295991 - protein, 11 aa, Mycobacterium
YTPEDSSYETT

SEQ ID NO: 295992 - protein, 8 aa, Mycobacterium
YTPGGGFP

SEQ ID NO: 295993 - protein, 9 aa, Mycobacterium
YTPPGVPPL

SEQ ID NO: 295994 - protein, 7 aa, Mycobacterium
YTPPSPF

SEQ ID NO: 295995 - protein, 29 aa, Mycobacterium
YTPQCASATESVSCSDAGDGSTWSAANAR

SEQ ID NO: 295996 - protein, 7 aa, Mycobacterium
YTPQRTM

SEQ ID NO: 295997 - protein, 10 aa, Mycobacterium
YTPRTDDTDI

SEQ ID NO: 295998 - protein, 8 aa, Mycobacterium
YTPSRASK

SEQ ID NO: 295999 - protein, 8 aa, Mycobacterium
YTPTPNNI

SEQ ID NO: 296000 - protein, 5 aa, Mycobacterium
YTREG

SEQ ID NO: 296001 - protein, 9 aa, Mycobacterium
YTRGDDYGA

SEQ ID NO: 296002 - protein, 10 aa, Mycobacterium
YTRGGGSDMG

SEQ ID NO: 296003 - protein, 9 aa, Mycobacterium
YTRPSAGSI

SEQ ID NO: 296004 - protein, 7 aa, Mycobacterium
YTRSEPV

SEQ ID NO: 296005 - protein, 5 aa, Mycobacterium
YTRTD

SEQ ID NO: 296006 - protein, 8 aa, Mycobacterium
YTSGPQFE

SEQ ID NO: 296007 - protein, 4 aa, Mycobacterium
YTSN

SEQ ID NO: 296008 - protein, 5 aa, Mycobacterium
YTSSR

SEQ ID NO: 296009 - protein, 9 aa, Mycobacterium
YTTGPAHRT

SEQ ID NO: 296010 - protein, 7 aa, Mycobacterium
YTTPAEG

SEQ ID NO: 296011 - protein, 6 aa, Mycobacterium
YTTPDL

SEQ ID NO: 296012 - protein, 9 aa, Mycobacterium
YTTPSAGSV

SEQ ID NO: 296013 - protein, 10 aa, Mycobacterium
YTTPSSGSVT

SEQ ID NO: 296014 - protein, 5 aa, Mycobacterium
YTTPY

SEQ ID NO: 296015 - protein, 7 aa, Mycobacterium
YTTPYHE

SEQ ID NO: 296016 - protein, 5 aa, Mycobacterium
YTTSS

SEQ ID NO: 296017 - protein, 21 aa, Mycobacterium
YTTSYNNRDYTPGFTPANQGF

SEQ ID NO: 296018 - protein, 9 aa, Mycobacterium
YTTTSTGAR

SEQ ID NO: 296019 - protein, 4 aa, Mycobacterium
YTYP

SEQ ID NO: 296020 - protein, 10 aa, Mycobacterium
YVGPGQSIPA

SEQ ID NO: 296021 - protein, 4 aa, Mycobacterium
YVGS

SEQ ID NO: 296022 - protein, 6 aa, Mycobacterium
YVGSDQ

SEQ ID NO: 296023 - protein, 11 aa, Mycobacterium
YVGSGADPAAI

SEQ ID NO: 296024 - protein, 5 aa, Mycobacterium
YVGSY

SEQ ID NO: 296025 - protein, 4 aa, Mycobacterium
YVPG

SEQ ID NO: 296026 - protein, 15 aa, Mycobacterium
YVPGQGSDLDPSNLP

SEQ ID NO: 296027 - protein, 22 aa, Mycobacterium
YVPPAGVDANGDGSKAGPQIPK

SEQ ID NO: 296028 - protein, 20 aa, Mycobacterium
YVPPATAETNGDGSGPSTQF

SEQ ID NO: 296029 - protein, 5 aa, Mycobacterium
YVPPD

SEQ ID NO: 296030 - protein, 21 aa, Mycobacterium
YVPYGPARRTVSSGGGGAAPR

SEQ ID NO: 296031 - protein, 4 aa, Mycobacterium
YVSN

SEQ ID NO: 296032 - protein, 11 aa, Mycobacterium
YYGGDNANGYD

SEQ ID NO: 296033 - protein, 9 aa, Mycobacterium
YYGGSDAAG

SEQ ID NO: 296034 - protein, 10 aa, Mycobacterium
YYGGSDANGF

SEQ ID NO: 296035 - protein, 12 aa, Mycobacterium
YYGGSNAQGLDY

SEQ ID NO: 296036 - protein, 5 aa, Mycobacterium
YYGQF

SEQ ID NO: 296037 - protein, 9 aa, Mycobacterium
YYPDAEPAR

SEQ ID NO: 296038 - protein, 9 aa, Mycobacterium
YYPDAQPAR

SEQ ID NO: 296039 - protein, 8 aa, Mycobacterium
YYPGAQPA

SEQ ID NO: 296040 - protein, 11 aa, Mycobacterium
YYSNNGGRDTA

SEQ ID NO: 296041 - protein, 5 aa, Mycobacterium
YYSTQ

SEQ ID NO: 296042 - protein, 30 aa, Mycobacterium; identical to SEQ ID NO: 10389

SEQ ID NO: 296043 - protein, 17 aa, Mycobacterium
IVSEIFPVFSRKPIFGY

SEQ ID NO: 296044 - protein, 20 aa, Mycobacterium
EAEGGMGPHGLMIGMTGSGK

SEQ ID NO: 296045 - protein, 26 aa, Mycobacterium
GVLLWQHLFWFFGHPEVYIIALPFFG

SEQ ID NO: 296046 - protein, 20 aa, Mycobacterium
AVTGCTRGPTVTRYEVELGP

SEQ ID NO: 296047 - protein, 23 aa, Mycobacterium
PDLPEYRTGLIIVGLARCIAMVI

SEQ ID NO: 296048 - protein, 23 aa, Mycobacterium
RLGKLHFWLTFIGFHTTFLVQHW

SEQ ID NO: 296049 - protein, 24 aa, Mycobacterium
VPTGIKFFNWIGTMWKGQLTFETP

SEQ ID NO: 296050 - protein, 17 aa, Mycobacterium
WIGTMWKGQLTFETPML

SEQ ID NO: 296051 - protein, 20 aa, Mycobacterium
AASPCALAISVPVTVVAAIG

SEQ ID NO: 296052 - protein, 18 aa, Mycobacterium
ATVIGLLTILGFSLYDTV

SEQ ID NO: 296053 - protein, 24 aa, Mycobacterium
ERLGKLHFWLTFIGFHTTFLVQHW

SEQ ID NO: 296054 - protein, 17 aa, Mycobacterium
FAAGRLYTTLSVADAAA

SEQ ID NO: 296055 - protein, 17 aa, Mycobacterium
FALSGFLLWRGHAAAAR

SEQ ID NO: 296056 - protein, 20 aa, Mycobacterium
IAPELYLKRLCVGGVERVFE

SEQ ID NO: 296057 - protein, 24 aa, Mycobacterium
PHEECEVLVGLGMRTWADGRTLLL

SEQ ID NO: 296058 - protein, 18 aa, Mycobacterium
RVPERDPRTEVGRLSLAL

SEQ ID NO: 296059 - protein, 18 aa, Mycobacterium
VTLSIQFALLAGQVGATS

SEQ ID NO: 296060 - protein, 20 aa, Mycobacterium
YLRFRREAQNAAALNHPAIV

SEQ ID NO: 296061 - protein, 19 aa, Mycobacterium
AFDNPDFQTGLRMFLSPDG

SEQ ID NO: 296062 - protein, 20 aa, Mycobacterium
ALHECGHMWVARATGMKVRR

SEQ ID NO: 296063 - protein, 19 aa, Mycobacterium
ATESVRMLAPIPGKSAVGI

SEQ ID NO: 296064 - protein, 24 aa, Mycobacterium
ATGAGKGSVLWSLIAGIAPAVKTG

SEQ ID NO: 296065 - protein, 29 aa, Mycobacterium
ATPYELAATIARRLGLTGALGTVAESVDG

SEQ ID NO: 296066 - protein, 31 aa, Mycobacterium; identical to SEQ ID NO: 10665

SEQ ID NO: 296067 - protein, 22 aa, Mycobacterium
DFLSVGWWPVFNVADPSVVGGA

SEQ ID NO: 296068 - protein, 19 aa, Mycobacterium
DLFLRIAPELYLKRLCVGG

SEQ ID NO: 296069 - protein, 26 aa, Mycobacterium
DPQQRMALELTWEALEHARIPASSLR

SEQ ID NO: 296070 - protein, 23 aa, Mycobacterium
EASRRIELHVGRDLQFIRINGTV

SEQ ID NO: 296071 - protein, 26 aa, Mycobacterium
EEDKGLRTRSEMIAQLVFAMGGRAAE

SEQ ID NO: 296072 - protein, 17 aa, Mycobacterium
EWNEAWRSDQFVLDATR

SEQ ID NO: 296073 - protein, 21 aa, Mycobacterium
FVVPYPPGFPVLVPGQVVSKE

SEQ ID NO: 296074 - protein, 20 aa, Mycobacterium
GDVFGLRRWYVITFLMGLFF

SEQ ID NO: 296075 - protein, 23 aa, Mycobacterium
GMSEVHLARDLRLHRDVAVKVLR

SEQ ID NO: 296076 - protein, 18 aa, Mycobacterium
GRLFTPFFITVGLVEAAY

SEQ ID NO: 296077 - protein, 21 aa, Mycobacterium
HELRTPLTTIRGFAELYRQGA

SEQ ID NO: 296078 - protein, 17 aa, Mycobacterium
IGLLTILGFSLYDTVIV

SEQ ID NO: 296079 - protein, 29 aa, Mycobacterium
IRGKMKGGPLPRGRGLLMAEDTGVFVQVA

SEQ ID NO: 296080 - protein, 19 aa, Mycobacterium
KPFVRQIRTTRQMQELQPQ

SEQ ID NO: 296081 - protein, 24 aa, Mycobacterium
KVNQAGVIPVIFASSLIYIPHLIT

SEQ ID NO: 296082 - protein, 18 aa, Mycobacterium
LDLLLAIVRRTRAGRSAF

SEQ ID NO: 296083 - protein, 25 aa, Mycobacterium
LLVSIPFTVLVAFTLNILLREIGAA

SEQ ID NO: 296084 - protein, 28 aa, Mycobacterium
LLVYVLPLLLLVGLFVMFSRMQGGARMG

SEQ ID NO: 296085 - protein, 18 aa, Mycobacterium
LMENMGYRLVLKARTAGA

SEQ ID NO: 296086 - protein, 21 aa, Mycobacterium
LNAAFRYALVRLRDAAEAVGF

SEQ ID NO: 296087 - protein, 24 aa, Mycobacterium
LNERELRAVLGHELSHVYNRDILI

SEQ ID NO: 296088 - protein, 23 aa, Mycobacterium
LNVDKAKSVIVLKRSMNSGFAGI

SEQ ID NO: 296089 - protein, 22 aa, Mycobacterium
LPDDLLSGIGLRAALSSITLGM

SEQ ID NO: 296090 - protein, 18 aa, Mycobacterium
LREVHALLYHEVFDTLGS

SEQ ID NO: 296091 - protein, 20 aa, Mycobacterium
LSLTAAFGALVWIFQDGHLG

SEQ ID NO: 296092 - protein, 18 aa, Mycobacterium
PGDIVLIDRNCHKSHHYG

SEQ ID NO: 296093 - protein, 23 aa, Mycobacterium
PTGIKFFNWIGTMWKGQLTFETP

SEQ ID NO: 296094 - protein, 17 aa, Mycobacterium
QHDKLPPSINFAGPSPY

SEQ ID NO: 296095 - protein, 19 aa, Mycobacterium
RALLYKPFVRQIRTTRQMQ

SEQ ID NO: 296096 - protein, 20 aa, Mycobacterium
RQAKFALAHGGIFGDGLGQG

SEQ ID NO: 296097 - protein, 19 aa, Mycobacterium
RQGRAYWIHLMMASQTIES

SEQ ID NO: 296098 - protein, 18 aa, Mycobacterium
RRRFFGYLNLFLASMLLL

SEQ ID NO: 296099 - protein, 19 aa, Mycobacterium
SERQRLRDLFGRYVGEDVA

SEQ ID NO: 296100 - protein, 19 aa, Mycobacterium
SHHYGLVLAGAYPLYLDAY

SEQ ID NO: 296101 - protein, 25 aa, Mycobacterium
SMLQRKLRVGFAKAGRLMDLMETRG

SEQ ID NO: 296102 - protein, 19 aa, Mycobacterium
SPASRAVAQIVLLDNRFAT

SEQ ID NO: 296103 - protein, 24 aa, Mycobacterium
SQDRGWVVLLARYQRPKAIRQSGV

SEQ ID NO: 296104 - protein, 22 aa, Mycobacterium
SQFDALHFAKPIFGPAARALAQ

SEQ ID NO: 296105 - protein, 20 aa, Mycobacterium
TPFLIISVLFYFTVVVQEKM

SEQ ID NO: 296106 - protein, 31 aa, Mycobacterium; identical to SEQ ID NO: 12485

SEQ ID NO: 296107 - protein, 18 aa, Mycobacterium
VGEAAMLAFLFSISEGLE

SEQ ID NO: 296108 - protein, 17 aa, Mycobacterium
VHHFGLFAAVGAAMAAL

SEQ ID NO: 296109 - protein, 22 aa, Mycobacterium
VIDEFYEWFRIMPTAVDVLDSI

SEQ ID NO: 296110 - protein, 26 aa, Mycobacterium
VPTGIKFFNWIGTMWKGQLTFETPML

SEQ ID NO: 296111 - protein, 17 aa, Mycobacterium
VTGKALQEFGRYQSVVY

SEQ ID NO: 296112 - protein, 17 aa, Mycobacterium
WQFGITTVYHFIFVPLT

SEQ ID NO: 296113 - protein, 19 aa, Mycobacterium
YLPPEAFDNPDFQTGLRMF

SEQ ID NO: 296114 - protein, 24 aa, Mycobacterium
YQALGAKIPKGVLLYGPPGTGKTL

SEQ ID NO: 296115 - protein, 18 aa, Mycobacterium
YSFLPSWLSFLVDKENAR

SEQ ID NO: 296116 - protein, 21 aa, Mycobacterium
AAFCYAAAVVTELGGPMSHAA

SEQ ID NO: 296117 - protein, 21 aa, Mycobacterium
AAYTRRTEIGIMRLVGASRWY

SEQ ID NO: 296118 - protein, 17 aa, Mycobacterium
AGALVMIGGTVGVAAFL

SEQ ID NO: 296119 - protein, 24 aa, Mycobacterium
AIRALRESRDWSLADLAAATGVSI

SEQ ID NO: 296120 - protein, 18 aa, Mycobacterium
ALLSAIGIAGMDRLVQRN

SEQ ID NO: 296121 - protein, 22 aa, Mycobacterium
AMGGRAAEELVFREPTTGAVSD

SEQ ID NO: 296122 - protein, 20 aa, Mycobacterium
ASLFAAIIGSISFWGSIIAF

SEQ ID NO: 296123 - protein, 24 aa, Mycobacterium
ATVAFPMYFLKSFAYAGVATVAFV

SEQ ID NO: 296124 - protein, 17 aa, Mycobacterium
AVLRVWPVPVVMVVPGV

SEQ ID NO: 296125 - protein, 25 aa, Mycobacterium
AYSEPRLQPPNGYKDTTVPGIWVPD

SEQ ID NO: 296126 - protein, 17 aa, Mycobacterium
CRAGIGVAAGQVVAGNV

SEQ ID NO: 296127 - protein, 23 aa, Mycobacterium
DALEVRGRILSAFEQAERSRDPE

SEQ ID NO: 296128 - protein, 24 aa, Mycobacterium
DVRIPRNRAVVMLVIDVSQSMRAT

SEQ ID NO: 296129 - protein, 25 aa, Mycobacterium
DVVPSRLRRPGAVVLEIDDEDPIFE

SEQ ID NO: 296130 - protein, 18 aa, Mycobacterium
EAASAYFAGGLSLRDATR

SEQ ID NO: 296131 - protein, 26 aa, Mycobacterium
EGDGRAWKCTLCYDRLHDGLEPACAK

SEQ ID NO: 296132 - protein, 20 aa, Mycobacterium
EIEQLLGLLLSQGRAVGISV

SEQ ID NO: 296133 - protein, 19 aa, Mycobacterium
ELQPIIQRLMRIHVTEEAR

SEQ ID NO: 296134 - protein, 20 aa, Mycobacterium
EQIMPLLVVAVMSQLVFSGG

SEQ ID NO: 296135 - protein, 17 aa, Mycobacterium
FAPNFTVLVILRLLYGI

SEQ ID NO: 296136 - protein, 23 aa, Mycobacterium
FAVLCGAASYIAVPAVQRLAIPE

SEQ ID NO: 296137 - protein, 20 aa, Mycobacterium
FGNDHFAEFAPGMKSIDDAL

SEQ ID NO: 296138 - protein, 17 aa, Mycobacterium
FKYGYGFHPMLAFVDHG

SEQ ID NO: 296139 - protein, 17 aa, Mycobacterium
FLCAFAPNFTVLVILRL

SEQ ID NO: 296140 - protein, 23 aa, Mycobacterium
FRLNCASCHNFTGKGGALSSGKY

SEQ ID NO: 296141 - protein, 30 aa, Mycobacterium
FSVGHALEGYAMGRARRAIEALAELAPKTA

SEQ ID NO: 296142 - protein, 20 aa, Mycobacterium
FTAHPARRWEPKRLRLRLLA

SEQ ID NO: 296143 - protein, 17 aa, Mycobacterium
FTANVFALMGLRQLYFL

SEQ ID NO: 296144 - protein, 24 aa, Mycobacterium
FTISSVLCAVAWDEATMVIARLSQ

SEQ ID NO: 296145 - protein, 23 aa, Mycobacterium
FVWNVFKSWRYGEVVTVDDPWGY

SEQ ID NO: 296146 - protein, 18 aa, Mycobacterium
GAAMAFSSVFVVGNSLRL

SEQ ID NO: 296147 - protein, 21 aa, Mycobacterium
GAKIPRGVLLYGPPGTGKTLL

SEQ ID NO: 296148 - protein, 20 aa, Mycobacterium
GAPEKAAWGIALGLTVTLVW

SEQ ID NO: 296149 - protein, 18 aa, Mycobacterium
GAQLRLTDDNGWRITCFA

SEQ ID NO: 296150 - protein, 20 aa, Mycobacterium
GAYLSYIMCKAMNRSFISVI

SEQ ID NO: 296151 - protein, 21 aa, Mycobacterium
GEALAGLLRPGSAGSNSAADH

SEQ ID NO: 296152 - protein, 19 aa, Mycobacterium
GFAELYRQGAARDVAMLLS

SEQ ID NO: 296153 - protein, 18 aa, Mycobacterium
GGVGLSLGQRQRLGLARA

SEQ ID NO: 296154 - protein, 17 aa, Mycobacterium
GPTVTRYEVELGPGVKV

SEQ ID NO: 296155 - protein, 17 aa, Mycobacterium
GQPHLSATLGLLPDADA

SEQ ID NO: 296156 - protein, 23 aa, Mycobacterium
GQRRIPVQYAKRMVGRRMYGGTS

SEQ ID NO: 296157 - protein, 26 aa, Mycobacterium
GTCALAALCYAEFASTLPVAGSAYTF

SEQ ID NO: 296158 - protein, 25 aa, Mycobacterium
HARLIFERFGKFWGAFSVGDLLILN

SEQ ID NO: 296159 - protein, 19 aa, Mycobacterium
HGNSLEWATSCPPPRHNFT

SEQ ID NO: 296160 - protein, 19 aa, Mycobacterium
HITDLKLQYSVGFYGMPPI

SEQ ID NO: 296161 - protein, 22 aa, Mycobacterium
HNLFKPLLLFFYFGFLIPILKV

SEQ ID NO: 296162 - protein, 25 aa, Mycobacterium
HPLMSHLAELGWVCVAINYRHSPRN

SEQ ID NO: 296163 - protein, 24 aa, Mycobacterium
HSAAPLFHNIAGWLMQRENVPLSP

SEQ ID NO: 296164 - protein, 17 aa, Mycobacterium
IAYCLGLGIPFVLLAFG

SEQ ID NO: 296165 - protein, 27 aa, Mycobacterium
ICFLWDEAWYAFATAVPWARQRTAMVA

SEQ ID NO: 296166 - protein, 19 aa, Mycobacterium
IISCVKAALFGLIAGLVAC

SEQ ID NO: 296167 - protein, 22 aa, Mycobacterium
IISCVKAALFGLIAGLVACYRG

SEQ ID NO: 296168 - protein, 19 aa, Mycobacterium
ILVSLPISVTLSIQFALLA

SEQ ID NO: 296169 - protein, 20 aa, Mycobacterium
ILVTSILVLLAFPLLTAALF

SEQ ID NO: 296170 - protein, 22 aa, Mycobacterium
IPSDLLWSFLQAIVMSIAVMLV

SEQ ID NO: 296171 - protein, 17 aa, Mycobacterium
ISFEVRGGLFVRQVHHW

SEQ ID NO: 296172 - protein, 17 aa, Mycobacterium
ISRAQSLDVLSSMANIA

SEQ ID NO: 296173 - protein, 18 aa, Mycobacterium
ISTISFGTPYGFVEINDQ

SEQ ID NO: 296174 - protein, 17 aa, Mycobacterium
ITSGHKWRVLTVATADL

SEQ ID NO: 296175 - protein, 18 aa, Mycobacterium
IVMGLVFMGFFPALQRDA

SEQ ID NO: 296176 - protein, 24 aa, Mycobacterium
IVTVVASYSWYYAWTPGTGYLANL

SEQ ID NO: 296177 - protein, 26 aa, Mycobacterium
KDPVFLDWLVGLAFPCQRPFGHQNGV

SEQ ID NO: 296178 - protein, 18 aa, Mycobacterium
KRPIPATICLARRRTNVL

SEQ ID NO: 296179 - protein, 17 aa, Mycobacterium
LEEYSLARTRRGLRALL

SEQ ID NO: 296180 - protein, 17 aa, Mycobacterium
LKLQYSVGFYGMPPIVE

SEQ ID NO: 296181 - protein, 18 aa, Mycobacterium
LLHGLLMHSGNDAAHALA

SEQ ID NO: 296182 - protein, 22 aa, Mycobacterium
LLHRAKGGGLSTLFGGGVQSSL

SEQ ID NO: 296183 - protein, 19 aa, Mycobacterium
LLYRYYRTRDPLFWFTTSS

SEQ ID NO: 296184 - protein, 18 aa, Mycobacterium
LPSFAAELVAFSGAMFGL

SEQ ID NO: 296185 - protein, 22 aa, Mycobacterium
LRALVAPLYLLGTVVLNYGAAL

SEQ ID NO: 296186 - protein, 17 aa, Mycobacterium
LSGGYVFSVFLQGVNPG

SEQ ID NO: 296187 - protein, 19 aa, Mycobacterium
LTFGGLMLLGGRLGDTIGR

SEQ ID NO: 296188 - protein, 18 aa, Mycobacterium
LVALPLSLGIAIASGAPL

SEQ ID NO: 296189 - protein, 30 aa, Mycobacterium
LVFQYGLGKEIAWPVPLLAFIILVAVGADY

SEQ ID NO: 296190 - protein, 19 aa, Mycobacterium
LVGASRWYTQLPFLVEAML

SEQ ID NO: 296191 - protein, 17 aa, Mycobacterium
LVLAMTFGLSMDYEIFL

SEQ ID NO: 296192 - protein, 18 aa, Mycobacterium
LVLDGPLLPADWTVELNY

SEQ ID NO: 296193 - protein, 18 aa, Mycobacterium
LWVAFWFFLAQLNLILGA

SEQ ID NO: 296194 - protein, 17 aa, Mycobacterium
MDAFDYFIVVLVYADIA

SEQ ID NO: 296195 - protein, 22 aa, Mycobacterium
MDGFDPRAGVILIAATNRPDIL

SEQ ID NO: 296196 - protein, 17 aa, Mycobacterium
MFAFRYVIPADKWPEKL

SEQ ID NO: 296197 - protein, 27 aa, Mycobacterium
MFMEELFWGCAGIGLAIVMPALALSAI

SEQ ID NO: 296198 - protein, 17 aa, Mycobacterium
MIAQLVFAMGGRAAEEL

SEQ ID NO: 296199 - protein, 19 aa, Mycobacterium
MKKLTGWAAIIAVPTAITG

SEQ ID NO: 296200 - protein, 24 aa, Mycobacterium
NDGKEVPANLVGRDPKTDLAVLKV

SEQ ID NO: 296201 - protein, 18 aa, Mycobacterium
NIGIEALTGFLAAFINVR

SEQ ID NO: 296202 - protein, 27 aa, Mycobacterium
NNGLRPEPIIALGILLTWCSVERAVAT

SEQ ID NO: 296203 - protein, 22 aa, Mycobacterium
NTQPGWIVAPGMQGQQVGPITA

SEQ ID NO: 296204 - protein, 25 aa, Mycobacterium
PDILDPALLRPGRFDRQIPVSNPDL

SEQ ID NO: 296205 - protein, 24 aa, Mycobacterium
PDLPEYRTGLIIVGLARCIAMVII

SEQ ID NO: 296206 - protein, 17 aa, Mycobacterium
PEAMLDVINELRAAGAE

SEQ ID NO: 296207 - protein, 17 aa, Mycobacterium
PFLANSAGWVFTEMGRQ

SEQ ID NO: 296208 - protein, 18 aa, Mycobacterium
PFQYWSWANLACVVCAIG

SEQ ID NO: 296209 - protein, 27 aa, Mycobacterium
PIIKPAVVVALLFRTLDAFRIFDNIYV

SEQ ID NO: 296210 - protein, 17 aa, Mycobacterium
PPPARIVLFSDGKETMP

SEQ ID NO: 296211 - protein, 24 aa, Mycobacterium
PRESDIWLLGAIGPRMVYSTNLDA

SEQ ID NO: 296212 - protein, 24 aa, Mycobacterium
PTWPQCFPGSFTPVAVAEVPRIHQ

SEQ ID NO: 296213 - protein, 24 aa, Mycobacterium
PVFGFGVIFGAIWAEEAWGRYWGW

SEQ ID NO: 296214 - protein, 18 aa, Mycobacterium
PVLMDWAVGLAFPCQQPM

SEQ ID NO: 296215 - protein, 22 aa, Mycobacterium
QFVMPDLSGMFWTDAEPRLRAL

SEQ ID NO: 296216 - protein, 18 aa, Mycobacterium
QRLLSADFHQLAFATLVI

SEQ ID NO: 296217 - protein, 24 aa, Mycobacterium
QTLRTIYQNLGWAFGYNTAAIPLA

SEQ ID NO: 296218 - protein, 29 aa, Mycobacterium
QVSGWRFLLRRVEHAIVRRDTRMFDDPLQ

SEQ ID NO: 296219 - protein, 20 aa, Mycobacterium
REPRNIWVMIGVPALIVALI

SEQ ID NO: 296220 - protein, 20 aa, Mycobacterium
REVLPRLGPAVAASKPANWA

SEQ ID NO: 296221 - protein, 19 aa, Mycobacterium
RQVDIEGFQLVRQVYDMAL

SEQ ID NO: 296222 - protein, 17 aa, Mycobacterium
RRTNVLYALIRDNRTWQ

SEQ ID NO: 296223 - protein, 18 aa, Mycobacterium
RRYADYLPSDGFTTLNIV

SEQ ID NO: 296224 - protein, 18 aa, Mycobacterium
RTTMLVRAGDRWLGAIGL

SEQ ID NO: 296225 - protein, 19 aa, Mycobacterium
RTVDLRRKILFTLGIVVLY

SEQ ID NO: 296226 - protein, 20 aa, Mycobacterium
RVGARIILLNSEFSGPQIKE

SEQ ID NO: 296227 - protein, 18 aa, Mycobacterium
SATFLLRQQRIWGASTVV

SEQ ID NO: 296228 - protein, 17 aa, Mycobacterium
SDLRVLGQFGSTVCIGL

SEQ ID NO: 296229 - protein, 18 aa, Mycobacterium
SGMPVSQFTIAFMTVILL

SEQ ID NO: 296230 - protein, 23 aa, Mycobacterium
SLTARPGTLTAIIGGSGAGKTTL

SEQ ID NO: 296231 - protein, 23 aa, Mycobacterium
SRRLRRVMYMSALTAIRCDPDSK

SEQ ID NO: 296232 - protein, 19 aa, Mycobacterium
SSASRAVAQIVLLDNKFAT

SEQ ID NO: 296233 - protein, 17 aa, Mycobacterium
TADSFVVFFERIKDEIR

SEQ ID NO: 296234 - protein, 24 aa, Mycobacterium
TAKGGIVFRVQQELGVPVKLVGLG

SEQ ID NO: 296235 - protein, 17 aa, Mycobacterium
TKWVHHFGLFAAVGAAM

SEQ ID NO: 296236 - protein, 26 aa, Mycobacterium
TLLVAIPFTVLVSFTLNILLRELGAA

SEQ ID NO: 296237 - protein, 23 aa, Mycobacterium
TPTKWTHHFGVFAGLAGSLGALA

SEQ ID NO: 296238 - protein, 20 aa, Mycobacterium
TVNRGCVVQTHLFHDRIMRM

SEQ ID NO: 296239 - protein, 19 aa, Mycobacterium
VAGRLPGHMNVLLAEAKVP

SEQ ID NO: 296240 - protein, 22 aa, Mycobacterium
VAGRMPGHMNVLLAEAEVDYDA

SEQ ID NO: 296241 - protein, 23 aa, Mycobacterium
VASHELRTPLTAMRTNLEVLSTL

SEQ ID NO: 296242 - protein, 20 aa, Mycobacterium
VATPCPLLLAAPVAIVSGLS

SEQ ID NO: 296243 - protein, 18 aa, Mycobacterium
VEIGKQLLITRGALTTFS

SEQ ID NO: 296244 - protein, 17 aa, Mycobacterium
VGFLCAFAPNFTVLVIL

SEQ ID NO: 296245 - protein, 17 aa, Mycobacterium
VKAALFGLIAGLVACYR

SEQ ID NO: 296246 - protein, 24 aa, Mycobacterium
VLAWATSGINGWFYVGNYGVPWYD

SEQ ID NO: 296247 - protein, 18 aa, Mycobacterium
VLFLPYSLLGPFAGALMD

SEQ ID NO: 296248 - protein, 20 aa, Mycobacterium
VTLFPPVLALAAKRGIGEPK

SEQ ID NO: 296249 - protein, 20 aa, Mycobacterium
VTMGVAWSVLYIPIGGVGTI

SEQ ID NO: 296250 - protein, 19 aa, Mycobacterium
VYDMALVFRHRVRKDRLIS

SEQ ID NO: 296251 - protein, 25 aa, Mycobacterium
VYEGFPADVLYYFRLYALGTQVVIY

SEQ ID NO: 296252 - protein, 26 aa, Mycobacterium
WEPKRLRLRLLAVAGRIIHTGRRRLL

SEQ ID NO: 296253 - protein, 23 aa, Mycobacterium
WIRELRPHIDLYLLTDESIAAGD

SEQ ID NO: 296254 - protein, 25 aa, Mycobacterium
WLSSELMFFAGLFAMYFTARAQSGG

SEQ ID NO: 296255 - protein, 32 aa, Mycobacterium; identical to SEQ ID NO: 159772

SEQ ID NO: 296256 - protein, 20 aa, Mycobacterium
YCLGLGIPFVLLAFGSAGAV

SEQ ID NO: 296257 - protein, 21 aa, Mycobacterium
YEVAMGLSFAAVFLYAGSMST

SEQ ID NO: 296258 - protein, 18 aa, Mycobacterium
YSYLPSWLSFLVDKENAR

SEQ ID NO: 296259 - protein, 17 aa, Mycobacterium
AAAAAYCVADESIDAFR

SEQ ID NO: 296260 - protein, 17 aa, Mycobacterium
AAEAVGFYRGERVEGAQ

SEQ ID NO: 296261 - protein, 22 aa, Mycobacterium
AAESGFSRFPIVDGDLDETVGI

SEQ ID NO: 296262 - protein, 19 aa, Mycobacterium
AAGCMPVMIGWSAVTGTIQ

SEQ ID NO: 296263 - protein, 19 aa, Mycobacterium
AAGCMPVMIGWSAVTGTLA

SEQ ID NO: 296264 - protein, 35 aa, Mycobacterium
AAGFVFSWLRRRSGSLIAPIALHWSLNGLGALAAA

SEQ ID NO: 296265 - protein, 25 aa, Mycobacterium
AAGPSFWWGFGLVFAGQFLVALVFA

SEQ ID NO: 296266 - protein, 18 aa, Mycobacterium
AAGTGWRVSGLLRIDEVA

SEQ ID NO: 296267 - protein, 24 aa, Mycobacterium
AAHDLELLGYVGLADTARPSARPL

SEQ ID NO: 296268 - protein, 20 aa, Mycobacterium
AAILMLYTIVIIRGLRTAIA

SEQ ID NO: 296269 - protein, 21 aa, Mycobacterium
AALGPPLHRVFGLWNVQHLLG

SEQ ID NO: 296270 - protein, 20 aa, Mycobacterium
AALQRCGRVTAMVGDGANDA

SEQ ID NO: 296271 - protein, 20 aa, Mycobacterium
AAQIPLYMGYAFRGFNTHGR

SEQ ID NO: 296272 - protein, 24 aa, Mycobacterium
AARRFSGLALWCFAAMAVSGIVNA

SEQ ID NO: 296273 - protein, 24 aa, Mycobacterium
AAVFCVLGVLPLIVLTQLGIIVGL

SEQ ID NO: 296274 - protein, 27 aa, Mycobacterium
AAVSGWRSGALGSLLSFVGVLLGAIAG

SEQ ID NO: 296275 - protein, 26 aa, Mycobacterium
AAVTAVLAAWGWFALLLQITGAIAVV

SEQ ID NO: 296276 - protein, 21 aa, Mycobacterium
AAYTRRTEIGIMRLVGATRWY

SEQ ID NO: 296277 - protein, 22 aa, Mycobacterium
ADAPVRCPRILSQTGGNGDTLK

SEQ ID NO: 296278 - protein, 17 aa, Mycobacterium
ADGRCKAFAAAADGTGW

SEQ ID NO: 296279 - protein, 23 aa, Mycobacterium
ADPSRVRRSGGTGLGLAISIEDA

SEQ ID NO: 296280 - protein, 23 aa, Mycobacterium
ADRLLTAMICHLAVFHPPDLLQI

SEQ ID NO: 296281 - protein, 24 aa, Mycobacterium
ADSAVFKALFLGFMFAFAIKAPLW

SEQ ID NO: 296282 - protein, 19 aa, Mycobacterium
AEKLAALLTQPGRTYDVSS

SEQ ID NO: 296283 - protein, 19 aa, Mycobacterium
AEPQWGPPVGRVLATLLAE

SEQ ID NO: 296284 - protein, 19 aa, Mycobacterium
AERQRLRDLFGRYVGEDVA

SEQ ID NO: 296285 - protein, 34 aa, Mycobacterium
AFAAAYAGWAWLDPRSFHGWVTEPVRRRWLTWSR

SEQ ID NO: 296286 - protein, 33 aa, Mycobacterium
AFALQIKWLVPILWICVGLSVLLVGPRELLRRR

SEQ ID NO: 296287 - protein, 23 aa, Mycobacterium
AFARALPWLAGQLHTPGVAAVPL

SEQ ID NO: 296288 - protein, 18 aa, Mycobacterium
AFGTYLMRQFFRTLPTDL

SEQ ID NO: 296289 - protein, 20 aa, Mycobacterium
AFQWNWKFGYQRVDFKDGTL

SEQ ID NO: 296290 - protein, 19 aa, Mycobacterium
AGAVFAILPRVTWAGIEAR

SEQ ID NO: 296291 - protein, 18 aa, Mycobacterium
AGDSTLARVVRLVAEAQT

SEQ ID NO: 296292 - protein, 23 aa, Mycobacterium
AGKDSFPASFIVKLENPEQHKDF

SEQ ID NO: 296293 - protein, 23 aa, Mycobacterium
AGLAAICYAELASAVPVSGSSYS

SEQ ID NO: 296294 - protein, 24 aa, Mycobacterium
AGLIGGILWNLLTWLFGIPSSSSH

SEQ ID NO: 296295 - protein, 19 aa, Mycobacterium
AGLLLWFLIALPIGAVLGG

SEQ ID NO: 296296 - protein, 27 aa, Mycobacterium
AGLQTGSSFKVFALVAALEQGIGLGYQ

SEQ ID NO: 296297 - protein, 25 aa, Mycobacterium
AGLVGGIVWNLLTWLLGIPSSSSHA

SEQ ID NO: 296298 - protein, 26 aa, Mycobacterium
AGNAGPPRLWVWIALTVLACGVLVLG

SEQ ID NO: 296299 - protein, 26 aa, Mycobacterium
AGQVRLTGWLSARFGPSRSLVLGMLV

SEQ ID NO: 296300 - protein, 23 aa, Mycobacterium
AGSALPLLLLFSVANRSLGDVLT

SEQ ID NO: 296301 - protein, 19 aa, Mycobacterium
AHAPYLAWLTTTSADYAAT

SEQ ID NO: 296302 - protein, 28 aa, Mycobacterium
AIAFGGPGAMFWMWAVAFLGASTSFVEC

SEQ ID NO: 296303 - protein, 24 aa, Mycobacterium
AIEIAEAMRGMLQRIWNEQIRTKE

SEQ ID NO: 296304 - protein, 23 aa, Mycobacterium
AIIGSISFWGSIIAFGKLQEIIS

SEQ ID NO: 296305 - protein, 17 aa, Mycobacterium
AILYWEGLNTSFREIRA

SEQ ID NO: 296306 - protein, 17 aa, Mycobacterium
AISELDLSPVYLNFAEN

SEQ ID NO: 296307 - protein, 18 aa, Mycobacterium
AISGEYLSAASFLGVAGL

SEQ ID NO: 296308 - protein, 26 aa, Mycobacterium
AIVPARSLLGLAVGWFVGALVVLVVG

SEQ ID NO: 296309 - protein, 19 aa, Mycobacterium
AKEALKLTSLENADIYLGG

SEQ ID NO: 296310 - protein, 19 aa, Mycobacterium
ALDDPRAATPWTADIITGT

SEQ ID NO: 296311 - protein, 18 aa, Mycobacterium
ALGFLQDFFATAVFLGIA

SEQ ID NO: 296312 - protein, 18 aa, Mycobacterium
ALGMMVLSKSFSVLRSAV

SEQ ID NO: 296313 - protein, 37 aa, Mycobacterium
ALGVRTAFRVPFLRNWKVSRAYLNWLADRLQKTKTRE

SEQ ID NO: 296314 - protein, 22 aa, Mycobacterium
ALIPGRPAPRIITAEMVASMKA

SEQ ID NO: 296315 - protein, 18 aa, Mycobacterium
ALLGHFCDPTVALVAPRI

SEQ ID NO: 296316 - protein, 25 aa, Mycobacterium
ALLRWEPLRPFRFVGVTVVLTFVVF

SEQ ID NO: 296317 - protein, 22 aa, Mycobacterium
ALLWYAGLPLRVFATSLLAVFM

SEQ ID NO: 296318 - protein, 23 aa, Mycobacterium
ALVIAVLVWWHFVGANTSDDGYI

SEQ ID NO: 296319 - protein, 18 aa, Mycobacterium
ALVLLPLVLPPVVGGIAL

SEQ ID NO: 296320 - protein, 24 aa, Mycobacterium
AMEVMGVSVIRRLVVPRFAAAIMI

SEQ ID NO: 296321 - protein, 17 aa, Mycobacterium
AMFEGFFGYSLPDDLLS

SEQ ID NO: 296322 - protein, 23 aa, Mycobacterium
AMGGRAAEELVFREPTTGAVSDI

SEQ ID NO: 296323 - protein, 20 aa, Mycobacterium
AMVFAILVLLGRYINYTLDL

SEQ ID NO: 296324 - protein, 22 aa, Mycobacterium
AMVQDITRPLGIPIQHSSIPFQ

SEQ ID NO: 296325 - protein, 33 aa, Mycobacterium; identical to SEQ ID NO: 13037

SEQ ID NO: 296326 - protein, 24 aa, Mycobacterium
APFGWYYDLLAMWAHVSTASVWMR

SEQ ID NO: 296327 - protein, 19 aa, Mycobacterium
APLAMEGLFAFFFESTFIG

SEQ ID NO: 296328 - protein, 27 aa, Mycobacterium
APNVPLIDSWMCAISGRAKQFGMIQYF

SEQ ID NO: 296329 - protein, 24 aa, Mycobacterium
APVYWPAVVPLGIGCLIGSRLGPI

SEQ ID NO: 296330 - protein, 24 aa, Mycobacterium
AQSDIKRLLSFTLVSHIGYMVFGI

SEQ ID NO: 296331 - protein, 23 aa, Mycobacterium
ARDPEALAFIIGHEVGHIAAGHA

SEQ ID NO: 296332 - protein, 21 aa, Mycobacterium
ARIALPLLVYFAVMWGGGYLL

SEQ ID NO: 296333 - protein, 18 aa, Mycobacterium
ARKITWGEMEKGRRRYLR

SEQ ID NO: 296334 - protein, 17 aa, Mycobacterium
ARLVVPGLYGYVSATKW

SEQ ID NO: 296335 - protein, 20 aa, Mycobacterium
ARPADLLVLLDSLRQREGTL

SEQ ID NO: 296336 - protein, 20 aa, Mycobacterium
ARPAVMVLAVLTWVNVWNDF

SEQ ID NO: 296337 - protein, 20 aa, Mycobacterium
ARPYALSMMAAVWLTVLLVH

SEQ ID NO: 296338 - protein, 18 aa, Mycobacterium
ARRAGLRTNALVAGGATL

SEQ ID NO: 296339 - protein, 18 aa, Mycobacterium
ARRARRIMLQNVGLSLGL

SEQ ID NO: 296340 - protein, 26 aa, Mycobacterium
ARRGQLRAGTALIARGEFSLIIIGLV

SEQ ID NO: 296341 - protein, 19 aa, Mycobacterium
ARTRRGLRALLSLVPDEAT

SEQ ID NO: 296342 - protein, 18 aa, Mycobacterium
ARVKRLMDRIAAYERYWL

SEQ ID NO: 296343 - protein, 21 aa, Mycobacterium
ARVSLVPTLLVSIPFTVLVAF

SEQ ID NO: 296344 - protein, 17 aa, Mycobacterium
ASGRVAYVLGLEGPAVS

SEQ ID NO: 296345 - protein, 19 aa, Mycobacterium
ASHELRTPLTAMRTNLEVL

SEQ ID NO: 296346 - protein, 19 aa, Mycobacterium
ASLILAVLAFRHFGNAVLL

SEQ ID NO: 296347 - protein, 27 aa, Mycobacterium
ASLTVLRWSWTPALLAGGLMTLMPLAV

SEQ ID NO: 296348 - protein, 18 aa, Mycobacterium
ASSIDFPSLVKVKQIPTN

SEQ ID NO: 296349 - protein, 18 aa, Mycobacterium
ATFAGWTLLAANPVAGMT

SEQ ID NO: 296350 - protein, 17 aa, Mycobacterium
ATFGLPLLSDGIDIVVI

SEQ ID NO: 296351 - protein, 20 aa, Mycobacterium
ATTFPWVFLFPAGVLVLILV

SEQ ID NO: 296352 - protein, 24 aa, Mycobacterium
ATVMSRLMLVLGVAPVLAPSLGAA

SEQ ID NO: 296353 - protein, 17 aa, Mycobacterium
AVITMIIGVGVYLSAQD

SEQ ID NO: 296354 - protein, 22 aa, Mycobacterium
AVPLGGFCDIAGMTSVEELAPD

SEQ ID NO: 296355 - protein, 24 aa, Mycobacterium
AVVCVLTLTIAGPVRTYFAQRTEM

SEQ ID NO: 296356 - protein, 22 aa, Mycobacterium
AVVGVVVLLAWIPLRNRPGIGT

SEQ ID NO: 296357 - protein, 19 aa, Mycobacterium
AWLGCMYFGVPLVVMSPQA

SEQ ID NO: 296358 - protein, 25 aa, Mycobacterium
AYAPEEIFLMLSVAGLAAYSMAPWI

SEQ ID NO: 296359 - protein, 26 aa, Mycobacterium
AYHEGGHTLAAWAMPDIDPVYKVTIL

SEQ ID NO: 296360 - protein, 17 aa, Mycobacterium
CDLEQVIPLMPGAQLTG

SEQ ID NO: 296361 - protein, 25 aa, Mycobacterium
CLIGSRLGPIIVRHAPSTPLRWLIG

SEQ ID NO: 296362 - protein, 19 aa, Mycobacterium
CRAAFPMVEQLRAEYGDRV

SEQ ID NO: 296363 - protein, 19 aa, Mycobacterium
CVIDPKGGMELGAGAPLFT

SEQ ID NO: 296364 - protein, 23 aa, Mycobacterium
CYEDARLVPRVGVASVIAEGFLV

SEQ ID NO: 296365 - protein, 21 aa, Mycobacterium
CYHAAGIWRRGIVGHPIKVVK

SEQ ID NO: 296366 - protein, 19 aa, Mycobacterium
DAARFSFLLATPIILAAGV

SEQ ID NO: 296367 - protein, 20 aa, Mycobacterium
DAGLALGMFLMFSTFGTLSY

SEQ ID NO: 296368 - protein, 22 aa, Mycobacterium
DALLVTCLERLRAILVGHAGWP

SEQ ID NO: 296369 - protein, 25 aa, Mycobacterium
DATVVRMFLVPSVMKLLGDDCWWAP

SEQ ID NO: 296370 - protein, 20 aa, Mycobacterium
DAVPRISRAQSLDVLSSMAN

SEQ ID NO: 296371 - protein, 19 aa, Mycobacterium
DAVTERLPLVLGLMAAITF

SEQ ID NO: 296372 - protein, 17 aa, Mycobacterium
DDFAYLVDFGIANAATD

SEQ ID NO: 296373 - protein, 17 aa, Mycobacterium
DDFAYLVDFGIASATTD

SEQ ID NO: 296374 - protein, 27 aa, Mycobacterium
DDKGLMTRSEMIARLVFAMGGRAAEEL

SEQ ID NO: 296375 - protein, 21 aa, Mycobacterium
DELRVPIGVTATGEPLMFDLK

SEQ ID NO: 296376 - protein, 21 aa, Mycobacterium
DFECEACRAAFPMVEQLRAEY

SEQ ID NO: 296377 - protein, 18 aa, Mycobacterium
DGAVVAMLSLVPWGTTGV

SEQ ID NO: 296378 - protein, 20 aa, Mycobacterium
DGKTARFAIESSYDPYSSDA

SEQ ID NO: 296379 - protein, 23 aa, Mycobacterium
DGPYILVGWSLGGVLAYACAIGL

SEQ ID NO: 296380 - protein, 18 aa, Mycobacterium
DIGIEALTGFLAAFINVR

SEQ ID NO: 296381 - protein, 29 aa, Mycobacterium
DIGPQPAWRNLRFPLAWAPPEANVARIVA

SEQ ID NO: 296382 - protein, 20 aa, Mycobacterium
DLGVAFSWSLFNWIADVACL

SEQ ID NO: 296383 - protein, 19 aa, Mycobacterium
DLMLYALIMAFSFTTLSTY

SEQ ID NO: 296384 - protein, 18 aa, Mycobacterium
DMSPWANFSLGFTYLSPV

SEQ ID NO: 296385 - protein, 19 aa, Mycobacterium
DNLRGKWRVTPGVAATGHL

SEQ ID NO: 296386 - protein, 20 aa, Mycobacterium
DQASSILLTLALTVSIVNAM

SEQ ID NO: 296387 - protein, 17 aa, Mycobacterium
DQLAAWAGLAPVSRDSR

SEQ ID NO: 296388 - protein, 24 aa, Mycobacterium
DRDRLKIPFGHELKTGNVMYLDIK

SEQ ID NO: 296389 - protein, 19 aa, Mycobacterium
DRLGLIVGSAMGYEPEDLP

SEQ ID NO: 296390 - protein, 24 aa, Mycobacterium
DRYELGDILGFGGMSEVHLARDLR

SEQ ID NO: 296391 - protein, 24 aa, Mycobacterium
DRYELGEILGFGGMSEVHLARDLR

SEQ ID NO: 296392 - protein, 18 aa, Mycobacterium
DSAGMLITAHLMAPIPRP

SEQ ID NO: 296393 - protein, 23 aa, Mycobacterium
DSARRSGNEFLFQQLAAQAVETL

SEQ ID NO: 296394 - protein, 17 aa, Mycobacterium
DSILAWLSNGEGVVTAK

SEQ ID NO: 296395 - protein, 20 aa, Mycobacterium
DSRGYLLRDGELTQITKDDT

SEQ ID NO: 296396 - protein, 21 aa, Mycobacterium
DTLFVCSATGFLILTTGAYRV

SEQ ID NO: 296397 - protein, 23 aa, Mycobacterium
DTMGRSRLRAPFGNRSDNGELLF

SEQ ID NO: 296398 - protein, 18 aa, Mycobacterium
DVDIKLIARTTHHLFQPL

SEQ ID NO: 296399 - protein, 18 aa, Mycobacterium
DVKIADFGLVRAVAAAGI

SEQ ID NO: 296400 - protein, 20 aa, Mycobacterium
DYLPSDGFTTLNIVSTIGAF

SEQ ID NO: 296401 - protein, 20 aa, Mycobacterium
EAAMKYFLLGAFSSAFFLYG

SEQ ID NO: 296402 - protein, 20 aa, Mycobacterium
EAIKGTPWEGAKVYLGGTAA

SEQ ID NO: 296403 - protein, 19 aa, Mycobacterium
EALEPARLSDWFQDHPQSP

SEQ ID NO: 296404 - protein, 19 aa, Mycobacterium
EALTGFLAAFINVRISAPV

SEQ ID NO: 296405 - protein, 22 aa, Mycobacterium
EASRRIELHVGRDLQFIRINGT

SEQ ID NO: 296406 - protein, 20 aa, Mycobacterium
EATIPNFAVAGFLYGTVLLY

SEQ ID NO: 296407 - protein, 20 aa, Mycobacterium
EDFTWKGMLDFATCTECGRC

SEQ ID NO: 296408 - protein, 24 aa, Mycobacterium
EESNFPAIVKFLSEKVLSRETDRV

SEQ ID NO: 296409 - protein, 26 aa, Mycobacterium
EGEAMLFGEYIRLMALVEYSADEIKT

SEQ ID NO: 296410 - protein, 21 aa, Mycobacterium
EGRGANVFFMLGGQRLDLSSL

SEQ ID NO: 296411 - protein, 18 aa, Mycobacterium
EGSHYGWYGLLAGASIVF

SEQ ID NO: 296412 - protein, 18 aa, Mycobacterium
EIGIMRLVGATRWYTQLP

SEQ ID NO: 296413 - protein, 18 aa, Mycobacterium
EIGVPIFFVLSGYLLFRP

SEQ ID NO: 296414 - protein, 26 aa, Mycobacterium
EIPGCLVALYLVARLRHRGMDEAGYM

SEQ ID NO: 296415 - protein, 25 aa, Mycobacterium
EIRANARIIVFLSVALVIATAVAVS

SEQ ID NO: 296416 - protein, 19 aa, Mycobacterium
EITALRLLAPYLGLTLETS

SEQ ID NO: 296417 - protein, 20 aa, Mycobacterium
EIVLAVANLMWFVFAGFGAL

SEQ ID NO: 296418 - protein, 22 aa, Mycobacterium
EIVLLLFLPAILYWEGLNTSFR

SEQ ID NO: 296419 - protein, 21 aa, Mycobacterium
EKISFLPAMRYYAGNWATSVW

SEQ ID NO: 296420 - protein, 23 aa, Mycobacterium
ELADRYSLVSGMSLGHWEFYMAL

SEQ ID NO: 296421 - protein, 20 aa, Mycobacterium
ELGIILALLMGWQFTAAEFV

SEQ ID NO: 296422 - protein, 20 aa, Mycobacterium
EMPLHVFIGVILMMAPRTLT

SEQ ID NO: 296423 - protein, 18 aa, Mycobacterium
EQMLQWAPECFGTPGDLK

SEQ ID NO: 296424 - protein, 25 aa, Mycobacterium
ERFGRGWAWLSAFTLFASAIGALLT

SEQ ID NO: 296425 - protein, 20 aa, Mycobacterium
ERGIGNGMSLLIFVGIAARI

SEQ ID NO: 296426 - protein, 20 aa, Mycobacterium
ERHLPRIFTHLNPRTRNPVT

SEQ ID NO: 296427 - protein, 18 aa, Mycobacterium
ERLPLVLGLMAAITFVLL

SEQ ID NO: 296428 - protein, 24 aa, Mycobacterium
ERNLSVALNEVFAAFNPLDPQNLD

SEQ ID NO: 296429 - protein, 21 aa, Mycobacterium
ESAQAGFWSALSLPPLLLGML

SEQ ID NO: 296430 - protein, 22 aa, Mycobacterium
ESKGRVALYLLITIAPFAVIAP

SEQ ID NO: 296431 - protein, 17 aa, Mycobacterium
ESVRMLAPIPGKSAVGI

SEQ ID NO: 296432 - protein, 26 aa, Mycobacterium
ETATRRFLVDAAHELRTPIAGIQVAA

SEQ ID NO: 296433 - protein, 19 aa, Mycobacterium
EVIRLVRRLVPALVVVLAG

SEQ ID NO: 296434 - protein, 19 aa, Mycobacterium
EVLKCGAQVVLPADADGHA

SEQ ID NO: 296435 - protein, 18 aa, Mycobacterium
EWNEYLWPFLMSDDESVA

SEQ ID NO: 296436 - protein, 24 aa, Mycobacterium
FAACGIIGLGAALLIAALLLSTYT

SEQ ID NO: 296437 - protein, 19 aa, Mycobacterium
FAAFPGWYATVFSTLYLPL

SEQ ID NO: 296438 - protein, 18 aa, Mycobacterium
FAFAGVGVLLPRWSGDQY

SEQ ID NO: 296439 - protein, 19 aa, Mycobacterium
FAFFIPVYFAIVGLKLDLI

SEQ ID NO: 296440 - protein, 17 aa, Mycobacterium
FAGNRLGLVHIGDSRGY

SEQ ID NO: 296441 - protein, 17 aa, Mycobacterium
FAGYTIVRRLGAGGMGE

SEQ ID NO: 296442 - protein, 26 aa, Mycobacterium
FALASGRAMRALGWLRRNTRRIQVFG

SEQ ID NO: 296443 - protein, 21 aa, Mycobacterium
FAMQAGCRFTAQLGSMRIAEE

SEQ ID NO: 296444 - protein, 24 aa, Mycobacterium
FARTRTGELGNFWVDLVRGTLRIL

SEQ ID NO: 296445 - protein, 21 aa, Mycobacterium
FASISDWFLVATIPLAVMNLP

SEQ ID NO: 296446 - protein, 19 aa, Mycobacterium
FAVGGEWAGSALLSAEYAP

SEQ ID NO: 296447 - protein, 21 aa, Mycobacterium
FAVTMCAFVFSGFQVLGQIGT

SEQ ID NO: 296448 - protein, 19 aa, Mycobacterium
FDLAVAVFFALSGFLLWRG

SEQ ID NO: 296449 - protein, 20 aa, Mycobacterium
FDLSQCRTGADANEIVQCRV

SEQ ID NO: 296450 - protein, 20 aa, Mycobacterium
FDRISWPAAGLIAAGSLVGG

SEQ ID NO: 296451 - protein, 17 aa, Mycobacterium
FDSKVFVVSFVFNVLVA

SEQ ID NO: 296452 - protein, 19 aa, Mycobacterium
FETLLADLLEISRHDAGVA

SEQ ID NO: 296453 - protein, 21 aa, Mycobacterium
FETPMLFSIGFIVTFLLGGLS

SEQ ID NO: 296454 - protein, 22 aa, Mycobacterium
FEVRGGLFVRQIHHWAALMFAA

SEQ ID NO: 296455 - protein, 37 aa, Mycobacterium
FFHPIRSYFYWEPHCFDIPVCWSLRSIFDAIDGVDLM

SEQ ID NO: 296456 - protein, 18 aa, Mycobacterium
FFVTFLIRTIAWKTILAD

SEQ ID NO: 296457 - protein, 18 aa, Mycobacterium
FGELVPKYLAVARPLSTA

SEQ ID NO: 296458 - protein, 17 aa, Mycobacterium
FGGLMLLGGRLGDTIGR

SEQ ID NO: 296459 - protein, 25 aa, Mycobacterium
FGLPVLPLIIGVILGPRIERQLRQS

SEQ ID NO: 296460 - protein, 20 aa, Mycobacterium
FGMLRYCLQLFPDASTYFRP

SEQ ID NO: 296461 - protein, 19 aa, Mycobacterium
FGPTVSRLIDVGAIAADYS

SEQ ID NO: 296462 - protein, 18 aa, Mycobacterium
FGQGYAILLLAIWIGIGF

SEQ ID NO: 296463 - protein, 18 aa, Mycobacterium
FHIVERWQFHYSQVVKST

SEQ ID NO: 296464 - protein, 30 aa, Mycobacterium
FIAKLRLFRVPELLAGSFLLALLAVTSANF

SEQ ID NO: 296465 - protein, 17 aa, Mycobacterium
FKRGLKLFLSPDGKAAR

SEQ ID NO: 296466 - protein, 19 aa, Mycobacterium
FKRGMKMFLSPDGHAVRFI

SEQ ID NO: 296467 - protein, 18 aa, Mycobacterium
FLLAVAFIGWSFVGFESA

SEQ ID NO: 296468 - protein, 25 aa, Mycobacterium
FLLGPTNFFAWALSVMFLVFTLRAI

SEQ ID NO: 296469 - protein, 21 aa, Mycobacterium
FLLPGDPLAAIAGDRPLTPAV

SEQ ID NO: 296470 - protein, 18 aa, Mycobacterium
FLTRLRVGEKLVDAKAVA

SEQ ID NO: 296471 - protein, 25 aa, Mycobacterium
FLVALSFASVNGWWYVSNFGVPWSN

SEQ ID NO: 296472 - protein, 17 aa, Mycobacterium
FLVLLGTFNRYWLAAAF

SEQ ID NO: 296473 - protein, 34 aa, Mycobacterium; identical to SEQ ID NO: 10939

SEQ ID NO: 296474 - protein, 19 aa, Mycobacterium
FPALASFVAEDRFLPRQLT

SEQ ID NO: 296475 - protein, 23 aa, Mycobacterium
FPDLEVCVYAAPTQTVIGGPPEQ

SEQ ID NO: 296476 - protein, 17 aa, Mycobacterium
FQIPGADKLNSWGKSLQ

SEQ ID NO: 296477 - protein, 17 aa, Mycobacterium
FQPIHVTIAAWFTIGIP

SEQ ID NO: 296478 - protein, 27 aa, Mycobacterium
FRAIDRLGPELSVREIAEEAGTAKPKI

SEQ ID NO: 296479 - protein, 20 aa, Mycobacterium
FRGLPEVVIILIIGLGVGPI

SEQ ID NO: 296480 - protein, 24 aa, Mycobacterium
FRKGANFTAAMAFEIGSTNLVVEL

SEQ ID NO: 296481 - protein, 17 aa, Mycobacterium
FSRFWRADPSRVRRSGG

SEQ ID NO: 296482 - protein, 20 aa, Mycobacterium
FSSVFVVGNSLRLRGFTSTS

SEQ ID NO: 296483 - protein, 24 aa, Mycobacterium
FTPTKWIHHFGLFAAVGGAMAALA

SEQ ID NO: 296484 - protein, 26 aa, Mycobacterium
FVGLFDTWPGLILPYITFALPLAIYT

SEQ ID NO: 296485 - protein, 18 aa, Mycobacterium
FVLFALASGRAMRALGWL

SEQ ID NO: 296486 - protein, 17 aa, Mycobacterium
FYLALKYTGEFLLGYLA

SEQ ID NO: 296487 - protein, 20 aa, Mycobacterium
FYNRRLRAATTRFSVRMKHD

SEQ ID NO: 296488 - protein, 22 aa, Mycobacterium
FYTPWSWLPRIVTQFTAGALAC

SEQ ID NO: 296489 - protein, 18 aa, Mycobacterium
GAASLLFGRGEQLPPLPR

SEQ ID NO: 296490 - protein, 25 aa, Mycobacterium
GAETLRLKGYLIMCRNSRRDYADFA

SEQ ID NO: 296491 - protein, 21 aa, Mycobacterium
GAETLRLKGYLIMSRNSSRDY

SEQ ID NO: 296492 - protein, 19 aa, Mycobacterium
GAIAVYGYDGFLYSIGFLV

SEQ ID NO: 296493 - protein, 18 aa, Mycobacterium
GALIVFAVLTVWFVIDPQ

SEQ ID NO: 296494 - protein, 17 aa, Mycobacterium
GALLKLTVFAVGVMPYI

SEQ ID NO: 296495 - protein, 18 aa, Mycobacterium
GALLKLTVFAVGVMPYIT

SEQ ID NO: 296496 - protein, 17 aa, Mycobacterium
GALLLGAAVGWRTRRWR

SEQ ID NO: 296497 - protein, 29 aa, Mycobacterium
GALYVRVGDRLYPALNLASARLITGRPDN

SEQ ID NO: 296498 - protein, 29 aa, Mycobacterium
GATYCLSFARLPWFNTMGAPVAIGMLVVV

SEQ ID NO: 296499 - protein, 23 aa, Mycobacterium
GAVICAAYGWAIVASALSIYALG

SEQ ID NO: 296500 - protein, 17 aa, Mycobacterium
GDPEVRNLLNWHAVEEL

SEQ ID NO: 296501 - protein, 19 aa, Mycobacterium
GDSIGWTWMHYLPPTPGFA

SEQ ID NO: 296502 - protein, 20 aa, Mycobacterium
GDVFGLRRWYVVTFVMGLFF

SEQ ID NO: 296503 - protein, 20 aa, Mycobacterium
GELQRLALAAALAREPALLI

SEQ ID NO: 296504 - protein, 19 aa, Mycobacterium
GETEYGLKAVPLGGFCDIA

SEQ ID NO: 296505 - protein, 22 aa, Mycobacterium
GFEKIVPFLLGFASVAILLPRR

SEQ ID NO: 296506 - protein, 24 aa, Mycobacterium
GFFPLMGIGAFSMLAFSGRFGRAR

SEQ ID NO: 296507 - protein, 19 aa, Mycobacterium
GFIIGCGLLLDTFVVRTLT

SEQ ID NO: 296508 - protein, 23 aa, Mycobacterium
GFIPMFLTAYAYRELNSRAPDCG

SEQ ID NO: 296509 - protein, 24 aa, Mycobacterium
GFKTKVSTLLSWTVTFLSTRRGQL

SEQ ID NO: 296510 - protein, 25 aa, Mycobacterium
GGGCLPKDIRAFMARAGELGANQAL

SEQ ID NO: 296511 - protein, 25 aa, Mycobacterium
GGLVGGVWLAFIGWFIFAAAREEET

SEQ ID NO: 296512 - protein, 30 aa, Mycobacterium
GGQRKRASVALELLTGPSLLILDEPTTGLD

SEQ ID NO: 296513 - protein, 26 aa, Mycobacterium
GGRPILRILVRRHRLVGTWPLVAPML

SEQ ID NO: 296514 - protein, 23 aa, Mycobacterium
GGVKRIAAFASIVVPFMAVVYIV

SEQ ID NO: 296515 - protein, 19 aa, Mycobacterium
GHCAEFCGTYHSMMNFEVR

SEQ ID NO: 296516 - protein, 23 aa, Mycobacterium
GIAALCLIFIIMLIITRAVVASA

SEQ ID NO: 296517 - protein, 25 aa, Mycobacterium
GIAERLRPGGVIQREIAMRTVAVFA

SEQ ID NO: 296518 - protein, 24 aa, Mycobacterium
GIITRGRTALDLSAITGESVPVEA

SEQ ID NO: 296519 - protein, 18 aa, Mycobacterium
GIMYCVVCFAFFLVGGLM

SEQ ID NO: 296520 - protein, 24 aa, Mycobacterium
GIPEEFSDKVFVIFQRLHGREVYA

SEQ ID NO: 296521 - protein, 22 aa, Mycobacterium
GISALCLIFLIMLLITRSFVAS

SEQ ID NO: 296522 - protein, 20 aa, Mycobacterium
GKQRPGVFSVDGPVTNGPVW

SEQ ID NO: 296523 - protein, 24 aa, Mycobacterium
GLAICVLAGYLARIPDCKVTIGEV

SEQ ID NO: 296524 - protein, 25 aa, Mycobacterium
GLDRELAARFGFLLAIPAVFASGLF

SEQ ID NO: 296525 - protein, 17 aa, Mycobacterium
GLGKPGGEVRWGVAGRM

SEQ ID NO: 296526 - protein, 20 aa, Mycobacterium
GLLACSPRALILDEPLAGLD

SEQ ID NO: 296527 - protein, 22 aa, Mycobacterium
GLVCAIGLSGGYVFSVFLQGVN

SEQ ID NO: 296528 - protein, 19 aa, Mycobacterium
GNDHFAEFAPGMKSIDDAL

SEQ ID NO: 296529 - protein, 22 aa, Mycobacterium
GNLWPGQGGVYIWATRTMGETW

SEQ ID NO: 296530 - protein, 26 aa, Mycobacterium
GNMFPRKISFLPGMRYYAGNWDTTLW

SEQ ID NO: 296531 - protein, 18 aa, Mycobacterium
GNNFLVPNGTFFFVLAIF

SEQ ID NO: 296532 - protein, 17 aa, Mycobacterium
GNSLEWATSCPPPRHNF

SEQ ID NO: 296533 - protein, 25 aa, Mycobacterium
GPAPEGMAAWIIGMVAAIGLALWIG

SEQ ID NO: 296534 - protein, 20 aa, Mycobacterium
GPILGGWLIDTSSWRWIFLI

SEQ ID NO: 296535 - protein, 18 aa, Mycobacterium
GPLSWFFHHLPKPLHRIE

SEQ ID NO: 296536 - protein, 20 aa, Mycobacterium
GQPSKFTMAGPWVGIAAPGE

SEQ ID NO: 296537 - protein, 23 aa, Mycobacterium
GQRFPVKYYLTAMLFIVFDIEIV

SEQ ID NO: 296538 - protein, 24 aa, Mycobacterium
GQRRIPVQYAKRMVGRKMYGGTST

SEQ ID NO: 296539 - protein, 22 aa, Mycobacterium
GQRRIPVQYAKRMVGRRMYGGT

SEQ ID NO: 296540 - protein, 19 aa, Mycobacterium
GREGVAFGLYTMTGRAVAF

SEQ ID NO: 296541 - protein, 21 aa, Mycobacterium
GRYTGEIAFYCYGEGKVQAIR

SEQ ID NO: 296542 - protein, 24 aa, Mycobacterium
GSSSPARTYGWHRAEVFTAVANAG

SEQ ID NO: 296543 - protein, 18 aa, Mycobacterium
GTEHGDPFLGRTMGTQAD

SEQ ID NO: 296544 - protein, 17 aa, Mycobacterium
GTRNWADIFAKVGADPD

SEQ ID NO: 296545 - protein, 18 aa, Mycobacterium
GTVVVGWVISLIMVNPFL

SEQ ID NO: 296546 - protein, 20 aa, Mycobacterium
GVAGALAWSYGEPVALLTTV

SEQ ID NO: 296547 - protein, 28 aa, Mycobacterium
GVAGRLFGRFDLAVAVFFALSGFLLWRG

SEQ ID NO: 296548 - protein, 20 aa, Mycobacterium
GVLPLLCCAGPALIAGGALG

SEQ ID NO: 296549 - protein, 19 aa, Mycobacterium
GVNGLRQLILGGIDGRLWQ

SEQ ID NO: 296550 - protein, 17 aa, Mycobacterium
GVPENFRAPGVILRQVL

SEQ ID NO: 296551 - protein, 25 aa, Mycobacterium
GVPKWKTIVRIVVPIAMPGIVSGVL

SEQ ID NO: 296552 - protein, 25 aa, Mycobacterium
GYDGFLYSIGFLVAWLVALLLVAEL

SEQ ID NO: 296553 - protein, 31 aa, Mycobacterium
GYKPLIVAGCFLRTAGFAMLAFVGTLPAILI

SEQ ID NO: 296554 - protein, 23 aa, Mycobacterium
GYTMGFGSLGWVYASESFPSRLR

SEQ ID NO: 296555 - protein, 18 aa, Mycobacterium
HAAFGARRRGLLAVYARE

SEQ ID NO: 296556 - protein, 22 aa, Mycobacterium
HCPLPRPAIGPGTYNLVVQLGN

SEQ ID NO: 296557 - protein, 19 aa, Mycobacterium
HDERARWSVGKTVTLRGHD

SEQ ID NO: 296558 - protein, 24 aa, Mycobacterium
HDYGEIDGQMFLEMRLIEGTDLDS

SEQ ID NO: 296559 - protein, 21 aa, Mycobacterium
HELKTGNVMYLDIKEGAEFGG

SEQ ID NO: 296560 - protein, 21 aa, Mycobacterium
HELRRSATRFLFEFADDLQND

SEQ ID NO: 296561 - protein, 20 aa, Mycobacterium
HELRTPLTTIRGFAELYRQG

SEQ ID NO: 296562 - protein, 24 aa, Mycobacterium
HETGIDWDVIFLLLGMMIIVSVLR

SEQ ID NO: 296563 - protein, 23 aa, Mycobacterium
HETSRAGNTFGIAGMAVALIATI

SEQ ID NO: 296564 - protein, 18 aa, Mycobacterium
HLKRLLGRGGMGEVYEAE

SEQ ID NO: 296565 - protein, 24 aa, Mycobacterium
HLSVGAAYSWSVFKKPLEGALGIS

SEQ ID NO: 296566 - protein, 21 aa, Mycobacterium
HPARYLSVFLVLLIGVYLLVF

SEQ ID NO: 296567 - protein, 21 aa, Mycobacterium
HPPGALLTFVWLDRIGLGGGA

SEQ ID NO: 296568 - protein, 17 aa, Mycobacterium
HPYVFVVGDLMSVPGVP

SEQ ID NO: 296569 - protein, 25 aa, Mycobacterium
HQVTGWRFVMRRIASGIALHDTRML

SEQ ID NO: 296570 - protein, 25 aa, Mycobacterium
HRDGHRIRLGRPGWLDRGPLTAEVT

SEQ ID NO: 296571 - protein, 23 aa, Mycobacterium
HREQWPVAGPVLGRLGWFVESKL

SEQ ID NO: 296572 - protein, 20 aa, Mycobacterium
HSLIPIVVGYIFAHYLSYLV

SEQ ID NO: 296573 - protein, 22 aa, Mycobacterium
HSLTYLDVCDQVLLLAPGGKTA

SEQ ID NO: 296574 - protein, 22 aa, Mycobacterium
HSLTYLDVCDQVLLMAPGGKTA

SEQ ID NO: 296575 - protein, 19 aa, Mycobacterium
HTMMFQEMVNRVGADVPGM

SEQ ID NO: 296576 - protein, 17 aa, Mycobacterium
HWGVAGWSMGGTCAVDL

SEQ ID NO: 296577 - protein, 19 aa, Mycobacterium
HYNSLYFPYVVGVRAYAQN

SEQ ID NO: 296578 - protein, 25 aa, Mycobacterium
IAAAERWNLPVILIVLLAVFGSLAA

SEQ ID NO: 296579 - protein, 17 aa, Mycobacterium
IAAAIGFLQMKRWGHQW

SEQ ID NO: 296580 - protein, 19 aa, Mycobacterium
IAACAAGVYLVDVRPKLLE

SEQ ID NO: 296581 - protein, 17 aa, Mycobacterium
IAEAVEGMLARIGKEQQ

SEQ ID NO: 296582 - protein, 19 aa, Mycobacterium
IAMRTVAVFAHRLYGAITS

SEQ ID NO: 296583 - protein, 18 aa, Mycobacterium
IAPFVLPLAVTIFVFILI

SEQ ID NO: 296584 - protein, 21 aa, Mycobacterium
ICASVIGGTVVVGWVISLIMV

SEQ ID NO: 296585 - protein, 20 aa, Mycobacterium
ICVLNPLVLIHLMGGVHNEM

SEQ ID NO: 296586 - protein, 25 aa, Mycobacterium
IDAARLLTWRASWMAANNVPFERGE

SEQ ID NO: 296587 - protein, 26 aa, Mycobacterium
IDDALELRGRILGAFEQAERSSDPVR

SEQ ID NO: 296588 - protein, 29 aa, Mycobacterium
IDLTGFWIRRARRLLPALVLMVLTVAAAR

SEQ ID NO: 296589 - protein, 19 aa, Mycobacterium
IEAAFPWYVRMWGGRQWAR

SEQ ID NO: 296590 - protein, 26 aa, Mycobacterium
IEASEPAAYCVAGRPPAIVVTSAALA

SEQ ID NO: 296591 - protein, 23 aa, Mycobacterium
IELPPGYLPLRVPIEVNFTQRVA

SEQ ID NO: 296592 - protein, 29 aa, Mycobacterium
IEPEVVQWKLKPGVVSTMNAQARYTDPNT

SEQ ID NO: 296593 - protein, 18 aa, Mycobacterium
IFDHLGPQLRWWEWTLEH

SEQ ID NO: 296594 - protein, 19 aa, Mycobacterium
IFTGYPFLRGALRSLRSGK

SEQ ID NO: 296595 - protein, 19 aa, Mycobacterium
IGAIAGWIAGKIVKGGGSG

SEQ ID NO: 296596 - protein, 24 aa, Mycobacterium
IGGITVRTGLLWWTVAIHLLTSMT

SEQ ID NO: 296597 - protein, 24 aa, Mycobacterium
IGISRISLNFAMFRSAFEQGAQLG

SEQ ID NO: 296598 - protein, 17 aa, Mycobacterium
IGLHLAMVWFQKHTQFP

SEQ ID NO: 296599 - protein, 18 aa, Mycobacterium
IGPSQAWYTENLRYYYLI

SEQ ID NO: 296600 - protein, 27 aa, Mycobacterium
IGRFGEKRAPLALGVAALLFGFPIFFD

SEQ ID NO: 296601 - protein, 17 aa, Mycobacterium
IGTAFTALVTKFTDSII

SEQ ID NO: 296602 - protein, 26 aa, Mycobacterium
IGVGLMAWLNIIGIIILQRPALAALK

SEQ ID NO: 296603 - protein, 17 aa, Mycobacterium
IHQNLGWAFGYNTAAIP

SEQ ID NO: 296604 - protein, 24 aa, Mycobacterium
IIANRVSYFYDFRGPSVAVDTACS

SEQ ID NO: 296605 - protein, 19 aa, Mycobacterium
IILALIGLHLAMVWFQKHT

SEQ ID NO: 296606 - protein, 22 aa, Mycobacterium
IISALHRPVPLSGEGSDTDTVI

SEQ ID NO: 296607 - protein, 23 aa, Mycobacterium
IKLIKMLIAPIIFCTVVLGIAHV

SEQ ID NO: 296608 - protein, 20 aa, Mycobacterium
ILLLPGIILALIGLHLAMVW

SEQ ID NO: 296609 - protein, 24 aa, Mycobacterium
ILRSAARPGNWSLFDGGYTFASKI

SEQ ID NO: 296610 - protein, 23 aa, Mycobacterium
INTWCTYNAWAFNMGSWAPHVPG

SEQ ID NO: 296611 - protein, 17 aa, Mycobacterium
IPLALGICTVVVTMGLV

SEQ ID NO: 296612 - protein, 17 aa, Mycobacterium
IPLTVLIIFTLNILLAE

SEQ ID NO: 296613 - protein, 24 aa, Mycobacterium
IPLYSLSVLAAFFAARFTTVYING

SEQ ID NO: 296614 - protein, 22 aa, Mycobacterium
IPPPEGKPWWLVVVGVLVVGLL

SEQ ID NO: 296615 - protein, 20 aa, Mycobacterium
IPVLIVGTVVWVGITNDRKE

SEQ ID NO: 296616 - protein, 18 aa, Mycobacterium
IQAGFIIGCGLLLDTFVV

SEQ ID NO: 296617 - protein, 18 aa, Mycobacterium
IRLPGVAMVQSITRPLGR

SEQ ID NO: 296618 - protein, 24 aa, Mycobacterium
ISFEVRGGLFVRQVHHWAALMFAA

SEQ ID NO: 296619 - protein, 26 aa, Mycobacterium
ISFVIGRPLIWLSFRNEKLNAAFRYA

SEQ ID NO: 296620 - protein, 25 aa, Mycobacterium
ISKYYPAWLPSRRFIAAVIAIGGMQ

SEQ ID NO: 296621 - protein, 23 aa, Mycobacterium
ITEALKRLPAYATTLGEVVGSGP

SEQ ID NO: 296622 - protein, 23 aa, Mycobacterium
ITETRHWWHLPLLGHHLLVAGAT

SEQ ID NO: 296623 - protein, 25 aa, Mycobacterium
ITHGSRAGLIIGIAFAAAYAGWAWL

SEQ ID NO: 296624 - protein, 17 aa, Mycobacterium
ITLPGSIYLGVIAVLPN

SEQ ID NO: 296625 - protein, 17 aa, Mycobacterium
ITVGPAFAQAGFDTLWS

SEQ ID NO: 296626 - protein, 26 aa, Mycobacterium
IVCTDAEAILGIGDWGVGGIQIAVGK

SEQ ID NO: 296627 - protein, 17 aa, Mycobacterium
IVSEGDIAPPTRVVLRR

SEQ ID NO: 296628 - protein, 22 aa, Mycobacterium
IVVANALRLLGMPMQSVTPAAP

SEQ ID NO: 296629 - protein, 17 aa, Mycobacterium
IYLTQRFIIAWRVWLTD

SEQ ID NO: 296630 - protein, 25 aa, Mycobacterium
IYNYTWLVLMLPFGMIGVTVLTVVM

SEQ ID NO: 296631 - protein, 31 aa, Mycobacterium
KADRTRRYWNWIAVAVVRRPVPLLVASLALV

SEQ ID NO: 296632 - protein, 18 aa, Mycobacterium
KALFLGFMFAFAVKAPLW

SEQ ID NO: 296633 - protein, 18 aa, Mycobacterium
KANGYRLVTVSELLGPRA

SEQ ID NO: 296634 - protein, 23 aa, Mycobacterium
KAPLWPFHRWLPDAAVEATPATA

SEQ ID NO: 296635 - protein, 23 aa, Mycobacterium
KAPLWPFHRWLPDAAVESTPATA

SEQ ID NO: 296636 - protein, 23 aa, Mycobacterium
KARGSEDRMRRFITDASHELRTP

SEQ ID NO: 296637 - protein, 19 aa, Mycobacterium
KFRGARGAIQATLDRDLPI

SEQ ID NO: 296638 - protein, 17 aa, Mycobacterium
KGGSAVKPFAGVPHVSR

SEQ ID NO: 296639 - protein, 17 aa, Mycobacterium
KHGREGVAFGLYTMTGR

SEQ ID NO: 296640 - protein, 23 aa, Mycobacterium
KIPEARRVLSMLLGQKNLEITIT

SEQ ID NO: 296641 - protein, 18 aa, Mycobacterium
KKPTGGIYGIVWVGLGLS

SEQ ID NO: 296642 - protein, 23 aa, Mycobacterium
KKRPRLTMFDDFGGRVPSDKPPI

SEQ ID NO: 296643 - protein, 18 aa, Mycobacterium
KLGMGRHWHFFSVIGWIL

SEQ ID NO: 296644 - protein, 22 aa, Mycobacterium
KNEMRTLGIAMVQDITRPLGIP

SEQ ID NO: 296645 - protein, 22 aa, Mycobacterium
KRRGWPTTLFRPHNLPFVMLGA

SEQ ID NO: 296646 - protein, 18 aa, Mycobacterium
KRWGHQWMVVTCWMGVVI

SEQ ID NO: 296647 - protein, 17 aa, Mycobacterium
KTGQLVGATPWKQQVAL

SEQ ID NO: 296648 - protein, 24 aa, Mycobacterium
KTNVRRFVDDVSFVVGKESRDRLK

SEQ ID NO: 296649 - protein, 19 aa, Mycobacterium
KTRRQTLKDYVAFPLLAGP

SEQ ID NO: 296650 - protein, 19 aa, Mycobacterium
KTSEVDWVLDRLARELEAL

SEQ ID NO: 296651 - protein, 23 aa, Mycobacterium
KTVPKRLSALLNTSGLPAVLEPF

SEQ ID NO: 296652 - protein, 22 aa, Mycobacterium
KVHRHWGFGGGPHRCLGSHLAR

SEQ ID NO: 296653 - protein, 20 aa, Mycobacterium
KVKLHAFVALVLVSLLTALA

SEQ ID NO: 296654 - protein, 17 aa, Mycobacterium
KVMSVSLAGRFAGFRGL

SEQ ID NO: 296655 - protein, 22 aa, Mycobacterium
LAATLPLLWSRGLSALPVTYIG

SEQ ID NO: 296656 - protein, 17 aa, Mycobacterium
LAFRGVLHGALNRAWGF

SEQ ID NO: 296657 - protein, 18 aa, Mycobacterium
LAFRHFGQGYAILLLAIW

SEQ ID NO: 296658 - protein, 27 aa, Mycobacterium
LAGPRLIDAYVDWLWFGELGYRSVFTT

SEQ ID NO: 296659 - protein, 28 aa, Mycobacterium
LAGQGAWLKRIIPVAALGGVAGAALLLS

SEQ ID NO: 296660 - protein, 18 aa, Mycobacterium
LALPLASLVFLGAFIPLI

SEQ ID NO: 296661 - protein, 18 aa, Mycobacterium
LARNTRWFLIANYGAARV

SEQ ID NO: 296662 - protein, 18 aa, Mycobacterium
LARYGPRAPQLWLPPLDE

SEQ ID NO: 296663 - protein, 18 aa, Mycobacterium
LAVGLAMFAFRYVIPADK

SEQ ID NO: 296664 - protein, 19 aa, Mycobacterium
LAVIRRGVIPASWGGKLKT

SEQ ID NO: 296665 - protein, 22 aa, Mycobacterium
LAWWFDWLPHHGLEDTQRTNRY

SEQ ID NO: 296666 - protein, 19 aa, Mycobacterium
LCDHPRLYFSRNATPGKDE

SEQ ID NO: 296667 - protein, 17 aa, Mycobacterium
LCLAAGVYFSIRTRLLQ

SEQ ID NO: 296668 - protein, 18 aa, Mycobacterium
LCLIFIIMLLITRGVVAS

SEQ ID NO: 296669 - protein, 20 aa, Mycobacterium
LDRVAKALIRLHGVAMVQGM

SEQ ID NO: 296670 - protein, 22 aa, Mycobacterium
LDRWLLFNWMRWGRALEYLKIT

SEQ ID NO: 296671 - protein, 24 aa, Mycobacterium
LEHTRAAGVFKVYGLLFAAVTVLA

SEQ ID NO: 296672 - protein, 18 aa, Mycobacterium
LETARPADLLVLLDSLRQ

SEQ ID NO: 296673 - protein, 26 aa, Mycobacterium
LFAYTKVCSHLGCPASLYEEQSYRIL

SEQ ID NO: 296674 - protein, 19 aa, Mycobacterium
LFDRLGRRFPKHFGPGHVA

SEQ ID NO: 296675 - protein, 25 aa, Mycobacterium
LFVPAALPWYYSWPLAIVAPLAQSR

SEQ ID NO: 296676 - protein, 26 aa, Mycobacterium
LGALLGGLVWPFLLLPQLGMIRGAAA

SEQ ID NO: 296677 - protein, 17 aa, Mycobacterium
LGGIGWGIGYISPVSTL

SEQ ID NO: 296678 - protein, 23 aa, Mycobacterium
LGGWASIHVFGFPALDNSTPLFA

SEQ ID NO: 296679 - protein, 17 aa, Mycobacterium
LGIPSALGLLVVIAGAL

SEQ ID NO: 296680 - protein, 21 aa, Mycobacterium
LGLFFAFWSWVGFESTAMYGE

SEQ ID NO: 296681 - protein, 19 aa, Mycobacterium
LGLFGLFAYTGMRIARRSA

SEQ ID NO: 296682 - protein, 23 aa, Mycobacterium
LGQAELDAGYILTCQSHPTTPFV

SEQ ID NO: 296683 - protein, 24 aa, Mycobacterium
LGSTMGILTWMFVDGHGSGLMNYT

SEQ ID NO: 296684 - protein, 17 aa, Mycobacterium
LHLAMVWFQKHTQFPGP

SEQ ID NO: 296685 - protein, 20 aa, Mycobacterium
LHRAKGGGLSTLFGGGVQSS

SEQ ID NO: 296686 - protein, 18 aa, Mycobacterium
LIAEISMGAGTLAMIGGT

SEQ ID NO: 296687 - protein, 19 aa, Mycobacterium
LIFVSGLERHLPRIFTHLN

SEQ ID NO: 296688 - protein, 19 aa, Mycobacterium
LIGKCLRPLPDKWKGLTDQ

SEQ ID NO: 296689 - protein, 18 aa, Mycobacterium
LIIAHGVINTVAYVGYAL

SEQ ID NO: 296690 - protein, 24 aa, Mycobacterium
LIMIAVFCGFAFAGMPLVAEIGVA

SEQ ID NO: 296691 - protein, 21 aa, Mycobacterium
LKASSLVYFLGLIANQRELFQ

SEQ ID NO: 296692 - protein, 19 aa, Mycobacterium
LKFAMFMLAEYVNMMTVSS

SEQ ID NO: 296693 - protein, 17 aa, Mycobacterium
LKFAMFMLAEYVNMTTV

SEQ ID NO: 296694 - protein, 19 aa, Mycobacterium
LKFAMFMLAEYVNMTTVSA

SEQ ID NO: 296695 - protein, 18 aa, Mycobacterium
LKGGSAVKPFAGVPHVSR

SEQ ID NO: 296696 - protein, 25 aa, Mycobacterium
LKVNQAGVIPVIFASSLIYIPHLIT

SEQ ID NO: 296697 - protein, 22 aa, Mycobacterium
LLAGIALLVSRQVVVPVRSASR

SEQ ID NO: 296698 - protein, 18 aa, Mycobacterium
LLASMPSWGMVVTLVAWG

SEQ ID NO: 296699 - protein, 25 aa, Mycobacterium
LLEAAADLFARQGFHAVGIDDIGAA

SEQ ID NO: 296700 - protein, 18 aa, Mycobacterium
LLFGFPIFFDAGLVVFLP

SEQ ID NO: 296701 - protein, 21 aa, Mycobacterium
LLGLFPLFVMFIITAITMQRE

SEQ ID NO: 296702 - protein, 18 aa, Mycobacterium
LLGTGLCGGLTTFSTMQV

SEQ ID NO: 296703 - protein, 24 aa, Mycobacterium
LLIDFKGGATFLDYARAPHVAAVI

SEQ ID NO: 296704 - protein, 20 aa, Mycobacterium
LLLGAAVGWRTRRWRLRILP

SEQ ID NO: 296705 - protein, 26 aa, Mycobacterium
LLLSSLVVGAGWPLIVEQFSVKPNAA

SEQ ID NO: 296706 - protein, 18 aa, Mycobacterium
LLQGHWSLLVGYGCLPWV

SEQ ID NO: 296707 - protein, 18 aa, Mycobacterium
LLSNITWGNGSIVVGGGT

SEQ ID NO: 296708 - protein, 24 aa, Mycobacterium
LLTDFKGGSTFLGMEKLPHTAAVI

SEQ ID NO: 296709 - protein, 24 aa, Mycobacterium
LLTDFKGGSTFLGMEKLPHTAAVV

SEQ ID NO: 296710 - protein, 17 aa, Mycobacterium
LLTILGFSLYDTVIVFD

SEQ ID NO: 296711 - protein, 18 aa, Mycobacterium
LLTLFAGSVLRGADLETL

SEQ ID NO: 296712 - protein, 18 aa, Mycobacterium
LMLLGGRLGDTIGRKRTF

SEQ ID NO: 296713 - protein, 19 aa, Mycobacterium
LMWIMSWLTATPVRVVRAA

SEQ ID NO: 296714 - protein, 18 aa, Mycobacterium
LNLALAVPVTLVLIASSF

SEQ ID NO: 296715 - protein, 29 aa, Mycobacterium
LPFLLAFRLTCYYYRKAYYRSVWQSPTAC

SEQ ID NO: 296716 - protein, 26 aa, Mycobacterium
LPFVMLGAGLLWFGWYGFNAGSATSS

SEQ ID NO: 296717 - protein, 17 aa, Mycobacterium
LPIGQGLSMTLLQMTGM

SEQ ID NO: 296718 - protein, 19 aa, Mycobacterium
LPLRVFATSLLAVFMAGAI

SEQ ID NO: 296719 - protein, 18 aa, Mycobacterium
LPPSINFAGPSPYIDFDA

SEQ ID NO: 296720 - protein, 17 aa, Mycobacterium
LPTPLSVHVYRLVWRQM

SEQ ID NO: 296721 - protein, 17 aa, Mycobacterium
LPVLFTAGMCLLDTIDG

SEQ ID NO: 296722 - protein, 23 aa, Mycobacterium
LPWYAILCLPVLFTAGMCLLDTI

SEQ ID NO: 296723 - protein, 17 aa, Mycobacterium
LRALPTLGVLLLGVLLW

SEQ ID NO: 296724 - protein, 19 aa, Mycobacterium
LRARFRAVTEDAERQIDSC

SEQ ID NO: 296725 - protein, 23 aa, Mycobacterium
LREFGNIVFHFSLLGLLVAVAVG

SEQ ID NO: 296726 - protein, 18 aa, Mycobacterium
LREGYAMGGLSGHPNIVN

SEQ ID NO: 296727 - protein, 31 aa, Mycobacterium
LRENVVALTVLWLLNIGEYLQDLTLRRTRRA

SEQ ID NO: 296728 - protein, 19 aa, Mycobacterium
LRGDYLAIVTLGFGEIIRL

SEQ ID NO: 296729 - protein, 18 aa, Mycobacterium
LRGQFWIWAGANIAPINW

SEQ ID NO: 296730 - protein, 17 aa, Mycobacterium
LRLRVETQVGFKMAKWI

SEQ ID NO: 296731 - protein, 17 aa, Mycobacterium
LRPLPNKWKGLTDPEAR

SEQ ID NO: 296732 - protein, 18 aa, Mycobacterium
LRPLPNKWKGLTDPEARV

SEQ ID NO: 296733 - protein, 20 aa, Mycobacterium
LRQLRWALSEVQRGNYNAHM

SEQ ID NO: 296734 - protein, 17 aa, Mycobacterium
LRRTRRAISELLRGNQD

SEQ ID NO: 296735 - protein, 18 aa, Mycobacterium
LRTPLTAMRADLDTLRIH

SEQ ID NO: 296736 - protein, 17 aa, Mycobacterium
LRVLGQFGSTVCIGLLL

SEQ ID NO: 296737 - protein, 18 aa, Mycobacterium
LRVLGQFGSTVCIGLLLD

SEQ ID NO: 296738 - protein, 18 aa, Mycobacterium
LSALPFTIGIVMLGLSAA

SEQ ID NO: 296739 - protein, 28 aa, Mycobacterium
LSLFKAAGYLLWWAVLFPAISIPIIASV

SEQ ID NO: 296740 - protein, 20 aa, Mycobacterium
LSLSAAFGALVWIFQDGHLG

SEQ ID NO: 296741 - protein, 19 aa, Mycobacterium
LSPEQWFAFTPPRVPVLET

SEQ ID NO: 296742 - protein, 18 aa, Mycobacterium
LSTIARRQVRLVVSDRGY

SEQ ID NO: 296743 - protein, 18 aa, Mycobacterium
LTAIPMGVPLEWNVFMIF

SEQ ID NO: 296744 - protein, 17 aa, Mycobacterium
LTARPGTLTAVIGGSGA

SEQ ID NO: 296745 - protein, 17 aa, Mycobacterium
LTFETPMLFSIGFIVTF

SEQ ID NO: 296746 - protein, 17 aa, Mycobacterium
LTFGGLMLLGGRLGDTI

SEQ ID NO: 296747 - protein, 23 aa, Mycobacterium
LTGEYRGGPAYYLSRALEHTRAA

SEQ ID NO: 296748 - protein, 22 aa, Mycobacterium
LTHGFFKAGLFLGAGSVMHAMN

SEQ ID NO: 296749 - protein, 24 aa, Mycobacterium
LTPGRPWAWLALVVAGLVVGIFIT

SEQ ID NO: 296750 - protein, 18 aa, Mycobacterium
LTWTSARTRATFGTTAEE

SEQ ID NO: 296751 - protein, 20 aa, Mycobacterium
LTYLDVCDQVLLLAPGGKTA

SEQ ID NO: 296752 - protein, 17 aa, Mycobacterium
LVAARFIQLTPAYTGGA

SEQ ID NO: 296753 - protein, 17 aa, Mycobacterium
LVALPIGVTLSIQFALL

SEQ ID NO: 296754 - protein, 24 aa, Mycobacterium
LVAQLGVACAVAIAVDATVVRLVL

SEQ ID NO: 296755 - protein, 20 aa, Mycobacterium
LVARTLPGKQFEAGRQLRVL

SEQ ID NO: 296756 - protein, 19 aa, Mycobacterium
LVGATRWYTQLPFLVEAML

SEQ ID NO: 296757 - protein, 18 aa, Mycobacterium
LVHHCHREQWPVAGPVLG

SEQ ID NO: 296758 - protein, 19 aa, Mycobacterium
LVITPLRVAFLIVLIGTTV

SEQ ID NO: 296759 - protein, 26 aa, Mycobacterium
LVIVGWLTLWPFLSWLTTHFVVTNRR

SEQ ID NO: 296760 - protein, 22 aa, Mycobacterium
LVKGGAALEALGRIRGVALDKT

SEQ ID NO: 296761 - protein, 17 aa, Mycobacterium
LVLELLATLGVALVAVS

SEQ ID NO: 296762 - protein, 27 aa, Mycobacterium
LVPGQGWAQCHSLAFDFSVWEIFGALL

SEQ ID NO: 296763 - protein, 24 aa, Mycobacterium
LVPNGTFFFVLAIFLIVLAVIGTF

SEQ ID NO: 296764 - protein, 20 aa, Mycobacterium
LVRAGDRWLGAIGLMDLPRP

SEQ ID NO: 296765 - protein, 17 aa, Mycobacterium
LVTSILVLIAFPILTAA

SEQ ID NO: 296766 - protein, 20 aa, Mycobacterium
LVVFALAIVIGYYVIGNVHH

SEQ ID NO: 296767 - protein, 18 aa, Mycobacterium
LVVSEWIRGGSLQEVADT

SEQ ID NO: 296768 - protein, 21 aa, Mycobacterium
LWPAEALESVRLLIFGGEACP

SEQ ID NO: 296769 - protein, 18 aa, Mycobacterium
LYLLLGWVAVWYTATILH

SEQ ID NO: 296770 - protein, 19 aa, Mycobacterium
LYLRIAPELYLKRLCVGGV

SEQ ID NO: 296771 - protein, 17 aa, Mycobacterium
LYMGYAFRGFNTHGRAL

SEQ ID NO: 296772 - protein, 19 aa, Mycobacterium
LYTGTGAFEVVGRRKLWYG

SEQ ID NO: 296773 - protein, 19 aa, Mycobacterium
LYTGTGAFEVVGRRRLWFG

SEQ ID NO: 296774 - protein, 29 aa, Mycobacterium
MAGGTYLGGWRIIRTLGKGLVEIKPPQGM

SEQ ID NO: 296775 - protein, 23 aa, Mycobacterium
MEVMGVSVIRRLVVPRFAAAIMI

SEQ ID NO: 296776 - protein, 18 aa, Mycobacterium
MFADVRFAGVVLPVVGWW

SEQ ID NO: 296777 - protein, 17 aa, Mycobacterium
MGGTCAVDLTVMHPDMF

SEQ ID NO: 296778 - protein, 25 aa, Mycobacterium
MGKLFPGACVVWFFVLFDMLDGAMA

SEQ ID NO: 296779 - protein, 22 aa, Mycobacterium
MITGGAVLLVLLAGIALLVSRQ

SEQ ID NO: 296780 - protein, 21 aa, Mycobacterium
MKQNLWWGAGYNLIAVPLAAG

SEQ ID NO: 296781 - protein, 21 aa, Mycobacterium
MKYQPEWVPRYACYEDARLIP

SEQ ID NO: 296782 - protein, 26 aa, Mycobacterium
MLAALWAVYTTRWWLSGLLVGVAAGI

SEQ ID NO: 296783 - protein, 17 aa, Mycobacterium
MLASGLVALLLNSLVVI

SEQ ID NO: 296784 - protein, 20 aa, Mycobacterium
MLEWAPECFGTPGDLKLAAL

SEQ ID NO: 296785 - protein, 18 aa, Mycobacterium
MLLLVYRSVITVLLTLVM

SEQ ID NO: 296786 - protein, 18 aa, Mycobacterium
MLPAPTAMPVRIAMMVGA

SEQ ID NO: 296787 - protein, 18 aa, Mycobacterium
MMAQLGLRNTFWALVLPF

SEQ ID NO: 296788 - protein, 23 aa, Mycobacterium
MNSAWGFSTWWVGVGIVIVLAFV

SEQ ID NO: 296789 - protein, 20 aa, Mycobacterium
MPAGLRLVIDNAIANAVKHG

SEQ ID NO: 296790 - protein, 23 aa, Mycobacterium
MPLLGRASDRFGRKLVLQVSLAL

SEQ ID NO: 296791 - protein, 27 aa, Mycobacterium
MPVLLFCIAFGLSMDYEVFLVARIREY

SEQ ID NO: 296792 - protein, 17 aa, Mycobacterium
MRRPWMSALAASLVLLV

SEQ ID NO: 296793 - protein, 22 aa, Mycobacterium
MSALTAIRCDPDSKAYYQRKRD

SEQ ID NO: 296794 - protein, 21 aa, Mycobacterium
MTIDALVWVPRMYYLYGNPNR

SEQ ID NO: 296795 - protein, 17 aa, Mycobacterium
MTTFGLTAAYVFIICWI

SEQ ID NO: 296796 - protein, 26 aa, Mycobacterium
MTVARRFGGSLLLYAFPAAGAFAAMH

SEQ ID NO: 296797 - protein, 27 aa, Mycobacterium
MVHLARIFFTGAFRRPREANWVIGSLL

SEQ ID NO: 296798 - protein, 24 aa, Mycobacterium
MVTAATTGCRWLAVTALSVVMVVP

SEQ ID NO: 296799 - protein, 17 aa, Mycobacterium
MVVRLGAVTGVGHARLI

SEQ ID NO: 296800 - protein, 19 aa, Mycobacterium
MVWLGEISYEIFLVHLVTM

SEQ ID NO: 296801 - protein, 26 aa, Mycobacterium
MVYTETKLNSAFAFGGPKCLVKEIQK

SEQ ID NO: 296802 - protein, 20 aa, Mycobacterium
MYKQATWKRVAVLFAGPGMN

SEQ ID NO: 296803 - protein, 29 aa, Mycobacterium
NAIKTPQFWLLWIVLCFNVTAGIGILEKA

SEQ ID NO: 296804 - protein, 30 aa, Mycobacterium
NAISAMLIYRLISWLFIAAIGWVVFFFMFR

SEQ ID NO: 296805 - protein, 17 aa, Mycobacterium
NAIWKAFDLFVGAIQAF

SEQ ID NO: 296806 - protein, 24 aa, Mycobacterium
NDGKEVPASLVGRDPKTDLAVLKV

SEQ ID NO: 296807 - protein, 23 aa, Mycobacterium
NDGQRPLAVGFFFSLGHSTVVFA

SEQ ID NO: 296808 - protein, 17 aa, Mycobacterium
NDLSALLLGAASTRRRK

SEQ ID NO: 296809 - protein, 31 aa, Mycobacterium
NDYRPNLFVTYWSFRAMIGFLAIPVLFALLA

SEQ ID NO: 296810 - protein, 17 aa, Mycobacterium
NELDRFETLLADLLEIS

SEQ ID NO: 296811 - protein, 22 aa, Mycobacterium
NELHLRVLLICASVIGGTVVVG

SEQ ID NO: 296812 - protein, 24 aa, Mycobacterium
NGGISFGGVIAFIFADLLILPILN

SEQ ID NO: 296813 - protein, 22 aa, Mycobacterium
NGGISFGGVIAFIYADLLILPI

SEQ ID NO: 296814 - protein, 23 aa, Mycobacterium
NGSRKWFVVAGFSMQPSELAKIA

SEQ ID NO: 296815 - protein, 25 aa, Mycobacterium
NLHDELFDACGFRRLVFATPEELEE

SEQ ID NO: 296816 - protein, 25 aa, Mycobacterium
NLLQMAFRFWAFRRFVFPDEFARNP

SEQ ID NO: 296817 - protein, 24 aa, Mycobacterium
NPLNWPPAFFSWFAAGMLLAEWVH

SEQ ID NO: 296818 - protein, 23 aa, Mycobacterium
NQLQRITWIITMYLLGYIAAMPL

SEQ ID NO: 296819 - protein, 19 aa, Mycobacterium
NRFATPFFDALRAYAAAPV

SEQ ID NO: 296820 - protein, 24 aa, Mycobacterium
NTVPWRPGPIRALLATRPAAFRSL

SEQ ID NO: 296821 - protein, 20 aa, Mycobacterium
NWFGVCLVPILALIVLQIRR

SEQ ID NO: 296822 - protein, 18 aa, Mycobacterium
PAKPIAVNVIDFGADPDR

SEQ ID NO: 296823 - protein, 17 aa, Mycobacterium
PALSRRLAGIRLPVFPS

SEQ ID NO: 296824 - protein, 17 aa, Mycobacterium
PATRAQLRIAVKHIPGG

SEQ ID NO: 296825 - protein, 19 aa, Mycobacterium
PCLTGFIPASEWRSPADTS

SEQ ID NO: 296826 - protein, 28 aa, Mycobacterium
PDFIGLFDRICRVGRSLRVHLLLATQSL

SEQ ID NO: 296827 - protein, 18 aa, Mycobacterium
PDGTPLWPGLPPAPPPGA

SEQ ID NO: 296828 - protein, 17 aa, Mycobacterium
PDHGFPARIIVPALPGV

SEQ ID NO: 296829 - protein, 25 aa, Mycobacterium
PDILDPALLRPGRFDRQIPVSSPDL

SEQ ID NO: 296830 - protein, 25 aa, Mycobacterium
PDILDPALLRPGRFDRQIPVTNPDL

SEQ ID NO: 296831 - protein, 21 aa, Mycobacterium
PDPNLRPQIVGVFTDLTGPAP

SEQ ID NO: 296832 - protein, 20 aa, Mycobacterium
PDTSIAWSFVLALLAAALTA

SEQ ID NO: 296833 - protein, 25 aa, Mycobacterium
PEGYPIKASARFGLYYTPSSALYYD

SEQ ID NO: 296834 - protein, 18 aa, Mycobacterium
PELARLVESARLLVDEAN

SEQ ID NO: 296835 - protein, 20 aa, Mycobacterium
PESERATVFERFARGSTASR

SEQ ID NO: 296836 - protein, 18 aa, Mycobacterium
PEVAGRFWSGRAMGAQNT

SEQ ID NO: 296837 - protein, 22 aa, Mycobacterium
PEVVQPYLPIAVVAALDAVFGG

SEQ ID NO: 296838 - protein, 18 aa, Mycobacterium
PFISEFLVLLGTFNRYWL

SEQ ID NO: 296839 - protein, 19 aa, Mycobacterium
PFLEKRFSGDYAHHNLLQR

SEQ ID NO: 296840 - protein, 20 aa, Mycobacterium
PFNNGLRPEGIIALGSLVTY

SEQ ID NO: 296841 - protein, 18 aa, Mycobacterium
PFNNGLRPEGQIATGALI

SEQ ID NO: 296842 - protein, 17 aa, Mycobacterium
PFVKQIRTTRQMQELQP

SEQ ID NO: 296843 - protein, 25 aa, Mycobacterium
PFVMLGAGLLWFGWYGFNAGSATSS

SEQ ID NO: 296844 - protein, 24 aa, Mycobacterium
PGGRGIGLALVRLVTAQHGGTVEV

SEQ ID NO: 296845 - protein, 18 aa, Mycobacterium
PGTLTAIIGGSGAGKTTL

SEQ ID NO: 296846 - protein, 19 aa, Mycobacterium
PHLFDRDGVDFATGPPPPA

SEQ ID NO: 296847 - protein, 20 aa, Mycobacterium
PHYLRGRVVGVMTSLAYAAG

SEQ ID NO: 296848 - protein, 24 aa, Mycobacterium
PIDLLWSFLQAVLMAITILLIHTY

SEQ ID NO: 296849 - protein, 17 aa, Mycobacterium
PIGQGLSMTLLQMAGMY

SEQ ID NO: 296850 - protein, 19 aa, Mycobacterium
PKETVSFVAWVIYAAYLHA

SEQ ID NO: 296851 - protein, 17 aa, Mycobacterium
PLAIGMVVVVAAALTLG

SEQ ID NO: 296852 - protein, 24 aa, Mycobacterium
PLGDRIGRHRVLVVTILMMTVSTT

SEQ ID NO: 296853 - protein, 17 aa, Mycobacterium
PLGRAIVEEVRRRGITI

SEQ ID NO: 296854 - protein, 20 aa, Mycobacterium
PLIDLRLFRNPVLTHANVTM

SEQ ID NO: 296855 - protein, 18 aa, Mycobacterium
PLILLPLVLPPVVGGIAL

SEQ ID NO: 296856 - protein, 20 aa, Mycobacterium
PLLFIGFMFGLLLLTGTTIR

SEQ ID NO: 296857 - protein, 20 aa, Mycobacterium
PLLVIGVSLAVGRGVLSALG

SEQ ID NO: 296858 - protein, 28 aa, Mycobacterium
PLMSHLAARGWVCVSIGYRVSPRHTWPD

SEQ ID NO: 296859 - protein, 24 aa, Mycobacterium
PLPEAKWAVFYSMGLGATGGIYYN

SEQ ID NO: 296860 - protein, 23 aa, Mycobacterium
PLRQLRWALGEVQRGNYNAHMQI

SEQ ID NO: 296861 - protein, 24 aa, Mycobacterium
PLTPPRAVAIITQIASALDAAHAD

SEQ ID NO: 296862 - protein, 18 aa, Mycobacterium
PLYHDMGLIGAWLGCMYF

SEQ ID NO: 296863 - protein, 19 aa, Mycobacterium
PPEELQFVLADLKGGSAVK

SEQ ID NO: 296864 - protein, 20 aa, Mycobacterium
PPEELQFVLADLKGGSAVKP

SEQ ID NO: 296865 - protein, 20 aa, Mycobacterium
PPLHDQWRPVLWAISILTMA

SEQ ID NO: 296866 - protein, 17 aa, Mycobacterium
PPVPVLLVIVDEYLELF

SEQ ID NO: 296867 - protein, 18 aa, Mycobacterium
PQQYSLVLADGVQTLPPL

SEQ ID NO: 296868 - protein, 23 aa, Mycobacterium
PQSPRLINMYGITETTVHASFRE

SEQ ID NO: 296869 - protein, 23 aa, Mycobacterium
PRPRDLAPLLAAWVISVGVMAFE

SEQ ID NO: 296870 - protein, 19 aa, Mycobacterium
PRYIEYRGGRFPELDVPAV

SEQ ID NO: 296871 - protein, 23 aa, Mycobacterium
PSLLPRGPLFQGLVSGGAGAIGY

SEQ ID NO: 296872 - protein, 22 aa, Mycobacterium
PSPTCIIVGLPAGLRLAVDNAI

SEQ ID NO: 296873 - protein, 24 aa, Mycobacterium
PSRPGEKNMPFWGTSFSAAYVSGV

SEQ ID NO: 296874 - protein, 26 aa, Mycobacterium
PSVPDARLRFVLCDAGPVVVVTTAEL

SEQ ID NO: 296875 - protein, 23 aa, Mycobacterium
PTELRIGDLMVVKPGERVATDGI

SEQ ID NO: 296876 - protein, 18 aa, Mycobacterium
PTGALFRTEFGTVVVQQD

SEQ ID NO: 296877 - protein, 21 aa, Mycobacterium
PTSRRPLLRLALTEAALFGVA

SEQ ID NO: 296878 - protein, 23 aa, Mycobacterium
PTVPKVYIALAWLWVAVPFAYGV

SEQ ID NO: 296879 - protein, 19 aa, Mycobacterium
PVAIWWFIIRPWRRERRIT

SEQ ID NO: 296880 - protein, 24 aa, Mycobacterium
PVAVASAVLRVWPVPVVMAVMVAL

SEQ ID NO: 296881 - protein, 22 aa, Mycobacterium
PVFPSATSRWVFEARPDLPTTV

SEQ ID NO: 296882 - protein, 18 aa, Mycobacterium
PVIGTWLHWALFGGDFPC

SEQ ID NO: 296883 - protein, 18 aa, Mycobacterium
PVRQRYNTMISRLRADSE

SEQ ID NO: 296884 - protein, 22 aa, Mycobacterium
PVSHMWVTKFLRTHGLIHDCPK

SEQ ID NO: 296885 - protein, 26 aa, Mycobacterium
PWLTFLRALPPLAYFFLLVIWLGIDE

SEQ ID NO: 296886 - protein, 18 aa, Mycobacterium
PWTALTLLVVGVYGLCLE

SEQ ID NO: 296887 - protein, 27 aa, Mycobacterium
PYLEPVSHMWVVKFLRTHGLIHDCPKL

SEQ ID NO: 296888 - protein, 19 aa, Mycobacterium
PYLTHWDAGAVVLEMYEHL

SEQ ID NO: 296889 - protein, 18 aa, Mycobacterium
QAAGLLFFAFAGYARIAT

SEQ ID NO: 296890 - protein, 17 aa, Mycobacterium
QDMGEFYGRNIFMAETS

SEQ ID NO: 296891 - protein, 20 aa, Mycobacterium
QELYQARGLMEYGSVLGHGA

SEQ ID NO: 296892 - protein, 20 aa, Mycobacterium
QELYQARGLMQYGSVLGHGA

SEQ ID NO: 296893 - protein, 23 aa, Mycobacterium
QGGARMGFGFGKSRAKQLSKDMP

SEQ ID NO: 296894 - protein, 18 aa, Mycobacterium
QKARAAGIHLVLATQRPS

SEQ ID NO: 296895 - protein, 18 aa, Mycobacterium
QLFLRLTPRRILFHDFGA

SEQ ID NO: 296896 - protein, 18 aa, Mycobacterium
QLIAFGILTVISLLVLGV

SEQ ID NO: 296897 - protein, 35 aa, Mycobacterium
QLRVRRWRKLGAAIARWPGPILITASVLALGGLLV

SEQ ID NO: 296898 - protein, 23 aa, Mycobacterium
QPKKAAAALAWLVEEMEQRYQDM

SEQ ID NO: 296899 - protein, 18 aa, Mycobacterium
QQDVWRFVTYLSDAGSAD

SEQ ID NO: 296900 - protein, 24 aa, Mycobacterium
QQQMSRPKLDAMRAQFMLMLDMLR

SEQ ID NO: 296901 - protein, 24 aa, Mycobacterium
QQQMSRPKLDSMRAQFMLMLDMLR

SEQ ID NO: 296902 - protein, 25 aa, Mycobacterium
QRFWRITLPMLRPTTFFVLVTGIVS

SEQ ID NO: 296903 - protein, 17 aa, Mycobacterium
QRLAIARAVIRRPAIYL

SEQ ID NO: 296904 - protein, 17 aa, Mycobacterium
QRSLIMRALTGHEVEPT

SEQ ID NO: 296905 - protein, 20 aa, Mycobacterium
QRSPIVGVMFSMFLLAFAGI

SEQ ID NO: 296906 - protein, 24 aa, Mycobacterium
QSYFGNDHFAEWAPGMKSIDDALE

SEQ ID NO: 296907 - protein, 21 aa, Mycobacterium
QTLFFPFVLLLAATAMYRGND

SEQ ID NO: 296908 - protein, 20 aa, Mycobacterium
QWNNFMWPLVITSGHKWRVL

SEQ ID NO: 296909 - protein, 21 aa, Mycobacterium
QWNNFMWPLVITSGHKWRVLT

SEQ ID NO: 296910 - protein, 24 aa, Mycobacterium
QYQASGALLAWLTAAAVAIAMLTL

SEQ ID NO: 296911 - protein, 23 aa, Mycobacterium
RAATPRECRDPKPYVPAGTNPWY

SEQ ID NO: 296912 - protein, 20 aa, Mycobacterium
RADWRPHGWTPPPVQAGSIV

SEQ ID NO: 296913 - protein, 20 aa, Mycobacterium
RAGYMSNYFRWFGSPEDPFG

SEQ ID NO: 296914 - protein, 18 aa, Mycobacterium
RAQFMLMLDMLRETAHES

SEQ ID NO: 296915 - protein, 18 aa, Mycobacterium
RAQFMLMLDMLRETAQES

SEQ ID NO: 296916 - protein, 28 aa, Mycobacterium
RASLPRLRYDQFMGLGWKLLIPASLVWV

SEQ ID NO: 296917 - protein, 21 aa, Mycobacterium
RASLRELLIPLVPAAVIALAL

SEQ ID NO: 296918 - protein, 22 aa, Mycobacterium
RAVLNFRHGWDIYNEHFDYVDP

SEQ ID NO: 296919 - protein, 25 aa, Mycobacterium
RCRASRIVLHPGFTIPVFLLSYYGL

SEQ ID NO: 296920 - protein, 17 aa, Mycobacterium
RDIKWLKWIEVPFARIG

SEQ ID NO: 296921 - protein, 18 aa, Mycobacterium
REAIKGTPLQGAAIYLGG

SEQ ID NO: 296922 - protein, 20 aa, Mycobacterium
REELVYLPPAWFASSPPPEL

SEQ ID NO: 296923 - protein, 24 aa, Mycobacterium
RELFQEVFLNPGLVLLMGGIIIGL

SEQ ID NO: 296924 - protein, 19 aa, Mycobacterium
RELLRRRFLWVGAAGAALT

SEQ ID NO: 296925 - protein, 20 aa, Mycobacterium
RELPTLAPGQEWRMVWDSAL

SEQ ID NO: 296926 - protein, 20 aa, Mycobacterium
REPERLWQITELQFAALSGV

SEQ ID NO: 296927 - protein, 21 aa, Mycobacterium
REYRAEAAILEMFRTDRPELV

SEQ ID NO: 296928 - protein, 18 aa, Mycobacterium
RFGFLITALCLFTAVFIM

SEQ ID NO: 296929 - protein, 18 aa, Mycobacterium
RFIAHPWTALTLLVVGVY

SEQ ID NO: 296930 - protein, 19 aa, Mycobacterium
RGGYDFRPQIVGVFTDLSG

SEQ ID NO: 296931 - protein, 18 aa, Mycobacterium
RGQMAITSQMVYARLAMR

SEQ ID NO: 296932 - protein, 19 aa, Mycobacterium
RGSDGVVIPGSYRNRHKAV

SEQ ID NO: 296933 - protein, 19 aa, Mycobacterium
RGSDGVVIPGSYRNRHRAV

SEQ ID NO: 296934 - protein, 23 aa, Mycobacterium
RGVGVCGGRVRGRVRIVRPETID

SEQ ID NO: 296935 - protein, 20 aa, Mycobacterium
RIALPLLAYFAIMWAGGYAL

SEQ ID NO: 296936 - protein, 22 aa, Mycobacterium
RIALPLLAYFAIMWGGGYLLGA

SEQ ID NO: 296937 - protein, 35 aa, Mycobacterium
RIKDEIREGRSFRSAVPRGWARARKTIVSGNAVTF

SEQ ID NO: 296938 - protein, 17 aa, Mycobacterium
RKIKIGMWRQANVAKVG

SEQ ID NO: 296939 - protein, 26 aa, Mycobacterium
RLDRRLDEAAGFAIPFVPRGLDEIPR

SEQ ID NO: 296940 - protein, 22 aa, Mycobacterium
RLELWRSDMVRMLSYGETDARV

SEQ ID NO: 296941 - protein, 18 aa, Mycobacterium
RLGAELLAAVGDPALIGS

SEQ ID NO: 296942 - protein, 23 aa, Mycobacterium
RLGATPLPVWGIIAGKSLAVVAV

SEQ ID NO: 296943 - protein, 25 aa, Mycobacterium
RLINERFGRGWGWFSVGDLFLLNFL

SEQ ID NO: 296944 - protein, 17 aa, Mycobacterium
RLMGVIFGTMFFLMFTP

SEQ ID NO: 296945 - protein, 30 aa, Mycobacterium
RLPTLVMALTCWWVISREVMPRLGHAVKQN

SEQ ID NO: 296946 - protein, 18 aa, Mycobacterium
RLQLGRPAVLVVRCTVVV

SEQ ID NO: 296947 - protein, 29 aa, Mycobacterium
RLRNELQHGFKLVKWIKGIEFVADYRDIG

SEQ ID NO: 296948 - protein, 31 aa, Mycobacterium; identical to SEQ ID NO: 14300

SEQ ID NO: 296949 - protein, 19 aa, Mycobacterium
RMAPFHHHFELVGWAETTV

SEQ ID NO: 296950 - protein, 17 aa, Mycobacterium
RMLAPIPGKSAVGIEVP

SEQ ID NO: 296951 - protein, 17 aa, Mycobacterium
RMRAEAFDLVLQTGAAG

SEQ ID NO: 296952 - protein, 19 aa, Mycobacterium
RMYALHILLLPGIILALIG

SEQ ID NO: 296953 - protein, 33 aa, Mycobacterium
RNGPRKAMFAAMCCFCGGWLVGAAGLALGQYWI

SEQ ID NO: 296954 - protein, 21 aa, Mycobacterium
RNILPPNKFPMIPPQVDPDPG

SEQ ID NO: 296955 - protein, 22 aa, Mycobacterium
RNRVGAEWLFTPVLLSQNYHLV

SEQ ID NO: 296956 - protein, 17 aa, Mycobacterium
RNTFWALVLPFMFGSPY

SEQ ID NO: 296957 - protein, 19 aa, Mycobacterium
RPASQLLRPYGPRPLVRAL

SEQ ID NO: 296958 - protein, 20 aa, Mycobacterium
RPEGIIALGSLVTYVLIERS

SEQ ID NO: 296959 - protein, 19 aa, Mycobacterium
RPGPQAALVGPEKTVPPER

SEQ ID NO: 296960 - protein, 17 aa, Mycobacterium
RPWNIKPGDVMPATYIG

SEQ ID NO: 296961 - protein, 24 aa, Mycobacterium
RRAGTQIGVPYSWGGGSLTGPSRG

SEQ ID NO: 296962 - protein, 18 aa, Mycobacterium
RRDIKAGHFSPMSHPQVM

SEQ ID NO: 296963 - protein, 19 aa, Mycobacterium
RRWYVITFLMGLFFVLGQG

SEQ ID NO: 296964 - protein, 20 aa, Mycobacterium
RRYADYLPSDGFQPYNIAST

SEQ ID NO: 296965 - protein, 18 aa, Mycobacterium
RRYADYLPTDGFTTLNVI

SEQ ID NO: 296966 - protein, 26 aa, Mycobacterium
RRYGGLRAALPITFATFGLGYLAIIG

SEQ ID NO: 296967 - protein, 19 aa, Mycobacterium
RSGSGLGLALVAQQAELHG

SEQ ID NO: 296968 - protein, 25 aa, Mycobacterium
RSLVRSGMDLGPWLVSRDITVVSTV

SEQ ID NO: 296969 - protein, 25 aa, Mycobacterium
RSSEQIMPLFVVTVMAQLVLCGGMV

SEQ ID NO: 296970 - protein, 25 aa, Mycobacterium
RTCIEATVLAVGWLMGGTVGVGTVL

SEQ ID NO: 296971 - protein, 17 aa, Mycobacterium
RTGLSVRLVRTCIEATV

SEQ ID NO: 296972 - protein, 23 aa, Mycobacterium
RTILHRRYKQFGALPLLAPLLAA

SEQ ID NO: 296973 - protein, 19 aa, Mycobacterium
RVANLFLTKTVYSVLLALL

SEQ ID NO: 296974 - protein, 18 aa, Mycobacterium
RVRGKIGPSQAWYTENLR

SEQ ID NO: 296975 - protein, 29 aa, Mycobacterium
RVRKYLTLMAFRIPALILAALAYGAWHNG

SEQ ID NO: 296976 - protein, 20 aa, Mycobacterium
RVSLVPTLLVSIPFTVLVAF

SEQ ID NO: 296977 - protein, 20 aa, Mycobacterium
RWVQNALSFIGFVPPDENDL

SEQ ID NO: 296978 - protein, 21 aa, Mycobacterium
RYLSFGGLFIGLSVFQIEYDF

SEQ ID NO: 296979 - protein, 19 aa, Mycobacterium
RYTRPHLRLFSGQVSTGCG

SEQ ID NO: 296980 - protein, 23 aa, Mycobacterium
SAFARTEFQAVQFIPLVMVPQLL

SEQ ID NO: 296981 - protein, 24 aa, Mycobacterium
SAFARTEFQAVQFIPLVMVPQLLL

SEQ ID NO: 296982 - protein, 19 aa, Mycobacterium
SAHELRTPLTAMRTNLEVL

SEQ ID NO: 296983 - protein, 19 aa, Mycobacterium
SAIGFAYGSARSWQAKVAW

SEQ ID NO: 296984 - protein, 19 aa, Mycobacterium
SALPTAGGGYTFARRALGP

SEQ ID NO: 296985 - protein, 24 aa, Mycobacterium
SAMATLRIAFLSALVLELLATLGV

SEQ ID NO: 296986 - protein, 21 aa, Mycobacterium
SAMNRFKRDYLAAYISASSDP

SEQ ID NO: 296987 - protein, 27 aa, Mycobacterium
SAVPEVLRLIFASAFGLDSAFGAIIGS

SEQ ID NO: 296988 - protein, 20 aa, Mycobacterium
SCQKVLEGSGFVIAPDRVMT

SEQ ID NO: 296989 - protein, 17 aa, Mycobacterium
SDTVPLYTAELLNLGKF

SEQ ID NO: 296990 - protein, 19 aa, Mycobacterium
SDVCKHCTHAGCLDVCPTG

SEQ ID NO: 296991 - protein, 23 aa, Mycobacterium
SEALFKTCFYAVIAALAVAPLAL

SEQ ID NO: 296992 - protein, 21 aa, Mycobacterium
SEGDIAPPTRVVLRRQRNVQV

SEQ ID NO: 296993 - protein, 21 aa, Mycobacterium
SELRPPVRSGFGSRVELRLAA

SEQ ID NO: 296994 - protein, 30 aa, Mycobacterium
SFDIPLWVLITWLLVRWARTRDDRLLLWAA

SEQ ID NO: 296995 - protein, 26 aa, Mycobacterium
SGGQRKRASVALELLTQPSLLLLDEP

SEQ ID NO: 296996 - protein, 17 aa, Mycobacterium
SGLAALIRARFPALTAR

SEQ ID NO: 296997 - protein, 22 aa, Mycobacterium
SGSGKSEFFLSLVYGIALTHSP

SEQ ID NO: 296998 - protein, 23 aa, Mycobacterium
SHELRTPLTTVRMAADLIYDHSA

SEQ ID NO: 296999 - protein, 27 aa, Mycobacterium
SHIAAPRAKLFAALFLILALVVIGEVA

SEQ ID NO: 297000 - protein, 20 aa, Mycobacterium
SILIRGLMNYTFWVPNGSPE

SEQ ID NO: 297001 - protein, 20 aa, Mycobacterium
SLCLIFIIMLILTRAFVAAA

SEQ ID NO: 297002 - protein, 17 aa, Mycobacterium
SLGGWVAFELERRGRAR

SEQ ID NO: 297003 - protein, 26 aa, Mycobacterium
SLNNGFHGKWPWQMTHQMDGAVQIDK

SEQ ID NO: 297004 - protein, 18 aa, Mycobacterium
SLTAFLAYFTQILMAVLM

SEQ ID NO: 297005 - protein, 24 aa, Mycobacterium
SNRLRRMQTGFARNYALSMLAGAV

SEQ ID NO: 297006 - protein, 19 aa, Mycobacterium
SPDALNLVLVDFKGGATFL

SEQ ID NO: 297007 - protein, 19 aa, Mycobacterium
SPRVPAEPGGDFVDQAGDG

SEQ ID NO: 297008 - protein, 18 aa, Mycobacterium
SRESLFWVSDNGVRFGIA

SEQ ID NO: 297009 - protein, 20 aa, Mycobacterium
SRITLPGSIYLGAISVLPNL

SEQ ID NO: 297010 - protein, 25 aa, Mycobacterium
SSALPAAGGGYTFARRALGPWGGFA

SEQ ID NO: 297011 - protein, 26 aa, Mycobacterium
SSCRSCGTCSRAGVTASPSRSTIRGA

SEQ ID NO: 297012 - protein, 19 aa, Mycobacterium
SSLCGHGDVAFGTTVSGRP

SEQ ID NO: 297013 - protein, 23 aa, Mycobacterium
SSSCSYAAVALARSLFRKGANFT

SEQ ID NO: 297014 - protein, 20 aa, Mycobacterium
SSVAGLGLFNPVSVGAGLIL

SEQ ID NO: 297015 - protein, 26 aa, Mycobacterium
STLPFLWNIFKSWRYGEVVTVDDPWG

SEQ ID NO: 297016 - protein, 27 aa, Mycobacterium
STLPFLWNVFKSWRYGEVVTVDDPWGY

SEQ ID NO: 297017 - protein, 27 aa, Mycobacterium
STQRFTDRFQRVFVPVILVGVVLLLFA

SEQ ID NO: 297018 - protein, 22 aa, Mycobacterium
SVADLRIGDIVVVRPNMRLAAD

SEQ ID NO: 297019 - protein, 21 aa, Mycobacterium
SVITEPGRHDWVFANTAFARA

SEQ ID NO: 297020 - protein, 25 aa, Mycobacterium
SVNALVPFYAIGVFTGFSMAGYGMT

SEQ ID NO: 297021 - protein, 19 aa, Mycobacterium
SVTLSIQFALLAGQVGATS

SEQ ID NO: 297022 - protein, 18 aa, Mycobacterium
SYESFWVEALVRARGDLD

SEQ ID NO: 297023 - protein, 25 aa, Mycobacterium
TALNEGRGDFFAVVRSLALFVNALH

SEQ ID NO: 297024 - protein, 24 aa, Mycobacterium
TALRELALLWLADQVDTALAKYRA

SEQ ID NO: 297025 - protein, 24 aa, Mycobacterium
TARAMPGSGLGLAIVKKVVLNHGG

SEQ ID NO: 297026 - protein, 17 aa, Mycobacterium
TASRSGSGLGLALVAQQ

SEQ ID NO: 297027 - protein, 25 aa, Mycobacterium
TDAEPRLRALGWTGVLDKGPDVDAG

SEQ ID NO: 297028 - protein, 22 aa, Mycobacterium
TDDLRPIPVFGSDELARLTEAF

SEQ ID NO: 297029 - protein, 18 aa, Mycobacterium
TDPAIRFVVLSLLAVDGV

SEQ ID NO: 297030 - protein, 21 aa, Mycobacterium
TERGFSMALGRLGDPADGDCL

SEQ ID NO: 297031 - protein, 22 aa, Mycobacterium
TFAVNLLVALAMAAGTDYAIFF

SEQ ID NO: 297032 - protein, 18 aa, Mycobacterium
TFCLKFARMPYFETLGIP

SEQ ID NO: 297033 - protein, 21 aa, Mycobacterium
TFLTVEAWAFLQLGARQQSGD

SEQ ID NO: 297034 - protein, 20 aa, Mycobacterium
TGMKVRRYFVGFGPTLWSTR

SEQ ID NO: 297035 - protein, 23 aa, Mycobacterium
TGPLPYIVMEYVDGVTLRDIVHT

SEQ ID NO: 297036 - protein, 17 aa, Mycobacterium
TGRRVFRMAPFHHHFEL

SEQ ID NO: 297037 - protein, 28 aa, Mycobacterium
TIARVFVEWRFDLIFGTAAFVIAGIYLV

SEQ ID NO: 297038 - protein, 25 aa, Mycobacterium
TIATACPFCRVMVTDGVNDRQEEAG

SEQ ID NO: 297039 - protein, 26 aa, Mycobacterium
TITAIAVVVLLGWSFFYFSDDTRGYK

SEQ ID NO: 297040 - protein, 18 aa, Mycobacterium
TKIARAMVTEYGMSSKLG

SEQ ID NO: 297041 - protein, 17 aa, Mycobacterium
TLLSWYALVAALTTIPL

SEQ ID NO: 297042 - protein, 23 aa, Mycobacterium
TLTLADGRVVIWGTTDRAEEKAE

SEQ ID NO: 297043 - protein, 18 aa, Mycobacterium
TMIAIAVLVGVALVGLTV

SEQ ID NO: 297044 - protein, 25 aa, Mycobacterium
TMREARAGDRYLLCSDGLSDPVSDE

SEQ ID NO: 297045 - protein, 23 aa, Mycobacterium
TPEKDGKVVLDFDDVVQRSITVV

SEQ ID NO: 297046 - protein, 17 aa, Mycobacterium
TPGRGFRNGPFASEIEL

SEQ ID NO: 297047 - protein, 22 aa, Mycobacterium
TPLTAKLAWFSKVLTIAILGLA

SEQ ID NO: 297048 - protein, 17 aa, Mycobacterium
TPTKWVHHFGLFAAVGA

SEQ ID NO: 297049 - protein, 24 aa, Mycobacterium
TQLSRQLRLELGHEAVRQAGELVR

SEQ ID NO: 297050 - protein, 24 aa, Mycobacterium
TQPKKAAAALAWLVEEMEQRYQDM

SEQ ID NO: 297051 - protein, 26 aa, Mycobacterium
TQPVLLDWAVGLAFPCQQPMLHVNGV

SEQ ID NO: 297052 - protein, 26 aa, Mycobacterium
TSMLQRKLRVGFAKAGRLMDLMETRG

SEQ ID NO: 297053 - protein, 23 aa, Mycobacterium
TTPEEPEMALARGASLAAANARL

SEQ ID NO: 297054 - protein, 24 aa, Mycobacterium
TTVIIRFWLLTAITCGLGVALFYG

SEQ ID NO: 297055 - protein, 23 aa, Mycobacterium
TVDRMGAAFGEQGSKTTIFVAME

SEQ ID NO: 297056 - protein, 17 aa, Mycobacterium
TVFGLGIGPAVLIHEGS

SEQ ID NO: 297057 - protein, 18 aa, Mycobacterium
TVFSMRVAAAIGFLQMKR

SEQ ID NO: 297058 - protein, 24 aa, Mycobacterium
TVGFDCSGLTRFAFAGVGVLLPRW

SEQ ID NO: 297059 - protein, 17 aa, Mycobacterium
TVLACGLLLPSVQSNSM

SEQ ID NO: 297060 - protein, 17 aa, Mycobacterium
TVLGRGGVGLSLGQRQR

SEQ ID NO: 297061 - protein, 17 aa, Mycobacterium
TVPPLVLAMTFGLSMDY

SEQ ID NO: 297062 - protein, 21 aa, Mycobacterium
TVVLCVVALYAVNVVLTTIGV

SEQ ID NO: 297063 - protein, 25 aa, Mycobacterium
TVVSPRAGLVMNPDAKVKMRGVEVG

SEQ ID NO: 297064 - protein, 25 aa, Mycobacterium
TYLGGWRIIRTLGKGLVEIQSPQGM

SEQ ID NO: 297065 - protein, 17 aa, Mycobacterium
VAAAIGFLQMKRWGHQW

SEQ ID NO: 297066 - protein, 18 aa, Mycobacterium
VAALSAWGLYRFNQILAG

SEQ ID NO: 297067 - protein, 18 aa, Mycobacterium
VAALSAWGLYRFNQIVAG

SEQ ID NO: 297068 - protein, 19 aa, Mycobacterium
VACQVPIYLMRSSRFTALE

SEQ ID NO: 297069 - protein, 18 aa, Mycobacterium
VADGRRVVLGAADTFRAA

SEQ ID NO: 297070 - protein, 25 aa, Mycobacterium
VAEAAYRLIELALRGGGPDNVTVVV

SEQ ID NO: 297071 - protein, 25 aa, Mycobacterium
VAESAYRLIELALRGGGPDNVTVVV

SEQ ID NO: 297072 - protein, 17 aa, Mycobacterium
VAGRLGDRFGPKNLYLI

SEQ ID NO: 297073 - protein, 19 aa, Mycobacterium
VAIACIIGALTLFSGPTGI

SEQ ID NO: 297074 - protein, 19 aa, Mycobacterium
VAIAPTLLVAIPFTVLVSF

SEQ ID NO: 297075 - protein, 19 aa, Mycobacterium
VALFFVWMIAVAFLYLVLG

SEQ ID NO: 297076 - protein, 20 aa, Mycobacterium
VALLGYHGLVGLSIFSTNVL

SEQ ID NO: 297077 - protein, 26 aa, Mycobacterium
VALLTTVIFAIRWRRDEESESKKREA

SEQ ID NO: 297078 - protein, 17 aa, Mycobacterium
VALLWFLGVYLVVLAFV

SEQ ID NO: 297079 - protein, 20 aa, Mycobacterium
VALTSILGFVFGVLGMAIAA

SEQ ID NO: 297080 - protein, 19 aa, Mycobacterium
VALVLWWRMVRFEYALIVT

SEQ ID NO: 297081 - protein, 27 aa, Mycobacterium
VAQRWASPFWQFWDLALLWLAQLHGGN

SEQ ID NO: 297082 - protein, 20 aa, Mycobacterium
VARLRHRGMDEAGYMPDEPG

SEQ ID NO: 297083 - protein, 20 aa, Mycobacterium
VAVLFGWGAWQRRWIADDGL

SEQ ID NO: 297084 - protein, 25 aa, Mycobacterium
VDAEPAAWLRFWFPDPDGSKTEFQR

SEQ ID NO: 297085 - protein, 17 aa, Mycobacterium
VDDGGYVSARWPGDTHT

SEQ ID NO: 297086 - protein, 23 aa, Mycobacterium
VDGVSLLAQMMWTMKSTGALRDR

SEQ ID NO: 297087 - protein, 21 aa, Mycobacterium
VDYSLFILMRFREELRSGRQP

SEQ ID NO: 297088 - protein, 18 aa, Mycobacterium
VEFLWGRLPLYIVAIYPM

SEQ ID NO: 297089 - protein, 23 aa, Mycobacterium
VEGLAALIFSRYLWAFELTSALL

SEQ ID NO: 297090 - protein, 19 aa, Mycobacterium
VEGMLARIGKEQQRTKAAL

SEQ ID NO: 297091 - protein, 25 aa, Mycobacterium
VELAAPWFIGAAMGLQVLGTFSVGQ

SEQ ID NO: 297092 - protein, 32 aa, Mycobacterium
VEQRSDQRLGFTARRAAVLAAVVCVLTLTIAG

SEQ ID NO: 297093 - protein, 21 aa, Mycobacterium
VETQVGFKMAKWINQIEFIDD

SEQ ID NO: 297094 - protein, 23 aa, Mycobacterium
VFGFGVIFGAIWAEEAWGRYWGW

SEQ ID NO: 297095 - protein, 21 aa, Mycobacterium
VFGGAGAIFPIFMIGGVAMMM

SEQ ID NO: 297096 - protein, 24 aa, Mycobacterium
VFGRGDIALTWAFLGAGIGSVIRP

SEQ ID NO: 297097 - protein, 21 aa, Mycobacterium
VFPSATSRWVFEARPDLPTTV

SEQ ID NO: 297098 - protein, 18 aa, Mycobacterium
VFVGFAFAGMPLVAEIGV

SEQ ID NO: 297099 - protein, 21 aa, Mycobacterium
VGALADWFAVTALFKHPLGIP

SEQ ID NO: 297100 - protein, 21 aa, Mycobacterium
VGALADWFAVTALFRHPLGIP

SEQ ID NO: 297101 - protein, 23 aa, Mycobacterium
VGGPRRKSRIISEHEKKITAYHE

SEQ ID NO: 297102 - protein, 20 aa, Mycobacterium
VGLASYLLIGFWYHKPSAAT

SEQ ID NO: 297103 - protein, 20 aa, Mycobacterium
VGLASYLLIGFWYHKPTAAT

SEQ ID NO: 297104 - protein, 20 aa, Mycobacterium
VGLGCCFGPLAGRYFPPMGS

SEQ ID NO: 297105 - protein, 24 aa, Mycobacterium
VGLRPGEEKLVFSRFWRADPSRVR

SEQ ID NO: 297106 - protein, 25 aa, Mycobacterium
VGPGQRVALLLSRSVEAVVAIMGVL

SEQ ID NO: 297107 - protein, 18 aa, Mycobacterium
VGRRLPLMVDVMFYSVVG

SEQ ID NO: 297108 - protein, 25 aa, Mycobacterium
VHLARIFFTGAFRRPREANWVIGSL

SEQ ID NO: 297109 - protein, 17 aa, Mycobacterium
VHSALLSAGPGPGALLA

SEQ ID NO: 297110 - protein, 25 aa, Mycobacterium
VIDGEIKQRYELFTSVGARDANDYE

SEQ ID NO: 297111 - protein, 25 aa, Mycobacterium
VILFQHLFWFFGHPEVYVIALPFFG

SEQ ID NO: 297112 - protein, 17 aa, Mycobacterium
VILSGPGRYGLDAGRGW

SEQ ID NO: 297113 - protein, 18 aa, Mycobacterium
VIQAPRLFAGQIDFGDVG

SEQ ID NO: 297114 - protein, 20 aa, Mycobacterium
VKAEMLVGTPAMWWLAVPVL

SEQ ID NO: 297115 - protein, 21 aa, Mycobacterium
VKSNIAFRIALRAESGDDSRE

SEQ ID NO: 297116 - protein, 27 aa, Mycobacterium
VLAFRHFGNAVLLLAIWIGIGFIFRGV

SEQ ID NO: 297117 - protein, 20 aa, Mycobacterium
VLAVRLNVLFSYQGNDMYTA

SEQ ID NO: 297118 - protein, 17 aa, Mycobacterium
VLCLFLLEMGMTASRKL

SEQ ID NO: 297119 - protein, 19 aa, Mycobacterium
VLGFLRFGLPPEDRIQLQD

SEQ ID NO: 297120 - protein, 23 aa, Mycobacterium
VLMLGQCRVLFAMARDGLLPRQL

SEQ ID NO: 297121 - protein, 24 aa, Mycobacterium
VMALSFASVNGWWYVSNFGVPWSN

SEQ ID NO: 297122 - protein, 23 aa, Mycobacterium
VMTAGAALVMWMGELITERGIGN

SEQ ID NO: 297123 - protein, 17 aa, Mycobacterium
VMVVPGVVVALVIRVRP

SEQ ID NO: 297124 - protein, 18 aa, Mycobacterium
VPANIGYAAAERGFGAAR

SEQ ID NO: 297125 - protein, 24 aa, Mycobacterium
VPPARLTKMTAMPQLVAFFNGVGG

SEQ ID NO: 297126 - protein, 19 aa, Mycobacterium
VRAFIPLFVANAVFWSLFQ

SEQ ID NO: 297127 - protein, 22 aa, Mycobacterium
VRDGEITWPPPPVQVSAAPAAQ

SEQ ID NO: 297128 - protein, 18 aa, Mycobacterium
VRQGALAEWNEAWRSDQF

SEQ ID NO: 297129 - protein, 21 aa, Mycobacterium
VRQLFTVRIGLRLTEATQTTM

SEQ ID NO: 297130 - protein, 17 aa, Mycobacterium
VRSEIEQLLGLLLSQGR

SEQ ID NO: 297131 - protein, 17 aa, Mycobacterium
VRTEIEQLLGLLLSQGR

SEQ ID NO: 297132 - protein, 18 aa, Mycobacterium
VSEREGAKLIIYDDEYTK

SEQ ID NO: 297133 - protein, 17 aa, Mycobacterium
VSIPLPWMAVLIANDRP

SEQ ID NO: 297134 - protein, 23 aa, Mycobacterium
VTAGFLTLFGFIFVITQYFQFIK

SEQ ID NO: 297135 - protein, 19 aa, Mycobacterium
VTAGVYSLVGFEVTPATVI

SEQ ID NO: 297136 - protein, 25 aa, Mycobacterium
VTEPVRRRWLTWSRYTRTWESTCTL

SEQ ID NO: 297137 - protein, 30 aa, Mycobacterium
VVALLMFSAGGLGLGWFTPATVPQAHAQCP

SEQ ID NO: 297138 - protein, 17 aa, Mycobacterium
VVCAIGLGSVAGVSRVF

SEQ ID NO: 297139 - protein, 24 aa, Mycobacterium
VVGLGCGFGPLNNRFFPPMGSILY

SEQ ID NO: 297140 - protein, 19 aa, Mycobacterium
VVHTFWVPEFLFKRDVIPN

SEQ ID NO: 297141 - protein, 17 aa, Mycobacterium
VVTLILALILKYTIGLR

SEQ ID NO: 297142 - protein, 18 aa, Mycobacterium
VVVLMAFAVYAVISAALY

SEQ ID NO: 297143 - protein, 19 aa, Mycobacterium
VVVPAFMHVMGRWNWWAPR

SEQ ID NO: 297144 - protein, 17 aa, Mycobacterium
VYLCLAAGVYFSIRTRL

SEQ ID NO: 297145 - protein, 18 aa, Mycobacterium
WAFLIWGMYAYLWAFVLY

SEQ ID NO: 297146 - protein, 18 aa, Mycobacterium
WALSVMFLVFTLRAILYK

SEQ ID NO: 297147 - protein, 17 aa, Mycobacterium
WAVGLAFPCQQPMLHAN

SEQ ID NO: 297148 - protein, 17 aa, Mycobacterium
WAVGLAFPCQQPMLHVN

SEQ ID NO: 297149 - protein, 17 aa, Mycobacterium
WDGPAWSISAEWLAYLL

SEQ ID NO: 297150 - protein, 19 aa, Mycobacterium
WFAVTALFRHPLGIPIPHT

SEQ ID NO: 297151 - protein, 20 aa, Mycobacterium
WGVRVGGIFTALGVTSVVIG

SEQ ID NO: 297152 - protein, 23 aa, Mycobacterium
WKKGLRHSVYFTHGIRNAVDSGH

SEQ ID NO: 297153 - protein, 18 aa, Mycobacterium
WLIGCLALLFATSSGLGM

SEQ ID NO: 297154 - protein, 17 aa, Mycobacterium
WLLLAPRDYLSTFMKVG

SEQ ID NO: 297155 - protein, 25 aa, Mycobacterium
WLSSELMFFAGLFAMYFTARAQADE

SEQ ID NO: 297156 - protein, 17 aa, Mycobacterium
WMANWRFVAQKTDYFTQ

SEQ ID NO: 297157 - protein, 18 aa, Mycobacterium
WMIARVSLVPTLLVSIPF

SEQ ID NO: 297158 - protein, 17 aa, Mycobacterium
WMLGLATVPAMLLLPLL

SEQ ID NO: 297159 - protein, 18 aa, Mycobacterium
WMVARVSLVPTLLVSIPF

SEQ ID NO: 297160 - protein, 17 aa, Mycobacterium
WNVFMIFGVLSLFVAHA

SEQ ID NO: 297161 - protein, 21 aa, Mycobacterium
WPLADRPRLAPGVPGGTIPVR

SEQ ID NO: 297162 - protein, 18 aa, Mycobacterium
WRNLRFARDKMPADAVAV

SEQ ID NO: 297163 - protein, 25 aa, Mycobacterium
WRTRRWRLRILPALVAAAAVLAGVM

SEQ ID NO: 297164 - protein, 21 aa, Mycobacterium
WRVTPGVAATGHFDAVHRVIG

SEQ ID NO: 297165 - protein, 25 aa, Mycobacterium
WSTLKVSLLLSVALFFVWMIAVAFL

SEQ ID NO: 297166 - protein, 18 aa, Mycobacterium
WVFLFPAGVLVLILVCAN

SEQ ID NO: 297167 - protein, 25 aa, Mycobacterium
WVTEPVRRRWLTWSRYTRTWQSVCT

SEQ ID NO: 297168 - protein, 18 aa, Mycobacterium
WWVGVGIVIVLAFVIIGG

SEQ ID NO: 297169 - protein, 20 aa, Mycobacterium
WYTENLRYYYLILPTVDGSL

SEQ ID NO: 297170 - protein, 22 aa, Mycobacterium
WYTENLRYYYLILPTVDGSLSR

SEQ ID NO: 297171 - protein, 17 aa, Mycobacterium
YAAMLFAVVPLRNALPG

SEQ ID NO: 297172 - protein, 20 aa, Mycobacterium
YAVFMSLGWMLVRVPRADWR

SEQ ID NO: 297173 - protein, 24 aa, Mycobacterium
YAVRWPDPWPSTFGYHEFFHACTA

SEQ ID NO: 297174 - protein, 19 aa, Mycobacterium
YFFLTRFFTGSGIGGEYAA

SEQ ID NO: 297175 - protein, 20 aa, Mycobacterium
YGSGRLVRLTTFMVDVLAGV

SEQ ID NO: 297176 - protein, 24 aa, Mycobacterium
YGSLVMVFQWGWLKDLGFAQISSI

SEQ ID NO: 297177 - protein, 24 aa, Mycobacterium
YLGGWRVIRTLGKGLVEIESPQGL

SEQ ID NO: 297178 - protein, 18 aa, Mycobacterium
YLLWAIIPMAAWATRTGF

SEQ ID NO: 297179 - protein, 18 aa, Mycobacterium
YLPPEAFDNPDFQRGLKL

SEQ ID NO: 297180 - protein, 19 aa, Mycobacterium
YLPPEAFKSPDFARGLKQF

SEQ ID NO: 297181 - protein, 18 aa, Mycobacterium
YLPSDGFQPYNIASTVGA

SEQ ID NO: 297182 - protein, 20 aa, Mycobacterium
YLRFRREAQNAAALNHPSIV

SEQ ID NO: 297183 - protein, 17 aa, Mycobacterium
YMSNYFRWFGSPEDPFG

SEQ ID NO: 297184 - protein, 19 aa, Mycobacterium
YNTMISRLRADSEHVRLVQ

SEQ ID NO: 297185 - protein, 20 aa, Mycobacterium
YQLHALIGMVLFTLWPFTRL

SEQ ID NO: 297186 - protein, 19 aa, Mycobacterium
YRIDWERSALVNGLVPAQF

SEQ ID NO: 297187 - protein, 18 aa, Mycobacterium
YRSYGQAVGRFLPVLGRF

SEQ ID NO: 297188 - protein, 23 aa, Mycobacterium
YSFLSFYPYWGFQGLTSHYANPL

SEQ ID NO: 297189 - protein, 20 aa, Mycobacterium
YSIGGILYAVRWPDPWPSTF

SEQ ID NO: 297190 - protein, 19 aa, Mycobacterium
YSIPLRRALVTGSDLPYPE

SEQ ID NO: 297191 - protein, 41 aa, Mycobacterium
YSLVAGLPLAHWEFYMALAYFKLAIIAAGIDFRRRMSDQAR

SEQ ID NO: 297192 - protein, 21 aa, Mycobacterium
YTKVCSHLGCPSSLYEQQTYR

SEQ ID NO: 297193 - protein, 23 aa, Mycobacterium
YTRSEGGGMLVLKRVDDARRDGD

SEQ ID NO: 297194 - protein, 17 aa, Mycobacterium
YVDAHAPYLAWLTTTSA

SEQ ID NO: 297195 - protein, 18 aa, Mycobacterium
YVDIAHRAALLYSFATLL

SEQ ID NO: 297196 - protein, 25 aa, Mycobacterium
YYYMAETNLRFLLGKSATIPVPIVR

SEQ ID NO: 297197 - protein, 20 aa, Mycobacterium
AAAAAVWLVAPCTELFEDER

SEQ ID NO: 297198 - protein, 17 aa, Mycobacterium
AAAACFTAGVAALRCVT

SEQ ID NO: 297199 - protein, 25 aa, Mycobacterium
AAAAELPIIIVILIQIILVLLEILY

SEQ ID NO: 297200 - protein, 27 aa, Mycobacterium
AAAAFLVTPTAWWVCGTTATLTVLYLA

SEQ ID NO: 297201 - protein, 20 aa, Mycobacterium
AAAAHWGIVGWSMGGTCAVD

SEQ ID NO: 297202 - protein, 19 aa, Mycobacterium
AAAALWACADGMVRFRSLT

SEQ ID NO: 297203 - protein, 23 aa, Mycobacterium
AAAALWLGVAGWSLWAANSPGMG

SEQ ID NO: 297204 - protein, 17 aa, Mycobacterium
AAAANGWTWSRTVSDTE

SEQ ID NO: 297205 - protein, 18 aa, Mycobacterium
AAAARARARAAKLRQEAL

SEQ ID NO: 297206 - protein, 31 aa, Mycobacterium
AAAARRRLRLRPRWLRRPGRTGLAAMAAAVV

SEQ ID NO: 297207 - protein, 24 aa, Mycobacterium
AAAARWFAWAGGMGPTMLAEGDHS

SEQ ID NO: 297208 - protein, 26 aa, Mycobacterium
AAAAVRSRGAVPLALTILAAVVGAII

SEQ ID NO: 297209 - protein, 27 aa, Mycobacterium
AAAAVWCVTAVIGAFAAHRGWRRWRAR

SEQ ID NO: 297210 - protein, 20 aa, Mycobacterium
AAACACALLLTAIPVPVGHG

SEQ ID NO: 297211 - protein, 20 aa, Mycobacterium
AAACARRIARHRPRRPSRSL

SEQ ID NO: 297212 - protein, 23 aa, Mycobacterium
AAACLAVAMASLLYSRRRSSRLA

SEQ ID NO: 297213 - protein, 21 aa, Mycobacterium
AAACVAGALSLRDGAAVVALR

SEQ ID NO: 297214 - protein, 24 aa, Mycobacterium
AAADARPVWARALGLRLPPTGASD

SEQ ID NO: 297215 - protein, 17 aa, Mycobacterium
AAADPGLTQGGMAVGTY

SEQ ID NO: 297216 - protein, 36 aa, Mycobacterium
AAADPRAKLLRKRRRALRLGVFLTVSAVFWVAMTAL

SEQ ID NO: 297217 - protein, 18 aa, Mycobacterium
AAADVVLLAPGLAVIVAA

SEQ ID NO: 297218 - protein, 18 aa, Mycobacterium
AAADVVLLAPGLSVIVAA

SEQ ID NO: 297219 - protein, 23 aa, Mycobacterium
AAAEALTGLGNRFGEAIANGNEI

SEQ ID NO: 297220 - protein, 23 aa, Mycobacterium
AAAERWNLPIILIVLLAVFGSLT

SEQ ID NO: 297221 - protein, 18 aa, Mycobacterium
AAAEWSHPEPAALAGVPG

SEQ ID NO: 297222 - protein, 19 aa, Mycobacterium
AAAFTFSAVVGFIGNAILH

SEQ ID NO: 297223 - protein, 23 aa, Mycobacterium
AAAGALPGIWAFFSHQVAVVFSF

SEQ ID NO: 297224 - protein, 21 aa, Mycobacterium
AAAGAPVLISWRRTRRPEFAT

SEQ ID NO: 297225 - protein, 17 aa, Mycobacterium
AAAGLYLFVWLELASAD

SEQ ID NO: 297226 - protein, 18 aa, Mycobacterium
AAAGRPSLWVDEAGTLSA

SEQ ID NO: 297227 - protein, 18 aa, Mycobacterium
AAAGTLWLTAAQWLMRLT

SEQ ID NO: 297228 - protein, 20 aa, Mycobacterium
AAAGVVAALAWVSRDRSPRF

SEQ ID NO: 297229 - protein, 23 aa, Mycobacterium
AAAGVVGLLAWVGRDRSPRLTAP

SEQ ID NO: 297230 - protein, 23 aa, Mycobacterium
AAAHLGFGIGWIAWIVIGGLAGW

SEQ ID NO: 297231 - protein, 22 aa, Mycobacterium
AAAHQPYVAWLMRNGAEAEAMA

SEQ ID NO: 297232 - protein, 27 aa, Mycobacterium
AAAHRKLCDTYKLAARAVQIQTNGDSP

SEQ ID NO: 297233 - protein, 24 aa, Mycobacterium
AAAIALLGFFAFYLSFVAELPPPP

SEQ ID NO: 297234 - protein, 20 aa, Mycobacterium
AAAIATLAVRGWALRVLAVL

SEQ ID NO: 297235 - protein, 17 aa, Mycobacterium
AAAIAVPIALPIALPLG

SEQ ID NO: 297236 - protein, 17 aa, Mycobacterium
AAAIAVWLLLPRNRADQ

SEQ ID NO: 297237 - protein, 18 aa, Mycobacterium
AAAIERFAPIIGGIRPGL

SEQ ID NO: 297238 - protein, 23 aa, Mycobacterium
AAAIGRWARRPRVWRVVAAGNAG

SEQ ID NO: 297239 - protein, 26 aa, Mycobacterium
AAAIVTWTPLFYVFAYAATFAVMGTP

SEQ ID NO: 297240 - protein, 17 aa, Mycobacterium
AAAKAYFGKPIEEVTVS

SEQ ID NO: 297241 - protein, 25 aa, Mycobacterium
AAAKRLPRGRAIGVDLWQADQTDNS

SEQ ID NO: 297242 - protein, 25 aa, Mycobacterium
AAAKRSALLHWSRRPESTQSRFWAR

SEQ ID NO: 297243 - protein, 25 aa, Mycobacterium
AAAKRSALLHWSRRPESTQSRFWTR

SEQ ID NO: 297244 - protein, 21 aa, Mycobacterium
AAAKRSGFLHWSRRPESTQSR

SEQ ID NO: 297245 - protein, 26 aa, Mycobacterium
AAAKRSSYLHWSRRAEAAQSRFWTRW

SEQ ID NO: 297246 - protein, 30 aa, Mycobacterium
AAAKYPPAWLLCALFPLAAVPLVPTRLLPP

SEQ ID NO: 297247 - protein, 35 aa, Mycobacterium
AAALAALRPTPGFPASGVVALCDFGAGGTSVTLAQ

SEQ ID NO: 297248 - protein, 20 aa, Mycobacterium
AAALAFAPFRRWIGMGRLVA

SEQ ID NO: 297249 - protein, 26 aa, Mycobacterium
AAALALLGAFGFYLAFIAELPPPPPK

SEQ ID NO: 297250 - protein, 19 aa, Mycobacterium
AAALAVWAGAPGMAAADDG

SEQ ID NO: 297251 - protein, 23 aa, Mycobacterium
AAALDRPGTLYSYVYADQTPDFP

SEQ ID NO: 297252 - protein, 20 aa, Mycobacterium
AAALGDWGTAWLRRLTAGDR

SEQ ID NO: 297253 - protein, 22 aa, Mycobacterium
AAALGGLIVYAALKLVDVRSFR

SEQ ID NO: 297254 - protein, 17 aa, Mycobacterium
AAALGIPRRRQFFRIVL

SEQ ID NO: 297255 - protein, 19 aa, Mycobacterium
AAALGLASVLLFVFLVPDI

SEQ ID NO: 297256 - protein, 17 aa, Mycobacterium
AAALGYVVWRLFGHIPY

SEQ ID NO: 297257 - protein, 24 aa, Mycobacterium
AAALILAVLCFRSLQESILLLAIW

SEQ ID NO: 297258 - protein, 20 aa, Mycobacterium
AAALILAVMCIRNFGNAVLL

SEQ ID NO: 297259 - protein, 26 aa, Mycobacterium
AAALLAALCAVGFSALPRLFTDDRSV

SEQ ID NO: 297260 - protein, 26 aa, Mycobacterium
AAALLLFFWRDWLRILSGFFSSLRYR

SEQ ID NO: 297261 - protein, 34 aa, Mycobacterium; identical to SEQ ID NO: 12861

SEQ ID NO: 297262 - protein, 31 aa, Mycobacterium
AAALMVPSLICAFSVAILDPFLDVGGKSALF

SEQ ID NO: 297263 - protein, 18 aa, Mycobacterium
AAALRDVLAARRIENVML

SEQ ID NO: 297264 - protein, 18 aa, Mycobacterium
AAALRRRPAIEYPGTRTL

SEQ ID NO: 297265 - protein, 29 aa, Mycobacterium
AAALSGTPAWEVFKPWAITSIAVAVAVAL

SEQ ID NO: 297266 - protein, 18 aa, Mycobacterium
AAALVFPKLFFPQASPAA

SEQ ID NO: 297267 - protein, 18 aa, Mycobacterium
AAALWLVAPCTELFQDGR

SEQ ID NO: 297268 - protein, 18 aa, Mycobacterium
AAALYERAAMLFKGTHVV

SEQ ID NO: 297269 - protein, 18 aa, Mycobacterium
AAAMFLRVLAIALPSVCL

SEQ ID NO: 297270 - protein, 24 aa, Mycobacterium
AAAMVLTAIAWVWATPFTIRHPRV

SEQ ID NO: 297271 - protein, 18 aa, Mycobacterium
AAAMVLTAVAWVWATPFT

SEQ ID NO: 297272 - protein, 19 aa, Mycobacterium
AAANGALALAARGKELDFR

SEQ ID NO: 297273 - protein, 18 aa, Mycobacterium
AAAPGREVPAGMVGVSDT

SEQ ID NO: 297274 - protein, 17 aa, Mycobacterium
AAAPLLVRLMLGRNPQV

SEQ ID NO: 297275 - protein, 18 aa, Mycobacterium
AAAPRPAPQPAAYWPQYP

SEQ ID NO: 297276 - protein, 24 aa, Mycobacterium
AAAPYLRIALRSAISPQIETTKAT

SEQ ID NO: 297277 - protein, 24 aa, Mycobacterium
AAAQAGDVITWWTGSQVLVLSASD

SEQ ID NO: 297278 - protein, 18 aa, Mycobacterium
AAAQGGAAPLVIIGVVAS

SEQ ID NO: 297279 - protein, 18 aa, Mycobacterium
AAAQGGAAPLVIVGVVAS

SEQ ID NO: 297280 - protein, 19 aa, Mycobacterium
AAAQRGGRLLPWVLITGVV

SEQ ID NO: 297281 - protein, 18 aa, Mycobacterium
AAAQWSHPEPEALASVPG

SEQ ID NO: 297282 - protein, 17 aa, Mycobacterium
AAARGAHAIATNSGFDV

SEQ ID NO: 297283 - protein, 17 aa, Mycobacterium
AAARIALLGLFIASVIV

SEQ ID NO: 297284 - protein, 24 aa, Mycobacterium
AAARIGAVVIPFSTFVTAREMREQ

SEQ ID NO: 297285 - protein, 18 aa, Mycobacterium
AAARPARQLRTWVLVPAL

SEQ ID NO: 297286 - protein, 20 aa, Mycobacterium
AAARPPFWRGAPGLVAGWAT

SEQ ID NO: 297287 - protein, 18 aa, Mycobacterium
AAASGIWNQTFVPYPSSV

SEQ ID NO: 297288 - protein, 17 aa, Mycobacterium
AAASLAQAVGRAVDYDT

SEQ ID NO: 297289 - protein, 23 aa, Mycobacterium
AAATAAWTMARFTGLPRRASTVG

SEQ ID NO: 297290 - protein, 24 aa, Mycobacterium
AAATCLPPGTVVRHRSAVLCGTAS

SEQ ID NO: 297291 - protein, 29 aa, Mycobacterium
AAATGTPAWEMFKPWSIVSITIAVALALV

SEQ ID NO: 297292 - protein, 30 aa, Mycobacterium
AAATRWAQHAHWMWWTWPAAAAAGIAGLTL

SEQ ID NO: 297293 - protein, 24 aa, Mycobacterium
AAAVAIYFMTFVRRHYGGRIAHLV

SEQ ID NO: 297294 - protein, 22 aa, Mycobacterium
AAAVCFVIRMVGVRFDLHAPRP

SEQ ID NO: 297295 - protein, 19 aa, Mycobacterium
AAAVFPVFALFGTEDIALY

SEQ ID NO: 297296 - protein, 19 aa, Mycobacterium
AAAVFSAIVLRDLRIPAIG

SEQ ID NO: 297297 - protein, 19 aa, Mycobacterium
AAAVGLVILMRCRGLGWAD

SEQ ID NO: 297298 - protein, 28 aa, Mycobacterium
AAAVILCIFIYWGWDACLAVGEETKDPG

SEQ ID NO: 297299 - protein, 22 aa, Mycobacterium
AAAVLVLLAGRRLWHRFRGQPD

SEQ ID NO: 297300 - protein, 19 aa, Mycobacterium
AAAVMACALLVADVLAPAL

SEQ ID NO: 297301 - protein, 19 aa, Mycobacterium
AAAVSDFWLLAYWLVLGAL

SEQ ID NO: 297302 - protein, 18 aa, Mycobacterium
AAAVVCSTPALTSEDLRT

SEQ ID NO: 297303 - protein, 18 aa, Mycobacterium
AAAVWLVAPCTELFNDGR

SEQ ID NO: 297304 - protein, 18 aa, Mycobacterium
AAAWEPLGMLAGGAILIA

SEQ ID NO: 297305 - protein, 17 aa, Mycobacterium
AAAWRADRIAIRATAPG

SEQ ID NO: 297306 - protein, 18 aa, Mycobacterium
AAAWTAAGMFLAVWLPLN

SEQ ID NO: 297307 - protein, 29 aa, Mycobacterium
AAAYALLGDHGWRAMMLLAGLPALLVWFI

SEQ ID NO: 297308 - protein, 21 aa, Mycobacterium
AAAYLMWGLFPAFFPLLEPAG

SEQ ID NO: 297309 - protein, 19 aa, Mycobacterium
AACACVLGATFGIASEYLA

SEQ ID NO: 297310 - protein, 18 aa, Mycobacterium
AACDRYGRSLARSSERYR

SEQ ID NO: 297311 - protein, 21 aa, Mycobacterium
AACGGCGSVPATGRELSPDEQ

SEQ ID NO: 297312 - protein, 17 aa, Mycobacterium
AACKAWLLTQPYLVGGT

SEQ ID NO: 297313 - protein, 25 aa, Mycobacterium
AACMTGRYLLTFQIYLALPIQASAL

SEQ ID NO: 297314 - protein, 19 aa, Mycobacterium
AACRRITEGSFDERISPPR

SEQ ID NO: 297315 - protein, 19 aa, Mycobacterium
AACRSEPKKATGLDGALKT

SEQ ID NO: 297316 - protein, 19 aa, Mycobacterium
AACVMAWGLAYPASPLGPA

SEQ ID NO: 297317 - protein, 22 aa, Mycobacterium
AACVPMAVGIAAAYAAGAASVI

SEQ ID NO: 297318 - protein, 18 aa, Mycobacterium
AACVRELAARGAAVTIAD

SEQ ID NO: 297319 - protein, 17 aa, Mycobacterium
AACVVFLLAAASVVATF

SEQ ID NO: 297320 - protein, 23 aa, Mycobacterium
AADACVYLGMALTKRFAVGTSQT

SEQ ID NO: 297321 - protein, 22 aa, Mycobacterium
AADELRGQLELARRQYPGSSNV

SEQ ID NO: 297322 - protein, 23 aa, Mycobacterium
AADFAPSCARLAACMSAAPAHTS

SEQ ID NO: 297323 - protein, 17 aa, Mycobacterium
AADGERWVVDLAPMLND

SEQ ID NO: 297324 - protein, 21 aa, Mycobacterium
AADGTYHWVEGHGKPYVDADG

SEQ ID NO: 297325 - protein, 21 aa, Mycobacterium
AADLGRLHLAASIRDPDLRSK

SEQ ID NO: 297326 - protein, 31 aa, Mycobacterium
AADLRSRLLRKLSRLPLGWFTERGSGAIKQL

SEQ ID NO: 297327 - protein, 25 aa, Mycobacterium
AADNGRRLRSIGVTWSDGADMQAAE

SEQ ID NO: 297328 - protein, 25 aa, Mycobacterium
AADPELPRRIRVALVALIAFVVSPI

SEQ ID NO: 297329 - protein, 19 aa, Mycobacterium
AADPLYWRGAQLVGNYPLS

SEQ ID NO: 297330 - protein, 37 aa, Mycobacterium
AADPRAKLLRKRRWALRFAVFFTFATGFWVFVTAVLA

SEQ ID NO: 297331 - protein, 25 aa, Mycobacterium
AADQRGATIAVNWPVELQRQIAELA

SEQ ID NO: 297332 - protein, 27 aa, Mycobacterium
AADRFGTKRLFIWSVLAFTMGSVLCAL

SEQ ID NO: 297333 - protein, 24 aa, Mycobacterium
AADRRWPHYMFGGRVRTSTLVLIV

SEQ ID NO: 297334 - protein, 26 aa, Mycobacterium
AADRWPRGVLAAGFGMLTVVLALLSV

SEQ ID NO: 297335 - protein, 19 aa, Mycobacterium
AADSLRIVTNVAITAQQAR

SEQ ID NO: 297336 - protein, 17 aa, Mycobacterium
AADTVRLLTRLGLTVAM

SEQ ID NO: 297337 - protein, 20 aa, Mycobacterium
AADVLRTAISPSFEEIGKLA

SEQ ID NO: 297338 - protein, 22 aa, Mycobacterium
AAEAEALAAAARARARAIQLRR

SEQ ID NO: 297339 - protein, 17 aa, Mycobacterium
AAEAVAFYRGEIAERTG

SEQ ID NO: 297340 - protein, 17 aa, Mycobacterium
AAEAVGFYRGERSERAT

SEQ ID NO: 297341 - protein, 26 aa, Mycobacterium
AAEFPRSGYRLPTFGGGPDQLLTETM

SEQ ID NO: 297342 - protein, 24 aa, Mycobacterium
AAEHDRALLIPAILAVILVVLYAL

SEQ ID NO: 297343 - protein, 20 aa, Mycobacterium
AAEIIRSSILSIPRGQWEAA

SEQ ID NO: 297344 - protein, 17 aa, Mycobacterium
AAEIVGYLALNDEEVSV

SEQ ID NO: 297345 - protein, 24 aa, Mycobacterium
AAEKWNMPIVLIVLLAVFGSLAAA

SEQ ID NO: 297346 - protein, 18 aa, Mycobacterium
AAELLEWAMQLGGDSVSR

SEQ ID NO: 297347 - protein, 19 aa, Mycobacterium
AAEMPRLNRWFMANINGLG

SEQ ID NO: 297348 - protein, 23 aa, Mycobacterium
AAEREIGSWLVLSVIVAVVLMIG

SEQ ID NO: 297349 - protein, 31 aa, Mycobacterium
AAERPAQIPLSFAQARLWFLDQLQGPSPVYN

SEQ ID NO: 297350 - protein, 25 aa, Mycobacterium
AAERWLERFSWIGLVVAVVAGLTAA

SEQ ID NO: 297351 - protein, 28 aa, Mycobacterium
AAESPSLRYAWCAGLALLTFVLLVVVVK

SEQ ID NO: 297352 - protein, 22 aa, Mycobacterium
AAEVLRLAASVDQVSPHVLADA

SEQ ID NO: 297353 - protein, 24 aa, Mycobacterium
AAEWLAAHRDLWLTMTLQVVTAAG

SEQ ID NO: 297354 - protein, 17 aa, Mycobacterium
AAEWSGLVADRLSAAAD

SEQ ID NO: 297355 - protein, 25 aa, Mycobacterium
AAEYRIPFGGGFRFVTSPAYLGELI

SEQ ID NO: 297356 - protein, 31 aa, Mycobacterium
AAFAAAAILIRWKLSIAFLPNVGIAAAAAIV

SEQ ID NO: 297357 - protein, 19 aa, Mycobacterium
AAFAAGWLYFINWAMTGVV

SEQ ID NO: 297358 - protein, 17 aa, Mycobacterium
AAFALGVPGDFGAPNVL

SEQ ID NO: 297359 - protein, 20 aa, Mycobacterium
AAFCQVCGTTTAALARHPSS

SEQ ID NO: 297360 - protein, 22 aa, Mycobacterium
AAFCYAAAVVTELGGPMSHAAV

SEQ ID NO: 297361 - protein, 17 aa, Mycobacterium
AAFEPGELVVVWVESQA

SEQ ID NO: 297362 - protein, 24 aa, Mycobacterium
AAFFACLSMTLAGLVRKRDRLMGI

SEQ ID NO: 297363 - protein, 22 aa, Mycobacterium
AAFFACLSMTLAGLVRNRDRLM

SEQ ID NO: 297364 - protein, 17 aa, Mycobacterium
AAFFARRSPAAGAGPDE

SEQ ID NO: 297365 - protein, 17 aa, Mycobacterium
AAFFFPAYSAILPRILP

SEQ ID NO: 297366 - protein, 24 aa, Mycobacterium
AAFFIIRALVRWHLAAVAERNRRH

SEQ ID NO: 297367 - protein, 17 aa, Mycobacterium
AAFFPDTIFQFLLNSSG

SEQ ID NO: 297368 - protein, 29 aa, Mycobacterium
AAFGELCPHLAAPMADGWVDRGRLVCPWH

SEQ ID NO: 297369 - protein, 25 aa, Mycobacterium
AAFGICLGCQIYPLITRLRRTQPSA

SEQ ID NO: 297370 - protein, 25 aa, Mycobacterium
AAFGYIALVGFMFIGRMIGDRLVDR

SEQ ID NO: 297371 - protein, 22 aa, Mycobacterium
AAFKEAWLYVLVMVAIGAAYLA

SEQ ID NO: 297372 - protein, 26 aa, Mycobacterium
AAFLLLRFLIALPIGALIGGWLATRI

SEQ ID NO: 297373 - protein, 23 aa, Mycobacterium
AAFLNRNLGWFFLFKQGNVSLAG

SEQ ID NO: 297374 - protein, 22 aa, Mycobacterium
AAFLSWGWRVAFWLSAVVVLIG

SEQ ID NO: 297375 - protein, 19 aa, Mycobacterium
AAFLSYIVYFGRRGVRAGE

SEQ ID NO: 297376 - protein, 17 aa, Mycobacterium
AAFLVPALQSWRPVTLA

SEQ ID NO: 297377 - protein, 28 aa, Mycobacterium
AAFMTWRITAEMPRRPAGGGIDEDAATL

SEQ ID NO: 297378 - protein, 17 aa, Mycobacterium
AAFMVAPIFAHFALTAT

SEQ ID NO: 297379 - protein, 17 aa, Mycobacterium
AAFPLFWLIDTRNAWAI

SEQ ID NO: 297380 - protein, 18 aa, Mycobacterium
AAFRYALVRIRDAAEAVG

SEQ ID NO: 297381 - protein, 17 aa, Mycobacterium
AAFSFATGYTWVLTLIA

SEQ ID NO: 297382 - protein, 17 aa, Mycobacterium
AAFSMATGYTWVLTLVA

SEQ ID NO: 297383 - protein, 17 aa, Mycobacterium
AAFTMMVLINFNLIAPT

SEQ ID NO: 297384 - protein, 21 aa, Mycobacterium
AAFTTHWMRHRHHAVGYANHP

SEQ ID NO: 297385 - protein, 24 aa, Mycobacterium
AAFVAGSALAWVIATVFVKPAGQE

SEQ ID NO: 297386 - protein, 17 aa, Mycobacterium
AAFVLLAFSFSAVMIGT

SEQ ID NO: 297387 - protein, 19 aa, Mycobacterium
AAFVSYIVYFGRRAAKAGE

SEQ ID NO: 297388 - protein, 17 aa, Mycobacterium
AAFWCALSLPPLLLGML

SEQ ID NO: 297389 - protein, 20 aa, Mycobacterium
AAFWLGLVVAISFIEAPLKF

SEQ ID NO: 297390 - protein, 18 aa, Mycobacterium
AAGAAAINSVLAWGALAA

SEQ ID NO: 297391 - protein, 25 aa, Mycobacterium
AAGAELLWHVKLVAIGCGLIVAALL

SEQ ID NO: 297392 - protein, 18 aa, Mycobacterium
AAGAEWGGAALLAVEHAP

SEQ ID NO: 297393 - protein, 28 aa, Mycobacterium
AAGALLFPGAHGWITYLWVPPFASEKVR

SEQ ID NO: 297394 - protein, 17 aa, Mycobacterium
AAGALLRSRNVSTEVNT

SEQ ID NO: 297395 - protein, 17 aa, Mycobacterium
AAGALWAASRLPWVVIR

SEQ ID NO: 297396 - protein, 23 aa, Mycobacterium
AAGALWLSVAGWSLWAANSPGMG

SEQ ID NO: 297397 - protein, 25 aa, Mycobacterium
AAGALWVASKFSWVRLRSFDGLGEP

SEQ ID NO: 297398 - protein, 21 aa, Mycobacterium
AAGAPTLVGVMPMGEDADSAA

SEQ ID NO: 297399 - protein, 22 aa, Mycobacterium
AAGAQPSFRLADYVTDNAGALS

SEQ ID NO: 297400 - protein, 19 aa, Mycobacterium
AAGARARALQLRRRAERAE

SEQ ID NO: 297401 - protein, 17 aa, Mycobacterium
AAGARFGLFEPRRAVSA

SEQ ID NO: 297402 - protein, 20 aa, Mycobacterium
AAGASWGNAGWVSPTLTIPL

SEQ ID NO: 297403 - protein, 23 aa, Mycobacterium
AAGATILLLAGRRSDRWGHLLGC

SEQ ID NO: 297404 - protein, 18 aa, Mycobacterium
AAGAVLAPIGVKGLAAVA

SEQ ID NO: 297405 - protein, 19 aa, Mycobacterium
AAGCMPVMIGWSAVTGTIA

SEQ ID NO: 297406 - protein, 19 aa, Mycobacterium
AAGCMPVMIGWSAVTNTIG

SEQ ID NO: 297407 - protein, 19 aa, Mycobacterium
AAGCMPVMIGWSAVTNTIQ

SEQ ID NO: 297408 - protein, 20 aa, Mycobacterium
AAGDELLCAVGRRLSGCLAD

SEQ ID NO: 297409 - protein, 28 aa, Mycobacterium
AAGEAFAAIAARARLGVNVDRALPRSVP

SEQ ID NO: 297410 - protein, 19 aa, Mycobacterium
AAGELPPGAVTIGRADDND

SEQ ID NO: 297411 - protein, 22 aa, Mycobacterium
AAGELWGNLAISMNRFALGLVA

SEQ ID NO: 297412 - protein, 23 aa, Mycobacterium
AAGEQALAVAIPYTETLTSIDSN

SEQ ID NO: 297413 - protein, 21 aa, Mycobacterium
AAGFLSGLAMYFQIRSARRAD

SEQ ID NO: 297414 - protein, 18 aa, Mycobacterium
AAGGEWAGSALLSAESAP

SEQ ID NO: 297415 - protein, 18 aa, Mycobacterium
AAGGLRVIAVARRELTAQ

SEQ ID NO: 297416 - protein, 24 aa, Mycobacterium
AAGGTKRALPWQPLPDVVMLEAKH

SEQ ID NO: 297417 - protein, 18 aa, Mycobacterium
AAGIARRTVFRYYSSKNA

SEQ ID NO: 297418 - protein, 22 aa, Mycobacterium
AAGIGCAQGFYLSRPKAHGHGF

SEQ ID NO: 297419 - protein, 24 aa, Mycobacterium
AAGIIVGAAGIWWVMRGHASGWWA

SEQ ID NO: 297420 - protein, 22 aa, Mycobacterium
AAGISIPLAITLASLSQMPEAP

SEQ ID NO: 297421 - protein, 22 aa, Mycobacterium
AAGITVWLGLVAQFGGVLGSSA

SEQ ID NO: 297422 - protein, 25 aa, Mycobacterium
AAGIVGALAFWLSHGVERLTGSSLA

SEQ ID NO: 297423 - protein, 27 aa, Mycobacterium
AAGIVLACPIWFYELWAFITPGLYQKE

SEQ ID NO: 297424 - protein, 21 aa, Mycobacterium
AAGKARTGAALGNPVLATGGR

SEQ ID NO: 297425 - protein, 23 aa, Mycobacterium
AAGKWPRMLFIVNRCDELGVDPL

SEQ ID NO: 297426 - protein, 24 aa, Mycobacterium
AAGLAALCYAELASAVPVSGSSFS

SEQ ID NO: 297427 - protein, 18 aa, Mycobacterium
AAGLCFIAAVFSASIGKS

SEQ ID NO: 297428 - protein, 17 aa, Mycobacterium
AAGLFFFFVIPRWPELM

SEQ ID NO: 297429 - protein, 19 aa, Mycobacterium
AAGLFLAFWLPLNNGLRPE

SEQ ID NO: 297430 - protein, 19 aa, Mycobacterium
AAGLFPGLFSGLLAFSYFV

SEQ ID NO: 297431 - protein, 24 aa, Mycobacterium
AAGLIAYFVSYGIEDAQFAVGAPI

SEQ ID NO: 297432 - protein, 25 aa, Mycobacterium
AAGLIITFGEFRFGSGKRYHAMFST

SEQ ID NO: 297433 - protein, 17 aa, Mycobacterium
AAGLPALAPVVAVGAAL

SEQ ID NO: 297434 - protein, 18 aa, Mycobacterium
AAGLRTGIIRAFGGTGGV

SEQ ID NO: 297435 - protein, 18 aa, Mycobacterium
AAGLSRRDMPGFEAHTRD

SEQ ID NO: 297436 - protein, 18 aa, Mycobacterium
AAGLSRRDMSGFEAHTRA

SEQ ID NO: 297437 - protein, 17 aa, Mycobacterium
AAGLVFAGFETTAAALA

SEQ ID NO: 297438 - protein, 18 aa, Mycobacterium
AAGMTMLSGKLSLAAQGV

SEQ ID NO: 297439 - protein, 22 aa, Mycobacterium
AAGPCADLPAVINALTGGAIAF

SEQ ID NO: 297440 - protein, 27 aa, Mycobacterium
AAGPLVMSGCRFFDVMLGAAPHYRRAL

SEQ ID NO: 297441 - protein, 25 aa, Mycobacterium
AAGPWQIAGSFAVLFLPYSALGPFA

SEQ ID NO: 297442 - protein, 24 aa, Mycobacterium
AAGQLHKVRMLLLTNCTFDGVVYN

SEQ ID NO: 297443 - protein, 25 aa, Mycobacterium
AAGRGRWALCLIDGSPLRATQSLTE

SEQ ID NO: 297444 - protein, 18 aa, Mycobacterium
AAGRLRFTTDYDAAADFA

SEQ ID NO: 297445 - protein, 20 aa, Mycobacterium
AAGRLRFTTDYDMAAEFADV

SEQ ID NO: 297446 - protein, 23 aa, Mycobacterium
AAGRLSWSLTMLAAVALIARGIF

SEQ ID NO: 297447 - protein, 23 aa, Mycobacterium
AAGRMRVAVAWVRADSRRAVAVE

SEQ ID NO: 297448 - protein, 21 aa, Mycobacterium
AAGRRKALAFIEGRSTAELVA

SEQ ID NO: 297449 - protein, 24 aa, Mycobacterium
AAGRVAVVVACRRGVPAAEGSTLG

SEQ ID NO: 297450 - protein, 28 aa, Mycobacterium
AAGSIFAALLFWWTWHRLETKRRSDPVS

SEQ ID NO: 297451 - protein, 23 aa, Mycobacterium
AAGSRSPVFLLYDGQRAVVDVTD

SEQ ID NO: 297452 - protein, 19 aa, Mycobacterium
AAGSWLPAILWGVAFAILV

SEQ ID NO: 297453 - protein, 19 aa, Mycobacterium
AAGSWLPAVLWGVAFAILV

SEQ ID NO: 297454 - protein, 19 aa, Mycobacterium
AAGSWLPAVLWGVAFAVLV

SEQ ID NO: 297455 - protein, 20 aa, Mycobacterium
AAGTVQAWLVGVVDATGVWP

SEQ ID NO: 297456 - protein, 19 aa, Mycobacterium
AAGTWRQLLGRRYLGASTV

SEQ ID NO: 297457 - protein, 26 aa, Mycobacterium
AAGVAAVLCVIAWPMRSAPASAPTTV

SEQ ID NO: 297458 - protein, 20 aa, Mycobacterium
AAGVPVVFLTAWYGLSVLAG

SEQ ID NO: 297459 - protein, 18 aa, Mycobacterium
AAGVTWAGAVVFGPSSPL

SEQ ID NO: 297460 - protein, 17 aa, Mycobacterium
AAGVVCAGGTLGVLIPP

SEQ ID NO: 297461 - protein, 25 aa, Mycobacterium
AAGVVPEWLAYALAVLLGAASLGIA

SEQ ID NO: 297462 - protein, 21 aa, Mycobacterium
AAGVVPEWLAYAVAAVLGVAS

SEQ ID NO: 297463 - protein, 24 aa, Mycobacterium
AAGVVPEWLAYTLAVVLGLAALGI

SEQ ID NO: 297464 - protein, 17 aa, Mycobacterium
AAGWMMLLNVLKPTGAV

SEQ ID NO: 297465 - protein, 19 aa, Mycobacterium
AAGYWRRGALVMAIGVAVA

SEQ ID NO: 297466 - protein, 18 aa, Mycobacterium
AAHAPRYGAVPWVGVAAA

SEQ ID NO: 297467 - protein, 19 aa, Mycobacterium
AAHAPRYGGVPWVGAAALP

SEQ ID NO: 297468 - protein, 23 aa, Mycobacterium
AAHDLELIGYVGLADTARASARP

SEQ ID NO: 297469 - protein, 17 aa, Mycobacterium
AAHDRVLLIPAILAVIL

SEQ ID NO: 297470 - protein, 21 aa, Mycobacterium
AAHEWFGIGLIVVSNAVLSAR

SEQ ID NO: 297471 - protein, 18 aa, Mycobacterium
AAHIPRVKDELGLSDAAL

SEQ ID NO: 297472 - protein, 19 aa, Mycobacterium
AAHKPAAPQMIPPRGETPK

SEQ ID NO: 297473 - protein, 19 aa, Mycobacterium
AAHLEETYSGFTIVKTFGH

SEQ ID NO: 297474 - protein, 19 aa, Mycobacterium
AAHQSWRGAAAIIVSLIGW

SEQ ID NO: 297475 - protein, 21 aa, Mycobacterium
AAHVSRFGYWALLAPIAAAGT

SEQ ID NO: 297476 - protein, 25 aa, Mycobacterium
AAIAAMCGIGAWLVVPGQMLVCAFA

SEQ ID NO: 297477 - protein, 21 aa, Mycobacterium
AAIAATVRRHHVLWAPPGRTA

SEQ ID NO: 297478 - protein, 17 aa, Mycobacterium
AAIAAWAALGRIPNADP

SEQ ID NO: 297479 - protein, 34 aa, Mycobacterium
AAIAGALPGIWAFFSHRVAFVFTFPNNVTDAVVH

SEQ ID NO: 297480 - protein, 17 aa, Mycobacterium
AAIAKWAKQHFPAVTAL

SEQ ID NO: 297481 - protein, 25 aa, Mycobacterium
AAIALVVSVSLLFARTDTTKLANPN

SEQ ID NO: 297482 - protein, 18 aa, Mycobacterium
AAIARAYLEYLFTDEAQE

SEQ ID NO: 297483 - protein, 24 aa, Mycobacterium
AAIAVEFFYLFVARILNTPEIADL

SEQ ID NO: 297484 - protein, 18 aa, Mycobacterium
AAIAVLVIACPCALGLAT

SEQ ID NO: 297485 - protein, 22 aa, Mycobacterium
AAIAVPLPRGFHSLGAPQLAAA

SEQ ID NO: 297486 - protein, 17 aa, Mycobacterium
AAIAVWCVSAIVGAFAA

SEQ ID NO: 297487 - protein, 28 aa, Mycobacterium
AAIAWFLKFLVSHSMYWFVGYRVVLGVV

SEQ ID NO: 297488 - protein, 21 aa, Mycobacterium
AAICHGVLLAARSVDPATGRS

SEQ ID NO: 297489 - protein, 23 aa, Mycobacterium
AAICIFSIGLLRSHGGDVLYYPP

SEQ ID NO: 297490 - protein, 19 aa, Mycobacterium
AAICIRLLVGLVFLSEGIQ

SEQ ID NO: 297491 - protein, 24 aa, Mycobacterium
AAIEAIGLVVLWQLLARSQRELDE

SEQ ID NO: 297492 - protein, 20 aa, Mycobacterium
AAIEVLWWVQGHVLGERRRL

SEQ ID NO: 297493 - protein, 18 aa, Mycobacterium
AAIFVLFCVILVMSWSNA

SEQ ID NO: 297494 - protein, 24 aa, Mycobacterium
AAIGLLGIFAFYLAFVAELPPPPP

SEQ ID NO: 297495 - protein, 17 aa, Mycobacterium
AAIGWFFAPETRPTPST

SEQ ID NO: 297496 - protein, 18 aa, Mycobacterium
AAIGYPFFWLLSTGEGWA

SEQ ID NO: 297497 - protein, 17 aa, Mycobacterium
AAIITVLMPPVFVLAWA

SEQ ID NO: 297498 - protein, 22 aa, Mycobacterium
AAIKDMFAWVAPVLAALQGNPV

SEQ ID NO: 297499 - protein, 31 aa, Mycobacterium
AAIKRAEMWPGIATPTLWARTAGICLVFGAV

SEQ ID NO: 297500 - protein, 35 aa, Mycobacterium
AAIKTAISAVWNWLSTTVFPGLKLAFTAIGTAATW

SEQ ID NO: 297501 - protein, 18 aa, Mycobacterium
AAILGCGVVLLAAVGLFF

SEQ ID NO: 297502 - protein, 18 aa, Mycobacterium
AAILRNSNSWGLASPPRL

SEQ ID NO: 297503 - protein, 17 aa, Mycobacterium
AAILRYNNSMAYAQNVL

SEQ ID NO: 297504 - protein, 17 aa, Mycobacterium
AAIMTWMVYVRRPVTAP

SEQ ID NO: 297505 - protein, 23 aa, Mycobacterium
AAIPVLRWMARRQPAAAGPRLPA

SEQ ID NO: 297506 - protein, 18 aa, Mycobacterium
AAIQDWTTGYVKRHPLES

SEQ ID NO: 297507 - protein, 18 aa, Mycobacterium
AAIRSWVAQAVTFHDPTL

SEQ ID NO: 297508 - protein, 24 aa, Mycobacterium
AAIRTDTILGRRNMEIEPRGSDPL

SEQ ID NO: 297509 - protein, 27 aa, Mycobacterium
AAISGWRSGALGSLMSFIGVVLGAVAG

SEQ ID NO: 297510 - protein, 26 aa, Mycobacterium
AAISGWRSGALGSMLSFAGVLLGAIA

SEQ ID NO: 297511 - protein, 24 aa, Mycobacterium
AAISIPIGVLVAIYLVEYGGASAL

SEQ ID NO: 297512 - protein, 23 aa, Mycobacterium
AAISVLFPIVWIALASVKTPEQL

SEQ ID NO: 297513 - protein, 60 aa, Mycobacterium
AAITLLPSILVLIGRRGWIKPRRDLTHRFWRILGTRIVRRPRVHLIGSLIVLAILASSTL

SEQ ID NO: 297514 - protein, 24 aa, Mycobacterium
AAIVAIRLVAQWGSAVVAGTAGEK

SEQ ID NO: 297515 - protein, 19 aa, Mycobacterium
AAIVAMTFIGIGMNAGLFN

SEQ ID NO: 297516 - protein, 18 aa, Mycobacterium
AAIVCADLSMLSKAETER

SEQ ID NO: 297517 - protein, 17 aa, Mycobacterium
AAIVVWSSLVAAILPPL

SEQ ID NO: 297518 - protein, 20 aa, Mycobacterium
AAIWRRMNIGVLALGAALPV

SEQ ID NO: 297519 - protein, 24 aa, Mycobacterium
AAIWTRTSPPWAFFSLPTRAWELA

SEQ ID NO: 297520 - protein, 29 aa, Mycobacterium
AAIYITVRYEWSMALAALATLVFDLVVTA

SEQ ID NO: 297521 - protein, 34 aa, Mycobacterium
AAIYITWRYERYMAISALATMVFDIVVTAGVYSL

SEQ ID NO: 297522 - protein, 27 aa, Mycobacterium
AAIYNEVLQFFVILAFLVPLTIFGLIK

SEQ ID NO: 297523 - protein, 25 aa, Mycobacterium
AAIYNEVLQFFVIVAALLPLTIVGL

SEQ ID NO: 297524 - protein, 18 aa, Mycobacterium
AAKCIAMSVVLGVPIPLV

SEQ ID NO: 297525 - protein, 18 aa, Mycobacterium
AAKHQFQGLVIFGIGLAL

SEQ ID NO: 297526 - protein, 18 aa, Mycobacterium
AAKLKTLVPQAVTVADPL

SEQ ID NO: 297527 - protein, 25 aa, Mycobacterium
AAKMRYPVFTAFNVLGAIVWGVGLT

SEQ ID NO: 297528 - protein, 25 aa, Mycobacterium
AAKRAGGSPVRIMILLVVVTAIASA

SEQ ID NO: 297529 - protein, 22 aa, Mycobacterium
AAKRALSAPVRRGSSRHAARPA

SEQ ID NO: 297530 - protein, 19 aa, Mycobacterium
AAKTSWPGVKIVNNIEVKG

SEQ ID NO: 297531 - protein, 26 aa, Mycobacterium
AAKVGLPSLLLFLAVGVALGNDGLGL

SEQ ID NO: 297532 - protein, 19 aa, Mycobacterium
AAKVVLDITPKYVKRIPAN

SEQ ID NO: 297533 - protein, 25 aa, Mycobacterium
AAKWSPPGGGVWVRLRQLDQLTAEV

SEQ ID NO: 297534 - protein, 18 aa, Mycobacterium
AALAALYAKPGFPTDGIV

SEQ ID NO: 297535 - protein, 25 aa, Mycobacterium
AALAAPWPALWLVLVVIALWSTAFG

SEQ ID NO: 297536 - protein, 19 aa, Mycobacterium
AALAARAGDHVDLLAHDRE

SEQ ID NO: 297537 - protein, 25 aa, Mycobacterium
AALAARKRIAWLLLLTNVVLAAFLN

SEQ ID NO: 297538 - protein, 24 aa, Mycobacterium
AALAARKRIAWWILTGYMVAAAVW

SEQ ID NO: 297539 - protein, 25 aa, Mycobacterium
AALAARKRIAWWVLVLYLVGAIGWN

SEQ ID NO: 297540 - protein, 24 aa, Mycobacterium
AALAAVLLTAGWILGRSGYEGVAH

SEQ ID NO: 297541 - protein, 20 aa, Mycobacterium
AALAELKAGGATVALLTTSA

SEQ ID NO: 297542 - protein, 23 aa, Mycobacterium
AALAERFSGFGLPVVDVQDPAIA

SEQ ID NO: 297543 - protein, 18 aa, Mycobacterium
AALAGLGWWILRRSTKVP

SEQ ID NO: 297544 - protein, 26 aa, Mycobacterium
AALAGLRLSRTVALGVCGLALATVGG

SEQ ID NO: 297545 - protein, 17 aa, Mycobacterium
AALALAVGAAVTTLAAY

SEQ ID NO: 297546 - protein, 25 aa, Mycobacterium
AALALCAVVALALFLWWEGRTPAPM

SEQ ID NO: 297547 - protein, 26 aa, Mycobacterium
AALALFPMYYLRSFAYAGIATVAFAA

SEQ ID NO: 297548 - protein, 17 aa, Mycobacterium
AALALSLKTAAASTAVC

SEQ ID NO: 297549 - protein, 26 aa, Mycobacterium
AALAMELGCDAVLLATAVTRAADPAA

SEQ ID NO: 297550 - protein, 19 aa, Mycobacterium
AALAPMLAAPLVPLAAGAV

SEQ ID NO: 297551 - protein, 27 aa, Mycobacterium
AALARTLRFGDGWLPFAELSTPADVAR

SEQ ID NO: 297552 - protein, 18 aa, Mycobacterium
AALASLRVSPGLPGSGVV

SEQ ID NO: 297553 - protein, 18 aa, Mycobacterium
AALAVIWVISKLEIIVVP

SEQ ID NO: 297554 - protein, 19 aa, Mycobacterium
AALAYRTRLGFAVVAGDPI

SEQ ID NO: 297555 - protein, 25 aa, Mycobacterium
AALCALALAIAGLWLQHCCKSPEEP

SEQ ID NO: 297556 - protein, 19 aa, Mycobacterium
AALCLIAVIWQERPSRTEA

SEQ ID NO: 297557 - protein, 19 aa, Mycobacterium
AALCVDWLLAYGLALLGVG

SEQ ID NO: 297558 - protein, 27 aa, Mycobacterium
AALDPYVREGWAFVAMRLTSTVPIVGG

SEQ ID NO: 297559 - protein, 33 aa, Mycobacterium
AALDQDFLFSWGWRIPFFFSLVLVAVALVIRFR

SEQ ID NO: 297560 - protein, 17 aa, Mycobacterium
AALDSRTPPRRDRTGGG

SEQ ID NO: 297561 - protein, 17 aa, Mycobacterium
AALEKAGLVHELVTEPG

SEQ ID NO: 297562 - protein, 17 aa, Mycobacterium
AALFADPRFTVETIGPF

SEQ ID NO: 297563 - protein, 17 aa, Mycobacterium
AALFCAGVATFAQLYSP

SEQ ID NO: 297564 - protein, 19 aa, Mycobacterium
AALFCVSAFLVSVQAQLLK

SEQ ID NO: 297565 - protein, 23 aa, Mycobacterium
AALFGVPVAKNLSAGGFQDPTSE

SEQ ID NO: 297566 - protein, 20 aa, Mycobacterium
AALFIGRAIIRNNYYVAEYH

SEQ ID NO: 297567 - protein, 23 aa, Mycobacterium
AALFRRVFLINGLIFALGTLILA

SEQ ID NO: 297568 - protein, 27 aa, Mycobacterium
AALGALRGALRNKPAFAPDGIPAALVP

SEQ ID NO: 297569 - protein, 29 aa, Mycobacterium
AALGDKAWWIPAWLDRLLPDLDIEGDALQ

SEQ ID NO: 297570 - protein, 19 aa, Mycobacterium
AALGLWGASRFNWVEVRSF

SEQ ID NO: 297571 - protein, 26 aa, Mycobacterium
AALGRRVIARFGWRRPQTLLIVGFLV

SEQ ID NO: 297572 - protein, 21 aa, Mycobacterium
AALGYAGWRSPPATPREVSAP

SEQ ID NO: 297573 - protein, 27 aa, Mycobacterium
AALHARARLVIMPSFDLGDFLGNIAEH

SEQ ID NO: 297574 - protein, 20 aa, Mycobacterium
AALHAWLCVGGFGGDGEATV

SEQ ID NO: 297575 - protein, 27 aa, Mycobacterium
AALHHCVIAFAALGWYASVHRLPNPAE

SEQ ID NO: 297576 - protein, 24 aa, Mycobacterium
AALHHLKYPMAVTVESIDEEGPSK

SEQ ID NO: 297577 - protein, 18 aa, Mycobacterium
AALIALKNGNPWSAVQVA

SEQ ID NO: 297578 - protein, 19 aa, Mycobacterium
AALIFRFNNPDALLVLLLV

SEQ ID NO: 297579 - protein, 33 aa, Mycobacterium
AALIGISVVTLWRGRGLFAPRLILAAMSAVTGV

SEQ ID NO: 297580 - protein, 18 aa, Mycobacterium
AALIGVSTDEMWDIRNRG

SEQ ID NO: 297581 - protein, 27 aa, Mycobacterium
AALIIPLGLAIFWKRMTSTAFVASLVL

SEQ ID NO: 297582 - protein, 26 aa, Mycobacterium
AALIIQFLGTFGFFYVGLQYIQLMLG

SEQ ID NO: 297583 - protein, 19 aa, Mycobacterium
AALIPRLVVVDELPTRTSG

SEQ ID NO: 297584 - protein, 18 aa, Mycobacterium
AALITIPITLRFVPETFR

SEQ ID NO: 297585 - protein, 26 aa, Mycobacterium
AALKCLTLIAFWGFAAAALRIVDYAV

SEQ ID NO: 297586 - protein, 37 aa, Mycobacterium
AALLAIGVILDWPLWWVSACSVLALLIVEGVVVNFWL

SEQ ID NO: 297587 - protein, 21 aa, Mycobacterium
AALLAYYAFVSLFPLLLLLTT

SEQ ID NO: 297588 - protein, 27 aa, Mycobacterium
AALLGGGGFVGWQLWQTKQVIAAGNQA

SEQ ID NO: 297589 - protein, 18 aa, Mycobacterium
AALLGPLALGGTVMCRRR

SEQ ID NO: 297590 - protein, 17 aa, Mycobacterium
AALLGRLMGPVRTPATL

SEQ ID NO: 297591 - protein, 26 aa, Mycobacterium
AALLKRLEPDWSITVVERLDTVAAES

SEQ ID NO: 297592 - protein, 17 aa, Mycobacterium
AALLLAALAARAGDHVD

SEQ ID NO: 297593 - protein, 24 aa, Mycobacterium
AALLMCAAIVLWLSGSAWLAPSER

SEQ ID NO: 297594 - protein, 20 aa, Mycobacterium
AALLMKEMIENTAAVLVVGG

SEQ ID NO: 297595 - protein, 19 aa, Mycobacterium
AALLMLTAAMAWLLLGRSP

SEQ ID NO: 297596 - protein, 20 aa, Mycobacterium
AALLRYLPGLTDMRITNPLT

SEQ ID NO: 297597 - protein, 32 aa, Mycobacterium
AALLSAPLWLPLLILAAWQYLQPPAVDAAPAD

SEQ ID NO: 297598 - protein, 18 aa, Mycobacterium
AALLTWSRYGRRAVPVAG

SEQ ID NO: 297599 - protein, 28 aa, Mycobacterium
AALLVFFWRDWLRIVAGFVSSLRHRRIE

SEQ ID NO: 297600 - protein, 19 aa, Mycobacterium
AALLWKFAGNDKARLRGKI

SEQ ID NO: 297601 - protein, 17 aa, Mycobacterium
AALMAGGQLVLAFSESL

SEQ ID NO: 297602 - protein, 23 aa, Mycobacterium
AALMDRFGVRPVLTVSLLLITTG

SEQ ID NO: 297603 - protein, 18 aa, Mycobacterium
AALMGRRAGVAGRGRTGT

SEQ ID NO: 297604 - protein, 29 aa, Mycobacterium
AALMLHYACGISWFPAVLVATAVAPTDPA

SEQ ID NO: 297605 - protein, 17 aa, Mycobacterium
AALMSVVLTSRFNGSAD

SEQ ID NO: 297606 - protein, 19 aa, Mycobacterium
AALMTSLKGLLSQNVTVVD

SEQ ID NO: 297607 - protein, 27 aa, Mycobacterium
AALNRASRGECLMWPDATPESAKIVNC

SEQ ID NO: 297608 - protein, 17 aa, Mycobacterium
AALPFGLDPARTPVMGS

SEQ ID NO: 297609 - protein, 18 aa, Mycobacterium
AALPGYRTSYDDKKYIPK

SEQ ID NO: 297610 - protein, 18 aa, Mycobacterium
AALPHFLGSSGVRLLLVT

SEQ ID NO: 297611 - protein, 24 aa, Mycobacterium
AALPHMYRQRFGRIVNISSVHGLR

SEQ ID NO: 297612 - protein, 21 aa, Mycobacterium
AALPLGLSLFGFEAPTAASDR

SEQ ID NO: 297613 - protein, 17 aa, Mycobacterium
AALPSGVESNIGYEAMD

SEQ ID NO: 297614 - protein, 22 aa, Mycobacterium
AALPSHMVPSGFVALTEFPLTP

SEQ ID NO: 297615 - protein, 18 aa, Mycobacterium
AALQRMLPRLGLNTGASA

SEQ ID NO: 297616 - protein, 19 aa, Mycobacterium
AALRGDHRAVLRAQGDEPG

SEQ ID NO: 297617 - protein, 20 aa, Mycobacterium
AALRGDHRAVLRARGDEPGW

SEQ ID NO: 297618 - protein, 25 aa, Mycobacterium
AALRIWDGGLGIWGAVALGAVGAWI

SEQ ID NO: 297619 - protein, 24 aa, Mycobacterium
AALRIWDGGLGIWGAVTLGTVGAW

SEQ ID NO: 297620 - protein, 25 aa, Mycobacterium
AALRPDVPPALAAAIERAMARDPAW

SEQ ID NO: 297621 - protein, 19 aa, Mycobacterium
AALRPLLIVSLVITIAGSA

SEQ ID NO: 297622 - protein, 24 aa, Mycobacterium
AALRRVATLIARGARPSDVFPAVA

SEQ ID NO: 297623 - protein, 22 aa, Mycobacterium
AALRSAGELSLLLAGAQLGITA

SEQ ID NO: 297624 - protein, 24 aa, Mycobacterium
AALRTVPSLAWVPLLLLWFGIGET

SEQ ID NO: 297625 - protein, 20 aa, Mycobacterium
AALRVNWAVGLQIFDYTGET

SEQ ID NO: 297626 - protein, 23 aa, Mycobacterium
AALSAGFNLVWRVRYALHPAGAA

SEQ ID NO: 297627 - protein, 23 aa, Mycobacterium
AALSAQYRRAYVSALVTYSPSDN

SEQ ID NO: 297628 - protein, 19 aa, Mycobacterium
AALSLLYGGFVRWKIRLRR

SEQ ID NO: 297629 - protein, 17 aa, Mycobacterium
AALSRVPEWSGGSECLS

SEQ ID NO: 297630 - protein, 24 aa, Mycobacterium
AALSVEALGGIGFITSNDTAYLSS

SEQ ID NO: 297631 - protein, 32 aa, Mycobacterium
AALTAGLFFISWKLGVAAAITLPLLLGALLAG

SEQ ID NO: 297632 - protein, 30 aa, Mycobacterium
AALTALFVTWYFSRRLQHSIAEVASAATAV

SEQ ID NO: 297633 - protein, 25 aa, Mycobacterium
AALTARKRIAWLLLLGNMILAAGLN

SEQ ID NO: 297634 - protein, 26 aa, Mycobacterium
AALTARKRIAWLLLLGNMVLAAFLNA

SEQ ID NO: 297635 - protein, 17 aa, Mycobacterium
AALTFGSALLMLGLAIV

SEQ ID NO: 297636 - protein, 17 aa, Mycobacterium
AALTFNIPPGDRMPPGA

SEQ ID NO: 297637 - protein, 28 aa, Mycobacterium
AALTGSPAWEMFKPWAITSIAVAVAVAL

SEQ ID NO: 297638 - protein, 29 aa, Mycobacterium
AALTGTPAWEMFKPWSIISITIAIVLAFV

SEQ ID NO: 297639 - protein, 28 aa, Mycobacterium
AALTGTPAWEVYKPWAVTSIAVAVAVAL

SEQ ID NO: 297640 - protein, 28 aa, Mycobacterium
AALTGTTAWEMFKPWAITSITIAVAVAL

SEQ ID NO: 297641 - protein, 21 aa, Mycobacterium
AALTIIFVFAVATLQPLAIYS

SEQ ID NO: 297642 - protein, 24 aa, Mycobacterium
AALTLFVRRQLRLPHPLIDVRLFA

SEQ ID NO: 297643 - protein, 20 aa, Mycobacterium
AALTLVLTGGAWQWQSSKND

SEQ ID NO: 297644 - protein, 19 aa, Mycobacterium
AALTQGAFPLLAVVFVVLG

SEQ ID NO: 297645 - protein, 35 aa, Mycobacterium
AALVAIGVVLGWPLWWVSACSVLVLLILEGVAVNF

SEQ ID NO: 297646 - protein, 21 aa, Mycobacterium
AALVEREAAELGLKAVVRQSD

SEQ ID NO: 297647 - protein, 24 aa, Mycobacterium
AALVGVDVAEIWDIRNRGVIPPGA

SEQ ID NO: 297648 - protein, 24 aa, Mycobacterium
AALVGVDVDEIWDIRNRGVISPGA

SEQ ID NO: 297649 - protein, 29 aa, Mycobacterium
AALVGWSFVGPRLPVAWRVTLQAGAAGLL

SEQ ID NO: 297650 - protein, 18 aa, Mycobacterium
AALVIGLVRYRRRRIRLS

SEQ ID NO: 297651 - protein, 17 aa, Mycobacterium
AALVIIVGVVFVEQGQR

SEQ ID NO: 297652 - protein, 19 aa, Mycobacterium
AALVIPGTVAFSFAGAFGL

SEQ ID NO: 297653 - protein, 23 aa, Mycobacterium
AALVNRGLCPRGWDYGWTAYTPL

SEQ ID NO: 297654 - protein, 17 aa, Mycobacterium
AALVVRLATSVAEAATA

SEQ ID NO: 297655 - protein, 20 aa, Mycobacterium
AALWACADGLVSFRNLSIMQ

SEQ ID NO: 297656 - protein, 24 aa, Mycobacterium
AALWPAEALEAVRLLIFGGEACPP

SEQ ID NO: 297657 - protein, 29 aa, Mycobacterium
AALYAHKAFGIHFITFLVAFVVMCSGITS

SEQ ID NO: 297658 - protein, 21 aa, Mycobacterium
AALYAKPGFPTDGIVVLCDFG

SEQ ID NO: 297659 - protein, 17 aa, Mycobacterium
AALYCVAYGVAGALIGA

SEQ ID NO: 297660 - protein, 19 aa, Mycobacterium
AALYSWSFLLLVFTGGGSL

SEQ ID NO: 297661 - protein, 18 aa, Mycobacterium
AAMAWLLLGRSPEFQPWL

SEQ ID NO: 297662 - protein, 18 aa, Mycobacterium
AAMGVCLIAYKGSRIGED

SEQ ID NO: 297663 - protein, 23 aa, Mycobacterium
AAMGVRILLNRRGAAGEKVWDNV

SEQ ID NO: 297664 - protein, 20 aa, Mycobacterium
AAMIALLYRYVRAAASYRPT

SEQ ID NO: 297665 - protein, 23 aa, Mycobacterium
AAMKEIQSAIGAARDAQKKGDFA

SEQ ID NO: 297666 - protein, 20 aa, Mycobacterium
AAMLCVQLGLAVAVTLIDDI

SEQ ID NO: 297667 - protein, 18 aa, Mycobacterium
AAMLGFMVLISGAFVAAT

SEQ ID NO: 297668 - protein, 19 aa, Mycobacterium
AAMLIDFRFLAALTAILAS

SEQ ID NO: 297669 - protein, 18 aa, Mycobacterium
AAMMPIAGYSRGHNLAGG

SEQ ID NO: 297670 - protein, 18 aa, Mycobacterium
AAMPPPVEGAPHLPVPGP

SEQ ID NO: 297671 - protein, 18 aa, Mycobacterium
AAMSRVTVAPVFALAAAV

SEQ ID NO: 297672 - protein, 22 aa, Mycobacterium
AAMSVLGCAVWAAARRGALRAS

SEQ ID NO: 297673 - protein, 19 aa, Mycobacterium
AAMVIPGTVAFSFAGAFGL

SEQ ID NO: 297674 - protein, 17 aa, Mycobacterium
AAMYLVAVFGIFGSITG

SEQ ID NO: 297675 - protein, 18 aa, Mycobacterium
AANAFACRSTIRPVWAVR

SEQ ID NO: 297676 - protein, 27 aa, Mycobacterium
AANFKLLVPVFRWQRRDNLLAEADPAA

SEQ ID NO: 297677 - protein, 26 aa, Mycobacterium
AANHDGRRLVAVLLHGTRQPIAPWEQ

SEQ ID NO: 297678 - protein, 17 aa, Mycobacterium
AANIGIFSLFVVVTLFV

SEQ ID NO: 297679 - protein, 26 aa, Mycobacterium
AANLFVVAFGMSWGPVVWVLLGEMFP

SEQ ID NO: 297680 - protein, 18 aa, Mycobacterium
AANLGWKLAAVVRGQAGE

SEQ ID NO: 297681 - protein, 25 aa, Mycobacterium
AANLILNASWSWIFFNRGKLGTAAI

SEQ ID NO: 297682 - protein, 18 aa, Mycobacterium
AANPFPIVAASALCFLVG

SEQ ID NO: 297683 - protein, 34 aa, Mycobacterium
AANSVLLLFGLLLPWLGALAVLGGLGYGIRHAVL

SEQ ID NO: 297684 - protein, 31 aa, Mycobacterium
AANTSWFGVEAWRWMLLVGLVPAVVYAIIAR

SEQ ID NO: 297685 - protein, 22 aa, Mycobacterium
AAPAFLVPIAFVLTGPGEYLLA

SEQ ID NO: 297686 - protein, 26 aa, Mycobacterium
AAPEARRLAAMLFGIGTLHFLAPKPF

SEQ ID NO: 297687 - protein, 20 aa, Mycobacterium
AAPEPVWWLIAVDTLTGDSL

SEQ ID NO: 297688 - protein, 23 aa, Mycobacterium
AAPGENLVALGYDGNPVNALQGE

SEQ ID NO: 297689 - protein, 18 aa, Mycobacterium
AAPGSRIMGLSSVNGAAV

SEQ ID NO: 297690 - protein, 18 aa, Mycobacterium
AAPHPWLNLPAVLLIIMC

SEQ ID NO: 297691 - protein, 18 aa, Mycobacterium
AAPIPPDVQPAGVSLPSF

SEQ ID NO: 297692 - protein, 21 aa, Mycobacterium
AAPIVTWAAWPFHSVAIRNAR

SEQ ID NO: 297693 - protein, 21 aa, Mycobacterium
AAPIVTWAAWPFHSVALRNAR

SEQ ID NO: 297694 - protein, 17 aa, Mycobacterium
AAPKLGIDLQGGTRVTL

SEQ ID NO: 297695 - protein, 17 aa, Mycobacterium
AAPKLKWVAGAVGGGLT

SEQ ID NO: 297696 - protein, 23 aa, Mycobacterium
AAPKLVMWFPPRVVVLASSGLIL

SEQ ID NO: 297697 - protein, 26 aa, Mycobacterium
AAPKRLRGALVGAFYVVTYVGFGLPL

SEQ ID NO: 297698 - protein, 17 aa, Mycobacterium
AAPLAARVTTDFVKVGG

SEQ ID NO: 297699 - protein, 20 aa, Mycobacterium
AAPLDWLGAALIGTAVAAFV

SEQ ID NO: 297700 - protein, 26 aa, Mycobacterium
AAPLLGVLCSISWQRRVPEIRVHGEP

SEQ ID NO: 297701 - protein, 20 aa, Mycobacterium
AAPLLWSVLVGLGMSVFSLA

SEQ ID NO: 297702 - protein, 20 aa, Mycobacterium
AAPLPCYQARLVNGMVEVRG

SEQ ID NO: 297703 - protein, 18 aa, Mycobacterium
AAPLPWSVTISTTLPSVS

SEQ ID NO: 297704 - protein, 28 aa, Mycobacterium
AAPLWRAAQLFRLLSCVYALGFQIAVNS

SEQ ID NO: 297705 - protein, 21 aa, Mycobacterium
AAPNLWIFLIGRFLQGAALAA

SEQ ID NO: 297706 - protein, 26 aa, Mycobacterium
AAPPGRRAAVIAAHLVWIALLAAGGV

SEQ ID NO: 297707 - protein, 20 aa, Mycobacterium
AAPPLQWPVLPRLPIPTFVL

SEQ ID NO: 297708 - protein, 23 aa, Mycobacterium
AAPPRQRLSVIVVETIVSLVALA

SEQ ID NO: 297709 - protein, 17 aa, Mycobacterium
AAPRRILVVAALVMIAA

SEQ ID NO: 297710 - protein, 17 aa, Mycobacterium
AAPSLRRTGRAASAVAF

SEQ ID NO: 297711 - protein, 25 aa, Mycobacterium
AAPTFEFFALYGTAAVYYWVICLVL

SEQ ID NO: 297712 - protein, 17 aa, Mycobacterium
AAPTGAFIRGMKVGPSA

SEQ ID NO: 297713 - protein, 20 aa, Mycobacterium
AAPTGRRPLAERARSFVRGD

SEQ ID NO: 297714 - protein, 25 aa, Mycobacterium
AAPTLPWTEKPWWVRHYTFTGTTVG

SEQ ID NO: 297715 - protein, 23 aa, Mycobacterium
AAPTVFPNANFADRPWASDYLRL

SEQ ID NO: 297716 - protein, 25 aa, Mycobacterium
AAPVPRRGEVLLGLGERELSAVSLD

SEQ ID NO: 297717 - protein, 25 aa, Mycobacterium
AAPWLARKLGLGWAISLAMGVLTVG

SEQ ID NO: 297718 - protein, 21 aa, Mycobacterium
AAPYLRTALRSAISPQIETTK

SEQ ID NO: 297719 - protein, 18 aa, Mycobacterium
AAQALRWWCITTLGPQWN

SEQ ID NO: 297720 - protein, 20 aa, Mycobacterium
AAQARLAALSILAGAVGATG

SEQ ID NO: 297721 - protein, 22 aa, Mycobacterium
AAQCGFGSVAAMRTHLRRVTAT

SEQ ID NO: 297722 - protein, 27 aa, Mycobacterium
AAQDTFLRWVWYAARREGLALDGAGDT

SEQ ID NO: 297723 - protein, 27 aa, Mycobacterium
AAQEWLKSLMPFGGFPWGSVAFGQAEG

SEQ ID NO: 297724 - protein, 27 aa, Mycobacterium
AAQEWLKSVFPFGGFPWGSVAFGQTHG

SEQ ID NO: 297725 - protein, 17 aa, Mycobacterium
AAQGGAVPLVIIGVIAS

SEQ ID NO: 297726 - protein, 24 aa, Mycobacterium
AAQIRRLAALGVRVALDDFGSGYN

SEQ ID NO: 297727 - protein, 23 aa, Mycobacterium
AAQIYMYIGYAFRAMNTHGRAMF

SEQ ID NO: 297728 - protein, 18 aa, Mycobacterium
AAQLAVLAAAAFIYVTAE

SEQ ID NO: 297729 - protein, 18 aa, Mycobacterium
AAQLGWAGVALVYLGCGV

SEQ ID NO: 297730 - protein, 26 aa, Mycobacterium
AAQLMRERFPAVLPVGEVLAIISATA

SEQ ID NO: 297731 - protein, 20 aa, Mycobacterium
AAQLRPGDVIEVRTHEVVPA

SEQ ID NO: 297732 - protein, 23 aa, Mycobacterium
AAQLSAFAARFPLPTIPAPGDAT

SEQ ID NO: 297733 - protein, 18 aa, Mycobacterium
AAQLSVLAAAAFIYVTAE

SEQ ID NO: 297734 - protein, 27 aa, Mycobacterium
AAQLVRFPWDFRRLYGLDPDEQPVADA

SEQ ID NO: 297735 - protein, 22 aa, Mycobacterium
AAQPEDVIVCIGAPLDDPAVTT

SEQ ID NO: 297736 - protein, 19 aa, Mycobacterium
AAQRFPFYTSVKHLLLDQA

SEQ ID NO: 297737 - protein, 17 aa, Mycobacterium
AAQRFWSTYLLVAGLVL

SEQ ID NO: 297738 - protein, 25 aa, Mycobacterium
AAQRGLELPVRMGIATGEAELRGGD

SEQ ID NO: 297739 - protein, 27 aa, Mycobacterium
AAQRLRAEKRLSYLLAQQTPPARKVIV

SEQ ID NO: 297740 - protein, 24 aa, Mycobacterium
AAQTELFPLAMLSVGGMMVFPASN

SEQ ID NO: 297741 - protein, 20 aa, Mycobacterium
AAQVPFWIGPILLYVLLPLL

SEQ ID NO: 297742 - protein, 26 aa, Mycobacterium
AAQVWLRPRSWLLRRATTEATVVVEI

SEQ ID NO: 297743 - protein, 17 aa, Mycobacterium
AAQWRSPADTSLAPMPS

SEQ ID NO: 297744 - protein, 24 aa, Mycobacterium
AAQYSWFIGCGIAFGLYYVLAKRD

SEQ ID NO: 297745 - protein, 21 aa, Mycobacterium
AARAAAPVRRGLGGKDLIPVL

SEQ ID NO: 297746 - protein, 24 aa, Mycobacterium
AARAGRTSVARWAVTTVALLLLVL

SEQ ID NO: 297747 - protein, 18 aa, Mycobacterium
AARALRILPGYYVCLLVT

SEQ ID NO: 297748 - protein, 23 aa, Mycobacterium
AARAMPGSGLGLAIVQQVVLKHG

SEQ ID NO: 297749 - protein, 25 aa, Mycobacterium
AARARARALKLRREAELAEAKKQAA

SEQ ID NO: 297750 - protein, 27 aa, Mycobacterium
AARASASLDEWGPEEWGMVGESPAANR

SEQ ID NO: 297751 - protein, 24 aa, Mycobacterium
AARATDVDGALAWSQDADGDEPVP

SEQ ID NO: 297752 - protein, 23 aa, Mycobacterium
AARATGNLAWWVFVVAALVNRGL

SEQ ID NO: 297753 - protein, 17 aa, Mycobacterium
AARAWRASYAEPLIAQV

SEQ ID NO: 297754 - protein, 33 aa, Mycobacterium
AARAYWTTLHQLRWAILTVMAVLALAFVMNLSG

SEQ ID NO: 297755 - protein, 22 aa, Mycobacterium
AARDGILAIRWRLPSGTEIDTG

SEQ ID NO: 297756 - protein, 17 aa, Mycobacterium
AARDGILAVRWQLPSGV

SEQ ID NO: 297757 - protein, 26 aa, Mycobacterium
AARFAEAFPGVPLHNLYGPTEAAVDV

SEQ ID NO: 297758 - protein, 17 aa, Mycobacterium
AARFCDQFEQPLQIIPA

SEQ ID NO: 297759 - protein, 18 aa, Mycobacterium
AARFPEMPVYASDLGTNI

SEQ ID NO: 297760 - protein, 22 aa, Mycobacterium
AARFSTCGEFAAALIDAARPPA

SEQ ID NO: 297761 - protein, 26 aa, Mycobacterium
AARGEHYWLKLFVFFFPFTDQIAAFK

SEQ ID NO: 297762 - protein, 26 aa, Mycobacterium
AARGEHYWLKLFVFFFPFTDQVAACK

SEQ ID NO: 297763 - protein, 29 aa, Mycobacterium
AARGEHYWLKLLVFFFPFTDQIAAFKIIM

SEQ ID NO: 297764 - protein, 29 aa, Mycobacterium
AARGEHYWLKLLVFFFPFTDQIAAYKLIM

SEQ ID NO: 297765 - protein, 23 aa, Mycobacterium
AARGEVYAPLALTFLFAGADIVV

SEQ ID NO: 297766 - protein, 24 aa, Mycobacterium
AARGEVYAPLALVFLFTGADSIIG

SEQ ID NO: 297767 - protein, 22 aa, Mycobacterium
AARGEVYGALTVAFLFTGADMI

SEQ ID NO: 297768 - protein, 24 aa, Mycobacterium
AARGEVYGSLAVCFLFSGADIIIA

SEQ ID NO: 297769 - protein, 19 aa, Mycobacterium
AARGMGPHGLCIGATGSGK

SEQ ID NO: 297770 - protein, 28 aa, Mycobacterium
AARGRRLRFRPGRAVTGVALLVVSLLML

SEQ ID NO: 297771 - protein, 17 aa, Mycobacterium
AARGVVAFLAWHGVIGL

SEQ ID NO: 297772 - protein, 24 aa, Mycobacterium
AARHVSLRPSFALREAADLLRESL

SEQ ID NO: 297773 - protein, 20 aa, Mycobacterium
AARILEHLEYTAIAVGASAL

SEQ ID NO: 297774 - protein, 19 aa, Mycobacterium
AARIPRWLRVVLRCDRAGS

SEQ ID NO: 297775 - protein, 18 aa, Mycobacterium
AARLKLGHPARLVVRCAI

SEQ ID NO: 297776 - protein, 25 aa, Mycobacterium
AARLSGIRVSRVLLFAFTFAGLCAG

SEQ ID NO: 297777 - protein, 21 aa, Mycobacterium
AARPAAGRMTYGWKRAEILSA

SEQ ID NO: 297778 - protein, 18 aa, Mycobacterium
AARPKRRVISDADAGDNI

SEQ ID NO: 297779 - protein, 26 aa, Mycobacterium
AARPRLRPTRVLAMVIGVGAVLAAIG

SEQ ID NO: 297780 - protein, 19 aa, Mycobacterium
AARRACFTAAAGTAAICVP

SEQ ID NO: 297781 - protein, 25 aa, Mycobacterium
AARRFSAIALWCWVAMALSGVMNAV

SEQ ID NO: 297782 - protein, 24 aa, Mycobacterium
AARRFSGLALWCFAAMAVSGFVNA

SEQ ID NO: 297783 - protein, 26 aa, Mycobacterium
AARRFSMLALWCYVAIGLSGIINALI

SEQ ID NO: 297784 - protein, 25 aa, Mycobacterium
AARRILRRLIVLLALVCAQAAVGTA

SEQ ID NO: 297785 - protein, 17 aa, Mycobacterium
AARRRRCVQEAMRRDMA

SEQ ID NO: 297786 - protein, 25 aa, Mycobacterium
AARSLGLPFWRVLTLIVLPQAMRSV

SEQ ID NO: 297787 - protein, 19 aa, Mycobacterium
AARSNWIVLRMRLYENLAA

SEQ ID NO: 297788 - protein, 26 aa, Mycobacterium
AARSRGVHGWALLRGHIAPVSVLPTL

SEQ ID NO: 297789 - protein, 26 aa, Mycobacterium
AARSRLDPAAGVMLSGLWVAATGQLV

SEQ ID NO: 297790 - protein, 20 aa, Mycobacterium
AARTRGGYLKDIKGFDSEFF

SEQ ID NO: 297791 - protein, 23 aa, Mycobacterium
AARVVLWVVFWFGWAIVFASTFM

SEQ ID NO: 297792 - protein, 23 aa, Mycobacterium
AARYLCSGGLNLRDPSQVMAAIL

SEQ ID NO: 297793 - protein, 22 aa, Mycobacterium
AARYLCSGGLNLRDQSQVLAAI

SEQ ID NO: 297794 - protein, 18 aa, Mycobacterium
AASAIRFPDRAALIDDSG

SEQ ID NO: 297795 - protein, 33 aa, Mycobacterium
AASALGRWAGFSVAWLYWYFWVIVVGFEAVAGG

SEQ ID NO: 297796 - protein, 33 aa, Mycobacterium
AASAPRWGRYPIRARVDVVARGGLLTGTGTVDA

SEQ ID NO: 297797 - protein, 21 aa, Mycobacterium
AASCGYAIAWQRQRTLSRPRQ

SEQ ID NO: 297798 - protein, 17 aa, Mycobacterium
AASDWPMSAFDRLHDQL

SEQ ID NO: 297799 - protein, 27 aa, Mycobacterium
AASEISIAVPAHWKPSTVQALRDALRT

SEQ ID NO: 297800 - protein, 17 aa, Mycobacterium
AASFLLYGLLDLWWHTV

SEQ ID NO: 297801 - protein, 25 aa, Mycobacterium
AASFYWGHHFGRLFAHPDSEQLLLR

SEQ ID NO: 297802 - protein, 18 aa, Mycobacterium
AASGADGYVRVWDAESGQ

SEQ ID NO: 297803 - protein, 24 aa, Mycobacterium
AASGISWLTDWPLWADGAVFLIVS

SEQ ID NO: 297804 - protein, 24 aa, Mycobacterium
AASGISWLTDWPVWADGTVFLIVS

SEQ ID NO: 297805 - protein, 24 aa, Mycobacterium
AASGPELVGLVVYLLTPLVSAVLL

SEQ ID NO: 297806 - protein, 23 aa, Mycobacterium
AASGRPGGSMSFADVGAVPAWRN

SEQ ID NO: 297807 - protein, 19 aa, Mycobacterium
AASHILPWIGLSYDSLLAK

SEQ ID NO: 297808 - protein, 19 aa, Mycobacterium
AASHLKVLRGCEVVRQGDP

SEQ ID NO: 297809 - protein, 21 aa, Mycobacterium
AASKATSAWQRAAVTAVLVVG

SEQ ID NO: 297810 - protein, 20 aa, Mycobacterium
AASLAGRFLVFQLLVVAVVL

SEQ ID NO: 297811 - protein, 17 aa, Mycobacterium
AASLLFGRGEQLPPLPR

SEQ ID NO: 297812 - protein, 22 aa, Mycobacterium
AASLPLLLGVCTVALSVAIVLA

SEQ ID NO: 297813 - protein, 25 aa, Mycobacterium
AASLPVQFGRDWFWLHAARTAAVTI

SEQ ID NO: 297814 - protein, 27 aa, Mycobacterium
AASNLSCKYLKVSDLRPSERQQVETGL

SEQ ID NO: 297815 - protein, 19 aa, Mycobacterium
AASPCALAIAVPLTVVAAI

SEQ ID NO: 297816 - protein, 20 aa, Mycobacterium
AASPCALAIAVPVSVVAAIG

SEQ ID NO: 297817 - protein, 19 aa, Mycobacterium
AASPCALAIAVPVSVVASI

SEQ ID NO: 297818 - protein, 20 aa, Mycobacterium
AASPCALAIAVPVTVVAAVG

SEQ ID NO: 297819 - protein, 21 aa, Mycobacterium
AASPLPNWLGDSVRAAAGGVL

SEQ ID NO: 297820 - protein, 24 aa, Mycobacterium
AASPRPVLFISPSARLARVPWGLL

SEQ ID NO: 297821 - protein, 25 aa, Mycobacterium
AASPRRLPIMMVRKFIDDLAASLRC

SEQ ID NO: 297822 - protein, 24 aa, Mycobacterium
AASQAGLWFAVWMPAAFFVYCLGV

SEQ ID NO: 297823 - protein, 18 aa, Mycobacterium
AASREALAELVKKFESVA

SEQ ID NO: 297824 - protein, 22 aa, Mycobacterium
AASRLAYSYGRDGMIMGSSLLK

SEQ ID NO: 297825 - protein, 17 aa, Mycobacterium
AASRLLGHVPYRIDIDV

SEQ ID NO: 297826 - protein, 23 aa, Mycobacterium
AASRVAMRAGLLGLTAASFATTG

SEQ ID NO: 297827 - protein, 24 aa, Mycobacterium
AASRWADLRPALKDQIGSRIELRL

SEQ ID NO: 297828 - protein, 20 aa, Mycobacterium
AASVDAIRTWARSLAGITRQ

SEQ ID NO: 297829 - protein, 25 aa, Mycobacterium
AASVLAFALGWAIFRITDWLSPPEP

SEQ ID NO: 297830 - protein, 19 aa, Mycobacterium
AASVLCFLAPNIAVLGIAR

SEQ ID NO: 297831 - protein, 24 aa, Mycobacterium
AASVLFFLLGCFTIVGTRQIAIVT

SEQ ID NO: 297832 - protein, 17 aa, Mycobacterium
AASVMLESFLFYSGFYL

SEQ ID NO: 297833 - protein, 19 aa, Mycobacterium
AASYSWYYAWTPGTGYLAN

SEQ ID NO: 297834 - protein, 24 aa, Mycobacterium
AATADLRGAIGFSSFAVLVYYAVA

SEQ ID NO: 297835 - protein, 25 aa, Mycobacterium
AATAPSLPLLIAWRSVGGVAAAAFA

SEQ ID NO: 297836 - protein, 24 aa, Mycobacterium
AATDIRLSQWFLLTAAFGSLFMVA

SEQ ID NO: 297837 - protein, 33 aa, Mycobacterium
AATDLRRLLPYLLPYRARWVTMVVVAIVSLGAT

SEQ ID NO: 297838 - protein, 17 aa, Mycobacterium
AATDPLGAFAQVAKADA

SEQ ID NO: 297839 - protein, 26 aa, Mycobacterium
AATDWPRYGGYALAGVSSFGFGGANA

SEQ ID NO: 297840 - protein, 21 aa, Mycobacterium
AATFCLVVYWVKREGLAGVTL

SEQ ID NO: 297841 - protein, 35 aa, Mycobacterium
AATFIAVLVTWDLLGHLPLPLGVAGHEGSTVLVGL

SEQ ID NO: 297842 - protein, 24 aa, Mycobacterium
AATFKDLRDGSAYDLLIAGVAALC

SEQ ID NO: 297843 - protein, 30 aa, Mycobacterium
AATGDAFETWGWRIPFLLSGVLVAVGLFIR

SEQ ID NO: 297844 - protein, 17 aa, Mycobacterium
AATGFGHDLRAAVFTHV

SEQ ID NO: 297845 - protein, 25 aa, Mycobacterium
AATGGPQCYDLPLVPFDKAPPFVVA

SEQ ID NO: 297846 - protein, 19 aa, Mycobacterium
AATGWPPLVVPVVYTTSLL

SEQ ID NO: 297847 - protein, 23 aa, Mycobacterium
AATIAKRLGFTGALGTVAESVDG

SEQ ID NO: 297848 - protein, 18 aa, Mycobacterium
AATLAWLTVEKIKDGHVT

SEQ ID NO: 297849 - protein, 17 aa, Mycobacterium
AATLCLLFARLPSFQTL

SEQ ID NO: 297850 - protein, 20 aa, Mycobacterium
AATLGFPIRLPVLPAGWQPN

SEQ ID NO: 297851 - protein, 17 aa, Mycobacterium
AATLIGRPTLWHWQVDV

SEQ ID NO: 297852 - protein, 27 aa, Mycobacterium
AATLILCLVCGLVLTRAAKTLSPATAL

SEQ ID NO: 297853 - protein, 25 aa, Mycobacterium
AATLRAEPFAAWIIGAACAYATHHW

SEQ ID NO: 297854 - protein, 20 aa, Mycobacterium
AATLSWIVAAALAFGYAARR

SEQ ID NO: 297855 - protein, 24 aa, Mycobacterium
AATLWPRLYLDADIQISAGAVLAV

SEQ ID NO: 297856 - protein, 20 aa, Mycobacterium
AATNRFGWFDPRRLVTTRRW

SEQ ID NO: 297857 - protein, 34 aa, Mycobacterium
AATPILAVAMPWLFLRLRFFRRKWTVTTLATTAA

SEQ ID NO: 297858 - protein, 25 aa, Mycobacterium
AATPKCPGCLIGAAMHPSFLYEIGF

SEQ ID NO: 297859 - protein, 19 aa, Mycobacterium
AATPPQWPAALDVPTGGVP

SEQ ID NO: 297860 - protein, 17 aa, Mycobacterium
AATPRVVVLSRLVPHKR

SEQ ID NO: 297861 - protein, 25 aa, Mycobacterium
AATPWCAAGLLALPLALRAAGPVRG

SEQ ID NO: 297862 - protein, 23 aa, Mycobacterium
AATQSWKAWLFGSLDAGNAITVD

SEQ ID NO: 297863 - protein, 28 aa, Mycobacterium
AATRARLPVRRLGGGLVEIPRVPDTDPL

SEQ ID NO: 297864 - protein, 17 aa, Mycobacterium
AATRLLLMTQIKPGSVV

SEQ ID NO: 297865 - protein, 24 aa, Mycobacterium
AATRPGLPLYFWVYLAALIAACLA

SEQ ID NO: 297866 - protein, 23 aa, Mycobacterium
AATRRYTYGFGRAEDLAGLFVVS

SEQ ID NO: 297867 - protein, 22 aa, Mycobacterium
AATRRYTYGFGRVEDLAGLFVV

SEQ ID NO: 297868 - protein, 26 aa, Mycobacterium
AATRSFAEGVGWLAQIGLFVLLGLLV

SEQ ID NO: 297869 - protein, 24 aa, Mycobacterium
AATRTRYAYGETFPDRDALAPNRL

SEQ ID NO: 297870 - protein, 19 aa, Mycobacterium
AATSLPQLCRLVEDTEKRY

SEQ ID NO: 297871 - protein, 20 aa, Mycobacterium
AATTCLRAADMLAAKGIDAV

SEQ ID NO: 297872 - protein, 24 aa, Mycobacterium
AATTESWGSQGFYRDDLDGLRGIA

SEQ ID NO: 297873 - protein, 45 aa, Mycobacterium
AATVAFAFLAMVFAKLSVFAALGPACAIAVFVGFAATVTLFPPVL

SEQ ID NO: 297874 - protein, 28 aa, Mycobacterium
AATVALAFLAMVFARLSVFAALGPACAI

SEQ ID NO: 297875 - protein, 28 aa, Mycobacterium
AATVHRPRLWFALVFLMTIAVSFLLSTM

SEQ ID NO: 297876 - protein, 17 aa, Mycobacterium
AATVIRLAVSRSREYQA

SEQ ID NO: 297877 - protein, 18 aa, Mycobacterium
AATVLHFEREYTRLSRLA

SEQ ID NO: 297878 - protein, 21 aa, Mycobacterium
AATVMICFHFGILSAIPMGVP

SEQ ID NO: 297879 - protein, 18 aa, Mycobacterium
AATVVLAMVVLRERVTRW

SEQ ID NO: 297880 - protein, 19 aa, Mycobacterium
AATWVGWASGIDRLTRINA

SEQ ID NO: 297881 - protein, 18 aa, Mycobacterium
AAVAAAILIHRRVVERFG

SEQ ID NO: 297882 - protein, 17 aa, Mycobacterium
AAVAAERTPTGKFVARH

SEQ ID NO: 297883 - protein, 17 aa, Mycobacterium
AAVAALIWWTSDARATI

SEQ ID NO: 297884 - protein, 29 aa, Mycobacterium
AAVAAVALWQWRAHRGPVLVTALVAGCAA

SEQ ID NO: 297885 - protein, 24 aa, Mycobacterium
AAVADLRGAIGFSSFAVLLYYAIA

SEQ ID NO: 297886 - protein, 20 aa, Mycobacterium
AAVAFAWRAKILTAETHLQP

SEQ ID NO: 297887 - protein, 25 aa, Mycobacterium
AAVAGRPGWWAGAALALVVSLLALL

SEQ ID NO: 297888 - protein, 26 aa, Mycobacterium
AAVAGRSGSFADLVPRLAELTASLDA

SEQ ID NO: 297889 - protein, 18 aa, Mycobacterium
AAVAGVWVAAAFIVGTQV

SEQ ID NO: 297890 - protein, 19 aa, Mycobacterium
AAVALARYWGAEVFATASV

SEQ ID NO: 297891 - protein, 17 aa, Mycobacterium
AAVALIALGGLFAAIDA

SEQ ID NO: 297892 - protein, 18 aa, Mycobacterium
AAVALTFLAVTTSRNASA

SEQ ID NO: 297893 - protein, 19 aa, Mycobacterium
AAVARLAVRHARDVVASEP

SEQ ID NO: 297894 - protein, 20 aa, Mycobacterium
AAVASLLLYLVFVFTQTVRH

SEQ ID NO: 297895 - protein, 17 aa, Mycobacterium
AAVAVVWAVLQFLNIAW

SEQ ID NO: 297896 - protein, 25 aa, Mycobacterium
AAVAVWQWRSHRGPVMAGALAAGSV

SEQ ID NO: 297897 - protein, 20 aa, Mycobacterium
AAVDDIDTGFVLTADEVAAQ

SEQ ID NO: 297898 - protein, 19 aa, Mycobacterium
AAVDGRPAGVLAVADTVKD

SEQ ID NO: 297899 - protein, 24 aa, Mycobacterium
AAVFCVLAVLPLIVLTQLGIIVGL

SEQ ID NO: 297900 - protein, 24 aa, Mycobacterium
AAVFCVLGVLPLIALTQIGIIVGL

SEQ ID NO: 297901 - protein, 24 aa, Mycobacterium
AAVFCVLGVLPLIVLTQVGIIVGL

SEQ ID NO: 297902 - protein, 18 aa, Mycobacterium
AAVFGPVLLFAAWGQYTF

SEQ ID NO: 297903 - protein, 20 aa, Mycobacterium
AAVFPFEMHIVVSLSSERLV

SEQ ID NO: 297904 - protein, 18 aa, Mycobacterium
AAVFSVLRVLPLPRRLAG

SEQ ID NO: 297905 - protein, 24 aa, Mycobacterium
AAVGCALFLWLEGRSADPMMDLTL

SEQ ID NO: 297906 - protein, 28 aa, Mycobacterium
AAVGFRSARWWRRGVSLLAIPLTLLAAL

SEQ ID NO: 297907 - protein, 18 aa, Mycobacterium
AAVGHFRLANLVDITPSD

SEQ ID NO: 297908 - protein, 30 aa, Mycobacterium
AAVGIGISEAVLWFIRRWLVARATMGVEAD

SEQ ID NO: 297909 - protein, 21 aa, Mycobacterium
AAVGPALFAFNGYDWPLYFSE

SEQ ID NO: 297910 - protein, 32 aa, Mycobacterium
AAVGVAYAGIWWPGGVVRWVAADGLGALVVGA

SEQ ID NO: 297911 - protein, 18 aa, Mycobacterium
AAVHAAALLLPAAALYVA

SEQ ID NO: 297912 - protein, 18 aa, Mycobacterium
AAVIASFAALTYRRQSDT

SEQ ID NO: 297913 - protein, 26 aa, Mycobacterium
AAVIAWYDWRSAVIVAIALPLIPIFM

SEQ ID NO: 297914 - protein, 25 aa, Mycobacterium
AAVICVLTLTIAGPVRTYFSQRTEM

SEQ ID NO: 297915 - protein, 20 aa, Mycobacterium
AAVIFGFLLWHVIGANSSDD

SEQ ID NO: 297916 - protein, 19 aa, Mycobacterium
AAVIGGLLLWHVVGAQSSD

SEQ ID NO: 297917 - protein, 26 aa, Mycobacterium
AAVIKAPLKLLGTFLASIPSEVFGFQ

SEQ ID NO: 297918 - protein, 20 aa, Mycobacterium
AAVLAALVWTVFRDPIDDLV

SEQ ID NO: 297919 - protein, 24 aa, Mycobacterium
AAVLAARFVNWVAQQVTRQLNLGF

SEQ ID NO: 297920 - protein, 25 aa, Mycobacterium
AAVLAARFVNWVAQQVTRRVSLGFA

SEQ ID NO: 297921 - protein, 24 aa, Mycobacterium
AAVLAARFVSWVAQRVTRRLDLGF

SEQ ID NO: 297922 - protein, 21 aa, Mycobacterium
AAVLAIGGFGAVVAGSGPGDA

SEQ ID NO: 297923 - protein, 20 aa, Mycobacterium
AAVLCAGIGTGGPTRVIVAA

SEQ ID NO: 297924 - protein, 27 aa, Mycobacterium
AAVLIWQWREHRGPAMVAAFAAGLVGA

SEQ ID NO: 297925 - protein, 17 aa, Mycobacterium
AAVLLLVVGGVYFALSP

SEQ ID NO: 297926 - protein, 23 aa, Mycobacterium
AAVLMLHQGFAWVRTVTRSVERM

SEQ ID NO: 297927 - protein, 25 aa, Mycobacterium
AAVLVALAGRRLWHRFRGQPDRADL

SEQ ID NO: 297928 - protein, 26 aa, Mycobacterium
AAVLVGYCAGWLPWFANIDRQMYFFY

SEQ ID NO: 297929 - protein, 21 aa, Mycobacterium
AAVLVLLAGRRLWHRFRGQPD

SEQ ID NO: 297930 - protein, 26 aa, Mycobacterium
AAVLVWQWREHRGPGMVVALSVGMVG

SEQ ID NO: 297931 - protein, 26 aa, Mycobacterium
AAVLWAVYTTRWWLSGLLVGAAAGIK

SEQ ID NO: 297932 - protein, 25 aa, Mycobacterium
AAVNKWGPRLPVVTCLAAMVTGLVL

SEQ ID NO: 297933 - protein, 21 aa, Mycobacterium
AAVPDWLFSLIALIAVANGAL

SEQ ID NO: 297934 - protein, 19 aa, Mycobacterium
AAVPLVWLAVAGIVYGVSV

SEQ ID NO: 297935 - protein, 24 aa, Mycobacterium
AAVPTRSALAFGLALTVVSVLWLW

SEQ ID NO: 297936 - protein, 24 aa, Mycobacterium
AAVPTRSALIFGLALTVISFFWLW

SEQ ID NO: 297937 - protein, 33 aa, Mycobacterium
AAVPVWRKVLRLLADKMTLVLLVAAAVSAVVSR

SEQ ID NO: 297938 - protein, 21 aa, Mycobacterium
AAVQLPAVWLLAAVAVGLFGL

SEQ ID NO: 297939 - protein, 21 aa, Mycobacterium
AAVQLPAVWLLSAVTVALFGL

SEQ ID NO: 297940 - protein, 21 aa, Mycobacterium
AAVQLPAVWLLSAVTVCVFGV

SEQ ID NO: 297941 - protein, 22 aa, Mycobacterium
AAVQLPGVWLLSAVTIALFGVT

SEQ ID NO: 297942 - protein, 18 aa, Mycobacterium
AAVQPYRAVVEKLQSKSA

SEQ ID NO: 297943 - protein, 19 aa, Mycobacterium
AAVQRLRAPLKVAGDYSPE

SEQ ID NO: 297944 - protein, 18 aa, Mycobacterium
AAVQRLRAPLKVAGEYSP

SEQ ID NO: 297945 - protein, 18 aa, Mycobacterium
AAVQTWGTTWGRAAALLL

SEQ ID NO: 297946 - protein, 17 aa, Mycobacterium
AAVRAALRAQLSSYKVP

SEQ ID NO: 297947 - protein, 18 aa, Mycobacterium
AAVRIRGPVDVARIEGAF

SEQ ID NO: 297948 - protein, 19 aa, Mycobacterium
AAVRRAVMTSGRTVMFSAV

SEQ ID NO: 297949 - protein, 19 aa, Mycobacterium
AAVRRTVMTAGRTVAFSAV

SEQ ID NO: 297950 - protein, 21 aa, Mycobacterium
AAVRRTVMTSGRTVVFSAVII

SEQ ID NO: 297951 - protein, 28 aa, Mycobacterium
AAVSGWRSGALGSLMSFVGVILGAVAGI

SEQ ID NO: 297952 - protein, 26 aa, Mycobacterium
AAVSGWRSGALGSMLSFAGVLLGAIA

SEQ ID NO: 297953 - protein, 28 aa, Mycobacterium
AAVSGWRSGAPGSLMALVGVVLGAGAGI

SEQ ID NO: 297954 - protein, 17 aa, Mycobacterium
AAVSIGLPLPGWDLAVV

SEQ ID NO: 297955 - protein, 18 aa, Mycobacterium
AAVSRGDLGYSLTDGRTV

SEQ ID NO: 297956 - protein, 29 aa, Mycobacterium
AAVSWFLRFLLRHSMYWFVGYRVVVGVVV

SEQ ID NO: 297957 - protein, 19 aa, Mycobacterium
AAVSWWLIEQPVREWRPAF

SEQ ID NO: 297958 - protein, 19 aa, Mycobacterium
AAVSWWLLEQPIRRWRPAR

SEQ ID NO: 297959 - protein, 25 aa, Mycobacterium
AAVTALALLLAWLALYLRVSAPVNR

SEQ ID NO: 297960 - protein, 27 aa, Mycobacterium
AAVTAVYAVFRWFFARDLRVAPDPEQL

SEQ ID NO: 297961 - protein, 18 aa, Mycobacterium
AAVTCAAMGLAVTVLVVH

SEQ ID NO: 297962 - protein, 24 aa, Mycobacterium
AAVTDRLPLVLGLMAVITLVLLFL

SEQ ID NO: 297963 - protein, 25 aa, Mycobacterium
AAVTMLLAAWGWFALLLEITGAVSV

SEQ ID NO: 297964 - protein, 17 aa, Mycobacterium
AAVTVFGYIKVENLIPG

SEQ ID NO: 297965 - protein, 19 aa, Mycobacterium
AAVVCGVVFAVAQYATSNF

SEQ ID NO: 297966 - protein, 21 aa, Mycobacterium
AAVVFRCRSWLPVVLALVGGG

SEQ ID NO: 297967 - protein, 18 aa, Mycobacterium
AAVVFVCSGTAPLTPSDC

SEQ ID NO: 297968 - protein, 17 aa, Mycobacterium
AAVVFWPLHLIPFTLLG

SEQ ID NO: 297969 - protein, 19 aa, Mycobacterium
AAVVGWGGLALILATCNQI

SEQ ID NO: 297970 - protein, 18 aa, Mycobacterium
AAVVLAGLMVAFAVITYL

SEQ ID NO: 297971 - protein, 26 aa, Mycobacterium
AAVVRLARAWSLAVSMVALVLIPVLA

SEQ ID NO: 297972 - protein, 18 aa, Mycobacterium
AAVWLVAPCMELFNDSRA

SEQ ID NO: 297973 - protein, 17 aa, Mycobacterium
AAVWLVAPCTELFHDSR

SEQ ID NO: 297974 - protein, 30 aa, Mycobacterium
AAVYDWLKARGRRGFATLLAVVGCMLLGVG

SEQ ID NO: 297975 - protein, 19 aa, Mycobacterium
AAVYLGSLVSMGFGRALRR

SEQ ID NO: 297976 - protein, 28 aa, Mycobacterium
AAVYRLARRGAPWSTRRTVSWLIGCVVL

SEQ ID NO: 297977 - protein, 27 aa, Mycobacterium
AAVYRVAAIGSVWTVPWASLRGVVQLA

SEQ ID NO: 297978 - protein, 27 aa, Mycobacterium
AAVYYWVICLVLSFGQSRIERRLERYV

SEQ ID NO: 297979 - protein, 21 aa, Mycobacterium
AAWAAAVLWFAIKVVPLDVYW

SEQ ID NO: 297980 - protein, 19 aa, Mycobacterium
AAWAQVLMWLTGRHDVAFG

SEQ ID NO: 297981 - protein, 25 aa, Mycobacterium
AAWARIATDPGQRWRLTVPQKRLSR

SEQ ID NO: 297982 - protein, 22 aa, Mycobacterium
AAWATRTGFRVATIIITLIVGI

SEQ ID NO: 297983 - protein, 25 aa, Mycobacterium
AAWDGGQAWLAVVVFVNSLVSLFYY

SEQ ID NO: 297984 - protein, 23 aa, Mycobacterium
AAWENRYLLSLAAERALRDPLTG

SEQ ID NO: 297985 - protein, 20 aa, Mycobacterium
AAWKGRRPGPLVAEELPVVV

SEQ ID NO: 297986 - protein, 17 aa, Mycobacterium
AAWLRRSMNFSARLLPE

SEQ ID NO: 297987 - protein, 17 aa, Mycobacterium
AAWMHPHRMGGPGGPGG

SEQ ID NO: 297988 - protein, 24 aa, Mycobacterium
AAWRMFVRRDWRYAAVLVGYCAGW

SEQ ID NO: 297989 - protein, 17 aa, Mycobacterium
AAWSRFDPATVINHHGR

SEQ ID NO: 297990 - protein, 18 aa, Mycobacterium
AAYAMAPWIGLAVAAVLL

SEQ ID NO: 297991 - protein, 17 aa, Mycobacterium
AAYLGVSLWAVRDVGPR

SEQ ID NO: 297992 - protein, 27 aa, Mycobacterium
AAYLPMFTVLALRGSWLDALGGTLAAI

SEQ ID NO: 297993 - protein, 18 aa, Mycobacterium
AAYLRVADTVKRNVAGSP

SEQ ID NO: 297994 - protein, 24 aa, Mycobacterium
AAYMAAKIVVFSAFAIAQAAIATT

SEQ ID NO: 297995 - protein, 20 aa, Mycobacterium
AAYNVVVVWSTDRVAAIPRV

SEQ ID NO: 297996 - protein, 22 aa, Mycobacterium
AAYQHYEWLSTVAIIALLATVA

SEQ ID NO: 297997 - protein, 25 aa, Mycobacterium
AAYRRAHGLAGLSLAWGLWEQASAM

SEQ ID NO: 297998 - protein, 23 aa, Mycobacterium
AAYSESLTQVFLWAVPVALVGFV

SEQ ID NO: 297999 - protein, 22 aa, Mycobacterium
AAYTRRTEIGIMRLVGASRWYT

SEQ ID NO: 298000 - protein, 20 aa, Mycobacterium
AAYVAGWMCFVNWASTSIVD

SEQ ID NO: 298001 - protein, 24 aa, Mycobacterium
AAYVTRVHWSRWVRSLAVLVGVAT

SEQ ID NO: 298002 - protein, 17 aa, Mycobacterium
AAYYLWTLASPRADARI

SEQ ID NO: 298003 - protein, 17 aa, Mycobacterium
ACAGGFDAGTPYWLIAA

SEQ ID NO: 298004 - protein, 17 aa, Mycobacterium
ACAKRYLSAGFEQLEVP

SEQ ID NO: 298005 - protein, 20 aa, Mycobacterium
ACALLALLAACCIPAREHRR

SEQ ID NO: 298006 - protein, 19 aa, Mycobacterium
ACAPLSGLVTVAAKALADR

SEQ ID NO: 298007 - protein, 20 aa, Mycobacterium
ACAVGLVGLLALPGYQTSYD

SEQ ID NO: 298008 - protein, 19 aa, Mycobacterium
ACAYEWTHHVALAEQAGIS

SEQ ID NO: 298009 - protein, 24 aa, Mycobacterium
ACEPEVRAAGTLSRGAKTGGKPRR

SEQ ID NO: 298010 - protein, 26 aa, Mycobacterium
ACERADAVLVLTEWREFVDLDPDDLA

SEQ ID NO: 298011 - protein, 20 aa, Mycobacterium
ACGARTRISTFSAGAFLLGL

SEQ ID NO: 298012 - protein, 34 aa, Mycobacterium
ACGIYKGAEPQVMWSNERTLVFALVAAKPPGPNL

SEQ ID NO: 298013 - protein, 21 aa, Mycobacterium
ACGMLAWARRRPVLAGVLIGL

SEQ ID NO: 298014 - protein, 25 aa, Mycobacterium
ACHPDCLREGIDFDIQLDVLSRPFL

SEQ ID NO: 298015 - protein, 17 aa, Mycobacterium
ACILIFAQLNLLWLGIT

SEQ ID NO: 298016 - protein, 24 aa, Mycobacterium
ACITDRLDGLLARNYGMATEFGAF

SEQ ID NO: 298017 - protein, 19 aa, Mycobacterium
ACIVRRWITGEGFTDSGLR

SEQ ID NO: 298018 - protein, 20 aa, Mycobacterium
ACLAGLWWAAHAMFDHYVVE

SEQ ID NO: 298019 - protein, 17 aa, Mycobacterium
ACLCLTMTTLPYFQSMA

SEQ ID NO: 298020 - protein, 17 aa, Mycobacterium
ACLCLTMTTLPYFQTMG

SEQ ID NO: 298021 - protein, 22 aa, Mycobacterium
ACLHFTRLPYFKPLGIPGAVGI

SEQ ID NO: 298022 - protein, 17 aa, Mycobacterium
ACLPLNGLVTMAAKDLA

SEQ ID NO: 298023 - protein, 27 aa, Mycobacterium
ACLTSWRPGTNWGDWLLKRCSRLFRPV

SEQ ID NO: 298024 - protein, 17 aa, Mycobacterium
ACMAAGGAVPFVTVGAY

SEQ ID NO: 298025 - protein, 27 aa, Mycobacterium
ACQGFGWVYVRHFLRHTGYSPLVLTAG

SEQ ID NO: 298026 - protein, 18 aa, Mycobacterium
ACQVPVYLMRSSRFTALE

SEQ ID NO: 298027 - protein, 23 aa, Mycobacterium
ACSERRLDLWADRAVVGQSLRAV

SEQ ID NO: 298028 - protein, 30 aa, Mycobacterium
ACSVVMVAHCVRRFGGITGDVLGAAVEVTT

SEQ ID NO: 298029 - protein, 22 aa, Mycobacterium
ACTGEGPAALAGLRAGDQVLTA

SEQ ID NO: 298030 - protein, 29 aa, Mycobacterium
ACTVGFLPPSEWRSPADLTDVDTPDGLYC

SEQ ID NO: 298031 - protein, 17 aa, Mycobacterium
ACVAALYWAADAMFGRY

SEQ ID NO: 298032 - protein, 18 aa, Mycobacterium
ACVALCGVAAGLFMLGFS

SEQ ID NO: 298033 - protein, 20 aa, Mycobacterium
ACVLYECLTAQHPFPGDIEE

SEQ ID NO: 298034 - protein, 26 aa, Mycobacterium
ACVPSWRPGTNWGGWLMKRAARLFRP

SEQ ID NO: 298035 - protein, 30 aa, Mycobacterium
ACVQSWRPGTAWGGWLLRRCTRLYRPVFYY

SEQ ID NO: 298036 - protein, 33 aa, Mycobacterium
ACVSTEALIEWAWRLPFLMSLILVGLALYVHVK

SEQ ID NO: 298037 - protein, 20 aa, Mycobacterium
ACVVPSLLVLIVRIVDEEKL

SEQ ID NO: 298038 - protein, 18 aa, Mycobacterium
ACWLVISHWVLRRLGPGR

SEQ ID NO: 298039 - protein, 26 aa, Mycobacterium
ACYKVSRPIDEISLGAAIDYAVNAKN

SEQ ID NO: 298040 - protein, 20 aa, Mycobacterium
ACYKVTRPIDEISLGAAINY

SEQ ID NO: 298041 - protein, 17 aa, Mycobacterium
ADAAAVCGCPVGTIRSR

SEQ ID NO: 298042 - protein, 26 aa, Mycobacterium
ADAALRAAVKIHRRVAERFGQELRIG

SEQ ID NO: 298043 - protein, 28 aa, Mycobacterium
ADAAPLWAAMAMWLVLWVLYLSIVNVGQ

SEQ ID NO: 298044 - protein, 24 aa, Mycobacterium
ADAAREWQTYFSTWTAWNHVRTVT

SEQ ID NO: 298045 - protein, 20 aa, Mycobacterium
ADAASGRFAVDVVLHEPAGP

SEQ ID NO: 298046 - protein, 18 aa, Mycobacterium
ADAAVFFGRDAQIVRALD

SEQ ID NO: 298047 - protein, 18 aa, Mycobacterium
ADADRKWLTIALILIGGF

SEQ ID NO: 298048 - protein, 17 aa, Mycobacterium
ADADYIRRVIKAQRALE

SEQ ID NO: 298049 - protein, 24 aa, Mycobacterium
ADAEARVLLARRFHNDAVRDTLAL

SEQ ID NO: 298050 - protein, 19 aa, Mycobacterium
ADAEGLCRPWLPTEADPFG

SEQ ID NO: 298051 - protein, 27 aa, Mycobacterium
ADAFNKVFALRGGNWVELPHLTHARAA

SEQ ID NO: 298052 - protein, 22 aa, Mycobacterium
ADAGFGRAIAVTALMTAVILLG

SEQ ID NO: 298053 - protein, 23 aa, Mycobacterium
ADAGFKPSLLTTVCSRSAAVGRL

SEQ ID NO: 298054 - protein, 25 aa, Mycobacterium
ADAGLRLSSIGVTWTDPVQAAALRD

SEQ ID NO: 298055 - protein, 22 aa, Mycobacterium
ADAGTPQRFVWFPVSDPDRPKD

SEQ ID NO: 298056 - protein, 26 aa, Mycobacterium
ADAHFGWDVVDATGWTTSQLREAIGE

SEQ ID NO: 298057 - protein, 30 aa, Mycobacterium
ADAHRRMGWPRLLAYGVLPGLALALALLAG

SEQ ID NO: 298058 - protein, 19 aa, Mycobacterium
ADAIAALQNRGFKTRTLQK

SEQ ID NO: 298059 - protein, 20 aa, Mycobacterium
ADAIAALQNRGFKTRTLQKP

SEQ ID NO: 298060 - protein, 37 aa, Mycobacterium
ADAIKFAFRRPFQWREFLEQSWFVARVAMLPTLLVAI

SEQ ID NO: 298061 - protein, 38 aa, Mycobacterium
ADAIKFVFRRPFQWREFLEQSWFVARVAIAPTLLVAIP

SEQ ID NO: 298062 - protein, 35 aa, Mycobacterium
ADAIKFVFRRPFQWREFLEQSWFVARVSMAPTLLV

SEQ ID NO: 298063 - protein, 25 aa, Mycobacterium
ADALGMPIDLSWQLWAFGVFAIAAV

SEQ ID NO: 298064 - protein, 18 aa, Mycobacterium
ADALLAHDALPPDTKPGR

SEQ ID NO: 298065 - protein, 18 aa, Mycobacterium
ADALLAHDGLAPDSRPGR

SEQ ID NO: 298066 - protein, 18 aa, Mycobacterium
ADALLAHDGLTPDQKPGR

SEQ ID NO: 298067 - protein, 19 aa, Mycobacterium
ADALSAVPVMLARILDLPQ

SEQ ID NO: 298068 - protein, 22 aa, Mycobacterium
ADAMPVRVGVAVIGAIIVFSLI

SEQ ID NO: 298069 - protein, 29 aa, Mycobacterium
ADANKYVQCRVVATGNSLDAVWKQLMPNR

SEQ ID NO: 298070 - protein, 27 aa, Mycobacterium
ADANKYVQCRVVATGNSVDAVWHQLMP

SEQ ID NO: 298071 - protein, 17 aa, Mycobacterium
ADAPPFFILHGQDDSII

SEQ ID NO: 298072 - protein, 19 aa, Mycobacterium
ADAPPFFVLHGCDDSLIPV

SEQ ID NO: 298073 - protein, 17 aa, Mycobacterium
ADAPPFFVLHGRNDSLV

SEQ ID NO: 298074 - protein, 24 aa, Mycobacterium
ADAQARYSALIERLRGNTEYVTFV

SEQ ID NO: 298075 - protein, 22 aa, Mycobacterium
ADARAAGLPAPLVIVTDTPVAR

SEQ ID NO: 298076 - protein, 18 aa, Mycobacterium
ADARAVLREVLVKELQPI

SEQ ID NO: 298077 - protein, 25 aa, Mycobacterium
ADARLTWVLAAAMLFVAVAFAALAR

SEQ ID NO: 298078 - protein, 23 aa, Mycobacterium
ADASLPTVALWALALLITGAGIG

SEQ ID NO: 298079 - protein, 23 aa, Mycobacterium
ADASWGVRIIAFVALVFGTLNVI

SEQ ID NO: 298080 - protein, 23 aa, Mycobacterium
ADATFLDIMWPLLLAASGIGLCT

SEQ ID NO: 298081 - protein, 21 aa, Mycobacterium
ADAVACGEPQLVVRSGVVHGA

SEQ ID NO: 298082 - protein, 26 aa, Mycobacterium
ADAVKFLFQRPFQWREFLEQSWFIAR

SEQ ID NO: 298083 - protein, 23 aa, Mycobacterium
ADAVKFLFRRPFQTSEFLLQSWF

SEQ ID NO: 298084 - protein, 21 aa, Mycobacterium
ADAVKKWAFDGGLMVRRRKEL

SEQ ID NO: 298085 - protein, 27 aa, Mycobacterium
ADAVPLWAAMLMWLALWALYLSIVNVG

SEQ ID NO: 298086 - protein, 18 aa, Mycobacterium
ADAVWIIVVFVATVALLN

SEQ ID NO: 298087 - protein, 20 aa, Mycobacterium
ADAWPRWASAIKKVTWTSPQ

SEQ ID NO: 298088 - protein, 18 aa, Mycobacterium
ADAYGWRFSLVAWVLVPV

SEQ ID NO: 298089 - protein, 20 aa, Mycobacterium
ADCPIYAEFAESQALTAGEP

SEQ ID NO: 298090 - protein, 23 aa, Mycobacterium
ADDARAAMRAWIAQAVTWHDPAV

SEQ ID NO: 298091 - protein, 24 aa, Mycobacterium
ADDDVGLVLGWPGGLRIAVDNLVR

SEQ ID NO: 298092 - protein, 18 aa, Mycobacterium
ADDHPLRPRIRVGSKSQL

SEQ ID NO: 298093 - protein, 22 aa, Mycobacterium
ADDIRAAVVGFIRKPAVTASLA

SEQ ID NO: 298094 - protein, 19 aa, Mycobacterium
ADDKLFCNSPFFWIGGFAF

SEQ ID NO: 298095 - protein, 18 aa, Mycobacterium
ADDKLFCNSPFFWVGGLA

SEQ ID NO: 298096 - protein, 18 aa, Mycobacterium
ADDLKAKAIEFVKKPAVT

SEQ ID NO: 298097 - protein, 26 aa, Mycobacterium
ADDRPMFAAAPNFAFALAAQRGLPPE

SEQ ID NO: 298098 - protein, 19 aa, Mycobacterium
ADDVFRGFAQQLGLDMSAF

SEQ ID NO: 298099 - protein, 19 aa, Mycobacterium
ADEAPARRRRRLRLTRSAV

SEQ ID NO: 298100 - protein, 24 aa, Mycobacterium
ADEHRAEAASTWWQSLPPIRLAHK

SEQ ID NO: 298101 - protein, 18 aa, Mycobacterium
ADEPVAAVLSRMASGHTR

SEQ ID NO: 298102 - protein, 24 aa, Mycobacterium
ADEQRTALQWSHPEPAALNGIPGT

SEQ ID NO: 298103 - protein, 21 aa, Mycobacterium
ADERSAVLAARLTTLGVGKGS

SEQ ID NO: 298104 - protein, 19 aa, Mycobacterium
ADETLSLIRRGDEDIRKQS

SEQ ID NO: 298105 - protein, 19 aa, Mycobacterium
ADETLSLIRRGDEEKRKES

SEQ ID NO: 298106 - protein, 18 aa, Mycobacterium
ADETLSLIRRGDQEVRKQ

SEQ ID NO: 298107 - protein, 18 aa, Mycobacterium
ADEVFYLLVDELDALPAD

SEQ ID NO: 298108 - protein, 17 aa, Mycobacterium
ADFAADLLGPWAGFFTG

SEQ ID NO: 298109 - protein, 21 aa, Mycobacterium
ADFAGIMPRAVNSCIRCGLHA

SEQ ID NO: 298110 - protein, 23 aa, Mycobacterium
ADFAREFNARLDAGAPAHTSRIR

SEQ ID NO: 298111 - protein, 23 aa, Mycobacterium
ADFARLYPYQVFMDLYGLPLEDR

SEQ ID NO: 298112 - protein, 20 aa, Mycobacterium
ADFCRIRIGLGTQPLATRLV

SEQ ID NO: 298113 - protein, 20 aa, Mycobacterium
ADFGGLMVGQPLRFSARIGR

SEQ ID NO: 298114 - protein, 19 aa, Mycobacterium
ADFLPPVLRTLTIGVPEKP

SEQ ID NO: 298115 - protein, 17 aa, Mycobacterium
ADFLQRPSAWLRLISQV

SEQ ID NO: 298116 - protein, 27 aa, Mycobacterium
ADFPTLSVLCGVVWLAGSLGYLSVGLL

SEQ ID NO: 298117 - protein, 23 aa, Mycobacterium
ADFPTVLLSGDWLSQEQVTGASE

SEQ ID NO: 298118 - protein, 23 aa, Mycobacterium
ADGAKWDLLIAGISSLCLIFIIM

SEQ ID NO: 298119 - protein, 19 aa, Mycobacterium
ADGALARMVRRFPDAQTLD

SEQ ID NO: 298120 - protein, 21 aa, Mycobacterium
ADGDRSTWFAVDRPVYVALTL

SEQ ID NO: 298121 - protein, 17 aa, Mycobacterium
ADGEDWDPVPAPMAPPE

SEQ ID NO: 298122 - protein, 22 aa, Mycobacterium
ADGGLRLFSRWDLGTDPIEVLD

SEQ ID NO: 298123 - protein, 17 aa, Mycobacterium
ADGGLVFGTAPAEGRDA

SEQ ID NO: 298124 - protein, 25 aa, Mycobacterium
ADGHVVSGSWSFRLTVPGTGTPGPP

SEQ ID NO: 298125 - protein, 20 aa, Mycobacterium
ADGIRRLRTRAGRTTVVLTS

SEQ ID NO: 298126 - protein, 20 aa, Mycobacterium
ADGKAAYVMLNLAGEQGQTL

SEQ ID NO: 298127 - protein, 21 aa, Mycobacterium
ADGKLVAPVAYPSLYADQATD

SEQ ID NO: 298128 - protein, 24 aa, Mycobacterium
ADGKRLYEEPGNFIGDKMVELPLA

SEQ ID NO: 298129 - protein, 17 aa, Mycobacterium
ADGLCKAYAGAADGTTW

SEQ ID NO: 298130 - protein, 17 aa, Mycobacterium
ADGLGFVGETARCDPGN

SEQ ID NO: 298131 - protein, 25 aa, Mycobacterium
ADGLNRFASVLARSSDSLGRTLDTL

SEQ ID NO: 298132 - protein, 20 aa, Mycobacterium
ADGLTPWIAAPLLFIGFMFG

SEQ ID NO: 298133 - protein, 18 aa, Mycobacterium
ADGMVRFRSLTVMQVANT

SEQ ID NO: 298134 - protein, 18 aa, Mycobacterium
ADGPEWLLLVASAVVVII

SEQ ID NO: 298135 - protein, 18 aa, Mycobacterium
ADGPRITFEVGHHQGVIG

SEQ ID NO: 298136 - protein, 17 aa, Mycobacterium
ADGPRSRAHYVYVALEL

SEQ ID NO: 298137 - protein, 20 aa, Mycobacterium
ADGPSILWILVQIILILLEI

SEQ ID NO: 298138 - protein, 19 aa, Mycobacterium
ADGPYRLQLRRSLSTAAFA

SEQ ID NO: 298139 - protein, 17 aa, Mycobacterium
ADGRCKAYAGAADGTAF

SEQ ID NO: 298140 - protein, 19 aa, Mycobacterium
ADGRGRLLTVPGVQSADPI

SEQ ID NO: 298141 - protein, 19 aa, Mycobacterium
ADGSLRYTAVITVLDGLVA

SEQ ID NO: 298142 - protein, 17 aa, Mycobacterium
ADGSRLVTTLTRHPGGA

SEQ ID NO: 298143 - protein, 20 aa, Mycobacterium
ADGTIWIFGGIRSDGALTGL

SEQ ID NO: 298144 - protein, 19 aa, Mycobacterium
ADGTVVKWDQAPLPDGGEP

SEQ ID NO: 298145 - protein, 20 aa, Mycobacterium
ADGWECQRALTVANNVIVDI

SEQ ID NO: 298146 - protein, 22 aa, Mycobacterium
ADGWSYPVLFGDIVDHYNAAIG

SEQ ID NO: 298147 - protein, 19 aa, Mycobacterium
ADHIARGPLTPAFVHAVLD

SEQ ID NO: 298148 - protein, 22 aa, Mycobacterium
ADHPEWKRSVAREAMRSLPGRT

SEQ ID NO: 298149 - protein, 22 aa, Mycobacterium
ADHPIWLAVPAFAPALIIAGVI

SEQ ID NO: 298150 - protein, 23 aa, Mycobacterium
ADHRRLEGLIAPGTWNIDPSAQP

SEQ ID NO: 298151 - protein, 24 aa, Mycobacterium
ADHVAFSIWALWSVMVLFMPASVY

SEQ ID NO: 298152 - protein, 27 aa, Mycobacterium
ADHVAVFRKLFWINLIIAIPVIAFSTM

SEQ ID NO: 298153 - protein, 17 aa, Mycobacterium
ADIARGSLRLWSQACAS

SEQ ID NO: 298154 - protein, 47 aa, Mycobacterium
ADIERLRLPAVLRRPRIRPAYRKAAPGAGVWNRLGAVMADAQSWLDV

SEQ ID NO: 298155 - protein, 17 aa, Mycobacterium
ADIGIAMGITGTDVSKG

SEQ ID NO: 298156 - protein, 33 aa, Mycobacterium
ADIIRLYGEVLRFLFEPIFNFLRDPIGNTFALI

SEQ ID NO: 298157 - protein, 17 aa, Mycobacterium
ADIKRIRITEFRRIGRK

SEQ ID NO: 298158 - protein, 17 aa, Mycobacterium
ADIKSLADGLARFTAEL

SEQ ID NO: 298159 - protein, 20 aa, Mycobacterium
ADILRRSRESTLPGTAAITP

SEQ ID NO: 298160 - protein, 22 aa, Mycobacterium
ADIRFSRNEFEQLITQPLDRFI

SEQ ID NO: 298161 - protein, 17 aa, Mycobacterium
ADIRLVAAGAIPRTTSG

SEQ ID NO: 298162 - protein, 18 aa, Mycobacterium
ADKIAANYPGVWYRAFDL

SEQ ID NO: 298163 - protein, 23 aa, Mycobacterium
ADKSGLTALTWPVVANFAVDAAM

SEQ ID NO: 298164 - protein, 24 aa, Mycobacterium
ADKSGLTALTWPVVANFAVDAAMA

SEQ ID NO: 298165 - protein, 23 aa, Mycobacterium
ADKSLPVFAVLVFVVACTVGSLL

SEQ ID NO: 298166 - protein, 26 aa, Mycobacterium
ADKSRSRAAGSFGLGLSIAASIVEAH

SEQ ID NO: 298167 - protein, 22 aa, Mycobacterium
ADKWKNCANRTVTVTNSKGETF

SEQ ID NO: 298168 - protein, 19 aa, Mycobacterium
ADLAHEIRTPVAVLEAYME

SEQ ID NO: 298169 - protein, 24 aa, Mycobacterium
ADLDRPDPPAARHAASGHRVDEEH

SEQ ID NO: 298170 - protein, 23 aa, Mycobacterium
ADLDRPDPPSARHTQQVGAPDRR

SEQ ID NO: 298171 - protein, 25 aa, Mycobacterium
ADLDWQTVWEKGWSVAAAAQDAPVD

SEQ ID NO: 298172 - protein, 33 aa, Mycobacterium
ADLEPTWSRPGWRHLKHFNGFVTSFWVTPSDIS

SEQ ID NO: 298173 - protein, 33 aa, Mycobacterium
ADLEPTWSRPGWRRLKHFNGFTTSFWVTPSDIT

SEQ ID NO: 298174 - protein, 33 aa, Mycobacterium
ADLEPTWSRPGWRRLKHFNGFVTSLWLTPSDIT

SEQ ID NO: 298175 - protein, 21 aa, Mycobacterium
ADLERAKRGPLLGIPGAPQFV

SEQ ID NO: 298176 - protein, 25 aa, Mycobacterium
ADLGEHALPLFGSVVLRAKTATSNG

SEQ ID NO: 298177 - protein, 18 aa, Mycobacterium
ADLGGGFGDLQWVVNAYT

SEQ ID NO: 298178 - protein, 21 aa, Mycobacterium
ADLHIPYPIALDNDYATWNNF

SEQ ID NO: 298179 - protein, 20 aa, Mycobacterium
ADLIDWPGLGVIARMMRVIP

SEQ ID NO: 298180 - protein, 19 aa, Mycobacterium
ADLILFFVFFDLSIVAMYF

SEQ ID NO: 298181 - protein, 22 aa, Mycobacterium
ADLKGGSGVRPFAGVPHVSQII

SEQ ID NO: 298182 - protein, 22 aa, Mycobacterium
ADLKHPVVVAILFVVIAGIVLL

SEQ ID NO: 298183 - protein, 18 aa, Mycobacterium
ADLLGPWAGFFTGWTYWF

SEQ ID NO: 298184 - protein, 18 aa, Mycobacterium
ADLLGRKRTFEFGVALFT

SEQ ID NO: 298185 - protein, 24 aa, Mycobacterium
ADLLGRRRTFTFGVVIFTIASGLC

SEQ ID NO: 298186 - protein, 21 aa, Mycobacterium
ADLPAAYCVIGRPHAIVVTSA

SEQ ID NO: 298187 - protein, 21 aa, Mycobacterium
ADLPDALGIAVEALRAGSAEN

SEQ ID NO: 298188 - protein, 23 aa, Mycobacterium
ADLPRERRFTAPGFDAKETQVIA

SEQ ID NO: 298189 - protein, 24 aa, Mycobacterium
ADLRLAADRAELIPDINNYMAALE

SEQ ID NO: 298190 - protein, 19 aa, Mycobacterium
ADLRMYLKPGFHPDDIDTT

SEQ ID NO: 298191 - protein, 18 aa, Mycobacterium
ADLRRAGIPFVHSTSERM

SEQ ID NO: 298192 - protein, 21 aa, Mycobacterium
ADLRRAVALSSLVQAGAALLA

SEQ ID NO: 298193 - protein, 25 aa, Mycobacterium
ADLRVAHPLIARAHLLLRFDRGRWL

SEQ ID NO: 298194 - protein, 26 aa, Mycobacterium
ADLRVAHPLIDRAHLLLRFEQGSWVA

SEQ ID NO: 298195 - protein, 17 aa, Mycobacterium
ADLRYAANSDLDFQLVV

SEQ ID NO: 298196 - protein, 17 aa, Mycobacterium
ADLSMLSKAEVERIWLP

SEQ ID NO: 298197 - protein, 17 aa, Mycobacterium
ADLTPDLALAYGAVFAE

SEQ ID NO: 298198 - protein, 18 aa, Mycobacterium
ADLVTWPALGPVVRLMKV

SEQ ID NO: 298199 - protein, 17 aa, Mycobacterium
ADLYLFAALLVCAAGYA

SEQ ID NO: 298200 - protein, 17 aa, Mycobacterium
ADMCWAAGTAVAIVPAV

SEQ ID NO: 298201 - protein, 17 aa, Mycobacterium
ADMIRLIIRDEAVHGYY

SEQ ID NO: 298202 - protein, 18 aa, Mycobacterium
ADMLRSFFGTLAVAVLFG

SEQ ID NO: 298203 - protein, 17 aa, Mycobacterium
ADMPANLAMEVADRHFS

SEQ ID NO: 298204 - protein, 21 aa, Mycobacterium
ADNWFTSAFLFAGMLSVLAVV

SEQ ID NO: 298205 - protein, 23 aa, Mycobacterium
ADPARLASCLAALGHPTTVEVVG

SEQ ID NO: 298206 - protein, 31 aa, Mycobacterium
ADPARRTGCLAALGYPPGIRVLGARPLDVAG

SEQ ID NO: 298207 - protein, 17 aa, Mycobacterium
ADPASGLAVGFVHNRLL

SEQ ID NO: 298208 - protein, 19 aa, Mycobacterium
ADPDLPFDNDVGGRPVTVR

SEQ ID NO: 298209 - protein, 17 aa, Mycobacterium
ADPERPVALHAVAGTIT

SEQ ID NO: 298210 - protein, 17 aa, Mycobacterium
ADPEYLAFYPFVYAGIL

SEQ ID NO: 298211 - protein, 19 aa, Mycobacterium
ADPFGRGWNLFGLAHLHVA

SEQ ID NO: 298212 - protein, 20 aa, Mycobacterium
ADPGNPLAILVPLTAAAMDV

SEQ ID NO: 298213 - protein, 24 aa, Mycobacterium
ADPGRAGAIALALVAALAVLVTVF

SEQ ID NO: 298214 - protein, 18 aa, Mycobacterium
ADPGRAGAIALAVVAALA

SEQ ID NO: 298215 - protein, 24 aa, Mycobacterium
ADPGRAGAIGLAIVAALAVLVTVF

SEQ ID NO: 298216 - protein, 19 aa, Mycobacterium
ADPHVTALRRSYADGTTLV

SEQ ID NO: 298217 - protein, 20 aa, Mycobacterium
ADPIAALAIAVIAVREGMNA

SEQ ID NO: 298218 - protein, 18 aa, Mycobacterium
ADPLWDQRVGVLQVTDAV

SEQ ID NO: 298219 - protein, 25 aa, Mycobacterium
ADPMIAWRYLDLRGDDLTPDHEIEQ

SEQ ID NO: 298220 - protein, 22 aa, Mycobacterium
ADPPSRRQALSSLVLLLCALVA

SEQ ID NO: 298221 - protein, 19 aa, Mycobacterium
ADPRIGFYLFPYTHVPEVL

SEQ ID NO: 298222 - protein, 26 aa, Mycobacterium
ADPRISRAHLILRFDQGRWLAIDNGS

SEQ ID NO: 298223 - protein, 30 aa, Mycobacterium
ADPRPMLAMHRISAFVLARGLITVRLTPDF

SEQ ID NO: 298224 - protein, 29 aa, Mycobacterium
ADPSRRASCLSGLGYPASTPILGAQPIDI

SEQ ID NO: 298225 - protein, 29 aa, Mycobacterium
ADPSRRASCLSGLGYPASTQILGAQPIGI

SEQ ID NO: 298226 - protein, 24 aa, Mycobacterium
ADPSRVRRSGGTGLGLAISIEDAR

SEQ ID NO: 298227 - protein, 22 aa, Mycobacterium
ADPSRVRRSGGTGLGLAISVED

SEQ ID NO: 298228 - protein, 29 aa, Mycobacterium
ADPVRRASCLTGLGYPASTQVLGGRRVEI

SEQ ID NO: 298229 - protein, 20 aa, Mycobacterium
ADQFALFRLSVKLPDTDTVS

SEQ ID NO: 298230 - protein, 23 aa, Mycobacterium
ADQPAQIKLHFHLADPDGVALDS

SEQ ID NO: 298231 - protein, 27 aa, Mycobacterium
ADQPHTRFDVLFAFDIIDHSGQAVALS

SEQ ID NO: 298232 - protein, 24 aa, Mycobacterium
ADQRALGAALWYAATVKDAVIVAA

SEQ ID NO: 298233 - protein, 23 aa, Mycobacterium
ADQRGSTMAVQWPAALQEQIARV

SEQ ID NO: 298234 - protein, 32 aa, Mycobacterium
ADQRNAFAVPWRLTVIQSVLWAGGVALFTLLY

SEQ ID NO: 298235 - protein, 17 aa, Mycobacterium
ADRAGVVAQVLEELDLT

SEQ ID NO: 298236 - protein, 24 aa, Mycobacterium
ADRAKAIGLWAAMVGVGVAVGPIS

SEQ ID NO: 298237 - protein, 26 aa, Mycobacterium
ADRDDPRRWLGLSLGISGVVVAFTPS

SEQ ID NO: 298238 - protein, 19 aa, Mycobacterium
ADRGFRIGTAATDVRARPA

SEQ ID NO: 298239 - protein, 20 aa, Mycobacterium
ADRGMPLLVLVVMAQLVLCG

SEQ ID NO: 298240 - protein, 20 aa, Mycobacterium
ADRHLLALAVAWLALPTAAI

SEQ ID NO: 298241 - protein, 17 aa, Mycobacterium
ADRIAKPLVPAIMITAA

SEQ ID NO: 298242 - protein, 17 aa, Mycobacterium
ADRIAKPLVPGVMIAAA

SEQ ID NO: 298243 - protein, 19 aa, Mycobacterium
ADRIRRLEDMAGRGGSRPD

SEQ ID NO: 298244 - protein, 23 aa, Mycobacterium
ADRKAWYLPVGVTGTLGDPTAAE

SEQ ID NO: 298245 - protein, 19 aa, Mycobacterium
ADRLLGLGGLTAHGGGAGS

SEQ ID NO: 298246 - protein, 23 aa, Mycobacterium
ADRLRLALRSPFMVQGSSVRVTA

SEQ ID NO: 298247 - protein, 23 aa, Mycobacterium
ADRMPNIRLDWLTAENTATARAA

SEQ ID NO: 298248 - protein, 23 aa, Mycobacterium
ADRPGTGEPRLWILTEGVRDADS

SEQ ID NO: 298249 - protein, 17 aa, Mycobacterium
ADRPPAAAIGYALTGIF

SEQ ID NO: 298250 - protein, 19 aa, Mycobacterium
ADRQPGLMVILLSVAFVLL

SEQ ID NO: 298251 - protein, 27 aa, Mycobacterium
ADRRGKLILCAAVGVLSVVVRAIGTVL

SEQ ID NO: 298252 - protein, 22 aa, Mycobacterium
ADRRGRYGVFTLMGGGIAAVLS

SEQ ID NO: 298253 - protein, 21 aa, Mycobacterium
ADRRRLIVLGLLGFGVLSGVA

SEQ ID NO: 298254 - protein, 23 aa, Mycobacterium
ADRSRLGTIGVVYIAANLLATVL

SEQ ID NO: 298255 - protein, 18 aa, Mycobacterium
ADRSRPDRGPRETQDSTG

SEQ ID NO: 298256 - protein, 22 aa, Mycobacterium
ADRVLPPGGFIPASRTSPALDL

SEQ ID NO: 298257 - protein, 17 aa, Mycobacterium
ADRWNWVLDGMVDIGAL

SEQ ID NO: 298258 - protein, 23 aa, Mycobacterium
ADRWRAEGAIILHVVRDGAVVGG

SEQ ID NO: 298259 - protein, 21 aa, Mycobacterium
ADRWRRGALVVGIAVGIAAAL

SEQ ID NO: 298260 - protein, 21 aa, Mycobacterium
ADRYPRCADFAREFNARLDAG

SEQ ID NO: 298261 - protein, 18 aa, Mycobacterium
ADSAACRALAGALPERLG

SEQ ID NO: 298262 - protein, 23 aa, Mycobacterium
ADSAKKFVMWSAIAGVVVIVIYG

SEQ ID NO: 298263 - protein, 23 aa, Mycobacterium
ADSAKKWVIWSAVIGVVVGIIYG

SEQ ID NO: 298264 - protein, 24 aa, Mycobacterium
ADSFALRGPWSLDYQGATAESDES

SEQ ID NO: 298265 - protein, 18 aa, Mycobacterium
ADSGLRPRYPAVEIYRVD

SEQ ID NO: 298266 - protein, 20 aa, Mycobacterium
ADSGTPWVLYTVIGVSAAVI

SEQ ID NO: 298267 - protein, 21 aa, Mycobacterium
ADSLGLVFLCAAPVALLGFVV

SEQ ID NO: 298268 - protein, 25 aa, Mycobacterium
ADSRHIGSVLDWWSDPLTVPLGTGS

SEQ ID NO: 298269 - protein, 29 aa, Mycobacterium
ADSSAFMHWGWRIPFLLSAVLVVIALFVR

SEQ ID NO: 298270 - protein, 25 aa, Mycobacterium
ADSVLLQYPLEWPMSREAATNTLDF

SEQ ID NO: 298271 - protein, 23 aa, Mycobacterium
ADSYRLLNIVFILVVVFTLIQGP

SEQ ID NO: 298272 - protein, 19 aa, Mycobacterium
ADTAIAIKRAEVRRDAEIM

SEQ ID NO: 298273 - protein, 21 aa, Mycobacterium
ADTFTAVPVMLSRILDLPETV

SEQ ID NO: 298274 - protein, 20 aa, Mycobacterium
ADTFVSWLPLYHDMGLIGAW

SEQ ID NO: 298275 - protein, 20 aa, Mycobacterium
ADTGNEVFLLIGTRMSAKPA

SEQ ID NO: 298276 - protein, 18 aa, Mycobacterium
ADTHRLLPLFAIGVFIGF

SEQ ID NO: 298277 - protein, 23 aa, Mycobacterium
ADTKAPFLYTYEGVRVECAEPGE

SEQ ID NO: 298278 - protein, 26 aa, Mycobacterium
ADTLPLLSLTLAWLYRDYGSTGRLTL

SEQ ID NO: 298279 - protein, 26 aa, Mycobacterium
ADTLRKAGYRPALIVGDPDKISTEVL

SEQ ID NO: 298280 - protein, 21 aa, Mycobacterium
ADTPDGLYCKLPQDSPIAVRG

SEQ ID NO: 298281 - protein, 19 aa, Mycobacterium
ADTPRPAAMHEWHAMSVEQ

SEQ ID NO: 298282 - protein, 24 aa, Mycobacterium
ADTRVHAAVPFYGVYDFTRFDDAM

SEQ ID NO: 298283 - protein, 22 aa, Mycobacterium
ADTSHHWLPAFVKLNNLSDKFF

SEQ ID NO: 298284 - protein, 18 aa, Mycobacterium
ADTVARRPARVVVVSVAG

SEQ ID NO: 298285 - protein, 23 aa, Mycobacterium
ADTVGWRGIFLINVPIGLAVLAG

SEQ ID NO: 298286 - protein, 18 aa, Mycobacterium
ADTVLGAFIVVIGATALV

SEQ ID NO: 298287 - protein, 18 aa, Mycobacterium
ADVAFRPDGRRFVSSGNS

SEQ ID NO: 298288 - protein, 17 aa, Mycobacterium
ADVALGLAQVVIRPDTS

SEQ ID NO: 298289 - protein, 21 aa, Mycobacterium
ADVARPALLLPDSLRVTAALS

SEQ ID NO: 298290 - protein, 23 aa, Mycobacterium
ADVARRIEFGVGVVGSSGAGGVM

SEQ ID NO: 298291 - protein, 18 aa, Mycobacterium
ADVDAVKFTQVLRGYKTS

SEQ ID NO: 298292 - protein, 19 aa, Mycobacterium
ADVELTVAFPGVVTSTNGD

SEQ ID NO: 298293 - protein, 20 aa, Mycobacterium
ADVFNVRVAFLIAAAATFAL

SEQ ID NO: 298294 - protein, 21 aa, Mycobacterium
ADVGAVPAWRNLRAPLSAIPD

SEQ ID NO: 298295 - protein, 18 aa, Mycobacterium
ADVKPVWQSLRHADTWIL

SEQ ID NO: 298296 - protein, 17 aa, Mycobacterium
ADVKPVWQSLRHPDTWV

SEQ ID NO: 298297 - protein, 22 aa, Mycobacterium
ADVLERCKSWAALTDEQTQEFN

SEQ ID NO: 298298 - protein, 21 aa, Mycobacterium
ADVLIALAITGFGARSAAKKQ

SEQ ID NO: 298299 - protein, 20 aa, Mycobacterium
ADVLIALALANYGAKTSAKV

SEQ ID NO: 298300 - protein, 20 aa, Mycobacterium
ADVLIALALANYGANSSAKN

SEQ ID NO: 298301 - protein, 18 aa, Mycobacterium
ADVLLPDLGAAWRIMHAI

SEQ ID NO: 298302 - protein, 27 aa, Mycobacterium
ADVLRLRPAGPFFFIFAMGATATVPAG

SEQ ID NO: 298303 - protein, 22 aa, Mycobacterium
ADVPMFLGAMIMGPLGGWCMKK

SEQ ID NO: 298304 - protein, 25 aa, Mycobacterium
ADVPWRDCLHFLWAGASGGSVPAVD

SEQ ID NO: 298305 - protein, 20 aa, Mycobacterium
ADVQLAFPAILLALAVVAFL

SEQ ID NO: 298306 - protein, 25 aa, Mycobacterium
ADVRIAHPLISRAHLVLRFDQGRWI

SEQ ID NO: 298307 - protein, 35 aa, Mycobacterium
ADVRIAHPLISRAHLVLRFDQGRWVAIDNGSLNGM

SEQ ID NO: 298308 - protein, 32 aa, Mycobacterium
ADVRVADPLISRVHLLLRFDQGRWIAIDNGSL

SEQ ID NO: 298309 - protein, 17 aa, Mycobacterium
ADVSLSVAFPGEVTSTN

SEQ ID NO: 298310 - protein, 25 aa, Mycobacterium
ADWLVALCVLTSLALCIYALAPART

SEQ ID NO: 298311 - protein, 18 aa, Mycobacterium
ADYARMWIQAATTMSAYQ

SEQ ID NO: 298312 - protein, 19 aa, Mycobacterium
ADYARMWIQAATTMSAYQV

SEQ ID NO: 298313 - protein, 21 aa, Mycobacterium
ADYARMWVQAAGVMQLYQQQA

SEQ ID NO: 298314 - protein, 18 aa, Mycobacterium
ADYARMWVQAATVMSVYQ

SEQ ID NO: 298315 - protein, 23 aa, Mycobacterium
ADYIRMWIQAATVMSTYQAVSES

SEQ ID NO: 298316 - protein, 23 aa, Mycobacterium
ADYKVWIDGCRELIQNAAEAAHG

SEQ ID NO: 298317 - protein, 24 aa, Mycobacterium
ADYLFRAFWVVFGIVIPVVAAMSP

SEQ ID NO: 298318 - protein, 21 aa, Mycobacterium
ADYLPSDGFTTLNIVSTIGAF

SEQ ID NO: 298319 - protein, 26 aa, Mycobacterium
ADYLRSLVMKMWPQIKDIGGRRAEDG

SEQ ID NO: 298320 - protein, 18 aa, Mycobacterium
ADYPTVLLSGSWLTQEQT

SEQ ID NO: 298321 - protein, 23 aa, Mycobacterium
ADYPTVLLSGSWLTREQATAASE

SEQ ID NO: 298322 - protein, 21 aa, Mycobacterium
ADYRLGWFVIVGTIPIGVFGL

SEQ ID NO: 298323 - protein, 17 aa, Mycobacterium
ADYTVWIDGCRELIQNA

SEQ ID NO: 298324 - protein, 19 aa, Mycobacterium
ADYVRMWIQAAATMGTYAT

SEQ ID NO: 298325 - protein, 52 aa, Mycobacterium
AEAAAPRGRSWRWLRVLLAGLAKAAAVVIICGFAALSGIMVWQHHQTTQRHE

SEQ ID NO: 298326 - protein, 21 aa, Mycobacterium
AEAAFLGYIVYFGRRAAKAGE

SEQ ID NO: 298327 - protein, 19 aa, Mycobacterium
AEAAGRVAAGWNRVGAQVK

SEQ ID NO: 298328 - protein, 18 aa, Mycobacterium
AEAALGFDLAEPPTIARV

SEQ ID NO: 298329 - protein, 19 aa, Mycobacterium
AEAALKCPATQAVLNSVRA

SEQ ID NO: 298330 - protein, 20 aa, Mycobacterium
AEAAMMAAWEKAGGDTSPLG

SEQ ID NO: 298331 - protein, 27 aa, Mycobacterium
AEAARRTGIKVTRHLIAVYALAGTLAG

SEQ ID NO: 298332 - protein, 26 aa, Mycobacterium
AEAARTGARFTAKVAWLTVGAGVAFG

SEQ ID NO: 298333 - protein, 29 aa, Mycobacterium
AEADPAFGVIWLLWAVLWFMLFLLLGLGH

SEQ ID NO: 298334 - protein, 23 aa, Mycobacterium
AEAEAKAAEAARLADTASTSRDA

SEQ ID NO: 298335 - protein, 23 aa, Mycobacterium
AEAEALAAAAGARARALQLRRRA

SEQ ID NO: 298336 - protein, 19 aa, Mycobacterium
AEAEALAAAARARARAAQL

SEQ ID NO: 298337 - protein, 19 aa, Mycobacterium
AEAEALAAAARARARAARL

SEQ ID NO: 298338 - protein, 26 aa, Mycobacterium
AEAGMIGALADWFAVTALFKHPLGIP

SEQ ID NO: 298339 - protein, 24 aa, Mycobacterium
AEAGRKARGLFRRVARRGDSDGAG

SEQ ID NO: 298340 - protein, 20 aa, Mycobacterium
AEAIALIVVIVRYLEPFTTI

SEQ ID NO: 298341 - protein, 20 aa, Mycobacterium
AEALCWDVAEVVELRGRAAP

SEQ ID NO: 298342 - protein, 20 aa, Mycobacterium
AEALCWDVAEVVELRGRTAP

SEQ ID NO: 298343 - protein, 19 aa, Mycobacterium
AEALCWDVGEVVELRGRRA

SEQ ID NO: 298344 - protein, 19 aa, Mycobacterium
AEALCWDVGEVVELRGRTA

SEQ ID NO: 298345 - protein, 17 aa, Mycobacterium
AEALFLAYVLILGRRGV

SEQ ID NO: 298346 - protein, 31 aa, Mycobacterium
AEALGRIVGRGRPADRPALLGAVKTNVGHLE

SEQ ID NO: 298347 - protein, 19 aa, Mycobacterium
AEALPVRVGVAVLGAVVVF

SEQ ID NO: 298348 - protein, 21 aa, Mycobacterium
AEALRMQGLLLMRRNAERDYT

SEQ ID NO: 298349 - protein, 23 aa, Mycobacterium
AEALTGHMFLVMLGGGALAAALT

SEQ ID NO: 298350 - protein, 18 aa, Mycobacterium
AEAMAAAARARARAAKLR

SEQ ID NO: 298351 - protein, 17 aa, Mycobacterium
AEAMGLVVINGLLIVLL

SEQ ID NO: 298352 - protein, 21 aa, Mycobacterium
AEAMTALVIASRWLTEKTAAA

SEQ ID NO: 298353 - protein, 18 aa, Mycobacterium
AEANRVREAYVLQYAEIF

SEQ ID NO: 298354 - protein, 24 aa, Mycobacterium
AEAPDARGAVLVIHENKGLTDHIR

SEQ ID NO: 298355 - protein, 18 aa, Mycobacterium
AEARISWAERTRGDWDRQ

SEQ ID NO: 298356 - protein, 28 aa, Mycobacterium
AEARPVPARLRGWGPLAAAFVVSVLLGV

SEQ ID NO: 298357 - protein, 20 aa, Mycobacterium
AEATAAAWLVSALPSVVVGG

SEQ ID NO: 298358 - protein, 17 aa, Mycobacterium
AECGAGLTMPSADGMAH

SEQ ID NO: 298359 - protein, 22 aa, Mycobacterium
AECLPSYMVPAAVVSLAALPLT

SEQ ID NO: 298360 - protein, 19 aa, Mycobacterium
AECRRWIQCYSTVLRGRSE

SEQ ID NO: 298361 - protein, 18 aa, Mycobacterium
AEDAARVFERFYRTDSSR

SEQ ID NO: 298362 - protein, 18 aa, Mycobacterium
AEDIHFLEALPLDRARYV

SEQ ID NO: 298363 - protein, 18 aa, Mycobacterium
AEDLAGLFVIGMITMSAV

SEQ ID NO: 298364 - protein, 19 aa, Mycobacterium
AEDLAGLFVVSMIALSAAV

SEQ ID NO: 298365 - protein, 18 aa, Mycobacterium
AEDLKRYFAEGLHYWPWV

SEQ ID NO: 298366 - protein, 26 aa, Mycobacterium
AEDRDFYGNPGFSFSGLLRAVKNNMF

SEQ ID NO: 298367 - protein, 28 aa, Mycobacterium
AEDRDFYSNPGFSFTGFLRAFKNNIFGG

SEQ ID NO: 298368 - protein, 29 aa, Mycobacterium
AEDRDFYSNPGFSWTGFLRAIKNNLFGGG

SEQ ID NO: 298369 - protein, 17 aa, Mycobacterium
AEDRLSSLLLSPAEVNS

SEQ ID NO: 298370 - protein, 23 aa, Mycobacterium
AEDSRWLRTGDLGVYLNNNLYVT

SEQ ID NO: 298371 - protein, 23 aa, Mycobacterium
AEDTRKRRVVALKLISTQYSGNP

SEQ ID NO: 298372 - protein, 23 aa, Mycobacterium
AEDTRLPTVLFQTTVNKLRQILT

SEQ ID NO: 298373 - protein, 19 aa, Mycobacterium
AEEAVRCGIDLQRALRRDA

SEQ ID NO: 298374 - protein, 18 aa, Mycobacterium
AEEFQRFGDLLSEVTKFA

SEQ ID NO: 298375 - protein, 22 aa, Mycobacterium
AEEMFFRGALYTALGRFYPVLL

SEQ ID NO: 298376 - protein, 21 aa, Mycobacterium
AEEMFFRGAVYTSLLKFHPVI

SEQ ID NO: 298377 - protein, 26 aa, Mycobacterium
AEEPKRRRPMLLAGRSVAALAAVLAL

SEQ ID NO: 298378 - protein, 17 aa, Mycobacterium
AEEPLRPALPRRPDRPG

SEQ ID NO: 298379 - protein, 21 aa, Mycobacterium
AEESVAMTIGFAAHRPGDGRS

SEQ ID NO: 298380 - protein, 23 aa, Mycobacterium
AEFARLYPFQVFLDLYGLPLQDR

SEQ ID NO: 298381 - protein, 19 aa, Mycobacterium
AEFEPMHQVFLGARSLLYF

SEQ ID NO: 298382 - protein, 22 aa, Mycobacterium
AEFGLSGFIAVSGYAVARRGGA

SEQ ID NO: 298383 - protein, 17 aa, Mycobacterium
AEFPGPWALVPVGATIL

SEQ ID NO: 298384 - protein, 20 aa, Mycobacterium
AEFPGPWALVPVGATILLIL

SEQ ID NO: 298385 - protein, 17 aa, Mycobacterium
AEFVAGGLVGGVWLAFI

SEQ ID NO: 298386 - protein, 25 aa, Mycobacterium
AEFYRLSSVRLWPDRQLSRRDLEII

SEQ ID NO: 298387 - protein, 21 aa, Mycobacterium
AEGDHSFLYAFLAAGLIGLYQ

SEQ ID NO: 298388 - protein, 21 aa, Mycobacterium
AEGDWAAAIRHRLRAVARQLE

SEQ ID NO: 298389 - protein, 24 aa, Mycobacterium
AEGELLRRIRLITAERRYLRMRLS

SEQ ID NO: 298390 - protein, 17 aa, Mycobacterium
AEGFTGYSLPDDLLSGT

SEQ ID NO: 298391 - protein, 27 aa, Mycobacterium
AEGGAGFPAAAWEFARAAAAELTGDPL

SEQ ID NO: 298392 - protein, 20 aa, Mycobacterium
AEGLPLFSLGRFGIVVNVLA

SEQ ID NO: 298393 - protein, 26 aa, Mycobacterium
AEGLRSRLWPTPALGVVMAIAVGLAL

SEQ ID NO: 298394 - protein, 25 aa, Mycobacterium
AEGMKAELWTSGWTPRYKGETIYLA

SEQ ID NO: 298395 - protein, 25 aa, Mycobacterium
AEGMKAVLWTSGWTPRFEGETIFLA

SEQ ID NO: 298396 - protein, 26 aa, Mycobacterium
AEGRATGSYFRMILPAGDASGPYLAN

SEQ ID NO: 298397 - protein, 17 aa, Mycobacterium
AEGSFWDLVVFRVDHLL

SEQ ID NO: 298398 - protein, 24 aa, Mycobacterium
AEGSLHLWLNLTLLAGVALVVVGA

SEQ ID NO: 298399 - protein, 19 aa, Mycobacterium
AEGTWPIWHGAGWFLLALS

SEQ ID NO: 298400 - protein, 18 aa, Mycobacterium
AEGYRSARVQSWLNPTAD

SEQ ID NO: 298401 - protein, 24 aa, Mycobacterium
AEHAKAGGTVEIWVDAHGNPVVPP

SEQ ID NO: 298402 - protein, 18 aa, Mycobacterium
AEHARTLLRRLLVAAVLF

SEQ ID NO: 298403 - protein, 25 aa, Mycobacterium
AEHGKVVGIALVFLVARSFSSGCAA

SEQ ID NO: 298404 - protein, 24 aa, Mycobacterium
AEHIGFSIWSIWSVMVLFMPEAVY

SEQ ID NO: 298405 - protein, 17 aa, Mycobacterium
AEHPGRMVLIDSDGSLD

SEQ ID NO: 298406 - protein, 29 aa, Mycobacterium
AEHPPGGFPRPEVFDALETEPTPWYRKPP

SEQ ID NO: 298407 - protein, 37 aa, Mycobacterium
AEHPPRPFIPRMIRTFAVPLILGWVLLIAVLNSVVPQ

SEQ ID NO: 298408 - protein, 23 aa, Mycobacterium
AEHPRLRVHWVARRDDRSLAAAI

SEQ ID NO: 298409 - protein, 23 aa, Mycobacterium
AEHPRMRVHWVVREDATSLAGAI

SEQ ID NO: 298410 - protein, 17 aa, Mycobacterium
AEHPRRQWWAFLRRGRD

SEQ ID NO: 298411 - protein, 21 aa, Mycobacterium
AEHRPSLGLLFPASACAVSAV

SEQ ID NO: 298412 - protein, 27 aa, Mycobacterium
AEHRRELPALFLLASLVAVVFAGGVFP

SEQ ID NO: 298413 - protein, 19 aa, Mycobacterium
AEHSRRRLVAFVSHDLRTP

SEQ ID NO: 298414 - protein, 27 aa, Mycobacterium
AEHVKFARDFMRIEIGIVSVVLVVCIG

SEQ ID NO: 298415 - protein, 23 aa, Mycobacterium
AEHWPQGRLSKAYAAYSTPFWRA

SEQ ID NO: 298416 - protein, 21 aa, Mycobacterium
AEIAPALAILGRPFKLVRIPV

SEQ ID NO: 298417 - protein, 22 aa, Mycobacterium
AEIDGRPVLVGRRKLIVEHDLL

SEQ ID NO: 298418 - protein, 17 aa, Mycobacterium
AEIGSLVRTLAAEGAER

SEQ ID NO: 298419 - protein, 20 aa, Mycobacterium
AEIGVPIFFVLSGFLLFRPW

SEQ ID NO: 298420 - protein, 18 aa, Mycobacterium
AEIIGALVVGGWLLIAHR

SEQ ID NO: 298421 - protein, 17 aa, Mycobacterium
AEILERWEHILFPIVLI

SEQ ID NO: 298422 - protein, 20 aa, Mycobacterium
AEILITAGFFFGRDISDNGP

SEQ ID NO: 298423 - protein, 20 aa, Mycobacterium
AEILITAGFFFGREIPAGAA

SEQ ID NO: 298424 - protein, 24 aa, Mycobacterium
AEIQANALLAFGLKADYASKAADV

SEQ ID NO: 298425 - protein, 20 aa, Mycobacterium
AEISMGGFPVALRDTRDYYQ

SEQ ID NO: 298426 - protein, 25 aa, Mycobacterium
AEITDLSRRVAFGAVLSAPVLYAVM

SEQ ID NO: 298427 - protein, 21 aa, Mycobacterium
AEIVLAVANLMWFVFAGLGAL

SEQ ID NO: 298428 - protein, 26 aa, Mycobacterium
AEIWVSLDSAGSWLFGIYGAAAALAL

SEQ ID NO: 298429 - protein, 22 aa, Mycobacterium
AEKHLPSWLRPGAPESRIPVLI

SEQ ID NO: 298430 - protein, 20 aa, Mycobacterium
AEKLGALLTQPGRTYDVSSP

SEQ ID NO: 298431 - protein, 23 aa, Mycobacterium
AEKRRREGFRWGQIATASLVALS

SEQ ID NO: 298432 - protein, 17 aa, Mycobacterium
AEKVCAELGLASKGTIT

SEQ ID NO: 298433 - protein, 25 aa, Mycobacterium
AELAAMAALLHWARAVPPVVAVAAA

SEQ ID NO: 298434 - protein, 18 aa, Mycobacterium
AELAGAGFEDARQVARGG

SEQ ID NO: 298435 - protein, 19 aa, Mycobacterium
AELARTGWADGIHAVASVS

SEQ ID NO: 298436 - protein, 24 aa, Mycobacterium
AELDRLKLASLISEAEYGDKRTEI

SEQ ID NO: 298437 - protein, 27 aa, Mycobacterium
AELDRPWQLAIGNRCRAMLLSATGDLD

SEQ ID NO: 298438 - protein, 24 aa, Mycobacterium
AELDVKFAALVKDQAEWVTHGRLG

SEQ ID NO: 298439 - protein, 19 aa, Mycobacterium
AELEGHLRGPLSNLINAIQ

SEQ ID NO: 298440 - protein, 27 aa, Mycobacterium
AELEPTWSRPGWRHLKHFNGYATSFWV

SEQ ID NO: 298441 - protein, 17 aa, Mycobacterium
AELERATRLAASLEERE

SEQ ID NO: 298442 - protein, 22 aa, Mycobacterium
AELGIILALLMGWQFTAAEFVG

SEQ ID NO: 298443 - protein, 19 aa, Mycobacterium
AELGLDMAAFDAAYNDPAT

SEQ ID NO: 298444 - protein, 19 aa, Mycobacterium
AELHSTVLTFENLKEVTDE

SEQ ID NO: 298445 - protein, 21 aa, Mycobacterium
AELIAKLGAPVPAHPAHHHSA

SEQ ID NO: 298446 - protein, 21 aa, Mycobacterium
AELIGALVVGVWLLVMHRHHG

SEQ ID NO: 298447 - protein, 23 aa, Mycobacterium
AELKRRDVAGFGDRVRRRVADIV

SEQ ID NO: 298448 - protein, 20 aa, Mycobacterium
AELLALFAGSVLRGADLTAL

SEQ ID NO: 298449 - protein, 18 aa, Mycobacterium
AELLARWQSETEILISRA

SEQ ID NO: 298450 - protein, 23 aa, Mycobacterium
AELLDSCSAYREFADSQSVSAGD

SEQ ID NO: 298451 - protein, 25 aa, Mycobacterium
AELLEGIEIIPPRYIEYRGGRFPEL

SEQ ID NO: 298452 - protein, 17 aa, Mycobacterium
AELLGGVTAGAWEGPSA

SEQ ID NO: 298453 - protein, 18 aa, Mycobacterium
AELLLRVQDKFGVTLPPH

SEQ ID NO: 298454 - protein, 20 aa, Mycobacterium
AELLQKFNAGLAQLKESGRY

SEQ ID NO: 298455 - protein, 20 aa, Mycobacterium
AELLRALGIADPRELDVDRL

SEQ ID NO: 298456 - protein, 20 aa, Mycobacterium
AELLRALGISDPRELDVDRL

SEQ ID NO: 298457 - protein, 23 aa, Mycobacterium
AELMPAHDSMLFAVPDAVPDEAA

SEQ ID NO: 298458 - protein, 22 aa, Mycobacterium
AELMPAHDSMLFPVPGPISDEA

SEQ ID NO: 298459 - protein, 18 aa, Mycobacterium
AELPAVVADATYAAATDK

SEQ ID NO: 298460 - protein, 24 aa, Mycobacterium
AELPEYRIIPNFKQMVVSSNQWQS

SEQ ID NO: 298461 - protein, 21 aa, Mycobacterium
AELPLREILPAVQRLVIPAAE

SEQ ID NO: 298462 - protein, 21 aa, Mycobacterium
AELPLREILPAVQRLVIPVAE

SEQ ID NO: 298463 - protein, 21 aa, Mycobacterium
AELPLREILPAVQRLVVPATA

SEQ ID NO: 298464 - protein, 24 aa, Mycobacterium
AELPRWRARVAGMDGRRIDQIELT

SEQ ID NO: 298465 - protein, 19 aa, Mycobacterium
AELPVAVVMIRGALLITRL

SEQ ID NO: 298466 - protein, 17 aa, Mycobacterium
AELRLPPDTTKEDREQV

SEQ ID NO: 298467 - protein, 23 aa, Mycobacterium
AELRPEDKAHLIAELGAHRPTAM

SEQ ID NO: 298468 - protein, 24 aa, Mycobacterium
AELRRDRTSFIIAHRLSTIRDADL

SEQ ID NO: 298469 - protein, 25 aa, Mycobacterium
AELRRDRTSFIIAHRLSTIRDADRI

SEQ ID NO: 298470 - protein, 18 aa, Mycobacterium
AELSAPLIEVHISNVHAR

SEQ ID NO: 298471 - protein, 24 aa, Mycobacterium
AELSLQPGIFAVHWYAGEQTNPML

SEQ ID NO: 298472 - protein, 22 aa, Mycobacterium
AELVAAYALWSQRHWAFVLTYY

SEQ ID NO: 298473 - protein, 21 aa, Mycobacterium
AELVISLLFLVGGVPGLLLVD

SEQ ID NO: 298474 - protein, 22 aa, Mycobacterium
AELYSAAKIRGFLHLYVGEEAV

SEQ ID NO: 298475 - protein, 17 aa, Mycobacterium
AELYVRHVADTKVAEAV

SEQ ID NO: 298476 - protein, 18 aa, Mycobacterium
AEMARQFLARAGQLDPHI

SEQ ID NO: 298477 - protein, 17 aa, Mycobacterium
AEMIGALAAQGKCEVMA

SEQ ID NO: 298478 - protein, 24 aa, Mycobacterium
AEMNFQDLNAWKVRLVKGTSPELK

SEQ ID NO: 298479 - protein, 18 aa, Mycobacterium
AENGMGPHGLCIGATGSG

SEQ ID NO: 298480 - protein, 20 aa, Mycobacterium
AENRLGAGIDPTWLTAERER

SEQ ID NO: 298481 - protein, 22 aa, Mycobacterium
AEPDCGTTFTWASRAFGPVTGW

SEQ ID NO: 298482 - protein, 23 aa, Mycobacterium
AEPDCGTTFTWASRTFGPIVGWL

SEQ ID NO: 298483 - protein, 24 aa, Mycobacterium
AEPEVKGLGIAGGAKRPGAKKAAP

SEQ ID NO: 298484 - protein, 17 aa, Mycobacterium
AEPGRWGDVDPVSVAVA

SEQ ID NO: 298485 - protein, 17 aa, Mycobacterium
AEPKLGQPVQWTPCRSS

SEQ ID NO: 298486 - protein, 27 aa, Mycobacterium
AEPLLKRTWGPEGLRIAQAVDDVQADL

SEQ ID NO: 298487 - protein, 18 aa, Mycobacterium
AEPLRANTFARFRQRFAG

SEQ ID NO: 298488 - protein, 21 aa, Mycobacterium
AEPPLRLATQITDQAGALSAS

SEQ ID NO: 298489 - protein, 18 aa, Mycobacterium
AEPQWGPPVGRMLQTVLS

SEQ ID NO: 298490 - protein, 25 aa, Mycobacterium
AEPRHLNELRWRRTGARIIRHAGAL

SEQ ID NO: 298491 - protein, 21 aa, Mycobacterium
AEPSSRLGLGRWLIQPLVCVA

SEQ ID NO: 298492 - protein, 21 aa, Mycobacterium
AEPSTWVFVVFYGLDWVATVP

SEQ ID NO: 298493 - protein, 27 aa, Mycobacterium
AEPTRRPSLWKVLAVLCTGIAIVGGVL

SEQ ID NO: 298494 - protein, 23 aa, Mycobacterium
AEQALACARRLARYRAEAASARR

SEQ ID NO: 298495 - protein, 22 aa, Mycobacterium
AEQFGWRGPFWTWIGGLDLNAV

SEQ ID NO: 298496 - protein, 19 aa, Mycobacterium
AEQGLRVLAVAQRPWVHDT

SEQ ID NO: 298497 - protein, 28 aa, Mycobacterium
AEQGPLPWYKRTALVLSVAGAAAAVLVA

SEQ ID NO: 298498 - protein, 24 aa, Mycobacterium
AEQIRPGLWDALPTAGRQAVQARI

SEQ ID NO: 298499 - protein, 24 aa, Mycobacterium
AEQQLSGALGRFFAVAESYPQLQS

SEQ ID NO: 298500 - protein, 17 aa, Mycobacterium
AEQRLAALHHDFSAAAL

SEQ ID NO: 298501 - protein, 19 aa, Mycobacterium
AEQVMPMLVIATMTQIVFS

SEQ ID NO: 298502 - protein, 18 aa, Mycobacterium
AEQWRSFADTSLQPLPKG

SEQ ID NO: 298503 - protein, 31 aa, Mycobacterium
AERAARPVIQFLRMISPLSWTPIAVAVFGIG

SEQ ID NO: 298504 - protein, 21 aa, Mycobacterium
AERAPFKFFDKGSMATVSRYS

SEQ ID NO: 298505 - protein, 24 aa, Mycobacterium
AERDGRRLVAVLMRGTRQPIAPWE

SEQ ID NO: 298506 - protein, 26 aa, Mycobacterium
AERDGRRLVVTMLRGTRLPIAPWEQA

SEQ ID NO: 298507 - protein, 17 aa, Mycobacterium
AERELVFERFFRSTTAR

SEQ ID NO: 298508 - protein, 19 aa, Mycobacterium
AERERKRRQYTIIGSAVGG

SEQ ID NO: 298509 - protein, 24 aa, Mycobacterium
AERESGVLTRLWVQPVHRASTVAG

SEQ ID NO: 298510 - protein, 19 aa, Mycobacterium
AERGARLGIPAAPEQIPTP

SEQ ID NO: 298511 - protein, 23 aa, Mycobacterium
AERGRLTRRSMLGGIAAAGMGVA

SEQ ID NO: 298512 - protein, 22 aa, Mycobacterium
AERGVAVWLLLGGAFGLALLLV

SEQ ID NO: 298513 - protein, 22 aa, Mycobacterium
AERGWAFVFDELFQPRTAALVG

SEQ ID NO: 298514 - protein, 26 aa, Mycobacterium
AERIVICSGFTQGLRLVCDALAAQGA

SEQ ID NO: 298515 - protein, 22 aa, Mycobacterium
AERLPGYMVPAAVVGLAALPMT

SEQ ID NO: 298516 - protein, 19 aa, Mycobacterium
AERLRLAIASTSWGITASV

SEQ ID NO: 298517 - protein, 31 aa, Mycobacterium
AERLYAVAIIYLRRIASWFAEHWPGEEMPPP

SEQ ID NO: 298518 - protein, 19 aa, Mycobacterium
AERMARFRLAEAYEAIEVD

SEQ ID NO: 298519 - protein, 17 aa, Mycobacterium
AERPVHPVTVWRGRLAI

SEQ ID NO: 298520 - protein, 17 aa, Mycobacterium
AERPVHPVTVWRGRLSI

SEQ ID NO: 298521 - protein, 22 aa, Mycobacterium
AERRCTYAYIAPPVAVALAKHP

SEQ ID NO: 298522 - protein, 20 aa, Mycobacterium
AERRRSRRALAAVGSVAATL

SEQ ID NO: 298523 - protein, 29 aa, Mycobacterium
AERRTWLRRVWLAWPFGLLSAGLTMMAAP

SEQ ID NO: 298524 - protein, 23 aa, Mycobacterium
AERVPPRPSRAAGVGATQWVGFS

SEQ ID NO: 298525 - protein, 26 aa, Mycobacterium
AERWLERFSWIALVVAIVFGLIAAFA

SEQ ID NO: 298526 - protein, 21 aa, Mycobacterium
AERYRYPVNLPKVAATGGPQC

SEQ ID NO: 298527 - protein, 24 aa, Mycobacterium
AESAARPTPPRALGRPPAAPGKSA

SEQ ID NO: 298528 - protein, 23 aa, Mycobacterium
AESEARGAMELLGGYRRELAFYR

SEQ ID NO: 298529 - protein, 20 aa, Mycobacterium
AESFDLVGVLLLSPGLATFL

SEQ ID NO: 298530 - protein, 17 aa, Mycobacterium
AESIPASGRTAVLGAMA

SEQ ID NO: 298531 - protein, 21 aa, Mycobacterium
AESLGAGSVRVVRTVTLPLLM

SEQ ID NO: 298532 - protein, 22 aa, Mycobacterium
AESLPAALVPRLVKLDELPTRT

SEQ ID NO: 298533 - protein, 22 aa, Mycobacterium
AESLQASGFEWAMLEAIASQRM

SEQ ID NO: 298534 - protein, 17 aa, Mycobacterium
AESRAAARAWHYHEPLL

SEQ ID NO: 298535 - protein, 24 aa, Mycobacterium
AESSLHLWLNLTLVAGVALVVLGV

SEQ ID NO: 298536 - protein, 22 aa, Mycobacterium
AESSMHLWLNYTLLAGVGLVVI

SEQ ID NO: 298537 - protein, 19 aa, Mycobacterium
AESVRRAGDLVRSHVADPS

SEQ ID NO: 298538 - protein, 19 aa, Mycobacterium
AETALPWVRIASLAVPAIL

SEQ ID NO: 298539 - protein, 21 aa, Mycobacterium
AETAWPLAGLVTGVAVAAALS

SEQ ID NO: 298540 - protein, 17 aa, Mycobacterium
AETLAITLFEKVQGPLS

SEQ ID NO: 298541 - protein, 17 aa, Mycobacterium
AETMLDVINELRAAGAE

SEQ ID NO: 298542 - protein, 17 aa, Mycobacterium
AETRNREAIALKLSSQG

SEQ ID NO: 298543 - protein, 19 aa, Mycobacterium
AEVAAIPLVAVVLFFVFGT

SEQ ID NO: 298544 - protein, 17 aa, Mycobacterium
AEVARYIARAVAQCGRA

SEQ ID NO: 298545 - protein, 20 aa, Mycobacterium
AEVDGQVVLVGRRKLVDEND

SEQ ID NO: 298546 - protein, 21 aa, Mycobacterium
AEVERIWLPFTIWLTAATALL

SEQ ID NO: 298547 - protein, 20 aa, Mycobacterium
AEVERIWLPFTVWLTAAPAL

SEQ ID NO: 298548 - protein, 23 aa, Mycobacterium
AEVFGWRSLRAEQLKAMSAILDG

SEQ ID NO: 298549 - protein, 21 aa, Mycobacterium
AEVGESLRAALTLETDGVFVD

SEQ ID NO: 298550 - protein, 21 aa, Mycobacterium
AEVIARSGKRPAPKASRHASI

SEQ ID NO: 298551 - protein, 27 aa, Mycobacterium
AEVIKYLWPVRRMRAAEVGTWSLVAGG

SEQ ID NO: 298552 - protein, 21 aa, Mycobacterium
AEVILGILLLIGWKPSLVGAV

SEQ ID NO: 298553 - protein, 20 aa, Mycobacterium
AEVLPLWRELVTRPSRRVID

SEQ ID NO: 298554 - protein, 19 aa, Mycobacterium
AEVPVLRHVVFDAECGGAA

SEQ ID NO: 298555 - protein, 21 aa, Mycobacterium
AEVRAAIRFAVLAAAAGVGFV

SEQ ID NO: 298556 - protein, 17 aa, Mycobacterium
AEVRDGWDTRLDRSVAV

SEQ ID NO: 298557 - protein, 18 aa, Mycobacterium
AEVRELFDTAVLHRLPVT

SEQ ID NO: 298558 - protein, 18 aa, Mycobacterium
AEVRGWTASIAILSFITG

SEQ ID NO: 298559 - protein, 18 aa, Mycobacterium
AEVRREAEIMWAEHQLTQ

SEQ ID NO: 298560 - protein, 17 aa, Mycobacterium
AEVSRIAQWYRIPPEIV

SEQ ID NO: 298561 - protein, 17 aa, Mycobacterium
AEVTALIQLYIVGVFVS

SEQ ID NO: 298562 - protein, 27 aa, Mycobacterium
AEVTSRIRLWLPYLPLVLAAAIGLGHL

SEQ ID NO: 298563 - protein, 24 aa, Mycobacterium
AEVWPAKTRAIGVGGVIFSLFSLG

SEQ ID NO: 298564 - protein, 19 aa, Mycobacterium
AEWARAVVNRALLDGAAIA

SEQ ID NO: 298565 - protein, 17 aa, Mycobacterium
AEWKGDLTAGLQDAAEH

SEQ ID NO: 298566 - protein, 24 aa, Mycobacterium
AEWSGEAVDRVWLRGTVLLVTAMG

SEQ ID NO: 298567 - protein, 28 aa, Mycobacterium
AEWVTHGRLGIAILKNLLLAAFAVEMAL

SEQ ID NO: 298568 - protein, 17 aa, Mycobacterium
AEYGDRVNFVLRYFPLP

SEQ ID NO: 298569 - protein, 17 aa, Mycobacterium
AEYGLYVGIGSAVCAVA

SEQ ID NO: 298570 - protein, 26 aa, Mycobacterium
AEYRFEKAWPLLWFVVIGVVAAAIGY

SEQ ID NO: 298571 - protein, 30 aa, Mycobacterium
AFAATYAGWAWLDPRSFRDWVTEPVRRRWL

SEQ ID NO: 298572 - protein, 22 aa, Mycobacterium
AFACIWYFRRELFTDAHNIVFK

SEQ ID NO: 298573 - protein, 19 aa, Mycobacterium
AFACVWYFRAELFQNAHNL

SEQ ID NO: 298574 - protein, 17 aa, Mycobacterium
AFAGISVNTDWYNTALG

SEQ ID NO: 298575 - protein, 32 aa, Mycobacterium
AFAGPSVGLGLFFAFWCWMGFESTALYGEESK

SEQ ID NO: 298576 - protein, 28 aa, Mycobacterium
AFAGPWIFLRIRFFRRKLIAVQLAATPA

SEQ ID NO: 298577 - protein, 25 aa, Mycobacterium
AFALAGGWRRATAVLTVLSAVAVLG

SEQ ID NO: 298578 - protein, 20 aa, Mycobacterium
AFALLPAVFVVFGIVGWIIA

SEQ ID NO: 298579 - protein, 20 aa, Mycobacterium
AFAPMPFAGVTAAHPDLDSC

SEQ ID NO: 298580 - protein, 24 aa, Mycobacterium
AFAPQTRSSRSFDLQFRDNQWKIC

SEQ ID NO: 298581 - protein, 25 aa, Mycobacterium
AFAQFAILCRRYVAVIAADRQYAVF

SEQ ID NO: 298582 - protein, 25 aa, Mycobacterium
AFARAEQALRCAIDIQDALHREAKR

SEQ ID NO: 298583 - protein, 21 aa, Mycobacterium
AFARLCAEPVIGRAIAFEEGR

SEQ ID NO: 298584 - protein, 21 aa, Mycobacterium
AFASLWCIYAATLSVLALVHM

SEQ ID NO: 298585 - protein, 18 aa, Mycobacterium
AFAVARGAAIAAAPATVL

SEQ ID NO: 298586 - protein, 17 aa, Mycobacterium
AFCSFPQVMGHEVVADV

SEQ ID NO: 298587 - protein, 18 aa, Mycobacterium
AFCSFPQVMGHEVVADVV

SEQ ID NO: 298588 - protein, 17 aa, Mycobacterium
AFDLFVGAIQAFIFAIL

SEQ ID NO: 298589 - protein, 17 aa, Mycobacterium
AFDLFVGAIQAFIFSIL

SEQ ID NO: 298590 - protein, 18 aa, Mycobacterium
AFDLLMGMVRWRYRVAVY

SEQ ID NO: 298591 - protein, 19 aa, Mycobacterium
AFDNPDFQRGLTLFLSPDG

SEQ ID NO: 298592 - protein, 26 aa, Mycobacterium
AFDQLRLAPWQIGYAVVYPAACVAAL

SEQ ID NO: 298593 - protein, 19 aa, Mycobacterium
AFELACYAAVAAIGKAGLA

SEQ ID NO: 298594 - protein, 26 aa, Mycobacterium
AFELPFYRLLLSYLFVAIFLAFVANV

SEQ ID NO: 298595 - protein, 17 aa, Mycobacterium
AFELWLFQAGLPPSGSK

SEQ ID NO: 298596 - protein, 28 aa, Mycobacterium
AFESYGWRIPFLLALPLAVFGVWIRAKT

SEQ ID NO: 298597 - protein, 24 aa, Mycobacterium
AFEYLKITYGWSLMMVVVFAVLLF

SEQ ID NO: 298598 - protein, 29 aa, Mycobacterium
AFFGGPRWVWLRYITLWAGLTVGAVLGAA

SEQ ID NO: 298599 - protein, 19 aa, Mycobacterium
AFFIPIYFAIVGLKLDLIR

SEQ ID NO: 298600 - protein, 24 aa, Mycobacterium
AFFIYFGIPATMGFQMSAVTAGII

SEQ ID NO: 298601 - protein, 19 aa, Mycobacterium
AFFPLSLVPLGSLVWVALN

SEQ ID NO: 298602 - protein, 17 aa, Mycobacterium
AFFPRLEEAIDYCDKFP

SEQ ID NO: 298603 - protein, 17 aa, Mycobacterium
AFFSHPIIAFILFVASP

SEQ ID NO: 298604 - protein, 23 aa, Mycobacterium
AFFSRPAGAIVFGHFGDRIGRKK

SEQ ID NO: 298605 - protein, 20 aa, Mycobacterium
AFFWTWPAVFVGQFLVALCF

SEQ ID NO: 298606 - protein, 33 aa, Mycobacterium
AFGALGVAGLVEWPVLLAVGGSALLLQRLSRKQ

SEQ ID NO: 298607 - protein, 17 aa, Mycobacterium
AFGCTQAGLAMAFAAVL

SEQ ID NO: 298608 - protein, 17 aa, Mycobacterium
AFGEFCPHLAAPMADGW

SEQ ID NO: 298609 - protein, 21 aa, Mycobacterium
AFGGFIVPLAYAWSKSEFGSI

SEQ ID NO: 298610 - protein, 21 aa, Mycobacterium
AFGGFLVPLAYAWSKAQFGNI

SEQ ID NO: 298611 - protein, 24 aa, Mycobacterium
AFGGPGALFWMWMVAFLGASTSFV

SEQ ID NO: 298612 - protein, 22 aa, Mycobacterium
AFGGSFPAPIDVAASPPNPNGL

SEQ ID NO: 298613 - protein, 18 aa, Mycobacterium
AFGGSRFGGNVGPVGSQY

SEQ ID NO: 298614 - protein, 18 aa, Mycobacterium
AFGGWLVVVWLLFDFMTG

SEQ ID NO: 298615 - protein, 23 aa, Mycobacterium
AFGICLGCQLYPLVARLRGAART

SEQ ID NO: 298616 - protein, 23 aa, Mycobacterium
AFGICLGCQLYPLVARLRGGARP

SEQ ID NO: 298617 - protein, 17 aa, Mycobacterium
AFGLSVLIWQHLVGLEL

SEQ ID NO: 298618 - protein, 27 aa, Mycobacterium
AFGPLILLSLFWRRLTSAGAIAGMIAG

SEQ ID NO: 298619 - protein, 25 aa, Mycobacterium
AFGQMAVLAVGGWMAAQGTITVGTF

SEQ ID NO: 298620 - protein, 18 aa, Mycobacterium
AFGRKGLPHPSTRVEEMH

SEQ ID NO: 298621 - protein, 25 aa, Mycobacterium
AFGRSEALLQLSWVLGGAIGVMIYT

SEQ ID NO: 298622 - protein, 26 aa, Mycobacterium
AFGSARAVAGLGWLRRNTRTIQILGG

SEQ ID NO: 298623 - protein, 18 aa, Mycobacterium
AFGSYFVYKGAWRKFYGD

SEQ ID NO: 298624 - protein, 21 aa, Mycobacterium
AFGTCLSRLASVVVAVLTGRR

SEQ ID NO: 298625 - protein, 18 aa, Mycobacterium
AFGTYLMRQFFRTLPADL

SEQ ID NO: 298626 - protein, 18 aa, Mycobacterium
AFGVVELAVFGLVLFLLA

SEQ ID NO: 298627 - protein, 18 aa, Mycobacterium
AFHFQRMRLGEQWGSRVR

SEQ ID NO: 298628 - protein, 20 aa, Mycobacterium
AFIGGSLWVLALGTALIGGL

SEQ ID NO: 298629 - protein, 17 aa, Mycobacterium
AFINVRIAAPIVAGIGL

SEQ ID NO: 298630 - protein, 17 aa, Mycobacterium
AFINVRIAAPVVAGIGL

SEQ ID NO: 298631 - protein, 19 aa, Mycobacterium
AFITMTLSLVWPVTAMGFL

SEQ ID NO: 298632 - protein, 26 aa, Mycobacterium
AFIVGMSVMLIWGFVQIYVLGTPLRA

SEQ ID NO: 298633 - protein, 24 aa, Mycobacterium
AFLADASGFDAEFFGISAREAQTM

SEQ ID NO: 298634 - protein, 21 aa, Mycobacterium
AFLCKTLEGLLVAPALLLAYL

SEQ ID NO: 298635 - protein, 22 aa, Mycobacterium
AFLFAPAGIVFGHLSLSQIKRT

SEQ ID NO: 298636 - protein, 25 aa, Mycobacterium
AFLFLVAACAYVFRRPLGPRLRTLF

SEQ ID NO: 298637 - protein, 25 aa, Mycobacterium
AFLGAFLMLWDWFAVRAHAFAASAM

SEQ ID NO: 298638 - protein, 18 aa, Mycobacterium
AFLLGVVMALQFGPTLLL

SEQ ID NO: 298639 - protein, 21 aa, Mycobacterium
AFLLRPGWIALALVVIAFTYL

SEQ ID NO: 298640 - protein, 19 aa, Mycobacterium
AFLLWRAIPALARNKENFL

SEQ ID NO: 298641 - protein, 31 aa, Mycobacterium
AFLPIPSLRCWTRFERLQAVVLPFVICSYIT

SEQ ID NO: 298642 - protein, 20 aa, Mycobacterium
AFLQRPARWMQLTASNSSVF

SEQ ID NO: 298643 - protein, 31 aa, Mycobacterium; identical to SEQ ID NO: 15020

SEQ ID NO: 298644 - protein, 23 aa, Mycobacterium
AFLSHPITAFILFVASPYIVYFT

SEQ ID NO: 298645 - protein, 19 aa, Mycobacterium
AFLVPYGWTVLVWGTVSDR

SEQ ID NO: 298646 - protein, 18 aa, Mycobacterium
AFLVRPLLVPAFMQLMGR

SEQ ID NO: 298647 - protein, 18 aa, Mycobacterium
AFLYLVLGGMGVWAKLNS

SEQ ID NO: 298648 - protein, 18 aa, Mycobacterium
AFLYLVLGGMGVWSKLNS

SEQ ID NO: 298649 - protein, 29 aa, Mycobacterium
AFMHVMGRWNWWAPRPLAWLHDRFGISEA

SEQ ID NO: 298650 - protein, 29 aa, Mycobacterium
AFMHVMGRWNWWAPRPLAWLHDRFGISEG

SEQ ID NO: 298651 - protein, 20 aa, Mycobacterium
AFMIGMYLMLGWGLFQIYVL

SEQ ID NO: 298652 - protein, 23 aa, Mycobacterium
AFNQIRLTAWQAGYAVAYPALSI

SEQ ID NO: 298653 - protein, 19 aa, Mycobacterium
AFPAPWVYYHYRVRKPAVW

SEQ ID NO: 298654 - protein, 22 aa, Mycobacterium
AFPDGYTLAWWVQAFSEPRVVS

SEQ ID NO: 298655 - protein, 18 aa, Mycobacterium
AFPDPGMKARAIAGWMAI

SEQ ID NO: 298656 - protein, 22 aa, Mycobacterium
AFPEGTTWCGLASGSFYPAMFQ

SEQ ID NO: 298657 - protein, 23 aa, Mycobacterium
AFPEGTTWCGLASGSFYPAMFQA

SEQ ID NO: 298658 - protein, 23 aa, Mycobacterium
AFPEGTTWCGLGYGRFRPAMFQA

SEQ ID NO: 298659 - protein, 21 aa, Mycobacterium
AFPGLALLGWVLTRTATTKAG

SEQ ID NO: 298660 - protein, 26 aa, Mycobacterium
AFPLIALLRQDWRGLAVVIGIALGCT

SEQ ID NO: 298661 - protein, 25 aa, Mycobacterium
AFPPERRGAAATVWAAAAGFGNLVG

SEQ ID NO: 298662 - protein, 18 aa, Mycobacterium
AFPQRFSAVSSRFQVPLF

SEQ ID NO: 298663 - protein, 22 aa, Mycobacterium
AFPRLGLGLTYLVVLTALGLAY

SEQ ID NO: 298664 - protein, 24 aa, Mycobacterium
AFPTTARIAHKFTRRGRKHASGIW

SEQ ID NO: 298665 - protein, 32 aa, Mycobacterium
AFPVFEWIIHVAILHWRPRSVGRFVVDPLLAR

SEQ ID NO: 298666 - protein, 25 aa, Mycobacterium
AFQDSLRWLAIAWVIGAVCLLAALV

SEQ ID NO: 298667 - protein, 28 aa, Mycobacterium
AFQGLRAVWRRGRDVFAEVGLPNDDGLD

SEQ ID NO: 298668 - protein, 18 aa, Mycobacterium
AFQNPDFQRGLKLFLSPD

SEQ ID NO: 298669 - protein, 19 aa, Mycobacterium
AFQNPDFQRGLTLFLSPDG

SEQ ID NO: 298670 - protein, 29 aa, Mycobacterium
AFQTRARRGRLFTRFCTVVAAGMLTASAV

SEQ ID NO: 298671 - protein, 26 aa, Mycobacterium
AFRLARPTSPWARWRYSPRRLTRARQ

SEQ ID NO: 298672 - protein, 19 aa, Mycobacterium
AFRRHWRQILLVAGAYLSQ

SEQ ID NO: 298673 - protein, 25 aa, Mycobacterium
AFSARPDLFGGAALAAFSSALALTQ

SEQ ID NO: 298674 - protein, 24 aa, Mycobacterium
AFSGAGVPLIWLAIAGIIYGSSNQ

SEQ ID NO: 298675 - protein, 17 aa, Mycobacterium
AFSGCLPCNKMTGTRVG

SEQ ID NO: 298676 - protein, 22 aa, Mycobacterium
AFSKPFFDQGLINRRAVLKSSY

SEQ ID NO: 298677 - protein, 22 aa, Mycobacterium
AFSKPFFNQGLLNRRAVLKSSY

SEQ ID NO: 298678 - protein, 19 aa, Mycobacterium
AFSLLGLRQLYFLIDNLLY

SEQ ID NO: 298679 - protein, 22 aa, Mycobacterium
AFSPRAVAAMRSWVEEIIGAGI

SEQ ID NO: 298680 - protein, 19 aa, Mycobacterium
AFSSFFVVSNSLRLRNFGS

SEQ ID NO: 298681 - protein, 21 aa, Mycobacterium
AFSVGCWPAGLGTRRTPAGRQ

SEQ ID NO: 298682 - protein, 20 aa, Mycobacterium
AFSVGLSVVVQRGAFIHFGA

SEQ ID NO: 298683 - protein, 18 aa, Mycobacterium
AFTIPASWLLHRFTRVRS

SEQ ID NO: 298684 - protein, 20 aa, Mycobacterium
AFTMCAMVVSDLRIVGQLGT

SEQ ID NO: 298685 - protein, 24 aa, Mycobacterium
AFTYEIVHLIGGYPGAIVGFALLV

SEQ ID NO: 298686 - protein, 18 aa, Mycobacterium
AFVAGWMYFLNWAMTGIV

SEQ ID NO: 298687 - protein, 19 aa, Mycobacterium
AFVASVTFLPAVLVLVGRR

SEQ ID NO: 298688 - protein, 17 aa, Mycobacterium
AFVLFAIATILVTRLYL

SEQ ID NO: 298689 - protein, 20 aa, Mycobacterium
AFVLHRAWIGPMVLLVLDDP

SEQ ID NO: 298690 - protein, 19 aa, Mycobacterium
AFVLRYVLLTATRGSPVLQ

SEQ ID NO: 298691 - protein, 35 aa, Mycobacterium
AFVPNLLLFELFQPFFDYFWGFKAYGTPGYPPDTA

SEQ ID NO: 298692 - protein, 19 aa, Mycobacterium
AFVRRDWRYAVVLTGYCAG

SEQ ID NO: 298693 - protein, 17 aa, Mycobacterium
AFVSRLAALDVPANAPV

SEQ ID NO: 298694 - protein, 18 aa, Mycobacterium
AFVVIFAVVLVFYIVTSN

SEQ ID NO: 298695 - protein, 20 aa, Mycobacterium
AFVVLVMFLLPALRDGAPAV

SEQ ID NO: 298696 - protein, 20 aa, Mycobacterium
AFVVMCFLGILWTLQHFDLK

SEQ ID NO: 298697 - protein, 36 aa, Mycobacterium
AFVVPSIVALLGRWFWWPSRPPRRAMAEAVKTPEPQ

SEQ ID NO: 298698 - protein, 24 aa, Mycobacterium
AFVVRGAMKAAWDKLRGPAGKLGA

SEQ ID NO: 298699 - protein, 18 aa, Mycobacterium
AFVVRGAMNAAWDKLGSS

SEQ ID NO: 298700 - protein, 24 aa, Mycobacterium
AFVVSYRWGHHVTRFVSHPDNEQL

SEQ ID NO: 298701 - protein, 17 aa, Mycobacterium
AFWCLVPGALSFVNVSE

SEQ ID NO: 298702 - protein, 18 aa, Mycobacterium
AFWICGLAIAAFVGPPQS

SEQ ID NO: 298703 - protein, 19 aa, Mycobacterium
AFWVFLVFYVICAAVTWYA

SEQ ID NO: 298704 - protein, 25 aa, Mycobacterium
AFYDYERTWPLIALAAVFAVVVVAV

SEQ ID NO: 298705 - protein, 23 aa, Mycobacterium
AFYPHRRKGFALGFNAGAGNLGV

SEQ ID NO: 298706 - protein, 20 aa, Mycobacterium
AFYPQRLKGFALGFTGGFTN

SEQ ID NO: 298707 - protein, 32 aa, Mycobacterium
AGAAACLHFTRLPYFNTMGFPLSIGMVVVVAA

SEQ ID NO: 298708 - protein, 27 aa, Mycobacterium
AGAAACPRSPFRDRWFVVFTIGNGVLW

SEQ ID NO: 298709 - protein, 20 aa, Mycobacterium
AGAAEYLLTVGLRSPADDSA

SEQ ID NO: 298710 - protein, 31 aa, Mycobacterium
AGAAFPATLAWLRYRWLRRTPLPVQRPTVGR

SEQ ID NO: 298711 - protein, 17 aa, Mycobacterium
AGAAILLFGGRRTDAWG

SEQ ID NO: 298712 - protein, 34 aa, Mycobacterium
AGAAITTLVLWDLFGQLPLPLGVAGHEGSTILVA

SEQ ID NO: 298713 - protein, 23 aa, Mycobacterium
AGAALPGLFALGIRLQSAGAGDI

SEQ ID NO: 298714 - protein, 24 aa, Mycobacterium
AGAALPWLRIAILGTPAILISLAG

SEQ ID NO: 298715 - protein, 20 aa, Mycobacterium
AGAALRALLDLGAKDVAVRK

SEQ ID NO: 298716 - protein, 25 aa, Mycobacterium
AGAALRALLELGVRDVTVRRGAAEH

SEQ ID NO: 298717 - protein, 20 aa, Mycobacterium
AGAAMAFSSFFVVSNSLRLR

SEQ ID NO: 298718 - protein, 25 aa, Mycobacterium
AGAAMAFSSFFVVSNSLRLRNFGPP

SEQ ID NO: 298719 - protein, 19 aa, Mycobacterium
AGAAMAFSSVFVVSNSLRL

SEQ ID NO: 298720 - protein, 25 aa, Mycobacterium
AGAATRLPGLWAAVRPRLPRLLVCV

SEQ ID NO: 298721 - protein, 20 aa, Mycobacterium
AGACLCLTMTTLPYFQSMAL

SEQ ID NO: 298722 - protein, 17 aa, Mycobacterium
AGACLGALFFGHLTDRF

SEQ ID NO: 298723 - protein, 18 aa, Mycobacterium
AGADAALLVADDDTASLT

SEQ ID NO: 298724 - protein, 23 aa, Mycobacterium
AGADFQTVLPLGGLNHPEGVAVD

SEQ ID NO: 298725 - protein, 20 aa, Mycobacterium
AGAELLWQLPVSSIGCGLIV

SEQ ID NO: 298726 - protein, 24 aa, Mycobacterium
AGAFLPPQIIPYFGLIPLALGLWA

SEQ ID NO: 298727 - protein, 19 aa, Mycobacterium
AGAFTFAGTVGFIGDYLWH

SEQ ID NO: 298728 - protein, 27 aa, Mycobacterium
AGAFTFLIAPFFARLIRFFPPVVTGSV

SEQ ID NO: 298729 - protein, 25 aa, Mycobacterium
AGAGLCLSFARLNYFHTMGPAVAIA

SEQ ID NO: 298730 - protein, 23 aa, Mycobacterium
AGAGLVLRGFVERVGDQSPLIAA

SEQ ID NO: 298731 - protein, 18 aa, Mycobacterium
AGAGTWHIVPGALPQVGQ

SEQ ID NO: 298732 - protein, 18 aa, Mycobacterium
AGAIACLHFTRLPYFKPL

SEQ ID NO: 298733 - protein, 19 aa, Mycobacterium
AGAIAGYFGAWRSSALMWL

SEQ ID NO: 298734 - protein, 18 aa, Mycobacterium
AGAIEGWSMLTDADAFIA

SEQ ID NO: 298735 - protein, 19 aa, Mycobacterium
AGAILHIVASLAITIAPNI

SEQ ID NO: 298736 - protein, 17 aa, Mycobacterium
AGAILWILGAVGRPVAG

SEQ ID NO: 298737 - protein, 18 aa, Mycobacterium
AGALIALHLVVRAVLAFG

SEQ ID NO: 298738 - protein, 26 aa, Mycobacterium
AGALMWKTAMLDPVFGFVNWLLPGGG

SEQ ID NO: 298739 - protein, 17 aa, Mycobacterium
AGALRAYLIDQRALPDA

SEQ ID NO: 298740 - protein, 26 aa, Mycobacterium
AGALVGYLLLRRALLPAGGHLIGVAE

SEQ ID NO: 298741 - protein, 23 aa, Mycobacterium
AGALVLRALLIAFFALVYLLPLI

SEQ ID NO: 298742 - protein, 30 aa, Mycobacterium
AGALVQRLGERWVYMSGLLIVAASTGICAF

SEQ ID NO: 298743 - protein, 17 aa, Mycobacterium
AGALWCGPRWNARADPF

SEQ ID NO: 298744 - protein, 24 aa, Mycobacterium
AGANFWRRGSLLIGIGVGVAAALR

SEQ ID NO: 298745 - protein, 29 aa, Mycobacterium
AGANLPRSRIWVFRTPRRNELMVNATRVA

SEQ ID NO: 298746 - protein, 17 aa, Mycobacterium
AGAPGTGSLFWVSDTGV

SEQ ID NO: 298747 - protein, 21 aa, Mycobacterium
AGAQAPFRLADYVTDNAGVLS

SEQ ID NO: 298748 - protein, 20 aa, Mycobacterium
AGAQIGGFGIHPALLDAALH

SEQ ID NO: 298749 - protein, 26 aa, Mycobacterium
AGAQISALGPDAGWQGTAAAAYVAQN

SEQ ID NO: 298750 - protein, 26 aa, Mycobacterium
AGAQKTLGIGLGWAAALLMGTITAVG

SEQ ID NO: 298751 - protein, 18 aa, Mycobacterium
AGARFGGRNWAMFSSAIL

SEQ ID NO: 298752 - protein, 18 aa, Mycobacterium
AGARRIRVRANWFRFDAV

SEQ ID NO: 298753 - protein, 17 aa, Mycobacterium
AGARYGRRLSGNALRAT

SEQ ID NO: 298754 - protein, 18 aa, Mycobacterium
AGASFCLHFARLAYFKAL

SEQ ID NO: 298755 - protein, 25 aa, Mycobacterium
AGATAARPPVEFSHEEEMYDAGPAP

SEQ ID NO: 298756 - protein, 27 aa, Mycobacterium
AGATGVRIGYRQAKARVTLHDMKFARF

SEQ ID NO: 298757 - protein, 18 aa, Mycobacterium
AGATLCLHFTRLPYFQTM

SEQ ID NO: 298758 - protein, 18 aa, Mycobacterium
AGATLCLHFTRMPYFQSL

SEQ ID NO: 298759 - protein, 28 aa, Mycobacterium
AGATSLLWLAVAGWSLWAAHSPGMGADA

SEQ ID NO: 298760 - protein, 26 aa, Mycobacterium
AGATWRARPKLAITDGGLVHRGWFRT

SEQ ID NO: 298761 - protein, 21 aa, Mycobacterium
AGAVDRARLGEGFLVDELGRP

SEQ ID NO: 298762 - protein, 20 aa, Mycobacterium
AGAVGMRLGWTVIAPGDRPR

SEQ ID NO: 298763 - protein, 23 aa, Mycobacterium
AGAVVTLARWWRPAVAGLVCCVA

SEQ ID NO: 298764 - protein, 30 aa, Mycobacterium
AGAVYCLSFTRLPYFQSLGVPVAIGILVAL

SEQ ID NO: 298765 - protein, 26 aa, Mycobacterium
AGAWLDYVLRRGWPLLKSDVVEEDSP

SEQ ID NO: 298766 - protein, 30 aa, Mycobacterium
AGAYAGGLLARFIPGTVLLIGFALMMIATA

SEQ ID NO: 298767 - protein, 18 aa, Mycobacterium
AGAYIAAGLVLFVLTFLV

SEQ ID NO: 298768 - protein, 22 aa, Mycobacterium
AGAYVMWGLFPAFFPLLKPAGA

SEQ ID NO: 298769 - protein, 17 aa, Mycobacterium
AGCLLPLANVFWAPVYV

SEQ ID NO: 298770 - protein, 23 aa, Mycobacterium
AGCLPAVIWLACHRPNRLWWRYT

SEQ ID NO: 298771 - protein, 21 aa, Mycobacterium
AGCLTLWGTMTMLGGAVQSGF

SEQ ID NO: 298772 - protein, 24 aa, Mycobacterium
AGCQELDGRNALGYVRSRATARAD

SEQ ID NO: 298773 - protein, 22 aa, Mycobacterium
AGDAAWWPSDVVVARPVLLRAG

SEQ ID NO: 298774 - protein, 18 aa, Mycobacterium
AGDDVRIAGISVGKVSTV

SEQ ID NO: 298775 - protein, 24 aa, Mycobacterium
AGDELLCAVGERLRRHVRSEDTLA

SEQ ID NO: 298776 - protein, 19 aa, Mycobacterium
AGDEPRRLLSMQRISAFVL

SEQ ID NO: 298777 - protein, 34 aa, Mycobacterium
AGDGAGRKVGFLKRLRGKVKRPSGKRVAAAVAVV

SEQ ID NO: 298778 - protein, 23 aa, Mycobacterium
AGDKMKVVFHFNNKYKVPENATA

SEQ ID NO: 298779 - protein, 29 aa, Mycobacterium
AGDKSRTAVTLGMMLSCLILVAALGTLAG

SEQ ID NO: 298780 - protein, 20 aa, Mycobacterium
AGDQPWRWFLIGFMVIFHLN

SEQ ID NO: 298781 - protein, 23 aa, Mycobacterium
AGDRLDALDVRRLVRRILGRPDP

SEQ ID NO: 298782 - protein, 17 aa, Mycobacterium
AGDRLGRRKVFHLGLSI

SEQ ID NO: 298783 - protein, 24 aa, Mycobacterium
AGDSAYVALCHWNANIDNAWFWRD

SEQ ID NO: 298784 - protein, 27 aa, Mycobacterium
AGDSIRTSRAFLWTFASLIVVALGALM

SEQ ID NO: 298785 - protein, 18 aa, Mycobacterium
AGDWTAMIGSADELAARG

SEQ ID NO: 298786 - protein, 22 aa, Mycobacterium
AGDYYFSITLPEDFSASVASPS

SEQ ID NO: 298787 - protein, 18 aa, Mycobacterium
AGEARPSPGGTPLVSYGI

SEQ ID NO: 298788 - protein, 22 aa, Mycobacterium
AGEGLAAAGVRQQLVAVQPVGD

SEQ ID NO: 298789 - protein, 21 aa, Mycobacterium
AGEIDGRHYLVMPAVPDGSTV

SEQ ID NO: 298790 - protein, 25 aa, Mycobacterium
AGEPAPPWLWLWIAGIGLSAGLTGA

SEQ ID NO: 298791 - protein, 22 aa, Mycobacterium
AGERRFTAPSGFDAGSTQVINR

SEQ ID NO: 298792 - protein, 18 aa, Mycobacterium
AGESWPLSVYMFIGTVVS

SEQ ID NO: 298793 - protein, 23 aa, Mycobacterium
AGFANGWTYWAVWATTCMAEITV

SEQ ID NO: 298794 - protein, 28 aa, Mycobacterium
AGFARLRPGVLHARRYVAIMGVAWLLLA

SEQ ID NO: 298795 - protein, 21 aa, Mycobacterium
AGFDLDWGALVIIAIVTAILA

SEQ ID NO: 298796 - protein, 17 aa, Mycobacterium
AGFEPDVRFDGVDLLVH

SEQ ID NO: 298797 - protein, 25 aa, Mycobacterium
AGFGLAYRARPVFVPAKGPGDALAQ

SEQ ID NO: 298798 - protein, 17 aa, Mycobacterium
AGFGRAAAVTALMTAVI

SEQ ID NO: 298799 - protein, 19 aa, Mycobacterium
AGFGRAAAVTAVMTAVILV

SEQ ID NO: 298800 - protein, 23 aa, Mycobacterium
AGFGRAAVVTALMTAVILLGQMT

SEQ ID NO: 298801 - protein, 21 aa, Mycobacterium
AGFGSLLTRWLNLSDEDGRLA

SEQ ID NO: 298802 - protein, 20 aa, Mycobacterium
AGFHHGFFIFAILLTAMSII

SEQ ID NO: 298803 - protein, 19 aa, Mycobacterium
AGFPFAHRIAGFSALPADA

SEQ ID NO: 298804 - protein, 26 aa, Mycobacterium
AGFPPTCLLAILGLVFFLVVRQWWGV

SEQ ID NO: 298805 - protein, 21 aa, Mycobacterium
AGFRSLIGYVRATFLVAAVDA

SEQ ID NO: 298806 - protein, 19 aa, Mycobacterium
AGFSTWIMVMWKPDGAHGM

SEQ ID NO: 298807 - protein, 18 aa, Mycobacterium
AGFSTWVMVIFKPDGSHG

SEQ ID NO: 298808 - protein, 17 aa, Mycobacterium
AGFVELALRAGDEVGCP

SEQ ID NO: 298809 - protein, 34 aa, Mycobacterium; identical to SEQ ID NO: 12939

SEQ ID NO: 298810 - protein, 17 aa, Mycobacterium
AGFVLGGGWLFIEHQRV

SEQ ID NO: 298811 - protein, 20 aa, Mycobacterium
AGFVLLLWAVAGVKRAVLTD

SEQ ID NO: 298812 - protein, 32 aa, Mycobacterium
AGFVRLRRRGHAWPVSRLVSWLIGCAVLVITS

SEQ ID NO: 298813 - protein, 19 aa, Mycobacterium
AGGAAVFAERAFKQPLVSF

SEQ ID NO: 298814 - protein, 18 aa, Mycobacterium
AGGAGDRRALRLGVVSTM

SEQ ID NO: 298815 - protein, 24 aa, Mycobacterium
AGGAIGILVSWGLVELFPGSLAPH

SEQ ID NO: 298816 - protein, 19 aa, Mycobacterium
AGGALAWIAADTIRPLSYV

SEQ ID NO: 298817 - protein, 21 aa, Mycobacterium
AGGAVAFSIVRRSVRAKPQEP

SEQ ID NO: 298818 - protein, 20 aa, Mycobacterium
AGGAVLYWLARRERNLRVFT

SEQ ID NO: 298819 - protein, 17 aa, Mycobacterium
AGGAYVFFGQSPKPTAP

SEQ ID NO: 298820 - protein, 19 aa, Mycobacterium
AGGFCDIAGMTPVEDLEPD

SEQ ID NO: 298821 - protein, 18 aa, Mycobacterium
AGGFCDIAGMTPVEELAP

SEQ ID NO: 298822 - protein, 37 aa, Mycobacterium
AGGFFDKLSRFVIQKPFVVIAIWISLAAIPALMFPPL

SEQ ID NO: 298823 - protein, 47 aa, Mycobacterium
AGGFFRMCVLTGKALKQPFEWREFIWNGWFLMRVSLLPTIAVSIPET

SEQ ID NO: 298824 - protein, 17 aa, Mycobacterium
AGGFPFLSMTGQFLIKD

SEQ ID NO: 298825 - protein, 19 aa, Mycobacterium
AGGGYTFARRALGPWGGFA

SEQ ID NO: 298826 - protein, 18 aa, Mycobacterium
AGGIPVLSALPGQFLLKD

SEQ ID NO: 298827 - protein, 20 aa, Mycobacterium
AGGITRRPRSPKPRPAPPAD

SEQ ID NO: 298828 - protein, 24 aa, Mycobacterium
AGGLAPTLWGWRRTPVLRWFVLGA

SEQ ID NO: 298829 - protein, 20 aa, Mycobacterium
AGGLAVLIMLIWVSTALVIS

SEQ ID NO: 298830 - protein, 19 aa, Mycobacterium
AGGLLALLAHAMRGRAGEG

SEQ ID NO: 298831 - protein, 17 aa, Mycobacterium
AGGLPQLKPGTIPETVA

SEQ ID NO: 298832 - protein, 17 aa, Mycobacterium
AGGLSWFGRLPGDIRIE

SEQ ID NO: 298833 - protein, 25 aa, Mycobacterium
AGGMVARAGLRPVARLTQAAERVAR

SEQ ID NO: 298834 - protein, 18 aa, Mycobacterium
AGGPFLFLQTMLRTSTIS

SEQ ID NO: 298835 - protein, 17 aa, Mycobacterium
AGGPPGFAVPAPIGAVV

SEQ ID NO: 298836 - protein, 26 aa, Mycobacterium
AGGRGGNSGAFALFAQAGNGGAGANG

SEQ ID NO: 298837 - protein, 23 aa, Mycobacterium
AGGRGPLIVLRAGRTGDGGDGGD

SEQ ID NO: 298838 - protein, 17 aa, Mycobacterium
AGGRKTLWHNLGVLSGA

SEQ ID NO: 298839 - protein, 23 aa, Mycobacterium
AGGRKVEVVACVGRDPCVTVDSA

SEQ ID NO: 298840 - protein, 17 aa, Mycobacterium
AGGRLLVRATRIGADTQ

SEQ ID NO: 298841 - protein, 17 aa, Mycobacterium
AGGRLVVRAARVGSDTQ

SEQ ID NO: 298842 - protein, 23 aa, Mycobacterium
AGGRPILRIFVKRHRLVGTLPLL

SEQ ID NO: 298843 - protein, 19 aa, Mycobacterium
AGGRPILRILMRRRQTVGL

SEQ ID NO: 298844 - protein, 25 aa, Mycobacterium
AGGRYELGETLPLDAGKILGAGLAL

SEQ ID NO: 298845 - protein, 25 aa, Mycobacterium
AGGRYELGETLPLDAGKILGTGLGL

SEQ ID NO: 298846 - protein, 18 aa, Mycobacterium
AGGRYGVFCLGSCWMLFV

SEQ ID NO: 298847 - protein, 26 aa, Mycobacterium
AGGSALPAPMMWAGVSAFDADLMPPT

SEQ ID NO: 298848 - protein, 23 aa, Mycobacterium
AGGSRLGKITTFMVDILTGVPSI

SEQ ID NO: 298849 - protein, 25 aa, Mycobacterium
AGGSWRARPKLAITREGLAIRGWLR

SEQ ID NO: 298850 - protein, 18 aa, Mycobacterium
AGGTGEREKLRYAVVATM

SEQ ID NO: 298851 - protein, 26 aa, Mycobacterium
AGGTIELLARLGIAILLFLVGLRLDL

SEQ ID NO: 298852 - protein, 18 aa, Mycobacterium
AGGVLTIIMGLVFVGLIP

SEQ ID NO: 298853 - protein, 18 aa, Mycobacterium
AGGVLTIVMGLVFVGLIP

SEQ ID NO: 298854 - protein, 19 aa, Mycobacterium
AGGVSVLRVFNVVEPAKAH

SEQ ID NO: 298855 - protein, 23 aa, Mycobacterium
AGGWWNLLRKPSFLIVVAGTAFI

SEQ ID NO: 298856 - protein, 23 aa, Mycobacterium
AGHACPPAIVLPGAYIGVVLLAT

SEQ ID NO: 298857 - protein, 19 aa, Mycobacterium
AGHAPGWAPLAVQYVDYTL

SEQ ID NO: 298858 - protein, 25 aa, Mycobacterium
AGHDRAVVIPAILVVVLIVLYVLLR

SEQ ID NO: 298859 - protein, 25 aa, Mycobacterium
AGHGCTRLLQGLVFGTILHWGARRS

SEQ ID NO: 298860 - protein, 21 aa, Mycobacterium
AGHRSDPDWSPSDEDAAADVD

SEQ ID NO: 298861 - protein, 20 aa, Mycobacterium
AGHVAGWLALVWVIVETVNV

SEQ ID NO: 298862 - protein, 18 aa, Mycobacterium
AGHVMGLFIPPRVTHLLK

SEQ ID NO: 298863 - protein, 18 aa, Mycobacterium
AGIALCFAGRNVSGVTLI

SEQ ID NO: 298864 - protein, 24 aa, Mycobacterium
AGIARLGSFVAMFFIVRHGVPALA

SEQ ID NO: 298865 - protein, 23 aa, Mycobacterium
AGIDPRRCIAVSLDVGTDNEQLL

SEQ ID NO: 298866 - protein, 30 aa, Mycobacterium
AGIFTFLIAPVFIKLLRFFPPVVTGTLITI

SEQ ID NO: 298867 - protein, 17 aa, Mycobacterium
AGIGAPGWVLLGPKAMD

SEQ ID NO: 298868 - protein, 17 aa, Mycobacterium
AGIGLRCKPGLVRLRPA

SEQ ID NO: 298869 - protein, 19 aa, Mycobacterium
AGIGVWSRVGPRVLAVSSL

SEQ ID NO: 298870 - protein, 22 aa, Mycobacterium
AGIGYGTLWLRRWPTRRQSLMM

SEQ ID NO: 298871 - protein, 19 aa, Mycobacterium
AGIIIDLVTGPGFYDVALR

SEQ ID NO: 298872 - protein, 20 aa, Mycobacterium
AGIILDLVTGPGFYDVALRD

SEQ ID NO: 298873 - protein, 19 aa, Mycobacterium
AGILILRRYYRATYALIPV

SEQ ID NO: 298874 - protein, 25 aa, Mycobacterium
AGILSGAVAWIIALFYKGIYVGGLI

SEQ ID NO: 298875 - protein, 20 aa, Mycobacterium
AGILVPLGLGGAVLAGVGTA

SEQ ID NO: 298876 - protein, 17 aa, Mycobacterium
AGIPFVHSTSERMRRAA

SEQ ID NO: 298877 - protein, 17 aa, Mycobacterium
AGIPLYGLIGLVRSAKG

SEQ ID NO: 298878 - protein, 21 aa, Mycobacterium
AGIPMIAGWMLLRRRNGQSWL

SEQ ID NO: 298879 - protein, 17 aa, Mycobacterium
AGIPVVGLIFVLTTVIV

SEQ ID NO: 298880 - protein, 19 aa, Mycobacterium
AGIPYGYWIPLTALLVLRP

SEQ ID NO: 298881 - protein, 17 aa, Mycobacterium
AGIRRIASARVQRQYPS

SEQ ID NO: 298882 - protein, 27 aa, Mycobacterium
AGISHQRWLRWPARVYTDIFRGLPEVV

SEQ ID NO: 298883 - protein, 27 aa, Mycobacterium
AGISKSRWLRWPARVYTDIFRGLPEVV

SEQ ID NO: 298884 - protein, 27 aa, Mycobacterium
AGISMPVFWLAAILLYFLSFKLQLFPS

SEQ ID NO: 298885 - protein, 17 aa, Mycobacterium
AGIVAALLIGDRRWEAR

SEQ ID NO: 298886 - protein, 23 aa, Mycobacterium
AGIVGALSYWLSHLVGNLTTPMV

SEQ ID NO: 298887 - protein, 24 aa, Mycobacterium
AGKDSFPASFIVKLNNPEQHAEFD

SEQ ID NO: 298888 - protein, 19 aa, Mycobacterium
AGKELSRWIGDARVLTDDY

SEQ ID NO: 298889 - protein, 27 aa, Mycobacterium
AGKLSFPISAAPGWSVFGDDQSPNLIG

SEQ ID NO: 298890 - protein, 20 aa, Mycobacterium
AGKMLACSLTIGIGGSGGVF

SEQ ID NO: 298891 - protein, 28 aa, Mycobacterium
AGKSSFIKRMFTEFGIDVPESLQIRADA

SEQ ID NO: 298892 - protein, 19 aa, Mycobacterium
AGKSTFARLVAGYTHPTSG

SEQ ID NO: 298893 - protein, 23 aa, Mycobacterium
AGKVIDMLAIFATLFGSAASLGL

SEQ ID NO: 298894 - protein, 22 aa, Mycobacterium
AGKWKGCAGKTVTVTNKGKTYR

SEQ ID NO: 298895 - protein, 23 aa, Mycobacterium
AGLAAVCYAELASAVPVSGSTYS

SEQ ID NO: 298896 - protein, 19 aa, Mycobacterium
AGLAFNFLSAGLILILSYY

SEQ ID NO: 298897 - protein, 17 aa, Mycobacterium
AGLAFVHGDRVSPAHYP

SEQ ID NO: 298898 - protein, 20 aa, Mycobacterium
AGLAGRRVWDAALVAASPLV

SEQ ID NO: 298899 - protein, 20 aa, Mycobacterium
AGLAGWLYYNEYRPDRETDP

SEQ ID NO: 298900 - protein, 18 aa, Mycobacterium
AGLAHHRWVSPAILVVAT

SEQ ID NO: 298901 - protein, 24 aa, Mycobacterium
AGLAIGICSHWWPELPGNGKSILT

SEQ ID NO: 298902 - protein, 18 aa, Mycobacterium
AGLAKRTVGMTGADLANV

SEQ ID NO: 298903 - protein, 19 aa, Mycobacterium
AGLALAYRTRPVFVPTAGP

SEQ ID NO: 298904 - protein, 27 aa, Mycobacterium
AGLALRQMGIGWAFGFPAATFAVGAVT

SEQ ID NO: 298905 - protein, 25 aa, Mycobacterium
AGLAVKDNFYWPGLILLVVAASGLT

SEQ ID NO: 298906 - protein, 27 aa, Mycobacterium
AGLAVLPIRLVVGWTYFSAFWRRVALE

SEQ ID NO: 298907 - protein, 20 aa, Mycobacterium
AGLAVPRPLGAVIAQGDALP

SEQ ID NO: 298908 - protein, 25 aa, Mycobacterium
AGLAVPRPLPALIADAAAHTEPPQP

SEQ ID NO: 298909 - protein, 22 aa, Mycobacterium
AGLDLSNTVGWFTTLYPVALRD

SEQ ID NO: 298910 - protein, 18 aa, Mycobacterium
AGLDPVFAKALAKDPSHR

SEQ ID NO: 298911 - protein, 17 aa, Mycobacterium
AGLFENRCEVGVNRLIG

SEQ ID NO: 298912 - protein, 36 aa, Mycobacterium
AGLFIAFDQLWRWNSIVALVLSVLVILGLVVGVRVV

SEQ ID NO: 298913 - protein, 22 aa, Mycobacterium
AGLFRYIAKRLLLAIPVLIGTS

SEQ ID NO: 298914 - protein, 25 aa, Mycobacterium
AGLGAVAFRYLIYGFTWLATGRDEF

SEQ ID NO: 298915 - protein, 22 aa, Mycobacterium
AGLGGICLVLLVGLLAMLAVRV

SEQ ID NO: 298916 - protein, 29 aa, Mycobacterium
AGLGLARARKAGVSAVIFVWCNISDDNAR

SEQ ID NO: 298917 - protein, 25 aa, Mycobacterium
AGLGLRSGGPLAIIFSLVCIGIAAF

SEQ ID NO: 298918 - protein, 19 aa, Mycobacterium
AGLGMFNLISLGAGAMLGK

SEQ ID NO: 298919 - protein, 21 aa, Mycobacterium
AGLGPEAGWQGSAARAYGAQN

SEQ ID NO: 298920 - protein, 25 aa, Mycobacterium
AGLGWLRRHTRAIQIFGGVLLIAVG

SEQ ID NO: 298921 - protein, 24 aa, Mycobacterium
AGLGWLRRHTRAIQVFGGVLLIAV

SEQ ID NO: 298922 - protein, 24 aa, Mycobacterium
AGLGWLRRHTRAIQVFGGVLLITV

SEQ ID NO: 298923 - protein, 19 aa, Mycobacterium
AGLGYPSVPWIGAGLGVVA

SEQ ID NO: 298924 - protein, 25 aa, Mycobacterium
AGLIGGILWNLLTWLFGIPSSSSHA

SEQ ID NO: 298925 - protein, 20 aa, Mycobacterium
AGLIGPWLLKVGFGDEYRAD

SEQ ID NO: 298926 - protein, 25 aa, Mycobacterium
AGLKAFWYHFAIMFEALFILTAVDA

SEQ ID NO: 298927 - protein, 25 aa, Mycobacterium
AGLKAFWYHFAIMFEALFILTTVDA

SEQ ID NO: 298928 - protein, 18 aa, Mycobacterium
AGLKVRDDIRLGKDTKAS

SEQ ID NO: 298929 - protein, 17 aa, Mycobacterium
AGLLALIRDLALGTNGQ

SEQ ID NO: 298930 - protein, 22 aa, Mycobacterium
AGLLALPLGYWGAVVAIIVFQV

SEQ ID NO: 298931 - protein, 30 aa, Mycobacterium
AGLLARFCGPELWWLLRVADYASAGGTTAI

SEQ ID NO: 298932 - protein, 37 aa, Mycobacterium
AGLLIAGGVTARFTRKAIWWSAFRQLLFGSVAVAATY

SEQ ID NO: 298933 - protein, 26 aa, Mycobacterium
AGLLIVIGIELLKPAHIETALRNGDL

SEQ ID NO: 298934 - protein, 24 aa, Mycobacterium
AGLLLCAGVALGVALSWLHASAWM

SEQ ID NO: 298935 - protein, 23 aa, Mycobacterium
AGLLLCALVPLLPVKQTTATILW

SEQ ID NO: 298936 - protein, 17 aa, Mycobacterium
AGLLLVLAAARPGLPQG

SEQ ID NO: 298937 - protein, 19 aa, Mycobacterium
AGLLPLVLVTSGVVFAYAA

SEQ ID NO: 298938 - protein, 24 aa, Mycobacterium
AGLLRIAAVLGIVAGLAVLAGPVV

SEQ ID NO: 298939 - protein, 21 aa, Mycobacterium
AGLLVSLVVRRRRVWVRIEPA

SEQ ID NO: 298940 - protein, 23 aa, Mycobacterium
AGLMAAIGFELFKQVASIYLRTV

SEQ ID NO: 298941 - protein, 23 aa, Mycobacterium
AGLMLRTDLSWWAALATNGIYLP

SEQ ID NO: 298942 - protein, 20 aa, Mycobacterium
AGLMVAFAVITYLSYTAAFA

SEQ ID NO: 298943 - protein, 21 aa, Mycobacterium
AGLNAYIPLLALGLLGRFTEL

SEQ ID NO: 298944 - protein, 19 aa, Mycobacterium
AGLPAVFAAGLVAYSSGAG

SEQ ID NO: 298945 - protein, 20 aa, Mycobacterium
AGLPAVFALGLVAFSRGAGS

SEQ ID NO: 298946 - protein, 19 aa, Mycobacterium
AGLPCAIGIVTGMVASLTL

SEQ ID NO: 298947 - protein, 23 aa, Mycobacterium
AGLPCAVGVLIGMLASLTLLPAL

SEQ ID NO: 298948 - protein, 22 aa, Mycobacterium
AGLPEGLSTMLIGGAQGLSAGQ

SEQ ID NO: 298949 - protein, 23 aa, Mycobacterium
AGLPERWTALELTGTTDAPRLTV

SEQ ID NO: 298950 - protein, 17 aa, Mycobacterium
AGLPFAAATYFFVIMIA

SEQ ID NO: 298951 - protein, 17 aa, Mycobacterium
AGLPGVLDGDIWEPAER

SEQ ID NO: 298952 - protein, 24 aa, Mycobacterium
AGLPQRVGARWGPGAVRASALILL

SEQ ID NO: 298953 - protein, 22 aa, Mycobacterium
AGLPRAANIASYIAFVLLAMSA

SEQ ID NO: 298954 - protein, 17 aa, Mycobacterium
AGLPWYAIICLPVLFAA

SEQ ID NO: 298955 - protein, 28 aa, Mycobacterium
AGLPWYAIVCLPVLFTAGMCLLDTIDGS

SEQ ID NO: 298956 - protein, 26 aa, Mycobacterium
AGLQTGSSFKVFALVAALEQGIGLGY

SEQ ID NO: 298957 - protein, 20 aa, Mycobacterium
AGLRADLLHRAGAVGRRDVA

SEQ ID NO: 298958 - protein, 19 aa, Mycobacterium
AGLRIPYSVATTVFGGRNW

SEQ ID NO: 298959 - protein, 19 aa, Mycobacterium
AGLRSRAGALLLHPAVTIP

SEQ ID NO: 298960 - protein, 23 aa, Mycobacterium
AGLSALCYAEMASAVPVSGSTYS

SEQ ID NO: 298961 - protein, 18 aa, Mycobacterium
AGLSGSLFMLVKHRDATR

SEQ ID NO: 298962 - protein, 21 aa, Mycobacterium
AGLSLGPAVVFVGSRFHFFER

SEQ ID NO: 298963 - protein, 24 aa, Mycobacterium
AGLSRFIFATAIIWFAGGLGTWLI

SEQ ID NO: 298964 - protein, 24 aa, Mycobacterium
AGLSRFVWATAIVWILGGFGTWLI

SEQ ID NO: 298965 - protein, 22 aa, Mycobacterium
AGLSRFVWATVIVWILGGFGTW

SEQ ID NO: 298966 - protein, 35 aa, Mycobacterium
AGLSRLLYRLPIYVYRAGLGWVFGNRIMLLHHIGR

SEQ ID NO: 298967 - protein, 19 aa, Mycobacterium
AGLSWLRFGHGLVVSSICM

SEQ ID NO: 298968 - protein, 17 aa, Mycobacterium
AGLTLGPAVVFVGSRFH

SEQ ID NO: 298969 - protein, 21 aa, Mycobacterium
AGLTPKPGRIALHSTVHGVMS

SEQ ID NO: 298970 - protein, 24 aa, Mycobacterium
AGLVAALCWRFSLPGLGWTLTALA

SEQ ID NO: 298971 - protein, 18 aa, Mycobacterium
AGLVELWLGVAAERRPLE

SEQ ID NO: 298972 - protein, 18 aa, Mycobacterium
AGLVERQRLQAAFGTYVD

SEQ ID NO: 298973 - protein, 24 aa, Mycobacterium
AGLVGGIVWNLLTWLFGIPSSSSH

SEQ ID NO: 298974 - protein, 18 aa, Mycobacterium
AGLVITLSMLVVVVVVAV

SEQ ID NO: 298975 - protein, 23 aa, Mycobacterium
AGLVPGYWLVWTMLLVSGLGVAA

SEQ ID NO: 298976 - protein, 19 aa, Mycobacterium
AGLVVLGVFVWWQSANRGE

SEQ ID NO: 298977 - protein, 17 aa, Mycobacterium
AGLWAFLRTYRVWKAEG

SEQ ID NO: 298978 - protein, 17 aa, Mycobacterium
AGLYPLATFGLGMLAFA

SEQ ID NO: 298979 - protein, 19 aa, Mycobacterium
AGMGARISGFSWPESVAVG

SEQ ID NO: 298980 - protein, 19 aa, Mycobacterium
AGMGGLCLVLVAGLVGMAA

SEQ ID NO: 298981 - protein, 18 aa, Mycobacterium
AGMKAVAQIAEWQERIAE

SEQ ID NO: 298982 - protein, 17 aa, Mycobacterium
AGMNRWTQYGALMVTDA

SEQ ID NO: 298983 - protein, 25 aa, Mycobacterium
AGMPARTRSTIAIFVAGFGITVVVT

SEQ ID NO: 298984 - protein, 18 aa, Mycobacterium
AGMRLGWKVIDPGDRPRA

SEQ ID NO: 298985 - protein, 17 aa, Mycobacterium
AGMRLGWSVISPGDRPR

SEQ ID NO: 298986 - protein, 25 aa, Mycobacterium
AGMSEAALTFALIWCARHLLQWVHA

SEQ ID NO: 298987 - protein, 24 aa, Mycobacterium
AGMSVGFLTVFGIFGLLVAPVIAS

SEQ ID NO: 298988 - protein, 23 aa, Mycobacterium
AGMVCAAVAYLLIDMASGRRSTA

SEQ ID NO: 298989 - protein, 23 aa, Mycobacterium
AGMVLCGLAPLLPVTQTTASITW

SEQ ID NO: 298990 - protein, 26 aa, Mycobacterium
AGNATLILSFLGGFFVEDNRGACPAS

SEQ ID NO: 298991 - protein, 20 aa, Mycobacterium
AGNKRIARRNLLCMMAADHV

SEQ ID NO: 298992 - protein, 19 aa, Mycobacterium
AGNKRIARRNLLWSVVTVH

SEQ ID NO: 298993 - protein, 18 aa, Mycobacterium
AGNPRLSAAVTAVQLVGT

SEQ ID NO: 298994 - protein, 19 aa, Mycobacterium
AGNRPFLRFAAAMIGSYVL

SEQ ID NO: 298995 - protein, 20 aa, Mycobacterium
AGPAEVRWAILTAVAAELPV

SEQ ID NO: 298996 - protein, 22 aa, Mycobacterium
AGPAMGPALFAYGNFHLGSAHY

SEQ ID NO: 298997 - protein, 23 aa, Mycobacterium
AGPAPRPAKPRLLQDGRDMFWSL

SEQ ID NO: 298998 - protein, 23 aa, Mycobacterium
AGPARLGLLGAVLITVGGLGAGS

SEQ ID NO: 298999 - protein, 23 aa, Mycobacterium
AGPARLGRVLAVLGIPMLLGPVF

SEQ ID NO: 299000 - protein, 19 aa, Mycobacterium
AGPAVLVSFVLAGVAAGLS

SEQ ID NO: 299001 - protein, 19 aa, Mycobacterium
AGPDGEPAGSIGFGDVGAS

SEQ ID NO: 299002 - protein, 21 aa, Mycobacterium
AGPDRPVVVSVVGLVHTPGLF

SEQ ID NO: 299003 - protein, 24 aa, Mycobacterium
AGPDRTAAMLAEIVGLLTRGVLTP

SEQ ID NO: 299004 - protein, 20 aa, Mycobacterium
AGPEKLWQVRELQFAVLAAV

SEQ ID NO: 299005 - protein, 17 aa, Mycobacterium
AGPGFWWALVVVLIGQV

SEQ ID NO: 299006 - protein, 22 aa, Mycobacterium
AGPGRFGWSVALLGAVALIARG

SEQ ID NO: 299007 - protein, 19 aa, Mycobacterium
AGPHSNFRCGNAVSARELT

SEQ ID NO: 299008 - protein, 23 aa, Mycobacterium
AGPKRLGRMMAVLGIPMLLGPIG

SEQ ID NO: 299009 - protein, 26 aa, Mycobacterium
AGPLGLCFLPAFVCLGIVPVVAGLAG

SEQ ID NO: 299010 - protein, 29 aa, Mycobacterium
AGPLGLCYLPAFLCLGIVPVVAGLAGDVL

SEQ ID NO: 299011 - protein, 17 aa, Mycobacterium
AGPLMEILQILKANNVP

SEQ ID NO: 299012 - protein, 18 aa, Mycobacterium
AGPLMLAAAFSRRPRDLG

SEQ ID NO: 299013 - protein, 18 aa, Mycobacterium
AGPLRRSSPESVDRMLIG

SEQ ID NO: 299014 - protein, 27 aa, Mycobacterium
AGPPEHLEWIGQWGIFDALRSGTEVVR

SEQ ID NO: 299015 - protein, 22 aa, Mycobacterium
AGPPPAAPRRPVTIPTTEPPPK

SEQ ID NO: 299016 - protein, 22 aa, Mycobacterium
AGPPPRRFAAGIMGRTMVVWFL

SEQ ID NO: 299017 - protein, 23 aa, Mycobacterium
AGPPVPRPPVPIFGPPTKFLTAW

SEQ ID NO: 299018 - protein, 28 aa, Mycobacterium
AGPQRLGRLIAIGGIPLVLAPIGAPILG

SEQ ID NO: 299019 - protein, 18 aa, Mycobacterium
AGPRGRRLAMAWTAITIW

SEQ ID NO: 299020 - protein, 24 aa, Mycobacterium
AGPRNGLGIAALIAAIAGLVLCWS

SEQ ID NO: 299021 - protein, 23 aa, Mycobacterium
AGPRRLGRVLAILGIPMLLGPVF

SEQ ID NO: 299022 - protein, 25 aa, Mycobacterium
AGPRTRFGVWLGRPMTSFHLIIAVA

SEQ ID NO: 299023 - protein, 17 aa, Mycobacterium
AGPRTRIGPLRKQIDEL

SEQ ID NO: 299024 - protein, 18 aa, Mycobacterium
AGPSSVWFVAFFLTLMLI

SEQ ID NO: 299025 - protein, 19 aa, Mycobacterium
AGPSSVWFVALFIGLMLFG

SEQ ID NO: 299026 - protein, 20 aa, Mycobacterium
AGPTPIPFFFGVLAGEEPID

SEQ ID NO: 299027 - protein, 31 aa, Mycobacterium
AGPVARLWRGFLLFFSRWWQLETLYRSNMKY

SEQ ID NO: 299028 - protein, 32 aa, Mycobacterium
AGPVARLWRWLLVFFSRWWQIETLYRSNQKYQ

SEQ ID NO: 299029 - protein, 32 aa, Mycobacterium
AGPVARLWRWLLVFFSRWWQLETLYRSNMKYQ

SEQ ID NO: 299030 - protein, 17 aa, Mycobacterium
AGQCVAVTIAIWNPYVA

SEQ ID NO: 299031 - protein, 31 aa, Mycobacterium
AGQEAAIAWLNRLRGLAQRMCVAPTTYAQAD

SEQ ID NO: 299032 - protein, 20 aa, Mycobacterium
AGQFLPALVLALIAVGAIFL

SEQ ID NO: 299033 - protein, 22 aa, Mycobacterium
AGQLHKVRMLLLTNCTFDGVVY

SEQ ID NO: 299034 - protein, 23 aa, Mycobacterium
AGQRFPIKYYLTAMLFIVFDIEI

SEQ ID NO: 299035 - protein, 24 aa, Mycobacterium
AGQVLRSVAVFDLMTRTWAGLPDM

SEQ ID NO: 299036 - protein, 20 aa, Mycobacterium
AGRAAQPMFVIWPENSSDID

SEQ ID NO: 299037 - protein, 18 aa, Mycobacterium
AGRARPTGKTVFVFPGQG

SEQ ID NO: 299038 - protein, 22 aa, Mycobacterium
AGRDAFPASFVVKLDDPEQHQN

SEQ ID NO: 299039 - protein, 26 aa, Mycobacterium
AGRELARWQPAWLRYSPLSFTGLAMI

SEQ ID NO: 299040 - protein, 24 aa, Mycobacterium
AGRFRPQPAPVWAAATAVLLVATT

SEQ ID NO: 299041 - protein, 18 aa, Mycobacterium
AGRFRTCHELADALRDEV

SEQ ID NO: 299042 - protein, 24 aa, Mycobacterium
AGRLGWPLWVAYVGVFALTVLVGA

SEQ ID NO: 299043 - protein, 18 aa, Mycobacterium
AGRLSWSLTVLAAVALIA

SEQ ID NO: 299044 - protein, 25 aa, Mycobacterium
AGRMQSERCRLRWMPMTAATDDEAV

SEQ ID NO: 299045 - protein, 22 aa, Mycobacterium
AGRPQVSAWVRYHSEKRLPRDV

SEQ ID NO: 299046 - protein, 20 aa, Mycobacterium
AGRPRPATKLVDAYGTSFPS

SEQ ID NO: 299047 - protein, 18 aa, Mycobacterium
AGRRGVRDGVEFEMLLGM

SEQ ID NO: 299048 - protein, 21 aa, Mycobacterium
AGRRKALAFIEGRSVDELLNL

SEQ ID NO: 299049 - protein, 19 aa, Mycobacterium
AGRRKALSFIEGRSTAELV

SEQ ID NO: 299050 - protein, 17 aa, Mycobacterium
AGRRLDAAQSYRSTNPT

SEQ ID NO: 299051 - protein, 17 aa, Mycobacterium
AGRRPHLQRAIAQIALT

SEQ ID NO: 299052 - protein, 24 aa, Mycobacterium
AGRRPRLQLLITVTALTTVLGVCT

SEQ ID NO: 299053 - protein, 21 aa, Mycobacterium
AGRSALKFFLYTFLGSLALLV

SEQ ID NO: 299054 - protein, 19 aa, Mycobacterium
AGRTGAPGPREWLLAALHS

SEQ ID NO: 299055 - protein, 21 aa, Mycobacterium
AGRVCWALRFDVAALVVAAAV

SEQ ID NO: 299056 - protein, 25 aa, Mycobacterium
AGRVPDKMTFLLAGGVRLTATARDG

SEQ ID NO: 299057 - protein, 22 aa, Mycobacterium
AGRVRLWLNVPYALLVLAFVGF

SEQ ID NO: 299058 - protein, 34 aa, Mycobacterium
AGRWELVAFAAPLAGALCSIGWQRRLPTVTVTGS

SEQ ID NO: 299059 - protein, 24 aa, Mycobacterium
AGSAIAIVAATGWLGYLLGPPLIG

SEQ ID NO: 299060 - protein, 26 aa, Mycobacterium
AGSAVWWKALLALAVSVCMIIGVNFA

SEQ ID NO: 299061 - protein, 34 aa, Mycobacterium
AGSEAAMRASDRWRDISSRVPGGTVARVAAGFFA

SEQ ID NO: 299062 - protein, 25 aa, Mycobacterium
AGSGALSWLSPLGWSLQVRPYAGDR

SEQ ID NO: 299063 - protein, 22 aa, Mycobacterium
AGSGRIARPVPRPPRIAKPGPR

SEQ ID NO: 299064 - protein, 20 aa, Mycobacterium
AGSHAELWVLWGGAHILLGV

SEQ ID NO: 299065 - protein, 25 aa, Mycobacterium
AGSLLRLFILAVIMAPIMAAVMLRA

SEQ ID NO: 299066 - protein, 23 aa, Mycobacterium
AGSLLRLLVLGLIMVPILAAVML

SEQ ID NO: 299067 - protein, 27 aa, Mycobacterium
AGSLMTWWTGDSLMVFDVNTLALRYTI

SEQ ID NO: 299068 - protein, 26 aa, Mycobacterium
AGSLSDRFGRMRVYRVGAVIQLVLAA

SEQ ID NO: 299069 - protein, 19 aa, Mycobacterium
AGSLSWGISDFIGGHASKR

SEQ ID NO: 299070 - protein, 25 aa, Mycobacterium
AGSMFGPYHLKRLLGRGGMGEVYEA

SEQ ID NO: 299071 - protein, 23 aa, Mycobacterium
AGSMFGPYRLIRPLGRGGMGQVY

SEQ ID NO: 299072 - protein, 18 aa, Mycobacterium
AGSMWLFLVGVGIPIGSQ

SEQ ID NO: 299073 - protein, 19 aa, Mycobacterium
AGSPARFAGAPGPVGTVVS

SEQ ID NO: 299074 - protein, 21 aa, Mycobacterium
AGSQPRMIWYAPQFNEGDGSA

SEQ ID NO: 299075 - protein, 22 aa, Mycobacterium
AGSRAAMWAAGLVLLGAWMPFN

SEQ ID NO: 299076 - protein, 25 aa, Mycobacterium
AGSRELSGVFGFCYVVGCLAAVLAV

SEQ ID NO: 299077 - protein, 23 aa, Mycobacterium
AGSRRAIPHAVVLSAVLAVVVEC

SEQ ID NO: 299078 - protein, 29 aa, Mycobacterium
AGSSADRLRCWLITIVIWVWAVRLTANWV

SEQ ID NO: 299079 - protein, 23 aa, Mycobacterium
AGSSLPLLLLFSVANRSLADVLT

SEQ ID NO: 299080 - protein, 23 aa, Mycobacterium
AGSSLPLLLLFSVANRSLTDVLT

SEQ ID NO: 299081 - protein, 30 aa, Mycobacterium
AGSSRDELWLGLPAWRWMFLAMALPALVYG

SEQ ID NO: 299082 - protein, 20 aa, Mycobacterium
AGSTLLKFFGGLRNNSDGKP

SEQ ID NO: 299083 - protein, 24 aa, Mycobacterium
AGSVALARRWRGLTLGLRPAEMAE

SEQ ID NO: 299084 - protein, 33 aa, Mycobacterium
AGSVIALCLFAWVESRAAAPILPTRLFGSPVFT

SEQ ID NO: 299085 - protein, 21 aa, Mycobacterium
AGSVLEWYDFFLYGFAATLVF

SEQ ID NO: 299086 - protein, 20 aa, Mycobacterium
AGSVSATWGYRAELRGQWDR

SEQ ID NO: 299087 - protein, 27 aa, Mycobacterium
AGSWEAPPPRVELVAALRDCTARLSTP

SEQ ID NO: 299088 - protein, 27 aa, Mycobacterium
AGSWFHAARPVGVWVDVVLRILIGSAV

SEQ ID NO: 299089 - protein, 23 aa, Mycobacterium
AGSWQSARFALRQEAAAPACAGS

SEQ ID NO: 299090 - protein, 22 aa, Mycobacterium
AGSYPLLLVCGFFLGVAGTIFA

SEQ ID NO: 299091 - protein, 18 aa, Mycobacterium
AGTALGVAAIGSFVGATI

SEQ ID NO: 299092 - protein, 20 aa, Mycobacterium
AGTAWLWGLHLIPLYRHTIH

SEQ ID NO: 299093 - protein, 21 aa, Mycobacterium
AGTDPVGWSAKCLQMARADVN

SEQ ID NO: 299094 - protein, 19 aa, Mycobacterium
AGTEFWSAVEFTGSRTSPE

SEQ ID NO: 299095 - protein, 21 aa, Mycobacterium
AGTETPAFWVFLLCYIGATTL

SEQ ID NO: 299096 - protein, 26 aa, Mycobacterium
AGTFDYWQAWVFMAVFAVATLVPSIY

SEQ ID NO: 299097 - protein, 33 aa, Mycobacterium
AGTFISVLVLWDLFGQLPLPLGVAGHEGSTVLV

SEQ ID NO: 299098 - protein, 19 aa, Mycobacterium
AGTGLRPVARLTDAAERVA

SEQ ID NO: 299099 - protein, 19 aa, Mycobacterium
AGTGLVRAASLVLLEAAPR

SEQ ID NO: 299100 - protein, 18 aa, Mycobacterium
AGTGWRVSGLLRIDEVAA

SEQ ID NO: 299101 - protein, 17 aa, Mycobacterium
AGTKLLVVFAISVLLTF

SEQ ID NO: 299102 - protein, 17 aa, Mycobacterium
AGTKLLVVFGVSVLLTL

SEQ ID NO: 299103 - protein, 21 aa, Mycobacterium
AGTLGGLFTAVSIPFLMFTQL

SEQ ID NO: 299104 - protein, 21 aa, Mycobacterium
AGTLLYAFGIGPLIQLVLRLV

SEQ ID NO: 299105 - protein, 27 aa, Mycobacterium
AGTMLLRLCMLPGLALLIWATPRLAHH

SEQ ID NO: 299106 - protein, 28 aa, Mycobacterium
AGTPGLVCAVVLVPICSITLGALGHRWF

SEQ ID NO: 299107 - protein, 17 aa, Mycobacterium
AGTPVFWILLAGVLLCN

SEQ ID NO: 299108 - protein, 19 aa, Mycobacterium
AGTQWARRPGTALGPASAC

SEQ ID NO: 299109 - protein, 17 aa, Mycobacterium
AGTRGVVSLAAIFTVPF

SEQ ID NO: 299110 - protein, 28 aa, Mycobacterium
AGTRWPRWLRQLLSFVAVVAILSCGALI

SEQ ID NO: 299111 - protein, 25 aa, Mycobacterium
AGTSTIIGVAKWLGASLARGGSAAT

SEQ ID NO: 299112 - protein, 19 aa, Mycobacterium
AGTVIRFVGAVPFVNLQVS

SEQ ID NO: 299113 - protein, 17 aa, Mycobacterium
AGTVLFPGAGFVELAIR

SEQ ID NO: 299114 - protein, 22 aa, Mycobacterium
AGVAFGTFLMRNHFLSLPPEII

SEQ ID NO: 299115 - protein, 22 aa, Mycobacterium
AGVAFGTFLMRNHFLSLPSEVI

SEQ ID NO: 299116 - protein, 24 aa, Mycobacterium
AGVAFVFFGLWTLRGDRLSEDEAT

SEQ ID NO: 299117 - protein, 18 aa, Mycobacterium
AGVALAVGVVVGELAALV

SEQ ID NO: 299118 - protein, 19 aa, Mycobacterium
AGVALVTRWLSSTIGEGLI

SEQ ID NO: 299119 - protein, 25 aa, Mycobacterium
AGVDPRVGLFASFTMAVTIAIVGGR

SEQ ID NO: 299120 - protein, 25 aa, Mycobacterium
AGVDPRVGLFASFTMAVTIAVVGGR

SEQ ID NO: 299121 - protein, 19 aa, Mycobacterium
AGVDPRVGLFSTVTMAITI

SEQ ID NO: 299122 - protein, 23 aa, Mycobacterium
AGVFAGIMALVFASAARYVKTNG

SEQ ID NO: 299123 - protein, 18 aa, Mycobacterium
AGVGAFWWSRTGFAGPIL

SEQ ID NO: 299124 - protein, 25 aa, Mycobacterium
AGVGFIPFVIAMGIGLGISSQLVSR

SEQ ID NO: 299125 - protein, 19 aa, Mycobacterium
AGVGFLAVFVYWQSVNTRE

SEQ ID NO: 299126 - protein, 25 aa, Mycobacterium
AGVGRFLLATAIIWLLGGVGTWLIG

SEQ ID NO: 299127 - protein, 18 aa, Mycobacterium
AGVGVDWRAAFDGLGGRR

SEQ ID NO: 299128 - protein, 19 aa, Mycobacterium
AGVGVLLPRWSGDQYDAGR

SEQ ID NO: 299129 - protein, 20 aa, Mycobacterium
AGVGVLLPRWSGDQYDAGRK

SEQ ID NO: 299130 - protein, 26 aa, Mycobacterium
AGVIAAEHPELWGGLVDLPAGADLAE

SEQ ID NO: 299131 - protein, 17 aa, Mycobacterium
AGVILALVSAATFGFSG

SEQ ID NO: 299132 - protein, 27 aa, Mycobacterium
AGVKSAWDLLWRYGGQYVATVLAPVAS

SEQ ID NO: 299133 - protein, 24 aa, Mycobacterium
AGVLAGAVFVHWLIFQSLYRIGAL

SEQ ID NO: 299134 - protein, 17 aa, Mycobacterium
AGVLAGYLADLALGDPA

SEQ ID NO: 299135 - protein, 20 aa, Mycobacterium
AGVLAPIGIVLPMSVGAILM

SEQ ID NO: 299136 - protein, 17 aa, Mycobacterium
AGVLFPSYFQQLLDHTP

SEQ ID NO: 299137 - protein, 17 aa, Mycobacterium
AGVLGFGSLIGYVRATV

SEQ ID NO: 299138 - protein, 18 aa, Mycobacterium
AGVLLLAMFLRLGGETLA

SEQ ID NO: 299139 - protein, 27 aa, Mycobacterium
AGVLMLYTIVIIRGFRTALAVRDSFGK

SEQ ID NO: 299140 - protein, 18 aa, Mycobacterium
AGVLVLIAFCANLVGDGL

SEQ ID NO: 299141 - protein, 17 aa, Mycobacterium
AGVLYFFFVLPRWPELM

SEQ ID NO: 299142 - protein, 20 aa, Mycobacterium
AGVNLWKFFLYIKDEMFLAL

SEQ ID NO: 299143 - protein, 25 aa, Mycobacterium
AGVNPTWFGWLIVAWLWLTVVFANL

SEQ ID NO: 299144 - protein, 18 aa, Mycobacterium
AGVPGRRGPGGGPGGKGP

SEQ ID NO: 299145 - protein, 17 aa, Mycobacterium
AGVPVGNVISVRLAGDH

SEQ ID NO: 299146 - protein, 25 aa, Mycobacterium
AGVPWPRHKLFAVIAGLVTFVLVGA

SEQ ID NO: 299147 - protein, 24 aa, Mycobacterium
AGVREVRDLHIWTVTSGMEAATAH

SEQ ID NO: 299148 - protein, 20 aa, Mycobacterium
AGVRYGFAMAWKVEALTEVF

SEQ ID NO: 299149 - protein, 24 aa, Mycobacterium
AGVSWRARPKLAITGDGLAIRGWL

SEQ ID NO: 299150 - protein, 18 aa, Mycobacterium
AGVTIGRWTIDRKAPPVT

SEQ ID NO: 299151 - protein, 19 aa, Mycobacterium
AGVTLCYTLFGGFLGASLT

SEQ ID NO: 299152 - protein, 25 aa, Mycobacterium
AGVTSVSIPSLWQPYVLSVASLTAG

SEQ ID NO: 299153 - protein, 26 aa, Mycobacterium
AGVTSVSIPSLWQPYVLSVASLTPDG

SEQ ID NO: 299154 - protein, 22 aa, Mycobacterium
AGVVAFRFALPANQPLALVGSA

SEQ ID NO: 299155 - protein, 18 aa, Mycobacterium
AGVVKYALAAPRDVQAGL

SEQ ID NO: 299156 - protein, 25 aa, Mycobacterium
AGVVLACPVWFYQLWAFITPGLYQK

SEQ ID NO: 299157 - protein, 28 aa, Mycobacterium
AGVVLACPVWLYQIWRFITPGLYRNERK

SEQ ID NO: 299158 - protein, 24 aa, Mycobacterium
AGVVPEWLAYTLAVALGVTSLGLA

SEQ ID NO: 299159 - protein, 23 aa, Mycobacterium
AGVVPEWLAYTLAVVLGVASLAL

SEQ ID NO: 299160 - protein, 19 aa, Mycobacterium
AGVVPEWMAYSLAGLLAVA

SEQ ID NO: 299161 - protein, 17 aa, Mycobacterium
AGVVVSVLICLGAALMA

SEQ ID NO: 299162 - protein, 19 aa, Mycobacterium
AGVVYRCRETALGRNVAIK

SEQ ID NO: 299163 - protein, 17 aa, Mycobacterium
AGVYALVGFEVTPATVI

SEQ ID NO: 299164 - protein, 18 aa, Mycobacterium
AGVYLELMIRQHRFTISV

SEQ ID NO: 299165 - protein, 18 aa, Mycobacterium
AGVYYWIVCMAMSAVQDR

SEQ ID NO: 299166 - protein, 20 aa, Mycobacterium
AGWAADRFGTKRMFMGSILV

SEQ ID NO: 299167 - protein, 23 aa, Mycobacterium
AGWLVDRVRPSILIGGGIALMIA

SEQ ID NO: 299168 - protein, 31 aa, Mycobacterium
AGWMVNLKLLMPVFRWQRRDNLLAEADPAAT

SEQ ID NO: 299169 - protein, 21 aa, Mycobacterium
AGWRDVRKAVRAFDIATLTWV

SEQ ID NO: 299170 - protein, 19 aa, Mycobacterium
AGWVLKMALVRLIPQTLRG

SEQ ID NO: 299171 - protein, 28 aa, Mycobacterium
AGYAGLKWKWPAPFLIAPMLVALVTQLP

SEQ ID NO: 299172 - protein, 26 aa, Mycobacterium
AGYELLRPRLGRVLAAIVLAALSLGS

SEQ ID NO: 299173 - protein, 23 aa, Mycobacterium
AGYFLRRRGLEPLSRRQPADAPG

SEQ ID NO: 299174 - protein, 17 aa, Mycobacterium
AGYIAAFSVPSEHGERL

SEQ ID NO: 299175 - protein, 23 aa, Mycobacterium
AGYIVCLLVLFLLAGLGKGSVFK

SEQ ID NO: 299176 - protein, 18 aa, Mycobacterium
AGYLGLANGLGFLAGATV

SEQ ID NO: 299177 - protein, 19 aa, Mycobacterium
AGYLQGRLARYEIPTRITI

SEQ ID NO: 299178 - protein, 27 aa, Mycobacterium
AGYPPAWALCALFPLAAVPLVPAEPGR

SEQ ID NO: 299179 - protein, 25 aa, Mycobacterium
AGYRGELKVALINLDPATPIVVNRG

SEQ ID NO: 299180 - protein, 25 aa, Mycobacterium
AGYRNHLRLPAAVPQQAAGTIRESP

SEQ ID NO: 299181 - protein, 17 aa, Mycobacterium
AGYVRRHPLAALTTVGE

SEQ ID NO: 299182 - protein, 24 aa, Mycobacterium
AHAAELRKRVRILRAVLAGTVVIA

SEQ ID NO: 299183 - protein, 17 aa, Mycobacterium
AHAAGLVHLGVRPEHVL

SEQ ID NO: 299184 - protein, 24 aa, Mycobacterium
AHAALPWLRVAILAAPAILVSMAG

SEQ ID NO: 299185 - protein, 18 aa, Mycobacterium
AHAEVVRFGKAVVLTASK

SEQ ID NO: 299186 - protein, 24 aa, Mycobacterium
AHAFSIQLICRMLGMLASVVSVAM

SEQ ID NO: 299187 - protein, 45 aa, Mycobacterium
AHAPLWREFLRFWTVSFPVVAYRSWRWWLGTAIGFFIVTIALAMW

SEQ ID NO: 299188 - protein, 26 aa, Mycobacterium
AHAPLWRKFIRFWTVSFPVVVYRSWR

SEQ ID NO: 299189 - protein, 25 aa, Mycobacterium
AHAPSVRIGRHWVSFAWLAVGALVA

SEQ ID NO: 299190 - protein, 19 aa, Mycobacterium
AHAPYLQWLAQQSANSAAA

SEQ ID NO: 299191 - protein, 20 aa, Mycobacterium
AHASPDLWDALDHAVTAART

SEQ ID NO: 299192 - protein, 21 aa, Mycobacterium
AHASPDLWDALEHAVTAARTL

SEQ ID NO: 299193 - protein, 19 aa, Mycobacterium
AHCVSAWGHDFRPTYLGSS

SEQ ID NO: 299194 - protein, 29 aa, Mycobacterium
AHDYSPEFGCLFKGVARGVKEFAPLIGTV

SEQ ID NO: 299195 - protein, 24 aa, Mycobacterium
AHEFLRKRVPELTKRQRFWTALYL

SEQ ID NO: 299196 - protein, 24 aa, Mycobacterium
AHEFLRRRVPQLTKRQRFWTALYL

SEQ ID NO: 299197 - protein, 23 aa, Mycobacterium
AHFEFTRAPLLLVIAVPIALARL

SEQ ID NO: 299198 - protein, 20 aa, Mycobacterium
AHFLTFRFLLGVGESPNSPN

SEQ ID NO: 299199 - protein, 18 aa, Mycobacterium
AHFTEWGRQFWRVTGDYF

SEQ ID NO: 299200 - protein, 20 aa, Mycobacterium
AHGDRTALITAERHVTYREL

SEQ ID NO: 299201 - protein, 18 aa, Mycobacterium
AHGLGEAIPLRFVTGFAL

SEQ ID NO: 299202 - protein, 25 aa, Mycobacterium
AHGLGMPIDLGWQLWAYGVFAIAAV

SEQ ID NO: 299203 - protein, 20 aa, Mycobacterium
AHGLPSIVIAISMVSLGVLL

SEQ ID NO: 299204 - protein, 31 aa, Mycobacterium
AHGLTAFGFATFAIWWAWMNFTWFASAYDTD

SEQ ID NO: 299205 - protein, 26 aa, Mycobacterium
AHGNIYPRERVDAALSNYFRPENLTA

SEQ ID NO: 299206 - protein, 19 aa, Mycobacterium
AHGSCSGVTPAVYFSDAVT

SEQ ID NO: 299207 - protein, 17 aa, Mycobacterium
AHHGLLWALLLVVVVAV

SEQ ID NO: 299208 - protein, 26 aa, Mycobacterium
AHHRITRWEWMWAVALAAALAVVIIV

SEQ ID NO: 299209 - protein, 18 aa, Mycobacterium
AHHYLRMIYDLLAAGIAF

SEQ ID NO: 299210 - protein, 27 aa, Mycobacterium
AHIAAPRAKLFTALFLILGLVVVGEVA

SEQ ID NO: 299211 - protein, 17 aa, Mycobacterium
AHIAVGFLLKISPSGVI

SEQ ID NO: 299212 - protein, 21 aa, Mycobacterium
AHILLGVAGYNFGRFCLTPLP

SEQ ID NO: 299213 - protein, 19 aa, Mycobacterium
AHIQIAWRTGNFAIYVITI

SEQ ID NO: 299214 - protein, 21 aa, Mycobacterium
AHIRMALRTGNFVIYAITIVC

SEQ ID NO: 299215 - protein, 19 aa, Mycobacterium
AHISEALKRLPGYGTALGE

SEQ ID NO: 299216 - protein, 18 aa, Mycobacterium
AHKLCGRDVVVVSASGEE

SEQ ID NO: 299217 - protein, 19 aa, Mycobacterium
AHKLCGRDVVVVSASGEEI

SEQ ID NO: 299218 - protein, 18 aa, Mycobacterium
AHLAVVFLVADLVLVTFA

SEQ ID NO: 299219 - protein, 22 aa, Mycobacterium
AHLCFLAALLPLARRTSGRLTA

SEQ ID NO: 299220 - protein, 17 aa, Mycobacterium
AHLHPALMLLAVFAGLQ

SEQ ID NO: 299221 - protein, 28 aa, Mycobacterium
AHLLDTLPLLIGWLWPLWDSRRRTFADL

SEQ ID NO: 299222 - protein, 25 aa, Mycobacterium
AHLLLRFDRGRWLAVDNNTLNGVYL

SEQ ID NO: 299223 - protein, 24 aa, Mycobacterium
AHLLLRVDWQVALLLGAIVSSTDA

SEQ ID NO: 299224 - protein, 17 aa, Mycobacterium
AHLLQPLVMGRAVSIHP

SEQ ID NO: 299225 - protein, 18 aa, Mycobacterium
AHLLQPLVMGRAVSIHPL

SEQ ID NO: 299226 - protein, 21 aa, Mycobacterium
AHLLRAGNRVSYFLVQPTVGF

SEQ ID NO: 299227 - protein, 21 aa, Mycobacterium
AHLPLLDPVRAIPVIGPPLAA

SEQ ID NO: 299228 - protein, 17 aa, Mycobacterium
AHLPWGKFFTYPQTWGM

SEQ ID NO: 299229 - protein, 25 aa, Mycobacterium
AHLQRARVPMPIIPVSSLLRSHAVT

SEQ ID NO: 299230 - protein, 25 aa, Mycobacterium
AHLQRARVPMPIVPVSSLLRSHAVT

SEQ ID NO: 299231 - protein, 17 aa, Mycobacterium
AHLRARHDLVLEAFTAV

SEQ ID NO: 299232 - protein, 17 aa, Mycobacterium
AHLRARHDLVLEMFTAV

SEQ ID NO: 299233 - protein, 19 aa, Mycobacterium
AHLRARHDLVLEMFTAVHA

SEQ ID NO: 299234 - protein, 24 aa, Mycobacterium
AHLRRRPAEVIPVGRPWMDRADFG

SEQ ID NO: 299235 - protein, 24 aa, Mycobacterium
AHLRRRPAEVIPVGRPWMGRDDWK

SEQ ID NO: 299236 - protein, 19 aa, Mycobacterium
AHLVLRFDQGRWIAIDNGS

SEQ ID NO: 299237 - protein, 18 aa, Mycobacterium
AHPARPGLNDAIALLLVI

SEQ ID NO: 299238 - protein, 33 aa, Mycobacterium
AHPDARFAIIGFAARPSIDWPLSADTWSLQPAV

SEQ ID NO: 299239 - protein, 24 aa, Mycobacterium
AHPGSGGVSLWWMIGLLAAAGVLG

SEQ ID NO: 299240 - protein, 22 aa, Mycobacterium
AHPHPPVSIWVLAPCVATVAVL

SEQ ID NO: 299241 - protein, 27 aa, Mycobacterium
AHPHRKRIRIAIVVGTVLTILVAVGIW

SEQ ID NO: 299242 - protein, 26 aa, Mycobacterium
AHPPFSVVVRRRWRPAARIETVTGTP

SEQ ID NO: 299243 - protein, 23 aa, Mycobacterium
AHPQFFGNSTFSLFVTVAGTCVA

SEQ ID NO: 299244 - protein, 34 aa, Mycobacterium
AHPVIGPWLDRLQAFDVFSSFWFTAIYVLLFVSL

SEQ ID NO: 299245 - protein, 24 aa, Mycobacterium
AHPVLGRWVAHFNIVVAAALTPAA

SEQ ID NO: 299246 - protein, 21 aa, Mycobacterium
AHQICPVGVLLATKTDLYPHW

SEQ ID NO: 299247 - protein, 18 aa, Mycobacterium
AHQLCPAGVVVATKTDLY

SEQ ID NO: 299248 - protein, 29 aa, Mycobacterium
AHQRGAVVLSICLGAFVLAAAGLLDGRPA

SEQ ID NO: 299249 - protein, 22 aa, Mycobacterium
AHRCAYAGLLLLGFAMAGVVLI

SEQ ID NO: 299250 - protein, 18 aa, Mycobacterium
AHRLFPGAILHFEDFGPL

SEQ ID NO: 299251 - protein, 26 aa, Mycobacterium
AHRLFPRAMLHFEDFGPTNARMILRT

SEQ ID NO: 299252 - protein, 17 aa, Mycobacterium
AHRRWGLAVPAVLAVCL

SEQ ID NO: 299253 - protein, 25 aa, Mycobacterium
AHRVGEPFGSLILAAAVTIIEVALI

SEQ ID NO: 299254 - protein, 25 aa, Mycobacterium
AHRVGEPFGSLVLAIAVTVIEVALI

SEQ ID NO: 299255 - protein, 25 aa, Mycobacterium
AHRVGEPFGSLVLAVAVTVIEVALI

SEQ ID NO: 299256 - protein, 25 aa, Mycobacterium
AHRWMLRVRWLIEPTLVVLTVGLLV

SEQ ID NO: 299257 - protein, 19 aa, Mycobacterium
AHSALTERILEFARTQAAL

SEQ ID NO: 299258 - protein, 21 aa, Mycobacterium
AHSLIPIVIGYIFAHYLTYLV

SEQ ID NO: 299259 - protein, 21 aa, Mycobacterium
AHSLIPIVLGYVFAHYLTYLI

SEQ ID NO: 299260 - protein, 22 aa, Mycobacterium
AHSVRVWLMLGVLLFSVLLSVR

SEQ ID NO: 299261 - protein, 17 aa, Mycobacterium
AHSVWLAALGVGFLGML

SEQ ID NO: 299262 - protein, 22 aa, Mycobacterium
AHTGWLRSARLVGVASMALAVL

SEQ ID NO: 299263 - protein, 20 aa, Mycobacterium
AHTVRLVIVLAMIALAGAAF

SEQ ID NO: 299264 - protein, 20 aa, Mycobacterium
AHTVYPGWRDAIAAAVLVGV

SEQ ID NO: 299265 - protein, 17 aa, Mycobacterium
AHVADRLFGLDGLTEHG

SEQ ID NO: 299266 - protein, 20 aa, Mycobacterium
AHVAGGLFLKVGSSGMIFQT

SEQ ID NO: 299267 - protein, 19 aa, Mycobacterium
AHVGFSIWYLWSVMMLFMP

SEQ ID NO: 299268 - protein, 18 aa, Mycobacterium
AHVIPLFAVYTFGPDILR

SEQ ID NO: 299269 - protein, 20 aa, Mycobacterium
AHVMSTYLSHDWGRDWGSLR

SEQ ID NO: 299270 - protein, 26 aa, Mycobacterium
AHVMSTYLSHDWGRDWGSLRKFDTIA

SEQ ID NO: 299271 - protein, 19 aa, Mycobacterium
AHVRVRVQMWWDPFSDPDG

SEQ ID NO: 299272 - protein, 26 aa, Mycobacterium
AHVSDLRAAFEWQRPQLDTATHGDHG

SEQ ID NO: 299273 - protein, 20 aa, Mycobacterium
AHVWSGRVAVLASVPVAVHC

SEQ ID NO: 299274 - protein, 22 aa, Mycobacterium
AHVYRYYGRIAPWQQLWDDWRT

SEQ ID NO: 299275 - protein, 18 aa, Mycobacterium
AHWEPWIWALIVAGFGFM

SEQ ID NO: 299276 - protein, 20 aa, Mycobacterium
AHYFILIGLFGIFVAGCTAM

SEQ ID NO: 299277 - protein, 28 aa, Mycobacterium
AIAAAALPWLRIAIFGAPAILVSLAGNG

SEQ ID NO: 299278 - protein, 24 aa, Mycobacterium
AIAAAWWLTYPLLGLKGVVIGEIV

SEQ ID NO: 299279 - protein, 20 aa, Mycobacterium
AIAACAAGVYLVDVRPKLLE

SEQ ID NO: 299280 - protein, 23 aa, Mycobacterium
AIAACAVALIVLSGFLVDLCNTT

SEQ ID NO: 299281 - protein, 19 aa, Mycobacterium
AIAAFMWLANWRFVAQKTD

SEQ ID NO: 299282 - protein, 18 aa, Mycobacterium
AIAAQWLVPIGVLITLLV

SEQ ID NO: 299283 - protein, 20 aa, Mycobacterium
AIAATVCRSFDLAIEIPLYA

SEQ ID NO: 299284 - protein, 22 aa, Mycobacterium
AIAAVLGALVARTGSPRVATAL

SEQ ID NO: 299285 - protein, 19 aa, Mycobacterium
AIAAWLVWRTGPSPETRRA

SEQ ID NO: 299286 - protein, 25 aa, Mycobacterium
AIADLYPRYVCDYGTPSHPPSAADY

SEQ ID NO: 299287 - protein, 18 aa, Mycobacterium
AIADRPGIAPGFTAGAVA

SEQ ID NO: 299288 - protein, 24 aa, Mycobacterium
AIAEARRAGVRVVMITGDHPRAAA

SEQ ID NO: 299289 - protein, 19 aa, Mycobacterium
AIAEGRCSVLHLWADAGGA

SEQ ID NO: 299290 - protein, 24 aa, Mycobacterium
AIAEIWLDLDRFGIWEFGGYGAAA

SEQ ID NO: 299291 - protein, 25 aa, Mycobacterium
AIAERLRPGGIVQREIATRTVAVFA

SEQ ID NO: 299292 - protein, 23 aa, Mycobacterium
AIAFAVGILAFFSRGRLRRARLA

SEQ ID NO: 299293 - protein, 29 aa, Mycobacterium
AIAFGYGWQEWVPAGAIAFGLIVVTNAAK

SEQ ID NO: 299294 - protein, 22 aa, Mycobacterium
AIAFILWYTCVRGLGTGRAGLL

SEQ ID NO: 299295 - protein, 25 aa, Mycobacterium
AIAFLIFAGWAWREGREDPAGADEV

SEQ ID NO: 299296 - protein, 17 aa, Mycobacterium
AIAFRWLKRAHYRNFPR

SEQ ID NO: 299297 - protein, 19 aa, Mycobacterium
AIAFTLPVAIAITVLLIVL

SEQ ID NO: 299298 - protein, 18 aa, Mycobacterium
AIAGCTLTGLALCAALMA

SEQ ID NO: 299299 - protein, 22 aa, Mycobacterium
AIAGLVLCWSIIGGLIVGVVAI

SEQ ID NO: 299300 - protein, 21 aa, Mycobacterium
AIAIVALAAIIGRLYEEQRIE

SEQ ID NO: 299301 - protein, 22 aa, Mycobacterium
AIALCPLVVPILAFGATTHLYL

SEQ ID NO: 299302 - protein, 26 aa, Mycobacterium
AIALGPRGNETFNHVKDGDCLNWPGR

SEQ ID NO: 299303 - protein, 27 aa, Mycobacterium
AIALLLIAVVLVLGFWQPGFFVTTKLD

SEQ ID NO: 299304 - protein, 34 aa, Mycobacterium
AIALSCCAIGYQLRDRVALVLGQVFGGLGAAVYL

SEQ ID NO: 299305 - protein, 17 aa, Mycobacterium
AIALVALLILNAFLTPG

SEQ ID NO: 299306 - protein, 20 aa, Mycobacterium
AIANMVSWQGLNVWAAQAMV

SEQ ID NO: 299307 - protein, 23 aa, Mycobacterium
AIARGVAMLLLLVHLALVAVTAL

SEQ ID NO: 299308 - protein, 27 aa, Mycobacterium
AIARIPLGVAVTIEFAGPLMLAAAFSR

SEQ ID NO: 299309 - protein, 32 aa, Mycobacterium
AIARIYEIRCLKPRFGTVLTVVGHTILTLGFG

SEQ ID NO: 299310 - protein, 24 aa, Mycobacterium
AIARPEPLARWLARSTTVYLKLFG

SEQ ID NO: 299311 - protein, 18 aa, Mycobacterium
AIARSLASAGLSWVLGVA

SEQ ID NO: 299312 - protein, 18 aa, Mycobacterium
AIARWSSWVHLPLTHVTP

SEQ ID NO: 299313 - protein, 24 aa, Mycobacterium
AIASGWMLLLNVLKPTGIVGDSAI

SEQ ID NO: 299314 - protein, 27 aa, Mycobacterium
AIASLGLRFYLNWITGTGYTYGALATP

SEQ ID NO: 299315 - protein, 19 aa, Mycobacterium
AIASLWLLYRYYRTRDPLF

SEQ ID NO: 299316 - protein, 24 aa, Mycobacterium
AIATGCPFCRVMMTDGVDDVSATR

SEQ ID NO: 299317 - protein, 19 aa, Mycobacterium
AIATGFLVERIIPYDPEWN

SEQ ID NO: 299318 - protein, 20 aa, Mycobacterium
AIAVAALGICAWRAREELDE

SEQ ID NO: 299319 - protein, 25 aa, Mycobacterium
AIAVRGVRNLPCMDVPGKRAPTVEL

SEQ ID NO: 299320 - protein, 19 aa, Mycobacterium
AIAVSSALRSHALQLNDKE

SEQ ID NO: 299321 - protein, 18 aa, Mycobacterium
AIAVTALMTAVILLGQLV

SEQ ID NO: 299322 - protein, 23 aa, Mycobacterium
AIAVVGLGVRFPGGGDDIHGPDD

SEQ ID NO: 299323 - protein, 23 aa, Mycobacterium
AICALPVVGMRCGIGDSRANPPG

SEQ ID NO: 299324 - protein, 18 aa, Mycobacterium
AICASAIAVALAIVALLS

SEQ ID NO: 299325 - protein, 18 aa, Mycobacterium
AIDAPILVGGVVRADGYT

SEQ ID NO: 299326 - protein, 25 aa, Mycobacterium
AIDAWLRLCQTYGWSPGVMGASSQG

SEQ ID NO: 299327 - protein, 17 aa, Mycobacterium
AIDFAGGTAVHINAGTA

SEQ ID NO: 299328 - protein, 17 aa, Mycobacterium
AIDKVPALAPGGRPMKL

SEQ ID NO: 299329 - protein, 24 aa, Mycobacterium
AIDPTAAINMAWRAAGGPNGPLGA

SEQ ID NO: 299330 - protein, 25 aa, Mycobacterium
AIDPYRLAIRIELAGVEAATGTYSV

SEQ ID NO: 299331 - protein, 27 aa, Mycobacterium
AIDRWIPVFPLWVAVVLVLNQLAAEVA

SEQ ID NO: 299332 - protein, 19 aa, Mycobacterium
AIDVIRIVSLVGVVLGHTI

SEQ ID NO: 299333 - protein, 32 aa, Mycobacterium
AIDYAMRNWMWFIGGIVFTFVLLNTMFGWWVL

SEQ ID NO: 299334 - protein, 18 aa, Mycobacterium
AIDYLALAIRHYLDSGSF

SEQ ID NO: 299335 - protein, 22 aa, Mycobacterium
AIEAWGRSVLKAAKYVAPQPDR

SEQ ID NO: 299336 - protein, 23 aa, Mycobacterium
AIEDYFLRLSISEMLEVCQGRYA

SEQ ID NO: 299337 - protein, 27 aa, Mycobacterium
AIEHPLWSSFVWRNEVADTFVETVAAP

SEQ ID NO: 299338 - protein, 22 aa, Mycobacterium
AIELKYRLGYDDSLDVVGVHLV

SEQ ID NO: 299339 - protein, 23 aa, Mycobacterium
AIEPTLRVFIDMAYDRDTGPGTT

SEQ ID NO: 299340 - protein, 28 aa, Mycobacterium
AIERGEPWPPPVPEPAFKKAIAEQAAAA

SEQ ID NO: 299341 - protein, 17 aa, Mycobacterium
AIEYGGQWISWEQVGTL

SEQ ID NO: 299342 - protein, 18 aa, Mycobacterium
AIFAALIGVHLALVWFQK

SEQ ID NO: 299343 - protein, 23 aa, Mycobacterium
AIFAIPLARKAFMLDPGNLAVTG

SEQ ID NO: 299344 - protein, 25 aa, Mycobacterium
AIFAQLRFGNELSYKARFGNVSGLE

SEQ ID NO: 299345 - protein, 19 aa, Mycobacterium
AIFLLPIALVLDILTAFPI

SEQ ID NO: 299346 - protein, 23 aa, Mycobacterium
AIFMGLYLRFLRPGRVSEVSLIG

SEQ ID NO: 299347 - protein, 22 aa, Mycobacterium
AIFTGLATLVWLLIASTPDDAS

SEQ ID NO: 299348 - protein, 17 aa, Mycobacterium
AIFVVGSGIDIPMIKPA

SEQ ID NO: 299349 - protein, 17 aa, Mycobacterium
AIGALLVPRRTRRTAAL

SEQ ID NO: 299350 - protein, 19 aa, Mycobacterium
AIGALMLIPGVPGRSSVSV

SEQ ID NO: 299351 - protein, 19 aa, Mycobacterium
AIGALMLIPSVPGRGSASV

SEQ ID NO: 299352 - protein, 19 aa, Mycobacterium
AIGAWCLVDPNSFAEAVEF

SEQ ID NO: 299353 - protein, 18 aa, Mycobacterium
AIGAYPWVFIPLIAAAAL

SEQ ID NO: 299354 - protein, 35 aa, Mycobacterium
AIGCVYAFFLTFFVYRDIPLSGFIPILQRTARTLG

SEQ ID NO: 299355 - protein, 18 aa, Mycobacterium
AIGDIVFGTLTLLGASIF

SEQ ID NO: 299356 - protein, 19 aa, Mycobacterium
AIGDRFGRQPAMVISILCF

SEQ ID NO: 299357 - protein, 20 aa, Mycobacterium
AIGDRYGAVKVYRWSMLAFL

SEQ ID NO: 299358 - protein, 25 aa, Mycobacterium
AIGDRYGRRGALLIGLVVFSAGSMA

SEQ ID NO: 299359 - protein, 19 aa, Mycobacterium
AIGEFGSIVLIGGAIPGET

SEQ ID NO: 299360 - protein, 18 aa, Mycobacterium
AIGFGWALVVLLATFVLG

SEQ ID NO: 299361 - protein, 17 aa, Mycobacterium
AIGFLYLLWLTRGLTRQ

SEQ ID NO: 299362 - protein, 30 aa, Mycobacterium
AIGGFLADWVPFLLGAVVALLWNYPLATLL

SEQ ID NO: 299363 - protein, 18 aa, Mycobacterium
AIGIGWGITWLGYAGDYS

SEQ ID NO: 299364 - protein, 21 aa, Mycobacterium
AIGILISWGLVELFPGSLAAP

SEQ ID NO: 299365 - protein, 35 aa, Mycobacterium
AIGIVVLCYLWLDRWEPEPSRLLVLAFVWGASLAV

SEQ ID NO: 299366 - protein, 22 aa, Mycobacterium
AIGLCGFALVLALDAVRNTSMA

SEQ ID NO: 299367 - protein, 18 aa, Mycobacterium
AIGMRIAPFVLPLAVTIF

SEQ ID NO: 299368 - protein, 28 aa, Mycobacterium
AIGMSFVIQEFVHWVLPKIAKGYGGSNA

SEQ ID NO: 299369 - protein, 20 aa, Mycobacterium
AIGMTIPIAALEIMRARLTP

SEQ ID NO: 299370 - protein, 23 aa, Mycobacterium
AIGPFAGGGFAWAGQSGIQVSFA

SEQ ID NO: 299371 - protein, 24 aa, Mycobacterium
AIGPKVGPLVIRRRDVVLVTGPWL

SEQ ID NO: 299372 - protein, 17 aa, Mycobacterium
AIGRGLKGIEGIRGGEA

SEQ ID NO: 299373 - protein, 23 aa, Mycobacterium
AIGRRRLAPFAVAIVIAVFCVTL

SEQ ID NO: 299374 - protein, 19 aa, Mycobacterium
AIGSALFAYGHFGGVDAGY

SEQ ID NO: 299375 - protein, 18 aa, Mycobacterium
AIGSALFSYGNFGAVDAG

SEQ ID NO: 299376 - protein, 21 aa, Mycobacterium
AIGSGIALVFTDKAIYLRVGL

SEQ ID NO: 299377 - protein, 18 aa, Mycobacterium
AIGTWLILSRCVLPRLGR

SEQ ID NO: 299378 - protein, 21 aa, Mycobacterium
AIGVALGWRPPLAGLALGAVI

SEQ ID NO: 299379 - protein, 25 aa, Mycobacterium
AIGVRPRGPLAFQVADRMAYISDAL

SEQ ID NO: 299380 - protein, 25 aa, Mycobacterium
AIGYGLGVFTVWLVRYMRSQNSSPP

SEQ ID NO: 299381 - protein, 19 aa, Mycobacterium
AIHAVCFALDPILFGSLRR

SEQ ID NO: 299382 - protein, 17 aa, Mycobacterium
AIHISTDIFPAVNSDKE

SEQ ID NO: 299383 - protein, 18 aa, Mycobacterium
AIHLLASMTMVWLSVLLY

SEQ ID NO: 299384 - protein, 17 aa, Mycobacterium
AIIALAVTVCVLPALQF

SEQ ID NO: 299385 - protein, 23 aa, Mycobacterium
AIIAVSIPLPWMAVLIANDRPPR

SEQ ID NO: 299386 - protein, 25 aa, Mycobacterium
AIIAVSLPMLWWRFRRDDRAALTGI

SEQ ID NO: 299387 - protein, 18 aa, Mycobacterium
AIIGCMAGLTAAFVVLTA

SEQ ID NO: 299388 - protein, 19 aa, Mycobacterium
AIIGGRPSPTDGFVGMAPD

SEQ ID NO: 299389 - protein, 17 aa, Mycobacterium
AIIGLAALPGYRTSYDD

SEQ ID NO: 299390 - protein, 17 aa, Mycobacterium
AIILIGLCALLLIRGVS

SEQ ID NO: 299391 - protein, 19 aa, Mycobacterium
AIILYWFSNNIWTFGQQHY

SEQ ID NO: 299392 - protein, 25 aa, Mycobacterium
AIISAVAIGVFWWLKRELGDHTRQD

SEQ ID NO: 299393 - protein, 17 aa, Mycobacterium
AIIYGAIVAVVSCQKGL

SEQ ID NO: 299394 - protein, 23 aa, Mycobacterium
AIKASRYDAGLVIITALVGVAVN

SEQ ID NO: 299395 - protein, 17 aa, Mycobacterium
AIKEFDTALSMSPDFPG

SEQ ID NO: 299396 - protein, 18 aa, Mycobacterium
AILANRLQLAELMQSNVY

SEQ ID NO: 299397 - protein, 24 aa, Mycobacterium
AILCLLACWRAGNDPELLAIAEAC

SEQ ID NO: 299398 - protein, 22 aa, Mycobacterium
AILGTLGVFFGMLIVYKTGAIR

SEQ ID NO: 299399 - protein, 20 aa, Mycobacterium
AILHYIAMWFAVFYTGTGAW

SEQ ID NO: 299400 - protein, 24 aa, Mycobacterium
AILIATSISMIFGELVPKNLAVAK

SEQ ID NO: 299401 - protein, 25 aa, Mycobacterium
AILIGMGIAWPLAMVVAIMSGLVLG

SEQ ID NO: 299402 - protein, 24 aa, Mycobacterium
AILIMPAIGAWVLVATLKAGLAHQ

SEQ ID NO: 299403 - protein, 17 aa, Mycobacterium
AILKRYGPLTPPRAVAV

SEQ ID NO: 299404 - protein, 24 aa, Mycobacterium
AILLAMYWPLGVVVLVSIVPIAAT

SEQ ID NO: 299405 - protein, 24 aa, Mycobacterium
AILLAVAGLGWWWSVAMATMQGDS

SEQ ID NO: 299406 - protein, 20 aa, Mycobacterium
AILLCLVLGVAIVTQVRQTE

SEQ ID NO: 299407 - protein, 19 aa, Mycobacterium
AILLFPGFFVPGYLFVGVP

SEQ ID NO: 299408 - protein, 25 aa, Mycobacterium
AILLLAGRRCDAWGHLLGTAAALAS

SEQ ID NO: 299409 - protein, 25 aa, Mycobacterium
AILLLVYLLFRPVRFYYDGENHRFT

SEQ ID NO: 299410 - protein, 27 aa, Mycobacterium
AILLPLGFSGAFAWFAGLSLLAGAVAI

SEQ ID NO: 299411 - protein, 25 aa, Mycobacterium
AILLVAVICTVVILGGGDSGSVSAT

SEQ ID NO: 299412 - protein, 24 aa, Mycobacterium
AILPGLTIRAVRAFYRQLDSADVE

SEQ ID NO: 299413 - protein, 17 aa, Mycobacterium
AILPVHVYEPIAGISTQ

SEQ ID NO: 299414 - protein, 19 aa, Mycobacterium
AILVGGFWLSLGVIGIDLA

SEQ ID NO: 299415 - protein, 35 aa, Mycobacterium
AIMLHLLRHFRWHVPAGYQPRMTWGTGPTPADGLP

SEQ ID NO: 299416 - protein, 19 aa, Mycobacterium
AIMVAWRWAPAKLAPIPGP

SEQ ID NO: 299417 - protein, 19 aa, Mycobacterium
AINAVPLRVAIFYIGALLA

SEQ ID NO: 299418 - protein, 27 aa, Mycobacterium
AINFLIVAAVIYFVIVVPFKKIKERDA

SEQ ID NO: 299419 - protein, 23 aa, Mycobacterium
AINFLIVAAVLYFVIMLPYKKLR

SEQ ID NO: 299420 - protein, 23 aa, Mycobacterium
AINHIPLRMQVWQGAVIAAAAAL

SEQ ID NO: 299421 - protein, 25 aa, Mycobacterium
AINKGISPLGCWPGSSALPTVSVPG

SEQ ID NO: 299422 - protein, 25 aa, Mycobacterium
AINKGISPLGCWPGSSALPTVSVPP

SEQ ID NO: 299423 - protein, 23 aa, Mycobacterium
AINRLRAPLKVAHDYSPEFGCLF

SEQ ID NO: 299424 - protein, 17 aa, Mycobacterium
AINRWAQRPRVWWAVAI

SEQ ID NO: 299425 - protein, 17 aa, Mycobacterium
AIPALARNKENFLTYGG

SEQ ID NO: 299426 - protein, 32 aa, Mycobacterium
AIPDELKAAIAAGIGCFIAFIGFVDAGFVRRV

SEQ ID NO: 299427 - protein, 18 aa, Mycobacterium
AIPISFVVLVWIFGGLYA

SEQ ID NO: 299428 - protein, 20 aa, Mycobacterium
AIPIVLGMILLVIPLFNLSL

SEQ ID NO: 299429 - protein, 24 aa, Mycobacterium
AIPLCVICAGLSINVWIGYLPTVH

SEQ ID NO: 299430 - protein, 22 aa, Mycobacterium
AIPLGGFCDIAGMTSVDEIAPE

SEQ ID NO: 299431 - protein, 23 aa, Mycobacterium
AIPLSFAVLVWVFGGLVAAALPI

SEQ ID NO: 299432 - protein, 18 aa, Mycobacterium
AIPLSFVVLVWVFGGLLA

SEQ ID NO: 299433 - protein, 20 aa, Mycobacterium
AIPPCPDCRVPGLPPFPGGS

SEQ ID NO: 299434 - protein, 19 aa, Mycobacterium
AIPQLRTAWVSYRRGAPRR

SEQ ID NO: 299435 - protein, 21 aa, Mycobacterium
AIPRMPSWWPLNVTWGGLPLF

SEQ ID NO: 299436 - protein, 25 aa, Mycobacterium
AIPRRFASVHPRYMTPAFGTIVMGI

SEQ ID NO: 299437 - protein, 22 aa, Mycobacterium
AIPYLTVGLVWSFFHADQVQLI

SEQ ID NO: 299438 - protein, 19 aa, Mycobacterium
AIQLARLWGARVFVTASRG

SEQ ID NO: 299439 - protein, 27 aa, Mycobacterium
AIQRFAREQWPILVVSAVFLAALGLVI

SEQ ID NO: 299440 - protein, 30 aa, Mycobacterium
AIQRLVETLLRWFGAKRMPYAMSLTIATAL

SEQ ID NO: 299441 - protein, 26 aa, Mycobacterium
AIRAGLLLWGGWVLVTGVVFSYMDGI

SEQ ID NO: 299442 - protein, 24 aa, Mycobacterium
AIRALRESHDWSLADLAAATGVSI

SEQ ID NO: 299443 - protein, 25 aa, Mycobacterium
AIREFKRLGLTPVLLTGDNPTVARH

SEQ ID NO: 299444 - protein, 25 aa, Mycobacterium
AIRFRGELLLGIVLIGLAYFPLTAQ

SEQ ID NO: 299445 - protein, 25 aa, Mycobacterium
AIRFRGELLLGLLLTGLAYFPLTAQ

SEQ ID NO: 299446 - protein, 29 aa, Mycobacterium
AIRHSGPATGWWAFRSVCTTNGCAATGAR

SEQ ID NO: 299447 - protein, 39 aa, Mycobacterium
AIRLGTFLLVCFLGVIGLFAVFGQLRFGEKTSTYKAEFS

SEQ ID NO: 299448 - protein, 25 aa, Mycobacterium
AIRLLSVPIIVFWLALAAVTNTVVP

SEQ ID NO: 299449 - protein, 18 aa, Mycobacterium
AIRLWARSLAGFTGQVVT

SEQ ID NO: 299450 - protein, 19 aa, Mycobacterium
AIRPRQWVKNLLVLAAPIA

SEQ ID NO: 299451 - protein, 19 aa, Mycobacterium
AIRPRQWVKNVLVLAAPLA

SEQ ID NO: 299452 - protein, 24 aa, Mycobacterium
AIRQAREIFARMTSYATYRIAETI

SEQ ID NO: 299453 - protein, 24 aa, Mycobacterium
AIRQAREIFARMTSYATYRVAETI

SEQ ID NO: 299454 - protein, 33 aa, Mycobacterium
AIRRQLRLFVARRVSFLFLLLLPFALGGLTLLI

SEQ ID NO: 299455 - protein, 17 aa, Mycobacterium
AIRTRWPALADRIERPI

SEQ ID NO: 299456 - protein, 19 aa, Mycobacterium
AISAAWDFVSPILDKFSAG

SEQ ID NO: 299457 - protein, 28 aa, Mycobacterium
AISAMLIYRLISWIFISAIGWVIFFFMF

SEQ ID NO: 299458 - protein, 35 aa, Mycobacterium
AISAMLIYRLISWLLIAAVGWVVFFFVFRTENVDD

SEQ ID NO: 299459 - protein, 26 aa, Mycobacterium
AISAVCVIAALALFKFFTPWGRQFWR

SEQ ID NO: 299460 - protein, 35 aa, Mycobacterium
AISAVCVLAVLVLLRFLTPWGRQYWRITREYFVGP

SEQ ID NO: 299461 - protein, 20 aa, Mycobacterium
AISCLSARRDRLWNLSRLIP

SEQ ID NO: 299462 - protein, 23 aa, Mycobacterium
AISDWQRRHCATGGTVKVHNETD

SEQ ID NO: 299463 - protein, 27 aa, Mycobacterium
AISFCYMCASGSFLGFAFAFGQVLAHN

SEQ ID NO: 299464 - protein, 18 aa, Mycobacterium
AISGRFSLVAVFANLAVT

SEQ ID NO: 299465 - protein, 22 aa, Mycobacterium
AISISIIIAFVAAITLLPSILV

SEQ ID NO: 299466 - protein, 18 aa, Mycobacterium
AISLSRRSSRVIKQNLWA

SEQ ID NO: 299467 - protein, 17 aa, Mycobacterium
AISLVVYLFYLKNKSET

SEQ ID NO: 299468 - protein, 17 aa, Mycobacterium
AISMTWLSIEMVPETPV

SEQ ID NO: 299469 - protein, 20 aa, Mycobacterium
AISPKKSWEGLAGSLVVGTT

SEQ ID NO: 299470 - protein, 17 aa, Mycobacterium
AISPSFEEIGKLAAIAA

SEQ ID NO: 299471 - protein, 18 aa, Mycobacterium
AISPWALYGLLFTIVILF

SEQ ID NO: 299472 - protein, 22 aa, Mycobacterium
AISRAVLHYCERLVTHDTALRA

SEQ ID NO: 299473 - protein, 25 aa, Mycobacterium
AISSGGPELVGFIANLLTPLIGAAL

SEQ ID NO: 299474 - protein, 21 aa, Mycobacterium
AISSLSARRDRLWNLSRLIPA

SEQ ID NO: 299475 - protein, 26 aa, Mycobacterium
AISVDGARIGPNVTIRQAGGAILVDN

SEQ ID NO: 299476 - protein, 19 aa, Mycobacterium
AISVGGLLGALGYATMVRH

SEQ ID NO: 299477 - protein, 22 aa, Mycobacterium
AISVLLTFYPGWVTIGLMAALV

SEQ ID NO: 299478 - protein, 25 aa, Mycobacterium
AISVVFPFHVSRIVLNGSVLDALQL

SEQ ID NO: 299479 - protein, 18 aa, Mycobacterium
AITAAWPGGWWIDPGIGL

SEQ ID NO: 299480 - protein, 19 aa, Mycobacterium
AITALLFVGSAAFAGAAVQ

SEQ ID NO: 299481 - protein, 19 aa, Mycobacterium
AITARRPVISMLRAIGGRR

SEQ ID NO: 299482 - protein, 17 aa, Mycobacterium
AITAVALGWYYLQIPTA

SEQ ID NO: 299483 - protein, 22 aa, Mycobacterium
AITDPRYVSLLSNARSQLQSQI

SEQ ID NO: 299484 - protein, 18 aa, Mycobacterium
AITDRLDGLLARNYGMAT

SEQ ID NO: 299485 - protein, 23 aa, Mycobacterium
AITGLRMNHAYVRPGGLAQDLPD

SEQ ID NO: 299486 - protein, 25 aa, Mycobacterium
AITKRLPTALGLIALVTFVLLFLLT

SEQ ID NO: 299487 - protein, 18 aa, Mycobacterium
AITLRDLRIPAIGLALLL

SEQ ID NO: 299488 - protein, 19 aa, Mycobacterium
AITNVCWPRTPEAPWYDNY

SEQ ID NO: 299489 - protein, 19 aa, Mycobacterium
AITRRSQRLFVAHWTSTGR

SEQ ID NO: 299490 - protein, 18 aa, Mycobacterium
AITTLWTYTPENIDTLPD

SEQ ID NO: 299491 - protein, 23 aa, Mycobacterium
AITVETRRIWFFTTNEMADSSRM

SEQ ID NO: 299492 - protein, 18 aa, Mycobacterium
AITVLMAMVLLRERISGL

SEQ ID NO: 299493 - protein, 27 aa, Mycobacterium
AIVALLWLIKRLEILFVPVALATMVAA

SEQ ID NO: 299494 - protein, 18 aa, Mycobacterium
AIVDPAFIRPLPRLHGSV

SEQ ID NO: 299495 - protein, 18 aa, Mycobacterium
AIVFGAIVAVVSSQKACP

SEQ ID NO: 299496 - protein, 24 aa, Mycobacterium
AIVGGATGWLVWQTQRAEQDQRMN

SEQ ID NO: 299497 - protein, 19 aa, Mycobacterium
AIVGLKLDLIRGVSLPMIA

SEQ ID NO: 299498 - protein, 20 aa, Mycobacterium
AIVGVLWVLFGFSMVFGTSY

SEQ ID NO: 299499 - protein, 27 aa, Mycobacterium
AIVICLVARWRGLRALVGILVAFLVLA

SEQ ID NO: 299500 - protein, 19 aa, Mycobacterium
AIVILRLVQGLAVGGEWSG

SEQ ID NO: 299501 - protein, 26 aa, Mycobacterium
AIVITVCLRQFFAAWENRQWLKAAAE

SEQ ID NO: 299502 - protein, 26 aa, Mycobacterium
AIVLRDLRIPAIGLVLLLLSSLIVGA

SEQ ID NO: 299503 - protein, 17 aa, Mycobacterium
AIVMLFGATFGFFYLGM

SEQ ID NO: 299504 - protein, 21 aa, Mycobacterium
AIVMVCFHLGILLSIPMGVPL

SEQ ID NO: 299505 - protein, 25 aa, Mycobacterium
AIVPARALLGLAVGWLVGSLVVLVV

SEQ ID NO: 299506 - protein, 20 aa, Mycobacterium
AIVPAVAWVILALRSGRLGV

SEQ ID NO: 299507 - protein, 20 aa, Mycobacterium
AIVPLPWVIQAPRLFAGQID

SEQ ID NO: 299508 - protein, 17 aa, Mycobacterium
AIVSRPPLGEALRNAVL

SEQ ID NO: 299509 - protein, 28 aa, Mycobacterium
AIVSTYLLLPVLRWQYRSPDFESEGSEA

SEQ ID NO: 299510 - protein, 27 aa, Mycobacterium
AIVTLLWLVLRLEILVVPVALATIIAA

SEQ ID NO: 299511 - protein, 25 aa, Mycobacterium
AIVTWVCASLGFGFYVANFGNYNKT

SEQ ID NO: 299512 - protein, 18 aa, Mycobacterium
AIVVAGWGSILLMGVTDP

SEQ ID NO: 299513 - protein, 25 aa, Mycobacterium
AIVYGDPRWLGAAADAARVPRSDLS

SEQ ID NO: 299514 - protein, 25 aa, Mycobacterium
AIWAEEAWGRFWAWDPKETVSFVAW

SEQ ID NO: 299515 - protein, 20 aa, Mycobacterium
AIWLRLNLKESPVFEERPDV

SEQ ID NO: 299516 - protein, 26 aa, Mycobacterium
AIWQLCIVVLLLAIWRGRRLGPVIAE

SEQ ID NO: 299517 - protein, 35 aa, Mycobacterium
AIWQYGIGLPLHWAVAPCSFIFLVAVGADYNLLLV

SEQ ID NO: 299518 - protein, 24 aa, Mycobacterium
AIWRGRRLGPVIAEKLPVIVRASE

SEQ ID NO: 299519 - protein, 24 aa, Mycobacterium
AIYFTLIVFFTFFYVSITFNPDER

SEQ ID NO: 299520 - protein, 19 aa, Mycobacterium
AIYGRWSQKVGWHSAEVSN

SEQ ID NO: 299521 - protein, 17 aa, Mycobacterium
AIYLCWGRGMRPTWRSY

SEQ ID NO: 299522 - protein, 28 aa, Mycobacterium
AIYNYAWLVLQLPFGMIGVTVLTVVMPR

SEQ ID NO: 299523 - protein, 27 aa, Mycobacterium
AIYNYTWLVLMLPFGMIGVTVLTVVMP

SEQ ID NO: 299524 - protein, 25 aa, Mycobacterium
AIYVFCALCAGIAGLMIASNISAAD

SEQ ID NO: 299525 - protein, 17 aa, Mycobacterium
AKAAMRRAVPIGVGIIA

SEQ ID NO: 299526 - protein, 19 aa, Mycobacterium
AKADVLLDCFRPGTCERLG

SEQ ID NO: 299527 - protein, 20 aa, Mycobacterium
AKADVLLDCFRPGTCERLGI

SEQ ID NO: 299528 - protein, 30 aa, Mycobacterium
AKAEYFTGTGLKGWFQRWFFTAVGQVPIDR

SEQ ID NO: 299529 - protein, 30 aa, Mycobacterium
AKAFGMPVPHPWALWLFGVFIMLTVGVAST

SEQ ID NO: 299530 - protein, 21 aa, Mycobacterium
AKAHIKARYTPVVGGEASVVL

SEQ ID NO: 299531 - protein, 26 aa, Mycobacterium
AKAKANKRPGWALLLLALVALVGVVL

SEQ ID NO: 299532 - protein, 28 aa, Mycobacterium
AKANDFKKMLTFFCAKYREAFKDIAGSG

SEQ ID NO: 299533 - protein, 23 aa, Mycobacterium
AKAPCTVNSFASLAAKDYFNDTP

SEQ ID NO: 299534 - protein, 19 aa, Mycobacterium
AKAPCTVNSFASLAQGGYF

SEQ ID NO: 299535 - protein, 17 aa, Mycobacterium
AKAPKVVRPKLTERMAV

SEQ ID NO: 299536 - protein, 21 aa, Mycobacterium
AKAPKVVRPPLRERILLRLSS

SEQ ID NO: 299537 - protein, 17 aa, Mycobacterium
AKAPVLFQIPGGAWTTG

SEQ ID NO: 299538 - protein, 28 aa, Mycobacterium
AKASAWVGALMLGFWAGVLVYFLPRRSW

SEQ ID NO: 299539 - protein, 28 aa, Mycobacterium
AKASAWVGALMLGWWVGLLVYFLPRRSW

SEQ ID NO: 299540 - protein, 26 aa, Mycobacterium
AKASAWVGALVLGWWIGVLVYLLPRR

SEQ ID NO: 299541 - protein, 18 aa, Mycobacterium
AKCIAMSVVLGLPIPLVL

SEQ ID NO: 299542 - protein, 23 aa, Mycobacterium
AKDEFKKAAQIFISPDGHGARYL

SEQ ID NO: 299543 - protein, 25 aa, Mycobacterium
AKDFYLPGIWMYLALAVLFTASVLA

SEQ ID NO: 299544 - protein, 30 aa, Mycobacterium
AKDPRDRYARCADFARALRHRLGTDADVAD

SEQ ID NO: 299545 - protein, 17 aa, Mycobacterium
AKDVPVKPGRGMVAVNY

SEQ ID NO: 299546 - protein, 17 aa, Mycobacterium
AKEACLLVGGQEILVPV

SEQ ID NO: 299547 - protein, 17 aa, Mycobacterium
AKEARLLIDGEEQLVPV

SEQ ID NO: 299548 - protein, 20 aa, Mycobacterium
AKELVIATKMSGEWSKDDVL

SEQ ID NO: 299549 - protein, 26 aa, Mycobacterium
AKELVIATKMSGEWSKDDVLQAYLNI

SEQ ID NO: 299550 - protein, 21 aa, Mycobacterium
AKGFGGFPVGGQWLRTGNPEL

SEQ ID NO: 299551 - protein, 21 aa, Mycobacterium
AKGGIVFRVQQELGVPVKLVG

SEQ ID NO: 299552 - protein, 22 aa, Mycobacterium
AKGGIVFRVQQELGVPVKLVGL

SEQ ID NO: 299553 - protein, 18 aa, Mycobacterium
AKGLRVLAVAERRLTAKQ

SEQ ID NO: 299554 - protein, 25 aa, Mycobacterium
AKGLSRPRVVAVHILRNSLIPVVTF

SEQ ID NO: 299555 - protein, 24 aa, Mycobacterium
AKGLSRPRVVTVHILRNSLIPVVT

SEQ ID NO: 299556 - protein, 18 aa, Mycobacterium
AKGPLLINGQPPVAPPDI

SEQ ID NO: 299557 - protein, 18 aa, Mycobacterium
AKGQCKAVGEIARRLATQ

SEQ ID NO: 299558 - protein, 31 aa, Mycobacterium
AKGQLRQGFSYVWRRRDLFMIMLTVFLVSTF

SEQ ID NO: 299559 - protein, 18 aa, Mycobacterium
AKGTMLITVFVFLGIEGA

SEQ ID NO: 299560 - protein, 18 aa, Mycobacterium
AKHPRLPRHEALKVLGAG

SEQ ID NO: 299561 - protein, 20 aa, Mycobacterium
AKIANYRFSDLVADANPIAS

SEQ ID NO: 299562 - protein, 26 aa, Mycobacterium
AKIASPRARLILVVAVTTPLWASYLV

SEQ ID NO: 299563 - protein, 26 aa, Mycobacterium
AKIDAWRFGWIVSIGRAITGGVGGLL

SEQ ID NO: 299564 - protein, 25 aa, Mycobacterium
AKIGFEMFRILPAAVIVIGLLAFLD

SEQ ID NO: 299565 - protein, 25 aa, Mycobacterium
AKIGFEMFRILPAAVIVIGLLALLD

SEQ ID NO: 299566 - protein, 17 aa, Mycobacterium
AKILLLIFFAAFLMTKR

SEQ ID NO: 299567 - protein, 19 aa, Mycobacterium
AKILLPILLGVLLGGPAAA

SEQ ID NO: 299568 - protein, 20 aa, Mycobacterium
AKINRFRWIRDKELRARFTP

SEQ ID NO: 299569 - protein, 22 aa, Mycobacterium
AKIRCYLRPGFHPDDIDHGPLL

SEQ ID NO: 299570 - protein, 19 aa, Mycobacterium
AKIVKYRFDDLVADANPIA

SEQ ID NO: 299571 - protein, 17 aa, Mycobacterium
AKKEVRGDAKYVQVLET

SEQ ID NO: 299572 - protein, 17 aa, Mycobacterium
AKKEYFTGTGIKGRFLA

SEQ ID NO: 299573 - protein, 19 aa, Mycobacterium
AKKVIKEGVEQAGEQLAKH

SEQ ID NO: 299574 - protein, 17 aa, Mycobacterium
AKLAGAVGLVIGLVAVP

SEQ ID NO: 299575 - protein, 26 aa, Mycobacterium
AKLDAWRFGWIVSIGRAITGGVGGLL

SEQ ID NO: 299576 - protein, 18 aa, Mycobacterium
AKLFLRKAGTIILGTSVV

SEQ ID NO: 299577 - protein, 26 aa, Mycobacterium
AKLGIPSFVVTLAFFLGLQGVTLKLI

SEQ ID NO: 299578 - protein, 18 aa, Mycobacterium
AKLGLPALVQVAALLAVF

SEQ ID NO: 299579 - protein, 17 aa, Mycobacterium
AKLILMAIALICAAAVF

SEQ ID NO: 299580 - protein, 25 aa, Mycobacterium
AKLLCDQRWCWGLLIMLASVGLQAA

SEQ ID NO: 299581 - protein, 25 aa, Mycobacterium
AKLLLEIAPKYAGLIALNVNAEITA

SEQ ID NO: 299582 - protein, 20 aa, Mycobacterium
AKLMRFIPRSVMVGFVNALA

SEQ ID NO: 299583 - protein, 18 aa, Mycobacterium
AKLSRPVAKGALKVGLTP

SEQ ID NO: 299584 - protein, 32 aa, Mycobacterium
AKLTTRTNAPVWKWIAAGVTVVIILGLLTVSG

SEQ ID NO: 299585 - protein, 17 aa, Mycobacterium
AKLVCMVIWLGAATSKL

SEQ ID NO: 299586 - protein, 23 aa, Mycobacterium
AKLWLPAYLSWFVGGMILSVLAV

SEQ ID NO: 299587 - protein, 24 aa, Mycobacterium
AKLWLPGYLVWFIGGMMLAALQPT

SEQ ID NO: 299588 - protein, 20 aa, Mycobacterium
AKLYPLLFLGPMLLLGIRTG

SEQ ID NO: 299589 - protein, 20 aa, Mycobacterium
AKLYPLLFLGPMVVLAIRTG

SEQ ID NO: 299590 - protein, 17 aa, Mycobacterium
AKLYPLLLLIPLVLLAV

SEQ ID NO: 299591 - protein, 21 aa, Mycobacterium
AKNFPVRQLVTNTGWGTGLDI

SEQ ID NO: 299592 - protein, 24 aa, Mycobacterium
AKNLEVLNALSCVKITDEDLEGQA

SEQ ID NO: 299593 - protein, 21 aa, Mycobacterium
AKNRARLGVGASDRVGLVDAI

SEQ ID NO: 299594 - protein, 21 aa, Mycobacterium
AKNVKDVKCNNGVNPTVKKGA

SEQ ID NO: 299595 - protein, 18 aa, Mycobacterium
AKPAVYVGGMLVEDDEDE

SEQ ID NO: 299596 - protein, 24 aa, Mycobacterium
AKPDRPELSLSLLSVSRSGNTLTL

SEQ ID NO: 299597 - protein, 23 aa, Mycobacterium
AKPEAMVGIALFLAFAALPASLH

SEQ ID NO: 299598 - protein, 19 aa, Mycobacterium
AKPGDEVTIRISDFAEQHG

SEQ ID NO: 299599 - protein, 22 aa, Mycobacterium
AKPGRELPAWVSRAVDSPTARW

SEQ ID NO: 299600 - protein, 21 aa, Mycobacterium
AKPKGQVVLPFTGLDNPQRVA

SEQ ID NO: 299601 - protein, 19 aa, Mycobacterium
AKPLGRAMLQFTDQTPGNL

SEQ ID NO: 299602 - protein, 25 aa, Mycobacterium
AKPLKFGHKVVTGMRGSYGGVLIFG

SEQ ID NO: 299603 - protein, 29 aa, Mycobacterium
AKPPFSVGEAISWAWNRFTQNAMALVVPI

SEQ ID NO: 299604 - protein, 20 aa, Mycobacterium
AKPPRSGKVPTEPAQVSASM

SEQ ID NO: 299605 - protein, 23 aa, Mycobacterium
AKPRLSTLQQWWVLVGRFTKPRL

SEQ ID NO: 299606 - protein, 20 aa, Mycobacterium
AKQAKRRRILMIVGSAVAAV

SEQ ID NO: 299607 - protein, 28 aa, Mycobacterium
AKRARGKPLRIMILLVIVTAVASALLDN

SEQ ID NO: 299608 - protein, 24 aa, Mycobacterium
AKRDFSEPTALNWAPHGTDVDFGA

SEQ ID NO: 299609 - protein, 24 aa, Mycobacterium
AKRDFSEPVALNWASGGTDVDFGA

SEQ ID NO: 299610 - protein, 22 aa, Mycobacterium
AKRLAGAHFGYLVAAAFMGFIV

SEQ ID NO: 299611 - protein, 25 aa, Mycobacterium
AKRNRPRLWACYALALMLAILLNLN

SEQ ID NO: 299612 - protein, 18 aa, Mycobacterium
AKSAGLVTVRGTATDSEV

SEQ ID NO: 299613 - protein, 17 aa, Mycobacterium
AKSDKRPEDFLKELDAR

SEQ ID NO: 299614 - protein, 26 aa, Mycobacterium
AKSILSLRGGEFFAPELAALASDPVR

SEQ ID NO: 299615 - protein, 18 aa, Mycobacterium
AKSLLAILRRSYRGKVEL

SEQ ID NO: 299616 - protein, 21 aa, Mycobacterium
AKSLLPHVVDTGWFFDTELLV

SEQ ID NO: 299617 - protein, 20 aa, Mycobacterium
AKSLYLRDEIFADWINKVDS

SEQ ID NO: 299618 - protein, 23 aa, Mycobacterium
AKSPVMCAYWSKPAKAASSSVNL

SEQ ID NO: 299619 - protein, 24 aa, Mycobacterium
AKSQAPREDLVWVRPNGAPPPPKP

SEQ ID NO: 299620 - protein, 19 aa, Mycobacterium
AKSTFPFGGFPWGASSYGQ

SEQ ID NO: 299621 - protein, 19 aa, Mycobacterium
AKSVLNMMMMCFSAVAVVW

SEQ ID NO: 299622 - protein, 24 aa, Mycobacterium
AKTGKLRPALFVVPTDSPGFTYTP

SEQ ID NO: 299623 - protein, 20 aa, Mycobacterium
AKTPGLLRMLRIYRDYAHDS

SEQ ID NO: 299624 - protein, 25 aa, Mycobacterium
AKTPGLLRMMRIYRDYAHDANISYG

SEQ ID NO: 299625 - protein, 20 aa, Mycobacterium
AKTPKAAFRIAFAGPATSLA

SEQ ID NO: 299626 - protein, 20 aa, Mycobacterium
AKTPKAAFRIAIAGPATSLA

SEQ ID NO: 299627 - protein, 21 aa, Mycobacterium
AKTSIPFLISMQGVGQQQNMK

SEQ ID NO: 299628 - protein, 34 aa, Mycobacterium
AKTSPAWRKLGTAIAKWPAAMIAVAALVIPLCIA

SEQ ID NO: 299629 - protein, 23 aa, Mycobacterium
AKTWRARFGYVFGPPGWSEKAVP

SEQ ID NO: 299630 - protein, 19 aa, Mycobacterium
AKVAADVQVFARVSPEQKV

SEQ ID NO: 299631 - protein, 18 aa, Mycobacterium
AKVADWVTHYGKPVVAVL

SEQ ID NO: 299632 - protein, 18 aa, Mycobacterium
AKVAWRSGQAVKGLTFGL

SEQ ID NO: 299633 - protein, 18 aa, Mycobacterium
AKVDGAWNLHQLTRDLDL

SEQ ID NO: 299634 - protein, 18 aa, Mycobacterium
AKVFLRKAGTIILGTSVV

SEQ ID NO: 299635 - protein, 25 aa, Mycobacterium
AKVGDGRTAITFVLRDDNADANSCS

SEQ ID NO: 299636 - protein, 18 aa, Mycobacterium
AKVKRLMDRIGAYERYWL

SEQ ID NO: 299637 - protein, 18 aa, Mycobacterium
AKVLMYWIHAPLWLLSLC

SEQ ID NO: 299638 - protein, 17 aa, Mycobacterium
AKVLPSVVKLETIMGRS

SEQ ID NO: 299639 - protein, 25 aa, Mycobacterium
AKVVNLRSAPGFSFVGEDLDRLRSL

SEQ ID NO: 299640 - protein, 25 aa, Mycobacterium
AKVVNLRSAPGFSFVGEDQDRLRSL

SEQ ID NO: 299641 - protein, 25 aa, Mycobacterium
AKVVNLRSAPGFSFVSEDLDRVRSL

SEQ ID NO: 299642 - protein, 23 aa, Mycobacterium
AKVVRPGWMVQLVMVVLVAPVGV

SEQ ID NO: 299643 - protein, 19 aa, Mycobacterium
AKWKNCANQTVTVTLSDGR

SEQ ID NO: 299644 - protein, 21 aa, Mycobacterium
AKWLALFSFWLVCLYSLAVHL

SEQ ID NO: 299645 - protein, 20 aa, Mycobacterium
AKYPVAGSVYNWSKKLASRL

SEQ ID NO: 299646 - protein, 23 aa, Mycobacterium
ALAAACLLIGSTVILRFSYQPRP

SEQ ID NO: 299647 - protein, 26 aa, Mycobacterium
ALAACVMAALLWRRDETLGDLRPLAN

SEQ ID NO: 299648 - protein, 17 aa, Mycobacterium
ALAADGLATVLAGSGGG

SEQ ID NO: 299649 - protein, 19 aa, Mycobacterium
ALAAHGIDDVMLVSESHAA

SEQ ID NO: 299650 - protein, 20 aa, Mycobacterium
ALAAKRSWLISVGVVALATV

SEQ ID NO: 299651 - protein, 18 aa, Mycobacterium
ALAALLGSQCGYFIGRRL

SEQ ID NO: 299652 - protein, 20 aa, Mycobacterium
ALAALSWITLPLIWDDPPIS

SEQ ID NO: 299653 - protein, 27 aa, Mycobacterium
ALAALVIFPMYFLRSFAYAGVAVVAFA

SEQ ID NO: 299654 - protein, 18 aa, Mycobacterium
ALAAMIFAAVPWLHRFGD

SEQ ID NO: 299655 - protein, 17 aa, Mycobacterium
ALAAVFAPAGWRTYVSG

SEQ ID NO: 299656 - protein, 27 aa, Mycobacterium
ALAAVLACALLRPRLQAIVAGLAAALV

SEQ ID NO: 299657 - protein, 45 aa, Mycobacterium
ALACGVAVIWWLAHRPNRTWWRFTAWWIPCLALASTWWIVALLIF

SEQ ID NO: 299658 - protein, 17 aa, Mycobacterium
ALACLLLPAGAIGDRYG

SEQ ID NO: 299659 - protein, 23 aa, Mycobacterium
ALACTAFNLLTGVPPYGDSNPTV

SEQ ID NO: 299660 - protein, 24 aa, Mycobacterium
ALACTAFQLLTGMPPYAGSNSAVV

SEQ ID NO: 299661 - protein, 19 aa, Mycobacterium
ALADVFPRVRLMTDGSAQI

SEQ ID NO: 299662 - protein, 18 aa, Mycobacterium
ALAFAMQAGCRFTAQLGA

SEQ ID NO: 299663 - protein, 18 aa, Mycobacterium
ALAFPPLTFPGAWTIPQL

SEQ ID NO: 299664 - protein, 18 aa, Mycobacterium
ALAFVIDILPYVVVHGIG

SEQ ID NO: 299665 - protein, 24 aa, Mycobacterium
ALAGALVHHVRWPMWLRTVVSVVA

SEQ ID NO: 299666 - protein, 20 aa, Mycobacterium
ALAGCLAVLVVQQRHANAQQ

SEQ ID NO: 299667 - protein, 23 aa, Mycobacterium
ALAGFLPLTWLSLVYGWGLAGIW

SEQ ID NO: 299668 - protein, 19 aa, Mycobacterium
ALAGLLIVIGIQLVKLAHM

SEQ ID NO: 299669 - protein, 19 aa, Mycobacterium
ALAGLPPAYAINPPTIDLG

SEQ ID NO: 299670 - protein, 18 aa, Mycobacterium
ALAGLPPAYAISPPTIDP

SEQ ID NO: 299671 - protein, 26 aa, Mycobacterium
ALAGLRLLAGLIWLYNVVWKLPPDFG

SEQ ID NO: 299672 - protein, 19 aa, Mycobacterium
ALAGLRMVGLLGQDWRYLG

SEQ ID NO: 299673 - protein, 18 aa, Mycobacterium
ALAGRGWTERDVADWHAL

SEQ ID NO: 299674 - protein, 18 aa, Mycobacterium
ALAGVAAVRRRLGARGAT

SEQ ID NO: 299675 - protein, 24 aa, Mycobacterium
ALAGWAIGEVICALFEACPPLDHA

SEQ ID NO: 299676 - protein, 26 aa, Mycobacterium
ALAHEMPQLIAAYTWLDTHRNSNRYL

SEQ ID NO: 299677 - protein, 23 aa, Mycobacterium
ALAHGSGFLAVFVAGIVIGDARA

SEQ ID NO: 299678 - protein, 27 aa, Mycobacterium
ALAIALTAWRVMWFRIHAEPSGDEWHV

SEQ ID NO: 299679 - protein, 21 aa, Mycobacterium
ALAICVFSVGLLRDHGGDVLF

SEQ ID NO: 299680 - protein, 18 aa, Mycobacterium
ALAIDIRPTVALQPRPNE

SEQ ID NO: 299681 - protein, 22 aa, Mycobacterium
ALAILFCFAFLLLVFTGGGSYS

SEQ ID NO: 299682 - protein, 26 aa, Mycobacterium
ALAKAFLRFNTHLLFASTLPARVREL

SEQ ID NO: 299683 - protein, 21 aa, Mycobacterium
ALALAGLAVVGFRADLADGGA

SEQ ID NO: 299684 - protein, 22 aa, Mycobacterium
ALALFGLCRRLLGGSPDGDRPG

SEQ ID NO: 299685 - protein, 21 aa, Mycobacterium
ALALIAWRILRLAGVRADSRL

SEQ ID NO: 299686 - protein, 20 aa, Mycobacterium
ALALLRRQLLVLTAFTTGVL

SEQ ID NO: 299687 - protein, 25 aa, Mycobacterium
ALALTVPGSTGFRVADPNGDGSDEP

SEQ ID NO: 299688 - protein, 23 aa, Mycobacterium
ALALWLPVQLRLMRSTSPLTELG

SEQ ID NO: 299689 - protein, 24 aa, Mycobacterium
ALALYGAVPWWLVLTLLGRDAVLA

SEQ ID NO: 299690 - protein, 21 aa, Mycobacterium
ALAMCTLVLLGRVLPAVDHDP

SEQ ID NO: 299691 - protein, 18 aa, Mycobacterium
ALAMGIGVFVNWLSPDKA

SEQ ID NO: 299692 - protein, 19 aa, Mycobacterium
ALAMMVFSKSFSVLRSAVT

SEQ ID NO: 299693 - protein, 28 aa, Mycobacterium
ALANAKRWGVLHVIWRQGLYPGIGAPSW

SEQ ID NO: 299694 - protein, 31 aa, Mycobacterium
ALAPGAGRPRWWCAAVGMAAALAAALPWLVA

SEQ ID NO: 299695 - protein, 18 aa, Mycobacterium
ALAPLGLLGSRLIFIHLF

SEQ ID NO: 299696 - protein, 19 aa, Mycobacterium
ALAPLRRVAQTAGQVADLP

SEQ ID NO: 299697 - protein, 24 aa, Mycobacterium
ALAPRPIAAGLFNAVPAAPALTAP

SEQ ID NO: 299698 - protein, 23 aa, Mycobacterium
ALAPRPIALGLFNAIPEAPPLTA

SEQ ID NO: 299699 - protein, 20 aa, Mycobacterium
ALAPVCSIILITGAGGAFGR

SEQ ID NO: 299700 - protein, 31 aa, Mycobacterium
ALAQAMRQGYRWARRALAISGAVTFGSYFYF

SEQ ID NO: 299701 - protein, 24 aa, Mycobacterium
ALARAAYKTGVPMWHGAVIDQPEG

SEQ ID NO: 299702 - protein, 17 aa, Mycobacterium
ALARAGEDLHRYLHAAH

SEQ ID NO: 299703 - protein, 26 aa, Mycobacterium
ALARAHGGELVCLPHQGGARFRLTLP

SEQ ID NO: 299704 - protein, 26 aa, Mycobacterium
ALARERPAAISLAWGYWQPSSGMTGD

SEQ ID NO: 299705 - protein, 24 aa, Mycobacterium
ALARFRLGPLRRVRPDVVVDTQNG

SEQ ID NO: 299706 - protein, 19 aa, Mycobacterium
ALARLPLQIPMITTALKIS

SEQ ID NO: 299707 - protein, 24 aa, Mycobacterium
ALASFKVTLLISIAVAVLNGLFGL

SEQ ID NO: 299708 - protein, 22 aa, Mycobacterium
ALASLKPPPVWTVTSPGEDARA

SEQ ID NO: 299709 - protein, 18 aa, Mycobacterium
ALASRAGDHVDFLAHDRV

SEQ ID NO: 299710 - protein, 17 aa, Mycobacterium
ALASRAGDRVDFLAHDR

SEQ ID NO: 299711 - protein, 28 aa, Mycobacterium
ALASSYIWFFLCPGLPELAIWSRISVSV

SEQ ID NO: 299712 - protein, 19 aa, Mycobacterium
ALASTWWIVALLIFGKISP

SEQ ID NO: 299713 - protein, 21 aa, Mycobacterium
ALASWRPVTLAGLGVGLLGTT

SEQ ID NO: 299714 - protein, 23 aa, Mycobacterium
ALATLRIAFLSALVLELLATLGV

SEQ ID NO: 299715 - protein, 18 aa, Mycobacterium
ALATPMFHGLGFGMLTLT

SEQ ID NO: 299716 - protein, 24 aa, Mycobacterium
ALAVAHLRRARGRAVKPVVQLVVT

SEQ ID NO: 299717 - protein, 24 aa, Mycobacterium
ALAVGLKFKLGFDDSLDVVGVHLV

SEQ ID NO: 299718 - protein, 18 aa, Mycobacterium
ALAVLFLFGIVFALIEGP

SEQ ID NO: 299719 - protein, 18 aa, Mycobacterium
ALAVSIAIAFLAAVTLLP

SEQ ID NO: 299720 - protein, 19 aa, Mycobacterium
ALAWWQWTRFESNSGTFQN

SEQ ID NO: 299721 - protein, 17 aa, Mycobacterium
ALAYWPIFVKRRSVVDA

SEQ ID NO: 299722 - protein, 18 aa, Mycobacterium
ALCALGRTNGIDCAVVPQ

SEQ ID NO: 299723 - protein, 17 aa, Mycobacterium
ALCGITVVRRDSHDGDD

SEQ ID NO: 299724 - protein, 17 aa, Mycobacterium
ALCLIFGIMLIMTRSFV

SEQ ID NO: 299725 - protein, 18 aa, Mycobacterium
ALCLIFIIMLIMTRSFIA

SEQ ID NO: 299726 - protein, 19 aa, Mycobacterium
ALCLIFIIMLLITRSVVAA

SEQ ID NO: 299727 - protein, 17 aa, Mycobacterium
ALCLVLVIMLVLTRSLV

SEQ ID NO: 299728 - protein, 20 aa, Mycobacterium
ALDAAYTYGLLWVAAVAVLV

SEQ ID NO: 299729 - protein, 17 aa, Mycobacterium
ALDAELSGAPMIADATA

SEQ ID NO: 299730 - protein, 25 aa, Mycobacterium
ALDALPWRAPTVLLMRQSGDNYSLR

SEQ ID NO: 299731 - protein, 19 aa, Mycobacterium
ALDAMAREVGGGAPVAIAT

SEQ ID NO: 299732 - protein, 19 aa, Mycobacterium
ALDDLDLPALTALLRPLSA

SEQ ID NO: 299733 - protein, 24 aa, Mycobacterium
ALDDQRLAPGWHHLADIPGAGRTG

SEQ ID NO: 299734 - protein, 18 aa, Mycobacterium
ALDFRRFLRRVLRRPKPG

SEQ ID NO: 299735 - protein, 23 aa, Mycobacterium
ALDGGGLAPGWHPLADIPGAGSV

SEQ ID NO: 299736 - protein, 17 aa, Mycobacterium
ALDHPGSLYSYVYADQT

SEQ ID NO: 299737 - protein, 24 aa, Mycobacterium
ALDKPRAAAIALFGAVTISALTYL

SEQ ID NO: 299738 - protein, 24 aa, Mycobacterium
ALDLNGFIWRRQSYGYGGSFTSGT

SEQ ID NO: 299739 - protein, 21 aa, Mycobacterium
ALDLRIFRAGPFNAAVITGLA

SEQ ID NO: 299740 - protein, 20 aa, Mycobacterium
ALDNYFCAGDQALFDMSALE

SEQ ID NO: 299741 - protein, 26 aa, Mycobacterium
ALDPLRRLAVIAGIAVVIGCTTWLPF

SEQ ID NO: 299742 - protein, 21 aa, Mycobacterium
ALDQVRAELVAWMDSPAPEVP

SEQ ID NO: 299743 - protein, 24 aa, Mycobacterium
ALDRHLRLPLRQVLWGLDEALLES

SEQ ID NO: 299744 - protein, 20 aa, Mycobacterium
ALDRLQRLISGFSQDRNTIG

SEQ ID NO: 299745 - protein, 26 aa, Mycobacterium
ALDRRFGWSSVPAWLALAADVVVVVS

SEQ ID NO: 299746 - protein, 27 aa, Mycobacterium
ALDRSAWWGRLAWMPHRPVLVPGTVRE

SEQ ID NO: 299747 - protein, 23 aa, Mycobacterium
ALDTCPWPPPTVFLMRRGANGNY

SEQ ID NO: 299748 - protein, 23 aa, Mycobacterium
ALDVRRLAPWYANHESHSPRLVN

SEQ ID NO: 299749 - protein, 21 aa, Mycobacterium
ALEAIPRDNLKTVIDESYTAV

SEQ ID NO: 299750 - protein, 18 aa, Mycobacterium
ALEAMKAIVLLANGAETY

SEQ ID NO: 299751 - protein, 26 aa, Mycobacterium
ALEAPRRVVVCIALLTVAAGIIGFPV

SEQ ID NO: 299752 - protein, 22 aa, Mycobacterium
ALEGRTSLVIAHRLSTVRAADL

SEQ ID NO: 299753 - protein, 22 aa, Mycobacterium
ALEHVSRQALLEVAEREDKVDE

SEQ ID NO: 299754 - protein, 28 aa, Mycobacterium
ALEIFPKLLDAFWLTIRLTIVGMAIALV

SEQ ID NO: 299755 - protein, 23 aa, Mycobacterium
ALEILAHRIIWSFVLMVVVVAAV

SEQ ID NO: 299756 - protein, 24 aa, Mycobacterium
ALEILHRLGTRMGEALRRWAALLV

SEQ ID NO: 299757 - protein, 23 aa, Mycobacterium
ALEPAFAMLLGFVVLDQVPGPFG

SEQ ID NO: 299758 - protein, 23 aa, Mycobacterium
ALEPLDYVDYCWGTEQFAPGGPT

SEQ ID NO: 299759 - protein, 19 aa, Mycobacterium
ALEPPRAASIVAQVARALD

SEQ ID NO: 299760 - protein, 19 aa, Mycobacterium
ALEQEGCRARALSAQEQDA

SEQ ID NO: 299761 - protein, 18 aa, Mycobacterium
ALERGWQSLIATVDGLVL

SEQ ID NO: 299762 - protein, 17 aa, Mycobacterium
ALERLREINLLKETIAQ

SEQ ID NO: 299763 - protein, 18 aa, Mycobacterium
ALERMRDFAVFKAIGTPT

SEQ ID NO: 299764 - protein, 23 aa, Mycobacterium
ALESRSFLLGEDWFDQDESSEIH

SEQ ID NO: 299765 - protein, 17 aa, Mycobacterium
ALEYCLRTDKLPTDELT

SEQ ID NO: 299766 - protein, 25 aa, Mycobacterium
ALEYLKITYGWCLLLIVVMMVLVLR

SEQ ID NO: 299767 - protein, 18 aa, Mycobacterium
ALFAFFFVANWHFAASGV

SEQ ID NO: 299768 - protein, 27 aa, Mycobacterium
ALFALRAVVLPWLLARALGAEKHEQRE

SEQ ID NO: 299769 - protein, 28 aa, Mycobacterium
ALFGDTPQDAWPWLGWLTAATAAGWIVD

SEQ ID NO: 299770 - protein, 19 aa, Mycobacterium
ALFGFIWDVSWHIGNGRDP

SEQ ID NO: 299771 - protein, 17 aa, Mycobacterium
ALFGIAVRRDDGGTVGI

SEQ ID NO: 299772 - protein, 19 aa, Mycobacterium
ALFGSIWALQGFGVLGGSP

SEQ ID NO: 299773 - protein, 17 aa, Mycobacterium
ALFGVPVTKHLAAGGQQ

SEQ ID NO: 299774 - protein, 23 aa, Mycobacterium
ALFKETPFLIVIGVLEMVTVANQ

SEQ ID NO: 299775 - protein, 17 aa, Mycobacterium
ALFLFTVGISLLVLAVL

SEQ ID NO: 299776 - protein, 20 aa, Mycobacterium
ALFLQRLEQAVARRHPNGMP

SEQ ID NO: 299777 - protein, 24 aa, Mycobacterium
ALFPDYRGSALEAFMSTMHDGGLW

SEQ ID NO: 299778 - protein, 19 aa, Mycobacterium
ALFPDYRGSVLDALASAFH

SEQ ID NO: 299779 - protein, 22 aa, Mycobacterium
ALFPGLFGLLAVVVRGLPGWPI

SEQ ID NO: 299780 - protein, 17 aa, Mycobacterium
ALFPPLWRRVMDPRVLA

SEQ ID NO: 299781 - protein, 19 aa, Mycobacterium
ALFPSYRTSVLDALGTAIH

SEQ ID NO: 299782 - protein, 17 aa, Mycobacterium
ALFQLIWARAVLARTTI

SEQ ID NO: 299783 - protein, 17 aa, Mycobacterium
ALFVFTIGIVLIVLALA

SEQ ID NO: 299784 - protein, 18 aa, Mycobacterium
ALFWAIVAIVALIAGMIP

SEQ ID NO: 299785 - protein, 19 aa, Mycobacterium
ALGAAMGYAGLRRRGAEGS

SEQ ID NO: 299786 - protein, 24 aa, Mycobacterium
ALGACYGLLGAVFAFFVCYVTYSY

SEQ ID NO: 299787 - protein, 26 aa, Mycobacterium
ALGALFMVPGVRRLRGPGPVTVGAVA

SEQ ID NO: 299788 - protein, 20 aa, Mycobacterium
ALGALLMVPGVRGLGPGPVT

SEQ ID NO: 299789 - protein, 21 aa, Mycobacterium
ALGAWPHWTFSALGAGVIGAV

SEQ ID NO: 299790 - protein, 21 aa, Mycobacterium
ALGAWPHWTFTALGAGVIGAV

SEQ ID NO: 299791 - protein, 22 aa, Mycobacterium
ALGCLALAWWQWTRYESTSGSF

SEQ ID NO: 299792 - protein, 20 aa, Mycobacterium
ALGCTAFHLLAGSAPFQHSN

SEQ ID NO: 299793 - protein, 20 aa, Mycobacterium
ALGCTAFHLLAGSAPFQHTN

SEQ ID NO: 299794 - protein, 21 aa, Mycobacterium
ALGCTLFRMLTGQPPFGSGNS

SEQ ID NO: 299795 - protein, 18 aa, Mycobacterium
ALGDRGWYTRFLASRPMV

SEQ ID NO: 299796 - protein, 23 aa, Mycobacterium
ALGDRIGRRKVLFLTLLLIGTAT

SEQ ID NO: 299797 - protein, 26 aa, Mycobacterium
ALGDRYGRRGALLVGLAIFALASLAP

SEQ ID NO: 299798 - protein, 18 aa, Mycobacterium
ALGEGRRDALYAFPGGIL

SEQ ID NO: 299799 - protein, 17 aa, Mycobacterium
ALGFPVRVIHSGIYATR

SEQ ID NO: 299800 - protein, 23 aa, Mycobacterium
ALGFSGLMPLAFTANDAVIAGFT

SEQ ID NO: 299801 - protein, 23 aa, Mycobacterium
ALGGGIKLIAWGIKPAITAVSVA

SEQ ID NO: 299802 - protein, 22 aa, Mycobacterium
ALGGISAGYGWLLASRVALGVV

SEQ ID NO: 299803 - protein, 28 aa, Mycobacterium
ALGGLLIGAGVGWWLARRRRDATNLPDE

SEQ ID NO: 299804 - protein, 18 aa, Mycobacterium
ALGGLMVETLGWRSVFAV

SEQ ID NO: 299805 - protein, 22 aa, Mycobacterium
ALGGLPPAAAWPYIIASATVHV

SEQ ID NO: 299806 - protein, 18 aa, Mycobacterium
ALGGLRCRASRIVLHPGF

SEQ ID NO: 299807 - protein, 19 aa, Mycobacterium
ALGGVEVCSTTALRDYELG

SEQ ID NO: 299808 - protein, 21 aa, Mycobacterium
ALGIPSALGLLVVVVGALTAA

SEQ ID NO: 299809 - protein, 18 aa, Mycobacterium
ALGIVFAALVGVVAAQAV

SEQ ID NO: 299810 - protein, 23 aa, Mycobacterium
ALGKTYCRLGGFLDGADRFDAGF

SEQ ID NO: 299811 - protein, 17 aa, Mycobacterium
ALGLALALVMHRTIFGK

SEQ ID NO: 299812 - protein, 26 aa, Mycobacterium
ALGLAMAFGRFLPIVLVLALAGSLAR

SEQ ID NO: 299813 - protein, 24 aa, Mycobacterium
ALGLAMAVGGSWIKELSSPPWDVG

SEQ ID NO: 299814 - protein, 19 aa, Mycobacterium
ALGLANWYIVHSMLPIFRR

SEQ ID NO: 299815 - protein, 22 aa, Mycobacterium
ALGLLAALFVFSYRPDREVDAQ

SEQ ID NO: 299816 - protein, 27 aa, Mycobacterium
ALGLLAYLASFGPMFTVSSELGGAGSE

SEQ ID NO: 299817 - protein, 21 aa, Mycobacterium
ALGLLPGLLIGGRASDALGRR

SEQ ID NO: 299818 - protein, 22 aa, Mycobacterium
ALGLPLLFLIYLQESDAFSDLP

SEQ ID NO: 299819 - protein, 18 aa, Mycobacterium
ALGLRVVKSFGREDYVFD

SEQ ID NO: 299820 - protein, 20 aa, Mycobacterium
ALGLRVVKSFGREDYVYDRF

SEQ ID NO: 299821 - protein, 29 aa, Mycobacterium
ALGMGALWLPWGWVAHRLLSAPLSAARAA

SEQ ID NO: 299822 - protein, 25 aa, Mycobacterium
ALGMLGTGLAYVWNTHIINGWGATA

SEQ ID NO: 299823 - protein, 19 aa, Mycobacterium
ALGPIRVLITFPDGDAASA

SEQ ID NO: 299824 - protein, 23 aa, Mycobacterium
ALGPRAASVAVVLRGTQSVPGKP

SEQ ID NO: 299825 - protein, 18 aa, Mycobacterium
ALGRARFITLYLVSALGG

SEQ ID NO: 299826 - protein, 17 aa, Mycobacterium
ALGRLSVRSVRDVAYAR

SEQ ID NO: 299827 - protein, 18 aa, Mycobacterium
ALGRPPGGWDASDFDHHI

SEQ ID NO: 299828 - protein, 18 aa, Mycobacterium
ALGSRFGIFDPKRKADSG

SEQ ID NO: 299829 - protein, 24 aa, Mycobacterium
ALGSVCLTGGLALGSLVTGLLIEY

SEQ ID NO: 299830 - protein, 19 aa, Mycobacterium
ALGSVWGWQRRARVDGRAA

SEQ ID NO: 299831 - protein, 17 aa, Mycobacterium
ALGSWAVADLIWLLCDY

SEQ ID NO: 299832 - protein, 22 aa, Mycobacterium
ALGVAIYKLVWLKHTTSQNAHN

SEQ ID NO: 299833 - protein, 17 aa, Mycobacterium
ALGVAWVVLVPAEMLGV

SEQ ID NO: 299834 - protein, 20 aa, Mycobacterium
ALGVCYALRRRERLRDRLTI

SEQ ID NO: 299835 - protein, 29 aa, Mycobacterium
ALGVGVTEAVLWFIRRWLVARATMGVEAD

SEQ ID NO: 299836 - protein, 35 aa, Mycobacterium
ALGVRTAFRVPFLRNWKYSRAYLNWLADRLQKTKT

SEQ ID NO: 299837 - protein, 36 aa, Mycobacterium
ALGWASYLILWVLQACVFWRGMEAIRKFIDFCGPAV

SEQ ID NO: 299838 - protein, 18 aa, Mycobacterium
ALGWWQWTRFESTSGSFQ

SEQ ID NO: 299839 - protein, 24 aa, Mycobacterium
ALGWYFNIRFVREYSHGATNPIWG

SEQ ID NO: 299840 - protein, 18 aa, Mycobacterium
ALGYAVACQVPIYLMRSS

SEQ ID NO: 299841 - protein, 20 aa, Mycobacterium
ALGYRIARRRLPARLGGDPV

SEQ ID NO: 299842 - protein, 25 aa, Mycobacterium
ALHALFPDYRTSVLDAIGSAMHDNG

SEQ ID NO: 299843 - protein, 23 aa, Mycobacterium
ALHAPGDVSFYCLDYGGGQLRVL

SEQ ID NO: 299844 - protein, 20 aa, Mycobacterium
ALHCTWMSCAFVAAAAVIRR

SEQ ID NO: 299845 - protein, 20 aa, Mycobacterium
ALHCTWMSCAFVAAAGAIRR

SEQ ID NO: 299846 - protein, 21 aa, Mycobacterium
ALHECGHMWVARATGMKVRRY

SEQ ID NO: 299847 - protein, 18 aa, Mycobacterium
ALHGRYHITRNFSTTMPQ

SEQ ID NO: 299848 - protein, 24 aa, Mycobacterium
ALHRAQRGPNRFLANAFDLNYVAL

SEQ ID NO: 299849 - protein, 19 aa, Mycobacterium
ALHRHWRGAPAIIVSAVGW

SEQ ID NO: 299850 - protein, 19 aa, Mycobacterium
ALHYLKITYGWSLLLIVAF

SEQ ID NO: 299851 - protein, 21 aa, Mycobacterium
ALIAGWLHFRLDYAGHTEVEN

SEQ ID NO: 299852 - protein, 25 aa, Mycobacterium
ALIALALTILVLWQRRRRRKRREAE

SEQ ID NO: 299853 - protein, 19 aa, Mycobacterium
ALIAMFPAWIMWAPNAIWK

SEQ ID NO: 299854 - protein, 34 aa, Mycobacterium
ALIEPDLRVLVNLGYGDPRFGYSTSPANVPTPFG

SEQ ID NO: 299855 - protein, 37 aa, Mycobacterium
ALIEYVDWRAVFWINLPICALAILLTAIFVRESKSST

SEQ ID NO: 299856 - protein, 18 aa, Mycobacterium
ALIGAFYLFTLVLGYGAA

SEQ ID NO: 299857 - protein, 19 aa, Mycobacterium
ALIGAFYLFTLVLGYGAAA

SEQ ID NO: 299858 - protein, 17 aa, Mycobacterium
ALIGLLALPGYRTNYDS

SEQ ID NO: 299859 - protein, 21 aa, Mycobacterium
ALIGLVALVFAVVTSNQLVAW

SEQ ID NO: 299860 - protein, 19 aa, Mycobacterium
ALIGLWRARVVEMTGMPEL

SEQ ID NO: 299861 - protein, 17 aa, Mycobacterium
ALIGVDSDELWDIRNRG

SEQ ID NO: 299862 - protein, 25 aa, Mycobacterium
ALIHSDLLGWLAIAIAIAIGVALVA

SEQ ID NO: 299863 - protein, 27 aa, Mycobacterium
ALILALRFHRGAALALLGMFVVQFPIA

SEQ ID NO: 299864 - protein, 18 aa, Mycobacterium
ALILCIVVAVPLGVIAAH

SEQ ID NO: 299865 - protein, 25 aa, Mycobacterium
ALIMIGWWSGFPYWTTVAVCGFGGL

SEQ ID NO: 299866 - protein, 22 aa, Mycobacterium
ALIPGRPAPRIITAEMVASMKP

SEQ ID NO: 299867 - protein, 24 aa, Mycobacterium
ALIPLCYVAFLGLESYFCYFVIRN

SEQ ID NO: 299868 - protein, 23 aa, Mycobacterium
ALIQLLADRAFEWSLNAGEVIQR

SEQ ID NO: 299869 - protein, 19 aa, Mycobacterium
ALIQLLADRAFQWSLNAGE

SEQ ID NO: 299870 - protein, 27 aa, Mycobacterium
ALIQYSGGYGIQWVVPVLFLVLVSGFL

SEQ ID NO: 299871 - protein, 17 aa, Mycobacterium
ALIRAWTLGVGPEVTLT

SEQ ID NO: 299872 - protein, 17 aa, Mycobacterium
ALIRPRGPERAAVRDAA

SEQ ID NO: 299873 - protein, 19 aa, Mycobacterium
ALISINWGTYIFAVTSGHV

SEQ ID NO: 299874 - protein, 17 aa, Mycobacterium
ALISVGLDPAMGTRRID

SEQ ID NO: 299875 - protein, 23 aa, Mycobacterium
ALITLPVAILFVYDAQHAFYRNF

SEQ ID NO: 299876 - protein, 23 aa, Mycobacterium
ALITWTMYVRRPFAGKSAAPLSP

SEQ ID NO: 299877 - protein, 17 aa, Mycobacterium
ALIVFRSPLPAARVTLE

SEQ ID NO: 299878 - protein, 17 aa, Mycobacterium
ALIVIDVVRHWNSPAVV

SEQ ID NO: 299879 - protein, 21 aa, Mycobacterium
ALIYCVPLALLAAGSGLLVYR

SEQ ID NO: 299880 - protein, 18 aa, Mycobacterium
ALKCGAQVVLPADADGHA

SEQ ID NO: 299881 - protein, 23 aa, Mycobacterium
ALKKADVGIAMGCRGTEAAKEAA

SEQ ID NO: 299882 - protein, 19 aa, Mycobacterium
ALKPLRFFEQTALLESLVT

SEQ ID NO: 299883 - protein, 20 aa, Mycobacterium
ALKRLPGYGTALGEVVSSGP

SEQ ID NO: 299884 - protein, 19 aa, Mycobacterium
ALKRLPTYATELGEVVGSG

SEQ ID NO: 299885 - protein, 22 aa, Mycobacterium
ALKRTWIALVILAVVVIAAFSV

SEQ ID NO: 299886 - protein, 24 aa, Mycobacterium
ALKRVWIPLVIVAVVAVAGFSVYR

SEQ ID NO: 299887 - protein, 23 aa, Mycobacterium
ALKRYVANGIHHWQLLIFPYMVL

SEQ ID NO: 299888 - protein, 18 aa, Mycobacterium
ALKVMFVITAIAMVGLVI

SEQ ID NO: 299889 - protein, 17 aa, Mycobacterium
ALLAALIRRPSALDPAI

SEQ ID NO: 299890 - protein, 19 aa, Mycobacterium
ALLACLAGAAAVTIFQNKA

SEQ ID NO: 299891 - protein, 18 aa, Mycobacterium
ALLACTIGAAAVTALQTK

SEQ ID NO: 299892 - protein, 17 aa, Mycobacterium
ALLACTVGAAFVTALQT

SEQ ID NO: 299893 - protein, 17 aa, Mycobacterium
ALLAFMLLTAGTAVFVA

SEQ ID NO: 299894 - protein, 24 aa, Mycobacterium
ALLAFPVIGVWVLIATLRAGLAHQ

SEQ ID NO: 299895 - protein, 26 aa, Mycobacterium
ALLAFWRRRRKDLGHAAVRPWVPGPL

SEQ ID NO: 299896 - protein, 18 aa, Mycobacterium
ALLAILAVVPWRQFSSGQ

SEQ ID NO: 299897 - protein, 19 aa, Mycobacterium
ALLAILSVVPWRRFASGES

SEQ ID NO: 299898 - protein, 25 aa, Mycobacterium
ALLALWRLDRLDGRRMHRIIPTRWR

SEQ ID NO: 299899 - protein, 23 aa, Mycobacterium
ALLANLFAPWGIAGDKPGAVAVL

SEQ ID NO: 299900 - protein, 26 aa, Mycobacterium
ALLAPLLVYRWGRLAFYPLALVPLGS

SEQ ID NO: 299901 - protein, 32 aa, Mycobacterium
ALLARAAVPPRHWRWPLGEIDKPFEMRRDPLV

SEQ ID NO: 299902 - protein, 25 aa, Mycobacterium
ALLARARWPYRAPRAAMVLWQAIAV

SEQ ID NO: 299903 - protein, 29 aa, Mycobacterium
ALLAVPILPAFGWRPMFFVGAGTGLIILV

SEQ ID NO: 299904 - protein, 22 aa, Mycobacterium
ALLAYWVWNWGYRQGITGSTVG

SEQ ID NO: 299905 - protein, 19 aa, Mycobacterium
ALLCGMAALAFVKLAPAAQ

SEQ ID NO: 299906 - protein, 17 aa, Mycobacterium
ALLCGWSDDTYGLSRVQ

SEQ ID NO: 299907 - protein, 18 aa, Mycobacterium
ALLCLPAVVGIATALPAG

SEQ ID NO: 299908 - protein, 18 aa, Mycobacterium
ALLDAGLARTLLCGVSEM

SEQ ID NO: 299909 - protein, 18 aa, Mycobacterium
ALLDGFLTFFVVAAFGAL

SEQ ID NO: 299910 - protein, 19 aa, Mycobacterium
ALLDGFLTFFVVAAFGALI

SEQ ID NO: 299911 - protein, 17 aa, Mycobacterium
ALLDGILTFFVVAAFGA

SEQ ID NO: 299912 - protein, 35 aa, Mycobacterium
ALLEAVLWFLSRKTPRLMKWLLRRTAIKNLPVGYD

SEQ ID NO: 299913 - protein, 28 aa, Mycobacterium
ALLEHAPRFARRRVGSAVDVVALQDVAV

SEQ ID NO: 299914 - protein, 19 aa, Mycobacterium
ALLELARRPQLRQLLRENH

SEQ ID NO: 299915 - protein, 24 aa, Mycobacterium
ALLEPLIGWHCLFLGVAALGTIVL

SEQ ID NO: 299916 - protein, 21 aa, Mycobacterium
ALLFAWKLRKAVMLIGVLAAV

SEQ ID NO: 299917 - protein, 18 aa, Mycobacterium
ALLFILAMFEGFFGYSLP

SEQ ID NO: 299918 - protein, 25 aa, Mycobacterium
ALLFIPLCVLLAVIALLTGHVAMAE

SEQ ID NO: 299919 - protein, 19 aa, Mycobacterium
ALLFLGGIYLFWNTVAGQA

SEQ ID NO: 299920 - protein, 18 aa, Mycobacterium
ALLFLLGMVIRDVLKDRD

SEQ ID NO: 299921 - protein, 19 aa, Mycobacterium
ALLFLPPAWLLGTAMLGLS

SEQ ID NO: 299922 - protein, 18 aa, Mycobacterium
ALLFSDARRAGRLVSDML

SEQ ID NO: 299923 - protein, 24 aa, Mycobacterium
ALLGFPLVLLVGLLVAYLYTVLMF

SEQ ID NO: 299924 - protein, 20 aa, Mycobacterium
ALLGGGAWRVGKVGERGSMS

SEQ ID NO: 299925 - protein, 20 aa, Mycobacterium
ALLGGLYWFSYRPDRATDAA

SEQ ID NO: 299926 - protein, 18 aa, Mycobacterium
ALLGHFCDPTVGLVAPRI

SEQ ID NO: 299927 - protein, 18 aa, Mycobacterium
ALLGLVGENICSPKTRAR

SEQ ID NO: 299928 - protein, 21 aa, Mycobacterium
ALLGPRLDALDARPILHRILH

SEQ ID NO: 299929 - protein, 24 aa, Mycobacterium
ALLGSCALLARYNYDDRKAVSPSA

SEQ ID NO: 299930 - protein, 19 aa, Mycobacterium
ALLGVPAFAMILLRRRAGA

SEQ ID NO: 299931 - protein, 23 aa, Mycobacterium
ALLGWAAGEVIWAFYDVRPEFDH

SEQ ID NO: 299932 - protein, 19 aa, Mycobacterium
ALLHLLSFGIALSIVVMLH

SEQ ID NO: 299933 - protein, 25 aa, Mycobacterium
ALLHNRRLMIFAATVVAFHFANAAM

SEQ ID NO: 299934 - protein, 17 aa, Mycobacterium
ALLIAAVVVAVSVLITV

SEQ ID NO: 299935 - protein, 31 aa, Mycobacterium
ALLIYHGMRLLGFRPGRERPSTVYADPAGPA

SEQ ID NO: 299936 - protein, 23 aa, Mycobacterium
ALLKASALVYFLGLIAQQRELFQ

SEQ ID NO: 299937 - protein, 23 aa, Mycobacterium
ALLKASALVYFLGLVADQRELFQ

SEQ ID NO: 299938 - protein, 23 aa, Mycobacterium
ALLKASALVYFLGLVAKQRELFQ

SEQ ID NO: 299939 - protein, 20 aa, Mycobacterium
ALLKRLNLRNDLSYGVYIYA

SEQ ID NO: 299940 - protein, 18 aa, Mycobacterium
ALLLAMPVALGIAIYLTE

SEQ ID NO: 299941 - protein, 25 aa, Mycobacterium
ALLLEYTAPLLVVGWLWATTRHRPS

SEQ ID NO: 299942 - protein, 29 aa, Mycobacterium
ALLLEYTAPVLVVGWVWAVTKRRPSAGTF

SEQ ID NO: 299943 - protein, 17 aa, Mycobacterium
ALLLGAASTRRRKQDEQ

SEQ ID NO: 299944 - protein, 17 aa, Mycobacterium
ALLLILAMFEGYFGYSL

SEQ ID NO: 299945 - protein, 26 aa, Mycobacterium
ALLLISIVFGFTWWLGGRLGLEDKLR

SEQ ID NO: 299946 - protein, 20 aa, Mycobacterium
ALLLIVMLIFAYKVVSLHNM

SEQ ID NO: 299947 - protein, 33 aa, Mycobacterium
ALLLLLLPRADWRWRVARAAVRLLARLTGTAIS

SEQ ID NO: 299948 - protein, 19 aa, Mycobacterium
ALLLPGGHRARGMRSYIDS

SEQ ID NO: 299949 - protein, 25 aa, Mycobacterium
ALLLPVVDWLDRRGLPRGGAVALVL

SEQ ID NO: 299950 - protein, 23 aa, Mycobacterium
ALLLTVLGSYPWTFLALGAILAL

SEQ ID NO: 299951 - protein, 18 aa, Mycobacterium
ALLLVGILFKIGAVPFHS

SEQ ID NO: 299952 - protein, 18 aa, Mycobacterium
ALLNLAPFWMTQPWVDAA

SEQ ID NO: 299953 - protein, 24 aa, Mycobacterium
ALLPEWPTGLSYVVSYVFIAIVWV

SEQ ID NO: 299954 - protein, 23 aa, Mycobacterium
ALLPRTGPQLLPRTPDGSSTLGA

SEQ ID NO: 299955 - protein, 22 aa, Mycobacterium
ALLPVRSHRIWLALNAAGAIAL

SEQ ID NO: 299956 - protein, 23 aa, Mycobacterium
ALLQRWLDMIAEIFDLAARKISA

SEQ ID NO: 299957 - protein, 18 aa, Mycobacterium
ALLRALQVILGWRPVLLI

SEQ ID NO: 299958 - protein, 31 aa, Mycobacterium
ALLRALRVMLGWRPVLLIPLTFALFTPLAVP

SEQ ID NO: 299959 - protein, 18 aa, Mycobacterium
ALLRAVVAPLYLIGTVIV

SEQ ID NO: 299960 - protein, 18 aa, Mycobacterium
ALLRAVVAPLYLVASVVI

SEQ ID NO: 299961 - protein, 24 aa, Mycobacterium
ALLRAVVAPLYLVASVVISYLSAV

SEQ ID NO: 299962 - protein, 20 aa, Mycobacterium
ALLRLARRSACSGAALSDAV

SEQ ID NO: 299963 - protein, 17 aa, Mycobacterium
ALLRLDGAMFFGAAERI

SEQ ID NO: 299964 - protein, 18 aa, Mycobacterium
ALLRRASLRQAVADGVAI

SEQ ID NO: 299965 - protein, 18 aa, Mycobacterium
ALLRRRASDHVSMSLPGT

SEQ ID NO: 299966 - protein, 30 aa, Mycobacterium
ALLRRSANPVARWFAAAYIWLFRGLPVLLQ

SEQ ID NO: 299967 - protein, 21 aa, Mycobacterium
ALLRSRFRISQTLAISLIAII

SEQ ID NO: 299968 - protein, 19 aa, Mycobacterium
ALLSAIGIAGMDRLVQRNV

SEQ ID NO: 299969 - protein, 29 aa, Mycobacterium
ALLTPEWLSGLSWRAWVFAVIVIAAIRPA

SEQ ID NO: 299970 - protein, 19 aa, Mycobacterium
ALLTRRWALAWIALAGSTV

SEQ ID NO: 299971 - protein, 18 aa, Mycobacterium
ALLTRRWALAWVALAGSA

SEQ ID NO: 299972 - protein, 17 aa, Mycobacterium
ALLTRRWVLSWIALAGS

SEQ ID NO: 299973 - protein, 19 aa, Mycobacterium
ALLVAGIGIGMAWPHLSAR

SEQ ID NO: 299974 - protein, 23 aa, Mycobacterium
ALLVALGLLWAYLVANRLDRLHV

SEQ ID NO: 299975 - protein, 19 aa, Mycobacterium
ALLVFRFSLAAAILGAWAR

SEQ ID NO: 299976 - protein, 24 aa, Mycobacterium
ALLVGFGAVLGRLVEMTGGAQVLA

SEQ ID NO: 299977 - protein, 17 aa, Mycobacterium
ALLVLGGWLIYRRGARR

SEQ ID NO: 299978 - protein, 33 aa, Mycobacterium
ALLVPALRFRPLIRLAVEWLEVLAMIVFLPAAA

SEQ ID NO: 299979 - protein, 20 aa, Mycobacterium
ALLVPLGLAMRTIRFELPMM

SEQ ID NO: 299980 - protein, 27 aa, Mycobacterium
ALLVPRFRLGTLTIWVGFIAAFFIVYL

SEQ ID NO: 299981 - protein, 23 aa, Mycobacterium
ALLVPVVDWLDARGLPRGAAVSL

SEQ ID NO: 299982 - protein, 25 aa, Mycobacterium
ALLVPVVDWLDRRGLPRGGAVALVL

SEQ ID NO: 299983 - protein, 21 aa, Mycobacterium
ALLVTCLERLRAILVGHAGWP

SEQ ID NO: 299984 - protein, 17 aa, Mycobacterium
ALLWTFIRHERRAPFPL

SEQ ID NO: 299985 - protein, 18 aa, Mycobacterium
ALLYCGPLAVLAAGSGLL

SEQ ID NO: 299986 - protein, 24 aa, Mycobacterium
ALLYVCSLFTAIFVIAAVERTVRH

SEQ ID NO: 299987 - protein, 24 aa, Mycobacterium
ALMACFMGTVGFTFANATTLAIGE

SEQ ID NO: 299988 - protein, 18 aa, Mycobacterium
ALMAIPLWIIIVLPVAKI

SEQ ID NO: 299989 - protein, 24 aa, Mycobacterium
ALMALWLAALRWRQGGAKAALDPL

SEQ ID NO: 299990 - protein, 32 aa, Mycobacterium
ALMAMFAQWNWWLPPWLSRILPSVDFDRPLPA

SEQ ID NO: 299991 - protein, 18 aa, Mycobacterium
ALMGEWRDDLRWPPASAL

SEQ ID NO: 299992 - protein, 18 aa, Mycobacterium
ALMHLRPAAPGPVPAAAL

SEQ ID NO: 299993 - protein, 22 aa, Mycobacterium
ALMHYRGWAIPVAFVIAQAVAT

SEQ ID NO: 299994 - protein, 22 aa, Mycobacterium
ALMKADIGVAMGKRGTEVARDA

SEQ ID NO: 299995 - protein, 25 aa, Mycobacterium
ALMLGLSCGIDYALFILNRYRNNLL

SEQ ID NO: 299996 - protein, 23 aa, Mycobacterium
ALMLIAWLWLGRRVIDRTATEYT

SEQ ID NO: 299997 - protein, 24 aa, Mycobacterium
ALMMPRYRVVWGIVINVVGGMAVI

SEQ ID NO: 299998 - protein, 21 aa, Mycobacterium
ALMPLWGRLSDRIGRKPVLLI

SEQ ID NO: 299999 - protein, 24 aa, Mycobacterium
ALMRIPYTAAIGIFGGRNFTVAST

SEQ ID NO: 300000 - protein, 24 aa, Mycobacterium
ALMRIPYTAGIGIFGGRNFTVAIT

SEQ ID NO: 300001 - protein, 25 aa, Mycobacterium
ALMSWITGVGFGWLTAFAGSAVKII

SEQ ID NO: 300002 - protein, 21 aa, Mycobacterium
ALMTRRWALAWIALVGSALAS

SEQ ID NO: 300003 - protein, 18 aa, Mycobacterium
ALMTRRWALAWVALAGSA

SEQ ID NO: 300004 - protein, 24 aa, Mycobacterium
ALMVAMVVSILAMRATGTGTTSLV

SEQ ID NO: 300005 - protein, 17 aa, Mycobacterium
ALMWLRTTIEPSPGFPV

SEQ ID NO: 300006 - protein, 17 aa, Mycobacterium
ALNALFPDYRGSVLDAL

SEQ ID NO: 300007 - protein, 20 aa, Mycobacterium
ALNALFPDYRGSVLDAVTSA

SEQ ID NO: 300008 - protein, 26 aa, Mycobacterium
ALNALFPNYRGSVFDALMSIMHEGGI

SEQ ID NO: 300009 - protein, 18 aa, Mycobacterium
ALNARWLALVFGSYLVFI

SEQ ID NO: 300010 - protein, 21 aa, Mycobacterium
ALNGLRLLSNRAWISPGATPT

SEQ ID NO: 300011 - protein, 27 aa, Mycobacterium
ALNGMRLLTNRSWRAAASMGAPTAGIR

SEQ ID NO: 300012 - protein, 31 aa, Mycobacterium
ALNGTANWVLRRMGIEPAEELRSARSPQELG

SEQ ID NO: 300013 - protein, 32 aa, Mycobacterium
ALNHGWCLVRTRWGRRVARFLPVIGVAGLAAL

SEQ ID NO: 300014 - protein, 17 aa, Mycobacterium
ALNIRYILTSSPTVRGF

SEQ ID NO: 300015 - protein, 24 aa, Mycobacterium
ALNPCGFAFLPGYLGLVIAGSDGT

SEQ ID NO: 300016 - protein, 24 aa, Mycobacterium
ALNPCGFAFLPGYLGLVIAGSQGT

SEQ ID NO: 300017 - protein, 26 aa, Mycobacterium
ALNPPRNRPAPLMLRGPDQQEPAGPI

SEQ ID NO: 300018 - protein, 24 aa, Mycobacterium
ALPADQWWTWALALFLADATYYVK

SEQ ID NO: 300019 - protein, 32 aa, Mycobacterium
ALPDEAFLTYGWRIAFLFSIVLVVFGVVVRLK

SEQ ID NO: 300020 - protein, 18 aa, Mycobacterium
ALPDFSGALAAVPTMAQL

SEQ ID NO: 300021 - protein, 19 aa, Mycobacterium
ALPDGRHVWEYAPRNGQTD

SEQ ID NO: 300022 - protein, 23 aa, Mycobacterium
ALPDSGPWRLPSIDAAGAPNTLG

SEQ ID NO: 300023 - protein, 23 aa, Mycobacterium
ALPDWLPFATLFAVAAGTLLWLG

SEQ ID NO: 300024 - protein, 23 aa, Mycobacterium
ALPEQWRMRGLHKYVTRALCFVT

SEQ ID NO: 300025 - protein, 23 aa, Mycobacterium
ALPERLRPQVLRRSSAAADTEED

SEQ ID NO: 300026 - protein, 18 aa, Mycobacterium
ALPFLATIVLRIRRVEGG

SEQ ID NO: 300027 - protein, 26 aa, Mycobacterium
ALPGLRDDWRPVLWAIAILTMVVGTV

SEQ ID NO: 300028 - protein, 21 aa, Mycobacterium
ALPGNPWIDTPLRDIATEIGK

SEQ ID NO: 300029 - protein, 23 aa, Mycobacterium
ALPGRGWEIFFGVISLLAGVVML

SEQ ID NO: 300030 - protein, 18 aa, Mycobacterium
ALPGSPPFGGWIDITLVL

SEQ ID NO: 300031 - protein, 18 aa, Mycobacterium
ALPGSPPFGSWVDITVVI

SEQ ID NO: 300032 - protein, 24 aa, Mycobacterium
ALPHADHPSVLLVVGVNGTGKTTT

SEQ ID NO: 300033 - protein, 22 aa, Mycobacterium
ALPIFLVVVVGLAFILLTIAFR

SEQ ID NO: 300034 - protein, 21 aa, Mycobacterium
ALPLAVICYFIASTPIAGAPT

SEQ ID NO: 300035 - protein, 18 aa, Mycobacterium
ALPLLAFALAGRRVAERV

SEQ ID NO: 300036 - protein, 22 aa, Mycobacterium
ALPPELHRLQLESGVGPSPMLA

SEQ ID NO: 300037 - protein, 18 aa, Mycobacterium
ALPPQFGLPGFRHSIGLA

SEQ ID NO: 300038 - protein, 20 aa, Mycobacterium
ALPREGLDSAALVVVGEACP

SEQ ID NO: 300039 - protein, 24 aa, Mycobacterium
ALPRPNSTGAWLMVQFGSDDPDES

SEQ ID NO: 300040 - protein, 23 aa, Mycobacterium
ALPRSTNSAVVWGIAAVELVTVV

SEQ ID NO: 300041 - protein, 28 aa, Mycobacterium
ALPRYMAVCLLAGYTWLLVPAVIWLLSG

SEQ ID NO: 300042 - protein, 23 aa, Mycobacterium
ALPSRVFAWLALVFGVGFSMLAL

SEQ ID NO: 300043 - protein, 24 aa, Mycobacterium
ALPSRVFAWLALVFGVGFSMLALM

SEQ ID NO: 300044 - protein, 24 aa, Mycobacterium
ALPSRVFAWLALVFGVGFSMLALV

SEQ ID NO: 300045 - protein, 20 aa, Mycobacterium
ALPTFVCTTILSGRMSRHFA

SEQ ID NO: 300046 - protein, 23 aa, Mycobacterium
ALPTRTGAALVMAYWACNSLVLV

SEQ ID NO: 300047 - protein, 31 aa, Mycobacterium
ALPVVTWAAWPFHRVALRNARHHGASMETLI

SEQ ID NO: 300048 - protein, 26 aa, Mycobacterium
ALPVVVWWFFIRPWRRERRITLDGML

SEQ ID NO: 300049 - protein, 22 aa, Mycobacterium
ALPVWKKLRAGDWVESADGAGG

SEQ ID NO: 300050 - protein, 18 aa, Mycobacterium
ALPWLAARIGTPGVPQTG

SEQ ID NO: 300051 - protein, 26 aa, Mycobacterium
ALQAYSMLMYTGWRDVIAQFVARRSG

SEQ ID NO: 300052 - protein, 17 aa, Mycobacterium
ALQCMSTVAVMRRETNS

SEQ ID NO: 300053 - protein, 17 aa, Mycobacterium
ALQEIQAAIGAARDAQK

SEQ ID NO: 300054 - protein, 20 aa, Mycobacterium
ALQKGWLPAVTVIALGIGSL

SEQ ID NO: 300055 - protein, 22 aa, Mycobacterium
ALQLAAALLLRYRSQAPQITLV

SEQ ID NO: 300056 - protein, 27 aa, Mycobacterium
ALQVILGWRPVLLIPLTFALFTPLGVP

SEQ ID NO: 300057 - protein, 19 aa, Mycobacterium
ALQVKWLIPIFWIATLIAV

SEQ ID NO: 300058 - protein, 18 aa, Mycobacterium
ALQVTRTRAFGVATITPL

SEQ ID NO: 300059 - protein, 18 aa, Mycobacterium
ALRAARWNPALLAGLSLL

SEQ ID NO: 300060 - protein, 21 aa, Mycobacterium
ALRDAEFDWQAAVSGGPQLGA

SEQ ID NO: 300061 - protein, 19 aa, Mycobacterium
ALRDGAWVTVPVRELVPGD

SEQ ID NO: 300062 - protein, 25 aa, Mycobacterium
ALRDKRFDIVAGFIMLMHGVTLVVA

SEQ ID NO: 300063 - protein, 21 aa, Mycobacterium
ALRHRGTGVLMSRASHRRPIT

SEQ ID NO: 300064 - protein, 22 aa, Mycobacterium
ALRICPQPWIALALAAVVGITV

SEQ ID NO: 300065 - protein, 24 aa, Mycobacterium
ALRIWDGGLGIWGAIALGAVGAWI

SEQ ID NO: 300066 - protein, 17 aa, Mycobacterium
ALRIWTAVVLVFLYIPL

SEQ ID NO: 300067 - protein, 18 aa, Mycobacterium
ALRLEGRTPYRVSRSLLS

SEQ ID NO: 300068 - protein, 24 aa, Mycobacterium
ALRLKRAGFDRVLIVEKGDGVGGV

SEQ ID NO: 300069 - protein, 24 aa, Mycobacterium
ALRLLRLRMPPALAVGLLPLVIGS

SEQ ID NO: 300070 - protein, 17 aa, Mycobacterium
ALRLRTTSIVFHVLAGV

SEQ ID NO: 300071 - protein, 25 aa, Mycobacterium
ALRNGLRTHVGFVRSGMAPRLVPDA

SEQ ID NO: 300072 - protein, 24 aa, Mycobacterium
ALRNRMVAGSLFFRPKQPAPVPPT

SEQ ID NO: 300073 - protein, 21 aa, Mycobacterium
ALRNVLTPGVTVIDQIRIDPL

SEQ ID NO: 300074 - protein, 23 aa, Mycobacterium
ALRPETLSGAGWYVVGATAAASV

SEQ ID NO: 300075 - protein, 20 aa, Mycobacterium
ALRPLRRVAATAAEVATLPL

SEQ ID NO: 300076 - protein, 23 aa, Mycobacterium
ALRQVLPLVVPVILASALFNGSL

SEQ ID NO: 300077 - protein, 19 aa, Mycobacterium
ALRRMKAVALSFLVGATVL

SEQ ID NO: 300078 - protein, 26 aa, Mycobacterium
ALRRNGIPKARLAAVATAGGGASIPL

SEQ ID NO: 300079 - protein, 17 aa, Mycobacterium
ALRRPAESVPHDQPGRG

SEQ ID NO: 300080 - protein, 24 aa, Mycobacterium
ALRRQRWGLVAIMVVLAALLKPQF

SEQ ID NO: 300081 - protein, 19 aa, Mycobacterium
ALRRRERLRDRLTIATSAG

SEQ ID NO: 300082 - protein, 17 aa, Mycobacterium
ALRRRLTAGPVLHTNAK

SEQ ID NO: 300083 - protein, 21 aa, Mycobacterium
ALRTVVAPALRLSQPDQQALT

SEQ ID NO: 300084 - protein, 28 aa, Mycobacterium
ALSAFFTPRFVNWFGLFTTHLIVAIALA

SEQ ID NO: 300085 - protein, 27 aa, Mycobacterium
ALSAFFTPRFVRWFGLINTHVIIAAAL

SEQ ID NO: 300086 - protein, 23 aa, Mycobacterium
ALSAIAALWAFWLHLTRRTESRV

SEQ ID NO: 300087 - protein, 17 aa, Mycobacterium
ALSALAISLKYKFGYDD

SEQ ID NO: 300088 - protein, 18 aa, Mycobacterium
ALSCMTFAQLDMMRSMGI

SEQ ID NO: 300089 - protein, 23 aa, Mycobacterium
ALSDIRSALIVAITLPLIPVFMI

SEQ ID NO: 300090 - protein, 24 aa, Mycobacterium
ALSDRFGRRPLLIGGAVAFIVLGY

SEQ ID NO: 300091 - protein, 18 aa, Mycobacterium
ALSEGSYGNAYACDLNAT

SEQ ID NO: 300092 - protein, 19 aa, Mycobacterium
ALSGRIGPRLPMTVGPVLA

SEQ ID NO: 300093 - protein, 20 aa, Mycobacterium
ALSIGGLLGALGFAVLSKYL

SEQ ID NO: 300094 - protein, 17 aa, Mycobacterium
ALSIRVASIVAHVLAGV

SEQ ID NO: 300095 - protein, 30 aa, Mycobacterium
ALSLIASGAMVFAILVLLGRYINYTLDLAG

SEQ ID NO: 300096 - protein, 17 aa, Mycobacterium
ALSLPPLLLGMLGSLAY

SEQ ID NO: 300097 - protein, 17 aa, Mycobacterium
ALSLPPLLLGMLGTMAY

SEQ ID NO: 300098 - protein, 26 aa, Mycobacterium
ALSLVLSVIIGWVYRYTHKNVSYSQS

SEQ ID NO: 300099 - protein, 17 aa, Mycobacterium
ALSQGWKKSQTPSGPAK

SEQ ID NO: 300100 - protein, 18 aa, Mycobacterium
ALSRRWLAVAAAVSLLLT

SEQ ID NO: 300101 - protein, 22 aa, Mycobacterium
ALSRTGSQLGYRVTVVDAREVF

SEQ ID NO: 300102 - protein, 25 aa, Mycobacterium
ALSTMGPDAWRWMLASPAVFGVVTL

SEQ ID NO: 300103 - protein, 23 aa, Mycobacterium
ALSVDWFGIVVLAVWGAVAALAA

SEQ ID NO: 300104 - protein, 18 aa, Mycobacterium
ALSVFYAGFVRWRIRLRR

SEQ ID NO: 300105 - protein, 19 aa, Mycobacterium
ALSVPRFPRGWLTEPNLAV

SEQ ID NO: 300106 - protein, 18 aa, Mycobacterium
ALSWFKDALPGWVFGVRI

SEQ ID NO: 300107 - protein, 19 aa, Mycobacterium
ALTAAWRHVRERGSASLIL

SEQ ID NO: 300108 - protein, 26 aa, Mycobacterium
ALTACGVYLMLERNLTRMVLGLLLIG

SEQ ID NO: 300109 - protein, 18 aa, Mycobacterium
ALTAPAWQAIQPDLVPRE

SEQ ID NO: 300110 - protein, 18 aa, Mycobacterium
ALTAPAWQAIQPDLVPSD

SEQ ID NO: 300111 - protein, 24 aa, Mycobacterium
ALTARKRIAWLVLLGQIILAAGVN

SEQ ID NO: 300112 - protein, 17 aa, Mycobacterium
ALTATAATTAWVMASVT

SEQ ID NO: 300113 - protein, 18 aa, Mycobacterium
ALTAVIAVVGYRVIHVVG

SEQ ID NO: 300114 - protein, 28 aa, Mycobacterium
ALTAVVCFVGFLGAYLFNVYWQGGAPGS

SEQ ID NO: 300115 - protein, 18 aa, Mycobacterium
ALTEVFGAGSGVGFMIRK

SEQ ID NO: 300116 - protein, 18 aa, Mycobacterium
ALTFVAWAALGNSLASAF

SEQ ID NO: 300117 - protein, 17 aa, Mycobacterium
ALTGAYGADVWVVAALG

SEQ ID NO: 300118 - protein, 19 aa, Mycobacterium
ALTGFALWVVTLIVPGMSF

SEQ ID NO: 300119 - protein, 18 aa, Mycobacterium
ALTGFLSAFINVRIAAPI

SEQ ID NO: 300120 - protein, 21 aa, Mycobacterium
ALTGLAGWAGLCAYRAHEAQE

SEQ ID NO: 300121 - protein, 31 aa, Mycobacterium
ALTGPEAFLAFGWRIPFLSSIVLVVVGLAIR

SEQ ID NO: 300122 - protein, 18 aa, Mycobacterium
ALTGWLARSPGARAALIG

SEQ ID NO: 300123 - protein, 18 aa, Mycobacterium
ALTGWVVGYTLRPLRRLG

SEQ ID NO: 300124 - protein, 27 aa, Mycobacterium
ALTHRRKILIAMCMVAGISLLIHGLGG

SEQ ID NO: 300125 - protein, 20 aa, Mycobacterium
ALTIIFVFAVATLQPLAIYA

SEQ ID NO: 300126 - protein, 18 aa, Mycobacterium
ALTIPLAWLLHRFTRVRD

SEQ ID NO: 300127 - protein, 19 aa, Mycobacterium
ALTLLWPAAIAALVYAVLA

SEQ ID NO: 300128 - protein, 26 aa, Mycobacterium
ALTLRAASFTGHFLAGVLIVGTAIAE

SEQ ID NO: 300129 - protein, 19 aa, Mycobacterium
ALTLSRLMSGVVSRLNPAL

SEQ ID NO: 300130 - protein, 24 aa, Mycobacterium
ALTLSWYLSHRVHRSATALSQAAS

SEQ ID NO: 300131 - protein, 32 aa, Mycobacterium
ALTLTNLISVRWFGEFEFWFSGIKVAAIVSFI

SEQ ID NO: 300132 - protein, 19 aa, Mycobacterium
ALTLWLHVVDARFAADLRS

SEQ ID NO: 300133 - protein, 26 aa, Mycobacterium
ALTLWLHVVDARFARDLRTGLLRKLS

SEQ ID NO: 300134 - protein, 26 aa, Mycobacterium
ALTLWLHVVDARFARGLRARLLGKMS

SEQ ID NO: 300135 - protein, 24 aa, Mycobacterium
ALTMIIPAVFALRGERFDRRPKAA

SEQ ID NO: 300136 - protein, 19 aa, Mycobacterium
ALTPARWAAVHAAALLLPA

SEQ ID NO: 300137 - protein, 31 aa, Mycobacterium
ALTPEAFLSYGWRIAFLVSIVLVIFGVVVRF

SEQ ID NO: 300138 - protein, 25 aa, Mycobacterium
ALTPLIKRPILFGALAGLGVGTAGL

SEQ ID NO: 300139 - protein, 26 aa, Mycobacterium
ALTPLVKRPLVFGAVSGLAVATVGLW

SEQ ID NO: 300140 - protein, 24 aa, Mycobacterium
ALTPRRFGPRWAPTARLGSTYGYG

SEQ ID NO: 300141 - protein, 24 aa, Mycobacterium
ALTRPALRNRLARRCSRWSAPTST

SEQ ID NO: 300142 - protein, 21 aa, Mycobacterium
ALTRRWRARVSLSAFLLTFAL

SEQ ID NO: 300143 - protein, 19 aa, Mycobacterium
ALTSILGFVFGVLGMAIAA

SEQ ID NO: 300144 - protein, 23 aa, Mycobacterium
ALTSRALAMWVHVSFQAGNGLDS

SEQ ID NO: 300145 - protein, 25 aa, Mycobacterium
ALTSWRLVLAIGVVFWHSWPLTGRE

SEQ ID NO: 300146 - protein, 19 aa, Mycobacterium
ALTSYRWDLIGSLLGIGMF

SEQ ID NO: 300147 - protein, 24 aa, Mycobacterium
ALTVLRFVQGIAIGGQMGGVVLLA

SEQ ID NO: 300148 - protein, 18 aa, Mycobacterium
ALTWFSEPVTPPWIRSVA

SEQ ID NO: 300149 - protein, 23 aa, Mycobacterium
ALTWIRFGVWLLVGTVIYVGYGR

SEQ ID NO: 300150 - protein, 21 aa, Mycobacterium
ALTWIRFGVWLVLGTAIYVGY

SEQ ID NO: 300151 - protein, 20 aa, Mycobacterium
ALTYPAHWGPAAVDALGAAL

SEQ ID NO: 300152 - protein, 25 aa, Mycobacterium
ALTYRLTAGPVYGRVRIDADGRFTY

SEQ ID NO: 300153 - protein, 23 aa, Mycobacterium
ALVACLYPVLPIEIGDGGGGFDE

SEQ ID NO: 300154 - protein, 18 aa, Mycobacterium
ALVAFAYTALRLHAHEPG

SEQ ID NO: 300155 - protein, 27 aa, Mycobacterium
ALVAFCAAVARTLVRWEPQAAGSGIPH

SEQ ID NO: 300156 - protein, 19 aa, Mycobacterium
ALVAFGAWLWWRRAHGTGR

SEQ ID NO: 300157 - protein, 24 aa, Mycobacterium
ALVALPVLLAWAIVRRRSGKPVFT

SEQ ID NO: 300158 - protein, 19 aa, Mycobacterium
ALVAPKGRLPGRRATETFR

SEQ ID NO: 300159 - protein, 23 aa, Mycobacterium
ALVAPRIVGLVLSDNAIARYEAV

SEQ ID NO: 300160 - protein, 23 aa, Mycobacterium
ALVARASGRWGQIGRGMMLGSLS

SEQ ID NO: 300161 - protein, 18 aa, Mycobacterium
ALVARLAPASGQGRAFGT

SEQ ID NO: 300162 - protein, 27 aa, Mycobacterium
ALVARLTRWTAVFPWAAMHSLRGTKGL

SEQ ID NO: 300163 - protein, 20 aa, Mycobacterium
ALVEPTILLAVFALSIPAGS

SEQ ID NO: 300164 - protein, 22 aa, Mycobacterium
ALVEPTILLAVFALSMPAGSAN

SEQ ID NO: 300165 - protein, 18 aa, Mycobacterium
ALVFAGVGSMLAAAVVLL

SEQ ID NO: 300166 - protein, 20 aa, Mycobacterium
ALVFPILFMLVLKIVLGNLI

SEQ ID NO: 300167 - protein, 26 aa, Mycobacterium
ALVGDRPVQVWSLWSTTLRRLAEGHR

SEQ ID NO: 300168 - protein, 32 aa, Mycobacterium
ALVGHPWQVFGVLWLYCLAVGGAVTGVSAAFG

SEQ ID NO: 300169 - protein, 17 aa, Mycobacterium
ALVGIAFVALRPLENNP

SEQ ID NO: 300170 - protein, 18 aa, Mycobacterium
ALVGKLGDMFGRKRVFQV

SEQ ID NO: 300171 - protein, 23 aa, Mycobacterium
ALVIGALGGVIGRKTAEVVEAFT

SEQ ID NO: 300172 - protein, 26 aa, Mycobacterium
ALVIICASLSASGFLLWHHHNAVAQR

SEQ ID NO: 300173 - protein, 25 aa, Mycobacterium
ALVILDVCWVPLLAVLAPALISTST

SEQ ID NO: 300174 - protein, 30 aa, Mycobacterium
ALVIPFMFGSPYAIFLLREHFRTIPDDLIR

SEQ ID NO: 300175 - protein, 18 aa, Mycobacterium
ALVIRQIYRPELDLVRHG

SEQ ID NO: 300176 - protein, 19 aa, Mycobacterium
ALVIVAGVVMLRRQEAPPS

SEQ ID NO: 300177 - protein, 17 aa, Mycobacterium
ALVKAVIFGAIVAIVSC

SEQ ID NO: 300178 - protein, 18 aa, Mycobacterium
ALVKEVFTAPADVLLGGE

SEQ ID NO: 300179 - protein, 18 aa, Mycobacterium
ALVLARWLANPAAIRSAA

SEQ ID NO: 300180 - protein, 24 aa, Mycobacterium
ALVLEIPLFLAMRIPLRAFLIRGA

SEQ ID NO: 300181 - protein, 18 aa, Mycobacterium
ALVLELLATLGVALIAVG

SEQ ID NO: 300182 - protein, 18 aa, Mycobacterium
ALVLELLATLGVALVAVG

SEQ ID NO: 300183 - protein, 17 aa, Mycobacterium
ALVLGLVRYRRRRISFT

SEQ ID NO: 300184 - protein, 17 aa, Mycobacterium
ALVLKLGGPGAVGAFLG

SEQ ID NO: 300185 - protein, 18 aa, Mycobacterium
ALVLKPLFFPSVSPTAGT

SEQ ID NO: 300186 - protein, 24 aa, Mycobacterium
ALVLLIVRLCYTWIVSGRRASAWG

SEQ ID NO: 300187 - protein, 18 aa, Mycobacterium
ALVLLQLRVFYARERAWT

SEQ ID NO: 300188 - protein, 18 aa, Mycobacterium
ALVLLQLRVFYARHEAWT

SEQ ID NO: 300189 - protein, 24 aa, Mycobacterium
ALVLRPRALRALDRVDAIMIDPRA

SEQ ID NO: 300190 - protein, 24 aa, Mycobacterium
ALVLWAAMIRFEYALVATAASTAA

SEQ ID NO: 300191 - protein, 21 aa, Mycobacterium
ALVLYCITQNFIARPYLIPSE

SEQ ID NO: 300192 - protein, 18 aa, Mycobacterium
ALVNRPGFRERLREVHDY

SEQ ID NO: 300193 - protein, 19 aa, Mycobacterium
ALVNVRFVAPVAAGQALAA

SEQ ID NO: 300194 - protein, 18 aa, Mycobacterium
ALVPDSMAALAALKADPG

SEQ ID NO: 300195 - protein, 17 aa, Mycobacterium
ALVPLFITDVMGRGVGV

SEQ ID NO: 300196 - protein, 17 aa, Mycobacterium
ALVPSVLQTVGWLPSFL

SEQ ID NO: 300197 - protein, 17 aa, Mycobacterium
ALVPVFLVALFVGDGHE

SEQ ID NO: 300198 - protein, 24 aa, Mycobacterium
ALVPYIRWPMWLRTIAATVGLAIV

SEQ ID NO: 300199 - protein, 25 aa, Mycobacterium
ALVPYVRCPMWLRTVLAVVALAAIL

SEQ ID NO: 300200 - protein, 25 aa, Mycobacterium
ALVQHVRWPMWLRTLVSVLALAAIL

SEQ ID NO: 300201 - protein, 18 aa, Mycobacterium
ALVQLAGLSAVFVSLFSV

SEQ ID NO: 300202 - protein, 18 aa, Mycobacterium
ALVQVAALLAVFISMSSI

SEQ ID NO: 300203 - protein, 26 aa, Mycobacterium
ALVRAKFPGLTAHQVINRIVQSAHNP

SEQ ID NO: 300204 - protein, 19 aa, Mycobacterium
ALVRAPRTIEALGRVDTVC

SEQ ID NO: 300205 - protein, 25 aa, Mycobacterium
ALVRSRFPHLSAREVMRRIEATAVR

SEQ ID NO: 300206 - protein, 24 aa, Mycobacterium
ALVSAFCRPDPYPVRAGRLAVLGI

SEQ ID NO: 300207 - protein, 25 aa, Mycobacterium
ALVSALLVGTGWIWSLSGDSLSTAT

SEQ ID NO: 300208 - protein, 17 aa, Mycobacterium
ALVSTGVFGWVRNPIFT

SEQ ID NO: 300209 - protein, 24 aa, Mycobacterium
ALVTFNIKGSVLLGSDTTAHIRTG

SEQ ID NO: 300210 - protein, 18 aa, Mycobacterium
ALVTGLMLLKSTGRLNDF

SEQ ID NO: 300211 - protein, 31 aa, Mycobacterium
ALVTIRGRRITGWIAALFAWRRRHRQPPPAP

SEQ ID NO: 300212 - protein, 24 aa, Mycobacterium
ALVTLWLTRRGRIPDQRWYGRFGI

SEQ ID NO: 300213 - protein, 19 aa, Mycobacterium
ALVTRFPNVVVVRTFSKAY

SEQ ID NO: 300214 - protein, 18 aa, Mycobacterium
ALVTRILLVSTLLVASAW

SEQ ID NO: 300215 - protein, 24 aa, Mycobacterium
ALVTRIRWPMWLRTALATVALGAV

SEQ ID NO: 300216 - protein, 37 aa, Mycobacterium
ALVVGMCWVVLPWPRRRVAIAFVWWADISMVVGACTL

SEQ ID NO: 300217 - protein, 19 aa, Mycobacterium
ALVVIAAILFQFTLPLTPA

SEQ ID NO: 300218 - protein, 18 aa, Mycobacterium
ALVVRYALSWFKDALPGW

SEQ ID NO: 300219 - protein, 25 aa, Mycobacterium
ALVWPAAAVAVMWLLAVHHCSLRQR

SEQ ID NO: 300220 - protein, 35 aa, Mycobacterium
ALVYLGAALGWPTWWVSVCSILCLLIVQGVVVNVV

SEQ ID NO: 300221 - protein, 27 aa, Mycobacterium
ALWAVPFGLAGGRIYHVITDWKTYFGP

SEQ ID NO: 300222 - protein, 17 aa, Mycobacterium
ALWERRSSHPMLDVSVF

SEQ ID NO: 300223 - protein, 20 aa, Mycobacterium
ALWFMCAGLGLLIATLGIVS

SEQ ID NO: 300224 - protein, 29 aa, Mycobacterium
ALWGNCTIKVMVGFLFLYPAFVAKSHDAS

SEQ ID NO: 300225 - protein, 18 aa, Mycobacterium
ALWICVLNPLVIIHLMGG

SEQ ID NO: 300226 - protein, 20 aa, Mycobacterium
ALWKGRRLGPLVAEELPVVV

SEQ ID NO: 300227 - protein, 25 aa, Mycobacterium
ALWLITAVVLIVVWVQFRGGFTPKI

SEQ ID NO: 300228 - protein, 18 aa, Mycobacterium
ALWMVPFGLIGGRLYHLA

SEQ ID NO: 300229 - protein, 22 aa, Mycobacterium
ALWPAEALEAVRLLIFGGEACP

SEQ ID NO: 300230 - protein, 22 aa, Mycobacterium
ALWPLGRLLVGSSLGTVAAMVP

SEQ ID NO: 300231 - protein, 24 aa, Mycobacterium
ALWRMLVRRDWRYAAVLVGYCAGW

SEQ ID NO: 300232 - protein, 24 aa, Mycobacterium
ALWTPARQRFVWLTLLLAVITLIA

SEQ ID NO: 300233 - protein, 20 aa, Mycobacterium
ALWTVCATAIFLGARHTARM

SEQ ID NO: 300234 - protein, 21 aa, Mycobacterium
ALWTVPFGLIGGRLYHLATDW

SEQ ID NO: 300235 - protein, 18 aa, Mycobacterium
ALYAHKAFGIHFVTFLVA

SEQ ID NO: 300236 - protein, 20 aa, Mycobacterium
ALYDEVWSWGSRVLGLTSDS

SEQ ID NO: 300237 - protein, 17 aa, Mycobacterium
ALYGGPSPRVWADLVAE

SEQ ID NO: 300238 - protein, 18 aa, Mycobacterium
ALYPEIIVVALIAAGILV

SEQ ID NO: 300239 - protein, 25 aa, Mycobacterium
ALYPVDIMPTWLRWLSAVNPLSYEV

SEQ ID NO: 300240 - protein, 17 aa, Mycobacterium
ALYPVDVMPAWLRALSK

SEQ ID NO: 300241 - protein, 36 aa, Mycobacterium
ALYVFPLGVVVGGPFLPIAIILYWVSNNIWTFGQQH

SEQ ID NO: 300242 - protein, 17 aa, Mycobacterium
ALYYVMLTFVARPYLIP

SEQ ID NO: 300243 - protein, 23 aa, Mycobacterium
AMAAGLLLGRLVPGLGAGLSAIE

SEQ ID NO: 300244 - protein, 25 aa, Mycobacterium
AMAAKRVPLVTGFQTASRYQWTAGY

SEQ ID NO: 300245 - protein, 37 aa, Mycobacterium
AMAEQFLGFIVNLAIIPFQFFLEAGWIFIVGLADICE

SEQ ID NO: 300246 - protein, 35 aa, Mycobacterium
AMAFVRRSGIYFGFAIGLVQMVAWALFKNPWIMPA

SEQ ID NO: 300247 - protein, 17 aa, Mycobacterium
AMAGCGAPQALAHAQQL

SEQ ID NO: 300248 - protein, 21 aa, Mycobacterium
AMAIAALGWLPPAAGALLQEG

SEQ ID NO: 300249 - protein, 24 aa, Mycobacterium
AMAKKPAERFARCQDFAAQLQRGL

SEQ ID NO: 300250 - protein, 19 aa, Mycobacterium
AMALAAGWLRGIVDANEKL

SEQ ID NO: 300251 - protein, 21 aa, Mycobacterium
AMALAYRWGGNVGAFLLASGA

SEQ ID NO: 300252 - protein, 17 aa, Mycobacterium
AMALRRPILPVGAVLRR

SEQ ID NO: 300253 - protein, 20 aa, Mycobacterium
AMALSSLLAALGLLVTLLVH

SEQ ID NO: 300254 - protein, 18 aa, Mycobacterium
AMAPNITLLVVFRVVQGL

SEQ ID NO: 300255 - protein, 19 aa, Mycobacterium
AMASSITLLVAFRAAQGLG

SEQ ID NO: 300256 - protein, 23 aa, Mycobacterium
AMATLRVAFLSALVLELLATLGV

SEQ ID NO: 300257 - protein, 21 aa, Mycobacterium
AMATTRFGGRSWAVFSSAVLF

SEQ ID NO: 300258 - protein, 22 aa, Mycobacterium
AMAVAALGWLPPAVGALVQEGI

SEQ ID NO: 300259 - protein, 22 aa, Mycobacterium
AMAVLIVVGVIGYRMIQNNTAA

SEQ ID NO: 300260 - protein, 18 aa, Mycobacterium
AMAVPVGFTLDRFGSHGV

SEQ ID NO: 300261 - protein, 23 aa, Mycobacterium
AMCAVFLGVLIYRSPWGVASGNA

SEQ ID NO: 300262 - protein, 27 aa, Mycobacterium
AMDIARWSRRIAVQSAIVGMVLSLAAM

SEQ ID NO: 300263 - protein, 24 aa, Mycobacterium
AMDIARWSRRIAVQSASVGMGLSL

SEQ ID NO: 300264 - protein, 24 aa, Mycobacterium
AMDIARWSRRIAVQSAVVGMSLSL

SEQ ID NO: 300265 - protein, 27 aa, Mycobacterium
AMDRLERRPPFTLAMCFLGVGLALRYD

SEQ ID NO: 300266 - protein, 29 aa, Mycobacterium
AMERGEPWPPPVPEPAFKAAIAAANREAE

SEQ ID NO: 300267 - protein, 28 aa, Mycobacterium
AMERGEPWPPPVPEPAFKAAIARASQAA

SEQ ID NO: 300268 - protein, 24 aa, Mycobacterium
AMERLAWRLTRVTRFWDRDYYRTY

SEQ ID NO: 300269 - protein, 24 aa, Mycobacterium
AMEVMGVSVIRRLVVPRFAAAVMI

SEQ ID NO: 300270 - protein, 19 aa, Mycobacterium
AMFAFRYAIPAAKWPEKWA

SEQ ID NO: 300271 - protein, 24 aa, Mycobacterium
AMFALRVGLHLALLHEQHDEIASD

SEQ ID NO: 300272 - protein, 25 aa, Mycobacterium
AMFARTVKLVGWFVGWIVVASALPI

SEQ ID NO: 300273 - protein, 29 aa, Mycobacterium
AMFDEWNWWLPRWLDRLLPSVDFEKPLPK

SEQ ID NO: 300274 - protein, 26 aa, Mycobacterium
AMFDKRNWWLPGWLDHVLPTVDFETP

SEQ ID NO: 300275 - protein, 19 aa, Mycobacterium
AMFDLWFPAALGARAAVTE

SEQ ID NO: 300276 - protein, 20 aa, Mycobacterium
AMFEPRPLIVALAFAVLTAP

SEQ ID NO: 300277 - protein, 22 aa, Mycobacterium
AMFGALALMLGNFLLGMFGVGG

SEQ ID NO: 300278 - protein, 24 aa, Mycobacterium
AMGASRLARRGAIIKQLSAVETLG

SEQ ID NO: 300279 - protein, 22 aa, Mycobacterium
AMGLGAWAFGARWFARADPFEV

SEQ ID NO: 300280 - protein, 31 aa, Mycobacterium
AMGLGLCEAGMLFIRRWLTAHATMGVEADIR

SEQ ID NO: 300281 - protein, 18 aa, Mycobacterium
AMGLRVAMITGDNTRTAH

SEQ ID NO: 300282 - protein, 18 aa, Mycobacterium
AMGLVVINGLLIVLLAVT

SEQ ID NO: 300283 - protein, 24 aa, Mycobacterium
AMGPQFLAAFGWERSDFALTGVIT

SEQ ID NO: 300284 - protein, 27 aa, Mycobacterium
AMGSATNWARTALLLVEPTSATLAVVD

SEQ ID NO: 300285 - protein, 21 aa, Mycobacterium
AMGTADWSKVLARVSADPDGA

SEQ ID NO: 300286 - protein, 18 aa, Mycobacterium
AMGVLIIMVMVSWLLLAV

SEQ ID NO: 300287 - protein, 18 aa, Mycobacterium
AMHLWFLAVYVVLAALTP

SEQ ID NO: 300288 - protein, 31 aa, Mycobacterium
AMIAAVGWRTRRWRRVWVPWAASIGGGLAFT

SEQ ID NO: 300289 - protein, 27 aa, Mycobacterium
AMIALPALGLWHLWAGSPTDPVGRRGA

SEQ ID NO: 300290 - protein, 18 aa, Mycobacterium
AMIDLSTMVGRVISPTDR

SEQ ID NO: 300291 - protein, 24 aa, Mycobacterium
AMIFAICVASMFVAQAAVRPVRRL

SEQ ID NO: 300292 - protein, 22 aa, Mycobacterium
AMIPALQFTYWQWASLTLAAPV

SEQ ID NO: 300293 - protein, 21 aa, Mycobacterium
AMIQLLADRAFQWSLNAGVVI

SEQ ID NO: 300294 - protein, 30 aa, Mycobacterium
AMIVIICVFSMLIAQLMVRPIRRLEAGTEK

SEQ ID NO: 300295 - protein, 18 aa, Mycobacterium
AMIVPGFFGSAFGTYLMR

SEQ ID NO: 300296 - protein, 23 aa, Mycobacterium
AMIVSAVGWFFAIRGVLLLTLPR

SEQ ID NO: 300297 - protein, 18 aa, Mycobacterium
AMIVSLFIVAFLFITQTW

SEQ ID NO: 300298 - protein, 22 aa, Mycobacterium
AMKGDGKGAGPLADLINNSTNA

SEQ ID NO: 300299 - protein, 23 aa, Mycobacterium
AMLAGVLVIVGLGYVGYMAVHGD

SEQ ID NO: 300300 - protein, 26 aa, Mycobacterium
AMLARAGVPPRQWQWPLGEIDKPFEM

SEQ ID NO: 300301 - protein, 25 aa, Mycobacterium
AMLARARWPLRAPRAAMVLWQAVAL

SEQ ID NO: 300302 - protein, 18 aa, Mycobacterium
AMLARLSGEYPPVRGVIH

SEQ ID NO: 300303 - protein, 29 aa, Mycobacterium
AMLFCVIPAVAGLLSWLLLGQRVDIGMGI

SEQ ID NO: 300304 - protein, 20 aa, Mycobacterium
AMLKRPNLRNDLSYGVYIYA

SEQ ID NO: 300305 - protein, 17 aa, Mycobacterium
AMLKRYGPLPPPRAVAI

SEQ ID NO: 300306 - protein, 25 aa, Mycobacterium
AMLLFLRIVQGVGLGGEYGSAVVYV

SEQ ID NO: 300307 - protein, 18 aa, Mycobacterium
AMLLLPLLIRAPDTARWY

SEQ ID NO: 300308 - protein, 23 aa, Mycobacterium
AMLQRRLGGRLGARLRAETQDHA

SEQ ID NO: 300309 - protein, 18 aa, Mycobacterium
AMLRSGWYRLPPADQRKK

SEQ ID NO: 300310 - protein, 27 aa, Mycobacterium
AMLTWRALRPSWGEWRSAGAAATAATL

SEQ ID NO: 300311 - protein, 28 aa, Mycobacterium
AMLTWRLLRPHWCEWRTAGAAATAAALS

SEQ ID NO: 300312 - protein, 17 aa, Mycobacterium
AMLVVLCAPLAGGSPLG

SEQ ID NO: 300313 - protein, 19 aa, Mycobacterium
AMMYELFFPSLLEKRLLRL

SEQ ID NO: 300314 - protein, 23 aa, Mycobacterium
AMNSAWGFSKWWVAVGTVIVLAF

SEQ ID NO: 300315 - protein, 28 aa, Mycobacterium
AMNSYGWRIPFMIAGLLGAVGLYIRLKL

SEQ ID NO: 300316 - protein, 17 aa, Mycobacterium
AMPARRTGPVVVDRHSD

SEQ ID NO: 300317 - protein, 29 aa, Mycobacterium
AMPDIAAGVKLCMAYSVIATLAMEFILAS

SEQ ID NO: 300318 - protein, 27 aa, Mycobacterium
AMPILPQAWRAWAWVIIVVGVVSVLYG

SEQ ID NO: 300319 - protein, 22 aa, Mycobacterium
AMPLGIWLFGPLRRRATASLAI

SEQ ID NO: 300320 - protein, 25 aa, Mycobacterium
AMPPERWVGFVLIWAALVIFTADTV

SEQ ID NO: 300321 - protein, 17 aa, Mycobacterium
AMPVGSPLRARIDQALL

SEQ ID NO: 300322 - protein, 20 aa, Mycobacterium
AMQAGCRFTAQLGAMRIAEE

SEQ ID NO: 300323 - protein, 21 aa, Mycobacterium
AMQIPAGWLIDRFGPRKLITA

SEQ ID NO: 300324 - protein, 21 aa, Mycobacterium
AMRATCLRYAAGIAAVQAAWV

SEQ ID NO: 300325 - protein, 18 aa, Mycobacterium
AMRGLRRRMPLLADTTLF

SEQ ID NO: 300326 - protein, 31 aa, Mycobacterium
AMRPDCRLDVAGLWGVLRINRYEQMYGTARL

SEQ ID NO: 300327 - protein, 23 aa, Mycobacterium
AMRRTVLPQAMRVIIPPTGNEII

SEQ ID NO: 300328 - protein, 18 aa, Mycobacterium
AMRYKEDYQEAGVPMLPA

SEQ ID NO: 300329 - protein, 24 aa, Mycobacterium
AMRYKEDYRAAGVPMLPVIATEEK

SEQ ID NO: 300330 - protein, 28 aa, Mycobacterium
AMSAFFTPRFVNWFGLFTTHVIIAVALA

SEQ ID NO: 300331 - protein, 25 aa, Mycobacterium
AMSHIKLALIAGLVGVLALAGLAGW

SEQ ID NO: 300332 - protein, 23 aa, Mycobacterium
AMSLKSRLLRKWAAEEESVAAID

SEQ ID NO: 300333 - protein, 24 aa, Mycobacterium
AMSQAMLLPAFIALFGVVAALFLL

SEQ ID NO: 300334 - protein, 23 aa, Mycobacterium
AMSQSMLLPAFVALFGVIAALFL

SEQ ID NO: 300335 - protein, 28 aa, Mycobacterium
AMSRDPRLRFGSAPQMRAALAGDPLALN

SEQ ID NO: 300336 - protein, 18 aa, Mycobacterium
AMSRVLRTFIYMRTGVRA

SEQ ID NO: 300337 - protein, 23 aa, Mycobacterium
AMTELRRGRTCFVIAHRLSTIRD

SEQ ID NO: 300338 - protein, 26 aa, Mycobacterium
AMTFALRYRWWVVLGGITLATTAVHL

SEQ ID NO: 300339 - protein, 21 aa, Mycobacterium
AMTGGAWQWSTSKNARLNTVN

SEQ ID NO: 300340 - protein, 17 aa, Mycobacterium
AMTGRYVLSSQFYLALP

SEQ ID NO: 300341 - protein, 30 aa, Mycobacterium
AMTLSRLLAGLAPRLNPWLTGAGIVGCVAL

SEQ ID NO: 300342 - protein, 17 aa, Mycobacterium
AMVAVGVGWITATLLPA

SEQ ID NO: 300343 - protein, 24 aa, Mycobacterium
AMVDRLRRILPFVNRIGGALLVLV

SEQ ID NO: 300344 - protein, 24 aa, Mycobacterium
AMVLRLACREVKDAGLDVDIHVNV

SEQ ID NO: 300345 - protein, 31 aa, Mycobacterium
AMVVEARPGTTLYGLHAMFFDQPRVNEKHQA

SEQ ID NO: 300346 - protein, 18 aa, Mycobacterium
AMVVLRLFQGALINAWQT

SEQ ID NO: 300347 - protein, 20 aa, Mycobacterium
AMVVSDLRIVGQLGTTIGLG

SEQ ID NO: 300348 - protein, 19 aa, Mycobacterium
AMVVWRFSGARTFSPSAER

SEQ ID NO: 300349 - protein, 29 aa, Mycobacterium
AMVWAIGWPEAVFRFVLYAFLCATALIVV

SEQ ID NO: 300350 - protein, 26 aa, Mycobacterium
AMWALLSWLVVRWVRTRRDGLLLVAG

SEQ ID NO: 300351 - protein, 19 aa, Mycobacterium
AMWLWNNAIQPAWDGIKNA

SEQ ID NO: 300352 - protein, 21 aa, Mycobacterium
AMWMKEQRTIAALPVVSVADA

SEQ ID NO: 300353 - protein, 18 aa, Mycobacterium
AMYVAAYCVGRFCVELMR

SEQ ID NO: 300354 - protein, 22 aa, Mycobacterium
ANAEFWVVLILQPRPDGTLSGE

SEQ ID NO: 300355 - protein, 21 aa, Mycobacterium
ANALQAFGLKADYASKAADVL

SEQ ID NO: 300356 - protein, 18 aa, Mycobacterium
ANATRFMFAVTFFGSCLL

SEQ ID NO: 300357 - protein, 18 aa, Mycobacterium
ANAVHFGAVISKVLIPAF

SEQ ID NO: 300358 - protein, 19 aa, Mycobacterium
ANAVLGGWLAVAGGAWFVV

SEQ ID NO: 300359 - protein, 23 aa, Mycobacterium
ANAVVSMGLLRGQLAGVISGFVL

SEQ ID NO: 300360 - protein, 20 aa, Mycobacterium
ANCSWLFAWHHNLFPLSMAL

SEQ ID NO: 300361 - protein, 26 aa, Mycobacterium
ANDFAAKQAQAWPKCNGATLHVSERG

SEQ ID NO: 300362 - protein, 26 aa, Mycobacterium
ANDHRFEIAESIDLRTFPGTEYGPNS

SEQ ID NO: 300363 - protein, 25 aa, Mycobacterium
ANDPAPAALWIWAGLTGVAATVLVL

SEQ ID NO: 300364 - protein, 21 aa, Mycobacterium
ANFADRPWASDYLRLADAQQF

SEQ ID NO: 300365 - protein, 22 aa, Mycobacterium
ANFDITHHVRWAALPRPGDDAA

SEQ ID NO: 300366 - protein, 17 aa, Mycobacterium
ANFFGGLLMAFSLAVIM

SEQ ID NO: 300367 - protein, 18 aa, Mycobacterium
ANFSLGFTYLSPVVGIYT

SEQ ID NO: 300368 - protein, 18 aa, Mycobacterium
ANGDAVGVSGIWDGSTLF

SEQ ID NO: 300369 - protein, 18 aa, Mycobacterium
ANGGRYHGIWSMTLAIAS

SEQ ID NO: 300370 - protein, 17 aa, Mycobacterium
ANGLGFMAGAIVGHVLL

SEQ ID NO: 300371 - protein, 19 aa, Mycobacterium
ANGTPFVWDGKKAVDLQNS

SEQ ID NO: 300372 - protein, 35 aa, Mycobacterium
ANGVRRGWSGMPVALRLLLPIAMVLTLVGIGFAFW

SEQ ID NO: 300373 - protein, 25 aa, Mycobacterium
ANHNGRRLFAVLLHGTRQPIAPWEQ

SEQ ID NO: 300374 - protein, 26 aa, Mycobacterium
ANHNGRRLMAVLLHGTRQPIAPWEQA

SEQ ID NO: 300375 - protein, 17 aa, Mycobacterium
ANHPVTTIIGWAVGVMI

SEQ ID NO: 300376 - protein, 19 aa, Mycobacterium
ANIALTERIIEFARTQQAL

SEQ ID NO: 300377 - protein, 22 aa, Mycobacterium
ANIDGLAAVFARVPVLEGAAEP

SEQ ID NO: 300378 - protein, 19 aa, Mycobacterium
ANILQYLSLTWFAIAVMAL

SEQ ID NO: 300379 - protein, 19 aa, Mycobacterium
ANILREFKTAKRDALLASL

SEQ ID NO: 300380 - protein, 29 aa, Mycobacterium
ANIPMLLFCIAFGLAMDYEVFLVSRIREY

SEQ ID NO: 300381 - protein, 17 aa, Mycobacterium
ANIVGGIDWDGHGLLGL

SEQ ID NO: 300382 - protein, 17 aa, Mycobacterium
ANKARDWDSKRDAAVEQ

SEQ ID NO: 300383 - protein, 21 aa, Mycobacterium
ANKVRFGLRFDTLPTVTEIVA

SEQ ID NO: 300384 - protein, 18 aa, Mycobacterium
ANLACVVCAIGLGGVAGL

SEQ ID NO: 300385 - protein, 19 aa, Mycobacterium
ANLACVVCAIGLGSVAGIS

SEQ ID NO: 300386 - protein, 18 aa, Mycobacterium
ANLACVVCAIGLGSVAGV

SEQ ID NO: 300387 - protein, 20 aa, Mycobacterium
ANLACVVCAIGLGSVAGVSR

SEQ ID NO: 300388 - protein, 20 aa, Mycobacterium
ANLADIWRRHDLPRDGKAPV

SEQ ID NO: 300389 - protein, 20 aa, Mycobacterium
ANLADIWRRRDLPRDAKAPV

SEQ ID NO: 300390 - protein, 20 aa, Mycobacterium
ANLEAIIGIAALAQNYELDL

SEQ ID NO: 300391 - protein, 25 aa, Mycobacterium
ANLFVVAFGMSWGPVVWVLLGEIFP

SEQ ID NO: 300392 - protein, 25 aa, Mycobacterium
ANLFVVAFGMSWGPVVWVLLGEMFP

SEQ ID NO: 300393 - protein, 22 aa, Mycobacterium
ANNRRVIWQGIGHGASIYDTCA

SEQ ID NO: 300394 - protein, 17 aa, Mycobacterium
ANPEERAAALIRPAVMY

SEQ ID NO: 300395 - protein, 18 aa, Mycobacterium
ANPIEWELLSTAHPADVH

SEQ ID NO: 300396 - protein, 19 aa, Mycobacterium
ANPLWDGRVGVLQVTDAVE

SEQ ID NO: 300397 - protein, 26 aa, Mycobacterium
ANPNCGIALHCGRSGAGVFDYDMNNL

SEQ ID NO: 300398 - protein, 20 aa, Mycobacterium
ANPNHAVALVYVDQTVSVGN

SEQ ID NO: 300399 - protein, 23 aa, Mycobacterium
ANPQRPGPFGLPAPTEEAVTALV

SEQ ID NO: 300400 - protein, 17 aa, Mycobacterium
ANPRATLGLTAIVVVAI

SEQ ID NO: 300401 - protein, 24 aa, Mycobacterium
ANPRPVPEADLARAKRGPLLGIPG

SEQ ID NO: 300402 - protein, 26 aa, Mycobacterium
ANPVFIPRFLFSMSVVGVLVATSSYL

SEQ ID NO: 300403 - protein, 17 aa, Mycobacterium
ANQLKAIDFAGGTAVHI

SEQ ID NO: 300404 - protein, 23 aa, Mycobacterium
ANRALDLLCCMPAALTAADMYEV

SEQ ID NO: 300405 - protein, 21 aa, Mycobacterium
ANRALRLALVTANGLAQNGPA

SEQ ID NO: 300406 - protein, 34 aa, Mycobacterium
ANRGRLWRRVGTAVVRWPAPILALSGAIVLVGMV

SEQ ID NO: 300407 - protein, 20 aa, Mycobacterium
ANRIPLYAAVGVVTVLVAAG

SEQ ID NO: 300408 - protein, 18 aa, Mycobacterium
ANRPRASQARRRAAEARP

SEQ ID NO: 300409 - protein, 26 aa, Mycobacterium
ANRTLPELWKLLGHIDAVHGFYYLLM

SEQ ID NO: 300410 - protein, 25 aa, Mycobacterium
ANRTLRGVLIATNFFGINTIPIAVN

SEQ ID NO: 300411 - protein, 20 aa, Mycobacterium
ANRYAIFWPEGHEFELLMIV

SEQ ID NO: 300412 - protein, 20 aa, Mycobacterium
ANSALTERIIEFARTQQALR

SEQ ID NO: 300413 - protein, 18 aa, Mycobacterium
ANSLWTWVTGAFVLVLGL

SEQ ID NO: 300414 - protein, 20 aa, Mycobacterium
ANSPSQFKTTVVFNDGKEVP

SEQ ID NO: 300415 - protein, 25 aa, Mycobacterium
ANSVILRIALFFVGSAFLLVTILPW

SEQ ID NO: 300416 - protein, 18 aa, Mycobacterium
ANTALRLVKVPVKDELEV

SEQ ID NO: 300417 - protein, 18 aa, Mycobacterium
ANTFARFRQRFAGYGLRP

SEQ ID NO: 300418 - protein, 30 aa, Mycobacterium
ANTPNGGIFARFPWLKIPLADIESNGAWEP

SEQ ID NO: 300419 - protein, 22 aa, Mycobacterium
ANTSWLPALWFVAKVWGFMFLF

SEQ ID NO: 300420 - protein, 17 aa, Mycobacterium
ANVDGLVAFLDHVHLQW

SEQ ID NO: 300421 - protein, 23 aa, Mycobacterium
ANVEGLASFMTRIHLQGAAADLK

SEQ ID NO: 300422 - protein, 22 aa, Mycobacterium
ANVEGLSSFMARMGMEGAAEDL

SEQ ID NO: 300423 - protein, 25 aa, Mycobacterium
ANVFTRINAILGVLFVIVLSTGSVI

SEQ ID NO: 300424 - protein, 19 aa, Mycobacterium
ANVFTRINAILGVLLAIVL

SEQ ID NO: 300425 - protein, 24 aa, Mycobacterium
ANVFTRINAILGVLLIIVLSTGSI

SEQ ID NO: 300426 - protein, 19 aa, Mycobacterium
ANVFTRINAILGVLLLIVL

SEQ ID NO: 300427 - protein, 24 aa, Mycobacterium
ANVFTRINAILGVLLLIVLATGSL

SEQ ID NO: 300428 - protein, 18 aa, Mycobacterium
ANVGRLILIAAIGTILAV

SEQ ID NO: 300429 - protein, 25 aa, Mycobacterium
ANVNMCRLWWNKPWPMRIAALARLP

SEQ ID NO: 300430 - protein, 25 aa, Mycobacterium
ANVRELRETWTLSGRALGVGMPLTM

SEQ ID NO: 300431 - protein, 23 aa, Mycobacterium
ANVSDRIGRRPVYAAGALISVLW

SEQ ID NO: 300432 - protein, 20 aa, Mycobacterium
ANVSKWAFLLTFAGVGLNTD

SEQ ID NO: 300433 - protein, 20 aa, Mycobacterium
ANVSLIWFAVCSSVVHAVIM

SEQ ID NO: 300434 - protein, 18 aa, Mycobacterium
ANVTMLLALHTWLLSLAS

SEQ ID NO: 300435 - protein, 21 aa, Mycobacterium
ANWCLRRVGVTPVDELADSQD

SEQ ID NO: 300436 - protein, 26 aa, Mycobacterium
ANWILRRLGIEPAEELRSARSPQELV

SEQ ID NO: 300437 - protein, 17 aa, Mycobacterium
ANWLITVSFPELRNHLG

SEQ ID NO: 300438 - protein, 23 aa, Mycobacterium
ANYAKLVAFTQFVPVLSEMTEEL

SEQ ID NO: 300439 - protein, 17 aa, Mycobacterium
ANYFRSFSGRGRGVHVV

SEQ ID NO: 300440 - protein, 23 aa, Mycobacterium
ANYGAWWFWLGLILIVGILLLVG

SEQ ID NO: 300441 - protein, 20 aa, Mycobacterium
ANYLAALAITVFVPFILWNF

SEQ ID NO: 300442 - protein, 28 aa, Mycobacterium
ANYWVMSHMLPLFRRMQGLIDGINRVLR

SEQ ID NO: 300443 - protein, 25 aa, Mycobacterium
APAAPRYEAAVAIRRIAIDAQRDEL

SEQ ID NO: 300444 - protein, 19 aa, Mycobacterium
APAARRALLRLSLTEAAVF

SEQ ID NO: 300445 - protein, 18 aa, Mycobacterium
APAAVVFVVSAAAELTAS

SEQ ID NO: 300446 - protein, 18 aa, Mycobacterium
APAEARRQADIAIAEGAR

SEQ ID NO: 300447 - protein, 22 aa, Mycobacterium
APAERRALIFGPLYRILGTPVV

SEQ ID NO: 300448 - protein, 22 aa, Mycobacterium
APAESFPAWLGPFVRQQPVSRV

SEQ ID NO: 300449 - protein, 25 aa, Mycobacterium
APAFLPAVIVVAVILYIALRDRREG

SEQ ID NO: 300450 - protein, 17 aa, Mycobacterium
APAGLGWALLGVVAAVL

SEQ ID NO: 300451 - protein, 28 aa, Mycobacterium
APAGPARPRRRRLLWTLIAAPFALLAVA

SEQ ID NO: 300452 - protein, 23 aa, Mycobacterium
APAHGPATAGFRVVEPDEETVAE

SEQ ID NO: 300453 - protein, 18 aa, Mycobacterium
APAHKVPVWSLLLMGAAA

SEQ ID NO: 300454 - protein, 27 aa, Mycobacterium
APAHPSRWRHVPTILLATSLVLLTTAM

SEQ ID NO: 300455 - protein, 30 aa, Mycobacterium
APAIARWARRPRVWWLAAIGNSGAMTLYLW

SEQ ID NO: 300456 - protein, 30 aa, Mycobacterium
APAIARWARRPRVWWLTAIGNTGAMTLYLW

SEQ ID NO: 300457 - protein, 24 aa, Mycobacterium
APAIPAMMPMFLVVFAAVAAGLLQ

SEQ ID NO: 300458 - protein, 25 aa, Mycobacterium
APALLWPRQRQLLAARRVEATLVVV

SEQ ID NO: 300459 - protein, 19 aa, Mycobacterium
APAMYRIVRELATSAHQPM

SEQ ID NO: 300460 - protein, 19 aa, Mycobacterium
APANRWVRHATARVAQPRP

SEQ ID NO: 300461 - protein, 22 aa, Mycobacterium
APAPEVRPPVAVPEPAPAPPVP

SEQ ID NO: 300462 - protein, 22 aa, Mycobacterium
APAPKLGVRDVLFGGRVSIPAL

SEQ ID NO: 300463 - protein, 18 aa, Mycobacterium
APAPRPGKPGKNGDANRP

SEQ ID NO: 300464 - protein, 17 aa, Mycobacterium
APARLAAVLATCLALTF

SEQ ID NO: 300465 - protein, 25 aa, Mycobacterium
APARLDDARFLLPVLGVPPDQPTEA

SEQ ID NO: 300466 - protein, 25 aa, Mycobacterium
APARLDDARFLLPVLGVPPPNNAAS

SEQ ID NO: 300467 - protein, 25 aa, Mycobacterium
APARLDNARFLLPVVGVPPDKSDRA

SEQ ID NO: 300468 - protein, 24 aa, Mycobacterium
APARLDNARFLLPVVGVPPDQGGD

SEQ ID NO: 300469 - protein, 25 aa, Mycobacterium
APARLDNARFLLPVVGVPPDRADDV

SEQ ID NO: 300470 - protein, 25 aa, Mycobacterium
APARLDNARFLLPVVGVPPDRDADF

SEQ ID NO: 300471 - protein, 24 aa, Mycobacterium
APARPRSLDWFGLLTLGSGIAATL

SEQ ID NO: 300472 - protein, 18 aa, Mycobacterium
APARRVGTDIVDRLQQSP

SEQ ID NO: 300473 - protein, 31 aa, Mycobacterium
APARSTPRLPRWWPPAAIGLAAAIVVTGVVL

SEQ ID NO: 300474 - protein, 26 aa, Mycobacterium
APARVAQKLLLLWGVGAVLLTVLYGL

SEQ ID NO: 300475 - protein, 17 aa, Mycobacterium
APASFGRLTSRRVPANA

SEQ ID NO: 300476 - protein, 19 aa, Mycobacterium
APASPRRQRCCCADSARIC

SEQ ID NO: 300477 - protein, 17 aa, Mycobacterium
APATALVPVTAFGYGLR

SEQ ID NO: 300478 - protein, 36 aa, Mycobacterium
APATPVWRLAVPIAFLGVGMVFAWPVLTVTATRDLP

SEQ ID NO: 300479 - protein, 25 aa, Mycobacterium
APAVVAWGAMLGWIDVADKWSEWMA

SEQ ID NO: 300480 - protein, 18 aa, Mycobacterium
APAWSRRLVRRGWPKPLA

SEQ ID NO: 300481 - protein, 26 aa, Mycobacterium
APAYRFPGYLGFHIVERWQFHYSQVV

SEQ ID NO: 300482 - protein, 17 aa, Mycobacterium
APCNEFATAAAKALADR

SEQ ID NO: 300483 - protein, 24 aa, Mycobacterium
APDAICVTDPLAFSGCGRGRGQAS

SEQ ID NO: 300484 - protein, 23 aa, Mycobacterium
APDAICVTDPLAFTGCGRNGSQR

SEQ ID NO: 300485 - protein, 19 aa, Mycobacterium
APDALRLPLHDDMQLALIE

SEQ ID NO: 300486 - protein, 24 aa, Mycobacterium
APDAPPGWLPDWLRPVGSRRASAP

SEQ ID NO: 300487 - protein, 19 aa, Mycobacterium
APDAQWRRVTATGHYLPDV

SEQ ID NO: 300488 - protein, 28 aa, Mycobacterium
APDERRVASWLAAFLVPSAICAVIVTAL

SEQ ID NO: 300489 - protein, 23 aa, Mycobacterium
APDFRLFWDNAYAVHTLTHDFVR

SEQ ID NO: 300490 - protein, 36 aa, Mycobacterium
APDGGLGFGQLRYCNPRTSAVLARLGTPQLLFNYLG

SEQ ID NO: 300491 - protein, 25 aa, Mycobacterium
APDGRFPWVIAVVFAAGAHFAALRP

SEQ ID NO: 300492 - protein, 19 aa, Mycobacterium
APDKAFRAAMDLLNRGVLL

SEQ ID NO: 300493 - protein, 27 aa, Mycobacterium
APDKARAAVTQGLFPVISLVLLGLGLA

SEQ ID NO: 300494 - protein, 25 aa, Mycobacterium
APDLRPRNVALLGLGAAVLATGALF

SEQ ID NO: 300495 - protein, 25 aa, Mycobacterium
APDPAVVVPPLLPFLVPPVLATGPE

SEQ ID NO: 300496 - protein, 34 aa, Mycobacterium
APDRPRRFRVGLSRPRWTTVAAAVALLCTAALLT

SEQ ID NO: 300497 - protein, 24 aa, Mycobacterium
APDRVRGPLAYVIDLLAAVPSIVY

SEQ ID NO: 300498 - protein, 23 aa, Mycobacterium
APDTARWYVLKGRLDDARSALLR

SEQ ID NO: 300499 - protein, 17 aa, Mycobacterium
APDTLMVTGLVFVAVGF

SEQ ID NO: 300500 - protein, 22 aa, Mycobacterium
APDTMRCAASMALAPEEPVNLS

SEQ ID NO: 300501 - protein, 38 aa, Mycobacterium; identical to SEQ ID NO: 13044

SEQ ID NO: 300502 - protein, 27 aa, Mycobacterium
APDTSKPVWITMLWPLADRPRLAPGVP

SEQ ID NO: 300503 - protein, 18 aa, Mycobacterium
APDVVLRFQGTHWVAMDG

SEQ ID NO: 300504 - protein, 23 aa, Mycobacterium
APEAFRAQMMALYFFSLGLGTAM

SEQ ID NO: 300505 - protein, 27 aa, Mycobacterium
APEDSWRKRLPAIFVDVARFGVIGVGL

SEQ ID NO: 300506 - protein, 28 aa, Mycobacterium
APEDSWRKRLPTIFLDVARFALIGVGLA

SEQ ID NO: 300507 - protein, 21 aa, Mycobacterium
APEELHALLVHERVSVLSQTP

SEQ ID NO: 300508 - protein, 18 aa, Mycobacterium
APEIYRIVRELATTAHQP

SEQ ID NO: 300509 - protein, 18 aa, Mycobacterium
APEKAAWGIALGLAVTLV

SEQ ID NO: 300510 - protein, 18 aa, Mycobacterium
APEKAAWGIALGLTVTLV

SEQ ID NO: 300511 - protein, 18 aa, Mycobacterium
APEKARKSPVIWWAVSST

SEQ ID NO: 300512 - protein, 22 aa, Mycobacterium
APEMLPAGWGQFGQLLPQGATA

SEQ ID NO: 300513 - protein, 26 aa, Mycobacterium
APEPPAAPQALAWSDADDVPDVAPPD

SEQ ID NO: 300514 - protein, 17 aa, Mycobacterium
APERLWHVVKLRRAALS

SEQ ID NO: 300515 - protein, 24 aa, Mycobacterium
APERNRFGAWLSRPMTSFHLIIAV

SEQ ID NO: 300516 - protein, 32 aa, Mycobacterium
APERRRAATDLKRLLPYLIPYRTRWIVIVVAA

SEQ ID NO: 300517 - protein, 23 aa, Mycobacterium
APETILPRCRFADPDADLAHAES

SEQ ID NO: 300518 - protein, 23 aa, Mycobacterium
APETILPRCRFADPDADLEHAEA

SEQ ID NO: 300519 - protein, 27 aa, Mycobacterium
APETTKPVWITMLWPLADRPRLAPGVP

SEQ ID NO: 300520 - protein, 22 aa, Mycobacterium
APEVFWPLRRVGAAFHAAQDGK

SEQ ID NO: 300521 - protein, 20 aa, Mycobacterium
APEVPVLPAPAVPEPVVAVP

SEQ ID NO: 300522 - protein, 20 aa, Mycobacterium
APEVYWPLRRVGIQFHSAAD

SEQ ID NO: 300523 - protein, 17 aa, Mycobacterium
APFALAVGLTFNRIMAA

SEQ ID NO: 300524 - protein, 18 aa, Mycobacterium
APFGKFLLVAAALGIAAF

SEQ ID NO: 300525 - protein, 25 aa, Mycobacterium
APFGWYYDLLALWAHVSTASIWMRL

SEQ ID NO: 300526 - protein, 25 aa, Mycobacterium
APFGWYYDLLALWAHVSTTSIWMRL

SEQ ID NO: 300527 - protein, 19 aa, Mycobacterium
APFLANMFGWVFTEMGRQP

SEQ ID NO: 300528 - protein, 23 aa, Mycobacterium
APFLILLIVLEWIAARKLLTTSA

SEQ ID NO: 300529 - protein, 25 aa, Mycobacterium
APFNVRGARNLPCVTVPGKRAPTAK

SEQ ID NO: 300530 - protein, 17 aa, Mycobacterium
APFPDRDLLLFCTLVVV

SEQ ID NO: 300531 - protein, 18 aa, Mycobacterium
APFPDRSLLIFIVTVVIL

SEQ ID NO: 300532 - protein, 18 aa, Mycobacterium
APFPDRSLLIFVVVVVIL

SEQ ID NO: 300533 - protein, 20 aa, Mycobacterium
APFQLAHGWADILGTDPLGR

SEQ ID NO: 300534 - protein, 22 aa, Mycobacterium
APFRIREYRLLIAAVTLSIFAE

SEQ ID NO: 300535 - protein, 18 aa, Mycobacterium
APFTIAVLAVLLAVFSIV

SEQ ID NO: 300536 - protein, 17 aa, Mycobacterium
APFVLPLAVTIFVFILI

SEQ ID NO: 300537 - protein, 36 aa, Mycobacterium
APFWVAFVAFMVWLLLRFDPFRAMRPYPQVLVAGAV

SEQ ID NO: 300538 - protein, 17 aa, Mycobacterium
APGELGLTAAGDVIGTC

SEQ ID NO: 300539 - protein, 17 aa, Mycobacterium
APGENLTSLGYDGQPVN

SEQ ID NO: 300540 - protein, 27 aa, Mycobacterium
APGHLHAAAALPAWSMVTAHVVAVVAG

SEQ ID NO: 300541 - protein, 22 aa, Mycobacterium
APGKRRSRRILLGSAVVVLLVG

SEQ ID NO: 300542 - protein, 18 aa, Mycobacterium
APGLPIDTILPFMTMFAV

SEQ ID NO: 300543 - protein, 24 aa, Mycobacterium
APGLRLAVVFLCTAALVAAVLTGY

SEQ ID NO: 300544 - protein, 24 aa, Mycobacterium
APGLRLAVVFLCTAALVAAVVTAY

SEQ ID NO: 300545 - protein, 21 aa, Mycobacterium
APGNELAPWLKAAIGVVPPVS

SEQ ID NO: 300546 - protein, 25 aa, Mycobacterium
APGQEWRMVWDSALDRAEIGHGVES

SEQ ID NO: 300547 - protein, 25 aa, Mycobacterium
APGQEWRMVWDSALDRAEIGQGVES

SEQ ID NO: 300548 - protein, 22 aa, Mycobacterium
APGQLWLFWVAPLIGGLIGGLL

SEQ ID NO: 300549 - protein, 24 aa, Mycobacterium
APGQRFADRAAFWLVLVALIGGTA

SEQ ID NO: 300550 - protein, 17 aa, Mycobacterium
APGRDVIVGYGPGCDIA

SEQ ID NO: 300551 - protein, 17 aa, Mycobacterium
APGRILIGFAAVGLIVF

SEQ ID NO: 300552 - protein, 17 aa, Mycobacterium
APGRLLAALAALGLLIF

SEQ ID NO: 300553 - protein, 22 aa, Mycobacterium
APGSALWGLLAVIAKDQLDLTS

SEQ ID NO: 300554 - protein, 24 aa, Mycobacterium
APGVILRQILTWMLSTAVPLMAIV

SEQ ID NO: 300555 - protein, 20 aa, Mycobacterium
APGVNRQRLLAGVREAAPAP

SEQ ID NO: 300556 - protein, 36 aa, Mycobacterium
APGVVPAPIPLPIPIIIPPWPNWSPGMPTPSTVTVT

SEQ ID NO: 300557 - protein, 22 aa, Mycobacterium
APGVWRVRCCLAPAEPAVRAGS

SEQ ID NO: 300558 - protein, 25 aa, Mycobacterium
APHERGELFAAVFVVSYLAFGGPAV

SEQ ID NO: 300559 - protein, 18 aa, Mycobacterium
APHLYRPAGGVSNAAVRA

SEQ ID NO: 300560 - protein, 24 aa, Mycobacterium
APHNLRLGPYSVMHAIADHVVDTY

SEQ ID NO: 300561 - protein, 23 aa, Mycobacterium
APHPAAYCVTGRPDSVVVVTTAA

SEQ ID NO: 300562 - protein, 17 aa, Mycobacterium
APIAGPILGGWLIDTSS

SEQ ID NO: 300563 - protein, 19 aa, Mycobacterium
APIDRAWDVLCDLEQVIPL

SEQ ID NO: 300564 - protein, 24 aa, Mycobacterium
APIGAPILGGWVIDTYGWEWIFLI

SEQ ID NO: 300565 - protein, 20 aa, Mycobacterium
APIGAPVWLRIFGVATVVSL

SEQ ID NO: 300566 - protein, 24 aa, Mycobacterium
APIGFRLAAFALPGTVIGALLALA

SEQ ID NO: 300567 - protein, 17 aa, Mycobacterium
APIGGPILGGWLIDTSS

SEQ ID NO: 300568 - protein, 25 aa, Mycobacterium
APIIGGIRPGLFVSSNFLPGSPAYT

SEQ ID NO: 300569 - protein, 19 aa, Mycobacterium
APIKRAAAFTTLYREVLAA

SEQ ID NO: 300570 - protein, 25 aa, Mycobacterium
APILQVLRYAPKMILLVVLLGLGQQ

SEQ ID NO: 300571 - protein, 22 aa, Mycobacterium
APIPWMIEAALVLSLAARHWTD

SEQ ID NO: 300572 - protein, 17 aa, Mycobacterium
APKAGYVANYYRYFGTT

SEQ ID NO: 300573 - protein, 17 aa, Mycobacterium
APKFDRGPVEFAGERRV

SEQ ID NO: 300574 - protein, 19 aa, Mycobacterium
APKGIGYVNFVVWLLPAVL

SEQ ID NO: 300575 - protein, 34 aa, Mycobacterium
APKQPTRWRHLPAILMVCSLVLFTIAMAGPTHDV

SEQ ID NO: 300576 - protein, 24 aa, Mycobacterium
APKVVRPPLRERLLVRLASIDLNP

SEQ ID NO: 300577 - protein, 23 aa, Mycobacterium
APLAAVLCRQRREIVLAAGAMLA

SEQ ID NO: 300578 - protein, 18 aa, Mycobacterium
APLAISLRDAVTIEGDAV

SEQ ID NO: 300579 - protein, 23 aa, Mycobacterium
APLDGGRLVRAYLWRRHGDIVRA

SEQ ID NO: 300580 - protein, 17 aa, Mycobacterium
APLDRRLLLGMLAELAA

SEQ ID NO: 300581 - protein, 20 aa, Mycobacterium
APLDWTWPAVSLVALQLLAS

SEQ ID NO: 300582 - protein, 22 aa, Mycobacterium
APLEARIPLAVELQVEQVVRSS

SEQ ID NO: 300583 - protein, 20 aa, Mycobacterium
APLEDIEFFTAFKNGVLHPQ

SEQ ID NO: 300584 - protein, 25 aa, Mycobacterium
APLFPMIVAVPGWAYLALPVVATLI

SEQ ID NO: 300585 - protein, 17 aa, Mycobacterium
APLGARVRNTWRALTSM

SEQ ID NO: 300586 - protein, 26 aa, Mycobacterium
APLGLTPPRLWAGLRLGAVAAAPVAT

SEQ ID NO: 300587 - protein, 18 aa, Mycobacterium
APLGWLYVLCGALVFAAL

SEQ ID NO: 300588 - protein, 23 aa, Mycobacterium
APLKFAQLVGLIFAVLGTAGFAA

SEQ ID NO: 300589 - protein, 19 aa, Mycobacterium
APLLLWQLATRHFTNITVE

SEQ ID NO: 300590 - protein, 29 aa, Mycobacterium
APLLWLPACAVFFPLWLVLQIVSGRQGDA

SEQ ID NO: 300591 - protein, 19 aa, Mycobacterium
APLNATRFVACPWGGPGTR

SEQ ID NO: 300592 - protein, 20 aa, Mycobacterium
APLPEPITTTILGPNSSPTV

SEQ ID NO: 300593 - protein, 24 aa, Mycobacterium
APLPRFEAEAALNLLHRTRRIAAH

SEQ ID NO: 300594 - protein, 23 aa, Mycobacterium
APLPTQRPIPVWFGAASDRAYER

SEQ ID NO: 300595 - protein, 23 aa, Mycobacterium
APLPTQRPIPVWIGAASDRGLER

SEQ ID NO: 300596 - protein, 25 aa, Mycobacterium
APLPVTRYGLLRAPQAFRDMSQARH

SEQ ID NO: 300597 - protein, 23 aa, Mycobacterium
APLQVVDAVSWFRVGEAGAGNDR

SEQ ID NO: 300598 - protein, 23 aa, Mycobacterium
APLQVVDLVQWFRVGDTGAAQPG

SEQ ID NO: 300599 - protein, 25 aa, Mycobacterium
APLSAPELTGFPAGIVGAALTVLGV

SEQ ID NO: 300600 - protein, 26 aa, Mycobacterium
APLSRRLLALLIDWLIAGGLALLFVK

SEQ ID NO: 300601 - protein, 19 aa, Mycobacterium
APLSSTFTRFWTVSFPVVA

SEQ ID NO: 300602 - protein, 19 aa, Mycobacterium
APLTMVFAHGFCLRMGAFH

SEQ ID NO: 300603 - protein, 18 aa, Mycobacterium
APLTYGWLLVLLITTFIQ

SEQ ID NO: 300604 - protein, 19 aa, Mycobacterium
APLTYTWLVVLAITTIIQN

SEQ ID NO: 300605 - protein, 26 aa, Mycobacterium
APLVISGWMLVVWMLVAVGSGIGYAA

SEQ ID NO: 300606 - protein, 17 aa, Mycobacterium
APLVRDGLYRWVRHPNY

SEQ ID NO: 300607 - protein, 18 aa, Mycobacterium
APLVTGCTAVLLSPMSFL

SEQ ID NO: 300608 - protein, 25 aa, Mycobacterium
APLWLCSLCLMVLMTTTNLFSVSSF

SEQ ID NO: 300609 - protein, 19 aa, Mycobacterium
APLWSGRMFVEARWLSVGL

SEQ ID NO: 300610 - protein, 20 aa, Mycobacterium
APLWVSFAVVPAYIVVALAL

SEQ ID NO: 300611 - protein, 17 aa, Mycobacterium
APMADGWIDRGRLVCPW

SEQ ID NO: 300612 - protein, 27 aa, Mycobacterium
APMGRRLGALMIDWLISYGLAALALRF

SEQ ID NO: 300613 - protein, 20 aa, Mycobacterium
APMHEDWSGLTLIDSYNVAM

SEQ ID NO: 300614 - protein, 19 aa, Mycobacterium
APMLETFAVTLERAATDPR

SEQ ID NO: 300615 - protein, 23 aa, Mycobacterium
APMLFGASWAGWLAFAATVPVQF

SEQ ID NO: 300616 - protein, 26 aa, Mycobacterium
APNFGTGMAPFFLTLALFFGALVLWM

SEQ ID NO: 300617 - protein, 27 aa, Mycobacterium
APNFGTGMAPFFLTLALFFGALVLWMV

SEQ ID NO: 300618 - protein, 24 aa, Mycobacterium
APNFGTGMAPFFVTLALFFGALVL

SEQ ID NO: 300619 - protein, 17 aa, Mycobacterium
APNGLLLVDSWMCAISG

SEQ ID NO: 300620 - protein, 19 aa, Mycobacterium
APNPRWGRRYAEQGDILAY

SEQ ID NO: 300621 - protein, 26 aa, Mycobacterium
APNQEWRIVWDSALDRKQLGEAIASR

SEQ ID NO: 300622 - protein, 24 aa, Mycobacterium
APNQVCAMLTRIAGGLPQLKPGTI

SEQ ID NO: 300623 - protein, 22 aa, Mycobacterium
APNTPGHEWAAPSGEDATESVP

SEQ ID NO: 300624 - protein, 21 aa, Mycobacterium
APPAAMPGLLEVVNQAHGDGI

SEQ ID NO: 300625 - protein, 30 aa, Mycobacterium
APPADEPRPRVPLTLTGILAAVALLAVGGA

SEQ ID NO: 300626 - protein, 24 aa, Mycobacterium
APPGPEHPAEWVGPPQEAAPVQPD

SEQ ID NO: 300627 - protein, 22 aa, Mycobacterium
APPGRRGLFGSFTQLGSPAGML

SEQ ID NO: 300628 - protein, 27 aa, Mycobacterium
APPHPSRWRHVPTILLATSLVLLTTAM

SEQ ID NO: 300629 - protein, 26 aa, Mycobacterium
APPIDWRALLRQLPLLNILGVVAVLV

SEQ ID NO: 300630 - protein, 17 aa, Mycobacterium
APPIMKADAELARAAAA

SEQ ID NO: 300631 - protein, 21 aa, Mycobacterium
APPIRGVIHGAGLTDSQLLTD

SEQ ID NO: 300632 - protein, 20 aa, Mycobacterium
APPKRRAFYGSFPQAGVPAG

SEQ ID NO: 300633 - protein, 25 aa, Mycobacterium
APPLKFAQLVGFVFAICGIIGFAVG

SEQ ID NO: 300634 - protein, 20 aa, Mycobacterium
APPLPAFKPSAEVGANCQYP

SEQ ID NO: 300635 - protein, 28 aa, Mycobacterium
APPLPEPMIKVLVYLGFGAERYRYPSNL

SEQ ID NO: 300636 - protein, 17 aa, Mycobacterium
APPLQFTYWQWLSLTLA

SEQ ID NO: 300637 - protein, 27 aa, Mycobacterium
APPLSFLPWLVVICYTAFAAQYLGGTV

SEQ ID NO: 300638 - protein, 19 aa, Mycobacterium
APPPAGRSRDFWGSAARLV

SEQ ID NO: 300639 - protein, 23 aa, Mycobacterium
APPPAMPPQLAWWASSLQLSGLA

SEQ ID NO: 300640 - protein, 51 aa, Mycobacterium
APPPDAEPPVPWYRKPAALVGLGALGAVLIALIVFGLAKAITGDSDSETTP

SEQ ID NO: 300641 - protein, 17 aa, Mycobacterium
APPPEDSLLRWSGVSSG

SEQ ID NO: 300642 - protein, 25 aa, Mycobacterium
APPPPFRTAGHRGLGNWQGGHRSAD

SEQ ID NO: 300643 - protein, 23 aa, Mycobacterium
APPPRPAAPKARRKKTKRRWGKI

SEQ ID NO: 300644 - protein, 25 aa, Mycobacterium
APPPRPSRIKPGLPAGLDTVIAKGM

SEQ ID NO: 300645 - protein, 17 aa, Mycobacterium
APPPSWWQPRDIYIGSV

SEQ ID NO: 300646 - protein, 20 aa, Mycobacterium
APPRMILAGANAFVRALSRT

SEQ ID NO: 300647 - protein, 17 aa, Mycobacterium
APPRWSSWLRVVLGAGL

SEQ ID NO: 300648 - protein, 25 aa, Mycobacterium
APPSWALRLARRRVLLAGVALSAFG

SEQ ID NO: 300649 - protein, 23 aa, Mycobacterium
APPVKGLGLAGGAKRPGAKKTAA

SEQ ID NO: 300650 - protein, 25 aa, Mycobacterium
APPVLSASIPAHWSPQTVSTLRDAI

SEQ ID NO: 300651 - protein, 28 aa, Mycobacterium
APPVRRLPARFGVEQVRELAARDARQGV

SEQ ID NO: 300652 - protein, 24 aa, Mycobacterium
APPVRRLPATFGIDQLREIAAQDT

SEQ ID NO: 300653 - protein, 25 aa, Mycobacterium
APPVSRLGPLYGVQPAMWRQFRIGY

SEQ ID NO: 300654 - protein, 17 aa, Mycobacterium
APQAAGRDVLRVEVGAP

SEQ ID NO: 300655 - protein, 30 aa, Mycobacterium
APQGSWRKRLPVIFLDVARFVLIGAGLAVI

SEQ ID NO: 300656 - protein, 26 aa, Mycobacterium
APQGTWRQRIPGIFLDVTRFVLIGVG

SEQ ID NO: 300657 - protein, 19 aa, Mycobacterium
APQGVPFTPSWAAFVSHSV

SEQ ID NO: 300658 - protein, 18 aa, Mycobacterium
APQHLRGALTGVFYVVTY

SEQ ID NO: 300659 - protein, 17 aa, Mycobacterium
APQHWIALTPPRIPELR

SEQ ID NO: 300660 - protein, 17 aa, Mycobacterium
APQHWIALTPPRIPQLR

SEQ ID NO: 300661 - protein, 24 aa, Mycobacterium
APQRPRLAQLLFLVVAVFLLTNKV

SEQ ID NO: 300662 - protein, 24 aa, Mycobacterium
APQRRRTWRWVILTLIVLAVVAGV

SEQ ID NO: 300663 - protein, 21 aa, Mycobacterium
APRGMPAPVVLKAGAAEGVSA

SEQ ID NO: 300664 - protein, 22 aa, Mycobacterium
APRGVPAPVVLKAGAAEGVSAA

SEQ ID NO: 300665 - protein, 26 aa, Mycobacterium
APRGWQRVGALTGRIGAFAIVELQKL

SEQ ID NO: 300666 - protein, 19 aa, Mycobacterium
APRGYRRWSPAVVGISALG

SEQ ID NO: 300667 - protein, 21 aa, Mycobacterium
APRISRRLIRAVAKHYLPEGY

SEQ ID NO: 300668 - protein, 20 aa, Mycobacterium
APRLKRLAATSVCLIGGWGL

SEQ ID NO: 300669 - protein, 17 aa, Mycobacterium
APRPFHLAWCAQPPRRA

SEQ ID NO: 300670 - protein, 20 aa, Mycobacterium
APRPLGGYLAVLVTYSAVVA

SEQ ID NO: 300671 - protein, 22 aa, Mycobacterium
APRPPRGIRVGFAVLAVGVIAF

SEQ ID NO: 300672 - protein, 24 aa, Mycobacterium
APRPRPASLAFLGGWLVGLVAFTA

SEQ ID NO: 300673 - protein, 19 aa, Mycobacterium
APRRRRFGGLFGRRHTTAH

SEQ ID NO: 300674 - protein, 19 aa, Mycobacterium
APRSASIRAVRDCTLVRLT

SEQ ID NO: 300675 - protein, 25 aa, Mycobacterium
APRVLILCGGVVVFGAMLYGSTIDR

SEQ ID NO: 300676 - protein, 20 aa, Mycobacterium
APRWLGHATDAWLVVLLTTV

SEQ ID NO: 300677 - protein, 18 aa, Mycobacterium
APSAMAPGVVHGDFRLGN

SEQ ID NO: 300678 - protein, 19 aa, Mycobacterium
APSARLVAVLAGLAGMVLC

SEQ ID NO: 300679 - protein, 19 aa, Mycobacterium
APSGARFAAVMALYGVTFA

SEQ ID NO: 300680 - protein, 23 aa, Mycobacterium
APSGVAFWSWMFIRQSGSYVKAF

SEQ ID NO: 300681 - protein, 27 aa, Mycobacterium
APSHCWVKELPDEPVWVNGDHARLHQL

SEQ ID NO: 300682 - protein, 18 aa, Mycobacterium
APSLRFLNQPVLNAATVF

SEQ ID NO: 300683 - protein, 22 aa, Mycobacterium
APSLRGRKAIMLPAGALVYIAL

SEQ ID NO: 300684 - protein, 20 aa, Mycobacterium
APSPMLQGGLTFIDTPGVGG

SEQ ID NO: 300685 - protein, 25 aa, Mycobacterium
APSPQRLRCAATLSLAPEEPGTFIR

SEQ ID NO: 300686 - protein, 18 aa, Mycobacterium
APSQRALLHIGEKFHESN

SEQ ID NO: 300687 - protein, 18 aa, Mycobacterium
APSQRALLHIGEKFQESN

SEQ ID NO: 300688 - protein, 19 aa, Mycobacterium
APSRLDMLTQQYVELTTRI

SEQ ID NO: 300689 - protein, 19 aa, Mycobacterium
APSVVALNRIGHVFNEGET

SEQ ID NO: 300690 - protein, 21 aa, Mycobacterium
APSYLAIMLFALVAVTAVLGA

SEQ ID NO: 300691 - protein, 21 aa, Mycobacterium
APSYLAIMLFALVAVTAVLGS

SEQ ID NO: 300692 - protein, 21 aa, Mycobacterium
APTALWVWIALTGVAAAVLVL

SEQ ID NO: 300693 - protein, 23 aa, Mycobacterium
APTAMRIAHRYGISPLLMGLMVA

SEQ ID NO: 300694 - protein, 18 aa, Mycobacterium
APTARLGSTYGYGVSYAT

SEQ ID NO: 300695 - protein, 31 aa, Mycobacterium
APTARLMTAWAVVGDKIWIVGGLRNGVALQT

SEQ ID NO: 300696 - protein, 18 aa, Mycobacterium
APTAVPHVSCGQVIASQW

SEQ ID NO: 300697 - protein, 17 aa, Mycobacterium
APTELPMDLTVVNAGDT

SEQ ID NO: 300698 - protein, 31 aa, Mycobacterium
APTFGTGFAPFFLPLALFIGALIVWMLLSPL

SEQ ID NO: 300699 - protein, 18 aa, Mycobacterium
APTGAGISWIGRALDNDI

SEQ ID NO: 300700 - protein, 33 aa, Mycobacterium
APTGKLGLREVLFGGRVSWIALLTLALVAVLIA

SEQ ID NO: 300701 - protein, 23 aa, Mycobacterium
APTKWVHHFGLFAALGAAVAALA

SEQ ID NO: 300702 - protein, 19 aa, Mycobacterium
APTLAWLVGFTLFLVPMSI

SEQ ID NO: 300703 - protein, 18 aa, Mycobacterium
APTLQPDQVDAFRAITRQ

SEQ ID NO: 300704 - protein, 22 aa, Mycobacterium
APTLREAALWSVVYVGIALLFG

SEQ ID NO: 300705 - protein, 18 aa, Mycobacterium
APTLRTATTLPRPDGAVQ

SEQ ID NO: 300706 - protein, 24 aa, Mycobacterium
APTLSRFSAAISRLQEQLSGSANG

SEQ ID NO: 300707 - protein, 26 aa, Mycobacterium
APTPRPFDWRGLLLLGAGIGAALVAL

SEQ ID NO: 300708 - protein, 21 aa, Mycobacterium
APTQWDWAKWLPHMQHSRLRD

SEQ ID NO: 300709 - protein, 17 aa, Mycobacterium
APTRGAVLLGHSALGAT

SEQ ID NO: 300710 - protein, 18 aa, Mycobacterium
APTRIPVPSLLRSLLSEH

SEQ ID NO: 300711 - protein, 20 aa, Mycobacterium
APTRISWRTGGMIAAVGSIL

SEQ ID NO: 300712 - protein, 19 aa, Mycobacterium
APTRPALLLGSATLELYVA

SEQ ID NO: 300713 - protein, 22 aa, Mycobacterium
APTTLWLWIAMSGLAAAVFLVG

SEQ ID NO: 300714 - protein, 34 aa, Mycobacterium
APTTPIWRLLLPQLLMGIGMAFIWSPLAATATRH

SEQ ID NO: 300715 - protein, 25 aa, Mycobacterium
APTTPVWRLALPIASLGMGMVFVWP

SEQ ID NO: 300716 - protein, 17 aa, Mycobacterium
APTVEICESDQPFEPLA

SEQ ID NO: 300717 - protein, 17 aa, Mycobacterium
APTWRILLRHILPNALA

SEQ ID NO: 300718 - protein, 22 aa, Mycobacterium
APVAEYWPEFAANGKAKLTVRD

SEQ ID NO: 300719 - protein, 17 aa, Mycobacterium
APVAFAAGWAFNRLMAA

SEQ ID NO: 300720 - protein, 28 aa, Mycobacterium
APVALWRSIRALPDFGRLLQLRIASQFG

SEQ ID NO: 300721 - protein, 23 aa, Mycobacterium
APVASLIGIYAYRKFSGGQVVAP

SEQ ID NO: 300722 - protein, 18 aa, Mycobacterium
APVAYLFRPYIVYRSRDE

SEQ ID NO: 300723 - protein, 20 aa, Mycobacterium
APVCCLALIFALPDLAWGAW

SEQ ID NO: 300724 - protein, 18 aa, Mycobacterium
APVFGVVELEKFMVRRRK

SEQ ID NO: 300725 - protein, 18 aa, Mycobacterium
APVFIVISLLAVWLTYLG

SEQ ID NO: 300726 - protein, 50 aa, Mycobacterium
APVFREVLGLKWGRGRQRLFEWLFLLVALGNRFLPIFVRQGTSYLLLADV

SEQ ID NO: 300727 - protein, 32 aa, Mycobacterium
APVIACLVASCGTWLIYRITRNVAQKRREQGF

SEQ ID NO: 300728 - protein, 18 aa, Mycobacterium
APVLTSWRSVVSNKAFLL

SEQ ID NO: 300729 - protein, 22 aa, Mycobacterium
APVLVGVAWKLLLAPVGGGLAG

SEQ ID NO: 300730 - protein, 18 aa, Mycobacterium
APVMYKIVRELATTARQP

SEQ ID NO: 300731 - protein, 19 aa, Mycobacterium
APVPESWDALIAKAMAKTP

SEQ ID NO: 300732 - protein, 20 aa, Mycobacterium
APVRGRYNAMISRLRADSEH

SEQ ID NO: 300733 - protein, 20 aa, Mycobacterium
APVRPWRAPVVLVAMAVRVA

SEQ ID NO: 300734 - protein, 25 aa, Mycobacterium
APVRTPVTMRLRLASAESIDIAEGI

SEQ ID NO: 300735 - protein, 18 aa, Mycobacterium
APVTSLPARGAFGLMFDR

SEQ ID NO: 300736 - protein, 17 aa, Mycobacterium
APVVAALLVEPLLAAVL

SEQ ID NO: 300737 - protein, 25 aa, Mycobacterium
APVYRREWEELITPRSVHTVHPATI

SEQ ID NO: 300738 - protein, 24 aa, Mycobacterium
APWHLRAGALAVDVLPAAAVVATM

SEQ ID NO: 300739 - protein, 17 aa, Mycobacterium
APWQIGYALLYPSVCVG

SEQ ID NO: 300740 - protein, 18 aa, Mycobacterium
APWVALRLLPQGPTLSRA

SEQ ID NO: 300741 - protein, 18 aa, Mycobacterium
APWVVLRLLPQGPTLSRA

SEQ ID NO: 300742 - protein, 19 aa, Mycobacterium
APYALRIGTRTGQSIIASS

SEQ ID NO: 300743 - protein, 23 aa, Mycobacterium
APYHLRLDWLMWFAAISPGYALP

SEQ ID NO: 300744 - protein, 24 aa, Mycobacterium
APYHLRLDWLMWFAAISPSYAQPW

SEQ ID NO: 300745 - protein, 21 aa, Mycobacterium
APYLRTSLRSAISPQIETTKA

SEQ ID NO: 300746 - protein, 20 aa, Mycobacterium
APYWVCAIYLVLLVAVGIAA

SEQ ID NO: 300747 - protein, 31 aa, Mycobacterium
AQAAALRDVLARRKIENVVLVSAFLAAAALA

SEQ ID NO: 300748 - protein, 25 aa, Mycobacterium
AQAAEPRGGILVIHENKGLNDWTRS

SEQ ID NO: 300749 - protein, 24 aa, Mycobacterium
AQACARAAAVARAMRVGDVGCVVR

SEQ ID NO: 300750 - protein, 19 aa, Mycobacterium
AQAEARTGTSVVVLGYPGG

SEQ ID NO: 300751 - protein, 26 aa, Mycobacterium
AQAEPAAWLRFWFPDPKGSNTEYQRA

SEQ ID NO: 300752 - protein, 22 aa, Mycobacterium
AQAEYPGRVVLVDSDGSVAADA

SEQ ID NO: 300753 - protein, 23 aa, Mycobacterium
AQAFDAALPWLAGRLGVPQAARI

SEQ ID NO: 300754 - protein, 18 aa, Mycobacterium
AQAFWKVIAPLATPGIVT

SEQ ID NO: 300755 - protein, 18 aa, Mycobacterium
AQAGCRMTAEIGAMRISE

SEQ ID NO: 300756 - protein, 29 aa, Mycobacterium
AQAGLPTGSSFKVFALVAALQQGIGLGYQ

SEQ ID NO: 300757 - protein, 17 aa, Mycobacterium
AQAGLSLAALLAAFVAV

SEQ ID NO: 300758 - protein, 21 aa, Mycobacterium
AQAHAVVKWVLTEGDPKENFP

SEQ ID NO: 300759 - protein, 24 aa, Mycobacterium
AQALDRLAYRTTIFGFPIFGFGVI

SEQ ID NO: 300760 - protein, 18 aa, Mycobacterium
AQALPPGRGLLVSADGDV

SEQ ID NO: 300761 - protein, 20 aa, Mycobacterium
AQALRLSYMALFSVPVVAPL

SEQ ID NO: 300762 - protein, 17 aa, Mycobacterium
AQAPLWIGPFLVYILLP

SEQ ID NO: 300763 - protein, 18 aa, Mycobacterium
AQARLAALSILVGAVGAT

SEQ ID NO: 300764 - protein, 17 aa, Mycobacterium
AQARLQLQVTDMFETLS

SEQ ID NO: 300765 - protein, 21 aa, Mycobacterium
AQASQWRRAGGTFPTNSGLTT

SEQ ID NO: 300766 - protein, 26 aa, Mycobacterium
AQATFLRWLWYAARREGLRLDGTEDD

SEQ ID NO: 300767 - protein, 24 aa, Mycobacterium
AQAVRRLSGVIAIVVLLFLACAPV

SEQ ID NO: 300768 - protein, 26 aa, Mycobacterium
AQEESRAWRMRLWVRRVGAQAKVSNV

SEQ ID NO: 300769 - protein, 34 aa, Mycobacterium
AQEHAKATVWRFFKHPIEVMVFVTFVSVMGLAIE

SEQ ID NO: 300770 - protein, 27 aa, Mycobacterium
AQESAKPQWWAGLKEGLKERSTHRALL

SEQ ID NO: 300771 - protein, 24 aa, Mycobacterium
AQEWLKSTVPFGGFPWGVVGFSQS

SEQ ID NO: 300772 - protein, 24 aa, Mycobacterium
AQFGDENFLIVGMDSRFGENSQMG

SEQ ID NO: 300773 - protein, 18 aa, Mycobacterium
AQFGFLLVWVIVAANLMA

SEQ ID NO: 300774 - protein, 18 aa, Mycobacterium
AQFGRLQFHPDVCAGVPI

SEQ ID NO: 300775 - protein, 27 aa, Mycobacterium
AQFGYRGVVVICAVVIFSIVGFNIFNQ

SEQ ID NO: 300776 - protein, 19 aa, Mycobacterium
AQGAIRFGAFGGWACVRSC

SEQ ID NO: 300777 - protein, 21 aa, Mycobacterium
AQGCSEFMFAGLITEVGDDFG

SEQ ID NO: 300778 - protein, 19 aa, Mycobacterium
AQGGMGMHGLFIGTTGAGK

SEQ ID NO: 300779 - protein, 20 aa, Mycobacterium
AQGGYRLKSSGVTWTDAAEA

SEQ ID NO: 300780 - protein, 17 aa, Mycobacterium
AQGLRVLLLGASDVAVD

SEQ ID NO: 300781 - protein, 17 aa, Mycobacterium
AQGLRVLLVGAADVAVD

SEQ ID NO: 300782 - protein, 23 aa, Mycobacterium
AQGQCQTMALAIGDRPGVSRLIH

SEQ ID NO: 300783 - protein, 17 aa, Mycobacterium
AQGRFVGLEKLFGDLQA

SEQ ID NO: 300784 - protein, 30 aa, Mycobacterium
AQGTAAWWLARLEWEVVLSLVTAVEMTLLW

SEQ ID NO: 300785 - protein, 18 aa, Mycobacterium
AQHAWRKAMAGFDAPTLL

SEQ ID NO: 300786 - protein, 18 aa, Mycobacterium
AQHAWRKAMAGFDAPTLV

SEQ ID NO: 300787 - protein, 24 aa, Mycobacterium
AQHGWPALAGVLFAADALLWTQAI

SEQ ID NO: 300788 - protein, 26 aa, Mycobacterium
AQHPRLPRRDALKILPAEFTSSQEFR

SEQ ID NO: 300789 - protein, 24 aa, Mycobacterium
AQHPRLPRRDALKILPRELTGDLE

SEQ ID NO: 300790 - protein, 23 aa, Mycobacterium
AQHPRLRLHWVARRDEKSLAAAI

SEQ ID NO: 300791 - protein, 17 aa, Mycobacterium
AQHYGLDHVFHLRPTKS

SEQ ID NO: 300792 - protein, 22 aa, Mycobacterium
AQIGLGTAMVWRHRETRWARWL

SEQ ID NO: 300793 - protein, 27 aa, Mycobacterium
AQIGPWLPFVHMYRFLDVDWLFPSYAM

SEQ ID NO: 300794 - protein, 17 aa, Mycobacterium
AQIKVTTILGSRYLAIE

SEQ ID NO: 300795 - protein, 24 aa, Mycobacterium
AQILVLLCVGAVFMGTALTIRDLV

SEQ ID NO: 300796 - protein, 19 aa, Mycobacterium
AQIPFHRWLPATLAAPTPV

SEQ ID NO: 300797 - protein, 23 aa, Mycobacterium
AQIPHLLGVPWLVYPMVAVALVI

SEQ ID NO: 300798 - protein, 20 aa, Mycobacterium
AQIPVFLGLFHVLRSFNRTT

SEQ ID NO: 300799 - protein, 17 aa, Mycobacterium
AQIRSGDDIRSLAEGLG

SEQ ID NO: 300800 - protein, 21 aa, Mycobacterium
AQIRTVLREGPGFAQETSRLL

SEQ ID NO: 300801 - protein, 17 aa, Mycobacterium
AQISGFVADNRREFGPA

SEQ ID NO: 300802 - protein, 23 aa, Mycobacterium
AQKLARWRLAEAYEEIGQRVAHI

SEQ ID NO: 300803 - protein, 18 aa, Mycobacterium
AQLGALRGALLTEPALAP

SEQ ID NO: 300804 - protein, 33 aa, Mycobacterium
AQLGDLRWFYIYSGVIWCCVFMRTGARRVRFGE

SEQ ID NO: 300805 - protein, 25 aa, Mycobacterium
AQLGRKRLALAMLLAALVNAGTFAT

SEQ ID NO: 300806 - protein, 19 aa, Mycobacterium
AQLHGGNGLRVIIDDYSRK

SEQ ID NO: 300807 - protein, 19 aa, Mycobacterium
AQLKALGFQSEFRRDMSPW

SEQ ID NO: 300808 - protein, 17 aa, Mycobacterium
AQLLGYLFLKLGQPKVV

SEQ ID NO: 300809 - protein, 21 aa, Mycobacterium
AQLLIRFTGPQVWWVLHVARW

SEQ ID NO: 300810 - protein, 20 aa, Mycobacterium
AQLLLPIALGVLLGGPAAAG

SEQ ID NO: 300811 - protein, 19 aa, Mycobacterium
AQLLPMVTLGLLFYVTPTM

SEQ ID NO: 300812 - protein, 27 aa, Mycobacterium
AQLLQPFLEYAFGFRNGVDIGQPPDNA

SEQ ID NO: 300813 - protein, 17 aa, Mycobacterium
AQLNWPTAIAVGPPLTY

SEQ ID NO: 300814 - protein, 17 aa, Mycobacterium
AQLPFPVNSLPQPGDLP

SEQ ID NO: 300815 - protein, 25 aa, Mycobacterium
AQLPRLDFSELVLRSGAPDPIVSWT

SEQ ID NO: 300816 - protein, 18 aa, Mycobacterium
AQLTRRWEEIGAQQYGVG

SEQ ID NO: 300817 - protein, 17 aa, Mycobacterium
AQLYPALAHPLGSSEAT

SEQ ID NO: 300818 - protein, 33 aa, Mycobacterium
AQLYRRIGASVVRWPVPIFVASSIIVMVGAVFV

SEQ ID NO: 300819 - protein, 17 aa, Mycobacterium
AQMASRMGISPIVVGMT

SEQ ID NO: 300820 - protein, 23 aa, Mycobacterium
AQMFCLGATLLAVPLYLVAHAVS

SEQ ID NO: 300821 - protein, 25 aa, Mycobacterium
AQMRLRAGSPILFYPAGALAVTVLA

SEQ ID NO: 300822 - protein, 17 aa, Mycobacterium
AQMTLPYAGFIGITILQ

SEQ ID NO: 300823 - protein, 23 aa, Mycobacterium
AQNIRRLLGRRGDLLADLDAIEK

SEQ ID NO: 300824 - protein, 22 aa, Mycobacterium
AQPDHYHWLSGYLGDRNLQGFT

SEQ ID NO: 300825 - protein, 26 aa, Mycobacterium
AQPGPPYCHTRLWPPVIVGLHHIVLL

SEQ ID NO: 300826 - protein, 18 aa, Mycobacterium
AQPGTRLSVLAAPSSTTP

SEQ ID NO: 300827 - protein, 20 aa, Mycobacterium
AQPKAALRMLFIAMPVGLAL

SEQ ID NO: 300828 - protein, 25 aa, Mycobacterium
AQPKGRSSGGLVVGAVVLALVSGGL

SEQ ID NO: 300829 - protein, 26 aa, Mycobacterium
AQPLDIIEIILAILINLIAITFFLVF

SEQ ID NO: 300830 - protein, 25 aa, Mycobacterium
AQPPEPEWGLLVSDGRKYIATRGWL

SEQ ID NO: 300831 - protein, 19 aa, Mycobacterium
AQPPFRLASYVTDNADALT

SEQ ID NO: 300832 - protein, 21 aa, Mycobacterium
AQPPFRLPGYVTDNAGVLSGS

SEQ ID NO: 300833 - protein, 17 aa, Mycobacterium
AQPPGSPCYFPFCLPGL

SEQ ID NO: 300834 - protein, 20 aa, Mycobacterium
AQPPMQWKPITNARISRDAA

SEQ ID NO: 300835 - protein, 20 aa, Mycobacterium
AQPPQPWWPSALGYGALGVV

SEQ ID NO: 300836 - protein, 30 aa, Mycobacterium
AQPRIRPGKILAGIAGFCAAVAAIGVGTAA

SEQ ID NO: 300837 - protein, 21 aa, Mycobacterium
AQQGRRVHRLAVSHAFHSPLM

SEQ ID NO: 300838 - protein, 31 aa, Mycobacterium
AQQMRPFVALRCWPFALLVLLAVALIALAAV

SEQ ID NO: 300839 - protein, 18 aa, Mycobacterium
AQQRIWLLDRLNLGGPEL

SEQ ID NO: 300840 - protein, 24 aa, Mycobacterium
AQRAAERRRYWVSTARTIQQKTTY

SEQ ID NO: 300841 - protein, 24 aa, Mycobacterium
AQRAMAGAIALMIGAGIGLTAVVS

SEQ ID NO: 300842 - protein, 25 aa, Mycobacterium
AQRDRAVVIPAILVVVLAVLYILLR

SEQ ID NO: 300843 - protein, 21 aa, Mycobacterium
AQRGVAVSFWLTAPYIAADSV

SEQ ID NO: 300844 - protein, 22 aa, Mycobacterium
AQRGVAVSFWLTAPYIAAESIR

SEQ ID NO: 300845 - protein, 21 aa, Mycobacterium
AQRGVAVSFWLTAPYIAAESL

SEQ ID NO: 300846 - protein, 17 aa, Mycobacterium
AQRGVAVSFWLVAPLVA

SEQ ID NO: 300847 - protein, 25 aa, Mycobacterium
AQRLPWRALPLVAWVTSALWAFSLA

SEQ ID NO: 300848 - protein, 20 aa, Mycobacterium
AQRLRRSRLGVENTDDRKLD

SEQ ID NO: 300849 - protein, 23 aa, Mycobacterium
AQRRELLTRVIVSAATADRELEA

SEQ ID NO: 300850 - protein, 23 aa, Mycobacterium
AQRRGKRPLIIAGVAVAVLAGGA

SEQ ID NO: 300851 - protein, 25 aa, Mycobacterium
AQRSRLTEVLGRIYGHPVTVQLQIS

SEQ ID NO: 300852 - protein, 24 aa, Mycobacterium
AQRTRLAQVLGQIYGRTIAVQLDV

SEQ ID NO: 300853 - protein, 28 aa, Mycobacterium
AQRTRLTEVLSRIYGHPVAVQLQIDSEL

SEQ ID NO: 300854 - protein, 27 aa, Mycobacterium
AQRTRLTEVLSRIYGRPVSVQLHVDPE

SEQ ID NO: 300855 - protein, 18 aa, Mycobacterium
AQRVREPHVIPVHDFGSI

SEQ ID NO: 300856 - protein, 24 aa, Mycobacterium
AQRWKAIRGEAGWMTTYAYPAEAI

SEQ ID NO: 300857 - protein, 28 aa, Mycobacterium
AQRWSSPFWQTWDLLLLWLAQLHGGNGL

SEQ ID NO: 300858 - protein, 28 aa, Mycobacterium
AQRWSSPFWQTWDLLLLWLAQLHGGNGM

SEQ ID NO: 300859 - protein, 25 aa, Mycobacterium
AQSDIKRLLSFTLVSHIGYMIFGIA

SEQ ID NO: 300860 - protein, 24 aa, Mycobacterium
AQSGFPRYFLNSVVVAAGTVVPTV

SEQ ID NO: 300861 - protein, 19 aa, Mycobacterium
AQSHGAAPWVGYVRAAAEA

SEQ ID NO: 300862 - protein, 25 aa, Mycobacterium
AQSIRRLGHMLAFFVEAIASIPNAL

SEQ ID NO: 300863 - protein, 24 aa, Mycobacterium
AQSLGSWRMALVMWVLQAGQRVLG

SEQ ID NO: 300864 - protein, 22 aa, Mycobacterium
AQSRLAALSILVGAVGATGPGV

SEQ ID NO: 300865 - protein, 18 aa, Mycobacterium
AQTLQRWFGLAGLDPRLL

SEQ ID NO: 300866 - protein, 18 aa, Mycobacterium
AQTPRFMPDPQPMRTPGA

SEQ ID NO: 300867 - protein, 25 aa, Mycobacterium
AQTRLRAGSPILFYPAGALAMTVLA

SEQ ID NO: 300868 - protein, 24 aa, Mycobacterium
AQTRLRAGSPILFYPAGALATTVL

SEQ ID NO: 300869 - protein, 18 aa, Mycobacterium
AQVDWGALVIVAGVATLI

SEQ ID NO: 300870 - protein, 24 aa, Mycobacterium
AQVHEFGWRIAFATGGVAAIVVYW

SEQ ID NO: 300871 - protein, 20 aa, Mycobacterium
AQVLDVRWAIGGLGITVVGI

SEQ ID NO: 300872 - protein, 18 aa, Mycobacterium
AQVLGFSFWQRLRVIVIP

SEQ ID NO: 300873 - protein, 20 aa, Mycobacterium
AQVLLPWDLSQRLFALPDAT

SEQ ID NO: 300874 - protein, 25 aa, Mycobacterium
AQVLWVEARNAMPLILGGLRSATLQ

SEQ ID NO: 300875 - protein, 23 aa, Mycobacterium
AQVPVELGLGYGLGHGEAIAILL

SEQ ID NO: 300876 - protein, 28 aa, Mycobacterium
AQVVLRVEMPNALPLILGGLRSATLQVV

SEQ ID NO: 300877 - protein, 18 aa, Mycobacterium
AQVWDIWRLRQLKRQNAC

SEQ ID NO: 300878 - protein, 19 aa, Mycobacterium
AQVWQVNWIYPVSWHYAFD

SEQ ID NO: 300879 - protein, 21 aa, Mycobacterium
AQWMTVLAMALGFAVTGADPT

SEQ ID NO: 300880 - protein, 19 aa, Mycobacterium
AQWPILLVGLTFATALALV

SEQ ID NO: 300881 - protein, 17 aa, Mycobacterium
AQYAGIPYGYWIPLTAL

SEQ ID NO: 300882 - protein, 17 aa, Mycobacterium
AQYSNNVFLKFEDREIT

SEQ ID NO: 300883 - protein, 20 aa, Mycobacterium
ARAAALLLLGLGFAAVIVIG

SEQ ID NO: 300884 - protein, 17 aa, Mycobacterium
ARAAAWVSATDFYAGYE

SEQ ID NO: 300885 - protein, 22 aa, Mycobacterium
ARAAFEAAWGAARLDSPTLRRW

SEQ ID NO: 300886 - protein, 19 aa, Mycobacterium
ARAAGVIRIPRAARSNNRW

SEQ ID NO: 300887 - protein, 23 aa, Mycobacterium
ARAARAGVMLRRVESLSRLQDIV

SEQ ID NO: 300888 - protein, 24 aa, Mycobacterium
ARAARGLLRAMICQLAVQHAPDQV

SEQ ID NO: 300889 - protein, 24 aa, Mycobacterium
ARACPPGSSALVWGWAPEIFVEQD

SEQ ID NO: 300890 - protein, 21 aa, Mycobacterium
ARADETLALIRRGDENVRKKS

SEQ ID NO: 300891 - protein, 21 aa, Mycobacterium
ARADIAVPLVAVFVLMLSFVA

SEQ ID NO: 300892 - protein, 17 aa, Mycobacterium
ARAEPRAAVGSAVVDLT

SEQ ID NO: 300893 - protein, 18 aa, Mycobacterium
ARAGATVVMVGHRAPVLA

SEQ ID NO: 300894 - protein, 18 aa, Mycobacterium
ARAGEVEAALSLGMSQRD

SEQ ID NO: 300895 - protein, 20 aa, Mycobacterium
ARAGGAAYCVADESIDAFKR

SEQ ID NO: 300896 - protein, 26 aa, Mycobacterium
ARAGRVQWRAGLSFGAAGMAGAYAGG

SEQ ID NO: 300897 - protein, 22 aa, Mycobacterium
ARAGRVQWRTGLIFGAAGMAGA

SEQ ID NO: 300898 - protein, 19 aa, Mycobacterium
ARAGVPVVLDAGIGTASDA

SEQ ID NO: 300899 - protein, 22 aa, Mycobacterium
ARAGVVAKWLVGQPVPGFSREW

SEQ ID NO: 300900 - protein, 19 aa, Mycobacterium
ARAHAWEAVRAALDGGGLA

SEQ ID NO: 300901 - protein, 19 aa, Mycobacterium
ARALGLRKNQVLRRIVLPQ

SEQ ID NO: 300902 - protein, 20 aa, Mycobacterium
ARALLAWPSGVAPIVVMAAV

SEQ ID NO: 300903 - protein, 27 aa, Mycobacterium
ARALLGSLLRPYRWAVVLLAVVVVVEN

SEQ ID NO: 300904 - protein, 19 aa, Mycobacterium
ARALLKPAPILLIDEATSA

SEQ ID NO: 300905 - protein, 19 aa, Mycobacterium
ARALLKPAPILLVDEATSA

SEQ ID NO: 300906 - protein, 20 aa, Mycobacterium
ARALLKPAPILLVDEATSAL

SEQ ID NO: 300907 - protein, 18 aa, Mycobacterium
ARALRAGGRYGVFCLGSC

SEQ ID NO: 300908 - protein, 22 aa, Mycobacterium
ARALRTGAVLTIGFTGTLTLAG

SEQ ID NO: 300909 - protein, 29 aa, Mycobacterium
ARAMGPMQFLPGTWARYASDGKGDGVADP

SEQ ID NO: 300910 - protein, 20 aa, Mycobacterium
ARAPGGFPYGTLAVNVSGAL

SEQ ID NO: 300911 - protein, 21 aa, Mycobacterium
ARARACGVVCRPRDIFVEQTV

SEQ ID NO: 300912 - protein, 23 aa, Mycobacterium
ARARGDGQFAQMLSGMNVIPGQG

SEQ ID NO: 300913 - protein, 20 aa, Mycobacterium
ARARGMSDWGVRWRHALRHA

SEQ ID NO: 300914 - protein, 23 aa, Mycobacterium
ARARIRGARRPGLAIRSLGAAGA

SEQ ID NO: 300915 - protein, 17 aa, Mycobacterium
ARARLGVENTHDRDYDV

SEQ ID NO: 300916 - protein, 20 aa, Mycobacterium
ARARRHALEYLDLHYEADPA

SEQ ID NO: 300917 - protein, 17 aa, Mycobacterium
ARARRQPLLDVRLFADP

SEQ ID NO: 300918 - protein, 17 aa, Mycobacterium
ARARRWGPQAGTAGAAL

SEQ ID NO: 300919 - protein, 37 aa, Mycobacterium
ARASQLPGHWQRLAVCWRLAQTHGLALGTLMRAAHED

SEQ ID NO: 300920 - protein, 25 aa, Mycobacterium
ARATFLRWIWYAARREGLHLNGADD

SEQ ID NO: 300921 - protein, 25 aa, Mycobacterium
ARATLSRPAAAPVPYLTPAAEVPAG

SEQ ID NO: 300922 - protein, 19 aa, Mycobacterium
ARAVFGRRGAYVPAAVQAV

SEQ ID NO: 300923 - protein, 20 aa, Mycobacterium
ARAVFLGRFIALLRILAGPL

SEQ ID NO: 300924 - protein, 26 aa, Mycobacterium
ARAVFLRWLWYAARRAELHLDGETDD

SEQ ID NO: 300925 - protein, 21 aa, Mycobacterium
ARAVLFSGLLSPPAPVALLRL

SEQ ID NO: 300926 - protein, 21 aa, Mycobacterium
ARAWARIALTMCVAAISAGPL

SEQ ID NO: 300927 - protein, 17 aa, Mycobacterium
ARCGIGYLHTGIEKNLE

SEQ ID NO: 300928 - protein, 19 aa, Mycobacterium
ARDESRCAPTRHGHSEAER

SEQ ID NO: 300929 - protein, 24 aa, Mycobacterium
ARDIRAAGWAAIMAIIPGIVVNFL

SEQ ID NO: 300930 - protein, 32 aa, Mycobacterium
ARDLPHMWQPIILLSALWALRALAHGVQVRFS

SEQ ID NO: 300931 - protein, 26 aa, Mycobacterium
ARDPAWRFGQAAAMRAALAGAGPGGR

SEQ ID NO: 300932 - protein, 21 aa, Mycobacterium
ARDPRKPVLILAAIGLCGFAL

SEQ ID NO: 300933 - protein, 22 aa, Mycobacterium
ARDPRKPVLVFAAIGLTSFAVV

SEQ ID NO: 300934 - protein, 21 aa, Mycobacterium
ARDPRWRFATAEQMRRSLDPP

SEQ ID NO: 300935 - protein, 20 aa, Mycobacterium
ARDRGWQLFVMYGATEATAR

SEQ ID NO: 300936 - protein, 23 aa, Mycobacterium
ARDRLRAPIGIAVDGTPVELDIK

SEQ ID NO: 300937 - protein, 30 aa, Mycobacterium
ARDTFRIPARVSLAVLFVWGFGMALWTTLY

SEQ ID NO: 300938 - protein, 26 aa, Mycobacterium
ARDTGWPAIVGQALITPVVDTDQARR

SEQ ID NO: 300939 - protein, 20 aa, Mycobacterium
ARDWPVLTFTKPVSLRDRFP

SEQ ID NO: 300940 - protein, 26 aa, Mycobacterium
AREFLPSRHYLYAVIAIAGMQFLATM

SEQ ID NO: 300941 - protein, 19 aa, Mycobacterium
AREIFARMTNYATYRIAET

SEQ ID NO: 300942 - protein, 21 aa, Mycobacterium
ARELACSALADLQLSATTAYA

SEQ ID NO: 300943 - protein, 18 aa, Mycobacterium
ARELASLRLAIGEVATRD

SEQ ID NO: 300944 - protein, 20 aa, Mycobacterium
ARELLPYQALTGLRNDALAA

SEQ ID NO: 300945 - protein, 18 aa, Mycobacterium
ARELLRVAFGPSVVALVI

SEQ ID NO: 300946 - protein, 17 aa, Mycobacterium
ARELMRPVLTMPDSTPV

SEQ ID NO: 300947 - protein, 21 aa, Mycobacterium
AREQPWTPILIIIIITSVKIG

SEQ ID NO: 300948 - protein, 23 aa, Mycobacterium
ARERAWTPIIVIIVITVVKIAGS

SEQ ID NO: 300949 - protein, 17 aa, Mycobacterium
ARERFEQRRFTKANRDV

SEQ ID NO: 300950 - protein, 31 aa, Mycobacterium
ARERPARVPLSFAQSRLWFLDQLQGPSAIYN

SEQ ID NO: 300951 - protein, 18 aa, Mycobacterium
ARETIDWMREKLPPVAGD

SEQ ID NO: 300952 - protein, 31 aa, Mycobacterium
AREVMRRIEATAVRPPRGWDAAVGSGVVDPL

SEQ ID NO: 300953 - protein, 21 aa, Mycobacterium
AREYLGFALSGPGGAHCNDGV

SEQ ID NO: 300954 - protein, 18 aa, Mycobacterium
ARFCARVAPHDLGPDVRS

SEQ ID NO: 300955 - protein, 17 aa, Mycobacterium
ARFFVNLSVAAFRRSRS

SEQ ID NO: 300956 - protein, 23 aa, Mycobacterium
ARFGESFWMFLPRSMFGSLKSAW

SEQ ID NO: 300957 - protein, 21 aa, Mycobacterium
ARFGNVSGLEAGNFVRIAGVE

SEQ ID NO: 300958 - protein, 18 aa, Mycobacterium
ARFGPSRSLVLGMLVIGT

SEQ ID NO: 300959 - protein, 36 aa, Mycobacterium
ARFGRRIAALLVDWLTCYGLTALAVAFGWISVGFQS

SEQ ID NO: 300960 - protein, 21 aa, Mycobacterium
ARFIAWPPGRWGAVKTVNPQT

SEQ ID NO: 300961 - protein, 27 aa, Mycobacterium
ARFKREAELAATLWHPHIVGVLDRGEF

SEQ ID NO: 300962 - protein, 20 aa, Mycobacterium
ARFMREASLAASLDHPNIVT

SEQ ID NO: 300963 - protein, 19 aa, Mycobacterium
ARFPELVADFAAMCHTHGW

SEQ ID NO: 300964 - protein, 20 aa, Mycobacterium
ARFPRAIANFNRYAGSVTRG

SEQ ID NO: 300965 - protein, 18 aa, Mycobacterium
ARFSALVTGVLPFMSVGD

SEQ ID NO: 300966 - protein, 18 aa, Mycobacterium
ARFTFADTINHTVHVIED

SEQ ID NO: 300967 - protein, 21 aa, Mycobacterium
ARFTGLPRRASTVGLVALVAA

SEQ ID NO: 300968 - protein, 19 aa, Mycobacterium
ARFTPDYDCGCKRPTMSNS

SEQ ID NO: 300969 - protein, 17 aa, Mycobacterium
ARFYERFDPPIQAIPTD

SEQ ID NO: 300970 - protein, 21 aa, Mycobacterium
ARGADALWQRVEQMLSESAGP

SEQ ID NO: 300971 - protein, 17 aa, Mycobacterium
ARGAHAIATNSGFDVDR

SEQ ID NO: 300972 - protein, 18 aa, Mycobacterium
ARGASLAAANARLGAPRT

SEQ ID NO: 300973 - protein, 18 aa, Mycobacterium
ARGASLAAANARLGAPST

SEQ ID NO: 300974 - protein, 23 aa, Mycobacterium
ARGEVVSVGFLISMWAGSSAISA

SEQ ID NO: 300975 - protein, 20 aa, Mycobacterium
ARGFMSRIWIVVAGGALPVL

SEQ ID NO: 300976 - protein, 30 aa, Mycobacterium
ARGGAGVIYCCYETALGRSVAVKVLPSHID

SEQ ID NO: 300977 - protein, 20 aa, Mycobacterium
ARGGGFSFPSAIREFALAAV

SEQ ID NO: 300978 - protein, 25 aa, Mycobacterium
ARGGPGGIPGCWQKITRELWPAPFL

SEQ ID NO: 300979 - protein, 24 aa, Mycobacterium
ARGIADIAGCERLVVCVAEPGPSV

SEQ ID NO: 300980 - protein, 18 aa, Mycobacterium
ARGIGGWPAATVAVGVLV

SEQ ID NO: 300981 - protein, 20 aa, Mycobacterium
ARGLGIGLMIGWALMSVLTA

SEQ ID NO: 300982 - protein, 35 aa, Mycobacterium
ARGLMPVVVIPLFASMVVGLLMFLLLGRPLAALTS

SEQ ID NO: 300983 - protein, 19 aa, Mycobacterium
ARGPVVWVRVWPAVTVGPG

SEQ ID NO: 300984 - protein, 23 aa, Mycobacterium
ARGQEVPFRLAYPLRSDNGPSMR

SEQ ID NO: 300985 - protein, 27 aa, Mycobacterium
ARGRARKSWTLMAGALGAYALGDLTWL

SEQ ID NO: 300986 - protein, 27 aa, Mycobacterium
ARGRGKYWWLRWVVIAVAVIVLAVEIA

SEQ ID NO: 300987 - protein, 23 aa, Mycobacterium
ARGSEERMRRFITDASHELRTPL

SEQ ID NO: 300988 - protein, 19 aa, Mycobacterium
ARGTWWGWQGAGWFLLTVM

SEQ ID NO: 300989 - protein, 22 aa, Mycobacterium
ARGVKEFAPLIGTVKAGLFTSS

SEQ ID NO: 300990 - protein, 17 aa, Mycobacterium
ARGWGWTELGLGREHWK

SEQ ID NO: 300991 - protein, 18 aa, Mycobacterium
ARHGRYTGVSGWFDVPGS

SEQ ID NO: 300992 - protein, 17 aa, Mycobacterium
ARHHRRLAVFFAVSVLS

SEQ ID NO: 300993 - protein, 19 aa, Mycobacterium
ARHLRDHIIVVGLGSFGSR

SEQ ID NO: 300994 - protein, 17 aa, Mycobacterium
ARHNFVLDRSVKSVNIV

SEQ ID NO: 300995 - protein, 18 aa, Mycobacterium
ARHPELLADLDAVENAAT

SEQ ID NO: 300996 - protein, 20 aa, Mycobacterium
ARHPHLAARFCGQFEQPVQL

SEQ ID NO: 300997 - protein, 19 aa, Mycobacterium
ARHPRSWIFYATLLVIFWG

SEQ ID NO: 300998 - protein, 19 aa, Mycobacterium
ARHTKRLERMTVDGTAVSV

SEQ ID NO: 300999 - protein, 18 aa, Mycobacterium
ARHTLCGLFDAVKERRSD

SEQ ID NO: 301000 - protein, 18 aa, Mycobacterium
ARHTVDWMRSELPQVAGG

SEQ ID NO: 301001 - protein, 18 aa, Mycobacterium
ARHVLRRVWGSEARTSVL

SEQ ID NO: 301002 - protein, 22 aa, Mycobacterium
ARHWTDAGIIAALLLVNGLVAF

SEQ ID NO: 301003 - protein, 20 aa, Mycobacterium
ARIAAELGIAEVIAEAMPDD

SEQ ID NO: 301004 - protein, 20 aa, Mycobacterium
ARIAGWGWLALTLIGVPWLL

SEQ ID NO: 301005 - protein, 17 aa, Mycobacterium
ARIAIALYPDHCDHPQE

SEQ ID NO: 301006 - protein, 17 aa, Mycobacterium
ARIDIDEPMPLGTALHM

SEQ ID NO: 301007 - protein, 24 aa, Mycobacterium
ARIEVIGSLGGWRVSTATSQAPAG

SEQ ID NO: 301008 - protein, 26 aa, Mycobacterium
ARIFDRIWLLAAFGWIGWAGVQGGAP

SEQ ID NO: 301009 - protein, 29 aa, Mycobacterium
ARIGAFARWVARTPWPVFTLGMLQADIIG

SEQ ID NO: 301010 - protein, 17 aa, Mycobacterium
ARIGVIFVVAVIFGVVN

SEQ ID NO: 301011 - protein, 26 aa, Mycobacterium
ARIKYKVGPTIAWYQDFLRYYFLTVE

SEQ ID NO: 301012 - protein, 33 aa, Mycobacterium
ARIKYKVGPTIAWYQDFLRYYFLTVESNADGSM

SEQ ID NO: 301013 - protein, 35 aa, Mycobacterium; identical to SEQ ID NO: 10588

SEQ ID NO: 301014 - protein, 35 aa, Mycobacterium
ARIKYKVGPTIAWYQDWLRYYFLTVESNPDGSMSR

SEQ ID NO: 301015 - protein, 17 aa, Mycobacterium
ARILEHLEYTAIAVGAS

SEQ ID NO: 301016 - protein, 19 aa, Mycobacterium
ARILVLRPRTVFLDESTSA

SEQ ID NO: 301017 - protein, 20 aa, Mycobacterium
ARINAVIDWEIWSIGDPRID

SEQ ID NO: 301018 - protein, 28 aa, Mycobacterium
ARIPVLPPDSGVGLWTFDGVAGRSEVAV

SEQ ID NO: 301019 - protein, 29 aa, Mycobacterium
ARIPWPSILLLCGLLTYLGLMQKIGTIDS

SEQ ID NO: 301020 - protein, 25 aa, Mycobacterium
ARIQFWSMLITFVLLLTVFATALLT

SEQ ID NO: 301021 - protein, 24 aa, Mycobacterium
ARIRDLERPLADRARASELGTHPY

SEQ ID NO: 301022 - protein, 22 aa, Mycobacterium
ARIREAIRLSGPDIYRNPQPVT

SEQ ID NO: 301023 - protein, 21 aa, Mycobacterium
ARIRFLGRGALFITLMATLMV

SEQ ID NO: 301024 - protein, 17 aa, Mycobacterium
ARISDRGAYGLVISGCL

SEQ ID NO: 301025 - protein, 24 aa, Mycobacterium
ARIWIARIMATWGLLSAAMAFVQG

SEQ ID NO: 301026 - protein, 20 aa, Mycobacterium
ARKAAADALRVERQAEADSL

SEQ ID NO: 301027 - protein, 17 aa, Mycobacterium
ARKAVGWALQVDPASLP

SEQ ID NO: 301028 - protein, 35 aa, Mycobacterium
ARKGRLWRRVGTAVVRWPAPILAVSGAIVLVGMVA

SEQ ID NO: 301029 - protein, 27 aa, Mycobacterium
ARKHLRTTDKWDGLRLWVRENGTRLMT

SEQ ID NO: 301030 - protein, 17 aa, Mycobacterium
ARLARKLAGWSITGTIL

SEQ ID NO: 301031 - protein, 17 aa, Mycobacterium
ARLAWTYLVPNGANFVD

SEQ ID NO: 301032 - protein, 19 aa, Mycobacterium
ARLAYWAQAEIVAMATDVA

SEQ ID NO: 301033 - protein, 26 aa, Mycobacterium
ARLCELAKSFPGRLLASAETLAGASE

SEQ ID NO: 301034 - protein, 18 aa, Mycobacterium
ARLCELAKSYSARLVASS

SEQ ID NO: 301035 - protein, 19 aa, Mycobacterium
ARLCELAKSYSARLVASSE

SEQ ID NO: 301036 - protein, 28 aa, Mycobacterium
ARLDFPGKRLLVGVALLITMFPAISLVT

SEQ ID NO: 301037 - protein, 25 aa, Mycobacterium
ARLEFPGRDVLFWVYLATLMVPATV

SEQ ID NO: 301038 - protein, 18 aa, Mycobacterium
ARLEFRGRDTLFVLYLGT

SEQ ID NO: 301039 - protein, 17 aa, Mycobacterium
ARLEKMGVEIQLGAMVT

SEQ ID NO: 301040 - protein, 18 aa, Mycobacterium
ARLGRSIERIRRRGVNLN

SEQ ID NO: 301041 - protein, 29 aa, Mycobacterium
ARLIGALALLCAACWLIEILARHHSQPNW

SEQ ID NO: 301042 - protein, 26 aa, Mycobacterium
ARLINERFGRGWGWFSVGDLFILNFL

SEQ ID NO: 301043 - protein, 25 aa, Mycobacterium
ARLIPRMVTAAAILAAFFVVELATS

SEQ ID NO: 301044 - protein, 17 aa, Mycobacterium
ARLIPRVGVASVIAEGF

SEQ ID NO: 301045 - protein, 24 aa, Mycobacterium
ARLLAWRPLVWLGAISYGIYLWHW

SEQ ID NO: 301046 - protein, 23 aa, Mycobacterium
ARLLAWRPLVWLGTISYGIYLWH

SEQ ID NO: 301047 - protein, 17 aa, Mycobacterium
ARLLFEMLRGEVITDGW

SEQ ID NO: 301048 - protein, 17 aa, Mycobacterium
ARLLGGAALVVAALGVA

SEQ ID NO: 301049 - protein, 26 aa, Mycobacterium
ARLLGKMSGLPLGWFTGRGSGSIKQL

SEQ ID NO: 301050 - protein, 19 aa, Mycobacterium
ARLLHRLLGLTVLKVSTGQ

SEQ ID NO: 301051 - protein, 21 aa, Mycobacterium
ARLLLRSMGYRDALIGGMLAA

SEQ ID NO: 301052 - protein, 17 aa, Mycobacterium
ARLLRSYQSQQDGLQVL

SEQ ID NO: 301053 - protein, 20 aa, Mycobacterium
ARLLTLPDILNSVVQATEAA

SEQ ID NO: 301054 - protein, 29 aa, Mycobacterium
ARLMSRIGLRPNIKRVPLFGLGCVAGAAG

SEQ ID NO: 301055 - protein, 20 aa, Mycobacterium
ARLMWRLCKIDGKPSRYRSE

SEQ ID NO: 301056 - protein, 20 aa, Mycobacterium
ARLMWRLCKINGKPSRYRSE

SEQ ID NO: 301057 - protein, 24 aa, Mycobacterium
ARLPDLLPGVPLVVSGRYRGSAPG

SEQ ID NO: 301058 - protein, 18 aa, Mycobacterium
ARLPEKVLLSDVFAGITE

SEQ ID NO: 301059 - protein, 28 aa, Mycobacterium
ARLPMPFERARSALTLGEVLRRLRRRDA

SEQ ID NO: 301060 - protein, 17 aa, Mycobacterium
ARLPRFIRPFAERHHEL

SEQ ID NO: 301061 - protein, 17 aa, Mycobacterium
ARLPRPTLALGTAIALL

SEQ ID NO: 301062 - protein, 19 aa, Mycobacterium
ARLQYWLLTVEVVVLIAFA

SEQ ID NO: 301063 - protein, 22 aa, Mycobacterium
ARLRADVLIPVLGGRFQTSGGE

SEQ ID NO: 301064 - protein, 26 aa, Mycobacterium
ARLRFIPWVRRLVDPPVRVLIRDGHV

SEQ ID NO: 301065 - protein, 19 aa, Mycobacterium
ARLRKRAVSPLAHSVGGYP

SEQ ID NO: 301066 - protein, 26 aa, Mycobacterium
ARLRRQLALRYVIFGGEALDVRRLAP

SEQ ID NO: 301067 - protein, 17 aa, Mycobacterium
ARLSARRLLPALALFAA

SEQ ID NO: 301068 - protein, 20 aa, Mycobacterium
ARLSNPHLIPIHTYGEINGR

SEQ ID NO: 301069 - protein, 18 aa, Mycobacterium
ARLSSFLTDGHEYQIVLL

SEQ ID NO: 301070 - protein, 19 aa, Mycobacterium
ARLSVPILVQKGIDDGIPP

SEQ ID NO: 301071 - protein, 21 aa, Mycobacterium
ARLSVPVLVQRGIDHGIPPIL

SEQ ID NO: 301072 - protein, 20 aa, Mycobacterium
ARLTDMADYHRIPFEVLEPT

SEQ ID NO: 301073 - protein, 27 aa, Mycobacterium
ARLTGRYAVLVVGLWVLAAAAANLAVP

SEQ ID NO: 301074 - protein, 19 aa, Mycobacterium
ARLTISFNTMLRALAESRD

SEQ ID NO: 301075 - protein, 18 aa, Mycobacterium
ARLTLRLTGGLPLLHVDK

SEQ ID NO: 301076 - protein, 17 aa, Mycobacterium
ARLTLRPTAGMPLLHVE

SEQ ID NO: 301077 - protein, 21 aa, Mycobacterium
ARLVAARGRLMAGLAAGGAMV

SEQ ID NO: 301078 - protein, 27 aa, Mycobacterium
ARLVKRLAPQRRLSIAVITLGLAGTVI

SEQ ID NO: 301079 - protein, 17 aa, Mycobacterium
ARLVKRLAPQRRLSLAV

SEQ ID NO: 301080 - protein, 22 aa, Mycobacterium
ARLWLPSYLAWFLGGMLLTVLQ

SEQ ID NO: 301081 - protein, 24 aa, Mycobacterium
ARLWLPSYLAWFLGGMMLTVLQAM

SEQ ID NO: 301082 - protein, 21 aa, Mycobacterium
ARLWLPTYLAWFLAGMLLAVL

SEQ ID NO: 301083 - protein, 24 aa, Mycobacterium
ARLWLPTYLAWFLAGMMLTVLQEM

SEQ ID NO: 301084 - protein, 23 aa, Mycobacterium
ARLWLPTYLAWFVAGMMLAVLGQ

SEQ ID NO: 301085 - protein, 18 aa, Mycobacterium
ARLWRTLDAHPPPGVERA

SEQ ID NO: 301086 - protein, 17 aa, Mycobacterium
ARLYAPVLRGRKALLLP

SEQ ID NO: 301087 - protein, 25 aa, Mycobacterium
ARMELDWRPKWTLDDGLPALLDWIA

SEQ ID NO: 301088 - protein, 18 aa, Mycobacterium
ARMGELAAVLAPRLPSDD

SEQ ID NO: 301089 - protein, 21 aa, Mycobacterium
ARMGFAFYGPFAFVIGSDQHV

SEQ ID NO: 301090 - protein, 26 aa, Mycobacterium
ARMGRRLGALTIDWLIALGLAALAMR

SEQ ID NO: 301091 - protein, 23 aa, Mycobacterium
ARMLSGLAAEAGFDSVITASGRM

SEQ ID NO: 301092 - protein, 20 aa, Mycobacterium
ARMLYCLIRSVIALVAAIAV

SEQ ID NO: 301093 - protein, 17 aa, Mycobacterium
ARMNPDLLMIESDHDMR

SEQ ID NO: 301094 - protein, 17 aa, Mycobacterium
ARMNPDLLMVESNHDMR

SEQ ID NO: 301095 - protein, 17 aa, Mycobacterium
ARMNPELLMLEADHDIR

SEQ ID NO: 301096 - protein, 25 aa, Mycobacterium
ARMRALKMPFYRSLISATNWLLGSV

SEQ ID NO: 301097 - protein, 25 aa, Mycobacterium
ARMSGHRVVTGLARIYISVIRGTPL

SEQ ID NO: 301098 - protein, 18 aa, Mycobacterium
ARMSYLMGLTVFGFASLV

SEQ ID NO: 301099 - protein, 22 aa, Mycobacterium
ARMYLMAVAAVLAFTVAALALA

SEQ ID NO: 301100 - protein, 30 aa, Mycobacterium
ARMYRTGDVVRWRADGQLEYLGRSDDQIKL

SEQ ID NO: 301101 - protein, 17 aa, Mycobacterium
ARNLVKLAAATRHELAD

SEQ ID NO: 301102 - protein, 21 aa, Mycobacterium
ARNPVFLAFPLMMLVSALASG

SEQ ID NO: 301103 - protein, 23 aa, Mycobacterium
ARNPVLRSAFWADDLPQPVAAIV

SEQ ID NO: 301104 - protein, 23 aa, Mycobacterium
ARNPVPCLRVVISSGDRLDPGLA

SEQ ID NO: 301105 - protein, 20 aa, Mycobacterium
ARNRAFWCFAAAMTGAYLLS

SEQ ID NO: 301106 - protein, 23 aa, Mycobacterium
ARNRTGELGNFWVDLVRGTLRIL

SEQ ID NO: 301107 - protein, 20 aa, Mycobacterium
ARNSSLAGLLARTRPLSDGV

SEQ ID NO: 301108 - protein, 17 aa, Mycobacterium
ARNTWRGLTSMGTALAL

SEQ ID NO: 301109 - protein, 20 aa, Mycobacterium
ARPADLLVLLDSLRQREATL

SEQ ID NO: 301110 - protein, 18 aa, Mycobacterium
ARPAFKRWWTRFVPQPIE

SEQ ID NO: 301111 - protein, 20 aa, Mycobacterium
ARPASHTGLAVAMIVLMMAG

SEQ ID NO: 301112 - protein, 20 aa, Mycobacterium
ARPASTISIAGVPWPAYKVF

SEQ ID NO: 301113 - protein, 21 aa, Mycobacterium
ARPAVMVLGVLTWVNVWNDFL

SEQ ID NO: 301114 - protein, 19 aa, Mycobacterium
ARPDRPAPVRATRPAETAS

SEQ ID NO: 301115 - protein, 20 aa, Mycobacterium
ARPEVEFVLNDCGARIDLAP

SEQ ID NO: 301116 - protein, 22 aa, Mycobacterium
ARPFGTEGSRQWHVELDGTLSF

SEQ ID NO: 301117 - protein, 32 aa, Mycobacterium
ARPFRGYLYWEQHCFNIPVCWASRSVFDAIDG

SEQ ID NO: 301118 - protein, 19 aa, Mycobacterium
ARPGAVALLKVMVERPRYI

SEQ ID NO: 301119 - protein, 17 aa, Mycobacterium
ARPGGYDPRPFDPFDEG

SEQ ID NO: 301120 - protein, 32 aa, Mycobacterium
ARPIAFAGAIAFLLFAVWAWREGAAGDDKPAN

SEQ ID NO: 301121 - protein, 21 aa, Mycobacterium
ARPKRNPVPSLLRALLSDHLD

SEQ ID NO: 301122 - protein, 21 aa, Mycobacterium
ARPLARFGHMVTFFVHAFLAI

SEQ ID NO: 301123 - protein, 34 aa, Mycobacterium
ARPLGARWVPAVLLDHWVQLVLITPVMMYVGWPI

SEQ ID NO: 301124 - protein, 21 aa, Mycobacterium
ARPLGGIIFGHFGDRAGRKQI

SEQ ID NO: 301125 - protein, 20 aa, Mycobacterium
ARPLGGIVFGHFGDRIGRKR

SEQ ID NO: 301126 - protein, 22 aa, Mycobacterium
ARPLGGVVFGHFGDLIGRKKTL

SEQ ID NO: 301127 - protein, 20 aa, Mycobacterium
ARPMAFVGAIAFLIFAGWAW

SEQ ID NO: 301128 - protein, 28 aa, Mycobacterium
ARPPELPWFATDGTWEFGGAPVADTPGP

SEQ ID NO: 301129 - protein, 20 aa, Mycobacterium
ARPPLSGTIAQLNRLAPILD

SEQ ID NO: 301130 - protein, 19 aa, Mycobacterium
ARPPSDFYVRGIDPDGHVW

SEQ ID NO: 301131 - protein, 18 aa, Mycobacterium
ARPPSKFYVRGISPDGHT

SEQ ID NO: 301132 - protein, 29 aa, Mycobacterium
ARPPVTSRWRWVPAFFGWFVGIQAILNFL

SEQ ID NO: 301133 - protein, 31 aa, Mycobacterium
ARPRAVLWSQWRFTFEPMFVVALSALLRSAT

SEQ ID NO: 301134 - protein, 22 aa, Mycobacterium
ARPRHRVVIIGSGFGGLNAAKK

SEQ ID NO: 301135 - protein, 21 aa, Mycobacterium
ARPRNALRLMFDPVFGALFWG

SEQ ID NO: 301136 - protein, 22 aa, Mycobacterium
ARPRPTGLAFLAGWVLGLAALT

SEQ ID NO: 301137 - protein, 25 aa, Mycobacterium
ARPSAVWWKVTLPLLMPGLVSGAVL

SEQ ID NO: 301138 - protein, 22 aa, Mycobacterium
ARPSAVWWRVTLPLLAPGVASG

SEQ ID NO: 301139 - protein, 19 aa, Mycobacterium
ARPSLSQFWDRFPKFVLGF

SEQ ID NO: 301140 - protein, 25 aa, Mycobacterium
ARPSTIWWRVTLPLLLPGMVSGAVL

SEQ ID NO: 301141 - protein, 34 aa, Mycobacterium
ARPSTVWWRVTLPLLRPGLMSGAVLAFARSLGEF

SEQ ID NO: 301142 - protein, 18 aa, Mycobacterium
ARPSWLLLGPAFVAAIAY

SEQ ID NO: 301143 - protein, 20 aa, Mycobacterium
ARPTIHMPLDHDPYQAPEGY

SEQ ID NO: 301144 - protein, 21 aa, Mycobacterium
ARPVPPPAPGPIPAMEPAHPA

SEQ ID NO: 301145 - protein, 19 aa, Mycobacterium
ARPVWARVLGRRLPETGSA

SEQ ID NO: 301146 - protein, 21 aa, Mycobacterium
ARPWAPHRRKAYVALTAMTGF

SEQ ID NO: 301147 - protein, 28 aa, Mycobacterium
ARPWPETGRARRAGISSFGISGTNAHVI

SEQ ID NO: 301148 - protein, 20 aa, Mycobacterium
ARPWVTAALVGLFAVAAAPN

SEQ ID NO: 301149 - protein, 27 aa, Mycobacterium
ARPYQWWRVALVVGSGLAYVVIFSIPL

SEQ ID NO: 301150 - protein, 26 aa, Mycobacterium
ARQAIPPLVARAAAPVYALNRRIGNP

SEQ ID NO: 301151 - protein, 20 aa, Mycobacterium
ARQARFALANGGVFGDGLGQ

SEQ ID NO: 301152 - protein, 20 aa, Mycobacterium
ARQARRVVTANLFIAGTFIS

SEQ ID NO: 301153 - protein, 22 aa, Mycobacterium
ARQELRVIAPLLDELGKRQPDV

SEQ ID NO: 301154 - protein, 22 aa, Mycobacterium
ARQFPQRYGRRIVGAAVISSAA

SEQ ID NO: 301155 - protein, 18 aa, Mycobacterium
ARQGVTVVVVGHRAPVVA

SEQ ID NO: 301156 - protein, 19 aa, Mycobacterium
ARQGYGFFVDEFRRKSPIW

SEQ ID NO: 301157 - protein, 19 aa, Mycobacterium
ARQQMAFSLGWHIVLACFG

SEQ ID NO: 301158 - protein, 19 aa, Mycobacterium
ARQRLDAVNQYIGLHRGAV

SEQ ID NO: 301159 - protein, 18 aa, Mycobacterium
ARQRTAMVSAEYLESMLA

SEQ ID NO: 301160 - protein, 18 aa, Mycobacterium
ARQVLTWLLGGLGGARWD

SEQ ID NO: 301161 - protein, 27 aa, Mycobacterium
ARQVRLLARRDVRLILADRLYSAFLVI

SEQ ID NO: 301162 - protein, 19 aa, Mycobacterium
ARQVVAWIVGMNVLYAVFL

SEQ ID NO: 301163 - protein, 20 aa, Mycobacterium
ARRAQMWQAFQIQRKEDKRL

SEQ ID NO: 301164 - protein, 28 aa, Mycobacterium
ARRARLLSIAAWLAVMVSVSFVLMQLLT

SEQ ID NO: 301165 - protein, 17 aa, Mycobacterium
ARRARRIMLQNVDLSLG

SEQ ID NO: 301166 - protein, 22 aa, Mycobacterium
ARRASICLSLGLGVGPLCAGLL

SEQ ID NO: 301167 - protein, 29 aa, Mycobacterium
ARRAWCEVLKDFDRPALVAPKGRLPGRRA

SEQ ID NO: 301168 - protein, 24 aa, Mycobacterium
ARRCGSVMVEALWDAGIGRDTLQL

SEQ ID NO: 301169 - protein, 23 aa, Mycobacterium
ARRDPVERALLYLLAALAALLLG

SEQ ID NO: 301170 - protein, 18 aa, Mycobacterium
ARRFGGGALAVYLDGQPV

SEQ ID NO: 301171 - protein, 27 aa, Mycobacterium
ARRFRRHPLGVAWLIALAVIPLLMAAI

SEQ ID NO: 301172 - protein, 23 aa, Mycobacterium
ARRFSAVALWCFVAMALSGTINA

SEQ ID NO: 301173 - protein, 23 aa, Mycobacterium
ARRGETMSAFYLLAYSAMAVPTL

SEQ ID NO: 301174 - protein, 21 aa, Mycobacterium
ARRGLPALVLSVAVAVAGAIL

SEQ ID NO: 301175 - protein, 19 aa, Mycobacterium
ARRGPRLRLRWERVSRSAV

SEQ ID NO: 301176 - protein, 20 aa, Mycobacterium
ARRGQLMWLTLILAAVTLVL

SEQ ID NO: 301177 - protein, 26 aa, Mycobacterium
ARRGQLRAGTALIARGEFSLIIIGLA

SEQ ID NO: 301178 - protein, 20 aa, Mycobacterium
ARRGSYGFLAPGFDARVVDP

SEQ ID NO: 301179 - protein, 19 aa, Mycobacterium
ARRHRHLRAALTPLVTERV

SEQ ID NO: 301180 - protein, 20 aa, Mycobacterium
ARRHTGDLGNFWVDLVRGTI

SEQ ID NO: 301181 - protein, 18 aa, Mycobacterium
ARRHTGELGNFWVDLVRG

SEQ ID NO: 301182 - protein, 18 aa, Mycobacterium
ARRIRMFVAATITYNVIE

SEQ ID NO: 301183 - protein, 20 aa, Mycobacterium
ARRKLRYGAVALVFLPIGQG

SEQ ID NO: 301184 - protein, 17 aa, Mycobacterium
ARRKVDQIWLFAVEGVE

SEQ ID NO: 301185 - protein, 19 aa, Mycobacterium
ARRLLPALIVVLGGAAVLT

SEQ ID NO: 301186 - protein, 22 aa, Mycobacterium
ARRLTQFGALVRIPRSVEALGR

SEQ ID NO: 301187 - protein, 19 aa, Mycobacterium
ARRPREFAGTIWVQQGSQP

SEQ ID NO: 301188 - protein, 37 aa, Mycobacterium
ARRPVLRPIRWPAFPYDPWVRISLWIGVAIIALLFGW

SEQ ID NO: 301189 - protein, 31 aa, Mycobacterium
ARRQGRLILADRGYFIFLALLPFVLAGLVLS

SEQ ID NO: 301190 - protein, 23 aa, Mycobacterium
ARRRLAQAIAEFAGQFGAMVIAE

SEQ ID NO: 301191 - protein, 24 aa, Mycobacterium
ARRRPHRRLVAIVAAVVLAVGTAV

SEQ ID NO: 301192 - protein, 24 aa, Mycobacterium
ARRRRARRATVWAVAVAAALLALA

SEQ ID NO: 301193 - protein, 23 aa, Mycobacterium
ARRRREVLVYAWLMPASTVLQAI

SEQ ID NO: 301194 - protein, 22 aa, Mycobacterium
ARRRREVLVYAWLMPASTVVQA

SEQ ID NO: 301195 - protein, 23 aa, Mycobacterium
ARRRREVLVYAWLMPVSTVVQAV

SEQ ID NO: 301196 - protein, 18 aa, Mycobacterium
ARRRSAMMAITYCGMTLG

SEQ ID NO: 301197 - protein, 24 aa, Mycobacterium
ARRRTKRPWVFAGAAVAVLAGGAV

SEQ ID NO: 301198 - protein, 18 aa, Mycobacterium
ARRRVFMAVVAVLAYLVA

SEQ ID NO: 301199 - protein, 20 aa, Mycobacterium
ARRSLLRSPLAWTVTVFFGS

SEQ ID NO: 301200 - protein, 18 aa, Mycobacterium
ARRSRRIMLQNIGLSLAI

SEQ ID NO: 301201 - protein, 20 aa, Mycobacterium
ARRTSRRRFIGGSAAAAAGL

SEQ ID NO: 301202 - protein, 26 aa, Mycobacterium
ARRTVEIIEYIALSLIVPIAVWVCGV

SEQ ID NO: 301203 - protein, 24 aa, Mycobacterium
ARRVAAVFAGAVLVVAAVTGLHGL

SEQ ID NO: 301204 - protein, 17 aa, Mycobacterium
ARRVARILPPAGLAGLA

SEQ ID NO: 301205 - protein, 19 aa, Mycobacterium
ARRVGPWAMFGVCAAITIS

SEQ ID NO: 301206 - protein, 19 aa, Mycobacterium
ARRVPVHHTFGYRSYSWYV

SEQ ID NO: 301207 - protein, 21 aa, Mycobacterium
ARRWLLLALVTVWGLRLSWHM

SEQ ID NO: 301208 - protein, 22 aa, Mycobacterium
ARSAAFHAMMRSLQSIVASLRT

SEQ ID NO: 301209 - protein, 19 aa, Mycobacterium
ARSAFRHSVDAVAICSLSG

SEQ ID NO: 301210 - protein, 17 aa, Mycobacterium
ARSANMNTLISLGTLTA

SEQ ID NO: 301211 - protein, 20 aa, Mycobacterium
ARSAPFLALMVSFALAALAS

SEQ ID NO: 301212 - protein, 18 aa, Mycobacterium
ARSARTGTALSIAALVPI

SEQ ID NO: 301213 - protein, 20 aa, Mycobacterium
ARSGVDHGKYYFMVELPPDF

SEQ ID NO: 301214 - protein, 25 aa, Mycobacterium
ARSGYLSLFSWMFGLVVTELPLQTL

SEQ ID NO: 301215 - protein, 17 aa, Mycobacterium
ARSLFRKGADFTAAMAF

SEQ ID NO: 301216 - protein, 17 aa, Mycobacterium
ARSLFRKGANFTAAMAF

SEQ ID NO: 301217 - protein, 18 aa, Mycobacterium
ARSLHFLGLIAFLIFIVI

SEQ ID NO: 301218 - protein, 23 aa, Mycobacterium
ARSLHFLGLIAFVVFIVIHLSMI

SEQ ID NO: 301219 - protein, 20 aa, Mycobacterium
ARSLHFLGLVAFLVFIVIHL

SEQ ID NO: 301220 - protein, 25 aa, Mycobacterium
ARSLLRVVILLGVLYIFATYPQILH

SEQ ID NO: 301221 - protein, 25 aa, Mycobacterium
ARSLLRVVLIIGVLYILATYPQILQ

SEQ ID NO: 301222 - protein, 18 aa, Mycobacterium
ARSLPDVDAVVVHISDVY

SEQ ID NO: 301223 - protein, 17 aa, Mycobacterium
ARSLRAAPVAAPRNLAR

SEQ ID NO: 301224 - protein, 24 aa, Mycobacterium
ARSPARWATMVARVRECADAAIHR

SEQ ID NO: 301225 - protein, 22 aa, Mycobacterium
ARSQELLVLFGVSYAVSVAALS

SEQ ID NO: 301226 - protein, 20 aa, Mycobacterium
ARSRALRMPFYRTLISMVAW

SEQ ID NO: 301227 - protein, 25 aa, Mycobacterium
ARSRELPVLRWADARSNRRMIEGGD

SEQ ID NO: 301228 - protein, 26 aa, Mycobacterium
ARSRLRRRGPAAGHRSDPDWSPSDED

SEQ ID NO: 301229 - protein, 22 aa, Mycobacterium
ARSRWLPLQFAALALVWGASFL

SEQ ID NO: 301230 - protein, 26 aa, Mycobacterium
ARSVMGIAPAGGWTRWSPAKFEVIAK

SEQ ID NO: 301231 - protein, 24 aa, Mycobacterium
ARSVTGIAPAGGWHRWSPAKFEVI

SEQ ID NO: 301232 - protein, 24 aa, Mycobacterium
ARSVTGIAPAGGWTRWSPAKFEVI

SEQ ID NO: 301233 - protein, 17 aa, Mycobacterium
ARTAAAIAQQVGIDQVL

SEQ ID NO: 301234 - protein, 21 aa, Mycobacterium
ARTAAPIFAARIVMGGLAGAA

SEQ ID NO: 301235 - protein, 17 aa, Mycobacterium
ARTAKAIARQVGVSRVL

SEQ ID NO: 301236 - protein, 32 aa, Mycobacterium
ARTAPGFLPWHLRLLIRLGAAVSVVLPGVVIP

SEQ ID NO: 301237 - protein, 23 aa, Mycobacterium
ARTGEQVMPMLVVSLMMQMVLCG

SEQ ID NO: 301238 - protein, 21 aa, Mycobacterium
ARTGTALSIAALVPIAAALVL

SEQ ID NO: 301239 - protein, 23 aa, Mycobacterium
ARTLLRRLLVAAVLFVPLADLST

SEQ ID NO: 301240 - protein, 20 aa, Mycobacterium
ARTLWGSIVINCRALDNALS

SEQ ID NO: 301241 - protein, 17 aa, Mycobacterium
ARTLWYLVMVVASVMLS

SEQ ID NO: 301242 - protein, 17 aa, Mycobacterium
ARTPAFVVMYLIMVIAA

SEQ ID NO: 301243 - protein, 25 aa, Mycobacterium
ARTPGELAEAHWIEFSATTRMSGVN

SEQ ID NO: 301244 - protein, 23 aa, Mycobacterium
ARTPGELAHAQWIEFSATTRMSG

SEQ ID NO: 301245 - protein, 24 aa, Mycobacterium
ARTPGELSQAHWVAFSATTRMSGV

SEQ ID NO: 301246 - protein, 25 aa, Mycobacterium
ARTPGELTHAHWVEFSAATRMSGVD

SEQ ID NO: 301247 - protein, 18 aa, Mycobacterium
ARTPGVVRKAIGGLRRLL

SEQ ID NO: 301248 - protein, 21 aa, Mycobacterium
ARTPPPPGIKVYVTGPSALTA

SEQ ID NO: 301249 - protein, 20 aa, Mycobacterium
ARTPWPVFTLGMLQADIIGA

SEQ ID NO: 301250 - protein, 19 aa, Mycobacterium
ARTRRGLRALLSLVPDQAT

SEQ ID NO: 301251 - protein, 18 aa, Mycobacterium
ARTSFRWLMSSDVCKHCT

SEQ ID NO: 301252 - protein, 17 aa, Mycobacterium
ARTSVLLAGDHDAVREM

SEQ ID NO: 301253 - protein, 18 aa, Mycobacterium
ARTTFTFLAVATLGTPEQ

SEQ ID NO: 301254 - protein, 19 aa, Mycobacterium
ARTVLLRFAVTSGVAVGAM

SEQ ID NO: 301255 - protein, 19 aa, Mycobacterium
ARTWPLAVVVVGIIVAVRW

SEQ ID NO: 301256 - protein, 21 aa, Mycobacterium
ARVAVSVLFFLYGGKLSLEQA

SEQ ID NO: 301257 - protein, 18 aa, Mycobacterium
ARVDAAGGSLVFLNTPTG

SEQ ID NO: 301258 - protein, 17 aa, Mycobacterium
ARVDRVILTGAFDTAAL

SEQ ID NO: 301259 - protein, 25 aa, Mycobacterium
ARVFFTGAFRRPREANWVIGALLLI

SEQ ID NO: 301260 - protein, 25 aa, Mycobacterium
ARVFGRLAMFTGIFNLLWAVVTVLM

SEQ ID NO: 301261 - protein, 19 aa, Mycobacterium
ARVGLFSLINAMRSIGLGI

SEQ ID NO: 301262 - protein, 17 aa, Mycobacterium
ARVGSPTALPMALSGTL

SEQ ID NO: 301263 - protein, 33 aa, Mycobacterium
ARVGVLIASAVAFLLAWATFRIGDRVRPLPTPA

SEQ ID NO: 301264 - protein, 28 aa, Mycobacterium
ARVIRAASIPIILIWVAIAAFLNVSVPQ

SEQ ID NO: 301265 - protein, 21 aa, Mycobacterium
ARVLDRFEAWVSRGDGSAVYA

SEQ ID NO: 301266 - protein, 18 aa, Mycobacterium
ARVLPPVVLLVALVAAWW

SEQ ID NO: 301267 - protein, 25 aa, Mycobacterium
ARVLTITAWLAVMVSVSFVLVQILG

SEQ ID NO: 301268 - protein, 26 aa, Mycobacterium
ARVLTSPEFVPWLLVALAGMIFQQSA

SEQ ID NO: 301269 - protein, 20 aa, Mycobacterium
ARVPHAVAISFNGRELTYRE

SEQ ID NO: 301270 - protein, 17 aa, Mycobacterium
ARVPRPAPSGVMHDLRL

SEQ ID NO: 301271 - protein, 18 aa, Mycobacterium
ARVPTLWIVLGPLGQSIT

SEQ ID NO: 301272 - protein, 19 aa, Mycobacterium
ARVPVSLAQLLGDANGLLA

SEQ ID NO: 301273 - protein, 17 aa, Mycobacterium
ARVPWGLLALPTAGPTR

SEQ ID NO: 301274 - protein, 21 aa, Mycobacterium
ARVQYWLPGYAIPLALAATAL

SEQ ID NO: 301275 - protein, 32 aa, Mycobacterium
ARVRKYLTLMAFRIPALILAAIAYGLWHNGLI

SEQ ID NO: 301276 - protein, 19 aa, Mycobacterium
ARVRNTWRALTSMGTALVL

SEQ ID NO: 301277 - protein, 26 aa, Mycobacterium
ARVRRYLTIMAFRIPALIGAAWAYSV

SEQ ID NO: 301278 - protein, 21 aa, Mycobacterium
ARVSIIPTLLLAIPFTVLVVF

SEQ ID NO: 301279 - protein, 34 aa, Mycobacterium
ARVSLAPTLLVAIPFTVLVSFTLNILLSELGAAD

SEQ ID NO: 301280 - protein, 21 aa, Mycobacterium
ARVSRCARFTFADTINHTVHV

SEQ ID NO: 301281 - protein, 29 aa, Mycobacterium
ARVSVVVAGLFPRLAATPDTDPAETTGTC

SEQ ID NO: 301282 - protein, 25 aa, Mycobacterium
ARVSWPRGGGGPAYGEEMPPSFHED

SEQ ID NO: 301283 - protein, 17 aa, Mycobacterium
ARVWDSAACKAWLLGHS

SEQ ID NO: 301284 - protein, 24 aa, Mycobacterium
ARVWIARIAITWGAVASLTAFVPN

SEQ ID NO: 301285 - protein, 21 aa, Mycobacterium
ARVWTKAFWRTRADAPEGHLS

SEQ ID NO: 301286 - protein, 21 aa, Mycobacterium
ARWIGWAHLPLGHVTPDRLLM

SEQ ID NO: 301287 - protein, 19 aa, Mycobacterium
ARWLPNRSVAAVAVAGIGG

SEQ ID NO: 301288 - protein, 17 aa, Mycobacterium
ARWNRLVTNKIVRLWAG

SEQ ID NO: 301289 - protein, 27 aa, Mycobacterium
ARWRGWQLTEGPAWHYALRRQPGKRLP

SEQ ID NO: 301290 - protein, 22 aa, Mycobacterium
ARWRRLWSRSAPVLAAYATLHC

SEQ ID NO: 301291 - protein, 17 aa, Mycobacterium
ARWRVAGSAALFVAGFT

SEQ ID NO: 301292 - protein, 22 aa, Mycobacterium
ARWTEDGSLEFLGRADNQVKIG

SEQ ID NO: 301293 - protein, 19 aa, Mycobacterium
ARWWVVFGPLPVITAIWAY

SEQ ID NO: 301294 - protein, 19 aa, Mycobacterium
ARWYVLKGRVDDARRALLR

SEQ ID NO: 301295 - protein, 19 aa, Mycobacterium
ARYDLMIAVVSALTLIFMI

SEQ ID NO: 301296 - protein, 19 aa, Mycobacterium
ARYGFYLRDIVTRFEYPDA

SEQ ID NO: 301297 - protein, 39 aa, Mycobacterium
ARYPISGAIYQWARRLGGAAVGWFAGWFMIIAQIVTASA

SEQ ID NO: 301298 - protein, 24 aa, Mycobacterium
ARYPISGAIYQWSRRMGGEVIGWF

SEQ ID NO: 301299 - protein, 34 aa, Mycobacterium
ASAAIRLFPRTPLNWRVLVGAFFVAAAFASAGAY

SEQ ID NO: 301300 - protein, 27 aa, Mycobacterium
ASAALIWRRPRWGRRLQPGPVADLLTE

SEQ ID NO: 301301 - protein, 19 aa, Mycobacterium
ASAATVLAAFALWERHSTH

SEQ ID NO: 301302 - protein, 17 aa, Mycobacterium
ASADAAKKWAIWSVVAW

SEQ ID NO: 301303 - protein, 17 aa, Mycobacterium
ASADLFGVGGILDIFDH

SEQ ID NO: 301304 - protein, 21 aa, Mycobacterium
ASADPPFRIPGYVTDRAGALK

SEQ ID NO: 301305 - protein, 25 aa, Mycobacterium
ASAGHSWPAPAWLALLAAVSLLCVL

SEQ ID NO: 301306 - protein, 36 aa, Mycobacterium
ASALAGFLPLVWLSLAFGWGLLGIWAGLSTFMVLRL

SEQ ID NO: 301307 - protein, 18 aa, Mycobacterium
ASALCAKLSTNMSRRLWQ

SEQ ID NO: 301308 - protein, 19 aa, Mycobacterium
ASALGLLSVYRFPRLARVT

SEQ ID NO: 301309 - protein, 20 aa, Mycobacterium
ASALRHLWVGALAWVPVALQ

SEQ ID NO: 301310 - protein, 20 aa, Mycobacterium
ASALRPRNVLAIAVSAISPT

SEQ ID NO: 301311 - protein, 27 aa, Mycobacterium
ASALTRRWPSIVGRAAVAVAVGVVVGE

SEQ ID NO: 301312 - protein, 20 aa, Mycobacterium
ASAMAICLSLASLLATTVVS

SEQ ID NO: 301313 - protein, 26 aa, Mycobacterium
ASAMLGFLPLIWLSLAFGWGLFGIWS

SEQ ID NO: 301314 - protein, 24 aa, Mycobacterium
ASARAMPGSGLGLAIVKQVVLNHG

SEQ ID NO: 301315 - protein, 23 aa, Mycobacterium
ASARRLTHFGALVRIPRSVEALG

SEQ ID NO: 301316 - protein, 25 aa, Mycobacterium
ASASDRGAATFGFAGTAGKEIVGQP

SEQ ID NO: 301317 - protein, 26 aa, Mycobacterium
ASASFMLCAAFNVLLRGLCGRDTAAP

SEQ ID NO: 301318 - protein, 23 aa, Mycobacterium
ASASRWAPSRVVAVQRTTTAVVT

SEQ ID NO: 301319 - protein, 22 aa, Mycobacterium
ASATGLLAVWSRQTVAAGHPGP

SEQ ID NO: 301320 - protein, 23 aa, Mycobacterium
ASATRSPWYSSLFIQLLVAIVAG

SEQ ID NO: 301321 - protein, 18 aa, Mycobacterium
ASAVAAYFYVRVIVLMFF

SEQ ID NO: 301322 - protein, 20 aa, Mycobacterium
ASAVESRSGHPLARAITDAA

SEQ ID NO: 301323 - protein, 18 aa, Mycobacterium
ASAVTAWALAFPHTPIIG

SEQ ID NO: 301324 - protein, 19 aa, Mycobacterium
ASAVVAVRRRRAVSDACGC

SEQ ID NO: 301325 - protein, 17 aa, Mycobacterium
ASAWLGTLMTGWWMAML

SEQ ID NO: 301326 - protein, 20 aa, Mycobacterium
ASAYLIGKIIMFGLVAAVQA

SEQ ID NO: 301327 - protein, 18 aa, Mycobacterium
ASAYRVGVYLEFIGVDGG

SEQ ID NO: 301328 - protein, 18 aa, Mycobacterium
ASCRRITEGNFTERIEPK

SEQ ID NO: 301329 - protein, 27 aa, Mycobacterium
ASCSVVAIATIWGWIFNDPIDVAGPAR

SEQ ID NO: 301330 - protein, 19 aa, Mycobacterium
ASCVLMLIPAAAWQRQVSA

SEQ ID NO: 301331 - protein, 23 aa, Mycobacterium
ASDAIEAPAWWRGTFIVMALAGL

SEQ ID NO: 301332 - protein, 19 aa, Mycobacterium
ASDHLKRSIGTFQLTLFGV

SEQ ID NO: 301333 - protein, 19 aa, Mycobacterium
ASDKLFCNSPFFWIGGFAF

SEQ ID NO: 301334 - protein, 19 aa, Mycobacterium
ASDPIAWWSPDLLFSEPDW

SEQ ID NO: 301335 - protein, 19 aa, Mycobacterium
ASDPIAWWTPDLLFSEPDW

SEQ ID NO: 301336 - protein, 21 aa, Mycobacterium
ASDPIAWWTPDLVFSKPDWLR

SEQ ID NO: 301337 - protein, 26 aa, Mycobacterium
ASDRHFPEARMGPEILMVEADHDMRN

SEQ ID NO: 301338 - protein, 20 aa, Mycobacterium
ASDTPCGAHVHFSGLQRMIL

SEQ ID NO: 301339 - protein, 24 aa, Mycobacterium
ASDVFIVALSNHWLQSKPSQAELR

SEQ ID NO: 301340 - protein, 24 aa, Mycobacterium
ASDVGGAVGRWVAWAELPESVSAG

SEQ ID NO: 301341 - protein, 24 aa, Mycobacterium
ASDVLRPAADVGLTIAPDRLYRDG

SEQ ID NO: 301342 - protein, 18 aa, Mycobacterium
ASDYLRLADAQQFATGAG

SEQ ID NO: 301343 - protein, 28 aa, Mycobacterium
ASEAFLPRLAILVVVAFVITAGVYGVVA

SEQ ID NO: 301344 - protein, 23 aa, Mycobacterium
ASEAISKLLAMGAKEARLLIDGE

SEQ ID NO: 301345 - protein, 24 aa, Mycobacterium
ASEAPEFIIAAIFAARGKGTAAIA

SEQ ID NO: 301346 - protein, 24 aa, Mycobacterium
ASEAPEFIVATIFAARGKGTAAIA

SEQ ID NO: 301347 - protein, 26 aa, Mycobacterium
ASEEKTRPSVVLALSGLVAVLVGGWA

SEQ ID NO: 301348 - protein, 18 aa, Mycobacterium
ASEGLRTLMIAGRDIDHD

SEQ ID NO: 301349 - protein, 23 aa, Mycobacterium
ASEHIPWRWSIGAAAVPAAIMLV

SEQ ID NO: 301350 - protein, 18 aa, Mycobacterium
ASEMVRLANKPPWYRSLF

SEQ ID NO: 301351 - protein, 22 aa, Mycobacterium
ASEPRWRIIVLPFSALGGPLAF

SEQ ID NO: 301352 - protein, 18 aa, Mycobacterium
ASERRAGPGGGREPSYRR

SEQ ID NO: 301353 - protein, 30 aa, Mycobacterium
ASEVASFAWQFVFYLGQIVVAYGVMLLGYA

SEQ ID NO: 301354 - protein, 19 aa, Mycobacterium
ASEVPECRAGIGVAAGQVV

SEQ ID NO: 301355 - protein, 25 aa, Mycobacterium
ASEYPLWSSFVWRNELADTFVETVA

SEQ ID NO: 301356 - protein, 20 aa, Mycobacterium
ASFAVVRLHGVFGRQSVSAG

SEQ ID NO: 301357 - protein, 17 aa, Mycobacterium
ASFDSGFVIADRLGGLR

SEQ ID NO: 301358 - protein, 19 aa, Mycobacterium
ASFGNKWMWSPIVVTPPVV

SEQ ID NO: 301359 - protein, 18 aa, Mycobacterium
ASFGPKLSLDDAQIDVSL

SEQ ID NO: 301360 - protein, 25 aa, Mycobacterium
ASFGVMPPFLLQHLSGHYDNIRIET

SEQ ID NO: 301361 - protein, 18 aa, Mycobacterium
ASFLGFAAALGYVLFEPP

SEQ ID NO: 301362 - protein, 34 aa, Mycobacterium
ASFLIALVPLGWVLSVVVARGWYAVTRATWWTHS

SEQ ID NO: 301363 - protein, 21 aa, Mycobacterium
ASFLVAGIVAWLAYSNRDRSP

SEQ ID NO: 301364 - protein, 35 aa, Mycobacterium
ASFTIAAGFLYFFFVLPRWPELMGDTAHSLGTALR

SEQ ID NO: 301365 - protein, 17 aa, Mycobacterium
ASFTTLLGIPDASRLDV

SEQ ID NO: 301366 - protein, 17 aa, Mycobacterium
ASFYAFYSGLGIPLPAG

SEQ ID NO: 301367 - protein, 30 aa, Mycobacterium
ASGAIGFRRWLPRHRRLLVTLSVAVAIGAV

SEQ ID NO: 301368 - protein, 23 aa, Mycobacterium
ASGAMVFAILVILGRQINYTLDL

SEQ ID NO: 301369 - protein, 25 aa, Mycobacterium
ASGASRFFINLSFAAFRKSRAAPGR

SEQ ID NO: 301370 - protein, 22 aa, Mycobacterium
ASGFHNRVTFLAGDPQTSTSGS

SEQ ID NO: 301371 - protein, 18 aa, Mycobacterium
ASGGLRAGDDVRIAGISV

SEQ ID NO: 301372 - protein, 19 aa, Mycobacterium
ASGIALLRCVGGRDLGIGL

SEQ ID NO: 301373 - protein, 18 aa, Mycobacterium
ASGIGLALFGLRHRASEA

SEQ ID NO: 301374 - protein, 25 aa, Mycobacterium
ASGLCAVAGSVEWLVAFRVLQGIGA

SEQ ID NO: 301375 - protein, 21 aa, Mycobacterium
ASGLFESWIVIGLVVGAWLNW

SEQ ID NO: 301376 - protein, 29 aa, Mycobacterium
ASGLLLWYRWHHNSWLPTAYSAVIALVVL

SEQ ID NO: 301377 - protein, 21 aa, Mycobacterium
ASGLYLFGFTYLWVAINNVTD

SEQ ID NO: 301378 - protein, 25 aa, Mycobacterium
ASGPFFKVVLHNLALYQISQPWVDA

SEQ ID NO: 301379 - protein, 31 aa, Mycobacterium
ASGPLGIAILFAFAGFMGFEATAVFRDEARQ

SEQ ID NO: 301380 - protein, 25 aa, Mycobacterium
ASGPLHLGGICWRGRNQRPVITGTT

SEQ ID NO: 301381 - protein, 22 aa, Mycobacterium
ASGPYFKVALLNLAPFWMTQPW

SEQ ID NO: 301382 - protein, 24 aa, Mycobacterium
ASGRAAARIPWQLADITEYTDGYR

SEQ ID NO: 301383 - protein, 19 aa, Mycobacterium
ASGRVAYALGLQGPAITVD

SEQ ID NO: 301384 - protein, 26 aa, Mycobacterium
ASGSFMLCAAFNVLLRALCGRDTAPA

SEQ ID NO: 301385 - protein, 26 aa, Mycobacterium
ASGSFMLCAAFNVLLRAVSGRDTAPA

SEQ ID NO: 301386 - protein, 22 aa, Mycobacterium
ASGTGLLAVWSRQTVAAGQPGP

SEQ ID NO: 301387 - protein, 18 aa, Mycobacterium
ASGTIMQNWWLRGLGAKI

SEQ ID NO: 301388 - protein, 30 aa, Mycobacterium
ASGTLRISNWPLYMADGFVAAFQTASGITV

SEQ ID NO: 301389 - protein, 19 aa, Mycobacterium
ASGVAAYFYVRVIVLMFFT

SEQ ID NO: 301390 - protein, 17 aa, Mycobacterium
ASGWEQLLILGIIGAAA

SEQ ID NO: 301391 - protein, 23 aa, Mycobacterium
ASGWEQLRILGMIGAAAAIGNFG

SEQ ID NO: 301392 - protein, 23 aa, Mycobacterium
ASHELRTPLAAIRGYTELAQRMG

SEQ ID NO: 301393 - protein, 23 aa, Mycobacterium
ASHELRTPLAAIRGYTELAQRMS

SEQ ID NO: 301394 - protein, 23 aa, Mycobacterium
ASHELRTPLAAIRGYTELTQRMG

SEQ ID NO: 301395 - protein, 21 aa, Mycobacterium
ASHKIGVLWRFHAVHHSVTRF

SEQ ID NO: 301396 - protein, 18 aa, Mycobacterium
ASHLARDLLTVFFEVWLA

SEQ ID NO: 301397 - protein, 20 aa, Mycobacterium
ASHPKCFSAAPNFAFELAVR

SEQ ID NO: 301398 - protein, 20 aa, Mycobacterium
ASHQCWRGTAAIIVSLLGWL

SEQ ID NO: 301399 - protein, 24 aa, Mycobacterium
ASIALALWAIRLAARPAAGRMTYG

SEQ ID NO: 301400 - protein, 17 aa, Mycobacterium
ASIALALWAIRLSARPA

SEQ ID NO: 301401 - protein, 17 aa, Mycobacterium
ASIAYRPALQARQAGPA

SEQ ID NO: 301402 - protein, 35 aa, Mycobacterium
ASIEFIEAIGLWLMKRWGEYFAVIATSIFLPLEIY

SEQ ID NO: 301403 - protein, 25 aa, Mycobacterium
ASIGFAAAALMSYGMTGTSSADTAF

SEQ ID NO: 301404 - protein, 20 aa, Mycobacterium
ASIGSFFPGPGTVIGGAVGG

SEQ ID NO: 301405 - protein, 20 aa, Mycobacterium
ASIHPPRFLVGLSQQNHTFR

SEQ ID NO: 301406 - protein, 18 aa, Mycobacterium
ASIIKVLVAMVSIKELNQ

SEQ ID NO: 301407 - protein, 21 aa, Mycobacterium
ASILMLYTIVIVRGMRTAIAT

SEQ ID NO: 301408 - protein, 25 aa, Mycobacterium
ASIPAGLLLPPVGIFLGHRARKQIR

SEQ ID NO: 301409 - protein, 33 aa, Mycobacterium
ASIPDFWFAITGVWLFAVLLGWLPTSGVDSGVL

SEQ ID NO: 301410 - protein, 19 aa, Mycobacterium
ASIPELFARQVTRSPKSIA

SEQ ID NO: 301411 - protein, 20 aa, Mycobacterium
ASIRCGKSIRFRSRDTTFPE

SEQ ID NO: 301412 - protein, 18 aa, Mycobacterium
ASIREIVKEQAIYRREHG

SEQ ID NO: 301413 - protein, 23 aa, Mycobacterium
ASIRSAGYLRKWLLLGVTIGVIA

SEQ ID NO: 301414 - protein, 17 aa, Mycobacterium
ASISDWFITATIPLAVM

SEQ ID NO: 301415 - protein, 18 aa, Mycobacterium
ASISDWFLAATIPLAILT

SEQ ID NO: 301416 - protein, 19 aa, Mycobacterium
ASIVLGLAVMSVFVIAERL

SEQ ID NO: 301417 - protein, 21 aa, Mycobacterium
ASKLMQCVVDGPGYVQSSPTL

SEQ ID NO: 301418 - protein, 22 aa, Mycobacterium
ASKLNWLRAGVLGANDGIVSTA

SEQ ID NO: 301419 - protein, 21 aa, Mycobacterium
ASKVFWRKQLQGLETAHFTGE

SEQ ID NO: 301420 - protein, 20 aa, Mycobacterium
ASLAAAIAIAVRPTASQQPV

SEQ ID NO: 301421 - protein, 27 aa, Mycobacterium
ASLAAANARLGAPRTITMPSARISSTE

SEQ ID NO: 301422 - protein, 17 aa, Mycobacterium
ASLALYLLFVFTQTVRH

SEQ ID NO: 301423 - protein, 22 aa, Mycobacterium
ASLAMAMLWLREHWPTRAQSLA

SEQ ID NO: 301424 - protein, 18 aa, Mycobacterium
ASLARLVGVIDLDAPGPD

SEQ ID NO: 301425 - protein, 17 aa, Mycobacterium
ASLDVLFALIVLGVLTG

SEQ ID NO: 301426 - protein, 19 aa, Mycobacterium
ASLFGYWWVSSSYPALPAF

SEQ ID NO: 301427 - protein, 18 aa, Mycobacterium
ASLFSRELLQEVFLNPGL

SEQ ID NO: 301428 - protein, 17 aa, Mycobacterium
ASLGIGGLLGFPSVAYA

SEQ ID NO: 301429 - protein, 24 aa, Mycobacterium
ASLGLSWWQTMRMIQLPQAITAML

SEQ ID NO: 301430 - protein, 24 aa, Mycobacterium
ASLKRAAALLPLPGQVGGATTSAT

SEQ ID NO: 301431 - protein, 32 aa, Mycobacterium
ASLLAGRAVESWGPRLPVLICLAAMIVGLALF

SEQ ID NO: 301432 - protein, 22 aa, Mycobacterium
ASLLALLAARGFVFSRAPDNLG

SEQ ID NO: 301433 - protein, 19 aa, Mycobacterium
ASLLWQLLLVWIGAVVGAG

SEQ ID NO: 301434 - protein, 24 aa, Mycobacterium
ASLNIIAMIWSRLALYGTSGSVRV

SEQ ID NO: 301435 - protein, 24 aa, Mycobacterium
ASLNIIAMIWSRLVLYGTSGTARV

SEQ ID NO: 301436 - protein, 19 aa, Mycobacterium
ASLPLHAFFGVVLMGTQSV

SEQ ID NO: 301437 - protein, 17 aa, Mycobacterium
ASLPLHAFFGVVLMGTR

SEQ ID NO: 301438 - protein, 17 aa, Mycobacterium
ASLPTNIGYAAAERHFT

SEQ ID NO: 301439 - protein, 26 aa, Mycobacterium
ASLPVLRWGWTPVLFAGSLVTLVPLA

SEQ ID NO: 301440 - protein, 26 aa, Mycobacterium
ASLPVLRWSWTPALLAGALATLMPLA

SEQ ID NO: 301441 - protein, 25 aa, Mycobacterium
ASLPVPGKRSRLVVPGRELRDYDEL

SEQ ID NO: 301442 - protein, 25 aa, Mycobacterium
ASLQIPRALFWIVIAYITFATVVAF

SEQ ID NO: 301443 - protein, 17 aa, Mycobacterium
ASLQTVFNRGRSLLIAT

SEQ ID NO: 301444 - protein, 21 aa, Mycobacterium
ASLRHVWCGGEVLTPGLFARF

SEQ ID NO: 301445 - protein, 22 aa, Mycobacterium
ASLRLLAERGRFIEMGKTDIRD

SEQ ID NO: 301446 - protein, 17 aa, Mycobacterium
ASLRSGECDMALAGGVT

SEQ ID NO: 301447 - protein, 17 aa, Mycobacterium
ASLRVSPGLPGSGVVVL

SEQ ID NO: 301448 - protein, 18 aa, Mycobacterium
ASLSELDEALTIAFLIIF

SEQ ID NO: 301449 - protein, 23 aa, Mycobacterium
ASLSRALAGFALAILVSIPLGVA

SEQ ID NO: 301450 - protein, 23 aa, Mycobacterium
ASLSRALGHPVTVELSWIPVRDP

SEQ ID NO: 301451 - protein, 30 aa, Mycobacterium
ASLTAQVGRNWPVLHAFRTVGVSLTLLTAI

SEQ ID NO: 301452 - protein, 17 aa, Mycobacterium
ASLVFPTVLALTGLAVV

SEQ ID NO: 301453 - protein, 18 aa, Mycobacterium
ASLVGVAVIIARIVVGLL

SEQ ID NO: 301454 - protein, 24 aa, Mycobacterium
ASLWCGLAGSIGWLIAARVVQGIG

SEQ ID NO: 301455 - protein, 23 aa, Mycobacterium
ASLWCGLSDSIGMLIAARVVQGV

SEQ ID NO: 301456 - protein, 21 aa, Mycobacterium
ASLWCGLSGSIGMLITARAVQ

SEQ ID NO: 301457 - protein, 19 aa, Mycobacterium
ASLWFGFRSAAKVFRDPLP

SEQ ID NO: 301458 - protein, 24 aa, Mycobacterium
ASMAALPPFFGFVAKEADLETVLH

SEQ ID NO: 301459 - protein, 25 aa, Mycobacterium
ASMDLRPHALLSRVPFVVLVIGSLG

SEQ ID NO: 301460 - protein, 18 aa, Mycobacterium
ASMFPAFARRAAAEGGAE

SEQ ID NO: 301461 - protein, 27 aa, Mycobacterium
ASMFPFVWNVFRSWRYGEVVTVDDPWG

SEQ ID NO: 301462 - protein, 27 aa, Mycobacterium
ASMPSWGMVVTLVLWGYVLDRVGERVV

SEQ ID NO: 301463 - protein, 18 aa, Mycobacterium
ASMREMLVPLVPAALIAL

SEQ ID NO: 301464 - protein, 18 aa, Mycobacterium
ASMTMVWLSVLLYVKIGE

SEQ ID NO: 301465 - protein, 25 aa, Mycobacterium
ASMVLYIGCWWRHLTPPAPAAAPPA

SEQ ID NO: 301466 - protein, 18 aa, Mycobacterium
ASMVMVWLAVLLFVKIGQ

SEQ ID NO: 301467 - protein, 24 aa, Mycobacterium
ASNRPEFLAVVLAIWRLAATAVLI

SEQ ID NO: 301468 - protein, 24 aa, Mycobacterium
ASPAEAGFRPGLLTQVCSRSVAVA

SEQ ID NO: 301469 - protein, 19 aa, Mycobacterium
ASPAWWADYVLAVGSVNGD

SEQ ID NO: 301470 - protein, 18 aa, Mycobacterium
ASPCALAIAVPLTVVAAI

SEQ ID NO: 301471 - protein, 18 aa, Mycobacterium
ASPCALAIAVPLTVVAAV

SEQ ID NO: 301472 - protein, 18 aa, Mycobacterium
ASPCALAIAVPVTVVAAI

SEQ ID NO: 301473 - protein, 19 aa, Mycobacterium
ASPFDWYATLLSWLTQVST

SEQ ID NO: 301474 - protein, 29 aa, Mycobacterium
ASPLLPFGLLGIWAAIPFAIWFFLAIEGV

SEQ ID NO: 301475 - protein, 20 aa, Mycobacterium
ASPLPIPFWFGILAGEEPID

SEQ ID NO: 301476 - protein, 18 aa, Mycobacterium
ASPLRFGEYLAAKLIVLL

SEQ ID NO: 301477 - protein, 21 aa, Mycobacterium
ASPQLPAPLPAASVAEAPVLP

SEQ ID NO: 301478 - protein, 24 aa, Mycobacterium
ASPSRARFAAVMGLYGVTFAVQVG

SEQ ID NO: 301479 - protein, 23 aa, Mycobacterium
ASPTRTFFKVTLPLIVPGIVAAA

SEQ ID NO: 301480 - protein, 20 aa, Mycobacterium
ASPTRTFFRVTLPLIVPGIV

SEQ ID NO: 301481 - protein, 17 aa, Mycobacterium
ASPVGLLVIVLLVVATL

SEQ ID NO: 301482 - protein, 19 aa, Mycobacterium
ASPVKRAIGSFGGFFILMF

SEQ ID NO: 301483 - protein, 18 aa, Mycobacterium
ASQCRYEQLITLGTFAAY

SEQ ID NO: 301484 - protein, 19 aa, Mycobacterium
ASQMRRLRAPRPQVKHGAS

SEQ ID NO: 301485 - protein, 19 aa, Mycobacterium
ASQMRRLRTPRPQVKRGGD

SEQ ID NO: 301486 - protein, 19 aa, Mycobacterium
ASQPPVFTSSWAGHDDPSG

SEQ ID NO: 301487 - protein, 17 aa, Mycobacterium
ASQRLADRIAKPLVPGV

SEQ ID NO: 301488 - protein, 28 aa, Mycobacterium
ASQRLSLPFQRARMDDMLKQADDMSKTI

SEQ ID NO: 301489 - protein, 30 aa, Mycobacterium
ASQVIKYTWPVKRMRAADVRTSVLVVGGIA

SEQ ID NO: 301490 - protein, 17 aa, Mycobacterium
ASRAHWFGTDLQGHDVY

SEQ ID NO: 301491 - protein, 18 aa, Mycobacterium
ASRAYAFLVPTAVKSVTA

SEQ ID NO: 301492 - protein, 24 aa, Mycobacterium
ASRDDNSWMGFWIFAAAMVLTAVA

SEQ ID NO: 301493 - protein, 22 aa, Mycobacterium
ASRDDNSWVGFGIFAAAMVLTA

SEQ ID NO: 301494 - protein, 21 aa, Mycobacterium
ASRERITLCALLVGTATVYLW

SEQ ID NO: 301495 - protein, 21 aa, Mycobacterium
ASRITKWLFVHVLVSSDGPSA

SEQ ID NO: 301496 - protein, 31 aa, Mycobacterium
ASRLGTRFGPYELRSLIGVGGMGEVYRAYDT

SEQ ID NO: 301497 - protein, 23 aa, Mycobacterium
ASRLPVSVFKPVVLVLLVAVGVF

SEQ ID NO: 301498 - protein, 26 aa, Mycobacterium
ASRREFSRPDGLRGSFVAERVRPQKY

SEQ ID NO: 301499 - protein, 17 aa, Mycobacterium
ASSAENWVDLMLAPKAM

SEQ ID NO: 301500 - protein, 19 aa, Mycobacterium
ASSALVFTSRVELLRLAVI

SEQ ID NO: 301501 - protein, 21 aa, Mycobacterium
ASSGRYQGVWSMTTAAAAVTA

SEQ ID NO: 301502 - protein, 18 aa, Mycobacterium
ASSIGALSVPQSWAKAAM

SEQ ID NO: 301503 - protein, 26 aa, Mycobacterium
ASSLLVAIASWARWSSAAPAPRRGLG

SEQ ID NO: 301504 - protein, 19 aa, Mycobacterium
ASSLLVAMASWAPWSSAGP

SEQ ID NO: 301505 - protein, 20 aa, Mycobacterium
ASSLRGGAVGVYVGVSNNDY

SEQ ID NO: 301506 - protein, 20 aa, Mycobacterium
ASSLRSGECDVALAGGVTVM

SEQ ID NO: 301507 - protein, 20 aa, Mycobacterium
ASSPPPSWGYATAASAPAPA

SEQ ID NO: 301508 - protein, 28 aa, Mycobacterium
ASSRLVKRGGPAAGHRSDPDWKHQRDWD

SEQ ID NO: 301509 - protein, 24 aa, Mycobacterium
ASSSCSYAAVALARSLFRKGADFT

SEQ ID NO: 301510 - protein, 24 aa, Mycobacterium
ASSSCSYAAVALARSLFRKGANFT

SEQ ID NO: 301511 - protein, 24 aa, Mycobacterium
ASSSRLPLAAAAVAGVLALVVALL

SEQ ID NO: 301512 - protein, 31 aa, Mycobacterium
ASSSRRRVRGLTRMRLGAAVVGAAAAAAFGG

SEQ ID NO: 301513 - protein, 20 aa, Mycobacterium
ASSTGWMNAFFVVNVLAVGF

SEQ ID NO: 301514 - protein, 24 aa, Mycobacterium
ASSTPRPLPPVAPSLSPETVTTVT

SEQ ID NO: 301515 - protein, 20 aa, Mycobacterium
ASSVGPWLPLVFLLVHIVVT

SEQ ID NO: 301516 - protein, 25 aa, Mycobacterium
ASSVPRCVGNTLLLHGRTYSPPYVI

SEQ ID NO: 301517 - protein, 30 aa, Mycobacterium
ASTAFAFFGWHWSLPLGVAILLAAVGGGLL

SEQ ID NO: 301518 - protein, 24 aa, Mycobacterium
ASTFGGPVPVGAGFNRPALEEQED

SEQ ID NO: 301519 - protein, 19 aa, Mycobacterium
ASTGWEWVLGVGWAVAAAA

SEQ ID NO: 301520 - protein, 23 aa, Mycobacterium
ASTHGRLLLCGVYAAVAVVALIR

SEQ ID NO: 301521 - protein, 18 aa, Mycobacterium
ASTILHGFWVLLFALPFA

SEQ ID NO: 301522 - protein, 18 aa, Mycobacterium
ASTILWSLALTAVFAPFA

SEQ ID NO: 301523 - protein, 24 aa, Mycobacterium
ASTLCPLLVLGIWWRGLTARGAMS

SEQ ID NO: 301524 - protein, 32 aa, Mycobacterium
ASTLCPLLVLGIWWRRLTVVGAASGLVVGGVV

SEQ ID NO: 301525 - protein, 27 aa, Mycobacterium
ASTLPFLWNVFKSYRYGEVVTVDDPWG

SEQ ID NO: 301526 - protein, 23 aa, Mycobacterium
ASTPECPACLTGQAMHPSFVYEI

SEQ ID NO: 301527 - protein, 23 aa, Mycobacterium
ASTQFGALMLFNVVAFALVEIPL

SEQ ID NO: 301528 - protein, 25 aa, Mycobacterium
ASTRIPIPVILVVTATLLFGVFANR

SEQ ID NO: 301529 - protein, 17 aa, Mycobacterium
ASTRSRTWRSWWSRWSR

SEQ ID NO: 301530 - protein, 20 aa, Mycobacterium
ASTSLAWTGRLVPRGGFDAI

SEQ ID NO: 301531 - protein, 17 aa, Mycobacterium
ASVACFGLLAVLRPGLP

SEQ ID NO: 301532 - protein, 22 aa, Mycobacterium
ASVAPMFLEWMRRRKAGKTAEG

SEQ ID NO: 301533 - protein, 17 aa, Mycobacterium
ASVAVVFVIIFRDQTLA

SEQ ID NO: 301534 - protein, 17 aa, Mycobacterium
ASVAWLAARGVGRGDRI

SEQ ID NO: 301535 - protein, 19 aa, Mycobacterium
ASVGIAFGLLVSGATLAVG

SEQ ID NO: 301536 - protein, 23 aa, Mycobacterium
ASVGKWDTLRAMGFDDDHIADSR

SEQ ID NO: 301537 - protein, 24 aa, Mycobacterium
ASVGRGGLQFMLIIWLQGIWLPLR

SEQ ID NO: 301538 - protein, 28 aa, Mycobacterium
ASVGSWKPGTSWGSWLMHRCTRLYRPVF

SEQ ID NO: 301539 - protein, 18 aa, Mycobacterium
ASVISWVSIVLIGIVVVM

SEQ ID NO: 301540 - protein, 19 aa, Mycobacterium
ASVISWVSIVLIYVIVLYE

SEQ ID NO: 301541 - protein, 18 aa, Mycobacterium
ASVISWVSVALLFVMVAV

SEQ ID NO: 301542 - protein, 24 aa, Mycobacterium
ASVISWVSVVIIGIWVMMQIADVL

SEQ ID NO: 301543 - protein, 21 aa, Mycobacterium
ASVLICGGLFLLHREDSTAYL

SEQ ID NO: 301544 - protein, 18 aa, Mycobacterium
ASVLRAALMASIALAAML

SEQ ID NO: 301545 - protein, 21 aa, Mycobacterium
ASVLRRKIQQAGFGDVKVTNS

SEQ ID NO: 301546 - protein, 19 aa, Mycobacterium
ASVNWDWTKAIPALETVGD

SEQ ID NO: 301547 - protein, 18 aa, Mycobacterium
ASVPSAIAVPPQLGGAIA

SEQ ID NO: 301548 - protein, 18 aa, Mycobacterium
ASVPVYWFGLLLIGAFAV

SEQ ID NO: 301549 - protein, 18 aa, Mycobacterium
ASVQVIVGWVASSLAGGI

SEQ ID NO: 301550 - protein, 31 aa, Mycobacterium
ASVSPAIRWLIKVPREFINDYLFNFPDTSIA

SEQ ID NO: 301551 - protein, 17 aa, Mycobacterium
ASVSPSLIRRAADYFDR

SEQ ID NO: 301552 - protein, 22 aa, Mycobacterium
ASVTAGLAWFLTHDVLDHPQPF

SEQ ID NO: 301553 - protein, 19 aa, Mycobacterium
ASVTARAEVWGVPGEPDES

SEQ ID NO: 301554 - protein, 23 aa, Mycobacterium
ASVTGWFTRLPVAPRSARAAAAL

SEQ ID NO: 301555 - protein, 19 aa, Mycobacterium
ASVTGWLAAVALPPAICAL

SEQ ID NO: 301556 - protein, 18 aa, Mycobacterium
ASVVATDTTVRWLAVFAL

SEQ ID NO: 301557 - protein, 24 aa, Mycobacterium
ASWLRIVLGTALIIFGVYRWLNRS

SEQ ID NO: 301558 - protein, 22 aa, Mycobacterium
ASWPQCRSAVAALLSSTVDIRE

SEQ ID NO: 301559 - protein, 18 aa, Mycobacterium
ASYAPWRTLLPAGLAAGF

SEQ ID NO: 301560 - protein, 20 aa, Mycobacterium
ASYLKDDWFRDWGALQRLTP

SEQ ID NO: 301561 - protein, 23 aa, Mycobacterium
ASYPRMYEVFAQRFASRTRDEWT

SEQ ID NO: 301562 - protein, 26 aa, Mycobacterium
ASYSKSTWRLWSFPWQAKSPGKHTIT

SEQ ID NO: 301563 - protein, 26 aa, Mycobacterium
ASYSNETWRLWSFPWEAKTPGRHTIT

SEQ ID NO: 301564 - protein, 18 aa, Mycobacterium
ATAAAALTGWLARSPGAR

SEQ ID NO: 301565 - protein, 37 aa, Mycobacterium
ATAAFKISPSAWWVCGSAIGITLLYLGYLRRQTRIEE

SEQ ID NO: 301566 - protein, 24 aa, Mycobacterium
ATAAFKVSPSAWWVCGTATAVTLL

SEQ ID NO: 301567 - protein, 24 aa, Mycobacterium
ATAAGLSWYLAHDVLAHPQPFFAP

SEQ ID NO: 301568 - protein, 19 aa, Mycobacterium
ATAALGARTPEDMVADLRS

SEQ ID NO: 301569 - protein, 20 aa, Mycobacterium
ATAALVRRSLQFGALTAEEL

SEQ ID NO: 301570 - protein, 26 aa, Mycobacterium
ATAARPLWFVCIALGLVILAVGFFST

SEQ ID NO: 301571 - protein, 25 aa, Mycobacterium
ATAATRLQVWLTRTGDDTFTLYASD

SEQ ID NO: 301572 - protein, 26 aa, Mycobacterium
ATAAVTIVWMWDRTETALWVGAAVVT

SEQ ID NO: 301573 - protein, 29 aa, Mycobacterium
ATACGVLMSVWWWRRKWPSRNQSWLVVGI

SEQ ID NO: 301574 - protein, 25 aa, Mycobacterium
ATADLYPRYTCDYGTPSHPPSAADY

SEQ ID NO: 301575 - protein, 30 aa, Mycobacterium
ATADLYPRYVCDYPTPRLPGSAADYPEPFL

SEQ ID NO: 301576 - protein, 24 aa, Mycobacterium
ATAFAMGGLLAWARRKPWLSGVLI

SEQ ID NO: 301577 - protein, 24 aa, Mycobacterium
ATAFAMGGLLAWARRRPWLAGLLI

SEQ ID NO: 301578 - protein, 24 aa, Mycobacterium
ATAFSMTALWAWARKKPWLAGVLI

SEQ ID NO: 301579 - protein, 17 aa, Mycobacterium
ATAGLLAMLSFALPMMN

SEQ ID NO: 301580 - protein, 17 aa, Mycobacterium
ATAHAFAPLPVDPSMLP

SEQ ID NO: 301581 - protein, 18 aa, Mycobacterium
ATAIFLGARHTARMWRVW

SEQ ID NO: 301582 - protein, 17 aa, Mycobacterium
ATAKSRLAPSLPAPQRE

SEQ ID NO: 301583 - protein, 20 aa, Mycobacterium
ATALCALAAALALLGTLLAR

SEQ ID NO: 301584 - protein, 20 aa, Mycobacterium
ATALGGWAGFSVGWLYWYFW

SEQ ID NO: 301585 - protein, 24 aa, Mycobacterium
ATALIAAFGHWWVIVVYLAVLTLL

SEQ ID NO: 301586 - protein, 18 aa, Mycobacterium
ATALPVWGIIAGKSLAVV

SEQ ID NO: 301587 - protein, 18 aa, Mycobacterium
ATALPVWGVIAGKSLAVV

SEQ ID NO: 301588 - protein, 17 aa, Mycobacterium
ATALPWLAARIGTPGVP

SEQ ID NO: 301589 - protein, 17 aa, Mycobacterium
ATALSIYVGLAVAFGLW

SEQ ID NO: 301590 - protein, 24 aa, Mycobacterium
ATAPFKSATKWSGASYAEHGNWVI

SEQ ID NO: 301591 - protein, 23 aa, Mycobacterium
ATAPFKSATKWSGTSYGEHGNWV

SEQ ID NO: 301592 - protein, 30 aa, Mycobacterium
ATAPFKSATKWSGVSFEGHGDWVMGAPDVL

SEQ ID NO: 301593 - protein, 18 aa, Mycobacterium
ATAPMMLIPQLTLGLASV

SEQ ID NO: 301594 - protein, 24 aa, Mycobacterium
ATAQRWGRYRIAARVEVIARGGLL

SEQ ID NO: 301595 - protein, 18 aa, Mycobacterium
ATAREFGGAGGSLVQALQ

SEQ ID NO: 301596 - protein, 18 aa, Mycobacterium
ATAREIGAQLGIGIGKPA

SEQ ID NO: 301597 - protein, 21 aa, Mycobacterium
ATARQAWQWLVTEVPQRSLHN

SEQ ID NO: 301598 - protein, 17 aa, Mycobacterium
ATARRFGPVGALAAATI

SEQ ID NO: 301599 - protein, 24 aa, Mycobacterium
ATASFGVTPLMLWQQATKHYTNIS

SEQ ID NO: 301600 - protein, 33 aa, Mycobacterium
ATASLAALHARPGCPTSGVVALCDFGAGGTSVT

SEQ ID NO: 301601 - protein, 25 aa, Mycobacterium
ATASVVAWEWLCARSERSGGQQAAP

SEQ ID NO: 301602 - protein, 23 aa, Mycobacterium
ATAVCLLVVLALLAHFTEWGRQF

SEQ ID NO: 301603 - protein, 21 aa, Mycobacterium
ATAVGYRPLTRMLKVELPLAL

SEQ ID NO: 301604 - protein, 21 aa, Mycobacterium
ATAVGYRPLTRMLKVELPLSI

SEQ ID NO: 301605 - protein, 27 aa, Mycobacterium
ATAVLVSRRAPRRWAARDAIADIERQS

SEQ ID NO: 301606 - protein, 25 aa, Mycobacterium
ATAVPLRVLSWLLMPLSRLLVVLGN

SEQ ID NO: 301607 - protein, 19 aa, Mycobacterium
ATAVPSLRVPRRVPVEVSM

SEQ ID NO: 301608 - protein, 18 aa, Mycobacterium
ATAVPWARQRTAMVAAEH

SEQ ID NO: 301609 - protein, 18 aa, Mycobacterium
ATAVPWARQRTAMVAAER

SEQ ID NO: 301610 - protein, 19 aa, Mycobacterium
ATAVPWARQRTAMVAAERL

SEQ ID NO: 301611 - protein, 21 aa, Mycobacterium
ATAVVVCYGLWAFERDHRAGS

SEQ ID NO: 301612 - protein, 19 aa, Mycobacterium
ATAVVVCYGLWAFERDNYS

SEQ ID NO: 301613 - protein, 21 aa, Mycobacterium
ATAYLLAKIITYCGAAIVQSA

SEQ ID NO: 301614 - protein, 18 aa, Mycobacterium
ATAYRLLTGAPPFSHSNP

SEQ ID NO: 301615 - protein, 19 aa, Mycobacterium
ATAYVCAVAAMPTLSELAA

SEQ ID NO: 301616 - protein, 19 aa, Mycobacterium
ATCDLRKLVPVGPQDELWN

SEQ ID NO: 301617 - protein, 17 aa, Mycobacterium
ATCELFRRQGMTGTGLK

SEQ ID NO: 301618 - protein, 19 aa, Mycobacterium
ATCLRHCHRPVSAPGASGR

SEQ ID NO: 301619 - protein, 17 aa, Mycobacterium
ATCRAIVTPEQNVLAAQ

SEQ ID NO: 301620 - protein, 21 aa, Mycobacterium
ATCWEVLFDRALRQSTLNGAE

SEQ ID NO: 301621 - protein, 17 aa, Mycobacterium
ATDAAYLRRFYPAGDDE

SEQ ID NO: 301622 - protein, 18 aa, Mycobacterium
ATDDEMWEALRVAAAADF

SEQ ID NO: 301623 - protein, 21 aa, Mycobacterium
ATDLKRLLGYSTIENMGLVTL

SEQ ID NO: 301624 - protein, 23 aa, Mycobacterium
ATDNVIRWLELWSGELTNISLAG

SEQ ID NO: 301625 - protein, 25 aa, Mycobacterium
ATDPLFCVAMGFLAAVSAAASISGV

SEQ ID NO: 301626 - protein, 17 aa, Mycobacterium
ATDQVWRVVNSRWVELP

SEQ ID NO: 301627 - protein, 20 aa, Mycobacterium
ATDRLKGWAQAFDELGRLRG

SEQ ID NO: 301628 - protein, 22 aa, Mycobacterium
ATDSICRPGGLADQLRAAHVVM

SEQ ID NO: 301629 - protein, 32 aa, Mycobacterium
ATEATFRFLLYAFLCVTAFVAVRVEERHARSV

SEQ ID NO: 301630 - protein, 28 aa, Mycobacterium
ATEDWTRIWERFTLVAMCAVGAMIVSGT

SEQ ID NO: 301631 - protein, 24 aa, Mycobacterium
ATEGILGGALAWLGYGFPERAEGL

SEQ ID NO: 301632 - protein, 19 aa, Mycobacterium
ATEGLALLLGRIAPVPAAG

SEQ ID NO: 301633 - protein, 24 aa, Mycobacterium
ATEPANLPLAWSEDANTGNEPVPY

SEQ ID NO: 301634 - protein, 22 aa, Mycobacterium
ATEPRWRVVALPFTALLGPVFF

SEQ ID NO: 301635 - protein, 23 aa, Mycobacterium
ATERSPLPLALRNDLPVPIRVRL

SEQ ID NO: 301636 - protein, 22 aa, Mycobacterium
ATESICRPGGLADQLRSRGIVM

SEQ ID NO: 301637 - protein, 17 aa, Mycobacterium
ATESVRMLAPIPGKSAV

SEQ ID NO: 301638 - protein, 19 aa, Mycobacterium
ATFAGNWPGLNVVDVNGDP

SEQ ID NO: 301639 - protein, 22 aa, Mycobacterium
ATFAIGWGLVGFLWATVAGSVS

SEQ ID NO: 301640 - protein, 28 aa, Mycobacterium
ATFCLSFTRLPYFQSLGVPLALGMLVLI

SEQ ID NO: 301641 - protein, 28 aa, Mycobacterium
ATFCLSFTRLPYFQTMGVPLAIGMFVVV

SEQ ID NO: 301642 - protein, 22 aa, Mycobacterium
ATFGEFLAWIIGWNLLLELAIG

SEQ ID NO: 301643 - protein, 23 aa, Mycobacterium
ATFGEFLAWIIGWNLLLELAIGA

SEQ ID NO: 301644 - protein, 20 aa, Mycobacterium
ATFGVGFAMRPLGGLLGGYL

SEQ ID NO: 301645 - protein, 19 aa, Mycobacterium
ATFLVWWAVGAGVQTALLF

SEQ ID NO: 301646 - protein, 17 aa, Mycobacterium
ATFVCLSLVLAVADIPA

SEQ ID NO: 301647 - protein, 17 aa, Mycobacterium
ATFVLDEWLRPVPPGVV

SEQ ID NO: 301648 - protein, 17 aa, Mycobacterium
ATGAGKGSVLWSLIAAL

SEQ ID NO: 301649 - protein, 24 aa, Mycobacterium
ATGAGKGSVLWSLIAGLAPAVKTG

SEQ ID NO: 301650 - protein, 31 aa, Mycobacterium
ATGAQLWSYARRNLDLCGAIGFIDDAVAVYR

SEQ ID NO: 301651 - protein, 30 aa, Mycobacterium
ATGATVFMGYPFFRGALRSIRSGRAGTDTL

SEQ ID NO: 301652 - protein, 23 aa, Mycobacterium
ATGDRFGRRRLFQIGLTVFALGS

SEQ ID NO: 301653 - protein, 24 aa, Mycobacterium
ATGFAMAGLLAWARRRPMLAGVLI

SEQ ID NO: 301654 - protein, 53 aa, Mycobacterium
ATGGGVSWPALLIVLGIIAVLIGILWIWSRRRRAKRRKAEFEAAKRVDPTDPD

SEQ ID NO: 301655 - protein, 17 aa, Mycobacterium
ATGHALRKFLNAQEYVD

SEQ ID NO: 301656 - protein, 18 aa, Mycobacterium
ATGHLRLLVRDGGATVGV

SEQ ID NO: 301657 - protein, 24 aa, Mycobacterium
ATGIALWLPWLIVAGVVFILGSAA

SEQ ID NO: 301658 - protein, 20 aa, Mycobacterium
ATGIAVRYSMVIVMLLVIAY

SEQ ID NO: 301659 - protein, 24 aa, Mycobacterium
ATGLAMAGLLAWARRKPVAAGVLI

SEQ ID NO: 301660 - protein, 32 aa, Mycobacterium
ATGLAMCGLSSWLRAMMLGIMRSYRSDEATIV

SEQ ID NO: 301661 - protein, 27 aa, Mycobacterium
ATGLLGWWRWHHNSWLPTVYAGVIGAL

SEQ ID NO: 301662 - protein, 20 aa, Mycobacterium
ATGLRIGWVLVHKQSPVSTG

SEQ ID NO: 301663 - protein, 20 aa, Mycobacterium
ATGLRRLVFDAVPMQLKLAI

SEQ ID NO: 301664 - protein, 19 aa, Mycobacterium
ATGPGRLAGYIDNNPVPST

SEQ ID NO: 301665 - protein, 26 aa, Mycobacterium
ATGQPGILSLFWEGILLLLQVPGELL

SEQ ID NO: 301666 - protein, 25 aa, Mycobacterium
ATGRGRWALCLVDGSPLRATQSLTE

SEQ ID NO: 301667 - protein, 18 aa, Mycobacterium
ATGSLFWVSDTGVRYGID

SEQ ID NO: 301668 - protein, 23 aa, Mycobacterium
ATGSRIGGWVARRGSRFGKGVLD

SEQ ID NO: 301669 - protein, 23 aa, Mycobacterium
ATGSWWPIAAMLVVYSLITLVSA

SEQ ID NO: 301670 - protein, 23 aa, Mycobacterium
ATGVALWLPWLIVAGVVFVLASA

SEQ ID NO: 301671 - protein, 23 aa, Mycobacterium
ATGYASTCFIRLAERVPPRPSRA

SEQ ID NO: 301672 - protein, 28 aa, Mycobacterium
ATGYPLAFAVCALFPLLALPVVPSEARS

SEQ ID NO: 301673 - protein, 24 aa, Mycobacterium
ATHSELLSGLGLMLNPTSLVPLLL

SEQ ID NO: 301674 - protein, 22 aa, Mycobacterium
ATHYRREIVRLVAEISMGAGTL

SEQ ID NO: 301675 - protein, 18 aa, Mycobacterium
ATHYWLDRHVRPDRTPGR

SEQ ID NO: 301676 - protein, 19 aa, Mycobacterium
ATIALFVIPLWLGADLQSA

SEQ ID NO: 301677 - protein, 24 aa, Mycobacterium
ATICGAVVPALMWTPAAALVSVVV

SEQ ID NO: 301678 - protein, 18 aa, Mycobacterium
ATIFGLGIGPAVLIHEGS

SEQ ID NO: 301679 - protein, 17 aa, Mycobacterium
ATIGVVFSMLARRLLDA

SEQ ID NO: 301680 - protein, 36 aa, Mycobacterium
ATIIRMLLVPSFMRLLGRFNWWAPKPLVTLHERIGF

SEQ ID NO: 301681 - protein, 28 aa, Mycobacterium
ATILHYWPRREGFDRISIAVCVGLVLAF

SEQ ID NO: 301682 - protein, 26 aa, Mycobacterium
ATIMIAKFFLCFAIIQQIVDFTQNIA

SEQ ID NO: 301683 - protein, 17 aa, Mycobacterium
ATINFILVAGVVYFLVV

SEQ ID NO: 301684 - protein, 25 aa, Mycobacterium
ATIPALSRRGKPVIDYAGIVLIGLG

SEQ ID NO: 301685 - protein, 19 aa, Mycobacterium
ATIRMWWQLTVALAVVGIV

SEQ ID NO: 301686 - protein, 19 aa, Mycobacterium
ATISCGVIVALITLATALF

SEQ ID NO: 301687 - protein, 27 aa, Mycobacterium
ATISRRWRPAWIGWWASLAVAAAIAGG

SEQ ID NO: 301688 - protein, 19 aa, Mycobacterium
ATKQRRIRRKKPAETEEAE

SEQ ID NO: 301689 - protein, 26 aa, Mycobacterium
ATKTPPPRLALMLLTALRSGMPPEQI

SEQ ID NO: 301690 - protein, 18 aa, Mycobacterium
ATLAVPSWAVEPVLELGA

SEQ ID NO: 301691 - protein, 19 aa, Mycobacterium
ATLAWCLGMVLVFGTITLR

SEQ ID NO: 301692 - protein, 19 aa, Mycobacterium
ATLDGMFRVAAFIVVGLVL

SEQ ID NO: 301693 - protein, 18 aa, Mycobacterium
ATLDRYNTYAARGEDPDF

SEQ ID NO: 301694 - protein, 17 aa, Mycobacterium
ATLDVATLGRAIVHAAD

SEQ ID NO: 301695 - protein, 18 aa, Mycobacterium
ATLFPRGWGEFFRLNTRR

SEQ ID NO: 301696 - protein, 26 aa, Mycobacterium
ATLGRRLSARFGWLAGNKRPITLLIV

SEQ ID NO: 301697 - protein, 24 aa, Mycobacterium
ATLGVGVMAAFFFWQSVNTREPLI

SEQ ID NO: 301698 - protein, 17 aa, Mycobacterium
ATLIWQHLLITAAVTAI

SEQ ID NO: 301699 - protein, 23 aa, Mycobacterium
ATLLHHWPVLMLLMGISSITMVT

SEQ ID NO: 301700 - protein, 19 aa, Mycobacterium
ATLLLPLLMRLPDTARWYL

SEQ ID NO: 301701 - protein, 24 aa, Mycobacterium
ATLNLPGAWQFSRGEGQLVAVLDT

SEQ ID NO: 301702 - protein, 18 aa, Mycobacterium
ATLNLRAASREALAELVK

SEQ ID NO: 301703 - protein, 18 aa, Mycobacterium
ATLPMLVAMRVLQGVGGA

SEQ ID NO: 301704 - protein, 24 aa, Mycobacterium
ATLPRLRYDQFMALGWKVLIPVSL

SEQ ID NO: 301705 - protein, 21 aa, Mycobacterium
ATLQLPVMIVCGFVLGAAGQV

SEQ ID NO: 301706 - protein, 25 aa, Mycobacterium
ATLRTIRMNMVWAFGYNVAAIPIAA

SEQ ID NO: 301707 - protein, 26 aa, Mycobacterium
ATLRTIRTNMIWAFGYNVAAIPIAAA

SEQ ID NO: 301708 - protein, 27 aa, Mycobacterium
ATLTAICACMAWSAFLFTMSLYLQGQR

SEQ ID NO: 301709 - protein, 18 aa, Mycobacterium
ATLTAVAFDTYFQPGKLP

SEQ ID NO: 301710 - protein, 18 aa, Mycobacterium
ATLTDFVERVGDPVPLVA

SEQ ID NO: 301711 - protein, 21 aa, Mycobacterium
ATLTGMQWVVWLGLLNNVAAA

SEQ ID NO: 301712 - protein, 26 aa, Mycobacterium
ATLVGMPTWFNPILNFGIAASFFAVV

SEQ ID NO: 301713 - protein, 19 aa, Mycobacterium
ATLVSRITGFIKLLLITAA

SEQ ID NO: 301714 - protein, 19 aa, Mycobacterium
ATLWWLVALTQLRGVSPPF

SEQ ID NO: 301715 - protein, 24 aa, Mycobacterium
ATLYVFVSCAAFFVAWPTAAVYLT

SEQ ID NO: 301716 - protein, 25 aa, Mycobacterium
ATMATFAFSPLRVMAQVGTTIALGL

SEQ ID NO: 301717 - protein, 20 aa, Mycobacterium
ATMHVGFSIWTLWSVMVLFM

SEQ ID NO: 301718 - protein, 24 aa, Mycobacterium
ATMLRISAFVSRRAPAADASVDTP

SEQ ID NO: 301719 - protein, 19 aa, Mycobacterium
ATMLYGCYAMFGLSLLASL

SEQ ID NO: 301720 - protein, 17 aa, Mycobacterium
ATMPRRRALTVPPNVSV

SEQ ID NO: 301721 - protein, 19 aa, Mycobacterium
ATMSLCIGAAVLWMALSIW

SEQ ID NO: 301722 - protein, 25 aa, Mycobacterium
ATMSRHFRRVVLVAAVMDGVVDWLR

SEQ ID NO: 301723 - protein, 19 aa, Mycobacterium
ATMVDMYVPLFGQRLAHMT

SEQ ID NO: 301724 - protein, 30 aa, Mycobacterium
ATMYRPATILGCWVTLVAAVALFFTGDAQG

SEQ ID NO: 301725 - protein, 25 aa, Mycobacterium
ATNAEMWEALRIAAADGFVAAHPDG

SEQ ID NO: 301726 - protein, 18 aa, Mycobacterium
ATNPAWPALDLGQVNSQW

SEQ ID NO: 301727 - protein, 17 aa, Mycobacterium
ATNPGLLLPIIAVAIAL

SEQ ID NO: 301728 - protein, 18 aa, Mycobacterium
ATNSYGLMQPPAVEASVV

SEQ ID NO: 301729 - protein, 34 aa, Mycobacterium
ATNVKRPQCPPLRSEHPLGYCLPPTVTLARIYPQ

SEQ ID NO: 301730 - protein, 25 aa, Mycobacterium
ATNVLRARRAAQMIIGVALGIVLGA

SEQ ID NO: 301731 - protein, 25 aa, Mycobacterium
ATPARIREAIKLSGPDIYRNPQPVT

SEQ ID NO: 301732 - protein, 25 aa, Mycobacterium
ATPDGRHVWEYSARGAVDGQALAAL

SEQ ID NO: 301733 - protein, 31 aa, Mycobacterium
ATPFPAFKQGVGLILRLAKPTALSEVTIDVP

SEQ ID NO: 301734 - protein, 23 aa, Mycobacterium
ATPFPSQVFLTLFGLPMADRDRL

SEQ ID NO: 301735 - protein, 28 aa, Mycobacterium
ATPGAPLAERRCMVFAGTTVVAGTALAL

SEQ ID NO: 301736 - protein, 18 aa, Mycobacterium
ATPGFRFIDHTVIGCSLV

SEQ ID NO: 301737 - protein, 21 aa, Mycobacterium
ATPGRGRWIAIALTALVIVAG

SEQ ID NO: 301738 - protein, 34 aa, Mycobacterium
ATPILAVAMPWLFLRLRFFRRKWTVTALAATAAG

SEQ ID NO: 301739 - protein, 24 aa, Mycobacterium
ATPIWELLVTFAIFGAGFAMVNAP

SEQ ID NO: 301740 - protein, 20 aa, Mycobacterium
ATPMTWRILDGVIAVTMIAL

SEQ ID NO: 301741 - protein, 23 aa, Mycobacterium
ATPPLLRLTVIRLPGGRDRMLFT

SEQ ID NO: 301742 - protein, 20 aa, Mycobacterium
ATPPRTPPPLQFPGNGVQVG

SEQ ID NO: 301743 - protein, 25 aa, Mycobacterium
ATPRARLVPAVGLIGCVVLAFTLPP

SEQ ID NO: 301744 - protein, 17 aa, Mycobacterium
ATPRILVAAIIMVIQVV

SEQ ID NO: 301745 - protein, 17 aa, Mycobacterium
ATPRQWLVAAVPVSAAV

SEQ ID NO: 301746 - protein, 22 aa, Mycobacterium
ATPRRRSDVGAWVDERARRPVD

SEQ ID NO: 301747 - protein, 28 aa, Mycobacterium
ATPRTAYYRLPVVYSNYGLRASALPARV

SEQ ID NO: 301748 - protein, 17 aa, Mycobacterium
ATPRVSWQRQPPSESDY

SEQ ID NO: 301749 - protein, 21 aa, Mycobacterium
ATPTRRTWTKGMLPGVFPVPL

SEQ ID NO: 301750 - protein, 17 aa, Mycobacterium
ATPWAAAGLVALPLAAR

SEQ ID NO: 301751 - protein, 18 aa, Mycobacterium
ATPWCAAGLVATPLALRA

SEQ ID NO: 301752 - protein, 20 aa, Mycobacterium
ATPWHHTRHWVAHKKVDRRG

SEQ ID NO: 301753 - protein, 25 aa, Mycobacterium
ATQLRRLPVDFGVGVSAGRVFAGNV

SEQ ID NO: 301754 - protein, 31 aa, Mycobacterium
ATQRRLRDTLLRFGGYPVDAMPTAHIAVFTS

SEQ ID NO: 301755 - protein, 24 aa, Mycobacterium
ATRAKAIGVWAAMVGVGVAVGPIS

SEQ ID NO: 301756 - protein, 17 aa, Mycobacterium
ATRCDKEDILAGNDDPK

SEQ ID NO: 301757 - protein, 30 aa, Mycobacterium
ATRFVACPWGGPGTRMYRTGDLVSWGTDGQ

SEQ ID NO: 301758 - protein, 21 aa, Mycobacterium
ATRIGFPSLLFFLLVGVVLGE

SEQ ID NO: 301759 - protein, 17 aa, Mycobacterium
ATRIMLVLIGFSYFYAR

SEQ ID NO: 301760 - protein, 21 aa, Mycobacterium
ATRLIFPVMMVLSAYFFFAGH

SEQ ID NO: 301761 - protein, 22 aa, Mycobacterium
ATRLKVFSDKFFSEVWDPEKDV

SEQ ID NO: 301762 - protein, 23 aa, Mycobacterium
ATRLRDRLGYVFGPPGWAPRTAG

SEQ ID NO: 301763 - protein, 23 aa, Mycobacterium
ATRLRDRLGYVFGPPGWAPRTTD

SEQ ID NO: 301764 - protein, 25 aa, Mycobacterium
ATRPKLWHVPGVRRRLVVGWLVYTA

SEQ ID NO: 301765 - protein, 18 aa, Mycobacterium
ATRPRLVRLVVSLVAGFL

SEQ ID NO: 301766 - protein, 22 aa, Mycobacterium
ATRPSTFLWLIAVTGTLLVINH

SEQ ID NO: 301767 - protein, 17 aa, Mycobacterium
ATRRYTYGFGRAEDLAG

SEQ ID NO: 301768 - protein, 20 aa, Mycobacterium
ATRSEMIAQLVFAMGGRAAE

SEQ ID NO: 301769 - protein, 25 aa, Mycobacterium
ATRSFAEGLGWLAQIGLFVLLGLLV

SEQ ID NO: 301770 - protein, 18 aa, Mycobacterium
ATRVLALDMYRRGFQANL

SEQ ID NO: 301771 - protein, 20 aa, Mycobacterium
ATRVNRWRLLSGPESNTMTP

SEQ ID NO: 301772 - protein, 20 aa, Mycobacterium
ATRVPARYAAIIGDAGMAAA

SEQ ID NO: 301773 - protein, 19 aa, Mycobacterium
ATRWAHLRGSLKDQLGTRI

SEQ ID NO: 301774 - protein, 20 aa, Mycobacterium
ATRWEVVKTVTLPFGRSGYI

SEQ ID NO: 301775 - protein, 19 aa, Mycobacterium
ATSAGPWFPLVFFVAHVVV

SEQ ID NO: 301776 - protein, 31 aa, Mycobacterium
ATSEQRSGSGWIWWFGGAWLVAAVVGAGVIL

SEQ ID NO: 301777 - protein, 19 aa, Mycobacterium
ATSISMIFGELVPKNFALA

SEQ ID NO: 301778 - protein, 21 aa, Mycobacterium
ATSMVVCYSLWAFERDGAAAS

SEQ ID NO: 301779 - protein, 18 aa, Mycobacterium
ATSPRPQVHLAIGVGARG

SEQ ID NO: 301780 - protein, 17 aa, Mycobacterium
ATSRRSGRVLIGAIVAA

SEQ ID NO: 301781 - protein, 21 aa, Mycobacterium
ATSVACPWPYPEAKVYDPQGY

SEQ ID NO: 301782 - protein, 18 aa, Mycobacterium
ATSVRVGRHIYKQVPQRK

SEQ ID NO: 301783 - protein, 31 aa, Mycobacterium
ATSWQGYAAHQWLAAHGPYLIWLEQAAIDSS

SEQ ID NO: 301784 - protein, 25 aa, Mycobacterium
ATTAGWKLLALLGYAVLYAYVAPWQ

SEQ ID NO: 301785 - protein, 27 aa, Mycobacterium
ATTALPPRWQRWLPRAAALMAGFATLC

SEQ ID NO: 301786 - protein, 20 aa, Mycobacterium
ATTFPWVFLFPAGVLVLIIL

SEQ ID NO: 301787 - protein, 21 aa, Mycobacterium
ATTGDCLMWPEGTPEAATIVD

SEQ ID NO: 301788 - protein, 17 aa, Mycobacterium
ATTIACGVLDFPYRQFV

SEQ ID NO: 301789 - protein, 21 aa, Mycobacterium
ATTICVIGWGKPLSDAVLLGD

SEQ ID NO: 301790 - protein, 29 aa, Mycobacterium
ATTRIAPAHPWWWFLKSTPGKILMLGIAL

SEQ ID NO: 301791 - protein, 18 aa, Mycobacterium
ATTSWVLGSGVPLVGIIL

SEQ ID NO: 301792 - protein, 18 aa, Mycobacterium
ATTVADFLAAQGVARDHI

SEQ ID NO: 301793 - protein, 25 aa, Mycobacterium
ATTVRGARNYPCQEFPGKRAPTIQL

SEQ ID NO: 301794 - protein, 20 aa, Mycobacterium
ATTWPSRLFGFLAHVCADET

SEQ ID NO: 301795 - protein, 19 aa, Mycobacterium
ATVAASFGGAKLQRITGAQ

SEQ ID NO: 301796 - protein, 32 aa, Mycobacterium
ATVAVTFLAMVFSKLAIFASIGPAISISIIIA

SEQ ID NO: 301797 - protein, 17 aa, Mycobacterium
ATVDIRDGLTITVGDPH

SEQ ID NO: 301798 - protein, 22 aa, Mycobacterium
ATVDLRGAIGFSSFGVLIYYAI

SEQ ID NO: 301799 - protein, 19 aa, Mycobacterium
ATVDRAYALITPRGGAVRA

SEQ ID NO: 301800 - protein, 19 aa, Mycobacterium
ATVEYAGAVFPGYKVAVPH

SEQ ID NO: 301801 - protein, 25 aa, Mycobacterium
ATVGELPIIIVILIQIILISLEILF

SEQ ID NO: 301802 - protein, 18 aa, Mycobacterium
ATVGLAIARRDPRRSMLA

SEQ ID NO: 301803 - protein, 19 aa, Mycobacterium
ATVGLWLESLWIGAVYTYP

SEQ ID NO: 301804 - protein, 18 aa, Mycobacterium
ATVIGLLTILGFSIYDTV

SEQ ID NO: 301805 - protein, 23 aa, Mycobacterium
ATVIGLLTILGFSLYDTVIVFDK

SEQ ID NO: 301806 - protein, 24 aa, Mycobacterium
ATVISRLTLVIGIAPILAPSLGAA

SEQ ID NO: 301807 - protein, 20 aa, Mycobacterium
ATVLFLACRWAQAHANLGVW

SEQ ID NO: 301808 - protein, 20 aa, Mycobacterium
ATVMRNRLAAVLLVGVTGYG

SEQ ID NO: 301809 - protein, 33 aa, Mycobacterium
ATVPPGAPLPTFPELPAAVLDQATTSSETTAGT

SEQ ID NO: 301810 - protein, 23 aa, Mycobacterium
ATVPPTPAWRKLLAQFHSPLIYL

SEQ ID NO: 301811 - protein, 25 aa, Mycobacterium
ATVRLCGEVASLVSRLADRPGTGEP

SEQ ID NO: 301812 - protein, 18 aa, Mycobacterium
ATVRPDVVIGLVIGVPGV

SEQ ID NO: 301813 - protein, 17 aa, Mycobacterium
ATVSGLRTLPMVAGMLI

SEQ ID NO: 301814 - protein, 19 aa, Mycobacterium
ATVSRRTALIIALALTVEV

SEQ ID NO: 301815 - protein, 29 aa, Mycobacterium
ATVVAFWIGRPLIRLSFRNEKLNAVFRYA

SEQ ID NO: 301816 - protein, 25 aa, Mycobacterium
ATVVICIAGALLGLLIGGRNEHAEE

SEQ ID NO: 301817 - protein, 19 aa, Mycobacterium
ATVVIGSLVIVLALVAGFV

SEQ ID NO: 301818 - protein, 35 aa, Mycobacterium
ATVVRMILVPAFMYLMGQWNWWAPAPLARLHQRVG

SEQ ID NO: 301819 - protein, 19 aa, Mycobacterium
ATVVTWAGELTRFGVAVVG

SEQ ID NO: 301820 - protein, 27 aa, Mycobacterium
ATVWLVFRRRYAISRIPAAVAVAAVVT

SEQ ID NO: 301821 - protein, 17 aa, Mycobacterium
ATVWPVVVVLALSLVAA

SEQ ID NO: 301822 - protein, 17 aa, Mycobacterium
ATWGLRVYLTWITSTGY

SEQ ID NO: 301823 - protein, 22 aa, Mycobacterium
ATWQVAGSFALYAALAAILGVA

SEQ ID NO: 301824 - protein, 18 aa, Mycobacterium
ATYALAVSFVAVGVVVLV

SEQ ID NO: 301825 - protein, 17 aa, Mycobacterium
ATYIAGVCLVSYLVMAV

SEQ ID NO: 301826 - protein, 27 aa, Mycobacterium
ATYLCYEGAEKVWGWFPGHHGHDPHAT

SEQ ID NO: 301827 - protein, 18 aa, Mycobacterium
ATYLSVAIIGVFYAVSCW

SEQ ID NO: 301828 - protein, 23 aa, Mycobacterium
ATYLWCGPPPLSVRTRQLGVAAV

SEQ ID NO: 301829 - protein, 22 aa, Mycobacterium
ATYRLKRTVFGWHGGRKLTTAT

SEQ ID NO: 301830 - protein, 17 aa, Mycobacterium
ATYRSPVLWLVPLLVVG

SEQ ID NO: 301831 - protein, 17 aa, Mycobacterium
ATYWAVGIVASFYAFSS

SEQ ID NO: 301832 - protein, 28 aa, Mycobacterium
AVAAAFIWQMLQWFGAGYVAHTVKRASA

SEQ ID NO: 301833 - protein, 20 aa, Mycobacterium
AVAAALDYAHGRGLLHRDVK

SEQ ID NO: 301834 - protein, 22 aa, Mycobacterium
AVAAALWVLAWVLGKTWVVVLP

SEQ ID NO: 301835 - protein, 18 aa, Mycobacterium
AVAAARPRHDTVTLLRPS

SEQ ID NO: 301836 - protein, 19 aa, Mycobacterium
AVAACAGIVFVILHALDQA

SEQ ID NO: 301837 - protein, 18 aa, Mycobacterium
AVAAFGFIFTFRDIPTPP

SEQ ID NO: 301838 - protein, 18 aa, Mycobacterium
AVAAFVWMANWRFVAQKT

SEQ ID NO: 301839 - protein, 18 aa, Mycobacterium
AVAAHLLFTVFTAVSAAG

SEQ ID NO: 301840 - protein, 19 aa, Mycobacterium
AVAAMTRRRVRMEAEPGRR

SEQ ID NO: 301841 - protein, 21 aa, Mycobacterium
AVAAPRASLILDRTARDSDGI

SEQ ID NO: 301842 - protein, 26 aa, Mycobacterium
AVAAQWRTEGAIILHVLLDGQVAAAL

SEQ ID NO: 301843 - protein, 24 aa, Mycobacterium
AVAARIGIRITLLLSVVLMMAGVA

SEQ ID NO: 301844 - protein, 27 aa, Mycobacterium
AVACLSFTRLPYFQSLGVPAALGILVA

SEQ ID NO: 301845 - protein, 20 aa, Mycobacterium
AVACQVPIYLMRSSRFTALE

SEQ ID NO: 301846 - protein, 18 aa, Mycobacterium
AVADRFGWWEPFGQGTWG

SEQ ID NO: 301847 - protein, 27 aa, Mycobacterium
AVADRLKFGAWLAFAGLWATFVYFPVA

SEQ ID NO: 301848 - protein, 26 aa, Mycobacterium
AVADRLKFGAWLLFAGLWATFVYFPV

SEQ ID NO: 301849 - protein, 26 aa, Mycobacterium
AVADRLKFGSWLLFAGLWVTVVYFPV

SEQ ID NO: 301850 - protein, 28 aa, Mycobacterium
AVADTRAWLIHEMIIVAAVGISCLALEE

SEQ ID NO: 301851 - protein, 24 aa, Mycobacterium
AVAEAVGLVVLWRLLSRSRQEVEE

SEQ ID NO: 301852 - protein, 19 aa, Mycobacterium
AVAELKAGGATVALLTTSQ

SEQ ID NO: 301853 - protein, 24 aa, Mycobacterium
AVAERMKFGTWLVFGGIWVTLVYF

SEQ ID NO: 301854 - protein, 21 aa, Mycobacterium
AVAFFAVVVLIAFWVAGSPEV

SEQ ID NO: 301855 - protein, 18 aa, Mycobacterium
AVAFWVLGALALVGAIGV

SEQ ID NO: 301856 - protein, 17 aa, Mycobacterium
AVAGFWWFDGYTLVQQR

SEQ ID NO: 301857 - protein, 17 aa, Mycobacterium
AVAGKLGLRGEVLDARQ

SEQ ID NO: 301858 - protein, 17 aa, Mycobacterium
AVAGRFVHMSVRTTVGA

SEQ ID NO: 301859 - protein, 22 aa, Mycobacterium
AVAGSLLFPLGSAALAWQMLRG

SEQ ID NO: 301860 - protein, 22 aa, Mycobacterium
AVAGTRVLQQWGKRSTSTGTAP

SEQ ID NO: 301861 - protein, 18 aa, Mycobacterium
AVAGVILCAAVRPRLRGV

SEQ ID NO: 301862 - protein, 18 aa, Mycobacterium
AVAHLLERPFELLGAPAA

SEQ ID NO: 301863 - protein, 26 aa, Mycobacterium
AVAIALAAYAVWKFRGARGAIQATLD

SEQ ID NO: 301864 - protein, 17 aa, Mycobacterium
AVAIDYSLFILMRFREE

SEQ ID NO: 301865 - protein, 17 aa, Mycobacterium
AVAIGALVVVYTDRPHM

SEQ ID NO: 301866 - protein, 25 aa, Mycobacterium
AVAIMSFLFNHGWWDPARDEQPFLG

SEQ ID NO: 301867 - protein, 18 aa, Mycobacterium
AVAKRFGFENVRSTVDLA

SEQ ID NO: 301868 - protein, 26 aa, Mycobacterium
AVALAVALLAGWAIDCNTLEVLVAVE

SEQ ID NO: 301869 - protein, 23 aa, Mycobacterium
AVALGGVGAWIACRRRGIPLPAF

SEQ ID NO: 301870 - protein, 28 aa, Mycobacterium
AVALGMPAPQLLAVWLFGAFIVATVGVM

SEQ ID NO: 301871 - protein, 25 aa, Mycobacterium
AVALGVAVGMLWPGFGRSVGVLGEI

SEQ ID NO: 301872 - protein, 18 aa, Mycobacterium
AVALLCTAALLTVGGYLT

SEQ ID NO: 301873 - protein, 18 aa, Mycobacterium
AVALMVVVVRFLEPFTVL

SEQ ID NO: 301874 - protein, 23 aa, Mycobacterium
AVALPGVAGLLFLTVGGGMIGYR

SEQ ID NO: 301875 - protein, 20 aa, Mycobacterium
AVALPLTFPSLGEMAEKHPL

SEQ ID NO: 301876 - protein, 26 aa, Mycobacterium
AVALSPRVAMVLARLPLPPVPTQGAP

SEQ ID NO: 301877 - protein, 20 aa, Mycobacterium
AVALVGLLALPGYRTNYNDR

SEQ ID NO: 301878 - protein, 25 aa, Mycobacterium
AVALVLWWRMIRFEYALLVTIATTA

SEQ ID NO: 301879 - protein, 26 aa, Mycobacterium
AVALWSAFRLIWALYIGMTFGWLFGS

SEQ ID NO: 301880 - protein, 19 aa, Mycobacterium
AVAMRRMYDAMAKLSDNTH

SEQ ID NO: 301881 - protein, 19 aa, Mycobacterium
AVAPAKQWGFFILLFLLLP

SEQ ID NO: 301882 - protein, 17 aa, Mycobacterium
AVAQRFGFENVRSTVEL

SEQ ID NO: 301883 - protein, 26 aa, Mycobacterium
AVARGRGRGRWAWPGLAAAGVLLLTE

SEQ ID NO: 301884 - protein, 20 aa, Mycobacterium
AVARLKAPGLVAVYDQGLDR

SEQ ID NO: 301885 - protein, 32 aa, Mycobacterium
AVARPLSWRAALWSVMSVRWAAFALALFLAGL

SEQ ID NO: 301886 - protein, 18 aa, Mycobacterium
AVARRVSRPFPFGTLVVN

SEQ ID NO: 301887 - protein, 18 aa, Mycobacterium
AVASHGWVDHTLVLLLIA

SEQ ID NO: 301888 - protein, 18 aa, Mycobacterium
AVASNDVDFVWITDFQQY

SEQ ID NO: 301889 - protein, 18 aa, Mycobacterium
AVASRSGDIPPGIKVPNP

SEQ ID NO: 301890 - protein, 24 aa, Mycobacterium
AVATCAGFAMAAAVIGARWQLIAF

SEQ ID NO: 301891 - protein, 19 aa, Mycobacterium
AVATCWVAPGISEHDLLAA

SEQ ID NO: 301892 - protein, 22 aa, Mycobacterium
AVATMSPWLFGWFALFCTATAI

SEQ ID NO: 301893 - protein, 19 aa, Mycobacterium
AVATRFGLLDPRRMIKTRG

SEQ ID NO: 301894 - protein, 18 aa, Mycobacterium
AVATRFGLLDPRRMIKVR

SEQ ID NO: 301895 - protein, 19 aa, Mycobacterium
AVAVARLPEKVLLSDVFAG

SEQ ID NO: 301896 - protein, 20 aa, Mycobacterium
AVAVCANNIGVIWVAVEATT

SEQ ID NO: 301897 - protein, 50 aa, Mycobacterium
AVAVIAGALGMWWTLRGGYAEWWQHLSGETSWTLLLGIGQMLMAVLAGAA

SEQ ID NO: 301898 - protein, 18 aa, Mycobacterium
AVAVPWLTELHRLFSGLT

SEQ ID NO: 301899 - protein, 22 aa, Mycobacterium
AVAVSCGERSWTYRELDSAANR

SEQ ID NO: 301900 - protein, 27 aa, Mycobacterium
AVAVVYGLWVARRVHGVSRTWRLLAVG

SEQ ID NO: 301901 - protein, 27 aa, Mycobacterium
AVAWFLRFLVRHSMYWFVGYRIILGSV

SEQ ID NO: 301902 - protein, 19 aa, Mycobacterium
AVAYGRIGTVSARLTSLYV

SEQ ID NO: 301903 - protein, 18 aa, Mycobacterium
AVAYGRVGDVSARLLSLY

SEQ ID NO: 301904 - protein, 18 aa, Mycobacterium
AVAYGRVGDVSVRLLSLY

SEQ ID NO: 301905 - protein, 19 aa, Mycobacterium
AVAYGRVGGVSARLLSLYI

SEQ ID NO: 301906 - protein, 25 aa, Mycobacterium
AVCGARWARTGLRDFDGLYRAAVYG

SEQ ID NO: 301907 - protein, 20 aa, Mycobacterium
AVCGELVIGFALALALHQQR

SEQ ID NO: 301908 - protein, 19 aa, Mycobacterium
AVCGVFVFFILRALGELIL

SEQ ID NO: 301909 - protein, 25 aa, Mycobacterium
AVDAWLRLCQTYGWSPGVMGASSQG

SEQ ID NO: 301910 - protein, 20 aa, Mycobacterium
AVDGREVWNTYGPTEATVVA

SEQ ID NO: 301911 - protein, 24 aa, Mycobacterium
AVDPLRRLAVIAAIAATIASTTWL

SEQ ID NO: 301912 - protein, 29 aa, Mycobacterium
AVDPVFRARLPLIRDLFVVLAYAASATSA

SEQ ID NO: 301913 - protein, 24 aa, Mycobacterium
AVDSRYRASAGLRRQLNKVFPTHW

SEQ ID NO: 301914 - protein, 24 aa, Mycobacterium
AVDSWMCAISGRAKQFGMIQYFKD

SEQ ID NO: 301915 - protein, 24 aa, Mycobacterium
AVDVPKPRLADYFQPGSPPKASEL

SEQ ID NO: 301916 - protein, 17 aa, Mycobacterium
AVEAGLRLSSVGVTCPD

SEQ ID NO: 301917 - protein, 21 aa, Mycobacterium
AVEALARWRAPSGVQIPPQTF

SEQ ID NO: 301918 - protein, 21 aa, Mycobacterium
AVEALARWTAPNGIRVAPETF

SEQ ID NO: 301919 - protein, 21 aa, Mycobacterium
AVEALGRVQTVCFDKTGTLTE

SEQ ID NO: 301920 - protein, 21 aa, Mycobacterium
AVEAMWWIRARMLGVQPRLWR

SEQ ID NO: 301921 - protein, 24 aa, Mycobacterium
AVEAPEFHAAVLAELALIGHRGPA

SEQ ID NO: 301922 - protein, 18 aa, Mycobacterium
AVEAVAGWMRRLGELARR

SEQ ID NO: 301923 - protein, 26 aa, Mycobacterium
AVEHPLWSSFVWRNEVSDTFVETVAA

SEQ ID NO: 301924 - protein, 24 aa, Mycobacterium
AVEIAEAMRGMLQRIWTEQDRTKD

SEQ ID NO: 301925 - protein, 27 aa, Mycobacterium
AVEKPLWSSFVWRNEVADTFVETVAAV

SEQ ID NO: 301926 - protein, 22 aa, Mycobacterium
AVELRNRIKAATGMTLSPTLIF

SEQ ID NO: 301927 - protein, 22 aa, Mycobacterium
AVEMVLLWWLRRLFEAPLPTVG

SEQ ID NO: 301928 - protein, 18 aa, Mycobacterium
AVEPMKTFAETRAQLAAL

SEQ ID NO: 301929 - protein, 26 aa, Mycobacterium
AVERRPSRLGRGWLVGISAALVLVAG

SEQ ID NO: 301930 - protein, 27 aa, Mycobacterium
AVEVEPPFRWGLPLVALVSALLIAAAI

SEQ ID NO: 301931 - protein, 18 aa, Mycobacterium
AVEVVRSAVYFGMNTFIA

SEQ ID NO: 301932 - protein, 22 aa, Mycobacterium
AVFAGLTWWAAFGLDSPSLVVA

SEQ ID NO: 301933 - protein, 21 aa, Mycobacterium
AVFAYRFTRTAALPVVLALAA

SEQ ID NO: 301934 - protein, 20 aa, Mycobacterium
AVFFPEMSSVTGVLLSFGTF

SEQ ID NO: 301935 - protein, 29 aa, Mycobacterium
AVFGRQVLWTAIGLVAFYFALRIRVATLR

SEQ ID NO: 301936 - protein, 17 aa, Mycobacterium
AVFGSAYVPEIASFIAA

SEQ ID NO: 301937 - protein, 19 aa, Mycobacterium
AVFGWCQYRAPSPIVDVRT

SEQ ID NO: 301938 - protein, 24 aa, Mycobacterium
AVFLAGAVGMRLGWSVIAPGDRPR

SEQ ID NO: 301939 - protein, 19 aa, Mycobacterium
AVFLAGAVGMRLGWTVIAP

SEQ ID NO: 301940 - protein, 18 aa, Mycobacterium
AVFLPMRAAITSAPLREP

SEQ ID NO: 301941 - protein, 21 aa, Mycobacterium
AVFRRERLAGLSVGAYVASKI

SEQ ID NO: 301942 - protein, 17 aa, Mycobacterium
AVFRRLLSYSRKDFHPD

SEQ ID NO: 301943 - protein, 18 aa, Mycobacterium
AVFSNPFISTFVDATGLL

SEQ ID NO: 301944 - protein, 18 aa, Mycobacterium
AVFTRLLDRPELRALEAG

SEQ ID NO: 301945 - protein, 24 aa, Mycobacterium
AVGAALWLPWLIAAGVAFVITSVC

SEQ ID NO: 301946 - protein, 19 aa, Mycobacterium
AVGAAMFAAYGRSADTSTV

SEQ ID NO: 301947 - protein, 24 aa, Mycobacterium
AVGADYNLLLALRIKQEAAAGLRT

SEQ ID NO: 301948 - protein, 19 aa, Mycobacterium
AVGAFVRKLPHAGRPRMIA

SEQ ID NO: 301949 - protein, 24 aa, Mycobacterium
AVGAMCIAGAWLYTGGSKPYGYAG

SEQ ID NO: 301950 - protein, 19 aa, Mycobacterium
AVGAPQFYALVLQELSLIG

SEQ ID NO: 301951 - protein, 25 aa, Mycobacterium
AVGARIVAFGRAWMRTATRQGAALI

SEQ ID NO: 301952 - protein, 18 aa, Mycobacterium
AVGAVWTLLKILRPIVKG

SEQ ID NO: 301953 - protein, 26 aa, Mycobacterium
AVGDRYGRRGALLIGLAIFSLASAAP

SEQ ID NO: 301954 - protein, 25 aa, Mycobacterium
AVGEFPTDRGWDLANLFDPDPDAVG

SEQ ID NO: 301955 - protein, 25 aa, Mycobacterium
AVGFLCVIMAWVAPTTVFIFLLNSS

SEQ ID NO: 301956 - protein, 23 aa, Mycobacterium
AVGFPLCYAAYLSVTDYKLTDRE

SEQ ID NO: 301957 - protein, 25 aa, Mycobacterium
AVGGLLSFIFGWIFVEPVINRAIAY

SEQ ID NO: 301958 - protein, 23 aa, Mycobacterium
AVGGPKCLVKVIQKLSGLHVNRF

SEQ ID NO: 301959 - protein, 24 aa, Mycobacterium
AVGHWLHRLELPITVLDAVGLSVF

SEQ ID NO: 301960 - protein, 22 aa, Mycobacterium
AVGIGLWLPWLIFAGVMFVLSS

SEQ ID NO: 301961 - protein, 18 aa, Mycobacterium
AVGLAAITLLAFVVVVQP

SEQ ID NO: 301962 - protein, 20 aa, Mycobacterium
AVGLAFTRLMAAARPARQLR

SEQ ID NO: 301963 - protein, 20 aa, Mycobacterium
AVGLALRFQPFSGDGAMELY

SEQ ID NO: 301964 - protein, 17 aa, Mycobacterium
AVGLAMFAFRYVIPADK

SEQ ID NO: 301965 - protein, 33 aa, Mycobacterium
AVGLIVFALMSWRARPKLAISDDALVYRGWFTA

SEQ ID NO: 301966 - protein, 24 aa, Mycobacterium
AVGLLVGGLWAWVAPAVHAVVAVT

SEQ ID NO: 301967 - protein, 17 aa, Mycobacterium
AVGLPFTPDPAVRPDGD

SEQ ID NO: 301968 - protein, 19 aa, Mycobacterium
AVGLYPGDQVRVLGVPVGQ

SEQ ID NO: 301969 - protein, 32 aa, Mycobacterium
AVGMLPILGWRSEFRWGFLVVGLVGFAVADTA

SEQ ID NO: 301970 - protein, 19 aa, Mycobacterium
AVGPSCRTYDLAMALEVGQ

SEQ ID NO: 301971 - protein, 25 aa, Mycobacterium
AVGPWLLRFAFGPQYHASSALLAWL

SEQ ID NO: 301972 - protein, 18 aa, Mycobacterium
AVGPWRLMVRDLAHLVDT

SEQ ID NO: 301973 - protein, 26 aa, Mycobacterium
AVGQQCARRALPPAAAMVKLLVASAA

SEQ ID NO: 301974 - protein, 21 aa, Mycobacterium
AVGQQCARRPLPPIPALAKLL

SEQ ID NO: 301975 - protein, 27 aa, Mycobacterium
AVGQVWRSPLAWGMAGMFGMTSLVTYS

SEQ ID NO: 301976 - protein, 23 aa, Mycobacterium
AVGRAAVMALVLFVLLVGVTIVQ

SEQ ID NO: 301977 - protein, 23 aa, Mycobacterium
AVGRKLGLPKRMMAILTGESLIN

SEQ ID NO: 301978 - protein, 27 aa, Mycobacterium
AVGRLLRRFSIDELPQFVNVIKQDMSV

SEQ ID NO: 301979 - protein, 28 aa, Mycobacterium
AVGRPPRRGAIRRLPWWAVTAVAVTAVV

SEQ ID NO: 301980 - protein, 17 aa, Mycobacterium
AVGRSMRASLIAIVMVV

SEQ ID NO: 301981 - protein, 17 aa, Mycobacterium
AVGRVLIMALLMLQLVS

SEQ ID NO: 301982 - protein, 17 aa, Mycobacterium
AVGRVLLMALLMLQLVS

SEQ ID NO: 301983 - protein, 20 aa, Mycobacterium
AVGSRMSRRTRLAYWVQAEL

SEQ ID NO: 301984 - protein, 19 aa, Mycobacterium
AVGTWWRYRYDKFGWTTRS

SEQ ID NO: 301985 - protein, 19 aa, Mycobacterium
AVGVALWLPWLLAAGAVFV

SEQ ID NO: 301986 - protein, 24 aa, Mycobacterium
AVGVWKAGMFHTLIAVAVILTMIR

SEQ ID NO: 301987 - protein, 26 aa, Mycobacterium
AVGWRSRRWRTVWLPAAALAGASAAY

SEQ ID NO: 301988 - protein, 29 aa, Mycobacterium
AVGYGTPITIAVPAYWSDAQFTALREEFF

SEQ ID NO: 301989 - protein, 23 aa, Mycobacterium
AVGYRPLARLVRVELPLSIPVLV

SEQ ID NO: 301990 - protein, 17 aa, Mycobacterium
AVHGFYIGYKCQRGLAE

SEQ ID NO: 301991 - protein, 19 aa, Mycobacterium
AVHLACIWIVAFGVNASAY

SEQ ID NO: 301992 - protein, 17 aa, Mycobacterium
AVHLGAVKIDWGALLIV

SEQ ID NO: 301993 - protein, 30 aa, Mycobacterium
AVIADGTWSRLYSDWVPRALPPGWKPGSKT

SEQ ID NO: 301994 - protein, 17 aa, Mycobacterium
AVIAKWLVIGRITAIEH

SEQ ID NO: 301995 - protein, 24 aa, Mycobacterium
AVIASLIGAMLLIKALGLGYTSYT

SEQ ID NO: 301996 - protein, 19 aa, Mycobacterium
AVIASSLFTRPQWIALEKS

SEQ ID NO: 301997 - protein, 23 aa, Mycobacterium
AVIAVGLPVMILAGVATYFNSRA

SEQ ID NO: 301998 - protein, 22 aa, Mycobacterium
AVIAVIVAVHIARRTMRTNRGG

SEQ ID NO: 301999 - protein, 26 aa, Mycobacterium
AVIAVLLLLWARRSLVAAAVVLLTAG

SEQ ID NO: 302000 - protein, 19 aa, Mycobacterium
AVICAAAVFSAIVLRDLRI

SEQ ID NO: 302001 - protein, 23 aa, Mycobacterium
AVICAVAVFSALVLKDLRIPAIG

SEQ ID NO: 302002 - protein, 24 aa, Mycobacterium
AVICAVAVFSALVLRDLRIPAIGV

SEQ ID NO: 302003 - protein, 20 aa, Mycobacterium
AVICQLARDTGWPAIVGQAL

SEQ ID NO: 302004 - protein, 18 aa, Mycobacterium
AVICSMLSPKAKRVGDIF

SEQ ID NO: 302005 - protein, 22 aa, Mycobacterium
AVIFFSATFLGWYSGGHYSWHR

SEQ ID NO: 302006 - protein, 17 aa, Mycobacterium
AVIFIMLLLVYRSPLTV

SEQ ID NO: 302007 - protein, 17 aa, Mycobacterium
AVIFIMLLVVYRSPITV

SEQ ID NO: 302008 - protein, 23 aa, Mycobacterium
AVIGGGLALVFAVLLFPPDPVQI

SEQ ID NO: 302009 - protein, 25 aa, Mycobacterium
AVIGVAVATFAGWTLIAGNPLAGMT

SEQ ID NO: 302010 - protein, 25 aa, Mycobacterium
AVIGVAVATFAGWTLLAGNPVAGMT

SEQ ID NO: 302011 - protein, 30 aa, Mycobacterium
AVIGVRIVWVYGCTYLGRLFTKNHEPPPSH

SEQ ID NO: 302012 - protein, 25 aa, Mycobacterium
AVIGWASGLGFGWLFTLGTANVVRS

SEQ ID NO: 302013 - protein, 18 aa, Mycobacterium
AVIGYYAGVYVWTLPAAR

SEQ ID NO: 302014 - protein, 26 aa, Mycobacterium
AVIIHLARSWSLAVSMVALVLIPVVA

SEQ ID NO: 302015 - protein, 25 aa, Mycobacterium
AVIKAPLKVLGTFLAAIPSEVFGFQ

SEQ ID NO: 302016 - protein, 32 aa, Mycobacterium
AVILCGPGRYGLDARRGWAHRPFIGSFVALLV

SEQ ID NO: 302017 - protein, 17 aa, Mycobacterium
AVILRLGKMETVENKLT

SEQ ID NO: 302018 - protein, 17 aa, Mycobacterium
AVIMIMLLITYRSVSTM

SEQ ID NO: 302019 - protein, 24 aa, Mycobacterium
AVINLVFWATMAAWVLGRPDVVEL

SEQ ID NO: 302020 - protein, 19 aa, Mycobacterium
AVIPQRWRAAWVGWWVSAG

SEQ ID NO: 302021 - protein, 18 aa, Mycobacterium
AVIPVVLMGVAGYAVVSR

SEQ ID NO: 302022 - protein, 26 aa, Mycobacterium
AVIRERPRYVNLVVLLRTTCEILSTV

SEQ ID NO: 302023 - protein, 26 aa, Mycobacterium
AVIRMFRPASVQVLAIWVLVGLLVLV

SEQ ID NO: 302024 - protein, 30 aa, Mycobacterium
AVIRSFRLVRGGFWRVLGIRLLTALVVGLV

SEQ ID NO: 302025 - protein, 17 aa, Mycobacterium
AVISMAILRNFRDHSIV

SEQ ID NO: 302026 - protein, 19 aa, Mycobacterium
AVISMLLVRAAGWRLNRLV

SEQ ID NO: 302027 - protein, 26 aa, Mycobacterium
AVITELLLLPVAWYLTVDSHRPGFGI

SEQ ID NO: 302028 - protein, 19 aa, Mycobacterium
AVITVCFDLIEAVEIGILV

SEQ ID NO: 302029 - protein, 24 aa, Mycobacterium
AVIVALHLVGWITLIALVEPAQLA

SEQ ID NO: 302030 - protein, 18 aa, Mycobacterium
AVIVALVGRNWWLRRRGW

SEQ ID NO: 302031 - protein, 19 aa, Mycobacterium
AVIVGRASLLADWAQHLDP

SEQ ID NO: 302032 - protein, 20 aa, Mycobacterium
AVKVCQRMGMTPSRMLMPLA

SEQ ID NO: 302033 - protein, 20 aa, Mycobacterium
AVLAAGLWAGFLWGVDGRLP

SEQ ID NO: 302034 - protein, 22 aa, Mycobacterium
AVLAARFVTWVAKRVTQRLDLG

SEQ ID NO: 302035 - protein, 21 aa, Mycobacterium
AVLAGLIAGVGLLPRQTPRPA

SEQ ID NO: 302036 - protein, 24 aa, Mycobacterium
AVLAGTAALGWLWKEQRDTEIAGR

SEQ ID NO: 302037 - protein, 17 aa, Mycobacterium
AVLAIGVYGYFGDSQRE

SEQ ID NO: 302038 - protein, 22 aa, Mycobacterium
AVLAIWLRLNLKNDALPARLIS

SEQ ID NO: 302039 - protein, 26 aa, Mycobacterium
AVLALATPVVRSWLFGDADHPGLLGA

SEQ ID NO: 302040 - protein, 26 aa, Mycobacterium
AVLALVMTGGAWQWSTSKNARLNTIN

SEQ ID NO: 302041 - protein, 20 aa, Mycobacterium
AVLARPKLLVLDEATSSVDT

SEQ ID NO: 302042 - protein, 23 aa, Mycobacterium
AVLAVCFVVRVLLDMYLTQRFMM

SEQ ID NO: 302043 - protein, 20 aa, Mycobacterium
AVLAVIWFFLLKRYITEGPL

SEQ ID NO: 302044 - protein, 20 aa, Mycobacterium
AVLAVLAWRALDAADQLGRL

SEQ ID NO: 302045 - protein, 19 aa, Mycobacterium
AVLAVVWFFLLKRYTVEGP

SEQ ID NO: 302046 - protein, 17 aa, Mycobacterium
AVLAWEWLCARSEHSGS

SEQ ID NO: 302047 - protein, 32 aa, Mycobacterium
AVLCGAALVTHCVRRFGGVTGDVIGAAIELTT

SEQ ID NO: 302048 - protein, 23 aa, Mycobacterium
AVLDAALHAWGFAAAADQLALPF

SEQ ID NO: 302049 - protein, 23 aa, Mycobacterium
AVLDAALHAWGFATATDQLMLPF

SEQ ID NO: 302050 - protein, 25 aa, Mycobacterium
AVLERFPQRWRPLIGAGTSTALAGA

SEQ ID NO: 302051 - protein, 19 aa, Mycobacterium
AVLFALTGFIGFEATAVFR

SEQ ID NO: 302052 - protein, 19 aa, Mycobacterium
AVLFLPYSLLGPFAGALMD

SEQ ID NO: 302053 - protein, 24 aa, Mycobacterium
AVLGAEIALGFALTAPIVHATAAM

SEQ ID NO: 302054 - protein, 24 aa, Mycobacterium
AVLGALRTGAWQGPTAEMCAGAYG

SEQ ID NO: 302055 - protein, 20 aa, Mycobacterium
AVLGAVAWAIIAFFRGETVN

SEQ ID NO: 302056 - protein, 18 aa, Mycobacterium
AVLGDFVLNCAWDDHHAD

SEQ ID NO: 302057 - protein, 18 aa, Mycobacterium
AVLGDWVLNHPFEKFNAD

SEQ ID NO: 302058 - protein, 19 aa, Mycobacterium
AVLGFFAFYLSFVAELPPP

SEQ ID NO: 302059 - protein, 22 aa, Mycobacterium
AVLGGAIALWPTRQHVDIPMPF

SEQ ID NO: 302060 - protein, 19 aa, Mycobacterium
AVLGIPMVLAPAFGPVLGG

SEQ ID NO: 302061 - protein, 17 aa, Mycobacterium
AVLGLWLLTRPHYGDPV

SEQ ID NO: 302062 - protein, 20 aa, Mycobacterium
AVLGTFSLRAESMLIDPGLD

SEQ ID NO: 302063 - protein, 25 aa, Mycobacterium
AVLGVAVLTFAGWTLIAANPIAGMT

SEQ ID NO: 302064 - protein, 25 aa, Mycobacterium
AVLHEMRVPWWFLVCQLPISGLVFA

SEQ ID NO: 302065 - protein, 28 aa, Mycobacterium
AVLIGWSAACAFAYLRGFGRRPAWVIAE

SEQ ID NO: 302066 - protein, 26 aa, Mycobacterium
AVLIGWSAACAVAYLRGFGRRPAWVI

SEQ ID NO: 302067 - protein, 26 aa, Mycobacterium
AVLILLRIPIALALALAAVFEAFYLD

SEQ ID NO: 302068 - protein, 21 aa, Mycobacterium
AVLIRLRLKESPTFVTLEKRD

SEQ ID NO: 302069 - protein, 22 aa, Mycobacterium
AVLIVRPSLRWLNAGRRPTPDE

SEQ ID NO: 302070 - protein, 23 aa, Mycobacterium
AVLKHRYFRRLNIAAADLGRLHL

SEQ ID NO: 302071 - protein, 17 aa, Mycobacterium
AVLLAYCAVAGALDVNL

SEQ ID NO: 302072 - protein, 29 aa, Mycobacterium
AVLLFCIAFGLSMDYEVFLIARIREYWSQ

SEQ ID NO: 302073 - protein, 20 aa, Mycobacterium
AVLLGAIGVALGWRPPLAGL

SEQ ID NO: 302074 - protein, 17 aa, Mycobacterium
AVLLIAGAGFMTVMVLA

SEQ ID NO: 302075 - protein, 25 aa, Mycobacterium
AVLLIWQAGSAWGLIDPDILPAPST

SEQ ID NO: 302076 - protein, 26 aa, Mycobacterium
AVLLLRLSALRDLRVENAWVYGHGVA

SEQ ID NO: 302077 - protein, 23 aa, Mycobacterium
AVLLRPRLPRVLAAITLGVLSLG

SEQ ID NO: 302078 - protein, 25 aa, Mycobacterium
AVLLVLAACLGFIYGPVAPIANFVM

SEQ ID NO: 302079 - protein, 20 aa, Mycobacterium
AVLLVRIARRAVRTRGGADF

SEQ ID NO: 302080 - protein, 19 aa, Mycobacterium
AVLLVWRRDLRSIVRLLAA

SEQ ID NO: 302081 - protein, 23 aa, Mycobacterium
AVLMLVGLWLRRAITESPEFAAA

SEQ ID NO: 302082 - protein, 20 aa, Mycobacterium
AVLMLYTILIIRGLRTAIAI

SEQ ID NO: 302083 - protein, 19 aa, Mycobacterium
AVLPVAAVFLIWDEVAVAA

SEQ ID NO: 302084 - protein, 18 aa, Mycobacterium
AVLPWILVLVRRRTNGTD

SEQ ID NO: 302085 - protein, 19 aa, Mycobacterium
AVLPWKIWGNEAAIVYFLG

SEQ ID NO: 302086 - protein, 20 aa, Mycobacterium
AVLPWLCLQLVMIPTVAGIY

SEQ ID NO: 302087 - protein, 23 aa, Mycobacterium
AVLQHWVDAAVLFAAVLINVVIA

SEQ ID NO: 302088 - protein, 24 aa, Mycobacterium
AVLQLLLCVGVDGFFAISGFLITA

SEQ ID NO: 302089 - protein, 31 aa, Mycobacterium
AVLRAGAAYLPLELDLPIDRLRTIIDNAEPV

SEQ ID NO: 302090 - protein, 22 aa, Mycobacterium
AVLRAGAAYLPLELDYPDERLA

SEQ ID NO: 302091 - protein, 26 aa, Mycobacterium
AVLRAPEFYPWLLAALAGMIFQQSAF

SEQ ID NO: 302092 - protein, 18 aa, Mycobacterium
AVLRECHGAFAFLLFAAF

SEQ ID NO: 302093 - protein, 18 aa, Mycobacterium
AVLRSAWYRLPDRDQAGP

SEQ ID NO: 302094 - protein, 18 aa, Mycobacterium
AVLRVWPVPVVMVAPVVV

SEQ ID NO: 302095 - protein, 24 aa, Mycobacterium
AVLSGRGFIAQGLMFVNQTAVSSV

SEQ ID NO: 302096 - protein, 18 aa, Mycobacterium
AVLSHRFALSPSRAVPIG

SEQ ID NO: 302097 - protein, 18 aa, Mycobacterium
AVLSIGLIRVHPLLAVGL

SEQ ID NO: 302098 - protein, 19 aa, Mycobacterium
AVLSRRGDPARGRERAALV

SEQ ID NO: 302099 - protein, 17 aa, Mycobacterium
AVLSVLSFYAFYSGLGI

SEQ ID NO: 302100 - protein, 22 aa, Mycobacterium
AVLTGLQWVVWLAVANNIAAEF

SEQ ID NO: 302101 - protein, 26 aa, Mycobacterium
AVLTRSSPRLLPWAVASIAAVLGLPL

SEQ ID NO: 302102 - protein, 20 aa, Mycobacterium
AVLVAAWLLSIPMQSSNQPN

SEQ ID NO: 302103 - protein, 21 aa, Mycobacterium
AVLVAGRWLLRDARAARLATV

SEQ ID NO: 302104 - protein, 21 aa, Mycobacterium
AVLVCLYPVLAPAIGAAGGGY

SEQ ID NO: 302105 - protein, 25 aa, Mycobacterium
AVLVGYCAGWLPWFADIDRQMYFFY

SEQ ID NO: 302106 - protein, 27 aa, Mycobacterium
AVLVLGWRGARSWRRGAGLLAVPLCAL

SEQ ID NO: 302107 - protein, 19 aa, Mycobacterium
AVLVPLLIARAIDLDAEAL

SEQ ID NO: 302108 - protein, 22 aa, Mycobacterium
AVLVRGLIRAMVCQLAVLHPPD

SEQ ID NO: 302109 - protein, 29 aa, Mycobacterium
AVLVRRLPGWPIWVAAVWAVQEWAKSNVP

SEQ ID NO: 302110 - protein, 18 aa, Mycobacterium
AVLVTAVLGWRRRNALLM

SEQ ID NO: 302111 - protein, 18 aa, Mycobacterium
AVLVTGVLAWRRRNTALA

SEQ ID NO: 302112 - protein, 23 aa, Mycobacterium
AVLVTLAGRRLWHRFRGQPDRAD

SEQ ID NO: 302113 - protein, 20 aa, Mycobacterium
AVLVTLIAWRLRQLDPQRKA

SEQ ID NO: 302114 - protein, 24 aa, Mycobacterium
AVLVVCTRGAMGLAGEAITDLAGA

SEQ ID NO: 302115 - protein, 17 aa, Mycobacterium
AVLVYLFIVDWRVALVL

SEQ ID NO: 302116 - protein, 17 aa, Mycobacterium
AVLVYLFVVDWRLALVM

SEQ ID NO: 302117 - protein, 17 aa, Mycobacterium
AVLVYLFVVDWRVALVL

SEQ ID NO: 302118 - protein, 17 aa, Mycobacterium
AVLWMLADSDRRWERDT

SEQ ID NO: 302119 - protein, 23 aa, Mycobacterium
AVLWRIHLASALLMVPQTVVLTF

SEQ ID NO: 302120 - protein, 23 aa, Mycobacterium
AVLWTCPSALAIEAPKVDPGVPP

SEQ ID NO: 302121 - protein, 25 aa, Mycobacterium
AVLYGRVSYEYVPKIILGTSLSGIA

SEQ ID NO: 302122 - protein, 19 aa, Mycobacterium
AVMAVFPMYFLKSSAYTIV

SEQ ID NO: 302123 - protein, 17 aa, Mycobacterium
AVMCHRLVVLIGVGLIV

SEQ ID NO: 302124 - protein, 26 aa, Mycobacterium
AVMDSFYLPLLVRRRITFLAKAEYFT

SEQ ID NO: 302125 - protein, 28 aa, Mycobacterium
AVMDSFYLPLVVRRRITFLAKAEYFTGT

SEQ ID NO: 302126 - protein, 20 aa, Mycobacterium
AVMDSFYLPLVVSRRITFLA

SEQ ID NO: 302127 - protein, 18 aa, Mycobacterium
AVMGDFALNCTWDDHGAD

SEQ ID NO: 302128 - protein, 18 aa, Mycobacterium
AVMGLCFAAAVEAGGAVT

SEQ ID NO: 302129 - protein, 17 aa, Mycobacterium
AVMGTFGVFFGMLVVYK

SEQ ID NO: 302130 - protein, 19 aa, Mycobacterium
AVMHRFIPRYSPWPRHARA

SEQ ID NO: 302131 - protein, 24 aa, Mycobacterium
AVMIPTLLLLIAVTLVYSLAHDPD

SEQ ID NO: 302132 - protein, 31 aa, Mycobacterium
AVMPHDAFLLWGWRVPFILSVVMLGVAVYVR

SEQ ID NO: 302133 - protein, 19 aa, Mycobacterium
AVMSPWFGLAVSRSRIPAS

SEQ ID NO: 302134 - protein, 17 aa, Mycobacterium
AVMSRFSPEEAQLTLID

SEQ ID NO: 302135 - protein, 18 aa, Mycobacterium
AVMTKLRAVLLIVGGVGV

SEQ ID NO: 302136 - protein, 23 aa, Mycobacterium
AVMTTLMALAFWLSGVGVAAAHT

SEQ ID NO: 302137 - protein, 18 aa, Mycobacterium
AVMVLDGFYLGRKVNRMV

SEQ ID NO: 302138 - protein, 22 aa, Mycobacterium
AVNEADYARMWVQAATTMTTYQ

SEQ ID NO: 302139 - protein, 20 aa, Mycobacterium
AVNLSKDWARAVVDIPVPTS

SEQ ID NO: 302140 - protein, 17 aa, Mycobacterium
AVNRLAPTLAQFSDALS

SEQ ID NO: 302141 - protein, 18 aa, Mycobacterium
AVNRWQRAQMRRWRDGEA

SEQ ID NO: 302142 - protein, 29 aa, Mycobacterium
AVPAEIRADFWFSALGAMASWSVLGVLLS

SEQ ID NO: 302143 - protein, 27 aa, Mycobacterium
AVPAIMGLLGRWFWWSPPPFLRASLAG

SEQ ID NO: 302144 - protein, 26 aa, Mycobacterium
AVPALRDDWRPVLWAIAILTMVVGTV

SEQ ID NO: 302145 - protein, 24 aa, Mycobacterium
AVPAPWAMLAMLPRGPELSSAAAS

SEQ ID NO: 302146 - protein, 23 aa, Mycobacterium
AVPDARLTFVLADAGPVVAVTTT

SEQ ID NO: 302147 - protein, 22 aa, Mycobacterium
AVPDPRIDRSRIKMTMEKVDGR

SEQ ID NO: 302148 - protein, 17 aa, Mycobacterium
AVPEPLAATGLLHHDGS

SEQ ID NO: 302149 - protein, 26 aa, Mycobacterium
AVPFCALCAALGLNIWVGYFPTVQAA

SEQ ID NO: 302150 - protein, 17 aa, Mycobacterium
AVPFIWSSPLWFPVLVG

SEQ ID NO: 302151 - protein, 21 aa, Mycobacterium
AVPGFAWWAAALNSLPMLAAL

SEQ ID NO: 302152 - protein, 18 aa, Mycobacterium
AVPGRFGPAQVMLAAAGV

SEQ ID NO: 302153 - protein, 20 aa, Mycobacterium
AVPIVVFWVGLVAVLVMFVP

SEQ ID NO: 302154 - protein, 24 aa, Mycobacterium
AVPKVGQCFSEFEVRMGSLKSPSD

SEQ ID NO: 302155 - protein, 24 aa, Mycobacterium
AVPLCLLSAALVLNLWVGYFPTVQ

SEQ ID NO: 302156 - protein, 23 aa, Mycobacterium
AVPLGGFCDIAGMTAVEELDPAD

SEQ ID NO: 302157 - protein, 22 aa, Mycobacterium
AVPLPEVLMRIAAGSSDTLAGR

SEQ ID NO: 302158 - protein, 19 aa, Mycobacterium
AVPRISRAQSLDVLSSMAN

SEQ ID NO: 302159 - protein, 20 aa, Mycobacterium
AVPTALAGIYGMNFDNMPEL

SEQ ID NO: 302160 - protein, 21 aa, Mycobacterium
AVPVEGRINLLRKVLDSATGS

SEQ ID NO: 302161 - protein, 23 aa, Mycobacterium
AVPVPGRTSATWPAQHSGPTGRP

SEQ ID NO: 302162 - protein, 24 aa, Mycobacterium
AVPVSFAALVWVFGGLLAAALPVA

SEQ ID NO: 302163 - protein, 18 aa, Mycobacterium
AVQAQPGTHDWPFATQAF

SEQ ID NO: 302164 - protein, 21 aa, Mycobacterium
AVQCKRYGKSVGVAAVQQVVS

SEQ ID NO: 302165 - protein, 26 aa, Mycobacterium
AVQDLSRLSGAYGQLLAWTRVLGAVL

SEQ ID NO: 302166 - protein, 27 aa, Mycobacterium
AVQGLGWLRRHTRTIQIFGGVLLILVG

SEQ ID NO: 302167 - protein, 20 aa, Mycobacterium
AVQRRLRRAILQAYDEHGIA

SEQ ID NO: 302168 - protein, 24 aa, Mycobacterium
AVRAPTWFRRASVTLGGFGLVCLI

SEQ ID NO: 302169 - protein, 24 aa, Mycobacterium
AVRAYPRTASVVIWYSPAQCDTAA

SEQ ID NO: 302170 - protein, 25 aa, Mycobacterium
AVREAGLGRVFRGIIPFIVADLVVV

SEQ ID NO: 302171 - protein, 23 aa, Mycobacterium
AVRGARNLPCVDVPGKRAATPRE

SEQ ID NO: 302172 - protein, 18 aa, Mycobacterium
AVRGELFFASSNDLVYQF

SEQ ID NO: 302173 - protein, 25 aa, Mycobacterium
AVRGNWIAAVGMGIAVLATLIKVSE

SEQ ID NO: 302174 - protein, 24 aa, Mycobacterium
AVRGWPLRVLAGLLAVASLAVGYL

SEQ ID NO: 302175 - protein, 19 aa, Mycobacterium
AVRLLRPLILLPLVLPPVV

SEQ ID NO: 302176 - protein, 23 aa, Mycobacterium
AVRLPDYMLPAAIVAVESLPLTV

SEQ ID NO: 302177 - protein, 24 aa, Mycobacterium
AVRNLPGWPLWFAAAWSATEWGKA

SEQ ID NO: 302178 - protein, 34 aa, Mycobacterium
AVRNSLRTGLGLALAVTVTHVFPVEHGFWVVLGA

SEQ ID NO: 302179 - protein, 23 aa, Mycobacterium
AVRPVGGPVWVAWRESALTRAYE

SEQ ID NO: 302180 - protein, 17 aa, Mycobacterium
AVRRRLGARGATTGSPV

SEQ ID NO: 302181 - protein, 18 aa, Mycobacterium
AVRRTVMTAGRTVTFSAV

SEQ ID NO: 302182 - protein, 19 aa, Mycobacterium
AVRSLHAALVVRLATSVAE

SEQ ID NO: 302183 - protein, 18 aa, Mycobacterium
AVRSVTWTAAPGGGIAAD

SEQ ID NO: 302184 - protein, 20 aa, Mycobacterium
AVRTAAEWAPATLLIVAALT

SEQ ID NO: 302185 - protein, 18 aa, Mycobacterium
AVRTLRVGIGRGLFTPPG

SEQ ID NO: 302186 - protein, 19 aa, Mycobacterium
AVRYYRKEMLRLIAEIGMG

SEQ ID NO: 302187 - protein, 18 aa, Mycobacterium
AVSAALWIGYLIGHRRGS

SEQ ID NO: 302188 - protein, 19 aa, Mycobacterium
AVSAGGWAAVTLAACLQAF

SEQ ID NO: 302189 - protein, 18 aa, Mycobacterium
AVSAGWYLALVALWPAGS

SEQ ID NO: 302190 - protein, 25 aa, Mycobacterium
AVSAVLCPLLVYGWLGFPRLELAGS

SEQ ID NO: 302191 - protein, 28 aa, Mycobacterium
AVSDPHRAHWEWLKWLPHNQHPGDSDAA

SEQ ID NO: 302192 - protein, 27 aa, Mycobacterium
AVSDRLKFGAWLVFAGLWATFVYFPVA

SEQ ID NO: 302193 - protein, 18 aa, Mycobacterium
AVSEFPSDRGWDIDAMFD

SEQ ID NO: 302194 - protein, 25 aa, Mycobacterium
AVSFQRARESLTLAGITPSDRVLTN

SEQ ID NO: 302195 - protein, 24 aa, Mycobacterium
AVSGSITQPVKFYGVGFATASNQT

SEQ ID NO: 302196 - protein, 17 aa, Mycobacterium
AVSHAFHSPLMEPMLEE

SEQ ID NO: 302197 - protein, 26 aa, Mycobacterium
AVSHAGSLITWWTGDSVLVFETGNLS

SEQ ID NO: 302198 - protein, 22 aa, Mycobacterium
AVSHPGIPFVLLIVIAATAGVG

SEQ ID NO: 302199 - protein, 19 aa, Mycobacterium
AVSIGLRLVFGEMTLTAGL

SEQ ID NO: 302200 - protein, 25 aa, Mycobacterium
AVSIVRRKWSLARRSLLALLVGFPV

SEQ ID NO: 302201 - protein, 25 aa, Mycobacterium
AVSKARWSHAFPREGADAGGGDDAD

SEQ ID NO: 302202 - protein, 24 aa, Mycobacterium
AVSKTATMPPLWVIVSCAVAMAGG

SEQ ID NO: 302203 - protein, 20 aa, Mycobacterium
AVSLARAALRILSESSPRHI

SEQ ID NO: 302204 - protein, 60 aa, Mycobacterium
AVSLLPAILVLIGRRGWIKPRRDLTHRFWRRTGTRIVRRPRIHLVASLVVLAILAGSSFL

SEQ ID NO: 302205 - protein, 31 aa, Mycobacterium
AVSSCIALITVLRARAFRDRRHAITLVVGAA

SEQ ID NO: 302206 - protein, 30 aa, Mycobacterium
AVSSWSEKWQIPALVLGWLIAVLIRLATGS

SEQ ID NO: 302207 - protein, 19 aa, Mycobacterium
AVSTSLAWAGRLTPPGTFR

SEQ ID NO: 302208 - protein, 22 aa, Mycobacterium
AVSVRPEWTRTVLARRVVAGVL

SEQ ID NO: 302209 - protein, 23 aa, Mycobacterium
AVSVWRTRWARRPFYPTFVPVVS

SEQ ID NO: 302210 - protein, 24 aa, Mycobacterium
AVSYWQPRCPVHVIPHGAEPGVRG

SEQ ID NO: 302211 - protein, 23 aa, Mycobacterium
AVTAGSLVVHWATMDQLYSVTND

SEQ ID NO: 302212 - protein, 35 aa, Mycobacterium
AVTALAVLLGYRLLPRLLRSLAVLIGMIAGTVIAA

SEQ ID NO: 302213 - protein, 17 aa, Mycobacterium
AVTALGISLLMGLVAVH

SEQ ID NO: 302214 - protein, 18 aa, Mycobacterium
AVTARLPESERILGQLRT

SEQ ID NO: 302215 - protein, 17 aa, Mycobacterium
AVTARVVPSNVFAVSSV

SEQ ID NO: 302216 - protein, 18 aa, Mycobacterium
AVTARVVPSNVFAVSSVQ

SEQ ID NO: 302217 - protein, 18 aa, Mycobacterium
AVTATLLTAWAFSGSLIT

SEQ ID NO: 302218 - protein, 23 aa, Mycobacterium
AVTAVLALLAWRAIDGAQDRLGG

SEQ ID NO: 302219 - protein, 24 aa, Mycobacterium
AVTEGIFTLIARASCVDLDGDKHC

SEQ ID NO: 302220 - protein, 17 aa, Mycobacterium
AVTEVFSGLRWVALVAL

SEQ ID NO: 302221 - protein, 18 aa, Mycobacterium
AVTFRLGSGATMAGASLS

SEQ ID NO: 302222 - protein, 25 aa, Mycobacterium
AVTGNLWSTIGFHWAFQITAQFLGP

SEQ ID NO: 302223 - protein, 24 aa, Mycobacterium
AVTGTIQWPALVMFLIIFFWTPPH

SEQ ID NO: 302224 - protein, 17 aa, Mycobacterium
AVTIAIWNPYVAERLLQ

SEQ ID NO: 302225 - protein, 20 aa, Mycobacterium
AVTIRSWEPLAFTAVDIAVL

SEQ ID NO: 302226 - protein, 30 aa, Mycobacterium
AVTLLPAILVLAGRRGWVKPRRELTTRFWR

SEQ ID NO: 302227 - protein, 22 aa, Mycobacterium
AVTMCAIGTWAAFSLDTTVTYS

SEQ ID NO: 302228 - protein, 18 aa, Mycobacterium
AVTNLAWTFDKNVELDYH

SEQ ID NO: 302229 - protein, 27 aa, Mycobacterium
AVTPKGWRGVLRGDFRKAGLAVPLRVG

SEQ ID NO: 302230 - protein, 23 aa, Mycobacterium
AVTPVLWWIGPFLLYLLLPALDV

SEQ ID NO: 302231 - protein, 23 aa, Mycobacterium
AVTRPGDRIFAGLATGSGVFVVA

SEQ ID NO: 302232 - protein, 20 aa, Mycobacterium
AVTRSGWWTHSLRGVLPEQF

SEQ ID NO: 302233 - protein, 21 aa, Mycobacterium
AVTSFAWREHVVMQRAKGHEL

SEQ ID NO: 302234 - protein, 20 aa, Mycobacterium
AVTTSWRPILQIIGLVVIHN

SEQ ID NO: 302235 - protein, 20 aa, Mycobacterium
AVTTTLRWFAGRIPAFGTER

SEQ ID NO: 302236 - protein, 17 aa, Mycobacterium
AVTVGWFLPLLGLTLAA

SEQ ID NO: 302237 - protein, 24 aa, Mycobacterium
AVTVPTYLKNDWFRDWGALQRLIP

SEQ ID NO: 302238 - protein, 17 aa, Mycobacterium
AVTYRYYLVFVLAVAAL

SEQ ID NO: 302239 - protein, 18 aa, Mycobacterium
AVVAACRRSVPAAAGSTL

SEQ ID NO: 302240 - protein, 24 aa, Mycobacterium
AVVAAVGCVVSWVASRATVEVAPV

SEQ ID NO: 302241 - protein, 27 aa, Mycobacterium
AVVAEIRWAFTPPRTWLMGVVANVVVA

SEQ ID NO: 302242 - protein, 24 aa, Mycobacterium
AVVAFGSGLAWLVASLALSEATSW

SEQ ID NO: 302243 - protein, 25 aa, Mycobacterium
AVVAGGLALARYVPLARGPIVWWVE

SEQ ID NO: 302244 - protein, 36 aa, Mycobacterium
AVVAGLCWLSFSWPGRRAMAAFVVWADVALAVGAAL

SEQ ID NO: 302245 - protein, 17 aa, Mycobacterium
AVVAGLVAAVFGGSHVQ

SEQ ID NO: 302246 - protein, 20 aa, Mycobacterium
AVVALRLGRCLAGLRTRSHE

SEQ ID NO: 302247 - protein, 25 aa, Mycobacterium
AVVALRLGRCLARLRTRSHEHAHAA

SEQ ID NO: 302248 - protein, 22 aa, Mycobacterium
AVVAPVQWVAVLALGAGCLVGS

SEQ ID NO: 302249 - protein, 21 aa, Mycobacterium
AVVAQRLVALVGLAGLGIANQ

SEQ ID NO: 302250 - protein, 24 aa, Mycobacterium
AVVARLATYILMYLVLRSESDLTG

SEQ ID NO: 302251 - protein, 35 aa, Mycobacterium
AVVARPYRWWRLGLVIACGLAYVAIFSLPLAQRKF

SEQ ID NO: 302252 - protein, 25 aa, Mycobacterium
AVVATRAPRRWTARNTLLGIEQQSA

SEQ ID NO: 302253 - protein, 24 aa, Mycobacterium
AVVAVVLAGLFWSGHRADTDELRY

SEQ ID NO: 302254 - protein, 17 aa, Mycobacterium
AVVAVVWLLAVSRGPVP

SEQ ID NO: 302255 - protein, 18 aa, Mycobacterium
AVVAYCVVFLVLVAVLVI

SEQ ID NO: 302256 - protein, 24 aa, Mycobacterium
AVVCAGVGVATEFALQRFLMNQLD

SEQ ID NO: 302257 - protein, 24 aa, Mycobacterium
AVVCALTLTVAGPVRTYFSQQAEK

SEQ ID NO: 302258 - protein, 19 aa, Mycobacterium
AVVCAVSAVLCLAAVIDPP

SEQ ID NO: 302259 - protein, 20 aa, Mycobacterium
AVVCVLTLTIAGPVRTYFAQ

SEQ ID NO: 302260 - protein, 26 aa, Mycobacterium
AVVDPSWFAGLIVAWLWLTVIFANLA

SEQ ID NO: 302261 - protein, 25 aa, Mycobacterium
AVVFAMSVVIGWPLVGVIWHGLTGG

SEQ ID NO: 302262 - protein, 24 aa, Mycobacterium
AVVFPFELDRVVSLSGNRLVATHY

SEQ ID NO: 302263 - protein, 22 aa, Mycobacterium
AVVGAAWAWVAPPIKGVIALTR

SEQ ID NO: 302264 - protein, 17 aa, Mycobacterium
AVVGFVMAFQATREANR

SEQ ID NO: 302265 - protein, 17 aa, Mycobacterium
AVVGLGMATGPLAGGYV

SEQ ID NO: 302266 - protein, 25 aa, Mycobacterium
AVVGPRIAVGLALVGLIAFVIVVQP

SEQ ID NO: 302267 - protein, 18 aa, Mycobacterium
AVVGVQLLFSLLFTPAIR

SEQ ID NO: 302268 - protein, 64 aa, Mycobacterium
AVVHPTFLYELIWNIAVFGFLIWVDRKFRIGHGRLFALYVASYCVGRFWVELMRSDTATEFAGI

SEQ ID NO: 302269 - protein, 20 aa, Mycobacterium
AVVICAAVILWVGDHQGVAG

SEQ ID NO: 302270 - protein, 18 aa, Mycobacterium
AVVIGVVWTWFRGQGGDA

SEQ ID NO: 302271 - protein, 24 aa, Mycobacterium
AVVIRLSRALGRMRTHTFAHADAV

SEQ ID NO: 302272 - protein, 24 aa, Mycobacterium
AVVKDIDEGAGWDLLIVGISAMCL

SEQ ID NO: 302273 - protein, 25 aa, Mycobacterium
AVVLAFRGAGAWALVSQLVIAEAIS

SEQ ID NO: 302274 - protein, 27 aa, Mycobacterium
AVVLAGAGYEGWLLFQHHQKDVAAAQA

SEQ ID NO: 302275 - protein, 18 aa, Mycobacterium
AVVLAGILTPAALVVMAA

SEQ ID NO: 302276 - protein, 30 aa, Mycobacterium
AVVLGARFYLRTGPFALFGKHYRDLAPVGI

SEQ ID NO: 302277 - protein, 18 aa, Mycobacterium
AVVLLVRPLWLLLTQSLP

SEQ ID NO: 302278 - protein, 17 aa, Mycobacterium
AVVMLLSAVVGRRRTVH

SEQ ID NO: 302279 - protein, 20 aa, Mycobacterium
AVVMVCFHLGILVSIPMGVP

SEQ ID NO: 302280 - protein, 19 aa, Mycobacterium
AVVNARAGTMLTAQLRRQS

SEQ ID NO: 302281 - protein, 22 aa, Mycobacterium
AVVNLGWPWWAAVLVAIACGAV

SEQ ID NO: 302282 - protein, 26 aa, Mycobacterium
AVVPARSLLGLAVGWFVGALVVLVSG

SEQ ID NO: 302283 - protein, 26 aa, Mycobacterium
AVVPARSLLGLAVGWFVGALVVWVVG

SEQ ID NO: 302284 - protein, 27 aa, Mycobacterium
AVVPEIPRWEFVVLVGTAAVILVVVGL

SEQ ID NO: 302285 - protein, 17 aa, Mycobacterium
AVVPFALFAARFKGAPS

SEQ ID NO: 302286 - protein, 17 aa, Mycobacterium
AVVPLRNILPGSPPAGS

SEQ ID NO: 302287 - protein, 20 aa, Mycobacterium
AVVPQPGKHDWPFADQAFVR

SEQ ID NO: 302288 - protein, 25 aa, Mycobacterium
AVVPQPGRHDWPFADQVFARALPWL

SEQ ID NO: 302289 - protein, 25 aa, Mycobacterium
AVVPQPGRHDWPFADRVFAAALPWL

SEQ ID NO: 302290 - protein, 28 aa, Mycobacterium
AVVPTHWQEWMPAGLFFAAVAVFQLCWA

SEQ ID NO: 302291 - protein, 26 aa, Mycobacterium
AVVPVPIPLFPPVWEPPRRQENPWWP

SEQ ID NO: 302292 - protein, 28 aa, Mycobacterium
AVVQPFRFLFMAFLWTIALTFEAGYYLV

SEQ ID NO: 302293 - protein, 17 aa, Mycobacterium
AVVREIFAPHSHDAADS

SEQ ID NO: 302294 - protein, 24 aa, Mycobacterium
AVVRGARNYPCQEFPGKRAPTVQL

SEQ ID NO: 302295 - protein, 24 aa, Mycobacterium
AVVSGCSLALFAVLTKAVVEVVGG

SEQ ID NO: 302296 - protein, 24 aa, Mycobacterium
AVVSQPGRHDWPFAAGAFAAALPW

SEQ ID NO: 302297 - protein, 18 aa, Mycobacterium
AVVSRPGNHDWPFASTAF

SEQ ID NO: 302298 - protein, 22 aa, Mycobacterium
AVVSVFLLRRVVGVRQLVTALG

SEQ ID NO: 302299 - protein, 17 aa, Mycobacterium
AVVSWAAFLSWINLHGT

SEQ ID NO: 302300 - protein, 17 aa, Mycobacterium
AVVTLCLELFGFSEHTP

SEQ ID NO: 302301 - protein, 19 aa, Mycobacterium
AVVTLMVWVMALNQPIDVQ

SEQ ID NO: 302302 - protein, 31 aa, Mycobacterium
AVVTSNELIAWVCIGASVLGVVLLIVDALRE

SEQ ID NO: 302303 - protein, 19 aa, Mycobacterium
AVVTVCFDLIEAVQIGILV

SEQ ID NO: 302304 - protein, 19 aa, Mycobacterium
AVVVAGVVIWVAMRDRRRG

SEQ ID NO: 302305 - protein, 17 aa, Mycobacterium
AVVVGRESLLADWSQHL

SEQ ID NO: 302306 - protein, 18 aa, Mycobacterium
AVVVPFAAGLSVLGTVPM

SEQ ID NO: 302307 - protein, 19 aa, Mycobacterium
AVVVPVVHFYGRKELAHIL

SEQ ID NO: 302308 - protein, 29 aa, Mycobacterium
AVVVRRLPGWPIWFAVLWGAQEWLKSIVP

SEQ ID NO: 302309 - protein, 39 aa, Mycobacterium
AVVVTDFYLLQAFIIRWRVWLTERITVDWLSKRAFYRSR

SEQ ID NO: 302310 - protein, 26 aa, Mycobacterium
AVVVVGLWWRYRYDKFGWTTRSSQLY

SEQ ID NO: 302311 - protein, 29 aa, Mycobacterium
AVVVVVVGVIGWRFFGDVLSNRSQTAAAR

SEQ ID NO: 302312 - protein, 18 aa, Mycobacterium
AVVVWTALWLLVALAVYD

SEQ ID NO: 302313 - protein, 24 aa, Mycobacterium
AVVYAILVLLGRYIGYTLDLAGIA

SEQ ID NO: 302314 - protein, 21 aa, Mycobacterium
AVWKELLTFMALRTERRGDNR

SEQ ID NO: 302315 - protein, 25 aa, Mycobacterium
AVWMYWRYGRPNSRRWLRQHQLDRP

SEQ ID NO: 302316 - protein, 23 aa, Mycobacterium
AVWPPQRWRAQRDAVVAAYRSLA

SEQ ID NO: 302317 - protein, 18 aa, Mycobacterium
AVWQAVAVAGIWNQTFVP

SEQ ID NO: 302318 - protein, 24 aa, Mycobacterium
AVWRGRRPGPLVAEALPVVVRASE

SEQ ID NO: 302319 - protein, 21 aa, Mycobacterium
AVWSMVWWIPLSVLLEFLIGW

SEQ ID NO: 302320 - protein, 19 aa, Mycobacterium
AVYGRWSQKIGWHSAEAST

SEQ ID NO: 302321 - protein, 18 aa, Mycobacterium
AVYGRWSQKVGWHGAEGS

SEQ ID NO: 302322 - protein, 18 aa, Mycobacterium
AVYGRWSQKVGWHSAESS

SEQ ID NO: 302323 - protein, 24 aa, Mycobacterium
AVYLLNFGPTFTIGAELGPGVGGR

SEQ ID NO: 302324 - protein, 18 aa, Mycobacterium
AVYLVRWLSMRMDMFNAG

SEQ ID NO: 302325 - protein, 23 aa, Mycobacterium
AVYSTRWWLSGLLVGLAAGIKLT

SEQ ID NO: 302326 - protein, 25 aa, Mycobacterium
AVYVYRRVWASLIWTTVLTAALVFA

SEQ ID NO: 302327 - protein, 17 aa, Mycobacterium
AVYWHMVDLLWIVIFGL

SEQ ID NO: 302328 - protein, 19 aa, Mycobacterium
AWAAVTLGIALLVLAAYLV

SEQ ID NO: 302329 - protein, 24 aa, Mycobacterium
AWAFIALGALGWVAAAAAAFLVPA

SEQ ID NO: 302330 - protein, 27 aa, Mycobacterium
AWAQAAGMVAAFLPAMAIVGALVPVHR

SEQ ID NO: 302331 - protein, 18 aa, Mycobacterium
AWARRRSEAQGRDADHVP

SEQ ID NO: 302332 - protein, 18 aa, Mycobacterium
AWASLILLLARIVQGLAC

SEQ ID NO: 302333 - protein, 18 aa, Mycobacterium
AWATRTGFRVAAIVITLI

SEQ ID NO: 302334 - protein, 21 aa, Mycobacterium
AWDPTSWGPWVVHTLEVMSTG

SEQ ID NO: 302335 - protein, 33 aa, Mycobacterium
AWDVFCTVLGPGAFRLAVLVLIVLALLRRRIRL

SEQ ID NO: 302336 - protein, 20 aa, Mycobacterium
AWDVLCDLEQVIPLMPGAQL

SEQ ID NO: 302337 - protein, 33 aa, Mycobacterium
AWEGIKTAISAAWRFVSPILDKFSEGWDALKSG

SEQ ID NO: 302338 - protein, 23 aa, Mycobacterium
AWETKAGLISAVLVAAYAVVALI

SEQ ID NO: 302339 - protein, 19 aa, Mycobacterium
AWFVARVSLLPTLMLTIPY

SEQ ID NO: 302340 - protein, 20 aa, Mycobacterium
AWFVVLGIAWAFLRRRLGHK

SEQ ID NO: 302341 - protein, 20 aa, Mycobacterium
AWGLLELFPRTLVPGDRFWW

SEQ ID NO: 302342 - protein, 24 aa, Mycobacterium
AWGSCGKPFPGMEIRIVDPETGTR

SEQ ID NO: 302343 - protein, 24 aa, Mycobacterium
AWHEAHPYLPFVFTGSAAASGGGL

SEQ ID NO: 302344 - protein, 24 aa, Mycobacterium
AWHEAHPYLPFVFTGSAAASGGGW

SEQ ID NO: 302345 - protein, 18 aa, Mycobacterium
AWHGAWCWDEHFLDFFAD

SEQ ID NO: 302346 - protein, 18 aa, Mycobacterium
AWIAILAMGALFGIMKLI

SEQ ID NO: 302347 - protein, 18 aa, Mycobacterium
AWILTRWLIRGWAGRVTV

SEQ ID NO: 302348 - protein, 17 aa, Mycobacterium
AWIMWAPNAIWKSFDLF

SEQ ID NO: 302349 - protein, 19 aa, Mycobacterium
AWINIAGFVAMVFNLFFIN

SEQ ID NO: 302350 - protein, 25 aa, Mycobacterium
AWLDGASWWKALLALVVAVALIIGV

SEQ ID NO: 302351 - protein, 22 aa, Mycobacterium
AWLGDRSKPLLIIGCAAAASMA

SEQ ID NO: 302352 - protein, 26 aa, Mycobacterium
AWLHDPRFLLGLAVYLCGFTLLLSSE

SEQ ID NO: 302353 - protein, 20 aa, Mycobacterium
AWLLGCLTLLFVTSSGVGRY

SEQ ID NO: 302354 - protein, 18 aa, Mycobacterium
AWLNLTAAMVMVFFFVAA

SEQ ID NO: 302355 - protein, 28 aa, Mycobacterium
AWLSCLPIAVAITACFGLILGTPTLRLR

SEQ ID NO: 302356 - protein, 21 aa, Mycobacterium
AWLTPFGPVALGLKVVALAVG

SEQ ID NO: 302357 - protein, 18 aa, Mycobacterium
AWNDPRFQRAAELYFAPG

SEQ ID NO: 302358 - protein, 21 aa, Mycobacterium
AWNPEFLREGFAVQDTLHPDR

SEQ ID NO: 302359 - protein, 20 aa, Mycobacterium
AWNPEFLREGFAVRDTLHPD

SEQ ID NO: 302360 - protein, 24 aa, Mycobacterium
AWPFIALGALGWLAAVAAAFLVPA

SEQ ID NO: 302361 - protein, 22 aa, Mycobacterium
AWPGGWWIDPGIGLVIAGIAVW

SEQ ID NO: 302362 - protein, 20 aa, Mycobacterium
AWPLVGHEGWPPNIVPSPGD

SEQ ID NO: 302363 - protein, 19 aa, Mycobacterium
AWRDKKRRLWLMGLIAPTA

SEQ ID NO: 302364 - protein, 21 aa, Mycobacterium
AWRHGACLVPAPRSLVRSGMD

SEQ ID NO: 302365 - protein, 20 aa, Mycobacterium
AWRHVRERGSASLILGSAAT

SEQ ID NO: 302366 - protein, 20 aa, Mycobacterium
AWRNLRFPLSTAPPEANVAR

SEQ ID NO: 302367 - protein, 23 aa, Mycobacterium
AWRNRSGWLPAARAHRSSAGLSQ

SEQ ID NO: 302368 - protein, 21 aa, Mycobacterium
AWRWLRNQALQPAVSGVLGVA

SEQ ID NO: 302369 - protein, 23 aa, Mycobacterium
AWRYWRMVVGVVAAVAVLVIGSL

SEQ ID NO: 302370 - protein, 22 aa, Mycobacterium
AWRYWRTVIGVVVAVAVLVIGG

SEQ ID NO: 302371 - protein, 25 aa, Mycobacterium
AWSPLRTAGMIALRGYLVVAVLLVG

SEQ ID NO: 302372 - protein, 18 aa, Mycobacterium
AWSRAYRSGDLVRLETDG

SEQ ID NO: 302373 - protein, 23 aa, Mycobacterium
AWTAAGLFLAFWLPLNNGLRPEP

SEQ ID NO: 302374 - protein, 25 aa, Mycobacterium
AWTGRLVPRGGFDAIPGYWNDTAHW

SEQ ID NO: 302375 - protein, 18 aa, Mycobacterium
AWTRYDTRTGTRMWTVPV

SEQ ID NO: 302376 - protein, 19 aa, Mycobacterium
AWTSVPAFLIAAAGFTVLG

SEQ ID NO: 302377 - protein, 24 aa, Mycobacterium
AWVALCGAAVLAARSLRRRHTSVS

SEQ ID NO: 302378 - protein, 24 aa, Mycobacterium
AWVNSCQRMKPVLKNHHPRTRIYW

SEQ ID NO: 302379 - protein, 21 aa, Mycobacterium
AWVRRCWLAAAIVAPAVIFCE

SEQ ID NO: 302380 - protein, 17 aa, Mycobacterium
AWVVHLLPLLPISTAVL

SEQ ID NO: 302381 - protein, 18 aa, Mycobacterium
AWWFLFLVVVAGLVALYI

SEQ ID NO: 302382 - protein, 30 aa, Mycobacterium
AWWKGMFLTTRIGRALAMVRRNRAEDTVET

SEQ ID NO: 302383 - protein, 23 aa, Mycobacterium
AWWLARLEWEVVLMLVTAVEMVL

SEQ ID NO: 302384 - protein, 17 aa, Mycobacterium
AWWLRRRSAGGGRGTAS

SEQ ID NO: 302385 - protein, 20 aa, Mycobacterium
AWYPAARRGFATGVFGMGMV

SEQ ID NO: 302386 - protein, 22 aa, Mycobacterium
AWYQDFLRYYFLTVETNIDGSM

SEQ ID NO: 302387 - protein, 19 aa, Mycobacterium
AWYVPVGVAGTLGDVKAAE

SEQ ID NO: 302388 - protein, 24 aa, Mycobacterium
AYAACSSCTAVAVAYQVIFVVDSD

SEQ ID NO: 302389 - protein, 21 aa, Mycobacterium
AYAAFHCWTFPLFLITNGEDV

SEQ ID NO: 302390 - protein, 18 aa, Mycobacterium
AYADRAGNMVPRPGRDVV

SEQ ID NO: 302391 - protein, 19 aa, Mycobacterium
AYAIGWMYFLGWSMTAIVD

SEQ ID NO: 302392 - protein, 25 aa, Mycobacterium
AYAPEEIFLMLSVAGLAAYAMAPWI

SEQ ID NO: 302393 - protein, 18 aa, Mycobacterium
AYAQAKFQLTGRENSDDV

SEQ ID NO: 302394 - protein, 19 aa, Mycobacterium
AYAVWKFRGARGAIQATLD

SEQ ID NO: 302395 - protein, 20 aa, Mycobacterium
AYCVGRFCVELMRVDPATQF

SEQ ID NO: 302396 - protein, 19 aa, Mycobacterium
AYCVGRFGVELLRDDYATH

SEQ ID NO: 302397 - protein, 25 aa, Mycobacterium
AYDIALFYRYAWQNPVFADIVHTQS

SEQ ID NO: 302398 - protein, 26 aa, Mycobacterium
AYDIGLFYRYAWQNPIFADIVATRTF

SEQ ID NO: 302399 - protein, 19 aa, Mycobacterium
AYEAASLNWARYTDAVQKW

SEQ ID NO: 302400 - protein, 21 aa, Mycobacterium
AYELGMALGIAVLGSILTAVY

SEQ ID NO: 302401 - protein, 18 aa, Mycobacterium
AYFFCVFIQHVSPGAFAA

SEQ ID NO: 302402 - protein, 24 aa, Mycobacterium
AYFVLTPVAGWLIDRRGSRSVFLS

SEQ ID NO: 302403 - protein, 18 aa, Mycobacterium
AYGEFCPHLAAPMADGWM

SEQ ID NO: 302404 - protein, 17 aa, Mycobacterium
AYGLGLWYGVVRERNIG

SEQ ID NO: 302405 - protein, 27 aa, Mycobacterium
AYGLGWRPRLLVAMLVATALALVGTNG

SEQ ID NO: 302406 - protein, 18 aa, Mycobacterium
AYGPSYWSAIAVFVIVAV

SEQ ID NO: 302407 - protein, 17 aa, Mycobacterium
AYGPYLAWLTAASADCM

SEQ ID NO: 302408 - protein, 17 aa, Mycobacterium
AYGRPWTWIALAAAVVA

SEQ ID NO: 302409 - protein, 35 aa, Mycobacterium
AYGVGDLQTAGWLPGHSWYAFDLSPRISADSWWVT

SEQ ID NO: 302410 - protein, 26 aa, Mycobacterium
AYHEAGHTLAAWAMPDIERVYKVTIL

SEQ ID NO: 302411 - protein, 23 aa, Mycobacterium
AYHLAAILAICYLIPTAKPRSSD

SEQ ID NO: 302412 - protein, 17 aa, Mycobacterium
AYHPVPMLLGVALGTLV

SEQ ID NO: 302413 - protein, 20 aa, Mycobacterium
AYHYYAREAMKPEVTLADYK

SEQ ID NO: 302414 - protein, 28 aa, Mycobacterium
AYIGWSVLEPSSFSRWVTNPVRQRFWAW

SEQ ID NO: 302415 - protein, 18 aa, Mycobacterium
AYIPPARSAFVRSTGLGG

SEQ ID NO: 302416 - protein, 19 aa, Mycobacterium
AYLASTRLLAGVIVVVPLY

SEQ ID NO: 302417 - protein, 22 aa, Mycobacterium
AYLFTPLFNWFGRRLGTGLAAT

SEQ ID NO: 302418 - protein, 20 aa, Mycobacterium
AYLLDIHLGFSFSAGLIDLL

SEQ ID NO: 302419 - protein, 29 aa, Mycobacterium
AYLLGPKNFFAWALSVMFLVFTLRAILYK

SEQ ID NO: 302420 - protein, 24 aa, Mycobacterium
AYLLTEFALRPVAAQALEAAPPPQ

SEQ ID NO: 302421 - protein, 17 aa, Mycobacterium
AYLPIDPALPGARVEFM

SEQ ID NO: 302422 - protein, 20 aa, Mycobacterium
AYLRVALREARKFRYFFTSA

SEQ ID NO: 302423 - protein, 24 aa, Mycobacterium
AYMLCVGVGLTAFILADYCWAMAA

SEQ ID NO: 302424 - protein, 29 aa, Mycobacterium
AYMTYRRGRPLSVRWLLEPVLGRRRVEGV

SEQ ID NO: 302425 - protein, 28 aa, Mycobacterium
AYNRIRRPLMRFGHMVAFFFRALSGIPV

SEQ ID NO: 302426 - protein, 23 aa, Mycobacterium
AYPARPKLADWVALTTTAMAGGA

SEQ ID NO: 302427 - protein, 18 aa, Mycobacterium
AYPILLFGKWFRLGTTTY

SEQ ID NO: 302428 - protein, 19 aa, Mycobacterium
AYPRGHDPGARMFTNARAI

SEQ ID NO: 302429 - protein, 25 aa, Mycobacterium
AYPVRSWKSLLALVLLAFAVAVVHT

SEQ ID NO: 302430 - protein, 17 aa, Mycobacterium
AYPWQTTFDRWLLGVAV

SEQ ID NO: 302431 - protein, 23 aa, Mycobacterium
AYQALSRQGIYGDFFSFYLCDVV

SEQ ID NO: 302432 - protein, 25 aa, Mycobacterium
AYQARLKPAESLLRLPPPGENWRLV

SEQ ID NO: 302433 - protein, 25 aa, Mycobacterium
AYRCYECADGRYVAVGALEDAFLRT

SEQ ID NO: 302434 - protein, 17 aa, Mycobacterium
AYREFRQNLGRSILIGL

SEQ ID NO: 302435 - protein, 29 aa, Mycobacterium
AYREGAEALGLPLGWTLRKIVLKSAIPGI

SEQ ID NO: 302436 - protein, 20 aa, Mycobacterium
AYRLRLAGQSMRIFEAGDDL

SEQ ID NO: 302437 - protein, 32 aa, Mycobacterium
AYRMAKAGLLQRPRFRMPWAPYSGYLTLAFLA

SEQ ID NO: 302438 - protein, 19 aa, Mycobacterium
AYRRLWQEIGREWRRDRNF

SEQ ID NO: 302439 - protein, 26 aa, Mycobacterium
AYRRTDWVRLILPYAGFFGTAVLFAF

SEQ ID NO: 302440 - protein, 23 aa, Mycobacterium
AYRRVQWGTVFLIAGILPMSTAV

SEQ ID NO: 302441 - protein, 20 aa, Mycobacterium
AYRRYEWVSTMVLIAVLGAI

SEQ ID NO: 302442 - protein, 19 aa, Mycobacterium
AYRTRPVFVPTAGPNDPIA

SEQ ID NO: 302443 - protein, 20 aa, Mycobacterium
AYRYRLRVLLAATVAAGVIA

SEQ ID NO: 302444 - protein, 25 aa, Mycobacterium
AYSEKRLQPPPGYKDTTVPGIWSRD

SEQ ID NO: 302445 - protein, 23 aa, Mycobacterium
AYSVGDAFSWAWNKFSKHAVEMI

SEQ ID NO: 302446 - protein, 26 aa, Mycobacterium
AYTETKLNSAFAFGGPKCLVKVIQKM

SEQ ID NO: 302447 - protein, 18 aa, Mycobacterium
AYTGTVLRAFEDEMEAVV

SEQ ID NO: 302448 - protein, 19 aa, Mycobacterium
AYTRRTEVGIMRLVGATRW

SEQ ID NO: 302449 - protein, 19 aa, Mycobacterium
AYVAGLILTVFSMRVAAAI

SEQ ID NO: 302450 - protein, 18 aa, Mycobacterium
AYVAGWMYFLNWAMTSIV

SEQ ID NO: 302451 - protein, 24 aa, Mycobacterium
AYVCDINAFGFFPGLNDVMPIIVN

SEQ ID NO: 302452 - protein, 18 aa, Mycobacterium
AYVKGVRYRVRTVEIPTP

SEQ ID NO: 302453 - protein, 25 aa, Mycobacterium
AYVLLVLVCRRRWRPRLLLGALAGL

SEQ ID NO: 302454 - protein, 18 aa, Mycobacterium
AYVMLRLVGDIGEAAANE

SEQ ID NO: 302455 - protein, 20 aa, Mycobacterium
AYVRAARPFIVFYDKCASVV

SEQ ID NO: 302456 - protein, 24 aa, Mycobacterium
AYVRAARPFIVFYNRCASVVVRAL

SEQ ID NO: 302457 - protein, 25 aa, Mycobacterium
AYVYSLDNTRLWSNLDCAPSNETLV

SEQ ID NO: 302458 - protein, 21 aa, Mycobacterium
CAAAAGALLLAARGRELDFRT

SEQ ID NO: 302459 - protein, 19 aa, Mycobacterium
CAAAASALFGAWSLARADV

SEQ ID NO: 302460 - protein, 18 aa, Mycobacterium
CAAQAAGVLLGLAITAGW

SEQ ID NO: 302461 - protein, 20 aa, Mycobacterium
CAAVPGSAGTIWSLTQGTLP

SEQ ID NO: 302462 - protein, 18 aa, Mycobacterium
CAAYGWTIVASVLSIFAL

SEQ ID NO: 302463 - protein, 17 aa, Mycobacterium
CADDWKSARSGLQTFTV

SEQ ID NO: 302464 - protein, 20 aa, Mycobacterium
CADGRYVAVGAIEPQFYAAM

SEQ ID NO: 302465 - protein, 18 aa, Mycobacterium
CAEGGVLGIVCASVAAVM

SEQ ID NO: 302466 - protein, 18 aa, Mycobacterium
CAEINVVLVERLYPRALL

SEQ ID NO: 302467 - protein, 19 aa, Mycobacterium
CAELSAPLIEVHISNVHAR

SEQ ID NO: 302468 - protein, 20 aa, Mycobacterium
CAELSAPLIEVHISNVHARE

SEQ ID NO: 302469 - protein, 24 aa, Mycobacterium
CAFAETYWQLLLFRSLGGVGSAMF

SEQ ID NO: 302470 - protein, 24 aa, Mycobacterium
CAFSQAYWQLMAFRVISGIGSTMF

SEQ ID NO: 302471 - protein, 20 aa, Mycobacterium
CAGIALAAAIVVGWLLPARA

SEQ ID NO: 302472 - protein, 30 aa, Mycobacterium
CAHQGITWAAGMLFPAYSIGLIMGNSASPA

SEQ ID NO: 302473 - protein, 25 aa, Mycobacterium
CAIALATALGFLFALLSTTSRNASG

SEQ ID NO: 302474 - protein, 17 aa, Mycobacterium
CAIWWHSHGGGWGHHGG

SEQ ID NO: 302475 - protein, 19 aa, Mycobacterium
CALAGALLQIFLRRPAIEE

SEQ ID NO: 302476 - protein, 25 aa, Mycobacterium
CALAPNILALIAFRVIQGIGGGMLM

SEQ ID NO: 302477 - protein, 20 aa, Mycobacterium
CALAPNILALIMFRVVQGLG

SEQ ID NO: 302478 - protein, 25 aa, Mycobacterium
CALAPNILSLIFFRVLQGVGGGMLM

SEQ ID NO: 302479 - protein, 24 aa, Mycobacterium
CALAPNISALIAFRVIQGLGGGML

SEQ ID NO: 302480 - protein, 27 aa, Mycobacterium
CALAVGLKYRLGFDDSLDVVGVHLVGG

SEQ ID NO: 302481 - protein, 18 aa, Mycobacterium
CALFGMLAVVVRRLPGWP

SEQ ID NO: 302482 - protein, 18 aa, Mycobacterium
CALLERVANALPQRRPNA

SEQ ID NO: 302483 - protein, 19 aa, Mycobacterium
CALLFTIIWWEVSHSRSNW

SEQ ID NO: 302484 - protein, 26 aa, Mycobacterium
CALLGDRYGRRRGFFIGLGVFAAASM

SEQ ID NO: 302485 - protein, 27 aa, Mycobacterium
CALLGDRYGRRRGFFVGLALFVASSVV

SEQ ID NO: 302486 - protein, 20 aa, Mycobacterium
CALLGLPIVPLFAYSRTAAM

SEQ ID NO: 302487 - protein, 35 aa, Mycobacterium
CALLLEIYAVMGAGWVWRRGRRGESIPAFANALVS

SEQ ID NO: 302488 - protein, 27 aa, Mycobacterium
CALLLWRGVEAVSFLGGLWIGATLIQL

SEQ ID NO: 302489 - protein, 24 aa, Mycobacterium
CALPRAEQLIAPWGERLNIATVNG

SEQ ID NO: 302490 - protein, 17 aa, Mycobacterium
CALRDTRLVIGYLGVIA

SEQ ID NO: 302491 - protein, 28 aa, Mycobacterium
CALVIRQIYRPELDLVRWHGRIDDPTGG

SEQ ID NO: 302492 - protein, 20 aa, Mycobacterium
CANAILRIFGVQPKDELDIT

SEQ ID NO: 302493 - protein, 24 aa, Mycobacterium
CANDGICSLVLKAVEPMDSVVAAT

SEQ ID NO: 302494 - protein, 21 aa, Mycobacterium
CANPDPAMLVRGARNAPRPAD

SEQ ID NO: 302495 - protein, 18 aa, Mycobacterium
CAPAAALLLYLQPLTIAV

SEQ ID NO: 302496 - protein, 18 aa, Mycobacterium
CAPGRGPIYRGRHDRNRS

SEQ ID NO: 302497 - protein, 20 aa, Mycobacterium
CASAPNIGLLITFRVVQGIG

SEQ ID NO: 302498 - protein, 20 aa, Mycobacterium
CATIPVGLILLSWLLARADP

SEQ ID NO: 302499 - protein, 17 aa, Mycobacterium
CATRARAAGVIRIPRAA

SEQ ID NO: 302500 - protein, 52 aa, Mycobacterium
CATRWGDRAERRWPFGVAAAFLALGMALRWDVFGIGLGRAAWFTILAFWFFA

SEQ ID NO: 302501 - protein, 19 aa, Mycobacterium
CATVPVVVVHLAIGYTHFV

SEQ ID NO: 302502 - protein, 18 aa, Mycobacterium
CAVGAVFFGARAATGFGH

SEQ ID NO: 302503 - protein, 20 aa, Mycobacterium
CAVGAWFAGGIADRIGRVRV

SEQ ID NO: 302504 - protein, 25 aa, Mycobacterium
CAVLAQPGKHDWPFADRAFAAALPW

SEQ ID NO: 302505 - protein, 20 aa, Mycobacterium
CAVLGLPIVPLFAYSRTAAM

SEQ ID NO: 302506 - protein, 22 aa, Mycobacterium
CAVSLTVGYLAPRVMRLAPRQA

SEQ ID NO: 302507 - protein, 20 aa, Mycobacterium
CAVSLVGLIALPGYQTNYDD

SEQ ID NO: 302508 - protein, 27 aa, Mycobacterium
CAVSPFSWAAHWVWFAPAIVWLVAKAC

SEQ ID NO: 302509 - protein, 17 aa, Mycobacterium
CAVVSDIEWIRAPARGI

SEQ ID NO: 302510 - protein, 21 aa, Mycobacterium
CAVWLTVLFVAAVRRGGRRWW

SEQ ID NO: 302511 - protein, 17 aa, Mycobacterium
CAVYLASYAPWFASETA

SEQ ID NO: 302512 - protein, 17 aa, Mycobacterium
CAYEWSHHVSMAKDEGI

SEQ ID NO: 302513 - protein, 19 aa, Mycobacterium
CAYFGLRLIGFSELHALMA

SEQ ID NO: 302514 - protein, 18 aa, Mycobacterium
CCAADAQLARIRLAGPAA

SEQ ID NO: 302515 - protein, 21 aa, Mycobacterium
CDGWPIRWARQVAQDQPDVAL

SEQ ID NO: 302516 - protein, 18 aa, Mycobacterium
CDIGQGFYFGKPVDPADV

SEQ ID NO: 302517 - protein, 17 aa, Mycobacterium
CDISLKINGLQPGGPVR

SEQ ID NO: 302518 - protein, 19 aa, Mycobacterium
CDITLKFNGLQPGGPVRTV

SEQ ID NO: 302519 - protein, 18 aa, Mycobacterium
CDKAGIPYLTHWDAGAVV

SEQ ID NO: 302520 - protein, 23 aa, Mycobacterium
CDLDVAGLWALLQIYRHSQVFGS

SEQ ID NO: 302521 - protein, 24 aa, Mycobacterium
CDLLERPTFRAALIRTSGNQHRFV

SEQ ID NO: 302522 - protein, 21 aa, Mycobacterium
CDLNATGFFPGLNDITTFIVN

SEQ ID NO: 302523 - protein, 20 aa, Mycobacterium
CDLNATGFFPGLNDVTPIIV

SEQ ID NO: 302524 - protein, 23 aa, Mycobacterium
CDLVNYRLGYRVLRDDDGAPRVV

SEQ ID NO: 302525 - protein, 24 aa, Mycobacterium
CDNALMIRRAWAIPAAAIGGITLV

SEQ ID NO: 302526 - protein, 24 aa, Mycobacterium
CDNPRLATFKVFKRIDGSVDETQC

SEQ ID NO: 302527 - protein, 18 aa, Mycobacterium
CDSAGIPYLTHWDAGAVV

SEQ ID NO: 302528 - protein, 18 aa, Mycobacterium
CDVAELVAAYALWSQRHW

SEQ ID NO: 302529 - protein, 21 aa, Mycobacterium
CDVETKYHCAQVIADPERDSG

SEQ ID NO: 302530 - protein, 25 aa, Mycobacterium
CEASVRNYLGLKFDPNSKFTVSLLW

SEQ ID NO: 302531 - protein, 19 aa, Mycobacterium
CEPWDPETREYGPIMDPES

SEQ ID NO: 302532 - protein, 25 aa, Mycobacterium
CERADAVLVLTEWRQFVDLDPADLA

SEQ ID NO: 302533 - protein, 25 aa, Mycobacterium
CERADAVLVLTEWRQFVELDPDDLA

SEQ ID NO: 302534 - protein, 27 aa, Mycobacterium
CERADAVLVLTEWSEFVGMHPDELSAA

SEQ ID NO: 302535 - protein, 20 aa, Mycobacterium
CERIRKTPMPFAYAVHLRRA

SEQ ID NO: 302536 - protein, 18 aa, Mycobacterium
CESDQPFEPLAMRQHIFG

SEQ ID NO: 302537 - protein, 29 aa, Mycobacterium
CEVAGRALMYLGFIPPVWLAAVGALSVSK

SEQ ID NO: 302538 - protein, 18 aa, Mycobacterium
CFAAMVVAVISALTLGPA

SEQ ID NO: 302539 - protein, 19 aa, Mycobacterium
CFIPGLVLGIFTQFTALFV

SEQ ID NO: 302540 - protein, 22 aa, Mycobacterium
CFLGVGLALRYDALGITMGDDA

SEQ ID NO: 302541 - protein, 20 aa, Mycobacterium
CFLITLGGTIAFYTYSVNAP

SEQ ID NO: 302542 - protein, 25 aa, Mycobacterium
CFLWDEAWYAFATAVPWARQRTAMV

SEQ ID NO: 302543 - protein, 22 aa, Mycobacterium
CFRPGTCERLGIGPDDCAAVNP

SEQ ID NO: 302544 - protein, 27 aa, Mycobacterium
CFSIGSFLCGLSWGYWSLFVFRAIVGL

SEQ ID NO: 302545 - protein, 17 aa, Mycobacterium
CFTAPLVQARPDLPEVL

SEQ ID NO: 302546 - protein, 18 aa, Mycobacterium
CFVAMVVAVIAALTLGPA

SEQ ID NO: 302547 - protein, 18 aa, Mycobacterium
CFWHLVDLLWIFLFALLY

SEQ ID NO: 302548 - protein, 20 aa, Mycobacterium
CGAGFALTSAHSWRIKTKWF

SEQ ID NO: 302549 - protein, 19 aa, Mycobacterium
CGAGLTMPSADGMAHIIYT

SEQ ID NO: 302550 - protein, 18 aa, Mycobacterium
CGAPTPKVVGKFRDGDVR

SEQ ID NO: 302551 - protein, 17 aa, Mycobacterium
CGASFTWSTKAFGPYVG

SEQ ID NO: 302552 - protein, 18 aa, Mycobacterium
CGASFTWSTKAFGPYVGW

SEQ ID NO: 302553 - protein, 20 aa, Mycobacterium
CGATMALAAVSWWLLEQPIR

SEQ ID NO: 302554 - protein, 19 aa, Mycobacterium
CGAVAMSIGSSWTTAGTIG

SEQ ID NO: 302555 - protein, 21 aa, Mycobacterium
CGAVFALASAHSWRIKTRWLT

SEQ ID NO: 302556 - protein, 17 aa, Mycobacterium
CGCRFTVRLPRVTDERL

SEQ ID NO: 302557 - protein, 20 aa, Mycobacterium
CGFAFLPSYLGLVIAGSQGV

SEQ ID NO: 302558 - protein, 20 aa, Mycobacterium
CGFALLPGYLGLVIAGGSQT

SEQ ID NO: 302559 - protein, 25 aa, Mycobacterium
CGFAMLPAYLLLVVRGRRPGERSGV

SEQ ID NO: 302560 - protein, 23 aa, Mycobacterium
CGFLPSVWLALVFGWGLAGIWCG

SEQ ID NO: 302561 - protein, 18 aa, Mycobacterium
CGFQESRPTVAWTTDADL

SEQ ID NO: 302562 - protein, 17 aa, Mycobacterium
CGGLAGVFTVFFVLIVK

SEQ ID NO: 302563 - protein, 17 aa, Mycobacterium
CGHSSCRSMQALLDNGA

SEQ ID NO: 302564 - protein, 20 aa, Mycobacterium
CGIETFVKRIESVLSAMVAD

SEQ ID NO: 302565 - protein, 28 aa, Mycobacterium
CGIGLLVAYPLVALIEVYAFRRLTGAPI

SEQ ID NO: 302566 - protein, 24 aa, Mycobacterium
CGIWMAISVACFYFATSSVLVVVI

SEQ ID NO: 302567 - protein, 20 aa, Mycobacterium
CGLSPIRAALLIAPVAISSG

SEQ ID NO: 302568 - protein, 19 aa, Mycobacterium
CGLWHARDIVPLGLAVLAA

SEQ ID NO: 302569 - protein, 21 aa, Mycobacterium
CGPAPAIAGISEWLNTPDGKP

SEQ ID NO: 302570 - protein, 22 aa, Mycobacterium
CGPAPALTGVTGWLNTPDGKPL

SEQ ID NO: 302571 - protein, 18 aa, Mycobacterium
CGPDGCGGGGNGQGSYGP

SEQ ID NO: 302572 - protein, 25 aa, Mycobacterium
CGPRALLRRPLLWVGAAVALAMVSP

SEQ ID NO: 302573 - protein, 25 aa, Mycobacterium
CGRAESSVSLSGWRPDPTARYEGRY

SEQ ID NO: 302574 - protein, 22 aa, Mycobacterium
CGSACGGCPGAGRNDSPGRDGL

SEQ ID NO: 302575 - protein, 25 aa, Mycobacterium
CGSAPDLKGIIGWLNTPGDQPLDLR

SEQ ID NO: 302576 - protein, 19 aa, Mycobacterium
CGSLPKVAENWPVRNLVTN

SEQ ID NO: 302577 - protein, 18 aa, Mycobacterium
CGSMTRVILATAATVAIA

SEQ ID NO: 302578 - protein, 18 aa, Mycobacterium
CGTFHAMMNFEVRVVEPN

SEQ ID NO: 302579 - protein, 17 aa, Mycobacterium
CGTRLLLGGCYFGAGVG

SEQ ID NO: 302580 - protein, 18 aa, Mycobacterium
CGTTFTWATKAFGPWIGW

SEQ ID NO: 302581 - protein, 18 aa, Mycobacterium
CGTYHAMMNFEVRVVAPN

SEQ ID NO: 302582 - protein, 18 aa, Mycobacterium
CGTYHSMMAFELRVVSPN

SEQ ID NO: 302583 - protein, 24 aa, Mycobacterium
CGVAALRLLTRFWPGPEKPGEPDV

SEQ ID NO: 302584 - protein, 20 aa, Mycobacterium
CGVAALRLLTRRFEPGPGDP

SEQ ID NO: 302585 - protein, 19 aa, Mycobacterium
CGVAKGWGWADGVAGLAVT

SEQ ID NO: 302586 - protein, 21 aa, Mycobacterium
CGVASILQAVGFWKIGVRLPL

SEQ ID NO: 302587 - protein, 19 aa, Mycobacterium
CGVFGIPVVTHLSAGGFQD

SEQ ID NO: 302588 - protein, 21 aa, Mycobacterium
CGVGAVIWGVIDAVLILTDKV

SEQ ID NO: 302589 - protein, 22 aa, Mycobacterium
CGVLDFPYRQFVVFDAIGAVVW

SEQ ID NO: 302590 - protein, 23 aa, Mycobacterium
CGVPVENVTLWLFGGVTTLGGEA

SEQ ID NO: 302591 - protein, 25 aa, Mycobacterium
CGVTLGALGGALAWLGNGLPDVGDA

SEQ ID NO: 302592 - protein, 25 aa, Mycobacterium
CHADPRLKACLMMDAAMPADVVRDG

SEQ ID NO: 302593 - protein, 33 aa, Mycobacterium
CHRPNRLWWRYTAWWLVALVLATLWWVVALSQL

SEQ ID NO: 302594 - protein, 25 aa, Mycobacterium
CHTMSLDWVAWRGLGFAADAQIVSE

SEQ ID NO: 302595 - protein, 17 aa, Mycobacterium
CIGASALGVVLLIVDAL

SEQ ID NO: 302596 - protein, 24 aa, Mycobacterium
CILLLEVLFLRWLLDGRTSRQWMA

SEQ ID NO: 302597 - protein, 24 aa, Mycobacterium
CILLLEVLFLRWLLDGRVSHQWWA

SEQ ID NO: 302598 - protein, 20 aa, Mycobacterium
CISLSPARRNIIFMALMLGV

SEQ ID NO: 302599 - protein, 20 aa, Mycobacterium
CITVSVLVAGLVSDRLLRIG

SEQ ID NO: 302600 - protein, 26 aa, Mycobacterium
CIVESACALFACLALLIVASSQLSPR

SEQ ID NO: 302601 - protein, 19 aa, Mycobacterium
CIVSVWRSVPFAAVVLLAA

SEQ ID NO: 302602 - protein, 17 aa, Mycobacterium
CIVWGGAAAGILLKVCW

SEQ ID NO: 302603 - protein, 19 aa, Mycobacterium
CIYGFRFMLLVNKIAVIAA

SEQ ID NO: 302604 - protein, 19 aa, Mycobacterium
CKALYRKIDDRDDVRSLRF

SEQ ID NO: 302605 - protein, 21 aa, Mycobacterium
CKGKPGVVHSFAFPDPPMAIC

SEQ ID NO: 302606 - protein, 19 aa, Mycobacterium
CKLAPRPGASFVMGSILSA

SEQ ID NO: 302607 - protein, 19 aa, Mycobacterium
CLAAAAFLAAAPVTLTAPP

SEQ ID NO: 302608 - protein, 26 aa, Mycobacterium
CLAAVTAVAVGLWVENNRTVDDIPQA

SEQ ID NO: 302609 - protein, 33 aa, Mycobacterium
CLAGLFAAGLLWRRGRRTLARLGALAFISAFSV

SEQ ID NO: 302610 - protein, 19 aa, Mycobacterium
CLAGLLGAGWAWRRGGRLR

SEQ ID NO: 302611 - protein, 25 aa, Mycobacterium
CLALLHYRGWAIPVAFVIAQGTATV

SEQ ID NO: 302612 - protein, 24 aa, Mycobacterium
CLARIRTAHQLGWFIAAMCLLTAL

SEQ ID NO: 302613 - protein, 17 aa, Mycobacterium
CLAVDPDLLVTVNAMTA

SEQ ID NO: 302614 - protein, 17 aa, Mycobacterium
CLGGGVYGMSLGQHVTQ

SEQ ID NO: 302615 - protein, 19 aa, Mycobacterium
CLHFTRLPYFKTTGIPLSI

SEQ ID NO: 302616 - protein, 21 aa, Mycobacterium
CLHFTRLPYFQTLGIPMAVGM

SEQ ID NO: 302617 - protein, 24 aa, Mycobacterium
CLHFTRMPYFQSLGIPLAIGMSVV

SEQ ID NO: 302618 - protein, 24 aa, Mycobacterium
CLHFTRMPYFQSLGIPLAIGMTVV

SEQ ID NO: 302619 - protein, 26 aa, Mycobacterium
CLHLARLSYFKALGIPSALGLLVVVA

SEQ ID NO: 302620 - protein, 26 aa, Mycobacterium
CLHLARLSYFKALGIPSALGLLVVVV

SEQ ID NO: 302621 - protein, 18 aa, Mycobacterium
CLIAATLGYCLQRVPTDR

SEQ ID NO: 302622 - protein, 23 aa, Mycobacterium
CLIATDFCYYWAHRADHRVRLLW

SEQ ID NO: 302623 - protein, 17 aa, Mycobacterium
CLIFIVMLILTRAFVAA

SEQ ID NO: 302624 - protein, 19 aa, Mycobacterium
CLLEGAKYLLDHGGYEAPG

SEQ ID NO: 302625 - protein, 19 aa, Mycobacterium
CLLFARLPSFQTLAIPCAV

SEQ ID NO: 302626 - protein, 19 aa, Mycobacterium
CLLGLLAAGILWRRGRQTV

SEQ ID NO: 302627 - protein, 17 aa, Mycobacterium
CLLVFAAFMAYFGLYSR

SEQ ID NO: 302628 - protein, 20 aa, Mycobacterium
CLLVPVVFGLGIGFLMPSVL

SEQ ID NO: 302629 - protein, 25 aa, Mycobacterium
CLLYECLTGEMPFPGDRVALQMTAH

SEQ ID NO: 302630 - protein, 33 aa, Mycobacterium
CLPDDAMLTYGWRIPLLLGAPFGLFALVLRLRL

SEQ ID NO: 302631 - protein, 19 aa, Mycobacterium
CLPMLAQIPVFIGLYHVLR

SEQ ID NO: 302632 - protein, 19 aa, Mycobacterium
CLPMLAQIPVFLGLFHVLR

SEQ ID NO: 302633 - protein, 19 aa, Mycobacterium
CLPMLAQIPVFLGLYHVLR

SEQ ID NO: 302634 - protein, 20 aa, Mycobacterium
CLPMLAQIPVFLGLYHVLRS

SEQ ID NO: 302635 - protein, 20 aa, Mycobacterium
CLPVFIDAYDQYGWQVKCGS

SEQ ID NO: 302636 - protein, 18 aa, Mycobacterium
CLPWFVHSYWNIAFGVLP

SEQ ID NO: 302637 - protein, 21 aa, Mycobacterium
CLQFTRLNYFNTMGLPCAAAT

SEQ ID NO: 302638 - protein, 20 aa, Mycobacterium
CLRGAAATVAIALVAIWTDL

SEQ ID NO: 302639 - protein, 20 aa, Mycobacterium
CLSFTRLPYLQTLGVPLAVG

SEQ ID NO: 302640 - protein, 21 aa, Mycobacterium
CLSFTRLPYLQTLGVPLAVGM

SEQ ID NO: 302641 - protein, 33 aa, Mycobacterium
CLSFTRMPYFQSMGIPCAVGIAAGVAVALTLGP

SEQ ID NO: 302642 - protein, 27 aa, Mycobacterium
CLSLTPSLLPRDWLFAGLIGGVNAAIG

SEQ ID NO: 302643 - protein, 23 aa, Mycobacterium
CLSLTRLNYFNSLGIPAGIGLAV

SEQ ID NO: 302644 - protein, 20 aa, Mycobacterium
CLVAAGFVAWAPATIALPPA

SEQ ID NO: 302645 - protein, 17 aa, Mycobacterium
CLVARWRGWQLTEGPAW

SEQ ID NO: 302646 - protein, 22 aa, Mycobacterium
CLVGSRIGPVVVRRTPDRPMRL

SEQ ID NO: 302647 - protein, 18 aa, Mycobacterium
CLVSVWRSVPFATVVLLA

SEQ ID NO: 302648 - protein, 19 aa, Mycobacterium
CLVSVWRSVPFATVVLLAA

SEQ ID NO: 302649 - protein, 31 aa, Mycobacterium
CLVVMNWLDLSWRWLFGLSIIPALISLIIRY

SEQ ID NO: 302650 - protein, 18 aa, Mycobacterium
CLVVSGLLLGGGTAQADP

SEQ ID NO: 302651 - protein, 20 aa, Mycobacterium
CLYGLHALLRLHFVQEEENY

SEQ ID NO: 302652 - protein, 20 aa, Mycobacterium
CLYGLHALLRLHFVQEEESY

SEQ ID NO: 302653 - protein, 45 aa, Mycobacterium
CLYIEGALGPAGWRLSQNIAGVVCIGALTSWFGLLAYGGIASDRN

SEQ ID NO: 302654 - protein, 24 aa, Mycobacterium
CMALARILAWYVFRVGRRRLDEQL

SEQ ID NO: 302655 - protein, 20 aa, Mycobacterium
CMGGACGTCRAKLIDGNVEM

SEQ ID NO: 302656 - protein, 28 aa, Mycobacterium
CMLLGAVLFFRWLLKGGRNAELLAGAAI

SEQ ID NO: 302657 - protein, 18 aa, Mycobacterium
CNAHRWSLLALSADPPAA

SEQ ID NO: 302658 - protein, 31 aa, Mycobacterium
CNAVTRNRLVWCALAICLGLIAAAFTIPVLA

SEQ ID NO: 302659 - protein, 25 aa, Mycobacterium
CNFKRSVMTASVWIAWPPEVLSGAL

SEQ ID NO: 302660 - protein, 20 aa, Mycobacterium
CNFNPILSCGSVMVTPQASL

SEQ ID NO: 302661 - protein, 17 aa, Mycobacterium
CNPWSAWTRWASTPLIL

SEQ ID NO: 302662 - protein, 24 aa, Mycobacterium
CNSDKPYMPLAMRQHTTGPYPLDP

SEQ ID NO: 302663 - protein, 18 aa, Mycobacterium
CNVREGLVEWLQRTNPGA

SEQ ID NO: 302664 - protein, 26 aa, Mycobacterium
CPACQSGDYSLCWSFTDGGIQPGIHT

SEQ ID NO: 302665 - protein, 17 aa, Mycobacterium
CPDGKASPGTWWHTQDP

SEQ ID NO: 302666 - protein, 18 aa, Mycobacterium
CPDVLLVNVPGTWESAPQ

SEQ ID NO: 302667 - protein, 18 aa, Mycobacterium
CPEQLAWGGVLKRHSLRL

SEQ ID NO: 302668 - protein, 25 aa, Mycobacterium
CPGAADLPAFCAVAGAVTAAAALSH

SEQ ID NO: 302669 - protein, 17 aa, Mycobacterium
CPGCDLDVAGLWALLQI

SEQ ID NO: 302670 - protein, 20 aa, Mycobacterium
CPGCGGLRMAYSLMHGDVLG

SEQ ID NO: 302671 - protein, 20 aa, Mycobacterium
CPGCGSLRMLYSLLHGNLLA

SEQ ID NO: 302672 - protein, 21 aa, Mycobacterium
CPGCGSLRMLYSLMHGDLLAA

SEQ ID NO: 302673 - protein, 20 aa, Mycobacterium
CPGCGSLRMLYSLMHGNVLA

SEQ ID NO: 302674 - protein, 22 aa, Mycobacterium
CPGNIQSPGPWRRNAAPDQPVG

SEQ ID NO: 302675 - protein, 20 aa, Mycobacterium
CPHLAAPMADGWIDRGRLVC

SEQ ID NO: 302676 - protein, 17 aa, Mycobacterium
CPPELHSALLSAGPGPA

SEQ ID NO: 302677 - protein, 26 aa, Mycobacterium
CPPELVDRWAPGRVMVNAYGPTEATV

SEQ ID NO: 302678 - protein, 18 aa, Mycobacterium
CPQLDLWSNRGALTHPVP

SEQ ID NO: 302679 - protein, 18 aa, Mycobacterium
CPQTPIIQAGLLAISAMS

SEQ ID NO: 302680 - protein, 20 aa, Mycobacterium
CPRCRGTLLAPSGPAPAQGW

SEQ ID NO: 302681 - protein, 19 aa, Mycobacterium
CPSASWPRIDVAKLGSFVD

SEQ ID NO: 302682 - protein, 26 aa, Mycobacterium
CPVWPAAARLLIRFTGPELWWVAGVA

SEQ ID NO: 302683 - protein, 20 aa, Mycobacterium
CQDGRFFAVGAIEPKFYAQF

SEQ ID NO: 302684 - protein, 24 aa, Mycobacterium
CQLIGRKVLQAWVPPPAGSDRNPT

SEQ ID NO: 302685 - protein, 25 aa, Mycobacterium
CQQGFCGTCKVKVLAGKVDRRGRTA

SEQ ID NO: 302686 - protein, 26 aa, Mycobacterium
CQQGFCGTCKVKVLAGQVDRRGSAAE

SEQ ID NO: 302687 - protein, 25 aa, Mycobacterium
CQQGFCGTCKVNVLAGTVDHRDQIL

SEQ ID NO: 302688 - protein, 19 aa, Mycobacterium
CRAFDAAADGFVRGEGAGV

SEQ ID NO: 302689 - protein, 18 aa, Mycobacterium
CRALAGALPERLGDYQRA

SEQ ID NO: 302690 - protein, 24 aa, Mycobacterium
CRASRIVLHPGFTIPVFLLSYYGL

SEQ ID NO: 302691 - protein, 19 aa, Mycobacterium
CRGAGSLRGRHLGSVSSGL

SEQ ID NO: 302692 - protein, 36 aa, Mycobacterium
CRHYWPVTLIAALLFRRCRRVVLVAAIVDGVVDWLR

SEQ ID NO: 302693 - protein, 17 aa, Mycobacterium
CRNGRNFVTAVFAASLV

SEQ ID NO: 302694 - protein, 18 aa, Mycobacterium
CRQGLPGVIWLLLGGNLV

SEQ ID NO: 302695 - protein, 18 aa, Mycobacterium
CRSRFVFFGSGYYNYDQG

SEQ ID NO: 302696 - protein, 17 aa, Mycobacterium
CRSTIRPVWAVRRRANR

SEQ ID NO: 302697 - protein, 19 aa, Mycobacterium
CRVLQGGAAAATWVAGYAT

SEQ ID NO: 302698 - protein, 20 aa, Mycobacterium
CRVVATGNSLDAVWTQLMPD

SEQ ID NO: 302699 - protein, 20 aa, Mycobacterium
CRVVATGNSVDAVWKQLMRG

SEQ ID NO: 302700 - protein, 27 aa, Mycobacterium
CSAFLPEVIDRVMLDLSSRFDRIVVDG

SEQ ID NO: 302701 - protein, 20 aa, Mycobacterium
CSALLLPSFFAYSFDRTGLL

SEQ ID NO: 302702 - protein, 19 aa, Mycobacterium
CSARLPVFALLVGLLVSPQ

SEQ ID NO: 302703 - protein, 19 aa, Mycobacterium
CSGLTRFAFAGVGVLLPRW

SEQ ID NO: 302704 - protein, 20 aa, Mycobacterium
CSGVTPAVYFSDAVTLADQL

SEQ ID NO: 302705 - protein, 19 aa, Mycobacterium
CSISAFGTAAGRELAGYDL

SEQ ID NO: 302706 - protein, 18 aa, Mycobacterium
CSITDAAGNVLVNQANNT

SEQ ID NO: 302707 - protein, 21 aa, Mycobacterium
CSLAGYAFARIRFLGRGALFI

SEQ ID NO: 302708 - protein, 20 aa, Mycobacterium
CSLRVPGLYPPQIYNGQLHV

SEQ ID NO: 302709 - protein, 20 aa, Mycobacterium
CSRLFRPVFYYLGFWVIALI

SEQ ID NO: 302710 - protein, 19 aa, Mycobacterium
CSSAVGFGCVIMARVAPHT

SEQ ID NO: 302711 - protein, 19 aa, Mycobacterium
CSVPLRVGLATGPVVAGVV

SEQ ID NO: 302712 - protein, 24 aa, Mycobacterium
CTAFLARLPTIWTAVGALSFAVSD

SEQ ID NO: 302713 - protein, 19 aa, Mycobacterium
CTARLSTPVEFDGRERLWV

SEQ ID NO: 302714 - protein, 20 aa, Mycobacterium
CTFLFRRLLGTHLRTMFVVL

SEQ ID NO: 302715 - protein, 21 aa, Mycobacterium
CTGHTAGLNGFFFYGGHQYRY

SEQ ID NO: 302716 - protein, 23 aa, Mycobacterium
CTHLFKLPGALFVVIAVTIAGAL

SEQ ID NO: 302717 - protein, 21 aa, Mycobacterium
CTHLFKLPGALFVVVAVTVAG

SEQ ID NO: 302718 - protein, 17 aa, Mycobacterium
CTLFHLLTGHAPFSDRP

SEQ ID NO: 302719 - protein, 22 aa, Mycobacterium
CTTAPETRQWIDIPEVLQPGSY

SEQ ID NO: 302720 - protein, 20 aa, Mycobacterium
CTYAFLPFQYLSVVFGAYLF

SEQ ID NO: 302721 - protein, 17 aa, Mycobacterium
CTYFTTTPFQNWTRNAT

SEQ ID NO: 302722 - protein, 21 aa, Mycobacterium
CTYIIGFRFYARLIEMKIVRP

SEQ ID NO: 302723 - protein, 17 aa, Mycobacterium
CTYVIGFRFYARLIEMK

SEQ ID NO: 302724 - protein, 20 aa, Mycobacterium
CTYVLLRLAGDIGQIQANES

SEQ ID NO: 302725 - protein, 20 aa, Mycobacterium
CTYVLLRLAGDIGQIQANQS

SEQ ID NO: 302726 - protein, 20 aa, Mycobacterium
CVAACAALVLNAPHSEKRTI

SEQ ID NO: 302727 - protein, 25 aa, Mycobacterium
CVAASAIGVLAWLYIGAQNKLSAEA

SEQ ID NO: 302728 - protein, 18 aa, Mycobacterium
CVACAVPMAIGYRRASTH

SEQ ID NO: 302729 - protein, 20 aa, Mycobacterium
CVAGAAILASVKWGLKDDGL

SEQ ID NO: 302730 - protein, 19 aa, Mycobacterium
CVAHAPLAVMIMVCEMTSS

SEQ ID NO: 302731 - protein, 18 aa, Mycobacterium
CVALLWFLGVYLVVLAFV

SEQ ID NO: 302732 - protein, 24 aa, Mycobacterium
CVAVLSRPGAGWVAILPTVIGAVC

SEQ ID NO: 302733 - protein, 17 aa, Mycobacterium
CVAWLLGNVLAVKVTPD

SEQ ID NO: 302734 - protein, 19 aa, Mycobacterium
CVAYGRIGSLSARATGALL

SEQ ID NO: 302735 - protein, 21 aa, Mycobacterium
CVDARVDAVVLAFGDKRGLVE

SEQ ID NO: 302736 - protein, 21 aa, Mycobacterium
CVEEPALACLADRIIDRMDGT

SEQ ID NO: 302737 - protein, 24 aa, Mycobacterium
CVFVIAALTAAGWLLAGGSPDRAF

SEQ ID NO: 302738 - protein, 29 aa, Mycobacterium
CVGALAVFCAACWLIALLARNYRHEDWQA

SEQ ID NO: 302739 - protein, 20 aa, Mycobacterium
CVGLVGGIRVWNRIRERFGL

SEQ ID NO: 302740 - protein, 21 aa, Mycobacterium
CVHMLGALIRPRGPERAAVRD

SEQ ID NO: 302741 - protein, 22 aa, Mycobacterium
CVHTRDMARWVSVRMPEISVVN

SEQ ID NO: 302742 - protein, 17 aa, Mycobacterium
CVIDPKGGMELGAGAPM

SEQ ID NO: 302743 - protein, 18 aa, Mycobacterium
CVIDPKGGMELGAGAPMF

SEQ ID NO: 302744 - protein, 26 aa, Mycobacterium
CVIGASVRFGRWIFLVGAAARIALLG

SEQ ID NO: 302745 - protein, 19 aa, Mycobacterium
CVISTGLPMMFYTQLALGF

SEQ ID NO: 302746 - protein, 26 aa, Mycobacterium
CVKAEMLVGTPAMWWVAVPVLIFALW

SEQ ID NO: 302747 - protein, 20 aa, Mycobacterium
CVKAVMLVGTPAMWFIAVPV

SEQ ID NO: 302748 - protein, 20 aa, Mycobacterium
CVLLGVPMALVLARGDIPGQ

SEQ ID NO: 302749 - protein, 20 aa, Mycobacterium
CVLLGVPMALVLARSRARLV

SEQ ID NO: 302750 - protein, 18 aa, Mycobacterium
CVLSECLTGSPPYRADTI

SEQ ID NO: 302751 - protein, 25 aa, Mycobacterium
CVLWTRTLPAWAFFSLPTRAWELAI

SEQ ID NO: 302752 - protein, 19 aa, Mycobacterium
CVLYECLTAQHPFPGNTVD

SEQ ID NO: 302753 - protein, 19 aa, Mycobacterium
CVLYECLTGRVPFSGGGVE

SEQ ID NO: 302754 - protein, 17 aa, Mycobacterium
CVSAMFAMATLTAPVSS

SEQ ID NO: 302755 - protein, 17 aa, Mycobacterium
CVSGCPYGVIDRREGDG

SEQ ID NO: 302756 - protein, 25 aa, Mycobacterium
CVSLTPSLLPRDWLFQGLIGGINAA

SEQ ID NO: 302757 - protein, 18 aa, Mycobacterium
CVVPLPYAQADLDALQRV

SEQ ID NO: 302758 - protein, 18 aa, Mycobacterium
CVVQTHLFHDRIMRMDSV

SEQ ID NO: 302759 - protein, 18 aa, Mycobacterium
CVVQTHLFHDRIMRMDTV

SEQ ID NO: 302760 - protein, 17 aa, Mycobacterium
CVYAVGLKSKFGYDDSL

SEQ ID NO: 302761 - protein, 17 aa, Mycobacterium
CWGQIAALAGHIEKITG

SEQ ID NO: 302762 - protein, 19 aa, Mycobacterium
CWLLIGVPFGIAAVITGDI

SEQ ID NO: 302763 - protein, 24 aa, Mycobacterium
CWLMRRIKNRWPGISNLRLILVTY

SEQ ID NO: 302764 - protein, 24 aa, Mycobacterium
CWNDDLRAGQLRQALETSGVSNVA

SEQ ID NO: 302765 - protein, 25 aa, Mycobacterium
CWPSAPRWVGIPLYLMLGYVAIWFA

SEQ ID NO: 302766 - protein, 30 aa, Mycobacterium
CWPTAPRWLGVPLYLLLGWVAIWYAPTILH

SEQ ID NO: 302767 - protein, 26 aa, Mycobacterium
CWPTAPRWVGVPLYLLLGWVAVGFFP

SEQ ID NO: 302768 - protein, 25 aa, Mycobacterium
CWQPITHDLWPAPFLVMDVGASVAP

SEQ ID NO: 302769 - protein, 19 aa, Mycobacterium
CWVALIATVGLFFSGDYQG

SEQ ID NO: 302770 - protein, 18 aa, Mycobacterium
CWVVLLAAVGLFFTGDRQ

SEQ ID NO: 302771 - protein, 24 aa, Mycobacterium
CYASLRMSVRFIRRVAFTGYVVTV

SEQ ID NO: 302772 - protein, 19 aa, Mycobacterium
CYDGRRAVVTGCSSGIGAQ

SEQ ID NO: 302773 - protein, 21 aa, Mycobacterium
CYHAAGIWRRGLVGHPIKLLK

SEQ ID NO: 302774 - protein, 21 aa, Mycobacterium
CYHVAGIWRRGIVGHPLAVLK

SEQ ID NO: 302775 - protein, 21 aa, Mycobacterium
CYHVAGIWRRGVVGHPLAVLK

SEQ ID NO: 302776 - protein, 18 aa, Mycobacterium
CYPYREPLPAPPPGGPPP

SEQ ID NO: 302777 - protein, 17 aa, Mycobacterium
CYQARLVNGMVEVRGEP

SEQ ID NO: 302778 - protein, 24 aa, Mycobacterium
CYTSLRMSVRFIRRVAFTGYVVTV

SEQ ID NO: 302779 - protein, 26 aa, Mycobacterium
CYVGLRMSVSFLRRIAFSGFAFTIVL

SEQ ID NO: 302780 - protein, 26 aa, Mycobacterium
DAAAARCVAGEIGVPVIADPTISTHI

SEQ ID NO: 302781 - protein, 17 aa, Mycobacterium
DAACDRISDGAVFCGLL

SEQ ID NO: 302782 - protein, 18 aa, Mycobacterium
DAACDRISDGAVFGGLLW

SEQ ID NO: 302783 - protein, 19 aa, Mycobacterium
DAAEAIGFYRGERVERSQL

SEQ ID NO: 302784 - protein, 19 aa, Mycobacterium
DAAEAVAFYRGEFAERTGL

SEQ ID NO: 302785 - protein, 19 aa, Mycobacterium
DAAEAVGFYRGERVERGQL

SEQ ID NO: 302786 - protein, 19 aa, Mycobacterium
DAAEAVGFYRGERVERTQL

SEQ ID NO: 302787 - protein, 19 aa, Mycobacterium
DAAFPDAFAPRAASADAGP

SEQ ID NO: 302788 - protein, 20 aa, Mycobacterium
DAAGERELWIGLTVSAAANL

SEQ ID NO: 302789 - protein, 17 aa, Mycobacterium
DAAGFDFAQAGLPTGSS

SEQ ID NO: 302790 - protein, 21 aa, Mycobacterium
DAAGRFAGWMRANRLGLFCVA

SEQ ID NO: 302791 - protein, 24 aa, Mycobacterium
DAAGRMRVAASWVRGDSRRAVAVE

SEQ ID NO: 302792 - protein, 19 aa, Mycobacterium
DAAIDRWLLSPSPTAALQH

SEQ ID NO: 302793 - protein, 22 aa, Mycobacterium
DAAIRWESFGAWAAGAASALAA

SEQ ID NO: 302794 - protein, 26 aa, Mycobacterium
DAAKGASWVRYAALGAVAAIMVGALV

SEQ ID NO: 302795 - protein, 24 aa, Mycobacterium
DAAKKWAIWSVVAWVVFAVIYGIL

SEQ ID NO: 302796 - protein, 20 aa, Mycobacterium
DAAPAQAFWLSVAVAGGCVA

SEQ ID NO: 302797 - protein, 20 aa, Mycobacterium
DAAPGWLPNWLRPGASRPGL

SEQ ID NO: 302798 - protein, 24 aa, Mycobacterium
DAARPGRALPPWVTRSVDAPATRW

SEQ ID NO: 302799 - protein, 17 aa, Mycobacterium
DAARRTLNRPGFGLTDS

SEQ ID NO: 302800 - protein, 20 aa, Mycobacterium
DAARSPGMWHALANSVVVGL

SEQ ID NO: 302801 - protein, 22 aa, Mycobacterium
DAARVRPGTPLLQIDTSQVADR

SEQ ID NO: 302802 - protein, 22 aa, Mycobacterium
DAARVRPGTPLLQINTSQVADR

SEQ ID NO: 302803 - protein, 20 aa, Mycobacterium
DAASGAVRSVTWTAAPGGGI

SEQ ID NO: 302804 - protein, 18 aa, Mycobacterium
DAASGGVHSVTWTATPGG

SEQ ID NO: 302805 - protein, 26 aa, Mycobacterium
DAATGARPPVAFAPGDDGYSDDLPPL

SEQ ID NO: 302806 - protein, 17 aa, Mycobacterium
DAAVVAGRARPTGKTVF

SEQ ID NO: 302807 - protein, 21 aa, Mycobacterium
DACPYFPGVSYRDWTLADPAG

SEQ ID NO: 302808 - protein, 20 aa, Mycobacterium
DADAVITGFIGKWPSELGAQ

SEQ ID NO: 302809 - protein, 18 aa, Mycobacterium
DADGEMKAVETITAEFPS

SEQ ID NO: 302810 - protein, 22 aa, Mycobacterium
DADGFLWVLGRADQAIIRGGFK

SEQ ID NO: 302811 - protein, 25 aa, Mycobacterium
DADNLAIRLANRFLRTSQNYNGDRF

SEQ ID NO: 302812 - protein, 24 aa, Mycobacterium
DADRRNRPVLTFVLDAGMPGLTQG

SEQ ID NO: 302813 - protein, 24 aa, Mycobacterium
DADSHLLGVVAFRALVLADPERLV

SEQ ID NO: 302814 - protein, 27 aa, Mycobacterium
DADSSRWPSVKGVALVAVPGQDPVTVD

SEQ ID NO: 302815 - protein, 21 aa, Mycobacterium
DADTGAFLWNVMYGHEGRIWG

SEQ ID NO: 302816 - protein, 19 aa, Mycobacterium
DAEALCWNVGEVVELRGRT

SEQ ID NO: 302817 - protein, 30 aa, Mycobacterium
DAEATEATFLRWVWYAARRARLRLDGADDN

SEQ ID NO: 302818 - protein, 19 aa, Mycobacterium
DAEAVWTTRLSGPGGATQI

SEQ ID NO: 302819 - protein, 24 aa, Mycobacterium
DAEGRLGWPLWAAYVSVFALTVLV

SEQ ID NO: 302820 - protein, 28 aa, Mycobacterium
DAEHARKLLWRLLVAAVLFVPLADLSTM

SEQ ID NO: 302821 - protein, 28 aa, Mycobacterium
DAEMARQILRLGVPISLTYGSEAGITSL

SEQ ID NO: 302822 - protein, 23 aa, Mycobacterium
DAEPNPGDWLLWDGKRSPIDLAD

SEQ ID NO: 302823 - protein, 26 aa, Mycobacterium
DAERLASLRKRVCAAMRTGMERTSTQ

SEQ ID NO: 302824 - protein, 22 aa, Mycobacterium
DAETACRWRTLTAVDPGENKYQ

SEQ ID NO: 302825 - protein, 23 aa, Mycobacterium
DAEVLERLGPLIAAELRGGDVAS

SEQ ID NO: 302826 - protein, 19 aa, Mycobacterium
DAFDRSPGMRRLKLLEISY

SEQ ID NO: 302827 - protein, 19 aa, Mycobacterium
DAFGFARLLALPATALVAA

SEQ ID NO: 302828 - protein, 19 aa, Mycobacterium
DAFLRAATIAFVIGWGLDA

SEQ ID NO: 302829 - protein, 19 aa, Mycobacterium
DAFNDAWNADTFYLPPEAF

SEQ ID NO: 302830 - protein, 23 aa, Mycobacterium
DAFRRRFERDSAIAARLYHPHIV

SEQ ID NO: 302831 - protein, 25 aa, Mycobacterium
DAGAIQFDGQWSCWGQIAALAGHIE

SEQ ID NO: 302832 - protein, 18 aa, Mycobacterium
DAGAMWRYAGMAAGALVG

SEQ ID NO: 302833 - protein, 18 aa, Mycobacterium
DAGEAVGFYRGERAESVE

SEQ ID NO: 302834 - protein, 17 aa, Mycobacterium
DAGELKSAHLLSPAPRP

SEQ ID NO: 302835 - protein, 25 aa, Mycobacterium
DAGERGAVCAISWTQTALATGMLAA

SEQ ID NO: 302836 - protein, 21 aa, Mycobacterium
DAGLDLGQFAARASRLTGRPL

SEQ ID NO: 302837 - protein, 18 aa, Mycobacterium
DAGLRIVAGLVLLYLFLP

SEQ ID NO: 302838 - protein, 20 aa, Mycobacterium
DAGLRRGVMGGGELAAQAIA

SEQ ID NO: 302839 - protein, 24 aa, Mycobacterium
DAGRPRRAGVSSFGISGTNAHVIL

SEQ ID NO: 302840 - protein, 25 aa, Mycobacterium
DAGRRAPVLAAGWVTLGVALAVMGV

SEQ ID NO: 302841 - protein, 19 aa, Mycobacterium
DAGRSTWYTVDRPVYVALT

SEQ ID NO: 302842 - protein, 24 aa, Mycobacterium
DAHAMLRARLVTTATGWTLTVPDQ

SEQ ID NO: 302843 - protein, 19 aa, Mycobacterium
DAHLGRWATISCGVIVALI

SEQ ID NO: 302844 - protein, 23 aa, Mycobacterium
DAHLPFRSGRAFSASVSGTELTV

SEQ ID NO: 302845 - protein, 18 aa, Mycobacterium
DAIAALQNRGFKTRTLLK

SEQ ID NO: 302846 - protein, 17 aa, Mycobacterium
DAIAALQNRGFKTRTLQ

SEQ ID NO: 302847 - protein, 19 aa, Mycobacterium
DAIEKWATGYVRRHPIASL

SEQ ID NO: 302848 - protein, 30 aa, Mycobacterium
DAIGIPANFAGGLSLFFAVVIATSLSMVFG

SEQ ID NO: 302849 - protein, 19 aa, Mycobacterium
DAIGRRRAFLISFAVSAAG

SEQ ID NO: 302850 - protein, 23 aa, Mycobacterium
DAIPARWTWVAASFAIVAVSGLL

SEQ ID NO: 302851 - protein, 24 aa, Mycobacterium
DAIPRAVVLLARLSPSGALSEALA

SEQ ID NO: 302852 - protein, 21 aa, Mycobacterium
DAITLSVLILFGLAGATLTVL

SEQ ID NO: 302853 - protein, 26 aa, Mycobacterium
DAITSRLPLVLAVIAAITFVLLFVLT

SEQ ID NO: 302854 - protein, 25 aa, Mycobacterium
DAITSRLPLVLGLIAIIMFALLFLL

SEQ ID NO: 302855 - protein, 27 aa, Mycobacterium
DAITSRLPWLFGFVACVTLVLLFALTG

SEQ ID NO: 302856 - protein, 18 aa, Mycobacterium
DAITTWARSLAGITRQIA

SEQ ID NO: 302857 - protein, 18 aa, Mycobacterium
DAITVFLALVVVTSLSMV

SEQ ID NO: 302858 - protein, 18 aa, Mycobacterium
DAKAENRLGAGIDPTWLT

SEQ ID NO: 302859 - protein, 25 aa, Mycobacterium
DAKAGRRIGISWMILTAIGAITTGF

SEQ ID NO: 302860 - protein, 20 aa, Mycobacterium
DAKSWRRRMHVYSENHRFAL

SEQ ID NO: 302861 - protein, 25 aa, Mycobacterium
DAKVAGKTVSVWAVAGVTFANGGDN

SEQ ID NO: 302862 - protein, 20 aa, Mycobacterium
DALAAFLWMANWRFVAQKTD

SEQ ID NO: 302863 - protein, 17 aa, Mycobacterium
DALAERRPVHVGDPDVD

SEQ ID NO: 302864 - protein, 18 aa, Mycobacterium
DALARLLSLLPLGYAPGT

SEQ ID NO: 302865 - protein, 19 aa, Mycobacterium
DALDALAIRPIPYLVTTRL

SEQ ID NO: 302866 - protein, 19 aa, Mycobacterium
DALGFLQDFFATAVFLGIV

SEQ ID NO: 302867 - protein, 18 aa, Mycobacterium
DALGGWAGFSVGWLYWYF

SEQ ID NO: 302868 - protein, 19 aa, Mycobacterium
DALHDVWLAAASRRRKGFS

SEQ ID NO: 302869 - protein, 24 aa, Mycobacterium
DALHSDWAIVLAIAVATLVISVIA

SEQ ID NO: 302870 - protein, 25 aa, Mycobacterium
DALIGGAVAIVFAVLLFPADPMTVL

SEQ ID NO: 302871 - protein, 19 aa, Mycobacterium
DALKCGAQVVLPADADGHA

SEQ ID NO: 302872 - protein, 19 aa, Mycobacterium
DALLLPGGHRARGMRSYID

SEQ ID NO: 302873 - protein, 18 aa, Mycobacterium
DALNRPTPDRVRELVVAW

SEQ ID NO: 302874 - protein, 18 aa, Mycobacterium
DALPGWVFGVRIYVDALW

SEQ ID NO: 302875 - protein, 17 aa, Mycobacterium
DALPPVQRIELMTTHDL

SEQ ID NO: 302876 - protein, 21 aa, Mycobacterium
DALPVRVGVAVIGAIIVFGLM

SEQ ID NO: 302877 - protein, 26 aa, Mycobacterium
DALRIRLHRPAPMLWSLETTAAAPVS

SEQ ID NO: 302878 - protein, 27 aa, Mycobacterium
DALSRGFRTEFFIKTGLVLLGASINLK

SEQ ID NO: 302879 - protein, 17 aa, Mycobacterium
DALSVVGLGPWLESLPQ

SEQ ID NO: 302880 - protein, 25 aa, Mycobacterium
DALTAIPLWIAFALSTKAATRRYTY

SEQ ID NO: 302881 - protein, 25 aa, Mycobacterium
DALTAVPLWIAFALGRRAATRRYTY

SEQ ID NO: 302882 - protein, 24 aa, Mycobacterium
DALTAVPLWIAFALGTRAATRRYT

SEQ ID NO: 302883 - protein, 24 aa, Mycobacterium
DALTAVPLWIAFALSTKAATRRYT

SEQ ID NO: 302884 - protein, 19 aa, Mycobacterium
DALTGAWVRAAVNRARLDS

SEQ ID NO: 302885 - protein, 19 aa, Mycobacterium
DALTSLPFQSGWLPEEHAL

SEQ ID NO: 302886 - protein, 18 aa, Mycobacterium
DALVDARVSAVVNASPSI

SEQ ID NO: 302887 - protein, 23 aa, Mycobacterium
DALVLRPGALRTLDRVDAIMIDP

SEQ ID NO: 302888 - protein, 27 aa, Mycobacterium
DALVLRPRVLRTLDRIDAIMIDPRALY

SEQ ID NO: 302889 - protein, 19 aa, Mycobacterium
DALVPRLTRASVLIGKSTV

SEQ ID NO: 302890 - protein, 20 aa, Mycobacterium
DALVPRLTRSSVLVGKSTVP

SEQ ID NO: 302891 - protein, 26 aa, Mycobacterium
DAMDIARWSRRIAVQSAVAGMSLSLV

SEQ ID NO: 302892 - protein, 20 aa, Mycobacterium
DAMFGWLGYMSFWTLDIEYR

SEQ ID NO: 302893 - protein, 18 aa, Mycobacterium
DAMGLAWSAVVFVCEAGF

SEQ ID NO: 302894 - protein, 19 aa, Mycobacterium
DAMKVPGFVEPGGDKTQMW

SEQ ID NO: 302895 - protein, 17 aa, Mycobacterium
DAMRHSMALAHRVIQQL

SEQ ID NO: 302896 - protein, 17 aa, Mycobacterium
DAMRRLDAVWSNMATFE

SEQ ID NO: 302897 - protein, 24 aa, Mycobacterium
DANHRITTILGWGVGILISLLNMV

SEQ ID NO: 302898 - protein, 18 aa, Mycobacterium
DANHRVTTAFGWGVAGLI

SEQ ID NO: 302899 - protein, 23 aa, Mycobacterium
DANHRVTTLLGWIIAALISALNV

SEQ ID NO: 302900 - protein, 22 aa, Mycobacterium
DANKYVQCRVVATGNSLDAVWT

SEQ ID NO: 302901 - protein, 22 aa, Mycobacterium
DANKYVQCRVVATGNSVDAVWK

SEQ ID NO: 302902 - protein, 25 aa, Mycobacterium
DANTNAGLFLRYVIFGGENLSFADL

SEQ ID NO: 302903 - protein, 24 aa, Mycobacterium
DAPDRVCALLSRVAAALPQLDGGF

SEQ ID NO: 302904 - protein, 25 aa, Mycobacterium
DAPDRVCAMLTRVAGALPARKPEAS

SEQ ID NO: 302905 - protein, 26 aa, Mycobacterium
DAPDRVCAVLSRVARALPQLKPGSVP

SEQ ID NO: 302906 - protein, 25 aa, Mycobacterium
DAPFGYLDWLSWFGYTLVLNVVGGL

SEQ ID NO: 302907 - protein, 30 aa, Mycobacterium
DAPKDVLAGFNFGEQGVWAFARPGAPPLKA

SEQ ID NO: 302908 - protein, 20 aa, Mycobacterium
DAPLHYERFGPPPVVDGVPF

SEQ ID NO: 302909 - protein, 20 aa, Mycobacterium
DAPLRSGLLTGVFLVLVMFL

SEQ ID NO: 302910 - protein, 19 aa, Mycobacterium
DAPPGLLAELDWPTEAGGA

SEQ ID NO: 302911 - protein, 23 aa, Mycobacterium
DAPRVDWLGAVLIGAAVAVSVFG

SEQ ID NO: 302912 - protein, 20 aa, Mycobacterium
DAPSAVAMRRIGELFKESDS

SEQ ID NO: 302913 - protein, 25 aa, Mycobacterium
DAPTPPPRWWFTIGGATQLGESLAQ

SEQ ID NO: 302914 - protein, 17 aa, Mycobacterium
DAPWFDLAARPDLDPAL

SEQ ID NO: 302915 - protein, 19 aa, Mycobacterium
DAPYACMGGACGTCRAKLI

SEQ ID NO: 302916 - protein, 18 aa, Mycobacterium
DAQARPASTISIAGVPWP

SEQ ID NO: 302917 - protein, 24 aa, Mycobacterium
DAQRFLGADARFVRYEVPTTAGRP

SEQ ID NO: 302918 - protein, 23 aa, Mycobacterium
DAQVTARASLWGLEGDPEEPITM

SEQ ID NO: 302919 - protein, 26 aa, Mycobacterium
DARDASYPLGSLFGGPSVDDDLDRDL

SEQ ID NO: 302920 - protein, 23 aa, Mycobacterium
DARFFKQRYLTVSREFFDKHGPK

SEQ ID NO: 302921 - protein, 22 aa, Mycobacterium
DARFGWPKRNGFVQPLVDAELL

SEQ ID NO: 302922 - protein, 36 aa, Mycobacterium
DARGHRWAVIPGCWVFTLGVFLFWLLTTSRADYASR

SEQ ID NO: 302923 - protein, 21 aa, Mycobacterium
DARGNVIHPTRVVSVNEPCQA

SEQ ID NO: 302924 - protein, 24 aa, Mycobacterium
DARGRRLAWCPSDFAGVTVVSIEL

SEQ ID NO: 302925 - protein, 29 aa, Mycobacterium
DARHPFLVMELIEGGTLRELLAERGPMPP

SEQ ID NO: 302926 - protein, 23 aa, Mycobacterium
DARHPFLVMELIEGGTLRELLSE

SEQ ID NO: 302927 - protein, 18 aa, Mycobacterium
DARHPFLVMELVEGGTLR

SEQ ID NO: 302928 - protein, 20 aa, Mycobacterium
DARIGRRFLNAGLGFGGGCL

SEQ ID NO: 302929 - protein, 23 aa, Mycobacterium
DARISVRSVIHRHYLEVLRPLVR

SEQ ID NO: 302930 - protein, 19 aa, Mycobacterium
DARLEWQRRWSDALALWSR

SEQ ID NO: 302931 - protein, 19 aa, Mycobacterium
DARMAIAAIAVLRVGAVLL

SEQ ID NO: 302932 - protein, 20 aa, Mycobacterium
DARPELINMYGITETTVHVT

SEQ ID NO: 302933 - protein, 18 aa, Mycobacterium
DARQLSLRMIVTGAAPIS

SEQ ID NO: 302934 - protein, 21 aa, Mycobacterium
DARTLARVMLSMALANAAAMD

SEQ ID NO: 302935 - protein, 23 aa, Mycobacterium
DASAGWLRLGALVLALAGLAALL

SEQ ID NO: 302936 - protein, 22 aa, Mycobacterium
DASALDVAALWAPRNRDDELRV

SEQ ID NO: 302937 - protein, 23 aa, Mycobacterium
DASALDVASLWAPRPRDEELRVP

SEQ ID NO: 302938 - protein, 21 aa, Mycobacterium
DASATVFLAAWVPLFASFGAM

SEQ ID NO: 302939 - protein, 21 aa, Mycobacterium
DASAVRWSWVLDGMVEIGALS

SEQ ID NO: 302940 - protein, 25 aa, Mycobacterium
DASDLRTLLAPALADRSGFTGDATG

SEQ ID NO: 302941 - protein, 17 aa, Mycobacterium
DASIWIRLPDLICALIC

SEQ ID NO: 302942 - protein, 22 aa, Mycobacterium
DASLRLLAPGGRFIEMGKTDVR

SEQ ID NO: 302943 - protein, 24 aa, Mycobacterium
DASLRLLVPGGRFIEMGKTDLRDP

SEQ ID NO: 302944 - protein, 24 aa, Mycobacterium
DASLRLLVPGGYFIEMGKTDLRDP

SEQ ID NO: 302945 - protein, 21 aa, Mycobacterium
DASLRLLVSGGRFIEMGKTDL

SEQ ID NO: 302946 - protein, 18 aa, Mycobacterium
DASLWMRLPDLFAGIVCW

SEQ ID NO: 302947 - protein, 18 aa, Mycobacterium
DASMLLALQGQRGTNPQD

SEQ ID NO: 302948 - protein, 18 aa, Mycobacterium
DASRGWAQVPRRLPTITV

SEQ ID NO: 302949 - protein, 22 aa, Mycobacterium
DASRLDVPALWAPRRRDDELRV

SEQ ID NO: 302950 - protein, 19 aa, Mycobacterium
DASRLDVPTLWAPRRREDE

SEQ ID NO: 302951 - protein, 23 aa, Mycobacterium
DASWPASRAELVLADSAPSAILT

SEQ ID NO: 302952 - protein, 18 aa, Mycobacterium
DATGPAFLFDLITAAQSH

SEQ ID NO: 302953 - protein, 26 aa, Mycobacterium
DATIIRMFLVPAIMKLLGDDCWWAPR

SEQ ID NO: 302954 - protein, 26 aa, Mycobacterium
DATIIRMFLVPAVMKLLGDDCWWAPR

SEQ ID NO: 302955 - protein, 17 aa, Mycobacterium
DATKNFPVRQLVTDTGW

SEQ ID NO: 302956 - protein, 24 aa, Mycobacterium
DATLIRMLIIFGIVTAIALAAATI

SEQ ID NO: 302957 - protein, 24 aa, Mycobacterium
DATLIRMLVIFGIVTAVALAAATI

SEQ ID NO: 302958 - protein, 24 aa, Mycobacterium
DATMIRMLIIFGIVTIVALVAATT

SEQ ID NO: 302959 - protein, 25 aa, Mycobacterium
DATMLRMLVMFGIVTAVALLAATTA

SEQ ID NO: 302960 - protein, 22 aa, Mycobacterium
DATRAICSRSHLMGEGEAMLFG

SEQ ID NO: 302961 - protein, 21 aa, Mycobacterium
DATVSVAGFPAVNSDIQRFLW

SEQ ID NO: 302962 - protein, 27 aa, Mycobacterium
DATVVRMLLIPAVMKLLGDDCWWAPAW

SEQ ID NO: 302963 - protein, 23 aa, Mycobacterium
DATWDLSDGEARSILSATSTLLH

SEQ ID NO: 302964 - protein, 21 aa, Mycobacterium
DAVACAIPLAPIEKLLDDLGV

SEQ ID NO: 302965 - protein, 21 aa, Mycobacterium
DAVACAIPLPPIAKILDDLGV

SEQ ID NO: 302966 - protein, 23 aa, Mycobacterium
DAVCSAIEKAMRFDPAERPASAA

SEQ ID NO: 302967 - protein, 26 aa, Mycobacterium
DAVEHTARLALLKRAEIAGEVDEVEE

SEQ ID NO: 302968 - protein, 31 aa, Mycobacterium
DAVGAMLSRIPAHYPLRGVVHAAGILDDGLI

SEQ ID NO: 302969 - protein, 19 aa, Mycobacterium
DAVGAVLLTIAWVVVICAM

SEQ ID NO: 302970 - protein, 17 aa, Mycobacterium
DAVGGLLGISPLAVAKI

SEQ ID NO: 302971 - protein, 17 aa, Mycobacterium
DAVGVSGIWDGSTLFAD

SEQ ID NO: 302972 - protein, 24 aa, Mycobacterium
DAVKERRSDLALANLSSDAFRKQY

SEQ ID NO: 302973 - protein, 37 aa, Mycobacterium
DAVKRARDLLSAEIWIVLVLLVVCIGLELHGPEGQIL

SEQ ID NO: 302974 - protein, 19 aa, Mycobacterium
DAVLARRRRNVLIGVGAGL

SEQ ID NO: 302975 - protein, 28 aa, Mycobacterium
DAVPLRHPWRWVAAAVIIVLVGLFLWGA

SEQ ID NO: 302976 - protein, 24 aa, Mycobacterium
DAVRASMAIPFFYRPVKLTGADGS

SEQ ID NO: 302977 - protein, 25 aa, Mycobacterium
DAVTDRLPLVLGLMAAITFALLFLL

SEQ ID NO: 302978 - protein, 26 aa, Mycobacterium
DAWHYMTRWALLFGITEQMCPKTGAD

SEQ ID NO: 302979 - protein, 22 aa, Mycobacterium
DAWLGLCQTYGWAPGVMGASTQ

SEQ ID NO: 302980 - protein, 19 aa, Mycobacterium
DAWYWPANVLRLLIVCAVV

SEQ ID NO: 302981 - protein, 25 aa, Mycobacterium
DAYLKALGANAVDFTWITDFKPYQP

SEQ ID NO: 302982 - protein, 21 aa, Mycobacterium
DAYVPGELWILLIGGGGVMMA

SEQ ID NO: 302983 - protein, 19 aa, Mycobacterium
DCDDYRPITLTIYGSTVVQ

SEQ ID NO: 302984 - protein, 20 aa, Mycobacterium
DCFRGRRLTSVSGLLGVAWG

SEQ ID NO: 302985 - protein, 23 aa, Mycobacterium
DCFRPGTCERLGIGPDDCAAANP

SEQ ID NO: 302986 - protein, 23 aa, Mycobacterium
DCFRPGTCERLGIGPDDCAAVNP

SEQ ID NO: 302987 - protein, 25 aa, Mycobacterium
DCGADLKLAALEGLPHVGGVAIRGD

SEQ ID NO: 302988 - protein, 20 aa, Mycobacterium
DCLFGLLALLAVLNAATLRG

SEQ ID NO: 302989 - protein, 19 aa, Mycobacterium
DCLPSQLPFRSLFAGPVTG

SEQ ID NO: 302990 - protein, 20 aa, Mycobacterium
DCLVYAGLVGAGFAWLEDIL

SEQ ID NO: 302991 - protein, 22 aa, Mycobacterium
DCPGCGSLRMLYSLMHGNIMAA

SEQ ID NO: 302992 - protein, 22 aa, Mycobacterium
DCPQTRITGVPGRGPETRTANQ

SEQ ID NO: 302993 - protein, 20 aa, Mycobacterium
DCSGLTRFAFAGVGVLLPRW

SEQ ID NO: 302994 - protein, 20 aa, Mycobacterium
DCSRYKCVALTFDDGPTPFT

SEQ ID NO: 302995 - protein, 17 aa, Mycobacterium
DCVEPLFDDCAAAPELP

SEQ ID NO: 302996 - protein, 26 aa, Mycobacterium
DDAARRASCLTGLGLSASTPVLGAQT

SEQ ID NO: 302997 - protein, 29 aa, Mycobacterium
DDAFLTWSLCSGFWILMFPFMGELDFYHV

SEQ ID NO: 302998 - protein, 23 aa, Mycobacterium
DDAGSKLAGWLPQGPAAVADYPT

SEQ ID NO: 302999 - protein, 25 aa, Mycobacterium
DDALELRGRILGAFEAAEVATDHAE

SEQ ID NO: 303000 - protein, 25 aa, Mycobacterium
DDALELRGRILGAFEAAEVATDHDE

SEQ ID NO: 303001 - protein, 19 aa, Mycobacterium
DDALGPWLLLVRDLAHLLD

SEQ ID NO: 303002 - protein, 30 aa, Mycobacterium
DDARAHVWPIPAFMLGIAMAARIEAGHARL

SEQ ID NO: 303003 - protein, 30 aa, Mycobacterium
DDAWALTVVHLRLSLVPVLVGLALAVPLGA

SEQ ID NO: 303004 - protein, 25 aa, Mycobacterium
DDAWRHYRFAVAYLMVLPVIILVGW

SEQ ID NO: 303005 - protein, 30 aa, Mycobacterium
DDAWWLTIVHLRLSLVPVVIGLAIALPLGL

SEQ ID NO: 303006 - protein, 20 aa, Mycobacterium
DDAYRFAVVLSLPVTVLVAG

SEQ ID NO: 303007 - protein, 21 aa, Mycobacterium
DDAYRRPTLYNPLNQAMTFRY

SEQ ID NO: 303008 - protein, 24 aa, Mycobacterium
DDDEIRVPWTLKPRERTSTGRKSS

SEQ ID NO: 303009 - protein, 24 aa, Mycobacterium
DDDELRWIAGTAYVGSGADPAAIE

SEQ ID NO: 303010 - protein, 19 aa, Mycobacterium
DDDGFVYFVGRLSAMVKTA

SEQ ID NO: 303011 - protein, 30 aa, Mycobacterium
DDDMALLPGRVVPSRALWAALFESLLTDRN

SEQ ID NO: 303012 - protein, 33 aa, Mycobacterium
DDDPNSLLPRWLPATTGSHGWLAKVRADPGRAG

SEQ ID NO: 303013 - protein, 19 aa, Mycobacterium
DDEAAVAELTRLVSGAENM

SEQ ID NO: 303014 - protein, 17 aa, Mycobacterium
DDFAYLVDFGIASATGD

SEQ ID NO: 303015 - protein, 38 aa, Mycobacterium
DDFFRPLRNYFYWEKHCFDIPICQSLRSIFDVLDSVDV

SEQ ID NO: 303016 - protein, 39 aa, Mycobacterium
DDFFRPLRSYFYWERHCYDIPICWSLRSIFDALDGIDKL

SEQ ID NO: 303017 - protein, 38 aa, Mycobacterium
DDFFRPVRNYFYWEPHCYDIPVCWTMRSVFDTLDGINP

SEQ ID NO: 303018 - protein, 24 aa, Mycobacterium
DDFSKAAVVAGIYGDAGPDIATVL

SEQ ID NO: 303019 - protein, 18 aa, Mycobacterium
DDGFKKKKIVDVLRESLR

SEQ ID NO: 303020 - protein, 21 aa, Mycobacterium
DDGHLWIAMEYVEGTAANDLD

SEQ ID NO: 303021 - protein, 22 aa, Mycobacterium
DDGNFLVVLAVRPHEEPAQPPQ

SEQ ID NO: 303022 - protein, 21 aa, Mycobacterium
DDGPRTPAMPSTWDGDPAPSP

SEQ ID NO: 303023 - protein, 18 aa, Mycobacterium
DDGRLDAAGFGFAAVAGA

SEQ ID NO: 303024 - protein, 21 aa, Mycobacterium
DDGWVFPVNRPLAPEPGDTQA

SEQ ID NO: 303025 - protein, 22 aa, Mycobacterium
DDIAAACGIILSGSAKAVGAKH

SEQ ID NO: 303026 - protein, 27 aa, Mycobacterium
DDIPQARPTVKLGVPLVNPEVTTSSTT

SEQ ID NO: 303027 - protein, 28 aa, Mycobacterium
DDITLRKDARASIKITTILGNQYVELRN

SEQ ID NO: 303028 - protein, 25 aa, Mycobacterium
DDKFIRWPVIIALAVVVGAMYVLHL

SEQ ID NO: 303029 - protein, 21 aa, Mycobacterium
DDKLGAVLRAFSSRLPNQKLP

SEQ ID NO: 303030 - protein, 24 aa, Mycobacterium
DDKNIRLAPTFPPLETVGAAVDGL

SEQ ID NO: 303031 - protein, 23 aa, Mycobacterium
DDKPWRVPVAFVIAQGTATVINF

SEQ ID NO: 303032 - protein, 23 aa, Mycobacterium
DDKRIRLWVVYVEDFSGQSAQTW

SEQ ID NO: 303033 - protein, 25 aa, Mycobacterium
DDLGVPHRIRWIFPPIKAASAVGLI

SEQ ID NO: 303034 - protein, 17 aa, Mycobacterium
DDLKSGVVRFVSKPPVA

SEQ ID NO: 303035 - protein, 25 aa, Mycobacterium
DDLLACLYGLYALLRLHFVQEEESY

SEQ ID NO: 303036 - protein, 20 aa, Mycobacterium
DDLLAIIVIAVFYTTQLSFG

SEQ ID NO: 303037 - protein, 17 aa, Mycobacterium
DDLRAAVDAIRLSRRTL

SEQ ID NO: 303038 - protein, 23 aa, Mycobacterium
DDLRLYLDGGLQFATVDEYRYSE

SEQ ID NO: 303039 - protein, 22 aa, Mycobacterium
DDLRPSALAGFIAHFSTAVEGL

SEQ ID NO: 303040 - protein, 23 aa, Mycobacterium
DDLSDADALRWAAALEARSEHPL

SEQ ID NO: 303041 - protein, 30 aa, Mycobacterium
DDLWELTVIHLRLSLVPIVLGLLIAVPLGA

SEQ ID NO: 303042 - protein, 25 aa, Mycobacterium
DDLWVLTLIHLRLSLIPIVLGLLIA

SEQ ID NO: 303043 - protein, 20 aa, Mycobacterium
DDMARLAVSFNDMAESLSRQ

SEQ ID NO: 303044 - protein, 22 aa, Mycobacterium
DDMEGLREFQLPYAKNRNRLGV

SEQ ID NO: 303045 - protein, 24 aa, Mycobacterium
DDNAKAALLAALRNVLTPGVTVID

SEQ ID NO: 303046 - protein, 25 aa, Mycobacterium
DDPGRYALTASYAFHRRKGLPNSYG

SEQ ID NO: 303047 - protein, 25 aa, Mycobacterium
DDPKLGEPVVYPRGTLAMANAGPGT

SEQ ID NO: 303048 - protein, 30 aa, Mycobacterium
DDPNSLLPRWLPEAGDGSGLLSRVRADPGR

SEQ ID NO: 303049 - protein, 17 aa, Mycobacterium
DDPRYVIGIEMNAPKRG

SEQ ID NO: 303050 - protein, 25 aa, Mycobacterium
DDPYRFPDNLPIIGAKGGPGGKPGC

SEQ ID NO: 303051 - protein, 22 aa, Mycobacterium
DDQRIQAIIITFSFGALLEALA

SEQ ID NO: 303052 - protein, 35 aa, Mycobacterium
DDQRPSKRKGRRVNVARWAAALILAVVLAGAGYEG

SEQ ID NO: 303053 - protein, 22 aa, Mycobacterium
DDRFVRVAISFSGTLNAICDSI

SEQ ID NO: 303054 - protein, 22 aa, Mycobacterium
DDRGRVVIMLNDRARADPDLPF

SEQ ID NO: 303055 - protein, 24 aa, Mycobacterium
DDRMPHLFGLRAEKPVYRYGVVAL

SEQ ID NO: 303056 - protein, 18 aa, Mycobacterium
DDRRPRRSPAVPLAGRPG

SEQ ID NO: 303057 - protein, 21 aa, Mycobacterium
DDRSQWGVAGWSMGGTCALDL

SEQ ID NO: 303058 - protein, 28 aa, Mycobacterium
DDRTRLYLPMPFFWVGGFGGGLLSALVA

SEQ ID NO: 303059 - protein, 28 aa, Mycobacterium
DDSGLRAVLPLAVHGKWVVLHNPNDAPN

SEQ ID NO: 303060 - protein, 27 aa, Mycobacterium
DDSGPGIWKWIAIGLLALGIIGALLGV

SEQ ID NO: 303061 - protein, 24 aa, Mycobacterium
DDSMLKVKMWLFPVLSILTAAAIF

SEQ ID NO: 303062 - protein, 20 aa, Mycobacterium
DDSRFGIGLLLDGILVAASL

SEQ ID NO: 303063 - protein, 19 aa, Mycobacterium
DDSTMAWGEINDSSSSNAQ

SEQ ID NO: 303064 - protein, 23 aa, Mycobacterium
DDTDFLRRVGLEQPVPGAEAETE

SEQ ID NO: 303065 - protein, 22 aa, Mycobacterium
DDTLRCFAQLFGDDALKPLDYV

SEQ ID NO: 303066 - protein, 25 aa, Mycobacterium
DDTREVREALGLKTKPALAPWVALR

SEQ ID NO: 303067 - protein, 25 aa, Mycobacterium
DDTREVREALGLKTKPSLAPWVALR

SEQ ID NO: 303068 - protein, 18 aa, Mycobacterium
DDTWPVLPVHPRNPEKLV

SEQ ID NO: 303069 - protein, 18 aa, Mycobacterium
DDVAMPLHRIRAVPAAHD

SEQ ID NO: 303070 - protein, 23 aa, Mycobacterium
DDVFWSFLEAIIIAAIVMVTHCY

SEQ ID NO: 303071 - protein, 19 aa, Mycobacterium
DDVLPYMRFNANRALANLG

SEQ ID NO: 303072 - protein, 17 aa, Mycobacterium
DDVPDFMQIQGIRELPS

SEQ ID NO: 303073 - protein, 20 aa, Mycobacterium
DDVRGRLQGVFTVVVAGGPR

SEQ ID NO: 303074 - protein, 30 aa, Mycobacterium
DDVRRDGAGELLVWLPYPGFAAYLQVGCGQ

SEQ ID NO: 303075 - protein, 19 aa, Mycobacterium
DDVTPIPAGFEVRNGGTTY

SEQ ID NO: 303076 - protein, 19 aa, Mycobacterium
DDWAWLKVTLVISGIALAM

SEQ ID NO: 303077 - protein, 17 aa, Mycobacterium
DDWFGELVMSLFTASGY

SEQ ID NO: 303078 - protein, 18 aa, Mycobacterium
DDWKRSWKPWLRGTAYGF

SEQ ID NO: 303079 - protein, 32 aa, Mycobacterium
DDYRPNLFVTYWSFRLMIGFLVFPVAFALAVL

SEQ ID NO: 303080 - protein, 24 aa, Mycobacterium
DDYRRLRVRGQRLLALYFPLVPLT

SEQ ID NO: 303081 - protein, 20 aa, Mycobacterium
DEAIPIRYAHWASHAVRGDF

SEQ ID NO: 303082 - protein, 23 aa, Mycobacterium
DEAIRGGPFVLIFVDIDDFKEVN

SEQ ID NO: 303083 - protein, 21 aa, Mycobacterium
DEALRAGAMTPLRAVHIISEV

SEQ ID NO: 303084 - protein, 22 aa, Mycobacterium
DEARAAIRAWIAQAVTWHDPTM

SEQ ID NO: 303085 - protein, 24 aa, Mycobacterium
DEARFLQIHIDRISPDLVTTTSDS

SEQ ID NO: 303086 - protein, 25 aa, Mycobacterium
DEARIRCLWVTFAGCAVLMSSTAVY

SEQ ID NO: 303087 - protein, 24 aa, Mycobacterium
DEASRRIELHVGRDLQFIRINGTV

SEQ ID NO: 303088 - protein, 17 aa, Mycobacterium
DEASVQVIVGWVASSLA

SEQ ID NO: 303089 - protein, 21 aa, Mycobacterium
DECDLSLAGFLVFADEPKSAA

SEQ ID NO: 303090 - protein, 25 aa, Mycobacterium
DECDQALGACTGWSVRAVLRGEPGA

SEQ ID NO: 303091 - protein, 18 aa, Mycobacterium
DEFGLALADSDRLAERLD

SEQ ID NO: 303092 - protein, 20 aa, Mycobacterium
DEFQVLYAARRLRPRPMPVT

SEQ ID NO: 303093 - protein, 17 aa, Mycobacterium
DEFREWKQLNGRLAKLL

SEQ ID NO: 303094 - protein, 42 aa, Mycobacterium
DEGGWRRIGAAVVRWPGPILVVTCGIALVGLLTLPGYTPGYD

SEQ ID NO: 303095 - protein, 29 aa, Mycobacterium
DEHGAPRWPWVVGIAAIVAAIALVVSVSL

SEQ ID NO: 303096 - protein, 30 aa, Mycobacterium
DEHGAPRWPWVVGVAAILAAIALVVSVSLL

SEQ ID NO: 303097 - protein, 17 aa, Mycobacterium
DEIGCHYLVMATGCLSV

SEQ ID NO: 303098 - protein, 29 aa, Mycobacterium
DEILWPLTVLFCVGFIARGIFLGRPVTYG

SEQ ID NO: 303099 - protein, 24 aa, Mycobacterium
DEIPDVAALFAVHGVDGLPFTWSV

SEQ ID NO: 303100 - protein, 19 aa, Mycobacterium
DEIPVLVLPTGKRIEFDLA

SEQ ID NO: 303101 - protein, 17 aa, Mycobacterium
DEIPVLVLPTGKRIQFQ

SEQ ID NO: 303102 - protein, 29 aa, Mycobacterium
DEIRGVAVPRLWLSYGLTATSTAALLGTF

SEQ ID NO: 303103 - protein, 22 aa, Mycobacterium
DEISERVYLTRVMQAAAEWTDV

SEQ ID NO: 303104 - protein, 23 aa, Mycobacterium
DEKKGTWGPRMVYTETKLNSAFS

SEQ ID NO: 303105 - protein, 20 aa, Mycobacterium
DEKLAFGIRDLFMVTVLSSI

SEQ ID NO: 303106 - protein, 20 aa, Mycobacterium
DEKPWFFALTDHISIAEAEE

SEQ ID NO: 303107 - protein, 23 aa, Mycobacterium
DEKTILRILGWMGLHDVAIPSVL

SEQ ID NO: 303108 - protein, 18 aa, Mycobacterium
DELDRWQLRFPVRAATVG

SEQ ID NO: 303109 - protein, 17 aa, Mycobacterium
DELGWHAPYALVHHAEE

SEQ ID NO: 303110 - protein, 23 aa, Mycobacterium
DELHLRVVLICAGVIAGTVVVGW

SEQ ID NO: 303111 - protein, 22 aa, Mycobacterium
DELHTIPTLIGLARQARRVVTA

SEQ ID NO: 303112 - protein, 19 aa, Mycobacterium
DELKAMGITPVLLTGDNAE

SEQ ID NO: 303113 - protein, 19 aa, Mycobacterium
DELLPQMVALMPKMTQTVR

SEQ ID NO: 303114 - protein, 20 aa, Mycobacterium
DELLPQMVALMPKMTQTVRN

SEQ ID NO: 303115 - protein, 18 aa, Mycobacterium
DELLRWLNSDNKRWQRLK

SEQ ID NO: 303116 - protein, 35 aa, Mycobacterium
DELPGLRPGTGLTMLTWLMRIGFLGAPLIVGVVAD

SEQ ID NO: 303117 - protein, 22 aa, Mycobacterium
DELPWEPPTVFLMRHGANDTYT

SEQ ID NO: 303118 - protein, 21 aa, Mycobacterium
DELRADGTLAQISQKYLKADA

SEQ ID NO: 303119 - protein, 20 aa, Mycobacterium
DELRTNFAHDLAMAVPVVVP

SEQ ID NO: 303120 - protein, 21 aa, Mycobacterium
DELRVPIGVTATGEPLIFDLK

SEQ ID NO: 303121 - protein, 21 aa, Mycobacterium
DEMEAVIALAFFIPLLIGTGG

SEQ ID NO: 303122 - protein, 22 aa, Mycobacterium
DENNLRFGIRDLFMVTVLSAVF

SEQ ID NO: 303123 - protein, 18 aa, Mycobacterium
DENRPLTFHLPRLEHSTL

SEQ ID NO: 303124 - protein, 24 aa, Mycobacterium
DEPDLRVTTIFPGRTDTDMQRELV

SEQ ID NO: 303125 - protein, 34 aa, Mycobacterium
DEPMTARGWRRRVLLGVVALVFAALLAVSGVLGW

SEQ ID NO: 303126 - protein, 21 aa, Mycobacterium
DEPRIRQVLSNLVANALQHTP

SEQ ID NO: 303127 - protein, 21 aa, Mycobacterium
DEPRLRQVLSNLVGNALQHTP

SEQ ID NO: 303128 - protein, 23 aa, Mycobacterium
DEPTHWLATVVRMDGRRIDLLEL

SEQ ID NO: 303129 - protein, 19 aa, Mycobacterium
DEPYVPLGTNPWYGDPNQI

SEQ ID NO: 303130 - protein, 23 aa, Mycobacterium
DERAYPGFVRRVLTSALPSGLVV

SEQ ID NO: 303131 - protein, 23 aa, Mycobacterium
DERDRISLWGRILPITFTALGLV

SEQ ID NO: 303132 - protein, 30 aa, Mycobacterium
DERDRLALWSRVLPITFTAIGLVALVGGGL

SEQ ID NO: 303133 - protein, 35 aa, Mycobacterium; identical to SEQ ID NO: 10713

SEQ ID NO: 303134 - protein, 33 aa, Mycobacterium
DERDRLALWSRVLPITFTAVGVIALVAGGLLAS

SEQ ID NO: 303135 - protein, 18 aa, Mycobacterium
DERFMSWAPFTKGVDYAG

SEQ ID NO: 303136 - protein, 32 aa, Mycobacterium
DERGFPVTEFNVALPWTKMVVLNPGVQTESVV

SEQ ID NO: 303137 - protein, 21 aa, Mycobacterium
DERGFSMALGRLGDPADADCL

SEQ ID NO: 303138 - protein, 18 aa, Mycobacterium
DERLKRFGTMAAAMVLYV

SEQ ID NO: 303139 - protein, 19 aa, Mycobacterium
DERLNRWRLVALALGVVAV

SEQ ID NO: 303140 - protein, 18 aa, Mycobacterium
DERTDVWVGPRPVTPDGR

SEQ ID NO: 303141 - protein, 18 aa, Mycobacterium
DERTSRKPSSRIAEDQSE

SEQ ID NO: 303142 - protein, 23 aa, Mycobacterium
DERVWRVGDTLIRSSGDGTELTS

SEQ ID NO: 303143 - protein, 20 aa, Mycobacterium
DERYILSWQGWETVPVTNPA

SEQ ID NO: 303144 - protein, 18 aa, Mycobacterium
DERYMSAGDLAIAAHEAL

SEQ ID NO: 303145 - protein, 24 aa, Mycobacterium
DESDWGVPGLRVDLGAWQFTAESP

SEQ ID NO: 303146 - protein, 38 aa, Mycobacterium
DESERSRRGLLRRPKLSTLTAALAVLVILAALAGSAYM

SEQ ID NO: 303147 - protein, 24 aa, Mycobacterium
DESNFPAIVKFLSEDVLGRRNDQL

SEQ ID NO: 303148 - protein, 28 aa, Mycobacterium
DESPAVLVGRLMFLLGLPATGLTLLIIG

SEQ ID NO: 303149 - protein, 17 aa, Mycobacterium
DETCGPVPFGLDLYIHP

SEQ ID NO: 303150 - protein, 28 aa, Mycobacterium
DETEFRARLWLPYLPLILAAAAGWAHAA

SEQ ID NO: 303151 - protein, 27 aa, Mycobacterium
DETSAVWAYDFAWRPAPVFQTYSAYTP

SEQ ID NO: 303152 - protein, 25 aa, Mycobacterium
DEVAPRIRNALGFNGYSLGAASSGA

SEQ ID NO: 303153 - protein, 20 aa, Mycobacterium
DEVEARLALGQPSRQAAAPY

SEQ ID NO: 303154 - protein, 26 aa, Mycobacterium
DEVLDHFPGWDFGWLDLDKMIRGAEY

SEQ ID NO: 303155 - protein, 21 aa, Mycobacterium
DEVLQVPGSIHMGGVTVRDAW

SEQ ID NO: 303156 - protein, 24 aa, Mycobacterium
DEVLRSGIYLWLGVRGEVHTGRFR

SEQ ID NO: 303157 - protein, 26 aa, Mycobacterium
DEVQAARLSRLWFDALAGICAHVRSG

SEQ ID NO: 303158 - protein, 17 aa, Mycobacterium
DEVRVGDLVRVRPGEKI

SEQ ID NO: 303159 - protein, 24 aa, Mycobacterium
DEVTEYFLVGSFTSWLLALGGIAL

SEQ ID NO: 303160 - protein, 17 aa, Mycobacterium
DEVVEYFLVGSFASWIF

SEQ ID NO: 303161 - protein, 19 aa, Mycobacterium
DEVYGRWMLAAILVGVPAL

SEQ ID NO: 303162 - protein, 17 aa, Mycobacterium
DEWAVTLALALRAFPML

SEQ ID NO: 303163 - protein, 23 aa, Mycobacterium
DEWPARWAQRIGHQKPDVVLLMV

SEQ ID NO: 303164 - protein, 17 aa, Mycobacterium
DEWRAEVMPEDKLEVVR

SEQ ID NO: 303165 - protein, 24 aa, Mycobacterium
DEWRAEVMPEDKLEVVRGLQDEGY

SEQ ID NO: 303166 - protein, 23 aa, Mycobacterium
DEYPEFPPRQGGPASSEPPAESP

SEQ ID NO: 303167 - protein, 20 aa, Mycobacterium
DFAADFKDLYAVVKELNDHV

SEQ ID NO: 303168 - protein, 20 aa, Mycobacterium
DFAPALLILMVLVVATLASV

SEQ ID NO: 303169 - protein, 24 aa, Mycobacterium
DFAPYVVVTGIGWLIMMVTTTSSC

SEQ ID NO: 303170 - protein, 25 aa, Mycobacterium
DFATIGMWAPIALVLLRILQGLGAG

SEQ ID NO: 303171 - protein, 18 aa, Mycobacterium
DFAVTLWTAAWLLVGLAV

SEQ ID NO: 303172 - protein, 23 aa, Mycobacterium
DFCIYGTAAALVFPAVFYPGLSP

SEQ ID NO: 303173 - protein, 20 aa, Mycobacterium
DFDVAIAYLVRRLEEGSSHQ

SEQ ID NO: 303174 - protein, 22 aa, Mycobacterium
DFECEGCRAVYPEIEQLRAEYG

SEQ ID NO: 303175 - protein, 24 aa, Mycobacterium
DFELSRPGALIAALPAVLGFIPEN

SEQ ID NO: 303176 - protein, 24 aa, Mycobacterium
DFFLSGRSLPAWVTGLAFVSANLG

SEQ ID NO: 303177 - protein, 24 aa, Mycobacterium
DFFLYATAASLVFNHAFFPDQSSF

SEQ ID NO: 303178 - protein, 19 aa, Mycobacterium
DFFLYATAASLVFNQAFFP

SEQ ID NO: 303179 - protein, 17 aa, Mycobacterium
DFFRPIRNYFYWEKHCA

SEQ ID NO: 303180 - protein, 38 aa, Mycobacterium
DFFRPIRNYFYWEPHCFNIPICWALRSVFDSLDGINTL

SEQ ID NO: 303181 - protein, 37 aa, Mycobacterium
DFFRPIRNYFYWEPHCYNIPVCWALRSVFDTLDGINI

SEQ ID NO: 303182 - protein, 38 aa, Mycobacterium
DFFRPLRSYFYWEQHCFNIPICWAMRSVFDGLDGVDKL

SEQ ID NO: 303183 - protein, 39 aa, Mycobacterium
DFFRPVRSYFYWEKHCYDIPACFAFRSLFDAIDGIDQLT

SEQ ID NO: 303184 - protein, 38 aa, Mycobacterium
DFFRPVRSYFYWERHCFDIPACFAFRSLFDALDGIDQL

SEQ ID NO: 303185 - protein, 23 aa, Mycobacterium
DFGEIDGQLFIDMRFIEGTDLGS

SEQ ID NO: 303186 - protein, 18 aa, Mycobacterium
DFGIAGWVGEASGLTATN

SEQ ID NO: 303187 - protein, 24 aa, Mycobacterium
DFGIARAAGELGLTTVGDVIGTCH

SEQ ID NO: 303188 - protein, 19 aa, Mycobacterium
DFGRLVWVRLLTQFSDGLF

SEQ ID NO: 303189 - protein, 25 aa, Mycobacterium
DFKIDLGDPPPCSVGFLPATEIRSP

SEQ ID NO: 303190 - protein, 18 aa, Mycobacterium
DFKIDLNDPPPCNVGFIP

SEQ ID NO: 303191 - protein, 33 aa, Mycobacterium
DFLCPACGNFERGFGPTVSRLIDIGAIAADYTM

SEQ ID NO: 303192 - protein, 25 aa, Mycobacterium
DFLCPACGNFERSFGPTISKLIDSG

SEQ ID NO: 303193 - protein, 27 aa, Mycobacterium
DFLCPACGNFERTFGPTVSRLIDVGAI

SEQ ID NO: 303194 - protein, 17 aa, Mycobacterium
DFLPILVDHGAILTVLA

SEQ ID NO: 303195 - protein, 18 aa, Mycobacterium
DFMHARVLLTPVFCMLLP

SEQ ID NO: 303196 - protein, 46 aa, Mycobacterium
DFMRNPVAAFFAWFPLLFFIAYEAFFIPFGFTFWGVLLSAPAWLPI

SEQ ID NO: 303197 - protein, 24 aa, Mycobacterium
DFPGNRPARALAFAGLAFNGAVLI

SEQ ID NO: 303198 - protein, 22 aa, Mycobacterium
DFPTDRGWDGASLFDPDPDAVG

SEQ ID NO: 303199 - protein, 18 aa, Mycobacterium
DFRLNLGDPPPCLTGFVP

SEQ ID NO: 303200 - protein, 21 aa, Mycobacterium
DFSNLTAHGGFFPLGATAVTV

SEQ ID NO: 303201 - protein, 17 aa, Mycobacterium
DFVAAVLTTPSWNYAAL

SEQ ID NO: 303202 - protein, 18 aa, Mycobacterium
DFVDRVGDQIGIVAADGS

SEQ ID NO: 303203 - protein, 28 aa, Mycobacterium
DFVRLRSIPALREFRLFFFHRLLMMTPL

SEQ ID NO: 303204 - protein, 28 aa, Mycobacterium
DFVSTAWWLELFPGLAIVGCTLAVTVVG

SEQ ID NO: 303205 - protein, 38 aa, Mycobacterium
DFWRPIRNYLYWEPHCYDIPLCWSIRSLFDGLDGINEV

SEQ ID NO: 303206 - protein, 26 aa, Mycobacterium
DFYLYATAAALVFKPLFFPNVSSTAG

SEQ ID NO: 303207 - protein, 17 aa, Mycobacterium
DGAACGGCGSVPATGRE

SEQ ID NO: 303208 - protein, 18 aa, Mycobacterium
DGAAEFRAPAMAAGGVLL

SEQ ID NO: 303209 - protein, 18 aa, Mycobacterium
DGAAPGFPGGLVGGLTHA

SEQ ID NO: 303210 - protein, 21 aa, Mycobacterium
DGAAPRYGLPQAYGTNRSYGY

SEQ ID NO: 303211 - protein, 19 aa, Mycobacterium
DGACVARALALTAVAGIFL

SEQ ID NO: 303212 - protein, 20 aa, Mycobacterium
DGADMLGLNMARRVADGEQI

SEQ ID NO: 303213 - protein, 20 aa, Mycobacterium
DGAGRCRQFFSITLPQMRHT

SEQ ID NO: 303214 - protein, 21 aa, Mycobacterium
DGAHIVWLWVLIFGLQFTSQG

SEQ ID NO: 303215 - protein, 39 aa, Mycobacterium
DGAISRRVAFVFTAMCLFPSLFMMLRRKHIAGVARGPAW

SEQ ID NO: 303216 - protein, 17 aa, Mycobacterium
DGALWMAMEYVRGTDAD

SEQ ID NO: 303217 - protein, 25 aa, Mycobacterium
DGAPATDWTLNWAHGLIANAPQPKH

SEQ ID NO: 303218 - protein, 24 aa, Mycobacterium
DGASDLRALWRIVVPTSLAPMMTM

SEQ ID NO: 303219 - protein, 20 aa, Mycobacterium
DGASTWRSMREVILPLVSPG

SEQ ID NO: 303220 - protein, 23 aa, Mycobacterium
DGASWPAALVLIGICAITAIGGL

SEQ ID NO: 303221 - protein, 23 aa, Mycobacterium
DGAVLRPAGLTVLNSEFGGDVAV

SEQ ID NO: 303222 - protein, 22 aa, Mycobacterium
DGDAQWRPAFNADRASTLGILT

SEQ ID NO: 303223 - protein, 25 aa, Mycobacterium
DGDGSWRLMGVLALADPPRDDSAAT

SEQ ID NO: 303224 - protein, 24 aa, Mycobacterium
DGDHPRTSVVIIRMSQLGMLDATG

SEQ ID NO: 303225 - protein, 25 aa, Mycobacterium
DGDKRLDCQTLYRRATMLAHALLSR

SEQ ID NO: 303226 - protein, 26 aa, Mycobacterium
DGDLGIPRTLVWRLAADPVPDDHDAF

SEQ ID NO: 303227 - protein, 20 aa, Mycobacterium
DGDPAFEVLVPFAVDGGPTV

SEQ ID NO: 303228 - protein, 25 aa, Mycobacterium
DGDQTWRLLGVLALADPPRADSAET

SEQ ID NO: 303229 - protein, 22 aa, Mycobacterium
DGDSLPALLGYAAIAAVLANLV

SEQ ID NO: 303230 - protein, 24 aa, Mycobacterium
DGDTPKPRLCVHYDAEAASATEVQ

SEQ ID NO: 303231 - protein, 24 aa, Mycobacterium
DGEATVLPFSWQHLSLHGSGASRL

SEQ ID NO: 303232 - protein, 31 aa, Mycobacterium
DGEEPPPPRWPWVVGVAAIIAAITLVASVAL

SEQ ID NO: 303233 - protein, 21 aa, Mycobacterium
DGEVKLADFGLVRAVAEAGIT

SEQ ID NO: 303234 - protein, 17 aa, Mycobacterium
DGFPGWTNPAVLFPASI

SEQ ID NO: 303235 - protein, 17 aa, Mycobacterium
DGFRPDRWDVIGALVCL

SEQ ID NO: 303236 - protein, 18 aa, Mycobacterium
DGFSRLGPSLVFVVALAL

SEQ ID NO: 303237 - protein, 25 aa, Mycobacterium
DGFVRRIPIEIDEAAVIDGLSVAAA

SEQ ID NO: 303238 - protein, 20 aa, Mycobacterium
DGGDRARQVLTWLLGGLGGA

SEQ ID NO: 303239 - protein, 19 aa, Mycobacterium
DGGKFSATVDRLEQLISGL

SEQ ID NO: 303240 - protein, 24 aa, Mycobacterium
DGGLIERPERLIIVLAGAIFSGGF

SEQ ID NO: 303241 - protein, 20 aa, Mycobacterium
DGGMLPGVLYDAGLKTITDL

SEQ ID NO: 303242 - protein, 24 aa, Mycobacterium
DGGPPPRWWQPRNVHLGSVHVHHV

SEQ ID NO: 303243 - protein, 23 aa, Mycobacterium
DGGQARRVFLADFGLARRIDDAT

SEQ ID NO: 303244 - protein, 23 aa, Mycobacterium
DGGSGFPVPWALLPVAGAALVIA

SEQ ID NO: 303245 - protein, 19 aa, Mycobacterium
DGHAARYLIQSSLNPFTTQ

SEQ ID NO: 303246 - protein, 18 aa, Mycobacterium
DGHAPAFVLFGSVIYLTG

SEQ ID NO: 303247 - protein, 23 aa, Mycobacterium
DGHVVTGSWSFRVLTAAGPAPAT

SEQ ID NO: 303248 - protein, 17 aa, Mycobacterium
DGIKEREFHLALVGALM

SEQ ID NO: 303249 - protein, 17 aa, Mycobacterium
DGIKERQFHIALVGALM

SEQ ID NO: 303250 - protein, 17 aa, Mycobacterium
DGIKERQFHIALVGAVM

SEQ ID NO: 303251 - protein, 17 aa, Mycobacterium
DGILARRYGLITPFGQL

SEQ ID NO: 303252 - protein, 19 aa, Mycobacterium
DGKASPGTWWHTQDPNTVL

SEQ ID NO: 303253 - protein, 25 aa, Mycobacterium
DGKKAVLWTSGWTPRFHGETIYLAR

SEQ ID NO: 303254 - protein, 24 aa, Mycobacterium
DGKLVAPIKYPSLYAGDEDGKITT

SEQ ID NO: 303255 - protein, 27 aa, Mycobacterium
DGKPARLTLDPGLRFSSLQTVFNRGRS

SEQ ID NO: 303256 - protein, 21 aa, Mycobacterium
DGKPFRMLKFRTMVDGADAQI

SEQ ID NO: 303257 - protein, 25 aa, Mycobacterium
DGKPRSAVSSALWQVLAAVTIATVF

SEQ ID NO: 303258 - protein, 21 aa, Mycobacterium
DGKTARFAIESSYDPYSSDAM

SEQ ID NO: 303259 - protein, 19 aa, Mycobacterium
DGLFLPMGAGRPIRMQGAF

SEQ ID NO: 303260 - protein, 31 aa, Mycobacterium
DGLGLRGWGSLRLAMPLGDDSDASFLAAEAV

SEQ ID NO: 303261 - protein, 24 aa, Mycobacterium
DGLGQIMRLPARFVVGALAGMRLV

SEQ ID NO: 303262 - protein, 18 aa, Mycobacterium
DGLHDWRPITVAGLGVGV

SEQ ID NO: 303263 - protein, 25 aa, Mycobacterium
DGLIFMVLVGLSFYMWWRAQQQKVD

SEQ ID NO: 303264 - protein, 19 aa, Mycobacterium
DGLLALAGWASVPGTGRLS

SEQ ID NO: 303265 - protein, 18 aa, Mycobacterium
DGLLGWLDGDSARWPGIK

SEQ ID NO: 303266 - protein, 26 aa, Mycobacterium
DGLMSRREALRRLGLLGLSTAAATAV

SEQ ID NO: 303267 - protein, 26 aa, Mycobacterium
DGLPERADVKFRGMLVGAVTSVTPAE

SEQ ID NO: 303268 - protein, 23 aa, Mycobacterium
DGLPRSTCLGIAMPSSDDTQTAI

SEQ ID NO: 303269 - protein, 25 aa, Mycobacterium
DGLRLGARSRAFWLLAASFAICGMT

SEQ ID NO: 303270 - protein, 17 aa, Mycobacterium
DGLSPWSLVGALAALVA

SEQ ID NO: 303271 - protein, 18 aa, Mycobacterium
DGLTAWIAAPLLFIGALF

SEQ ID NO: 303272 - protein, 18 aa, Mycobacterium
DGLTAWIAAPLLFIGVLF

SEQ ID NO: 303273 - protein, 19 aa, Mycobacterium
DGLVSLGRRARRMRLIRQY

SEQ ID NO: 303274 - protein, 25 aa, Mycobacterium
DGMLPRRLQPLFGRLSTRSRVPVHG

SEQ ID NO: 303275 - protein, 28 aa, Mycobacterium
DGNGMTRTVLGASLPWTMIVTPSPGITG

SEQ ID NO: 303276 - protein, 25 aa, Mycobacterium
DGPAGYRVALPVAVYSWAFGPGLWN

SEQ ID NO: 303277 - protein, 18 aa, Mycobacterium
DGPAILVNRGYVRPEQGT

SEQ ID NO: 303278 - protein, 19 aa, Mycobacterium
DGPAMPMLPATWGPALATV

SEQ ID NO: 303279 - protein, 20 aa, Mycobacterium
DGPAPEFARFVDWLEQRDTD

SEQ ID NO: 303280 - protein, 24 aa, Mycobacterium
DGPERPRGWRFWERERLPLETPVV

SEQ ID NO: 303281 - protein, 24 aa, Mycobacterium
DGPEWLRIGVMAVLYILTIPVVSI

SEQ ID NO: 303282 - protein, 20 aa, Mycobacterium
DGPGFIPWLRRTVGQPAAPH

SEQ ID NO: 303283 - protein, 22 aa, Mycobacterium
DGPIKAMARCGDFNAVHYAQNL

SEQ ID NO: 303284 - protein, 25 aa, Mycobacterium
DGPLRAGHWLMFAVISLSTFSAMAV

SEQ ID NO: 303285 - protein, 19 aa, Mycobacterium
DGPMAPTRAIEIIADACQA

SEQ ID NO: 303286 - protein, 20 aa, Mycobacterium
DGPMPPQRAIEVIADACQAL

SEQ ID NO: 303287 - protein, 17 aa, Mycobacterium
DGPYILAGWSLGGVLAY

SEQ ID NO: 303288 - protein, 17 aa, Mycobacterium
DGPYILVGWSLGGALAY

SEQ ID NO: 303289 - protein, 24 aa, Mycobacterium
DGQEVSFYIASFVAAIVLLIAGVV

SEQ ID NO: 303290 - protein, 20 aa, Mycobacterium
DGQLYLGTSWWIAVFPGLAL

SEQ ID NO: 303291 - protein, 24 aa, Mycobacterium
DGQNRIRWGNLLTLPMGDGGLLYV

SEQ ID NO: 303292 - protein, 31 aa, Mycobacterium
DGQRPGRQVLVWSFFCMVMFGICMILLAEAG

SEQ ID NO: 303293 - protein, 34 aa, Mycobacterium
DGQYRRAGLLLSDARRAGRLVSDMLDLSRIDAGL

SEQ ID NO: 303294 - protein, 20 aa, Mycobacterium
DGRARGVLMVADAVKPTSAE

SEQ ID NO: 303295 - protein, 46 aa, Mycobacterium
DGRDAGTGQSRWSYARDTSLCGVSWLYRYAVGVYRDDRGCGQVSTL

SEQ ID NO: 303296 - protein, 26 aa, Mycobacterium
DGRGGRFRCTFGFTFEVTEGQDRYVV

SEQ ID NO: 303297 - protein, 19 aa, Mycobacterium
DGRGYGWRTAVLAAAAAAV

SEQ ID NO: 303298 - protein, 18 aa, Mycobacterium
DGRHPFLVMELIEGGTLR

SEQ ID NO: 303299 - protein, 21 aa, Mycobacterium
DGRLYPALNLTSARLATGTAN

SEQ ID NO: 303300 - protein, 22 aa, Mycobacterium
DGRPRRAGVSSFGISGTNAHVI

SEQ ID NO: 303301 - protein, 26 aa, Mycobacterium
DGRPRTENLGSLGFYRVKSHVNGSDV

SEQ ID NO: 303302 - protein, 22 aa, Mycobacterium
DGRRGQLGKMFALRHYGPDKVA

SEQ ID NO: 303303 - protein, 20 aa, Mycobacterium
DGRRGQLGTMFALRRYGPDK

SEQ ID NO: 303304 - protein, 26 aa, Mycobacterium
DGRRVPLVDIRDGLVVNLGRPDGPRI

SEQ ID NO: 303305 - protein, 22 aa, Mycobacterium
DGRSRLMFLIAGYVAGTAAFAV

SEQ ID NO: 303306 - protein, 21 aa, Mycobacterium
DGRTSRWTLASLKDMPAAITL

SEQ ID NO: 303307 - protein, 21 aa, Mycobacterium
DGSAALAYRTRLGIAVVSGDP

SEQ ID NO: 303308 - protein, 28 aa, Mycobacterium
DGSAWSAANARFDFFLRGIVTRFDYRDA

SEQ ID NO: 303309 - protein, 27 aa, Mycobacterium
DGSAWSAANARFNGYFREIVTRFDYDD

SEQ ID NO: 303310 - protein, 17 aa, Mycobacterium
DGSCDRPADVFLVVDGW

SEQ ID NO: 303311 - protein, 18 aa, Mycobacterium
DGSEIARIVPPEGNRVDV

SEQ ID NO: 303312 - protein, 18 aa, Mycobacterium
DGSKKSLLLFGGLGAAAL

SEQ ID NO: 303313 - protein, 17 aa, Mycobacterium
DGSMSAMDIIPLTRTSS

SEQ ID NO: 303314 - protein, 18 aa, Mycobacterium
DGSPIIWLGPGLQEKLAF

SEQ ID NO: 303315 - protein, 23 aa, Mycobacterium
DGSQTRLATWVAEPGHTATPAGS

SEQ ID NO: 303316 - protein, 24 aa, Mycobacterium
DGSQTRLATWVAEPGHTATPAGSI

SEQ ID NO: 303317 - protein, 24 aa, Mycobacterium
DGSQTRLATWVAEPGRTATPAGSI

SEQ ID NO: 303318 - protein, 26 aa, Mycobacterium
DGSQTRLATWVAVPGHTATPVGAIST

SEQ ID NO: 303319 - protein, 23 aa, Mycobacterium
DGSVLRATFSWPAHAVAEVDVRT

SEQ ID NO: 303320 - protein, 21 aa, Mycobacterium
DGTAPLAPLSRRLAQCRSAKE

SEQ ID NO: 303321 - protein, 24 aa, Mycobacterium
DGTDGVPAWPFVAAVTVIVAAGAL

SEQ ID NO: 303322 - protein, 19 aa, Mycobacterium
DGTDRPCPDPSLPIPTKHS

SEQ ID NO: 303323 - protein, 20 aa, Mycobacterium
DGTDRPCPHPDLPIPTKHSG

SEQ ID NO: 303324 - protein, 28 aa, Mycobacterium
DGTEAIPSRLSRRSLVVGNAVIAFAVIG

SEQ ID NO: 303325 - protein, 18 aa, Mycobacterium
DGTIWIFGGIGSNHAVVA

SEQ ID NO: 303326 - protein, 19 aa, Mycobacterium
DGTLREVLEKVALPHLADR

SEQ ID NO: 303327 - protein, 26 aa, Mycobacterium
DGTPRGVPWPGVWNGSIWTLVFEMIC

SEQ ID NO: 303328 - protein, 17 aa, Mycobacterium
DGTRLPGKYTHAAAVDK

SEQ ID NO: 303329 - protein, 24 aa, Mycobacterium
DGTRLSRRGALVATTLHQRSPLAA

SEQ ID NO: 303330 - protein, 19 aa, Mycobacterium
DGTVLSMTLAWPGGLLDAD

SEQ ID NO: 303331 - protein, 19 aa, Mycobacterium
DGVAPEFVEQLFTEGTTTK

SEQ ID NO: 303332 - protein, 17 aa, Mycobacterium
DGVARCAVVARATGANP

SEQ ID NO: 303333 - protein, 17 aa, Mycobacterium
DGVGLSLGQRQRLALAR

SEQ ID NO: 303334 - protein, 20 aa, Mycobacterium
DGVKAARVDADITIGDTSRH

SEQ ID NO: 303335 - protein, 25 aa, Mycobacterium
DGVKEFPGPWALVPVGATILFIFSA

SEQ ID NO: 303336 - protein, 20 aa, Mycobacterium
DGVLGLVLWQGPLVASTYYL

SEQ ID NO: 303337 - protein, 17 aa, Mycobacterium
DGVLGWQGWQWMFVIEG

SEQ ID NO: 303338 - protein, 23 aa, Mycobacterium
DGVPEEFDELVLRATSRDPDARY

SEQ ID NO: 303339 - protein, 25 aa, Mycobacterium
DGVRAELGIVLVLLVVCLGLESQGP

SEQ ID NO: 303340 - protein, 21 aa, Mycobacterium
DGVRIPPRIIKATIAADGTRT

SEQ ID NO: 303341 - protein, 25 aa, Mycobacterium
DGVRWPPTTIRIALAVLTIGVVSFA

SEQ ID NO: 303342 - protein, 26 aa, Mycobacterium
DGVSKLPMYLSMAVAALGLLAYLASF

SEQ ID NO: 303343 - protein, 22 aa, Mycobacterium
DGVTPPLRWHSGRRVHFDLDPL

SEQ ID NO: 303344 - protein, 18 aa, Mycobacterium
DGVVLFPGAGFVELALRA

SEQ ID NO: 303345 - protein, 24 aa, Mycobacterium
DGVVLHWIIDYWNRFSLWVQNLVT

SEQ ID NO: 303346 - protein, 17 aa, Mycobacterium
DGVVVGGMAIWYVIGAN

SEQ ID NO: 303347 - protein, 20 aa, Mycobacterium
DGVWFSYRPGTPVVEDLSLV

SEQ ID NO: 303348 - protein, 18 aa, Mycobacterium
DGWNHPDIVLPVSAGPTG

SEQ ID NO: 303349 - protein, 19 aa, Mycobacterium
DGWVDRGRLVCPWHGSWFA

SEQ ID NO: 303350 - protein, 17 aa, Mycobacterium
DGYDPALLIAEVEKTGY

SEQ ID NO: 303351 - protein, 25 aa, Mycobacterium
DGYPIKASARYGLYYTPGSDLYQDT

SEQ ID NO: 303352 - protein, 28 aa, Mycobacterium
DGYRPAAPAVWAAVLALLFFAFFTRGIP

SEQ ID NO: 303353 - protein, 35 aa, Mycobacterium
DGYSDDLPPLPWYKRPPVLFGLAAAAALLAVGGLA

SEQ ID NO: 303354 - protein, 18 aa, Mycobacterium
DHAGYMSNYFRWFGSPED

SEQ ID NO: 303355 - protein, 26 aa, Mycobacterium
DHDLWRGEPISVLGLALLTSLALGVG

SEQ ID NO: 303356 - protein, 21 aa, Mycobacterium
DHDSISWGWGLGVILGVYTAA

SEQ ID NO: 303357 - protein, 19 aa, Mycobacterium
DHFCGKLLGLPMGVDVCYT

SEQ ID NO: 303358 - protein, 24 aa, Mycobacterium
DHGLSLADISAWVCHPGGPKVLDS

SEQ ID NO: 303359 - protein, 24 aa, Mycobacterium
DHIGRRPIISFGFVVLAASMVTFW

SEQ ID NO: 303360 - protein, 25 aa, Mycobacterium
DHISGPRTKLFATLFLILVLVVIGE

SEQ ID NO: 303361 - protein, 24 aa, Mycobacterium
DHIVDVKQALAWVKANIADFGGDP

SEQ ID NO: 303362 - protein, 25 aa, Mycobacterium
DHIVDVKRALAWVKQHIAEYGGDPD

SEQ ID NO: 303363 - protein, 20 aa, Mycobacterium
DHLDCHLMKLEDLRPSERAQ

SEQ ID NO: 303364 - protein, 18 aa, Mycobacterium
DHLKRSYFNGGICGDGTD

SEQ ID NO: 303365 - protein, 19 aa, Mycobacterium
DHLSISFAIGERHELGPVP

SEQ ID NO: 303366 - protein, 21 aa, Mycobacterium
DHLVCAGCMFAFVVLWVAYGA

SEQ ID NO: 303367 - protein, 19 aa, Mycobacterium
DHNVIRTLIYLKLSVSGHL

SEQ ID NO: 303368 - protein, 24 aa, Mycobacterium
DHPAEALSAAWQRAFRARAAFEAA

SEQ ID NO: 303369 - protein, 20 aa, Mycobacterium
DHPDQVLGWAGYLRAPDSTS

SEQ ID NO: 303370 - protein, 20 aa, Mycobacterium
DHPDQVVGWAGWLAAPNSDN

SEQ ID NO: 303371 - protein, 22 aa, Mycobacterium
DHRGRMRIGTVLVSPVELGETV

SEQ ID NO: 303372 - protein, 18 aa, Mycobacterium
DHRIAHRVRLIWAAHQPH

SEQ ID NO: 303373 - protein, 22 aa, Mycobacterium
DHRKAQVLGVIHLKDVVKQGMR

SEQ ID NO: 303374 - protein, 25 aa, Mycobacterium
DHRMLSRYGYVFGLTGLVLLVIPAL

SEQ ID NO: 303375 - protein, 26 aa, Mycobacterium
DHRPKGAVILCMTGLTAAFVVLTALA

SEQ ID NO: 303376 - protein, 22 aa, Mycobacterium
DHRPPRAPVWVAVYGVTSILLG

SEQ ID NO: 303377 - protein, 20 aa, Mycobacterium
DHRRIEGLIAPGTFNIDPAG

SEQ ID NO: 303378 - protein, 23 aa, Mycobacterium
DHRRLEGLIAPGTWNIDPDASAQ

SEQ ID NO: 303379 - protein, 20 aa, Mycobacterium
DHSARLLIWQTLVQTQRILT

SEQ ID NO: 303380 - protein, 29 aa, Mycobacterium
DHSPPPPRWAWKVLIPIGVVGQVLMAIWF

SEQ ID NO: 303381 - protein, 20 aa, Mycobacterium
DHTTHWGLHIDDFWWTAIWA

SEQ ID NO: 303382 - protein, 17 aa, Mycobacterium
DHVAFSIWSLWSVMVLF

SEQ ID NO: 303383 - protein, 23 aa, Mycobacterium
DHVAFSIWTLWPVMALFMPGAVY

SEQ ID NO: 303384 - protein, 21 aa, Mycobacterium
DHVALRWQHGYLVSAIELIPR

SEQ ID NO: 303385 - protein, 18 aa, Mycobacterium
DHVAVRWRRDHLIAVIEL

SEQ ID NO: 303386 - protein, 19 aa, Mycobacterium
DHVAVRWRRECLIAVIELK

SEQ ID NO: 303387 - protein, 19 aa, Mycobacterium
DHVEVWWGRPVTSCVQTET

SEQ ID NO: 303388 - protein, 26 aa, Mycobacterium
DHVQRMPVAFFTRTRTGALVSRLGND

SEQ ID NO: 303389 - protein, 17 aa, Mycobacterium
DIAAARCVEGEVAVAVI

SEQ ID NO: 303390 - protein, 32 aa, Mycobacterium
DIAAFVADMVRWGEFGMIPALNARRHPHRTAV

SEQ ID NO: 303391 - protein, 19 aa, Mycobacterium
DIADAKWSTLPPMPTARHA

SEQ ID NO: 303392 - protein, 20 aa, Mycobacterium
DIAGAWRWTAILAAAVTIAS

SEQ ID NO: 303393 - protein, 24 aa, Mycobacterium
DIAGMSCAACASRVETKLNKVPGV

SEQ ID NO: 303394 - protein, 21 aa, Mycobacterium
DIAPAVALLCRPLRVLRVPVD

SEQ ID NO: 303395 - protein, 18 aa, Mycobacterium
DIAPIAVLCLDLDNFKAV

SEQ ID NO: 303396 - protein, 19 aa, Mycobacterium
DIARLRWQFERLARSIPIS

SEQ ID NO: 303397 - protein, 25 aa, Mycobacterium
DIASLCWALVFAVRFVVQRLLYDAN

SEQ ID NO: 303398 - protein, 18 aa, Mycobacterium
DIDLPRPVADDFQPDIPA

SEQ ID NO: 303399 - protein, 22 aa, Mycobacterium
DIEGLRAVAILTVVLYHAGVPG

SEQ ID NO: 303400 - protein, 17 aa, Mycobacterium
DIEGLRFNRGSWARAQL

SEQ ID NO: 303401 - protein, 23 aa, Mycobacterium
DIEIVFLYPWAVHFDALGVFGLL

SEQ ID NO: 303402 - protein, 17 aa, Mycobacterium
DIEQLWSAIGLVPQRGY

SEQ ID NO: 303403 - protein, 17 aa, Mycobacterium
DIERRLSAAPAPVAAAF

SEQ ID NO: 303404 - protein, 19 aa, Mycobacterium
DIFALIVGVSLLFAHLERS

SEQ ID NO: 303405 - protein, 24 aa, Mycobacterium
DIGVPTLIPWLSGFLILTIAGERL

SEQ ID NO: 303406 - protein, 17 aa, Mycobacterium
DIINRGGENVSSVEVES

SEQ ID NO: 303407 - protein, 19 aa, Mycobacterium
DIIPTGVKWAARLTPSGAL

SEQ ID NO: 303408 - protein, 26 aa, Mycobacterium
DIKKAEKWNIPVILIVLIAAFGSLAA

SEQ ID NO: 303409 - protein, 25 aa, Mycobacterium
DILAAFPILIPILIGLMALAAAFGA

SEQ ID NO: 303410 - protein, 19 aa, Mycobacterium
DILESRGGAVFAAVCVATL

SEQ ID NO: 303411 - protein, 25 aa, Mycobacterium
DILGGLRRRPKFVIAAVLIVFILVV

SEQ ID NO: 303412 - protein, 24 aa, Mycobacterium
DILGRLTKMLARRVSGRAPADAAP

SEQ ID NO: 303413 - protein, 20 aa, Mycobacterium
DILLFYVFFEAMLIPMYFLI

SEQ ID NO: 303414 - protein, 31 aa, Mycobacterium
DILVGGLLVPILGGFVWKRATGAGALVAMGV

SEQ ID NO: 303415 - protein, 23 aa, Mycobacterium
DIMLPRFANTIILTVAALILCIV

SEQ ID NO: 303416 - protein, 18 aa, Mycobacterium
DIMVSGRGLDIWSALPIL

SEQ ID NO: 303417 - protein, 19 aa, Mycobacterium
DIPAPRPVAPGLFNAIPQA

SEQ ID NO: 303418 - protein, 19 aa, Mycobacterium
DIPMCAAARSLFDSLDTVD

SEQ ID NO: 303419 - protein, 18 aa, Mycobacterium
DIPMPGPVLPAAAPDPAL

SEQ ID NO: 303420 - protein, 23 aa, Mycobacterium
DIPTDIRTATNFDQASGADKAAL

SEQ ID NO: 303421 - protein, 18 aa, Mycobacterium
DIPTWPFAVGAIAAVAAG

SEQ ID NO: 303422 - protein, 22 aa, Mycobacterium
DIPVQRCYDGAVVRYRDGNRTV

SEQ ID NO: 303423 - protein, 19 aa, Mycobacterium
DIQRFLWADFAQLAIATII

SEQ ID NO: 303424 - protein, 25 aa, Mycobacterium
DIRENPATCWWWQKTSGENRARIQV

SEQ ID NO: 303425 - protein, 19 aa, Mycobacterium
DIRRTVGLLDNWPTKTAQT

SEQ ID NO: 303426 - protein, 20 aa, Mycobacterium
DISAESWLIADLNTGNVVAA

SEQ ID NO: 303427 - protein, 26 aa, Mycobacterium
DISDSIKRWLVRRFNKDDKASAQAVT

SEQ ID NO: 303428 - protein, 24 aa, Mycobacterium
DISSRRAVTVLAFSLLGFVLAGVH

SEQ ID NO: 303429 - protein, 22 aa, Mycobacterium
DISVPCPAIATLPATGGLVLST

SEQ ID NO: 303430 - protein, 18 aa, Mycobacterium
DITKAVRVNEEFQVSRQF

SEQ ID NO: 303431 - protein, 20 aa, Mycobacterium
DIVDLLPLLQHPLGLQLDSI

SEQ ID NO: 303432 - protein, 24 aa, Mycobacterium
DIVDRILGVRTIRGATLVGDGPLT

SEQ ID NO: 303433 - protein, 25 aa, Mycobacterium
DIVELQHWVNILGMHSGYKVTRLFG

SEQ ID NO: 303434 - protein, 18 aa, Mycobacterium
DIVHTDGPIAPRRAIEII

SEQ ID NO: 303435 - protein, 17 aa, Mycobacterium
DIVKRVFLGKPLITEDI

SEQ ID NO: 303436 - protein, 18 aa, Mycobacterium
DIVLGVVRDGHLWRIDAP

SEQ ID NO: 303437 - protein, 17 aa, Mycobacterium
DIVLPHLENGYANTTID

SEQ ID NO: 303438 - protein, 25 aa, Mycobacterium
DIVLTPSWWAKLVVLGLILFAGIAA

SEQ ID NO: 303439 - protein, 22 aa, Mycobacterium
DIVMTCILPPLLYNAALESSLV

SEQ ID NO: 303440 - protein, 19 aa, Mycobacterium
DIVRPELKALTGACGLAQA

SEQ ID NO: 303441 - protein, 26 aa, Mycobacterium
DIVTRFEYPDALLLDMQGNVIFSVNK

SEQ ID NO: 303442 - protein, 24 aa, Mycobacterium
DIVVVFLVTWPLVYLASKSPRLAK

SEQ ID NO: 303443 - protein, 23 aa, Mycobacterium
DIWANAGGVGANFAGLPNASGTL

SEQ ID NO: 303444 - protein, 23 aa, Mycobacterium
DIYALACLVYESLIGRPPYEAGD

SEQ ID NO: 303445 - protein, 24 aa, Mycobacterium
DIYFTVDWLQAWWAHYGRQRNFVG

SEQ ID NO: 303446 - protein, 26 aa, Mycobacterium
DIYLREVQDVWTWVRPYFDDRATAAA

SEQ ID NO: 303447 - protein, 19 aa, Mycobacterium
DIYSIALAAMIVPATIAMY

SEQ ID NO: 303448 - protein, 24 aa, Mycobacterium
DKADAVFLLSRFLVALPIGAVIGG

SEQ ID NO: 303449 - protein, 28 aa, Mycobacterium
DKAIYLRVGLLLALWAAVIASFAALTYR

SEQ ID NO: 303450 - protein, 23 aa, Mycobacterium
DKALGPICAIILITGAGGMFGGV

SEQ ID NO: 303451 - protein, 18 aa, Mycobacterium
DKCVIARLGGDEFAVVIE

SEQ ID NO: 303452 - protein, 25 aa, Mycobacterium
DKEWGHRLRCFVVKAEGATIDEDAI

SEQ ID NO: 303453 - protein, 20 aa, Mycobacterium
DKFALRGRWTLDDQGATAKG

SEQ ID NO: 303454 - protein, 19 aa, Mycobacterium
DKFSEGWDALKSGISGASS

SEQ ID NO: 303455 - protein, 42 aa, Mycobacterium
DKHGRPFRRRNFLPGAVMFACLAVAALLVWMIALSRPPEVVQ

SEQ ID NO: 303456 - protein, 30 aa, Mycobacterium
DKHGRPFRRRNPKPAIVVVILLAVATAVVW

SEQ ID NO: 303457 - protein, 32 aa, Mycobacterium
DKHGRPFRRRNPRPAIIVVILLVVLTGVVWTV

SEQ ID NO: 303458 - protein, 28 aa, Mycobacterium
DKIGAILGRYGLVIVIGWIGALKFADFE

SEQ ID NO: 303459 - protein, 18 aa, Mycobacterium
DKLDAVWLAKLTEKGLLR

SEQ ID NO: 303460 - protein, 17 aa, Mycobacterium
DKLEILLLVEEDDIATR

SEQ ID NO: 303461 - protein, 17 aa, Mycobacterium
DKLGPLASDWPLVVADA

SEQ ID NO: 303462 - protein, 20 aa, Mycobacterium
DKLLRRGRGAHRTSEPDRSR

SEQ ID NO: 303463 - protein, 21 aa, Mycobacterium
DKLPWPAPTVFLMRRGTGNTY

SEQ ID NO: 303464 - protein, 21 aa, Mycobacterium
DKLRACPDAKVTVNGYTDNSG

SEQ ID NO: 303465 - protein, 21 aa, Mycobacterium
DKMVRAIWVLRALLREHGRRL

SEQ ID NO: 303466 - protein, 25 aa, Mycobacterium
DKNEVFPKWFAYVSIWQIITEVIAT

SEQ ID NO: 303467 - protein, 21 aa, Mycobacterium
DKPILCPRCGNVVPDMAFCAH

SEQ ID NO: 303468 - protein, 21 aa, Mycobacterium
DKPPAALWITGLSVRLFGMSP

SEQ ID NO: 303469 - protein, 21 aa, Mycobacterium
DKPPPARIVLFSDGKETMPTN

SEQ ID NO: 303470 - protein, 26 aa, Mycobacterium
DKPRTVRWNLRLDVADVDGQLMISRL

SEQ ID NO: 303471 - protein, 19 aa, Mycobacterium
DKPVIFWTPDHGAFVVRGA

SEQ ID NO: 303472 - protein, 18 aa, Mycobacterium
DKRLLPYMIGAFVLIVAA

SEQ ID NO: 303473 - protein, 17 aa, Mycobacterium
DKSDLFVAIGERLRDML

SEQ ID NO: 303474 - protein, 24 aa, Mycobacterium
DKSPELPCVMFGGQSPATLRRIAR

SEQ ID NO: 303475 - protein, 25 aa, Mycobacterium
DKVGRKPLLLFFGFGGVVYTYVLIT

SEQ ID NO: 303476 - protein, 25 aa, Mycobacterium
DKVGRKPLLLWFGFGGVIYTYILIT

SEQ ID NO: 303477 - protein, 19 aa, Mycobacterium
DKVRLLLRFDTLPTVTEIV

SEQ ID NO: 303478 - protein, 24 aa, Mycobacterium
DKVRVGDEVLAAGAPLGLRSTVTH

SEQ ID NO: 303479 - protein, 23 aa, Mycobacterium
DKWLRPAPEGVVGELYVAGHGVA

SEQ ID NO: 303480 - protein, 25 aa, Mycobacterium
DKWPEKLARISFWCMNIGLAWMVFA

SEQ ID NO: 303481 - protein, 28 aa, Mycobacterium
DKWPEKLARISFWGMNIGLAWMVFATLL

SEQ ID NO: 303482 - protein, 17 aa, Mycobacterium
DLAATLWHPHVVGVHDR

SEQ ID NO: 303483 - protein, 30 aa, Mycobacterium
DLADGRAVTIGSFFRPRNVGMVFLAVLLVE

SEQ ID NO: 303484 - protein, 25 aa, Mycobacterium
DLADGRPVTVGSFFKPRNFGMVFLA

SEQ ID NO: 303485 - protein, 18 aa, Mycobacterium
DLAGIGVALVIWGSAVVA

SEQ ID NO: 303486 - protein, 29 aa, Mycobacterium
DLALARGAALVSARRGRFMFPDKADQQRS

SEQ ID NO: 303487 - protein, 19 aa, Mycobacterium
DLALYRLGGDTARVPAGTR

SEQ ID NO: 303488 - protein, 25 aa, Mycobacterium
DLAMALEVGQVFAGYTILRVLGAGG

SEQ ID NO: 303489 - protein, 26 aa, Mycobacterium
DLANVLRYGYYPALILGLLVGVVILY

SEQ ID NO: 303490 - protein, 17 aa, Mycobacterium
DLAQRIATAKQWRQSTD

SEQ ID NO: 303491 - protein, 19 aa, Mycobacterium
DLARAKRGPLLGIPGAPQL

SEQ ID NO: 303492 - protein, 20 aa, Mycobacterium
DLARLLPYNLARTWHLQLAL

SEQ ID NO: 303493 - protein, 23 aa, Mycobacterium
DLAYGLGLWWGVLRERNVRALKP

SEQ ID NO: 303494 - protein, 17 aa, Mycobacterium
DLCALLLQIYVVMGAGW

SEQ ID NO: 303495 - protein, 18 aa, Mycobacterium
DLDAIIAAGGRKGEIYAA

SEQ ID NO: 303496 - protein, 23 aa, Mycobacterium
DLDEWDWVKWIPHFGDPRRQDAA

SEQ ID NO: 303497 - protein, 23 aa, Mycobacterium
DLDEWDWVKWLPHFGDSRRHDAA

SEQ ID NO: 303498 - protein, 17 aa, Mycobacterium
DLDGHVLGVVFGAAVDD

SEQ ID NO: 303499 - protein, 25 aa, Mycobacterium
DLDGLGRYRVVAFPSHMEGEAVVAG

SEQ ID NO: 303500 - protein, 27 aa, Mycobacterium
DLDGLRRFHRNLGRGLLGRRIERSPVP

SEQ ID NO: 303501 - protein, 17 aa, Mycobacterium
DLDLVAVDRAEFLAALS

SEQ ID NO: 303502 - protein, 23 aa, Mycobacterium
DLDRARKVLAGKRIRLPELGAEA

SEQ ID NO: 303503 - protein, 24 aa, Mycobacterium
DLDRPDPPHARRAAESGATHDNAD

SEQ ID NO: 303504 - protein, 22 aa, Mycobacterium
DLEIAPGVITTWMKLAVRDRID

SEQ ID NO: 303505 - protein, 24 aa, Mycobacterium
DLEIAPGVVTTWMKLAIRDRILPD

SEQ ID NO: 303506 - protein, 22 aa, Mycobacterium
DLEIAPGVVTTWMKLAVRDRIL

SEQ ID NO: 303507 - protein, 22 aa, Mycobacterium
DLEISPGVVTTWMKLAIRDRIL

SEQ ID NO: 303508 - protein, 25 aa, Mycobacterium
DLEPARWWAQLSWLPQRPVLVPGTV

SEQ ID NO: 303509 - protein, 25 aa, Mycobacterium
DLEPFRCFYLSAPFVVPKKKEVAKT

SEQ ID NO: 303510 - protein, 26 aa, Mycobacterium
DLEPFRCFYLSAPFVVPKTKEVAETV

SEQ ID NO: 303511 - protein, 24 aa, Mycobacterium
DLEQGRALVRAMLCQLAAFHSPAD

SEQ ID NO: 303512 - protein, 19 aa, Mycobacterium
DLERGFKAPWVPLLPIASI

SEQ ID NO: 303513 - protein, 24 aa, Mycobacterium
DLESGDWSWLKWLPHVDVPNEADG

SEQ ID NO: 303514 - protein, 20 aa, Mycobacterium
DLFGIKIHWIVAALSVIILL

SEQ ID NO: 303515 - protein, 20 aa, Mycobacterium
DLFGRHVGTDVARRALEEGS

SEQ ID NO: 303516 - protein, 17 aa, Mycobacterium
DLFNMQLALGWSTLALA

SEQ ID NO: 303517 - protein, 24 aa, Mycobacterium
DLGASSWQTFRFVTFPMMRGALLA

SEQ ID NO: 303518 - protein, 25 aa, Mycobacterium
DLGFTLRTALLMTFVLTASAVAGSF

SEQ ID NO: 303519 - protein, 19 aa, Mycobacterium
DLGGLYFNALVAIAITGVW

SEQ ID NO: 303520 - protein, 35 aa, Mycobacterium
DLGLILGRSRIHGIKNWKTAILAATLVLFLGGGVA

SEQ ID NO: 303521 - protein, 18 aa, Mycobacterium
DLGLKAWAGRALNDGSST

SEQ ID NO: 303522 - protein, 25 aa, Mycobacterium
DLHASCWRRRGKLGHFGDWPGSEEF

SEQ ID NO: 303523 - protein, 26 aa, Mycobacterium
DLIAEFGWGITCFITAVAGLMQILLG

SEQ ID NO: 303524 - protein, 18 aa, Mycobacterium
DLIAKRGGVRMAVQCKRL

SEQ ID NO: 303525 - protein, 20 aa, Mycobacterium
DLIAQFGWGLTCFITAIAGL

SEQ ID NO: 303526 - protein, 19 aa, Mycobacterium
DLIAQRVADAFAEPFIVDG

SEQ ID NO: 303527 - protein, 25 aa, Mycobacterium
DLIGARLAVDLAWALWVAGTLGGLF

SEQ ID NO: 303528 - protein, 34 aa, Mycobacterium
DLIVRGLAFQACFVSAAAVAARFGAAALAAHQVV

SEQ ID NO: 303529 - protein, 24 aa, Mycobacterium
DLKVGQLLCKFGMKTGRAECGQVT

SEQ ID NO: 303530 - protein, 22 aa, Mycobacterium
DLKVVGKLAQFGSGMLQQVSEK

SEQ ID NO: 303531 - protein, 20 aa, Mycobacterium
DLLARIGVNVPNFYQDAHWA

SEQ ID NO: 303532 - protein, 17 aa, Mycobacterium
DLLCSYPAGQIMDRYGR

SEQ ID NO: 303533 - protein, 20 aa, Mycobacterium
DLLHGLLMYSGNDAAHALAM

SEQ ID NO: 303534 - protein, 17 aa, Mycobacterium
DLLKVTVFVSAFALILA

SEQ ID NO: 303535 - protein, 25 aa, Mycobacterium
DLLLCGFGTLLQSLGIWRVGVRLPM

SEQ ID NO: 303536 - protein, 18 aa, Mycobacterium
DLLLRSLAFQACFVSAGA

SEQ ID NO: 303537 - protein, 19 aa, Mycobacterium
DLLLVRPGEKIPVDGEITD

SEQ ID NO: 303538 - protein, 31 aa, Mycobacterium
DLLNLVYYRVWFLKLRRKLRLPPRPLWRPWI

SEQ ID NO: 303539 - protein, 18 aa, Mycobacterium
DLLTVFFEVWLARIPFFW

SEQ ID NO: 303540 - protein, 18 aa, Mycobacterium
DLLWSFLQAILMAMAVLL

SEQ ID NO: 303541 - protein, 19 aa, Mycobacterium
DLMAIMTRVTWGCEPDDVS

SEQ ID NO: 303542 - protein, 23 aa, Mycobacterium
DLMALCLTGFPAFDEAAPQRRSL

SEQ ID NO: 303543 - protein, 20 aa, Mycobacterium
DLMGPWPWYVVVATVLVLAV

SEQ ID NO: 303544 - protein, 27 aa, Mycobacterium
DLMGVPRLTFWDYPLAAAISVVTLFLF

SEQ ID NO: 303545 - protein, 30 aa, Mycobacterium
DLMLACLIVPFILGLVWRRGTTTAALAAIA

SEQ ID NO: 303546 - protein, 19 aa, Mycobacterium
DLMLYALVMAFCFTTLSTY

SEQ ID NO: 303547 - protein, 33 aa, Mycobacterium
DLMVRGALRLVRGRVAFIPWVMFGITAVLTALG

SEQ ID NO: 303548 - protein, 18 aa, Mycobacterium
DLNAVVSVRTVFEAPTVG

SEQ ID NO: 303549 - protein, 29 aa, Mycobacterium
DLNDPPPCAVGFLPPPLMRTPADETVREL

SEQ ID NO: 303550 - protein, 24 aa, Mycobacterium
DLNRGHWDWLKWLPHNQHQRCVDA

SEQ ID NO: 303551 - protein, 24 aa, Mycobacterium
DLPAPRPIAPGLFNAIPEAAPLAA

SEQ ID NO: 303552 - protein, 26 aa, Mycobacterium
DLPARRWEFPQFPQLPMLRWVDSTLG

SEQ ID NO: 303553 - protein, 18 aa, Mycobacterium
DLPASAWVGYVFLIHREP

SEQ ID NO: 303554 - protein, 23 aa, Mycobacterium
DLPASEWERVRVEAVHREATGPD

SEQ ID NO: 303555 - protein, 23 aa, Mycobacterium
DLPFYRFVLTYLFIAASIALIVN

SEQ ID NO: 303556 - protein, 23 aa, Mycobacterium
DLPFYRLVLTYLFVATFLAFVAN

SEQ ID NO: 303557 - protein, 23 aa, Mycobacterium
DLPFYRLVLTYLFVGVFLAFLAN

SEQ ID NO: 303558 - protein, 31 aa, Mycobacterium
DLPGFRSEVRVTRPELEQMIAGPLDGLLSLI

SEQ ID NO: 303559 - protein, 19 aa, Mycobacterium
DLPLDRGEVALPVRVSDTD

SEQ ID NO: 303560 - protein, 20 aa, Mycobacterium
DLPPLIGVTMYGAFFIVLFN

SEQ ID NO: 303561 - protein, 25 aa, Mycobacterium
DLPRPEASAVIARLAALGVKNTVML

SEQ ID NO: 303562 - protein, 20 aa, Mycobacterium
DLQGAEQLLVRWQQANDRIN

SEQ ID NO: 303563 - protein, 26 aa, Mycobacterium
DLQHTLRSLVWLQIAIGVGVLVLVGI

SEQ ID NO: 303564 - protein, 18 aa, Mycobacterium
DLQMWVAACLFVGLEDTY

SEQ ID NO: 303565 - protein, 17 aa, Mycobacterium
DLQRPDAPWGKPRVVYL

SEQ ID NO: 303566 - protein, 21 aa, Mycobacterium
DLRARFRAITEHAERVIDSCD

SEQ ID NO: 303567 - protein, 20 aa, Mycobacterium
DLRIPAIGLALLLLSSLVVG

SEQ ID NO: 303568 - protein, 24 aa, Mycobacterium
DLRLAENWFTLSLLTDHGETLIPV

SEQ ID NO: 303569 - protein, 25 aa, Mycobacterium
DLRLHGMTCASCASRVEKGLNKITG

SEQ ID NO: 303570 - protein, 19 aa, Mycobacterium
DLRNPADFLVLDRLAKRVF

SEQ ID NO: 303571 - protein, 23 aa, Mycobacterium
DLRPGRLSRWLAHLSTAIEMLVP

SEQ ID NO: 303572 - protein, 24 aa, Mycobacterium
DLRRDRTSFIIAHRLSTIRDADRI

SEQ ID NO: 303573 - protein, 23 aa, Mycobacterium
DLRRSWRADLLAGVTVGVVALPL

SEQ ID NO: 303574 - protein, 20 aa, Mycobacterium
DLRSIPGWFRLIGLAEAVSW

SEQ ID NO: 303575 - protein, 20 aa, Mycobacterium
DLRSLSGFSDAYSAAGQDIL

SEQ ID NO: 303576 - protein, 26 aa, Mycobacterium
DLRSRMGMVLQDTWLFGGTIVENIAY

SEQ ID NO: 303577 - protein, 19 aa, Mycobacterium
DLRSVVCYPSPPDAYDDTR

SEQ ID NO: 303578 - protein, 25 aa, Mycobacterium
DLSALRPGSLEALLPHELRAQPGAR

SEQ ID NO: 303579 - protein, 24 aa, Mycobacterium
DLSALRPGSLEALLPPEQRARPGA

SEQ ID NO: 303580 - protein, 23 aa, Mycobacterium
DLSEAMSAMLDRLAAAQRVTTNS

SEQ ID NO: 303581 - protein, 20 aa, Mycobacterium
DLSEVWRLTRGAGQRIAVID

SEQ ID NO: 303582 - protein, 20 aa, Mycobacterium
DLSGGEAFTASSLEQLKQVF

SEQ ID NO: 303583 - protein, 19 aa, Mycobacterium
DLSGPIPRAQRRSAPDRPV

SEQ ID NO: 303584 - protein, 20 aa, Mycobacterium
DLSIHAGDWTAMIGTAEELA

SEQ ID NO: 303585 - protein, 21 aa, Mycobacterium
DLTGCMALGITGPVLRATGLA

SEQ ID NO: 303586 - protein, 21 aa, Mycobacterium
DLTGCMALGITGPVLRSTGLP

SEQ ID NO: 303587 - protein, 24 aa, Mycobacterium
DLTNRFPLMKVIDMSSAMCRDDYC

SEQ ID NO: 303588 - protein, 19 aa, Mycobacterium
DLTPLRYSPTVSVAPFDPA

SEQ ID NO: 303589 - protein, 27 aa, Mycobacterium
DLTTLFWFVSVFACALAFHNITARYAF

SEQ ID NO: 303590 - protein, 24 aa, Mycobacterium
DLVARAAAVAAVLAIAGRPLVHDR

SEQ ID NO: 303591 - protein, 17 aa, Mycobacterium
DLVERLRAAKARISDPQ

SEQ ID NO: 303592 - protein, 27 aa, Mycobacterium
DLVIFLPLLIIMGAFMFFASRRQKKAM

SEQ ID NO: 303593 - protein, 19 aa, Mycobacterium
DLVPARFVLANSAQVGVPR

SEQ ID NO: 303594 - protein, 28 aa, Mycobacterium
DLVRGSLRILLPLSFAVALILLSQGTIQ

SEQ ID NO: 303595 - protein, 27 aa, Mycobacterium
DLVRGTLRILLPIAVLGAVVLVMGGVV

SEQ ID NO: 303596 - protein, 24 aa, Mycobacterium
DLVTRPGTFLWLIVAVGTPMITSG

SEQ ID NO: 303597 - protein, 20 aa, Mycobacterium
DLWWSARADHIVTRVRIAPG

SEQ ID NO: 303598 - protein, 25 aa, Mycobacterium
DLYLRIAPELYLKRLCVGGVERVFE

SEQ ID NO: 303599 - protein, 50 aa, Mycobacterium
DLYSRIKPTLLGVLPWRWGDPQARLLKPWARIVVTLWVVTVVPLLLATLA

SEQ ID NO: 303600 - protein, 19 aa, Mycobacterium
DMAFYLAAGLCFIAAVFSA

SEQ ID NO: 303601 - protein, 30 aa, Mycobacterium
DMAMLVILGALWAGFVLFRLRPPSHGTSAR

SEQ ID NO: 303602 - protein, 18 aa, Mycobacterium
DMAPRQVATYTLLGVVAL

SEQ ID NO: 303603 - protein, 25 aa, Mycobacterium
DMAPSVDWWAFRSLCTSAGCVATGA

SEQ ID NO: 303604 - protein, 17 aa, Mycobacterium
DMARLAVSFNDMAESLH

SEQ ID NO: 303605 - protein, 17 aa, Mycobacterium
DMARLAVSFNDMAESLS

SEQ ID NO: 303606 - protein, 18 aa, Mycobacterium
DMARLAVSFNDMAESLSR

SEQ ID NO: 303607 - protein, 23 aa, Mycobacterium
DMDERLVAMIARIVEAYGKYSSS

SEQ ID NO: 303608 - protein, 30 aa, Mycobacterium
DMDRLDALMPRMVALMPPQIETMRKMRTMM

SEQ ID NO: 303609 - protein, 34 aa, Mycobacterium
DMDTCAPIACYTALLGICCDLYEPVTWAEELVQP

SEQ ID NO: 303610 - protein, 20 aa, Mycobacterium
DMFPALAVAITSQYDDPEDD

SEQ ID NO: 303611 - protein, 26 aa, Mycobacterium
DMGEIELPPGYLPLRVPIEVHFTQRV

SEQ ID NO: 303612 - protein, 17 aa, Mycobacterium
DMGMPRRYADYLPSDGF

SEQ ID NO: 303613 - protein, 23 aa, Mycobacterium
DMGSLPAVLGLVVLFVVFGLAND

SEQ ID NO: 303614 - protein, 18 aa, Mycobacterium
DMKAADGKSGRLVQIGGT

SEQ ID NO: 303615 - protein, 18 aa, Mycobacterium
DMLWAAIFPSIDLKTDSS

SEQ ID NO: 303616 - protein, 18 aa, Mycobacterium
DMLWAAIFPSINLATDSA

SEQ ID NO: 303617 - protein, 20 aa, Mycobacterium
DMMRARRSCHSFQKRDLTER

SEQ ID NO: 303618 - protein, 21 aa, Mycobacterium
DMNDRCPLTSYVIAGFSQGAV

SEQ ID NO: 303619 - protein, 29 aa, Mycobacterium
DMPTPRGSYGAAFIDGRIVAVGGEEPTQV

SEQ ID NO: 303620 - protein, 29 aa, Mycobacterium
DMPWYQAWWQWIGGVARGELGWSSTQSQP

SEQ ID NO: 303621 - protein, 21 aa, Mycobacterium
DMSATVAMRMVVPRVLPVRYR

SEQ ID NO: 303622 - protein, 19 aa, Mycobacterium
DMSTGDFRADFEATAEDFA

SEQ ID NO: 303623 - protein, 17 aa, Mycobacterium
DMTLRLWPGPAAWPDLL

SEQ ID NO: 303624 - protein, 22 aa, Mycobacterium
DMTNKCPLTSYVVVGFSQGAVI

SEQ ID NO: 303625 - protein, 17 aa, Mycobacterium
DMYRYAVAAGCDIEQFD

SEQ ID NO: 303626 - protein, 27 aa, Mycobacterium
DNALERNGFDWSAVAAVVTIGGGASIP

SEQ ID NO: 303627 - protein, 23 aa, Mycobacterium
DNALRYAPHCLVRVNAGRVGDRV

SEQ ID NO: 303628 - protein, 24 aa, Mycobacterium
DNARTAAAIARQVGVSRVLAEVLP

SEQ ID NO: 303629 - protein, 22 aa, Mycobacterium
DNDEYECTLGFLGRDSSGTPIG

SEQ ID NO: 303630 - protein, 18 aa, Mycobacterium
DNFGLKWGLFGAAAIMVV

SEQ ID NO: 303631 - protein, 27 aa, Mycobacterium
DNGLRPEPIIALGILLTWCSVERAVAT

SEQ ID NO: 303632 - protein, 26 aa, Mycobacterium
DNGPSLRASWTWAPSAFDEEQATRLS

SEQ ID NO: 303633 - protein, 25 aa, Mycobacterium
DNIALALPRLAKYQVTLGETVASGP

SEQ ID NO: 303634 - protein, 18 aa, Mycobacterium
DNKVGYGLVDPVAALTFN

SEQ ID NO: 303635 - protein, 23 aa, Mycobacterium
DNKVGYGLVDPVAALTFNIPPGD

SEQ ID NO: 303636 - protein, 18 aa, Mycobacterium
DNLGRPTGITARITPDMI

SEQ ID NO: 303637 - protein, 21 aa, Mycobacterium
DNLPRAVSIGGAQAKTNVPQG

SEQ ID NO: 303638 - protein, 21 aa, Mycobacterium
DNLPRVNAHGGPGGKPGCWKT

SEQ ID NO: 303639 - protein, 19 aa, Mycobacterium
DNLRGKWRVTPGVAATGHF

SEQ ID NO: 303640 - protein, 19 aa, Mycobacterium
DNLRGKWRVTPGVATTGHF

SEQ ID NO: 303641 - protein, 22 aa, Mycobacterium
DNLRRGGIQFADTRGYAYDRRD

SEQ ID NO: 303642 - protein, 22 aa, Mycobacterium
DNLWPMARAMITVTLPLTAISF

SEQ ID NO: 303643 - protein, 25 aa, Mycobacterium
DNMPELHWAWGYPAVLCVMAVVCFV

SEQ ID NO: 303644 - protein, 25 aa, Mycobacterium
DNPAGRPALPYSPPSNPVFPAIETP

SEQ ID NO: 303645 - protein, 24 aa, Mycobacterium
DNPDEVYGWAGWLRAPTTTDPTVK

SEQ ID NO: 303646 - protein, 17 aa, Mycobacterium
DNPDFKRGMKMFLSPDG

SEQ ID NO: 303647 - protein, 22 aa, Mycobacterium
DNPGQIVAWGLVFGYAQQLFTR

SEQ ID NO: 303648 - protein, 20 aa, Mycobacterium
DNPWKWNVIGLLAIAVVLSI

SEQ ID NO: 303649 - protein, 22 aa, Mycobacterium
DNRVVAMLSLVPWGTTGVSLDL

SEQ ID NO: 303650 - protein, 25 aa, Mycobacterium
DNSEAFAAVAAFSRALVLVTVAIIL

SEQ ID NO: 303651 - protein, 23 aa, Mycobacterium
DNSGLWGLLGLLGLGGLAGLMRR

SEQ ID NO: 303652 - protein, 26 aa, Mycobacterium
DNSGSILSWFSPIAWAQQMRPFVALR

SEQ ID NO: 303653 - protein, 24 aa, Mycobacterium
DNTETGWKLGFYAASRASQLRRMR

SEQ ID NO: 303654 - protein, 25 aa, Mycobacterium
DNTSWPIPRRWVGRSIRFRHNTLDP

SEQ ID NO: 303655 - protein, 19 aa, Mycobacterium
DNVLSFQWLSIIATPIDFV

SEQ ID NO: 303656 - protein, 17 aa, Mycobacterium
DNVVIRIAKKVLHTTEH

SEQ ID NO: 303657 - protein, 30 aa, Mycobacterium
DNYKRAEICRQRMGPVFKRITMNYPPLLFH

SEQ ID NO: 303658 - protein, 18 aa, Mycobacterium
DNYRGVFGGDLFSSALIN

SEQ ID NO: 303659 - protein, 17 aa, Mycobacterium
DNYRGVFRGEFFSSALI

SEQ ID NO: 303660 - protein, 25 aa, Mycobacterium
DPAEVRGKVVLIDFWAYSCINCQRA

SEQ ID NO: 303661 - protein, 18 aa, Mycobacterium
DPAFSGAVLIIFTVLALV

SEQ ID NO: 303662 - protein, 22 aa, Mycobacterium
DPAGACAYTASARRHASELQSG

SEQ ID NO: 303663 - protein, 24 aa, Mycobacterium
DPAGRFASCREFADALNEQAGVTP

SEQ ID NO: 303664 - protein, 26 aa, Mycobacterium
DPAHPDARIGFMMSDAKPVAALTTAD

SEQ ID NO: 303665 - protein, 22 aa, Mycobacterium
DPAIKGMWTVPVFSNPTGTVYS

SEQ ID NO: 303666 - protein, 18 aa, Mycobacterium
DPAKWPWPTFTVNIVGAF

SEQ ID NO: 303667 - protein, 19 aa, Mycobacterium
DPALDLQVMMMLRQLADAG

SEQ ID NO: 303668 - protein, 24 aa, Mycobacterium
DPALPDVRVEFMIGDAAPTAAITT

SEQ ID NO: 303669 - protein, 24 aa, Mycobacterium
DPALPWPVKGGVPAVVSKIPVAAQ

SEQ ID NO: 303670 - protein, 17 aa, Mycobacterium
DPALRFASLQTVFQHGR

SEQ ID NO: 303671 - protein, 31 aa, Mycobacterium
DPALSRWQWLIKWILAIPHYIVLVFLYLGAF

SEQ ID NO: 303672 - protein, 25 aa, Mycobacterium
DPAPFRLWLWIGVFATSVAVAAVGF

SEQ ID NO: 303673 - protein, 18 aa, Mycobacterium
DPAQAVALMNAERCTHMA

SEQ ID NO: 303674 - protein, 18 aa, Mycobacterium
DPARGRERAALVILGLVS

SEQ ID NO: 303675 - protein, 19 aa, Mycobacterium
DPARWPWPTFTVNIVGAFL

SEQ ID NO: 303676 - protein, 18 aa, Mycobacterium
DPASATVLILKRAAEEYR

SEQ ID NO: 303677 - protein, 17 aa, Mycobacterium
DPASVAWLRICGAALVF

SEQ ID NO: 303678 - protein, 20 aa, Mycobacterium
DPATPFSVTVSFDRPGGLPP

SEQ ID NO: 303679 - protein, 17 aa, Mycobacterium
DPAVFKALFLGFMFAFA

SEQ ID NO: 303680 - protein, 19 aa, Mycobacterium
DPAVITLIIRKGHTFVPMP

SEQ ID NO: 303681 - protein, 21 aa, Mycobacterium
DPAVLQFIYVRAFASVVDASF

SEQ ID NO: 303682 - protein, 20 aa, Mycobacterium
DPCRWWIVYCTAAAVAIGLA

SEQ ID NO: 303683 - protein, 26 aa, Mycobacterium
DPDDRYPRCIDFAKALAAGPGSIAEH

SEQ ID NO: 303684 - protein, 25 aa, Mycobacterium
DPDGAIEDPVRWLATVIKMDGRRID

SEQ ID NO: 303685 - protein, 23 aa, Mycobacterium
DPDGGAAFIRRLLTLATALLLAV

SEQ ID NO: 303686 - protein, 24 aa, Mycobacterium
DPDGGAAFVRRLVTLVTTLLLVTT

SEQ ID NO: 303687 - protein, 25 aa, Mycobacterium
DPDGGWRGNAAQAYWVQNLAQSRHA

SEQ ID NO: 303688 - protein, 19 aa, Mycobacterium
DPDGHVWMLINDREAEPEL

SEQ ID NO: 303689 - protein, 19 aa, Mycobacterium
DPDLGFTFGVMVVATVLYG

SEQ ID NO: 303690 - protein, 23 aa, Mycobacterium
DPDLKKRVAGFIGQEMTHGLHHR

SEQ ID NO: 303691 - protein, 21 aa, Mycobacterium
DPDMRAAVVSIDPHNGGVRAY

SEQ ID NO: 303692 - protein, 25 aa, Mycobacterium
DPDRCRRFRHLLLAFTVGAEHFTAV

SEQ ID NO: 303693 - protein, 20 aa, Mycobacterium
DPDWSWLKWLPHVQHQTDTD

SEQ ID NO: 303694 - protein, 21 aa, Mycobacterium
DPDWSWLKWLPHVQHQTETDG

SEQ ID NO: 303695 - protein, 39 aa, Mycobacterium
DPEARPRLILGSAMVALPAFGLWHLWAGAPADPVERRHA

SEQ ID NO: 303696 - protein, 25 aa, Mycobacterium
DPEARPRLILGTAMIALPALGLWHL

SEQ ID NO: 303697 - protein, 25 aa, Mycobacterium
DPEARRRAAGFIGFAIGGPLADGLT

SEQ ID NO: 303698 - protein, 25 aa, Mycobacterium
DPEARRRAAGFIGFAIGGPLSDGLT

SEQ ID NO: 303699 - protein, 37 aa, Mycobacterium
DPEEAELAFLLAGWRDDVRQAPMTGIINPREAVVALD

SEQ ID NO: 303700 - protein, 23 aa, Mycobacterium
DPEGAVARWNWVLDGMVETKALS

SEQ ID NO: 303701 - protein, 28 aa, Mycobacterium
DPEGAVTRALCLAVDPDLLVTVNAMTAG

SEQ ID NO: 303702 - protein, 24 aa, Mycobacterium
DPEHLKLGPFVVMHAIADYVVDHY

SEQ ID NO: 303703 - protein, 22 aa, Mycobacterium
DPEIKNLLNWHAIEELEHKSVA

SEQ ID NO: 303704 - protein, 17 aa, Mycobacterium
DPEIRRILTTGTPAAQQ

SEQ ID NO: 303705 - protein, 22 aa, Mycobacterium
DPELKKRVAGFIGQESVHGQEH

SEQ ID NO: 303706 - protein, 22 aa, Mycobacterium
DPELRARHLALASTVADETTLT

SEQ ID NO: 303707 - protein, 21 aa, Mycobacterium
DPEMAPAVDRRVFLARTAAVT

SEQ ID NO: 303708 - protein, 21 aa, Mycobacterium
DPEMRAAVVSIDPHNGAVRAY

SEQ ID NO: 303709 - protein, 31 aa, Mycobacterium
DPETVLTSWLWPMWAGIGVIVAGTLVAVLPT

SEQ ID NO: 303710 - protein, 23 aa, Mycobacterium
DPEVLRTSLTVVMRRHQALRASF

SEQ ID NO: 303711 - protein, 26 aa, Mycobacterium
DPEVRPRLILGASLITLSVLGLRHLW

SEQ ID NO: 303712 - protein, 24 aa, Mycobacterium
DPEYPRERLEYMVSDARPITVLDD

SEQ ID NO: 303713 - protein, 18 aa, Mycobacterium
DPFKYPALTEALKLSLNV

SEQ ID NO: 303714 - protein, 27 aa, Mycobacterium
DPFPVLFKPGVGLLLDLQSSSALSSVT

SEQ ID NO: 303715 - protein, 26 aa, Mycobacterium
DPGGLRLKMWLFPWLSYATIALMASV

SEQ ID NO: 303716 - protein, 21 aa, Mycobacterium
DPGQAWVLVFAVTMMAGLLVS

SEQ ID NO: 303717 - protein, 22 aa, Mycobacterium
DPGQTWVLVFAITMMAGLVVSL

SEQ ID NO: 303718 - protein, 17 aa, Mycobacterium
DPGRWPWPTFTVNIVGA

SEQ ID NO: 303719 - protein, 18 aa, Mycobacterium
DPGSPVMLMFLCTTLIVW

SEQ ID NO: 303720 - protein, 38 aa, Mycobacterium
DPHAPEFWGLLALRAVVFAVLMAIAFRLLSPIEHRPLP

SEQ ID NO: 303721 - protein, 18 aa, Mycobacterium
DPHLERIRCWIQDRHRAL

SEQ ID NO: 303722 - protein, 21 aa, Mycobacterium
DPISGAVLWTYARDADLCGVT

SEQ ID NO: 303723 - protein, 18 aa, Mycobacterium
DPISWLRHMSHHGSTHTA

SEQ ID NO: 303724 - protein, 29 aa, Mycobacterium
DPKDRYQRCIDFARALGHRLGGGGDADET

SEQ ID NO: 303725 - protein, 28 aa, Mycobacterium
DPKDRYQRCIDFARALSHRLGGVGDPDD

SEQ ID NO: 303726 - protein, 23 aa, Mycobacterium
DPKELPVPVLLLGVQNDPIVGNE

SEQ ID NO: 303727 - protein, 20 aa, Mycobacterium
DPKETVSFIAWVAYAAYLHA

SEQ ID NO: 303728 - protein, 22 aa, Mycobacterium
DPKETVSFIAWVVYAAYLHARS

SEQ ID NO: 303729 - protein, 20 aa, Mycobacterium
DPKETVSFVAWVIYAAYLHA

SEQ ID NO: 303730 - protein, 21 aa, Mycobacterium
DPKETVSFVAWVIYAAYLHAR

SEQ ID NO: 303731 - protein, 21 aa, Mycobacterium
DPKETVSFVAWVVYAAYLHAR

SEQ ID NO: 303732 - protein, 23 aa, Mycobacterium
DPKGVRFRPFLAALGASLAAGAA

SEQ ID NO: 303733 - protein, 26 aa, Mycobacterium
DPKKVPGRAGVLCVVSILLTYLLVSV

SEQ ID NO: 303734 - protein, 36 aa, Mycobacterium
DPKRAISSRGWRRIGVSVVRWPGPVLAATLALALVG

SEQ ID NO: 303735 - protein, 24 aa, Mycobacterium
DPKSQWQVLSSWKYRNPEANEPSE

SEQ ID NO: 303736 - protein, 21 aa, Mycobacterium
DPLARALLRIGLTPDAVTIIG

SEQ ID NO: 303737 - protein, 24 aa, Mycobacterium
DPLGGWRTALMVWAAVSLLALTLW

SEQ ID NO: 303738 - protein, 23 aa, Mycobacterium
DPLKFWLSRADSVGVEQARQVAR

SEQ ID NO: 303739 - protein, 23 aa, Mycobacterium
DPLPGDPTRGWSSVKTIATPAWF

SEQ ID NO: 303740 - protein, 20 aa, Mycobacterium
DPLPRWLRADVLSTGDLTIA

SEQ ID NO: 303741 - protein, 18 aa, Mycobacterium
DPLPRWLRADVLTTGDLL

SEQ ID NO: 303742 - protein, 17 aa, Mycobacterium
DPLPRWVRAEVLSSGDL

SEQ ID NO: 303743 - protein, 20 aa, Mycobacterium
DPLRIGVVAYMLSRRHPMRL

SEQ ID NO: 303744 - protein, 23 aa, Mycobacterium
DPLRTGIFGVVLVICVVLIAFGY

SEQ ID NO: 303745 - protein, 21 aa, Mycobacterium
DPLSFLDCLYYATVSLSTTGY

SEQ ID NO: 303746 - protein, 18 aa, Mycobacterium
DPLTGLLGCITFAALAGY

SEQ ID NO: 303747 - protein, 18 aa, Mycobacterium
DPLVPAAVFGPVLLFAAW

SEQ ID NO: 303748 - protein, 22 aa, Mycobacterium
DPLWDYKVSSWLLAAGACLVQA

SEQ ID NO: 303749 - protein, 28 aa, Mycobacterium
DPNARSHRGIIMAFAMLAGVLVIVGLGY

SEQ ID NO: 303750 - protein, 20 aa, Mycobacterium
DPNPPLPPWMAPAPPVPGTA

SEQ ID NO: 303751 - protein, 27 aa, Mycobacterium
DPNQRYPTCTAFALALTQHGPHRDAAL

SEQ ID NO: 303752 - protein, 23 aa, Mycobacterium
DPPARRRVGALEAQRREKVPTKR

SEQ ID NO: 303753 - protein, 19 aa, Mycobacterium
DPPGGRLVSLTVVRTILVT

SEQ ID NO: 303754 - protein, 34 aa, Mycobacterium
DPPKEPPWRRLRFSQLLIGFSAVVAMTAIGGVAF

SEQ ID NO: 303755 - protein, 21 aa, Mycobacterium
DPPPALPVVMMIGGEFNTPAD

SEQ ID NO: 303756 - protein, 21 aa, Mycobacterium
DPPPHPPPRSWRLERQLTAVL

SEQ ID NO: 303757 - protein, 23 aa, Mycobacterium
DPPPRLPVVMMIGGQFNTPADWA

SEQ ID NO: 303758 - protein, 19 aa, Mycobacterium
DPQGAVLLRDPLRRQAPRT

SEQ ID NO: 303759 - protein, 25 aa, Mycobacterium
DPQQRLLLEVAWEALEHAGIAPSAL

SEQ ID NO: 303760 - protein, 18 aa, Mycobacterium
DPQQRLMLEVSWEALEHA

SEQ ID NO: 303761 - protein, 24 aa, Mycobacterium
DPQQRLMLEVSWEALERSGIDPTT

SEQ ID NO: 303762 - protein, 26 aa, Mycobacterium
DPQQRMALELTWEALEHARIPPSSLR

SEQ ID NO: 303763 - protein, 24 aa, Mycobacterium
DPQTVSVPARWVVGGVEHAGPVDA

SEQ ID NO: 303764 - protein, 30 aa, Mycobacterium
DPRARARFLAICGGGGFLLYLQMHDNPTDL

SEQ ID NO: 303765 - protein, 20 aa, Mycobacterium
DPRCDGGFTLFYLGVNLGAF

SEQ ID NO: 303766 - protein, 25 aa, Mycobacterium
DPRGWREVQTIVSPAWYDPLVLTVG

SEQ ID NO: 303767 - protein, 20 aa, Mycobacterium
DPRIGRQFLNAGLGFGGGCL

SEQ ID NO: 303768 - protein, 26 aa, Mycobacterium
DPRISRAHLILRFDQGRWLAIDNGSL

SEQ ID NO: 303769 - protein, 18 aa, Mycobacterium
DPRLAAFDDVIAKGMAKK

SEQ ID NO: 303770 - protein, 25 aa, Mycobacterium
DPRLIVCYYLALSVLTFGAACVARE

SEQ ID NO: 303771 - protein, 24 aa, Mycobacterium
DPRLRGADQAALWQAVTIRGVTTA

SEQ ID NO: 303772 - protein, 19 aa, Mycobacterium
DPRLRRVLKDDAHKLTAVG

SEQ ID NO: 303773 - protein, 17 aa, Mycobacterium
DPRNWAGVTSISIPSWW

SEQ ID NO: 303774 - protein, 24 aa, Mycobacterium
DPRNYRLIVTVARDGRQLKMSKVE

SEQ ID NO: 303775 - protein, 18 aa, Mycobacterium
DPRRGRVSVDDALQASCA

SEQ ID NO: 303776 - protein, 25 aa, Mycobacterium
DPRSLRTVWRAGLRLWTASLALTAA

SEQ ID NO: 303777 - protein, 22 aa, Mycobacterium
DPRTLWRNPVMFIVEIGAGWAT

SEQ ID NO: 303778 - protein, 20 aa, Mycobacterium
DPRTSWTAPQRVVQFQTPPT

SEQ ID NO: 303779 - protein, 22 aa, Mycobacterium
DPSALWTLAGGRRMWERRPGDS

SEQ ID NO: 303780 - protein, 25 aa, Mycobacterium
DPSARSFAGAAIWLGVASFLVAGIV

SEQ ID NO: 303781 - protein, 25 aa, Mycobacterium
DPSARSFTTAAIWLVIAAFVVASVV

SEQ ID NO: 303782 - protein, 24 aa, Mycobacterium
DPSFRANPDGSWQARNGEWSPPNY

SEQ ID NO: 303783 - protein, 23 aa, Mycobacterium
DPSRERMFRWLLAVLGLAARLLP

SEQ ID NO: 303784 - protein, 22 aa, Mycobacterium
DPSRVRRSGGTGLGLAISIEDA

SEQ ID NO: 303785 - protein, 20 aa, Mycobacterium
DPSTGTVRWQGHDVRSVPLT

SEQ ID NO: 303786 - protein, 27 aa, Mycobacterium
DPSVPAARLEFMLGDAKPVAAVTTGDL

SEQ ID NO: 303787 - protein, 17 aa, Mycobacterium
DPTDARALAAVPLDVLD

SEQ ID NO: 303788 - protein, 22 aa, Mycobacterium
DPTLALRLEFLLSEADTAALTA

SEQ ID NO: 303789 - protein, 19 aa, Mycobacterium
DPTLARAALDVDTLSRAIV

SEQ ID NO: 303790 - protein, 35 aa, Mycobacterium
DPTPRGKWSVPTPYGGPQWPLPIPGDAPLPPEAPA

SEQ ID NO: 303791 - protein, 21 aa, Mycobacterium
DPTREPISFAPPREPAVESAT

SEQ ID NO: 303792 - protein, 22 aa, Mycobacterium
DPTSRRPLLRLALTEAALFGVA

SEQ ID NO: 303793 - protein, 20 aa, Mycobacterium
DPTVDIGWWKMHRLRMRDSK

SEQ ID NO: 303794 - protein, 24 aa, Mycobacterium
DPVGAAFLVARRKLGGGLPPDPAG

SEQ ID NO: 303795 - protein, 17 aa, Mycobacterium
DPVGPRFFPIVIGVALL

SEQ ID NO: 303796 - protein, 24 aa, Mycobacterium
DPVGRCAAIGFALIGAMFYLDHAA

SEQ ID NO: 303797 - protein, 24 aa, Mycobacterium
DPVLKKRVAGFIGQEAMHGREHRK

SEQ ID NO: 303798 - protein, 23 aa, Mycobacterium
DPVLKKRVAGFIGQESVHGQEHR

SEQ ID NO: 303799 - protein, 25 aa, Mycobacterium
DPVNDLRPSWLPKLMAHVGGTTAEF

SEQ ID NO: 303800 - protein, 26 aa, Mycobacterium
DPVPFPNFKNGVGLMLQLSEPARIGS

SEQ ID NO: 303801 - protein, 17 aa, Mycobacterium
DPVPGRTATELARTAGR

SEQ ID NO: 303802 - protein, 24 aa, Mycobacterium
DPVSVSRDSLWWVSDQGIRYGIEL

SEQ ID NO: 303803 - protein, 21 aa, Mycobacterium
DPWLAEAWRAQQFGGSDTRWA

SEQ ID NO: 303804 - protein, 21 aa, Mycobacterium
DPWLAESWRAKQFGGSDTRWA

SEQ ID NO: 303805 - protein, 35 aa, Mycobacterium
DPYKYFLEFFQRMGFSPAVAVILAIIALQLYDFLW

SEQ ID NO: 303806 - protein, 23 aa, Mycobacterium
DPYTELYGLMALLGTTAIMIVQA

SEQ ID NO: 303807 - protein, 28 aa, Mycobacterium
DPYVFPDNLPLVAARGGPGGAPGCGSLP

SEQ ID NO: 303808 - protein, 24 aa, Mycobacterium
DQAQAAGMLLWFLIALPIGAVVGG

SEQ ID NO: 303809 - protein, 20 aa, Mycobacterium
DQASSILLTLALTVSVVNAM

SEQ ID NO: 303810 - protein, 24 aa, Mycobacterium
DQCAPFCAVQAWPQLGRQRLSVAA

SEQ ID NO: 303811 - protein, 28 aa, Mycobacterium
DQDPAVFLKLMLRWLNAFVPKPGQTIPG

SEQ ID NO: 303812 - protein, 25 aa, Mycobacterium
DQEGSSTFRALAWSEDEPADDVVPY

SEQ ID NO: 303813 - protein, 24 aa, Mycobacterium
DQELRHWLVVLAFTVIGWTFAAFA

SEQ ID NO: 303814 - protein, 19 aa, Mycobacterium
DQFRDASTMRVEVPEDPTF

SEQ ID NO: 303815 - protein, 20 aa, Mycobacterium
DQGGCLVKGAAMFDDLGAQI

SEQ ID NO: 303816 - protein, 23 aa, Mycobacterium
DQIGTRVELRLGDPLDSDFDRKL

SEQ ID NO: 303817 - protein, 24 aa, Mycobacterium
DQISWLIPAHWGFAAAASTVDLRR

SEQ ID NO: 303818 - protein, 25 aa, Mycobacterium
DQITMKALFALVVFLALVGVYITVR

SEQ ID NO: 303819 - protein, 26 aa, Mycobacterium
DQKRWSGDLAMTWDLLCRSITHGIVG

SEQ ID NO: 303820 - protein, 23 aa, Mycobacterium
DQKVGINHIALWARSRAEIDRFH

SEQ ID NO: 303821 - protein, 17 aa, Mycobacterium
DQLAAWAGLAPVSRDSG

SEQ ID NO: 303822 - protein, 17 aa, Mycobacterium
DQLAGVRVVRAFAREGF

SEQ ID NO: 303823 - protein, 19 aa, Mycobacterium
DQLALPFSWQGVSLHAAGA

SEQ ID NO: 303824 - protein, 23 aa, Mycobacterium
DQLLAVPIWWAYAASLLLITAGL

SEQ ID NO: 303825 - protein, 20 aa, Mycobacterium
DQLMLPFSWQGVSLHAAGAA

SEQ ID NO: 303826 - protein, 19 aa, Mycobacterium
DQLPGLRPGTGLTAVTWLM

SEQ ID NO: 303827 - protein, 18 aa, Mycobacterium
DQLSGVRVVRAFAREDYE

SEQ ID NO: 303828 - protein, 18 aa, Mycobacterium
DQLSGVRVVRAFTREGFE

SEQ ID NO: 303829 - protein, 18 aa, Mycobacterium
DQLSGVRVVRAFTREPFE

SEQ ID NO: 303830 - protein, 20 aa, Mycobacterium
DQLSVCFVLLISGVGSLIHI

SEQ ID NO: 303831 - protein, 17 aa, Mycobacterium
DQMVAGLAADGLRVIAV

SEQ ID NO: 303832 - protein, 32 aa, Mycobacterium
DQPAERKPFLLVGAPLLLVFGICSIALAVSLT

SEQ ID NO: 303833 - protein, 24 aa, Mycobacterium
DQPEVANPALWILGGAVAGLVAIA

SEQ ID NO: 303834 - protein, 25 aa, Mycobacterium
DQPFEPLAMRQHIFGTYPLDPNLIA

SEQ ID NO: 303835 - protein, 20 aa, Mycobacterium
DQPFEPLAMRQHVFGTYPLD

SEQ ID NO: 303836 - protein, 19 aa, Mycobacterium
DQPGTFMSGFVERIGDSVA

SEQ ID NO: 303837 - protein, 24 aa, Mycobacterium
DQPWAWTTARGWLEVLPGAATALG

SEQ ID NO: 303838 - protein, 17 aa, Mycobacterium
DQQPARRRAELSDAALV

SEQ ID NO: 303839 - protein, 23 aa, Mycobacterium
DQRALGAALWYAATAKDAVIVAA

SEQ ID NO: 303840 - protein, 23 aa, Mycobacterium
DQRALGAALWYAATVKDAVVVAA

SEQ ID NO: 303841 - protein, 18 aa, Mycobacterium
DQRALGAAVRYAAVDKNA

SEQ ID NO: 303842 - protein, 19 aa, Mycobacterium
DQRRELLTRVVVSAAGADR

SEQ ID NO: 303843 - protein, 27 aa, Mycobacterium
DQRVGYRLRATMAWDEAQYRISSLEQV

SEQ ID NO: 303844 - protein, 24 aa, Mycobacterium
DQSFLPRLIILLVVAVVITIAVYG

SEQ ID NO: 303845 - protein, 20 aa, Mycobacterium
DQSTAPSWRDLRKPTGGLHA

SEQ ID NO: 303846 - protein, 19 aa, Mycobacterium
DQTDRWRRVLATPPALPAA

SEQ ID NO: 303847 - protein, 25 aa, Mycobacterium
DQTLLDASHSWALAPRRQSPPPYEG

SEQ ID NO: 303848 - protein, 24 aa, Mycobacterium
DQTQAAGMLLWFLIALPIGAVTGG

SEQ ID NO: 303849 - protein, 17 aa, Mycobacterium
DQVDAFRAITRQNLENQ

SEQ ID NO: 303850 - protein, 19 aa, Mycobacterium
DQVEALRAALDAELSGAPM

SEQ ID NO: 303851 - protein, 20 aa, Mycobacterium
DQVHPVLNLASARLITGRPD

SEQ ID NO: 303852 - protein, 18 aa, Mycobacterium
DQVWRDFATYGVVAMLGV

SEQ ID NO: 303853 - protein, 24 aa, Mycobacterium
DQVYFGPNFANFVAVTGNNPAAQT

SEQ ID NO: 303854 - protein, 23 aa, Mycobacterium
DQYARLTYGAALVVTATLLLINH

SEQ ID NO: 303855 - protein, 24 aa, Mycobacterium
DQYVLRRACLDAQWIQRQVTDLRL

SEQ ID NO: 303856 - protein, 17 aa, Mycobacterium
DRAAVLEAIGGAKHVAA

SEQ ID NO: 303857 - protein, 17 aa, Mycobacterium
DRAFSVTLGVLVIACPC

SEQ ID NO: 303858 - protein, 23 aa, Mycobacterium
DRAGSETGFFVWLANMVSSHPVN

SEQ ID NO: 303859 - protein, 22 aa, Mycobacterium
DRALGWKTLRDAGPVVFMNGHY

SEQ ID NO: 303860 - protein, 17 aa, Mycobacterium
DRAMAAGRAGYGSLIGY

SEQ ID NO: 303861 - protein, 21 aa, Mycobacterium
DRARLAFLLTPPLAWLVVAYL

SEQ ID NO: 303862 - protein, 19 aa, Mycobacterium
DRATMLMFMQGRRGAAPDE

SEQ ID NO: 303863 - protein, 43 aa, Mycobacterium
DRAVARNRPRLPLALVGSAAAAVLCLGGFGAAVYGSSPGDALY

SEQ ID NO: 303864 - protein, 20 aa, Mycobacterium
DRAVVAIKLNVARTAANAIT

SEQ ID NO: 303865 - protein, 32 aa, Mycobacterium
DRDDVELAQLLAGWRDDIRETPMGHVVTPLQA

SEQ ID NO: 303866 - protein, 21 aa, Mycobacterium
DRDGTTWLLWDGKRSQINLTD

SEQ ID NO: 303867 - protein, 24 aa, Mycobacterium
DRDHPLWECWIIEGLPERRWAALI

SEQ ID NO: 303868 - protein, 17 aa, Mycobacterium
DRDLRFILEDAGTAMLF

SEQ ID NO: 303869 - protein, 29 aa, Mycobacterium
DRDNRIGVGLGLSVAKGFVEAMGGTISAT

SEQ ID NO: 303870 - protein, 23 aa, Mycobacterium
DRDRLKIPFGHELKTGEIMYLDI

SEQ ID NO: 303871 - protein, 23 aa, Mycobacterium
DRDRLRIPFGHELKTGDVMYLDI

SEQ ID NO: 303872 - protein, 30 aa, Mycobacterium
DRDRSTPSVGRWVAVVAVLAVLTIVVTIAI

SEQ ID NO: 303873 - protein, 25 aa, Mycobacterium
DRDRVAGLLLSRGALDVQTRDEQPS

SEQ ID NO: 303874 - protein, 18 aa, Mycobacterium
DRDRVIWYSPQKFEGTST

SEQ ID NO: 303875 - protein, 26 aa, Mycobacterium
DRDVFYRQILKYSGLVIAIGPLVAWA

SEQ ID NO: 303876 - protein, 23 aa, Mycobacterium
DREIILRLGPTISEHFDFSPDTW

SEQ ID NO: 303877 - protein, 18 aa, Mycobacterium
DRELRFILEDADSRMVFV

SEQ ID NO: 303878 - protein, 17 aa, Mycobacterium
DRFARAVALARVDELVA

SEQ ID NO: 303879 - protein, 33 aa, Mycobacterium
DRFGRRRLMLVGWAAGLPWSLSVMSLIDSGDRT

SEQ ID NO: 303880 - protein, 25 aa, Mycobacterium
DRFGTKRLWMGSVLAFALGSLLCAL

SEQ ID NO: 303881 - protein, 21 aa, Mycobacterium
DRFGYALGFDLYSFWGVVVTY

SEQ ID NO: 303882 - protein, 21 aa, Mycobacterium
DRFPRGNLIGIPGAPERMVQN

SEQ ID NO: 303883 - protein, 19 aa, Mycobacterium
DRFVPFRLSATIVVVTLAV

SEQ ID NO: 303884 - protein, 30 aa, Mycobacterium
DRFWQHTPRVWLLDMGMLAALSVFYAGFVR

SEQ ID NO: 303885 - protein, 21 aa, Mycobacterium
DRFWWALNRVAGFSIASHRDF

SEQ ID NO: 303886 - protein, 25 aa, Mycobacterium
DRGAQRWDLERQVRLVAGSIVLTGV

SEQ ID NO: 303887 - protein, 21 aa, Mycobacterium
DRGDGLVCSASMFDGVGAQIA

SEQ ID NO: 303888 - protein, 23 aa, Mycobacterium
DRGEFDGHLWISMDYVEGTDASR

SEQ ID NO: 303889 - protein, 24 aa, Mycobacterium
DRGEFDGRLWISMDYVDGTDARHL

SEQ ID NO: 303890 - protein, 23 aa, Mycobacterium
DRGEFQGQLWISMDYVEGTDAAQ

SEQ ID NO: 303891 - protein, 26 aa, Mycobacterium
DRGLRRLAIERGWQVLSFSRPVSLRD

SEQ ID NO: 303892 - protein, 25 aa, Mycobacterium
DRGNPAPLMLWVWIALTGVAATVLV

SEQ ID NO: 303893 - protein, 18 aa, Mycobacterium
DRGRYQGAMGAVFGVTTV

SEQ ID NO: 303894 - protein, 19 aa, Mycobacterium
DRGSIGPFVAGAVIFGIVV

SEQ ID NO: 303895 - protein, 17 aa, Mycobacterium
DRGWDVEGVFDPDPDAL

SEQ ID NO: 303896 - protein, 25 aa, Mycobacterium
DRIAKEVFRSPGIAMVQSITRPLGG

SEQ ID NO: 303897 - protein, 20 aa, Mycobacterium
DRIAKNIFRTPGIERIQSIT

SEQ ID NO: 303898 - protein, 23 aa, Mycobacterium
DRIAKRIIRVAGIARVQGITRPL

SEQ ID NO: 303899 - protein, 18 aa, Mycobacterium
DRIAKRVFQVPGISRVQA

SEQ ID NO: 303900 - protein, 23 aa, Mycobacterium
DRIEPSVFRHEWTRAALAAANGL

SEQ ID NO: 303901 - protein, 22 aa, Mycobacterium
DRIGPASAIALMLQNLGGPLVL

SEQ ID NO: 303902 - protein, 17 aa, Mycobacterium
DRIGRKRVLMFTILLMA

SEQ ID NO: 303903 - protein, 21 aa, Mycobacterium
DRIGRKRVLVVAISVFAAGAI

SEQ ID NO: 303904 - protein, 23 aa, Mycobacterium
DRIGRKSLLIAGAVAFAVFAYPL

SEQ ID NO: 303905 - protein, 19 aa, Mycobacterium
DRIGVPWWFLVAQLPVAGI

SEQ ID NO: 303906 - protein, 19 aa, Mycobacterium
DRIMSVLNRYGMSPSSLTI

SEQ ID NO: 303907 - protein, 21 aa, Mycobacterium
DRIPPKYVVLASFAGTALLAF

SEQ ID NO: 303908 - protein, 23 aa, Mycobacterium
DRIRELERPLADAARASEVGSAQ

SEQ ID NO: 303909 - protein, 33 aa, Mycobacterium
DRISGVFVPIVIAIAVITLGAWLGAGFSVTAAF

SEQ ID NO: 303910 - protein, 34 aa, Mycobacterium
DRISGVFVPIVLAIAVITLGAWLGAGFPVAAAFT

SEQ ID NO: 303911 - protein, 19 aa, Mycobacterium
DRISYSTVDVAFFAEQVGG

SEQ ID NO: 303912 - protein, 31 aa, Mycobacterium
DRIVAVEYVLAWVFACVLIALLLAMFEPRPL

SEQ ID NO: 303913 - protein, 19 aa, Mycobacterium
DRIVCPWHGSRFACESGEV

SEQ ID NO: 303914 - protein, 22 aa, Mycobacterium
DRKAWYVPVGVAGTLGDLKAAE

SEQ ID NO: 303915 - protein, 24 aa, Mycobacterium
DRKLLEVGQTFALSRRETIRLVVV

SEQ ID NO: 303916 - protein, 22 aa, Mycobacterium
DRKRASVAIYGMLVRLARVTFF

SEQ ID NO: 303917 - protein, 21 aa, Mycobacterium
DRKWLTIALILIGGFMAIEVV

SEQ ID NO: 303918 - protein, 27 aa, Mycobacterium
DRLAERDPRWLLWIVVTLTLVLLPASV

SEQ ID NO: 303919 - protein, 19 aa, Mycobacterium
DRLAFSNGIIFLSAAAVGA

SEQ ID NO: 303920 - protein, 19 aa, Mycobacterium
DRLAFSNGIIFLSAVAILF

SEQ ID NO: 303921 - protein, 20 aa, Mycobacterium
DRLAFSNGILILALAAIAFV

SEQ ID NO: 303922 - protein, 25 aa, Mycobacterium
DRLAKDIFRSPGIAMVQSITRPLGG

SEQ ID NO: 303923 - protein, 19 aa, Mycobacterium
DRLAKGIFRVPGISRVQAI

SEQ ID NO: 303924 - protein, 21 aa, Mycobacterium
DRLATTGPYAWVRHPQYDGFL

SEQ ID NO: 303925 - protein, 20 aa, Mycobacterium
DRLDGLLARNYGMATEFGAF

SEQ ID NO: 303926 - protein, 21 aa, Mycobacterium
DRLDGSLLRIAGICVFASVAV

SEQ ID NO: 303927 - protein, 19 aa, Mycobacterium
DRLDWPTIRIAGVCLIAAI

SEQ ID NO: 303928 - protein, 18 aa, Mycobacterium
DRLGEVEEVLPLLPLQEG

SEQ ID NO: 303929 - protein, 33 aa, Mycobacterium
DRLGRRRIMLVGWSCCLLWSFLVMPLLNTGKPV

SEQ ID NO: 303930 - protein, 19 aa, Mycobacterium
DRLGRRTVILSSMTLTLPW

SEQ ID NO: 303931 - protein, 25 aa, Mycobacterium
DRLGSRMRPIRIIAMAAAVVMVLLA

SEQ ID NO: 303932 - protein, 25 aa, Mycobacterium
DRLHRLRVALLLAVFVLLTLGVTRA

SEQ ID NO: 303933 - protein, 23 aa, Mycobacterium
DRLKEMIKVRGFQVAPAEIETVL

SEQ ID NO: 303934 - protein, 20 aa, Mycobacterium
DRLLMIVGVVLVQFATANQL

SEQ ID NO: 303935 - protein, 23 aa, Mycobacterium
DRLLRRVCPGDIVVLDALDLDRI

SEQ ID NO: 303936 - protein, 24 aa, Mycobacterium
DRLLRRVCPGDIVVLDILDLDRIT

SEQ ID NO: 303937 - protein, 20 aa, Mycobacterium
DRLLSRGGMDSMLLTIWLII

SEQ ID NO: 303938 - protein, 18 aa, Mycobacterium
DRLLSRRAPRPGPDVPVL

SEQ ID NO: 303939 - protein, 26 aa, Mycobacterium
DRLMPKLQAALGIPVFTPADGDLALA

SEQ ID NO: 303940 - protein, 23 aa, Mycobacterium
DRLPKLCRSYLLAPSRQAREQGW

SEQ ID NO: 303941 - protein, 25 aa, Mycobacterium
DRLPLGTAVAIEFLGPIGVAAMGSR

SEQ ID NO: 303942 - protein, 17 aa, Mycobacterium
DRLPYVANRVIGFALAD

SEQ ID NO: 303943 - protein, 22 aa, Mycobacterium
DRLREVARLNAAIAQAPVFGHG

SEQ ID NO: 303944 - protein, 23 aa, Mycobacterium
DRLRSRHGWLDHVIRAYQRFDER

SEQ ID NO: 303945 - protein, 17 aa, Mycobacterium
DRLRVPIGTTMQGAPLE

SEQ ID NO: 303946 - protein, 25 aa, Mycobacterium
DRLTGDWLDGRAYYRGRFIDQTIDN

SEQ ID NO: 303947 - protein, 22 aa, Mycobacterium
DRLTHIPLGWFSAERTALARQA

SEQ ID NO: 303948 - protein, 18 aa, Mycobacterium
DRLWIRFIPDTEHRSQVI

SEQ ID NO: 303949 - protein, 17 aa, Mycobacterium
DRLWIRFIQDTEHRSQV

SEQ ID NO: 303950 - protein, 21 aa, Mycobacterium
DRLYRDRHLQLWVVYIDNFSR

SEQ ID NO: 303951 - protein, 21 aa, Mycobacterium
DRMSAAFGEEGSKTMVFVAME

SEQ ID NO: 303952 - protein, 17 aa, Mycobacterium
DRMSSVWENAGLHDVLK

SEQ ID NO: 303953 - protein, 25 aa, Mycobacterium
DRMVLAVSGSEDWSLVGRTFDHIRG

SEQ ID NO: 303954 - protein, 18 aa, Mycobacterium
DRMVRAIWVLRDLLREYG

SEQ ID NO: 303955 - protein, 17 aa, Mycobacterium
DRNAGVLVMNNVPPPKP

SEQ ID NO: 303956 - protein, 17 aa, Mycobacterium
DRNAGVLVMNNVPPPSP

SEQ ID NO: 303957 - protein, 17 aa, Mycobacterium
DRNRVFPKWFGYLNLCN

SEQ ID NO: 303958 - protein, 25 aa, Mycobacterium
DRNSREGVHILALFSSAVLILMLDS

SEQ ID NO: 303959 - protein, 30 aa, Mycobacterium
DRPAEVAWYRRPLVMILGAAAAVLALSAII

SEQ ID NO: 303960 - protein, 24 aa, Mycobacterium
DRPARPKRRAGWVSKLSSGKVVAA

SEQ ID NO: 303961 - protein, 23 aa, Mycobacterium
DRPDQPRGWRFWQRERSPLHTDV

SEQ ID NO: 303962 - protein, 20 aa, Mycobacterium
DRPDTVLLMIGRWEIVDRKH

SEQ ID NO: 303963 - protein, 23 aa, Mycobacterium
DRPDWGTDLSFAFMRSMMVSSGR

SEQ ID NO: 303964 - protein, 21 aa, Mycobacterium
DRPECGEIHLPAQDVELDNTG

SEQ ID NO: 303965 - protein, 19 aa, Mycobacterium
DRPFVELYLTLAATAVVSA

SEQ ID NO: 303966 - protein, 21 aa, Mycobacterium
DRPGWITFLLGYGAIINPVLF

SEQ ID NO: 303967 - protein, 19 aa, Mycobacterium
DRPIMIVVGLGFGIWFGFK

SEQ ID NO: 303968 - protein, 29 aa, Mycobacterium
DRPPQILTLRIAPLDVILTVAFLGALLVV

SEQ ID NO: 303969 - protein, 19 aa, Mycobacterium
DRPRAILARVVITLAIALS

SEQ ID NO: 303970 - protein, 25 aa, Mycobacterium
DRPSYRLEHLISFGFNALGGARDRV

SEQ ID NO: 303971 - protein, 21 aa, Mycobacterium
DRPTAAPFLTALVVIVLVVIG

SEQ ID NO: 303972 - protein, 24 aa, Mycobacterium
DRQLLVCGVAVLAIVSIVTAVLLV

SEQ ID NO: 303973 - protein, 17 aa, Mycobacterium
DRQRMALEMQKLQREHG

SEQ ID NO: 303974 - protein, 18 aa, Mycobacterium
DRQSRGGVRLSRRRPGWA

SEQ ID NO: 303975 - protein, 23 aa, Mycobacterium
DRQWLRHDGWPVLQAVAEYWAGR

SEQ ID NO: 303976 - protein, 20 aa, Mycobacterium
DRRALRLGVVSTMCAGAFLG

SEQ ID NO: 303977 - protein, 26 aa, Mycobacterium
DRRGLPRGGAVALVLLTSFSLLGGIL

SEQ ID NO: 303978 - protein, 22 aa, Mycobacterium
DRRGRYPSLRRAHRRPAPSPIR

SEQ ID NO: 303979 - protein, 19 aa, Mycobacterium
DRRILAYTYRGGWGDPTSS

SEQ ID NO: 303980 - protein, 28 aa, Mycobacterium
DRRLSYPRLLAWFTLFLRLCLGGQMLFY

SEQ ID NO: 303981 - protein, 20 aa, Mycobacterium
DRRPKGAIIGCMAGLTAAFV

SEQ ID NO: 303982 - protein, 19 aa, Mycobacterium
DRRRGMMAGFLPLGTLTGY

SEQ ID NO: 303983 - protein, 20 aa, Mycobacterium
DRRRRVVVVSLFLVSGAVIL

SEQ ID NO: 303984 - protein, 19 aa, Mycobacterium
DRRVLSYTYRGGWGDPTSS

SEQ ID NO: 303985 - protein, 20 aa, Mycobacterium
DRSANPFVFVYNYLKQVVAE

SEQ ID NO: 303986 - protein, 24 aa, Mycobacterium
DRSARSQLWLSLLSWAVVIGLYLA

SEQ ID NO: 303987 - protein, 18 aa, Mycobacterium
DRSMRLILLVTFAVIVVM

SEQ ID NO: 303988 - protein, 19 aa, Mycobacterium
DRSRIPAAILAFTGVASVH

SEQ ID NO: 303989 - protein, 18 aa, Mycobacterium
DRSRPMWMSYLIDGLEDG

SEQ ID NO: 303990 - protein, 19 aa, Mycobacterium
DRSRPVLRAVDYLRSQGYH

SEQ ID NO: 303991 - protein, 18 aa, Mycobacterium
DRSTARSPFRAVANGVRR

SEQ ID NO: 303992 - protein, 22 aa, Mycobacterium
DRSVGMPPTIPAPALGPQRSDV

SEQ ID NO: 303993 - protein, 19 aa, Mycobacterium
DRSWWSGPEIYILVDDYDL

SEQ ID NO: 303994 - protein, 18 aa, Mycobacterium
DRSWWSGPEIYLMVDDYD

SEQ ID NO: 303995 - protein, 20 aa, Mycobacterium
DRTAAGLIKLAGDGYDDGPR

SEQ ID NO: 303996 - protein, 32 aa, Mycobacterium
DRTGAHRVPGAFRLAVLAGALALAGLAVVGFR

SEQ ID NO: 303997 - protein, 17 aa, Mycobacterium
DRTLLLWLLPLLVAPPM

SEQ ID NO: 303998 - protein, 22 aa, Mycobacterium
DRTLRCFASLFGDDALEPLDYV

SEQ ID NO: 303999 - protein, 17 aa, Mycobacterium
DRTPAPPGIKAYVTGGA

SEQ ID NO: 304000 - protein, 20 aa, Mycobacterium
DRTWFAVAILGVYAIAAAGF

SEQ ID NO: 304001 - protein, 28 aa, Mycobacterium
DRVAPPLVMLWLVRWLLFRVEFGAGLIK

SEQ ID NO: 304002 - protein, 26 aa, Mycobacterium
DRVEPVLRAKAAGAWNLHELTHGMDL

SEQ ID NO: 304003 - protein, 19 aa, Mycobacterium
DRVGDIWVSIIVRTTGVVP

SEQ ID NO: 304004 - protein, 18 aa, Mycobacterium
DRVGLLAVRSRTVDIVTT

SEQ ID NO: 304005 - protein, 20 aa, Mycobacterium
DRVGRRPVMLVGGVAIICYA

SEQ ID NO: 304006 - protein, 24 aa, Mycobacterium
DRVGRRRFLLPIGVAATVAMVGVF

SEQ ID NO: 304007 - protein, 17 aa, Mycobacterium
DRVKAWLDPSADPQATG

SEQ ID NO: 304008 - protein, 23 aa, Mycobacterium
DRVQRWALPAAMVVLLIAAAPSM

SEQ ID NO: 304009 - protein, 18 aa, Mycobacterium
DRVRLASLALPVAKVPST

SEQ ID NO: 304010 - protein, 19 aa, Mycobacterium
DRVSSVFVPAVIGVAVATF

SEQ ID NO: 304011 - protein, 29 aa, Mycobacterium
DRVVVLEWRMPRMLMALLIGAALGVSGAI

SEQ ID NO: 304012 - protein, 20 aa, Mycobacterium
DRWAVLSFLAYQHMSLVLQT

SEQ ID NO: 304013 - protein, 22 aa, Mycobacterium
DRWVCGCPGAAAPAPAAVGDRH

SEQ ID NO: 304014 - protein, 21 aa, Mycobacterium
DRYDRCVDFARALSNRSTVTA

SEQ ID NO: 304015 - protein, 24 aa, Mycobacterium
DRYELGEILGFGGMSEVHLARDVR

SEQ ID NO: 304016 - protein, 23 aa, Mycobacterium
DRYEVGEILGFGGMSEVHLARDL

SEQ ID NO: 304017 - protein, 17 aa, Mycobacterium
DRYGRKHLLQIAIVLVG

SEQ ID NO: 304018 - protein, 21 aa, Mycobacterium
DSAGGYPYPGWEQSGDTVGHF

SEQ ID NO: 304019 - protein, 21 aa, Mycobacterium
DSALLFRRAWAIPAVAIGWLL

SEQ ID NO: 304020 - protein, 22 aa, Mycobacterium
DSARLVLHGGFVVIATYVLLYL

SEQ ID NO: 304021 - protein, 23 aa, Mycobacterium
DSARRSGNEFLFQQLAAQNVETI

SEQ ID NO: 304022 - protein, 23 aa, Mycobacterium
DSARRSGNEFLFQQLAAQNVETL

SEQ ID NO: 304023 - protein, 23 aa, Mycobacterium
DSARRSGNEFLFQQLAQQAIETL

SEQ ID NO: 304024 - protein, 24 aa, Mycobacterium
DSARSASGLTKWSVVIDAPPSSDR

SEQ ID NO: 304025 - protein, 23 aa, Mycobacterium
DSASRMWEVFTLQPGPNGTFTGE

SEQ ID NO: 304026 - protein, 27 aa, Mycobacterium
DSAYKMPGGVVMCWAILGFFVFVIWTL

SEQ ID NO: 304027 - protein, 20 aa, Mycobacterium
DSDAVIAGFIGKWPSELGGQ

SEQ ID NO: 304028 - protein, 23 aa, Mycobacterium
DSDCLQLPARFGGLPVITPALVR

SEQ ID NO: 304029 - protein, 29 aa, Mycobacterium
DSDETKLPFCWRGVSLHAGGAGRVRARLT

SEQ ID NO: 304030 - protein, 25 aa, Mycobacterium
DSDEYAVAMMLAAWREDVGREPMPA

SEQ ID NO: 304031 - protein, 25 aa, Mycobacterium
DSDLREIIVVTLLIIFLVMCLLLRA

SEQ ID NO: 304032 - protein, 22 aa, Mycobacterium
DSDPCKALREKIEKRKDVKAVR

SEQ ID NO: 304033 - protein, 22 aa, Mycobacterium
DSDPCKALREKIEKRSDVKAVR

SEQ ID NO: 304034 - protein, 23 aa, Mycobacterium
DSESRIARQLTYWENMLAGMPER

SEQ ID NO: 304035 - protein, 23 aa, Mycobacterium
DSFDGFEYLFWVGCAGAYEDRAK

SEQ ID NO: 304036 - protein, 24 aa, Mycobacterium
DSFDGYEYLFWVGCAGAYDDKAKK

SEQ ID NO: 304037 - protein, 24 aa, Mycobacterium
DSFGRIGVLAAVMLVFTLVFANFF

SEQ ID NO: 304038 - protein, 28 aa, Mycobacterium
DSFLERFSRYGLRPEVVKPSYGMAEAVV

SEQ ID NO: 304039 - protein, 19 aa, Mycobacterium
DSFNGFLLVAGSAAVIGGT

SEQ ID NO: 304040 - protein, 20 aa, Mycobacterium
DSGALFVRVGDVWHPVPNLA

SEQ ID NO: 304041 - protein, 22 aa, Mycobacterium
DSGDSIERWSHNLNVLAAQSAE

SEQ ID NO: 304042 - protein, 23 aa, Mycobacterium
DSGKRLRQVPVRRSVTPSPPVDR

SEQ ID NO: 304043 - protein, 22 aa, Mycobacterium
DSGLRPRYPAVEIFRVEPADAG

SEQ ID NO: 304044 - protein, 18 aa, Mycobacterium
DSHHDLDGAVFSRRQLLV

SEQ ID NO: 304045 - protein, 32 aa, Mycobacterium
DSHVLWDGVVPRLAERFRILRYDNRGVGLSSA

SEQ ID NO: 304046 - protein, 31 aa, Mycobacterium
DSHVLWDGVVPRLAQRFRVIRYDNRGVGLSS

SEQ ID NO: 304047 - protein, 22 aa, Mycobacterium
DSIEALIARWQRVVASMTADPS

SEQ ID NO: 304048 - protein, 20 aa, Mycobacterium
DSIIAIQLVNRARREGVRIT

SEQ ID NO: 304049 - protein, 18 aa, Mycobacterium
DSIKRVGARMSVRQADRV

SEQ ID NO: 304050 - protein, 24 aa, Mycobacterium
DSKRSRSAAGWLALAGAGIGFAFL

SEQ ID NO: 304051 - protein, 19 aa, Mycobacterium
DSLAPAMFVFLPIALLTNL

SEQ ID NO: 304052 - protein, 20 aa, Mycobacterium
DSLDLVFLCAAPVAAVGFVL

SEQ ID NO: 304053 - protein, 18 aa, Mycobacterium
DSLDVHRLARRVLRRPEP

SEQ ID NO: 304054 - protein, 21 aa, Mycobacterium
DSLPAWLWTGISGMLRASALL

SEQ ID NO: 304055 - protein, 20 aa, Mycobacterium
DSLPLLPFLIVVVIFLIIPT

SEQ ID NO: 304056 - protein, 19 aa, Mycobacterium
DSLVFCSIAATALGIHTFG

SEQ ID NO: 304057 - protein, 23 aa, Mycobacterium
DSMGRSRLRAPFGNRSDNGELLF

SEQ ID NO: 304058 - protein, 25 aa, Mycobacterium
DSMGRSRLRAPFGVRSDNGELLFLD

SEQ ID NO: 304059 - protein, 17 aa, Mycobacterium
DSMLGYVPAEFGPVYRF

SEQ ID NO: 304060 - protein, 18 aa, Mycobacterium
DSNRAVVVSNHLNTPPPR

SEQ ID NO: 304061 - protein, 25 aa, Mycobacterium
DSPDRVCALLSRIAAELPQLHSGFI

SEQ ID NO: 304062 - protein, 27 aa, Mycobacterium
DSPISVRGARNYPCIEHPGKRAPTVEI

SEQ ID NO: 304063 - protein, 25 aa, Mycobacterium
DSPRSRIPLVYLVSGLCGVAVLLGT

SEQ ID NO: 304064 - protein, 25 aa, Mycobacterium
DSQRELMVLAGFALLIWVPALRCPA

SEQ ID NO: 304065 - protein, 19 aa, Mycobacterium
DSRGYLLRDGELTQITKDD

SEQ ID NO: 304066 - protein, 23 aa, Mycobacterium
DSRLGRRSPIPGALSFVAGVFAV

SEQ ID NO: 304067 - protein, 25 aa, Mycobacterium
DSRSARGPRLFRISVTTAFAGSTNA

SEQ ID NO: 304068 - protein, 26 aa, Mycobacterium
DSSLPAKLKRIFSDPVSVVLVVVIVL

SEQ ID NO: 304069 - protein, 26 aa, Mycobacterium
DSSMYRGDVAYDWIRSELKNFGVTRF

SEQ ID NO: 304070 - protein, 24 aa, Mycobacterium
DSTARTQLWLSLLSWSVVVAVYFV

SEQ ID NO: 304071 - protein, 20 aa, Mycobacterium
DSTASWLAWVLALAVAAAPI

SEQ ID NO: 304072 - protein, 19 aa, Mycobacterium
DSTIARWDLGSELLGRPGC

SEQ ID NO: 304073 - protein, 24 aa, Mycobacterium
DSTLKIAHRLSRELVGVDVLHLEE

SEQ ID NO: 304074 - protein, 24 aa, Mycobacterium
DSTLTRVGIIFVVAVIFGLVNAII

SEQ ID NO: 304075 - protein, 26 aa, Mycobacterium
DSTTPVLCLLPIIATGVLYGLAMDYE

SEQ ID NO: 304076 - protein, 26 aa, Mycobacterium
DSVCVSWLPFYHDMGLMQGVIAPILG

SEQ ID NO: 304077 - protein, 19 aa, Mycobacterium
DSVEFSVGIALIVAGSVAS

SEQ ID NO: 304078 - protein, 19 aa, Mycobacterium
DSVGAFGGFAIDIALRQSY

SEQ ID NO: 304079 - protein, 18 aa, Mycobacterium
DSVGLSILLWVLSVLMSL

SEQ ID NO: 304080 - protein, 19 aa, Mycobacterium
DSVQWCLLTMLASVDMRFR

SEQ ID NO: 304081 - protein, 19 aa, Mycobacterium
DSWRARTRELVLIGGVAAL

SEQ ID NO: 304082 - protein, 17 aa, Mycobacterium
DSWSTRSTLRFLWLRLA

SEQ ID NO: 304083 - protein, 30 aa, Mycobacterium
DSYPLGYANAMWDPTIRQFAYGDKGYFQAA

SEQ ID NO: 304084 - protein, 24 aa, Mycobacterium
DSYSLPLRRLLGFVAAGLDVSLIP

SEQ ID NO: 304085 - protein, 27 aa, Mycobacterium
DTACSSSLVAIHWAMASLRSGECDMAL

SEQ ID NO: 304086 - protein, 20 aa, Mycobacterium
DTADGLGCYGPAQRALAVMR

SEQ ID NO: 304087 - protein, 17 aa, Mycobacterium
DTAELFAVRAGDRERAE

SEQ ID NO: 304088 - protein, 24 aa, Mycobacterium
DTAHVGSVLDWWSDPLTAPLGTSP

SEQ ID NO: 304089 - protein, 19 aa, Mycobacterium
DTAIAIKRAEVRREAEIMW

SEQ ID NO: 304090 - protein, 26 aa, Mycobacterium
DTAKGTVKSVTWKAVAGNGIGPDQFA

SEQ ID NO: 304091 - protein, 17 aa, Mycobacterium
DTALARGAALAAASSPL

SEQ ID NO: 304092 - protein, 25 aa, Mycobacterium
DTALARLGYSIGFALLNDSQHQVAD

SEQ ID NO: 304093 - protein, 20 aa, Mycobacterium
DTALRRLVSHAARRSPTATT

SEQ ID NO: 304094 - protein, 25 aa, Mycobacterium
DTARLREQWRFRPAWNSSECVEDFA

SEQ ID NO: 304095 - protein, 19 aa, Mycobacterium
DTASRFAVIAAKYYCPEQL

SEQ ID NO: 304096 - protein, 26 aa, Mycobacterium
DTATARIGFNLGFAVLDHSQHDVADR

SEQ ID NO: 304097 - protein, 19 aa, Mycobacterium
DTATGPWARAAVNRARLDG

SEQ ID NO: 304098 - protein, 31 aa, Mycobacterium
DTAWVLTVIHLRLSLIPVLIGMAIAVPLGLA

SEQ ID NO: 304099 - protein, 23 aa, Mycobacterium
DTDPALPGNRAWGRAVTGRIAGS

SEQ ID NO: 304100 - protein, 24 aa, Mycobacterium
DTDPRLYVPAGIEQMWFGDAVAAP

SEQ ID NO: 304101 - protein, 18 aa, Mycobacterium
DTEFSEWEQVAARVAGEL

SEQ ID NO: 304102 - protein, 30 aa, Mycobacterium
DTELPRQFGYNMPLELALTVTPFLIISVLF

SEQ ID NO: 304103 - protein, 30 aa, Mycobacterium
DTELPRQFGYNMPLELTLTVIPFIIISVLF

SEQ ID NO: 304104 - protein, 32 aa, Mycobacterium
DTELPRQFGYNMPLELTLTVIPFLIISVLFYF

SEQ ID NO: 304105 - protein, 30 aa, Mycobacterium; identical to SEQ ID NO: 10767

SEQ ID NO: 304106 - protein, 19 aa, Mycobacterium
DTERARWSLGDTVTLRGHE

SEQ ID NO: 304107 - protein, 26 aa, Mycobacterium
DTERLQRWFAYLVFVVAGYVLIDTIF

SEQ ID NO: 304108 - protein, 19 aa, Mycobacterium
DTFAGPVQVPSRWQHDVDM

SEQ ID NO: 304109 - protein, 28 aa, Mycobacterium
DTFDRPTPELALRFAGNRWVAIDQSRNG

SEQ ID NO: 304110 - protein, 18 aa, Mycobacterium
DTFGETFLLLAAVVAVLL

SEQ ID NO: 304111 - protein, 19 aa, Mycobacterium
DTFVSWLPLYHDMGLIGAW

SEQ ID NO: 304112 - protein, 21 aa, Mycobacterium
DTGCWLWLAALPLMIVSYMAA

SEQ ID NO: 304113 - protein, 29 aa, Mycobacterium
DTGENRDAWMVGFTPSLSTAVWVGTVDGT

SEQ ID NO: 304114 - protein, 22 aa, Mycobacterium
DTGIDWDVIFLLLGMMIIVSVL

SEQ ID NO: 304115 - protein, 21 aa, Mycobacterium
DTGNYWPVVAIIVPAYNEPDI

SEQ ID NO: 304116 - protein, 23 aa, Mycobacterium
DTGVPRPGLSTVFSPSRSTFGVD

SEQ ID NO: 304117 - protein, 17 aa, Mycobacterium
DTGWRGFVDHLLVITLI

SEQ ID NO: 304118 - protein, 27 aa, Mycobacterium
DTHSARMDLAFSLAESWTEAGEAAGIS

SEQ ID NO: 304119 - protein, 26 aa, Mycobacterium
DTIAALGIMICWYYGITAFACIWEFR

SEQ ID NO: 304120 - protein, 25 aa, Mycobacterium
DTIAALGIMICWYYGITAFACVWYF

SEQ ID NO: 304121 - protein, 24 aa, Mycobacterium
DTIAALGMLVCWYYGITAFACMWY

SEQ ID NO: 304122 - protein, 24 aa, Mycobacterium
DTITSMYGHLRWLTTGTHDDMAMR

SEQ ID NO: 304123 - protein, 24 aa, Mycobacterium
DTIYQKMLSEWLVDPHELSHSSDL

SEQ ID NO: 304124 - protein, 24 aa, Mycobacterium
DTKEAREALGLSLAPSMAPWVALR

SEQ ID NO: 304125 - protein, 23 aa, Mycobacterium
DTKTPVSFMCYWVIPVSLLGLAA

SEQ ID NO: 304126 - protein, 24 aa, Mycobacterium
DTLFICSATGFLILSTGAYRVFEG

SEQ ID NO: 304127 - protein, 24 aa, Mycobacterium
DTLFRLDHLAARLRRNSANLLVLA

SEQ ID NO: 304128 - protein, 25 aa, Mycobacterium
DTLIGAAVAVVFGYLLWPGARRLPG

SEQ ID NO: 304129 - protein, 17 aa, Mycobacterium
DTLPEYLVFGAISIATL

SEQ ID NO: 304130 - protein, 19 aa, Mycobacterium
DTLPMLALTLARLYTDYGS

SEQ ID NO: 304131 - protein, 25 aa, Mycobacterium
DTLRALARRGLRVLAVAARELTGET

SEQ ID NO: 304132 - protein, 19 aa, Mycobacterium
DTLRPDRIVLGVHQDSVRA

SEQ ID NO: 304133 - protein, 23 aa, Mycobacterium
DTLSLRGLIAPNWRQRLPNNSVP

SEQ ID NO: 304134 - protein, 32 aa, Mycobacterium
DTLVAMFKWPFPWREFLLQSWFVARVSIIPTL

SEQ ID NO: 304135 - protein, 23 aa, Mycobacterium
DTLWLPGLFLIVLGVIGLAGIVA

SEQ ID NO: 304136 - protein, 18 aa, Mycobacterium
DTMMGRGVAIKVLPPELA

SEQ ID NO: 304137 - protein, 26 aa, Mycobacterium
DTNFIPKVLLGISFPGIVVSVSCHLF

SEQ ID NO: 304138 - protein, 24 aa, Mycobacterium
DTPAEVLAGFDFEAQGVWTFARPG

SEQ ID NO: 304139 - protein, 17 aa, Mycobacterium
DTPAMWRYAGMAASALV

SEQ ID NO: 304140 - protein, 17 aa, Mycobacterium
DTPAREVMVPRTEMIWI

SEQ ID NO: 304141 - protein, 17 aa, Mycobacterium
DTPAREVMVPRTEMVWI

SEQ ID NO: 304142 - protein, 21 aa, Mycobacterium
DTPDGLVLTARVAGLTKSIPT

SEQ ID NO: 304143 - protein, 26 aa, Mycobacterium
DTPEFPWAGLTIFLLIAVLAAAVGTR

SEQ ID NO: 304144 - protein, 26 aa, Mycobacterium
DTPEFPWTGLTIFLLIGVLAAAVGTR

SEQ ID NO: 304145 - protein, 25 aa, Mycobacterium
DTPLPVSGKETWRGVADDAGVVAAY

SEQ ID NO: 304146 - protein, 23 aa, Mycobacterium
DTPPDVLAGFDFSAQGVWAFARP

SEQ ID NO: 304147 - protein, 23 aa, Mycobacterium
DTPPDVLAGFDFTAQGVWSFARP

SEQ ID NO: 304148 - protein, 17 aa, Mycobacterium
DTPTAWVVSPVGMNGKF

SEQ ID NO: 304149 - protein, 20 aa, Mycobacterium
DTPTVWAAVLWFVLVAASTV

SEQ ID NO: 304150 - protein, 33 aa, Mycobacterium
DTPVWRLVLPFCAIGVGMAFVWSPLAATATRNL

SEQ ID NO: 304151 - protein, 22 aa, Mycobacterium
DTRDVLMLQDFVNTPALRPVLT

SEQ ID NO: 304152 - protein, 18 aa, Mycobacterium
DTRDVLMLQDFVSTPALR

SEQ ID NO: 304153 - protein, 18 aa, Mycobacterium
DTRFARLVLGVAVLEDIV

SEQ ID NO: 304154 - protein, 20 aa, Mycobacterium
DTRISRPVAVAVPAAKKSLA

SEQ ID NO: 304155 - protein, 17 aa, Mycobacterium
DTRMFDDPLQFYSRAVF

SEQ ID NO: 304156 - protein, 17 aa, Mycobacterium
DTRMFDDPLQFYSRAVS

SEQ ID NO: 304157 - protein, 17 aa, Mycobacterium
DTRMFDDPLQFYSRSIA

SEQ ID NO: 304158 - protein, 17 aa, Mycobacterium
DTRMFDDPLQFYSRSVG

SEQ ID NO: 304159 - protein, 22 aa, Mycobacterium
DTRPRWVTPALLALLASTAVLY

SEQ ID NO: 304160 - protein, 23 aa, Mycobacterium
DTRTRLSGFAFAREIGSVLAGGF

SEQ ID NO: 304161 - protein, 23 aa, Mycobacterium
DTRVQAAVPFYGVYDFTRFDDAM

SEQ ID NO: 304162 - protein, 23 aa, Mycobacterium
DTRVQAAVPFYGVYDFTRFNDAM

SEQ ID NO: 304163 - protein, 22 aa, Mycobacterium
DTSDILWWLLAAHAVHFLVVPQ

SEQ ID NO: 304164 - protein, 19 aa, Mycobacterium
DTSHPLPVVGFGFSALAIA

SEQ ID NO: 304165 - protein, 25 aa, Mycobacterium
DTSNFAPNMGWRLAFGLGAIFGIFV

SEQ ID NO: 304166 - protein, 30 aa, Mycobacterium
DTSNFPPNIGWRLAFGVGAIFGIFVLLVRR

SEQ ID NO: 304167 - protein, 30 aa, Mycobacterium
DTSRAWRNRMPPQRLALVMGSVAAVTMGAL

SEQ ID NO: 304168 - protein, 22 aa, Mycobacterium
DTSRHWVPAFVKLNELSRKFFD

SEQ ID NO: 304169 - protein, 31 aa, Mycobacterium
DTSRPVGLTLLWPLADRPRLAPGQPGGPTPV

SEQ ID NO: 304170 - protein, 20 aa, Mycobacterium
DTTIVSWLPFYHDMGLIVGV

SEQ ID NO: 304171 - protein, 17 aa, Mycobacterium
DTTQAWVCVTGGNVGQF

SEQ ID NO: 304172 - protein, 27 aa, Mycobacterium
DTTTALSYLCYWLIPFTLFGLAALASR

SEQ ID NO: 304173 - protein, 22 aa, Mycobacterium
DTVDPGRRWSLVALGLLTTGVV

SEQ ID NO: 304174 - protein, 24 aa, Mycobacterium
DTVLRRLGWVLLIVGGVGVAVAAA

SEQ ID NO: 304175 - protein, 26 aa, Mycobacterium
DTVRLLTRLGLTVAMLTGDNARTAEA

SEQ ID NO: 304176 - protein, 25 aa, Mycobacterium
DTVSVVGWLWPLWDSGRRTFADVLL

SEQ ID NO: 304177 - protein, 32 aa, Mycobacterium
DTVWGRFAPIVLRLHFYAGLLVGPFLLIAALT

SEQ ID NO: 304178 - protein, 18 aa, Mycobacterium
DTVWIPAPLAVLATALRL

SEQ ID NO: 304179 - protein, 24 aa, Mycobacterium
DTYGWEWIFLINLPIGITTIVLAA

SEQ ID NO: 304180 - protein, 22 aa, Mycobacterium
DTYRPTPAISLPGDSVVLVNRA

SEQ ID NO: 304181 - protein, 24 aa, Mycobacterium
DVAAGRRKALAFIEGRSVEQLVAL

SEQ ID NO: 304182 - protein, 19 aa, Mycobacterium
DVAALPLAYAVIVSGSLIH

SEQ ID NO: 304183 - protein, 23 aa, Mycobacterium
DVAANWPLRQLITNTGWGTGLDI

SEQ ID NO: 304184 - protein, 18 aa, Mycobacterium
DVADKWSEWMAHPITATV

SEQ ID NO: 304185 - protein, 33 aa, Mycobacterium
DVAFRPVDACIFGDMRSAFYAGYEESDREHVLI

SEQ ID NO: 304186 - protein, 19 aa, Mycobacterium
DVAGVSFPVGNRWARIDLP

SEQ ID NO: 304187 - protein, 31 aa, Mycobacterium; identical to SEQ ID NO: 15529

SEQ ID NO: 304188 - protein, 18 aa, Mycobacterium
DVAIVFLLFAARRPEIDQ

SEQ ID NO: 304189 - protein, 23 aa, Mycobacterium
DVALHLAASFARQRVVYGRRVDQ

SEQ ID NO: 304190 - protein, 25 aa, Mycobacterium
DVARIAVPLLAYFAIMWAGGYLLGA

SEQ ID NO: 304191 - protein, 23 aa, Mycobacterium
DVARIAVPLLAYFALMWGGGYLL

SEQ ID NO: 304192 - protein, 21 aa, Mycobacterium
DVARLQLGLIVGERDDLTALV

SEQ ID NO: 304193 - protein, 23 aa, Mycobacterium
DVARPEVFAMPTWTEVLDEVLRA

SEQ ID NO: 304194 - protein, 29 aa, Mycobacterium
DVARRRGWEVRDFRTARKAARIGVPSAVL

SEQ ID NO: 304195 - protein, 18 aa, Mycobacterium
DVCKHCTHAGCLDVCPTG

SEQ ID NO: 304196 - protein, 22 aa, Mycobacterium
DVDAVLERRPALVLIDEMAHTN

SEQ ID NO: 304197 - protein, 23 aa, Mycobacterium
DVDEPLAYCLPGVRSRVVVSEGA

SEQ ID NO: 304198 - protein, 22 aa, Mycobacterium
DVDIPWYCWVAGAVIGALLGAL

SEQ ID NO: 304199 - protein, 20 aa, Mycobacterium
DVDLCWRLNESGARLRYEPI

SEQ ID NO: 304200 - protein, 25 aa, Mycobacterium
DVEKRPRLTMFDDFGGRIPSDKPPI

SEQ ID NO: 304201 - protein, 18 aa, Mycobacterium
DVEMVLGALLDRHAMLRL

SEQ ID NO: 304202 - protein, 22 aa, Mycobacterium
DVFCALVQRPALAAVDDRALVA

SEQ ID NO: 304203 - protein, 18 aa, Mycobacterium
DVFGLRRWYTLTLAMGTF

SEQ ID NO: 304204 - protein, 24 aa, Mycobacterium
DVFQRSAPWVLPKFDRQYGGRHHQ

SEQ ID NO: 304205 - protein, 20 aa, Mycobacterium
DVGAAPAWRNLRAPLSSIPP

SEQ ID NO: 304206 - protein, 25 aa, Mycobacterium
DVGASPAWRNLRLALSAIPDSATQI

SEQ ID NO: 304207 - protein, 24 aa, Mycobacterium
DVGASPAWRNLRLPLSAIPGSATQ

SEQ ID NO: 304208 - protein, 19 aa, Mycobacterium
DVGLSWLLVVSVPVLTVAS

SEQ ID NO: 304209 - protein, 28 aa, Mycobacterium
DVGPMMWIPVAAFAVWLVIWRVKFSVME

SEQ ID NO: 304210 - protein, 26 aa, Mycobacterium
DVGSLRPSLSWLWPSGLDFGTQMAPA

SEQ ID NO: 304211 - protein, 24 aa, Mycobacterium
DVHTPWFWCLLALRAVVFTLVMAA

SEQ ID NO: 304212 - protein, 24 aa, Mycobacterium
DVIERWPKNHPTPPAQLADEVAAA

SEQ ID NO: 304213 - protein, 20 aa, Mycobacterium
DVIHAFWVPEFLFKRDVMPN

SEQ ID NO: 304214 - protein, 20 aa, Mycobacterium
DVIHGFWVPEFLFKRDVLPE

SEQ ID NO: 304215 - protein, 20 aa, Mycobacterium
DVIHGFWVPEFLFKRDVLPN

SEQ ID NO: 304216 - protein, 25 aa, Mycobacterium
DVIMAMPLVSLLLVALVLALRKVGK

SEQ ID NO: 304217 - protein, 19 aa, Mycobacterium
DVINELRAAGAEAIEIRGG

SEQ ID NO: 304218 - protein, 19 aa, Mycobacterium
DVINELRAAGAEAIEVNDA

SEQ ID NO: 304219 - protein, 19 aa, Mycobacterium
DVINELRAAGAEAIQISDA

SEQ ID NO: 304220 - protein, 19 aa, Mycobacterium
DVIRITSLIGVVLGHTVMA

SEQ ID NO: 304221 - protein, 25 aa, Mycobacterium
DVIRRRRLTWGFLFLFNSLAVYWME

SEQ ID NO: 304222 - protein, 37 aa, Mycobacterium
DVKQARTALWAAIGFVSVYLLICLGIELQGPEGQLLS

SEQ ID NO: 304223 - protein, 22 aa, Mycobacterium
DVLCDLEKVIPLMPGAQLTGHD

SEQ ID NO: 304224 - protein, 18 aa, Mycobacterium
DVLCDLEQVIPLMPGAQL

SEQ ID NO: 304225 - protein, 22 aa, Mycobacterium
DVLEARHSIGFLSLPVLGTDLI

SEQ ID NO: 304226 - protein, 23 aa, Mycobacterium
DVLGHAGPYFARGAADLVGSSQL

SEQ ID NO: 304227 - protein, 24 aa, Mycobacterium
DVLGWPLWLLYVVVFSLTLFIGAR

SEQ ID NO: 304228 - protein, 21 aa, Mycobacterium
DVLHHRQPFFAPISAVVCMSA

SEQ ID NO: 304229 - protein, 20 aa, Mycobacterium
DVLIALAITAMGTRSAAKHQ

SEQ ID NO: 304230 - protein, 18 aa, Mycobacterium
DVLIRELHPDMDRSIRAL

SEQ ID NO: 304231 - protein, 27 aa, Mycobacterium
DVLLDCFRPGTCERLGIGPDECAAVNP

SEQ ID NO: 304232 - protein, 20 aa, Mycobacterium
DVLMLQDFVSTPALRSAVTS

SEQ ID NO: 304233 - protein, 25 aa, Mycobacterium
DVLPQTRWIPVVTFLQVTADMAVAV

SEQ ID NO: 304234 - protein, 23 aa, Mycobacterium
DVLRDGAIVRRFFYLVLLMTAFN

SEQ ID NO: 304235 - protein, 25 aa, Mycobacterium
DVLRKAGYRPALIVGDPDKMSVEVL

SEQ ID NO: 304236 - protein, 19 aa, Mycobacterium
DVLRLGDRGARSLAIGPLT

SEQ ID NO: 304237 - protein, 25 aa, Mycobacterium
DVLSRRFTVGLAFLAGLSVLIRPEL

SEQ ID NO: 304238 - protein, 25 aa, Mycobacterium
DVMARRASAHAARWRTGQFTYRPDH

SEQ ID NO: 304239 - protein, 27 aa, Mycobacterium
DVMAVLGYRTLVAIWRGRYAEADAYAA

SEQ ID NO: 304240 - protein, 25 aa, Mycobacterium
DVMYCAAAMLVGRFAGPAVEGLGSW

SEQ ID NO: 304241 - protein, 26 aa, Mycobacterium
DVNAKLIFPGLITFSATQQGQTIPYG

SEQ ID NO: 304242 - protein, 38 aa, Mycobacterium
DVNEWLQSWTIFYWAWWISWTPFVGMFIARISRGRTIR

SEQ ID NO: 304243 - protein, 29 aa, Mycobacterium
DVPDPAAAVNNFILLFIGNGTATHPDAGL

SEQ ID NO: 304244 - protein, 23 aa, Mycobacterium
DVPETARIVPMIPTTWSTDSDEA

SEQ ID NO: 304245 - protein, 19 aa, Mycobacterium
DVPGARWVAPLLGTVMYVV

SEQ ID NO: 304246 - protein, 19 aa, Mycobacterium
DVPGGRWIAPLLGTVMYVV

SEQ ID NO: 304247 - protein, 26 aa, Mycobacterium
DVPGKRAPTVELCRSDKAFQPLAARP

SEQ ID NO: 304248 - protein, 24 aa, Mycobacterium
DVPGMPRLLKWLSPLVPLVAGPLP

SEQ ID NO: 304249 - protein, 27 aa, Mycobacterium
DVPGMPRLLRWLSPFIPLASTVAPETF

SEQ ID NO: 304250 - protein, 25 aa, Mycobacterium
DVPWQLRVLPPFLSRKHLPSRLAKL

SEQ ID NO: 304251 - protein, 35 aa, Mycobacterium
DVPYLRASPWLLWRKRIVWLLVLFAAEAYTGTVLR

SEQ ID NO: 304252 - protein, 18 aa, Mycobacterium
DVQFKPAAANTWADFTAA

SEQ ID NO: 304253 - protein, 20 aa, Mycobacterium
DVRFSYPAADQVSLASLEEV

SEQ ID NO: 304254 - protein, 22 aa, Mycobacterium
DVRFSYPSADKVSLASLEEVAE

SEQ ID NO: 304255 - protein, 19 aa, Mycobacterium
DVRGAAMLATALGLLTLGL

SEQ ID NO: 304256 - protein, 19 aa, Mycobacterium
DVRGHRLAWCPSDFRGAVV

SEQ ID NO: 304257 - protein, 26 aa, Mycobacterium
DVRGRGGVSLGEFWATEGPLSYLGLA

SEQ ID NO: 304258 - protein, 20 aa, Mycobacterium
DVRGVGIGVIVANIFFTLSS

SEQ ID NO: 304259 - protein, 21 aa, Mycobacterium
DVRIARWVATIAGLLGFVLSV

SEQ ID NO: 304260 - protein, 25 aa, Mycobacterium
DVRIPRNRAVVMLVIDVSQSMRATD

SEQ ID NO: 304261 - protein, 26 aa, Mycobacterium
DVRIPRNRAVVMLVIDVSRSMESTDV

SEQ ID NO: 304262 - protein, 24 aa, Mycobacterium
DVRIYVCGPTGFVESVTTKLIGLG

SEQ ID NO: 304263 - protein, 18 aa, Mycobacterium
DVRKEIFWKSPASRQTMS

SEQ ID NO: 304264 - protein, 18 aa, Mycobacterium
DVRLDRPVALKVMDSRYA

SEQ ID NO: 304265 - protein, 18 aa, Mycobacterium
DVRLEMRSAATLPDGSQT

SEQ ID NO: 304266 - protein, 21 aa, Mycobacterium
DVRLTRAELEGHLRGPLSNLI

SEQ ID NO: 304267 - protein, 24 aa, Mycobacterium
DVRPLLRRILWGVPRQPASFQQWS

SEQ ID NO: 304268 - protein, 20 aa, Mycobacterium
DVRRVLKDDGMYIANLIDYG

SEQ ID NO: 304269 - protein, 17 aa, Mycobacterium
DVRSAQLDDVWAYQSDH

SEQ ID NO: 304270 - protein, 27 aa, Mycobacterium
DVRSARRWTDRLGYVFGPPGWTPARTC

SEQ ID NO: 304271 - protein, 26 aa, Mycobacterium
DVSAEAWLVADLDSGAVIAAKDPHGR

SEQ ID NO: 304272 - protein, 29 aa, Mycobacterium
DVSAEAWLVADLDSGAVIAARDPHGRHRP

SEQ ID NO: 304273 - protein, 20 aa, Mycobacterium
DVSAEAWLVADLDSGDVIAA

SEQ ID NO: 304274 - protein, 28 aa, Mycobacterium
DVSAEAWLVGDLDSGAIIAARDPHARHR

SEQ ID NO: 304275 - protein, 23 aa, Mycobacterium
DVSFGYRPGVPVIHDVSLTLCPG

SEQ ID NO: 304276 - protein, 17 aa, Mycobacterium
DVSRGTAGLSFGLAKSA

SEQ ID NO: 304277 - protein, 28 aa, Mycobacterium
DVSSGPWLPLAVLICVAWGVQAYFMRKT

SEQ ID NO: 304278 - protein, 24 aa, Mycobacterium
DVSSLKPGDSVRVAGLRVGTVNSV

SEQ ID NO: 304279 - protein, 24 aa, Mycobacterium
DVSSRRAAVVLAFTLVGFALAVVQ

SEQ ID NO: 304280 - protein, 25 aa, Mycobacterium
DVSSTRFWKGVAHHYLRMIYDLLAA

SEQ ID NO: 304281 - protein, 17 aa, Mycobacterium
DVSTWFNWSSWYGEVIQ

SEQ ID NO: 304282 - protein, 20 aa, Mycobacterium
DVSVTVFLAAWIPLFGAFGA

SEQ ID NO: 304283 - protein, 22 aa, Mycobacterium
DVTKLRVGDCVADLGEKSYYTT

SEQ ID NO: 304284 - protein, 17 aa, Mycobacterium
DVTLCGLALGILAAVLI

SEQ ID NO: 304285 - protein, 18 aa, Mycobacterium
DVTSCYDGALVRYTEGGR

SEQ ID NO: 304286 - protein, 20 aa, Mycobacterium
DVTVIFGFVLWHVIGANSSD

SEQ ID NO: 304287 - protein, 18 aa, Mycobacterium
DVVAGWALGYAFFVVCLL

SEQ ID NO: 304288 - protein, 18 aa, Mycobacterium
DVVGVSFPGGSRWARIDL

SEQ ID NO: 304289 - protein, 24 aa, Mycobacterium
DVVHSFWVPEFLFKRDVMPNPAAN

SEQ ID NO: 304290 - protein, 30 aa, Mycobacterium
DVVKTELFGRMVAVLSWVWVATAAAMTVSS

SEQ ID NO: 304291 - protein, 19 aa, Mycobacterium
DVVLICIPAGLGIGTAGLG

SEQ ID NO: 304292 - protein, 19 aa, Mycobacterium
DVVLRPYWTPVVAYTAAIL

SEQ ID NO: 304293 - protein, 19 aa, Mycobacterium
DVVLVTGPWLAGVSSVVAA

SEQ ID NO: 304294 - protein, 23 aa, Mycobacterium
DVVMTCILPPLLFNAALESSLVG

SEQ ID NO: 304295 - protein, 18 aa, Mycobacterium
DVVNAWLMSVVLFGVTIA

SEQ ID NO: 304296 - protein, 17 aa, Mycobacterium
DVVNIRGILSFTPSTMY

SEQ ID NO: 304297 - protein, 24 aa, Mycobacterium
DVVRVRRPGGLTLPAENVDLLHRG

SEQ ID NO: 304298 - protein, 18 aa, Mycobacterium
DVVRVRRPGGLVMPPEDR

SEQ ID NO: 304299 - protein, 23 aa, Mycobacterium
DVVVVFLVTWPLVYLSSKSATLS

SEQ ID NO: 304300 - protein, 17 aa, Mycobacterium
DVYRSSFGAQFFSGLVA

SEQ ID NO: 304301 - protein, 33 aa, Mycobacterium
DVYWHRMGVNIVRHPWPFFGVATVILLAAASFV

SEQ ID NO: 304302 - protein, 26 aa, Mycobacterium
DWAARAYAWTDWRFAQLRDWFHRKSA

SEQ ID NO: 304303 - protein, 31 aa, Mycobacterium
DWAARAYAWTDWRFTQARAWLHRQSGFVQAA

SEQ ID NO: 304304 - protein, 27 aa, Mycobacterium
DWAGFSVGWLYWYFWVIVVGFEAVAGG

SEQ ID NO: 304305 - protein, 23 aa, Mycobacterium
DWAQSLGPWFPLAFLVAHIVVTV

SEQ ID NO: 304306 - protein, 25 aa, Mycobacterium
DWARDLGPWFPLAFLGAHTIVTVLP

SEQ ID NO: 304307 - protein, 19 aa, Mycobacterium
DWARPGGDHETMFISQLPY

SEQ ID NO: 304308 - protein, 22 aa, Mycobacterium
DWASRHVWLGVATVTVIAMVTV

SEQ ID NO: 304309 - protein, 24 aa, Mycobacterium
DWATSVGPWFPLAFLVVHIVVTVP

SEQ ID NO: 304310 - protein, 26 aa, Mycobacterium
DWDRHLRPMLARRYEIATGQRLAKDP

SEQ ID NO: 304311 - protein, 25 aa, Mycobacterium
DWDRHLRPMLARRYEIATGQRQAKD

SEQ ID NO: 304312 - protein, 24 aa, Mycobacterium
DWDRHLRPMLARRYEMATGQRQSK

SEQ ID NO: 304313 - protein, 21 aa, Mycobacterium
DWFDWSAWYGELLRGIFNVTP

SEQ ID NO: 304314 - protein, 39 aa, Mycobacterium
DWFRPIKNYFYWEKHCFDIPVCQAFRSIFEVLDKIDELT

SEQ ID NO: 304315 - protein, 19 aa, Mycobacterium
DWFRPIRNYLYWEKHCFDI

SEQ ID NO: 304316 - protein, 17 aa, Mycobacterium
DWHALPVAEVQRLLPRP

SEQ ID NO: 304317 - protein, 17 aa, Mycobacterium
DWHPRGATVVILELIFT

SEQ ID NO: 304318 - protein, 19 aa, Mycobacterium
DWKERIAAGDLGFRSKAVL

SEQ ID NO: 304319 - protein, 22 aa, Mycobacterium
DWKLWLGFLLVAIPVCLSPGAG

SEQ ID NO: 304320 - protein, 26 aa, Mycobacterium
DWLELSWRWLFGLSIVPALISLIIRY

SEQ ID NO: 304321 - protein, 22 aa, Mycobacterium
DWLYRLTTLVQMAGALTIAAGV

SEQ ID NO: 304322 - protein, 19 aa, Mycobacterium
DWMIADGPWLKRYPYIPRY

SEQ ID NO: 304323 - protein, 20 aa, Mycobacterium
DWMREKGLNSREFEWDTVCP

SEQ ID NO: 304324 - protein, 26 aa, Mycobacterium
DWNLPIPGLPGFEFPPTSGIPGIDFP

SEQ ID NO: 304325 - protein, 18 aa, Mycobacterium
DWPSRRGAPPPDVTASLG

SEQ ID NO: 304326 - protein, 23 aa, Mycobacterium
DWQKRAPALAATWGAQRLTIRAT

SEQ ID NO: 304327 - protein, 19 aa, Mycobacterium
DWRAAFDGLGGRRVDLPTY

SEQ ID NO: 304328 - protein, 20 aa, Mycobacterium
DWREAFAGLGAQRTDLPTYG

SEQ ID NO: 304329 - protein, 31 aa, Mycobacterium
DWRLGLVCVAVFPVLLGLGAWFRAESSKTYR

SEQ ID NO: 304330 - protein, 18 aa, Mycobacterium
DWRSMVATIARRTRRRSL

SEQ ID NO: 304331 - protein, 17 aa, Mycobacterium
DWVPAILTWNRIGAAYG

SEQ ID NO: 304332 - protein, 19 aa, Mycobacterium
DWVPVTALVVLAGYAGSAG

SEQ ID NO: 304333 - protein, 31 aa, Mycobacterium
DYAELPGCPGSVCTGKIKQAYGLAYQQSLNT

SEQ ID NO: 304334 - protein, 21 aa, Mycobacterium
DYAHARGLLHRDVKPANILLT

SEQ ID NO: 304335 - protein, 18 aa, Mycobacterium
DYAHDLYDGLGWTDDVLP

SEQ ID NO: 304336 - protein, 20 aa, Mycobacterium
DYAPGCKRILFSSDYYPALA

SEQ ID NO: 304337 - protein, 17 aa, Mycobacterium
DYARMWIQAATTMSVYD

SEQ ID NO: 304338 - protein, 26 aa, Mycobacterium
DYDCGCKRPTMSNSFYHAFRKPHVRL

SEQ ID NO: 304339 - protein, 32 aa, Mycobacterium
DYDDYPPLPWYRRPLVWFIAAAAVAGIAFTGM

SEQ ID NO: 304340 - protein, 25 aa, Mycobacterium
DYDTEELWSAIGLVPQRGYLFSGTV

SEQ ID NO: 304341 - protein, 30 aa, Mycobacterium
DYEVFLLARIREFWLRSGRSAADLDRSVVL

SEQ ID NO: 304342 - protein, 30 aa, Mycobacterium
DYFQYSDMLQFVWAQAKFRLTGRENSDDVA

SEQ ID NO: 304343 - protein, 21 aa, Mycobacterium
DYGAPAGWRAPGWPPPSERPQ

SEQ ID NO: 304344 - protein, 21 aa, Mycobacterium
DYGAPAGWRAPGWPPQAQQPQ

SEQ ID NO: 304345 - protein, 23 aa, Mycobacterium
DYGEIDGRFYVDMRLVDGVDLGT

SEQ ID NO: 304346 - protein, 25 aa, Mycobacterium
DYHTERLWAAIGLVPQRGYLFSGTV

SEQ ID NO: 304347 - protein, 25 aa, Mycobacterium
DYHTERLWSAIGLVPQRGYLFSGTV

SEQ ID NO: 304348 - protein, 20 aa, Mycobacterium
DYIFGFSFYDGHYFGAWVFI

SEQ ID NO: 304349 - protein, 30 aa, Mycobacterium
DYIFGFSFYTAHYFGAWVFIAGFVVHIAIK

SEQ ID NO: 304350 - protein, 29 aa, Mycobacterium
DYIFGFSFYTAHYFGAWVFITGFVVHVAI

SEQ ID NO: 304351 - protein, 32 aa, Mycobacterium
DYIFGFSFYTGHYFGAWVFIAGFLMHIALKVP

SEQ ID NO: 304352 - protein, 22 aa, Mycobacterium
DYLEFRAGELPGGWFTILVTTL

SEQ ID NO: 304353 - protein, 24 aa, Mycobacterium
DYLKAHPLIGPWLNKLQAFDVFSS

SEQ ID NO: 304354 - protein, 24 aa, Mycobacterium
DYLKRLTADLRRTRRRVAELEDKL

SEQ ID NO: 304355 - protein, 22 aa, Mycobacterium
DYLPTLLVGLAIMGLGIGCTTA

SEQ ID NO: 304356 - protein, 19 aa, Mycobacterium
DYLSSVEWDTLLFFVGLFI

SEQ ID NO: 304357 - protein, 20 aa, Mycobacterium
DYNLLLTMRMREEALARTGT

SEQ ID NO: 304358 - protein, 20 aa, Mycobacterium
DYNLLLTMRMREEVFLHGAG

SEQ ID NO: 304359 - protein, 24 aa, Mycobacterium
DYNPWRPAVKFAYPEDHGDFSHAA

SEQ ID NO: 304360 - protein, 18 aa, Mycobacterium
DYPAGSLPREFVPPKDGP

SEQ ID NO: 304361 - protein, 24 aa, Mycobacterium
DYPDRLDAGLLRISGVCILATVMA

SEQ ID NO: 304362 - protein, 24 aa, Mycobacterium
DYRIGRLRVVLALNEGHRFHHLKW

SEQ ID NO: 304363 - protein, 19 aa, Mycobacterium
DYRVRAAVRYVLADRPLLL

SEQ ID NO: 304364 - protein, 20 aa, Mycobacterium
DYVAALGCLLVFAAFMAYFG

SEQ ID NO: 304365 - protein, 18 aa, Mycobacterium
DYVRMWIQAAAVMGGYQD

SEQ ID NO: 304366 - protein, 17 aa, Mycobacterium
DYVRMWVQAAAVMGTYH

SEQ ID NO: 304367 - protein, 25 aa, Mycobacterium
DYWFRSIRQTVQFERAVRGACDAGY

SEQ ID NO: 304368 - protein, 25 aa, Mycobacterium
EAAARLKKWCKIVADGDAGQFRRRL

SEQ ID NO: 304369 - protein, 18 aa, Mycobacterium
EAAELGLKAVVRQSDSEA

SEQ ID NO: 304370 - protein, 20 aa, Mycobacterium
EAAESDGLADSAFTAGAADP

SEQ ID NO: 304371 - protein, 18 aa, Mycobacterium
EAAHSLSVTTTFGVSDSP

SEQ ID NO: 304372 - protein, 18 aa, Mycobacterium
EAAIRAADDIPLPSKPVG

SEQ ID NO: 304373 - protein, 17 aa, Mycobacterium
EAALGFDLAEPPTIARV

SEQ ID NO: 304374 - protein, 23 aa, Mycobacterium
EAALPWLRIAILGVPAILVSLAG

SEQ ID NO: 304375 - protein, 19 aa, Mycobacterium
EAALRPARVAIIGDTAIGD

SEQ ID NO: 304376 - protein, 26 aa, Mycobacterium
EAAQFKVILTRLWESGLKPKGGPKEP

SEQ ID NO: 304377 - protein, 17 aa, Mycobacterium
EAAQRFGLQEVPDAYVV

SEQ ID NO: 304378 - protein, 22 aa, Mycobacterium
EAARHRKIFLIGLGVVGVLVIS

SEQ ID NO: 304379 - protein, 18 aa, Mycobacterium
EAARRAGISVDRIRVTAF

SEQ ID NO: 304380 - protein, 18 aa, Mycobacterium
EAARRTLNRPGFGLTESL

SEQ ID NO: 304381 - protein, 20 aa, Mycobacterium
EAARSVMFWLLGSLGASSWD

SEQ ID NO: 304382 - protein, 19 aa, Mycobacterium
EAATAWASLSVEYASVAED

SEQ ID NO: 304383 - protein, 25 aa, Mycobacterium
EAATRAMLAAEAWNGRSTWFRHEPR

SEQ ID NO: 304384 - protein, 21 aa, Mycobacterium
EAATRAMLAAEAWTGRLTWRR

SEQ ID NO: 304385 - protein, 23 aa, Mycobacterium
EAATYRIVRRLGLPVDGAPQVVT

SEQ ID NO: 304386 - protein, 17 aa, Mycobacterium
EAAVAYAEAGTWEDPAD

SEQ ID NO: 304387 - protein, 18 aa, Mycobacterium
EAAVLRFGQLHRPDLIGS

SEQ ID NO: 304388 - protein, 19 aa, Mycobacterium
EACPPELAERLAAGPDSAG

SEQ ID NO: 304389 - protein, 19 aa, Mycobacterium
EACPPELAERLAVDGRELW

SEQ ID NO: 304390 - protein, 25 aa, Mycobacterium
EACPPELAQRLAVDGREVWNTYGPT

SEQ ID NO: 304391 - protein, 23 aa, Mycobacterium
EADARKAAADAFRVEQQAAADGA

SEQ ID NO: 304392 - protein, 18 aa, Mycobacterium
EADGQLWIAMDYVDGTDA

SEQ ID NO: 304393 - protein, 22 aa, Mycobacterium
EADLPAAYCVIGRPHAIVVTSA

SEQ ID NO: 304394 - protein, 24 aa, Mycobacterium
EADNGMFAAFKPRDPEAVRASISS

SEQ ID NO: 304395 - protein, 26 aa, Mycobacterium
EADSLRSRLLISLVLTVPVIAMSMIP

SEQ ID NO: 304396 - protein, 19 aa, Mycobacterium
EADYARMWVQAATTMSAYQ

SEQ ID NO: 304397 - protein, 20 aa, Mycobacterium
EADYARMWVQAATVMSVYEA

SEQ ID NO: 304398 - protein, 20 aa, Mycobacterium
EADYARMWVQAAVTMSVYAA

SEQ ID NO: 304399 - protein, 18 aa, Mycobacterium
EAEAIAAAARARAEALRL

SEQ ID NO: 304400 - protein, 18 aa, Mycobacterium
EAEARPAPADVVHTIEAQ

SEQ ID NO: 304401 - protein, 18 aa, Mycobacterium
EAEPLIAAFERNGAELDR

SEQ ID NO: 304402 - protein, 28 aa, Mycobacterium
EAEPLPWYKRAAVVFSLAAAGLAILVAV

SEQ ID NO: 304403 - protein, 20 aa, Mycobacterium
EAEPWAIAGAFAVLFLPYSA

SEQ ID NO: 304404 - protein, 22 aa, Mycobacterium
EAETLWPLTGLIVGVLIAVAIA

SEQ ID NO: 304405 - protein, 29 aa, Mycobacterium
EAFATLNMFNRAGIFLGPLIGLAFVTSNF

SEQ ID NO: 304406 - protein, 20 aa, Mycobacterium
EAFETADFQRGIKLFLSPDG

SEQ ID NO: 304407 - protein, 19 aa, Mycobacterium
EAFWPLRRVGAAFHSAQDG

SEQ ID NO: 304408 - protein, 19 aa, Mycobacterium
EAGADIFRNFPQVVAVISN

SEQ ID NO: 304409 - protein, 18 aa, Mycobacterium
EAGAKTWHIVPGTTPKIG

SEQ ID NO: 304410 - protein, 22 aa, Mycobacterium
EAGDLRQLMSAHMFSAPPRPSI

SEQ ID NO: 304411 - protein, 21 aa, Mycobacterium
EAGFWGKLVNWVMKRPLAFAI

SEQ ID NO: 304412 - protein, 21 aa, Mycobacterium
EAGFWGKLVNWVMRRPLVFAI

SEQ ID NO: 304413 - protein, 23 aa, Mycobacterium
EAGGTRRSIFVGAMRVGRDHIAS

SEQ ID NO: 304414 - protein, 23 aa, Mycobacterium
EAGHARLAHPLRWAVGAQVAALV

SEQ ID NO: 304415 - protein, 25 aa, Mycobacterium
EAGLFPGVMLYLTYWFGRDQLARAN

SEQ ID NO: 304416 - protein, 19 aa, Mycobacterium
EAGLHQWLNVTLLAGAALV

SEQ ID NO: 304417 - protein, 18 aa, Mycobacterium
EAGLKIRDNIALGKDSRA

SEQ ID NO: 304418 - protein, 20 aa, Mycobacterium
EAGLSFLPTPLAWLLAVVAL

SEQ ID NO: 304419 - protein, 19 aa, Mycobacterium
EAGLTRLILLTGDRAEPTR

SEQ ID NO: 304420 - protein, 17 aa, Mycobacterium
EAGMWRAIGIRGASTTI

SEQ ID NO: 304421 - protein, 24 aa, Mycobacterium
EAGPARLGRLMSILSIPMLLAPIG

SEQ ID NO: 304422 - protein, 26 aa, Mycobacterium
EAHLTTCPQCRAGVAELSGMPALLSL

SEQ ID NO: 304423 - protein, 19 aa, Mycobacterium
EAIFGWPGIGKLMIDAILQ

SEQ ID NO: 304424 - protein, 17 aa, Mycobacterium
EAIFGYNGLGWRFSGAV

SEQ ID NO: 304425 - protein, 19 aa, Mycobacterium
EAIFGYSGVGWRFTGALLG

SEQ ID NO: 304426 - protein, 17 aa, Mycobacterium
EAIGTPIPGGRFDIEQL

SEQ ID NO: 304427 - protein, 34 aa, Mycobacterium
EAIPKHRWRALLVRLHFYAGVLVGPFLVIAALTG

SEQ ID NO: 304428 - protein, 20 aa, Mycobacterium
EAIQPYLPIAVVAALDAVFG

SEQ ID NO: 304429 - protein, 19 aa, Mycobacterium
EAIRDGWYRTGDVGWLDTG

SEQ ID NO: 304430 - protein, 24 aa, Mycobacterium
EAISNGFYYTAFVPNFLVMEIFQP

SEQ ID NO: 304431 - protein, 18 aa, Mycobacterium
EAKGMKVALDIRDVRLED

SEQ ID NO: 304432 - protein, 21 aa, Mycobacterium
EAKPPRTGKVPTEPAQISASM

SEQ ID NO: 304433 - protein, 23 aa, Mycobacterium
EAKSDFEPVCATMRYEDFSGNQI

SEQ ID NO: 304434 - protein, 21 aa, Mycobacterium
EAKTPKAAFRIAFAGPATSLA

SEQ ID NO: 304435 - protein, 18 aa, Mycobacterium
EAKVVWPNATTYLGAHPG

SEQ ID NO: 304436 - protein, 18 aa, Mycobacterium
EALAKLQSWLAGDDPGVL

SEQ ID NO: 304437 - protein, 22 aa, Mycobacterium
EALARTGTRVGLRTAMIRAFGS

SEQ ID NO: 304438 - protein, 19 aa, Mycobacterium
EALEHAGIAPSALRRSQTG

SEQ ID NO: 304439 - protein, 18 aa, Mycobacterium
EALEHAGIDPMSLRGSST

SEQ ID NO: 304440 - protein, 21 aa, Mycobacterium
EALFLPAHDPLASAVVGEANR

SEQ ID NO: 304441 - protein, 28 aa, Mycobacterium
EALKRSLNTSFYRLMLKLKNGPEDVAAA

SEQ ID NO: 304442 - protein, 20 aa, Mycobacterium
EALKVMFVITAIALVGLLIF

SEQ ID NO: 304443 - protein, 19 aa, Mycobacterium
EALLARAGRYAELYYTQFD

SEQ ID NO: 304444 - protein, 24 aa, Mycobacterium
EALLCLIALIACRTARESAWLPIS

SEQ ID NO: 304445 - protein, 22 aa, Mycobacterium
EALLQLLADRAFQWSLDSEEII

SEQ ID NO: 304446 - protein, 28 aa, Mycobacterium
EALPKIAWPSVFLIVGIVTYVGLLQELG

SEQ ID NO: 304447 - protein, 17 aa, Mycobacterium
EALRAASGLDRPLVSQF

SEQ ID NO: 304448 - protein, 19 aa, Mycobacterium
EALRLRRQAEEAAKRSSEA

SEQ ID NO: 304449 - protein, 19 aa, Mycobacterium
EALTGFLAAFINVRIAAPI

SEQ ID NO: 304450 - protein, 19 aa, Mycobacterium
EALTGFLAAFINVRIAAPV

SEQ ID NO: 304451 - protein, 19 aa, Mycobacterium
EALTGFLSAFINVRIAAPV

SEQ ID NO: 304452 - protein, 19 aa, Mycobacterium
EALTIAAACYCLLEDSVRA

SEQ ID NO: 304453 - protein, 20 aa, Mycobacterium
EALTVEALNAMARTVGYGAP

SEQ ID NO: 304454 - protein, 18 aa, Mycobacterium
EAMERGWPVLSFSRPVSL

SEQ ID NO: 304455 - protein, 27 aa, Mycobacterium
EAMESYGWRIPFLIAGPLGLVGLYIRL

SEQ ID NO: 304456 - protein, 28 aa, Mycobacterium
EAMFRTPEFYGWMLVLPIGLMLQQSSLR

SEQ ID NO: 304457 - protein, 21 aa, Mycobacterium
EAMLIPMYFLIGGFGGEHRGR

SEQ ID NO: 304458 - protein, 22 aa, Mycobacterium
EAMLIPMYFLIGGFGGENRSRA

SEQ ID NO: 304459 - protein, 21 aa, Mycobacterium
EAMLIPMYFLIGGFGGGAGRS

SEQ ID NO: 304460 - protein, 21 aa, Mycobacterium
EAMLIPMYFLIGGFGGGSGRS

SEQ ID NO: 304461 - protein, 20 aa, Mycobacterium
EAMLIPMYFLIGGFGQGPGR

SEQ ID NO: 304462 - protein, 21 aa, Mycobacterium
EAMLIPMYFLIGGFGQGRARS

SEQ ID NO: 304463 - protein, 21 aa, Mycobacterium
EAMLIPMYFLIGGFGSTHSDV

SEQ ID NO: 304464 - protein, 26 aa, Mycobacterium
EAMNAYGWRLPFFIAGVLGGVGLYIR

SEQ ID NO: 304465 - protein, 29 aa, Mycobacterium
EAMRRIRAEPRWRHLPIVALTAKAMKGDR

SEQ ID NO: 304466 - protein, 19 aa, Mycobacterium
EANRRAGAIDSFLKSPFAG

SEQ ID NO: 304467 - protein, 37 aa, Mycobacterium
EAPAGTRLSSRSLLISNAVVAFAVIGFASLAVAVAVA

SEQ ID NO: 304468 - protein, 24 aa, Mycobacterium
EAPATRPSRRVKIWATAGGVILAF

SEQ ID NO: 304469 - protein, 21 aa, Mycobacterium
EAPEAAAYCVAGRPSAIVLTT

SEQ ID NO: 304470 - protein, 24 aa, Mycobacterium
EAPELGGTMGWLAGLWRDILAAPV

SEQ ID NO: 304471 - protein, 17 aa, Mycobacterium
EAPFDWYHELLAHLAQI

SEQ ID NO: 304472 - protein, 18 aa, Mycobacterium
EAPFDWYQSVLAHLASIS

SEQ ID NO: 304473 - protein, 18 aa, Mycobacterium
EAPFDWYQSVLSHLASIS

SEQ ID NO: 304474 - protein, 20 aa, Mycobacterium
EAPFLILAVLLPFAEGGERV

SEQ ID NO: 304475 - protein, 25 aa, Mycobacterium
EAPGLRLAVVFLCTAALVAAVLTGY

SEQ ID NO: 304476 - protein, 17 aa, Mycobacterium
EAPLKFRAPGVTIQLGL

SEQ ID NO: 304477 - protein, 17 aa, Mycobacterium
EAPLKFRAPHVTLQIGL

SEQ ID NO: 304478 - protein, 17 aa, Mycobacterium
EAPLKFRAPNVTLPIGL

SEQ ID NO: 304479 - protein, 17 aa, Mycobacterium
EAPLKFRAPNVTLQIGL

SEQ ID NO: 304480 - protein, 18 aa, Mycobacterium
EAPLKFRAPNVTLQIGLG

SEQ ID NO: 304481 - protein, 29 aa, Mycobacterium
EAPPRRRLGRGAAIAIVLASVATLAVVIV

SEQ ID NO: 304482 - protein, 22 aa, Mycobacterium
EAPRELIGFAGANLTEMPRHAE

SEQ ID NO: 304483 - protein, 18 aa, Mycobacterium
EAPRSAVVSKIRELNELD

SEQ ID NO: 304484 - protein, 19 aa, Mycobacterium
EAPRSWLKVNARGVPVQAI

SEQ ID NO: 304485 - protein, 19 aa, Mycobacterium
EAQAGYIGSIFLLGYTIGT

SEQ ID NO: 304486 - protein, 24 aa, Mycobacterium
EAQQQLGVAAARVNEVGDAQQKAE

SEQ ID NO: 304487 - protein, 22 aa, Mycobacterium
EAQSNWPLIGLIAGVAIAGLIA

SEQ ID NO: 304488 - protein, 19 aa, Mycobacterium
EARALGSVLGRGRAADAPL

SEQ ID NO: 304489 - protein, 20 aa, Mycobacterium
EARDSDWTVCDAISSGSQGG

SEQ ID NO: 304490 - protein, 22 aa, Mycobacterium
EARGDVLTGAWWTLAVPAAALI

SEQ ID NO: 304491 - protein, 20 aa, Mycobacterium
EARLAGPLVVSRRGAICPTR

SEQ ID NO: 304492 - protein, 20 aa, Mycobacterium
EARLINVLVITPLRVAFLIV

SEQ ID NO: 304493 - protein, 25 aa, Mycobacterium
EARLREIAAQLGLPYVPRRDGAELP

SEQ ID NO: 304494 - protein, 31 aa, Mycobacterium
EARLRWLHRSILLWWVVWVVSTAVSIFSIAT

SEQ ID NO: 304495 - protein, 21 aa, Mycobacterium
EARLSWVLAALAGVVGAISFT

SEQ ID NO: 304496 - protein, 22 aa, Mycobacterium
EARLSWVLAGLAGVLGATAFTH

SEQ ID NO: 304497 - protein, 22 aa, Mycobacterium
EARLSWVLAVLAGVLGATAFTH

SEQ ID NO: 304498 - protein, 19 aa, Mycobacterium
EARRAHRRAVLTGPTPSLD

SEQ ID NO: 304499 - protein, 20 aa, Mycobacterium
EARRASARFRRAEIARRADE

SEQ ID NO: 304500 - protein, 17 aa, Mycobacterium
EASAVVARLAALGVTNT

SEQ ID NO: 304501 - protein, 34 aa, Mycobacterium
EASGKRDLWRIKVNLRPVSIILVVLVMISGGIAA

SEQ ID NO: 304502 - protein, 30 aa, Mycobacterium
EASGYPLAFAVCGLFPLLAWPIVPQHTRAR

SEQ ID NO: 304503 - protein, 18 aa, Mycobacterium
EASMHQWLDVTLLAGAAL

SEQ ID NO: 304504 - protein, 17 aa, Mycobacterium
EASRLAGVRSRTIVFAI

SEQ ID NO: 304505 - protein, 19 aa, Mycobacterium
EASSLFRVSKLNCSITTSD

SEQ ID NO: 304506 - protein, 20 aa, Mycobacterium
EATAQCVLYVPGPDGDDLDA

SEQ ID NO: 304507 - protein, 19 aa, Mycobacterium
EATARGWPVRAFSKPVSLR

SEQ ID NO: 304508 - protein, 19 aa, Mycobacterium
EATERVRFADSRITHGREL

SEQ ID NO: 304509 - protein, 26 aa, Mycobacterium
EATGRGRWALCLVDGSPLRATQSLSE

SEQ ID NO: 304510 - protein, 27 aa, Mycobacterium
EATGRGRWALCLVDGTPLRATQSLTEQ

SEQ ID NO: 304511 - protein, 20 aa, Mycobacterium
EATGRPIARRNLIFSVFAEH

SEQ ID NO: 304512 - protein, 25 aa, Mycobacterium
EATMSSWRKRLFIATSYITADAAAY

SEQ ID NO: 304513 - protein, 18 aa, Mycobacterium
EATQCGKDDILAGNDDPK

SEQ ID NO: 304514 - protein, 30 aa, Mycobacterium
EATVSLTYCAMCRSIIPFDVTDIGPLFVGS

SEQ ID NO: 304515 - protein, 25 aa, Mycobacterium
EAVAADLGRRVHSIGVTWSDDAGTE

SEQ ID NO: 304516 - protein, 17 aa, Mycobacterium
EAVAPWLTTDTTVYPAI

SEQ ID NO: 304517 - protein, 17 aa, Mycobacterium
EAVDARFADIMDGSTGE

SEQ ID NO: 304518 - protein, 21 aa, Mycobacterium
EAVEWLTPWLVDSLKKLPPGK

SEQ ID NO: 304519 - protein, 25 aa, Mycobacterium
EAVFGDFRIGFLFITVVTALILVLA

SEQ ID NO: 304520 - protein, 23 aa, Mycobacterium
EAVHARHAAPWGTQDPAGDRRGT

SEQ ID NO: 304521 - protein, 25 aa, Mycobacterium
EAVLARAVSRWTWLLSAVAMTALGS

SEQ ID NO: 304522 - protein, 23 aa, Mycobacterium
EAVLKAKVDGAWNLHQLTQDVDL

SEQ ID NO: 304523 - protein, 25 aa, Mycobacterium
EAVMNKLRWVLLIVGGVGVAVAAVA

SEQ ID NO: 304524 - protein, 29 aa, Mycobacterium
EAVQPPVRRRLRLLLGVAAVVLVADIVTK

SEQ ID NO: 304525 - protein, 21 aa, Mycobacterium
EAVRGPARWTSLQKIGFRVLF

SEQ ID NO: 304526 - protein, 38 aa, Mycobacterium
EAVRRRRTVFVDAWRSRLWPVPALGVVFAIVAGVALPE

SEQ ID NO: 304527 - protein, 21 aa, Mycobacterium
EAVTLPEFVAPEGLGGNCQYP

SEQ ID NO: 304528 - protein, 31 aa, Mycobacterium
EAWGEPGNGALFRLTVPLVRGHKVTTSPLPL

SEQ ID NO: 304529 - protein, 28 aa, Mycobacterium
EAWQRAKPRIWALLGVAVVELVLFAVVL

SEQ ID NO: 304530 - protein, 20 aa, Mycobacterium
EAWRSLLQRGIDTAAEVSGA

SEQ ID NO: 304531 - protein, 17 aa, Mycobacterium
EAYADSLGLVFLCAAPV

SEQ ID NO: 304532 - protein, 22 aa, Mycobacterium
EAYARRRRNLLIGISAGAAVLL

SEQ ID NO: 304533 - protein, 23 aa, Mycobacterium
EAYSDSLGLVFLCAAPVAVIGFV

SEQ ID NO: 304534 - protein, 20 aa, Mycobacterium
EAYWTKLGWSAHGPIKTQSR

SEQ ID NO: 304535 - protein, 18 aa, Mycobacterium
ECAVPGLAGGAISLAAYT

SEQ ID NO: 304536 - protein, 21 aa, Mycobacterium
ECCVAAYVPYLAWVMQESADC

SEQ ID NO: 304537 - protein, 18 aa, Mycobacterium
ECDSVVAAVSRLTTAQAP

SEQ ID NO: 304538 - protein, 19 aa, Mycobacterium
ECGEQALLPAIRKNRDALV

SEQ ID NO: 304539 - protein, 19 aa, Mycobacterium
ECRSKEPYVPLGTNPWYGD

SEQ ID NO: 304540 - protein, 25 aa, Mycobacterium
EDAARVVALRSRLLVGLSGRGGMVS

SEQ ID NO: 304541 - protein, 23 aa, Mycobacterium
EDACAKLAADVQVFARVSPEQKV

SEQ ID NO: 304542 - protein, 26 aa, Mycobacterium
EDADSRMVFVPARFGRQDYCAMLRRV

SEQ ID NO: 304543 - protein, 19 aa, Mycobacterium
EDAEWRRVTATGHYLPDRQ

SEQ ID NO: 304544 - protein, 19 aa, Mycobacterium
EDAKAALMTSLKGLLSQNV

SEQ ID NO: 304545 - protein, 25 aa, Mycobacterium
EDAKKGLEFVRPVAVDLTYIPIVGW

SEQ ID NO: 304546 - protein, 25 aa, Mycobacterium
EDAPKRLLRGSLICLGTETLLGSVL

SEQ ID NO: 304547 - protein, 19 aa, Mycobacterium
EDAPSLIAMKRIGKDFQQY

SEQ ID NO: 304548 - protein, 29 aa, Mycobacterium
EDARFLLWVALCFAVLALTVWAARRALRA

SEQ ID NO: 304549 - protein, 26 aa, Mycobacterium
EDASLRASLLWGYSHYFIFASVAAIS

SEQ ID NO: 304550 - protein, 21 aa, Mycobacterium
EDDARAVLRDVLIKALQPDMD

SEQ ID NO: 304551 - protein, 18 aa, Mycobacterium
EDDLRWFSVVWHAVCGIP

SEQ ID NO: 304552 - protein, 31 aa, Mycobacterium
EDEPSTPRWPWVVGVAAIMAAIALVASVSLL

SEQ ID NO: 304553 - protein, 34 aa, Mycobacterium
EDESKPFSWHWSWWWLVALIPVLLLAGLVVGAAL

SEQ ID NO: 304554 - protein, 20 aa, Mycobacterium
EDFGEWLQRFEAALQGLSDQ

SEQ ID NO: 304555 - protein, 28 aa, Mycobacterium
EDFLCPACGNFERTFGPTVSRLIDVGAI

SEQ ID NO: 304556 - protein, 19 aa, Mycobacterium
EDFRKAGIVTNVYADAAPD

SEQ ID NO: 304557 - protein, 18 aa, Mycobacterium
EDFSEAIASPSGDSPQQA

SEQ ID NO: 304558 - protein, 19 aa, Mycobacterium
EDFSWKAMLDFATCTECGR

SEQ ID NO: 304559 - protein, 25 aa, Mycobacterium
EDFWRPLRNYFYWEKHCYDIPICFS

SEQ ID NO: 304560 - protein, 23 aa, Mycobacterium
EDGCAKIAADVPVFARVSPEQKV

SEQ ID NO: 304561 - protein, 23 aa, Mycobacterium
EDGHPVDGSWAFTITGSGSSAAA

SEQ ID NO: 304562 - protein, 21 aa, Mycobacterium
EDGPAGWSMRLNVIDPPRERR

SEQ ID NO: 304563 - protein, 28 aa, Mycobacterium
EDGRPAPLLRLRGKFFAHADQLSIHRAY

SEQ ID NO: 304564 - protein, 20 aa, Mycobacterium
EDGRVLLLRGFDPAAPTPAV

SEQ ID NO: 304565 - protein, 23 aa, Mycobacterium
EDILGIELYWLVLAMSVILLLAV

SEQ ID NO: 304566 - protein, 23 aa, Mycobacterium
EDKPWRVPVAFVIAQGTATVINF

SEQ ID NO: 304567 - protein, 19 aa, Mycobacterium
EDLGPEFDDLRGPLSELQK

SEQ ID NO: 304568 - protein, 24 aa, Mycobacterium
EDLHPVLNLTSARLITGRPVDPTM

SEQ ID NO: 304569 - protein, 24 aa, Mycobacterium
EDLKRPADPWARPRIVYLQHASDP

SEQ ID NO: 304570 - protein, 20 aa, Mycobacterium
EDLPHPWLDALGIPDRVGDA

SEQ ID NO: 304571 - protein, 20 aa, Mycobacterium
EDLRVARALAERADVLVENF

SEQ ID NO: 304572 - protein, 25 aa, Mycobacterium
EDLSEAMSGMLTRLAAAQRATTNSL

SEQ ID NO: 304573 - protein, 17 aa, Mycobacterium
EDLSELYGIDFDEGLDV

SEQ ID NO: 304574 - protein, 28 aa, Mycobacterium
EDMAAREAIDWMRAELPGVAGQNATIDV

SEQ ID NO: 304575 - protein, 19 aa, Mycobacterium
EDMYGLWSVPISGVRYDNV

SEQ ID NO: 304576 - protein, 18 aa, Mycobacterium
EDPIPPSRRHEGISADLD

SEQ ID NO: 304577 - protein, 22 aa, Mycobacterium
EDPVWAWLKWLPHLQHQTDTDA

SEQ ID NO: 304578 - protein, 25 aa, Mycobacterium
EDREPRMWLWVLAALAVLVVVGLVI

SEQ ID NO: 304579 - protein, 23 aa, Mycobacterium
EDRSKFWIGMIAVGVVAAIIASM

SEQ ID NO: 304580 - protein, 23 aa, Mycobacterium
EDRTVGSVGRWIVAVAALAVLTI

SEQ ID NO: 304581 - protein, 18 aa, Mycobacterium
EDRVDAFYTAYHSVSHVI

SEQ ID NO: 304582 - protein, 23 aa, Mycobacterium
EDRVKLGAYHWLDHHPRREHPSD

SEQ ID NO: 304583 - protein, 17 aa, Mycobacterium
EDSRFFKKHYVTESHAF

SEQ ID NO: 304584 - protein, 19 aa, Mycobacterium
EDSWEEVEDTLLIADLGPV

SEQ ID NO: 304585 - protein, 18 aa, Mycobacterium
EDTGGFSVADLLGRIQTD

SEQ ID NO: 304586 - protein, 28 aa, Mycobacterium
EDTGRKWNKWWLLAVVPLLLLAGLVAFA

SEQ ID NO: 304587 - protein, 24 aa, Mycobacterium
EDTKEAREALGLGLTPSPAPWVVL

SEQ ID NO: 304588 - protein, 26 aa, Mycobacterium
EDTTRWGLQIDHFWWTAIWAAILLSI

SEQ ID NO: 304589 - protein, 20 aa, Mycobacterium
EDVDLCWRLIEAGSRLRYEP

SEQ ID NO: 304590 - protein, 28 aa, Mycobacterium
EDVPNLAWCVGYINASWTLRADLTARAV

SEQ ID NO: 304591 - protein, 24 aa, Mycobacterium
EDWCRYYRRNGWSYGADRDDARKL

SEQ ID NO: 304592 - protein, 18 aa, Mycobacterium
EDYFLTKPLRMRVAVIGV

SEQ ID NO: 304593 - protein, 17 aa, Mycobacterium
EDYSAFAGYTCADQRGN

SEQ ID NO: 304594 - protein, 22 aa, Mycobacterium
EEAHVASAERCVHYEPRCVNRG

SEQ ID NO: 304595 - protein, 18 aa, Mycobacterium
EEAIRDAHGWSMSETFWL

SEQ ID NO: 304596 - protein, 27 aa, Mycobacterium
EEAPRGKYWWVRWVILGIVAIVLAVEV

SEQ ID NO: 304597 - protein, 26 aa, Mycobacterium
EEAQKRFPALCGHLTTRGDYCINPAD

SEQ ID NO: 304598 - protein, 26 aa, Mycobacterium
EEAVTALVAMSIWALLYSALPGLSGL

SEQ ID NO: 304599 - protein, 24 aa, Mycobacterium
EEAWFPVIFAVGFGLLIWAALVLR

SEQ ID NO: 304600 - protein, 24 aa, Mycobacterium
EEAYRYATAISIAVAIGVAALTAL

SEQ ID NO: 304601 - protein, 20 aa, Mycobacterium
EEDGHLWISMDYVAGIDLGR

SEQ ID NO: 304602 - protein, 27 aa, Mycobacterium
EEFAQALARWRLAEAYEEIGQRVAHIG

SEQ ID NO: 304603 - protein, 32 aa, Mycobacterium
EEFFFPLPGLWKWVAAAVFVWGSACVIGASVR

SEQ ID NO: 304604 - protein, 19 aa, Mycobacterium
EEFTGQHVLVVGGGISAVQ

SEQ ID NO: 304605 - protein, 22 aa, Mycobacterium
EEGWMGDLRPSLGGEPPVGPPS

SEQ ID NO: 304606 - protein, 20 aa, Mycobacterium
EEHRQRIALATRAQTLGELK

SEQ ID NO: 304607 - protein, 25 aa, Mycobacterium
EEIDALAVMGIRPIAYLASTRLLAG

SEQ ID NO: 304608 - protein, 19 aa, Mycobacterium
EEIGAGLKTGMIRSMASTG

SEQ ID NO: 304609 - protein, 20 aa, Mycobacterium
EEIQAGVGTGLIRTMGGSGS

SEQ ID NO: 304610 - protein, 20 aa, Mycobacterium
EEIRDPRRVYPRALFGALIT

SEQ ID NO: 304611 - protein, 20 aa, Mycobacterium
EEITLTYVVVHLWDERRLVL

SEQ ID NO: 304612 - protein, 21 aa, Mycobacterium
EEITLTYVVVHLWDERRLVLP

SEQ ID NO: 304613 - protein, 25 aa, Mycobacterium
EEIVYRGLLWGALEQRWGRIVAALV

SEQ ID NO: 304614 - protein, 20 aa, Mycobacterium
EEIYSGLAVVQAFGHQTPVR

SEQ ID NO: 304615 - protein, 24 aa, Mycobacterium
EEKALKLAALLTQPGQVYDVSSPD

SEQ ID NO: 304616 - protein, 24 aa, Mycobacterium
EELAEAMAAMLSRVSAAQSETTKS

SEQ ID NO: 304617 - protein, 28 aa, Mycobacterium
EELGGIPGRLAVCGWSAGAGIAAVICQL

SEQ ID NO: 304618 - protein, 21 aa, Mycobacterium
EELHSGLLFMCLVSSTMQSAI

SEQ ID NO: 304619 - protein, 17 aa, Mycobacterium
EELPINAPIVIAGPAGF

SEQ ID NO: 304620 - protein, 20 aa, Mycobacterium
EELRSARSPQELGSLVRTSA

SEQ ID NO: 304621 - protein, 19 aa, Mycobacterium
EELRSARSPQELLSLVRSS

SEQ ID NO: 304622 - protein, 20 aa, Mycobacterium
EELRSARSPQELLSLVRSSA

SEQ ID NO: 304623 - protein, 20 aa, Mycobacterium
EELRSARSPQELVSLVRSSA

SEQ ID NO: 304624 - protein, 24 aa, Mycobacterium
EELRVPIGVTSSGEPLMFDLKDEA

SEQ ID NO: 304625 - protein, 21 aa, Mycobacterium
EELRVPIGVTSTGEPLYFDLK

SEQ ID NO: 304626 - protein, 23 aa, Mycobacterium
EELSRYALMAQIYAIGWQILSTA

SEQ ID NO: 304627 - protein, 24 aa, Mycobacterium
EEPAERPNPYVLSDPYGPTEVIAQ

SEQ ID NO: 304628 - protein, 18 aa, Mycobacterium
EEPITMTRYYAAQRTFWV

SEQ ID NO: 304629 - protein, 25 aa, Mycobacterium
EEPKRSRRPIYLGRSIAAVVAVCSL

SEQ ID NO: 304630 - protein, 42 aa, Mycobacterium
EEPRLRECRSLRYVFCGGEPLPIALCRRVAEALPHAEMVNYY

SEQ ID NO: 304631 - protein, 18 aa, Mycobacterium
EEQGRTAVFVGRDDQVVG

SEQ ID NO: 304632 - protein, 21 aa, Mycobacterium
EEQRISLLLSELERTHAFDRE

SEQ ID NO: 304633 - protein, 26 aa, Mycobacterium
EERAPLAPVRLALAVGLVTVAALTGL

SEQ ID NO: 304634 - protein, 19 aa, Mycobacterium
EERFRPGGHPTPMPNPGVY

SEQ ID NO: 304635 - protein, 24 aa, Mycobacterium
EERLPARLPLAVTAAAEHFTAVLA

SEQ ID NO: 304636 - protein, 18 aa, Mycobacterium
EERMRRFITDASHELRTP

SEQ ID NO: 304637 - protein, 24 aa, Mycobacterium
EESAWRAAARIGLLLIAVWGVGSM

SEQ ID NO: 304638 - protein, 22 aa, Mycobacterium
EESNFPAIVKFLSDEVLSRHNG

SEQ ID NO: 304639 - protein, 23 aa, Mycobacterium
EESNFPAIVKFLSEHVLSRQNDR

SEQ ID NO: 304640 - protein, 18 aa, Mycobacterium
EESQNFFIAPFLMLGLSG

SEQ ID NO: 304641 - protein, 19 aa, Mycobacterium
EESWEEVEDTLLIADLGPV

SEQ ID NO: 304642 - protein, 22 aa, Mycobacterium
EEVTHAFPVWVSSALALGVVAI

SEQ ID NO: 304643 - protein, 28 aa, Mycobacterium
EEVYTEYKLNSAFAVGGPKCLVKVIQKL

SEQ ID NO: 304644 - protein, 18 aa, Mycobacterium
EFADAWVRIAIAAVAAHR

SEQ ID NO: 304645 - protein, 20 aa, Mycobacterium
EFAGQFWSGRALGVQNTTQR

SEQ ID NO: 304646 - protein, 20 aa, Mycobacterium
EFANPVQFICGGSFETAAGP

SEQ ID NO: 304647 - protein, 19 aa, Mycobacterium
EFAPPKRKGIMGAAPGIGA

SEQ ID NO: 304648 - protein, 20 aa, Mycobacterium
EFDKRAGAIEGWSMLTDADA

SEQ ID NO: 304649 - protein, 17 aa, Mycobacterium
EFEVLAVPDAVYTAIDE

SEQ ID NO: 304650 - protein, 20 aa, Mycobacterium
EFFFLVGACIVVLLLGIEHI

SEQ ID NO: 304651 - protein, 20 aa, Mycobacterium
EFGALVADFVRMCRGRGWQI

SEQ ID NO: 304652 - protein, 24 aa, Mycobacterium
EFGVKIDPFPAAVIAFSLNVGGYA

SEQ ID NO: 304653 - protein, 19 aa, Mycobacterium
EFHWPIIGDTFLWHLWDEL

SEQ ID NO: 304654 - protein, 18 aa, Mycobacterium
EFIAGFFFVVALLYGVLT

SEQ ID NO: 304655 - protein, 27 aa, Mycobacterium
EFIAIPLSFAALVWVFGGLLAAALPIL

SEQ ID NO: 304656 - protein, 31 aa, Mycobacterium
EFIGSPLRYRAGRVGDFFRIEGPPGLRRAVG

SEQ ID NO: 304657 - protein, 22 aa, Mycobacterium
EFIGVSMALGFLGCPKAIAVPA

SEQ ID NO: 304658 - protein, 21 aa, Mycobacterium
EFIGVSMALGFLGCPKAVAIP

SEQ ID NO: 304659 - protein, 25 aa, Mycobacterium
EFIGVSMALGFLGCPKFVAVPAAAV

SEQ ID NO: 304660 - protein, 19 aa, Mycobacterium
EFINVFELIVGIVVLSTYG

SEQ ID NO: 304661 - protein, 21 aa, Mycobacterium
EFKSGGAQTWADFTAANVGTQ

SEQ ID NO: 304662 - protein, 20 aa, Mycobacterium
EFLDDIFKPLGRVADPAEQA

SEQ ID NO: 304663 - protein, 20 aa, Mycobacterium
EFLRLVFSGTMVTWLAAALA

SEQ ID NO: 304664 - protein, 18 aa, Mycobacterium
EFLTAFFALCAVVYAVLT

SEQ ID NO: 304665 - protein, 19 aa, Mycobacterium
EFMEVRQSPAMLRHLTDAC

SEQ ID NO: 304666 - protein, 30 aa, Mycobacterium
EFPGKRAPTIQLCRDPRGYVPLGSNPWRGP

SEQ ID NO: 304667 - protein, 25 aa, Mycobacterium
EFPGKRAPTVQLCRDPNGYVPIGSN

SEQ ID NO: 304668 - protein, 26 aa, Mycobacterium
EFPPERFRMLMTLMVESPFLLIRAAL

SEQ ID NO: 304669 - protein, 20 aa, Mycobacterium
EFPPRRSGPSSAEPPAASPS

SEQ ID NO: 304670 - protein, 22 aa, Mycobacterium
EFPSDRGWDIDAMFDPDPDARG

SEQ ID NO: 304671 - protein, 28 aa, Mycobacterium
EFQHVSFGYRPGVPVIHDLSMVAEPGST

SEQ ID NO: 304672 - protein, 22 aa, Mycobacterium
EFQPWLRWAILILALLALIGLA

SEQ ID NO: 304673 - protein, 18 aa, Mycobacterium
EFRARFMREASLAASLDH

SEQ ID NO: 304674 - protein, 18 aa, Mycobacterium
EFRGARGAIQTTLDRDLP

SEQ ID NO: 304675 - protein, 19 aa, Mycobacterium
EFSAIGWILTIIGYIALFF

SEQ ID NO: 304676 - protein, 22 aa, Mycobacterium
EFSKHGIPVLAMRDTPWMVDED

SEQ ID NO: 304677 - protein, 21 aa, Mycobacterium
EFSKTESFVSITLASLTALVL

SEQ ID NO: 304678 - protein, 19 aa, Mycobacterium
EFTARFVINCSGVLSRPKW

SEQ ID NO: 304679 - protein, 19 aa, Mycobacterium
EFTPFDWITAVAVGAIVGR

SEQ ID NO: 304680 - protein, 17 aa, Mycobacterium
EFTQRVENEFSITVTPT

SEQ ID NO: 304681 - protein, 24 aa, Mycobacterium
EFVGSPLRYRAGRIGHLLRIEGPP

SEQ ID NO: 304682 - protein, 18 aa, Mycobacterium
EFWSRAPSALAVGAAAAG

SEQ ID NO: 304683 - protein, 23 aa, Mycobacterium
EGAACTFLALPRLTRMLTSVPRG

SEQ ID NO: 304684 - protein, 23 aa, Mycobacterium
EGAACTFLALPRLTRVLSSIPAG

SEQ ID NO: 304685 - protein, 25 aa, Mycobacterium
EGAAWLRLAWAGILMLVIVRPRPSA

SEQ ID NO: 304686 - protein, 23 aa, Mycobacterium
EGADGWECQRAMSVANNVIVDVN

SEQ ID NO: 304687 - protein, 20 aa, Mycobacterium
EGAGGWPVDAVVIAVILVLN

SEQ ID NO: 304688 - protein, 17 aa, Mycobacterium
EGAHEFLVAIAPRNYDR

SEQ ID NO: 304689 - protein, 19 aa, Mycobacterium
EGAIGMRIAPFVLPLAVTI

SEQ ID NO: 304690 - protein, 24 aa, Mycobacterium
EGALATAELVVWFVLGVVSVRLFG

SEQ ID NO: 304691 - protein, 19 aa, Mycobacterium
EGALGRLVVELEDGADSDT

SEQ ID NO: 304692 - protein, 18 aa, Mycobacterium
EGALLAWLTVAAVAIALL

SEQ ID NO: 304693 - protein, 20 aa, Mycobacterium
EGALLIGVFFWFTVVGSLTV

SEQ ID NO: 304694 - protein, 22 aa, Mycobacterium
EGALLVGVFFWFAVVGGATLVM

SEQ ID NO: 304695 - protein, 21 aa, Mycobacterium
EGAQAIIMAPNLVTARFVQLT

SEQ ID NO: 304696 - protein, 17 aa, Mycobacterium
EGAWLVVVVFPLLVFML

SEQ ID NO: 304697 - protein, 19 aa, Mycobacterium
EGAYRLRPGAGGSQTLGLF

SEQ ID NO: 304698 - protein, 28 aa, Mycobacterium
EGDGRAWKCTLCYDRLRDGLEPACAKAC

SEQ ID NO: 304699 - protein, 20 aa, Mycobacterium
EGDIAPPTRVVLRRQRNAQV

SEQ ID NO: 304700 - protein, 25 aa, Mycobacterium
EGDIFRRVVLWSLGFLVLLCALTAL

SEQ ID NO: 304701 - protein, 19 aa, Mycobacterium
EGDRAGALILADRDYFDDF

SEQ ID NO: 304702 - protein, 19 aa, Mycobacterium
EGDVIAYLVARRFSLSVYS

SEQ ID NO: 304703 - protein, 29 aa, Mycobacterium
EGDVRTALFFLACRTAIMFASGAFLYQWR

SEQ ID NO: 304704 - protein, 24 aa, Mycobacterium
EGDYETIGGLILEKLGHIPDEGET

SEQ ID NO: 304705 - protein, 19 aa, Mycobacterium
EGEAFMIRSVRAVAGQITD

SEQ ID NO: 304706 - protein, 25 aa, Mycobacterium
EGEAMLFGEYIRLMALVEYSADEIE

SEQ ID NO: 304707 - protein, 25 aa, Mycobacterium
EGEAMLFGEYIRLMALVEYSADEIK

SEQ ID NO: 304708 - protein, 24 aa, Mycobacterium
EGEGCGTCSIAEALKRSLNTSYYR

SEQ ID NO: 304709 - protein, 24 aa, Mycobacterium
EGELPRWLGTAAAVFTVEQLIETI

SEQ ID NO: 304710 - protein, 22 aa, Mycobacterium
EGEPAFEVLTPFAVEGGPTILV

SEQ ID NO: 304711 - protein, 24 aa, Mycobacterium
EGEPFTAQGARTWHIVPGTTPQVG

SEQ ID NO: 304712 - protein, 18 aa, Mycobacterium
EGEPKPAPADVISALEGQ

SEQ ID NO: 304713 - protein, 25 aa, Mycobacterium
EGFAKRELWAHLGWQDIKQRYRRSV

SEQ ID NO: 304714 - protein, 27 aa, Mycobacterium
EGFTRLWPTVICLTVYGFSFAMLAMSI

SEQ ID NO: 304715 - protein, 17 aa, Mycobacterium
EGGGVLMSIGIRADSIL

SEQ ID NO: 304716 - protein, 18 aa, Mycobacterium
EGGLGIWGAVALGGVGAW

SEQ ID NO: 304717 - protein, 17 aa, Mycobacterium
EGGQCIRSFMPDLPLPY

SEQ ID NO: 304718 - protein, 29 aa, Mycobacterium
EGGQSRFWNRWIGWVMRRPWMSALAASLV

SEQ ID NO: 304719 - protein, 19 aa, Mycobacterium
EGGRRGVSVGVIVALVAVI

SEQ ID NO: 304720 - protein, 18 aa, Mycobacterium
EGHDLPPIPTLLVVADEF

SEQ ID NO: 304721 - protein, 24 aa, Mycobacterium
EGHLKRALGLPSLVLFGLVYMVPL

SEQ ID NO: 304722 - protein, 28 aa, Mycobacterium
EGHVAVAIPTGWPTQRVIGGPGSTRVQI

SEQ ID NO: 304723 - protein, 19 aa, Mycobacterium
EGITLLGVWQTAWPFLSGG

SEQ ID NO: 304724 - protein, 24 aa, Mycobacterium
EGKKAVLWTSGWTPRFKGETIYLA

SEQ ID NO: 304725 - protein, 22 aa, Mycobacterium
EGKPAFEVLAPFVVDAGPTVLV

SEQ ID NO: 304726 - protein, 25 aa, Mycobacterium
EGKVGIAPGDIGFVVVVVVVVGAVV

SEQ ID NO: 304727 - protein, 21 aa, Mycobacterium
EGLAALIFTKYLWAFELTGAL

SEQ ID NO: 304728 - protein, 23 aa, Mycobacterium
EGLAYRFPFHTEKKSYPYFDPIA

SEQ ID NO: 304729 - protein, 17 aa, Mycobacterium
EGLEFLLYQLVRTELPD

SEQ ID NO: 304730 - protein, 23 aa, Mycobacterium
EGLFLGALSFVFAHFSVSNANAG

SEQ ID NO: 304731 - protein, 23 aa, Mycobacterium
EGLFLGALSFVFANFSVSNANAG

SEQ ID NO: 304732 - protein, 29 aa, Mycobacterium
EGLKERSTHRALLLVTFGGLFIAGVTQAL

SEQ ID NO: 304733 - protein, 21 aa, Mycobacterium
EGLLTSMICHLAVFHPPDLVQ

SEQ ID NO: 304734 - protein, 21 aa, Mycobacterium
EGLPIVATLALARGMLRMARQ

SEQ ID NO: 304735 - protein, 25 aa, Mycobacterium
EGLPYFSIGMANNFVQSSKTLGLLG

SEQ ID NO: 304736 - protein, 24 aa, Mycobacterium
EGLQFVWRTPVLRTLAIVDLVATG

SEQ ID NO: 304737 - protein, 21 aa, Mycobacterium
EGLRAVAVLAVVFFHCSAPGL

SEQ ID NO: 304738 - protein, 22 aa, Mycobacterium
EGLRAVAVLAVVLFHAGVPGVG

SEQ ID NO: 304739 - protein, 20 aa, Mycobacterium
EGLRGVAVLAVVLYHCSSPG

SEQ ID NO: 304740 - protein, 18 aa, Mycobacterium
EGLSKFFTWTGWASPAAW

SEQ ID NO: 304741 - protein, 24 aa, Mycobacterium
EGLSYRFPFHTEKKSYPYFDPIAQ

SEQ ID NO: 304742 - protein, 18 aa, Mycobacterium
EGLWLAVRQNQYTWNNQR

SEQ ID NO: 304743 - protein, 19 aa, Mycobacterium
EGMAMWIIGIVAAIAAALW

SEQ ID NO: 304744 - protein, 18 aa, Mycobacterium
EGPAGRFAKVASATANSV

SEQ ID NO: 304745 - protein, 21 aa, Mycobacterium
EGPEDLAALRRTNRMIDAIAA

SEQ ID NO: 304746 - protein, 19 aa, Mycobacterium
EGPEIGAFFDLDGTLVAGF

SEQ ID NO: 304747 - protein, 18 aa, Mycobacterium
EGPTVVLVHGFPDSHVLW

SEQ ID NO: 304748 - protein, 20 aa, Mycobacterium
EGPWLRTGDLGVMSNGELFI

SEQ ID NO: 304749 - protein, 25 aa, Mycobacterium
EGPWLRTGDSGFFYDGELFIIGRIK

SEQ ID NO: 304750 - protein, 24 aa, Mycobacterium
EGPYALPSMELLVAGDPPKKRSAA

SEQ ID NO: 304751 - protein, 26 aa, Mycobacterium
EGPYETIGGLALREFGHIPVAGETVK

SEQ ID NO: 304752 - protein, 23 aa, Mycobacterium
EGQAADWAPWIWAVLVAGVGFMA

SEQ ID NO: 304753 - protein, 21 aa, Mycobacterium
EGQPFPWSIETCRATSDGVLA

SEQ ID NO: 304754 - protein, 25 aa, Mycobacterium
EGQPSKFTVAGPWVGVAAPGERIVS

SEQ ID NO: 304755 - protein, 22 aa, Mycobacterium
EGQSHGWALWIWATVLAGVAVM

SEQ ID NO: 304756 - protein, 20 aa, Mycobacterium
EGRFPGIQLIIARDATGKVQ

SEQ ID NO: 304757 - protein, 21 aa, Mycobacterium
EGRFPGIQLIVARDTSGKVQG

SEQ ID NO: 304758 - protein, 26 aa, Mycobacterium
EGRRGSSVCGWTMRLMTALELSLGDG

SEQ ID NO: 304759 - protein, 25 aa, Mycobacterium
EGRSLRWAVGYVLKIRTNVALIVAS

SEQ ID NO: 304760 - protein, 20 aa, Mycobacterium
EGRTAYLVMELVNGEPLNSV

SEQ ID NO: 304761 - protein, 28 aa, Mycobacterium
EGSAAFLQWGWRVPFLLSAVLVGLALYV

SEQ ID NO: 304762 - protein, 27 aa, Mycobacterium
EGSSVGRLWMCAAILVPLGRLLWITIK

SEQ ID NO: 304763 - protein, 20 aa, Mycobacterium
EGSWQPPSYPAADYQQYQQP

SEQ ID NO: 304764 - protein, 24 aa, Mycobacterium
EGTETPAFCIFLACYVVAALLVWA

SEQ ID NO: 304765 - protein, 20 aa, Mycobacterium
EGTGALPDRHFDLSHTEVPY

SEQ ID NO: 304766 - protein, 23 aa, Mycobacterium
EGTKFSGAIDRLERLISALSQDR

SEQ ID NO: 304767 - protein, 17 aa, Mycobacterium
EGTRFRFTLPVTADDTA

SEQ ID NO: 304768 - protein, 20 aa, Mycobacterium
EGTRIAVRYLNLVGDRYLEL

SEQ ID NO: 304769 - protein, 21 aa, Mycobacterium
EGTTVGWGVYLVIAFTLLQAA

SEQ ID NO: 304770 - protein, 19 aa, Mycobacterium
EGVAGLTFFDVRGLGRVPA

SEQ ID NO: 304771 - protein, 21 aa, Mycobacterium
EGVAIGLAVAILFLLVRVVRA

SEQ ID NO: 304772 - protein, 26 aa, Mycobacterium
EGVAWLRLAWAGILFLIIVRPRRTAF

SEQ ID NO: 304773 - protein, 22 aa, Mycobacterium
EGVELVQAIAIFFSTGLVPLNS

SEQ ID NO: 304774 - protein, 26 aa, Mycobacterium
EGVFVVGCGVDIVALKPVLEVATSLV

SEQ ID NO: 304775 - protein, 29 aa, Mycobacterium
EGVGLWLLKRWGEYFAVVATSLFLPLEIH

SEQ ID NO: 304776 - protein, 29 aa, Mycobacterium
EGVGLWLLKRWGEYFAVVATSVFLPLEIH

SEQ ID NO: 304777 - protein, 18 aa, Mycobacterium
EGVHFGYLIAASFMGFIV

SEQ ID NO: 304778 - protein, 24 aa, Mycobacterium
EGVTFGYRPGVPVIHDVSLTLRHG

SEQ ID NO: 304779 - protein, 24 aa, Mycobacterium
EGVWAQLCFPNFGGFAGSTFHKAK

SEQ ID NO: 304780 - protein, 21 aa, Mycobacterium
EGWLVKGRTDTRLYYTPDDPD

SEQ ID NO: 304781 - protein, 17 aa, Mycobacterium
EGYALEHCYAYSDSITD

SEQ ID NO: 304782 - protein, 20 aa, Mycobacterium
EGYLAWAAAAAMVAPRTLFG

SEQ ID NO: 304783 - protein, 17 aa, Mycobacterium
EGYNFLDLLGLGPATGI

SEQ ID NO: 304784 - protein, 23 aa, Mycobacterium
EGYNFLELMGLGPATGVISSLVT

SEQ ID NO: 304785 - protein, 19 aa, Mycobacterium
EGYPAVIWLLLGGNLVVRA

SEQ ID NO: 304786 - protein, 23 aa, Mycobacterium
EGYTASYLRFVWTLAATAVVVCY

SEQ ID NO: 304787 - protein, 22 aa, Mycobacterium
EHAGYMANYFRWFGSPEDPFGW

SEQ ID NO: 304788 - protein, 23 aa, Mycobacterium
EHAGYMANYFRWFGSPEDPFGWY

SEQ ID NO: 304789 - protein, 25 aa, Mycobacterium
EHAMIPRSRVDAIPADEPVAAVLSR

SEQ ID NO: 304790 - protein, 23 aa, Mycobacterium
EHAPEFPVLGLVAVGVWAVSLAI

SEQ ID NO: 304791 - protein, 23 aa, Mycobacterium
EHARSKVSVAWNVGFDGGTGIGA

SEQ ID NO: 304792 - protein, 21 aa, Mycobacterium
EHARTVLLAAGMDYLPPNIPG

SEQ ID NO: 304793 - protein, 17 aa, Mycobacterium
EHATIPYLFTMQGSTSG

SEQ ID NO: 304794 - protein, 18 aa, Mycobacterium
EHDIKFIVGVTIIVVLLT

SEQ ID NO: 304795 - protein, 22 aa, Mycobacterium
EHEAMAAAYCAALAAMPTMGEL

SEQ ID NO: 304796 - protein, 23 aa, Mycobacterium
EHEGIDWNVIFLLLGMMVIVGVV

SEQ ID NO: 304797 - protein, 18 aa, Mycobacterium
EHFVLRFDGGHWVVIDCS

SEQ ID NO: 304798 - protein, 25 aa, Mycobacterium
EHGAKPGATVAFLIPRSGEAILSIL

SEQ ID NO: 304799 - protein, 24 aa, Mycobacterium
EHGAWPWVAALAMLTLGGLAGAWY

SEQ ID NO: 304800 - protein, 17 aa, Mycobacterium
EHGHWGLAVGYTVASIV

SEQ ID NO: 304801 - protein, 29 aa, Mycobacterium
EHGKVVGFALAFLVARSFSSGCAALTGVE

SEQ ID NO: 304802 - protein, 25 aa, Mycobacterium
EHGWRAVWYWMRYSSVVKKHTTRTV

SEQ ID NO: 304803 - protein, 20 aa, Mycobacterium
EHHARIPGFPGTVHAESLQF

SEQ ID NO: 304804 - protein, 25 aa, Mycobacterium
EHIGFSVWMLWSIVVVHMTAVGGHP

SEQ ID NO: 304805 - protein, 25 aa, Mycobacterium
EHIGFSVWMLWSIVVVQMMAVGAPG

SEQ ID NO: 304806 - protein, 24 aa, Mycobacterium
EHIRRLGITAMQFVPSQLDVVLEE

SEQ ID NO: 304807 - protein, 20 aa, Mycobacterium
EHLKPSGVFAMYNAYRQPWL

SEQ ID NO: 304808 - protein, 17 aa, Mycobacterium
EHLLSFAYNGLGGARNT

SEQ ID NO: 304809 - protein, 23 aa, Mycobacterium
EHLPRLFERFYRADAARDREHGG

SEQ ID NO: 304810 - protein, 17 aa, Mycobacterium
EHLRGVASLAFLPWPVR

SEQ ID NO: 304811 - protein, 23 aa, Mycobacterium
EHMSGCPACRQAVAELSGVPALL

SEQ ID NO: 304812 - protein, 21 aa, Mycobacterium
EHNGVRMCFAANLLQGQCYAS

SEQ ID NO: 304813 - protein, 18 aa, Mycobacterium
EHPQMVAARCAASLLTAI

SEQ ID NO: 304814 - protein, 17 aa, Mycobacterium
EHPSLKGALGSVAGALA

SEQ ID NO: 304815 - protein, 19 aa, Mycobacterium
EHRALMAIAIGQADVANTS

SEQ ID NO: 304816 - protein, 19 aa, Mycobacterium
EHRDRAAVMILRGGPEGGM

SEQ ID NO: 304817 - protein, 29 aa, Mycobacterium
EHRFPAALDDGWAAVRWVAEHAEELGGIP

SEQ ID NO: 304818 - protein, 24 aa, Mycobacterium
EHRGASSGFGRYVLAEASDQSLDV

SEQ ID NO: 304819 - protein, 22 aa, Mycobacterium
EHRQLWLQLGWQDIKQRYRRSV

SEQ ID NO: 304820 - protein, 18 aa, Mycobacterium
EHRTEAYASELPDLSGPV

SEQ ID NO: 304821 - protein, 19 aa, Mycobacterium
EHRWPNYVFGGRMRTSTLV

SEQ ID NO: 304822 - protein, 21 aa, Mycobacterium
EHTTHWGLAIDDFWWTAIWAA

SEQ ID NO: 304823 - protein, 26 aa, Mycobacterium
EHTTHWGLQIDHFWWTAIWAAIALSI

SEQ ID NO: 304824 - protein, 26 aa, Mycobacterium
EHTTHWGLQIDHFWWTAIWAAIVLSI

SEQ ID NO: 304825 - protein, 18 aa, Mycobacterium
EHVARRAAPFVAIAPTAI

SEQ ID NO: 304826 - protein, 25 aa, Mycobacterium
EHVGFSVWMLWSIVVVQMTAGAHGL

SEQ ID NO: 304827 - protein, 25 aa, Mycobacterium
EHVGFSVWMLWSIVVVQMTAGPHGH

SEQ ID NO: 304828 - protein, 25 aa, Mycobacterium
EHVLARRADDEFVLMLPATTEQAAL

SEQ ID NO: 304829 - protein, 24 aa, Mycobacterium
EHVRSLRAVPVAAPRNLGRLPKHH

SEQ ID NO: 304830 - protein, 17 aa, Mycobacterium
EHWSIEPGDTFLVPSPV

SEQ ID NO: 304831 - protein, 30 aa, Mycobacterium
EHYARIRRLIVRWWIAWVASYLVSVFAMFT

SEQ ID NO: 304832 - protein, 23 aa, Mycobacterium
EHYGLPFIVMERLPGVSLADHIA

SEQ ID NO: 304833 - protein, 24 aa, Mycobacterium
EHYVPLNDGFNWKGDPNATLSGQG

SEQ ID NO: 304834 - protein, 25 aa, Mycobacterium
EHYVVDILLGWALAATVIFVFNRFH

SEQ ID NO: 304835 - protein, 21 aa, Mycobacterium
EIAFSFKRTRKVTVNSESSDS

SEQ ID NO: 304836 - protein, 24 aa, Mycobacterium
EIAKNASVLISVWVTVTDIDGVNA

SEQ ID NO: 304837 - protein, 19 aa, Mycobacterium
EIALARGPRFDRVQTTPVP

SEQ ID NO: 304838 - protein, 26 aa, Mycobacterium
EIAPGSWPSAANFYGTLVVPVPSLSE

SEQ ID NO: 304839 - protein, 19 aa, Mycobacterium
EIATSVLIFLGIPLMAGYL

SEQ ID NO: 304840 - protein, 19 aa, Mycobacterium
EIATTPALRDKLFYSTTFV

SEQ ID NO: 304841 - protein, 20 aa, Mycobacterium
EIAVFVFFGLVAVLGTEYAQ

SEQ ID NO: 304842 - protein, 26 aa, Mycobacterium
EICESDRPFEPLAMRQHVTGPYPIDP

SEQ ID NO: 304843 - protein, 22 aa, Mycobacterium
EIDARRFGMKAANLDAESPWKL

SEQ ID NO: 304844 - protein, 19 aa, Mycobacterium
EIDDAFRWSEENPNLQRKA

SEQ ID NO: 304845 - protein, 20 aa, Mycobacterium
EIDGQLYLDMRLIEGTHLAL

SEQ ID NO: 304846 - protein, 19 aa, Mycobacterium
EIDGVPFIDMHLVDDGGSL

SEQ ID NO: 304847 - protein, 25 aa, Mycobacterium
EIELAGQEAFVWIGLHEPDEKQMQD

SEQ ID NO: 304848 - protein, 19 aa, Mycobacterium
EIELLRRYGLLSFATAREF

SEQ ID NO: 304849 - protein, 21 aa, Mycobacterium
EIERNALCGMYDAVRDKRSDQ

SEQ ID NO: 304850 - protein, 19 aa, Mycobacterium
EIFGALLHGGRLVIVPETV

SEQ ID NO: 304851 - protein, 19 aa, Mycobacterium
EIFGALLHGGRLVVVPEGV

SEQ ID NO: 304852 - protein, 18 aa, Mycobacterium
EIFGALLHGGRLVVVSDS

SEQ ID NO: 304853 - protein, 19 aa, Mycobacterium
EIFMLGMFGAYFALDVILG

SEQ ID NO: 304854 - protein, 18 aa, Mycobacterium
EIFTVFFGVVLAGAVGLS

SEQ ID NO: 304855 - protein, 18 aa, Mycobacterium
EIFVLSWAGTRGVVSLAA

SEQ ID NO: 304856 - protein, 17 aa, Mycobacterium
EIFYRRDPAGFVDVHSL

SEQ ID NO: 304857 - protein, 20 aa, Mycobacterium
EIGARAGLWTTQVLPAPSVI

SEQ ID NO: 304858 - protein, 18 aa, Mycobacterium
EIGDGGGGFDEFLGRQGT

SEQ ID NO: 304859 - protein, 26 aa, Mycobacterium
EIGEYDGRLYLVMPIVDGVDLNKVLK

SEQ ID NO: 304860 - protein, 30 aa, Mycobacterium
EIGGRALLFGGIFPPFWLAGTTMLGLSKII

SEQ ID NO: 304861 - protein, 18 aa, Mycobacterium
EIGIMRLVGASRWYTQLP

SEQ ID NO: 304862 - protein, 21 aa, Mycobacterium
EIGITVLRFSVLRHGVIPANR

SEQ ID NO: 304863 - protein, 19 aa, Mycobacterium
EIGQPLLNEYVWGRQFGEN

SEQ ID NO: 304864 - protein, 24 aa, Mycobacterium
EIGTRVDPLAARRGMQLELTERGL

SEQ ID NO: 304865 - protein, 17 aa, Mycobacterium
EIGVPIFFVLSGFLLFR

SEQ ID NO: 304866 - protein, 18 aa, Mycobacterium
EIGVPIFFVLSGFLLFRP

SEQ ID NO: 304867 - protein, 20 aa, Mycobacterium
EIGVTVLRLAVIRRGVIPAS

SEQ ID NO: 304868 - protein, 25 aa, Mycobacterium
EIIELRTALFDAFQPVGPDGQPSEQ

SEQ ID NO: 304869 - protein, 20 aa, Mycobacterium
EIIFRGLLWGAVDRRRGPWA

SEQ ID NO: 304870 - protein, 18 aa, Mycobacterium
EIIVVALIAAGILVPLGL

SEQ ID NO: 304871 - protein, 20 aa, Mycobacterium
EIIVVPVLLALILSALLVPV

SEQ ID NO: 304872 - protein, 20 aa, Mycobacterium
EIIVVPVLLALMLSALLVPV

SEQ ID NO: 304873 - protein, 22 aa, Mycobacterium
EIKGFAGFPIGGRFLRTDNPVL

SEQ ID NO: 304874 - protein, 19 aa, Mycobacterium
EIKGTPTGLVNWPPSLGYS

SEQ ID NO: 304875 - protein, 25 aa, Mycobacterium
EILAILIIPVCLTRTYSTMVGDKRQ

SEQ ID NO: 304876 - protein, 31 aa, Mycobacterium
EILETFLSELWMWVQEALLVFQEIMTAFFQG

SEQ ID NO: 304877 - protein, 18 aa, Mycobacterium
EILTAFFALAAVVYAVLT

SEQ ID NO: 304878 - protein, 18 aa, Mycobacterium
EILTGFFALATVVYAVLT

SEQ ID NO: 304879 - protein, 19 aa, Mycobacterium
EINDVLYIDMRLVQGQTLH

SEQ ID NO: 304880 - protein, 24 aa, Mycobacterium
EIPAPRPIALGLFNAIPEAPPLTA

SEQ ID NO: 304881 - protein, 17 aa, Mycobacterium
EIPDDLASAVARAEAGG

SEQ ID NO: 304882 - protein, 20 aa, Mycobacterium
EIPLISYLVHPGRTEATMLW

SEQ ID NO: 304883 - protein, 18 aa, Mycobacterium
EIPNGAKIALRDDPAGQA

SEQ ID NO: 304884 - protein, 20 aa, Mycobacterium
EIPPGLDSVVLKALSKNPDN

SEQ ID NO: 304885 - protein, 26 aa, Mycobacterium
EIPPTLRMLFVFGVLTLLAMAGSLTL

SEQ ID NO: 304886 - protein, 20 aa, Mycobacterium
EIPSQFLLSAYAPQPRTLID

SEQ ID NO: 304887 - protein, 26 aa, Mycobacterium
EIRDFMGVPRLKFWDHPLTAVLSIVV

SEQ ID NO: 304888 - protein, 26 aa, Mycobacterium
EIRHQRRWNLDLGFRAGGPDEGVRAA

SEQ ID NO: 304889 - protein, 26 aa, Mycobacterium
EIRSRTRLWLPYLPLLVAAAVGLGHA

SEQ ID NO: 304890 - protein, 19 aa, Mycobacterium
EITTGVGIVAAVLIFVLSL

SEQ ID NO: 304891 - protein, 27 aa, Mycobacterium
EIVAALLIALRPWWPRVSAAGSALAVV

SEQ ID NO: 304892 - protein, 20 aa, Mycobacterium
EIVGDPTLLTMLWQNLIGNA

SEQ ID NO: 304893 - protein, 18 aa, Mycobacterium
EIVRRCVVAAVGAASASS

SEQ ID NO: 304894 - protein, 21 aa, Mycobacterium
EIVVSPAWIFRGGVLAWNGQI

SEQ ID NO: 304895 - protein, 19 aa, Mycobacterium
EIWGALLHGGRLVIVPESI

SEQ ID NO: 304896 - protein, 19 aa, Mycobacterium
EIWGALLHGGRLVVVPESV

SEQ ID NO: 304897 - protein, 28 aa, Mycobacterium
EIWRSVRSLPDFWRLLQVRMASQFGDGL

SEQ ID NO: 304898 - protein, 18 aa, Mycobacterium
EIYIRIARHTQDVDEMPD

SEQ ID NO: 304899 - protein, 21 aa, Mycobacterium
EIYSHLRLHGIEDMNRVRRAY

SEQ ID NO: 304900 - protein, 23 aa, Mycobacterium
EKALKLAALLTQPGTTYDVSSPD

SEQ ID NO: 304901 - protein, 25 aa, Mycobacterium
EKAMAANSVDFVWITDFAPYQAQLG

SEQ ID NO: 304902 - protein, 19 aa, Mycobacterium
EKATAPAFFVVTSAFVLAE

SEQ ID NO: 304903 - protein, 19 aa, Mycobacterium
EKFCPSCGEPIVIDASAHG

SEQ ID NO: 304904 - protein, 23 aa, Mycobacterium
EKGRGRALAAAWLSSDAEVVAYC

SEQ ID NO: 304905 - protein, 23 aa, Mycobacterium
EKHCADIPICWASRTVFDALDGV

SEQ ID NO: 304906 - protein, 20 aa, Mycobacterium
EKHCETIPICFAIRSVFQAL

SEQ ID NO: 304907 - protein, 27 aa, Mycobacterium
EKHCFDIPMCWAMRSIFDTLDKIDEMT

SEQ ID NO: 304908 - protein, 26 aa, Mycobacterium
EKHCYDIPNCWTFRSLFDALDGLDQI

SEQ ID NO: 304909 - protein, 25 aa, Mycobacterium
EKHCYDVPICWSLRSIFDALDGVDK

SEQ ID NO: 304910 - protein, 24 aa, Mycobacterium
EKHFSRARLEPELLMVETDHDMRN

SEQ ID NO: 304911 - protein, 18 aa, Mycobacterium
EKIRSALVGYRIMAWTTG

SEQ ID NO: 304912 - protein, 31 aa, Mycobacterium
EKKKRRFLRDPLSILLVCIIVVCLVIAGLVG

SEQ ID NO: 304913 - protein, 19 aa, Mycobacterium
EKLAALLTQPGRTYDVSSP

SEQ ID NO: 304914 - protein, 19 aa, Mycobacterium
EKLAFGIRDLFMVTMLSSI

SEQ ID NO: 304915 - protein, 22 aa, Mycobacterium
EKLFNRWGARAVFLGRFIALLR

SEQ ID NO: 304916 - protein, 24 aa, Mycobacterium
EKLRVRMWFFPWLPILTVVGIVVV

SEQ ID NO: 304917 - protein, 17 aa, Mycobacterium
EKLRYRVMVEKLALIAG

SEQ ID NO: 304918 - protein, 20 aa, Mycobacterium
EKPFLARMIHAFAVPIILAW

SEQ ID NO: 304919 - protein, 20 aa, Mycobacterium
EKPLIARIIHAFAVPIILGW

SEQ ID NO: 304920 - protein, 18 aa, Mycobacterium
EKPWGTPQIQRGATVAVV

SEQ ID NO: 304921 - protein, 25 aa, Mycobacterium
EKRAERGVALWLLLGGGGFGLALLL

SEQ ID NO: 304922 - protein, 20 aa, Mycobacterium
EKRFGELVADFAATCHAHGW

SEQ ID NO: 304923 - protein, 31 aa, Mycobacterium
EKRTAYPYDKARIIVTAALEHYCPKPAAVQP

SEQ ID NO: 304924 - protein, 24 aa, Mycobacterium
EKSEARAAFLWGLSISPVLLSLIV

SEQ ID NO: 304925 - protein, 18 aa, Mycobacterium
EKSLPRKLADAMEAAQAQ

SEQ ID NO: 304926 - protein, 33 aa, Mycobacterium
EKSQRRWRRIATYVVRWPGPVLAGSMAVLAIAF

SEQ ID NO: 304927 - protein, 23 aa, Mycobacterium
EKSRARVSISVRTLVIAAVICVA

SEQ ID NO: 304928 - protein, 23 aa, Mycobacterium
EKSRLAVRAVIAILVLVAAVSST

SEQ ID NO: 304929 - protein, 22 aa, Mycobacterium
EKTFPAWLRPYVRNQPVSQFAE

SEQ ID NO: 304930 - protein, 17 aa, Mycobacterium
EKTLVYPGGFAAHVDRN

SEQ ID NO: 304931 - protein, 20 aa, Mycobacterium
EKTSIRRGWCTVARNRAFWC

SEQ ID NO: 304932 - protein, 21 aa, Mycobacterium
EKVAFVAGWMYFLNWAMTGVV

SEQ ID NO: 304933 - protein, 17 aa, Mycobacterium
EKVQLVIFGIQIALGEL

SEQ ID NO: 304934 - protein, 23 aa, Mycobacterium
EKVRGRGWYESKFLPAISPWALY

SEQ ID NO: 304935 - protein, 18 aa, Mycobacterium
EKVTKLILVYTWLTVLST

SEQ ID NO: 304936 - protein, 29 aa, Mycobacterium
EKVVGSRRIRWPAVAIGVAGVAVILVVVM

SEQ ID NO: 304937 - protein, 22 aa, Mycobacterium
EKYGPWTIILARFAPFVRTFVP

SEQ ID NO: 304938 - protein, 25 aa, Mycobacterium
EKYGPWTVILARFVPFARTFVPVIA

SEQ ID NO: 304939 - protein, 24 aa, Mycobacterium
EKYKVTAMVVVPVMLSRILDAVEK

SEQ ID NO: 304940 - protein, 24 aa, Mycobacterium
EKYKVTAMVVVPVMLSRILEAVEK

SEQ ID NO: 304941 - protein, 26 aa, Mycobacterium
EKYRSANKIPDTWKPRERVVVGVTGG

SEQ ID NO: 304942 - protein, 24 aa, Mycobacterium
ELAAAAGHRLRVVGVTWNDEASAQ

SEQ ID NO: 304943 - protein, 21 aa, Mycobacterium
ELAAAFPFYGPTPEAPDFAGS

SEQ ID NO: 304944 - protein, 21 aa, Mycobacterium
ELAALRLAIGAVPTRDYLRHE

SEQ ID NO: 304945 - protein, 19 aa, Mycobacterium
ELAALRLAVGEVVTREYLR

SEQ ID NO: 304946 - protein, 19 aa, Mycobacterium
ELAAWLGWDNSLWASLIMP

SEQ ID NO: 304947 - protein, 23 aa, Mycobacterium
ELAEDMAAFAIIFGVPVWGFAML

SEQ ID NO: 304948 - protein, 21 aa, Mycobacterium
ELAEPAAYPIVLLVMVLVCTL

SEQ ID NO: 304949 - protein, 22 aa, Mycobacterium
ELAETMQAFAIIFGVPVWGFAM

SEQ ID NO: 304950 - protein, 19 aa, Mycobacterium
ELAFRGVLHGALDRAWGFR

SEQ ID NO: 304951 - protein, 19 aa, Mycobacterium
ELAFRGVLHGALNRAWGFR

SEQ ID NO: 304952 - protein, 21 aa, Mycobacterium
ELAPKAKIIAAAREAENQHLL

SEQ ID NO: 304953 - protein, 20 aa, Mycobacterium
ELARRPQLRAELRDNPKQIR

SEQ ID NO: 304954 - protein, 21 aa, Mycobacterium
ELASLSVFGIRLNWLILAGLI

SEQ ID NO: 304955 - protein, 19 aa, Mycobacterium
ELATAKGRVNLSFTPSYTY

SEQ ID NO: 304956 - protein, 24 aa, Mycobacterium
ELATRPGLSGALAALARPAHQPVS

SEQ ID NO: 304957 - protein, 21 aa, Mycobacterium
ELCAEFAGILILFGVGVVAQV

SEQ ID NO: 304958 - protein, 20 aa, Mycobacterium
ELCGVPALLSQLGADEVAAI

SEQ ID NO: 304959 - protein, 20 aa, Mycobacterium
ELDDAIGVVHLRDLLGSAGT

SEQ ID NO: 304960 - protein, 24 aa, Mycobacterium
ELDDLLRRPLDGVFTALDDLLSRN

SEQ ID NO: 304961 - protein, 21 aa, Mycobacterium
ELDEALTIAFLIIFTVLVLVG

SEQ ID NO: 304962 - protein, 24 aa, Mycobacterium
ELDGPRVLVTFTVASNLRLGERTE

SEQ ID NO: 304963 - protein, 21 aa, Mycobacterium
ELDMPAAAWAYLAAGPVVCLV

SEQ ID NO: 304964 - protein, 19 aa, Mycobacterium
ELDPGHATDIYFSLIDTAT

SEQ ID NO: 304965 - protein, 17 aa, Mycobacterium
ELDRRRPDLVASVGSLA

SEQ ID NO: 304966 - protein, 20 aa, Mycobacterium
ELDVPDWASNGVNAVRDDHR

SEQ ID NO: 304967 - protein, 20 aa, Mycobacterium
ELDVSWIIFAHMVFQELAGL

SEQ ID NO: 304968 - protein, 17 aa, Mycobacterium
ELDWPRAESTYLLSAHG

SEQ ID NO: 304969 - protein, 22 aa, Mycobacterium
ELDWPSAESTYLLSAHALALAP

SEQ ID NO: 304970 - protein, 20 aa, Mycobacterium
ELEGEQAFVWIGLHEPNHHQ

SEQ ID NO: 304971 - protein, 17 aa, Mycobacterium
ELEHFYWARQRARRALL

SEQ ID NO: 304972 - protein, 19 aa, Mycobacterium
ELEKYALSQGWKKSQTPSG

SEQ ID NO: 304973 - protein, 21 aa, Mycobacterium
ELEQLLAYRQRLFRDRGIASV

SEQ ID NO: 304974 - protein, 21 aa, Mycobacterium
ELEQRGVLALAQITGLTETGT

SEQ ID NO: 304975 - protein, 19 aa, Mycobacterium
ELESCLRTRESLFGEQGID

SEQ ID NO: 304976 - protein, 19 aa, Mycobacterium
ELFCTLDRCPVIVGNTVVF

SEQ ID NO: 304977 - protein, 21 aa, Mycobacterium
ELFDGMTVTLTWLWVAAFAGM

SEQ ID NO: 304978 - protein, 20 aa, Mycobacterium
ELFDVAGLDLSRARAARKEI

SEQ ID NO: 304979 - protein, 19 aa, Mycobacterium
ELFGRVVQVLGWVWVATFA

SEQ ID NO: 304980 - protein, 27 aa, Mycobacterium
ELFIIGRIKDLLIVYGRNHSPDDIEAT

SEQ ID NO: 304981 - protein, 26 aa, Mycobacterium
ELFRMSLRDARWWLGGMAAVTNYSLQ

SEQ ID NO: 304982 - protein, 21 aa, Mycobacterium
ELGAALRWAATERNVVVVVAA

SEQ ID NO: 304983 - protein, 25 aa, Mycobacterium
ELGALRRPQVWLALAVGMIGFGGMF

SEQ ID NO: 304984 - protein, 26 aa, Mycobacterium
ELGALRRPQVWLAVLVGMIGFGGMFA

SEQ ID NO: 304985 - protein, 24 aa, Mycobacterium
ELGDLRWFYVYSGVMWAIVFMRTG

SEQ ID NO: 304986 - protein, 18 aa, Mycobacterium
ELGLDMAAFDAAYNDPAT

SEQ ID NO: 304987 - protein, 25 aa, Mycobacterium
ELGLQIPAATAFASLAGHGVQAQID

SEQ ID NO: 304988 - protein, 19 aa, Mycobacterium
ELGPLNWVIAKAGARGIRR

SEQ ID NO: 304989 - protein, 23 aa, Mycobacterium
ELGSGSLGRALLCVVPVMHLVAI

SEQ ID NO: 304990 - protein, 20 aa, Mycobacterium
ELGTTVGLLPAWKIVLILLL

SEQ ID NO: 304991 - protein, 30 aa, Mycobacterium
ELGVILRWPVWWVVVCTAVCVLIVEGMAVN

SEQ ID NO: 304992 - protein, 21 aa, Mycobacterium
ELGVTMLRLAVIRRGVIPASW

SEQ ID NO: 304993 - protein, 25 aa, Mycobacterium
ELGYDPFPLWSLLWGLVETMLIEII

SEQ ID NO: 304994 - protein, 24 aa, Mycobacterium
ELHARYGDRVRFIVINVREAHPGA

SEQ ID NO: 304995 - protein, 18 aa, Mycobacterium
ELHIGYADVVWVTSAYLL

SEQ ID NO: 304996 - protein, 20 aa, Mycobacterium
ELIAKLGAPAPARPTHRHSA

SEQ ID NO: 304997 - protein, 26 aa, Mycobacterium
ELIEIFCLTFLWLVVLVRIPTIRGRN

SEQ ID NO: 304998 - protein, 18 aa, Mycobacterium
ELIEITLVKNPGMRYKSG

SEQ ID NO: 304999 - protein, 18 aa, Mycobacterium
ELIKFAIVGGTTFIIDSA

SEQ ID NO: 305000 - protein, 18 aa, Mycobacterium
ELIWRGRGLLITFAVGHI

SEQ ID NO: 305001 - protein, 18 aa, Mycobacterium
ELKDALGERDWGSLPDLQ

SEQ ID NO: 305002 - protein, 23 aa, Mycobacterium
ELKETLDLLPLLLDNVDRSIDPV

SEQ ID NO: 305003 - protein, 18 aa, Mycobacterium
ELLAGVLAAAYVTRVHWS

SEQ ID NO: 305004 - protein, 22 aa, Mycobacterium
ELLDDGAAPGWHRIHAASIDEP

SEQ ID NO: 305005 - protein, 19 aa, Mycobacterium
ELLDRLGAHLTRHVGPGVE

SEQ ID NO: 305006 - protein, 30 aa, Mycobacterium
ELLGRIPLPGSAPRSEWLRAVAHPERDKRV

SEQ ID NO: 305007 - protein, 23 aa, Mycobacterium
ELLGSPLRYRAGRIGQFLQVQGP

SEQ ID NO: 305008 - protein, 22 aa, Mycobacterium
ELLISELVLRKHLSEPVDASEN

SEQ ID NO: 305009 - protein, 21 aa, Mycobacterium
ELLLDLGVWAGWSTRLISDAS

SEQ ID NO: 305010 - protein, 19 aa, Mycobacterium
ELLLRAVTVPTYLKNDWFR

SEQ ID NO: 305011 - protein, 18 aa, Mycobacterium
ELLPDVFERFARGDSSRS

SEQ ID NO: 305012 - protein, 23 aa, Mycobacterium
ELLPRLFERFVRADKSRSDGSGH

SEQ ID NO: 305013 - protein, 24 aa, Mycobacterium
ELLQEVFLNPGLCLLLGGIIIGLI

SEQ ID NO: 305014 - protein, 32 aa, Mycobacterium
ELLTRYRKPLLLCFLITMGGTLAFYTYSVNAP

SEQ ID NO: 305015 - protein, 18 aa, Mycobacterium
ELLVLIAPIVGLIYAGIR

SEQ ID NO: 305016 - protein, 30 aa, Mycobacterium
ELMPARLRRTWPGALLARLARPAGLSAAAV

SEQ ID NO: 305017 - protein, 23 aa, Mycobacterium
ELNASGTPFVWDGSKSIDLQNPS

SEQ ID NO: 305018 - protein, 24 aa, Mycobacterium
ELNLRPGSLEALLPPNLRARPGAR

SEQ ID NO: 305019 - protein, 25 aa, Mycobacterium
ELNRAAFELAAFAAFGSAASATEWW

SEQ ID NO: 305020 - protein, 21 aa, Mycobacterium
ELNRQILAGPWTWSPQPPVWV

SEQ ID NO: 305021 - protein, 20 aa, Mycobacterium
ELPAAVTATVFGVLAGVAVR

SEQ ID NO: 305022 - protein, 22 aa, Mycobacterium
ELPATGARLRWVRAQGSSATPA

SEQ ID NO: 305023 - protein, 21 aa, Mycobacterium
ELPDCVVVSVSHRPTVEQHHE

SEQ ID NO: 305024 - protein, 22 aa, Mycobacterium
ELPECVLVSVSHRPAVEQHHEQ

SEQ ID NO: 305025 - protein, 18 aa, Mycobacterium
ELPGAGTEIRVTRAELDD

SEQ ID NO: 305026 - protein, 19 aa, Mycobacterium
ELPGHRSDVRLTRTELDEV

SEQ ID NO: 305027 - protein, 32 aa, Mycobacterium
ELPIPGMEVELNFGGLLSPGGSMFNSLNLVFG

SEQ ID NO: 305028 - protein, 24 aa, Mycobacterium
ELPTYPFQHHRYWLTPRSGTDAAG

SEQ ID NO: 305029 - protein, 25 aa, Mycobacterium
ELPWPYTWDPVLGRSVPRVVTTGVL

SEQ ID NO: 305030 - protein, 20 aa, Mycobacterium
ELQAAVPLVSFAILAAVGVP

SEQ ID NO: 305031 - protein, 21 aa, Mycobacterium
ELQHAVMLRLLVPALGSFALL

SEQ ID NO: 305032 - protein, 26 aa, Mycobacterium
ELQHGFRHVKWLKGIEFVAHYSELGS

SEQ ID NO: 305033 - protein, 29 aa, Mycobacterium
ELQNLPAPKPRRWKSWGATLETSVALRAV

SEQ ID NO: 305034 - protein, 24 aa, Mycobacterium
ELRALKPWEGCRHFVLIDDLQDLR

SEQ ID NO: 305035 - protein, 30 aa, Mycobacterium
ELRGQWDRLRWQLPASFIGAAGGAWLLLHL

SEQ ID NO: 305036 - protein, 30 aa, Mycobacterium
ELRGQWKRLRWQIPASLIGAIIGAWLLLHL

SEQ ID NO: 305037 - protein, 24 aa, Mycobacterium
ELRGRRAPTQLARPVKLAAPEEVA

SEQ ID NO: 305038 - protein, 21 aa, Mycobacterium
ELRHWVVVLILTAVGWVLAAI

SEQ ID NO: 305039 - protein, 20 aa, Mycobacterium
ELRKVIWPNRKEMIAYTTTV

SEQ ID NO: 305040 - protein, 17 aa, Mycobacterium
ELRLADFNEATLVAKAR

SEQ ID NO: 305041 - protein, 19 aa, Mycobacterium
ELRLPAVTFATLPQLTEAS

SEQ ID NO: 305042 - protein, 18 aa, Mycobacterium
ELRNRLKNATGLTLSPTL

SEQ ID NO: 305043 - protein, 18 aa, Mycobacterium
ELRNRLKSSTGLTLSPTL

SEQ ID NO: 305044 - protein, 18 aa, Mycobacterium
ELRNRLKTVTGLTLPPTL

SEQ ID NO: 305045 - protein, 19 aa, Mycobacterium
ELRPEAAHVIAALHRSGYR

SEQ ID NO: 305046 - protein, 20 aa, Mycobacterium
ELRPPGGAQSEWIAVYRFDS

SEQ ID NO: 305047 - protein, 18 aa, Mycobacterium
ELRPRPVPETAPPPPEVP

SEQ ID NO: 305048 - protein, 19 aa, Mycobacterium
ELRRSATRFLFEFADDLQH

SEQ ID NO: 305049 - protein, 18 aa, Mycobacterium
ELRSRRPTAMVGDGVNDA

SEQ ID NO: 305050 - protein, 19 aa, Mycobacterium
ELRTRLLISLAAILITTIF

SEQ ID NO: 305051 - protein, 19 aa, Mycobacterium
ELRVPIGVTATGEPLIFDL

SEQ ID NO: 305052 - protein, 18 aa, Mycobacterium
ELSAEIFGATPIGGTGGW

SEQ ID NO: 305053 - protein, 25 aa, Mycobacterium
ELSAYKIPRRFLAVPRSQLPLLSSG

SEQ ID NO: 305054 - protein, 19 aa, Mycobacterium
ELSEAASLLRAGHAAATEP

SEQ ID NO: 305055 - protein, 20 aa, Mycobacterium
ELSGGAWAPFTMVLASALLS

SEQ ID NO: 305056 - protein, 21 aa, Mycobacterium
ELSLQPGIYAVHWYAGEQSNP

SEQ ID NO: 305057 - protein, 25 aa, Mycobacterium
ELSLSALRRLVCPLFEEPTVFSMSV

SEQ ID NO: 305058 - protein, 39 aa, Mycobacterium
ELTAQFWRRSGIRIVRRPIPHLVASVLVLALLGSCALLA

SEQ ID NO: 305059 - protein, 33 aa, Mycobacterium
ELTAQFWRRSGIRIVRRPVPHLVASALVLALLA

SEQ ID NO: 305060 - protein, 38 aa, Mycobacterium
ELTFRRIAAALGRPVIRLGFELAELRLVHGAAFMDTAR

SEQ ID NO: 305061 - protein, 28 aa, Mycobacterium
ELTGFWIRRARRLLPALVLMVLTVAAAR

SEQ ID NO: 305062 - protein, 18 aa, Mycobacterium
ELTHVFAGFYIAGCVAAV

SEQ ID NO: 305063 - protein, 24 aa, Mycobacterium
ELTKRPTSFYTLPISDFGADSNGS

SEQ ID NO: 305064 - protein, 18 aa, Mycobacterium
ELTLICYLIAPARTIAVL

SEQ ID NO: 305065 - protein, 20 aa, Mycobacterium
ELTPPYRGGPTLQDGDTIGL

SEQ ID NO: 305066 - protein, 19 aa, Mycobacterium
ELTPVYRGGPTLKNGDIIG

SEQ ID NO: 305067 - protein, 29 aa, Mycobacterium
ELTTRFWRRSGIRIVRRPKVNLIASVLVL

SEQ ID NO: 305068 - protein, 38 aa, Mycobacterium
ELTTRFWRRSGIRIVRRPVPHLVGSVLVLALLGGFTLV

SEQ ID NO: 305069 - protein, 19 aa, Mycobacterium
ELVAFSGAMFGLVTSDNML

SEQ ID NO: 305070 - protein, 19 aa, Mycobacterium
ELVAFSGAMFGLVVSDNML

SEQ ID NO: 305071 - protein, 20 aa, Mycobacterium
ELVARVPFVVLVIAALGLGL

SEQ ID NO: 305072 - protein, 25 aa, Mycobacterium
ELVDALGGVRMCLTEPIGDPLAGID

SEQ ID NO: 305073 - protein, 20 aa, Mycobacterium
ELVDIADLLDRVAGDALMHR

SEQ ID NO: 305074 - protein, 18 aa, Mycobacterium
ELVGEVVEVLALLELGER

SEQ ID NO: 305075 - protein, 18 aa, Mycobacterium
ELVKEALAGSTLTAHYAG

SEQ ID NO: 305076 - protein, 19 aa, Mycobacterium
ELVLIRWLGSNVLHLSYFT

SEQ ID NO: 305077 - protein, 21 aa, Mycobacterium
ELVPLLWLIACAVIIISYARR

SEQ ID NO: 305078 - protein, 19 aa, Mycobacterium
ELVRDARFVILVLVAALGM

SEQ ID NO: 305079 - protein, 20 aa, Mycobacterium
ELVRKLVVWNIVGGVYGSFV

SEQ ID NO: 305080 - protein, 25 aa, Mycobacterium
ELVRLRGPAPAWKKARGKIAVVEVR

SEQ ID NO: 305081 - protein, 26 aa, Mycobacterium
ELVRYNIGAALTRWLRLANTCVIFLF

SEQ ID NO: 305082 - protein, 19 aa, Mycobacterium
ELVSKLVVWNIVGGIYGTF

SEQ ID NO: 305083 - protein, 18 aa, Mycobacterium
ELWRSVRSLPDFWRLLQV

SEQ ID NO: 305084 - protein, 23 aa, Mycobacterium
ELWSEAGKLGFLGVNLPEEYGGG

SEQ ID NO: 305085 - protein, 19 aa, Mycobacterium
ELYDTWWRIPVLLGSAFAN

SEQ ID NO: 305086 - protein, 20 aa, Mycobacterium
ELYPQCFDWVQAAMREIVSD

SEQ ID NO: 305087 - protein, 19 aa, Mycobacterium
EMAGGFVLALLVVYGNYLR

SEQ ID NO: 305088 - protein, 17 aa, Mycobacterium
EMATRGRSLGKMAMGLR

SEQ ID NO: 305089 - protein, 17 aa, Mycobacterium
EMFPTRMRYSGVSLGYQ

SEQ ID NO: 305090 - protein, 20 aa, Mycobacterium
EMFVPVALFLSHGGWPTTAA

SEQ ID NO: 305091 - protein, 24 aa, Mycobacterium
EMGTRLYCAGGWYTGDTLDITAAT

SEQ ID NO: 305092 - protein, 18 aa, Mycobacterium
EMHGEGNGILGFALVFLV

SEQ ID NO: 305093 - protein, 20 aa, Mycobacterium
EMIALPLSFVVLIWVFGGLL

SEQ ID NO: 305094 - protein, 19 aa, Mycobacterium
EMLGPRVISGVPRRDVPLV

SEQ ID NO: 305095 - protein, 19 aa, Mycobacterium
EMLRIVPMDLREASYALGV

SEQ ID NO: 305096 - protein, 21 aa, Mycobacterium
EMLSARGLRVLATGVRPATDG

SEQ ID NO: 305097 - protein, 19 aa, Mycobacterium
EMLVLVVVGLVVLGPERLP

SEQ ID NO: 305098 - protein, 18 aa, Mycobacterium
EMMEWKPIGLEAVDHLLV

SEQ ID NO: 305099 - protein, 26 aa, Mycobacterium
EMMYADARLRGWFRRTPEHLGALTGY

SEQ ID NO: 305100 - protein, 18 aa, Mycobacterium
EMPVDALGLGLVLGLTMG

SEQ ID NO: 305101 - protein, 22 aa, Mycobacterium
EMRFKPMPRYEVGAVVHDRPRR

SEQ ID NO: 305102 - protein, 22 aa, Mycobacterium
EMRLRGGRGVGVVHAAEQAAAE

SEQ ID NO: 305103 - protein, 23 aa, Mycobacterium
EMSFELGTAFGLALFGALASAVF

SEQ ID NO: 305104 - protein, 19 aa, Mycobacterium
EMSIRGDATRAWASTWHAL

SEQ ID NO: 305105 - protein, 20 aa, Mycobacterium
EMVFGCRILVTFGCYAVLLL

SEQ ID NO: 305106 - protein, 18 aa, Mycobacterium
EMVHRGTAMYELDVDAVL

SEQ ID NO: 305107 - protein, 21 aa, Mycobacterium
EMVIGILMLPTIGLRIPLEAL

SEQ ID NO: 305108 - protein, 18 aa, Mycobacterium
EMVVRLGAVTGVGHARLI

SEQ ID NO: 305109 - protein, 20 aa, Mycobacterium
EMWEALRVAAAADFVRAHPQ

SEQ ID NO: 305110 - protein, 33 aa, Mycobacterium
EMYDAGPAPLPWYKRPPILFGAAAVAALLAAGG

SEQ ID NO: 305111 - protein, 19 aa, Mycobacterium
EMYPELVSALSEDTSPGST

SEQ ID NO: 305112 - protein, 17 aa, Mycobacterium
ENADLPDALGIAVEALR

SEQ ID NO: 305113 - protein, 21 aa, Mycobacterium
ENDAVYCCGPAPMLAVLQRRL

SEQ ID NO: 305114 - protein, 19 aa, Mycobacterium
ENDLGFKIIFGLPGIVLAS

SEQ ID NO: 305115 - protein, 17 aa, Mycobacterium
ENDRLLLALMPESVVQR

SEQ ID NO: 305116 - protein, 21 aa, Mycobacterium
ENDRRVAVGIVLLAALTAATS

SEQ ID NO: 305117 - protein, 24 aa, Mycobacterium
ENFSIPVIGHWDALGFLQDFFATA

SEQ ID NO: 305118 - protein, 21 aa, Mycobacterium
ENGFWGRTVVYVMQRPLVFAV

SEQ ID NO: 305119 - protein, 18 aa, Mycobacterium
ENGMRIYVEYDVNNPDLV

SEQ ID NO: 305120 - protein, 20 aa, Mycobacterium
ENGRAAWLLGASFISEGAIP

SEQ ID NO: 305121 - protein, 20 aa, Mycobacterium
ENGRAAWLLGASFITEGAIP

SEQ ID NO: 305122 - protein, 20 aa, Mycobacterium
ENGRLLTWRRGKLDENAIAS

SEQ ID NO: 305123 - protein, 25 aa, Mycobacterium
ENLSFADLLPWIDAHGDARPELINM

SEQ ID NO: 305124 - protein, 25 aa, Mycobacterium
ENNLGLKIIFGFPGIVLASIFVTVP

SEQ ID NO: 305125 - protein, 39 aa, Mycobacterium
ENPEPPARWGKYVPGEPQLRAAAFGTLVGLLVAVLMGAA

SEQ ID NO: 305126 - protein, 19 aa, Mycobacterium
ENPFALLLVSLLGPIAATV

SEQ ID NO: 305127 - protein, 30 aa, Mycobacterium
ENPTRWTNWLEIFLLLVISFSLPRTFGRMV

SEQ ID NO: 305128 - protein, 24 aa, Mycobacterium
ENRLRVAEVLPLVGHSREEVLRCA

SEQ ID NO: 305129 - protein, 19 aa, Mycobacterium
ENRLRVVRGVPYQTGADAP

SEQ ID NO: 305130 - protein, 24 aa, Mycobacterium
ENRSRAAVKFLLYNLFGGLIMLAA

SEQ ID NO: 305131 - protein, 27 aa, Mycobacterium
ENSPAFLQWGWRVPFLVSAALIGIALY

SEQ ID NO: 305132 - protein, 20 aa, Mycobacterium
ENSRRWWTAMLLAGPGWVLF

SEQ ID NO: 305133 - protein, 24 aa, Mycobacterium
ENTFSLDNFIAWAVASDNQPLIDA

SEQ ID NO: 305134 - protein, 24 aa, Mycobacterium
ENTFSLDNFVAWAVAKENQPLIDA

SEQ ID NO: 305135 - protein, 20 aa, Mycobacterium
ENTNRWAATAKWEGNQWKIS

SEQ ID NO: 305136 - protein, 17 aa, Mycobacterium
ENVPGCISLYVKTTGQY

SEQ ID NO: 305137 - protein, 23 aa, Mycobacterium
ENYIWKARTQGVGYLDLTGCMAL

SEQ ID NO: 305138 - protein, 27 aa, Mycobacterium
EPAAWWRQLSWLPQRPVLVPGTVRDNL

SEQ ID NO: 305139 - protein, 31 aa, Mycobacterium
EPAEFAPPPRWPWVVGVVAIVAAVALVVSVS

SEQ ID NO: 305140 - protein, 25 aa, Mycobacterium
EPALLKRWVLLLILVGTWIPAAAVG

SEQ ID NO: 305141 - protein, 19 aa, Mycobacterium
EPAQMFWVVCAVCVPAALM

SEQ ID NO: 305142 - protein, 18 aa, Mycobacterium
EPAREVAAVLGLDEVYAE

SEQ ID NO: 305143 - protein, 17 aa, Mycobacterium
EPARLAALRHVMPQLLG

SEQ ID NO: 305144 - protein, 22 aa, Mycobacterium
EPARLPSTIGLVEWLPTFVVVT

SEQ ID NO: 305145 - protein, 50 aa, Mycobacterium
EPARSRRRLRMPPLSVTWKVAVILLICAFVAASGYMMWNRHEVNERSQRI

SEQ ID NO: 305146 - protein, 23 aa, Mycobacterium
EPARSVFHAVLDRLAGHGPPAHQ

SEQ ID NO: 305147 - protein, 24 aa, Mycobacterium
EPATSRPALVFVIAVLSGSVALMA

SEQ ID NO: 305148 - protein, 25 aa, Mycobacterium
EPAVLRLPFVFSGVTLYATAATRLQ

SEQ ID NO: 305149 - protein, 18 aa, Mycobacterium
EPCVRRLHAFLADEVPYS

SEQ ID NO: 305150 - protein, 25 aa, Mycobacterium
EPDGKQVLPSWGLPVLAGALVAAVA

SEQ ID NO: 305151 - protein, 20 aa, Mycobacterium
EPDHPVVVSVVGLVHTPGLV

SEQ ID NO: 305152 - protein, 26 aa, Mycobacterium
EPDTRLRKDLTWKDLVVFGVSVVIGA

SEQ ID NO: 305153 - protein, 20 aa, Mycobacterium
EPDVPLRSFAMLTDHEIEEL

SEQ ID NO: 305154 - protein, 27 aa, Mycobacterium
EPDVVSWKLKPGVVSTMTAQARYTDPN

SEQ ID NO: 305155 - protein, 22 aa, Mycobacterium
EPDYRFTLANERTFLAWIRTAL

SEQ ID NO: 305156 - protein, 21 aa, Mycobacterium
EPDYRFTLANERTFLAWQRTA

SEQ ID NO: 305157 - protein, 22 aa, Mycobacterium
EPDYRFTLANERTFLAWQRTAL

SEQ ID NO: 305158 - protein, 19 aa, Mycobacterium
EPDYRFTLANERTYLAWVR

SEQ ID NO: 305159 - protein, 22 aa, Mycobacterium
EPEIIPIPVADIGKDLKRAPQA

SEQ ID NO: 305160 - protein, 20 aa, Mycobacterium
EPELRRQAGELIDAIVASGE

SEQ ID NO: 305161 - protein, 24 aa, Mycobacterium
EPEPRWPKSEPITRTKAGPERSEY

SEQ ID NO: 305162 - protein, 22 aa, Mycobacterium
EPEPRWPKSPPQPKRVPGPERS

SEQ ID NO: 305163 - protein, 26 aa, Mycobacterium
EPETRLRKDLTWRDLVVFGVSVVIGA

SEQ ID NO: 305164 - protein, 22 aa, Mycobacterium
EPEVKGLGIAAGARRPGAKKKA

SEQ ID NO: 305165 - protein, 18 aa, Mycobacterium
EPEYPAPTLTLAAGPVAA

SEQ ID NO: 305166 - protein, 22 aa, Mycobacterium
EPEYRDGPVLAALGILYSAELI

SEQ ID NO: 305167 - protein, 18 aa, Mycobacterium
EPFMSAMARLGRSRQRTG

SEQ ID NO: 305168 - protein, 19 aa, Mycobacterium
EPFSLLAVVPSWVAEARAS

SEQ ID NO: 305169 - protein, 21 aa, Mycobacterium
EPGDWLYFVTIDMQGTTLFTR

SEQ ID NO: 305170 - protein, 20 aa, Mycobacterium
EPGFPGWQVLEILPQSWSSD

SEQ ID NO: 305171 - protein, 24 aa, Mycobacterium
EPGHTYEFAKFVGVDTRRRDASTA

SEQ ID NO: 305172 - protein, 28 aa, Mycobacterium
EPGKGACFRLTLPLVRGHKVTSSPLPVK

SEQ ID NO: 305173 - protein, 28 aa, Mycobacterium
EPGKGACFRLTLPLVRGHKVTTSPLPLK

SEQ ID NO: 305174 - protein, 18 aa, Mycobacterium
EPGLRKLLNENLAAGRLR

SEQ ID NO: 305175 - protein, 21 aa, Mycobacterium
EPGLVLRGFVERVGDPAPLVA

SEQ ID NO: 305176 - protein, 20 aa, Mycobacterium
EPGQILVLLNVGAIFMGTAL

SEQ ID NO: 305177 - protein, 19 aa, Mycobacterium
EPGQILVLLNVGAVFMGTA

SEQ ID NO: 305178 - protein, 20 aa, Mycobacterium
EPGQILVMLNVGAIFMGTAL

SEQ ID NO: 305179 - protein, 23 aa, Mycobacterium
EPGQLRWPLGEIDKPFEMRRDVL

SEQ ID NO: 305180 - protein, 25 aa, Mycobacterium
EPGRSLWWSWAWIAGMIGYAGDVAR

SEQ ID NO: 305181 - protein, 21 aa, Mycobacterium
EPGSGRAALTFVIVALSASVA

SEQ ID NO: 305182 - protein, 37 aa, Mycobacterium
EPGVIYDIALWAVPFGLIGGRLYHVITDWPTYFGDGG

SEQ ID NO: 305183 - protein, 21 aa, Mycobacterium
EPGWRHRLAINLSAAILSTIV

SEQ ID NO: 305184 - protein, 20 aa, Mycobacterium
EPHCDSIPVCQSIRSIFDTL

SEQ ID NO: 305185 - protein, 17 aa, Mycobacterium
EPHVIPVHDFGSIDGVF

SEQ ID NO: 305186 - protein, 19 aa, Mycobacterium
EPIGPWGLLLRDLAHLLDT

SEQ ID NO: 305187 - protein, 20 aa, Mycobacterium
EPILGLPSDFVHKGGHTAYF

SEQ ID NO: 305188 - protein, 26 aa, Mycobacterium
EPILPIRLFASPVFAVCCVLSFVVGF

SEQ ID NO: 305189 - protein, 27 aa, Mycobacterium
EPILPPRLFRDPVFTICCVLSFVVGFA

SEQ ID NO: 305190 - protein, 17 aa, Mycobacterium
EPIRLGLVVLLLSRRRP

SEQ ID NO: 305191 - protein, 24 aa, Mycobacterium
EPIRPGMKASLIMLSACCLGFGVL

SEQ ID NO: 305192 - protein, 19 aa, Mycobacterium
EPITVIGVAFLLSSVLGVG

SEQ ID NO: 305193 - protein, 21 aa, Mycobacterium
EPKAATFLGGNGYSLATHSEL

SEQ ID NO: 305194 - protein, 36 aa, Mycobacterium
EPKPWYRKPATLIGWALLCLILIALIIYGITQLMGD

SEQ ID NO: 305195 - protein, 22 aa, Mycobacterium
EPKRLRKAKQPKASRGAQRPEP

SEQ ID NO: 305196 - protein, 24 aa, Mycobacterium
EPLARGGVFVFVFAGWIVSLCLHE

SEQ ID NO: 305197 - protein, 17 aa, Mycobacterium
EPLDVRAGKYYKELVAK

SEQ ID NO: 305198 - protein, 21 aa, Mycobacterium
EPLGFGMSVVRQLAHIVDAII

SEQ ID NO: 305199 - protein, 20 aa, Mycobacterium
EPLIPLRLFADRNFSLAGVG

SEQ ID NO: 305200 - protein, 17 aa, Mycobacterium
EPLLEILQILKAHNIGM

SEQ ID NO: 305201 - protein, 19 aa, Mycobacterium
EPLLIWTLIASLFIGNFLL

SEQ ID NO: 305202 - protein, 19 aa, Mycobacterium
EPLPTAVDLLGERRFELAL

SEQ ID NO: 305203 - protein, 18 aa, Mycobacterium
EPLRICLIAATLGYCLQR

SEQ ID NO: 305204 - protein, 22 aa, Mycobacterium
EPLTFLDCLYFSAVSLSTTGYG

SEQ ID NO: 305205 - protein, 19 aa, Mycobacterium
EPLVLAALLQLLSAVAQNC

SEQ ID NO: 305206 - protein, 28 aa, Mycobacterium
EPLVRKTAAWAWRLLVILFALLALLWVV

SEQ ID NO: 305207 - protein, 20 aa, Mycobacterium
EPMLEEFARIAAQVEAREPQ

SEQ ID NO: 305208 - protein, 17 aa, Mycobacterium
EPMVIDRGIPFQISAVA

SEQ ID NO: 305209 - protein, 17 aa, Mycobacterium
EPNAVPGPREWLVSALN

SEQ ID NO: 305210 - protein, 28 aa, Mycobacterium
EPNPEERPRLLLGFAMVALPILGLWHLF

SEQ ID NO: 305211 - protein, 19 aa, Mycobacterium
EPNPSWSRLFSTGREIKRY

SEQ ID NO: 305212 - protein, 23 aa, Mycobacterium
EPPAIVLRRRIVVGVVLLIGAAV

SEQ ID NO: 305213 - protein, 29 aa, Mycobacterium
EPPARYMCPPDCGAPPMGEPVAINPVFTA

SEQ ID NO: 305214 - protein, 21 aa, Mycobacterium
EPPCAGTWFGVHIPIPQTVVH

SEQ ID NO: 305215 - protein, 24 aa, Mycobacterium
EPPERLRTAVLGSVNPATGRRQSR

SEQ ID NO: 305216 - protein, 18 aa, Mycobacterium
EPPGPYPSARGRFDDDVT

SEQ ID NO: 305217 - protein, 17 aa, Mycobacterium
EPPKVVYFDSAKLPAGE

SEQ ID NO: 305218 - protein, 19 aa, Mycobacterium
EPPPARIVLMSDGKETVPS

SEQ ID NO: 305219 - protein, 23 aa, Mycobacterium
EPPPRRLRLLLSVAAVVLALDVV

SEQ ID NO: 305220 - protein, 21 aa, Mycobacterium
EPPRAGTPWGESGAQEPVRAS

SEQ ID NO: 305221 - protein, 24 aa, Mycobacterium
EPPRMADMRALFDAIINDDPLPEE

SEQ ID NO: 305222 - protein, 22 aa, Mycobacterium
EPPRMSDMRALFDAIINDDPLP

SEQ ID NO: 305223 - protein, 19 aa, Mycobacterium
EPPSAWSLLEWNPPTIPVL

SEQ ID NO: 305224 - protein, 19 aa, Mycobacterium
EPPYKIAGIALFLVGLLIL

SEQ ID NO: 305225 - protein, 23 aa, Mycobacterium
EPQAGHVISAYALGVVVGAPVIA

SEQ ID NO: 305226 - protein, 26 aa, Mycobacterium
EPQVVVRRGVAYAARLRPVRADSAIG

SEQ ID NO: 305227 - protein, 31 aa, Mycobacterium
EPRCVNRGRLTPAWRDYRTAWATNFGVVEVP

SEQ ID NO: 305228 - protein, 23 aa, Mycobacterium
EPRDNTPRIIAFVGTGVLAAAVG

SEQ ID NO: 305229 - protein, 25 aa, Mycobacterium
EPREALEGLKHWKLHTTVLAATYVL

SEQ ID NO: 305230 - protein, 34 aa, Mycobacterium
EPRPRKRRIGWSRLLVFGVLPISALLIAVATGFL

SEQ ID NO: 305231 - protein, 30 aa, Mycobacterium
EPRRRLLRITRWDVCLAMVFAGAVNMAMLL

SEQ ID NO: 305232 - protein, 22 aa, Mycobacterium
EPSDVEAAVFFDYLTKPKALDT

SEQ ID NO: 305233 - protein, 26 aa, Mycobacterium
EPSEALDFIGALLLSPGVAIFLGGVS

SEQ ID NO: 305234 - protein, 28 aa, Mycobacterium
EPSRHLMVLTGLALLIWVPAIRCPAGVA

SEQ ID NO: 305235 - protein, 24 aa, Mycobacterium
EPSTRLRKDLTWWDLTVFGVSVVI

SEQ ID NO: 305236 - protein, 22 aa, Mycobacterium
EPTELNLGLAIPVTAVLVASSF

SEQ ID NO: 305237 - protein, 31 aa, Mycobacterium
EPTFDIFLWEIFGPLSAGGRLVFPALGPGEW

SEQ ID NO: 305238 - protein, 33 aa, Mycobacterium
EPTFLAKWIRRLSIPIVIGWLAIVFALNTFVPQ

SEQ ID NO: 305239 - protein, 23 aa, Mycobacterium
EPTLHGCTGCVGDRIMVDKISYR

SEQ ID NO: 305240 - protein, 17 aa, Mycobacterium
EPTPLRRAGYAPGGGAA

SEQ ID NO: 305241 - protein, 30 aa, Mycobacterium
EPTPWYRKPPLLIAWLVFVAVLIGLIVYGI

SEQ ID NO: 305242 - protein, 18 aa, Mycobacterium
EPTREVAAILGLDEVYAD

SEQ ID NO: 305243 - protein, 22 aa, Mycobacterium
EPTREVATILGLDEVYADQSPA

SEQ ID NO: 305244 - protein, 23 aa, Mycobacterium
EPTRPLIPLAVSGFLTSRKKAAA

SEQ ID NO: 305245 - protein, 25 aa, Mycobacterium
EPTVGWRYVDLSAEWNCADKDEELQ

SEQ ID NO: 305246 - protein, 20 aa, Mycobacterium
EPTVRVTLVLGALGFAMFTM

SEQ ID NO: 305247 - protein, 22 aa, Mycobacterium
EPVATRPVSAWTPGAPARSTPR

SEQ ID NO: 305248 - protein, 23 aa, Mycobacterium
EPVAVVGMACRFPGGADSAAALW

SEQ ID NO: 305249 - protein, 21 aa, Mycobacterium
EPVAVVGMGCRYPGGIETPEG

SEQ ID NO: 305250 - protein, 17 aa, Mycobacterium
EPVKPLRLFLQSNNYLA

SEQ ID NO: 305251 - protein, 23 aa, Mycobacterium
EPVLAWGDSRIGNVLYEDFEPVA

SEQ ID NO: 305252 - protein, 26 aa, Mycobacterium
EPVLPIRLFASPVFTVCCVLSFIVGF

SEQ ID NO: 305253 - protein, 26 aa, Mycobacterium
EPVLPPRLFRSPVFTVCCVLAFVVGF

SEQ ID NO: 305254 - protein, 25 aa, Mycobacterium
EPVLTRSGAEWMPNFIELLQRKLSR

SEQ ID NO: 305255 - protein, 17 aa, Mycobacterium
EPVMARWIQPLSNAGIL

SEQ ID NO: 305256 - protein, 23 aa, Mycobacterium
EPVPAEAALGFDLTEAPTIARVL

SEQ ID NO: 305257 - protein, 25 aa, Mycobacterium
EPVPAPWPIVGLLPPGPRLSKEDAL

SEQ ID NO: 305258 - protein, 19 aa, Mycobacterium
EPVPTGWLRGFLHARKLDR

SEQ ID NO: 305259 - protein, 29 aa, Mycobacterium
EPVSPRKGRDYKSLVLIAVIVVAVALAAV

SEQ ID NO: 305260 - protein, 18 aa, Mycobacterium
EPVYRSVLIVYFVVMSCF

SEQ ID NO: 305261 - protein, 20 aa, Mycobacterium
EPYPQCFDWVQAAMREIVAD

SEQ ID NO: 305262 - protein, 18 aa, Mycobacterium
EQAGHPPVLVLLGGEAVS

SEQ ID NO: 305263 - protein, 25 aa, Mycobacterium
EQAHTRFDVLFARDIIDHSAQAVAL

SEQ ID NO: 305264 - protein, 17 aa, Mycobacterium
EQAKGTMLITVFVFLGI

SEQ ID NO: 305265 - protein, 67 aa, Mycobacterium
EQARSGIRFWSRRAWLAWPLGLLASGLTMFFGAYAWAGWLAFAATIPVQFIAGWPFLVGAVQQARAR

SEQ ID NO: 305266 - protein, 19 aa, Mycobacterium
EQGCVIPSLGRDDGGPDRF

SEQ ID NO: 305267 - protein, 17 aa, Mycobacterium
EQGMGSHGLILGTTGSG

SEQ ID NO: 305268 - protein, 19 aa, Mycobacterium
EQGRTAVFVGQGDRVVGVV

SEQ ID NO: 305269 - protein, 17 aa, Mycobacterium
EQGRTAVFVGRDDHVVG

SEQ ID NO: 305270 - protein, 20 aa, Mycobacterium
EQGRTAVFVGRGDRVVGVLA

SEQ ID NO: 305271 - protein, 23 aa, Mycobacterium
EQHCYNIPVCWATRSVFEAIDGV

SEQ ID NO: 305272 - protein, 26 aa, Mycobacterium
EQIAEHLRIPFDQSHKVFMQYDGYRD

SEQ ID NO: 305273 - protein, 17 aa, Mycobacterium
EQILPKVMTTFGLTAAY

SEQ ID NO: 305274 - protein, 17 aa, Mycobacterium
EQILTPLQWVSTARPLA

SEQ ID NO: 305275 - protein, 19 aa, Mycobacterium
EQIMPLLVVAIMSQLVFSG

SEQ ID NO: 305276 - protein, 20 aa, Mycobacterium
EQIMPLLVVAIMSQLVFSGG

SEQ ID NO: 305277 - protein, 21 aa, Mycobacterium
EQIMPLLVVAVMSQLVFSGGM

SEQ ID NO: 305278 - protein, 22 aa, Mycobacterium
EQLFRAVSWLPADGRGRLLTVP

SEQ ID NO: 305279 - protein, 19 aa, Mycobacterium
EQLIAEPLDRFLGDLEEAL

SEQ ID NO: 305280 - protein, 29 aa, Mycobacterium
EQLPGPAWLRRLWLAVIIVAPASLWLEPI

SEQ ID NO: 305281 - protein, 17 aa, Mycobacterium
EQLRPGDVIEVRTHEVV

SEQ ID NO: 305282 - protein, 17 aa, Mycobacterium
EQLWSAIGLVPQRGYLF

SEQ ID NO: 305283 - protein, 24 aa, Mycobacterium
EQLWTRPELYGWVFCGAAGMIFHQ

SEQ ID NO: 305284 - protein, 31 aa, Mycobacterium
EQMRKRFGDTMGYRLVIYPTYAALDRPDPSD

SEQ ID NO: 305285 - protein, 34 aa, Mycobacterium
EQPSAGFRWPRALQASATRRGLLLTALGGLLIAG

SEQ ID NO: 305286 - protein, 21 aa, Mycobacterium
EQQLAFGRLRAVEHDRYVVVA

SEQ ID NO: 305287 - protein, 24 aa, Mycobacterium
EQQPRAWRMRISVQEIDGDAKVSN

SEQ ID NO: 305288 - protein, 21 aa, Mycobacterium
EQQPRPAPRPEPRETRQEPRP

SEQ ID NO: 305289 - protein, 23 aa, Mycobacterium
EQRAEFRAANGFDQSVGAQLLDY

SEQ ID NO: 305290 - protein, 20 aa, Mycobacterium
EQRDILALLMCARGDDGEWL

SEQ ID NO: 305291 - protein, 23 aa, Mycobacterium
EQRKWLRRVWLAAPLGLVSMAAP

SEQ ID NO: 305292 - protein, 36 aa, Mycobacterium
EQRLLRGSVVCFGTFSALAGMLGWLGHASPDPGDRL

SEQ ID NO: 305293 - protein, 21 aa, Mycobacterium
EQRPRLWRMRIDVQRVGDVAK

SEQ ID NO: 305294 - protein, 24 aa, Mycobacterium
EQRSRKSVLAVVAATLVFVGGVVA

SEQ ID NO: 305295 - protein, 25 aa, Mycobacterium
EQRTRLTEILSRIYGTPVSVQLDVD

SEQ ID NO: 305296 - protein, 25 aa, Mycobacterium
EQSALRRHFDWVRSWYDFAAPDIGR

SEQ ID NO: 305297 - protein, 27 aa, Mycobacterium
EQSLLRLGRLMTLVWAVLMAVFACGFS

SEQ ID NO: 305298 - protein, 27 aa, Mycobacterium
EQTPRGKYWWVRWVILGMVAIVLAVEV

SEQ ID NO: 305299 - protein, 20 aa, Mycobacterium
EQTRGVLFWLLGSLAGVAWS

SEQ ID NO: 305300 - protein, 33 aa, Mycobacterium
EQTRKRFGDTMGYRLVIYPTYAVLDRKDPADDR

SEQ ID NO: 305301 - protein, 28 aa, Mycobacterium
EQTRKRFGDTMGYRMVIYPEYAVLDRKD

SEQ ID NO: 305302 - protein, 33 aa, Mycobacterium
EQTRKRFGDTVGYRLVIYPTYAVLDRPDPSDDR

SEQ ID NO: 305303 - protein, 26 aa, Mycobacterium
EQVHDFGWRIGFAIGGVAAIVVFWLR

SEQ ID NO: 305304 - protein, 22 aa, Mycobacterium
EQWSTLPRVAKWAVGVIGFGLL

SEQ ID NO: 305305 - protein, 29 aa, Mycobacterium
ERAARAPIMARFHGMWSVGTLVGAVIGAA

SEQ ID NO: 305306 - protein, 19 aa, Mycobacterium
ERACAVAFGGWLVVVWLLF

SEQ ID NO: 305307 - protein, 19 aa, Mycobacterium
ERAEGLAGTGSRFGAVSAQ

SEQ ID NO: 305308 - protein, 19 aa, Mycobacterium
ERAGQLGIEVVVFGGEALE

SEQ ID NO: 305309 - protein, 24 aa, Mycobacterium
ERAIYRLIGVDSRSEQTWGAYARS

SEQ ID NO: 305310 - protein, 20 aa, Mycobacterium
ERAPLRLDRAVLRAQLVMGR

SEQ ID NO: 305311 - protein, 25 aa, Mycobacterium
ERASWTPVAPLVFWMALAGLTPTGL

SEQ ID NO: 305312 - protein, 21 aa, Mycobacterium
ERATGRFSLIQAISAGLVGAS

SEQ ID NO: 305313 - protein, 21 aa, Mycobacterium
ERCPEAVVAMLAVLKTGAAYL

SEQ ID NO: 305314 - protein, 24 aa, Mycobacterium
ERDAGLLSRLWVVPVHRAAGLLAR

SEQ ID NO: 305315 - protein, 20 aa, Mycobacterium
ERDDRLLGAIAVRDELRPEA

SEQ ID NO: 305316 - protein, 23 aa, Mycobacterium
ERDRLRDLFGRHVGADVAQRAIN

SEQ ID NO: 305317 - protein, 23 aa, Mycobacterium
ERDRLRDLFGRHVGADVAQRAVE

SEQ ID NO: 305318 - protein, 23 aa, Mycobacterium
ERDSPQWSPRWVDHLVGDRIHRE

SEQ ID NO: 305319 - protein, 18 aa, Mycobacterium
ERDSPTWSPRFIDHLVGD

SEQ ID NO: 305320 - protein, 21 aa, Mycobacterium
ERDSPTWSPRFVDHMVGDRIH

SEQ ID NO: 305321 - protein, 22 aa, Mycobacterium
ERELKVPAATAFTSIAGHGVRA

SEQ ID NO: 305322 - protein, 21 aa, Mycobacterium
ERFAQMRAMGIRTVMVTGDNP

SEQ ID NO: 305323 - protein, 17 aa, Mycobacterium
ERFARSMARYRAHGSTS

SEQ ID NO: 305324 - protein, 17 aa, Mycobacterium
ERFASRTRDEWAAVFAG

SEQ ID NO: 305325 - protein, 23 aa, Mycobacterium
ERFDRLRLAVLVPADAPADQRVP

SEQ ID NO: 305326 - protein, 25 aa, Mycobacterium
ERFGEEFRIGIGINTGVVIAGTIGG

SEQ ID NO: 305327 - protein, 23 aa, Mycobacterium
ERFGRGWAWLSAFTLFASAIGAL

SEQ ID NO: 305328 - protein, 27 aa, Mycobacterium
ERFPYQSGAFFSDFMAWILRPLGATAN

SEQ ID NO: 305329 - protein, 17 aa, Mycobacterium
ERFRHLMESYDLTGNED

SEQ ID NO: 305330 - protein, 27 aa, Mycobacterium
ERGAGLPRWRYLVLPVIGAAVDIYLLA

SEQ ID NO: 305331 - protein, 26 aa, Mycobacterium
ERGEFEGRLWIAMDYIDGISAAQLMR

SEQ ID NO: 305332 - protein, 25 aa, Mycobacterium
ERGEPWPQPMPEPAFKQAIAQATQA

SEQ ID NO: 305333 - protein, 20 aa, Mycobacterium
ERGIGNGMSLLIFAGIAARI

SEQ ID NO: 305334 - protein, 18 aa, Mycobacterium
ERGLEIPAAASFTNVAGH

SEQ ID NO: 305335 - protein, 18 aa, Mycobacterium
ERGLEIPSATGFANLAGH

SEQ ID NO: 305336 - protein, 23 aa, Mycobacterium
ERGRSVSLLLERVSSVSRQVEGF

SEQ ID NO: 305337 - protein, 17 aa, Mycobacterium
ERGVIYDIALWMVPFGL

SEQ ID NO: 305338 - protein, 17 aa, Mycobacterium
ERHAAEMIAALACRNAC

SEQ ID NO: 305339 - protein, 17 aa, Mycobacterium
ERHARDMIGALAGRGEC

SEQ ID NO: 305340 - protein, 17 aa, Mycobacterium
ERHFARGSVEIRTAAAE

SEQ ID NO: 305341 - protein, 18 aa, Mycobacterium
ERHFPRGTLPAAMDDTLV

SEQ ID NO: 305342 - protein, 24 aa, Mycobacterium
ERHLAIPVGFGIIFAIGGMIAVNN

SEQ ID NO: 305343 - protein, 18 aa, Mycobacterium
ERHPAWRLLRAGNATLIL

SEQ ID NO: 305344 - protein, 25 aa, Mycobacterium
ERHQTLRHAVQWSYDLLEDDEKTVL

SEQ ID NO: 305345 - protein, 30 aa, Mycobacterium
ERHTLGLIFVCCYIALVATNFAWLFPVLTG

SEQ ID NO: 305346 - protein, 23 aa, Mycobacterium
ERIDRGAGCERLDITSNLDGTYA

SEQ ID NO: 305347 - protein, 22 aa, Mycobacterium
ERIESWCKVWSAGVSASPLGKN

SEQ ID NO: 305348 - protein, 25 aa, Mycobacterium
ERIFDPKVFVVSFVFNVLVAALIVY

SEQ ID NO: 305349 - protein, 44 aa, Mycobacterium
ERISRVRGYLRTGAFTVVTIFAVFGFAAAVKVFFTASHPDEGDV

SEQ ID NO: 305350 - protein, 24 aa, Mycobacterium
ERKPVERPAHRWLVVRPDGPPPQP

SEQ ID NO: 305351 - protein, 18 aa, Mycobacterium
ERKPVERPAHRWVVVSDG

SEQ ID NO: 305352 - protein, 23 aa, Mycobacterium
ERKPVQRPAHRWLVMGQDDQPGR

SEQ ID NO: 305353 - protein, 25 aa, Mycobacterium
ERKRKVPGWLAPAAVVAALLILALV

SEQ ID NO: 305354 - protein, 27 aa, Mycobacterium
ERKYRFRKRVLALFALILVASAAAAFL

SEQ ID NO: 305355 - protein, 19 aa, Mycobacterium
ERLAISVSRRSWWQERLML

SEQ ID NO: 305356 - protein, 19 aa, Mycobacterium
ERLALAIAFLVGIASVFVI

SEQ ID NO: 305357 - protein, 25 aa, Mycobacterium
ERLARYEIPTEIAIVDAIPRTPSGK

SEQ ID NO: 305358 - protein, 17 aa, Mycobacterium
ERLATLARFTLRHKALV

SEQ ID NO: 305359 - protein, 17 aa, Mycobacterium
ERLCDRCLEGFPPTGAA

SEQ ID NO: 305360 - protein, 26 aa, Mycobacterium
ERLDRRLDEAAGFVIPFLPRGLDEIP

SEQ ID NO: 305361 - protein, 19 aa, Mycobacterium
ERLDVFAAIARSFALVKTG

SEQ ID NO: 305362 - protein, 17 aa, Mycobacterium
ERLELARVIALPVRTEL

SEQ ID NO: 305363 - protein, 27 aa, Mycobacterium
ERLFNRWGVRAVFFGRFIALLRILAGP

SEQ ID NO: 305364 - protein, 26 aa, Mycobacterium
ERLGDFWGYLAGWGFVVGKTASCAAM

SEQ ID NO: 305365 - protein, 17 aa, Mycobacterium
ERLGFVMPGDIPFQVQL

SEQ ID NO: 305366 - protein, 27 aa, Mycobacterium
ERLGFVMPGEVPFQVQLPNTPVDVKPQ

SEQ ID NO: 305367 - protein, 23 aa, Mycobacterium
ERLGKFHFWLTFIGFHATFLVQH

SEQ ID NO: 305368 - protein, 23 aa, Mycobacterium
ERLGKFHFWLTFIGFHSTFLVQH

SEQ ID NO: 305369 - protein, 23 aa, Mycobacterium
ERLGKLHFWLTFAGFHTTFLVQH

SEQ ID NO: 305370 - protein, 23 aa, Mycobacterium
ERLKSWRRGLIFTMFVFAAVFTP

SEQ ID NO: 305371 - protein, 18 aa, Mycobacterium
ERLPAWFVLIQVYLDALW

SEQ ID NO: 305372 - protein, 25 aa, Mycobacterium
ERLPDDRLLLWAGIVTAISMQTKFL

SEQ ID NO: 305373 - protein, 24 aa, Mycobacterium
ERLRKRPLANFVYRSVIGVVGTVV

SEQ ID NO: 305374 - protein, 20 aa, Mycobacterium
ERLRSWRRGLIFAMFVFAAV

SEQ ID NO: 305375 - protein, 23 aa, Mycobacterium
ERLSAWRRGLIFGLFVFAAFATP

SEQ ID NO: 305376 - protein, 18 aa, Mycobacterium
ERLSVLIAVVLGVLMVCA

SEQ ID NO: 305377 - protein, 17 aa, Mycobacterium
ERLSWPSTLGLGAQHVV

SEQ ID NO: 305378 - protein, 18 aa, Mycobacterium
ERLVRRVALASGIGSMLE

SEQ ID NO: 305379 - protein, 17 aa, Mycobacterium
ERMPFTLALSGAALLTA

SEQ ID NO: 305380 - protein, 18 aa, Mycobacterium
ERMPLLGKIAVWLTGAAW

SEQ ID NO: 305381 - protein, 18 aa, Mycobacterium
ERPFELLGAPAAVTHTVA

SEQ ID NO: 305382 - protein, 17 aa, Mycobacterium
ERPGHRYTYTNNWPAEP

SEQ ID NO: 305383 - protein, 20 aa, Mycobacterium
ERPLIARKIHAFAVPIVLGW

SEQ ID NO: 305384 - protein, 23 aa, Mycobacterium
ERPVLRISGGRIERWQNGTWASN

SEQ ID NO: 305385 - protein, 23 aa, Mycobacterium
ERQLLACGLAVLVVAGLISTVLL

SEQ ID NO: 305386 - protein, 17 aa, Mycobacterium
ERQLLVLAAGWLAIPTA

SEQ ID NO: 305387 - protein, 17 aa, Mycobacterium
ERQMVFERFSRGSTASH

SEQ ID NO: 305388 - protein, 19 aa, Mycobacterium
ERQVRRWGSQWDLVRLPDD

SEQ ID NO: 305389 - protein, 19 aa, Mycobacterium
ERQVRRWGSQWDLVRLPED

SEQ ID NO: 305390 - protein, 23 aa, Mycobacterium
ERQWRARMAGLRTNALVATGATL

SEQ ID NO: 305391 - protein, 24 aa, Mycobacterium
ERRADIANLTRRFIIGTVLTTPVL

SEQ ID NO: 305392 - protein, 24 aa, Mycobacterium
ERRAKQAKTRRIVLIAAGSIVAVA

SEQ ID NO: 305393 - protein, 19 aa, Mycobacterium
ERRAQPGARARLFGMTEAF

SEQ ID NO: 305394 - protein, 20 aa, Mycobacterium
ERREPVPLPTVVSAAVSEVE

SEQ ID NO: 305395 - protein, 23 aa, Mycobacterium
ERRGKPSMLFPLWFMSNANLTTL

SEQ ID NO: 305396 - protein, 19 aa, Mycobacterium
ERRILSYTYRGGWGDPTGS

SEQ ID NO: 305397 - protein, 22 aa, Mycobacterium
ERRLGPEGTDMFFGVVNATAAA

SEQ ID NO: 305398 - protein, 18 aa, Mycobacterium
ERRPRWIVGGATILTFVG

SEQ ID NO: 305399 - protein, 20 aa, Mycobacterium
ERRPTLPISEEIGSAKAVLH

SEQ ID NO: 305400 - protein, 26 aa, Mycobacterium
ERRPWRRLRISQLIIGMSAVVAMTAV

SEQ ID NO: 305401 - protein, 18 aa, Mycobacterium
ERRRELWTDPAILGQTLR

SEQ ID NO: 305402 - protein, 19 aa, Mycobacterium
ERRTEWPLAGTAVLFLAAY

SEQ ID NO: 305403 - protein, 19 aa, Mycobacterium
ERRTLGLIAVCCYVALVLT

SEQ ID NO: 305404 - protein, 19 aa, Mycobacterium
ERRTRQAVEVASRGASFVF

SEQ ID NO: 305405 - protein, 26 aa, Mycobacterium
ERRTWLRRVLLAFPLGLVAMASTMFF

SEQ ID NO: 305406 - protein, 23 aa, Mycobacterium
ERRYLRMRLSALGIYTTDAHANF

SEQ ID NO: 305407 - protein, 23 aa, Mycobacterium
ERSARLRLFTGFVGANLLLNAAV

SEQ ID NO: 305408 - protein, 20 aa, Mycobacterium
ERSGRVCAMVGDGSNDAAAI

SEQ ID NO: 305409 - protein, 27 aa, Mycobacterium
ERSHFDILRHLYLPALTTFVFAGVRYG

SEQ ID NO: 305410 - protein, 24 aa, Mycobacterium
ERSPVPFARDHWVLAPAPAEIDFV

SEQ ID NO: 305411 - protein, 18 aa, Mycobacterium
ERSRPSIYVLEDAPWSAF

SEQ ID NO: 305412 - protein, 18 aa, Mycobacterium
ERSRRWRALTGFVGANLL

SEQ ID NO: 305413 - protein, 18 aa, Mycobacterium
ERSVLKSRLDSVMDNYRG

SEQ ID NO: 305414 - protein, 20 aa, Mycobacterium
ERTALAWRRTGLTAAGTAAV

SEQ ID NO: 305415 - protein, 19 aa, Mycobacterium
ERTELVFAGLAGSLLLTGW

SEQ ID NO: 305416 - protein, 24 aa, Mycobacterium
ERTGELPAVEGFANIEGLGVQGTV

SEQ ID NO: 305417 - protein, 24 aa, Mycobacterium
ERTIPRAIVLIALIGGAIFVTVAY

SEQ ID NO: 305418 - protein, 23 aa, Mycobacterium
ERTRLAWRRSLLALVAVLALVGR

SEQ ID NO: 305419 - protein, 17 aa, Mycobacterium
ERTRVRAFIPLFVANAV

SEQ ID NO: 305420 - protein, 25 aa, Mycobacterium
ERTSGLLSRLWVLPVHRMSGLMARI

SEQ ID NO: 305421 - protein, 20 aa, Mycobacterium
ERVANLFLAKTVYSALLALL

SEQ ID NO: 305422 - protein, 24 aa, Mycobacterium
ERVAPCLPGATLLSTEGDTFHGSV

SEQ ID NO: 305423 - protein, 19 aa, Mycobacterium
ERVGRVCAMVGDGSNDAAA

SEQ ID NO: 305424 - protein, 27 aa, Mycobacterium
ERVKPPRLYKAAAWVVIVAGIVFIIAT

SEQ ID NO: 305425 - protein, 21 aa, Mycobacterium
ERVLMRPGMTFTRHLVELDDE

SEQ ID NO: 305426 - protein, 30 aa, Mycobacterium
ERVLRLPLRGTVPTVLPFLVGHPDNVAVDT

SEQ ID NO: 305427 - protein, 19 aa, Mycobacterium
ERVNMVFVLAVSQLVQIMV

SEQ ID NO: 305428 - protein, 21 aa, Mycobacterium
ERVRAGISYVMVSMVSSLVFL

SEQ ID NO: 305429 - protein, 21 aa, Mycobacterium
ERVSNLFLTKTVYSVLLALTV

SEQ ID NO: 305430 - protein, 21 aa, Mycobacterium
ERVYKPYPYIVAIVDELADLM

SEQ ID NO: 305431 - protein, 25 aa, Mycobacterium
ERYARFGWAAARLDDAANYVAARVT

SEQ ID NO: 305432 - protein, 17 aa, Mycobacterium
ERYDRVGGRASTIDVDG

SEQ ID NO: 305433 - protein, 23 aa, Mycobacterium
ERYMTISAIAAMIFDLTVTAGVY

SEQ ID NO: 305434 - protein, 24 aa, Mycobacterium
ERYMTISAIAAMVFDLTVTAGVYA

SEQ ID NO: 305435 - protein, 20 aa, Mycobacterium
ERYMTLAAIAAMFFDLTVTA

SEQ ID NO: 305436 - protein, 20 aa, Mycobacterium
ERYPTCSDFAAALAGQHPLA

SEQ ID NO: 305437 - protein, 19 aa, Mycobacterium
ESAAWPAGVPWADASLTSA

SEQ ID NO: 305438 - protein, 22 aa, Mycobacterium
ESADGKAAYVLINLKGNMGTAL

SEQ ID NO: 305439 - protein, 23 aa, Mycobacterium
ESADRLIELALRGGGPDNVTVVV

SEQ ID NO: 305440 - protein, 25 aa, Mycobacterium
ESAEEAIQFLVEVAVARRGEIVAQV

SEQ ID NO: 305441 - protein, 25 aa, Mycobacterium
ESAELCAQYLAPILDSIKFNYLPFG

SEQ ID NO: 305442 - protein, 25 aa, Mycobacterium
ESAELCAQYLAPVLDAIKFNYFPFG

SEQ ID NO: 305443 - protein, 25 aa, Mycobacterium
ESAELCAQYLGPILDAIKFNYLPFG

SEQ ID NO: 305444 - protein, 21 aa, Mycobacterium
ESAKKWAIWSAAIGVVVGIIY

SEQ ID NO: 305445 - protein, 24 aa, Mycobacterium
ESALKYFLLGAFSSAFFLYGVALL

SEQ ID NO: 305446 - protein, 20 aa, Mycobacterium
ESALPRLIAKMEHAGVKPAT

SEQ ID NO: 305447 - protein, 21 aa, Mycobacterium
ESALPRLIAKMEHLGVDRSTV

SEQ ID NO: 305448 - protein, 23 aa, Mycobacterium
ESALRPGLVVLVAFDPADREALS

SEQ ID NO: 305449 - protein, 18 aa, Mycobacterium
ESARFGAPTLLTRSTNDV

SEQ ID NO: 305450 - protein, 18 aa, Mycobacterium
ESASPLLHYWPLAVEEQF

SEQ ID NO: 305451 - protein, 21 aa, Mycobacterium
ESAWDTVMWALRTVFGGAAVP

SEQ ID NO: 305452 - protein, 28 aa, Mycobacterium
ESDARIAGIGAFVFAWLAMVGLIGGGYA

SEQ ID NO: 305453 - protein, 17 aa, Mycobacterium
ESDEVRLTDVFVDDQLT

SEQ ID NO: 305454 - protein, 27 aa, Mycobacterium
ESDLFKRIVAILTWVWVGAFAGMTVSS

SEQ ID NO: 305455 - protein, 19 aa, Mycobacterium
ESDPAIGFNYLGRLGSPAA

SEQ ID NO: 305456 - protein, 22 aa, Mycobacterium
ESDPLSFLDCFYYATVSLSTTG

SEQ ID NO: 305457 - protein, 27 aa, Mycobacterium
ESEAFPDLEVCVYAAPTQTVIGGPPEQ

SEQ ID NO: 305458 - protein, 17 aa, Mycobacterium
ESEAVRGPARWTSLQKI

SEQ ID NO: 305459 - protein, 24 aa, Mycobacterium
ESEDLLKRWKRGVMSTVGDVTAKN

SEQ ID NO: 305460 - protein, 17 aa, Mycobacterium
ESEHFFVAPALMLGLLT

SEQ ID NO: 305461 - protein, 18 aa, Mycobacterium
ESELALAVEEFGAQDTAA

SEQ ID NO: 305462 - protein, 19 aa, Mycobacterium
ESERAHWTLGRHVKLRGHK

SEQ ID NO: 305463 - protein, 22 aa, Mycobacterium
ESETLVRRAFRIASKASAELMV

SEQ ID NO: 305464 - protein, 22 aa, Mycobacterium
ESETLVRRAFRIASKSSAELMV

SEQ ID NO: 305465 - protein, 23 aa, Mycobacterium
ESETRWSIRGMAAPAAWADADEV

SEQ ID NO: 305466 - protein, 17 aa, Mycobacterium
ESFDVLGMLLLSPGLAT

SEQ ID NO: 305467 - protein, 24 aa, Mycobacterium
ESGALYVRVGDTWHPVLNLASARL

SEQ ID NO: 305468 - protein, 19 aa, Mycobacterium
ESGDWLYFVTIDAEGTTLF

SEQ ID NO: 305469 - protein, 20 aa, Mycobacterium
ESGGRLFLMTEGWTIRDGSI

SEQ ID NO: 305470 - protein, 17 aa, Mycobacterium
ESGKSWGQFLMGRATRL

SEQ ID NO: 305471 - protein, 24 aa, Mycobacterium
ESGRSTTGLAKWSVVIDAPPASKK

SEQ ID NO: 305472 - protein, 17 aa, Mycobacterium
ESGSRWVATTIKEGQQW

SEQ ID NO: 305473 - protein, 25 aa, Mycobacterium
ESHSPRLVNMYGITETCVHVSHRAL

SEQ ID NO: 305474 - protein, 22 aa, Mycobacterium
ESICVADPLAFTGCGRSARGPE

SEQ ID NO: 305475 - protein, 24 aa, Mycobacterium
ESIELAKLGEIFWINPVNLVPLLF

SEQ ID NO: 305476 - protein, 17 aa, Mycobacterium
ESIKIAQQCVDRLRPGP

SEQ ID NO: 305477 - protein, 19 aa, Mycobacterium
ESILIRGLIQYAFSVPNGS

SEQ ID NO: 305478 - protein, 23 aa, Mycobacterium
ESIPRSDLWWGALSGFGTAVGMA

SEQ ID NO: 305479 - protein, 18 aa, Mycobacterium
ESKGMVLFWIVWGGAIAG

SEQ ID NO: 305480 - protein, 29 aa, Mycobacterium
ESKIASWSEPKGGYFISLDVLDGTAKRTV

SEQ ID NO: 305481 - protein, 26 aa, Mycobacterium
ESKQLKSRFDAIIANFWQLVYRSMGF

SEQ ID NO: 305482 - protein, 20 aa, Mycobacterium
ESKRRMGVMLATGLIVGESL

SEQ ID NO: 305483 - protein, 22 aa, Mycobacterium
ESKSRVALYLLITIAPFAVIAP

SEQ ID NO: 305484 - protein, 22 aa, Mycobacterium
ESLDGPNAIAIVYTNTTTTSPL

SEQ ID NO: 305485 - protein, 22 aa, Mycobacterium
ESLDGPNAVAIVYTNTTTTSPL

SEQ ID NO: 305486 - protein, 18 aa, Mycobacterium
ESLGSFAGQGAFGGLGDI

SEQ ID NO: 305487 - protein, 19 aa, Mycobacterium
ESLKNWAIHSRFHISEDQI

SEQ ID NO: 305488 - protein, 21 aa, Mycobacterium
ESLLPPGFSDPTQWGLVQAGS

SEQ ID NO: 305489 - protein, 25 aa, Mycobacterium
ESLLRQWSELAGWLRDERKDLRDAD

SEQ ID NO: 305490 - protein, 25 aa, Mycobacterium
ESLLSRHFAWRVLLVSVLMAGGALG

SEQ ID NO: 305491 - protein, 17 aa, Mycobacterium
ESLRAVPHRSPRRPWLE

SEQ ID NO: 305492 - protein, 23 aa, Mycobacterium
ESLTWTSPRTRAVFGLTAEEAEA

SEQ ID NO: 305493 - protein, 21 aa, Mycobacterium
ESMAARLQRAQSWAIGSDPGL

SEQ ID NO: 305494 - protein, 22 aa, Mycobacterium
ESNRLNKAAAWVGIAAGAVFIV

SEQ ID NO: 305495 - protein, 21 aa, Mycobacterium
ESPAPSGIRYATADIDLGDGL

SEQ ID NO: 305496 - protein, 24 aa, Mycobacterium
ESPDWSWLKWLPHIDIPGELDGVG

SEQ ID NO: 305497 - protein, 20 aa, Mycobacterium
ESPIMVSVFAFIKMMSGGLF

SEQ ID NO: 305498 - protein, 23 aa, Mycobacterium
ESPIPRWLRFVLASDRAGSAWYI

SEQ ID NO: 305499 - protein, 23 aa, Mycobacterium
ESPIPRWLRFVLASDRAGSAWYV

SEQ ID NO: 305500 - protein, 30 aa, Mycobacterium
ESPKPAPSKVRLAIVVGLAAVVAMAALASW

SEQ ID NO: 305501 - protein, 19 aa, Mycobacterium
ESPRYLARRGEYESAAAVL

SEQ ID NO: 305502 - protein, 23 aa, Mycobacterium
ESPSLFRGGHRGLADWRGGHRSE

SEQ ID NO: 305503 - protein, 19 aa, Mycobacterium
ESPWHLHLFPGVKGAPQVP

SEQ ID NO: 305504 - protein, 32 aa, Mycobacterium
ESQAVAALMRAAGRPGAALVMDGATATLSVPG

SEQ ID NO: 305505 - protein, 24 aa, Mycobacterium
ESRIKCLWLTFFGVAVLLTGTLVY

SEQ ID NO: 305506 - protein, 21 aa, Mycobacterium
ESRKWLRDMFADVRMLAHDTG

SEQ ID NO: 305507 - protein, 22 aa, Mycobacterium
ESRKWLRDMFADVRMLAYDTGL

SEQ ID NO: 305508 - protein, 19 aa, Mycobacterium
ESRLLRIGSPMFHFGILVV

SEQ ID NO: 305509 - protein, 20 aa, Mycobacterium
ESRLMVVLGAGFGLGVAMTL

SEQ ID NO: 305510 - protein, 22 aa, Mycobacterium
ESRLSWVLAVLAGILGATAFTH

SEQ ID NO: 305511 - protein, 17 aa, Mycobacterium
ESSGLVPPIDQWSGSTF

SEQ ID NO: 305512 - protein, 19 aa, Mycobacterium
ESSLPQILLGVAAAAGLIA

SEQ ID NO: 305513 - protein, 17 aa, Mycobacterium
ESSRAALALSLKTAAAS

SEQ ID NO: 305514 - protein, 17 aa, Mycobacterium
ESSRAALLLSLKTSAAA

SEQ ID NO: 305515 - protein, 31 aa, Mycobacterium
ESSSAFLQWGWRVPFLLSALLIAFALYVRLE

SEQ ID NO: 305516 - protein, 31 aa, Mycobacterium
ESSTGLFCDLGWFGVWAILDAVVPRGSAASA

SEQ ID NO: 305517 - protein, 21 aa, Mycobacterium
ESTAALLACRVLDAYEDLMDP

SEQ ID NO: 305518 - protein, 23 aa, Mycobacterium
ESTDIIKRWKRGVMSTVGDVTAR

SEQ ID NO: 305519 - protein, 22 aa, Mycobacterium
ESTDILQRWTRGVMSTVGEVPA

SEQ ID NO: 305520 - protein, 22 aa, Mycobacterium
ESTEILHRWKRGVMSTVGDVPA

SEQ ID NO: 305521 - protein, 18 aa, Mycobacterium
ESTESGWIGKLLAVAGVA

SEQ ID NO: 305522 - protein, 18 aa, Mycobacterium
ESTLKFLCPAPGYDRHFA

SEQ ID NO: 305523 - protein, 29 aa, Mycobacterium
ESTTRWHTARAVLALPFTVAVLVPLVILY

SEQ ID NO: 305524 - protein, 17 aa, Mycobacterium
ESVAPKRPSTWRHVPAI

SEQ ID NO: 305525 - protein, 19 aa, Mycobacterium
ESVDLSRLAVDAVNDAHVA

SEQ ID NO: 305526 - protein, 18 aa, Mycobacterium
ESVDRVVLFFTFACALGV

SEQ ID NO: 305527 - protein, 21 aa, Mycobacterium
ESVPRLAVPTVGIFLAALTAF

SEQ ID NO: 305528 - protein, 22 aa, Mycobacterium
ESVRAGALMELYYTAQLKKNKK

SEQ ID NO: 305529 - protein, 22 aa, Mycobacterium
ESVVATSIYSRLNCAIVNAQGQ

SEQ ID NO: 305530 - protein, 20 aa, Mycobacterium
ESVWHPGLVAALIGGGLGLV

SEQ ID NO: 305531 - protein, 19 aa, Mycobacterium
ESWAKLRTAGEFIAALDKL

SEQ ID NO: 305532 - protein, 20 aa, Mycobacterium
ESWYRRYLAVQLLFGSVVLG

SEQ ID NO: 305533 - protein, 20 aa, Mycobacterium
ESYGSVASMLFQVEQHPKSI

SEQ ID NO: 305534 - protein, 30 aa, Mycobacterium
ESYSLLPSLSWFWPGGMDFGTVIAPAVLTT

SEQ ID NO: 305535 - protein, 22 aa, Mycobacterium
ESYSLPSRRLLGFLASGIDASL

SEQ ID NO: 305536 - protein, 24 aa, Mycobacterium
ESYSLPVRRLVGFAAAGLDASLIP

SEQ ID NO: 305537 - protein, 23 aa, Mycobacterium
ESYTASYLRFVWTVAATSMVVCY

SEQ ID NO: 305538 - protein, 23 aa, Mycobacterium
ESYTSTYLRFVWTLSATAVVVCY

SEQ ID NO: 305539 - protein, 23 aa, Mycobacterium
ESYTSTYLRFVWTLSATAVVVSY

SEQ ID NO: 305540 - protein, 22 aa, Mycobacterium
ESYTSTYLRFVWTMSATAVVLC

SEQ ID NO: 305541 - protein, 22 aa, Mycobacterium
ESYTSTYLRFVWTMSATAVVVC

SEQ ID NO: 305542 - protein, 20 aa, Mycobacterium
ESYWPSFALTGLLLCGQVAY

SEQ ID NO: 305543 - protein, 23 aa, Mycobacterium
ETAARCFDGFTGYELLEPAHDGG

SEQ ID NO: 305544 - protein, 19 aa, Mycobacterium
ETAEVFVILNAIRAARITA

SEQ ID NO: 305545 - protein, 20 aa, Mycobacterium
ETAHWFKTFLAPLLGGTGML

SEQ ID NO: 305546 - protein, 20 aa, Mycobacterium
ETAKGYGAVVYWIAGGCGAL

SEQ ID NO: 305547 - protein, 21 aa, Mycobacterium
ETARPADLLVLLDSLQQREAS

SEQ ID NO: 305548 - protein, 17 aa, Mycobacterium
ETAYCLGVEKLLGVTDD

SEQ ID NO: 305549 - protein, 23 aa, Mycobacterium
ETCRVIPVIITFGIGVAVLGALQ

SEQ ID NO: 305550 - protein, 26 aa, Mycobacterium
ETDAKRIPVPLARAIVDCGVYVDGVR

SEQ ID NO: 305551 - protein, 22 aa, Mycobacterium
ETDELYRAGSYPEGDYNWTGWP

SEQ ID NO: 305552 - protein, 19 aa, Mycobacterium
ETDLAALVRSAATQVLSDA

SEQ ID NO: 305553 - protein, 17 aa, Mycobacterium
ETDPVIIVGPFVLFDML

SEQ ID NO: 305554 - protein, 26 aa, Mycobacterium
ETDRAMFKQAVWKRVAVLFAGPAANF

SEQ ID NO: 305555 - protein, 18 aa, Mycobacterium
ETDVDFCVRVTAEIGSLV

SEQ ID NO: 305556 - protein, 26 aa, Mycobacterium
ETEDGPSLYAAWTWAPSVLDEVQAAR

SEQ ID NO: 305557 - protein, 22 aa, Mycobacterium
ETERGFSMALGRLGDPADDDCL

SEQ ID NO: 305558 - protein, 22 aa, Mycobacterium
ETERGFSMALGRLGDPADSDCL

SEQ ID NO: 305559 - protein, 21 aa, Mycobacterium
ETERIWLPFTIWLTAAPALLP

SEQ ID NO: 305560 - protein, 18 aa, Mycobacterium
ETEVLLGVVLALLGQGRP

SEQ ID NO: 305561 - protein, 21 aa, Mycobacterium
ETFDLVGVLLLSPGLATFLFA

SEQ ID NO: 305562 - protein, 20 aa, Mycobacterium
ETFDVVGMLLLSPGLPAFLY

SEQ ID NO: 305563 - protein, 17 aa, Mycobacterium
ETFNVIFVDMKFESAAQ

SEQ ID NO: 305564 - protein, 18 aa, Mycobacterium
ETFRNFRAGYGATIATMM

SEQ ID NO: 305565 - protein, 18 aa, Mycobacterium
ETFRNFRAGYGATVATIM

SEQ ID NO: 305566 - protein, 18 aa, Mycobacterium
ETFWEFLPRSVFGSLKSA

SEQ ID NO: 305567 - protein, 18 aa, Mycobacterium
ETFWEFLPRSVFGSLRSS

SEQ ID NO: 305568 - protein, 19 aa, Mycobacterium
ETFWEFLPRSVFGSLRSSL

SEQ ID NO: 305569 - protein, 19 aa, Mycobacterium
ETFWEFLPRSVIGSLRSAI

SEQ ID NO: 305570 - protein, 20 aa, Mycobacterium
ETGACRWRCSEALRRTWRRG

SEQ ID NO: 305571 - protein, 19 aa, Mycobacterium
ETGCAALGIPGHFAVLPAD

SEQ ID NO: 305572 - protein, 24 aa, Mycobacterium
ETGEIMVFVGPEFVVTVRHGDHSG

SEQ ID NO: 305573 - protein, 26 aa, Mycobacterium
ETGELWFKGPNVMAGYLNNERATRET

SEQ ID NO: 305574 - protein, 22 aa, Mycobacterium
ETGIDWDVVFLLLGMMIIVSVL

SEQ ID NO: 305575 - protein, 18 aa, Mycobacterium
ETGLTKWSVVIDAPPSSD

SEQ ID NO: 305576 - protein, 22 aa, Mycobacterium
ETGSPYAIEYVWGRQVGDNTIN

SEQ ID NO: 305577 - protein, 22 aa, Mycobacterium
ETGYRLRVRMTPTDGQYKISKL

SEQ ID NO: 305578 - protein, 24 aa, Mycobacterium
ETHPDFFTPLLWTAALLKGGDPAR

SEQ ID NO: 305579 - protein, 26 aa, Mycobacterium
ETIAPRTGYTDYLRLTKTSEIAAVAI

SEQ ID NO: 305580 - protein, 26 aa, Mycobacterium
ETIGPNIDGCWGFPFGPVKVPEGKLW

SEQ ID NO: 305581 - protein, 25 aa, Mycobacterium
ETIKGDASVGWLRLGAGVLALAALG

SEQ ID NO: 305582 - protein, 28 aa, Mycobacterium
ETIKGDASVGWLRLGALILALAGVAALL

SEQ ID NO: 305583 - protein, 25 aa, Mycobacterium
ETIKGDASVGWVRLGALVLALAALA

SEQ ID NO: 305584 - protein, 26 aa, Mycobacterium
ETIKGDASVGWVRLGALVLALAALAA

SEQ ID NO: 305585 - protein, 19 aa, Mycobacterium
ETILILPVAIAMFIAGAMV

SEQ ID NO: 305586 - protein, 20 aa, Mycobacterium
ETIVEARCGIGYLHTGIEKN

SEQ ID NO: 305587 - protein, 19 aa, Mycobacterium
ETKRRGGGMSAQDLLRREG

SEQ ID NO: 305588 - protein, 19 aa, Mycobacterium
ETLDEVWLSDAPEVGATVL

SEQ ID NO: 305589 - protein, 21 aa, Mycobacterium
ETLGGLGRRPAADQAPTPPTH

SEQ ID NO: 305590 - protein, 25 aa, Mycobacterium
ETLIGAPMWVVWGALPKYLAESFPA

SEQ ID NO: 305591 - protein, 27 aa, Mycobacterium
ETLPPSARRPLRAGAILRTYRDLLRDK

SEQ ID NO: 305592 - protein, 18 aa, Mycobacterium
ETLTEMFMMTVALAASAI

SEQ ID NO: 305593 - protein, 17 aa, Mycobacterium
ETLTWSQVYARACVVAD

SEQ ID NO: 305594 - protein, 26 aa, Mycobacterium
ETLVALAWFPLWLILLAVGWLVVRRR

SEQ ID NO: 305595 - protein, 19 aa, Mycobacterium
ETLVRRASRIAAKSSAELL

SEQ ID NO: 305596 - protein, 18 aa, Mycobacterium
ETLWAVLVLAALRGLGFG

SEQ ID NO: 305597 - protein, 19 aa, Mycobacterium
ETMLFGCYAMFGLSFVASL

SEQ ID NO: 305598 - protein, 18 aa, Mycobacterium
ETNLRTAYQKALASNEID

SEQ ID NO: 305599 - protein, 22 aa, Mycobacterium
ETNPGPGLGILLAFTVFGKGVA

SEQ ID NO: 305600 - protein, 20 aa, Mycobacterium
ETPAAPWYLSVAIMAALVVV

SEQ ID NO: 305601 - protein, 25 aa, Mycobacterium
ETPDIPLLVALCAVLALSVLPLCRR

SEQ ID NO: 305602 - protein, 19 aa, Mycobacterium
ETPLTMVGGFFRMCVLTGK

SEQ ID NO: 305603 - protein, 23 aa, Mycobacterium
ETPPRLPVVMMIAGEFNTPADWV

SEQ ID NO: 305604 - protein, 21 aa, Mycobacterium
ETPVWRLVLPFAAMGAGMAFV

SEQ ID NO: 305605 - protein, 25 aa, Mycobacterium
ETQGGSIGLGFAIPVDQAKRVADQL

SEQ ID NO: 305606 - protein, 24 aa, Mycobacterium
ETQVPQWFAGTSFAKAAKSIEFPV

SEQ ID NO: 305607 - protein, 25 aa, Mycobacterium
ETRARWDRYALFAQRTFNVEIPEIP

SEQ ID NO: 305608 - protein, 24 aa, Mycobacterium
ETRFLPRVGPWALYGLLFTIVILF

SEQ ID NO: 305609 - protein, 18 aa, Mycobacterium
ETRFPLIVQNSHRYFFYI

SEQ ID NO: 305610 - protein, 22 aa, Mycobacterium
ETRHWWHLPLLGHHVLVAGATG

SEQ ID NO: 305611 - protein, 18 aa, Mycobacterium
ETRLPLIIQNSHRYFFYV

SEQ ID NO: 305612 - protein, 18 aa, Mycobacterium
ETRRRPVGSIVIGLAGVL

SEQ ID NO: 305613 - protein, 21 aa, Mycobacterium
ETRSWRIVVNVERDGTQLKIS

SEQ ID NO: 305614 - protein, 25 aa, Mycobacterium
ETRWARWLCAALVFGTGTWAVVVLA

SEQ ID NO: 305615 - protein, 20 aa, Mycobacterium
ETRWFQWSVVSDHGLLFGAG

SEQ ID NO: 305616 - protein, 32 aa, Mycobacterium
ETSAPPARRRVKVVPAILIALLLLSGGGATWL

SEQ ID NO: 305617 - protein, 25 aa, Mycobacterium
ETSPPRLRVLPARFVGGVLGIGSGL

SEQ ID NO: 305618 - protein, 22 aa, Mycobacterium
ETSVMLLLKMFVPDNAFGVLYL

SEQ ID NO: 305619 - protein, 23 aa, Mycobacterium
ETTMIPMAIKWAARLTPSGALTE

SEQ ID NO: 305620 - protein, 22 aa, Mycobacterium
ETVCAVAADLTSTVSAPRTAPF

SEQ ID NO: 305621 - protein, 25 aa, Mycobacterium
ETVDAGLWVAFWFFLAQLNFVLGAI

SEQ ID NO: 305622 - protein, 24 aa, Mycobacterium
ETVEAGIWVAFWFFLAQLNFVLGG

SEQ ID NO: 305623 - protein, 18 aa, Mycobacterium
ETVFLRLAQVLFHPFVAG

SEQ ID NO: 305624 - protein, 26 aa, Mycobacterium
ETVKGDASLAWMLLGAVVMAGAVLAG

SEQ ID NO: 305625 - protein, 25 aa, Mycobacterium
ETVKGDASLAWMLLGTVAMAGAVLA

SEQ ID NO: 305626 - protein, 23 aa, Mycobacterium
ETVRIAPHFVRIRMTSPTLFEDV

SEQ ID NO: 305627 - protein, 19 aa, Mycobacterium
ETVRLVAACVAFIVILGVI

SEQ ID NO: 305628 - protein, 23 aa, Mycobacterium
ETVSEGFYYTAFVPNLLLFELFQ

SEQ ID NO: 305629 - protein, 23 aa, Mycobacterium
ETVTDVRCGIGYLHTGIEKNLEY

SEQ ID NO: 305630 - protein, 24 aa, Mycobacterium
ETVTRLRRELAYLGSDTASAPEVP

SEQ ID NO: 305631 - protein, 17 aa, Mycobacterium
ETVVAALAWTLALLPQN

SEQ ID NO: 305632 - protein, 23 aa, Mycobacterium
ETVVLCFIALFAVNAALTTIGVR

SEQ ID NO: 305633 - protein, 20 aa, Mycobacterium
ETYSGLPLVKTFGQRARAQE

SEQ ID NO: 305634 - protein, 20 aa, Mycobacterium
EVAAARWLYTVFTVLAAVGF

SEQ ID NO: 305635 - protein, 19 aa, Mycobacterium
EVAAATGFRAPEGPYETIG

SEQ ID NO: 305636 - protein, 21 aa, Mycobacterium
EVAAQLRARYHLDDPFVVQYL

SEQ ID NO: 305637 - protein, 23 aa, Mycobacterium
EVACSIGATLGNGGWATLLNSAK

SEQ ID NO: 305638 - protein, 23 aa, Mycobacterium
EVACSIGATLGNGGWATLVNSAK

SEQ ID NO: 305639 - protein, 22 aa, Mycobacterium
EVADALDLCLACKGCTSDCPVD

SEQ ID NO: 305640 - protein, 26 aa, Mycobacterium
EVADLAFLPRLVVLIVVALVITGAVY

SEQ ID NO: 305641 - protein, 19 aa, Mycobacterium
EVADWARTRLPEYMVPKAF

SEQ ID NO: 305642 - protein, 30 aa, Mycobacterium
EVAERVYLSRVMRAAAEWTDVLINMNAGNV

SEQ ID NO: 305643 - protein, 18 aa, Mycobacterium
EVAESIDMRTFPGSEYGP

SEQ ID NO: 305644 - protein, 18 aa, Mycobacterium
EVAFLVAMVMARPQLDQL

SEQ ID NO: 305645 - protein, 25 aa, Mycobacterium
EVALPQPHCPAGFDVADETARGPHT

SEQ ID NO: 305646 - protein, 30 aa, Mycobacterium
EVAPESLLYQWDELAGWLRAERQNLATADD

SEQ ID NO: 305647 - protein, 19 aa, Mycobacterium
EVARARRDAPCAVEADTCP

SEQ ID NO: 305648 - protein, 23 aa, Mycobacterium
EVARGMLRAMICQLAMFHGPDQF

SEQ ID NO: 305649 - protein, 19 aa, Mycobacterium
EVAVFVFFGLIAVLGTQYT

SEQ ID NO: 305650 - protein, 19 aa, Mycobacterium
EVAVFVFFGLVAVLGTQYT

SEQ ID NO: 305651 - protein, 33 aa, Mycobacterium
EVAYLGITVAFLFWEFFIPLLLSLLQGLLGLIG

SEQ ID NO: 305652 - protein, 19 aa, Mycobacterium
EVDALRALLIGTPFNPVGI

SEQ ID NO: 305653 - protein, 22 aa, Mycobacterium
EVDYVRMWIQAAAAMSVYDEVS

SEQ ID NO: 305654 - protein, 25 aa, Mycobacterium
EVEDRARKGLSIVIAPEGTRVDTTE

SEQ ID NO: 305655 - protein, 28 aa, Mycobacterium
EVEEGRPGWKLRLQQLFLTLVGLIVAAT

SEQ ID NO: 305656 - protein, 18 aa, Mycobacterium
EVELPLRVRESDANPATE

SEQ ID NO: 305657 - protein, 24 aa, Mycobacterium
EVELRGPIGGWFVWRPEERSQILL

SEQ ID NO: 305658 - protein, 20 aa, Mycobacterium
EVELRWRASPLTLAIATGAA

SEQ ID NO: 305659 - protein, 19 aa, Mycobacterium
EVETALRHIAYRVLAQRDW

SEQ ID NO: 305660 - protein, 18 aa, Mycobacterium
EVETFTGRGLRVLAVAAA

SEQ ID NO: 305661 - protein, 22 aa, Mycobacterium
EVFASPPGGMPAQPGTPAKPAV

SEQ ID NO: 305662 - protein, 17 aa, Mycobacterium
EVFEEFKTSSSVMIVLE

SEQ ID NO: 305663 - protein, 26 aa, Mycobacterium
EVFGQRRLLRWSIPGIAHFFTMWGFF

SEQ ID NO: 305664 - protein, 18 aa, Mycobacterium
EVFLLSRIREYWLASEQG

SEQ ID NO: 305665 - protein, 19 aa, Mycobacterium
EVFMLGMFGAYFALDVVLG

SEQ ID NO: 305666 - protein, 20 aa, Mycobacterium
EVFNNAKFKRVMKMFLSPDG

SEQ ID NO: 305667 - protein, 21 aa, Mycobacterium
EVFPLTMFAVAGMLLFPAADD

SEQ ID NO: 305668 - protein, 19 aa, Mycobacterium
EVGEGRWRHGVMRYRESQA

SEQ ID NO: 305669 - protein, 28 aa, Mycobacterium
EVGGAAWLPFLVAFAIATITAFSYLELV

SEQ ID NO: 305670 - protein, 24 aa, Mycobacterium
EVGGAAWLPFLVAFLVATVTAFSY

SEQ ID NO: 305671 - protein, 31 aa, Mycobacterium
EVGGRALLFAGILPPAWLAGTAMLGLSKILD

SEQ ID NO: 305672 - protein, 30 aa, Mycobacterium
EVGGRALLFGGIFPPFWLAGTAMLAVSKIL

SEQ ID NO: 305673 - protein, 18 aa, Mycobacterium
EVGGVLWAPMTVALGLAL

SEQ ID NO: 305674 - protein, 17 aa, Mycobacterium
EVGKVKGVELIDNGSKV

SEQ ID NO: 305675 - protein, 20 aa, Mycobacterium
EVGLMGRIGRRMWRRSGFLP

SEQ ID NO: 305676 - protein, 24 aa, Mycobacterium
EVGPKIRAALGFTGYSLGAASGSI

SEQ ID NO: 305677 - protein, 18 aa, Mycobacterium
EVGTLPGTDFRLPPKYME

SEQ ID NO: 305678 - protein, 20 aa, Mycobacterium
EVHDLHVWTLVPGKDMVTAH

SEQ ID NO: 305679 - protein, 20 aa, Mycobacterium
EVIQPYLPIAVVAALDAVFG

SEQ ID NO: 305680 - protein, 19 aa, Mycobacterium
EVIVVPVLVALLLSALLVP

SEQ ID NO: 305681 - protein, 17 aa, Mycobacterium
EVKPLGVGINMLPHAVG

SEQ ID NO: 305682 - protein, 25 aa, Mycobacterium
EVLADRTAVIFTRRRSMLSLADRVA

SEQ ID NO: 305683 - protein, 20 aa, Mycobacterium
EVLAGILLFVPRTATLGALV

SEQ ID NO: 305684 - protein, 25 aa, Mycobacterium
EVLAIGLCVSERFGIDDGIAPGLTC

SEQ ID NO: 305685 - protein, 19 aa, Mycobacterium
EVLARAVAHGVLRPDNAGQ

SEQ ID NO: 305686 - protein, 20 aa, Mycobacterium
EVLDYPAYGWPAVAPPQPPV

SEQ ID NO: 305687 - protein, 22 aa, Mycobacterium
EVLELRRCVNPLSAAFQRMQTE

SEQ ID NO: 305688 - protein, 25 aa, Mycobacterium
EVLGPWVNRPWLNWVAGLIVGVLLL

SEQ ID NO: 305689 - protein, 25 aa, Mycobacterium
EVLGPWVNRPWLNWVAGVIVGTLLV

SEQ ID NO: 305690 - protein, 20 aa, Mycobacterium
EVLGVPMLIVATVGLAVNVL

SEQ ID NO: 305691 - protein, 19 aa, Mycobacterium
EVLIICLAGGLAIGTSALG

SEQ ID NO: 305692 - protein, 20 aa, Mycobacterium
EVLLRNAYLWLFAVLLIWLG

SEQ ID NO: 305693 - protein, 22 aa, Mycobacterium
EVLNPPEFLTGALANLSGQAAD

SEQ ID NO: 305694 - protein, 17 aa, Mycobacterium
EVLPDDKLEVVRGLQDE

SEQ ID NO: 305695 - protein, 27 aa, Mycobacterium
EVLPDLRARGSLWLIVVGFSAGVAVLV

SEQ ID NO: 305696 - protein, 19 aa, Mycobacterium
EVLPLLPTAAMVWGVARTV

SEQ ID NO: 305697 - protein, 18 aa, Mycobacterium
EVLPRDVIEREPDPESAP

SEQ ID NO: 305698 - protein, 20 aa, Mycobacterium
EVLQQIPLLVGSVVLGSATG

SEQ ID NO: 305699 - protein, 19 aa, Mycobacterium
EVLQVPGTIEMGGVSVHDA

SEQ ID NO: 305700 - protein, 19 aa, Mycobacterium
EVLRCGAQVVLPADADGHA

SEQ ID NO: 305701 - protein, 28 aa, Mycobacterium
EVLRRDATSLVRYCHDHRIDVINVTPTY

SEQ ID NO: 305702 - protein, 18 aa, Mycobacterium
EVLRRELRRPSWQRETVA

SEQ ID NO: 305703 - protein, 17 aa, Mycobacterium
EVLRVPDSWGIAFLYLC

SEQ ID NO: 305704 - protein, 29 aa, Mycobacterium
EVLSLPLYLMCGLARHRRLLSQEAAMKYF

SEQ ID NO: 305705 - protein, 24 aa, Mycobacterium
EVLSPFKVPSVWALLDDEAAVPIG

SEQ ID NO: 305706 - protein, 25 aa, Mycobacterium
EVLSSFKVPSVWALLPDEAAIPRGA

SEQ ID NO: 305707 - protein, 19 aa, Mycobacterium
EVLVLSWAGTRGVVSLAAI

SEQ ID NO: 305708 - protein, 17 aa, Mycobacterium
EVMAHALELFSYLTEHI

SEQ ID NO: 305709 - protein, 19 aa, Mycobacterium
EVMFVIGFLASFLALQTSA

SEQ ID NO: 305710 - protein, 25 aa, Mycobacterium
EVMRLLRRLARRGVTVILTTHEPAG

SEQ ID NO: 305711 - protein, 18 aa, Mycobacterium
EVMVPRTEMVWIESDKTA

SEQ ID NO: 305712 - protein, 21 aa, Mycobacterium
EVNHWLPGLYAAILGSYAVVA

SEQ ID NO: 305713 - protein, 24 aa, Mycobacterium
EVPAEFRATFQAGIVGDRLAAGSA

SEQ ID NO: 305714 - protein, 23 aa, Mycobacterium
EVPAGTWVFGLSVPQNQRQLLRA

SEQ ID NO: 305715 - protein, 20 aa, Mycobacterium
EVPDAVRAMFGPRLLDDDEY

SEQ ID NO: 305716 - protein, 19 aa, Mycobacterium
EVPEFRITPDYDQKRKDTD

SEQ ID NO: 305717 - protein, 19 aa, Mycobacterium
EVPEGSALTVAARRDLYGD

SEQ ID NO: 305718 - protein, 25 aa, Mycobacterium
EVPEYGFWAWLAMLFSAGMGIGLVF

SEQ ID NO: 305719 - protein, 22 aa, Mycobacterium
EVPGPPAGSVVQQWDLGTELLG

SEQ ID NO: 305720 - protein, 24 aa, Mycobacterium
EVPPDRLERVLSLVPGNPRIGAGR

SEQ ID NO: 305721 - protein, 22 aa, Mycobacterium
EVPSAKWGWSRINHRTWHIVGL

SEQ ID NO: 305722 - protein, 23 aa, Mycobacterium
EVPSARWGWSRINYRTWHITGAC

SEQ ID NO: 305723 - protein, 21 aa, Mycobacterium
EVPSAWKLLVYGLQHLLVMYA

SEQ ID NO: 305724 - protein, 21 aa, Mycobacterium
EVPSTVRAMFSTRGFHDGEYD

SEQ ID NO: 305725 - protein, 18 aa, Mycobacterium
EVPTGTAYAVWVGIGATL

SEQ ID NO: 305726 - protein, 20 aa, Mycobacterium
EVPYDLQALLADTAATYEQV

SEQ ID NO: 305727 - protein, 20 aa, Mycobacterium
EVQAMLSMAVVKLVDLVMKA

SEQ ID NO: 305728 - protein, 19 aa, Mycobacterium
EVQLYPALARPLGSGEATA

SEQ ID NO: 305729 - protein, 20 aa, Mycobacterium
EVQNTGGVVLEFVTGDRSGQ

SEQ ID NO: 305730 - protein, 19 aa, Mycobacterium
EVQPKGVALPSFITSSADF

SEQ ID NO: 305731 - protein, 17 aa, Mycobacterium
EVRAVATAGGYRLSGRK

SEQ ID NO: 305732 - protein, 32 aa, Mycobacterium
EVRDGWDLKLHRAVAIKLLYPGVADRPDSRVR

SEQ ID NO: 305733 - protein, 22 aa, Mycobacterium
EVREICERYGLPYNSGPLVKQF

SEQ ID NO: 305734 - protein, 20 aa, Mycobacterium
EVRESTALVIMQFIESMAGI

SEQ ID NO: 305735 - protein, 18 aa, Mycobacterium
EVRFRRWDGDTMWGAVSA

SEQ ID NO: 305736 - protein, 33 aa, Mycobacterium
EVRGWRRVGTVVVRWPAPVLAAACAIAVIGLLA

SEQ ID NO: 305737 - protein, 19 aa, Mycobacterium
EVRRLVRRLLPALVVVLAA

SEQ ID NO: 305738 - protein, 38 aa, Mycobacterium
EVRTEPALLARWIRRLAIPIMLGWLAIIVLINILVPSL

SEQ ID NO: 305739 - protein, 19 aa, Mycobacterium
EVRTVFVIAAIAAFAGFAV

SEQ ID NO: 305740 - protein, 20 aa, Mycobacterium
EVSEAIDFANYYASLAEKLD

SEQ ID NO: 305741 - protein, 20 aa, Mycobacterium
EVSPGITQRLWTFGGSAPGP

SEQ ID NO: 305742 - protein, 19 aa, Mycobacterium
EVSPHPLLTYGISDTLGTS

SEQ ID NO: 305743 - protein, 23 aa, Mycobacterium
EVSRRAFDRWVRKMAHQSKAIRL

SEQ ID NO: 305744 - protein, 22 aa, Mycobacterium
EVTEYFLVGSFASWLLALGGMA

SEQ ID NO: 305745 - protein, 28 aa, Mycobacterium
EVTLSALRRYGCTITQGFVHSPPLPADE

SEQ ID NO: 305746 - protein, 28 aa, Mycobacterium
EVTLTALRRYGCTITQGFVHSPPLPPED

SEQ ID NO: 305747 - protein, 21 aa, Mycobacterium
EVTRMLTILLHEWLPATVDGV

SEQ ID NO: 305748 - protein, 19 aa, Mycobacterium
EVTRWWRRDAARAGHACPP

SEQ ID NO: 305749 - protein, 27 aa, Mycobacterium
EVVAIAGYVAFWWPDLPLWIPALVTVA

SEQ ID NO: 305750 - protein, 25 aa, Mycobacterium
EVVEAMTASCERPMIFPLSNPTSRM

SEQ ID NO: 305751 - protein, 32 aa, Mycobacterium
EVVEGVGLWLLKRWGEYFAVIATSVFLPLEIH

SEQ ID NO: 305752 - protein, 19 aa, Mycobacterium
EVVEITGAVLTKLDGTAKG

SEQ ID NO: 305753 - protein, 20 aa, Mycobacterium
EVVFAWPGLGRLVFNSVAAR

SEQ ID NO: 305754 - protein, 26 aa, Mycobacterium
EVVGCSLRLPGLYPPGLYNGTLHVDG

SEQ ID NO: 305755 - protein, 21 aa, Mycobacterium
EVVGIIGFMALFILSGMGNGS

SEQ ID NO: 305756 - protein, 17 aa, Mycobacterium
EVVGRCFGQLDALTSYR

SEQ ID NO: 305757 - protein, 22 aa, Mycobacterium
EVVGRRKLWYGISGAIMAIAIL

SEQ ID NO: 305758 - protein, 22 aa, Mycobacterium
EVVGRRKLWYGISGGIVTIAIL

SEQ ID NO: 305759 - protein, 19 aa, Mycobacterium
EVVGSMAYLSPERLTSKPA

SEQ ID NO: 305760 - protein, 19 aa, Mycobacterium
EVVIICLAAGLAIGTGGLG

SEQ ID NO: 305761 - protein, 25 aa, Mycobacterium
EVVKPTRISKLFILASRSVRRETAS

SEQ ID NO: 305762 - protein, 18 aa, Mycobacterium
EVVLDFPVSRRVRPEALL

SEQ ID NO: 305763 - protein, 20 aa, Mycobacterium
EVVLVTGPWLAGVSAVAAAL

SEQ ID NO: 305764 - protein, 20 aa, Mycobacterium
EVVPSAWAVGASRAAAGEAS

SEQ ID NO: 305765 - protein, 17 aa, Mycobacterium
EVVREGRHVTLTVKPEP

SEQ ID NO: 305766 - protein, 18 aa, Mycobacterium
EVVSIGFVISLWAGSSAI

SEQ ID NO: 305767 - protein, 18 aa, Mycobacterium
EVVSIGFVISLWAGSSAV

SEQ ID NO: 305768 - protein, 18 aa, Mycobacterium
EVVSLGFVISLWAGSSAI

SEQ ID NO: 305769 - protein, 20 aa, Mycobacterium
EVVTLPVLIYTRGIVTFDLP

SEQ ID NO: 305770 - protein, 19 aa, Mycobacterium
EVYIAFFSFIGFIIANPWL

SEQ ID NO: 305771 - protein, 18 aa, Mycobacterium
EVYLPVAVLAGGESPASQ

SEQ ID NO: 305772 - protein, 22 aa, Mycobacterium
EVYMLAIGRFHLDWGAADQPPV

SEQ ID NO: 305773 - protein, 24 aa, Mycobacterium
EWAHSPIGWPHRLARRRVFMAVVA

SEQ ID NO: 305774 - protein, 21 aa, Mycobacterium
EWDWVKWLPHFGDPRRQDAAG

SEQ ID NO: 305775 - protein, 19 aa, Mycobacterium
EWETLLFFAGLFIMIGALV

SEQ ID NO: 305776 - protein, 20 aa, Mycobacterium
EWETLMFFAGLFIMVGALVK

SEQ ID NO: 305777 - protein, 26 aa, Mycobacterium
EWFGELEFWAALIKVFALIAFLVVGI

SEQ ID NO: 305778 - protein, 18 aa, Mycobacterium
EWGPAWHLGVLPLEDGGT

SEQ ID NO: 305779 - protein, 19 aa, Mycobacterium
EWNVFMIFGVLALFVSHAN

SEQ ID NO: 305780 - protein, 18 aa, Mycobacterium
EWNVFMIFGVLWLFVAHA

SEQ ID NO: 305781 - protein, 25 aa, Mycobacterium
EWPGGPYRGVEWVAIAAIAGPTLLW

SEQ ID NO: 305782 - protein, 25 aa, Mycobacterium
EWRDDLRWPPASALVSQNEAVDALI

SEQ ID NO: 305783 - protein, 19 aa, Mycobacterium
EWSGAALLSAEYSPSQNRG

SEQ ID NO: 305784 - protein, 21 aa, Mycobacterium
EWWRLASMSAVIVALHLVGWI

SEQ ID NO: 305785 - protein, 32 aa, Mycobacterium
EWYNTALGLAMVFGRLLPIILVLALAGSLASQ

SEQ ID NO: 305786 - protein, 18 aa, Mycobacterium
EYAGPRLALVEWAAGMRL

SEQ ID NO: 305787 - protein, 18 aa, Mycobacterium
EYAHAVVTSMVGNGDPVW

SEQ ID NO: 305788 - protein, 21 aa, Mycobacterium
EYASWRYVFVLIAALSVVVGL

SEQ ID NO: 305789 - protein, 28 aa, Mycobacterium
EYAVLVLLVGALRGWLLTLAQPAHHGLL

SEQ ID NO: 305790 - protein, 20 aa, Mycobacterium
EYFLLCPMLIVFGIAVIGVL

SEQ ID NO: 305791 - protein, 21 aa, Mycobacterium
EYFLLCPMLIVFGVAVVGVLV

SEQ ID NO: 305792 - protein, 18 aa, Mycobacterium
EYGPAFRGLQAVWESGDE

SEQ ID NO: 305793 - protein, 24 aa, Mycobacterium
EYGVHLMVSAGGWIHGQRQSLLQN

SEQ ID NO: 305794 - protein, 18 aa, Mycobacterium
EYIAQAWFVARVSLLPTL

SEQ ID NO: 305795 - protein, 35 aa, Mycobacterium
EYLDLPRLFQILLIIGMFVWIAIIFRGMRARLKGE

SEQ ID NO: 305796 - protein, 35 aa, Mycobacterium
EYLDLPRLWQILLIVGMFVWIAIIFRGMRARLKGE

SEQ ID NO: 305797 - protein, 36 aa, Mycobacterium
EYLDLPRLWQVLLIVGMFLWIAIIWRGIRGRLKTES

SEQ ID NO: 305798 - protein, 20 aa, Mycobacterium
EYLIDWERSALVNGLVPAQF

SEQ ID NO: 305799 - protein, 18 aa, Mycobacterium
EYQRAAVAVGRIRSLLNT

SEQ ID NO: 305800 - protein, 25 aa, Mycobacterium
EYRFERAWPLLWFVVIGLVAAAVGY

SEQ ID NO: 305801 - protein, 31 aa, Mycobacterium
EYRMVKGFVPGGARFALSVIRNARGFGGLTA

SEQ ID NO: 305802 - protein, 32 aa, Mycobacterium
EYRPPGSNENWKWVASIAGAVFAIAVIATAVV

SEQ ID NO: 305803 - protein, 20 aa, Mycobacterium
EYRRGFVTRHQVTGWRFVMR

SEQ ID NO: 305804 - protein, 22 aa, Mycobacterium
EYSIGAFFVLYGLLVFGLAAIP

SEQ ID NO: 305805 - protein, 22 aa, Mycobacterium
EYSMGAFFVLYGLVVFGLAALP

SEQ ID NO: 305806 - protein, 22 aa, Mycobacterium
EYTRLGVCTVPASLAVAVLALW

SEQ ID NO: 305807 - protein, 25 aa, Mycobacterium
EYVALAAVIPLAFWVSGVYGLVRDA

SEQ ID NO: 305808 - protein, 25 aa, Mycobacterium
EYVRAYRRYRIMLAAIAIATTGLLL

SEQ ID NO: 305809 - protein, 18 aa, Mycobacterium
EYYCAATQAFFDEIDSDG

SEQ ID NO: 305810 - protein, 30 aa, Mycobacterium
FAAAAVILAHFMWRRRVPDAEPRIVGLAMS

SEQ ID NO: 305811 - protein, 21 aa, Mycobacterium
FAAACGALILASRGGELDLRT

SEQ ID NO: 305812 - protein, 17 aa, Mycobacterium
FAAAIAVYAALTAVLGV

SEQ ID NO: 305813 - protein, 18 aa, Mycobacterium
FAAAITVAALLIVEANQD

SEQ ID NO: 305814 - protein, 26 aa, Mycobacterium
FAAAVGEVGIGWGLITLAVVSGLQAA

SEQ ID NO: 305815 - protein, 25 aa, Mycobacterium
FAAESGWLGLFGWAVVILGFLTVVI

SEQ ID NO: 305816 - protein, 24 aa, Mycobacterium
FAAFLLYLRMFFEPMHEITHFFNA

SEQ ID NO: 305817 - protein, 19 aa, Mycobacterium
FAAFPGWYATVFSALYLPL

SEQ ID NO: 305818 - protein, 21 aa, Mycobacterium
FAAFPHWYATVFSGLYLPLLL

SEQ ID NO: 305819 - protein, 18 aa, Mycobacterium
FAAFPVWYATLFSALYLP

SEQ ID NO: 305820 - protein, 24 aa, Mycobacterium
FAAFWIGLFIWYVGVSTLLVGAKA

SEQ ID NO: 305821 - protein, 17 aa, Mycobacterium
FAAGLALLGTVPTGLLA

SEQ ID NO: 305822 - protein, 18 aa, Mycobacterium
FAAGLSVLGTVPMGLLAY

SEQ ID NO: 305823 - protein, 26 aa, Mycobacterium
FAAILWRLSGTLTVFGIDIPKALFWV

SEQ ID NO: 305824 - protein, 27 aa, Mycobacterium
FAALGPACAIAVLFGFLATVTLLPPVL

SEQ ID NO: 305825 - protein, 23 aa, Mycobacterium
FAALLVYHGAGWVFAMMIAVIAS

SEQ ID NO: 305826 - protein, 33 aa, Mycobacterium
FAALNVFWALSWCTRPWPSLRRSRMFITSADIG

SEQ ID NO: 305827 - protein, 25 aa, Mycobacterium
FAALQRWGLQPDFVMGHSVGELSAA

SEQ ID NO: 305828 - protein, 20 aa, Mycobacterium
FAALTRWYGPGAVRALMVLT

SEQ ID NO: 305829 - protein, 27 aa, Mycobacterium
FAAPLLGVLCSIYWQRPVPAVQVHGEP

SEQ ID NO: 305830 - protein, 24 aa, Mycobacterium
FAAQCVATGCPLGPDPKAAVDSLL

SEQ ID NO: 305831 - protein, 19 aa, Mycobacterium
FAAQGNWAAAIRHRLRAVA

SEQ ID NO: 305832 - protein, 31 aa, Mycobacterium
FAARANPGIPARGVVAVCDFGGSGTSITLAD

SEQ ID NO: 305833 - protein, 22 aa, Mycobacterium
FAARDDNGWVGFWIFAAAMVVV

SEQ ID NO: 305834 - protein, 17 aa, Mycobacterium
FAARPIGAVIFGYIGDR

SEQ ID NO: 305835 - protein, 25 aa, Mycobacterium
FAASYRWGHHFGRLVEHPDSEQLLL

SEQ ID NO: 305836 - protein, 18 aa, Mycobacterium
FAATFCWGLLLLAVTAND

SEQ ID NO: 305837 - protein, 24 aa, Mycobacterium
FAATVVVCMIWRLLSQGLGSQPVN

SEQ ID NO: 305838 - protein, 24 aa, Mycobacterium
FAATVVVCMIWRLVGHGLNHAPQN

SEQ ID NO: 305839 - protein, 23 aa, Mycobacterium
FAAVAIYWAYRWTARRWTHLMPR

SEQ ID NO: 305840 - protein, 20 aa, Mycobacterium
FAAVCARIVMGRGAAIIGAL

SEQ ID NO: 305841 - protein, 18 aa, Mycobacterium
FAAVITIAALFIVEANQD

SEQ ID NO: 305842 - protein, 26 aa, Mycobacterium
FAAVPWLHRFGDLIAPLTFIGAAYVT

SEQ ID NO: 305843 - protein, 25 aa, Mycobacterium
FAAVPWLQRFGELVAPLTFMGAAYV

SEQ ID NO: 305844 - protein, 19 aa, Mycobacterium
FAAVTARFAVMFAAGALLY

SEQ ID NO: 305845 - protein, 18 aa, Mycobacterium
FACAIPGIMATRTLPSSR

SEQ ID NO: 305846 - protein, 17 aa, Mycobacterium
FACGMAFHNCAARYLYA

SEQ ID NO: 305847 - protein, 18 aa, Mycobacterium
FACSRYAHCPLRRITGIG

SEQ ID NO: 305848 - protein, 24 aa, Mycobacterium
FACYIGAAILTWVRYVRPTETAAG

SEQ ID NO: 305849 - protein, 26 aa, Mycobacterium
FADEFGWRGAFWDWIAGLNLNLVGFL

SEQ ID NO: 305850 - protein, 21 aa, Mycobacterium
FADFEYLFWVGCAGAYEDRAK

SEQ ID NO: 305851 - protein, 22 aa, Mycobacterium
FADGARAYGFILAFFGIGSAMG

SEQ ID NO: 305852 - protein, 18 aa, Mycobacterium
FADLFVAIGRLGRSLGIH

SEQ ID NO: 305853 - protein, 25 aa, Mycobacterium
FADLGPSPAWRNLRMSRDAIPTQAT

SEQ ID NO: 305854 - protein, 26 aa, Mycobacterium
FADLVSRWPFEGSIYQWTKRLAGNVA

SEQ ID NO: 305855 - protein, 22 aa, Mycobacterium
FADNQWAVFFARMALWSMLPWY

SEQ ID NO: 305856 - protein, 30 aa, Mycobacterium
FADPIWGPKFRKLYLRIARVGRSLHVFLKL

SEQ ID NO: 305857 - protein, 24 aa, Mycobacterium
FADQFGWRGAFWTWIGGLDLNAVG

SEQ ID NO: 305858 - protein, 23 aa, Mycobacterium
FADRAFAAALPWLAGRLGTPGIP

SEQ ID NO: 305859 - protein, 24 aa, Mycobacterium
FADREHVVFWAAMAYLGFLQVTAV

SEQ ID NO: 305860 - protein, 29 aa, Mycobacterium
FADRLAWSLTVLVAVAWIARGVFLGRPVT

SEQ ID NO: 305861 - protein, 20 aa, Mycobacterium
FADRTRPWITTVLAVEIGLL

SEQ ID NO: 305862 - protein, 23 aa, Mycobacterium
FADVGAAPAWRNLRATLSAIPDS

SEQ ID NO: 305863 - protein, 18 aa, Mycobacterium
FADYSRNALGHWAGFSVG

SEQ ID NO: 305864 - protein, 23 aa, Mycobacterium
FAEAGLRPGDRALLVYPPGLEMV

SEQ ID NO: 305865 - protein, 18 aa, Mycobacterium
FAELYRQGAARDIEMLMG

SEQ ID NO: 305866 - protein, 18 aa, Mycobacterium
FAELYRQGAARDVEMLMG

SEQ ID NO: 305867 - protein, 21 aa, Mycobacterium
FAERWGTRRSLAVGLTIMAAS

SEQ ID NO: 305868 - protein, 17 aa, Mycobacterium
FAEVFPEHKYRIVRLLQ

SEQ ID NO: 305869 - protein, 22 aa, Mycobacterium
FAFAAGFSLLFGYIGFATTGTL

SEQ ID NO: 305870 - protein, 17 aa, Mycobacterium
FAFAFYFATMERQRRHE

SEQ ID NO: 305871 - protein, 25 aa, Mycobacterium
FAFAPWFFFVCRFFTGAGIGGEYAA

SEQ ID NO: 305872 - protein, 25 aa, Mycobacterium
FAFLGWHWSLPLGVAILGAAVAGGL

SEQ ID NO: 305873 - protein, 20 aa, Mycobacterium
FAFVALIAFVMLLVSIRSVF

SEQ ID NO: 305874 - protein, 18 aa, Mycobacterium
FAFVEVIVMLSMQVTVVH

SEQ ID NO: 305875 - protein, 20 aa, Mycobacterium
FAGAFGLSVLVWQHLIGLPL

SEQ ID NO: 305876 - protein, 23 aa, Mycobacterium
FAGALLDRWDRRAVLICANLIRV

SEQ ID NO: 305877 - protein, 29 aa, Mycobacterium
FAGALLDRWDRRLVLIGANTGRVAIVLLV

SEQ ID NO: 305878 - protein, 30 aa, Mycobacterium
FAGALLDRWDRRLVMIGANLGRLLLVVLVG

SEQ ID NO: 305879 - protein, 17 aa, Mycobacterium
FAGALVFGHGACHHHRH

SEQ ID NO: 305880 - protein, 17 aa, Mycobacterium
FAGATAGVPGRAPTTER

SEQ ID NO: 305881 - protein, 19 aa, Mycobacterium
FAGAVAKTGLTIGLAAAGY

SEQ ID NO: 305882 - protein, 26 aa, Mycobacterium
FAGAWLDYVLRKGWPLLASDNTKQAA

SEQ ID NO: 305883 - protein, 17 aa, Mycobacterium
FAGCGYALMALTRALAA

SEQ ID NO: 305884 - protein, 20 aa, Mycobacterium
FAGGGMLAAFGILAALFERE

SEQ ID NO: 305885 - protein, 23 aa, Mycobacterium
FAGIGMFGPWGIIIGPVLMILIV

SEQ ID NO: 305886 - protein, 32 aa, Mycobacterium
FAGILVLLKVAAYWLDRYELLSHTRAGKPFTG

SEQ ID NO: 305887 - protein, 26 aa, Mycobacterium
FAGLARLGSIVAMFLVLRSAIPSLAA

SEQ ID NO: 305888 - protein, 17 aa, Mycobacterium
FAGLGAVTAQLWRTARA

SEQ ID NO: 305889 - protein, 32 aa, Mycobacterium
FAGLGMFNPLSLGAGFVLGRKAYKEDMENRLL

SEQ ID NO: 305890 - protein, 23 aa, Mycobacterium
FAGRITAVLACRRSVPAAEGSVL

SEQ ID NO: 305891 - protein, 19 aa, Mycobacterium
FAGRPIWGVGLIATAVAVK

SEQ ID NO: 305892 - protein, 20 aa, Mycobacterium
FAGSCLSEYGAIASTDLSQV

SEQ ID NO: 305893 - protein, 21 aa, Mycobacterium
FAGVMGLFVVFPIGGADMPVV

SEQ ID NO: 305894 - protein, 18 aa, Mycobacterium
FAGYTIVRLLGSGGMGEV

SEQ ID NO: 305895 - protein, 19 aa, Mycobacterium
FAGYVIQRLLGTGGMGEVY

SEQ ID NO: 305896 - protein, 20 aa, Mycobacterium
FAGYVIQRLLGTGGMGEVYL

SEQ ID NO: 305897 - protein, 24 aa, Mycobacterium
FAHPSTCPWAGKPLALPGVCVLNA

SEQ ID NO: 305898 - protein, 17 aa, Mycobacterium
FAHPWFFLVLLLVAALI

SEQ ID NO: 305899 - protein, 17 aa, Mycobacterium
FAIAALVISAWWLSSLI

SEQ ID NO: 305900 - protein, 24 aa, Mycobacterium
FAIADRPGLAPGFTAGALAVFVGG

SEQ ID NO: 305901 - protein, 18 aa, Mycobacterium
FAIFHLLVWGTFTILLTA

SEQ ID NO: 305902 - protein, 20 aa, Mycobacterium
FAIGLVFAPRYTRLVAGVFT

SEQ ID NO: 305903 - protein, 18 aa, Mycobacterium
FAIGRPLIRLSYLNELRN

SEQ ID NO: 305904 - protein, 23 aa, Mycobacterium
FAILAVLCAIGILAFTDSSPVSA

SEQ ID NO: 305905 - protein, 18 aa, Mycobacterium
FAIMSAWNGLLLAEWFGS

SEQ ID NO: 305906 - protein, 21 aa, Mycobacterium
FAIPGCYNLSVPPVERPKRLN

SEQ ID NO: 305907 - protein, 24 aa, Mycobacterium
FAISRGILHYCGRLASHDTALRAA

SEQ ID NO: 305908 - protein, 24 aa, Mycobacterium
FAISRGVLHYCERLATHDIALRAA

SEQ ID NO: 305909 - protein, 20 aa, Mycobacterium
FAIVCRLARVRFTVSYLAAL

SEQ ID NO: 305910 - protein, 20 aa, Mycobacterium
FAIVGLKLDLIRGVSLPMIV

SEQ ID NO: 305911 - protein, 17 aa, Mycobacterium
FAKVNPRTMTPVNNTVI

SEQ ID NO: 305912 - protein, 27 aa, Mycobacterium
FALASGRAMRALGWLRRNARRIQVFGG

SEQ ID NO: 305913 - protein, 21 aa, Mycobacterium
FALAVGLTFNRIMAAARPRTL

SEQ ID NO: 305914 - protein, 17 aa, Mycobacterium
FALGAAVTYLFRIETGG

SEQ ID NO: 305915 - protein, 25 aa, Mycobacterium
FALGVGSLLSWMLYVGLLITVADVL

SEQ ID NO: 305916 - protein, 17 aa, Mycobacterium
FALGVWFALHRRTRLGK

SEQ ID NO: 305917 - protein, 18 aa, Mycobacterium
FALHGVDYFHISKLSLSP

SEQ ID NO: 305918 - protein, 25 aa, Mycobacterium
FALLAIRLHIGLSLMASAFVGVLLL

SEQ ID NO: 305919 - protein, 17 aa, Mycobacterium
FALLAVIAVVLYYVMLT

SEQ ID NO: 305920 - protein, 17 aa, Mycobacterium
FALLIWVPALRCPAPVA

SEQ ID NO: 305921 - protein, 18 aa, Mycobacterium
FALLPGYLALVVRGENAA

SEQ ID NO: 305922 - protein, 17 aa, Mycobacterium
FALLSPILGWLGVAVTG

SEQ ID NO: 305923 - protein, 23 aa, Mycobacterium
FALMRLCFAPATGMLIQRLGERR

SEQ ID NO: 305924 - protein, 28 aa, Mycobacterium
FALNLKLLVPVFRWQRRDNLVAAADPSA

SEQ ID NO: 305925 - protein, 17 aa, Mycobacterium
FALPANQPLALVGSALT

SEQ ID NO: 305926 - protein, 17 aa, Mycobacterium
FALPIAMVAGWRCGSWR

SEQ ID NO: 305927 - protein, 18 aa, Mycobacterium
FALQCMSTVAVMRRETNS

SEQ ID NO: 305928 - protein, 27 aa, Mycobacterium
FALRLAVGVGCGALIGLERQWRARRAG

SEQ ID NO: 305929 - protein, 27 aa, Mycobacterium
FALRLGVGVGCGALIGLERQWRARRAG

SEQ ID NO: 305930 - protein, 17 aa, Mycobacterium
FALSGFLLWRGHAGAAR

SEQ ID NO: 305931 - protein, 18 aa, Mycobacterium
FALSRTIGLFGFSEHGWD

SEQ ID NO: 305932 - protein, 21 aa, Mycobacterium
FALSWWLGLYLLARDPRKPML

SEQ ID NO: 305933 - protein, 24 aa, Mycobacterium
FALTVWLWFSLDGLALIIGLCWLA

SEQ ID NO: 305934 - protein, 21 aa, Mycobacterium
FALVAFAWRQPRFDPLKPGRP

SEQ ID NO: 305935 - protein, 23 aa, Mycobacterium
FAMGGRAAEELVFREPTTGASSD

SEQ ID NO: 305936 - protein, 24 aa, Mycobacterium
FAMGGRAAEELVFREPTTGAVSDI

SEQ ID NO: 305937 - protein, 17 aa, Mycobacterium
FAMGRDGLLPPVFAKVR

SEQ ID NO: 305938 - protein, 21 aa, Mycobacterium
FAMQAGCRFTAQLGAQRINEE

SEQ ID NO: 305939 - protein, 21 aa, Mycobacterium
FAMQGGCRFTAQLGSMRIAEE

SEQ ID NO: 305940 - protein, 19 aa, Mycobacterium
FAMYAVFPITAGFTALANL

SEQ ID NO: 305941 - protein, 19 aa, Mycobacterium
FANATPWGQPPPRPRRNVW

SEQ ID NO: 305942 - protein, 22 aa, Mycobacterium
FANLFPFQLFLVLYGLPVADRD

SEQ ID NO: 305943 - protein, 22 aa, Mycobacterium
FANLRRFLTYHLTDNVAELAPF

SEQ ID NO: 305944 - protein, 26 aa, Mycobacterium
FANLVGGWVIMWLIMTGFPELHAQTI

SEQ ID NO: 305945 - protein, 17 aa, Mycobacterium
FANMELLESVAPKQPSR

SEQ ID NO: 305946 - protein, 18 aa, Mycobacterium
FANMEVLERVAPPHPSRW

SEQ ID NO: 305947 - protein, 23 aa, Mycobacterium
FAPFFPAIWCLRKLQAKHGPTAF

SEQ ID NO: 305948 - protein, 21 aa, Mycobacterium
FAPGRSLWWSLAWTAGMIAYA

SEQ ID NO: 305949 - protein, 23 aa, Mycobacterium
FAPICLGTTFYSLRAAKKMGSLH

SEQ ID NO: 305950 - protein, 21 aa, Mycobacterium
FAPLLRYIPQAALAGLLLVTA

SEQ ID NO: 305951 - protein, 18 aa, Mycobacterium
FAPNFTVLVILRLLYGIG

SEQ ID NO: 305952 - protein, 19 aa, Mycobacterium
FAPPPPWASGRNFPPPGMP

SEQ ID NO: 305953 - protein, 19 aa, Mycobacterium
FAPQTRSTRSFDLQFRDDE

SEQ ID NO: 305954 - protein, 18 aa, Mycobacterium
FAPRFTRLVAGTFTALAG

SEQ ID NO: 305955 - protein, 26 aa, Mycobacterium
FAPSGRFPWVAAIVFAFGLVLVACRP

SEQ ID NO: 305956 - protein, 26 aa, Mycobacterium
FAQAASLRAGQPITVAGIPMGTVTSM

SEQ ID NO: 305957 - protein, 31 aa, Mycobacterium
FAQAGLPTGSSFKVFALIAALEQGMGLGYQV

SEQ ID NO: 305958 - protein, 25 aa, Mycobacterium
FAQANRIAHRWMFTGAVPSGNSTDE

SEQ ID NO: 305959 - protein, 19 aa, Mycobacterium
FAQGRRVVAVAARPAPGLT

SEQ ID NO: 305960 - protein, 18 aa, Mycobacterium
FAQSGQWIPVAIGVAIAL

SEQ ID NO: 305961 - protein, 19 aa, Mycobacterium
FARADQAVRCGIDLQHALR

SEQ ID NO: 305962 - protein, 24 aa, Mycobacterium
FARANEIAHTWLFTDRIRRDEGGS

SEQ ID NO: 305963 - protein, 19 aa, Mycobacterium
FARAWELLAGVLAALLLTR

SEQ ID NO: 305964 - protein, 19 aa, Mycobacterium
FARDLRTGLLTKMSRLPLG

SEQ ID NO: 305965 - protein, 25 aa, Mycobacterium
FARDRLAGPAAHLFTIGSAVTVTQL

SEQ ID NO: 305966 - protein, 32 aa, Mycobacterium
FARDRRGQSLWRVRIAPALGLIGLVGALVLIL

SEQ ID NO: 305967 - protein, 19 aa, Mycobacterium
FARGLRARLLGKMSGLPLG

SEQ ID NO: 305968 - protein, 24 aa, Mycobacterium
FARKHLRTTDKWDGLRLWVRENGK

SEQ ID NO: 305969 - protein, 20 aa, Mycobacterium
FARLDFRGRDALFVVYLGTL

SEQ ID NO: 305970 - protein, 20 aa, Mycobacterium
FARLLLIWTAIATVALVLVG

SEQ ID NO: 305971 - protein, 26 aa, Mycobacterium
FARLRFPGRDGLFWIYLATLMIPATV

SEQ ID NO: 305972 - protein, 27 aa, Mycobacterium
FARPRRRAFATCWSQIVAICGLLLGAG

SEQ ID NO: 305973 - protein, 17 aa, Mycobacterium
FARSMARYRAHGSTSVT

SEQ ID NO: 305974 - protein, 20 aa, Mycobacterium
FARTEFQAVQFMPLVIAPQL

SEQ ID NO: 305975 - protein, 18 aa, Mycobacterium
FASFAVNYLLQWLAGGPN

SEQ ID NO: 305976 - protein, 24 aa, Mycobacterium
FASGHGFRRFVVVYSDLFEIGGEA

SEQ ID NO: 305977 - protein, 26 aa, Mycobacterium
FASGPLHLGGICWRGRNQRPVVTGAA

SEQ ID NO: 305978 - protein, 24 aa, Mycobacterium
FASGPLHMGYVCFRGRNQRPVITG

SEQ ID NO: 305979 - protein, 26 aa, Mycobacterium
FASHRQRFWFWLSVATLGFNVALNLA

SEQ ID NO: 305980 - protein, 23 aa, Mycobacterium
FASHSQRFWFWLSVATLALNIVL

SEQ ID NO: 305981 - protein, 18 aa, Mycobacterium
FASLPLHAFFGVVMMGMK

SEQ ID NO: 305982 - protein, 24 aa, Mycobacterium
FASLWCVYAAMLSILVLVHMVRRR

SEQ ID NO: 305983 - protein, 22 aa, Mycobacterium
FASQGHVLWLLGLALGLANIVG

SEQ ID NO: 305984 - protein, 21 aa, Mycobacterium
FASRTRDEWAAVFAGTDACVT

SEQ ID NO: 305985 - protein, 18 aa, Mycobacterium
FASRVPAEIACRLLHAPM

SEQ ID NO: 305986 - protein, 19 aa, Mycobacterium
FASTIPVAGSAYTFSYATF

SEQ ID NO: 305987 - protein, 26 aa, Mycobacterium
FASTPRLVIVPALFLSAAVLGFIMVG

SEQ ID NO: 305988 - protein, 30 aa, Mycobacterium
FASTVARLANHPSFGRRDLSSMRRGNLYPI

SEQ ID NO: 305989 - protein, 19 aa, Mycobacterium
FASVIFLYVLQRIQGVLPL

SEQ ID NO: 305990 - protein, 27 aa, Mycobacterium
FATASPGKWDTLRAMGFDDDHIANSRT

SEQ ID NO: 305991 - protein, 17 aa, Mycobacterium
FATAWPANVWLIRRGIK

SEQ ID NO: 305992 - protein, 25 aa, Mycobacterium
FATGADPLLAWMFWTGLLITAADVL

SEQ ID NO: 305993 - protein, 18 aa, Mycobacterium
FATGWSAFGLRVALVPLF

SEQ ID NO: 305994 - protein, 17 aa, Mycobacterium
FATGYTWVLTLIAISVV

SEQ ID NO: 305995 - protein, 29 aa, Mycobacterium
FATLPTYRYGWWPATAITVVALILLAVTV

SEQ ID NO: 305996 - protein, 24 aa, Mycobacterium
FATMLHYWPFLFFASGVVSITFVS

SEQ ID NO: 305997 - protein, 25 aa, Mycobacterium
FATMRMVLAPLVFPGIAAGSIFTFS

SEQ ID NO: 305998 - protein, 17 aa, Mycobacterium
FATMWRYAGFAFTNSAF

SEQ ID NO: 305999 - protein, 25 aa, Mycobacterium
FATQAFKASLPWLAGAIGTPDVPVV

SEQ ID NO: 306000 - protein, 19 aa, Mycobacterium
FATRRTLVFRRFVRNKPAV

SEQ ID NO: 306001 - protein, 19 aa, Mycobacterium
FATVAIFGLMGWNVRLGEA

SEQ ID NO: 306002 - protein, 23 aa, Mycobacterium
FAVAEMYGAILIVGALALIANLG

SEQ ID NO: 306003 - protein, 26 aa, Mycobacterium
FAVALAYKLARPHLDTSVPLQLCDVA

SEQ ID NO: 306004 - protein, 21 aa, Mycobacterium
FAVAVLTIWQVFRPLSQGSQY

SEQ ID NO: 306005 - protein, 27 aa, Mycobacterium
FAVCCVLSFVVGFAMLGALTFLPTYMQ

SEQ ID NO: 306006 - protein, 21 aa, Mycobacterium
FAVCGLLFWRLRDFDRKTSDR

SEQ ID NO: 306007 - protein, 17 aa, Mycobacterium
FAVCGVAGFALGPFLVG

SEQ ID NO: 306008 - protein, 20 aa, Mycobacterium
FAVDLKYGIEVSVGSALFSK

SEQ ID NO: 306009 - protein, 19 aa, Mycobacterium
FAVFALPLVLTRPVPDPAA

SEQ ID NO: 306010 - protein, 19 aa, Mycobacterium
FAVFDWLFWLFSILIATLV

SEQ ID NO: 306011 - protein, 20 aa, Mycobacterium
FAVGGEWAGSALLSIESAPA

SEQ ID NO: 306012 - protein, 17 aa, Mycobacterium
FAVGIPFANHWYDASRR

SEQ ID NO: 306013 - protein, 20 aa, Mycobacterium
FAVGLEWDPYPFILLNLAFS

SEQ ID NO: 306014 - protein, 22 aa, Mycobacterium
FAVGPLWLWVWVLLLPIAFGAL

SEQ ID NO: 306015 - protein, 20 aa, Mycobacterium
FAVGVIRLGQRRCLVQELPA

SEQ ID NO: 306016 - protein, 19 aa, Mycobacterium
FAVGVVRLGQRRCLVQELP

SEQ ID NO: 306017 - protein, 24 aa, Mycobacterium
FAVGWWLLDVVWRPVRGRLADAAT

SEQ ID NO: 306018 - protein, 25 aa, Mycobacterium
FAVIEFAEKLLIPWHSSRRTVGSAT

SEQ ID NO: 306019 - protein, 24 aa, Mycobacterium
FAVLAAVLLSVGWIVGRFGGYEGV

SEQ ID NO: 306020 - protein, 23 aa, Mycobacterium
FAVLCAAASYIAVPAVQRLAIPE

SEQ ID NO: 306021 - protein, 18 aa, Mycobacterium
FAVLRGATVLGFKRRLLH

SEQ ID NO: 306022 - protein, 25 aa, Mycobacterium
FAVLSWVAGVGLGWLTALAGSVKII

SEQ ID NO: 306023 - protein, 17 aa, Mycobacterium
FAVLVKLGQDYLPTRPG

SEQ ID NO: 306024 - protein, 19 aa, Mycobacterium
FAVMFCFFQVVFTVAAPLQ

SEQ ID NO: 306025 - protein, 17 aa, Mycobacterium
FAVPAPIGAVVEALTLN

SEQ ID NO: 306026 - protein, 29 aa, Mycobacterium
FAVPGIAGLLGRWFWWSPPAFLLGPLRRR

SEQ ID NO: 306027 - protein, 19 aa, Mycobacterium
FAVSLSRRSSRVIKQNLWA

SEQ ID NO: 306028 - protein, 18 aa, Mycobacterium
FAVTLGWLPTSGMYNPRF

SEQ ID NO: 306029 - protein, 25 aa, Mycobacterium
FAVVAFAWRRPRFDPDKPGHPLPEW

SEQ ID NO: 306030 - protein, 21 aa, Mycobacterium
FAVVALAWRKPRFDTNRTGRP

SEQ ID NO: 306031 - protein, 18 aa, Mycobacterium
FAVVLSLPVTVLVAGFGV

SEQ ID NO: 306032 - protein, 28 aa, Mycobacterium
FAVVPAHWQEWMPAGLFFVAVALFQLIW

SEQ ID NO: 306033 - protein, 21 aa, Mycobacterium
FAVVRPRGWPEAVAALPAALS

SEQ ID NO: 306034 - protein, 26 aa, Mycobacterium
FAWETGSLWVAFAIGLLLGGIEPDAG

SEQ ID NO: 306035 - protein, 23 aa, Mycobacterium
FAYKKIWWPLAVWLLLVAVEVDA

SEQ ID NO: 306036 - protein, 25 aa, Mycobacterium
FAYTKVCSHLGCPASLYEQQTYRIL

SEQ ID NO: 306037 - protein, 17 aa, Mycobacterium
FCAIVCAAYPYLLKGPD

SEQ ID NO: 306038 - protein, 28 aa, Mycobacterium
FCANCGAAHHPAEKFCPNCGKKIPAGES

SEQ ID NO: 306039 - protein, 21 aa, Mycobacterium
FCAVLALPIVPIFAYSRTAAM

SEQ ID NO: 306040 - protein, 22 aa, Mycobacterium
FCAVLALPIVPLFAYSRGAAML

SEQ ID NO: 306041 - protein, 19 aa, Mycobacterium
FCAVVQRPALAHVDDRAML

SEQ ID NO: 306042 - protein, 18 aa, Mycobacterium
FCDLLGSHYVHFEHEVVI

SEQ ID NO: 306043 - protein, 17 aa, Mycobacterium
FCGLLVATGSYLLTEFA

SEQ ID NO: 306044 - protein, 19 aa, Mycobacterium
FCGLVAAAWVLRKPQYRSL

SEQ ID NO: 306045 - protein, 17 aa, Mycobacterium
FCHDLTEIVLLRGLQGV

SEQ ID NO: 306046 - protein, 26 aa, Mycobacterium
FCLHFARLAYFKALGIPSALGLLVVI

SEQ ID NO: 306047 - protein, 17 aa, Mycobacterium
FCLLAPVAVVPVAIPDG

SEQ ID NO: 306048 - protein, 22 aa, Mycobacterium
FCLNFTRLPYFQPLGIPCAIGI

SEQ ID NO: 306049 - protein, 22 aa, Mycobacterium
FCLTFTRLPYFHTMGVPCAIGM

SEQ ID NO: 306050 - protein, 26 aa, Mycobacterium
FCLTSTLWFFLTWFPTYLVEYRGMDY

SEQ ID NO: 306051 - protein, 26 aa, Mycobacterium
FCNSPFCWIGGFAFGLLATLLAGSTL

SEQ ID NO: 306052 - protein, 19 aa, Mycobacterium
FCNSPFFWIGGFAFGLLAT

SEQ ID NO: 306053 - protein, 20 aa, Mycobacterium
FCNSPFFWVGGLAFALLASM

SEQ ID NO: 306054 - protein, 24 aa, Mycobacterium
FCPHLAAPMADGWMDRGRLVCPWH

SEQ ID NO: 306055 - protein, 19 aa, Mycobacterium
FCQVCGTATAALARHPAPD

SEQ ID NO: 306056 - protein, 19 aa, Mycobacterium
FCVAAALTVHAARRGLSFT

SEQ ID NO: 306057 - protein, 17 aa, Mycobacterium
FCVAYQRVASVGPQQLS

SEQ ID NO: 306058 - protein, 25 aa, Mycobacterium
FCVHPASGLSWQFAGLKRHLPRQIP

SEQ ID NO: 306059 - protein, 20 aa, Mycobacterium
FCVIGSGSIAVWMFAEPGLQ

SEQ ID NO: 306060 - protein, 25 aa, Mycobacterium
FCVIPAVAGVLSWLMLGERPDVGIA

SEQ ID NO: 306061 - protein, 23 aa, Mycobacterium
FCVLLYLLPLILGRWRGETTHDR

SEQ ID NO: 306062 - protein, 23 aa, Mycobacterium
FCYVVGCLAAVLAVRQSGVFTAV

SEQ ID NO: 306063 - protein, 18 aa, Mycobacterium
FDAAALASIGDNVAEATE

SEQ ID NO: 306064 - protein, 24 aa, Mycobacterium
FDADGKLVEPVRFASLYDDDADAQ

SEQ ID NO: 306065 - protein, 18 aa, Mycobacterium
FDALAGICAHVRSGGGGL

SEQ ID NO: 306066 - protein, 17 aa, Mycobacterium
FDAQGFVTLAWWMAVFP

SEQ ID NO: 306067 - protein, 24 aa, Mycobacterium
FDDAELRSTIGFFAEDAHIFATTV

SEQ ID NO: 306068 - protein, 17 aa, Mycobacterium
FDDARAAAVWTAVTMWT

SEQ ID NO: 306069 - protein, 41 aa, Mycobacterium
FDDFWRPLRSYFYWEQHCFDIPICWSLRSLFDATDGVDKLS

SEQ ID NO: 306070 - protein, 22 aa, Mycobacterium
FDDPGGWLRHIILPGLTVGLVA

SEQ ID NO: 306071 - protein, 18 aa, Mycobacterium
FDDYDYGPEFGDDAEAGE

SEQ ID NO: 306072 - protein, 25 aa, Mycobacterium
FDEAGLRRAVTFFAEDAHVFATTVR

SEQ ID NO: 306073 - protein, 18 aa, Mycobacterium
FDEPIPSATALHLPLDDP

SEQ ID NO: 306074 - protein, 25 aa, Mycobacterium
FDFEAQGVWTFARPGFPPLKLDQSL

SEQ ID NO: 306075 - protein, 18 aa, Mycobacterium
FDFSARKDLYIAYVPFAV

SEQ ID NO: 306076 - protein, 19 aa, Mycobacterium
FDGAESILLATAMLGATVM

SEQ ID NO: 306077 - protein, 24 aa, Mycobacterium
FDGFRPDRWDVIGALVCLAGVTII

SEQ ID NO: 306078 - protein, 19 aa, Mycobacterium
FDGLGGRRVDLPTYGFVRQ

SEQ ID NO: 306079 - protein, 18 aa, Mycobacterium
FDGLLARNYGMATEFGAF

SEQ ID NO: 306080 - protein, 29 aa, Mycobacterium
FDGLPPHFLNWLFGLFGALALIAAAIVLF

SEQ ID NO: 306081 - protein, 17 aa, Mycobacterium
FDGNAWTLAAPIPTPRQ

SEQ ID NO: 306082 - protein, 17 aa, Mycobacterium
FDGNRLGLVHIGDSRGY

SEQ ID NO: 306083 - protein, 17 aa, Mycobacterium
FDGNSWKDAADMPTPRE

SEQ ID NO: 306084 - protein, 19 aa, Mycobacterium
FDGPLGWAGKLGVALSVGV

SEQ ID NO: 306085 - protein, 24 aa, Mycobacterium
FDGRLPWLHILAALGTVVGVTVSV

SEQ ID NO: 306086 - protein, 26 aa, Mycobacterium
FDHMPELNWTFGYPLALLVMATVCVV

SEQ ID NO: 306087 - protein, 17 aa, Mycobacterium
FDHYRSGPITVELFSGA

SEQ ID NO: 306088 - protein, 25 aa, Mycobacterium
FDIDIARNLPLLPSLYAQPATVATG

SEQ ID NO: 306089 - protein, 22 aa, Mycobacterium
FDIEIVFLYPWAVAFDSLGLFA

SEQ ID NO: 306090 - protein, 23 aa, Mycobacterium
FDIEIVFLYPWAVSYDALGTFAL

SEQ ID NO: 306091 - protein, 21 aa, Mycobacterium
FDIPICASLRSLFDAIDGVDK

SEQ ID NO: 306092 - protein, 17 aa, Mycobacterium
FDIPRGRLEELYESGYA

SEQ ID NO: 306093 - protein, 24 aa, Mycobacterium
FDIVVCVLSLLVLAVLLFTGPLAG

SEQ ID NO: 306094 - protein, 23 aa, Mycobacterium
FDKDEFLKVMLRWLNAFVSKPGQ

SEQ ID NO: 306095 - protein, 18 aa, Mycobacterium
FDKPSRILLINQFGINVG

SEQ ID NO: 306096 - protein, 18 aa, Mycobacterium
FDKVEGFVYCRPEEAEAE

SEQ ID NO: 306097 - protein, 26 aa, Mycobacterium
FDKVSFGYRPGVPVIRDVSLQLRPGT

SEQ ID NO: 306098 - protein, 19 aa, Mycobacterium
FDLAARWGGDEFLVITRCV

SEQ ID NO: 306099 - protein, 17 aa, Mycobacterium
FDLALAYFIAVVDASAI

SEQ ID NO: 306100 - protein, 19 aa, Mycobacterium
FDLAVAVFFALSGFLLWRP

SEQ ID NO: 306101 - protein, 19 aa, Mycobacterium
FDLGICLVLITLPTLALFV

SEQ ID NO: 306102 - protein, 18 aa, Mycobacterium
FDLIWEFLQDPIGNTIKI

SEQ ID NO: 306103 - protein, 23 aa, Mycobacterium
FDLLKRYHKGLEQVLVFLPQGAS

SEQ ID NO: 306104 - protein, 19 aa, Mycobacterium
FDLSAEIPLKAALFRVTDN

SEQ ID NO: 306105 - protein, 21 aa, Mycobacterium
FDLTGEIPLRVDVLRSGPEDH

SEQ ID NO: 306106 - protein, 17 aa, Mycobacterium
FDMAESLLVSALVTLTG

SEQ ID NO: 306107 - protein, 18 aa, Mycobacterium
FDMAMLAALSVVYSAVVW

SEQ ID NO: 306108 - protein, 24 aa, Mycobacterium
FDMETRIAVELTRREEDLPWEDGD

SEQ ID NO: 306109 - protein, 17 aa, Mycobacterium
FDMGILGLLSLVMAGFV

SEQ ID NO: 306110 - protein, 25 aa, Mycobacterium
FDMWRGLGIYDTWLGLIIPYLTFAL

SEQ ID NO: 306111 - protein, 25 aa, Mycobacterium
FDNDPLTAWRCQWKEQDGQSITAKF

SEQ ID NO: 306112 - protein, 18 aa, Mycobacterium
FDNMPAMLVILLTATTLL

SEQ ID NO: 306113 - protein, 17 aa, Mycobacterium
FDNPDFQRGLKLFLSPD

SEQ ID NO: 306114 - protein, 17 aa, Mycobacterium
FDNPDFQRGLKLFLSSD

SEQ ID NO: 306115 - protein, 17 aa, Mycobacterium
FDPATVMTRHGRYANTA

SEQ ID NO: 306116 - protein, 27 aa, Mycobacterium
FDPELQKWVAVCLYKGFVDVYEAFVGP

SEQ ID NO: 306117 - protein, 35 aa, Mycobacterium
FDPKRAIRTRGWRRIGTAIVRWPGAVLASACALAL

SEQ ID NO: 306118 - protein, 35 aa, Mycobacterium
FDPKRMIKIRGWRRIGTVVVRWPGPVLAATIAIAL

SEQ ID NO: 306119 - protein, 21 aa, Mycobacterium
FDPKRTIGFGRWRRIGTAIVR

SEQ ID NO: 306120 - protein, 37 aa, Mycobacterium
FDPKRVLAFGRWRRIGTAIVRWPVPILAATIAVAVVG

SEQ ID NO: 306121 - protein, 50 aa, Mycobacterium
FDPKRVLQVRGWRRVGTAIVRWPLPILAVTCAVALVGLITLPGYRPSYND

SEQ ID NO: 306122 - protein, 24 aa, Mycobacterium
FDPLLVVAAVIEWILGGGAALGSV

SEQ ID NO: 306123 - protein, 20 aa, Mycobacterium
FDPLPPFLLQHMSGHYTNIN

SEQ ID NO: 306124 - protein, 31 aa, Mycobacterium
FDPNGKFTIGLLWSGEKAWKQSGERRMLCGL

SEQ ID NO: 306125 - protein, 27 aa, Mycobacterium
FDPNSKFTTSMLWSGDRAWRQAGERRM

SEQ ID NO: 306126 - protein, 32 aa, Mycobacterium
FDPNSKFTVSLLWPGDRAWRQSGDRRMLCGLQ

SEQ ID NO: 306127 - protein, 23 aa, Mycobacterium
FDPPPNLGLDCQYPPTTEPAAKP

SEQ ID NO: 306128 - protein, 17 aa, Mycobacterium
FDPVLSRLKELGCMGLM

SEQ ID NO: 306129 - protein, 25 aa, Mycobacterium
FDQRARSQLWLGLLSWAVVIGLYVV

SEQ ID NO: 306130 - protein, 17 aa, Mycobacterium
FDQSLADMPVHALTDRV

SEQ ID NO: 306131 - protein, 26 aa, Mycobacterium
FDQWNWWLPRWLDKILPEVDFEKPLP

SEQ ID NO: 306132 - protein, 23 aa, Mycobacterium
FDRAKAYWTRQGWAAQAPIKTES

SEQ ID NO: 306133 - protein, 23 aa, Mycobacterium
FDRAKERLAEPVLAVVASGAVIV

SEQ ID NO: 306134 - protein, 23 aa, Mycobacterium
FDRAQAYWTRLGWSARGPIKTAS

SEQ ID NO: 306135 - protein, 18 aa, Mycobacterium
FDRIKVPTLIIRGGENDW

SEQ ID NO: 306136 - protein, 17 aa, Mycobacterium
FDRLRHLVLPSLTLALA

SEQ ID NO: 306137 - protein, 19 aa, Mycobacterium
FDRYHTIQLPSYLGFFGGR

SEQ ID NO: 306138 - protein, 37 aa, Mycobacterium
FDSEYKYMATFCARSDLDGSGGHRCFVKGAPGVLLEH

SEQ ID NO: 306139 - protein, 20 aa, Mycobacterium
FDTWCTYNTWLFNRGSWSSN

SEQ ID NO: 306140 - protein, 17 aa, Mycobacterium
FDVCGIETFVKRIESVL

SEQ ID NO: 306141 - protein, 19 aa, Mycobacterium
FDVGKLLNGFEPLFTLLNP

SEQ ID NO: 306142 - protein, 17 aa, Mycobacterium
FDVIGVLLLSPGLAAFL

SEQ ID NO: 306143 - protein, 17 aa, Mycobacterium
FDVTDIGPLFVGSFKNA

SEQ ID NO: 306144 - protein, 26 aa, Mycobacterium
FDVTLCGLALCILGAAVVAGQLRGRR

SEQ ID NO: 306145 - protein, 18 aa, Mycobacterium
FDVVEKVVTLTCVSNPVG

SEQ ID NO: 306146 - protein, 25 aa, Mycobacterium
FDVYGNYVANWGFLVSYLLVVVATP

SEQ ID NO: 306147 - protein, 21 aa, Mycobacterium
FDYALPCFLTVVTMPFTYSIA

SEQ ID NO: 306148 - protein, 19 aa, Mycobacterium
FDYLWEELTPPPVPEQNGF

SEQ ID NO: 306149 - protein, 17 aa, Mycobacterium
FDYWMGWYVIVGTMPIG

SEQ ID NO: 306150 - protein, 23 aa, Mycobacterium
FEAEALFLPAHDPLASAVVAEAH

SEQ ID NO: 306151 - protein, 22 aa, Mycobacterium
FEAGGVPAHFWVPDAAEGANGT

SEQ ID NO: 306152 - protein, 24 aa, Mycobacterium
FEAGRGDVFLGLITPHGLIELTAV

SEQ ID NO: 306153 - protein, 19 aa, Mycobacterium
FEALKRVAVELNQTRAQLR

SEQ ID NO: 306154 - protein, 17 aa, Mycobacterium
FEALTPVLTERELFGAD

SEQ ID NO: 306155 - protein, 17 aa, Mycobacterium
FEAMSLPNLRYVTQAGG

SEQ ID NO: 306156 - protein, 20 aa, Mycobacterium
FEAPELDSHILLSVVLPPLL

SEQ ID NO: 306157 - protein, 19 aa, Mycobacterium
FECDSVVAAVSRLTTSQAP

SEQ ID NO: 306158 - protein, 20 aa, Mycobacterium
FECPFCSRVTGAIDEVRAHF

SEQ ID NO: 306159 - protein, 26 aa, Mycobacterium
FEDKSIRRRSLIYLGYSSFRAAAEDR

SEQ ID NO: 306160 - protein, 17 aa, Mycobacterium
FEGARLRSVNGLLGAAW

SEQ ID NO: 306161 - protein, 22 aa, Mycobacterium
FEGYEYLFWVGCAGAYEDRAKK

SEQ ID NO: 306162 - protein, 22 aa, Mycobacterium
FEHLDYAGPVRGYGWPRDLPRA

SEQ ID NO: 306163 - protein, 17 aa, Mycobacterium
FEHRFRRECGLAQRVRE

SEQ ID NO: 306164 - protein, 18 aa, Mycobacterium
FEINELFQKFTPVVKKVD

SEQ ID NO: 306165 - protein, 34 aa, Mycobacterium
FEIPALVLCVIWLRFLGGESWRSTAIVSVVTTAV

SEQ ID NO: 306166 - protein, 22 aa, Mycobacterium
FEIWIRRVGAYIIDVIPVALLS

SEQ ID NO: 306167 - protein, 18 aa, Mycobacterium
FEKAYAWVMGLKGRSFVG

SEQ ID NO: 306168 - protein, 25 aa, Mycobacterium
FEKYGPWAIILARFAPFVRTFVPPV

SEQ ID NO: 306169 - protein, 24 aa, Mycobacterium
FEKYGPWAIILARFAPFVRTFVPV

SEQ ID NO: 306170 - protein, 19 aa, Mycobacterium
FELARCGLPMPKLDTPSYT

SEQ ID NO: 306171 - protein, 25 aa, Mycobacterium
FELPFYRLVLSYLFVAVFLAFVANL

SEQ ID NO: 306172 - protein, 18 aa, Mycobacterium
FENMPAMLVILLTTTTLL

SEQ ID NO: 306173 - protein, 19 aa, Mycobacterium
FENPDFKRGMKMFLSPDGH

SEQ ID NO: 306174 - protein, 18 aa, Mycobacterium
FENYPIDVTERWDIEGLA

SEQ ID NO: 306175 - protein, 18 aa, Mycobacterium
FEPDVRFDGVDLLVHLQM

SEQ ID NO: 306176 - protein, 17 aa, Mycobacterium
FEPEGALALTVDRRDGV

SEQ ID NO: 306177 - protein, 25 aa, Mycobacterium
FEPGRSLWWSWAWVAGMVAYAGDLA

SEQ ID NO: 306178 - protein, 38 aa, Mycobacterium
FEPKRAMRTRGWRKLGAAVVRWPAPILVTTIALSVVGL

SEQ ID NO: 306179 - protein, 49 aa, Mycobacterium
FEPKRAMRTRGWRRIGTAIVRWPGPVLVVACALALVGLLALPGYKTSYD

SEQ ID NO: 306180 - protein, 17 aa, Mycobacterium
FEPLGVPAMVSRIADMA

SEQ ID NO: 306181 - protein, 23 aa, Mycobacterium
FEPLLAALRDFGCMALMMSGRCD

SEQ ID NO: 306182 - protein, 19 aa, Mycobacterium
FEPMHEITHFFNAFQAATS

SEQ ID NO: 306183 - protein, 39 aa, Mycobacterium
FEPPFRLKVMRGIVETCRIIPIIVTFGIGVGVLLTLQNI

SEQ ID NO: 306184 - protein, 17 aa, Mycobacterium
FEQALAFGEAPTEAQWG

SEQ ID NO: 306185 - protein, 21 aa, Mycobacterium
FEQFAGLIGAHIGPVAKIAWP

SEQ ID NO: 306186 - protein, 19 aa, Mycobacterium
FEQPIRRWRPARVPLLPLA

SEQ ID NO: 306187 - protein, 23 aa, Mycobacterium
FEQWLWQMYTTFYNNVIQPFVDW

SEQ ID NO: 306188 - protein, 25 aa, Mycobacterium
FEREARAAAALTHPHVVAVHDCGEH

SEQ ID NO: 306189 - protein, 17 aa, Mycobacterium
FERQAKRGRLWRRVGTA

SEQ ID NO: 306190 - protein, 23 aa, Mycobacterium
FERVFEVLDLEPLIAEEPDAMPV

SEQ ID NO: 306191 - protein, 25 aa, Mycobacterium
FERVFEVLDLVPLIRERPSAVEVPS

SEQ ID NO: 306192 - protein, 18 aa, Mycobacterium
FESGSRWVATTILEGQQW

SEQ ID NO: 306193 - protein, 17 aa, Mycobacterium
FESWRPITVAGLGTGAL

SEQ ID NO: 306194 - protein, 20 aa, Mycobacterium
FETADFKSGIKLFVSPNGHA

SEQ ID NO: 306195 - protein, 22 aa, Mycobacterium
FETPMLFSIGFLVTFLFGGLTG

SEQ ID NO: 306196 - protein, 25 aa, Mycobacterium
FEVGRRLRILIIAALAGAGISTQEH

SEQ ID NO: 306197 - protein, 26 aa, Mycobacterium
FEVGRRLRVRVVRALRRAGVVTSSDA

SEQ ID NO: 306198 - protein, 24 aa, Mycobacterium
FEVPADLPSGFLLIGDSASIPAIN

SEQ ID NO: 306199 - protein, 21 aa, Mycobacterium
FEVPVAGWGRTVVPVQPGRHR

SEQ ID NO: 306200 - protein, 22 aa, Mycobacterium
FEVRGGLFVRQVHHWAALIFAA

SEQ ID NO: 306201 - protein, 22 aa, Mycobacterium
FEVRGGLFVRQVHHWAALIFSA

SEQ ID NO: 306202 - protein, 22 aa, Mycobacterium
FEVRGGLFVRQVHHWAALMFAA

SEQ ID NO: 306203 - protein, 27 aa, Mycobacterium
FEVSPLRRILGLQTFWILGVLVLICLF

SEQ ID NO: 306204 - protein, 25 aa, Mycobacterium
FEVVGRRRLWFGISGAIVAVALLSI

SEQ ID NO: 306205 - protein, 25 aa, Mycobacterium
FEVVGRRRLWFGISGGIVAVALASI

SEQ ID NO: 306206 - protein, 20 aa, Mycobacterium
FEVYFVPAGYVFSIWSVIYL

SEQ ID NO: 306207 - protein, 17 aa, Mycobacterium
FEWSLNAGEVIQRVVER

SEQ ID NO: 306208 - protein, 19 aa, Mycobacterium
FFAALLAGLGLKADDVPNQ

SEQ ID NO: 306209 - protein, 17 aa, Mycobacterium
FFAALLVMQAMGMILEI

SEQ ID NO: 306210 - protein, 27 aa, Mycobacterium
FFAAVAVFQLCWARLVLVRTTNPVLAL

SEQ ID NO: 306211 - protein, 23 aa, Mycobacterium
FFAEFVGTFILVFTVFGVIHRRA

SEQ ID NO: 306212 - protein, 18 aa, Mycobacterium
FFALFLYVVGLLFIVISA

SEQ ID NO: 306213 - protein, 23 aa, Mycobacterium
FFAPGRFWWWSLAAVVGILAVPY

SEQ ID NO: 306214 - protein, 20 aa, Mycobacterium
FFAVMFCFFQVVFTVAAPLQ

SEQ ID NO: 306215 - protein, 18 aa, Mycobacterium
FFDAISFPTLIGPADGDW

SEQ ID NO: 306216 - protein, 19 aa, Mycobacterium
FFDEVWRPERNVGNMRMNL

SEQ ID NO: 306217 - protein, 20 aa, Mycobacterium
FFDKLMRQIQEFFSDPLGTL

SEQ ID NO: 306218 - protein, 19 aa, Mycobacterium
FFEFLTDLLDGWVAYYAEH

SEQ ID NO: 306219 - protein, 24 aa, Mycobacterium
FFEQRGPFAIVIARFVPIVRTLAP

SEQ ID NO: 306220 - protein, 30 aa, Mycobacterium
FFFFFFAAEVLKIWLPAWAAYLIIFAAMVF

SEQ ID NO: 306221 - protein, 28 aa, Mycobacterium
FFFFVIPRWPELMGETSPTLGTVLRIVT

SEQ ID NO: 306222 - protein, 32 aa, Mycobacterium
FFFLAELLDSWLWRWVAFLIVFALMVVTTVVL

SEQ ID NO: 306223 - protein, 32 aa, Mycobacterium
FFFLAELLDTWLWRWVAFLIVFAIMLVVTGAL

SEQ ID NO: 306224 - protein, 18 aa, Mycobacterium
FFFVGWFLYNSMPSGFIE

SEQ ID NO: 306225 - protein, 24 aa, Mycobacterium
FFFVLPRWPELMGDTAHSLGTGLR

SEQ ID NO: 306226 - protein, 23 aa, Mycobacterium
FFFVLPRWPELMGDTTHTLGTAL

SEQ ID NO: 306227 - protein, 17 aa, Mycobacterium
FFGALVLWMILRPLQTR

SEQ ID NO: 306228 - protein, 23 aa, Mycobacterium
FFGCTPLGPVAWTGVFGATAGAT

SEQ ID NO: 306229 - protein, 17 aa, Mycobacterium
FFGEKRWAPGAHPHEAP

SEQ ID NO: 306230 - protein, 18 aa, Mycobacterium
FFGEKVAFVAGWMYFLNW

SEQ ID NO: 306231 - protein, 23 aa, Mycobacterium
FFGGRIGATVGWALTGVVVAVIV

SEQ ID NO: 306232 - protein, 24 aa, Mycobacterium
FFGHVSPRFSTPVYAILAVAVISL

SEQ ID NO: 306233 - protein, 18 aa, Mycobacterium
FFGLGWRGAALAEIAVLW

SEQ ID NO: 306234 - protein, 24 aa, Mycobacterium
FFGTRSPVVFGWVFASHQVGAAIA

SEQ ID NO: 306235 - protein, 18 aa, Mycobacterium
FFGVFPILRNVVVGLTGV

SEQ ID NO: 306236 - protein, 18 aa, Mycobacterium
FFHVATWLLVWAGTIALL

SEQ ID NO: 306237 - protein, 21 aa, Mycobacterium
FFIGKVIDIHGAFGVPGTGER

SEQ ID NO: 306238 - protein, 17 aa, Mycobacterium
FFIPLLIGTGGNTGTQI

SEQ ID NO: 306239 - protein, 20 aa, Mycobacterium
FFIVGLEVTREFTIGELTDR

SEQ ID NO: 306240 - protein, 17 aa, Mycobacterium
FFIVWPVLILGITAIAV

SEQ ID NO: 306241 - protein, 31 aa, Mycobacterium
FFLAELLDTWLWRWVAFLIVFGLMVLTTGML

SEQ ID NO: 306242 - protein, 18 aa, Mycobacterium
FFLGLPVAILVSLAVFVL

SEQ ID NO: 306243 - protein, 17 aa, Mycobacterium
FFLLGVADDEAMRWMGR

SEQ ID NO: 306244 - protein, 23 aa, Mycobacterium
FFLLPPERIHTMVFAVLRGATVL

SEQ ID NO: 306245 - protein, 25 aa, Mycobacterium
FFLPPEVFDNPDFKRAMTSFLSPDG

SEQ ID NO: 306246 - protein, 25 aa, Mycobacterium
FFLPPEVFKNPDFQRAMSSFLSPDG

SEQ ID NO: 306247 - protein, 18 aa, Mycobacterium
FFLQFGLLLLAATILGRV

SEQ ID NO: 306248 - protein, 20 aa, Mycobacterium
FFLYATAAGLVFNKVFFPNE

SEQ ID NO: 306249 - protein, 18 aa, Mycobacterium
FFLYATAATLVFNKVFFA

SEQ ID NO: 306250 - protein, 18 aa, Mycobacterium
FFLYATAATLVFNKVFFP

SEQ ID NO: 306251 - protein, 17 aa, Mycobacterium
FFLYTFLGSLALLVGFI

SEQ ID NO: 306252 - protein, 17 aa, Mycobacterium
FFMVIAVQMKRMANQTH

SEQ ID NO: 306253 - protein, 17 aa, Mycobacterium
FFMVIVVQMKRMRNQSH

SEQ ID NO: 306254 - protein, 19 aa, Mycobacterium
FFNLFMMMFIIRTGIQILC

SEQ ID NO: 306255 - protein, 20 aa, Mycobacterium
FFNLFMMMFIIRTGIQILCD

SEQ ID NO: 306256 - protein, 24 aa, Mycobacterium
FFNLVGWPTWALILSSPFLLPAAL

SEQ ID NO: 306257 - protein, 34 aa, Mycobacterium
FFNLVGWPTWGMIFASPFLIPALAALGITGLVLL

SEQ ID NO: 306258 - protein, 20 aa, Mycobacterium
FFPLMGIGAFSMLAFSGRFG

SEQ ID NO: 306259 - protein, 17 aa, Mycobacterium
FFPQRLKGFALGLTGGI

SEQ ID NO: 306260 - protein, 25 aa, Mycobacterium
FFQPLGIPCAVGIAVAVLIALTLGP

SEQ ID NO: 306261 - protein, 28 aa, Mycobacterium
FFRAEPKAAVRWGLPVLSALTALVVVAA

SEQ ID NO: 306262 - protein, 19 aa, Mycobacterium
FFRAIPVLILMVFSYYLYG

SEQ ID NO: 306263 - protein, 24 aa, Mycobacterium
FFRPIRSYFYWEKHCYDIPICFSL

SEQ ID NO: 306264 - protein, 24 aa, Mycobacterium
FFRPIRSYFYWEKHCYDIPVCFAL

SEQ ID NO: 306265 - protein, 37 aa, Mycobacterium
FFRPMRSYFYWEKHCYDIPACWSLRSVFDGLDGIDTM

SEQ ID NO: 306266 - protein, 20 aa, Mycobacterium
FFSMDRWLLGHWPTTGRALE

SEQ ID NO: 306267 - protein, 18 aa, Mycobacterium
FFSPHSWWPILVALSGSV

SEQ ID NO: 306268 - protein, 21 aa, Mycobacterium
FFSVGWWPVFNVADPSVVGGA

SEQ ID NO: 306269 - protein, 18 aa, Mycobacterium
FFSYPAMLTVVGLLAAAC

SEQ ID NO: 306270 - protein, 23 aa, Mycobacterium
FFTGWTYWFCWIVTGVAEVVAIA

SEQ ID NO: 306271 - protein, 18 aa, Mycobacterium
FFTLPHLFLYSGSAISGI

SEQ ID NO: 306272 - protein, 19 aa, Mycobacterium
FFTSFAFPLACYFATIERQ

SEQ ID NO: 306273 - protein, 18 aa, Mycobacterium
FFVARFFTGSGIGGEYAA

SEQ ID NO: 306274 - protein, 23 aa, Mycobacterium
FFVKGMWRKGLVLLGISLGIGVV

SEQ ID NO: 306275 - protein, 30 aa, Mycobacterium
FFVLCAWLKDFRGFFGIGFAVLAALLVIAG

SEQ ID NO: 306276 - protein, 18 aa, Mycobacterium
FFVLDWTTPGPLRQMVRA

SEQ ID NO: 306277 - protein, 17 aa, Mycobacterium
FFVLRLLPQFVWRKMPR

SEQ ID NO: 306278 - protein, 18 aa, Mycobacterium
FFVNLSVAAFRRSRSAAG

SEQ ID NO: 306279 - protein, 19 aa, Mycobacterium
FFVVIGLVALYIVVQLARQ

SEQ ID NO: 306280 - protein, 17 aa, Mycobacterium
FFVVRRAVLRQALDEGV

SEQ ID NO: 306281 - protein, 21 aa, Mycobacterium
FFWVGGLAFALLASMIAGATL

SEQ ID NO: 306282 - protein, 19 aa, Mycobacterium
FFYDGELFIIGRIKDLLIV

SEQ ID NO: 306283 - protein, 23 aa, Mycobacterium
FFYPHRRKGFALGFNAGAGNLGV

SEQ ID NO: 306284 - protein, 20 aa, Mycobacterium
FFYYSGRLSTMIKTAGANVS

SEQ ID NO: 306285 - protein, 18 aa, Mycobacterium
FGAAVAFTVLMYAVVEVI

SEQ ID NO: 306286 - protein, 26 aa, Mycobacterium
FGADGYPQMLLRVGWAPVNADPLPST

SEQ ID NO: 306287 - protein, 19 aa, Mycobacterium
FGAELWEWVNPNNVVRSGA

SEQ ID NO: 306288 - protein, 18 aa, Mycobacterium
FGAGLFVAFDELWRWNSI

SEQ ID NO: 306289 - protein, 44 aa, Mycobacterium
FGAGLFVAFDQLWKWNNIIALVLSVLVILGLVVGVRLVRKTEDI

SEQ ID NO: 306290 - protein, 21 aa, Mycobacterium
FGAGLFVAFDQLWKWNTIVAL

SEQ ID NO: 306291 - protein, 20 aa, Mycobacterium
FGAGPHRCFGAAMGYLEAQF

SEQ ID NO: 306292 - protein, 18 aa, Mycobacterium
FGAGSGVGFMIRKAYQEF

SEQ ID NO: 306293 - protein, 18 aa, Mycobacterium
FGAGVLLGLACATKWSGL

SEQ ID NO: 306294 - protein, 23 aa, Mycobacterium
FGAHPRRTWARPSRFGMRESALI

SEQ ID NO: 306295 - protein, 27 aa, Mycobacterium
FGAHVLLRMDWQLALLLGAIVSSTDAA

SEQ ID NO: 306296 - protein, 18 aa, Mycobacterium
FGAIAAWATRWYLGTLAN

SEQ ID NO: 306297 - protein, 22 aa, Mycobacterium
FGALAGAFGEFFYKDPRRISAA

SEQ ID NO: 306298 - protein, 34 aa, Mycobacterium
FGALFFCLSLTPSLMPRTWLFQGLIGGATAAIGY

SEQ ID NO: 306299 - protein, 25 aa, Mycobacterium
FGALFGRTALILAVLFAVGMNVYVY

SEQ ID NO: 306300 - protein, 26 aa, Mycobacterium
FGALGDRLGRKWVLMLTIALMGGSST

SEQ ID NO: 306301 - protein, 26 aa, Mycobacterium
FGALGVLLCLLLGVAIVTQVRQNESG

SEQ ID NO: 306302 - protein, 34 aa, Mycobacterium
FGALVADARPGDTLYGLHAMMFNEPRVSDDPIVL

SEQ ID NO: 306303 - protein, 18 aa, Mycobacterium
FGAMALVAVTAYLHAGWY

SEQ ID NO: 306304 - protein, 24 aa, Mycobacterium
FGAMVVVCMIWRLFMQDKRSDGGA

SEQ ID NO: 306305 - protein, 22 aa, Mycobacterium
FGAPLAMEGLMAFFFESTFIGL

SEQ ID NO: 306306 - protein, 22 aa, Mycobacterium
FGAPLAMEGLMAFFFESTFLGL

SEQ ID NO: 306307 - protein, 20 aa, Mycobacterium
FGAPPARWPVTLHVLPNVRD

SEQ ID NO: 306308 - protein, 20 aa, Mycobacterium
FGAPPARWPVTLYVLPTVRD

SEQ ID NO: 306309 - protein, 18 aa, Mycobacterium
FGAPYTRFNGRLGPERAV

SEQ ID NO: 306310 - protein, 26 aa, Mycobacterium
FGASAFPQMMLRVGWAPVNADPLPPT

SEQ ID NO: 306311 - protein, 20 aa, Mycobacterium
FGASDFTFWALRPTPNALLG

SEQ ID NO: 306312 - protein, 18 aa, Mycobacterium
FGATPIGGTGGWLRTGDL

SEQ ID NO: 306313 - protein, 17 aa, Mycobacterium
FGATRVRHWFASPRTWR

SEQ ID NO: 306314 - protein, 28 aa, Mycobacterium
FGAVLVGAFMLFSWFRTRSRRRAEIEAA

SEQ ID NO: 306315 - protein, 21 aa, Mycobacterium
FGCVGIIALTFIKLFGAAAPG

SEQ ID NO: 306316 - protein, 17 aa, Mycobacterium
FGDAIAPGIVLAQAIGR

SEQ ID NO: 306317 - protein, 18 aa, Mycobacterium
FGDEKPYRAHFSNVSGLE

SEQ ID NO: 306318 - protein, 26 aa, Mycobacterium
FGDEYRADGTLLAWLTAAAVAIAMLT

SEQ ID NO: 306319 - protein, 17 aa, Mycobacterium
FGDHGNWVIGAPDVLLD

SEQ ID NO: 306320 - protein, 22 aa, Mycobacterium
FGDMRSAFYAGYEEADREHVLI

SEQ ID NO: 306321 - protein, 28 aa, Mycobacterium
FGEAPRTNWWAIVSLIFGVIGGVLIALV

SEQ ID NO: 306322 - protein, 18 aa, Mycobacterium
FGEFFYKDPRRISAAITL

SEQ ID NO: 306323 - protein, 23 aa, Mycobacterium
FGEGEPLLHAGIPAISLVTAPLY

SEQ ID NO: 306324 - protein, 17 aa, Mycobacterium
FGEKTSTYKAEFSNVTG

SEQ ID NO: 306325 - protein, 19 aa, Mycobacterium
FGELFAFTKVCSHLGCPSS

SEQ ID NO: 306326 - protein, 23 aa, Mycobacterium
FGESMVRAAMWWQVLMVAVGLLG

SEQ ID NO: 306327 - protein, 24 aa, Mycobacterium
FGEYLPWRGFFRLFSSSADRAGYF

SEQ ID NO: 306328 - protein, 21 aa, Mycobacterium
FGEYLPWRSFFAHFSEYADRA

SEQ ID NO: 306329 - protein, 24 aa, Mycobacterium
FGFASLRIAAYALWPFGRTIVDKP

SEQ ID NO: 306330 - protein, 24 aa, Mycobacterium
FGFASLRIAAYALWPFGRTIVEKP

SEQ ID NO: 306331 - protein, 24 aa, Mycobacterium
FGFASLRIASYALWPFGRTIVEKP

SEQ ID NO: 306332 - protein, 21 aa, Mycobacterium
FGFFAQYAVFFAIDRGLGPVD

SEQ ID NO: 306333 - protein, 19 aa, Mycobacterium
FGFFGEACVNVLALNLDLD

SEQ ID NO: 306334 - protein, 18 aa, Mycobacterium
FGFGCAMTGLSTVVQERA

SEQ ID NO: 306335 - protein, 19 aa, Mycobacterium
FGFGVIFGAIWAEETWGRF

SEQ ID NO: 306336 - protein, 17 aa, Mycobacterium
FGFRITGGLGYAAAFLL

SEQ ID NO: 306337 - protein, 24 aa, Mycobacterium
FGGAGAIMYVACWLLMPTARYTTP

SEQ ID NO: 306338 - protein, 17 aa, Mycobacterium
FGGDFPGTILIPRLYAL

SEQ ID NO: 306339 - protein, 19 aa, Mycobacterium
FGGGLFVAFDQLWRWNSIV

SEQ ID NO: 306340 - protein, 25 aa, Mycobacterium
FGGGLLPLVGTWGFDQISWLIPAHW

SEQ ID NO: 306341 - protein, 26 aa, Mycobacterium
FGGGVKRCLGAAFSMRELVTVLHVLL

SEQ ID NO: 306342 - protein, 26 aa, Mycobacterium
FGGIHEIYFPYVLMKPKLIIATILGG

SEQ ID NO: 306343 - protein, 24 aa, Mycobacterium
FGGIRLTGRVGALSRAARIQLISL

SEQ ID NO: 306344 - protein, 23 aa, Mycobacterium
FGGKGGVMGTFIAVLLLSVLRNL

SEQ ID NO: 306345 - protein, 38 aa, Mycobacterium
FGGKVSFVALMVLGLIALVIGVAGGWVGRTTAEVVSAF

SEQ ID NO: 306346 - protein, 20 aa, Mycobacterium
FGGLLGVMYSIPLRRALVTG

SEQ ID NO: 306347 - protein, 24 aa, Mycobacterium
FGGLLWWVAFGMRDRLLVVATLIC

SEQ ID NO: 306348 - protein, 22 aa, Mycobacterium
FGGNSFGTWLFFILAVVLFIGF

SEQ ID NO: 306349 - protein, 17 aa, Mycobacterium
FGGPGFPAPVDVMTSPP

SEQ ID NO: 306350 - protein, 22 aa, Mycobacterium
FGGPKCLVKVIQKISGLSVNRF

SEQ ID NO: 306351 - protein, 24 aa, Mycobacterium
FGGPKCLVKVIQKMSGLNINRFLG

SEQ ID NO: 306352 - protein, 20 aa, Mycobacterium
FGGPQIPWWILTALVLAAVA

SEQ ID NO: 306353 - protein, 21 aa, Mycobacterium
FGGQVSYLALIVLAVIALVIG

SEQ ID NO: 306354 - protein, 17 aa, Mycobacterium
FGGRNWTVFSALVLAVP

SEQ ID NO: 306355 - protein, 17 aa, Mycobacterium
FGGRNWTVFSALVLLIP

SEQ ID NO: 306356 - protein, 17 aa, Mycobacterium
FGGSASYATLVETTSDF

SEQ ID NO: 306357 - protein, 28 aa, Mycobacterium
FGGSGFKAFWYHFAIMFEALFILTTVDA

SEQ ID NO: 306358 - protein, 19 aa, Mycobacterium
FGGSNFFAAYTIEMIVLVE

SEQ ID NO: 306359 - protein, 18 aa, Mycobacterium
FGGTVIGVFGMLPTAMFA

SEQ ID NO: 306360 - protein, 21 aa, Mycobacterium
FGGVEHGHWIALTVLVVLRPE

SEQ ID NO: 306361 - protein, 19 aa, Mycobacterium
FGHDLRAAVFTHVTTFSAE

SEQ ID NO: 306362 - protein, 19 aa, Mycobacterium
FGHDPWWLILAKSLGVFVF

SEQ ID NO: 306363 - protein, 20 aa, Mycobacterium
FGHDPWWLMLAKAVAIFVFL

SEQ ID NO: 306364 - protein, 24 aa, Mycobacterium
FGHLDAGLFFIAFVRNPVTQFVPM

SEQ ID NO: 306365 - protein, 25 aa, Mycobacterium
FGHQSSYGYLVWVFVAVFVVGLLDL

SEQ ID NO: 306366 - protein, 17 aa, Mycobacterium
FGHVEVRIGKPMDFSRF

SEQ ID NO: 306367 - protein, 20 aa, Mycobacterium
FGIAEGFYIPAYTALLPSLL

SEQ ID NO: 306368 - protein, 17 aa, Mycobacterium
FGIAGWVGEASGLTATN

SEQ ID NO: 306369 - protein, 17 aa, Mycobacterium
FGIARAAADPGLTQGGM

SEQ ID NO: 306370 - protein, 23 aa, Mycobacterium
FGICLGCQLYPLVARLRRARAAN

SEQ ID NO: 306371 - protein, 21 aa, Mycobacterium
FGIDFKGGTTVSFPRGDSQVT

SEQ ID NO: 306372 - protein, 24 aa, Mycobacterium
FGIDFKGGTTVSFPRGDVKVTEVE

SEQ ID NO: 306373 - protein, 25 aa, Mycobacterium
FGIFWGVQTWDVWDFDDRYPAAAVP

SEQ ID NO: 306374 - protein, 23 aa, Mycobacterium
FGIIMADYWLVRRSKINVLALFT

SEQ ID NO: 306375 - protein, 19 aa, Mycobacterium
FGILLAGLLTPLAGADTPD

SEQ ID NO: 306376 - protein, 19 aa, Mycobacterium
FGIRLNWLILAGLIYPLLY

SEQ ID NO: 306377 - protein, 18 aa, Mycobacterium
FGISTVFFGLSVLAILIA

SEQ ID NO: 306378 - protein, 19 aa, Mycobacterium
FGKDLGFYAFELPFYRLVL

SEQ ID NO: 306379 - protein, 20 aa, Mycobacterium
FGKGGLKGTAGWFDSMGMKP

SEQ ID NO: 306380 - protein, 17 aa, Mycobacterium
FGKLRAVEHDRYVVVAG

SEQ ID NO: 306381 - protein, 20 aa, Mycobacterium
FGKNWFDGWGGLLISLGLGL

SEQ ID NO: 306382 - protein, 21 aa, Mycobacterium
FGKNWMDGWHGLLISVVLGLA

SEQ ID NO: 306383 - protein, 24 aa, Mycobacterium
FGLAAAVCAACYFMMSNNVDSDGD

SEQ ID NO: 306384 - protein, 19 aa, Mycobacterium
FGLAAGAGAAWLFLQSFNS

SEQ ID NO: 306385 - protein, 18 aa, Mycobacterium
FGLAHIRPARAAGDSIPG

SEQ ID NO: 306386 - protein, 18 aa, Mycobacterium
FGLALAWLATVWASAGLA

SEQ ID NO: 306387 - protein, 22 aa, Mycobacterium
FGLALLLVFLFWPWQYKASGES

SEQ ID NO: 306388 - protein, 24 aa, Mycobacterium
FGLCGLPPPMLVIFVLTPVVASGS

SEQ ID NO: 306389 - protein, 17 aa, Mycobacterium
FGLELNWIAPVFGLIIL

SEQ ID NO: 306390 - protein, 18 aa, Mycobacterium
FGLFCLVFAQILFVFTGF

SEQ ID NO: 306391 - protein, 18 aa, Mycobacterium
FGLGCVAGAAGMARVHDY

SEQ ID NO: 306392 - protein, 25 aa, Mycobacterium
FGLGLALLAWFGFYLYKVSHGDVEE

SEQ ID NO: 306393 - protein, 17 aa, Mycobacterium
FGLGVAMVVTRLVAGLA

SEQ ID NO: 306394 - protein, 20 aa, Mycobacterium
FGLIGGRLYHLSTDWQTYFG

SEQ ID NO: 306395 - protein, 19 aa, Mycobacterium
FGLLGKWLHWPQLGLFCYL

SEQ ID NO: 306396 - protein, 17 aa, Mycobacterium
FGLLIWAALVLRRRELL

SEQ ID NO: 306397 - protein, 17 aa, Mycobacterium
FGLLVDHDFHIPLIGRW

SEQ ID NO: 306398 - protein, 17 aa, Mycobacterium
FGLLWPVIFAGGGGDAA

SEQ ID NO: 306399 - protein, 27 aa, Mycobacterium
FGLPGFRHSIGLARWWHLGVDVLWLLN

SEQ ID NO: 306400 - protein, 23 aa, Mycobacterium
FGLPNLPGLPGLPSFPGLPIPGF

SEQ ID NO: 306401 - protein, 18 aa, Mycobacterium
FGLQEVPDAYVVLGNGQI

SEQ ID NO: 306402 - protein, 17 aa, Mycobacterium
FGLSAGMIACYKGISVG

SEQ ID NO: 306403 - protein, 18 aa, Mycobacterium
FGLSVLIWQHLIGIELHW

SEQ ID NO: 306404 - protein, 19 aa, Mycobacterium
FGLSWWLGLYLLARNPRKP

SEQ ID NO: 306405 - protein, 25 aa, Mycobacterium
FGLTLMWLLSWLIATPVRVVRSALK

SEQ ID NO: 306406 - protein, 25 aa, Mycobacterium
FGLVARLPFAFAAGLGINSFLATTV

SEQ ID NO: 306407 - protein, 24 aa, Mycobacterium
FGLVAVFQLGWAVVMPVRPHAAVL

SEQ ID NO: 306408 - protein, 17 aa, Mycobacterium
FGLVMAVLTAFLFLVFS

SEQ ID NO: 306409 - protein, 19 aa, Mycobacterium
FGLWGGPGLGGFRDQLTDV

SEQ ID NO: 306410 - protein, 19 aa, Mycobacterium
FGMGLPITVGAGFSPSLQP

SEQ ID NO: 306411 - protein, 18 aa, Mycobacterium
FGMILRIVGIEWRGKIND

SEQ ID NO: 306412 - protein, 21 aa, Mycobacterium
FGMLRYCLQLFPDASTYFRPL

SEQ ID NO: 306413 - protein, 22 aa, Mycobacterium
FGMLRYCLQLFPGASTYFRPLI

SEQ ID NO: 306414 - protein, 24 aa, Mycobacterium
FGMSEMLHRVFGGMDLKAFWYHFA

SEQ ID NO: 306415 - protein, 22 aa, Mycobacterium
FGMVGMHYFWIGAVPAILFLGI

SEQ ID NO: 306416 - protein, 20 aa, Mycobacterium
FGNRLAAFIVARPDCDLDPE

SEQ ID NO: 306417 - protein, 30 aa, Mycobacterium
FGNTGADVFERGGPYLARGAADLVPSAQLL

SEQ ID NO: 306418 - protein, 17 aa, Mycobacterium
FGNTMGYELDIHSDMAF

SEQ ID NO: 306419 - protein, 17 aa, Mycobacterium
FGPAGGMLTGIAVTAAN

SEQ ID NO: 306420 - protein, 19 aa, Mycobacterium
FGPAHIMLAAAGVTAWSLV

SEQ ID NO: 306421 - protein, 25 aa, Mycobacterium
FGPAPEGMAIWIIGMVAAIGLALWI

SEQ ID NO: 306422 - protein, 25 aa, Mycobacterium
FGPAPEGMAMWIIGMVAAIGLALWI

SEQ ID NO: 306423 - protein, 25 aa, Mycobacterium
FGPAPEGMAMWIIGMVAAIGVAMWI

SEQ ID NO: 306424 - protein, 18 aa, Mycobacterium
FGPAQVMLAAAGVTAWSL

SEQ ID NO: 306425 - protein, 21 aa, Mycobacterium
FGPAVGFAFFPPAGVTVAAML

SEQ ID NO: 306426 - protein, 19 aa, Mycobacterium
FGPDYANFVAVTGNDPGAK

SEQ ID NO: 306427 - protein, 20 aa, Mycobacterium
FGPDYGNFVAVTGNDPGAKT

SEQ ID NO: 306428 - protein, 24 aa, Mycobacterium
FGPEVLQRMAVPALELYTRGLYTD

SEQ ID NO: 306429 - protein, 18 aa, Mycobacterium
FGPGELWTLASEIETVNA

SEQ ID NO: 306430 - protein, 24 aa, Mycobacterium
FGPGRALYTLAFIDVWQWTPFMVL

SEQ ID NO: 306431 - protein, 18 aa, Mycobacterium
FGPKNVYLIGLAIFTAAS

SEQ ID NO: 306432 - protein, 19 aa, Mycobacterium
FGPKVMRLPFSRRLATYAI

SEQ ID NO: 306433 - protein, 18 aa, Mycobacterium
FGPLAGRYFPPMGSILYW

SEQ ID NO: 306434 - protein, 18 aa, Mycobacterium
FGPLAGRYFPPMGSVLYW

SEQ ID NO: 306435 - protein, 24 aa, Mycobacterium
FGPLRRRATASLAIAGERRRRERE

SEQ ID NO: 306436 - protein, 19 aa, Mycobacterium
FGPNIGFYVPIVFGTSYAA

SEQ ID NO: 306437 - protein, 17 aa, Mycobacterium
FGPPGTVADISYFDVNS

SEQ ID NO: 306438 - protein, 17 aa, Mycobacterium
FGPRRHPYGLLYSTFVS

SEQ ID NO: 306439 - protein, 18 aa, Mycobacterium
FGPSDCRVNPAVLSALDP

SEQ ID NO: 306440 - protein, 19 aa, Mycobacterium
FGPTVSRLVDIGAVAADYT

SEQ ID NO: 306441 - protein, 17 aa, Mycobacterium
FGPVGALAAATIQRAPR

SEQ ID NO: 306442 - protein, 25 aa, Mycobacterium
FGPVSWAGGIGFRVVQLMGPEALET

SEQ ID NO: 306443 - protein, 19 aa, Mycobacterium
FGPYAGWSPKFLKHGRLSD

SEQ ID NO: 306444 - protein, 20 aa, Mycobacterium
FGPYAGWSPKFLKQGHFSDL

SEQ ID NO: 306445 - protein, 17 aa, Mycobacterium
FGPYELRSLIGEGATGE

SEQ ID NO: 306446 - protein, 22 aa, Mycobacterium
FGPYRLRRLLGRGGMGEVYEAH

SEQ ID NO: 306447 - protein, 17 aa, Mycobacterium
FGPYVGWMAGWGQVVAC

SEQ ID NO: 306448 - protein, 27 aa, Mycobacterium
FGPYVGWMCGWGMVIATIIVLSNLASI

SEQ ID NO: 306449 - protein, 17 aa, Mycobacterium
FGQDGRGGLYWFSHGFN

SEQ ID NO: 306450 - protein, 20 aa, Mycobacterium
FGQMRFDRTTGYSAIFSNAS

SEQ ID NO: 306451 - protein, 18 aa, Mycobacterium
FGQPHLSSTLGLLPDADV

SEQ ID NO: 306452 - protein, 26 aa, Mycobacterium
FGQPNREALVFIGLALLIWLPAIRCP

SEQ ID NO: 306453 - protein, 36 aa, Mycobacterium
FGQRKLLKWSIPGLAHFFTMWGFFILLTVYIEAYGL

SEQ ID NO: 306454 - protein, 36 aa, Mycobacterium
FGQRRLLKWSIPGLAHFFTMWGFFILLTVYIEAYGL

SEQ ID NO: 306455 - protein, 20 aa, Mycobacterium
FGQTWVPQALAKRVGHSQLT

SEQ ID NO: 306456 - protein, 18 aa, Mycobacterium
FGQYLLMFIVMYLLAAAS

SEQ ID NO: 306457 - protein, 20 aa, Mycobacterium
FGQYRLRRLVGRGAMGDVYE

SEQ ID NO: 306458 - protein, 26 aa, Mycobacterium
FGRAREVRIGWLLPLSGVRLGLDPLA

SEQ ID NO: 306459 - protein, 27 aa, Mycobacterium
FGRGSSMPFLATWNCTAFVVNPDGWVA

SEQ ID NO: 306460 - protein, 26 aa, Mycobacterium
FGRKGYSTVVAFAFGWPTSENGPLIT

SEQ ID NO: 306461 - protein, 22 aa, Mycobacterium
FGRKMIFGVAILFFLAGSVLCG

SEQ ID NO: 306462 - protein, 21 aa, Mycobacterium
FGRPTDRAHLPGLVEAAALPR

SEQ ID NO: 306463 - protein, 18 aa, Mycobacterium
FGRRDTLILVCLVLGLAQ

SEQ ID NO: 306464 - protein, 35 aa, Mycobacterium
FGRRGLRTVTIIALVAVLVGGIYVLASVGGNGRKI

SEQ ID NO: 306465 - protein, 21 aa, Mycobacterium
FGRRWGSGRSLAIGMLILALS

SEQ ID NO: 306466 - protein, 19 aa, Mycobacterium
FGRRYTIAFCAVLGLPIVP

SEQ ID NO: 306467 - protein, 18 aa, Mycobacterium
FGRSMLRLLVHVVDAVPL

SEQ ID NO: 306468 - protein, 21 aa, Mycobacterium
FGRTRVMLVSAIATTIIGLLL

SEQ ID NO: 306469 - protein, 23 aa, Mycobacterium
FGRTTCRTCVPAGPHSNFRCGNA

SEQ ID NO: 306470 - protein, 19 aa, Mycobacterium
FGRYRLFEVLRSGGTGIVY

SEQ ID NO: 306471 - protein, 25 aa, Mycobacterium
FGSAARRAAILAAVICVLTLTIAGP

SEQ ID NO: 306472 - protein, 19 aa, Mycobacterium
FGSAARRAAILAAVVCVLT

SEQ ID NO: 306473 - protein, 19 aa, Mycobacterium
FGSARAVRGMDWLRRHTRM

SEQ ID NO: 306474 - protein, 17 aa, Mycobacterium
FGSFIGFSFAFGQVLQT

SEQ ID NO: 306475 - protein, 28 aa, Mycobacterium
FGSGLDWRPNPGIAFPTYANYLPVTRAV

SEQ ID NO: 306476 - protein, 27 aa, Mycobacterium
FGSRTGMGFGRDLRAAMFDHITTFSEH

SEQ ID NO: 306477 - protein, 21 aa, Mycobacterium
FGSRTGMGFGRDLRAAVFEHV

SEQ ID NO: 306478 - protein, 19 aa, Mycobacterium
FGSRTGMGFGRDMRSALFH

SEQ ID NO: 306479 - protein, 17 aa, Mycobacterium
FGSWIGFSFAFGQVLQI

SEQ ID NO: 306480 - protein, 17 aa, Mycobacterium
FGSWIGFSFAFGQVLQV

SEQ ID NO: 306481 - protein, 17 aa, Mycobacterium
FGTAVFVAAEFSLTALE

SEQ ID NO: 306482 - protein, 24 aa, Mycobacterium
FGTDRLEVFTVPYTAQFRNPLSAD

SEQ ID NO: 306483 - protein, 27 aa, Mycobacterium
FGTGLLLGWRLPMWRAPTLILAAIWNG

SEQ ID NO: 306484 - protein, 33 aa, Mycobacterium
FGTGMDWRPNPGIGFPGWANYFPVTRGTPEPPS

SEQ ID NO: 306485 - protein, 18 aa, Mycobacterium
FGTLAGFSFGALLMLGFS

SEQ ID NO: 306486 - protein, 21 aa, Mycobacterium
FGTLPLFWSIAMARMSGLVAA

SEQ ID NO: 306487 - protein, 17 aa, Mycobacterium
FGTPLVMHVMYGVKIAL

SEQ ID NO: 306488 - protein, 25 aa, Mycobacterium
FGTQWRDVVAFVLLVLVLLFRPTGI

SEQ ID NO: 306489 - protein, 24 aa, Mycobacterium
FGTQWRDVVAFVLLVLVLLVRPTG

SEQ ID NO: 306490 - protein, 25 aa, Mycobacterium
FGTQWRDVVAFVLLVLVLMFRPTGI

SEQ ID NO: 306491 - protein, 19 aa, Mycobacterium
FGTRAMRALGIGGAPKPTP

SEQ ID NO: 306492 - protein, 19 aa, Mycobacterium
FGTRTRPGPIVKPVSATVF

SEQ ID NO: 306493 - protein, 27 aa, Mycobacterium
FGTSFGWRVLTPVLRRLEEVTDLASVG

SEQ ID NO: 306494 - protein, 18 aa, Mycobacterium
FGTVAVRYSQLGFGRTSS

SEQ ID NO: 306495 - protein, 17 aa, Mycobacterium
FGTVPAIVWVGFQLTFA

SEQ ID NO: 306496 - protein, 17 aa, Mycobacterium
FGTYLMRQFFRTLPSDL

SEQ ID NO: 306497 - protein, 19 aa, Mycobacterium
FGVACQLGALAAGADSLVA

SEQ ID NO: 306498 - protein, 27 aa, Mycobacterium
FGVALCAGLWFIGRRVIATVGHNLTTM

SEQ ID NO: 306499 - protein, 17 aa, Mycobacterium
FGVAMITPLVFAGAVSG

SEQ ID NO: 306500 - protein, 18 aa, Mycobacterium
FGVAPAFIVYGTLLSHSR

SEQ ID NO: 306501 - protein, 18 aa, Mycobacterium
FGVAPAFIVYGTLLSTSR

SEQ ID NO: 306502 - protein, 20 aa, Mycobacterium
FGVAVCALIAYLVGQSKGYF

SEQ ID NO: 306503 - protein, 20 aa, Mycobacterium
FGVAVGRVVTLAFLMLQLVS

SEQ ID NO: 306504 - protein, 24 aa, Mycobacterium
FGVGCLACAVFAAVGAVVVAFLLP

SEQ ID NO: 306505 - protein, 21 aa, Mycobacterium
FGVGVLMRPHAPSNIGEQVLA

SEQ ID NO: 306506 - protein, 30 aa, Mycobacterium
FGVLASRWPMAGGVYQWSRRLLGSAYGWFA

SEQ ID NO: 306507 - protein, 21 aa, Mycobacterium
FGVLDWFFWLLSIVISTAVSW

SEQ ID NO: 306508 - protein, 17 aa, Mycobacterium
FGVLMLRIEETAIGAVI

SEQ ID NO: 306509 - protein, 19 aa, Mycobacterium
FGVLPPFWAAKAFWVASAH

SEQ ID NO: 306510 - protein, 24 aa, Mycobacterium
FGVLPWAALADRVGRVQVITVSVV

SEQ ID NO: 306511 - protein, 17 aa, Mycobacterium
FGVLRIDAAMANSGNLR

SEQ ID NO: 306512 - protein, 22 aa, Mycobacterium
FGVNPPFLWQHITGHYTNISVQ

SEQ ID NO: 306513 - protein, 17 aa, Mycobacterium
FGVPRVAQQKVLLFGVA

SEQ ID NO: 306514 - protein, 17 aa, Mycobacterium
FGVPVTKHLAAGGQQDP

SEQ ID NO: 306515 - protein, 30 aa, Mycobacterium
FGVPWSNSFPKWRWSLTTALLELSVVVLVV

SEQ ID NO: 306516 - protein, 23 aa, Mycobacterium
FGVRIDPFPAAVIAFSLNVGGYA

SEQ ID NO: 306517 - protein, 26 aa, Mycobacterium
FGVSIPDFRLGILLIGLFASVLGWLP

SEQ ID NO: 306518 - protein, 26 aa, Mycobacterium
FGVTLRAPHGGIFVFFAIGNLLWFVI

SEQ ID NO: 306519 - protein, 18 aa, Mycobacterium
FGVTVLRLAVIRRGVIPA

SEQ ID NO: 306520 - protein, 19 aa, Mycobacterium
FGVTVLRLAVIRRGVIPAS

SEQ ID NO: 306521 - protein, 17 aa, Mycobacterium
FGVTVSSILLGRIAEPA

SEQ ID NO: 306522 - protein, 19 aa, Mycobacterium
FGVVWVGRFLLLDRWLFRL

SEQ ID NO: 306523 - protein, 20 aa, Mycobacterium
FGWHGMGEWAVRGIATQDTN

SEQ ID NO: 306524 - protein, 23 aa, Mycobacterium
FGWLPIVMGLTFWQAVSSSVTGL

SEQ ID NO: 306525 - protein, 17 aa, Mycobacterium
FGWQMGADIAWLLPAAL

SEQ ID NO: 306526 - protein, 20 aa, Mycobacterium
FGWRETCFITVVAGVLQLAF

SEQ ID NO: 306527 - protein, 20 aa, Mycobacterium
FGWWGGSGVGGFKNSLSDVG

SEQ ID NO: 306528 - protein, 20 aa, Mycobacterium
FGYASALAWVIFAILLVLTV

SEQ ID NO: 306529 - protein, 19 aa, Mycobacterium
FGYKPMIVAGCLIRTGGFG

SEQ ID NO: 306530 - protein, 17 aa, Mycobacterium
FHAAGALAGFGATVVVC

SEQ ID NO: 306531 - protein, 17 aa, Mycobacterium
FHAALLAELALIGHRGP

SEQ ID NO: 306532 - protein, 17 aa, Mycobacterium
FHALAAVFCQLTGAAAT

SEQ ID NO: 306533 - protein, 24 aa, Mycobacterium
FHDRNRLVTFIAIFLAGGVMFSLT

SEQ ID NO: 306534 - protein, 17 aa, Mycobacterium
FHEAAKIGFRYIETDVR

SEQ ID NO: 306535 - protein, 20 aa, Mycobacterium
FHEGARWARLDLPDDEYVPV

SEQ ID NO: 306536 - protein, 18 aa, Mycobacterium
FHGMWSLGALLGALIGAA

SEQ ID NO: 306537 - protein, 25 aa, Mycobacterium
FHGPTGGLPLVFSGGNWTVDVEDDS

SEQ ID NO: 306538 - protein, 26 aa, Mycobacterium
FHGRLPRIALATIIVMPLLYGAMYLW

SEQ ID NO: 306539 - protein, 25 aa, Mycobacterium
FHGSEYGVEFFAGWLTEYSLSVDNL

SEQ ID NO: 306540 - protein, 19 aa, Mycobacterium
FHIAVAACGVVQVAAAATL

SEQ ID NO: 306541 - protein, 27 aa, Mycobacterium
FHIPFIGRWPVLGFLQDFFAVAVLLGI

SEQ ID NO: 306542 - protein, 17 aa, Mycobacterium
FHIVERWQFHYSQVVKS

SEQ ID NO: 306543 - protein, 25 aa, Mycobacterium
FHLATRAGAGFPDFGAPQLPITELT

SEQ ID NO: 306544 - protein, 18 aa, Mycobacterium
FHLVREIGVDPAAKPSAR

SEQ ID NO: 306545 - protein, 20 aa, Mycobacterium
FHNCAARYLYAIGRENVVPG

SEQ ID NO: 306546 - protein, 23 aa, Mycobacterium
FHNCAARYLYALGRENVIPGMRK

SEQ ID NO: 306547 - protein, 21 aa, Mycobacterium
FHPPSRLSLADALARAAIGEP

SEQ ID NO: 306548 - protein, 24 aa, Mycobacterium
FHPSPRLKAMRAAVETCRVIPVII

SEQ ID NO: 306549 - protein, 26 aa, Mycobacterium
FHPTAPRGAIGWGFGAHGLLTNIGIT

SEQ ID NO: 306550 - protein, 17 aa, Mycobacterium
FHQGLAMRTGMSIGLAS

SEQ ID NO: 306551 - protein, 18 aa, Mycobacterium
FHRGIACCVAGFGIVLPL

SEQ ID NO: 306552 - protein, 17 aa, Mycobacterium
FHRRKGLPNSYGLGDGL

SEQ ID NO: 306553 - protein, 24 aa, Mycobacterium
FHSGPFAWNGVVGFWIPAILFIVY

SEQ ID NO: 306554 - protein, 24 aa, Mycobacterium
FHSLGAPCSIALLVTIAASLTLAP

SEQ ID NO: 306555 - protein, 17 aa, Mycobacterium
FHSLGIPAALGILVALL

SEQ ID NO: 306556 - protein, 23 aa, Mycobacterium
FHVCLGLGALIFVLSQTRRTHLS

SEQ ID NO: 306557 - protein, 18 aa, Mycobacterium
FHVRRIDLEGSPLDALQL

SEQ ID NO: 306558 - protein, 17 aa, Mycobacterium
FHVRRIDLEGSPLDALR

SEQ ID NO: 306559 - protein, 22 aa, Mycobacterium
FHWAVGIAIGVPVGLILLTELH

SEQ ID NO: 306560 - protein, 21 aa, Mycobacterium
FHYWTAFHVIPQWALALSALL

SEQ ID NO: 306561 - protein, 22 aa, Mycobacterium
FIAAIGWVVFFFMFRTEKAADS

SEQ ID NO: 306562 - protein, 21 aa, Mycobacterium
FIAAIGWVVFFFMFRTENVAD

SEQ ID NO: 306563 - protein, 17 aa, Mycobacterium
FIACVAAGSVVYLPDLF

SEQ ID NO: 306564 - protein, 25 aa, Mycobacterium
FIAGACALALFAIFWWALPLTLRTH

SEQ ID NO: 306565 - protein, 21 aa, Mycobacterium
FIAGCVLAVWLRKSAPQRYEL

SEQ ID NO: 306566 - protein, 22 aa, Mycobacterium
FIAGILLAIAVAVAREANDRTV

SEQ ID NO: 306567 - protein, 32 aa, Mycobacterium
FIAKLAEFIYLFVSELIALLIAGELLQALMFV

SEQ ID NO: 306568 - protein, 18 aa, Mycobacterium
FIALIVLSCVAAVYAGRG

SEQ ID NO: 306569 - protein, 18 aa, Mycobacterium
FIAMPVGLALSVLLGLWL

SEQ ID NO: 306570 - protein, 23 aa, Mycobacterium
FIAVAVVALVAWAGLGAAPSPRT

SEQ ID NO: 306571 - protein, 21 aa, Mycobacterium
FIAYRPLRKRNARALTFLITA

SEQ ID NO: 306572 - protein, 19 aa, Mycobacterium
FIDLRFFRSVPFASATLVA

SEQ ID NO: 306573 - protein, 22 aa, Mycobacterium
FIELIAAVLIVFLLAINVQHSP

SEQ ID NO: 306574 - protein, 18 aa, Mycobacterium
FIERAVIDEVMYELMRLS

SEQ ID NO: 306575 - protein, 19 aa, Mycobacterium
FIETLKIGWAGLALVLVNE

SEQ ID NO: 306576 - protein, 17 aa, Mycobacterium
FIFGQYRTGATTGYSAV

SEQ ID NO: 306577 - protein, 17 aa, Mycobacterium
FIFTRFGLAALYRPPRR

SEQ ID NO: 306578 - protein, 30 aa, Mycobacterium
FIGEFPRASIIVALVWQWTPFMMLLILAGL

SEQ ID NO: 306579 - protein, 19 aa, Mycobacterium
FIGFVCVILAYFFEHTVFL

SEQ ID NO: 306580 - protein, 23 aa, Mycobacterium
FIGLWIFGWSRLPKLLHLACIWI

SEQ ID NO: 306581 - protein, 22 aa, Mycobacterium
FIGLWIFGWSRLPRAVHLACIW

SEQ ID NO: 306582 - protein, 22 aa, Mycobacterium
FIGLWIFGWSRLPRLVHLACIW

SEQ ID NO: 306583 - protein, 22 aa, Mycobacterium
FIGLWIFGWTRLPRWLHLACIW

SEQ ID NO: 306584 - protein, 17 aa, Mycobacterium
FIGTRLLAIPAVFMMLL

SEQ ID NO: 306585 - protein, 17 aa, Mycobacterium
FIIATIFATRGKGTAAI

SEQ ID NO: 306586 - protein, 17 aa, Mycobacterium
FIIGISAMLGWGLFRIY

SEQ ID NO: 306587 - protein, 25 aa, Mycobacterium
FILAWSTSGINGWFYVGNYGVPWFD

SEQ ID NO: 306588 - protein, 19 aa, Mycobacterium
FILEGFDFGVGMLMEPLAR

SEQ ID NO: 306589 - protein, 20 aa, Mycobacterium
FILLAVVALAGWATLGGSTS

SEQ ID NO: 306590 - protein, 25 aa, Mycobacterium
FILLIKKIWWPLAVWVLLVVMNVNA

SEQ ID NO: 306591 - protein, 19 aa, Mycobacterium
FILLRRKRVPGVARGPAWR

SEQ ID NO: 306592 - protein, 17 aa, Mycobacterium
FILLVPRLFPGAFTADP

SEQ ID NO: 306593 - protein, 17 aa, Mycobacterium
FILPRLDGRTVLIAGGV

SEQ ID NO: 306594 - protein, 26 aa, Mycobacterium
FILTRILRLNISWSSWLKNWPEIALG

SEQ ID NO: 306595 - protein, 20 aa, Mycobacterium
FINEARWVRGAVPFQGDIGS

SEQ ID NO: 306596 - protein, 18 aa, Mycobacterium
FIPGTALLIAFAVVMVAA

SEQ ID NO: 306597 - protein, 26 aa, Mycobacterium
FIPKTKLTMLAPRAGLVTDPGAKVTY

SEQ ID NO: 306598 - protein, 23 aa, Mycobacterium
FIPMFLTAFAYRELNADTPDCGA

SEQ ID NO: 306599 - protein, 20 aa, Mycobacterium
FIPPAVIMGFVLWRYQLRQG

SEQ ID NO: 306600 - protein, 22 aa, Mycobacterium
FIQDRFGPHITLVWTSVLGGGT

SEQ ID NO: 306601 - protein, 23 aa, Mycobacterium
FIQRIRIQLILTVFVVAANLIGI

SEQ ID NO: 306602 - protein, 17 aa, Mycobacterium
FIQTSGFSAFRHGESPT

SEQ ID NO: 306603 - protein, 26 aa, Mycobacterium
FIRGREWIRLPAIFGAGMVVRATGLY

SEQ ID NO: 306604 - protein, 18 aa, Mycobacterium
FIRLGVILSVLGAYLAWT

SEQ ID NO: 306605 - protein, 22 aa, Mycobacterium
FIRLRVMESPEFTALHRSGELS

SEQ ID NO: 306606 - protein, 25 aa, Mycobacterium
FIRPLPRLHGSVPLPEALSTLRRSN

SEQ ID NO: 306607 - protein, 19 aa, Mycobacterium
FIRQRPLRTPDRFARPGPS

SEQ ID NO: 306608 - protein, 21 aa, Mycobacterium
FISAIGWVIFFFLFRDESQID

SEQ ID NO: 306609 - protein, 20 aa, Mycobacterium
FISAIGWVVFFFMFRTEQQI

SEQ ID NO: 306610 - protein, 17 aa, Mycobacterium
FISEFLVLIGTFTRYPV

SEQ ID NO: 306611 - protein, 17 aa, Mycobacterium
FISEFLVLLGTFNRYWL

SEQ ID NO: 306612 - protein, 18 aa, Mycobacterium
FISGAYLPADLSLYDYDG

SEQ ID NO: 306613 - protein, 18 aa, Mycobacterium
FISGPYLPADLSLYDYDN

SEQ ID NO: 306614 - protein, 18 aa, Mycobacterium
FISLPFLLAFRLTCYYYR

SEQ ID NO: 306615 - protein, 19 aa, Mycobacterium
FISNHSMYWFVGYRVILGL

SEQ ID NO: 306616 - protein, 18 aa, Mycobacterium
FISQLPFWYFGGVAAIAV

SEQ ID NO: 306617 - protein, 17 aa, Mycobacterium
FISRCYNLILKSTLAAK

SEQ ID NO: 306618 - protein, 19 aa, Mycobacterium
FISVLRLVPHWFKPSQVPL

SEQ ID NO: 306619 - protein, 25 aa, Mycobacterium
FITPIAVGLIFRFLLNDQIGAVPAL

SEQ ID NO: 306620 - protein, 25 aa, Mycobacterium
FIVAEIVLVHLFKRVAPENAFGAIF

SEQ ID NO: 306621 - protein, 18 aa, Mycobacterium
FIVAVIFFTGFRLGMQSG

SEQ ID NO: 306622 - protein, 23 aa, Mycobacterium
FIVAVVFFSGFFVAWSAGYGGGG

SEQ ID NO: 306623 - protein, 28 aa, Mycobacterium
FIVCATVLSWLRLFAVGRVEPAGDAAWW

SEQ ID NO: 306624 - protein, 17 aa, Mycobacterium
FIVFGYVAFYFAPFFPA

SEQ ID NO: 306625 - protein, 17 aa, Mycobacterium
FIVGVGFFAPGRFWWWS

SEQ ID NO: 306626 - protein, 28 aa, Mycobacterium
FIVPALVRLLGTWFWWPTRVLARPRREP

SEQ ID NO: 306627 - protein, 17 aa, Mycobacterium
FIVPGGPADFGWTAYTP

SEQ ID NO: 306628 - protein, 20 aa, Mycobacterium
FIWETLIGIELHWLTLPIAF

SEQ ID NO: 306629 - protein, 18 aa, Mycobacterium
FIYGLAAALVFPAVFFPE

SEQ ID NO: 306630 - protein, 27 aa, Mycobacterium
FIYYPVSAIMWVWYKAFAFLLGPTNFF

SEQ ID NO: 306631 - protein, 26 aa, Mycobacterium
FIYYPVSGIMWVWYKLFAYLLGPKNF

SEQ ID NO: 306632 - protein, 20 aa, Mycobacterium
FKAAAWVAIVAGIVFIVSVI

SEQ ID NO: 306633 - protein, 23 aa, Mycobacterium
FKAAGPPIAIAIVLALAVSLTVP

SEQ ID NO: 306634 - protein, 18 aa, Mycobacterium
FKAARRAILLGFAMNALA

SEQ ID NO: 306635 - protein, 18 aa, Mycobacterium
FKAARRAIYTGFAMNVLA

SEQ ID NO: 306636 - protein, 20 aa, Mycobacterium
FKAGAYIAAGLVLFILTFVV

SEQ ID NO: 306637 - protein, 23 aa, Mycobacterium
FKAGRFKNLILGLVILPFFVTFL

SEQ ID NO: 306638 - protein, 24 aa, Mycobacterium
FKAGRFKNLILGLVILPFFVTFLI

SEQ ID NO: 306639 - protein, 21 aa, Mycobacterium
FKANPMWPWLYGAILLMGGLF

SEQ ID NO: 306640 - protein, 25 aa, Mycobacterium
FKAPANLGANCQYPPSPDKAAKEAK

SEQ ID NO: 306641 - protein, 32 aa, Mycobacterium
FKDLLINCGYPLIERFPLMLGTAGTVLLIGLI

SEQ ID NO: 306642 - protein, 22 aa, Mycobacterium
FKDQGSKTWAEFTAANVGVQTA

SEQ ID NO: 306643 - protein, 22 aa, Mycobacterium
FKEEIHAGLNTCIIRAMAGSGS

SEQ ID NO: 306644 - protein, 24 aa, Mycobacterium
FKEELRAGIKTGIIRSMVGTGSVV

SEQ ID NO: 306645 - protein, 20 aa, Mycobacterium
FKEPRWPVPGTKAEKRTERL

SEQ ID NO: 306646 - protein, 22 aa, Mycobacterium
FKFAGQYLLPFSTIVIASSLTP

SEQ ID NO: 306647 - protein, 22 aa, Mycobacterium
FKGSLGVASIVVFIPMLSAAIG

SEQ ID NO: 306648 - protein, 21 aa, Mycobacterium
FKHRGEYVYLPPAWFAGETPP

SEQ ID NO: 306649 - protein, 17 aa, Mycobacterium
FKKRGIDPEDFWRSAGL

SEQ ID NO: 306650 - protein, 18 aa, Mycobacterium
FKKRGIDPEEFWRNAGLP

SEQ ID NO: 306651 - protein, 17 aa, Mycobacterium
FKKRGIDPEQFWRSAGL

SEQ ID NO: 306652 - protein, 18 aa, Mycobacterium
FKKRGINPEEFWRNAGLP

SEQ ID NO: 306653 - protein, 20 aa, Mycobacterium
FKLFGVRCAVTVALAAASWW

SEQ ID NO: 306654 - protein, 22 aa, Mycobacterium
FKLSGPDMRGVRQAVTRARRAG

SEQ ID NO: 306655 - protein, 22 aa, Mycobacterium
FKLSGPEMRGVRQAVTRARRAG

SEQ ID NO: 306656 - protein, 17 aa, Mycobacterium
FKLVASIYLRSVLTGPA

SEQ ID NO: 306657 - protein, 24 aa, Mycobacterium
FKLVGSAVAAVFVIGVVALVVSLA

SEQ ID NO: 306658 - protein, 20 aa, Mycobacterium
FKMMGVTGVVIMIMLFIAYR

SEQ ID NO: 306659 - protein, 21 aa, Mycobacterium
FKPAAANTWADFTAAHIGTQT

SEQ ID NO: 306660 - protein, 26 aa, Mycobacterium
FKPSAEVGANCQYPATPEPAAKQVKP

SEQ ID NO: 306661 - protein, 20 aa, Mycobacterium
FKPTLPVLLANLTTVGQILV

SEQ ID NO: 306662 - protein, 22 aa, Mycobacterium
FKRGEFDPRAAAGVGPAQIVFW

SEQ ID NO: 306663 - protein, 17 aa, Mycobacterium
FKRGLKMFLSPDGHAVR

SEQ ID NO: 306664 - protein, 17 aa, Mycobacterium
FKRGLKMFLSPDGKTLR

SEQ ID NO: 306665 - protein, 19 aa, Mycobacterium
FKRGMKMFLSQDGKAARLF

SEQ ID NO: 306666 - protein, 19 aa, Mycobacterium
FKRVMKIFMSPDGKAARML

SEQ ID NO: 306667 - protein, 17 aa, Mycobacterium
FKSGIKLFVSPNGHAVR

SEQ ID NO: 306668 - protein, 17 aa, Mycobacterium
FKTAVLVGVALLIATCL

SEQ ID NO: 306669 - protein, 21 aa, Mycobacterium
FKTKDFQSGLKFMMTPDGKGA

SEQ ID NO: 306670 - protein, 19 aa, Mycobacterium
FKTSWYLLGPAFVAAIAYV

SEQ ID NO: 306671 - protein, 26 aa, Mycobacterium
FKYFVKRFALKRGVLLFGKLLPAGIG

SEQ ID NO: 306672 - protein, 25 aa, Mycobacterium
FLAACMFSLIALRRRRFRWCCGAAY

SEQ ID NO: 306673 - protein, 17 aa, Mycobacterium
FLACAPVASAQPAAGPW

SEQ ID NO: 306674 - protein, 17 aa, Mycobacterium
FLACTGIGSFLGTVSTP

SEQ ID NO: 306675 - protein, 25 aa, Mycobacterium
FLACYVVAALLVWARYVRPQSRHAS

SEQ ID NO: 306676 - protein, 20 aa, Mycobacterium
FLADRWTKRGTFILGALITA

SEQ ID NO: 306677 - protein, 30 aa, Mycobacterium
FLAELLDNWLWKWAAYLIVFGIMVVLTALL

SEQ ID NO: 306678 - protein, 17 aa, Mycobacterium
FLAGQSFWRTPSLFHLR

SEQ ID NO: 306679 - protein, 20 aa, Mycobacterium
FLAGRARRGDARFRLATLAL

SEQ ID NO: 306680 - protein, 22 aa, Mycobacterium
FLAGTVVGWLAARAWRRPTAVA

SEQ ID NO: 306681 - protein, 17 aa, Mycobacterium
FLAIPLLFAVAALWLTR

SEQ ID NO: 306682 - protein, 25 aa, Mycobacterium
FLAIPVLFALLALWLTRGGRIPDKR

SEQ ID NO: 306683 - protein, 24 aa, Mycobacterium
FLAIPVLFALLALWLTRGGRIPGR

SEQ ID NO: 306684 - protein, 22 aa, Mycobacterium
FLALRLSGLGADVFAAVSSPRT

SEQ ID NO: 306685 - protein, 25 aa, Mycobacterium
FLAPEFRALMRLDWSAAQQRQFEWL

SEQ ID NO: 306686 - protein, 19 aa, Mycobacterium
FLARSSTLTSVGWIGYIII

SEQ ID NO: 306687 - protein, 26 aa, Mycobacterium
FLATLAFLRYRWLRGEPLPPQRITRH

SEQ ID NO: 306688 - protein, 17 aa, Mycobacterium
FLAVGGESALFVIGVLV

SEQ ID NO: 306689 - protein, 34 aa, Mycobacterium
FLAVPVLAWAVWRAFVKRDWRYAVLLVGYNAGFL

SEQ ID NO: 306690 - protein, 19 aa, Mycobacterium
FLAVVAVIGAVAWAILALV

SEQ ID NO: 306691 - protein, 24 aa, Mycobacterium
FLAVWPCGLPVVAATALALGFVVL

SEQ ID NO: 306692 - protein, 18 aa, Mycobacterium
FLCAAPVALLGFVVSLFL

SEQ ID NO: 306693 - protein, 17 aa, Mycobacterium
FLCCPVLSLVALILLGR

SEQ ID NO: 306694 - protein, 19 aa, Mycobacterium
FLCPACGMFERAFGPTVSR

SEQ ID NO: 306695 - protein, 17 aa, Mycobacterium
FLDAAAPAVVLAQAIGR

SEQ ID NO: 306696 - protein, 24 aa, Mycobacterium
FLDAVICYIGFLLPLFTAKRQTIA

SEQ ID NO: 306697 - protein, 20 aa, Mycobacterium
FLDITLRAAMAVVQQLAVFL

SEQ ID NO: 306698 - protein, 19 aa, Mycobacterium
FLDNIPIVLGLAAGGVVAA

SEQ ID NO: 306699 - protein, 17 aa, Mycobacterium
FLEEPRIAERVANARTR

SEQ ID NO: 306700 - protein, 19 aa, Mycobacterium
FLEEPRLAERMAKARTRGG

SEQ ID NO: 306701 - protein, 18 aa, Mycobacterium
FLEFGYASALAWVIFAIL

SEQ ID NO: 306702 - protein, 18 aa, Mycobacterium
FLEFGYASALAWVMFAIL

SEQ ID NO: 306703 - protein, 18 aa, Mycobacterium
FLEFGYASALAWVMFAVL

SEQ ID NO: 306704 - protein, 23 aa, Mycobacterium
FLEFGYASALAWVMFAVLLVLTV

SEQ ID NO: 306705 - protein, 18 aa, Mycobacterium
FLEHGIASMEMFRRRKFG

SEQ ID NO: 306706 - protein, 17 aa, Mycobacterium
FLEKRFTGDYAHHNLLQ

SEQ ID NO: 306707 - protein, 18 aa, Mycobacterium
FLEKRFTGDYAHHNLLQR

SEQ ID NO: 306708 - protein, 19 aa, Mycobacterium
FLERTFRPIAGDKGIEFLV

SEQ ID NO: 306709 - protein, 19 aa, Mycobacterium
FLEYDVELFSQSTAGRLAA

SEQ ID NO: 306710 - protein, 19 aa, Mycobacterium
FLEYMKITYGWSLMLVVVF

SEQ ID NO: 306711 - protein, 19 aa, Mycobacterium
FLFAALWLSALAVFQTRSP

SEQ ID NO: 306712 - protein, 20 aa, Mycobacterium
FLFAALWLSCLAIFNTRSQH

SEQ ID NO: 306713 - protein, 19 aa, Mycobacterium
FLFAALWLSSLAIFHTRSP

SEQ ID NO: 306714 - protein, 24 aa, Mycobacterium
FLFARPELDQVAAINARYPGMAAP

SEQ ID NO: 306715 - protein, 18 aa, Mycobacterium
FLFFATFGFFFVSMQYIQ

SEQ ID NO: 306716 - protein, 27 aa, Mycobacterium
FLFFKVLEWARLVGIGHGFDSDDFFTY

SEQ ID NO: 306717 - protein, 20 aa, Mycobacterium
FLFGCFLVGVFAVRQTGQGL

SEQ ID NO: 306718 - protein, 19 aa, Mycobacterium
FLFGCFVFGVLAVRRTTEG

SEQ ID NO: 306719 - protein, 28 aa, Mycobacterium
FLFGMPKFDFVACLTMIIVLMITAVEST

SEQ ID NO: 306720 - protein, 24 aa, Mycobacterium
FLFVAPRYSFTIGETDNALTILMM

SEQ ID NO: 306721 - protein, 19 aa, Mycobacterium
FLFWPWEYKPKAAPGSLLY

SEQ ID NO: 306722 - protein, 21 aa, Mycobacterium
FLGAKVLEWARQIRMGNSLTA

SEQ ID NO: 306723 - protein, 19 aa, Mycobacterium
FLGAMALRRVALPASGLYP

SEQ ID NO: 306724 - protein, 22 aa, Mycobacterium
FLGARSLLYFGGRGDAGLSQAL

SEQ ID NO: 306725 - protein, 18 aa, Mycobacterium
FLGCPKFVAVPAAAVLLF

SEQ ID NO: 306726 - protein, 23 aa, Mycobacterium
FLGFSGIWTYIGFAFLGALFAML

SEQ ID NO: 306727 - protein, 17 aa, Mycobacterium
FLGGLPITGVIVRSSTN

SEQ ID NO: 306728 - protein, 23 aa, Mycobacterium
FLGLWIFGWSRLPRLVHLACIWI

SEQ ID NO: 306729 - protein, 18 aa, Mycobacterium
FLGPIGVAAMGSRSLREG

SEQ ID NO: 306730 - protein, 18 aa, Mycobacterium
FLGPLTVAIAGSRRLLDM

SEQ ID NO: 306731 - protein, 21 aa, Mycobacterium
FLGSAGFELIGIAAVISTASA

SEQ ID NO: 306732 - protein, 18 aa, Mycobacterium
FLGSLGLAAFIWETLIGI

SEQ ID NO: 306733 - protein, 18 aa, Mycobacterium
FLGTGLCGGLTTFSTMQV

SEQ ID NO: 306734 - protein, 22 aa, Mycobacterium
FLGVSVALRLTRSGVPKARAAA

SEQ ID NO: 306735 - protein, 19 aa, Mycobacterium
FLGWFVEGWSGATTLLVYW

SEQ ID NO: 306736 - protein, 17 aa, Mycobacterium
FLHARWGYPDDRVLPAS

SEQ ID NO: 306737 - protein, 31 aa, Mycobacterium
FLHFAAAMTLPWIAAIVVEFLLLRWLFAKDL

SEQ ID NO: 306738 - protein, 18 aa, Mycobacterium
FLHSRRVLVLSWIASGLT

SEQ ID NO: 306739 - protein, 19 aa, Mycobacterium
FLHWSRRPESTQSRFWNRW

SEQ ID NO: 306740 - protein, 32 aa, Mycobacterium
FLIALVPLFWVLSIVVARGWYAVTRSGWWTHS

SEQ ID NO: 306741 - protein, 17 aa, Mycobacterium
FLIGRGVGPGERVALMF

SEQ ID NO: 306742 - protein, 18 aa, Mycobacterium
FLILRALGELVLYRPSSG

SEQ ID NO: 306743 - protein, 25 aa, Mycobacterium
FLIPARRIGAAMARLSREAAAHNAT

SEQ ID NO: 306744 - protein, 25 aa, Mycobacterium
FLIRRLRLSQEVSLLIGTAIVAVLA

SEQ ID NO: 306745 - protein, 35 aa, Mycobacterium
FLITALCLFTAVFIMLRRKRIPGVARGPAWRLMGV

SEQ ID NO: 306746 - protein, 33 aa, Mycobacterium
FLITALCLFTAVFIMLRRKRVAGVARGPAWRLM

SEQ ID NO: 306747 - protein, 23 aa, Mycobacterium
FLIVLGVIAKWVVPPISKVLAER

SEQ ID NO: 306748 - protein, 30 aa, Mycobacterium
FLIVSAVVLGFVWLQFRGRLTPTTQLTMLA

SEQ ID NO: 306749 - protein, 19 aa, Mycobacterium
FLIVWLIPVVIGVGYARRL

SEQ ID NO: 306750 - protein, 20 aa, Mycobacterium
FLIYGTAAALVFPKLFFPNA

SEQ ID NO: 306751 - protein, 20 aa, Mycobacterium
FLIYGTAAALVFPKLFFPQA

SEQ ID NO: 306752 - protein, 17 aa, Mycobacterium
FLKDRMADITKMADEMQ

SEQ ID NO: 306753 - protein, 20 aa, Mycobacterium
FLKNPALEAVRFTARSAPKL

SEQ ID NO: 306754 - protein, 19 aa, Mycobacterium
FLLAIIFQRYRLALPEGWK

SEQ ID NO: 306755 - protein, 23 aa, Mycobacterium
FLLALGCSLCYGTATVLQAAGTR

SEQ ID NO: 306756 - protein, 20 aa, Mycobacterium
FLLAVVYQAVSWVGASILYP

SEQ ID NO: 306757 - protein, 21 aa, Mycobacterium
FLLCGVGLLVAAPVASLLIVY

SEQ ID NO: 306758 - protein, 21 aa, Mycobacterium
FLLCPVENLLSLPAVACIVVA

SEQ ID NO: 306759 - protein, 19 aa, Mycobacterium
FLLCYIGATTLTWWRYVRP

SEQ ID NO: 306760 - protein, 36 aa, Mycobacterium
FLLGDVLGVPGWVTQRLWWALLLTVGFWGVLRVAEA

SEQ ID NO: 306761 - protein, 27 aa, Mycobacterium
FLLGFRLTCYYYRKAYYRSVWQSPTGC

SEQ ID NO: 306762 - protein, 19 aa, Mycobacterium
FLLGLVLTCALMVRSTKYQ

SEQ ID NO: 306763 - protein, 19 aa, Mycobacterium
FLLHGGRNIFSFVTRIFPS

SEQ ID NO: 306764 - protein, 17 aa, Mycobacterium
FLLLDGWSREQLLRELF

SEQ ID NO: 306765 - protein, 19 aa, Mycobacterium
FLLLPRLTNVLSELPEGSD

SEQ ID NO: 306766 - protein, 18 aa, Mycobacterium
FLLLRWLFAKDLATEPQR

SEQ ID NO: 306767 - protein, 17 aa, Mycobacterium
FLLLVGRKLVWGVAWHR

SEQ ID NO: 306768 - protein, 18 aa, Mycobacterium
FLLPLLFQLEFGWSAFTA

SEQ ID NO: 306769 - protein, 18 aa, Mycobacterium
FLLQSWFVARVSLAPTLL

SEQ ID NO: 306770 - protein, 21 aa, Mycobacterium
FLLRCRSGAGAGLLSFAVGGT

SEQ ID NO: 306771 - protein, 17 aa, Mycobacterium
FLLRERRHPWPQIWSEQ

SEQ ID NO: 306772 - protein, 17 aa, Mycobacterium
FLLSVFAALGVQVAIFQ

SEQ ID NO: 306773 - protein, 18 aa, Mycobacterium
FLLVGGFGGLIMVAIASF

SEQ ID NO: 306774 - protein, 19 aa, Mycobacterium
FLLYLCGGTSALIAASLFK

SEQ ID NO: 306775 - protein, 20 aa, Mycobacterium
FLMDRVDGIVPPDVMPYTFG

SEQ ID NO: 306776 - protein, 31 aa, Mycobacterium
FLMPSIAALLGRWFWWPQIVRSRPASQLLRP

SEQ ID NO: 306777 - protein, 28 aa, Mycobacterium
FLMQEFIIRWRVWLTHRLMGDWLGDRAY

SEQ ID NO: 306778 - protein, 24 aa, Mycobacterium
FLMQLCVQGAWGVIPAHLTEMSPD

SEQ ID NO: 306779 - protein, 17 aa, Mycobacterium
FLNRLERAIAARDQRPT

SEQ ID NO: 306780 - protein, 22 aa, Mycobacterium
FLPAELDGPVLFVLLDQYAPAG

SEQ ID NO: 306781 - protein, 22 aa, Mycobacterium
FLPASRCMLAMGAYRAFPQRFS

SEQ ID NO: 306782 - protein, 24 aa, Mycobacterium
FLPAYIPVEICDIAGIDPAVPDAV

SEQ ID NO: 306783 - protein, 25 aa, Mycobacterium
FLPDYRIVAALPLAYAVIVSGTLIR

SEQ ID NO: 306784 - protein, 23 aa, Mycobacterium
FLPFLLIMGGFMYFASRRQRKAM

SEQ ID NO: 306785 - protein, 24 aa, Mycobacterium
FLPFLLIMGGFMYFASRRQRRAMQ

SEQ ID NO: 306786 - protein, 22 aa, Mycobacterium
FLPGIIGVTIGRWRVDRNPPPR

SEQ ID NO: 306787 - protein, 18 aa, Mycobacterium
FLPGIIGVTVGRWRVDRN

SEQ ID NO: 306788 - protein, 26 aa, Mycobacterium
FLPHGYLGIWAAIPFAIWFFLAIEGV

SEQ ID NO: 306789 - protein, 22 aa, Mycobacterium
FLPMFLTAYAYRELNAKNPDAG

SEQ ID NO: 306790 - protein, 19 aa, Mycobacterium
FLPPVGGFLYWLRPKTIRL

SEQ ID NO: 306791 - protein, 18 aa, Mycobacterium
FLPRRSWLRAAAEDTSGA

SEQ ID NO: 306792 - protein, 17 aa, Mycobacterium
FLQAVLMALTILLIHTY

SEQ ID NO: 306793 - protein, 19 aa, Mycobacterium
FLQRPARWMHLLASNTRAF

SEQ ID NO: 306794 - protein, 19 aa, Mycobacterium
FLQRPARWMQLMASSGRVF

SEQ ID NO: 306795 - protein, 19 aa, Mycobacterium
FLQRPSAWLRLISQVRATH

SEQ ID NO: 306796 - protein, 22 aa, Mycobacterium
FLRDRLGLRRILALVLGVAAVL

SEQ ID NO: 306797 - protein, 25 aa, Mycobacterium
FLREWLPGQLLQGIGVGATLPVLGS

SEQ ID NO: 306798 - protein, 19 aa, Mycobacterium
FLRHGYRATSLRAIAAQAG

SEQ ID NO: 306799 - protein, 17 aa, Mycobacterium
FLRKPLMERGRILAQSW

SEQ ID NO: 306800 - protein, 22 aa, Mycobacterium
FLRKRLPQLTKRQRFWTSLYFP

SEQ ID NO: 306801 - protein, 20 aa, Mycobacterium
FLRLRLEESSAYQSAHDDAH

SEQ ID NO: 306802 - protein, 29 aa, Mycobacterium
FLRPILVPRDARLNPALMLLSVFSGIAMF

SEQ ID NO: 306803 - protein, 24 aa, Mycobacterium
FLRPILVPRDARLNSALMLLSVFA

SEQ ID NO: 306804 - protein, 24 aa, Mycobacterium
FLRPILVPRDARLNSALMLMSVFA

SEQ ID NO: 306805 - protein, 27 aa, Mycobacterium
FLRSRGMKLRWFVVLVGVTLMAFGAVI

SEQ ID NO: 306806 - protein, 17 aa, Mycobacterium
FLRTLILSLAATHHPDQ

SEQ ID NO: 306807 - protein, 17 aa, Mycobacterium
FLRTMILSLVAMTHPDQ

SEQ ID NO: 306808 - protein, 21 aa, Mycobacterium
FLRVFPAFAAAVLREELARRT

SEQ ID NO: 306809 - protein, 17 aa, Mycobacterium
FLRVWRDSPVPAYLDNA

SEQ ID NO: 306810 - protein, 19 aa, Mycobacterium
FLSAWGLSVAIWQYGIGLP

SEQ ID NO: 306811 - protein, 18 aa, Mycobacterium
FLSGCAILGAVMGLSIER

SEQ ID NO: 306812 - protein, 19 aa, Mycobacterium
FLSGCLDLADGRAVTIGSF

SEQ ID NO: 306813 - protein, 19 aa, Mycobacterium
FLSGCLDLADGRPVTVGSF

SEQ ID NO: 306814 - protein, 29 aa, Mycobacterium
FLSGCSSWADALALGWPRGITPQAQLNRE

SEQ ID NO: 306815 - protein, 20 aa, Mycobacterium
FLSIIGLIGFIFFISQHLQL

SEQ ID NO: 306816 - protein, 21 aa, Mycobacterium
FLSLTAAFGALVWIFQDGHLG

SEQ ID NO: 306817 - protein, 18 aa, Mycobacterium
FLSPDGKSARMFITHQSD

SEQ ID NO: 306818 - protein, 17 aa, Mycobacterium
FLSPDGKTARFAIESSY

SEQ ID NO: 306819 - protein, 18 aa, Mycobacterium
FLSREMVAGLTGRRSLRP

SEQ ID NO: 306820 - protein, 23 aa, Mycobacterium
FLSRPLGAAVFGHFGDRLGRQKT

SEQ ID NO: 306821 - protein, 22 aa, Mycobacterium
FLSRPLGAAVFGYFGDRLGRKK

SEQ ID NO: 306822 - protein, 19 aa, Mycobacterium
FLSSGAMRFDPPAGTYPDE

SEQ ID NO: 306823 - protein, 17 aa, Mycobacterium
FLTATVITLSMIGIAIG

SEQ ID NO: 306824 - protein, 17 aa, Mycobacterium
FLTEVGLMGRFARRGWK

SEQ ID NO: 306825 - protein, 17 aa, Mycobacterium
FLTFFVVAAFGALIVDR

SEQ ID NO: 306826 - protein, 18 aa, Mycobacterium
FLTFFVVAAFGALIVDRD

SEQ ID NO: 306827 - protein, 17 aa, Mycobacterium
FLTGALANLSGQAADPF

SEQ ID NO: 306828 - protein, 25 aa, Mycobacterium
FLTGLNWPTAFLVGAILSPTDPVFA

SEQ ID NO: 306829 - protein, 18 aa, Mycobacterium
FLTGWALMLDYLLLPLVN

SEQ ID NO: 306830 - protein, 21 aa, Mycobacterium
FLTLACLLTAIGVVTDSTVTV

SEQ ID NO: 306831 - protein, 20 aa, Mycobacterium
FLTMLHWLGGAAVFALFGAL

SEQ ID NO: 306832 - protein, 18 aa, Mycobacterium
FLTNAGFVLLLWAVAGVK

SEQ ID NO: 306833 - protein, 24 aa, Mycobacterium
FLTPWRVAIVDLILWGVGAALLTT

SEQ ID NO: 306834 - protein, 24 aa, Mycobacterium
FLTRLKVGAKLVDAKAVATLYRNR

SEQ ID NO: 306835 - protein, 22 aa, Mycobacterium
FLTSFAERWVLVPAPSGTTVRW

SEQ ID NO: 306836 - protein, 28 aa, Mycobacterium
FLTTVGWRIPFVASFALVAVGLWIRASV

SEQ ID NO: 306837 - protein, 17 aa, Mycobacterium
FLTYAVGFVARPIGGIV

SEQ ID NO: 306838 - protein, 18 aa, Mycobacterium
FLVALPIGAVIGGWLATR

SEQ ID NO: 306839 - protein, 18 aa, Mycobacterium
FLVAPGIPHETLAAAARA

SEQ ID NO: 306840 - protein, 17 aa, Mycobacterium
FLVCQLPISGLVFALDG

SEQ ID NO: 306841 - protein, 26 aa, Mycobacterium
FLVFGGAVAACLPVMVGGLSIAGALG

SEQ ID NO: 306842 - protein, 25 aa, Mycobacterium
FLVFPVAFALAVLWLTRAGRTPKGR

SEQ ID NO: 306843 - protein, 28 aa, Mycobacterium
FLVFYVICAAVTWYAYVRRPMTVSVPAI

SEQ ID NO: 306844 - protein, 39 aa, Mycobacterium
FLVGHLLQLPGWITQRLWWALLLTIGFWGLLRVAEALGI

SEQ ID NO: 306845 - protein, 19 aa, Mycobacterium
FLVIIVMLLFVYRSIVQVL

SEQ ID NO: 306846 - protein, 19 aa, Mycobacterium
FLVIVVMLLFFYRSIFTVI

SEQ ID NO: 306847 - protein, 17 aa, Mycobacterium
FLVLLGLLWPHIHLPHA

SEQ ID NO: 306848 - protein, 17 aa, Mycobacterium
FLVLLGTFNRYWLAAGF

SEQ ID NO: 306849 - protein, 17 aa, Mycobacterium
FLVLLGTYNRYWLAAAF

SEQ ID NO: 306850 - protein, 18 aa, Mycobacterium
FLVLVWVFGGLLAAALPM

SEQ ID NO: 306851 - protein, 18 aa, Mycobacterium
FLVLVWVFGGLVAAALPV

SEQ ID NO: 306852 - protein, 18 aa, Mycobacterium
FLVLYVVPFLKFPANPPA

SEQ ID NO: 306853 - protein, 30 aa, Mycobacterium
FLVPAFIHLLGPWSWWAPKPLAWLHDRLTT

SEQ ID NO: 306854 - protein, 17 aa, Mycobacterium
FLVPAPGAVPIKFRSTY

SEQ ID NO: 306855 - protein, 33 aa, Mycobacterium
FLVPSIAALLGRWFWWPRRVYSRPVNTAPSSPR

SEQ ID NO: 306856 - protein, 18 aa, Mycobacterium
FLVTDILAAFPILIPILI

SEQ ID NO: 306857 - protein, 24 aa, Mycobacterium
FLVWHLNLPLGVTVLIAAVAGALL

SEQ ID NO: 306858 - protein, 22 aa, Mycobacterium
FLWHFLIIFAWIAYLLVLFQIL

SEQ ID NO: 306859 - protein, 18 aa, Mycobacterium
FLYFTEPWLVAGVLLAVI

SEQ ID NO: 306860 - protein, 17 aa, Mycobacterium
FLYGGKEIWEFVTRIFP

SEQ ID NO: 306861 - protein, 17 aa, Mycobacterium
FLYGGRNIWAYVSKIFP

SEQ ID NO: 306862 - protein, 21 aa, Mycobacterium
FLYGGRNIWQYVVKIVPVPAR

SEQ ID NO: 306863 - protein, 17 aa, Mycobacterium
FLYGTAATLVFSKVFFA

SEQ ID NO: 306864 - protein, 24 aa, Mycobacterium
FLYVLQRIQGVLPLSGGLGAVSPA

SEQ ID NO: 306865 - protein, 23 aa, Mycobacterium
FMAAKDCWLDWGRQMGTHCFSDY

SEQ ID NO: 306866 - protein, 17 aa, Mycobacterium
FMADLCWIENIGARGFA

SEQ ID NO: 306867 - protein, 24 aa, Mycobacterium
FMAFLAGDLFNLFVGFEVLLTASF

SEQ ID NO: 306868 - protein, 28 aa, Mycobacterium
FMDYLKLGLPVTIVFFLAAVIYTPLFWP

SEQ ID NO: 306869 - protein, 20 aa, Mycobacterium
FMESGGWSLPTFAALMVTTA

SEQ ID NO: 306870 - protein, 30 aa, Mycobacterium
FMFGSPYAIFLLREHFRIIPNDLVNAAHLD

SEQ ID NO: 306871 - protein, 31 aa, Mycobacterium
FMFGSPYAIFLLREHFRMIPNDLVNAARLDG

SEQ ID NO: 306872 - protein, 24 aa, Mycobacterium
FMHRGVAYFPNLVLPIVVGGIGIG

SEQ ID NO: 306873 - protein, 29 aa, Mycobacterium
FMHVFGGLNWWAPKPLERWHSRSGADRSA

SEQ ID NO: 306874 - protein, 22 aa, Mycobacterium
FMHVFGSLNWWAPQPLAAMHRR

SEQ ID NO: 306875 - protein, 27 aa, Mycobacterium
FMHVMGRWNWWAPKPLVWLHQRFGISE

SEQ ID NO: 306876 - protein, 19 aa, Mycobacterium
FMIFGEYRSGAANRYSAVF

SEQ ID NO: 306877 - protein, 18 aa, Mycobacterium
FMILIGLIVAGQWKLLGA

SEQ ID NO: 306878 - protein, 18 aa, Mycobacterium
FMLALCWATTNGWWYVSS

SEQ ID NO: 306879 - protein, 18 aa, Mycobacterium
FMLFFTFIVGRSISENAA

SEQ ID NO: 306880 - protein, 18 aa, Mycobacterium
FMLGPRWLFGAGDSGASI

SEQ ID NO: 306881 - protein, 26 aa, Mycobacterium
FMLLVKKIWWPLAVWLLLVVMNVNAG

SEQ ID NO: 306882 - protein, 17 aa, Mycobacterium
FMLMLDMLRETAHESAD

SEQ ID NO: 306883 - protein, 18 aa, Mycobacterium
FMLMLDMLRETAHESADS

SEQ ID NO: 306884 - protein, 19 aa, Mycobacterium
FMLMLRAAFGAGDLGSATV

SEQ ID NO: 306885 - protein, 18 aa, Mycobacterium
FMLRLKVAMTAGVVMACP

SEQ ID NO: 306886 - protein, 19 aa, Mycobacterium
FMLRLKVGMAAGIVLACPI

SEQ ID NO: 306887 - protein, 18 aa, Mycobacterium
FMLRLKVGMTAGVVLACP

SEQ ID NO: 306888 - protein, 17 aa, Mycobacterium
FMLSDGLSNLGGPLRKL

SEQ ID NO: 306889 - protein, 28 aa, Mycobacterium
FMLVDCAWVGGLCGIVKRKGRGTPTVAF

SEQ ID NO: 306890 - protein, 20 aa, Mycobacterium
FMMKPSRWMQLLGSNPSAFT

SEQ ID NO: 306891 - protein, 33 aa, Mycobacterium
FMMRLSRNLRRFRWLVFTGWFLALVPAIYLAMT

SEQ ID NO: 306892 - protein, 21 aa, Mycobacterium
FMNFAYGWAFSNPVRKIYYNI

SEQ ID NO: 306893 - protein, 19 aa, Mycobacterium
FMNFFPVTAVMIVFLALLN

SEQ ID NO: 306894 - protein, 20 aa, Mycobacterium
FMNFFPVTAVMIVFLALLND

SEQ ID NO: 306895 - protein, 26 aa, Mycobacterium
FMPELDSRWGYPAVISSMVLVCLFLY

SEQ ID NO: 306896 - protein, 36 aa, Mycobacterium
FMQLMGRLNWWAPGPLARWHQRWGLVEEQEIPAEPA

SEQ ID NO: 306897 - protein, 27 aa, Mycobacterium
FMQNFGFYFGYPMGFVLVAILQSVPHH

SEQ ID NO: 306898 - protein, 25 aa, Mycobacterium
FMRLGWEVLIPVALVWIVVVGVVKA

SEQ ID NO: 306899 - protein, 30 aa, Mycobacterium
FMRNPLEALVAWGPLLFFIAYEAFFIPFGF

SEQ ID NO: 306900 - protein, 17 aa, Mycobacterium
FMRRRFWLQDLGVDQTT

SEQ ID NO: 306901 - protein, 25 aa, Mycobacterium
FMRRSVELMYFLAIPVAVVGALLAG

SEQ ID NO: 306902 - protein, 24 aa, Mycobacterium
FMRRSVELMYFLAVPIAVVGVLVA

SEQ ID NO: 306903 - protein, 18 aa, Mycobacterium
FMRVSRMAPSPAGPEEDQ

SEQ ID NO: 306904 - protein, 24 aa, Mycobacterium
FMSLPKLITFTGVVIAIVYLLVAL

SEQ ID NO: 306905 - protein, 18 aa, Mycobacterium
FMSVGDMIGRVIVGVLVG

SEQ ID NO: 306906 - protein, 30 aa, Mycobacterium
FMTPAIAALMGRWFWWPMKVSKYATDPPPP

SEQ ID NO: 306907 - protein, 21 aa, Mycobacterium
FMTQRFMLAWRTWLTDRLTGD

SEQ ID NO: 306908 - protein, 27 aa, Mycobacterium
FMVGFYIPFAIPWNHFVGGASSGVASN

SEQ ID NO: 306909 - protein, 23 aa, Mycobacterium
FMVGGMMMMMFGGRFGGQQQMSR

SEQ ID NO: 306910 - protein, 19 aa, Mycobacterium
FNALFGVAVGRVVTLAFLM

SEQ ID NO: 306911 - protein, 18 aa, Mycobacterium
FNCTDFADLFTLLEQDKA

SEQ ID NO: 306912 - protein, 24 aa, Mycobacterium
FNDVLRLRLTIGIYGAAVAVLFPL

SEQ ID NO: 306913 - protein, 26 aa, Mycobacterium
FNEPICPPCGAFIRSYASDIETAVAD

SEQ ID NO: 306914 - protein, 22 aa, Mycobacterium
FNEVRARRGLPGPAVVFECVGA

SEQ ID NO: 306915 - protein, 22 aa, Mycobacterium
FNFPDTSFAWAFVLALLAAALA

SEQ ID NO: 306916 - protein, 17 aa, Mycobacterium
FNFPDTSFAWSFVLALL

SEQ ID NO: 306917 - protein, 18 aa, Mycobacterium
FNGAAIFVSIAALLVGAL

SEQ ID NO: 306918 - protein, 18 aa, Mycobacterium
FNGLNFRFSPGGVAVDDQ

SEQ ID NO: 306919 - protein, 19 aa, Mycobacterium
FNGVPIGRLKGVDVVEVDD

SEQ ID NO: 306920 - protein, 17 aa, Mycobacterium
FNIDIAQSLSFLPSLYG

SEQ ID NO: 306921 - protein, 17 aa, Mycobacterium
FNILPFVFGVILLAGLA

SEQ ID NO: 306922 - protein, 19 aa, Mycobacterium
FNKAAALFVSPDGRSVRYL

SEQ ID NO: 306923 - protein, 24 aa, Mycobacterium
FNKPAGKFNYSWQGFTLDNWLDPF

SEQ ID NO: 306924 - protein, 20 aa, Mycobacterium
FNKPAGKFNYTWQGFTLDNW

SEQ ID NO: 306925 - protein, 34 aa, Mycobacterium
FNKPSAFSTGWALWIVLVCIVFQAVAAVGALLLE

SEQ ID NO: 306926 - protein, 23 aa, Mycobacterium
FNLAEAPLVRYMLVRLGDDDHRL

SEQ ID NO: 306927 - protein, 17 aa, Mycobacterium
FNLARTWHVQLSLFWTA

SEQ ID NO: 306928 - protein, 17 aa, Mycobacterium
FNLAWRVRYALQPTNSA

SEQ ID NO: 306929 - protein, 20 aa, Mycobacterium
FNMQLALGWSTLALAAVAVL

SEQ ID NO: 306930 - protein, 37 aa, Mycobacterium
FNMTIASWWLHRQCDYRTPVLFLLRLSVPTAASVAMV

SEQ ID NO: 306931 - protein, 24 aa, Mycobacterium
FNMTISSWWLRRRCGYRTPVPFVL

SEQ ID NO: 306932 - protein, 30 aa, Mycobacterium
FNMWRGIGLFDTWPGLIIPYITFALPLAIY

SEQ ID NO: 306933 - protein, 27 aa, Mycobacterium
FNNGLRPEPIIALGILLTWCSVERSIA

SEQ ID NO: 306934 - protein, 27 aa, Mycobacterium
FNNGLRPEPIIVFGTVLTWILVERAIA

SEQ ID NO: 306935 - protein, 30 aa, Mycobacterium
FNNGLRPEPLIAFAVITVWMLVENSIGTRR

SEQ ID NO: 306936 - protein, 32 aa, Mycobacterium
FNNGLRPEPLIAFGVVAAWMLTELAIGRRRLA

SEQ ID NO: 306937 - protein, 32 aa, Mycobacterium
FNNGLRPEPLIALGVLVTWALVERAIALSRLA

SEQ ID NO: 306938 - protein, 33 aa, Mycobacterium
FNNGLRPEPLIALGVLVTWILVERAIALQRLAP

SEQ ID NO: 306939 - protein, 35 aa, Mycobacterium
FNNGLRPEPLIALGVLVTWMLVERAIALRRLAPAA

SEQ ID NO: 306940 - protein, 32 aa, Mycobacterium
FNNGLRPEPLIALGVLVTWVLVERSIAQRHLA

SEQ ID NO: 306941 - protein, 19 aa, Mycobacterium
FNNVHFGYVPGRPVLSGLS

SEQ ID NO: 306942 - protein, 23 aa, Mycobacterium
FNPRTLWRNPVMFIVEIGATWST

SEQ ID NO: 306943 - protein, 20 aa, Mycobacterium
FNPVHVGLLYLPELGGAVVM

SEQ ID NO: 306944 - protein, 23 aa, Mycobacterium
FNPVQFPAALLLNVTNPIRAQFG

SEQ ID NO: 306945 - protein, 25 aa, Mycobacterium
FNREADIAASLWHPHIVQVHDRGEF

SEQ ID NO: 306946 - protein, 25 aa, Mycobacterium
FNRVVSVMMPVNFLALVILGASAGV

SEQ ID NO: 306947 - protein, 25 aa, Mycobacterium
FNSAKAGECLNWPAPASTNDVNIVD

SEQ ID NO: 306948 - protein, 17 aa, Mycobacterium
FNTMNLLLLLLVTFLPF

SEQ ID NO: 306949 - protein, 19 aa, Mycobacterium
FNTRMFKYFAKRFALKRGA

SEQ ID NO: 306950 - protein, 17 aa, Mycobacterium
FNTWGVFAISYATGALG

SEQ ID NO: 306951 - protein, 18 aa, Mycobacterium
FNVAGLFDRTGQLPEAAE

SEQ ID NO: 306952 - protein, 19 aa, Mycobacterium
FNVLGAIVWGVGLTLLGYW

SEQ ID NO: 306953 - protein, 18 aa, Mycobacterium
FNVPRAVTALGISLLMGL

SEQ ID NO: 306954 - protein, 19 aa, Mycobacterium
FPAAFCTIAAVASLVGVVD

SEQ ID NO: 306955 - protein, 21 aa, Mycobacterium
FPADGVVALCDFGAGGTTVTV

SEQ ID NO: 306956 - protein, 19 aa, Mycobacterium
FPAFARRAAAEGGAELGSL

SEQ ID NO: 306957 - protein, 18 aa, Mycobacterium
FPALGLVFERMVRRTLHR

SEQ ID NO: 306958 - protein, 24 aa, Mycobacterium
FPALRDALGIAYGCYALCAVLSLL

SEQ ID NO: 306959 - protein, 23 aa, Mycobacterium
FPAMFPTHVRYAGFAIAYNVSTS

SEQ ID NO: 306960 - protein, 22 aa, Mycobacterium
FPAPSWWWLAWFALVPLLLLVR

SEQ ID NO: 306961 - protein, 21 aa, Mycobacterium
FPAQLHGAGVWIGLAPASPRR

SEQ ID NO: 306962 - protein, 23 aa, Mycobacterium
FPARGLRGTLVYRLLGTTDHKLI

SEQ ID NO: 306963 - protein, 25 aa, Mycobacterium
FPATVCALAALLCAVWVRDPSRPAR

SEQ ID NO: 306964 - protein, 21 aa, Mycobacterium
FPDDLRPGLLSRMLAHLSTFI

SEQ ID NO: 306965 - protein, 23 aa, Mycobacterium
FPDDLRPGWLSRWLAHLSTAIEM

SEQ ID NO: 306966 - protein, 17 aa, Mycobacterium
FPDWMIADGPWLKRYPY

SEQ ID NO: 306967 - protein, 24 aa, Mycobacterium
FPEHKYRIVRLLQGRGHIVGMTGD

SEQ ID NO: 306968 - protein, 18 aa, Mycobacterium
FPELFPSSVRYSGVSVVW

SEQ ID NO: 306969 - protein, 18 aa, Mycobacterium
FPEPELFEPRPQAFRPEP

SEQ ID NO: 306970 - protein, 17 aa, Mycobacterium
FPFLSMTGQFLIKDIVL

SEQ ID NO: 306971 - protein, 24 aa, Mycobacterium
FPGDGKSATLLALMTFAVSFLVRP

SEQ ID NO: 306972 - protein, 23 aa, Mycobacterium
FPGGADSAAALWDLVAGGAEAVG

SEQ ID NO: 306973 - protein, 20 aa, Mycobacterium
FPGGDRAPLILVVTRSDGTT

SEQ ID NO: 306974 - protein, 20 aa, Mycobacterium
FPGGMPLDAAAPIITAVGSA

SEQ ID NO: 306975 - protein, 19 aa, Mycobacterium
FPGGSRWARIDLPDDEYIP

SEQ ID NO: 306976 - protein, 21 aa, Mycobacterium
FPGIGLGIIVAGARLLTKGML

SEQ ID NO: 306977 - protein, 20 aa, Mycobacterium
FPGIGLGVVVAGARLLTQGM

SEQ ID NO: 306978 - protein, 18 aa, Mycobacterium
FPGKRALVGATLLITMFP

SEQ ID NO: 306979 - protein, 25 aa, Mycobacterium
FPGKRAPTIQLCRDPKGYVPIGRNP

SEQ ID NO: 306980 - protein, 27 aa, Mycobacterium
FPGKRAPTIQLCRDPKGYVPLGRNPWR

SEQ ID NO: 306981 - protein, 25 aa, Mycobacterium
FPGKRAPTIQLCRDPKGYVPVGRNP

SEQ ID NO: 306982 - protein, 29 aa, Mycobacterium
FPGKRAPTIQLCRDPRGYVPIGSNPWRGP

SEQ ID NO: 306983 - protein, 19 aa, Mycobacterium
FPGKRILDAIIDLPFALPT

SEQ ID NO: 306984 - protein, 17 aa, Mycobacterium
FPGLESFEGPVVHPQHW

SEQ ID NO: 306985 - protein, 22 aa, Mycobacterium
FPGLFSGLLAFSYFVAFEVSQG

SEQ ID NO: 306986 - protein, 18 aa, Mycobacterium
FPGPWALVPVGATILLIL

SEQ ID NO: 306987 - protein, 25 aa, Mycobacterium
FPGRAQLCFLTFVVVVGTLLLHGLT

SEQ ID NO: 306988 - protein, 20 aa, Mycobacterium
FPGTELMSACFMPDAIESLI

SEQ ID NO: 306989 - protein, 21 aa, Mycobacterium
FPGTILIPRLYALHILLLPGI

SEQ ID NO: 306990 - protein, 25 aa, Mycobacterium
FPHHEFLAFWSIHLLVVWAAIYLCW

SEQ ID NO: 306991 - protein, 19 aa, Mycobacterium
FPIAAHFHTVIPFADVMES

SEQ ID NO: 306992 - protein, 25 aa, Mycobacterium
FPIAMAITAIATWAAESLGWITLDS

SEQ ID NO: 306993 - protein, 17 aa, Mycobacterium
FPIDIGPQPAWRNLRFP

SEQ ID NO: 306994 - protein, 17 aa, Mycobacterium
FPILSVFGFIVMFGGVV

SEQ ID NO: 306995 - protein, 20 aa, Mycobacterium
FPILSVIGFIVMFGGVVFAI

SEQ ID NO: 306996 - protein, 21 aa, Mycobacterium
FPILVYFLMRLNREYRSEAAI

SEQ ID NO: 306997 - protein, 22 aa, Mycobacterium
FPIRLPKLPAGWQANSGGRGGI

SEQ ID NO: 306998 - protein, 19 aa, Mycobacterium
FPIRLPVLPAGWQPNSGGR

SEQ ID NO: 306999 - protein, 17 aa, Mycobacterium
FPIVAASALCFLVGFAG

SEQ ID NO: 307000 - protein, 23 aa, Mycobacterium
FPKADVHAAAYWTFGRAMGSRRG

SEQ ID NO: 307001 - protein, 19 aa, Mycobacterium
FPKPDFRLPRPLQRLLSRR

SEQ ID NO: 307002 - protein, 17 aa, Mycobacterium
FPLAGSVFAYVGRGIHP

SEQ ID NO: 307003 - protein, 20 aa, Mycobacterium
FPLAPTVTVLLWFPTTVAKL

SEQ ID NO: 307004 - protein, 17 aa, Mycobacterium
FPLFINFVYIWYVGGLA

SEQ ID NO: 307005 - protein, 21 aa, Mycobacterium
FPLGSAALAWQMLRGRTTRTF

SEQ ID NO: 307006 - protein, 22 aa, Mycobacterium
FPLLGGLSMLAAFAISAKDMIQ

SEQ ID NO: 307007 - protein, 26 aa, Mycobacterium
FPLLRELRSALVAGEPMGLVSTLSGI

SEQ ID NO: 307008 - protein, 21 aa, Mycobacterium
FPLLVFMLMRLNREYRAEAAI

SEQ ID NO: 307009 - protein, 18 aa, Mycobacterium
FPLQLPWLPLAAPLGALV

SEQ ID NO: 307010 - protein, 17 aa, Mycobacterium
FPLRGGTGANWNIEAPG

SEQ ID NO: 307011 - protein, 21 aa, Mycobacterium
FPLSKQDLWEVVAAAPDLGPL

SEQ ID NO: 307012 - protein, 19 aa, Mycobacterium
FPMAFAVLAAACAVMGVAS

SEQ ID NO: 307013 - protein, 17 aa, Mycobacterium
FPMMGMIDMSNALCRDD

SEQ ID NO: 307014 - protein, 19 aa, Mycobacterium
FPMYFLKSSAYTIVATAAI

SEQ ID NO: 307015 - protein, 26 aa, Mycobacterium
FPNYLSLAGPYAFLGLNFFNTMEYQM

SEQ ID NO: 307016 - protein, 22 aa, Mycobacterium
FPPDGRAGVTVITLGAQRQAAY

SEQ ID NO: 307017 - protein, 21 aa, Mycobacterium
FPPEVHSALLGAGPGPGPLLA

SEQ ID NO: 307018 - protein, 18 aa, Mycobacterium
FPPGAQWARLDLEDFEYE

SEQ ID NO: 307019 - protein, 26 aa, Mycobacterium
FPPGMGPPGRHLRVFDPEQGPGPGFL

SEQ ID NO: 307020 - protein, 17 aa, Mycobacterium
FPPKRAEELTSLIDSRF

SEQ ID NO: 307021 - protein, 17 aa, Mycobacterium
FPPLGSILYWLRPNTIR

SEQ ID NO: 307022 - protein, 17 aa, Mycobacterium
FPPMGSILYWLRPGTIR

SEQ ID NO: 307023 - protein, 17 aa, Mycobacterium
FPPMGSILYWLRPKTIR

SEQ ID NO: 307024 - protein, 19 aa, Mycobacterium
FPPMGSVLYWLRPGTIRLP

SEQ ID NO: 307025 - protein, 31 aa, Mycobacterium
FPPMGSVLYWLRPRTIRLPPWPNRVPLTAGD

SEQ ID NO: 307026 - protein, 20 aa, Mycobacterium
FPPPPPRPGPQPPQQATKPP

SEQ ID NO: 307027 - protein, 24 aa, Mycobacterium
FPPPRYPPPPGYGPPPGWQPPGYG

SEQ ID NO: 307028 - protein, 21 aa, Mycobacterium
FPPSRMKPDVLLIVADHDMRN

SEQ ID NO: 307029 - protein, 17 aa, Mycobacterium
FPPSWGYPAQPGGQPQP

SEQ ID NO: 307030 - protein, 20 aa, Mycobacterium
FPPVNWWWAAIVAVALLTWV

SEQ ID NO: 307031 - protein, 20 aa, Mycobacterium
FPQNMMTPMMLFIKSPHDLR

SEQ ID NO: 307032 - protein, 17 aa, Mycobacterium
FPQVVAVISNMAEKKSL

SEQ ID NO: 307033 - protein, 19 aa, Mycobacterium
FPRDIEARLSEVARNRRVP

SEQ ID NO: 307034 - protein, 17 aa, Mycobacterium
FPRELFPDQALALISRY

SEQ ID NO: 307035 - protein, 20 aa, Mycobacterium
FPRGNLIGIPGAPERMVQAK

SEQ ID NO: 307036 - protein, 20 aa, Mycobacterium
FPRGNLLGIPGAPERMVQNA

SEQ ID NO: 307037 - protein, 23 aa, Mycobacterium
FPRKISFLPGMRYYAGNWDTSLW

SEQ ID NO: 307038 - protein, 27 aa, Mycobacterium
FPRQFGYNMPLELVLTVTPFLIISVLF

SEQ ID NO: 307039 - protein, 21 aa, Mycobacterium
FPSGRHGIFRYWDVANPNNPH

SEQ ID NO: 307040 - protein, 19 aa, Mycobacterium
FPSGSRWARIDLPDDEYIP

SEQ ID NO: 307041 - protein, 18 aa, Mycobacterium
FPSPADFFYLVFTILAVL

SEQ ID NO: 307042 - protein, 20 aa, Mycobacterium
FPTDGIVVLCDFGASGSSVT

SEQ ID NO: 307043 - protein, 23 aa, Mycobacterium
FPTLLGVFSRWYVPQLLITGTAD

SEQ ID NO: 307044 - protein, 24 aa, Mycobacterium
FPTPNVFDAPAWVNFVIVPVYIAL

SEQ ID NO: 307045 - protein, 17 aa, Mycobacterium
FPTRMRYSGVSLGYQVT

SEQ ID NO: 307046 - protein, 19 aa, Mycobacterium
FPVGARWARIDLPDDEYVA

SEQ ID NO: 307047 - protein, 19 aa, Mycobacterium
FPVGNRWARIDLPDDEYIP

SEQ ID NO: 307048 - protein, 24 aa, Mycobacterium
FPVLPMAFTPDFAVVVDDWNRIGF

SEQ ID NO: 307049 - protein, 19 aa, Mycobacterium
FPVTLRLALIALAVEAVLG

SEQ ID NO: 307050 - protein, 19 aa, Mycobacterium
FPVVAWPPALPVAMWLLAA

SEQ ID NO: 307051 - protein, 19 aa, Mycobacterium
FPVVQPWYLLWAIIPLAAW

SEQ ID NO: 307052 - protein, 19 aa, Mycobacterium
FPVVVAALFGLTIAMPLGM

SEQ ID NO: 307053 - protein, 19 aa, Mycobacterium
FPVWMIFACHAIVLFYQFP

SEQ ID NO: 307054 - protein, 20 aa, Mycobacterium
FPVWMMLQIVLGRQSDAPSA

SEQ ID NO: 307055 - protein, 23 aa, Mycobacterium
FPWTECIRQASFMAATAIMPTIL

SEQ ID NO: 307056 - protein, 17 aa, Mycobacterium
FPYAAQIWQGMWQEQTG

SEQ ID NO: 307057 - protein, 17 aa, Mycobacterium
FPYWITVAVCAVGGILG

SEQ ID NO: 307058 - protein, 24 aa, Mycobacterium
FQAEEFRPHYGLTKPVHTFNIWKL

SEQ ID NO: 307059 - protein, 24 aa, Mycobacterium
FQGREFLDQCWFIARVSMAPTLLV

SEQ ID NO: 307060 - protein, 25 aa, Mycobacterium
FQILMRQGYRWTRTVLTGGAIAAVV

SEQ ID NO: 307061 - protein, 19 aa, Mycobacterium
FQIPAGIFIERAGTRRAMT

SEQ ID NO: 307062 - protein, 18 aa, Mycobacterium
FQISAAAARAVQPGGGIR

SEQ ID NO: 307063 - protein, 17 aa, Mycobacterium
FQKQRIGDMLKQVDDMN

SEQ ID NO: 307064 - protein, 20 aa, Mycobacterium
FQLAGSWPNLVAISLVIALA

SEQ ID NO: 307065 - protein, 34 aa, Mycobacterium
FQLILGKDLHWSLPGLSFILLVAVGADYNMLLIS

SEQ ID NO: 307066 - protein, 18 aa, Mycobacterium
FQLPYAKNRNRLGVQARI

SEQ ID NO: 307067 - protein, 18 aa, Mycobacterium
FQMFKRYSQFSGGTCDPL

SEQ ID NO: 307068 - protein, 17 aa, Mycobacterium
FQNPDFQRGLKLFLSPD

SEQ ID NO: 307069 - protein, 18 aa, Mycobacterium
FQNPDFQRGLKLMVSPDN

SEQ ID NO: 307070 - protein, 18 aa, Mycobacterium
FQNTNPVYSRSLWDQSHG

SEQ ID NO: 307071 - protein, 27 aa, Mycobacterium
FQQKAWRNLRFPLAWAPPEANVARIVA

SEQ ID NO: 307072 - protein, 19 aa, Mycobacterium
FQQRSVIVLTSLLLIIVAL

SEQ ID NO: 307073 - protein, 25 aa, Mycobacterium
FQQVNFSYRPGIPVIKDVSLVAEPG

SEQ ID NO: 307074 - protein, 17 aa, Mycobacterium
FQRGLKMFLSKDGKAAR

SEQ ID NO: 307075 - protein, 18 aa, Mycobacterium
FQRLLHRGKGAWENGALW

SEQ ID NO: 307076 - protein, 22 aa, Mycobacterium
FQRPAMLLFGLVPLALLAVYVV

SEQ ID NO: 307077 - protein, 19 aa, Mycobacterium
FQRTPAWIIPKPNPALSPR

SEQ ID NO: 307078 - protein, 19 aa, Mycobacterium
FQRWNSWDLIHRPGAVAAS

SEQ ID NO: 307079 - protein, 23 aa, Mycobacterium
FQSFTMWLIIGIIYFVVIMALTK

SEQ ID NO: 307080 - protein, 26 aa, Mycobacterium
FQSLPAVTVSHLFRRVPPVGSAPAAE

SEQ ID NO: 307081 - protein, 25 aa, Mycobacterium
FQSMALPCAISILVIVIAALTLAPA

SEQ ID NO: 307082 - protein, 25 aa, Mycobacterium
FQSMALPCAISLVVIVAAALTLAPA

SEQ ID NO: 307083 - protein, 25 aa, Mycobacterium
FQTLGIPCSVGMLVALLVALTLAPA

SEQ ID NO: 307084 - protein, 23 aa, Mycobacterium
FQTLIRRPLWWAGTAAAIAGFVF

SEQ ID NO: 307085 - protein, 19 aa, Mycobacterium
FQTSGFSGASGRNIKRAAE

SEQ ID NO: 307086 - protein, 19 aa, Mycobacterium
FQVGLRRFSYLLLQVAIAL

SEQ ID NO: 307087 - protein, 17 aa, Mycobacterium
FQVLYAARRLRPNHMPT

SEQ ID NO: 307088 - protein, 19 aa, Mycobacterium
FQVPYAKNRARLGVGASDR

SEQ ID NO: 307089 - protein, 19 aa, Mycobacterium
FQVPYAKNRARLGVSPGVR

SEQ ID NO: 307090 - protein, 18 aa, Mycobacterium
FQVVPVFFAVAGFASAVS

SEQ ID NO: 307091 - protein, 17 aa, Mycobacterium
FQWAPGVWAMMAAGLVV

SEQ ID NO: 307092 - protein, 18 aa, Mycobacterium
FQWHEFVRQGAFMAGTAV

SEQ ID NO: 307093 - protein, 21 aa, Mycobacterium
FQWNWKFGYQRVDFHDHTLTY

SEQ ID NO: 307094 - protein, 18 aa, Mycobacterium
FQWQEFVRQGAFMAGTAV

SEQ ID NO: 307095 - protein, 23 aa, Mycobacterium
FQWREFLEQSWFVAKVSMAPTLL

SEQ ID NO: 307096 - protein, 26 aa, Mycobacterium
FQWTALFCIACLALVATAIWTVLDRD

SEQ ID NO: 307097 - protein, 17 aa, Mycobacterium
FQYGLGKKIAWLVPLLA

SEQ ID NO: 307098 - protein, 17 aa, Mycobacterium
FQYWSWANLACVVCAIG

SEQ ID NO: 307099 - protein, 17 aa, Mycobacterium
FRAAGAATQKWPEELHR

SEQ ID NO: 307100 - protein, 23 aa, Mycobacterium
FRAALLLATLCGAAFLEGIDIAM

SEQ ID NO: 307101 - protein, 21 aa, Mycobacterium
FRAEARTVAMLNHPGIAGVYD

SEQ ID NO: 307102 - protein, 20 aa, Mycobacterium
FRAEARTVAMLNHPGIASVY

SEQ ID NO: 307103 - protein, 20 aa, Mycobacterium
FRAEVMRVRALDYVEAAFLS

SEQ ID NO: 307104 - protein, 17 aa, Mycobacterium
FRAGEKIGKLFATHPPM

SEQ ID NO: 307105 - protein, 17 aa, Mycobacterium
FRAGERIGSLFSTHPPI

SEQ ID NO: 307106 - protein, 20 aa, Mycobacterium
FRAHPAFGLGLGASPPEIYG

SEQ ID NO: 307107 - protein, 18 aa, Mycobacterium
FRAMQRMGEVFGESNSDS

SEQ ID NO: 307108 - protein, 19 aa, Mycobacterium
FRAQWPILLVGLIFTVAFV

SEQ ID NO: 307109 - protein, 19 aa, Mycobacterium
FRAVPVLIMMIFAYFFYAA

SEQ ID NO: 307110 - protein, 18 aa, Mycobacterium
FRAYGIDSMAEYRRRKGA

SEQ ID NO: 307111 - protein, 17 aa, Mycobacterium
FRDITWLGVSTRGAAPG

SEQ ID NO: 307112 - protein, 24 aa, Mycobacterium
FRDRNRLVTFIAIFLAGGVMFTLT

SEQ ID NO: 307113 - protein, 18 aa, Mycobacterium
FRDSHTFLKSTQVIQAVV

SEQ ID NO: 307114 - protein, 21 aa, Mycobacterium
FREEIHHGLKTGIIRSMAGTG

SEQ ID NO: 307115 - protein, 25 aa, Mycobacterium
FREIFTYPARFILRSTMHYMSVLNS

SEQ ID NO: 307116 - protein, 19 aa, Mycobacterium
FRESLRIYGVRTNEGRWAA

SEQ ID NO: 307117 - protein, 23 aa, Mycobacterium
FRFLCPLLGGAMLLVIFAISIRE

SEQ ID NO: 307118 - protein, 24 aa, Mycobacterium
FRGADQRAGGLLGPGAQHPAEARL

SEQ ID NO: 307119 - protein, 20 aa, Mycobacterium
FRGGPAFYIERGLRSRAGGV

SEQ ID NO: 307120 - protein, 19 aa, Mycobacterium
FRGIIPFIVADLVVVGVLI

SEQ ID NO: 307121 - protein, 25 aa, Mycobacterium
FRGLLGRLAIFTSVVIGYFVALARG

SEQ ID NO: 307122 - protein, 21 aa, Mycobacterium
FRGLLRAAGSFVHRRPRGSGA

SEQ ID NO: 307123 - protein, 21 aa, Mycobacterium
FRGLPEVVIILIIGLGVGPIV

SEQ ID NO: 307124 - protein, 21 aa, Mycobacterium
FRGLPEVVIILLIGLGVGPIV

SEQ ID NO: 307125 - protein, 21 aa, Mycobacterium
FRGLPEVVIILLIGLGVGPVV

SEQ ID NO: 307126 - protein, 21 aa, Mycobacterium
FRGLPEVVIILLIGMGVGPLV

SEQ ID NO: 307127 - protein, 25 aa, Mycobacterium
FRGPRGRIALGLTAVAWALLYLIHR

SEQ ID NO: 307128 - protein, 27 aa, Mycobacterium
FRGPRRPPRFTGWVAGAGFLAAIIVGL

SEQ ID NO: 307129 - protein, 21 aa, Mycobacterium
FRGSPQIPRKYVVLVGVTTVL

SEQ ID NO: 307130 - protein, 19 aa, Mycobacterium
FRGTSILVQLAWVVYALPF

SEQ ID NO: 307131 - protein, 25 aa, Mycobacterium
FRHEHSVGLAVPAYVAAKILVFGLV

SEQ ID NO: 307132 - protein, 21 aa, Mycobacterium
FRHGLLIGVAIAAVFVIAPVA

SEQ ID NO: 307133 - protein, 23 aa, Mycobacterium
FRHKDRPPRVVIECAPGEGTHDG

SEQ ID NO: 307134 - protein, 19 aa, Mycobacterium
FRIDWEQWKPQHLGSSATF

SEQ ID NO: 307135 - protein, 25 aa, Mycobacterium
FRIEGPPGLRRAVGRVVRLRPAEDA

SEQ ID NO: 307136 - protein, 26 aa, Mycobacterium
FRIPALIGAAWAYSVWHNGWVSLAIL

SEQ ID NO: 307137 - protein, 25 aa, Mycobacterium
FRIRKSDGTWGWYVVHSRRTEDGLT

SEQ ID NO: 307138 - protein, 17 aa, Mycobacterium
FRISLTSPDTVREGCGY

SEQ ID NO: 307139 - protein, 17 aa, Mycobacterium
FRITPDYDQKRKDTDTW

SEQ ID NO: 307140 - protein, 25 aa, Mycobacterium
FRKGADFTAAMAFEIGSTNLVAELG

SEQ ID NO: 307141 - protein, 25 aa, Mycobacterium
FRKGANFTAAMAFEIGSTNLVVELG

SEQ ID NO: 307142 - protein, 20 aa, Mycobacterium
FRKHVPGCASSYLEDTGTEV

SEQ ID NO: 307143 - protein, 17 aa, Mycobacterium
FRLADYVTDNAGALSDS

SEQ ID NO: 307144 - protein, 18 aa, Mycobacterium
FRLFFFHRLLMMTPLIAL

SEQ ID NO: 307145 - protein, 21 aa, Mycobacterium
FRLKQRPVRMAAATSTLTVSL

SEQ ID NO: 307146 - protein, 18 aa, Mycobacterium
FRLMVMLMIITAFASPVL

SEQ ID NO: 307147 - protein, 21 aa, Mycobacterium
FRLSGPDMRAVRQAVTRARRA

SEQ ID NO: 307148 - protein, 17 aa, Mycobacterium
FRLSLAGIFLVVVVTSS

SEQ ID NO: 307149 - protein, 21 aa, Mycobacterium
FRLSLLGKFLCFAIVAVGIGL

SEQ ID NO: 307150 - protein, 18 aa, Mycobacterium
FRNFPQVVAVISNMAEKR

SEQ ID NO: 307151 - protein, 17 aa, Mycobacterium
FRPAATIAVVLSVATVM

SEQ ID NO: 307152 - protein, 21 aa, Mycobacterium
FRPDRWDVIGALVCLAGVGVI

SEQ ID NO: 307153 - protein, 22 aa, Mycobacterium
FRPEKFMELGWVILLPAVLLQD

SEQ ID NO: 307154 - protein, 22 aa, Mycobacterium
FRPELPGGVRAVLRGSPPALND

SEQ ID NO: 307155 - protein, 38 aa, Mycobacterium
FRPHGPGTLGYRIWGVLASLCFMIGWGGVMLVVPTACW

SEQ ID NO: 307156 - protein, 17 aa, Mycobacterium
FRPIAAGVVPEWLAYAL

SEQ ID NO: 307157 - protein, 17 aa, Mycobacterium
FRPIAAGVVPEWLAYAV

SEQ ID NO: 307158 - protein, 17 aa, Mycobacterium
FRPIAAGVVPEWLAYTL

SEQ ID NO: 307159 - protein, 34 aa, Mycobacterium
FRPIRNYFYWEPHCFDIPFCAALRSVFDALDGID

SEQ ID NO: 307160 - protein, 36 aa, Mycobacterium
FRPIRNYLYWEPHCFDIPMCWAMRSLNESVDNIDEA

SEQ ID NO: 307161 - protein, 37 aa, Mycobacterium
FRPIRNYLYWEPHCYDIPMCWSMRSIFESIDGINTMS

SEQ ID NO: 307162 - protein, 35 aa, Mycobacterium
FRPIRNYLYWEPHCYNIPMCYSLRSIFDTMDGIDT

SEQ ID NO: 307163 - protein, 17 aa, Mycobacterium
FRPIRSYFYWEKHCFDI

SEQ ID NO: 307164 - protein, 36 aa, Mycobacterium
FRPIRSYFYWEKHCFDIPGCWSLRSLFDALDGLDQI

SEQ ID NO: 307165 - protein, 24 aa, Mycobacterium
FRPIRSYFYWERHCYDVPVCWALR

SEQ ID NO: 307166 - protein, 21 aa, Mycobacterium
FRPKLKAFMADLCWIENIGAR

SEQ ID NO: 307167 - protein, 29 aa, Mycobacterium
FRPLRNYFYWEPHCFDIPMCAAARSLFDS

SEQ ID NO: 307168 - protein, 17 aa, Mycobacterium
FRPPVLKSTVLGMLSRW

SEQ ID NO: 307169 - protein, 21 aa, Mycobacterium
FRPRPRRNQFASGTREYTPSG

SEQ ID NO: 307170 - protein, 28 aa, Mycobacterium
FRQIAAALGRPVVRLGFEPGELQRAQGA

SEQ ID NO: 307171 - protein, 21 aa, Mycobacterium
FRQIAAALGRTILPFAAGALQ

SEQ ID NO: 307172 - protein, 22 aa, Mycobacterium
FRQLWRKIRFRSDETAPLQTSM

SEQ ID NO: 307173 - protein, 18 aa, Mycobacterium
FRREAYAAARLASPNIIP

SEQ ID NO: 307174 - protein, 18 aa, Mycobacterium
FRRGGGRRGAERCAVIAT

SEQ ID NO: 307175 - protein, 24 aa, Mycobacterium
FRRGLRIAMRGRRDPATGAGQRSR

SEQ ID NO: 307176 - protein, 17 aa, Mycobacterium
FRRGMLYAVNPVGFGSM

SEQ ID NO: 307177 - protein, 23 aa, Mycobacterium
FRRLLRDRQWWTGSLVAGAGFGF

SEQ ID NO: 307178 - protein, 20 aa, Mycobacterium
FRRMLNRATFAWETGSLWVA

SEQ ID NO: 307179 - protein, 17 aa, Mycobacterium
FRRRRFGGEPGPVPNDG

SEQ ID NO: 307180 - protein, 17 aa, Mycobacterium
FRRVRREDVLGANGSNI

SEQ ID NO: 307181 - protein, 20 aa, Mycobacterium
FRRWAELLTALAHDPGVVEH

SEQ ID NO: 307182 - protein, 20 aa, Mycobacterium
FRRWERAMFVFIAITLIQIP

SEQ ID NO: 307183 - protein, 20 aa, Mycobacterium
FRRWERAMFVFIAITLLQIP

SEQ ID NO: 307184 - protein, 18 aa, Mycobacterium
FRRWERFLFALIAINIVM

SEQ ID NO: 307185 - protein, 25 aa, Mycobacterium
FRSAVRELSQTAGRLGDSRADLFGT

SEQ ID NO: 307186 - protein, 17 aa, Mycobacterium
FRSFLRPGFTPESIGDT

SEQ ID NO: 307187 - protein, 17 aa, Mycobacterium
FRSSGLTHLTAVSGANV

SEQ ID NO: 307188 - protein, 18 aa, Mycobacterium
FRSVATMVLILFMVFAEL

SEQ ID NO: 307189 - protein, 17 aa, Mycobacterium
FRTAFAAAYAVAYLVGG

SEQ ID NO: 307190 - protein, 25 aa, Mycobacterium
FRTAHAVLNLFGWVGLTVLGTLVTL

SEQ ID NO: 307191 - protein, 18 aa, Mycobacterium
FRTALRIDPGNASAMENV

SEQ ID NO: 307192 - protein, 20 aa, Mycobacterium
FRTGDLGRWVSTGSGDRYLV

SEQ ID NO: 307193 - protein, 19 aa, Mycobacterium
FRTLDAFRIFDNIYVLTAG

SEQ ID NO: 307194 - protein, 19 aa, Mycobacterium
FRTLDAFRIFDNIYVLTDG

SEQ ID NO: 307195 - protein, 18 aa, Mycobacterium
FRTLDAFRIFDNIYVLTG

SEQ ID NO: 307196 - protein, 19 aa, Mycobacterium
FRTLDAFRIFDNIYVLTGG

SEQ ID NO: 307197 - protein, 19 aa, Mycobacterium
FRTLDAFRIFDNIYVLTNG

SEQ ID NO: 307198 - protein, 17 aa, Mycobacterium
FRTLYAARRLRPRERPD

SEQ ID NO: 307199 - protein, 20 aa, Mycobacterium
FRTPWVPVLPILSIIACVWL

SEQ ID NO: 307200 - protein, 19 aa, Mycobacterium
FRTTMLYRLVRHPIMLGFI

SEQ ID NO: 307201 - protein, 25 aa, Mycobacterium
FRVAFAAACAMTVLLVLADLALALP

SEQ ID NO: 307202 - protein, 22 aa, Mycobacterium
FRVALELLGLARLMLGYRATMI

SEQ ID NO: 307203 - protein, 18 aa, Mycobacterium
FRVEFGAGLIKMRGDACW

SEQ ID NO: 307204 - protein, 19 aa, Mycobacterium
FRVLFRGWVVLPALVAFGV

SEQ ID NO: 307205 - protein, 17 aa, Mycobacterium
FRVMPEHKQVATSSNMW

SEQ ID NO: 307206 - protein, 22 aa, Mycobacterium
FRVPCDFWLASYWFIMCGTTAY

SEQ ID NO: 307207 - protein, 19 aa, Mycobacterium
FRWYWGDPVKSVWHDAALH

SEQ ID NO: 307208 - protein, 18 aa, Mycobacterium
FRYGQWGSASLVSLAHGT

SEQ ID NO: 307209 - protein, 17 aa, Mycobacterium
FRYRRSRSVANSFAMCL

SEQ ID NO: 307210 - protein, 26 aa, Mycobacterium
FSAAFAVCALFPLAAVGLVPVKLERP

SEQ ID NO: 307211 - protein, 24 aa, Mycobacterium
FSAAGAAMLCGWSDDDYGLSRVSW

SEQ ID NO: 307212 - protein, 18 aa, Mycobacterium
FSAAPNFAFELAVRRTTD

SEQ ID NO: 307213 - protein, 17 aa, Mycobacterium
FSAARYAMGSGQSNAQQ

SEQ ID NO: 307214 - protein, 17 aa, Mycobacterium
FSADVRRRLLDKLSRVP

SEQ ID NO: 307215 - protein, 22 aa, Mycobacterium
FSAELIGAIVVGVWLLCTQRHH

SEQ ID NO: 307216 - protein, 24 aa, Mycobacterium
FSAEPHRALVWLGWLTTATAAGWA

SEQ ID NO: 307217 - protein, 25 aa, Mycobacterium
FSAFAIELMALWLAGVRWHRDGVKA

SEQ ID NO: 307218 - protein, 19 aa, Mycobacterium
FSAFWRRVALENKLDPDVS

SEQ ID NO: 307219 - protein, 19 aa, Mycobacterium
FSAIIAGGIAPFVGALLLS

SEQ ID NO: 307220 - protein, 25 aa, Mycobacterium
FSAIPTFWLGLVVLQIFSVQLGLFS

SEQ ID NO: 307221 - protein, 20 aa, Mycobacterium
FSAPLAFAAAAVWCVTAVIG

SEQ ID NO: 307222 - protein, 19 aa, Mycobacterium
FSASASLLPLACWTCGVFS

SEQ ID NO: 307223 - protein, 18 aa, Mycobacterium
FSATGAALLCGWSDDTYG

SEQ ID NO: 307224 - protein, 25 aa, Mycobacterium
FSAVAVVWLLWVIFGYSMAFGTDIG

SEQ ID NO: 307225 - protein, 20 aa, Mycobacterium
FSAWDVFLGYELPQPPNVVT

SEQ ID NO: 307226 - protein, 24 aa, Mycobacterium
FSDARRAGRLVSDMLDLSRIDAGL

SEQ ID NO: 307227 - protein, 21 aa, Mycobacterium
FSDDDALRWAAALETRSEHPL

SEQ ID NO: 307228 - protein, 21 aa, Mycobacterium
FSDLAGWPNVHIISSDPFESI

SEQ ID NO: 307229 - protein, 34 aa, Mycobacterium
FSEAPHRAMVWLGWLTAATALGWVIDTATARIGF

SEQ ID NO: 307230 - protein, 25 aa, Mycobacterium
FSELRSANWWWALVGLAVSALKYLG

SEQ ID NO: 307231 - protein, 19 aa, Mycobacterium
FSEPEFPEPELFEPRPQAF

SEQ ID NO: 307232 - protein, 17 aa, Mycobacterium
FSEVFVAIGRLGRSLGI

SEQ ID NO: 307233 - protein, 22 aa, Mycobacterium
FSFAGAFGLSVLIWQHLVGLPL

SEQ ID NO: 307234 - protein, 17 aa, Mycobacterium
FSFGVLMLRIEETAIGA

SEQ ID NO: 307235 - protein, 29 aa, Mycobacterium
FSFLHQPTWLRLFSIMLMFAGVTTTALLV

SEQ ID NO: 307236 - protein, 26 aa, Mycobacterium
FSFYDGHYFGAWVFIAGFLMHIAVKM

SEQ ID NO: 307237 - protein, 20 aa, Mycobacterium
FSGAVLIIFTVLALVGYPAI

SEQ ID NO: 307238 - protein, 18 aa, Mycobacterium
FSGGCGLADDILVEPDSN

SEQ ID NO: 307239 - protein, 18 aa, Mycobacterium
FSGGCGLADDVLVEPDSN

SEQ ID NO: 307240 - protein, 17 aa, Mycobacterium
FSGGMIWVTNRFLLDQL

SEQ ID NO: 307241 - protein, 17 aa, Mycobacterium
FSGLLAQVASRRFDVGS

SEQ ID NO: 307242 - protein, 19 aa, Mycobacterium
FSGLLRAVKNNMFGGDTQG

SEQ ID NO: 307243 - protein, 24 aa, Mycobacterium
FSGLLWWIAFGMRDRLLVVATLTC

SEQ ID NO: 307244 - protein, 17 aa, Mycobacterium
FSGQGAVNWAQRTARAS

SEQ ID NO: 307245 - protein, 21 aa, Mycobacterium
FSGQSPTGWAQGTVRASDLGG

SEQ ID NO: 307246 - protein, 20 aa, Mycobacterium
FSGRPAQQYILAGILIAIGI

SEQ ID NO: 307247 - protein, 24 aa, Mycobacterium
FSGRRFDVGLGVGRRDDDYVASDV

SEQ ID NO: 307248 - protein, 21 aa, Mycobacterium
FSGTFGMLRLYLRRDRISLPL

SEQ ID NO: 307249 - protein, 21 aa, Mycobacterium
FSGTVGGLVPRFPGGLDSTVL

SEQ ID NO: 307250 - protein, 24 aa, Mycobacterium
FSGVPWLVTVNWWVLLAAFVLFIT

SEQ ID NO: 307251 - protein, 17 aa, Mycobacterium
FSGWEILVAALTTPILL

SEQ ID NO: 307252 - protein, 17 aa, Mycobacterium
FSHLVLHHEIRWIEVVH

SEQ ID NO: 307253 - protein, 34 aa, Mycobacterium
FSIAAGLLYFYFVLPRWFELMGETSHALGTTLRI

SEQ ID NO: 307254 - protein, 23 aa, Mycobacterium
FSIAMTLAGWVMRRWNDDLWERA

SEQ ID NO: 307255 - protein, 32 aa, Mycobacterium
FSITVTVLAFWIGRPLVRLNFLNERYGASFRY

SEQ ID NO: 307256 - protein, 18 aa, Mycobacterium
FSIWTLWSVMVLFMPQSV

SEQ ID NO: 307257 - protein, 20 aa, Mycobacterium
FSIWYLWSVMMLFMPQSVYG

SEQ ID NO: 307258 - protein, 23 aa, Mycobacterium
FSKAYGLAGLRIGYAVASHQLAP

SEQ ID NO: 307259 - protein, 18 aa, Mycobacterium
FSKILLLIFFSAVLVSKR

SEQ ID NO: 307260 - protein, 19 aa, Mycobacterium
FSKILLLVFFAAVLVDKRS

SEQ ID NO: 307261 - protein, 21 aa, Mycobacterium
FSKRWAKRWLPATAAIYAANG

SEQ ID NO: 307262 - protein, 20 aa, Mycobacterium
FSLAAAILGAWARFAGVAWP

SEQ ID NO: 307263 - protein, 21 aa, Mycobacterium
FSLAAARGVIAFLGYYEIIGL

SEQ ID NO: 307264 - protein, 20 aa, Mycobacterium
FSLALALLGLRARTPEDTAA

SEQ ID NO: 307265 - protein, 36 aa, Mycobacterium
FSLGHLLGVPAWVTQRLWWALLIVAGFWGLIRVAEA

SEQ ID NO: 307266 - protein, 19 aa, Mycobacterium
FSLGLGDPSSCTVGFLPPS

SEQ ID NO: 307267 - protein, 17 aa, Mycobacterium
FSLIQAISAGLVGASTR

SEQ ID NO: 307268 - protein, 20 aa, Mycobacterium
FSLLCGIVGPIFIVMYYVID

SEQ ID NO: 307269 - protein, 17 aa, Mycobacterium
FSLLGLRQLYFLIEGLL

SEQ ID NO: 307270 - protein, 26 aa, Mycobacterium
FSLLYAVCIVLRLARFNTLLDDDTAP

SEQ ID NO: 307271 - protein, 17 aa, Mycobacterium
FSLPRTFGRMVGSARQG

SEQ ID NO: 307272 - protein, 18 aa, Mycobacterium
FSLRTDLSYGVYIFAFPI

SEQ ID NO: 307273 - protein, 18 aa, Mycobacterium
FSLSAALSLLNWGLGLVA

SEQ ID NO: 307274 - protein, 19 aa, Mycobacterium
FSLTLGDPPACTVGFLPPS

SEQ ID NO: 307275 - protein, 30 aa, Mycobacterium
FSLVDWVSPVSWWWVLAGFLVFVTPPGRMS

SEQ ID NO: 307276 - protein, 17 aa, Mycobacterium
FSLVGALLWSYNGGRTF

SEQ ID NO: 307277 - protein, 25 aa, Mycobacterium
FSNASGLRPGQFVRASGVEIGKVKS

SEQ ID NO: 307278 - protein, 25 aa, Mycobacterium
FSNISGLRAGQFVRASGVEVGKVDK

SEQ ID NO: 307279 - protein, 17 aa, Mycobacterium
FSNVTYRGVQLGKVTAV

SEQ ID NO: 307280 - protein, 19 aa, Mycobacterium
FSPAGVRWAAGDQRDSANS

SEQ ID NO: 307281 - protein, 17 aa, Mycobacterium
FSPALSSALGWAIFHTL

SEQ ID NO: 307282 - protein, 18 aa, Mycobacterium
FSPLRRRANASIAVIDER

SEQ ID NO: 307283 - protein, 17 aa, Mycobacterium
FSPNFVALLSFLFGAGL

SEQ ID NO: 307284 - protein, 20 aa, Mycobacterium
FSPPSLRWAGAGDQRGPASA

SEQ ID NO: 307285 - protein, 28 aa, Mycobacterium
FSQPSSRASLWLPYLPVLLAIVVGAVHF

SEQ ID NO: 307286 - protein, 17 aa, Mycobacterium
FSRAVFRRLLSYSRKDF

SEQ ID NO: 307287 - protein, 17 aa, Mycobacterium
FSRDRNAGVLVMNNVPP

SEQ ID NO: 307288 - protein, 21 aa, Mycobacterium
FSRERNSGVLVMNNVTPPQPG

SEQ ID NO: 307289 - protein, 20 aa, Mycobacterium
FSRGEGQLVAVLDTGVRPGP

SEQ ID NO: 307290 - protein, 18 aa, Mycobacterium
FSRGPAIRGGIHRLGAML

SEQ ID NO: 307291 - protein, 19 aa, Mycobacterium
FSRLFPGRRFGGGALAVYQ

SEQ ID NO: 307292 - protein, 17 aa, Mycobacterium
FSSFFVVSNSLQLRNFG

SEQ ID NO: 307293 - protein, 17 aa, Mycobacterium
FSSRSLFALLSVTLAGA

SEQ ID NO: 307294 - protein, 19 aa, Mycobacterium
FSSVFVVANSLRLRSFTSV

SEQ ID NO: 307295 - protein, 19 aa, Mycobacterium
FSSVFVVGNSLRLRSFTSV

SEQ ID NO: 307296 - protein, 18 aa, Mycobacterium
FSSVFVVSNSLRLRRFTS

SEQ ID NO: 307297 - protein, 19 aa, Mycobacterium
FSTALARRDQLIGDTITNL

SEQ ID NO: 307298 - protein, 18 aa, Mycobacterium
FSTIARRQVRLIVADRAY

SEQ ID NO: 307299 - protein, 18 aa, Mycobacterium
FSTIARRQVRLVVADRAY

SEQ ID NO: 307300 - protein, 36 aa, Mycobacterium
FSTIGRRQLRLIISDRGYFIFLALLPFIMGTLSLSV

SEQ ID NO: 307301 - protein, 17 aa, Mycobacterium
FSTVGAFAIVGLIRDDD

SEQ ID NO: 307302 - protein, 18 aa, Mycobacterium
FSTVGAFAIVSLIRDADG

SEQ ID NO: 307303 - protein, 20 aa, Mycobacterium
FSVAIGALFAVVFAVAYGRV

SEQ ID NO: 307304 - protein, 18 aa, Mycobacterium
FSVALPVVLTVATMAFSY

SEQ ID NO: 307305 - protein, 18 aa, Mycobacterium
FSVDGWIIKRFPRLRAAL

SEQ ID NO: 307306 - protein, 26 aa, Mycobacterium
FSVDRWGRRPILLSGIAMMIAADGLL

SEQ ID NO: 307307 - protein, 18 aa, Mycobacterium
FSVGIALIVAGSVASGLM

SEQ ID NO: 307308 - protein, 23 aa, Mycobacterium
FSVGRALFGIAVVRRDGEPIGPW

SEQ ID NO: 307309 - protein, 20 aa, Mycobacterium
FSVGVDGFFALSGFLITASW

SEQ ID NO: 307310 - protein, 22 aa, Mycobacterium
FSVGWLYWYFWVIVVGFEAVAG

SEQ ID NO: 307311 - protein, 20 aa, Mycobacterium
FSVKVHWSVLVILWLFTWSL

SEQ ID NO: 307312 - protein, 17 aa, Mycobacterium
FSVLAAYAFARLEFPGR

SEQ ID NO: 307313 - protein, 20 aa, Mycobacterium
FSVLGGYAFARLEFPGRDAL

SEQ ID NO: 307314 - protein, 18 aa, Mycobacterium
FSVLRAAALNKWVDTGGY

SEQ ID NO: 307315 - protein, 25 aa, Mycobacterium
FSVLRVAELTKWVDAGGYGKVMSGS

SEQ ID NO: 307316 - protein, 18 aa, Mycobacterium
FSVNRLRSYFGVHDDRPL

SEQ ID NO: 307317 - protein, 21 aa, Mycobacterium
FSVPVLAPLVLRATLSRASVR

SEQ ID NO: 307318 - protein, 24 aa, Mycobacterium
FSVTSFGEFEFWFAGIKVAAIAIF

SEQ ID NO: 307319 - protein, 19 aa, Mycobacterium
FSVWSIWSVMVLFMPQNVY

SEQ ID NO: 307320 - protein, 21 aa, Mycobacterium
FSYAGAFGLSILVWQHLIGLH

SEQ ID NO: 307321 - protein, 17 aa, Mycobacterium
FSYEMRPSWSRTYAHGN

SEQ ID NO: 307322 - protein, 18 aa, Mycobacterium
FSYGALRYLRDGTSGLEA

SEQ ID NO: 307323 - protein, 33 aa, Mycobacterium
FSYSGAFGLSVLVWQHFLGIPLSWLNLPITFII

SEQ ID NO: 307324 - protein, 18 aa, Mycobacterium
FTAEPLLWLLAIDAGLIT

SEQ ID NO: 307325 - protein, 17 aa, Mycobacterium
FTAIGLVALVGGGLLTS

SEQ ID NO: 307326 - protein, 22 aa, Mycobacterium
FTAKLRFGIAVPLVGVALLVAD

SEQ ID NO: 307327 - protein, 19 aa, Mycobacterium
FTALACYKSVATWSLIVKH

SEQ ID NO: 307328 - protein, 20 aa, Mycobacterium
FTALCVFLPGIIGVTIGRWR

SEQ ID NO: 307329 - protein, 19 aa, Mycobacterium
FTALCVFLPGIIGVTVGRW

SEQ ID NO: 307330 - protein, 20 aa, Mycobacterium
FTAMGLRFAENIMYYLVVTF

SEQ ID NO: 307331 - protein, 21 aa, Mycobacterium
FTARPGSLIAVVGPSENRTTA

SEQ ID NO: 307332 - protein, 22 aa, Mycobacterium
FTASVLPVWLLLAPRDYLSTFM

SEQ ID NO: 307333 - protein, 25 aa, Mycobacterium
FTDDGTALWGFLEYDVELFSQSTAG

SEQ ID NO: 307334 - protein, 17 aa, Mycobacterium
FTDLIPPQVYWMVLQLA

SEQ ID NO: 307335 - protein, 28 aa, Mycobacterium
FTDQVAACKLIMLCLWWGAAVSKLNHHF

SEQ ID NO: 307336 - protein, 22 aa, Mycobacterium
FTEFALRPVAAQALEAGPPPVR

SEQ ID NO: 307337 - protein, 23 aa, Mycobacterium
FTEGFFSPLFFVWLGASLHVREL

SEQ ID NO: 307338 - protein, 26 aa, Mycobacterium
FTEPEMWFLRKAHQLCPAGVVVATKT

SEQ ID NO: 307339 - protein, 17 aa, Mycobacterium
FTETGAIKAKSVIIAAG

SEQ ID NO: 307340 - protein, 25 aa, Mycobacterium
FTFASTLCGIAWDGGTLITARLLHG

SEQ ID NO: 307341 - protein, 25 aa, Mycobacterium
FTFLGWHWSLPLGVAILLAAVGGGL

SEQ ID NO: 307342 - protein, 26 aa, Mycobacterium
FTFLGWHWSLPLGVAILLAAVVGGLI

SEQ ID NO: 307343 - protein, 37 aa, Mycobacterium
FTFTNKDRWSMFHSIAFDFSVWELWGALLHGGCVVVV

SEQ ID NO: 307344 - protein, 20 aa, Mycobacterium
FTGAWWTLVFPLGMYSVATY

SEQ ID NO: 307345 - protein, 17 aa, Mycobacterium
FTGFLRAFKNNIFGGDL

SEQ ID NO: 307346 - protein, 33 aa, Mycobacterium
FTGFRRLRALFTQRRATGLLGEHTVFGRLAAHA

SEQ ID NO: 307347 - protein, 18 aa, Mycobacterium
FTGGRYVTGLAREALTES

SEQ ID NO: 307348 - protein, 21 aa, Mycobacterium
FTGGWGAVVGLGMATGPLAGG

SEQ ID NO: 307349 - protein, 17 aa, Mycobacterium
FTGHLPAVLALTLIFGF

SEQ ID NO: 307350 - protein, 18 aa, Mycobacterium
FTGLHAMLDPPRGAARRA

SEQ ID NO: 307351 - protein, 24 aa, Mycobacterium
FTGLNFPAGVTVDLSGNVYVADLN

SEQ ID NO: 307352 - protein, 25 aa, Mycobacterium
FTGPDWRWVLAYATVVAPSLMLAAD

SEQ ID NO: 307353 - protein, 24 aa, Mycobacterium
FTGPELWWVAGVARWAAGLPGATV

SEQ ID NO: 307354 - protein, 26 aa, Mycobacterium
FTGPQVWWVLHVARWAADVPGATVAV

SEQ ID NO: 307355 - protein, 17 aa, Mycobacterium
FTGRGLRVLAVAAAPRD

SEQ ID NO: 307356 - protein, 21 aa, Mycobacterium
FTGRLDIDRAGALGISLGAVT

SEQ ID NO: 307357 - protein, 18 aa, Mycobacterium
FTGTVTRHDVTAAGLTTL

SEQ ID NO: 307358 - protein, 34 aa, Mycobacterium
FTGVEPRVLPALFPTKVRYGAMSIGFNISVSSFG

SEQ ID NO: 307359 - protein, 19 aa, Mycobacterium
FTGVYRVQFGPVTKLAEAP

SEQ ID NO: 307360 - protein, 17 aa, Mycobacterium
FTGWRGFDPGLGFWEPP

SEQ ID NO: 307361 - protein, 18 aa, Mycobacterium
FTGYPFLRGALRSLRSGK

SEQ ID NO: 307362 - protein, 27 aa, Mycobacterium
FTHEQRRALGLTGRLPAAVLTLDQQSE

SEQ ID NO: 307363 - protein, 17 aa, Mycobacterium
FTHEQRRRLGLTGRLPS

SEQ ID NO: 307364 - protein, 24 aa, Mycobacterium
FTHPVYRSALVVYFVVMSCYFGTL

SEQ ID NO: 307365 - protein, 24 aa, Mycobacterium
FTIASVLCGIAWNETTLVTARLLQ

SEQ ID NO: 307366 - protein, 26 aa, Mycobacterium
FTICCVLSFVVGFAMLGVMTYLPTFM

SEQ ID NO: 307367 - protein, 19 aa, Mycobacterium
FTILVPFLIGQSVILALAI

SEQ ID NO: 307368 - protein, 22 aa, Mycobacterium
FTILYAFPLFWLVETEVAVLIW

SEQ ID NO: 307369 - protein, 24 aa, Mycobacterium
FTIRGIRLSARISLVLELVSVSII

SEQ ID NO: 307370 - protein, 24 aa, Mycobacterium
FTISSVLCAVAWDEATLVIARLSQ

SEQ ID NO: 307371 - protein, 30 aa, Mycobacterium
FTITYSMRFMWGAFARKGLPEPSARVQGMH

SEQ ID NO: 307372 - protein, 39 aa, Mycobacterium
FTKFTLVMTLPWLLAIAAVYVIFRWFFARDLVAEPNREH

SEQ ID NO: 307373 - protein, 21 aa, Mycobacterium
FTKVILPLSMPGVLAGSMLVF

SEQ ID NO: 307374 - protein, 26 aa, Mycobacterium
FTKYPKRAVLGLALFIGQAFIYNAFT

SEQ ID NO: 307375 - protein, 21 aa, Mycobacterium
FTLEVYPRYLSLIPSNVNADI

SEQ ID NO: 307376 - protein, 32 aa, Mycobacterium
FTLEVYRLTGLWPKLGAPWYAFWRLLPKIPPW

SEQ ID NO: 307377 - protein, 25 aa, Mycobacterium
FTLLDGVVIFAFLLWHVIGANSSDD

SEQ ID NO: 307378 - protein, 18 aa, Mycobacterium
FTLPRPRLSAPPIPADVQ

SEQ ID NO: 307379 - protein, 26 aa, Mycobacterium
FTLRLAVGLGCGALIGIERQWRARMA

SEQ ID NO: 307380 - protein, 28 aa, Mycobacterium
FTLRLAVGVGCGALIGLERQWRARMAGL

SEQ ID NO: 307381 - protein, 17 aa, Mycobacterium
FTLSVPTLWRETPAPYG

SEQ ID NO: 307382 - protein, 19 aa, Mycobacterium
FTLSWWLGLYLVARDPRKP

SEQ ID NO: 307383 - protein, 18 aa, Mycobacterium
FTMAGPWVGIAAPGENIL

SEQ ID NO: 307384 - protein, 18 aa, Mycobacterium
FTMAGPWVGIAAPGENIV

SEQ ID NO: 307385 - protein, 19 aa, Mycobacterium
FTMAGPWVGIAAPGERIVS

SEQ ID NO: 307386 - protein, 25 aa, Mycobacterium
FTNVSGLRAGQFVRASGVEIGKVDK

SEQ ID NO: 307387 - protein, 19 aa, Mycobacterium
FTPKVKLTMFSERAGLVMD

SEQ ID NO: 307388 - protein, 24 aa, Mycobacterium
FTPLPWQFFAVLGAFVACYLVLVE

SEQ ID NO: 307389 - protein, 18 aa, Mycobacterium
FTPMAWGVLVGFVALYLI

SEQ ID NO: 307390 - protein, 27 aa, Mycobacterium
FTPQQVGSFPFVCSMNMISGTLVVTPN

SEQ ID NO: 307391 - protein, 23 aa, Mycobacterium
FTPRTLDVPLVFADLPGSPEFSV

SEQ ID NO: 307392 - protein, 20 aa, Mycobacterium
FTPTKWAIQFGIFAGLSGAL

SEQ ID NO: 307393 - protein, 25 aa, Mycobacterium
FTPTKWTHHFGVFAGLAGPLGALAA

SEQ ID NO: 307394 - protein, 25 aa, Mycobacterium
FTPTKWTHHFGVFAGLAGSLGALAA

SEQ ID NO: 307395 - protein, 18 aa, Mycobacterium
FTPVAWGVLVGFVALYLL

SEQ ID NO: 307396 - protein, 17 aa, Mycobacterium
FTPVLGVLAQKSNNFVP

SEQ ID NO: 307397 - protein, 18 aa, Mycobacterium
FTQHAFDIFGSVRAAHTA

SEQ ID NO: 307398 - protein, 18 aa, Mycobacterium
FTQMCVLTGKALARPFQW

SEQ ID NO: 307399 - protein, 17 aa, Mycobacterium
FTQNVGYGSDGKLVAPI

SEQ ID NO: 307400 - protein, 17 aa, Mycobacterium
FTQRVAIDVALKTPDGM

SEQ ID NO: 307401 - protein, 17 aa, Mycobacterium
FTQRVAIDVSLRTPDGM

SEQ ID NO: 307402 - protein, 22 aa, Mycobacterium
FTRARGDLVAGFRRHELWLHLG

SEQ ID NO: 307403 - protein, 17 aa, Mycobacterium
FTREADLAATLNHPNIV

SEQ ID NO: 307404 - protein, 17 aa, Mycobacterium
FTRGERRTVGWLIIVGT

SEQ ID NO: 307405 - protein, 25 aa, Mycobacterium
FTRLWPTVVCLTGYAISFALLALSI

SEQ ID NO: 307406 - protein, 23 aa, Mycobacterium
FTRYPRRAFLGLALFIGQAFLYN

SEQ ID NO: 307407 - protein, 24 aa, Mycobacterium
FTSFVVNWLLQWAAGGPNEVLAMG

SEQ ID NO: 307408 - protein, 20 aa, Mycobacterium
FTSIPMLFAQATYYGEFKDT

SEQ ID NO: 307409 - protein, 17 aa, Mycobacterium
FTTDGGERFPVRDLLLF

SEQ ID NO: 307410 - protein, 17 aa, Mycobacterium
FTTFGRVRPDQKRAIVH

SEQ ID NO: 307411 - protein, 22 aa, Mycobacterium
FTTIYSLRFLWGAFAGKGLSGP

SEQ ID NO: 307412 - protein, 18 aa, Mycobacterium
FTTLRMIYEDVQAHFRAD

SEQ ID NO: 307413 - protein, 17 aa, Mycobacterium
FTTMFALGVWFALHRRT

SEQ ID NO: 307414 - protein, 18 aa, Mycobacterium
FTTYCYIRSAGVADESNP

SEQ ID NO: 307415 - protein, 21 aa, Mycobacterium
FTVAAVLIWRRASDWWLLLGL

SEQ ID NO: 307416 - protein, 27 aa, Mycobacterium
FTVCCVLSFIVGFAMLGALTFLPTFMQ

SEQ ID NO: 307417 - protein, 29 aa, Mycobacterium
FTVFSDNVLRAWPGLFGVAVPVLEVALGA

SEQ ID NO: 307418 - protein, 26 aa, Mycobacterium
FTVGFYIPFAIPWNHYVGGGASGVAS

SEQ ID NO: 307419 - protein, 19 aa, Mycobacterium
FTVIALVVFRRARRSLRRR

SEQ ID NO: 307420 - protein, 19 aa, Mycobacterium
FTVIIAMLLLVYRSVITVL

SEQ ID NO: 307421 - protein, 19 aa, Mycobacterium
FTVIIGMLLLVYRSVITVL

SEQ ID NO: 307422 - protein, 20 aa, Mycobacterium
FTVLAALGFIASYQATQRRR

SEQ ID NO: 307423 - protein, 17 aa, Mycobacterium
FTVLLIFTLNVLLAQFG

SEQ ID NO: 307424 - protein, 17 aa, Mycobacterium
FTVLVVFTLNILLVEFG

SEQ ID NO: 307425 - protein, 21 aa, Mycobacterium
FTVMIFVVFGQMRFDRTNGYS

SEQ ID NO: 307426 - protein, 20 aa, Mycobacterium
FTVPAPFGLRDDVFTLLLSL

SEQ ID NO: 307427 - protein, 20 aa, Mycobacterium
FTVPLPRTLLARLFSRNPLV

SEQ ID NO: 307428 - protein, 20 aa, Mycobacterium
FTVQRTIFRLAFPGGTPRPK

SEQ ID NO: 307429 - protein, 17 aa, Mycobacterium
FTVVLWVAWVRRDLLGG

SEQ ID NO: 307430 - protein, 17 aa, Mycobacterium
FTWPIVAGIGLIIAGVL

SEQ ID NO: 307431 - protein, 25 aa, Mycobacterium
FVAAGGLLIALGFLFGGYEIADSGN

SEQ ID NO: 307432 - protein, 19 aa, Mycobacterium
FVAAGGLLIALGFLLAGYE

SEQ ID NO: 307433 - protein, 31 aa, Mycobacterium
FVACPFGVPGARMYRTGDLVSWRPDGQLQYR

SEQ ID NO: 307434 - protein, 17 aa, Mycobacterium
FVADDGVSLGIGFLGVA

SEQ ID NO: 307435 - protein, 30 aa, Mycobacterium
FVAELLDTWLWRWAAFLIVFGAQVVVGALL

SEQ ID NO: 307436 - protein, 30 aa, Mycobacterium
FVAELLDTWLWRWVAYLIVFGIMVVVGAVL

SEQ ID NO: 307437 - protein, 33 aa, Mycobacterium
FVAFDELWRWNSIVALVLSVLVILGLVVGVRVV

SEQ ID NO: 307438 - protein, 19 aa, Mycobacterium
FVAFPGFRPPMPPDLPADQ

SEQ ID NO: 307439 - protein, 17 aa, Mycobacterium
FVAFPLYVIHAVLTGLS

SEQ ID NO: 307440 - protein, 21 aa, Mycobacterium
FVAFWSCLTLVSRPACDLAGM

SEQ ID NO: 307441 - protein, 25 aa, Mycobacterium
FVAGALCGYLLLRRSLGRAAGPLIG

SEQ ID NO: 307442 - protein, 20 aa, Mycobacterium
FVAGVAALVRSRFPHLSARE

SEQ ID NO: 307443 - protein, 33 aa, Mycobacterium
FVALEVFSLPLYVMCALARRRRLLSQESALKYF

SEQ ID NO: 307444 - protein, 18 aa, Mycobacterium
FVALIAFVMLLISIHSVL

SEQ ID NO: 307445 - protein, 17 aa, Mycobacterium
FVALIAFVMLLVSVHSV

SEQ ID NO: 307446 - protein, 17 aa, Mycobacterium
FVALLIGGGVFGTAMLM

SEQ ID NO: 307447 - protein, 29 aa, Mycobacterium
FVANSWCSYICWRCFARTRSSPLRVALLF

SEQ ID NO: 307448 - protein, 21 aa, Mycobacterium
FVAPRLQRRFGTVPTLLVNLI

SEQ ID NO: 307449 - protein, 25 aa, Mycobacterium
FVARALRILPGYYIVLAITAFVVAP

SEQ ID NO: 307450 - protein, 32 aa, Mycobacterium
FVARHEILGIDGWRWLLILGGLAAVFVLAVRS

SEQ ID NO: 307451 - protein, 23 aa, Mycobacterium
FVARPVGGFVFGWLADRAGRRTA

SEQ ID NO: 307452 - protein, 17 aa, Mycobacterium
FVARVSLAPTLLVAIPF

SEQ ID NO: 307453 - protein, 17 aa, Mycobacterium
FVASSLYSTWTFLRVWR

SEQ ID NO: 307454 - protein, 20 aa, Mycobacterium
FVCFSHALNKVWRRHMLAKH

SEQ ID NO: 307455 - protein, 23 aa, Mycobacterium
FVCVGLIALLFIKVFGAAAPGGD

SEQ ID NO: 307456 - protein, 23 aa, Mycobacterium
FVDAIICYVGFLFPLWDAKRQTL

SEQ ID NO: 307457 - protein, 31 aa, Mycobacterium
FVDGEPRAGVVVGRARPVGKTVFVFPGQGSQ

SEQ ID NO: 307458 - protein, 23 aa, Mycobacterium
FVDHKLWIRFGVSGALLSAVLAL

SEQ ID NO: 307459 - protein, 19 aa, Mycobacterium
FVDHTVIGCSLVRGTPYRY

SEQ ID NO: 307460 - protein, 19 aa, Mycobacterium
FVEERWLSVALLCAGLAGF

SEQ ID NO: 307461 - protein, 18 aa, Mycobacterium
FVEHLTYHYTFGSLLDGI

SEQ ID NO: 307462 - protein, 23 aa, Mycobacterium
FVEKVWLRFVLSVTCALGVATAV

SEQ ID NO: 307463 - protein, 23 aa, Mycobacterium
FVENYRWIPSFGTGYILGIDGIA

SEQ ID NO: 307464 - protein, 26 aa, Mycobacterium
FVFAPAGAVLGHLGLARIRRTGELGR

SEQ ID NO: 307465 - protein, 18 aa, Mycobacterium
FVFFFPFTDQIAAFKLIM

SEQ ID NO: 307466 - protein, 17 aa, Mycobacterium
FVFICYHAAGIWRRGIV

SEQ ID NO: 307467 - protein, 24 aa, Mycobacterium
FVFPMTAFFLVWYAIYVALGAFAH

SEQ ID NO: 307468 - protein, 32 aa, Mycobacterium
FVFSWLRRRSGSLIAPIALHWSLNGLGALAAA

SEQ ID NO: 307469 - protein, 32 aa, Mycobacterium
FVFSWLRRRSGSLIAPIALHWSLNGVGALAAA

SEQ ID NO: 307470 - protein, 17 aa, Mycobacterium
FVFVCYHAAGIWRRGIV

SEQ ID NO: 307471 - protein, 25 aa, Mycobacterium
FVFVCYHAAGIWRRGIVGHPIKLLK

SEQ ID NO: 307472 - protein, 18 aa, Mycobacterium
FVFVCYHAAGIWRRGLVG

SEQ ID NO: 307473 - protein, 18 aa, Mycobacterium
FVFVCYHVAGIWRRGIVG

SEQ ID NO: 307474 - protein, 18 aa, Mycobacterium
FVFVCYHVAGIWRRGVVG

SEQ ID NO: 307475 - protein, 18 aa, Mycobacterium
FVFVRPFQWREFLEQSWF

SEQ ID NO: 307476 - protein, 18 aa, Mycobacterium
FVGAYGPYLAWLTAASAD

SEQ ID NO: 307477 - protein, 19 aa, Mycobacterium
FVGEGKLPWWTVSFSVVAT

SEQ ID NO: 307478 - protein, 18 aa, Mycobacterium
FVGELLVLVAGIVIAATI

SEQ ID NO: 307479 - protein, 18 aa, Mycobacterium
FVGFEVLLAASFVLLTIG

SEQ ID NO: 307480 - protein, 19 aa, Mycobacterium
FVGGLLVGRTPEFLGKKIG

SEQ ID NO: 307481 - protein, 17 aa, Mycobacterium
FVGIVAVLLLWRRPAAE

SEQ ID NO: 307482 - protein, 20 aa, Mycobacterium
FVGSASFLFANLVSSGGPAM

SEQ ID NO: 307483 - protein, 26 aa, Mycobacterium
FVGSGRWNSPCCGFDNPDGALSVIDA

SEQ ID NO: 307484 - protein, 18 aa, Mycobacterium
FVGWLPAVVVIGVLTALM

SEQ ID NO: 307485 - protein, 27 aa, Mycobacterium
FVHRALTCWRWWLAPAALFVALGAWPF

SEQ ID NO: 307486 - protein, 19 aa, Mycobacterium
FVHTIDWQPRVDVVDAQAH

SEQ ID NO: 307487 - protein, 17 aa, Mycobacterium
FVIAMVLLRSSLVGYGH

SEQ ID NO: 307488 - protein, 17 aa, Mycobacterium
FVIAWVFVVEAQLQEHS

SEQ ID NO: 307489 - protein, 20 aa, Mycobacterium
FVIDILPYVVVHGIGTAILL

SEQ ID NO: 307490 - protein, 26 aa, Mycobacterium
FVIDPLLVVDAVIEWILGGGAGFGAV

SEQ ID NO: 307491 - protein, 18 aa, Mycobacterium
FVIDRAVARRVSRPFPFG

SEQ ID NO: 307492 - protein, 18 aa, Mycobacterium
FVIGCAAIAYVVLTAPQR

SEQ ID NO: 307493 - protein, 18 aa, Mycobacterium
FVIGCGQALTAPAWQAIQ

SEQ ID NO: 307494 - protein, 18 aa, Mycobacterium
FVIGKLVNIIRCKLDDPL

SEQ ID NO: 307495 - protein, 17 aa, Mycobacterium
FVIGVAVTFSGVLSETL

SEQ ID NO: 307496 - protein, 23 aa, Mycobacterium
FVIRYFPIQSHFNAERAARAVEA

SEQ ID NO: 307497 - protein, 25 aa, Mycobacterium
FVIVDWRMHAAILPPSVFSPGPLKW

SEQ ID NO: 307498 - protein, 25 aa, Mycobacterium
FVIVDWRMHVAVLPHSVFGSGPLKW

SEQ ID NO: 307499 - protein, 18 aa, Mycobacterium
FVIVPVYIALAVLIGAVW

SEQ ID NO: 307500 - protein, 26 aa, Mycobacterium
FVKGKWKGHWMPKGRGFLLNTAESGE

SEQ ID NO: 307501 - protein, 17 aa, Mycobacterium
FVLAELLGYSAFAANIL

SEQ ID NO: 307502 - protein, 26 aa, Mycobacterium
FVLALSWASAAGWWYVSSFGIPFNSS

SEQ ID NO: 307503 - protein, 33 aa, Mycobacterium
FVLAPRLEPVAAFLNRHLGWFFLFKQGNVSLAG

SEQ ID NO: 307504 - protein, 17 aa, Mycobacterium
FVLAWAGLRARTRGGGW

SEQ ID NO: 307505 - protein, 23 aa, Mycobacterium
FVLFGIAALAAFWLHLRNKQDSR

SEQ ID NO: 307506 - protein, 20 aa, Mycobacterium
FVLGGGWLFIEHQRVRRLEE

SEQ ID NO: 307507 - protein, 19 aa, Mycobacterium
FVLGLALALVMHRTLIGKG

SEQ ID NO: 307508 - protein, 19 aa, Mycobacterium
FVLGLALALVMHRTLVGRG

SEQ ID NO: 307509 - protein, 25 aa, Mycobacterium
FVLGRPRLQRAYCRAVLRCFGVRIM

SEQ ID NO: 307510 - protein, 17 aa, Mycobacterium
FVLGSFYIVPSILAVRG

SEQ ID NO: 307511 - protein, 18 aa, Mycobacterium
FVLGWGLGGYLWATVAGA

SEQ ID NO: 307512 - protein, 19 aa, Mycobacterium
FVLHRAWVGPMVLVVLDDP

SEQ ID NO: 307513 - protein, 18 aa, Mycobacterium
FVLIAAVVYFLIVLPYNR

SEQ ID NO: 307514 - protein, 24 aa, Mycobacterium
FVLIFLVCGSLGLAGGAPFTALQI

SEQ ID NO: 307515 - protein, 28 aa, Mycobacterium
FVLIGVGLAVIFSYVWGVRVGGLFTALG

SEQ ID NO: 307516 - protein, 26 aa, Mycobacterium
FVLLGVFKMTAWKASLISLAVSIAVA

SEQ ID NO: 307517 - protein, 27 aa, Mycobacterium
FVLLLVEIIKEFAFFLVVAGLAALGAW

SEQ ID NO: 307518 - protein, 17 aa, Mycobacterium
FVLLWFFVQHERRAVFP

SEQ ID NO: 307519 - protein, 17 aa, Mycobacterium
FVLTAVITVCFDLIEAV

SEQ ID NO: 307520 - protein, 28 aa, Mycobacterium
FVLTPLAAILLRIDWPDFVPLITSESSR

SEQ ID NO: 307521 - protein, 25 aa, Mycobacterium
FVLVDWRMHVAVLPHSVFGPGPLKW

SEQ ID NO: 307522 - protein, 19 aa, Mycobacterium
FVLVPIFLYLLFYDGGHQT

SEQ ID NO: 307523 - protein, 24 aa, Mycobacterium
FVLWAAMIRFEYALVVSTATAAAA

SEQ ID NO: 307524 - protein, 24 aa, Mycobacterium
FVMESLTWTSPRTRATFGTTPAEA

SEQ ID NO: 307525 - protein, 18 aa, Mycobacterium
FVMLGRLAFAMIGSGRAA

SEQ ID NO: 307526 - protein, 20 aa, Mycobacterium
FVMYVVVHFGVGLQAKHPVA

SEQ ID NO: 307527 - protein, 20 aa, Mycobacterium
FVNELWMWIQEALLVAAEIL

SEQ ID NO: 307528 - protein, 19 aa, Mycobacterium
FVNFYACDITLKINGLQAG

SEQ ID NO: 307529 - protein, 19 aa, Mycobacterium
FVNFYSCDISLKINGLQPG

SEQ ID NO: 307530 - protein, 18 aa, Mycobacterium
FVNGKSWLVFGPYAGWSP

SEQ ID NO: 307531 - protein, 24 aa, Mycobacterium
FVPAALPWYYTWPLAVAAALVQTR

SEQ ID NO: 307532 - protein, 24 aa, Mycobacterium
FVPAALPWYYTWPLAVIAALAQSR

SEQ ID NO: 307533 - protein, 18 aa, Mycobacterium
FVPEITILQRERNLDHPS

SEQ ID NO: 307534 - protein, 18 aa, Mycobacterium
FVPGKYGAPHAMLALMVA

SEQ ID NO: 307535 - protein, 18 aa, Mycobacterium
FVPIHLVISAIVPARSLL

SEQ ID NO: 307536 - protein, 23 aa, Mycobacterium
FVPLADLSTMFALVPSTRFPGWG

SEQ ID NO: 307537 - protein, 17 aa, Mycobacterium
FVPLTIFIVCFHAARVL

SEQ ID NO: 307538 - protein, 24 aa, Mycobacterium
FVPNLRRWLSTEVRPKLKEVSSDL

SEQ ID NO: 307539 - protein, 24 aa, Mycobacterium
FVPNLRRWLSTEVRPKLKEVTSDL

SEQ ID NO: 307540 - protein, 21 aa, Mycobacterium
FVPRGHRLRTQLALATVGILG

SEQ ID NO: 307541 - protein, 26 aa, Mycobacterium
FVPWPRVPVRWLLLYGLGFGTIQFAF

SEQ ID NO: 307542 - protein, 24 aa, Mycobacterium
FVQHERRAVFPLIDLQLFTHPVYR

SEQ ID NO: 307543 - protein, 21 aa, Mycobacterium
FVRARQDLRKFVWLAATSILV

SEQ ID NO: 307544 - protein, 17 aa, Mycobacterium
FVRASGMALPFADDSMD

SEQ ID NO: 307545 - protein, 18 aa, Mycobacterium
FVREAEIAASLWHPNILG

SEQ ID NO: 307546 - protein, 21 aa, Mycobacterium
FVRGEGAGVVVLKRLTDAQRD

SEQ ID NO: 307547 - protein, 20 aa, Mycobacterium
FVRMCRGRGWQIIVLAAGER

SEQ ID NO: 307548 - protein, 17 aa, Mycobacterium
FVRRGGGVQTVRLPGAL

SEQ ID NO: 307549 - protein, 17 aa, Mycobacterium
FVSEFLVLLGTYNRYWL

SEQ ID NO: 307550 - protein, 18 aa, Mycobacterium
FVSFIAVGIALWRMRPGE

SEQ ID NO: 307551 - protein, 21 aa, Mycobacterium
FVSGSLWAVFAVLAKGVVHRI

SEQ ID NO: 307552 - protein, 18 aa, Mycobacterium
FVSLFPLLLLLTTGLGVV

SEQ ID NO: 307553 - protein, 21 aa, Mycobacterium
FVSMFAFAMYAVFPITAGFTA

SEQ ID NO: 307554 - protein, 18 aa, Mycobacterium
FVSNVVHSFEFTRYRIDR

SEQ ID NO: 307555 - protein, 18 aa, Mycobacterium
FVSPILDKFSAGWDALKS

SEQ ID NO: 307556 - protein, 22 aa, Mycobacterium
FVSRMPVSVILIGLGSILVLGG

SEQ ID NO: 307557 - protein, 22 aa, Mycobacterium
FVTAGSLVVHWATMQELYGITD

SEQ ID NO: 307558 - protein, 25 aa, Mycobacterium
FVTALSFATVNGWWYVSNFGVPWSN

SEQ ID NO: 307559 - protein, 17 aa, Mycobacterium
FVTARTALLDGFLTLFV

SEQ ID NO: 307560 - protein, 21 aa, Mycobacterium
FVTAVLLGLLIRDTVARPLAA

SEQ ID NO: 307561 - protein, 20 aa, Mycobacterium
FVTFLLAISLSAGWQLTFGP

SEQ ID NO: 307562 - protein, 19 aa, Mycobacterium
FVTFPMMRGALLAGAILAF

SEQ ID NO: 307563 - protein, 20 aa, Mycobacterium
FVTLCGLLFALQGFGVVGGS

SEQ ID NO: 307564 - protein, 22 aa, Mycobacterium
FVTLFARPRLRVGPSGVAVRNL

SEQ ID NO: 307565 - protein, 18 aa, Mycobacterium
FVTMAWWMAVFPGAAIFL

SEQ ID NO: 307566 - protein, 22 aa, Mycobacterium
FVTRVVDTYGRLDILVNNAGGT

SEQ ID NO: 307567 - protein, 17 aa, Mycobacterium
FVVAGRDHLSWGYFDQP

SEQ ID NO: 307568 - protein, 17 aa, Mycobacterium
FVVFGYVTFYLGPYFPA

SEQ ID NO: 307569 - protein, 26 aa, Mycobacterium
FVVFTRVLFRKELRANHVHIEEVMAL

SEQ ID NO: 307570 - protein, 19 aa, Mycobacterium
FVVGAWIAILAMGALFGIM

SEQ ID NO: 307571 - protein, 27 aa, Mycobacterium
FVVGGAMPLIAAVAWVFAPETLGRLAS

SEQ ID NO: 307572 - protein, 18 aa, Mycobacterium
FVVGVAFNRIMAAARPAS

SEQ ID NO: 307573 - protein, 19 aa, Mycobacterium
FVVGWGLVGFLWATVAGSV

SEQ ID NO: 307574 - protein, 19 aa, Mycobacterium
FVVHRAWIGPMVLVVLNDA

SEQ ID NO: 307575 - protein, 18 aa, Mycobacterium
FVVIAVTAVGAWASMRIP

SEQ ID NO: 307576 - protein, 24 aa, Mycobacterium
FVVIIVMLLWVYRSIITVFSTLFM

SEQ ID NO: 307577 - protein, 20 aa, Mycobacterium
FVVIPICALLTYNAVSTILD

SEQ ID NO: 307578 - protein, 17 aa, Mycobacterium
FVVLVWIFGGLYAALLP

SEQ ID NO: 307579 - protein, 23 aa, Mycobacterium
FVVRGAMKAAWDKLKGATGKLGA

SEQ ID NO: 307580 - protein, 21 aa, Mycobacterium
FVWDAWTVGLQWWRRFGPERP

SEQ ID NO: 307581 - protein, 20 aa, Mycobacterium
FVWDAWTVGLQWWRRFGPQR

SEQ ID NO: 307582 - protein, 26 aa, Mycobacterium
FVWMIAVAFLYLVLGGMGVWSKLNSN

SEQ ID NO: 307583 - protein, 25 aa, Mycobacterium
FVWQELIGIPLHWSVAPLSFVFLVA

SEQ ID NO: 307584 - protein, 22 aa, Mycobacterium
FVYDHKVFFAVAAILLVTALNL

SEQ ID NO: 307585 - protein, 18 aa, Mycobacterium
FWAALIKVIALVIFLIIG

SEQ ID NO: 307586 - protein, 18 aa, Mycobacterium
FWAARFGTTVLYSQATGV

SEQ ID NO: 307587 - protein, 18 aa, Mycobacterium
FWAGVLVYFLPRRSWLRA

SEQ ID NO: 307588 - protein, 17 aa, Mycobacterium
FWASLIKVLALVTFLVV

SEQ ID NO: 307589 - protein, 23 aa, Mycobacterium
FWAWWRYGRNWASVCALHGLTAR

SEQ ID NO: 307590 - protein, 18 aa, Mycobacterium
FWAYSCINCQRAIPHVID

SEQ ID NO: 307591 - protein, 22 aa, Mycobacterium
FWCALSLPPLLLGMLGSLAYVA

SEQ ID NO: 307592 - protein, 17 aa, Mycobacterium
FWCMNIGLAWMVFATLL

SEQ ID NO: 307593 - protein, 24 aa, Mycobacterium
FWDTELWMYPNLLLAHPEIARNII

SEQ ID NO: 307594 - protein, 17 aa, Mycobacterium
FWELPVYDPHHLAGTVP

SEQ ID NO: 307595 - protein, 19 aa, Mycobacterium
FWFGWAIVFASTFMINHFD

SEQ ID NO: 307596 - protein, 22 aa, Mycobacterium
FWFPEVHAGAMAPIGIGALAAL

SEQ ID NO: 307597 - protein, 19 aa, Mycobacterium
FWGAFGLVAGAAFGLLQET

SEQ ID NO: 307598 - protein, 18 aa, Mycobacterium
FWGKMFAVVAVWTHGLVA

SEQ ID NO: 307599 - protein, 22 aa, Mycobacterium
FWGLPLWWVCVNPLMPLTAGTL

SEQ ID NO: 307600 - protein, 18 aa, Mycobacterium
FWHLKTITIPLLLALMGS

SEQ ID NO: 307601 - protein, 17 aa, Mycobacterium
FWHSWPLTGREIGYAPA

SEQ ID NO: 307602 - protein, 29 aa, Mycobacterium
FWILGVLVLICLFFSVLAGDRFLSAGNFS

SEQ ID NO: 307603 - protein, 17 aa, Mycobacterium
FWINVPLTAIAMVMIHF

SEQ ID NO: 307604 - protein, 19 aa, Mycobacterium
FWLCPVSGRVAHARIDIVG

SEQ ID NO: 307605 - protein, 19 aa, Mycobacterium
FWLELKLLLRNGEQLLLTM

SEQ ID NO: 307606 - protein, 18 aa, Mycobacterium
FWLGAPIADMLFMLGAAG

SEQ ID NO: 307607 - protein, 17 aa, Mycobacterium
FWLVCLYSLAVHLNEPA

SEQ ID NO: 307608 - protein, 18 aa, Mycobacterium
FWMLLAGRKLSARDRRVL

SEQ ID NO: 307609 - protein, 19 aa, Mycobacterium
FWMTQPWVDAAFKKRGIDP

SEQ ID NO: 307610 - protein, 27 aa, Mycobacterium
FWPSAPRWLGVPLYILLGWVAAWFIGP

SEQ ID NO: 307611 - protein, 17 aa, Mycobacterium
FWQRFRTIIVPSAAPQV

SEQ ID NO: 307612 - protein, 22 aa, Mycobacterium
FWRGHIGEWIITRGLRVVMLLI

SEQ ID NO: 307613 - protein, 21 aa, Mycobacterium
FWRLLPKIPPWLGLQTTLSGL

SEQ ID NO: 307614 - protein, 17 aa, Mycobacterium
FWRLLQVRMASQFGDGL

SEQ ID NO: 307615 - protein, 23 aa, Mycobacterium
FWRPIRSYFYWDKHCNGVPMCWS

SEQ ID NO: 307616 - protein, 25 aa, Mycobacterium
FWSDAYPRLTALGWTGVLDKGPDVR

SEQ ID NO: 307617 - protein, 25 aa, Mycobacterium
FWTLLEIIPNLTLIVVLGFGAYAAG

SEQ ID NO: 307618 - protein, 24 aa, Mycobacterium
FWTPDYGAVIVRGAMNAAWEKLGG

SEQ ID NO: 307619 - protein, 25 aa, Mycobacterium
FWTVACGLSAVALFLTWPPNVVDAA

SEQ ID NO: 307620 - protein, 20 aa, Mycobacterium
FWVPEFLFKRDVIPNADANN

SEQ ID NO: 307621 - protein, 20 aa, Mycobacterium
FWVPEFLFKRDVIPNAEANN

SEQ ID NO: 307622 - protein, 25 aa, Mycobacterium
FWYRSTRYVLRHAIPIGLSVVALLL

SEQ ID NO: 307623 - protein, 23 aa, Mycobacterium
FWYRSTRYVLRHSLPVGLSVIAL

SEQ ID NO: 307624 - protein, 17 aa, Mycobacterium
FWYSLTMAIVLMAAVAA

SEQ ID NO: 307625 - protein, 17 aa, Mycobacterium
FYAARFATTSVYGQPTG

SEQ ID NO: 307626 - protein, 19 aa, Mycobacterium
FYALTCWAFVVAIGPDQVA

SEQ ID NO: 307627 - protein, 18 aa, Mycobacterium
FYALVGHALAPGGLMVVQ

SEQ ID NO: 307628 - protein, 25 aa, Mycobacterium
FYAREEPWTPIVLIVVITIVKIAAS

SEQ ID NO: 307629 - protein, 17 aa, Mycobacterium
FYAYYKFVRYEEAPPER

SEQ ID NO: 307630 - protein, 21 aa, Mycobacterium
FYCYGEGKVAAIQELAKREGY

SEQ ID NO: 307631 - protein, 18 aa, Mycobacterium
FYDEHHWVLWAGVAFLGF

SEQ ID NO: 307632 - protein, 19 aa, Mycobacterium
FYGARARRLLPAAATVGVA

SEQ ID NO: 307633 - protein, 19 aa, Mycobacterium
FYGARARRLLPASAAVGVV

SEQ ID NO: 307634 - protein, 24 aa, Mycobacterium
FYGARARRLLPASALVGVVTAIAS

SEQ ID NO: 307635 - protein, 23 aa, Mycobacterium
FYIAVAIGFGVWFAMTHGGDFGT

SEQ ID NO: 307636 - protein, 26 aa, Mycobacterium
FYIPPEVFDNPDFKRGLKMFLSPDGH

SEQ ID NO: 307637 - protein, 17 aa, Mycobacterium
FYITYSLAHIVGAVLVL

SEQ ID NO: 307638 - protein, 23 aa, Mycobacterium
FYIYGTAAALVFPAVFFPNLSHS

SEQ ID NO: 307639 - protein, 20 aa, Mycobacterium
FYIYGTAAALVFPSVFYPGL

SEQ ID NO: 307640 - protein, 18 aa, Mycobacterium
FYLALPLLAFLARRVPVG

SEQ ID NO: 307641 - protein, 19 aa, Mycobacterium
FYLALPLLALLARRLPVRA

SEQ ID NO: 307642 - protein, 18 aa, Mycobacterium
FYLALPVLALLARRIPVG

SEQ ID NO: 307643 - protein, 18 aa, Mycobacterium
FYLALPVLALLARRLPVR

SEQ ID NO: 307644 - protein, 19 aa, Mycobacterium
FYLPPDIFENADFKKAMSQ

SEQ ID NO: 307645 - protein, 20 aa, Mycobacterium
FYLPPDVFDNPDFKRGMKMF

SEQ ID NO: 307646 - protein, 26 aa, Mycobacterium
FYLPPEAFDNPAFKRGMKLFMSPDGK

SEQ ID NO: 307647 - protein, 24 aa, Mycobacterium
FYLPPEIFDNADFKRGMKSFLSPD

SEQ ID NO: 307648 - protein, 26 aa, Mycobacterium
FYLPPEIFDNPDFKRGLKMFLSPDGK

SEQ ID NO: 307649 - protein, 23 aa, Mycobacterium
FYLPPEIFENADFQRGLEQFLSP

SEQ ID NO: 307650 - protein, 21 aa, Mycobacterium
FYLPPEIFNNADFKRGMDSFI

SEQ ID NO: 307651 - protein, 26 aa, Mycobacterium
FYLPPEVFDNPDFKRGLKMFLSPDGK

SEQ ID NO: 307652 - protein, 25 aa, Mycobacterium
FYLPPEVFENADFKRAMGSFLSPDG

SEQ ID NO: 307653 - protein, 17 aa, Mycobacterium
FYLPPEVFKNEDFKRAM

SEQ ID NO: 307654 - protein, 18 aa, Mycobacterium
FYLPPEVFKNKDFQRAMK

SEQ ID NO: 307655 - protein, 24 aa, Mycobacterium
FYLPPEVFNNPDFKRGLEQFLSPD

SEQ ID NO: 307656 - protein, 26 aa, Mycobacterium
FYLPPEVFNNPDFKRGLKLFLSPDGK

SEQ ID NO: 307657 - protein, 27 aa, Mycobacterium
FYLPPEVFNNPDFKRGLKLFLSPDGKA

SEQ ID NO: 307658 - protein, 26 aa, Mycobacterium
FYLPPEVFNNPDFKRGMKMFLSQDGK

SEQ ID NO: 307659 - protein, 25 aa, Mycobacterium
FYLPPEVFTNANFKRIMKLFLSPDG

SEQ ID NO: 307660 - protein, 19 aa, Mycobacterium
FYLPPRLVSLYGTAMWDEM

SEQ ID NO: 307661 - protein, 22 aa, Mycobacterium
FYLTCAVFVFGVLGVLLYVVSG

SEQ ID NO: 307662 - protein, 27 aa, Mycobacterium
FYLVWPALIIATAWLLRRIGKNNRGAT

SEQ ID NO: 307663 - protein, 26 aa, Mycobacterium
FYLVWPALIIATAWLVRRARRRPSAA

SEQ ID NO: 307664 - protein, 25 aa, Mycobacterium
FYLVWPALILGVAWWLRRRSAGGGR

SEQ ID NO: 307665 - protein, 17 aa, Mycobacterium
FYMWWRAQQQKVDHNNV

SEQ ID NO: 307666 - protein, 20 aa, Mycobacterium
FYPGEEALRDAIRRGDVYGG

SEQ ID NO: 307667 - protein, 19 aa, Mycobacterium
FYPIPKFPFNILPLIFGAI

SEQ ID NO: 307668 - protein, 20 aa, Mycobacterium
FYPQRFKGWALGLNAGGGNI

SEQ ID NO: 307669 - protein, 24 aa, Mycobacterium
FYRRSGALLCLLYAFNGTDFHFEN

SEQ ID NO: 307670 - protein, 17 aa, Mycobacterium
FYRSLKLSWHADLLSDQ

SEQ ID NO: 307671 - protein, 29 aa, Mycobacterium
FYSALPICGTALFVAAVALTFLAVTTSRN

SEQ ID NO: 307672 - protein, 17 aa, Mycobacterium
FYSLCYLGFGVPAAMVF

SEQ ID NO: 307673 - protein, 18 aa, Mycobacterium
FYSNPGFDFTGFARAVDN

SEQ ID NO: 307674 - protein, 17 aa, Mycobacterium
FYSPLFYRDLIGDPTGL

SEQ ID NO: 307675 - protein, 22 aa, Mycobacterium
FYTLLRITRFIGILIIAMSLPL

SEQ ID NO: 307676 - protein, 18 aa, Mycobacterium
FYTPTFRKIVEWVEYVCL

SEQ ID NO: 307677 - protein, 25 aa, Mycobacterium
FYTPWSWLPRIVMQFTAGALACAAV

SEQ ID NO: 307678 - protein, 22 aa, Mycobacterium
FYTPWSWLPRIVTQFIAGALAC

SEQ ID NO: 307679 - protein, 22 aa, Mycobacterium
FYTPWSWLPRIVTQFVAGALAA

SEQ ID NO: 307680 - protein, 18 aa, Mycobacterium
FYVALPFLAYVLLVLVSR

SEQ ID NO: 307681 - protein, 23 aa, Mycobacterium
FYWAIGIAVGFPVGLILLTELHR

SEQ ID NO: 307682 - protein, 17 aa, Mycobacterium
FYWAVGIAAALPVLVVI

SEQ ID NO: 307683 - protein, 21 aa, Mycobacterium
FYWAVGIAIGLPVGMILLTEL

SEQ ID NO: 307684 - protein, 25 aa, Mycobacterium
FYWAVSVALGLPVLIVILTELQHTL

SEQ ID NO: 307685 - protein, 17 aa, Mycobacterium
FYYASVVTLAFGLALAV

SEQ ID NO: 307686 - protein, 25 aa, Mycobacterium
GAAAARFTRRPRIRSAVRQLLLGGA

SEQ ID NO: 307687 - protein, 25 aa, Mycobacterium
GAAADALRRGWAMAAICFVVVAIAA

SEQ ID NO: 307688 - protein, 25 aa, Mycobacterium
GAAALCGVCALLTLAAARRRGKALS

SEQ ID NO: 307689 - protein, 30 aa, Mycobacterium
GAAAWLDAAVWWKALLALAVSLALIVGVNF

SEQ ID NO: 307690 - protein, 21 aa, Mycobacterium
GAAAWSRPIGTQALFRPNFDD

SEQ ID NO: 307691 - protein, 22 aa, Mycobacterium
GAAAYRFLIERFLPAEPPVLDD

SEQ ID NO: 307692 - protein, 17 aa, Mycobacterium
GAADVFFLLGVADDEAM

SEQ ID NO: 307693 - protein, 23 aa, Mycobacterium
GAAEGRPPLHVDLDPTGGPFNRL

SEQ ID NO: 307694 - protein, 24 aa, Mycobacterium
GAAELAFLVAMVMARPDPRALVDG

SEQ ID NO: 307695 - protein, 27 aa, Mycobacterium
GAAEPVWWTLYLACYLAGGWGSAWAGA

SEQ ID NO: 307696 - protein, 28 aa, Mycobacterium
GAAERDGRRLIAVLLKGTRVPIAPWEQA

SEQ ID NO: 307697 - protein, 20 aa, Mycobacterium
GAAFSMATGYTWVLTLVATG

SEQ ID NO: 307698 - protein, 20 aa, Mycobacterium
GAAGLMMVSLVYGLSRLAHG

SEQ ID NO: 307699 - protein, 19 aa, Mycobacterium
GAAIAAAPATVLAAGDATA

SEQ ID NO: 307700 - protein, 17 aa, Mycobacterium
GAAIGLWRAKIVEMTGM

SEQ ID NO: 307701 - protein, 24 aa, Mycobacterium
GAAIPVLIVGVVVWVGITNDRKER

SEQ ID NO: 307702 - protein, 19 aa, Mycobacterium
GAAIWRLGELTGLPGVPDA

SEQ ID NO: 307703 - protein, 26 aa, Mycobacterium
GAAKALCILLGYLAAVLMHGLWNGSS

SEQ ID NO: 307704 - protein, 36 aa, Mycobacterium
GAAKVCEIVCAALICAACLTALVLNGVRADKRTVTA

SEQ ID NO: 307705 - protein, 21 aa, Mycobacterium
GAALAALGWWLLRRRTDVPPL

SEQ ID NO: 307706 - protein, 25 aa, Mycobacterium
GAALACAQPGEFAAWEHTTRQPVTP

SEQ ID NO: 307707 - protein, 28 aa, Mycobacterium
GAALAKRVEWGAVLPYWIVQVIGGLLAG

SEQ ID NO: 307708 - protein, 18 aa, Mycobacterium
GAALAWLAGSSVRPLAYA

SEQ ID NO: 307709 - protein, 17 aa, Mycobacterium
GAALCAAGPLTVAHTDN

SEQ ID NO: 307710 - protein, 21 aa, Mycobacterium
GAALCLPLARALNRSGDVGVR

SEQ ID NO: 307711 - protein, 18 aa, Mycobacterium
GAALLGFLGGLALNKEAA

SEQ ID NO: 307712 - protein, 26 aa, Mycobacterium
GAALLRPGRGPSVWYQPDRTSAQPVG

SEQ ID NO: 307713 - protein, 21 aa, Mycobacterium
GAALPGLFALGLRFHAVGAGQ

SEQ ID NO: 307714 - protein, 18 aa, Mycobacterium
GAALPHLAGELVRAATAF

SEQ ID NO: 307715 - protein, 17 aa, Mycobacterium
GAALPLISIEFHLAATE

SEQ ID NO: 307716 - protein, 20 aa, Mycobacterium
GAALRALLDMGAKDVAVVRN

SEQ ID NO: 307717 - protein, 17 aa, Mycobacterium
GAALRALLNLGAKDVSV

SEQ ID NO: 307718 - protein, 18 aa, Mycobacterium
GAALRYAAVEKDAVIVAA

SEQ ID NO: 307719 - protein, 24 aa, Mycobacterium
GAALYALTTRRWPLAETGQPSGLP

SEQ ID NO: 307720 - protein, 19 aa, Mycobacterium
GAAMAFSSFFVVSNSLQLR

SEQ ID NO: 307721 - protein, 18 aa, Mycobacterium
GAAMAFSSVFVVANSLRL

SEQ ID NO: 307722 - protein, 17 aa, Mycobacterium
GAAMAFSSVFVVTNSLR

SEQ ID NO: 307723 - protein, 23 aa, Mycobacterium
GAAMIARSFGWRAVATATAAVTA

SEQ ID NO: 307724 - protein, 28 aa, Mycobacterium
GAANRNGRRLMAVLLHGTRQPIAPWEQA

SEQ ID NO: 307725 - protein, 21 aa, Mycobacterium
GAAPDWLLATFDRLHNQLGGL

SEQ ID NO: 307726 - protein, 24 aa, Mycobacterium
GAAPFRAPLQTSFRDFVALERQAE

SEQ ID NO: 307727 - protein, 21 aa, Mycobacterium
GAAPWSATTLVVWLVTTIAAI

SEQ ID NO: 307728 - protein, 25 aa, Mycobacterium
GAAQCSVGFGVGRGCDGLTVDGNRV

SEQ ID NO: 307729 - protein, 25 aa, Mycobacterium
GAAQTEIFPLLTLSVGGMMVFPAAN

SEQ ID NO: 307730 - protein, 25 aa, Mycobacterium
GAAQTEIFPLLTLSVGGMMVFSASN

SEQ ID NO: 307731 - protein, 26 aa, Mycobacterium
GAAQTELFPLLMLSVGGMLVFPASND

SEQ ID NO: 307732 - protein, 18 aa, Mycobacterium
GAARARIYHRLAVGPAAE

SEQ ID NO: 307733 - protein, 17 aa, Mycobacterium
GAARFTLRTVFVALVAA

SEQ ID NO: 307734 - protein, 17 aa, Mycobacterium
GAARPARPTPKQAHAAN

SEQ ID NO: 307735 - protein, 19 aa, Mycobacterium
GAARPSFWYDEAATISASY

SEQ ID NO: 307736 - protein, 26 aa, Mycobacterium
GAARSARPNHRWLDVVAVAVVAALGG

SEQ ID NO: 307737 - protein, 20 aa, Mycobacterium
GAASAVWLVRTHRRVRETEL

SEQ ID NO: 307738 - protein, 26 aa, Mycobacterium
GAASFRRRWLVLGTWLAVLLGVGLAF

SEQ ID NO: 307739 - protein, 27 aa, Mycobacterium
GAASFVLGVLCFKDELNSILLLAIWIG

SEQ ID NO: 307740 - protein, 18 aa, Mycobacterium
GAASRAYIAQALAQSQRA

SEQ ID NO: 307741 - protein, 28 aa, Mycobacterium
GAATATFLRWAWYAARRENLHLDDADDD

SEQ ID NO: 307742 - protein, 24 aa, Mycobacterium
GAAVAGSLIVHWSTMHDLYSITES

SEQ ID NO: 307743 - protein, 25 aa, Mycobacterium
GAAVLWMALSIWFGYLSAVHAGRFT

SEQ ID NO: 307744 - protein, 18 aa, Mycobacterium
GAAVWLRASREQLDADSD

SEQ ID NO: 307745 - protein, 24 aa, Mycobacterium
GAAYKRRLALALTLTASYALVEVV

SEQ ID NO: 307746 - protein, 18 aa, Mycobacterium
GACAAVWLVLVGVSVAAA

SEQ ID NO: 307747 - protein, 19 aa, Mycobacterium
GACLCLSLTTLDYFRTLGP

SEQ ID NO: 307748 - protein, 17 aa, Mycobacterium
GACLGALFFGHLTDRFG

SEQ ID NO: 307749 - protein, 21 aa, Mycobacterium
GACSVLHVWADAGASGAEFVG

SEQ ID NO: 307750 - protein, 19 aa, Mycobacterium
GACVLMVIPAAAWQRQVSG

SEQ ID NO: 307751 - protein, 23 aa, Mycobacterium
GADAEARRRRALIVGLSAGAAII

SEQ ID NO: 307752 - protein, 30 aa, Mycobacterium
GADALAQWAWRLPFLLGGLLGVVGLYLRRS

SEQ ID NO: 307753 - protein, 20 aa, Mycobacterium
GADEVMAFVAGQVAPYKKVR

SEQ ID NO: 307754 - protein, 23 aa, Mycobacterium
GADLARIGMEVDVLKIAGISDRN

SEQ ID NO: 307755 - protein, 19 aa, Mycobacterium
GADLIGLNMARRVADGEQI

SEQ ID NO: 307756 - protein, 19 aa, Mycobacterium
GADLRMVLKSAAKLKQLAP

SEQ ID NO: 307757 - protein, 23 aa, Mycobacterium
GADLSWLAGLIVTGPIYLLLVRR

SEQ ID NO: 307758 - protein, 26 aa, Mycobacterium
GADPRRWPNWWWAGVTALGLILAGIG

SEQ ID NO: 307759 - protein, 23 aa, Mycobacterium
GADQWHQHRVLTRVQWSFNDVPP

SEQ ID NO: 307760 - protein, 24 aa, Mycobacterium
GADSIKVWVWLAALLLSVITGVRL

SEQ ID NO: 307761 - protein, 30 aa, Mycobacterium
GADYLRSLVMRMWPQIKSIGGRRSEDGFGE

SEQ ID NO: 307762 - protein, 17 aa, Mycobacterium
GAEAISVGGVRIGPDAT

SEQ ID NO: 307763 - protein, 17 aa, Mycobacterium
GAEAISVGGVRVGAGVT

SEQ ID NO: 307764 - protein, 22 aa, Mycobacterium
GAEATRFGRKPVLLVSIATMIA

SEQ ID NO: 307765 - protein, 21 aa, Mycobacterium
GAEAYRAAGLNALQLGDEAIL

SEQ ID NO: 307766 - protein, 25 aa, Mycobacterium
GAEFCVALWYLARVRHLSGRERGAA

SEQ ID NO: 307767 - protein, 21 aa, Mycobacterium
GAEGWECQRAMSVANNVIVDI

SEQ ID NO: 307768 - protein, 17 aa, Mycobacterium
GAELAWHSSGIAAVGVS

SEQ ID NO: 307769 - protein, 18 aa, Mycobacterium
GAELPRPVADDFQPDIPA

SEQ ID NO: 307770 - protein, 23 aa, Mycobacterium
GAELRRRLMIVGFIVALPIDLIV

SEQ ID NO: 307771 - protein, 21 aa, Mycobacterium
GAELTGRFVLQPAVKALAAVL

SEQ ID NO: 307772 - protein, 21 aa, Mycobacterium
GAERSAALWIVTRGVHESVTP

SEQ ID NO: 307773 - protein, 21 aa, Mycobacterium
GAETLRLKSYLILERNSTRDF

SEQ ID NO: 307774 - protein, 22 aa, Mycobacterium
GAEYRGGYRGGFGSEYDTDYSD

SEQ ID NO: 307775 - protein, 18 aa, Mycobacterium
GAFALSRLRARFGQNKLL

SEQ ID NO: 307776 - protein, 18 aa, Mycobacterium
GAFATRAAVVGAQKAGQP

SEQ ID NO: 307777 - protein, 17 aa, Mycobacterium
GAFFAAIVGVLGLMGGL

SEQ ID NO: 307778 - protein, 24 aa, Mycobacterium
GAFFNIYFCTVTIKINGPAGSDIL

SEQ ID NO: 307779 - protein, 20 aa, Mycobacterium
GAFLGFAGIVLFIFGYTMGF

SEQ ID NO: 307780 - protein, 25 aa, Mycobacterium
GAFLPPDVIPFFGLIPLALGLKAAW

SEQ ID NO: 307781 - protein, 19 aa, Mycobacterium
GAFNGRLAAAGAYAATMAL

SEQ ID NO: 307782 - protein, 24 aa, Mycobacterium
GAFPKRFASVSPRFLTPTFSTVVA

SEQ ID NO: 307783 - protein, 38 aa, Mycobacterium
GAFRLESPLNYAAMANEIVKWGEFGMLPSLNARRHPDR

SEQ ID NO: 307784 - protein, 24 aa, Mycobacterium
GAFRLESPLNYAAMATEIAKWGEF

SEQ ID NO: 307785 - protein, 19 aa, Mycobacterium
GAFTLPLLAIWYGYPTLSF

SEQ ID NO: 307786 - protein, 25 aa, Mycobacterium
GAFTPDRPVAVNVIDFGDDADRPTW

SEQ ID NO: 307787 - protein, 23 aa, Mycobacterium
GAFVAALLVRWNYGSVLAAIDPG

SEQ ID NO: 307788 - protein, 19 aa, Mycobacterium
GAFVFCVAAALTVHAARRG

SEQ ID NO: 307789 - protein, 25 aa, Mycobacterium
GAFVGFGLVCLVAVGIWLQSRKARV

SEQ ID NO: 307790 - protein, 21 aa, Mycobacterium
GAFVGYVVYFGRRAVAAGETG

SEQ ID NO: 307791 - protein, 26 aa, Mycobacterium
GAGAAARLPGLWAATRPRLVRLVVSL

SEQ ID NO: 307792 - protein, 17 aa, Mycobacterium
GAGAIAVAAVWTFLKIA

SEQ ID NO: 307793 - protein, 17 aa, Mycobacterium
GAGALVLERLTDAQRLG

SEQ ID NO: 307794 - protein, 20 aa, Mycobacterium
GAGALVWWAVCALRVDEPLI

SEQ ID NO: 307795 - protein, 26 aa, Mycobacterium
GAGDRLPLWAAMLVWVLLWVLYLSIV

SEQ ID NO: 307796 - protein, 20 aa, Mycobacterium
GAGEAYVFRHGVLRNSSMPV

SEQ ID NO: 307797 - protein, 22 aa, Mycobacterium
GAGESMGFLGAFLIASLASGYV

SEQ ID NO: 307798 - protein, 19 aa, Mycobacterium
GAGFGRAALVTALMTAVIL

SEQ ID NO: 307799 - protein, 17 aa, Mycobacterium
GAGGSMFGASLSFALIG

SEQ ID NO: 307800 - protein, 25 aa, Mycobacterium
GAGILDPAAALTWELPAADGGAPQV

SEQ ID NO: 307801 - protein, 22 aa, Mycobacterium
GAGKGSVLWSLIAALAPDVKCG

SEQ ID NO: 307802 - protein, 23 aa, Mycobacterium
GAGKRPSFARMIHRLAVPIVLLW

SEQ ID NO: 307803 - protein, 21 aa, Mycobacterium
GAGKSTFARLVAGYTHPSTGT

SEQ ID NO: 307804 - protein, 21 aa, Mycobacterium
GAGKSTFARLVAGYTHPTNGT

SEQ ID NO: 307805 - protein, 21 aa, Mycobacterium
GAGKSTFARLVAGYTHPTRGT

SEQ ID NO: 307806 - protein, 21 aa, Mycobacterium
GAGKSTFARLVAGYTHPTTGQ

SEQ ID NO: 307807 - protein, 24 aa, Mycobacterium
GAGLALGGLIVFWQSRRHRRKNAA

SEQ ID NO: 307808 - protein, 22 aa, Mycobacterium
GAGLARSYPAGGIGLPLIGIDH

SEQ ID NO: 307809 - protein, 28 aa, Mycobacterium
GAGLFFGFRELWSWNQGIALVLGVLFIA

SEQ ID NO: 307810 - protein, 24 aa, Mycobacterium
GAGLLPPLLIRHGIDVGIRQHVLT

SEQ ID NO: 307811 - protein, 22 aa, Mycobacterium
GAGLPALFAVGVRLQADSGQIT

SEQ ID NO: 307812 - protein, 18 aa, Mycobacterium
GAGLVLWGTWMVSNYVIL

SEQ ID NO: 307813 - protein, 26 aa, Mycobacterium
GAGLVMGICSHWWPELPGNGRSILTV

SEQ ID NO: 307814 - protein, 25 aa, Mycobacterium
GAGLVMGVCSHWWPELPGNGRSILT

SEQ ID NO: 307815 - protein, 23 aa, Mycobacterium
GAGNAPEGLAFDLDWFNPFTNLA

SEQ ID NO: 307816 - protein, 17 aa, Mycobacterium
GAGPERRTLGLIAVCCY

SEQ ID NO: 307817 - protein, 25 aa, Mycobacterium
GAGPGERVALLFARSAEAIVAIMGV

SEQ ID NO: 307818 - protein, 32 aa, Mycobacterium
GAGPVARLWRWLLIFFSRWWQIETLYRSNQKY

SEQ ID NO: 307819 - protein, 26 aa, Mycobacterium
GAGPWKRLTKVILPMIKPAILVALLF

SEQ ID NO: 307820 - protein, 24 aa, Mycobacterium
GAGQRLADRIARPLVPAIMALAAA

SEQ ID NO: 307821 - protein, 24 aa, Mycobacterium
GAGQRLADRIARPLVPAIMALAAG

SEQ ID NO: 307822 - protein, 24 aa, Mycobacterium
GAGQRLADRIARPLVPTIMVLAAA

SEQ ID NO: 307823 - protein, 17 aa, Mycobacterium
GAGRLRGRRSGRGQMPQ

SEQ ID NO: 307824 - protein, 18 aa, Mycobacterium
GAGRRARRLAALPEAHHQ

SEQ ID NO: 307825 - protein, 18 aa, Mycobacterium
GAGSAALSGLRGQHGSGK

SEQ ID NO: 307826 - protein, 22 aa, Mycobacterium
GAGSLVRLFVLGLIMLPITATV

SEQ ID NO: 307827 - protein, 26 aa, Mycobacterium
GAGSNPVSCQRCMFYVNAYHTANVCN

SEQ ID NO: 307828 - protein, 22 aa, Mycobacterium
GAGTVFRFAATVAVLLAVVTVT

SEQ ID NO: 307829 - protein, 19 aa, Mycobacterium
GAGVLFPSYFQQLLNQTPL

SEQ ID NO: 307830 - protein, 18 aa, Mycobacterium
GAGVLLGLACGTKWSGLY

SEQ ID NO: 307831 - protein, 18 aa, Mycobacterium
GAGVTLTGFVERVGDPVP

SEQ ID NO: 307832 - protein, 21 aa, Mycobacterium
GAGVVYRCRETALGRNVAVKV

SEQ ID NO: 307833 - protein, 19 aa, Mycobacterium
GAGYARFLAQQSDGRSDAQ

SEQ ID NO: 307834 - protein, 21 aa, Mycobacterium
GAHKLRIVGIVPNSTALAKIP

SEQ ID NO: 307835 - protein, 19 aa, Mycobacterium
GAHLDLLLPSGRMRQYSLC

SEQ ID NO: 307836 - protein, 22 aa, Mycobacterium
GAHPLHLLTMLAGLALVGYIVA

SEQ ID NO: 307837 - protein, 21 aa, Mycobacterium
GAHPRLILLGAGLGFGAVLAH

SEQ ID NO: 307838 - protein, 20 aa, Mycobacterium
GAHRAKPLPTRGRSQSRRLL

SEQ ID NO: 307839 - protein, 17 aa, Mycobacterium
GAHRPGLVLGLLVIAIL

SEQ ID NO: 307840 - protein, 18 aa, Mycobacterium
GAIAGVLLKMCWPTAPRW

SEQ ID NO: 307841 - protein, 19 aa, Mycobacterium
GAIALHILFGLPLMVGGLI

SEQ ID NO: 307842 - protein, 19 aa, Mycobacterium
GAIALHLLFGLPLLLGGVI

SEQ ID NO: 307843 - protein, 25 aa, Mycobacterium
GAIALRILFGLPLPIGGIITGVISL

SEQ ID NO: 307844 - protein, 19 aa, Mycobacterium
GAIATMLGTAGVSRTPLQQ

SEQ ID NO: 307845 - protein, 23 aa, Mycobacterium
GAIAVAAVWTFLKIAGPIMAGIA

SEQ ID NO: 307846 - protein, 29 aa, Mycobacterium
GAIFCLSFTRLPYFQTMGIPAAIGMAVAV

SEQ ID NO: 307847 - protein, 19 aa, Mycobacterium
GAIGARLGAGSALISDHTD

SEQ ID NO: 307848 - protein, 25 aa, Mycobacterium
GAIGIGWAALWYLKYREPRESNANE

SEQ ID NO: 307849 - protein, 17 aa, Mycobacterium
GAIGLALLAALIAAAFG

SEQ ID NO: 307850 - protein, 23 aa, Mycobacterium
GAIGRGSVIGFVLGVLPGGGAVL

SEQ ID NO: 307851 - protein, 19 aa, Mycobacterium
GAIGRLMLVSVLAPLIAGM

SEQ ID NO: 307852 - protein, 27 aa, Mycobacterium
GAIGYALGVFGVWLVRFMRSKDTSPPA

SEQ ID NO: 307853 - protein, 26 aa, Mycobacterium
GAIGYALGVLVVWLVRYMRSQDSSPK

SEQ ID NO: 307854 - protein, 26 aa, Mycobacterium
GAIGYGLGVFAVWLVRYMGAKDHSPP

SEQ ID NO: 307855 - protein, 26 aa, Mycobacterium
GAIGYGLGVFAVWLVRYMRSQDDSPP

SEQ ID NO: 307856 - protein, 26 aa, Mycobacterium
GAIGYGLGVFGVWLVRYMCSADSSPK

SEQ ID NO: 307857 - protein, 26 aa, Mycobacterium
GAIGYGLGVFSVWLVRFMREKDHSPP

SEQ ID NO: 307858 - protein, 23 aa, Mycobacterium
GAIIWAGSLVWYLQRVGTEPNFL

SEQ ID NO: 307859 - protein, 19 aa, Mycobacterium
GAILAPYPLWCTFATVLST

SEQ ID NO: 307860 - protein, 28 aa, Mycobacterium
GAILFPVGFCLLYLLGFDLLTGVFTLVP

SEQ ID NO: 307861 - protein, 18 aa, Mycobacterium
GAINAAWDKLGGSAGVLG

SEQ ID NO: 307862 - protein, 19 aa, Mycobacterium
GAINSHRMLLAVAVVIAFI

SEQ ID NO: 307863 - protein, 24 aa, Mycobacterium
GAIRRTGLSLVRYPEPIDWNGKPA

SEQ ID NO: 307864 - protein, 25 aa, Mycobacterium
GAIRVTPKFTRMIIAGIFGVVALAI

SEQ ID NO: 307865 - protein, 25 aa, Mycobacterium
GAIRVTPKFTRMIVAGLFGVVALML

SEQ ID NO: 307866 - protein, 25 aa, Mycobacterium
GAIRVTPKFTRMVVAALFGVLFLML

SEQ ID NO: 307867 - protein, 19 aa, Mycobacterium
GAISLWLLYRHYRTRDPFF

SEQ ID NO: 307868 - protein, 24 aa, Mycobacterium
GAITRWQTGGGWQAYIDHADQLGA

SEQ ID NO: 307869 - protein, 24 aa, Mycobacterium
GAIVGYYLLRRALRPGGGQLVGTR

SEQ ID NO: 307870 - protein, 18 aa, Mycobacterium
GAKAGLFPFHTWLADAHS

SEQ ID NO: 307871 - protein, 22 aa, Mycobacterium
GAKGKAAARRARPKRLTGRRLA

SEQ ID NO: 307872 - protein, 33 aa, Mycobacterium
GAKPRSRLAEWGWQAIAAIAIAVVFAAAVAQTT

SEQ ID NO: 307873 - protein, 27 aa, Mycobacterium
GAKSRASACLHGVWILLFTIPFAGLVD

SEQ ID NO: 307874 - protein, 20 aa, Mycobacterium
GAKSRLANVIAALQDRIKAL

SEQ ID NO: 307875 - protein, 20 aa, Mycobacterium
GAKYGFLLVWVIVTANVMAG

SEQ ID NO: 307876 - protein, 18 aa, Mycobacterium
GALAAFAITGLVFTVRVQ

SEQ ID NO: 307877 - protein, 20 aa, Mycobacterium
GALAAVGCVAAWLGAATPVT

SEQ ID NO: 307878 - protein, 37 aa, Mycobacterium; identical to SEQ ID NO: 10987

SEQ ID NO: 307879 - protein, 19 aa, Mycobacterium
GALAERVKFGTWLVFSGLW

SEQ ID NO: 307880 - protein, 19 aa, Mycobacterium
GALAGVALKMCWPSAPRWV

SEQ ID NO: 307881 - protein, 23 aa, Mycobacterium
GALAKLTLVWALADLTMAVMAIA

SEQ ID NO: 307882 - protein, 20 aa, Mycobacterium
GALALFGFLKVRRIRGPRQT

SEQ ID NO: 307883 - protein, 20 aa, Mycobacterium
GALCVSWRAATPGVTLLAGS

SEQ ID NO: 307884 - protein, 29 aa, Mycobacterium
GALEATWKYVVICSVGIAVAFLGTVLLYY

SEQ ID NO: 307885 - protein, 23 aa, Mycobacterium
GALEGGFPWAAFVVGLSSAGPPP

SEQ ID NO: 307886 - protein, 22 aa, Mycobacterium
GALEGGFPWVAFVAGLSSAGPP

SEQ ID NO: 307887 - protein, 23 aa, Mycobacterium
GALELLGAAGLLLPVTRVAAALC

SEQ ID NO: 307888 - protein, 18 aa, Mycobacterium
GALETAHRAGTLHRDIKP

SEQ ID NO: 307889 - protein, 17 aa, Mycobacterium
GALFAAVLIVYLDRHGY

SEQ ID NO: 307890 - protein, 22 aa, Mycobacterium
GALFAGWCPVPLPEPQGGLQDK

SEQ ID NO: 307891 - protein, 19 aa, Mycobacterium
GALFFCLSLTPSLLPRDWL

SEQ ID NO: 307892 - protein, 26 aa, Mycobacterium
GALFRAPEFYVWIAAALGGMIFQQSS

SEQ ID NO: 307893 - protein, 17 aa, Mycobacterium
GALGAIGLIEWPVLLAV

SEQ ID NO: 307894 - protein, 26 aa, Mycobacterium
GALGILRLVAVFGPVHFFAQPVVSLI

SEQ ID NO: 307895 - protein, 20 aa, Mycobacterium
GALGNLVDRFFRSPGPLRGH

SEQ ID NO: 307896 - protein, 23 aa, Mycobacterium
GALGVVWFWLIRRYTIEGPLEHD

SEQ ID NO: 307897 - protein, 18 aa, Mycobacterium
GALGVWFAVTGLGVATWM

SEQ ID NO: 307898 - protein, 24 aa, Mycobacterium
GALGWLRRHTRAIQIFGGALLIAV

SEQ ID NO: 307899 - protein, 19 aa, Mycobacterium
GALHARYGAQDAIRDAAAL

SEQ ID NO: 307900 - protein, 19 aa, Mycobacterium
GALIVILSIQGWRNYHKGE

SEQ ID NO: 307901 - protein, 18 aa, Mycobacterium
GALLAALIQRPSRLDPAV

SEQ ID NO: 307902 - protein, 24 aa, Mycobacterium
GALLAGPLIRLFGNQAFVGRGTPT

SEQ ID NO: 307903 - protein, 26 aa, Mycobacterium
GALLAWSLACAVAYLQGFGRRLSWVL

SEQ ID NO: 307904 - protein, 18 aa, Mycobacterium
GALLCLSVAAWPVLSQRR

SEQ ID NO: 307905 - protein, 18 aa, Mycobacterium
GALLEALAGFGTPVAVTS

SEQ ID NO: 307906 - protein, 26 aa, Mycobacterium
GALLGAFLLGRLVRRANQFDAVVSFV

SEQ ID NO: 307907 - protein, 25 aa, Mycobacterium
GALLGASVIVAWVTPLGPVVLGMKA

SEQ ID NO: 307908 - protein, 18 aa, Mycobacterium
GALLGGLILGVMENYGQA

SEQ ID NO: 307909 - protein, 18 aa, Mycobacterium
GALLGGLLLGIMENYGQA

SEQ ID NO: 307910 - protein, 25 aa, Mycobacterium
GALLHRTPIRFIRAFSGAARVSGPL

SEQ ID NO: 307911 - protein, 19 aa, Mycobacterium
GALLIMWAAYRGLDGHWQT

SEQ ID NO: 307912 - protein, 18 aa, Mycobacterium
GALLLAAGRPELLVYSVF

SEQ ID NO: 307913 - protein, 20 aa, Mycobacterium
GALLLRRMNKKPGDSGPPVK

SEQ ID NO: 307914 - protein, 18 aa, Mycobacterium
GALLLSWFNNSWVPLAAY

SEQ ID NO: 307915 - protein, 24 aa, Mycobacterium
GALLMPKRALDWLVAGAGAFAAHA

SEQ ID NO: 307916 - protein, 17 aa, Mycobacterium
GALLPWTRPMFLNNNYA

SEQ ID NO: 307917 - protein, 19 aa, Mycobacterium
GALLTALAIVGGLARRFAL

SEQ ID NO: 307918 - protein, 20 aa, Mycobacterium
GALLVGRLVVGVGVGLAISS

SEQ ID NO: 307919 - protein, 17 aa, Mycobacterium
GALMAFNAVAFALIEIP

SEQ ID NO: 307920 - protein, 28 aa, Mycobacterium
GALPDVSKNFPLRYLVTNTGWGRGLDMR

SEQ ID NO: 307921 - protein, 26 aa, Mycobacterium
GALPDYRVVAALPLAYAVVVSGILLR

SEQ ID NO: 307922 - protein, 18 aa, Mycobacterium
GALPGFLLVAVCFLTATF

SEQ ID NO: 307923 - protein, 17 aa, Mycobacterium
GALQIAFGVSRMARAAL

SEQ ID NO: 307924 - protein, 17 aa, Mycobacterium
GALRRAGIGVVMATGDH

SEQ ID NO: 307925 - protein, 20 aa, Mycobacterium
GALRRAVRMAAPAIVASNAT

SEQ ID NO: 307926 - protein, 21 aa, Mycobacterium
GALRVNWALGVQLFDYTGETS

SEQ ID NO: 307927 - protein, 25 aa, Mycobacterium
GALSILFCFAFFLLVFIGGGPYSLD

SEQ ID NO: 307928 - protein, 26 aa, Mycobacterium
GALSKSAIVPLHFWLPGAMAAPTPVS

SEQ ID NO: 307929 - protein, 27 aa, Mycobacterium
GALSKSAIVPLHFWLPGAMAAPTPVSA

SEQ ID NO: 307930 - protein, 24 aa, Mycobacterium
GALTDVSWRLAFLVNVPIGLAVIC

SEQ ID NO: 307931 - protein, 25 aa, Mycobacterium
GALTEVSWRLAFLVNVPIGLVMIYL

SEQ ID NO: 307932 - protein, 27 aa, Mycobacterium
GALTEVSWRLAFMVNVPIGLVMIYLAR

SEQ ID NO: 307933 - protein, 19 aa, Mycobacterium
GALTIIVAVVIGIWLINVF

SEQ ID NO: 307934 - protein, 17 aa, Mycobacterium
GALTLRLLTIAFCVLLY

SEQ ID NO: 307935 - protein, 19 aa, Mycobacterium
GALTRLRDQCRLAKERLSG

SEQ ID NO: 307936 - protein, 20 aa, Mycobacterium
GALVAILAVVPWRRFASGQS

SEQ ID NO: 307937 - protein, 25 aa, Mycobacterium
GALVGFVRWPMWLRTVVSVVSLAAI

SEQ ID NO: 307938 - protein, 27 aa, Mycobacterium
GALVGGLGWEWIFFVNIPIGVLGLALA

SEQ ID NO: 307939 - protein, 18 aa, Mycobacterium
GALVLGWWIAVLVYLLPR

SEQ ID NO: 307940 - protein, 18 aa, Mycobacterium
GALVSLLMLFIIQHTTNR

SEQ ID NO: 307941 - protein, 20 aa, Mycobacterium
GALVVFAALTVWFVIDPALW

SEQ ID NO: 307942 - protein, 21 aa, Mycobacterium
GALVWAGSLFWYLQRVGTEPD

SEQ ID NO: 307943 - protein, 29 aa, Mycobacterium
GALYVRVGDRLYPALNLASARLITGRASN

SEQ ID NO: 307944 - protein, 22 aa, Mycobacterium
GAMADRFGRRRTLQIGLTIFAS

SEQ ID NO: 307945 - protein, 19 aa, Mycobacterium
GAMFCMSFTHLPYFHSLGA

SEQ ID NO: 307946 - protein, 20 aa, Mycobacterium
GAMFGRNIMFLAVLFALGMN

SEQ ID NO: 307947 - protein, 20 aa, Mycobacterium
GAMILVRFINWGAQKITRRL

SEQ ID NO: 307948 - protein, 27 aa, Mycobacterium
GAMLCLSFTRLPYFQTMGVPCAVGTFV

SEQ ID NO: 307949 - protein, 17 aa, Mycobacterium
GAMLCLSFTRLPYLQTL

SEQ ID NO: 307950 - protein, 19 aa, Mycobacterium
GAMMAGRLLIPVTGAIGVY

SEQ ID NO: 307951 - protein, 18 aa, Mycobacterium
GAMNAAWDKLGSSGGVLG

SEQ ID NO: 307952 - protein, 21 aa, Mycobacterium
GAMPFLRIQIDTVTPDIVTTT

SEQ ID NO: 307953 - protein, 18 aa, Mycobacterium
GAMTGVYVLCLWAVVAAP

SEQ ID NO: 307954 - protein, 32 aa, Mycobacterium
GAMVASFMGFYWMDHRVVGGIGFELTQRLEHR

SEQ ID NO: 307955 - protein, 23 aa, Mycobacterium
GAMVFAILVLLGRYINYTLDLAG

SEQ ID NO: 307956 - protein, 34 aa, Mycobacterium
GAMVVEARPGTPLHGLHAMFFDQPRVHEKQEMLA

SEQ ID NO: 307957 - protein, 26 aa, Mycobacterium
GAMWLWNNAIKPAWNGIKEVIGLAWE

SEQ ID NO: 307958 - protein, 26 aa, Mycobacterium
GAMYCLSFARLPYFNTLGPPCAIGML

SEQ ID NO: 307959 - protein, 25 aa, Mycobacterium
GAMYCLSFARLPYFQTLAAPCAIGM

SEQ ID NO: 307960 - protein, 25 aa, Mycobacterium
GAMYCLSFCRLPYFQTLGVPCAVGM

SEQ ID NO: 307961 - protein, 25 aa, Mycobacterium
GAMYCLSFCRLPYFQTMGVPCAVGM

SEQ ID NO: 307962 - protein, 25 aa, Mycobacterium
GAMYCLSFTRLPYFQTLALPCSIGL

SEQ ID NO: 307963 - protein, 25 aa, Mycobacterium
GAMYCLSFTRLPYFQTLGAPCAIGM

SEQ ID NO: 307964 - protein, 25 aa, Mycobacterium
GAMYCLSFTRLPYFQTLGAPCAVGM

SEQ ID NO: 307965 - protein, 25 aa, Mycobacterium
GAMYCLSFTRLPYFQTLGSPCSIGL

SEQ ID NO: 307966 - protein, 38 aa, Mycobacterium
GAMYCLSFTRLPYFQTMGIPCAVGMLVAVAAALTLGPA

SEQ ID NO: 307967 - protein, 23 aa, Mycobacterium
GANFWRRGALLIGIGVGVAAALR

SEQ ID NO: 307968 - protein, 24 aa, Mycobacterium
GANFWRRGSLLIGIGVGLAAALRL

SEQ ID NO: 307969 - protein, 24 aa, Mycobacterium
GANIGRLILIAGIGTILAFEAGDL

SEQ ID NO: 307970 - protein, 23 aa, Mycobacterium
GANLGASFAKWSPDSGETIGDRL

SEQ ID NO: 307971 - protein, 21 aa, Mycobacterium
GANLPLLLKGFARITSEGAYA

SEQ ID NO: 307972 - protein, 20 aa, Mycobacterium
GANLPLMLKGFARITQEGTY

SEQ ID NO: 307973 - protein, 24 aa, Mycobacterium
GANSDWWPLLWFTAKVWLFLFFFM

SEQ ID NO: 307974 - protein, 24 aa, Mycobacterium
GANSGWWPLLWFTAKVWTFMFLYF

SEQ ID NO: 307975 - protein, 19 aa, Mycobacterium
GANVGGLFTALGVTSIVLG

SEQ ID NO: 307976 - protein, 19 aa, Mycobacterium
GAPDDGLWVRTGDYGTYFK

SEQ ID NO: 307977 - protein, 23 aa, Mycobacterium
GAPDGLPAWIGWTHFFNLFMMMF

SEQ ID NO: 307978 - protein, 17 aa, Mycobacterium
GAPDGPADLAFLIAAPD

SEQ ID NO: 307979 - protein, 17 aa, Mycobacterium
GAPDGPADLAFLIAAPE

SEQ ID NO: 307980 - protein, 29 aa, Mycobacterium
GAPDLPVPRLAGMPSRPPLPAADEFAALP

SEQ ID NO: 307981 - protein, 22 aa, Mycobacterium
GAPDMPIPVLAGLPDLSGGVAG

SEQ ID NO: 307982 - protein, 28 aa, Mycobacterium
GAPEGSWRKRIPSIFLDVARFALIAVGV

SEQ ID NO: 307983 - protein, 19 aa, Mycobacterium
GAPFPDRNLIIFVVSVVIL

SEQ ID NO: 307984 - protein, 24 aa, Mycobacterium
GAPGDLPRRWYLAPPGGAPLDESM

SEQ ID NO: 307985 - protein, 21 aa, Mycobacterium
GAPGPREWLLAALHSRVSQFL

SEQ ID NO: 307986 - protein, 18 aa, Mycobacterium
GAPGRLGPLLAQEKKRTA

SEQ ID NO: 307987 - protein, 17 aa, Mycobacterium
GAPHLPIPTLAGLAILP

SEQ ID NO: 307988 - protein, 23 aa, Mycobacterium
GAPHLPIPTLVGLPRQPDVFRGL

SEQ ID NO: 307989 - protein, 20 aa, Mycobacterium
GAPKFPVGERIPLDGDTVTT

SEQ ID NO: 307990 - protein, 20 aa, Mycobacterium
GAPLAERDCMLYAGTTVVAG

SEQ ID NO: 307991 - protein, 29 aa, Mycobacterium
GAPLDGGRVLRAFLWRRHGDSVRASIGAA

SEQ ID NO: 307992 - protein, 22 aa, Mycobacterium
GAPLRPVPEVTRLVRRLLPALV

SEQ ID NO: 307993 - protein, 25 aa, Mycobacterium
GAPLSRLEGDYFMRVLPQRLPNIRV

SEQ ID NO: 307994 - protein, 22 aa, Mycobacterium
GAPLSWDIGFLIFGLALIGAGW

SEQ ID NO: 307995 - protein, 24 aa, Mycobacterium
GAPPIGGLHLQFGRDAATEVVVSW

SEQ ID NO: 307996 - protein, 19 aa, Mycobacterium
GAPPRRPPAAFALASIGSV

SEQ ID NO: 307997 - protein, 29 aa, Mycobacterium
GAPQGSWRRRLPVIFVDVARFVLIGAGLA

SEQ ID NO: 307998 - protein, 27 aa, Mycobacterium
GAPQPVWWTLYLGCYLAGGWGSAWAGA

SEQ ID NO: 307999 - protein, 18 aa, Mycobacterium
GAPRLHARVPSRRLLPAL

SEQ ID NO: 308000 - protein, 31 aa, Mycobacterium
GAPRPAPVSRLGRWRWPALAVPAVVLTAALV

SEQ ID NO: 308001 - protein, 19 aa, Mycobacterium
GAPSSFTLAGPWVDVAATG

SEQ ID NO: 308002 - protein, 18 aa, Mycobacterium
GAPTVPWVLSARSAPALA

SEQ ID NO: 308003 - protein, 17 aa, Mycobacterium
GAPVGWVLALAAVDSAM

SEQ ID NO: 308004 - protein, 27 aa, Mycobacterium
GAPVLPGKVVKKGWFSWDKAAVSAHAN

SEQ ID NO: 308005 - protein, 25 aa, Mycobacterium
GAPVTLLRLLFCRGAPARHSNGRYA

SEQ ID NO: 308006 - protein, 24 aa, Mycobacterium
GAQADSWGGLSAEEYVAAHVPYLA

SEQ ID NO: 308007 - protein, 21 aa, Mycobacterium
GAQAPRPAAFHEWHAMSAEQV

SEQ ID NO: 308008 - protein, 25 aa, Mycobacterium
GAQAWWITLCVVFALVGLYLTYVGW

SEQ ID NO: 308009 - protein, 26 aa, Mycobacterium
GAQEWLKSIVPFGGFPWGSVAFGQVD

SEQ ID NO: 308010 - protein, 19 aa, Mycobacterium
GAQGLRILLLGVADVAVDD

SEQ ID NO: 308011 - protein, 19 aa, Mycobacterium
GAQGLRVLLLGSSDRSVDA

SEQ ID NO: 308012 - protein, 25 aa, Mycobacterium
GAQIAALVPDSGWQGSAARSYGAHT

SEQ ID NO: 308013 - protein, 27 aa, Mycobacterium
GAQQRANRSFFWWVLALAAMASVGSNA

SEQ ID NO: 308014 - protein, 42 aa, Mycobacterium
GAQRISMGIALRMFLSFMGSALWRAPSAWIASALGSVSSVVA

SEQ ID NO: 308015 - protein, 18 aa, Mycobacterium
GAQTALICVYAFAALWAL

SEQ ID NO: 308016 - protein, 25 aa, Mycobacterium
GARDRMPIELAIAVLVLVVLLMIYR

SEQ ID NO: 308017 - protein, 20 aa, Mycobacterium
GARECLRTVDALTDDVLVEA

SEQ ID NO: 308018 - protein, 18 aa, Mycobacterium
GARGIVLTALAALVLAVA

SEQ ID NO: 308019 - protein, 20 aa, Mycobacterium
GARGLRVLLLGSSDRPVDAP

SEQ ID NO: 308020 - protein, 23 aa, Mycobacterium
GARLCSVVSSAVRVPAAPAHVLP

SEQ ID NO: 308021 - protein, 25 aa, Mycobacterium
GARSPRTGIALSIAALAPVGAALAL

SEQ ID NO: 308022 - protein, 22 aa, Mycobacterium
GARSSAWAYPWWAYIDGGDLRY

SEQ ID NO: 308023 - protein, 39 aa, Mycobacterium
GARTDFRLRWSWRELWIGIAFGFGGLFVTLPAAALYLSI

SEQ ID NO: 308024 - protein, 17 aa, Mycobacterium
GARTRWNLDEAQRRLAA

SEQ ID NO: 308025 - protein, 18 aa, Mycobacterium
GARVDWPLSEDIWSLRAL

SEQ ID NO: 308026 - protein, 18 aa, Mycobacterium
GARVEFMVSDAGPMAVVT

SEQ ID NO: 308027 - protein, 19 aa, Mycobacterium
GASEGWCPYCGSPYSFLPQ

SEQ ID NO: 308028 - protein, 17 aa, Mycobacterium
GASFRLVASEVDRMSPA

SEQ ID NO: 308029 - protein, 37 aa, Mycobacterium
GASGARAATGWVVLCGCALGFAFLTKMLQAFLIVPGL

SEQ ID NO: 308030 - protein, 20 aa, Mycobacterium
GASGEFRHGLLIGVAIAAVF

SEQ ID NO: 308031 - protein, 22 aa, Mycobacterium
GASGLLLLLARFTVPESPRFLL

SEQ ID NO: 308032 - protein, 28 aa, Mycobacterium
GASGRLFGRFDLAVAVFFALSGFLLWRG

SEQ ID NO: 308033 - protein, 25 aa, Mycobacterium
GASHSEGAFAFGVFMLAMTVGRFTV

SEQ ID NO: 308034 - protein, 25 aa, Mycobacterium
GASIGRLAFIAGIGAILAFRGGDLL

SEQ ID NO: 308035 - protein, 25 aa, Mycobacterium
GASILYPSLFLLPLLATTLAIVAGV

SEQ ID NO: 308036 - protein, 19 aa, Mycobacterium
GASLGTWAAVAVVLGPLLV

SEQ ID NO: 308037 - protein, 18 aa, Mycobacterium
GASLMAVPLCVLSAALAL

SEQ ID NO: 308038 - protein, 19 aa, Mycobacterium
GASLPRPAPPASTPTTTPP

SEQ ID NO: 308039 - protein, 27 aa, Mycobacterium
GASLTLAVLLFRLMWRGWRARAQRQTD

SEQ ID NO: 308040 - protein, 25 aa, Mycobacterium
GASMAGYFVCFIALFILSGLGNGSV

SEQ ID NO: 308041 - protein, 34 aa, Mycobacterium
GASPPAVKRAWLRTWQAAVLIAVIVVALVVGGLA

SEQ ID NO: 308042 - protein, 24 aa, Mycobacterium
GASPRKGPNWGRWISAFALLGFFG

SEQ ID NO: 308043 - protein, 39 aa, Mycobacterium
GASPWRVLAKVVMPEAWPALMAGGSLVLLLALNEFGIVL

SEQ ID NO: 308044 - protein, 18 aa, Mycobacterium
GASQRLADRIAQPLVPGI

SEQ ID NO: 308045 - protein, 26 aa, Mycobacterium
GASRGWRAAAPLSRDDAWIIFTSGST

SEQ ID NO: 308046 - protein, 25 aa, Mycobacterium
GASRGWRAGAPLVRDDAWIIFTSGS

SEQ ID NO: 308047 - protein, 23 aa, Mycobacterium
GASRKMSWGELTARRRKWFALQD

SEQ ID NO: 308048 - protein, 24 aa, Mycobacterium
GASSAPPWPAYAPHGAAAPVNHGV

SEQ ID NO: 308049 - protein, 24 aa, Mycobacterium
GASVGMLLVWLLLYLRVSAPINHQ

SEQ ID NO: 308050 - protein, 24 aa, Mycobacterium
GASVPYIRWPMWLRTVTATAALAA

SEQ ID NO: 308051 - protein, 21 aa, Mycobacterium
GASYAEHGNWVIGAPDVLLDP

SEQ ID NO: 308052 - protein, 21 aa, Mycobacterium
GASYGEHGNWVIGAPDVLLDP

SEQ ID NO: 308053 - protein, 17 aa, Mycobacterium
GASYRSSLLYPEPPRRH

SEQ ID NO: 308054 - protein, 28 aa, Mycobacterium
GASYSNETWRLWRFPWQAKSPGRETITV

SEQ ID NO: 308055 - protein, 18 aa, Mycobacterium
GATAFVLLAWATARYGQI

SEQ ID NO: 308056 - protein, 24 aa, Mycobacterium
GATAHLSGAGWLWTVLAGLLAPVL

SEQ ID NO: 308057 - protein, 24 aa, Mycobacterium
GATEIPARLPGPVEHTAYLVLNEA

SEQ ID NO: 308058 - protein, 22 aa, Mycobacterium
GATELLRALGISDPRDLDVDRL

SEQ ID NO: 308059 - protein, 24 aa, Mycobacterium
GATELPIIIVIVALVAQWARQDRQ

SEQ ID NO: 308060 - protein, 24 aa, Mycobacterium
GATELPIIIVIVALVAQWARQDRR

SEQ ID NO: 308061 - protein, 17 aa, Mycobacterium
GATFCLHFTRLPYFKTT

SEQ ID NO: 308062 - protein, 25 aa, Mycobacterium
GATFCLKFTRLPYFESLGVPCAIGM

SEQ ID NO: 308063 - protein, 25 aa, Mycobacterium
GATFCLSLARLPYFQTLGVPCAVGM

SEQ ID NO: 308064 - protein, 18 aa, Mycobacterium
GATFECTVSIDGASKHVT

SEQ ID NO: 308065 - protein, 23 aa, Mycobacterium
GATFGRRRRNLLIGIGAGAAILL

SEQ ID NO: 308066 - protein, 26 aa, Mycobacterium
GATGFLGRYLLLEWLRQLRRVDDKVI

SEQ ID NO: 308067 - protein, 23 aa, Mycobacterium
GATGIGIWSRHPIVHSGRIDGYA

SEQ ID NO: 308068 - protein, 28 aa, Mycobacterium
GATGVFLACRWAQAHAGAGVWVGYVGAA

SEQ ID NO: 308069 - protein, 18 aa, Mycobacterium
GATGVPWLLISGPLGSAA

SEQ ID NO: 308070 - protein, 25 aa, Mycobacterium
GATGWKVFTSVIFPSLMPALLSGAG

SEQ ID NO: 308071 - protein, 24 aa, Mycobacterium
GATIPYYICQFGLRGTDLNGKTVR

SEQ ID NO: 308072 - protein, 17 aa, Mycobacterium
GATLCLHFTRLPYFQTL

SEQ ID NO: 308073 - protein, 17 aa, Mycobacterium
GATLCLHFTRMPYFQSL

SEQ ID NO: 308074 - protein, 39 aa, Mycobacterium
GATLCLSLTRLPLFRSMGVPCALVILVIVAAALTLAPAI

SEQ ID NO: 308075 - protein, 21 aa, Mycobacterium
GATLLSLFSFMFLLFGLLLIY

SEQ ID NO: 308076 - protein, 24 aa, Mycobacterium
GATMSRFVVAPVFAVAAAVVAASL

SEQ ID NO: 308077 - protein, 19 aa, Mycobacterium
GATMSRYTVAPVFVVAAAV

SEQ ID NO: 308078 - protein, 25 aa, Mycobacterium
GATPTSWWYPVAWLAYPAAYLVLAL

SEQ ID NO: 308079 - protein, 17 aa, Mycobacterium
GATRGLLRIPLQDGLYV

SEQ ID NO: 308080 - protein, 25 aa, Mycobacterium
GATRWEVVRTIVLPFGRSGYISAAV

SEQ ID NO: 308081 - protein, 27 aa, Mycobacterium
GATSDAISWCILAVVLAVYRNSPVMAV

SEQ ID NO: 308082 - protein, 23 aa, Mycobacterium
GATTALFQWGWGQPLLGMDSTTP

SEQ ID NO: 308083 - protein, 20 aa, Mycobacterium
GATVGYLLLRARLDPPGGHL

SEQ ID NO: 308084 - protein, 24 aa, Mycobacterium
GATVGYYLLRRALRPGGGQLIGAH

SEQ ID NO: 308085 - protein, 19 aa, Mycobacterium
GATVLGFKRRLLHRLLGPG

SEQ ID NO: 308086 - protein, 20 aa, Mycobacterium
GATVPSWLQPLIQSSPPVFA

SEQ ID NO: 308087 - protein, 28 aa, Mycobacterium
GATYCLSFARLPYFSTMGAPVAIGMIVV

SEQ ID NO: 308088 - protein, 29 aa, Mycobacterium
GATYCLSFTRLPWFNTMGAPVAIGMIVVV

SEQ ID NO: 308089 - protein, 29 aa, Mycobacterium
GATYCLSFTRLPWFNTMGAPVAIGMLVVV

SEQ ID NO: 308090 - protein, 30 aa, Mycobacterium
GAVAALVGWPALRLKGAYFAIATWALAEAV

SEQ ID NO: 308091 - protein, 18 aa, Mycobacterium
GAVAQRFDFESVRSTVEL

SEQ ID NO: 308092 - protein, 19 aa, Mycobacterium
GAVARAGLRPVGRLTEAAE

SEQ ID NO: 308093 - protein, 17 aa, Mycobacterium
GAVATLYVVFRWFFAKD

SEQ ID NO: 308094 - protein, 22 aa, Mycobacterium
GAVCIAGAWLYTGGKKPYGYQG

SEQ ID NO: 308095 - protein, 21 aa, Mycobacterium
GAVCIAGAWLYTGGSKPYGYL

SEQ ID NO: 308096 - protein, 17 aa, Mycobacterium
GAVELRLARARRQPLLD

SEQ ID NO: 308097 - protein, 23 aa, Mycobacterium
GAVEVIAGLLLFVPRTAVLGTML

SEQ ID NO: 308098 - protein, 17 aa, Mycobacterium
GAVFCLNFTRLPYFQPL

SEQ ID NO: 308099 - protein, 18 aa, Mycobacterium
GAVFTRFAVAGVILCAAV

SEQ ID NO: 308100 - protein, 27 aa, Mycobacterium
GAVGALSLVQCLNWPSGSAPQDPKELP

SEQ ID NO: 308101 - protein, 27 aa, Mycobacterium
GAVGIWKAGMFHLLIAVAVILTVIRHT

SEQ ID NO: 308102 - protein, 26 aa, Mycobacterium
GAVGLWKAGMFHTLIAVAVILTVIRH

SEQ ID NO: 308103 - protein, 21 aa, Mycobacterium
GAVGPWLLRSAFGQQYQASGA

SEQ ID NO: 308104 - protein, 23 aa, Mycobacterium
GAVIGTAWGYRWGGLGAGIIGAV

SEQ ID NO: 308105 - protein, 25 aa, Mycobacterium
GAVIIARLLWRWLRPKRQAEQTPSQ

SEQ ID NO: 308106 - protein, 25 aa, Mycobacterium
GAVIPVLWILVLIVIAAGSSSTSGS

SEQ ID NO: 308107 - protein, 32 aa, Mycobacterium
GAVIVGALGMWWTFRGGYAGWWQQLSGESQWS

SEQ ID NO: 308108 - protein, 20 aa, Mycobacterium
GAVIVWCVLGDGPAAVCGAV

SEQ ID NO: 308109 - protein, 19 aa, Mycobacterium
GAVLARLVARLARDVQPVP

SEQ ID NO: 308110 - protein, 25 aa, Mycobacterium
GAVLCLSFTRLPFFQPLGIPCAVGI

SEQ ID NO: 308111 - protein, 20 aa, Mycobacterium
GAVLSRLAVRLARDVRPAPV

SEQ ID NO: 308112 - protein, 24 aa, Mycobacterium
GAVNGLRALPTLGVLLLGTLLFGL

SEQ ID NO: 308113 - protein, 24 aa, Mycobacterium
GAVNGLRSLPTLGVLLFGTLLFGL

SEQ ID NO: 308114 - protein, 25 aa, Mycobacterium
GAVNVLCALVFLWIPRLCPLGELLA

SEQ ID NO: 308115 - protein, 23 aa, Mycobacterium
GAVPFPFQPIHVTIAAWFTIGIP

SEQ ID NO: 308116 - protein, 17 aa, Mycobacterium
GAVPIVAVINLVFWATM

SEQ ID NO: 308117 - protein, 18 aa, Mycobacterium
GAVPLVIIGVIASGVAAY

SEQ ID NO: 308118 - protein, 25 aa, Mycobacterium
GAVPSRPRIAAAALMCVVSVGLLIW

SEQ ID NO: 308119 - protein, 30 aa, Mycobacterium
GAVRLDLGKFFKWTGVFLIVVAAGILAYAT

SEQ ID NO: 308120 - protein, 21 aa, Mycobacterium
GAVRLKMTPHWSGPAQVVDRI

SEQ ID NO: 308121 - protein, 23 aa, Mycobacterium
GAVSFTTLRLVYGDATARFREGQ

SEQ ID NO: 308122 - protein, 19 aa, Mycobacterium
GAVSGPFGGPGFPAPVDVM

SEQ ID NO: 308123 - protein, 25 aa, Mycobacterium
GAVSRSRWLASHLVAALAGPSAAML

SEQ ID NO: 308124 - protein, 22 aa, Mycobacterium
GAVSRTRWLASHLVTALGGSAL

SEQ ID NO: 308125 - protein, 20 aa, Mycobacterium
GAVSRWRWLSTSVVAAVLGA

SEQ ID NO: 308126 - protein, 24 aa, Mycobacterium
GAVSVLWLGVAGWSLWAANSPGMG

SEQ ID NO: 308127 - protein, 20 aa, Mycobacterium
GAVSWLIALVYKGLYTGGLI

SEQ ID NO: 308128 - protein, 26 aa, Mycobacterium
GAVTVLLGIWAWRAIRDTPEEHPKVD

SEQ ID NO: 308129 - protein, 24 aa, Mycobacterium
GAVVAFGAVLAWLVAGLAVSESVS

SEQ ID NO: 308130 - protein, 23 aa, Mycobacterium
GAVVCAAFGWTIVASALSIYALA

SEQ ID NO: 308131 - protein, 20 aa, Mycobacterium
GAVVFAWLGAVPMGVLCYRH

SEQ ID NO: 308132 - protein, 17 aa, Mycobacterium
GAVVHFAGIGWIESLMP

SEQ ID NO: 308133 - protein, 19 aa, Mycobacterium
GAVYWHMVDLLWVVIFALL

SEQ ID NO: 308134 - protein, 17 aa, Mycobacterium
GAWARGALATAFGKDLP

SEQ ID NO: 308135 - protein, 18 aa, Mycobacterium
GAWLPLLIGLAVFTVMTT

SEQ ID NO: 308136 - protein, 26 aa, Mycobacterium
GAWRIPFLLCGPLGVIALIIRLRLEE

SEQ ID NO: 308137 - protein, 19 aa, Mycobacterium
GAWTSVPVRELVPGDVVRV

SEQ ID NO: 308138 - protein, 17 aa, Mycobacterium
GAYFCLDVILGFTPSGN

SEQ ID NO: 308139 - protein, 20 aa, Mycobacterium
GAYFLRDYFVLIVVAAVGAY

SEQ ID NO: 308140 - protein, 20 aa, Mycobacterium
GAYFLRTFFVLIVMAAVGAY

SEQ ID NO: 308141 - protein, 29 aa, Mycobacterium
GAYLALRLLIPVIRWQRRETVLSEGDPGI

SEQ ID NO: 308142 - protein, 18 aa, Mycobacterium
GAYPARPANQLVPVLSLL

SEQ ID NO: 308143 - protein, 32 aa, Mycobacterium
GAYTVPDFAEFRLGSTRLRKVAMLVVVVICIF

SEQ ID NO: 308144 - protein, 26 aa, Mycobacterium
GCAESPTGIRCAAAMALASEEPANLS

SEQ ID NO: 308145 - protein, 19 aa, Mycobacterium
GCAPRLRFANPPAVHVDSA

SEQ ID NO: 308146 - protein, 17 aa, Mycobacterium
GCAPTSFGCGRVLASRT

SEQ ID NO: 308147 - protein, 23 aa, Mycobacterium
GCDVETKYHCARVIADPERDSGR

SEQ ID NO: 308148 - protein, 24 aa, Mycobacterium
GCDVETKYHCARVIADPERDSGRI

SEQ ID NO: 308149 - protein, 18 aa, Mycobacterium
GCECGSVPVARRLYGPGS

SEQ ID NO: 308150 - protein, 21 aa, Mycobacterium
GCGAVPFIAAFALTLTSTTRT

SEQ ID NO: 308151 - protein, 25 aa, Mycobacterium
GCGDTCPFFPGVSYRDWPLRDPAGQ

SEQ ID NO: 308152 - protein, 22 aa, Mycobacterium
GCGEGLEAVTVIRRGEVDESGL

SEQ ID NO: 308153 - protein, 17 aa, Mycobacterium
GCGYALMALTRALAAGR

SEQ ID NO: 308154 - protein, 24 aa, Mycobacterium
GCIAAESLLVHFLQKVAPESTFGT

SEQ ID NO: 308155 - protein, 54 aa, Mycobacterium
GCLAAVIWWACHRPNRLWWRFTAWWLLCGALAVTWWVVALLMLGRISPPFLDFI

SEQ ID NO: 308156 - protein, 32 aa, Mycobacterium
GCLAGLVAAGWAWRRYRWLARLGGLTFVSAFT

SEQ ID NO: 308157 - protein, 21 aa, Mycobacterium
GCLPAMIWLACHRPNRRWWRH

SEQ ID NO: 308158 - protein, 21 aa, Mycobacterium
GCLPMLAQIPVFIGLYHVLRS

SEQ ID NO: 308159 - protein, 21 aa, Mycobacterium
GCLPMLAQVPVFLGLYHVLMS

SEQ ID NO: 308160 - protein, 20 aa, Mycobacterium
GCLPTYAAIGVWAPAMLLFL

SEQ ID NO: 308161 - protein, 20 aa, Mycobacterium
GCLQVLIALAADFVVDLPSL

SEQ ID NO: 308162 - protein, 20 aa, Mycobacterium
GCPLMGARVFLIAAVANTAG

SEQ ID NO: 308163 - protein, 27 aa, Mycobacterium
GCQAQRPGSWWKNFGPKMHYRASAMLC

SEQ ID NO: 308164 - protein, 27 aa, Mycobacterium
GCSGAGKGSIFWGIAGGLGPAVKSGTV

SEQ ID NO: 308165 - protein, 17 aa, Mycobacterium
GCTQAGLAMAFAAVLDR

SEQ ID NO: 308166 - protein, 18 aa, Mycobacterium
GCVFTLITAVVFVTQHLF

SEQ ID NO: 308167 - protein, 21 aa, Mycobacterium
GCVIEPWALHRPFIPWLGWPM

SEQ ID NO: 308168 - protein, 25 aa, Mycobacterium
GCVLLAEVLFLRWLLDGKVGHQWWA

SEQ ID NO: 308169 - protein, 25 aa, Mycobacterium
GCVWIAKGDRPSIVAAPEDLGSVEV

SEQ ID NO: 308170 - protein, 24 aa, Mycobacterium
GCYALCAVLSLLFVARWVEETKGR

SEQ ID NO: 308171 - protein, 27 aa, Mycobacterium
GCYVGLRMSVQFLRRIAFSAFAFTIVL

SEQ ID NO: 308172 - protein, 35 aa, Mycobacterium
GDADRAARVWVWVRRPRFALGSAVVLLAVSLAVTS

SEQ ID NO: 308173 - protein, 21 aa, Mycobacterium
GDADRVISMLAELRQVAADRL

SEQ ID NO: 308174 - protein, 21 aa, Mycobacterium
GDAGFAAALCATRSEFGLSEP

SEQ ID NO: 308175 - protein, 20 aa, Mycobacterium
GDAIEQWSRNLNVIASQTAE

SEQ ID NO: 308176 - protein, 22 aa, Mycobacterium
GDAIVIRPGDKIPVDATVLSGQ

SEQ ID NO: 308177 - protein, 24 aa, Mycobacterium
GDALARSGAMFDRAGAQISALGPD

SEQ ID NO: 308178 - protein, 18 aa, Mycobacterium
GDALASCGIVAAPNTPPL

SEQ ID NO: 308179 - protein, 19 aa, Mycobacterium
GDALGSCGIVAAPDAPPLP

SEQ ID NO: 308180 - protein, 23 aa, Mycobacterium
GDALRASDMGFEFDDENPDAVDT

SEQ ID NO: 308181 - protein, 19 aa, Mycobacterium
GDAPPTMLAAAPVEGDATS

SEQ ID NO: 308182 - protein, 20 aa, Mycobacterium
GDAVIFISVLRLVSYWFEPR

SEQ ID NO: 308183 - protein, 25 aa, Mycobacterium
GDAWQLSLIHLRLSLVPILIGLAIA

SEQ ID NO: 308184 - protein, 29 aa, Mycobacterium
GDDAAELIAWSGLLLLALTALGGGIKLAM

SEQ ID NO: 308185 - protein, 20 aa, Mycobacterium
GDDALKRKAASVMLESFLFY

SEQ ID NO: 308186 - protein, 19 aa, Mycobacterium
GDDEFWMLLAGRKLSARDR

SEQ ID NO: 308187 - protein, 22 aa, Mycobacterium
GDDEFWMLLAGRKLSARDRRVL

SEQ ID NO: 308188 - protein, 17 aa, Mycobacterium
GDDLRRWIGDARVLTDD

SEQ ID NO: 308189 - protein, 17 aa, Mycobacterium
GDDPGRRRRPPIGVAPL

SEQ ID NO: 308190 - protein, 20 aa, Mycobacterium
GDDYRARVGVKVGPVGLTLA

SEQ ID NO: 308191 - protein, 25 aa, Mycobacterium
GDEARLRLLVNDMFETMSRRSRSLV

SEQ ID NO: 308192 - protein, 24 aa, Mycobacterium
GDECLRRVADVLAHLADDSVCVAA

SEQ ID NO: 308193 - protein, 20 aa, Mycobacterium
GDENFLIIGVDTRAGANSAM

SEQ ID NO: 308194 - protein, 18 aa, Mycobacterium
GDEPLKRKVASTLLESFL

SEQ ID NO: 308195 - protein, 25 aa, Mycobacterium
GDERLRIPLVVRIDDPWQAAAWRAQ

SEQ ID NO: 308196 - protein, 22 aa, Mycobacterium
GDERVASLLMWHFVEEVEHRSS

SEQ ID NO: 308197 - protein, 25 aa, Mycobacterium
GDETGYARPDLRFEQQPDTDEDRPA

SEQ ID NO: 308198 - protein, 23 aa, Mycobacterium
GDEVSVGIAQLFSAHAQDYQTLA

SEQ ID NO: 308199 - protein, 19 aa, Mycobacterium
GDFMHARVLLAPVFCLLAP

SEQ ID NO: 308200 - protein, 23 aa, Mycobacterium
GDGELTWRKALFSHETDYSPIPT

SEQ ID NO: 308201 - protein, 25 aa, Mycobacterium
GDGEYRKARLLAIVTGFLGALLAIA

SEQ ID NO: 308202 - protein, 20 aa, Mycobacterium
GDGFRAVGGFSDLYQQMTGP

SEQ ID NO: 308203 - protein, 17 aa, Mycobacterium
GDGGLLYVAPIYASPGN

SEQ ID NO: 308204 - protein, 17 aa, Mycobacterium
GDGKGGGPAADLVNIGA

SEQ ID NO: 308205 - protein, 23 aa, Mycobacterium
GDGKRLLVYQVLKSGAKLITDPD

SEQ ID NO: 308206 - protein, 17 aa, Mycobacterium
GDGNYSWASLFEQAKGT

SEQ ID NO: 308207 - protein, 23 aa, Mycobacterium
GDGQVWLERGCRTHGLVRTLYDE

SEQ ID NO: 308208 - protein, 19 aa, Mycobacterium
GDGSWIACQFVVNKHDGSG

SEQ ID NO: 308209 - protein, 20 aa, Mycobacterium
GDGVALLARNHRWFLIANYG

SEQ ID NO: 308210 - protein, 19 aa, Mycobacterium
GDGVGGVWRENTYPGAACD

SEQ ID NO: 308211 - protein, 17 aa, Mycobacterium
GDGWFPMTAPGPDLDHA

SEQ ID NO: 308212 - protein, 21 aa, Mycobacterium
GDGYLSMAVVDTGIGIDEKDH

SEQ ID NO: 308213 - protein, 25 aa, Mycobacterium
GDHPRPRIGQTLRFRHTTLDPDDLE

SEQ ID NO: 308214 - protein, 29 aa, Mycobacterium
GDHVLVVRPSIWYRLRRSVRFRSHATITA

SEQ ID NO: 308215 - protein, 19 aa, Mycobacterium
GDHWPVLALHLATTVALTA

SEQ ID NO: 308216 - protein, 22 aa, Mycobacterium
GDIAALALIRFPATGDKIGSLV

SEQ ID NO: 308217 - protein, 22 aa, Mycobacterium
GDIDGVLYIDMRLVEGASLKDI

SEQ ID NO: 308218 - protein, 20 aa, Mycobacterium
GDKPFGAEMHRYYADLMEKF

SEQ ID NO: 308219 - protein, 22 aa, Mycobacterium
GDKPPPARIVLMSDGKETVPSN

SEQ ID NO: 308220 - protein, 17 aa, Mycobacterium
GDKRAAPKLGIDLQGGT

SEQ ID NO: 308221 - protein, 22 aa, Mycobacterium
GDKSMKRVLLFTIAVIIIMLVL

SEQ ID NO: 308222 - protein, 17 aa, Mycobacterium
GDLAFTGLHAMLDPPRG

SEQ ID NO: 308223 - protein, 18 aa, Mycobacterium
GDLAHEIRTPVAVLDAYV

SEQ ID NO: 308224 - protein, 18 aa, Mycobacterium
GDLAHEIRTPVAVLEAYI

SEQ ID NO: 308225 - protein, 18 aa, Mycobacterium
GDLAMTWLLAGLVAGLLS

SEQ ID NO: 308226 - protein, 19 aa, Mycobacterium
GDLANPVLFKATTKTLESA

SEQ ID NO: 308227 - protein, 23 aa, Mycobacterium
GDLEILCCALIINGFTRFVSSGL

SEQ ID NO: 308228 - protein, 20 aa, Mycobacterium
GDLELSRSVGLAFAVAASTL

SEQ ID NO: 308229 - protein, 20 aa, Mycobacterium
GDLFIGIALFGLNSMMATVD

SEQ ID NO: 308230 - protein, 17 aa, Mycobacterium
GDLFLLNFLTLVTEFIG

SEQ ID NO: 308231 - protein, 17 aa, Mycobacterium
GDLFVVVGLLFLGTVAL

SEQ ID NO: 308232 - protein, 17 aa, Mycobacterium
GDLGALLPGGRVVFAGR

SEQ ID NO: 308233 - protein, 20 aa, Mycobacterium
GDLGFPISGEEDGGLTPASR

SEQ ID NO: 308234 - protein, 17 aa, Mycobacterium
GDLGFRAKAVLTRFPEG

SEQ ID NO: 308235 - protein, 17 aa, Mycobacterium
GDLGNFWVDLVRGTIRI

SEQ ID NO: 308236 - protein, 17 aa, Mycobacterium
GDLGVAIGLLLAAALSV

SEQ ID NO: 308237 - protein, 24 aa, Mycobacterium
GDLGYRAAATLTRYSRGILLERSG

SEQ ID NO: 308238 - protein, 19 aa, Mycobacterium
GDLILIVGGVLPFVWIAWI

SEQ ID NO: 308239 - protein, 21 aa, Mycobacterium
GDLLLVRPGEKIPVDGEIVDG

SEQ ID NO: 308240 - protein, 17 aa, Mycobacterium
GDLLRAAPMTARLLPGL

SEQ ID NO: 308241 - protein, 23 aa, Mycobacterium
GDLPEYRTGLIIVGLARCIAMVI

SEQ ID NO: 308242 - protein, 21 aa, Mycobacterium
GDLPGLQAWLASNGYALRPAV

SEQ ID NO: 308243 - protein, 23 aa, Mycobacterium
GDLPKIGAVTVVVIGLILLLVFR

SEQ ID NO: 308244 - protein, 20 aa, Mycobacterium
GDLRAAVDAIRLSRRTLTII

SEQ ID NO: 308245 - protein, 22 aa, Mycobacterium
GDLRARELIVVAPLIALLLVLG

SEQ ID NO: 308246 - protein, 21 aa, Mycobacterium
GDLRMVLKSAARFKHLAPESI

SEQ ID NO: 308247 - protein, 19 aa, Mycobacterium
GDLTALVCGGEFVDYAELL

SEQ ID NO: 308248 - protein, 24 aa, Mycobacterium
GDLVCWRPDGQLNYLGRADEQVKI

SEQ ID NO: 308249 - protein, 20 aa, Mycobacterium
GDLVPREMIVVAPLIALLLV

SEQ ID NO: 308250 - protein, 24 aa, Mycobacterium
GDLVRRLRRARARITDPQIRVVIA

SEQ ID NO: 308251 - protein, 31 aa, Mycobacterium
GDMAERMRIYFARLLKLFGVGFIVGAAPPLR

SEQ ID NO: 308252 - protein, 17 aa, Mycobacterium
GDMFGRKRVFQVAALLF

SEQ ID NO: 308253 - protein, 19 aa, Mycobacterium
GDMGFPAVETVPVGRAIVV

SEQ ID NO: 308254 - protein, 19 aa, Mycobacterium
GDMSFYVMRFLLGAAEAGL

SEQ ID NO: 308255 - protein, 29 aa, Mycobacterium
GDNAGRPWWRPSFKALVRVYDPHEPTCRS

SEQ ID NO: 308256 - protein, 18 aa, Mycobacterium
GDNPLGWDLGSPLQGRSG

SEQ ID NO: 308257 - protein, 23 aa, Mycobacterium
GDNRRPRLVAGPRPQHIPASPAQ

SEQ ID NO: 308258 - protein, 21 aa, Mycobacterium
GDPALPIGWAMWGFLITVIIS

SEQ ID NO: 308259 - protein, 23 aa, Mycobacterium
GDPDGGAAFVRRLVTLTTALLLL

SEQ ID NO: 308260 - protein, 23 aa, Mycobacterium
GDPDGGAAFVRRLVTLTTALLVF

SEQ ID NO: 308261 - protein, 24 aa, Mycobacterium
GDPDRMRVPIGWTKSGAVMSLNIK

SEQ ID NO: 308262 - protein, 17 aa, Mycobacterium
GDPKLTLPDAITGNPGD

SEQ ID NO: 308263 - protein, 21 aa, Mycobacterium
GDPLFWPSFVGAALIVMSNPV

SEQ ID NO: 308264 - protein, 17 aa, Mycobacterium
GDPPVGLIGVFGEATQG

SEQ ID NO: 308265 - protein, 19 aa, Mycobacterium
GDPSGYFFLPSQAFESPLF

SEQ ID NO: 308266 - protein, 17 aa, Mycobacterium
GDPVPTIFSHWENPGVR

SEQ ID NO: 308267 - protein, 22 aa, Mycobacterium
GDQAFEVLTPFAVDGGPTVLVD

SEQ ID NO: 308268 - protein, 17 aa, Mycobacterium
GDQKLGGGVAWAAGEVP

SEQ ID NO: 308269 - protein, 19 aa, Mycobacterium
GDQSLSEWSLHAEGVLAPA

SEQ ID NO: 308270 - protein, 25 aa, Mycobacterium
GDRDHVINLPGFPALGGATNPDAPF

SEQ ID NO: 308271 - protein, 23 aa, Mycobacterium
GDRGVEAFALYSVFYQSGALLGP

SEQ ID NO: 308272 - protein, 23 aa, Mycobacterium
GDRIGRKRVLAIVVVLMALATLG

SEQ ID NO: 308273 - protein, 24 aa, Mycobacterium
GDRIQHSLPLFGPIDLPALMTNGN

SEQ ID NO: 308274 - protein, 23 aa, Mycobacterium
GDRKIEAFAMFNIFYQAGILLGP

SEQ ID NO: 308275 - protein, 24 aa, Mycobacterium
GDRKVEAFAMFNVFYQAGILLGPL

SEQ ID NO: 308276 - protein, 22 aa, Mycobacterium
GDRLAFSNGILFLAAAAIAAVI

SEQ ID NO: 308277 - protein, 24 aa, Mycobacterium
GDRLAFSNGILFLAFGAVAFVVAF

SEQ ID NO: 308278 - protein, 21 aa, Mycobacterium
GDRLAFSNGILFLSAAAVAAV

SEQ ID NO: 308279 - protein, 22 aa, Mycobacterium
GDRLAFSNGILFLSGVAVLAIV

SEQ ID NO: 308280 - protein, 24 aa, Mycobacterium
GDRLGRKRMLVFTIVLMGVATTLI

SEQ ID NO: 308281 - protein, 25 aa, Mycobacterium
GDRLGRRRLYLLGMALFTTASLVCA

SEQ ID NO: 308282 - protein, 18 aa, Mycobacterium
GDRLRIVFRHHTTDDQAL

SEQ ID NO: 308283 - protein, 19 aa, Mycobacterium
GDRLWIRFIPDTEHRSQVI

SEQ ID NO: 308284 - protein, 22 aa, Mycobacterium
GDRRIMLGDFGLTRALDDSNSV

SEQ ID NO: 308285 - protein, 22 aa, Mycobacterium
GDRRMLCGLQLPATNNQQQAFK

SEQ ID NO: 308286 - protein, 22 aa, Mycobacterium
GDRSIELFLDIAVTCVASAMVG

SEQ ID NO: 308287 - protein, 25 aa, Mycobacterium
GDRYGRRGWLTIGLVIVGASSAVAA

SEQ ID NO: 308288 - protein, 25 aa, Mycobacterium
GDSANVWRLLSLGLIVAGIIGLKLA

SEQ ID NO: 308289 - protein, 24 aa, Mycobacterium
GDSARRAGNEFLFQQLAMQNIELL

SEQ ID NO: 308290 - protein, 18 aa, Mycobacterium
GDSGRFGDKIARISHRAN

SEQ ID NO: 308291 - protein, 25 aa, Mycobacterium
GDSLPRARPTFARRSNVSVVAATFA

SEQ ID NO: 308292 - protein, 20 aa, Mycobacterium
GDSRGYLLRDGELSQITKDD

SEQ ID NO: 308293 - protein, 20 aa, Mycobacterium
GDSRGYLLRDGELTQITKDD

SEQ ID NO: 308294 - protein, 21 aa, Mycobacterium
GDSRGYLLRDGELTQITKDDT

SEQ ID NO: 308295 - protein, 18 aa, Mycobacterium
GDSVMVFDAAGLRYKYTV

SEQ ID NO: 308296 - protein, 19 aa, Mycobacterium
GDTAHAVWNGATRVNRWRL

SEQ ID NO: 308297 - protein, 24 aa, Mycobacterium
GDTARYSAVFTDVYGLREGDDVRM

SEQ ID NO: 308298 - protein, 18 aa, Mycobacterium
GDTCARVTAIGQHTRLAG

SEQ ID NO: 308299 - protein, 18 aa, Mycobacterium
GDTCARVTAIGQHTRLAV

SEQ ID NO: 308300 - protein, 19 aa, Mycobacterium
GDTPLALAYQRIDRDVQAP

SEQ ID NO: 308301 - protein, 17 aa, Mycobacterium
GDTRTAFDVALYAIVLI

SEQ ID NO: 308302 - protein, 25 aa, Mycobacterium
GDTSARPAVQYVPPTGPVEEPAGGW

SEQ ID NO: 308303 - protein, 23 aa, Mycobacterium
GDTTKPRLCVHYDAEAASATEVQ

SEQ ID NO: 308304 - protein, 17 aa, Mycobacterium
GDTVFKSVAVAAGATII

SEQ ID NO: 308305 - protein, 18 aa, Mycobacterium
GDVARGGDLFRLNCASCH

SEQ ID NO: 308306 - protein, 18 aa, Mycobacterium
GDVAVLLSVELCSLTLQR

SEQ ID NO: 308307 - protein, 27 aa, Mycobacterium
GDVDFGGGWDFGGGSDFGGGSDSGGGD

SEQ ID NO: 308308 - protein, 23 aa, Mycobacterium
GDVDLRALPLFAELDADTLRELQ

SEQ ID NO: 308309 - protein, 20 aa, Mycobacterium
GDVFFGLPLLLAAIVLMQVM

SEQ ID NO: 308310 - protein, 21 aa, Mycobacterium
GDVFGLRRWYVITLIMGTFFV

SEQ ID NO: 308311 - protein, 21 aa, Mycobacterium
GDVFGLRRWYVVTLLMGLIFV

SEQ ID NO: 308312 - protein, 17 aa, Mycobacterium
GDVGWLDTGGWLRITDR

SEQ ID NO: 308313 - protein, 17 aa, Mycobacterium
GDVIPVDRSYVPPDINS

SEQ ID NO: 308314 - protein, 17 aa, Mycobacterium
GDVLELMTPTGRFGTPL

SEQ ID NO: 308315 - protein, 27 aa, Mycobacterium
GDVPNCPGDMLCVAAGKVIDPVDRVVD

SEQ ID NO: 308316 - protein, 24 aa, Mycobacterium
GDVQRKKRLGVLLATGLIVGESLY

SEQ ID NO: 308317 - protein, 26 aa, Mycobacterium
GDVRASWPWAVAVFIVVVFVGPLCEE

SEQ ID NO: 308318 - protein, 17 aa, Mycobacterium
GDVRFELFVTVAATCVA

SEQ ID NO: 308319 - protein, 20 aa, Mycobacterium
GDVRGLLHLSAHDGLNVRAA

SEQ ID NO: 308320 - protein, 18 aa, Mycobacterium
GDVRRLAGKVLLAAVAVC

SEQ ID NO: 308321 - protein, 26 aa, Mycobacterium
GDVVVFKGPPNWSIGYKSIRSDNAAV

SEQ ID NO: 308322 - protein, 18 aa, Mycobacterium
GDVYPAGEGFALDFDGGK

SEQ ID NO: 308323 - protein, 28 aa, Mycobacterium
GDWCYRQRWVVIAAWLVLISAVATILVV

SEQ ID NO: 308324 - protein, 21 aa, Mycobacterium
GDWDRQLRPLIAADFETAAGH

SEQ ID NO: 308325 - protein, 25 aa, Mycobacterium
GDYFRGRHSVIAWAMVAALLLSVIV

SEQ ID NO: 308326 - protein, 33 aa, Mycobacterium
GDYNWTGWPAELRWRPVTAIVGAVVAVGAIATA

SEQ ID NO: 308327 - protein, 24 aa, Mycobacterium
GDYRFGQALDLAWFVVLGVIAGGV

SEQ ID NO: 308328 - protein, 21 aa, Mycobacterium
GDYRPLRALDHAVAEFGPDQI

SEQ ID NO: 308329 - protein, 33 aa, Mycobacterium
GDYRVRAALRHVWRDRPLLLALLAVSTVGFASD

SEQ ID NO: 308330 - protein, 28 aa, Mycobacterium
GEAGADIFRDFPQVVAVISNMAEKRSLA

SEQ ID NO: 308331 - protein, 20 aa, Mycobacterium
GEAGHGLGLAIVNSIVKAHD

SEQ ID NO: 308332 - protein, 22 aa, Mycobacterium
GEAGYRIPFVPLLVGGQATLWL

SEQ ID NO: 308333 - protein, 20 aa, Mycobacterium
GEAIAGLVISAGWIVLFAAL

SEQ ID NO: 308334 - protein, 22 aa, Mycobacterium
GEAIASRFDGAITYYDEPPENG

SEQ ID NO: 308335 - protein, 20 aa, Mycobacterium
GEALFGYTGLGWRFSGALLG

SEQ ID NO: 308336 - protein, 22 aa, Mycobacterium
GEALKVMFVITVIALIGIVVFA

SEQ ID NO: 308337 - protein, 18 aa, Mycobacterium
GEALPEDSVDDFVAAGAN

SEQ ID NO: 308338 - protein, 24 aa, Mycobacterium
GEAMPRRRILLADFGIARQLGEIS

SEQ ID NO: 308339 - protein, 17 aa, Mycobacterium
GEAPAWADLPVQYADYS

SEQ ID NO: 308340 - protein, 25 aa, Mycobacterium
GEAPFGYLTWLGWFAYTVVGNMVGG

SEQ ID NO: 308341 - protein, 23 aa, Mycobacterium
GEARRLAWSLLRTGLERTGSDSP

SEQ ID NO: 308342 - protein, 21 aa, Mycobacterium
GEARWATYIALDHRLDDGQAA

SEQ ID NO: 308343 - protein, 25 aa, Mycobacterium
GEASFGYLDWLKWFGYTVVANVAGG

SEQ ID NO: 308344 - protein, 22 aa, Mycobacterium
GEATFRFPLVVAPRYIPGEPLA

SEQ ID NO: 308345 - protein, 20 aa, Mycobacterium
GEAVDRIWLRGTVALTGAIG

SEQ ID NO: 308346 - protein, 21 aa, Mycobacterium
GEAVEGLGFTHILAYDHVVGA

SEQ ID NO: 308347 - protein, 17 aa, Mycobacterium
GEAVKILDEFARAHRGY

SEQ ID NO: 308348 - protein, 20 aa, Mycobacterium
GEAVKPLRLFLQSNNYLAVV

SEQ ID NO: 308349 - protein, 29 aa, Mycobacterium
GEAVLAFALLMLFGFGMIWFGILIGSLMR

SEQ ID NO: 308350 - protein, 30 aa, Mycobacterium
GEDAPTKLSRRSLVIGNAVIAFAVIGLASL

SEQ ID NO: 308351 - protein, 21 aa, Mycobacterium
GEDLLDWSMQILKAVPNFALT

SEQ ID NO: 308352 - protein, 20 aa, Mycobacterium
GEDLLDWTMQILKAVPNFAL

SEQ ID NO: 308353 - protein, 23 aa, Mycobacterium
GEDSAPPAIHWGVLTVSISVLLT

SEQ ID NO: 308354 - protein, 25 aa, Mycobacterium
GEDSPAFLSWGWRVPFIASGLLVAV

SEQ ID NO: 308355 - protein, 17 aa, Mycobacterium
GEEDGGLTPASRKSAFA

SEQ ID NO: 308356 - protein, 22 aa, Mycobacterium
GEELPPPLAPLWMQELKASMHV

SEQ ID NO: 308357 - protein, 22 aa, Mycobacterium
GEERRAAVIFVDIIGSTKLVTS

SEQ ID NO: 308358 - protein, 23 aa, Mycobacterium
GEEYALRIAIDMLWHDLPQPHRV

SEQ ID NO: 308359 - protein, 24 aa, Mycobacterium
GEFFTQGMSMDWRTVFTGLGAERV

SEQ ID NO: 308360 - protein, 18 aa, Mycobacterium
GEFLRLLSNITWGNGSIV

SEQ ID NO: 308361 - protein, 18 aa, Mycobacterium
GEGARLVTTLARHPGGAS

SEQ ID NO: 308362 - protein, 17 aa, Mycobacterium
GEGARLVTTLTRHPGGA

SEQ ID NO: 308363 - protein, 17 aa, Mycobacterium
GEGARLVTTMTRHPGGA

SEQ ID NO: 308364 - protein, 18 aa, Mycobacterium
GEGCGTCNIAEALKMSLN

SEQ ID NO: 308365 - protein, 27 aa, Mycobacterium
GEGEAMLFGEYIRFMALVEYSADELKT

SEQ ID NO: 308366 - protein, 17 aa, Mycobacterium
GEGGYYLPQRAWQDPRF

SEQ ID NO: 308367 - protein, 26 aa, Mycobacterium
GEGSCFRLTLPLVRGHKVTTSPLPIK

SEQ ID NO: 308368 - protein, 23 aa, Mycobacterium
GEGSFWRRLFSPAGFTSVSHVFV

SEQ ID NO: 308369 - protein, 29 aa, Mycobacterium
GEGSGIPFTATWTCTAFVVNPDGWVATAG

SEQ ID NO: 308370 - protein, 20 aa, Mycobacterium
GEGTDLFSMLCRSRSDEGER

SEQ ID NO: 308371 - protein, 23 aa, Mycobacterium
GEGTRPLLLASIAWVVIPTGIVL

SEQ ID NO: 308372 - protein, 21 aa, Mycobacterium
GEHAGALWISMDYVEGTDAAS

SEQ ID NO: 308373 - protein, 19 aa, Mycobacterium
GEHPLAVDADVRRVTSATG

SEQ ID NO: 308374 - protein, 19 aa, Mycobacterium
GEHPYLMWDAAYVLGSLSA

SEQ ID NO: 308375 - protein, 23 aa, Mycobacterium
GEHRGRAAVKFLLYNLVGGLIML

SEQ ID NO: 308376 - protein, 25 aa, Mycobacterium
GEHSRLGQVVAWVVIVAGVVFVAAV

SEQ ID NO: 308377 - protein, 22 aa, Mycobacterium
GEIAEGALLLFLFSVGHALEGY

SEQ ID NO: 308378 - protein, 19 aa, Mycobacterium
GEIDGQMYLEMRLIEGTDL

SEQ ID NO: 308379 - protein, 20 aa, Mycobacterium
GEIDGQMYLEMRLIEGTDLD

SEQ ID NO: 308380 - protein, 21 aa, Mycobacterium
GEIDGVLYIDMRLVEGASLKE

SEQ ID NO: 308381 - protein, 23 aa, Mycobacterium
GEIGEIWLRGTSVAAGYWNLPEL

SEQ ID NO: 308382 - protein, 20 aa, Mycobacterium
GEIGMIPALNARRHPNRVAV

SEQ ID NO: 308383 - protein, 17 aa, Mycobacterium
GEIKAWFDSHDESVLFV

SEQ ID NO: 308384 - protein, 17 aa, Mycobacterium
GEILAVSQIRWLYSDDD

SEQ ID NO: 308385 - protein, 17 aa, Mycobacterium
GEILIPRLYALHILLIP

SEQ ID NO: 308386 - protein, 32 aa, Mycobacterium
GEIMAAGGISRRLIAFASLFVGWLRGGLAMIN

SEQ ID NO: 308387 - protein, 21 aa, Mycobacterium
GEIPGGGTATVVFSRERNSGV

SEQ ID NO: 308388 - protein, 22 aa, Mycobacterium
GEIPRELSALLDRILDFPTSTA

SEQ ID NO: 308389 - protein, 20 aa, Mycobacterium
GEIVVGVLLVLGLFTPLAGA

SEQ ID NO: 308390 - protein, 20 aa, Mycobacterium
GEKLPWAVIVLVFPVFGPIL

SEQ ID NO: 308391 - protein, 23 aa, Mycobacterium
GELAALFCWGFLLLVFTGGGSLS

SEQ ID NO: 308392 - protein, 21 aa, Mycobacterium
GELAKAGFRVEGVEPPASDVV

SEQ ID NO: 308393 - protein, 25 aa, Mycobacterium
GELDGRLWIAMDYIEGIDVGQLMRD

SEQ ID NO: 308394 - protein, 21 aa, Mycobacterium
GELEIVYPPVSIRAEPAVAWV

SEQ ID NO: 308395 - protein, 19 aa, Mycobacterium
GELFFGAAPELDRYLESLH

SEQ ID NO: 308396 - protein, 21 aa, Mycobacterium
GELFIMGRIKDLVIVDGRNHY

SEQ ID NO: 308397 - protein, 19 aa, Mycobacterium
GELFVIYIAAYAVFRFFVE

SEQ ID NO: 308398 - protein, 22 aa, Mycobacterium
GELKSAHLLSPAPRPSIMRRGV

SEQ ID NO: 308399 - protein, 21 aa, Mycobacterium
GELLGIPAPNLIAANNASLSL

SEQ ID NO: 308400 - protein, 19 aa, Mycobacterium
GELLIPVEGGIDVFNMTTG

SEQ ID NO: 308401 - protein, 18 aa, Mycobacterium
GELMPSLVDTIFGDTAGQ

SEQ ID NO: 308402 - protein, 22 aa, Mycobacterium
GELPHTVEFLLGIIPSSIVSAF

SEQ ID NO: 308403 - protein, 22 aa, Mycobacterium
GELPHTVEFLLNIIPSSVVSAF

SEQ ID NO: 308404 - protein, 22 aa, Mycobacterium
GELPSHLPAPVLPHVDVNTLRT

SEQ ID NO: 308405 - protein, 23 aa, Mycobacterium
GELQRLALAAALARDPALLIADE

SEQ ID NO: 308406 - protein, 20 aa, Mycobacterium
GELQRLALAAALAREPAMLI

SEQ ID NO: 308407 - protein, 22 aa, Mycobacterium
GELQVWNVLNWHAVEELEHKSV

SEQ ID NO: 308408 - protein, 19 aa, Mycobacterium
GELRDAMLLMPISDPAAPT

SEQ ID NO: 308409 - protein, 31 aa, Mycobacterium
GELSRATLRRHCWRGNGRAWIEVRGLADAAD

SEQ ID NO: 308410 - protein, 19 aa, Mycobacterium
GELVCLPHEGGARFRLTLP

SEQ ID NO: 308411 - protein, 21 aa, Mycobacterium
GELWIGGACVGMGYRGLPALT

SEQ ID NO: 308412 - protein, 21 aa, Mycobacterium
GELWQLSARMSRERLWQTIGF

SEQ ID NO: 308413 - protein, 17 aa, Mycobacterium
GEMPAYPVRSWKSLLAL

SEQ ID NO: 308414 - protein, 17 aa, Mycobacterium
GEMQLLLDNSCLQQGRA

SEQ ID NO: 308415 - protein, 24 aa, Mycobacterium
GEMQVGSLIAFLSYFMQILMSVLM

SEQ ID NO: 308416 - protein, 27 aa, Mycobacterium
GENARFLFGPMARFFYDAGIIKGIPAT

SEQ ID NO: 308417 - protein, 18 aa, Mycobacterium
GENLTSLGYDGQPVNATP

SEQ ID NO: 308418 - protein, 20 aa, Mycobacterium
GENRPGLVVPQGRRPLAERV

SEQ ID NO: 308419 - protein, 26 aa, Mycobacterium
GEPCEKLWLPPLLRPRPLGRLIADSG

SEQ ID NO: 308420 - protein, 18 aa, Mycobacterium
GEPHFCANCGAQHHHTEK

SEQ ID NO: 308421 - protein, 26 aa, Mycobacterium
GEPILPRWVGHFSLATAVVMIPAAGA

SEQ ID NO: 308422 - protein, 20 aa, Mycobacterium
GEPLPAFGSAMVLLGAIGIV

SEQ ID NO: 308423 - protein, 31 aa, Mycobacterium
GEPPAVVRRRLRWWPAIGYGLLPALALLLAG

SEQ ID NO: 308424 - protein, 17 aa, Mycobacterium
GEPRILLSDFGIAGRAP

SEQ ID NO: 308425 - protein, 26 aa, Mycobacterium
GEPTSFVRRTWLVLRMNPQRNIAAVA

SEQ ID NO: 308426 - protein, 21 aa, Mycobacterium
GEPVPLPAGSVLPLERSDPSF

SEQ ID NO: 308427 - protein, 19 aa, Mycobacterium
GEQAFEVLAPFAVDDGPTV

SEQ ID NO: 308428 - protein, 26 aa, Mycobacterium
GEQDRLPIEIAIAVLVLGVLLLVYRN

SEQ ID NO: 308429 - protein, 19 aa, Mycobacterium
GEQGLQWAVAGYSLGMAAV

SEQ ID NO: 308430 - protein, 24 aa, Mycobacterium
GEQGRSLAIAGLVISYVFTVLTVV

SEQ ID NO: 308431 - protein, 21 aa, Mycobacterium
GEQISLLVFMIFASKGAAGVS

SEQ ID NO: 308432 - protein, 17 aa, Mycobacterium
GEQQSRTVLTFRPGLPL

SEQ ID NO: 308433 - protein, 28 aa, Mycobacterium
GEQRKWLRRVWLALPLGLLSMAAPMLFG

SEQ ID NO: 308434 - protein, 21 aa, Mycobacterium
GEQYLPAMFFFAVLGFANFAD

SEQ ID NO: 308435 - protein, 29 aa, Mycobacterium
GERDALRFVACGRPLPGHEIRIVDTAGTE

SEQ ID NO: 308436 - protein, 26 aa, Mycobacterium
GERDRLPIELAIGVLVLVVLLVVYRN

SEQ ID NO: 308437 - protein, 22 aa, Mycobacterium
GEREKLRYAVVATMCLGAVIGA

SEQ ID NO: 308438 - protein, 19 aa, Mycobacterium
GERLDWGRTIGIGAQHVVA

SEQ ID NO: 308439 - protein, 19 aa, Mycobacterium
GERPPRRRPAAAAAADAKE

SEQ ID NO: 308440 - protein, 20 aa, Mycobacterium
GERQRLRDLFGRYVGEDVAR

SEQ ID NO: 308441 - protein, 24 aa, Mycobacterium
GERQRLRVGVVVTMGAGAFVGATM

SEQ ID NO: 308442 - protein, 33 aa, Mycobacterium
GERRKWLRRVWLTWPLALLATASTMVFGAAPWA

SEQ ID NO: 308443 - protein, 22 aa, Mycobacterium
GERSISVALLFPATVCALAALL

SEQ ID NO: 308444 - protein, 25 aa, Mycobacterium
GERSPDYWLGWWVIIGTIPISVIGL

SEQ ID NO: 308445 - protein, 28 aa, Mycobacterium
GERYRRIVKRRGKLKALVAVARSILVII

SEQ ID NO: 308446 - protein, 19 aa, Mycobacterium
GESCGTCNIAQALKQSLNT

SEQ ID NO: 308447 - protein, 22 aa, Mycobacterium
GESDGQFWISMDFVDGTDAATL

SEQ ID NO: 308448 - protein, 20 aa, Mycobacterium
GESGGQFWISMDFVAGTDAA

SEQ ID NO: 308449 - protein, 17 aa, Mycobacterium
GESKGYFLLGIWMSLLW

SEQ ID NO: 308450 - protein, 22 aa, Mycobacterium
GESKGYFLLGIWMSLVWAVVVA

SEQ ID NO: 308451 - protein, 22 aa, Mycobacterium
GESKMNMPWLFFFSGLAIPAFY

SEQ ID NO: 308452 - protein, 22 aa, Mycobacterium
GESKMNMPWLFFFSGLAIPTFY

SEQ ID NO: 308453 - protein, 17 aa, Mycobacterium
GESLGSFGGEAPFLALN

SEQ ID NO: 308454 - protein, 21 aa, Mycobacterium
GESRVRKVVERFQRVLEAMTG

SEQ ID NO: 308455 - protein, 21 aa, Mycobacterium
GETFWEFLPRTVFGSLRSAIG

SEQ ID NO: 308456 - protein, 19 aa, Mycobacterium
GETIALMLILSGTSVAFGW

SEQ ID NO: 308457 - protein, 23 aa, Mycobacterium
GETLAAGGWEWFVLAVTAVVVIV

SEQ ID NO: 308458 - protein, 19 aa, Mycobacterium
GETRFPLIIQNTHRYFFYI

SEQ ID NO: 308459 - protein, 20 aa, Mycobacterium
GETRLPLIIQNSHRYFFYIA

SEQ ID NO: 308460 - protein, 19 aa, Mycobacterium
GETVDRVWLRGTVILTGTM

SEQ ID NO: 308461 - protein, 18 aa, Mycobacterium
GETWAIWTALIVGTGVLV

SEQ ID NO: 308462 - protein, 20 aa, Mycobacterium
GETWGFIGGYLSWVPVILNA

SEQ ID NO: 308463 - protein, 21 aa, Mycobacterium
GETWGFIGGYLSWVPVILNAA

SEQ ID NO: 308464 - protein, 18 aa, Mycobacterium
GEVAGVVLGRAMRGAIRN

SEQ ID NO: 308465 - protein, 21 aa, Mycobacterium
GEVAVFVFFGLVAVLGTEYTQ

SEQ ID NO: 308466 - protein, 21 aa, Mycobacterium
GEVAVFVFFGLVAVLGTQYTQ

SEQ ID NO: 308467 - protein, 17 aa, Mycobacterium
GEVFAVLMMPDGDFPGQ

SEQ ID NO: 308468 - protein, 25 aa, Mycobacterium
GEVGRIFVGNAFPFEGYTGGGHKQI

SEQ ID NO: 308469 - protein, 25 aa, Mycobacterium
GEVGRIFVRNTFPFKGYTGGGGKQI

SEQ ID NO: 308470 - protein, 19 aa, Mycobacterium
GEVKIADFGLVRAVAEAKI

SEQ ID NO: 308471 - protein, 20 aa, Mycobacterium
GEVKIADFGLVRAVAVAGIT

SEQ ID NO: 308472 - protein, 17 aa, Mycobacterium
GEVLTPGLFARFRKQLT

SEQ ID NO: 308473 - protein, 24 aa, Mycobacterium
GEVNWRRCAPRSIGAGLVVGLLTG

SEQ ID NO: 308474 - protein, 19 aa, Mycobacterium
GEVPLLAVVIAFSLAFGMG

SEQ ID NO: 308475 - protein, 25 aa, Mycobacterium
GEVPPEFRATFQAGIVGDRLADGST

SEQ ID NO: 308476 - protein, 26 aa, Mycobacterium
GEVPPEFRATYQAGLVGTRLADGSNQ

SEQ ID NO: 308477 - protein, 20 aa, Mycobacterium
GEVVDARFAIRDNYTEQLIK

SEQ ID NO: 308478 - protein, 24 aa, Mycobacterium
GEVVVFKGPPEWNGNYRSIRSSNT

SEQ ID NO: 308479 - protein, 22 aa, Mycobacterium
GEVWRCLRCGDFTLGAPRGRGH

SEQ ID NO: 308480 - protein, 20 aa, Mycobacterium
GEVWRCLRCGEFTVGEPHGR

SEQ ID NO: 308481 - protein, 21 aa, Mycobacterium
GEVWRCLRCGEFTVGPPHGRG

SEQ ID NO: 308482 - protein, 21 aa, Mycobacterium
GEVYASFTVAFLFAGHGVDAI

SEQ ID NO: 308483 - protein, 26 aa, Mycobacterium
GEWLPGQILQGIGVGAAFPLLGSAAL

SEQ ID NO: 308484 - protein, 17 aa, Mycobacterium
GEWPRPLSPDFVAFRRV

SEQ ID NO: 308485 - protein, 23 aa, Mycobacterium
GEYETIGGLVLQELGHIPETGEA

SEQ ID NO: 308486 - protein, 23 aa, Mycobacterium
GEYETIGGLVLQELGHIPTVGET

SEQ ID NO: 308487 - protein, 23 aa, Mycobacterium
GEYLKRIVMCSMLYLAVVTPLYA

SEQ ID NO: 308488 - protein, 17 aa, Mycobacterium
GEYRPLRALAKAVETFR

SEQ ID NO: 308489 - protein, 17 aa, Mycobacterium
GEYRSAVVYSLIVVALA

SEQ ID NO: 308490 - protein, 24 aa, Mycobacterium
GEYTRLGLCTVPTALLAAVLALWA

SEQ ID NO: 308491 - protein, 24 aa, Mycobacterium
GEYTRLGVCTVPASLLIAVLALWA

SEQ ID NO: 308492 - protein, 22 aa, Mycobacterium
GFAALRIASYAFWPFGRTIVDK

SEQ ID NO: 308493 - protein, 23 aa, Mycobacterium
GFAALRIASYALWPFGRTIVEKP

SEQ ID NO: 308494 - protein, 36 aa, Mycobacterium
GFAAVALSRNWFRRWQLVLCDQAIVIALMLAGRLVV

SEQ ID NO: 308495 - protein, 33 aa, Mycobacterium
GFADFPRYPLNVLSDINAVFGIITVHTQYQYLT

SEQ ID NO: 308496 - protein, 25 aa, Mycobacterium
GFAEAAPWRPVVLVLGIATMILAGW

SEQ ID NO: 308497 - protein, 18 aa, Mycobacterium
GFAELYRQGAARDVAMLL

SEQ ID NO: 308498 - protein, 22 aa, Mycobacterium
GFAGLRLLDIVTVVFFTAVTVA

SEQ ID NO: 308499 - protein, 18 aa, Mycobacterium
GFAGLYAAYRLRLAGQSM

SEQ ID NO: 308500 - protein, 18 aa, Mycobacterium
GFALGWRPAPAALALGAA

SEQ ID NO: 308501 - protein, 18 aa, Mycobacterium
GFALGWRPPLAGLALGAL

SEQ ID NO: 308502 - protein, 19 aa, Mycobacterium
GFALLPAWITGTIATGGTD

SEQ ID NO: 308503 - protein, 19 aa, Mycobacterium
GFAMAQGYHFGRPQTREDV

SEQ ID NO: 308504 - protein, 19 aa, Mycobacterium
GFAMLPAYLFLVVRGLHPA

SEQ ID NO: 308505 - protein, 20 aa, Mycobacterium
GFAMLPAYLLLVVRGQHGGE

SEQ ID NO: 308506 - protein, 17 aa, Mycobacterium
GFAPADSAAMCFGVSGV

SEQ ID NO: 308507 - protein, 19 aa, Mycobacterium
GFARRGLIGHPIKLLKGHT

SEQ ID NO: 308508 - protein, 25 aa, Mycobacterium
GFASLAVAVAVAIRPTASSEPVEGH

SEQ ID NO: 308509 - protein, 17 aa, Mycobacterium
GFAWWAAALNSLPMLAA

SEQ ID NO: 308510 - protein, 23 aa, Mycobacterium
GFAYLFRRVFGRHLRTVFIVLLA

SEQ ID NO: 308511 - protein, 18 aa, Mycobacterium
GFCAWFVGMHLLFSFNTI

SEQ ID NO: 308512 - protein, 17 aa, Mycobacterium
GFDAEFFGIAPSEVMAM

SEQ ID NO: 308513 - protein, 25 aa, Mycobacterium
GFDPRAWPAWIWGALTGLGLVVAGI

SEQ ID NO: 308514 - protein, 19 aa, Mycobacterium
GFEAVSFASPRTGAGTASL

SEQ ID NO: 308515 - protein, 23 aa, Mycobacterium
GFEIRYVPRQECAPLTDRISFSL

SEQ ID NO: 308516 - protein, 25 aa, Mycobacterium
GFENARLGTLASWIGVRETWRVIGD

SEQ ID NO: 308517 - protein, 25 aa, Mycobacterium
GFFAPHSWWPILISLSFSTAAVGAA

SEQ ID NO: 308518 - protein, 21 aa, Mycobacterium
GFFGFLMGCIIYAGDGLTTIY

SEQ ID NO: 308519 - protein, 20 aa, Mycobacterium
GFFGSAFGTYLMRQFFRTLP

SEQ ID NO: 308520 - protein, 45 aa, Mycobacterium
GFFRMCVLTGRALFRWPFQWREFVLQCWFIMRVAFLPTIMVSIPL

SEQ ID NO: 308521 - protein, 26 aa, Mycobacterium
GFFRSPRWVPVLGWLLVLGSVAGVLF

SEQ ID NO: 308522 - protein, 23 aa, Mycobacterium
GFFSPHSWWPILIALSGSVVAVG

SEQ ID NO: 308523 - protein, 20 aa, Mycobacterium
GFFSPHSWWPILVALSASVS

SEQ ID NO: 308524 - protein, 21 aa, Mycobacterium
GFFSPHSWWPIMIALSGSITA

SEQ ID NO: 308525 - protein, 19 aa, Mycobacterium
GFFSPHSWWPIMVALSGSV

SEQ ID NO: 308526 - protein, 26 aa, Mycobacterium
GFGAMIVVCMFWRLFMQDNRPHDGAG

SEQ ID NO: 308527 - protein, 25 aa, Mycobacterium
GFGATVVLCLIWRLLSGGLTAAPVN

SEQ ID NO: 308528 - protein, 25 aa, Mycobacterium
GFGGLRMSRSLSRLRARSHEHAHAA

SEQ ID NO: 308529 - protein, 18 aa, Mycobacterium
GFGITVVVTVLFDVVASR

SEQ ID NO: 308530 - protein, 18 aa, Mycobacterium
GFGLAGLIAFEVNMGLAP

SEQ ID NO: 308531 - protein, 22 aa, Mycobacterium
GFGLTGIMPLTFSTQDVHVAGW

SEQ ID NO: 308532 - protein, 28 aa, Mycobacterium
GFGRWRRIGTAIVRWPAPILCATIAIAI

SEQ ID NO: 308533 - protein, 24 aa, Mycobacterium
GFGVLRDGQKWVALAVPGYALAGA

SEQ ID NO: 308534 - protein, 20 aa, Mycobacterium
GFGVQWPLHTAMWVLAVASL

SEQ ID NO: 308535 - protein, 17 aa, Mycobacterium
GFGYTRYQAEFAQAAQL

SEQ ID NO: 308536 - protein, 17 aa, Mycobacterium
GFHHGFFIFAIVLTALS

SEQ ID NO: 308537 - protein, 18 aa, Mycobacterium
GFHHGFFIFAVLLTALSI

SEQ ID NO: 308538 - protein, 32 aa, Mycobacterium
GFLARFRLEARAVARLRHPGLVAVFDQGMDGR

SEQ ID NO: 308539 - protein, 20 aa, Mycobacterium
GFLMGCVIYGPGGYATIYGS

SEQ ID NO: 308540 - protein, 20 aa, Mycobacterium
GFLPLFPPGMGPPGRHLRVF

SEQ ID NO: 308541 - protein, 19 aa, Mycobacterium
GFLPVPGAVLVLRRDGSAL

SEQ ID NO: 308542 - protein, 26 aa, Mycobacterium
GFLRAIKNNLFGGGGLQGGSTITQQY

SEQ ID NO: 308543 - protein, 20 aa, Mycobacterium
GFLREVKFLSRWIDGKPVFT

SEQ ID NO: 308544 - protein, 21 aa, Mycobacterium
GFLRRSVELMYFVAVPVAVVG

SEQ ID NO: 308545 - protein, 24 aa, Mycobacterium
GFLTMDRWLLWQLPSTGRAFEYLK

SEQ ID NO: 308546 - protein, 17 aa, Mycobacterium
GFMGFQFIVVLYLQELR

SEQ ID NO: 308547 - protein, 20 aa, Mycobacterium
GFNLYWRVRYALQNAGGAAE

SEQ ID NO: 308548 - protein, 19 aa, Mycobacterium
GFNTWMFDLIWEFLQDPIG

SEQ ID NO: 308549 - protein, 29 aa, Mycobacterium
GFPAWLRWQHFFNIVFMMFIIRSGLQILA

SEQ ID NO: 308550 - protein, 19 aa, Mycobacterium
GFPLLPSRLSRGSKATRTT

SEQ ID NO: 308551 - protein, 24 aa, Mycobacterium
GFPRSEFAVSLALVLLMLPVIVRA

SEQ ID NO: 308552 - protein, 23 aa, Mycobacterium
GFQQRLWRECRKVTRLQEPHVLP

SEQ ID NO: 308553 - protein, 19 aa, Mycobacterium
GFQRRHLWRAARNPGRLPD

SEQ ID NO: 308554 - protein, 24 aa, Mycobacterium
GFRARFSREALIAARLTDPHIIPV

SEQ ID NO: 308555 - protein, 19 aa, Mycobacterium
GFRERLREVHDYLDASHRR

SEQ ID NO: 308556 - protein, 21 aa, Mycobacterium
GFRGAEMFRPVAGIQDEWTIC

SEQ ID NO: 308557 - protein, 22 aa, Mycobacterium
GFRQRCVTSWAGFRGAVSLAAA

SEQ ID NO: 308558 - protein, 29 aa, Mycobacterium
GFRSRLYADRWCAWAMLAAAVVIPTGLAV

SEQ ID NO: 308559 - protein, 29 aa, Mycobacterium
GFRSRLYAERWCAWALLAATVAVPTGLMI

SEQ ID NO: 308560 - protein, 30 aa, Mycobacterium
GFRSRLYVERWCAWALMAAAVAIPSGIAVR

SEQ ID NO: 308561 - protein, 17 aa, Mycobacterium
GFRSVLLPPELVAIEPA

SEQ ID NO: 308562 - protein, 23 aa, Mycobacterium
GFSHFTLLLVHALRQQFSRVRVF

SEQ ID NO: 308563 - protein, 24 aa, Mycobacterium
GFSIPAEVLGAVEFQKASEAFVSP

SEQ ID NO: 308564 - protein, 19 aa, Mycobacterium
GFSNVGAWWTEPIVFEKAV

SEQ ID NO: 308565 - protein, 23 aa, Mycobacterium
GFSVAWLYWYFWVIVVGFEAVAG

SEQ ID NO: 308566 - protein, 23 aa, Mycobacterium
GFSVGWLYWYFWVIVVGFEAVAG

SEQ ID NO: 308567 - protein, 20 aa, Mycobacterium
GFSVWSIWSVMVLFMPQDVY

SEQ ID NO: 308568 - protein, 30 aa, Mycobacterium
GFTELLLGLALAFRRTRIVGSLGGLAYVAF

SEQ ID NO: 308569 - protein, 20 aa, Mycobacterium
GFTFGFGSLVWVYAGESFPA

SEQ ID NO: 308570 - protein, 24 aa, Mycobacterium
GFTKPPVWGMRWTLWRTITVLVVS

SEQ ID NO: 308571 - protein, 29 aa, Mycobacterium
GFTPARPRRLPQWGRIAAGAAVVIAMAGT

SEQ ID NO: 308572 - protein, 25 aa, Mycobacterium
GFTRAGALWSSLFAGFVILILLLIF

SEQ ID NO: 308573 - protein, 25 aa, Mycobacterium
GFTRLWPTVVCLTGYAVAFALLALS

SEQ ID NO: 308574 - protein, 19 aa, Mycobacterium
GFTSVAHVFVMEWMAILRD

SEQ ID NO: 308575 - protein, 20 aa, Mycobacterium
GFTVELWQAIASRERWTTDW

SEQ ID NO: 308576 - protein, 22 aa, Mycobacterium
GFVALALALLFGRDPGTDKPPE

SEQ ID NO: 308577 - protein, 19 aa, Mycobacterium
GFVALRWRRTIACHAFAVA

SEQ ID NO: 308578 - protein, 18 aa, Mycobacterium
GFVDARAFDSLSPERRRD

SEQ ID NO: 308579 - protein, 23 aa, Mycobacterium
GFVGGLLLWLVWPSGGGWADIRA

SEQ ID NO: 308580 - protein, 24 aa, Mycobacterium
GFVVPLCALALLFVDIAATAILLS

SEQ ID NO: 308581 - protein, 17 aa, Mycobacterium
GFWLVKEYFGMSVGQTL

SEQ ID NO: 308582 - protein, 30 aa, Mycobacterium
GFWRDTWRGLRARPKFVIAGLLILFIAAVA

SEQ ID NO: 308583 - protein, 18 aa, Mycobacterium
GFWVPGYPVTPILSILAC

SEQ ID NO: 308584 - protein, 25 aa, Mycobacterium
GFYALCAVLSFLFVSKWVEETRGKN

SEQ ID NO: 308585 - protein, 17 aa, Mycobacterium
GFYIPAYTALLPSLLPA

SEQ ID NO: 308586 - protein, 18 aa, Mycobacterium
GFYLSRPKAHGHGFPAAT

SEQ ID NO: 308587 - protein, 18 aa, Mycobacterium
GFYSPLFYRDLIGDPTGL

SEQ ID NO: 308588 - protein, 24 aa, Mycobacterium
GFYVTCAIFIFGVLGTLLWAVSRV

SEQ ID NO: 308589 - protein, 37 aa, Mycobacterium
GGAAAGILLKVCWPTAPRWLGVPLYIVLGWVAVWFCP

SEQ ID NO: 308590 - protein, 18 aa, Mycobacterium
GGAALEALGRIRGIALDK

SEQ ID NO: 308591 - protein, 20 aa, Mycobacterium
GGAARAMFDPLLARMRDMGC

SEQ ID NO: 308592 - protein, 25 aa, Mycobacterium
GGADHRGRVRIGTVLLSPAQPETNG

SEQ ID NO: 308593 - protein, 17 aa, Mycobacterium
GGADIQPGQLLRISGKA

SEQ ID NO: 308594 - protein, 21 aa, Mycobacterium
GGADRCQAIAWFSDSKIDFTA

SEQ ID NO: 308595 - protein, 18 aa, Mycobacterium
GGAEAISVGGVRVGPNVT

SEQ ID NO: 308596 - protein, 21 aa, Mycobacterium
GGAGAIFPIFMVGGMMMMMFG

SEQ ID NO: 308597 - protein, 17 aa, Mycobacterium
GGAGRVRARLTMSGPDS

SEQ ID NO: 308598 - protein, 23 aa, Mycobacterium
GGAIAAVVVLVAIIALVVLLLVP

SEQ ID NO: 308599 - protein, 38 aa, Mycobacterium
GGAIAGILLKMCWPTAPRWVGVPLYLLLGWVAVWYTAT

SEQ ID NO: 308600 - protein, 26 aa, Mycobacterium
GGAIALRILFDLPLLLGGIITGLVSL

SEQ ID NO: 308601 - protein, 19 aa, Mycobacterium
GGAKIAMGWPLTAVGALVT

SEQ ID NO: 308602 - protein, 19 aa, Mycobacterium
GGAKPRKGTGLIGLTDRVT

SEQ ID NO: 308603 - protein, 25 aa, Mycobacterium
GGALAGIALKVCWPTAPRWLGVPLY

SEQ ID NO: 308604 - protein, 23 aa, Mycobacterium
GGALAGLGWWALRRAATMPPLAE

SEQ ID NO: 308605 - protein, 20 aa, Mycobacterium
GGALAGLGWWLLRRRTDVPP

SEQ ID NO: 308606 - protein, 20 aa, Mycobacterium
GGALARTVFGLKYAERNFLF

SEQ ID NO: 308607 - protein, 17 aa, Mycobacterium
GGALAWLAGASVRPLAY

SEQ ID NO: 308608 - protein, 17 aa, Mycobacterium
GGALAWTSGDDVRPLSY

SEQ ID NO: 308609 - protein, 24 aa, Mycobacterium
GGALCVAVALATVMLSRRGRQGIT

SEQ ID NO: 308610 - protein, 25 aa, Mycobacterium
GGALDLLQTIGFVWFELLITSCYLG

SEQ ID NO: 308611 - protein, 30 aa, Mycobacterium
GGALGLAIAVVLCWLLYRRAVRLNLRVFFT

SEQ ID NO: 308612 - protein, 24 aa, Mycobacterium
GGALLKRKRPGAEHGGRQWGRYLR

SEQ ID NO: 308613 - protein, 27 aa, Mycobacterium
GGALLRSWPAFLAYLVSFVFIGSSWLA

SEQ ID NO: 308614 - protein, 26 aa, Mycobacterium
GGALTEVSWRLAFLVNVPIGLIMIYL

SEQ ID NO: 308615 - protein, 26 aa, Mycobacterium
GGALTEVSWRLAFLVNVPIGLVMIYL

SEQ ID NO: 308616 - protein, 26 aa, Mycobacterium
GGALTEVSWRLAFLVNVPIGLVMMYL

SEQ ID NO: 308617 - protein, 18 aa, Mycobacterium
GGALVIGALGKRAADREV

SEQ ID NO: 308618 - protein, 20 aa, Mycobacterium
GGAMPLIARAIRVDPAVFSN

SEQ ID NO: 308619 - protein, 18 aa, Mycobacterium
GGAMVVAYLAYLTFLLFT

SEQ ID NO: 308620 - protein, 19 aa, Mycobacterium
GGAPGCWQQITHDFWPAPE

SEQ ID NO: 308621 - protein, 19 aa, Mycobacterium
GGAPGEVLLVGSSEHTTVI

SEQ ID NO: 308622 - protein, 25 aa, Mycobacterium
GGAPRRNVWPWVNWGLALATVPAAA

SEQ ID NO: 308623 - protein, 18 aa, Mycobacterium
GGAPRVAPVVARLYSGQF

SEQ ID NO: 308624 - protein, 28 aa, Mycobacterium
GGAPVAIATPAYWGPAALGALRGALRNK

SEQ ID NO: 308625 - protein, 17 aa, Mycobacterium
GGARAFAHLGVLDELEA

SEQ ID NO: 308626 - protein, 17 aa, Mycobacterium
GGARFFVNLSVAAFRRS

SEQ ID NO: 308627 - protein, 17 aa, Mycobacterium
GGARIPVVTQRLSEEFR

SEQ ID NO: 308628 - protein, 17 aa, Mycobacterium
GGARKGTMTTIRIFGLS

SEQ ID NO: 308629 - protein, 23 aa, Mycobacterium
GGARPSGGVARVQLRAVGAGFRA

SEQ ID NO: 308630 - protein, 19 aa, Mycobacterium
GGARWRWAAATTVIAVLVS

SEQ ID NO: 308631 - protein, 29 aa, Mycobacterium
GGASIPLLTARLAERFQVPVHTAPQPAVS

SEQ ID NO: 308632 - protein, 18 aa, Mycobacterium
GGATGRRWQFFDFASVAA

SEQ ID NO: 308633 - protein, 24 aa, Mycobacterium
GGATLLLLFWLRRRVPHPERYEHD

SEQ ID NO: 308634 - protein, 20 aa, Mycobacterium
GGAVAFSLVRRSVRAKPQDP

SEQ ID NO: 308635 - protein, 18 aa, Mycobacterium
GGAVSFTTLRLVYNEAKA

SEQ ID NO: 308636 - protein, 23 aa, Mycobacterium
GGAWLLLHLPERVFIQVVPGLLV

SEQ ID NO: 308637 - protein, 24 aa, Mycobacterium
GGCLPKDIRAFMARAGELGADQAL

SEQ ID NO: 308638 - protein, 26 aa, Mycobacterium
GGDALRDWRSPIAWLSRYRPRLPRLS

SEQ ID NO: 308639 - protein, 21 aa, Mycobacterium
GGDALSGCGVITAPGTPPVPG

SEQ ID NO: 308640 - protein, 17 aa, Mycobacterium
GGDDLPVPVQHAMAVTW

SEQ ID NO: 308641 - protein, 19 aa, Mycobacterium
GGDDLPVPVSHAMAVTWQG

SEQ ID NO: 308642 - protein, 20 aa, Mycobacterium
GGDDTRSWGPPFVADQSAYY

SEQ ID NO: 308643 - protein, 21 aa, Mycobacterium
GGDLARIGMEVDVLKIAGISD

SEQ ID NO: 308644 - protein, 25 aa, Mycobacterium
GGDSVSCGVKRSWALSETNPTLDLA

SEQ ID NO: 308645 - protein, 19 aa, Mycobacterium
GGDVPVWPFVVVAVVIVAG

SEQ ID NO: 308646 - protein, 17 aa, Mycobacterium
GGEGAAIERGVLGDLAS

SEQ ID NO: 308647 - protein, 19 aa, Mycobacterium
GGEITWPPPPVQVSAAPAA

SEQ ID NO: 308648 - protein, 22 aa, Mycobacterium
GGEPRLVAYVVTHSGEQPEIGP

SEQ ID NO: 308649 - protein, 22 aa, Mycobacterium
GGEPRMTLPDAITGNPGDHPCG

SEQ ID NO: 308650 - protein, 26 aa, Mycobacterium
GGEPTVLFCFGFLLLFAIGGGAFALD

SEQ ID NO: 308651 - protein, 21 aa, Mycobacterium
GGEWRITRMSTITSFDLTPQL

SEQ ID NO: 308652 - protein, 23 aa, Mycobacterium
GGFEVIPFLVGIIVAIALIAAYL

SEQ ID NO: 308653 - protein, 52 aa, Mycobacterium
GGFFRMCVLTGKALFRRPFQWREFILQCWFIMRVALLPAILVSVPFTVLLIF

SEQ ID NO: 308654 - protein, 46 aa, Mycobacterium; identical to SEQ ID NO: 11031

SEQ ID NO: 308655 - protein, 26 aa, Mycobacterium
GGFLALRWPRTIVLHRAAVAWGVAVV

SEQ ID NO: 308656 - protein, 26 aa, Mycobacterium
GGFLALRWPRTLAFHVPTVIWGAFVV

SEQ ID NO: 308657 - protein, 20 aa, Mycobacterium
GGFLFAVLWMDLMFDVQVLR

SEQ ID NO: 308658 - protein, 24 aa, Mycobacterium
GGFLQYLGAILFTLGGLAFSFLVP

SEQ ID NO: 308659 - protein, 26 aa, Mycobacterium
GGFPGGRMAIGGGIGGLLIVVVALFL

SEQ ID NO: 308660 - protein, 17 aa, Mycobacterium
GGFPILSVIGFIVMFGG

SEQ ID NO: 308661 - protein, 19 aa, Mycobacterium
GGFRSMYFPGMVAAVQGDT

SEQ ID NO: 308662 - protein, 18 aa, Mycobacterium
GGFSVHRIRGFFASEKRE

SEQ ID NO: 308663 - protein, 29 aa, Mycobacterium
GGFWRDTWRRLHRRPKFIGAALLIAFIVA

SEQ ID NO: 308664 - protein, 27 aa, Mycobacterium
GGGAGRSRAAVKFLLYNLFGGLIMLAA

SEQ ID NO: 308665 - protein, 25 aa, Mycobacterium
GGGALCALTALPHVGAVAGRRDTDL

SEQ ID NO: 308666 - protein, 21 aa, Mycobacterium
GGGARGFAHLGILEELEQAGV

SEQ ID NO: 308667 - protein, 24 aa, Mycobacterium
GGGARSASQITAWVTQTFAPRDVG

SEQ ID NO: 308668 - protein, 25 aa, Mycobacterium
GGGCLPKDIRAFMARAGELGADQAL

SEQ ID NO: 308669 - protein, 26 aa, Mycobacterium
GGGDAWWNKILEQIRASDVFIVALSN

SEQ ID NO: 308670 - protein, 19 aa, Mycobacterium
GGGEGINFPLSVQRATTVA

SEQ ID NO: 308671 - protein, 18 aa, Mycobacterium
GGGFDEFLGRQGTPGMID

SEQ ID NO: 308672 - protein, 25 aa, Mycobacterium
GGGFGRMAIGGGIGGLLIVVVAMFL

SEQ ID NO: 308673 - protein, 18 aa, Mycobacterium
GGGFRFVTSPAYLGELIA

SEQ ID NO: 308674 - protein, 19 aa, Mycobacterium
GGGGLPFGVDVVALGVVAV

SEQ ID NO: 308675 - protein, 22 aa, Mycobacterium
GGGGLTFPRYLAATRPGSHNVV

SEQ ID NO: 308676 - protein, 22 aa, Mycobacterium
GGGGLTFPRYLAATRPGTRNVV

SEQ ID NO: 308677 - protein, 21 aa, Mycobacterium
GGGGWQCQRALTARNNIVIDV

SEQ ID NO: 308678 - protein, 27 aa, Mycobacterium
GGGGWYFWPVWPIMGWGIGVASHAIPI

SEQ ID NO: 308679 - protein, 27 aa, Mycobacterium
GGGHRRTSWRVLLIGLAVIAAYLLLTL

SEQ ID NO: 308680 - protein, 19 aa, Mycobacterium
GGGHYCLGAPLSRLEGDYF

SEQ ID NO: 308681 - protein, 24 aa, Mycobacterium
GGGKPRWLCATAALTAALVGALPW

SEQ ID NO: 308682 - protein, 22 aa, Mycobacterium
GGGKPWYACGYLVATAVISVVA

SEQ ID NO: 308683 - protein, 18 aa, Mycobacterium
GGGLAWQAGYSARPLAYV

SEQ ID NO: 308684 - protein, 21 aa, Mycobacterium
GGGLGGLLIVVLALFLGVDPG

SEQ ID NO: 308685 - protein, 19 aa, Mycobacterium
GGGLGLVLLTAGITPRLYV

SEQ ID NO: 308686 - protein, 24 aa, Mycobacterium
GGGLGTRWVAMNALTFASKGALAL

SEQ ID NO: 308687 - protein, 21 aa, Mycobacterium
GGGLRVAGVVAVGDHVGGQAV

SEQ ID NO: 308688 - protein, 21 aa, Mycobacterium
GGGLTFPRYLAATRPGTHNVV

SEQ ID NO: 308689 - protein, 26 aa, Mycobacterium
GGGLWPKRIHDGIARRLREGGFASLS

SEQ ID NO: 308690 - protein, 19 aa, Mycobacterium
GGGMDRILLVAGLLTMVIG

SEQ ID NO: 308691 - protein, 19 aa, Mycobacterium
GGGMVLRFVDGRWEQTPHL

SEQ ID NO: 308692 - protein, 17 aa, Mycobacterium
GGGPGYFASAFADAGVR

SEQ ID NO: 308693 - protein, 17 aa, Mycobacterium
GGGRIEGVLALQFPISV

SEQ ID NO: 308694 - protein, 18 aa, Mycobacterium
GGGRLRQALLGLPMAHPG

SEQ ID NO: 308695 - protein, 19 aa, Mycobacterium
GGGRLRQPLLGLPMAHPGA

SEQ ID NO: 308696 - protein, 21 aa, Mycobacterium
GGGRRAVPVAVGPRPRETRRE

SEQ ID NO: 308697 - protein, 19 aa, Mycobacterium
GGGSVRARLREMVTAPYRR

SEQ ID NO: 308698 - protein, 18 aa, Mycobacterium
GGGTMVLNLYRWPDDLSP

SEQ ID NO: 308699 - protein, 18 aa, Mycobacterium
GGGYVPALRDEWREPLRA

SEQ ID NO: 308700 - protein, 23 aa, Mycobacterium
GGHAYRTSFAYIWGENSSTETTT

SEQ ID NO: 308701 - protein, 17 aa, Mycobacterium
GGHLVIVDHGKMPPNAT

SEQ ID NO: 308702 - protein, 23 aa, Mycobacterium
GGHPESWPWPTFTVNIVGAFLVG

SEQ ID NO: 308703 - protein, 17 aa, Mycobacterium
GGHVSTWVSSGLLEKAG

SEQ ID NO: 308704 - protein, 18 aa, Mycobacterium
GGHYSWHRGGAAGQLSPR

SEQ ID NO: 308705 - protein, 19 aa, Mycobacterium
GGIAMIVLAVALVFNLPAM

SEQ ID NO: 308706 - protein, 23 aa, Mycobacterium
GGIDPRRCLAVSLDVGTDNEQLL

SEQ ID NO: 308707 - protein, 18 aa, Mycobacterium
GGIEILRRGYNFTDGSDG

SEQ ID NO: 308708 - protein, 18 aa, Mycobacterium
GGIFGERTELVFAGLAGS

SEQ ID NO: 308709 - protein, 19 aa, Mycobacterium
GGIFGERTELVFAGLAGSL

SEQ ID NO: 308710 - protein, 17 aa, Mycobacterium
GGIGLVFFLGFGILALG

SEQ ID NO: 308711 - protein, 17 aa, Mycobacterium
GGIGLVFYIGFGILLLG

SEQ ID NO: 308712 - protein, 19 aa, Mycobacterium
GGIIERPERLVIVLIGAGL

SEQ ID NO: 308713 - protein, 18 aa, Mycobacterium
GGILGVMYSIPLRRALVT

SEQ ID NO: 308714 - protein, 22 aa, Mycobacterium
GGILIVWDRLFGSYAEEDEPVR

SEQ ID NO: 308715 - protein, 17 aa, Mycobacterium
GGIRAGMLAARRLQNTL

SEQ ID NO: 308716 - protein, 22 aa, Mycobacterium
GGIRLAGRSGALSRAARIQLIT

SEQ ID NO: 308717 - protein, 22 aa, Mycobacterium
GGIRLSGRTGALSRSARVQLVS

SEQ ID NO: 308718 - protein, 24 aa, Mycobacterium
GGIRRRPRRPKPRPAPPVEADVDE

SEQ ID NO: 308719 - protein, 24 aa, Mycobacterium
GGISGRIFGRFDLAVAVFFALSGF

SEQ ID NO: 308720 - protein, 17 aa, Mycobacterium
GGISRILGHDAGFGPGV

SEQ ID NO: 308721 - protein, 18 aa, Mycobacterium
GGISTFLFPILGVVLGVL

SEQ ID NO: 308722 - protein, 17 aa, Mycobacterium
GGIWLNMIAIVIISVAS

SEQ ID NO: 308723 - protein, 25 aa, Mycobacterium
GGKEIWEFVTRIFPTAVRPRVRRAG

SEQ ID NO: 308724 - protein, 20 aa, Mycobacterium
GGKILRTALNPSLKLSPITE

SEQ ID NO: 308725 - protein, 22 aa, Mycobacterium
GGKPQCVYCGSSDGPFHIDHVV

SEQ ID NO: 308726 - protein, 23 aa, Mycobacterium
GGKTAYCGPPRSIGQEMGTTDWA

SEQ ID NO: 308727 - protein, 24 aa, Mycobacterium
GGKVEDWLGYFLLYASFSLGAVAG

SEQ ID NO: 308728 - protein, 25 aa, Mycobacterium
GGLAAGWRLAEYAMIATTPTHTAAT

SEQ ID NO: 308729 - protein, 44 aa, Mycobacterium
GGLADRFGLVRVMLCGAIFQVLWAYPYFWLLDTRGIPALYVAVV

SEQ ID NO: 308730 - protein, 29 aa, Mycobacterium
GGLAFTVFCLIGFPFLIAAVLWGIVDAIM

SEQ ID NO: 308731 - protein, 19 aa, Mycobacterium
GGLAFVYFLAMSTVALAIG

SEQ ID NO: 308732 - protein, 18 aa, Mycobacterium
GGLANLTAHGGFFPKGVG

SEQ ID NO: 308733 - protein, 22 aa, Mycobacterium
GGLARKMPYTAVFFGIAALGAS

SEQ ID NO: 308734 - protein, 26 aa, Mycobacterium
GGLARRFALSPIPVYLLAGLSLGKGG

SEQ ID NO: 308735 - protein, 27 aa, Mycobacterium
GGLFAQFGLWRWAFAAMAVMSGLMAVL

SEQ ID NO: 308736 - protein, 26 aa, Mycobacterium
GGLFAQLGIWRWAFVTMAVLTVLMAL

SEQ ID NO: 308737 - protein, 21 aa, Mycobacterium
GGLFGEVMGPPAAPADPAPTS

SEQ ID NO: 308738 - protein, 18 aa, Mycobacterium
GGLFPYGLLPLVVVTSGV

SEQ ID NO: 308739 - protein, 30 aa, Mycobacterium
GGLFTDHLGWRWAFYINLPISVVVIMVAAG

SEQ ID NO: 308740 - protein, 20 aa, Mycobacterium
GGLGALGLVTAEWLADRGAR

SEQ ID NO: 308741 - protein, 20 aa, Mycobacterium
GGLGDFAIVQGYQRFNWQVT

SEQ ID NO: 308742 - protein, 29 aa, Mycobacterium
GGLGGARWDNLWLPLAVVGAGLVVLMAHG

SEQ ID NO: 308743 - protein, 19 aa, Mycobacterium
GGLGLLILVGALLLGVDPG

SEQ ID NO: 308744 - protein, 19 aa, Mycobacterium
GGLGQNFAGGKIFYSPETG

SEQ ID NO: 308745 - protein, 19 aa, Mycobacterium
GGLIAFIFLLARTGMSKFT

SEQ ID NO: 308746 - protein, 24 aa, Mycobacterium
GGLIELRNPFSLANWTLPVLEVTM

SEQ ID NO: 308747 - protein, 24 aa, Mycobacterium
GGLKESLLPPGFSDPMQWGFMQAG

SEQ ID NO: 308748 - protein, 18 aa, Mycobacterium
GGLKESLLPPGFSDPTQW

SEQ ID NO: 308749 - protein, 22 aa, Mycobacterium
GGLKPVDISGVWAVKTVYDAVS

SEQ ID NO: 308750 - protein, 17 aa, Mycobacterium
GGLKVTFLALAVPILLI

SEQ ID NO: 308751 - protein, 22 aa, Mycobacterium
GGLLAARFINWSARRITRRIDA

SEQ ID NO: 308752 - protein, 26 aa, Mycobacterium
GGLLGWCWRGGAAPRPPVSDFPQNCL

SEQ ID NO: 308753 - protein, 19 aa, Mycobacterium
GGLLLAAVLIVWRRDLLAI

SEQ ID NO: 308754 - protein, 25 aa, Mycobacterium
GGLLQTEFNVMLPWTKEVALPRPGE

SEQ ID NO: 308755 - protein, 20 aa, Mycobacterium
GGLLRHVFVIAAVITAVLSL

SEQ ID NO: 308756 - protein, 18 aa, Mycobacterium
GGLLVFGAIAVWAIVERT

SEQ ID NO: 308757 - protein, 17 aa, Mycobacterium
GGLPLAVGVALADAMLK

SEQ ID NO: 308758 - protein, 19 aa, Mycobacterium
GGLQRFWLSVAQAHVAGVR

SEQ ID NO: 308759 - protein, 17 aa, Mycobacterium
GGLRGLIGYGVLALVVG

SEQ ID NO: 308760 - protein, 32 aa, Mycobacterium
GGLVSNYPGDGWKWWAWLSIGAGCVAVIVAVA

SEQ ID NO: 308761 - protein, 20 aa, Mycobacterium
GGLVWPFVLLPHLGMIRGAA

SEQ ID NO: 308762 - protein, 17 aa, Mycobacterium
GGLYQFSNVTYRGSQIG

SEQ ID NO: 308763 - protein, 18 aa, Mycobacterium
GGLYRFANVTYRGVQIGK

SEQ ID NO: 308764 - protein, 18 aa, Mycobacterium
GGLYRFVRHPMYVGNVIM

SEQ ID NO: 308765 - protein, 23 aa, Mycobacterium
GGLYYGVWKRWRVQLSAHGPRLQ

SEQ ID NO: 308766 - protein, 23 aa, Mycobacterium
GGMASGVAGFWASMRVFAVLAVC

SEQ ID NO: 308767 - protein, 18 aa, Mycobacterium
GGMGEVWRAYDPVTDRVV

SEQ ID NO: 308768 - protein, 19 aa, Mycobacterium
GGMGEVWRAYDTVTDRVVA

SEQ ID NO: 308769 - protein, 25 aa, Mycobacterium
GGMLSSLRSGRVWIMGFAYLGVVYS

SEQ ID NO: 308770 - protein, 23 aa, Mycobacterium
GGMTCASCAARVEKKLNKLDGVT

SEQ ID NO: 308771 - protein, 25 aa, Mycobacterium
GGNGGSVGLFAIFATAGAGGAGGAG

SEQ ID NO: 308772 - protein, 21 aa, Mycobacterium
GGNKEKTGWWDRFVSTYLTDP

SEQ ID NO: 308773 - protein, 23 aa, Mycobacterium
GGNMLPWLLPLLYVLVALSLVAA

SEQ ID NO: 308774 - protein, 18 aa, Mycobacterium
GGNRPRWLGADIGQRQFY

SEQ ID NO: 308775 - protein, 19 aa, Mycobacterium
GGNRRCLGATFALVEMRVV

SEQ ID NO: 308776 - protein, 23 aa, Mycobacterium
GGNSRSSYSYSYEGPELSGGAIA

SEQ ID NO: 308777 - protein, 19 aa, Mycobacterium
GGNTFSGWGTAEHISEFTA

SEQ ID NO: 308778 - protein, 23 aa, Mycobacterium
GGPAMGSALFAYGHFGNVDAGYL

SEQ ID NO: 308779 - protein, 23 aa, Mycobacterium
GGPAMGTALFAYGHFGQVDAGYL

SEQ ID NO: 308780 - protein, 23 aa, Mycobacterium
GGPARVPRRLGIAAQGVLGVYIG

SEQ ID NO: 308781 - protein, 25 aa, Mycobacterium
GGPDHRGRVRIGTVLVSPMETEETD

SEQ ID NO: 308782 - protein, 23 aa, Mycobacterium
GGPERLRQAVIRALSAVVEIFMF

SEQ ID NO: 308783 - protein, 25 aa, Mycobacterium
GGPGSKLPWLIIGGLVILAVVALVA

SEQ ID NO: 308784 - protein, 19 aa, Mycobacterium
GGPGSMVGFDFARTFNTGA

SEQ ID NO: 308785 - protein, 18 aa, Mycobacterium
GGPGYRFANEYPTNQYRL

SEQ ID NO: 308786 - protein, 26 aa, Mycobacterium
GGPILWQHLFWFFGHPEVYIVALPFF

SEQ ID NO: 308787 - protein, 25 aa, Mycobacterium
GGPISRGAIFWGCLYGVGMAVGMWA

SEQ ID NO: 308788 - protein, 22 aa, Mycobacterium
GGPIYGSGLPSDIWKKTMDGAL

SEQ ID NO: 308789 - protein, 21 aa, Mycobacterium
GGPLCDRFGRKAIYTYDLLVY

SEQ ID NO: 308790 - protein, 32 aa, Mycobacterium; identical to SEQ ID NO: 15897

SEQ ID NO: 308791 - protein, 17 aa, Mycobacterium
GGPNASWLDRRLQTDRL

SEQ ID NO: 308792 - protein, 19 aa, Mycobacterium
GGPPMIWSLVIVGVGQLLV

SEQ ID NO: 308793 - protein, 19 aa, Mycobacterium
GGPPPQFANATPWGQPPPR

SEQ ID NO: 308794 - protein, 21 aa, Mycobacterium
GGPRMPMIPGTWGADSASSSG

SEQ ID NO: 308795 - protein, 17 aa, Mycobacterium
GGPRMVTTFVRTPADTV

SEQ ID NO: 308796 - protein, 21 aa, Mycobacterium
GGPRRKGRIISEHEKKITAYH

SEQ ID NO: 308797 - protein, 21 aa, Mycobacterium
GGPRRKGRIISEQEKKITAYH

SEQ ID NO: 308798 - protein, 22 aa, Mycobacterium
GGPRRSLLRQAVRFGAVGVVST

SEQ ID NO: 308799 - protein, 20 aa, Mycobacterium
GGPSPRVWADLVAEAVIVAL

SEQ ID NO: 308800 - protein, 38 aa, Mycobacterium
GGPTFLRWHHTRVGYLKSWRLALGAVWSTYRHTISEYL

SEQ ID NO: 308801 - protein, 17 aa, Mycobacterium
GGPTSWFALYLGPALVV

SEQ ID NO: 308802 - protein, 25 aa, Mycobacterium
GGQAGSIGLGFAIPVDQAKRIADEL

SEQ ID NO: 308803 - protein, 18 aa, Mycobacterium
GGQAHDAWERAAILIHRR

SEQ ID NO: 308804 - protein, 24 aa, Mycobacterium
GGQLTVWLTWPFHAAGALAGFGVT

SEQ ID NO: 308805 - protein, 21 aa, Mycobacterium
GGQMWPFNFLVRLEQPVVQGL

SEQ ID NO: 308806 - protein, 42 aa, Mycobacterium
GGQPRLAVPGVFARLVLLWFLCSALPIGVIGTFIVLRSYGWV

SEQ ID NO: 308807 - protein, 23 aa, Mycobacterium
GGQRGTAGLGLWIVQQIAESMGG

SEQ ID NO: 308808 - protein, 26 aa, Mycobacterium
GGQRKRASVAMELLTGPSLLILDEPT

SEQ ID NO: 308809 - protein, 32 aa, Mycobacterium
GGRAIARVVAVRRLRYGRFTPIAVLAASVAGV

SEQ ID NO: 308810 - protein, 22 aa, Mycobacterium
GGRAMRATWMMAAKGTGGAARS

SEQ ID NO: 308811 - protein, 20 aa, Mycobacterium
GGRAVRWDEIDGLRFHRGSW

SEQ ID NO: 308812 - protein, 26 aa, Mycobacterium
GGRFPELDVPAVLARRPQVVLVDELA

SEQ ID NO: 308813 - protein, 24 aa, Mycobacterium
GGRFPELDVPAVLDRKPQVVLVDE

SEQ ID NO: 308814 - protein, 19 aa, Mycobacterium
GGRGIGLALSRQISRSLGG

SEQ ID NO: 308815 - protein, 28 aa, Mycobacterium
GGRIRRSRRAAPDVAPWERDIDSNAGHD

SEQ ID NO: 308816 - protein, 19 aa, Mycobacterium
GGRLADRFGGNRVTLAVFV

SEQ ID NO: 308817 - protein, 17 aa, Mycobacterium
GGRLMAYYVPAGVEASA

SEQ ID NO: 308818 - protein, 21 aa, Mycobacterium
GGRPQVSAWVRYHTEKRLRRN

SEQ ID NO: 308819 - protein, 19 aa, Mycobacterium
GGRRRRRRGNSDAVTVAEL

SEQ ID NO: 308820 - protein, 26 aa, Mycobacterium
GGRRTDRWGHWLGCATALAAFALGLS

SEQ ID NO: 308821 - protein, 20 aa, Mycobacterium
GGRSGLPVPAFGRGKEYVTL

SEQ ID NO: 308822 - protein, 19 aa, Mycobacterium
GGRTLAAWGNLVADEALYR

SEQ ID NO: 308823 - protein, 17 aa, Mycobacterium
GGRVGHRLHSAVIIAII

SEQ ID NO: 308824 - protein, 19 aa, Mycobacterium
GGRWIRWDDARAAEAYARG

SEQ ID NO: 308825 - protein, 18 aa, Mycobacterium
GGRWLSRVRRLIEPALVV

SEQ ID NO: 308826 - protein, 19 aa, Mycobacterium
GGRYSVYVWALLAMAAARL

SEQ ID NO: 308827 - protein, 21 aa, Mycobacterium
GGRYSVYVWALLAMVAARMGL

SEQ ID NO: 308828 - protein, 17 aa, Mycobacterium
GGSAFFFHTTDGGPTAG

SEQ ID NO: 308829 - protein, 17 aa, Mycobacterium
GGSARHVILGVFACAVG

SEQ ID NO: 308830 - protein, 25 aa, Mycobacterium
GGSFRRWEQMMFLLIAVNVVIIPMA

SEQ ID NO: 308831 - protein, 23 aa, Mycobacterium
GGSGNDWRPVAGIGALTEGVDPS

SEQ ID NO: 308832 - protein, 26 aa, Mycobacterium
GGSGRSRAAVKFLLYNLFGGLIMLAA

SEQ ID NO: 308833 - protein, 19 aa, Mycobacterium
GGSILGAVAIYLAYIAGLT

SEQ ID NO: 308834 - protein, 20 aa, Mycobacterium
GGSLGVFLIALLVLGLTTNN

SEQ ID NO: 308835 - protein, 22 aa, Mycobacterium
GGSLIRLAVLGLVMGPIILGVL

SEQ ID NO: 308836 - protein, 26 aa, Mycobacterium
GGSNPASCQWCQYLVARYHTSNVCSQ

SEQ ID NO: 308837 - protein, 25 aa, Mycobacterium
GGSPNRFGAWLGRPMTSFHLIIAIA

SEQ ID NO: 308838 - protein, 30 aa, Mycobacterium
GGSPVAIAVPSHWGPGTVGALRGALRTVPS

SEQ ID NO: 308839 - protein, 18 aa, Mycobacterium
GGSRFIVSLPHRGPHPDS

SEQ ID NO: 308840 - protein, 21 aa, Mycobacterium
GGSRGSSGFARPWAIPLVTTG

SEQ ID NO: 308841 - protein, 25 aa, Mycobacterium
GGSVSWFGVIVALALIALALTILVL

SEQ ID NO: 308842 - protein, 24 aa, Mycobacterium
GGTAAEWLGYFLLFASFVVGATVG

SEQ ID NO: 308843 - protein, 17 aa, Mycobacterium
GGTAFFLDKCFGTAIGG

SEQ ID NO: 308844 - protein, 22 aa, Mycobacterium
GGTFLLMLFLDFVFHDRDIKWL

SEQ ID NO: 308845 - protein, 27 aa, Mycobacterium
GGTGGRSLLRYSVIAAMCGGALLGAAM

SEQ ID NO: 308846 - protein, 19 aa, Mycobacterium
GGTGIVYRAYDTMMGRGVA

SEQ ID NO: 308847 - protein, 19 aa, Mycobacterium
GGTGPVFSVAFSPDGRRIV

SEQ ID NO: 308848 - protein, 18 aa, Mycobacterium
GGTIKALLLTGGGMAALS

SEQ ID NO: 308849 - protein, 23 aa, Mycobacterium
GGTLGWLAGVWRDVLAAPIDGPE

SEQ ID NO: 308850 - protein, 24 aa, Mycobacterium
GGTLHCGLMDWGCVGQMNLGMALW

SEQ ID NO: 308851 - protein, 18 aa, Mycobacterium
GGTLQRWLEPVVGAHEEA

SEQ ID NO: 308852 - protein, 23 aa, Mycobacterium
GGTLRHWLEPVVGVPEEATHAIP

SEQ ID NO: 308853 - protein, 19 aa, Mycobacterium
GGTMPPWAATANETNTTKR

SEQ ID NO: 308854 - protein, 25 aa, Mycobacterium
GGTSFARWSALLAEHAKTDTVRDLA

SEQ ID NO: 308855 - protein, 26 aa, Mycobacterium
GGTVIAILLVWSRLPAMVRMVPGPLV

SEQ ID NO: 308856 - protein, 17 aa, Mycobacterium
GGVAALVRAKFPNLTAH

SEQ ID NO: 308857 - protein, 20 aa, Mycobacterium
GGVAFLGYHRIIGLSTFATN

SEQ ID NO: 308858 - protein, 20 aa, Mycobacterium
GGVAMMMFGGRFGGQQQMSR

SEQ ID NO: 308859 - protein, 17 aa, Mycobacterium
GGVAPMLVSDATAAVAA

SEQ ID NO: 308860 - protein, 17 aa, Mycobacterium
GGVAPVLVSDATAALAA

SEQ ID NO: 308861 - protein, 24 aa, Mycobacterium
GGVAQYLGAVLFTLGGLAFSFLVP

SEQ ID NO: 308862 - protein, 27 aa, Mycobacterium
GGVASAALWVRRWPTRGQSAAFAAVTT

SEQ ID NO: 308863 - protein, 26 aa, Mycobacterium
GGVFSRRWAKLWLPITAGIYTANGLM

SEQ ID NO: 308864 - protein, 17 aa, Mycobacterium
GGVGAVLSVLGPRDERG

SEQ ID NO: 308865 - protein, 18 aa, Mycobacterium
GGVGLSLGQRQRLGLARV

SEQ ID NO: 308866 - protein, 18 aa, Mycobacterium
GGVGLSLGQRQRLGLVRA

SEQ ID NO: 308867 - protein, 25 aa, Mycobacterium
GGVGQLHWADLLLFGAVIAAAIGYA

SEQ ID NO: 308868 - protein, 17 aa, Mycobacterium
GGVGVWIGLALLIIAQV

SEQ ID NO: 308869 - protein, 18 aa, Mycobacterium
GGVLFALLLFGRWSDAIG

SEQ ID NO: 308870 - protein, 18 aa, Mycobacterium
GGVLGFLTTAWVVRARAL

SEQ ID NO: 308871 - protein, 24 aa, Mycobacterium
GGVLPFVWIAWIALRNFRSGTTAQ

SEQ ID NO: 308872 - protein, 28 aa, Mycobacterium
GGVLSEWDWRAIFWVGVPLGLLGTVWSY

SEQ ID NO: 308873 - protein, 28 aa, Mycobacterium
GGVLSEWDWRAIFWVGVPVGILGTVWSY

SEQ ID NO: 308874 - protein, 29 aa, Mycobacterium
GGVLTQLLVWRWVMYISVLMTMTALAGTL

SEQ ID NO: 308875 - protein, 19 aa, Mycobacterium
GGVLVLSLIGFIAGFGPFY

SEQ ID NO: 308876 - protein, 20 aa, Mycobacterium
GGVRLSRRRPGWAIWLADAG

SEQ ID NO: 308877 - protein, 18 aa, Mycobacterium
GGVSGTWGYRRELRGQWD

SEQ ID NO: 308878 - protein, 25 aa, Mycobacterium
GGVTASLDWVAWRGLGFGSDAQVVI

SEQ ID NO: 308879 - protein, 30 aa, Mycobacterium
GGVTVLAIVLWRWRPFRLVSGVAALAGLAW

SEQ ID NO: 308880 - protein, 25 aa, Mycobacterium
GGVVGGIALLFVVVILVLGFWVPGF

SEQ ID NO: 308881 - protein, 17 aa, Mycobacterium
GGVVLSLSAAIAVALGL

SEQ ID NO: 308882 - protein, 26 aa, Mycobacterium
GGWADIRAPYWIALLLFLAHRVEEKQ

SEQ ID NO: 308883 - protein, 21 aa, Mycobacterium
GGWEPAWVGVRALRNRTLDVD

SEQ ID NO: 308884 - protein, 30 aa, Mycobacterium
GGWLIDRFGWEWIFWINLPIGLITVGLAAV

SEQ ID NO: 308885 - protein, 25 aa, Mycobacterium
GGWLIPLLAIWAYWQVFHVLKQHFG

SEQ ID NO: 308886 - protein, 25 aa, Mycobacterium
GGWLVPLLAIWAYWQVFHVLKQHFG

SEQ ID NO: 308887 - protein, 17 aa, Mycobacterium
GGWQIDIAPMIKSLAPQ

SEQ ID NO: 308888 - protein, 20 aa, Mycobacterium
GGYARPAALLLPRGRSRGNG

SEQ ID NO: 308889 - protein, 19 aa, Mycobacterium
GGYARPAALLLPRGRTRGH

SEQ ID NO: 308890 - protein, 26 aa, Mycobacterium
GGYFKGHDSIPVWGRLALLLMLVMVA

SEQ ID NO: 308891 - protein, 30 aa, Mycobacterium
GGYFTDHLTWRWAFWINVPIGIVVLIVALA

SEQ ID NO: 308892 - protein, 21 aa, Mycobacterium
GGYGFPARLWRTLDAHPPPGV

SEQ ID NO: 308893 - protein, 21 aa, Mycobacterium
GGYVRRHPLASLATVGDQFVL

SEQ ID NO: 308894 - protein, 23 aa, Mycobacterium
GHADAGLSHALAMTSIGLVIGLL

SEQ ID NO: 308895 - protein, 25 aa, Mycobacterium
GHARLIFSRFGRFWGAFSVGDLFVV

SEQ ID NO: 308896 - protein, 19 aa, Mycobacterium
GHARVLGVIHLKDVVKQGM

SEQ ID NO: 308897 - protein, 23 aa, Mycobacterium
GHASRPGPGRTLGASFAEVAATY

SEQ ID NO: 308898 - protein, 20 aa, Mycobacterium
GHASYWRQLMQLAMRVPLLG

SEQ ID NO: 308899 - protein, 20 aa, Mycobacterium
GHATARRLAIEFIGNIASPG

SEQ ID NO: 308900 - protein, 25 aa, Mycobacterium
GHAVAKRLDCKVVQGYGMSELSPVS

SEQ ID NO: 308901 - protein, 18 aa, Mycobacterium
GHCAAVTISGIRNVIEVD

SEQ ID NO: 308902 - protein, 18 aa, Mycobacterium
GHDKNLFPDWAIAEGPWV

SEQ ID NO: 308903 - protein, 20 aa, Mycobacterium
GHDLDMRTLFPGPAGPADYA

SEQ ID NO: 308904 - protein, 19 aa, Mycobacterium
GHDTWWLVLGKALAIFVFL

SEQ ID NO: 308905 - protein, 23 aa, Mycobacterium
GHEAPYWVCAVYLVLLAVAGLGA

SEQ ID NO: 308906 - protein, 32 aa, Mycobacterium
GHEEQSVWFSWPFRSLAVLCAVAVAIGGLHLV

SEQ ID NO: 308907 - protein, 19 aa, Mycobacterium
GHEFFWRMAAFTVFAVAVI

SEQ ID NO: 308908 - protein, 24 aa, Mycobacterium
GHEGRAAGYISFFVNFGILLASLV

SEQ ID NO: 308909 - protein, 22 aa, Mycobacterium
GHFGEMEFWLALIKVVAILSLI

SEQ ID NO: 308910 - protein, 20 aa, Mycobacterium
GHGDGMPFLSLTSLSAALTG

SEQ ID NO: 308911 - protein, 20 aa, Mycobacterium
GHGFRRYVVVYSDLFEIGGQ

SEQ ID NO: 308912 - protein, 18 aa, Mycobacterium
GHGLAFRGSSSLEMMYPE

SEQ ID NO: 308913 - protein, 20 aa, Mycobacterium
GHGTVDRWVDVPDRLLQRYT

SEQ ID NO: 308914 - protein, 20 aa, Mycobacterium
GHGVWITPASGWTLVDQGPN

SEQ ID NO: 308915 - protein, 24 aa, Mycobacterium
GHIPAAGIMLIFGIDKFMAECRAL

SEQ ID NO: 308916 - protein, 22 aa, Mycobacterium
GHIRIPREWARRGKRRAREAIA

SEQ ID NO: 308917 - protein, 20 aa, Mycobacterium
GHKGLRFGHVEVRIGKPMDF

SEQ ID NO: 308918 - protein, 21 aa, Mycobacterium
GHLRFGRAVQLAGRMSEPADP

SEQ ID NO: 308919 - protein, 31 aa, Mycobacterium
GHLYRRIGTSVVRWPKPIFVASAAVVMVGAV

SEQ ID NO: 308920 - protein, 17 aa, Mycobacterium
GHMGVLFGIPNQILVAL

SEQ ID NO: 308921 - protein, 25 aa, Mycobacterium
GHNLFDVAYAWILAGRRGVRDGVEF

SEQ ID NO: 308922 - protein, 26 aa, Mycobacterium
GHNLWNWPPAFFSWFAAGMVLAELTV

SEQ ID NO: 308923 - protein, 26 aa, Mycobacterium
GHNPWNWPPAFFSWFAAGMVLAELTV

SEQ ID NO: 308924 - protein, 25 aa, Mycobacterium
GHNYGISSVNGWAAIAPPAGWTPQD

SEQ ID NO: 308925 - protein, 24 aa, Mycobacterium
GHPARLVVRCAIAVTVVALATALT

SEQ ID NO: 308926 - protein, 21 aa, Mycobacterium
GHPGPGIGLIVSWIIVMLLTF

SEQ ID NO: 308927 - protein, 26 aa, Mycobacterium
GHPGPGLGLITAWIVVLALIYQWARV

SEQ ID NO: 308928 - protein, 24 aa, Mycobacterium
GHPSLNLLAVQTFPDRAGKIVDVP

SEQ ID NO: 308929 - protein, 21 aa, Mycobacterium
GHPVAAFGRAAARLERVTYRD

SEQ ID NO: 308930 - protein, 29 aa, Mycobacterium
GHPYVFVIGDLMAVPGVPGMAQGAIQGAR

SEQ ID NO: 308931 - protein, 17 aa, Mycobacterium
GHQLWRRVQSAVSVLLG

SEQ ID NO: 308932 - protein, 26 aa, Mycobacterium
GHQQRRFSTGMLVGSGLLGLLVGAVG

SEQ ID NO: 308933 - protein, 22 aa, Mycobacterium
GHRKLLLCGATAFSAVSALTAY

SEQ ID NO: 308934 - protein, 34 aa, Mycobacterium
GHRPYLPHAIRIFAIPIILGWLVITVLVNVLVPS

SEQ ID NO: 308935 - protein, 31 aa, Mycobacterium
GHRWSTRETLHFLWLRLARVWPVYLVTMHLA

SEQ ID NO: 308936 - protein, 18 aa, Mycobacterium
GHSFARFQLNAVATSGRV

SEQ ID NO: 308937 - protein, 24 aa, Mycobacterium
GHSPWYLAWTRLRRNKVALFNGGV

SEQ ID NO: 308938 - protein, 17 aa, Mycobacterium
GHSSLIVPDDFNSPTTL

SEQ ID NO: 308939 - protein, 18 aa, Mycobacterium
GHTALNYVRARQVTTEYN

SEQ ID NO: 308940 - protein, 22 aa, Mycobacterium
GHTLRLGRPGWIDPGSLAPDVA

SEQ ID NO: 308941 - protein, 26 aa, Mycobacterium
GHVFFCSLAGYAFARLDFRGRDALFV

SEQ ID NO: 308942 - protein, 17 aa, Mycobacterium
GHVMGLFIPPRVTKALH

SEQ ID NO: 308943 - protein, 23 aa, Mycobacterium
GHVMPAAFLLAGMITKFAPLNWF

SEQ ID NO: 308944 - protein, 22 aa, Mycobacterium
GHVMPAAFLLAGTIIRLAPLDW

SEQ ID NO: 308945 - protein, 26 aa, Mycobacterium
GHVPGVASGPAWRLIGTTAIGLLLVT

SEQ ID NO: 308946 - protein, 18 aa, Mycobacterium
GHVWIPLAVGTALIVGFV

SEQ ID NO: 308947 - protein, 23 aa, Mycobacterium
GHWSLLVGYGCLPWVATAMLTLR

SEQ ID NO: 308948 - protein, 25 aa, Mycobacterium
GHWSLLVGYGCLPWVAVSMLSLRAG

SEQ ID NO: 308949 - protein, 28 aa, Mycobacterium
GHWSLLVGYGCLPWVAVSVLRLRERASW

SEQ ID NO: 308950 - protein, 21 aa, Mycobacterium
GHYEIRRLIGTGGMGEVYEAY

SEQ ID NO: 308951 - protein, 18 aa, Mycobacterium
GIAAAVTVFGYIKVENLI

SEQ ID NO: 308952 - protein, 25 aa, Mycobacterium
GIAAIPFVVGMGIGLGLSSQLVTRL

SEQ ID NO: 308953 - protein, 20 aa, Mycobacterium
GIAALSAWGLYRFNQHLASL

SEQ ID NO: 308954 - protein, 22 aa, Mycobacterium
GIAAMCLIFIIMLIVTRSFIAA

SEQ ID NO: 308955 - protein, 23 aa, Mycobacterium
GIACAAFVVVLMRLLRARITAAG

SEQ ID NO: 308956 - protein, 24 aa, Mycobacterium
GIACFAVGTGQPWPNGVVVAAIFS

SEQ ID NO: 308957 - protein, 19 aa, Mycobacterium
GIAEFPVVVAALFGLTIAM

SEQ ID NO: 308958 - protein, 18 aa, Mycobacterium
GIAGFARISNRWVTCANQ

SEQ ID NO: 308959 - protein, 25 aa, Mycobacterium
GIAGFWKSILIFGLLVAADITRTLL

SEQ ID NO: 308960 - protein, 19 aa, Mycobacterium
GIAGIAVAVFAGRVTAVLG

SEQ ID NO: 308961 - protein, 23 aa, Mycobacterium
GIAGLSWLCKIAFGKYVVAQSGG

SEQ ID NO: 308962 - protein, 25 aa, Mycobacterium
GIAKRADNPISFWEFTRKGIVVTTM

SEQ ID NO: 308963 - protein, 19 aa, Mycobacterium
GIAMFGPWGIVIGPVLMIL

SEQ ID NO: 308964 - protein, 26 aa, Mycobacterium
GIARLRPRFASMVGLSEVMFAVLAAW

SEQ ID NO: 308965 - protein, 31 aa, Mycobacterium
GIARRAGTPISFWEFTRKGILVTTISLAVAA

SEQ ID NO: 308966 - protein, 25 aa, Mycobacterium
GIARRAGTPISFWEFTRKGIVVTTI

SEQ ID NO: 308967 - protein, 17 aa, Mycobacterium
GIASLAVQCRRDALDSA

SEQ ID NO: 308968 - protein, 23 aa, Mycobacterium
GIASVRINYPLSRVVVDIDAATS

SEQ ID NO: 308969 - protein, 24 aa, Mycobacterium
GIAVADLIPARFVLANSAEVGVPR

SEQ ID NO: 308970 - protein, 32 aa, Mycobacterium
GIAVPAHFLAGLNWPTAFLVGAILSPTDPVFA

SEQ ID NO: 308971 - protein, 27 aa, Mycobacterium
GIAVVIGCTTWLPFLVRAARSPISNTG

SEQ ID NO: 308972 - protein, 23 aa, Mycobacterium
GIAWPHLSAWAMSSVDDPAEGPA

SEQ ID NO: 308973 - protein, 20 aa, Mycobacterium
GICAVCAVPLAVGWRRASTH

SEQ ID NO: 308974 - protein, 17 aa, Mycobacterium
GIDDKWLPGPALPAPTR

SEQ ID NO: 308975 - protein, 24 aa, Mycobacterium
GIDDRLKKFGAMAAAMVLYVLISQ

SEQ ID NO: 308976 - protein, 17 aa, Mycobacterium
GIDEWRAEVLPDDKLEV

SEQ ID NO: 308977 - protein, 19 aa, Mycobacterium
GIDITHGFVVPRVLATAVA

SEQ ID NO: 308978 - protein, 34 aa, Mycobacterium
GIDMAEFYWARQRAKRMVLMWVIAVLTVTGLTAA

SEQ ID NO: 308979 - protein, 26 aa, Mycobacterium
GIDMGLRSGGPIAIIFSLVCIGLAAF

SEQ ID NO: 308980 - protein, 20 aa, Mycobacterium
GIDRCDRVVFLARDGHLAFT

SEQ ID NO: 308981 - protein, 21 aa, Mycobacterium
GIEGYNFLDLLGLGPATGLIS

SEQ ID NO: 308982 - protein, 23 aa, Mycobacterium
GIELHWLTLPIAFIVLVGVGCDY

SEQ ID NO: 308983 - protein, 17 aa, Mycobacterium
GIERLTRIYPTWPQMMP

SEQ ID NO: 308984 - protein, 18 aa, Mycobacterium
GIESRFTGTISYFDGPER

SEQ ID NO: 308985 - protein, 20 aa, Mycobacterium
GIESWKAAVLALTLVLFLVG

SEQ ID NO: 308986 - protein, 18 aa, Mycobacterium
GIFLGHRARKQIRQTGEQ

SEQ ID NO: 308987 - protein, 23 aa, Mycobacterium
GIFLMRAGYRLARTFLTGGAVGS

SEQ ID NO: 308988 - protein, 19 aa, Mycobacterium
GIGAAIWGAWQRRRGKLGW

SEQ ID NO: 308989 - protein, 29 aa, Mycobacterium
GIGEAARGPSRLGRGWLAGIASTLVLLAA

SEQ ID NO: 308990 - protein, 17 aa, Mycobacterium
GIGGPWSLAEGRNVAGS

SEQ ID NO: 308991 - protein, 26 aa, Mycobacterium
GIGIAPEFADKVFVIFQRLHGRDAYT

SEQ ID NO: 308992 - protein, 20 aa, Mycobacterium
GIGIAWPHLTVRAMDCVDDP

SEQ ID NO: 308993 - protein, 23 aa, Mycobacterium
GIGLAVLVAGLWAGFLWGANGQL

SEQ ID NO: 308994 - protein, 17 aa, Mycobacterium
GIGLGVIVAGARLLTQG

SEQ ID NO: 308995 - protein, 25 aa, Mycobacterium
GIGLLFACLVLRGLATVRVPWGNMY

SEQ ID NO: 308996 - protein, 17 aa, Mycobacterium
GIGLWVYDGKEGNTVVR

SEQ ID NO: 308997 - protein, 17 aa, Mycobacterium
GIGMAWGTNAGYAINPA

SEQ ID NO: 308998 - protein, 20 aa, Mycobacterium
GIGQSIVWASSLSFLGLGVA

SEQ ID NO: 308999 - protein, 23 aa, Mycobacterium
GIGRFTGVAGWWSEPIVFEKAVL

SEQ ID NO: 309000 - protein, 22 aa, Mycobacterium
GIGSVSRFLVDRAVARRTARAF

SEQ ID NO: 309001 - protein, 18 aa, Mycobacterium
GIGTLHFLAPKPFDSIVP

SEQ ID NO: 309002 - protein, 35 aa, Mycobacterium
GIGVVVFQWGLGHEIAWPVPLLAFIILVAVGADYN

SEQ ID NO: 309003 - protein, 23 aa, Mycobacterium
GIGWLMDRFGLHRIVAIGMGCAG

SEQ ID NO: 309004 - protein, 26 aa, Mycobacterium
GIGYWRRSGLTAARFMACPFGEPGSR

SEQ ID NO: 309005 - protein, 18 aa, Mycobacterium
GIHGFWMAIATFAVLAVI

SEQ ID NO: 309006 - protein, 24 aa, Mycobacterium
GIHPGLGFFAGWAMLLDYLLIPTL

SEQ ID NO: 309007 - protein, 18 aa, Mycobacterium
GIHSAEVFIGVFIGAVTF

SEQ ID NO: 309008 - protein, 19 aa, Mycobacterium
GIHSAEVFIGVFIGAVTFT

SEQ ID NO: 309009 - protein, 21 aa, Mycobacterium
GIIALCGMALWKPEDLTSTRD

SEQ ID NO: 309010 - protein, 19 aa, Mycobacterium
GIIERPERLIIVLAGAGVS

SEQ ID NO: 309011 - protein, 26 aa, Mycobacterium
GIIKGIPATILWRLSRALPEDVKAQL

SEQ ID NO: 309012 - protein, 17 aa, Mycobacterium
GIILGGLITLVFTAANV

SEQ ID NO: 309013 - protein, 23 aa, Mycobacterium
GIINECHRLCVAYAKTRTLWGKN

SEQ ID NO: 309014 - protein, 24 aa, Mycobacterium
GIINPREAVVALDRAVARNRPRLP

SEQ ID NO: 309015 - protein, 22 aa, Mycobacterium
GIIYAVLWLYGLVIDPHSSANF

SEQ ID NO: 309016 - protein, 26 aa, Mycobacterium
GILAAFMVIVAWPWLEQHFTGDDAAH

SEQ ID NO: 309017 - protein, 17 aa, Mycobacterium
GILAFEFNMGVTRHSSW

SEQ ID NO: 309018 - protein, 19 aa, Mycobacterium
GILAPLAGWLVDRVRPSIL

SEQ ID NO: 309019 - protein, 19 aa, Mycobacterium
GILAVRWQLPSGVEIDTGF

SEQ ID NO: 309020 - protein, 21 aa, Mycobacterium
GILEGLRFVWNNKVLRTLAFV

SEQ ID NO: 309021 - protein, 24 aa, Mycobacterium
GILEGPSWGWGRRRTLLLLIAGAI

SEQ ID NO: 309022 - protein, 21 aa, Mycobacterium
GILGMILAVFGFFGIGPIVSA

SEQ ID NO: 309023 - protein, 19 aa, Mycobacterium
GILLGPLVGLALMAIDFRV

SEQ ID NO: 309024 - protein, 17 aa, Mycobacterium
GILLRIGQPDLLGRIES

SEQ ID NO: 309025 - protein, 23 aa, Mycobacterium
GILPAIALLLALRREVWIRYAAA

SEQ ID NO: 309026 - protein, 25 aa, Mycobacterium
GILPPRLFRNQVFAVCSVLSLMVGF

SEQ ID NO: 309027 - protein, 19 aa, Mycobacterium
GILRLDIGGGQAIDLNILV

SEQ ID NO: 309028 - protein, 23 aa, Mycobacterium
GILSALPATFAFTGDLTVEVGRA

SEQ ID NO: 309029 - protein, 25 aa, Mycobacterium
GILVWPRVRFANGRHRAFFTASIVY

SEQ ID NO: 309030 - protein, 17 aa, Mycobacterium
GIMALITLIRRGGGVRG

SEQ ID NO: 309031 - protein, 18 aa, Mycobacterium
GIMGRTMVVWALGSGVPI

SEQ ID NO: 309032 - protein, 21 aa, Mycobacterium
GIMLFASRFVFTFVNRHPTVK

SEQ ID NO: 309033 - protein, 20 aa, Mycobacterium
GIMVAWRWAPAKVAAVPGPL

SEQ ID NO: 309034 - protein, 27 aa, Mycobacterium
GINIVKRPGAHLAVSLVVLVILATCGA

SEQ ID NO: 309035 - protein, 24 aa, Mycobacterium
GINPVQRLLVPRVLALCLNGLLLN

SEQ ID NO: 309036 - protein, 18 aa, Mycobacterium
GINTMWITSVAFGLSILA

SEQ ID NO: 309037 - protein, 17 aa, Mycobacterium
GIPAFWAWSHLNGPLAH

SEQ ID NO: 309038 - protein, 26 aa, Mycobacterium
GIPALLRIPEVYVWVVVAIAATAWEQ

SEQ ID NO: 309039 - protein, 24 aa, Mycobacterium
GIPEEFTGKVFIIFQRLHGRDTYG

SEQ ID NO: 309040 - protein, 21 aa, Mycobacterium
GIPFANAWYPAARRGFATGVF

SEQ ID NO: 309041 - protein, 23 aa, Mycobacterium
GIPIPRILALGLLMGVLSNVIPY

SEQ ID NO: 309042 - protein, 18 aa, Mycobacterium
GIPMTSIMAEMFGKQEGC

SEQ ID NO: 309043 - protein, 24 aa, Mycobacterium
GIQSARLALPRVKDALARLQSLSK

SEQ ID NO: 309044 - protein, 20 aa, Mycobacterium
GIQWLSNINMVLAISLAFFV

SEQ ID NO: 309045 - protein, 25 aa, Mycobacterium
GIRARMRDRICKRGKTASQRVKPAL

SEQ ID NO: 309046 - protein, 24 aa, Mycobacterium
GIRDFPVVVALLFAIVVALPLGIW

SEQ ID NO: 309047 - protein, 24 aa, Mycobacterium
GIRLTEPIPLRWAKGARLHAEIVG

SEQ ID NO: 309048 - protein, 21 aa, Mycobacterium
GIRLTGRSGALSRSARIQLVS

SEQ ID NO: 309049 - protein, 32 aa, Mycobacterium
GIRRMSPMMLMFPLMFLMAAGGMMAGHGNSGG

SEQ ID NO: 309050 - protein, 17 aa, Mycobacterium
GISAAHWLGTDLQGCDY

SEQ ID NO: 309051 - protein, 22 aa, Mycobacterium
GISALCLIFIIMLIITRSVVAA

SEQ ID NO: 309052 - protein, 18 aa, Mycobacterium
GISALCLIFIIMLLITRS

SEQ ID NO: 309053 - protein, 22 aa, Mycobacterium
GISAMCLIFIIVLILTRALIAA

SEQ ID NO: 309054 - protein, 23 aa, Mycobacterium
GISGVAVGRWRVDRNAPPAPTHD

SEQ ID NO: 309055 - protein, 18 aa, Mycobacterium
GISLPIALGLLIMMYPVL

SEQ ID NO: 309056 - protein, 20 aa, Mycobacterium
GISLPIALGLLIMMYPVLAK

SEQ ID NO: 309057 - protein, 27 aa, Mycobacterium
GISLWRLLIGLCLAAVIGVPAGLLLGV

SEQ ID NO: 309058 - protein, 25 aa, Mycobacterium
GISQSRWLRWPARVYTDVFRGLPEV

SEQ ID NO: 309059 - protein, 23 aa, Mycobacterium
GISSIPSVIGFLVAAVVFVYLMR

SEQ ID NO: 309060 - protein, 24 aa, Mycobacterium
GISTRFVSYQVWFIAGFLAGLAGV

SEQ ID NO: 309061 - protein, 23 aa, Mycobacterium
GITAVLALLAWRAIGGAQDRLGG

SEQ ID NO: 309062 - protein, 26 aa, Mycobacterium
GITDPEFGKDLGFYAFDLPFYRLVLT

SEQ ID NO: 309063 - protein, 18 aa, Mycobacterium
GITMGIPVVGTWMHWALF

SEQ ID NO: 309064 - protein, 20 aa, Mycobacterium
GITNGWWVYLAAYAFFIGIH

SEQ ID NO: 309065 - protein, 19 aa, Mycobacterium
GITRPLGEVPPEFRATFQA

SEQ ID NO: 309066 - protein, 24 aa, Mycobacterium
GITTCVTLALGVLFGLREFTLETM

SEQ ID NO: 309067 - protein, 19 aa, Mycobacterium
GITTMWITAGAFGLSLLAI

SEQ ID NO: 309068 - protein, 20 aa, Mycobacterium
GIVACTELDIGFVAMTLAVI

SEQ ID NO: 309069 - protein, 17 aa, Mycobacterium
GIVFGHLSLSQIKRTGE

SEQ ID NO: 309070 - protein, 30 aa, Mycobacterium
GIVGAALTVLGVWGLHVLTRGDGVAGVLGW

SEQ ID NO: 309071 - protein, 18 aa, Mycobacterium
GIVLAVLGGICAFATSTT

SEQ ID NO: 309072 - protein, 24 aa, Mycobacterium
GIVLLFARPRLRVGPSGVSVRNLL

SEQ ID NO: 309073 - protein, 18 aa, Mycobacterium
GIVLREMLGAVKANRRDI

SEQ ID NO: 309074 - protein, 19 aa, Mycobacterium
GIVLREMLGGLKAKGRSVP

SEQ ID NO: 309075 - protein, 21 aa, Mycobacterium
GIVNMAGFFAALLVMQAMGMI

SEQ ID NO: 309076 - protein, 18 aa, Mycobacterium
GIVPWWFIAALLARDAAL

SEQ ID NO: 309077 - protein, 22 aa, Mycobacterium
GIVQAFGVWWFYAALGSGPISV

SEQ ID NO: 309078 - protein, 23 aa, Mycobacterium
GIVSALHRPVPLSGEGSDTDTVI

SEQ ID NO: 309079 - protein, 18 aa, Mycobacterium
GIVSGILLSIARVIGETA

SEQ ID NO: 309080 - protein, 19 aa, Mycobacterium
GIVSTSPWALRSAERLAPL

SEQ ID NO: 309081 - protein, 23 aa, Mycobacterium
GIVTIPFGIGMMFFGNTIGGIFI

SEQ ID NO: 309082 - protein, 21 aa, Mycobacterium
GIVTRFDYRDALLLDLHGNVV

SEQ ID NO: 309083 - protein, 21 aa, Mycobacterium
GIVTRFDYRDALLLDMQGNVV

SEQ ID NO: 309084 - protein, 17 aa, Mycobacterium
GIVTRFFAPHSHDAGDS

SEQ ID NO: 309085 - protein, 20 aa, Mycobacterium
GIVTRFQYRDALLLDLQGNV

SEQ ID NO: 309086 - protein, 25 aa, Mycobacterium
GIVVAFAVLVVFLLPALRDGAPAVP

SEQ ID NO: 309087 - protein, 19 aa, Mycobacterium
GIVVHLIALAFWRDPQLAE

SEQ ID NO: 309088 - protein, 23 aa, Mycobacterium
GIVWNFTRLGRWAPLGVTVALQG

SEQ ID NO: 309089 - protein, 20 aa, Mycobacterium
GIWEDGWKASALHAPISGKG

SEQ ID NO: 309090 - protein, 39 aa, Mycobacterium
GIWGAIALGAVGAWIACRRRGIPLPAFLDAAAPAVVLAQ

SEQ ID NO: 309091 - protein, 40 aa, Mycobacterium
GIWGAVAFGAVGAWIACRLRGIPLPAFGDAIAPGIILAQG

SEQ ID NO: 309092 - protein, 17 aa, Mycobacterium
GIYAHYLISGLPYYLQS

SEQ ID NO: 309093 - protein, 27 aa, Mycobacterium
GIYGDFFSFYLCDVVLKLNGRGGQPVY

SEQ ID NO: 309094 - protein, 22 aa, Mycobacterium
GIYLAEFIRRSSQRQAWGATVT

SEQ ID NO: 309095 - protein, 25 aa, Mycobacterium
GIYLWHWPIFLALNGERTGWTGFKL

SEQ ID NO: 309096 - protein, 25 aa, Mycobacterium
GIYLWHWPIFLALNGERTGWTGMRL

SEQ ID NO: 309097 - protein, 22 aa, Mycobacterium
GIYMLPMTIGFLVSGPLAGSLS

SEQ ID NO: 309098 - protein, 18 aa, Mycobacterium
GKAAYVQLFLRGAQGTTP

SEQ ID NO: 309099 - protein, 19 aa, Mycobacterium
GKAKIRVYFTLTSGASATD

SEQ ID NO: 309100 - protein, 34 aa, Mycobacterium
GKAKPPGWVDNSGFARGHLFARQLGGGKESENIV

SEQ ID NO: 309101 - protein, 36 aa, Mycobacterium
GKALFTRPFQWKEFVLQSWFLIRVAFLPTLAVSIPL

SEQ ID NO: 309102 - protein, 21 aa, Mycobacterium
GKALKEFRTALRIDPGNASAM

SEQ ID NO: 309103 - protein, 21 aa, Mycobacterium
GKDAFPASFVVKLVDPENHEE

SEQ ID NO: 309104 - protein, 35 aa, Mycobacterium
GKDRQSVRWSVAWRMLLAWCFTLPASGIVGGIAAR

SEQ ID NO: 309105 - protein, 18 aa, Mycobacterium
GKDVRFVGLIDAVRAGEE

SEQ ID NO: 309106 - protein, 18 aa, Mycobacterium
GKEGVAFGLYTTVGRAVS

SEQ ID NO: 309107 - protein, 18 aa, Mycobacterium
GKELARWQSARALGELVG

SEQ ID NO: 309108 - protein, 24 aa, Mycobacterium
GKELHWSLPGLSFILLVAVGADYN

SEQ ID NO: 309109 - protein, 21 aa, Mycobacterium
GKEVLPSYGLPVLTGAIVAAV

SEQ ID NO: 309110 - protein, 19 aa, Mycobacterium
GKEYIGFAVDGAKRMQVLI

SEQ ID NO: 309111 - protein, 19 aa, Mycobacterium
GKFGDLFGRRTVFITCIVI

SEQ ID NO: 309112 - protein, 34 aa, Mycobacterium
GKFKDLLINCGYPLIERFPLMLGTAGGVLLIGLI

SEQ ID NO: 309113 - protein, 18 aa, Mycobacterium
GKFNYTWQGFTLDNWKDP

SEQ ID NO: 309114 - protein, 25 aa, Mycobacterium
GKGAPKRPAVLLGNATLELFVAVAA

SEQ ID NO: 309115 - protein, 19 aa, Mycobacterium
GKGGLLLGLLAPHGLLELT

SEQ ID NO: 309116 - protein, 17 aa, Mycobacterium
GKGGVLLGLLIPHGLLE

SEQ ID NO: 309117 - protein, 17 aa, Mycobacterium
GKGISWLTGDDIVAGAL

SEQ ID NO: 309118 - protein, 23 aa, Mycobacterium
GKGLMTWGALGFGYAEVGTVTAN

SEQ ID NO: 309119 - protein, 20 aa, Mycobacterium
GKGLSALQMVQWDEIGQIAI

SEQ ID NO: 309120 - protein, 17 aa, Mycobacterium
GKHSYTYAFLAASLIAL

SEQ ID NO: 309121 - protein, 36 aa, Mycobacterium
GKIEFAGFFAWLAWLLLHLLYLVGHRNRIAAAYSWG

SEQ ID NO: 309122 - protein, 21 aa, Mycobacterium
GKKFRDAMTYLKARERGAALP

SEQ ID NO: 309123 - protein, 31 aa, Mycobacterium
GKLAAVAAKRGWPILRFTSRSGSSPMAQLRT

SEQ ID NO: 309124 - protein, 18 aa, Mycobacterium
GKLAKVRFVVQNEQRLFG

SEQ ID NO: 309125 - protein, 22 aa, Mycobacterium
GKLAVLVGPIWWAAGHSALAVA

SEQ ID NO: 309126 - protein, 19 aa, Mycobacterium
GKLFIGTLVVWFFVLFDML

SEQ ID NO: 309127 - protein, 20 aa, Mycobacterium
GKLFSMLKFRTMVENADQML

SEQ ID NO: 309128 - protein, 21 aa, Mycobacterium
GKLLGIPGFVFSHFGKVRTHG

SEQ ID NO: 309129 - protein, 20 aa, Mycobacterium
GKLLGLPMGVDVCYTNHAEA

SEQ ID NO: 309130 - protein, 19 aa, Mycobacterium
GKLPGFMGSRGFVLGTAVV

SEQ ID NO: 309131 - protein, 18 aa, Mycobacterium
GKLPWWTVSFSVVATETS

SEQ ID NO: 309132 - protein, 22 aa, Mycobacterium
GKLRAMEGLAHVGSVASALEPE

SEQ ID NO: 309133 - protein, 24 aa, Mycobacterium
GKLSDRYGRRPVFITYSIAFMVLS

SEQ ID NO: 309134 - protein, 23 aa, Mycobacterium
GKLSRAAVQIGTAVILALLAVTL

SEQ ID NO: 309135 - protein, 17 aa, Mycobacterium
GKLSTLLDESFNAFNGA

SEQ ID NO: 309136 - protein, 26 aa, Mycobacterium
GKLVCLNFRRGMTVDQIVAAFRASNP

SEQ ID NO: 309137 - protein, 33 aa, Mycobacterium
GKMAAVAKRRGWPILRFNSRGPVGLRRQLRTLA

SEQ ID NO: 309138 - protein, 18 aa, Mycobacterium
GKMAGDWSRVEIAEPKPP

SEQ ID NO: 309139 - protein, 23 aa, Mycobacterium
GKMHRHWGFGGGPHRCLGSHLAR

SEQ ID NO: 309140 - protein, 18 aa, Mycobacterium
GKNVGVWTVAAVTFANGG

SEQ ID NO: 309141 - protein, 21 aa, Mycobacterium
GKNVIHWRGWTHSYRGTIPKL

SEQ ID NO: 309142 - protein, 20 aa, Mycobacterium
GKPFTMLKFRTMVDGADTQL

SEQ ID NO: 309143 - protein, 24 aa, Mycobacterium
GKPGLELFADVALTCVASAMLGLA

SEQ ID NO: 309144 - protein, 25 aa, Mycobacterium
GKPHVPAKVGNPWPSRKDLRQSSGA

SEQ ID NO: 309145 - protein, 24 aa, Mycobacterium
GKPLISFLVGFSMLAAGVTSAAGL

SEQ ID NO: 309146 - protein, 18 aa, Mycobacterium
GKPLRLAVAVAVLDIFAN

SEQ ID NO: 309147 - protein, 18 aa, Mycobacterium
GKPPARRNRILVAALAAV

SEQ ID NO: 309148 - protein, 23 aa, Mycobacterium
GKPPEIADSIGIPETKGSLGGTE

SEQ ID NO: 309149 - protein, 17 aa, Mycobacterium
GKPPMMGVARWREILKQ

SEQ ID NO: 309150 - protein, 33 aa, Mycobacterium
GKPSPEFEEAWRFSRGEGQSVAIIDTGVKPSAR

SEQ ID NO: 309151 - protein, 28 aa, Mycobacterium
GKPTWHWSNDVLNAWAMSVVFYGALIAV

SEQ ID NO: 309152 - protein, 22 aa, Mycobacterium
GKRAERRLGLLLIAPAALLMLA

SEQ ID NO: 309153 - protein, 24 aa, Mycobacterium
GKRARVKFNVDRSIPLYQSTTAQI

SEQ ID NO: 309154 - protein, 24 aa, Mycobacterium
GKRARVKFNVDRSVPLYQSTTAQI

SEQ ID NO: 309155 - protein, 22 aa, Mycobacterium
GKRELWLHLGWQDIKQRYRRSV

SEQ ID NO: 309156 - protein, 23 aa, Mycobacterium
GKRKGWPTTLFRPHNLPFVMLGA

SEQ ID NO: 309157 - protein, 21 aa, Mycobacterium
GKRKLWYAVSGIIVVISLASI

SEQ ID NO: 309158 - protein, 17 aa, Mycobacterium
GKRPAPKASRHASIIIL

SEQ ID NO: 309159 - protein, 19 aa, Mycobacterium
GKSEFLRTLILSLAATHHP

SEQ ID NO: 309160 - protein, 21 aa, Mycobacterium
GKSEFLRTLILSLVAMTHPDQ

SEQ ID NO: 309161 - protein, 21 aa, Mycobacterium
GKSEFLRTLILSLVATHHPDQ

SEQ ID NO: 309162 - protein, 23 aa, Mycobacterium
GKSEFLRTLTLGMIATHSPDALN

SEQ ID NO: 309163 - protein, 23 aa, Mycobacterium
GKSEFLRTLVLGLITTHSPDALN

SEQ ID NO: 309164 - protein, 25 aa, Mycobacterium
GKSEFLRTLVLGMVCAHPPGLLNLV

SEQ ID NO: 309165 - protein, 21 aa, Mycobacterium
GKSGTGRIVFVSSAHVYRPGQ

SEQ ID NO: 309166 - protein, 24 aa, Mycobacterium
GKSKLPLYLNIAVVVLGLVAYLLN

SEQ ID NO: 309167 - protein, 28 aa, Mycobacterium
GKSKWHWSNDVLNAWAMSVVFYGVLIAV

SEQ ID NO: 309168 - protein, 25 aa, Mycobacterium
GKSLYLRNAVFAEWIEKVDALIQDE

SEQ ID NO: 309169 - protein, 19 aa, Mycobacterium
GKSSLLWISIVATPIVLFA

SEQ ID NO: 309170 - protein, 28 aa, Mycobacterium
GKSTILALLCRFHDPSTGTVRWQGHDVR

SEQ ID NO: 309171 - protein, 18 aa, Mycobacterium
GKSTLAWIMAGLAVPTVG

SEQ ID NO: 309172 - protein, 19 aa, Mycobacterium
GKSTLAWIMAGLTTPTSGT

SEQ ID NO: 309173 - protein, 19 aa, Mycobacterium
GKSTLAWIMAGLTVPTAGV

SEQ ID NO: 309174 - protein, 18 aa, Mycobacterium
GKSTLAWIMAGLTVPTSG

SEQ ID NO: 309175 - protein, 19 aa, Mycobacterium
GKSTLAWIMAGLTVPTYGA

SEQ ID NO: 309176 - protein, 18 aa, Mycobacterium
GKSTLAWVMAGLTVPTTG

SEQ ID NO: 309177 - protein, 18 aa, Mycobacterium
GKSTLVSLICRFYDVADG

SEQ ID NO: 309178 - protein, 19 aa, Mycobacterium
GKSVMKFKVVSEITGQPLG

SEQ ID NO: 309179 - protein, 19 aa, Mycobacterium
GKSVMKFKVVSEVTGQPIG

SEQ ID NO: 309180 - protein, 19 aa, Mycobacterium
GKTALLRTMCREIVRTTTP

SEQ ID NO: 309181 - protein, 24 aa, Mycobacterium
GKTPLPPPRQARRPETVPTTEAPP

SEQ ID NO: 309182 - protein, 19 aa, Mycobacterium
GKTRLANVIAALQDKIKAL

SEQ ID NO: 309183 - protein, 20 aa, Mycobacterium
GKTRLANVVAALQSRLKTLP

SEQ ID NO: 309184 - protein, 18 aa, Mycobacterium
GKTSLEVAKAAGYQLPTT

SEQ ID NO: 309185 - protein, 20 aa, Mycobacterium
GKTYRWTFEQVQGGPPKIAV

SEQ ID NO: 309186 - protein, 17 aa, Mycobacterium
GKVAAAVACEVKDKATA

SEQ ID NO: 309187 - protein, 18 aa, Mycobacterium
GKVAHPTLLVNAVTVSNS

SEQ ID NO: 309188 - protein, 19 aa, Mycobacterium
GKVALYLLITIAPFAVIAP

SEQ ID NO: 309189 - protein, 17 aa, Mycobacterium
GKVERIRLDGRKVLVDF

SEQ ID NO: 309190 - protein, 18 aa, Mycobacterium
GKVLRAALDPAVKLSPIT

SEQ ID NO: 309191 - protein, 18 aa, Mycobacterium
GKVPKAWYPKPYSASPSD

SEQ ID NO: 309192 - protein, 26 aa, Mycobacterium
GKVPPPGSGVVSWLPFYHDMGFFVGI

SEQ ID NO: 309193 - protein, 24 aa, Mycobacterium
GKVRRIQPGVLILVLYFFLWLTTY

SEQ ID NO: 309194 - protein, 17 aa, Mycobacterium
GKVRSRLDVKRSQKQVQ

SEQ ID NO: 309195 - protein, 17 aa, Mycobacterium
GKVYAQVLLPWDLSQRL

SEQ ID NO: 309196 - protein, 20 aa, Mycobacterium
GKYGAPHAMLALMVAMVVSI

SEQ ID NO: 309197 - protein, 22 aa, Mycobacterium
GKYLYEAWADRFAVTARLNNAL

SEQ ID NO: 309198 - protein, 27 aa, Mycobacterium
GKYYFMVELPPDFSAAIASPVTGQPKK

SEQ ID NO: 309199 - protein, 18 aa, Mycobacterium
GLAAGLAVIGWGIRDTAT

SEQ ID NO: 309200 - protein, 24 aa, Mycobacterium
GLAAKDIPLVFGYDYQTVERSLNA

SEQ ID NO: 309201 - protein, 25 aa, Mycobacterium
GLAALGRALSLAWRRSLQLRVVTLT

SEQ ID NO: 309202 - protein, 21 aa, Mycobacterium
GLAAWAVWEFRGARGAIQTTL

SEQ ID NO: 309203 - protein, 17 aa, Mycobacterium
GLACGGVGLLLAGAAAA

SEQ ID NO: 309204 - protein, 25 aa, Mycobacterium
GLADGWWIYLAVYAVFIGIHLSGAG

SEQ ID NO: 309205 - protein, 22 aa, Mycobacterium
GLADICELVIAWFLGNLGFVGG

SEQ ID NO: 309206 - protein, 24 aa, Mycobacterium
GLAEAVSWAGLLVGMYFKYLGSPR

SEQ ID NO: 309207 - protein, 19 aa, Mycobacterium
GLAEILWDVIPFDWANDSN

SEQ ID NO: 309208 - protein, 22 aa, Mycobacterium
GLAERIFIDYLWAFELTGALLI

SEQ ID NO: 309209 - protein, 23 aa, Mycobacterium
GLAERRRGRRGLTAIASVAAALI

SEQ ID NO: 309210 - protein, 23 aa, Mycobacterium
GLAFLLPVAPMWAVHIGADNLGA

SEQ ID NO: 309211 - protein, 22 aa, Mycobacterium
GLAGARWGRRLSPGALRAVIVA

SEQ ID NO: 309212 - protein, 23 aa, Mycobacterium
GLAGELGLNRWAVEDAVAAAERV

SEQ ID NO: 309213 - protein, 21 aa, Mycobacterium
GLAGFCLHATLLGMLAGIDRW

SEQ ID NO: 309214 - protein, 26 aa, Mycobacterium
GLAGFPLFPLPWLLHVAMWLLAVTSL

SEQ ID NO: 309215 - protein, 29 aa, Mycobacterium
GLAGGPWHWDRWAPASPWATPPPAVMALG

SEQ ID NO: 309216 - protein, 26 aa, Mycobacterium
GLAGGPWHWDRWAPASPWATPPPSVM

SEQ ID NO: 309217 - protein, 29 aa, Mycobacterium
GLAGGPWHWDRWAPASPWGTPPPAVMTLG

SEQ ID NO: 309218 - protein, 17 aa, Mycobacterium
GLAGGRGPLYLLTDHGV

SEQ ID NO: 309219 - protein, 19 aa, Mycobacterium
GLAGRRVWDAALVAASPVL

SEQ ID NO: 309220 - protein, 21 aa, Mycobacterium
GLAGTGSRFGAVSAQIAGLGP

SEQ ID NO: 309221 - protein, 18 aa, Mycobacterium
GLAGTVIGVIVPRILGHA

SEQ ID NO: 309222 - protein, 17 aa, Mycobacterium
GLAGVLGATAFTHSAGY

SEQ ID NO: 309223 - protein, 23 aa, Mycobacterium
GLAHGTAGLVLWIALAFLAVGGA

SEQ ID NO: 309224 - protein, 18 aa, Mycobacterium
GLAHPRSNVHFTPTYSSW

SEQ ID NO: 309225 - protein, 19 aa, Mycobacterium
GLAHWLRFGSETETISTYR

SEQ ID NO: 309226 - protein, 19 aa, Mycobacterium
GLAIARRVVLNNYYVSAHE

SEQ ID NO: 309227 - protein, 20 aa, Mycobacterium
GLAIDDFWWTAIWAAIVLSV

SEQ ID NO: 309228 - protein, 22 aa, Mycobacterium
GLAKGLALLVLYGLATVLLAPY

SEQ ID NO: 309229 - protein, 18 aa, Mycobacterium
GLALAYRTRPVFVPNNDN

SEQ ID NO: 309230 - protein, 23 aa, Mycobacterium
GLALAYRTRPVFVPSNDNDPVAR

SEQ ID NO: 309231 - protein, 18 aa, Mycobacterium
GLALAYRTRPVFVPTAGP

SEQ ID NO: 309232 - protein, 26 aa, Mycobacterium
GLALCASFPPWGFWWAAFPALSVLGL

SEQ ID NO: 309233 - protein, 25 aa, Mycobacterium
GLALLGVFLFWPWEYKPFGDPGNAL

SEQ ID NO: 309234 - protein, 19 aa, Mycobacterium
GLALLLVFLFWPWEYQPFG

SEQ ID NO: 309235 - protein, 19 aa, Mycobacterium
GLALMRWSPIDLLPKHREA

SEQ ID NO: 309236 - protein, 20 aa, Mycobacterium
GLALPFLFWVWMRHLHERRG

SEQ ID NO: 309237 - protein, 34 aa, Mycobacterium
GLAMAGISRAVWLRWPARIYTDIFRGLPEVVIIL

SEQ ID NO: 309238 - protein, 24 aa, Mycobacterium
GLAMLIAHAMFKASLFMVVGVIDH

SEQ ID NO: 309239 - protein, 20 aa, Mycobacterium
GLANGLGFLAGAIVGYYLLR

SEQ ID NO: 309240 - protein, 24 aa, Mycobacterium
GLAPLRPGRAVPVAARGAVTTYLL

SEQ ID NO: 309241 - protein, 24 aa, Mycobacterium
GLARVSRSIWLRAIGTTFVDIFRG

SEQ ID NO: 309242 - protein, 20 aa, Mycobacterium
GLARYSDWAFTSAVVALVVA

SEQ ID NO: 309243 - protein, 18 aa, Mycobacterium
GLATCPVTEPLEISETRD

SEQ ID NO: 309244 - protein, 19 aa, Mycobacterium
GLATWQFRRASSWTYRQAR

SEQ ID NO: 309245 - protein, 18 aa, Mycobacterium
GLAVCVFHARTLDAFAFG

SEQ ID NO: 309246 - protein, 20 aa, Mycobacterium
GLAVILSYVWGVRIGGLFTA

SEQ ID NO: 309247 - protein, 35 aa, Mycobacterium
GLAVLLISMWGWRRGERWVWWSLLLGCAFGTVPVL

SEQ ID NO: 309248 - protein, 42 aa, Mycobacterium
GLAVLLISMWGWRRGQRWVWWCLLLGCACATVPVVVVHLAIG

SEQ ID NO: 309249 - protein, 25 aa, Mycobacterium
GLAVLPWLWQVRRLTPAGRRLLAQE

SEQ ID NO: 309250 - protein, 24 aa, Mycobacterium
GLAVPDLPGWLAAVVVYGALLNPT

SEQ ID NO: 309251 - protein, 18 aa, Mycobacterium
GLAVPRPLSALISEAAAH

SEQ ID NO: 309252 - protein, 23 aa, Mycobacterium
GLAVWLLTLYLGWNSLSGLSSLW

SEQ ID NO: 309253 - protein, 17 aa, Mycobacterium
GLAWVLGVTLLLMVVAF

SEQ ID NO: 309254 - protein, 20 aa, Mycobacterium
GLAYRFPFHTEKKTYPYFDP

SEQ ID NO: 309255 - protein, 21 aa, Mycobacterium
GLAYWQFQRFESVTGDGQNLG

SEQ ID NO: 309256 - protein, 19 aa, Mycobacterium
GLCGFAVVVALDAVRTASP

SEQ ID NO: 309257 - protein, 17 aa, Mycobacterium
GLCGVAKGWGWADGVAG

SEQ ID NO: 309258 - protein, 28 aa, Mycobacterium
GLCVDLLGWRWVFVLSAIPMAAGYALTF

SEQ ID NO: 309259 - protein, 26 aa, Mycobacterium
GLDAPRLIPLSGRPRPAPRRASSAER

SEQ ID NO: 309260 - protein, 26 aa, Mycobacterium
GLDDRLKQFGGMAAAMFAYVAISQFG

SEQ ID NO: 309261 - protein, 22 aa, Mycobacterium
GLDFTVGFVDRVIRPDDPRVAA

SEQ ID NO: 309262 - protein, 19 aa, Mycobacterium
GLDGLRPYFTGYLPALLLA

SEQ ID NO: 309263 - protein, 19 aa, Mycobacterium
GLDGLRPYFTGYLPAVVLA

SEQ ID NO: 309264 - protein, 18 aa, Mycobacterium
GLDGLRPYFTGYLPTLFL

SEQ ID NO: 309265 - protein, 19 aa, Mycobacterium
GLDGLRVYFTAYLPSLLLA

SEQ ID NO: 309266 - protein, 20 aa, Mycobacterium
GLDLGRLASGMPREAAIPFS

SEQ ID NO: 309267 - protein, 18 aa, Mycobacterium
GLDLPRNKIWIFDTTRPG

SEQ ID NO: 309268 - protein, 24 aa, Mycobacterium
GLDRLDVGFSLARRTAFEYRAVVL

SEQ ID NO: 309269 - protein, 18 aa, Mycobacterium
GLEAHLSYRVCLKTLSAI

SEQ ID NO: 309270 - protein, 17 aa, Mycobacterium
GLECGIVVMILVAFLVK

SEQ ID NO: 309271 - protein, 19 aa, Mycobacterium
GLEEYALARTRRGLRALLS

SEQ ID NO: 309272 - protein, 18 aa, Mycobacterium
GLEGGNFVRIAGVEVGKV

SEQ ID NO: 309273 - protein, 28 aa, Mycobacterium
GLEIFRSRWARWVAWSLPVVGLVVLFLA

SEQ ID NO: 309274 - protein, 25 aa, Mycobacterium
GLELARIAALSAIFTGLGGVVVGVF

SEQ ID NO: 309275 - protein, 20 aa, Mycobacterium
GLELMLYRLVRSELPQTIVV

SEQ ID NO: 309276 - protein, 20 aa, Mycobacterium
GLELSRSVGLAFAVAASTLC

SEQ ID NO: 309277 - protein, 18 aa, Mycobacterium
GLESTTLIVAGEACPTEL

SEQ ID NO: 309278 - protein, 18 aa, Mycobacterium
GLFAGIAGWSVWVANSPG

SEQ ID NO: 309279 - protein, 27 aa, Mycobacterium
GLFEVFGAAAAVCFLSVSALYVADRRG

SEQ ID NO: 309280 - protein, 17 aa, Mycobacterium
GLFGLGAVVVVRLPGWP

SEQ ID NO: 309281 - protein, 28 aa, Mycobacterium
GLFKRLLRDGRWWLGSGVAAAGFALQAA

SEQ ID NO: 309282 - protein, 23 aa, Mycobacterium
GLFLGAISFVLANIVSVGGVGMI

SEQ ID NO: 309283 - protein, 18 aa, Mycobacterium
GLFLPMGAGKPIRLQGAF

SEQ ID NO: 309284 - protein, 24 aa, Mycobacterium
GLFLVYGICGFFVFLILRALGELV

SEQ ID NO: 309285 - protein, 25 aa, Mycobacterium
GLFMPATLFLMFAMFTTPQLQLYVS

SEQ ID NO: 309286 - protein, 26 aa, Mycobacterium
GLFPVSFYPLLRVTRLVGIAIIAVSL

SEQ ID NO: 309287 - protein, 17 aa, Mycobacterium
GLFRRPAYWLSMVIVLG

SEQ ID NO: 309288 - protein, 25 aa, Mycobacterium
GLFVVSRLAAQHGLVARLRSTVAGQ

SEQ ID NO: 309289 - protein, 17 aa, Mycobacterium
GLFYAFVSWMIMSGNGI

SEQ ID NO: 309290 - protein, 18 aa, Mycobacterium
GLFYGGGIDQLWKQAVAA

SEQ ID NO: 309291 - protein, 34 aa, Mycobacterium
GLGAAALVLIVLAVLFFWVPGWAVTTELDIDKAQ

SEQ ID NO: 309292 - protein, 30 aa, Mycobacterium
GLGAALGLLASWLLSRRIKRQTGGLEVAEI

SEQ ID NO: 309293 - protein, 25 aa, Mycobacterium
GLGAFRPGYDPAILAMLYDFGYLAF

SEQ ID NO: 309294 - protein, 19 aa, Mycobacterium
GLGAHIGRGVWCESYWLPE

SEQ ID NO: 309295 - protein, 18 aa, Mycobacterium
GLGALRVVLASYWPGLLI

SEQ ID NO: 309296 - protein, 22 aa, Mycobacterium
GLGALWCLSGGVLGILDVAGLD

SEQ ID NO: 309297 - protein, 19 aa, Mycobacterium
GLGATAWFIPPAVIMGFVL

SEQ ID NO: 309298 - protein, 20 aa, Mycobacterium
GLGAVCRFLVDRTVSARAPG

SEQ ID NO: 309299 - protein, 19 aa, Mycobacterium
GLGAVVFYLALKYTGEFLL

SEQ ID NO: 309300 - protein, 17 aa, Mycobacterium
GLGCLQVLIALAADFVV

SEQ ID NO: 309301 - protein, 18 aa, Mycobacterium
GLGDLAIRYGARSYDGPV

SEQ ID NO: 309302 - protein, 18 aa, Mycobacterium
GLGELAWAGLILVGIVAA

SEQ ID NO: 309303 - protein, 23 aa, Mycobacterium
GLGGALHKLTGGLLGGGGGGNGG

SEQ ID NO: 309304 - protein, 18 aa, Mycobacterium
GLGGEYGSAVVYVTEHAP

SEQ ID NO: 309305 - protein, 26 aa, Mycobacterium
GLGGPRTPMFLAFPIMLLASSMATSL

SEQ ID NO: 309306 - protein, 24 aa, Mycobacterium
GLGGWASVHIFGFPALDNGTPLFA

SEQ ID NO: 309307 - protein, 19 aa, Mycobacterium
GLGILRDGQKWVALAMPAY

SEQ ID NO: 309308 - protein, 25 aa, Mycobacterium
GLGISRISLNFAMFRSAFEQGAQLG

SEQ ID NO: 309309 - protein, 19 aa, Mycobacterium
GLGLPIARALAHAHGGELV

SEQ ID NO: 309310 - protein, 21 aa, Mycobacterium
GLGLPIARALARAHGGELVCL

SEQ ID NO: 309311 - protein, 18 aa, Mycobacterium
GLGLRLELRLHDPRDSNV

SEQ ID NO: 309312 - protein, 24 aa, Mycobacterium
GLGLRSGGPLAIIFSLVCIGIAAF

SEQ ID NO: 309313 - protein, 25 aa, Mycobacterium
GLGLRSGGPLAILFSLVVIGIAAFS

SEQ ID NO: 309314 - protein, 25 aa, Mycobacterium
GLGLSDYEFGLWAGLAVDNTAETVA

SEQ ID NO: 309315 - protein, 18 aa, Mycobacterium
GLGMAWGSIAGYAINPAR

SEQ ID NO: 309316 - protein, 17 aa, Mycobacterium
GLGPALRTLARRSSVPV

SEQ ID NO: 309317 - protein, 21 aa, Mycobacterium
GLGPLRRVRPAAVIDTQNGLP

SEQ ID NO: 309318 - protein, 34 aa, Mycobacterium
GLGPPIGGMLVDWASWRWVFLVNIPLGVVAVLAT

SEQ ID NO: 309319 - protein, 17 aa, Mycobacterium
GLGPRILVGIDRNPLAT

SEQ ID NO: 309320 - protein, 18 aa, Mycobacterium
GLGQSMIAAGLWMAPGGL

SEQ ID NO: 309321 - protein, 22 aa, Mycobacterium
GLGRAGVTVVHRGATPPHREQY

SEQ ID NO: 309322 - protein, 19 aa, Mycobacterium
GLGRAHRPLLIIALGAVAS

SEQ ID NO: 309323 - protein, 17 aa, Mycobacterium
GLGRAVTFIPWPVIEGF

SEQ ID NO: 309324 - protein, 29 aa, Mycobacterium
GLGRAVTFIPWPVIEGFTLGIAAIIFLQQ

SEQ ID NO: 309325 - protein, 25 aa, Mycobacterium
GLGREHWKSGLGYALAAVLLVASVI

SEQ ID NO: 309326 - protein, 19 aa, Mycobacterium
GLGRIGDWWTQPIVYQKVV

SEQ ID NO: 309327 - protein, 18 aa, Mycobacterium
GLGRLVFNAVAARDYPLI

SEQ ID NO: 309328 - protein, 23 aa, Mycobacterium
GLGRYRLIGLHPRHGGPQTIVTG

SEQ ID NO: 309329 - protein, 20 aa, Mycobacterium
GLGRYRVVAAPSRNGSDIIV

SEQ ID NO: 309330 - protein, 20 aa, Mycobacterium
GLGRYRVVAAPSRNRTDVIV

SEQ ID NO: 309331 - protein, 22 aa, Mycobacterium
GLGSFGIRVVRDLTAAGYDVAV

SEQ ID NO: 309332 - protein, 25 aa, Mycobacterium
GLGSWPEVIGALLLVVVAAAGIARG

SEQ ID NO: 309333 - protein, 20 aa, Mycobacterium
GLGVARLMRFVPRSVMVGFV

SEQ ID NO: 309334 - protein, 18 aa, Mycobacterium
GLGVAVAAACPWLVAAFV

SEQ ID NO: 309335 - protein, 20 aa, Mycobacterium
GLGWKTLRDAGPVVFMNGWY

SEQ ID NO: 309336 - protein, 23 aa, Mycobacterium
GLGYELPLMFALVAPAIAAQSLR

SEQ ID NO: 309337 - protein, 17 aa, Mycobacterium
GLGYPVIIGMHLDNGLA

SEQ ID NO: 309338 - protein, 17 aa, Mycobacterium
GLHGGAWAGLLCLLAGS

SEQ ID NO: 309339 - protein, 20 aa, Mycobacterium
GLHIDDFWWTAIWAAIVLSV

SEQ ID NO: 309340 - protein, 18 aa, Mycobacterium
GLHLSAALPAHQRTIVKF

SEQ ID NO: 309341 - protein, 24 aa, Mycobacterium
GLHLWRGQAMLSILAGTTCYVTLM

SEQ ID NO: 309342 - protein, 18 aa, Mycobacterium
GLHSGCRLISAAASSSAV

SEQ ID NO: 309343 - protein, 24 aa, Mycobacterium
GLHVPLWLGYAISTLMIFPLVMYG

SEQ ID NO: 309344 - protein, 26 aa, Mycobacterium
GLHYDPPFCSVRGIGLQPGDPDHIYA

SEQ ID NO: 309345 - protein, 18 aa, Mycobacterium
GLIAAVGFEVFKQVGSIY

SEQ ID NO: 309346 - protein, 24 aa, Mycobacterium
GLIARLPFALAAGLGINSFLATTV

SEQ ID NO: 309347 - protein, 25 aa, Mycobacterium
GLIARTRLGAWLNRPMTSFHLVVAT

SEQ ID NO: 309348 - protein, 17 aa, Mycobacterium
GLICAIVCSAGYAGWAW

SEQ ID NO: 309349 - protein, 23 aa, Mycobacterium
GLIFAASMCGLLFSSISTVVQGG

SEQ ID NO: 309350 - protein, 19 aa, Mycobacterium
GLIFFGWGVALAVTSVFVA

SEQ ID NO: 309351 - protein, 18 aa, Mycobacterium
GLIGAVWIGSGANAVHFG

SEQ ID NO: 309352 - protein, 23 aa, Mycobacterium
GLIGCFLFSLIRPAGDVGTDSIL

SEQ ID NO: 309353 - protein, 26 aa, Mycobacterium
GLIGGRLYHLATDWRTYFGHGGAGFA

SEQ ID NO: 309354 - protein, 30 aa, Mycobacterium
GLIGGRLYHLATDWRTYWGPGGAGLGAAIR

SEQ ID NO: 309355 - protein, 17 aa, Mycobacterium
GLIGVAFAWGFVFDFVM

SEQ ID NO: 309356 - protein, 28 aa, Mycobacterium
GLIGYAMGFFAIWWAWMNFTWFASAFDT

SEQ ID NO: 309357 - protein, 17 aa, Mycobacterium
GLIIGAVVLVLVVVGAF

SEQ ID NO: 309358 - protein, 24 aa, Mycobacterium
GLIIPMLIGGWFLVRDRVLEIARR

SEQ ID NO: 309359 - protein, 20 aa, Mycobacterium
GLIKMVLAMQHGVLPQTLHV

SEQ ID NO: 309360 - protein, 19 aa, Mycobacterium
GLILPIGFTVVLWVAWVRR

SEQ ID NO: 309361 - protein, 28 aa, Mycobacterium
GLILVCLGIWLLAGRRLGVLMPNSLADN

SEQ ID NO: 309362 - protein, 18 aa, Mycobacterium
GLIPLFIVWFGIGELPKV

SEQ ID NO: 309363 - protein, 20 aa, Mycobacterium
GLIPRFDGAESILLATAMLG

SEQ ID NO: 309364 - protein, 18 aa, Mycobacterium
GLIRGVGQSRGWRAAAPL

SEQ ID NO: 309365 - protein, 27 aa, Mycobacterium
GLIRRLSVPIILGWLGMIAIVTFAVPS

SEQ ID NO: 309366 - protein, 18 aa, Mycobacterium
GLIRVHPLLAIGLNMVAV

SEQ ID NO: 309367 - protein, 17 aa, Mycobacterium
GLISELTTFAAFTALIV

SEQ ID NO: 309368 - protein, 24 aa, Mycobacterium
GLITCWMMLGVPFGIAAVVTGDVA

SEQ ID NO: 309369 - protein, 22 aa, Mycobacterium
GLIVAGVAALLWVFAGADKARA

SEQ ID NO: 309370 - protein, 18 aa, Mycobacterium
GLIVAVGAMFGRNIMFLA

SEQ ID NO: 309371 - protein, 20 aa, Mycobacterium
GLIVSEWIRGGSLAEVADTA

SEQ ID NO: 309372 - protein, 17 aa, Mycobacterium
GLIVVASRTRRHRRQQQ

SEQ ID NO: 309373 - protein, 20 aa, Mycobacterium
GLIYPWGDLVLLALAVGMLP

SEQ ID NO: 309374 - protein, 21 aa, Mycobacterium
GLKPFIRYLMVGIMAILGAAT

SEQ ID NO: 309375 - protein, 25 aa, Mycobacterium
GLKREVAARFGFLLAIPAVLASGLF

SEQ ID NO: 309376 - protein, 25 aa, Mycobacterium
GLKRHLPRQIPIYGLQSPLFTGTPL

SEQ ID NO: 309377 - protein, 20 aa, Mycobacterium
GLLAAIALVVARQIVQPVRS

SEQ ID NO: 309378 - protein, 23 aa, Mycobacterium
GLLAARFISWAAQRVVRRIDAEY

SEQ ID NO: 309379 - protein, 19 aa, Mycobacterium
GLLACSPRVLILDEPLAGL

SEQ ID NO: 309380 - protein, 21 aa, Mycobacterium
GLLADRYGPKRIYATGIALYA

SEQ ID NO: 309381 - protein, 19 aa, Mycobacterium
GLLALLGLGFPDQGDGLHS

SEQ ID NO: 309382 - protein, 19 aa, Mycobacterium
GLLAVRAARRILRRLIVLL

SEQ ID NO: 309383 - protein, 20 aa, Mycobacterium
GLLAWLGHEFPDQGDRLDSS

SEQ ID NO: 309384 - protein, 25 aa, Mycobacterium
GLLCTGIPLLLAMWAFLIRGRRGGK

SEQ ID NO: 309385 - protein, 24 aa, Mycobacterium
GLLCTVVVIPLCAATLGVLGQRWY

SEQ ID NO: 309386 - protein, 22 aa, Mycobacterium
GLLDRLDPLTAVPHATHTLSAR

SEQ ID NO: 309387 - protein, 28 aa, Mycobacterium
GLLDRLKARWPWFDHVMRAQERYNDSKG

SEQ ID NO: 309388 - protein, 26 aa, Mycobacterium
GLLDTSLRWQATVIRMDGRRIDLLEL

SEQ ID NO: 309389 - protein, 19 aa, Mycobacterium
GLLFTWLLVAARTARGSLR

SEQ ID NO: 309390 - protein, 19 aa, Mycobacterium
GLLGALGFAVLSKYLKRRT

SEQ ID NO: 309391 - protein, 20 aa, Mycobacterium
GLLGCVVLAFAMPRWSVLSG

SEQ ID NO: 309392 - protein, 17 aa, Mycobacterium
GLLGLGSALIIAALLLS

SEQ ID NO: 309393 - protein, 26 aa, Mycobacterium
GLLGRASDVAMGLAMHAGLRGAGSAA

SEQ ID NO: 309394 - protein, 18 aa, Mycobacterium
GLLGVALYGLVGVALQGA

SEQ ID NO: 309395 - protein, 18 aa, Mycobacterium
GLLGWGHFEAMRVPQIRR

SEQ ID NO: 309396 - protein, 17 aa, Mycobacterium
GLLGWIAYLAIANRESL

SEQ ID NO: 309397 - protein, 24 aa, Mycobacterium
GLLGWWRWHHNTWLTTIFASVVAV

SEQ ID NO: 309398 - protein, 28 aa, Mycobacterium
GLLHHELEFWWELALLIVIMLLGHWVEM

SEQ ID NO: 309399 - protein, 24 aa, Mycobacterium
GLLHLRLAFNPGVAFSLGDTLPPA

SEQ ID NO: 309400 - protein, 18 aa, Mycobacterium
GLLHRDVKPANILLTDPS

SEQ ID NO: 309401 - protein, 17 aa, Mycobacterium
GLLHRRIPMLLRRLITV

SEQ ID NO: 309402 - protein, 27 aa, Mycobacterium
GLLIAFCLIELRVPNPMMNIRLFRSTA

SEQ ID NO: 309403 - protein, 25 aa, Mycobacterium
GLLIAGGVAARFTRKRVSFAALRQL

SEQ ID NO: 309404 - protein, 18 aa, Mycobacterium
GLLIGVALFILWEAIQRL

SEQ ID NO: 309405 - protein, 20 aa, Mycobacterium
GLLIICVFHVVQAVIGFIVN

SEQ ID NO: 309406 - protein, 18 aa, Mycobacterium
GLLILRVGLGFVLAAHGL

SEQ ID NO: 309407 - protein, 31 aa, Mycobacterium
GLLIRFTGPEVWWLLSVARWASGMPAATVPT

SEQ ID NO: 309408 - protein, 23 aa, Mycobacterium
GLLKASALVYFLGLIAEQRELFQ

SEQ ID NO: 309409 - protein, 26 aa, Mycobacterium
GLLKKSYPLLLRRLVTLVPALLVLAI

SEQ ID NO: 309410 - protein, 23 aa, Mycobacterium
GLLKYRSTIPVAFVLALCGTAVF

SEQ ID NO: 309411 - protein, 18 aa, Mycobacterium
GLLLALVFIAMFGPGVVT

SEQ ID NO: 309412 - protein, 22 aa, Mycobacterium
GLLLCALVPLLPVKQTTATVLW

SEQ ID NO: 309413 - protein, 22 aa, Mycobacterium
GLLLCGQVAYGLYLVPMNYIVQ

SEQ ID NO: 309414 - protein, 20 aa, Mycobacterium
GLLLCLLVPVLPAKQTTATV

SEQ ID NO: 309415 - protein, 27 aa, Mycobacterium
GLLLCVSFPPFGWWYTAIVAFALLAWV

SEQ ID NO: 309416 - protein, 17 aa, Mycobacterium
GLLLLAFPKAFVSVADA

SEQ ID NO: 309417 - protein, 20 aa, Mycobacterium
GLLLLAMVVTVLHFATVFGL

SEQ ID NO: 309418 - protein, 18 aa, Mycobacterium
GLLLLRVAVGALLIGHGL

SEQ ID NO: 309419 - protein, 27 aa, Mycobacterium
GLLLNYFLIAPRHSFTIAEPNSAITEL

SEQ ID NO: 309420 - protein, 19 aa, Mycobacterium
GLLMAFWSWVGFESTAIYG

SEQ ID NO: 309421 - protein, 29 aa, Mycobacterium
GLLNRRAVLKSSYAQFIFLLSGADHDQMD

SEQ ID NO: 309422 - protein, 28 aa, Mycobacterium
GLLNRRAVLKSSYAQFIYLLSGADHDQM

SEQ ID NO: 309423 - protein, 25 aa, Mycobacterium
GLLPAWKVVLILLLLAVLGLRDKVI

SEQ ID NO: 309424 - protein, 25 aa, Mycobacterium
GLLPDYRVVAALPLAYAVIVSGALL

SEQ ID NO: 309425 - protein, 23 aa, Mycobacterium
GLLPGYRSIGIWAQVLLVIIRIG

SEQ ID NO: 309426 - protein, 24 aa, Mycobacterium
GLLPGYSVIGIWAPILLVIARIFQ

SEQ ID NO: 309427 - protein, 17 aa, Mycobacterium
GLLPPIDQWSGSSFSNL

SEQ ID NO: 309428 - protein, 17 aa, Mycobacterium
GLLPRDHICCGNMGLVE

SEQ ID NO: 309429 - protein, 29 aa, Mycobacterium
GLLPRQTPRPALVAVLSLLGFLIALATLF

SEQ ID NO: 309430 - protein, 24 aa, Mycobacterium
GLLRLYLRRDRVVLPLWVLLLSVP

SEQ ID NO: 309431 - protein, 24 aa, Mycobacterium
GLLRNKRWWAGALLLAASIALQAA

SEQ ID NO: 309432 - protein, 19 aa, Mycobacterium
GLLRPEIRVAGGTALSLAL

SEQ ID NO: 309433 - protein, 19 aa, Mycobacterium
GLLRPEIRVTGGTLLALGL

SEQ ID NO: 309434 - protein, 18 aa, Mycobacterium
GLLRRLPLQHAVGSAIAI

SEQ ID NO: 309435 - protein, 21 aa, Mycobacterium
GLLRVSRSVVLRAIGTTYVDI

SEQ ID NO: 309436 - protein, 18 aa, Mycobacterium
GLLSIPNFANPVQFICGG

SEQ ID NO: 309437 - protein, 19 aa, Mycobacterium
GLLSLVMAGFVRWRIRLKG

SEQ ID NO: 309438 - protein, 17 aa, Mycobacterium
GLLSRWAEGSAFNTWGV

SEQ ID NO: 309439 - protein, 32 aa, Mycobacterium
GLLSSMPSWGMVATLVLWGWVLDRVGERIVLT

SEQ ID NO: 309440 - protein, 23 aa, Mycobacterium
GLLTAVLCALAWGLSTLLDPAAA

SEQ ID NO: 309441 - protein, 20 aa, Mycobacterium
GLLTAWLFDRYHTIQLPSYL

SEQ ID NO: 309442 - protein, 19 aa, Mycobacterium
GLLTGCLDIADGKPVSIGT

SEQ ID NO: 309443 - protein, 23 aa, Mycobacterium
GLLTGICSHWWPQLPGNGKSILT

SEQ ID NO: 309444 - protein, 17 aa, Mycobacterium
GLLTGVFLVLVMFLWSA

SEQ ID NO: 309445 - protein, 17 aa, Mycobacterium
GLLTKVGVYAIIRAHSL

SEQ ID NO: 309446 - protein, 18 aa, Mycobacterium
GLLTPGALFAADRTVVVA

SEQ ID NO: 309447 - protein, 21 aa, Mycobacterium
GLLTSFSLRTESILMDPSLDR

SEQ ID NO: 309448 - protein, 17 aa, Mycobacterium
GLLVCVVMPLGAMYSDR

SEQ ID NO: 309449 - protein, 20 aa, Mycobacterium
GLLVGWLGGMLLSGMLTVIV

SEQ ID NO: 309450 - protein, 25 aa, Mycobacterium
GLLVIAILVAWRWAPARVAGIPGPL

SEQ ID NO: 309451 - protein, 20 aa, Mycobacterium
GLLVSWLGGMLLSGILTVVV

SEQ ID NO: 309452 - protein, 20 aa, Mycobacterium
GLLVVLAAVAAWRGDPDADR

SEQ ID NO: 309453 - protein, 17 aa, Mycobacterium
GLLWGALERRWGQWVAL

SEQ ID NO: 309454 - protein, 19 aa, Mycobacterium
GLLYGGGLHQFWLQLVGVV

SEQ ID NO: 309455 - protein, 23 aa, Mycobacterium
GLLYLLCRLIYVIVDEAWVAKNA

SEQ ID NO: 309456 - protein, 30 aa, Mycobacterium
GLLYRRIGASVVRWPVPILAASSAVVMIGA

SEQ ID NO: 309457 - protein, 17 aa, Mycobacterium
GLMALLMRTELAAPGLQ

SEQ ID NO: 309458 - protein, 18 aa, Mycobacterium
GLMGLGFFLALTVRDTTS

SEQ ID NO: 309459 - protein, 17 aa, Mycobacterium
GLMMAGIALCFAGRNVS

SEQ ID NO: 309460 - protein, 19 aa, Mycobacterium
GLMMRRFGLPVLPLIIGVI

SEQ ID NO: 309461 - protein, 19 aa, Mycobacterium
GLMPIVFFLLAAGWFVLVA

SEQ ID NO: 309462 - protein, 23 aa, Mycobacterium
GLMPLKLFPHWIHPFVRNQPITQ

SEQ ID NO: 309463 - protein, 19 aa, Mycobacterium
GLMRKAKELVIATKMSGEW

SEQ ID NO: 309464 - protein, 24 aa, Mycobacterium
GLMSGSLWGLFAVLTKGVVDQLDR

SEQ ID NO: 309465 - protein, 25 aa, Mycobacterium
GLMVIAILVVWRWAPARVAKIPGPL

SEQ ID NO: 309466 - protein, 23 aa, Mycobacterium
GLNGKRPKLRRILSDPDARVIVV

SEQ ID NO: 309467 - protein, 22 aa, Mycobacterium
GLNNFRTFFGFTLNDPVNKRML

SEQ ID NO: 309468 - protein, 25 aa, Mycobacterium
GLNPLNWPPAFFSWFAAGMLLAEWA

SEQ ID NO: 309469 - protein, 21 aa, Mycobacterium
GLNPLRVLIVLAALVLATVVF

SEQ ID NO: 309470 - protein, 20 aa, Mycobacterium
GLNSLMAMAIRREAEQFVGI

SEQ ID NO: 309471 - protein, 18 aa, Mycobacterium
GLNVPVIPASSVLRSHAI

SEQ ID NO: 309472 - protein, 23 aa, Mycobacterium
GLPAFLLLIAVEYYSYFRERREN

SEQ ID NO: 309473 - protein, 24 aa, Mycobacterium
GLPCLPWFIHSNWGYAFGVLPPFW

SEQ ID NO: 309474 - protein, 21 aa, Mycobacterium
GLPGQIWKSTMDNALDGTDNE

SEQ ID NO: 309475 - protein, 22 aa, Mycobacterium
GLPGWGSLRLALPSSGNADAAQ

SEQ ID NO: 309476 - protein, 27 aa, Mycobacterium
GLPISVAQPCPFGWPAPGPDEQGGLAS

SEQ ID NO: 309477 - protein, 19 aa, Mycobacterium
GLPLPLLPLQILFLNLVTD

SEQ ID NO: 309478 - protein, 21 aa, Mycobacterium
GLPLWPYLICAALTGLGGANY

SEQ ID NO: 309479 - protein, 19 aa, Mycobacterium
GLPLWPYLVCAALSGLGGG

SEQ ID NO: 309480 - protein, 19 aa, Mycobacterium
GLPLWPYLVCAALTGLGGG

SEQ ID NO: 309481 - protein, 21 aa, Mycobacterium
GLPMKRAPRFAGESKAYTFKV

SEQ ID NO: 309482 - protein, 19 aa, Mycobacterium
GLPPALWTLILLGTITGLV

SEQ ID NO: 309483 - protein, 24 aa, Mycobacterium
GLPPGTRRRLILGFITGLEGAFVL

SEQ ID NO: 309484 - protein, 20 aa, Mycobacterium
GLPSDIWKKTMDGALDGTAK

SEQ ID NO: 309485 - protein, 22 aa, Mycobacterium
GLPTGLRLVIDNAIANAVKHGN

SEQ ID NO: 309486 - protein, 18 aa, Mycobacterium
GLPVWPFVLAAVVIVGGG

SEQ ID NO: 309487 - protein, 17 aa, Mycobacterium
GLPVYSYLDDRIVHLVR

SEQ ID NO: 309488 - protein, 18 aa, Mycobacterium
GLQARRNLHDLLLAATSR

SEQ ID NO: 309489 - protein, 18 aa, Mycobacterium
GLQMFGFIGIVLGPVLMI

SEQ ID NO: 309490 - protein, 24 aa, Mycobacterium
GLQQRPGYPTPYGGYSGSGQTTGG

SEQ ID NO: 309491 - protein, 36 aa, Mycobacterium
GLQVLCALGALYAGSRASIGFGRDLRSAMFDHVTEL

SEQ ID NO: 309492 - protein, 19 aa, Mycobacterium
GLRAEFLDNIPIVLGLAAG

SEQ ID NO: 309493 - protein, 21 aa, Mycobacterium
GLRGGFGGWSPTSFGGSSSSS

SEQ ID NO: 309494 - protein, 20 aa, Mycobacterium
GLRGGFVGVDVFFVVSGFLI

SEQ ID NO: 309495 - protein, 41 aa, Mycobacterium
GLRGPRARLRWRWVLLGLAVLMCWLSVAVLISRLTDTSELP

SEQ ID NO: 309496 - protein, 22 aa, Mycobacterium
GLRGSYGGVVMIGMLSSVAGLG

SEQ ID NO: 309497 - protein, 17 aa, Mycobacterium
GLRGWRTAIRHEGEAVE

SEQ ID NO: 309498 - protein, 25 aa, Mycobacterium
GLRIPLEALLDFLTLHFAAGFFMLW

SEQ ID NO: 309499 - protein, 28 aa, Mycobacterium
GLRLGGLARTRLGTVPVEERLIELGPDP

SEQ ID NO: 309500 - protein, 41 aa, Mycobacterium
GLRNTFWALVLPFVFGSPYAIFLLREYFRGIPGDLINAARL

SEQ ID NO: 309501 - protein, 22 aa, Mycobacterium
GLRPGEEKLVFNRFWRADPSRK

SEQ ID NO: 309502 - protein, 22 aa, Mycobacterium
GLRPGEEKLVFSRFWRADPSRV

SEQ ID NO: 309503 - protein, 23 aa, Mycobacterium
GLRPGEEKLVFSRFWRADPSRVR

SEQ ID NO: 309504 - protein, 18 aa, Mycobacterium
GLRPGTGLTAVTWLMRVG

SEQ ID NO: 309505 - protein, 27 aa, Mycobacterium
GLRQEFLENWPVVVGLMVGGVIAAPFA

SEQ ID NO: 309506 - protein, 19 aa, Mycobacterium
GLRQWWKVGVAAILAVAAL

SEQ ID NO: 309507 - protein, 25 aa, Mycobacterium
GLRRMKAVALSFLLGATVVFLVCSW

SEQ ID NO: 309508 - protein, 20 aa, Mycobacterium
GLRRMKLVALGFLVGATIVF

SEQ ID NO: 309509 - protein, 23 aa, Mycobacterium
GLRRMKVVALSFLVGATVIFLLC

SEQ ID NO: 309510 - protein, 19 aa, Mycobacterium
GLRRPWRPRTFVRAISQAL

SEQ ID NO: 309511 - protein, 18 aa, Mycobacterium
GLRSLDISRSWRKLYDNG

SEQ ID NO: 309512 - protein, 22 aa, Mycobacterium
GLRSMSFFRTVLFLPQVIATVV

SEQ ID NO: 309513 - protein, 19 aa, Mycobacterium
GLRTLPMVAGMLITSTGTG

SEQ ID NO: 309514 - protein, 19 aa, Mycobacterium
GLRTLPMVVGMLITSTGSG

SEQ ID NO: 309515 - protein, 26 aa, Mycobacterium
GLRTRRWFRRWVPVAVGIGVALAGWA

SEQ ID NO: 309516 - protein, 25 aa, Mycobacterium
GLSALLCPLLVYGWLGLPRLGLAGS

SEQ ID NO: 309517 - protein, 24 aa, Mycobacterium
GLSALLCPLLVYGWLGLPRMELAG

SEQ ID NO: 309518 - protein, 24 aa, Mycobacterium
GLSALLCPLLVYGWLGMPRLGLSG

SEQ ID NO: 309519 - protein, 26 aa, Mycobacterium
GLSARRGLHIVGMFIAVQPLITLVAG

SEQ ID NO: 309520 - protein, 18 aa, Mycobacterium
GLSAWLITRAWQMPPVLD

SEQ ID NO: 309521 - protein, 26 aa, Mycobacterium
GLSGARGIVAFLGFYNVFGLTTFATN

SEQ ID NO: 309522 - protein, 17 aa, Mycobacterium
GLSHPLAQCHIEVQLAK

SEQ ID NO: 309523 - protein, 23 aa, Mycobacterium
GLSIAAAMTVRFVTRQRVAQPSP

SEQ ID NO: 309524 - protein, 27 aa, Mycobacterium
GLSLFMAIAIAVTWMVYATLRRDVAGP

SEQ ID NO: 309525 - protein, 28 aa, Mycobacterium
GLSLFMIVAITLTWLVYVTLRRDVAGEK

SEQ ID NO: 309526 - protein, 24 aa, Mycobacterium
GLSLFYWWFHTIDKTLPVFVVLVY

SEQ ID NO: 309527 - protein, 26 aa, Mycobacterium
GLSLLGWGGFLLMWVLQAAVFWNGME

SEQ ID NO: 309528 - protein, 18 aa, Mycobacterium
GLSPALSTALGWAIFHTL

SEQ ID NO: 309529 - protein, 20 aa, Mycobacterium
GLSRDGLHMVVARPVAEVPA

SEQ ID NO: 309530 - protein, 24 aa, Mycobacterium
GLSRWRGELLILWADLLNLVYYRV

SEQ ID NO: 309531 - protein, 22 aa, Mycobacterium
GLSSLCLIFIIMLLITRGFVAA

SEQ ID NO: 309532 - protein, 19 aa, Mycobacterium
GLSSLRAGLIAGAVGLAAV

SEQ ID NO: 309533 - protein, 18 aa, Mycobacterium
GLSTWVMVIFKPDGSHGM

SEQ ID NO: 309534 - protein, 28 aa, Mycobacterium
GLSVLIWQDLFGIRIHWIVMALSVIILL

SEQ ID NO: 309535 - protein, 20 aa, Mycobacterium
GLSYRFPFDTEKKTYQYFDV

SEQ ID NO: 309536 - protein, 22 aa, Mycobacterium
GLSYRFPFHTEKKTYPYFDPIA

SEQ ID NO: 309537 - protein, 26 aa, Mycobacterium
GLTAGEIFAGYTILRLLGSGGMGEVY

SEQ ID NO: 309538 - protein, 23 aa, Mycobacterium
GLTAHAPLLWLALLFLVIGGIAD

SEQ ID NO: 309539 - protein, 19 aa, Mycobacterium
GLTALKFTQNVGFDADGKL

SEQ ID NO: 309540 - protein, 18 aa, Mycobacterium
GLTARFTGKAVWWAASRQ

SEQ ID NO: 309541 - protein, 23 aa, Mycobacterium
GLTDHEFGLWAGLSVDNTAETTA

SEQ ID NO: 309542 - protein, 23 aa, Mycobacterium
GLTDLPALVKAAAAEVLPDAQLA

SEQ ID NO: 309543 - protein, 17 aa, Mycobacterium
GLTFNDFLIHMAPIVIV

SEQ ID NO: 309544 - protein, 17 aa, Mycobacterium
GLTFNDFLVHLAPIVVI

SEQ ID NO: 309545 - protein, 17 aa, Mycobacterium
GLTGSPVPIPWSVLSLF

SEQ ID NO: 309546 - protein, 18 aa, Mycobacterium
GLTGSVFFIAALVVLFYS

SEQ ID NO: 309547 - protein, 17 aa, Mycobacterium
GLTGVKALAYFQAGTIV

SEQ ID NO: 309548 - protein, 25 aa, Mycobacterium
GLTIAGACLCLRFTTLPYFQSMALP

SEQ ID NO: 309549 - protein, 17 aa, Mycobacterium
GLTRLLGVGLWAQIAGV

SEQ ID NO: 309550 - protein, 25 aa, Mycobacterium
GLTRPQWFLLPSVVLIAVRLGYGYQ

SEQ ID NO: 309551 - protein, 23 aa, Mycobacterium
GLTSLRAGLIAGAIGLALVLLYS

SEQ ID NO: 309552 - protein, 23 aa, Mycobacterium
GLTSLRAGLIAGAIGLVLVLLYS

SEQ ID NO: 309553 - protein, 21 aa, Mycobacterium
GLTSLRAGLIAGGIGLALVLV

SEQ ID NO: 309554 - protein, 23 aa, Mycobacterium
GLTSLRAGLIAGGIGLVLVLLYS

SEQ ID NO: 309555 - protein, 26 aa, Mycobacterium
GLTSRPGPEPDLGFSQPSSRASLWLP

SEQ ID NO: 309556 - protein, 23 aa, Mycobacterium
GLTTYRFTQNIGYNSEGKLVAPV

SEQ ID NO: 309557 - protein, 19 aa, Mycobacterium
GLTTYRFTQNVGYGSDGKL

SEQ ID NO: 309558 - protein, 23 aa, Mycobacterium
GLTTYRFVQNVGYDADGKLADPI

SEQ ID NO: 309559 - protein, 25 aa, Mycobacterium
GLTWTMPVLGVWAIVSLWILPGVHL

SEQ ID NO: 309560 - protein, 20 aa, Mycobacterium
GLTYRFPFDTEKKTYPFFDP

SEQ ID NO: 309561 - protein, 20 aa, Mycobacterium
GLTYRFPFDTEKKTYQVFDP

SEQ ID NO: 309562 - protein, 18 aa, Mycobacterium
GLVACYRGLTIVGGGAKA

SEQ ID NO: 309563 - protein, 25 aa, Mycobacterium
GLVAFCLLALTVVRIVPVLLALLFS

SEQ ID NO: 309564 - protein, 26 aa, Mycobacterium
GLVAGALGGVLAFVWSWIFIEPLINR

SEQ ID NO: 309565 - protein, 18 aa, Mycobacterium
GLVAIFWYGIQTYLASTA

SEQ ID NO: 309566 - protein, 24 aa, Mycobacterium
GLVARELLRLPGVSKIVQVELDPA

SEQ ID NO: 309567 - protein, 24 aa, Mycobacterium
GLVCAIGLAGGYVFSVFLQGVNPG

SEQ ID NO: 309568 - protein, 25 aa, Mycobacterium
GLVCIACAVAWVVLRPLQRYRSYRW

SEQ ID NO: 309569 - protein, 17 aa, Mycobacterium
GLVCLAFLGVYLVSRWV

SEQ ID NO: 309570 - protein, 18 aa, Mycobacterium
GLVCSFSLATLLGSALLT

SEQ ID NO: 309571 - protein, 17 aa, Mycobacterium
GLVDVALYATARLLLAV

SEQ ID NO: 309572 - protein, 19 aa, Mycobacterium
GLVEFRNPFALENWTLPVL

SEQ ID NO: 309573 - protein, 17 aa, Mycobacterium
GLVELWLGVAAERRPLE

SEQ ID NO: 309574 - protein, 19 aa, Mycobacterium
GLVGCFVFSLIRPNGQAGS

SEQ ID NO: 309575 - protein, 19 aa, Mycobacterium
GLVGCFVFSLIRPNGQVGS

SEQ ID NO: 309576 - protein, 24 aa, Mycobacterium
GLVGCFVFSLLRPSGIAGTDPILA

SEQ ID NO: 309577 - protein, 20 aa, Mycobacterium
GLVGCVIVSLALPLSSVAAG

SEQ ID NO: 309578 - protein, 18 aa, Mycobacterium
GLVGCYRGLTAGGGAKGV

SEQ ID NO: 309579 - protein, 25 aa, Mycobacterium
GLVGGVVWNLLTWLLGIPSSSSHAL

SEQ ID NO: 309580 - protein, 33 aa, Mycobacterium
GLVGRSSLAYDMWGAAVDLAYQVQRGMPQPGVY

SEQ ID NO: 309581 - protein, 27 aa, Mycobacterium
GLVGVLALAGLAGWLGYQTYESHQAEE

SEQ ID NO: 309582 - protein, 24 aa, Mycobacterium
GLVIPIMVACGFLLGVAGQVVKLC

SEQ ID NO: 309583 - protein, 20 aa, Mycobacterium
GLVLAVCLAVPLLVPVTDFH

SEQ ID NO: 309584 - protein, 22 aa, Mycobacterium
GLVLCALVPLLPVKQTTATILW

SEQ ID NO: 309585 - protein, 18 aa, Mycobacterium
GLVLLAFPGLMRAGVDAS

SEQ ID NO: 309586 - protein, 24 aa, Mycobacterium
GLVLSVPGSAGFNVALPDNPNEPG

SEQ ID NO: 309587 - protein, 19 aa, Mycobacterium
GLVLYMFIIGLNFDVNHVK

SEQ ID NO: 309588 - protein, 25 aa, Mycobacterium
GLVMIGWWTGFPYWITVAVCAVGGI

SEQ ID NO: 309589 - protein, 28 aa, Mycobacterium
GLVPLRARLCALHAFIGAPQSRAFLLFA

SEQ ID NO: 309590 - protein, 19 aa, Mycobacterium
GLVPMVWLNVLRQFSVGMR

SEQ ID NO: 309591 - protein, 19 aa, Mycobacterium
GLVRDAWPPSARAQPRTHP

SEQ ID NO: 309592 - protein, 23 aa, Mycobacterium
GLVRRRPLLTAAFTVGVLSIAGL

SEQ ID NO: 309593 - protein, 17 aa, Mycobacterium
GLVSLLIHALRGGGHLD

SEQ ID NO: 309594 - protein, 18 aa, Mycobacterium
GLVSLLYAAIVYILIGIS

SEQ ID NO: 309595 - protein, 23 aa, Mycobacterium
GLVTAGSLVVHWATMQELYGITD

SEQ ID NO: 309596 - protein, 17 aa, Mycobacterium
GLVTAMIFWMSRTAANL

SEQ ID NO: 309597 - protein, 24 aa, Mycobacterium
GLVTLELIGMVALTALLLVVAAVR

SEQ ID NO: 309598 - protein, 27 aa, Mycobacterium
GLVTTLPALCFAGAGLAAPWVASRIGL

SEQ ID NO: 309599 - protein, 23 aa, Mycobacterium
GLVTTLRLPPFIVTLGTFTAILA

SEQ ID NO: 309600 - protein, 19 aa, Mycobacterium
GLVVAEWIRGGSLREVAET

SEQ ID NO: 309601 - protein, 21 aa, Mycobacterium
GLVYPWGDLVLLALAAGMLPI

SEQ ID NO: 309602 - protein, 18 aa, Mycobacterium
GLWLAGWGAARLVAEVLQ

SEQ ID NO: 309603 - protein, 24 aa, Mycobacterium
GLWMLFDGAFGWRSVAIGVTAAVA

SEQ ID NO: 309604 - protein, 20 aa, Mycobacterium
GLWPAARRGQLMWLTLILAA

SEQ ID NO: 309605 - protein, 19 aa, Mycobacterium
GLWSILGGLALYMTDALPV

SEQ ID NO: 309606 - protein, 19 aa, Mycobacterium
GLWVTRRGRIPGQRWFAWL

SEQ ID NO: 309607 - protein, 20 aa, Mycobacterium
GLYAQFRGAFIPKTKLTMLA

SEQ ID NO: 309608 - protein, 24 aa, Mycobacterium
GLYKKERRFAMAFVSFGAMLFISG

SEQ ID NO: 309609 - protein, 28 aa, Mycobacterium
GMAAVQLARLWGLEVFATASPGKWDTLR

SEQ ID NO: 309610 - protein, 20 aa, Mycobacterium
GMADRYGRKRMFIVEMVIFT

SEQ ID NO: 309611 - protein, 17 aa, Mycobacterium
GMADSFATLVGTLGSAP

SEQ ID NO: 309612 - protein, 19 aa, Mycobacterium
GMAFIFRPLLFTSVNSRVA

SEQ ID NO: 309613 - protein, 19 aa, Mycobacterium
GMALARRWGGGVRGLFQAG

SEQ ID NO: 309614 - protein, 18 aa, Mycobacterium
GMALKLTPAVFLLYFLLR

SEQ ID NO: 309615 - protein, 17 aa, Mycobacterium
GMALSYLAVGIMSDSWG

SEQ ID NO: 309616 - protein, 25 aa, Mycobacterium
GMASASRWTPSRVQPVRRTTTAVIT

SEQ ID NO: 309617 - protein, 17 aa, Mycobacterium
GMAVWAFAVYPLMGTGN

SEQ ID NO: 309618 - protein, 25 aa, Mycobacterium
GMDRELAARFGFLLAIPAVFASGLF

SEQ ID NO: 309619 - protein, 21 aa, Mycobacterium
GMFERAFGPTVSRLVDIGAVA

SEQ ID NO: 309620 - protein, 17 aa, Mycobacterium
GMFGRAFAARFAPLTFV

SEQ ID NO: 309621 - protein, 20 aa, Mycobacterium
GMFLVLLGLLWPHLHLSHSW

SEQ ID NO: 309622 - protein, 24 aa, Mycobacterium
GMFNALPAMGAWQLPPIPGAGTPN

SEQ ID NO: 309623 - protein, 20 aa, Mycobacterium
GMGCAGVLLALIAVAPQEVV

SEQ ID NO: 309624 - protein, 20 aa, Mycobacterium
GMGEVYLARHPRLPRQDALK

SEQ ID NO: 309625 - protein, 23 aa, Mycobacterium
GMGFPHYLILLFGALGLATTMPI

SEQ ID NO: 309626 - protein, 18 aa, Mycobacterium
GMGFTKLGILSTVGPALS

SEQ ID NO: 309627 - protein, 23 aa, Mycobacterium
GMGLGCTGLLLAASVMRVLAPHQ

SEQ ID NO: 309628 - protein, 21 aa, Mycobacterium
GMGMGCTRMPLVAVAMQSLAP

SEQ ID NO: 309629 - protein, 23 aa, Mycobacterium
GMGSMVFPGYGAELLGWLDRAPR

SEQ ID NO: 309630 - protein, 18 aa, Mycobacterium
GMGVAFLLFLPMAGTTGR

SEQ ID NO: 309631 - protein, 19 aa, Mycobacterium
GMHRLLFRRHRLVVLVSAA

SEQ ID NO: 309632 - protein, 18 aa, Mycobacterium
GMKVRRYFVGFGPTLWST

SEQ ID NO: 309633 - protein, 22 aa, Mycobacterium
GMLADLRFLVALTAILASGAAV

SEQ ID NO: 309634 - protein, 23 aa, Mycobacterium
GMLIGMAALGGWGIHRFYQNFDA

SEQ ID NO: 309635 - protein, 20 aa, Mycobacterium
GMLIGWRMHGSLADAVLAFV

SEQ ID NO: 309636 - protein, 31 aa, Mycobacterium
GMLPILGLRNEFRWILLVAGFTLFAAADTLY

SEQ ID NO: 309637 - protein, 18 aa, Mycobacterium
GMLTGVTILNNWIRQGVV

SEQ ID NO: 309638 - protein, 22 aa, Mycobacterium
GMLTMMVFLPFAGRLSDRVGRK

SEQ ID NO: 309639 - protein, 26 aa, Mycobacterium
GMLVLLKAVAYWFDRYELLSHSRGGK

SEQ ID NO: 309640 - protein, 19 aa, Mycobacterium
GMMRSPMFMLFPIMMMVSM

SEQ ID NO: 309641 - protein, 18 aa, Mycobacterium
GMMYVFSTFVMRGLNGID

SEQ ID NO: 309642 - protein, 17 aa, Mycobacterium
GMNGKFEGVMALPVPIG

SEQ ID NO: 309643 - protein, 19 aa, Mycobacterium
GMPAIEWLHVRQLRRAAEA

SEQ ID NO: 309644 - protein, 19 aa, Mycobacterium
GMPKLKHRAYQPVARKAGG

SEQ ID NO: 309645 - protein, 22 aa, Mycobacterium
GMPLALGSYWGLLFVIPGGVML

SEQ ID NO: 309646 - protein, 24 aa, Mycobacterium
GMRPNPWAPYPLRLPWNNYEAGGG

SEQ ID NO: 309647 - protein, 25 aa, Mycobacterium
GMSEVHLARDLRLHRDVAIKVLRAD

SEQ ID NO: 309648 - protein, 23 aa, Mycobacterium
GMSGMRYPTFLLYNAIGSAAWGT

SEQ ID NO: 309649 - protein, 26 aa, Mycobacterium
GMSLLLDWKALWRHCATVAAFAATVP

SEQ ID NO: 309650 - protein, 17 aa, Mycobacterium
GMSMVFGAMALVAVTAY

SEQ ID NO: 309651 - protein, 21 aa, Mycobacterium
GMSPFTWDLPDPTPLPAPPAK

SEQ ID NO: 309652 - protein, 26 aa, Mycobacterium
GMTDWECARRVTLPWVSSGIVGAVVL

SEQ ID NO: 309653 - protein, 19 aa, Mycobacterium
GMTFGWLFGSMVFQLVLWG

SEQ ID NO: 309654 - protein, 22 aa, Mycobacterium
GMTLPRALFWIVVVYVLVATII

SEQ ID NO: 309655 - protein, 18 aa, Mycobacterium
GMTPRAALTKHLLDGDDS

SEQ ID NO: 309656 - protein, 44 aa, Mycobacterium
GMTTLDWRLGLAGALAIPAYIAGLHWYLPRSAPMYADERIAIAN

SEQ ID NO: 309657 - protein, 26 aa, Mycobacterium
GMTWTLPVLGAWVIVSTWILPDVTLT

SEQ ID NO: 309658 - protein, 24 aa, Mycobacterium
GMVGGVWLAFIGWFIFAASREEET

SEQ ID NO: 309659 - protein, 21 aa, Mycobacterium
GMVIAHAVGLPAVGDEVVIDL

SEQ ID NO: 309660 - protein, 20 aa, Mycobacterium
GMVNMGGFLASLLLMQAMGM

SEQ ID NO: 309661 - protein, 22 aa, Mycobacterium
GMVNRLLSFGGFFDASVHWLTG

SEQ ID NO: 309662 - protein, 19 aa, Mycobacterium
GMVRTAILIPYGIVTVVAS

SEQ ID NO: 309663 - protein, 22 aa, Mycobacterium
GMVTRAGLRPVARLTQAAERVA

SEQ ID NO: 309664 - protein, 18 aa, Mycobacterium
GMVTRAGLRPVGRLTEAA

SEQ ID NO: 309665 - protein, 19 aa, Mycobacterium
GMVTRAGLRPVGRLTEAAE

SEQ ID NO: 309666 - protein, 20 aa, Mycobacterium
GMVTRAGLRPVGRLTEAAER

SEQ ID NO: 309667 - protein, 25 aa, Mycobacterium
GMYNPRFPGGFTDLLAHLVLPAIAA

SEQ ID NO: 309668 - protein, 25 aa, Mycobacterium
GMYRGALSINLAKFFTYTGVFLIVV

SEQ ID NO: 309669 - protein, 17 aa, Mycobacterium
GNAAVRLIYTWRWSLVT

SEQ ID NO: 309670 - protein, 24 aa, Mycobacterium
GNADRGMPLLVLVVMAQLVLCGGM

SEQ ID NO: 309671 - protein, 22 aa, Mycobacterium
GNAFGLAWRLDRGALLLWTVGL

SEQ ID NO: 309672 - protein, 18 aa, Mycobacterium
GNALLVWLVEVALFVVGA

SEQ ID NO: 309673 - protein, 17 aa, Mycobacterium
GNAVEFNAANGLLVDSW

SEQ ID NO: 309674 - protein, 22 aa, Mycobacterium
GNAWPVPVLVAGTVVFAAAFVA

SEQ ID NO: 309675 - protein, 45 aa, Mycobacterium
GNDIYYLPNLVAWACAKDPGALSFSWRLSVCTIRPDDEVDTAATQ

SEQ ID NO: 309676 - protein, 22 aa, Mycobacterium
GNEALAVPIWWSYAAAEILITA

SEQ ID NO: 309677 - protein, 24 aa, Mycobacterium
GNEALAVPIWWSYAAALVLMTAGF

SEQ ID NO: 309678 - protein, 22 aa, Mycobacterium
GNEALAVPIWWSYAAAQILITA

SEQ ID NO: 309679 - protein, 18 aa, Mycobacterium
GNEIGVKVFGWIHGIIFI

SEQ ID NO: 309680 - protein, 21 aa, Mycobacterium
GNELVLRVEFDTGLFGESRVR

SEQ ID NO: 309681 - protein, 19 aa, Mycobacterium
GNFAWLNWITIVLACGVVS

SEQ ID NO: 309682 - protein, 19 aa, Mycobacterium
GNFAWLNWVTILLACSAID

SEQ ID NO: 309683 - protein, 22 aa, Mycobacterium
GNFGSRVELRLADFNEATLVAK

SEQ ID NO: 309684 - protein, 27 aa, Mycobacterium
GNGAWWPYLIGGVVYNLAIAWALFSRF

SEQ ID NO: 309685 - protein, 20 aa, Mycobacterium
GNGILGFALVFLVARAFSSG

SEQ ID NO: 309686 - protein, 22 aa, Mycobacterium
GNGLILRKGEVFELQPTTPSSI

SEQ ID NO: 309687 - protein, 17 aa, Mycobacterium
GNGYSVRLTGTILGGTN

SEQ ID NO: 309688 - protein, 22 aa, Mycobacterium
GNIDLSRTVGWFTTKYPVSLAV

SEQ ID NO: 309689 - protein, 17 aa, Mycobacterium
GNIKAQWVSLWTGPVVG

SEQ ID NO: 309690 - protein, 25 aa, Mycobacterium
GNLDFFCAVVIVGLLAGVAGLATTL

SEQ ID NO: 309691 - protein, 17 aa, Mycobacterium
GNLIAAVGMTIAVAATL

SEQ ID NO: 309692 - protein, 26 aa, Mycobacterium
GNLIDALEHVARLALLARAERDGQSE

SEQ ID NO: 309693 - protein, 22 aa, Mycobacterium
GNLIGIVVAWGLLQAFPGTLDP

SEQ ID NO: 309694 - protein, 17 aa, Mycobacterium
GNLIGMGLREQRLYDAM

SEQ ID NO: 309695 - protein, 17 aa, Mycobacterium
GNLLPVLLVVVIEMCAA

SEQ ID NO: 309696 - protein, 18 aa, Mycobacterium
GNLLTLVAAAGFYCYVLT

SEQ ID NO: 309697 - protein, 18 aa, Mycobacterium
GNLSLRYTIAAGDKTAPL

SEQ ID NO: 309698 - protein, 19 aa, Mycobacterium
GNMGMPRRYADYLATDGFQ

SEQ ID NO: 309699 - protein, 25 aa, Mycobacterium
GNMVPRPGRDVVHIAGVPVGVATCW

SEQ ID NO: 309700 - protein, 28 aa, Mycobacterium
GNNPSGVVLTGFVDRVGDPVPLIAEDGS

SEQ ID NO: 309701 - protein, 34 aa, Mycobacterium
GNNRIARRNLLWIIACDHIAFGVWTLFPVMALFM

SEQ ID NO: 309702 - protein, 28 aa, Mycobacterium
GNPFPHRWAVMFLVAVGFWNFVGAGIFG

SEQ ID NO: 309703 - protein, 21 aa, Mycobacterium
GNPLYAFLLMVLFQYGVALHE

SEQ ID NO: 309704 - protein, 20 aa, Mycobacterium
GNPNIQFVLMGSANTPNGGI

SEQ ID NO: 309705 - protein, 25 aa, Mycobacterium
GNPSPALEWARGGEITISLPPEQAR

SEQ ID NO: 309706 - protein, 24 aa, Mycobacterium
GNPSWPGQWAIVYVDTTGKHPGAV

SEQ ID NO: 309707 - protein, 19 aa, Mycobacterium
GNPYPGWFLSAAEPTGYFL

SEQ ID NO: 309708 - protein, 37 aa, Mycobacterium
GNQFSCDPLRVFPADVAGGYWLDYMVPMMSLDARSVG

SEQ ID NO: 309709 - protein, 18 aa, Mycobacterium
GNQLPAPFINPGGAGGSG

SEQ ID NO: 309710 - protein, 24 aa, Mycobacterium
GNQPLRPGASLPLGQSTTPYQIYD

SEQ ID NO: 309711 - protein, 25 aa, Mycobacterium
GNQRYALSGALVFLGGLLFFEKAAI

SEQ ID NO: 309712 - protein, 23 aa, Mycobacterium
GNRAPYWVCAVYLVALAVAGLGA

SEQ ID NO: 309713 - protein, 20 aa, Mycobacterium
GNRELEAFAPLNIPNSDLHW

SEQ ID NO: 309714 - protein, 24 aa, Mycobacterium
GNRRAEQRLAFILVAPAALLMLAV

SEQ ID NO: 309715 - protein, 25 aa, Mycobacterium
GNRWRRLGTVLARPANDGERIRTLE

SEQ ID NO: 309716 - protein, 17 aa, Mycobacterium
GNSLEWATTCPPPRHNF

SEQ ID NO: 309717 - protein, 22 aa, Mycobacterium
GNSLPLMLLFSVANRSLGDVLT

SEQ ID NO: 309718 - protein, 17 aa, Mycobacterium
GNSLRLRGFTSTSTSSA

SEQ ID NO: 309719 - protein, 23 aa, Mycobacterium
GNTALSWLVQYAVVLAGELLCFV

SEQ ID NO: 309720 - protein, 19 aa, Mycobacterium
GNVDLVFRGGTLTKRSEAA

SEQ ID NO: 309721 - protein, 19 aa, Mycobacterium
GNVDLVFSGGILIRRQEAA

SEQ ID NO: 309722 - protein, 37 aa, Mycobacterium
GNVEGLAALIFFRYLWAFELTSALLITAAIGAMVLAH

SEQ ID NO: 309723 - protein, 22 aa, Mycobacterium
GNVETIWPLSPLQEGVYLQARY

SEQ ID NO: 309724 - protein, 21 aa, Mycobacterium
GNVGLAMPFTLVGALGGLALV

SEQ ID NO: 309725 - protein, 17 aa, Mycobacterium
GNVILMLGIPLALGSYW

SEQ ID NO: 309726 - protein, 18 aa, Mycobacterium
GNVNEFRHGLLILVALAA

SEQ ID NO: 309727 - protein, 18 aa, Mycobacterium
GNVPLLRVGIPALAGLSV

SEQ ID NO: 309728 - protein, 23 aa, Mycobacterium
GNVPRLGFEFNEQRRAVLDNHVR

SEQ ID NO: 309729 - protein, 17 aa, Mycobacterium
GNVRGWDVLFSSNGATD

SEQ ID NO: 309730 - protein, 17 aa, Mycobacterium
GNYDMWDVVPAYPPPPD

SEQ ID NO: 309731 - protein, 17 aa, Mycobacterium
GNYLPALIVIAVLMISV

SEQ ID NO: 309732 - protein, 24 aa, Mycobacterium
GPAAFWVCGLLLCMFIGPTQSSSR

SEQ ID NO: 309733 - protein, 25 aa, Mycobacterium
GPAASRRASVRLGIIDDHVVIGDEV

SEQ ID NO: 309734 - protein, 18 aa, Mycobacterium
GPADLAFLIAAPDSGGQE

SEQ ID NO: 309735 - protein, 18 aa, Mycobacterium
GPADLAFLIAAPESGGSE

SEQ ID NO: 309736 - protein, 21 aa, Mycobacterium
GPAFTRYSLFADRGALDAAFD

SEQ ID NO: 309737 - protein, 23 aa, Mycobacterium
GPAGLRRWWLAVMIAVGATMWLE

SEQ ID NO: 309738 - protein, 30 aa, Mycobacterium
GPAGQLLSFKIAIPICGAALAVAAGFLIDL

SEQ ID NO: 309739 - protein, 21 aa, Mycobacterium
GPAHAGSAVLLVGEETASLSV

SEQ ID NO: 309740 - protein, 21 aa, Mycobacterium
GPAIGRLADRYGRAGFIPLGL

SEQ ID NO: 309741 - protein, 19 aa, Mycobacterium
GPAKLTAIVDGGTFLLSTL

SEQ ID NO: 309742 - protein, 24 aa, Mycobacterium
GPALFSVFGVFWGAFGLVTGAANG

SEQ ID NO: 309743 - protein, 18 aa, Mycobacterium
GPALIGWVADALSLNTAL

SEQ ID NO: 309744 - protein, 18 aa, Mycobacterium
GPAPALTVPDGWRAVQTS

SEQ ID NO: 309745 - protein, 17 aa, Mycobacterium
GPARMRVIVLLALVVGL

SEQ ID NO: 309746 - protein, 18 aa, Mycobacterium
GPARSAALLLPRGRGRDF

SEQ ID NO: 309747 - protein, 18 aa, Mycobacterium
GPASMIGLDFARTFNTSA

SEQ ID NO: 309748 - protein, 22 aa, Mycobacterium
GPAVAGAFLLAALLFTIGRLRM

SEQ ID NO: 309749 - protein, 17 aa, Mycobacterium
GPAVPPGSPCSYTPPAD

SEQ ID NO: 309750 - protein, 20 aa, Mycobacterium
GPDAQAWDPTSWGPWVVHTL

SEQ ID NO: 309751 - protein, 20 aa, Mycobacterium
GPDDLWEFLAQGRSAVSQVP

SEQ ID NO: 309752 - protein, 24 aa, Mycobacterium
GPDFGKASPIGLLIVVLLLIATLF

SEQ ID NO: 309753 - protein, 18 aa, Mycobacterium
GPDFGKASPLGLLVVVVL

SEQ ID NO: 309754 - protein, 21 aa, Mycobacterium
GPDHRRLLPTVALLGAVFMVW

SEQ ID NO: 309755 - protein, 19 aa, Mycobacterium
GPDLDRFDAIIVDLPDPDT

SEQ ID NO: 309756 - protein, 21 aa, Mycobacterium
GPDRFWLSAGQAFVAGVGVDW

SEQ ID NO: 309757 - protein, 23 aa, Mycobacterium
GPDRRFSAVVAFASSCRHPATAL

SEQ ID NO: 309758 - protein, 19 aa, Mycobacterium
GPDRSGRPGAHRAPDRPGP

SEQ ID NO: 309759 - protein, 20 aa, Mycobacterium
GPDWSWLKWLPHTDVPGELD

SEQ ID NO: 309760 - protein, 41 aa, Mycobacterium
GPDYYRRAELCRERLGPVLRRLTANYPPIMFHPLNTITAYK

SEQ ID NO: 309761 - protein, 17 aa, Mycobacterium
GPEAGWMSPVTIGSGIA

SEQ ID NO: 309762 - protein, 18 aa, Mycobacterium
GPEHGWQSAITIGSGLVA

SEQ ID NO: 309763 - protein, 19 aa, Mycobacterium
GPEKLWQVRELQFAALAAV

SEQ ID NO: 309764 - protein, 18 aa, Mycobacterium
GPELGWQNILLILAAAVL

SEQ ID NO: 309765 - protein, 20 aa, Mycobacterium
GPELRRLITGSSKLAIDARA

SEQ ID NO: 309766 - protein, 22 aa, Mycobacterium
GPERFMDLVDKFGLGQRTGVGL

SEQ ID NO: 309767 - protein, 22 aa, Mycobacterium
GPERFYDMVRKFGLGQRTNAGL

SEQ ID NO: 309768 - protein, 22 aa, Mycobacterium
GPERFYDMVRKFGLGQRTNVGL

SEQ ID NO: 309769 - protein, 25 aa, Mycobacterium
GPERFYEMLRKFGLGQRTNVGLPGE

SEQ ID NO: 309770 - protein, 25 aa, Mycobacterium
GPERFYEMVRKFGLGQRTGVGLPGE

SEQ ID NO: 309771 - protein, 24 aa, Mycobacterium
GPERLPGAIRWSANALRQARDYLS

SEQ ID NO: 309772 - protein, 27 aa, Mycobacterium
GPERLPGAIRWTAGAVRQARDYITGAT

SEQ ID NO: 309773 - protein, 23 aa, Mycobacterium
GPESSTFRALAWSEDDAPAGEPV

SEQ ID NO: 309774 - protein, 17 aa, Mycobacterium
GPEVTAIITAVAEALDY

SEQ ID NO: 309775 - protein, 33 aa, Mycobacterium
GPFAWNGSLAFWWAVVVFCVWLTALIVILKQAA

SEQ ID NO: 309776 - protein, 27 aa, Mycobacterium
GPFAWNGSVSFWLAVVVFSIWLGALIV

SEQ ID NO: 309777 - protein, 19 aa, Mycobacterium
GPFGGGRGGFGHGFGGFGG

SEQ ID NO: 309778 - protein, 19 aa, Mycobacterium
GPFLVPLYFAFGVVAALLG

SEQ ID NO: 309779 - protein, 17 aa, Mycobacterium
GPFSVGIWSTWASGEPN

SEQ ID NO: 309780 - protein, 22 aa, Mycobacterium
GPFSVGKWATWQSGLPNGRPEV

SEQ ID NO: 309781 - protein, 17 aa, Mycobacterium
GPGACKVLLGATAAAVT

SEQ ID NO: 309782 - protein, 19 aa, Mycobacterium
GPGAPIRAGAHIAEDTQLP

SEQ ID NO: 309783 - protein, 26 aa, Mycobacterium
GPGDALYGLRTMLFGEQVQMRDDAVI

SEQ ID NO: 309784 - protein, 21 aa, Mycobacterium
GPGEFRKALREALAENRIARK

SEQ ID NO: 309785 - protein, 18 aa, Mycobacterium
GPGEKWLVAPRQLDDSGR

SEQ ID NO: 309786 - protein, 23 aa, Mycobacterium
GPGEVPMAVVFVVSAAAHLTASD

SEQ ID NO: 309787 - protein, 32 aa, Mycobacterium
GPGGRPGCWQPITRDLWPAPFLVLDTGASVAP

SEQ ID NO: 309788 - protein, 24 aa, Mycobacterium
GPGILPPITLPVLPGAAPAPAPTP

SEQ ID NO: 309789 - protein, 18 aa, Mycobacterium
GPGKSVLVGLTLIAAGLG

SEQ ID NO: 309790 - protein, 23 aa, Mycobacterium
GPGLWPFVVGIVIAVLSVLLLLL

SEQ ID NO: 309791 - protein, 22 aa, Mycobacterium
GPGPFCSMLLADFGADVVTVER

SEQ ID NO: 309792 - protein, 17 aa, Mycobacterium
GPGSFKITVQLPDVATL

SEQ ID NO: 309793 - protein, 18 aa, Mycobacterium
GPGVFFWFLVIGLLTVFM

SEQ ID NO: 309794 - protein, 21 aa, Mycobacterium
GPGWMRFPIGVYADTGETVWL

SEQ ID NO: 309795 - protein, 19 aa, Mycobacterium
GPHGFGFGLGNLIMVGNVV

SEQ ID NO: 309796 - protein, 19 aa, Mycobacterium
GPHGIWPRVVHGITAASAV

SEQ ID NO: 309797 - protein, 18 aa, Mycobacterium
GPHSLRASGLSTIKHSRV

SEQ ID NO: 309798 - protein, 17 aa, Mycobacterium
GPIGGPILGGWLISSFG

SEQ ID NO: 309799 - protein, 19 aa, Mycobacterium
GPILWRLSEPVSIGGMTLP

SEQ ID NO: 309800 - protein, 21 aa, Mycobacterium
GPISDLWRLYQRIYEILWALR

SEQ ID NO: 309801 - protein, 35 aa, Mycobacterium
GPIVGGLLIQWVGWRAVFWINLPVCVLAFVLTAVF

SEQ ID NO: 309802 - protein, 24 aa, Mycobacterium
GPIVGWLGGWGIIAADVICLANLA

SEQ ID NO: 309803 - protein, 19 aa, Mycobacterium
GPKCLVKVIQKLSGLSINR

SEQ ID NO: 309804 - protein, 20 aa, Mycobacterium
GPKCLVKVIQKLSGLSINRF

SEQ ID NO: 309805 - protein, 25 aa, Mycobacterium
GPKRLGRLMAAIGIPMLLGPIGGPI

SEQ ID NO: 309806 - protein, 21 aa, Mycobacterium
GPKRVGRVMAVLGIPGVLAPA

SEQ ID NO: 309807 - protein, 20 aa, Mycobacterium
GPLALRFTKGASVLVGIVVG

SEQ ID NO: 309808 - protein, 19 aa, Mycobacterium
GPLAWDGFLSFWMRNGAFA

SEQ ID NO: 309809 - protein, 18 aa, Mycobacterium
GPLAWNGFLSFWVKNVAI

SEQ ID NO: 309810 - protein, 17 aa, Mycobacterium
GPLAWNGVFAFYIPGLV

SEQ ID NO: 309811 - protein, 19 aa, Mycobacterium
GPLDPRRTASIVAQVASAL

SEQ ID NO: 309812 - protein, 17 aa, Mycobacterium
GPLFQGLVSGLSGAIGY

SEQ ID NO: 309813 - protein, 17 aa, Mycobacterium
GPLGDRLGRKSVMAITI

SEQ ID NO: 309814 - protein, 19 aa, Mycobacterium
GPLGPRQGDVYAIGAGFGQ

SEQ ID NO: 309815 - protein, 19 aa, Mycobacterium
GPLLIAFSFRERTDATREP

SEQ ID NO: 309816 - protein, 19 aa, Mycobacterium
GPLLLWFAIFFTFQAIAIR

SEQ ID NO: 309817 - protein, 24 aa, Mycobacterium
GPLMAGLLLNWVDLSTLYLIDAIT

SEQ ID NO: 309818 - protein, 17 aa, Mycobacterium
GPLPAGRGVLIGRTGDE

SEQ ID NO: 309819 - protein, 19 aa, Mycobacterium
GPLPIRAYALFIITGIVVA

SEQ ID NO: 309820 - protein, 18 aa, Mycobacterium
GPLPPARAVHIIEQVAKA

SEQ ID NO: 309821 - protein, 19 aa, Mycobacterium
GPLPTVLTDVGYRYAGAER

SEQ ID NO: 309822 - protein, 18 aa, Mycobacterium
GPLRIAIGCQHEPGNRDS

SEQ ID NO: 309823 - protein, 38 aa, Mycobacterium
GPLRKLKDPSWRVGAWVCSVIVVAAWGSILLMGVTDPL

SEQ ID NO: 309824 - protein, 19 aa, Mycobacterium
GPLRLPGIAPHNIDVFAVL

SEQ ID NO: 309825 - protein, 20 aa, Mycobacterium
GPLSRWTGTDFARRIHPEDR

SEQ ID NO: 309826 - protein, 18 aa, Mycobacterium
GPLSWFFHHLPKPLHRVE

SEQ ID NO: 309827 - protein, 17 aa, Mycobacterium
GPLTPAFVHAVLDGVLD

SEQ ID NO: 309828 - protein, 23 aa, Mycobacterium
GPLTPPRAVAVVRQIGSALDAAH

SEQ ID NO: 309829 - protein, 28 aa, Mycobacterium
GPLTRLTARWRLPAVIQLAVRSLTRSRG

SEQ ID NO: 309830 - protein, 26 aa, Mycobacterium
GPLVRAPEFYAWMTVLPIGLMLQQSS

SEQ ID NO: 309831 - protein, 26 aa, Mycobacterium
GPMITFLLPILIGYTGGRMIHGNRGA

SEQ ID NO: 309832 - protein, 25 aa, Mycobacterium
GPMSHAAVVAREFGFPCVVDAQGAT

SEQ ID NO: 309833 - protein, 32 aa, Mycobacterium
GPMSHAAVVAREFGFPCVVDVQGATKLLPPGA

SEQ ID NO: 309834 - protein, 29 aa, Mycobacterium
GPMSHAAVVAREFGFPCVVDVQGATQYLQ

SEQ ID NO: 309835 - protein, 30 aa, Mycobacterium
GPMYRLADRVRVSWFRTLLLKWMLVAVVSL

SEQ ID NO: 309836 - protein, 26 aa, Mycobacterium
GPNEPLWLGMDAWRWMFLAMAVPAVV

SEQ ID NO: 309837 - protein, 26 aa, Mycobacterium
GPNRLARLMSVMGIPLLLGPMAGPIL

SEQ ID NO: 309838 - protein, 18 aa, Mycobacterium
GPPAGTWFLSSAVLADHV

SEQ ID NO: 309839 - protein, 20 aa, Mycobacterium
GPPAHPVWLPPLGAAPELSA

SEQ ID NO: 309840 - protein, 25 aa, Mycobacterium
GPPLFREHLHRAGVPMNSPEEVHAE

SEQ ID NO: 309841 - protein, 19 aa, Mycobacterium
GPPLLRWAPGIRGRTIVVW

SEQ ID NO: 309842 - protein, 20 aa, Mycobacterium
GPPPGPPPMMAFHHGPPPPP

SEQ ID NO: 309843 - protein, 17 aa, Mycobacterium
GPPPGRWPRALHLVPPI

SEQ ID NO: 309844 - protein, 31 aa, Mycobacterium
GPPPQRPSGNRMWWIMGTVIAVGVLALAGGI

SEQ ID NO: 309845 - protein, 26 aa, Mycobacterium
GPPPRRIVSGIMGRTILIWLLGSGVP

SEQ ID NO: 309846 - protein, 19 aa, Mycobacterium
GPPPVRWPRALHLVPPYHE

SEQ ID NO: 309847 - protein, 19 aa, Mycobacterium
GPPRALLIAAVVVAVSVLI

SEQ ID NO: 309848 - protein, 32 aa, Mycobacterium
GPPRLPLWPVSARTRAALCAQADRLHQLLVCH

SEQ ID NO: 309849 - protein, 21 aa, Mycobacterium
GPPRTEILGRLGSYRLDSTVD

SEQ ID NO: 309850 - protein, 25 aa, Mycobacterium
GPPSLDIGAAFSWSFNKFSKNAVPL

SEQ ID NO: 309851 - protein, 29 aa, Mycobacterium
GPPTPARILFDWRFDLIFGSAAIVFAALY

SEQ ID NO: 309852 - protein, 31 aa, Mycobacterium
GPPTPGRLMFDWRFDLIFGTAAIVFAIAYVV

SEQ ID NO: 309853 - protein, 18 aa, Mycobacterium
GPQFPWLPPQQAPPQQAP

SEQ ID NO: 309854 - protein, 20 aa, Mycobacterium
GPQLSFGVAAPFLYQDEMGF

SEQ ID NO: 309855 - protein, 19 aa, Mycobacterium
GPQTVWRNLRFPTKTAPPG

SEQ ID NO: 309856 - protein, 23 aa, Mycobacterium
GPQWQRLSPRMLLVHPVHEVLQQ

SEQ ID NO: 309857 - protein, 19 aa, Mycobacterium
GPRAGTWFLSSAVLADHVE

SEQ ID NO: 309858 - protein, 22 aa, Mycobacterium
GPRELLRRPTLWFSAVAVALSA

SEQ ID NO: 309859 - protein, 24 aa, Mycobacterium
GPRFRFEELCATPAVPRDPRDSAV

SEQ ID NO: 309860 - protein, 23 aa, Mycobacterium
GPRGEVLNGTLLVTGVSPRPEAT

SEQ ID NO: 309861 - protein, 25 aa, Mycobacterium
GPRLGVRWWRFGAGVLLGLACATKW

SEQ ID NO: 309862 - protein, 25 aa, Mycobacterium
GPRLGVRWWRFGAGVLLGLACGTKW

SEQ ID NO: 309863 - protein, 28 aa, Mycobacterium
GPRLGVRWWRFGAGVLLGLAFATKWSGL

SEQ ID NO: 309864 - protein, 30 aa, Mycobacterium
GPRLRMLLRVTRFDVGLAMLVAGAVNMAML

SEQ ID NO: 309865 - protein, 18 aa, Mycobacterium
GPRLTFALGGLGGETQLG

SEQ ID NO: 309866 - protein, 24 aa, Mycobacterium
GPRRHPYGVAFAALIAPRLGPARE

SEQ ID NO: 309867 - protein, 25 aa, Mycobacterium
GPRRLGRLMSILSIPMLLAPIAGPI

SEQ ID NO: 309868 - protein, 23 aa, Mycobacterium
GPRRRHELASFVAITSIATIAAA

SEQ ID NO: 309869 - protein, 22 aa, Mycobacterium
GPRRVGRVMAVLGIPMVLAPAF

SEQ ID NO: 309870 - protein, 24 aa, Mycobacterium
GPRTRFGAWLGRPMTSFHLIIAVA

SEQ ID NO: 309871 - protein, 21 aa, Mycobacterium
GPSCYTAPLVPTRAALPDVLL

SEQ ID NO: 309872 - protein, 21 aa, Mycobacterium
GPSKWRRPQLIPDERTVVHAG

SEQ ID NO: 309873 - protein, 22 aa, Mycobacterium
GPSLRREDWAGAAIAAADQLNT

SEQ ID NO: 309874 - protein, 17 aa, Mycobacterium
GPSPYIDFDGMRLKVVD

SEQ ID NO: 309875 - protein, 20 aa, Mycobacterium
GPSTWMFGAICAVIATLLMG

SEQ ID NO: 309876 - protein, 23 aa, Mycobacterium
GPTNIPALVFVMFQAGFAMVTVA

SEQ ID NO: 309877 - protein, 22 aa, Mycobacterium
GPTPYSAVWLWVAIALTVALIG

SEQ ID NO: 309878 - protein, 24 aa, Mycobacterium
GPTRAWSAVCVLAVVGTLNYADRF

SEQ ID NO: 309879 - protein, 20 aa, Mycobacterium
GPTRQGWRGRLRNRMRRSGR

SEQ ID NO: 309880 - protein, 19 aa, Mycobacterium
GPTSARLGQPVTVDLTVEN

SEQ ID NO: 309881 - protein, 17 aa, Mycobacterium
GPTVRYREFSGDEIDQL

SEQ ID NO: 309882 - protein, 28 aa, Mycobacterium
GPTYIAQNVFEFDRRIDVDAMRRAFTAL

SEQ ID NO: 309883 - protein, 19 aa, Mycobacterium
GPVAAAFRLSSGDLVARVG

SEQ ID NO: 309884 - protein, 30 aa, Mycobacterium
GPVARLWRALLVFFSKWWQLESLYRSNMKY

SEQ ID NO: 309885 - protein, 30 aa, Mycobacterium; identical to SEQ ID NO: 11106

SEQ ID NO: 309886 - protein, 24 aa, Mycobacterium
GPVAVEAYGLFVFRDAIAACGVQT

SEQ ID NO: 309887 - protein, 34 aa, Mycobacterium
GPVEFSGLIAWFAWLVLHLVYLVGFKTKVSTLLS

SEQ ID NO: 309888 - protein, 34 aa, Mycobacterium
GPVEISGFIAWLAWLVLHLVYLVGFKTKVSTLLS

SEQ ID NO: 309889 - protein, 24 aa, Mycobacterium
GPVFPGSLFPFLFITIACGALSGF

SEQ ID NO: 309890 - protein, 27 aa, Mycobacterium
GPVLARISPLLSRHPWAIDQFVTRFQT

SEQ ID NO: 309891 - protein, 20 aa, Mycobacterium
GPVMVFCVLGARIWSGSVAA

SEQ ID NO: 309892 - protein, 17 aa, Mycobacterium
GPVPPGFPVTADDAPPP

SEQ ID NO: 309893 - protein, 17 aa, Mycobacterium
GPVRLDDLPGFLRSHDP

SEQ ID NO: 309894 - protein, 25 aa, Mycobacterium
GPVSWAGGVGFRVALLMGPEALETV

SEQ ID NO: 309895 - protein, 25 aa, Mycobacterium
GPVTATPIMRWLKEIGGPVAEFNQT

SEQ ID NO: 309896 - protein, 18 aa, Mycobacterium
GPVTSEFSGKVRFVEQDR

SEQ ID NO: 309897 - protein, 19 aa, Mycobacterium
GPVTSEFSGRVHFVEQDRD

SEQ ID NO: 309898 - protein, 17 aa, Mycobacterium
GPVTWVMLGEIFPNSYR

SEQ ID NO: 309899 - protein, 24 aa, Mycobacterium
GPVVQCLLISIGIFACIAAIILRR

SEQ ID NO: 309900 - protein, 17 aa, Mycobacterium
GPVVWVLLGEIFPNRIR

SEQ ID NO: 309901 - protein, 17 aa, Mycobacterium
GPVWRLVGTTGIGLLLL

SEQ ID NO: 309902 - protein, 25 aa, Mycobacterium
GPWDWQRWAPASPWATPPVIVMVVG

SEQ ID NO: 309903 - protein, 33 aa, Mycobacterium
GPWLPARLAPEYSVDTWRQWWFAWQATAGEHII

SEQ ID NO: 309904 - protein, 19 aa, Mycobacterium
GPWTPRIAAQLAVLAAAAF

SEQ ID NO: 309905 - protein, 18 aa, Mycobacterium
GPWYRGFVGILLKAILPV

SEQ ID NO: 309906 - protein, 18 aa, Mycobacterium
GPYELHSVIGVGGMGEVY

SEQ ID NO: 309907 - protein, 28 aa, Mycobacterium
GPYETIGGLVLREIGHIPAAGDTVKLPG

SEQ ID NO: 309908 - protein, 24 aa, Mycobacterium
GPYETIGGLVLRELGHIPVAGESV

SEQ ID NO: 309909 - protein, 19 aa, Mycobacterium
GPYRLTRLLGRGGMGEVYE

SEQ ID NO: 309910 - protein, 19 aa, Mycobacterium
GPYRRRLLRVTRWDVGLAM

SEQ ID NO: 309911 - protein, 17 aa, Mycobacterium
GPYRWLHHPNYVAVVAE

SEQ ID NO: 309912 - protein, 19 aa, Mycobacterium
GPYTLPSMSLLVAGDPPKK

SEQ ID NO: 309913 - protein, 18 aa, Mycobacterium
GPYVLPSLSLLVAGDPPK

SEQ ID NO: 309914 - protein, 21 aa, Mycobacterium
GQAAFDWLPDISRMGFSSVLW

SEQ ID NO: 309915 - protein, 24 aa, Mycobacterium
GQADPRAGLALSAYPLWCSFATVL

SEQ ID NO: 309916 - protein, 25 aa, Mycobacterium
GQAEILWDVIPFDWANDSNTAATRY

SEQ ID NO: 309917 - protein, 17 aa, Mycobacterium
GQALSGFSSPVWSVIGI

SEQ ID NO: 309918 - protein, 18 aa, Mycobacterium
GQAMGIAVCGAAYSLSAA

SEQ ID NO: 309919 - protein, 25 aa, Mycobacterium
GQARPADRPLWLGSIKSNMGHTQAA

SEQ ID NO: 309920 - protein, 20 aa, Mycobacterium
GQATAWLGYLLLYASYIVGA

SEQ ID NO: 309921 - protein, 20 aa, Mycobacterium
GQAVGRFLPVLGRFPRTVGG

SEQ ID NO: 309922 - protein, 18 aa, Mycobacterium
GQAVKGLTFGLADGQGNP

SEQ ID NO: 309923 - protein, 18 aa, Mycobacterium
GQAVLAFTGYFLVLELNV

SEQ ID NO: 309924 - protein, 25 aa, Mycobacterium
GQAYREFRVQLGRSILVGLELLVAG

SEQ ID NO: 309925 - protein, 23 aa, Mycobacterium
GQCIVALAFADLVSRWPFEGSIY

SEQ ID NO: 309926 - protein, 20 aa, Mycobacterium
GQDDHFDWLTGYLQAHGLST

SEQ ID NO: 309927 - protein, 18 aa, Mycobacterium
GQELAALVRNSARSGSLD

SEQ ID NO: 309928 - protein, 18 aa, Mycobacterium
GQESFNFGEFFAYTKVCS

SEQ ID NO: 309929 - protein, 20 aa, Mycobacterium
GQESFNFGELFAFTKVCSHL

SEQ ID NO: 309930 - protein, 17 aa, Mycobacterium
GQESFNFGELFAYTKVC

SEQ ID NO: 309931 - protein, 18 aa, Mycobacterium
GQESFNFGELFAYTKVCS

SEQ ID NO: 309932 - protein, 25 aa, Mycobacterium
GQFRMPNIMGKFWTDAEPMLYQAGW

SEQ ID NO: 309933 - protein, 25 aa, Mycobacterium
GQFVSGLSLFLAILIATSISMIFGE

SEQ ID NO: 309934 - protein, 18 aa, Mycobacterium
GQGPSLKNGDVIPVDRSY

SEQ ID NO: 309935 - protein, 24 aa, Mycobacterium
GQGRARSGAAVKFLLYNLFGGLIM

SEQ ID NO: 309936 - protein, 17 aa, Mycobacterium
GQHAWGELVSSAQAAGV

SEQ ID NO: 309937 - protein, 26 aa, Mycobacterium
GQIFFCSLAGYAFARLEFRGRDTLFV

SEQ ID NO: 309938 - protein, 17 aa, Mycobacterium
GQILVLLNVGAVFMGTA

SEQ ID NO: 309939 - protein, 27 aa, Mycobacterium
GQIRVIFAMCRDGLLPRELARTGSHGT

SEQ ID NO: 309940 - protein, 17 aa, Mycobacterium
GQIYAGAGVLALVAFSA

SEQ ID NO: 309941 - protein, 17 aa, Mycobacterium
GQIYVPWINGVLMVAVL

SEQ ID NO: 309942 - protein, 17 aa, Mycobacterium
GQKWVALAMPGYALAAG

SEQ ID NO: 309943 - protein, 24 aa, Mycobacterium
GQLAGTSFRSALMYPEPKRPGWRH

SEQ ID NO: 309944 - protein, 26 aa, Mycobacterium
GQLAGTSFRSALMYPEPNHPGWHHHQ

SEQ ID NO: 309945 - protein, 24 aa, Mycobacterium
GQLATYTALGWVFKSVVEIVMLPV

SEQ ID NO: 309946 - protein, 18 aa, Mycobacterium
GQLCLPFYGALVTNCGLD

SEQ ID NO: 309947 - protein, 17 aa, Mycobacterium
GQLEAARALGFSYRSSM

SEQ ID NO: 309948 - protein, 30 aa, Mycobacterium
GQLFSTGMSVDWPAVFAGSGATRVDLPTYA

SEQ ID NO: 309949 - protein, 21 aa, Mycobacterium
GQLGPWLTAMGRLDTAADGTP

SEQ ID NO: 309950 - protein, 27 aa, Mycobacterium
GQLGRLKTGIGLLCFVIVFLQGVTQFY

SEQ ID NO: 309951 - protein, 23 aa, Mycobacterium
GQLHPVYNLTSARLVLGNPAAPT

SEQ ID NO: 309952 - protein, 20 aa, Mycobacterium
GQLHPVYNLTSARLVLGTPA

SEQ ID NO: 309953 - protein, 17 aa, Mycobacterium
GQLIFSVVSQIALILLV

SEQ ID NO: 309954 - protein, 19 aa, Mycobacterium
GQLLFVVPLCIYGGGCYTF

SEQ ID NO: 309955 - protein, 17 aa, Mycobacterium
GQLLLVIHHLVIDGVSW

SEQ ID NO: 309956 - protein, 17 aa, Mycobacterium
GQLLQGLGVGATLPMLG

SEQ ID NO: 309957 - protein, 31 aa, Mycobacterium
GQLRAGTALIARGEFSLVIIGLVGQTYERLE

SEQ ID NO: 309958 - protein, 22 aa, Mycobacterium
GQLRIGMAASFVRCEDPALLAH

SEQ ID NO: 309959 - protein, 23 aa, Mycobacterium
GQLRITRWFAERWGTRRSLAVGL

SEQ ID NO: 309960 - protein, 22 aa, Mycobacterium
GQLRRLAVWGPWISVGAAASSA

SEQ ID NO: 309961 - protein, 21 aa, Mycobacterium
GQLRSLEGLAHVGSVASALEP

SEQ ID NO: 309962 - protein, 21 aa, Mycobacterium
GQLRTEFDAAALASIGDNVAE

SEQ ID NO: 309963 - protein, 26 aa, Mycobacterium
GQLTFESPMLFSLGFLVTFLAGGLTG

SEQ ID NO: 309964 - protein, 27 aa, Mycobacterium
GQLTFETPMLFSFGFLVTFLAGGLTGV

SEQ ID NO: 309965 - protein, 24 aa, Mycobacterium
GQLTIAVAFIGMWASLVDLGIGRV

SEQ ID NO: 309966 - protein, 24 aa, Mycobacterium
GQLTIAVAFIGMWASLVDLGVGRV

SEQ ID NO: 309967 - protein, 21 aa, Mycobacterium
GQLTIAVAFVAMWTSFADLGI

SEQ ID NO: 309968 - protein, 19 aa, Mycobacterium
GQMLVCAFAAFTAALMVRM

SEQ ID NO: 309969 - protein, 22 aa, Mycobacterium
GQMRVGQLLAFMLYAMQILAAA

SEQ ID NO: 309970 - protein, 24 aa, Mycobacterium
GQNAGEIALGFARDSVGGIVSTVT

SEQ ID NO: 309971 - protein, 23 aa, Mycobacterium
GQPATQWTLNWAHDLIDKAPHPK

SEQ ID NO: 309972 - protein, 19 aa, Mycobacterium
GQPGLAVRPGPRDWLAPAV

SEQ ID NO: 309973 - protein, 34 aa, Mycobacterium
GQPGRRWRRVGAMVSRWPGPVLAGSLLVLVVCAL

SEQ ID NO: 309974 - protein, 19 aa, Mycobacterium
GQPHPFWIAMLVVEIVIPA

SEQ ID NO: 309975 - protein, 22 aa, Mycobacterium
GQPIGFGMSVVRALAHFVDAII

SEQ ID NO: 309976 - protein, 31 aa, Mycobacterium
GQPKVVRGGARFKMPGIERVDIMSLEPFNVN

SEQ ID NO: 309977 - protein, 25 aa, Mycobacterium
GQPLARFGHMIAFYLHTVLAIPVAL

SEQ ID NO: 309978 - protein, 18 aa, Mycobacterium
GQPLPQWYATAAAALVGL

SEQ ID NO: 309979 - protein, 25 aa, Mycobacterium
GQPMTKMSIAGPWVSIAAPGTDVIG

SEQ ID NO: 309980 - protein, 23 aa, Mycobacterium
GQPPEVHSGALSFGPGPGPLSEA

SEQ ID NO: 309981 - protein, 17 aa, Mycobacterium
GQPRATFGLPLLSDGID

SEQ ID NO: 309982 - protein, 18 aa, Mycobacterium
GQPRILLKGFGIAAPHGA

SEQ ID NO: 309983 - protein, 17 aa, Mycobacterium
GQPRMVLARVVASLLTA

SEQ ID NO: 309984 - protein, 23 aa, Mycobacterium
GQPSKFSLGGPWVDVSAPGEDIV

SEQ ID NO: 309985 - protein, 18 aa, Mycobacterium
GQPSKFTMAGPWVGIAAP

SEQ ID NO: 309986 - protein, 26 aa, Mycobacterium
GQQDRLPIEIAIAVLVLAVLLLVYRS

SEQ ID NO: 309987 - protein, 26 aa, Mycobacterium
GQQDRLPIEIAIAVLVLGVLLLVYRN

SEQ ID NO: 309988 - protein, 17 aa, Mycobacterium
GQQRLDGALGRLIAVAE

SEQ ID NO: 309989 - protein, 28 aa, Mycobacterium
GQQRLGEFWGYLAGWGFVVGKTASCAAM

SEQ ID NO: 309990 - protein, 18 aa, Mycobacterium
GQRALLWAAGVLGALAII

SEQ ID NO: 309991 - protein, 18 aa, Mycobacterium
GQRALLWAAGVLGALAIV

SEQ ID NO: 309992 - protein, 23 aa, Mycobacterium
GQREHIEPLPAIALAPTATPVPT

SEQ ID NO: 309993 - protein, 24 aa, Mycobacterium
GQRFPVKYYLTAMLFIVFDIEIVF

SEQ ID NO: 309994 - protein, 24 aa, Mycobacterium
GQRLGSLFLAPAMTGFVGAVAVVP

SEQ ID NO: 309995 - protein, 30 aa, Mycobacterium
GQSEAAVALGMRKSQMMRLILLPQSISAML

SEQ ID NO: 309996 - protein, 19 aa, Mycobacterium
GQSGLRRVRLAGIDGDGNQ

SEQ ID NO: 309997 - protein, 24 aa, Mycobacterium
GQSLGWRAAFGLVVAVGVLTLTAL

SEQ ID NO: 309998 - protein, 18 aa, Mycobacterium
GQSVLPFNGIDFRLSPGG

SEQ ID NO: 309999 - protein, 17 aa, Mycobacterium
GQTARLYIRPVVHAIPA

SEQ ID NO: 310000 - protein, 24 aa, Mycobacterium
GQTATQWTLEWARNLVENAPHPKH

SEQ ID NO: 310001 - protein, 18 aa, Mycobacterium
GQTLRAVRAFYRQLDATG

SEQ ID NO: 310002 - protein, 35 aa, Mycobacterium
GQTRLLRWSIPGIAHFFTMWGFFVLATVYLEAFGL

SEQ ID NO: 310003 - protein, 35 aa, Mycobacterium
GQTRLLRWSVPGIAHFFTMWGFFVLASVYLEAYGV

SEQ ID NO: 310004 - protein, 23 aa, Mycobacterium
GQTVFRIRLPLIDAPLNASAPGR

SEQ ID NO: 310005 - protein, 22 aa, Mycobacterium
GQVELTPWLAVYAVGYPVLGIA

SEQ ID NO: 310006 - protein, 25 aa, Mycobacterium
GQVFFCSLAGYAFARLHFRGRDTLF

SEQ ID NO: 310007 - protein, 26 aa, Mycobacterium
GQVFFCSLAGYAFARLQFRGRDTLFV

SEQ ID NO: 310008 - protein, 24 aa, Mycobacterium
GQVLKRLGTVLLIVGGIGVVVAAI

SEQ ID NO: 310009 - protein, 18 aa, Mycobacterium
GQVPRLRAILLADLADAS

SEQ ID NO: 310010 - protein, 24 aa, Mycobacterium
GQVWSQWHSLVFDVSVWEIWGALL

SEQ ID NO: 310011 - protein, 22 aa, Mycobacterium
GQWDRLRWQLPASLAGATLGAY

SEQ ID NO: 310012 - protein, 19 aa, Mycobacterium
GQWKVANLTVLKRPMMNAG

SEQ ID NO: 310013 - protein, 22 aa, Mycobacterium
GQWNRLRWQLPASLAGAALGAF

SEQ ID NO: 310014 - protein, 18 aa, Mycobacterium
GQWVPDRLGAEVTVAEPG

SEQ ID NO: 310015 - protein, 19 aa, Mycobacterium
GQWYHLWAYGTVFLLATLA

SEQ ID NO: 310016 - protein, 24 aa, Mycobacterium
GQYGDEDFLIVGMDSRAGDNANMG

SEQ ID NO: 310017 - protein, 25 aa, Mycobacterium
GQYSPRLLRTFARDRFVQTTMALFL

SEQ ID NO: 310018 - protein, 20 aa, Mycobacterium
GRAAAAASRVVFARMTPEHK

SEQ ID NO: 310019 - protein, 20 aa, Mycobacterium
GRAAFRRPFQFGEFLDQTWM

SEQ ID NO: 310020 - protein, 17 aa, Mycobacterium
GRAAWFTILAFWFFAIG

SEQ ID NO: 310021 - protein, 24 aa, Mycobacterium
GRAESLYLILDTGVRFGIGNLEAA

SEQ ID NO: 310022 - protein, 24 aa, Mycobacterium
GRAGFPMDGRSGVTVLTLGNHRST

SEQ ID NO: 310023 - protein, 19 aa, Mycobacterium
GRAGLLCVTTILLTYLLVA

SEQ ID NO: 310024 - protein, 25 aa, Mycobacterium
GRAGRLRLALNTPYLLLVLAFVVYD

SEQ ID NO: 310025 - protein, 18 aa, Mycobacterium
GRAIAVIATVAAVAAAIV

SEQ ID NO: 310026 - protein, 21 aa, Mycobacterium
GRALCAITHGLLWSVIAPIAT

SEQ ID NO: 310027 - protein, 21 aa, Mycobacterium
GRALLTLAFIDIWQWTPFMVL

SEQ ID NO: 310028 - protein, 20 aa, Mycobacterium
GRALLTLAHRAMADYDEDDY

SEQ ID NO: 310029 - protein, 18 aa, Mycobacterium
GRALPAVLTRPSDDESVE

SEQ ID NO: 310030 - protein, 28 aa, Mycobacterium
GRALRWPRLPSSVLAGVVAFDYQPRLRG

SEQ ID NO: 310031 - protein, 18 aa, Mycobacterium
GRAPAGILPPRLFRNQVF

SEQ ID NO: 310032 - protein, 21 aa, Mycobacterium
GRAPGVLAMRARRLLDGRSLW

SEQ ID NO: 310033 - protein, 17 aa, Mycobacterium
GRAPRWPTFGITVLPRL

SEQ ID NO: 310034 - protein, 19 aa, Mycobacterium
GRASFALAGVNDVAGERSS

SEQ ID NO: 310035 - protein, 19 aa, Mycobacterium
GRASGRRGGGYGGSDVDEL

SEQ ID NO: 310036 - protein, 23 aa, Mycobacterium
GRAVRRHPGFLIGAVASIVLLVA

SEQ ID NO: 310037 - protein, 24 aa, Mycobacterium
GRDAPPGMREWLLAALHSRLSRFL

SEQ ID NO: 310038 - protein, 18 aa, Mycobacterium
GRDGIGIVRAFIRVLLIA

SEQ ID NO: 310039 - protein, 23 aa, Mycobacterium
GRDGREFSCLKFRSMREPKESDA

SEQ ID NO: 310040 - protein, 17 aa, Mycobacterium
GRDHWRSGAKYAAVAVV

SEQ ID NO: 310041 - protein, 19 aa, Mycobacterium
GRDLGKWWRETRFQAYQGV

SEQ ID NO: 310042 - protein, 25 aa, Mycobacterium
GRDRARAGVALSYSFIAVAVVALVA

SEQ ID NO: 310043 - protein, 22 aa, Mycobacterium
GRDRTGHIVAIFKAPDGKTVND

SEQ ID NO: 310044 - protein, 17 aa, Mycobacterium
GRDWLIHRPVDIAIYVV

SEQ ID NO: 310045 - protein, 21 aa, Mycobacterium
GREHFSWTALTIVLVVLVAAA

SEQ ID NO: 310046 - protein, 25 aa, Mycobacterium
GRELARWQPSWLRYSPLTFTGLITI

SEQ ID NO: 310047 - protein, 18 aa, Mycobacterium
GRELRGWTYGLVAVVAFA

SEQ ID NO: 310048 - protein, 22 aa, Mycobacterium
GRETTLPWGLEIFYRRDPSGYI

SEQ ID NO: 310049 - protein, 18 aa, Mycobacterium
GREVTCSITVNGTQRESR

SEQ ID NO: 310050 - protein, 18 aa, Mycobacterium
GREVTRFGVDGRRLCTVT

SEQ ID NO: 310051 - protein, 17 aa, Mycobacterium
GRFAEFWRQQESTSGWR

SEQ ID NO: 310052 - protein, 21 aa, Mycobacterium
GRFDPFGALTLAAGLVMLLLP

SEQ ID NO: 310053 - protein, 19 aa, Mycobacterium
GRFGDKIARISHRANPVDG

SEQ ID NO: 310054 - protein, 19 aa, Mycobacterium
GRFGTHLLTIVLLAGLLWL

SEQ ID NO: 310055 - protein, 20 aa, Mycobacterium
GRFGVDLIAVLSLIGTLLVG

SEQ ID NO: 310056 - protein, 22 aa, Mycobacterium
GRFMPPIGGILYWLRPNTIRLP

SEQ ID NO: 310057 - protein, 23 aa, Mycobacterium
GRFMPPIGGILYWLRPNTIRLPA

SEQ ID NO: 310058 - protein, 23 aa, Mycobacterium
GRFMPPVGGFLYWLRPKTIRLPP

SEQ ID NO: 310059 - protein, 19 aa, Mycobacterium
GRFQFIFDIDGPRGPGKGT

SEQ ID NO: 310060 - protein, 27 aa, Mycobacterium
GRFTMADVLSFRLKQRPVRLAAATNTL

SEQ ID NO: 310061 - protein, 18 aa, Mycobacterium
GRGAPHIAGAAVAFTPHR

SEQ ID NO: 310062 - protein, 25 aa, Mycobacterium
GRGFIFASFAIRAGLAVLARKPMLQ

SEQ ID NO: 310063 - protein, 21 aa, Mycobacterium
GRGGLSGTVPVHISPLANPSD

SEQ ID NO: 310064 - protein, 18 aa, Mycobacterium
GRGIALFVTEGQIITVTS

SEQ ID NO: 310065 - protein, 23 aa, Mycobacterium
GRGIKEFAPLIGVRKAGLFTSSN

SEQ ID NO: 310066 - protein, 30 aa, Mycobacterium
GRGLAARHYFTYRDVLGFVYAQAKFQLLGT

SEQ ID NO: 310067 - protein, 30 aa, Mycobacterium
GRGLAARHYFTYRDVLGFVYAQAKFQLLGV

SEQ ID NO: 310068 - protein, 18 aa, Mycobacterium
GRGLKPLPWQILMFSSFG

SEQ ID NO: 310069 - protein, 22 aa, Mycobacterium
GRGNWLPMFVLLIVLTVVTAAY

SEQ ID NO: 310070 - protein, 28 aa, Mycobacterium
GRGPAVMFFPAMMAMSVLATLAYSLRGN

SEQ ID NO: 310071 - protein, 20 aa, Mycobacterium
GRGPLRTAILIPYGIVTVVS

SEQ ID NO: 310072 - protein, 23 aa, Mycobacterium
GRGPNAWTSLAWRELAQRGMRIN

SEQ ID NO: 310073 - protein, 24 aa, Mycobacterium
GRGPSERQLFGVGIAVVVVSALVT

SEQ ID NO: 310074 - protein, 19 aa, Mycobacterium
GRGPVRASMQIRRIDPWST

SEQ ID NO: 310075 - protein, 22 aa, Mycobacterium
GRGRWLAFGVSISVAAAMFYAQ

SEQ ID NO: 310076 - protein, 20 aa, Mycobacterium
GRGTLRKMRQNLGWAVGYNV

SEQ ID NO: 310077 - protein, 23 aa, Mycobacterium
GRGVCSARLFAGLGGRPGGLRGL

SEQ ID NO: 310078 - protein, 19 aa, Mycobacterium
GRGVGVIALADAVRETSAE

SEQ ID NO: 310079 - protein, 22 aa, Mycobacterium
GRGVIWSGVVSKVIVPAVVAAL

SEQ ID NO: 310080 - protein, 31 aa, Mycobacterium
GRGVKAPRARRRRLLAIAMLLLLVPLATGCL

SEQ ID NO: 310081 - protein, 19 aa, Mycobacterium
GRHDVPLASPVRVKDIADE

SEQ ID NO: 310082 - protein, 18 aa, Mycobacterium
GRHDWPFAAQAFDAALPW

SEQ ID NO: 310083 - protein, 24 aa, Mycobacterium
GRHFSRARLNPEVLMVETDHDMRN

SEQ ID NO: 310084 - protein, 24 aa, Mycobacterium
GRHFSRARLNPEVLMVETNHDMRN

SEQ ID NO: 310085 - protein, 20 aa, Mycobacterium
GRHHVPLATALRVNDTADEI

SEQ ID NO: 310086 - protein, 21 aa, Mycobacterium
GRHPHRRSRLVLWIIASNASI

SEQ ID NO: 310087 - protein, 18 aa, Mycobacterium
GRHPHRRSTMALSIIVAN

SEQ ID NO: 310088 - protein, 27 aa, Mycobacterium
GRHTWLSCVGLLLTLVVSVAYLLIGVL

SEQ ID NO: 310089 - protein, 22 aa, Mycobacterium
GRHWHFFSVIGWILVGLSYYIL

SEQ ID NO: 310090 - protein, 17 aa, Mycobacterium
GRIADWWTQPIVYQKVI

SEQ ID NO: 310091 - protein, 18 aa, Mycobacterium
GRIGIGLKLTGNRTAQAW

SEQ ID NO: 310092 - protein, 19 aa, Mycobacterium
GRIGRDVVNVLLLTSLFAC

SEQ ID NO: 310093 - protein, 24 aa, Mycobacterium
GRIINISSVLGFLPAPYAALYAAS

SEQ ID NO: 310094 - protein, 19 aa, Mycobacterium
GRIKDLVIIDGRNHYPQDL

SEQ ID NO: 310095 - protein, 20 aa, Mycobacterium
GRILAQSWVEYGFPSPRMVH

SEQ ID NO: 310096 - protein, 18 aa, Mycobacterium
GRILGRFDLAVAVFFALS

SEQ ID NO: 310097 - protein, 21 aa, Mycobacterium
GRILIGFAAVGLIVFALMSWR

SEQ ID NO: 310098 - protein, 19 aa, Mycobacterium
GRIMALWLVGFLGSRPIAA

SEQ ID NO: 310099 - protein, 24 aa, Mycobacterium
GRINARLAVYTGLIETARTNNRAG

SEQ ID NO: 310100 - protein, 24 aa, Mycobacterium
GRINARLAVYTGLVETARTNNRAG

SEQ ID NO: 310101 - protein, 25 aa, Mycobacterium
GRIPDKRWFGWFALLTIPTPFLANI

SEQ ID NO: 310102 - protein, 24 aa, Mycobacterium
GRIPDQRWFSWFALLTIPTPFLAN

SEQ ID NO: 310103 - protein, 28 aa, Mycobacterium
GRIPLPGSAPRAVWVSAFAHPERDKRVA

SEQ ID NO: 310104 - protein, 24 aa, Mycobacterium
GRIPNQRWFSWFALLTIPTPFLAN

SEQ ID NO: 310105 - protein, 24 aa, Mycobacterium
GRISAFVRWVARTPWPVFTLGMLQ

SEQ ID NO: 310106 - protein, 23 aa, Mycobacterium
GRISAFVRWVVRTPWPLFSLSML

SEQ ID NO: 310107 - protein, 24 aa, Mycobacterium
GRKAAARFRPRLDILAAAGVWTAV

SEQ ID NO: 310108 - protein, 19 aa, Mycobacterium
GRKPLLLAGSIGFVVLAYP

SEQ ID NO: 310109 - protein, 18 aa, Mycobacterium
GRKPLRFTSFGDQSTPAL

SEQ ID NO: 310110 - protein, 19 aa, Mycobacterium
GRKPLWWFSLAGLFVAGLP

SEQ ID NO: 310111 - protein, 20 aa, Mycobacterium
GRKQPWRVLRETVGVVRGPL

SEQ ID NO: 310112 - protein, 23 aa, Mycobacterium
GRKRVFEAAVVFFVGGSVLCGLA

SEQ ID NO: 310113 - protein, 20 aa, Mycobacterium
GRKWGVGFMWTEAVAYTAIS

SEQ ID NO: 310114 - protein, 25 aa, Mycobacterium
GRLAAEFVEALGLLARTPGCRIEDY

SEQ ID NO: 310115 - protein, 21 aa, Mycobacterium
GRLADGWFPMTAPGPGLEHAR

SEQ ID NO: 310116 - protein, 25 aa, Mycobacterium
GRLADRIGRRPVFLTTITVFTAATA

SEQ ID NO: 310117 - protein, 19 aa, Mycobacterium
GRLAPRPVERPPVDPAAQR

SEQ ID NO: 310118 - protein, 17 aa, Mycobacterium
GRLATPWERSSRGRRRF

SEQ ID NO: 310119 - protein, 17 aa, Mycobacterium
GRLCEALGISGLARDPR

SEQ ID NO: 310120 - protein, 19 aa, Mycobacterium
GRLDGVVLAIQLSRRTLRT

SEQ ID NO: 310121 - protein, 21 aa, Mycobacterium
GRLEPGLAILACLAGVLVGDC

SEQ ID NO: 310122 - protein, 18 aa, Mycobacterium
GRLFGPVMIAWFVAIGAS

SEQ ID NO: 310123 - protein, 23 aa, Mycobacterium
GRLGLTLPLAEWVNEGLMTVFFF

SEQ ID NO: 310124 - protein, 20 aa, Mycobacterium
GRLGNFGAVGVDEGALLIGV

SEQ ID NO: 310125 - protein, 27 aa, Mycobacterium
GRLHPLSLLKLVAWVIFQLLSSSVQVA

SEQ ID NO: 310126 - protein, 26 aa, Mycobacterium
GRLIGKRPWLVIGVWVALAGTLSLTA

SEQ ID NO: 310127 - protein, 26 aa, Mycobacterium
GRLIRPSPRYALAMFADRGVRLTNVG

SEQ ID NO: 310128 - protein, 36 aa, Mycobacterium
GRLKDLLINCGYPLIERFPLMLGTAGAVLAIGLARW

SEQ ID NO: 310129 - protein, 18 aa, Mycobacterium
GRLLAGAVFLVFAASTVA

SEQ ID NO: 310130 - protein, 20 aa, Mycobacterium
GRLLPLHLIAAGLAAAAIAA

SEQ ID NO: 310131 - protein, 20 aa, Mycobacterium
GRLLPVVGFLAAVLVLAHLC

SEQ ID NO: 310132 - protein, 23 aa, Mycobacterium
GRLLPWVLITGVVSWIISAVEER

SEQ ID NO: 310133 - protein, 19 aa, Mycobacterium
GRLLQLRIASQFGDGLFQA

SEQ ID NO: 310134 - protein, 23 aa, Mycobacterium
GRLMAVGGIPILLGPIGGPILGG

SEQ ID NO: 310135 - protein, 26 aa, Mycobacterium
GRLPAKELPGYWVAQVLGGLLAGTAL

SEQ ID NO: 310136 - protein, 23 aa, Mycobacterium
GRLPLLCCLLAFILTFFVTRTFV

SEQ ID NO: 310137 - protein, 17 aa, Mycobacterium
GRLRALSVFGLIGCLVL

SEQ ID NO: 310138 - protein, 17 aa, Mycobacterium
GRLRGMDGVWVADASIL

SEQ ID NO: 310139 - protein, 23 aa, Mycobacterium
GRLRLLSDRSFEIPDDLASAVAR

SEQ ID NO: 310140 - protein, 21 aa, Mycobacterium
GRLRYPARLGYWPAAAGLFAF

SEQ ID NO: 310141 - protein, 24 aa, Mycobacterium
GRLSDTRPGIVIGAGGPALLAGWA

SEQ ID NO: 310142 - protein, 21 aa, Mycobacterium
GRLSLDWMIFGKNWFDGWGGL

SEQ ID NO: 310143 - protein, 20 aa, Mycobacterium
GRLSRHFGERTRAWITTVLA

SEQ ID NO: 310144 - protein, 17 aa, Mycobacterium
GRLSSLVARARAAVTGA

SEQ ID NO: 310145 - protein, 18 aa, Mycobacterium
GRLSTMIKTAGANVSADE

SEQ ID NO: 310146 - protein, 19 aa, Mycobacterium
GRLSWPKVLGGGMLSGAWL

SEQ ID NO: 310147 - protein, 19 aa, Mycobacterium
GRLSWPKVLGGGVLSGAWL

SEQ ID NO: 310148 - protein, 18 aa, Mycobacterium
GRLTTWVRSWWHDLEFVQ

SEQ ID NO: 310149 - protein, 17 aa, Mycobacterium
GRLVFPALGPGEWNAHQ

SEQ ID NO: 310150 - protein, 19 aa, Mycobacterium
GRLVTMLLVGVVLLAVGYS

SEQ ID NO: 310151 - protein, 21 aa, Mycobacterium
GRLVVFSSIAGARVRRANYVY

SEQ ID NO: 310152 - protein, 20 aa, Mycobacterium
GRLYPALNFTSARLATGTAG

SEQ ID NO: 310153 - protein, 18 aa, Mycobacterium
GRMGFGFGKSKAKMLSKD

SEQ ID NO: 310154 - protein, 23 aa, Mycobacterium
GRMLFGVELWDWVNPNNVIRNGD

SEQ ID NO: 310155 - protein, 23 aa, Mycobacterium
GRMLGFLGEPRVNVLELNIALDT

SEQ ID NO: 310156 - protein, 20 aa, Mycobacterium
GRMLRYPRAVALLTAGYSVG

SEQ ID NO: 310157 - protein, 18 aa, Mycobacterium
GRMQLRLGPNRVGPRGLL

SEQ ID NO: 310158 - protein, 18 aa, Mycobacterium
GRMRLEITGFIGCAVGLA

SEQ ID NO: 310159 - protein, 21 aa, Mycobacterium
GRMSLTRAVHIISEVAKALDY

SEQ ID NO: 310160 - protein, 24 aa, Mycobacterium
GRMTFGPELWRWVDPNGASDTDRA

SEQ ID NO: 310161 - protein, 20 aa, Mycobacterium
GRMVGRFGSRPSLVSAGVLI

SEQ ID NO: 310162 - protein, 18 aa, Mycobacterium
GRMYRTGDLVVRRADDNI

SEQ ID NO: 310163 - protein, 20 aa, Mycobacterium
GRNAPPFLRTILAYIALTKP

SEQ ID NO: 310164 - protein, 17 aa, Mycobacterium
GRNCVACGRQTRRSYYG

SEQ ID NO: 310165 - protein, 17 aa, Mycobacterium
GRNIFSFVTRIFPSHVR

SEQ ID NO: 310166 - protein, 19 aa, Mycobacterium
GRNIWRYVVQIIPAHVRDR

SEQ ID NO: 310167 - protein, 23 aa, Mycobacterium
GRNRLGAALCGLALLTGSALQRF

SEQ ID NO: 310168 - protein, 29 aa, Mycobacterium
GRNVAATGACWCLGLAAWAVAAVSHNLLI

SEQ ID NO: 310169 - protein, 20 aa, Mycobacterium
GRNVAIKVLPTFGDDESRER

SEQ ID NO: 310170 - protein, 20 aa, Mycobacterium
GRNVPRIKGRGMSLGTHETP

SEQ ID NO: 310171 - protein, 18 aa, Mycobacterium
GRNWTVFSALVLAVPTAL

SEQ ID NO: 310172 - protein, 19 aa, Mycobacterium
GRNWTVFSALVLLIPTVMT

SEQ ID NO: 310173 - protein, 19 aa, Mycobacterium
GRPAGVLAVADTVKDDSMA

SEQ ID NO: 310174 - protein, 26 aa, Mycobacterium
GRPFRRRNYLPALILGIALLAVTVFV

SEQ ID NO: 310175 - protein, 26 aa, Mycobacterium
GRPGCADSPVGVRCAAAMALASEEPV

SEQ ID NO: 310176 - protein, 25 aa, Mycobacterium
GRPGLELFADVALTCVASAMLGLAL

SEQ ID NO: 310177 - protein, 19 aa, Mycobacterium
GRPGRGITRDRRHMLIGLP

SEQ ID NO: 310178 - protein, 26 aa, Mycobacterium
GRPGSLEWWAGVGFVGAILAGVAAPL

SEQ ID NO: 310179 - protein, 20 aa, Mycobacterium
GRPGSMATIAIVVGVLAAVS

SEQ ID NO: 310180 - protein, 21 aa, Mycobacterium
GRPGSREWLAGVGFSAAIAMA

SEQ ID NO: 310181 - protein, 25 aa, Mycobacterium
GRPITRCYHGALIRFRDGGRTVTAV

SEQ ID NO: 310182 - protein, 20 aa, Mycobacterium
GRPLIRLSYLNELRNAGLRY

SEQ ID NO: 310183 - protein, 32 aa, Mycobacterium; identical to SEQ ID NO: 11131

SEQ ID NO: 310184 - protein, 17 aa, Mycobacterium
GRPPALRLHDLGKVIDL

SEQ ID NO: 310185 - protein, 22 aa, Mycobacterium
GRPPRVVPVIGLLGCVVLAFAM

SEQ ID NO: 310186 - protein, 17 aa, Mycobacterium
GRPPSKFYVRGVGTDGV

SEQ ID NO: 310187 - protein, 18 aa, Mycobacterium
GRPPSKFYVRGVGTNGTP

SEQ ID NO: 310188 - protein, 25 aa, Mycobacterium
GRPRPVEFLFGWDGWLWVHQIGCVI

SEQ ID NO: 310189 - protein, 17 aa, Mycobacterium
GRPSFWYDEAATISAAY

SEQ ID NO: 310190 - protein, 22 aa, Mycobacterium
GRPTEAMAFLAIAAILDALDGR

SEQ ID NO: 310191 - protein, 19 aa, Mycobacterium
GRPTGAVLLRDPLRRHAPR

SEQ ID NO: 310192 - protein, 25 aa, Mycobacterium
GRPVHGRGLLTLSLLTLIGVTGHFV

SEQ ID NO: 310193 - protein, 17 aa, Mycobacterium
GRPYIVMSYCAAGSLGL

SEQ ID NO: 310194 - protein, 19 aa, Mycobacterium
GRPYLNRGVFLGGVAVTFA

SEQ ID NO: 310195 - protein, 25 aa, Mycobacterium
GRQARARVPVAIFVKEPSPALVSTA

SEQ ID NO: 310196 - protein, 19 aa, Mycobacterium
GRQIRSARALAAKANVIVD

SEQ ID NO: 310197 - protein, 19 aa, Mycobacterium
GRQPAMVISILCFSIGSFL

SEQ ID NO: 310198 - protein, 21 aa, Mycobacterium
GRQVIGLNLILSFSPAWTYVR

SEQ ID NO: 310199 - protein, 29 aa, Mycobacterium
GRQWGRYLRRGALPVLLVASLAVSGFLGW

SEQ ID NO: 310200 - protein, 18 aa, Mycobacterium
GRQYWRITREYFVGPRSI

SEQ ID NO: 310201 - protein, 22 aa, Mycobacterium
GRRAERRLAFALVAPATILMLL

SEQ ID NO: 310202 - protein, 26 aa, Mycobacterium
GRRDLGVAFGWSMFNWVADVACLGFA

SEQ ID NO: 310203 - protein, 17 aa, Mycobacterium
GRRGWIAPRTDLSRRFW

SEQ ID NO: 310204 - protein, 18 aa, Mycobacterium
GRRHHVVIIGSGFGGLNA

SEQ ID NO: 310205 - protein, 26 aa, Mycobacterium
GRRKFLPPFSTWYAAMLFAVVPLRNI

SEQ ID NO: 310206 - protein, 20 aa, Mycobacterium
GRRLRGWVRDSWAPSMRAAP

SEQ ID NO: 310207 - protein, 23 aa, Mycobacterium
GRRPGARLKTVFLVVLSALTLAS

SEQ ID NO: 310208 - protein, 22 aa, Mycobacterium
GRRPMSVGFWFSLGHSSIVFIM

SEQ ID NO: 310209 - protein, 28 aa, Mycobacterium
GRRQFLPPLCTWFAAMLFAVVPLRNILP

SEQ ID NO: 310210 - protein, 23 aa, Mycobacterium
GRRQSVLMIAGWIAAAVSAAFGA

SEQ ID NO: 310211 - protein, 22 aa, Mycobacterium
GRRQVRAYARFLAENVPGCGHA

SEQ ID NO: 310212 - protein, 17 aa, Mycobacterium
GRRRAEDTGGFSVADLL

SEQ ID NO: 310213 - protein, 19 aa, Mycobacterium
GRRRWGWLALTTALAGWAI

SEQ ID NO: 310214 - protein, 24 aa, Mycobacterium
GRRSAGIEPVRVGIGIGVVHDSGD

SEQ ID NO: 310215 - protein, 28 aa, Mycobacterium
GRRSDRWGHLLGCAMSLAAFAVGTVLFA

SEQ ID NO: 310216 - protein, 24 aa, Mycobacterium
GRRVPLIDIRDGLAMNLGRADGPR

SEQ ID NO: 310217 - protein, 19 aa, Mycobacterium
GRRVVAWAVIDAVVVVYAL

SEQ ID NO: 310218 - protein, 21 aa, Mycobacterium
GRRWGRGIAVIANLLLLPVAW

SEQ ID NO: 310219 - protein, 20 aa, Mycobacterium
GRRWGRGIAVMMQLLLLPVA

SEQ ID NO: 310220 - protein, 18 aa, Mycobacterium
GRRWVRPAEQWAAGHHVD

SEQ ID NO: 310221 - protein, 21 aa, Mycobacterium
GRSAGRLRWDQVVAGDPLLGA

SEQ ID NO: 310222 - protein, 24 aa, Mycobacterium
GRSGWRSSTSLRWCSARWHWRSRS

SEQ ID NO: 310223 - protein, 18 aa, Mycobacterium
GRSKTGAGPINFDGGKAK

SEQ ID NO: 310224 - protein, 21 aa, Mycobacterium
GRSQMAAALLRHLAGDRIDVR

SEQ ID NO: 310225 - protein, 29 aa, Mycobacterium
GRSQSRRLLPYTWLGAGAVALGVGAALTG

SEQ ID NO: 310226 - protein, 18 aa, Mycobacterium
GRSRDFWGSAARLVKRLA

SEQ ID NO: 310227 - protein, 18 aa, Mycobacterium
GRSRFQARNLVAVAGLAV

SEQ ID NO: 310228 - protein, 25 aa, Mycobacterium
GRSRWQRFRMLLAVLGPGLIVMVGD

SEQ ID NO: 310229 - protein, 17 aa, Mycobacterium
GRSSLEEPIAVIGMGCR

SEQ ID NO: 310230 - protein, 17 aa, Mycobacterium
GRSVCPMAVQPDGTFES

SEQ ID NO: 310231 - protein, 21 aa, Mycobacterium
GRSWVTRTGFVLAAMAVAKLF

SEQ ID NO: 310232 - protein, 20 aa, Mycobacterium
GRTAMTWLLGATFALAFVNP

SEQ ID NO: 310233 - protein, 20 aa, Mycobacterium
GRTAMTWLLGVTFALAFVNP

SEQ ID NO: 310234 - protein, 20 aa, Mycobacterium
GRTATSFALLTGQIVGVGYT

SEQ ID NO: 310235 - protein, 17 aa, Mycobacterium
GRTAVLGAMAVDRPTLY

SEQ ID NO: 310236 - protein, 19 aa, Mycobacterium
GRTAYLVMELINGEPLNSV

SEQ ID NO: 310237 - protein, 19 aa, Mycobacterium
GRTAYLVMELVNGEPLNSV

SEQ ID NO: 310238 - protein, 30 aa, Mycobacterium
GRTEATMLWLRNWLRAHRRQIIAVAVGLAG

SEQ ID NO: 310239 - protein, 17 aa, Mycobacterium
GRTGEVLAHAGANPCTD

SEQ ID NO: 310240 - protein, 19 aa, Mycobacterium
GRTGIGLKLTGKRVAQAWA

SEQ ID NO: 310241 - protein, 17 aa, Mycobacterium
GRTGRYKIFPVLGTALM

SEQ ID NO: 310242 - protein, 23 aa, Mycobacterium
GRTGRYKIFPVMGTAIMVVGFLL

SEQ ID NO: 310243 - protein, 17 aa, Mycobacterium
GRTGRYKVFPVTGTALM

SEQ ID NO: 310244 - protein, 20 aa, Mycobacterium
GRTHPLRIAGMVGLASAVVI

SEQ ID NO: 310245 - protein, 19 aa, Mycobacterium
GRTIREFIGAVLLVPTVIA

SEQ ID NO: 310246 - protein, 19 aa, Mycobacterium
GRTIRQFIAGVLFVPSVVS

SEQ ID NO: 310247 - protein, 18 aa, Mycobacterium
GRTPEFLGKKIGRRQITM

SEQ ID NO: 310248 - protein, 24 aa, Mycobacterium
GRTPKGRWVSWFALLTIPTPFLAN

SEQ ID NO: 310249 - protein, 19 aa, Mycobacterium
GRTSFYGIVLIGYVAAFTL

SEQ ID NO: 310250 - protein, 19 aa, Mycobacterium
GRTSRQWMAGLAIGLTLVL

SEQ ID NO: 310251 - protein, 22 aa, Mycobacterium
GRTSVGALVRWATDEQLPVRHS

SEQ ID NO: 310252 - protein, 27 aa, Mycobacterium
GRTTACATLMREIRRVYAPGADGATGP

SEQ ID NO: 310253 - protein, 25 aa, Mycobacterium
GRTTFLPPLGTWFAALLFAVVPLRN

SEQ ID NO: 310254 - protein, 19 aa, Mycobacterium
GRTVPFTVVGADPDDDIAV

SEQ ID NO: 310255 - protein, 27 aa, Mycobacterium
GRTYLHTAWWLSFFPGLAIVITTVSAT

SEQ ID NO: 310256 - protein, 19 aa, Mycobacterium
GRVAGKNVGVWTVAAVTFA

SEQ ID NO: 310257 - protein, 24 aa, Mycobacterium
GRVERARALGFWGAVVGISMALGP

SEQ ID NO: 310258 - protein, 18 aa, Mycobacterium
GRVGIGIKLTGGRTAQAW

SEQ ID NO: 310259 - protein, 19 aa, Mycobacterium
GRVGTHVSIGRFDSVVTEI

SEQ ID NO: 310260 - protein, 20 aa, Mycobacterium
GRVIPGLAIREGTLHQYPLY

SEQ ID NO: 310261 - protein, 20 aa, Mycobacterium
GRVIPGLAIREGTVHQYPLY

SEQ ID NO: 310262 - protein, 20 aa, Mycobacterium
GRVKVGPDLSIPGHPNVFVV

SEQ ID NO: 310263 - protein, 20 aa, Mycobacterium
GRVLASRTMRAVGRVSYSWY

SEQ ID NO: 310264 - protein, 23 aa, Mycobacterium
GRVLCALAHGLMWSVIAPIGVRL

SEQ ID NO: 310265 - protein, 18 aa, Mycobacterium
GRVLCRPVMRAIGRVSYS

SEQ ID NO: 310266 - protein, 24 aa, Mycobacterium
GRVRRLPGVIAIVVLLFLACAPVA

SEQ ID NO: 310267 - protein, 18 aa, Mycobacterium
GRVRVLRGGCALAAVGML

SEQ ID NO: 310268 - protein, 19 aa, Mycobacterium
GRWARSVCRAAGFEPDVRF

SEQ ID NO: 310269 - protein, 29 aa, Mycobacterium
GRWEWSPLYFKEISWVGSNAFGVEEVEGV

SEQ ID NO: 310270 - protein, 18 aa, Mycobacterium
GRYFEKRSKRQAGAALRA

SEQ ID NO: 310271 - protein, 29 aa, Mycobacterium
GRYFYLKWWKLLLVLLGVWSAAAVAGFGL

SEQ ID NO: 310272 - protein, 19 aa, Mycobacterium
GRYHGIWSMTLAIASVVAP

SEQ ID NO: 310273 - protein, 25 aa, Mycobacterium
GRYKIFPVLGTALMTLAFLLMSRMD

SEQ ID NO: 310274 - protein, 29 aa, Mycobacterium
GRYQYLKWWKLLLVILGVWFGAAEVGLSL

SEQ ID NO: 310275 - protein, 31 aa, Mycobacterium
GRYRLLVFHGGIPPLQFWQALDTALDRQVAL

SEQ ID NO: 310276 - protein, 19 aa, Mycobacterium
GRYRRLWEGHRHEQSSVLA

SEQ ID NO: 310277 - protein, 21 aa, Mycobacterium
GRYTGDIAFYCYGEGKAEAIR

SEQ ID NO: 310278 - protein, 23 aa, Mycobacterium
GRYTGEIAFYCYGEGKAQAIKAL

SEQ ID NO: 310279 - protein, 22 aa, Mycobacterium
GRYVVISALGGLRCRASRIVLH

SEQ ID NO: 310280 - protein, 17 aa, Mycobacterium
GSAARAYGARNLAQSQH

SEQ ID NO: 310281 - protein, 30 aa, Mycobacterium
GSAARLAFVIAVIWVFLRRRGHHQPSPARQ

SEQ ID NO: 310282 - protein, 30 aa, Mycobacterium
GSAARLVKRLAPQRRLSIAVISLGITGTAI

SEQ ID NO: 310283 - protein, 22 aa, Mycobacterium
GSADLFAVVGLLFVGTVALTLA

SEQ ID NO: 310284 - protein, 24 aa, Mycobacterium
GSAECRFTFAFPVTEGEDLYIVSV

SEQ ID NO: 310285 - protein, 22 aa, Mycobacterium
GSAFPGDGWLGSAADHYSGKNR

SEQ ID NO: 310286 - protein, 21 aa, Mycobacterium
GSAFRPLPGPAPGPGSAPPNQ

SEQ ID NO: 310287 - protein, 25 aa, Mycobacterium
GSAGEFRHGLLIGVAIAAVFVVAPV

SEQ ID NO: 310288 - protein, 22 aa, Mycobacterium
GSAHRVADRWSQFVTKHRLLAI

SEQ ID NO: 310289 - protein, 17 aa, Mycobacterium
GSAIVLAGVVARAVGDH

SEQ ID NO: 310290 - protein, 17 aa, Mycobacterium
GSAKFDLLASFTDDGTA

SEQ ID NO: 310291 - protein, 17 aa, Mycobacterium
GSANLGALVSHTITHPG

SEQ ID NO: 310292 - protein, 17 aa, Mycobacterium
GSAPLWSGRMFVEARWL

SEQ ID NO: 310293 - protein, 17 aa, Mycobacterium
GSAPVTRSSVLTLFNQR

SEQ ID NO: 310294 - protein, 26 aa, Mycobacterium
GSAQRWKAIRGELGWMTTYAYPAEAI

SEQ ID NO: 310295 - protein, 19 aa, Mycobacterium
GSAQWGLGIGGAIVLTLVL

SEQ ID NO: 310296 - protein, 25 aa, Mycobacterium
GSARRWRRGAGMLAVPLCLLSAALV

SEQ ID NO: 310297 - protein, 21 aa, Mycobacterium
GSARVPTLWIVLGPLGQSITA

SEQ ID NO: 310298 - protein, 19 aa, Mycobacterium
GSASFWTFGIIAMVTLLAK

SEQ ID NO: 310299 - protein, 25 aa, Mycobacterium
GSASMAAFMTWRITAEMPPGFDADR

SEQ ID NO: 310300 - protein, 20 aa, Mycobacterium
GSATLLAWVMLVSALGAGLT

SEQ ID NO: 310301 - protein, 25 aa, Mycobacterium
GSATNCARTALLLVEPTTATMAVVD

SEQ ID NO: 310302 - protein, 18 aa, Mycobacterium
GSAVVLAGIVARVVADPS

SEQ ID NO: 310303 - protein, 22 aa, Mycobacterium
GSAWSAANARFNDYFREIATRF

SEQ ID NO: 310304 - protein, 23 aa, Mycobacterium
GSAWSAASARYGFYLRDIVTRFE

SEQ ID NO: 310305 - protein, 19 aa, Mycobacterium
GSDAARLAGVAAKDGAAGF

SEQ ID NO: 310306 - protein, 25 aa, Mycobacterium
GSDAERAAAAWVLADLPLDTFLNEA

SEQ ID NO: 310307 - protein, 17 aa, Mycobacterium
GSDGVVIPGSYRNRHDA

SEQ ID NO: 310308 - protein, 24 aa, Mycobacterium
GSDHLPWLGLGFFVVIPVVGGLLY

SEQ ID NO: 310309 - protein, 27 aa, Mycobacterium
GSDPVFLDWLVGLAFPCQRPFGHKNGV

SEQ ID NO: 310310 - protein, 24 aa, Mycobacterium
GSDRLIVGVSLNLADQIISRKNIT

SEQ ID NO: 310311 - protein, 19 aa, Mycobacterium
GSDSVQWKLNPGVVSSFTA

SEQ ID NO: 310312 - protein, 22 aa, Mycobacterium
GSEARLSWLLSGLAGMVGAVAF

SEQ ID NO: 310313 - protein, 18 aa, Mycobacterium
GSFAWCVHMLGALIRPRG

SEQ ID NO: 310314 - protein, 24 aa, Mycobacterium
GSFDARTGIGWLVCGVAGTLTIAW

SEQ ID NO: 310315 - protein, 19 aa, Mycobacterium
GSFGSFIGFAFALSQVLHI

SEQ ID NO: 310316 - protein, 17 aa, Mycobacterium
GSFLEFGTLAGFSLGAL

SEQ ID NO: 310317 - protein, 22 aa, Mycobacterium
GSFLLCAAFNVLLRGLCGRDVA

SEQ ID NO: 310318 - protein, 24 aa, Mycobacterium
GSFLMMAGPLAMIAVLLDRFGRHE

SEQ ID NO: 310319 - protein, 17 aa, Mycobacterium
GSFMLMPYLVGYLTGPL

SEQ ID NO: 310320 - protein, 24 aa, Mycobacterium
GSFMNFAYGWAFSNPVRKIYYNIT

SEQ ID NO: 310321 - protein, 24 aa, Mycobacterium
GSFPARIGLMTGIYTAALQGGGAL

SEQ ID NO: 310322 - protein, 26 aa, Mycobacterium
GSFTSRPRWLSALRQLTFGAIAIGAT

SEQ ID NO: 310323 - protein, 17 aa, Mycobacterium
GSFVAERVRPQKYRDQA

SEQ ID NO: 310324 - protein, 19 aa, Mycobacterium
GSFVARADMFTGLATGIVA

SEQ ID NO: 310325 - protein, 24 aa, Mycobacterium
GSFYRPQLGPGYLFRGMAWVLGPH

SEQ ID NO: 310326 - protein, 24 aa, Mycobacterium
GSGALSWLSPLGWSLQVRPYAGDH

SEQ ID NO: 310327 - protein, 20 aa, Mycobacterium
GSGGASLWWMIGLLAAAGVL

SEQ ID NO: 310328 - protein, 23 aa, Mycobacterium
GSGHPGPGIGLVIAWIAVILLTF

SEQ ID NO: 310329 - protein, 17 aa, Mycobacterium
GSGIDIPLIKPALEAAT

SEQ ID NO: 310330 - protein, 21 aa, Mycobacterium
GSGKSEFFLSLVYGIALTHSP

SEQ ID NO: 310331 - protein, 23 aa, Mycobacterium
GSGLPSDIWKATMDGALKGTQNE

SEQ ID NO: 310332 - protein, 18 aa, Mycobacterium
GSGPLRFFLTFHDGVATE

SEQ ID NO: 310333 - protein, 17 aa, Mycobacterium
GSGQSRWSYERDSALCG

SEQ ID NO: 310334 - protein, 25 aa, Mycobacterium
GSGRAPGALVALWRGTVVVLQSIMA

SEQ ID NO: 310335 - protein, 22 aa, Mycobacterium
GSGTMHPMALIPVSRTSSPYSL

SEQ ID NO: 310336 - protein, 21 aa, Mycobacterium
GSGWLGTTCLDEWQIGILGIS

SEQ ID NO: 310337 - protein, 17 aa, Mycobacterium
GSGYMANYYRWFGTPES

SEQ ID NO: 310338 - protein, 22 aa, Mycobacterium
GSGYRNPPSLVRRADGQTVQLT

SEQ ID NO: 310339 - protein, 17 aa, Mycobacterium
GSHISRTLSTLTPTFPT

SEQ ID NO: 310340 - protein, 19 aa, Mycobacterium
GSHLARLELRVALEEFLAR

SEQ ID NO: 310341 - protein, 23 aa, Mycobacterium
GSHPRLGRNLALHPATMLAGRFE

SEQ ID NO: 310342 - protein, 22 aa, Mycobacterium
GSHVELYVGFVHRDEADEMSGH

SEQ ID NO: 310343 - protein, 22 aa, Mycobacterium
GSIARVTRRLAAIADDVDPSLN

SEQ ID NO: 310344 - protein, 22 aa, Mycobacterium
GSIEPALRFYVIFFVGLLVVTW

SEQ ID NO: 310345 - protein, 19 aa, Mycobacterium
GSIFFAVAFTGWYPDYATA

SEQ ID NO: 310346 - protein, 18 aa, Mycobacterium
GSIGTPALWFMCAGLGLL

SEQ ID NO: 310347 - protein, 25 aa, Mycobacterium
GSIKSAAIGAAFDWLSVDPPPNPKK

SEQ ID NO: 310348 - protein, 24 aa, Mycobacterium
GSILVLGGIVVEWRMRRRNTLSAI

SEQ ID NO: 310349 - protein, 29 aa, Mycobacterium
GSIPAFLLIRFGGIYPVIFVGVLLIGLME

SEQ ID NO: 310350 - protein, 19 aa, Mycobacterium
GSISDLFGRVPVMRFGLVV

SEQ ID NO: 310351 - protein, 27 aa, Mycobacterium
GSIVAFNIIKWIGVAYLIYLAVRQWRT

SEQ ID NO: 310352 - protein, 23 aa, Mycobacterium
GSKAGLLPLHAWLPRAHPEAPSP

SEQ ID NO: 310353 - protein, 23 aa, Mycobacterium
GSKAGLLPLHAWLPRAHPESPSP

SEQ ID NO: 310354 - protein, 18 aa, Mycobacterium
GSKPLVFSSRSWILATER

SEQ ID NO: 310355 - protein, 26 aa, Mycobacterium
GSKSEWPLQKGFDRYYGFLGGETNNW

SEQ ID NO: 310356 - protein, 18 aa, Mycobacterium
GSLALLIMQMRRGRQAQP

SEQ ID NO: 310357 - protein, 25 aa, Mycobacterium
GSLARALCIAVDPDLLVTVNAMTNG

SEQ ID NO: 310358 - protein, 44 aa, Mycobacterium
GSLARRFSVLILLVCLFGVIALLLRRGSVPGAHNGPVWRLVGTT

SEQ ID NO: 310359 - protein, 20 aa, Mycobacterium
GSLARVTGRLSTSASDVYPA

SEQ ID NO: 310360 - protein, 17 aa, Mycobacterium
GSLFAGTFRSFVPVTLV

SEQ ID NO: 310361 - protein, 21 aa, Mycobacterium
GSLFGKTAMFLAVLFAIGMNV

SEQ ID NO: 310362 - protein, 24 aa, Mycobacterium
GSLFGRTAMFLAVLFAVGMNIYTY

SEQ ID NO: 310363 - protein, 17 aa, Mycobacterium
GSLFGRVGLGIGALLAV

SEQ ID NO: 310364 - protein, 17 aa, Mycobacterium
GSLFPFLFITIACGALS

SEQ ID NO: 310365 - protein, 25 aa, Mycobacterium
GSLGELWPAFDAIRRVPKAAQNGSI

SEQ ID NO: 310366 - protein, 25 aa, Mycobacterium
GSLGILRLVSLFGPVHFFAQPVVSL

SEQ ID NO: 310367 - protein, 20 aa, Mycobacterium
GSLLLILAMFEGFFGYSLPD

SEQ ID NO: 310368 - protein, 20 aa, Mycobacterium
GSLLWGMAFDGFRPDRADIV

SEQ ID NO: 310369 - protein, 21 aa, Mycobacterium
GSLPDVAKNFPVRQLVTNTGW

SEQ ID NO: 310370 - protein, 20 aa, Mycobacterium
GSLPRLLSTRVMVYGGEISF

SEQ ID NO: 310371 - protein, 18 aa, Mycobacterium
GSLRLWSQACASLAGGIL

SEQ ID NO: 310372 - protein, 20 aa, Mycobacterium
GSLVIVLALVAGFVGWKLYQ

SEQ ID NO: 310373 - protein, 19 aa, Mycobacterium
GSLVLLAWGAANRDPRQYD

SEQ ID NO: 310374 - protein, 23 aa, Mycobacterium
GSLVQLVSQWGFQQISWFVPAQW

SEQ ID NO: 310375 - protein, 17 aa, Mycobacterium
GSLVSMGFGRALRRELF

SEQ ID NO: 310376 - protein, 25 aa, Mycobacterium
GSLVTWWTGDALLVFDSGKLTQRYT

SEQ ID NO: 310377 - protein, 18 aa, Mycobacterium
GSLVVHWATMQELYGITD

SEQ ID NO: 310378 - protein, 21 aa, Mycobacterium
GSLWLLYRYYRERDPRFWLLT

SEQ ID NO: 310379 - protein, 35 aa, Mycobacterium
GSMARRFAVLILLLCLFGMLVILLRRGHVPGVASG

SEQ ID NO: 310380 - protein, 22 aa, Mycobacterium
GSMIRLVVLGLIMLPIIAGVLI

SEQ ID NO: 310381 - protein, 20 aa, Mycobacterium
GSMVIAFSICAAVAAYRGRE

SEQ ID NO: 310382 - protein, 22 aa, Mycobacterium
GSPACRALTAALPQHLGDYQRV

SEQ ID NO: 310383 - protein, 17 aa, Mycobacterium
GSPAQAWALGAVSVALV

SEQ ID NO: 310384 - protein, 25 aa, Mycobacterium
GSPATRSPVFLAFPAMTVASLVVTA

SEQ ID NO: 310385 - protein, 25 aa, Mycobacterium
GSPFHRARWGFADDRILPASASARQ

SEQ ID NO: 310386 - protein, 24 aa, Mycobacterium
GSPGSKIAIRWAARDAELRNVALT

SEQ ID NO: 310387 - protein, 17 aa, Mycobacterium
GSPLRARIDQALLELRE

SEQ ID NO: 310388 - protein, 22 aa, Mycobacterium
GSPLRIMILLVLVMAFGSALLD

SEQ ID NO: 310389 - protein, 23 aa, Mycobacterium
GSPSKFTMAGPWVGIAANGENVT

SEQ ID NO: 310390 - protein, 20 aa, Mycobacterium
GSPTRSEVCADYRTVRYSGQ

SEQ ID NO: 310391 - protein, 32 aa, Mycobacterium
GSPTWAAIFVWELARPPIWMLVVFLVTAVGAE

SEQ ID NO: 310392 - protein, 25 aa, Mycobacterium
GSPVPIPWSVLSLFASGPTLSRADA

SEQ ID NO: 310393 - protein, 23 aa, Mycobacterium
GSQEAAEIARWVQAHFTPITIDD

SEQ ID NO: 310394 - protein, 23 aa, Mycobacterium
GSQRKVVLRWSLLTLVIVSVFAA

SEQ ID NO: 310395 - protein, 30 aa, Mycobacterium
GSQRRLLLRVTRLDVVLAMAVAGTVNAAML

SEQ ID NO: 310396 - protein, 21 aa, Mycobacterium
GSRARRVFMIGAVSVLVVLAL

SEQ ID NO: 310397 - protein, 25 aa, Mycobacterium
GSRFGDGCGEFRKTDELQESAAPNE

SEQ ID NO: 310398 - protein, 22 aa, Mycobacterium
GSRFRRWRRLPAAVAVGGATAC

SEQ ID NO: 310399 - protein, 23 aa, Mycobacterium
GSRGRAGTALATFQMTSDIGLVV

SEQ ID NO: 310400 - protein, 18 aa, Mycobacterium
GSRIPQLIQVWLLELFFV

SEQ ID NO: 310401 - protein, 25 aa, Mycobacterium
GSRLIPRMMAAAAILATFFVVELTT

SEQ ID NO: 310402 - protein, 19 aa, Mycobacterium
GSRNMPCVDVPGKRAATPR

SEQ ID NO: 310403 - protein, 29 aa, Mycobacterium
GSRPEPDAHLPFRSGRAFSASVTGTQLTV

SEQ ID NO: 310404 - protein, 23 aa, Mycobacterium
GSRSEMRRALAMAPRKLQEIGLQ

SEQ ID NO: 310405 - protein, 28 aa, Mycobacterium
GSRVGSRFGPYELVRLIGRGGMGEVYEA

SEQ ID NO: 310406 - protein, 19 aa, Mycobacterium
GSRVLWLIHGVSVLLVVPQ

SEQ ID NO: 310407 - protein, 28 aa, Mycobacterium
GSSAAPLFHEIASWLLQRHNVPLSPDPG

SEQ ID NO: 310408 - protein, 28 aa, Mycobacterium
GSSAAPLFHNIASWLLRRENVPLSADPG

SEQ ID NO: 310409 - protein, 19 aa, Mycobacterium
GSSAVGWLGGLAFDAAGWS

SEQ ID NO: 310410 - protein, 23 aa, Mycobacterium
GSSDGPFHIDHVVPRAKGGTNAP

SEQ ID NO: 310411 - protein, 17 aa, Mycobacterium
GSSDPKVVLGLYEDFLC

SEQ ID NO: 310412 - protein, 23 aa, Mycobacterium
GSSLPAVVRWARMPDDVTRADEL

SEQ ID NO: 310413 - protein, 26 aa, Mycobacterium
GSSLREVLPLVVPVILASLLFAGGLV

SEQ ID NO: 310414 - protein, 19 aa, Mycobacterium
GSSRGWRAAKPTPRDDAWI

SEQ ID NO: 310415 - protein, 24 aa, Mycobacterium
GSSTTWRCSFEFDEPNPVQNGQKE

SEQ ID NO: 310416 - protein, 18 aa, Mycobacterium
GSTAPRVVTPDVLVNIPE

SEQ ID NO: 310417 - protein, 18 aa, Mycobacterium
GSTAPRVVTPDVLVNIPQ

SEQ ID NO: 310418 - protein, 31 aa, Mycobacterium
GSTEPRGQVVLPFTGLNFRFAPGGVAVDANG

SEQ ID NO: 310419 - protein, 18 aa, Mycobacterium
GSTGRRGPARSGYADQHV

SEQ ID NO: 310420 - protein, 33 aa, Mycobacterium
GSTGTPRPSYRFMREVYDLFVAPHYFGDSLFGV

SEQ ID NO: 310421 - protein, 26 aa, Mycobacterium
GSTIPERWRTLRWVLLGLAAIVAVAA

SEQ ID NO: 310422 - protein, 24 aa, Mycobacterium
GSTLKRRKVIGLSLGIGLGAFGAG

SEQ ID NO: 310423 - protein, 17 aa, Mycobacterium
GSTLVMWLGEMVTERGI

SEQ ID NO: 310424 - protein, 29 aa, Mycobacterium
GSTMGILTWIFVDGHFSKWLNFTPTPLTA

SEQ ID NO: 310425 - protein, 24 aa, Mycobacterium
GSTSCLLALLPQVRHLLQPGTAAA

SEQ ID NO: 310426 - protein, 23 aa, Mycobacterium
GSTSGVGWRARYWYDANQLDGFL

SEQ ID NO: 310427 - protein, 27 aa, Mycobacterium
GSTSLRVGVSVVWLSIIVLLPLAAIAW

SEQ ID NO: 310428 - protein, 24 aa, Mycobacterium
GSTSPARTFGWHRAEVFTAVANAA

SEQ ID NO: 310429 - protein, 27 aa, Mycobacterium
GSTVRRFNERFAAFGLPDTAMRPSYGL

SEQ ID NO: 310430 - protein, 25 aa, Mycobacterium
GSVAASGLVTWLGGMLLSGILTVVV

SEQ ID NO: 310431 - protein, 25 aa, Mycobacterium
GSVAFWICGLLLCMFIGPSQSSSRA

SEQ ID NO: 310432 - protein, 17 aa, Mycobacterium
GSVARLALVGATVPAVL

SEQ ID NO: 310433 - protein, 29 aa, Mycobacterium
GSVEDMLQRSGVPRPSLAAVAAVGGGAAI

SEQ ID NO: 310434 - protein, 19 aa, Mycobacterium
GSVHLRVWFAERLAEASGA

SEQ ID NO: 310435 - protein, 18 aa, Mycobacterium
GSVLKRFGPLTPPRAVAV

SEQ ID NO: 310436 - protein, 26 aa, Mycobacterium
GSVLKSAVSFLVLVWVILQSLAILGV

SEQ ID NO: 310437 - protein, 24 aa, Mycobacterium
GSVLPRPGPALGSRNGLEERVSEK

SEQ ID NO: 310438 - protein, 22 aa, Mycobacterium
GSVNRMAHQWLFTNSSSAQRDS

SEQ ID NO: 310439 - protein, 18 aa, Mycobacterium
GSVPFPISALISGLVNAA

SEQ ID NO: 310440 - protein, 18 aa, Mycobacterium
GSVPGYAVSPGIVVGSVI

SEQ ID NO: 310441 - protein, 22 aa, Mycobacterium
GSVPTSLKWIHLDVAAGRASLV

SEQ ID NO: 310442 - protein, 17 aa, Mycobacterium
GSVSFWGSLVAFAKLQE

SEQ ID NO: 310443 - protein, 18 aa, Mycobacterium
GSVSGTWGYRAELRGQWN

SEQ ID NO: 310444 - protein, 19 aa, Mycobacterium
GSVSRIRLLSSHLVIALAA

SEQ ID NO: 310445 - protein, 26 aa, Mycobacterium
GSVTEFRHGLLLGVAVAAVFVVAPVA

SEQ ID NO: 310446 - protein, 29 aa, Mycobacterium
GSVTWIIGAAWGWHGAGWMLTKLGFHDVG

SEQ ID NO: 310447 - protein, 25 aa, Mycobacterium
GSVTWPEAMGLVVINGLIIVLLAAT

SEQ ID NO: 310448 - protein, 22 aa, Mycobacterium
GSVVLRGRLVVRASAVGNETTI

SEQ ID NO: 310449 - protein, 21 aa, Mycobacterium
GSVVRKSVPLFVARIRGIPTI

SEQ ID NO: 310450 - protein, 26 aa, Mycobacterium
GSVVWIIGASWGWHGAGWMLTELGFH

SEQ ID NO: 310451 - protein, 25 aa, Mycobacterium
GSWARAHLRSGAQLRLPAVTFATLP

SEQ ID NO: 310452 - protein, 17 aa, Mycobacterium
GSWLHRLPAGVKLIGLG

SEQ ID NO: 310453 - protein, 17 aa, Mycobacterium
GSWNLPALACYVIGVVV

SEQ ID NO: 310454 - protein, 22 aa, Mycobacterium
GSWQSARFALSRVDTIPDEASC

SEQ ID NO: 310455 - protein, 22 aa, Mycobacterium
GSWQSARYALRRGAATPKSADC

SEQ ID NO: 310456 - protein, 24 aa, Mycobacterium
GSWRELLGGRYLRTSIVLAGGVAL

SEQ ID NO: 310457 - protein, 26 aa, Mycobacterium
GSYHRLHVHVSFWCGIFSLLFSGLMV

SEQ ID NO: 310458 - protein, 24 aa, Mycobacterium
GSYRAGSTLDVLWPASSLLVAIAS

SEQ ID NO: 310459 - protein, 27 aa, Mycobacterium
GSYSFESFRLAWTVQYAIWILATIGIL

SEQ ID NO: 310460 - protein, 17 aa, Mycobacterium
GTAALIAASVFKSTILR

SEQ ID NO: 310461 - protein, 22 aa, Mycobacterium
GTAASLRLVRDFAAEMRDDLSD

SEQ ID NO: 310462 - protein, 19 aa, Mycobacterium
GTAAWRGAADMEPIILRCG

SEQ ID NO: 310463 - protein, 22 aa, Mycobacterium
GTACSYTPPADALPRPWNPLPC

SEQ ID NO: 310464 - protein, 25 aa, Mycobacterium
GTAEPYPRYTCDYGTPKLPPSSADF

SEQ ID NO: 310465 - protein, 18 aa, Mycobacterium
GTAIEWYDFFIFGTAAGL

SEQ ID NO: 310466 - protein, 18 aa, Mycobacterium
GTAIGPRIETGGMVADVA

SEQ ID NO: 310467 - protein, 20 aa, Mycobacterium
GTAISEIWLSLDAAGQYLFA

SEQ ID NO: 310468 - protein, 20 aa, Mycobacterium
GTAISEIWLSLDSAGQWLFG

SEQ ID NO: 310469 - protein, 22 aa, Mycobacterium
GTAISEIWLSLDSVGQWLFGIY

SEQ ID NO: 310470 - protein, 26 aa, Mycobacterium
GTAISEIWLSLDVAGRWLFGIYGAAA

SEQ ID NO: 310471 - protein, 17 aa, Mycobacterium
GTALCLLQATYWELPAA

SEQ ID NO: 310472 - protein, 25 aa, Mycobacterium
GTANALCGIGIFALVIFATGLPLAY

SEQ ID NO: 310473 - protein, 28 aa, Mycobacterium
GTAPKSPKFPSLKNHLKSVPGLSEKKNP

SEQ ID NO: 310474 - protein, 17 aa, Mycobacterium
GTAPTVWSYAAMAVLFA

SEQ ID NO: 310475 - protein, 17 aa, Mycobacterium
GTARLYAPVLRGRKALL

SEQ ID NO: 310476 - protein, 30 aa, Mycobacterium
GTARMAAAMAIGLECGIVLTVPGVGALALA

SEQ ID NO: 310477 - protein, 23 aa, Mycobacterium
GTARPAVLAMLVVVLGLAGLVAF

SEQ ID NO: 310478 - protein, 37 aa, Mycobacterium
GTASFYRCLFALRLLAPLAVAEWRGGGSPTAAQHGWP

SEQ ID NO: 310479 - protein, 20 aa, Mycobacterium
GTASIIRFMLLRVAGAIDQA

SEQ ID NO: 310480 - protein, 28 aa, Mycobacterium
GTATHPDAGLLIGNGFSYTAETCPDGKV

SEQ ID NO: 310481 - protein, 18 aa, Mycobacterium
GTAVGWLAARGWRRPTAV

SEQ ID NO: 310482 - protein, 31 aa, Mycobacterium
GTAWALTMVHLRLSLIPVLIGTAIAIPLGLF

SEQ ID NO: 310483 - protein, 19 aa, Mycobacterium
GTAYGFPFGALPAGGAELP

SEQ ID NO: 310484 - protein, 24 aa, Mycobacterium
GTDHRGRVRIGTVLLSPVESDGSP

SEQ ID NO: 310485 - protein, 25 aa, Mycobacterium
GTDPGRRRSLLTIGLLAAGAVSGVA

SEQ ID NO: 310486 - protein, 28 aa, Mycobacterium
GTDRTGLKAVLPLAVHNKWVVLHDPGGP

SEQ ID NO: 310487 - protein, 17 aa, Mycobacterium
GTDVARRALEEGSGSPG

SEQ ID NO: 310488 - protein, 24 aa, Mycobacterium
GTDVFCAAVLRPALESVDDGALVS

SEQ ID NO: 310489 - protein, 20 aa, Mycobacterium
GTDYLERWSNFAALESVLTA

SEQ ID NO: 310490 - protein, 23 aa, Mycobacterium
GTEAFGVRGIRRLLWQLEPLGVE

SEQ ID NO: 310491 - protein, 17 aa, Mycobacterium
GTELLLDALAGRADVTL

SEQ ID NO: 310492 - protein, 30 aa, Mycobacterium
GTEPDFLRRWLPGQLLQGIGVGATLPVLSS

SEQ ID NO: 310493 - protein, 20 aa, Mycobacterium
GTETPAFWIFLLCYIAAAAL

SEQ ID NO: 310494 - protein, 21 aa, Mycobacterium
GTFALCLWYELMDGPEGQALS

SEQ ID NO: 310495 - protein, 24 aa, Mycobacterium
GTFIAGICGWWMVRSHKVGTLDDA

SEQ ID NO: 310496 - protein, 24 aa, Mycobacterium
GTFINLRCVCLAPPDAHHDTLAMV

SEQ ID NO: 310497 - protein, 33 aa, Mycobacterium
GTFISVLVLWDLLGHLPLPLGVAGHEGSTVLVA

SEQ ID NO: 310498 - protein, 17 aa, Mycobacterium
GTFLFVPTLRRWLSTEV

SEQ ID NO: 310499 - protein, 22 aa, Mycobacterium
GTFPLAALWPLLLLALATVFTY

SEQ ID NO: 310500 - protein, 20 aa, Mycobacterium
GTGAALCWAALVVSVPYGNL

SEQ ID NO: 310501 - protein, 17 aa, Mycobacterium
GTGGRGGFHTSGSGGHG

SEQ ID NO: 310502 - protein, 21 aa, Mycobacterium
GTGIWSRYPLTPVHQDDQGFA

SEQ ID NO: 310503 - protein, 20 aa, Mycobacterium
GTGKGARAGILIRSAEALET

SEQ ID NO: 310504 - protein, 21 aa, Mycobacterium
GTGKGARAGILIRSAEALETA

SEQ ID NO: 310505 - protein, 21 aa, Mycobacterium
GTGMGFLAVFVHWQSVNLREP

SEQ ID NO: 310506 - protein, 19 aa, Mycobacterium
GTGQIRFRDLPAIVSKEMS

SEQ ID NO: 310507 - protein, 18 aa, Mycobacterium
GTGQWGAPEGQWQGAPPA

SEQ ID NO: 310508 - protein, 35 aa, Mycobacterium
GTGRGRPSWRVLLVGLAVIVAWLLIVMLLSRLLAP

SEQ ID NO: 310509 - protein, 29 aa, Mycobacterium
GTGRGRPSWRVVLIGLAVILAWLLIVVVT

SEQ ID NO: 310510 - protein, 24 aa, Mycobacterium
GTGRLRPVPDLPDREGHAVYADSG

SEQ ID NO: 310511 - protein, 28 aa, Mycobacterium
GTGRRWLLRTGIVLKFVLAAALTVQCAF

SEQ ID NO: 310512 - protein, 30 aa, Mycobacterium
GTGRYLRVVLRWGALTAAGLLLVLAAARPG

SEQ ID NO: 310513 - protein, 17 aa, Mycobacterium
GTGSLFWVSDTGVRYGI

SEQ ID NO: 310514 - protein, 20 aa, Mycobacterium
GTGVKGRFLAWFYTAVGQVP

SEQ ID NO: 310515 - protein, 27 aa, Mycobacterium
GTGVLLHFFSWQSIFYMFAAGALLMFI

SEQ ID NO: 310516 - protein, 18 aa, Mycobacterium
GTGYPHLYSTLLADRGAA

SEQ ID NO: 310517 - protein, 18 aa, Mycobacterium
GTHDWPFATQAFKASLPW

SEQ ID NO: 310518 - protein, 20 aa, Mycobacterium
GTHTAFRRAGLIIGLASCSV

SEQ ID NO: 310519 - protein, 17 aa, Mycobacterium
GTIEAFIQYVRQFNQPV

SEQ ID NO: 310520 - protein, 18 aa, Mycobacterium
GTIGALVGIVAGYRGGWA

SEQ ID NO: 310521 - protein, 19 aa, Mycobacterium
GTIGGLFTAVSIPFLMFTQ

SEQ ID NO: 310522 - protein, 24 aa, Mycobacterium
GTIHLGSINFDWGALLIVAVVATL

SEQ ID NO: 310523 - protein, 20 aa, Mycobacterium
GTILGWLVARGWRRPTSVAP

SEQ ID NO: 310524 - protein, 18 aa, Mycobacterium
GTIPRLSLTGLLDIARLR

SEQ ID NO: 310525 - protein, 17 aa, Mycobacterium
GTIRLASGVSFLVDPLR

SEQ ID NO: 310526 - protein, 17 aa, Mycobacterium
GTIVRFDGAVPFVNLQV

SEQ ID NO: 310527 - protein, 20 aa, Mycobacterium
GTKPRRLRSSLVPHDRNERS

SEQ ID NO: 310528 - protein, 18 aa, Mycobacterium
GTKQAYRGYYLDFNLNLN

SEQ ID NO: 310529 - protein, 23 aa, Mycobacterium
GTKRLLMASVLMFTAGSLLCALA

SEQ ID NO: 310530 - protein, 22 aa, Mycobacterium
GTKRRIMLTDFGIARRTDDVNG

SEQ ID NO: 310531 - protein, 32 aa, Mycobacterium
GTLADRVGYKWLIVSGCLLRTAGFALLVAAQS

SEQ ID NO: 310532 - protein, 26 aa, Mycobacterium
GTLAGFSCGALLMLGCSLVLGDEDMQ

SEQ ID NO: 310533 - protein, 21 aa, Mycobacterium
GTLAGLAGRVARLNQLANTAA

SEQ ID NO: 310534 - protein, 20 aa, Mycobacterium
GTLAGWLVSRGWRRPTSMTP

SEQ ID NO: 310535 - protein, 17 aa, Mycobacterium
GTLARWLEPVVGKHEEV

SEQ ID NO: 310536 - protein, 24 aa, Mycobacterium
GTLDALHRYGCMITQGYVHTAPLP

SEQ ID NO: 310537 - protein, 17 aa, Mycobacterium
GTLGGFAVGAAFVLVLD

SEQ ID NO: 310538 - protein, 18 aa, Mycobacterium
GTLGGLFTAMTIPYLMFT

SEQ ID NO: 310539 - protein, 19 aa, Mycobacterium
GTLGGLFTAVSIPFLMFTQ

SEQ ID NO: 310540 - protein, 27 aa, Mycobacterium
GTLIRARWRRWIAWVLPVFGLAVLGAA

SEQ ID NO: 310541 - protein, 20 aa, Mycobacterium
GTLLFIVWIRLMRSDLPVES

SEQ ID NO: 310542 - protein, 21 aa, Mycobacterium
GTLLIRRQFAPLARVSATARE

SEQ ID NO: 310543 - protein, 32 aa, Mycobacterium
GTLLMAVGFACMYRLNLHSSYLEFAWPTLVLA

SEQ ID NO: 310544 - protein, 27 aa, Mycobacterium
GTLLPHYRLLGGIPLAYAVIVSGALLR

SEQ ID NO: 310545 - protein, 19 aa, Mycobacterium
GTLLRAPRGWQRVGALTGR

SEQ ID NO: 310546 - protein, 19 aa, Mycobacterium
GTLLRRDGPLAAPRAIAII

SEQ ID NO: 310547 - protein, 17 aa, Mycobacterium
GTLLRRDLPLIADAAAQ

SEQ ID NO: 310548 - protein, 18 aa, Mycobacterium
GTLLSWYALVAALTTVPL

SEQ ID NO: 310549 - protein, 33 aa, Mycobacterium
GTLLWAVSRVSIFRLVRYLAREYLLIVSTSSSE

SEQ ID NO: 310550 - protein, 22 aa, Mycobacterium
GTLPATVFVAFQLMFAIITVAL

SEQ ID NO: 310551 - protein, 17 aa, Mycobacterium
GTLRIYLGAAPGVGKTF

SEQ ID NO: 310552 - protein, 20 aa, Mycobacterium
GTLRLLRLYLRRDRVGLPLW

SEQ ID NO: 310553 - protein, 22 aa, Mycobacterium
GTLRLVGYVVGKADPDRIRTQL

SEQ ID NO: 310554 - protein, 33 aa, Mycobacterium
GTLRRFAYRYSEGRAAHWLILLFADRVDVAEHR

SEQ ID NO: 310555 - protein, 17 aa, Mycobacterium
GTLRRIILPQATRVAVP

SEQ ID NO: 310556 - protein, 17 aa, Mycobacterium
GTLVAGIVAGQPGNDGF

SEQ ID NO: 310557 - protein, 18 aa, Mycobacterium
GTLVAWSSLVAVAGFARV

SEQ ID NO: 310558 - protein, 25 aa, Mycobacterium
GTLWLKSQVVALTFDDSGQVDGATI

SEQ ID NO: 310559 - protein, 17 aa, Mycobacterium
GTMTAAIIGGRPSPTDG

SEQ ID NO: 310560 - protein, 25 aa, Mycobacterium
GTNMLRFGRVTVRFGEPMDFSRFEG

SEQ ID NO: 310561 - protein, 32 aa, Mycobacterium
GTNRLLADENHRLVGTRVCWNDDLRAGQLRQA

SEQ ID NO: 310562 - protein, 24 aa, Mycobacterium
GTPDAVGVFADLPGSPEFSGPTSP

SEQ ID NO: 310563 - protein, 23 aa, Mycobacterium
GTPDRGVVVVCDLGGSGSSITLA

SEQ ID NO: 310564 - protein, 24 aa, Mycobacterium
GTPESPRWLLSRGRTEEAQRVCRK

SEQ ID NO: 310565 - protein, 23 aa, Mycobacterium
GTPGRRLQVPIGVVDCPFEQQQM

SEQ ID NO: 310566 - protein, 19 aa, Mycobacterium
GTPKCPGCLTGAAMHPSFL

SEQ ID NO: 310567 - protein, 17 aa, Mycobacterium
GTPLLRLVRELRADRGP

SEQ ID NO: 310568 - protein, 23 aa, Mycobacterium
GTPPIGQAMLEFTGQTPGNLIAV

SEQ ID NO: 310569 - protein, 32 aa, Mycobacterium
GTPQLLFNYLGRWAADACDDWASAPEVDALRT

SEQ ID NO: 310570 - protein, 23 aa, Mycobacterium
GTPRSWLVQEIACFVYTTTLLVL

SEQ ID NO: 310571 - protein, 24 aa, Mycobacterium
GTPSRVRAAGAWVAGHLSTRLLQG

SEQ ID NO: 310572 - protein, 20 aa, Mycobacterium
GTPTLALLFIAVGLRFIATT

SEQ ID NO: 310573 - protein, 25 aa, Mycobacterium
GTPTTRLGSMYGYGVGYAVASLSCT

SEQ ID NO: 310574 - protein, 25 aa, Mycobacterium
GTPTTRLTSMYGYGVGYAIASLSCT

SEQ ID NO: 310575 - protein, 23 aa, Mycobacterium
GTPYRFTPKVAWLTVVAGSAMGL

SEQ ID NO: 310576 - protein, 18 aa, Mycobacterium
GTQDLGLLILRVAIGGLL

SEQ ID NO: 310577 - protein, 19 aa, Mycobacterium
GTQDLGLLLLRVAVGALLI

SEQ ID NO: 310578 - protein, 17 aa, Mycobacterium
GTQEAKAPILQVLRYAP

SEQ ID NO: 310579 - protein, 19 aa, Mycobacterium
GTRGSRIIAAVAFALSPRV

SEQ ID NO: 310580 - protein, 24 aa, Mycobacterium
GTRIEMWCSYPVYGDDADDSAAAP

SEQ ID NO: 310581 - protein, 23 aa, Mycobacterium
GTRLRRPTIVLGLVVTLLGGALT

SEQ ID NO: 310582 - protein, 21 aa, Mycobacterium
GTRLWLRFAADTEARINVVEH

SEQ ID NO: 310583 - protein, 24 aa, Mycobacterium
GTRYQKLMFWIVGVVFLLLMVPAG

SEQ ID NO: 310584 - protein, 25 aa, Mycobacterium
GTSIALRCVCLAPLNAHHDTLAMVV

SEQ ID NO: 310585 - protein, 26 aa, Mycobacterium
GTSINLRCVCLAPLNAHHDTLAMVVV

SEQ ID NO: 310586 - protein, 23 aa, Mycobacterium
GTSRRSRWARLFEEGIGPRIVEL

SEQ ID NO: 310587 - protein, 21 aa, Mycobacterium
GTSTAAWDWAVPRGPDNQSLA

SEQ ID NO: 310588 - protein, 18 aa, Mycobacterium
GTSYDCLVLDLGLPDIDG

SEQ ID NO: 310589 - protein, 21 aa, Mycobacterium
GTSYGEHGNWVIGAPDVLLDP

SEQ ID NO: 310590 - protein, 19 aa, Mycobacterium
GTTALRVGAATVWLSVIVL

SEQ ID NO: 310591 - protein, 18 aa, Mycobacterium
GTTAYLLVYSVLALVPML

SEQ ID NO: 310592 - protein, 24 aa, Mycobacterium
GTTFPELDVPAVLARHPQVVLVDE

SEQ ID NO: 310593 - protein, 25 aa, Mycobacterium
GTTHRARPRPVAGLTTLPDDMSPGS

SEQ ID NO: 310594 - protein, 25 aa, Mycobacterium
GTTIRIGFCLLLILLGGAALTNGLV

SEQ ID NO: 310595 - protein, 18 aa, Mycobacterium
GTTLEWYDFLIYGTAAAL

SEQ ID NO: 310596 - protein, 23 aa, Mycobacterium
GTTLTAFLFAGKRLGMVHIGDSR

SEQ ID NO: 310597 - protein, 25 aa, Mycobacterium
GTTNPWPALWALLIGFFMILVDATI

SEQ ID NO: 310598 - protein, 21 aa, Mycobacterium
GTTPYYARMHKWIKRAVLVCL

SEQ ID NO: 310599 - protein, 36 aa, Mycobacterium
GTTVRWTVAFTPQWIGWFPLRWTAFAIRPFMSILLK

SEQ ID NO: 310600 - protein, 26 aa, Mycobacterium
GTTVVFGAFSHRWLARRTRRRINPGL

SEQ ID NO: 310601 - protein, 18 aa, Mycobacterium
GTTWCGRAYGSFRPAMFQ

SEQ ID NO: 310602 - protein, 25 aa, Mycobacterium
GTVAFSFAGAFGLSVMMWQHLIGLP

SEQ ID NO: 310603 - protein, 18 aa, Mycobacterium
GTVAITFMGLAFTDLGVF

SEQ ID NO: 310604 - protein, 23 aa, Mycobacterium
GTVFPPPAADIMLHGTGPNPQEV

SEQ ID NO: 310605 - protein, 30 aa, Mycobacterium
GTVGALRGALRTVPSLSPGGVPATLIPDST

SEQ ID NO: 310606 - protein, 22 aa, Mycobacterium
GTVGVFIGMLFVYRSGAIRVTP

SEQ ID NO: 310607 - protein, 17 aa, Mycobacterium
GTVLTGFVFVSRMPVSV

SEQ ID NO: 310608 - protein, 17 aa, Mycobacterium
GTVLTGFVFVSRVPVSM

SEQ ID NO: 310609 - protein, 17 aa, Mycobacterium
GTVRRWALRVGTVTAVA

SEQ ID NO: 310610 - protein, 34 aa, Mycobacterium
GTVSDRWGRRRVILMSLCAFVVLTIVTPLATDVG

SEQ ID NO: 310611 - protein, 18 aa, Mycobacterium
GTVVRFDGAVPFVNLQVS

SEQ ID NO: 310612 - protein, 21 aa, Mycobacterium
GTVVRKIVKLAFRGSDRQEAH

SEQ ID NO: 310613 - protein, 21 aa, Mycobacterium
GTVVRKIVRLALPWGSKPKSP

SEQ ID NO: 310614 - protein, 17 aa, Mycobacterium
GTVYWLVLLLYHFVANS

SEQ ID NO: 310615 - protein, 34 aa, Mycobacterium
GTWAALSVREVPSWLRRVIDAVFHLPIAIPSVAI

SEQ ID NO: 310616 - protein, 17 aa, Mycobacterium
GTWIAWAAWAAIVLAVV

SEQ ID NO: 310617 - protein, 19 aa, Mycobacterium
GTWIPAAAVGLLLYQNWFA

SEQ ID NO: 310618 - protein, 21 aa, Mycobacterium
GTWLVYRITRNVVKKRREEGF

SEQ ID NO: 310619 - protein, 28 aa, Mycobacterium
GTWTKLVGMPTPRGSYGATYIDGRIVVV

SEQ ID NO: 310620 - protein, 17 aa, Mycobacterium
GTYHSMMNFEVRVVPPN

SEQ ID NO: 310621 - protein, 17 aa, Mycobacterium
GTYHSMMNFEVRVVSPN

SEQ ID NO: 310622 - protein, 21 aa, Mycobacterium
GTYKFVCLMAGEPAKYSAAQQ

SEQ ID NO: 310623 - protein, 17 aa, Mycobacterium
GVAAAPRLGEPRLDDLV

SEQ ID NO: 310624 - protein, 19 aa, Mycobacterium
GVAALRYLAIDLVTGRFPW

SEQ ID NO: 310625 - protein, 22 aa, Mycobacterium
GVAALTFAGWALIAANPIAGMT

SEQ ID NO: 310626 - protein, 18 aa, Mycobacterium
GVAAMLAGKGVKSMLGPA

SEQ ID NO: 310627 - protein, 19 aa, Mycobacterium
GVAAMLASARLGRIAPVSR

SEQ ID NO: 310628 - protein, 25 aa, Mycobacterium
GVAAPFLWLAWLLRIPTVFVESITR

SEQ ID NO: 310629 - protein, 24 aa, Mycobacterium
GVAAPRPRHLVLVLDRSRSMAGWK

SEQ ID NO: 310630 - protein, 17 aa, Mycobacterium
GVAAVRITDDWYAPVGG

SEQ ID NO: 310631 - protein, 17 aa, Mycobacterium
GVAAVRLAPTHYGALAA

SEQ ID NO: 310632 - protein, 24 aa, Mycobacterium
GVACAVAARLSRVPVRDSLALGSL

SEQ ID NO: 310633 - protein, 23 aa, Mycobacterium
GVAEELPVLLAVFGVPAAVAGIG

SEQ ID NO: 310634 - protein, 25 aa, Mycobacterium
GVAEEVFFRGALYTALGRFHPVLIS

SEQ ID NO: 310635 - protein, 27 aa, Mycobacterium
GVAFALVAACFWALYILAGKRITGQQT

SEQ ID NO: 310636 - protein, 18 aa, Mycobacterium
GVAFIPFGIGVAIGVGAA

SEQ ID NO: 310637 - protein, 28 aa, Mycobacterium
GVAFKLYPRRAVLGLALFIGQAFLYNGV

SEQ ID NO: 310638 - protein, 24 aa, Mycobacterium
GVAFVKLAWLLAVSAYVSLVHGRV

SEQ ID NO: 310639 - protein, 19 aa, Mycobacterium
GVAGDWAAAAFFVAIAASS

SEQ ID NO: 310640 - protein, 22 aa, Mycobacterium
GVAGYAGELGHTFVGGQRLCHC

SEQ ID NO: 310641 - protein, 23 aa, Mycobacterium
GVAGYWLVHRSLRPLAEVEATAA

SEQ ID NO: 310642 - protein, 21 aa, Mycobacterium
GVAHLKWYDYPVAAGLSLVVL

SEQ ID NO: 310643 - protein, 17 aa, Mycobacterium
GVAHQRESLLLLLAGLT

SEQ ID NO: 310644 - protein, 25 aa, Mycobacterium
GVAIGYLGAFALRRIALPASGLYPI

SEQ ID NO: 310645 - protein, 18 aa, Mycobacterium
GVAILVGVLAFRRSRTRR

SEQ ID NO: 310646 - protein, 25 aa, Mycobacterium
GVAKLGMPLLVALLLCYLGGIVSAF

SEQ ID NO: 310647 - protein, 21 aa, Mycobacterium
GVALARGLLRLPARSRRRTGT

SEQ ID NO: 310648 - protein, 34 aa, Mycobacterium
GVALCAGQWALWWANGFSWIWMAVGLVGAAAALI

SEQ ID NO: 310649 - protein, 19 aa, Mycobacterium
GVALCALIAYVLGESKGYF

SEQ ID NO: 310650 - protein, 20 aa, Mycobacterium
GVALGFPLADPVIGLVITVA

SEQ ID NO: 310651 - protein, 29 aa, Mycobacterium
GVALILALRFHRATAWALLALFVVQFPIT

SEQ ID NO: 310652 - protein, 26 aa, Mycobacterium
GVALLVGWWLWERRITHPLVSTRMLA

SEQ ID NO: 310653 - protein, 19 aa, Mycobacterium
GVALMRWSPIDLLPKHHEA

SEQ ID NO: 310654 - protein, 20 aa, Mycobacterium
GVALPARWAESVMLTGAAMS

SEQ ID NO: 310655 - protein, 23 aa, Mycobacterium
GVALRQPWIGWLAVASVVLSLYL

SEQ ID NO: 310656 - protein, 34 aa, Mycobacterium
GVALSKLVLRFWLRHQKWWPLRDRVMITVKLGVV

SEQ ID NO: 310657 - protein, 27 aa, Mycobacterium
GVALTGVVCFAGFFASYMFNVYFQNGA

SEQ ID NO: 310658 - protein, 18 aa, Mycobacterium
GVALVMIFGFLVMGILVY

SEQ ID NO: 310659 - protein, 18 aa, Mycobacterium
GVAMCVAACLLLEYGVAT

SEQ ID NO: 310660 - protein, 29 aa, Mycobacterium
GVAMGLRFTHGWPAALLFLLTPSIVVTGF

SEQ ID NO: 310661 - protein, 19 aa, Mycobacterium
GVANAALWRYESDGTATLV

SEQ ID NO: 310662 - protein, 26 aa, Mycobacterium
GVANYGTWWFWLGLALIVGILLLVGN

SEQ ID NO: 310663 - protein, 19 aa, Mycobacterium
GVAQLPWMIGAVLVGTLCT

SEQ ID NO: 310664 - protein, 18 aa, Mycobacterium
GVARSPEYLWPARSRQDI

SEQ ID NO: 310665 - protein, 25 aa, Mycobacterium
GVARSPRLPPLIPGGDYVFEGGNGT

SEQ ID NO: 310666 - protein, 20 aa, Mycobacterium
GVASIIQSVGFWKIGVRLPL

SEQ ID NO: 310667 - protein, 18 aa, Mycobacterium
GVATCWIGPGANQTRVVE

SEQ ID NO: 310668 - protein, 19 aa, Mycobacterium
GVATRAQYLPTLLVGLAIM

SEQ ID NO: 310669 - protein, 20 aa, Mycobacterium
GVAVARWRIDRNAPPPPTHD

SEQ ID NO: 310670 - protein, 21 aa, Mycobacterium
GVAVGALVRFSAGAVAVLLLW

SEQ ID NO: 310671 - protein, 21 aa, Mycobacterium
GVAVGLLIVWAALLIALALAR

SEQ ID NO: 310672 - protein, 24 aa, Mycobacterium
GVAVLEDIVLWLALAIATAIATKT

SEQ ID NO: 310673 - protein, 28 aa, Mycobacterium
GVAVVAVIAALIITRSDDKPAPAGNTSS

SEQ ID NO: 310674 - protein, 20 aa, Mycobacterium
GVAWLAVLLELARPCDSWRA

SEQ ID NO: 310675 - protein, 20 aa, Mycobacterium
GVAYLDSWSAAIAVGLAAMF

SEQ ID NO: 310676 - protein, 18 aa, Mycobacterium
GVCGIFVFLILRALGELV

SEQ ID NO: 310677 - protein, 20 aa, Mycobacterium
GVDPIRRLAAPRVLAATVVA

SEQ ID NO: 310678 - protein, 20 aa, Mycobacterium
GVDRAHLIAHDWGSIQAWAA

SEQ ID NO: 310679 - protein, 18 aa, Mycobacterium
GVDYPRELLRVVVVDDKS

SEQ ID NO: 310680 - protein, 24 aa, Mycobacterium
GVEDAEWSWLKWLPHVDISGEVDG

SEQ ID NO: 310681 - protein, 26 aa, Mycobacterium
GVEGPLRLGHWVLFAAVSVPAVGAMI

SEQ ID NO: 310682 - protein, 20 aa, Mycobacterium
GVEIPRAMFWTVLVYVVVAT

SEQ ID NO: 310683 - protein, 25 aa, Mycobacterium
GVEKRPRLTMFDDFGGRIPSDKPPI

SEQ ID NO: 310684 - protein, 19 aa, Mycobacterium
GVELKREFVVGDLRDPAKA

SEQ ID NO: 310685 - protein, 25 aa, Mycobacterium
GVELPRAMFFIGILYVVVATVIAFW

SEQ ID NO: 310686 - protein, 19 aa, Mycobacterium
GVEPMRLAPEPGIADIPGL

SEQ ID NO: 310687 - protein, 23 aa, Mycobacterium
GVFAFGAAMALYFKFKDKRRYEL

SEQ ID NO: 310688 - protein, 23 aa, Mycobacterium
GVFEVISAFGIRSASRDLAALRR

SEQ ID NO: 310689 - protein, 23 aa, Mycobacterium
GVFEVVSAFGIRSGVRKLGAALS

SEQ ID NO: 310690 - protein, 21 aa, Mycobacterium
GVFLDVALSWVVANPSTCPVM

SEQ ID NO: 310691 - protein, 19 aa, Mycobacterium
GVFPGWLQPVVRFSPISPT

SEQ ID NO: 310692 - protein, 27 aa, Mycobacterium
GVFTALVPVCTLIGIRIERRSKNTHAV

SEQ ID NO: 310693 - protein, 17 aa, Mycobacterium
GVFVGFVIGKLVNIIRC

SEQ ID NO: 310694 - protein, 17 aa, Mycobacterium
GVFVNWLSPDKAFAYIT

SEQ ID NO: 310695 - protein, 22 aa, Mycobacterium
GVGALSFLTAVGFVLWPHIDEV

SEQ ID NO: 310696 - protein, 17 aa, Mycobacterium
GVGENDAVYCCGPAPML

SEQ ID NO: 310697 - protein, 19 aa, Mycobacterium
GVGFIVPVIWGIVDAVLMF

SEQ ID NO: 310698 - protein, 24 aa, Mycobacterium
GVGGELYAAGFLLGRGYVNAPSLT

SEQ ID NO: 310699 - protein, 17 aa, Mycobacterium
GVGGLLLVPATRRIGAL

SEQ ID NO: 310700 - protein, 18 aa, Mycobacterium
GVGGPWSLAQGRNVARSG

SEQ ID NO: 310701 - protein, 18 aa, Mycobacterium
GVGLAALVALLSLITYHG

SEQ ID NO: 310702 - protein, 24 aa, Mycobacterium
GVGLAMILSYVWGVRVGGIFTALG

SEQ ID NO: 310703 - protein, 26 aa, Mycobacterium
GVGLARSGPWLFAALAVWGMFQGGLD

SEQ ID NO: 310704 - protein, 23 aa, Mycobacterium
GVGLFFAFWSWVGFESSAMYAEE

SEQ ID NO: 310705 - protein, 25 aa, Mycobacterium
GVGLGYKWGLSGMWLVVAIAVGLLA

SEQ ID NO: 310706 - protein, 26 aa, Mycobacterium
GVGLLGKYAQIWWKDLAKAQHWTVPD

SEQ ID NO: 310707 - protein, 25 aa, Mycobacterium
GVGPGERVALMFPRSAEAVVAILAV

SEQ ID NO: 310708 - protein, 22 aa, Mycobacterium
GVGPGIPAWVGWSHFFNLFLMM

SEQ ID NO: 310709 - protein, 25 aa, Mycobacterium
GVGRAFDDVIAWGMAKQRSTRFASA

SEQ ID NO: 310710 - protein, 25 aa, Mycobacterium
GVGRLAPIRPIRWVCTVIVEFFRAV

SEQ ID NO: 310711 - protein, 22 aa, Mycobacterium
GVGRRAPVLGIVFALFLLAFAG

SEQ ID NO: 310712 - protein, 18 aa, Mycobacterium
GVGSMLAAALVLLVSSPD

SEQ ID NO: 310713 - protein, 25 aa, Mycobacterium
GVGSRAHRRYFWAVLAISAIISIGG

SEQ ID NO: 310714 - protein, 18 aa, Mycobacterium
GVGSRMRPVRIVALATSV

SEQ ID NO: 310715 - protein, 27 aa, Mycobacterium
GVGVLILPFIGLWAMIATLRAGFAHQR

SEQ ID NO: 310716 - protein, 22 aa, Mycobacterium
GVHAATAWPGKQVVIHLPNERA

SEQ ID NO: 310717 - protein, 19 aa, Mycobacterium
GVHFKDLTPVLADAYGLAE

SEQ ID NO: 310718 - protein, 17 aa, Mycobacterium
GVHIEPYAAFSEKYRSA

SEQ ID NO: 310719 - protein, 18 aa, Mycobacterium
GVHSVTWTATPGGGIGPD

SEQ ID NO: 310720 - protein, 23 aa, Mycobacterium
GVIAISAPVLWWRYRRTDRDALM

SEQ ID NO: 310721 - protein, 17 aa, Mycobacterium
GVIFLMLLLLYRRVLIV

SEQ ID NO: 310722 - protein, 26 aa, Mycobacterium
GVIGMGVAFLCFVPLAGVSAVPALVV

SEQ ID NO: 310723 - protein, 17 aa, Mycobacterium
GVIGVLWGAATLTFIAQ

SEQ ID NO: 310724 - protein, 17 aa, Mycobacterium
GVIHLKDVVKHGMRERF

SEQ ID NO: 310725 - protein, 18 aa, Mycobacterium
GVIHRRAAAGFAGVAIGL

SEQ ID NO: 310726 - protein, 17 aa, Mycobacterium
GVILAFQIYVWIRWITG

SEQ ID NO: 310727 - protein, 22 aa, Mycobacterium
GVILRQILTWMLSTAVPVLAIV

SEQ ID NO: 310728 - protein, 26 aa, Mycobacterium
GVILWQHLFWYFGHPEVYVIALPFFG

SEQ ID NO: 310729 - protein, 21 aa, Mycobacterium
GVIMASLLLGLAMDLSALVIP

SEQ ID NO: 310730 - protein, 19 aa, Mycobacterium
GVIMLGVLKFAYSDDPREA

SEQ ID NO: 310731 - protein, 32 aa, Mycobacterium
GVIPLPHLDAGPFLSYGIQWIAFGIIAPIGVG

SEQ ID NO: 310732 - protein, 27 aa, Mycobacterium
GVIQRCARTPLATGLEVRAAGFIAIED

SEQ ID NO: 310733 - protein, 26 aa, Mycobacterium
GVISARLVGRFGPRKLLLGGVSAMVV

SEQ ID NO: 310734 - protein, 24 aa, Mycobacterium
GVITCAMGAIPWVTLKKLRELGSS

SEQ ID NO: 310735 - protein, 23 aa, Mycobacterium
GVKAAGQLLWWAILFPVLSIPAT

SEQ ID NO: 310736 - protein, 24 aa, Mycobacterium
GVKHPGWVNFWFAVSFVLGPITTR

SEQ ID NO: 310737 - protein, 25 aa, Mycobacterium
GVKIALYVLGGWVFGWCTTGIGRFT

SEQ ID NO: 310738 - protein, 20 aa, Mycobacterium
GVLAFGFARIFAAPQTARAI

SEQ ID NO: 310739 - protein, 19 aa, Mycobacterium
GVLAFGFARIFAAPQTSRA

SEQ ID NO: 310740 - protein, 25 aa, Mycobacterium
GVLAISVLAAMPWLVASGLGAAVPA

SEQ ID NO: 310741 - protein, 17 aa, Mycobacterium
GVLALVLLVWWRGTFLT

SEQ ID NO: 310742 - protein, 28 aa, Mycobacterium
GVLAVRRGEAGRGWTMILLAIMMPALAL

SEQ ID NO: 310743 - protein, 26 aa, Mycobacterium
GVLAVVGVCRLRRARQSPSAPADNSS

SEQ ID NO: 310744 - protein, 17 aa, Mycobacterium
GVLAWNGQIAWWLDMVV

SEQ ID NO: 310745 - protein, 24 aa, Mycobacterium
GVLAWNGQIAWWLDMVVFGVYQVT

SEQ ID NO: 310746 - protein, 26 aa, Mycobacterium
GVLDARIRLGWPLWAAYITVFALTVL

SEQ ID NO: 310747 - protein, 29 aa, Mycobacterium
GVLEGLRFFWNIKILRTIALVDMAITALY

SEQ ID NO: 310748 - protein, 27 aa, Mycobacterium
GVLFIAILVASLWVIRKTVDLISILIA

SEQ ID NO: 310749 - protein, 19 aa, Mycobacterium
GVLFRLSSGGIEWGVAIPF

SEQ ID NO: 310750 - protein, 31 aa, Mycobacterium
GVLFVPSVVSLVWFCVFGGAAIHEQQNGVDL

SEQ ID NO: 310751 - protein, 24 aa, Mycobacterium
GVLGWWRWHHNTWLTTIFASVIAV

SEQ ID NO: 310752 - protein, 21 aa, Mycobacterium
GVLHLLVAYIILRLAFGSGGN

SEQ ID NO: 310753 - protein, 25 aa, Mycobacterium
GVLIIGVVRWYWGIFSGRPARDKTA

SEQ ID NO: 310754 - protein, 18 aa, Mycobacterium
GVLIPVVGFVAVLIAPIL

SEQ ID NO: 310755 - protein, 18 aa, Mycobacterium
GVLIVCFVSGVVIASVCR

SEQ ID NO: 310756 - protein, 20 aa, Mycobacterium
GVLLCGLVPLLPVEETTATV

SEQ ID NO: 310757 - protein, 23 aa, Mycobacterium
GVLLCTILGCWIMRKAQQRWPNL

SEQ ID NO: 310758 - protein, 22 aa, Mycobacterium
GVLLCTILGCWVMRKAQQRWPN

SEQ ID NO: 310759 - protein, 25 aa, Mycobacterium
GVLLEHFWWGSVFLINIPVMVILLV

SEQ ID NO: 310760 - protein, 30 aa, Mycobacterium
GVLLFAARRRPSFLRPALAPDYGRVARAVH

SEQ ID NO: 310761 - protein, 17 aa, Mycobacterium
GVLLFIVGFNFGFGSLV

SEQ ID NO: 310762 - protein, 21 aa, Mycobacterium
GVLLFTFVRKARRGVRPPTSD

SEQ ID NO: 310763 - protein, 17 aa, Mycobacterium
GVLLGMLASLLVLAIMT

SEQ ID NO: 310764 - protein, 23 aa, Mycobacterium
GVLLHHFWWGSVFLINVPVLIVL

SEQ ID NO: 310765 - protein, 24 aa, Mycobacterium
GVLLIGLIRWYFGMTQRTTTAAKA

SEQ ID NO: 310766 - protein, 19 aa, Mycobacterium
GVLLIRWLIARRAAAFAHH

SEQ ID NO: 310767 - protein, 18 aa, Mycobacterium
GVLLKMGAYGFVRIAMPI

SEQ ID NO: 310768 - protein, 30 aa, Mycobacterium
GVLLLAARRRPSFLRPALSPDYGRVARGVQ

SEQ ID NO: 310769 - protein, 21 aa, Mycobacterium
GVLLLCSWLVLPLAQGYYSMM

SEQ ID NO: 310770 - protein, 25 aa, Mycobacterium
GVLLLLEVLFFRWLLDGNRNHEWLA

SEQ ID NO: 310771 - protein, 21 aa, Mycobacterium
GVLLLRVLMRRFWPDAEDPNG

SEQ ID NO: 310772 - protein, 17 aa, Mycobacterium
GVLLMGILVVRKVRGGL

SEQ ID NO: 310773 - protein, 29 aa, Mycobacterium
GVLLSAPAWLPIVLGLALSALVPPAGIEE

SEQ ID NO: 310774 - protein, 17 aa, Mycobacterium
GVLLVLVAVLAVFLAQR

SEQ ID NO: 310775 - protein, 26 aa, Mycobacterium
GVLLWQHLFWFFGHPEVYILALPFFG

SEQ ID NO: 310776 - protein, 26 aa, Mycobacterium
GVLLWQHLFWFFGHPEVYIVALPFFG

SEQ ID NO: 310777 - protein, 26 aa, Mycobacterium
GVLLWQHLFWFFGHPEVYVLALPFFG

SEQ ID NO: 310778 - protein, 20 aa, Mycobacterium
GVLMLYTILIIRGLRTAIAV

SEQ ID NO: 310779 - protein, 17 aa, Mycobacterium
GVLNIVAVLGFIAVAVF

SEQ ID NO: 310780 - protein, 24 aa, Mycobacterium
GVLNQKARGIGIFRTIVFLPLAIS

SEQ ID NO: 310781 - protein, 24 aa, Mycobacterium
GVLNRKVKGIGIFRTITFLPLAIS

SEQ ID NO: 310782 - protein, 22 aa, Mycobacterium
GVLPFVWIAWTALRHFRTGSTV

SEQ ID NO: 310783 - protein, 20 aa, Mycobacterium
GVLPRPLLDLIEPAAHALAG

SEQ ID NO: 310784 - protein, 17 aa, Mycobacterium
GVLPRPPAPVVPGVVVV

SEQ ID NO: 310785 - protein, 17 aa, Mycobacterium
GVLRDGQKWVALAVPGY

SEQ ID NO: 310786 - protein, 20 aa, Mycobacterium
GVLRDGQKWVALAVPGYTVA

SEQ ID NO: 310787 - protein, 27 aa, Mycobacterium
GVLRGTSKWLILNGCVLGAALALTGLM

SEQ ID NO: 310788 - protein, 25 aa, Mycobacterium
GVLRQRLGLDTAWLSSFHDDTQTIE

SEQ ID NO: 310789 - protein, 22 aa, Mycobacterium
GVLSAFGLVFVRFPGKNVVFLV

SEQ ID NO: 310790 - protein, 25 aa, Mycobacterium
GVLSDFLLRRGVSLGAARKGPIIAG

SEQ ID NO: 310791 - protein, 19 aa, Mycobacterium
GVLTLWVQQAFGFNLAGSG

SEQ ID NO: 310792 - protein, 21 aa, Mycobacterium
GVLTLWVRQLFGWDLAGSGWL

SEQ ID NO: 310793 - protein, 17 aa, Mycobacterium
GVLTWVNVWNDFLWPLL

SEQ ID NO: 310794 - protein, 26 aa, Mycobacterium
GVLVAGWRGARRWRRTASALAVPLCA

SEQ ID NO: 310795 - protein, 20 aa, Mycobacterium
GVLVGVLWSFLAPGVHGAIA

SEQ ID NO: 310796 - protein, 31 aa, Mycobacterium
GVLVIAILVAWRWVPAKVRRVPGPLVAIVAA

SEQ ID NO: 310797 - protein, 19 aa, Mycobacterium
GVLVIAIMVAWRWAPAKLA

SEQ ID NO: 310798 - protein, 17 aa, Mycobacterium
GVLVIGIMVAWRWAPAK

SEQ ID NO: 310799 - protein, 19 aa, Mycobacterium
GVLVIVIMVAWRWVPAKAR

SEQ ID NO: 310800 - protein, 31 aa, Mycobacterium
GVLVSGWLAAITWRLSFLWLAVAGLLLTLAL

SEQ ID NO: 310801 - protein, 25 aa, Mycobacterium
GVLVTRPGAKVLRPLFVGIANVGQA

SEQ ID NO: 310802 - protein, 21 aa, Mycobacterium
GVLWRRGHRAVSKWLSLLFLA

SEQ ID NO: 310803 - protein, 17 aa, Mycobacterium
GVMGAVLAVVRPDVVLI

SEQ ID NO: 310804 - protein, 23 aa, Mycobacterium
GVMIASSATLVFGLLLIAISAWL

SEQ ID NO: 310805 - protein, 22 aa, Mycobacterium
GVMIYTDLWVGFTVISAVLILG

SEQ ID NO: 310806 - protein, 26 aa, Mycobacterium
GVMLFQHLFWFFGHPEVYVIALPFFG

SEQ ID NO: 310807 - protein, 25 aa, Mycobacterium
GVMLSAPLWLPLLLVGLAQLVNPVP

SEQ ID NO: 310808 - protein, 26 aa, Mycobacterium
GVMLWQHLFWFFGHPEVYIIALPFFG

SEQ ID NO: 310809 - protein, 17 aa, Mycobacterium
GVMPLGLIATGLALAAA

SEQ ID NO: 310810 - protein, 19 aa, Mycobacterium
GVMPLLPVLLMIYGTARTT

SEQ ID NO: 310811 - protein, 18 aa, Mycobacterium
GVMTRKRWQTAIVTAVVT

SEQ ID NO: 310812 - protein, 36 aa, Mycobacterium
GVNGLRQLILGGIDARLWQAIIVLAAITAVALAISC

SEQ ID NO: 310813 - protein, 25 aa, Mycobacterium
GVNGSRARLPFGLDPARTPVLGSWS

SEQ ID NO: 310814 - protein, 23 aa, Mycobacterium
GVNGSRVFLPFGLDPQTTPVMGS

SEQ ID NO: 310815 - protein, 24 aa, Mycobacterium
GVNGSRVFLPFGLDPSRTPVMGSY

SEQ ID NO: 310816 - protein, 21 aa, Mycobacterium
GVNVPRAMFWTVLVYVLIVTV

SEQ ID NO: 310817 - protein, 21 aa, Mycobacterium
GVPAAFCWSADPSCPLDAERL

SEQ ID NO: 310818 - protein, 23 aa, Mycobacterium
GVPDDGFGEVFLLIDNLYAFGRD

SEQ ID NO: 310819 - protein, 25 aa, Mycobacterium
GVPDSWRLLHIVFILVVLYTAIQGP

SEQ ID NO: 310820 - protein, 30 aa, Mycobacterium
GVPESRWIAWPGYLWFGVLVYLFLVLLALE

SEQ ID NO: 310821 - protein, 19 aa, Mycobacterium
GVPEYRYLLAADDELDDGS

SEQ ID NO: 310822 - protein, 23 aa, Mycobacterium
GVPFRMIKFRSMYTGADLQTAGM

SEQ ID NO: 310823 - protein, 23 aa, Mycobacterium
GVPGGQAILDFLKDPLGNLGRLL

SEQ ID NO: 310824 - protein, 21 aa, Mycobacterium
GVPIGRVERLDITPAGVDAVV

SEQ ID NO: 310825 - protein, 25 aa, Mycobacterium
GVPLGLLGTVWSYRSLVEIDQPTPG

SEQ ID NO: 310826 - protein, 18 aa, Mycobacterium
GVPLLFVLGRPRLQRAYC

SEQ ID NO: 310827 - protein, 22 aa, Mycobacterium
GVPLLLGALWASGRFARRADKV

SEQ ID NO: 310828 - protein, 22 aa, Mycobacterium
GVPLQRPYLVGCLNARNELALV

SEQ ID NO: 310829 - protein, 18 aa, Mycobacterium
GVPLWPGVPPAPTEPAPI

SEQ ID NO: 310830 - protein, 25 aa, Mycobacterium
GVPPARLTKMTAMPQLVAFFNGVGG

SEQ ID NO: 310831 - protein, 17 aa, Mycobacterium
GVPRARPDHAFALADFA

SEQ ID NO: 310832 - protein, 23 aa, Mycobacterium
GVPSSFSMHGPWVGVAAPAENII

SEQ ID NO: 310833 - protein, 23 aa, Mycobacterium
GVPSSFSMHGPWVGVAAPAENIV

SEQ ID NO: 310834 - protein, 18 aa, Mycobacterium
GVPVAKSLSPGGFQDPDS

SEQ ID NO: 310835 - protein, 17 aa, Mycobacterium
GVPVHALGIVFAALVGV

SEQ ID NO: 310836 - protein, 29 aa, Mycobacterium
GVPVWTILRWLWIGGSDVWALGEIVPSTV

SEQ ID NO: 310837 - protein, 23 aa, Mycobacterium
GVPWPRHKLFAVIAGFAALVLLG

SEQ ID NO: 310838 - protein, 27 aa, Mycobacterium
GVPWSNSFPQWHFGISTVFFGLSVLAI

SEQ ID NO: 310839 - protein, 20 aa, Mycobacterium
GVPYFPNLVAPIVIGGIGIG

SEQ ID NO: 310840 - protein, 24 aa, Mycobacterium
GVQIPRAMFWSVFVYVAFATVIAF

SEQ ID NO: 310841 - protein, 24 aa, Mycobacterium
GVQPAMWRQFRIGYLPFEAPIPST

SEQ ID NO: 310842 - protein, 25 aa, Mycobacterium
GVQTYEFWLKIGIVALGARFVLGDV

SEQ ID NO: 310843 - protein, 23 aa, Mycobacterium
GVRATWPLALAVFATVTFVAPVC

SEQ ID NO: 310844 - protein, 26 aa, Mycobacterium
GVRAVLAFRGYFYWDDLILVGRAGTQ

SEQ ID NO: 310845 - protein, 21 aa, Mycobacterium
GVRIGGLFTALGITSVVIGLM

SEQ ID NO: 310846 - protein, 19 aa, Mycobacterium
GVRIGGLFTALGVTSVVIG

SEQ ID NO: 310847 - protein, 19 aa, Mycobacterium
GVRIPPRIIKATIAADGTR

SEQ ID NO: 310848 - protein, 20 aa, Mycobacterium
GVRIPPRIIKATIAPDGTRT

SEQ ID NO: 310849 - protein, 19 aa, Mycobacterium
GVRIPPRIVKSITAPDGSR

SEQ ID NO: 310850 - protein, 19 aa, Mycobacterium
GVRLARAGYRTRILDSVTL

SEQ ID NO: 310851 - protein, 24 aa, Mycobacterium
GVRLQRRDWLAICAVLLSLCVLAA

SEQ ID NO: 310852 - protein, 18 aa, Mycobacterium
GVRLVPLAFSYAGLSVIA

SEQ ID NO: 310853 - protein, 22 aa, Mycobacterium
GVRRRAELFGGIMRDGSDDGLR

SEQ ID NO: 310854 - protein, 18 aa, Mycobacterium
GVRRRRTGQPDAYEAYEH

SEQ ID NO: 310855 - protein, 25 aa, Mycobacterium
GVRRWRAAVCSAIVFLVSVGVSLLI

SEQ ID NO: 310856 - protein, 21 aa, Mycobacterium
GVRRYVFKRPPLLGPSGRMVA

SEQ ID NO: 310857 - protein, 18 aa, Mycobacterium
GVRSPKCFLNGGEQVLCL

SEQ ID NO: 310858 - protein, 18 aa, Mycobacterium
GVRVAWVVGTLVAAAYAL

SEQ ID NO: 310859 - protein, 19 aa, Mycobacterium
GVRVMPVFAVKSGAFFAMT

SEQ ID NO: 310860 - protein, 19 aa, Mycobacterium
GVRVMPVFAVKSGAFFAVT

SEQ ID NO: 310861 - protein, 18 aa, Mycobacterium
GVSAALLGRRLWQRKDEK

SEQ ID NO: 310862 - protein, 22 aa, Mycobacterium
GVSFLVAAAMVWPTVSRTEAVA

SEQ ID NO: 310863 - protein, 24 aa, Mycobacterium
GVSILLGVAIGWGLYGNTRSPLDF

SEQ ID NO: 310864 - protein, 18 aa, Mycobacterium
GVSLNLADRIIARKQVTT

SEQ ID NO: 310865 - protein, 17 aa, Mycobacterium
GVSLWRLSIGLAVATVI

SEQ ID NO: 310866 - protein, 18 aa, Mycobacterium
GVSMVWLSVIVLLPLAAI

SEQ ID NO: 310867 - protein, 24 aa, Mycobacterium
GVSNLAVGFLRGFPVSSSASRTAL

SEQ ID NO: 310868 - protein, 25 aa, Mycobacterium
GVSPHPRFPHLIPGGDYVMGGDGLS

SEQ ID NO: 310869 - protein, 22 aa, Mycobacterium
GVSSCFFFFYNVPAQWIGMHSD

SEQ ID NO: 310870 - protein, 25 aa, Mycobacterium
GVSSFGFGGANAHLVVREVLPRDVI

SEQ ID NO: 310871 - protein, 25 aa, Mycobacterium
GVSSFGFGGANAHLVVREVLPRDVV

SEQ ID NO: 310872 - protein, 23 aa, Mycobacterium
GVSSFGFGGANAHVVVREVLPRD

SEQ ID NO: 310873 - protein, 23 aa, Mycobacterium
GVSSIPSVIGFLLAGVVFIYLMR

SEQ ID NO: 310874 - protein, 18 aa, Mycobacterium
GVSSTLFYLFAYGFSTLG

SEQ ID NO: 310875 - protein, 17 aa, Mycobacterium
GVSTCWEVIFDRAPRKA

SEQ ID NO: 310876 - protein, 27 aa, Mycobacterium
GVSYMRYPLFLGFDIVGGIAWGGGATL

SEQ ID NO: 310877 - protein, 22 aa, Mycobacterium
GVTAELGAGVLLVLGLLTPLAG

SEQ ID NO: 310878 - protein, 18 aa, Mycobacterium
GVTAGWLAWLLALAVAAP

SEQ ID NO: 310879 - protein, 17 aa, Mycobacterium
GVTALLYNFGFFTLLAF

SEQ ID NO: 310880 - protein, 21 aa, Mycobacterium
GVTDPRTWGLVGWISDLVPHL

SEQ ID NO: 310881 - protein, 19 aa, Mycobacterium
GVTESRRWWTLPVLGQHIL

SEQ ID NO: 310882 - protein, 19 aa, Mycobacterium
GVTGAFLAIMIIDGRRVAD

SEQ ID NO: 310883 - protein, 25 aa, Mycobacterium
GVTGFCALTAMFVLVVAWSPPYGNW

SEQ ID NO: 310884 - protein, 21 aa, Mycobacterium
GVTGLPRRASTVGLVALVSAQ

SEQ ID NO: 310885 - protein, 18 aa, Mycobacterium
GVTGSIFSFWGWDTCLTL

SEQ ID NO: 310886 - protein, 19 aa, Mycobacterium
GVTLSIQFALLAGQVGASS

SEQ ID NO: 310887 - protein, 20 aa, Mycobacterium
GVTPFVRVRIDQVTPDVVTT

SEQ ID NO: 310888 - protein, 24 aa, Mycobacterium
GVTPGLPAWIGWTHFFNLFMMMFI

SEQ ID NO: 310889 - protein, 25 aa, Mycobacterium
GVTPHPRFPHLIPGGDYVMAGGDGL

SEQ ID NO: 310890 - protein, 25 aa, Mycobacterium
GVTPNPRFPALFAGGDYVQGLPNGG

SEQ ID NO: 310891 - protein, 25 aa, Mycobacterium
GVTRHIWVRFTVVLALTLAQALVGV

SEQ ID NO: 310892 - protein, 21 aa, Mycobacterium
GVTVALCLGGGVFGLSLGKHV

SEQ ID NO: 310893 - protein, 22 aa, Mycobacterium
GVTVALCLLGGVFGISLGKHVT

SEQ ID NO: 310894 - protein, 22 aa, Mycobacterium
GVTVRDAWPHGTVPFTTTGVFG

SEQ ID NO: 310895 - protein, 23 aa, Mycobacterium
GVTVTLWAFAFVGVRSAGRVFSP

SEQ ID NO: 310896 - protein, 24 aa, Mycobacterium
GVTVVACLFWRLFMQDNRTPPEPA

SEQ ID NO: 310897 - protein, 17 aa, Mycobacterium
GVTVVHCSSTLPHREQY

SEQ ID NO: 310898 - protein, 25 aa, Mycobacterium
GVVAFKLYVNRDWTATFEVTGTGTT

SEQ ID NO: 310899 - protein, 22 aa, Mycobacterium
GVVAFLAWHGVIGLSTYAINLL

SEQ ID NO: 310900 - protein, 25 aa, Mycobacterium
GVVAQCSVLLPAIRRERISLRPLWG

SEQ ID NO: 310901 - protein, 24 aa, Mycobacterium
GVVARITGGLLRLLGVSTETDTSE

SEQ ID NO: 310902 - protein, 22 aa, Mycobacterium
GVVDPVAALTWDVPDGPVKPPQ

SEQ ID NO: 310903 - protein, 19 aa, Mycobacterium
GVVGICLFAQMAGRVAAVS

SEQ ID NO: 310904 - protein, 18 aa, Mycobacterium
GVVGIVWLLILVPAAVVL

SEQ ID NO: 310905 - protein, 23 aa, Mycobacterium
GVVGLVAGLGYWLLTPEHVTAQC

SEQ ID NO: 310906 - protein, 17 aa, Mycobacterium
GVVGRRAAVAAAALCTV

SEQ ID NO: 310907 - protein, 26 aa, Mycobacterium
GVVHPTFLYELLWNLLVFAVLILVDR

SEQ ID NO: 310908 - protein, 30 aa, Mycobacterium
GVVIGLGVAIAFLLIRVIRAPIEARLVSEE

SEQ ID NO: 310909 - protein, 27 aa, Mycobacterium
GVVLACPVWFYELWAFITPGLYKKERR

SEQ ID NO: 310910 - protein, 27 aa, Mycobacterium
GVVLACPVWFYELWAFITPGLYQKERR

SEQ ID NO: 310911 - protein, 22 aa, Mycobacterium
GVVLACPVWLYQLWAFITPGLY

SEQ ID NO: 310912 - protein, 20 aa, Mycobacterium
GVVLCALALAGAGLDAILYR

SEQ ID NO: 310913 - protein, 25 aa, Mycobacterium
GVVLLFARPRLRIGAAGISVRNLLG

SEQ ID NO: 310914 - protein, 24 aa, Mycobacterium
GVVMACPVWLYQVWAFITPGLYAK

SEQ ID NO: 310915 - protein, 25 aa, Mycobacterium
GVVPFTAVGDGWVAAGSFYGGGSVP

SEQ ID NO: 310916 - protein, 26 aa, Mycobacterium
GVVPLLRPLYDYNWVVAFLVAMFVYW

SEQ ID NO: 310917 - protein, 43 aa, Mycobacterium
GVVPNPDPGWAPRPNPIVPVPIPIPIPIPGWQPPYNPPYNPTT

SEQ ID NO: 310918 - protein, 22 aa, Mycobacterium
GVVRLLLCVAYLVVVIGFVAFH

SEQ ID NO: 310919 - protein, 20 aa, Mycobacterium
GVVSCSLLGVFISNFASNAV

SEQ ID NO: 310920 - protein, 18 aa, Mycobacterium
GVVSEIFPVFSRKPIFGY

SEQ ID NO: 310921 - protein, 20 aa, Mycobacterium
GVVSGALWGVFAVLTKTVVH

SEQ ID NO: 310922 - protein, 30 aa, Mycobacterium
GVVSITFVSLVGWWALSRVLKRLAGVPDVH

SEQ ID NO: 310923 - protein, 24 aa, Mycobacterium
GVVTFILALILKYTIGLRLGPEQE

SEQ ID NO: 310924 - protein, 19 aa, Mycobacterium
GVVTVLWVLYGYSIAFGDD

SEQ ID NO: 310925 - protein, 19 aa, Mycobacterium
GVVTVLWVLYGYSMAFGDD

SEQ ID NO: 310926 - protein, 18 aa, Mycobacterium
GVVTVLWVLYGYSVAFGN

SEQ ID NO: 310927 - protein, 29 aa, Mycobacterium
GVVVNLKLLMPVFRWQRRDNMLAETDPVA

SEQ ID NO: 310928 - protein, 19 aa, Mycobacterium
GVVVRFRVAETPAFEQVQR

SEQ ID NO: 310929 - protein, 20 aa, Mycobacterium
GVVYLLYLAVRQWRSAGTDV

SEQ ID NO: 310930 - protein, 18 aa, Mycobacterium
GVWAFARPGFPPLRLDQS

SEQ ID NO: 310931 - protein, 24 aa, Mycobacterium
GVWTHYSGWWAFDMAMLVILGALW

SEQ ID NO: 310932 - protein, 20 aa, Mycobacterium
GVWVSLCLVFALVGLYLTYV

SEQ ID NO: 310933 - protein, 19 aa, Mycobacterium
GVYHRPHFVQKVVNSDGQV

SEQ ID NO: 310934 - protein, 21 aa, Mycobacterium
GVYLQARYATAAVYIVQNVFD

SEQ ID NO: 310935 - protein, 24 aa, Mycobacterium
GVYLWHWPIFLILNGERTGASGWQ

SEQ ID NO: 310936 - protein, 24 aa, Mycobacterium
GVYLWHWPIFLVLNGERTGWTGLP

SEQ ID NO: 310937 - protein, 24 aa, Mycobacterium
GVYLWHWPLFLILNGERTGLTGWS

SEQ ID NO: 310938 - protein, 18 aa, Mycobacterium
GVYNSVRLLGAVLGSSGM

SEQ ID NO: 310939 - protein, 21 aa, Mycobacterium
GVYVLCLWAVVAAPKASAAVG

SEQ ID NO: 310940 - protein, 29 aa, Mycobacterium
GVYWNFLDLRPFWAGQLVSGWYPLVFLCF

SEQ ID NO: 310941 - protein, 18 aa, Mycobacterium
GWADFGIAAGSWLPAVLW

SEQ ID NO: 310942 - protein, 19 aa, Mycobacterium
GWAHVVLFIGILGGEEPID

SEQ ID NO: 310943 - protein, 17 aa, Mycobacterium
GWALMTWTLMAFGSTLS

SEQ ID NO: 310944 - protein, 26 aa, Mycobacterium
GWALRAIIAALLEWQRKSELSGDRAG

SEQ ID NO: 310945 - protein, 18 aa, Mycobacterium
GWALTAWILMSLGTGLCR

SEQ ID NO: 310946 - protein, 18 aa, Mycobacterium
GWAPAIYCGGLAALLLAA

SEQ ID NO: 310947 - protein, 22 aa, Mycobacterium
GWAQVPRRLPTITVDDPNPARP

SEQ ID NO: 310948 - protein, 21 aa, Mycobacterium
GWASYRVDAWLSRDDDQHHPA

SEQ ID NO: 310949 - protein, 25 aa, Mycobacterium
GWATVVWAYALFWFLVEDRVKLSTY

SEQ ID NO: 310950 - protein, 19 aa, Mycobacterium
GWAVLVAMILIVTVGHAVT

SEQ ID NO: 310951 - protein, 20 aa, Mycobacterium
GWDNSLWASLIMPFAGIARL

SEQ ID NO: 310952 - protein, 26 aa, Mycobacterium
GWDRQQWRSAALFAVALAGMNGFFFA

SEQ ID NO: 310953 - protein, 28 aa, Mycobacterium
GWFGDRFGRRRVYCAALLATAVCAVGAA

SEQ ID NO: 310954 - protein, 23 aa, Mycobacterium
GWGAARLVGHVLFDAGLAGRFTA

SEQ ID NO: 310955 - protein, 17 aa, Mycobacterium
GWGITWLGYAGDYSRFV

SEQ ID NO: 310956 - protein, 20 aa, Mycobacterium
GWGLTCFITAIAGLMQVLLG

SEQ ID NO: 310957 - protein, 32 aa, Mycobacterium
GWHAFWRGEIGQWIITRGLRIAMVLIAAVLAA

SEQ ID NO: 310958 - protein, 19 aa, Mycobacterium
GWHAPGWPPPPGGPQQQQP

SEQ ID NO: 310959 - protein, 20 aa, Mycobacterium
GWHAPWPLNMWAGANTGWWP

SEQ ID NO: 310960 - protein, 26 aa, Mycobacterium
GWHGSHIFWLLGAWVLFQAAVAFPAG

SEQ ID NO: 310961 - protein, 18 aa, Mycobacterium
GWIGKLLAVAGVAVTLIG

SEQ ID NO: 310962 - protein, 24 aa, Mycobacterium
GWIMRLAPLGAFGAMAYIIGQYGI

SEQ ID NO: 310963 - protein, 18 aa, Mycobacterium
GWITLAFLASVLILMLFD

SEQ ID NO: 310964 - protein, 27 aa, Mycobacterium
GWITPRKAYANKIWHRSGINIVKRPGA

SEQ ID NO: 310965 - protein, 20 aa, Mycobacterium
GWLAAARIGMGWPLTVLAAL

SEQ ID NO: 310966 - protein, 20 aa, Mycobacterium
GWLAGMWRDLLGAAISGPEA

SEQ ID NO: 310967 - protein, 28 aa, Mycobacterium
GWLAILSLRLIPAVPFAALNYGAGASAV

SEQ ID NO: 310968 - protein, 29 aa, Mycobacterium
GWLALAVTVPVQFVAGWSILKEAVAQARA

SEQ ID NO: 310969 - protein, 29 aa, Mycobacterium
GWLATRFGDRIIAVIGMLIAAFGYYLISG

SEQ ID NO: 310970 - protein, 25 aa, Mycobacterium
GWLAVDGARDWWPMRPPDDVDEIDF

SEQ ID NO: 310971 - protein, 24 aa, Mycobacterium
GWLAVDGSHQWWPLTPVKKPITAA

SEQ ID NO: 310972 - protein, 24 aa, Mycobacterium
GWLGPRGTTSIVFGLLAFNALDGV

SEQ ID NO: 310973 - protein, 27 aa, Mycobacterium
GWLIGAFSWPWIFLVNLPIGLIAFTLA

SEQ ID NO: 310974 - protein, 20 aa, Mycobacterium
GWLLLRIPVGTVWSEEAAFR

SEQ ID NO: 310975 - protein, 20 aa, Mycobacterium
GWLRTRHQIQAGLLLCAGVA

SEQ ID NO: 310976 - protein, 19 aa, Mycobacterium
GWLSARRRIREMVLPVVTT

SEQ ID NO: 310977 - protein, 18 aa, Mycobacterium
GWLSRPWEQMLDSMGRQS

SEQ ID NO: 310978 - protein, 26 aa, Mycobacterium
GWLSTVFTRADWEPEALVLVGSGEDL

SEQ ID NO: 310979 - protein, 27 aa, Mycobacterium
GWLVRHWLIKLAVYVGVHFGGFWGDLV

SEQ ID NO: 310980 - protein, 17 aa, Mycobacterium
GWPGTPMRPHNLPFVML

SEQ ID NO: 310981 - protein, 20 aa, Mycobacterium
GWPTALAAFVMIVFHLNILL

SEQ ID NO: 310982 - protein, 22 aa, Mycobacterium
GWQPLPGHIWSAGGIGSAVLDA

SEQ ID NO: 310983 - protein, 21 aa, Mycobacterium
GWQVLPFLIIQAFYGASLLES

SEQ ID NO: 310984 - protein, 27 aa, Mycobacterium
GWREAARWARRLAWVSMIAMLTEGAVG

SEQ ID NO: 310985 - protein, 26 aa, Mycobacterium
GWRERRDLFSGFAWLAVVSLATAGAC

SEQ ID NO: 310986 - protein, 29 aa, Mycobacterium
GWRKVGTSVVRWPIPIIVLTSLIAIIGFV

SEQ ID NO: 310987 - protein, 34 aa, Mycobacterium
GWRPLFAEYCVMARLMAVAVLQWVANSAEFLARL

SEQ ID NO: 310988 - protein, 20 aa, Mycobacterium
GWSAKCLQMARADVNEDGVA

SEQ ID NO: 310989 - protein, 25 aa, Mycobacterium
GWSMSETFWLLAIWALFQAGIAFPA

SEQ ID NO: 310990 - protein, 18 aa, Mycobacterium
GWSWLFFRYHKLGAAAVG

SEQ ID NO: 310991 - protein, 18 aa, Mycobacterium
GWTDPASGVAFSLVHNRL

SEQ ID NO: 310992 - protein, 28 aa, Mycobacterium
GWTEAGERRVLCGLQLPGADNQQQLFRG

SEQ ID NO: 310993 - protein, 26 aa, Mycobacterium
GWTGLPLFAARCGATMALAAVSWWLL

SEQ ID NO: 310994 - protein, 24 aa, Mycobacterium
GWTGMRLFAARCALTVAIAALSWW

SEQ ID NO: 310995 - protein, 26 aa, Mycobacterium
GWTNWLEIFLILVIGFSLPRTFGRMV

SEQ ID NO: 310996 - protein, 24 aa, Mycobacterium
GWTSDRTAIGFGLATMVLVAFALW

SEQ ID NO: 310997 - protein, 18 aa, Mycobacterium
GWTTTRCVLLALASAFGL

SEQ ID NO: 310998 - protein, 23 aa, Mycobacterium
GWVFCGAAGMIFHQSAYRAGALT

SEQ ID NO: 310999 - protein, 18 aa, Mycobacterium
GWVFCVMIAIIASDVGGY

SEQ ID NO: 311000 - protein, 19 aa, Mycobacterium
GWVKPRRELTAQFWRRSGI

SEQ ID NO: 311001 - protein, 18 aa, Mycobacterium
GWVKPRRELTTRFWRRSG

SEQ ID NO: 311002 - protein, 26 aa, Mycobacterium
GWVVLALVFYFVWGRHHSALNDETVG

SEQ ID NO: 311003 - protein, 32 aa, Mycobacterium
GWVVLPALVAFGVVCWWVFFEKGLASAAYDAF

SEQ ID NO: 311004 - protein, 17 aa, Mycobacterium
GWVYMWTLVIAMATVAL

SEQ ID NO: 311005 - protein, 19 aa, Mycobacterium
GWWRQRLVDHVNRLGISDA

SEQ ID NO: 311006 - protein, 28 aa, Mycobacterium
GWWRSDRLFCIAVGFLALVFASSTTAGV

SEQ ID NO: 311007 - protein, 28 aa, Mycobacterium
GWWRTDRLFCIAVAFLALVFGATTVTGV

SEQ ID NO: 311008 - protein, 28 aa, Mycobacterium
GWWRTDRLFCIAVGFLALVFAAATVTGV

SEQ ID NO: 311009 - protein, 20 aa, Mycobacterium
GWWSSVWAICGWMVFVSMLI

SEQ ID NO: 311010 - protein, 20 aa, Mycobacterium
GWWTLILVAVFAVAIFVTYA

SEQ ID NO: 311011 - protein, 29 aa, Mycobacterium
GWYDRYHPYRQYYDWKFQNTNPVYSRSLW

SEQ ID NO: 311012 - protein, 17 aa, Mycobacterium
GWYYEWGAFIYIGVILG

SEQ ID NO: 311013 - protein, 21 aa, Mycobacterium
GYAGLLLLMRARLKRVPVGVR

SEQ ID NO: 311014 - protein, 17 aa, Mycobacterium
GYALMALTRALAAGRAD

SEQ ID NO: 311015 - protein, 26 aa, Mycobacterium
GYALQEFWPTWLFAVTVSVGGPLSYA

SEQ ID NO: 311016 - protein, 26 aa, Mycobacterium
GYALQWPLFAAFVIWAYRRFVQYEDE

SEQ ID NO: 311017 - protein, 28 aa, Mycobacterium
GYALQWPMFAGFCFYAYYKFVRYEEAPP

SEQ ID NO: 311018 - protein, 32 aa, Mycobacterium
GYAMQWPLFAGFCFYAYFKFVRYEEAPPELHP

SEQ ID NO: 311019 - protein, 21 aa, Mycobacterium
GYARFWWPASPVWLPALLTVG

SEQ ID NO: 311020 - protein, 18 aa, Mycobacterium
GYASALAWVMFAILLGLT

SEQ ID NO: 311021 - protein, 20 aa, Mycobacterium
GYAVPLFVRIVEELAHTSTF

SEQ ID NO: 311022 - protein, 21 aa, Mycobacterium
GYCAGWLPWFADIDRQMYFFY

SEQ ID NO: 311023 - protein, 22 aa, Mycobacterium
GYDLVAACWATPPGQMLADPDR

SEQ ID NO: 311024 - protein, 35 aa, Mycobacterium
GYDPSWSLLYGYNVLDWFNWGLSGFNRYGYDFMGF

SEQ ID NO: 311025 - protein, 25 aa, Mycobacterium
GYELPKAMFWIGIVYILFATVVAFW

SEQ ID NO: 311026 - protein, 21 aa, Mycobacterium
GYELWRHVLQYGFAAWTGILL

SEQ ID NO: 311027 - protein, 32 aa, Mycobacterium
GYFGVLKILLEWVIGNLFGFSPLLAGMLAGGV

SEQ ID NO: 311028 - protein, 18 aa, Mycobacterium
GYFHTGDLGRWVDDDYLV

SEQ ID NO: 311029 - protein, 17 aa, Mycobacterium
GYFLIGIWANFFWGTVF

SEQ ID NO: 311030 - protein, 36 aa, Mycobacterium
GYFRRSLEDIVRFQAEFLWRDYFPRGLTDDGDEAPA

SEQ ID NO: 311031 - protein, 36 aa, Mycobacterium
GYFRRSLEDIVRFQAEFLWRDYFPRGLTDDGEEAPA

SEQ ID NO: 311032 - protein, 18 aa, Mycobacterium
GYFVCFIALFVLAGLGNG

SEQ ID NO: 311033 - protein, 25 aa, Mycobacterium
GYFVGRESIPVWTLLGVLLLSVMVS

SEQ ID NO: 311034 - protein, 26 aa, Mycobacterium
GYGAKNVKDVKCNGGKNPVVKKGDTF

SEQ ID NO: 311035 - protein, 25 aa, Mycobacterium
GYGFAASVLPVWLLLAPRDYLSTFM

SEQ ID NO: 311036 - protein, 24 aa, Mycobacterium
GYGLTAPLMRWFFDHYADPEVRDD

SEQ ID NO: 311037 - protein, 18 aa, Mycobacterium
GYGSAAYWVEHVRKPVRF

SEQ ID NO: 311038 - protein, 26 aa, Mycobacterium
GYGTPISIAVPAYWSDEQFAALRDEF

SEQ ID NO: 311039 - protein, 33 aa, Mycobacterium
GYGYGPAFRGLRAAWRRGREIYAEVAASEDVKV

SEQ ID NO: 311040 - protein, 33 aa, Mycobacterium
GYGYGPAFRGLRSVWRRGREIYAEVVAPEDATV

SEQ ID NO: 311041 - protein, 19 aa, Mycobacterium
GYHPVRSRTGWQLWTTERL

SEQ ID NO: 311042 - protein, 19 aa, Mycobacterium
GYHRGWRETVAMRIADVIM

SEQ ID NO: 311043 - protein, 18 aa, Mycobacterium
GYHRRAGLTAATMVADPY

SEQ ID NO: 311044 - protein, 24 aa, Mycobacterium
GYHSLPIGNVMPGFGHVGLGGSLG

SEQ ID NO: 311045 - protein, 38 aa, Mycobacterium
GYIGMVLGAYRWLRPHGRRTAKEIAVEFSTALLRGLIR

SEQ ID NO: 311046 - protein, 17 aa, Mycobacterium
GYKLPIVAGCLIQTGGF

SEQ ID NO: 311047 - protein, 17 aa, Mycobacterium
GYLDRYGIRADKIRITS

SEQ ID NO: 311048 - protein, 19 aa, Mycobacterium
GYLFRRRLGTHLRTLFLGL

SEQ ID NO: 311049 - protein, 19 aa, Mycobacterium
GYLGARLGVAGAAFLVAGG

SEQ ID NO: 311050 - protein, 23 aa, Mycobacterium
GYLGLANGLGFLAGATVGYLLLR

SEQ ID NO: 311051 - protein, 23 aa, Mycobacterium
GYLHRGALTAARFVASPFDQGAR

SEQ ID NO: 311052 - protein, 24 aa, Mycobacterium
GYLKDRLADMLKMADELGGMISTV

SEQ ID NO: 311053 - protein, 21 aa, Mycobacterium
GYLMCAVLLAGAIWVASTSRS

SEQ ID NO: 311054 - protein, 20 aa, Mycobacterium
GYLNLCVWLIPAMFGVAYRR

SEQ ID NO: 311055 - protein, 22 aa, Mycobacterium
GYLRAELLLVLGTSSAEPALPG

SEQ ID NO: 311056 - protein, 25 aa, Mycobacterium
GYLTARISLGAALTISAIVMVVTSF

SEQ ID NO: 311057 - protein, 21 aa, Mycobacterium
GYLVVAVAFVIIKIVQAGVVG

SEQ ID NO: 311058 - protein, 21 aa, Mycobacterium
GYMRVPAMVGIGQYRVTVELP

SEQ ID NO: 311059 - protein, 27 aa, Mycobacterium
GYMVIGWQAGVAFTRESLRAIGRILPL

SEQ ID NO: 311060 - protein, 21 aa, Mycobacterium
GYNVVIGWMLFWRFYAKSISF

SEQ ID NO: 311061 - protein, 18 aa, Mycobacterium
GYNWDGYNWSGYNRDGRD

SEQ ID NO: 311062 - protein, 22 aa, Mycobacterium
GYPARMVVPGLYGYVSATKWVV

SEQ ID NO: 311063 - protein, 25 aa, Mycobacterium
GYPDPNLRPAIVGVFTDLTGPAPPG

SEQ ID NO: 311064 - protein, 25 aa, Mycobacterium
GYPDPNLRPAIVGVFTDLTGPAPQG

SEQ ID NO: 311065 - protein, 24 aa, Mycobacterium
GYPGLKRNPLLWVTLVGTMCVLAP

SEQ ID NO: 311066 - protein, 26 aa, Mycobacterium
GYPLAFALCGLFPLAAAPLVPVGLRP

SEQ ID NO: 311067 - protein, 24 aa, Mycobacterium
GYQKCGDPAWIDRAMFLGIGGGAV

SEQ ID NO: 311068 - protein, 24 aa, Mycobacterium
GYQTRLQERYVWNSVDVLLEAFVF

SEQ ID NO: 311069 - protein, 18 aa, Mycobacterium
GYRDGYGEVFLLIDNLYA

SEQ ID NO: 311070 - protein, 27 aa, Mycobacterium
GYRGPVRPRFWLTVPVDAGTAGRTPLG

SEQ ID NO: 311071 - protein, 18 aa, Mycobacterium
GYRLQRPDLVGCLDSRGD

SEQ ID NO: 311072 - protein, 35 aa, Mycobacterium
GYRRSRAGEVLMRILDVLFAFPLVLLAIALSAVLG

SEQ ID NO: 311073 - protein, 23 aa, Mycobacterium
GYSARLLTGIAIAFAGVVLISAG

SEQ ID NO: 311074 - protein, 18 aa, Mycobacterium
GYSFRTAFVESKPLKGGA

SEQ ID NO: 311075 - protein, 28 aa, Mycobacterium
GYSKFWWPDIPAWLPVVITVSLILGCNL

SEQ ID NO: 311076 - protein, 19 aa, Mycobacterium
GYSRFPVANVDGSFVGYLH

SEQ ID NO: 311077 - protein, 23 aa, Mycobacterium
GYSSVRTLVWQRWPTTGLAPPAT

SEQ ID NO: 311078 - protein, 20 aa, Mycobacterium
GYTGRPGLTATRFVANPFDG

SEQ ID NO: 311079 - protein, 24 aa, Mycobacterium
GYVAFCHSARLLVFILATALGAAA

SEQ ID NO: 311080 - protein, 18 aa, Mycobacterium
GYVAIWFADALLHGAGAT

SEQ ID NO: 311081 - protein, 25 aa, Mycobacterium
GYVSATKWVVDWEITRFDKADAYWT

SEQ ID NO: 311082 - protein, 19 aa, Mycobacterium
GYVSEDFLLLAAVALALVF

SEQ ID NO: 311083 - protein, 19 aa, Mycobacterium
GYVVDRFGERLVLGLGSAL

SEQ ID NO: 311084 - protein, 22 aa, Mycobacterium
GYVVPRVSGWLTGDDPMAALAA

SEQ ID NO: 311085 - protein, 26 aa, Mycobacterium
GYVVWRLFGHIPYRIDIDIYQMGGQA

SEQ ID NO: 311086 - protein, 24 aa, Mycobacterium
GYVYFAGRLGDWLRVDGENLGTAP

SEQ ID NO: 311087 - protein, 18 aa, Mycobacterium
GYVYNRWAIRTGGDVQRK

SEQ ID NO: 311088 - protein, 23 aa, Mycobacterium
GYWPAAAGLFAFVWLELASPDPG

SEQ ID NO: 311089 - protein, 25 aa, Mycobacterium
GYWRRTGLTSTRFVACPFGEPGGRM

SEQ ID NO: 311090 - protein, 18 aa, Mycobacterium
GYYQPLFRLDLSTGAIGQ

SEQ ID NO: 311091 - protein, 18 aa, Mycobacterium
GYYVCLLVTAFVFAPLSV

SEQ ID NO: 311092 - protein, 24 aa, Mycobacterium
HAAAQRKALEWSHPDPEELTTVPG

SEQ ID NO: 311093 - protein, 23 aa, Mycobacterium
HAAEMIAALACRNACEVMADFAR

SEQ ID NO: 311094 - protein, 25 aa, Mycobacterium
HAAEQRAALEWSHPEPEVLATIPGT

SEQ ID NO: 311095 - protein, 20 aa, Mycobacterium
HAAGAARLRVRITPADAGSV

SEQ ID NO: 311096 - protein, 22 aa, Mycobacterium
HAAMWWSIDRELAPSDAPPVAL

SEQ ID NO: 311097 - protein, 28 aa, Mycobacterium
HAAPMAALLKWLGVPQFAVFDWLFWLFS

SEQ ID NO: 311098 - protein, 25 aa, Mycobacterium
HAAQFRKLFWLNLILAVPVVAFSGM

SEQ ID NO: 311099 - protein, 31 aa, Mycobacterium
HAAVVPAHWSEWMPAGVFFAAMALAQAGWAL

SEQ ID NO: 311100 - protein, 19 aa, Mycobacterium
HADAPPFFVLHGRNDSLAY

SEQ ID NO: 311101 - protein, 21 aa, Mycobacterium
HADARRLAIEFVGSVATPGLI

SEQ ID NO: 311102 - protein, 22 aa, Mycobacterium
HADRRYVVVLGIVVIVIAALLN

SEQ ID NO: 311103 - protein, 24 aa, Mycobacterium
HADVTPELDAVVLKALAKNPDNRY

SEQ ID NO: 311104 - protein, 17 aa, Mycobacterium
HAEEIAQDYAVHAAEMN

SEQ ID NO: 311105 - protein, 22 aa, Mycobacterium
HAEEINRAVILIAVTVLLVGAV

SEQ ID NO: 311106 - protein, 27 aa, Mycobacterium
HAEFREYRFLPAVGVVLYVVFVATAGR

SEQ ID NO: 311107 - protein, 27 aa, Mycobacterium
HAFFEKRGPFAIVIARFVPIVRTLAPI

SEQ ID NO: 311108 - protein, 22 aa, Mycobacterium
HAFSAPIGYLFRPYIVYRSRDA

SEQ ID NO: 311109 - protein, 19 aa, Mycobacterium
HAFTAWRFGDHGVETRGYL

SEQ ID NO: 311110 - protein, 18 aa, Mycobacterium
HAGESLIDVMSWPGYLFM

SEQ ID NO: 311111 - protein, 29 aa, Mycobacterium
HAGPGRLEALWRGSLVVFQSILAVAFGAG

SEQ ID NO: 311112 - protein, 25 aa, Mycobacterium
HAGSIGRLSVPPSWAQALPDVESIP

SEQ ID NO: 311113 - protein, 17 aa, Mycobacterium
HAGSVVLRGRLVVRASA

SEQ ID NO: 311114 - protein, 24 aa, Mycobacterium
HAGTGNPLWLIVVVLVLAGIMGLF

SEQ ID NO: 311115 - protein, 17 aa, Mycobacterium
HAGYMSNYFRWFGSPED

SEQ ID NO: 311116 - protein, 25 aa, Mycobacterium
HAIATRLPMVLTFIVLITVVLVFLL

SEQ ID NO: 311117 - protein, 24 aa, Mycobacterium
HAIMLCAFAIALAPAITRWAQRPR

SEQ ID NO: 311118 - protein, 23 aa, Mycobacterium
HAIPKPQLFSAGWVDPEPDTVIV

SEQ ID NO: 311119 - protein, 25 aa, Mycobacterium
HAITARLPLVLGLIAAITFTLLFLL

SEQ ID NO: 311120 - protein, 24 aa, Mycobacterium
HAIYILKLIFGYALGGVIVATLTS

SEQ ID NO: 311121 - protein, 17 aa, Mycobacterium
HALALAGSMTWEILWAL

SEQ ID NO: 311122 - protein, 27 aa, Mycobacterium
HALALTGSMTWEILWALILGFTLSAMV

SEQ ID NO: 311123 - protein, 25 aa, Mycobacterium
HALDACPWPPPTVFLMRRGANGNYT

SEQ ID NO: 311124 - protein, 18 aa, Mycobacterium
HALGFRPLLGILVAALIG

SEQ ID NO: 311125 - protein, 19 aa, Mycobacterium
HALGPYPFDPSLVAQGVPP

SEQ ID NO: 311126 - protein, 27 aa, Mycobacterium
HALHTRICLWLGLLCGMFPVLAVFLIF

SEQ ID NO: 311127 - protein, 20 aa, Mycobacterium
HALLRGIPMTSIMAEMFGKQ

SEQ ID NO: 311128 - protein, 26 aa, Mycobacterium
HALLSRLPRNSVVSFMLPNWHEAAVI

SEQ ID NO: 311129 - protein, 19 aa, Mycobacterium
HALNKVWRRHMLAVHDLDP

SEQ ID NO: 311130 - protein, 25 aa, Mycobacterium
HALPLFGSIRLPRELTPIDPALHNG

SEQ ID NO: 311131 - protein, 25 aa, Mycobacterium
HALSRIPLPASVPVRQWLSALARPE

SEQ ID NO: 311132 - protein, 18 aa, Mycobacterium
HAMAVTWQGNPVVLGGWK

SEQ ID NO: 311133 - protein, 19 aa, Mycobacterium
HANHYFARDPLKPELTLAD

SEQ ID NO: 311134 - protein, 22 aa, Mycobacterium
HANHYFAREAMKPEVTLADYKV

SEQ ID NO: 311135 - protein, 25 aa, Mycobacterium
HANLRFFGERLVRVMNENDMLEGRL

SEQ ID NO: 311136 - protein, 22 aa, Mycobacterium
HAPELRVAGVLTDVIAESQRQQ

SEQ ID NO: 311137 - protein, 24 aa, Mycobacterium
HAPELRVGGLLPHQLEVARHRRGE

SEQ ID NO: 311138 - protein, 19 aa, Mycobacterium
HAPESKASVVLDISPVSAR

SEQ ID NO: 311139 - protein, 26 aa, Mycobacterium
HAPGFWARLALRAIVFTIVMAGVFRL

SEQ ID NO: 311140 - protein, 17 aa, Mycobacterium
HAPHPDDLLSIVGTHRQ

SEQ ID NO: 311141 - protein, 27 aa, Mycobacterium
HAPLAGLTPCWGEHLLVLRSLNPLSSK

SEQ ID NO: 311142 - protein, 24 aa, Mycobacterium
HAPLWRHFIHFWTVSFPVVAYRSW

SEQ ID NO: 311143 - protein, 18 aa, Mycobacterium
HAPRRRGRDDLSVDDEDA

SEQ ID NO: 311144 - protein, 23 aa, Mycobacterium
HAPWKKRGRYAAIPQAGVPLGVL

SEQ ID NO: 311145 - protein, 18 aa, Mycobacterium
HAPYLAWLTTTSADYAAT

SEQ ID NO: 311146 - protein, 20 aa, Mycobacterium
HARAQLVVMPSFDLAEFLGN

SEQ ID NO: 311147 - protein, 17 aa, Mycobacterium
HARILIAVMLFITVVIN

SEQ ID NO: 311148 - protein, 19 aa, Mycobacterium
HARIVRYGANEIVEHAGRV

SEQ ID NO: 311149 - protein, 19 aa, Mycobacterium
HARRARKIMLQNIGLSLAI

SEQ ID NO: 311150 - protein, 17 aa, Mycobacterium
HARRARTIMLQNVGLSL

SEQ ID NO: 311151 - protein, 18 aa, Mycobacterium
HARRSGAEYDEFIKRYIE

SEQ ID NO: 311152 - protein, 26 aa, Mycobacterium
HARTWKTRLLTLLAIVGPGIIVMVGD

SEQ ID NO: 311153 - protein, 17 aa, Mycobacterium
HASGCSLKSLTTATTAD

SEQ ID NO: 311154 - protein, 24 aa, Mycobacterium
HASGFRFDTICAVAIEDAVGMVAG

SEQ ID NO: 311155 - protein, 17 aa, Mycobacterium
HASGIWFITQDFRDLAR

SEQ ID NO: 311156 - protein, 22 aa, Mycobacterium
HASPDPGDRLVASGSMFDDVSA

SEQ ID NO: 311157 - protein, 19 aa, Mycobacterium
HATDLLFNGVIGRELPAGL

SEQ ID NO: 311158 - protein, 19 aa, Mycobacterium
HATDLLFNGVIGRQLPAGQ

SEQ ID NO: 311159 - protein, 19 aa, Mycobacterium
HATDLLFNGVIGRQLPAGS

SEQ ID NO: 311160 - protein, 21 aa, Mycobacterium
HATDLLFNGVIGRRLPADITK

SEQ ID NO: 311161 - protein, 27 aa, Mycobacterium
HATRILAIPILIGWLLITAALNVIAPQ

SEQ ID NO: 311162 - protein, 17 aa, Mycobacterium
HAVAAVFNPLLGGLAVA

SEQ ID NO: 311163 - protein, 21 aa, Mycobacterium
HAVAQRVARRPAPVALVTVAL

SEQ ID NO: 311164 - protein, 17 aa, Mycobacterium
HAVCDFLAHQHNFSDAV

SEQ ID NO: 311165 - protein, 23 aa, Mycobacterium
HAVHPVAMLGFMILISAAFVAAT

SEQ ID NO: 311166 - protein, 18 aa, Mycobacterium
HAVIGCGEPQVVVRRGVA

SEQ ID NO: 311167 - protein, 24 aa, Mycobacterium
HAVPGVGAVLAWLVNTGISAVVGL

SEQ ID NO: 311168 - protein, 18 aa, Mycobacterium
HAWSDELHLLLDHGDGRT

SEQ ID NO: 311169 - protein, 27 aa, Mycobacterium
HAYGWRIPFLLGGVFGLVAIYMRRKMP

SEQ ID NO: 311170 - protein, 18 aa, Mycobacterium
HAYPRTGSVVVWYSPRRC

SEQ ID NO: 311171 - protein, 26 aa, Mycobacterium
HAYTAWRFGDTQARGYLTLNPLQYTD

SEQ ID NO: 311172 - protein, 26 aa, Mycobacterium
HCGAEHHPAERFCPNCGKHIELPAPA

SEQ ID NO: 311173 - protein, 24 aa, Mycobacterium
HCLTRAVGSAAVWWVVAAGAALGA

SEQ ID NO: 311174 - protein, 20 aa, Mycobacterium
HCPACREAVADLSGVPALLS

SEQ ID NO: 311175 - protein, 17 aa, Mycobacterium
HCVALPAARLGAGATVG

SEQ ID NO: 311176 - protein, 17 aa, Mycobacterium
HCYPIGLLFGLGFDTAT

SEQ ID NO: 311177 - protein, 27 aa, Mycobacterium
HDAARQWFSAKWPGFFATNRQPQPLLD

SEQ ID NO: 311178 - protein, 25 aa, Mycobacterium
HDAQAVIMSPNLVAARFIQLTPAYT

SEQ ID NO: 311179 - protein, 24 aa, Mycobacterium
HDDVIEFEPRYAIRQPDGGWGEYV

SEQ ID NO: 311180 - protein, 20 aa, Mycobacterium
HDEWVRPVWLSRNFGQHPAT

SEQ ID NO: 311181 - protein, 17 aa, Mycobacterium
HDFWRGHIGEWIITRGL

SEQ ID NO: 311182 - protein, 20 aa, Mycobacterium
HDGPPFIKLRPEDMDAGGME

SEQ ID NO: 311183 - protein, 22 aa, Mycobacterium
HDGRLVVFTRWDLGTDPLDVLD

SEQ ID NO: 311184 - protein, 22 aa, Mycobacterium
HDGTWRPFLLSFAISYGVGLTV

SEQ ID NO: 311185 - protein, 26 aa, Mycobacterium
HDHCGLPVAVFRSGMIMVDPTYAGQL

SEQ ID NO: 311186 - protein, 22 aa, Mycobacterium
HDICSADPWVYGYTFPATPLNY

SEQ ID NO: 311187 - protein, 23 aa, Mycobacterium
HDLGFRLVERWQFNLVQVLKAQR

SEQ ID NO: 311188 - protein, 23 aa, Mycobacterium
HDLGFRLVERWQFNLVQVLKATK

SEQ ID NO: 311189 - protein, 17 aa, Mycobacterium
HDLHIWEITSGSPALSA

SEQ ID NO: 311190 - protein, 17 aa, Mycobacterium
HDLHVWEITSGDPALSA

SEQ ID NO: 311191 - protein, 18 aa, Mycobacterium
HDLHVWTLSPGKDMCTAH

SEQ ID NO: 311192 - protein, 17 aa, Mycobacterium
HDLHVWTLSPGKDMVTA

SEQ ID NO: 311193 - protein, 30 aa, Mycobacterium
HDLLRRNGVHPAQLAALVTVGGGARIPVVT

SEQ ID NO: 311194 - protein, 25 aa, Mycobacterium
HDLPLRSRDRLPLMNALLGANDDVV

SEQ ID NO: 311195 - protein, 24 aa, Mycobacterium
HDLPLRSRDRLPLMNTLLGPNDAD

SEQ ID NO: 311196 - protein, 19 aa, Mycobacterium
HDLRHRFRIIAAHTEKVID

SEQ ID NO: 311197 - protein, 19 aa, Mycobacterium
HDLSHAYSVVFAAAVGLVA

SEQ ID NO: 311198 - protein, 23 aa, Mycobacterium
HDLTAFFAWTAWAGAAERPGHKY

SEQ ID NO: 311199 - protein, 26 aa, Mycobacterium
HDMRIPRNRAVIMLVIDMSQSMRATD

SEQ ID NO: 311200 - protein, 25 aa, Mycobacterium
HDMRIPRNRAVVVLVIDMSQSMRAT

SEQ ID NO: 311201 - protein, 25 aa, Mycobacterium
HDPATRLTPSLAWNTAVSFVTNTNW

SEQ ID NO: 311202 - protein, 23 aa, Mycobacterium
HDPGQTWVLVFAITMMGGLVVSL

SEQ ID NO: 311203 - protein, 23 aa, Mycobacterium
HDPGQTWVLVFAVTMMAGLLVSL

SEQ ID NO: 311204 - protein, 23 aa, Mycobacterium
HDPKRALFKLGLVLQSDDKDLYL

SEQ ID NO: 311205 - protein, 18 aa, Mycobacterium
HDPRFAFVRIDGTDEAKP

SEQ ID NO: 311206 - protein, 30 aa, Mycobacterium
HDQCAAKLDTRRMWAIPIGVLSFVIALCAA

SEQ ID NO: 311207 - protein, 26 aa, Mycobacterium
HDRGEFEGRLWISMDYVDGHDAARLL

SEQ ID NO: 311208 - protein, 22 aa, Mycobacterium
HDRGEFHGQLWISMDYVEGTDA

SEQ ID NO: 311209 - protein, 25 aa, Mycobacterium
HDRGEFNGQLWISMDYIEGTDAAAL

SEQ ID NO: 311210 - protein, 24 aa, Mycobacterium
HDSPSCLGDGFAVPRTKSPEDVLE

SEQ ID NO: 311211 - protein, 23 aa, Mycobacterium
HDTTHFPLTWVLTPGRELAIKLE

SEQ ID NO: 311212 - protein, 18 aa, Mycobacterium
HDTWWLVLGKALAIFVFL

SEQ ID NO: 311213 - protein, 23 aa, Mycobacterium
HDVVWPVMIVLLLNVAAAYSAKR

SEQ ID NO: 311214 - protein, 23 aa, Mycobacterium
HDYGEIDGLLFVDMRMIDGVDLR

SEQ ID NO: 311215 - protein, 23 aa, Mycobacterium
HDYGEIDGQIFLEMRLVEGTDLG

SEQ ID NO: 311216 - protein, 24 aa, Mycobacterium
HDYGEIDGQMFLEMRLIEGTNLDS

SEQ ID NO: 311217 - protein, 21 aa, Mycobacterium
HEAAEVLVILNAIRAARTHPL

SEQ ID NO: 311218 - protein, 22 aa, Mycobacterium
HEAPYWVCAIYLVLLAIGGIGA

SEQ ID NO: 311219 - protein, 22 aa, Mycobacterium
HEAPYWVCATYLVLLALVGIAA

SEQ ID NO: 311220 - protein, 21 aa, Mycobacterium
HEAPYWVCAVYLVLIAIAGLG

SEQ ID NO: 311221 - protein, 25 aa, Mycobacterium
HEDWCRYYRRHGWRHGPRRDDRAKV

SEQ ID NO: 311222 - protein, 23 aa, Mycobacterium
HEFANRLHLLNGLLHTGHLDEGL

SEQ ID NO: 311223 - protein, 17 aa, Mycobacterium
HEFGHAAAARYGGSTPG

SEQ ID NO: 311224 - protein, 17 aa, Mycobacterium
HEFLRKRLPQLTKRQRF

SEQ ID NO: 311225 - protein, 29 aa, Mycobacterium
HEGIRLRTKLRLFGFEVIETVSEEAAREG

SEQ ID NO: 311226 - protein, 21 aa, Mycobacterium
HEGNGGIVVAQWVRGGSLREV

SEQ ID NO: 311227 - protein, 19 aa, Mycobacterium
HEIAFRILAFVIFAVAAIT

SEQ ID NO: 311228 - protein, 32 aa, Mycobacterium
HEIGALAGIFVCLFCAFYFMTVTYSLMTFWIT

SEQ ID NO: 311229 - protein, 21 aa, Mycobacterium
HEILKGGALEAQRASDIIRQI

SEQ ID NO: 311230 - protein, 29 aa, Mycobacterium
HEISAVWAYDLAWRPTLVFQTYQALTPML

SEQ ID NO: 311231 - protein, 19 aa, Mycobacterium
HELADPLTPILAVGAAASA

SEQ ID NO: 311232 - protein, 20 aa, Mycobacterium
HELADPLTPILAVGAAASAI

SEQ ID NO: 311233 - protein, 31 aa, Mycobacterium
HELANSADLDWRSVWDRGWSAAAEAQDTPVQ

SEQ ID NO: 311234 - protein, 18 aa, Mycobacterium
HELIKFAIVGATTFVIDS

SEQ ID NO: 311235 - protein, 18 aa, Mycobacterium
HELIKFAIVGGTTFVIDS

SEQ ID NO: 311236 - protein, 19 aa, Mycobacterium
HELIKFAIVGGTTFVIDSA

SEQ ID NO: 311237 - protein, 21 aa, Mycobacterium
HELKTGDVMYLDIKEGAEFGA

SEQ ID NO: 311238 - protein, 19 aa, Mycobacterium
HELLYYKVLTEHLVELMPV

SEQ ID NO: 311239 - protein, 23 aa, Mycobacterium
HELREYGVRALLVEPSYTRTDFE

SEQ ID NO: 311240 - protein, 20 aa, Mycobacterium
HELRLRAGINTGNVISGLVG

SEQ ID NO: 311241 - protein, 21 aa, Mycobacterium
HELRRSATRFLFEFADDLQHD

SEQ ID NO: 311242 - protein, 23 aa, Mycobacterium
HELRRSATRFLFEFAGDLQNDAV

SEQ ID NO: 311243 - protein, 24 aa, Mycobacterium
HELRRSATRFMFEFADDLQNDPAT

SEQ ID NO: 311244 - protein, 19 aa, Mycobacterium
HELRTPLTTIRGYAELYRQ

SEQ ID NO: 311245 - protein, 21 aa, Mycobacterium
HELRTPLTTVRMAADLIHDHI

SEQ ID NO: 311246 - protein, 21 aa, Mycobacterium
HELRTPLTTVRMAADLIYDHS

SEQ ID NO: 311247 - protein, 22 aa, Mycobacterium
HELRTPLTTVRMAADLIYDHSA

SEQ ID NO: 311248 - protein, 22 aa, Mycobacterium
HELRTPLTTVRMAADLIYDHSE

SEQ ID NO: 311249 - protein, 20 aa, Mycobacterium
HEMLVLIPPMIDTMKTTKAL

SEQ ID NO: 311250 - protein, 18 aa, Mycobacterium
HERRGYRPAHAFLVAAAA

SEQ ID NO: 311251 - protein, 21 aa, Mycobacterium
HESKVKMVFWIIVLLLIGGPF

SEQ ID NO: 311252 - protein, 18 aa, Mycobacterium
HETFWRLTAFTIFLVAVI

SEQ ID NO: 311253 - protein, 23 aa, Mycobacterium
HETGVDWDVIFLLLGMMIIVSVL

SEQ ID NO: 311254 - protein, 24 aa, Mycobacterium
HETRLRGRVLRRSRGRHDGFGDDP

SEQ ID NO: 311255 - protein, 23 aa, Mycobacterium
HETSRAGNTFGITGMAVALIATV

SEQ ID NO: 311256 - protein, 22 aa, Mycobacterium
HEVGHAIGYLRHEACEKPGGLA

SEQ ID NO: 311257 - protein, 21 aa, Mycobacterium
HEVGHAIGYLRHEPCDKQGGL

SEQ ID NO: 311258 - protein, 22 aa, Mycobacterium
HEVGHAIGYRSHEPCEQDQQLA

SEQ ID NO: 311259 - protein, 18 aa, Mycobacterium
HEVIGDYCFTVSVRPADS

SEQ ID NO: 311260 - protein, 19 aa, Mycobacterium
HEVRFRYPRGESDALAPLS

SEQ ID NO: 311261 - protein, 40 aa, Mycobacterium
HEVTARFWRRSGIRIVRRPRAHLVASMLVLIVLAGCAGLV

SEQ ID NO: 311262 - protein, 32 aa, Mycobacterium
HFAVLPAHWQEWPASGVFFGLVAVFQLGWAVV

SEQ ID NO: 311263 - protein, 22 aa, Mycobacterium
HFDLGSPLFLEHVWGRQVGDYT

SEQ ID NO: 311264 - protein, 18 aa, Mycobacterium
HFDQDKWELFHVDEDRSE

SEQ ID NO: 311265 - protein, 19 aa, Mycobacterium
HFEHLLPVYVLVVVTVVAL

SEQ ID NO: 311266 - protein, 24 aa, Mycobacterium
HFFDAPCLLLGLLTVLAVVVAVLA

SEQ ID NO: 311267 - protein, 24 aa, Mycobacterium
HFFGCTPLGPVAWTGVFSATAGAT

SEQ ID NO: 311268 - protein, 25 aa, Mycobacterium
HFFGCTPMGPVAWTGVIGATAGATV

SEQ ID NO: 311269 - protein, 20 aa, Mycobacterium
HFFNLFLMMFIIRSGIQILC

SEQ ID NO: 311270 - protein, 19 aa, Mycobacterium
HFFVAPALMLGLLTVLAVV

SEQ ID NO: 311271 - protein, 17 aa, Mycobacterium
HFLIVGYLFYWAIIGID

SEQ ID NO: 311272 - protein, 17 aa, Mycobacterium
HFLLSGYLFYWVVIGID

SEQ ID NO: 311273 - protein, 21 aa, Mycobacterium
HFLLSGYLFYWVVIGIDPSPR

SEQ ID NO: 311274 - protein, 19 aa, Mycobacterium
HFMEVRTAPRWLGHATDAW

SEQ ID NO: 311275 - protein, 22 aa, Mycobacterium
HFPDAEVVTMLRMLGIAMLEVG

SEQ ID NO: 311276 - protein, 17 aa, Mycobacterium
HFSEARMNPDLLMIESD

SEQ ID NO: 311277 - protein, 17 aa, Mycobacterium
HFSEARMNPDLLMVESN

SEQ ID NO: 311278 - protein, 17 aa, Mycobacterium
HFSEARMNPELLMLEAD

SEQ ID NO: 311279 - protein, 27 aa, Mycobacterium
HFVDAIICFIGFLFPLWDAKRQTLADK

SEQ ID NO: 311280 - protein, 26 aa, Mycobacterium
HFVDAIICFIGFLFPLWDSKRQTLAD

SEQ ID NO: 311281 - protein, 21 aa, Mycobacterium
HFVHLLPVYLLIVAVIAALAL

SEQ ID NO: 311282 - protein, 22 aa, Mycobacterium
HFWRVFEGIPQWALALFALGIA

SEQ ID NO: 311283 - protein, 20 aa, Mycobacterium
HGAAAIWLYAAVGFVLMTLG

SEQ ID NO: 311284 - protein, 27 aa, Mycobacterium
HGAALLGGPDKLVWTRVAGDVLDMALL

SEQ ID NO: 311285 - protein, 26 aa, Mycobacterium
HGAAMSWVTLVVWAVTGAVLATLATA

SEQ ID NO: 311286 - protein, 26 aa, Mycobacterium
HGAFVVRGAMKVAWDKLKGATGKLGA

SEQ ID NO: 311287 - protein, 22 aa, Mycobacterium
HGALCMLGTVWLVVRARTSTRA

SEQ ID NO: 311288 - protein, 20 aa, Mycobacterium
HGALPWAIGLLVLIGLGLLW

SEQ ID NO: 311289 - protein, 26 aa, Mycobacterium
HGANAGWWPVLWFTAKVWGFLFMYFW

SEQ ID NO: 311290 - protein, 20 aa, Mycobacterium
HGATPWCIAGIIVAAVTLVR

SEQ ID NO: 311291 - protein, 17 aa, Mycobacterium
HGCGGRVGAVPRTQLRK

SEQ ID NO: 311292 - protein, 17 aa, Mycobacterium
HGCSTCVGDRILVDKLT

SEQ ID NO: 311293 - protein, 25 aa, Mycobacterium
HGDEARILWAASWVAWSVFVVDYLI

SEQ ID NO: 311294 - protein, 19 aa, Mycobacterium
HGDGMPFLSLTGISAALVG

SEQ ID NO: 311295 - protein, 21 aa, Mycobacterium
HGEIPFADLLERFGTRLQKSA

SEQ ID NO: 311296 - protein, 27 aa, Mycobacterium
HGEPLPWQDLRAAFTERGWLDLTHNRR

SEQ ID NO: 311297 - protein, 26 aa, Mycobacterium
HGFGGGHGFGGFGGGHGFGGGHGFGG

SEQ ID NO: 311298 - protein, 17 aa, Mycobacterium
HGFWVAIWTFCVIATLQ

SEQ ID NO: 311299 - protein, 17 aa, Mycobacterium
HGGCVVVVPYLVTRNPV

SEQ ID NO: 311300 - protein, 18 aa, Mycobacterium
HGGDVLYYPPAVISVVLA

SEQ ID NO: 311301 - protein, 31 aa, Mycobacterium
HGGEFHYRYTVGLWFRRIWIFQPHGEVMINA

SEQ ID NO: 311302 - protein, 32 aa, Mycobacterium
HGGEFHYRYTVGLWFRRIWILQPHGEVMINAP

SEQ ID NO: 311303 - protein, 31 aa, Mycobacterium
HGGEFHYRYTVGMWFRRIWLFQPHGEVMINA

SEQ ID NO: 311304 - protein, 18 aa, Mycobacterium
HGGGHGRGGFNIPFIPGI

SEQ ID NO: 311305 - protein, 19 aa, Mycobacterium
HGGLLPAGLLPLVLVTSGV

SEQ ID NO: 311306 - protein, 32 aa, Mycobacterium
HGGMPARLVPDAVASLAALRVNPGLPTGGVVA

SEQ ID NO: 311307 - protein, 21 aa, Mycobacterium
HGGQLWPFHYVVSAVQPSLAG

SEQ ID NO: 311308 - protein, 17 aa, Mycobacterium
HGGSRFRALWAAGAGLV

SEQ ID NO: 311309 - protein, 17 aa, Mycobacterium
HGIGVDHMIDLRSNPAA

SEQ ID NO: 311310 - protein, 21 aa, Mycobacterium
HGLGARWVAMNELTFADAGAL

SEQ ID NO: 311311 - protein, 25 aa, Mycobacterium
HGLLIKCGIVLLLVFTAFVANSALH

SEQ ID NO: 311312 - protein, 19 aa, Mycobacterium
HGLPAIVIGISMVSLGVLV

SEQ ID NO: 311313 - protein, 27 aa, Mycobacterium
HGLPLRAMVMVLLFLGVIFLLVGFNAL

SEQ ID NO: 311314 - protein, 19 aa, Mycobacterium
HGLRQWRLHALVLITTFLI

SEQ ID NO: 311315 - protein, 25 aa, Mycobacterium
HGLSSCAAVLCDLVNYRLGYRVLRD

SEQ ID NO: 311316 - protein, 26 aa, Mycobacterium
HGMLPIPRFVAAQSFWRTPSIFHLRY

SEQ ID NO: 311317 - protein, 24 aa, Mycobacterium
HGNHEPAWVVAPGMQGVEVQPFTR

SEQ ID NO: 311318 - protein, 24 aa, Mycobacterium
HGNHEPGWIVAPGMQGVQVQPATA

SEQ ID NO: 311319 - protein, 20 aa, Mycobacterium
HGPDHLRLVVVTSDAAEWDW

SEQ ID NO: 311320 - protein, 33 aa, Mycobacterium
HGPGKARAVRNLAIRNGLNLKRCTAYSDSVNDV

SEQ ID NO: 311321 - protein, 26 aa, Mycobacterium
HGPKRELWLAWGILVVFYNLFFPMFF

SEQ ID NO: 311322 - protein, 29 aa, Mycobacterium
HGPLPRQIYWRRRALAAGIAALVIAVVVA

SEQ ID NO: 311323 - protein, 22 aa, Mycobacterium
HGPWTRLAPVIIGLVVVGIGMA

SEQ ID NO: 311324 - protein, 20 aa, Mycobacterium
HGQDRIDAFYTMYKGTAHVV

SEQ ID NO: 311325 - protein, 18 aa, Mycobacterium
HGQSPAAVVFVCSGTAPL

SEQ ID NO: 311326 - protein, 18 aa, Mycobacterium
HGRGHGRGGFNIPFIPGL

SEQ ID NO: 311327 - protein, 24 aa, Mycobacterium
HGRRIKPATLIAGLVAVALVAVAA

SEQ ID NO: 311328 - protein, 22 aa, Mycobacterium
HGRTMLVCFGVYLGGVTVPFFV

SEQ ID NO: 311329 - protein, 18 aa, Mycobacterium
HGSAQVLLVFTWATAAAA

SEQ ID NO: 311330 - protein, 18 aa, Mycobacterium
HGSGSIARFGRRIAALLV

SEQ ID NO: 311331 - protein, 20 aa, Mycobacterium
HGSLLDRHRPLWEAHLVEGL

SEQ ID NO: 311332 - protein, 26 aa, Mycobacterium
HGSQGYGYGSGYGRGAYAGDYQDYDD

SEQ ID NO: 311333 - protein, 17 aa, Mycobacterium
HGSTPRFGTDVTADDAV

SEQ ID NO: 311334 - protein, 21 aa, Mycobacterium
HGTPIRITLIVGFLVAVAASL

SEQ ID NO: 311335 - protein, 18 aa, Mycobacterium
HGVAHSIHRACIDHDDGE

SEQ ID NO: 311336 - protein, 26 aa, Mycobacterium
HGVDGLPFTWSVDSWAPRDTGLVVGV

SEQ ID NO: 311337 - protein, 25 aa, Mycobacterium
HGVIWKGLVSHVLIPAVVAAILAIA

SEQ ID NO: 311338 - protein, 24 aa, Mycobacterium
HGVIWKGVISKAIIPAVVSAILAI

SEQ ID NO: 311339 - protein, 18 aa, Mycobacterium
HGVTAWRSGAHSEPVVLR

SEQ ID NO: 311340 - protein, 20 aa, Mycobacterium
HGVVDPVAALTFDIPAGDPK

SEQ ID NO: 311341 - protein, 20 aa, Mycobacterium
HGYPAMFVALGVAGIIGAAA

SEQ ID NO: 311342 - protein, 23 aa, Mycobacterium
HGYPARLVVPGLYGYVSATKWVV

SEQ ID NO: 311343 - protein, 21 aa, Mycobacterium
HGYRAIVVVGALIWAGSLVWY

SEQ ID NO: 311344 - protein, 19 aa, Mycobacterium
HHAVPVWVVTAIVLAVVAV

SEQ ID NO: 311345 - protein, 17 aa, Mycobacterium
HHDELRRTAARVCRVLA

SEQ ID NO: 311346 - protein, 20 aa, Mycobacterium
HHFDIPGIVLSAVGMFLIVF

SEQ ID NO: 311347 - protein, 22 aa, Mycobacterium
HHFTDLLPLTPLQQGLLYHSGT

SEQ ID NO: 311348 - protein, 19 aa, Mycobacterium
HHGSGRWVLAAALAGLRSR

SEQ ID NO: 311349 - protein, 24 aa, Mycobacterium
HHIVRLVVFAGFLLGLWYLVAVAR

SEQ ID NO: 311350 - protein, 24 aa, Mycobacterium
HHKHWTWHGDFWPYELTFNVDTIV

SEQ ID NO: 311351 - protein, 17 aa, Mycobacterium
HHLFITFFVLHVLVVWS

SEQ ID NO: 311352 - protein, 20 aa, Mycobacterium
HHLRGRVVGVMAGLTYAAGP

SEQ ID NO: 311353 - protein, 19 aa, Mycobacterium
HHPAMMLRPGMHHGGAPAV

SEQ ID NO: 311354 - protein, 22 aa, Mycobacterium
HHPDLMALRARYERVAESMSAH

SEQ ID NO: 311355 - protein, 19 aa, Mycobacterium
HHRFWFRSTQFVLRHALPV

SEQ ID NO: 311356 - protein, 20 aa, Mycobacterium
HHRLGFAVPFTFASVAAVAQ

SEQ ID NO: 311357 - protein, 21 aa, Mycobacterium
HHRPPVPAWTLALVVSVPLLI

SEQ ID NO: 311358 - protein, 22 aa, Mycobacterium
HHSVTRFYGLNGLMKHPLHQTV

SEQ ID NO: 311359 - protein, 26 aa, Mycobacterium
HHTPGAWWFDMGMLVLISVFYVGFVR

SEQ ID NO: 311360 - protein, 24 aa, Mycobacterium
HHWARVRSGALIGFAGSFGALGGV

SEQ ID NO: 311361 - protein, 24 aa, Mycobacterium
HHWVKDLPDEPVWVRGDQDRLHQL

SEQ ID NO: 311362 - protein, 18 aa, Mycobacterium
HIATPLLIVLGVASGVAI

SEQ ID NO: 311363 - protein, 18 aa, Mycobacterium
HIAVKMPKMITGLRSFSI

SEQ ID NO: 311364 - protein, 24 aa, Mycobacterium
HIIDVKRALAWVKAHIAEYGGDPD

SEQ ID NO: 311365 - protein, 19 aa, Mycobacterium
HILLGVAGYNFGRFCLTPL

SEQ ID NO: 311366 - protein, 20 aa, Mycobacterium
HILLIPGIILALIGVHLALV

SEQ ID NO: 311367 - protein, 23 aa, Mycobacterium
HILLLERKQRLLVAVSDATLRDP

SEQ ID NO: 311368 - protein, 21 aa, Mycobacterium
HILLLPGIILALIGLHLALVW

SEQ ID NO: 311369 - protein, 18 aa, Mycobacterium
HIPFAWRSQRWVAARPES

SEQ ID NO: 311370 - protein, 25 aa, Mycobacterium
HIPLTAGVGLWAFLTRFALNCRLSS

SEQ ID NO: 311371 - protein, 19 aa, Mycobacterium
HIRSGEFSWRQSADAMRTV

SEQ ID NO: 311372 - protein, 25 aa, Mycobacterium
HIVDVKRALAWIKEHIAEYGGDPDF

SEQ ID NO: 311373 - protein, 24 aa, Mycobacterium
HIVDVKRALAWVKAHIAEYGGDPD

SEQ ID NO: 311374 - protein, 24 aa, Mycobacterium
HIVDVKRALAWVKAHIAEYGGDPE

SEQ ID NO: 311375 - protein, 23 aa, Mycobacterium
HIVDVKRALAWVKENIADYGGDP

SEQ ID NO: 311376 - protein, 23 aa, Mycobacterium
HIVDVKRALAWVKENISRYGGDP

SEQ ID NO: 311377 - protein, 23 aa, Mycobacterium
HIVLRRRAADMARPYRTPGGIAT

SEQ ID NO: 311378 - protein, 17 aa, Mycobacterium
HIYRVSARLPIEDLAEL

SEQ ID NO: 311379 - protein, 20 aa, Mycobacterium
HKAQAALRWMLGGLGGATWR

SEQ ID NO: 311380 - protein, 24 aa, Mycobacterium
HKDLTHVFAGFYIVGCIAAVLAVR

SEQ ID NO: 311381 - protein, 19 aa, Mycobacterium
HKELQFMQNFGFYFGYPMG

SEQ ID NO: 311382 - protein, 21 aa, Mycobacterium
HKEPRWPIPGTKAEKRAERTV

SEQ ID NO: 311383 - protein, 31 aa, Mycobacterium
HKFGHLLTGMAIRIADVWNMTRKVGVEEGYG

SEQ ID NO: 311384 - protein, 18 aa, Mycobacterium
HKGPRTNFNREMIGQGSA

SEQ ID NO: 311385 - protein, 25 aa, Mycobacterium
HKHGATWFLVLPIVLLIFIVPPALS

SEQ ID NO: 311386 - protein, 18 aa, Mycobacterium
HKHWGFGGGTHRCLGSHL

SEQ ID NO: 311387 - protein, 18 aa, Mycobacterium
HKLARAREAVEGGRHSGS

SEQ ID NO: 311388 - protein, 17 aa, Mycobacterium
HKLCGRDVVVVSASGEE

SEQ ID NO: 311389 - protein, 23 aa, Mycobacterium
HKLHQLRSYRLVSVLRLGVLVFL

SEQ ID NO: 311390 - protein, 21 aa, Mycobacterium
HKPLHAMAVAFFGPIFFATIG

SEQ ID NO: 311391 - protein, 30 aa, Mycobacterium
HKRFMPEGWWKPRPLDALVGAVLVWWHFVG

SEQ ID NO: 311392 - protein, 18 aa, Mycobacterium
HKSGMIVAGLKGGENDAQ

SEQ ID NO: 311393 - protein, 24 aa, Mycobacterium
HKVRSTLWALVAIVSVLLVVCIGL

SEQ ID NO: 311394 - protein, 19 aa, Mycobacterium
HKVWFAVAAILVLAALNLR

SEQ ID NO: 311395 - protein, 26 aa, Mycobacterium
HLAEILWDVIPFDWINDADTAATVYM

SEQ ID NO: 311396 - protein, 27 aa, Mycobacterium
HLAEQGWICVSIGYRISPKHSWPDHIV

SEQ ID NO: 311397 - protein, 19 aa, Mycobacterium
HLAGIEPQLAFTGDNLPLL

SEQ ID NO: 311398 - protein, 25 aa, Mycobacterium
HLALGIALLAWFGFYLFTISRGEAE

SEQ ID NO: 311399 - protein, 18 aa, Mycobacterium
HLAPLLSIDGWNADAEMA

SEQ ID NO: 311400 - protein, 25 aa, Mycobacterium
HLAQDLLEALAFGVGQLAADPGRRR

SEQ ID NO: 311401 - protein, 19 aa, Mycobacterium
HLARLSRQLILLTLVLASV

SEQ ID NO: 311402 - protein, 17 aa, Mycobacterium
HLARVFFTGAFRRPREA

SEQ ID NO: 311403 - protein, 20 aa, Mycobacterium
HLAVDMGFALSVVATAALVV

SEQ ID NO: 311404 - protein, 26 aa, Mycobacterium
HLDLDPLLPFPRWHEHAAVLEEPVRR

SEQ ID NO: 311405 - protein, 25 aa, Mycobacterium
HLDVPVFRVRLAFAVLGAASGMGIV

SEQ ID NO: 311406 - protein, 23 aa, Mycobacterium
HLEALARFALSLSDSVGHLTDHT

SEQ ID NO: 311407 - protein, 28 aa, Mycobacterium
HLELFWLSLRDSRWWLGALGAIANYLLQ

SEQ ID NO: 311408 - protein, 23 aa, Mycobacterium
HLESCRRCRAWLIGAAAQSRRFA

SEQ ID NO: 311409 - protein, 23 aa, Mycobacterium
HLESCRRCRSWLIGAAAQTRRLA

SEQ ID NO: 311410 - protein, 24 aa, Mycobacterium
HLESCRSCRSWLIGAAAQTRRFAS

SEQ ID NO: 311411 - protein, 23 aa, Mycobacterium
HLFAGSFKLGYVMQSTQAFGTVH

SEQ ID NO: 311412 - protein, 27 aa, Mycobacterium
HLFFEQRGPFAIVIARFVPIVRTLAPI

SEQ ID NO: 311413 - protein, 22 aa, Mycobacterium
HLGAVKIDWGALLIVSVLTVLL

SEQ ID NO: 311414 - protein, 25 aa, Mycobacterium
HLGGSRRAIFLGAMRVGRDHIASTV

SEQ ID NO: 311415 - protein, 31 aa, Mycobacterium
HLGTWAVDLFKILLMTGSFACGMAFHNCAAR

SEQ ID NO: 311416 - protein, 20 aa, Mycobacterium
HLHIFLAPINVVFKRLPDGL

SEQ ID NO: 311417 - protein, 19 aa, Mycobacterium
HLIAHDWGSIQAWAAVTDD

SEQ ID NO: 311418 - protein, 19 aa, Mycobacterium
HLIERPFAYLPQRQIGANA

SEQ ID NO: 311419 - protein, 17 aa, Mycobacterium
HLIKARVTWVRTIAPGP

SEQ ID NO: 311420 - protein, 17 aa, Mycobacterium
HLINGLGPLPWRAVLGI

SEQ ID NO: 311421 - protein, 35 aa, Mycobacterium
HLLGIPGWITQRLWWAVLLTVGFWGLLRVAEALGI

SEQ ID NO: 311422 - protein, 17 aa, Mycobacterium
HLLGIQINWVVLAMSVI

SEQ ID NO: 311423 - protein, 19 aa, Mycobacterium
HLLIPAILAVILAVLYALL

SEQ ID NO: 311424 - protein, 20 aa, Mycobacterium
HLLLVRPGFVIGRMTEGMSP

SEQ ID NO: 311425 - protein, 19 aa, Mycobacterium
HLLSRMWVLPIHRASTVVG

SEQ ID NO: 311426 - protein, 18 aa, Mycobacterium
HLLVAHVAALRHYLSEFN

SEQ ID NO: 311427 - protein, 18 aa, Mycobacterium
HLLVPILIAPSVLLCAVY

SEQ ID NO: 311428 - protein, 34 aa, Mycobacterium
HLMGGVNWWAPRFLTRIHRRLGFSDDPPTHQRAH

SEQ ID NO: 311429 - protein, 24 aa, Mycobacterium
HLMIASPFRAGERIGKLFSTHPPI

SEQ ID NO: 311430 - protein, 24 aa, Mycobacterium
HLMIASPFRAGERIGSLFSTHPPI

SEQ ID NO: 311431 - protein, 22 aa, Mycobacterium
HLNDFPVQYGLILLAAVGGFML

SEQ ID NO: 311432 - protein, 23 aa, Mycobacterium
HLNDFPYQYGLMALAILGGVIFA

SEQ ID NO: 311433 - protein, 23 aa, Mycobacterium
HLNFRRAAFISAVIGLVILPWNL

SEQ ID NO: 311434 - protein, 17 aa, Mycobacterium
HLNRAGLPHSSNEQFHA

SEQ ID NO: 311435 - protein, 23 aa, Mycobacterium
HLPAFRVAAAIAYAGLLFTWLLV

SEQ ID NO: 311436 - protein, 26 aa, Mycobacterium
HLPEIRYSMILFNWFGVCLVPILALI

SEQ ID NO: 311437 - protein, 25 aa, Mycobacterium
HLPEIRYSMIVFNWFGVCLVPILAL

SEQ ID NO: 311438 - protein, 21 aa, Mycobacterium
HLPIPRLSGTPSMPATTAPPA

SEQ ID NO: 311439 - protein, 24 aa, Mycobacterium
HLPNPRFALLTVVSSFVLAELSDK

SEQ ID NO: 311440 - protein, 20 aa, Mycobacterium
HLPQAFSHARRARRIMLQNV

SEQ ID NO: 311441 - protein, 24 aa, Mycobacterium
HLPRLRRELEKRLGPEGTDVLFGV

SEQ ID NO: 311442 - protein, 19 aa, Mycobacterium
HLQELRTRLLISVAAVLLT

SEQ ID NO: 311443 - protein, 25 aa, Mycobacterium
HLQHTKWGVGIALLFVTLPFVVRSV

SEQ ID NO: 311444 - protein, 37 aa, Mycobacterium
HLQWLGVDVKRVFEFGLHYWPWLMLGYVTYGVMVSSL

SEQ ID NO: 311445 - protein, 22 aa, Mycobacterium
HLRVALAGFVRALHAMGLDQPG

SEQ ID NO: 311446 - protein, 19 aa, Mycobacterium
HLSAARWYTWVIALVGVDL

SEQ ID NO: 311447 - protein, 17 aa, Mycobacterium
HLSFGLLLAGSFVLFSF

SEQ ID NO: 311448 - protein, 23 aa, Mycobacterium
HLSHIFFTIIGWIMRLAPVGALG

SEQ ID NO: 311449 - protein, 22 aa, Mycobacterium
HLSHIFFTVIGWIMRLAPLGAF

SEQ ID NO: 311450 - protein, 30 aa, Mycobacterium
HLSLALLHYRGWAIPVAFVIAQGTATVINF

SEQ ID NO: 311451 - protein, 18 aa, Mycobacterium
HLSLHGSGASRLRVRIAP

SEQ ID NO: 311452 - protein, 22 aa, Mycobacterium
HLSPGRWYTWVIAIVGVDLLYY

SEQ ID NO: 311453 - protein, 26 aa, Mycobacterium
HLSQAWTLRADEVIQNITVYPDGQCT

SEQ ID NO: 311454 - protein, 26 aa, Mycobacterium
HLSVPEGRRGRRRWMVAAAVAAVLAI

SEQ ID NO: 311455 - protein, 17 aa, Mycobacterium
HLSYRVCLKTFSAGESR

SEQ ID NO: 311456 - protein, 21 aa, Mycobacterium
HLTELRRRLLISLAAIVLTTI

SEQ ID NO: 311457 - protein, 17 aa, Mycobacterium
HLTELRSRLLIAVLAVL

SEQ ID NO: 311458 - protein, 23 aa, Mycobacterium
HLTELRTRLLLSLAAILITTIFG

SEQ ID NO: 311459 - protein, 17 aa, Mycobacterium
HLVGLTVEQTRLAVTNL

SEQ ID NO: 311460 - protein, 28 aa, Mycobacterium
HLVPQEGFCVYPWSPLRLINGTVGYTGV

SEQ ID NO: 311461 - protein, 27 aa, Mycobacterium
HLVRIFAVPIILGWVFVAVALAVVTPS

SEQ ID NO: 311462 - protein, 22 aa, Mycobacterium
HLYDRKGFHRIPGAVELAIAAE

SEQ ID NO: 311463 - protein, 22 aa, Mycobacterium
HLYDRKGFHRIPGAVEMAIAAE

SEQ ID NO: 311464 - protein, 21 aa, Mycobacterium
HLYDRKGFHRIPGAVEMAIAT

SEQ ID NO: 311465 - protein, 19 aa, Mycobacterium
HLYPGRTATSFALLTGQIV

SEQ ID NO: 311466 - protein, 25 aa, Mycobacterium
HLYPGRTGTSFALLTGQIVGVGYSG

SEQ ID NO: 311467 - protein, 17 aa, Mycobacterium
HMFGPEADLAVAIQRIT

SEQ ID NO: 311468 - protein, 23 aa, Mycobacterium
HMGRQAFAAVLGRGLASEGQLVL

SEQ ID NO: 311469 - protein, 31 aa, Mycobacterium
HMISAAALRRGRLMVLAAILLFALCLRSAVT

SEQ ID NO: 311470 - protein, 18 aa, Mycobacterium
HMIYRKRVADGLLPASDY

SEQ ID NO: 311471 - protein, 19 aa, Mycobacterium
HMLPGQRRKQAWLRELSNW

SEQ ID NO: 311472 - protein, 19 aa, Mycobacterium
HMLSAPVAYLFRPYIVYRS

SEQ ID NO: 311473 - protein, 23 aa, Mycobacterium
HNALRELSQAAGRLGDSRSDIFG

SEQ ID NO: 311474 - protein, 22 aa, Mycobacterium
HNCASRYLYALGREGLSRGLQK

SEQ ID NO: 311475 - protein, 23 aa, Mycobacterium
HNCASRYLYALGREGLSTGLQKT

SEQ ID NO: 311476 - protein, 22 aa, Mycobacterium
HNCASRYLYALGRERILPGVLG

SEQ ID NO: 311477 - protein, 27 aa, Mycobacterium
HNEVWAHYAGWWAFDIGMLVTFGVVAA

SEQ ID NO: 311478 - protein, 23 aa, Mycobacterium
HNGKAALIGIDWRSVGLGCLQVL

SEQ ID NO: 311479 - protein, 21 aa, Mycobacterium
HNITARYAFVLGQNNVFPKQL

SEQ ID NO: 311480 - protein, 21 aa, Mycobacterium
HNLFKPLLLFFYFGFLIPILK

SEQ ID NO: 311481 - protein, 26 aa, Mycobacterium
HNPDKVVYRRGFVTRHQVTGWRFVMR

SEQ ID NO: 311482 - protein, 19 aa, Mycobacterium
HNPQFAFVRIDAGTPDFRI

SEQ ID NO: 311483 - protein, 23 aa, Mycobacterium
HNRGRRILVNWVLALLTVPAAAL

SEQ ID NO: 311484 - protein, 24 aa, Mycobacterium
HNYGESVLDGWAAVAPPDGWTPED

SEQ ID NO: 311485 - protein, 25 aa, Mycobacterium
HPADRLIVIYADFKGEAGADIFRNF

SEQ ID NO: 311486 - protein, 28 aa, Mycobacterium
HPALAKAFLRFNLHLLFASTLPPRVREL

SEQ ID NO: 311487 - protein, 25 aa, Mycobacterium
HPALAKAFLRFNVHLLTSSTLPPRI

SEQ ID NO: 311488 - protein, 25 aa, Mycobacterium
HPALAKAFLRFNVHLLTSSTLPPRV

SEQ ID NO: 311489 - protein, 23 aa, Mycobacterium
HPALDLRIFRAGPFNAAVIAGLA

SEQ ID NO: 311490 - protein, 23 aa, Mycobacterium
HPALSLLLPMVFIALGGIGLPGA

SEQ ID NO: 311491 - protein, 22 aa, Mycobacterium
HPAPDCRVACGDVLVLYGHTDA

SEQ ID NO: 311492 - protein, 19 aa, Mycobacterium
HPARETWAALEIGAAGRPG

SEQ ID NO: 311493 - protein, 22 aa, Mycobacterium
HPARYLSVFLLLLVGVYLLVFL

SEQ ID NO: 311494 - protein, 21 aa, Mycobacterium
HPARYLTLFLVLLVGVYLLVF

SEQ ID NO: 311495 - protein, 23 aa, Mycobacterium
HPAWHTLILVLLFVAAMWVTYAL

SEQ ID NO: 311496 - protein, 17 aa, Mycobacterium
HPCYADYLPVTRAVPQP

SEQ ID NO: 311497 - protein, 25 aa, Mycobacterium
HPDAPHCGISWGWGAHGLVTNICVT

SEQ ID NO: 311498 - protein, 25 aa, Mycobacterium
HPDDFRLSGPEMRAVRQAVTRARRA

SEQ ID NO: 311499 - protein, 18 aa, Mycobacterium
HPDFGYFGPDSVTWRVFL

SEQ ID NO: 311500 - protein, 25 aa, Mycobacterium
HPDHKGRAVGIWAGFASAGSIMGLL

SEQ ID NO: 311501 - protein, 26 aa, Mycobacterium
HPDKTARWFGGIGLILGAVALVLAVT

SEQ ID NO: 311502 - protein, 19 aa, Mycobacterium
HPDLAPGAVQPALIGDAAA

SEQ ID NO: 311503 - protein, 19 aa, Mycobacterium
HPDLFWGVINSMYIGNLAL

SEQ ID NO: 311504 - protein, 25 aa, Mycobacterium
HPDRFRLSGPDMRAVRQAVTRARRA

SEQ ID NO: 311505 - protein, 23 aa, Mycobacterium
HPDVRLQIGREFNQSGFDAMTAR

SEQ ID NO: 311506 - protein, 24 aa, Mycobacterium
HPERDKRVAVAIVVLSALAAGTSL

SEQ ID NO: 311507 - protein, 24 aa, Mycobacterium
HPERDKRVAVGIVVLTALAVSTSL

SEQ ID NO: 311508 - protein, 25 aa, Mycobacterium
HPESERLWGVVKLRRAAFSGVVLTA

SEQ ID NO: 311509 - protein, 27 aa, Mycobacterium
HPFEVAGMKFVVWRSEAPREATLREIY

SEQ ID NO: 311510 - protein, 28 aa, Mycobacterium
HPFGYGRSRFFYSFVVALVLFTLGSVFA

SEQ ID NO: 311511 - protein, 22 aa, Mycobacterium
HPFIDLRFFRSIPFASATLTAI

SEQ ID NO: 311512 - protein, 22 aa, Mycobacterium
HPFLVMELIDGGTLRELLRERG

SEQ ID NO: 311513 - protein, 26 aa, Mycobacterium
HPFWSRPAPARILLAAVIGTQVIATL

SEQ ID NO: 311514 - protein, 19 aa, Mycobacterium
HPFWVRFWAGVSFALGPVP

SEQ ID NO: 311515 - protein, 38 aa, Mycobacterium
HPGAGQAAAVEWLDRLRALAQRTCVVPLPYAQADLDAL

SEQ ID NO: 311516 - protein, 17 aa, Mycobacterium
HPGDGFAGVAPDAALIS

SEQ ID NO: 311517 - protein, 18 aa, Mycobacterium
HPGGMSVALGQPGSQGES

SEQ ID NO: 311518 - protein, 18 aa, Mycobacterium
HPGLSFAALVAIAATAGF

SEQ ID NO: 311519 - protein, 25 aa, Mycobacterium
HPGTGQAAATIWLNRLRALAHRTCV

SEQ ID NO: 311520 - protein, 30 aa, Mycobacterium
HPGTGQGLAVAWLDRLRAMAKHTCVTPLPY

SEQ ID NO: 311521 - protein, 17 aa, Mycobacterium
HPHLAARFYERFDPPIQ

SEQ ID NO: 311522 - protein, 26 aa, Mycobacterium
HPHPRLEHRILLVLLIQADGAVVGVD

SEQ ID NO: 311523 - protein, 19 aa, Mycobacterium
HPHVSVVIIRMSQLGMLDA

SEQ ID NO: 311524 - protein, 18 aa, Mycobacterium
HPHWKRLIWPVLVLIVVT

SEQ ID NO: 311525 - protein, 17 aa, Mycobacterium
HPHWKRLIWPVVALLLA

SEQ ID NO: 311526 - protein, 25 aa, Mycobacterium
HPILVGYGFDGIWIGVLIVKVAEMA

SEQ ID NO: 311527 - protein, 28 aa, Mycobacterium
HPINGFVIAMCLAIAAAYAARAARFKPR

SEQ ID NO: 311528 - protein, 18 aa, Mycobacterium
HPLARAIVAAALDENLSL

SEQ ID NO: 311529 - protein, 18 aa, Mycobacterium
HPLARLFMIAIISAVAIG

SEQ ID NO: 311530 - protein, 19 aa, Mycobacterium
HPLGLPIPHTAIIKRKKDQ

SEQ ID NO: 311531 - protein, 20 aa, Mycobacterium
HPLLALDLFRNRTFTVAIVG

SEQ ID NO: 311532 - protein, 26 aa, Mycobacterium
HPLMSHLAELGWICVAINYRHSPRNT

SEQ ID NO: 311533 - protein, 22 aa, Mycobacterium
HPLPTLWPLLLVGYGVVAILPS

SEQ ID NO: 311534 - protein, 23 aa, Mycobacterium
HPLRTVRFWLAPIVVTLAVLAGL

SEQ ID NO: 311535 - protein, 17 aa, Mycobacterium
HPLWVVVLVSWLIAFFE

SEQ ID NO: 311536 - protein, 19 aa, Mycobacterium
HPMMPALLVKSVVKQRPST

SEQ ID NO: 311537 - protein, 18 aa, Mycobacterium
HPMRYLAAFLVLLIGAYL

SEQ ID NO: 311538 - protein, 20 aa, Mycobacterium
HPPGALLTFVWLDRIGLHGG

SEQ ID NO: 311539 - protein, 21 aa, Mycobacterium
HPPGALLTFVWLDRLGLHGGA

SEQ ID NO: 311540 - protein, 28 aa, Mycobacterium
HPPHGLAAWRVPLAILLTLWTIRTLAHW

SEQ ID NO: 311541 - protein, 18 aa, Mycobacterium
HPPIPTTPWQHHRHWITT

SEQ ID NO: 311542 - protein, 29 aa, Mycobacterium
HPPSARRLLAHYALGLAIAYVLAVLDASA

SEQ ID NO: 311543 - protein, 18 aa, Mycobacterium
HPQPFFAPISAAVCMSAT

SEQ ID NO: 311544 - protein, 17 aa, Mycobacterium
HPRLPRQDALKVLPTSI

SEQ ID NO: 311545 - protein, 22 aa, Mycobacterium
HPRPADLPRVWELIKVTRDDAL

SEQ ID NO: 311546 - protein, 17 aa, Mycobacterium
HPRRPAQGVGRHQAPPS

SEQ ID NO: 311547 - protein, 18 aa, Mycobacterium
HPRRRAARRITMFFKHAA

SEQ ID NO: 311548 - protein, 21 aa, Mycobacterium
HPRSGVLQLVVRFAQPLPQSP

SEQ ID NO: 311549 - protein, 21 aa, Mycobacterium
HPRTRIYWLAMPVDAGRAGHS

SEQ ID NO: 311550 - protein, 20 aa, Mycobacterium
HPRYGSPWVASIVQSAFVVI

SEQ ID NO: 311551 - protein, 24 aa, Mycobacterium
HPSELSWGVVGAWTGSAAAGLLVS

SEQ ID NO: 311552 - protein, 20 aa, Mycobacterium
HPSFARRDLSSMRRGNLYPI

SEQ ID NO: 311553 - protein, 26 aa, Mycobacterium
HPSIFAWAITAWLWFTVVFANLAEAV

SEQ ID NO: 311554 - protein, 23 aa, Mycobacterium
HPSVPFYRYLRTWKRNEEAYLER

SEQ ID NO: 311555 - protein, 23 aa, Mycobacterium
HPSVPFYRYVRTWKRNEEAYLER

SEQ ID NO: 311556 - protein, 23 aa, Mycobacterium
HPVFGRWVAHFNLLIAAALVPAA

SEQ ID NO: 311557 - protein, 22 aa, Mycobacterium
HPVKAGDTVQIWLDEKGAVTSA

SEQ ID NO: 311558 - protein, 24 aa, Mycobacterium
HPVLPRLVNMYGITETTVHASFRE

SEQ ID NO: 311559 - protein, 17 aa, Mycobacterium
HPVRGRLADLLTLAGVA

SEQ ID NO: 311560 - protein, 21 aa, Mycobacterium
HPVRSRQGWQLWATERLMDAA

SEQ ID NO: 311561 - protein, 20 aa, Mycobacterium
HPVRSRVGWQLWATERLMDA

SEQ ID NO: 311562 - protein, 22 aa, Mycobacterium
HPVTNMFLVLSVITALIAGWLH

SEQ ID NO: 311563 - protein, 18 aa, Mycobacterium
HPVYNLASARLLLGSPEV

SEQ ID NO: 311564 - protein, 20 aa, Mycobacterium
HPWRGMLRRDLGPAAYVFGL

SEQ ID NO: 311565 - protein, 21 aa, Mycobacterium
HPYVDIAHRAALLYSFATMLL

SEQ ID NO: 311566 - protein, 23 aa, Mycobacterium
HQALWCGLGGMAGNLHGPAAPDP

SEQ ID NO: 311567 - protein, 18 aa, Mycobacterium
HQGLTWVAGLLFPAFSIG

SEQ ID NO: 311568 - protein, 24 aa, Mycobacterium
HQGSGPPLWVVFSAGTAIAIGTYL

SEQ ID NO: 311569 - protein, 23 aa, Mycobacterium
HQKLCDAYKLAGRAVQIETNGKN

SEQ ID NO: 311570 - protein, 23 aa, Mycobacterium
HQLMPGYTRPHVRLFSDQVSTGC

SEQ ID NO: 311571 - protein, 23 aa, Mycobacterium
HQLPCPERLAWVAALAPDDRMTY

SEQ ID NO: 311572 - protein, 18 aa, Mycobacterium
HQLRSYRLASLLRIGVVA

SEQ ID NO: 311573 - protein, 27 aa, Mycobacterium
HQLYRRLKRWLSLFERSAIREPESQSA

SEQ ID NO: 311574 - protein, 24 aa, Mycobacterium
HQNAQPGKFMPLLPTQQQAPVPPP

SEQ ID NO: 311575 - protein, 30 aa, Mycobacterium
HQPIRLSSLRGRVVLVDFWAYSCINCQRAI

SEQ ID NO: 311576 - protein, 24 aa, Mycobacterium
HQRRTLVLCFFCIVVDGLEVTVVG

SEQ ID NO: 311577 - protein, 24 aa, Mycobacterium
HQVTGWRFVMRRIASGVALHDARM

SEQ ID NO: 311578 - protein, 24 aa, Mycobacterium
HRAAGLLARLAADFIRITAITLVV

SEQ ID NO: 311579 - protein, 21 aa, Mycobacterium
HRAKGSLIFDLGIILVLISLP

SEQ ID NO: 311580 - protein, 17 aa, Mycobacterium
HRALMAIAIGDLGLAST

SEQ ID NO: 311581 - protein, 21 aa, Mycobacterium
HRAPLISLAIFRDWEFSLCNI

SEQ ID NO: 311582 - protein, 45 aa, Mycobacterium
HRAPRAGPLRLRWRPLLIAAAILLAWSVVLLLLMRWVSPLPLDEP

SEQ ID NO: 311583 - protein, 17 aa, Mycobacterium
HRASGLIARILANAIRT

SEQ ID NO: 311584 - protein, 24 aa, Mycobacterium
HRAVDFALEIGRIIDRFNSQSRHQ

SEQ ID NO: 311585 - protein, 18 aa, Mycobacterium
HRAVLRARGDEPGWDDDR

SEQ ID NO: 311586 - protein, 28 aa, Mycobacterium
HRCGDRAGGHPGDWARMLGIGEIATYHP

SEQ ID NO: 311587 - protein, 19 aa, Mycobacterium
HRDDIALVVGETEWTYGQL

SEQ ID NO: 311588 - protein, 19 aa, Mycobacterium
HRDDLRAARDQRFVDTAVQ

SEQ ID NO: 311589 - protein, 23 aa, Mycobacterium
HRDFSTPTALNWAAHGTDVDFGA

SEQ ID NO: 311590 - protein, 25 aa, Mycobacterium
HRDPGWRRRLAINFSAAVLSTIVVG

SEQ ID NO: 311591 - protein, 19 aa, Mycobacterium
HREALLHSIREGVVAVNTD

SEQ ID NO: 311592 - protein, 18 aa, Mycobacterium
HREPVPLLTVISAAVSEV

SEQ ID NO: 311593 - protein, 23 aa, Mycobacterium
HREQWPVAGPVLGRLGWFVESTL

SEQ ID NO: 311594 - protein, 19 aa, Mycobacterium
HRFDVAALVTRFPNVVVVR

SEQ ID NO: 311595 - protein, 21 aa, Mycobacterium
HRFEVAAAIDMRTFPGSEYGP

SEQ ID NO: 311596 - protein, 24 aa, Mycobacterium
HRFFANRWLWAAIGLSALLQVAVV

SEQ ID NO: 311597 - protein, 23 aa, Mycobacterium
HRFHHLKWAGVGDVNFGLFTLVW

SEQ ID NO: 311598 - protein, 28 aa, Mycobacterium
HRGEALLADALRALGYAATGGRPLPEVT

SEQ ID NO: 311599 - protein, 17 aa, Mycobacterium
HRGELVYLPPEWFATSP

SEQ ID NO: 311600 - protein, 24 aa, Mycobacterium
HRGGDEVLHGISFRAEPGQMVALV

SEQ ID NO: 311601 - protein, 17 aa, Mycobacterium
HRGLFGVGVTALLYNFG

SEQ ID NO: 311602 - protein, 25 aa, Mycobacterium
HRGQWARILPRFSRLSFGCVAALLA

SEQ ID NO: 311603 - protein, 34 aa, Mycobacterium
HRGRAWLSAGALVFILVVAAAYLFVGALQVNPLA

SEQ ID NO: 311604 - protein, 19 aa, Mycobacterium
HRGYRRWRTHAGRDADTGS

SEQ ID NO: 311605 - protein, 17 aa, Mycobacterium
HRHHGFDAIFHGIDLTS

SEQ ID NO: 311606 - protein, 25 aa, Mycobacterium
HRHPHWGRLVLPAVFLIIASAAAAF

SEQ ID NO: 311607 - protein, 20 aa, Mycobacterium
HRHPHWKRLIWPVVVLILVT

SEQ ID NO: 311608 - protein, 20 aa, Mycobacterium
HRISAEMLRQYAGAPMHEDW

SEQ ID NO: 311609 - protein, 25 aa, Mycobacterium
HRITRREWLSAVLLAAALATLITAG

SEQ ID NO: 311610 - protein, 25 aa, Mycobacterium
HRKPVARPAHRWVMVPDDGAPAPAS

SEQ ID NO: 311611 - protein, 26 aa, Mycobacterium
HRKVSRGEWAWAVLLTVALAVFVVLA

SEQ ID NO: 311612 - protein, 18 aa, Mycobacterium
HRLAEPVQAVIAAVAVIA

SEQ ID NO: 311613 - protein, 22 aa, Mycobacterium
HRLLPLFAIGVFIGFTISQTGL

SEQ ID NO: 311614 - protein, 18 aa, Mycobacterium
HRLLPSVLSRVLTKRRTP

SEQ ID NO: 311615 - protein, 20 aa, Mycobacterium
HRLMTVINCRTRPASSESSG

SEQ ID NO: 311616 - protein, 24 aa, Mycobacterium
HRLVELLGVLLIIWATPRLAQRCG

SEQ ID NO: 311617 - protein, 19 aa, Mycobacterium
HRLVVPRVVASTIVALLLN

SEQ ID NO: 311618 - protein, 25 aa, Mycobacterium
HRMAAKFLLPRLMGFSVDGSEADFR

SEQ ID NO: 311619 - protein, 25 aa, Mycobacterium
HRMFPRAMLHFEDFGPANARMILQT

SEQ ID NO: 311620 - protein, 20 aa, Mycobacterium
HRNPRLWSTTVFSVKDGKVL

SEQ ID NO: 311621 - protein, 17 aa, Mycobacterium
HRPESWLSAADFVAADI

SEQ ID NO: 311622 - protein, 26 aa, Mycobacterium
HRPNRRWWRHTAWFMLALLLATLWWL

SEQ ID NO: 311623 - protein, 19 aa, Mycobacterium
HRPPVNFLLAPAILSAAGL

SEQ ID NO: 311624 - protein, 17 aa, Mycobacterium
HRPRLGDIELCIIDINE

SEQ ID NO: 311625 - protein, 25 aa, Mycobacterium
HRPVPRLLATGLLRRVDAETVILPR

SEQ ID NO: 311626 - protein, 24 aa, Mycobacterium
HRPWGGRVPLVLTGAAIALVIAGF

SEQ ID NO: 311627 - protein, 31 aa, Mycobacterium
HRPYLPHAIRIFAVPIILIWVAVTVLVNVVV

SEQ ID NO: 311628 - protein, 17 aa, Mycobacterium
HRQAVASVISWVSVALL

SEQ ID NO: 311629 - protein, 18 aa, Mycobacterium
HRRALAQMRPDYPATPPP

SEQ ID NO: 311630 - protein, 20 aa, Mycobacterium
HRRAVLGLTLSYVFITLAVI

SEQ ID NO: 311631 - protein, 21 aa, Mycobacterium
HRRDAGSFSRQDWIRHRLARV

SEQ ID NO: 311632 - protein, 26 aa, Mycobacterium
HRRFLPARWWSIGALDALVIAVLVWW

SEQ ID NO: 311633 - protein, 26 aa, Mycobacterium
HRRFLPSRWWSLSGLDALVVAVLVWW

SEQ ID NO: 311634 - protein, 31 aa, Mycobacterium
HRRGIRVRARRSPTMTAPIWIAFPPEVHSTL

SEQ ID NO: 311635 - protein, 19 aa, Mycobacterium
HRRGWDLVVMYGQTEATAR

SEQ ID NO: 311636 - protein, 23 aa, Mycobacterium
HRRIPMLLRRLITVCPALVILAV

SEQ ID NO: 311637 - protein, 18 aa, Mycobacterium
HRRRTFASIAVMAVSATY

SEQ ID NO: 311638 - protein, 22 aa, Mycobacterium
HRRSAMATMRIAFLSALVLELL

SEQ ID NO: 311639 - protein, 18 aa, Mycobacterium
HRRTRTALEATWKYVVIC

SEQ ID NO: 311640 - protein, 35 aa, Mycobacterium
HRRTRTALEATWKYVVICSVGIAVAFLGTAMLYFA

SEQ ID NO: 311641 - protein, 36 aa, Mycobacterium
HRRVPPGSVAPGFRLPALNRRQFLGSLAASVVAGVG

SEQ ID NO: 311642 - protein, 20 aa, Mycobacterium
HRRWREILVTGFFGGTEVAM

SEQ ID NO: 311643 - protein, 18 aa, Mycobacterium
HRSDPDWQPPEDSADTDL

SEQ ID NO: 311644 - protein, 19 aa, Mycobacterium
HRSDPHWKPEDDWGHEPVG

SEQ ID NO: 311645 - protein, 18 aa, Mycobacterium
HRSDVTIGVLRARHPPPW

SEQ ID NO: 311646 - protein, 33 aa, Mycobacterium
HRSFIPRMIRLFAVPIILGWIALIVVVNVTVPQ

SEQ ID NO: 311647 - protein, 18 aa, Mycobacterium
HRSLVGALHARYGAQDAI

SEQ ID NO: 311648 - protein, 28 aa, Mycobacterium
HRSPRYLRFGWAAARFDDVLNYVPARVT

SEQ ID NO: 311649 - protein, 23 aa, Mycobacterium
HRSRPGLVGRAAMAAAVGVIVGE

SEQ ID NO: 311650 - protein, 19 aa, Mycobacterium
HRSTLQLWAGCLTPLANLL

SEQ ID NO: 311651 - protein, 29 aa, Mycobacterium
HRTDAVWPLRWLRNAALAFTFLNALVDFA

SEQ ID NO: 311652 - protein, 17 aa, Mycobacterium
HRTDLTPWILAARSAPA

SEQ ID NO: 311653 - protein, 19 aa, Mycobacterium
HRTELVYLPPAWFGRNPAP

SEQ ID NO: 311654 - protein, 19 aa, Mycobacterium
HRTLPRSDALKILSAELSV

SEQ ID NO: 311655 - protein, 21 aa, Mycobacterium
HRTPARMFPKVTTLPLGVPTP

SEQ ID NO: 311656 - protein, 17 aa, Mycobacterium
HRTRAAAMWASLATGFL

SEQ ID NO: 311657 - protein, 18 aa, Mycobacterium
HRTRRIAAHISDDARSRV

SEQ ID NO: 311658 - protein, 17 aa, Mycobacterium
HRTVEALAPLLGDSDVR

SEQ ID NO: 311659 - protein, 23 aa, Mycobacterium
HRTWRGVLVTGFFGGTEVGIGVL

SEQ ID NO: 311660 - protein, 17 aa, Mycobacterium
HRVRLIWAAHQPHHSSE

SEQ ID NO: 311661 - protein, 20 aa, Mycobacterium
HRVTTAFGWGVAGLISVLNV

SEQ ID NO: 311662 - protein, 20 aa, Mycobacterium
HRWVPAAAGWIVGVIATLSL

SEQ ID NO: 311663 - protein, 17 aa, Mycobacterium
HRYRKELLRMVAQMGMG

SEQ ID NO: 311664 - protein, 17 aa, Mycobacterium
HSADLLLEPAVSPPAHL

SEQ ID NO: 311665 - protein, 25 aa, Mycobacterium
HSADRLIVIYADFKGEAGADIFRDF

SEQ ID NO: 311666 - protein, 25 aa, Mycobacterium
HSADRLIVIYADFKGEAGADSFRHF

SEQ ID NO: 311667 - protein, 25 aa, Mycobacterium
HSADRLIVIYADFKGEAGADSFRNF

SEQ ID NO: 311668 - protein, 24 aa, Mycobacterium
HSAERLIVIYADFKGEAGADSFRH

SEQ ID NO: 311669 - protein, 24 aa, Mycobacterium
HSAERLIVIYADFKGEAGADSFRN

SEQ ID NO: 311670 - protein, 37 aa, Mycobacterium
HSAPPRPRLPWFLRTFAVPIILAWVAVVAILNTVVPT

SEQ ID NO: 311671 - protein, 18 aa, Mycobacterium
HSELKPSQQLIGLGGAVV

SEQ ID NO: 311672 - protein, 31 aa, Mycobacterium
HSGDAAWQQGVRWARRLAWISLAVLVTEGAV

SEQ ID NO: 311673 - protein, 26 aa, Mycobacterium
HSHRRGVAWLLLIPIVLLAFVAPPAI

SEQ ID NO: 311674 - protein, 22 aa, Mycobacterium
HSIPDALNRFGFLLDVDPPGDT

SEQ ID NO: 311675 - protein, 20 aa, Mycobacterium
HSKARLRRDYGIPERFVKTI

SEQ ID NO: 311676 - protein, 23 aa, Mycobacterium
HSLFGCFFYGVFVAKMMLLTRKG

SEQ ID NO: 311677 - protein, 26 aa, Mycobacterium
HSLHWKISEAPLFYGGYAALLAISAA

SEQ ID NO: 311678 - protein, 17 aa, Mycobacterium
HSLLVGWLVDKLARSPG

SEQ ID NO: 311679 - protein, 20 aa, Mycobacterium
HSLVPIVIGYVFAHYLTYLV

SEQ ID NO: 311680 - protein, 25 aa, Mycobacterium
HSNCQLMTLRDLRRPGQVQVQTGLP

SEQ ID NO: 311681 - protein, 18 aa, Mycobacterium
HSNRAVVVGQHLNMPPPR

SEQ ID NO: 311682 - protein, 26 aa, Mycobacterium
HSPIEWQSCTPFGVVIHLRDGNRFEL

SEQ ID NO: 311683 - protein, 32 aa, Mycobacterium
HSPLPLVLRNELPVPIRVSLRVETPAGMSATD

SEQ ID NO: 311684 - protein, 35 aa, Mycobacterium
HSPPAPRWAWKVLIPIGALGMVLMAIWFHVWQDNV

SEQ ID NO: 311685 - protein, 20 aa, Mycobacterium
HSQFSRYAGMAGLQHQLETT

SEQ ID NO: 311686 - protein, 24 aa, Mycobacterium
HSRKPAATVALVMTIFVTGFVALA

SEQ ID NO: 311687 - protein, 24 aa, Mycobacterium
HSRRARRIMVQNIAFSLAIIAVLI

SEQ ID NO: 311688 - protein, 21 aa, Mycobacterium
HSRRRLVAFVSHDLRTPLAGI

SEQ ID NO: 311689 - protein, 28 aa, Mycobacterium
HSRSLCPRCVPRSSISQHRRWRDVRPAL

SEQ ID NO: 311690 - protein, 20 aa, Mycobacterium
HSRSNWLVMFVVMIVLTVIV

SEQ ID NO: 311691 - protein, 17 aa, Mycobacterium
HSSHYGWYGVLAGASIV

SEQ ID NO: 311692 - protein, 17 aa, Mycobacterium
HSSLWGLAGVVGAEQPQ

SEQ ID NO: 311693 - protein, 30 aa, Mycobacterium
HSTLTPPEWWRLGAMFAFIAALHVVGWGTL

SEQ ID NO: 311694 - protein, 27 aa, Mycobacterium
HSVLMRLGPRVAYLVALTVFGAGSLGC

SEQ ID NO: 311695 - protein, 17 aa, Mycobacterium
HSVLPLRPESLRRLNKV

SEQ ID NO: 311696 - protein, 24 aa, Mycobacterium
HSVLPRLYVLHVLLVPAIMIALIS

SEQ ID NO: 311697 - protein, 17 aa, Mycobacterium
HSVWILVFTLFFAGLIQ

SEQ ID NO: 311698 - protein, 18 aa, Mycobacterium
HSVWILVFTLFFAGLIQQ

SEQ ID NO: 311699 - protein, 19 aa, Mycobacterium
HSYLWAGLVLLALAGACGE

SEQ ID NO: 311700 - protein, 26 aa, Mycobacterium
HSYSFDFSVWEIWGALLHGGRLVVVP

SEQ ID NO: 311701 - protein, 22 aa, Mycobacterium
HSYVPLRLITLTGFLLSAVAAI

SEQ ID NO: 311702 - protein, 24 aa, Mycobacterium
HTAWGVAVALAFVTLPFVVRAVQP

SEQ ID NO: 311703 - protein, 24 aa, Mycobacterium
HTAWGVGVALAFVTLPFVVRAVQP

SEQ ID NO: 311704 - protein, 20 aa, Mycobacterium
HTDLFVKFSRDFGDPARDRG

SEQ ID NO: 311705 - protein, 18 aa, Mycobacterium
HTDPRAVAFRGFTGTDSP

SEQ ID NO: 311706 - protein, 26 aa, Mycobacterium
HTERIGTLWPAWEFMFNTPSHHRVHH

SEQ ID NO: 311707 - protein, 19 aa, Mycobacterium
HTEVRHWPGDVSGLNPTRT

SEQ ID NO: 311708 - protein, 21 aa, Mycobacterium
HTEWIPVVTFLQVSADMAVAV

SEQ ID NO: 311709 - protein, 25 aa, Mycobacterium
HTGGAWEILFMIFLVIATYALFRGA

SEQ ID NO: 311710 - protein, 25 aa, Mycobacterium
HTGGAWLILFMIFNVIWTYALVRGA

SEQ ID NO: 311711 - protein, 25 aa, Mycobacterium
HTGGAWLILFMIFNVIWTYVLVRGS

SEQ ID NO: 311712 - protein, 23 aa, Mycobacterium
HTGGAWLVLFMIFNVVWTYVLVR

SEQ ID NO: 311713 - protein, 22 aa, Mycobacterium
HTGGLRQWWLLTRRNVDVLSRN

SEQ ID NO: 311714 - protein, 24 aa, Mycobacterium
HTGHGGLVVSEWVRGGSLQEVADT

SEQ ID NO: 311715 - protein, 33 aa, Mycobacterium
HTGIARWIRRLAIPIILGWIALLGVLGATVPSL

SEQ ID NO: 311716 - protein, 35 aa, Mycobacterium
HTGLLIRLALRRDRIRLSIWIAMLSLLMIYTPNAL

SEQ ID NO: 311717 - protein, 17 aa, Mycobacterium
HTGPRTNFDREMIGQGS

SEQ ID NO: 311718 - protein, 18 aa, Mycobacterium
HTIIRLGGLMLMVTGLQV

SEQ ID NO: 311719 - protein, 27 aa, Mycobacterium
HTIRIFAVPIILAWVVLTVIVNVAVPR

SEQ ID NO: 311720 - protein, 27 aa, Mycobacterium
HTIRILAVPIILGWVLLTVLVNVVVPS

SEQ ID NO: 311721 - protein, 17 aa, Mycobacterium
HTLEILLAYTVPLLIMI

SEQ ID NO: 311722 - protein, 18 aa, Mycobacterium
HTLGHCFLFAGGNTSIGG

SEQ ID NO: 311723 - protein, 25 aa, Mycobacterium
HTLLYAASMGVAWLLGVPALMRKRF

SEQ ID NO: 311724 - protein, 24 aa, Mycobacterium
HTLPEEWRMRGVRKYITRTLCLFV

SEQ ID NO: 311725 - protein, 23 aa, Mycobacterium
HTMMFQEMINRVGADVPGMPRRL

SEQ ID NO: 311726 - protein, 20 aa, Mycobacterium
HTPDGLPLGDPVRLSVHSNA

SEQ ID NO: 311727 - protein, 22 aa, Mycobacterium
HTPEIIGIGVAFLILLITFGAV

SEQ ID NO: 311728 - protein, 22 aa, Mycobacterium
HTPGTWLFDMGMLALISVGYLA

SEQ ID NO: 311729 - protein, 23 aa, Mycobacterium
HTRFRRMLDPFFGPKKMAEREPE

SEQ ID NO: 311730 - protein, 18 aa, Mycobacterium
HTRRVLKRRGAASPVAAE

SEQ ID NO: 311731 - protein, 18 aa, Mycobacterium
HTSIPFLISMQGTSQKLT

SEQ ID NO: 311732 - protein, 26 aa, Mycobacterium
HTSRIRPAVLIPVVLAVLLVAAVAVA

SEQ ID NO: 311733 - protein, 25 aa, Mycobacterium
HTTALCSPTRSCLLTGRNHHVNRFA

SEQ ID NO: 311734 - protein, 26 aa, Mycobacterium
HTTGAWLLDMAMLGLLSTVYAGFVLW

SEQ ID NO: 311735 - protein, 18 aa, Mycobacterium
HTTIPFMLSMSSASQSHL

SEQ ID NO: 311736 - protein, 24 aa, Mycobacterium
HTVWGVGVALAFVTLPFVVRAVQP

SEQ ID NO: 311737 - protein, 18 aa, Mycobacterium
HTWWPSSIPFVLQVLIAA

SEQ ID NO: 311738 - protein, 25 aa, Mycobacterium
HTYGEIDGRLFVDMRLIEGHDLQSV

SEQ ID NO: 311739 - protein, 19 aa, Mycobacterium
HVAEPTLHPAAFATAVMML

SEQ ID NO: 311740 - protein, 22 aa, Mycobacterium
HVAGVGGVLGWLVNTAASAVIG

SEQ ID NO: 311741 - protein, 18 aa, Mycobacterium
HVALAEKLFNRWGARAVF

SEQ ID NO: 311742 - protein, 25 aa, Mycobacterium
HVAQFRKLFWINLIIAVPVIAFSTM

SEQ ID NO: 311743 - protein, 17 aa, Mycobacterium
HVEFGWEVIDACDWQTD

SEQ ID NO: 311744 - protein, 24 aa, Mycobacterium
HVEHALNFWGQRFTSSGVESYDHK

SEQ ID NO: 311745 - protein, 22 aa, Mycobacterium
HVFSAPIGYLFRPYIVYRSRDV

SEQ ID NO: 311746 - protein, 26 aa, Mycobacterium
HVHGLSGLINLFSFGLLGKSGHEHTI

SEQ ID NO: 311747 - protein, 21 aa, Mycobacterium
HVISRRAMHYLPLVGMALLAA

SEQ ID NO: 311748 - protein, 23 aa, Mycobacterium
HVKARVLYNIAFPGAYLCLSATS

SEQ ID NO: 311749 - protein, 20 aa, Mycobacterium
HVLAGLLFLLFGLWMLFDGA

SEQ ID NO: 311750 - protein, 17 aa, Mycobacterium
HVLDRVGDLGLDPDEVG

SEQ ID NO: 311751 - protein, 24 aa, Mycobacterium
HVLGHWNWWAPPLLSRLHQRIGIS

SEQ ID NO: 311752 - protein, 19 aa, Mycobacterium
HVLGRPLGRLIDRDNTGDE

SEQ ID NO: 311753 - protein, 20 aa, Mycobacterium
HVLLAVAGYNFGRFCLTPLP

SEQ ID NO: 311754 - protein, 27 aa, Mycobacterium
HVLLGLTLFCLWPFTRLVHAFSAPIGY

SEQ ID NO: 311755 - protein, 18 aa, Mycobacterium
HVLQYGFAAWTGILLGVV

SEQ ID NO: 311756 - protein, 25 aa, Mycobacterium
HVLRAATGTACWYALFFAITQIPLA

SEQ ID NO: 311757 - protein, 18 aa, Mycobacterium
HVLRGSILHDLRRIEEST

SEQ ID NO: 311758 - protein, 28 aa, Mycobacterium
HVMIALVLFCLWPFTRLVHVFSAPIGYL

SEQ ID NO: 311759 - protein, 20 aa, Mycobacterium
HVMPQLLGIGPWQSLAIASP

SEQ ID NO: 311760 - protein, 19 aa, Mycobacterium
HVNDLRPSLLPKLMAHVGG

SEQ ID NO: 311761 - protein, 24 aa, Mycobacterium
HVNDLRPSWLPKIMAHVGGTTAEF

SEQ ID NO: 311762 - protein, 24 aa, Mycobacterium
HVNELQALLLDWGFAPMTVGSRPP

SEQ ID NO: 311763 - protein, 17 aa, Mycobacterium
HVPAPSCKGTWRPRAER

SEQ ID NO: 311764 - protein, 21 aa, Mycobacterium
HVPESPRWLFIHGQEDEAERV

SEQ ID NO: 311765 - protein, 18 aa, Mycobacterium
HVPQPPAPPPSAWAPAPA

SEQ ID NO: 311766 - protein, 21 aa, Mycobacterium
HVPVAHTGRILMILVAVAVFL

SEQ ID NO: 311767 - protein, 17 aa, Mycobacterium
HVPYLTWLTKTSADYAA

SEQ ID NO: 311768 - protein, 19 aa, Mycobacterium
HVQFGLGLVIVLAVLAVPV

SEQ ID NO: 311769 - protein, 19 aa, Mycobacterium
HVRAASPAQIHWYRRHRAM

SEQ ID NO: 311770 - protein, 20 aa, Mycobacterium
HVRPARLAMAVMFGVLALGS

SEQ ID NO: 311771 - protein, 18 aa, Mycobacterium
HVSARFGYMERPHVPHAL

SEQ ID NO: 311772 - protein, 18 aa, Mycobacterium
HVSCGQVIASQWLVIVDP

SEQ ID NO: 311773 - protein, 19 aa, Mycobacterium
HVSDSEFLIADVFKTNDPS

SEQ ID NO: 311774 - protein, 19 aa, Mycobacterium
HVVDTGWFFDTELLVLAER

SEQ ID NO: 311775 - protein, 20 aa, Mycobacterium
HVVSGSWSFDLTVAGPGTPG

SEQ ID NO: 311776 - protein, 20 aa, Mycobacterium
HVVSGSWSFQLTVSGTGTPG

SEQ ID NO: 311777 - protein, 24 aa, Mycobacterium
HVVSMIRLAFTVGWYMVLSSLQVA

SEQ ID NO: 311778 - protein, 18 aa, Mycobacterium
HWALPRWGSHRLVPVTAA

SEQ ID NO: 311779 - protein, 25 aa, Mycobacterium
HWAMFMVTVTYVWKNLGYTFVIYLA

SEQ ID NO: 311780 - protein, 28 aa, Mycobacterium
HWAQGAIGWCVLPLMLALPTRTGAALVM

SEQ ID NO: 311781 - protein, 23 aa, Mycobacterium
HWARVRSGALIGFAGAFGALGGV

SEQ ID NO: 311782 - protein, 19 aa, Mycobacterium
HWAVVGALTAVGWVLAAFA

SEQ ID NO: 311783 - protein, 20 aa, Mycobacterium
HWDSPLFKKINTVITIVWAG

SEQ ID NO: 311784 - protein, 23 aa, Mycobacterium
HWEPGSVVWPLMIAIGTALAVYG

SEQ ID NO: 311785 - protein, 17 aa, Mycobacterium
HWERLAVYWQLASDHGL

SEQ ID NO: 311786 - protein, 23 aa, Mycobacterium
HWFIEVPIRITAYIVIVLIARYV

SEQ ID NO: 311787 - protein, 19 aa, Mycobacterium
HWGGGGSLIRLAVLGLVMG

SEQ ID NO: 311788 - protein, 19 aa, Mycobacterium
HWGLRPAGIAFALAVCVLA

SEQ ID NO: 311789 - protein, 18 aa, Mycobacterium
HWGVEIFVTASRGKWDTL

SEQ ID NO: 311790 - protein, 19 aa, Mycobacterium
HWIDVPDDLVARYTNIVVA

SEQ ID NO: 311791 - protein, 18 aa, Mycobacterium
HWIYLAGIVVILLTMAVR

SEQ ID NO: 311792 - protein, 25 aa, Mycobacterium
HWMPFKRPAGDWVFENGPPLFWLLF

SEQ ID NO: 311793 - protein, 19 aa, Mycobacterium
HWPAAAALGYLNLAVWLIP

SEQ ID NO: 311794 - protein, 23 aa, Mycobacterium
HWPSSWWFDPAVGLAIAIVAVWQ

SEQ ID NO: 311795 - protein, 27 aa, Mycobacterium
HWQSPRSSNRFAFFFGLTAINPVTLVY

SEQ ID NO: 311796 - protein, 18 aa, Mycobacterium
HWRELPFALLPTVFAVHQ

SEQ ID NO: 311797 - protein, 18 aa, Mycobacterium
HWRWDPYPFILLNLAFST

SEQ ID NO: 311798 - protein, 26 aa, Mycobacterium
HWSLLLGYGCLPWVAATMLGLRASEA

SEQ ID NO: 311799 - protein, 17 aa, Mycobacterium
HWSRFVSACRRRYGDVF

SEQ ID NO: 311800 - protein, 19 aa, Mycobacterium
HWTDAAIIAGLLMMNGGVA

SEQ ID NO: 311801 - protein, 27 aa, Mycobacterium
HWTHSRPAWLFDMAMLATLSVAYACLV

SEQ ID NO: 311802 - protein, 26 aa, Mycobacterium
HWVGELPWFIPMAFISLPFLLAFRLT

SEQ ID NO: 311803 - protein, 30 aa, Mycobacterium
HWVRLRGPVLQWWIAWVCSYAVSIAAIVTS

SEQ ID NO: 311804 - protein, 17 aa, Mycobacterium
HWVTDYWNHFCLMVQKW

SEQ ID NO: 311805 - protein, 18 aa, Mycobacterium
HWVWMLPAVVVTGVLAWR

SEQ ID NO: 311806 - protein, 18 aa, Mycobacterium
HWWLAVAVAAWVAALCIY

SEQ ID NO: 311807 - protein, 20 aa, Mycobacterium
HYCHYWKTFQAVPQWTLALI

SEQ ID NO: 311808 - protein, 27 aa, Mycobacterium
HYDLFIRVLAWFFGLMVFNRIDGSSDS

SEQ ID NO: 311809 - protein, 20 aa, Mycobacterium
HYFIIIGLFGIFLGGMTAVV

SEQ ID NO: 311810 - protein, 22 aa, Mycobacterium
HYFPRHRFLFGDKYDSVMIDQK

SEQ ID NO: 311811 - protein, 21 aa, Mycobacterium
HYGGGAVWLIAWRVVQGVGGA

SEQ ID NO: 311812 - protein, 18 aa, Mycobacterium
HYGYYPALFFAVALFVTV

SEQ ID NO: 311813 - protein, 18 aa, Mycobacterium
HYIVLVFLYLGAFVATVI

SEQ ID NO: 311814 - protein, 27 aa, Mycobacterium
HYKPGAVRGRNGFDLGTYYCDNDMRTY

SEQ ID NO: 311815 - protein, 28 aa, Mycobacterium
HYMDMLDLAEAWRFGRGAGQKVAVIDTG

SEQ ID NO: 311816 - protein, 17 aa, Mycobacterium
HYPRKRLAQQPSWSKEL

SEQ ID NO: 311817 - protein, 26 aa, Mycobacterium
HYPTGWAVAFSTPFQMFKRYSQFSGG

SEQ ID NO: 311818 - protein, 19 aa, Mycobacterium
HYQAWAIPVAFVIAQGTAT

SEQ ID NO: 311819 - protein, 21 aa, Mycobacterium
HYRVELIRLIAQMGLGAGALM

SEQ ID NO: 311820 - protein, 31 aa, Mycobacterium
HYTAEFLQAASLRAGNPIVVAGIPVGNVTSM

SEQ ID NO: 311821 - protein, 28 aa, Mycobacterium
HYTVADFWRFWVVHLWVEDFLELFTTVM

SEQ ID NO: 311822 - protein, 29 aa, Mycobacterium
IAAAAAWQWRAHRGPMMVGALTLGSLACS

SEQ ID NO: 311823 - protein, 18 aa, Mycobacterium
IAAALFLLSAVGAGLAPN

SEQ ID NO: 311824 - protein, 18 aa, Mycobacterium
IAAAVVWAHAGSRALILR

SEQ ID NO: 311825 - protein, 18 aa, Mycobacterium
IAACAAGVYLVDVRPKLL

SEQ ID NO: 311826 - protein, 23 aa, Mycobacterium
IAACGLLGLGAALLIAALLLTTY

SEQ ID NO: 311827 - protein, 19 aa, Mycobacterium
IAAEVLAFRVVLASYLPAA

SEQ ID NO: 311828 - protein, 25 aa, Mycobacterium
IAAFFIVYLMNSWLPILMTDVGFAL

SEQ ID NO: 311829 - protein, 17 aa, Mycobacterium
IAAFGFWGIVLGPVLMI

SEQ ID NO: 311830 - protein, 18 aa, Mycobacterium
IAAFKIIMLCLWWGAATS

SEQ ID NO: 311831 - protein, 27 aa, Mycobacterium
IAAFPRYHPRWAWWLTTVPLLREFLVS

SEQ ID NO: 311832 - protein, 25 aa, Mycobacterium
IAAFTLPDLHAWRPYTVAGLGVGVL

SEQ ID NO: 311833 - protein, 24 aa, Mycobacterium
IAAGACSVLHAWAGVGAAGAEFVG

SEQ ID NO: 311834 - protein, 17 aa, Mycobacterium
IAAGIGFLQMKRWGHQW

SEQ ID NO: 311835 - protein, 17 aa, Mycobacterium
IAAGLWMAPGGLAMMVA

SEQ ID NO: 311836 - protein, 17 aa, Mycobacterium
IAAGMAFAALSFLLFLG

SEQ ID NO: 311837 - protein, 19 aa, Mycobacterium
IAAGVLYFFFVLPRTPELL

SEQ ID NO: 311838 - protein, 19 aa, Mycobacterium
IAAHDRWGLVVPLALAAAV

SEQ ID NO: 311839 - protein, 17 aa, Mycobacterium
IAAIAGLVLCWSIIGGL

SEQ ID NO: 311840 - protein, 23 aa, Mycobacterium
IAAILLIAAIVWVARNKRNEHRH

SEQ ID NO: 311841 - protein, 19 aa, Mycobacterium
IAAIQLFTLQGPRAAGLRA

SEQ ID NO: 311842 - protein, 19 aa, Mycobacterium
IAAISGRTWLLLTAASALI

SEQ ID NO: 311843 - protein, 19 aa, Mycobacterium
IAAKLGLHARFVGTDFSGL

SEQ ID NO: 311844 - protein, 18 aa, Mycobacterium
IAAKLGLQVRFVGTDFSG

SEQ ID NO: 311845 - protein, 22 aa, Mycobacterium
IAAKLVCLTIWIGAATSKLNKH

SEQ ID NO: 311846 - protein, 23 aa, Mycobacterium
IAALADWLPYAILFTVAAAALLW

SEQ ID NO: 311847 - protein, 22 aa, Mycobacterium
IAALCALALVIAALWLQYCCTS

SEQ ID NO: 311848 - protein, 22 aa, Mycobacterium
IAALCALLITRRHLAAYSSVIA

SEQ ID NO: 311849 - protein, 22 aa, Mycobacterium
IAALCTLAVLVLLARYTTWGRQ

SEQ ID NO: 311850 - protein, 17 aa, Mycobacterium
IAALCWAAKALFARYVV

SEQ ID NO: 311851 - protein, 18 aa, Mycobacterium
IAALGWGVLALVGQHRDA

SEQ ID NO: 311852 - protein, 23 aa, Mycobacterium
IAALLGKWFWWPQHVRQRPVPSP

SEQ ID NO: 311853 - protein, 29 aa, Mycobacterium
IAALLGKWFWWPQRVRQRPVPSPWPKPSA

SEQ ID NO: 311854 - protein, 25 aa, Mycobacterium
IAALLGKWFWWPQVVRQRPAPQPWP

SEQ ID NO: 311855 - protein, 24 aa, Mycobacterium
IAALLIGVGTIHFVAPKPFDDIIP

SEQ ID NO: 311856 - protein, 17 aa, Mycobacterium
IAALPFVVVMVGLTVSL

SEQ ID NO: 311857 - protein, 18 aa, Mycobacterium
IAALRARGDNGFADLVSG

SEQ ID NO: 311858 - protein, 23 aa, Mycobacterium
IAALRSRGLRTILLTGDNQAAAD

SEQ ID NO: 311859 - protein, 24 aa, Mycobacterium
IAAMTVEMAMGFAVATLLHREHRA

SEQ ID NO: 311860 - protein, 21 aa, Mycobacterium
IAANYPGVWYRAFDLSEAGPV

SEQ ID NO: 311861 - protein, 21 aa, Mycobacterium
IAAPAYWSGAQLGALRGALLT

SEQ ID NO: 311862 - protein, 17 aa, Mycobacterium
IAAPRRIVGIAFLVLVG

SEQ ID NO: 311863 - protein, 23 aa, Mycobacterium
IAAPRRVLMAALLVAIACGVFGI

SEQ ID NO: 311864 - protein, 18 aa, Mycobacterium
IAAPRWHFDLSDKLTTLP

SEQ ID NO: 311865 - protein, 17 aa, Mycobacterium
IAAQARERLGFVMPGDI

SEQ ID NO: 311866 - protein, 17 aa, Mycobacterium
IAAQARERLGFVMPGET

SEQ ID NO: 311867 - protein, 18 aa, Mycobacterium
IAAQARERLGFVMPGEVP

SEQ ID NO: 311868 - protein, 17 aa, Mycobacterium
IAAQLGIDTVIAEVLPG

SEQ ID NO: 311869 - protein, 19 aa, Mycobacterium
IAARGWRRRVLIVVAGGLL

SEQ ID NO: 311870 - protein, 18 aa, Mycobacterium
IAARWQSRLLRLASVAAA

SEQ ID NO: 311871 - protein, 17 aa, Mycobacterium
IAASLWHPNILGIHDRG

SEQ ID NO: 311872 - protein, 23 aa, Mycobacterium
IAATSRAAWAWFRHLHGLADRTL

SEQ ID NO: 311873 - protein, 18 aa, Mycobacterium
IAAVAVAVGAVFFGVALL

SEQ ID NO: 311874 - protein, 17 aa, Mycobacterium
IAAVCTLAVLALLVRFT

SEQ ID NO: 311875 - protein, 18 aa, Mycobacterium
IAAVFAIARACAGVQDSD

SEQ ID NO: 311876 - protein, 20 aa, Mycobacterium
IAAVGAVAWAMIAFARGETV

SEQ ID NO: 311877 - protein, 27 aa, Mycobacterium
IAAVIAFMICRHLPWVPAPALPRGPAS

SEQ ID NO: 311878 - protein, 18 aa, Mycobacterium
IAAVLFLLSAFGTAFAPE

SEQ ID NO: 311879 - protein, 21 aa, Mycobacterium
IAAVVLMCLVSIALLVWFWPH

SEQ ID NO: 311880 - protein, 17 aa, Mycobacterium
IAAVVSAVFVLDPPRPP

SEQ ID NO: 311881 - protein, 18 aa, Mycobacterium
IAAWCLGSVVMRLTDLST

SEQ ID NO: 311882 - protein, 22 aa, Mycobacterium
IACAVLRRPDHRETYDAMFDLW

SEQ ID NO: 311883 - protein, 26 aa, Mycobacterium
IACGLAALCYAEFASTVPVAGSAYTF

SEQ ID NO: 311884 - protein, 17 aa, Mycobacterium
IACGYLADLVFADPRRG

SEQ ID NO: 311885 - protein, 23 aa, Mycobacterium
IACLSFTRLPYFQPLGIPGAVGI

SEQ ID NO: 311886 - protein, 17 aa, Mycobacterium
IADAPWFDLAARPDLDP

SEQ ID NO: 311887 - protein, 19 aa, Mycobacterium
IADDIRAAIAVGHGVTVRD

SEQ ID NO: 311888 - protein, 17 aa, Mycobacterium
IADELVSTGTVRHASLG

SEQ ID NO: 311889 - protein, 25 aa, Mycobacterium
IADIYPRYTCDYGYPRTAVSAADYP

SEQ ID NO: 311890 - protein, 22 aa, Mycobacterium
IADKALICAALVGLSLLGDLSW

SEQ ID NO: 311891 - protein, 19 aa, Mycobacterium
IADLRGRRTALAAVVTVGL

SEQ ID NO: 311892 - protein, 18 aa, Mycobacterium
IADNLRYGAAPGHDITGD

SEQ ID NO: 311893 - protein, 17 aa, Mycobacterium
IADRIGRVRVMGVAAVL

SEQ ID NO: 311894 - protein, 21 aa, Mycobacterium
IADSNFRLAVLGLTVYTASFV

SEQ ID NO: 311895 - protein, 22 aa, Mycobacterium
IADVLLRPGFLRPPAVIDGPRR

SEQ ID NO: 311896 - protein, 30 aa, Mycobacterium
IADWQPVGAAGWPWLAGLGFAQLFSQALIV

SEQ ID NO: 311897 - protein, 20 aa, Mycobacterium
IADYPAVLLNGSWLSQEQTT

SEQ ID NO: 311898 - protein, 19 aa, Mycobacterium
IAEACGRHLLDARSPTASG

SEQ ID NO: 311899 - protein, 20 aa, Mycobacterium
IAEAINGLVQRVWEEQERTK

SEQ ID NO: 311900 - protein, 17 aa, Mycobacterium
IAEAVEGMLARIGSEQE

SEQ ID NO: 311901 - protein, 17 aa, Mycobacterium
IAEAVEGMLARIGTEQQ

SEQ ID NO: 311902 - protein, 24 aa, Mycobacterium
IAEAVNGMLKRIWKEQDRTKSALA

SEQ ID NO: 311903 - protein, 24 aa, Mycobacterium
IAEEMFFRGALYTALGRFYPVAVS

SEQ ID NO: 311904 - protein, 25 aa, Mycobacterium
IAEGISVTAAPGWTLVNRGPNWVTL

SEQ ID NO: 311905 - protein, 25 aa, Mycobacterium
IAEILERWEHILFPIVLIGLGIVIL

SEQ ID NO: 311906 - protein, 17 aa, Mycobacterium
IAELVTFLERTFRPIAG

SEQ ID NO: 311907 - protein, 18 aa, Mycobacterium
IAELVVVVALMLSTELVA

SEQ ID NO: 311908 - protein, 25 aa, Mycobacterium
IAEPKPPAAAAWRRGQDSVIARCGV

SEQ ID NO: 311909 - protein, 17 aa, Mycobacterium
IAERFAEGHLSERMPVR

SEQ ID NO: 311910 - protein, 23 aa, Mycobacterium
IAESPWHPVLMVLSGVVTAVPLL

SEQ ID NO: 311911 - protein, 22 aa, Mycobacterium
IAEVWKTTPFMSLLLLAGLAMV

SEQ ID NO: 311912 - protein, 24 aa, Mycobacterium
IAFAGGGALMFVKNSAWARGIGMG

SEQ ID NO: 311913 - protein, 21 aa, Mycobacterium
IAFAVGVVRLGQRQCLVQELP

SEQ ID NO: 311914 - protein, 20 aa, Mycobacterium
IAFGALWGAIFGFAAHASTG

SEQ ID NO: 311915 - protein, 23 aa, Mycobacterium
IAFGIYFLRDYLILIVVAGVAAY

SEQ ID NO: 311916 - protein, 20 aa, Mycobacterium
IAFLAIALVSVWLLYKYYRR

SEQ ID NO: 311917 - protein, 17 aa, Mycobacterium
IAFLRMISPLSWTPIAL

SEQ ID NO: 311918 - protein, 19 aa, Mycobacterium
IAFSFKRTRKVTVNTESSD

SEQ ID NO: 311919 - protein, 23 aa, Mycobacterium
IAFSTMFAMLLGYAVPDFPGARW

SEQ ID NO: 311920 - protein, 18 aa, Mycobacterium
IAFVTRSRGQMAITEQQA

SEQ ID NO: 311921 - protein, 26 aa, Mycobacterium
IAGAFAALFLPYSLLGPFAGALLDRW

SEQ ID NO: 311922 - protein, 23 aa, Mycobacterium
IAGAIPSFGLILIWIASWLMATP

SEQ ID NO: 311923 - protein, 28 aa, Mycobacterium
IAGALGILRLVAVFGPVHFFAQPVVSLI

SEQ ID NO: 311924 - protein, 26 aa, Mycobacterium
IAGAMFIFFGLWTLRGDSLSDEEASR

SEQ ID NO: 311925 - protein, 19 aa, Mycobacterium
IAGCVAAVLAVRQDGLFTA

SEQ ID NO: 311926 - protein, 17 aa, Mycobacterium
IAGDYLSAASFLGIAGA

SEQ ID NO: 311927 - protein, 28 aa, Mycobacterium
IAGEGLYWAKLCAASTMAALPVVLAGWV

SEQ ID NO: 311928 - protein, 27 aa, Mycobacterium
IAGELLQALMFVIGTVAFVVWALATVV

SEQ ID NO: 311929 - protein, 24 aa, Mycobacterium
IAGERPAVMPLSYAQSRLWFIDQL

SEQ ID NO: 311930 - protein, 19 aa, Mycobacterium
IAGFVAMVFNLFFINLVTV

SEQ ID NO: 311931 - protein, 22 aa, Mycobacterium
IAGGVGWLYARVFYGTVAVTKM

SEQ ID NO: 311932 - protein, 19 aa, Mycobacterium
IAGICVFASVAVNLANTAV

SEQ ID NO: 311933 - protein, 27 aa, Mycobacterium
IAGIRINLFTSTFVFIGAVVYVILAPK

SEQ ID NO: 311934 - protein, 18 aa, Mycobacterium
IAGLAERWDLVAWGVELG

SEQ ID NO: 311935 - protein, 19 aa, Mycobacterium
IAGLCLAAAATARRQGQPV

SEQ ID NO: 311936 - protein, 20 aa, Mycobacterium
IAGLIAVYVVLQLARQKRML

SEQ ID NO: 311937 - protein, 25 aa, Mycobacterium
IAGLLCLLIAFPVAYYVARLSGRRK

SEQ ID NO: 311938 - protein, 21 aa, Mycobacterium
IAGLLQLLGLFGIAGIGRIYL

SEQ ID NO: 311939 - protein, 29 aa, Mycobacterium
IAGLPCVPWFIDSAWNLAFGVLPPYWAAK

SEQ ID NO: 311940 - protein, 22 aa, Mycobacterium
IAGLPCVPWFIHSNWNVAFGVL

SEQ ID NO: 311941 - protein, 18 aa, Mycobacterium
IAGLSLIGGFAWHAWHRA

SEQ ID NO: 311942 - protein, 24 aa, Mycobacterium
IAGMTCASCAMRIEKKLNKLDGVS

SEQ ID NO: 311943 - protein, 18 aa, Mycobacterium
IAGMYAYQAFAPNFLIPQ

SEQ ID NO: 311944 - protein, 23 aa, Mycobacterium
IAGNPTEYWGLKGLIGGNAVAAD

SEQ ID NO: 311945 - protein, 18 aa, Mycobacterium
IAGPAALIGDMRVMLDRD

SEQ ID NO: 311946 - protein, 25 aa, Mycobacterium
IAGPARLGHWIMFCANGTAAIGAAI

SEQ ID NO: 311947 - protein, 25 aa, Mycobacterium
IAGPIARLALVGAAAEGSAVIDQSS

SEQ ID NO: 311948 - protein, 29 aa, Mycobacterium
IAGPLGLCFLPAFVCLGIVPVLAGLAAKV

SEQ ID NO: 311949 - protein, 26 aa, Mycobacterium
IAGPLLAGVLLKWVDLSTLYLIDAIA

SEQ ID NO: 311950 - protein, 22 aa, Mycobacterium
IAGRQALSAALRFTENLTTIDS

SEQ ID NO: 311951 - protein, 21 aa, Mycobacterium
IAGRRAGRFGVFKQISLIGLV

SEQ ID NO: 311952 - protein, 21 aa, Mycobacterium
IAGSAPLWAGRVFVEQRWLSV

SEQ ID NO: 311953 - protein, 17 aa, Mycobacterium
IAGTVLTGFVFVSRMPV

SEQ ID NO: 311954 - protein, 20 aa, Mycobacterium
IAGTVVWFGITDAWNERLDR

SEQ ID NO: 311955 - protein, 18 aa, Mycobacterium
IAGVAVWQGVRAWRGEQC

SEQ ID NO: 311956 - protein, 24 aa, Mycobacterium
IAGVFWPKKFVATSVINSVLFAAI

SEQ ID NO: 311957 - protein, 24 aa, Mycobacterium
IAGVLGVVIAHPWRSPGPPTASAP

SEQ ID NO: 311958 - protein, 18 aa, Mycobacterium
IAGVPIVLRHYWKEFLRH

SEQ ID NO: 311959 - protein, 17 aa, Mycobacterium
IAGVPVGRVKNVSLNRD

SEQ ID NO: 311960 - protein, 24 aa, Mycobacterium
IAGVPWPAYKVFALLIGAFVLVTV

SEQ ID NO: 311961 - protein, 19 aa, Mycobacterium
IAGYRIEGVLGSGGMGTVY

SEQ ID NO: 311962 - protein, 29 aa, Mycobacterium
IAHGLGMPIPAGWKLWLYGVFAITAVGVT

SEQ ID NO: 311963 - protein, 26 aa, Mycobacterium
IAHGLGMPVSLGWQLWLYGVFAIIAV

SEQ ID NO: 311964 - protein, 22 aa, Mycobacterium
IAHKLENVMLVSAFMAAAALTQ

SEQ ID NO: 311965 - protein, 17 aa, Mycobacterium
IAHRTGGRVVLRHVAGT

SEQ ID NO: 311966 - protein, 23 aa, Mycobacterium
IAHYCHYWKALQFVPQWTLALVA

SEQ ID NO: 311967 - protein, 26 aa, Mycobacterium
IAIALKVDWPNFWSMIASASSKTALV

SEQ ID NO: 311968 - protein, 18 aa, Mycobacterium
IAIALWWSATSVLSGPES

SEQ ID NO: 311969 - protein, 17 aa, Mycobacterium
IAIAVVFAAAVAQTTRI

SEQ ID NO: 311970 - protein, 24 aa, Mycobacterium
IAIDEWSDAVFLADLDAAYAAHRA

SEQ ID NO: 311971 - protein, 25 aa, Mycobacterium
IAIFMGLYLRFLRPGRVSEVSVIGV

SEQ ID NO: 311972 - protein, 28 aa, Mycobacterium
IAIGAVATWLVYRITRGVPKARTEAGFR

SEQ ID NO: 311973 - protein, 19 aa, Mycobacterium
IAIGGLIFVRAMFLENALN

SEQ ID NO: 311974 - protein, 18 aa, Mycobacterium
IAIGGLIVVRAMFLENAL

SEQ ID NO: 311975 - protein, 20 aa, Mycobacterium
IAIGSIRNKIVFILPAILLL

SEQ ID NO: 311976 - protein, 20 aa, Mycobacterium
IAIGSLRNKLLIILPAAMLL

SEQ ID NO: 311977 - protein, 17 aa, Mycobacterium
IAIPILGGFAGVLTSPA

SEQ ID NO: 311978 - protein, 26 aa, Mycobacterium
IAIPLNGFVQFSWLRFGIFYYSEAVG

SEQ ID NO: 311979 - protein, 19 aa, Mycobacterium
IAIPLSFLVLVWVFGGLLA

SEQ ID NO: 311980 - protein, 25 aa, Mycobacterium
IAIPVSFVALVWVFGGLLAAALPVA

SEQ ID NO: 311981 - protein, 23 aa, Mycobacterium
IAIRARVAAVFGISTSLAPVVGS

SEQ ID NO: 311982 - protein, 17 aa, Mycobacterium
IAIRRILLDPSRSNPLR

SEQ ID NO: 311983 - protein, 19 aa, Mycobacterium
IAISLVVYLFFLKNKSQTY

SEQ ID NO: 311984 - protein, 18 aa, Mycobacterium
IAIVAVWQGIRAWRGEDC

SEQ ID NO: 311985 - protein, 34 aa, Mycobacterium
IAIVSLALVLGRWGGQTVRHWAVTGFKYLTGRTY

SEQ ID NO: 311986 - protein, 27 aa, Mycobacterium
IAIWIGRPIIRLTFRNELTNAAFRYAL

SEQ ID NO: 311987 - protein, 20 aa, Mycobacterium
IAKDVWRAAARNGLLLIAAW

SEQ ID NO: 311988 - protein, 22 aa, Mycobacterium
IAKGHGLAGLADRIRAGGGTLD

SEQ ID NO: 311989 - protein, 19 aa, Mycobacterium
IAKGSLRNKILIILPVALL

SEQ ID NO: 311990 - protein, 19 aa, Mycobacterium
IALAGLWLGLLGIAMATGL

SEQ ID NO: 311991 - protein, 20 aa, Mycobacterium
IALALWAIRLSARPASGRMT

SEQ ID NO: 311992 - protein, 17 aa, Mycobacterium
IALAPGLVPMVWLNVLR

SEQ ID NO: 311993 - protein, 29 aa, Mycobacterium
IALAQLWHVFNMRGPRSAVLCNAVTRNRL

SEQ ID NO: 311994 - protein, 20 aa, Mycobacterium
IALASIWLSGPLLLGLGALQ

SEQ ID NO: 311995 - protein, 22 aa, Mycobacterium
IALASLWLSGPLLLGLGPTQLV

SEQ ID NO: 311996 - protein, 17 aa, Mycobacterium
IALAVALPLSFPSLGQM

SEQ ID NO: 311997 - protein, 21 aa, Mycobacterium
IALAVCVPAALFLLPPRHHGQ

SEQ ID NO: 311998 - protein, 49 aa, Mycobacterium
IALAVGIAVVFVRWWGQPAWSWAVLGLRGRRPVSWDAPITVANNRSGGG

SEQ ID NO: 311999 - protein, 19 aa, Mycobacterium
IALAVLLGLFLATAVLLIM

SEQ ID NO: 312000 - protein, 19 aa, Mycobacterium
IALCYEMVMKYGFNDDSLG

SEQ ID NO: 312001 - protein, 18 aa, Mycobacterium
IALEGSLLDALQLPAIPH

SEQ ID NO: 312002 - protein, 26 aa, Mycobacterium
IALFWVRSRAAAVLLLPYLVWTTFAA

SEQ ID NO: 312003 - protein, 19 aa, Mycobacterium
IALGAVVAAIARRAGQVQE

SEQ ID NO: 312004 - protein, 21 aa, Mycobacterium
IALGGEWGGAVLLSVEHAPPG

SEQ ID NO: 312005 - protein, 17 aa, Mycobacterium
IALGLAGLVCSIAALVL

SEQ ID NO: 312006 - protein, 18 aa, Mycobacterium
IALGLAVTLVWLYVEILR

SEQ ID NO: 312007 - protein, 17 aa, Mycobacterium
IALGLTVTLVWLYIEIL

SEQ ID NO: 312008 - protein, 17 aa, Mycobacterium
IALGLTVTLVWLYLEIL

SEQ ID NO: 312009 - protein, 17 aa, Mycobacterium
IALIGTFALCLWYELMD

SEQ ID NO: 312010 - protein, 26 aa, Mycobacterium
IALLATFSWPALRRTATLFLVGTAVV

SEQ ID NO: 312011 - protein, 17 aa, Mycobacterium
IALLGSGAMTLVCTVLF

SEQ ID NO: 312012 - protein, 19 aa, Mycobacterium
IALLLACIVLRGLSTSRVP

SEQ ID NO: 312013 - protein, 17 aa, Mycobacterium
IALLVSRQVVVPVRSAS

SEQ ID NO: 312014 - protein, 21 aa, Mycobacterium
IALMVYFIFALQCMSTVAVMR

SEQ ID NO: 312015 - protein, 17 aa, Mycobacterium
IALNTGVPFGIHSLVHS

SEQ ID NO: 312016 - protein, 19 aa, Mycobacterium
IALPLLAYFAVMWGGGFLL

SEQ ID NO: 312017 - protein, 17 aa, Mycobacterium
IALPLVFIALGGIGLPG

SEQ ID NO: 312018 - protein, 24 aa, Mycobacterium
IALRPDTVSALGWYVVAATAATAT

SEQ ID NO: 312019 - protein, 22 aa, Mycobacterium
IALRWLLLLAVTIAVTVPLTLI

SEQ ID NO: 312020 - protein, 26 aa, Mycobacterium
IALTGVVCFVGFLASYLFNVFVQGGA

SEQ ID NO: 312021 - protein, 28 aa, Mycobacterium
IALTGVVCFVGFLGAYLFNVYWQNGAPG

SEQ ID NO: 312022 - protein, 19 aa, Mycobacterium
IALVAAVVGFVMAFQATRE

SEQ ID NO: 312023 - protein, 19 aa, Mycobacterium
IALVGLLTLPGYRTNYNDR

SEQ ID NO: 312024 - protein, 19 aa, Mycobacterium
IALVSVWLLYKYYRRRDPR

SEQ ID NO: 312025 - protein, 20 aa, Mycobacterium
IALWMVPFGLIGGRLYHLST

SEQ ID NO: 312026 - protein, 17 aa, Mycobacterium
IAMGALFSVAYVVAIGR

SEQ ID NO: 312027 - protein, 19 aa, Mycobacterium
IAMGLVFIGLVPALQRDIR

SEQ ID NO: 312028 - protein, 19 aa, Mycobacterium
IAMGWPVFLLTSTLIYLAI

SEQ ID NO: 312029 - protein, 19 aa, Mycobacterium
IAMKRVGKVFNEFDTDSAV

SEQ ID NO: 312030 - protein, 26 aa, Mycobacterium
IAMMKGRNPLGWGILGLFFSILTLIV

SEQ ID NO: 312031 - protein, 21 aa, Mycobacterium
IAMPGPLPWLQVYPENLLTRA

SEQ ID NO: 312032 - protein, 21 aa, Mycobacterium
IAMPLGMWIFTPLRRQATAAL

SEQ ID NO: 312033 - protein, 17 aa, Mycobacterium
IAMQMLLLGGGLGLTTA

SEQ ID NO: 312034 - protein, 34 aa, Mycobacterium
IAMRPDCRLDVAGLWGLLRINRYQQFFGAARITD

SEQ ID NO: 312035 - protein, 32 aa, Mycobacterium
IAMRPDCRLDVAGLWGVLRINRYTQMYGTARL

SEQ ID NO: 312036 - protein, 23 aa, Mycobacterium
IAMSLPLLWWRFRRDDRAVLAGI

SEQ ID NO: 312037 - protein, 18 aa, Mycobacterium
IAMVAGWRCGSWRPVVLA

SEQ ID NO: 312038 - protein, 28 aa, Mycobacterium
IANDIAKYFAIIPAMFVALFPGLDLINV

SEQ ID NO: 312039 - protein, 27 aa, Mycobacterium
IANDIAKYFAIIPAMFVALFPGLDLLN

SEQ ID NO: 312040 - protein, 17 aa, Mycobacterium
IANFNRYAGSVTRGLDE

SEQ ID NO: 312041 - protein, 25 aa, Mycobacterium
IANHQPWLRRALGGGIGPGATDTAL

SEQ ID NO: 312042 - protein, 25 aa, Mycobacterium
IANLAGGWLIMWLVMTAYPKLHEKT

SEQ ID NO: 312043 - protein, 25 aa, Mycobacterium
IANMWRIVFAQLRLNGWNRGVGDVT

SEQ ID NO: 312044 - protein, 17 aa, Mycobacterium
IANRFPLLKILDMTRAI

SEQ ID NO: 312045 - protein, 23 aa, Mycobacterium
IANRVSYFYDLRGPSVTIDTACS

SEQ ID NO: 312046 - protein, 17 aa, Mycobacterium
IAPAAVLDNGIRKQTGL

SEQ ID NO: 312047 - protein, 17 aa, Mycobacterium
IAPAETWVDLMLDPRQA

SEQ ID NO: 312048 - protein, 17 aa, Mycobacterium
IAPAPWILVPGGEAAAV

SEQ ID NO: 312049 - protein, 21 aa, Mycobacterium
IAPDDRVNWSRDRIFGPVEGT

SEQ ID NO: 312050 - protein, 20 aa, Mycobacterium
IAPELSGLWTAGFVMAPYNT

SEQ ID NO: 312051 - protein, 20 aa, Mycobacterium
IAPELYLKRLCVGGVEKVFE

SEQ ID NO: 312052 - protein, 17 aa, Mycobacterium
IAPFLGALTIIVAVVIG

SEQ ID NO: 312053 - protein, 19 aa, Mycobacterium
IAPFVLPLAVTIFVFILIS

SEQ ID NO: 312054 - protein, 21 aa, Mycobacterium
IAPFWISYMMRMLAWVNLLQD

SEQ ID NO: 312055 - protein, 17 aa, Mycobacterium
IAPGITIPVGPPTTVPV

SEQ ID NO: 312056 - protein, 27 aa, Mycobacterium
IAPGIVLAQAIGRLGNYFNQELYGRET

SEQ ID NO: 312057 - protein, 22 aa, Mycobacterium
IAPHFLRIRMVSPTLFEDAQAE

SEQ ID NO: 312058 - protein, 17 aa, Mycobacterium
IAPHVWLSVVSMFVIGV

SEQ ID NO: 312059 - protein, 18 aa, Mycobacterium
IAPMEAIMLDGGRTQPVS

SEQ ID NO: 312060 - protein, 18 aa, Mycobacterium
IAPPGDRQVLLTGLAQIN

SEQ ID NO: 312061 - protein, 26 aa, Mycobacterium
IAPRKEEKRSWGWVIALALVVAALAA

SEQ ID NO: 312062 - protein, 17 aa, Mycobacterium
IAPSVLLCAVYVYRRVW

SEQ ID NO: 312063 - protein, 23 aa, Mycobacterium
IAPTPRPASVITIAPAGTALPEG

SEQ ID NO: 312064 - protein, 24 aa, Mycobacterium
IAPVIAGVIWKLMFNPQFGILNHV

SEQ ID NO: 312065 - protein, 17 aa, Mycobacterium
IAPWVFDLITRPLFPDD

SEQ ID NO: 312066 - protein, 27 aa, Mycobacterium
IAQARMTLLYFARKRVGSVGGELREDI

SEQ ID NO: 312067 - protein, 27 aa, Mycobacterium
IAQCVKAEMLAAGSWRVAVNAGADSTD

SEQ ID NO: 312068 - protein, 28 aa, Mycobacterium
IAQCVKAEMLAASSWRVAVSAGADSTGR

SEQ ID NO: 312069 - protein, 26 aa, Mycobacterium
IAQIAALGPDGGWQGSAARAYGARNL

SEQ ID NO: 312070 - protein, 20 aa, Mycobacterium
IAQLGGLVFVSAFTVVTLGM

SEQ ID NO: 312071 - protein, 18 aa, Mycobacterium
IAQRRPVISLLRAIGGRR

SEQ ID NO: 312072 - protein, 23 aa, Mycobacterium
IAQRSDVMLLLRSDPGAGGGGYA

SEQ ID NO: 312073 - protein, 26 aa, Mycobacterium
IAQSRSGSVAMELADSAGLPVLTVRD

SEQ ID NO: 312074 - protein, 18 aa, Mycobacterium
IAQVCLGVALLAAFGAQG

SEQ ID NO: 312075 - protein, 19 aa, Mycobacterium
IARAWIVVTICALVVAVAL

SEQ ID NO: 312076 - protein, 29 aa, Mycobacterium
IARHAMAIALPRWGTTEVVSEVVYGSRAF

SEQ ID NO: 312077 - protein, 18 aa, Mycobacterium
IARLPLQIPMITTALKVY

SEQ ID NO: 312078 - protein, 19 aa, Mycobacterium
IARMDRLVQRNVLAMSGRA

SEQ ID NO: 312079 - protein, 23 aa, Mycobacterium
IARPWRWGYLGVLFVIFGFPLLA

SEQ ID NO: 312080 - protein, 22 aa, Mycobacterium
IARRMARTFPFGTFAVNVSGAA

SEQ ID NO: 312081 - protein, 18 aa, Mycobacterium
IARRNLLCMMAADHVAFS

SEQ ID NO: 312082 - protein, 23 aa, Mycobacterium
IARTGWRPLVVAVIGLTVVATVS

SEQ ID NO: 312083 - protein, 28 aa, Mycobacterium
IARVAFKLYPRRAFLGLALFTGQAFLYN

SEQ ID NO: 312084 - protein, 39 aa, Mycobacterium
IARYRTAVMARLRLIGIGVPLAIGVLAGFVGQSYWQRVQ

SEQ ID NO: 312085 - protein, 23 aa, Mycobacterium
IASAIVFDCIRNWPKANPLSTES

SEQ ID NO: 312086 - protein, 17 aa, Mycobacterium
IASAIVLASMVARVASD

SEQ ID NO: 312087 - protein, 19 aa, Mycobacterium
IASGIGLALFGLRRGVQDR

SEQ ID NO: 312088 - protein, 25 aa, Mycobacterium
IASHMPLLLGVAFALLVARERVRSD

SEQ ID NO: 312089 - protein, 26 aa, Mycobacterium
IASIAACVWLMLNLTALTWVRFGVWL

SEQ ID NO: 312090 - protein, 25 aa, Mycobacterium
IASIVGVAVMLFAYMQVPTLLGLGR

SEQ ID NO: 312091 - protein, 24 aa, Mycobacterium
IASLGMGMVFVWPALAATATRDLP

SEQ ID NO: 312092 - protein, 18 aa, Mycobacterium
IASLLLARREFWARVRPG

SEQ ID NO: 312093 - protein, 18 aa, Mycobacterium
IASLWLLYRYYRTRDPLF

SEQ ID NO: 312094 - protein, 19 aa, Mycobacterium
IASMEMFRRRKFGGEAGPV

SEQ ID NO: 312095 - protein, 18 aa, Mycobacterium
IASMEVFRRRKFGGEPGP

SEQ ID NO: 312096 - protein, 18 aa, Mycobacterium
IASMEVFRRRRFGGEPGP

SEQ ID NO: 312097 - protein, 19 aa, Mycobacterium
IASMGVWPLAIGQSRIGVL

SEQ ID NO: 312098 - protein, 17 aa, Mycobacterium
IASMPWWAVVGGLVGAV

SEQ ID NO: 312099 - protein, 24 aa, Mycobacterium
IASPKTRKFALIGLAVYLIYMLGN

SEQ ID NO: 312100 - protein, 17 aa, Mycobacterium
IASRVGTGVGFAQDQVF

SEQ ID NO: 312101 - protein, 27 aa, Mycobacterium
IASSIQLPAWLSRTGADVLKAHPIVAV

SEQ ID NO: 312102 - protein, 19 aa, Mycobacterium
IASTVWDHTVRLWDADTGQ

SEQ ID NO: 312103 - protein, 21 aa, Mycobacterium
IASVCRRHFWVAHPHGPTVLT

SEQ ID NO: 312104 - protein, 24 aa, Mycobacterium
IASVRLSVLFSFQGNDMMTSFQVI

SEQ ID NO: 312105 - protein, 19 aa, Mycobacterium
IATAAAWTVALTRPTDVRE

SEQ ID NO: 312106 - protein, 19 aa, Mycobacterium
IATACALSGTLRGVSDAFN

SEQ ID NO: 312107 - protein, 17 aa, Mycobacterium
IATAGAVVMLAMSSQLA

SEQ ID NO: 312108 - protein, 19 aa, Mycobacterium
IATDRYDGILARRYGLITP

SEQ ID NO: 312109 - protein, 22 aa, Mycobacterium
IATERFSWVVLGLALFAAGSIA

SEQ ID NO: 312110 - protein, 19 aa, Mycobacterium
IATGALFGLAALPVVFNLS

SEQ ID NO: 312111 - protein, 27 aa, Mycobacterium
IATGAWLSRLVKAWVPTPVRAGRGYSF

SEQ ID NO: 312112 - protein, 17 aa, Mycobacterium
IATGFGITEPTAGHVIS

SEQ ID NO: 312113 - protein, 17 aa, Mycobacterium
IATHLALAQSAGAIQHD

SEQ ID NO: 312114 - protein, 21 aa, Mycobacterium
IATKMSGEWSKDDVLQAYLNI

SEQ ID NO: 312115 - protein, 30 aa, Mycobacterium
IATLDPDGGWRGNAARAYGAKNLAQSQHTT

SEQ ID NO: 312116 - protein, 18 aa, Mycobacterium
IATLGLRVYLGWITSTGY

SEQ ID NO: 312117 - protein, 17 aa, Mycobacterium
IATMLLVAIAFLGLASA

SEQ ID NO: 312118 - protein, 17 aa, Mycobacterium
IATNAGVAWAIYPISLA

SEQ ID NO: 312119 - protein, 18 aa, Mycobacterium
IATPVAWAQAAGMVAAFL

SEQ ID NO: 312120 - protein, 24 aa, Mycobacterium
IATRFEYRDALLLDTRGNVVYSVK

SEQ ID NO: 312121 - protein, 22 aa, Mycobacterium
IATSCALAAWYALYRAPDLRTR

SEQ ID NO: 312122 - protein, 22 aa, Mycobacterium
IATSLSMVFGELVPKNLAVARP

SEQ ID NO: 312123 - protein, 27 aa, Mycobacterium
IATTLWYLVMRDFRIALAGIGFALATV

SEQ ID NO: 312124 - protein, 23 aa, Mycobacterium
IATVFALAWAQARDTAPGVRETQ

SEQ ID NO: 312125 - protein, 20 aa, Mycobacterium
IATVVAVVFVARGLSGTPGR

SEQ ID NO: 312126 - protein, 24 aa, Mycobacterium
IATYRSPVLWLLPLLVIGFADRLA

SEQ ID NO: 312127 - protein, 18 aa, Mycobacterium
IAVAARFSVAFRDVSALA

SEQ ID NO: 312128 - protein, 17 aa, Mycobacterium
IAVALGIGAGIGAIFAA

SEQ ID NO: 312129 - protein, 17 aa, Mycobacterium
IAVALVLIGHGGIPGVS

SEQ ID NO: 312130 - protein, 49 aa, Mycobacterium
IAVAVGIALVFVRWWGQPAWSWLVLWRRGRRPISWDAPITVANNRSGGG

SEQ ID NO: 312131 - protein, 25 aa, Mycobacterium
IAVAWAGLVLVAWRTSRAPECVGAD

SEQ ID NO: 312132 - protein, 18 aa, Mycobacterium
IAVAYRLYANAKIPRVAP

SEQ ID NO: 312133 - protein, 19 aa, Mycobacterium
IAVAYRLYATADIPRVAPL

SEQ ID NO: 312134 - protein, 23 aa, Mycobacterium
IAVCAAFILWNRMIRFEYALIVS

SEQ ID NO: 312135 - protein, 17 aa, Mycobacterium
IAVCAAVTVLLGILPQP

SEQ ID NO: 312136 - protein, 21 aa, Mycobacterium
IAVCAGLALLAIRPVPTGTGA

SEQ ID NO: 312137 - protein, 20 aa, Mycobacterium
IAVCAPTLLLAPVASADPPF

SEQ ID NO: 312138 - protein, 26 aa, Mycobacterium
IAVFGMRLLFPLVIVWATAGIGPVRA

SEQ ID NO: 312139 - protein, 17 aa, Mycobacterium
IAVFVAFHVARRTMRAR

SEQ ID NO: 312140 - protein, 28 aa, Mycobacterium
IAVGAIATWLVYRITRGIPIKHTESGFR

SEQ ID NO: 312141 - protein, 18 aa, Mycobacterium
IAVGFGMFAMSLVGPQLL

SEQ ID NO: 312142 - protein, 17 aa, Mycobacterium
IAVGFLIVQDIIVVLVM

SEQ ID NO: 312143 - protein, 20 aa, Mycobacterium
IAVGFLLKISPSGVIFKTSD

SEQ ID NO: 312144 - protein, 18 aa, Mycobacterium
IAVGFYLYKSAPRGSLIW

SEQ ID NO: 312145 - protein, 25 aa, Mycobacterium
IAVGGLAPTVWGWRRVPVWRWFVLG

SEQ ID NO: 312146 - protein, 21 aa, Mycobacterium
IAVGIADGWRRLSRAVWPPLV

SEQ ID NO: 312147 - protein, 20 aa, Mycobacterium
IAVGLELAGLLSTRARSSRR

SEQ ID NO: 312148 - protein, 22 aa, Mycobacterium
IAVGWLLGYVMRAQRLLLAEQI

SEQ ID NO: 312149 - protein, 18 aa, Mycobacterium
IAVIACFVLVLVAMLFDA

SEQ ID NO: 312150 - protein, 25 aa, Mycobacterium
IAVICAVAVFSAIFLRDLRIPAIGV

SEQ ID NO: 312151 - protein, 18 aa, Mycobacterium
IAVILSFLASKLTTVVLF

SEQ ID NO: 312152 - protein, 18 aa, Mycobacterium
IAVILSFLASQFTTVILF

SEQ ID NO: 312153 - protein, 18 aa, Mycobacterium
IAVILSFLASQFTTVVLF

SEQ ID NO: 312154 - protein, 20 aa, Mycobacterium
IAVILSFLASQFVTVVLFGQ

SEQ ID NO: 312155 - protein, 19 aa, Mycobacterium
IAVILSFVASQFITVFMFG

SEQ ID NO: 312156 - protein, 18 aa, Mycobacterium
IAVITIAGGMLFVPTSHD

SEQ ID NO: 312157 - protein, 23 aa, Mycobacterium
IAVKRHRGAQALLWKAFNTGSEN

SEQ ID NO: 312158 - protein, 21 aa, Mycobacterium
IAVLGFFAFYLSFVAELPPPP

SEQ ID NO: 312159 - protein, 24 aa, Mycobacterium
IAVLRVGAVLLMLNPAHPTRRVRD

SEQ ID NO: 312160 - protein, 20 aa, Mycobacterium
IAVLVGLVALWPEHRTVDIP

SEQ ID NO: 312161 - protein, 23 aa, Mycobacterium
IAVLVSMWWYWGLYVRAMRLNPD

SEQ ID NO: 312162 - protein, 25 aa, Mycobacterium
IAVNEAWYAAQWIRTALAMIAYGAA

SEQ ID NO: 312163 - protein, 19 aa, Mycobacterium
IAVPAHFLTGLNWPTAFLV

SEQ ID NO: 312164 - protein, 26 aa, Mycobacterium
IAVPAHWKPTAVQALRNGLRTHVGFV

SEQ ID NO: 312165 - protein, 22 aa, Mycobacterium
IAVPLLLPIAAKLGFTRSALTS

SEQ ID NO: 312166 - protein, 23 aa, Mycobacterium
IAVPLSFVVLTWVFGGLLAAAVP

SEQ ID NO: 312167 - protein, 19 aa, Mycobacterium
IAVPSYWTVEATRALAQTV

SEQ ID NO: 312168 - protein, 17 aa, Mycobacterium
IAVPWWFLVAQLPFAGI

SEQ ID NO: 312169 - protein, 18 aa, Mycobacterium
IAVRDIIVVLGFALAALC

SEQ ID NO: 312170 - protein, 25 aa, Mycobacterium
IAVRPHPALRLIGAVTLLALAPTVL

SEQ ID NO: 312171 - protein, 19 aa, Mycobacterium
IAVRRIPDGGGGSIEMHDT

SEQ ID NO: 312172 - protein, 17 aa, Mycobacterium
IAVRYERYMSLAALAAL

SEQ ID NO: 312173 - protein, 22 aa, Mycobacterium
IAVSLPLLWWRFRRDDRAALTG

SEQ ID NO: 312174 - protein, 23 aa, Mycobacterium
IAVSLPLLWWRFRRDDRAALTGM

SEQ ID NO: 312175 - protein, 19 aa, Mycobacterium
IAVSTFFRSGDGLTPEGRV

SEQ ID NO: 312176 - protein, 17 aa, Mycobacterium
IAVSVGFGGNPSGGQPR

SEQ ID NO: 312177 - protein, 22 aa, Mycobacterium
IAVTAVGAWASMRIPKWVEVTA

SEQ ID NO: 312178 - protein, 24 aa, Mycobacterium
IAVTDCRDLVRPAAAAQRLPSGDL

SEQ ID NO: 312179 - protein, 18 aa, Mycobacterium
IAVTFVWLGMVLAISFLE

SEQ ID NO: 312180 - protein, 26 aa, Mycobacterium
IAVVFRIGRALGRMRSHTFAHADAVR

SEQ ID NO: 312181 - protein, 25 aa, Mycobacterium
IAVVFRIGRALGRMRTHTFAHADAV

SEQ ID NO: 312182 - protein, 19 aa, Mycobacterium
IAVVGIRILGQVDFADTAN

SEQ ID NO: 312183 - protein, 20 aa, Mycobacterium
IAVVGLILVRAWFLDNALSQ

SEQ ID NO: 312184 - protein, 17 aa, Mycobacterium
IAVWFAAVGRGVRRWAL

SEQ ID NO: 312185 - protein, 17 aa, Mycobacterium
IAWFAVLLEMSRPRDTW

SEQ ID NO: 312186 - protein, 23 aa, Mycobacterium
IAWPPEVLSGALWSGSGPGPLFT

SEQ ID NO: 312187 - protein, 18 aa, Mycobacterium
IAWPRAAFDQRWLDWSVW

SEQ ID NO: 312188 - protein, 24 aa, Mycobacterium
IAYAVGLAISWLLQRLGRRSTLLH

SEQ ID NO: 312189 - protein, 24 aa, Mycobacterium
IAYFPDFATAIFVGGIGIGTIVVP

SEQ ID NO: 312190 - protein, 25 aa, Mycobacterium
IAYLLEILPALAYLHALGLVYNDLK

SEQ ID NO: 312191 - protein, 20 aa, Mycobacterium
IAYRPLRKRNARALTFLITA

SEQ ID NO: 312192 - protein, 24 aa, Mycobacterium
IAYSVLKCVVFVWLSSTVQCYYGF

SEQ ID NO: 312193 - protein, 23 aa, Mycobacterium
ICDVSRLPTRNALLLEKAAKDST

SEQ ID NO: 312194 - protein, 24 aa, Mycobacterium
ICFVAVALGAVWLGRIRPAPAEAV

SEQ ID NO: 312195 - protein, 17 aa, Mycobacterium
ICGCAAGALAVTPPSKS

SEQ ID NO: 312196 - protein, 37 aa, Mycobacterium
ICGNGLRPAIWDDFTKRFGIDRVCEFYSASESNTAFV

SEQ ID NO: 312197 - protein, 26 aa, Mycobacterium
ICIGLIFDMMIVRLFLVMPLARILGP

SEQ ID NO: 312198 - protein, 26 aa, Mycobacterium
ICIGLVFDMMIVRLFLVMPLARLLGP

SEQ ID NO: 312199 - protein, 17 aa, Mycobacterium
ICLGALLYSFLSPAGQV

SEQ ID NO: 312200 - protein, 18 aa, Mycobacterium
ICLGCQLYPLVARLRRAP

SEQ ID NO: 312201 - protein, 20 aa, Mycobacterium
ICLGSLLWSFISPSGQINDS

SEQ ID NO: 312202 - protein, 23 aa, Mycobacterium
ICLSEIWKTTPFISLLLLAGLVQ

SEQ ID NO: 312203 - protein, 25 aa, Mycobacterium
ICQSDRPFEPLAMRQHVTGPYPIDP

SEQ ID NO: 312204 - protein, 23 aa, Mycobacterium
ICRDHLVCIGFMLVFLLLWLAYG

SEQ ID NO: 312205 - protein, 19 aa, Mycobacterium
ICRYGLVIVLAWIGVGKYV

SEQ ID NO: 312206 - protein, 25 aa, Mycobacterium
ICSITLGALGHRWFAGAGAEPESGS

SEQ ID NO: 312207 - protein, 17 aa, Mycobacterium
ICTATAFIVLLSGPETY

SEQ ID NO: 312208 - protein, 33 aa, Mycobacterium
ICTFAIGAATVFAWLLAVFAVRPFKQLAEQTRS

SEQ ID NO: 312209 - protein, 19 aa, Mycobacterium
ICTPLRFREYLSAKLVVLL

SEQ ID NO: 312210 - protein, 21 aa, Mycobacterium
ICVADPLAFTGCERVGKGPER

SEQ ID NO: 312211 - protein, 29 aa, Mycobacterium
ICVASMVLAQLMLRPIRRLQAGTQKISSG

SEQ ID NO: 312212 - protein, 23 aa, Mycobacterium
ICVGAYAPYVAWLMQASADSAAA

SEQ ID NO: 312213 - protein, 42 aa, Mycobacterium
ICVLTFRERTVWQWAWRAMSWTRRRVRRLQLPQPVDVTLNEH

SEQ ID NO: 312214 - protein, 20 aa, Mycobacterium
ICVLVGLLILVRMTPLIALW

SEQ ID NO: 312215 - protein, 20 aa, Mycobacterium
IDAAMRCVAEMGYSRSTIRE

SEQ ID NO: 312216 - protein, 28 aa, Mycobacterium
IDAARLLTWRASWMAANGVSFERGEGSM

SEQ ID NO: 312217 - protein, 28 aa, Mycobacterium
IDAAVPSLREWLRLVFIVLGGYAVATRT

SEQ ID NO: 312218 - protein, 17 aa, Mycobacterium
IDAGWFLINCDPDTYRR

SEQ ID NO: 312219 - protein, 26 aa, Mycobacterium
IDAIGARVGFELGFAVLDHSQHGVAD

SEQ ID NO: 312220 - protein, 19 aa, Mycobacterium
IDAKWRWRDWLRAARQYKL

SEQ ID NO: 312221 - protein, 19 aa, Mycobacterium
IDALDVRRLIRRVLGRPEP

SEQ ID NO: 312222 - protein, 18 aa, Mycobacterium
IDAMAGALGEFFYNDPRR

SEQ ID NO: 312223 - protein, 24 aa, Mycobacterium
IDAPSRWLWLFKWCVLAVPHYPVL

SEQ ID NO: 312224 - protein, 17 aa, Mycobacterium
IDARLMSRIGLRPNIKR

SEQ ID NO: 312225 - protein, 20 aa, Mycobacterium
IDASQAMAFVRQRRDENDGS

SEQ ID NO: 312226 - protein, 18 aa, Mycobacterium
IDATRGTVHLVIGCGGRS

SEQ ID NO: 312227 - protein, 17 aa, Mycobacterium
IDAVPVRVAIFYIGALL

SEQ ID NO: 312228 - protein, 17 aa, Mycobacterium
IDCRDLYDRQEMLDQAQ

SEQ ID NO: 312229 - protein, 26 aa, Mycobacterium
IDDALELRGRILGAFEAAEVATDPAE

SEQ ID NO: 312230 - protein, 25 aa, Mycobacterium
IDDALELRGRILGSFEQAERSSDPA

SEQ ID NO: 312231 - protein, 25 aa, Mycobacterium
IDDALELRGRILSAFEQAERSRDAE

SEQ ID NO: 312232 - protein, 19 aa, Mycobacterium
IDDAMSWLRGPGRGTFDAI

SEQ ID NO: 312233 - protein, 25 aa, Mycobacterium
IDDSNGGSVGRWIVAVAALAVLTIV

SEQ ID NO: 312234 - protein, 23 aa, Mycobacterium
IDEFAELFKLMGQEIQDSLYQIA

SEQ ID NO: 312235 - protein, 23 aa, Mycobacterium
IDEHRFVRPRHWDYVDYDDAYRR

SEQ ID NO: 312236 - protein, 18 aa, Mycobacterium
IDEKPWFFALTDHISVAE

SEQ ID NO: 312237 - protein, 23 aa, Mycobacterium
IDFPFPNIPGLPSFPSLPGLPSI

SEQ ID NO: 312238 - protein, 19 aa, Mycobacterium
IDGAGARRVQPTGSGADEN

SEQ ID NO: 312239 - protein, 19 aa, Mycobacterium
IDGANSWRTFTTVTWPAIA

SEQ ID NO: 312240 - protein, 24 aa, Mycobacterium
IDGDLEWTLFLSAQWVAAAGSIFA

SEQ ID NO: 312241 - protein, 23 aa, Mycobacterium
IDGDPTLLIMVWQNLLGNAVKFR

SEQ ID NO: 312242 - protein, 17 aa, Mycobacterium
IDGELILLWTLPATLII

SEQ ID NO: 312243 - protein, 27 aa, Mycobacterium
IDGESRPGWFVSRRVDILFVFGLGALL

SEQ ID NO: 312244 - protein, 17 aa, Mycobacterium
IDGHKMWIGNGGIANVH

SEQ ID NO: 312245 - protein, 18 aa, Mycobacterium
IDGQFYVEMRLIDGVSLR

SEQ ID NO: 312246 - protein, 18 aa, Mycobacterium
IDGQLYLDMRLIEGTHLA

SEQ ID NO: 312247 - protein, 18 aa, Mycobacterium
IDGQLYLVMPVVDGTDVQ

SEQ ID NO: 312248 - protein, 19 aa, Mycobacterium
IDGRLPSVVPDTSQNQTTH

SEQ ID NO: 312249 - protein, 22 aa, Mycobacterium
IDGRLWQAVITLLFILLGGLLI

SEQ ID NO: 312250 - protein, 22 aa, Mycobacterium
IDGRLYPALNLTSARLATGTAN

SEQ ID NO: 312251 - protein, 17 aa, Mycobacterium
IDGRRWSIGDIRHLGDG

SEQ ID NO: 312252 - protein, 17 aa, Mycobacterium
IDGRYHWQGSILDADMV

SEQ ID NO: 312253 - protein, 25 aa, Mycobacterium
IDGVKEFPGPWALVPVGAAMLMIMA

SEQ ID NO: 312254 - protein, 17 aa, Mycobacterium
IDGVSWRILSEDLSRAW

SEQ ID NO: 312255 - protein, 17 aa, Mycobacterium
IDHTVIGCSLVRGTPYR

SEQ ID NO: 312256 - protein, 21 aa, Mycobacterium
IDIAQNLPFLLSLYAQPASVG

SEQ ID NO: 312257 - protein, 25 aa, Mycobacterium
IDIAQNLPLLLGFYAQPATLPIPPA

SEQ ID NO: 312258 - protein, 21 aa, Mycobacterium
IDIAQSLSFLPSLYGQPAPLG

SEQ ID NO: 312259 - protein, 21 aa, Mycobacterium
IDIGPNLPFLLSLYAPPAEAE

SEQ ID NO: 312260 - protein, 24 aa, Mycobacterium
IDINARPGVLLVLAGDAPADLAVY

SEQ ID NO: 312261 - protein, 25 aa, Mycobacterium
IDINLRMSVVLGFVGAGGIGFALQD

SEQ ID NO: 312262 - protein, 18 aa, Mycobacterium
IDIPTSLFGEINGGRDID

SEQ ID NO: 312263 - protein, 19 aa, Mycobacterium
IDISKAVRVNEQFQVTRQF

SEQ ID NO: 312264 - protein, 25 aa, Mycobacterium
IDLAKVRPLPGLPRSLPLAEALSRL

SEQ ID NO: 312265 - protein, 20 aa, Mycobacterium
IDLAVAVVVGAAFTGLVTAF

SEQ ID NO: 312266 - protein, 30 aa, Mycobacterium
IDLGPQPAWRNLRFPLTWAPPEADVARIVA

SEQ ID NO: 312267 - protein, 19 aa, Mycobacterium
IDLHPAVWLGLHIPVGTVW

SEQ ID NO: 312268 - protein, 18 aa, Mycobacterium
IDLKTHRAVQFFGEGDLA

SEQ ID NO: 312269 - protein, 17 aa, Mycobacterium
IDLNDPPPCNVGFIPPP

SEQ ID NO: 312270 - protein, 18 aa, Mycobacterium
IDLPVPRRSVLLSHEGLW

SEQ ID NO: 312271 - protein, 24 aa, Mycobacterium
IDLPWEVYAVIGLVAIAALSHFDI

SEQ ID NO: 312272 - protein, 20 aa, Mycobacterium
IDLSRTVGWFTAKYPVSLSG

SEQ ID NO: 312273 - protein, 20 aa, Mycobacterium
IDLSRTVGWFTTKYPVALAV

SEQ ID NO: 312274 - protein, 24 aa, Mycobacterium
IDLVPDFIPFLGYADDAIVVAVAL

SEQ ID NO: 312275 - protein, 17 aa, Mycobacterium
IDMALCLLLVTAAPMIV

SEQ ID NO: 312276 - protein, 17 aa, Mycobacterium
IDMAMAREVAFRYPDAA

SEQ ID NO: 312277 - protein, 20 aa, Mycobacterium
IDMMLRQSYLLARTETPALW

SEQ ID NO: 312278 - protein, 21 aa, Mycobacterium
IDNRTVLVIAHRLHTIADADQ

SEQ ID NO: 312279 - protein, 24 aa, Mycobacterium
IDNWVRRLFALPAFPDGSADDVLQ

SEQ ID NO: 312280 - protein, 22 aa, Mycobacterium
IDPALWAVVCWLLVRWTRSLRE

SEQ ID NO: 312281 - protein, 18 aa, Mycobacterium
IDPALWLLIVVTVLALLL

SEQ ID NO: 312282 - protein, 17 aa, Mycobacterium
IDPAWLLSWPFWPRLLV

SEQ ID NO: 312283 - protein, 18 aa, Mycobacterium
IDPECAFQDLGFDSVKAT

SEQ ID NO: 312284 - protein, 31 aa, Mycobacterium; identical to SEQ ID NO: 13595

SEQ ID NO: 312285 - protein, 31 aa, Mycobacterium
IDPEDFWRSAGLPEFRWPDPNGTRFPNGAPP

SEQ ID NO: 312286 - protein, 28 aa, Mycobacterium
IDPEQFWRSAGLPAYQFPDPNGTRFPNG

SEQ ID NO: 312287 - protein, 26 aa, Mycobacterium
IDPKGARDRWNWVLDGMVETKALSPS

SEQ ID NO: 312288 - protein, 21 aa, Mycobacterium
IDPLLRLAVIAVISGAIALLT

SEQ ID NO: 312289 - protein, 19 aa, Mycobacterium
IDPLPARIVVGLLVAIGVA

SEQ ID NO: 312290 - protein, 17 aa, Mycobacterium
IDPRTGGIKAYYGGSDA

SEQ ID NO: 312291 - protein, 23 aa, Mycobacterium
IDPRVLCTNKLRVARIRGADEDQ

SEQ ID NO: 312292 - protein, 22 aa, Mycobacterium
IDPTAAINMAWRAAGGATGPLG

SEQ ID NO: 312293 - protein, 19 aa, Mycobacterium
IDPVAALTWEIPDGPEKAP

SEQ ID NO: 312294 - protein, 23 aa, Mycobacterium
IDPVAALTWQLPAPQSAVPAKPV

SEQ ID NO: 312295 - protein, 25 aa, Mycobacterium
IDPVMPSARIDFMLDDAAPTAVVTT

SEQ ID NO: 312296 - protein, 28 aa, Mycobacterium
IDQPADWPRYGGYALAGVSSFGFGGANA

SEQ ID NO: 312297 - protein, 19 aa, Mycobacterium
IDQPHAVAMGGAPAPTAST

SEQ ID NO: 312298 - protein, 25 aa, Mycobacterium
IDQRRRGWRSWALYAAMPAVGVVLT

SEQ ID NO: 312299 - protein, 35 aa, Mycobacterium
IDQYPRARFEVISFAAKASLDWPLSDDVWSLKPFV

SEQ ID NO: 312300 - protein, 18 aa, Mycobacterium
IDRANGAVRARFLTDRLI

SEQ ID NO: 312301 - protein, 22 aa, Mycobacterium
IDRAREAGRMAAREALPQIMKL

SEQ ID NO: 312302 - protein, 22 aa, Mycobacterium
IDRAREAGRMAARQALPQIMKL

SEQ ID NO: 312303 - protein, 17 aa, Mycobacterium
IDRCAATTPVVRLWEAL

SEQ ID NO: 312304 - protein, 19 aa, Mycobacterium
IDRGIPFQISAVAVRAVQE

SEQ ID NO: 312305 - protein, 26 aa, Mycobacterium
IDRLLRRVCPGDIVVLDILDLDRITA

SEQ ID NO: 312306 - protein, 24 aa, Mycobacterium
IDRLPKLCRTYLLSPSRQASEHKW

SEQ ID NO: 312307 - protein, 22 aa, Mycobacterium
IDRLYRDRHIQLWVVYTDNFSR

SEQ ID NO: 312308 - protein, 17 aa, Mycobacterium
IDRPWPLAWAGLVDIVA

SEQ ID NO: 312309 - protein, 22 aa, Mycobacterium
IDSELLGGLLISVADEVIDGTL

SEQ ID NO: 312310 - protein, 25 aa, Mycobacterium
IDSGAKTPTWWIAGGIVAAVIIGVS

SEQ ID NO: 312311 - protein, 20 aa, Mycobacterium
IDSGNHWPGWEDSAVPWRRV

SEQ ID NO: 312312 - protein, 19 aa, Mycobacterium
IDSHWLTGLFALNFFALIS

SEQ ID NO: 312313 - protein, 27 aa, Mycobacterium
IDSRFNYRIPVSLAWTRTSGPAKSDGT

SEQ ID NO: 312314 - protein, 17 aa, Mycobacterium
IDSTRGTVHLVIGGGGT

SEQ ID NO: 312315 - protein, 21 aa, Mycobacterium
IDSWMCAISGRAKQFGMIEYF

SEQ ID NO: 312316 - protein, 17 aa, Mycobacterium
IDTAADDAMDWTRTGPA

SEQ ID NO: 312317 - protein, 17 aa, Mycobacterium
IDTGFVLTADEVAAQMA

SEQ ID NO: 312318 - protein, 26 aa, Mycobacterium
IDTGVARHRWLPRLVGGGDYVSNGDG

SEQ ID NO: 312319 - protein, 21 aa, Mycobacterium
IDTPDGLYCKLPQDSAIAVRG

SEQ ID NO: 312320 - protein, 21 aa, Mycobacterium
IDTPDGLYCKLPQDSPISVRG

SEQ ID NO: 312321 - protein, 21 aa, Mycobacterium
IDTVLRAKVDAAWNLHEATLD

SEQ ID NO: 312322 - protein, 20 aa, Mycobacterium
IDTWGYAGAYWIAAASALVS

SEQ ID NO: 312323 - protein, 18 aa, Mycobacterium
IDTYIDWLIEAGYPIERI

SEQ ID NO: 312324 - protein, 18 aa, Mycobacterium
IDVAFAIDRAYTMYSSTR

SEQ ID NO: 312325 - protein, 18 aa, Mycobacterium
IDVGGLLREVGLEGLAER

SEQ ID NO: 312326 - protein, 25 aa, Mycobacterium
IDVGQLMRDRFPAVLPVGEVLEIVA

SEQ ID NO: 312327 - protein, 23 aa, Mycobacterium
IDVGSFRIVWAFLGSLAIATIPF

SEQ ID NO: 312328 - protein, 18 aa, Mycobacterium
IDVHRAWRDVLAANRGTL

SEQ ID NO: 312329 - protein, 21 aa, Mycobacterium
IDVIRITALLGVIVGHTVMAI

SEQ ID NO: 312330 - protein, 23 aa, Mycobacterium
IDVPAVPAAIVFLALVGALNARG

SEQ ID NO: 312331 - protein, 18 aa, Mycobacterium
IDVVNIWIVLAAAVAQGF

SEQ ID NO: 312332 - protein, 18 aa, Mycobacterium
IDYWTVSVGAAWQSRTGN

SEQ ID NO: 312333 - protein, 21 aa, Mycobacterium
IEAAFLLLWFLAALPVGALLG

SEQ ID NO: 312334 - protein, 17 aa, Mycobacterium
IEAALALGATRWEVVRT

SEQ ID NO: 312335 - protein, 22 aa, Mycobacterium
IEADGGSAFVWIGLHEPDDQQM

SEQ ID NO: 312336 - protein, 23 aa, Mycobacterium
IEAESRFTLIYGNRTKESTMFRA

SEQ ID NO: 312337 - protein, 22 aa, Mycobacterium
IEALARLNVVCFDKTGTLSENR

SEQ ID NO: 312338 - protein, 18 aa, Mycobacterium
IEALGRVDTICFDKTGTL

SEQ ID NO: 312339 - protein, 19 aa, Mycobacterium
IEALGRVDTVCFDKTGTLT

SEQ ID NO: 312340 - protein, 29 aa, Mycobacterium
IEALQKLVFRILIGVLWLAPIGAFGAIAE

SEQ ID NO: 312341 - protein, 18 aa, Mycobacterium
IEALTFAVIITMLLLVYR

SEQ ID NO: 312342 - protein, 20 aa, Mycobacterium
IEALTGFLAAFINVRIAAPI

SEQ ID NO: 312343 - protein, 20 aa, Mycobacterium
IEALTGFLAAFINVRISAPV

SEQ ID NO: 312344 - protein, 19 aa, Mycobacterium
IEAMARAVGYGTPITIAVP

SEQ ID NO: 312345 - protein, 26 aa, Mycobacterium
IEASEPAAYCVAGRPPAIVVTTAAMA

SEQ ID NO: 312346 - protein, 18 aa, Mycobacterium
IEATGSHAVVLLFVNQTV

SEQ ID NO: 312347 - protein, 25 aa, Mycobacterium
IEAVLKLARARRATWVEVTQEALDD

SEQ ID NO: 312348 - protein, 17 aa, Mycobacterium
IEDAWDLLTDLDQVVPL

SEQ ID NO: 312349 - protein, 18 aa, Mycobacterium
IEDLAGWARIERPDLARV

SEQ ID NO: 312350 - protein, 17 aa, Mycobacterium
IEDLPLYRRDDDAVAAA

SEQ ID NO: 312351 - protein, 19 aa, Mycobacterium
IEELIKYAVEHRDEVEQLH

SEQ ID NO: 312352 - protein, 19 aa, Mycobacterium
IEESVAWLAARGIGRGDRI

SEQ ID NO: 312353 - protein, 20 aa, Mycobacterium
IEGIPAVLLAAVVLKVLPNG

SEQ ID NO: 312354 - protein, 18 aa, Mycobacterium
IEGKSGADRWLIAEDSDN

SEQ ID NO: 312355 - protein, 25 aa, Mycobacterium
IEGLPERRWAALIKIHHCIADGIAA

SEQ ID NO: 312356 - protein, 24 aa, Mycobacterium
IEGRVALQVPAEWTVERVTGDAGS

SEQ ID NO: 312357 - protein, 18 aa, Mycobacterium
IEGSPLFHIISGNLGYQV

SEQ ID NO: 312358 - protein, 24 aa, Mycobacterium
IEGSRTKLFASLLLILVLVVIGEV

SEQ ID NO: 312359 - protein, 18 aa, Mycobacterium
IEGVLALQFPISVVNQLM

SEQ ID NO: 312360 - protein, 17 aa, Mycobacterium
IEGVLGSGGMGTVYLAR

SEQ ID NO: 312361 - protein, 20 aa, Mycobacterium
IEGYNFLDLLGLGPATGFVS

SEQ ID NO: 312362 - protein, 20 aa, Mycobacterium
IEGYNFLDLLGLGPATGIIS

SEQ ID NO: 312363 - protein, 20 aa, Mycobacterium
IEGYNFLNLLGLGPATGFVS

SEQ ID NO: 312364 - protein, 21 aa, Mycobacterium
IEHISRQALLEVAERENKVDD

SEQ ID NO: 312365 - protein, 24 aa, Mycobacterium
IEHPGKRAPTVEICDSDKPYEPLA

SEQ ID NO: 312366 - protein, 24 aa, Mycobacterium
IEHPGKRAPTVEICDSDQPFEPLA

SEQ ID NO: 312367 - protein, 29 aa, Mycobacterium
IEHRHPLVAWAWNLLRLDFCGIAFGALFF

SEQ ID NO: 312368 - protein, 18 aa, Mycobacterium
IEHTNLPLVTVFVKENDT

SEQ ID NO: 312369 - protein, 18 aa, Mycobacterium
IEIAAYYVVAEALANTAK

SEQ ID NO: 312370 - protein, 17 aa, Mycobacterium
IEIALPFERPLYQVPAA

SEQ ID NO: 312371 - protein, 28 aa, Mycobacterium
IEIEKKRRWPWIAGAATAVAAIVGGVVY

SEQ ID NO: 312372 - protein, 17 aa, Mycobacterium
IEIEPRGSETLKPRGVL

SEQ ID NO: 312373 - protein, 20 aa, Mycobacterium
IEIIGVPFFTLFVISVIILS

SEQ ID NO: 312374 - protein, 24 aa, Mycobacterium
IEKRSDIKSVRFVNREDAYADAGR

SEQ ID NO: 312375 - protein, 24 aa, Mycobacterium
IEKRSDVKAVRFLNRQQAYDDAIR

SEQ ID NO: 312376 - protein, 17 aa, Mycobacterium
IELAIGMAIGMAAQTAR

SEQ ID NO: 312377 - protein, 17 aa, Mycobacterium
IELALALVAVWATAASW

SEQ ID NO: 312378 - protein, 25 aa, Mycobacterium
IELDGPRVLVKFTVDKHIRLGDHTE

SEQ ID NO: 312379 - protein, 21 aa, Mycobacterium
IELKARPFVLAAVGSGSSHTR

SEQ ID NO: 312380 - protein, 17 aa, Mycobacterium
IELLLWAGIFWSRAGIT

SEQ ID NO: 312381 - protein, 21 aa, Mycobacterium
IELTGDWPGLRCDVDTPEDLA

SEQ ID NO: 312382 - protein, 17 aa, Mycobacterium
IELVTFGVIMVMLLLVY

SEQ ID NO: 312383 - protein, 20 aa, Mycobacterium
IEMAIGFVLAMFVVYSGHVR

SEQ ID NO: 312384 - protein, 20 aa, Mycobacterium
IEMIVARAGVPVVLDAGIGT

SEQ ID NO: 312385 - protein, 26 aa, Mycobacterium
IEMLLKNSQHFLGMYRALKGLITDPV

SEQ ID NO: 312386 - protein, 21 aa, Mycobacterium
IEMLVPLVLFFSHGGWPTAIA

SEQ ID NO: 312387 - protein, 21 aa, Mycobacterium
IEMVVGFVLALLIVYGGYLKF

SEQ ID NO: 312388 - protein, 21 aa, Mycobacterium
IENDPSFSMLSWLPQFHDMGL

SEQ ID NO: 312389 - protein, 18 aa, Mycobacterium
IENWSLWLDFKILAMTVG

SEQ ID NO: 312390 - protein, 22 aa, Mycobacterium
IEPALRFYVGFFLALLVVTWFC

SEQ ID NO: 312391 - protein, 18 aa, Mycobacterium
IEPIKLAAIEAVKGTPLE

SEQ ID NO: 312392 - protein, 24 aa, Mycobacterium
IEPRGSETLKPRGVLPVGQTSAPY

SEQ ID NO: 312393 - protein, 18 aa, Mycobacterium
IEQLLGLLLSQGRAVGIS

SEQ ID NO: 312394 - protein, 19 aa, Mycobacterium
IEQPIRRWRPARVPLLPLA

SEQ ID NO: 312395 - protein, 17 aa, Mycobacterium
IERAMARDPAWRFGQAA

SEQ ID NO: 312396 - protein, 29 aa, Mycobacterium
IERAVGLFDTWPGLILPYITFALPLAIYT

SEQ ID NO: 312397 - protein, 17 aa, Mycobacterium
IERAVVDEVMYELMRLS

SEQ ID NO: 312398 - protein, 23 aa, Mycobacterium
IERDSPTWSPRWVDHLVGDRIHR

SEQ ID NO: 312399 - protein, 31 aa, Mycobacterium
IERDTWWSMIGWLPQRPVLIPGTVRENLEIF

SEQ ID NO: 312400 - protein, 17 aa, Mycobacterium
IERFGGPQIPWWILTAL

SEQ ID NO: 312401 - protein, 20 aa, Mycobacterium
IERFKALGIRIALDDFGAGY

SEQ ID NO: 312402 - protein, 24 aa, Mycobacterium
IERFRAEARTVAMLNHPGIASVYD

SEQ ID NO: 312403 - protein, 20 aa, Mycobacterium
IERFTTLLAPFGLAEHAVTP

SEQ ID NO: 312404 - protein, 28 aa, Mycobacterium
IERGEPWPKPVPEPAFKTAIAQASRAAA

SEQ ID NO: 312405 - protein, 26 aa, Mycobacterium
IERGEPWPPPTPEPAFKAAIARASEA

SEQ ID NO: 312406 - protein, 25 aa, Mycobacterium
IERIPPKFIEYRGSRFAELDVEAVL

SEQ ID NO: 312407 - protein, 18 aa, Mycobacterium
IERLLGRFELVLTAMTAD

SEQ ID NO: 312408 - protein, 17 aa, Mycobacterium
IERSMGFRLSREDEVSG

SEQ ID NO: 312409 - protein, 24 aa, Mycobacterium
IERSRPGGPVILTGIFGSKTVKAL

SEQ ID NO: 312410 - protein, 24 aa, Mycobacterium
IESAQRWVLPVAMIVLLVAVAPRM

SEQ ID NO: 312411 - protein, 24 aa, Mycobacterium
IESGQRSQVFWSFIIGAAVMAVAG

SEQ ID NO: 312412 - protein, 19 aa, Mycobacterium
IESNGAWEPDQFKTKVINT

SEQ ID NO: 312413 - protein, 23 aa, Mycobacterium
IESRGSTGTMHFRKESGEWKVCM

SEQ ID NO: 312414 - protein, 18 aa, Mycobacterium
IESTRRWLINGPAHLRSE

SEQ ID NO: 312415 - protein, 21 aa, Mycobacterium
IESYAPLMAYLVRSMQSGSEL

SEQ ID NO: 312416 - protein, 18 aa, Mycobacterium
IESYNFLDLLGLGPATGI

SEQ ID NO: 312417 - protein, 26 aa, Mycobacterium
IETEAGVLLNADWTWARSALDQTQVG

SEQ ID NO: 312418 - protein, 23 aa, Mycobacterium
IETESRFTLIYGNRTRESTMFRA

SEQ ID NO: 312419 - protein, 30 aa, Mycobacterium
IETFATVFLPFVFGYEVGNLVIQWISQWIM

SEQ ID NO: 312420 - protein, 19 aa, Mycobacterium
IETFLSWVMATRRSESADR

SEQ ID NO: 312421 - protein, 27 aa, Mycobacterium
IETLSGLLRRWLVDHLAVAPGVEQQPD

SEQ ID NO: 312422 - protein, 17 aa, Mycobacterium
IETTALLAHIAVMLAFL

SEQ ID NO: 312423 - protein, 35 aa, Mycobacterium
IETVGWRSVFWINLPICAAAIILTAVFVPESKSQT

SEQ ID NO: 312424 - protein, 23 aa, Mycobacterium
IETVNAWRWMAFIAAGVAITSRV

SEQ ID NO: 312425 - protein, 21 aa, Mycobacterium
IEVATMRSVMFVRDTWVLALL

SEQ ID NO: 312426 - protein, 21 aa, Mycobacterium
IEVLIMLRFVQGFAGAAGIVI

SEQ ID NO: 312427 - protein, 17 aa, Mycobacterium
IEVLKLYPRGVITAMGL

SEQ ID NO: 312428 - protein, 18 aa, Mycobacterium
IEVPVALSADIERAEQVA

SEQ ID NO: 312429 - protein, 20 aa, Mycobacterium
IEVVRDGRPLTLMVTPIGDD

SEQ ID NO: 312430 - protein, 21 aa, Mycobacterium
IEYFLLCPTLIVFGVAVAGVL

SEQ ID NO: 312431 - protein, 25 aa, Mycobacterium
IEYLCLMPIFPLALWLMNVYAAIRY

SEQ ID NO: 312432 - protein, 18 aa, Mycobacterium
IFACGLVIMITGVRLTWA

SEQ ID NO: 312433 - protein, 24 aa, Mycobacterium
IFACIAAIILRRSPRISLRRRTPR

SEQ ID NO: 312434 - protein, 23 aa, Mycobacterium
IFAFPIQRLLVIGGLDSTNPFAL

SEQ ID NO: 312435 - protein, 24 aa, Mycobacterium
IFAGLKDPDGWVAKIGGWGAYDGA

SEQ ID NO: 312436 - protein, 17 aa, Mycobacterium
IFAHLSFVLPVVTWFLI

SEQ ID NO: 312437 - protein, 20 aa, Mycobacterium
IFAQFTIPFAIDRSEQPIKA

SEQ ID NO: 312438 - protein, 18 aa, Mycobacterium
IFARASPEHKLRLVRALQ

SEQ ID NO: 312439 - protein, 18 aa, Mycobacterium
IFAVGIPFSNNWYDVSRR

SEQ ID NO: 312440 - protein, 18 aa, Mycobacterium
IFAVKSGAFFAAIVGVLG

SEQ ID NO: 312441 - protein, 22 aa, Mycobacterium
IFAVQFYPLLRVTRLVGIAIIA

SEQ ID NO: 312442 - protein, 17 aa, Mycobacterium
IFAYICVAYLVSYATTV

SEQ ID NO: 312443 - protein, 20 aa, Mycobacterium
IFCGLSLWWWPLHAGTGNLD

SEQ ID NO: 312444 - protein, 22 aa, Mycobacterium
IFCLGLIGIYISKIFTETKQRP

SEQ ID NO: 312445 - protein, 26 aa, Mycobacterium
IFDEVSGRIAALVPEDRWQGLAAQAY

SEQ ID NO: 312446 - protein, 18 aa, Mycobacterium
IFDHLGPQLRWWEWTLDN

SEQ ID NO: 312447 - protein, 18 aa, Mycobacterium
IFDQLGPQLRWWAWNTDN

SEQ ID NO: 312448 - protein, 18 aa, Mycobacterium
IFDRVALWAYLGWLRYKV

SEQ ID NO: 312449 - protein, 19 aa, Mycobacterium
IFDRVPRKAVLNGAQLLAV

SEQ ID NO: 312450 - protein, 18 aa, Mycobacterium
IFDTIGVRSHIDHIGGLP

SEQ ID NO: 312451 - protein, 26 aa, Mycobacterium
IFEGYRWQLIPAYVLAAAIGAWEVVS

SEQ ID NO: 312452 - protein, 17 aa, Mycobacterium
IFEPAFAPMPFAGVTAA

SEQ ID NO: 312453 - protein, 18 aa, Mycobacterium
IFEPQRRGVALAIWTATG

SEQ ID NO: 312454 - protein, 21 aa, Mycobacterium
IFFEPRYAGAVVVGAIGIAIV

SEQ ID NO: 312455 - protein, 20 aa, Mycobacterium
IFFVLSGFLLFLPWVKAAAA

SEQ ID NO: 312456 - protein, 19 aa, Mycobacterium
IFFVLSGFLLFLPWVRAAA

SEQ ID NO: 312457 - protein, 19 aa, Mycobacterium
IFFVLSGFLLFRPWLKSAA

SEQ ID NO: 312458 - protein, 18 aa, Mycobacterium
IFFVLSGFLLFRPWVKAA

SEQ ID NO: 312459 - protein, 18 aa, Mycobacterium
IFFVLSGYLLFRPWVKSG

SEQ ID NO: 312460 - protein, 18 aa, Mycobacterium
IFFVLSGYLLFRPWVRSA

SEQ ID NO: 312461 - protein, 17 aa, Mycobacterium
IFGDRNFALCSFGVAVI

SEQ ID NO: 312462 - protein, 17 aa, Mycobacterium
IFGEYRSGSANTYSAVF

SEQ ID NO: 312463 - protein, 23 aa, Mycobacterium
IFGFGVIFGAIWAEEAWGRFWAW

SEQ ID NO: 312464 - protein, 21 aa, Mycobacterium
IFGFLAQFAIIAAVDRSLSPI

SEQ ID NO: 312465 - protein, 19 aa, Mycobacterium
IFGGLRNFSPYMLMMPMMV

SEQ ID NO: 312466 - protein, 27 aa, Mycobacterium
IFGIALGLRFSYGWIAALAFVLVPVAI

SEQ ID NO: 312467 - protein, 20 aa, Mycobacterium
IFGLELNWIAPVFGLIILLA

SEQ ID NO: 312468 - protein, 18 aa, Mycobacterium
IFGPRLLRRLTRTGYAPR

SEQ ID NO: 312469 - protein, 23 aa, Mycobacterium
IFGRGVVRTAVLIPYGIVTVAAS

SEQ ID NO: 312470 - protein, 23 aa, Mycobacterium
IFGSEFLGAVGLLRAELLILPAS

SEQ ID NO: 312471 - protein, 20 aa, Mycobacterium
IFGWHGMGEWMVRGISTQDT

SEQ ID NO: 312472 - protein, 21 aa, Mycobacterium
IFGWHGVGEWFVLGIAAQDTN

SEQ ID NO: 312473 - protein, 18 aa, Mycobacterium
IFGWLTFLLVFGLFVRKV

SEQ ID NO: 312474 - protein, 26 aa, Mycobacterium
IFGYEMPRALVFLTYIYVIVTTLIAF

SEQ ID NO: 312475 - protein, 18 aa, Mycobacterium
IFHAARGPIAWIGEHLLG

SEQ ID NO: 312476 - protein, 17 aa, Mycobacterium
IFHTLMIFWPFMQAAIQ

SEQ ID NO: 312477 - protein, 19 aa, Mycobacterium
IFIKGYRALETIHGIDTVV

SEQ ID NO: 312478 - protein, 17 aa, Mycobacterium
IFIVCFHAARVLALSWT

SEQ ID NO: 312479 - protein, 21 aa, Mycobacterium
IFKFCSYEALNIQPLVANSPF

SEQ ID NO: 312480 - protein, 19 aa, Mycobacterium
IFLFWPWEYKPYGSGGEFL

SEQ ID NO: 312481 - protein, 25 aa, Mycobacterium
IFLLCYIAAAALTWVRYARPRGVLL

SEQ ID NO: 312482 - protein, 23 aa, Mycobacterium
IFLLPMTLGFLVAGPVAGLLSDR

SEQ ID NO: 312483 - protein, 20 aa, Mycobacterium
IFLSLTIDWLLAHLAGSSRD

SEQ ID NO: 312484 - protein, 47 aa, Mycobacterium
IFMIAMSLWLLRFAMSNTWLVWLATWFRPVFETIRVILADLWVFPIC

SEQ ID NO: 312485 - protein, 20 aa, Mycobacterium
IFMMVGIMMMMFRSVGAGGQ

SEQ ID NO: 312486 - protein, 20 aa, Mycobacterium
IFNVVWTYVLVRGSAVNNGT

SEQ ID NO: 312487 - protein, 17 aa, Mycobacterium
IFPPERRGIAVSLWGAT

SEQ ID NO: 312488 - protein, 22 aa, Mycobacterium
IFPPQRRGMALGISSAIGGLAL

SEQ ID NO: 312489 - protein, 23 aa, Mycobacterium
IFPSLMPALLSGAGLAFSRAIGE

SEQ ID NO: 312490 - protein, 24 aa, Mycobacterium
IFQNSDFQLGLSLMVSPDGKAARF

SEQ ID NO: 312491 - protein, 18 aa, Mycobacterium
IFQPYSWVAVIVVLVLLA

SEQ ID NO: 312492 - protein, 32 aa, Mycobacterium
IFQRYRLALPEGWKPKHHFNFSVTLEGGLPVT

SEQ ID NO: 312493 - protein, 20 aa, Mycobacterium
IFRTPVPVWNPLYWDATQFM

SEQ ID NO: 312494 - protein, 18 aa, Mycobacterium
IFSFWGWDTCLTLGEECT

SEQ ID NO: 312495 - protein, 28 aa, Mycobacterium
IFSLCKALGYLLWWAVLFPAVSIPIIAS

SEQ ID NO: 312496 - protein, 17 aa, Mycobacterium
IFSLVLMLFSVMIIIVF

SEQ ID NO: 312497 - protein, 18 aa, Mycobacterium
IFSRTVTGLGVWPLAVIA

SEQ ID NO: 312498 - protein, 22 aa, Mycobacterium
IFSSSRLNPWGPKHIQRGALAA

SEQ ID NO: 312499 - protein, 22 aa, Mycobacterium
IFSTSRLKPWGTTHIQRGALAA

SEQ ID NO: 312500 - protein, 22 aa, Mycobacterium
IFSTSRLRPWDARHLQRGALAA

SEQ ID NO: 312501 - protein, 17 aa, Mycobacterium
IFTFSLSLGDYIAVTIV

SEQ ID NO: 312502 - protein, 20 aa, Mycobacterium
IFTQKAWRNLRFPLSTAPPE

SEQ ID NO: 312503 - protein, 18 aa, Mycobacterium
IFTWASWVITLAMIAIAI

SEQ ID NO: 312504 - protein, 18 aa, Mycobacterium
IFVIILFSFNKPAGKFNY

SEQ ID NO: 312505 - protein, 18 aa, Mycobacterium
IFVILRFLSGIGLGAELC

SEQ ID NO: 312506 - protein, 18 aa, Mycobacterium
IFVLGFLAQFVFGVRLGI

SEQ ID NO: 312507 - protein, 33 aa, Mycobacterium
IFVPRGGVYGTWGWRGLAAYAIGIIAMIPFVVT

SEQ ID NO: 312508 - protein, 19 aa, Mycobacterium
IFVQMIVLYGGIFVVAFSL

SEQ ID NO: 312509 - protein, 19 aa, Mycobacterium
IFVVIGIIALFSWTYFARL

SEQ ID NO: 312510 - protein, 24 aa, Mycobacterium
IFWFNFAALYPHLSFGIPGVDIDA

SEQ ID NO: 312511 - protein, 18 aa, Mycobacterium
IFWHSWPLTGRTITYRPF

SEQ ID NO: 312512 - protein, 24 aa, Mycobacterium
IFYGLRWPDLWPRTFGYHEFFHAF

SEQ ID NO: 312513 - protein, 17 aa, Mycobacterium
IGAAAPVILILCRLVQG

SEQ ID NO: 312514 - protein, 19 aa, Mycobacterium
IGAACGIAAILAIASGLVV

SEQ ID NO: 312515 - protein, 30 aa, Mycobacterium
IGAAELAFLVAMVMARPQFDALLAGLSSMP

SEQ ID NO: 312516 - protein, 25 aa, Mycobacterium
IGAALGLLTSWLLSRRIKTHTRGLD

SEQ ID NO: 312517 - protein, 18 aa, Mycobacterium
IGAALGWSLLRNRRRARA

SEQ ID NO: 312518 - protein, 18 aa, Mycobacterium
IGAAMSMAACSGAQCPDL

SEQ ID NO: 312519 - protein, 19 aa, Mycobacterium
IGAANLVAARAGRAPVVRS

SEQ ID NO: 312520 - protein, 20 aa, Mycobacterium
IGACAAVWLALVGVGVAAVV

SEQ ID NO: 312521 - protein, 19 aa, Mycobacterium
IGACAAVWLVLLGVSVAAA

SEQ ID NO: 312522 - protein, 23 aa, Mycobacterium
IGADFTGAPLLWLLAIDAGLITL

SEQ ID NO: 312523 - protein, 17 aa, Mycobacterium
IGAELGPGVGGRAGDAG

SEQ ID NO: 312524 - protein, 33 aa, Mycobacterium
IGAELVFAVFLYRVWNLPVAILSGAVAGLALAI

SEQ ID NO: 312525 - protein, 17 aa, Mycobacterium
IGAELYVRHVADTKVAE

SEQ ID NO: 312526 - protein, 17 aa, Mycobacterium
IGAFGGFAIDMMLRQSY

SEQ ID NO: 312527 - protein, 25 aa, Mycobacterium
IGAFGIIAAIAFAWLISAGPPGPPG

SEQ ID NO: 312528 - protein, 22 aa, Mycobacterium
IGAFLCSVFLMHVSAGAWVTGL

SEQ ID NO: 312529 - protein, 18 aa, Mycobacterium
IGAGFGQDFTGGKMFFTP

SEQ ID NO: 312530 - protein, 18 aa, Mycobacterium
IGAGRWSDHYVRRSGDLL

SEQ ID NO: 312531 - protein, 17 aa, Mycobacterium
IGAGWATILAIGDNTWF

SEQ ID NO: 312532 - protein, 19 aa, Mycobacterium
IGAIAGWIAGKIVKGSGSG

SEQ ID NO: 312533 - protein, 25 aa, Mycobacterium
IGAIVLMQRFFRGFWSTIAVLLGLV

SEQ ID NO: 312534 - protein, 28 aa, Mycobacterium
IGAKELPGGAFVFARAAGMTMLSGKLSL

SEQ ID NO: 312535 - protein, 19 aa, Mycobacterium
IGALAGWIAGKIVKGGGSG

SEQ ID NO: 312536 - protein, 18 aa, Mycobacterium
IGALFVLGFLRFGLPPED

SEQ ID NO: 312537 - protein, 19 aa, Mycobacterium
IGALIGGVGNRMMGKKIVA

SEQ ID NO: 312538 - protein, 17 aa, Mycobacterium
IGALIGGWLATRIGDRL

SEQ ID NO: 312539 - protein, 17 aa, Mycobacterium
IGALLLILAMFEGYFGY

SEQ ID NO: 312540 - protein, 18 aa, Mycobacterium
IGALLPLIAILAPPTTWR

SEQ ID NO: 312541 - protein, 19 aa, Mycobacterium
IGALLPLIAILVPPTTARV

SEQ ID NO: 312542 - protein, 20 aa, Mycobacterium
IGALLPWTRPMFMNDNYATL

SEQ ID NO: 312543 - protein, 23 aa, Mycobacterium
IGAMILRGFTFGIDFEGGTKVSF

SEQ ID NO: 312544 - protein, 19 aa, Mycobacterium
IGAMLLVRVADIGYTQYTA

SEQ ID NO: 312545 - protein, 23 aa, Mycobacterium
IGAPAWMRIFAVATVVTLVVAVD

SEQ ID NO: 312546 - protein, 17 aa, Mycobacterium
IGAPGWVLLGPKAMDEF

SEQ ID NO: 312547 - protein, 22 aa, Mycobacterium
IGARGLRVLLLASAELSVDDAH

SEQ ID NO: 312548 - protein, 17 aa, Mycobacterium
IGASIGSFFPGPGTVIG

SEQ ID NO: 312549 - protein, 25 aa, Mycobacterium
IGASILLAVAFCMLVAGNLVAGGLL

SEQ ID NO: 312550 - protein, 25 aa, Mycobacterium
IGATGSWRWAFIIAGAVTVLLGIWA

SEQ ID NO: 312551 - protein, 19 aa, Mycobacterium
IGATVFLATWVPLFASFGA

SEQ ID NO: 312552 - protein, 32 aa, Mycobacterium
IGATVLFLACRWWQSVGAPGWVGYVGAAAEAG

SEQ ID NO: 312553 - protein, 20 aa, Mycobacterium
IGAVCLLAALVAARYLTPWG

SEQ ID NO: 312554 - protein, 17 aa, Mycobacterium
IGAVIGFFVIPFAGSLS

SEQ ID NO: 312555 - protein, 17 aa, Mycobacterium
IGAVVFVGAFTVMRVRT

SEQ ID NO: 312556 - protein, 26 aa, Mycobacterium
IGCGLAAMCYAEFASTIPVAGSAYTF

SEQ ID NO: 312557 - protein, 22 aa, Mycobacterium
IGCWLIIGHWMLRRLGPGRDGL

SEQ ID NO: 312558 - protein, 18 aa, Mycobacterium
IGCWLLISHFALRRLGPG

SEQ ID NO: 312559 - protein, 25 aa, Mycobacterium
IGDARAPYKPEIKRFHAALAGLAEI

SEQ ID NO: 312560 - protein, 20 aa, Mycobacterium
IGDHTLFYARALAGVPFATA

SEQ ID NO: 312561 - protein, 21 aa, Mycobacterium
IGDIVAIDFMARVFSAKSPEA

SEQ ID NO: 312562 - protein, 25 aa, Mycobacterium
IGDLRARELLVVAPLIALLLVLGVY

SEQ ID NO: 312563 - protein, 21 aa, Mycobacterium
IGDLVPREMIVVAPLIAMLLI

SEQ ID NO: 312564 - protein, 23 aa, Mycobacterium
IGDPLLVVTINFLGLRHLTEALI

SEQ ID NO: 312565 - protein, 23 aa, Mycobacterium
IGDPRIDVGWFLINCDPDTYRRV

SEQ ID NO: 312566 - protein, 17 aa, Mycobacterium
IGDPRRGPRLTFQLAAP

SEQ ID NO: 312567 - protein, 28 aa, Mycobacterium
IGDRRFAARGGERGVIYDIALWMVPFGL

SEQ ID NO: 312568 - protein, 25 aa, Mycobacterium
IGDRRWEARGGERGVIYDIALWTVP

SEQ ID NO: 312569 - protein, 24 aa, Mycobacterium
IGDRYGRRGALLFGLTVFSVASVA

SEQ ID NO: 312570 - protein, 19 aa, Mycobacterium
IGDRYGRRPALLATIIMIG

SEQ ID NO: 312571 - protein, 20 aa, Mycobacterium
IGDSRAYLMRDGELTQISKD

SEQ ID NO: 312572 - protein, 21 aa, Mycobacterium
IGEALFGYTGFGWRFSGAVLG

SEQ ID NO: 312573 - protein, 17 aa, Mycobacterium
IGEDASWVFDVAPAALV

SEQ ID NO: 312574 - protein, 21 aa, Mycobacterium
IGEGLVILVAIAFGAALPILP

SEQ ID NO: 312575 - protein, 36 aa, Mycobacterium
IGEPKADRTRRYWNWIAVAVVRRPVPLLVASLALVL

SEQ ID NO: 312576 - protein, 22 aa, Mycobacterium
IGETAPPRWEQIAEHLRIPFDQ

SEQ ID NO: 312577 - protein, 20 aa, Mycobacterium
IGFAAIVFLVVRYVVPPVRR

SEQ ID NO: 312578 - protein, 19 aa, Mycobacterium
IGFALGWRPALAALALGGA

SEQ ID NO: 312579 - protein, 21 aa, Mycobacterium
IGFALGWRPALLALALGAGVI

SEQ ID NO: 312580 - protein, 20 aa, Mycobacterium
IGFALGWRPAPPALALGAAV

SEQ ID NO: 312581 - protein, 25 aa, Mycobacterium
IGFAVIAFIIVKWVVPPVRTLMRNQ

SEQ ID NO: 312582 - protein, 29 aa, Mycobacterium
IGFAVIVFIIMKWVAPLVKSMMQKQQEAI

SEQ ID NO: 312583 - protein, 22 aa, Mycobacterium
IGFAVIVFLVVKYVVPPVRTLM

SEQ ID NO: 312584 - protein, 19 aa, Mycobacterium
IGFGIAMGALFSVAYVVAI

SEQ ID NO: 312585 - protein, 34 aa, Mycobacterium
IGFGPAWVVTALWWFPFAVIFPVGDPLDFGALAT

SEQ ID NO: 312586 - protein, 19 aa, Mycobacterium
IGFGPSFFLKDGVDRFGIA

SEQ ID NO: 312587 - protein, 23 aa, Mycobacterium
IGFIAGLLLAIAVALTREAGDRT

SEQ ID NO: 312588 - protein, 17 aa, Mycobacterium
IGFLLSLLLVVIGIVVR

SEQ ID NO: 312589 - protein, 23 aa, Mycobacterium
IGFSTWPLRAMQSLDFTFIPADG

SEQ ID NO: 312590 - protein, 25 aa, Mycobacterium
IGFTRAGALWSSLIAGFLILILLLI

SEQ ID NO: 312591 - protein, 31 aa, Mycobacterium
IGFTSPFAFGAPRFDVIAVVSLIVVLMVTAV

SEQ ID NO: 312592 - protein, 17 aa, Mycobacterium
IGGALLVRRSQAADTSV

SEQ ID NO: 312593 - protein, 17 aa, Mycobacterium
IGGASLWVAIYGTFVLN

SEQ ID NO: 312594 - protein, 27 aa, Mycobacterium
IGGAVALRILFDVPLPVGGIITGVISL

SEQ ID NO: 312595 - protein, 24 aa, Mycobacterium
IGGDGGFYAGHMVATILWIAMAAV

SEQ ID NO: 312596 - protein, 23 aa, Mycobacterium
IGGEALSGCGVITAPNTPPVPED

SEQ ID NO: 312597 - protein, 19 aa, Mycobacterium
IGGFAVFRVRGIFGSESFG

SEQ ID NO: 312598 - protein, 24 aa, Mycobacterium
IGGFTQVSAWWAEPIVFQKAVLYT

SEQ ID NO: 312599 - protein, 18 aa, Mycobacterium
IGGGALLLVDLMFLAANL

SEQ ID NO: 312600 - protein, 24 aa, Mycobacterium
IGGGFWLIAVAWRHLHAAAQADRL

SEQ ID NO: 312601 - protein, 32 aa, Mycobacterium
IGGGSYAWTIFRKRFWRFWLGAPIADMLFMLG

SEQ ID NO: 312602 - protein, 25 aa, Mycobacterium
IGGIHIWLGGALNFLRITTLSVVLL

SEQ ID NO: 312603 - protein, 21 aa, Mycobacterium
IGGIRPGLYVASNFLPGSPGY

SEQ ID NO: 312604 - protein, 24 aa, Mycobacterium
IGGITVRTGLLWWTVAIHLLASMT

SEQ ID NO: 312605 - protein, 24 aa, Mycobacterium
IGGITVRTGLLWWTVAIHLLVSMG

SEQ ID NO: 312606 - protein, 24 aa, Mycobacterium
IGGITVRTGLLWWTVSVHLLASMT

SEQ ID NO: 312607 - protein, 17 aa, Mycobacterium
IGGIVFGHFGDRYGRKH

SEQ ID NO: 312608 - protein, 17 aa, Mycobacterium
IGGLFAMSADAVKFLFQ

SEQ ID NO: 312609 - protein, 17 aa, Mycobacterium
IGGLGSWFTQGYQTDKS

SEQ ID NO: 312610 - protein, 20 aa, Mycobacterium
IGGLLGFPSVAYALARVGVL

SEQ ID NO: 312611 - protein, 18 aa, Mycobacterium
IGGLLIVVVALFLGVDPG

SEQ ID NO: 312612 - protein, 26 aa, Mycobacterium
IGGLLSFGAGLAWLAMERRRVREAER

SEQ ID NO: 312613 - protein, 19 aa, Mycobacterium
IGGLRAHGYQVAMLTGDNE

SEQ ID NO: 312614 - protein, 23 aa, Mycobacterium
IGGMTCASCAARIEKKLNKIDGV

SEQ ID NO: 312615 - protein, 23 aa, Mycobacterium
IGGPRRKGRIISEHEKKITAYHE

SEQ ID NO: 312616 - protein, 22 aa, Mycobacterium
IGGPRRKGRIISEQEKKITAYH

SEQ ID NO: 312617 - protein, 24 aa, Mycobacterium
IGGQPLSWSVPGMAFIVLVAVGAD

SEQ ID NO: 312618 - protein, 25 aa, Mycobacterium
IGGRELGVLPLLPVLLMIWATARST

SEQ ID NO: 312619 - protein, 25 aa, Mycobacterium
IGGRELGVMPLLPVLAMVWGTAKTT

SEQ ID NO: 312620 - protein, 25 aa, Mycobacterium
IGGRELGVMPLLPVLLMVWATARST

SEQ ID NO: 312621 - protein, 25 aa, Mycobacterium
IGGRELGVMPLLPVLLMVWGTARTT

SEQ ID NO: 312622 - protein, 21 aa, Mycobacterium
IGGVAMMMFGGRFGGQQQMSR

SEQ ID NO: 312623 - protein, 25 aa, Mycobacterium
IGGVITILMGLVFIGLVPVLQRDTR

SEQ ID NO: 312624 - protein, 17 aa, Mycobacterium
IGGVVTIVMGLVFVGFI

SEQ ID NO: 312625 - protein, 17 aa, Mycobacterium
IGGWPGAYPARPANQLV

SEQ ID NO: 312626 - protein, 18 aa, Mycobacterium
IGGYPGVIVGFGLLVAVS

SEQ ID NO: 312627 - protein, 27 aa, Mycobacterium
IGHAGMPGMRMAFSLLPDAGSETEHIY

SEQ ID NO: 312628 - protein, 20 aa, Mycobacterium
IGHARARGADVIALDDAETA

SEQ ID NO: 312629 - protein, 18 aa, Mycobacterium
IGHGASIYDTCAIAPVTS

SEQ ID NO: 312630 - protein, 18 aa, Mycobacterium
IGHLLRIEGPPGLRRAVG

SEQ ID NO: 312631 - protein, 28 aa, Mycobacterium
IGHPIKLLKGHTWVTAFINPIEELAKPI

SEQ ID NO: 312632 - protein, 26 aa, Mycobacterium
IGHRNRIAAMFAWGISFLGRTRGQMA

SEQ ID NO: 312633 - protein, 31 aa, Mycobacterium
IGIAKRAGHPISFWQFTRYGIVVTFLSTALA

SEQ ID NO: 312634 - protein, 26 aa, Mycobacterium
IGIAQEFADKVFIIFQRLHGRDSYGG

SEQ ID NO: 312635 - protein, 34 aa, Mycobacterium
IGIARLKPRFASLVGLSEVMFAVIIAWIMVGEAM

SEQ ID NO: 312636 - protein, 19 aa, Mycobacterium
IGIAWPHLSAWAMDSVDDP

SEQ ID NO: 312637 - protein, 17 aa, Mycobacterium
IGIEAYNLLNIIGLGPA

SEQ ID NO: 312638 - protein, 23 aa, Mycobacterium
IGIGAFYVIVSWLAIVGTGPQNA

SEQ ID NO: 312639 - protein, 19 aa, Mycobacterium
IGIGCVMPVLASAAIDAMP

SEQ ID NO: 312640 - protein, 24 aa, Mycobacterium
IGIGMAWPHLSARAMACVNDPAEG

SEQ ID NO: 312641 - protein, 21 aa, Mycobacterium
IGIGVARLVAWLLSVAGILAF

SEQ ID NO: 312642 - protein, 23 aa, Mycobacterium
IGIMCIWPNLIAYWAGKPPIRGL

SEQ ID NO: 312643 - protein, 24 aa, Mycobacterium
IGINARPGLLLVVPGDGPDTVAVY

SEQ ID NO: 312644 - protein, 20 aa, Mycobacterium
IGISAMLGWGLFRIYVLGNQ

SEQ ID NO: 312645 - protein, 19 aa, Mycobacterium
IGISGMLIGWRMHGSLADA

SEQ ID NO: 312646 - protein, 18 aa, Mycobacterium
IGITMCRALAGFALALLI

SEQ ID NO: 312647 - protein, 30 aa, Mycobacterium
IGIVGAAFQWCLRAAEGLRLDVVEWAQRLP

SEQ ID NO: 312648 - protein, 21 aa, Mycobacterium
IGIVLVVGFWQPGFFVTTKLD

SEQ ID NO: 312649 - protein, 19 aa, Mycobacterium
IGKCLRPLPNKWKGLTDPE

SEQ ID NO: 312650 - protein, 49 aa, Mycobacterium
IGKIEFSGFIAWLSWLALHLVYLVGFKNRLVTLILWSIAFVTRSRGQMA

SEQ ID NO: 312651 - protein, 20 aa, Mycobacterium
IGKLFIGTLVVWFFVLFDML

SEQ ID NO: 312652 - protein, 19 aa, Mycobacterium
IGLAAAHFFAFKISARLIG

SEQ ID NO: 312653 - protein, 24 aa, Mycobacterium
IGLADEVLYFFLVESAVIFVTAYL

SEQ ID NO: 312654 - protein, 18 aa, Mycobacterium
IGLAGLWLGLLGIAMAVG

SEQ ID NO: 312655 - protein, 22 aa, Mycobacterium
IGLAMILSYVWGVRVGGIFTAL

SEQ ID NO: 312656 - protein, 18 aa, Mycobacterium
IGLARLGGLPALDSPEIR

SEQ ID NO: 312657 - protein, 19 aa, Mycobacterium
IGLAVSWTLAGTALCLLQA

SEQ ID NO: 312658 - protein, 25 aa, Mycobacterium
IGLFDRICRVGRSLRVHLLLATQSL

SEQ ID NO: 312659 - protein, 17 aa, Mycobacterium
IGLFKVMPFTSSILANF

SEQ ID NO: 312660 - protein, 25 aa, Mycobacterium
IGLFMFVGFCAWFVGMHLLFAFNTV

SEQ ID NO: 312661 - protein, 26 aa, Mycobacterium
IGLHPGLPVWWIVAVLVFAGVMGLFV

SEQ ID NO: 312662 - protein, 17 aa, Mycobacterium
IGLHSRRNLTLYVTALL

SEQ ID NO: 312663 - protein, 27 aa, Mycobacterium
IGLIFFGWGVALAFTSVVVAPRLQHRF

SEQ ID NO: 312664 - protein, 19 aa, Mycobacterium
IGLIIGMIMFIRRYLQRVT

SEQ ID NO: 312665 - protein, 21 aa, Mycobacterium
IGLLCGFLGAMALRRVALPAS

SEQ ID NO: 312666 - protein, 20 aa, Mycobacterium
IGLLLACIVLRGLATMRVPW

SEQ ID NO: 312667 - protein, 24 aa, Mycobacterium
IGLLNLISLIGIYRIAKRMRGGEV

SEQ ID NO: 312668 - protein, 18 aa, Mycobacterium
IGLLSAWCALPGDEGFRT

SEQ ID NO: 312669 - protein, 17 aa, Mycobacterium
IGLLTILGFSIYDTVIV

SEQ ID NO: 312670 - protein, 19 aa, Mycobacterium
IGLMVDRLGPRRVGIIGAG

SEQ ID NO: 312671 - protein, 22 aa, Mycobacterium
IGLNAFWSRTLSPLIFSLNSVP

SEQ ID NO: 312672 - protein, 17 aa, Mycobacterium
IGLNVCILFIGFGAGSL

SEQ ID NO: 312673 - protein, 17 aa, Mycobacterium
IGLRAAAAVAIPGTLVV

SEQ ID NO: 312674 - protein, 26 aa, Mycobacterium
IGLRPWWVRPLWKLLHIDGRPSRYRS

SEQ ID NO: 312675 - protein, 24 aa, Mycobacterium
IGLRTRLMGYIGLTKPRVIELLLV

SEQ ID NO: 312676 - protein, 19 aa, Mycobacterium
IGLSWPRETLQPILDSFTS

SEQ ID NO: 312677 - protein, 18 aa, Mycobacterium
IGLVALYIVVQLARQKRM

SEQ ID NO: 312678 - protein, 19 aa, Mycobacterium
IGLVFSVLVGRGLDERADS

SEQ ID NO: 312679 - protein, 17 aa, Mycobacterium
IGLVGIAITVVIALAAL

SEQ ID NO: 312680 - protein, 25 aa, Mycobacterium
IGLVGSIFAFWGWDTCLTLGEESKD

SEQ ID NO: 312681 - protein, 20 aa, Mycobacterium
IGLVIATAVAVSWTARALGM

SEQ ID NO: 312682 - protein, 17 aa, Mycobacterium
IGLVIRARLGLKETSQQ

SEQ ID NO: 312683 - protein, 21 aa, Mycobacterium
IGLVLSALVIASAFATSTTVN

SEQ ID NO: 312684 - protein, 17 aa, Mycobacterium
IGLVVGCVVAYGLGDMS

SEQ ID NO: 312685 - protein, 20 aa, Mycobacterium
IGLWRAKIVEMTGMPELIAL

SEQ ID NO: 312686 - protein, 22 aa, Mycobacterium
IGMALGLLQYVAFRRNLGEHGR

SEQ ID NO: 312687 - protein, 17 aa, Mycobacterium
IGMGFLISRKSWSILPL

SEQ ID NO: 312688 - protein, 24 aa, Mycobacterium
IGMLPKHLRRSTVVTMFVLAASVI

SEQ ID NO: 312689 - protein, 23 aa, Mycobacterium
IGMLSMMVFLPFAGRISDRVGRK

SEQ ID NO: 312690 - protein, 20 aa, Mycobacterium
IGMPLGLLIGSSRIAERAGG

SEQ ID NO: 312691 - protein, 19 aa, Mycobacterium
IGMTCYIAILGLTGALTSA

SEQ ID NO: 312692 - protein, 21 aa, Mycobacterium
IGMWMPVMLFFYMGFEHSVVN

SEQ ID NO: 312693 - protein, 18 aa, Mycobacterium
IGNLEAAKALGLNVEPVP

SEQ ID NO: 312694 - protein, 18 aa, Mycobacterium
IGNLRGALLGGLILGVME

SEQ ID NO: 312695 - protein, 18 aa, Mycobacterium
IGNLRGALLGGLLLGIME

SEQ ID NO: 312696 - protein, 24 aa, Mycobacterium
IGNLRGALLGGLLLGVMENYGQAV

SEQ ID NO: 312697 - protein, 20 aa, Mycobacterium
IGPAPTLDDPCCGPQRSTPP

SEQ ID NO: 312698 - protein, 28 aa, Mycobacterium
IGPEPAWRNLRFPLTWAPPEANVARIVA

SEQ ID NO: 312699 - protein, 33 aa, Mycobacterium
IGPFLGGALVEWNWRAAFLINVPLAAFVIAVTL

SEQ ID NO: 312700 - protein, 25 aa, Mycobacterium
IGPIWRSPISWGLTFMFSMTSLITY

SEQ ID NO: 312701 - protein, 36 aa, Mycobacterium
IGPLEFGGFIAWLSWLVLHLVYLVGFKTKIVTLLSW

SEQ ID NO: 312702 - protein, 18 aa, Mycobacterium
IGPLVLPVHGVFVALGVL

SEQ ID NO: 312703 - protein, 17 aa, Mycobacterium
IGPRAAVGLAAITLLAF

SEQ ID NO: 312704 - protein, 21 aa, Mycobacterium
IGPRLPMTVGPVLAGLGLLLM

SEQ ID NO: 312705 - protein, 17 aa, Mycobacterium
IGPSGIWYAISALGGLL

SEQ ID NO: 312706 - protein, 36 aa, Mycobacterium
IGPVEFSGLFAWFAWLVLHLVYLVGFKTKISTLLSW

SEQ ID NO: 312707 - protein, 30 aa, Mycobacterium
IGPVWEANHVWLIYILVIWWTGFPRTFAAA

SEQ ID NO: 312708 - protein, 30 aa, Mycobacterium
IGPWLDRVQAFDVFSSFWFTAIYVLLFVSL

SEQ ID NO: 312709 - protein, 24 aa, Mycobacterium
IGQFIRRLVGFLVRQVDRIAPFRV

SEQ ID NO: 312710 - protein, 22 aa, Mycobacterium
IGQFIRWLVRFLVGQVDRIAPF

SEQ ID NO: 312711 - protein, 24 aa, Mycobacterium
IGQFTRWLVRFLVGQVDRFVPFRL

SEQ ID NO: 312712 - protein, 25 aa, Mycobacterium
IGQHFGWRAAVWTVTVLTLVAAGAV

SEQ ID NO: 312713 - protein, 19 aa, Mycobacterium
IGQKVLLELRRRVFRHFGR

SEQ ID NO: 312714 - protein, 19 aa, Mycobacterium
IGQLAQWLLSLVGLAYLVW

SEQ ID NO: 312715 - protein, 18 aa, Mycobacterium
IGQLGVAYLDSWSAAIAV

SEQ ID NO: 312716 - protein, 27 aa, Mycobacterium
IGQLLVNAAFSFVLWSYNLIQALVNLN

SEQ ID NO: 312717 - protein, 19 aa, Mycobacterium
IGQLVGRLVRFLVRQVDRV

SEQ ID NO: 312718 - protein, 20 aa, Mycobacterium
IGQLWWGAVVVSFFVLADML

SEQ ID NO: 312719 - protein, 19 aa, Mycobacterium
IGQQVSQRLQVPVITTARP

SEQ ID NO: 312720 - protein, 23 aa, Mycobacterium
IGRIKDLLIVDGRNHYPDDIEAT

SEQ ID NO: 312721 - protein, 18 aa, Mycobacterium
IGRKRMLVYSLVGMGVST

SEQ ID NO: 312722 - protein, 17 aa, Mycobacterium
IGRLRWQFDRIARTIPV

SEQ ID NO: 312723 - protein, 19 aa, Mycobacterium
IGRPLKTMIAIAVLVGVAL

SEQ ID NO: 312724 - protein, 20 aa, Mycobacterium
IGRPLKTMIAIAVLVGVALV

SEQ ID NO: 312725 - protein, 17 aa, Mycobacterium
IGRPWYLAWAGLVYVVA

SEQ ID NO: 312726 - protein, 18 aa, Mycobacterium
IGRRSELLRDIAPLTRKP

SEQ ID NO: 312727 - protein, 19 aa, Mycobacterium
IGSAIPFVGHHKVLFAVAA

SEQ ID NO: 312728 - protein, 20 aa, Mycobacterium
IGSAIPFVYDHKVFFAVAAI

SEQ ID NO: 312729 - protein, 28 aa, Mycobacterium
IGSAIPFVYEHKVFFAVSAIVLVTAMNL

SEQ ID NO: 312730 - protein, 19 aa, Mycobacterium
IGSAIPIVAEHKVFFCVAS

SEQ ID NO: 312731 - protein, 19 aa, Mycobacterium
IGSAVPFVYDHKVIFAVAA

SEQ ID NO: 312732 - protein, 25 aa, Mycobacterium
IGSDLAGWCSIAGHRQMGMTLTIKA

SEQ ID NO: 312733 - protein, 18 aa, Mycobacterium
IGSFPILSVFGFIVMFGG

SEQ ID NO: 312734 - protein, 17 aa, Mycobacterium
IGSIAIFARVFRAEVMR

SEQ ID NO: 312735 - protein, 24 aa, Mycobacterium
IGSKSRLAIRTDTILGKKVLEIDP

SEQ ID NO: 312736 - protein, 18 aa, Mycobacterium
IGSLHQWLNLTLAVGGGL

SEQ ID NO: 312737 - protein, 24 aa, Mycobacterium
IGSLLRLLILGVIMAPIVIAVLLA

SEQ ID NO: 312738 - protein, 23 aa, Mycobacterium
IGSLWYTIACLVIATLSVTAAKT

SEQ ID NO: 312739 - protein, 21 aa, Mycobacterium
IGSNPWRGPPVPYGQPIEDGR

SEQ ID NO: 312740 - protein, 18 aa, Mycobacterium
IGSPMFHFGILVVIVGHV

SEQ ID NO: 312741 - protein, 25 aa, Mycobacterium
IGSPTAWAAFFVLDEWLRPVPAGVV

SEQ ID NO: 312742 - protein, 18 aa, Mycobacterium
IGSPVLFPVAIWWFIIRP

SEQ ID NO: 312743 - protein, 19 aa, Mycobacterium
IGSRIELRLGDPAESEMDR

SEQ ID NO: 312744 - protein, 19 aa, Mycobacterium
IGSRTLWYLVMVLASVVLA

SEQ ID NO: 312745 - protein, 18 aa, Mycobacterium
IGSVIGETLKLAGTATVL

SEQ ID NO: 312746 - protein, 20 aa, Mycobacterium
IGSVPFPISAVISGLVNAAL

SEQ ID NO: 312747 - protein, 19 aa, Mycobacterium
IGSVSFWGSLVAYLKLQES

SEQ ID NO: 312748 - protein, 20 aa, Mycobacterium
IGTASFWTFGIIAMVTLLAK

SEQ ID NO: 312749 - protein, 17 aa, Mycobacterium
IGTEIRDAHSINGTFVN

SEQ ID NO: 312750 - protein, 17 aa, Mycobacterium
IGTFNTLVLLLSSWSVA

SEQ ID NO: 312751 - protein, 18 aa, Mycobacterium
IGTGGYLALRAHQQSAAI

SEQ ID NO: 312752 - protein, 21 aa, Mycobacterium
IGTICTVFFAVYGMLLLTTQF

SEQ ID NO: 312753 - protein, 25 aa, Mycobacterium
IGTIPICILGLFFKDEIRSGVRNLW

SEQ ID NO: 312754 - protein, 20 aa, Mycobacterium
IGTKPLMWVGCASLIAASVP

SEQ ID NO: 312755 - protein, 23 aa, Mycobacterium
IGTKRLFMISVLGFTLGSVLCAV

SEQ ID NO: 312756 - protein, 17 aa, Mycobacterium
IGTLFAFVLVSAGVIVL

SEQ ID NO: 312757 - protein, 21 aa, Mycobacterium
IGTLIAALVPEAGWQGAASRA

SEQ ID NO: 312758 - protein, 17 aa, Mycobacterium
IGTPLHWMVLPMAVIIL

SEQ ID NO: 312759 - protein, 19 aa, Mycobacterium
IGTRIELRLGDPADSELDR

SEQ ID NO: 312760 - protein, 24 aa, Mycobacterium
IGTRRLWPAAVAIVIAMFSVTLAP

SEQ ID NO: 312761 - protein, 22 aa, Mycobacterium
IGTSRRSRWARLFEEGIGARIV

SEQ ID NO: 312762 - protein, 20 aa, Mycobacterium
IGTVLMIVWFHFWQDRVRDL

SEQ ID NO: 312763 - protein, 17 aa, Mycobacterium
IGVAARALLAWPSGVAP

SEQ ID NO: 312764 - protein, 18 aa, Mycobacterium
IGVAGSWGPLAGKIKPMT

SEQ ID NO: 312765 - protein, 29 aa, Mycobacterium
IGVAVPRILGHATDLLFNGVIGRQLPAGI

SEQ ID NO: 312766 - protein, 18 aa, Mycobacterium
IGVAVTFSGVLSETLAAG

SEQ ID NO: 312767 - protein, 25 aa, Mycobacterium
IGVCRRWQLQYSRRLRVTDSAIVFA

SEQ ID NO: 312768 - protein, 25 aa, Mycobacterium
IGVDGGSLWGGVGFVAGQWMITHAL

SEQ ID NO: 312769 - protein, 25 aa, Mycobacterium
IGVDLDLSRLGAFFMALTGAVAVVV

SEQ ID NO: 312770 - protein, 24 aa, Mycobacterium
IGVEAFTGFLAALVNVRFVAPVAA

SEQ ID NO: 312771 - protein, 21 aa, Mycobacterium
IGVEIGWLLPAAVVAAVVGSF

SEQ ID NO: 312772 - protein, 22 aa, Mycobacterium
IGVFLERMLRRFVLPNRLWWPL

SEQ ID NO: 312773 - protein, 19 aa, Mycobacterium
IGVGAAFPLLGSAALAGLA

SEQ ID NO: 312774 - protein, 17 aa, Mycobacterium
IGVGFISWAVLRTAAGK

SEQ ID NO: 312775 - protein, 26 aa, Mycobacterium
IGVGLMAWLNIIGILILQRPAYKALW

SEQ ID NO: 312776 - protein, 18 aa, Mycobacterium
IGVGPGWLHPLAVARTLM

SEQ ID NO: 312777 - protein, 18 aa, Mycobacterium
IGVGQSFTSVPMLFAKPS

SEQ ID NO: 312778 - protein, 19 aa, Mycobacterium
IGVGVVRQGAPMTAGLLMG

SEQ ID NO: 312779 - protein, 19 aa, Mycobacterium
IGVGYARRLIGPRIALVAA

SEQ ID NO: 312780 - protein, 21 aa, Mycobacterium
IGVKLCGALETAHRTGTLHRD

SEQ ID NO: 312781 - protein, 22 aa, Mycobacterium
IGVLAVRLWRFTPGQYMAGLQV

SEQ ID NO: 312782 - protein, 21 aa, Mycobacterium
IGVLGFFAFYLSFVAELPPPP

SEQ ID NO: 312783 - protein, 23 aa, Mycobacterium
IGVLGVALAVRFVPVLPTHAHRF

SEQ ID NO: 312784 - protein, 19 aa, Mycobacterium
IGVLPRWQTVAVLAVLALI

SEQ ID NO: 312785 - protein, 20 aa, Mycobacterium
IGVLVGTVFVHWLIFESLYR

SEQ ID NO: 312786 - protein, 28 aa, Mycobacterium
IGVPQLDAGPFLSYGIQWISFGIVAPLG

SEQ ID NO: 312787 - protein, 25 aa, Mycobacterium
IGVPRSAEMVVCVLAAMMAGVAFVP

SEQ ID NO: 312788 - protein, 17 aa, Mycobacterium
IGVPWWFLVAQLPFAGM

SEQ ID NO: 312789 - protein, 23 aa, Mycobacterium
IGVSELRVRRAIEREDPAKLTLK

SEQ ID NO: 312790 - protein, 24 aa, Mycobacterium
IGVTGSIFAFWGWDTCLTLGEESK

SEQ ID NO: 312791 - protein, 17 aa, Mycobacterium
IGVVALVISLAVSIRPT

SEQ ID NO: 312792 - protein, 22 aa, Mycobacterium
IGVVCTWMFMYGMTPLLQGPAA

SEQ ID NO: 312793 - protein, 17 aa, Mycobacterium
IGVVIYFLYGRRRSVLA

SEQ ID NO: 312794 - protein, 17 aa, Mycobacterium
IGVVLERVFRGVTVVAG

SEQ ID NO: 312795 - protein, 25 aa, Mycobacterium
IGVVPAAAVGLVFLMRANGLDWADL

SEQ ID NO: 312796 - protein, 21 aa, Mycobacterium
IGVVPFDFVTFLLAISLSAGW

SEQ ID NO: 312797 - protein, 21 aa, Mycobacterium
IGVVTRVGRRIALVLQLPSWP

SEQ ID NO: 312798 - protein, 32 aa, Mycobacterium
IGVVWLVLVGWLSLWPFLNWLTTHFVITDRRV

SEQ ID NO: 312799 - protein, 28 aa, Mycobacterium
IGVWLAMAVALPLSFPSLGEMAEKHPLQ

SEQ ID NO: 312800 - protein, 20 aa, Mycobacterium
IGWAASKSSTVWQRIAVTAV

SEQ ID NO: 312801 - protein, 25 aa, Mycobacterium
IGWASARTAAGFALAVVLLAVFLWL

SEQ ID NO: 312802 - protein, 29 aa, Mycobacterium
IGWRSRRRLPAAVIFGAIAAWATRWYLGT

SEQ ID NO: 312803 - protein, 25 aa, Mycobacterium
IGYEDFPLAIAILFALIIALPLGMA

SEQ ID NO: 312804 - protein, 18 aa, Mycobacterium
IGYGFRIDWEQWKPQHLG

SEQ ID NO: 312805 - protein, 20 aa, Mycobacterium
IGYIALFFVVAYMHAGLLTG

SEQ ID NO: 312806 - protein, 24 aa, Mycobacterium
IGYLPTMRKVILPQAIRTMIPSYI

SEQ ID NO: 312807 - protein, 24 aa, Mycobacterium
IGYTMGFGSLGWVYASESFPTRLR

SEQ ID NO: 312808 - protein, 20 aa, Mycobacterium
IHALLPRTGSNEMPAGSVTI

SEQ ID NO: 312809 - protein, 26 aa, Mycobacterium
IHDAWEGGSSWVAWVIGLISVPVDGV

SEQ ID NO: 312810 - protein, 18 aa, Mycobacterium
IHDCPKLVQLRTFPTVAV

SEQ ID NO: 312811 - protein, 23 aa, Mycobacterium
IHDLTAFFAWTAWASAAERPGHS

SEQ ID NO: 312812 - protein, 22 aa, Mycobacterium
IHFLEALPLDRARYVISAIPVL

SEQ ID NO: 312813 - protein, 28 aa, Mycobacterium
IHGFGEIDGRLYLDMRLIEGRNLGTMLQ

SEQ ID NO: 312814 - protein, 29 aa, Mycobacterium
IHGFGEIDGRLYLDMRLIEGRNLGTMLTR

SEQ ID NO: 312815 - protein, 23 aa, Mycobacterium
IHGTAILFRWPDLASMPPVESWS

SEQ ID NO: 312816 - protein, 17 aa, Mycobacterium
IHHCIADGIAAMRMLAN

SEQ ID NO: 312817 - protein, 20 aa, Mycobacterium
IHHVLPVWVVTVIVLSVVAV

SEQ ID NO: 312818 - protein, 18 aa, Mycobacterium
IHLACIWIVAFGVNASAF

SEQ ID NO: 312819 - protein, 18 aa, Mycobacterium
IHLAELNSGLWSGRGKHL

SEQ ID NO: 312820 - protein, 18 aa, Mycobacterium
IHLAFAFRGMNTHGRALY

SEQ ID NO: 312821 - protein, 24 aa, Mycobacterium
IHLDQFRIAAPMGGTFAEDRDLER

SEQ ID NO: 312822 - protein, 17 aa, Mycobacterium
IHLGFSFSAGLIDLLLY

SEQ ID NO: 312823 - protein, 24 aa, Mycobacterium
IHLSMIFFWSWGQLTASMIFGSVR

SEQ ID NO: 312824 - protein, 26 aa, Mycobacterium
IHLYPGRTGTNFALLTGQIVGVGYSG

SEQ ID NO: 312825 - protein, 24 aa, Mycobacterium
IHRAYRYARAMARWSPTSRSEIAD

SEQ ID NO: 312826 - protein, 19 aa, Mycobacterium
IHREPALGMGRLIGIIAVG

SEQ ID NO: 312827 - protein, 17 aa, Mycobacterium
IHSGEVVIGVFIGAVTF

SEQ ID NO: 312828 - protein, 25 aa, Mycobacterium
IHTPLGYRGPLWVSVMLAALALVVT

SEQ ID NO: 312829 - protein, 28 aa, Mycobacterium
IHTYGEINGRLFVDMRLIEGRDLQSVLS

SEQ ID NO: 312830 - protein, 24 aa, Mycobacterium
IHVVGRIATVLGVVGFTYLAIRLF

SEQ ID NO: 312831 - protein, 17 aa, Mycobacterium
IIAALVLEATFTAIFIP

SEQ ID NO: 312832 - protein, 29 aa, Mycobacterium
IIADGTWARLYTDWVPRALPPGWKPGSKA

SEQ ID NO: 312833 - protein, 26 aa, Mycobacterium
IIAGACALALFAVFWVLVPLLLRTRD

SEQ ID NO: 312834 - protein, 18 aa, Mycobacterium
IIAGRPAPTDGFVGVAPD

SEQ ID NO: 312835 - protein, 25 aa, Mycobacterium
IIAGSCALVLFALFWVLVPLLLRTR

SEQ ID NO: 312836 - protein, 17 aa, Mycobacterium
IIAGVLIAAKVPEAQAA

SEQ ID NO: 312837 - protein, 30 aa, Mycobacterium
IIAIAALVLFVALPLIYVRNYVKVPPNEVA

SEQ ID NO: 312838 - protein, 18 aa, Mycobacterium
IIALFSWTYFARLVRNSV

SEQ ID NO: 312839 - protein, 19 aa, Mycobacterium
IIALSCLRCGGRVQATLWS

SEQ ID NO: 312840 - protein, 24 aa, Mycobacterium
IIANRVSYFYDFRGPSVAIDTACS

SEQ ID NO: 312841 - protein, 24 aa, Mycobacterium
IIANRVSYFYDFRGPSVALDTACS

SEQ ID NO: 312842 - protein, 24 aa, Mycobacterium
IIANYRRLVLRGVAFLGWNRSISQ

SEQ ID NO: 312843 - protein, 22 aa, Mycobacterium
IIARSGFEAVFIGSFGIAASAY

SEQ ID NO: 312844 - protein, 25 aa, Mycobacterium
IICYAWPFYWLVDMRAMAWLVVAMM

SEQ ID NO: 312845 - protein, 18 aa, Mycobacterium
IIDLIMWLIMNILYYSII

SEQ ID NO: 312846 - protein, 19 aa, Mycobacterium
IIDRLFFRVLLGGWPSLIV

SEQ ID NO: 312847 - protein, 18 aa, Mycobacterium
IIETVALLLHIAVMLAFL

SEQ ID NO: 312848 - protein, 17 aa, Mycobacterium
IIFLWLTDRDYGLVNAA

SEQ ID NO: 312849 - protein, 18 aa, Mycobacterium
IIFVLIFQRRIVAGLTSG

SEQ ID NO: 312850 - protein, 23 aa, Mycobacterium
IIGDTFLWHLWDELLGIGTVIGI

SEQ ID NO: 312851 - protein, 24 aa, Mycobacterium
IIGGIAGVTGRLWGLTSALTTDER

SEQ ID NO: 312852 - protein, 18 aa, Mycobacterium
IIGGRPAPTDGFVGVAPD

SEQ ID NO: 312853 - protein, 18 aa, Mycobacterium
IIGLELFAAQGITATAGN

SEQ ID NO: 312854 - protein, 25 aa, Mycobacterium
IIGRRSRFLKLFGLRVDLDQLEHSL

SEQ ID NO: 312855 - protein, 19 aa, Mycobacterium
IIGRVRPATYLAFGPPALV

SEQ ID NO: 312856 - protein, 22 aa, Mycobacterium
IIGSISFWGSIIAFGKLQELIS

SEQ ID NO: 312857 - protein, 23 aa, Mycobacterium
IIGWALACSVPVVLVGAAVVRLA

SEQ ID NO: 312858 - protein, 27 aa, Mycobacterium
IIHAFAVPIILGWIAICVALSVFIPSL

SEQ ID NO: 312859 - protein, 28 aa, Mycobacterium
IIKFVKFQLTTAWGFVLIFLVCGSLGLA

SEQ ID NO: 312860 - protein, 21 aa, Mycobacterium
IIKMKVEPFIALIVVSVAVAL

SEQ ID NO: 312861 - protein, 26 aa, Mycobacterium
IIKRFPRLRAALLYYASRPTPASITT

SEQ ID NO: 312862 - protein, 17 aa, Mycobacterium
IILALIGIHLALVWYQK

SEQ ID NO: 312863 - protein, 23 aa, Mycobacterium
IILAQGIGRLGNYFNQELYGRPT

SEQ ID NO: 312864 - protein, 23 aa, Mycobacterium
IILRSAAKPGNWSLFDGGYTFAS

SEQ ID NO: 312865 - protein, 23 aa, Mycobacterium
IILRSAAQPGTWSLFDGGYTFAS

SEQ ID NO: 312866 - protein, 25 aa, Mycobacterium
IILRSAARPGNWSLFDGGYTFASKI

SEQ ID NO: 312867 - protein, 17 aa, Mycobacterium
IILSPLWLFAFVLAELL

SEQ ID NO: 312868 - protein, 19 aa, Mycobacterium
IILVTGLVAAIGFASLLTY

SEQ ID NO: 312869 - protein, 17 aa, Mycobacterium
IILYWFSNNIWTFAQQH

SEQ ID NO: 312870 - protein, 19 aa, Mycobacterium
IIMLCLWWGAATSKLNHHF

SEQ ID NO: 312871 - protein, 22 aa, Mycobacterium
IIPIDMFLEWIVAPTVLVAAAL

SEQ ID NO: 312872 - protein, 18 aa, Mycobacterium
IIPLAAWATRPAFRGTAI

SEQ ID NO: 312873 - protein, 17 aa, Mycobacterium
IIPLRPLTLSDIYNGAA

SEQ ID NO: 312874 - protein, 17 aa, Mycobacterium
IIPVSSLLRSHAVTLND

SEQ ID NO: 312875 - protein, 18 aa, Mycobacterium
IIPVTRFLVGTTVGIPAA

SEQ ID NO: 312876 - protein, 17 aa, Mycobacterium
IIQFFGGIHEIYFPYVL

SEQ ID NO: 312877 - protein, 18 aa, Mycobacterium
IIRRAYRVLFVVAGVLIA

SEQ ID NO: 312878 - protein, 21 aa, Mycobacterium
IIRRVRIGIVIAACLVTLQSV

SEQ ID NO: 312879 - protein, 17 aa, Mycobacterium
IIRTGRVVLNLVADKNA

SEQ ID NO: 312880 - protein, 19 aa, Mycobacterium
IISALHRAVPLSGEGSDTD

SEQ ID NO: 312881 - protein, 22 aa, Mycobacterium
IISALHRPVPLSGDGSDTDTVI

SEQ ID NO: 312882 - protein, 17 aa, Mycobacterium
IISGRWVSESGWGETLF

SEQ ID NO: 312883 - protein, 26 aa, Mycobacterium
IISTFPLAVPLEWNVLFAYATIFLFL

SEQ ID NO: 312884 - protein, 20 aa, Mycobacterium
IITAIFGWQLFQDVGGNDYI

SEQ ID NO: 312885 - protein, 26 aa, Mycobacterium
IITEPKKAAAALAWLVEEMEQRYQDM

SEQ ID NO: 312886 - protein, 17 aa, Mycobacterium
IIVCATAGQLLGFEPVI

SEQ ID NO: 312887 - protein, 18 aa, Mycobacterium
IIVFWAFLAVTTNTFVPQ

SEQ ID NO: 312888 - protein, 19 aa, Mycobacterium
IIVIAAAFAPLALPADQWW

SEQ ID NO: 312889 - protein, 20 aa, Mycobacterium
IIVLGVTNWVSYARVARSSV

SEQ ID NO: 312890 - protein, 18 aa, Mycobacterium
IIVLTSLIAIIGFVSLMT

SEQ ID NO: 312891 - protein, 17 aa, Mycobacterium
IIVPVLVALLLSALLLP

SEQ ID NO: 312892 - protein, 21 aa, Mycobacterium
IIYGAWGRMCWRRSCGPSRPG

SEQ ID NO: 312893 - protein, 29 aa, Mycobacterium
IIYGLAASVLPVWFLLAPRDYLSTFMKVG

SEQ ID NO: 312894 - protein, 23 aa, Mycobacterium
IKAKQYRSGRGMAIAGIVLAAVW

SEQ ID NO: 312895 - protein, 21 aa, Mycobacterium
IKALACNFLSLTAAFGALVWI

SEQ ID NO: 312896 - protein, 17 aa, Mycobacterium
IKALLFGVVAGLVGCYR

SEQ ID NO: 312897 - protein, 19 aa, Mycobacterium
IKALNIRYIYTSAPTVRGF

SEQ ID NO: 312898 - protein, 18 aa, Mycobacterium
IKALTGLRIVAAVWVVLF

SEQ ID NO: 312899 - protein, 24 aa, Mycobacterium
IKAPLWPLHRWLPDSAVEATPASA

SEQ ID NO: 312900 - protein, 19 aa, Mycobacterium
IKARVLRRGGQVQIKSEIG

SEQ ID NO: 312901 - protein, 20 aa, Mycobacterium
IKASTLFGSKYVDLVYPENP

SEQ ID NO: 312902 - protein, 21 aa, Mycobacterium
IKAVIYGAIVAVVACQKGLST

SEQ ID NO: 312903 - protein, 17 aa, Mycobacterium
IKAVLLIAGAGFMTVMV

SEQ ID NO: 312904 - protein, 19 aa, Mycobacterium
IKDEIREGRSFRSAVPRGW

SEQ ID NO: 312905 - protein, 33 aa, Mycobacterium
IKDEIREGRSYRSAVPRGWARARKTILSGNAVT

SEQ ID NO: 312906 - protein, 22 aa, Mycobacterium
IKDLSNKSARNFSKELAAQTPR

SEQ ID NO: 312907 - protein, 24 aa, Mycobacterium
IKDNCTRLTNDYMGNPDGFRATTL

SEQ ID NO: 312908 - protein, 24 aa, Mycobacterium
IKDPQFGLDLGFFAFDLPFYRFVL

SEQ ID NO: 312909 - protein, 18 aa, Mycobacterium
IKDTCTRLTDAYLAPIKL

SEQ ID NO: 312910 - protein, 20 aa, Mycobacterium
IKFGAFAAVMIVLTVFLFFI

SEQ ID NO: 312911 - protein, 20 aa, Mycobacterium
IKGVLIVAAVAVDVWSSRRR

SEQ ID NO: 312912 - protein, 23 aa, Mycobacterium
IKHPTPWMLLAWSSALIIGRITL

SEQ ID NO: 312913 - protein, 20 aa, Mycobacterium
IKHTESGFRYGQWGSASLVS

SEQ ID NO: 312914 - protein, 22 aa, Mycobacterium
IKIRHTESWVLIIAGLVVGVVL

SEQ ID NO: 312915 - protein, 17 aa, Mycobacterium
IKLAAIEAVKGTPLEDA

SEQ ID NO: 312916 - protein, 20 aa, Mycobacterium
IKLSIFAAVSGIAAAVTVFG

SEQ ID NO: 312917 - protein, 34 aa, Mycobacterium
IKNRTWRKVGTAIVRWPGPILAVTMIIALLGLGI

SEQ ID NO: 312918 - protein, 18 aa, Mycobacterium
IKPDICFLWDEAWYAFAT

SEQ ID NO: 312919 - protein, 19 aa, Mycobacterium
IKPDICFLWDEAWYAFATA

SEQ ID NO: 312920 - protein, 24 aa, Mycobacterium
IKPEGVRFGPFFAALAASLAAGAA

SEQ ID NO: 312921 - protein, 20 aa, Mycobacterium
IKPGDVMPATYIGIWQQFSD

SEQ ID NO: 312922 - protein, 20 aa, Mycobacterium
IKPGDVMPATYIGIWQTFAD

SEQ ID NO: 312923 - protein, 20 aa, Mycobacterium
IKPGDVMPATYIGIWQTLSD

SEQ ID NO: 312924 - protein, 23 aa, Mycobacterium
IKPKFPARVRLFLLTLAVVDDVG

SEQ ID NO: 312925 - protein, 19 aa, Mycobacterium
IKPPIVTGYGFWVAICASA

SEQ ID NO: 312926 - protein, 17 aa, Mycobacterium
IKQAYGLAYQQSLNTQA

SEQ ID NO: 312927 - protein, 19 aa, Mycobacterium
IKQRGRFAALVQIGSPVGT

SEQ ID NO: 312928 - protein, 23 aa, Mycobacterium
IKRKGQESFNFGELFAYTKVCSH

SEQ ID NO: 312929 - protein, 24 aa, Mycobacterium
IKRTGRLSLRHALDMLEQTGRALQ

SEQ ID NO: 312930 - protein, 19 aa, Mycobacterium
IKSLTGLRIIAAVWVVLFH

SEQ ID NO: 312931 - protein, 20 aa, Mycobacterium
IKSPHDLRSPTALADLELMV

SEQ ID NO: 312932 - protein, 18 aa, Mycobacterium
IKSPRDLRNPTALADLEM

SEQ ID NO: 312933 - protein, 23 aa, Mycobacterium
IKSSGRAAVLGAMAIDRPTLYLQ

SEQ ID NO: 312934 - protein, 33 aa, Mycobacterium
IKSYFYWEKHCFDIPICWAFRSLWDTIDHIDHL

SEQ ID NO: 312935 - protein, 34 aa, Mycobacterium
IKSYFYWERHCFDIPICWTFRSLFETIDQVDKLA

SEQ ID NO: 312936 - protein, 27 aa, Mycobacterium
IKVCTSRSAVWCSLLALALGVGLAGLQ

SEQ ID NO: 312937 - protein, 21 aa, Mycobacterium
IKYIWWILGGLAMVAAFFIIR

SEQ ID NO: 312938 - protein, 17 aa, Mycobacterium
IKYVVGPTIAWYQEFLR

SEQ ID NO: 312939 - protein, 24 aa, Mycobacterium
ILAACGLPYLLDRTATPISTEAPI

SEQ ID NO: 312940 - protein, 19 aa, Mycobacterium
ILAAILMGFWIGAITAGAI

SEQ ID NO: 312941 - protein, 22 aa, Mycobacterium
ILAALARFFSYPAMLTVVGLLA

SEQ ID NO: 312942 - protein, 25 aa, Mycobacterium
ILAAVAVLWRRRWRAETSNTHTDVA

SEQ ID NO: 312943 - protein, 18 aa, Mycobacterium
ILADEGWLVSALGGIGLL

SEQ ID NO: 312944 - protein, 17 aa, Mycobacterium
ILAEASLSFLGLGIQPP

SEQ ID NO: 312945 - protein, 18 aa, Mycobacterium
ILAEIKALLFGVVAGLVG

SEQ ID NO: 312946 - protein, 24 aa, Mycobacterium
ILAEVWKTTPFMALLLLAGLALVP

SEQ ID NO: 312947 - protein, 24 aa, Mycobacterium
ILAFEAGDLLLLFVALLANGLARF

SEQ ID NO: 312948 - protein, 22 aa, Mycobacterium
ILAGILRVFFRLRRGEFSEAEL

SEQ ID NO: 312949 - protein, 24 aa, Mycobacterium
ILAGPLVGLALMFVDFKITAAAAA

SEQ ID NO: 312950 - protein, 27 aa, Mycobacterium
ILAGWRALREYDLKLILAFGTVSQLGF

SEQ ID NO: 312951 - protein, 30 aa, Mycobacterium
ILAGWSLGGALAYACAIGLKRAGADVRFVG

SEQ ID NO: 312952 - protein, 17 aa, Mycobacterium
ILAIIFIPLERLFALRP

SEQ ID NO: 312953 - protein, 18 aa, Mycobacterium
ILAIPVVVISMAMPLHFS

SEQ ID NO: 312954 - protein, 17 aa, Mycobacterium
ILAIRWRLPSGTEIDTG

SEQ ID NO: 312955 - protein, 17 aa, Mycobacterium
ILALAAIGYVIRKSVRE

SEQ ID NO: 312956 - protein, 20 aa, Mycobacterium
ILALGSRFGLFEPKRKYDEG

SEQ ID NO: 312957 - protein, 24 aa, Mycobacterium
ILALPFMILIGLVLGRQWKLLGAY

SEQ ID NO: 312958 - protein, 18 aa, Mycobacterium
ILALPFVILIGLIVSRQW

SEQ ID NO: 312959 - protein, 18 aa, Mycobacterium
ILALRCAPAPAKISAAVA

SEQ ID NO: 312960 - protein, 23 aa, Mycobacterium
ILALVTRGRYYLRRSDDGIDLPM

SEQ ID NO: 312961 - protein, 21 aa, Mycobacterium
ILAQAIGRLGNYFNQELYGRE

SEQ ID NO: 312962 - protein, 19 aa, Mycobacterium
ILAQEIHPFVGLAAASLTV

SEQ ID NO: 312963 - protein, 18 aa, Mycobacterium
ILARTRIGSDITAFQGLV

SEQ ID NO: 312964 - protein, 49 aa, Mycobacterium
ILASAATVAFAFLAMVFAKLSVFAALGPACAIAVFVGFAATVTLFPPVL

SEQ ID NO: 312965 - protein, 17 aa, Mycobacterium
ILASGLVALLLNSLVVI

SEQ ID NO: 312966 - protein, 27 aa, Mycobacterium
ILASRWTWSSAPPIWVAAVAPRQTGVT

SEQ ID NO: 312967 - protein, 28 aa, Mycobacterium
ILAVPVVAFSGMFAMLVGYDVPDVPGAR

SEQ ID NO: 312968 - protein, 20 aa, Mycobacterium
ILAVSQIRWLYSDDDRHIWE

SEQ ID NO: 312969 - protein, 30 aa, Mycobacterium
ILAVWRAARIPLRWILPRMLIEAPFLVLAV

SEQ ID NO: 312970 - protein, 24 aa, Mycobacterium
ILAWATSGLNGWFYVGNYGVPWFD

SEQ ID NO: 312971 - protein, 27 aa, Mycobacterium
ILCAAVLFWLAWKSMRTAFRGKHLTEA

SEQ ID NO: 312972 - protein, 18 aa, Mycobacterium
ILCAGGLARQLNALAMGD

SEQ ID NO: 312973 - protein, 17 aa, Mycobacterium
ILCCLPFGIVSIVYSTK

SEQ ID NO: 312974 - protein, 26 aa, Mycobacterium
ILCDRFGRRRVMLVGWAVGLFWSPLV

SEQ ID NO: 312975 - protein, 19 aa, Mycobacterium
ILCFGRLSDRLGRRVPFLV

SEQ ID NO: 312976 - protein, 20 aa, Mycobacterium
ILCGTALVAIVAANTLYTIQ

SEQ ID NO: 312977 - protein, 20 aa, Mycobacterium
ILCVHVVLYLTLRFSTVLIR

SEQ ID NO: 312978 - protein, 25 aa, Mycobacterium
ILDNWLRPVPDGVPGELYIAGAGLA

SEQ ID NO: 312979 - protein, 26 aa, Mycobacterium
ILDRLRARHGWFDHAVRAYKRFSERR

SEQ ID NO: 312980 - protein, 18 aa, Mycobacterium
ILDRNVYGGIAFGPEGPA

SEQ ID NO: 312981 - protein, 27 aa, Mycobacterium
ILDRYRARFPWFDHIMRMQERYGKVNG

SEQ ID NO: 312982 - protein, 25 aa, Mycobacterium
ILDVAQPLAYCLPGVRSRVVVSEGT

SEQ ID NO: 312983 - protein, 17 aa, Mycobacterium
ILEEVWEFLTHPFEFLK

SEQ ID NO: 312984 - protein, 18 aa, Mycobacterium
ILEGFDFGVGMLMEPFAR

SEQ ID NO: 312985 - protein, 19 aa, Mycobacterium
ILEKYEMLGGPAGSDLGFP

SEQ ID NO: 312986 - protein, 21 aa, Mycobacterium
ILELATPYALDAVSQEERSEI

SEQ ID NO: 312987 - protein, 18 aa, Mycobacterium
ILERVGLRRPVSRANAVF

SEQ ID NO: 312988 - protein, 22 aa, Mycobacterium
ILERWEHILFPIVLIGLGIVIL

SEQ ID NO: 312989 - protein, 29 aa, Mycobacterium
ILFALCVLAVFGYLCYQVVLLALSALFWA

SEQ ID NO: 312990 - protein, 17 aa, Mycobacterium
ILFAWWRGLFVTTLVAR

SEQ ID NO: 312991 - protein, 22 aa, Mycobacterium
ILFWQHIIGVDVDWSVFPVSFM

SEQ ID NO: 312992 - protein, 23 aa, Mycobacterium
ILGAHWKLALTALLACTVGAAFV

SEQ ID NO: 312993 - protein, 25 aa, Mycobacterium
ILGALRVNWALGFQLFDYTGETSPG

SEQ ID NO: 312994 - protein, 20 aa, Mycobacterium
ILGALVWFWPAISVFVAAVF

SEQ ID NO: 312995 - protein, 19 aa, Mycobacterium
ILGATCLVPADGLPLNSSL

SEQ ID NO: 312996 - protein, 35 aa, Mycobacterium
ILGAVGVDFGASIYAEYRLSTSVRKAAHLGSDPFV

SEQ ID NO: 312997 - protein, 30 aa, Mycobacterium
ILGDGFTHWAELLGLFVFAAMIALLYRYVR

SEQ ID NO: 312998 - protein, 18 aa, Mycobacterium
ILGGILAFVILQFIDGLP

SEQ ID NO: 312999 - protein, 18 aa, Mycobacterium
ILGGWLIDSYGWQWIFLI

SEQ ID NO: 313000 - protein, 29 aa, Mycobacterium
ILGGWLIGAYGWKWIFLINLPIGLTAFAL

SEQ ID NO: 313001 - protein, 19 aa, Mycobacterium
ILGLLSRWGEGAAFNTWGV

SEQ ID NO: 313002 - protein, 17 aa, Mycobacterium
ILGQPLHWMVLAMAVII

SEQ ID NO: 313003 - protein, 20 aa, Mycobacterium
ILGVPSFRGVTLVGDGPLTE

SEQ ID NO: 313004 - protein, 17 aa, Mycobacterium
ILHLSRWIPELKTYGLA

SEQ ID NO: 313005 - protein, 17 aa, Mycobacterium
ILHRVDLFATTARGEKQ

SEQ ID NO: 313006 - protein, 20 aa, Mycobacterium
ILHWRPRRLGPVVVDTRLAR

SEQ ID NO: 313007 - protein, 30 aa, Mycobacterium
ILIAAVGRRTWRWHLIWLPAAAAVGAVLAL

SEQ ID NO: 313008 - protein, 24 aa, Mycobacterium
ILIAFGVLWPVVFDGGSGDPTDID

SEQ ID NO: 313009 - protein, 17 aa, Mycobacterium
ILIAFMCVAMVVYFLIL

SEQ ID NO: 313010 - protein, 19 aa, Mycobacterium
ILIAILMFFSIGFVPLDQY

SEQ ID NO: 313011 - protein, 18 aa, Mycobacterium
ILIGSAVVLLPIVLVATA

SEQ ID NO: 313012 - protein, 17 aa, Mycobacterium
ILIGVPLLIVWALIRRR

SEQ ID NO: 313013 - protein, 18 aa, Mycobacterium
ILIHRRVVERFGEEFRIG

SEQ ID NO: 313014 - protein, 25 aa, Mycobacterium
ILIIGCVYVPYMARPIRGEVLALRQ

SEQ ID NO: 313015 - protein, 17 aa, Mycobacterium
ILIRVVPAADALSTDGA

SEQ ID NO: 313016 - protein, 24 aa, Mycobacterium
ILISGGITAWLYAKLYRPDQQVGP

SEQ ID NO: 313017 - protein, 24 aa, Mycobacterium
ILISLEILFAIVAYAIVIALITPL

SEQ ID NO: 313018 - protein, 18 aa, Mycobacterium
ILKKSRVTLSSFAEMNNG

SEQ ID NO: 313019 - protein, 22 aa, Mycobacterium
ILKVLRERDAMVAKTLADNKKS

SEQ ID NO: 313020 - protein, 22 aa, Mycobacterium
ILKVLRERDAMVAKTLADSKKA

SEQ ID NO: 313021 - protein, 17 aa, Mycobacterium
ILLAAGIAFLAGRTRQG

SEQ ID NO: 313022 - protein, 19 aa, Mycobacterium
ILLAFPMGVPLEWNVFMIF

SEQ ID NO: 313023 - protein, 26 aa, Mycobacterium
ILLAFPMGVPLEWNVFMIFGVLSLFV

SEQ ID NO: 313024 - protein, 30 aa, Mycobacterium
ILLAFPMGVPLEWNVFMIFGVLWLFVTHAP

SEQ ID NO: 313025 - protein, 30 aa, Mycobacterium
ILLAGLAWYWYLKRTRPEIAQRIGTIQTLS

SEQ ID NO: 313026 - protein, 21 aa, Mycobacterium
ILLCAAVAYTVVVVRSARVES

SEQ ID NO: 313027 - protein, 29 aa, Mycobacterium
ILLFGGRRTDAWGHWLGCAAALAAFGVGL

SEQ ID NO: 313028 - protein, 26 aa, Mycobacterium
ILLFGGRRTDAWGHWLGCAAALASFG

SEQ ID NO: 313029 - protein, 17 aa, Mycobacterium
ILLGAIGFALGWRPALL

SEQ ID NO: 313030 - protein, 24 aa, Mycobacterium
ILLGGNWLVCLLAAATSAVIDQTG

SEQ ID NO: 313031 - protein, 24 aa, Mycobacterium
ILLGLLWYAGLPLRVFLTSLGAVL

SEQ ID NO: 313032 - protein, 26 aa, Mycobacterium
ILLGLLWYAGLPLRVFMSSFAAVVVS

SEQ ID NO: 313033 - protein, 26 aa, Mycobacterium
ILLICGACGLLGLWYAGRGLDRNPRR

SEQ ID NO: 313034 - protein, 19 aa, Mycobacterium
ILLILGITCLIPAGGLALP

SEQ ID NO: 313035 - protein, 19 aa, Mycobacterium
ILLILGVVGCVIGLKVVSH

SEQ ID NO: 313036 - protein, 19 aa, Mycobacterium
ILLIPGIILALIGAHLALV

SEQ ID NO: 313037 - protein, 24 aa, Mycobacterium
ILLIPILIALAFSVVVFAFYIAIA

SEQ ID NO: 313038 - protein, 25 aa, Mycobacterium
ILLKRFTPQQIMVWALAASSVFGLV

SEQ ID NO: 313039 - protein, 19 aa, Mycobacterium
ILLLFCVAGLAFVDGSRVS

SEQ ID NO: 313040 - protein, 20 aa, Mycobacterium
ILLLGSRSKTAWILGTACLG

SEQ ID NO: 313041 - protein, 19 aa, Mycobacterium
ILLLPGIILALIGMHMALV

SEQ ID NO: 313042 - protein, 26 aa, Mycobacterium
ILLLWPKLPPKIRMVPGALVAIVTAT

SEQ ID NO: 313043 - protein, 17 aa, Mycobacterium
ILLNSEFSGPQIKEVSH

SEQ ID NO: 313044 - protein, 17 aa, Mycobacterium
ILLQEIFAAYRGQRLPA

SEQ ID NO: 313045 - protein, 18 aa, Mycobacterium
ILLRGFTFGIDFEGGTKV

SEQ ID NO: 313046 - protein, 24 aa, Mycobacterium
ILLSGLWGSFGMLVFVFVAGGLAD

SEQ ID NO: 313047 - protein, 19 aa, Mycobacterium
ILLSIPFNALSVFIINVLL

SEQ ID NO: 313048 - protein, 17 aa, Mycobacterium
ILLTITVVYLWDISQNG

SEQ ID NO: 313049 - protein, 18 aa, Mycobacterium
ILLVAGLLTMVIGIFGAI

SEQ ID NO: 313050 - protein, 20 aa, Mycobacterium
ILLVATMLVATAWWLFEWEI

SEQ ID NO: 313051 - protein, 17 aa, Mycobacterium
ILLVFGLGAFLSAVLFA

SEQ ID NO: 313052 - protein, 32 aa, Mycobacterium
ILLVIGMYVLLRFSLRTPPVFRSGATPHTAKF

SEQ ID NO: 313053 - protein, 19 aa, Mycobacterium
ILLVSTLLVASAWWLFEWE

SEQ ID NO: 313054 - protein, 21 aa, Mycobacterium
ILLVVGWCVGIFVWTMPVEKL

SEQ ID NO: 313055 - protein, 24 aa, Mycobacterium
ILLWGSAGALGFVERDLGIRIIFG

SEQ ID NO: 313056 - protein, 20 aa, Mycobacterium
ILLWGSAGLFGFVENNLGLK

SEQ ID NO: 313057 - protein, 25 aa, Mycobacterium
ILLYAVCVVLRLARYNALLEDGSQP

SEQ ID NO: 313058 - protein, 19 aa, Mycobacterium
ILLYILGAWLFASATAGLG

SEQ ID NO: 313059 - protein, 19 aa, Mycobacterium
ILLYILGAWVFASATRGLG

SEQ ID NO: 313060 - protein, 21 aa, Mycobacterium
ILLYILVGWLIVFSTKGIEGF

SEQ ID NO: 313061 - protein, 17 aa, Mycobacterium
ILMDLGLASHEIAQVIL

SEQ ID NO: 313062 - protein, 20 aa, Mycobacterium
ILMGFEFRQGLIASLMWLCV

SEQ ID NO: 313063 - protein, 18 aa, Mycobacterium
ILMLPRLFPGSFEADPER

SEQ ID NO: 313064 - protein, 18 aa, Mycobacterium
ILMPQMRAQIPFQIASMK

SEQ ID NO: 313065 - protein, 18 aa, Mycobacterium
ILNRQGLYGDFFSFYLCD

SEQ ID NO: 313066 - protein, 18 aa, Mycobacterium
ILPALAWTPVATVVAVLT

SEQ ID NO: 313067 - protein, 21 aa, Mycobacterium
ILPFCALAGAIVIPSRDDSRF

SEQ ID NO: 313068 - protein, 18 aa, Mycobacterium
ILPFFALIAMYRQIDDLS

SEQ ID NO: 313069 - protein, 17 aa, Mycobacterium
ILPGAPPTGAWIDVAVI

SEQ ID NO: 313070 - protein, 27 aa, Mycobacterium
ILPHGYLGIWAAIPFAIWFFLAVEGVP

SEQ ID NO: 313071 - protein, 20 aa, Mycobacterium
ILPMVRLAQQRGIDWRAVYA

SEQ ID NO: 313072 - protein, 24 aa, Mycobacterium
ILPTRLFGSPVFTVCCVLSFVVGF

SEQ ID NO: 313073 - protein, 23 aa, Mycobacterium
ILQHSWSLTGRKIYPPVEQLLTQ

SEQ ID NO: 313074 - protein, 25 aa, Mycobacterium
ILQILKANGIPLNRMVDIRSNPALR

SEQ ID NO: 313075 - protein, 25 aa, Mycobacterium
ILQILKANGIPLNRMVDIRSNPVLR

SEQ ID NO: 313076 - protein, 24 aa, Mycobacterium
ILQTRIGFHYGFGAAAIGMALGLV

SEQ ID NO: 313077 - protein, 19 aa, Mycobacterium
ILRAPRLVVPGALLALGLA

SEQ ID NO: 313078 - protein, 25 aa, Mycobacterium
ILRCGLERPVDFVVGAPLQVVDLVQ

SEQ ID NO: 313079 - protein, 23 aa, Mycobacterium
ILRGTEQAFGWSLFDGGSTFATK

SEQ ID NO: 313080 - protein, 21 aa, Mycobacterium
ILRIVGIEWRGKINDPQWRRW

SEQ ID NO: 313081 - protein, 18 aa, Mycobacterium
ILRLLGSGGMGEVYLAKH

SEQ ID NO: 313082 - protein, 22 aa, Mycobacterium
ILRRLTVLVVLVFAQAGVGTVQ

SEQ ID NO: 313083 - protein, 27 aa, Mycobacterium
ILRRQARCRPDHPFLVCDSDRISYAQA

SEQ ID NO: 313084 - protein, 17 aa, Mycobacterium
ILRRYYRATYALIPVAG

SEQ ID NO: 313085 - protein, 22 aa, Mycobacterium
ILRVDGPVPFAPRVTTEGVEVA

SEQ ID NO: 313086 - protein, 17 aa, Mycobacterium
ILRVFARLRRGEFDPET

SEQ ID NO: 313087 - protein, 33 aa, Mycobacterium
ILSCGALINGVREFPGPLALVPVVATLLLILSA

SEQ ID NO: 313088 - protein, 23 aa, Mycobacterium
ILSGTSVAFGWSLFDSGSTFATH

SEQ ID NO: 313089 - protein, 24 aa, Mycobacterium
ILSIGMVLAALVIASAFATSTTIN

SEQ ID NO: 313090 - protein, 26 aa, Mycobacterium
ILSIIACVWLMLNLTGLTWIRFSVWM

SEQ ID NO: 313091 - protein, 17 aa, Mycobacterium
ILSKLALRDALSRGFRT

SEQ ID NO: 313092 - protein, 21 aa, Mycobacterium
ILSMRRTRLFGATGTVLMAIG

SEQ ID NO: 313093 - protein, 25 aa, Mycobacterium
ILSRCVLPRLGRRLAGNRVAVLTAG

SEQ ID NO: 313094 - protein, 17 aa, Mycobacterium
ILSVFGFIVMFGGVVFA

SEQ ID NO: 313095 - protein, 17 aa, Mycobacterium
ILTLAGLGFLGFGIEPT

SEQ ID NO: 313096 - protein, 17 aa, Mycobacterium
ILTRRVAAAKALLIGCT

SEQ ID NO: 313097 - protein, 25 aa, Mycobacterium
ILTVLAVLFMMVWISPLLALITVLT

SEQ ID NO: 313098 - protein, 18 aa, Mycobacterium
ILTWNRIGAAYGSFKDYG

SEQ ID NO: 313099 - protein, 18 aa, Mycobacterium
ILVAALTTPILLWGGYPF

SEQ ID NO: 313100 - protein, 23 aa, Mycobacterium
ILVALILVLWVARSLVRPLRTLR

SEQ ID NO: 313101 - protein, 25 aa, Mycobacterium
ILVALRLLQGFAVGGEWAGSALLSA

SEQ ID NO: 313102 - protein, 25 aa, Mycobacterium
ILVALRLLQGFAVGGEWAGSALLSI

SEQ ID NO: 313103 - protein, 27 aa, Mycobacterium
ILVGLSPDRFVAWATMVRYQALFTEAG

SEQ ID NO: 313104 - protein, 17 aa, Mycobacterium
ILVGTYFSSWVLADVTT

SEQ ID NO: 313105 - protein, 18 aa, Mycobacterium
ILVIRWRLPSGVEIDTGF

SEQ ID NO: 313106 - protein, 18 aa, Mycobacterium
ILVLAIAASTVWTVLDRR

SEQ ID NO: 313107 - protein, 18 aa, Mycobacterium
ILVLCALVGFVYGPIAPI

SEQ ID NO: 313108 - protein, 26 aa, Mycobacterium
ILVPKAARLDAALMLLAVFAGIAMFG

SEQ ID NO: 313109 - protein, 17 aa, Mycobacterium
ILVQLAFAELIASGALD

SEQ ID NO: 313110 - protein, 17 aa, Mycobacterium
ILVQLAWVVYALPFLGV

SEQ ID NO: 313111 - protein, 18 aa, Mycobacterium
ILVSIPFGVIVAVQAGSI

SEQ ID NO: 313112 - protein, 20 aa, Mycobacterium
ILVSVPFTVLLIFTLNVLLA

SEQ ID NO: 313113 - protein, 18 aa, Mycobacterium
ILVTSILVLIAFPPLTAA

SEQ ID NO: 313114 - protein, 19 aa, Mycobacterium
ILVTSILVLLAFPILTAAL

SEQ ID NO: 313115 - protein, 18 aa, Mycobacterium
ILVTSVLVLLAFPLLTAA

SEQ ID NO: 313116 - protein, 19 aa, Mycobacterium
ILVTSWLVLIAFPLLTAAL

SEQ ID NO: 313117 - protein, 18 aa, Mycobacterium
ILVVFVGLIVWRTAELRT

SEQ ID NO: 313118 - protein, 28 aa, Mycobacterium
ILVVIWLSLCRWDLLGPLRFVGLSNWRS

SEQ ID NO: 313119 - protein, 25 aa, Mycobacterium
ILVVLLAALLIKWTYGPASDAQTPA

SEQ ID NO: 313120 - protein, 17 aa, Mycobacterium
ILVVPVALATIIAALLL

SEQ ID NO: 313121 - protein, 28 aa, Mycobacterium
ILVVVWLSLCRWDLLGPIEFVGLDNWRS

SEQ ID NO: 313122 - protein, 22 aa, Mycobacterium
ILWDVIPFDWANDSNTAATRYM

SEQ ID NO: 313123 - protein, 19 aa, Mycobacterium
ILWFGGWLIPLLAIWAYWQ

SEQ ID NO: 313124 - protein, 24 aa, Mycobacterium
ILWHGRKGFGAGIMVSTIAVGILG

SEQ ID NO: 313125 - protein, 20 aa, Mycobacterium
ILWNLAGPLTILGVTVPKAL

SEQ ID NO: 313126 - protein, 17 aa, Mycobacterium
ILWNLSGDFNLFGVNVP

SEQ ID NO: 313127 - protein, 23 aa, Mycobacterium
ILWNLSGPVTLPFIGYELPKAMF

SEQ ID NO: 313128 - protein, 24 aa, Mycobacterium
IMAALRYPVRVGFLAGLTVAQISE

SEQ ID NO: 313129 - protein, 21 aa, Mycobacterium
IMALYLWHMIPVVIVAIVGYP

SEQ ID NO: 313130 - protein, 25 aa, Mycobacterium
IMANLRIGYDTVVWVTSAYLLGYAV

SEQ ID NO: 313131 - protein, 24 aa, Mycobacterium
IMASRLAFGMAEHRLLPSVLSRVL

SEQ ID NO: 313132 - protein, 17 aa, Mycobacterium
IMCVGGIFMAIHQDAGL

SEQ ID NO: 313133 - protein, 18 aa, Mycobacterium
IMGATVLLGAVVGGVLLD

SEQ ID NO: 313134 - protein, 17 aa, Mycobacterium
IMGCVFTLITAVVFVTQ

SEQ ID NO: 313135 - protein, 27 aa, Mycobacterium
IMGPLGGWCMKKIDAIWDGKIRPGFEM

SEQ ID NO: 313136 - protein, 18 aa, Mycobacterium
IMIFVGGDFVVTVRHGDH

SEQ ID NO: 313137 - protein, 21 aa, Mycobacterium
IMLVLIGFSYFYARLQVDPVP

SEQ ID NO: 313138 - protein, 23 aa, Mycobacterium
IMPAVLRRPLPYTPLMYGPVVLL

SEQ ID NO: 313139 - protein, 21 aa, Mycobacterium
IMPAYVVTVLFAYVLYHFREA

SEQ ID NO: 313140 - protein, 18 aa, Mycobacterium
IMPPGGFIPLSRTSPALD

SEQ ID NO: 313141 - protein, 17 aa, Mycobacterium
IMPTILVALPIGATLSI

SEQ ID NO: 313142 - protein, 17 aa, Mycobacterium
IMQTGAFVGRCTEMCGT

SEQ ID NO: 313143 - protein, 25 aa, Mycobacterium
IMRVFAEFMPVHFFAQPVVTLMGLG

SEQ ID NO: 313144 - protein, 19 aa, Mycobacterium
IMSICCVAWLLGNVLAVKV

SEQ ID NO: 313145 - protein, 18 aa, Mycobacterium
IMSRHLSQAWTLRADEVI

SEQ ID NO: 313146 - protein, 19 aa, Mycobacterium
IMTHLLPLFRGMQSLIDGI

SEQ ID NO: 313147 - protein, 25 aa, Mycobacterium
IMTSLRIGYDTVVWVTSAYLLGYAV

SEQ ID NO: 313148 - protein, 30 aa, Mycobacterium
IMTVMGRWFWWPKRVRVRPASQMLRSVGPR

SEQ ID NO: 313149 - protein, 19 aa, Mycobacterium
IMVAIEFSNLSALLAPRTG

SEQ ID NO: 313150 - protein, 31 aa, Mycobacterium
IMVGALVFSGIFGWKVWQQHQIDAAGEQALA

SEQ ID NO: 313151 - protein, 18 aa, Mycobacterium
IMVGCGFLLGVTGQMVKL

SEQ ID NO: 313152 - protein, 21 aa, Mycobacterium
IMVRPSIGFTVCTGASACTVD

SEQ ID NO: 313153 - protein, 18 aa, Mycobacterium
IMWLGKLLTPWTRAQPRS

SEQ ID NO: 313154 - protein, 18 aa, Mycobacterium
INAILGVLLLIVLATGSL

SEQ ID NO: 313155 - protein, 18 aa, Mycobacterium
INAILGVLLLIVLATGSV

SEQ ID NO: 313156 - protein, 22 aa, Mycobacterium
INALICLVAFRVTTARALTYRQ

SEQ ID NO: 313157 - protein, 21 aa, Mycobacterium
INAVLRRSRLLGVSLAVGVVV

SEQ ID NO: 313158 - protein, 18 aa, Mycobacterium
INCLGVKWMSRVNSAGVV

SEQ ID NO: 313159 - protein, 25 aa, Mycobacterium
INCQRAIPHVIDWYNRYHDAGFVVI

SEQ ID NO: 313160 - protein, 25 aa, Mycobacterium
INCQRAIPHVVDWYDRYHDAGFVVI

SEQ ID NO: 313161 - protein, 26 aa, Mycobacterium
INCQRAIPHVVGWYNAYKDQGFEVIG

SEQ ID NO: 313162 - protein, 27 aa, Mycobacterium
INCQRAIPHVVGWYRAYKDSGLEVIGV

SEQ ID NO: 313163 - protein, 25 aa, Mycobacterium
INDKSWLLFGPFAGWSPKFLKQGKV

SEQ ID NO: 313164 - protein, 17 aa, Mycobacterium
INEARQVAEVLIKDGKI

SEQ ID NO: 313165 - protein, 18 aa, Mycobacterium
INEARWVRGAVPFQGDIG

SEQ ID NO: 313166 - protein, 19 aa, Mycobacterium
INEARWVRGAVPFQGDITS

SEQ ID NO: 313167 - protein, 20 aa, Mycobacterium
INECHRLCVDYAKTRTLWGK

SEQ ID NO: 313168 - protein, 28 aa, Mycobacterium
INELYADRHIRLWVVYVDNFSGQSAMNW

SEQ ID NO: 313169 - protein, 17 aa, Mycobacterium
INFILVAGVVYFLVVVP

SEQ ID NO: 313170 - protein, 23 aa, Mycobacterium
INGFGFLAVYALIGIPIARISDR

SEQ ID NO: 313171 - protein, 27 aa, Mycobacterium
INGLGPLPWRAVLGIAAALCAVAAVIA

SEQ ID NO: 313172 - protein, 22 aa, Mycobacterium
INGSRARLPFNLDPARTPVLGS

SEQ ID NO: 313173 - protein, 23 aa, Mycobacterium
INGSRARLPFNLDPARTPVLGSW

SEQ ID NO: 313174 - protein, 18 aa, Mycobacterium
INGSRARLPYGLNPATTP

SEQ ID NO: 313175 - protein, 25 aa, Mycobacterium
INGVKEFPGPWALVPVGAAMLMIMA

SEQ ID NO: 313176 - protein, 25 aa, Mycobacterium
INGVKEFPGPWALVPVGATMVMILA

SEQ ID NO: 313177 - protein, 22 aa, Mycobacterium
INKLSRNWFEHMWMADRDVPNM

SEQ ID NO: 313178 - protein, 21 aa, Mycobacterium
INLGPRIGRFLPDGTAVTIRP

SEQ ID NO: 313179 - protein, 17 aa, Mycobacterium
INLGRWMPLGATVILAV

SEQ ID NO: 313180 - protein, 26 aa, Mycobacterium
INLIAITFFLVFAIIAYTIIFAILLI

SEQ ID NO: 313181 - protein, 21 aa, Mycobacterium
INLKPALAHTVPRSVTARVVP

SEQ ID NO: 313182 - protein, 19 aa, Mycobacterium
INLLLVFGISFEFPLLIIM

SEQ ID NO: 313183 - protein, 19 aa, Mycobacterium
INLLPLLPFDGGHIAVATY

SEQ ID NO: 313184 - protein, 18 aa, Mycobacterium
INLLPLLPFDGGHIAVAV

SEQ ID NO: 313185 - protein, 19 aa, Mycobacterium
INLLPLLPFDGGHIAVAVF

SEQ ID NO: 313186 - protein, 29 aa, Mycobacterium
INLVLNAGWSWLFFRFHRLGASALGAAVL

SEQ ID NO: 313187 - protein, 39 aa, Mycobacterium
INMWAGANTGWWPVLWFTAKMWTFLFIYFWLRASLPRLR

SEQ ID NO: 313188 - protein, 25 aa, Mycobacterium
INNARDFLRIDIIIFGLIVYALLGI

SEQ ID NO: 313189 - protein, 23 aa, Mycobacterium
INNARDFLRIDIVIFGLTIYALL

SEQ ID NO: 313190 - protein, 26 aa, Mycobacterium
INPDLRRPALGWVLFTVLIGWSAACA

SEQ ID NO: 313191 - protein, 18 aa, Mycobacterium
INPGYVRTPLVTKQIADQ

SEQ ID NO: 313192 - protein, 24 aa, Mycobacterium
INPLRFAARALNLWSSDLPFGQAQ

SEQ ID NO: 313193 - protein, 19 aa, Mycobacterium
INPRLDILAIAGGWTALTM

SEQ ID NO: 313194 - protein, 17 aa, Mycobacterium
INPVLSCGSVMVTWQAS

SEQ ID NO: 313195 - protein, 21 aa, Mycobacterium
INQILRFITYLLIPAGALIIY

SEQ ID NO: 313196 - protein, 21 aa, Mycobacterium
INRLRAPLKVLSDYSPEFGCL

SEQ ID NO: 313197 - protein, 27 aa, Mycobacterium
INRRAVLKSSYAQFFFLLSGADHDQMD

SEQ ID NO: 313198 - protein, 25 aa, Mycobacterium
INSGQRGQVMWSFLIGAAVMAIAGL

SEQ ID NO: 313199 - protein, 25 aa, Mycobacterium
INSGQRSQVFWSFLIGAVVMAAAGL

SEQ ID NO: 313200 - protein, 24 aa, Mycobacterium
INSMSAELVVLVLLIITALAFDFT

SEQ ID NO: 313201 - protein, 25 aa, Mycobacterium
INSVSWLPLFHDMGLLMIMFPALAG

SEQ ID NO: 313202 - protein, 26 aa, Mycobacterium
INVPLRLTIFQPYSWVAAAAVLVLLA

SEQ ID NO: 313203 - protein, 17 aa, Mycobacterium
IPAAASFTNVAGHGVRA

SEQ ID NO: 313204 - protein, 18 aa, Mycobacterium
IPAAFSWFLIEKRALALK

SEQ ID NO: 313205 - protein, 23 aa, Mycobacterium
IPAAMAVLGDRMWSRSKWFDRYV

SEQ ID NO: 313206 - protein, 18 aa, Mycobacterium
IPAATAFANVAGHGVRAE

SEQ ID NO: 313207 - protein, 18 aa, Mycobacterium
IPAATSFTNLAGHGVRAE

SEQ ID NO: 313208 - protein, 20 aa, Mycobacterium
IPACIAICMHFDLLWLGITL

SEQ ID NO: 313209 - protein, 17 aa, Mycobacterium
IPACTTNPICAHARAQL

SEQ ID NO: 313210 - protein, 17 aa, Mycobacterium
IPADEPVAAVLSRMASG

SEQ ID NO: 313211 - protein, 20 aa, Mycobacterium
IPADLRAEVRSVSAVGEQYV

SEQ ID NO: 313212 - protein, 26 aa, Mycobacterium
IPAFLLIRFGGIYPVIFIGVLLIGLM

SEQ ID NO: 313213 - protein, 17 aa, Mycobacterium
IPAFRHAEIAPKVREIC

SEQ ID NO: 313214 - protein, 17 aa, Mycobacterium
IPAGWSFAEAASAPIVF

SEQ ID NO: 313215 - protein, 20 aa, Mycobacterium
IPAIIRGLIAVAWYGIQTFL

SEQ ID NO: 313216 - protein, 20 aa, Mycobacterium
IPAIIRGLIAVAWYGIQTYL

SEQ ID NO: 313217 - protein, 18 aa, Mycobacterium
IPAIRRPLLTGIRLAVSL

SEQ ID NO: 313218 - protein, 25 aa, Mycobacterium
IPALIRGAVAIAWFGIQTYLASVVL

SEQ ID NO: 313219 - protein, 25 aa, Mycobacterium
IPALPRRPKPAIDYLGIMVITLATT

SEQ ID NO: 313220 - protein, 20 aa, Mycobacterium
IPALQFTNWQWLALTLASPV

SEQ ID NO: 313221 - protein, 27 aa, Mycobacterium
IPANRERVVAVSFPRDLEIEPMKCEPW

SEQ ID NO: 313222 - protein, 26 aa, Mycobacterium
IPANRKRVVAVSFPRDLAITPVKCEA

SEQ ID NO: 313223 - protein, 23 aa, Mycobacterium
IPAPLLATMFDFFYQPGKMPASL

SEQ ID NO: 313224 - protein, 17 aa, Mycobacterium
IPARLQPDVFERFARGD

SEQ ID NO: 313225 - protein, 20 aa, Mycobacterium
IPARPDTRFVAGMATADKVN

SEQ ID NO: 313226 - protein, 21 aa, Mycobacterium
IPARWSLVAVCLVIVAASGLL

SEQ ID NO: 313227 - protein, 17 aa, Mycobacterium
IPASLPTNIGYAAAERH

SEQ ID NO: 313228 - protein, 27 aa, Mycobacterium
IPASRERVVAVSFPRDLAITPMKCEPW

SEQ ID NO: 313229 - protein, 26 aa, Mycobacterium
IPATLLFFRYRWLRAEPLPTPRPANT

SEQ ID NO: 313230 - protein, 18 aa, Mycobacterium
IPAVASRSGDLPPAVNVP

SEQ ID NO: 313231 - protein, 24 aa, Mycobacterium
IPAVAVGYALSRWVNRHLDRNRQR

SEQ ID NO: 313232 - protein, 34 aa, Mycobacterium
IPDDVGWLRLPVFAWPTHPSWLYRLTQGVHVGLG

SEQ ID NO: 313233 - protein, 19 aa, Mycobacterium
IPDILALPGALPGRPETRH

SEQ ID NO: 313234 - protein, 23 aa, Mycobacterium
IPDRPHDWIECGEWIRELRPHID

SEQ ID NO: 313235 - protein, 18 aa, Mycobacterium
IPDVALRGAELAQVSVIT

SEQ ID NO: 313236 - protein, 23 aa, Mycobacterium
IPDVLRPDLTIAYTDTDGDGQRG

SEQ ID NO: 313237 - protein, 23 aa, Mycobacterium
IPDVLRPDLTIAYTDTDGNGQRG

SEQ ID NO: 313238 - protein, 24 aa, Mycobacterium
IPDVLRPDLTIAYTDTDGYGERGD

SEQ ID NO: 313239 - protein, 23 aa, Mycobacterium
IPEARAALDVVRRRFGGRVPLPR

SEQ ID NO: 313240 - protein, 24 aa, Mycobacterium
IPEDSRLPTVLFQTTLSKLRDLLA

SEQ ID NO: 313241 - protein, 25 aa, Mycobacterium
IPEITTRLSEHFRAPVVTSPRPQLA

SEQ ID NO: 313242 - protein, 21 aa, Mycobacterium
IPESPRWLLRQGRISDAEDVV

SEQ ID NO: 313243 - protein, 21 aa, Mycobacterium
IPFLIISVLFYFTVVVQERMM

SEQ ID NO: 313244 - protein, 24 aa, Mycobacterium
IPFLVYMASYWSWFASETGINRHA

SEQ ID NO: 313245 - protein, 17 aa, Mycobacterium
IPFVWNVFKSWRYGEVV

SEQ ID NO: 313246 - protein, 35 aa, Mycobacterium
IPGAAGIAMMTFVGAALGYRQAKAGHTVRASAAAR

SEQ ID NO: 313247 - protein, 30 aa, Mycobacterium
IPGCLVALYFVARLRHRGMDAAGNMADEPG

SEQ ID NO: 313248 - protein, 30 aa, Mycobacterium
IPGCLVALYFVARLRHRGMDAGGYMPDEPG

SEQ ID NO: 313249 - protein, 21 aa, Mycobacterium
IPGDEYVTWAALLWLTVFTTG

SEQ ID NO: 313250 - protein, 23 aa, Mycobacterium
IPGELRLAVRESLMGLLSEQSSL

SEQ ID NO: 313251 - protein, 18 aa, Mycobacterium
IPGFPDFGAPDMPIPVLA

SEQ ID NO: 313252 - protein, 25 aa, Mycobacterium
IPGGELRLRIEYDTALFDVCGIETF

SEQ ID NO: 313253 - protein, 22 aa, Mycobacterium
IPGGSWRGSAAQAYLVQNLAQS

SEQ ID NO: 313254 - protein, 17 aa, Mycobacterium
IPGIADGTLTMAFAITE

SEQ ID NO: 313255 - protein, 17 aa, Mycobacterium
IPGIGFPQVPQVPQIPQ

SEQ ID NO: 313256 - protein, 19 aa, Mycobacterium
IPGIPGMARRHYAPGTATS

SEQ ID NO: 313257 - protein, 19 aa, Mycobacterium
IPGIRMVQSASRPAGTIPE

SEQ ID NO: 313258 - protein, 27 aa, Mycobacterium
IPGLPDFKWPPVPGIPDFNLPIPGLPE

SEQ ID NO: 313259 - protein, 23 aa, Mycobacterium
IPGQRWFAWLSILAIPTPFLANS

SEQ ID NO: 313260 - protein, 19 aa, Mycobacterium
IPGQVPGAPGPVPLPGQLP

SEQ ID NO: 313261 - protein, 26 aa, Mycobacterium
IPGRARARRALLLLSLSDFHEITDSI

SEQ ID NO: 313262 - protein, 22 aa, Mycobacterium
IPGRRWFAWFALLTIPAPFLAN

SEQ ID NO: 313263 - protein, 30 aa, Mycobacterium
IPGSVKTVWLRPGNRLGFFTHMGTQFSVTV

SEQ ID NO: 313264 - protein, 35 aa, Mycobacterium
IPIAALEIMRARLTPAAFERSAALASTYVGDDAVA

SEQ ID NO: 313265 - protein, 25 aa, Mycobacterium
IPIALFMGCYLRFLRPGRVAEVSVI

SEQ ID NO: 313266 - protein, 26 aa, Mycobacterium
IPIALFMGCYLRFLRPGRVMEVSVIG

SEQ ID NO: 313267 - protein, 25 aa, Mycobacterium
IPIAVFMGCYLRFLRPGRVAEVSLI

SEQ ID NO: 313268 - protein, 17 aa, Mycobacterium
IPICALLTYNAVSTILE

SEQ ID NO: 313269 - protein, 18 aa, Mycobacterium
IPICFAIRSVFQALDGTD

SEQ ID NO: 313270 - protein, 17 aa, Mycobacterium
IPIEVNFTQRVAVDVTL

SEQ ID NO: 313271 - protein, 17 aa, Mycobacterium
IPIGLVWLAFLPNAPYL

SEQ ID NO: 313272 - protein, 19 aa, Mycobacterium
IPIISFWVAPVATRAAVER

SEQ ID NO: 313273 - protein, 18 aa, Mycobacterium
IPILGGFAGVLTSPAAFL

SEQ ID NO: 313274 - protein, 18 aa, Mycobacterium
IPITLRFVPETFRIQGRR

SEQ ID NO: 313275 - protein, 29 aa, Mycobacterium
IPIVAEHKVFFCVASILLVMALNLRGVRE

SEQ ID NO: 313276 - protein, 17 aa, Mycobacterium
IPIVAFMTVGGPAMGSA

SEQ ID NO: 313277 - protein, 17 aa, Mycobacterium
IPIVALMTVGGPAIGTA

SEQ ID NO: 313278 - protein, 19 aa, Mycobacterium
IPIVILWVLLACGLNAAGP

SEQ ID NO: 313279 - protein, 20 aa, Mycobacterium
IPIVLFWVGVAVLLSVLVPK

SEQ ID NO: 313280 - protein, 18 aa, Mycobacterium
IPIVLGMILLVIPLFNLS

SEQ ID NO: 313281 - protein, 18 aa, Mycobacterium
IPKFRISPDYYAKLQSTD

SEQ ID NO: 313282 - protein, 18 aa, Mycobacterium
IPKWKTIVRIVVPTALPG

SEQ ID NO: 313283 - protein, 28 aa, Mycobacterium
IPLAAGVLYPLLGLRLSPMIAAGAMALS

SEQ ID NO: 313284 - protein, 18 aa, Mycobacterium
IPLADIESNGAWEPDQFK

SEQ ID NO: 313285 - protein, 20 aa, Mycobacterium
IPLAIGMSVVVLASLTMGAA

SEQ ID NO: 313286 - protein, 18 aa, Mycobacterium
IPLAIGMTVVVLTALAVG

SEQ ID NO: 313287 - protein, 19 aa, Mycobacterium
IPLAQELFMLDPTNMKVTS

SEQ ID NO: 313288 - protein, 18 aa, Mycobacterium
IPLEIFRYRDFALSSLGV

SEQ ID NO: 313289 - protein, 17 aa, Mycobacterium
IPLFALIGVLIVAWRRT

SEQ ID NO: 313290 - protein, 19 aa, Mycobacterium
IPLGGAVSVFGHRTPLQLT

SEQ ID NO: 313291 - protein, 17 aa, Mycobacterium
IPLGTAAALEFLGPLSV

SEQ ID NO: 313292 - protein, 21 aa, Mycobacterium
IPLIPHRASFWALSSLSRPAM

SEQ ID NO: 313293 - protein, 34 aa, Mycobacterium
IPLLCISLSIPAFLWGIRYARARAVTYGESVAYV

SEQ ID NO: 313294 - protein, 22 aa, Mycobacterium
IPLLFAVAALWLTRGGRIPNQR

SEQ ID NO: 313295 - protein, 18 aa, Mycobacterium
IPLLIGVVVLVGAFTVMR

SEQ ID NO: 313296 - protein, 19 aa, Mycobacterium
IPLLLVVLMYLGFAATGSV

SEQ ID NO: 313297 - protein, 17 aa, Mycobacterium
IPLMIIAGVATYFNSRA

SEQ ID NO: 313298 - protein, 17 aa, Mycobacterium
IPLMMVPFWDVEASVAE

SEQ ID NO: 313299 - protein, 17 aa, Mycobacterium
IPLNAPNSFGLFSNGGD

SEQ ID NO: 313300 - protein, 30 aa, Mycobacterium
IPLPGRVRWQRGYCRLMLRCLGVRISVSGG

SEQ ID NO: 313301 - protein, 21 aa, Mycobacterium
IPLPLAIQAPRLFTGEIAFGD

SEQ ID NO: 313302 - protein, 20 aa, Mycobacterium
IPLRVSLVAATLVLVLCGLL

SEQ ID NO: 313303 - protein, 17 aa, Mycobacterium
IPLSFVVLVWVFGGLLA

SEQ ID NO: 313304 - protein, 23 aa, Mycobacterium
IPLTGWAADRFGTKRIFIGSVVA

SEQ ID NO: 313305 - protein, 23 aa, Mycobacterium
IPLYCIGLWMSFYAARFATTSVY

SEQ ID NO: 313306 - protein, 23 aa, Mycobacterium
IPLYCVAVVCAFQAARFGTTGIY

SEQ ID NO: 313307 - protein, 24 aa, Mycobacterium
IPLYSLSVLAAFFASRATTVMING

SEQ ID NO: 313308 - protein, 24 aa, Mycobacterium
IPLYSVAVLLSFFSAQLVTTLFYA

SEQ ID NO: 313309 - protein, 19 aa, Mycobacterium
IPMAVGMTIAVVAALTLGP

SEQ ID NO: 313310 - protein, 34 aa, Mycobacterium
IPMGVPLEWNVFMIFCVATLFVGHADVGITDLST

SEQ ID NO: 313311 - protein, 22 aa, Mycobacterium
IPMGVPLEWNVFMIFGVLALFV

SEQ ID NO: 313312 - protein, 22 aa, Mycobacterium
IPMGVPLEWNVFMIFGVLSLFV

SEQ ID NO: 313313 - protein, 21 aa, Mycobacterium
IPMGVPLEWNVFMMFSVLALF

SEQ ID NO: 313314 - protein, 17 aa, Mycobacterium
IPMILGVHSHDWELVGI

SEQ ID NO: 313315 - protein, 25 aa, Mycobacterium
IPMLCAVAFDLAERRFWLIPLGLVW

SEQ ID NO: 313316 - protein, 20 aa, Mycobacterium
IPMQRVSIFLSVLDAHVQRA

SEQ ID NO: 313317 - protein, 18 aa, Mycobacterium
IPMVARRLITLCPALVIL

SEQ ID NO: 313318 - protein, 21 aa, Mycobacterium
IPMVLAPAFGPVLGGWLIDSY

SEQ ID NO: 313319 - protein, 22 aa, Mycobacterium
IPNGTFFVVLAIFLIVLAVIGT

SEQ ID NO: 313320 - protein, 17 aa, Mycobacterium
IPPAHRAAIEFNPPLPT

SEQ ID NO: 313321 - protein, 20 aa, Mycobacterium
IPPALAAPSLNRGVGFTHEQ

SEQ ID NO: 313322 - protein, 33 aa, Mycobacterium
IPPFLPRMIHKLALPIVLVWLGIVFVTNTVAPQ

SEQ ID NO: 313323 - protein, 33 aa, Mycobacterium
IPPFLPRMIHRLALPIVLVWLGIVFVTNTVAPQ

SEQ ID NO: 313324 - protein, 20 aa, Mycobacterium
IPPNVSWIVWQLALVVLLVA

SEQ ID NO: 313325 - protein, 24 aa, Mycobacterium
IPPPEGKPWWLIVVGVVVIGLLGG

SEQ ID NO: 313326 - protein, 23 aa, Mycobacterium
IPPPEGKPWWLIVVGVVVVGLLG

SEQ ID NO: 313327 - protein, 20 aa, Mycobacterium
IPPQVYWMVLQLALAVALLA

SEQ ID NO: 313328 - protein, 17 aa, Mycobacterium
IPPRGGKPPLRQRNWGW

SEQ ID NO: 313329 - protein, 32 aa, Mycobacterium
IPPRLGGKLRTSRQFNWGWVLALVLVVLALAA

SEQ ID NO: 313330 - protein, 18 aa, Mycobacterium
IPPWMVFFSFSISLIYQF

SEQ ID NO: 313331 - protein, 20 aa, Mycobacterium
IPPWMVFFSFSVNLIYQFWI

SEQ ID NO: 313332 - protein, 19 aa, Mycobacterium
IPPWVVFAAFSVNLIYQFW

SEQ ID NO: 313333 - protein, 22 aa, Mycobacterium
IPQEWAQFLPGYGVTRLLFDTS

SEQ ID NO: 313334 - protein, 26 aa, Mycobacterium
IPQGFPADVLYEFRLVSLGTQLVLWA

SEQ ID NO: 313335 - protein, 22 aa, Mycobacterium
IPQMITRFALVFAAGAVLHQFQ

SEQ ID NO: 313336 - protein, 17 aa, Mycobacterium
IPQSAFGGSRFGGNVGP

SEQ ID NO: 313337 - protein, 24 aa, Mycobacterium
IPRAGMGAASFPWPPPSQPDRPPY

SEQ ID NO: 313338 - protein, 17 aa, Mycobacterium
IPRAIGLALVIALLTYA

SEQ ID NO: 313339 - protein, 17 aa, Mycobacterium
IPRALRALSRSPITTFD

SEQ ID NO: 313340 - protein, 28 aa, Mycobacterium
IPRGAVPSVPRWLWVVLAIGGITAALAG

SEQ ID NO: 313341 - protein, 21 aa, Mycobacterium
IPRGGGQLHEPIPLERTTSPY

SEQ ID NO: 313342 - protein, 24 aa, Mycobacterium
IPRGVVPTIPWWMWLLVAFGALTA

SEQ ID NO: 313343 - protein, 19 aa, Mycobacterium
IPRLFAWPPARSIAQLLER

SEQ ID NO: 313344 - protein, 18 aa, Mycobacterium
IPRMPGQLPFPRDFDMET

SEQ ID NO: 313345 - protein, 25 aa, Mycobacterium
IPRPWRPVWIGWWLGVAASVAATAT

SEQ ID NO: 313346 - protein, 21 aa, Mycobacterium
IPRSGEAILSILSVLKTGAAY

SEQ ID NO: 313347 - protein, 17 aa, Mycobacterium
IPSALGLLVVVAGAMTA

SEQ ID NO: 313348 - protein, 23 aa, Mycobacterium
IPSARGGPTLAARFDRTITEGEL

SEQ ID NO: 313349 - protein, 19 aa, Mycobacterium
IPSATGFANLAGHGVRAEV

SEQ ID NO: 313350 - protein, 22 aa, Mycobacterium
IPSDLLWSFLQAIVMAIAVMLV

SEQ ID NO: 313351 - protein, 21 aa, Mycobacterium
IPSELPYGADVVVGVASSKHN

SEQ ID NO: 313352 - protein, 19 aa, Mycobacterium
IPSNFLATVGLLAGSVVLV

SEQ ID NO: 313353 - protein, 31 aa, Mycobacterium
IPSPPRGVWHLGPLPIRAYALFIITGIIVAL

SEQ ID NO: 313354 - protein, 25 aa, Mycobacterium
IPSTPELLGILAIVVAVAARRDAPP

SEQ ID NO: 313355 - protein, 21 aa, Mycobacterium
IPTQMPFVLNRLVEPYGNFSP

SEQ ID NO: 313356 - protein, 20 aa, Mycobacterium
IPVALALWLSVRFGPHVLGP

SEQ ID NO: 313357 - protein, 17 aa, Mycobacterium
IPVCQALRSVFDTLDGV

SEQ ID NO: 313358 - protein, 23 aa, Mycobacterium
IPVDCAAPHAMEVTGTVNLAEKF

SEQ ID NO: 313359 - protein, 18 aa, Mycobacterium
IPVDEWAVTLALALRAFP

SEQ ID NO: 313360 - protein, 21 aa, Mycobacterium
IPVGPELSVPVIPNAGSPARF

SEQ ID NO: 313361 - protein, 20 aa, Mycobacterium
IPVIARILMDLGLASHEIAQ

SEQ ID NO: 313362 - protein, 17 aa, Mycobacterium
IPVLAGLAFGERPGTLA

SEQ ID NO: 313363 - protein, 18 aa, Mycobacterium
IPVLGAWALLRRRRGRTS

SEQ ID NO: 313364 - protein, 28 aa, Mycobacterium
IPVLLFCIAFGLSMDYEVFLLARIREFW

SEQ ID NO: 313365 - protein, 19 aa, Mycobacterium
IPVLVLPAGKRIEFQLNSA

SEQ ID NO: 313366 - protein, 17 aa, Mycobacterium
IPVLVLPTGKRIQFQLA

SEQ ID NO: 313367 - protein, 20 aa, Mycobacterium
IPVLVVGLAVMLTANALLLR

SEQ ID NO: 313368 - protein, 18 aa, Mycobacterium
IPVLWRQWRNSAFTPNAR

SEQ ID NO: 313369 - protein, 19 aa, Mycobacterium
IPVNYIWDFAVEGTATAMG

SEQ ID NO: 313370 - protein, 23 aa, Mycobacterium
IPVPPIFGPGGGGGFPGGGDDGD

SEQ ID NO: 313371 - protein, 17 aa, Mycobacterium
IPVSAMLARAGVPPRQW

SEQ ID NO: 313372 - protein, 19 aa, Mycobacterium
IPVSIALLLSLRFGSRVLG

SEQ ID NO: 313373 - protein, 18 aa, Mycobacterium
IPVTASFVIGWVIIGPAL

SEQ ID NO: 313374 - protein, 18 aa, Mycobacterium
IPVVAPLLLRLTLSIPAL

SEQ ID NO: 313375 - protein, 18 aa, Mycobacterium
IPVWMIFLCQAIVLVYQF

SEQ ID NO: 313376 - protein, 27 aa, Mycobacterium
IPWVMLGAALLWFGWFGFNVGSEGAAD

SEQ ID NO: 313377 - protein, 23 aa, Mycobacterium
IPYFPNLLVPLSIGALGIGAIFV

SEQ ID NO: 313378 - protein, 23 aa, Mycobacterium
IPYLCIGFAWTVFHPEQTQRIHA

SEQ ID NO: 313379 - protein, 22 aa, Mycobacterium
IPYLCIGFVWTVFHAEEAARIQ

SEQ ID NO: 313380 - protein, 18 aa, Mycobacterium
IPYLIIQAIYGFTFLETV

SEQ ID NO: 313381 - protein, 21 aa, Mycobacterium
IPYPGAPPYGAPRYAPDGTPL

SEQ ID NO: 313382 - protein, 22 aa, Mycobacterium
IPYRAHWDAGAVVLELYEHLVE

SEQ ID NO: 313383 - protein, 18 aa, Mycobacterium
IQAEAWRGPSSGICVGAY

SEQ ID NO: 313384 - protein, 17 aa, Mycobacterium
IQAPRLFAGQIEFGDVS

SEQ ID NO: 313385 - protein, 17 aa, Mycobacterium
IQCEAWNPDTGKYGPIY

SEQ ID NO: 313386 - protein, 17 aa, Mycobacterium
IQCEAWNPDTGKYGPLY

SEQ ID NO: 313387 - protein, 22 aa, Mycobacterium
IQDRLTGFIYAFDDMLARNKAS

SEQ ID NO: 313388 - protein, 17 aa, Mycobacterium
IQEKLGLGETELPDERK

SEQ ID NO: 313389 - protein, 24 aa, Mycobacterium
IQEPPEILGVPMLVVAVAGLAVNL

SEQ ID NO: 313390 - protein, 24 aa, Mycobacterium
IQESIKGLAAYAMQFGETIAAGPF

SEQ ID NO: 313391 - protein, 19 aa, Mycobacterium
IQGAIPLVGSFVNAVTTDA

SEQ ID NO: 313392 - protein, 25 aa, Mycobacterium
IQIGGTAFVVFFAVALVFYIVTSHQ

SEQ ID NO: 313393 - protein, 33 aa, Mycobacterium
IQIRGPHILRGICRRGREEVFTRDGYYPTGDLG

SEQ ID NO: 313394 - protein, 30 aa, Mycobacterium
IQIRGPHLMRGICRRTREDVFTPDGFYPTG

SEQ ID NO: 313395 - protein, 18 aa, Mycobacterium
IQIVDRVQWFRVTDETPS

SEQ ID NO: 313396 - protein, 19 aa, Mycobacterium
IQLITFAGILVLLKVAAYW

SEQ ID NO: 313397 - protein, 27 aa, Mycobacterium
IQLPRLSRAAVIIGALVVAAALVAGYF

SEQ ID NO: 313398 - protein, 20 aa, Mycobacterium
IQLPSYLGFFGGRRFVPIVV

SEQ ID NO: 313399 - protein, 23 aa, Mycobacterium
IQLSVPVPRGLTPAALNAIVEPP

SEQ ID NO: 313400 - protein, 17 aa, Mycobacterium
IQLTIFAVIALSVLAIT

SEQ ID NO: 313401 - protein, 17 aa, Mycobacterium
IQLVNRARREGVRITPQ

SEQ ID NO: 313402 - protein, 19 aa, Mycobacterium
IQPFVDWLANLPFFQTMFA

SEQ ID NO: 313403 - protein, 19 aa, Mycobacterium
IQPLVCVAAVAGSLLYVEV

SEQ ID NO: 313404 - protein, 25 aa, Mycobacterium
IQQARVQLCYFARSRCASVRTELQE

SEQ ID NO: 313405 - protein, 24 aa, Mycobacterium
IQQLDRFMMAPAFMAAFTAPDDVD

SEQ ID NO: 313406 - protein, 23 aa, Mycobacterium
IQQLLVICWPGRPNAVVHAAVAA

SEQ ID NO: 313407 - protein, 18 aa, Mycobacterium
IQTAGTDPVGWSAKCLQM

SEQ ID NO: 313408 - protein, 17 aa, Mycobacterium
IQVLEYVALAAVIPLAF

SEQ ID NO: 313409 - protein, 19 aa, Mycobacterium
IQVVIAWFGYRVIAKFERW

SEQ ID NO: 313410 - protein, 18 aa, Mycobacterium
IRAARFMGVSSRRIITGH

SEQ ID NO: 313411 - protein, 18 aa, Mycobacterium
IRAARLLPDGSRILPGSF

SEQ ID NO: 313412 - protein, 20 aa, Mycobacterium
IRAGEHLSLMLAGSQLGITI

SEQ ID NO: 313413 - protein, 25 aa, Mycobacterium
IRAIDLRSPLLLAIVLAAVAVVVAG

SEQ ID NO: 313414 - protein, 24 aa, Mycobacterium
IRALCDRVRSAAWQRELDHLAGTD

SEQ ID NO: 313415 - protein, 19 aa, Mycobacterium
IRALIAFGRNDIRGTYREP

SEQ ID NO: 313416 - protein, 26 aa, Mycobacterium
IRALPAESYTPWITRVLAALIDFAPY

SEQ ID NO: 313417 - protein, 18 aa, Mycobacterium
IRALPHADKPSVLLVVGV

SEQ ID NO: 313418 - protein, 23 aa, Mycobacterium
IRALPLIDRRIGTFVGTVVRPMR

SEQ ID NO: 313419 - protein, 20 aa, Mycobacterium
IRALPRVLPHASGPVDLGSL

SEQ ID NO: 313420 - protein, 22 aa, Mycobacterium
IRARQVRWRMAGIFSAAGIPAT

SEQ ID NO: 313421 - protein, 25 aa, Mycobacterium
IRARSEGRCGAGILQPWRDLRKQLR

SEQ ID NO: 313422 - protein, 17 aa, Mycobacterium
IRARSGALHAIRETLYS

SEQ ID NO: 313423 - protein, 23 aa, Mycobacterium
IRARSRLQAYAFWDSATFLLNGS

SEQ ID NO: 313424 - protein, 24 aa, Mycobacterium
IRARSRLQSFAFWDISTFLINGSL

SEQ ID NO: 313425 - protein, 18 aa, Mycobacterium
IRARSRMQSYAFWDITTF

SEQ ID NO: 313426 - protein, 20 aa, Mycobacterium
IRATTVFGAKFVDLVYPQDP

SEQ ID NO: 313427 - protein, 22 aa, Mycobacterium
IRDALPLLPFVAVVTVFLIVPT

SEQ ID NO: 313428 - protein, 17 aa, Mycobacterium
IRDEARVAGRQVVDEKR

SEQ ID NO: 313429 - protein, 18 aa, Mycobacterium
IRDRLSRVGDPVVEMPPP

SEQ ID NO: 313430 - protein, 25 aa, Mycobacterium
IRDSAYRIALWLALAATVLVGGFGV

SEQ ID NO: 313431 - protein, 25 aa, Mycobacterium
IRDVLRSGAIIRRFIYLALLMTAFN

SEQ ID NO: 313432 - protein, 27 aa, Mycobacterium
IREGRSFRSAVPRGWTRARKTIVSGNA

SEQ ID NO: 313433 - protein, 24 aa, Mycobacterium
IRENPATCWWWQKTSGENRARVQV

SEQ ID NO: 313434 - protein, 20 aa, Mycobacterium
IREVGIRSAVGAPILVDGRV

SEQ ID NO: 313435 - protein, 31 aa, Mycobacterium
IRFTGPELWWVLRVARWSARVPAATVPVPSG

SEQ ID NO: 313436 - protein, 19 aa, Mycobacterium
IRFVVPVLLLVAWQVAAAW

SEQ ID NO: 313437 - protein, 28 aa, Mycobacterium
IRGAAAWRGSNRNPAWLLEGTRLSEAAA

SEQ ID NO: 313438 - protein, 31 aa, Mycobacterium
IRGDASMGWLRLGALVLVAAALAALLINRRL

SEQ ID NO: 313439 - protein, 19 aa, Mycobacterium
IRGPHTLRGICGRRREELF

SEQ ID NO: 313440 - protein, 19 aa, Mycobacterium
IRGPHTLRGLCRRSREEVF

SEQ ID NO: 313441 - protein, 17 aa, Mycobacterium
IRGRRGGKFFAGVLTLL

SEQ ID NO: 313442 - protein, 18 aa, Mycobacterium
IRGSLVVAGHVSWVDVFA

SEQ ID NO: 313443 - protein, 17 aa, Mycobacterium
IRGSMLVLYQLACVTGI

SEQ ID NO: 313444 - protein, 18 aa, Mycobacterium
IRGVRVHLLGSYTPTPNN

SEQ ID NO: 313445 - protein, 31 aa, Mycobacterium
IRHLLTLLLCLAVMAWLSLPLALLVVLLVPL

SEQ ID NO: 313446 - protein, 24 aa, Mycobacterium
IRHNGWFPRPIRRRSKAADESESA

SEQ ID NO: 313447 - protein, 24 aa, Mycobacterium
IRHRRLPNRFTLPGAGAMLLGALV

SEQ ID NO: 313448 - protein, 24 aa, Mycobacterium
IRIFSLPIVLLWVLLVVALGAIFP

SEQ ID NO: 313449 - protein, 31 aa, Mycobacterium
IRINSFTSTFVFIGAVVYIILAPKGREDPAS

SEQ ID NO: 313450 - protein, 17 aa, Mycobacterium
IRITALVGVVVGHTVMA

SEQ ID NO: 313451 - protein, 21 aa, Mycobacterium
IRITTDFTPVLGVLAQKSNNF

SEQ ID NO: 313452 - protein, 19 aa, Mycobacterium
IRITVVWWLVFTAVATWVL

SEQ ID NO: 313453 - protein, 18 aa, Mycobacterium
IRIVSLVGVVLGHTIMAT

SEQ ID NO: 313454 - protein, 23 aa, Mycobacterium
IRKRLRTVRNIGVFGVNLIGLSA

SEQ ID NO: 313455 - protein, 18 aa, Mycobacterium
IRKTRLRNDFSYGVYIYA

SEQ ID NO: 313456 - protein, 17 aa, Mycobacterium
IRLAALVVVMFGHCALL

SEQ ID NO: 313457 - protein, 18 aa, Mycobacterium
IRLAEVMLSSGSGTADVV

SEQ ID NO: 313458 - protein, 29 aa, Mycobacterium
IRLAGVPGMLVAPFVGSWVGRVGTETGAL

SEQ ID NO: 313459 - protein, 25 aa, Mycobacterium
IRLAQRLTPHAGLIAAVLAAAIAGI

SEQ ID NO: 313460 - protein, 17 aa, Mycobacterium
IRLETRSAATLPDGSQT

SEQ ID NO: 313461 - protein, 20 aa, Mycobacterium
IRLLGTRAAIPAGLLAGILY

SEQ ID NO: 313462 - protein, 17 aa, Mycobacterium
IRLNRGGSDIIYFTSAS

SEQ ID NO: 313463 - protein, 27 aa, Mycobacterium
IRLPDLIASLVCWLLISREVLPRLGPA

SEQ ID NO: 313464 - protein, 26 aa, Mycobacterium
IRLPDLICALICWLLLSREVLPRLGP

SEQ ID NO: 313465 - protein, 17 aa, Mycobacterium
IRLPKVSRATVIIGSLV

SEQ ID NO: 313466 - protein, 17 aa, Mycobacterium
IRLRLRDTPEFEALQES

SEQ ID NO: 313467 - protein, 19 aa, Mycobacterium
IRLSLMVGGSMAMVPWLGY

SEQ ID NO: 313468 - protein, 25 aa, Mycobacterium
IRLSRPHAPWARWRYTKRPRKMHRA

SEQ ID NO: 313469 - protein, 19 aa, Mycobacterium
IRLTEIPVLVVGLAVMLTA

SEQ ID NO: 313470 - protein, 17 aa, Mycobacterium
IRLTFAMARDNALPFGE

SEQ ID NO: 313471 - protein, 19 aa, Mycobacterium
IRLVKALQSRGHVVAMTGD

SEQ ID NO: 313472 - protein, 18 aa, Mycobacterium
IRMSARWLPTAVVAVGAF

SEQ ID NO: 313473 - protein, 18 aa, Mycobacterium
IRNADVLRMVIGGAALAL

SEQ ID NO: 313474 - protein, 28 aa, Mycobacterium
IRNAHCIEALARLNVVCFDKTGTLSENR

SEQ ID NO: 313475 - protein, 23 aa, Mycobacterium
IRNGELPTAMALNSLPMTVGRVI

SEQ ID NO: 313476 - protein, 20 aa, Mycobacterium
IRNYFYWEKHCFDIPICWSI

SEQ ID NO: 313477 - protein, 33 aa, Mycobacterium
IRNYFYWEPHCYNIPICWSLRSIFDAMDGVDRL

SEQ ID NO: 313478 - protein, 33 aa, Mycobacterium
IRNYFYWEPHCYNIPVCHSMRSLFDLIDGTNLL

SEQ ID NO: 313479 - protein, 19 aa, Mycobacterium
IRNYLYWEKHCFDIPMCWA

SEQ ID NO: 313480 - protein, 32 aa, Mycobacterium
IRNYLYWEPHCFDIPMCWAMRSLNESLDSIDE

SEQ ID NO: 313481 - protein, 21 aa, Mycobacterium
IRPALEQALGPARRAIRVAVG

SEQ ID NO: 313482 - protein, 22 aa, Mycobacterium
IRPDTRAVGLLEFHQIDAAREA

SEQ ID NO: 313483 - protein, 19 aa, Mycobacterium
IRPEFRPKLKAFMADLCWI

SEQ ID NO: 313484 - protein, 22 aa, Mycobacterium
IRPEVTLVFKSLVVVSVVLLQS

SEQ ID NO: 313485 - protein, 17 aa, Mycobacterium
IRPILQAHLDWLLMGAV

SEQ ID NO: 313486 - protein, 21 aa, Mycobacterium
IRPILSWTGLTLIGAAFVLVD

SEQ ID NO: 313487 - protein, 25 aa, Mycobacterium
IRPVAPEAYALYGFSRIAPQGLRNF

SEQ ID NO: 313488 - protein, 25 aa, Mycobacterium
IRPVAPEAYALYGLSRVAPQGLRNA

SEQ ID NO: 313489 - protein, 17 aa, Mycobacterium
IRQGQDLIGEFVAHSAA

SEQ ID NO: 313490 - protein, 25 aa, Mycobacterium
IRQRPRSLRPLAWVQRLTALPEYVR

SEQ ID NO: 313491 - protein, 29 aa, Mycobacterium
IRRALPRPWSLRARLLAVQAALLAFVCVG

SEQ ID NO: 313492 - protein, 22 aa, Mycobacterium
IRRGDVYGGIALPGSPGDQPAM

SEQ ID NO: 313493 - protein, 21 aa, Mycobacterium
IRRGPRLLGAVRECAVPGLAG

SEQ ID NO: 313494 - protein, 20 aa, Mycobacterium
IRRLILFLIERLNRVAPKRV

SEQ ID NO: 313495 - protein, 26 aa, Mycobacterium
IRRLRPHLRPLLAIIVFTAMLGPKMA

SEQ ID NO: 313496 - protein, 25 aa, Mycobacterium
IRRLSIPIVIGWIALSAYLTVGLPP

SEQ ID NO: 313497 - protein, 21 aa, Mycobacterium
IRRPPGLPAPRPFRTAFAAAY

SEQ ID NO: 313498 - protein, 30 aa, Mycobacterium
IRRQRVTVLMAVPVMLQRILALADLDRRDA

SEQ ID NO: 313499 - protein, 20 aa, Mycobacterium
IRRRKLVGLSLGMGLGAFGL

SEQ ID NO: 313500 - protein, 17 aa, Mycobacterium
IRRRLGERPDLMGDLDA

SEQ ID NO: 313501 - protein, 20 aa, Mycobacterium
IRRYTWRSRWEAGATRNIAL

SEQ ID NO: 313502 - protein, 21 aa, Mycobacterium
IRSALIIGRSVDNWVRRLLAL

SEQ ID NO: 313503 - protein, 23 aa, Mycobacterium
IRSALILGRSVDNWVRRMLALPV

SEQ ID NO: 313504 - protein, 17 aa, Mycobacterium
IRSDDTFAYLARSVDPG

SEQ ID NO: 313505 - protein, 22 aa, Mycobacterium
IRSNPVLRQQIQAVVRRAAQQA

SEQ ID NO: 313506 - protein, 18 aa, Mycobacterium
IRSTAGGLLRGRSLAAQF

SEQ ID NO: 313507 - protein, 19 aa, Mycobacterium
IRSYFYWEKHCFDVPLCWS

SEQ ID NO: 313508 - protein, 20 aa, Mycobacterium
IRSYFYWEKHCYDIPICSSF

SEQ ID NO: 313509 - protein, 19 aa, Mycobacterium
IRSYLYWEKHCYDIPNCWT

SEQ ID NO: 313510 - protein, 32 aa, Mycobacterium
IRSYLYWERHCYDIPVCWSLRSVFDGLDGIDI

SEQ ID NO: 313511 - protein, 21 aa, Mycobacterium
IRTGFSRFPIIKGDLDETIGV

SEQ ID NO: 313512 - protein, 24 aa, Mycobacterium
IRTPPIVVSVAWWLAGVNLLLGLF

SEQ ID NO: 313513 - protein, 20 aa, Mycobacterium
IRTRMVPFFRSRPSALLAVT

SEQ ID NO: 313514 - protein, 18 aa, Mycobacterium
IRTYIPLLKSDVVTQRVI

SEQ ID NO: 313515 - protein, 25 aa, Mycobacterium
IRVAGTYCYLVLPLFIACVAAGSVV

SEQ ID NO: 313516 - protein, 27 aa, Mycobacterium
IRVDRCARAVWPLCLAASAAIPFVTAG

SEQ ID NO: 313517 - protein, 18 aa, Mycobacterium
IRVFGGAAASSFKRQLDE

SEQ ID NO: 313518 - protein, 17 aa, Mycobacterium
IRVGEEVIAAGAPLGLR

SEQ ID NO: 313519 - protein, 31 aa, Mycobacterium
IRVIQGLAFGAEWGGAILMTYEHAPWKKRGR

SEQ ID NO: 313520 - protein, 25 aa, Mycobacterium
IRVITRRVAIALVVLIAAAVIVYVD

SEQ ID NO: 313521 - protein, 24 aa, Mycobacterium
IRVKEMRESLRIVEQCVERLERST

SEQ ID NO: 313522 - protein, 25 aa, Mycobacterium
IRVLALPIVVFWVLLAVGVNVFVPQ

SEQ ID NO: 313523 - protein, 24 aa, Mycobacterium
IRVLSLPIILFWVALAVILGTVTP

SEQ ID NO: 313524 - protein, 24 aa, Mycobacterium
IRVNTFTATFVFVAAVVYVIVAPK

SEQ ID NO: 313525 - protein, 24 aa, Mycobacterium
IRVNTFTSTFVFIGAVVYIMLAPK

SEQ ID NO: 313526 - protein, 24 aa, Mycobacterium
IRVPREFVNDFIFNFPDTSFAWAF

SEQ ID NO: 313527 - protein, 22 aa, Mycobacterium
IRVTPKFQRMLLAGLVGVLVLA

SEQ ID NO: 313528 - protein, 20 aa, Mycobacterium
IRVTPKFTRMLVAAMFGVLA

SEQ ID NO: 313529 - protein, 22 aa, Mycobacterium
IRVTPKFTRMVVAALFGVLALM

SEQ ID NO: 313530 - protein, 28 aa, Mycobacterium
IRVWNRIRERFGLVGLFAGSAILSIAAA

SEQ ID NO: 313531 - protein, 22 aa, Mycobacterium
IRWGIPPLFVLAPFWLLPASLY

SEQ ID NO: 313532 - protein, 17 aa, Mycobacterium
IRWLELWSGELTNAALA

SEQ ID NO: 313533 - protein, 17 aa, Mycobacterium
IRYAHWASHAVRGDFGK

SEQ ID NO: 313534 - protein, 21 aa, Mycobacterium
IRYFPIQSHFNAERAARAVEA

SEQ ID NO: 313535 - protein, 20 aa, Mycobacterium
ISAALSICFVNLPDQFVGPL

SEQ ID NO: 313536 - protein, 20 aa, Mycobacterium
ISAIGWVIFFFMFRTETDLD

SEQ ID NO: 313537 - protein, 17 aa, Mycobacterium
ISALAYVVIFSIPAARE

SEQ ID NO: 313538 - protein, 21 aa, Mycobacterium
ISALHRPVPLSGEGSDTDTVI

SEQ ID NO: 313539 - protein, 27 aa, Mycobacterium
ISAMLIYRLISWIFISAIGWVVFFFMF

SEQ ID NO: 313540 - protein, 17 aa, Mycobacterium
ISAPFGIVGQILLGATA

SEQ ID NO: 313541 - protein, 18 aa, Mycobacterium
ISATNWLLGSVVFIVASW

SEQ ID NO: 313542 - protein, 37 aa, Mycobacterium
ISAVCLFIALVLFRYLTPWGRQFWRITRGYFVGAHSV

SEQ ID NO: 313543 - protein, 25 aa, Mycobacterium
ISAWLQVCDAYGWAPAVMGASAEGA

SEQ ID NO: 313544 - protein, 23 aa, Mycobacterium
ISCGVLAAWSFFRLVWLLYVSMT

SEQ ID NO: 313545 - protein, 17 aa, Mycobacterium
ISDIVRLRHPWQDTVIQ

SEQ ID NO: 313546 - protein, 18 aa, Mycobacterium
ISDPQIRVVIAGQLKQGK

SEQ ID NO: 313547 - protein, 22 aa, Mycobacterium
ISEILPDFGGLADIGIGGLKES

SEQ ID NO: 313548 - protein, 17 aa, Mycobacterium
ISFEVRGGLFVRQIHHW

SEQ ID NO: 313549 - protein, 24 aa, Mycobacterium
ISFEVRGGLFVRQIHHWAALMFAA

SEQ ID NO: 313550 - protein, 24 aa, Mycobacterium
ISFEVRGGLFVRQVHHWAALLFAA

SEQ ID NO: 313551 - protein, 19 aa, Mycobacterium
ISFGSRFGLFEPKRRMMVR

SEQ ID NO: 313552 - protein, 26 aa, Mycobacterium
ISFIKFTLVMGLPWLAAVTAVYAVFR

SEQ ID NO: 313553 - protein, 18 aa, Mycobacterium
ISGATIFFFLFVHVLDAA

SEQ ID NO: 313554 - protein, 20 aa, Mycobacterium
ISGCLSLWGVMTMLGGAVQS

SEQ ID NO: 313555 - protein, 18 aa, Mycobacterium
ISGFGWAAGYGGSVLLLL

SEQ ID NO: 313556 - protein, 17 aa, Mycobacterium
ISGFGWAAGYVGSVLLL

SEQ ID NO: 313557 - protein, 17 aa, Mycobacterium
ISGFGWASGYVGSVVLL

SEQ ID NO: 313558 - protein, 17 aa, Mycobacterium
ISGFRTAVFHAIPDELK

SEQ ID NO: 313559 - protein, 17 aa, Mycobacterium
ISGLGWAAGYVGSVLLL

SEQ ID NO: 313560 - protein, 22 aa, Mycobacterium
ISGLLLNFLFVAPRYSFTIGET

SEQ ID NO: 313561 - protein, 34 aa, Mycobacterium
ISGLVGRASLAYDMWGAAVSLAYQMHSGSPQPGI

SEQ ID NO: 313562 - protein, 34 aa, Mycobacterium
ISGLVGRSGLVYDMWGAAVSLAYQMQSGSSQSGI

SEQ ID NO: 313563 - protein, 27 aa, Mycobacterium
ISGLVGRSSIVYDMWGAAVNLAHQTRS

SEQ ID NO: 313564 - protein, 34 aa, Mycobacterium
ISGLVGRSSVVYDMWGAAVSLAYQTHSGSPQPGI

SEQ ID NO: 313565 - protein, 22 aa, Mycobacterium
ISGLVGRTSVVYDMWGAAVSTA

SEQ ID NO: 313566 - protein, 31 aa, Mycobacterium
ISGPRYLVSMWPWRALLWTVFGGVLGTVLIV

SEQ ID NO: 313567 - protein, 18 aa, Mycobacterium
ISGVPRRDVPLVLRVYDR

SEQ ID NO: 313568 - protein, 20 aa, Mycobacterium
ISGVSLRPVGMILLVVGAGA

SEQ ID NO: 313569 - protein, 29 aa, Mycobacterium
ISGVTLTVLWRSRWVRRAVAGAAVVMLAW

SEQ ID NO: 313570 - protein, 17 aa, Mycobacterium
ISGWALMTWTLMAFGST

SEQ ID NO: 313571 - protein, 22 aa, Mycobacterium
ISGWTLMVWLMLGVGSFFGYLA

SEQ ID NO: 313572 - protein, 18 aa, Mycobacterium
ISIPCPDIATLPASGGLV

SEQ ID NO: 313573 - protein, 19 aa, Mycobacterium
ISIRVTDLQGRTAVFPMIK

SEQ ID NO: 313574 - protein, 18 aa, Mycobacterium
ISIVNVFCNLVAKPSQQT

SEQ ID NO: 313575 - protein, 20 aa, Mycobacterium
ISKEAPRTVVCIFIPEYVVG

SEQ ID NO: 313576 - protein, 20 aa, Mycobacterium
ISKYSRRLPKAAGRQRTSSA

SEQ ID NO: 313577 - protein, 33 aa, Mycobacterium
ISLATIWLRTGLMPRWLAGISYLAAAALLTVSD

SEQ ID NO: 313578 - protein, 19 aa, Mycobacterium
ISLFFWPTPAVPLVGAVLI

SEQ ID NO: 313579 - protein, 23 aa, Mycobacterium
ISLGLLAAWSFYRVIWLLYLSMT

SEQ ID NO: 313580 - protein, 32 aa, Mycobacterium
ISLGVSAAYLWSLWALFIGHAGMPGMRMAFSL

SEQ ID NO: 313581 - protein, 18 aa, Mycobacterium
ISLIPLFALIGVLIVAWR

SEQ ID NO: 313582 - protein, 19 aa, Mycobacterium
ISLLKRAGLTPIMVTGDNE

SEQ ID NO: 313583 - protein, 21 aa, Mycobacterium
ISLLLCLAIALGADALGSSAK

SEQ ID NO: 313584 - protein, 21 aa, Mycobacterium
ISLLLGMLVTMRFDRPVRWTP

SEQ ID NO: 313585 - protein, 26 aa, Mycobacterium
ISLLYMCASGSFLGFAFAFGQVLQHN

SEQ ID NO: 313586 - protein, 27 aa, Mycobacterium
ISLLYVCTFGSWIGFSFAFGQVLEVNF

SEQ ID NO: 313587 - protein, 17 aa, Mycobacterium
ISLPFKAAVNVLLYTDQ

SEQ ID NO: 313588 - protein, 17 aa, Mycobacterium
ISLPIALGLLIMMYPVL

SEQ ID NO: 313589 - protein, 27 aa, Mycobacterium
ISLQEPYRLGCLNARNELSLIGANENR

SEQ ID NO: 313590 - protein, 21 aa, Mycobacterium
ISLSAASLMFFDYMQIPTVFF

SEQ ID NO: 313591 - protein, 17 aa, Mycobacterium
ISLTLAIVTLVVSVGGF

SEQ ID NO: 313592 - protein, 25 aa, Mycobacterium
ISLVAMTAGGAWLWNEARRLRKLED

SEQ ID NO: 313593 - protein, 19 aa, Mycobacterium
ISLYLPLTMRSLANAILVP

SEQ ID NO: 313594 - protein, 24 aa, Mycobacterium
ISMGGIPTGFPWQAPVLTAGTQVL

SEQ ID NO: 313595 - protein, 20 aa, Mycobacterium
ISMGVLRLFANHSIVENNIV

SEQ ID NO: 313596 - protein, 17 aa, Mycobacterium
ISMLAELRQVAADRLLQ

SEQ ID NO: 313597 - protein, 22 aa, Mycobacterium
ISNDIAKYFAIIPALFVGLFPG

SEQ ID NO: 313598 - protein, 32 aa, Mycobacterium
ISNLPMGVPLEWNVFFIFSLFYLFGHYASVQA

SEQ ID NO: 313599 - protein, 32 aa, Mycobacterium
ISNLPMGVPLEWNVFFIFSLFYLFGHYGAVRA

SEQ ID NO: 313600 - protein, 22 aa, Mycobacterium
ISNWLAVLPLQYGGADGAAAEL

SEQ ID NO: 313601 - protein, 24 aa, Mycobacterium
ISPCILPVLPVVFFSGAHGGATVA

SEQ ID NO: 313602 - protein, 21 aa, Mycobacterium
ISPDLDAVVLKALAKNPENRY

SEQ ID NO: 313603 - protein, 27 aa, Mycobacterium
ISPIAEWLIHVGILHWRPRSLGPVTLD

SEQ ID NO: 313604 - protein, 18 aa, Mycobacterium
ISPKHSWPDHIVDVKQAL

SEQ ID NO: 313605 - protein, 19 aa, Mycobacterium
ISPKKSWEGFAGSMVCGVT

SEQ ID NO: 313606 - protein, 19 aa, Mycobacterium
ISPKKSWEGFVGSLFCGIV

SEQ ID NO: 313607 - protein, 19 aa, Mycobacterium
ISPKKSWEGLAGSLLFGVT

SEQ ID NO: 313608 - protein, 18 aa, Mycobacterium
ISPKKSWEGLAGSLVLGI

SEQ ID NO: 313609 - protein, 18 aa, Mycobacterium
ISPLLGSLVQLLFFMTPI

SEQ ID NO: 313610 - protein, 24 aa, Mycobacterium
ISPTPRPATVITIAPAGVRLSEGQ

SEQ ID NO: 313611 - protein, 26 aa, Mycobacterium
ISQALRLTYMIFFSIPVVAPLLLRLT

SEQ ID NO: 313612 - protein, 22 aa, Mycobacterium
ISQELLGGLLISVADEVIDGTL

SEQ ID NO: 313613 - protein, 18 aa, Mycobacterium
ISQLSWPIAVAVGPALTY

SEQ ID NO: 313614 - protein, 21 aa, Mycobacterium
ISRGLLGYCERLASHDTALRA

SEQ ID NO: 313615 - protein, 23 aa, Mycobacterium
ISRNAAMPPLWVIVACALSMAAG

SEQ ID NO: 313616 - protein, 23 aa, Mycobacterium
ISRPRPVQNLAAYWLGSMIVSLA

SEQ ID NO: 313617 - protein, 24 aa, Mycobacterium
ISRPRPVQNLLAFWVGALVVNVPS

SEQ ID NO: 313618 - protein, 18 aa, Mycobacterium
ISRVRFWLPAPIVFEILL

SEQ ID NO: 313619 - protein, 21 aa, Mycobacterium
ISSALPRTFGRLVGSKRQGYA

SEQ ID NO: 313620 - protein, 34 aa, Mycobacterium
ISSARRSPIIAAFPKMFIPFVVVIPGMIAGAVIG

SEQ ID NO: 313621 - protein, 20 aa, Mycobacterium
ISSASFWTFGIIAMVTLLAK

SEQ ID NO: 313622 - protein, 28 aa, Mycobacterium
ISSGDRLDPGLARRFMDTYGDILYNLYG

SEQ ID NO: 313623 - protein, 22 aa, Mycobacterium
ISSLCFMFIWTIILSSYLVYRR

SEQ ID NO: 313624 - protein, 26 aa, Mycobacterium
ISSQFGVSIPDFWMGILLIALFSTVL

SEQ ID NO: 313625 - protein, 21 aa, Mycobacterium
ISSRRAAVVLALTLVGFALAL

SEQ ID NO: 313626 - protein, 17 aa, Mycobacterium
ISTALVIPKFTVIEDGA

SEQ ID NO: 313627 - protein, 23 aa, Mycobacterium
ISTAVSWLLFAWMIARLPREKVS

SEQ ID NO: 313628 - protein, 17 aa, Mycobacterium
ISTFFRFVARRLDTRPE

SEQ ID NO: 313629 - protein, 17 aa, Mycobacterium
ISTFSAGAFLLGLVVGL

SEQ ID NO: 313630 - protein, 19 aa, Mycobacterium
ISTIARRQFRLVVADRAYF

SEQ ID NO: 313631 - protein, 18 aa, Mycobacterium
ISTISFGTPYGFVEINGQ

SEQ ID NO: 313632 - protein, 21 aa, Mycobacterium
ISTKMSGEWSKDAVLQAYLNI

SEQ ID NO: 313633 - protein, 20 aa, Mycobacterium
ISVADLRDAGLLDKLLRLRK

SEQ ID NO: 313634 - protein, 17 aa, Mycobacterium
ISVAELLARNGTIGAPA

SEQ ID NO: 313635 - protein, 30 aa, Mycobacterium
ISVALMAIFYLRVPTALGIGKHDVKAQFVA

SEQ ID NO: 313636 - protein, 23 aa, Mycobacterium
ISVDSPQWWTWTLAQRTSTLIRL

SEQ ID NO: 313637 - protein, 20 aa, Mycobacterium
ISVEAMIEFGLWMAIPYLVI

SEQ ID NO: 313638 - protein, 44 aa, Mycobacterium
ISVFLSLIGFRVPWREKMFLSWAGLRGAVPIVLCTYPIVAGVPD

SEQ ID NO: 313639 - protein, 19 aa, Mycobacterium
ISVGGVRIGPDATIRQAGG

SEQ ID NO: 313640 - protein, 18 aa, Mycobacterium
ISVGGVRVGAGVTIRQAG

SEQ ID NO: 313641 - protein, 20 aa, Mycobacterium
ISVGGVRVGPNVTIRQAGGG

SEQ ID NO: 313642 - protein, 28 aa, Mycobacterium
ISVLPFAWNVFKSWRFGEPVLVDDPWGH

SEQ ID NO: 313643 - protein, 20 aa, Mycobacterium
ISVLVAWLAVLLFASLAAAP

SEQ ID NO: 313644 - protein, 17 aa, Mycobacterium
ISVYRVVYRDAPMESIT

SEQ ID NO: 313645 - protein, 24 aa, Mycobacterium
ISWTHHWVWLIPLMIWLLHGPLRD

SEQ ID NO: 313646 - protein, 24 aa, Mycobacterium
ISWTHHWVWLIPLMMWLLHGPLSA

SEQ ID NO: 313647 - protein, 23 aa, Mycobacterium
ISWTHHWVWLVPLMIWAIHGAGR

SEQ ID NO: 313648 - protein, 23 aa, Mycobacterium
ISWTHHWVWLVPLMIWAIHGPLR

SEQ ID NO: 313649 - protein, 24 aa, Mycobacterium
ISYEIAMGLTFAAVFLLAGTMSTS

SEQ ID NO: 313650 - protein, 26 aa, Mycobacterium
ISYEPFPIWQILWDLIKVVGTEILAV

SEQ ID NO: 313651 - protein, 18 aa, Mycobacterium
ISYGLAALALRFGAFSEH

SEQ ID NO: 313652 - protein, 18 aa, Mycobacterium
ITAATAWSLSTVFVDKHP

SEQ ID NO: 313653 - protein, 20 aa, Mycobacterium
ITAAVCLRQAVAAWENRYLL

SEQ ID NO: 313654 - protein, 23 aa, Mycobacterium
ITAAVPPSPGVRVYVTGPATTSA

SEQ ID NO: 313655 - protein, 22 aa, Mycobacterium
ITADEAYAWGLVSQVYPADSLE

SEQ ID NO: 313656 - protein, 19 aa, Mycobacterium
ITAGALFGLAALPVVFTLL

SEQ ID NO: 313657 - protein, 24 aa, Mycobacterium
ITAGWWIYLAAFAIFIGIHLAGVG

SEQ ID NO: 313658 - protein, 18 aa, Mycobacterium
ITAGYGYRAPSLVGAALA

SEQ ID NO: 313659 - protein, 25 aa, Mycobacterium
ITAHSRLRVHWVRRRDETSLAEAIE

SEQ ID NO: 313660 - protein, 32 aa, Mycobacterium
ITAISAWMLTRWLIPWWTARVTVWAVAIGATF

SEQ ID NO: 313661 - protein, 25 aa, Mycobacterium
ITAIWRPDGAHGMYSWAHVLLATAC

SEQ ID NO: 313662 - protein, 18 aa, Mycobacterium
ITALRAGGYQVTMLTGDN

SEQ ID NO: 313663 - protein, 26 aa, Mycobacterium
ITAMGLRFGENIMYYLVVTFTITYLA

SEQ ID NO: 313664 - protein, 23 aa, Mycobacterium
ITAPEAFTAWEYADGYDVAQAVV

SEQ ID NO: 313665 - protein, 26 aa, Mycobacterium
ITAQIAGQVGRLWKLTAALTTDDRTG

SEQ ID NO: 313666 - protein, 26 aa, Mycobacterium
ITARFWRRSGIRIVRRPVTNLVASLM

SEQ ID NO: 313667 - protein, 28 aa, Mycobacterium
ITARVGLALGVAVAVCFVTGLISHFIQH

SEQ ID NO: 313668 - protein, 17 aa, Mycobacterium
ITARWIPYARADLVLGI

SEQ ID NO: 313669 - protein, 25 aa, Mycobacterium
ITASGRMALALAKQHQPAAITLDIG

SEQ ID NO: 313670 - protein, 17 aa, Mycobacterium
ITATTAFGAKYVDLSYP

SEQ ID NO: 313671 - protein, 26 aa, Mycobacterium
ITAVLSRSRLVGWSFAVGVIALLGLP

SEQ ID NO: 313672 - protein, 19 aa, Mycobacterium
ITDDYSFDWFRLAWTVQYP

SEQ ID NO: 313673 - protein, 18 aa, Mycobacterium
ITDGWWVYLAAYALFIGI

SEQ ID NO: 313674 - protein, 23 aa, Mycobacterium
ITDLGALLWARGVDTLIGCAVAL

SEQ ID NO: 313675 - protein, 25 aa, Mycobacterium
ITDLPEGRWAEFLEEPRLAERMAKA

SEQ ID NO: 313676 - protein, 34 aa, Mycobacterium
ITDLPEGRWSEFLDEPRIAARVGAARTRGGYLKD

SEQ ID NO: 313677 - protein, 25 aa, Mycobacterium
ITDLPEGRWSEFLEEPRIAERVANA

SEQ ID NO: 313678 - protein, 26 aa, Mycobacterium
ITDLPEGRWSEFLSEPRIAERVAKAR

SEQ ID NO: 313679 - protein, 25 aa, Mycobacterium
ITDLPEGRWTEFLEEPRLAERVKAA

SEQ ID NO: 313680 - protein, 23 aa, Mycobacterium
ITEFALRPIAAQALEAGRPPRRL

SEQ ID NO: 313681 - protein, 23 aa, Mycobacterium
ITEGFFSPLFFVWLGASLQVREL

SEQ ID NO: 313682 - protein, 25 aa, Mycobacterium
ITEPKKAAAALGWLVEEMEQRYQDM

SEQ ID NO: 313683 - protein, 17 aa, Mycobacterium
ITESALVDSARSRNTVA

SEQ ID NO: 313684 - protein, 17 aa, Mycobacterium
ITESARALVPGMLGSMV

SEQ ID NO: 313685 - protein, 38 aa, Mycobacterium
ITETINLPAGFAIGWAMWPLVAAIVLQAIAAVVVVLLD

SEQ ID NO: 313686 - protein, 40 aa, Mycobacterium
ITETINLPAGFAIGWAMWPLVACSVLQAIAAVVVVLLDAG

SEQ ID NO: 313687 - protein, 20 aa, Mycobacterium
ITFALKRTRTVTVNSEASSA

SEQ ID NO: 313688 - protein, 27 aa, Mycobacterium
ITFFDYQPWLRRRLEDRIGGPATDTVM

SEQ ID NO: 313689 - protein, 23 aa, Mycobacterium
ITFMAWSGVVGFLLGSVTVTLLQ

SEQ ID NO: 313690 - protein, 17 aa, Mycobacterium
ITGDFLLIAAGIGGLGG

SEQ ID NO: 313691 - protein, 24 aa, Mycobacterium
ITGFARIVLLAAILGAALSSSFSV

SEQ ID NO: 313692 - protein, 22 aa, Mycobacterium
ITGGLAFFFGPVVVFWVLATMA

SEQ ID NO: 313693 - protein, 19 aa, Mycobacterium
ITGGLGYAAAFLLISLLLC

SEQ ID NO: 313694 - protein, 28 aa, Mycobacterium
ITGGWLLEHFSWGSIFLVNVPIAVAAMA

SEQ ID NO: 313695 - protein, 23 aa, Mycobacterium
ITGIPFVVAAGWLSSLTGIPVAV

SEQ ID NO: 313696 - protein, 19 aa, Mycobacterium
ITGLLWREATTAGTVRLSR

SEQ ID NO: 313697 - protein, 25 aa, Mycobacterium
ITGLRGVLITLCLTEITSWGVLYYA

SEQ ID NO: 313698 - protein, 18 aa, Mycobacterium
ITGLTFLVIVVMLLFFYR

SEQ ID NO: 313699 - protein, 18 aa, Mycobacterium
ITGMLWREASIAGTVGLL

SEQ ID NO: 313700 - protein, 17 aa, Mycobacterium
ITGPLANRVRALAPGSG

SEQ ID NO: 313701 - protein, 25 aa, Mycobacterium
ITHGPRPGLIIGIAFAATYAGWAWL

SEQ ID NO: 313702 - protein, 17 aa, Mycobacterium
ITIAFTGGRPAMITAAT

SEQ ID NO: 313703 - protein, 20 aa, Mycobacterium
ITIGALWLLYRYYRTRDPLF

SEQ ID NO: 313704 - protein, 28 aa, Mycobacterium
ITIGEAWARVRGRVLALIGLALLEAAGM

SEQ ID NO: 313705 - protein, 20 aa, Mycobacterium
ITIGETWAKIRGRLVPLLGL

SEQ ID NO: 313706 - protein, 21 aa, Mycobacterium
ITIMLVLFFRSIVTTLLILVM

SEQ ID NO: 313707 - protein, 29 aa, Mycobacterium
ITISEAWARVRGRILALIGLALLEGAGLV

SEQ ID NO: 313708 - protein, 18 aa, Mycobacterium
ITKLGWQVARSVTDSTAS

SEQ ID NO: 313709 - protein, 17 aa, Mycobacterium
ITKMCRGVLAGAMLLVL

SEQ ID NO: 313710 - protein, 19 aa, Mycobacterium
ITLACLVALILILPLAALS

SEQ ID NO: 313711 - protein, 17 aa, Mycobacterium
ITLAPWLLTAAILVPLN

SEQ ID NO: 313712 - protein, 17 aa, Mycobacterium
ITLEVLDGPGIPEVLGD

SEQ ID NO: 313713 - protein, 19 aa, Mycobacterium
ITLEVLWTGGISRPPTVLY

SEQ ID NO: 313714 - protein, 21 aa, Mycobacterium
ITLFICCGIGKGSVFKLIPSI

SEQ ID NO: 313715 - protein, 17 aa, Mycobacterium
ITLIVGFLVAVAASLTP

SEQ ID NO: 313716 - protein, 30 aa, Mycobacterium
ITLKRAKGPLVFDLGICLVLVTLPTLALFV

SEQ ID NO: 313717 - protein, 17 aa, Mycobacterium
ITLLLSVVLMMAGVALL

SEQ ID NO: 313718 - protein, 20 aa, Mycobacterium
ITLLPACLGVLGRHVDALGV

SEQ ID NO: 313719 - protein, 25 aa, Mycobacterium
ITLLPALLVLAGRRGWIAPRTDLSR

SEQ ID NO: 313720 - protein, 20 aa, Mycobacterium
ITLNCLWVSLVFGVLATRYR

SEQ ID NO: 313721 - protein, 21 aa, Mycobacterium
ITLPLIPVFMVLIGLATAERS

SEQ ID NO: 313722 - protein, 23 aa, Mycobacterium
ITLPMLRPTMFFVLVTGIVSAAQ

SEQ ID NO: 313723 - protein, 22 aa, Mycobacterium
ITLPVALPLGIGGYVNYRDQSA

SEQ ID NO: 313724 - protein, 18 aa, Mycobacterium
ITLQRSKGALIFDVGICL

SEQ ID NO: 313725 - protein, 18 aa, Mycobacterium
ITLSPAWNLAATSRMSEN

SEQ ID NO: 313726 - protein, 25 aa, Mycobacterium
ITLTGGVVLALLVGRRLWHRFRGQP

SEQ ID NO: 313727 - protein, 17 aa, Mycobacterium
ITLTIYGSTVVQNTPAE

SEQ ID NO: 313728 - protein, 30 aa, Mycobacterium
ITLTVMAIFYLRLPATFGIGTYGVSADFVA

SEQ ID NO: 313729 - protein, 18 aa, Mycobacterium
ITLVGLLALPGYKTNYND

SEQ ID NO: 313730 - protein, 21 aa, Mycobacterium
ITMQHSIAWRSMHSQGRGLFS

SEQ ID NO: 313731 - protein, 25 aa, Mycobacterium
ITMSVPVIGTWLHWALFGGDFPGDI

SEQ ID NO: 313732 - protein, 18 aa, Mycobacterium
ITNSRKAPTLALIVPGVI

SEQ ID NO: 313733 - protein, 17 aa, Mycobacterium
ITPASGWTLVDQGPNRV

SEQ ID NO: 313734 - protein, 18 aa, Mycobacterium
ITPIAVGLTFRFLLNDQL

SEQ ID NO: 313735 - protein, 17 aa, Mycobacterium
ITPKYVKRIPANVAADI

SEQ ID NO: 313736 - protein, 29 aa, Mycobacterium
ITPMLPGMAVFRAVFYFAVEKDFAAGMTQ

SEQ ID NO: 313737 - protein, 29 aa, Mycobacterium
ITPMLPGMAVFRAVYFFAVEDRFGDGLAQ

SEQ ID NO: 313738 - protein, 25 aa, Mycobacterium
ITPREIKLAASYFLATPLIVLTGSA

SEQ ID NO: 313739 - protein, 24 aa, Mycobacterium
ITPREIKLAASYFLVTPLIVLTGT

SEQ ID NO: 313740 - protein, 24 aa, Mycobacterium
ITPREMKLAAGYFLVTPLIVLVGT

SEQ ID NO: 313741 - protein, 17 aa, Mycobacterium
ITPRRRNFIFLALVLGI

SEQ ID NO: 313742 - protein, 20 aa, Mycobacterium
ITQVKLPTGQKCVVPTDAEA

SEQ ID NO: 313743 - protein, 19 aa, Mycobacterium
ITRHLPPWGSAARQPMAAL

SEQ ID NO: 313744 - protein, 43 aa, Mycobacterium
ITRPGNSLIEWLRLPGDFVFILGGVLPFVWIAWTAIRNVRRAP

SEQ ID NO: 313745 - protein, 17 aa, Mycobacterium
ITRRTVIALRWAIEERE

SEQ ID NO: 313746 - protein, 20 aa, Mycobacterium
ITRVRWEFSDGSSVKQQVPV

SEQ ID NO: 313747 - protein, 24 aa, Mycobacterium
ITSLWGNSTIKVMVGFLTLYPAFV

SEQ ID NO: 313748 - protein, 25 aa, Mycobacterium
ITSNELVAWLCIAASVVGVVLLILD

SEQ ID NO: 313749 - protein, 18 aa, Mycobacterium
ITSWGVLYYAFPVLAPRI

SEQ ID NO: 313750 - protein, 18 aa, Mycobacterium
ITSWGVLYYAFTVLSASI

SEQ ID NO: 313751 - protein, 25 aa, Mycobacterium
ITTESFNQMWSLRSDDLVHVMMLRK

SEQ ID NO: 313752 - protein, 30 aa, Mycobacterium
ITTHRWRRIGTAIVRWPAPILITTLAVALI

SEQ ID NO: 313753 - protein, 17 aa, Mycobacterium
ITTLWTYTPENMDKLAD

SEQ ID NO: 313754 - protein, 25 aa, Mycobacterium
ITTMRDLRALLLILHSTLSGLVAQL

SEQ ID NO: 313755 - protein, 18 aa, Mycobacterium
ITTQITEVFGQTRLLRWS

SEQ ID NO: 313756 - protein, 26 aa, Mycobacterium
ITTVSACLLVFVTVWFALRDTARAEA

SEQ ID NO: 313757 - protein, 27 aa, Mycobacterium
ITTWRTGGVTRWRWAGLTTAAFLLLVA

SEQ ID NO: 313758 - protein, 18 aa, Mycobacterium
ITVAAWTTVWVLVGLAVH

SEQ ID NO: 313759 - protein, 25 aa, Mycobacterium
ITVAGVYIQRWWPGIPQWVTALVVL

SEQ ID NO: 313760 - protein, 18 aa, Mycobacterium
ITVAVWTTLWVFVGIAVH

SEQ ID NO: 313761 - protein, 22 aa, Mycobacterium
ITVCSLMFASHVTRYHAARKDH

SEQ ID NO: 313762 - protein, 19 aa, Mycobacterium
ITVGEAIAGMYAYQAFAPN

SEQ ID NO: 313763 - protein, 32 aa, Mycobacterium
ITVGEAWKRLRPRFWPLIGFTVLKMLVFLVGL

SEQ ID NO: 313764 - protein, 26 aa, Mycobacterium
ITVITRGYLMWWRRRPTKSGRWPVPP

SEQ ID NO: 313765 - protein, 24 aa, Mycobacterium
ITVKVDWPNFWSLITSSSSQTALL

SEQ ID NO: 313766 - protein, 29 aa, Mycobacterium
ITVPAIAALVGRANWWPSQGGVPSPKPSL

SEQ ID NO: 313767 - protein, 28 aa, Mycobacterium
ITVPAIASLVGRANWWPGQIGTSPSNSR

SEQ ID NO: 313768 - protein, 27 aa, Mycobacterium
ITVPALATLVGRASWWPSRPGTQRSRS

SEQ ID NO: 313769 - protein, 22 aa, Mycobacterium
ITVPFVPVPIPIQVPSREQPQP

SEQ ID NO: 313770 - protein, 29 aa, Mycobacterium
ITVSFPELRNHLGLAYGFYALCAVLSFLF

SEQ ID NO: 313771 - protein, 27 aa, Mycobacterium
ITVTLELPSTGGLYRFSNVTYRGIEVG

SEQ ID NO: 313772 - protein, 17 aa, Mycobacterium
ITYGWSLMLVVVFCVLY

SEQ ID NO: 313773 - protein, 17 aa, Mycobacterium
ITYLYPTKRSWAQGDRA

SEQ ID NO: 313774 - protein, 35 aa, Mycobacterium
IVAADGSVHRAEWALTEAMRVLIADAVSSANFTAP

SEQ ID NO: 313775 - protein, 31 aa, Mycobacterium
IVAAIGDRARPEWEWLKWLPHNQHPAAADEL

SEQ ID NO: 313776 - protein, 17 aa, Mycobacterium
IVAALFIFALWIATLGF

SEQ ID NO: 313777 - protein, 17 aa, Mycobacterium
IVAALFLYALWVGVLGF

SEQ ID NO: 313778 - protein, 28 aa, Mycobacterium
IVAAPARPGYRTALGARLGVPVEAISVA

SEQ ID NO: 313779 - protein, 26 aa, Mycobacterium
IVAAPPRPGFRAALSARLGVAAELIG

SEQ ID NO: 313780 - protein, 18 aa, Mycobacterium
IVAARVAVSVLFFLYGGK

SEQ ID NO: 313781 - protein, 25 aa, Mycobacterium
IVAASALCFLVGFAGLLWAPLTAPI

SEQ ID NO: 313782 - protein, 19 aa, Mycobacterium
IVAFFAMAVVLAVLVRNAV

SEQ ID NO: 313783 - protein, 21 aa, Mycobacterium
IVAFGLALAWLVTIWASAGLS

SEQ ID NO: 313784 - protein, 20 aa, Mycobacterium
IVAGGCWLLSGAGADRAFSV

SEQ ID NO: 313785 - protein, 22 aa, Mycobacterium
IVAGTCTFLSVPRLTHVLASIP

SEQ ID NO: 313786 - protein, 27 aa, Mycobacterium
IVAHWVWGPGGWLARLGVLDYAGGLVV

SEQ ID NO: 313787 - protein, 17 aa, Mycobacterium
IVAIIPLFFLLRHVGLT

SEQ ID NO: 313788 - protein, 25 aa, Mycobacterium
IVAIVACGWLMLNLAVRTWLFALSW

SEQ ID NO: 313789 - protein, 23 aa, Mycobacterium
IVALAWKHPRFDPAKPGRELPAW

SEQ ID NO: 313790 - protein, 30 aa, Mycobacterium
IVALPFVILVSLIFSRQWKLLGAYAAAGLI

SEQ ID NO: 313791 - protein, 20 aa, Mycobacterium
IVALVVGLLRYRRRRISLAA

SEQ ID NO: 313792 - protein, 17 aa, Mycobacterium
IVAPLYLIGSVIISYAS

SEQ ID NO: 313793 - protein, 18 aa, Mycobacterium
IVAPPFRSPESMATVLYA

SEQ ID NO: 313794 - protein, 17 aa, Mycobacterium
IVASFYAFSSWALIEGN

SEQ ID NO: 313795 - protein, 35 aa, Mycobacterium
IVATMPMLLFCIAFGLSMDYEVFLISRIREYWMAS

SEQ ID NO: 313796 - protein, 39 aa, Mycobacterium
IVAVLVWGVGANLGWWKGLAGLWKWATDASHKAAATSGV

SEQ ID NO: 313797 - protein, 17 aa, Mycobacterium
IVAVVVALIVVGVLVAL

SEQ ID NO: 313798 - protein, 18 aa, Mycobacterium
IVCAGSFYQFASYGSLLV

SEQ ID NO: 313799 - protein, 23 aa, Mycobacterium
IVCASILLAQYVRFGEISNTSGY

SEQ ID NO: 313800 - protein, 26 aa, Mycobacterium
IVCSAGYAGWAWLQPGSFRAWVTEPV

SEQ ID NO: 313801 - protein, 27 aa, Mycobacterium
IVCSAGYAGWAWLQPGSFRAWVTEPVR

SEQ ID NO: 313802 - protein, 18 aa, Mycobacterium
IVDAPGCRVRVTLPQFDN

SEQ ID NO: 313803 - protein, 17 aa, Mycobacterium
IVDCGVYVDGVRLPGKY

SEQ ID NO: 313804 - protein, 21 aa, Mycobacterium
IVDGLICYVGYLFPLWDAKRQ

SEQ ID NO: 313805 - protein, 25 aa, Mycobacterium
IVDKRLTPRWIRYERVDLAVGIVVV

SEQ ID NO: 313806 - protein, 18 aa, Mycobacterium
IVDKRLVWIVDGYTTLDN

SEQ ID NO: 313807 - protein, 21 aa, Mycobacterium
IVDPVAALTWDVPEGPLKPPQ

SEQ ID NO: 313808 - protein, 23 aa, Mycobacterium
IVDRLKELIKYKGYQVPPAELEA

SEQ ID NO: 313809 - protein, 20 aa, Mycobacterium
IVDSVPAPPGIKAHVAGTTV

SEQ ID NO: 313810 - protein, 22 aa, Mycobacterium
IVDTPDGLYCKLPQDSPIGVRG

SEQ ID NO: 313811 - protein, 19 aa, Mycobacterium
IVEHMKPPPGVKTYVTGAA

SEQ ID NO: 313812 - protein, 18 aa, Mycobacterium
IVEKGDGVGGVWRENTYP

SEQ ID NO: 313813 - protein, 23 aa, Mycobacterium
IVELHHWVNILGMHSGYKVTRLF

SEQ ID NO: 313814 - protein, 18 aa, Mycobacterium
IVEMGASLDVLFALIVLG

SEQ ID NO: 313815 - protein, 17 aa, Mycobacterium
IVEPWALHRPFIAWLGW

SEQ ID NO: 313816 - protein, 26 aa, Mycobacterium
IVEQWRPMLICAALVLTSQVADFMLT

SEQ ID NO: 313817 - protein, 17 aa, Mycobacterium
IVETGEIMVFVGRDFVV

SEQ ID NO: 313818 - protein, 26 aa, Mycobacterium
IVFDIEIVFLYPWAVSFDALGTFALV

SEQ ID NO: 313819 - protein, 25 aa, Mycobacterium
IVFDIEIVFLYPWAVSYDALGTFAL

SEQ ID NO: 313820 - protein, 23 aa, Mycobacterium
IVFGARLGGYALLIPAATCAAVA

SEQ ID NO: 313821 - protein, 17 aa, Mycobacterium
IVFGFLFAVHGASKLFA

SEQ ID NO: 313822 - protein, 19 aa, Mycobacterium
IVFIYRPLLFASVNAQVAE

SEQ ID NO: 313823 - protein, 17 aa, Mycobacterium
IVFLACRAAIMFAAGAL

SEQ ID NO: 313824 - protein, 22 aa, Mycobacterium
IVGACTLAAVVVAALLAPMAKI

SEQ ID NO: 313825 - protein, 25 aa, Mycobacterium
IVGALGILVMVVWVGTALTISTAAS

SEQ ID NO: 313826 - protein, 18 aa, Mycobacterium
IVGFCLLVLAIGAVLSFG

SEQ ID NO: 313827 - protein, 24 aa, Mycobacterium
IVGFPGPGWRTLRSREDQIVAERL

SEQ ID NO: 313828 - protein, 20 aa, Mycobacterium
IVGGFTCPPSVFGTFGEVAK

SEQ ID NO: 313829 - protein, 18 aa, Mycobacterium
IVGGIAWGGGATLAGYFL

SEQ ID NO: 313830 - protein, 21 aa, Mycobacterium
IVGGIDWDGHGLLGLEDSLDA

SEQ ID NO: 313831 - protein, 23 aa, Mycobacterium
IVGGIDWDGHGLLGLEDSLDAVL

SEQ ID NO: 313832 - protein, 17 aa, Mycobacterium
IVGGILWGGGVTLAGYF

SEQ ID NO: 313833 - protein, 23 aa, Mycobacterium
IVGGLLAGWLHFRMDYAGHTEVA

SEQ ID NO: 313834 - protein, 23 aa, Mycobacterium
IVGIACMLVWGLFRIFVLDDPLR

SEQ ID NO: 313835 - protein, 18 aa, Mycobacterium
IVGICLLESINYLEHYGL

SEQ ID NO: 313836 - protein, 27 aa, Mycobacterium
IVGLCAVGSLGWALRWAVGPWPSLREA

SEQ ID NO: 313837 - protein, 27 aa, Mycobacterium
IVGLMLVALFGWHAWHRADHPLLDLRL

SEQ ID NO: 313838 - protein, 20 aa, Mycobacterium
IVGLPLILVMGVSRSARTAV

SEQ ID NO: 313839 - protein, 24 aa, Mycobacterium
IVGLSIGGLVVFRKAVSQTRLENA

SEQ ID NO: 313840 - protein, 17 aa, Mycobacterium
IVGLSWAAIGFLYLLWL

SEQ ID NO: 313841 - protein, 28 aa, Mycobacterium
IVGLVRFGYRKRSWLSALGLVMTLVVAT

SEQ ID NO: 313842 - protein, 20 aa, Mycobacterium
IVGPPDLLPRAAAHTDEARF

SEQ ID NO: 313843 - protein, 26 aa, Mycobacterium
IVGSIDWEGYGLLGLEDSLDSALAGK

SEQ ID NO: 313844 - protein, 18 aa, Mycobacterium
IVGSLFMRNAWLGGTIVA

SEQ ID NO: 313845 - protein, 26 aa, Mycobacterium
IVGTGIPFLLGLAFGPQLIRPSLAGP

SEQ ID NO: 313846 - protein, 18 aa, Mycobacterium
IVGTRLATRVGFPSMLLF

SEQ ID NO: 313847 - protein, 31 aa, Mycobacterium
IVGTRLATRVGFPSMLLFLLVGVAVGEDGLG

SEQ ID NO: 313848 - protein, 18 aa, Mycobacterium
IVGTWMHWGLFGGDFPGH

SEQ ID NO: 313849 - protein, 19 aa, Mycobacterium
IVGTWWRYRYDKFGWTSRS

SEQ ID NO: 313850 - protein, 25 aa, Mycobacterium
IVGVFIPMMLGRPAVLMSPVAFMMK

SEQ ID NO: 313851 - protein, 36 aa, Mycobacterium
IVGWIIAPLIYRVRMSKYALPALMGLAFTFGLATLI

SEQ ID NO: 313852 - protein, 24 aa, Mycobacterium
IVGYAVGFVCLFILSGVGNGSIYK

SEQ ID NO: 313853 - protein, 17 aa, Mycobacterium
IVHKLPLVLAIIAVVTF

SEQ ID NO: 313854 - protein, 19 aa, Mycobacterium
IVIALPLLWWRYRHTDREA

SEQ ID NO: 313855 - protein, 21 aa, Mycobacterium
IVIALVFWGPYLVAVAHASLE

SEQ ID NO: 313856 - protein, 17 aa, Mycobacterium
IVIDFAVQMNVWRVIGV

SEQ ID NO: 313857 - protein, 17 aa, Mycobacterium
IVIIIMLLFFYRSIFTV

SEQ ID NO: 313858 - protein, 32 aa, Mycobacterium
IVIKKGHLKWAWIPGVPLLWDLIVTLTASWQK

SEQ ID NO: 313859 - protein, 36 aa, Mycobacterium
IVIKKGLLKWAWIPGLPLLWDLAVTLTASWQKVFSA

SEQ ID NO: 313860 - protein, 18 aa, Mycobacterium
IVILCVLVAIAGLGLFVA

SEQ ID NO: 313861 - protein, 24 aa, Mycobacterium
IVIPVAGVLYMLVRLVRRTVAGTW

SEQ ID NO: 313862 - protein, 17 aa, Mycobacterium
IVIYFVVAIIFPKPWSW

SEQ ID NO: 313863 - protein, 25 aa, Mycobacterium
IVKDDGPMPIRRAIEVIADSCQALN

SEQ ID NO: 313864 - protein, 17 aa, Mycobacterium
IVKSINLSKDWARAVID

SEQ ID NO: 313865 - protein, 24 aa, Mycobacterium
IVKSLNLSKDWARAVVDIPVSVSV

SEQ ID NO: 313866 - protein, 19 aa, Mycobacterium
IVKWWRAGGRAHRGADEPA

SEQ ID NO: 313867 - protein, 24 aa, Mycobacterium
IVLACFGVAFPTMIFVVHRRGIVR

SEQ ID NO: 313868 - protein, 18 aa, Mycobacterium
IVLALANLLWFIFAGLGA

SEQ ID NO: 313869 - protein, 19 aa, Mycobacterium
IVLALANLLWFVFAGFGAL

SEQ ID NO: 313870 - protein, 19 aa, Mycobacterium
IVLALANLLWFVFAGLGAL

SEQ ID NO: 313871 - protein, 26 aa, Mycobacterium
IVLALSGTVPWWFVLTLLARDAALAA

SEQ ID NO: 313872 - protein, 19 aa, Mycobacterium
IVLCALIIRQIYRPREDLV

SEQ ID NO: 313873 - protein, 26 aa, Mycobacterium
IVLDMVRRYGADFGFVSYDQAWLDGL

SEQ ID NO: 313874 - protein, 17 aa, Mycobacterium
IVLERLDVFAAIARSFA

SEQ ID NO: 313875 - protein, 17 aa, Mycobacterium
IVLGAAVGTVFTAFHSA

SEQ ID NO: 313876 - protein, 18 aa, Mycobacterium
IVLGLSGIVPWWFIAALL

SEQ ID NO: 313877 - protein, 20 aa, Mycobacterium
IVLGVISKWVVPPISKVLAE

SEQ ID NO: 313878 - protein, 19 aa, Mycobacterium
IVLHPLWGSVIFFAVMFCF

SEQ ID NO: 313879 - protein, 19 aa, Mycobacterium
IVLIARYVLHRLIDRATTG

SEQ ID NO: 313880 - protein, 18 aa, Mycobacterium
IVLILCRLVQGFATGGEY

SEQ ID NO: 313881 - protein, 18 aa, Mycobacterium
IVLITLVLLAVYRSLVTA

SEQ ID NO: 313882 - protein, 17 aa, Mycobacterium
IVLLAVFTAFIAHSPLH

SEQ ID NO: 313883 - protein, 17 aa, Mycobacterium
IVLLGWMVLGVLSVLGV

SEQ ID NO: 313884 - protein, 19 aa, Mycobacterium
IVLLLFLPAILYWESLNTS

SEQ ID NO: 313885 - protein, 20 aa, Mycobacterium
IVLLLFLPAILYWESLNTSF

SEQ ID NO: 313886 - protein, 17 aa, Mycobacterium
IVLLVWVVLAVLNVVGV

SEQ ID NO: 313887 - protein, 24 aa, Mycobacterium
IVLMACAWLTDTIGIYAIFGAFIL

SEQ ID NO: 313888 - protein, 18 aa, Mycobacterium
IVLMAIWFHFWQDDVRDL

SEQ ID NO: 313889 - protein, 31 aa, Mycobacterium
IVLPDGPIDFGWEIIDATSWQTGQLDEAIAA

SEQ ID NO: 313890 - protein, 17 aa, Mycobacterium
IVLPGAVVFAWLGAVPM

SEQ ID NO: 313891 - protein, 33 aa, Mycobacterium
IVLPPLLALCGKRLFWPFIPKVGATALTESGVW

SEQ ID NO: 313892 - protein, 17 aa, Mycobacterium
IVLPQAMRSVMPNAANE

SEQ ID NO: 313893 - protein, 23 aa, Mycobacterium
IVLRGLLLVAFPKFFASLANDMI

SEQ ID NO: 313894 - protein, 20 aa, Mycobacterium
IVLRHYWKEFLRHLSDIAWG

SEQ ID NO: 313895 - protein, 21 aa, Mycobacterium
IVLSCGALINGVKEFPGPWAL

SEQ ID NO: 313896 - protein, 20 aa, Mycobacterium
IVLSCIVYGMAFDFFNVSGS

SEQ ID NO: 313897 - protein, 21 aa, Mycobacterium
IVLSCVAAVYAGRGVLRAITS

SEQ ID NO: 313898 - protein, 29 aa, Mycobacterium
IVLSSFWGWRGPYGTHPINGFVIAMCLAI

SEQ ID NO: 313899 - protein, 20 aa, Mycobacterium
IVLWGSAGALGFVENDLGFK

SEQ ID NO: 313900 - protein, 22 aa, Mycobacterium
IVLWMLAAYPAFAGIRTAVGSS

SEQ ID NO: 313901 - protein, 17 aa, Mycobacterium
IVLYVLGAWLFALSTSG

SEQ ID NO: 313902 - protein, 18 aa, Mycobacterium
IVMPPLVWSLGPDDAQAI

SEQ ID NO: 313903 - protein, 21 aa, Mycobacterium
IVMRVVDVMFAFPVLLLALAI

SEQ ID NO: 313904 - protein, 17 aa, Mycobacterium
IVMSLGAAFGFSTLIWQ

SEQ ID NO: 313905 - protein, 18 aa, Mycobacterium
IVNKRMVWILDGYTTLDN

SEQ ID NO: 313906 - protein, 18 aa, Mycobacterium
IVNRLFLAVELVFVVLFI

SEQ ID NO: 313907 - protein, 17 aa, Mycobacterium
IVPIAVWVCGVYSAVRG

SEQ ID NO: 313908 - protein, 25 aa, Mycobacterium
IVPICAGIFGVVFGFISLNQIKRTG

SEQ ID NO: 313909 - protein, 19 aa, Mycobacterium
IVPLPWVIQAPRLFAGQIE

SEQ ID NO: 313910 - protein, 17 aa, Mycobacterium
IVPPIVYFVTYRWCIGL

SEQ ID NO: 313911 - protein, 27 aa, Mycobacterium
IVPSLVRLFGTWFWWPTRVFARPLRRQ

SEQ ID NO: 313912 - protein, 18 aa, Mycobacterium
IVPVSSLLRSHAVTSNDK

SEQ ID NO: 313913 - protein, 17 aa, Mycobacterium
IVQGRDLLGEFVSRQAS

SEQ ID NO: 313914 - protein, 24 aa, Mycobacterium
IVQGYQRFNWQVTIVSTVIIIALV

SEQ ID NO: 313915 - protein, 33 aa, Mycobacterium
IVQPFGEYLPMPWLFRHLSGYADRAGHFVPRPG

SEQ ID NO: 313916 - protein, 28 aa, Mycobacterium
IVQVVIRLAVCWLLSRHGLAAGIGDVGI

SEQ ID NO: 313917 - protein, 19 aa, Mycobacterium
IVQYLRYLGGVLHGDLGRA

SEQ ID NO: 313918 - protein, 29 aa, Mycobacterium
IVRLADRYAAWFLPLSLLLASAAWLASGS

SEQ ID NO: 313919 - protein, 22 aa, Mycobacterium
IVRLRHWGRWVGAAVIVAALVL

SEQ ID NO: 313920 - protein, 19 aa, Mycobacterium
IVRPIPFVVLIAALGPITL

SEQ ID NO: 313921 - protein, 26 aa, Mycobacterium
IVRRAPVIVIGLWIGLAAVLALTAPS

SEQ ID NO: 313922 - protein, 23 aa, Mycobacterium
IVRRSNALLDWAYGRQLRYSESM

SEQ ID NO: 313923 - protein, 33 aa, Mycobacterium
IVRSLVVPCLLRLLGPWFWWPTFIRQRPLRQAV

SEQ ID NO: 313924 - protein, 33 aa, Mycobacterium
IVRSLVVPCLLRLLGPWFWWPTFIRQRPLRTPD

SEQ ID NO: 313925 - protein, 22 aa, Mycobacterium
IVSALHRPVPLSGDGSDTDTVI

SEQ ID NO: 313926 - protein, 19 aa, Mycobacterium
IVSDLRVVGQLGMTIGIGL

SEQ ID NO: 313927 - protein, 23 aa, Mycobacterium
IVSEGDIAPPTRVVLRRQRNVQV

SEQ ID NO: 313928 - protein, 17 aa, Mycobacterium
IVSFFVVHNIIGISTFA

SEQ ID NO: 313929 - protein, 17 aa, Mycobacterium
IVSFWLLGFDTAGSPAW

SEQ ID NO: 313930 - protein, 19 aa, Mycobacterium
IVSGVAALVRAKFPQLSAY

SEQ ID NO: 313931 - protein, 20 aa, Mycobacterium
IVSGVAALVRAKFPQLSAYQ

SEQ ID NO: 313932 - protein, 23 aa, Mycobacterium
IVSGVPAALCWSTGPPGDPLSGE

SEQ ID NO: 313933 - protein, 19 aa, Mycobacterium
IVSHLAFDHEIRWIEVVHG

SEQ ID NO: 313934 - protein, 27 aa, Mycobacterium
IVSMLFKLEIARGFLVIALPVGVVVLV

SEQ ID NO: 313935 - protein, 18 aa, Mycobacterium
IVSPAWYSPLVLTVGSIA

SEQ ID NO: 313936 - protein, 26 aa, Mycobacterium
IVSVGRRGEFRYSFDQLRSRGVQVHL

SEQ ID NO: 313937 - protein, 18 aa, Mycobacterium
IVSVRINVLLTYYVNDLF

SEQ ID NO: 313938 - protein, 24 aa, Mycobacterium
IVTAGSLVVHWGTMHDLFAITDTV

SEQ ID NO: 313939 - protein, 17 aa, Mycobacterium
IVTEIFPVFSRKPVFGY

SEQ ID NO: 313940 - protein, 18 aa, Mycobacterium
IVTGALLVFFTLIFLLHG

SEQ ID NO: 313941 - protein, 18 aa, Mycobacterium
IVTGTGWPSQPGLSPVGQ

SEQ ID NO: 313942 - protein, 23 aa, Mycobacterium
IVTICLIVVMLLLVYRAPSTLLV

SEQ ID NO: 313943 - protein, 22 aa, Mycobacterium
IVTIPFGIGMIFYGNIAGGAFV

SEQ ID NO: 313944 - protein, 22 aa, Mycobacterium
IVTIPFGIGMIFYGNIAGGVFV

SEQ ID NO: 313945 - protein, 18 aa, Mycobacterium
IVTLSAWRGIRYTQRRHA

SEQ ID NO: 313946 - protein, 17 aa, Mycobacterium
IVTQWGPAVPFLIAAGG

SEQ ID NO: 313947 - protein, 21 aa, Mycobacterium
IVTSMSRWVRASAWLSQLYPL

SEQ ID NO: 313948 - protein, 22 aa, Mycobacterium
IVTYRSPILWLVPLLVIAFADR

SEQ ID NO: 313949 - protein, 20 aa, Mycobacterium
IVVACGLVLTAIFLLLYRTL

SEQ ID NO: 313950 - protein, 22 aa, Mycobacterium
IVVANALRLLGMPMQSINPAAP

SEQ ID NO: 313951 - protein, 18 aa, Mycobacterium
IVVAVPLGVIAAHKQYSI

SEQ ID NO: 313952 - protein, 26 aa, Mycobacterium
IVVFLCAVLFTIVWWNIDHDRTNWLP

SEQ ID NO: 313953 - protein, 22 aa, Mycobacterium
IVVFYGVVLFWGLPDNNAPTHP

SEQ ID NO: 313954 - protein, 20 aa, Mycobacterium
IVVGVLLILWGAYRWLKRAS

SEQ ID NO: 313955 - protein, 17 aa, Mycobacterium
IVVLALIYQWARVVWSR

SEQ ID NO: 313956 - protein, 18 aa, Mycobacterium
IVVLIAGTVVWFGITDAW

SEQ ID NO: 313957 - protein, 18 aa, Mycobacterium
IVVPTSLAPMMTMAVIIT

SEQ ID NO: 313958 - protein, 19 aa, Mycobacterium
IVVQLLLPFVAGQVLRPKL

SEQ ID NO: 313959 - protein, 20 aa, Mycobacterium
IVVSCYVALVVTNFAWLFPI

SEQ ID NO: 313960 - protein, 20 aa, Mycobacterium
IVVSPAWIFRRGVLAWNGQI

SEQ ID NO: 313961 - protein, 22 aa, Mycobacterium
IVVTCAHCFNALGNEYPQVGGD

SEQ ID NO: 313962 - protein, 20 aa, Mycobacterium
IVVTCPHCFNTIGKEYRQLG

SEQ ID NO: 313963 - protein, 20 aa, Mycobacterium
IVVTCPHCFNTIGREYPQLG

SEQ ID NO: 313964 - protein, 21 aa, Mycobacterium
IVVTCPHCFNTLGREYRQLGA

SEQ ID NO: 313965 - protein, 17 aa, Mycobacterium
IVVTRYLTVPAEDAEPR

SEQ ID NO: 313966 - protein, 17 aa, Mycobacterium
IVVTRYLTVPAEDATPR

SEQ ID NO: 313967 - protein, 25 aa, Mycobacterium
IVVVIAGAVVWFGITSAWKERLDRR

SEQ ID NO: 313968 - protein, 17 aa, Mycobacterium
IVVVLGFAITSLGLAAV

SEQ ID NO: 313969 - protein, 20 aa, Mycobacterium
IVVWVQFRGGFTPKITLTAL

SEQ ID NO: 313970 - protein, 20 aa, Mycobacterium
IVWFHFWQDRVRDLMGVPRL

SEQ ID NO: 313971 - protein, 19 aa, Mycobacterium
IVWTSCVITALGLVILLLF

SEQ ID NO: 313972 - protein, 36 aa, Mycobacterium
IVYAALKLVDVRSFRALARFRRSEVVLAALTAIAVT

SEQ ID NO: 313973 - protein, 26 aa, Mycobacterium
IVYGLGFWKGVLAIVVGNAVLFGYVG

SEQ ID NO: 313974 - protein, 18 aa, Mycobacterium
IVYLSMIILLVFWHTFLM

SEQ ID NO: 313975 - protein, 22 aa, Mycobacterium
IWAEEAWGRYWGWDPKETVSFI

SEQ ID NO: 313976 - protein, 23 aa, Mycobacterium
IWAEEAWGRYWGWDPKETVSFVA

SEQ ID NO: 313977 - protein, 18 aa, Mycobacterium
IWAGANIAPINWILGALG

SEQ ID NO: 313978 - protein, 20 aa, Mycobacterium
IWEGGLGIWGAVAFGAVGAW

SEQ ID NO: 313979 - protein, 39 aa, Mycobacterium
IWGAVALGAVGAWIACRRRGIPLPAFGDAIAPGIVLAQA

SEQ ID NO: 313980 - protein, 24 aa, Mycobacterium
IWGAVALGCVGAWIACRRHGIPLP

SEQ ID NO: 313981 - protein, 29 aa, Mycobacterium
IWGAVALGGVGAWIGCRRHGIPLPAFADA

SEQ ID NO: 313982 - protein, 25 aa, Mycobacterium
IWGVSFPRAMFWTVLGYVLVATVIS

SEQ ID NO: 313983 - protein, 19 aa, Mycobacterium
IWHRSGINIVKRPGAHLAV

SEQ ID NO: 313984 - protein, 17 aa, Mycobacterium
IWHVMAVAFAMGCAAAI

SEQ ID NO: 313985 - protein, 23 aa, Mycobacterium
IWLAHSMPTWAAVLVSTAISLVA

SEQ ID NO: 313986 - protein, 27 aa, Mycobacterium
IWLDRLRTLARRTCVVTLPYAQADLDA

SEQ ID NO: 313987 - protein, 21 aa, Mycobacterium
IWLLHYGNRGWFFPLSIRQVP

SEQ ID NO: 313988 - protein, 26 aa, Mycobacterium
IWLNRLRALAHRTCVAPLPYAQADLD

SEQ ID NO: 313989 - protein, 18 aa, Mycobacterium
IWLSVIVLLPLAAILWQA

SEQ ID NO: 313990 - protein, 23 aa, Mycobacterium
IWLYGDNVGKGYWGRPHETEVSF

SEQ ID NO: 313991 - protein, 28 aa, Mycobacterium
IWQHILHMPLHWLVLPMAIIVMLAVGSD

SEQ ID NO: 313992 - protein, 24 aa, Mycobacterium
IWQHLGDFQLHWVATEFALIVLLA

SEQ ID NO: 313993 - protein, 22 aa, Mycobacterium
IWQHSKHIFVFDMAMLIFLSAA

SEQ ID NO: 313994 - protein, 22 aa, Mycobacterium
IWQHSKHIFVFDMAMLTLLSIA

SEQ ID NO: 313995 - protein, 23 aa, Mycobacterium
IWQYIFGIELYWMVLPMSVIVLL

SEQ ID NO: 313996 - protein, 24 aa, Mycobacterium
IWQYILGIELHWLVMQMAIIVLLA

SEQ ID NO: 313997 - protein, 22 aa, Mycobacterium
IWQYILGINLYWMVLPMSVIVL

SEQ ID NO: 313998 - protein, 28 aa, Mycobacterium
IWRLAAFMVVCTLGLAAMLAIFAQLRFG

SEQ ID NO: 313999 - protein, 30 aa, Mycobacterium
IWRLAIFMVVCTLGLIAMLAIFADLRFGDE

SEQ ID NO: 314000 - protein, 27 aa, Mycobacterium
IWRRASDWWLLLGLFVLFPMTFFGANF

SEQ ID NO: 314001 - protein, 24 aa, Mycobacterium
IWSRISVSVFAAVEFIGRPRGERR

SEQ ID NO: 314002 - protein, 24 aa, Mycobacterium
IWVARLVPIPGIAIRLLAAGLFAG

SEQ ID NO: 314003 - protein, 20 aa, Mycobacterium
IWVGIISVFLGIAMWEVTKR

SEQ ID NO: 314004 - protein, 21 aa, Mycobacterium
IWVSAFLLFPGFTPPMSPRMP

SEQ ID NO: 314005 - protein, 20 aa, Mycobacterium
IWWLAGAGWAIAAALVVLVV

SEQ ID NO: 314006 - protein, 27 aa, Mycobacterium
IYADRRFGLGHGRLFALYVAAYCVGRF

SEQ ID NO: 314007 - protein, 39 aa, Mycobacterium
IYADRRFTLGHGRLFALYVAGYCVGRFCVELLRDDTATH

SEQ ID NO: 314008 - protein, 25 aa, Mycobacterium
IYALACVLFECLTGAPPYRADSAGM

SEQ ID NO: 314009 - protein, 24 aa, Mycobacterium
IYALACVLFECLTGSPPYRSDSAG

SEQ ID NO: 314010 - protein, 18 aa, Mycobacterium
IYALACVLYECLTGQLPF

SEQ ID NO: 314011 - protein, 22 aa, Mycobacterium
IYASQLTPWWLRILGAKIGKDT

SEQ ID NO: 314012 - protein, 24 aa, Mycobacterium
IYDHPRLGSLAGYLDELSPPPEIT

SEQ ID NO: 314013 - protein, 17 aa, Mycobacterium
IYDIALWAVPFGLAGGR

SEQ ID NO: 314014 - protein, 18 aa, Mycobacterium
IYDNGGARIYEWSGKTAQ

SEQ ID NO: 314015 - protein, 23 aa, Mycobacterium
IYDRIPVVAGLVLGLGIAGVGLV

SEQ ID NO: 314016 - protein, 18 aa, Mycobacterium
IYGLAASVLPVWLLLAPR

SEQ ID NO: 314017 - protein, 19 aa, Mycobacterium
IYGLMTWLTLWRVVNERQD

SEQ ID NO: 314018 - protein, 25 aa, Mycobacterium
IYGYHWIHRVQNWLTWLFLATFGVF

SEQ ID NO: 314019 - protein, 17 aa, Mycobacterium
IYIWSLLMALALNKVWR

SEQ ID NO: 314020 - protein, 18 aa, Mycobacterium
IYLLVHWVAPGGMGAGDV

SEQ ID NO: 314021 - protein, 21 aa, Mycobacterium
IYLSNFNRPYALWVPIVLLVP

SEQ ID NO: 314022 - protein, 24 aa, Mycobacterium
IYPLPARASALGWSNGTSFVGSFT

SEQ ID NO: 314023 - protein, 25 aa, Mycobacterium
IYPTWPQMMPWTALWLATLGAAILL

SEQ ID NO: 314024 - protein, 17 aa, Mycobacterium
IYQEVQANFRAGQANSI

SEQ ID NO: 314025 - protein, 20 aa, Mycobacterium
IYRIAKRMRGGEVDEAALER

SEQ ID NO: 314026 - protein, 19 aa, Mycobacterium
IYTWLGVNFSQRFGLTLVG

SEQ ID NO: 314027 - protein, 18 aa, Mycobacterium
IYVASLFGYWWVSSSYPA

SEQ ID NO: 314028 - protein, 25 aa, Mycobacterium
IYYGLPMWLILLLRVVFLLLAVGSL

SEQ ID NO: 314029 - protein, 18 aa, Mycobacterium
IYYPRYLILTAPAAAVIL

SEQ ID NO: 314030 - protein, 17 aa, Mycobacterium
IYYPRYLILTAPGAAVI

SEQ ID NO: 314031 - protein, 26 aa, Mycobacterium
IYYPVSAIMWVWYKAFSFLLGPTNFF

SEQ ID NO: 314032 - protein, 26 aa, Mycobacterium
IYYSPRIFAAMGFTGDFALLGLPALV

SEQ ID NO: 314033 - protein, 26 aa, Mycobacterium
IYYSPRIFAAMGFTGNFALLALPALV

SEQ ID NO: 314034 - protein, 24 aa, Mycobacterium
IYYSPRIFEAMGFTGDFALLGLPA

SEQ ID NO: 314035 - protein, 24 aa, Mycobacterium
IYYSPRIFEAMGFTGNFALLGLPA

SEQ ID NO: 314036 - protein, 20 aa, Mycobacterium
KAAAAWRAAYADPMIASIQP

SEQ ID NO: 314037 - protein, 18 aa, Mycobacterium
KAAAIGAAVGALLWVAPL

SEQ ID NO: 314038 - protein, 18 aa, Mycobacterium
KAAARRVRASNLDDNIDT

SEQ ID NO: 314039 - protein, 21 aa, Mycobacterium
KAALALDGMAIVPGLGAIGRG

SEQ ID NO: 314040 - protein, 17 aa, Mycobacterium
KAALAMTAASWAILGVI

SEQ ID NO: 314041 - protein, 25 aa, Mycobacterium
KAARDTRDSLAIWSNILPITFAALG

SEQ ID NO: 314042 - protein, 20 aa, Mycobacterium
KAAYVAGWMYFFNWAATAIV

SEQ ID NO: 314043 - protein, 35 aa, Mycobacterium
KADSGIWRKVGTVTVRWPGRILVVSSVVVMIGSIT

SEQ ID NO: 314044 - protein, 21 aa, Mycobacterium
KADSWGRKPIFLLGFGVLAAR

SEQ ID NO: 314045 - protein, 20 aa, Mycobacterium
KADTKTGMYWAPDSADYEDA

SEQ ID NO: 314046 - protein, 20 aa, Mycobacterium
KADVKPVWQALRHTDTWVLS

SEQ ID NO: 314047 - protein, 17 aa, Mycobacterium
KADVLLDCFRPGTCERL

SEQ ID NO: 314048 - protein, 36 aa, Mycobacterium
KAEFLYHHFRSLRRWRPRYAYAFGFIDQAARLASAM

SEQ ID NO: 314049 - protein, 23 aa, Mycobacterium
KAEGAWWGWHGAGWFLFTLMVLT

SEQ ID NO: 314050 - protein, 21 aa, Mycobacterium
KAFAYWLDRYELLSNDRSAKP

SEQ ID NO: 314051 - protein, 19 aa, Mycobacterium
KAFFDDVTARLSVVDCPGN

SEQ ID NO: 314052 - protein, 21 aa, Mycobacterium
KAFGWWGGPGFDGFGTSLDDM

SEQ ID NO: 314053 - protein, 21 aa, Mycobacterium
KAGAAGPFLGSIPFPDVDVAR

SEQ ID NO: 314054 - protein, 18 aa, Mycobacterium
KAGDRRRSAIFLGPTAEQ

SEQ ID NO: 314055 - protein, 18 aa, Mycobacterium
KAGDRYLLCSDGLSDPVS

SEQ ID NO: 314056 - protein, 36 aa, Mycobacterium
KAGKPPRKRVFEWGWEVLAALAIAAVFAIAAAQVQL

SEQ ID NO: 314057 - protein, 18 aa, Mycobacterium
KAGSSWLGSPPVRLRRRP

SEQ ID NO: 314058 - protein, 19 aa, Mycobacterium
KAHGARPGALIGQSLGEAA

SEQ ID NO: 314059 - protein, 22 aa, Mycobacterium
KAHGVKSWTALLTMAILLLVYL

SEQ ID NO: 314060 - protein, 32 aa, Mycobacterium
KAHPVIGPWLDRLQAFNVFSSFWFTAIYVLLF

SEQ ID NO: 314061 - protein, 20 aa, Mycobacterium
KAHQVCPVGAVVATKTDLYP

SEQ ID NO: 314062 - protein, 22 aa, Mycobacterium
KAIGKIPMKVGALWDSITGSER

SEQ ID NO: 314063 - protein, 18 aa, Mycobacterium
KAIGRPGILTAINAGKLA

SEQ ID NO: 314064 - protein, 26 aa, Mycobacterium
KAIIYCAAATLIHCYYGYFASGGPVG

SEQ ID NO: 314065 - protein, 18 aa, Mycobacterium
KAILRDVLIRELHPDMDR

SEQ ID NO: 314066 - protein, 18 aa, Mycobacterium
KAIPQWSIALIALVIVLT

SEQ ID NO: 314067 - protein, 21 aa, Mycobacterium
KAIRTVRFWAAPLIITLALMS

SEQ ID NO: 314068 - protein, 18 aa, Mycobacterium
KAISFFLGTAFLVGAPLP

SEQ ID NO: 314069 - protein, 25 aa, Mycobacterium
KAITFARSRIRGIRLTEPIPLRWAK

SEQ ID NO: 314070 - protein, 20 aa, Mycobacterium
KAKAIEFVKKPAVTVSLAGV

SEQ ID NO: 314071 - protein, 17 aa, Mycobacterium
KAKRSRATAALIAVAIV

SEQ ID NO: 314072 - protein, 20 aa, Mycobacterium
KAKSYAGIVAVIAVLGALLA

SEQ ID NO: 314073 - protein, 20 aa, Mycobacterium
KAKVIEFVTKPAVTVTLVGV

SEQ ID NO: 314074 - protein, 19 aa, Mycobacterium
KALAAREGYALEHCYAYSD

SEQ ID NO: 314075 - protein, 18 aa, Mycobacterium
KALAQAFSVRKQLDDAIP

SEQ ID NO: 314076 - protein, 19 aa, Mycobacterium
KALARLEAKPAGKAQKMVS

SEQ ID NO: 314077 - protein, 25 aa, Mycobacterium
KALDARVGFMVGWAVLLDYLFLPLV

SEQ ID NO: 314078 - protein, 22 aa, Mycobacterium
KALEGRPALVLDRVASHEGQVK

SEQ ID NO: 314079 - protein, 23 aa, Mycobacterium
KALEGRSALVLDRVAHHEGQVKL

SEQ ID NO: 314080 - protein, 18 aa, Mycobacterium
KALFDRFAPKGPDGKPSI

SEQ ID NO: 314081 - protein, 18 aa, Mycobacterium
KALFLGFMFAFAIKAPLW

SEQ ID NO: 314082 - protein, 20 aa, Mycobacterium
KALFRLRSLVFAHAQRLDLD

SEQ ID NO: 314083 - protein, 20 aa, Mycobacterium
KALGGWAGFSVAWLYWYFWV

SEQ ID NO: 314084 - protein, 17 aa, Mycobacterium
KALGLAIVNFAIALSAA

SEQ ID NO: 314085 - protein, 25 aa, Mycobacterium
KALPASAVVGLWTFDGHEGRSEVAS

SEQ ID NO: 314086 - protein, 25 aa, Mycobacterium
KALPPTSVVGLWTFDGHEGRSEVPG

SEQ ID NO: 314087 - protein, 18 aa, Mycobacterium
KALPVTSEVGLWTFDGTE

SEQ ID NO: 314088 - protein, 20 aa, Mycobacterium
KALRPRQWVKNVLVLAAPVA

SEQ ID NO: 314089 - protein, 17 aa, Mycobacterium
KALTGLRIVAALWVVLF

SEQ ID NO: 314090 - protein, 21 aa, Mycobacterium
KAMVPHEWYAHGSCSGVTPAV

SEQ ID NO: 314091 - protein, 17 aa, Mycobacterium
KANEILIQIARAEPATG

SEQ ID NO: 314092 - protein, 21 aa, Mycobacterium
KANFLQVFLTWLIFNVLISVG

SEQ ID NO: 314093 - protein, 20 aa, Mycobacterium
KAPPAFAARMVLGAFYGAVF

SEQ ID NO: 314094 - protein, 19 aa, Mycobacterium
KAPPLKLFDVRSAQQAYRY

SEQ ID NO: 314095 - protein, 27 aa, Mycobacterium
KAPPVAWRILVVLGLIGTVLMIVWFHF

SEQ ID NO: 314096 - protein, 18 aa, Mycobacterium
KAPTLALIVPGVIGFALS

SEQ ID NO: 314097 - protein, 17 aa, Mycobacterium
KAPVLALIVPGIVGFLL

SEQ ID NO: 314098 - protein, 24 aa, Mycobacterium
KAQSRRWRLSSALRAYLDLGAMDI

SEQ ID NO: 314099 - protein, 19 aa, Mycobacterium
KARELSHALGVRRAAVITA

SEQ ID NO: 314100 - protein, 21 aa, Mycobacterium
KARGWIHFYACVIAIVTGIVL

SEQ ID NO: 314101 - protein, 33 aa, Mycobacterium
KARHPWPDYRPPRAGQWVPIYGLTSILLGGLPL

SEQ ID NO: 314102 - protein, 25 aa, Mycobacterium
KARSPRTAGVLSYLLTRPSRLERTG

SEQ ID NO: 314103 - protein, 19 aa, Mycobacterium
KARVGDIKKITGFLDTQIA

SEQ ID NO: 314104 - protein, 18 aa, Mycobacterium
KASAWLFDMAMLAVLSIA

SEQ ID NO: 314105 - protein, 19 aa, Mycobacterium
KASAWLFDMAMLGVVSIAY

SEQ ID NO: 314106 - protein, 21 aa, Mycobacterium
KASAWVGALVLGWWIAVLVYL

SEQ ID NO: 314107 - protein, 20 aa, Mycobacterium
KASEVDWVLDRLARQIDDLR

SEQ ID NO: 314108 - protein, 20 aa, Mycobacterium
KASPLGLLVVVVLVIATLFL

SEQ ID NO: 314109 - protein, 18 aa, Mycobacterium
KASPWVLNVSSAWTSSPQ

SEQ ID NO: 314110 - protein, 23 aa, Mycobacterium
KASVGSWRLVRDFADEMRSDLSD

SEQ ID NO: 314111 - protein, 25 aa, Mycobacterium
KATASFGVAPLMLWQQLTKHYTNIS

SEQ ID NO: 314112 - protein, 24 aa, Mycobacterium
KATGRLDPYVRVVAALINVGDGLP

SEQ ID NO: 314113 - protein, 23 aa, Mycobacterium
KATQRDGRWRPLAQVPLRQRQSV

SEQ ID NO: 314114 - protein, 26 aa, Mycobacterium
KATYYCIVVVPAAMVGMSGWQRGKKY

SEQ ID NO: 314115 - protein, 20 aa, Mycobacterium
KAVAELLALAGTKFLVLGAD

SEQ ID NO: 314116 - protein, 22 aa, Mycobacterium
KAVEPITVCLNGDTRDSYSGAD

SEQ ID NO: 314117 - protein, 23 aa, Mycobacterium
KAVFARNPLKWIYLTIAVLAVAS

SEQ ID NO: 314118 - protein, 18 aa, Mycobacterium
KAVGRVGVVLGVVAVAAD

SEQ ID NO: 314119 - protein, 19 aa, Mycobacterium
KAVLPVAAVFLIWDEIAIA

SEQ ID NO: 314120 - protein, 19 aa, Mycobacterium
KAVLVGALLLMGVATAVIG

SEQ ID NO: 314121 - protein, 18 aa, Mycobacterium
KAVMMIIAGLIFAALAGL

SEQ ID NO: 314122 - protein, 28 aa, Mycobacterium
KAVSPKVWGRRGAPLLLVFSVAARLAWT

SEQ ID NO: 314123 - protein, 22 aa, Mycobacterium
KAWTDERWRAHLAVAVGVVVIA

SEQ ID NO: 314124 - protein, 20 aa, Mycobacterium
KAWYVPVGVAGTLGDLKAAE

SEQ ID NO: 314125 - protein, 19 aa, Mycobacterium
KAYLLAKMAVFFVFAIVQS

SEQ ID NO: 314126 - protein, 26 aa, Mycobacterium
KAYQEFRVDDMLAWTTLFIVAMVLIE

SEQ ID NO: 314127 - protein, 20 aa, Mycobacterium
KAYVAGLILTVFSMRVAAAI

SEQ ID NO: 314128 - protein, 18 aa, Mycobacterium
KCNGATLHVSERGYPGSI

SEQ ID NO: 314129 - protein, 27 aa, Mycobacterium
KDAPRNWRLSVDLRRDGDQIKMAKVEF

SEQ ID NO: 314130 - protein, 22 aa, Mycobacterium
KDARNLPGLAIIGVSLVVFVSS

SEQ ID NO: 314131 - protein, 25 aa, Mycobacterium
KDAWMVGFTPSLSTAVWVGTDDGKP

SEQ ID NO: 314132 - protein, 20 aa, Mycobacterium
KDCLRRAECEAKDLDLVVNA

SEQ ID NO: 314133 - protein, 19 aa, Mycobacterium
KDDDGLLCMSSTSAGSHFD

SEQ ID NO: 314134 - protein, 24 aa, Mycobacterium
KDDLAWRDFCLRVADRVILVAGQP

SEQ ID NO: 314135 - protein, 21 aa, Mycobacterium
KDELNSILLLAIWIGVGWIAQ

SEQ ID NO: 314136 - protein, 33 aa, Mycobacterium
KDEPKPRRRPILLAGRSLAALFAVLALVLTGGA

SEQ ID NO: 314137 - protein, 21 aa, Mycobacterium
KDGQLTLDWDDVVQRSVTVVR

SEQ ID NO: 314138 - protein, 24 aa, Mycobacterium
KDHLELGEALGLIDMERGAKVSGS

SEQ ID NO: 314139 - protein, 17 aa, Mycobacterium
KDIGLHVVIARRTSGAS

SEQ ID NO: 314140 - protein, 29 aa, Mycobacterium
KDIIARFNARTGYHLALRAGINTGNVISG

SEQ ID NO: 314141 - protein, 17 aa, Mycobacterium
KDIIAYVRASSETPDPG

SEQ ID NO: 314142 - protein, 25 aa, Mycobacterium
KDKALRRKGTRLGVRTLAIGSGAVL

SEQ ID NO: 314143 - protein, 17 aa, Mycobacterium
KDLGLKIIFGLPGIVLA

SEQ ID NO: 314144 - protein, 21 aa, Mycobacterium
KDLLSGFFILAERQYGFGDLV

SEQ ID NO: 314145 - protein, 20 aa, Mycobacterium
KDLYARLQILPMSFHGRWQS

SEQ ID NO: 314146 - protein, 22 aa, Mycobacterium
KDMRDGSRWDLLIAGVAAVSLI

SEQ ID NO: 314147 - protein, 23 aa, Mycobacterium
KDNKAWNLPVMFKTSQDDPATQS

SEQ ID NO: 314148 - protein, 25 aa, Mycobacterium
KDPYRAVPRAIMWSAAGVGVLYVFA

SEQ ID NO: 314149 - protein, 20 aa, Mycobacterium
KDQERVAAERVIFARMTPEN

SEQ ID NO: 314150 - protein, 18 aa, Mycobacterium
KDQLKEKRLPVIVHTGRE

SEQ ID NO: 314151 - protein, 24 aa, Mycobacterium
KDRLAADVHLVWWMVAVVGFNSLL

SEQ ID NO: 314152 - protein, 25 aa, Mycobacterium
KDSRIAEPVLRELYAALLADGAPFL

SEQ ID NO: 314153 - protein, 19 aa, Mycobacterium
KDTHSRVAEAGRYPVVASI

SEQ ID NO: 314154 - protein, 24 aa, Mycobacterium
KDTRGIIRVHQFDKVEGFVYCRPE

SEQ ID NO: 314155 - protein, 18 aa, Mycobacterium
KDVAGRDAFPASFVVKLD

SEQ ID NO: 314156 - protein, 21 aa, Mycobacterium
KDVVSGLLWPAVAVAAFAACG

SEQ ID NO: 314157 - protein, 24 aa, Mycobacterium
KEALRTAWRPILQIAGLVVIHNVG

SEQ ID NO: 314158 - protein, 26 aa, Mycobacterium
KEAQLWPLVFGRAAAVVVVLIAAVAT

SEQ ID NO: 314159 - protein, 25 aa, Mycobacterium
KEEGLPFWIIFSCAVAIGLGTYLGG

SEQ ID NO: 314160 - protein, 23 aa, Mycobacterium
KEEPREWRLKVTVTEEDGQYKMS

SEQ ID NO: 314161 - protein, 27 aa, Mycobacterium
KEFDTALSMSPDFPGLVDLRTSAVNLR

SEQ ID NO: 314162 - protein, 24 aa, Mycobacterium
KEFTRGRVAAFSIADERSERLVIV

SEQ ID NO: 314163 - protein, 20 aa, Mycobacterium
KEGKAAWSRAMSGALIGFAG

SEQ ID NO: 314164 - protein, 21 aa, Mycobacterium
KEICNLMGLRQLGCSTGTLQD

SEQ ID NO: 314165 - protein, 25 aa, Mycobacterium
KEIVISTKMSQSWSKDQVMEAYLNI

SEQ ID NO: 314166 - protein, 17 aa, Mycobacterium
KELDALLLAAIGLSNSG

SEQ ID NO: 314167 - protein, 17 aa, Mycobacterium
KELGVRTPGKLDWAGTL

SEQ ID NO: 314168 - protein, 19 aa, Mycobacterium
KELVISTKMSGEWSKDAVL

SEQ ID NO: 314169 - protein, 18 aa, Mycobacterium
KELVISTKMSSEWSKDQV

SEQ ID NO: 314170 - protein, 24 aa, Mycobacterium
KENARKFAFRKRVLMGLVGAMVVA

SEQ ID NO: 314171 - protein, 20 aa, Mycobacterium
KENFVSFLLLSLAVAIVAGV

SEQ ID NO: 314172 - protein, 26 aa, Mycobacterium
KEPGRLKRFAARARKRSSGKIVPAVL

SEQ ID NO: 314173 - protein, 20 aa, Mycobacterium
KEPLLIWTLIASLFIGNFLL

SEQ ID NO: 314174 - protein, 20 aa, Mycobacterium
KEPYVPLGTNPWYGDPNQIL

SEQ ID NO: 314175 - protein, 22 aa, Mycobacterium
KEQAIYRREHGIGMSGGAYLAS

SEQ ID NO: 314176 - protein, 19 aa, Mycobacterium
KERDSWLLSLLYVGTFGSF

SEQ ID NO: 314177 - protein, 19 aa, Mycobacterium
KEREFHLALVGALMVAALA

SEQ ID NO: 314178 - protein, 28 aa, Mycobacterium
KERLDRRLDEAAGFAIPFLPRGLDDIPR

SEQ ID NO: 314179 - protein, 17 aa, Mycobacterium
KERPRVIAVDAVPTEVA

SEQ ID NO: 314180 - protein, 18 aa, Mycobacterium
KERSEGWIGKLLAVAGVA

SEQ ID NO: 314181 - protein, 25 aa, Mycobacterium
KESMARGWPVLTFSRPVSLGDRIPV

SEQ ID NO: 314182 - protein, 21 aa, Mycobacterium
KETFPKPGPIGGYAGVPTYVP

SEQ ID NO: 314183 - protein, 24 aa, Mycobacterium
KETLPRPGGLITLAGDQCDGDPRV

SEQ ID NO: 314184 - protein, 22 aa, Mycobacterium
KEWGHRLRAFVVKKDGADLDED

SEQ ID NO: 314185 - protein, 22 aa, Mycobacterium
KEWGHRLRAFVVKKDGSDVDED

SEQ ID NO: 314186 - protein, 26 aa, Mycobacterium
KEYFTGTGIKGRFLAWFYTVVGQVPI

SEQ ID NO: 314187 - protein, 18 aa, Mycobacterium
KFAAWMVFVPVWAVVVYS

SEQ ID NO: 314188 - protein, 17 aa, Mycobacterium
KFAAWMVFVPVWTIAVY

SEQ ID NO: 314189 - protein, 21 aa, Mycobacterium
KFAWLFMRFSGVVLVFLALGH

SEQ ID NO: 314190 - protein, 24 aa, Mycobacterium
KFDDGYEAYREWVLARMIDKGIMP

SEQ ID NO: 314191 - protein, 18 aa, Mycobacterium
KFDPEWVKADGKTCRFNP

SEQ ID NO: 314192 - protein, 19 aa, Mycobacterium
KFFPWPITLDNYRGIFSGN

SEQ ID NO: 314193 - protein, 20 aa, Mycobacterium
KFFTWTGWASPAAWLNTAHQ

SEQ ID NO: 314194 - protein, 30 aa, Mycobacterium
KFGHMFTGMAIRIADVWKITRKVGVQESYG

SEQ ID NO: 314195 - protein, 19 aa, Mycobacterium
KFHRGDMEMVLLVNSDSGV

SEQ ID NO: 314196 - protein, 20 aa, Mycobacterium
KFKRVMKMFLSPDGHAARFI

SEQ ID NO: 314197 - protein, 18 aa, Mycobacterium
KFPNLTAHQVIHRLEATA

SEQ ID NO: 314198 - protein, 24 aa, Mycobacterium
KFREISPLLWVVALGFVLYFARGW

SEQ ID NO: 314199 - protein, 17 aa, Mycobacterium
KFRGARVPISIGDGDRA

SEQ ID NO: 314200 - protein, 17 aa, Mycobacterium
KFSGGAISWDRADNTFT

SEQ ID NO: 314201 - protein, 17 aa, Mycobacterium
KFVPIFRNINKLSRNWF

SEQ ID NO: 314202 - protein, 20 aa, Mycobacterium
KFVRRTIIFNGWNWSVSQAI

SEQ ID NO: 314203 - protein, 27 aa, Mycobacterium
KFYLPPRLVSLYGTEIWDEMTREQQIE

SEQ ID NO: 314204 - protein, 20 aa, Mycobacterium
KFYLPPRLVSLYGTPMWDEM

SEQ ID NO: 314205 - protein, 19 aa, Mycobacterium
KGAASSVAEWVRGQGGKVP

SEQ ID NO: 314206 - protein, 20 aa, Mycobacterium
KGAAWAAVIGLLIVVLVALT

SEQ ID NO: 314207 - protein, 21 aa, Mycobacterium
KGAAWSAVIGLVAVVLIATTI

SEQ ID NO: 314208 - protein, 25 aa, Mycobacterium
KGACPMLDLPLKVFVQRNYTECEHW

SEQ ID NO: 314209 - protein, 25 aa, Mycobacterium
KGALALRLLTIAFFALVYLLPLILW

SEQ ID NO: 314210 - protein, 17 aa, Mycobacterium
KGARSDRGFHMNLDGVL

SEQ ID NO: 314211 - protein, 20 aa, Mycobacterium
KGARTDRGFCMSLDGVLEGK

SEQ ID NO: 314212 - protein, 25 aa, Mycobacterium
KGASQRLADRIARPLVPGIMIAGAA

SEQ ID NO: 314213 - protein, 25 aa, Mycobacterium
KGASQRLADRIARPLVPGIMVTGAL

SEQ ID NO: 314214 - protein, 18 aa, Mycobacterium
KGATFDCDVSIDGAPKHV

SEQ ID NO: 314215 - protein, 21 aa, Mycobacterium
KGCPLFLVVLGSVLALMHFYV

SEQ ID NO: 314216 - protein, 28 aa, Mycobacterium
KGEAGADIFRHFPQVVAVISNMAEKRSL

SEQ ID NO: 314217 - protein, 21 aa, Mycobacterium
KGEATFDGFEKLNHTVEIISN

SEQ ID NO: 314218 - protein, 20 aa, Mycobacterium
KGEPAVQVGKNWSVLAEIPE

SEQ ID NO: 314219 - protein, 22 aa, Mycobacterium
KGEPSLPVVPWVISARSAEALT

SEQ ID NO: 314220 - protein, 20 aa, Mycobacterium
KGFESLRRFQAIAAPIVVGT

SEQ ID NO: 314221 - protein, 26 aa, Mycobacterium
KGGNGCFLKFRVDDVPSGARFYRVHV

SEQ ID NO: 314222 - protein, 17 aa, Mycobacterium
KGGSFSDLAGWPNVHII

SEQ ID NO: 314223 - protein, 27 aa, Mycobacterium
KGGSPTWVIRRHVLKNAAGPALTVTAT

SEQ ID NO: 314224 - protein, 17 aa, Mycobacterium
KGGSTGLGLAIVAAVVK

SEQ ID NO: 314225 - protein, 17 aa, Mycobacterium
KGGSTGLGLAIVSAVVK

SEQ ID NO: 314226 - protein, 25 aa, Mycobacterium
KGHPHVFVIGDLMSVPGVPGMAQGA

SEQ ID NO: 314227 - protein, 17 aa, Mycobacterium
KGIGFLINNARDFLRID

SEQ ID NO: 314228 - protein, 17 aa, Mycobacterium
KGIWQALLGSDAIYFEV

SEQ ID NO: 314229 - protein, 19 aa, Mycobacterium
KGKLGALLDESFKAFNGAG

SEQ ID NO: 314230 - protein, 20 aa, Mycobacterium
KGLFYGGGWAQLERQAVGAF

SEQ ID NO: 314231 - protein, 24 aa, Mycobacterium
KGLGERWGLGAAFVALVTYTAIQV

SEQ ID NO: 314232 - protein, 17 aa, Mycobacterium
KGLGIAGGAKRPGAKKA

SEQ ID NO: 314233 - protein, 19 aa, Mycobacterium
KGLLFFLAVMPQFVNPAAP

SEQ ID NO: 314234 - protein, 17 aa, Mycobacterium
KGLPDAVGGGFVADGKR

SEQ ID NO: 314235 - protein, 19 aa, Mycobacterium
KGLRFGRVRVKIGPPMDFS

SEQ ID NO: 314236 - protein, 23 aa, Mycobacterium
KGLSRPRVVTVHILRNSLIPVVT

SEQ ID NO: 314237 - protein, 19 aa, Mycobacterium
KGLVLLAAVGFDVYNKRKG

SEQ ID NO: 314238 - protein, 23 aa, Mycobacterium
KGNPDVLWWALALGTDFGGNLTA

SEQ ID NO: 314239 - protein, 18 aa, Mycobacterium
KGNPRGIHDWPDLIKENV

SEQ ID NO: 314240 - protein, 22 aa, Mycobacterium
KGPSRWGAHLQLHVSAGIGTSP

SEQ ID NO: 314241 - protein, 28 aa, Mycobacterium
KGQLTFETPMLWAFGFLVTFLLGGLSGV

SEQ ID NO: 314242 - protein, 18 aa, Mycobacterium
KGQWEAAETIGLNYVGTL

SEQ ID NO: 314243 - protein, 18 aa, Mycobacterium
KGQWEAAETIGLTYGKSL

SEQ ID NO: 314244 - protein, 17 aa, Mycobacterium
KGRGRALHAVWSTSDAP

SEQ ID NO: 314245 - protein, 19 aa, Mycobacterium
KGRLARRAGVQNVLVGWSE

SEQ ID NO: 314246 - protein, 22 aa, Mycobacterium
KGRNPLGWGLLGLFFSILTLIV

SEQ ID NO: 314247 - protein, 23 aa, Mycobacterium
KGRPSLSARLVFARNTIRPPHLI

SEQ ID NO: 314248 - protein, 21 aa, Mycobacterium
KGSALSWFSPLAWAQQMRPFV

SEQ ID NO: 314249 - protein, 23 aa, Mycobacterium
KGSARTAVDIALYAAFLGMVLVA

SEQ ID NO: 314250 - protein, 25 aa, Mycobacterium
KGSPEVLASALLRDGDSLTGQVNDM

SEQ ID NO: 314251 - protein, 24 aa, Mycobacterium
KGTFPRLKSALIVEGAGAVVGGAT

SEQ ID NO: 314252 - protein, 19 aa, Mycobacterium
KGTPMAGAQIYLGGTAATY

SEQ ID NO: 314253 - protein, 20 aa, Mycobacterium
KGVALPSFITSSADFYRVDT

SEQ ID NO: 314254 - protein, 18 aa, Mycobacterium
KGVFFGRMLPFFRSFISV

SEQ ID NO: 314255 - protein, 18 aa, Mycobacterium
KGVGKVVGITRPDGNKLT

SEQ ID NO: 314256 - protein, 18 aa, Mycobacterium
KGVHLGRLVELVRPLPQA

SEQ ID NO: 314257 - protein, 24 aa, Mycobacterium
KGVSERRIAVWSADSEDQRLLEET

SEQ ID NO: 314258 - protein, 31 aa, Mycobacterium
KGYLYRRIGASVVRWPVPILVASSAVVMLGA

SEQ ID NO: 314259 - protein, 21 aa, Mycobacterium
KHCISMADLRTAATKSTPATL

SEQ ID NO: 314260 - protein, 19 aa, Mycobacterium
KHCNGVPMCWSLRSIFDAL

SEQ ID NO: 314261 - protein, 21 aa, Mycobacterium
KHETLRMIAEMGLGAGALAVI

SEQ ID NO: 314262 - protein, 26 aa, Mycobacterium
KHEVWTRLIAMIAFSAVAGVTIAALL

SEQ ID NO: 314263 - protein, 31 aa, Mycobacterium
KHGRPFRRRNPRPAIVVVILLAIATAAAWTV

SEQ ID NO: 314264 - protein, 31 aa, Mycobacterium
KHGRPFRRRNPRPAIVVVVLLVVVTAVVWTI

SEQ ID NO: 314265 - protein, 18 aa, Mycobacterium
KHHYHCHHHHGMFHPGGP

SEQ ID NO: 314266 - protein, 24 aa, Mycobacterium
KHIQARRGVTVFGEEPATKACAEC

SEQ ID NO: 314267 - protein, 23 aa, Mycobacterium
KHKVTAMVVVPVMLSRILDAIEK

SEQ ID NO: 314268 - protein, 23 aa, Mycobacterium
KHKVTAMVVVPVMLSRLLDAVEK

SEQ ID NO: 314269 - protein, 33 aa, Mycobacterium
KHPAAARWLRVLAIPVVLFWVIAAAVLNIFVPS

SEQ ID NO: 314270 - protein, 20 aa, Mycobacterium
KHRGELVYLPPAWFASDPPP

SEQ ID NO: 314271 - protein, 20 aa, Mycobacterium
KHRGELVYLPPAWFASYPPP

SEQ ID NO: 314272 - protein, 20 aa, Mycobacterium
KHRMGHRIRLFWAEHSVHHS

SEQ ID NO: 314273 - protein, 20 aa, Mycobacterium
KHRQALASVISWIIVVLVVV

SEQ ID NO: 314274 - protein, 20 aa, Mycobacterium
KHRQALASVISWVSVVIIGI

SEQ ID NO: 314275 - protein, 17 aa, Mycobacterium
KHSPRSSAAVLLDITGS

SEQ ID NO: 314276 - protein, 19 aa, Mycobacterium
KHVVYEVFGPPGTIANINY

SEQ ID NO: 314277 - protein, 21 aa, Mycobacterium
KHVVYEVFGPPGTVANINYLD

SEQ ID NO: 314278 - protein, 20 aa, Mycobacterium
KHYPGRLIFVLFNLLIALVL

SEQ ID NO: 314279 - protein, 18 aa, Mycobacterium
KIAGAIFRVPGIERVQSI

SEQ ID NO: 314280 - protein, 21 aa, Mycobacterium
KIAIAPLFIVWLGFGPSPKIL

SEQ ID NO: 314281 - protein, 18 aa, Mycobacterium
KIDAARVVGATRWQIITK

SEQ ID NO: 314282 - protein, 19 aa, Mycobacterium
KIDACIAIALYPDHCDHPQ

SEQ ID NO: 314283 - protein, 24 aa, Mycobacterium
KIDGDHIRLKFSIGTNTIGTESRL

SEQ ID NO: 314284 - protein, 18 aa, Mycobacterium
KIEGVMALPLPISKINDI

SEQ ID NO: 314285 - protein, 22 aa, Mycobacterium
KIEQRYSVAMVVATLALIVIPL

SEQ ID NO: 314286 - protein, 20 aa, Mycobacterium
KIFGEAEFWFSMIKVTAILG

SEQ ID NO: 314287 - protein, 17 aa, Mycobacterium
KIFGWHGMGEWVVQGIA

SEQ ID NO: 314288 - protein, 18 aa, Mycobacterium
KIGVRLPLLQGVTFATLA

SEQ ID NO: 314289 - protein, 17 aa, Mycobacterium
KIIPIAIVTSVVGVGLF

SEQ ID NO: 314290 - protein, 17 aa, Mycobacterium
KIIQFWIDVPLWLTALI

SEQ ID NO: 314291 - protein, 24 aa, Mycobacterium
KIKPMTGGIRFWARPGTIRLRPWK

SEQ ID NO: 314292 - protein, 17 aa, Mycobacterium
KILAFSLLCGIVGPIFI

SEQ ID NO: 314293 - protein, 18 aa, Mycobacterium
KILLPILLGVVLGGPAAA

SEQ ID NO: 314294 - protein, 18 aa, Mycobacterium
KILRPGRAAGELPPGAVT

SEQ ID NO: 314295 - protein, 25 aa, Mycobacterium
KILRRFSIDELPQFINVLKGDMSVV

SEQ ID NO: 314296 - protein, 17 aa, Mycobacterium
KIMLQNIGLSLAIITIL

SEQ ID NO: 314297 - protein, 24 aa, Mycobacterium
KIPAGSRVWLCLGAINRDGSDATS

SEQ ID NO: 314298 - protein, 17 aa, Mycobacterium
KIPELFGPLGAGIGGQV

SEQ ID NO: 314299 - protein, 17 aa, Mycobacterium
KIPRIIRTFAVPIILVW

SEQ ID NO: 314300 - protein, 27 aa, Mycobacterium
KIQAFVLLCGIVGPIFLVIYFATGADP

SEQ ID NO: 314301 - protein, 17 aa, Mycobacterium
KIQLAIFTVISLSAASL

SEQ ID NO: 314302 - protein, 20 aa, Mycobacterium
KIQPPRPVAVPRPMNAPAPV

SEQ ID NO: 314303 - protein, 33 aa, Mycobacterium
KIQRTISGWVYLHGAWPWLFILGLVAVGAAIWW

SEQ ID NO: 314304 - protein, 20 aa, Mycobacterium
KIRTPFEYFDKGSMATVSRF

SEQ ID NO: 314305 - protein, 18 aa, Mycobacterium
KISLYAFIAMIFGAGILV

SEQ ID NO: 314306 - protein, 17 aa, Mycobacterium
KISMVGYPVMLRDTRDF

SEQ ID NO: 314307 - protein, 20 aa, Mycobacterium
KISRSACAKRYLSAGFEQLE

SEQ ID NO: 314308 - protein, 20 aa, Mycobacterium
KITLPNMKAAIMVALLFRTL

SEQ ID NO: 314309 - protein, 19 aa, Mycobacterium
KITYGWSLLLIVAFTVLLF

SEQ ID NO: 314310 - protein, 17 aa, Mycobacterium
KIVGKLAQFGSGMLQQV

SEQ ID NO: 314311 - protein, 25 aa, Mycobacterium
KIVYPGFPAHDLYLFRLYSFTTQAI

SEQ ID NO: 314312 - protein, 18 aa, Mycobacterium
KIWGNEAAIVYFLGGVGA

SEQ ID NO: 314313 - protein, 18 aa, Mycobacterium
KIWIRFPGFSIQPAEFSK

SEQ ID NO: 314314 - protein, 19 aa, Mycobacterium
KIYDNGGARIYEWRGQSST

SEQ ID NO: 314315 - protein, 21 aa, Mycobacterium
KKAASALAWLVEEMEQRYQDM

SEQ ID NO: 314316 - protein, 19 aa, Mycobacterium
KKAFVWIGLHEPDEFQMQS

SEQ ID NO: 314317 - protein, 26 aa, Mycobacterium
KKDPRKYRLIVTITRDGDQLKMSKVE

SEQ ID NO: 314318 - protein, 17 aa, Mycobacterium
KKFGNTMGYELDIHSDM

SEQ ID NO: 314319 - protein, 18 aa, Mycobacterium
KKFLRYNANKALMNLGYE

SEQ ID NO: 314320 - protein, 17 aa, Mycobacterium
KKFPEFKDVAGKDSFPA

SEQ ID NO: 314321 - protein, 17 aa, Mycobacterium
KKFPEFKDVAGKESFPA

SEQ ID NO: 314322 - protein, 30 aa, Mycobacterium
KKFSISALARRFWIPLLIGAVVFVGAFTVM

SEQ ID NO: 314323 - protein, 19 aa, Mycobacterium
KKGTRSLIVGDWRMIGKCL

SEQ ID NO: 314324 - protein, 18 aa, Mycobacterium
KKHEELRAALATLVPAPP

SEQ ID NO: 314325 - protein, 24 aa, Mycobacterium
KKIARLSLPNGWFRGDDQLVVHIE

SEQ ID NO: 314326 - protein, 20 aa, Mycobacterium
KKKLSSWLPPGPVAVADYPA

SEQ ID NO: 314327 - protein, 20 aa, Mycobacterium
KKLLIMTVVGIVVALLVGGA

SEQ ID NO: 314328 - protein, 19 aa, Mycobacterium
KKLRARVGVEGDKPGQTAD

SEQ ID NO: 314329 - protein, 23 aa, Mycobacterium
KKLRSDETFVYLARAVDPTISDA

SEQ ID NO: 314330 - protein, 26 aa, Mycobacterium
KKMGFGMGEASAFLLSMKNEATTPAM

SEQ ID NO: 314331 - protein, 17 aa, Mycobacterium
KKPIRPVAPEAYALYGL

SEQ ID NO: 314332 - protein, 20 aa, Mycobacterium
KKPKTRRLRRKKGAEADEAE

SEQ ID NO: 314333 - protein, 27 aa, Mycobacterium
KKRRFGRDPVSVLLIFIIVFALIIAGL

SEQ ID NO: 314334 - protein, 21 aa, Mycobacterium
KKSRKNWIIGAAVVAVLLVVA

SEQ ID NO: 314335 - protein, 19 aa, Mycobacterium
KKSRSSRVYTFDADMTLPG

SEQ ID NO: 314336 - protein, 25 aa, Mycobacterium
KKTKRRWGKIVALSLLTAVLLAGAG

SEQ ID NO: 314337 - protein, 25 aa, Mycobacterium
KKTYGVGAKPYWRPPYAKRNAAVDA

SEQ ID NO: 314338 - protein, 19 aa, Mycobacterium
KKVATEWHQLVGAKTVEEI

SEQ ID NO: 314339 - protein, 19 aa, Mycobacterium
KKVKNLRYWILGWLLLAGI

SEQ ID NO: 314340 - protein, 17 aa, Mycobacterium
KKWAIISAIGGVVVAVA

SEQ ID NO: 314341 - protein, 17 aa, Mycobacterium
KKYGPAVAGAFLLAALL

SEQ ID NO: 314342 - protein, 33 aa, Mycobacterium
KLAAAAKLRVTWEMSFLYAIVFGGFVAFANYLP

SEQ ID NO: 314343 - protein, 17 aa, Mycobacterium
KLADPIKYSSLYEDDAD

SEQ ID NO: 314344 - protein, 27 aa, Mycobacterium
KLADWGIRGHMGFLFGLLNQLLLLGIA

SEQ ID NO: 314345 - protein, 19 aa, Mycobacterium
KLAFPGFAVTIVLLVLVLI

SEQ ID NO: 314346 - protein, 23 aa, Mycobacterium
KLAGLTPGRLVPVARFGQLAVWI

SEQ ID NO: 314347 - protein, 22 aa, Mycobacterium
KLAGPWAPVAYILAGVFAGIMA

SEQ ID NO: 314348 - protein, 17 aa, Mycobacterium
KLAGWSITGTIIDKGTR

SEQ ID NO: 314349 - protein, 17 aa, Mycobacterium
KLAGWSITGTILDKTSR

SEQ ID NO: 314350 - protein, 17 aa, Mycobacterium
KLAKGIFRVPGISRVQA

SEQ ID NO: 314351 - protein, 27 aa, Mycobacterium
KLAPTLTRLNSVIAMLEKNRDNLSQAL

SEQ ID NO: 314352 - protein, 19 aa, Mycobacterium
KLASPRAVLTAAIVSLAVG

SEQ ID NO: 314353 - protein, 23 aa, Mycobacterium
KLATYGFQHVVAFYAGAVLVPIL

SEQ ID NO: 314354 - protein, 24 aa, Mycobacterium
KLCGGQWRPARLLVGLGGLALVTP

SEQ ID NO: 314355 - protein, 31 aa, Mycobacterium
KLDDLSERVGWRWRLVWYRAVSELLTGAYDA

SEQ ID NO: 314356 - protein, 19 aa, Mycobacterium
KLDELISAIPAAREEAIDI

SEQ ID NO: 314357 - protein, 19 aa, Mycobacterium
KLDIARGYLAVALPVGTLG

SEQ ID NO: 314358 - protein, 18 aa, Mycobacterium
KLDKLGCRASHTAELRFN

SEQ ID NO: 314359 - protein, 25 aa, Mycobacterium
KLDNGDALVGFTIDGKYALGSDTTA

SEQ ID NO: 314360 - protein, 17 aa, Mycobacterium
KLDPRRRTADQADPAVQ

SEQ ID NO: 314361 - protein, 28 aa, Mycobacterium
KLDVVPARLRRPGAVVLDIDDEDPIFEH

SEQ ID NO: 314362 - protein, 27 aa, Mycobacterium
KLEPVIRLPLALGLVHLLGRIPLPGSA

SEQ ID NO: 314363 - protein, 18 aa, Mycobacterium
KLFDVRSAQQAYRYVSQA

SEQ ID NO: 314364 - protein, 21 aa, Mycobacterium
KLFGELEFWAALIKVIALVIF

SEQ ID NO: 314365 - protein, 20 aa, Mycobacterium
KLFLIGGLALTFGLQNAIAR

SEQ ID NO: 314366 - protein, 20 aa, Mycobacterium
KLGAFALVLLMFTAIIIVVF

SEQ ID NO: 314367 - protein, 23 aa, Mycobacterium
KLGDLPAVDGFANLRGLGVEGDV

SEQ ID NO: 314368 - protein, 20 aa, Mycobacterium
KLGGRQSAILVGAWSASGSV

SEQ ID NO: 314369 - protein, 20 aa, Mycobacterium
KLGLLPLYRRLFGANTLSYF

SEQ ID NO: 314370 - protein, 18 aa, Mycobacterium
KLGNFAISGISTVLLLAV

SEQ ID NO: 314371 - protein, 27 aa, Mycobacterium
KLGPVIRLPLVLGIAELLGRIPLPGSA

SEQ ID NO: 314372 - protein, 24 aa, Mycobacterium
KLGRLSVVEAIVWTTVGSVVGAWI

SEQ ID NO: 314373 - protein, 27 aa, Mycobacterium
KLGWNAATPVLWWVGPLLLYVLLPILD

SEQ ID NO: 314374 - protein, 24 aa, Mycobacterium
KLIMIGCLTVIFTVVLLLLRGLVA

SEQ ID NO: 314375 - protein, 28 aa, Mycobacterium
KLIRTLAVPIILVWVALIAVLNTIVPQL

SEQ ID NO: 314376 - protein, 34 aa, Mycobacterium
KLLGDDCWWAPAWMKRIQVKLGLGEVTLPDERKR

SEQ ID NO: 314377 - protein, 29 aa, Mycobacterium
KLLGDDCWWAPRWMKRIQEKLGLGETELP

SEQ ID NO: 314378 - protein, 29 aa, Mycobacterium
KLLGDDCWWAPRWMKRVQEKLGLGETELP

SEQ ID NO: 314379 - protein, 18 aa, Mycobacterium
KLLLARLSTRKALPLYIA

SEQ ID NO: 314380 - protein, 18 aa, Mycobacterium
KLLLARLSTRKALPLYIG

SEQ ID NO: 314381 - protein, 18 aa, Mycobacterium
KLLRPEMAADHSFQERFR

SEQ ID NO: 314382 - protein, 18 aa, Mycobacterium
KLLRRTGPAAGHRSDPDF

SEQ ID NO: 314383 - protein, 26 aa, Mycobacterium
KLLRTPRPYLYAGILFFATLGAFAVN

SEQ ID NO: 314384 - protein, 25 aa, Mycobacterium
KLLSAFKVPTVWLLLHSGDDVPRGG

SEQ ID NO: 314385 - protein, 25 aa, Mycobacterium
KLLSELRAEFDYVIVDSTPLLAVTD

SEQ ID NO: 314386 - protein, 20 aa, Mycobacterium
KLLVPLALLFLLGMVIRDVL

SEQ ID NO: 314387 - protein, 30 aa, Mycobacterium
KLLVVFGISVLLTFYPGWVTIGLMAALVLT

SEQ ID NO: 314388 - protein, 19 aa, Mycobacterium
KLLWFGLAMIIVFGVVHAL

SEQ ID NO: 314389 - protein, 17 aa, Mycobacterium
KLMATSLALNWLVGPAV

SEQ ID NO: 314390 - protein, 19 aa, Mycobacterium
KLMCALVLLVLCASVVTRI

SEQ ID NO: 314391 - protein, 20 aa, Mycobacterium
KLPGRQSAILFGAWGVTGGI

SEQ ID NO: 314392 - protein, 21 aa, Mycobacterium
KLPTQRPDLRQESGGDPPGSA

SEQ ID NO: 314393 - protein, 19 aa, Mycobacterium
KLPTVLGLTAAVIFVVLFA

SEQ ID NO: 314394 - protein, 19 aa, Mycobacterium
KLQAAGFKGTFTQSETKSL

SEQ ID NO: 314395 - protein, 25 aa, Mycobacterium
KLQFGEGWWTSVYFLAFWITGTSLL

SEQ ID NO: 314396 - protein, 25 aa, Mycobacterium
KLQFGRRSVDLFRVPLRTTRALTKL

SEQ ID NO: 314397 - protein, 20 aa, Mycobacterium
KLQGLASVTFVFTRLLAEGV

SEQ ID NO: 314398 - protein, 24 aa, Mycobacterium
KLQLWVAACLYRYFVDQHEFLHGP

SEQ ID NO: 314399 - protein, 33 aa, Mycobacterium
KLRAAAKLPVTWEMSFLYAVVFGGFVAFSNYLP

SEQ ID NO: 314400 - protein, 19 aa, Mycobacterium
KLRAARPSFRTAQASATYR

SEQ ID NO: 314401 - protein, 17 aa, Mycobacterium
KLRDFAIARGLRIFPGL

SEQ ID NO: 314402 - protein, 24 aa, Mycobacterium
KLRIPLSVGDIVKRVFLGKPLITE

SEQ ID NO: 314403 - protein, 21 aa, Mycobacterium
KLRVKMWLFPALSILTVAGII

SEQ ID NO: 314404 - protein, 20 aa, Mycobacterium
KLRVKMWLFPVLSGLTALGI

SEQ ID NO: 314405 - protein, 24 aa, Mycobacterium
KLSDLMPDQVRWIVLQLCVVVALF

SEQ ID NO: 314406 - protein, 17 aa, Mycobacterium
KLSDLRPDLARLDALFA

SEQ ID NO: 314407 - protein, 25 aa, Mycobacterium
KLSEPVALVGMGCRYPGGADSPESL

SEQ ID NO: 314408 - protein, 25 aa, Mycobacterium
KLSFPASAVPPNWTVFSDDQDPNLI

SEQ ID NO: 314409 - protein, 19 aa, Mycobacterium
KLSLDWVIFGNNWLNGWPG

SEQ ID NO: 314410 - protein, 19 aa, Mycobacterium
KLSRLDVPGIARVLDVAHS

SEQ ID NO: 314411 - protein, 24 aa, Mycobacterium
KLSTLDRFLPVWIGAAMAAGLLLG

SEQ ID NO: 314412 - protein, 24 aa, Mycobacterium
KLSTLDRFLPVWIGVAMAAGLLLG

SEQ ID NO: 314413 - protein, 24 aa, Mycobacterium
KLSTLDRLLPVWIGVAMAAGLLLG

SEQ ID NO: 314414 - protein, 27 aa, Mycobacterium
KLSTNMSRRLWQAWVSPGIDYVEACPG

SEQ ID NO: 314415 - protein, 25 aa, Mycobacterium
KLTGGRTAQAWARRHRHLRAALTPL

SEQ ID NO: 314416 - protein, 25 aa, Mycobacterium
KLTGNRTAQAWARRHRELRAALTPL

SEQ ID NO: 314417 - protein, 24 aa, Mycobacterium
KLTKRQRFWISLYLPLTMRSLANA

SEQ ID NO: 314418 - protein, 19 aa, Mycobacterium
KLTLAQWMTVLAMALGFAV

SEQ ID NO: 314419 - protein, 26 aa, Mycobacterium
KLTNGRTAQAWARRHRQLRAALTPLV

SEQ ID NO: 314420 - protein, 20 aa, Mycobacterium
KLTPATRWGPMLQWILVAAA

SEQ ID NO: 314421 - protein, 19 aa, Mycobacterium
KLTPAVFLLYFLLRRDIHT

SEQ ID NO: 314422 - protein, 19 aa, Mycobacterium
KLTPAVFLLYFLLRRDNRA

SEQ ID NO: 314423 - protein, 27 aa, Mycobacterium
KLTSNISRHDWREWISPDVDYIALCPN

SEQ ID NO: 314424 - protein, 27 aa, Mycobacterium
KLVARIPEWILKALFVFVLLATAAKLL

SEQ ID NO: 314425 - protein, 18 aa, Mycobacterium
KLVLGVIVLGSFIASIDL

SEQ ID NO: 314426 - protein, 24 aa, Mycobacterium
KLYRLRLSYFDGHQRGELLSRVTN

SEQ ID NO: 314427 - protein, 19 aa, Mycobacterium
KMAIGGGVGGLLIAVVVML

SEQ ID NO: 314428 - protein, 19 aa, Mycobacterium
KMCRGVLAGAMLLVLAFVL

SEQ ID NO: 314429 - protein, 20 aa, Mycobacterium
KMLQGFQQWFEKMGFNPATS

SEQ ID NO: 314430 - protein, 28 aa, Mycobacterium
KMLTGWDCPGCGGLRMTHDLLHGDVAAA

SEQ ID NO: 314431 - protein, 17 aa, Mycobacterium
KMNLPWMFFFTGLAIPA

SEQ ID NO: 314432 - protein, 22 aa, Mycobacterium
KMPGQLWVLGGFLLGAVGVEGL

SEQ ID NO: 314433 - protein, 20 aa, Mycobacterium
KMRQNLGWAVGYNVIALPIA

SEQ ID NO: 314434 - protein, 18 aa, Mycobacterium
KMTAARRAASRIVDALTS

SEQ ID NO: 314435 - protein, 18 aa, Mycobacterium
KMTVAITVRDVSLKKTAD

SEQ ID NO: 314436 - protein, 17 aa, Mycobacterium
KMVEDMRDMIPLMESMQ

SEQ ID NO: 314437 - protein, 17 aa, Mycobacterium
KNIPRGILMAMLVLVIT

SEQ ID NO: 314438 - protein, 24 aa, Mycobacterium
KNIPSLRYLSYRLTMNRDGGEWRI

SEQ ID NO: 314439 - protein, 23 aa, Mycobacterium
KNLGYTCVIYLAALQGVRRDLLE

SEQ ID NO: 314440 - protein, 21 aa, Mycobacterium
KNLREAMCYQWPGYGSGRTLD

SEQ ID NO: 314441 - protein, 18 aa, Mycobacterium
KNPGKFKIEVIFNDSKKV

SEQ ID NO: 314442 - protein, 23 aa, Mycobacterium
KNRRATILASVPWFLQDLGLYGI

SEQ ID NO: 314443 - protein, 17 aa, Mycobacterium
KNTSYRIGLKVASPSAS

SEQ ID NO: 314444 - protein, 28 aa, Mycobacterium
KPAGRKRRKWLAGKRMAVTVAVAAALFV

SEQ ID NO: 314445 - protein, 32 aa, Mycobacterium
KPAHSMFWYRSTRFVLRHAVAVGSSVVVLLLL

SEQ ID NO: 314446 - protein, 25 aa, Mycobacterium
KPAIPLSLGDIVKRVFLGKPLITEN

SEQ ID NO: 314447 - protein, 17 aa, Mycobacterium
KPALEKLNLVLDNLLER

SEQ ID NO: 314448 - protein, 24 aa, Mycobacterium
KPAPPRDMVPVWVAAGGLLGALLI

SEQ ID NO: 314449 - protein, 24 aa, Mycobacterium
KPAPRPAAPTTRWLARLRRPTLVL

SEQ ID NO: 314450 - protein, 23 aa, Mycobacterium
KPASSSKPIWPLVAIGVIVVVVL

SEQ ID NO: 314451 - protein, 20 aa, Mycobacterium
KPAWYVVAIVGMFALTAIGS

SEQ ID NO: 314452 - protein, 25 aa, Mycobacterium
KPDGKEVLPSWGVPVLIAALIAAVA

SEQ ID NO: 314453 - protein, 25 aa, Mycobacterium
KPDLEGADQLLLRWRQANDRISSYI

SEQ ID NO: 314454 - protein, 25 aa, Mycobacterium
KPDLEGADQLLLRWRQANDRITSYI

SEQ ID NO: 314455 - protein, 22 aa, Mycobacterium
KPDPSQLSFIFIGNEMNPNGGI

SEQ ID NO: 314456 - protein, 18 aa, Mycobacterium
KPDSVWTGATAMYNCGQN

SEQ ID NO: 314457 - protein, 19 aa, Mycobacterium
KPEREILIRVVPAADALST

SEQ ID NO: 314458 - protein, 21 aa, Mycobacterium
KPFASRFLVQWPELADRIPRT

SEQ ID NO: 314459 - protein, 20 aa, Mycobacterium
KPFFAQGLLNRRAVLKSSYA

SEQ ID NO: 314460 - protein, 20 aa, Mycobacterium
KPFFSQGLINRRAVLKSTYA

SEQ ID NO: 314461 - protein, 24 aa, Mycobacterium
KPFTAGWGCTAFTVNPDGWLATAG

SEQ ID NO: 314462 - protein, 18 aa, Mycobacterium
KPGDVMPSTYLGIWETFN

SEQ ID NO: 314463 - protein, 21 aa, Mycobacterium
KPGEHKWPFAQTAFTSALPWM

SEQ ID NO: 314464 - protein, 18 aa, Mycobacterium
KPGETVRIAGVRVGTVNS

SEQ ID NO: 314465 - protein, 17 aa, Mycobacterium
KPGGWGLSVPSLSGSPF

SEQ ID NO: 314466 - protein, 19 aa, Mycobacterium
KPGLLPWLAGSAVVVIGLG

SEQ ID NO: 314467 - protein, 27 aa, Mycobacterium
KPGLVRLRPAPSLGLPPPLTELAVRSE

SEQ ID NO: 314468 - protein, 28 aa, Mycobacterium
KPGNAVLEWLRLPGDVILIVGGVLPFVW

SEQ ID NO: 314469 - protein, 25 aa, Mycobacterium
KPGPAAIRITRTWYAPVGGVLMALC

SEQ ID NO: 314470 - protein, 22 aa, Mycobacterium
KPGPATVRMSLVITTAPAPNPH

SEQ ID NO: 314471 - protein, 23 aa, Mycobacterium
KPGPRPGALVGNVIWVILFGIWL

SEQ ID NO: 314472 - protein, 22 aa, Mycobacterium
KPGPRPGALVGNVIWVIVAGVW

SEQ ID NO: 314473 - protein, 17 aa, Mycobacterium
KPGPRWDAYLDNQLGSM

SEQ ID NO: 314474 - protein, 18 aa, Mycobacterium
KPGSRAVAAPTLPDFAAI

SEQ ID NO: 314475 - protein, 19 aa, Mycobacterium
KPIGAGLGMASIGFAAAAL

SEQ ID NO: 314476 - protein, 25 aa, Mycobacterium
KPIIRLGHMLVFFFRALAGVPIAVR

SEQ ID NO: 314477 - protein, 19 aa, Mycobacterium
KPIKIGHKVVTGMRGSYGG

SEQ ID NO: 314478 - protein, 18 aa, Mycobacterium
KPILQVIGMFIVFNVGYY

SEQ ID NO: 314479 - protein, 17 aa, Mycobacterium
KPIPAMALIAVAAILDA

SEQ ID NO: 314480 - protein, 24 aa, Mycobacterium
KPIVRLGHMLVFFVRAVAAIPIVL

SEQ ID NO: 314481 - protein, 24 aa, Mycobacterium
KPKLPGEVWVLIVANAVIALGYGV

SEQ ID NO: 314482 - protein, 25 aa, Mycobacterium
KPKRRIKLLLIVASVVLVLDVVTKV

SEQ ID NO: 314483 - protein, 27 aa, Mycobacterium
KPLARNGFASLWSWIFGLVVTEFPLPT

SEQ ID NO: 314484 - protein, 17 aa, Mycobacterium
KPLGFDWHINVALLGSF

SEQ ID NO: 314485 - protein, 21 aa, Mycobacterium
KPLKGGASWWQFIRNSRNPEL

SEQ ID NO: 314486 - protein, 19 aa, Mycobacterium
KPLKLAWAVAVLDICANVT

SEQ ID NO: 314487 - protein, 22 aa, Mycobacterium
KPLREVGSYFALTLDIFTQLVR

SEQ ID NO: 314488 - protein, 17 aa, Mycobacterium
KPLRSVGEFFAMSLDTL

SEQ ID NO: 314489 - protein, 27 aa, Mycobacterium
KPLSWRDRAVKWARIARLSIVVKVAAL

SEQ ID NO: 314490 - protein, 19 aa, Mycobacterium
KPLVPAIMITAAAIAVLGS

SEQ ID NO: 314491 - protein, 20 aa, Mycobacterium
KPPAALWLMELSVRVFGLSG

SEQ ID NO: 314492 - protein, 24 aa, Mycobacterium
KPPPDVFSALTFITLAIFLGAGTG

SEQ ID NO: 314493 - protein, 20 aa, Mycobacterium
KPPRPEGYLDPDAVTQRGGH

SEQ ID NO: 314494 - protein, 20 aa, Mycobacterium
KPPVGAALWKLMERARQIGL

SEQ ID NO: 314495 - protein, 21 aa, Mycobacterium
KPPVWEWKIAAYLFSGGLSAG

SEQ ID NO: 314496 - protein, 22 aa, Mycobacterium
KPQRSTKTIAIIGGIVAAAVVL

SEQ ID NO: 314497 - protein, 20 aa, Mycobacterium
KPQTVHWNLRIDVSEVDGKL

SEQ ID NO: 314498 - protein, 21 aa, Mycobacterium
KPQTVHWNLRLDVANVEGKLM

SEQ ID NO: 314499 - protein, 20 aa, Mycobacterium
KPQTVHWNLRLDVSDVDGKL

SEQ ID NO: 314500 - protein, 20 aa, Mycobacterium
KPQTVHWSLRVEVSDVDGKL

SEQ ID NO: 314501 - protein, 26 aa, Mycobacterium
KPRARWWSPSWWAQKFASRGSKPGAK

SEQ ID NO: 314502 - protein, 22 aa, Mycobacterium
KPRPMVNLLAFWFGGMATGAAV

SEQ ID NO: 314503 - protein, 23 aa, Mycobacterium
KPRSEGWIGKVLAMAGVAVTLVG

SEQ ID NO: 314504 - protein, 20 aa, Mycobacterium
KPRYVRIGFRELVKIHDDRL

SEQ ID NO: 314505 - protein, 26 aa, Mycobacterium
KPSADLGANCQYPASPEPAAKPVKPP

SEQ ID NO: 314506 - protein, 31 aa, Mycobacterium
KPSAYSTGWALWVVLVFIVFQSVAAVGALLL

SEQ ID NO: 314507 - protein, 24 aa, Mycobacterium
KPSERRSAVPAGFDDVIARGMAKQ

SEQ ID NO: 314508 - protein, 25 aa, Mycobacterium
KPSGFDPAIPVGFDAVIARGMAKEP

SEQ ID NO: 314509 - protein, 21 aa, Mycobacterium
KPSMPYRLRVIVHEDDSGRMS

SEQ ID NO: 314510 - protein, 24 aa, Mycobacterium
KPSNLLMVGEGFVYLIDFGLVHEA

SEQ ID NO: 314511 - protein, 21 aa, Mycobacterium
KPSRSAFAWATLALSAVFASR

SEQ ID NO: 314512 - protein, 24 aa, Mycobacterium
KPSWDIQAGYVLRSLHALPRSGTK

SEQ ID NO: 314513 - protein, 18 aa, Mycobacterium
KPSYGMAEATLFVSTTPP

SEQ ID NO: 314514 - protein, 28 aa, Mycobacterium
KPTEAVMTKLRWVLLIVGGVGVAVAAVA

SEQ ID NO: 314515 - protein, 19 aa, Mycobacterium
KPTEIGGYAGVPAPPPPPP

SEQ ID NO: 314516 - protein, 18 aa, Mycobacterium
KPTRSGRRSLPLGNTVAR

SEQ ID NO: 314517 - protein, 21 aa, Mycobacterium
KPVERARALGIWGGVTGISMA

SEQ ID NO: 314518 - protein, 18 aa, Mycobacterium
KPVGGWIDNAFRVVVGSG

SEQ ID NO: 314519 - protein, 23 aa, Mycobacterium
KPVGPHVVGRVFVGGDLTFEAYT

SEQ ID NO: 314520 - protein, 17 aa, Mycobacterium
KPVIFWTPDHGAFVVRG

SEQ ID NO: 314521 - protein, 18 aa, Mycobacterium
KPVLQWRVVDIVVASVLA

SEQ ID NO: 314522 - protein, 19 aa, Mycobacterium
KQIAGHTWNTWGNPAKPLS

SEQ ID NO: 314523 - protein, 19 aa, Mycobacterium
KQLILKRAASEYVAHFPDS

SEQ ID NO: 314524 - protein, 19 aa, Mycobacterium
KQLRTIRNIGVFGVNLVGL

SEQ ID NO: 314525 - protein, 23 aa, Mycobacterium
KQPLVSFLVGFSMLAAGVTSAAG

SEQ ID NO: 314526 - protein, 19 aa, Mycobacterium
KQQVALVIGVLFGSAIIPP

SEQ ID NO: 314527 - protein, 20 aa, Mycobacterium
KQRIWPVLAVAAGYAVACQV

SEQ ID NO: 314528 - protein, 27 aa, Mycobacterium
KQSWLGRFVSTYGWRAYALPVLMVLTV

SEQ ID NO: 314529 - protein, 27 aa, Mycobacterium
KQTWLGRFISTYGWRAYAIPLLVALTV

SEQ ID NO: 314530 - protein, 26 aa, Mycobacterium
KQTWLGRFVSTYGWRAYALPILMVLT

SEQ ID NO: 314531 - protein, 27 aa, Mycobacterium
KQTWLGRFVSTYGWRAYALPVLIVLTV

SEQ ID NO: 314532 - protein, 24 aa, Mycobacterium
KQVRTRLRDEFGFPKSEVHAQAYW

SEQ ID NO: 314533 - protein, 17 aa, Mycobacterium
KQWPSFIRVSGELPRTA

SEQ ID NO: 314534 - protein, 26 aa, Mycobacterium
KQWSRACAWYLTAIGFGAVFVVLKAF

SEQ ID NO: 314535 - protein, 23 aa, Mycobacterium
KRAERGVALWLLLGGFFGLALLL

SEQ ID NO: 314536 - protein, 23 aa, Mycobacterium
KRAERGVALWLLLGGGFGLALLL

SEQ ID NO: 314537 - protein, 23 aa, Mycobacterium
KRAGFGRTPYRPHNIPFVMLGAA

SEQ ID NO: 314538 - protein, 18 aa, Mycobacterium
KRALIIFQIFIYGYLLAM

SEQ ID NO: 314539 - protein, 17 aa, Mycobacterium
KRALLEVTYFTGLGALI

SEQ ID NO: 314540 - protein, 37 aa, Mycobacterium
KRAMRIRTWRRIGAAITRWPGPILAASMAIAIIGLAA

SEQ ID NO: 314541 - protein, 20 aa, Mycobacterium
KRAPTVEICESDRPFEPLAM

SEQ ID NO: 314542 - protein, 20 aa, Mycobacterium
KRASVAQLFKLWGGTLAANL

SEQ ID NO: 314543 - protein, 20 aa, Mycobacterium
KRAVYYLITMALHWTIGGGS

SEQ ID NO: 314544 - protein, 19 aa, Mycobacterium
KRDAERPSMAGFNVPPQVL

SEQ ID NO: 314545 - protein, 24 aa, Mycobacterium
KRDEVEARLALGLPSRQAAAPYLR

SEQ ID NO: 314546 - protein, 20 aa, Mycobacterium
KRDRTHWLYILVIVAVVAGI

SEQ ID NO: 314547 - protein, 35 aa, Mycobacterium
KREKTARPNRSWARYLRRGAMPLLLAGALALSAFL

SEQ ID NO: 314548 - protein, 22 aa, Mycobacterium
KRERDAVELDLRANVAAMSATL

SEQ ID NO: 314549 - protein, 26 aa, Mycobacterium
KREVVELRRCVHPLSVAFGRMQTDNK

SEQ ID NO: 314550 - protein, 28 aa, Mycobacterium
KREVVELRRCVNPLSAAFHRIQVENKDV

SEQ ID NO: 314551 - protein, 23 aa, Mycobacterium
KRFASRTRDEWARTFAGTDACVT

SEQ ID NO: 314552 - protein, 27 aa, Mycobacterium
KRFEREADIAATLWHPHIVGVHDRGED

SEQ ID NO: 314553 - protein, 21 aa, Mycobacterium
KRFGYAALLAPILAAGLVTLI

SEQ ID NO: 314554 - protein, 24 aa, Mycobacterium
KRFLPPRWWSVSPLDGLVAAVLVW

SEQ ID NO: 314555 - protein, 19 aa, Mycobacterium
KRFRKAKAAKNGRPADRPD

SEQ ID NO: 314556 - protein, 19 aa, Mycobacterium
KRFWQGRELFVIIDGATAW

SEQ ID NO: 314557 - protein, 20 aa, Mycobacterium
KRGAAFDAFQRLGDRDNTVG

SEQ ID NO: 314558 - protein, 21 aa, Mycobacterium
KRGAFSLADPVARRFLRDTGV

SEQ ID NO: 314559 - protein, 25 aa, Mycobacterium
KRGALPAPRAVAIVSQVAEALDAAH

SEQ ID NO: 314560 - protein, 20 aa, Mycobacterium
KRGGRSLVLYALPMLAGLSM

SEQ ID NO: 314561 - protein, 26 aa, Mycobacterium
KRGGTPRFGTDTAFDDAVRGMRTRLL

SEQ ID NO: 314562 - protein, 18 aa, Mycobacterium
KRGHRLVFSNGIITLTTL

SEQ ID NO: 314563 - protein, 17 aa, Mycobacterium
KRGHVVVAVDVLDGSPF

SEQ ID NO: 314564 - protein, 20 aa, Mycobacterium
KRGSSWLGSPPMRLRRKPAE

SEQ ID NO: 314565 - protein, 19 aa, Mycobacterium
KRGTVGFSGVAPFSVEAVP

SEQ ID NO: 314566 - protein, 25 aa, Mycobacterium
KRGWLEALLGHFCDPAVALVAPRIV

SEQ ID NO: 314567 - protein, 23 aa, Mycobacterium
KRGYRLVFSNGIITLTALSVTLL

SEQ ID NO: 314568 - protein, 26 aa, Mycobacterium
KRHEEIRVRIGIHMGRSVRRGDDLFG

SEQ ID NO: 314569 - protein, 17 aa, Mycobacterium
KRHLRYPEDLFKVQRTL

SEQ ID NO: 314570 - protein, 21 aa, Mycobacterium
KRIAQLEAFAASQGWMYTAED

SEQ ID NO: 314571 - protein, 19 aa, Mycobacterium
KRIATFASVVVPFMAVVYI

SEQ ID NO: 314572 - protein, 26 aa, Mycobacterium
KRIIPRATMIAVLGVGIFYVFVSWMA

SEQ ID NO: 314573 - protein, 26 aa, Mycobacterium
KRIIPRATMIAVLGVGVFYVFISWMA

SEQ ID NO: 314574 - protein, 22 aa, Mycobacterium
KRINLGTLLREPLVGPLVALVI

SEQ ID NO: 314575 - protein, 18 aa, Mycobacterium
KRIQGHWPPPDLKEGGYF

SEQ ID NO: 314576 - protein, 24 aa, Mycobacterium
KRIQRTAGVPIPIIFGDTASADAL

SEQ ID NO: 314577 - protein, 19 aa, Mycobacterium
KRITARWIPYGRADLVIGI

SEQ ID NO: 314578 - protein, 21 aa, Mycobacterium
KRIVQPFGEYLPWRSFFSKLS

SEQ ID NO: 314579 - protein, 17 aa, Mycobacterium
KRIYAFALSGQGRNADA

SEQ ID NO: 314580 - protein, 17 aa, Mycobacterium
KRKLWYTVSALIVAVSI

SEQ ID NO: 314581 - protein, 17 aa, Mycobacterium
KRKMRVRRWRGIGTAIV

SEQ ID NO: 314582 - protein, 20 aa, Mycobacterium
KRLDHSMIFVFIAGSYTPFA

SEQ ID NO: 314583 - protein, 19 aa, Mycobacterium
KRLEKLGVEIQLSAMVTDV

SEQ ID NO: 314584 - protein, 24 aa, Mycobacterium
KRLGATPLPVWGIIAGKSLAVVTV

SEQ ID NO: 314585 - protein, 18 aa, Mycobacterium
KRLIWPVVVLILVTGLAA

SEQ ID NO: 314586 - protein, 19 aa, Mycobacterium
KRLKPREGGDFGTTEQWRY

SEQ ID NO: 314587 - protein, 18 aa, Mycobacterium
KRLLRLLFRVDAAVFGKR

SEQ ID NO: 314588 - protein, 19 aa, Mycobacterium
KRLRSVHTRLDRLKGSGER

SEQ ID NO: 314589 - protein, 18 aa, Mycobacterium
KRLRVVWFNLVQTATAAG

SEQ ID NO: 314590 - protein, 18 aa, Mycobacterium
KRLSGLLNTSGLPAVLEP

SEQ ID NO: 314591 - protein, 18 aa, Mycobacterium
KRLTVVVISHDFAGLENL

SEQ ID NO: 314592 - protein, 21 aa, Mycobacterium
KRLYEAPALNQAWFVYPPFAT

SEQ ID NO: 314593 - protein, 19 aa, Mycobacterium
KRMLMAMAVVLVGSATAAF

SEQ ID NO: 314594 - protein, 22 aa, Mycobacterium
KRMPGSLSARFDRACAQSSLPE

SEQ ID NO: 314595 - protein, 25 aa, Mycobacterium
KRMSPFWRQMFLTVGIVIAVFGMRL

SEQ ID NO: 314596 - protein, 18 aa, Mycobacterium
KRMVEELDVSRSAQTLLD

SEQ ID NO: 314597 - protein, 21 aa, Mycobacterium
KRNRVTACYFGDGAVAEGAFH

SEQ ID NO: 314598 - protein, 17 aa, Mycobacterium
KRPADFPTLSVLCGVVW

SEQ ID NO: 314599 - protein, 23 aa, Mycobacterium
KRPLRTAWQAGIRLWTAALALTA

SEQ ID NO: 314600 - protein, 26 aa, Mycobacterium
KRPSGKRVAAAVAVVGVLLFVGSAAF

SEQ ID NO: 314601 - protein, 18 aa, Mycobacterium
KRPSLPPTLYGTLPVSPT

SEQ ID NO: 314602 - protein, 26 aa, Mycobacterium
KRRGVTFCSMMRNWGLVFVGNLGGAI

SEQ ID NO: 314603 - protein, 17 aa, Mycobacterium
KRRITVPTAAGFTSSPA

SEQ ID NO: 314604 - protein, 18 aa, Mycobacterium
KRRLRRILIGSVVAILLV

SEQ ID NO: 314605 - protein, 17 aa, Mycobacterium
KRRMMVRRWRWIGTATV

SEQ ID NO: 314606 - protein, 19 aa, Mycobacterium
KRRRIWLLAVASIDVLMVI

SEQ ID NO: 314607 - protein, 19 aa, Mycobacterium
KRRVMQSLDRAGRRRWIGI

SEQ ID NO: 314608 - protein, 20 aa, Mycobacterium
KRRWVIPAIFVLTLCATAYF

SEQ ID NO: 314609 - protein, 18 aa, Mycobacterium
KRTARLVGDVPIYDIVIG

SEQ ID NO: 314610 - protein, 18 aa, Mycobacterium
KRTARLVGEVPIYDIIVG

SEQ ID NO: 314611 - protein, 24 aa, Mycobacterium
KRTPHRVMRILYEQFVAYSRAYVG

SEQ ID NO: 314612 - protein, 18 aa, Mycobacterium
KRTSRIALGKLAINLVAV

SEQ ID NO: 314613 - protein, 20 aa, Mycobacterium
KRVAVLFAGPAMNFLIGIVV

SEQ ID NO: 314614 - protein, 21 aa, Mycobacterium
KRVAVLFAGPAMNFVIGLVLI

SEQ ID NO: 314615 - protein, 36 aa, Mycobacterium
KRVAVLFAGPGMNFVICLVLIYAIAVMWGLPNLHPP

SEQ ID NO: 314616 - protein, 26 aa, Mycobacterium
KRVHLDLGGAVVRADPGLLERVLANL

SEQ ID NO: 314617 - protein, 25 aa, Mycobacterium
KRVLLSYSGSLAFIAGFVNAVGLLL

SEQ ID NO: 314618 - protein, 23 aa, Mycobacterium
KRVRKLHQLRSYRIASVLRVGVV

SEQ ID NO: 314619 - protein, 23 aa, Mycobacterium
KRVRVKFDADRSVVLTTGTRAVV

SEQ ID NO: 314620 - protein, 19 aa, Mycobacterium
KRWGHQWLLVTCWFGVVIW

SEQ ID NO: 314621 - protein, 18 aa, Mycobacterium
KRWGHQWMIITCWMGVLI

SEQ ID NO: 314622 - protein, 22 aa, Mycobacterium
KRWNPRLIVIPGAPLVRDGLYR

SEQ ID NO: 314623 - protein, 23 aa, Mycobacterium
KRWRVDIDGTLSFLLLPRLTNVL

SEQ ID NO: 314624 - protein, 18 aa, Mycobacterium
KRYAWHRFRRIMPAYWIL

SEQ ID NO: 314625 - protein, 29 aa, Mycobacterium
KRYFADGLQYWPWVLLGYFTLGIVIVSLI

SEQ ID NO: 314626 - protein, 30 aa, Mycobacterium
KRYIAADGSIVWCALTAVIVHAPRDQPRCF

SEQ ID NO: 314627 - protein, 26 aa, Mycobacterium
KSAPRIEFDCVTFGYGDHPVLDDVSF

SEQ ID NO: 314628 - protein, 35 aa, Mycobacterium
KSATAAFWVFLAFYVVCAFVTWFVFLRLQEHRAHS

SEQ ID NO: 314629 - protein, 21 aa, Mycobacterium
KSELLRTIALGMIARNSPAVL

SEQ ID NO: 314630 - protein, 21 aa, Mycobacterium
KSELLRTIALGMMVRNPPLTL

SEQ ID NO: 314631 - protein, 21 aa, Mycobacterium
KSERRLAFWLIAPAVLLMLAV

SEQ ID NO: 314632 - protein, 18 aa, Mycobacterium
KSFFMLAFTKIGLMPDGA

SEQ ID NO: 314633 - protein, 17 aa, Mycobacterium
KSFPLAGSVFAYVGRGI

SEQ ID NO: 314634 - protein, 18 aa, Mycobacterium
KSGDTVRIAGIRVGTVKD

SEQ ID NO: 314635 - protein, 18 aa, Mycobacterium
KSGDVMPATYIGIWQTLS

SEQ ID NO: 314636 - protein, 17 aa, Mycobacterium
KSGLGRRGVRTHQLSGR

SEQ ID NO: 314637 - protein, 27 aa, Mycobacterium
KSGRWPVPPRRGGLLALKPLELAILAV

SEQ ID NO: 314638 - protein, 17 aa, Mycobacterium
KSGVRPLVLEFGQGQWK

SEQ ID NO: 314639 - protein, 21 aa, Mycobacterium
KSINLSKDWARAVIDIPVPTG

SEQ ID NO: 314640 - protein, 23 aa, Mycobacterium
KSIRSDNAAVRWIQDTLSVVGFV

SEQ ID NO: 314641 - protein, 19 aa, Mycobacterium
KSIVGRMNWLGGRAELATG

SEQ ID NO: 314642 - protein, 19 aa, Mycobacterium
KSIWLPIVGGLVVVVVVVV

SEQ ID NO: 314643 - protein, 20 aa, Mycobacterium
KSLADGLARFTAELRAADPR

SEQ ID NO: 314644 - protein, 22 aa, Mycobacterium
KSLEGTGFVIAPHRVMSNAHVV

SEQ ID NO: 314645 - protein, 20 aa, Mycobacterium
KSLLLFGGLGAAALVLIVLA

SEQ ID NO: 314646 - protein, 17 aa, Mycobacterium
KSLPLSWAQPAAPAPNA

SEQ ID NO: 314647 - protein, 24 aa, Mycobacterium
KSLTADGGLDWHVVDLAEARNGVD

SEQ ID NO: 314648 - protein, 25 aa, Mycobacterium
KSLTADGSMDWHVLSLDEARSGVDH

SEQ ID NO: 314649 - protein, 21 aa, Mycobacterium
KSLYLRNPVFAEWIEKVDALV

SEQ ID NO: 314650 - protein, 22 aa, Mycobacterium
KSLYLRNPVFAEWIEKVDALVQ

SEQ ID NO: 314651 - protein, 20 aa, Mycobacterium
KSMRIFKSEMREMQSETKAE

SEQ ID NO: 314652 - protein, 20 aa, Mycobacterium
KSMRIFKSEMREMQSETKNQ

SEQ ID NO: 314653 - protein, 20 aa, Mycobacterium
KSNIAFRIALRAESGDDSRE

SEQ ID NO: 314654 - protein, 26 aa, Mycobacterium
KSNRRDALRWVWLGVAGAVAMTLIIF

SEQ ID NO: 314655 - protein, 18 aa, Mycobacterium
KSPCTVNSFASLAQQGYF

SEQ ID NO: 314656 - protein, 18 aa, Mycobacterium
KSPHDLRTPRGLADLEQM

SEQ ID NO: 314657 - protein, 26 aa, Mycobacterium
KSPKGRKLWIAALVAIVGVIVLTAAA

SEQ ID NO: 314658 - protein, 38 aa, Mycobacterium
KSPPRWSSWLRVVFGSALIVYGIYKWLNRRGHGESPKW

SEQ ID NO: 314659 - protein, 21 aa, Mycobacterium
KSPSRTVPRLKIEITDLVHLH

SEQ ID NO: 314660 - protein, 24 aa, Mycobacterium
KSRGTRLAIGLAVVLGIIVVYALS

SEQ ID NO: 314661 - protein, 18 aa, Mycobacterium
KSRLDSVMDNYRGWLNRM

SEQ ID NO: 314662 - protein, 17 aa, Mycobacterium
KSRPGSPAWNHAYVIAA

SEQ ID NO: 314663 - protein, 24 aa, Mycobacterium
KSSFLRAGLLPRLRREDRRFVVMN

SEQ ID NO: 314664 - protein, 17 aa, Mycobacterium
KSSKRSMAIIGGVVGVI

SEQ ID NO: 314665 - protein, 21 aa, Mycobacterium
KSSRVKSTWTTKTISPQAGTE

SEQ ID NO: 314666 - protein, 17 aa, Mycobacterium
KSSTVWQRIAVTAVLAV

SEQ ID NO: 314667 - protein, 18 aa, Mycobacterium
KSTALRALCDRLVRTNDP

SEQ ID NO: 314668 - protein, 25 aa, Mycobacterium
KSTGRLDPRVRVVAAMVNVGDGLPQ

SEQ ID NO: 314669 - protein, 21 aa, Mycobacterium
KSTGRLNDYVRVVADLINVGD

SEQ ID NO: 314670 - protein, 18 aa, Mycobacterium
KSTLVSLICRLRDVTDGA

SEQ ID NO: 314671 - protein, 25 aa, Mycobacterium
KSVVALAFAGGVLFVAENPSRSLQK

SEQ ID NO: 314672 - protein, 30 aa, Mycobacterium
KSWRKVGTAVVRWPIPIILVTGLVAAIGFA

SEQ ID NO: 314673 - protein, 23 aa, Mycobacterium
KSWTHNGLFAFTRVDAGSGVEPD

SEQ ID NO: 314674 - protein, 18 aa, Mycobacterium
KTACAGMVILVVTVLVLT

SEQ ID NO: 314675 - protein, 23 aa, Mycobacterium
KTAELLEGIEFVPPRYIEYRGGS

SEQ ID NO: 314676 - protein, 23 aa, Mycobacterium
KTAGRGFIFFGLLAPNLFATIGI

SEQ ID NO: 314677 - protein, 19 aa, Mycobacterium
KTALFFAAVLPQFADPAVG

SEQ ID NO: 314678 - protein, 18 aa, Mycobacterium
KTAPRLPDGTPFPTLYYL

SEQ ID NO: 314679 - protein, 25 aa, Mycobacterium
KTATGGLVVSEWIRGGSLAEVAATN

SEQ ID NO: 314680 - protein, 17 aa, Mycobacterium
KTAYFDTDFFQVLVTQF

SEQ ID NO: 314681 - protein, 25 aa, Mycobacterium
KTDLYPHWRAVVAANSAHLQRAKIA

SEQ ID NO: 314682 - protein, 21 aa, Mycobacterium
KTEIDYAATVIKGYVHERENA

SEQ ID NO: 314683 - protein, 20 aa, Mycobacterium
KTGAVKVMDFGIARALADAG

SEQ ID NO: 314684 - protein, 20 aa, Mycobacterium
KTGAVKVMDFGIARAVSDAG

SEQ ID NO: 314685 - protein, 25 aa, Mycobacterium
KTGELWFKGPNVMAGYLNNEEATKE

SEQ ID NO: 314686 - protein, 20 aa, Mycobacterium
KTGEVDWVLDRLGREIDALR

SEQ ID NO: 314687 - protein, 18 aa, Mycobacterium
KTGGFGFGMGNVILVTNV

SEQ ID NO: 314688 - protein, 21 aa, Mycobacterium
KTGLARLALHTGVPVIPVAMI

SEQ ID NO: 314689 - protein, 21 aa, Mycobacterium
KTGLARLALQTGVPVIPVAMV

SEQ ID NO: 314690 - protein, 19 aa, Mycobacterium
KTGMLVECIVWGGAAAGIL

SEQ ID NO: 314691 - protein, 34 aa, Mycobacterium
KTIGVFFLLLPFTWNRAGGLDGIRERAGDAVFSL

SEQ ID NO: 314692 - protein, 17 aa, Mycobacterium
KTIRLPPWPDRVPLTKG

SEQ ID NO: 314693 - protein, 19 aa, Mycobacterium
KTITIPLLLALMGSALLVP

SEQ ID NO: 314694 - protein, 25 aa, Mycobacterium
KTKTPVEFDRVLGMLDKLSVSLKGD

SEQ ID NO: 314695 - protein, 17 aa, Mycobacterium
KTLAAYVIPDRWPAEDA

SEQ ID NO: 314696 - protein, 25 aa, Mycobacterium
KTLPPSAVIGLWTFDGHEGRSEVPT

SEQ ID NO: 314697 - protein, 25 aa, Mycobacterium
KTLPPTSAVGLWTFDGREGRTEVPT

SEQ ID NO: 314698 - protein, 19 aa, Mycobacterium
KTLRLFVLLVIAFALIPVG

SEQ ID NO: 314699 - protein, 17 aa, Mycobacterium
KTLRSMLSRNVLAQLGL

SEQ ID NO: 314700 - protein, 22 aa, Mycobacterium
KTLWHRSFWVIPLALVRTVELR

SEQ ID NO: 314701 - protein, 24 aa, Mycobacterium
KTNLRRFVDDVSFVVGKESRDRLK

SEQ ID NO: 314702 - protein, 24 aa, Mycobacterium
KTNVRRFLDDVSFVVLKESRDRLR

SEQ ID NO: 314703 - protein, 24 aa, Mycobacterium
KTNVRRFVDDVAFAVGKESRDRLK

SEQ ID NO: 314704 - protein, 24 aa, Mycobacterium
KTPAWEWKIAAYLFSGGLSAGSAL

SEQ ID NO: 314705 - protein, 18 aa, Mycobacterium
KTPLIGMSMVFGAMALVA

SEQ ID NO: 314706 - protein, 23 aa, Mycobacterium
KTPPRTAAPIFAGRIVMGGLAGA

SEQ ID NO: 314707 - protein, 18 aa, Mycobacterium
KTPPRTAPPVFAVRIILG

SEQ ID NO: 314708 - protein, 18 aa, Mycobacterium
KTPSRKTAIQFGTRLVTG

SEQ ID NO: 314709 - protein, 30 aa, Mycobacterium
KTQLVAMMFALRYRWWVVLSAITVATTAVH

SEQ ID NO: 314710 - protein, 25 aa, Mycobacterium
KTQSLLRVLHDWVRTYHRQILVILF

SEQ ID NO: 314711 - protein, 21 aa, Mycobacterium
KTRADSRWTLVAAAIVLAAIC

SEQ ID NO: 314712 - protein, 18 aa, Mycobacterium
KTRCQAIEVAIGMTIPIA

SEQ ID NO: 314713 - protein, 29 aa, Mycobacterium
KTRGWRRIGTAVVRWPAPILTATCAVSLV

SEQ ID NO: 314714 - protein, 18 aa, Mycobacterium
KTRSQLMFGALGVLLCLL

SEQ ID NO: 314715 - protein, 19 aa, Mycobacterium
KTSERRILCSAAALDRAHE

SEQ ID NO: 314716 - protein, 20 aa, Mycobacterium
KTSEVDWVLDRLGRELDALR

SEQ ID NO: 314717 - protein, 19 aa, Mycobacterium
KTSEVDWVLDRLGRELEEL

SEQ ID NO: 314718 - protein, 19 aa, Mycobacterium
KTTDLRGQFWIWAGANIAP

SEQ ID NO: 314719 - protein, 17 aa, Mycobacterium
KTTLLMQTPGVFFAEDA

SEQ ID NO: 314720 - protein, 18 aa, Mycobacterium
KTTLLRHLIRTVREHSTP

SEQ ID NO: 314721 - protein, 18 aa, Mycobacterium
KTTRPGWWVRQYTFTGTA

SEQ ID NO: 314722 - protein, 25 aa, Mycobacterium
KTVWSRPGTRLGFFTHMTTQFPLTV

SEQ ID NO: 314723 - protein, 17 aa, Mycobacterium
KTWRGRVGYLLRPPGWS

SEQ ID NO: 314724 - protein, 22 aa, Mycobacterium
KVADTLSDWPRYSGHAVAGVSG

SEQ ID NO: 314725 - protein, 23 aa, Mycobacterium
KVAKEIFRIPGISRVQGITRPEG

SEQ ID NO: 314726 - protein, 23 aa, Mycobacterium
KVAVPRFIRRSVPDAGTVISAAR

SEQ ID NO: 314727 - protein, 31 aa, Mycobacterium
KVCKGLEKVPILGWLWSWELALPMSGIAMAT

SEQ ID NO: 314728 - protein, 31 aa, Mycobacterium
KVCKGLEKVPLLGWLWSWELALPMSGIAMAT

SEQ ID NO: 314729 - protein, 18 aa, Mycobacterium
KVEAFYWATITFSQTLGT

SEQ ID NO: 314730 - protein, 19 aa, Mycobacterium
KVEEHIPLGLSNVLRYGYY

SEQ ID NO: 314731 - protein, 34 aa, Mycobacterium
KVEFAGFIAWLAWLFLHLLYLVGHRNRVAAAFSW

SEQ ID NO: 314732 - protein, 22 aa, Mycobacterium
KVENVMLVSAFLAAAALAQAVG

SEQ ID NO: 314733 - protein, 23 aa, Mycobacterium
KVFGCGWLVLLLIGVPWLLSFAQ

SEQ ID NO: 314734 - protein, 22 aa, Mycobacterium
KVFGEVEFWLSLVKVLAIVAMI

SEQ ID NO: 314735 - protein, 17 aa, Mycobacterium
KVFKAAAWVAIVAGIVF

SEQ ID NO: 314736 - protein, 22 aa, Mycobacterium
KVFKAAAWVVIVAGIVFIVAVI

SEQ ID NO: 314737 - protein, 20 aa, Mycobacterium
KVGARIILLNSEFSGPQIKE

SEQ ID NO: 314738 - protein, 19 aa, Mycobacterium
KVGGAAFLIGYGLMAARRA

SEQ ID NO: 314739 - protein, 17 aa, Mycobacterium
KVGYWTQHFQYRNARDG

SEQ ID NO: 314740 - protein, 21 aa, Mycobacterium
KVHEVAVCNPPPKADGSAPAQ

SEQ ID NO: 314741 - protein, 24 aa, Mycobacterium
KVHLHIAGPGLLPFDSEDRVIASV

SEQ ID NO: 314742 - protein, 22 aa, Mycobacterium
KVHRHWGFGGGPHRCIGSHLAR

SEQ ID NO: 314743 - protein, 23 aa, Mycobacterium
KVHRHWGFGGGPHRCLGSHLARI

SEQ ID NO: 314744 - protein, 22 aa, Mycobacterium
KVHRHWGFGGGPHRCLGSHLGR

SEQ ID NO: 314745 - protein, 24 aa, Mycobacterium
KVHTLEVFGALFFAALAVIGLVAT

SEQ ID NO: 314746 - protein, 19 aa, Mycobacterium
KVIATRSKLMSRLSGQGAM

SEQ ID NO: 314747 - protein, 20 aa, Mycobacterium
KVIDMLAIFATLFGSAASLG

SEQ ID NO: 314748 - protein, 20 aa, Mycobacterium
KVIQKLSGLSINRFIAIDFV

SEQ ID NO: 314749 - protein, 17 aa, Mycobacterium
KVISGLVGRASLAYDMW

SEQ ID NO: 314750 - protein, 17 aa, Mycobacterium
KVKVGPVTSEFSGKVHF

SEQ ID NO: 314751 - protein, 17 aa, Mycobacterium
KVLDLTVRLAEVMLSAG

SEQ ID NO: 314752 - protein, 19 aa, Mycobacterium
KVLDLVIRLAEVMLSSGSG

SEQ ID NO: 314753 - protein, 20 aa, Mycobacterium
KVLFICAAAGLAIGSAGLGQ

SEQ ID NO: 314754 - protein, 19 aa, Mycobacterium
KVLGAGFFLGLPVAILVSL

SEQ ID NO: 314755 - protein, 18 aa, Mycobacterium
KVLKHRIRAALTRVETKD

SEQ ID NO: 314756 - protein, 19 aa, Mycobacterium
KVLMVGAFVGIAGFLMLSL

SEQ ID NO: 314757 - protein, 17 aa, Mycobacterium
KVLRGCEVVRQGDPGDR

SEQ ID NO: 314758 - protein, 19 aa, Mycobacterium
KVMAVHNFVDWRLRVGGLV

SEQ ID NO: 314759 - protein, 19 aa, Mycobacterium
KVMAVHNFVDWRVRVGGLV

SEQ ID NO: 314760 - protein, 33 aa, Mycobacterium
KVNQAGVIPVIFASSLLYIPGLITQLVRSGGNK

SEQ ID NO: 314761 - protein, 24 aa, Mycobacterium
KVPAKRLRPGDIIEVHADEVVPAD

SEQ ID NO: 314762 - protein, 33 aa, Mycobacterium
KVPDSWGIALLYLCCSGSFLGFAFAFGQVLQHN

SEQ ID NO: 314763 - protein, 18 aa, Mycobacterium
KVPPRPGAPSGFDTACMV

SEQ ID NO: 314764 - protein, 19 aa, Mycobacterium
KVPTALNMIGRAIGSYGDF

SEQ ID NO: 314765 - protein, 24 aa, Mycobacterium
KVQDFKATYLASGQAHSFESNIQY

SEQ ID NO: 314766 - protein, 21 aa, Mycobacterium
KVQLHISGPGFLPFDSEDRVI

SEQ ID NO: 314767 - protein, 20 aa, Mycobacterium
KVRESAALVIVQFVETMTGI

SEQ ID NO: 314768 - protein, 22 aa, Mycobacterium
KVRLRTLRLIDEMYPDPDSPDR

SEQ ID NO: 314769 - protein, 17 aa, Mycobacterium
KVRRMNFRFGEPAPMKK

SEQ ID NO: 314770 - protein, 24 aa, Mycobacterium
KVRVGDEVLAAGAPLGLRSTVTHG

SEQ ID NO: 314771 - protein, 20 aa, Mycobacterium
KVSALLSVALFFIWMIAVAF

SEQ ID NO: 314772 - protein, 24 aa, Mycobacterium
KVSALPEWALPVLSGSGVAFLAFI

SEQ ID NO: 314773 - protein, 20 aa, Mycobacterium
KVSASVPPHSVWAFDEAVDH

SEQ ID NO: 314774 - protein, 19 aa, Mycobacterium
KVSFLPSMRQYAGNWASAV

SEQ ID NO: 314775 - protein, 17 aa, Mycobacterium
KVSGLWAQGRYAEAQAA

SEQ ID NO: 314776 - protein, 25 aa, Mycobacterium
KVSGSRFYFLTGFGALLQLGLFQLA

SEQ ID NO: 314777 - protein, 24 aa, Mycobacterium
KVSRRGVPHIAILCSSAVGFGCVV

SEQ ID NO: 314778 - protein, 20 aa, Mycobacterium
KVTAAVVVPVMLSRMLDHLE

SEQ ID NO: 314779 - protein, 24 aa, Mycobacterium
KVTALELYLVFPLSNEESTISLVR

SEQ ID NO: 314780 - protein, 38 aa, Mycobacterium
KVTVRRWRRIGAAIVRWPAPILVATCAVALIGLLTLPV

SEQ ID NO: 314781 - protein, 19 aa, Mycobacterium
KVVALAAVAGFLVMSAPAA

SEQ ID NO: 314782 - protein, 26 aa, Mycobacterium
KVVGAALAFLVARSFSSGCAALTGVE

SEQ ID NO: 314783 - protein, 27 aa, Mycobacterium
KVVGSRRIRWPAVAIGVAGVAVILVVA

SEQ ID NO: 314784 - protein, 20 aa, Mycobacterium
KVVSAPSWFSDYVLSVGAVD

SEQ ID NO: 314785 - protein, 20 aa, Mycobacterium
KVVSSPSWFSDYVLSVGAVD

SEQ ID NO: 314786 - protein, 25 aa, Mycobacterium
KVWGFMFLFMWLRATLPRLRYDQFM

SEQ ID NO: 314787 - protein, 21 aa, Mycobacterium
KVWPAGTCLGIDPATNQPTDV

SEQ ID NO: 314788 - protein, 27 aa, Mycobacterium
KWIRVLAVPIILVWVAIIAVLNTVVPQ

SEQ ID NO: 314789 - protein, 22 aa, Mycobacterium
KWLGLTRFGVLYALSGLGGSVL

SEQ ID NO: 314790 - protein, 19 aa, Mycobacterium
KWLHWPQLGLFCYLMTLVV

SEQ ID NO: 314791 - protein, 19 aa, Mycobacterium
KWPVGWMVVLLYAVCVVLR

SEQ ID NO: 314792 - protein, 18 aa, Mycobacterium
KWSAIAMSVVTVAFIASV

SEQ ID NO: 314793 - protein, 21 aa, Mycobacterium
KWSRFVPFTSSMVGNSTGILL

SEQ ID NO: 314794 - protein, 18 aa, Mycobacterium
KWSTLPPMPTARHAEVVA

SEQ ID NO: 314795 - protein, 21 aa, Mycobacterium
KWTDKELLSLAAAAEHPSEHP

SEQ ID NO: 314796 - protein, 25 aa, Mycobacterium
KYAFRKRMLMAMALVLVGSAVAAFE

SEQ ID NO: 314797 - protein, 24 aa, Mycobacterium
KYALPAFLVPFAFVLTENGQGLIG

SEQ ID NO: 314798 - protein, 19 aa, Mycobacterium
KYAQIWWNALAKHEHWTVP

SEQ ID NO: 314799 - protein, 24 aa, Mycobacterium
KYGSYPLLLVFGFFLGIAGTVFAV

SEQ ID NO: 314800 - protein, 18 aa, Mycobacterium
KYHRLGFRELVKIHDERL

SEQ ID NO: 314801 - protein, 19 aa, Mycobacterium
KYLPKAVLFSLTFIALVVG

SEQ ID NO: 314802 - protein, 26 aa, Mycobacterium
KYMEMLNINEAWQFGRGAGVKVAVID

SEQ ID NO: 314803 - protein, 22 aa, Mycobacterium
KYNLRFVWLYIVGSFFIAVSVM

SEQ ID NO: 314804 - protein, 24 aa, Mycobacterium
KYNPEYTCMLLGATWYVDNGGRDA

SEQ ID NO: 314805 - protein, 23 aa, Mycobacterium
KYPRAGGAAVFAERAFGKPLISF

SEQ ID NO: 314806 - protein, 17 aa, Mycobacterium
KYPTGYGATLFESLQDK

SEQ ID NO: 314807 - protein, 19 aa, Mycobacterium
KYQPEWVPRYACYEDARLI

SEQ ID NO: 314808 - protein, 19 aa, Mycobacterium
KYQPEWVPRYACYEDARLV

SEQ ID NO: 314809 - protein, 19 aa, Mycobacterium
KYQPQWVPRYACYEDARVI

SEQ ID NO: 314810 - protein, 17 aa, Mycobacterium
KYREAFKDIAGSGQAPD

SEQ ID NO: 314811 - protein, 26 aa, Mycobacterium
KYRFRARTIAVMSVLMLASAVAALTW

SEQ ID NO: 314812 - protein, 23 aa, Mycobacterium
KYRKETIRVLAEITMGTGALVMI

SEQ ID NO: 314813 - protein, 21 aa, Mycobacterium
KYRLLELLGRGGMGEVWRAYD

SEQ ID NO: 314814 - protein, 23 aa, Mycobacterium
KYRWLVFTGWLLALVPAVYLALT

SEQ ID NO: 314815 - protein, 17 aa, Mycobacterium
KYTGEVAFYCYGEGKVQ

SEQ ID NO: 314816 - protein, 26 aa, Mycobacterium
KYYFMVELPPDFSAAIASPVTGQPKK

SEQ ID NO: 314817 - protein, 24 aa, Mycobacterium
KYYRYCTYAFIPLQMVSLVLACYL

SEQ ID NO: 314818 - protein, 17 aa, Mycobacterium
LAAAACGLQNAMTSNFP

SEQ ID NO: 314819 - protein, 20 aa, Mycobacterium
LAAAACWAGYILLTQKVGDA

SEQ ID NO: 314820 - protein, 19 aa, Mycobacterium
LAAAFAAVLWTCPSALAIE

SEQ ID NO: 314821 - protein, 18 aa, Mycobacterium
LAAAGFVVGALWLALEHL

SEQ ID NO: 314822 - protein, 17 aa, Mycobacterium
LAAAIWVSGRCREVGAA

SEQ ID NO: 314823 - protein, 18 aa, Mycobacterium
LAAALFCRALFVEKVPLR

SEQ ID NO: 314824 - protein, 19 aa, Mycobacterium
LAAALGLLAIIRRPPWPDL

SEQ ID NO: 314825 - protein, 19 aa, Mycobacterium
LAAALKYGSLPLSFESSDA

SEQ ID NO: 314826 - protein, 23 aa, Mycobacterium
LAAALPWLVATVVAPGWAAADAG

SEQ ID NO: 314827 - protein, 21 aa, Mycobacterium
LAAALWLLFANRMGYPVSTTH

SEQ ID NO: 314828 - protein, 20 aa, Mycobacterium
LAAANARLGAPSTIAMPLAG

SEQ ID NO: 314829 - protein, 17 aa, Mycobacterium
LAAAPGWFGVLVALRVT

SEQ ID NO: 314830 - protein, 25 aa, Mycobacterium
LAAAPRPPLGPVWVALLIIGASSGV

SEQ ID NO: 314831 - protein, 24 aa, Mycobacterium
LAAARAEPPVGLILVTIAVPTVLA

SEQ ID NO: 314832 - protein, 17 aa, Mycobacterium
LAAARCIAERLADEMSD

SEQ ID NO: 314833 - protein, 20 aa, Mycobacterium
LAAARFLLGLTVGVSVVVVP

SEQ ID NO: 314834 - protein, 24 aa, Mycobacterium
LAAARGVALLATRPDLPPQDATAM

SEQ ID NO: 314835 - protein, 34 aa, Mycobacterium
LAAAVFLVGWRGTRWWRRGVAVLSIPLCVLCAGL

SEQ ID NO: 314836 - protein, 21 aa, Mycobacterium
LAAAVGTRFMQLRARRSATSP

SEQ ID NO: 314837 - protein, 18 aa, Mycobacterium
LAAAVIWQILQWGGAGYI

SEQ ID NO: 314838 - protein, 18 aa, Mycobacterium
LAAAWRADRITIRATAPG

SEQ ID NO: 314839 - protein, 20 aa, Mycobacterium
LAAAWRMMSAIPAAREARRR

SEQ ID NO: 314840 - protein, 19 aa, Mycobacterium
LAACRRAGIRVAMVTGDHP

SEQ ID NO: 314841 - protein, 18 aa, Mycobacterium
LAACVSAVLAARAVGSAP

SEQ ID NO: 314842 - protein, 19 aa, Mycobacterium
LAADEFKKAAQIFISSDGH

SEQ ID NO: 314843 - protein, 18 aa, Mycobacterium
LAADRTTLIIAHELAIAE

SEQ ID NO: 314844 - protein, 19 aa, Mycobacterium
LAADRWGRKTTLGASILLY

SEQ ID NO: 314845 - protein, 17 aa, Mycobacterium
LAADRWQALLAPVATLV

SEQ ID NO: 314846 - protein, 23 aa, Mycobacterium
LAAEPASLVQSWRTTLARAAALL

SEQ ID NO: 314847 - protein, 18 aa, Mycobacterium
LAAEVMFFHSWVITGRAL

SEQ ID NO: 314848 - protein, 19 aa, Mycobacterium
LAAFGCLYLASTFLPSYAQ

SEQ ID NO: 314849 - protein, 19 aa, Mycobacterium
LAAFGWSIYALFWGTAGVP

SEQ ID NO: 314850 - protein, 24 aa, Mycobacterium
LAAFLLYLRMFFEPMQEISQFFNT

SEQ ID NO: 314851 - protein, 22 aa, Mycobacterium
LAAGAELLWELPMRSVGCGLIV

SEQ ID NO: 314852 - protein, 23 aa, Mycobacterium
LAAGCVFTVLALAGCALLGLLSP

SEQ ID NO: 314853 - protein, 27 aa, Mycobacterium
LAAGGIAWLLGERGMADGCWIAGTVLA

SEQ ID NO: 314854 - protein, 25 aa, Mycobacterium
LAAGGRYRRLWAGGRRIDRVGAATT

SEQ ID NO: 314855 - protein, 25 aa, Mycobacterium
LAAGLAAVCYAELASAVPVSGSSYS

SEQ ID NO: 314856 - protein, 34 aa, Mycobacterium
LAAGMLPILGWRNDFRWALLMTGLVVFAVADVAY

SEQ ID NO: 314857 - protein, 17 aa, Mycobacterium
LAAGNWQALMLPVTTLT

SEQ ID NO: 314858 - protein, 25 aa, Mycobacterium
LAAGTPQLAAAVPFYGPTPDDPDFA

SEQ ID NO: 314859 - protein, 17 aa, Mycobacterium
LAAGVAAPIGFVMPMSA

SEQ ID NO: 314860 - protein, 23 aa, Mycobacterium
LAAGVLAPIGFVLPMSVGAILMS

SEQ ID NO: 314861 - protein, 25 aa, Mycobacterium
LAAGVLAPVGFILPMSVGAVLMSLS

SEQ ID NO: 314862 - protein, 18 aa, Mycobacterium
LAAGVLYPTLGLRLSPMI

SEQ ID NO: 314863 - protein, 23 aa, Mycobacterium
LAAGVVALLAWISRDRSPRLTAA

SEQ ID NO: 314864 - protein, 25 aa, Mycobacterium
LAAHKLENVMLVSAFLAAAALGQAV

SEQ ID NO: 314865 - protein, 18 aa, Mycobacterium
LAAHPRLPREDALKVLPA

SEQ ID NO: 314866 - protein, 27 aa, Mycobacterium
LAAIALVVSVSLLVTRTGSQRLANPAT

SEQ ID NO: 314867 - protein, 17 aa, Mycobacterium
LAAIAVVLMRSEPDPEA

SEQ ID NO: 314868 - protein, 19 aa, Mycobacterium
LAAIKCFAGGAVVSSLATE

SEQ ID NO: 314869 - protein, 18 aa, Mycobacterium
LAAILYNLMRTMCVGVVT

SEQ ID NO: 314870 - protein, 23 aa, Mycobacterium
LAAIYVLWMYQRMMTGPLAPGNE

SEQ ID NO: 314871 - protein, 25 aa, Mycobacterium
LAAKPGGPLALWIAAAALFAMGLWR

SEQ ID NO: 314872 - protein, 20 aa, Mycobacterium
LAAKSGYFGPVPRMVSGAAL

SEQ ID NO: 314873 - protein, 20 aa, Mycobacterium
LAALAAACRRVTEGNFGERI

SEQ ID NO: 314874 - protein, 30 aa, Mycobacterium
LAALAAFELIDWPVAVVIAAGHFLASNHHN

SEQ ID NO: 314875 - protein, 21 aa, Mycobacterium
LAALAISCWALPPLLPYSHTD

SEQ ID NO: 314876 - protein, 20 aa, Mycobacterium
LAALALRFGAFSEHTLSTAV

SEQ ID NO: 314877 - protein, 27 aa, Mycobacterium
LAALCGLCAVAYLVSRHAAGAPAGVAM

SEQ ID NO: 314878 - protein, 21 aa, Mycobacterium
LAALCQPNLFSAHLALQPPGS

SEQ ID NO: 314879 - protein, 18 aa, Mycobacterium
LAALFLDERLNRWRLVAL

SEQ ID NO: 314880 - protein, 20 aa, Mycobacterium
LAALGALMWLRTTIEPSPGF

SEQ ID NO: 314881 - protein, 18 aa, Mycobacterium
LAALGWQAKIHRFPNPAE

SEQ ID NO: 314882 - protein, 37 aa, Mycobacterium
LAALGWSVYALFWGTAGMPGMRHAFEFTVTRTDGTGN

SEQ ID NO: 314883 - protein, 27 aa, Mycobacterium
LAALIRARFPALTARQVMQRIESTAHH

SEQ ID NO: 314884 - protein, 28 aa, Mycobacterium
LAALIRARFPALTARQVMQRITSTAHHP

SEQ ID NO: 314885 - protein, 23 aa, Mycobacterium
LAALLVIAGLCFLWYERPRQQQR

SEQ ID NO: 314886 - protein, 18 aa, Mycobacterium
LAALPQYWLGIVLLVVFA

SEQ ID NO: 314887 - protein, 17 aa, Mycobacterium
LAALSILVGAVGATGPG

SEQ ID NO: 314888 - protein, 18 aa, Mycobacterium
LAALTANGSPDGWFLGMT

SEQ ID NO: 314889 - protein, 18 aa, Mycobacterium
LAALTGTSGWEMYKPWAI

SEQ ID NO: 314890 - protein, 31 aa, Mycobacterium
LAALVAARYLTPWGRQFWRITRGYFVGPTSV

SEQ ID NO: 314891 - protein, 20 aa, Mycobacterium
LAALVAFSGSIDRYLDEHAL

SEQ ID NO: 314892 - protein, 17 aa, Mycobacterium
LAALVSIGSMGLITVGA

SEQ ID NO: 314893 - protein, 25 aa, Mycobacterium
LAALWFWLPEQLRTMHISSPLTELG

SEQ ID NO: 314894 - protein, 23 aa, Mycobacterium
LAAMAVAVVAAYFAIRGSMTVGQ

SEQ ID NO: 314895 - protein, 18 aa, Mycobacterium
LAAMHRRIFAGETGEAGE

SEQ ID NO: 314896 - protein, 26 aa, Mycobacterium
LAAMVPRSSTALSVFSGTLAFVLTIA

SEQ ID NO: 314897 - protein, 27 aa, Mycobacterium
LAANIIGGIDWDGHGLLGLEDSLDSVL

SEQ ID NO: 314898 - protein, 17 aa, Mycobacterium
LAANIVGGIDWDGHGLL

SEQ ID NO: 314899 - protein, 19 aa, Mycobacterium
LAANIVGGIDWDGHGLLGL

SEQ ID NO: 314900 - protein, 25 aa, Mycobacterium
LAANIVGGIDWDGHGLLGLEDSMDA

SEQ ID NO: 314901 - protein, 27 aa, Mycobacterium
LAANLVGGWVIMWLIMLGFPKLHAQTV

SEQ ID NO: 314902 - protein, 19 aa, Mycobacterium
LAANVLKVVTLLSIAFGAL

SEQ ID NO: 314903 - protein, 17 aa, Mycobacterium
LAANVLQLITFRVVQGV

SEQ ID NO: 314904 - protein, 18 aa, Mycobacterium
LAAPLLVRLMLGRDPQVN

SEQ ID NO: 314905 - protein, 24 aa, Mycobacterium
LAAPLRRLTGLSGKTGALAKLTNT

SEQ ID NO: 314906 - protein, 18 aa, Mycobacterium
LAAPLWSEHVAHTLPNEN

SEQ ID NO: 314907 - protein, 35 aa, Mycobacterium
LAAPMIACLVAGCGTWLVYRLTRRVAEKRRREGFR

SEQ ID NO: 314908 - protein, 19 aa, Mycobacterium
LAAPRRVLAVAALIAAAAA

SEQ ID NO: 314909 - protein, 30 aa, Mycobacterium
LAAPVVVWGALPFHRAAWLNLRHGTATMDT

SEQ ID NO: 314910 - protein, 18 aa, Mycobacterium
LAAPWPMPIEDWKSDYAT

SEQ ID NO: 314911 - protein, 25 aa, Mycobacterium
LAAQAGILRPEFRVSAGGALAAALV

SEQ ID NO: 314912 - protein, 21 aa, Mycobacterium
LAAQGLRWWCIKTLGPQWNTR

SEQ ID NO: 314913 - protein, 20 aa, Mycobacterium
LAARALRILPGFYVCLVVTA

SEQ ID NO: 314914 - protein, 20 aa, Mycobacterium
LAARALRILPGFYVCMIVTA

SEQ ID NO: 314915 - protein, 18 aa, Mycobacterium
LAARFCGQFEQPVQLIPA

SEQ ID NO: 314916 - protein, 24 aa, Mycobacterium
LAARGEVYAPLTLVFLFSGSDIVV

SEQ ID NO: 314917 - protein, 17 aa, Mycobacterium
LAARGWRRPTAVAPTGV

SEQ ID NO: 314918 - protein, 17 aa, Mycobacterium
LAARLIRAFSVPIVLFW

SEQ ID NO: 314919 - protein, 27 aa, Mycobacterium
LAARLPSWFPSWGFLSAVIAIGGMQLL

SEQ ID NO: 314920 - protein, 25 aa, Mycobacterium
LAARRFSALALWCFIAMGVSGVINA

SEQ ID NO: 314921 - protein, 17 aa, Mycobacterium
LAARRSAPVAAVLCAVV

SEQ ID NO: 314922 - protein, 18 aa, Mycobacterium
LAASATFLAVVITSSLIT

SEQ ID NO: 314923 - protein, 18 aa, Mycobacterium
LAASFGMSVVVWQYIFGI

SEQ ID NO: 314924 - protein, 17 aa, Mycobacterium
LAASGAMVFAILVILGR

SEQ ID NO: 314925 - protein, 24 aa, Mycobacterium
LAASTWALTVVKLVGAAYLIYLGA

SEQ ID NO: 314926 - protein, 23 aa, Mycobacterium
LAASVLPVWLLLAPRDYLSTFMK

SEQ ID NO: 314927 - protein, 17 aa, Mycobacterium
LAATAAEVAALPLAGED

SEQ ID NO: 314928 - protein, 18 aa, Mycobacterium
LAATIPVAWVLHRLTRPR

SEQ ID NO: 314929 - protein, 19 aa, Mycobacterium
LAATLWHPHIVGVHDRGEF

SEQ ID NO: 314930 - protein, 21 aa, Mycobacterium
LAAVAAIVAVLVWGVGANLGW

SEQ ID NO: 314931 - protein, 20 aa, Mycobacterium
LAAVAAWRGDPDADRSEVVV

SEQ ID NO: 314932 - protein, 26 aa, Mycobacterium
LAAVALPPAICALLLAVPPLGVGTQT

SEQ ID NO: 314933 - protein, 18 aa, Mycobacterium
LAAVAWEVSCLRSERTGR

SEQ ID NO: 314934 - protein, 25 aa, Mycobacterium
LAAVFCVLGVLPLIVLTQLGTIVGL

SEQ ID NO: 314935 - protein, 19 aa, Mycobacterium
LAAVIALVSTVGWGWTLLA

SEQ ID NO: 314936 - protein, 19 aa, Mycobacterium
LAAVIGVPAGLLLGVSTTA

SEQ ID NO: 314937 - protein, 17 aa, Mycobacterium
LAAVLLVGVTGYGCGAI

SEQ ID NO: 314938 - protein, 25 aa, Mycobacterium
LAAVPRPPLGPVWVALLIIGASSGV

SEQ ID NO: 314939 - protein, 21 aa, Mycobacterium
LAAVPRRRRLVIIVFGLTVLA

SEQ ID NO: 314940 - protein, 21 aa, Mycobacterium
LAAVSMFLGFFAWYRGLAIGP

SEQ ID NO: 314941 - protein, 29 aa, Mycobacterium
LAAVVAMAALASWFGFHAYQSHQADQQRK

SEQ ID NO: 314942 - protein, 22 aa, Mycobacterium
LAAVWPAGAGLLIRFTGPEVWW

SEQ ID NO: 314943 - protein, 22 aa, Mycobacterium
LAAWATRPAFRGTAIGITLLVG

SEQ ID NO: 314944 - protein, 23 aa, Mycobacterium
LAAWATRPGFRGATIAITLIVGI

SEQ ID NO: 314945 - protein, 24 aa, Mycobacterium
LAAWATRSGFRAAVIVITLVVGIF

SEQ ID NO: 314946 - protein, 20 aa, Mycobacterium
LAAWAVWEFRGARGAIQATL

SEQ ID NO: 314947 - protein, 19 aa, Mycobacterium
LAAYLFAEAGLRPGDRALL

SEQ ID NO: 314948 - protein, 20 aa, Mycobacterium
LAAYSMAPWIALAVAAVLLV

SEQ ID NO: 314949 - protein, 20 aa, Mycobacterium
LAAYSMAPWIAMAVAAVLLV

SEQ ID NO: 314950 - protein, 18 aa, Mycobacterium
LAAYTKLVEKLRAEKYSV

SEQ ID NO: 314951 - protein, 20 aa, Mycobacterium
LACATKWSGLYFVLFFGVMT

SEQ ID NO: 314952 - protein, 19 aa, Mycobacterium
LACATKWSGLYFVMFFGLM

SEQ ID NO: 314953 - protein, 17 aa, Mycobacterium
LACDLLIPFGYIGSLVS

SEQ ID NO: 314954 - protein, 30 aa, Mycobacterium
LACFTVPPRSVWWWPCVAVIGATVLLMLVN

SEQ ID NO: 314955 - protein, 19 aa, Mycobacterium
LACFVPLLPWIGTLVGPVP

SEQ ID NO: 314956 - protein, 18 aa, Mycobacterium
LACGELIAGAVVTEAVFA

SEQ ID NO: 314957 - protein, 19 aa, Mycobacterium
LACGLCLTGFFLLGYRVLS

SEQ ID NO: 314958 - protein, 19 aa, Mycobacterium
LACGTKWSGLYFIAFFGVL

SEQ ID NO: 314959 - protein, 19 aa, Mycobacterium
LACGTKWSGLYFVVFFGAM

SEQ ID NO: 314960 - protein, 20 aa, Mycobacterium
LACGTKWSGLYFVVFFGVMS

SEQ ID NO: 314961 - protein, 32 aa, Mycobacterium
LACLGAAVGLTWWWWGYRRRGISYVQLTPEGF

SEQ ID NO: 314962 - protein, 24 aa, Mycobacterium
LACNELDGLMVLPGTTRASIERGI

SEQ ID NO: 314963 - protein, 17 aa, Mycobacterium
LACRVSLLVLIASLALM

SEQ ID NO: 314964 - protein, 25 aa, Mycobacterium
LACRWAQAHANLGVWVGYVGAAAEA

SEQ ID NO: 314965 - protein, 19 aa, Mycobacterium
LACVGRWLPAAGLAVDTLA

SEQ ID NO: 314966 - protein, 20 aa, Mycobacterium
LACWATRAGFRVAAIVISLV

SEQ ID NO: 314967 - protein, 24 aa, Mycobacterium
LACYVAAALLAWVRYGRPRTMPAP

SEQ ID NO: 314968 - protein, 21 aa, Mycobacterium
LADAISAYFVPVVIAIAIATF

SEQ ID NO: 314969 - protein, 20 aa, Mycobacterium
LADAISAYFVPVVIATAVAT

SEQ ID NO: 314970 - protein, 18 aa, Mycobacterium
LADARPVWARVLGRRLPE

SEQ ID NO: 314971 - protein, 23 aa, Mycobacterium
LADDLKARVIGFVQKPVVLASLA

SEQ ID NO: 314972 - protein, 17 aa, Mycobacterium
LADGWSAALAKDGVTAG

SEQ ID NO: 314973 - protein, 22 aa, Mycobacterium
LADHLPRLRRELERRLGPEGTD

SEQ ID NO: 314974 - protein, 17 aa, Mycobacterium
LADHLVGGAVLFPGTGF

SEQ ID NO: 314975 - protein, 19 aa, Mycobacterium
LADHVDWSLIDVIRGAPGA

SEQ ID NO: 314976 - protein, 21 aa, Mycobacterium
LADKVGEKFHRPSWVALPVLV

SEQ ID NO: 314977 - protein, 19 aa, Mycobacterium
LADLKKRALVWGDSAVRVA

SEQ ID NO: 314978 - protein, 17 aa, Mycobacterium
LADLSFFVLDDWLRPLQ

SEQ ID NO: 314979 - protein, 27 aa, Mycobacterium
LADLWVFPICLLLGVSVGAFHILWHGR

SEQ ID NO: 314980 - protein, 18 aa, Mycobacterium
LADNAVDIIVHFRGGGVA

SEQ ID NO: 314981 - protein, 28 aa, Mycobacterium
LADNRGRWFFRHLFDLAIVVLPMLRPLR

SEQ ID NO: 314982 - protein, 25 aa, Mycobacterium
LADPEVRLLFSLGLRILERRRHTGT

SEQ ID NO: 314983 - protein, 22 aa, Mycobacterium
LADPFGLGWRLFGLAPDDVSYV

SEQ ID NO: 314984 - protein, 19 aa, Mycobacterium
LADPHGLAFDSADTCYVVD

SEQ ID NO: 314985 - protein, 23 aa, Mycobacterium
LADPRGLPVLSVKQLVVRAVSGE

SEQ ID NO: 314986 - protein, 32 aa, Mycobacterium
LADPRPLRPDWVITRPRLTGICGSDSKQILLD

SEQ ID NO: 314987 - protein, 20 aa, Mycobacterium
LADRAAVYLSGDFGAQYRKF

SEQ ID NO: 314988 - protein, 21 aa, Mycobacterium
LADRLGRPVVYAFGLVFFAVG

SEQ ID NO: 314989 - protein, 22 aa, Mycobacterium
LADRLRRVLPLVNRISGGLLVV

SEQ ID NO: 314990 - protein, 20 aa, Mycobacterium
LADRRCMIYAGTTVVAGTAV

SEQ ID NO: 314991 - protein, 25 aa, Mycobacterium
LADRRLLGRIWRFAARHHRRLAVFV

SEQ ID NO: 314992 - protein, 23 aa, Mycobacterium
LADRTAVVIAHRLSTVQIADRVL

SEQ ID NO: 314993 - protein, 20 aa, Mycobacterium
LADRYGRAGFIPLGLAVAAT

SEQ ID NO: 314994 - protein, 20 aa, Mycobacterium
LADSAFTAGAADPGVTAVAA

SEQ ID NO: 314995 - protein, 24 aa, Mycobacterium
LADTRYTSGNAWIFGLELVGVVTG

SEQ ID NO: 314996 - protein, 22 aa, Mycobacterium
LADTWWQLAILRFIAGVGSGVE

SEQ ID NO: 314997 - protein, 25 aa, Mycobacterium
LADVLGRKRMFVFGVVLFTIASGLC

SEQ ID NO: 314998 - protein, 20 aa, Mycobacterium
LADVLPVYLAIVVGLSLVIL

SEQ ID NO: 314999 - protein, 26 aa, Mycobacterium
LAEAFLPRRIRYAGQVTLALGGLIAA

SEQ ID NO: 315000 - protein, 26 aa, Mycobacterium
LAEAFLPRRLRYGAQVTLALSGLVAA

SEQ ID NO: 315001 - protein, 18 aa, Mycobacterium
LAEAVPRDRGYWVTEDPS

SEQ ID NO: 315002 - protein, 17 aa, Mycobacterium
LAEDVRAGLAPQPQFVI

SEQ ID NO: 315003 - protein, 23 aa, Mycobacterium
LAEDYRTGLPVAEVAQIVTAVAD

SEQ ID NO: 315004 - protein, 24 aa, Mycobacterium
LAEGLRSATFYKLLVAAGLFAFTT

SEQ ID NO: 315005 - protein, 23 aa, Mycobacterium
LAEGSAPRQALIRTMVTAGRTVV

SEQ ID NO: 315006 - protein, 23 aa, Mycobacterium
LAEHLPAALVPRLVQIDELPTRT

SEQ ID NO: 315007 - protein, 29 aa, Mycobacterium
LAEKALAPWHLRVAAFAVDVVPGIAVVAT

SEQ ID NO: 315008 - protein, 29 aa, Mycobacterium
LAEKLFSRWGVRAVFFGRFIALLRIFAGP

SEQ ID NO: 315009 - protein, 30 aa, Mycobacterium
LAELARLAGVREFFDTMVIVENFPSTSSAE

SEQ ID NO: 315010 - protein, 19 aa, Mycobacterium
LAELEYKAPVWGYSAGSLG

SEQ ID NO: 315011 - protein, 22 aa, Mycobacterium
LAELFGTFWLVFGGCGSAIFAA

SEQ ID NO: 315012 - protein, 17 aa, Mycobacterium
LAELMGGPNIAPVQSNL

SEQ ID NO: 315013 - protein, 21 aa, Mycobacterium
LAELQRYAADLSRVPDVSSVS

SEQ ID NO: 315014 - protein, 29 aa, Mycobacterium
LAENNGRTWLLWDGRRSAIDLADRAVAGG

SEQ ID NO: 315015 - protein, 26 aa, Mycobacterium
LAENYLRLNALGAYGSFFNIFYCSTR

SEQ ID NO: 315016 - protein, 26 aa, Mycobacterium
LAENYLRLNALGAYGSFFNIYYCSIR

SEQ ID NO: 315017 - protein, 21 aa, Mycobacterium
LAEPLRLALEHLMDTGEYRTI

SEQ ID NO: 315018 - protein, 18 aa, Mycobacterium
LAERLAVDGRELWNTYGP

SEQ ID NO: 315019 - protein, 21 aa, Mycobacterium
LAERRCMLYAGTTVVAGTAVA

SEQ ID NO: 315020 - protein, 18 aa, Mycobacterium
LAESLPAYMVPTAVVVLD

SEQ ID NO: 315021 - protein, 25 aa, Mycobacterium
LAESYGWRASLAIWALIPAVAVLPW

SEQ ID NO: 315022 - protein, 24 aa, Mycobacterium
LAETIARRLGLTGALGTVAESVDG

SEQ ID NO: 315023 - protein, 25 aa, Mycobacterium
LAETRRRPVCSIAIVIAGGIGCAAV

SEQ ID NO: 315024 - protein, 23 aa, Mycobacterium
LAEVKPDHEAFVFTEYDTRSGDR

SEQ ID NO: 315025 - protein, 21 aa, Mycobacterium
LAEVLDRVWTTLGGFIRTQAL

SEQ ID NO: 315026 - protein, 19 aa, Mycobacterium
LAFACTQAGIAVAIAPALN

SEQ ID NO: 315027 - protein, 23 aa, Mycobacterium
LAFFAQFAIAFVVDKSLSPIESI

SEQ ID NO: 315028 - protein, 27 aa, Mycobacterium
LAFGHQSSYGWLVWVFVAMFGVGLIDL

SEQ ID NO: 315029 - protein, 17 aa, Mycobacterium
LAFGLGAIFGIFVLLVR

SEQ ID NO: 315030 - protein, 18 aa, Mycobacterium
LAFGLMAALLLDATVVRM

SEQ ID NO: 315031 - protein, 17 aa, Mycobacterium
LAFHLGYHSVPFGVMAG

SEQ ID NO: 315032 - protein, 25 aa, Mycobacterium
LAFIGVKLILHWGHVDINPQIPEIN

SEQ ID NO: 315033 - protein, 20 aa, Mycobacterium
LAFLLVFGIFVRRFVDIAIG

SEQ ID NO: 315034 - protein, 20 aa, Mycobacterium
LAFLLVFGIFVRRVSNIVIG

SEQ ID NO: 315035 - protein, 19 aa, Mycobacterium
LAFLPKWSALTALSQTSSL

SEQ ID NO: 315036 - protein, 22 aa, Mycobacterium
LAFLYQRPKAMVPRHTSSHRIT

SEQ ID NO: 315037 - protein, 31 aa, Mycobacterium
LAFMMMPFVLGYDIANAVIYWITHLSAGIVS

SEQ ID NO: 315038 - protein, 28 aa, Mycobacterium
LAFQACFVSAGAVAARFGAAAVAAHQVV

SEQ ID NO: 315039 - protein, 27 aa, Mycobacterium
LAFQACFVSAGAVAARFGASALAAHQV

SEQ ID NO: 315040 - protein, 19 aa, Mycobacterium
LAFQISLFVVILGYGLTAR

SEQ ID NO: 315041 - protein, 17 aa, Mycobacterium
LAFRGVLHGALHRAWGF

SEQ ID NO: 315042 - protein, 17 aa, Mycobacterium
LAFSAVSIVFLFGLQLV

SEQ ID NO: 315043 - protein, 18 aa, Mycobacterium
LAFSIWVSVVLVFYFVWG

SEQ ID NO: 315044 - protein, 23 aa, Mycobacterium
LAFSKPFFDQGLLNRRTVLKSSY

SEQ ID NO: 315045 - protein, 20 aa, Mycobacterium
LAFSVLDEWLQPVSVDVVGE

SEQ ID NO: 315046 - protein, 19 aa, Mycobacterium
LAFTGCERVGKGPERIPEL

SEQ ID NO: 315047 - protein, 19 aa, Mycobacterium
LAFVALIAFVMLLVSVHSM

SEQ ID NO: 315048 - protein, 19 aa, Mycobacterium
LAFVFRFLVLAPLSWLIPA

SEQ ID NO: 315049 - protein, 25 aa, Mycobacterium
LAFVLPFLILVEAFVFTILGLMFSI

SEQ ID NO: 315050 - protein, 20 aa, Mycobacterium
LAFVRRPRRWIKQLATESAY

SEQ ID NO: 315051 - protein, 19 aa, Mycobacterium
LAGAAILLLAGRRCDAWGH

SEQ ID NO: 315052 - protein, 22 aa, Mycobacterium
LAGALCYGWGLGLAQRMGPGTV

SEQ ID NO: 315053 - protein, 25 aa, Mycobacterium
LAGALGAVMAFSFARIGLHSRRNLT

SEQ ID NO: 315054 - protein, 31 aa, Mycobacterium
LAGALPLVMWLRRRPPRLPDTVHAWAYVGLL

SEQ ID NO: 315055 - protein, 24 aa, Mycobacterium
LAGAWGLAEVFGWKHTLNERPNRA

SEQ ID NO: 315056 - protein, 24 aa, Mycobacterium
LAGAWGLSEVFGWQHTLNQRPTRA

SEQ ID NO: 315057 - protein, 24 aa, Mycobacterium
LAGAWGLSEVFGWRHTLNQRPNRA

SEQ ID NO: 315058 - protein, 17 aa, Mycobacterium
LAGCALLGLLSPHVALD

SEQ ID NO: 315059 - protein, 26 aa, Mycobacterium
LAGCASCRAAVAELCGVPALLSQLGA

SEQ ID NO: 315060 - protein, 24 aa, Mycobacterium
LAGDAAHLMPVWQGQGYNSGIRDA

SEQ ID NO: 315061 - protein, 20 aa, Mycobacterium
LAGDLFNLFVGFEVLLAASF

SEQ ID NO: 315062 - protein, 20 aa, Mycobacterium
LAGFAFAWSDSWEYWTETVR

SEQ ID NO: 315063 - protein, 19 aa, Mycobacterium
LAGFCLHATLLGMLAGTNR

SEQ ID NO: 315064 - protein, 17 aa, Mycobacterium
LAGFCVHTTLLGALAGM

SEQ ID NO: 315065 - protein, 17 aa, Mycobacterium
LAGFGWMISSRMVRGMT

SEQ ID NO: 315066 - protein, 18 aa, Mycobacterium
LAGGFGLFGGMAAFSAIG

SEQ ID NO: 315067 - protein, 18 aa, Mycobacterium
LAGGLWIAAAILYGATVS

SEQ ID NO: 315068 - protein, 17 aa, Mycobacterium
LAGGPWQWQRWAPASPW

SEQ ID NO: 315069 - protein, 28 aa, Mycobacterium
LAGGPWRWDRWAPASPWATPPPTVMALG

SEQ ID NO: 315070 - protein, 17 aa, Mycobacterium
LAGGRAIARVVAVRRLR

SEQ ID NO: 315071 - protein, 19 aa, Mycobacterium
LAGHAVAGTVLFPGAGFVE

SEQ ID NO: 315072 - protein, 26 aa, Mycobacterium
LAGHRVSRWEWIWALVLAGALAVVIM

SEQ ID NO: 315073 - protein, 23 aa, Mycobacterium
LAGIAAGIGYRYNVDPLLVRVIF

SEQ ID NO: 315074 - protein, 18 aa, Mycobacterium
LAGIALLVSRQVVVPVRS

SEQ ID NO: 315075 - protein, 27 aa, Mycobacterium
LAGILGLAPADSWPAAVAVGLAAMFTL

SEQ ID NO: 315076 - protein, 21 aa, Mycobacterium
LAGIMGLFVVFPIGGADMPVV

SEQ ID NO: 315077 - protein, 17 aa, Mycobacterium
LAGIPSVIVGLWGAMTF

SEQ ID NO: 315078 - protein, 17 aa, Mycobacterium
LAGIYGMNFDNMPELHW

SEQ ID NO: 315079 - protein, 19 aa, Mycobacterium
LAGIYIAVRYERYMSLAAL

SEQ ID NO: 315080 - protein, 18 aa, Mycobacterium
LAGLAARNAAKEYLGATQ

SEQ ID NO: 315081 - protein, 26 aa, Mycobacterium
LAGLAMLCAHAMFKAALFMVVGIIDH

SEQ ID NO: 315082 - protein, 25 aa, Mycobacterium
LAGLARFVWATAIIWILGGIGTWLI

SEQ ID NO: 315083 - protein, 24 aa, Mycobacterium
LAGLARFVWATAIVWILGGFGTWL

SEQ ID NO: 315084 - protein, 22 aa, Mycobacterium
LAGLDLGNIISIVSGAERIHPA

SEQ ID NO: 315085 - protein, 27 aa, Mycobacterium
LAGLDPRLLHTLSFVVALAIVVTLHVL

SEQ ID NO: 315086 - protein, 18 aa, Mycobacterium
LAGLFATVGILAALRARD

SEQ ID NO: 315087 - protein, 25 aa, Mycobacterium
LAGLICGGVGLLIAGWVAGSFTSRP

SEQ ID NO: 315088 - protein, 19 aa, Mycobacterium
LAGLIGFIGNEWVALYRIG

SEQ ID NO: 315089 - protein, 19 aa, Mycobacterium
LAGLIMFGLQVWGRGGVSP

SEQ ID NO: 315090 - protein, 18 aa, Mycobacterium
LAGLKKFQITVGEAIAGM

SEQ ID NO: 315091 - protein, 24 aa, Mycobacterium
LAGLKRLVSAAAFQHRTDAGYLTE

SEQ ID NO: 315092 - protein, 26 aa, Mycobacterium
LAGLLGPWFWWPLRVRTGPTAEARPN

SEQ ID NO: 315093 - protein, 27 aa, Mycobacterium
LAGLLIVIGIELLKPAHIETALRNGDL

SEQ ID NO: 315094 - protein, 25 aa, Mycobacterium
LAGLPDSLLWRIGDIAAQPPNRIRG

SEQ ID NO: 315095 - protein, 17 aa, Mycobacterium
LAGLPWVAAALIAISLA

SEQ ID NO: 315096 - protein, 25 aa, Mycobacterium
LAGLSRFVWATAIVWILGGLGTWLI

SEQ ID NO: 315097 - protein, 18 aa, Mycobacterium
LAGLVGAVPQVWWGPAEQ

SEQ ID NO: 315098 - protein, 21 aa, Mycobacterium
LAGLVGGLRRPGGARADGAKT

SEQ ID NO: 315099 - protein, 20 aa, Mycobacterium
LAGMATWLTVRGELSVPEAV

SEQ ID NO: 315100 - protein, 17 aa, Mycobacterium
LAGMFLARGMCYVVSVD

SEQ ID NO: 315101 - protein, 28 aa, Mycobacterium
LAGNVAGWFAGWVYMWALVIIMATVAYA

SEQ ID NO: 315102 - protein, 25 aa, Mycobacterium
LAGPDGRPTIHLPLDDPYQAPDGYP

SEQ ID NO: 315103 - protein, 17 aa, Mycobacterium
LAGPGWVLFGAIKQVIG

SEQ ID NO: 315104 - protein, 17 aa, Mycobacterium
LAGPRQVTYSVTGTKAP

SEQ ID NO: 315105 - protein, 18 aa, Mycobacterium
LAGPWTWSPQPPVWVAAV

SEQ ID NO: 315106 - protein, 24 aa, Mycobacterium
LAGQRPGNLPAWLRGSAAIASGYT

SEQ ID NO: 315107 - protein, 17 aa, Mycobacterium
LAGQWLAAVLFGRALLA

SEQ ID NO: 315108 - protein, 17 aa, Mycobacterium
LAGRGVVLTRILGTTLH

SEQ ID NO: 315109 - protein, 19 aa, Mycobacterium
LAGRHHYVLAFARALAVAI

SEQ ID NO: 315110 - protein, 24 aa, Mycobacterium
LAGRLCSTREKLAILFTGRGLVVT

SEQ ID NO: 315111 - protein, 18 aa, Mycobacterium
LAGRQSAILVTAWALSGG

SEQ ID NO: 315112 - protein, 18 aa, Mycobacterium
LAGRSAFEHRAVVVGADR

SEQ ID NO: 315113 - protein, 25 aa, Mycobacterium
LAGRSRGGAVAAVFFALVSGSLWGI

SEQ ID NO: 315114 - protein, 20 aa, Mycobacterium
LAGSLARQGSTPASAGTLPT

SEQ ID NO: 315115 - protein, 20 aa, Mycobacterium
LAGSLFGQIWKRIGDNDPEP

SEQ ID NO: 315116 - protein, 26 aa, Mycobacterium
LAGSLPMTVFVAFQLMFAIITVALIS

SEQ ID NO: 315117 - protein, 23 aa, Mycobacterium
LAGSMTWEILWALILGFALSAMV

SEQ ID NO: 315118 - protein, 23 aa, Mycobacterium
LAGSMTWEILWALIVGFTLSAVV

SEQ ID NO: 315119 - protein, 17 aa, Mycobacterium
LAGSSFLVRFNYDDLKA

SEQ ID NO: 315120 - protein, 20 aa, Mycobacterium
LAGTTGWLAGMWRDLLGAAI

SEQ ID NO: 315121 - protein, 20 aa, Mycobacterium
LAGTTWWSPWTAYLATVDPR

SEQ ID NO: 315122 - protein, 25 aa, Mycobacterium
LAGVMLAFVGVGWALTLPAALFVVG

SEQ ID NO: 315123 - protein, 19 aa, Mycobacterium
LAGVTGWLPLFAVAWLVVG

SEQ ID NO: 315124 - protein, 22 aa, Mycobacterium
LAGVVVLLGAMWASNRLSRKAD

SEQ ID NO: 315125 - protein, 25 aa, Mycobacterium
LAGYGPRAPQLWLPPLDEPIPVSAM

SEQ ID NO: 315126 - protein, 17 aa, Mycobacterium
LAHEFRSSTDLLGLTVP

SEQ ID NO: 315127 - protein, 23 aa, Mycobacterium
LAHLCFLGALVPLAARRPPKPRI

SEQ ID NO: 315128 - protein, 22 aa, Mycobacterium
LAHMKLAWRTGDLAVYAITMVC

SEQ ID NO: 315129 - protein, 23 aa, Mycobacterium
LAHTTRWGSYLSEIDEFDADYFE

SEQ ID NO: 315130 - protein, 17 aa, Mycobacterium
LAIACVAVLAAVLKVSP

SEQ ID NO: 315131 - protein, 19 aa, Mycobacterium
LAIAEAFDTVEIYGAAPSQ

SEQ ID NO: 315132 - protein, 17 aa, Mycobacterium
LAIALAFDEASRRKVDL

SEQ ID NO: 315133 - protein, 23 aa, Mycobacterium
LAIALKYKFGYDDSLDVVGVHLV

SEQ ID NO: 315134 - protein, 17 aa, Mycobacterium
LAIALPSVCLFIDVSPT

SEQ ID NO: 315135 - protein, 27 aa, Mycobacterium
LAIALTAWRVMWFRIHAHPAGDEWHVA

SEQ ID NO: 315136 - protein, 18 aa, Mycobacterium
LAIAMTWLSIEMEPDTPV

SEQ ID NO: 315137 - protein, 17 aa, Mycobacterium
LAIAPGWFGILAAIQVI

SEQ ID NO: 315138 - protein, 22 aa, Mycobacterium
LAIATRGRYYLRRGHDGIDLPM

SEQ ID NO: 315139 - protein, 17 aa, Mycobacterium
LAICVALTVFVPSLEKV

SEQ ID NO: 315140 - protein, 17 aa, Mycobacterium
LAIDIALYTLARLGLAV

SEQ ID NO: 315141 - protein, 28 aa, Mycobacterium
LAIGAATLGGWVLAAFAVRPFKQLARQT

SEQ ID NO: 315142 - protein, 30 aa, Mycobacterium
LAIGDNTWFSWLVVFWLWLTVIFANLAEAV

SEQ ID NO: 315143 - protein, 20 aa, Mycobacterium
LAIGLARWYFGNAQGTKATS

SEQ ID NO: 315144 - protein, 19 aa, Mycobacterium
LAIGMAIGMAAQTARRAHA

SEQ ID NO: 315145 - protein, 19 aa, Mycobacterium
LAIGPVWRVLSPVRALHRF

SEQ ID NO: 315146 - protein, 28 aa, Mycobacterium
LAIGTLRWPRRRALLAFLGVFVVAHIVA

SEQ ID NO: 315147 - protein, 17 aa, Mycobacterium
LAIGVARMARRRAVVRR

SEQ ID NO: 315148 - protein, 32 aa, Mycobacterium
LAIIGRSGGIYGDFFNFYACDVTLKLNGLQPG

SEQ ID NO: 315149 - protein, 19 aa, Mycobacterium
LAIITVLGLIVAYIFRPAG

SEQ ID NO: 315150 - protein, 17 aa, Mycobacterium
LAILGDGFTHWAELLGL

SEQ ID NO: 315151 - protein, 22 aa, Mycobacterium
LAILLCLVLGVAIVTQVRQTES

SEQ ID NO: 315152 - protein, 21 aa, Mycobacterium
LAILYCFAFLLLATLGAGAWS

SEQ ID NO: 315153 - protein, 20 aa, Mycobacterium
LAIPLSFLVLVWVFGGLVAA

SEQ ID NO: 315154 - protein, 17 aa, Mycobacterium
LAIPLVISIATERAARG

SEQ ID NO: 315155 - protein, 20 aa, Mycobacterium
LAISGVAVWQGVRSWQGHDC

SEQ ID NO: 315156 - protein, 23 aa, Mycobacterium
LAISLKYKFGYDDSLDVVGVHLV

SEQ ID NO: 315157 - protein, 25 aa, Mycobacterium
LAISPRITIALARLSPSRPAVDDEE

SEQ ID NO: 315158 - protein, 30 aa, Mycobacterium
LAITFLHFAKLPAMLFGVGRYTVTMELTKS

SEQ ID NO: 315159 - protein, 18 aa, Mycobacterium
LAITGMVAAAAWTIGSNL

SEQ ID NO: 315160 - protein, 17 aa, Mycobacterium
LAITPVKCEAWNPDTGK

SEQ ID NO: 315161 - protein, 18 aa, Mycobacterium
LAIWAQVMIGLWVALGGV

SEQ ID NO: 315162 - protein, 18 aa, Mycobacterium
LAKAGFRAEDATSPDSDV

SEQ ID NO: 315163 - protein, 28 aa, Mycobacterium
LAKDAKDRFDTCHDFAVALAEANKGDES

SEQ ID NO: 315164 - protein, 28 aa, Mycobacterium
LAKGRRTVWIPWALGPAAAVMRLLPAFV

SEQ ID NO: 315165 - protein, 24 aa, Mycobacterium
LAKHPRLPRYDALKVLSASVSTDS

SEQ ID NO: 315166 - protein, 20 aa, Mycobacterium
LAKHQKLEFDSTVNYPLDRQ

SEQ ID NO: 315167 - protein, 19 aa, Mycobacterium
LAKKLPRRALTVLKAESLI

SEQ ID NO: 315168 - protein, 19 aa, Mycobacterium
LAKKLPRRSVTVLKAESLI

SEQ ID NO: 315169 - protein, 17 aa, Mycobacterium
LAKLPHDRIPVLYCKTG

SEQ ID NO: 315170 - protein, 20 aa, Mycobacterium
LAKRLPRRTLTVLKGESLIN

SEQ ID NO: 315171 - protein, 24 aa, Mycobacterium
LAKSAVFCAFAILQSAIVTAIVVA

SEQ ID NO: 315172 - protein, 25 aa, Mycobacterium
LAKVMAVPMAKRFAPAIAAVAAAGL

SEQ ID NO: 315173 - protein, 17 aa, Mycobacterium
LALAAALAREPALLIAD

SEQ ID NO: 315174 - protein, 19 aa, Mycobacterium
LALAARARRRFTRATVGGV

SEQ ID NO: 315175 - protein, 20 aa, Mycobacterium
LALAAVMPRSFHFVAAEVLE

SEQ ID NO: 315176 - protein, 24 aa, Mycobacterium
LALAEGYALAGARVVVASRKADAC

SEQ ID NO: 315177 - protein, 17 aa, Mycobacterium
LALAGSMTWEILWALIL

SEQ ID NO: 315178 - protein, 19 aa, Mycobacterium
LALAIAMTGWRVLRAKVEA

SEQ ID NO: 315179 - protein, 25 aa, Mycobacterium
LALALALLAGFLKWQCSSAPDSTGR

SEQ ID NO: 315180 - protein, 32 aa, Mycobacterium
LALALVVCTVLWPPVRWLRNKGVPPAAAVLVV

SEQ ID NO: 315181 - protein, 17 aa, Mycobacterium
LALAPGWFGVLAAIQVA

SEQ ID NO: 315182 - protein, 17 aa, Mycobacterium
LALASWLLAGYIGAAVA

SEQ ID NO: 315183 - protein, 25 aa, Mycobacterium
LALATVGGFLIDLAVRTSRNATELL

SEQ ID NO: 315184 - protein, 21 aa, Mycobacterium
LALAVRYVLHRAIDRLVQGAR

SEQ ID NO: 315185 - protein, 17 aa, Mycobacterium
LALCGAILQSLLRNPLA

SEQ ID NO: 315186 - protein, 24 aa, Mycobacterium
LALCVSFPPFGWWYIAILAFAVLG

SEQ ID NO: 315187 - protein, 17 aa, Mycobacterium
LALDLVGTFAFGLNGAL

SEQ ID NO: 315188 - protein, 21 aa, Mycobacterium
LALEPVRLVLRRWTRPAPPPT

SEQ ID NO: 315189 - protein, 17 aa, Mycobacterium
LALFAGGVLVNSDLSAL

SEQ ID NO: 315190 - protein, 20 aa, Mycobacterium
LALFALVFAGLWLILTKARK

SEQ ID NO: 315191 - protein, 26 aa, Mycobacterium
LALFGAEIALGFALTAPVVGAVAATA

SEQ ID NO: 315192 - protein, 17 aa, Mycobacterium
LALFIDWLARVVEIIAA

SEQ ID NO: 315193 - protein, 21 aa, Mycobacterium
LALFIGALIIWMLLKPLQTRP

SEQ ID NO: 315194 - protein, 24 aa, Mycobacterium
LALFKAVIFGAIVAVVSAQKGLST

SEQ ID NO: 315195 - protein, 19 aa, Mycobacterium
LALFLVYPMGYLVALALTK

SEQ ID NO: 315196 - protein, 25 aa, Mycobacterium
LALFSVVGLVFFLAHLVAEIRVETM

SEQ ID NO: 315197 - protein, 18 aa, Mycobacterium
LALFVNWLRVLVAHRYEG

SEQ ID NO: 315198 - protein, 17 aa, Mycobacterium
LALGSYWGLVIVPPSVL

SEQ ID NO: 315199 - protein, 17 aa, Mycobacterium
LALGVGVGVGMLEHHLT

SEQ ID NO: 315200 - protein, 22 aa, Mycobacterium
LALGWWQWTRFQSVSGSFQNLG

SEQ ID NO: 315201 - protein, 22 aa, Mycobacterium
LALGWWQWTRFQSVSGTFQNLG

SEQ ID NO: 315202 - protein, 23 aa, Mycobacterium
LALGWWQWTRFQSVSGTFQNLGY

SEQ ID NO: 315203 - protein, 25 aa, Mycobacterium
LALHPRLPRRDVIKVLAEAVTADPE

SEQ ID NO: 315204 - protein, 17 aa, Mycobacterium
LALIAIPVNFNYWVFAL

SEQ ID NO: 315205 - protein, 18 aa, Mycobacterium
LALIEELVAWGGGRLRQP

SEQ ID NO: 315206 - protein, 17 aa, Mycobacterium
LALILKYTIGLRLGAEE

SEQ ID NO: 315207 - protein, 17 aa, Mycobacterium
LALILKYTIGLRLNPEA

SEQ ID NO: 315208 - protein, 19 aa, Mycobacterium
LALILKYTIGLRVGVEEES

SEQ ID NO: 315209 - protein, 25 aa, Mycobacterium
LALILLCAFVFRRVFGRHARAAFVV

SEQ ID NO: 315210 - protein, 26 aa, Mycobacterium
LALINPTWFAWLIVTWLWLTVLFANL

SEQ ID NO: 315211 - protein, 17 aa, Mycobacterium
LALIPVFVYVMLIAHIH

SEQ ID NO: 315212 - protein, 18 aa, Mycobacterium
LALIPVFVYVMLIAPAHG

SEQ ID NO: 315213 - protein, 17 aa, Mycobacterium
LALIVLAVIALVIGALG

SEQ ID NO: 315214 - protein, 19 aa, Mycobacterium
LALLAGLYFFSYRPDREVD

SEQ ID NO: 315215 - protein, 24 aa, Mycobacterium
LALLANLFVPWGIAGADPSLIGIA

SEQ ID NO: 315216 - protein, 17 aa, Mycobacterium
LALLASVSTMVFGAYPW

SEQ ID NO: 315217 - protein, 17 aa, Mycobacterium
LALLAWIALRRRNQCSL

SEQ ID NO: 315218 - protein, 25 aa, Mycobacterium
LALLIVVAVGAVFLGSKLWHSMSGS

SEQ ID NO: 315219 - protein, 18 aa, Mycobacterium
LALLLATLWWLVALTQLR

SEQ ID NO: 315220 - protein, 27 aa, Mycobacterium
LALLLIRAAGWQLSRLVSHPRIDKLDA

SEQ ID NO: 315221 - protein, 21 aa, Mycobacterium
LALLLPWNLQFGVGVPGSDGS

SEQ ID NO: 315222 - protein, 20 aa, Mycobacterium
LALLLVFLFWPWEYKPSGDK

SEQ ID NO: 315223 - protein, 42 aa, Mycobacterium
LALLPILACLALLPARGRTTLPPVAPWCAGPAAGVAVLAALT

SEQ ID NO: 315224 - protein, 24 aa, Mycobacterium
LALLPLLLVLAFVPVRAGAAAGAA

SEQ ID NO: 315225 - protein, 20 aa, Mycobacterium
LALLYWQWRTMPTVIWDVRM

SEQ ID NO: 315226 - protein, 29 aa, Mycobacterium
LALMFGFYVTCFVFVFGVLGVLMRAVAGV

SEQ ID NO: 315227 - protein, 18 aa, Mycobacterium
LALMGRAQHRDDLRAARD

SEQ ID NO: 315228 - protein, 18 aa, Mycobacterium
LALMIWTNVLFDRVGEGT

SEQ ID NO: 315229 - protein, 20 aa, Mycobacterium
LALMTRRWTLAWVALAGSAL

SEQ ID NO: 315230 - protein, 19 aa, Mycobacterium
LALNRRAASSQGHRIGTVT

SEQ ID NO: 315231 - protein, 35 aa, Mycobacterium
LALNTRLRIPVVIGELLAGIVIGRTGFGWIDAFDP

SEQ ID NO: 315232 - protein, 24 aa, Mycobacterium
LALPAHATAAVAIVQVVIRLAVCW

SEQ ID NO: 315233 - protein, 24 aa, Mycobacterium
LALPDRLWRLGVGGGGTFEEVAVR

SEQ ID NO: 315234 - protein, 26 aa, Mycobacterium
LALPFLFWVWMRHLRDDRGYRPPRAF

SEQ ID NO: 315235 - protein, 19 aa, Mycobacterium
LALPFLVWIWMRRLASDHV

SEQ ID NO: 315236 - protein, 22 aa, Mycobacterium
LALPGLAGILLLTGAGGLLGYR

SEQ ID NO: 315237 - protein, 23 aa, Mycobacterium
LALPLSRYPRLSGFTEANDAYLQ

SEQ ID NO: 315238 - protein, 25 aa, Mycobacterium
LALPMLCFPQVLFGGAIVPVDQMAA

SEQ ID NO: 315239 - protein, 24 aa, Mycobacterium
LALPSFLITLAFTFLYGAAGAVNA

SEQ ID NO: 315240 - protein, 18 aa, Mycobacterium
LALRGRFTPAPQHNSPAA

SEQ ID NO: 315241 - protein, 18 aa, Mycobacterium
LALRHHLLKQLDGQLSGA

SEQ ID NO: 315242 - protein, 28 aa, Mycobacterium
LALRREVWIRYAAAVVFSGLAGITTAAL

SEQ ID NO: 315243 - protein, 17 aa, Mycobacterium
LALRTVFTIAPIVFGLD

SEQ ID NO: 315244 - protein, 18 aa, Mycobacterium
LALSGFGALVADARPGDT

SEQ ID NO: 315245 - protein, 17 aa, Mycobacterium
LALSGFVERVADNEPLI

SEQ ID NO: 315246 - protein, 18 aa, Mycobacterium
LALSRPVGLAVVGLVSVL

SEQ ID NO: 315247 - protein, 25 aa, Mycobacterium
LALSRRPATSQGRRIGTVTTMRDST

SEQ ID NO: 315248 - protein, 24 aa, Mycobacterium
LALSWARLTTVFVIDLLILIVASH

SEQ ID NO: 315249 - protein, 19 aa, Mycobacterium
LALTAVFAPFALYAYKRRT

SEQ ID NO: 315250 - protein, 19 aa, Mycobacterium
LALTGLVATAAWTIGSNLN

SEQ ID NO: 315251 - protein, 19 aa, Mycobacterium
LALVAGFVGWKLYQKLTNN

SEQ ID NO: 315252 - protein, 17 aa, Mycobacterium
LALVAMVMIHFSLPGRM

SEQ ID NO: 315253 - protein, 20 aa, Mycobacterium
LALVGYVAVDAWRGEVTAAR

SEQ ID NO: 315254 - protein, 17 aa, Mycobacterium
LALVLFLGHLVRQIRIE

SEQ ID NO: 315255 - protein, 25 aa, Mycobacterium
LALVYFRLRMMRFFFDGENNQLTLS

SEQ ID NO: 315256 - protein, 22 aa, Mycobacterium
LALWRLDRLDGRRMHRLIPTRW

SEQ ID NO: 315257 - protein, 17 aa, Mycobacterium
LALYLLFVFTQTVRHRD

SEQ ID NO: 315258 - protein, 17 aa, Mycobacterium
LALYPGDKVLIMGVRVG

SEQ ID NO: 315259 - protein, 24 aa, Mycobacterium
LALYRSGVGLERIFDALIGGAVAI

SEQ ID NO: 315260 - protein, 18 aa, Mycobacterium
LALYVVASLLIWTQARLL

SEQ ID NO: 315261 - protein, 18 aa, Mycobacterium
LAMAEGFTGYSLPDDLLS

SEQ ID NO: 315262 - protein, 23 aa, Mycobacterium
LAMAMAALGWLPPAAGALLQEGI

SEQ ID NO: 315263 - protein, 19 aa, Mycobacterium
LAMFEGFFGYSLPDDLLSG

SEQ ID NO: 315264 - protein, 22 aa, Mycobacterium
LAMGSIARWTMGRARHRWPTLG

SEQ ID NO: 315265 - protein, 17 aa, Mycobacterium
LAMMVFSKSFSVLRSAV

SEQ ID NO: 315266 - protein, 18 aa, Mycobacterium
LAMMVFSKSFSVLRSAVT

SEQ ID NO: 315267 - protein, 17 aa, Mycobacterium
LAMMVLSKSFSVLRSAM

SEQ ID NO: 315268 - protein, 17 aa, Mycobacterium
LAMPSILVGWRYAAGTA

SEQ ID NO: 315269 - protein, 17 aa, Mycobacterium
LAMRTIRFELPMMAVAA

SEQ ID NO: 315270 - protein, 30 aa, Mycobacterium
LAMSVLGWHYLRLPSVVGMGQYSLEVDLPT

SEQ ID NO: 315271 - protein, 19 aa, Mycobacterium
LAMVCLMTAVSAPMWLLMQ

SEQ ID NO: 315272 - protein, 19 aa, Mycobacterium
LAMVFPVIGAFPFNGHFTV

SEQ ID NO: 315273 - protein, 17 aa, Mycobacterium
LAMWYPPYRPGRANYML

SEQ ID NO: 315274 - protein, 30 aa, Mycobacterium
LANDMGWNFSAAKDMFGWINPVLAALQGNP

SEQ ID NO: 315275 - protein, 19 aa, Mycobacterium
LANFGRIGVIYNKSLEHAL

SEQ ID NO: 315276 - protein, 24 aa, Mycobacterium
LANFGRIGVIYSKSLEQALVIFPA

SEQ ID NO: 315277 - protein, 19 aa, Mycobacterium
LANGLGFLAGATVGYYLLR

SEQ ID NO: 315278 - protein, 18 aa, Mycobacterium
LANHLVDQGCDGLVVSGT

SEQ ID NO: 315279 - protein, 17 aa, Mycobacterium
LANIRRRPERFVLAVLG

SEQ ID NO: 315280 - protein, 20 aa, Mycobacterium
LANKPPWYRSLFVQLLVAIV

SEQ ID NO: 315281 - protein, 23 aa, Mycobacterium
LANLPHPWFDAIGISDRAADAIM

SEQ ID NO: 315282 - protein, 27 aa, Mycobacterium
LANPGLPLWLFVLCAALTGLGGGNYAA

SEQ ID NO: 315283 - protein, 19 aa, Mycobacterium
LANQARRLLAWVDQRPALA

SEQ ID NO: 315284 - protein, 20 aa, Mycobacterium
LANRCAIRAALIRTADEQHR

SEQ ID NO: 315285 - protein, 25 aa, Mycobacterium
LANRLAWAVEAWPAATRIAKSPLSF

SEQ ID NO: 315286 - protein, 25 aa, Mycobacterium
LANRRLLARIWRFAARHHRRLAVFF

SEQ ID NO: 315287 - protein, 17 aa, Mycobacterium
LANRRWVSPVLLVVGIC

SEQ ID NO: 315288 - protein, 17 aa, Mycobacterium
LAPAENWVDLMLAPKQV

SEQ ID NO: 315289 - protein, 25 aa, Mycobacterium
LAPAIAPVALWLNRNLGFIPLFADS

SEQ ID NO: 315290 - protein, 17 aa, Mycobacterium
LAPARTWTGLVYGQLVM

SEQ ID NO: 315291 - protein, 18 aa, Mycobacterium
LAPASGQGRAFGTYGSYK

SEQ ID NO: 315292 - protein, 27 aa, Mycobacterium
LAPDAMPYRGRYRFHGVELVPASVVLH

SEQ ID NO: 315293 - protein, 17 aa, Mycobacterium
LAPEPGIADIPGLVADF

SEQ ID NO: 315294 - protein, 25 aa, Mycobacterium
LAPFSGTDLTGWIDWVVRGSHELFA

SEQ ID NO: 315295 - protein, 25 aa, Mycobacterium
LAPGIKAKAAFVWDKFPKFVLGFLA

SEQ ID NO: 315296 - protein, 26 aa, Mycobacterium
LAPHRGRWFIRHIIDLLIVALPMMRP

SEQ ID NO: 315297 - protein, 17 aa, Mycobacterium
LAPKFQLALEILDDRLS

SEQ ID NO: 315298 - protein, 42 aa, Mycobacterium
LAPKRLGMQYARRWAGLVAPLLRFLAIVTKPVIWGLGQSTDI

SEQ ID NO: 315299 - protein, 22 aa, Mycobacterium
LAPKRWRLAGIGIGIVAGIKLT

SEQ ID NO: 315300 - protein, 18 aa, Mycobacterium
LAPLAASVAVVFVIIFRD

SEQ ID NO: 315301 - protein, 21 aa, Mycobacterium
LAPLRRALALLGREQVADTDD

SEQ ID NO: 315302 - protein, 19 aa, Mycobacterium
LAPLRRVAQTASRVADLPL

SEQ ID NO: 315303 - protein, 27 aa, Mycobacterium
LAPMGRRLGALCIDWLVAYGLALLGLG

SEQ ID NO: 315304 - protein, 22 aa, Mycobacterium
LAPMPSGTYCKIPQDTPANAVR

SEQ ID NO: 315305 - protein, 17 aa, Mycobacterium
LAPNIFAPLGILVAHIY

SEQ ID NO: 315306 - protein, 18 aa, Mycobacterium
LAPPEVLGVPMLIVATVG

SEQ ID NO: 315307 - protein, 25 aa, Mycobacterium
LAPPPAMPPTLAWWASSLQLSGLSA

SEQ ID NO: 315308 - protein, 25 aa, Mycobacterium
LAPQLRPIATWLNRSMGWCFLFADG

SEQ ID NO: 315309 - protein, 24 aa, Mycobacterium
LAPRAPARRALLLLHLSEFDEITG

SEQ ID NO: 315310 - protein, 23 aa, Mycobacterium
LAPRGVPVLNHIRVPALGAGLTL

SEQ ID NO: 315311 - protein, 27 aa, Mycobacterium
LAPRGWVAICALAMAVASHEVVRRLRE

SEQ ID NO: 315312 - protein, 18 aa, Mycobacterium
LAPRLGAWNAGLAAVGAY

SEQ ID NO: 315313 - protein, 20 aa, Mycobacterium
LAPRLRLAALTGALGVLAVT

SEQ ID NO: 315314 - protein, 17 aa, Mycobacterium
LAPSGAPPRLISDTEAA

SEQ ID NO: 315315 - protein, 25 aa, Mycobacterium
LAPSGFSLFGVFWGAFGLVTGAAFG

SEQ ID NO: 315316 - protein, 25 aa, Mycobacterium
LAPSGFSVFGVFWGAFGLVAGAAFG

SEQ ID NO: 315317 - protein, 25 aa, Mycobacterium
LAPSGFSVFGVFWGAFGLVSGAAFG

SEQ ID NO: 315318 - protein, 25 aa, Mycobacterium
LAPSGFSVFGVFWGAFGLVSGAANG

SEQ ID NO: 315319 - protein, 25 aa, Mycobacterium
LAPTKRAGRRWGSYNIFTLWANDVH

SEQ ID NO: 315320 - protein, 17 aa, Mycobacterium
LAPTLQWFVPGHPPTKA

SEQ ID NO: 315321 - protein, 19 aa, Mycobacterium
LAPTLWGWRRTPVLRWFVL

SEQ ID NO: 315322 - protein, 30 aa, Mycobacterium
LAPTTSWYVIRWVIASALAGPLLMTAISLA

SEQ ID NO: 315323 - protein, 29 aa, Mycobacterium
LAPTVWGWRNRPVWRWFVLGSAVGVVGGW

SEQ ID NO: 315324 - protein, 20 aa, Mycobacterium
LAPVAFVVGVAFNRIMAAAR

SEQ ID NO: 315325 - protein, 35 aa, Mycobacterium
LAPYWGNAHSLGLHAVVSCPIGLATRVLAQSGSLL

SEQ ID NO: 315326 - protein, 25 aa, Mycobacterium
LAQAFSIQLICRILGMLASVVSVML

SEQ ID NO: 315327 - protein, 24 aa, Mycobacterium
LAQALGWRTAFVVMGAISVLFVPV

SEQ ID NO: 315328 - protein, 18 aa, Mycobacterium
LAQGFTGFRRLRALFTQR

SEQ ID NO: 315329 - protein, 25 aa, Mycobacterium
LAQGGMVLRGFVERVGDRSPLVAAD

SEQ ID NO: 315330 - protein, 24 aa, Mycobacterium
LAQHPRLPRHDALKVLSLAATADQ

SEQ ID NO: 315331 - protein, 19 aa, Mycobacterium
LAQHPRLPRQDALKVLRPE

SEQ ID NO: 315332 - protein, 25 aa, Mycobacterium
LAQHPRLPRRDALKVLPAAVSADVE

SEQ ID NO: 315333 - protein, 27 aa, Mycobacterium
LAQHPRLPRRDALKVLPPDVSADTAFR

SEQ ID NO: 315334 - protein, 20 aa, Mycobacterium
LAQKERWLPELMTLEKVAAW

SEQ ID NO: 315335 - protein, 18 aa, Mycobacterium
LAQLPDRYPLKGIFHAAG

SEQ ID NO: 315336 - protein, 20 aa, Mycobacterium
LAQLPLRRGILIGAAQILAL

SEQ ID NO: 315337 - protein, 18 aa, Mycobacterium
LAQLRSWRDQGMNLTVAV

SEQ ID NO: 315338 - protein, 27 aa, Mycobacterium
LAQLTVRGWLALVLWIMGATVLLGAVV

SEQ ID NO: 315339 - protein, 18 aa, Mycobacterium
LAQLWPYASGTMRCPQGR

SEQ ID NO: 315340 - protein, 22 aa, Mycobacterium
LAQNRIRTWSNWFDNNTRSARH

SEQ ID NO: 315341 - protein, 18 aa, Mycobacterium
LAQPAKRRSWLAVGAGAF

SEQ ID NO: 315342 - protein, 19 aa, Mycobacterium
LAQRFGAAVGLPYTADPSE

SEQ ID NO: 315343 - protein, 19 aa, Mycobacterium
LAQRWAKVSAVLFAIGAVS

SEQ ID NO: 315344 - protein, 20 aa, Mycobacterium
LAQRYHRDSLVIARNDATAL

SEQ ID NO: 315345 - protein, 21 aa, Mycobacterium
LAQSLGWRTAFVIMGAVSVVL

SEQ ID NO: 315346 - protein, 18 aa, Mycobacterium
LAQVRARSLAAYENQDVP

SEQ ID NO: 315347 - protein, 19 aa, Mycobacterium
LAQVRARSLGAFENQDVPF

SEQ ID NO: 315348 - protein, 23 aa, Mycobacterium
LARARADLVDGFRRHELWLHLGW

SEQ ID NO: 315349 - protein, 26 aa, Mycobacterium
LARDLRLNRDVAIKVLRADLARDPSF

SEQ ID NO: 315350 - protein, 22 aa, Mycobacterium
LARDPRKPMLVLAAIGLTGFSL

SEQ ID NO: 315351 - protein, 22 aa, Mycobacterium
LARDPRKPVLVLAAIGLCGFAV

SEQ ID NO: 315352 - protein, 22 aa, Mycobacterium
LARDPRKPVLVLAATGLCGFAL

SEQ ID NO: 315353 - protein, 26 aa, Mycobacterium
LARELGRPEFLWVLLTVIGMLSAAAL

SEQ ID NO: 315354 - protein, 19 aa, Mycobacterium
LAREPKRLILIVLGAAGTT

SEQ ID NO: 315355 - protein, 29 aa, Mycobacterium
LARERGWEIRDFRTARKAARIGVPSALAL

SEQ ID NO: 315356 - protein, 24 aa, Mycobacterium
LARFDHKRHVPPYALLAAVIVPAS

SEQ ID NO: 315357 - protein, 25 aa, Mycobacterium
LARFDHKRHVPPYSLLIAVIIPAVL

SEQ ID NO: 315358 - protein, 25 aa, Mycobacterium
LARGGYPSLYSWMVGLIVTELPLQT

SEQ ID NO: 315359 - protein, 19 aa, Mycobacterium
LARHPRLPRQDALKILPTS

SEQ ID NO: 315360 - protein, 19 aa, Mycobacterium
LARHPRLPRQDALKVLRPE

SEQ ID NO: 315361 - protein, 19 aa, Mycobacterium
LARLCFAPVSGQLVQRLGE

SEQ ID NO: 315362 - protein, 18 aa, Mycobacterium
LARLNPFLFFLLAATATL

SEQ ID NO: 315363 - protein, 32 aa, Mycobacterium
LARLRDSFFDWEMYRRAIPVLLTTGLPNTLIL

SEQ ID NO: 315364 - protein, 22 aa, Mycobacterium
LARNPRKPVLVLAAIGLIGYSV

SEQ ID NO: 315365 - protein, 20 aa, Mycobacterium
LARNRCSSLRVELQEDVAVL

SEQ ID NO: 315366 - protein, 23 aa, Mycobacterium
LARPNAAWDRPRVVYLQHASDPI

SEQ ID NO: 315367 - protein, 28 aa, Mycobacterium
LARQRGWEVRDFRTARKAARIGVPSALA

SEQ ID NO: 315368 - protein, 23 aa, Mycobacterium
LARRARRVVAANLTIAATFIAVL

SEQ ID NO: 315369 - protein, 23 aa, Mycobacterium
LARRARRVVIANLVMAGAAITTL

SEQ ID NO: 315370 - protein, 27 aa, Mycobacterium
LARRGIRAVQLIFAWMVLSVRLLVARP

SEQ ID NO: 315371 - protein, 23 aa, Mycobacterium
LARRLPAVIATVILLLLACAPVA

SEQ ID NO: 315372 - protein, 21 aa, Mycobacterium
LARRPELRALLRDNPKQIRVF

SEQ ID NO: 315373 - protein, 18 aa, Mycobacterium
LARRRPDGGAARAIAPWY

SEQ ID NO: 315374 - protein, 17 aa, Mycobacterium
LARRRTAFFVPLLGCVA

SEQ ID NO: 315375 - protein, 17 aa, Mycobacterium
LARRTRRRVNIGFVAGG

SEQ ID NO: 315376 - protein, 21 aa, Mycobacterium
LARSRALRMPYYRTLSTVAYW

SEQ ID NO: 315377 - protein, 21 aa, Mycobacterium
LARSRARAVRLLRPLILLPLV

SEQ ID NO: 315378 - protein, 25 aa, Mycobacterium
LARSRARLMRLMRPLILLPLVLPPV

SEQ ID NO: 315379 - protein, 25 aa, Mycobacterium
LARSRARLVRLLRPLILLPLVLPPV

SEQ ID NO: 315380 - protein, 21 aa, Mycobacterium
LARSRVLRMPFYRTLISVGSW

SEQ ID NO: 315381 - protein, 20 aa, Mycobacterium
LARSWPRSLAGQAIALQVIV

SEQ ID NO: 315382 - protein, 18 aa, Mycobacterium
LARTATRMAVPAGSDVIR

SEQ ID NO: 315383 - protein, 23 aa, Mycobacterium
LARTVCVAVDPDLLVTVNEMTQN

SEQ ID NO: 315384 - protein, 21 aa, Mycobacterium
LARWLPRRTSAAIVVAGVGGA

SEQ ID NO: 315385 - protein, 19 aa, Mycobacterium
LASAAAWKSLSGEYASAAA

SEQ ID NO: 315386 - protein, 17 aa, Mycobacterium
LASAATVAFAFLAMVFA

SEQ ID NO: 315387 - protein, 26 aa, Mycobacterium
LASAFAFGCSGPFAKALMTAGWSPTA

SEQ ID NO: 315388 - protein, 21 aa, Mycobacterium
LASAGLSWVLGVALVLMVVAF

SEQ ID NO: 315389 - protein, 18 aa, Mycobacterium
LASALCIGTGGSVGREGP

SEQ ID NO: 315390 - protein, 19 aa, Mycobacterium
LASDSTLARVVRLVAEAQT

SEQ ID NO: 315391 - protein, 18 aa, Mycobacterium
LASELGISDVRAELLPED

SEQ ID NO: 315392 - protein, 26 aa, Mycobacterium
LASELRRLPVDFGIGISAGPVFAGNI

SEQ ID NO: 315393 - protein, 18 aa, Mycobacterium
LASFDRWQRPPILPPGED

SEQ ID NO: 315394 - protein, 18 aa, Mycobacterium
LASFKVTLTISIIVTLVN

SEQ ID NO: 315395 - protein, 19 aa, Mycobacterium
LASFSYLGALVWARYLERG

SEQ ID NO: 315396 - protein, 31 aa, Mycobacterium
LASFVFLALVLRRGMGLGVAYGIWGASGVAM

SEQ ID NO: 315397 - protein, 21 aa, Mycobacterium
LASGDHSLTYVIEAPPVFFAR

SEQ ID NO: 315398 - protein, 21 aa, Mycobacterium
LASGDIVYWLWVPDGQSPSLA

SEQ ID NO: 315399 - protein, 18 aa, Mycobacterium
LASGPYFKVMLANLAPYW

SEQ ID NO: 315400 - protein, 24 aa, Mycobacterium
LASGPYFKVMLVNLIPPTILQPFV

SEQ ID NO: 315401 - protein, 20 aa, Mycobacterium
LASGVMVRTVLAWMLGSGVP

SEQ ID NO: 315402 - protein, 29 aa, Mycobacterium
LASIGLGVAHPWRLLGLVMLPLIAKAARP

SEQ ID NO: 315403 - protein, 23 aa, Mycobacterium
LASILMLYTIVIVRGMRTAIATR

SEQ ID NO: 315404 - protein, 31 aa, Mycobacterium
LASLLFAGGLVPLVGTWGFDQIAWFVPAHWG

SEQ ID NO: 315405 - protein, 23 aa, Mycobacterium
LASLLLAAGLSWAAIEFTHITGL

SEQ ID NO: 315406 - protein, 25 aa, Mycobacterium
LASLNIIAMIWARLTLYGTSGSARV

SEQ ID NO: 315407 - protein, 22 aa, Mycobacterium
LASLRTSLGILFDADLEQRPAL

SEQ ID NO: 315408 - protein, 17 aa, Mycobacterium
LASLVLIAAGAILDAAE

SEQ ID NO: 315409 - protein, 23 aa, Mycobacterium
LASLWSEGARCMALEDRAEREKA

SEQ ID NO: 315410 - protein, 19 aa, Mycobacterium
LASMTMVWLSVLLYVKVGQ

SEQ ID NO: 315411 - protein, 25 aa, Mycobacterium
LASNEFRHPIAWARATLDGVDALLL

SEQ ID NO: 315412 - protein, 17 aa, Mycobacterium
LASNIALLVAFRAVQGF

SEQ ID NO: 315413 - protein, 20 aa, Mycobacterium
LASPFAFSGLSFFHTIEYQM

SEQ ID NO: 315414 - protein, 18 aa, Mycobacterium
LASPMLELIVPVVEAAAQ

SEQ ID NO: 315415 - protein, 18 aa, Mycobacterium
LASPRADARIGLRGAVVL

SEQ ID NO: 315416 - protein, 23 aa, Mycobacterium
LASRLVGWTSGWLMLTASIVTIS

SEQ ID NO: 315417 - protein, 17 aa, Mycobacterium
LASSVFGALLLLPPTRA

SEQ ID NO: 315418 - protein, 17 aa, Mycobacterium
LASTRVAAGVIVVIPLY

SEQ ID NO: 315419 - protein, 18 aa, Mycobacterium
LASVISWIIVVLVVVLTT

SEQ ID NO: 315420 - protein, 17 aa, Mycobacterium
LASVKWGLKDDGLACIA

SEQ ID NO: 315421 - protein, 17 aa, Mycobacterium
LASVVGRYARTTAALSV

SEQ ID NO: 315422 - protein, 23 aa, Mycobacterium
LASWAVVIVLFWLNRMFVSRRPQ

SEQ ID NO: 315423 - protein, 25 aa, Mycobacterium
LASWPHDRLPEFDIYSPRKAAKKTA

SEQ ID NO: 315424 - protein, 26 aa, Mycobacterium
LASWQARAGAFAIDMLPGAGIIVTLA

SEQ ID NO: 315425 - protein, 25 aa, Mycobacterium
LASYRGVPIVGIILVVLTLVYAFMM

SEQ ID NO: 315426 - protein, 18 aa, Mycobacterium
LATAFSLNGVDWAAKVIS

SEQ ID NO: 315427 - protein, 19 aa, Mycobacterium
LATAIAVAVRPTAAQQPVV

SEQ ID NO: 315428 - protein, 18 aa, Mycobacterium
LATALRLMPRWAWRRVKR

SEQ ID NO: 315429 - protein, 29 aa, Mycobacterium
LATFGRRAAKRSSYLHWGRGVEATQSKFW

SEQ ID NO: 315430 - protein, 18 aa, Mycobacterium
LATFTWFVGAGIGFAVYL

SEQ ID NO: 315431 - protein, 23 aa, Mycobacterium
LATGCLRVRASLTVSPDDLVSGE

SEQ ID NO: 315432 - protein, 27 aa, Mycobacterium
LATGVRRWKGHGAQWAMILSGAQSALV

SEQ ID NO: 315433 - protein, 21 aa, Mycobacterium
LATIAALYAFTGFESIANAAE

SEQ ID NO: 315434 - protein, 21 aa, Mycobacterium
LATIWLRTRLMPTWLVVLTYV

SEQ ID NO: 315435 - protein, 24 aa, Mycobacterium
LATLGSWRWIFIVNIPIGIVGFVL

SEQ ID NO: 315436 - protein, 23 aa, Mycobacterium
LATLKGVLLLAVPQSYAAFGESM

SEQ ID NO: 315437 - protein, 26 aa, Mycobacterium
LATLLFGAFANRWLARRTRRRVNIGF

SEQ ID NO: 315438 - protein, 22 aa, Mycobacterium
LATLSLVFAFVFAPAGAVLGHL

SEQ ID NO: 315439 - protein, 33 aa, Mycobacterium
LATLSVAFNLYWRLRYLFVTEVAFGSHDVAVIV

SEQ ID NO: 315440 - protein, 22 aa, Mycobacterium
LATLWGLGALYWAGGLVGFEPA

SEQ ID NO: 315441 - protein, 26 aa, Mycobacterium
LATMMTGGVSLAVWIAGVARELNLLA

SEQ ID NO: 315442 - protein, 26 aa, Mycobacterium
LATPIIRLGHMLVFFVRALLGIPVAI

SEQ ID NO: 315443 - protein, 20 aa, Mycobacterium
LATRALSFWLNPGVPTRITI

SEQ ID NO: 315444 - protein, 23 aa, Mycobacterium
LATRIGDRLVVLIGLLIAAGGFV

SEQ ID NO: 315445 - protein, 22 aa, Mycobacterium
LATRLHPVLFFLASVTATLPLA

SEQ ID NO: 315446 - protein, 19 aa, Mycobacterium
LATRLTMTVLIPVVAVMTV

SEQ ID NO: 315447 - protein, 26 aa, Mycobacterium
LATRVGFPSMLLFLLVGVIVGEDGFG

SEQ ID NO: 315448 - protein, 19 aa, Mycobacterium
LATSWGGIVYPWGSVTIVG

SEQ ID NO: 315449 - protein, 22 aa, Mycobacterium
LATTCALLAWYSLYRTPEAGAA

SEQ ID NO: 315450 - protein, 18 aa, Mycobacterium
LATTRWLVAILENHQQPD

SEQ ID NO: 315451 - protein, 18 aa, Mycobacterium
LATVIRPRLFSEPERENG

SEQ ID NO: 315452 - protein, 19 aa, Mycobacterium
LATWGVQGLVYFRAYRALH

SEQ ID NO: 315453 - protein, 22 aa, Mycobacterium
LATYGFQHVVAFYAGAVVVPII

SEQ ID NO: 315454 - protein, 18 aa, Mycobacterium
LAVAFGWISVGFQSTAVL

SEQ ID NO: 315455 - protein, 23 aa, Mycobacterium
LAVAFVAFVFWPNPTVPADQPNM

SEQ ID NO: 315456 - protein, 25 aa, Mycobacterium
LAVAGSMTWEILWALILGFALSAVV

SEQ ID NO: 315457 - protein, 20 aa, Mycobacterium
LAVAILFLLVRVVRAPIEAQ

SEQ ID NO: 315458 - protein, 23 aa, Mycobacterium
LAVALRTPWIAWLAVAFVIVALY

SEQ ID NO: 315459 - protein, 22 aa, Mycobacterium
LAVASAWCVGLLALFGVLAVRM

SEQ ID NO: 315460 - protein, 22 aa, Mycobacterium
LAVATAVVWTVALTRPAKVHEA

SEQ ID NO: 315461 - protein, 21 aa, Mycobacterium
LAVAVAVQWIANFVVTVTFPP

SEQ ID NO: 315462 - protein, 20 aa, Mycobacterium
LAVAVPAAWAQTHIIDRDGY

SEQ ID NO: 315463 - protein, 17 aa, Mycobacterium
LAVAVPAAWAQTTIIDE

SEQ ID NO: 315464 - protein, 17 aa, Mycobacterium
LAVAVVIGAAFTALVTK

SEQ ID NO: 315465 - protein, 18 aa, Mycobacterium
LAVAVVIGAAFTGLVTAF

SEQ ID NO: 315466 - protein, 18 aa, Mycobacterium
LAVAWPLAAALRAIPGQN

SEQ ID NO: 315467 - protein, 25 aa, Mycobacterium
LAVCLCPVAATFARPVSPPADPEHA

SEQ ID NO: 315468 - protein, 17 aa, Mycobacterium
LAVCPAAIIAAVTAGLL

SEQ ID NO: 315469 - protein, 24 aa, Mycobacterium
LAVCVLAVICLVAILVEESRQRRA

SEQ ID NO: 315470 - protein, 17 aa, Mycobacterium
LAVDIGFALSVVATAAL

SEQ ID NO: 315471 - protein, 18 aa, Mycobacterium
LAVDMGFALSVVATAGLV

SEQ ID NO: 315472 - protein, 23 aa, Mycobacterium
LAVDSWMCAISGRAKQFNMIPYF

SEQ ID NO: 315473 - protein, 24 aa, Mycobacterium
LAVFAICIYGGYFGAAAGVLLLAM

SEQ ID NO: 315474 - protein, 26 aa, Mycobacterium
LAVFFPWNLYFGFRIPGSSNYVLAVL

SEQ ID NO: 315475 - protein, 28 aa, Mycobacterium
LAVFRGFPWKQVIPFILAQVGGAFVAAL

SEQ ID NO: 315476 - protein, 29 aa, Mycobacterium
LAVGADSAWLLGVGRVFSGLALGLAMAVG

SEQ ID NO: 315477 - protein, 19 aa, Mycobacterium
LAVGAEWGGAALLSVEHAP

SEQ ID NO: 315478 - protein, 20 aa, Mycobacterium
LAVGFLGEIVRRCVVAAVGA

SEQ ID NO: 315479 - protein, 20 aa, Mycobacterium
LAVGGEWSGAALLSAEYSPS

SEQ ID NO: 315480 - protein, 19 aa, Mycobacterium
LAVGGGVTFTVLRSRRQRS

SEQ ID NO: 315481 - protein, 17 aa, Mycobacterium
LAVGMAYSAVVAAELFN

SEQ ID NO: 315482 - protein, 17 aa, Mycobacterium
LAVGMAYSSVVAAELFN

SEQ ID NO: 315483 - protein, 18 aa, Mycobacterium
LAVILAWLLIVVVTSRLL

SEQ ID NO: 315484 - protein, 18 aa, Mycobacterium
LAVIRRGVIPASWGGKVK

SEQ ID NO: 315485 - protein, 17 aa, Mycobacterium
LAVLIRYAGGRWWIPVV

SEQ ID NO: 315486 - protein, 24 aa, Mycobacterium
LAVLKAGAAYLAIDPVMPSARIDF

SEQ ID NO: 315487 - protein, 19 aa, Mycobacterium
LAVLLLIMRYRRRRRRAAD

SEQ ID NO: 315488 - protein, 17 aa, Mycobacterium
LAVLMLLPLSAFEAMTP

SEQ ID NO: 315489 - protein, 20 aa, Mycobacterium
LAVLMLLPLSAFEATTALPA

SEQ ID NO: 315490 - protein, 19 aa, Mycobacterium
LAVLRGRIASAYVSSIGMV

SEQ ID NO: 315491 - protein, 18 aa, Mycobacterium
LAVLRPGLPVVLMAVILY

SEQ ID NO: 315492 - protein, 18 aa, Mycobacterium
LAVLSVFAIIAFTAFHAG

SEQ ID NO: 315493 - protein, 18 aa, Mycobacterium
LAVLTIVVVIAFNTFGGG

SEQ ID NO: 315494 - protein, 18 aa, Mycobacterium
LAVLTIVVVIAFNTFGGT

SEQ ID NO: 315495 - protein, 27 aa, Mycobacterium
LAVLVVGLWWRYRYDKFGWTSRSSQIY

SEQ ID NO: 315496 - protein, 20 aa, Mycobacterium
LAVMCIRNFGNAVLLLAIWI

SEQ ID NO: 315497 - protein, 28 aa, Mycobacterium
LAVMIVACLWCARDLWRRGTPAVWCTVA

SEQ ID NO: 315498 - protein, 24 aa, Mycobacterium
LAVPDMPAAPLVFASKPAKTGDDA

SEQ ID NO: 315499 - protein, 24 aa, Mycobacterium
LAVPGLFALAALWLTRGGRIPDQR

SEQ ID NO: 315500 - protein, 19 aa, Mycobacterium
LAVPGRFGPAHIMLAAAGV

SEQ ID NO: 315501 - protein, 36 aa, Mycobacterium
LAVPGVYARLVLLWFLCSAFPIGVIATLVMLRSYGW

SEQ ID NO: 315502 - protein, 17 aa, Mycobacterium
LAVPLLVALFVIADEGH

SEQ ID NO: 315503 - protein, 26 aa, Mycobacterium
LAVPLRVGVAVTLVFVAGGVFGHRDV

SEQ ID NO: 315504 - protein, 24 aa, Mycobacterium
LAVPRTPPAPVIIKPGADAAAQFA

SEQ ID NO: 315505 - protein, 18 aa, Mycobacterium
LAVQCKRLSRPVGAGAVQ

SEQ ID NO: 315506 - protein, 20 aa, Mycobacterium
LAVRFVFYGVPFPGFGSLVS

SEQ ID NO: 315507 - protein, 21 aa, Mycobacterium
LAVRGVRNVPCETVPGKRAPT

SEQ ID NO: 315508 - protein, 17 aa, Mycobacterium
LAVRGWPLRGLAALLAM

SEQ ID NO: 315509 - protein, 20 aa, Mycobacterium
LAVRTWLFALSWMVIGVIVY

SEQ ID NO: 315510 - protein, 25 aa, Mycobacterium
LAVRVEPRVAVSGLRVSVVMVATPV

SEQ ID NO: 315511 - protein, 24 aa, Mycobacterium
LAVSAVAVLLAWIALYVRVSAPIN

SEQ ID NO: 315512 - protein, 29 aa, Mycobacterium
LAVSESVSWPGWAVVGVTLVFGLLIGAVT

SEQ ID NO: 315513 - protein, 17 aa, Mycobacterium
LAVSIYLDARPEPVFAR

SEQ ID NO: 315514 - protein, 18 aa, Mycobacterium
LAVSLGIGAGIGAIFGAP

SEQ ID NO: 315515 - protein, 21 aa, Mycobacterium
LAVSPLPNWLGDSLRAAAAGV

SEQ ID NO: 315516 - protein, 20 aa, Mycobacterium
LAVSVAFLLFYLVCLGETAT

SEQ ID NO: 315517 - protein, 17 aa, Mycobacterium
LAVSYLTTQTVVFLISG

SEQ ID NO: 315518 - protein, 31 aa, Mycobacterium
LAVTGFICHVGWEVSSEIGHRLLDGVDPGVV

SEQ ID NO: 315519 - protein, 19 aa, Mycobacterium
LAVTLEFLGPLTVAIAGSR

SEQ ID NO: 315520 - protein, 19 aa, Mycobacterium
LAVTLVWLYVEILRLLSYF

SEQ ID NO: 315521 - protein, 23 aa, Mycobacterium
LAVTVIALVYAWRQYLKAKERRA

SEQ ID NO: 315522 - protein, 17 aa, Mycobacterium
LAVTWWVIALLHLGRIS

SEQ ID NO: 315523 - protein, 19 aa, Mycobacterium
LAVVAAVCAFAFMNNLAEA

SEQ ID NO: 315524 - protein, 19 aa, Mycobacterium
LAVVAAVCAFAFMNNLSEA

SEQ ID NO: 315525 - protein, 19 aa, Mycobacterium
LAVVAAVCAFGFMNNLTEA

SEQ ID NO: 315526 - protein, 24 aa, Mycobacterium
LAVVAIGCAVGFPLLTTLALQTSS

SEQ ID NO: 315527 - protein, 24 aa, Mycobacterium
LAVVCLSIGLATEFALQRFLMHQL

SEQ ID NO: 315528 - protein, 24 aa, Mycobacterium
LAVVGVPVWAWVLWALVTVAAALL

SEQ ID NO: 315529 - protein, 17 aa, Mycobacterium
LAVVVVLAFARDRLAGP

SEQ ID NO: 315530 - protein, 17 aa, Mycobacterium
LAVVWVLRRKIFSRASR

SEQ ID NO: 315531 - protein, 20 aa, Mycobacterium
LAVVYALIGTIAMEFTTAQA

SEQ ID NO: 315532 - protein, 21 aa, Mycobacterium
LAVWVGLPLWLMAMLLMAALT

SEQ ID NO: 315533 - protein, 20 aa, Mycobacterium
LAWATALMVFFEWGVMVHEL

SEQ ID NO: 315534 - protein, 26 aa, Mycobacterium
LAWGGIREGHRWARNALLISGTVSFL

SEQ ID NO: 315535 - protein, 19 aa, Mycobacterium
LAWLTWRCTERRWARPASH

SEQ ID NO: 315536 - protein, 26 aa, Mycobacterium
LAWMTIDALVWVPRMLYLYGESNKGL

SEQ ID NO: 315537 - protein, 22 aa, Mycobacterium
LAWNGQIAWWLDMVVFGIYQVT

SEQ ID NO: 315538 - protein, 22 aa, Mycobacterium
LAWNGQIAWWLDMVVFGIYTGV

SEQ ID NO: 315539 - protein, 19 aa, Mycobacterium
LAWPADLKVGPDGLGNSPE

SEQ ID NO: 315540 - protein, 17 aa, Mycobacterium
LAWPSSRAQWQRWQPMA

SEQ ID NO: 315541 - protein, 25 aa, Mycobacterium
LAWQWRAHRGPGMVVALSTGMVTAA

SEQ ID NO: 315542 - protein, 22 aa, Mycobacterium
LAWRDSWEYWTDTLLHTDRIGS

SEQ ID NO: 315543 - protein, 20 aa, Mycobacterium
LAWTAPLLGWVWWVYTVAAV

SEQ ID NO: 315544 - protein, 19 aa, Mycobacterium
LAWTHHWVWTVPLMVLLVN

SEQ ID NO: 315545 - protein, 18 aa, Mycobacterium
LAWWLLDALWRPVRGRLA

SEQ ID NO: 315546 - protein, 22 aa, Mycobacterium
LAYATLKWARIDPEMYPELVSA

SEQ ID NO: 315547 - protein, 22 aa, Mycobacterium
LAYCLGLGIPFVLLALGSARAV

SEQ ID NO: 315548 - protein, 22 aa, Mycobacterium
LAYGLGLWWGVLRERNLRALKP

SEQ ID NO: 315549 - protein, 22 aa, Mycobacterium
LAYGVGLGSNWLVQRVGGRSAV

SEQ ID NO: 315550 - protein, 23 aa, Mycobacterium
LAYPIGRRLAAPSVTNPPPAALA

SEQ ID NO: 315551 - protein, 20 aa, Mycobacterium
LAYRTRPVFVPNNDNDPVAR

SEQ ID NO: 315552 - protein, 20 aa, Mycobacterium
LAYRTRPVFVPTAGPNDPVA

SEQ ID NO: 315553 - protein, 20 aa, Mycobacterium
LCAAAYAPYLAWLMQASTDT

SEQ ID NO: 315554 - protein, 18 aa, Mycobacterium
LCAAPVAAVGFVLALFLK

SEQ ID NO: 315555 - protein, 24 aa, Mycobacterium
LCAATLGVLGQRWYSGLGDQPARP

SEQ ID NO: 315556 - protein, 23 aa, Mycobacterium
LCACTEAVLFAWLIHALAHPTPP

SEQ ID NO: 315557 - protein, 23 aa, Mycobacterium
LCAEALGEFVDWSLLDVVNGVAG

SEQ ID NO: 315558 - protein, 26 aa, Mycobacterium
LCALAVGLKFKLGFDDSLDVVGVHLV

SEQ ID NO: 315559 - protein, 26 aa, Mycobacterium
LCALMAGVWFLHWPTRAESIAFSILS

SEQ ID NO: 315560 - protein, 18 aa, Mycobacterium
LCAPPLASAEPGFTPPDT

SEQ ID NO: 315561 - protein, 23 aa, Mycobacterium
LCAPTFAGLAARLGFSCDDAGGL

SEQ ID NO: 315562 - protein, 22 aa, Mycobacterium
LCASFPTLNWWWAAVIAAALLA

SEQ ID NO: 315563 - protein, 24 aa, Mycobacterium
LCASQLVGLGIMRYGLRSEPMHSM

SEQ ID NO: 315564 - protein, 24 aa, Mycobacterium
LCAVAPNIACLIIFRAVQGGGGGI

SEQ ID NO: 315565 - protein, 26 aa, Mycobacterium
LCAVAPNILLLILFRVVQGVGGGMLL

SEQ ID NO: 315566 - protein, 32 aa, Mycobacterium
LCAVLVRGLPGWPVWFALVWAAQEWLKSLVPF

SEQ ID NO: 315567 - protein, 19 aa, Mycobacterium
LCAVTAIISVIVPFAAGLA

SEQ ID NO: 315568 - protein, 17 aa, Mycobacterium
LCCGQRWLSNADPFEVY

SEQ ID NO: 315569 - protein, 18 aa, Mycobacterium
LCDARADVLAALRETLVE

SEQ ID NO: 315570 - protein, 17 aa, Mycobacterium
LCDHHGASLIVTVGHTA

SEQ ID NO: 315571 - protein, 19 aa, Mycobacterium
LCDHPRLYFSRNATPGRDE

SEQ ID NO: 315572 - protein, 21 aa, Mycobacterium
LCDRCLEGFPPTGAARAGNGH

SEQ ID NO: 315573 - protein, 20 aa, Mycobacterium
LCFLAALLPLARRTPVRVAA

SEQ ID NO: 315574 - protein, 28 aa, Mycobacterium
LCGQANWWPSASVESWFRQRFSRSKPDA

SEQ ID NO: 315575 - protein, 19 aa, Mycobacterium
LCGRFRVALELLGLARLML

SEQ ID NO: 315576 - protein, 23 aa, Mycobacterium
LCHLARRSLHHTVLCRDDVPRAI

SEQ ID NO: 315577 - protein, 19 aa, Mycobacterium
LCIAEPLGYFLASLATAVC

SEQ ID NO: 315578 - protein, 23 aa, Mycobacterium
LCIGWCAVNTWIVLDLVMALLGR

SEQ ID NO: 315579 - protein, 25 aa, Mycobacterium
LCILAGLVYVGWRLSRAASEKSRTR

SEQ ID NO: 315580 - protein, 17 aa, Mycobacterium
LCIRGPYVMQGYYKRSR

SEQ ID NO: 315581 - protein, 22 aa, Mycobacterium
LCIVPGLIFGFLAQFAIIAAVD

SEQ ID NO: 315582 - protein, 20 aa, Mycobacterium
LCIVPGLIVSIFALFTTVFI

SEQ ID NO: 315583 - protein, 21 aa, Mycobacterium
LCLACKGCTSDCPVDVDIPTY

SEQ ID NO: 315584 - protein, 20 aa, Mycobacterium
LCLAILLPLGMFLDGISMIL

SEQ ID NO: 315585 - protein, 26 aa, Mycobacterium
LCLHFTRLPYFQTMGVPLAIGMLIVV

SEQ ID NO: 315586 - protein, 18 aa, Mycobacterium
LCLIFIIMLIITRGFVAS

SEQ ID NO: 315587 - protein, 18 aa, Mycobacterium
LCLIFIIMLIITRSFIAA

SEQ ID NO: 315588 - protein, 18 aa, Mycobacterium
LCLIFIIMLILTRALIAA

SEQ ID NO: 315589 - protein, 30 aa, Mycobacterium
LCLRDVPWKRPRVRPAMLVEGLVVGTIVVF

SEQ ID NO: 315590 - protein, 17 aa, Mycobacterium
LCPRSLYLRNGVLETAS

SEQ ID NO: 315591 - protein, 21 aa, Mycobacterium
LCQTNCRARLLTAAQMNDAVA

SEQ ID NO: 315592 - protein, 23 aa, Mycobacterium
LCRLVRLLLWLSVIPVIECSLGG

SEQ ID NO: 315593 - protein, 25 aa, Mycobacterium
LCRPIPRLGGHPALSPEPVSSGIQV

SEQ ID NO: 315594 - protein, 18 aa, Mycobacterium
LCRRHFRPWRLLGGLAVL

SEQ ID NO: 315595 - protein, 22 aa, Mycobacterium
LCVAIIAVIFIKGFGASAPTTD

SEQ ID NO: 315596 - protein, 21 aa, Mycobacterium
LCVALGVPMALVLARSTARLV

SEQ ID NO: 315597 - protein, 21 aa, Mycobacterium
LCVGALLVGLVVAVRVAGLSR

SEQ ID NO: 315598 - protein, 22 aa, Mycobacterium
LCVIAVSIAVGWVRRRPLNGRT

SEQ ID NO: 315599 - protein, 20 aa, Mycobacterium
LCVLAIPLTASIGISVYHDR

SEQ ID NO: 315600 - protein, 17 aa, Mycobacterium
LCVLIAVLAWCIAVLAL

SEQ ID NO: 315601 - protein, 21 aa, Mycobacterium
LCVLSAALALNLWVGYFPTVQ

SEQ ID NO: 315602 - protein, 20 aa, Mycobacterium
LCVLSVPPLAVFVLLVSLIY

SEQ ID NO: 315603 - protein, 21 aa, Mycobacterium
LCYLGFGVPAAMVFLSDYASY

SEQ ID NO: 315604 - protein, 18 aa, Mycobacterium
LDAACDRISDGAVFSGLL

SEQ ID NO: 315605 - protein, 21 aa, Mycobacterium
LDAALAFAVWLSVPGAGRLRG

SEQ ID NO: 315606 - protein, 27 aa, Mycobacterium
LDAARLLTWRASWMAATGVPFERGEGS

SEQ ID NO: 315607 - protein, 19 aa, Mycobacterium
LDAATAWKAEGVRIPVAVN

SEQ ID NO: 315608 - protein, 18 aa, Mycobacterium
LDADGLLDTSLRWQATVI

SEQ ID NO: 315609 - protein, 30 aa, Mycobacterium
LDAELGLAVARRLDCRVVQGYGMSELSPVS

SEQ ID NO: 315610 - protein, 33 aa, Mycobacterium
LDAESPWKLLGRFGYHFSSLIAIVVLLAVGMSA

SEQ ID NO: 315611 - protein, 17 aa, Mycobacterium
LDAFGLPVILAGFLIAI

SEQ ID NO: 315612 - protein, 19 aa, Mycobacterium
LDAFKRLNDTYGHLAGDQA

SEQ ID NO: 315613 - protein, 19 aa, Mycobacterium
LDAFTEFNRTSVIIVGVPI

SEQ ID NO: 315614 - protein, 21 aa, Mycobacterium
LDAGRFRVALFILSAAMTGCF

SEQ ID NO: 315615 - protein, 23 aa, Mycobacterium
LDAHLRLPLRQVMWGTDEGLLES

SEQ ID NO: 315616 - protein, 17 aa, Mycobacterium
LDAIMFAFRRPFQGREF

SEQ ID NO: 315617 - protein, 19 aa, Mycobacterium
LDALDARPILHRILHGQRS

SEQ ID NO: 315618 - protein, 20 aa, Mycobacterium
LDALLAFAVWASVPGTGRLS

SEQ ID NO: 315619 - protein, 18 aa, Mycobacterium
LDALLAIIRRTRAGRSPF

SEQ ID NO: 315620 - protein, 17 aa, Mycobacterium
LDALLLAAIGLSNSGID

SEQ ID NO: 315621 - protein, 25 aa, Mycobacterium
LDALVVAVLVWWQFVGANTSDDGYI

SEQ ID NO: 315622 - protein, 23 aa, Mycobacterium
LDAMPWEPPSVFLMRRGANDTYT

SEQ ID NO: 315623 - protein, 19 aa, Mycobacterium
LDAPTAWVVSPIGMAGKIE

SEQ ID NO: 315624 - protein, 25 aa, Mycobacterium
LDAQPRLAILLGDYAVPVEGRVALL

SEQ ID NO: 315625 - protein, 24 aa, Mycobacterium
LDARIDRWLLPPSETAALQHEVSA

SEQ ID NO: 315626 - protein, 20 aa, Mycobacterium
LDARLPRVVLAAVVGAGLAA

SEQ ID NO: 315627 - protein, 18 aa, Mycobacterium
LDASRADEGRSWFGDTDI

SEQ ID NO: 315628 - protein, 18 aa, Mycobacterium
LDATIGIVHVKQVFEVPR

SEQ ID NO: 315629 - protein, 18 aa, Mycobacterium
LDATISWTSDGIKESVQN

SEQ ID NO: 315630 - protein, 19 aa, Mycobacterium
LDATITWTSDGIKESVQNA

SEQ ID NO: 315631 - protein, 27 aa, Mycobacterium
LDATVVRMFLVPSVMKLLGDDCWWAPR

SEQ ID NO: 315632 - protein, 17 aa, Mycobacterium
LDAVIARGMAKRPEDRY

SEQ ID NO: 315633 - protein, 21 aa, Mycobacterium
LDAVLALAVWLSAPGTGRLRP

SEQ ID NO: 315634 - protein, 17 aa, Mycobacterium
LDAVSLLVAGEPCPGEV

SEQ ID NO: 315635 - protein, 20 aa, Mycobacterium
LDAVTRWQARVIRMDGRRID

SEQ ID NO: 315636 - protein, 22 aa, Mycobacterium
LDAYDVRRFFRRVFGRPEPEPK

SEQ ID NO: 315637 - protein, 17 aa, Mycobacterium
LDAYGVRHLVLASRRGD

SEQ ID NO: 315638 - protein, 25 aa, Mycobacterium
LDCFRPGTCERLGIGPKECEAVNPR

SEQ ID NO: 315639 - protein, 18 aa, Mycobacterium
LDDELRYGTPPAAAARLA

SEQ ID NO: 315640 - protein, 18 aa, Mycobacterium
LDDLPGFLRSHDPGARDE

SEQ ID NO: 315641 - protein, 17 aa, Mycobacterium
LDDLRPYFAGYLPALLS

SEQ ID NO: 315642 - protein, 18 aa, Mycobacterium
LDDPRWIGMLAAVLTVSG

SEQ ID NO: 315643 - protein, 22 aa, Mycobacterium
LDDRAAAVAATLAERGVGAESR

SEQ ID NO: 315644 - protein, 26 aa, Mycobacterium
LDDYLRFLNDWQRPFIGRKTFMDLVT

SEQ ID NO: 315645 - protein, 17 aa, Mycobacterium
LDEALPGVIQRCARTPL

SEQ ID NO: 315646 - protein, 19 aa, Mycobacterium
LDECGACGLWFEQVAGQAS

SEQ ID NO: 315647 - protein, 27 aa, Mycobacterium
LDEDLAWRDVLGLALLAGIGFTVSLLI

SEQ ID NO: 315648 - protein, 25 aa, Mycobacterium
LDEGGDLWCQAALVLAAGAASAGDA

SEQ ID NO: 315649 - protein, 19 aa, Mycobacterium
LDELIGFFVNTLVLRLDLS

SEQ ID NO: 315650 - protein, 20 aa, Mycobacterium
LDELIGFFVNTLVLRVDLAG

SEQ ID NO: 315651 - protein, 27 aa, Mycobacterium
LDERLAKFHFWLTFLGFHATFLVQHWL

SEQ ID NO: 315652 - protein, 17 aa, Mycobacterium
LDERLGKFHFWLTFIGF

SEQ ID NO: 315653 - protein, 23 aa, Mycobacterium
LDFPGRDALFWVYIATLMVPGTV

SEQ ID NO: 315654 - protein, 17 aa, Mycobacterium
LDFTGVALGALFFCVSL

SEQ ID NO: 315655 - protein, 20 aa, Mycobacterium
LDGFCLYPESPLRLANGTVT

SEQ ID NO: 315656 - protein, 17 aa, Mycobacterium
LDGFCSGLADALHGSGV

SEQ ID NO: 315657 - protein, 18 aa, Mycobacterium
LDGFRYLAGHKIVLMSFV

SEQ ID NO: 315658 - protein, 22 aa, Mycobacterium
LDGGAPFYGCYETADGGYVAVG

SEQ ID NO: 315659 - protein, 23 aa, Mycobacterium
LDGGAPFYGCYETADGKYLAVGA

SEQ ID NO: 315660 - protein, 30 aa, Mycobacterium
LDGLALIIGLCWLAIGFVWLAGVTRGFQRP

SEQ ID NO: 315661 - protein, 27 aa, Mycobacterium
LDGLGRYRVVSALSRRGDELIVTGLSM

SEQ ID NO: 315662 - protein, 24 aa, Mycobacterium
LDGLLRPVPPGVVGELYIAGHGVG

SEQ ID NO: 315663 - protein, 18 aa, Mycobacterium
LDGLRPYFTGYLPALLLA

SEQ ID NO: 315664 - protein, 32 aa, Mycobacterium
LDGPPTLGRLLFDWRFDLVLGTAAIVLALVYL

SEQ ID NO: 315665 - protein, 18 aa, Mycobacterium
LDGPSVYHDVFSYLVRAQ

SEQ ID NO: 315666 - protein, 17 aa, Mycobacterium
LDGPVLVITAYRVLPEN

SEQ ID NO: 315667 - protein, 17 aa, Mycobacterium
LDGRRVPVVDIRDGQSI

SEQ ID NO: 315668 - protein, 19 aa, Mycobacterium
LDGSLVRLGRPGWIQPGPL

SEQ ID NO: 315669 - protein, 18 aa, Mycobacterium
LDGTLSFLSLPRLTKTLS

SEQ ID NO: 315670 - protein, 19 aa, Mycobacterium
LDGVVGWSALAGFVASTAA

SEQ ID NO: 315671 - protein, 25 aa, Mycobacterium
LDGWAGVAPPDGWTRADTERIRVAL

SEQ ID NO: 315672 - protein, 20 aa, Mycobacterium
LDGWSLPILLREVFASYYGQ

SEQ ID NO: 315673 - protein, 19 aa, Mycobacterium
LDGYCLYPESPLRLTNGSI

SEQ ID NO: 315674 - protein, 32 aa, Mycobacterium
LDHAVAGWLVHWPWFFGVSVWLIVIFGTSFGW

SEQ ID NO: 315675 - protein, 27 aa, Mycobacterium
LDHELRFAQMFPLARLVRDAMRGAVRP

SEQ ID NO: 315676 - protein, 18 aa, Mycobacterium
LDHRFGWSSVPPAICAAG

SEQ ID NO: 315677 - protein, 19 aa, Mycobacterium
LDHRFGWSSVPTAVCLIGD

SEQ ID NO: 315678 - protein, 17 aa, Mycobacterium
LDHSMIFIFIAGSYTPF

SEQ ID NO: 315679 - protein, 18 aa, Mycobacterium
LDHSMIFLFIAGSYTPFA

SEQ ID NO: 315680 - protein, 22 aa, Mycobacterium
LDHVFTLSVPNLWRETPAPYGP

SEQ ID NO: 315681 - protein, 21 aa, Mycobacterium
LDHVFTLSVPSLWRETPAPYG

SEQ ID NO: 315682 - protein, 21 aa, Mycobacterium
LDHVFTLSVPSMWRETPAPYG

SEQ ID NO: 315683 - protein, 17 aa, Mycobacterium
LDIGPLISYETTFSDLA

SEQ ID NO: 315684 - protein, 21 aa, Mycobacterium
LDILLFYVFFEAMLIPMYFLI

SEQ ID NO: 315685 - protein, 21 aa, Mycobacterium
LDIPAASGFTSEPALGVSAQV

SEQ ID NO: 315686 - protein, 19 aa, Mycobacterium
LDIPGVENFTGELYFTSSW

SEQ ID NO: 315687 - protein, 25 aa, Mycobacterium
LDISSARFWKAVAHHYVRLTYDALA

SEQ ID NO: 315688 - protein, 17 aa, Mycobacterium
LDKEGKAAWSRAMSGAL

SEQ ID NO: 315689 - protein, 18 aa, Mycobacterium
LDKKFWWPLPMTQLWRRT

SEQ ID NO: 315690 - protein, 17 aa, Mycobacterium
LDKLGCRASHTAELKFN

SEQ ID NO: 315691 - protein, 17 aa, Mycobacterium
LDKLGCRASHTAELLLE

SEQ ID NO: 315692 - protein, 22 aa, Mycobacterium
LDKLPWPAPTVFLMRRGAGPGS

SEQ ID NO: 315693 - protein, 21 aa, Mycobacterium
LDKYSPSFFCMMRNYHDVEPK

SEQ ID NO: 315694 - protein, 20 aa, Mycobacterium
LDLAACLAVGYTAFLLCPVE

SEQ ID NO: 315695 - protein, 20 aa, Mycobacterium
LDLAAELGLNTWAVEDAVAP

SEQ ID NO: 315696 - protein, 18 aa, Mycobacterium
LDLAVTIERLLRTHGLPP

SEQ ID NO: 315697 - protein, 17 aa, Mycobacterium
LDLDLSMFVLCSSIAAT

SEQ ID NO: 315698 - protein, 25 aa, Mycobacterium
LDLFMAQRFMLAWRQWLTARLTSDW

SEQ ID NO: 315699 - protein, 19 aa, Mycobacterium
LDLIRGVSLPMIAIFVLGT

SEQ ID NO: 315700 - protein, 21 aa, Mycobacterium
LDLIRGVSLPMIVIFIAGTCV

SEQ ID NO: 315701 - protein, 21 aa, Mycobacterium
LDLPGRPALLGSRGPDGKPYA

SEQ ID NO: 315702 - protein, 28 aa, Mycobacterium
LDLPPILQPFLDYAFGFRRGVDAGQPPD

SEQ ID NO: 315703 - protein, 25 aa, Mycobacterium
LDLRQWWTRVAWLAQRPVLIPGTVR

SEQ ID NO: 315704 - protein, 24 aa, Mycobacterium
LDLSCWRLAYNGAEPVSAATIERF

SEQ ID NO: 315705 - protein, 20 aa, Mycobacterium
LDLSDAVCRPDRCRAVEGNV

SEQ ID NO: 315706 - protein, 19 aa, Mycobacterium
LDLSIAVVAVRTFAISRGV

SEQ ID NO: 315707 - protein, 23 aa, Mycobacterium
LDLSRIDAGLPLDRHDTDLAEIV

SEQ ID NO: 315708 - protein, 23 aa, Mycobacterium
LDLSRIDAGLPLDRHDVDLAALA

SEQ ID NO: 315709 - protein, 22 aa, Mycobacterium
LDLSSWRLAYNGAEPVSPATIE

SEQ ID NO: 315710 - protein, 17 aa, Mycobacterium
LDLVGTFAFGLNGALTA

SEQ ID NO: 315711 - protein, 28 aa, Mycobacterium
LDLVPWAQPVNWWLLLAGFGVFITPVGR

SEQ ID NO: 315712 - protein, 26 aa, Mycobacterium
LDMFGVCLRSGMPVATAALVVAAAAP

SEQ ID NO: 315713 - protein, 20 aa, Mycobacterium
LDMIGLVLLPRMAKRSGHEH

SEQ ID NO: 315714 - protein, 19 aa, Mycobacterium
LDMLAVAGVWVTLCMGVAG

SEQ ID NO: 315715 - protein, 27 aa, Mycobacterium
LDMLGGLAHRMRCTTTFFGIAALGASG

SEQ ID NO: 315716 - protein, 19 aa, Mycobacterium
LDMRLEVGDTLVITGPSGS

SEQ ID NO: 315717 - protein, 19 aa, Mycobacterium
LDNPWGLAVDNMGTVYVGG

SEQ ID NO: 315718 - protein, 29 aa, Mycobacterium
LDPAAAVQAPWPLLRTFAAGPALSREAAL

SEQ ID NO: 315719 - protein, 25 aa, Mycobacterium
LDPENGVVVVAVWFDRGTDTQGRLL

SEQ ID NO: 315720 - protein, 20 aa, Mycobacterium
LDPKRLIEVRGWRRVGTVVV

SEQ ID NO: 315721 - protein, 40 aa, Mycobacterium
LDPKRMIKVRGWRRIGTATVRWPGPIFVASLLIALVGMLV

SEQ ID NO: 315722 - protein, 24 aa, Mycobacterium
LDPLPRWVRPDVLSSGDLVISGVL

SEQ ID NO: 315723 - protein, 17 aa, Mycobacterium
LDPLRRLAVVAVIAAAI

SEQ ID NO: 315724 - protein, 22 aa, Mycobacterium
LDPLRRLTVIAVIAAAIASSTW

SEQ ID NO: 315725 - protein, 25 aa, Mycobacterium
LDPMLRFASLQTVFNRGRTLLIATS

SEQ ID NO: 315726 - protein, 22 aa, Mycobacterium
LDPRAGNMVRAVWFDAPEASGQ

SEQ ID NO: 315727 - protein, 25 aa, Mycobacterium
LDPRQRLRVPIGISDHGVRVDLDLN

SEQ ID NO: 315728 - protein, 24 aa, Mycobacterium
LDPRTLWRNPVMFIVEIGATWATA

SEQ ID NO: 315729 - protein, 23 aa, Mycobacterium
LDPRTLWRNPVMFIVELGAVWST

SEQ ID NO: 315730 - protein, 24 aa, Mycobacterium
LDPSWEAAVALARIHHLAWGPEIV

SEQ ID NO: 315731 - protein, 18 aa, Mycobacterium
LDPSWPAHRRRQVLADSG

SEQ ID NO: 315732 - protein, 22 aa, Mycobacterium
LDPTAAINMAWRAAGGAAGPLG

SEQ ID NO: 315733 - protein, 24 aa, Mycobacterium
LDPTARQAWQWLVTEVPQRSLHNW

SEQ ID NO: 315734 - protein, 21 aa, Mycobacterium
LDPTLRFASLQTVFNRGRSLL

SEQ ID NO: 315735 - protein, 18 aa, Mycobacterium
LDPVDWWRQLSWLPQRSV

SEQ ID NO: 315736 - protein, 18 aa, Mycobacterium
LDPWDVFHQGLALRTGMT

SEQ ID NO: 315737 - protein, 19 aa, Mycobacterium
LDPWDVFHQGLAMRTGMSI

SEQ ID NO: 315738 - protein, 17 aa, Mycobacterium
LDPYVRDGWAFVAIRLT

SEQ ID NO: 315739 - protein, 17 aa, Mycobacterium
LDQAAAFLLTMRNDASS

SEQ ID NO: 315740 - protein, 19 aa, Mycobacterium
LDQGYSYGLLWVAAVAVIV

SEQ ID NO: 315741 - protein, 25 aa, Mycobacterium
LDQLSFAMPARWGYAAAASTVDLRH

SEQ ID NO: 315742 - protein, 25 aa, Mycobacterium
LDQMSWFTPARWGFAASASTVDLIR

SEQ ID NO: 315743 - protein, 22 aa, Mycobacterium
LDQPRVYFGPVIANTSADYAIV

SEQ ID NO: 315744 - protein, 25 aa, Mycobacterium
LDQRRPELVSSIGSLARVLERLSAS

SEQ ID NO: 315745 - protein, 23 aa, Mycobacterium
LDQTAKLVGRMRALGDALTSNMV

SEQ ID NO: 315746 - protein, 25 aa, Mycobacterium
LDRAHPRAVAGFGFSVVAISLIWFS

SEQ ID NO: 315747 - protein, 27 aa, Mycobacterium
LDRAHPRPVVGFGFFVVAIALTWFSIE

SEQ ID NO: 315748 - protein, 19 aa, Mycobacterium
LDRDIGYGILRMSSDQKWR

SEQ ID NO: 315749 - protein, 29 aa, Mycobacterium
LDRDRLVAELPRLAAIPFSSERQFMATLH

SEQ ID NO: 315750 - protein, 25 aa, Mycobacterium
LDRECGWLHVAVIYTREATAETVRP

SEQ ID NO: 315751 - protein, 26 aa, Mycobacterium
LDRFEPEPPRLLLFAFGWGASVAVVL

SEQ ID NO: 315752 - protein, 31 aa, Mycobacterium
LDRFGEKRAPLALAVASLFYAFPIFLDAGFI

SEQ ID NO: 315753 - protein, 22 aa, Mycobacterium
LDRFPRGNLIGIPGAPERMVQN

SEQ ID NO: 315754 - protein, 23 aa, Mycobacterium
LDRFPRGNLIGIPGAPERMVQNP

SEQ ID NO: 315755 - protein, 22 aa, Mycobacterium
LDRFPRGNLIGIPGAPERMVQS

SEQ ID NO: 315756 - protein, 20 aa, Mycobacterium
LDRFSLKRLHQVAIVAVLAT

SEQ ID NO: 315757 - protein, 23 aa, Mycobacterium
LDRGALTAFMSWVESRPSPRAQR

SEQ ID NO: 315758 - protein, 17 aa, Mycobacterium
LDRGFVWVGLHEPDEHQ

SEQ ID NO: 315759 - protein, 25 aa, Mycobacterium
LDRIAKEVFRAPGIARVQSITRPLG

SEQ ID NO: 315760 - protein, 17 aa, Mycobacterium
LDRIAYRTTIFAFPVFG

SEQ ID NO: 315761 - protein, 17 aa, Mycobacterium
LDRKAHISEALKRLPGY

SEQ ID NO: 315762 - protein, 25 aa, Mycobacterium
LDRLHAVPTPAGRLVQLGGVAQSNR

SEQ ID NO: 315763 - protein, 24 aa, Mycobacterium
LDRLRSLMRSVLCSLAVFHNPRDV

SEQ ID NO: 315764 - protein, 19 aa, Mycobacterium
LDRPADFVVGAPIQIVDRV

SEQ ID NO: 315765 - protein, 18 aa, Mycobacterium
LDRPAEFVTGAPLQVVDA

SEQ ID NO: 315766 - protein, 17 aa, Mycobacterium
LDRRLLLGMLAELAAGA

SEQ ID NO: 315767 - protein, 23 aa, Mycobacterium
LDRRPKGTIIFCVAGLTFAFVLL

SEQ ID NO: 315768 - protein, 30 aa, Mycobacterium
LDRRSERQYPFLVMELIEGGTLRELLTERG

SEQ ID NO: 315769 - protein, 17 aa, Mycobacterium
LDRRSRASVLPKAVFAR

SEQ ID NO: 315770 - protein, 26 aa, Mycobacterium
LDRRSRGGGVPINWRSPIAPPQAGGA

SEQ ID NO: 315771 - protein, 26 aa, Mycobacterium
LDRSLKLTRWQSFRLILLPSAMPDIA

SEQ ID NO: 315772 - protein, 23 aa, Mycobacterium
LDRTAKLVGRMRALGDALSANMV

SEQ ID NO: 315773 - protein, 28 aa, Mycobacterium
LDRTDRLLLGGCAVIWLAALGAAVAAVV

SEQ ID NO: 315774 - protein, 20 aa, Mycobacterium
LDRVAKALIRLPGVAMVQSI

SEQ ID NO: 315775 - protein, 29 aa, Mycobacterium
LDRVLEMPDRFPGWVAVVGYGVQSAGLAL

SEQ ID NO: 315776 - protein, 21 aa, Mycobacterium
LDRWLLFNWMRWGRALEYLKI

SEQ ID NO: 315777 - protein, 20 aa, Mycobacterium
LDRYLPLWIGLAMAAGLLLG

SEQ ID NO: 315778 - protein, 18 aa, Mycobacterium
LDSAALVVVGEACPAEVV

SEQ ID NO: 315779 - protein, 17 aa, Mycobacterium
LDSCRELIQNAAQAANG

SEQ ID NO: 315780 - protein, 19 aa, Mycobacterium
LDSGFTMLGLVGIIDALRP

SEQ ID NO: 315781 - protein, 17 aa, Mycobacterium
LDSHDWLVVLTALGSLA

SEQ ID NO: 315782 - protein, 17 aa, Mycobacterium
LDSIALGAGVALSAIES

SEQ ID NO: 315783 - protein, 24 aa, Mycobacterium
LDSLFRLDHLAARLRRNSANLLVL

SEQ ID NO: 315784 - protein, 20 aa, Mycobacterium
LDSRPGRNQPPGAFDLSEVW

SEQ ID NO: 315785 - protein, 25 aa, Mycobacterium
LDSVAPTRPRTWRHAATALLVVGLM

SEQ ID NO: 315786 - protein, 24 aa, Mycobacterium
LDSWRRLRRRPKFVVAAALILLIL

SEQ ID NO: 315787 - protein, 18 aa, Mycobacterium
LDSWSVIADAPWFDLAAR

SEQ ID NO: 315788 - protein, 18 aa, Mycobacterium
LDTGGWLRITDRLKEMIK

SEQ ID NO: 315789 - protein, 28 aa, Mycobacterium
LDTKTPLSFLCYWIIPFGLVGLAAVASR

SEQ ID NO: 315790 - protein, 29 aa, Mycobacterium
LDTKTPLSFVCYWVIPFALLGVAALVSRV

SEQ ID NO: 315791 - protein, 18 aa, Mycobacterium
LDTLKIIAPYALTMAVVG

SEQ ID NO: 315792 - protein, 18 aa, Mycobacterium
LDTLLLNVIGFGRAGVDL

SEQ ID NO: 315793 - protein, 27 aa, Mycobacterium
LDTPEFPWTGLTIFLLIAVFAAAVGTR

SEQ ID NO: 315794 - protein, 19 aa, Mycobacterium
LDTPRVWRGPRLQVDVEAV

SEQ ID NO: 315795 - protein, 25 aa, Mycobacterium
LDTQPRLAILLGDYAVPVEGRINLL

SEQ ID NO: 315796 - protein, 20 aa, Mycobacterium
LDTRFARLILGVAVLEDIVL

SEQ ID NO: 315797 - protein, 34 aa, Mycobacterium
LDTWPGCIAEILMFTGFLWPPVVSRVQAHRDVRR

SEQ ID NO: 315798 - protein, 22 aa, Mycobacterium
LDVAAWPAYKLLALGAGAVVFI

SEQ ID NO: 315799 - protein, 18 aa, Mycobacterium
LDVALLLGDEAYRYPDNL

SEQ ID NO: 315800 - protein, 19 aa, Mycobacterium
LDVARWERSGWRVFRLGAR

SEQ ID NO: 315801 - protein, 20 aa, Mycobacterium
LDVINELRAAGAEAIEVNDA

SEQ ID NO: 315802 - protein, 20 aa, Mycobacterium
LDVINELRAAGAEAIQVSDA

SEQ ID NO: 315803 - protein, 19 aa, Mycobacterium
LDVLDELSRSMVVDVDNAV

SEQ ID NO: 315804 - protein, 27 aa, Mycobacterium
LDVLPSWLSWFGRPGSMATIAVVVSVL

SEQ ID NO: 315805 - protein, 19 aa, Mycobacterium
LDVLRRIATDFDRSQRAAS

SEQ ID NO: 315806 - protein, 19 aa, Mycobacterium
LDVLRRIATDFDRTQKAAS

SEQ ID NO: 315807 - protein, 18 aa, Mycobacterium
LDVPTAWLVAPVQADGRT

SEQ ID NO: 315808 - protein, 18 aa, Mycobacterium
LDVPTAWVVSPVGMNGKF

SEQ ID NO: 315809 - protein, 18 aa, Mycobacterium
LDVSLVISSMVALNAALP

SEQ ID NO: 315810 - protein, 18 aa, Mycobacterium
LDVSNWRIALLGSGAMTL

SEQ ID NO: 315811 - protein, 19 aa, Mycobacterium
LDVVWAAGLVCFAAAGQLA

SEQ ID NO: 315812 - protein, 21 aa, Mycobacterium
LDWATKIAIAVLFFLYGTRLE

SEQ ID NO: 315813 - protein, 30 aa, Mycobacterium
LDWIDELLYRLAYEGSTVPGGWFTISVLAI

SEQ ID NO: 315814 - protein, 17 aa, Mycobacterium
LDWSVWIGVVVLGIIGA

SEQ ID NO: 315815 - protein, 19 aa, Mycobacterium
LDYAMPMRTFGWPRDLPRA

SEQ ID NO: 315816 - protein, 17 aa, Mycobacterium
LDYARDSLIAFQEHHPA

SEQ ID NO: 315817 - protein, 25 aa, Mycobacterium
LDYDPEQRRIAALVLGYTLIIVMIG

SEQ ID NO: 315818 - protein, 17 aa, Mycobacterium
LDYVMRKGWRDCLNNGG

SEQ ID NO: 315819 - protein, 17 aa, Mycobacterium
LDYVPGILLLIGVGLLG

SEQ ID NO: 315820 - protein, 24 aa, Mycobacterium
LDYYLKTHIEYAADKCHGDTRAST

SEQ ID NO: 315821 - protein, 19 aa, Mycobacterium
LEAAVRAMAKRGFVVSRLT

SEQ ID NO: 315822 - protein, 17 aa, Mycobacterium
LEACRRTTGLALPIVCV

SEQ ID NO: 315823 - protein, 19 aa, Mycobacterium
LEADARLRRQLALRYVIFG

SEQ ID NO: 315824 - protein, 17 aa, Mycobacterium
LEAEFGWSRTALSALPL

SEQ ID NO: 315825 - protein, 23 aa, Mycobacterium
LEAEPKIFSWLANFEPMRQVFIG

SEQ ID NO: 315826 - protein, 20 aa, Mycobacterium
LEAFTEFNRLAVIIVGVPIM

SEQ ID NO: 315827 - protein, 17 aa, Mycobacterium
LEAGNFVRIAGVEVGKV

SEQ ID NO: 315828 - protein, 31 aa, Mycobacterium
LEAIHMSWLRFGHGLVLSSIVLWTGVGLMLI

SEQ ID NO: 315829 - protein, 17 aa, Mycobacterium
LEAIKALNIRYIYTSAP

SEQ ID NO: 315830 - protein, 17 aa, Mycobacterium
LEAILPYYGPYRNDVLK

SEQ ID NO: 315831 - protein, 20 aa, Mycobacterium
LEALARWTAPNGILIAPETF

SEQ ID NO: 315832 - protein, 17 aa, Mycobacterium
LEALLATVQAGPWQGPS

SEQ ID NO: 315833 - protein, 19 aa, Mycobacterium
LEAPLKFRAPGVTLPIGLG

SEQ ID NO: 315834 - protein, 19 aa, Mycobacterium
LEAPLKFRAPNVTLQIGLG

SEQ ID NO: 315835 - protein, 17 aa, Mycobacterium
LEAPRPPQHVVAKPVRS

SEQ ID NO: 315836 - protein, 26 aa, Mycobacterium
LEARPLRMAFLLGAAMLIDFRFLAAL

SEQ ID NO: 315837 - protein, 24 aa, Mycobacterium
LEASRTWAQASWRHSMPSVEGPDP

SEQ ID NO: 315838 - protein, 26 aa, Mycobacterium
LEAVGLPKRLWPVLPVVKGASALGLL

SEQ ID NO: 315839 - protein, 21 aa, Mycobacterium
LEAVPPFFRWLATFEPMHQVF

SEQ ID NO: 315840 - protein, 25 aa, Mycobacterium
LEAYGVLFDPEFHIPFIGRWPVLGF

SEQ ID NO: 315841 - protein, 23 aa, Mycobacterium
LEDGRFAFYIKVHHTVIDGVAGF

SEQ ID NO: 315842 - protein, 18 aa, Mycobacterium
LEEGRRWTVEEFRTTHPI

SEQ ID NO: 315843 - protein, 21 aa, Mycobacterium
LEERGRTAVFVGQDGQVVGVL

SEQ ID NO: 315844 - protein, 18 aa, Mycobacterium
LEEYSLARTRRGLRALLS

SEQ ID NO: 315845 - protein, 17 aa, Mycobacterium
LEFAWPTLVLATGIGIC

SEQ ID NO: 315846 - protein, 18 aa, Mycobacterium
LEGAVRAMAKRGFAVSML

SEQ ID NO: 315847 - protein, 24 aa, Mycobacterium
LEGFDFGVGMLMSFFGRAAEKRGQ

SEQ ID NO: 315848 - protein, 19 aa, Mycobacterium
LEGHALRFDDFGNIITDAP

SEQ ID NO: 315849 - protein, 19 aa, Mycobacterium
LEGLTVFGIALTITSGSLY

SEQ ID NO: 315850 - protein, 17 aa, Mycobacterium
LEGPAGQLLSFKIAIPI

SEQ ID NO: 315851 - protein, 29 aa, Mycobacterium
LEGRLVQHLWRWSRMLPEDFVPQSKRTAD

SEQ ID NO: 315852 - protein, 23 aa, Mycobacterium
LEGSDWSWLKWLPHVDIPGQADG

SEQ ID NO: 315853 - protein, 17 aa, Mycobacterium
LEGTELWESLTREQRLE

SEQ ID NO: 315854 - protein, 22 aa, Mycobacterium
LEHAKRVSDLLAQRAGQVNQLI

SEQ ID NO: 315855 - protein, 17 aa, Mycobacterium
LEHASLPYAMGSMGTKI

SEQ ID NO: 315856 - protein, 19 aa, Mycobacterium
LEHGHHWLALGYVAASIAV

SEQ ID NO: 315857 - protein, 17 aa, Mycobacterium
LEHLVMRKPLLLQDLGR

SEQ ID NO: 315858 - protein, 37 aa, Mycobacterium
LEHPGKRAPTVELCNDPRGFVPMAIRQHITGPYPFDP

SEQ ID NO: 315859 - protein, 18 aa, Mycobacterium
LEHSRTALLDAVEQERRR

SEQ ID NO: 315860 - protein, 19 aa, Mycobacterium
LEHYCPKPAAVQPAVYDQK

SEQ ID NO: 315861 - protein, 24 aa, Mycobacterium
LEIAPGVVTRWMKLAVRDKIVDEV

SEQ ID NO: 315862 - protein, 22 aa, Mycobacterium
LEIAPGVVTTWMKLAIRDRILP

SEQ ID NO: 315863 - protein, 18 aa, Mycobacterium
LEIECARLSLIDEAAAER

SEQ ID NO: 315864 - protein, 27 aa, Mycobacterium
LEIHRISGFVLPRGLITVRISPHVDME

SEQ ID NO: 315865 - protein, 18 aa, Mycobacterium
LEIVQRQGFATGNVTTAE

SEQ ID NO: 315866 - protein, 17 aa, Mycobacterium
LEIVVQLLLPFVAGQVL

SEQ ID NO: 315867 - protein, 17 aa, Mycobacterium
LEKAGWHLVFGLSAGLL

SEQ ID NO: 315868 - protein, 17 aa, Mycobacterium
LEKHYLAAVMASGAAVG

SEQ ID NO: 315869 - protein, 17 aa, Mycobacterium
LEKLARVGFAASGVLHL

SEQ ID NO: 315870 - protein, 26 aa, Mycobacterium
LEKNDLRPGWHPVPGISSGTRESGVR

SEQ ID NO: 315871 - protein, 22 aa, Mycobacterium
LEKSAHPWAFLIRSLVGGAMVG

SEQ ID NO: 315872 - protein, 19 aa, Mycobacterium
LEKVAAWAITEPDSGSDAF

SEQ ID NO: 315873 - protein, 26 aa, Mycobacterium
LEKYLDHWPDAFKILNRQGLYGDFFS

SEQ ID NO: 315874 - protein, 18 aa, Mycobacterium
LELALGYNGIDRIVSGGH

SEQ ID NO: 315875 - protein, 20 aa, Mycobacterium
LELDGLWGIVFSPLLHASWE

SEQ ID NO: 315876 - protein, 19 aa, Mycobacterium
LELELAYKPQTLLAYEMNG

SEQ ID NO: 315877 - protein, 20 aa, Mycobacterium
LELFDGAAIAAVIPLLLWIA

SEQ ID NO: 315878 - protein, 25 aa, Mycobacterium
LELFRMSLKDTRWWLGGMAAVTNYS

SEQ ID NO: 315879 - protein, 22 aa, Mycobacterium
LELLFDLTFVIAFGVAASQLAH

SEQ ID NO: 315880 - protein, 21 aa, Mycobacterium
LELLFDLVFVVAVSRASGSLH

SEQ ID NO: 315881 - protein, 17 aa, Mycobacterium
LELLKTATAQRWSSEGN

SEQ ID NO: 315882 - protein, 19 aa, Mycobacterium
LELLRAVLAYYQYAAKETD

SEQ ID NO: 315883 - protein, 22 aa, Mycobacterium
LELPEGPWRLAVGGGGTLEDVL

SEQ ID NO: 315884 - protein, 17 aa, Mycobacterium
LELPEISWGLQINDGQS

SEQ ID NO: 315885 - protein, 17 aa, Mycobacterium
LELRLHDPRDSNVRLVG

SEQ ID NO: 315886 - protein, 21 aa, Mycobacterium
LELRLLPSLIPIGLLAGLSAV

SEQ ID NO: 315887 - protein, 17 aa, Mycobacterium
LELRLQISRVVDGLSSL

SEQ ID NO: 315888 - protein, 20 aa, Mycobacterium
LELTDSPLLLGVTVAGQQLP

SEQ ID NO: 315889 - protein, 19 aa, Mycobacterium
LELTSTMGASRFKTFLKIR

SEQ ID NO: 315890 - protein, 22 aa, Mycobacterium
LELWRSDMVRMVAYGETDARVK

SEQ ID NO: 315891 - protein, 25 aa, Mycobacterium
LELYNGRCGVALFFAALEKVAPDLG

SEQ ID NO: 315892 - protein, 24 aa, Mycobacterium
LEMIMVVGALHFKESRGRGNISAA

SEQ ID NO: 315893 - protein, 24 aa, Mycobacterium
LEMLAPGYRRARSMSKEAFDMVFA

SEQ ID NO: 315894 - protein, 19 aa, Mycobacterium
LEMPLRRTLRYAALLRLPA

SEQ ID NO: 315895 - protein, 17 aa, Mycobacterium
LEMRRIIDRFNRQTGHE

SEQ ID NO: 315896 - protein, 28 aa, Mycobacterium
LEPAAAVLRFLRRVPRDTVVLLDEAYIE

SEQ ID NO: 315897 - protein, 25 aa, Mycobacterium
LEPAGFSVFAVFWGAFGLVTGAANG

SEQ ID NO: 315898 - protein, 25 aa, Mycobacterium
LEPAGFSVFGVFWGAFGLVSGAAFG

SEQ ID NO: 315899 - protein, 17 aa, Mycobacterium
LEPCPRSDEPLAVGQVR

SEQ ID NO: 315900 - protein, 18 aa, Mycobacterium
LEPFAFTVIDVIVLTVFQ

SEQ ID NO: 315901 - protein, 24 aa, Mycobacterium
LEPFRCFYLSAPFVVPKVKEVATT

SEQ ID NO: 315902 - protein, 19 aa, Mycobacterium
LEPFRIGMTVLMLNRPKPL

SEQ ID NO: 315903 - protein, 18 aa, Mycobacterium
LEPGETLALVGSTGAGKS

SEQ ID NO: 315904 - protein, 18 aa, Mycobacterium
LEPGIRFGSLQTVSADGN

SEQ ID NO: 315905 - protein, 41 aa, Mycobacterium
LEPKGMKRARGWRRIGAATVRWPGAVLVMAVVLALVGLLTL

SEQ ID NO: 315906 - protein, 38 aa, Mycobacterium
LEPKRAMRIRAWRRIGTMVVRWPGPILVASLALALVGL

SEQ ID NO: 315907 - protein, 36 aa, Mycobacterium
LEPKRAMRIRGWRKIGAAIVRWPGPILVATMAITLV

SEQ ID NO: 315908 - protein, 36 aa, Mycobacterium
LEPKRAMRIRGWRRLGAFVVRWPGAVLMATVLLSLV

SEQ ID NO: 315909 - protein, 41 aa, Mycobacterium
LEPKRAMRTRGWRKVGAAVVRWPGPILVAAVGLSMIGLLAL

SEQ ID NO: 315910 - protein, 40 aa, Mycobacterium
LEPKRFSRSPGWHRVGTATVRWPGAILVCAVVAALIGLLA

SEQ ID NO: 315911 - protein, 38 aa, Mycobacterium
LEPKRMARVRGWRKIGAAIVRWPGPILIGAVALALVGL

SEQ ID NO: 315912 - protein, 17 aa, Mycobacterium
LEPKRTQRIRGWRKIGA

SEQ ID NO: 315913 - protein, 17 aa, Mycobacterium
LEPNWSMTLVERLDGAA

SEQ ID NO: 315914 - protein, 17 aa, Mycobacterium
LEPPYKGGPVLADNAVI

SEQ ID NO: 315915 - protein, 20 aa, Mycobacterium
LEPRGKLSTTGWRKVGTSVV

SEQ ID NO: 315916 - protein, 17 aa, Mycobacterium
LEPVFLVTVRFTAVAVS

SEQ ID NO: 315917 - protein, 17 aa, Mycobacterium
LEQAVARQSCDIAPIAV

SEQ ID NO: 315918 - protein, 17 aa, Mycobacterium
LEQVIPLMPGAQLTGHQ

SEQ ID NO: 315919 - protein, 25 aa, Mycobacterium
LERIFDPKVFVISFVFNVFVAALIV

SEQ ID NO: 315920 - protein, 30 aa, Mycobacterium
LERLFALRPLHVLRRGWRTDVVHYLVNGAA

SEQ ID NO: 315921 - protein, 18 aa, Mycobacterium
LERLVTFLALGVAAIPAW

SEQ ID NO: 315922 - protein, 28 aa, Mycobacterium
LERPTHWNHFAARAAAAVRSRGAVPLAL

SEQ ID NO: 315923 - protein, 20 aa, Mycobacterium
LERQVRRWGSQWALVRLPDD

SEQ ID NO: 315924 - protein, 24 aa, Mycobacterium
LERQWRARMAGLRTNALVATGATL

SEQ ID NO: 315925 - protein, 25 aa, Mycobacterium
LERRAKQAKTRRIVLIAAGAIVAVA

SEQ ID NO: 315926 - protein, 29 aa, Mycobacterium
LERREHIGEALKRLPAYATALGEVVGSGP

SEQ ID NO: 315927 - protein, 22 aa, Mycobacterium
LERRERIGGTWDLFRYPGVRSD

SEQ ID NO: 315928 - protein, 21 aa, Mycobacterium
LERRSRIGGTWDLHRYPGIRS

SEQ ID NO: 315929 - protein, 26 aa, Mycobacterium
LERRWEIVRFLSPLAVLLIWQAGSAW

SEQ ID NO: 315930 - protein, 17 aa, Mycobacterium
LERWHSRSGADRSAGQT

SEQ ID NO: 315931 - protein, 22 aa, Mycobacterium
LERWTADVLLSLGCTLEQLVAS

SEQ ID NO: 315932 - protein, 24 aa, Mycobacterium
LESEAWSWLKWLPHVDVPGRIDGV

SEQ ID NO: 315933 - protein, 17 aa, Mycobacterium
LESFGYKQELSRQISTV

SEQ ID NO: 315934 - protein, 33 aa, Mycobacterium
LESIHMSWLRFGHGLVLSSIVLWLGVGLMLIAW

SEQ ID NO: 315935 - protein, 31 aa, Mycobacterium; identical to SEQ ID NO: 11497

SEQ ID NO: 315936 - protein, 24 aa, Mycobacterium
LESPTVTVPARWSVDGIEHTGDVA

SEQ ID NO: 315937 - protein, 17 aa, Mycobacterium
LESRLAALGSKIGPAAM

SEQ ID NO: 315938 - protein, 21 aa, Mycobacterium
LESRLAALGSRAAGALPKGPL

SEQ ID NO: 315939 - protein, 23 aa, Mycobacterium
LESRLAALGTRAGAAVMPKGPLP

SEQ ID NO: 315940 - protein, 17 aa, Mycobacterium
LESRYADRLEILHVMSN

SEQ ID NO: 315941 - protein, 17 aa, Mycobacterium
LESVAPKQPTRWRHLPA

SEQ ID NO: 315942 - protein, 26 aa, Mycobacterium
LESYDLSSLRYIMWGATPVNANVAQT

SEQ ID NO: 315943 - protein, 35 aa, Mycobacterium
LETEQSLREPRRAVPEVPASRPARPAPNATAPTAP

SEQ ID NO: 315944 - protein, 23 aa, Mycobacterium
LETGSPYAIEYVWGRQVGDNTIN

SEQ ID NO: 315945 - protein, 30 aa, Mycobacterium
LETIHMSWLRFGHGLVLSSIVLWSGVGLML

SEQ ID NO: 315946 - protein, 19 aa, Mycobacterium
LETLMRPPLTGVLDTLDNA

SEQ ID NO: 315947 - protein, 23 aa, Mycobacterium
LETRLMAVLAVGFGLGVALAVSR

SEQ ID NO: 315948 - protein, 23 aa, Mycobacterium
LETRLMMVLGVGFGLGVALTLSR

SEQ ID NO: 315949 - protein, 24 aa, Mycobacterium
LETYRSATPIAWYLAAAASVSAVA

SEQ ID NO: 315950 - protein, 21 aa, Mycobacterium
LEVAGAIAPFIAVGAVLCLVV

SEQ ID NO: 315951 - protein, 17 aa, Mycobacterium
LEVARIIGIAAIVIALP

SEQ ID NO: 315952 - protein, 24 aa, Mycobacterium
LEVDEPLAYCLPGVRSRVVVSEGT

SEQ ID NO: 315953 - protein, 20 aa, Mycobacterium
LEVLAIKPDICFLWDEAWYA

SEQ ID NO: 315954 - protein, 20 aa, Mycobacterium
LEVLQRWLADDLPAVLVVCT

SEQ ID NO: 315955 - protein, 36 aa, Mycobacterium
LEVPYLRASPWLLWRKRVVWLLVLFVAEAYTGSVLR

SEQ ID NO: 315956 - protein, 29 aa, Mycobacterium
LEVVCVFWPTARRGPLLWLALLSAAATMV

SEQ ID NO: 315957 - protein, 33 aa, Mycobacterium
LEVVEGVGLWLLKRWGEYFAVIATSVFLPLEIH

SEQ ID NO: 315958 - protein, 22 aa, Mycobacterium
LEWYDWMIFGLLAAYLGPQFFA

SEQ ID NO: 315959 - protein, 21 aa, Mycobacterium
LEYEGRRAIGFSADDDTRFVK

SEQ ID NO: 315960 - protein, 20 aa, Mycobacterium
LEYQGAALPKRMNKLGSAGA

SEQ ID NO: 315961 - protein, 17 aa, Mycobacterium
LEYRDVDAFERRRAIWQ

SEQ ID NO: 315962 - protein, 17 aa, Mycobacterium
LFAAAAVVLSLVRRAAT

SEQ ID NO: 315963 - protein, 26 aa, Mycobacterium
LFAAFLRNNVKLIPLVPFPVDHATST

SEQ ID NO: 315964 - protein, 17 aa, Mycobacterium
LFAAIIGSVSFWGSLVA

SEQ ID NO: 315965 - protein, 17 aa, Mycobacterium
LFAAVIGSISFWGSIIA

SEQ ID NO: 315966 - protein, 25 aa, Mycobacterium
LFADEFGWRGPFWKWIAGLDLNVVG

SEQ ID NO: 315967 - protein, 18 aa, Mycobacterium
LFAFFGGFAIMLGAELNA

SEQ ID NO: 315968 - protein, 22 aa, Mycobacterium
LFAGLKGAVPILLGELLRAAHV

SEQ ID NO: 315969 - protein, 31 aa, Mycobacterium
LFAGPAANFVICLVLLYGIALVWGLPDLHPP

SEQ ID NO: 315970 - protein, 24 aa, Mycobacterium
LFAGPAMNFLIGIVVFYGVVLFWG

SEQ ID NO: 315971 - protein, 18 aa, Mycobacterium
LFAGVVAALAFVAVSRTR

SEQ ID NO: 315972 - protein, 24 aa, Mycobacterium
LFAIGRDGLLPSVFAQVNPRTLTP

SEQ ID NO: 315973 - protein, 18 aa, Mycobacterium
LFAIVAGVLLWFSRIRVE

SEQ ID NO: 315974 - protein, 19 aa, Mycobacterium
LFAIWPFTRLVHAFSAPVA

SEQ ID NO: 315975 - protein, 18 aa, Mycobacterium
LFALRFPVFIEAYDQFGW

SEQ ID NO: 315976 - protein, 25 aa, Mycobacterium
LFAMGRDGLLPSMFARVNSHTMTPI

SEQ ID NO: 315977 - protein, 24 aa, Mycobacterium
LFAQANRAAHGWLFGDPASGENGD

SEQ ID NO: 315978 - protein, 25 aa, Mycobacterium
LFAQANRVAHDWLFSEAQSAADGER

SEQ ID NO: 315979 - protein, 27 aa, Mycobacterium
LFAQYGSWRWAFGVLVILTAAMAVLVP

SEQ ID NO: 315980 - protein, 24 aa, Mycobacterium
LFASGGHPVAWVGLGVAALLAVIA

SEQ ID NO: 315981 - protein, 30 aa, Mycobacterium
LFATFILGMFWRRMTATAGWAGLVSGTFAA

SEQ ID NO: 315982 - protein, 18 aa, Mycobacterium
LFATLIVMPYRFRGVAMF

SEQ ID NO: 315983 - protein, 19 aa, Mycobacterium
LFATVVAFWIGRPIITLAF

SEQ ID NO: 315984 - protein, 26 aa, Mycobacterium
LFAYTKICSHLGCPTSLFEQQTYRIL

SEQ ID NO: 315985 - protein, 21 aa, Mycobacterium
LFCNSPFFWIGGFAFGLLATL

SEQ ID NO: 315986 - protein, 18 aa, Mycobacterium
LFCVGLITAYLAARAGTT

SEQ ID NO: 315987 - protein, 17 aa, Mycobacterium
LFDDMEGLREFQLPYAK

SEQ ID NO: 315988 - protein, 18 aa, Mycobacterium
LFDFNVGVMRWRWRVAFY

SEQ ID NO: 315989 - protein, 18 aa, Mycobacterium
LFDKEPLLIWTLIASLFI

SEQ ID NO: 315990 - protein, 20 aa, Mycobacterium
LFDMAMLGVLSVFYVTFVRW

SEQ ID NO: 315991 - protein, 18 aa, Mycobacterium
LFDMAMLGVVSIAYTAIV

SEQ ID NO: 315992 - protein, 39 aa, Mycobacterium
LFDPKRLIKVRGWRRVGTVVVRWPLPVLAATLAVALVGL

SEQ ID NO: 315993 - protein, 41 aa, Mycobacterium
LFDPKRLLKVRGWRRVGTVVVRWPLPVLAATCAVALVGLLA

SEQ ID NO: 315994 - protein, 20 aa, Mycobacterium
LFDRLGRRFPRHFGPGHVAL

SEQ ID NO: 315995 - protein, 17 aa, Mycobacterium
LFEAARLDGAGRVREFV

SEQ ID NO: 315996 - protein, 18 aa, Mycobacterium
LFEACPPLDHAAHPTAAE

SEQ ID NO: 315997 - protein, 22 aa, Mycobacterium
LFEPKRAMRIRSWRKIGTTIVR

SEQ ID NO: 315998 - protein, 18 aa, Mycobacterium
LFESMSIDGASEWSTLWQ

SEQ ID NO: 315999 - protein, 26 aa, Mycobacterium
LFFDRNRLAAFAAMFLGGGVLFSLTV

SEQ ID NO: 316000 - protein, 19 aa, Mycobacterium
LFFGALVLWMVLRPLQSRA

SEQ ID NO: 316001 - protein, 19 aa, Mycobacterium
LFFGALVLWMVLRPLQTRP

SEQ ID NO: 316002 - protein, 30 aa, Mycobacterium
LFFIAYEAFFIPFGFTFWGVMLSAPLWLPL

SEQ ID NO: 316003 - protein, 25 aa, Mycobacterium
LFFSLCIGYAPRLVGLADVGRALAL

SEQ ID NO: 316004 - protein, 22 aa, Mycobacterium
LFFSVGVDGFFALSGFLITRSW

SEQ ID NO: 316005 - protein, 21 aa, Mycobacterium
LFFSVKLGWLPASGRSTVGTE

SEQ ID NO: 316006 - protein, 20 aa, Mycobacterium
LFGELEFWASLIKVLALVTF

SEQ ID NO: 316007 - protein, 22 aa, Mycobacterium
LFGGKVSYLALLVLVLIALLIG

SEQ ID NO: 316008 - protein, 18 aa, Mycobacterium
LFGGLGMTFVGGSVAVSG

SEQ ID NO: 316009 - protein, 24 aa, Mycobacterium
LFGGRGRLAGTFLGALVIAVLGNG

SEQ ID NO: 316010 - protein, 30 aa, Mycobacterium
LFGIVFSLFCFLGFPVLLGGIIWAIVDAIL

SEQ ID NO: 316011 - protein, 25 aa, Mycobacterium
LFGLNLWWSLLAFVVGHVIGGALMA

SEQ ID NO: 316012 - protein, 18 aa, Mycobacterium
LFGLSWPLRHRVVPNEAT

SEQ ID NO: 316013 - protein, 19 aa, Mycobacterium
LFGRNVMFLAVLFAVGMNA

SEQ ID NO: 316014 - protein, 18 aa, Mycobacterium
LFGSAFGTYLMRQFFRTL

SEQ ID NO: 316015 - protein, 23 aa, Mycobacterium
LFGTCLFVWQLAAARRGARGAQA

SEQ ID NO: 316016 - protein, 19 aa, Mycobacterium
LFGTTAMWLAVLFAVGMNV

SEQ ID NO: 316017 - protein, 25 aa, Mycobacterium
LFGVEVPNALPLILSGLRTATLQVV

SEQ ID NO: 316018 - protein, 23 aa, Mycobacterium
LFGWPDGSLSWAFVLSLLAAALA

SEQ ID NO: 316019 - protein, 19 aa, Mycobacterium
LFGYRLFPWTEVVDVSFHE

SEQ ID NO: 316020 - protein, 25 aa, Mycobacterium
LFHGHRYGVEFFAGWLTEYSLSVDN

SEQ ID NO: 316021 - protein, 17 aa, Mycobacterium
LFHVISGNLGYQVEHHL

SEQ ID NO: 316022 - protein, 19 aa, Mycobacterium
LFIAEVFHRGPGIAGLALA

SEQ ID NO: 316023 - protein, 33 aa, Mycobacterium
LFIAFDQLWRWNSIVALVLSVLVILGLVVAVRV

SEQ ID NO: 316024 - protein, 17 aa, Mycobacterium
LFIGSVLAFMLGSLLCA

SEQ ID NO: 316025 - protein, 17 aa, Mycobacterium
LFIGVLFGLLLITGTTI

SEQ ID NO: 316026 - protein, 26 aa, Mycobacterium
LFIIGRIKDLLIVYGRNHSPDDIEAT

SEQ ID NO: 316027 - protein, 25 aa, Mycobacterium
LFILTVAAALAWYLILRRRSPHVVA

SEQ ID NO: 316028 - protein, 28 aa, Mycobacterium
LFIVDWRVALVLLIPVLMYLVMTSSLAV

SEQ ID NO: 316029 - protein, 17 aa, Mycobacterium
LFIVYRSVSTVLLVLAM

SEQ ID NO: 316030 - protein, 26 aa, Mycobacterium
LFKFFTPWGRQFWRITSEYFIGPKSI

SEQ ID NO: 316031 - protein, 17 aa, Mycobacterium
LFLAVAVLVVIAAIAAI

SEQ ID NO: 316032 - protein, 17 aa, Mycobacterium
LFLCIWITGTSILMVSK

SEQ ID NO: 316033 - protein, 17 aa, Mycobacterium
LFLDLNWAAGYSTIVIA

SEQ ID NO: 316034 - protein, 17 aa, Mycobacterium
LFLGFLVLEGFDFGVGM

SEQ ID NO: 316035 - protein, 25 aa, Mycobacterium
LFLGSAFVCLAVWLGKLDRCQPQGD

SEQ ID NO: 316036 - protein, 20 aa, Mycobacterium
LFLGVWLLIWYMRNQVRDRQ

SEQ ID NO: 316037 - protein, 21 aa, Mycobacterium
LFLHTRYWWAGIAIVAVATIV

SEQ ID NO: 316038 - protein, 17 aa, Mycobacterium
LFLIAGLAITFGIQNAT

SEQ ID NO: 316039 - protein, 21 aa, Mycobacterium
LFLNYVWHYTLLQAGFAIAPA

SEQ ID NO: 316040 - protein, 22 aa, Mycobacterium
LFLPIDMWQRMFLAMSALFVVT

SEQ ID NO: 316041 - protein, 28 aa, Mycobacterium
LFLVFGGAVAACLPVMVGGLSIAGALGI

SEQ ID NO: 316042 - protein, 19 aa, Mycobacterium
LFLVLALFTLFSGTPVALA

SEQ ID NO: 316043 - protein, 24 aa, Mycobacterium
LFLVTDAAIMFGIRDADAAAALGL

SEQ ID NO: 316044 - protein, 21 aa, Mycobacterium
LFLWETILAIIAFIAKLAEFI

SEQ ID NO: 316045 - protein, 26 aa, Mycobacterium
LFMGGFLIALAMQRWNLHRRIALLTV

SEQ ID NO: 316046 - protein, 23 aa, Mycobacterium
LFMPSALALLFAMFAVPQLQLYM

SEQ ID NO: 316047 - protein, 22 aa, Mycobacterium
LFMPSTLFLMFVMFGVPQLQLW

SEQ ID NO: 316048 - protein, 17 aa, Mycobacterium
LFMRFSGIVLVFLALGH

SEQ ID NO: 316049 - protein, 23 aa, Mycobacterium
LFMVVALTLTWMVYVTLRRDVAG

SEQ ID NO: 316050 - protein, 25 aa, Mycobacterium
LFMVVSLTLTWLVYVSLRRDVAGDT

SEQ ID NO: 316051 - protein, 18 aa, Mycobacterium
LFNGPAPWHTSLTTSDFG

SEQ ID NO: 316052 - protein, 19 aa, Mycobacterium
LFNIIHLLIFAGLDTVTAS

SEQ ID NO: 316053 - protein, 19 aa, Mycobacterium
LFPDCDARTLADRFERVLS

SEQ ID NO: 316054 - protein, 19 aa, Mycobacterium
LFPPSVRATALAVCNSVGR

SEQ ID NO: 316055 - protein, 21 aa, Mycobacterium
LFPVVQPWYLLWAIIPLAAWA

SEQ ID NO: 316056 - protein, 21 aa, Mycobacterium
LFPVVQPWYLLWAIIPMAAWA

SEQ ID NO: 316057 - protein, 20 aa, Mycobacterium
LFQRGEIMVCSYVLRTGGSY

SEQ ID NO: 316058 - protein, 23 aa, Mycobacterium
LFRELRIGSMAAYRDKVAAGQAA

SEQ ID NO: 316059 - protein, 19 aa, Mycobacterium
LFRPRFIKRMFFAKFPDDL

SEQ ID NO: 316060 - protein, 28 aa, Mycobacterium
LFRPTHPRKFLGLFPFQGLLHAQREQIT

SEQ ID NO: 316061 - protein, 18 aa, Mycobacterium
LFRYPGVRSDSSIFTLSF

SEQ ID NO: 316062 - protein, 25 aa, Mycobacterium
LFSGIGKWGTLPTWTDLAALPDFLG

SEQ ID NO: 316063 - protein, 17 aa, Mycobacterium
LFSGRRWVTTLGAFILA

SEQ ID NO: 316064 - protein, 23 aa, Mycobacterium
LFSHFRPLEIVWNILTDALSTAF

SEQ ID NO: 316065 - protein, 29 aa, Mycobacterium
LFSNLPLLFAVGVAIGFARKADGSTALAA

SEQ ID NO: 316066 - protein, 19 aa, Mycobacterium
LFSPAAVRWAAGGQGDSAS

SEQ ID NO: 316067 - protein, 25 aa, Mycobacterium
LFSRLTMLLRPDWTRTVLARRIAAG

SEQ ID NO: 316068 - protein, 23 aa, Mycobacterium
LFSVLGLSGLVFFLSQYFQLVHG

SEQ ID NO: 316069 - protein, 28 aa, Mycobacterium
LFTAAGYVLWWAVLFPAISVPIIASLVL

SEQ ID NO: 316070 - protein, 17 aa, Mycobacterium
LFTALGITSVVIGLMLQ

SEQ ID NO: 316071 - protein, 30 aa, Mycobacterium
LFTCGIASIIQAVGFWKVGVRLPLLQGVTF

SEQ ID NO: 316072 - protein, 18 aa, Mycobacterium
LFTEGMAGFTIDKVAARS

SEQ ID NO: 316073 - protein, 26 aa, Mycobacterium
LFTIASVLCGIAWDEATLVIARLLQG

SEQ ID NO: 316074 - protein, 21 aa, Mycobacterium
LFTLMCMNDIIALKFHISLNA

SEQ ID NO: 316075 - protein, 18 aa, Mycobacterium
LFTRPQWIALEKSISEIV

SEQ ID NO: 316076 - protein, 20 aa, Mycobacterium
LFTRPRLRIGAAGISVRNLL

SEQ ID NO: 316077 - protein, 23 aa, Mycobacterium
LFTRRTSRLLAVIAVAALAGGLA

SEQ ID NO: 316078 - protein, 18 aa, Mycobacterium
LFTVLLIIGVSAPVSGII

SEQ ID NO: 316079 - protein, 18 aa, Mycobacterium
LFVAAMWVTYALFMGSLR

SEQ ID NO: 316080 - protein, 29 aa, Mycobacterium
LFVACARAVGRWAHRPRVWHVVAVGNGGA

SEQ ID NO: 316081 - protein, 26 aa, Mycobacterium
LFVAFAARLAHRMGRVLPDGNSVTVV

SEQ ID NO: 316082 - protein, 34 aa, Mycobacterium
LFVAFDQLWRWNSIVALVLSVLVILGLVVGVRVV

SEQ ID NO: 316083 - protein, 19 aa, Mycobacterium
LFVAFLMSYFYPIFDAGLT

SEQ ID NO: 316084 - protein, 27 aa, Mycobacterium
LFVAVEAFYLFSCRSLTHSAWRIGVLS

SEQ ID NO: 316085 - protein, 17 aa, Mycobacterium
LFVAVSLNYPFSRYDTV

SEQ ID NO: 316086 - protein, 21 aa, Mycobacterium
LFVFVDWRMHAAVLPPSVFGG

SEQ ID NO: 316087 - protein, 18 aa, Mycobacterium
LFVGAVFLFTLGSLLCAL

SEQ ID NO: 316088 - protein, 18 aa, Mycobacterium
LFVGLSFAALAIYALVPA

SEQ ID NO: 316089 - protein, 19 aa, Mycobacterium
LFVISGLLAAGAVVCLITG

SEQ ID NO: 316090 - protein, 24 aa, Mycobacterium
LFVITSLLSVLGFFAIATYRNASN

SEQ ID NO: 316091 - protein, 25 aa, Mycobacterium
LFVKLIKMMTVPVIFCTVVLGIGKV

SEQ ID NO: 316092 - protein, 26 aa, Mycobacterium
LFVLGFLRFGLPPSDRVELTELGPTR

SEQ ID NO: 316093 - protein, 28 aa, Mycobacterium
LFVLSGMAVGWWVIQRNYYVTEYDGKVS

SEQ ID NO: 316094 - protein, 17 aa, Mycobacterium
LFVMFVITAITMQRERA

SEQ ID NO: 316095 - protein, 25 aa, Mycobacterium
LFVPAALPWYYSWPLAVAAPLAQSR

SEQ ID NO: 316096 - protein, 25 aa, Mycobacterium
LFVPAALPWYYSWPLAVVAPLAQSR

SEQ ID NO: 316097 - protein, 19 aa, Mycobacterium
LFVPEVVLSFTPFHADAAM

SEQ ID NO: 316098 - protein, 23 aa, Mycobacterium
LFVPKLRHWLATAVRPRLKEVLD

SEQ ID NO: 316099 - protein, 26 aa, Mycobacterium
LFVPTLRRWLSTEVRPKLNEVVGDLV

SEQ ID NO: 316100 - protein, 18 aa, Mycobacterium
LFVRSRLIDAAREQADRG

SEQ ID NO: 316101 - protein, 18 aa, Mycobacterium
LFVRSRLVDAAREQAEKG

SEQ ID NO: 316102 - protein, 21 aa, Mycobacterium
LFVSFGVTWFLAHGMTSPLRD

SEQ ID NO: 316103 - protein, 17 aa, Mycobacterium
LFVSWWIAGARYLMAND

SEQ ID NO: 316104 - protein, 24 aa, Mycobacterium
LFVTRTGGVWAFIAVLAVAFFLAS

SEQ ID NO: 316105 - protein, 19 aa, Mycobacterium
LFVVAGVVWWVRQGLAESQ

SEQ ID NO: 316106 - protein, 19 aa, Mycobacterium
LFVVARRWVLALLAVALTV

SEQ ID NO: 316107 - protein, 25 aa, Mycobacterium
LFVVDWRVALVLFAPVLVYLVLTSS

SEQ ID NO: 316108 - protein, 27 aa, Mycobacterium
LFVVDWRVALVLFLPVLVYLVLTSSLT

SEQ ID NO: 316109 - protein, 22 aa, Mycobacterium
LFVVLPLVWAMNSLGWQTGSQA

SEQ ID NO: 316110 - protein, 24 aa, Mycobacterium
LFWQDILGIALHWLVLPMSVIVLL

SEQ ID NO: 316111 - protein, 25 aa, Mycobacterium
LFWQHLVGLHLHWLVLPLTFIILVA

SEQ ID NO: 316112 - protein, 17 aa, Mycobacterium
LFYGEGTSMLFGDAKKS

SEQ ID NO: 316113 - protein, 20 aa, Mycobacterium
LFYLPPEIFQNSDFQLGLSL

SEQ ID NO: 316114 - protein, 17 aa, Mycobacterium
LFYNVVSALTFLVGALL

SEQ ID NO: 316115 - protein, 18 aa, Mycobacterium
LFYPVMIVLVGINAMSVI

SEQ ID NO: 316116 - protein, 24 aa, Mycobacterium
LFYTGYCVLLLLASTLVIIRMPET

SEQ ID NO: 316117 - protein, 19 aa, Mycobacterium
LFYVGAALLTWSRYGRRAV

SEQ ID NO: 316118 - protein, 17 aa, Mycobacterium
LGAAFAFAILASIVIDF

SEQ ID NO: 316119 - protein, 18 aa, Mycobacterium
LGAAIAVALGLWPRLKEY

SEQ ID NO: 316120 - protein, 18 aa, Mycobacterium
LGAAIAVALGLWPRLREY

SEQ ID NO: 316121 - protein, 20 aa, Mycobacterium
LGAALRYAALEKDAVIVAAA

SEQ ID NO: 316122 - protein, 30 aa, Mycobacterium
LGAAPRMSIALARLSPRFATTDFADPGPSD

SEQ ID NO: 316123 - protein, 18 aa, Mycobacterium
LGAAVSVVLPGVVIPIAS

SEQ ID NO: 316124 - protein, 17 aa, Mycobacterium
LGAAVWLLTRLSVTESK

SEQ ID NO: 316125 - protein, 19 aa, Mycobacterium
LGAAWRIMHAIPAAKAARR

SEQ ID NO: 316126 - protein, 20 aa, Mycobacterium
LGADEISAWARVDDTGVGID

SEQ ID NO: 316127 - protein, 17 aa, Mycobacterium
LGAELLAAVGDPALIGS

SEQ ID NO: 316128 - protein, 33 aa, Mycobacterium
LGAELVFAAFLYRRWNLPVAVLAGAAAGVALAV

SEQ ID NO: 316129 - protein, 42 aa, Mycobacterium
LGAEPRLAVPSVYARLVLLWFLCSAFPIAVIASLVVLRSYGW

SEQ ID NO: 316130 - protein, 18 aa, Mycobacterium
LGAFAERAATVGTLKAGQ

SEQ ID NO: 316131 - protein, 18 aa, Mycobacterium
LGAFAFGVAKQAHYLPVL

SEQ ID NO: 316132 - protein, 17 aa, Mycobacterium
LGAFALVLTGYVINDAV

SEQ ID NO: 316133 - protein, 20 aa, Mycobacterium
LGAFILALAPGWFGVLAAIQ

SEQ ID NO: 316134 - protein, 17 aa, Mycobacterium
LGAGALVMIGGTVGVAA

SEQ ID NO: 316135 - protein, 18 aa, Mycobacterium
LGAGAPLFTVFTHDATDT

SEQ ID NO: 316136 - protein, 18 aa, Mycobacterium
LGAGEYKTSIPLRTPADD

SEQ ID NO: 316137 - protein, 24 aa, Mycobacterium
LGAGLPALFALGVRLQAAGAGAIG

SEQ ID NO: 316138 - protein, 32 aa, Mycobacterium
LGAIGLIEWPVLLAVGGGALVLQRIARQQKES

SEQ ID NO: 316139 - protein, 33 aa, Mycobacterium
LGAIPLPHLDAGPFLSYGIQWIAFGIIAPIGLG

SEQ ID NO: 316140 - protein, 32 aa, Mycobacterium
LGAIPLPQLDAGPFLSYGIQWIAFGILAPIGL

SEQ ID NO: 316141 - protein, 17 aa, Mycobacterium
LGAKIGRGVWCETYWLP

SEQ ID NO: 316142 - protein, 19 aa, Mycobacterium
LGALCFPRGKTHPKPVTIG

SEQ ID NO: 316143 - protein, 25 aa, Mycobacterium
LGALFIIIWRCWRVLGFSANAPLAI

SEQ ID NO: 316144 - protein, 29 aa, Mycobacterium
LGALGALIVALVIYAVIQLFSSDDSSSTT

SEQ ID NO: 316145 - protein, 17 aa, Mycobacterium
LGALGLVKRFAKGLVVR

SEQ ID NO: 316146 - protein, 21 aa, Mycobacterium
LGALLMLPGVRGLGPGPVTTG

SEQ ID NO: 316147 - protein, 26 aa, Mycobacterium
LGALLRRLEPDWSMTVIERLDAVAAE

SEQ ID NO: 316148 - protein, 26 aa, Mycobacterium
LGALLRRLQPEWSLTFVERLDAVAAE

SEQ ID NO: 316149 - protein, 24 aa, Mycobacterium
LGALPPERRASAALPVGGGGAAEA

SEQ ID NO: 316150 - protein, 20 aa, Mycobacterium
LGALPPGWVLWRRQVRDRPN

SEQ ID NO: 316151 - protein, 20 aa, Mycobacterium
LGALRLHARLSARRLLPALA

SEQ ID NO: 316152 - protein, 27 aa, Mycobacterium
LGALRQCLRLLPLTCAFIGVAVAGCLV

SEQ ID NO: 316153 - protein, 24 aa, Mycobacterium
LGALRVNWALGLQLFDYTGETAPG

SEQ ID NO: 316154 - protein, 19 aa, Mycobacterium
LGALTFLPTFMQFVDGVSA

SEQ ID NO: 316155 - protein, 18 aa, Mycobacterium
LGALVLGVADWWRRDAAT

SEQ ID NO: 316156 - protein, 17 aa, Mycobacterium
LGALWWSAMPAYLNASN

SEQ ID NO: 316157 - protein, 18 aa, Mycobacterium
LGAMASWSVLGVLLSLYP

SEQ ID NO: 316158 - protein, 17 aa, Mycobacterium
LGAMIEFIAIVRTVAAI

SEQ ID NO: 316159 - protein, 29 aa, Mycobacterium
LGANIYWLGEQWWRPLIAVGAVALGITVI

SEQ ID NO: 316160 - protein, 23 aa, Mycobacterium
LGANWRTCAIAALTAATIDRLGR

SEQ ID NO: 316161 - protein, 17 aa, Mycobacterium
LGAPSTIAMPLAGDPSA

SEQ ID NO: 316162 - protein, 24 aa, Mycobacterium
LGARLPAMPVYAWDPNARGTEDSS

SEQ ID NO: 316163 - protein, 25 aa, Mycobacterium
LGARPDAPGDVYLVGASPELAQVAD

SEQ ID NO: 316164 - protein, 18 aa, Mycobacterium
LGARRMYFAAVGIWSVAT

SEQ ID NO: 316165 - protein, 21 aa, Mycobacterium
LGARVGIAVVVVLAVLTGWLG

SEQ ID NO: 316166 - protein, 28 aa, Mycobacterium
LGASAFWRLRREHVRLVAVGAVIAVVAA

SEQ ID NO: 316167 - protein, 25 aa, Mycobacterium
LGASFPALLPVVLAAAVWNGAFGGI

SEQ ID NO: 316168 - protein, 29 aa, Mycobacterium
LGASGSWIPYYLCELSMRVSDLQYRTVVV

SEQ ID NO: 316169 - protein, 23 aa, Mycobacterium
LGASKLRGAISLFLGLAIGCVGI

SEQ ID NO: 316170 - protein, 18 aa, Mycobacterium
LGATFALVEMRVVLREIL

SEQ ID NO: 316171 - protein, 23 aa, Mycobacterium
LGAVAVIVLVNWISERTRLPSAP

SEQ ID NO: 316172 - protein, 24 aa, Mycobacterium
LGAVCSLAMIVPAARWQRQIAALM

SEQ ID NO: 316173 - protein, 18 aa, Mycobacterium
LGAVFVHWLIFQSLYRIG

SEQ ID NO: 316174 - protein, 19 aa, Mycobacterium
LGAVGIWKAGMFHVLIAVA

SEQ ID NO: 316175 - protein, 18 aa, Mycobacterium
LGAVVFYLALKYTGEFLL

SEQ ID NO: 316176 - protein, 17 aa, Mycobacterium
LGAVVVPVVHFYGRKEL

SEQ ID NO: 316177 - protein, 25 aa, Mycobacterium
LGAWARFAGVAWPRGGKLAHVAVAG

SEQ ID NO: 316178 - protein, 19 aa, Mycobacterium
LGAWLPGQLLQGLGVGATL

SEQ ID NO: 316179 - protein, 28 aa, Mycobacterium
LGCGEGGDAVWLAERGWRVTAVDISHTA

SEQ ID NO: 316180 - protein, 22 aa, Mycobacterium
LGCKRPSFHNSYLATYNRSNVS

SEQ ID NO: 316181 - protein, 23 aa, Mycobacterium
LGCLPMLAQVPVFLGLYHTLMSF

SEQ ID NO: 316182 - protein, 17 aa, Mycobacterium
LGCTLFHLLTGHAPFSD

SEQ ID NO: 316183 - protein, 17 aa, Mycobacterium
LGCTPLDPVGWAQALGA

SEQ ID NO: 316184 - protein, 24 aa, Mycobacterium
LGDAGWPDSVFVFSLYAFLCATAL

SEQ ID NO: 316185 - protein, 19 aa, Mycobacterium
LGDARLFTQFVIRSAAAGA

SEQ ID NO: 316186 - protein, 22 aa, Mycobacterium
LGDEAWVPRRGRGRDGQQPSDS

SEQ ID NO: 316187 - protein, 17 aa, Mycobacterium
LGDHTFALIAIGLIGTW

SEQ ID NO: 316188 - protein, 18 aa, Mycobacterium
LGDLAMLLILVASLSAIG

SEQ ID NO: 316189 - protein, 22 aa, Mycobacterium
LGDLLSRPGVFVFGSNDYFGPR

SEQ ID NO: 316190 - protein, 24 aa, Mycobacterium
LGDLVIFGGYFVIFMIYRAMNPDE

SEQ ID NO: 316191 - protein, 24 aa, Mycobacterium
LGDPRAVAGVGFLLVFMLPALAGY

SEQ ID NO: 316192 - protein, 17 aa, Mycobacterium
LGDRADMVFKGTAVTTG

SEQ ID NO: 316193 - protein, 23 aa, Mycobacterium
LGDRIGRQRVLAIVILLMSASTL

SEQ ID NO: 316194 - protein, 25 aa, Mycobacterium
LGDRLGRKRVLAITILMMAGATLCV

SEQ ID NO: 316195 - protein, 25 aa, Mycobacterium
LGDRLGRKRVLAMTILLMAGATFCV

SEQ ID NO: 316196 - protein, 23 aa, Mycobacterium
LGDRLGRQRVLAIVILLMSAATL

SEQ ID NO: 316197 - protein, 20 aa, Mycobacterium
LGDRLMRRPGRHRADGDGRD

SEQ ID NO: 316198 - protein, 25 aa, Mycobacterium
LGDSARDGLGWLVVAGFAVAVSATL

SEQ ID NO: 316199 - protein, 26 aa, Mycobacterium
LGDSARPGMGWLVAVAFLGAVVSAVA

SEQ ID NO: 316200 - protein, 20 aa, Mycobacterium
LGDSRTDLFGTIKNLQTLVD

SEQ ID NO: 316201 - protein, 26 aa, Mycobacterium
LGDSYSGDTWRMWSYAWEARDTGFHT

SEQ ID NO: 316202 - protein, 18 aa, Mycobacterium
LGDTFRWKGENVATTEVE

SEQ ID NO: 316203 - protein, 19 aa, Mycobacterium
LGDVRFELFVTVAATCVAS

SEQ ID NO: 316204 - protein, 22 aa, Mycobacterium
LGDVWRCLRCGDFTLGEPHGRG

SEQ ID NO: 316205 - protein, 27 aa, Mycobacterium
LGEAIPLRFVTGFALAGVYPVGMKLMA

SEQ ID NO: 316206 - protein, 27 aa, Mycobacterium
LGEHRLRKGAAAAVVDWVRGEGGTVPV

SEQ ID NO: 316207 - protein, 24 aa, Mycobacterium
LGEIAEGALLLFLFSVGHALEGYA

SEQ ID NO: 316208 - protein, 17 aa, Mycobacterium
LGEIERLSIIGGAGDAQ

SEQ ID NO: 316209 - protein, 18 aa, Mycobacterium
LGELKGVVADLQITAHAA

SEQ ID NO: 316210 - protein, 27 aa, Mycobacterium
LGELLTCPFCLDMWVATALVIGLIFAP

SEQ ID NO: 316211 - protein, 32 aa, Mycobacterium
LGELLTCPFCLDMWVATGFAIGLVFAPRYTRL

SEQ ID NO: 316212 - protein, 41 aa, Mycobacterium
LGELLTCPFCLDMWVATGFAIGLVFVPRFTRLIAGVFSALA

SEQ ID NO: 316213 - protein, 22 aa, Mycobacterium
LGELRPAFDDIRPLRHGSIDDA

SEQ ID NO: 316214 - protein, 29 aa, Mycobacterium
LGENDMQAWGWRLPFLVAAPLGLVGIYLR

SEQ ID NO: 316215 - protein, 19 aa, Mycobacterium
LGENPKLILLGVGLGVAAV

SEQ ID NO: 316216 - protein, 19 aa, Mycobacterium
LGEQLRTLITVPLFHVTGC

SEQ ID NO: 316217 - protein, 19 aa, Mycobacterium
LGEQPALWIPGSSISSARL

SEQ ID NO: 316218 - protein, 18 aa, Mycobacterium
LGETLPFDAGKILGLGLA

SEQ ID NO: 316219 - protein, 18 aa, Mycobacterium
LGETYAHASPDLWDALEH

SEQ ID NO: 316220 - protein, 17 aa, Mycobacterium
LGEVKRRGATTFEVTEE

SEQ ID NO: 316221 - protein, 17 aa, Mycobacterium
LGFAHILAYDHVVGADT

SEQ ID NO: 316222 - protein, 17 aa, Mycobacterium
LGFALVFLVARAFSSGS

SEQ ID NO: 316223 - protein, 27 aa, Mycobacterium
LGFAQLPGAPGFRLPTVASPGFPDFGA

SEQ ID NO: 316224 - protein, 25 aa, Mycobacterium
LGFAVARPRGWPEALAAIPAALILV

SEQ ID NO: 316225 - protein, 25 aa, Mycobacterium
LGFAVARPRGWPEALAAVPAAVILI

SEQ ID NO: 316226 - protein, 25 aa, Mycobacterium
LGFDGALPWPAKIGLALSVGLLGGV

SEQ ID NO: 316227 - protein, 25 aa, Mycobacterium
LGFDGGLNWLGKIGVALSVGVLGGV

SEQ ID NO: 316228 - protein, 25 aa, Mycobacterium
LGFEGGLSWAGKIGVALSVGVLGGV

SEQ ID NO: 316229 - protein, 18 aa, Mycobacterium
LGFGCGSGPLTGRFMPPV

SEQ ID NO: 316230 - protein, 17 aa, Mycobacterium
LGFGVLGAMTLRRIALP

SEQ ID NO: 316231 - protein, 18 aa, Mycobacterium
LGFLTVFGVFGALTVSAA

SEQ ID NO: 316232 - protein, 26 aa, Mycobacterium
LGFPFTDHGLRLGVEASLRSLARVAP

SEQ ID NO: 316233 - protein, 17 aa, Mycobacterium
LGFQSEFRRDMSPWANF

SEQ ID NO: 316234 - protein, 20 aa, Mycobacterium
LGFRPLKAAVLALVANTAPV

SEQ ID NO: 316235 - protein, 19 aa, Mycobacterium
LGFTRMPIFQTMGMPCAVG

SEQ ID NO: 316236 - protein, 25 aa, Mycobacterium
LGFVAMALAWRWGGTVKAFVISCTS

SEQ ID NO: 316237 - protein, 24 aa, Mycobacterium
LGFVMPGDIPFQVQLPPGAVVAPQ

SEQ ID NO: 316238 - protein, 24 aa, Mycobacterium
LGFVMPGDIPFQVQLPPTAAVSPQ

SEQ ID NO: 316239 - protein, 24 aa, Mycobacterium
LGFYSPHSWWPIMIALAAATTAVG

SEQ ID NO: 316240 - protein, 19 aa, Mycobacterium
LGGAFYRSLKLSWHADLLS

SEQ ID NO: 316241 - protein, 18 aa, Mycobacterium
LGGALGFGAQRVVQDLLS

SEQ ID NO: 316242 - protein, 22 aa, Mycobacterium
LGGARLLLRLPINRSRGDDASF

SEQ ID NO: 316243 - protein, 20 aa, Mycobacterium
LGGATGELGAPVADQTESGN

SEQ ID NO: 316244 - protein, 25 aa, Mycobacterium
LGGATWRAVWIPAVVVLIGVVVLLA

SEQ ID NO: 316245 - protein, 23 aa, Mycobacterium
LGGDGLALTGFVERTGDPVPIVA

SEQ ID NO: 316246 - protein, 18 aa, Mycobacterium
LGGDLWLSSPGDPAAPLR

SEQ ID NO: 316247 - protein, 17 aa, Mycobacterium
LGGEIMAAGGISRRLIA

SEQ ID NO: 316248 - protein, 19 aa, Mycobacterium
LGGETDWAPGLVALAVLWS

SEQ ID NO: 316249 - protein, 33 aa, Mycobacterium
LGGFCTDYLHWRWAFWINLPISIVVLAVTATAI

SEQ ID NO: 316250 - protein, 19 aa, Mycobacterium
LGGFIRTQALVSFVDAVLI

SEQ ID NO: 316251 - protein, 20 aa, Mycobacterium
LGGFLVPLAYAWSKAQFGSI

SEQ ID NO: 316252 - protein, 17 aa, Mycobacterium
LGGGARAVGSFFGGRIG

SEQ ID NO: 316253 - protein, 25 aa, Mycobacterium
LGGGARLLLPIVLGVLLGGSAAAGT

SEQ ID NO: 316254 - protein, 19 aa, Mycobacterium
LGGGRVAFTAGFPALSPVM

SEQ ID NO: 316255 - protein, 18 aa, Mycobacterium
LGGGVFGLSLGKHVTQSG

SEQ ID NO: 316256 - protein, 19 aa, Mycobacterium
LGGGWWVALAELWPASSRP

SEQ ID NO: 316257 - protein, 19 aa, Mycobacterium
LGGIAVVLSLAFIAIWATL

SEQ ID NO: 316258 - protein, 20 aa, Mycobacterium
LGGIGVMFAVYGRWSQKVGW

SEQ ID NO: 316259 - protein, 19 aa, Mycobacterium
LGGIVVEWRMRRRNTVSAA

SEQ ID NO: 316260 - protein, 24 aa, Mycobacterium
LGGLALAVAVLWWLSVQRDRRQAD

SEQ ID NO: 316261 - protein, 26 aa, Mycobacterium
LGGLGDIASYCLLAAALDKGSVMLVT

SEQ ID NO: 316262 - protein, 18 aa, Mycobacterium
LGGLLIVVVALFLGVDPS

SEQ ID NO: 316263 - protein, 18 aa, Mycobacterium
LGGLLVLPGYRASFDDRN

SEQ ID NO: 316264 - protein, 20 aa, Mycobacterium
LGGLLVLPGYRASFDDRNYL

SEQ ID NO: 316265 - protein, 17 aa, Mycobacterium
LGGLMLMVTGLQVLCAL

SEQ ID NO: 316266 - protein, 39 aa, Mycobacterium
LGGLNYLLCWGLLYQLGICWQAGLLSGRRPIVLAAGSAV

SEQ ID NO: 316267 - protein, 18 aa, Mycobacterium
LGGLPALDSPEIRRDIAA

SEQ ID NO: 316268 - protein, 30 aa, Mycobacterium
LGGLPLMLGALWASARLARRADSTAAEANS

SEQ ID NO: 316269 - protein, 17 aa, Mycobacterium
LGGLRCRASRIVLHPGF

SEQ ID NO: 316270 - protein, 19 aa, Mycobacterium
LGGLTRKAKEIVISTKMSQ

SEQ ID NO: 316271 - protein, 18 aa, Mycobacterium
LGGMLLSGMLTVIVGRAV

SEQ ID NO: 316272 - protein, 20 aa, Mycobacterium
LGGNRPRWLGADIGQRQFYR

SEQ ID NO: 316273 - protein, 23 aa, Mycobacterium
LGGPTGYSGWWWLVAGVCAGAVI

SEQ ID NO: 316274 - protein, 17 aa, Mycobacterium
LGGPVGFAGTITNGTVP

SEQ ID NO: 316275 - protein, 19 aa, Mycobacterium
LGGQPALWIPGSSISAARL

SEQ ID NO: 316276 - protein, 17 aa, Mycobacterium
LGGRPGPGFAARDPKLS

SEQ ID NO: 316277 - protein, 17 aa, Mycobacterium
LGGTVMCRRRFDAQQAM

SEQ ID NO: 316278 - protein, 21 aa, Mycobacterium
LGGVARRWRLLGWSATIGALA

SEQ ID NO: 316279 - protein, 19 aa, Mycobacterium
LGGVEGWTALGCFLAALLA

SEQ ID NO: 316280 - protein, 30 aa, Mycobacterium
LGGVPLLLGALWASARLARRADAAADEANG

SEQ ID NO: 316281 - protein, 28 aa, Mycobacterium
LGGVRRLRWRLATMLAIAAGTYAVLYGV

SEQ ID NO: 316282 - protein, 17 aa, Mycobacterium
LGGVVFGHFGDKYGRKK

SEQ ID NO: 316283 - protein, 18 aa, Mycobacterium
LGGVYDRLAARGYEYGPA

SEQ ID NO: 316284 - protein, 18 aa, Mycobacterium
LGGWPSLIVSIWMLGGLT

SEQ ID NO: 316285 - protein, 18 aa, Mycobacterium
LGGWWPVVLAGGVLVAAV

SEQ ID NO: 316286 - protein, 30 aa, Mycobacterium
LGGYFTDHFTWRWAFWINVPISVVVFFVAA

SEQ ID NO: 316287 - protein, 30 aa, Mycobacterium
LGGYFTDYLTWRWAFWINVPISVVVILVAA

SEQ ID NO: 316288 - protein, 29 aa, Mycobacterium
LGGYFTDYLTWRWAFWVNVPISVVVIFVA

SEQ ID NO: 316289 - protein, 28 aa, Mycobacterium
LGGYGHAREVWWMLAAQLVIVLALIAVL

SEQ ID NO: 316290 - protein, 18 aa, Mycobacterium
LGGYLSSVQIDWSLALAV

SEQ ID NO: 316291 - protein, 18 aa, Mycobacterium
LGHALSGHAVYRTMMMHL

SEQ ID NO: 316292 - protein, 21 aa, Mycobacterium
LGHATDLLFAGMMGRQLPAGT

SEQ ID NO: 316293 - protein, 21 aa, Mycobacterium
LGHATDLLFNGVIGRQLPAGI

SEQ ID NO: 316294 - protein, 18 aa, Mycobacterium
LGHLAFSVLDEWLQPVSV

SEQ ID NO: 316295 - protein, 22 aa, Mycobacterium
LGHPEHLRRLYAEVDGLAGALP

SEQ ID NO: 316296 - protein, 23 aa, Mycobacterium
LGHVVPLPIMLWLKGIDGPIEEF

SEQ ID NO: 316297 - protein, 17 aa, Mycobacterium
LGIAILLGGNWLVCLLA

SEQ ID NO: 316298 - protein, 27 aa, Mycobacterium
LGIARRAGTPISFWEFTRKGVVVTAVS

SEQ ID NO: 316299 - protein, 17 aa, Mycobacterium
LGIDPSLIDSPPMETPD

SEQ ID NO: 316300 - protein, 17 aa, Mycobacterium
LGIDRFLLVQWLAPLAS

SEQ ID NO: 316301 - protein, 19 aa, Mycobacterium
LGIELHWLVLAMSVIILLA

SEQ ID NO: 316302 - protein, 18 aa, Mycobacterium
LGIELHWMTMAFSVIVLL

SEQ ID NO: 316303 - protein, 21 aa, Mycobacterium
LGIEMYRWWRSPSVGPDGARP

SEQ ID NO: 316304 - protein, 20 aa, Mycobacterium
LGIFEIVSSFGIRKASQTLT

SEQ ID NO: 316305 - protein, 21 aa, Mycobacterium
LGIFSALSFWYVPKLGLRLVL

SEQ ID NO: 316306 - protein, 17 aa, Mycobacterium
LGIHLDPATPFSVTVSF

SEQ ID NO: 316307 - protein, 22 aa, Mycobacterium
LGIKGSALMDLLFVAGIVTAIL

SEQ ID NO: 316308 - protein, 22 aa, Mycobacterium
LGILSALSFWYVPKLGLRLVLL

SEQ ID NO: 316309 - protein, 17 aa, Mycobacterium
LGIPLAIGMTVVVLTAL

SEQ ID NO: 316310 - protein, 37 aa, Mycobacterium
LGIPLLVLAWMFRQRVLRLPFSRPLATYAISASPDGV

SEQ ID NO: 316311 - protein, 17 aa, Mycobacterium
LGIPSALGLLVVVAGAM

SEQ ID NO: 316312 - protein, 20 aa, Mycobacterium
LGIRICIVAAVVAALVVVEY

SEQ ID NO: 316313 - protein, 25 aa, Mycobacterium
LGISRGIWRYCERLAGHDIALRGAA

SEQ ID NO: 316314 - protein, 24 aa, Mycobacterium
LGISRISLNFAMFRSAFEQGAQLG

SEQ ID NO: 316315 - protein, 17 aa, Mycobacterium
LGITGPVLRSTGLPHDL

SEQ ID NO: 316316 - protein, 18 aa, Mycobacterium
LGITICSILLGRVAEPAV

SEQ ID NO: 316317 - protein, 18 aa, Mycobacterium
LGITICSILLGRVGEPAV

SEQ ID NO: 316318 - protein, 24 aa, Mycobacterium
LGITRISLNFAMFRSAFEQGAQLG

SEQ ID NO: 316319 - protein, 17 aa, Mycobacterium
LGIVAGVAFVFFGLWTL

SEQ ID NO: 316320 - protein, 17 aa, Mycobacterium
LGIVGWIVLVAFTDGGV

SEQ ID NO: 316321 - protein, 25 aa, Mycobacterium
LGIVIVSLIGWWALSRLLERMRGIP

SEQ ID NO: 316322 - protein, 27 aa, Mycobacterium
LGIWVFKPLRLRATASIAEFDERRRKD

SEQ ID NO: 316323 - protein, 33 aa, Mycobacterium
LGKALYRFALRNRTWWPPPNWVLLWAKTLIVGG

SEQ ID NO: 316324 - protein, 18 aa, Mycobacterium
LGKFGCLLLGYAGAVLLH

SEQ ID NO: 316325 - protein, 17 aa, Mycobacterium
LGKKLLGMRVHGPPGAE

SEQ ID NO: 316326 - protein, 22 aa, Mycobacterium
LGKLHFWLTLIGFHTTFLVQHW

SEQ ID NO: 316327 - protein, 24 aa, Mycobacterium
LGKPDPWWVFLAAFAVLVVSILPW

SEQ ID NO: 316328 - protein, 20 aa, Mycobacterium
LGKPGLELFVDVALTCVASA

SEQ ID NO: 316329 - protein, 26 aa, Mycobacterium
LGKRWGRGVAVFTQLLLLPVAWYLSV

SEQ ID NO: 316330 - protein, 22 aa, Mycobacterium
LGLAAGVFFVWWEQHTDQPALD

SEQ ID NO: 316331 - protein, 19 aa, Mycobacterium
LGLAALAMRLGWLPEGALA

SEQ ID NO: 316332 - protein, 24 aa, Mycobacterium
LGLAEVFGGLLLLLPRTTAAGALV

SEQ ID NO: 316333 - protein, 17 aa, Mycobacterium
LGLAGLSAWLITRAWQM

SEQ ID NO: 316334 - protein, 17 aa, Mycobacterium
LGLAGVYLVFAYSAFGF

SEQ ID NO: 316335 - protein, 17 aa, Mycobacterium
LGLAIAFLLSIAAAFVV

SEQ ID NO: 316336 - protein, 19 aa, Mycobacterium
LGLAIALAGVWSHFPTWLN

SEQ ID NO: 316337 - protein, 17 aa, Mycobacterium
LGLARIRRTGELGRDRA

SEQ ID NO: 316338 - protein, 26 aa, Mycobacterium
LGLCFLPSFICLGIVPVVMGLARDVF

SEQ ID NO: 316339 - protein, 18 aa, Mycobacterium
LGLCGVAAGWGWADGVAG

SEQ ID NO: 316340 - protein, 17 aa, Mycobacterium
LGLDRALPIQFFDYLGG

SEQ ID NO: 316341 - protein, 21 aa, Mycobacterium
LGLDVHRFRAAMFVVVALMVG

SEQ ID NO: 316342 - protein, 23 aa, Mycobacterium
LGLELCIVSAPLGACVLSCVERG

SEQ ID NO: 316343 - protein, 20 aa, Mycobacterium
LGLFPLFVMFVITAITMQRE

SEQ ID NO: 316344 - protein, 22 aa, Mycobacterium
LGLGAALTFLGLRMQRPGHPAP

SEQ ID NO: 316345 - protein, 26 aa, Mycobacterium
LGLGGWASVHLFGFPALDNTAPLFAF

SEQ ID NO: 316346 - protein, 24 aa, Mycobacterium
LGLGMPKTAPWEIVRLLVDGPVLS

SEQ ID NO: 316347 - protein, 25 aa, Mycobacterium
LGLGREHWKPGLGYALAAVAVVASV

SEQ ID NO: 316348 - protein, 19 aa, Mycobacterium
LGLHGGAWAGLLCLLVGSS

SEQ ID NO: 316349 - protein, 24 aa, Mycobacterium
LGLHIPLWLGYAFSTLLIFPLVIY

SEQ ID NO: 316350 - protein, 17 aa, Mycobacterium
LGLIAGAMFIFFGLWTL

SEQ ID NO: 316351 - protein, 23 aa, Mycobacterium
LGLLIFAAVSWRCRPKLRLADDG

SEQ ID NO: 316352 - protein, 18 aa, Mycobacterium
LGLLLMIIGFHAIDFTTP

SEQ ID NO: 316353 - protein, 48 aa, Mycobacterium
LGLLSMAAPMLFGGAWAGWLAFAATVPVQFVAGWPFLVGAVQQARAGS

SEQ ID NO: 316354 - protein, 26 aa, Mycobacterium
LGLLVIAIMVAWRWAPAKAAAVPGPL

SEQ ID NO: 316355 - protein, 26 aa, Mycobacterium
LGLLVIAIMVAWRWAPAKVAPVPGPL

SEQ ID NO: 316356 - protein, 23 aa, Mycobacterium
LGLLWPHIHLPHAWGIAAVALIV

SEQ ID NO: 316357 - protein, 24 aa, Mycobacterium
LGLLWWMMVCWAQPVRNRPDKNVF

SEQ ID NO: 316358 - protein, 24 aa, Mycobacterium
LGLLWWMMVCWSQPLRGRSDHPVF

SEQ ID NO: 316359 - protein, 26 aa, Mycobacterium
LGLLWYAGLPLKVFVSSLFAVVASAI

SEQ ID NO: 316360 - protein, 19 aa, Mycobacterium
LGLMLGRARREGIESWKAA

SEQ ID NO: 316361 - protein, 23 aa, Mycobacterium
LGLMRAIICQLAFSHGPDHVQMV

SEQ ID NO: 316362 - protein, 22 aa, Mycobacterium
LGLMRAIICQLTFSHGPDHVQF

SEQ ID NO: 316363 - protein, 22 aa, Mycobacterium
LGLMRAIICQLTFSHGPDHVQL

SEQ ID NO: 316364 - protein, 24 aa, Mycobacterium
LGLMRAILCELVFFHGPDHLRLVV

SEQ ID NO: 316365 - protein, 24 aa, Mycobacterium
LGLMRAIVCQLAFSHGPDHVRMIV

SEQ ID NO: 316366 - protein, 23 aa, Mycobacterium
LGLPAPVPAPWPILRTLPAGPEL

SEQ ID NO: 316367 - protein, 23 aa, Mycobacterium
LGLPFFILIGLILARQWKLLGAY

SEQ ID NO: 316368 - protein, 27 aa, Mycobacterium
LGLPGFRHSIGLARWWHLGVDVLWLVN

SEQ ID NO: 316369 - protein, 21 aa, Mycobacterium
LGLPGSDRVDVYWHRMGVNIV

SEQ ID NO: 316370 - protein, 17 aa, Mycobacterium
LGLPPFRVPAPRNSAQH

SEQ ID NO: 316371 - protein, 22 aa, Mycobacterium
LGLPPWMVFFGFSVSLIYQFWV

SEQ ID NO: 316372 - protein, 24 aa, Mycobacterium
LGLPQILLCWAMEPLLQALCVVSA

SEQ ID NO: 316373 - protein, 17 aa, Mycobacterium
LGLQIPFGTVWAEEAAF

SEQ ID NO: 316374 - protein, 17 aa, Mycobacterium
LGLQRFPTIDVISEELF

SEQ ID NO: 316375 - protein, 23 aa, Mycobacterium
LGLRSFNYFGWFFLVPGVLAAAV

SEQ ID NO: 316376 - protein, 20 aa, Mycobacterium
LGLRVYLGWITSTGYTYGAL

SEQ ID NO: 316377 - protein, 26 aa, Mycobacterium
LGLSERRRSRRAWAAIGSVAATLLAL

SEQ ID NO: 316378 - protein, 17 aa, Mycobacterium
LGLSIGATNLAAVTADS

SEQ ID NO: 316379 - protein, 25 aa, Mycobacterium
LGLSLGETGSRGMLSAGSVIPVQQT

SEQ ID NO: 316380 - protein, 24 aa, Mycobacterium
LGLSRISLNFAMFRSAFEQGAQLG

SEQ ID NO: 316381 - protein, 26 aa, Mycobacterium
LGLSSLRAGLIAGAIGLAAVLLYSLL

SEQ ID NO: 316382 - protein, 20 aa, Mycobacterium
LGLSVAKGFVEAMGGTISAG

SEQ ID NO: 316383 - protein, 19 aa, Mycobacterium
LGLTDQWLFSRISDDIMNF

SEQ ID NO: 316384 - protein, 27 aa, Mycobacterium
LGLTLLAGGGALVFLSGYVVPRVSSWL

SEQ ID NO: 316385 - protein, 18 aa, Mycobacterium
LGLVLWAPMGGWQLGRHL

SEQ ID NO: 316386 - protein, 17 aa, Mycobacterium
LGLVLWAPMGGWQLSRQ

SEQ ID NO: 316387 - protein, 17 aa, Mycobacterium
LGLVVLLLSRRRPLVQL

SEQ ID NO: 316388 - protein, 24 aa, Mycobacterium
LGLYYLRLPSLVGVGQYTLYAELP

SEQ ID NO: 316389 - protein, 17 aa, Mycobacterium
LGMAVGRIGCHLTEAPG

SEQ ID NO: 316390 - protein, 17 aa, Mycobacterium
LGMFCVIAAVALIAAIT

SEQ ID NO: 316391 - protein, 17 aa, Mycobacterium
LGMGIGWGLYGNTRSPL

SEQ ID NO: 316392 - protein, 33 aa, Mycobacterium
LGMHAAHPVAMLGFMVLISFAFVAATQAINALV

SEQ ID NO: 316393 - protein, 18 aa, Mycobacterium
LGMLAVWSRQTAGDNPGP

SEQ ID NO: 316394 - protein, 22 aa, Mycobacterium
LGMPHWLGVVLIAAIAVAYTGT

SEQ ID NO: 316395 - protein, 25 aa, Mycobacterium
LGMVCAHPPGLLNLVLVDFKGGATF

SEQ ID NO: 316396 - protein, 17 aa, Mycobacterium
LGMVCSQSATVLGYPSP

SEQ ID NO: 316397 - protein, 18 aa, Mycobacterium
LGNARLFTQFVVRSAAAG

SEQ ID NO: 316398 - protein, 18 aa, Mycobacterium
LGNFGRLGIDQGTFGPGV

SEQ ID NO: 316399 - protein, 24 aa, Mycobacterium
LGNGKFFINLPVSVPYKAVEVGST

SEQ ID NO: 316400 - protein, 27 aa, Mycobacterium
LGNGWVATICAVLLLLAGGAVAAGVLS

SEQ ID NO: 316401 - protein, 18 aa, Mycobacterium
LGNLNARKVVVLVNPTTN

SEQ ID NO: 316402 - protein, 18 aa, Mycobacterium
LGNLPVWLRYSGQIVSGY

SEQ ID NO: 316403 - protein, 29 aa, Mycobacterium
LGNLRSAPVPFILAEAAAMPPPVEGAPHL

SEQ ID NO: 316404 - protein, 25 aa, Mycobacterium
LGNLRSAPVPFILAEANPQQPAAPP

SEQ ID NO: 316405 - protein, 21 aa, Mycobacterium
LGNRQAGAFVHLPGVSEAELA

SEQ ID NO: 316406 - protein, 17 aa, Mycobacterium
LGNSWWAYPLILASCTF

SEQ ID NO: 316407 - protein, 37 aa, Mycobacterium
LGNTDLAYEFGFWAGACLPLGLALCLLITGIFFAKPM

SEQ ID NO: 316408 - protein, 24 aa, Mycobacterium
LGNVDLHAFWSAWGPNTISPQWVS

SEQ ID NO: 316409 - protein, 20 aa, Mycobacterium
LGNVSRPCVLVVADKAGHVV

SEQ ID NO: 316410 - protein, 29 aa, Mycobacterium
LGPAAGFFMGWSYWFAWIVTGIADLVAIT

SEQ ID NO: 316411 - protein, 29 aa, Mycobacterium
LGPAAGYFMGWSYWFAWIVAGIADLVAIT

SEQ ID NO: 316412 - protein, 21 aa, Mycobacterium
LGPARRAIRVAVGRRQYDQIT

SEQ ID NO: 316413 - protein, 17 aa, Mycobacterium
LGPEGTDVLFGVVNAST

SEQ ID NO: 316414 - protein, 19 aa, Mycobacterium
LGPELSRLITGTSNLAIDA

SEQ ID NO: 316415 - protein, 20 aa, Mycobacterium
LGPELSRLVSGTAKLATDSR

SEQ ID NO: 316416 - protein, 24 aa, Mycobacterium
LGPGIPLALLYAAKWYVGKIPPVP

SEQ ID NO: 316417 - protein, 17 aa, Mycobacterium
LGPGLQEKLAFVWELPD

SEQ ID NO: 316418 - protein, 24 aa, Mycobacterium
LGPGPRWWGVALLAVGAVTALYGV

SEQ ID NO: 316419 - protein, 17 aa, Mycobacterium
LGPGRRGHFGGGAPGRS

SEQ ID NO: 316420 - protein, 21 aa, Mycobacterium
LGPHEWMWWASYRESIRTAIA

SEQ ID NO: 316421 - protein, 18 aa, Mycobacterium
LGPIRVLITFPDGGAASP

SEQ ID NO: 316422 - protein, 26 aa, Mycobacterium
LGPPPTMPPALAWWAASLQLSGLSVG

SEQ ID NO: 316423 - protein, 17 aa, Mycobacterium
LGPQLGIVKRSILQDWR

SEQ ID NO: 316424 - protein, 17 aa, Mycobacterium
LGPQTGGLVTWRDLTAL

SEQ ID NO: 316425 - protein, 23 aa, Mycobacterium
LGPRAGFAAGAIQLLAYLALAAK

SEQ ID NO: 316426 - protein, 23 aa, Mycobacterium
LGPRELDIAWLIFAHLVFQEIAG

SEQ ID NO: 316427 - protein, 17 aa, Mycobacterium
LGPRLDALDVRRLLRRV

SEQ ID NO: 316428 - protein, 19 aa, Mycobacterium
LGPSLVFVVALALSMAGLA

SEQ ID NO: 316429 - protein, 26 aa, Mycobacterium
LGPVIRLPLVLGLAELLGRIPLPGSA

SEQ ID NO: 316430 - protein, 31 aa, Mycobacterium
LGPVPIRAYALCIIVGIVAALVIGDRRWQAR

SEQ ID NO: 316431 - protein, 23 aa, Mycobacterium
LGPVSARFTGLVQLAAYAALGVG

SEQ ID NO: 316432 - protein, 17 aa, Mycobacterium
LGPVWLAALGYAVACQV

SEQ ID NO: 316433 - protein, 22 aa, Mycobacterium
LGPWFWWPQRVRTRPVPAPWPR

SEQ ID NO: 316434 - protein, 30 aa, Mycobacterium
LGPWLDRLQAFDVFSSFWFTAIYVLLFISL

SEQ ID NO: 316435 - protein, 18 aa, Mycobacterium
LGPYSFRAVFAVFIVVAL

SEQ ID NO: 316436 - protein, 26 aa, Mycobacterium
LGQALGWRSAFGLVVFVGVLTLAALW

SEQ ID NO: 316437 - protein, 18 aa, Mycobacterium
LGQAVGWSDGRMIALLAA

SEQ ID NO: 316438 - protein, 21 aa, Mycobacterium
LGQFFSWIPVISLSYAQIIIG

SEQ ID NO: 316439 - protein, 25 aa, Mycobacterium
LGQGCIHSRVKFDLRHRDGLRTYRN

SEQ ID NO: 316440 - protein, 17 aa, Mycobacterium
LGQPGIDPDSLWLPMRP

SEQ ID NO: 316441 - protein, 21 aa, Mycobacterium
LGQRGKLGVRDVLFGGKVSYL

SEQ ID NO: 316442 - protein, 20 aa, Mycobacterium
LGQRQRLALARVLGSPSPVL

SEQ ID NO: 316443 - protein, 17 aa, Mycobacterium
LGQRQRLGLARALGSNA

SEQ ID NO: 316444 - protein, 17 aa, Mycobacterium
LGQRQRLGLARALGSSA

SEQ ID NO: 316445 - protein, 17 aa, Mycobacterium
LGQRQRLGLARALGSTA

SEQ ID NO: 316446 - protein, 17 aa, Mycobacterium
LGQRQRLGLARVLGSPA

SEQ ID NO: 316447 - protein, 20 aa, Mycobacterium
LGQRQRLGLVRALGAPADVL

SEQ ID NO: 316448 - protein, 22 aa, Mycobacterium
LGQTAKLYIRPVVQAVPAQPKE

SEQ ID NO: 316449 - protein, 25 aa, Mycobacterium
LGQTARLYIRPVMNSMPAQPAAQEP

SEQ ID NO: 316450 - protein, 17 aa, Mycobacterium
LGQTGPSWIGFLAALLA

SEQ ID NO: 316451 - protein, 27 aa, Mycobacterium
LGQVLRLPARFVLGALAGLRMVGLLGQ

SEQ ID NO: 316452 - protein, 28 aa, Mycobacterium
LGRDTRAAIKITTIFGSRYIDLHPTGAG

SEQ ID NO: 316453 - protein, 22 aa, Mycobacterium
LGREHWKTGAGYALAAVGVVLS

SEQ ID NO: 316454 - protein, 25 aa, Mycobacterium
LGREHWRSGAGYALGAVALVGTVIA

SEQ ID NO: 316455 - protein, 25 aa, Mycobacterium
LGREPRGVLEIAYRCPNGEPGVVKT

SEQ ID NO: 316456 - protein, 19 aa, Mycobacterium
LGRFLPIIFTLALAGSLAT

SEQ ID NO: 316457 - protein, 28 aa, Mycobacterium
LGRGAVRGLKMLMWTAVIAVVVVGLGLL

SEQ ID NO: 316458 - protein, 24 aa, Mycobacterium
LGRIDPAFNGFRIAVVSDIHLGPM

SEQ ID NO: 316459 - protein, 26 aa, Mycobacterium
LGRISPRGATPLNFFVGGLQVVTPTV

SEQ ID NO: 316460 - protein, 17 aa, Mycobacterium
LGRPLGRLIDRDNSADE

SEQ ID NO: 316461 - protein, 20 aa, Mycobacterium
LGRQHWRSGMGYALAAVAVV

SEQ ID NO: 316462 - protein, 24 aa, Mycobacterium
LGRQRLAGVPGRALRLAAAALGAG

SEQ ID NO: 316463 - protein, 27 aa, Mycobacterium
LGRRDMGVAFGWSMFNWVADVACLGFA

SEQ ID NO: 316464 - protein, 17 aa, Mycobacterium
LGRRPGITSIVISAVNT

SEQ ID NO: 316465 - protein, 24 aa, Mycobacterium
LGRSWDALCMAWRAVLAHPNEPLA

SEQ ID NO: 316466 - protein, 23 aa, Mycobacterium
LGSAGLYWLGTRWSKGTVVAAER

SEQ ID NO: 316467 - protein, 26 aa, Mycobacterium
LGSALALAGIAAWLITRAWQMPPVLD

SEQ ID NO: 316468 - protein, 25 aa, Mycobacterium
LGSALALAGVSAWLITRASQMPPVL

SEQ ID NO: 316469 - protein, 27 aa, Mycobacterium
LGSALALTAVSAWLITRAWQMPPVLHL

SEQ ID NO: 316470 - protein, 25 aa, Mycobacterium
LGSALKRYGITVLPARNGQAGLDAL

SEQ ID NO: 316471 - protein, 20 aa, Mycobacterium
LGSARAVQGLGWLRRHTRTI

SEQ ID NO: 316472 - protein, 23 aa, Mycobacterium
LGSDPFVAILGFPFIPQAMRHRY

SEQ ID NO: 316473 - protein, 25 aa, Mycobacterium
LGSFSRIGALAAIMLVFTLVFANFF

SEQ ID NO: 316474 - protein, 28 aa, Mycobacterium
LGSGAWWLARLEWELVLAVVTAALLCLL

SEQ ID NO: 316475 - protein, 26 aa, Mycobacterium
LGSGLALAGVSAWLITRAWQMPPVLD

SEQ ID NO: 316476 - protein, 25 aa, Mycobacterium
LGSGVLLRFWDWHAIFWSLGAAGLV

SEQ ID NO: 316477 - protein, 18 aa, Mycobacterium
LGSIAIELILGVALLVLA

SEQ ID NO: 316478 - protein, 17 aa, Mycobacterium
LGSIVFIVASWPVASHS

SEQ ID NO: 316479 - protein, 19 aa, Mycobacterium
LGSIWPLLVAAVITAAAAI

SEQ ID NO: 316480 - protein, 17 aa, Mycobacterium
LGSLFGLFDPKRRVKAR

SEQ ID NO: 316481 - protein, 17 aa, Mycobacterium
LGSLLIVVSTIWLTAWL

SEQ ID NO: 316482 - protein, 21 aa, Mycobacterium
LGSLLQWMFYVGLLVTVADVL

SEQ ID NO: 316483 - protein, 18 aa, Mycobacterium
LGSLLSWMFYVGLLITVA

SEQ ID NO: 316484 - protein, 23 aa, Mycobacterium
LGSLRSAWRLERRRLNRRGKSVW

SEQ ID NO: 316485 - protein, 17 aa, Mycobacterium
LGSMAGQAAFDWLPDIS

SEQ ID NO: 316486 - protein, 31 aa, Mycobacterium
LGSMLLALYWRKARPDLYDRIGSTIFDDREP

SEQ ID NO: 316487 - protein, 17 aa, Mycobacterium
LGSMYGYGISYAVASLS

SEQ ID NO: 316488 - protein, 22 aa, Mycobacterium
LGSNPWRGPPVPVGTPVQDGRN

SEQ ID NO: 316489 - protein, 23 aa, Mycobacterium
LGSPCSIGLLAVILASLTLAPAV

SEQ ID NO: 316490 - protein, 28 aa, Mycobacterium
LGSRYFRLLPRRLVERIVPKPGTGPSES

SEQ ID NO: 316491 - protein, 24 aa, Mycobacterium
LGSTDVCYLSMPMFHSNAVMAGWS

SEQ ID NO: 316492 - protein, 27 aa, Mycobacterium
LGSTLVLRRRFKPATVLADIEKHRATA

SEQ ID NO: 316493 - protein, 24 aa, Mycobacterium
LGSTLVLRRRFKPATVLEDIEKHK

SEQ ID NO: 316494 - protein, 23 aa, Mycobacterium
LGSYNPWPVALIVGIPLVTVGLA

SEQ ID NO: 316495 - protein, 21 aa, Mycobacterium
LGTAAALEFLGPLSVAVIHGR

SEQ ID NO: 316496 - protein, 23 aa, Mycobacterium
LGTACGLSVLLWQDILGLGVQWI

SEQ ID NO: 316497 - protein, 33 aa, Mycobacterium
LGTACGLSVLLWQDILGLGVQWIVIPLSMVILL

SEQ ID NO: 316498 - protein, 24 aa, Mycobacterium
LGTACGLSVLLWQDILGLGVQWVV

SEQ ID NO: 316499 - protein, 22 aa, Mycobacterium
LGTACGLSVLLWQDVLGLGVQW

SEQ ID NO: 316500 - protein, 29 aa, Mycobacterium
LGTAGADVFGRAGPYLARGATDLVGSSQL

SEQ ID NO: 316501 - protein, 24 aa, Mycobacterium
LGTFNRYWLAAAFGVTALVLSAIY

SEQ ID NO: 316502 - protein, 24 aa, Mycobacterium
LGTFNRYWLAAGFGVTALVLSAVY

SEQ ID NO: 316503 - protein, 23 aa, Mycobacterium
LGTGLCRLASLVIAVATGRRIAR

SEQ ID NO: 316504 - protein, 25 aa, Mycobacterium
LGTGRVPFAAAFGIAAVDVVLLVVV

SEQ ID NO: 316505 - protein, 25 aa, Mycobacterium
LGTIAAYLWSLWVLFANAGHTHGDV

SEQ ID NO: 316506 - protein, 25 aa, Mycobacterium
LGTIGRLDVEVSWPTAGITESARAL

SEQ ID NO: 316507 - protein, 20 aa, Mycobacterium
LGTILGGLGIHLDPATPFSV

SEQ ID NO: 316508 - protein, 18 aa, Mycobacterium
LGTKRLVMGSVLLFTLGS

SEQ ID NO: 316509 - protein, 18 aa, Mycobacterium
LGTLAIVCTMSVLRLISF

SEQ ID NO: 316510 - protein, 20 aa, Mycobacterium
LGTLMLGFYVTCAIFIFGVL

SEQ ID NO: 316511 - protein, 18 aa, Mycobacterium
LGTLRVWPSRARAFREID

SEQ ID NO: 316512 - protein, 32 aa, Mycobacterium
LGTQLRRLPVDFGIGVSAGRVFAGNVGAENRY

SEQ ID NO: 316513 - protein, 19 aa, Mycobacterium
LGTRVELRLGDPADSELDR

SEQ ID NO: 316514 - protein, 22 aa, Mycobacterium
LGTSRRSRWARILDEGVAAAVI

SEQ ID NO: 316515 - protein, 24 aa, Mycobacterium
LGTSRRSRWARMFDEGIGATVVQQ

SEQ ID NO: 316516 - protein, 19 aa, Mycobacterium
LGTTVEWYDFFLYATAAGL

SEQ ID NO: 316517 - protein, 19 aa, Mycobacterium
LGTVFVHWLIFQSLYRIGA

SEQ ID NO: 316518 - protein, 25 aa, Mycobacterium
LGTVTLELPAGGGWGEVAFTDADGN

SEQ ID NO: 316519 - protein, 24 aa, Mycobacterium
LGTYNRYWLAAAFGVTALVLSAIY

SEQ ID NO: 316520 - protein, 20 aa, Mycobacterium
LGVAAWGVNAVRVVTDHQAL

SEQ ID NO: 316521 - protein, 25 aa, Mycobacterium
LGVAGLLKRHWVIPILLISALFCSA

SEQ ID NO: 316522 - protein, 17 aa, Mycobacterium
LGVAIGLLLAAALSVWS

SEQ ID NO: 316523 - protein, 18 aa, Mycobacterium
LGVALLAAFGAQGWQQFT

SEQ ID NO: 316524 - protein, 19 aa, Mycobacterium
LGVAMRWVCGAIFVAISAS

SEQ ID NO: 316525 - protein, 17 aa, Mycobacterium
LGVAPSIVVMLFGVMYG

SEQ ID NO: 316526 - protein, 24 aa, Mycobacterium
LGVARLMRFIPRSVMVGFVNALAI

SEQ ID NO: 316527 - protein, 22 aa, Mycobacterium
LGVAVAYLMWRSAVVRSALEPY

SEQ ID NO: 316528 - protein, 25 aa, Mycobacterium
LGVAVLEDIVLWLALAIATSIAAKS

SEQ ID NO: 316529 - protein, 19 aa, Mycobacterium
LGVDSAYVLLGFPLATVSF

SEQ ID NO: 316530 - protein, 17 aa, Mycobacterium
LGVDVFFVLSGFLITSL

SEQ ID NO: 316531 - protein, 18 aa, Mycobacterium
LGVDVLWLLNGVVFYVLL

SEQ ID NO: 316532 - protein, 19 aa, Mycobacterium
LGVEASLRSLARVAPTQRH

SEQ ID NO: 316533 - protein, 19 aa, Mycobacterium
LGVFLLLYPRRSWGPTAWV

SEQ ID NO: 316534 - protein, 19 aa, Mycobacterium
LGVFLMISSTFNKPSAFST

SEQ ID NO: 316535 - protein, 17 aa, Mycobacterium
LGVFPLIVMFLITSITM

SEQ ID NO: 316536 - protein, 20 aa, Mycobacterium
LGVGIALLWSARGPRDGSGA

SEQ ID NO: 316537 - protein, 21 aa, Mycobacterium
LGVGIALLWTVRGGARVYWVL

SEQ ID NO: 316538 - protein, 21 aa, Mycobacterium
LGVGTAGLWLESLWIGAVYRY

SEQ ID NO: 316539 - protein, 19 aa, Mycobacterium
LGVGVGVGMLEHHLTKPVL

SEQ ID NO: 316540 - protein, 17 aa, Mycobacterium
LGVGVGYALANSVFGGT

SEQ ID NO: 316541 - protein, 25 aa, Mycobacterium
LGVHLRNPVLLIMFGLAFLLMGGFV

SEQ ID NO: 316542 - protein, 18 aa, Mycobacterium
LGVKWMSRVNSAGVVCEI

SEQ ID NO: 316543 - protein, 18 aa, Mycobacterium
LGVLFKIILPLSLPALST

SEQ ID NO: 316544 - protein, 25 aa, Mycobacterium
LGVLLWNRPQWRAEIIDSAISQFPL

SEQ ID NO: 316545 - protein, 23 aa, Mycobacterium
LGVLRDGQKWVALAMPAYALAGA

SEQ ID NO: 316546 - protein, 23 aa, Mycobacterium
LGVLRDGQKWVALAMPGYAVSAA

SEQ ID NO: 316547 - protein, 17 aa, Mycobacterium
LGVNVDRALPRSVPARA

SEQ ID NO: 316548 - protein, 18 aa, Mycobacterium
LGVPAFLVPYGWTVLVWG

SEQ ID NO: 316549 - protein, 22 aa, Mycobacterium
LGVPKWKTIVRIVIPTALSGIV

SEQ ID NO: 316550 - protein, 25 aa, Mycobacterium
LGVPKWKTIVSIVFPIAMPGIVSGI

SEQ ID NO: 316551 - protein, 23 aa, Mycobacterium
LGVQARIGLVDAIKLASPTVLLG

SEQ ID NO: 316552 - protein, 21 aa, Mycobacterium
LGVQRRAPSWAKWFQRISPIL

SEQ ID NO: 316553 - protein, 24 aa, Mycobacterium
LGVRLALIIPTAWILMTLVFVLMR

SEQ ID NO: 316554 - protein, 19 aa, Mycobacterium
LGVRLARTLIRLRDTAHEH

SEQ ID NO: 316555 - protein, 25 aa, Mycobacterium
LGVSILLTFYPGWASVGLMLVLLIT

SEQ ID NO: 316556 - protein, 30 aa, Mycobacterium
LGVTGIVEWPILLAVGGGALLLRRMNKKPG

SEQ ID NO: 316557 - protein, 18 aa, Mycobacterium
LGVVAVLVAATLVVVKNL

SEQ ID NO: 316558 - protein, 17 aa, Mycobacterium
LGVVLLIVDALRERQQR

SEQ ID NO: 316559 - protein, 21 aa, Mycobacterium
LGVVSLRGATLLGDSHLSAAS

SEQ ID NO: 316560 - protein, 32 aa, Mycobacterium
LGVVYRTLFMAFLWTIALTFEAGFFLVTVAIP

SEQ ID NO: 316561 - protein, 30 aa, Mycobacterium
LGVWAVNLFKVLLMTGSFACGMAFHNCAAR

SEQ ID NO: 316562 - protein, 17 aa, Mycobacterium
LGVWPMLGVLAALSAAA

SEQ ID NO: 316563 - protein, 18 aa, Mycobacterium
LGVWVVFVLAAASWAVGG

SEQ ID NO: 316564 - protein, 19 aa, Mycobacterium
LGWAARWALGSWPTVRESA

SEQ ID NO: 316565 - protein, 20 aa, Mycobacterium
LGWAGPRARGLLRVLAVTGF

SEQ ID NO: 316566 - protein, 20 aa, Mycobacterium
LGWKLLIPASLVWVLIAAVI

SEQ ID NO: 316567 - protein, 21 aa, Mycobacterium
LGWKLLIPASLVWVLIAAVVR

SEQ ID NO: 316568 - protein, 30 aa, Mycobacterium
LGWLGFDGGLGWPAKIGLALSVGVLGGVGI

SEQ ID NO: 316569 - protein, 27 aa, Mycobacterium
LGWLNYLFCWGMLYQLGIAWQTGLLTG

SEQ ID NO: 316570 - protein, 17 aa, Mycobacterium
LGWLRIAIFAAPAILVS

SEQ ID NO: 316571 - protein, 27 aa, Mycobacterium
LGWPVFPYTRMVRVSLWISVAVVAVLF

SEQ ID NO: 316572 - protein, 25 aa, Mycobacterium
LGWRNVRRRNLGWRMWYGGPWFSTR

SEQ ID NO: 316573 - protein, 26 aa, Mycobacterium
LGWVAERLSYGWGFVISGIVLLIAAV

SEQ ID NO: 316574 - protein, 25 aa, Mycobacterium
LGYADEISRAVVLIAVTVLLVGVAE

SEQ ID NO: 316575 - protein, 24 aa, Mycobacterium
LGYAPGTCRPFLPPKDALASVICD

SEQ ID NO: 316576 - protein, 19 aa, Mycobacterium
LGYCVLALIAFVFGEQKGR

SEQ ID NO: 316577 - protein, 18 aa, Mycobacterium
LGYFGGLNALVGKDKPGP

SEQ ID NO: 316578 - protein, 20 aa, Mycobacterium
LGYKSIRSNNTVLRWMQNAL

SEQ ID NO: 316579 - protein, 18 aa, Mycobacterium
LGYKSIRSNNTVLRWVQN

SEQ ID NO: 316580 - protein, 29 aa, Mycobacterium
LGYLLVNGLYRWFPPITVLTGLSLLAVAI

SEQ ID NO: 316581 - protein, 21 aa, Mycobacterium
LGYLRRQLLVLAAFTTGVLLI

SEQ ID NO: 316582 - protein, 24 aa, Mycobacterium
LGYLYFLVCLWVFRPPAPTVRAKA

SEQ ID NO: 316583 - protein, 24 aa, Mycobacterium
LGYRSRFLPLFIRLIERIQNRRLP

SEQ ID NO: 316584 - protein, 17 aa, Mycobacterium
LGYSVWTLWPVLVLFMP

SEQ ID NO: 316585 - protein, 21 aa, Mycobacterium
LHAAGASRCRVRIAQSRSGSV

SEQ ID NO: 316586 - protein, 18 aa, Mycobacterium
LHAEGLLRPGAVTPAADL

SEQ ID NO: 316587 - protein, 23 aa, Mycobacterium
LHAELWMAALIFPAFTAGAAIGN

SEQ ID NO: 316588 - protein, 18 aa, Mycobacterium
LHAFFGVVLMGTRRVLGA

SEQ ID NO: 316589 - protein, 18 aa, Mycobacterium
LHAFFGVVMMGMKTVLGE

SEQ ID NO: 316590 - protein, 26 aa, Mycobacterium
LHAILGWRPVLLIPLTFALFTPLGVP

SEQ ID NO: 316591 - protein, 17 aa, Mycobacterium
LHAIVWIGVALAVFQQL

SEQ ID NO: 316592 - protein, 24 aa, Mycobacterium
LHALDHGYTYGMLWIAGTAVLVGV

SEQ ID NO: 316593 - protein, 20 aa, Mycobacterium
LHDVTHGWTAPWVLFLAVFC

SEQ ID NO: 316594 - protein, 24 aa, Mycobacterium
LHELTHGMDLAAFVMFSSLAGIAG

SEQ ID NO: 316595 - protein, 22 aa, Mycobacterium
LHEVPILSGLGLTMTGARPGGF

SEQ ID NO: 316596 - protein, 31 aa, Mycobacterium
LHFEDFGPLNARRILHEYGQKYCVFNDDIQG

SEQ ID NO: 316597 - protein, 21 aa, Mycobacterium
LHGCNGCVGDRIMVDKLTYRF

SEQ ID NO: 316598 - protein, 21 aa, Mycobacterium
LHGCNGCVGDRIMVDKMSYRF

SEQ ID NO: 316599 - protein, 24 aa, Mycobacterium
LHGFWVMLFALPFAGLIELIPSAA

SEQ ID NO: 316600 - protein, 27 aa, Mycobacterium
LHGLYRAGGDVVAWSVWVVELLAGMTA

SEQ ID NO: 316601 - protein, 17 aa, Mycobacterium
LHGWPVATWPTKQDTDT

SEQ ID NO: 316602 - protein, 18 aa, Mycobacterium
LHHFRIYVDIAIVVVVLA

SEQ ID NO: 316603 - protein, 18 aa, Mycobacterium
LHHGFRPALVIGAVVVSV

SEQ ID NO: 316604 - protein, 18 aa, Mycobacterium
LHHLGIFSLYMMFFVLCG

SEQ ID NO: 316605 - protein, 26 aa, Mycobacterium
LHKRVPTMHWFNRFVLSISTPIIMRV

SEQ ID NO: 316606 - protein, 18 aa, Mycobacterium
LHLACIWIVAIAVNLSAF

SEQ ID NO: 316607 - protein, 17 aa, Mycobacterium
LHLADSALIDLIRVGDV

SEQ ID NO: 316608 - protein, 19 aa, Mycobacterium
LHLADSALIDLVRVGDVVD

SEQ ID NO: 316609 - protein, 24 aa, Mycobacterium
LHLARLSYFKALGIPSALGLLVVI

SEQ ID NO: 316610 - protein, 19 aa, Mycobacterium
LHLDLRFVNGKSWLVFGPY

SEQ ID NO: 316611 - protein, 21 aa, Mycobacterium
LHLDWGKAGVVVLALLFMALI

SEQ ID NO: 316612 - protein, 19 aa, Mycobacterium
LHLLLPAGERWFIRVVDEA

SEQ ID NO: 316613 - protein, 22 aa, Mycobacterium
LHLPTRRALAYARATRPDVLEA

SEQ ID NO: 316614 - protein, 19 aa, Mycobacterium
LHLVHIAWCTASVVGIAIW

SEQ ID NO: 316615 - protein, 25 aa, Mycobacterium
LHLVPWTVSVNWWLIVVAFVAFVTP

SEQ ID NO: 316616 - protein, 27 aa, Mycobacterium
LHNGYLASCGLNFPRLDSVHRTVEFAV

SEQ ID NO: 316617 - protein, 22 aa, Mycobacterium
LHPAWWTLILVVATLGTIVLTS

SEQ ID NO: 316618 - protein, 19 aa, Mycobacterium
LHPEHWGTFINLRCVCLAP

SEQ ID NO: 316619 - protein, 33 aa, Mycobacterium
LHPIFRSGVLTYEFWLKVGIVALGSRFVLGDIA

SEQ ID NO: 316620 - protein, 19 aa, Mycobacterium
LHPVIAWGGVLLGMLASLL

SEQ ID NO: 316621 - protein, 21 aa, Mycobacterium
LHPVLNLTSARLIAGKAADPT

SEQ ID NO: 316622 - protein, 18 aa, Mycobacterium
LHPVLNLTSARLISGSPD

SEQ ID NO: 316623 - protein, 19 aa, Mycobacterium
LHQLRSYRIVSVLRIGVLV

SEQ ID NO: 316624 - protein, 25 aa, Mycobacterium
LHQQRWAKDLSRAIVLAPMFITPIA

SEQ ID NO: 316625 - protein, 18 aa, Mycobacterium
LHQRLPEQLLHVLAGLLF

SEQ ID NO: 316626 - protein, 23 aa, Mycobacterium
LHQRPGAAGLVFAAFAAGDVSTA

SEQ ID NO: 316627 - protein, 17 aa, Mycobacterium
LHQRWHGVAAIVVSVLG

SEQ ID NO: 316628 - protein, 21 aa, Mycobacterium
LHRAKGGGLSTLFGGGVQSSL

SEQ ID NO: 316629 - protein, 22 aa, Mycobacterium
LHRCAGALADHVDWSLIDVIRG

SEQ ID NO: 316630 - protein, 19 aa, Mycobacterium
LHRDVAIKVLRADLARDPS

SEQ ID NO: 316631 - protein, 26 aa, Mycobacterium
LHRHPHWKRLIGPVFILIVATALASF

SEQ ID NO: 316632 - protein, 23 aa, Mycobacterium
LHRLDAIALYLGFIAVGWLLGYV

SEQ ID NO: 316633 - protein, 25 aa, Mycobacterium
LHRPVKRWYQGIFFTMFYTIILVLQ

SEQ ID NO: 316634 - protein, 25 aa, Mycobacterium
LHRRLGRFESFAAGFSFVSILTTIF

SEQ ID NO: 316635 - protein, 18 aa, Mycobacterium
LHSGCKLVSAAASSSAVS

SEQ ID NO: 316636 - protein, 25 aa, Mycobacterium
LHSHPAHLAGWGFGGVGAGIALSAV

SEQ ID NO: 316637 - protein, 22 aa, Mycobacterium
LHSPRAITFYCLDYGGGKLADL

SEQ ID NO: 316638 - protein, 23 aa, Mycobacterium
LHTLQVIAPYAFGAALVGLLESL

SEQ ID NO: 316639 - protein, 18 aa, Mycobacterium
LHTVSFLVALSIVVTLHV

SEQ ID NO: 316640 - protein, 25 aa, Mycobacterium
LHVDPELLGGLSITVGDEVIDGSIA

SEQ ID NO: 316641 - protein, 28 aa, Mycobacterium
LHVHRRLSFRYGYLHIFVFGAIVATGAG

SEQ ID NO: 316642 - protein, 31 aa, Mycobacterium
LHVSGRRFLLRRVECALLGGDIHTLSARSRT

SEQ ID NO: 316643 - protein, 20 aa, Mycobacterium
LHVVDARFAADLRSRLLRKL

SEQ ID NO: 316644 - protein, 20 aa, Mycobacterium
LHWPENWPLIMLSPTVEPFI

SEQ ID NO: 316645 - protein, 17 aa, Mycobacterium
LHYGYYPALIVGLTLGV

SEQ ID NO: 316646 - protein, 17 aa, Mycobacterium
LHYPVASTILWSLALTA

SEQ ID NO: 316647 - protein, 19 aa, Mycobacterium
LHYQRARMNDLLTQADEMA

SEQ ID NO: 316648 - protein, 21 aa, Mycobacterium
LHYRHELLYYKVLENHLPELM

SEQ ID NO: 316649 - protein, 20 aa, Mycobacterium
LHYRHELLYYKVLIDHLPEL

SEQ ID NO: 316650 - protein, 19 aa, Mycobacterium
LHYRHELLYYKVLTEHLVE

SEQ ID NO: 316651 - protein, 19 aa, Mycobacterium
LIAAGRWDFDPMAEPEQIL

SEQ ID NO: 316652 - protein, 18 aa, Mycobacterium
LIAAVGMTIAVAATLVMI

SEQ ID NO: 316653 - protein, 18 aa, Mycobacterium
LIAGAAIVETVFGWPGMA

SEQ ID NO: 316654 - protein, 18 aa, Mycobacterium
LIAGASCNDAALTHDDAR

SEQ ID NO: 316655 - protein, 19 aa, Mycobacterium
LIAGLLFFFFVLPRWPELN

SEQ ID NO: 316656 - protein, 20 aa, Mycobacterium
LIAHGLRKVFGWWGGTGLSG

SEQ ID NO: 316657 - protein, 23 aa, Mycobacterium
LIALFPPYVMWLPNAIWKSFDLF

SEQ ID NO: 316658 - protein, 19 aa, Mycobacterium
LIALIVYGIIELISDRQGT

SEQ ID NO: 316659 - protein, 24 aa, Mycobacterium
LIALLGGIGIMFAIYGRWSQKVGW

SEQ ID NO: 316660 - protein, 24 aa, Mycobacterium
LIALLGGIGIMFAVYGRWSQKVGW

SEQ ID NO: 316661 - protein, 28 aa, Mycobacterium
LIALLVVAGFGWVGWDFSLVVGAVLVGV

SEQ ID NO: 316662 - protein, 19 aa, Mycobacterium
LIALWRLDRLDGRRLRSLF

SEQ ID NO: 316663 - protein, 24 aa, Mycobacterium
LIAMFPWYIQWFPNAVWKTFDLFV

SEQ ID NO: 316664 - protein, 23 aa, Mycobacterium
LIAMFPWYIQWLPNAVWKTFDLF

SEQ ID NO: 316665 - protein, 17 aa, Mycobacterium
LIAMPILGFGLFGALSG

SEQ ID NO: 316666 - protein, 17 aa, Mycobacterium
LIAPTGWEVGLIRVEDV

SEQ ID NO: 316667 - protein, 18 aa, Mycobacterium
LIAPTGWQVGLIRIEDVV

SEQ ID NO: 316668 - protein, 24 aa, Mycobacterium
LIARQRWIYPVLVVLWAAAGTYIT

SEQ ID NO: 316669 - protein, 19 aa, Mycobacterium
LIASLAVGLIMFFLIGRPL

SEQ ID NO: 316670 - protein, 18 aa, Mycobacterium
LIATGGMGQVWEAVDSRL

SEQ ID NO: 316671 - protein, 26 aa, Mycobacterium
LIATLGLRFYLGWITHTGYTYGALST

SEQ ID NO: 316672 - protein, 25 aa, Mycobacterium
LIATLGLRFYLTWITSTGYTYGALS

SEQ ID NO: 316673 - protein, 23 aa, Mycobacterium
LIAVAVAVLVDFAAKRTREARRA

SEQ ID NO: 316674 - protein, 24 aa, Mycobacterium
LIAVCCYVALVLTNFAWLFPVLTG

SEQ ID NO: 316675 - protein, 28 aa, Mycobacterium
LIAVFGMRLVFPLAIVWVTAGLDPVHAM

SEQ ID NO: 316676 - protein, 26 aa, Mycobacterium
LIAVFRGRLHPIGGLGVALGVTVLLF

SEQ ID NO: 316677 - protein, 20 aa, Mycobacterium
LIAVIAALWVSRADAAVLEW

SEQ ID NO: 316678 - protein, 23 aa, Mycobacterium
LIAVSIGMRLVFGHLDLTTALTV

SEQ ID NO: 316679 - protein, 18 aa, Mycobacterium
LIAWAGFALLTWSLAGVA

SEQ ID NO: 316680 - protein, 17 aa, Mycobacterium
LIAWPDVAGVSFPVGNR

SEQ ID NO: 316681 - protein, 19 aa, Mycobacterium
LIAWSGFALLTWALPGVVI

SEQ ID NO: 316682 - protein, 27 aa, Mycobacterium
LICAGVIAGTVVVGWVISLVMINPFRL

SEQ ID NO: 316683 - protein, 28 aa, Mycobacterium
LICALSIGAAAVFAWLLAAFAVRPFKRL

SEQ ID NO: 316684 - protein, 20 aa, Mycobacterium
LIDAFGWQWIFLINLPIGAL

SEQ ID NO: 316685 - protein, 18 aa, Mycobacterium
LIDDLRLVAPQASVDDVW

SEQ ID NO: 316686 - protein, 26 aa, Mycobacterium
LIDEVGWPMLCVMTIAAGALQIAFGV

SEQ ID NO: 316687 - protein, 33 aa, Mycobacterium
LIDGEVHWALTIPRLGSIIARNSLDAPVPGLDG

SEQ ID NO: 316688 - protein, 24 aa, Mycobacterium
LIDGMTCASCAARIERKLNKLAGV

SEQ ID NO: 316689 - protein, 27 aa, Mycobacterium
LIDGVHEFPGPWALVPVGATLLFILSA

SEQ ID NO: 316690 - protein, 27 aa, Mycobacterium
LIDIAGAWRWTALFAALVTVVSIPVLR

SEQ ID NO: 316691 - protein, 18 aa, Mycobacterium
LIDIFAIFIFYVVGVLLW

SEQ ID NO: 316692 - protein, 19 aa, Mycobacterium
LIDLDGRVLGVVFGAAVDD

SEQ ID NO: 316693 - protein, 20 aa, Mycobacterium
LIDLRLFRNRVVTVANATIV

SEQ ID NO: 316694 - protein, 18 aa, Mycobacterium
LIDLRLFTDRVVRLANLA

SEQ ID NO: 316695 - protein, 19 aa, Mycobacterium
LIDLRLFTNRVVALANSAM

SEQ ID NO: 316696 - protein, 19 aa, Mycobacterium
LIDLRLLKNRAVAAANATR

SEQ ID NO: 316697 - protein, 18 aa, Mycobacterium
LIDLRLLTNRALTLANVA

SEQ ID NO: 316698 - protein, 25 aa, Mycobacterium
LIDRTRTRYGLALTAYSLVNLAITV

SEQ ID NO: 316699 - protein, 19 aa, Mycobacterium
LIDSFGWQWIFLINLPIGV

SEQ ID NO: 316700 - protein, 25 aa, Mycobacterium
LIDTSSWRWIFLINLPIGLVTIVLA

SEQ ID NO: 316701 - protein, 25 aa, Mycobacterium
LIDVLHWPGYLLVVAGVIGGVGSLA

SEQ ID NO: 316702 - protein, 25 aa, Mycobacterium
LIDVLHWPGYLLVVAGVIGTCGSLA

SEQ ID NO: 316703 - protein, 25 aa, Mycobacterium
LIDVLHWPGYLLVVAGVVGACGSLA

SEQ ID NO: 316704 - protein, 18 aa, Mycobacterium
LIEAGPGWFNRVIEAATP

SEQ ID NO: 316705 - protein, 21 aa, Mycobacterium
LIEAMWWLRARALGLRPRVWR

SEQ ID NO: 316706 - protein, 21 aa, Mycobacterium
LIEEFQVLYAARRLRPNETPR

SEQ ID NO: 316707 - protein, 17 aa, Mycobacterium
LIEFCLLAAQYDGLAAT

SEQ ID NO: 316708 - protein, 17 aa, Mycobacterium
LIEGIGVKVLHWVNSVR

SEQ ID NO: 316709 - protein, 18 aa, Mycobacterium
LIEHFSVGSIFWVNVPIA

SEQ ID NO: 316710 - protein, 18 aa, Mycobacterium
LIELALRSGGPDNVTVVV

SEQ ID NO: 316711 - protein, 18 aa, Mycobacterium
LIELDRRLGWDAVSGPAQ

SEQ ID NO: 316712 - protein, 27 aa, Mycobacterium
LIEQPVREWRPAFVPMLPLAGATAATA

SEQ ID NO: 316713 - protein, 18 aa, Mycobacterium
LIEQVGWQMLCLMTLGAG

SEQ ID NO: 316714 - protein, 19 aa, Mycobacterium
LIEQVRPTLPVLLANLTSL

SEQ ID NO: 316715 - protein, 17 aa, Mycobacterium
LIERPERLVIVLVGAGL

SEQ ID NO: 316716 - protein, 24 aa, Mycobacterium
LIESEFPGELAGLFKNLENKGNPW

SEQ ID NO: 316717 - protein, 22 aa, Mycobacterium
LIEVPVLVGLVYVSLALRPRLS

SEQ ID NO: 316718 - protein, 19 aa, Mycobacterium
LIFGLVIAWVLVRDDFVGK

SEQ ID NO: 316719 - protein, 19 aa, Mycobacterium
LIFGWLAFLLVFGIFVRRF

SEQ ID NO: 316720 - protein, 19 aa, Mycobacterium
LIFGWLAFLLVFGIFVRRV

SEQ ID NO: 316721 - protein, 18 aa, Mycobacterium
LIFGWLAFLLVFGLFVRK

SEQ ID NO: 316722 - protein, 25 aa, Mycobacterium
LIFGWLTFLIVFGFFTRTVWEIVVG

SEQ ID NO: 316723 - protein, 25 aa, Mycobacterium
LIFGWLTFLLVFGWFTRNAWQIVVG

SEQ ID NO: 316724 - protein, 24 aa, Mycobacterium
LIFVCAGIIALVYIKVFGVAAPGG

SEQ ID NO: 316725 - protein, 23 aa, Mycobacterium
LIGALCMLGTVWLVVRARSSTRA

SEQ ID NO: 316726 - protein, 17 aa, Mycobacterium
LIGCGQALTAPAWQAIQ

SEQ ID NO: 316727 - protein, 26 aa, Mycobacterium
LIGCSRAWMLAFSWIAMAGIGVLQYG

SEQ ID NO: 316728 - protein, 19 aa, Mycobacterium
LIGFSELHALMAATAVSAT

SEQ ID NO: 316729 - protein, 27 aa, Mycobacterium
LIGHRNRLAAMFAWGISFLGRTRGQMA

SEQ ID NO: 316730 - protein, 24 aa, Mycobacterium
LIGIAWCWLFPIAWAVSGSLKGEG

SEQ ID NO: 316731 - protein, 25 aa, Mycobacterium
LIGIELHWLTLPIAFIVLVGVGCDY

SEQ ID NO: 316732 - protein, 18 aa, Mycobacterium
LIGIFAFFFQNFLSSQLG

SEQ ID NO: 316733 - protein, 26 aa, Mycobacterium
LIGIFSFFGNDLFKSFFDVDVPWIVF

SEQ ID NO: 316734 - protein, 33 aa, Mycobacterium
LIGILVISVIWRLRLALAMSIASAIVFDCIRNW

SEQ ID NO: 316735 - protein, 24 aa, Mycobacterium
LIGLRRLSVTYLRQHPAASLATAG

SEQ ID NO: 316736 - protein, 27 aa, Mycobacterium
LIGLSMLGDLPWWVTAVVLAREIGITL

SEQ ID NO: 316737 - protein, 28 aa, Mycobacterium
LIGLSMLGDLPWWVTVLILAREIGVTVL

SEQ ID NO: 316738 - protein, 29 aa, Mycobacterium
LIGLSMLGELPWWVTIVILVREFGVTVLR

SEQ ID NO: 316739 - protein, 29 aa, Mycobacterium
LIGLSMLGELPWWVTVVILVREFGVTVLR

SEQ ID NO: 316740 - protein, 18 aa, Mycobacterium
LIGLVGFVGFGRIYLGQT

SEQ ID NO: 316741 - protein, 17 aa, Mycobacterium
LIGMAIAVPLGLAVQHA

SEQ ID NO: 316742 - protein, 17 aa, Mycobacterium
LIGSLILAIPVVVISMA

SEQ ID NO: 316743 - protein, 17 aa, Mycobacterium
LIGTAIAIPLGLFVQHA

SEQ ID NO: 316744 - protein, 17 aa, Mycobacterium
LIGYIIAAAPLVMASGL

SEQ ID NO: 316745 - protein, 27 aa, Mycobacterium
LIHDCPKLLQLRTFPTIAIGGARPGAD

SEQ ID NO: 316746 - protein, 25 aa, Mycobacterium
LIHDCPKLLQLRTFPTIAVGGDTDG

SEQ ID NO: 316747 - protein, 29 aa, Mycobacterium
LIHDCPKLVQLRSFPTIAIGGDRPGADRL

SEQ ID NO: 316748 - protein, 19 aa, Mycobacterium
LIHVIDMAMAREVAFRYPD

SEQ ID NO: 316749 - protein, 24 aa, Mycobacterium
LIHWPESWPLVSLSPTVEPFVVFG

SEQ ID NO: 316750 - protein, 24 aa, Mycobacterium
LIIAGLVVRYIWWVVGAAALAGVV

SEQ ID NO: 316751 - protein, 19 aa, Mycobacterium
LIIGWYLQRDRVMRLAQER

SEQ ID NO: 316752 - protein, 22 aa, Mycobacterium
LIIKVRLHAFFSLIVVSVLTGL

SEQ ID NO: 316753 - protein, 18 aa, Mycobacterium
LIILGRLITWFARRHSES

SEQ ID NO: 316754 - protein, 18 aa, Mycobacterium
LIILSFLLGLVLTCALMV

SEQ ID NO: 316755 - protein, 18 aa, Mycobacterium
LIIPLGIVPSWLALASTG

SEQ ID NO: 316756 - protein, 18 aa, Mycobacterium
LIIRDEAVHGFYIGYKCQ

SEQ ID NO: 316757 - protein, 24 aa, Mycobacterium
LIITYRSPVLWLVPLLVIGFADRV

SEQ ID NO: 316758 - protein, 21 aa, Mycobacterium
LIKARSAILHAIRETLVGKGF

SEQ ID NO: 316759 - protein, 20 aa, Mycobacterium
LIKCGVVLVAVFTAFVANSA

SEQ ID NO: 316760 - protein, 30 aa, Mycobacterium
LIKDLELLPTFPFHYKYLRNAVRGDYLNVF

SEQ ID NO: 316761 - protein, 25 aa, Mycobacterium
LIKPAVLVALLFRTLDAFRIFDNIY

SEQ ID NO: 316762 - protein, 17 aa, Mycobacterium
LIKVGGWSGLKDKVIDT

SEQ ID NO: 316763 - protein, 17 aa, Mycobacterium
LILAAFFSGGWRVVMLG

SEQ ID NO: 316764 - protein, 19 aa, Mycobacterium
LILAIALAIAVIFASALAG

SEQ ID NO: 316765 - protein, 17 aa, Mycobacterium
LILALLAFRHFGQGYAI

SEQ ID NO: 316766 - protein, 19 aa, Mycobacterium
LILFLPFLLIMGGFMYFAS

SEQ ID NO: 316767 - protein, 17 aa, Mycobacterium
LILFPPLIVIAYEMFAH

SEQ ID NO: 316768 - protein, 18 aa, Mycobacterium
LILGIALLAVTVFVWASA

SEQ ID NO: 316769 - protein, 17 aa, Mycobacterium
LILIAAGVWGLRRTRDG

SEQ ID NO: 316770 - protein, 18 aa, Mycobacterium
LILIAAIGTILAVRAGDL

SEQ ID NO: 316771 - protein, 23 aa, Mycobacterium
LILIVVAGGFAFSDLVMMKYLAF

SEQ ID NO: 316772 - protein, 23 aa, Mycobacterium
LILIWRLIRRDSVQPAISGFFAV

SEQ ID NO: 316773 - protein, 17 aa, Mycobacterium
LILLPLVLPPVVGGIAL

SEQ ID NO: 316774 - protein, 18 aa, Mycobacterium
LILLPLVLVYGVAQRSFI

SEQ ID NO: 316775 - protein, 18 aa, Mycobacterium
LILLPLVVVYAVAQRAFI

SEQ ID NO: 316776 - protein, 26 aa, Mycobacterium
LILLWGSAGAFGFVERDLGFKIIFGL

SEQ ID NO: 316777 - protein, 24 aa, Mycobacterium
LILLWGSAGALGFVEKDLGLKIIF

SEQ ID NO: 316778 - protein, 18 aa, Mycobacterium
LILPGFWLLVPGSMGLIG

SEQ ID NO: 316779 - protein, 17 aa, Mycobacterium
LILRIVALFYVIALLIV

SEQ ID NO: 316780 - protein, 17 aa, Mycobacterium
LILRLVLGLTLAAHGLN

SEQ ID NO: 316781 - protein, 17 aa, Mycobacterium
LILRLVLGLTMAAHGFN

SEQ ID NO: 316782 - protein, 23 aa, Mycobacterium
LILSSPFLLPAALGLALSAIAFT

SEQ ID NO: 316783 - protein, 17 aa, Mycobacterium
LILVCLVLGLAQYAVYF

SEQ ID NO: 316784 - protein, 26 aa, Mycobacterium
LILVGLRLLQGFAVGGEWAGSALLSA

SEQ ID NO: 316785 - protein, 17 aa, Mycobacterium
LILVMGVSRSARTAVWA

SEQ ID NO: 316786 - protein, 28 aa, Mycobacterium
LILVSPWPVRLFWLLLLALALLIAVDIA

SEQ ID NO: 316787 - protein, 25 aa, Mycobacterium
LIMLLRAVVAPLYLVASVVVSYLSA

SEQ ID NO: 316788 - protein, 18 aa, Mycobacterium
LIMPLIGLWAMVATLRFG

SEQ ID NO: 316789 - protein, 26 aa, Mycobacterium
LIMREARAGDRYLLCSDGLSDPVSQD

SEQ ID NO: 316790 - protein, 23 aa, Mycobacterium
LIMRYRRRRRRAADLAAARRVDP

SEQ ID NO: 316791 - protein, 28 aa, Mycobacterium
LINCGYPLIQRFPLMFFTSAAVLLIGLA

SEQ ID NO: 316792 - protein, 20 aa, Mycobacterium
LINLGPRIGRFLPDGTPVTI

SEQ ID NO: 316793 - protein, 18 aa, Mycobacterium
LINRRWTFQAAPSTARFV

SEQ ID NO: 316794 - protein, 18 aa, Mycobacterium
LIPALPVAMVLAVVTAAT

SEQ ID NO: 316795 - protein, 27 aa, Mycobacterium
LIPANVMWVVWQLWLVVLLAALWKGRR

SEQ ID NO: 316796 - protein, 34 aa, Mycobacterium
LIPANVSWIVWQLWLAVILVALWKGRRMGPLVAE

SEQ ID NO: 316797 - protein, 18 aa, Mycobacterium
LIPGSATLLAWVMLVSAL

SEQ ID NO: 316798 - protein, 25 aa, Mycobacterium
LIPLALGLWAAWKAWRGNDDDDDDD

SEQ ID NO: 316799 - protein, 26 aa, Mycobacterium
LIPLDRTRTPVGFDRVLATVDKLASA

SEQ ID NO: 316800 - protein, 17 aa, Mycobacterium
LIPLFILWFGIGELPKV

SEQ ID NO: 316801 - protein, 17 aa, Mycobacterium
LIPLFIVWFGIGELPKV

SEQ ID NO: 316802 - protein, 18 aa, Mycobacterium
LIPLRIFGNREFAWSSLG

SEQ ID NO: 316803 - protein, 18 aa, Mycobacterium
LIPLTGLTTPWMSYGGSS

SEQ ID NO: 316804 - protein, 17 aa, Mycobacterium
LIPLVIFRDRDFGLCNA

SEQ ID NO: 316805 - protein, 17 aa, Mycobacterium
LIPLVPAAVVALALIVA

SEQ ID NO: 316806 - protein, 23 aa, Mycobacterium
LIPNAPPLTVWFGSVRYVFAPGR

SEQ ID NO: 316807 - protein, 23 aa, Mycobacterium
LIPRIGIASVIAEGFLVLPFGNR

SEQ ID NO: 316808 - protein, 30 aa, Mycobacterium
LIPRQRPNLRFRIVSAWRALRPTLASTASD

SEQ ID NO: 316809 - protein, 18 aa, Mycobacterium
LIPTRWRTVTAVDGVVVG

SEQ ID NO: 316810 - protein, 22 aa, Mycobacterium
LIPVLWILSLSLKPTSSVKDGK

SEQ ID NO: 316811 - protein, 24 aa, Mycobacterium
LIPWSDVVGLSFPVGARWARIDLP

SEQ ID NO: 316812 - protein, 18 aa, Mycobacterium
LIPWSEVVGVSFPPGAQW

SEQ ID NO: 316813 - protein, 22 aa, Mycobacterium
LIQRSGGDLVVIVRNVPVVSAP

SEQ ID NO: 316814 - protein, 25 aa, Mycobacterium
LIQTEFNVALPWSKEVSLSKSATHP

SEQ ID NO: 316815 - protein, 28 aa, Mycobacterium
LIQVWLLELFFVMPLTFFIGKVIDIHGA

SEQ ID NO: 316816 - protein, 23 aa, Mycobacterium
LIRAGFIGVILIILVIAVGLQPE

SEQ ID NO: 316817 - protein, 23 aa, Mycobacterium
LIRKRRIGAVWLTAAGYAVACQV

SEQ ID NO: 316818 - protein, 19 aa, Mycobacterium
LIRLIRRLLPAMVVVLAAC

SEQ ID NO: 316819 - protein, 18 aa, Mycobacterium
LIRSQYPAGMPVAEVVAV

SEQ ID NO: 316820 - protein, 26 aa, Mycobacterium
LIRTLSIPIILFWLGIAIVLNIVTPS

SEQ ID NO: 316821 - protein, 19 aa, Mycobacterium
LIRVAMMYNDQIGYGPTVR

SEQ ID NO: 316822 - protein, 18 aa, Mycobacterium
LISCCGFLAIGQAAPTAI

SEQ ID NO: 316823 - protein, 19 aa, Mycobacterium
LISCGGALVSAWFVAKFAP

SEQ ID NO: 316824 - protein, 24 aa, Mycobacterium
LISFSIWYFWADRFSLLALSVLIG

SEQ ID NO: 316825 - protein, 25 aa, Mycobacterium
LISGPLQLFISCVEEVLQRNQIPQG

SEQ ID NO: 316826 - protein, 26 aa, Mycobacterium
LISGRWPRRRALVLFLSVFIAAHIVG

SEQ ID NO: 316827 - protein, 18 aa, Mycobacterium
LISHLVFHHEIRWIEIVH

SEQ ID NO: 316828 - protein, 17 aa, Mycobacterium
LISIWRRIMSSPLLTLN

SEQ ID NO: 316829 - protein, 22 aa, Mycobacterium
LISLCVVLGMAIALSLLVVAVI

SEQ ID NO: 316830 - protein, 19 aa, Mycobacterium
LISLFYLGFVRWKIRLRGG

SEQ ID NO: 316831 - protein, 23 aa, Mycobacterium
LISLLLCLAVALGADALGSSAKS

SEQ ID NO: 316832 - protein, 22 aa, Mycobacterium
LISRIREYWMASGRTRADNDEA

SEQ ID NO: 316833 - protein, 34 aa, Mycobacterium
LITALCLFTAVFIMLRRKRVPGVARGPAWRLMGV

SEQ ID NO: 316834 - protein, 17 aa, Mycobacterium
LITASWLRHPHLRDYSA

SEQ ID NO: 316835 - protein, 18 aa, Mycobacterium
LITATLLALKPWYPKASV

SEQ ID NO: 316836 - protein, 18 aa, Mycobacterium
LITFPTLVTLGFPPVTAT

SEQ ID NO: 316837 - protein, 18 aa, Mycobacterium
LITIVGCWIMRKIKTRWP

SEQ ID NO: 316838 - protein, 17 aa, Mycobacterium
LITLIIVGLLRYRRRGH

SEQ ID NO: 316839 - protein, 18 aa, Mycobacterium
LITLTGFLLSAVAAIAVF

SEQ ID NO: 316840 - protein, 17 aa, Mycobacterium
LITMLLIGVVLLGLGYS

SEQ ID NO: 316841 - protein, 31 aa, Mycobacterium
LITPEVFSWHLPALIVINGFAAYALFTGHLR

SEQ ID NO: 316842 - protein, 29 aa, Mycobacterium
LITPVMFYVGWPIHRTGWLALAHRSADMN

SEQ ID NO: 316843 - protein, 29 aa, Mycobacterium
LITPVMMYVGWPIHRTGWLALAHRSADMN

SEQ ID NO: 316844 - protein, 25 aa, Mycobacterium
LITRLRLHPFLALLLGSGTLAAAAS

SEQ ID NO: 316845 - protein, 17 aa, Mycobacterium
LITRMPQGWSFAQAAAV

SEQ ID NO: 316846 - protein, 17 aa, Mycobacterium
LITRSGPIFEHAPYAQV

SEQ ID NO: 316847 - protein, 18 aa, Mycobacterium
LITRYEWVALERSISEVV

SEQ ID NO: 316848 - protein, 26 aa, Mycobacterium
LITSLEYIARLALLERAERDGQIEDV

SEQ ID NO: 316849 - protein, 18 aa, Mycobacterium
LITVLAWPQVRRADKLSD

SEQ ID NO: 316850 - protein, 18 aa, Mycobacterium
LIVACLDVSLVISSMVAL

SEQ ID NO: 316851 - protein, 30 aa, Mycobacterium
LIVAIQWRARSWLKRVLPVALIAAVAVTAL

SEQ ID NO: 316852 - protein, 24 aa, Mycobacterium
LIVCAGRLATPWVCAVDTAGRRSV

SEQ ID NO: 316853 - protein, 27 aa, Mycobacterium
LIVCTDAEAILGIGDWGVGGIQIAVGK

SEQ ID NO: 316854 - protein, 17 aa, Mycobacterium
LIVEAMVLLSFSALDVL

SEQ ID NO: 316855 - protein, 17 aa, Mycobacterium
LIVFLILVILLRAIVAP

SEQ ID NO: 316856 - protein, 19 aa, Mycobacterium
LIVGAAWPMIVEQISVKPN

SEQ ID NO: 316857 - protein, 21 aa, Mycobacterium
LIVGFCWALFFNGFLGAKLGV

SEQ ID NO: 316858 - protein, 17 aa, Mycobacterium
LIVKAVNLSKDWARAVV

SEQ ID NO: 316859 - protein, 24 aa, Mycobacterium
LIVKRVYWPVAVWLLLVIAIVHSS

SEQ ID NO: 316860 - protein, 20 aa, Mycobacterium
LIVLFCLAAPLWSEHVAHTL

SEQ ID NO: 316861 - protein, 18 aa, Mycobacterium
LIVMLNFVGILSYDKLRN

SEQ ID NO: 316862 - protein, 24 aa, Mycobacterium
LIVSDRGYFVFLALLPFIMGSLSM

SEQ ID NO: 316863 - protein, 19 aa, Mycobacterium
LIVSRQWKLLGAYAAAAFM

SEQ ID NO: 316864 - protein, 18 aa, Mycobacterium
LIVSRQWKLLGAYAAAAI

SEQ ID NO: 316865 - protein, 30 aa, Mycobacterium
LIVSWIIVMLLTFYWARVVWQRTIVQLAAE

SEQ ID NO: 316866 - protein, 30 aa, Mycobacterium
LIVVAVGAAVLWRARKALGLLGIAVAAVII

SEQ ID NO: 316867 - protein, 22 aa, Mycobacterium
LIVWRRDLRSIVWLLAAQGLAL

SEQ ID NO: 316868 - protein, 20 aa, Mycobacterium
LIWCARHLLQWVHARRSGDL

SEQ ID NO: 316869 - protein, 27 aa, Mycobacterium
LIWNISEVRWLPAILLFSYIDLVGYIP

SEQ ID NO: 316870 - protein, 25 aa, Mycobacterium
LIWQAAHGWPYLRMAAIVAAESERG

SEQ ID NO: 316871 - protein, 27 aa, Mycobacterium
LIWQDLFGFKIHWIVAALSVIILLAVG

SEQ ID NO: 316872 - protein, 17 aa, Mycobacterium
LIWQHLIGIELHWMVLA

SEQ ID NO: 316873 - protein, 25 aa, Mycobacterium
LIWQHLIGLPLHWLVLPLTFIILVA

SEQ ID NO: 316874 - protein, 25 aa, Mycobacterium
LIWQHLLGLELHWLVLAFTLIVLLA

SEQ ID NO: 316875 - protein, 17 aa, Mycobacterium
LIYGTAAALVFPTVFFP

SEQ ID NO: 316876 - protein, 40 aa, Mycobacterium
LIYLDRRFTIGHGRLFASYVALYCVGRFCVELLRDDTATH

SEQ ID NO: 316877 - protein, 25 aa, Mycobacterium
LIYMLPLLLLVALFVLFSRMQSGGR

SEQ ID NO: 316878 - protein, 27 aa, Mycobacterium
LIYMLPLLLLVALFVMFSRMQTGGRMG

SEQ ID NO: 316879 - protein, 17 aa, Mycobacterium
LIYRMFTLEADDVVDDD

SEQ ID NO: 316880 - protein, 25 aa, Mycobacterium
LKAAEARAGALAWQHHEPELAQYAE

SEQ ID NO: 316881 - protein, 17 aa, Mycobacterium
LKAGGATVALLTTSALQ

SEQ ID NO: 316882 - protein, 17 aa, Mycobacterium
LKAGGATVALLTTSQLK

SEQ ID NO: 316883 - protein, 19 aa, Mycobacterium
LKAGQTVRVAGIRVGTVNS

SEQ ID NO: 316884 - protein, 27 aa, Mycobacterium
LKAIRAKTVPIMLGIALVASAALATFV

SEQ ID NO: 316885 - protein, 21 aa, Mycobacterium
LKAIVFGAIVAIVSSQKGLST

SEQ ID NO: 316886 - protein, 17 aa, Mycobacterium
LKALHDMIFELLDDARA

SEQ ID NO: 316887 - protein, 18 aa, Mycobacterium
LKALLAERIAALKPRDGG

SEQ ID NO: 316888 - protein, 19 aa, Mycobacterium
LKATTVFFSPGNEQAAATV

SEQ ID NO: 316889 - protein, 17 aa, Mycobacterium
LKATVEAISAGGGTPLA

SEQ ID NO: 316890 - protein, 21 aa, Mycobacterium
LKAVIYGAIVAVIACQKGLFT

SEQ ID NO: 316891 - protein, 22 aa, Mycobacterium
LKAVLPVAAVFLIWDEIAIAAR

SEQ ID NO: 316892 - protein, 18 aa, Mycobacterium
LKAYKPGDTIAVDYRRKN

SEQ ID NO: 316893 - protein, 17 aa, Mycobacterium
LKDIINRGGENVSSVEV

SEQ ID NO: 316894 - protein, 30 aa, Mycobacterium
LKDLAINCGYPLIERFPLMLFTSAAVLLIG

SEQ ID NO: 316895 - protein, 32 aa, Mycobacterium
LKDLLINCGYPLIERFPLMLGTAGIVLLIGLT

SEQ ID NO: 316896 - protein, 19 aa, Mycobacterium
LKDMREFTGLLAQHDDLLS

SEQ ID NO: 316897 - protein, 23 aa, Mycobacterium
LKDPPAGWWPAHVDPRQWAFDKT

SEQ ID NO: 316898 - protein, 17 aa, Mycobacterium
LKDQIGTRVELRLGDPL

SEQ ID NO: 316899 - protein, 20 aa, Mycobacterium
LKEEIHAGIGTGIIRAMGGS

SEQ ID NO: 316900 - protein, 22 aa, Mycobacterium
LKEKRLPVIVHTGRELTAVETE

SEQ ID NO: 316901 - protein, 17 aa, Mycobacterium
LKGGALGLLSSVVVGLA

SEQ ID NO: 316902 - protein, 20 aa, Mycobacterium
LKGLARMFGEGAYMNAYACD

SEQ ID NO: 316903 - protein, 20 aa, Mycobacterium
LKGNWYLLGPAFVAAIAYVD

SEQ ID NO: 316904 - protein, 17 aa, Mycobacterium
LKGPMWLYPPAEHGAVW

SEQ ID NO: 316905 - protein, 22 aa, Mycobacterium
LKGPSCFTAPELVVRPDLPETL

SEQ ID NO: 316906 - protein, 22 aa, Mycobacterium
LKGPSCFTAPLIPVRPDLPEVL

SEQ ID NO: 316907 - protein, 23 aa, Mycobacterium
LKGPSCFTAPLVVTRPALPDQML

SEQ ID NO: 316908 - protein, 19 aa, Mycobacterium
LKGSGQCYFLQGSPANGTL

SEQ ID NO: 316909 - protein, 18 aa, Mycobacterium
LKGTAGWFDSMGMKPGMF

SEQ ID NO: 316910 - protein, 19 aa, Mycobacterium
LKGTEGYRLSTIALGASAL

SEQ ID NO: 316911 - protein, 21 aa, Mycobacterium
LKGTPLVGGKVYIAGAASTAK

SEQ ID NO: 316912 - protein, 21 aa, Mycobacterium
LKGTPMAGAGIYLGGTASTYK

SEQ ID NO: 316913 - protein, 18 aa, Mycobacterium
LKGVVADLQITAHAAETP

SEQ ID NO: 316914 - protein, 26 aa, Mycobacterium
LKHLRKRLRDEFGFPKADVHAAAYWT

SEQ ID NO: 316915 - protein, 25 aa, Mycobacterium
LKHPWKRARTTFSYLAVAILGNDED

SEQ ID NO: 316916 - protein, 26 aa, Mycobacterium
LKHVRKRLRDAFGFPKSVVHAQAYWT

SEQ ID NO: 316917 - protein, 25 aa, Mycobacterium
LKHVRTRLRDEFGFPKSVIHAQAYW

SEQ ID NO: 316918 - protein, 19 aa, Mycobacterium
LKIGIAVALGCIAAESLLV

SEQ ID NO: 316919 - protein, 18 aa, Mycobacterium
LKIGRRIYAVGGNREAAR

SEQ ID NO: 316920 - protein, 19 aa, Mycobacterium
LKIIAPYALTMAVVGLLES

SEQ ID NO: 316921 - protein, 17 aa, Mycobacterium
LKILDTRFARLILGVAV

SEQ ID NO: 316922 - protein, 21 aa, Mycobacterium
LKIMTWAALVFAPLVVVYQGW

SEQ ID NO: 316923 - protein, 19 aa, Mycobacterium
LKINPLALFTWVFPSVGIF

SEQ ID NO: 316924 - protein, 18 aa, Mycobacterium
LKIPAARRRRFLFVVMPL

SEQ ID NO: 316925 - protein, 20 aa, Mycobacterium
LKITAVTVVIIFAMLLMVYR

SEQ ID NO: 316926 - protein, 20 aa, Mycobacterium
LKITAVTVVIIFTLLLILYR

SEQ ID NO: 316927 - protein, 19 aa, Mycobacterium
LKITYGWSLLLIVTFTVLY

SEQ ID NO: 316928 - protein, 20 aa, Mycobacterium
LKITYGWSLLLIVVFTVLYF

SEQ ID NO: 316929 - protein, 20 aa, Mycobacterium
LKIVGKLAQFGSGMLQQVSE

SEQ ID NO: 316930 - protein, 17 aa, Mycobacterium
LKKLRANGIRRVVMLTG

SEQ ID NO: 316931 - protein, 42 aa, Mycobacterium
LKLAFTAIGTAATWLWNNAITPAWNGIKAVIGVAWEVVSDIF

SEQ ID NO: 316932 - protein, 17 aa, Mycobacterium
LKLDLIRGVSLPMIVIF

SEQ ID NO: 316933 - protein, 26 aa, Mycobacterium
LKLDLIRGVSVWMIVIFIVGTCAIKV

SEQ ID NO: 316934 - protein, 18 aa, Mycobacterium
LKLILAFGTVSQLGFLVV

SEQ ID NO: 316935 - protein, 25 aa, Mycobacterium
LKLPARRIQPASQWRTLPDAPTARL

SEQ ID NO: 316936 - protein, 24 aa, Mycobacterium
LKLPHGYASLLLGCTGLTLTIGAM

SEQ ID NO: 316937 - protein, 20 aa, Mycobacterium
LKLPHPPWWEVVISTVYMSF

SEQ ID NO: 316938 - protein, 22 aa, Mycobacterium
LKLPRPTEVSGMRIVPGDTEPP

SEQ ID NO: 316939 - protein, 27 aa, Mycobacterium
LKLQFGDGWWTSPLFLCIWITGTSILM

SEQ ID NO: 316940 - protein, 19 aa, Mycobacterium
LKLQIVSFNALGFTMPKES

SEQ ID NO: 316941 - protein, 22 aa, Mycobacterium
LKLRESPGLMILGRQGCGKTTA

SEQ ID NO: 316942 - protein, 26 aa, Mycobacterium
LKLTGGRTAQAWARRHRHLRAALTPL

SEQ ID NO: 316943 - protein, 26 aa, Mycobacterium
LKLTGKRVAQAWARRHRTLRAALQQL

SEQ ID NO: 316944 - protein, 17 aa, Mycobacterium
LKLVYDLQLEREISARR

SEQ ID NO: 316945 - protein, 18 aa, Mycobacterium
LKMCWPTAPRWVGVPLYL

SEQ ID NO: 316946 - protein, 20 aa, Mycobacterium
LKMLVFLVGLVLVVGIIGAT

SEQ ID NO: 316947 - protein, 17 aa, Mycobacterium
LKMPAIFVFGFIPMFLT

SEQ ID NO: 316948 - protein, 17 aa, Mycobacterium
LKNGNPWSAVQVAGQGA

SEQ ID NO: 316949 - protein, 19 aa, Mycobacterium
LKNPLNYVLNPSHRVRGEP

SEQ ID NO: 316950 - protein, 18 aa, Mycobacterium
LKPARWAENTMRTNGFAD

SEQ ID NO: 316951 - protein, 18 aa, Mycobacterium
LKPLDYVDHRWGAEQFAP

SEQ ID NO: 316952 - protein, 21 aa, Mycobacterium
LKPLIKGMWRKASKQVLKDYV

SEQ ID NO: 316953 - protein, 19 aa, Mycobacterium
LKPVPVILIVLILISGGIT

SEQ ID NO: 316954 - protein, 19 aa, Mycobacterium
LKQIPDFDLPQGYVPEIKF

SEQ ID NO: 316955 - protein, 24 aa, Mycobacterium
LKQIPDFELPPGYTAYIKFPSKSF

SEQ ID NO: 316956 - protein, 21 aa, Mycobacterium
LKRDCVNAVHGIYYFTEHKEM

SEQ ID NO: 316957 - protein, 22 aa, Mycobacterium
LKRERDAVELDLRANVASMAAT

SEQ ID NO: 316958 - protein, 22 aa, Mycobacterium
LKRERDAVELDLRANVGTMSAT

SEQ ID NO: 316959 - protein, 29 aa, Mycobacterium
LKREVVELRRCVNPLSGAFHRIQIENKDL

SEQ ID NO: 316960 - protein, 19 aa, Mycobacterium
LKRIPDFGLAPGYTPEIQF

SEQ ID NO: 316961 - protein, 22 aa, Mycobacterium
LKRPRMALFHECLVLWMVSYAI

SEQ ID NO: 316962 - protein, 23 aa, Mycobacterium
LKRRELTVVAPLVALLLVLGIYP

SEQ ID NO: 316963 - protein, 19 aa, Mycobacterium
LKRWWTLVVAAAVVAVVAF

SEQ ID NO: 316964 - protein, 29 aa, Mycobacterium
LKRYFAEGLHYWPWVLLGYFTVAIMVVSL

SEQ ID NO: 316965 - protein, 26 aa, Mycobacterium
LKRYGPLPPPRAVAITRQIGSALDAA

SEQ ID NO: 316966 - protein, 21 aa, Mycobacterium
LKSADIGIAMGRSGTEVAREA

SEQ ID NO: 316967 - protein, 21 aa, Mycobacterium
LKSATGLTLPPTVIFDHPTPT

SEQ ID NO: 316968 - protein, 20 aa, Mycobacterium
LKSNETFVYLARAVDPAIAN

SEQ ID NO: 316969 - protein, 18 aa, Mycobacterium
LKSRARRNGLGLLVAAFG

SEQ ID NO: 316970 - protein, 19 aa, Mycobacterium
LKSSWYLLGPAFVAAIAYV

SEQ ID NO: 316971 - protein, 21 aa, Mycobacterium
LKSTVSIVLLGWMVLGVLSVL

SEQ ID NO: 316972 - protein, 21 aa, Mycobacterium
LKSTVSIVLLVWVVLAVLNVV

SEQ ID NO: 316973 - protein, 17 aa, Mycobacterium
LKSYLILERNSTRDFSE

SEQ ID NO: 316974 - protein, 24 aa, Mycobacterium
LKTDVNAALPWTKTVVLNPGVTLS

SEQ ID NO: 316975 - protein, 18 aa, Mycobacterium
LKTMFATLLHHWPVLMLL

SEQ ID NO: 316976 - protein, 19 aa, Mycobacterium
LKTSWYLLGPAFVAAIAYV

SEQ ID NO: 316977 - protein, 26 aa, Mycobacterium
LKTTREFLDRNGGVLTHDIDNLEQVT

SEQ ID NO: 316978 - protein, 19 aa, Mycobacterium
LKTVPKRLSGLLNTSGLPA

SEQ ID NO: 316979 - protein, 18 aa, Mycobacterium
LKVAAADAIKGTPFEGAR

SEQ ID NO: 316980 - protein, 18 aa, Mycobacterium
LKVAECRAEARAWEQHEP

SEQ ID NO: 316981 - protein, 21 aa, Mycobacterium
LKVELPLSIPVLVASLRVVAV

SEQ ID NO: 316982 - protein, 17 aa, Mycobacterium
LKVELPLSIPVLVSGLR

SEQ ID NO: 316983 - protein, 17 aa, Mycobacterium
LKVESREGLANALANPE

SEQ ID NO: 316984 - protein, 17 aa, Mycobacterium
LKVGPSLSKGATTGTPI

SEQ ID NO: 316985 - protein, 17 aa, Mycobacterium
LKVMLRWLNAFVSKPGQ

SEQ ID NO: 316986 - protein, 19 aa, Mycobacterium
LKVSAVVAAPGWDADEVLA

SEQ ID NO: 316987 - protein, 17 aa, Mycobacterium
LKVTFLALAVPILLIGL

SEQ ID NO: 316988 - protein, 21 aa, Mycobacterium
LKYTEGFTRLWPTVGTVGSMI

SEQ ID NO: 316989 - protein, 19 aa, Mycobacterium
LKYYLPRARSRPVAEVAET

SEQ ID NO: 316990 - protein, 18 aa, Mycobacterium
LLAAAACGLQNAMTSNSP

SEQ ID NO: 316991 - protein, 17 aa, Mycobacterium
LLAACLTSGMAVSTAAG

SEQ ID NO: 316992 - protein, 19 aa, Mycobacterium
LLAADARRAGLPVDGVIVT

SEQ ID NO: 316993 - protein, 26 aa, Mycobacterium
LLAAGARPAFIGPLLLMCGVCSLAGL

SEQ ID NO: 316994 - protein, 24 aa, Mycobacterium
LLAAGGRYAALWAAHSRVGRPSPS

SEQ ID NO: 316995 - protein, 18 aa, Mycobacterium
LLAAGLIAVRAYRLKADR

SEQ ID NO: 316996 - protein, 23 aa, Mycobacterium
LLAAIALLVARQIVLPVRSASRI

SEQ ID NO: 316997 - protein, 17 aa, Mycobacterium
LLAASWTHSVWALTGGV

SEQ ID NO: 316998 - protein, 27 aa, Mycobacterium
LLAAWPLLRPRLPRVALSVLLGALSLG

SEQ ID NO: 316999 - protein, 19 aa, Mycobacterium
LLAAWYHFRMDYAGHTEVK

SEQ ID NO: 317000 - protein, 19 aa, Mycobacterium
LLACGCLFALMLFSEDGQT

SEQ ID NO: 317001 - protein, 24 aa, Mycobacterium
LLADQRVGGGIAWAAGEVPLVVVL

SEQ ID NO: 317002 - protein, 19 aa, Mycobacterium
LLAEARPPLSGTIAQLNRL

SEQ ID NO: 317003 - protein, 26 aa, Mycobacterium
LLAEFRVSPVPVMRIFGTWYVNVVRN

SEQ ID NO: 317004 - protein, 20 aa, Mycobacterium
LLAFILTFFVTRTFVRFIRH

SEQ ID NO: 317005 - protein, 17 aa, Mycobacterium
LLAFSVAIGALFAVVFA

SEQ ID NO: 317006 - protein, 18 aa, Mycobacterium
LLAFSVAIGALFAVVFAV
